United States Patent 7,250,289 (METHODS OF GENETIC ANALYSIS OF MOUSE) - sequence listing, part 5

SEQ ID NO: 161029 - DNA, 25 bp, Mus musculus
agatgactcgggagtcctgtgtgtc

SEQ ID NO: 161030 - DNA, 25 bp, Mus musculus
agatgactcgggtgtcctgtgtgtc

SEQ ID NO: 161031 - DNA, 25 bp, Mus musculus
agatgactcgtgagagtctagcaaa

SEQ ID NO: 161032 - DNA, 25 bp, Mus musculus
agatgactcgtgtgagtctagcaaa

SEQ ID NO: 161033 - DNA, 25 bp, Mus musculus
agatgactctgacctgattgggcaa

SEQ ID NO: 161034 - DNA, 25 bp, Mus musculus
agatgactctgagctgattgggcaa

SEQ ID NO: 161035 - DNA, 25 bp, Mus musculus
agatgactctgcagttctaagcctc

SEQ ID NO: 161036 - DNA, 25 bp, Mus musculus
agatgactctgctgttctaagcctc

SEQ ID NO: 161037 - DNA, 25 bp, Mus musculus
agatgactctgtcctctagaggaga

SEQ ID NO: 161038 - DNA, 25 bp, Mus musculus
agatgactctgtgctctagaggaga

SEQ ID NO: 161039 - DNA, 25 bp, Mus musculus
agatgactcttcaatccagggtgcc

SEQ ID NO: 161040 - DNA, 25 bp, Mus musculus
agatgactcttcaggtgacagcgtg

SEQ ID NO: 161041 - DNA, 25 bp, Mus musculus
agatgactcttctatccagggtgcc

SEQ ID NO: 161042 - DNA, 25 bp, Mus musculus
agatgactcttctggtgacagcgtg

SEQ ID NO: 161043 - DNA, 25 bp, Mus musculus
agatgactgaatagttggtaactat

SEQ ID NO: 161044 - DNA, 25 bp, Mus musculus
agatgactgaattgttggtaactat

SEQ ID NO: 161045 - DNA, 25 bp, Mus musculus
agatgactgaccagagtgtggcaca

SEQ ID NO: 161046 - DNA, 25 bp, Mus musculus
agatgactgacctgagtgtggcaca

SEQ ID NO: 161047 - DNA, 25 bp, Mus musculus
agatgactgagcaacaaactgtgaa

SEQ ID NO: 161048 - DNA, 25 bp, Mus musculus
agatgactgagctacaaactgtgaa

SEQ ID NO: 161049 - DNA, 25 bp, Mus musculus
agatgactgctacacttcagccaga

SEQ ID NO: 161050 - DNA, 25 bp, Mus musculus
agatgactgctagacttcagccaga

SEQ ID NO: 161051 - DNA, 25 bp, Mus musculus
agatgactggaaacaccccagcttc

SEQ ID NO: 161052 - DNA, 25 bp, Mus musculus
agatgactggaatcaccccagcttc

SEQ ID NO: 161053 - DNA, 25 bp, Mus musculus
agatgactggtaaaaggctttgctt

SEQ ID NO: 161054 - DNA, 25 bp, Mus musculus
agatgactggtataaggctttgctt

SEQ ID NO: 161055 - DNA, 25 bp, Mus musculus
agatgactgtggactgagtaattcc

SEQ ID NO: 161056 - DNA, 25 bp, Mus musculus
agatgactgtggtctgagtaattcc

SEQ ID NO: 161057 - DNA, 25 bp, Mus musculus
agatgactgttaatggcgctccttg

SEQ ID NO: 161058 - DNA, 25 bp, Mus musculus
agatgactgttattggcgctccttg

SEQ ID NO: 161059 - DNA, 25 bp, Mus musculus
agatgactgtttcctgggatctgcc

SEQ ID NO: 161060 - DNA, 25 bp, Mus musculus
agatgactgtttgctgggatctgcc

SEQ ID NO: 161061 - DNA, 25 bp, Mus musculus
agatgacttactaatggctcagaag

SEQ ID NO: 161062 - DNA, 25 bp, Mus musculus
agatgacttactctcactaagccca

SEQ ID NO: 161063 - DNA, 25 bp, Mus musculus
agatgacttactgtcactaagccca

SEQ ID NO: 161064 - DNA, 25 bp, Mus musculus
agatgacttacttatggctcagaag

SEQ ID NO: 161065 - DNA, 25 bp, Mus musculus
agatgacttcaactacaccagggaa

SEQ ID NO: 161066 - DNA, 25 bp, Mus musculus
agatgacttcaagtacaccagggaa

SEQ ID NO: 161067 - DNA, 25 bp, Mus musculus
agatgacttcacatcgaccccttgt

SEQ ID NO: 161068 - DNA, 25 bp, Mus musculus
agatgacttcacttcgaccccttgt

SEQ ID NO: 161069 - DNA, 25 bp, Mus musculus
agatgacttgcgctggtctgctttc

SEQ ID NO: 161070 - DNA, 25 bp, Mus musculus
agatgacttgcggtggtctgctttc

SEQ ID NO: 161071 - DNA, 25 bp, Mus musculus
agatgacttgctcccagaataatat

SEQ ID NO: 161072 - DNA, 25 bp, Mus musculus
agatgacttgctgccagaataatat

SEQ ID NO: 161073 - DNA, 25 bp, Mus musculus
agatgagaacaaaccactggatgac

SEQ ID NO: 161074 - DNA, 25 bp, Mus musculus
agatgagaacaatccactggatgac

SEQ ID NO: 161075 - DNA, 25 bp, Mus musculus
agatgagaacctcgtttcaacgccg

SEQ ID NO: 161076 - DNA, 25 bp, Mus musculus
agatgagaacctggtttcaacgccg

SEQ ID NO: 161077 - DNA, 25 bp, Mus musculus
agatgagaagcactccccttcctta

SEQ ID NO: 161078 - DNA, 25 bp, Mus musculus
agatgagaagcagtccccttcctta

SEQ ID NO: 161079 - DNA, 25 bp, Mus musculus
agatgagacacacttagcccagacg

SEQ ID NO: 161080 - DNA, 25 bp, Mus musculus
agatgagacacagttagcccagacg

SEQ ID NO: 161081 - DNA, 25 bp, Mus musculus
agatgagaccttactatgtgattga

SEQ ID NO: 161082 - DNA, 25 bp, Mus musculus
agatgagacctttctatgtgattga

SEQ ID NO: 161083 - DNA, 25 bp, Mus musculus
agatgagactcccatcctagctttg

SEQ ID NO: 161084 - DNA, 25 bp, Mus musculus
agatgagactccgatcctagctttg

SEQ ID NO: 161085 - DNA, 25 bp, Mus musculus
agatgagagaccacgttccacccgt

SEQ ID NO: 161086 - DNA, 25 bp, Mus musculus
agatgagagacctcgttccacccgt

SEQ ID NO: 161087 - DNA, 25 bp, Mus musculus
agatgagagagtagcaccctgtccc

SEQ ID NO: 161088 - DNA, 25 bp, Mus musculus
agatgagagagttgcaccctgtccc

SEQ ID NO: 161089 - DNA, 25 bp, Mus musculus
agatgagagatgagatgcgtaatga

SEQ ID NO: 161090 - DNA, 25 bp, Mus musculus
agatgagagatgtgatgcgtaatga

SEQ ID NO: 161091 - DNA, 25 bp, Mus musculus
agatgagaggcaagaacccttccta

SEQ ID NO: 161092 - DNA, 25 bp, Mus musculus
agatgagaggcatgaacccttccta

SEQ ID NO: 161093 - DNA, 25 bp, Mus musculus
agatgagaggttatgttctctacga

SEQ ID NO: 161094 - DNA, 25 bp, Mus musculus
agatgagaggttttgttctctacga

SEQ ID NO: 161095 - DNA, 25 bp, Mus musculus
agatgagatcacagattgcttctct

SEQ ID NO: 161096 - DNA, 25 bp, Mus musculus
agatgagatcactgattgcttctct

SEQ ID NO: 161097 - DNA, 25 bp, Mus musculus
agatgagatccaattccaagccttc

SEQ ID NO: 161098 - DNA, 25 bp, Mus musculus
agatgagatccatttccaagccttc

SEQ ID NO: 161099 - DNA, 25 bp, Mus musculus
agatgagatgctctgactccatcgt

SEQ ID NO: 161100 - DNA, 25 bp, Mus musculus
agatgagatgctgtgactccatcgt

SEQ ID NO: 161101 - DNA, 25 bp, Mus musculus
agatgagatgggaggttgcctttcc

SEQ ID NO: 161102 - DNA, 25 bp, Mus musculus
agatgagatgggtggttgcctttcc

SEQ ID NO: 161103 - DNA, 25 bp, Mus musculus
agatgagatgtacaaggcgctgctt

SEQ ID NO: 161104 - DNA, 25 bp, Mus musculus
agatgagatgtagaaggcgctgctt

SEQ ID NO: 161105 - DNA, 25 bp, Mus musculus
agatgagatttgatcttgcccagga

SEQ ID NO: 161106 - DNA, 25 bp, Mus musculus
agatgagatttgttcttgcccagga

SEQ ID NO: 161107 - DNA, 25 bp, Mus musculus
agatgagcacccaagcatgaaccgc

SEQ ID NO: 161108 - DNA, 25 bp, Mus musculus
agatgagcaccctagcatgaaccgc

SEQ ID NO: 161109 - DNA, 25 bp, Mus musculus
agatgagcagccctcgcttcggcca

SEQ ID NO: 161110 - DNA, 25 bp, Mus musculus
agatgagcagccgtcgcttcggcca

SEQ ID NO: 161111 - DNA, 25 bp, Mus musculus
agatgagcatcacgactttaaggat

SEQ ID NO: 161112 - DNA, 25 bp, Mus musculus
agatgagcatcaggactttaaggat

SEQ ID NO: 161113 - DNA, 25 bp, Mus musculus
agatgagcatccatgctgttgctat

SEQ ID NO: 161114 - DNA, 25 bp, Mus musculus
agatgagcatcccaccctgagtgtt

SEQ ID NO: 161115 - DNA, 25 bp, Mus musculus
agatgagcatccgaccctgagtgtt

SEQ ID NO: 161116 - DNA, 25 bp, Mus musculus
agatgagcatccttgctgttgctat

SEQ ID NO: 161117 - DNA, 25 bp, Mus musculus
agatgagccaccagtacccttctga

SEQ ID NO: 161118 - DNA, 25 bp, Mus musculus
agatgagccacctgtacccttctga

SEQ ID NO: 161119 - DNA, 25 bp, Mus musculus
agatgagccactcagcgctgccgaa

SEQ ID NO: 161120 - DNA, 25 bp, Mus musculus
agatgagccactgagcgctgccgaa

SEQ ID NO: 161121 - DNA, 25 bp, Mus musculus
agatgagccagtcctgtctgtgacc

SEQ ID NO: 161122 - DNA, 25 bp, Mus musculus
agatgagccagtgctgtctgtgacc

SEQ ID NO: 161123 - DNA, 25 bp, Mus musculus
agatgagcccttagtttagcaactg

SEQ ID NO: 161124 - DNA, 25 bp, Mus musculus
agatgagccctttgtttagcaactg

SEQ ID NO: 161125 - DNA, 25 bp, Mus musculus
agatgagcctggaccacactgtgag

SEQ ID NO: 161126 - DNA, 25 bp, Mus musculus
agatgagcctggatcctatgttccc

SEQ ID NO: 161127 - DNA, 25 bp, Mus musculus
agatgagcctggtccacactgtgag

SEQ ID NO: 161128 - DNA, 25 bp, Mus musculus
agatgagcctggttcctatgttccc

SEQ ID NO: 161129 - DNA, 25 bp, Mus musculus
agatgagctgccctatctcaagtgt

SEQ ID NO: 161130 - DNA, 25 bp, Mus musculus
agatgagctgccgtatctcaagtgt

SEQ ID NO: 161131 - DNA, 25 bp, Mus musculus
agatgagcttagatctgcttgcttc

SEQ ID NO: 161132 - DNA, 25 bp, Mus musculus
agatgagcttagttctgcttgcttc

SEQ ID NO: 161133 - DNA, 25 bp, Mus musculus
agatgaggaaccatagacaaaatac

SEQ ID NO: 161134 - DNA, 25 bp, Mus musculus
agatgaggaaccttagacaaaatac

SEQ ID NO: 161135 - DNA, 25 bp, Mus musculus
agatgaggaccgcacttctctagca

SEQ ID NO: 161136 - DNA, 25 bp, Mus musculus
agatgaggaccggacttctctagca

SEQ ID NO: 161137 - DNA, 25 bp, Mus musculus
agatgaggacctccagctggatttc

SEQ ID NO: 161138 - DNA, 25 bp, Mus musculus
agatgaggacctgcagctggatttc

SEQ ID NO: 161139 - DNA, 25 bp, Mus musculus
agatgaggacttctgtggctttcac

SEQ ID NO: 161140 - DNA, 25 bp, Mus musculus
agatgaggacttgtgtggctttcac

SEQ ID NO: 161141 - DNA, 25 bp, Mus musculus
agatgaggagcacatgcccctctgc

SEQ ID NO: 161142 - DNA, 25 bp, Mus musculus
agatgaggagcagatgcccctctgc

SEQ ID NO: 161143 - DNA, 25 bp, Mus musculus
agatgaggatgccacaccaccagat

SEQ ID NO: 161144 - DNA, 25 bp, Mus musculus
agatgaggatgcgacaccaccagat

SEQ ID NO: 161145 - DNA, 25 bp, Mus musculus
agatgaggccaaccttcctggaaat

SEQ ID NO: 161146 - DNA, 25 bp, Mus musculus
agatgaggccaagcttcctggaaat

SEQ ID NO: 161147 - DNA, 25 bp, Mus musculus
agatgagggagccaagctgcccacc

SEQ ID NO: 161148 - DNA, 25 bp, Mus musculus
agatgagggagcgaagctgcccacc

SEQ ID NO: 161149 - DNA, 25 bp, Mus musculus
agatgaggtctccatgggatgccat

SEQ ID NO: 161150 - DNA, 25 bp, Mus musculus
agatgaggtctcgatgggatgccat

SEQ ID NO: 161151 - DNA, 25 bp, Mus musculus
agatgagtaaccaggtggcctccca

SEQ ID NO: 161152 - DNA, 25 bp, Mus musculus
agatgagtaacctggtggcctccca

SEQ ID NO: 161153 - DNA, 25 bp, Mus musculus
agatgagtaagcatcaattccagtg

SEQ ID NO: 161154 - DNA, 25 bp, Mus musculus
agatgagtaagcttcaattccagtg

SEQ ID NO: 161155 - DNA, 25 bp, Mus musculus
agatgagtaatgcaccacctggcct

SEQ ID NO: 161156 - DNA, 25 bp, Mus musculus
agatgagtaatggaccacctggcct

SEQ ID NO: 161157 - DNA, 25 bp, Mus musculus
agatgagtacataggcagagctttc

SEQ ID NO: 161158 - DNA, 25 bp, Mus musculus
agatgagtacattggcagagctttc

SEQ ID NO: 161159 - DNA, 25 bp, Mus musculus
agatgagtacccatcattcctcaga

SEQ ID NO: 161160 - DNA, 25 bp, Mus musculus
agatgagtacccttcattcctcaga

SEQ ID NO: 161161 - DNA, 25 bp, Mus musculus
agatgagtcactcagcacttgtatc

SEQ ID NO: 161162 - DNA, 25 bp, Mus musculus
agatgagtcactgagcacttgtatc

SEQ ID NO: 161163 - DNA, 25 bp, Mus musculus
agatgagtcccacattcctgggcaa

SEQ ID NO: 161164 - DNA, 25 bp, Mus musculus
agatgagtcccagattcctgggcaa

SEQ ID NO: 161165 - DNA, 25 bp, Mus musculus
agatgagtcctcaccatatgcagcc

SEQ ID NO: 161166 - DNA, 25 bp, Mus musculus
agatgagtcctctccatatgcagcc

SEQ ID NO: 161167 - DNA, 25 bp, Mus musculus
agatgagtcctgctctcctgtcgag

SEQ ID NO: 161168 - DNA, 25 bp, Mus musculus
agatgagtcctggtctcctgtcgag

SEQ ID NO: 161169 - DNA, 25 bp, Mus musculus
agatgagtctgtatcgatctctccc

SEQ ID NO: 161170 - DNA, 25 bp, Mus musculus
agatgagtctgtttcgatctctccc

SEQ ID NO: 161171 - DNA, 25 bp, Mus musculus
agatgagtcttacggcgcatgccac

SEQ ID NO: 161172 - DNA, 25 bp, Mus musculus
agatgagtcttagggcgcatgccac

SEQ ID NO: 161173 - DNA, 25 bp, Mus musculus
agatgagtctttcttgtctacacct

SEQ ID NO: 161174 - DNA, 25 bp, Mus musculus
agatgagtctttgttgtctacacct

SEQ ID NO: 161175 - DNA, 25 bp, Mus musculus
agatgagtgaccacctgtgccaggt

SEQ ID NO: 161176 - DNA, 25 bp, Mus musculus
agatgagtgacctcctgtgccaggt

SEQ ID NO: 161177 - DNA, 25 bp, Mus musculus
agatgagtgactcgaagggctacat

SEQ ID NO: 161178 - DNA, 25 bp, Mus musculus
agatgagtgactggaagggctacat

SEQ ID NO: 161179 - DNA, 25 bp, Mus musculus
agatgagtgagcataaattccttca

SEQ ID NO: 161180 - DNA, 25 bp, Mus musculus
agatgagtgagcttaaattccttca

SEQ ID NO: 161181 - DNA, 25 bp, Mus musculus
agatgagtggtacggccagctttcc

SEQ ID NO: 161182 - DNA, 25 bp, Mus musculus
agatgagtggtagggccagctttcc

SEQ ID NO: 161183 - DNA, 25 bp, Mus musculus
agatgagtgtacatggaccctcctg

SEQ ID NO: 161184 - DNA, 25 bp, Mus musculus
agatgagtgtacttggaccctcctg

SEQ ID NO: 161185 - DNA, 25 bp, Mus musculus
agatgagtgtcgactcctactgttc

SEQ ID NO: 161186 - DNA, 25 bp, Mus musculus
agatgagtgtcgtctcctactgttc

SEQ ID NO: 161187 - DNA, 25 bp, Mus musculus
agatgagtgtctctgaccctggcca

SEQ ID NO: 161188 - DNA, 25 bp, Mus musculus
agatgagtgtctgtgaccctggcca

SEQ ID NO: 161189 - DNA, 25 bp, Mus musculus
agatgagtgtgaacgtcccaggcat

SEQ ID NO: 161190 - DNA, 25 bp, Mus musculus
agatgagtgtgatcgtcccaggcat

SEQ ID NO: 161191 - DNA, 25 bp, Mus musculus
agatgagttaaaagcctgtaggaaa

SEQ ID NO: 161192 - DNA, 25 bp, Mus musculus
agatgagttaaatgcctgtaggaaa

SEQ ID NO: 161193 - DNA, 25 bp, Mus musculus
agatgagttgcgagcccaatcacag

SEQ ID NO: 161194 - DNA, 25 bp, Mus musculus
agatgagttgcgtgcccaatcacag

SEQ ID NO: 161195 - DNA, 25 bp, Mus musculus
agatgagttgtacctgcttgcaaga

SEQ ID NO: 161196 - DNA, 25 bp, Mus musculus
agatgagttgtagctgcttgcaaga

SEQ ID NO: 161197 - DNA, 25 bp, Mus musculus
agatgagtttgcagtcgctcttgac

SEQ ID NO: 161198 - DNA, 25 bp, Mus musculus
agatgagtttgctgtcgctcttgac

SEQ ID NO: 161199 - DNA, 25 bp, Mus musculus
agatgataacataaccagggaagac

SEQ ID NO: 161200 - DNA, 25 bp, Mus musculus
agatgataacattaccagggaagac

SEQ ID NO: 161201 - DNA, 25 bp, Mus musculus
agatgatacagcctaaaagaccctg

SEQ ID NO: 161202 - DNA, 25 bp, Mus musculus
agatgatacagcgtaaaagaccctg

SEQ ID NO: 161203 - DNA, 25 bp, Mus musculus
agatgatagtgcctgtctgcccact

SEQ ID NO: 161204 - DNA, 25 bp, Mus musculus
agatgatagtgcgtgtctgcccact

SEQ ID NO: 161205 - DNA, 25 bp, Mus musculus
agatgatatgtaacctgctcgccca

SEQ ID NO: 161206 - DNA, 25 bp, Mus musculus
agatgatatgtatcctgctcgccca

SEQ ID NO: 161207 - DNA, 25 bp, Mus musculus
agatgatatgttccacttccttctc

SEQ ID NO: 161208 - DNA, 25 bp, Mus musculus
agatgatatgttgcacttccttctc

SEQ ID NO: 161209 - DNA, 25 bp, Mus musculus
agatgatcagacaaggcaaagcgaa

SEQ ID NO: 161210 - DNA, 25 bp, Mus musculus
agatgatcagactaggcaaagcgaa

SEQ ID NO: 161211 - DNA, 25 bp, Mus musculus
agatgatccccactgttacagtgac

SEQ ID NO: 161212 - DNA, 25 bp, Mus musculus
agatgatccccagtgttacagtgac

SEQ ID NO: 161213 - DNA, 25 bp, Mus musculus
agatgatccccgaggaagggccctt

SEQ ID NO: 161214 - DNA, 25 bp, Mus musculus
agatgatccccgtggaagggccctt

SEQ ID NO: 161215 - DNA, 25 bp, Mus musculus
agatgatcccgactgaactccaacc

SEQ ID NO: 161216 - DNA, 25 bp, Mus musculus
agatgatcccgagtgaactccaacc

SEQ ID NO: 161217 - DNA, 25 bp, Mus musculus
agatgatccgagagggcttcgtgat

SEQ ID NO: 161218 - DNA, 25 bp, Mus musculus
agatgatccgagtgggcttcgtgat

SEQ ID NO: 161219 - DNA, 25 bp, Mus musculus
agatgatccgtcaggcttgctcgtt

SEQ ID NO: 161220 - DNA, 25 bp, Mus musculus
agatgatccgtcatccatggtgaga

SEQ ID NO: 161221 - DNA, 25 bp, Mus musculus
agatgatccgtctggcttgctcgtt

SEQ ID NO: 161222 - DNA, 25 bp, Mus musculus
agatgatccgtcttccatggtgaga

SEQ ID NO: 161223 - DNA, 25 bp, Mus musculus
agatgatctcaaccgctttgctctg

SEQ ID NO: 161224 - DNA, 25 bp, Mus musculus
agatgatctcaagcgctttgctctg

SEQ ID NO: 161225 - DNA, 25 bp, Mus musculus
agatgatctggcaaggacctgtaac

SEQ ID NO: 161226 - DNA, 25 bp, Mus musculus
agatgatctggctaggacctgtaac

SEQ ID NO: 161227 - DNA, 25 bp, Mus musculus
agatgatgacagagggagtatttct

SEQ ID NO: 161228 - DNA, 25 bp, Mus musculus
agatgatgacagcaaccagcccatg

SEQ ID NO: 161229 - DNA, 25 bp, Mus musculus
agatgatgacaggaaccagcccatg

SEQ ID NO: 161230 - DNA, 25 bp, Mus musculus
agatgatgacagtgggagtatttct

SEQ ID NO: 161231 - DNA, 25 bp, Mus musculus
agatgatgaccaattctctcctttg

SEQ ID NO: 161232 - DNA, 25 bp, Mus musculus
agatgatgaccatttctctcctttg

SEQ ID NO: 161233 - DNA, 25 bp, Mus musculus
agatgatgactcaggcacggtccca

SEQ ID NO: 161234 - DNA, 25 bp, Mus musculus
agatgatgactctggcacggtccca

SEQ ID NO: 161235 - DNA, 25 bp, Mus musculus
agatgatgagggaaccacccctttc

SEQ ID NO: 161236 - DNA, 25 bp, Mus musculus
agatgatgagggtaccacccctttc

SEQ ID NO: 161237 - DNA, 25 bp, Mus musculus
agatgatgatggaccacacctttaa

SEQ ID NO: 161238 - DNA, 25 bp, Mus musculus
agatgatgatggtccacacctttaa

SEQ ID NO: 161239 - DNA, 25 bp, Mus musculus
agatgatgcacaaggctgcgccgcg

SEQ ID NO: 161240 - DNA, 25 bp, Mus musculus
agatgatgcacatggctgcgccgcg

SEQ ID NO: 161241 - DNA, 25 bp, Mus musculus
agatgatgcaccaaattctcaaaag

SEQ ID NO: 161242 - DNA, 25 bp, Mus musculus
agatgatgcacctaattctcaaaag

SEQ ID NO: 161243 - DNA, 25 bp, Mus musculus
agatgatgcaggatggccaccaggt

SEQ ID NO: 161244 - DNA, 25 bp, Mus musculus
agatgatgcaggttggccaccaggt

SEQ ID NO: 161245 - DNA, 25 bp, Mus musculus
agatgatgcagtaggccgcactcca

SEQ ID NO: 161246 - DNA, 25 bp, Mus musculus
agatgatgcagttggccgcactcca

SEQ ID NO: 161247 - DNA, 25 bp, Mus musculus
agatgatgccatagaaacagatgat

SEQ ID NO: 161248 - DNA, 25 bp, Mus musculus
agatgatgccattgaaacagatgat

SEQ ID NO: 161249 - DNA, 25 bp, Mus musculus
agatgatgctaacactcgagacccc

SEQ ID NO: 161250 - DNA, 25 bp, Mus musculus
agatgatgctaagactcgagacccc

SEQ ID NO: 161251 - DNA, 25 bp, Mus musculus
agatgatgctagaatttccttcagt

SEQ ID NO: 161252 - DNA, 25 bp, Mus musculus
agatgatgctagtatttccttcagt

SEQ ID NO: 161253 - DNA, 25 bp, Mus musculus
agatgatgctctatccttactccta

SEQ ID NO: 161254 - DNA, 25 bp, Mus musculus
agatgatgctctttccttactccta

SEQ ID NO: 161255 - DNA, 25 bp, Mus musculus
agatgatggacacagaaatgcagct

SEQ ID NO: 161256 - DNA, 25 bp, Mus musculus
agatgatggacagagaaatgcagct

SEQ ID NO: 161257 - DNA, 25 bp, Mus musculus
agatgatggagacgcccctggacca

SEQ ID NO: 161258 - DNA, 25 bp, Mus musculus
agatgatggagaggcccctggacca

SEQ ID NO: 161259 - DNA, 25 bp, Mus musculus
agatgatggccacttcccttaagga

SEQ ID NO: 161260 - DNA, 25 bp, Mus musculus
agatgatggccagttcccttaagga

SEQ ID NO: 161261 - DNA, 25 bp, Mus musculus
agatgatggcctctcaagcgttacg

SEQ ID NO: 161262 - DNA, 25 bp, Mus musculus
agatgatggcctgtcaagcgttacg

SEQ ID NO: 161263 - DNA, 25 bp, Mus musculus
agatgatgggcaagttcgcttgctt

SEQ ID NO: 161264 - DNA, 25 bp, Mus musculus
agatgatgggcatgttcgcttgctt

SEQ ID NO: 161265 - DNA, 25 bp, Mus musculus
agatgatggtacagagccctgcttt

SEQ ID NO: 161266 - DNA, 25 bp, Mus musculus
agatgatggtactgagccctgcttt

SEQ ID NO: 161267 - DNA, 25 bp, Mus musculus
agatgatgtcaccactccaaataga

SEQ ID NO: 161268 - DNA, 25 bp, Mus musculus
agatgatgtcacgactccaaataga

SEQ ID NO: 161269 - DNA, 25 bp, Mus musculus
agatgatgtctaccgtagaaaagct

SEQ ID NO: 161270 - DNA, 25 bp, Mus musculus
agatgatgtctagcgtagaaaagct

SEQ ID NO: 161271 - DNA, 25 bp, Mus musculus
agatgatgtcttcagggaatttttt

SEQ ID NO: 161272 - DNA, 25 bp, Mus musculus
agatgatgtcttgagggaatttttt

SEQ ID NO: 161273 - DNA, 25 bp, Mus musculus
agatgatgtgagatgtcttgcaaca

SEQ ID NO: 161274 - DNA, 25 bp, Mus musculus
agatgatgtgagttgtcttgcaaca

SEQ ID NO: 161275 - DNA, 25 bp, Mus musculus
agatgatgtgctcgtcctgggaaca

SEQ ID NO: 161276 - DNA, 25 bp, Mus musculus
agatgatgtgctggtcctgggaaca

SEQ ID NO: 161277 - DNA, 25 bp, Mus musculus
agatgatgtgggaaccgtcttcgtt

SEQ ID NO: 161278 - DNA, 25 bp, Mus musculus
agatgatgtgggtaccgtcttcgtt

SEQ ID NO: 161279 - DNA, 25 bp, Mus musculus
agatgatgttcgacgtctttactgc

SEQ ID NO: 161280 - DNA, 25 bp, Mus musculus
agatgatgttcgtcgtctttactgc

SEQ ID NO: 161281 - DNA, 25 bp, Mus musculus
agatgattatggagcccctcgcttc

SEQ ID NO: 161282 - DNA, 25 bp, Mus musculus
agatgattatggtgcccctcgcttc

SEQ ID NO: 161283 - DNA, 25 bp, Mus musculus
agatgattatttccctacctttcaa

SEQ ID NO: 161284 - DNA, 25 bp, Mus musculus
agatgattatttgcctacctttcaa

SEQ ID NO: 161285 - DNA, 25 bp, Mus musculus
agatgattccctctttctcgttaac

SEQ ID NO: 161286 - DNA, 25 bp, Mus musculus
agatgattccctgtttctcgttaac

SEQ ID NO: 161287 - DNA, 25 bp, Mus musculus
agatgattccttccatcagctccga

SEQ ID NO: 161288 - DNA, 25 bp, Mus musculus
agatgattccttgcatcagctccga

SEQ ID NO: 161289 - DNA, 25 bp, Mus musculus
agatgattctgcagccctcggcaga

SEQ ID NO: 161290 - DNA, 25 bp, Mus musculus
agatgattctgctgccctcggcaga

SEQ ID NO: 161291 - DNA, 25 bp, Mus musculus
agatgattgctaattccagacccca

SEQ ID NO: 161292 - DNA, 25 bp, Mus musculus
agatgattgctatttccagacccca

SEQ ID NO: 161293 - DNA, 25 bp, Mus musculus
agatgatttcaacaaggcccacttc

SEQ ID NO: 161294 - DNA, 25 bp, Mus musculus
agatgatttcaagaaggcccacttc

SEQ ID NO: 161295 - DNA, 25 bp, Mus musculus
agatgatttcctacatcccctttga

SEQ ID NO: 161296 - DNA, 25 bp, Mus musculus
agatgatttccttcatcccctttga

SEQ ID NO: 161297 - DNA, 25 bp, Mus musculus
agatgatttggtatctcagagggta

SEQ ID NO: 161298 - DNA, 25 bp, Mus musculus
agatgatttggtttctcagagggta

SEQ ID NO: 161299 - DNA, 25 bp, Mus musculus
agatgatttttccaaccagggtcag

SEQ ID NO: 161300 - DNA, 25 bp, Mus musculus
agatgatttttcgaaccagggtcag

SEQ ID NO: 161301 - DNA, 25 bp, Mus musculus
agatgcaaacctcaccgacagaata

SEQ ID NO: 161302 - DNA, 25 bp, Mus musculus
agatgcaaacctgaccgacagaata

SEQ ID NO: 161303 - DNA, 25 bp, Mus musculus
agatgcaaactgcagcagagatgta

SEQ ID NO: 161304 - DNA, 25 bp, Mus musculus
agatgcaaactggagcagagatgta

SEQ ID NO: 161305 - DNA, 25 bp, Mus musculus
agatgcaacatcaccttccatcttt

SEQ ID NO: 161306 - DNA, 25 bp, Mus musculus
agatgcaacatctccttccatcttt

SEQ ID NO: 161307 - DNA, 25 bp, Mus musculus
agatgcaacatgcacctgaagctcc

SEQ ID NO: 161308 - DNA, 25 bp, Mus musculus
agatgcaacatggacctgaagctcc

SEQ ID NO: 161309 - DNA, 25 bp, Mus musculus
agatgcaaccagatcctgggaggga

SEQ ID NO: 161310 - DNA, 25 bp, Mus musculus
agatgcaaccagttcctgggaggga

SEQ ID NO: 161311 - DNA, 25 bp, Mus musculus
agatgcaacccactgtaagctttgt

SEQ ID NO: 161312 - DNA, 25 bp, Mus musculus
agatgcaacccagtgtaagctttgt

SEQ ID NO: 161313 - DNA, 25 bp, Mus musculus
agatgcaactctatcaatctcacac

SEQ ID NO: 161314 - DNA, 25 bp, Mus musculus
agatgcaactctttcaatctcacac

SEQ ID NO: 161315 - DNA, 25 bp, Mus musculus
agatgcaagtctcaccttcaaggtg

SEQ ID NO: 161316 - DNA, 25 bp, Mus musculus
agatgcaagtctgaccttcaaggtg

SEQ ID NO: 161317 - DNA, 25 bp, Mus musculus
agatgcaatgtgacctggacctcag

SEQ ID NO: 161318 - DNA, 25 bp, Mus musculus
agatgcaatgtgtcctggacctcag

SEQ ID NO: 161319 - DNA, 25 bp, Mus musculus
agatgcaatgttaggattttaatgt

SEQ ID NO: 161320 - DNA, 25 bp, Mus musculus
agatgcaatgtttggattttaatgt

SEQ ID NO: 161321 - DNA, 25 bp, Mus musculus
agatgcacacgcatgtgtctgtgta

SEQ ID NO: 161322 - DNA, 25 bp, Mus musculus
agatgcacacgcttgtgtctgtgta

SEQ ID NO: 161323 - DNA, 25 bp, Mus musculus
agatgcacactcacgctttcatttt

SEQ ID NO: 161324 - DNA, 25 bp, Mus musculus
agatgcacactctcgctttcatttt

SEQ ID NO: 161325 - DNA, 25 bp, Mus musculus
agatgcacaggaaagaatctccgtg

SEQ ID NO: 161326 - DNA, 25 bp, Mus musculus
agatgcacaggatagaatctccgtg

SEQ ID NO: 161327 - DNA, 25 bp, Mus musculus
agatgcacaggtacgggaacacaca

SEQ ID NO: 161328 - DNA, 25 bp, Mus musculus
agatgcacaggttcgggaacacaca

SEQ ID NO: 161329 - DNA, 25 bp, Mus musculus
agatgcacattcctttcctcaacat

SEQ ID NO: 161330 - DNA, 25 bp, Mus musculus
agatgcacattcgtttcctcaacat

SEQ ID NO: 161331 - DNA, 25 bp, Mus musculus
agatgcaccacgagttgcttgaggt

SEQ ID NO: 161332 - DNA, 25 bp, Mus musculus
agatgcaccacgtgttgcttgaggt

SEQ ID NO: 161333 - DNA, 25 bp, Mus musculus
agatgcaccctgacacgagtgttca

SEQ ID NO: 161334 - DNA, 25 bp, Mus musculus
agatgcaccctgtcacgagtgttca

SEQ ID NO: 161335 - DNA, 25 bp, Mus musculus
agatgcacggttctcttctcaaatg

SEQ ID NO: 161336 - DNA, 25 bp, Mus musculus
agatgcacggttgtcttctcaaatg

SEQ ID NO: 161337 - DNA, 25 bp, Mus musculus
agatgcacgtgacctgggcctcgca

SEQ ID NO: 161338 - DNA, 25 bp, Mus musculus
agatgcacgtgagctgggcctcgca

SEQ ID NO: 161339 - DNA, 25 bp, Mus musculus
agatgcactagacggacacagctga

SEQ ID NO: 161340 - DNA, 25 bp, Mus musculus
agatgcactagagggacacagctga

SEQ ID NO: 161341 - DNA, 25 bp, Mus musculus
agatgcactcatcgcttaaggtgat

SEQ ID NO: 161342 - DNA, 25 bp, Mus musculus
agatgcactcatggcttaaggtgat

SEQ ID NO: 161343 - DNA, 25 bp, Mus musculus
agatgcactggtcgtaccagtagga

SEQ ID NO: 161344 - DNA, 25 bp, Mus musculus
agatgcactggtggtaccagtagga

SEQ ID NO: 161345 - DNA, 25 bp, Mus musculus
agatgcactgtgcatggccaccttg

SEQ ID NO: 161346 - DNA, 25 bp, Mus musculus
agatgcactgtggatggccaccttg

SEQ ID NO: 161347 - DNA, 25 bp, Mus musculus
agatgcactttcaacagcgtgggtg

SEQ ID NO: 161348 - DNA, 25 bp, Mus musculus
agatgcactttctacagcgtgggtg

SEQ ID NO: 161349 - DNA, 25 bp, Mus musculus
agatgcacttttctctggctcataa

SEQ ID NO: 161350 - DNA, 25 bp, Mus musculus
agatgcacttttgtctggctcataa

SEQ ID NO: 161351 - DNA, 25 bp, Mus musculus
agatgcagaaatcatgcacctgtcg

SEQ ID NO: 161352 - DNA, 25 bp, Mus musculus
agatgcagaaatgatgcacctgtcg

SEQ ID NO: 161353 - DNA, 25 bp, Mus musculus
agatgcagacccctgtgagccaaac

SEQ ID NO: 161354 - DNA, 25 bp, Mus musculus
agatgcagacccgtgtgagccaaac

SEQ ID NO: 161355 - DNA, 25 bp, Mus musculus
agatgcagagcaatggcccaggtta

SEQ ID NO: 161356 - DNA, 25 bp, Mus musculus
agatgcagagcattggcccaggtta

SEQ ID NO: 161357 - DNA, 25 bp, Mus musculus
agatgcagagctaggcaacaccctt

SEQ ID NO: 161358 - DNA, 25 bp, Mus musculus
agatgcagagcttggcaacaccctt

SEQ ID NO: 161359 - DNA, 25 bp, Mus musculus
agatgcagcatcatttctggaagag

SEQ ID NO: 161360 - DNA, 25 bp, Mus musculus
agatgcagcatcttttctggaagag

SEQ ID NO: 161361 - DNA, 25 bp, Mus musculus
agatgcagctgccatcttgctggat

SEQ ID NO: 161362 - DNA, 25 bp, Mus musculus
agatgcagctgcgatcttgctggat

SEQ ID NO: 161363 - DNA, 25 bp, Mus musculus
agatgcagctggcttgccgcctgca

SEQ ID NO: 161364 - DNA, 25 bp, Mus musculus
agatgcagctgggttgccgcctgca

SEQ ID NO: 161365 - DNA, 25 bp, Mus musculus
agatgcagcttaagggtctcccaga

SEQ ID NO: 161366 - DNA, 25 bp, Mus musculus
agatgcagcttatgggtctcccaga

SEQ ID NO: 161367 - DNA, 25 bp, Mus musculus
agatgcaggccgcagcttgtactat

SEQ ID NO: 161368 - DNA, 25 bp, Mus musculus
agatgcaggccggagcttgtactat

SEQ ID NO: 161369 - DNA, 25 bp, Mus musculus
agatgcagggacagcttgcccatgt

SEQ ID NO: 161370 - DNA, 25 bp, Mus musculus
agatgcagggactgcttgcccatgt

SEQ ID NO: 161371 - DNA, 25 bp, Mus musculus
agatgcagtgctctttgcagagtgt

SEQ ID NO: 161372 - DNA, 25 bp, Mus musculus
agatgcagtgctgtttgcagagtgt

SEQ ID NO: 161373 - DNA, 25 bp, Mus musculus
agatgcagtggacaagggacttcaa

SEQ ID NO: 161374 - DNA, 25 bp, Mus musculus
agatgcagtggagaagggacttcaa

SEQ ID NO: 161375 - DNA, 25 bp, Mus musculus
agatgcagtgttccacgttgacaca

SEQ ID NO: 161376 - DNA, 25 bp, Mus musculus
agatgcagtgttctgggcctagtcc

SEQ ID NO: 161377 - DNA, 25 bp, Mus musculus
agatgcagtgttgcacgttgacaca

SEQ ID NO: 161378 - DNA, 25 bp, Mus musculus
agatgcagtgttgtgggcctagtcc

SEQ ID NO: 161379 - DNA, 25 bp, Mus musculus
agatgcagttctagctgagtcttcc

SEQ ID NO: 161380 - DNA, 25 bp, Mus musculus
agatgcagttcttgctgagtcttcc

SEQ ID NO: 161381 - DNA, 25 bp, Mus musculus
agatgcagttgcaggtgactgatca

SEQ ID NO: 161382 - DNA, 25 bp, Mus musculus
agatgcagttgctggtgactgatca

SEQ ID NO: 161383 - DNA, 25 bp, Mus musculus
agatgcatatctaggccacagtaca

SEQ ID NO: 161384 - DNA, 25 bp, Mus musculus
agatgcatatcttggccacagtaca

SEQ ID NO: 161385 - DNA, 25 bp, Mus musculus
agatgcatatttaaccccaactggc

SEQ ID NO: 161386 - DNA, 25 bp, Mus musculus
agatgcatattttaccccaactggc

SEQ ID NO: 161387 - DNA, 25 bp, Mus musculus
agatgcatcctgagcctgaggcaga

SEQ ID NO: 161388 - DNA, 25 bp, Mus musculus
agatgcatcctgtgcctgaggcaga

SEQ ID NO: 161389 - DNA, 25 bp, Mus musculus
agatgcatccttacctgaccccggg

SEQ ID NO: 161390 - DNA, 25 bp, Mus musculus
agatgcatcctttcctgaccccggg

SEQ ID NO: 161391 - DNA, 25 bp, Mus musculus
agatgcatctctctgttctcttgtt

SEQ ID NO: 161392 - DNA, 25 bp, Mus musculus
agatgcatctctgtgttctcttgtt

SEQ ID NO: 161393 - DNA, 25 bp, Mus musculus
agatgcatctgaccaaccacagaag

SEQ ID NO: 161394 - DNA, 25 bp, Mus musculus
agatgcatctgagcaaccacagaag

SEQ ID NO: 161395 - DNA, 25 bp, Mus musculus
agatgcatctgcattttcatgagtg

SEQ ID NO: 161396 - DNA, 25 bp, Mus musculus
agatgcatctgcctaccttgctagg

SEQ ID NO: 161397 - DNA, 25 bp, Mus musculus
agatgcatctgcgtaccttgctagg

SEQ ID NO: 161398 - DNA, 25 bp, Mus musculus
agatgcatctgctttttcatgagtg

SEQ ID NO: 161399 - DNA, 25 bp, Mus musculus
agatgcatgatgcttctcacagatg

SEQ ID NO: 161400 - DNA, 25 bp, Mus musculus
agatgcatgatggttctcacagatg

SEQ ID NO: 161401 - DNA, 25 bp, Mus musculus
agatgcatgcataaaagttctttcc

SEQ ID NO: 161402 - DNA, 25 bp, Mus musculus
agatgcatgcattaaagttctttcc

SEQ ID NO: 161403 - DNA, 25 bp, Mus musculus
agatgcatgccccagatttcactgt

SEQ ID NO: 161404 - DNA, 25 bp, Mus musculus
agatgcatgcccgagatttcactgt

SEQ ID NO: 161405 - DNA, 25 bp, Mus musculus
agatgcatgtccacctcagggtgtg

SEQ ID NO: 161406 - DNA, 25 bp, Mus musculus
agatgcatgtcctcctcagggtgtg

SEQ ID NO: 161407 - DNA, 25 bp, Mus musculus
agatgcattcgacctgtgtttccta

SEQ ID NO: 161408 - DNA, 25 bp, Mus musculus
agatgcattcgagctgtgtttccta

SEQ ID NO: 161409 - DNA, 25 bp, Mus musculus
agatgcattgcaaaaatccttacaa

SEQ ID NO: 161410 - DNA, 25 bp, Mus musculus
agatgcattgcataaatccttacaa

SEQ ID NO: 161411 - DNA, 25 bp, Mus musculus
agatgcattgtcaagctgagcttcc

SEQ ID NO: 161412 - DNA, 25 bp, Mus musculus
agatgcattgtctagctgagcttcc

SEQ ID NO: 161413 - DNA, 25 bp, Mus musculus
agatgcattgtgcaggcccacatgc

SEQ ID NO: 161414 - DNA, 25 bp, Mus musculus
agatgcattgtggaggcccacatgc

SEQ ID NO: 161415 - DNA, 25 bp, Mus musculus
agatgcatttttcactagttttagt

SEQ ID NO: 161416 - DNA, 25 bp, Mus musculus
agatgcatttttgactagttttagt

SEQ ID NO: 161417 - DNA, 25 bp, Mus musculus
agatgccaaagcaccattagacatg

SEQ ID NO: 161418 - DNA, 25 bp, Mus musculus
agatgccaaagctccattagacatg

SEQ ID NO: 161419 - DNA, 25 bp, Mus musculus
agatgccaaagtccatagggcccta

SEQ ID NO: 161420 - DNA, 25 bp, Mus musculus
agatgccaaagtgcatagggcccta

SEQ ID NO: 161421 - DNA, 25 bp, Mus musculus
agatgccaacagatgagagcctcag

SEQ ID NO: 161422 - DNA, 25 bp, Mus musculus
agatgccaacagttgagagcctcag

SEQ ID NO: 161423 - DNA, 25 bp, Mus musculus
agatgccaacatcagctctcaaaaa

SEQ ID NO: 161424 - DNA, 25 bp, Mus musculus
agatgccaacatgagctctcaaaaa

SEQ ID NO: 161425 - DNA, 25 bp, Mus musculus
agatgccaaccccaggagcgggcct

SEQ ID NO: 161426 - DNA, 25 bp, Mus musculus
agatgccaacccgaggagcgggcct

SEQ ID NO: 161427 - DNA, 25 bp, Mus musculus
agatgccacatgagacctgccttgt

SEQ ID NO: 161428 - DNA, 25 bp, Mus musculus
agatgccacatgtgacctgccttgt

SEQ ID NO: 161429 - DNA, 25 bp, Mus musculus
agatgccaccaaatggacattgaca

SEQ ID NO: 161430 - DNA, 25 bp, Mus musculus
agatgccaccaattggacattgaca

SEQ ID NO: 161431 - DNA, 25 bp, Mus musculus
agatgccaccttctacattatcctg

SEQ ID NO: 161432 - DNA, 25 bp, Mus musculus
agatgccaccttgtacattatcctg

SEQ ID NO: 161433 - DNA, 25 bp, Mus musculus
agatgccactggagtaaacctccta

SEQ ID NO: 161434 - DNA, 25 bp, Mus musculus
agatgccactggtgtaaacctccta

SEQ ID NO: 161435 - DNA, 25 bp, Mus musculus
agatgccagactactgagctgtgct

SEQ ID NO: 161436 - DNA, 25 bp, Mus musculus
agatgccagactccggaggactcca

SEQ ID NO: 161437 - DNA, 25 bp, Mus musculus
agatgccagactgcggaggactcca

SEQ ID NO: 161438 - DNA, 25 bp, Mus musculus
agatgccagacttctgagctgtgct

SEQ ID NO: 161439 - DNA, 25 bp, Mus musculus
agatgccagccaaggtccgctgagc

SEQ ID NO: 161440 - DNA, 25 bp, Mus musculus
agatgccagccatggtccgctgagc

SEQ ID NO: 161441 - DNA, 25 bp, Mus musculus
agatgccagctaaaacttcctcact

SEQ ID NO: 161442 - DNA, 25 bp, Mus musculus
agatgccagctataacttcctcact

SEQ ID NO: 161443 - DNA, 25 bp, Mus musculus
agatgccagggcattgattcaatga

SEQ ID NO: 161444 - DNA, 25 bp, Mus musculus
agatgccagggctttgattcaatga

SEQ ID NO: 161445 - DNA, 25 bp, Mus musculus
agatgccaggtcaaagaggagtcac

SEQ ID NO: 161446 - DNA, 25 bp, Mus musculus
agatgccaggtctaagaggagtcac

SEQ ID NO: 161447 - DNA, 25 bp, Mus musculus
agatgccataatcctgcctgggaca

SEQ ID NO: 161448 - DNA, 25 bp, Mus musculus
agatgccataatgctgcctgggaca

SEQ ID NO: 161449 - DNA, 25 bp, Mus musculus
agatgccatactctctgctattctg

SEQ ID NO: 161450 - DNA, 25 bp, Mus musculus
agatgccatactgtctgctattctg

SEQ ID NO: 161451 - DNA, 25 bp, Mus musculus
agatgccatcctatacagacccaga

SEQ ID NO: 161452 - DNA, 25 bp, Mus musculus
agatgccatcctttacagacccaga

SEQ ID NO: 161453 - DNA, 25 bp, Mus musculus
agatgccatcgccaggaaactgagg

SEQ ID NO: 161454 - DNA, 25 bp, Mus musculus
agatgccatcgcgaggaaactgagg

SEQ ID NO: 161455 - DNA, 25 bp, Mus musculus
agatgccatgcacccaatccaaatg

SEQ ID NO: 161456 - DNA, 25 bp, Mus musculus
agatgccatgcagccaatccaaatg

SEQ ID NO: 161457 - DNA, 25 bp, Mus musculus
agatgccatgtcagagcagccaact

SEQ ID NO: 161458 - DNA, 25 bp, Mus musculus
agatgccatgtctgagcagccaact

SEQ ID NO: 161459 - DNA, 25 bp, Mus musculus
agatgccatgtgctccagcttagac

SEQ ID NO: 161460 - DNA, 25 bp, Mus musculus
agatgccatgtggtccagcttagac

SEQ ID NO: 161461 - DNA, 25 bp, Mus musculus
agatgccattctagtagctcttgcc

SEQ ID NO: 161462 - DNA, 25 bp, Mus musculus
agatgccattctctgtgccaagaaa

SEQ ID NO: 161463 - DNA, 25 bp, Mus musculus
agatgccattctgtgtgccaagaaa

SEQ ID NO: 161464 - DNA, 25 bp, Mus musculus
agatgccattcttgtagctcttgcc

SEQ ID NO: 161465 - DNA, 25 bp, Mus musculus
agatgccatttacctgtggccagag

SEQ ID NO: 161466 - DNA, 25 bp, Mus musculus
agatgccatttagctgtggccagag

SEQ ID NO: 161467 - DNA, 25 bp, Mus musculus
agatgcccaagcatcattcggctca

SEQ ID NO: 161468 - DNA, 25 bp, Mus musculus
agatgcccaagcttcattcggctca

SEQ ID NO: 161469 - DNA, 25 bp, Mus musculus
agatgcccaattaattctcccagtt

SEQ ID NO: 161470 - DNA, 25 bp, Mus musculus
agatgcccaattatactatagggac

SEQ ID NO: 161471 - DNA, 25 bp, Mus musculus
agatgcccaatttattctcccagtt

SEQ ID NO: 161472 - DNA, 25 bp, Mus musculus
agatgcccaattttactatagggac

SEQ ID NO: 161473 - DNA, 25 bp, Mus musculus
agatgcccacttacagataactaga

SEQ ID NO: 161474 - DNA, 25 bp, Mus musculus
agatgcccactttcagataactaga

SEQ ID NO: 161475 - DNA, 25 bp, Mus musculus
agatgcccagctaaggcaactcagt

SEQ ID NO: 161476 - DNA, 25 bp, Mus musculus
agatgcccagcttaggcaactcagt

SEQ ID NO: 161477 - DNA, 25 bp, Mus musculus
agatgcccaggcactgaacacaagc

SEQ ID NO: 161478 - DNA, 25 bp, Mus musculus
agatgcccaggcattagagctgaga

SEQ ID NO: 161479 - DNA, 25 bp, Mus musculus
agatgcccaggctctgaacacaagc

SEQ ID NO: 161480 - DNA, 25 bp, Mus musculus
agatgcccaggctttagagctgaga

SEQ ID NO: 161481 - DNA, 25 bp, Mus musculus
agatgcccatgaacacatccggaca

SEQ ID NO: 161482 - DNA, 25 bp, Mus musculus
agatgcccatgatcacatccggaca

SEQ ID NO: 161483 - DNA, 25 bp, Mus musculus
agatgcccatttcaagatctcggga

SEQ ID NO: 161484 - DNA, 25 bp, Mus musculus
agatgcccatttgaagatctcggga

SEQ ID NO: 161485 - DNA, 25 bp, Mus musculus
agatgccccaacatcatggctgtat

SEQ ID NO: 161486 - DNA, 25 bp, Mus musculus
agatgccccaacttcatggctgtat

SEQ ID NO: 161487 - DNA, 25 bp, Mus musculus
agatgccccaagacttgacacggct

SEQ ID NO: 161488 - DNA, 25 bp, Mus musculus
agatgccccaagtcttgacacggct

SEQ ID NO: 161489 - DNA, 25 bp, Mus musculus
agatgccccagcaagctagtcattg

SEQ ID NO: 161490 - DNA, 25 bp, Mus musculus
agatgccccagctagctagtcattg

SEQ ID NO: 161491 - DNA, 25 bp, Mus musculus
agatgccccgagcaggctcactgga

SEQ ID NO: 161492 - DNA, 25 bp, Mus musculus
agatgccccgaggaggctcactgga

SEQ ID NO: 161493 - DNA, 25 bp, Mus musculus
agatgcccctcccaattgtgagtgg

SEQ ID NO: 161494 - DNA, 25 bp, Mus musculus
agatgcccctccgaattgtgagtgg

SEQ ID NO: 161495 - DNA, 25 bp, Mus musculus
agatgcccctgtatgagcctggtgt

SEQ ID NO: 161496 - DNA, 25 bp, Mus musculus
agatgcccctgtttgagcctggtgt

SEQ ID NO: 161497 - DNA, 25 bp, Mus musculus
agatgcccctttataagacattacg

SEQ ID NO: 161498 - DNA, 25 bp, Mus musculus
agatgcccctttttaagacattacg

SEQ ID NO: 161499 - DNA, 25 bp, Mus musculus
agatgcccgagccagccaaagtact

SEQ ID NO: 161500 - DNA, 25 bp, Mus musculus
agatgcccgagcgagccaaagtact

SEQ ID NO: 161501 - DNA, 25 bp, Mus musculus
agatgcccggccagctgagattgac

SEQ ID NO: 161502 - DNA, 25 bp, Mus musculus
agatgcccggcctgctgagattgac

SEQ ID NO: 161503 - DNA, 25 bp, Mus musculus
agatgccctccacgcgagctgaggt

SEQ ID NO: 161504 - DNA, 25 bp, Mus musculus
agatgccctccaggcgagctgaggt

SEQ ID NO: 161505 - DNA, 25 bp, Mus musculus
agatgccctctaaggattctgccca

SEQ ID NO: 161506 - DNA, 25 bp, Mus musculus
agatgccctctatggattctgccca

SEQ ID NO: 161507 - DNA, 25 bp, Mus musculus
agatgccctgaacagtagctactac

SEQ ID NO: 161508 - DNA, 25 bp, Mus musculus
agatgccctgaacctagagttatag

SEQ ID NO: 161509 - DNA, 25 bp, Mus musculus
agatgccctgaagagtagctactac

SEQ ID NO: 161510 - DNA, 25 bp, Mus musculus
agatgccctgaagctagagttatag

SEQ ID NO: 161511 - DNA, 25 bp, Mus musculus
agatgccctggaaggcggctttcag

SEQ ID NO: 161512 - DNA, 25 bp, Mus musculus
agatgccctggatggcggctttcag

SEQ ID NO: 161513 - DNA, 25 bp, Mus musculus
agatgccctgttcccatcaaaaggt

SEQ ID NO: 161514 - DNA, 25 bp, Mus musculus
agatgccctgttgccatcaaaaggt

SEQ ID NO: 161515 - DNA, 25 bp, Mus musculus
agatgccgagatccacatcgtgcag

SEQ ID NO: 161516 - DNA, 25 bp, Mus musculus
agatgccgagatgcacatcgtgcag

SEQ ID NO: 161517 - DNA, 25 bp, Mus musculus
agatgccgcctgagtcgtgcagaaa

SEQ ID NO: 161518 - DNA, 25 bp, Mus musculus
agatgccgcctgtgtcgtgcagaaa

SEQ ID NO: 161519 - DNA, 25 bp, Mus musculus
agatgccgcttcagctctgggaatt

SEQ ID NO: 161520 - DNA, 25 bp, Mus musculus
agatgccgcttctgctctgggaatt

SEQ ID NO: 161521 - DNA, 25 bp, Mus musculus
agatgccgtcctcaagatgacttga

SEQ ID NO: 161522 - DNA, 25 bp, Mus musculus
agatgccgtcctgaagatgacttga

SEQ ID NO: 161523 - DNA, 25 bp, Mus musculus
agatgccgtctacgatccaagaacc

SEQ ID NO: 161524 - DNA, 25 bp, Mus musculus
agatgccgtctaggatccaagaacc

SEQ ID NO: 161525 - DNA, 25 bp, Mus musculus
agatgccgtgacagcttctctgcat

SEQ ID NO: 161526 - DNA, 25 bp, Mus musculus
agatgccgtgactgcttctctgcat

SEQ ID NO: 161527 - DNA, 25 bp, Mus musculus
agatgccgtttaatggtactcagcc

SEQ ID NO: 161528 - DNA, 25 bp, Mus musculus
agatgccgtttattggtactcagcc

SEQ ID NO: 161529 - DNA, 25 bp, Mus musculus
agatgcctaccccactcttttaaag

SEQ ID NO: 161530 - DNA, 25 bp, Mus musculus
agatgcctacccgactcttttaaag

SEQ ID NO: 161531 - DNA, 25 bp, Mus musculus
agatgcctacgtctacattgtgccc

SEQ ID NO: 161532 - DNA, 25 bp, Mus musculus
agatgcctacgtgtacattgtgccc

SEQ ID NO: 161533 - DNA, 25 bp, Mus musculus
agatgcctatcaagaagactccagc

SEQ ID NO: 161534 - DNA, 25 bp, Mus musculus
agatgcctatcatgaagactccagc

SEQ ID NO: 161535 - DNA, 25 bp, Mus musculus
agatgcctatgcagagttttgccca

SEQ ID NO: 161536 - DNA, 25 bp, Mus musculus
agatgcctatgcatatgggtccacc

SEQ ID NO: 161537 - DNA, 25 bp, Mus musculus
agatgcctatgctgagttttgccca

SEQ ID NO: 161538 - DNA, 25 bp, Mus musculus
agatgcctatgcttatgggtccacc

SEQ ID NO: 161539 - DNA, 25 bp, Mus musculus
agatgcctattccagcatggccaag

SEQ ID NO: 161540 - DNA, 25 bp, Mus musculus
agatgcctattcgagcatggccaag

SEQ ID NO: 161541 - DNA, 25 bp, Mus musculus
agatgcctcagacctactccagaga

SEQ ID NO: 161542 - DNA, 25 bp, Mus musculus
agatgcctcagagctactccagaga

SEQ ID NO: 161543 - DNA, 25 bp, Mus musculus
agatgcctcattagctctttcagag

SEQ ID NO: 161544 - DNA, 25 bp, Mus musculus
agatgcctcatttgctctttcagag

SEQ ID NO: 161545 - DNA, 25 bp, Mus musculus
agatgcctccacatacaatcctgag

SEQ ID NO: 161546 - DNA, 25 bp, Mus musculus
agatgcctccacttacaatcctgag

SEQ ID NO: 161547 - DNA, 25 bp, Mus musculus
agatgcctccgtaggtatccaggta

SEQ ID NO: 161548 - DNA, 25 bp, Mus musculus
agatgcctccgttggtatccaggta

SEQ ID NO: 161549 - DNA, 25 bp, Mus musculus
agatgcctcctaattgtttaaatta

SEQ ID NO: 161550 - DNA, 25 bp, Mus musculus
agatgcctcctatttgtttaaatta

SEQ ID NO: 161551 - DNA, 25 bp, Mus musculus
agatgcctctatatcctgagttcta

SEQ ID NO: 161552 - DNA, 25 bp, Mus musculus
agatgcctctatttcctgagttcta

SEQ ID NO: 161553 - DNA, 25 bp, Mus musculus
agatgcctctgcagacctcaccatg

SEQ ID NO: 161554 - DNA, 25 bp, Mus musculus
agatgcctctgctgacctcaccatg

SEQ ID NO: 161555 - DNA, 25 bp, Mus musculus
agatgcctcttaacctggaccagca

SEQ ID NO: 161556 - DNA, 25 bp, Mus musculus
agatgcctcttatcctggaccagca

SEQ ID NO: 161557 - DNA, 25 bp, Mus musculus
agatgcctgactaaagtgagtgtga

SEQ ID NO: 161558 - DNA, 25 bp, Mus musculus
agatgcctgacttaagtgagtgtga

SEQ ID NO: 161559 - DNA, 25 bp, Mus musculus
agatgcctgagcacagatggcccag

SEQ ID NO: 161560 - DNA, 25 bp, Mus musculus
agatgcctgagctcagatggcccag

SEQ ID NO: 161561 - DNA, 25 bp, Mus musculus
agatgcctgcagacgatagctgggc

SEQ ID NO: 161562 - DNA, 25 bp, Mus musculus
agatgcctgcagtcgatagctgggc

SEQ ID NO: 161563 - DNA, 25 bp, Mus musculus
agatgcctgcatagatgggagccca

SEQ ID NO: 161564 - DNA, 25 bp, Mus musculus
agatgcctgcattgatgggagccca

SEQ ID NO: 161565 - DNA, 25 bp, Mus musculus
agatgcctgcctattattctcattt

SEQ ID NO: 161566 - DNA, 25 bp, Mus musculus
agatgcctgccttttattctcattt

SEQ ID NO: 161567 - DNA, 25 bp, Mus musculus
agatgcctggagatatgtgacccta

SEQ ID NO: 161568 - DNA, 25 bp, Mus musculus
agatgcctggagttatgtgacccta

SEQ ID NO: 161569 - DNA, 25 bp, Mus musculus
agatgcctggatctacctctgtgcg

SEQ ID NO: 161570 - DNA, 25 bp, Mus musculus
agatgcctggatgtacctctgtgcg

SEQ ID NO: 161571 - DNA, 25 bp, Mus musculus
agatgcctgggacaagctgctgctt

SEQ ID NO: 161572 - DNA, 25 bp, Mus musculus
agatgcctgggagaagctgctgctt

SEQ ID NO: 161573 - DNA, 25 bp, Mus musculus
agatgcctgtccaagctggtcaagt

SEQ ID NO: 161574 - DNA, 25 bp, Mus musculus
agatgcctgtcctagctggtcaagt

SEQ ID NO: 161575 - DNA, 25 bp, Mus musculus
agatgcctgttgcttcctctgttat

SEQ ID NO: 161576 - DNA, 25 bp, Mus musculus
agatgcctgttggttcctctgttat

SEQ ID NO: 161577 - DNA, 25 bp, Mus musculus
agatgcctgtttctagcctaatgaa

SEQ ID NO: 161578 - DNA, 25 bp, Mus musculus
agatgcctgtttgtagcctaatgaa

SEQ ID NO: 161579 - DNA, 25 bp, Mus musculus
agatgccttcaaatatattcacaga

SEQ ID NO: 161580 - DNA, 25 bp, Mus musculus
agatgccttcaattatattcacaga

SEQ ID NO: 161581 - DNA, 25 bp, Mus musculus
agatgccttgatctctctgagaagt

SEQ ID NO: 161582 - DNA, 25 bp, Mus musculus
agatgccttgatgtctctgagaagt

SEQ ID NO: 161583 - DNA, 25 bp, Mus musculus
agatgccttggaccgggagcttaca

SEQ ID NO: 161584 - DNA, 25 bp, Mus musculus
agatgccttggacgtcatccccatg

SEQ ID NO: 161585 - DNA, 25 bp, Mus musculus
agatgccttggagcgggagcttaca

SEQ ID NO: 161586 - DNA, 25 bp, Mus musculus
agatgccttggaggtcatccccatg

SEQ ID NO: 161587 - DNA, 25 bp, Mus musculus
agatgccttgtcaccatgctgacag

SEQ ID NO: 161588 - DNA, 25 bp, Mus musculus
agatgccttgtctccatgctgacag

SEQ ID NO: 161589 - DNA, 25 bp, Mus musculus
agatgccttgtgacttccagcaaac

SEQ ID NO: 161590 - DNA, 25 bp, Mus musculus
agatgccttgtgagaaatgcctttg

SEQ ID NO: 161591 - DNA, 25 bp, Mus musculus
agatgccttgtgtcttccagcaaac

SEQ ID NO: 161592 - DNA, 25 bp, Mus musculus
agatgccttgtgtgaaatgcctttg

SEQ ID NO: 161593 - DNA, 25 bp, Mus musculus
agatgccttgttcctttgaagaagg

SEQ ID NO: 161594 - DNA, 25 bp, Mus musculus
agatgccttgttgctttgaagaagg

SEQ ID NO: 161595 - DNA, 25 bp, Mus musculus
agatgcctttcaatgccgcaagaat

SEQ ID NO: 161596 - DNA, 25 bp, Mus musculus
agatgcctttcattgccgcaagaat

SEQ ID NO: 161597 - DNA, 25 bp, Mus musculus
agatgcgacaaaccgccggctggac

SEQ ID NO: 161598 - DNA, 25 bp, Mus musculus
agatgcgacaaagcgccggctggac

SEQ ID NO: 161599 - DNA, 25 bp, Mus musculus
agatgcgagtttactcccttctttt

SEQ ID NO: 161600 - DNA, 25 bp, Mus musculus
agatgcgagttttctcccttctttt

SEQ ID NO: 161601 - DNA, 25 bp, Mus musculus
agatgcgcagcaaacaaccattggc

SEQ ID NO: 161602 - DNA, 25 bp, Mus musculus
agatgcgcagcatacaaccattggc

SEQ ID NO: 161603 - DNA, 25 bp, Mus musculus
agatgcgcatccagatggtgggcct

SEQ ID NO: 161604 - DNA, 25 bp, Mus musculus
agatgcgcatcctgatggtgggcct

SEQ ID NO: 161605 - DNA, 25 bp, Mus musculus
agatgcgctggaacctggaaaccac

SEQ ID NO: 161606 - DNA, 25 bp, Mus musculus
agatgcgctggatcctggaaaccac

SEQ ID NO: 161607 - DNA, 25 bp, Mus musculus
agatgcgcttcacaagatgactggg

SEQ ID NO: 161608 - DNA, 25 bp, Mus musculus
agatgcgcttcagaagatgactggg

SEQ ID NO: 161609 - DNA, 25 bp, Mus musculus
agatgcgcttgcctggaggacactc

SEQ ID NO: 161610 - DNA, 25 bp, Mus musculus
agatgcgcttgcgtggaggacactc

SEQ ID NO: 161611 - DNA, 25 bp, Mus musculus
agatgcggaaacagttcccttcgac

SEQ ID NO: 161612 - DNA, 25 bp, Mus musculus
agatgcggaaactgttcccttcgac

SEQ ID NO: 161613 - DNA, 25 bp, Mus musculus
agatgcggcatcacattagcagcct

SEQ ID NO: 161614 - DNA, 25 bp, Mus musculus
agatgcggcatctcattagcagcct

SEQ ID NO: 161615 - DNA, 25 bp, Mus musculus
agatgcggccctccttcctggagat

SEQ ID NO: 161616 - DNA, 25 bp, Mus musculus
agatgcggccctgcttcctggagat

SEQ ID NO: 161617 - DNA, 25 bp, Mus musculus
agatgcggccttaccggctgccacg

SEQ ID NO: 161618 - DNA, 25 bp, Mus musculus
agatgcggcctttccggctgccacg

SEQ ID NO: 161619 - DNA, 25 bp, Mus musculus
agatgcggcgctaggtagcatacct

SEQ ID NO: 161620 - DNA, 25 bp, Mus musculus
agatgcggcgcttggtagcatacct

SEQ ID NO: 161621 - DNA, 25 bp, Mus musculus
agatgcgggagtctcattgcttaga

SEQ ID NO: 161622 - DNA, 25 bp, Mus musculus
agatgcgggagtgtcattgcttaga

SEQ ID NO: 161623 - DNA, 25 bp, Mus musculus
agatgcggtctgagtacgctcactt

SEQ ID NO: 161624 - DNA, 25 bp, Mus musculus
agatgcggtctgtgtacgctcactt

SEQ ID NO: 161625 - DNA, 25 bp, Mus musculus
agatgcgtcatcaagtagctcccag

SEQ ID NO: 161626 - DNA, 25 bp, Mus musculus
agatgcgtcatctagtagctcccag

SEQ ID NO: 161627 - DNA, 25 bp, Mus musculus
agatgcgtgcgaaggctgctctaca

SEQ ID NO: 161628 - DNA, 25 bp, Mus musculus
agatgcgtgcgatggctgctctaca

SEQ ID NO: 161629 - DNA, 25 bp, Mus musculus
agatgcgtggtcatctggccaagcg

SEQ ID NO: 161630 - DNA, 25 bp, Mus musculus
agatgcgtggtcttctggccaagcg

SEQ ID NO: 161631 - DNA, 25 bp, Mus musculus
agatgcgtgtggcttttgcgaccta

SEQ ID NO: 161632 - DNA, 25 bp, Mus musculus
agatgcgtgtgggttttgcgaccta

SEQ ID NO: 161633 - DNA, 25 bp, Mus musculus
agatgcgtgttgctactggttgata

SEQ ID NO: 161634 - DNA, 25 bp, Mus musculus
agatgcgtgttggtactggttgata

SEQ ID NO: 161635 - DNA, 25 bp, Mus musculus
agatgcgttccacactgacggcttg

SEQ ID NO: 161636 - DNA, 25 bp, Mus musculus
agatgcgttccagactgacggcttg

SEQ ID NO: 161637 - DNA, 25 bp, Mus musculus
agatgctaacggcttgtcggagact

SEQ ID NO: 161638 - DNA, 25 bp, Mus musculus
agatgctaacgggttgtcggagact

SEQ ID NO: 161639 - DNA, 25 bp, Mus musculus
agatgctaaggcacaattaagtacc

SEQ ID NO: 161640 - DNA, 25 bp, Mus musculus
agatgctaaggctcaattaagtacc

SEQ ID NO: 161641 - DNA, 25 bp, Mus musculus
agatgctaccgacgcaaccttgctt

SEQ ID NO: 161642 - DNA, 25 bp, Mus musculus
agatgctaccgaggcaaccttgctt

SEQ ID NO: 161643 - DNA, 25 bp, Mus musculus
agatgctactcgactgcctaggcat

SEQ ID NO: 161644 - DNA, 25 bp, Mus musculus
agatgctactcgtctgcctaggcat

SEQ ID NO: 161645 - DNA, 25 bp, Mus musculus
agatgctactctcgcctcagataca

SEQ ID NO: 161646 - DNA, 25 bp, Mus musculus
agatgctactctggcctcagataca

SEQ ID NO: 161647 - DNA, 25 bp, Mus musculus
agatgctactgcacagcttgtacta

SEQ ID NO: 161648 - DNA, 25 bp, Mus musculus
agatgctactgctcagcttgtacta

SEQ ID NO: 161649 - DNA, 25 bp, Mus musculus
agatgctacttgaatctttgtccat

SEQ ID NO: 161650 - DNA, 25 bp, Mus musculus
agatgctacttgtatctttgtccat

SEQ ID NO: 161651 - DNA, 25 bp, Mus musculus
agatgctaggacataacttgttaca

SEQ ID NO: 161652 - DNA, 25 bp, Mus musculus
agatgctaggacttaacttgttaca

SEQ ID NO: 161653 - DNA, 25 bp, Mus musculus
agatgctagtggactctacttcctc

SEQ ID NO: 161654 - DNA, 25 bp, Mus musculus
agatgctagtggtctctacttcctc

SEQ ID NO: 161655 - DNA, 25 bp, Mus musculus
agatgctatgcacagttgaatatga

SEQ ID NO: 161656 - DNA, 25 bp, Mus musculus
agatgctatgcagagttgaatatga

SEQ ID NO: 161657 - DNA, 25 bp, Mus musculus
agatgctatggaacctttcttttct

SEQ ID NO: 161658 - DNA, 25 bp, Mus musculus
agatgctatggatcctttcttttct

SEQ ID NO: 161659 - DNA, 25 bp, Mus musculus
agatgctcaacgatatttcttacga

SEQ ID NO: 161660 - DNA, 25 bp, Mus musculus
agatgctcaacgcagctgtcttcag

SEQ ID NO: 161661 - DNA, 25 bp, Mus musculus
agatgctcaacggagctgtcttcag

SEQ ID NO: 161662 - DNA, 25 bp, Mus musculus
agatgctcaacgttatttcttacga

SEQ ID NO: 161663 - DNA, 25 bp, Mus musculus
agatgctcaagccatacctagtatg

SEQ ID NO: 161664 - DNA, 25 bp, Mus musculus
agatgctcaagcgatacctagtatg

SEQ ID NO: 161665 - DNA, 25 bp, Mus musculus
agatgctcaagtaccctatataaaa

SEQ ID NO: 161666 - DNA, 25 bp, Mus musculus
agatgctcaagttccctatataaaa

SEQ ID NO: 161667 - DNA, 25 bp, Mus musculus
agatgctcacacattcatagcgctt

SEQ ID NO: 161668 - DNA, 25 bp, Mus musculus
agatgctcacactttcatagcgctt

SEQ ID NO: 161669 - DNA, 25 bp, Mus musculus
agatgctcaccactatggctgggag

SEQ ID NO: 161670 - DNA, 25 bp, Mus musculus
agatgctcaccagtatggctgggag

SEQ ID NO: 161671 - DNA, 25 bp, Mus musculus
agatgctcacccaatacttcttgag

SEQ ID NO: 161672 - DNA, 25 bp, Mus musculus
agatgctcaccctatacttcttgag

SEQ ID NO: 161673 - DNA, 25 bp, Mus musculus
agatgctcactcagtacctggtcat

SEQ ID NO: 161674 - DNA, 25 bp, Mus musculus
agatgctcactctgtacctggtcat

SEQ ID NO: 161675 - DNA, 25 bp, Mus musculus
agatgctcactgacaggatcttaat

SEQ ID NO: 161676 - DNA, 25 bp, Mus musculus
agatgctcactgcatctggagaccc

SEQ ID NO: 161677 - DNA, 25 bp, Mus musculus
agatgctcactggatctggagaccc

SEQ ID NO: 161678 - DNA, 25 bp, Mus musculus
agatgctcactgtcaggatcttaat

SEQ ID NO: 161679 - DNA, 25 bp, Mus musculus
agatgctcagagaatagctccctgc

SEQ ID NO: 161680 - DNA, 25 bp, Mus musculus
agatgctcagagtatagctccctgc

SEQ ID NO: 161681 - DNA, 25 bp, Mus musculus
agatgctcagtgctggtcccatcaa

SEQ ID NO: 161682 - DNA, 25 bp, Mus musculus
agatgctcagtggtggtcccatcaa

SEQ ID NO: 161683 - DNA, 25 bp, Mus musculus
agatgctcatcccaggaacctcgaa

SEQ ID NO: 161684 - DNA, 25 bp, Mus musculus
agatgctcatccgaggaacctcgaa

SEQ ID NO: 161685 - DNA, 25 bp, Mus musculus
agatgctcatgaattccctgcggta

SEQ ID NO: 161686 - DNA, 25 bp, Mus musculus
agatgctcatgatttccctgcggta

SEQ ID NO: 161687 - DNA, 25 bp, Mus musculus
agatgctccaaaaatcatacacaaa

SEQ ID NO: 161688 - DNA, 25 bp, Mus musculus
agatgctccaaatatcatacacaaa

SEQ ID NO: 161689 - DNA, 25 bp, Mus musculus
agatgctccaagaccgttctagtag

SEQ ID NO: 161690 - DNA, 25 bp, Mus musculus
agatgctccaagtccgttctagtag

SEQ ID NO: 161691 - DNA, 25 bp, Mus musculus
agatgctccactcgtcggtgtgcgc

SEQ ID NO: 161692 - DNA, 25 bp, Mus musculus
agatgctccactggtcggtgtgcgc

SEQ ID NO: 161693 - DNA, 25 bp, Mus musculus
agatgctccattaagggctgagtat

SEQ ID NO: 161694 - DNA, 25 bp, Mus musculus
agatgctccatttagggctgagtat

SEQ ID NO: 161695 - DNA, 25 bp, Mus musculus
agatgctccccaaggagttgcgtgg

SEQ ID NO: 161696 - DNA, 25 bp, Mus musculus
agatgctccccatggagttgcgtgg

SEQ ID NO: 161697 - DNA, 25 bp, Mus musculus
agatgctccccgcagttcctgagct

SEQ ID NO: 161698 - DNA, 25 bp, Mus musculus
agatgctccccggagttcctgagct

SEQ ID NO: 161699 - DNA, 25 bp, Mus musculus
agatgctcccctcagcagtggtgga

SEQ ID NO: 161700 - DNA, 25 bp, Mus musculus
agatgctcccctgagcagtggtgga

SEQ ID NO: 161701 - DNA, 25 bp, Mus musculus
agatgctcccggaagctgtgtaacg

SEQ ID NO: 161702 - DNA, 25 bp, Mus musculus
agatgctcccggtagctgtgtaacg

SEQ ID NO: 161703 - DNA, 25 bp, Mus musculus
agatgctccgtcagagttgtgcagc

SEQ ID NO: 161704 - DNA, 25 bp, Mus musculus
agatgctccgtctgagttgtgcagc

SEQ ID NO: 161705 - DNA, 25 bp, Mus musculus
agatgctcctaaataccggctcaag

SEQ ID NO: 161706 - DNA, 25 bp, Mus musculus
agatgctcctaattaccggctcaag

SEQ ID NO: 161707 - DNA, 25 bp, Mus musculus
agatgctcctggagtatacaccaag

SEQ ID NO: 161708 - DNA, 25 bp, Mus musculus
agatgctcctggtgtatacaccaag

SEQ ID NO: 161709 - DNA, 25 bp, Mus musculus
agatgctcctgtctgaccgattcct

SEQ ID NO: 161710 - DNA, 25 bp, Mus musculus
agatgctcctgtgtgaccgattcct

SEQ ID NO: 161711 - DNA, 25 bp, Mus musculus
agatgctcggagacctgactgacaa

SEQ ID NO: 161712 - DNA, 25 bp, Mus musculus
agatgctcggagtcctgactgacaa

SEQ ID NO: 161713 - DNA, 25 bp, Mus musculus
agatgctcgttcatccagtgttgag

SEQ ID NO: 161714 - DNA, 25 bp, Mus musculus
agatgctcgttcttccagtgttgag

SEQ ID NO: 161715 - DNA, 25 bp, Mus musculus
agatgctctaccaggctactcgtat

SEQ ID NO: 161716 - DNA, 25 bp, Mus musculus
agatgctctacctggctactcgtat

SEQ ID NO: 161717 - DNA, 25 bp, Mus musculus
agatgctctcagcttgccatcgcct

SEQ ID NO: 161718 - DNA, 25 bp, Mus musculus
agatgctctcaggttgccatcgcct

SEQ ID NO: 161719 - DNA, 25 bp, Mus musculus
agatgctctcccatccttaataaca

SEQ ID NO: 161720 - DNA, 25 bp, Mus musculus
agatgctctcccctcttgcttgagg

SEQ ID NO: 161721 - DNA, 25 bp, Mus musculus
agatgctctcccgtcttgcttgagg

SEQ ID NO: 161722 - DNA, 25 bp, Mus musculus
agatgctctcccttccttaataaca

SEQ ID NO: 161723 - DNA, 25 bp, Mus musculus
agatgctctgacctgaacacggcaa

SEQ ID NO: 161724 - DNA, 25 bp, Mus musculus
agatgctctgacgtgaacacggcaa

SEQ ID NO: 161725 - DNA, 25 bp, Mus musculus
agatgctctggcagtctcggagttc

SEQ ID NO: 161726 - DNA, 25 bp, Mus musculus
agatgctctggctgtctcggagttc

SEQ ID NO: 161727 - DNA, 25 bp, Mus musculus
agatgctctgggcttttggcctttg

SEQ ID NO: 161728 - DNA, 25 bp, Mus musculus
agatgctctggggttttggcctttg

SEQ ID NO: 161729 - DNA, 25 bp, Mus musculus
agatgctctgtcctcatgtgtgcag

SEQ ID NO: 161730 - DNA, 25 bp, Mus musculus
agatgctctgtcgtcatgtgtgcag

SEQ ID NO: 161731 - DNA, 25 bp, Mus musculus
agatgctcttcccacttctgtaagg

SEQ ID NO: 161732 - DNA, 25 bp, Mus musculus
agatgctcttccgacttctgtaagg

SEQ ID NO: 161733 - DNA, 25 bp, Mus musculus
agatgctgaaaaaccaatgggttgt

SEQ ID NO: 161734 - DNA, 25 bp, Mus musculus
agatgctgaaaatccaatgggttgt

SEQ ID NO: 161735 - DNA, 25 bp, Mus musculus
agatgctgaagacctgcatggccca

SEQ ID NO: 161736 - DNA, 25 bp, Mus musculus
agatgctgaagagctgcatggccca

SEQ ID NO: 161737 - DNA, 25 bp, Mus musculus
agatgctgaagcacctggactttgg

SEQ ID NO: 161738 - DNA, 25 bp, Mus musculus
agatgctgaagctcctggactttgg

SEQ ID NO: 161739 - DNA, 25 bp, Mus musculus
agatgctgacaaaccacatgtggga

SEQ ID NO: 161740 - DNA, 25 bp, Mus musculus
agatgctgacaatccacatgtggga

SEQ ID NO: 161741 - DNA, 25 bp, Mus musculus
agatgctgacagcaggttctgcagc

SEQ ID NO: 161742 - DNA, 25 bp, Mus musculus
agatgctgacaggaggttctgcagc

SEQ ID NO: 161743 - DNA, 25 bp, Mus musculus
agatgctgaccgcaagtatgaagag

SEQ ID NO: 161744 - DNA, 25 bp, Mus musculus
agatgctgaccggaagtatgaagag

SEQ ID NO: 161745 - DNA, 25 bp, Mus musculus
agatgctgacggcattaccacctca

SEQ ID NO: 161746 - DNA, 25 bp, Mus musculus
agatgctgacgggattaccacctca

SEQ ID NO: 161747 - DNA, 25 bp, Mus musculus
agatgctgactgaccctgcaggaaa

SEQ ID NO: 161748 - DNA, 25 bp, Mus musculus
agatgctgactgtccctgcaggaaa

SEQ ID NO: 161749 - DNA, 25 bp, Mus musculus
agatgctgagccaggcgcagatgac

SEQ ID NO: 161750 - DNA, 25 bp, Mus musculus
agatgctgagcctggcgcagatgac

SEQ ID NO: 161751 - DNA, 25 bp, Mus musculus
agatgctgatgtagccaggccatgc

SEQ ID NO: 161752 - DNA, 25 bp, Mus musculus
agatgctgatgttgccaggccatgc

SEQ ID NO: 161753 - DNA, 25 bp, Mus musculus
agatgctgcactattgggttgtgct

SEQ ID NO: 161754 - DNA, 25 bp, Mus musculus
agatgctgcacttttgggttgtgct

SEQ ID NO: 161755 - DNA, 25 bp, Mus musculus
agatgctgcagaacaatgccgaccc

SEQ ID NO: 161756 - DNA, 25 bp, Mus musculus
agatgctgcagatcaatgccgaccc

SEQ ID NO: 161757 - DNA, 25 bp, Mus musculus
agatgctgcataatccaacgatgga

SEQ ID NO: 161758 - DNA, 25 bp, Mus musculus
agatgctgcatacttgttcttgaca

SEQ ID NO: 161759 - DNA, 25 bp, Mus musculus
agatgctgcatagttgttcttgaca

SEQ ID NO: 161760 - DNA, 25 bp, Mus musculus
agatgctgcatattccaacgatgga

SEQ ID NO: 161761 - DNA, 25 bp, Mus musculus
agatgctgcccgagacctattcttc

SEQ ID NO: 161762 - DNA, 25 bp, Mus musculus
agatgctgcccgtgacctattcttc

SEQ ID NO: 161763 - DNA, 25 bp, Mus musculus
agatgctgccttatgtgtgctaatt

SEQ ID NO: 161764 - DNA, 25 bp, Mus musculus
agatgctgccttttgtgtgctaatt

SEQ ID NO: 161765 - DNA, 25 bp, Mus musculus
agatgctgcgtcatgtagctcaggc

SEQ ID NO: 161766 - DNA, 25 bp, Mus musculus
agatgctgcgtcttgtagctcaggc

SEQ ID NO: 161767 - DNA, 25 bp, Mus musculus
agatgctgcgtgacatttgctccaa

SEQ ID NO: 161768 - DNA, 25 bp, Mus musculus
agatgctgcgtgtcatttgctccaa

SEQ ID NO: 161769 - DNA, 25 bp, Mus musculus
agatgctgctctcctcaacagcttc

SEQ ID NO: 161770 - DNA, 25 bp, Mus musculus
agatgctgctctgctcaacagcttc

SEQ ID NO: 161771 - DNA, 25 bp, Mus musculus
agatgctgctgcagcgcttggagca

SEQ ID NO: 161772 - DNA, 25 bp, Mus musculus
agatgctgctgctgcgcttggagca

SEQ ID NO: 161773 - DNA, 25 bp, Mus musculus
agatgctgctggctcaagcctagaa

SEQ ID NO: 161774 - DNA, 25 bp, Mus musculus
agatgctgctgggtcaagcctagaa

SEQ ID NO: 161775 - DNA, 25 bp, Mus musculus
agatgctgctttacacagaggtcac

SEQ ID NO: 161776 - DNA, 25 bp, Mus musculus
agatgctgcttttcacagaggtcac

SEQ ID NO: 161777 - DNA, 25 bp, Mus musculus
agatgctggaccagcactctcagga

SEQ ID NO: 161778 - DNA, 25 bp, Mus musculus
agatgctggacctgcactctcagga

SEQ ID NO: 161779 - DNA, 25 bp, Mus musculus
agatgctggatactacccaaatcac

SEQ ID NO: 161780 - DNA, 25 bp, Mus musculus
agatgctggatagtacccaaatcac

SEQ ID NO: 161781 - DNA, 25 bp, Mus musculus
agatgctggatgatgtctctgtgct

SEQ ID NO: 161782 - DNA, 25 bp, Mus musculus
agatgctggatgttgtctctgtgct

SEQ ID NO: 161783 - DNA, 25 bp, Mus musculus
agatgctggcaacctctgttgtctg

SEQ ID NO: 161784 - DNA, 25 bp, Mus musculus
agatgctggcaagctctgttgtctg

SEQ ID NO: 161785 - DNA, 25 bp, Mus musculus
agatgctggcacaaggcgttattca

SEQ ID NO: 161786 - DNA, 25 bp, Mus musculus
agatgctggcactaggcgttattca

SEQ ID NO: 161787 - DNA, 25 bp, Mus musculus
agatgctggcagactatcctcaact

SEQ ID NO: 161788 - DNA, 25 bp, Mus musculus
agatgctggcagtctatcctcaact

SEQ ID NO: 161789 - DNA, 25 bp, Mus musculus
agatgctggctaagccttggcactg

SEQ ID NO: 161790 - DNA, 25 bp, Mus musculus
agatgctggctatgccttggcactg

SEQ ID NO: 161791 - DNA, 25 bp, Mus musculus
agatgctggcttccatcttactgaa

SEQ ID NO: 161792 - DNA, 25 bp, Mus musculus
agatgctggcttccctcaggatcag

SEQ ID NO: 161793 - DNA, 25 bp, Mus musculus
agatgctggcttgcatcttactgaa

SEQ ID NO: 161794 - DNA, 25 bp, Mus musculus
agatgctggcttgcctcaggatcag

SEQ ID NO: 161795 - DNA, 25 bp, Mus musculus
agatgctgggacacatcctgagctc

SEQ ID NO: 161796 - DNA, 25 bp, Mus musculus
agatgctgggactcatcctgagctc

SEQ ID NO: 161797 - DNA, 25 bp, Mus musculus
agatgctgggagaggcgccacctac

SEQ ID NO: 161798 - DNA, 25 bp, Mus musculus
agatgctgggagtggcgccacctac

SEQ ID NO: 161799 - DNA, 25 bp, Mus musculus
agatgctgggtacccaagcaaccac

SEQ ID NO: 161800 - DNA, 25 bp, Mus musculus
agatgctgggtagccaagcaaccac

SEQ ID NO: 161801 - DNA, 25 bp, Mus musculus
agatgctgtaatcttgtgaaatgtt

SEQ ID NO: 161802 - DNA, 25 bp, Mus musculus
agatgctgtaatgttgtgaaatgtt

SEQ ID NO: 161803 - DNA, 25 bp, Mus musculus
agatgctgtacacgatgtccctccc

SEQ ID NO: 161804 - DNA, 25 bp, Mus musculus
agatgctgtacaggatgtccctccc

SEQ ID NO: 161805 - DNA, 25 bp, Mus musculus
agatgctgtactcctcaagcttgga

SEQ ID NO: 161806 - DNA, 25 bp, Mus musculus
agatgctgtactgctcaagcttgga

SEQ ID NO: 161807 - DNA, 25 bp, Mus musculus
agatgctgtatccttgaggcttcac

SEQ ID NO: 161808 - DNA, 25 bp, Mus musculus
agatgctgtatcgttgaggcttcac

SEQ ID NO: 161809 - DNA, 25 bp, Mus musculus
agatgctgtcacatattggaaatgc

SEQ ID NO: 161810 - DNA, 25 bp, Mus musculus
agatgctgtcacttattggaaatgc

SEQ ID NO: 161811 - DNA, 25 bp, Mus musculus
agatgctgtcagagcacctgtctgt

SEQ ID NO: 161812 - DNA, 25 bp, Mus musculus
agatgctgtcagtgcacctgtctgt

SEQ ID NO: 161813 - DNA, 25 bp, Mus musculus
agatgctgtgacctgcaaccgagaa

SEQ ID NO: 161814 - DNA, 25 bp, Mus musculus
agatgctgtgacgtgcaaccgagaa

SEQ ID NO: 161815 - DNA, 25 bp, Mus musculus
agatgctgtgcaacaccttccagat

SEQ ID NO: 161816 - DNA, 25 bp, Mus musculus
agatgctgtgcatcaccttccagat

SEQ ID NO: 161817 - DNA, 25 bp, Mus musculus
agatgctgtgccaggagcggcataa

SEQ ID NO: 161818 - DNA, 25 bp, Mus musculus
agatgctgtgcctggagcggcataa

SEQ ID NO: 161819 - DNA, 25 bp, Mus musculus
agatgctgtgcgagcctttcagatc

SEQ ID NO: 161820 - DNA, 25 bp, Mus musculus
agatgctgtgcgcacatgcgccctt

SEQ ID NO: 161821 - DNA, 25 bp, Mus musculus
agatgctgtgcggacatgcgccctt

SEQ ID NO: 161822 - DNA, 25 bp, Mus musculus
agatgctgtgcgtgcctttcagatc

SEQ ID NO: 161823 - DNA, 25 bp, Mus musculus
agatgctgtggacacacgctcagga

SEQ ID NO: 161824 - DNA, 25 bp, Mus musculus
agatgctgtggagacacgctcagga

SEQ ID NO: 161825 - DNA, 25 bp, Mus musculus
agatgcttaaacaggaaccttccgg

SEQ ID NO: 161826 - DNA, 25 bp, Mus musculus
agatgcttaaactggaaccttccgg

SEQ ID NO: 161827 - DNA, 25 bp, Mus musculus
agatgcttaaagacgagatgaacaa

SEQ ID NO: 161828 - DNA, 25 bp, Mus musculus
agatgcttaaagtcgagatgaacaa

SEQ ID NO: 161829 - DNA, 25 bp, Mus musculus
agatgcttaacccaagccactgttt

SEQ ID NO: 161830 - DNA, 25 bp, Mus musculus
agatgcttaaccgaagccactgttt

SEQ ID NO: 161831 - DNA, 25 bp, Mus musculus
agatgcttacatagataatcccaga

SEQ ID NO: 161832 - DNA, 25 bp, Mus musculus
agatgcttacatattctgctcctgg

SEQ ID NO: 161833 - DNA, 25 bp, Mus musculus
agatgcttacattgataatcccaga

SEQ ID NO: 161834 - DNA, 25 bp, Mus musculus
agatgcttacattttctgctcctgg

SEQ ID NO: 161835 - DNA, 25 bp, Mus musculus
agatgcttagatcagcctcctctat

SEQ ID NO: 161836 - DNA, 25 bp, Mus musculus
agatgcttagatgagcctcctctat

SEQ ID NO: 161837 - DNA, 25 bp, Mus musculus
agatgcttagctcctacagtcttgt

SEQ ID NO: 161838 - DNA, 25 bp, Mus musculus
agatgcttagctgctacagtcttgt

SEQ ID NO: 161839 - DNA, 25 bp, Mus musculus
agatgcttaggcagcttctgggtcg

SEQ ID NO: 161840 - DNA, 25 bp, Mus musculus
agatgcttaggctgcttctgggtcg

SEQ ID NO: 161841 - DNA, 25 bp, Mus musculus
agatgcttccacacaggctcacagc

SEQ ID NO: 161842 - DNA, 25 bp, Mus musculus
agatgcttccacacgaagaggtcaa

SEQ ID NO: 161843 - DNA, 25 bp, Mus musculus
agatgcttccactcaggctcacagc

SEQ ID NO: 161844 - DNA, 25 bp, Mus musculus
agatgcttccactcgaagaggtcaa

SEQ ID NO: 161845 - DNA, 25 bp, Mus musculus
agatgcttccatcccgtaagcaaga

SEQ ID NO: 161846 - DNA, 25 bp, Mus musculus
agatgcttccatgccgtaagcaaga

SEQ ID NO: 161847 - DNA, 25 bp, Mus musculus
agatgcttccccagtttgcaagtgt

SEQ ID NO: 161848 - DNA, 25 bp, Mus musculus
agatgcttcccctgtttgcaagtgt

SEQ ID NO: 161849 - DNA, 25 bp, Mus musculus
agatgcttccggatcttccgtgtga

SEQ ID NO: 161850 - DNA, 25 bp, Mus musculus
agatgcttccggttcttccgtgtga

SEQ ID NO: 161851 - DNA, 25 bp, Mus musculus
agatgcttcgtgagtcccgtggaat

SEQ ID NO: 161852 - DNA, 25 bp, Mus musculus
agatgcttcgtgtgtcccgtggaat

SEQ ID NO: 161853 - DNA, 25 bp, Mus musculus
agatgcttctaaccctgactgtcgt

SEQ ID NO: 161854 - DNA, 25 bp, Mus musculus
agatgcttctaagcctgactgtcgt

SEQ ID NO: 161855 - DNA, 25 bp, Mus musculus
agatgcttctgcacagaggaaaaca

SEQ ID NO: 161856 - DNA, 25 bp, Mus musculus
agatgcttctgctcagaggaaaaca

SEQ ID NO: 161857 - DNA, 25 bp, Mus musculus
agatgcttctggaatcaactgtttt

SEQ ID NO: 161858 - DNA, 25 bp, Mus musculus
agatgcttctggtatcaactgtttt

SEQ ID NO: 161859 - DNA, 25 bp, Mus musculus
agatgcttctgtccacagtctcaga

SEQ ID NO: 161860 - DNA, 25 bp, Mus musculus
agatgcttctgtgcacagtctcaga

SEQ ID NO: 161861 - DNA, 25 bp, Mus musculus
agatgcttgcctactcgatgctgag

SEQ ID NO: 161862 - DNA, 25 bp, Mus musculus
agatgcttgccttctcgatgctgag

SEQ ID NO: 161863 - DNA, 25 bp, Mus musculus
agatgcttggccacttactaagaag

SEQ ID NO: 161864 - DNA, 25 bp, Mus musculus
agatgcttggcctcttactaagaag

SEQ ID NO: 161865 - DNA, 25 bp, Mus musculus
agatgcttgggtatccactctggct

SEQ ID NO: 161866 - DNA, 25 bp, Mus musculus
agatgcttgggtttccactctggct

SEQ ID NO: 161867 - DNA, 25 bp, Mus musculus
agatgctttccacatctgccaaaag

SEQ ID NO: 161868 - DNA, 25 bp, Mus musculus
agatgctttccagatctgccaaaag

SEQ ID NO: 161869 - DNA, 25 bp, Mus musculus
agatgctttcccatgtacatgatcc

SEQ ID NO: 161870 - DNA, 25 bp, Mus musculus
agatgctttcccttgtacatgatcc

SEQ ID NO: 161871 - DNA, 25 bp, Mus musculus
agatgctttctcattgtccattgta

SEQ ID NO: 161872 - DNA, 25 bp, Mus musculus
agatgctttctctttgtccattgta

SEQ ID NO: 161873 - DNA, 25 bp, Mus musculus
agatgctttcttacatcgagccgct

SEQ ID NO: 161874 - DNA, 25 bp, Mus musculus
agatgctttctttcatcgagccgct

SEQ ID NO: 161875 - DNA, 25 bp, Mus musculus
agatgcttttctatccagccaaatt

SEQ ID NO: 161876 - DNA, 25 bp, Mus musculus
agatgcttttctttccagccaaatt

SEQ ID NO: 161877 - DNA, 25 bp, Mus musculus
agatgcttttgacttctcggaccat

SEQ ID NO: 161878 - DNA, 25 bp, Mus musculus
agatgcttttgagttctcggaccat

SEQ ID NO: 161879 - DNA, 25 bp, Mus musculus
agatgctttttgagtacctatcaac

SEQ ID NO: 161880 - DNA, 25 bp, Mus musculus
agatgctttttgtgtacctatcaac

SEQ ID NO: 161881 - DNA, 25 bp, Mus musculus
agatggaaaaggaccacctcaccct

SEQ ID NO: 161882 - DNA, 25 bp, Mus musculus
agatggaaaaggtccacctcaccct

SEQ ID NO: 161883 - DNA, 25 bp, Mus musculus
agatggaaacaaaccctcttctctc

SEQ ID NO: 161884 - DNA, 25 bp, Mus musculus
agatggaaacaatccctcttctctc

SEQ ID NO: 161885 - DNA, 25 bp, Mus musculus
agatggaacagccttctcctcatta

SEQ ID NO: 161886 - DNA, 25 bp, Mus musculus
agatggaacagcgttctcctcatta

SEQ ID NO: 161887 - DNA, 25 bp, Mus musculus
agatggaaccggaccaggtgtacga

SEQ ID NO: 161888 - DNA, 25 bp, Mus musculus
agatggaaccggtccaggtgtacga

SEQ ID NO: 161889 - DNA, 25 bp, Mus musculus
agatggaacctccaaaggaggtaag

SEQ ID NO: 161890 - DNA, 25 bp, Mus musculus
agatggaacctcgaaaggaggtaag

SEQ ID NO: 161891 - DNA, 25 bp, Mus musculus
agatggaactacatgcgctgtccac

SEQ ID NO: 161892 - DNA, 25 bp, Mus musculus
agatggaactacttgcgctgtccac

SEQ ID NO: 161893 - DNA, 25 bp, Mus musculus
agatggaactgaattctcccggcac

SEQ ID NO: 161894 - DNA, 25 bp, Mus musculus
agatggaactgatttctcccggcac

SEQ ID NO: 161895 - DNA, 25 bp, Mus musculus
agatggaactggcttgccctttgtc

SEQ ID NO: 161896 - DNA, 25 bp, Mus musculus
agatggaactgggttgccctttgtc

SEQ ID NO: 161897 - DNA, 25 bp, Mus musculus
agatggaactgtacgtgccacgttt

SEQ ID NO: 161898 - DNA, 25 bp, Mus musculus
agatggaactgttcgtgccacgttt

SEQ ID NO: 161899 - DNA, 25 bp, Mus musculus
agatggaagaatatcctttgaggaa

SEQ ID NO: 161900 - DNA, 25 bp, Mus musculus
agatggaagaatttcctttgaggaa

SEQ ID NO: 161901 - DNA, 25 bp, Mus musculus
agatggaagcacagccgggcaaact

SEQ ID NO: 161902 - DNA, 25 bp, Mus musculus
agatggaagcactgccgggcaaact

SEQ ID NO: 161903 - DNA, 25 bp, Mus musculus
agatggaagctacccgccacagagt

SEQ ID NO: 161904 - DNA, 25 bp, Mus musculus
agatggaagctagccgccacagagt

SEQ ID NO: 161905 - DNA, 25 bp, Mus musculus
agatggaaggccatgttctccctgg

SEQ ID NO: 161906 - DNA, 25 bp, Mus musculus
agatggaaggccttgttctccctgg

SEQ ID NO: 161907 - DNA, 25 bp, Mus musculus
agatggaagtcacgcctgtcggtca

SEQ ID NO: 161908 - DNA, 25 bp, Mus musculus
agatggaagtcaggcctgtcggtca

SEQ ID NO: 161909 - DNA, 25 bp, Mus musculus
agatggaagtccagtctactgtctc

SEQ ID NO: 161910 - DNA, 25 bp, Mus musculus
agatggaagtcctgtctactgtctc

SEQ ID NO: 161911 - DNA, 25 bp, Mus musculus
agatggaataaaccccttgaaccag

SEQ ID NO: 161912 - DNA, 25 bp, Mus musculus
agatggaataaagcccttgaaccag

SEQ ID NO: 161913 - DNA, 25 bp, Mus musculus
agatggaatgctcggcttctgcgcc

SEQ ID NO: 161914 - DNA, 25 bp, Mus musculus
agatggaatgctgggcttctgcgcc

SEQ ID NO: 161915 - DNA, 25 bp, Mus musculus
agatggaattccacccggctgcagt

SEQ ID NO: 161916 - DNA, 25 bp, Mus musculus
agatggaattcctcccggctgcagt

SEQ ID NO: 161917 - DNA, 25 bp, Mus musculus
agatggacaataccctcaagccgtg

SEQ ID NO: 161918 - DNA, 25 bp, Mus musculus
agatggacaatagcctcaagccgtg

SEQ ID NO: 161919 - DNA, 25 bp, Mus musculus
agatggacagcgacagcagacccac

SEQ ID NO: 161920 - DNA, 25 bp, Mus musculus
agatggacagcgtcagcagacccac

SEQ ID NO: 161921 - DNA, 25 bp, Mus musculus
agatggacagtgctgccagtgacct

SEQ ID NO: 161922 - DNA, 25 bp, Mus musculus
agatggacagtggtgccagtgacct

SEQ ID NO: 161923 - DNA, 25 bp, Mus musculus
agatggaccagaatggaactacagt

SEQ ID NO: 161924 - DNA, 25 bp, Mus musculus
agatggaccagattggaactacagt

SEQ ID NO: 161925 - DNA, 25 bp, Mus musculus
agatggaccagtaggctcggtgcat

SEQ ID NO: 161926 - DNA, 25 bp, Mus musculus
agatggaccagttggctcggtgcat

SEQ ID NO: 161927 - DNA, 25 bp, Mus musculus
agatggacccagagtcgtgagagca

SEQ ID NO: 161928 - DNA, 25 bp, Mus musculus
agatggacccagtgtcgtgagagca

SEQ ID NO: 161929 - DNA, 25 bp, Mus musculus
agatggaccgttacacagactgaga

SEQ ID NO: 161930 - DNA, 25 bp, Mus musculus
agatggaccgtttcacagactgaga

SEQ ID NO: 161931 - DNA, 25 bp, Mus musculus
agatggacctcgctctgagcagcga

SEQ ID NO: 161932 - DNA, 25 bp, Mus musculus
agatggacctcggtctgagcagcga

SEQ ID NO: 161933 - DNA, 25 bp, Mus musculus
agatggacctctagacattcagcga

SEQ ID NO: 161934 - DNA, 25 bp, Mus musculus
agatggacctcttgacattcagcga

SEQ ID NO: 161935 - DNA, 25 bp, Mus musculus
agatggacctgaagctgacttcctc

SEQ ID NO: 161936 - DNA, 25 bp, Mus musculus
agatggacctgatgctgacttcctc

SEQ ID NO: 161937 - DNA, 25 bp, Mus musculus
agatggacctggctctcataaccaa

SEQ ID NO: 161938 - DNA, 25 bp, Mus musculus
agatggacctgggtctcataaccaa

SEQ ID NO: 161939 - DNA, 25 bp, Mus musculus
agatggacgacacgaccaagagtgt

SEQ ID NO: 161940 - DNA, 25 bp, Mus musculus
agatggacgacaggaccaagagtgt

SEQ ID NO: 161941 - DNA, 25 bp, Mus musculus
agatggacgatgacctgcctgagag

SEQ ID NO: 161942 - DNA, 25 bp, Mus musculus
agatggacgatgtcctgcctgagag

SEQ ID NO: 161943 - DNA, 25 bp, Mus musculus
agatggacgcgacccacaagctgca

SEQ ID NO: 161944 - DNA, 25 bp, Mus musculus
agatggacgcgagccacaagctgca

SEQ ID NO: 161945 - DNA, 25 bp, Mus musculus
agatggacggacactgtttcctggc

SEQ ID NO: 161946 - DNA, 25 bp, Mus musculus
agatggacggactctgtttcctggc

SEQ ID NO: 161947 - DNA, 25 bp, Mus musculus
agatggacgtgcagaacgccttcaa

SEQ ID NO: 161948 - DNA, 25 bp, Mus musculus
agatggacgtgctgaacgccttcaa

SEQ ID NO: 161949 - DNA, 25 bp, Mus musculus
agatggactccaccccttcaggagg

SEQ ID NO: 161950 - DNA, 25 bp, Mus musculus
agatggactccagcccttcaggagg

SEQ ID NO: 161951 - DNA, 25 bp, Mus musculus
agatggactgagctggttgtattta

SEQ ID NO: 161952 - DNA, 25 bp, Mus musculus
agatggactgaggtggttgtattta

SEQ ID NO: 161953 - DNA, 25 bp, Mus musculus
agatggactgcaagggtatcccagg

SEQ ID NO: 161954 - DNA, 25 bp, Mus musculus
agatggactgcatgggtatcccagg

SEQ ID NO: 161955 - DNA, 25 bp, Mus musculus
agatggactggcacaactatttttt

SEQ ID NO: 161956 - DNA, 25 bp, Mus musculus
agatggactggctcaactatttttt

SEQ ID NO: 161957 - DNA, 25 bp, Mus musculus
agatggactgtgatgtgtggctttc

SEQ ID NO: 161958 - DNA, 25 bp, Mus musculus
agatggactgtgcactaacccctgc

SEQ ID NO: 161959 - DNA, 25 bp, Mus musculus
agatggactgtggactaacccctgc

SEQ ID NO: 161960 - DNA, 25 bp, Mus musculus
agatggactgtgttgtgtggctttc

SEQ ID NO: 161961 - DNA, 25 bp, Mus musculus
agatggacttctccgacctgtctag

SEQ ID NO: 161962 - DNA, 25 bp, Mus musculus
agatggacttctcgctattagcaca

SEQ ID NO: 161963 - DNA, 25 bp, Mus musculus
agatggacttctgcgacctgtctag

SEQ ID NO: 161964 - DNA, 25 bp, Mus musculus
agatggacttctggctattagcaca

SEQ ID NO: 161965 - DNA, 25 bp, Mus musculus
agatggagaccccagtttggctcct

SEQ ID NO: 161966 - DNA, 25 bp, Mus musculus
agatggagacccgagtttggctcct

SEQ ID NO: 161967 - DNA, 25 bp, Mus musculus
agatggagactgcttaggtgactat

SEQ ID NO: 161968 - DNA, 25 bp, Mus musculus
agatggagactggttaggtgactat

SEQ ID NO: 161969 - DNA, 25 bp, Mus musculus
agatggagagacctgcctacactta

SEQ ID NO: 161970 - DNA, 25 bp, Mus musculus
agatggagagacgtgcctacactta

SEQ ID NO: 161971 - DNA, 25 bp, Mus musculus
agatggagaggccacctacctgctc

SEQ ID NO: 161972 - DNA, 25 bp, Mus musculus
agatggagaggcgacctacctgctc

SEQ ID NO: 161973 - DNA, 25 bp, Mus musculus
agatggagagtgacccagttagtgt

SEQ ID NO: 161974 - DNA, 25 bp, Mus musculus
agatggagagtgtcccagttagtgt

SEQ ID NO: 161975 - DNA, 25 bp, Mus musculus
agatggagatgcactgcaggcctca

SEQ ID NO: 161976 - DNA, 25 bp, Mus musculus
agatggagatgctctgcaggcctca

SEQ ID NO: 161977 - DNA, 25 bp, Mus musculus
agatggagcagacctccggcttttt

SEQ ID NO: 161978 - DNA, 25 bp, Mus musculus
agatggagcagagctccggcttttt

SEQ ID NO: 161979 - DNA, 25 bp, Mus musculus
agatggagccagaagcgcagtcgtt

SEQ ID NO: 161980 - DNA, 25 bp, Mus musculus
agatggagccagtagcgcagtcgtt

SEQ ID NO: 161981 - DNA, 25 bp, Mus musculus
agatggagcccaccgcggacttgcc

SEQ ID NO: 161982 - DNA, 25 bp, Mus musculus
agatggagcccagcgcggacttgcc

SEQ ID NO: 161983 - DNA, 25 bp, Mus musculus
agatggagccccagaataacctgca

SEQ ID NO: 161984 - DNA, 25 bp, Mus musculus
agatggagcccctgaataacctgca

SEQ ID NO: 161985 - DNA, 25 bp, Mus musculus
agatggagctccagtgtgcccaggc

SEQ ID NO: 161986 - DNA, 25 bp, Mus musculus
agatggagctcctgtgtgcccaggc

SEQ ID NO: 161987 - DNA, 25 bp, Mus musculus
agatggagctgaactactcccgggc

SEQ ID NO: 161988 - DNA, 25 bp, Mus musculus
agatggagctgatctactcccgggc

SEQ ID NO: 161989 - DNA, 25 bp, Mus musculus
agatggagctggctatggtaacaca

SEQ ID NO: 161990 - DNA, 25 bp, Mus musculus
agatggagctgggtatggtaacaca

SEQ ID NO: 161991 - DNA, 25 bp, Mus musculus
agatggagcttgagtctgagcacca

SEQ ID NO: 161992 - DNA, 25 bp, Mus musculus
agatggagcttgtgtctgagcacca

SEQ ID NO: 161993 - DNA, 25 bp, Mus musculus
agatggagctttcggcatctggaaa

SEQ ID NO: 161994 - DNA, 25 bp, Mus musculus
agatggagctttgggcatctggaaa

SEQ ID NO: 161995 - DNA, 25 bp, Mus musculus
agatggaggacccaaactattggaa

SEQ ID NO: 161996 - DNA, 25 bp, Mus musculus
agatggaggaccgaaactattggaa

SEQ ID NO: 161997 - DNA, 25 bp, Mus musculus
agatggaggctgatgcccgctctat

SEQ ID NO: 161998 - DNA, 25 bp, Mus musculus
agatggaggctgttgcccgctctat

SEQ ID NO: 161999 - DNA, 25 bp, Mus musculus
agatggagggacacccgacattggc

SEQ ID NO: 162000 - DNA, 25 bp, Mus musculus
agatggagggactcccgacattggc

SEQ ID NO: 162001 - DNA, 25 bp, Mus musculus
agatggagggccaggacaaccacac

SEQ ID NO: 162002 - DNA, 25 bp, Mus musculus
agatggagggcctggacaaccacac

SEQ ID NO: 162003 - DNA, 25 bp, Mus musculus
agatggagggttctgctttgtctct

SEQ ID NO: 162004 - DNA, 25 bp, Mus musculus
agatggagggttgtgctttgtctct

SEQ ID NO: 162005 - DNA, 25 bp, Mus musculus
agatggaggtagaccagcttaagaa

SEQ ID NO: 162006 - DNA, 25 bp, Mus musculus
agatggaggtagtccagcttaagaa

SEQ ID NO: 162007 - DNA, 25 bp, Mus musculus
agatggaggtccactaagcttttga

SEQ ID NO: 162008 - DNA, 25 bp, Mus musculus
agatggaggtcctctaagcttttga

SEQ ID NO: 162009 - DNA, 25 bp, Mus musculus
agatggaggtgtccaaactgccccg

SEQ ID NO: 162010 - DNA, 25 bp, Mus musculus
agatggaggtgtctttcctcctgta

SEQ ID NO: 162011 - DNA, 25 bp, Mus musculus
agatggaggtgtgcaaactgccccg

SEQ ID NO: 162012 - DNA, 25 bp, Mus musculus
agatggaggtgtgtttcctcctgta

SEQ ID NO: 162013 - DNA, 25 bp, Mus musculus
agatggagtactcatggctatccca

SEQ ID NO: 162014 - DNA, 25 bp, Mus musculus
agatggagtactgatggctatccca

SEQ ID NO: 162015 - DNA, 25 bp, Mus musculus
agatggagtgacatctccctgggaa

SEQ ID NO: 162016 - DNA, 25 bp, Mus musculus
agatggagtgacttctccctgggaa

SEQ ID NO: 162017 - DNA, 25 bp, Mus musculus
agatggagtgtgcttgcctgtcaca

SEQ ID NO: 162018 - DNA, 25 bp, Mus musculus
agatggagtgtggttgcctgtcaca

SEQ ID NO: 162019 - DNA, 25 bp, Mus musculus
agatggagtttcctttggctctgac

SEQ ID NO: 162020 - DNA, 25 bp, Mus musculus
agatggagtttcgtttggctctgac

SEQ ID NO: 162021 - DNA, 25 bp, Mus musculus
agatggagttttccctcaagcacag

SEQ ID NO: 162022 - DNA, 25 bp, Mus musculus
agatggagttttgcctcaagcacag

SEQ ID NO: 162023 - DNA, 25 bp, Mus musculus
agatggatccctaaactctgtgttc

SEQ ID NO: 162024 - DNA, 25 bp, Mus musculus
agatggatcccttaactctgtgttc

SEQ ID NO: 162025 - DNA, 25 bp, Mus musculus
agatggatccttcaaccataccttg

SEQ ID NO: 162026 - DNA, 25 bp, Mus musculus
agatggatccttgaaccataccttg

SEQ ID NO: 162027 - DNA, 25 bp, Mus musculus
agatggatctctctggcattgggat

SEQ ID NO: 162028 - DNA, 25 bp, Mus musculus
agatggatctctgtggcattgggat

SEQ ID NO: 162029 - DNA, 25 bp, Mus musculus
agatggatctttcttcctcctaggc

SEQ ID NO: 162030 - DNA, 25 bp, Mus musculus
agatggatctttgttcctcctaggc

SEQ ID NO: 162031 - DNA, 25 bp, Mus musculus
agatggatgagcctgctgcttgctt

SEQ ID NO: 162032 - DNA, 25 bp, Mus musculus
agatggatgagcgtgctgcttgctt

SEQ ID NO: 162033 - DNA, 25 bp, Mus musculus
agatggatgcaacccctataggcgt

SEQ ID NO: 162034 - DNA, 25 bp, Mus musculus
agatggatgcaagccctataggcgt

SEQ ID NO: 162035 - DNA, 25 bp, Mus musculus
agatggatgccaaacaggccaagga

SEQ ID NO: 162036 - DNA, 25 bp, Mus musculus
agatggatgccatacaggccaagga

SEQ ID NO: 162037 - DNA, 25 bp, Mus musculus
agatggatgctaacccgaaaagagg

SEQ ID NO: 162038 - DNA, 25 bp, Mus musculus
agatggatgctatcccgaaaagagg

SEQ ID NO: 162039 - DNA, 25 bp, Mus musculus
agatggatgcttctgctcaacccaa

SEQ ID NO: 162040 - DNA, 25 bp, Mus musculus
agatggatgcttgtgctcaacccaa

SEQ ID NO: 162041 - DNA, 25 bp, Mus musculus
agatggatggctaagcacgctcgga

SEQ ID NO: 162042 - DNA, 25 bp, Mus musculus
agatggatggcttagcacgctcgga

SEQ ID NO: 162043 - DNA, 25 bp, Mus musculus
agatggatgtcaaattgtgccacca

SEQ ID NO: 162044 - DNA, 25 bp, Mus musculus
agatggatgtcatattgtgccacca

SEQ ID NO: 162045 - DNA, 25 bp, Mus musculus
agatggatgtgccaaacgtcctcac

SEQ ID NO: 162046 - DNA, 25 bp, Mus musculus
agatggatgtgcgaaacgtcctcac

SEQ ID NO: 162047 - DNA, 25 bp, Mus musculus
agatggatgttaagtcaagtcagga

SEQ ID NO: 162048 - DNA, 25 bp, Mus musculus
agatggatgttatgtcaagtcagga

SEQ ID NO: 162049 - DNA, 25 bp, Mus musculus
agatggattatcagctcaacagcaa

SEQ ID NO: 162050 - DNA, 25 bp, Mus musculus
agatggattatctgctcaacagcaa

SEQ ID NO: 162051 - DNA, 25 bp, Mus musculus
agatggattccaaactgcaccctgt

SEQ ID NO: 162052 - DNA, 25 bp, Mus musculus
agatggattccatactgcaccctgt

SEQ ID NO: 162053 - DNA, 25 bp, Mus musculus
agatggatttctcagctcttagctg

SEQ ID NO: 162054 - DNA, 25 bp, Mus musculus
agatggatttctgagctcttagctg

SEQ ID NO: 162055 - DNA, 25 bp, Mus musculus
agatggcaaaaacggcacctcccct

SEQ ID NO: 162056 - DNA, 25 bp, Mus musculus
agatggcaaaaagggcacctcccct

SEQ ID NO: 162057 - DNA, 25 bp, Mus musculus
agatggcaaagtcggcttccagagc

SEQ ID NO: 162058 - DNA, 25 bp, Mus musculus
agatggcaaagtgggcttccagagc

SEQ ID NO: 162059 - DNA, 25 bp, Mus musculus
agatggcaaattcctttcctgtttt

SEQ ID NO: 162060 - DNA, 25 bp, Mus musculus
agatggcaaattgctttcctgtttt

SEQ ID NO: 162061 - DNA, 25 bp, Mus musculus
agatggcaacctccacgtgacccag

SEQ ID NO: 162062 - DNA, 25 bp, Mus musculus
agatggcaacctgcacgtgacccag

SEQ ID NO: 162063 - DNA, 25 bp, Mus musculus
agatggcaagcgactttacgccact

SEQ ID NO: 162064 - DNA, 25 bp, Mus musculus
agatggcaagcgtctttacgccact

SEQ ID NO: 162065 - DNA, 25 bp, Mus musculus
agatggcaaggtacctttgcctctg

SEQ ID NO: 162066 - DNA, 25 bp, Mus musculus
agatggcaaggttcctttgcctctg

SEQ ID NO: 162067 - DNA, 25 bp, Mus musculus
agatggcacaccatagcgcctatgg

SEQ ID NO: 162068 - DNA, 25 bp, Mus musculus
agatggcacaccttagcgcctatgg

SEQ ID NO: 162069 - DNA, 25 bp, Mus musculus
agatggcacagcctccacagcaaag

SEQ ID NO: 162070 - DNA, 25 bp, Mus musculus
agatggcacagcgtccacagcaaag

SEQ ID NO: 162071 - DNA, 25 bp, Mus musculus
agatggcacaggagctctgaccaga

SEQ ID NO: 162072 - DNA, 25 bp, Mus musculus
agatggcacaggtgctctgaccaga

SEQ ID NO: 162073 - DNA, 25 bp, Mus musculus
agatggcacctgaggcagcgatcct

SEQ ID NO: 162074 - DNA, 25 bp, Mus musculus
agatggcacctgtggcagcgatcct

SEQ ID NO: 162075 - DNA, 25 bp, Mus musculus
agatggcagctccttgcagagcaag

SEQ ID NO: 162076 - DNA, 25 bp, Mus musculus
agatggcagctcgttgcagagcaag

SEQ ID NO: 162077 - DNA, 25 bp, Mus musculus
agatggcagcttccagatggcgctt

SEQ ID NO: 162078 - DNA, 25 bp, Mus musculus
agatggcagcttctctgccagcgag

SEQ ID NO: 162079 - DNA, 25 bp, Mus musculus
agatggcagcttgcagatggcgctt

SEQ ID NO: 162080 - DNA, 25 bp, Mus musculus
agatggcagcttgtctgccagcgag

SEQ ID NO: 162081 - DNA, 25 bp, Mus musculus
agatggcagtccagagccgagtcca

SEQ ID NO: 162082 - DNA, 25 bp, Mus musculus
agatggcagtcctgagccgagtcca

SEQ ID NO: 162083 - DNA, 25 bp, Mus musculus
agatggcagtgtcccagacgctcag

SEQ ID NO: 162084 - DNA, 25 bp, Mus musculus
agatggcagtgtgccagacgctcag

SEQ ID NO: 162085 - DNA, 25 bp, Mus musculus
agatggcagtttatcctcagcttct

SEQ ID NO: 162086 - DNA, 25 bp, Mus musculus
agatggcagtttttcctcagcttct

SEQ ID NO: 162087 - DNA, 25 bp, Mus musculus
agatggcatcacaagtgtttgtagt

SEQ ID NO: 162088 - DNA, 25 bp, Mus musculus
agatggcatcactagtgtttgtagt

SEQ ID NO: 162089 - DNA, 25 bp, Mus musculus
agatggcatccaccgccgcaggcgt

SEQ ID NO: 162090 - DNA, 25 bp, Mus musculus
agatggcatccagcgccgcaggcgt

SEQ ID NO: 162091 - DNA, 25 bp, Mus musculus
agatggcatcggagcatggtccaca

SEQ ID NO: 162092 - DNA, 25 bp, Mus musculus
agatggcatcggtgcatggtccaca

SEQ ID NO: 162093 - DNA, 25 bp, Mus musculus
agatggcatcgtcgctcagcagaga

SEQ ID NO: 162094 - DNA, 25 bp, Mus musculus
agatggcatcgtggctcagcagaga

SEQ ID NO: 162095 - DNA, 25 bp, Mus musculus
agatggcatgatagcccatccaagc

SEQ ID NO: 162096 - DNA, 25 bp, Mus musculus
agatggcatgattgcccatccaagc

SEQ ID NO: 162097 - DNA, 25 bp, Mus musculus
agatggcatgctaacttataattat

SEQ ID NO: 162098 - DNA, 25 bp, Mus musculus
agatggcatgcttacttataattat

SEQ ID NO: 162099 - DNA, 25 bp, Mus musculus
agatggcatgtaagagtgtctttca

SEQ ID NO: 162100 - DNA, 25 bp, Mus musculus
agatggcatgtatgagtgtctttca

SEQ ID NO: 162101 - DNA, 25 bp, Mus musculus
agatggcatgttcggagcctctcct

SEQ ID NO: 162102 - DNA, 25 bp, Mus musculus
agatggcatgttctgaaggttcaag

SEQ ID NO: 162103 - DNA, 25 bp, Mus musculus
agatggcatgttgggagcctctcct

SEQ ID NO: 162104 - DNA, 25 bp, Mus musculus
agatggcatgttgtgaaggttcaag

SEQ ID NO: 162105 - DNA, 25 bp, Mus musculus
agatggccacatcgaagaagacctg

SEQ ID NO: 162106 - DNA, 25 bp, Mus musculus
agatggccacatggaagaagacctg

SEQ ID NO: 162107 - DNA, 25 bp, Mus musculus
agatggccaccaagatcgacgtgaa

SEQ ID NO: 162108 - DNA, 25 bp, Mus musculus
agatggccaccatgatcgacgtgaa

SEQ ID NO: 162109 - DNA, 25 bp, Mus musculus
agatggccacccactcaaggctttt

SEQ ID NO: 162110 - DNA, 25 bp, Mus musculus
agatggccaccctctcaaggctttt

SEQ ID NO: 162111 - DNA, 25 bp, Mus musculus
agatggccagcaatgaagtttcgaa

SEQ ID NO: 162112 - DNA, 25 bp, Mus musculus
agatggccagcattgaagtttcgaa

SEQ ID NO: 162113 - DNA, 25 bp, Mus musculus
agatggccagccagacacattagac

SEQ ID NO: 162114 - DNA, 25 bp, Mus musculus
agatggccagcctgacacattagac

SEQ ID NO: 162115 - DNA, 25 bp, Mus musculus
agatggccagtacttgggctgacat

SEQ ID NO: 162116 - DNA, 25 bp, Mus musculus
agatggccagtagttgggctgacat

SEQ ID NO: 162117 - DNA, 25 bp, Mus musculus
agatggccagtcagagggagcatca

SEQ ID NO: 162118 - DNA, 25 bp, Mus musculus
agatggccagtctgagggagcatca

SEQ ID NO: 162119 - DNA, 25 bp, Mus musculus
agatggccattcatggaataactga

SEQ ID NO: 162120 - DNA, 25 bp, Mus musculus
agatggccattcttggaataactga

SEQ ID NO: 162121 - DNA, 25 bp, Mus musculus
agatggccatttacccttgcacagg

SEQ ID NO: 162122 - DNA, 25 bp, Mus musculus
agatggccattttcccttgcacagg

SEQ ID NO: 162123 - DNA, 25 bp, Mus musculus
agatggcccaagatcttgtaaacaa

SEQ ID NO: 162124 - DNA, 25 bp, Mus musculus
agatggcccaagttcttgtaaacaa

SEQ ID NO: 162125 - DNA, 25 bp, Mus musculus
agatggcccactcgagtaacaagta

SEQ ID NO: 162126 - DNA, 25 bp, Mus musculus
agatggcccactggagtaacaagta

SEQ ID NO: 162127 - DNA, 25 bp, Mus musculus
agatggcccaggcttaggatgctct

SEQ ID NO: 162128 - DNA, 25 bp, Mus musculus
agatggcccagggttaggatgctct

SEQ ID NO: 162129 - DNA, 25 bp, Mus musculus
agatggccccggactgtctaagaaa

SEQ ID NO: 162130 - DNA, 25 bp, Mus musculus
agatggccccggtctgtctaagaaa

SEQ ID NO: 162131 - DNA, 25 bp, Mus musculus
agatggcccctgatcgatttttatt

SEQ ID NO: 162132 - DNA, 25 bp, Mus musculus
agatggcccctgttcgatttttatt

SEQ ID NO: 162133 - DNA, 25 bp, Mus musculus
agatggccccttatcagagcaataa

SEQ ID NO: 162134 - DNA, 25 bp, Mus musculus
agatggccccttttcagagcaataa

SEQ ID NO: 162135 - DNA, 25 bp, Mus musculus
agatggcccggaacggtaagctgat

SEQ ID NO: 162136 - DNA, 25 bp, Mus musculus
agatggcccggatcggtaagctgat

SEQ ID NO: 162137 - DNA, 25 bp, Mus musculus
agatggcccgtacaggtggcacaca

SEQ ID NO: 162138 - DNA, 25 bp, Mus musculus
agatggcccgtagaggtggcacaca

SEQ ID NO: 162139 - DNA, 25 bp, Mus musculus
agatggccgactcccagaagtcagc

SEQ ID NO: 162140 - DNA, 25 bp, Mus musculus
agatggccgactgccagaagtcagc

SEQ ID NO: 162141 - DNA, 25 bp, Mus musculus
agatggccgcaccctctctgattac

SEQ ID NO: 162142 - DNA, 25 bp, Mus musculus
agatggccgcacgctctctgattac

SEQ ID NO: 162143 - DNA, 25 bp, Mus musculus
agatggccgccactgtgtctggact

SEQ ID NO: 162144 - DNA, 25 bp, Mus musculus
agatggccgccagtgtgtctggact

SEQ ID NO: 162145 - DNA, 25 bp, Mus musculus
agatggccgcgtctctactgctgag

SEQ ID NO: 162146 - DNA, 25 bp, Mus musculus
agatggccgcgtgtctactgctgag

SEQ ID NO: 162147 - DNA, 25 bp, Mus musculus
agatggccggctaaatggccttccc

SEQ ID NO: 162148 - DNA, 25 bp, Mus musculus
agatggccggcttaatggccttccc

SEQ ID NO: 162149 - DNA, 25 bp, Mus musculus
agatggccgtctctggtgcctaatc

SEQ ID NO: 162150 - DNA, 25 bp, Mus musculus
agatggccgtctgtggtgcctaatc

SEQ ID NO: 162151 - DNA, 25 bp, Mus musculus
agatggccgtggactgttggatccc

SEQ ID NO: 162152 - DNA, 25 bp, Mus musculus
agatggccgtggtctgttggatccc

SEQ ID NO: 162153 - DNA, 25 bp, Mus musculus
agatggcctcccagggtggcatcaa

SEQ ID NO: 162154 - DNA, 25 bp, Mus musculus
agatggcctccctgggtggcatcaa

SEQ ID NO: 162155 - DNA, 25 bp, Mus musculus
agatggcctctaagtccaactttag

SEQ ID NO: 162156 - DNA, 25 bp, Mus musculus
agatggcctctatgtccaactttag

SEQ ID NO: 162157 - DNA, 25 bp, Mus musculus
agatggcctctgattttatttacag

SEQ ID NO: 162158 - DNA, 25 bp, Mus musculus
agatggcctctgctctccactgaga

SEQ ID NO: 162159 - DNA, 25 bp, Mus musculus
agatggcctctggtctccactgaga

SEQ ID NO: 162160 - DNA, 25 bp, Mus musculus
agatggcctctgtttttatttacag

SEQ ID NO: 162161 - DNA, 25 bp, Mus musculus
agatggcctgacctgctgccaaaaa

SEQ ID NO: 162162 - DNA, 25 bp, Mus musculus
agatggcctgacgtgctgccaaaaa

SEQ ID NO: 162163 - DNA, 25 bp, Mus musculus
agatggcctggcagtttgcacctga

SEQ ID NO: 162164 - DNA, 25 bp, Mus musculus
agatggcctggctgtttgcacctga

SEQ ID NO: 162165 - DNA, 25 bp, Mus musculus
agatggcctgttatagaacgttagt

SEQ ID NO: 162166 - DNA, 25 bp, Mus musculus
agatggcctgttttagaacgttagt

SEQ ID NO: 162167 - DNA, 25 bp, Mus musculus
agatggccttacatgggattggagt

SEQ ID NO: 162168 - DNA, 25 bp, Mus musculus
agatggccttacttgggattggagt

SEQ ID NO: 162169 - DNA, 25 bp, Mus musculus
agatggccttgaatgcccctcaaag

SEQ ID NO: 162170 - DNA, 25 bp, Mus musculus
agatggccttgattgcccctcaaag

SEQ ID NO: 162171 - DNA, 25 bp, Mus musculus
agatggcctttcagccaccatgaaa

SEQ ID NO: 162172 - DNA, 25 bp, Mus musculus
agatggcctttctgccaccatgaaa

SEQ ID NO: 162173 - DNA, 25 bp, Mus musculus
agatggcgaccaatactctgatctt

SEQ ID NO: 162174 - DNA, 25 bp, Mus musculus
agatggcgaccattactctgatctt

SEQ ID NO: 162175 - DNA, 25 bp, Mus musculus
agatggcgacccacatcattgacac

SEQ ID NO: 162176 - DNA, 25 bp, Mus musculus
agatggcgaccctcatcattgacac

SEQ ID NO: 162177 - DNA, 25 bp, Mus musculus
agatggcgcaagactcattcctcca

SEQ ID NO: 162178 - DNA, 25 bp, Mus musculus
agatggcgcaagtctcattcctcca

SEQ ID NO: 162179 - DNA, 25 bp, Mus musculus
agatggcgccagatccaaggaaaaa

SEQ ID NO: 162180 - DNA, 25 bp, Mus musculus
agatggcgccagttccaaggaaaaa

SEQ ID NO: 162181 - DNA, 25 bp, Mus musculus
agatggcgcccgagagctgaactga

SEQ ID NO: 162182 - DNA, 25 bp, Mus musculus
agatggcgcccgtgagctgaactga

SEQ ID NO: 162183 - DNA, 25 bp, Mus musculus
agatggcgctggagcttgctgccct

SEQ ID NO: 162184 - DNA, 25 bp, Mus musculus
agatggcgctggtgcttgctgccct

SEQ ID NO: 162185 - DNA, 25 bp, Mus musculus
agatggcggctgaactatctggtac

SEQ ID NO: 162186 - DNA, 25 bp, Mus musculus
agatggcggctgtactatctggtac

SEQ ID NO: 162187 - DNA, 25 bp, Mus musculus
agatggcgtcacacgtgccgctgaa

SEQ ID NO: 162188 - DNA, 25 bp, Mus musculus
agatggcgtcactcgtgccgctgaa

SEQ ID NO: 162189 - DNA, 25 bp, Mus musculus
agatggcgttccaagtggccttgct

SEQ ID NO: 162190 - DNA, 25 bp, Mus musculus
agatggcgttcctagtggccttgct

SEQ ID NO: 162191 - DNA, 25 bp, Mus musculus
agatggctaattagggcttcctgat

SEQ ID NO: 162192 - DNA, 25 bp, Mus musculus
agatggctaatttgggcttcctgat

SEQ ID NO: 162193 - DNA, 25 bp, Mus musculus
agatggctactaccggaagatgcag

SEQ ID NO: 162194 - DNA, 25 bp, Mus musculus
agatggctactagcggaagatgcag

SEQ ID NO: 162195 - DNA, 25 bp, Mus musculus
agatggctactcactcctgactggt

SEQ ID NO: 162196 - DNA, 25 bp, Mus musculus
agatggctactctctcctgactggt

SEQ ID NO: 162197 - DNA, 25 bp, Mus musculus
agatggctagggattctgtcttgca

SEQ ID NO: 162198 - DNA, 25 bp, Mus musculus
agatggctagggtttctgtcttgca

SEQ ID NO: 162199 - DNA, 25 bp, Mus musculus
agatggctatatcggcagcacctca

SEQ ID NO: 162200 - DNA, 25 bp, Mus musculus
agatggctatatgggcagcacctca

SEQ ID NO: 162201 - DNA, 25 bp, Mus musculus
agatggctatcaacttctttcaata

SEQ ID NO: 162202 - DNA, 25 bp, Mus musculus
agatggctatcatcttctttcaata

SEQ ID NO: 162203 - DNA, 25 bp, Mus musculus
agatggctatcgatgctggcatgct

SEQ ID NO: 162204 - DNA, 25 bp, Mus musculus
agatggctatcgttgctggcatgct

SEQ ID NO: 162205 - DNA, 25 bp, Mus musculus
agatggctatttacctagtttcctt

SEQ ID NO: 162206 - DNA, 25 bp, Mus musculus
agatggctattttcctagtttcctt

SEQ ID NO: 162207 - DNA, 25 bp, Mus musculus
agatggctcacaagtttcccacaaa

SEQ ID NO: 162208 - DNA, 25 bp, Mus musculus
agatggctcacaccggtattcacag

SEQ ID NO: 162209 - DNA, 25 bp, Mus musculus
agatggctcacagcggtattcacag

SEQ ID NO: 162210 - DNA, 25 bp, Mus musculus
agatggctcacatgtttcccacaaa

SEQ ID NO: 162211 - DNA, 25 bp, Mus musculus
agatggctcaccatgcgcctaaaca

SEQ ID NO: 162212 - DNA, 25 bp, Mus musculus
agatggctcaccttgcgcctaaaca

SEQ ID NO: 162213 - DNA, 25 bp, Mus musculus
agatggctccaaagaggtgctcccc

SEQ ID NO: 162214 - DNA, 25 bp, Mus musculus
agatggctccaatgaggtgctcccc

SEQ ID NO: 162215 - DNA, 25 bp, Mus musculus
agatggctccatatgctgcagtgtg

SEQ ID NO: 162216 - DNA, 25 bp, Mus musculus
agatggctccatttgctgcagtgtg

SEQ ID NO: 162217 - DNA, 25 bp, Mus musculus
agatggctcctcacactgggaatag

SEQ ID NO: 162218 - DNA, 25 bp, Mus musculus
agatggctcctctcactgggaatag

SEQ ID NO: 162219 - DNA, 25 bp, Mus musculus
agatggctcgagagagttgcccagt

SEQ ID NO: 162220 - DNA, 25 bp, Mus musculus
agatggctcgagtgagttgcccagt

SEQ ID NO: 162221 - DNA, 25 bp, Mus musculus
agatggctcgtgcttactgtacata

SEQ ID NO: 162222 - DNA, 25 bp, Mus musculus
agatggctcgtggttactgtacata

SEQ ID NO: 162223 - DNA, 25 bp, Mus musculus
agatggctctccaggcttcagtaag

SEQ ID NO: 162224 - DNA, 25 bp, Mus musculus
agatggctctcctggcttcagtaag

SEQ ID NO: 162225 - DNA, 25 bp, Mus musculus
agatggctctggacagtctgagtgc

SEQ ID NO: 162226 - DNA, 25 bp, Mus musculus
agatggctctggtcagtctgagtgc

SEQ ID NO: 162227 - DNA, 25 bp, Mus musculus
agatggctctttcacactctgagaa

SEQ ID NO: 162228 - DNA, 25 bp, Mus musculus
agatggctctttgacactctgagaa

SEQ ID NO: 162229 - DNA, 25 bp, Mus musculus
agatggctgaagatccactttcctg

SEQ ID NO: 162230 - DNA, 25 bp, Mus musculus
agatggctgaagttccactttcctg

SEQ ID NO: 162231 - DNA, 25 bp, Mus musculus
agatggctgaggacgcccaacgcgt

SEQ ID NO: 162232 - DNA, 25 bp, Mus musculus
agatggctgaggactacccgcgata

SEQ ID NO: 162233 - DNA, 25 bp, Mus musculus
agatggctgaggtcgcccaacgcgt

SEQ ID NO: 162234 - DNA, 25 bp, Mus musculus
agatggctgaggtctacccgcgata

SEQ ID NO: 162235 - DNA, 25 bp, Mus musculus
agatggctgcctctcgcagtaaaca

SEQ ID NO: 162236 - DNA, 25 bp, Mus musculus
agatggctgcctgtcgcagtaaaca

SEQ ID NO: 162237 - DNA, 25 bp, Mus musculus
agatggctgctaacgtgctgctgtg

SEQ ID NO: 162238 - DNA, 25 bp, Mus musculus
agatggctgctatcgtgctgctgtg

SEQ ID NO: 162239 - DNA, 25 bp, Mus musculus
agatggctggccctgagaatcacga

SEQ ID NO: 162240 - DNA, 25 bp, Mus musculus
agatggctggccgtgagaatcacga

SEQ ID NO: 162241 - DNA, 25 bp, Mus musculus
agatggctggtaatcctcctgcttc

SEQ ID NO: 162242 - DNA, 25 bp, Mus musculus
agatggctggtattcctcctgcttc

SEQ ID NO: 162243 - DNA, 25 bp, Mus musculus
agatggctgtacctacctgaagtct

SEQ ID NO: 162244 - DNA, 25 bp, Mus musculus
agatggctgtacgtacctgaagtct

SEQ ID NO: 162245 - DNA, 25 bp, Mus musculus
agatggctgttaactggctcttgcc

SEQ ID NO: 162246 - DNA, 25 bp, Mus musculus
agatggctgttatctggctcttgcc

SEQ ID NO: 162247 - DNA, 25 bp, Mus musculus
agatggcttaatatgagttcctcgg

SEQ ID NO: 162248 - DNA, 25 bp, Mus musculus
agatggcttaatttgagttcctcgg

SEQ ID NO: 162249 - DNA, 25 bp, Mus musculus
agatggcttccaagttcttcaataa

SEQ ID NO: 162250 - DNA, 25 bp, Mus musculus
agatggcttccatgttcttcaataa

SEQ ID NO: 162251 - DNA, 25 bp, Mus musculus
agatggcttgctagagcagcctact

SEQ ID NO: 162252 - DNA, 25 bp, Mus musculus
agatggcttgcttgagcagcctact

SEQ ID NO: 162253 - DNA, 25 bp, Mus musculus
agatggcttgtgaagacttggaatg

SEQ ID NO: 162254 - DNA, 25 bp, Mus musculus
agatggcttgtgtagacttggaatg

SEQ ID NO: 162255 - DNA, 25 bp, Mus musculus
agatggctttcaactctgtttgtat

SEQ ID NO: 162256 - DNA, 25 bp, Mus musculus
agatggctttcatctctgtttgtat

SEQ ID NO: 162257 - DNA, 25 bp, Mus musculus
agatggcttttgagttaccccaggg

SEQ ID NO: 162258 - DNA, 25 bp, Mus musculus
agatggcttttgtgttaccccaggg

SEQ ID NO: 162259 - DNA, 25 bp, Mus musculus
agatgggaaaatccccaaggctgga

SEQ ID NO: 162260 - DNA, 25 bp, Mus musculus
agatgggaaaatgcccaaggctgga

SEQ ID NO: 162261 - DNA, 25 bp, Mus musculus
agatgggacacacttgctgtctcac

SEQ ID NO: 162262 - DNA, 25 bp, Mus musculus
agatgggacacagttgctgtctcac

SEQ ID NO: 162263 - DNA, 25 bp, Mus musculus
agatgggacccaattttctgtgcat

SEQ ID NO: 162264 - DNA, 25 bp, Mus musculus
agatgggacccatttttctgtgcat

SEQ ID NO: 162265 - DNA, 25 bp, Mus musculus
agatgggacctcatcccttcaaaaa

SEQ ID NO: 162266 - DNA, 25 bp, Mus musculus
agatgggacctcttcccttcaaaaa

SEQ ID NO: 162267 - DNA, 25 bp, Mus musculus
agatgggacctgcatatctcctttt

SEQ ID NO: 162268 - DNA, 25 bp, Mus musculus
agatgggacctggatatctcctttt

SEQ ID NO: 162269 - DNA, 25 bp, Mus musculus
agatgggactctagtatgtgtgcgt

SEQ ID NO: 162270 - DNA, 25 bp, Mus musculus
agatgggactcttgtatgtgtgcgt

SEQ ID NO: 162271 - DNA, 25 bp, Mus musculus
agatgggagcgcagattaactttca

SEQ ID NO: 162272 - DNA, 25 bp, Mus musculus
agatgggagcgctgattaactttca

SEQ ID NO: 162273 - DNA, 25 bp, Mus musculus
agatgggagggtactcctctgtctc

SEQ ID NO: 162274 - DNA, 25 bp, Mus musculus
agatgggagggttctcctctgtctc

SEQ ID NO: 162275 - DNA, 25 bp, Mus musculus
agatgggataaaccaacctctctcc

SEQ ID NO: 162276 - DNA, 25 bp, Mus musculus
agatgggataaagcaacctctctcc

SEQ ID NO: 162277 - DNA, 25 bp, Mus musculus
agatgggatccccttcagtgcgatg

SEQ ID NO: 162278 - DNA, 25 bp, Mus musculus
agatgggatcccgttcagtgcgatg

SEQ ID NO: 162279 - DNA, 25 bp, Mus musculus
agatgggatgctctgtttctctcat

SEQ ID NO: 162280 - DNA, 25 bp, Mus musculus
agatgggatgctgtgtttctctcat

SEQ ID NO: 162281 - DNA, 25 bp, Mus musculus
agatgggattagattccctgaatct

SEQ ID NO: 162282 - DNA, 25 bp, Mus musculus
agatgggattagtttccctgaatct

SEQ ID NO: 162283 - DNA, 25 bp, Mus musculus
agatgggcaactctacctgactggt

SEQ ID NO: 162284 - DNA, 25 bp, Mus musculus
agatgggcaactgtacctgactggt

SEQ ID NO: 162285 - DNA, 25 bp, Mus musculus
agatgggcaagtccaaacggccaaa

SEQ ID NO: 162286 - DNA, 25 bp, Mus musculus
agatgggcaagtgcaaacggccaaa

SEQ ID NO: 162287 - DNA, 25 bp, Mus musculus
agatgggcactcagatgcgcccgtg

SEQ ID NO: 162288 - DNA, 25 bp, Mus musculus
agatgggcactctgatgcgcccgtg

SEQ ID NO: 162289 - DNA, 25 bp, Mus musculus
agatgggcatgtcacaatccctggg

SEQ ID NO: 162290 - DNA, 25 bp, Mus musculus
agatgggcatgtgacaatccctggg

SEQ ID NO: 162291 - DNA, 25 bp, Mus musculus
agatgggccacaactaactactctc

SEQ ID NO: 162292 - DNA, 25 bp, Mus musculus
agatgggccacatctaactactctc

SEQ ID NO: 162293 - DNA, 25 bp, Mus musculus
agatgggccagaactataccaggct

SEQ ID NO: 162294 - DNA, 25 bp, Mus musculus
agatgggccagatctataccaggct

SEQ ID NO: 162295 - DNA, 25 bp, Mus musculus
agatgggccatgactaccacaagat

SEQ ID NO: 162296 - DNA, 25 bp, Mus musculus
agatgggccatgtctaccacaagat

SEQ ID NO: 162297 - DNA, 25 bp, Mus musculus
agatgggcccaaagcatccacatgc

SEQ ID NO: 162298 - DNA, 25 bp, Mus musculus
agatgggcccaatgcatccacatgc

SEQ ID NO: 162299 - DNA, 25 bp, Mus musculus
agatgggccccacaagtgaggataa

SEQ ID NO: 162300 - DNA, 25 bp, Mus musculus
agatgggccccagaagtgaggataa

SEQ ID NO: 162301 - DNA, 25 bp, Mus musculus
agatgggccctcagattgcctgtgt

SEQ ID NO: 162302 - DNA, 25 bp, Mus musculus
agatgggccctctgattgcctgtgt

SEQ ID NO: 162303 - DNA, 25 bp, Mus musculus
agatgggccctgagaacaccccaga

SEQ ID NO: 162304 - DNA, 25 bp, Mus musculus
agatgggccctgtgaacaccccaga

SEQ ID NO: 162305 - DNA, 25 bp, Mus musculus
agatgggccgtaagcaggctgacct

SEQ ID NO: 162306 - DNA, 25 bp, Mus musculus
agatgggccgtatgcaggctgacct

SEQ ID NO: 162307 - DNA, 25 bp, Mus musculus
agatgggcctatccaggactctgct

SEQ ID NO: 162308 - DNA, 25 bp, Mus musculus
agatgggcctatgcaggactctgct

SEQ ID NO: 162309 - DNA, 25 bp, Mus musculus
agatgggcctcaacttcgaggtggc

SEQ ID NO: 162310 - DNA, 25 bp, Mus musculus
agatgggcctcaagttcttgggcac

SEQ ID NO: 162311 - DNA, 25 bp, Mus musculus
agatgggcctcatcttcgaggtggc

SEQ ID NO: 162312 - DNA, 25 bp, Mus musculus
agatgggcctcatgttcttgggcac

SEQ ID NO: 162313 - DNA, 25 bp, Mus musculus
agatgggcctcgagtggtcttcatt

SEQ ID NO: 162314 - DNA, 25 bp, Mus musculus
agatgggcctcgtgtggtcttcatt

SEQ ID NO: 162315 - DNA, 25 bp, Mus musculus
agatgggcgaccaagcctaactcgt

SEQ ID NO: 162316 - DNA, 25 bp, Mus musculus
agatgggcgacctagcctaactcgt

SEQ ID NO: 162317 - DNA, 25 bp, Mus musculus
agatgggcgtttaggaaagacacac

SEQ ID NO: 162318 - DNA, 25 bp, Mus musculus
agatgggcgttttggaaagacacac

SEQ ID NO: 162319 - DNA, 25 bp, Mus musculus
agatgggctatactgaccccgggca

SEQ ID NO: 162320 - DNA, 25 bp, Mus musculus
agatgggctatagtgaccccgggca

SEQ ID NO: 162321 - DNA, 25 bp, Mus musculus
agatgggctcaacagtcaccgctgc

SEQ ID NO: 162322 - DNA, 25 bp, Mus musculus
agatgggctcaagagtcaccgctgc

SEQ ID NO: 162323 - DNA, 25 bp, Mus musculus
agatgggctccacggctctgcagtt

SEQ ID NO: 162324 - DNA, 25 bp, Mus musculus
agatgggctccagggctctgcagtt

SEQ ID NO: 162325 - DNA, 25 bp, Mus musculus
agatgggctcgaatctggaaacagt

SEQ ID NO: 162326 - DNA, 25 bp, Mus musculus
agatgggctcgattctggaaacagt

SEQ ID NO: 162327 - DNA, 25 bp, Mus musculus
agatgggctgtcagacttcacctga

SEQ ID NO: 162328 - DNA, 25 bp, Mus musculus
agatgggctgtctgacttcacctga

SEQ ID NO: 162329 - DNA, 25 bp, Mus musculus
agatgggtagatcataagcctgcct

SEQ ID NO: 162330 - DNA, 25 bp, Mus musculus
agatgggtagatgataagcctgcct

SEQ ID NO: 162331 - DNA, 25 bp, Mus musculus
agatgggtatcgacttgtggttaat

SEQ ID NO: 162332 - DNA, 25 bp, Mus musculus
agatgggtatcgtcttgtggttaat

SEQ ID NO: 162333 - DNA, 25 bp, Mus musculus
agatgggtcagtccagttggacaca

SEQ ID NO: 162334 - DNA, 25 bp, Mus musculus
agatgggtcagtgcagttggacaca

SEQ ID NO: 162335 - DNA, 25 bp, Mus musculus
agatgggtccaacccctgagaatct

SEQ ID NO: 162336 - DNA, 25 bp, Mus musculus
agatgggtccaagccctgagaatct

SEQ ID NO: 162337 - DNA, 25 bp, Mus musculus
agatgggtcccaatatttatgcttt

SEQ ID NO: 162338 - DNA, 25 bp, Mus musculus
agatgggtcccacagcaagcaaagc

SEQ ID NO: 162339 - DNA, 25 bp, Mus musculus
agatgggtcccagagcaagcaaagc

SEQ ID NO: 162340 - DNA, 25 bp, Mus musculus
agatgggtcccattatttatgcttt

SEQ ID NO: 162341 - DNA, 25 bp, Mus musculus
agatgggtcctcaaattggttgtcc

SEQ ID NO: 162342 - DNA, 25 bp, Mus musculus
agatgggtcctctaattggttgtcc

SEQ ID NO: 162343 - DNA, 25 bp, Mus musculus
agatgggtccttagattcgtcccga

SEQ ID NO: 162344 - DNA, 25 bp, Mus musculus
agatgggtcctttgattcgtcccga

SEQ ID NO: 162345 - DNA, 25 bp, Mus musculus
agatgggtctgtatattggctcccg

SEQ ID NO: 162346 - DNA, 25 bp, Mus musculus
agatgggtctgtttattggctcccg

SEQ ID NO: 162347 - DNA, 25 bp, Mus musculus
agatgggtgaagagccccacacgtt

SEQ ID NO: 162348 - DNA, 25 bp, Mus musculus
agatgggtgaagtgccccacacgtt

SEQ ID NO: 162349 - DNA, 25 bp, Mus musculus
agatgggtgacaatctctctactca

SEQ ID NO: 162350 - DNA, 25 bp, Mus musculus
agatgggtgacattctctctactca

SEQ ID NO: 162351 - DNA, 25 bp, Mus musculus
agatgggtgcccagggagctattca

SEQ ID NO: 162352 - DNA, 25 bp, Mus musculus
agatgggtgccctgggagctattca

SEQ ID NO: 162353 - DNA, 25 bp, Mus musculus
agatgggttggactgatctcttcag

SEQ ID NO: 162354 - DNA, 25 bp, Mus musculus
agatgggttggagtgatctcttcag

SEQ ID NO: 162355 - DNA, 25 bp, Mus musculus
agatgggtttctcgccgtgtagttc

SEQ ID NO: 162356 - DNA, 25 bp, Mus musculus
agatgggtttctggccgtgtagttc

SEQ ID NO: 162357 - DNA, 25 bp, Mus musculus
agatggtaagccactgcggcaggat

SEQ ID NO: 162358 - DNA, 25 bp, Mus musculus
agatggtaagcctctgcggcaggat

SEQ ID NO: 162359 - DNA, 25 bp, Mus musculus
agatggtaagtgcaggatgccccta

SEQ ID NO: 162360 - DNA, 25 bp, Mus musculus
agatggtaagtggaggatgccccta

SEQ ID NO: 162361 - DNA, 25 bp, Mus musculus
agatggtaccacaaactgaggtgag

SEQ ID NO: 162362 - DNA, 25 bp, Mus musculus
agatggtaccactaactgaggtgag

SEQ ID NO: 162363 - DNA, 25 bp, Mus musculus
agatggtacccaatccagagctaaa

SEQ ID NO: 162364 - DNA, 25 bp, Mus musculus
agatggtacccattccagagctaaa

SEQ ID NO: 162365 - DNA, 25 bp, Mus musculus
agatggtaccccagtcactcagggt

SEQ ID NO: 162366 - DNA, 25 bp, Mus musculus
agatggtacccctgtcactcagggt

SEQ ID NO: 162367 - DNA, 25 bp, Mus musculus
agatggtagcatacctgacaccctc

SEQ ID NO: 162368 - DNA, 25 bp, Mus musculus
agatggtagcattcctgacaccctc

SEQ ID NO: 162369 - DNA, 25 bp, Mus musculus
agatggtagttgagtgcacactgat

SEQ ID NO: 162370 - DNA, 25 bp, Mus musculus
agatggtagttgtgtgcacactgat

SEQ ID NO: 162371 - DNA, 25 bp, Mus musculus
agatggtataccctcaggctgacag

SEQ ID NO: 162372 - DNA, 25 bp, Mus musculus
agatggtataccgtcaggctgacag

SEQ ID NO: 162373 - DNA, 25 bp, Mus musculus
agatggtatacgacagccctgtgtg

SEQ ID NO: 162374 - DNA, 25 bp, Mus musculus
agatggtatacgtcagccctgtgtg

SEQ ID NO: 162375 - DNA, 25 bp, Mus musculus
agatggtcaagcaggctgcactgca

SEQ ID NO: 162376 - DNA, 25 bp, Mus musculus
agatggtcaagctggctgcactgca

SEQ ID NO: 162377 - DNA, 25 bp, Mus musculus
agatggtcactaatggactgttcca

SEQ ID NO: 162378 - DNA, 25 bp, Mus musculus
agatggtcactattggactgttcca

SEQ ID NO: 162379 - DNA, 25 bp, Mus musculus
agatggtcagggattcggatttgca

SEQ ID NO: 162380 - DNA, 25 bp, Mus musculus
agatggtcagggtttcggatttgca

SEQ ID NO: 162381 - DNA, 25 bp, Mus musculus
agatggtcatcgagtgtctcatcac

SEQ ID NO: 162382 - DNA, 25 bp, Mus musculus
agatggtcatcgtgtgtctcatcac

SEQ ID NO: 162383 - DNA, 25 bp, Mus musculus
agatggtccagtatgtttcacttat

SEQ ID NO: 162384 - DNA, 25 bp, Mus musculus
agatggtccagtttgtttcacttat

SEQ ID NO: 162385 - DNA, 25 bp, Mus musculus
agatggtcccatcgctaagtggtga

SEQ ID NO: 162386 - DNA, 25 bp, Mus musculus
agatggtcccatggctaagtggtga

SEQ ID NO: 162387 - DNA, 25 bp, Mus musculus
agatggtccccacatgcggtccagc

SEQ ID NO: 162388 - DNA, 25 bp, Mus musculus
agatggtccccagatgcggtccagc

SEQ ID NO: 162389 - DNA, 25 bp, Mus musculus
agatggtccgagaggccctgaagca

SEQ ID NO: 162390 - DNA, 25 bp, Mus musculus
agatggtccgagtggccctgaagca

SEQ ID NO: 162391 - DNA, 25 bp, Mus musculus
agatggtcctaactgtgtgctaaca

SEQ ID NO: 162392 - DNA, 25 bp, Mus musculus
agatggtcctaagtgtgtgctaaca

SEQ ID NO: 162393 - DNA, 25 bp, Mus musculus
agatggtcctgaagctgggcagact

SEQ ID NO: 162394 - DNA, 25 bp, Mus musculus
agatggtcctgatgctgggcagact

SEQ ID NO: 162395 - DNA, 25 bp, Mus musculus
agatggtcgtttctcagctaactgc

SEQ ID NO: 162396 - DNA, 25 bp, Mus musculus
agatggtcgtttgtcagctaactgc

SEQ ID NO: 162397 - DNA, 25 bp, Mus musculus
agatggtctcttcgatgtcgtggaa

SEQ ID NO: 162398 - DNA, 25 bp, Mus musculus
agatggtctcttggatgtcgtggaa

SEQ ID NO: 162399 - DNA, 25 bp, Mus musculus
agatggtctgacacggagctggaaa

SEQ ID NO: 162400 - DNA, 25 bp, Mus musculus
agatggtctgactcggagctggaaa

SEQ ID NO: 162401 - DNA, 25 bp, Mus musculus
agatggtctgccaagtgaacgctga

SEQ ID NO: 162402 - DNA, 25 bp, Mus musculus
agatggtctgcctagtgaacgctga

SEQ ID NO: 162403 - DNA, 25 bp, Mus musculus
agatggtcttcacttgccaaacgtg

SEQ ID NO: 162404 - DNA, 25 bp, Mus musculus
agatggtcttcagttgccaaacgtg

SEQ ID NO: 162405 - DNA, 25 bp, Mus musculus
agatggtgaatgctcgtcaggcaaa

SEQ ID NO: 162406 - DNA, 25 bp, Mus musculus
agatggtgaatggtcgtcaggcaaa

SEQ ID NO: 162407 - DNA, 25 bp, Mus musculus
agatggtgaccacggacttccagaa

SEQ ID NO: 162408 - DNA, 25 bp, Mus musculus
agatggtgaccagggacttccagaa

SEQ ID NO: 162409 - DNA, 25 bp, Mus musculus
agatggtgacgaccacactggaact

SEQ ID NO: 162410 - DNA, 25 bp, Mus musculus
agatggtgacgagcacactggaact

SEQ ID NO: 162411 - DNA, 25 bp, Mus musculus
agatggtgagctatcgctattgcca

SEQ ID NO: 162412 - DNA, 25 bp, Mus musculus
agatggtgagctttcgctattgcca

SEQ ID NO: 162413 - DNA, 25 bp, Mus musculus
agatggtgagtccttcctgcaatag

SEQ ID NO: 162414 - DNA, 25 bp, Mus musculus
agatggtgagtcgttcctgcaatag

SEQ ID NO: 162415 - DNA, 25 bp, Mus musculus
agatggtgatagcagccctgccact

SEQ ID NO: 162416 - DNA, 25 bp, Mus musculus
agatggtgataggagccctgccact

SEQ ID NO: 162417 - DNA, 25 bp, Mus musculus
agatggtgcccaacaatggcgttcc

SEQ ID NO: 162418 - DNA, 25 bp, Mus musculus
agatggtgcccatcaatggcgttcc

SEQ ID NO: 162419 - DNA, 25 bp, Mus musculus
agatggtgcctgagtttgctgccaa

SEQ ID NO: 162420 - DNA, 25 bp, Mus musculus
agatggtgcctgtgtttgctgccaa

SEQ ID NO: 162421 - DNA, 25 bp, Mus musculus
agatggtgcttgcatccttgatgct

SEQ ID NO: 162422 - DNA, 25 bp, Mus musculus
agatggtgcttggatccttgatgct

SEQ ID NO: 162423 - DNA, 25 bp, Mus musculus
agatggtggcgtagagcacctccat

SEQ ID NO: 162424 - DNA, 25 bp, Mus musculus
agatggtggcgttgagcacctccat

SEQ ID NO: 162425 - DNA, 25 bp, Mus musculus
agatggtgtacacccatcatgtaaa

SEQ ID NO: 162426 - DNA, 25 bp, Mus musculus
agatggtgtacagccatcatgtaaa

SEQ ID NO: 162427 - DNA, 25 bp, Mus musculus
agatggtgtcgccgaactccagcag

SEQ ID NO: 162428 - DNA, 25 bp, Mus musculus
agatggtgtcgcggaactccagcag

SEQ ID NO: 162429 - DNA, 25 bp, Mus musculus
agatggtgtctgaagcttcctttta

SEQ ID NO: 162430 - DNA, 25 bp, Mus musculus
agatggtgtctgtagcttcctttta

SEQ ID NO: 162431 - DNA, 25 bp, Mus musculus
agatggtgtggtctttcttaaggct

SEQ ID NO: 162432 - DNA, 25 bp, Mus musculus
agatggtgtggtgtttcttaaggct

SEQ ID NO: 162433 - DNA, 25 bp, Mus musculus
agatggtgtttcaccgagtcaccac

SEQ ID NO: 162434 - DNA, 25 bp, Mus musculus
agatggtgtttctccgagtcaccac

SEQ ID NO: 162435 - DNA, 25 bp, Mus musculus
agatggttacggctctgcattcaat

SEQ ID NO: 162436 - DNA, 25 bp, Mus musculus
agatggttacgggtctgcattcaat

SEQ ID NO: 162437 - DNA, 25 bp, Mus musculus
agatggttatggatccctcagtcat

SEQ ID NO: 162438 - DNA, 25 bp, Mus musculus
agatggttatggttccctcagtcat

SEQ ID NO: 162439 - DNA, 25 bp, Mus musculus
agatggttcagtcggcacagtacat

SEQ ID NO: 162440 - DNA, 25 bp, Mus musculus
agatggttcagtgggcacagtacat

SEQ ID NO: 162441 - DNA, 25 bp, Mus musculus
agatggttcccaccacttgtttgtg

SEQ ID NO: 162442 - DNA, 25 bp, Mus musculus
agatggttcccagcacttgtttgtg

SEQ ID NO: 162443 - DNA, 25 bp, Mus musculus
agatggttcccgatgctgtgaaaga

SEQ ID NO: 162444 - DNA, 25 bp, Mus musculus
agatggttcccgttgctgtgaaaga

SEQ ID NO: 162445 - DNA, 25 bp, Mus musculus
agatggttcgagacaaccctctcta

SEQ ID NO: 162446 - DNA, 25 bp, Mus musculus
agatggttcgagtcaaccctctcta

SEQ ID NO: 162447 - DNA, 25 bp, Mus musculus
agatggttctacactgtcatccaga

SEQ ID NO: 162448 - DNA, 25 bp, Mus musculus
agatggttctactctgtcatccaga

SEQ ID NO: 162449 - DNA, 25 bp, Mus musculus
agatggttctcacacccgacattaa

SEQ ID NO: 162450 - DNA, 25 bp, Mus musculus
agatggttctcagacccgacattaa

SEQ ID NO: 162451 - DNA, 25 bp, Mus musculus
agatggttctctcggtaaagtactt

SEQ ID NO: 162452 - DNA, 25 bp, Mus musculus
agatggttctctgggtaaagtactt

SEQ ID NO: 162453 - DNA, 25 bp, Mus musculus
agatggttctgcacacttctcggct

SEQ ID NO: 162454 - DNA, 25 bp, Mus musculus
agatggttctgctcacttctcggct

SEQ ID NO: 162455 - DNA, 25 bp, Mus musculus
agatggttctggacgctctaaaaca

SEQ ID NO: 162456 - DNA, 25 bp, Mus musculus
agatggttctggtcgctctaaaaca

SEQ ID NO: 162457 - DNA, 25 bp, Mus musculus
agatggttgccacggtttctttgca

SEQ ID NO: 162458 - DNA, 25 bp, Mus musculus
agatggttgccagggtttctttgca

SEQ ID NO: 162459 - DNA, 25 bp, Mus musculus
agatggttgcctacatctctgtgtg

SEQ ID NO: 162460 - DNA, 25 bp, Mus musculus
agatggttgccttcatctctgtgtg

SEQ ID NO: 162461 - DNA, 25 bp, Mus musculus
agatggttggttagtcagaactcac

SEQ ID NO: 162462 - DNA, 25 bp, Mus musculus
agatggttggtttgtcagaactcac

SEQ ID NO: 162463 - DNA, 25 bp, Mus musculus
agatggttgtcacctgccctttgtg

SEQ ID NO: 162464 - DNA, 25 bp, Mus musculus
agatggttgtcagctgccctttgtg

SEQ ID NO: 162465 - DNA, 25 bp, Mus musculus
agatggtttgccctatcgtttttct

SEQ ID NO: 162466 - DNA, 25 bp, Mus musculus
agatggtttgccgtatcgtttttct

SEQ ID NO: 162467 - DNA, 25 bp, Mus musculus
agatggtttttgagcctgttcctta

SEQ ID NO: 162468 - DNA, 25 bp, Mus musculus
agatggtttttgtgcctgttcctta

SEQ ID NO: 162469 - DNA, 25 bp, Mus musculus
agatgtaaacagacgccagacccag

SEQ ID NO: 162470 - DNA, 25 bp, Mus musculus
agatgtaaacagtcgccagacccag

SEQ ID NO: 162471 - DNA, 25 bp, Mus musculus
agatgtaacatcactctgtactccc

SEQ ID NO: 162472 - DNA, 25 bp, Mus musculus
agatgtaacatctctctgtactccc

SEQ ID NO: 162473 - DNA, 25 bp, Mus musculus
agatgtaaggctctcagctggcact

SEQ ID NO: 162474 - DNA, 25 bp, Mus musculus
agatgtaaggctgtcagctggcact

SEQ ID NO: 162475 - DNA, 25 bp, Mus musculus
agatgtaagtcacacacctccagcc

SEQ ID NO: 162476 - DNA, 25 bp, Mus musculus
agatgtaagtcagacacctccagcc

SEQ ID NO: 162477 - DNA, 25 bp, Mus musculus
agatgtaagtgaagtgccctccgaa

SEQ ID NO: 162478 - DNA, 25 bp, Mus musculus
agatgtaagtgatgtgccctccgaa

SEQ ID NO: 162479 - DNA, 25 bp, Mus musculus
agatgtaatgacctgcagacccaca

SEQ ID NO: 162480 - DNA, 25 bp, Mus musculus
agatgtaatgacgtgcagacccaca

SEQ ID NO: 162481 - DNA, 25 bp, Mus musculus
agatgtacaaccaaagtgctcccca

SEQ ID NO: 162482 - DNA, 25 bp, Mus musculus
agatgtacaacctaagtgctcccca

SEQ ID NO: 162483 - DNA, 25 bp, Mus musculus
agatgtacaatgacctcctcaggaa

SEQ ID NO: 162484 - DNA, 25 bp, Mus musculus
agatgtacaatgtcctcctcaggaa

SEQ ID NO: 162485 - DNA, 25 bp, Mus musculus
agatgtacactcactccttgtggtt

SEQ ID NO: 162486 - DNA, 25 bp, Mus musculus
agatgtacactctctccttgtggtt

SEQ ID NO: 162487 - DNA, 25 bp, Mus musculus
agatgtacactgagacgcccagttt

SEQ ID NO: 162488 - DNA, 25 bp, Mus musculus
agatgtacactgagcaaagcccctg

SEQ ID NO: 162489 - DNA, 25 bp, Mus musculus
agatgtacactgtgacgcccagttt

SEQ ID NO: 162490 - DNA, 25 bp, Mus musculus
agatgtacactgtgcaaagcccctg

SEQ ID NO: 162491 - DNA, 25 bp, Mus musculus
agatgtacccgtctggttcccaaag

SEQ ID NO: 162492 - DNA, 25 bp, Mus musculus
agatgtacccgtgtggttcccaaag

SEQ ID NO: 162493 - DNA, 25 bp, Mus musculus
agatgtaccgacctggatatttggt

SEQ ID NO: 162494 - DNA, 25 bp, Mus musculus
agatgtaccgacgtggatatttggt

SEQ ID NO: 162495 - DNA, 25 bp, Mus musculus
agatgtacctgacctttcttatttc

SEQ ID NO: 162496 - DNA, 25 bp, Mus musculus
agatgtacctgaccttttttatgtc

SEQ ID NO: 162497 - DNA, 25 bp, Mus musculus
agatgtacctgagctttcttatttc

SEQ ID NO: 162498 - DNA, 25 bp, Mus musculus
agatgtacctgagcttttttatgtc

SEQ ID NO: 162499 - DNA, 25 bp, Mus musculus
agatgtaccttgcttggaccccata

SEQ ID NO: 162500 - DNA, 25 bp, Mus musculus
agatgtaccttggttggaccccata

SEQ ID NO: 162501 - DNA, 25 bp, Mus musculus
agatgtacggcaagactctcagcag

SEQ ID NO: 162502 - DNA, 25 bp, Mus musculus
agatgtacggcatgactctcagcag

SEQ ID NO: 162503 - DNA, 25 bp, Mus musculus
agatgtacggtgagcgcccttcagg

SEQ ID NO: 162504 - DNA, 25 bp, Mus musculus
agatgtacggtgtgcgcccttcagg

SEQ ID NO: 162505 - DNA, 25 bp, Mus musculus
agatgtactactagcccttggggaa

SEQ ID NO: 162506 - DNA, 25 bp, Mus musculus
agatgtactacttgcccttggggaa

SEQ ID NO: 162507 - DNA, 25 bp, Mus musculus
agatgtactcaacctggcctactgg

SEQ ID NO: 162508 - DNA, 25 bp, Mus musculus
agatgtactcaagctggcctactgg

SEQ ID NO: 162509 - DNA, 25 bp, Mus musculus
agatgtactcacatatctatggtac

SEQ ID NO: 162510 - DNA, 25 bp, Mus musculus
agatgtactcacttatctatggtac

SEQ ID NO: 162511 - DNA, 25 bp, Mus musculus
agatgtagacacatttgggatccag

SEQ ID NO: 162512 - DNA, 25 bp, Mus musculus
agatgtagacacttttgggatccag

SEQ ID NO: 162513 - DNA, 25 bp, Mus musculus
agatgtagacatcttcccctcagac

SEQ ID NO: 162514 - DNA, 25 bp, Mus musculus
agatgtagacatgttcccctcagac

SEQ ID NO: 162515 - DNA, 25 bp, Mus musculus
agatgtagactgacttcctgcatga

SEQ ID NO: 162516 - DNA, 25 bp, Mus musculus
agatgtagactgtcttcctgcatga

SEQ ID NO: 162517 - DNA, 25 bp, Mus musculus
agatgtagagttcctgattcagtgc

SEQ ID NO: 162518 - DNA, 25 bp, Mus musculus
agatgtagagttgctgattcagtgc

SEQ ID NO: 162519 - DNA, 25 bp, Mus musculus
agatgtagattcatccttcggtatt

SEQ ID NO: 162520 - DNA, 25 bp, Mus musculus
agatgtagattcttccttcggtatt

SEQ ID NO: 162521 - DNA, 25 bp, Mus musculus
agatgtagcaagacactttctaaaa

SEQ ID NO: 162522 - DNA, 25 bp, Mus musculus
agatgtagcaagtcactttctaaaa

SEQ ID NO: 162523 - DNA, 25 bp, Mus musculus
agatgtagctcccttgtgtccgttt

SEQ ID NO: 162524 - DNA, 25 bp, Mus musculus
agatgtagctccgttgtgtccgttt

SEQ ID NO: 162525 - DNA, 25 bp, Mus musculus
agatgtaggccccaggactgtctct

SEQ ID NO: 162526 - DNA, 25 bp, Mus musculus
agatgtaggcccgaggactgtctct

SEQ ID NO: 162527 - DNA, 25 bp, Mus musculus
agatgtaggctcactggaatttttt

SEQ ID NO: 162528 - DNA, 25 bp, Mus musculus
agatgtaggctctctggaatttttt

SEQ ID NO: 162529 - DNA, 25 bp, Mus musculus
agatgtaggcttcctgactttgggt

SEQ ID NO: 162530 - DNA, 25 bp, Mus musculus
agatgtaggcttgctgactttgggt

SEQ ID NO: 162531 - DNA, 25 bp, Mus musculus
agatgtagggcgctacccctaaggc

SEQ ID NO: 162532 - DNA, 25 bp, Mus musculus
agatgtagggcggtacccctaaggc

SEQ ID NO: 162533 - DNA, 25 bp, Mus musculus
agatgtaggtttactgttaggtgct

SEQ ID NO: 162534 - DNA, 25 bp, Mus musculus
agatgtaggttttctgttaggtgct

SEQ ID NO: 162535 - DNA, 25 bp, Mus musculus
agatgtagtcacagtttatgggcct

SEQ ID NO: 162536 - DNA, 25 bp, Mus musculus
agatgtagtcactgtttatgggcct

SEQ ID NO: 162537 - DNA, 25 bp, Mus musculus
agatgtagttctcacgtgccctgcc

SEQ ID NO: 162538 - DNA, 25 bp, Mus musculus
agatgtagttctgacgtgccctgcc

SEQ ID NO: 162539 - DNA, 25 bp, Mus musculus
agatgtataacgatgccaggaggca

SEQ ID NO: 162540 - DNA, 25 bp, Mus musculus
agatgtataacgttgccaggaggca

SEQ ID NO: 162541 - DNA, 25 bp, Mus musculus
agatgtatcccaattagtgagtaga

SEQ ID NO: 162542 - DNA, 25 bp, Mus musculus
agatgtatcccatttagtgagtaga

SEQ ID NO: 162543 - DNA, 25 bp, Mus musculus
agatgtatcctccagtcgccaggtt

SEQ ID NO: 162544 - DNA, 25 bp, Mus musculus
agatgtatcctcgagtcgccaggtt

SEQ ID NO: 162545 - DNA, 25 bp, Mus musculus
agatgtatctaacttcctggagctg

SEQ ID NO: 162546 - DNA, 25 bp, Mus musculus
agatgtatctaagttcctggagctg

SEQ ID NO: 162547 - DNA, 25 bp, Mus musculus
agatgtatgatgcttaaccctccca

SEQ ID NO: 162548 - DNA, 25 bp, Mus musculus
agatgtatgatggttaaccctccca

SEQ ID NO: 162549 - DNA, 25 bp, Mus musculus
agatgtatgcatacccaagctttgg

SEQ ID NO: 162550 - DNA, 25 bp, Mus musculus
agatgtatgcattcccaagctttgg

SEQ ID NO: 162551 - DNA, 25 bp, Mus musculus
agatgtatgccaccctataaggcta

SEQ ID NO: 162552 - DNA, 25 bp, Mus musculus
agatgtatgccagcctataaggcta

SEQ ID NO: 162553 - DNA, 25 bp, Mus musculus
agatgtatgcctaagatttctttat

SEQ ID NO: 162554 - DNA, 25 bp, Mus musculus
agatgtatgccttagatttctttat

SEQ ID NO: 162555 - DNA, 25 bp, Mus musculus
agatgtatgggaagcaaatagtgca

SEQ ID NO: 162556 - DNA, 25 bp, Mus musculus
agatgtatgggatgcaaatagtgca

SEQ ID NO: 162557 - DNA, 25 bp, Mus musculus
agatgtatgggtagcgcaccaagga

SEQ ID NO: 162558 - DNA, 25 bp, Mus musculus
agatgtatgggttgcgcaccaagga

SEQ ID NO: 162559 - DNA, 25 bp, Mus musculus
agatgtatggtaccctttaaagtgg

SEQ ID NO: 162560 - DNA, 25 bp, Mus musculus
agatgtatggtagcctttaaagtgg

SEQ ID NO: 162561 - DNA, 25 bp, Mus musculus
agatgtatgtatagtaggccctgac

SEQ ID NO: 162562 - DNA, 25 bp, Mus musculus
agatgtatgtattgtaggccctgac

SEQ ID NO: 162563 - DNA, 25 bp, Mus musculus
agatgtattactactcagtcatgag

SEQ ID NO: 162564 - DNA, 25 bp, Mus musculus
agatgtattacttctcagtcatgag

SEQ ID NO: 162565 - DNA, 25 bp, Mus musculus
agatgtattcccagaagccattgat

SEQ ID NO: 162566 - DNA, 25 bp, Mus musculus
agatgtattccctgaagccattgat

SEQ ID NO: 162567 - DNA, 25 bp, Mus musculus
agatgtattttaatccctccagctt

SEQ ID NO: 162568 - DNA, 25 bp, Mus musculus
agatgtattttattccctccagctt

SEQ ID NO: 162569 - DNA, 25 bp, Mus musculus
agatgtcaacatctgtctcctctac

SEQ ID NO: 162570 - DNA, 25 bp, Mus musculus
agatgtcaacatgtgtctcctctac

SEQ ID NO: 162571 - DNA, 25 bp, Mus musculus
agatgtcaacgccaatcgaggtcct

SEQ ID NO: 162572 - DNA, 25 bp, Mus musculus
agatgtcaacgcgaatcgaggtcct

SEQ ID NO: 162573 - DNA, 25 bp, Mus musculus
agatgtcaagaacttctactttgtc

SEQ ID NO: 162574 - DNA, 25 bp, Mus musculus
agatgtcaagaagttctactttgtc

SEQ ID NO: 162575 - DNA, 25 bp, Mus musculus
agatgtcacctcctaaggatctacc

SEQ ID NO: 162576 - DNA, 25 bp, Mus musculus
agatgtcacctcgtaaggatctacc

SEQ ID NO: 162577 - DNA, 25 bp, Mus musculus
agatgtcactgacgtctagaccatt

SEQ ID NO: 162578 - DNA, 25 bp, Mus musculus
agatgtcactgaggtctagaccatt

SEQ ID NO: 162579 - DNA, 25 bp, Mus musculus
agatgtcacttaattggcctggccc

SEQ ID NO: 162580 - DNA, 25 bp, Mus musculus
agatgtcacttatttggcctggccc

SEQ ID NO: 162581 - DNA, 25 bp, Mus musculus
agatgtcacttcattaaggctgttt

SEQ ID NO: 162582 - DNA, 25 bp, Mus musculus
agatgtcacttctttaaggctgttt

SEQ ID NO: 162583 - DNA, 25 bp, Mus musculus
agatgtcagcgtccctttccctgtt

SEQ ID NO: 162584 - DNA, 25 bp, Mus musculus
agatgtcagcgtgcctttccctgtt

SEQ ID NO: 162585 - DNA, 25 bp, Mus musculus
agatgtcaggctacttcctaggact

SEQ ID NO: 162586 - DNA, 25 bp, Mus musculus
agatgtcaggcttcttcctaggact

SEQ ID NO: 162587 - DNA, 25 bp, Mus musculus
agatgtcatatacccatctggcagc

SEQ ID NO: 162588 - DNA, 25 bp, Mus musculus
agatgtcatatagccatctggcagc

SEQ ID NO: 162589 - DNA, 25 bp, Mus musculus
agatgtcatcggcagtctccaaggg

SEQ ID NO: 162590 - DNA, 25 bp, Mus musculus
agatgtcatcgggagtctccaaggg

SEQ ID NO: 162591 - DNA, 25 bp, Mus musculus
agatgtcatggcacacgtggctggc

SEQ ID NO: 162592 - DNA, 25 bp, Mus musculus
agatgtcatggcatccttctaggct

SEQ ID NO: 162593 - DNA, 25 bp, Mus musculus
agatgtcatggctcacgtggctggc

SEQ ID NO: 162594 - DNA, 25 bp, Mus musculus
agatgtcatggcttccttctaggct

SEQ ID NO: 162595 - DNA, 25 bp, Mus musculus
agatgtccaccaaccaaaatgctga

SEQ ID NO: 162596 - DNA, 25 bp, Mus musculus
agatgtccaccatccaaaatgctga

SEQ ID NO: 162597 - DNA, 25 bp, Mus musculus
agatgtccatccagaggctgtagat

SEQ ID NO: 162598 - DNA, 25 bp, Mus musculus
agatgtccatcctgaggctgtagat

SEQ ID NO: 162599 - DNA, 25 bp, Mus musculus
agatgtccatctaacagctgcagct

SEQ ID NO: 162600 - DNA, 25 bp, Mus musculus
agatgtccatcttacagctgcagct

SEQ ID NO: 162601 - DNA, 25 bp, Mus musculus
agatgtccatgacctttaagtctga

SEQ ID NO: 162602 - DNA, 25 bp, Mus musculus
agatgtccatgagctttaagtctga

SEQ ID NO: 162603 - DNA, 25 bp, Mus musculus
agatgtccccagctaaataaagcct

SEQ ID NO: 162604 - DNA, 25 bp, Mus musculus
agatgtccccaggtaaataaagcct

SEQ ID NO: 162605 - DNA, 25 bp, Mus musculus
agatgtccccatccaggcatgaaac

SEQ ID NO: 162606 - DNA, 25 bp, Mus musculus
agatgtccccatgcaggcatgaaac

SEQ ID NO: 162607 - DNA, 25 bp, Mus musculus
agatgtccccttatgaaggacctgt

SEQ ID NO: 162608 - DNA, 25 bp, Mus musculus
agatgtccccttttgaaggacctgt

SEQ ID NO: 162609 - DNA, 25 bp, Mus musculus
agatgtccctaaatcagttgcctgc

SEQ ID NO: 162610 - DNA, 25 bp, Mus musculus
agatgtccctaattcagttgcctgc

SEQ ID NO: 162611 - DNA, 25 bp, Mus musculus
agatgtccctgtactgaactctgtt

SEQ ID NO: 162612 - DNA, 25 bp, Mus musculus
agatgtccctgtactggcaccacag

SEQ ID NO: 162613 - DNA, 25 bp, Mus musculus
agatgtccctgtctgcagatgtctc

SEQ ID NO: 162614 - DNA, 25 bp, Mus musculus
agatgtccctgtgtgcagatgtctc

SEQ ID NO: 162615 - DNA, 25 bp, Mus musculus
agatgtccctgttctgaactctgtt

SEQ ID NO: 162616 - DNA, 25 bp, Mus musculus
agatgtccctgttctggcaccacag

SEQ ID NO: 162617 - DNA, 25 bp, Mus musculus
agatgtccgaaaagccaagctctga

SEQ ID NO: 162618 - DNA, 25 bp, Mus musculus
agatgtccgaaatgccaagctctga

SEQ ID NO: 162619 - DNA, 25 bp, Mus musculus
agatgtccgctcacggcgcaagtgg

SEQ ID NO: 162620 - DNA, 25 bp, Mus musculus
agatgtccgctctcggcgcaagtgg

SEQ ID NO: 162621 - DNA, 25 bp, Mus musculus
agatgtccgctgcagaaggctgttc

SEQ ID NO: 162622 - DNA, 25 bp, Mus musculus
agatgtccgctggagaaggctgttc

SEQ ID NO: 162623 - DNA, 25 bp, Mus musculus
agatgtcctcatactgttgtgttca

SEQ ID NO: 162624 - DNA, 25 bp, Mus musculus
agatgtcctcattctgttgtgttca

SEQ ID NO: 162625 - DNA, 25 bp, Mus musculus
agatgtcctcgtcagctcaggagaa

SEQ ID NO: 162626 - DNA, 25 bp, Mus musculus
agatgtcctcgtgagctcaggagaa

SEQ ID NO: 162627 - DNA, 25 bp, Mus musculus
agatgtcctctgaaggcttccagga

SEQ ID NO: 162628 - DNA, 25 bp, Mus musculus
agatgtcctctgtaggcttccagga

SEQ ID NO: 162629 - DNA, 25 bp, Mus musculus
agatgtcctgacagtatgctttagc

SEQ ID NO: 162630 - DNA, 25 bp, Mus musculus
agatgtcctgacagtgaagatcaaa

SEQ ID NO: 162631 - DNA, 25 bp, Mus musculus
agatgtcctgactgtatgctttagc

SEQ ID NO: 162632 - DNA, 25 bp, Mus musculus
agatgtcctgactgtgaagatcaaa

SEQ ID NO: 162633 - DNA, 25 bp, Mus musculus
agatgtcctgccagcctagaggccg

SEQ ID NO: 162634 - DNA, 25 bp, Mus musculus
agatgtcctgcccttgatcttcaag

SEQ ID NO: 162635 - DNA, 25 bp, Mus musculus
agatgtcctgccgttgatcttcaag

SEQ ID NO: 162636 - DNA, 25 bp, Mus musculus
agatgtcctgcctgcctagaggccg

SEQ ID NO: 162637 - DNA, 25 bp, Mus musculus
agatgtcctggactgctaagagtgc

SEQ ID NO: 162638 - DNA, 25 bp, Mus musculus
agatgtcctggagtgctaagagtgc

SEQ ID NO: 162639 - DNA, 25 bp, Mus musculus
agatgtccttatcgacttcctgctg

SEQ ID NO: 162640 - DNA, 25 bp, Mus musculus
agatgtccttatggacttcctgctg

SEQ ID NO: 162641 - DNA, 25 bp, Mus musculus
agatgtccttccagcttgtcagaca

SEQ ID NO: 162642 - DNA, 25 bp, Mus musculus
agatgtccttcctgcttgtcagaca

SEQ ID NO: 162643 - DNA, 25 bp, Mus musculus
agatgtccttgtcttgggaactcca

SEQ ID NO: 162644 - DNA, 25 bp, Mus musculus
agatgtccttgtgttgggaactcca

SEQ ID NO: 162645 - DNA, 25 bp, Mus musculus
agatgtcgagtgcaccatgtttcca

SEQ ID NO: 162646 - DNA, 25 bp, Mus musculus
agatgtcgagtggaccatgtttcca

SEQ ID NO: 162647 - DNA, 25 bp, Mus musculus
agatgtcgcagaaggactcaagcca

SEQ ID NO: 162648 - DNA, 25 bp, Mus musculus
agatgtcgcagatggactcaagcca

SEQ ID NO: 162649 - DNA, 25 bp, Mus musculus
agatgtcgctggcatggctcccaag

SEQ ID NO: 162650 - DNA, 25 bp, Mus musculus
agatgtcgctgggatggctcccaag

SEQ ID NO: 162651 - DNA, 25 bp, Mus musculus
agatgtcgggcaatagctctgtggt

SEQ ID NO: 162652 - DNA, 25 bp, Mus musculus
agatgtcgggcattagctctgtggt

SEQ ID NO: 162653 - DNA, 25 bp, Mus musculus
agatgtcggttccaaaactcagttg

SEQ ID NO: 162654 - DNA, 25 bp, Mus musculus
agatgtcggttcgaaaactcagttg

SEQ ID NO: 162655 - DNA, 25 bp, Mus musculus
agatgtcgtggtatgtaagatgccc

SEQ ID NO: 162656 - DNA, 25 bp, Mus musculus
agatgtcgtggtttgtaagatgccc

SEQ ID NO: 162657 - DNA, 25 bp, Mus musculus
agatgtctaataagtcttggcttag

SEQ ID NO: 162658 - DNA, 25 bp, Mus musculus
agatgtctaatatgtcttggcttag

SEQ ID NO: 162659 - DNA, 25 bp, Mus musculus
agatgtctatacacaatggcttgct

SEQ ID NO: 162660 - DNA, 25 bp, Mus musculus
agatgtctatactcaatggcttgct

SEQ ID NO: 162661 - DNA, 25 bp, Mus musculus
agatgtctatcccaggctctctcat

SEQ ID NO: 162662 - DNA, 25 bp, Mus musculus
agatgtctatccgaggctctctcat

SEQ ID NO: 162663 - DNA, 25 bp, Mus musculus
agatgtctcaacaaacacctgtcat

SEQ ID NO: 162664 - DNA, 25 bp, Mus musculus
agatgtctcaactaacacctgtcat

SEQ ID NO: 162665 - DNA, 25 bp, Mus musculus
agatgtctcacgactgctttgattt

SEQ ID NO: 162666 - DNA, 25 bp, Mus musculus
agatgtctcacgtctgctttgattt

SEQ ID NO: 162667 - DNA, 25 bp, Mus musculus
agatgtctctccaagtgagccctag

SEQ ID NO: 162668 - DNA, 25 bp, Mus musculus
agatgtctctccctttgattccttt

SEQ ID NO: 162669 - DNA, 25 bp, Mus musculus
agatgtctctccgtttgattccttt

SEQ ID NO: 162670 - DNA, 25 bp, Mus musculus
agatgtctctcctagtgagccctag

SEQ ID NO: 162671 - DNA, 25 bp, Mus musculus
agatgtctctgaacggacagcgcgg

SEQ ID NO: 162672 - DNA, 25 bp, Mus musculus
agatgtctctgatcggacagcgcgg

SEQ ID NO: 162673 - DNA, 25 bp, Mus musculus
agatgtctgaatatgatggctgttt

SEQ ID NO: 162674 - DNA, 25 bp, Mus musculus
agatgtctgaatttgatggctgttt

SEQ ID NO: 162675 - DNA, 25 bp, Mus musculus
agatgtctgaccagcattgctctga

SEQ ID NO: 162676 - DNA, 25 bp, Mus musculus
agatgtctgacctgcattgctctga

SEQ ID NO: 162677 - DNA, 25 bp, Mus musculus
agatgtctgactcccaagaaagctt

SEQ ID NO: 162678 - DNA, 25 bp, Mus musculus
agatgtctgactgccaagaaagctt

SEQ ID NO: 162679 - DNA, 25 bp, Mus musculus
agatgtctgcctactgttctcaaca

SEQ ID NO: 162680 - DNA, 25 bp, Mus musculus
agatgtctgccttctgttctcaaca

SEQ ID NO: 162681 - DNA, 25 bp, Mus musculus
agatgtctgggtctctgactggtca

SEQ ID NO: 162682 - DNA, 25 bp, Mus musculus
agatgtctgggtgtctgactggtca

SEQ ID NO: 162683 - DNA, 25 bp, Mus musculus
agatgtctgtagctctgtggcaaca

SEQ ID NO: 162684 - DNA, 25 bp, Mus musculus
agatgtctgtaggtctgtggcaaca

SEQ ID NO: 162685 - DNA, 25 bp, Mus musculus
agatgtctgtctccgagatctgcaa

SEQ ID NO: 162686 - DNA, 25 bp, Mus musculus
agatgtctgtctgcgagatctgcaa

SEQ ID NO: 162687 - DNA, 25 bp, Mus musculus
agatgtctgtgcctgaacagtggct

SEQ ID NO: 162688 - DNA, 25 bp, Mus musculus
agatgtctgtgcgtgaacagtggct

SEQ ID NO: 162689 - DNA, 25 bp, Mus musculus
agatgtctgtggcaccaagtttcca

SEQ ID NO: 162690 - DNA, 25 bp, Mus musculus
agatgtctgtgggaccaagtttcca

SEQ ID NO: 162691 - DNA, 25 bp, Mus musculus
agatgtcttaacagtccgaaagcag

SEQ ID NO: 162692 - DNA, 25 bp, Mus musculus
agatgtcttaactgtccgaaagcag

SEQ ID NO: 162693 - DNA, 25 bp, Mus musculus
agatgtcttagacaaactggcagac

SEQ ID NO: 162694 - DNA, 25 bp, Mus musculus
agatgtcttagagaaactggcagac

SEQ ID NO: 162695 - DNA, 25 bp, Mus musculus
agatgtcttagcagcttctagtgat

SEQ ID NO: 162696 - DNA, 25 bp, Mus musculus
agatgtcttagctgcttctagtgat

SEQ ID NO: 162697 - DNA, 25 bp, Mus musculus
agatgtcttcatatactgttgtagg

SEQ ID NO: 162698 - DNA, 25 bp, Mus musculus
agatgtcttcatttactgttgtagg

SEQ ID NO: 162699 - DNA, 25 bp, Mus musculus
agatgtcttgacaggatcactgaga

SEQ ID NO: 162700 - DNA, 25 bp, Mus musculus
agatgtcttgactggatcactgaga

SEQ ID NO: 162701 - DNA, 25 bp, Mus musculus
agatgtcttggaacctttcaatgat

SEQ ID NO: 162702 - DNA, 25 bp, Mus musculus
agatgtcttggatcctttcaatgat

SEQ ID NO: 162703 - DNA, 25 bp, Mus musculus
agatgtcttttgagtgtgaacttgt

SEQ ID NO: 162704 - DNA, 25 bp, Mus musculus
agatgtcttttgtgtgtgaacttgt

SEQ ID NO: 162705 - DNA, 25 bp, Mus musculus
agatgtgaacaacgccagaactcca

SEQ ID NO: 162706 - DNA, 25 bp, Mus musculus
agatgtgaacaactcctgcaaaaac

SEQ ID NO: 162707 - DNA, 25 bp, Mus musculus
agatgtgaacaaggccagaactcca

SEQ ID NO: 162708 - DNA, 25 bp, Mus musculus
agatgtgaacaagtcctgcaaaaac

SEQ ID NO: 162709 - DNA, 25 bp, Mus musculus
agatgtgaactgagtgactcccctt

SEQ ID NO: 162710 - DNA, 25 bp, Mus musculus
agatgtgaactgtgtgactcccctt

SEQ ID NO: 162711 - DNA, 25 bp, Mus musculus
agatgtgaagaacgctgcccaccag

SEQ ID NO: 162712 - DNA, 25 bp, Mus musculus
agatgtgaagaaggctgcccaccag

SEQ ID NO: 162713 - DNA, 25 bp, Mus musculus
agatgtgaatccattcttggctccc

SEQ ID NO: 162714 - DNA, 25 bp, Mus musculus
agatgtgaatcctttcttggctccc

SEQ ID NO: 162715 - DNA, 25 bp, Mus musculus
agatgtgaatgccaaagtgccttgc

SEQ ID NO: 162716 - DNA, 25 bp, Mus musculus
agatgtgaatgcgaaagtgccttgc

SEQ ID NO: 162717 - DNA, 25 bp, Mus musculus
agatgtgacacgagggaccagtccc

SEQ ID NO: 162718 - DNA, 25 bp, Mus musculus
agatgtgacacgtgggaccagtccc

SEQ ID NO: 162719 - DNA, 25 bp, Mus musculus
agatgtgaccaacgtttccatgagt

SEQ ID NO: 162720 - DNA, 25 bp, Mus musculus
agatgtgaccaaggtttccatgagt

SEQ ID NO: 162721 - DNA, 25 bp, Mus musculus
agatgtgacccaaagccccgagggt

SEQ ID NO: 162722 - DNA, 25 bp, Mus musculus
agatgtgacccatagccccgagggt

SEQ ID NO: 162723 - DNA, 25 bp, Mus musculus
agatgtgacgtcagtctccttgaga

SEQ ID NO: 162724 - DNA, 25 bp, Mus musculus
agatgtgacgtctgtctccttgaga

SEQ ID NO: 162725 - DNA, 25 bp, Mus musculus
agatgtgactccagtgctgtgggaa

SEQ ID NO: 162726 - DNA, 25 bp, Mus musculus
agatgtgactcctgtgctgtgggaa

SEQ ID NO: 162727 - DNA, 25 bp, Mus musculus
agatgtgactctcacgttgtgattc

SEQ ID NO: 162728 - DNA, 25 bp, Mus musculus
agatgtgactctgacgttgtgattc

SEQ ID NO: 162729 - DNA, 25 bp, Mus musculus
agatgtgagaacactctcctgggca

SEQ ID NO: 162730 - DNA, 25 bp, Mus musculus
agatgtgagaactctctcctgggca

SEQ ID NO: 162731 - DNA, 25 bp, Mus musculus
agatgtgaggcaataggcccggctc

SEQ ID NO: 162732 - DNA, 25 bp, Mus musculus
agatgtgaggcattaggcccggctc

SEQ ID NO: 162733 - DNA, 25 bp, Mus musculus
agatgtgagtgacagcctgcagcct

SEQ ID NO: 162734 - DNA, 25 bp, Mus musculus
agatgtgagtgagagcctgcagcct

SEQ ID NO: 162735 - DNA, 25 bp, Mus musculus
agatgtgagttaaccaccacccagc

SEQ ID NO: 162736 - DNA, 25 bp, Mus musculus
agatgtgagttatccaccacccagc

SEQ ID NO: 162737 - DNA, 25 bp, Mus musculus
agatgtgatcttctactgtgctgcc

SEQ ID NO: 162738 - DNA, 25 bp, Mus musculus
agatgtgatcttgtactgtgctgcc

SEQ ID NO: 162739 - DNA, 25 bp, Mus musculus
agatgtgatgccagtgtgctccaga

SEQ ID NO: 162740 - DNA, 25 bp, Mus musculus
agatgtgatgcctgtgtgctccaga

SEQ ID NO: 162741 - DNA, 25 bp, Mus musculus
agatgtgatggtaccttggctgtct

SEQ ID NO: 162742 - DNA, 25 bp, Mus musculus
agatgtgatggttccttggctgtct

SEQ ID NO: 162743 - DNA, 25 bp, Mus musculus
agatgtgatgtcaggtgctcacctg

SEQ ID NO: 162744 - DNA, 25 bp, Mus musculus
agatgtgatgtcattgtccacccaa

SEQ ID NO: 162745 - DNA, 25 bp, Mus musculus
agatgtgatgtctggtgctcacctg

SEQ ID NO: 162746 - DNA, 25 bp, Mus musculus
agatgtgatgtctttgtccacccaa

SEQ ID NO: 162747 - DNA, 25 bp, Mus musculus
agatgtgattcactcactgaaactg

SEQ ID NO: 162748 - DNA, 25 bp, Mus musculus
agatgtgattcagtcactgaaactg

SEQ ID NO: 162749 - DNA, 25 bp, Mus musculus
agatgtgcacagacctgtgtcttat

SEQ ID NO: 162750 - DNA, 25 bp, Mus musculus
agatgtgcacagtcctgtgtcttat

SEQ ID NO: 162751 - DNA, 25 bp, Mus musculus
agatgtgcaccgcttcatttttata

SEQ ID NO: 162752 - DNA, 25 bp, Mus musculus
agatgtgcaccggttcatttttata

SEQ ID NO: 162753 - DNA, 25 bp, Mus musculus
agatgtgcacctcagatggcaagct

SEQ ID NO: 162754 - DNA, 25 bp, Mus musculus
agatgtgcacctgagatggcaagct

SEQ ID NO: 162755 - DNA, 25 bp, Mus musculus
agatgtgcacgactatctccagctg

SEQ ID NO: 162756 - DNA, 25 bp, Mus musculus
agatgtgcacgagtatctccagctg

SEQ ID NO: 162757 - DNA, 25 bp, Mus musculus
agatgtgcatgcatgtctcctaagc

SEQ ID NO: 162758 - DNA, 25 bp, Mus musculus
agatgtgcatgcttgtctcctaagc

SEQ ID NO: 162759 - DNA, 25 bp, Mus musculus
agatgtgcattcacttatacaggca

SEQ ID NO: 162760 - DNA, 25 bp, Mus musculus
agatgtgcattctcttatacaggca

SEQ ID NO: 162761 - DNA, 25 bp, Mus musculus
agatgtgccagcaggaaccatggag

SEQ ID NO: 162762 - DNA, 25 bp, Mus musculus
agatgtgccagctggaaccatggag

SEQ ID NO: 162763 - DNA, 25 bp, Mus musculus
agatgtgccatcaacttgagctagc

SEQ ID NO: 162764 - DNA, 25 bp, Mus musculus
agatgtgccatctacttgagctagc

SEQ ID NO: 162765 - DNA, 25 bp, Mus musculus
agatgtgccctcctgtgacactttt

SEQ ID NO: 162766 - DNA, 25 bp, Mus musculus
agatgtgccctcgtgtgacactttt

SEQ ID NO: 162767 - DNA, 25 bp, Mus musculus
agatgtgccgacacttattccagct

SEQ ID NO: 162768 - DNA, 25 bp, Mus musculus
agatgtgccgactcttattccagct

SEQ ID NO: 162769 - DNA, 25 bp, Mus musculus
agatgtgcctaaagcctgccctacc

SEQ ID NO: 162770 - DNA, 25 bp, Mus musculus
agatgtgcctaatgcctgccctacc

SEQ ID NO: 162771 - DNA, 25 bp, Mus musculus
agatgtgcctcacacgtactttggt

SEQ ID NO: 162772 - DNA, 25 bp, Mus musculus
agatgtgcctcagacgtactttggt

SEQ ID NO: 162773 - DNA, 25 bp, Mus musculus
agatgtgcctctcaccaattagtca

SEQ ID NO: 162774 - DNA, 25 bp, Mus musculus
agatgtgcctctgaccaattagtca

SEQ ID NO: 162775 - DNA, 25 bp, Mus musculus
agatgtgctatgctgccacagacca

SEQ ID NO: 162776 - DNA, 25 bp, Mus musculus
agatgtgctatggtgccacagacca

SEQ ID NO: 162777 - DNA, 25 bp, Mus musculus
agatgtgctcagctcagatgtgctc

SEQ ID NO: 162778 - DNA, 25 bp, Mus musculus
agatgtgctcaggtcagatgtgctc

SEQ ID NO: 162779 - DNA, 25 bp, Mus musculus
agatgtgctggactgctgtctcgtc

SEQ ID NO: 162780 - DNA, 25 bp, Mus musculus
agatgtgctggagtgctgtctcgtc

SEQ ID NO: 162781 - DNA, 25 bp, Mus musculus
agatgtgctgggaaaccggagttat

SEQ ID NO: 162782 - DNA, 25 bp, Mus musculus
agatgtgctgggtaaccggagttat

SEQ ID NO: 162783 - DNA, 25 bp, Mus musculus
agatgtgcttgtcaccatcacctgc

SEQ ID NO: 162784 - DNA, 25 bp, Mus musculus
agatgtgcttgtgaccatcacctgc

SEQ ID NO: 162785 - DNA, 25 bp, Mus musculus
agatgtggacgtctttacctctggc

SEQ ID NO: 162786 - DNA, 25 bp, Mus musculus
agatgtggacgtgtttacctctggc

SEQ ID NO: 162787 - DNA, 25 bp, Mus musculus
agatgtggagatctgggtcatcaca

SEQ ID NO: 162788 - DNA, 25 bp, Mus musculus
agatgtggagatgtgggtcatcaca

SEQ ID NO: 162789 - DNA, 25 bp, Mus musculus
agatgtggattacgaatggctcccc

SEQ ID NO: 162790 - DNA, 25 bp, Mus musculus
agatgtggattaggaatggctcccc

SEQ ID NO: 162791 - DNA, 25 bp, Mus musculus
agatgtggcaacacctggctcttgg

SEQ ID NO: 162792 - DNA, 25 bp, Mus musculus
agatgtggcaactcctggctcttgg

SEQ ID NO: 162793 - DNA, 25 bp, Mus musculus
agatgtggcacacccacctgaagtc

SEQ ID NO: 162794 - DNA, 25 bp, Mus musculus
agatgtggcacagccacctgaagtc

SEQ ID NO: 162795 - DNA, 25 bp, Mus musculus
agatgtggccacagctaaccgctga

SEQ ID NO: 162796 - DNA, 25 bp, Mus musculus
agatgtggccactgctaaccgctga

SEQ ID NO: 162797 - DNA, 25 bp, Mus musculus
agatgtggccccagtagaagagacc

SEQ ID NO: 162798 - DNA, 25 bp, Mus musculus
agatgtggcccctgtagaagagacc

SEQ ID NO: 162799 - DNA, 25 bp, Mus musculus
agatgtggccgtacgtgggaataac

SEQ ID NO: 162800 - DNA, 25 bp, Mus musculus
agatgtggccgttcgtgggaataac

SEQ ID NO: 162801 - DNA, 25 bp, Mus musculus
agatgtggcctcaaaaggcctggac

SEQ ID NO: 162802 - DNA, 25 bp, Mus musculus
agatgtggcctctaaaggcctggac

SEQ ID NO: 162803 - DNA, 25 bp, Mus musculus
agatgtggcctgaggtgactgctct

SEQ ID NO: 162804 - DNA, 25 bp, Mus musculus
agatgtggcctgtggtgactgctct

SEQ ID NO: 162805 - DNA, 25 bp, Mus musculus
agatgtggccttcacgagtttcttc

SEQ ID NO: 162806 - DNA, 25 bp, Mus musculus
agatgtggccttgacgagtttcttc

SEQ ID NO: 162807 - DNA, 25 bp, Mus musculus
agatgtggctaacgccgcattgcga

SEQ ID NO: 162808 - DNA, 25 bp, Mus musculus
agatgtggctaaggccgcattgcga

SEQ ID NO: 162809 - DNA, 25 bp, Mus musculus
agatgtggctccatcatgttctcat

SEQ ID NO: 162810 - DNA, 25 bp, Mus musculus
agatgtggctccttcatgttctcat

SEQ ID NO: 162811 - DNA, 25 bp, Mus musculus
agatgtgggaacacggtccaagaat

SEQ ID NO: 162812 - DNA, 25 bp, Mus musculus
agatgtgggaactcggtccaagaat

SEQ ID NO: 162813 - DNA, 25 bp, Mus musculus
agatgtgggaccaagacgactcttc

SEQ ID NO: 162814 - DNA, 25 bp, Mus musculus
agatgtgggacctagacgactcttc

SEQ ID NO: 162815 - DNA, 25 bp, Mus musculus
agatgtgggatcaattactgctggg

SEQ ID NO: 162816 - DNA, 25 bp, Mus musculus
agatgtgggatctattactgctggg

SEQ ID NO: 162817 - DNA, 25 bp, Mus musculus
agatgtgggcccaagaaccttcaga

SEQ ID NO: 162818 - DNA, 25 bp, Mus musculus
agatgtgggccccttcaacatttag

SEQ ID NO: 162819 - DNA, 25 bp, Mus musculus
agatgtgggcccgttcaacatttag

SEQ ID NO: 162820 - DNA, 25 bp, Mus musculus
agatgtgggccctagaaccttcaga

SEQ ID NO: 162821 - DNA, 25 bp, Mus musculus
agatgtgggtttactgactcctttc

SEQ ID NO: 162822 - DNA, 25 bp, Mus musculus
agatgtgggttttctgactcctttc

SEQ ID NO: 162823 - DNA, 25 bp, Mus musculus
agatgtggtctcagttggcagctta

SEQ ID NO: 162824 - DNA, 25 bp, Mus musculus
agatgtggtctctgttggcagctta

SEQ ID NO: 162825 - DNA, 25 bp, Mus musculus
agatgtggtgccagagcctgtgttc

SEQ ID NO: 162826 - DNA, 25 bp, Mus musculus
agatgtggtgcccaaagatgtgaat

SEQ ID NO: 162827 - DNA, 25 bp, Mus musculus
agatgtggtgccgaaagatgtgaat

SEQ ID NO: 162828 - DNA, 25 bp, Mus musculus
agatgtggtgcctgagcctgtgttc

SEQ ID NO: 162829 - DNA, 25 bp, Mus musculus
agatgtggttcgagattctccctgg

SEQ ID NO: 162830 - DNA, 25 bp, Mus musculus
agatgtggttcgtgattctccctgg

SEQ ID NO: 162831 - DNA, 25 bp, Mus musculus
agatgtgtacagatccaggctactc

SEQ ID NO: 162832 - DNA, 25 bp, Mus musculus
agatgtgtacagttccaggctactc

SEQ ID NO: 162833 - DNA, 25 bp, Mus musculus
agatgtgtaccacagccggtggcca

SEQ ID NO: 162834 - DNA, 25 bp, Mus musculus
agatgtgtaccagagccggtggcca

SEQ ID NO: 162835 - DNA, 25 bp, Mus musculus
agatgtgtagcaagtcccaaccagt

SEQ ID NO: 162836 - DNA, 25 bp, Mus musculus
agatgtgtagcatgtcccaaccagt

SEQ ID NO: 162837 - DNA, 25 bp, Mus musculus
agatgtgtagctcccatgctttttc

SEQ ID NO: 162838 - DNA, 25 bp, Mus musculus
agatgtgtagctgccatgctttttc

SEQ ID NO: 162839 - DNA, 25 bp, Mus musculus
agatgtgtagtgatagctctcacaa

SEQ ID NO: 162840 - DNA, 25 bp, Mus musculus
agatgtgtagtgttagctctcacaa

SEQ ID NO: 162841 - DNA, 25 bp, Mus musculus
agatgtgtagttaaccacacacaca

SEQ ID NO: 162842 - DNA, 25 bp, Mus musculus
agatgtgtagtttaccacacacaca

SEQ ID NO: 162843 - DNA, 25 bp, Mus musculus
agatgtgtcacaaactctcttgaaa

SEQ ID NO: 162844 - DNA, 25 bp, Mus musculus
agatgtgtcacatactctcttgaaa

SEQ ID NO: 162845 - DNA, 25 bp, Mus musculus
agatgtgtcatgagtcactcaggag

SEQ ID NO: 162846 - DNA, 25 bp, Mus musculus
agatgtgtcatgtgtcactcaggag

SEQ ID NO: 162847 - DNA, 25 bp, Mus musculus
agatgtgtcctaaaaccccgtgatg

SEQ ID NO: 162848 - DNA, 25 bp, Mus musculus
agatgtgtcctataaccccgtgatg

SEQ ID NO: 162849 - DNA, 25 bp, Mus musculus
agatgtgtccttatattgcctcgtg

SEQ ID NO: 162850 - DNA, 25 bp, Mus musculus
agatgtgtccttttattgcctcgtg

SEQ ID NO: 162851 - DNA, 25 bp, Mus musculus
agatgtgtctatctgcgttctgcca

SEQ ID NO: 162852 - DNA, 25 bp, Mus musculus
agatgtgtctatgtgcgttctgcca

SEQ ID NO: 162853 - DNA, 25 bp, Mus musculus
agatgtgtctcactatcccttggtg

SEQ ID NO: 162854 - DNA, 25 bp, Mus musculus
agatgtgtctcagtatcccttggtg

SEQ ID NO: 162855 - DNA, 25 bp, Mus musculus
agatgtgtctttcgatccccggttt

SEQ ID NO: 162856 - DNA, 25 bp, Mus musculus
agatgtgtctttggatccccggttt

SEQ ID NO: 162857 - DNA, 25 bp, Mus musculus
agatgtgtgcaacttctattagcaa

SEQ ID NO: 162858 - DNA, 25 bp, Mus musculus
agatgtgtgcaagttctattagcaa

SEQ ID NO: 162859 - DNA, 25 bp, Mus musculus
agatgtgtgcatccttttagagctg

SEQ ID NO: 162860 - DNA, 25 bp, Mus musculus
agatgtgtgcatgcttttagagctg

SEQ ID NO: 162861 - DNA, 25 bp, Mus musculus
agatgtgtgcctaaagttacttact

SEQ ID NO: 162862 - DNA, 25 bp, Mus musculus
agatgtgtgcctcgactctgctggc

SEQ ID NO: 162863 - DNA, 25 bp, Mus musculus
agatgtgtgcctggactctgctggc

SEQ ID NO: 162864 - DNA, 25 bp, Mus musculus
agatgtgtgccttaagttacttact

SEQ ID NO: 162865 - DNA, 25 bp, Mus musculus
agatgtgtgcgtaatccttctgtgc

SEQ ID NO: 162866 - DNA, 25 bp, Mus musculus
agatgtgtgcgttatccttctgtgc

SEQ ID NO: 162867 - DNA, 25 bp, Mus musculus
agatgtgtggaactacccctggatc

SEQ ID NO: 162868 - DNA, 25 bp, Mus musculus
agatgtgtggaagtacccctggatc

SEQ ID NO: 162869 - DNA, 25 bp, Mus musculus
agatgtgtggtcacattcatgtgcc

SEQ ID NO: 162870 - DNA, 25 bp, Mus musculus
agatgtgtggtctcattcatgtgcc

SEQ ID NO: 162871 - DNA, 25 bp, Mus musculus
agatgtgtgtagatcgtgtgtttgt

SEQ ID NO: 162872 - DNA, 25 bp, Mus musculus
agatgtgtgtagttcgtgtgtttgt

SEQ ID NO: 162873 - DNA, 25 bp, Mus musculus
agatgtgtgtccagaaccgccctgt

SEQ ID NO: 162874 - DNA, 25 bp, Mus musculus
agatgtgtgtcctgaaccgccctgt

SEQ ID NO: 162875 - DNA, 25 bp, Mus musculus
agatgtgtgtgacagtgactacagc

SEQ ID NO: 162876 - DNA, 25 bp, Mus musculus
agatgtgtgtgagagtgactacagc

SEQ ID NO: 162877 - DNA, 25 bp, Mus musculus
agatgtgtgtgcactgttcttgcaa

SEQ ID NO: 162878 - DNA, 25 bp, Mus musculus
agatgtgtgtgctctgttcttgcaa

SEQ ID NO: 162879 - DNA, 25 bp, Mus musculus
agatgtgttatgacacccggaacat

SEQ ID NO: 162880 - DNA, 25 bp, Mus musculus
agatgtgttatgtcacccggaacat

SEQ ID NO: 162881 - DNA, 25 bp, Mus musculus
agatgtgttctgacagttctgttcc

SEQ ID NO: 162882 - DNA, 25 bp, Mus musculus
agatgtgttctgtcagttctgttcc

SEQ ID NO: 162883 - DNA, 25 bp, Mus musculus
agatgtgttcttcgcaacaccccaa

SEQ ID NO: 162884 - DNA, 25 bp, Mus musculus
agatgtgttcttggcaacaccccaa

SEQ ID NO: 162885 - DNA, 25 bp, Mus musculus
agatgtgttgctagcctttcccgaa

SEQ ID NO: 162886 - DNA, 25 bp, Mus musculus
agatgtgttgcttgcctttcccgaa

SEQ ID NO: 162887 - DNA, 25 bp, Mus musculus
agatgtgtttgcacacttacgtgag

SEQ ID NO: 162888 - DNA, 25 bp, Mus musculus
agatgtgtttgcatccaccaagagc

SEQ ID NO: 162889 - DNA, 25 bp, Mus musculus
agatgtgtttgctcacttacgtgag

SEQ ID NO: 162890 - DNA, 25 bp, Mus musculus
agatgtgtttgcttccaccaagagc

SEQ ID NO: 162891 - DNA, 25 bp, Mus musculus
agatgtgtttgtctcccaccaacag

SEQ ID NO: 162892 - DNA, 25 bp, Mus musculus
agatgtgtttgtgtcccaccaacag

SEQ ID NO: 162893 - DNA, 25 bp, Mus musculus
agatgtgttttcagcattctgtata

SEQ ID NO: 162894 - DNA, 25 bp, Mus musculus
agatgtgttttctgcattctgtata

SEQ ID NO: 162895 - DNA, 25 bp, Mus musculus
agatgttaacttcagctcttgggac

SEQ ID NO: 162896 - DNA, 25 bp, Mus musculus
agatgttaacttgagctcttgggac

SEQ ID NO: 162897 - DNA, 25 bp, Mus musculus
agatgttaattcatagttgctcagt

SEQ ID NO: 162898 - DNA, 25 bp, Mus musculus
agatgttaattcttagttgctcagt

SEQ ID NO: 162899 - DNA, 25 bp, Mus musculus
agatgttacacaaaatccaaagaca

SEQ ID NO: 162900 - DNA, 25 bp, Mus musculus
agatgttacacataatccaaagaca

SEQ ID NO: 162901 - DNA, 25 bp, Mus musculus
agatgttacactaggtgcctcttga

SEQ ID NO: 162902 - DNA, 25 bp, Mus musculus
agatgttacacttggtgcctcttga

SEQ ID NO: 162903 - DNA, 25 bp, Mus musculus
agatgttacagaacgaatgggtcaa

SEQ ID NO: 162904 - DNA, 25 bp, Mus musculus
agatgttacagatcgaatgggtcaa

SEQ ID NO: 162905 - DNA, 25 bp, Mus musculus
agatgttacatgctgttttgaagcc

SEQ ID NO: 162906 - DNA, 25 bp, Mus musculus
agatgttacatggtgttttgaagcc

SEQ ID NO: 162907 - DNA, 25 bp, Mus musculus
agatgttactggacctcatctctac

SEQ ID NO: 162908 - DNA, 25 bp, Mus musculus
agatgttactggtcctcatctctac

SEQ ID NO: 162909 - DNA, 25 bp, Mus musculus
agatgttagactccacactcgtgca

SEQ ID NO: 162910 - DNA, 25 bp, Mus musculus
agatgttagactgcacactcgtgca

SEQ ID NO: 162911 - DNA, 25 bp, Mus musculus
agatgttatcacaccattcagcctt

SEQ ID NO: 162912 - DNA, 25 bp, Mus musculus
agatgttatcactccattcagcctt

SEQ ID NO: 162913 - DNA, 25 bp, Mus musculus
agatgttatctccttcttgcagcac

SEQ ID NO: 162914 - DNA, 25 bp, Mus musculus
agatgttatctcgttcttgcagcac

SEQ ID NO: 162915 - DNA, 25 bp, Mus musculus
agatgttattgtccctcaagtgtta

SEQ ID NO: 162916 - DNA, 25 bp, Mus musculus
agatgttattgtgcctcaagtgtta

SEQ ID NO: 162917 - DNA, 25 bp, Mus musculus
agatgttcaacaaggctctggtgca

SEQ ID NO: 162918 - DNA, 25 bp, Mus musculus
agatgttcaacatggctctggtgca

SEQ ID NO: 162919 - DNA, 25 bp, Mus musculus
agatgttcaaccaccaaagcagcag

SEQ ID NO: 162920 - DNA, 25 bp, Mus musculus
agatgttcaacctccaaagcagcag

SEQ ID NO: 162921 - DNA, 25 bp, Mus musculus
agatgttcaagtcgctcaccggaag

SEQ ID NO: 162922 - DNA, 25 bp, Mus musculus
agatgttcaagtggctcaccggaag

SEQ ID NO: 162923 - DNA, 25 bp, Mus musculus
agatgttcaattctattcttaaaac

SEQ ID NO: 162924 - DNA, 25 bp, Mus musculus
agatgttcaattgtattcttaaaac

SEQ ID NO: 162925 - DNA, 25 bp, Mus musculus
agatgttcacaccttctgcagagca

SEQ ID NO: 162926 - DNA, 25 bp, Mus musculus
agatgttcacacgttctgcagagca

SEQ ID NO: 162927 - DNA, 25 bp, Mus musculus
agatgttcagtaatattccggccaa

SEQ ID NO: 162928 - DNA, 25 bp, Mus musculus
agatgttcagtattattccggccaa

SEQ ID NO: 162929 - DNA, 25 bp, Mus musculus
agatgttcagttacaggcatgctta

SEQ ID NO: 162930 - DNA, 25 bp, Mus musculus
agatgttcagtttcaggcatgctta

SEQ ID NO: 162931 - DNA, 25 bp, Mus musculus
agatgttcatatcctaactttcctt

SEQ ID NO: 162932 - DNA, 25 bp, Mus musculus
agatgttcatatgctaactttcctt

SEQ ID NO: 162933 - DNA, 25 bp, Mus musculus
agatgttccccaatttctggttcca

SEQ ID NO: 162934 - DNA, 25 bp, Mus musculus
agatgttccccattttctggttcca

SEQ ID NO: 162935 - DNA, 25 bp, Mus musculus
agatgttccgatccactcattaaac

SEQ ID NO: 162936 - DNA, 25 bp, Mus musculus
agatgttccgatgcactcattaaac

SEQ ID NO: 162937 - DNA, 25 bp, Mus musculus
agatgttcctcgcaagctgctgagc

SEQ ID NO: 162938 - DNA, 25 bp, Mus musculus
agatgttcctcggaagctgctgagc

SEQ ID NO: 162939 - DNA, 25 bp, Mus musculus
agatgttcctgtctcctggagccca

SEQ ID NO: 162940 - DNA, 25 bp, Mus musculus
agatgttcctgtgtcctggagccca

SEQ ID NO: 162941 - DNA, 25 bp, Mus musculus
agatgttccttcatgcctatgctgt

SEQ ID NO: 162942 - DNA, 25 bp, Mus musculus
agatgttccttcttgcctatgctgt

SEQ ID NO: 162943 - DNA, 25 bp, Mus musculus
agatgttctctgaacctctggattc

SEQ ID NO: 162944 - DNA, 25 bp, Mus musculus
agatgttctctgtacctctggattc

SEQ ID NO: 162945 - DNA, 25 bp, Mus musculus
agatgttctgcgcttgctccaagca

SEQ ID NO: 162946 - DNA, 25 bp, Mus musculus
agatgttctgcggttgctccaagca

SEQ ID NO: 162947 - DNA, 25 bp, Mus musculus
agatgttctgttcgcttggagctct

SEQ ID NO: 162948 - DNA, 25 bp, Mus musculus
agatgttctgttggcttggagctct

SEQ ID NO: 162949 - DNA, 25 bp, Mus musculus
agatgttgaagtctagctctacgca

SEQ ID NO: 162950 - DNA, 25 bp, Mus musculus
agatgttgaagtgtagctctacgca

SEQ ID NO: 162951 - DNA, 25 bp, Mus musculus
agatgttgagcgcaatgcctcctct

SEQ ID NO: 162952 - DNA, 25 bp, Mus musculus
agatgttgagcggaatgcctcctct

SEQ ID NO: 162953 - DNA, 25 bp, Mus musculus
agatgttgagtgactgtgctgcccc

SEQ ID NO: 162954 - DNA, 25 bp, Mus musculus
agatgttgagtgtctgtgctgcccc

SEQ ID NO: 162955 - DNA, 25 bp, Mus musculus
agatgttgatctatttgctggcacc

SEQ ID NO: 162956 - DNA, 25 bp, Mus musculus
agatgttgatctttttgctggcacc

SEQ ID NO: 162957 - DNA, 25 bp, Mus musculus
agatgttgcaaaccagctgaaggag

SEQ ID NO: 162958 - DNA, 25 bp, Mus musculus
agatgttgcaaagcagctgaaggag

SEQ ID NO: 162959 - DNA, 25 bp, Mus musculus
agatgttgccccagcagctgagcac

SEQ ID NO: 162960 - DNA, 25 bp, Mus musculus
agatgttgcccctgcagctgagcac

SEQ ID NO: 162961 - DNA, 25 bp, Mus musculus
agatgttgccctaatagcaccactc

SEQ ID NO: 162962 - DNA, 25 bp, Mus musculus
agatgttgcccttatagcaccactc

SEQ ID NO: 162963 - DNA, 25 bp, Mus musculus
agatgttgcgagaaatggacctcaa

SEQ ID NO: 162964 - DNA, 25 bp, Mus musculus
agatgttgcgagtaatggacctcaa

SEQ ID NO: 162965 - DNA, 25 bp, Mus musculus
agatgttgcttcattgtgctcacaa

SEQ ID NO: 162966 - DNA, 25 bp, Mus musculus
agatgttgcttctttgtgctcacaa

SEQ ID NO: 162967 - DNA, 25 bp, Mus musculus
agatgttggatgctctgacggacac

SEQ ID NO: 162968 - DNA, 25 bp, Mus musculus
agatgttggatggtctgacggacac

SEQ ID NO: 162969 - DNA, 25 bp, Mus musculus
agatgttggcccagttctgagctca

SEQ ID NO: 162970 - DNA, 25 bp, Mus musculus
agatgttggccctgttctgagctca

SEQ ID NO: 162971 - DNA, 25 bp, Mus musculus
agatgttgggcaaatgaccctttat

SEQ ID NO: 162972 - DNA, 25 bp, Mus musculus
agatgttgggcatatgaccctttat

SEQ ID NO: 162973 - DNA, 25 bp, Mus musculus
agatgttgtcaactgtccgcagcca

SEQ ID NO: 162974 - DNA, 25 bp, Mus musculus
agatgttgtcaagtgtccgcagcca

SEQ ID NO: 162975 - DNA, 25 bp, Mus musculus
agatgttgtcacagcaatgggttct

SEQ ID NO: 162976 - DNA, 25 bp, Mus musculus
agatgttgtcactgcaatgggttct

SEQ ID NO: 162977 - DNA, 25 bp, Mus musculus
agatgttgtcagacatcccagtagt

SEQ ID NO: 162978 - DNA, 25 bp, Mus musculus
agatgttgtcagtcatcccagtagt

SEQ ID NO: 162979 - DNA, 25 bp, Mus musculus
agatgttgtgttacccagtctggca

SEQ ID NO: 162980 - DNA, 25 bp, Mus musculus
agatgttgtgtttcccagtctggca

SEQ ID NO: 162981 - DNA, 25 bp, Mus musculus
agatgttgttggattggacctggaa

SEQ ID NO: 162982 - DNA, 25 bp, Mus musculus
agatgttgttggtttggacctggaa

SEQ ID NO: 162983 - DNA, 25 bp, Mus musculus
agatgttgttttacgtgggctgagc

SEQ ID NO: 162984 - DNA, 25 bp, Mus musculus
agatgttgtttttcgtgggctgagc

SEQ ID NO: 162985 - DNA, 25 bp, Mus musculus
agatgtttaaatcctgatgcccaag

SEQ ID NO: 162986 - DNA, 25 bp, Mus musculus
agatgtttaaatgctgatgcccaag

SEQ ID NO: 162987 - DNA, 25 bp, Mus musculus
agatgtttaactctgatccactgtg

SEQ ID NO: 162988 - DNA, 25 bp, Mus musculus
agatgtttaactgtgatccactgtg

SEQ ID NO: 162989 - DNA, 25 bp, Mus musculus
agatgtttaccaatcagtatatcaa

SEQ ID NO: 162990 - DNA, 25 bp, Mus musculus
agatgtttaccattcagtatatcaa

SEQ ID NO: 162991 - DNA, 25 bp, Mus musculus
agatgtttattgatgcccagttgcc

SEQ ID NO: 162992 - DNA, 25 bp, Mus musculus
agatgtttattgttgcccagttgcc

SEQ ID NO: 162993 - DNA, 25 bp, Mus musculus
agatgtttcaatccctcatgataca

SEQ ID NO: 162994 - DNA, 25 bp, Mus musculus
agatgtttcaatgcctcatgataca

SEQ ID NO: 162995 - DNA, 25 bp, Mus musculus
agatgtttcactcacattccttcta

SEQ ID NO: 162996 - DNA, 25 bp, Mus musculus
agatgtttcactcacttctgcctga

SEQ ID NO: 162997 - DNA, 25 bp, Mus musculus
agatgtttcactgacattccttcta

SEQ ID NO: 162998 - DNA, 25 bp, Mus musculus
agatgtttcactgacttctgcctga

SEQ ID NO: 162999 - DNA, 25 bp, Mus musculus
agatgtttcagcctggttttttgtt

SEQ ID NO: 163000 - DNA, 25 bp, Mus musculus
agatgtttcagcgtggttttttgtt

SEQ ID NO: 163001 - DNA, 25 bp, Mus musculus
agatgtttccacaccagccgggtgg

SEQ ID NO: 163002 - DNA, 25 bp, Mus musculus
agatgtttccactccagccgggtgg

SEQ ID NO: 163003 - DNA, 25 bp, Mus musculus
agatgtttcctactcaggtccttat

SEQ ID NO: 163004 - DNA, 25 bp, Mus musculus
agatgtttcctagtcaggtccttat

SEQ ID NO: 163005 - DNA, 25 bp, Mus musculus
agatgtttctaaaagccgtgctgaa

SEQ ID NO: 163006 - DNA, 25 bp, Mus musculus
agatgtttctaatagccgtgctgaa

SEQ ID NO: 163007 - DNA, 25 bp, Mus musculus
agatgtttctgtatgctaatcctgc

SEQ ID NO: 163008 - DNA, 25 bp, Mus musculus
agatgtttctgtctcaaccttctgc

SEQ ID NO: 163009 - DNA, 25 bp, Mus musculus
agatgtttctgtgtcaaccttctgc

SEQ ID NO: 163010 - DNA, 25 bp, Mus musculus
agatgtttctgtttgctaatcctgc

SEQ ID NO: 163011 - DNA, 25 bp, Mus musculus
agatgtttgatacctgcatttgcag

SEQ ID NO: 163012 - DNA, 25 bp, Mus musculus
agatgtttgatagctgcatttgcag

SEQ ID NO: 163013 - DNA, 25 bp, Mus musculus
agatgtttgcagagcggctggccaa

SEQ ID NO: 163014 - DNA, 25 bp, Mus musculus
agatgtttgcagctttcccgccaga

SEQ ID NO: 163015 - DNA, 25 bp, Mus musculus
agatgtttgcaggtttcccgccaga

SEQ ID NO: 163016 - DNA, 25 bp, Mus musculus
agatgtttgcagtgcggctggccaa

SEQ ID NO: 163017 - DNA, 25 bp, Mus musculus
agatgtttgccaataaacctcaact

SEQ ID NO: 163018 - DNA, 25 bp, Mus musculus
agatgtttgccattaaacctcaact

SEQ ID NO: 163019 - DNA, 25 bp, Mus musculus
agatgtttgcctagcttttccttaa

SEQ ID NO: 163020 - DNA, 25 bp, Mus musculus
agatgtttgccttgcttttccttaa

SEQ ID NO: 163021 - DNA, 25 bp, Mus musculus
agatgtttggaaccatgcctggctc

SEQ ID NO: 163022 - DNA, 25 bp, Mus musculus
agatgtttggaagcatgcctggctc

SEQ ID NO: 163023 - DNA, 25 bp, Mus musculus
agatgtttgggaactggaccttcgg

SEQ ID NO: 163024 - DNA, 25 bp, Mus musculus
agatgtttgggatctggaccttcgg

SEQ ID NO: 163025 - DNA, 25 bp, Mus musculus
agatgtttggtcatgccgacaggct

SEQ ID NO: 163026 - DNA, 25 bp, Mus musculus
agatgtttggtcttgccgacaggct

SEQ ID NO: 163027 - DNA, 25 bp, Mus musculus
agatgtttgtgacccgccacaggac

SEQ ID NO: 163028 - DNA, 25 bp, Mus musculus
agatgtttgtgagccgccacaggac

SEQ ID NO: 163029 - DNA, 25 bp, Mus musculus
agatgtttgtggcacctggttgcta

SEQ ID NO: 163030 - DNA, 25 bp, Mus musculus
agatgtttgtgggacctggttgcta

SEQ ID NO: 163031 - DNA, 25 bp, Mus musculus
agatgttttaatacggagccagctg

SEQ ID NO: 163032 - DNA, 25 bp, Mus musculus
agatgttttaattcggagccagctg

SEQ ID NO: 163033 - DNA, 25 bp, Mus musculus
agatgttttccactggcagcgggaa

SEQ ID NO: 163034 - DNA, 25 bp, Mus musculus
agatgttttccagtggcagcgggaa

SEQ ID NO: 163035 - DNA, 25 bp, Mus musculus
agatgttttcgaaggcagtataatt

SEQ ID NO: 163036 - DNA, 25 bp, Mus musculus
agatgttttcgaaggtaaggctgta

SEQ ID NO: 163037 - DNA, 25 bp, Mus musculus
agatgttttcgatggcagtataatt

SEQ ID NO: 163038 - DNA, 25 bp, Mus musculus
agatgttttcgatggtaaggctgta

SEQ ID NO: 163039 - DNA, 25 bp, Mus musculus
agatgttttctcactatctcacagg

SEQ ID NO: 163040 - DNA, 25 bp, Mus musculus
agatgttttctctctatctcacagg

SEQ ID NO: 163041 - DNA, 25 bp, Mus musculus
agatgttttctgaatgtagccaaag

SEQ ID NO: 163042 - DNA, 25 bp, Mus musculus
agatgttttctgtatgtagccaaag

SEQ ID NO: 163043 - DNA, 25 bp, Mus musculus
agatgttttggaaaggcctcaagct

SEQ ID NO: 163044 - DNA, 25 bp, Mus musculus
agatgttttggataggcctcaagct

SEQ ID NO: 163045 - DNA, 25 bp, Mus musculus
agatgttttggccacttgaccaggc

SEQ ID NO: 163046 - DNA, 25 bp, Mus musculus
agatgttttggcgacttgaccaggc

SEQ ID NO: 163047 - DNA, 25 bp, Mus musculus
agatgtttttcgctcaccatcataa

SEQ ID NO: 163048 - DNA, 25 bp, Mus musculus
agatgtttttcggtcaccatcataa

SEQ ID NO: 163049 - DNA, 25 bp, Mus musculus
agatgtttttctcttcattatcgaa

SEQ ID NO: 163050 - DNA, 25 bp, Mus musculus
agatgtttttctgttcattatcgaa

SEQ ID NO: 163051 - DNA, 25 bp, Mus musculus
agattaaaccacacagcctctaaat

SEQ ID NO: 163052 - DNA, 25 bp, Mus musculus
agattaaaccactcagcctctaaat

SEQ ID NO: 163053 - DNA, 25 bp, Mus musculus
agattaacaggtcctcatttcccag

SEQ ID NO: 163054 - DNA, 25 bp, Mus musculus
agattaacaggtgctcatttcccag

SEQ ID NO: 163055 - DNA, 25 bp, Mus musculus
agattaaccaacaacctgctggagt

SEQ ID NO: 163056 - DNA, 25 bp, Mus musculus
agattaaccaactacctgctggagt

SEQ ID NO: 163057 - DNA, 25 bp, Mus musculus
agattaaccaagaggccttcccagt

SEQ ID NO: 163058 - DNA, 25 bp, Mus musculus
agattaaccaagtggccttcccagt

SEQ ID NO: 163059 - DNA, 25 bp, Mus musculus
agattaacccacagtctgactgttc

SEQ ID NO: 163060 - DNA, 25 bp, Mus musculus
agattaacccactgtctgactgttc

SEQ ID NO: 163061 - DNA, 25 bp, Mus musculus
agattaacctcaacctgacgtgtgt

SEQ ID NO: 163062 - DNA, 25 bp, Mus musculus
agattaacctcatcctgacgtgtgt

SEQ ID NO: 163063 - DNA, 25 bp, Mus musculus
agattaacttctaccaggaccacac

SEQ ID NO: 163064 - DNA, 25 bp, Mus musculus
agattaacttcttccaggaccacac

SEQ ID NO: 163065 - DNA, 25 bp, Mus musculus
agattaagagctagcctcaccacca

SEQ ID NO: 163066 - DNA, 25 bp, Mus musculus
agattaagagcttgcctcaccacca

SEQ ID NO: 163067 - DNA, 25 bp, Mus musculus
agattaagcttgaatcctccatgtg

SEQ ID NO: 163068 - DNA, 25 bp, Mus musculus
agattaagcttgtatcctccatgtg

SEQ ID NO: 163069 - DNA, 25 bp, Mus musculus
agattaagggcaccctggtgttttg

SEQ ID NO: 163070 - DNA, 25 bp, Mus musculus
agattaagggcagcctggtgttttg

SEQ ID NO: 163071 - DNA, 25 bp, Mus musculus
agattaatcttaatccttgacaagt

SEQ ID NO: 163072 - DNA, 25 bp, Mus musculus
agattaatcttattccttgacaagt

SEQ ID NO: 163073 - DNA, 25 bp, Mus musculus
agattaatcttcatatggcctctat

SEQ ID NO: 163074 - DNA, 25 bp, Mus musculus
agattaatcttcttatggcctctat

SEQ ID NO: 163075 - DNA, 25 bp, Mus musculus
agattaatgcagaacctcctccatt

SEQ ID NO: 163076 - DNA, 25 bp, Mus musculus
agattaatgcagtacctcctccatt

SEQ ID NO: 163077 - DNA, 25 bp, Mus musculus
agattaatgtccacactttctgcat

SEQ ID NO: 163078 - DNA, 25 bp, Mus musculus
agattaatgtcctcactttctgcat

SEQ ID NO: 163079 - DNA, 25 bp, Mus musculus
agattacagcatacttctcctgtcc

SEQ ID NO: 163080 - DNA, 25 bp, Mus musculus
agattacagcattcttctcctgtcc

SEQ ID NO: 163081 - DNA, 25 bp, Mus musculus
agattacagcttcttacttcctccc

SEQ ID NO: 163082 - DNA, 25 bp, Mus musculus
agattacagcttgttacttcctccc

SEQ ID NO: 163083 - DNA, 25 bp, Mus musculus
agattacaggtaaattgttttggta

SEQ ID NO: 163084 - DNA, 25 bp, Mus musculus
agattacaggtatattgttttggta

SEQ ID NO: 163085 - DNA, 25 bp, Mus musculus
agattacatattctcctcagcagcc

SEQ ID NO: 163086 - DNA, 25 bp, Mus musculus
agattacatattgtcctcagcagcc

SEQ ID NO: 163087 - DNA, 25 bp, Mus musculus
agattaccgactcactttcttggtt

SEQ ID NO: 163088 - DNA, 25 bp, Mus musculus
agattaccgactgactttcttggtt

SEQ ID NO: 163089 - DNA, 25 bp, Mus musculus
agattacctaccagtgggagtccca

SEQ ID NO: 163090 - DNA, 25 bp, Mus musculus
agattacctacctgtgggagtccca

SEQ ID NO: 163091 - DNA, 25 bp, Mus musculus
agattaccttccagacccacttgat

SEQ ID NO: 163092 - DNA, 25 bp, Mus musculus
agattaccttcctgacccacttgat

SEQ ID NO: 163093 - DNA, 25 bp, Mus musculus
agattacgccagcaccccttgaggg

SEQ ID NO: 163094 - DNA, 25 bp, Mus musculus
agattacgccaggaccccttgaggg

SEQ ID NO: 163095 - DNA, 25 bp, Mus musculus
agattacggggtcctaactctgccc

SEQ ID NO: 163096 - DNA, 25 bp, Mus musculus
agattacggggtgctaactctgccc

SEQ ID NO: 163097 - DNA, 25 bp, Mus musculus
agattactagatccgccgggcgtag

SEQ ID NO: 163098 - DNA, 25 bp, Mus musculus
agattactagatgcgccgggcgtag

SEQ ID NO: 163099 - DNA, 25 bp, Mus musculus
agattactcaaaatcccatcaccac

SEQ ID NO: 163100 - DNA, 25 bp, Mus musculus
agattactcaaattcccatcaccac

SEQ ID NO: 163101 - DNA, 25 bp, Mus musculus
agattactgtaacccttatcttatt

SEQ ID NO: 163102 - DNA, 25 bp, Mus musculus
agattactgtaagccttatcttatt

SEQ ID NO: 163103 - DNA, 25 bp, Mus musculus
agattacttcgacatgtttgctccc

SEQ ID NO: 163104 - DNA, 25 bp, Mus musculus
agattacttcgagatgtttgctccc

SEQ ID NO: 163105 - DNA, 25 bp, Mus musculus
agattacttgcaagccaggagccca

SEQ ID NO: 163106 - DNA, 25 bp, Mus musculus
agattacttgcatgccaggagccca

SEQ ID NO: 163107 - DNA, 25 bp, Mus musculus
agattactttcacagacttgttaga

SEQ ID NO: 163108 - DNA, 25 bp, Mus musculus
agattactttcagagacttgttaga

SEQ ID NO: 163109 - DNA, 25 bp, Mus musculus
agattactttccactgctgtatcat

SEQ ID NO: 163110 - DNA, 25 bp, Mus musculus
agattactttcctctgctgtatcat

SEQ ID NO: 163111 - DNA, 25 bp, Mus musculus
agattagaacagagaccgtggtgtc

SEQ ID NO: 163112 - DNA, 25 bp, Mus musculus
agattagaacagtgaccgtggtgtc

SEQ ID NO: 163113 - DNA, 25 bp, Mus musculus
agattagagcctatgttctgacact

SEQ ID NO: 163114 - DNA, 25 bp, Mus musculus
agattagagcctttgttctgacact

SEQ ID NO: 163115 - DNA, 25 bp, Mus musculus
agattagaggaaccctggaactcac

SEQ ID NO: 163116 - DNA, 25 bp, Mus musculus
agattagaggaagcctggaactcac

SEQ ID NO: 163117 - DNA, 25 bp, Mus musculus
agattagataccagctgtgctctcc

SEQ ID NO: 163118 - DNA, 25 bp, Mus musculus
agattagatacctgctgtgctctcc

SEQ ID NO: 163119 - DNA, 25 bp, Mus musculus
agattagatcttaggctgcaggcag

SEQ ID NO: 163120 - DNA, 25 bp, Mus musculus
agattagatctttggctgcaggcag

SEQ ID NO: 163121 - DNA, 25 bp, Mus musculus
agattagattatctctgcctcccga

SEQ ID NO: 163122 - DNA, 25 bp, Mus musculus
agattagattatgtctgcctcccga

SEQ ID NO: 163123 - DNA, 25 bp, Mus musculus
agattagattggagtccatggctgt

SEQ ID NO: 163124 - DNA, 25 bp, Mus musculus
agattagattggtgtccatggctgt

SEQ ID NO: 163125 - DNA, 25 bp, Mus musculus
agattagattgtacgcccactgggc

SEQ ID NO: 163126 - DNA, 25 bp, Mus musculus
agattagattgttcgcccactgggc

SEQ ID NO: 163127 - DNA, 25 bp, Mus musculus
agattagcaccaactgtcctcttgg

SEQ ID NO: 163128 - DNA, 25 bp, Mus musculus
agattagcaccatctgtcctcttgg

SEQ ID NO: 163129 - DNA, 25 bp, Mus musculus
agattagcactgactggagccttaa

SEQ ID NO: 163130 - DNA, 25 bp, Mus musculus
agattagcactgtctggagccttaa

SEQ ID NO: 163131 - DNA, 25 bp, Mus musculus
agattagcagatcaaatacttcccc

SEQ ID NO: 163132 - DNA, 25 bp, Mus musculus
agattagcagatgaaatacttcccc

SEQ ID NO: 163133 - DNA, 25 bp, Mus musculus
agattagctctcaagctgctgagcc

SEQ ID NO: 163134 - DNA, 25 bp, Mus musculus
agattagctctctagctgctgagcc

SEQ ID NO: 163135 - DNA, 25 bp, Mus musculus
agattagcttccagcttcagttgca

SEQ ID NO: 163136 - DNA, 25 bp, Mus musculus
agattagcttcctgcttcagttgca

SEQ ID NO: 163137 - DNA, 25 bp, Mus musculus
agattaggcatcattccttccatat

SEQ ID NO: 163138 - DNA, 25 bp, Mus musculus
agattaggcatctttccttccatat

SEQ ID NO: 163139 - DNA, 25 bp, Mus musculus
agattaggccctcgacacaagcgac

SEQ ID NO: 163140 - DNA, 25 bp, Mus musculus
agattaggccctggacacaagcgac

SEQ ID NO: 163141 - DNA, 25 bp, Mus musculus
agattaggttgccaagtctgctcca

SEQ ID NO: 163142 - DNA, 25 bp, Mus musculus
agattaggttgcgaagtctgctcca

SEQ ID NO: 163143 - DNA, 25 bp, Mus musculus
agattagtatctccttcccctcttt

SEQ ID NO: 163144 - DNA, 25 bp, Mus musculus
agattagtatctgcttcccctcttt

SEQ ID NO: 163145 - DNA, 25 bp, Mus musculus
agattagtcagaccttgaactcaga

SEQ ID NO: 163146 - DNA, 25 bp, Mus musculus
agattagtcagagcttgaactcaga

SEQ ID NO: 163147 - DNA, 25 bp, Mus musculus
agattagtcctccatttccagctat

SEQ ID NO: 163148 - DNA, 25 bp, Mus musculus
agattagtcctcgatttccagctat

SEQ ID NO: 163149 - DNA, 25 bp, Mus musculus
agattagtcgcaaacaaggcttgta

SEQ ID NO: 163150 - DNA, 25 bp, Mus musculus
agattagtcgcatacaaggcttgta

SEQ ID NO: 163151 - DNA, 25 bp, Mus musculus
agattagtgggaattgccctcagaa

SEQ ID NO: 163152 - DNA, 25 bp, Mus musculus
agattagtgggatttgccctcagaa

SEQ ID NO: 163153 - DNA, 25 bp, Mus musculus
agattatacattcctcattttaccg

SEQ ID NO: 163154 - DNA, 25 bp, Mus musculus
agattatacattgctcattttaccg

SEQ ID NO: 163155 - DNA, 25 bp, Mus musculus
agattatagatacgttgccactgaa

SEQ ID NO: 163156 - DNA, 25 bp, Mus musculus
agattatagataggttgccactgaa

SEQ ID NO: 163157 - DNA, 25 bp, Mus musculus
agattatattctatggctgttgtaa

SEQ ID NO: 163158 - DNA, 25 bp, Mus musculus
agattatattctttggctgttgtaa

SEQ ID NO: 163159 - DNA, 25 bp, Mus musculus
agattatcagcgagcgggacacact

SEQ ID NO: 163160 - DNA, 25 bp, Mus musculus
agattatcagcgtgcgggacacact

SEQ ID NO: 163161 - DNA, 25 bp, Mus musculus
agattatccagtcccaggtattttg

SEQ ID NO: 163162 - DNA, 25 bp, Mus musculus
agattatccagtgccaggtattttg

SEQ ID NO: 163163 - DNA, 25 bp, Mus musculus
agattatccattccccgatgtcctc

SEQ ID NO: 163164 - DNA, 25 bp, Mus musculus
agattatccattgcccgatgtcctc

SEQ ID NO: 163165 - DNA, 25 bp, Mus musculus
agattatcgttcacttaaagtgcca

SEQ ID NO: 163166 - DNA, 25 bp, Mus musculus
agattatcgttctcttaaagtgcca

SEQ ID NO: 163167 - DNA, 25 bp, Mus musculus
agattatctgtgaagtgctgtattc

SEQ ID NO: 163168 - DNA, 25 bp, Mus musculus
agattatctgtgtagtgctgtattc

SEQ ID NO: 163169 - DNA, 25 bp, Mus musculus
agattatctgttaatcacttcccac

SEQ ID NO: 163170 - DNA, 25 bp, Mus musculus
agattatctgtttatcacttcccac

SEQ ID NO: 163171 - DNA, 25 bp, Mus musculus
agattatgatgcagctgcttcctaa

SEQ ID NO: 163172 - DNA, 25 bp, Mus musculus
agattatgatgctgctgcttcctaa

SEQ ID NO: 163173 - DNA, 25 bp, Mus musculus
agattatggatcaggaaacgccgga

SEQ ID NO: 163174 - DNA, 25 bp, Mus musculus
agattatggatctggaaacgccgga

SEQ ID NO: 163175 - DNA, 25 bp, Mus musculus
agattatggcctcgagcaagcgctg

SEQ ID NO: 163176 - DNA, 25 bp, Mus musculus
agattatggcctggagcaagcgctg

SEQ ID NO: 163177 - DNA, 25 bp, Mus musculus
agattatgggctctacagggtgcca

SEQ ID NO: 163178 - DNA, 25 bp, Mus musculus
agattatgggctgtacagggtgcca

SEQ ID NO: 163179 - DNA, 25 bp, Mus musculus
agattatgtgaacctcccaccgaat

SEQ ID NO: 163180 - DNA, 25 bp, Mus musculus
agattatgtgaagctcccaccgaat

SEQ ID NO: 163181 - DNA, 25 bp, Mus musculus
agattattgttcagtgccaagctca

SEQ ID NO: 163182 - DNA, 25 bp, Mus musculus
agattattgttctgtgccaagctca

SEQ ID NO: 163183 - DNA, 25 bp, Mus musculus
agattatttaagctttatgctgcac

SEQ ID NO: 163184 - DNA, 25 bp, Mus musculus
agattatttaaggtttatgctgcac

SEQ ID NO: 163185 - DNA, 25 bp, Mus musculus
agattattttgtatgcaggttccag

SEQ ID NO: 163186 - DNA, 25 bp, Mus musculus
agattattttgtttgcaggttccag

SEQ ID NO: 163187 - DNA, 25 bp, Mus musculus
agattcaaacgtcctccctccatgt

SEQ ID NO: 163188 - DNA, 25 bp, Mus musculus
agattcaaacgtgctccctccatgt

SEQ ID NO: 163189 - DNA, 25 bp, Mus musculus
agattcaaactcatagcttcttgta

SEQ ID NO: 163190 - DNA, 25 bp, Mus musculus
agattcaaactcttagcttcttgta

SEQ ID NO: 163191 - DNA, 25 bp, Mus musculus
agattcaaaggaatccttaccaaag

SEQ ID NO: 163192 - DNA, 25 bp, Mus musculus
agattcaaaggaccaccgacctgga

SEQ ID NO: 163193 - DNA, 25 bp, Mus musculus
agattcaaaggagcaccgacctgga

SEQ ID NO: 163194 - DNA, 25 bp, Mus musculus
agattcaaaggattccttaccaaag

SEQ ID NO: 163195 - DNA, 25 bp, Mus musculus
agattcaaccctcttgtggtcccag

SEQ ID NO: 163196 - DNA, 25 bp, Mus musculus
agattcaaccctgttgtggtcccag

SEQ ID NO: 163197 - DNA, 25 bp, Mus musculus
agattcaacgttcctttcatgtgca

SEQ ID NO: 163198 - DNA, 25 bp, Mus musculus
agattcaacgttgctttcatgtgca

SEQ ID NO: 163199 - DNA, 25 bp, Mus musculus
agattcaactccatgttaaccacac

SEQ ID NO: 163200 - DNA, 25 bp, Mus musculus
agattcaactccttgttaaccacac

SEQ ID NO: 163201 - DNA, 25 bp, Mus musculus
agattcaagcatacacccttggcct

SEQ ID NO: 163202 - DNA, 25 bp, Mus musculus
agattcaagcattcacccttggcct

SEQ ID NO: 163203 - DNA, 25 bp, Mus musculus
agattcaatattactccttcaccca

SEQ ID NO: 163204 - DNA, 25 bp, Mus musculus
agattcaatatttctccttcaccca

SEQ ID NO: 163205 - DNA, 25 bp, Mus musculus
agattcaatcagaccatgcattcta

SEQ ID NO: 163206 - DNA, 25 bp, Mus musculus
agattcaatcagtccatgcattcta

SEQ ID NO: 163207 - DNA, 25 bp, Mus musculus
agattcacaggcagttccccaggaa

SEQ ID NO: 163208 - DNA, 25 bp, Mus musculus
agattcacaggctgttccccaggaa

SEQ ID NO: 163209 - DNA, 25 bp, Mus musculus
agattcacagtcacaacaccaagcg

SEQ ID NO: 163210 - DNA, 25 bp, Mus musculus
agattcacagtctcaacaccaagcg

SEQ ID NO: 163211 - DNA, 25 bp, Mus musculus
agattcacatgcagccacatccaat

SEQ ID NO: 163212 - DNA, 25 bp, Mus musculus
agattcacatgctgccacatccaat

SEQ ID NO: 163213 - DNA, 25 bp, Mus musculus
agattcaccataatgctcttcacat

SEQ ID NO: 163214 - DNA, 25 bp, Mus musculus
agattcaccatattgctcttcacat

SEQ ID NO: 163215 - DNA, 25 bp, Mus musculus
agattcaccctaccggtagctgacc

SEQ ID NO: 163216 - DNA, 25 bp, Mus musculus
agattcaccctagcggtagctgacc

SEQ ID NO: 163217 - DNA, 25 bp, Mus musculus
agattcacggcaagctctggcagtg

SEQ ID NO: 163218 - DNA, 25 bp, Mus musculus
agattcacggcatgctctggcagtg

SEQ ID NO: 163219 - DNA, 25 bp, Mus musculus
agattcacggtgagctgcacagggt

SEQ ID NO: 163220 - DNA, 25 bp, Mus musculus
agattcacggtgtgctgcacagggt

SEQ ID NO: 163221 - DNA, 25 bp, Mus musculus
agattcactatgcttccaagggctc

SEQ ID NO: 163222 - DNA, 25 bp, Mus musculus
agattcactatggttccaagggctc

SEQ ID NO: 163223 - DNA, 25 bp, Mus musculus
agattcactctgaccagctcagtaa

SEQ ID NO: 163224 - DNA, 25 bp, Mus musculus
agattcactctgtccagctcagtaa

SEQ ID NO: 163225 - DNA, 25 bp, Mus musculus
agattcactttccaattctgattta

SEQ ID NO: 163226 - DNA, 25 bp, Mus musculus
agattcactttcgaattctgattta

SEQ ID NO: 163227 - DNA, 25 bp, Mus musculus
agattcagacccagaagtgctcact

SEQ ID NO: 163228 - DNA, 25 bp, Mus musculus
agattcagaccctgaagtgctcact

SEQ ID NO: 163229 - DNA, 25 bp, Mus musculus
agattcagagcaaggccggctcttg

SEQ ID NO: 163230 - DNA, 25 bp, Mus musculus
agattcagagcatggccggctcttg

SEQ ID NO: 163231 - DNA, 25 bp, Mus musculus
agattcagagcgatagggtccccgg

SEQ ID NO: 163232 - DNA, 25 bp, Mus musculus
agattcagagcgttagggtccccgg

SEQ ID NO: 163233 - DNA, 25 bp, Mus musculus
agattcagcaaccagggagtagcct

SEQ ID NO: 163234 - DNA, 25 bp, Mus musculus
agattcagcaacgagggagtagcct

SEQ ID NO: 163235 - DNA, 25 bp, Mus musculus
agattcagcctcatggctgtcgata

SEQ ID NO: 163236 - DNA, 25 bp, Mus musculus
agattcagcctcttggctgtcgata

SEQ ID NO: 163237 - DNA, 25 bp, Mus musculus
agattcagggaaacctctctactca

SEQ ID NO: 163238 - DNA, 25 bp, Mus musculus
agattcagggaatcctctctactca

SEQ ID NO: 163239 - DNA, 25 bp, Mus musculus
agattcagggtcctgatggagacaa

SEQ ID NO: 163240 - DNA, 25 bp, Mus musculus
agattcagggtcgtgatggagacaa

SEQ ID NO: 163241 - DNA, 25 bp, Mus musculus
agattcaggtgcagttttgggtttt

SEQ ID NO: 163242 - DNA, 25 bp, Mus musculus
agattcaggtgctgttttgggtttt

SEQ ID NO: 163243 - DNA, 25 bp, Mus musculus
agattcagtcagagcgccaccctca

SEQ ID NO: 163244 - DNA, 25 bp, Mus musculus
agattcagtcagtgcgccaccctca

SEQ ID NO: 163245 - DNA, 25 bp, Mus musculus
agattcagtccacctaatatagcag

SEQ ID NO: 163246 - DNA, 25 bp, Mus musculus
agattcagtccagctaatatagcag

SEQ ID NO: 163247 - DNA, 25 bp, Mus musculus
agattcagtgggaaatcctgtctca

SEQ ID NO: 163248 - DNA, 25 bp, Mus musculus
agattcagtgggtaatcctgtctca

SEQ ID NO: 163249 - DNA, 25 bp, Mus musculus
agattcatcaatcctgccattgtct

SEQ ID NO: 163250 - DNA, 25 bp, Mus musculus
agattcatcaatgctgccattgtct

SEQ ID NO: 163251 - DNA, 25 bp, Mus musculus
agattcatcacactagccctgcatg

SEQ ID NO: 163252 - DNA, 25 bp, Mus musculus
agattcatcacagtagccctgcatg

SEQ ID NO: 163253 - DNA, 25 bp, Mus musculus
agattcatcatgacctgcagcaggc

SEQ ID NO: 163254 - DNA, 25 bp, Mus musculus
agattcatcatgtcctgcagcaggc

SEQ ID NO: 163255 - DNA, 25 bp, Mus musculus
agattcatctaaccaagccctgtaa

SEQ ID NO: 163256 - DNA, 25 bp, Mus musculus
agattcatctaagcaagccctgtaa

SEQ ID NO: 163257 - DNA, 25 bp, Mus musculus
agattcatctggcatactatccgaa

SEQ ID NO: 163258 - DNA, 25 bp, Mus musculus
agattcatctgggatactatccgaa

SEQ ID NO: 163259 - DNA, 25 bp, Mus musculus
agattcatgctgctagctctggtga

SEQ ID NO: 163260 - DNA, 25 bp, Mus musculus
agattcatgctggtagctctggtga

SEQ ID NO: 163261 - DNA, 25 bp, Mus musculus
agattcatggcaatcctgctttcag

SEQ ID NO: 163262 - DNA, 25 bp, Mus musculus
agattcatggcattcctgctttcag

SEQ ID NO: 163263 - DNA, 25 bp, Mus musculus
agattcattattctctcagcatttg

SEQ ID NO: 163264 - DNA, 25 bp, Mus musculus
agattcattattgtctcagcatttg

SEQ ID NO: 163265 - DNA, 25 bp, Mus musculus
agattcattgatatagccccaaaac

SEQ ID NO: 163266 - DNA, 25 bp, Mus musculus
agattcattgatttagccccaaaac

SEQ ID NO: 163267 - DNA, 25 bp, Mus musculus
agattccaacaaaggtcttctccac

SEQ ID NO: 163268 - DNA, 25 bp, Mus musculus
agattccaacaatggtcttctccac

SEQ ID NO: 163269 - DNA, 25 bp, Mus musculus
agattccaagagatctttgcccaca

SEQ ID NO: 163270 - DNA, 25 bp, Mus musculus
agattccaagagatgtcctttgacc

SEQ ID NO: 163271 - DNA, 25 bp, Mus musculus
agattccaagagttctttgcccaca

SEQ ID NO: 163272 - DNA, 25 bp, Mus musculus
agattccaagagttgtcctttgacc

SEQ ID NO: 163273 - DNA, 25 bp, Mus musculus
agattccacacgattgctcttaacc

SEQ ID NO: 163274 - DNA, 25 bp, Mus musculus
agattccacacgtttgctcttaacc

SEQ ID NO: 163275 - DNA, 25 bp, Mus musculus
agattccacagacgtagccagcagt

SEQ ID NO: 163276 - DNA, 25 bp, Mus musculus
agattccacagaggtagccagcagt

SEQ ID NO: 163277 - DNA, 25 bp, Mus musculus
agattccacatactttacccttcag

SEQ ID NO: 163278 - DNA, 25 bp, Mus musculus
agattccacatagtttacccttcag

SEQ ID NO: 163279 - DNA, 25 bp, Mus musculus
agattccaccttactcttccaactt

SEQ ID NO: 163280 - DNA, 25 bp, Mus musculus
agattccaccttatattcctaatgt

SEQ ID NO: 163281 - DNA, 25 bp, Mus musculus
agattccacctttctcttccaactt

SEQ ID NO: 163282 - DNA, 25 bp, Mus musculus
agattccaccttttattcctaatgt

SEQ ID NO: 163283 - DNA, 25 bp, Mus musculus
agattccagaccaaacgtcagtctc

SEQ ID NO: 163284 - DNA, 25 bp, Mus musculus
agattccagacccaggagtgcccac

SEQ ID NO: 163285 - DNA, 25 bp, Mus musculus
agattccagaccgaggagtgcccac

SEQ ID NO: 163286 - DNA, 25 bp, Mus musculus
agattccagacctaacgtcagtctc

SEQ ID NO: 163287 - DNA, 25 bp, Mus musculus
agattccagagcacatcttctatgc

SEQ ID NO: 163288 - DNA, 25 bp, Mus musculus
agattccagagctcatcttctatgc

SEQ ID NO: 163289 - DNA, 25 bp, Mus musculus
agattccagatcaacttcacagagt

SEQ ID NO: 163290 - DNA, 25 bp, Mus musculus
agattccagatctacttcacagagt

SEQ ID NO: 163291 - DNA, 25 bp, Mus musculus
agattccaggaaaagctcattagct

SEQ ID NO: 163292 - DNA, 25 bp, Mus musculus
agattccaggaatagctcattagct

SEQ ID NO: 163293 - DNA, 25 bp, Mus musculus
agattccagtatagtcttcccacag

SEQ ID NO: 163294 - DNA, 25 bp, Mus musculus
agattccagtattgtcttcccacag

SEQ ID NO: 163295 - DNA, 25 bp, Mus musculus
agattccatgttctgctgctactga

SEQ ID NO: 163296 - DNA, 25 bp, Mus musculus
agattccatgttgtgctgctactga

SEQ ID NO: 163297 - DNA, 25 bp, Mus musculus
agattcccagatcttgcctaacttc

SEQ ID NO: 163298 - DNA, 25 bp, Mus musculus
agattcccagatgttgcctaacttc

SEQ ID NO: 163299 - DNA, 25 bp, Mus musculus
agattcccattgatagcatgaccaa

SEQ ID NO: 163300 - DNA, 25 bp, Mus musculus
agattcccattgttagcatgaccaa

SEQ ID NO: 163301 - DNA, 25 bp, Mus musculus
agattccccagaactctaacaagca

SEQ ID NO: 163302 - DNA, 25 bp, Mus musculus
agattccccagatctctaacaagca

SEQ ID NO: 163303 - DNA, 25 bp, Mus musculus
agattccccagcctgtcggtggaag

SEQ ID NO: 163304 - DNA, 25 bp, Mus musculus
agattccccagcgtgtcggtggaag

SEQ ID NO: 163305 - DNA, 25 bp, Mus musculus
agattccccgatatgcctagactga

SEQ ID NO: 163306 - DNA, 25 bp, Mus musculus
agattccccgatttgcctagactga

SEQ ID NO: 163307 - DNA, 25 bp, Mus musculus
agattcccggacagctgccgagttc

SEQ ID NO: 163308 - DNA, 25 bp, Mus musculus
agattcccggactgctgccgagttc

SEQ ID NO: 163309 - DNA, 25 bp, Mus musculus
agattccctaccagcttggaaccaa

SEQ ID NO: 163310 - DNA, 25 bp, Mus musculus
agattccctacctgcttggaaccaa

SEQ ID NO: 163311 - DNA, 25 bp, Mus musculus
agattccctcacatctttaagcttc

SEQ ID NO: 163312 - DNA, 25 bp, Mus musculus
agattccctcacctctggacattac

SEQ ID NO: 163313 - DNA, 25 bp, Mus musculus
agattccctcacgtctggacattac

SEQ ID NO: 163314 - DNA, 25 bp, Mus musculus
agattccctcacttctttaagcttc

SEQ ID NO: 163315 - DNA, 25 bp, Mus musculus
agattccctggaatccttggttcag

SEQ ID NO: 163316 - DNA, 25 bp, Mus musculus
agattccctggactgggccttgtat

SEQ ID NO: 163317 - DNA, 25 bp, Mus musculus
agattccctggagtgggccttgtat

SEQ ID NO: 163318 - DNA, 25 bp, Mus musculus
agattccctggattccttggttcag

SEQ ID NO: 163319 - DNA, 25 bp, Mus musculus
agattccctggcaagattttcctct

SEQ ID NO: 163320 - DNA, 25 bp, Mus musculus
agattccctggctagattttcctct

SEQ ID NO: 163321 - DNA, 25 bp, Mus musculus
agattcccttatcacattcttgtct

SEQ ID NO: 163322 - DNA, 25 bp, Mus musculus
agattcccttatgacattcttgtct

SEQ ID NO: 163323 - DNA, 25 bp, Mus musculus
agattcccttgtcgttctaggagca

SEQ ID NO: 163324 - DNA, 25 bp, Mus musculus
agattcccttgtggttctaggagca

SEQ ID NO: 163325 - DNA, 25 bp, Mus musculus
agattccgaagcctcttgtgcacag

SEQ ID NO: 163326 - DNA, 25 bp, Mus musculus
agattccgaagcgtcttgtgcacag

SEQ ID NO: 163327 - DNA, 25 bp, Mus musculus
agattccgagacagctttggccaat

SEQ ID NO: 163328 - DNA, 25 bp, Mus musculus
agattccgagactgctttggccaat

SEQ ID NO: 163329 - DNA, 25 bp, Mus musculus
agattccgcgttcctgttttacagc

SEQ ID NO: 163330 - DNA, 25 bp, Mus musculus
agattccgcgttgctgttttacagc

SEQ ID NO: 163331 - DNA, 25 bp, Mus musculus
agattccgtaacctcagtagacacc

SEQ ID NO: 163332 - DNA, 25 bp, Mus musculus
agattccgtaacgtcagtagacacc

SEQ ID NO: 163333 - DNA, 25 bp, Mus musculus
agattccgtttgcactcgccaggag

SEQ ID NO: 163334 - DNA, 25 bp, Mus musculus
agattccgtttggactcgccaggag

SEQ ID NO: 163335 - DNA, 25 bp, Mus musculus
agattcctaatcaatgttctcgaag

SEQ ID NO: 163336 - DNA, 25 bp, Mus musculus
agattcctaatctatgttctcgaag

SEQ ID NO: 163337 - DNA, 25 bp, Mus musculus
agattcctactaagctatccctggc

SEQ ID NO: 163338 - DNA, 25 bp, Mus musculus
agattcctactatgctatccctggc

SEQ ID NO: 163339 - DNA, 25 bp, Mus musculus
agattcctcaaaagttaatatgtaa

SEQ ID NO: 163340 - DNA, 25 bp, Mus musculus
agattcctcaaatgttaatatgtaa

SEQ ID NO: 163341 - DNA, 25 bp, Mus musculus
agattcctcataagccggagtcgga

SEQ ID NO: 163342 - DNA, 25 bp, Mus musculus
agattcctcatatgccggagtcgga

SEQ ID NO: 163343 - DNA, 25 bp, Mus musculus
agattcctcatgctgaatggaagaa

SEQ ID NO: 163344 - DNA, 25 bp, Mus musculus
agattcctcatggtgaatggaagaa

SEQ ID NO: 163345 - DNA, 25 bp, Mus musculus
agattcctcccaagagtatctgatg

SEQ ID NO: 163346 - DNA, 25 bp, Mus musculus
agattcctcccatgagtatctgatg

SEQ ID NO: 163347 - DNA, 25 bp, Mus musculus
agattcctcggaagtctggtctcgt

SEQ ID NO: 163348 - DNA, 25 bp, Mus musculus
agattcctcggatgtctggtctcgt

SEQ ID NO: 163349 - DNA, 25 bp, Mus musculus
agattcctcttcctgatagttgcta

SEQ ID NO: 163350 - DNA, 25 bp, Mus musculus
agattcctcttcgtgatagttgcta

SEQ ID NO: 163351 - DNA, 25 bp, Mus musculus
agattcctgaccaattgtcttcctg

SEQ ID NO: 163352 - DNA, 25 bp, Mus musculus
agattcctgacctattgtcttcctg

SEQ ID NO: 163353 - DNA, 25 bp, Mus musculus
agattcctgagacctatgggcacgg

SEQ ID NO: 163354 - DNA, 25 bp, Mus musculus
agattcctgagagctatgggcacgg

SEQ ID NO: 163355 - DNA, 25 bp, Mus musculus
agattcctgcagaggtcttgtacct

SEQ ID NO: 163356 - DNA, 25 bp, Mus musculus
agattcctgcagtggtcttgtacct

SEQ ID NO: 163357 - DNA, 25 bp, Mus musculus
agattccttagacctgtaacctgag

SEQ ID NO: 163358 - DNA, 25 bp, Mus musculus
agattccttagagctgtaacctgag

SEQ ID NO: 163359 - DNA, 25 bp, Mus musculus
agattccttatgagatttttatatg

SEQ ID NO: 163360 - DNA, 25 bp, Mus musculus
agattccttatgtgatttttatatg

SEQ ID NO: 163361 - DNA, 25 bp, Mus musculus
agattccttcctacatggtgcaaga

SEQ ID NO: 163362 - DNA, 25 bp, Mus musculus
agattccttccttcatggtgcaaga

SEQ ID NO: 163363 - DNA, 25 bp, Mus musculus
agattccttgtcctgagttgcagtt

SEQ ID NO: 163364 - DNA, 25 bp, Mus musculus
agattccttgtcgtgagttgcagtt

SEQ ID NO: 163365 - DNA, 25 bp, Mus musculus
agattcctttaaattcgctcagtga

SEQ ID NO: 163366 - DNA, 25 bp, Mus musculus
agattcctttaatttcgctcagtga

SEQ ID NO: 163367 - DNA, 25 bp, Mus musculus
agattcctttcgctacaactttgat

SEQ ID NO: 163368 - DNA, 25 bp, Mus musculus
agattcctttcggtacaactttgat

SEQ ID NO: 163369 - DNA, 25 bp, Mus musculus
agattccttttccaggtaacacatg

SEQ ID NO: 163370 - DNA, 25 bp, Mus musculus
agattccttttcgaggtaacacatg

SEQ ID NO: 163371 - DNA, 25 bp, Mus musculus
agattcgatgtgatccttcaggctc

SEQ ID NO: 163372 - DNA, 25 bp, Mus musculus
agattcgatgtgttccttcaggctc

SEQ ID NO: 163373 - DNA, 25 bp, Mus musculus
agattcgcaaacacatcctgcgcag

SEQ ID NO: 163374 - DNA, 25 bp, Mus musculus
agattcgcaaactcatcctgcgcag

SEQ ID NO: 163375 - DNA, 25 bp, Mus musculus
agattcgcacttactccacccagat

SEQ ID NO: 163376 - DNA, 25 bp, Mus musculus
agattcgcactttctccacccagat

SEQ ID NO: 163377 - DNA, 25 bp, Mus musculus
agattcgcagcactgggttgtgcca

SEQ ID NO: 163378 - DNA, 25 bp, Mus musculus
agattcgcagcagtgggttgtgcca

SEQ ID NO: 163379 - DNA, 25 bp, Mus musculus
agattcgcctaaaactgccatcgtt

SEQ ID NO: 163380 - DNA, 25 bp, Mus musculus
agattcgcctaatactgccatcgtt

SEQ ID NO: 163381 - DNA, 25 bp, Mus musculus
agattcgctatgcaggtgaataggt

SEQ ID NO: 163382 - DNA, 25 bp, Mus musculus
agattcgctatggaggtgaataggt

SEQ ID NO: 163383 - DNA, 25 bp, Mus musculus
agattcggaacaccgtcaacactat

SEQ ID NO: 163384 - DNA, 25 bp, Mus musculus
agattcggaacagcgtcaacactat

SEQ ID NO: 163385 - DNA, 25 bp, Mus musculus
agattcgggaacacagtgctctgac

SEQ ID NO: 163386 - DNA, 25 bp, Mus musculus
agattcgggaactcagtgctctgac

SEQ ID NO: 163387 - DNA, 25 bp, Mus musculus
agattcggtgccagagccatcggta

SEQ ID NO: 163388 - DNA, 25 bp, Mus musculus
agattcggtgcctgagccatcggta

SEQ ID NO: 163389 - DNA, 25 bp, Mus musculus
agattcggttctagagcttgtttcc

SEQ ID NO: 163390 - DNA, 25 bp, Mus musculus
agattcggttcttgagcttgtttcc

SEQ ID NO: 163391 - DNA, 25 bp, Mus musculus
agattcgtagtacccgatttggcac

SEQ ID NO: 163392 - DNA, 25 bp, Mus musculus
agattcgtagtagccgatttggcac

SEQ ID NO: 163393 - DNA, 25 bp, Mus musculus
agattcgtctgtactcatcatcagg

SEQ ID NO: 163394 - DNA, 25 bp, Mus musculus
agattcgtctgttctcatcatcagg

SEQ ID NO: 163395 - DNA, 25 bp, Mus musculus
agattcgtggcccaggtgatagcgg

SEQ ID NO: 163396 - DNA, 25 bp, Mus musculus
agattcgtggccgaggtgatagcgg

SEQ ID NO: 163397 - DNA, 25 bp, Mus musculus
agattcgtgtcaaagcagagccatt

SEQ ID NO: 163398 - DNA, 25 bp, Mus musculus
agattcgtgtcatagcagagccatt

SEQ ID NO: 163399 - DNA, 25 bp, Mus musculus
agattcgttgctaacagatgtgagt

SEQ ID NO: 163400 - DNA, 25 bp, Mus musculus
agattcgttgcttacagatgtgagt

SEQ ID NO: 163401 - DNA, 25 bp, Mus musculus
agattcgttgtgacctggagcggca

SEQ ID NO: 163402 - DNA, 25 bp, Mus musculus
agattcgttgtgtcctggagcggca

SEQ ID NO: 163403 - DNA, 25 bp, Mus musculus
agattcgtttatcttcttttgtaag

SEQ ID NO: 163404 - DNA, 25 bp, Mus musculus
agattcgtttatgttcttttgtaag

SEQ ID NO: 163405 - DNA, 25 bp, Mus musculus
agattctaagctctctttgtctcat

SEQ ID NO: 163406 - DNA, 25 bp, Mus musculus
agattctaagctgtctttgtctcat

SEQ ID NO: 163407 - DNA, 25 bp, Mus musculus
agattctaatagctccctgtcagtt

SEQ ID NO: 163408 - DNA, 25 bp, Mus musculus
agattctaataggtccctgtcagtt

SEQ ID NO: 163409 - DNA, 25 bp, Mus musculus
agattctaccctcagcagactccat

SEQ ID NO: 163410 - DNA, 25 bp, Mus musculus
agattctaccctgagcagactccat

SEQ ID NO: 163411 - DNA, 25 bp, Mus musculus
agattctacctaccctccattgttt

SEQ ID NO: 163412 - DNA, 25 bp, Mus musculus
agattctacctagcctccattgttt

SEQ ID NO: 163413 - DNA, 25 bp, Mus musculus
agattctacctcattttgttgctgg

SEQ ID NO: 163414 - DNA, 25 bp, Mus musculus
agattctacctctttttgttgctgg

SEQ ID NO: 163415 - DNA, 25 bp, Mus musculus
agattctactccctgctgagaggct

SEQ ID NO: 163416 - DNA, 25 bp, Mus musculus
agattctactccgtgctgagaggct

SEQ ID NO: 163417 - DNA, 25 bp, Mus musculus
agattctaggtgcttccgtcctcca

SEQ ID NO: 163418 - DNA, 25 bp, Mus musculus
agattctaggtggttccgtcctcca

SEQ ID NO: 163419 - DNA, 25 bp, Mus musculus
agattctatgacacatttctatgta

SEQ ID NO: 163420 - DNA, 25 bp, Mus musculus
agattctatgactcatttctatgta

SEQ ID NO: 163421 - DNA, 25 bp, Mus musculus
agattctattagatgcaccggcaga

SEQ ID NO: 163422 - DNA, 25 bp, Mus musculus
agattctattagttgcaccggcaga

SEQ ID NO: 163423 - DNA, 25 bp, Mus musculus
agattctcaagccacacacagtaac

SEQ ID NO: 163424 - DNA, 25 bp, Mus musculus
agattctcaagcgacacacagtaac

SEQ ID NO: 163425 - DNA, 25 bp, Mus musculus
agattctcagggaagtcctggtcct

SEQ ID NO: 163426 - DNA, 25 bp, Mus musculus
agattctcagggtagtcctggtcct

SEQ ID NO: 163427 - DNA, 25 bp, Mus musculus
agattctcatagcaccaggtttaca

SEQ ID NO: 163428 - DNA, 25 bp, Mus musculus
agattctcataggaccaggtttaca

SEQ ID NO: 163429 - DNA, 25 bp, Mus musculus
agattctcatatcagtcaataggga

SEQ ID NO: 163430 - DNA, 25 bp, Mus musculus
agattctcatatgagtcaataggga

SEQ ID NO: 163431 - DNA, 25 bp, Mus musculus
agattctcatctccacactgtgaat

SEQ ID NO: 163432 - DNA, 25 bp, Mus musculus
agattctcatctgcacactgtgaat

SEQ ID NO: 163433 - DNA, 25 bp, Mus musculus
agattctccaatacagacttctgtg

SEQ ID NO: 163434 - DNA, 25 bp, Mus musculus
agattctccaattcagacttctgtg

SEQ ID NO: 163435 - DNA, 25 bp, Mus musculus
agattctccagaaggctgcgaggcc

SEQ ID NO: 163436 - DNA, 25 bp, Mus musculus
agattctccagatggctgcgaggcc

SEQ ID NO: 163437 - DNA, 25 bp, Mus musculus
agattctccaggatggtagtcccca

SEQ ID NO: 163438 - DNA, 25 bp, Mus musculus
agattctccaggttggtagtcccca

SEQ ID NO: 163439 - DNA, 25 bp, Mus musculus
agattctccagtcgtggccgagcgt

SEQ ID NO: 163440 - DNA, 25 bp, Mus musculus
agattctccagtggtggccgagcgt

SEQ ID NO: 163441 - DNA, 25 bp, Mus musculus
agattctcccataattcggctctgc

SEQ ID NO: 163442 - DNA, 25 bp, Mus musculus
agattctcccattattcggctctgc

SEQ ID NO: 163443 - DNA, 25 bp, Mus musculus
agattctccctaagcagcctaagtt

SEQ ID NO: 163444 - DNA, 25 bp, Mus musculus
agattctccctatgcagcctaagtt

SEQ ID NO: 163445 - DNA, 25 bp, Mus musculus
agattctcccttaggattgagttcc

SEQ ID NO: 163446 - DNA, 25 bp, Mus musculus
agattctccctttggattgagttcc

SEQ ID NO: 163447 - DNA, 25 bp, Mus musculus
agattctcctccaatcaccaaaaat

SEQ ID NO: 163448 - DNA, 25 bp, Mus musculus
agattctcctcctatcaccaaaaat

SEQ ID NO: 163449 - DNA, 25 bp, Mus musculus
agattctcctttaagctcacagtag

SEQ ID NO: 163450 - DNA, 25 bp, Mus musculus
agattctcctttctgggcattttag

SEQ ID NO: 163451 - DNA, 25 bp, Mus musculus
agattctcctttgtgggcattttag

SEQ ID NO: 163452 - DNA, 25 bp, Mus musculus
agattctccttttagctcacagtag

SEQ ID NO: 163453 - DNA, 25 bp, Mus musculus
agattctcgggaacaccagtgtgga

SEQ ID NO: 163454 - DNA, 25 bp, Mus musculus
agattctcgggatcaccagtgtgga

SEQ ID NO: 163455 - DNA, 25 bp, Mus musculus
agattctcggtaactgtagcagaaa

SEQ ID NO: 163456 - DNA, 25 bp, Mus musculus
agattctcggtatctgtagcagaaa

SEQ ID NO: 163457 - DNA, 25 bp, Mus musculus
agattctctatgagccaccaagtag

SEQ ID NO: 163458 - DNA, 25 bp, Mus musculus
agattctctatgtgccaccaagtag

SEQ ID NO: 163459 - DNA, 25 bp, Mus musculus
agattctctcagcagggatgtggct

SEQ ID NO: 163460 - DNA, 25 bp, Mus musculus
agattctctcaggagggatgtggct

SEQ ID NO: 163461 - DNA, 25 bp, Mus musculus
agattctcttctctaaactccttaa

SEQ ID NO: 163462 - DNA, 25 bp, Mus musculus
agattctcttctgtaaactccttaa

SEQ ID NO: 163463 - DNA, 25 bp, Mus musculus
agattctgaaaacgcctttctcccg

SEQ ID NO: 163464 - DNA, 25 bp, Mus musculus
agattctgaaaaggcctttctcccg

SEQ ID NO: 163465 - DNA, 25 bp, Mus musculus
agattctgaccaaggactctaccac

SEQ ID NO: 163466 - DNA, 25 bp, Mus musculus
agattctgaccatggactctaccac

SEQ ID NO: 163467 - DNA, 25 bp, Mus musculus
agattctgacggcatcccacaggga

SEQ ID NO: 163468 - DNA, 25 bp, Mus musculus
agattctgacgggatcccacaggga

SEQ ID NO: 163469 - DNA, 25 bp, Mus musculus
agattctgactcctttgtatccgtt

SEQ ID NO: 163470 - DNA, 25 bp, Mus musculus
agattctgactcgtttgtatccgtt

SEQ ID NO: 163471 - DNA, 25 bp, Mus musculus
agattctgagtacctacattcccat

SEQ ID NO: 163472 - DNA, 25 bp, Mus musculus
agattctgagtagctacattcccat

SEQ ID NO: 163473 - DNA, 25 bp, Mus musculus
agattctgagttatcacttacacag

SEQ ID NO: 163474 - DNA, 25 bp, Mus musculus
agattctgagttttcacttacacag

SEQ ID NO: 163475 - DNA, 25 bp, Mus musculus
agattctgatccacggcgttgtgta

SEQ ID NO: 163476 - DNA, 25 bp, Mus musculus
agattctgatcctcggcgttgtgta

SEQ ID NO: 163477 - DNA, 25 bp, Mus musculus
agattctgcatcagtacagagagca

SEQ ID NO: 163478 - DNA, 25 bp, Mus musculus
agattctgcatctgtacagagagca

SEQ ID NO: 163479 - DNA, 25 bp, Mus musculus
agattctgcgagatgatttcatgat

SEQ ID NO: 163480 - DNA, 25 bp, Mus musculus
agattctgcgagttgatttcatgat

SEQ ID NO: 163481 - DNA, 25 bp, Mus musculus
agattctgcgcaaccgctgtgagga

SEQ ID NO: 163482 - DNA, 25 bp, Mus musculus
agattctgcgcatccgctgtgagga

SEQ ID NO: 163483 - DNA, 25 bp, Mus musculus
agattctgcggtatatgggacctcc

SEQ ID NO: 163484 - DNA, 25 bp, Mus musculus
agattctgcggtttatgggacctcc

SEQ ID NO: 163485 - DNA, 25 bp, Mus musculus
agattctgctgtcgtgcccggctgt

SEQ ID NO: 163486 - DNA, 25 bp, Mus musculus
agattctgctgtggtgcccggctgt

SEQ ID NO: 163487 - DNA, 25 bp, Mus musculus
agattctgcttaatatgggttatcc

SEQ ID NO: 163488 - DNA, 25 bp, Mus musculus
agattctgcttattatgggttatcc

SEQ ID NO: 163489 - DNA, 25 bp, Mus musculus
agattctggaacacccgtgtctttt

SEQ ID NO: 163490 - DNA, 25 bp, Mus musculus
agattctggaactcccgtgtctttt

SEQ ID NO: 163491 - DNA, 25 bp, Mus musculus
agattctggccacgatcgagctact

SEQ ID NO: 163492 - DNA, 25 bp, Mus musculus
agattctggccaggatcgagctact

SEQ ID NO: 163493 - DNA, 25 bp, Mus musculus
agattctggcctctgctggtgtaca

SEQ ID NO: 163494 - DNA, 25 bp, Mus musculus
agattctggcctgtgctggtgtaca

SEQ ID NO: 163495 - DNA, 25 bp, Mus musculus
agattctgggaaccagtatatttat

SEQ ID NO: 163496 - DNA, 25 bp, Mus musculus
agattctgggaagcagtatatttat

SEQ ID NO: 163497 - DNA, 25 bp, Mus musculus
agattctgggcaacttctcgttttc

SEQ ID NO: 163498 - DNA, 25 bp, Mus musculus
agattctgggcatcttctcgttttc

SEQ ID NO: 163499 - DNA, 25 bp, Mus musculus
agattctgggttagctctggttgca

SEQ ID NO: 163500 - DNA, 25 bp, Mus musculus
agattctgggtttgctctggttgca

SEQ ID NO: 163501 - DNA, 25 bp, Mus musculus
agattctggtttctttcctagactg

SEQ ID NO: 163502 - DNA, 25 bp, Mus musculus
agattctggtttgtttcctagactg

SEQ ID NO: 163503 - DNA, 25 bp, Mus musculus
agattctgtatgctcaacttcaaat

SEQ ID NO: 163504 - DNA, 25 bp, Mus musculus
agattctgtatggtcaacttcaaat

SEQ ID NO: 163505 - DNA, 25 bp, Mus musculus
agattctgtcatccttacacgcatc

SEQ ID NO: 163506 - DNA, 25 bp, Mus musculus
agattctgtcatgcttacacgcatc

SEQ ID NO: 163507 - DNA, 25 bp, Mus musculus
agattctgtcccaaaacttgtggct

SEQ ID NO: 163508 - DNA, 25 bp, Mus musculus
agattctgtccctaaacttgtggct

SEQ ID NO: 163509 - DNA, 25 bp, Mus musculus
agattctgtccgagagaagccctga

SEQ ID NO: 163510 - DNA, 25 bp, Mus musculus
agattctgtccgtgagaagccctga

SEQ ID NO: 163511 - DNA, 25 bp, Mus musculus
agattctgtggcagttgtcattgga

SEQ ID NO: 163512 - DNA, 25 bp, Mus musculus
agattctgtggctgttgtcattgga

SEQ ID NO: 163513 - DNA, 25 bp, Mus musculus
agattctgtgtgattctctaacctc

SEQ ID NO: 163514 - DNA, 25 bp, Mus musculus
agattctgtgtgtttctctaacctc

SEQ ID NO: 163515 - DNA, 25 bp, Mus musculus
agattcttatggcaggagtcgcctg

SEQ ID NO: 163516 - DNA, 25 bp, Mus musculus
agattcttatgggaggagtcgcctg

SEQ ID NO: 163517 - DNA, 25 bp, Mus musculus
agattcttattgagtcctgtcagcc

SEQ ID NO: 163518 - DNA, 25 bp, Mus musculus
agattcttattgtgtcctgtcagcc

SEQ ID NO: 163519 - DNA, 25 bp, Mus musculus
agattcttcacccagtttgttctag

SEQ ID NO: 163520 - DNA, 25 bp, Mus musculus
agattcttcaccgagtttgttctag

SEQ ID NO: 163521 - DNA, 25 bp, Mus musculus
agattcttccaacagatccagagca

SEQ ID NO: 163522 - DNA, 25 bp, Mus musculus
agattcttccaagagatccagagca

SEQ ID NO: 163523 - DNA, 25 bp, Mus musculus
agattcttccatcggcctttaaggc

SEQ ID NO: 163524 - DNA, 25 bp, Mus musculus
agattcttccatgggcctttaaggc

SEQ ID NO: 163525 - DNA, 25 bp, Mus musculus
agattcttcctcaggttgcccgagc

SEQ ID NO: 163526 - DNA, 25 bp, Mus musculus
agattcttcctctggttgcccgagc

SEQ ID NO: 163527 - DNA, 25 bp, Mus musculus
agattcttcctgcactctaactttc

SEQ ID NO: 163528 - DNA, 25 bp, Mus musculus
agattcttcctggactctaactttc

SEQ ID NO: 163529 - DNA, 25 bp, Mus musculus
agattcttctcaacatttctccaga

SEQ ID NO: 163530 - DNA, 25 bp, Mus musculus
agattcttctcaactttttgctcct

SEQ ID NO: 163531 - DNA, 25 bp, Mus musculus
agattcttctcacggcaagctggtg

SEQ ID NO: 163532 - DNA, 25 bp, Mus musculus
agattcttctcagggcaagctggtg

SEQ ID NO: 163533 - DNA, 25 bp, Mus musculus
agattcttctcatcatttctccaga

SEQ ID NO: 163534 - DNA, 25 bp, Mus musculus
agattcttctcatctttttgctcct

SEQ ID NO: 163535 - DNA, 25 bp, Mus musculus
agattcttgatgctccttgtttggc

SEQ ID NO: 163536 - DNA, 25 bp, Mus musculus
agattcttgatggtccttgtttggc

SEQ ID NO: 163537 - DNA, 25 bp, Mus musculus
agattcttgcagctcttcaggaaag

SEQ ID NO: 163538 - DNA, 25 bp, Mus musculus
agattcttgcaggtcttcaggaaag

SEQ ID NO: 163539 - DNA, 25 bp, Mus musculus
agattcttgcgcacacagtctctca

SEQ ID NO: 163540 - DNA, 25 bp, Mus musculus
agattcttgcgctcacagtctctca

SEQ ID NO: 163541 - DNA, 25 bp, Mus musculus
agattcttgcttattcctgctacca

SEQ ID NO: 163542 - DNA, 25 bp, Mus musculus
agattcttgctttttcctgctacca

SEQ ID NO: 163543 - DNA, 25 bp, Mus musculus
agattcttggacacattagcattgt

SEQ ID NO: 163544 - DNA, 25 bp, Mus musculus
agattcttggactcattagcattgt

SEQ ID NO: 163545 - DNA, 25 bp, Mus musculus
agattctttctaacttgtctgccca

SEQ ID NO: 163546 - DNA, 25 bp, Mus musculus
agattctttctaccttgtcgcagtg

SEQ ID NO: 163547 - DNA, 25 bp, Mus musculus
agattctttctagcttgtcgcagtg

SEQ ID NO: 163548 - DNA, 25 bp, Mus musculus
agattctttctatcttgtctgccca

SEQ ID NO: 163549 - DNA, 25 bp, Mus musculus
agattctttgtgatcattaccctcc

SEQ ID NO: 163550 - DNA, 25 bp, Mus musculus
agattctttgtgttcattaccctcc

SEQ ID NO: 163551 - DNA, 25 bp, Mus musculus
agattcttttccatgcagctcaagt

SEQ ID NO: 163552 - DNA, 25 bp, Mus musculus
agattcttttccttgcagctcaagt

SEQ ID NO: 163553 - DNA, 25 bp, Mus musculus
agattgaaatccagttcgcacaggg

SEQ ID NO: 163554 - DNA, 25 bp, Mus musculus
agattgaaatcctgttcgcacaggg

SEQ ID NO: 163555 - DNA, 25 bp, Mus musculus
agattgaacaggagcgcaagcgccg

SEQ ID NO: 163556 - DNA, 25 bp, Mus musculus
agattgaacaggtgcgcaagcgccg

SEQ ID NO: 163557 - DNA, 25 bp, Mus musculus
agattgaacctaccaccttgaacat

SEQ ID NO: 163558 - DNA, 25 bp, Mus musculus
agattgaacctagcaccttgaacat

SEQ ID NO: 163559 - DNA, 25 bp, Mus musculus
agattgaagctcatgttgcacagaa

SEQ ID NO: 163560 - DNA, 25 bp, Mus musculus
agattgaagctcttgttgcacagaa

SEQ ID NO: 163561 - DNA, 25 bp, Mus musculus
agattgaaggtaccacagtgtctga

SEQ ID NO: 163562 - DNA, 25 bp, Mus musculus
agattgaaggtagcacagtgtctga

SEQ ID NO: 163563 - DNA, 25 bp, Mus musculus
agattgaagtcaaagctttcctcct

SEQ ID NO: 163564 - DNA, 25 bp, Mus musculus
agattgaagtcatagctttcctcct

SEQ ID NO: 163565 - DNA, 25 bp, Mus musculus
agattgaagtctattctcagagaaa

SEQ ID NO: 163566 - DNA, 25 bp, Mus musculus
agattgaagtcttttctcagagaaa

SEQ ID NO: 163567 - DNA, 25 bp, Mus musculus
agattgaatcataaccactgctggg

SEQ ID NO: 163568 - DNA, 25 bp, Mus musculus
agattgaatcattaccactgctggg

SEQ ID NO: 163569 - DNA, 25 bp, Mus musculus
agattgaatcgcacacgctttcctg

SEQ ID NO: 163570 - DNA, 25 bp, Mus musculus
agattgaatcgctcacgctttcctg

SEQ ID NO: 163571 - DNA, 25 bp, Mus musculus
agattgacaataccattcccacgtg

SEQ ID NO: 163572 - DNA, 25 bp, Mus musculus
agattgacaatagcattcccacgtg

SEQ ID NO: 163573 - DNA, 25 bp, Mus musculus
agattgacagtacgcaacgatgggt

SEQ ID NO: 163574 - DNA, 25 bp, Mus musculus
agattgacagtaggcaacgatgggt

SEQ ID NO: 163575 - DNA, 25 bp, Mus musculus
agattgaccatgattggagttctga

SEQ ID NO: 163576 - DNA, 25 bp, Mus musculus
agattgaccatgtttggagttctga

SEQ ID NO: 163577 - DNA, 25 bp, Mus musculus
agattgacccagatcctccgaactg

SEQ ID NO: 163578 - DNA, 25 bp, Mus musculus
agattgacccagttcctccgaactg

SEQ ID NO: 163579 - DNA, 25 bp, Mus musculus
agattgaccgtccttctggcaagaa

SEQ ID NO: 163580 - DNA, 25 bp, Mus musculus
agattgaccgtcgttctggcaagaa

SEQ ID NO: 163581 - DNA, 25 bp, Mus musculus
agattgacctcaccgagctgtagaa

SEQ ID NO: 163582 - DNA, 25 bp, Mus musculus
agattgacctcagcgagctgtagaa

SEQ ID NO: 163583 - DNA, 25 bp, Mus musculus
agattgacctctcaatgcccctaag

SEQ ID NO: 163584 - DNA, 25 bp, Mus musculus
agattgacctctgaatgcccctaag

SEQ ID NO: 163585 - DNA, 25 bp, Mus musculus
agattgacgagccccttgtggactg

SEQ ID NO: 163586 - DNA, 25 bp, Mus musculus
agattgacgagcgccttgtggactg

SEQ ID NO: 163587 - DNA, 25 bp, Mus musculus
agattgacgtcaaggctggtgcaga

SEQ ID NO: 163588 - DNA, 25 bp, Mus musculus
agattgacgtcatggctggtgcaga

SEQ ID NO: 163589 - DNA, 25 bp, Mus musculus
agattgacgtggacctgtctctgga

SEQ ID NO: 163590 - DNA, 25 bp, Mus musculus
agattgacgtggtcctgtctctgga

SEQ ID NO: 163591 - DNA, 25 bp, Mus musculus
agattgactccgaggctgatgctga

SEQ ID NO: 163592 - DNA, 25 bp, Mus musculus
agattgactccgtggctgatgctga

SEQ ID NO: 163593 - DNA, 25 bp, Mus musculus
agattgacttacacacatagcctag

SEQ ID NO: 163594 - DNA, 25 bp, Mus musculus
agattgacttactcacatagcctag

SEQ ID NO: 163595 - DNA, 25 bp, Mus musculus
agattgagagcccataggtggcaat

SEQ ID NO: 163596 - DNA, 25 bp, Mus musculus
agattgagagccgataggtggcaat

SEQ ID NO: 163597 - DNA, 25 bp, Mus musculus
agattgagcctcatggtgccaggaa

SEQ ID NO: 163598 - DNA, 25 bp, Mus musculus
agattgagcctcttggtgccaggaa

SEQ ID NO: 163599 - DNA, 25 bp, Mus musculus
agattgagctaccatgtactgatga

SEQ ID NO: 163600 - DNA, 25 bp, Mus musculus
agattgagctacgatgtactgatga

SEQ ID NO: 163601 - DNA, 25 bp, Mus musculus
agattgaggcttcgttctcaacgat

SEQ ID NO: 163602 - DNA, 25 bp, Mus musculus
agattgaggcttggttctcaacgat

SEQ ID NO: 163603 - DNA, 25 bp, Mus musculus
agattgagttatatggacgaccaca

SEQ ID NO: 163604 - DNA, 25 bp, Mus musculus
agattgagttatttggacgaccaca

SEQ ID NO: 163605 - DNA, 25 bp, Mus musculus
agattgagttcacctagacctcctg

SEQ ID NO: 163606 - DNA, 25 bp, Mus musculus
agattgagttcagctagacctcctg

SEQ ID NO: 163607 - DNA, 25 bp, Mus musculus
agattgatcaccatctaagcatatg

SEQ ID NO: 163608 - DNA, 25 bp, Mus musculus
agattgatcaccttctaagcatatg

SEQ ID NO: 163609 - DNA, 25 bp, Mus musculus
agattgatcgatataccctccctga

SEQ ID NO: 163610 - DNA, 25 bp, Mus musculus
agattgatcgatttaccctccctga

SEQ ID NO: 163611 - DNA, 25 bp, Mus musculus
agattgatcgtgagtcgggcaagac

SEQ ID NO: 163612 - DNA, 25 bp, Mus musculus
agattgatcgtgtgtcgggcaagac

SEQ ID NO: 163613 - DNA, 25 bp, Mus musculus
agattgatctccaggtgaggtgaga

SEQ ID NO: 163614 - DNA, 25 bp, Mus musculus
agattgatctcctggtgaggtgaga

SEQ ID NO: 163615 - DNA, 25 bp, Mus musculus
agattgatgcaaacctcctctatca

SEQ ID NO: 163616 - DNA, 25 bp, Mus musculus
agattgatgcaatcctcctctatca

SEQ ID NO: 163617 - DNA, 25 bp, Mus musculus
agattgatgctgcagaccgcttcct

SEQ ID NO: 163618 - DNA, 25 bp, Mus musculus
agattgatgctggagaccgcttcct

SEQ ID NO: 163619 - DNA, 25 bp, Mus musculus
agattgattatcatcagcccatccc

SEQ ID NO: 163620 - DNA, 25 bp, Mus musculus
agattgattatcttcagcccatccc

SEQ ID NO: 163621 - DNA, 25 bp, Mus musculus
agattgatttctctgatcctcttcc

SEQ ID NO: 163622 - DNA, 25 bp, Mus musculus
agattgatttctgtgatcctcttcc

SEQ ID NO: 163623 - DNA, 25 bp, Mus musculus
agattgcaaatactgcccgcaaacg

SEQ ID NO: 163624 - DNA, 25 bp, Mus musculus
agattgcaaatagtgcccgcaaacg

SEQ ID NO: 163625 - DNA, 25 bp, Mus musculus
agattgcaaatcacaggaccccttc

SEQ ID NO: 163626 - DNA, 25 bp, Mus musculus
agattgcaaatctcaggaccccttc

SEQ ID NO: 163627 - DNA, 25 bp, Mus musculus
agattgcaagagactcaagagagac

SEQ ID NO: 163628 - DNA, 25 bp, Mus musculus
agattgcaagagtctcaagagagac

SEQ ID NO: 163629 - DNA, 25 bp, Mus musculus
agattgcactgcagcgtagtggcgc

SEQ ID NO: 163630 - DNA, 25 bp, Mus musculus
agattgcactgctgcgtagtggcgc

SEQ ID NO: 163631 - DNA, 25 bp, Mus musculus
agattgcaggccattggtctcaacc

SEQ ID NO: 163632 - DNA, 25 bp, Mus musculus
agattgcaggcctttggtctcaacc

SEQ ID NO: 163633 - DNA, 25 bp, Mus musculus
agattgcatctacgcattccaataa

SEQ ID NO: 163634 - DNA, 25 bp, Mus musculus
agattgcatctaggcattccaataa

SEQ ID NO: 163635 - DNA, 25 bp, Mus musculus
agattgcatctgagcgcgtgcgcgc

SEQ ID NO: 163636 - DNA, 25 bp, Mus musculus
agattgcatctgtgcgcgtgcgcgc

SEQ ID NO: 163637 - DNA, 25 bp, Mus musculus
agattgcattctctatcctgccctg

SEQ ID NO: 163638 - DNA, 25 bp, Mus musculus
agattgcattctgtatcctgccctg

SEQ ID NO: 163639 - DNA, 25 bp, Mus musculus
agattgccacttaccagtattttga

SEQ ID NO: 163640 - DNA, 25 bp, Mus musculus
agattgccacttccacaactgcttt

SEQ ID NO: 163641 - DNA, 25 bp, Mus musculus
agattgccacttgcacaactgcttt

SEQ ID NO: 163642 - DNA, 25 bp, Mus musculus
agattgccactttccagtattttga

SEQ ID NO: 163643 - DNA, 25 bp, Mus musculus
agattgccagcaaggttacaggtaa

SEQ ID NO: 163644 - DNA, 25 bp, Mus musculus
agattgccagcatggttacaggtaa

SEQ ID NO: 163645 - DNA, 25 bp, Mus musculus
agattgccagccctttacagtaagt

SEQ ID NO: 163646 - DNA, 25 bp, Mus musculus
agattgccagccgtttacagtaagt

SEQ ID NO: 163647 - DNA, 25 bp, Mus musculus
agattgccagcgacggttagaggct

SEQ ID NO: 163648 - DNA, 25 bp, Mus musculus
agattgccagcgtcggttagaggct

SEQ ID NO: 163649 - DNA, 25 bp, Mus musculus
agattgccatgccttggtcctggat

SEQ ID NO: 163650 - DNA, 25 bp, Mus musculus
agattgccatgcgttggtcctggat

SEQ ID NO: 163651 - DNA, 25 bp, Mus musculus
agattgccatttctaactgcctaca

SEQ ID NO: 163652 - DNA, 25 bp, Mus musculus
agattgccatttgtaactgcctaca

SEQ ID NO: 163653 - DNA, 25 bp, Mus musculus
agattgcccaagcagcccaaagatg

SEQ ID NO: 163654 - DNA, 25 bp, Mus musculus
agattgcccaaggagcccaaagatg

SEQ ID NO: 163655 - DNA, 25 bp, Mus musculus
agattgccctggattctgttgatac

SEQ ID NO: 163656 - DNA, 25 bp, Mus musculus
agattgccctggtttctgttgatac

SEQ ID NO: 163657 - DNA, 25 bp, Mus musculus
agattgccctgtcatagccattgac

SEQ ID NO: 163658 - DNA, 25 bp, Mus musculus
agattgccctgtgatagccattgac

SEQ ID NO: 163659 - DNA, 25 bp, Mus musculus
agattgcctgctcaattccgtcaga

SEQ ID NO: 163660 - DNA, 25 bp, Mus musculus
agattgcctgctgaattccgtcaga

SEQ ID NO: 163661 - DNA, 25 bp, Mus musculus
agattgcctggcaacactcttttgc

SEQ ID NO: 163662 - DNA, 25 bp, Mus musculus
agattgcctggctacactcttttgc

SEQ ID NO: 163663 - DNA, 25 bp, Mus musculus
agattgcctgggattttagcgcaca

SEQ ID NO: 163664 - DNA, 25 bp, Mus musculus
agattgcctgggtttttagcgcaca

SEQ ID NO: 163665 - DNA, 25 bp, Mus musculus
agattgccttacaaatcctaatgaa

SEQ ID NO: 163666 - DNA, 25 bp, Mus musculus
agattgccttactaatcctaatgaa

SEQ ID NO: 163667 - DNA, 25 bp, Mus musculus
agattgccttctctcataaacagac

SEQ ID NO: 163668 - DNA, 25 bp, Mus musculus
agattgccttctgtcataaacagac

SEQ ID NO: 163669 - DNA, 25 bp, Mus musculus
agattgcggctgagatcgcacaggc

SEQ ID NO: 163670 - DNA, 25 bp, Mus musculus
agattgcggctgaggctcagtgaca

SEQ ID NO: 163671 - DNA, 25 bp, Mus musculus
agattgcggctgagtgtatctctaa

SEQ ID NO: 163672 - DNA, 25 bp, Mus musculus
agattgcggctgtgatcgcacaggc

SEQ ID NO: 163673 - DNA, 25 bp, Mus musculus
agattgcggctgtggctcagtgaca

SEQ ID NO: 163674 - DNA, 25 bp, Mus musculus
agattgcggctgtgtgtatctctaa

SEQ ID NO: 163675 - DNA, 25 bp, Mus musculus
agattgctacatcctttgaagcccc

SEQ ID NO: 163676 - DNA, 25 bp, Mus musculus
agattgctacatgctttgaagcccc

SEQ ID NO: 163677 - DNA, 25 bp, Mus musculus
agattgctaggtaggtagacacaca

SEQ ID NO: 163678 - DNA, 25 bp, Mus musculus
agattgctaggttggtagacacaca

SEQ ID NO: 163679 - DNA, 25 bp, Mus musculus
agattgctcactcagtgaccacctc

SEQ ID NO: 163680 - DNA, 25 bp, Mus musculus
agattgctcactgagtgaccacctc

SEQ ID NO: 163681 - DNA, 25 bp, Mus musculus
agattgctcatcactatgtgataat

SEQ ID NO: 163682 - DNA, 25 bp, Mus musculus
agattgctcatctctatgtgataat

SEQ ID NO: 163683 - DNA, 25 bp, Mus musculus
agattgctcctactgtgtaagtaaa

SEQ ID NO: 163684 - DNA, 25 bp, Mus musculus
agattgctcctagtgtgtaagtaaa

SEQ ID NO: 163685 - DNA, 25 bp, Mus musculus
agattgctcttacgtggtctccaag

SEQ ID NO: 163686 - DNA, 25 bp, Mus musculus
agattgctcttaggtggtctccaag

SEQ ID NO: 163687 - DNA, 25 bp, Mus musculus
agattgctgcctcctctaatcagga

SEQ ID NO: 163688 - DNA, 25 bp, Mus musculus
agattgctgcctctcctataactca

SEQ ID NO: 163689 - DNA, 25 bp, Mus musculus
agattgctgcctgctctaatcagga

SEQ ID NO: 163690 - DNA, 25 bp, Mus musculus
agattgctgcctgtcctataactca

SEQ ID NO: 163691 - DNA, 25 bp, Mus musculus
agattgctgcttctagggtctaggc

SEQ ID NO: 163692 - DNA, 25 bp, Mus musculus
agattgctgcttgtagggtctaggc

SEQ ID NO: 163693 - DNA, 25 bp, Mus musculus
agattgctggtcagtctatgggaca

SEQ ID NO: 163694 - DNA, 25 bp, Mus musculus
agattgctggtctgtctatgggaca

SEQ ID NO: 163695 - DNA, 25 bp, Mus musculus
agattgctgtttataaagacttaag

SEQ ID NO: 163696 - DNA, 25 bp, Mus musculus
agattgctgtttttaaagacttaag

SEQ ID NO: 163697 - DNA, 25 bp, Mus musculus
agattgcttacccattctagaacgg

SEQ ID NO: 163698 - DNA, 25 bp, Mus musculus
agattgcttaccgattctagaacgg

SEQ ID NO: 163699 - DNA, 25 bp, Mus musculus
agattggaataaccgtccgtggttt

SEQ ID NO: 163700 - DNA, 25 bp, Mus musculus
agattggaataagcgtccgtggttt

SEQ ID NO: 163701 - DNA, 25 bp, Mus musculus
agattggacaggctcatctcacact

SEQ ID NO: 163702 - DNA, 25 bp, Mus musculus
agattggacagggtcatctcacact

SEQ ID NO: 163703 - DNA, 25 bp, Mus musculus
agattggactcaaggtcaataccca

SEQ ID NO: 163704 - DNA, 25 bp, Mus musculus
agattggactcatggtcaataccca

SEQ ID NO: 163705 - DNA, 25 bp, Mus musculus
agattggactgacgtcatccgactt

SEQ ID NO: 163706 - DNA, 25 bp, Mus musculus
agattggactgaggtcatccgactt

SEQ ID NO: 163707 - DNA, 25 bp, Mus musculus
agattggagagcagagtcctctgtg

SEQ ID NO: 163708 - DNA, 25 bp, Mus musculus
agattggagagctgagtcctctgtg

SEQ ID NO: 163709 - DNA, 25 bp, Mus musculus
agattggaggccagggttctcactg

SEQ ID NO: 163710 - DNA, 25 bp, Mus musculus
agattggaggcctgggttctcactg

SEQ ID NO: 163711 - DNA, 25 bp, Mus musculus
agattggcaactcacaattcttgtc

SEQ ID NO: 163712 - DNA, 25 bp, Mus musculus
agattggcaactgacaattcttgtc

SEQ ID NO: 163713 - DNA, 25 bp, Mus musculus
agattggcaataagaaacccgctat

SEQ ID NO: 163714 - DNA, 25 bp, Mus musculus
agattggcaatatgaaacccgctat

SEQ ID NO: 163715 - DNA, 25 bp, Mus musculus
agattggcacctatgcctctgtgga

SEQ ID NO: 163716 - DNA, 25 bp, Mus musculus
agattggcacctttgcctctgtgga

SEQ ID NO: 163717 - DNA, 25 bp, Mus musculus
agattggcagttcgaccaccgagct

SEQ ID NO: 163718 - DNA, 25 bp, Mus musculus
agattggcagttctggagttccttt

SEQ ID NO: 163719 - DNA, 25 bp, Mus musculus
agattggcagttggaccaccgagct

SEQ ID NO: 163720 - DNA, 25 bp, Mus musculus
agattggcagttgtggagttccttt

SEQ ID NO: 163721 - DNA, 25 bp, Mus musculus
agattggcatctcggtggaattgtt

SEQ ID NO: 163722 - DNA, 25 bp, Mus musculus
agattggcatctgggtggaattgtt

SEQ ID NO: 163723 - DNA, 25 bp, Mus musculus
agattggccaatctcatcccatgct

SEQ ID NO: 163724 - DNA, 25 bp, Mus musculus
agattggccaatgtcatcccatgct

SEQ ID NO: 163725 - DNA, 25 bp, Mus musculus
agattggccacccacagggtactga

SEQ ID NO: 163726 - DNA, 25 bp, Mus musculus
agattggccaccgacagggtactga

SEQ ID NO: 163727 - DNA, 25 bp, Mus musculus
agattggccagtacagagtcccact

SEQ ID NO: 163728 - DNA, 25 bp, Mus musculus
agattggccagttcagagtcccact

SEQ ID NO: 163729 - DNA, 25 bp, Mus musculus
agattggccatcatggaggcccagc

SEQ ID NO: 163730 - DNA, 25 bp, Mus musculus
agattggccatcttggaggcccagc

SEQ ID NO: 163731 - DNA, 25 bp, Mus musculus
agattggctgtcctgacagggtcct

SEQ ID NO: 163732 - DNA, 25 bp, Mus musculus
agattggctgtcgtgacagggtcct

SEQ ID NO: 163733 - DNA, 25 bp, Mus musculus
agattggcttcaaacttctgtttgc

SEQ ID NO: 163734 - DNA, 25 bp, Mus musculus
agattggcttcatacttctgtttgc

SEQ ID NO: 163735 - DNA, 25 bp, Mus musculus
agattgggaacaccacttaccactc

SEQ ID NO: 163736 - DNA, 25 bp, Mus musculus
agattgggaacagcacttaccactc

SEQ ID NO: 163737 - DNA, 25 bp, Mus musculus
agattgggaagacaggtgcctacct

SEQ ID NO: 163738 - DNA, 25 bp, Mus musculus
agattgggaagagaggtgcctacct

SEQ ID NO: 163739 - DNA, 25 bp, Mus musculus
agattgggacctcccaagccaattt

SEQ ID NO: 163740 - DNA, 25 bp, Mus musculus
agattgggacctgccaagccaattt

SEQ ID NO: 163741 - DNA, 25 bp, Mus musculus
agattgggtactccaactttccatc

SEQ ID NO: 163742 - DNA, 25 bp, Mus musculus
agattgggtactctccctctctggg

SEQ ID NO: 163743 - DNA, 25 bp, Mus musculus
agattgggtactgcaactttccatc

SEQ ID NO: 163744 - DNA, 25 bp, Mus musculus
agattgggtactgtccctctctggg

SEQ ID NO: 163745 - DNA, 25 bp, Mus musculus
agattgggtggcagactttctacca

SEQ ID NO: 163746 - DNA, 25 bp, Mus musculus
agattgggtggctgactttctacca

SEQ ID NO: 163747 - DNA, 25 bp, Mus musculus
agattggtaacaccctttcttgaag

SEQ ID NO: 163748 - DNA, 25 bp, Mus musculus
agattggtaacagcctttcttgaag

SEQ ID NO: 163749 - DNA, 25 bp, Mus musculus
agattggtgaatagtgagctttgtc

SEQ ID NO: 163750 - DNA, 25 bp, Mus musculus
agattggtgaattgtgagctttgtc

SEQ ID NO: 163751 - DNA, 25 bp, Mus musculus
agattggtgccacagacctttcttc

SEQ ID NO: 163752 - DNA, 25 bp, Mus musculus
agattggtgccagagacctttcttc

SEQ ID NO: 163753 - DNA, 25 bp, Mus musculus
agattggtggttattgatgctcgat

SEQ ID NO: 163754 - DNA, 25 bp, Mus musculus
agattggtggtttttgatgctcgat

SEQ ID NO: 163755 - DNA, 25 bp, Mus musculus
agattggtgttcacgattgtgttcg

SEQ ID NO: 163756 - DNA, 25 bp, Mus musculus
agattggtgttctcgattgtgttcg

SEQ ID NO: 163757 - DNA, 25 bp, Mus musculus
agattggttcacagcactcgtatcg

SEQ ID NO: 163758 - DNA, 25 bp, Mus musculus
agattggttcactgcactcgtatcg

SEQ ID NO: 163759 - DNA, 25 bp, Mus musculus
agattggttctcatgaaggctgctc

SEQ ID NO: 163760 - DNA, 25 bp, Mus musculus
agattggttctcttgaaggctgctc

SEQ ID NO: 163761 - DNA, 25 bp, Mus musculus
agattggttgacagctttccctaga

SEQ ID NO: 163762 - DNA, 25 bp, Mus musculus
agattggttgactgctttccctaga

SEQ ID NO: 163763 - DNA, 25 bp, Mus musculus
agattggttgatcctccttcatgtt

SEQ ID NO: 163764 - DNA, 25 bp, Mus musculus
agattggttgatgctccttcatgtt

SEQ ID NO: 163765 - DNA, 25 bp, Mus musculus
agattggtttcaatcgttctcccca

SEQ ID NO: 163766 - DNA, 25 bp, Mus musculus
agattggtttcattcgttctcccca

SEQ ID NO: 163767 - DNA, 25 bp, Mus musculus
agattgtacctaccccattgtttct

SEQ ID NO: 163768 - DNA, 25 bp, Mus musculus
agattgtacctagcccattgtttct

SEQ ID NO: 163769 - DNA, 25 bp, Mus musculus
agattgtaggcacttctagctccat

SEQ ID NO: 163770 - DNA, 25 bp, Mus musculus
agattgtaggcagttctagctccat

SEQ ID NO: 163771 - DNA, 25 bp, Mus musculus
agattgtaggttatgccttcctcct

SEQ ID NO: 163772 - DNA, 25 bp, Mus musculus
agattgtaggttttgccttcctcct

SEQ ID NO: 163773 - DNA, 25 bp, Mus musculus
agattgtagtgaaccgtaggcttgg

SEQ ID NO: 163774 - DNA, 25 bp, Mus musculus
agattgtagtgatccgtaggcttgg

SEQ ID NO: 163775 - DNA, 25 bp, Mus musculus
agattgtattaacctctgccagaga

SEQ ID NO: 163776 - DNA, 25 bp, Mus musculus
agattgtattaagctctgccagaga

SEQ ID NO: 163777 - DNA, 25 bp, Mus musculus
agattgtcaagaatgtcagctgtca

SEQ ID NO: 163778 - DNA, 25 bp, Mus musculus
agattgtcaagattgtcagctgtca

SEQ ID NO: 163779 - DNA, 25 bp, Mus musculus
agattgtcaatcaaactgcggcttt

SEQ ID NO: 163780 - DNA, 25 bp, Mus musculus
agattgtcaatctaactgcggcttt

SEQ ID NO: 163781 - DNA, 25 bp, Mus musculus
agattgtcagtgcatactccttcct

SEQ ID NO: 163782 - DNA, 25 bp, Mus musculus
agattgtcagtggatactccttcct

SEQ ID NO: 163783 - DNA, 25 bp, Mus musculus
agattgtccagtcctgcaaccatgt

SEQ ID NO: 163784 - DNA, 25 bp, Mus musculus
agattgtccagtgctgcaaccatgt

SEQ ID NO: 163785 - DNA, 25 bp, Mus musculus
agattgtccattaataccaccctta

SEQ ID NO: 163786 - DNA, 25 bp, Mus musculus
agattgtccatttataccaccctta

SEQ ID NO: 163787 - DNA, 25 bp, Mus musculus
agattgtccctaccgcagactccag

SEQ ID NO: 163788 - DNA, 25 bp, Mus musculus
agattgtccctagcgcagactccag

SEQ ID NO: 163789 - DNA, 25 bp, Mus musculus
agattgtcctgaatttcctctagaa

SEQ ID NO: 163790 - DNA, 25 bp, Mus musculus
agattgtcctgattttcctctagaa

SEQ ID NO: 163791 - DNA, 25 bp, Mus musculus
agattgtcctgccacttgcactgtg

SEQ ID NO: 163792 - DNA, 25 bp, Mus musculus
agattgtcctgcgacttgcactgtg

SEQ ID NO: 163793 - DNA, 25 bp, Mus musculus
agattgtctctcacaccagtggcca

SEQ ID NO: 163794 - DNA, 25 bp, Mus musculus
agattgtctctctcaccagtggcca

SEQ ID NO: 163795 - DNA, 25 bp, Mus musculus
agattgtctgggagctcactcagag

SEQ ID NO: 163796 - DNA, 25 bp, Mus musculus
agattgtctgggtgctcactcagag

SEQ ID NO: 163797 - DNA, 25 bp, Mus musculus
agattgtgacccagggaggcaaccc

SEQ ID NO: 163798 - DNA, 25 bp, Mus musculus
agattgtgaccctgggaggcaaccc

SEQ ID NO: 163799 - DNA, 25 bp, Mus musculus
agattgtgacggactacaccctggc

SEQ ID NO: 163800 - DNA, 25 bp, Mus musculus
agattgtgacggtctacaccctggc

SEQ ID NO: 163801 - DNA, 25 bp, Mus musculus
agattgtgagacagcttccttgaaa

SEQ ID NO: 163802 - DNA, 25 bp, Mus musculus
agattgtgagactgcttccttgaaa

SEQ ID NO: 163803 - DNA, 25 bp, Mus musculus
agattgtgcaccattgtaatcccag

SEQ ID NO: 163804 - DNA, 25 bp, Mus musculus
agattgtgcacctttgtaatcccag

SEQ ID NO: 163805 - DNA, 25 bp, Mus musculus
agattgtgccaacctaccgcactca

SEQ ID NO: 163806 - DNA, 25 bp, Mus musculus
agattgtgccaagctaccgcactca

SEQ ID NO: 163807 - DNA, 25 bp, Mus musculus
agattgtgctctctgaggcacctca

SEQ ID NO: 163808 - DNA, 25 bp, Mus musculus
agattgtgctctgtgaggcacctca

SEQ ID NO: 163809 - DNA, 25 bp, Mus musculus
agattgtgctgacccctgagctaga

SEQ ID NO: 163810 - DNA, 25 bp, Mus musculus
agattgtgctgagccctgagctaga

SEQ ID NO: 163811 - DNA, 25 bp, Mus musculus
agattgtgcttccttcagattgtac

SEQ ID NO: 163812 - DNA, 25 bp, Mus musculus
agattgtgcttcgttcagattgtac

SEQ ID NO: 163813 - DNA, 25 bp, Mus musculus
agattgtgcttgatcaaggtgagcc

SEQ ID NO: 163814 - DNA, 25 bp, Mus musculus
agattgtgcttgttcaaggtgagcc

SEQ ID NO: 163815 - DNA, 25 bp, Mus musculus
agattgtggaggatcatgagtttac

SEQ ID NO: 163816 - DNA, 25 bp, Mus musculus
agattgtggaggttcatgagtttac

SEQ ID NO: 163817 - DNA, 25 bp, Mus musculus
agattgtggatcatcagattgataa

SEQ ID NO: 163818 - DNA, 25 bp, Mus musculus
agattgtggatcttcagattgataa

SEQ ID NO: 163819 - DNA, 25 bp, Mus musculus
agattgtggcttcagtgttttctct

SEQ ID NO: 163820 - DNA, 25 bp, Mus musculus
agattgtggcttgagtgttttctct

SEQ ID NO: 163821 - DNA, 25 bp, Mus musculus
agattgtgtcatcgaggccttgtat

SEQ ID NO: 163822 - DNA, 25 bp, Mus musculus
agattgtgtcatggaggccttgtat

SEQ ID NO: 163823 - DNA, 25 bp, Mus musculus
agattgtgtctgcaccaggagggat

SEQ ID NO: 163824 - DNA, 25 bp, Mus musculus
agattgtgtctggaccaggagggat

SEQ ID NO: 163825 - DNA, 25 bp, Mus musculus
agattgttagatatcacccagtggg

SEQ ID NO: 163826 - DNA, 25 bp, Mus musculus
agattgttagatttcacccagtggg

SEQ ID NO: 163827 - DNA, 25 bp, Mus musculus
agattgttatgcctcactgtatagc

SEQ ID NO: 163828 - DNA, 25 bp, Mus musculus
agattgttatgcgtcactgtatagc

SEQ ID NO: 163829 - DNA, 25 bp, Mus musculus
agattgttcaggctccaatcccgag

SEQ ID NO: 163830 - DNA, 25 bp, Mus musculus
agattgttcagggtccaatcccgag

SEQ ID NO: 163831 - DNA, 25 bp, Mus musculus
agattgttcatgaaacgcaaccttg

SEQ ID NO: 163832 - DNA, 25 bp, Mus musculus
agattgttcatgtaacgcaaccttg

SEQ ID NO: 163833 - DNA, 25 bp, Mus musculus
agattgttccctccctgtctttgta

SEQ ID NO: 163834 - DNA, 25 bp, Mus musculus
agattgttccctgcctgtctttgta

SEQ ID NO: 163835 - DNA, 25 bp, Mus musculus
agattgttctacacagcgtttccag

SEQ ID NO: 163836 - DNA, 25 bp, Mus musculus
agattgttctacatggtttgctcag

SEQ ID NO: 163837 - DNA, 25 bp, Mus musculus
agattgttctactcagcgtttccag

SEQ ID NO: 163838 - DNA, 25 bp, Mus musculus
agattgttctacttggtttgctcag

SEQ ID NO: 163839 - DNA, 25 bp, Mus musculus
agattgttgtgtctgtggcttccct

SEQ ID NO: 163840 - DNA, 25 bp, Mus musculus
agattgttgtgtgtgtggcttccct

SEQ ID NO: 163841 - DNA, 25 bp, Mus musculus
agattgtttcctccctggtgtaacc

SEQ ID NO: 163842 - DNA, 25 bp, Mus musculus
agattgtttcctgcctggtgtaacc

SEQ ID NO: 163843 - DNA, 25 bp, Mus musculus
agattgtttctgctgaggcctcggc

SEQ ID NO: 163844 - DNA, 25 bp, Mus musculus
agattgtttctggtgaggcctcggc

SEQ ID NO: 163845 - DNA, 25 bp, Mus musculus
agattgttttcacgcttgatcaaat

SEQ ID NO: 163846 - DNA, 25 bp, Mus musculus
agattgttttcaggcttgatcaaat

SEQ ID NO: 163847 - DNA, 25 bp, Mus musculus
agattgtttttacaatgactgcttt

SEQ ID NO: 163848 - DNA, 25 bp, Mus musculus
agattgtttttagaatgactgcttt

SEQ ID NO: 163849 - DNA, 25 bp, Mus musculus
agatttaaatttccacgtcttcttg

SEQ ID NO: 163850 - DNA, 25 bp, Mus musculus
agatttaaatttgcacgtcttcttg

SEQ ID NO: 163851 - DNA, 25 bp, Mus musculus
agatttaaccaccaagttcctgtct

SEQ ID NO: 163852 - DNA, 25 bp, Mus musculus
agatttaaccacgaagttcctgtct

SEQ ID NO: 163853 - DNA, 25 bp, Mus musculus
agatttaaccatcaactggcccact

SEQ ID NO: 163854 - DNA, 25 bp, Mus musculus
agatttaaccatgaactggcccact

SEQ ID NO: 163855 - DNA, 25 bp, Mus musculus
agatttaaggccacagatgacacaa

SEQ ID NO: 163856 - DNA, 25 bp, Mus musculus
agatttaaggcctcagatgacacaa

SEQ ID NO: 163857 - DNA, 25 bp, Mus musculus
agatttaatatcagtcagtacccgt

SEQ ID NO: 163858 - DNA, 25 bp, Mus musculus
agatttaatatctgtcagtacccgt

SEQ ID NO: 163859 - DNA, 25 bp, Mus musculus
agatttaatctgcatttccctgatg

SEQ ID NO: 163860 - DNA, 25 bp, Mus musculus
agatttaatctggatttccctgatg

SEQ ID NO: 163861 - DNA, 25 bp, Mus musculus
agatttaatgccaatatttctcaaa

SEQ ID NO: 163862 - DNA, 25 bp, Mus musculus
agatttaatgcctatatttctcaaa

SEQ ID NO: 163863 - DNA, 25 bp, Mus musculus
agatttaattagaatgcccagagag

SEQ ID NO: 163864 - DNA, 25 bp, Mus musculus
agatttaattagtatgcccagagag

SEQ ID NO: 163865 - DNA, 25 bp, Mus musculus
agatttacaatgatcccgtggctgc

SEQ ID NO: 163866 - DNA, 25 bp, Mus musculus
agatttacaatgttcccgtggctgc

SEQ ID NO: 163867 - DNA, 25 bp, Mus musculus
agatttacctatactgagaccagat

SEQ ID NO: 163868 - DNA, 25 bp, Mus musculus
agatttacctattctgagaccagat

SEQ ID NO: 163869 - DNA, 25 bp, Mus musculus
agatttactgcacctctcttatggt

SEQ ID NO: 163870 - DNA, 25 bp, Mus musculus
agatttactgcagctctcttatggt

SEQ ID NO: 163871 - DNA, 25 bp, Mus musculus
agatttactgccagccatttgctgc

SEQ ID NO: 163872 - DNA, 25 bp, Mus musculus
agatttactgcctgccatttgctgc

SEQ ID NO: 163873 - DNA, 25 bp, Mus musculus
agatttagagacctgggattacttc

SEQ ID NO: 163874 - DNA, 25 bp, Mus musculus
agatttagagacgtgggattacttc

SEQ ID NO: 163875 - DNA, 25 bp, Mus musculus
agatttagagccaagtttgtgcccc

SEQ ID NO: 163876 - DNA, 25 bp, Mus musculus
agatttagagcctagtttgtgcccc

SEQ ID NO: 163877 - DNA, 25 bp, Mus musculus
agatttagcgtgatctcgggtgcgt

SEQ ID NO: 163878 - DNA, 25 bp, Mus musculus
agatttagcgtgttctcgggtgcgt

SEQ ID NO: 163879 - DNA, 25 bp, Mus musculus
agatttagctgtcagaggcaactgt

SEQ ID NO: 163880 - DNA, 25 bp, Mus musculus
agatttagctgtgagaggcaactgt

SEQ ID NO: 163881 - DNA, 25 bp, Mus musculus
agatttaggcagctttcctcacaga

SEQ ID NO: 163882 - DNA, 25 bp, Mus musculus
agatttaggcaggtttcctcacaga

SEQ ID NO: 163883 - DNA, 25 bp, Mus musculus
agatttaggcatcctcttacactgc

SEQ ID NO: 163884 - DNA, 25 bp, Mus musculus
agatttaggcatgctcttacactgc

SEQ ID NO: 163885 - DNA, 25 bp, Mus musculus
agatttagtatcacatgggccaaag

SEQ ID NO: 163886 - DNA, 25 bp, Mus musculus
agatttagtatctcatgggccaaag

SEQ ID NO: 163887 - DNA, 25 bp, Mus musculus
agatttagttgcacatgatcaggag

SEQ ID NO: 163888 - DNA, 25 bp, Mus musculus
agatttagttgctcatgatcaggag

SEQ ID NO: 163889 - DNA, 25 bp, Mus musculus
agatttatacatccgtttttaatga

SEQ ID NO: 163890 - DNA, 25 bp, Mus musculus
agatttatacatgcgtttttaatga

SEQ ID NO: 163891 - DNA, 25 bp, Mus musculus
agatttatatctcggtcttcgattc

SEQ ID NO: 163892 - DNA, 25 bp, Mus musculus
agatttatatctgggtcttcgattc

SEQ ID NO: 163893 - DNA, 25 bp, Mus musculus
agatttatgtgaccatcccctccac

SEQ ID NO: 163894 - DNA, 25 bp, Mus musculus
agatttatgtgagcatcccctccac

SEQ ID NO: 163895 - DNA, 25 bp, Mus musculus
agatttattctaactctcaataatg

SEQ ID NO: 163896 - DNA, 25 bp, Mus musculus
agatttattctatctctcaataatg

SEQ ID NO: 163897 - DNA, 25 bp, Mus musculus
agatttattgttcagctgctggcat

SEQ ID NO: 163898 - DNA, 25 bp, Mus musculus
agatttattgttgagctgctggcat

SEQ ID NO: 163899 - DNA, 25 bp, Mus musculus
agatttatttataaccacatggtct

SEQ ID NO: 163900 - DNA, 25 bp, Mus musculus
agatttatttattaccacatggtct

SEQ ID NO: 163901 - DNA, 25 bp, Mus musculus
agatttcaaccccaacttagagcta

SEQ ID NO: 163902 - DNA, 25 bp, Mus musculus
agatttcaacccgaacttagagcta

SEQ ID NO: 163903 - DNA, 25 bp, Mus musculus
agatttcaagagactcagtggcaca

SEQ ID NO: 163904 - DNA, 25 bp, Mus musculus
agatttcaagagtctcagtggcaca

SEQ ID NO: 163905 - DNA, 25 bp, Mus musculus
agatttcacaatcgcccctggctgc

SEQ ID NO: 163906 - DNA, 25 bp, Mus musculus
agatttcacaatggcccctggctgc

SEQ ID NO: 163907 - DNA, 25 bp, Mus musculus
agatttcacaggacactattgtggg

SEQ ID NO: 163908 - DNA, 25 bp, Mus musculus
agatttcacaggtcactattgtggg

SEQ ID NO: 163909 - DNA, 25 bp, Mus musculus
agatttcaccacaagtcaggagctg

SEQ ID NO: 163910 - DNA, 25 bp, Mus musculus
agatttcaccactagtcaggagctg

SEQ ID NO: 163911 - DNA, 25 bp, Mus musculus
agatttcaccagacttaccaacagc

SEQ ID NO: 163912 - DNA, 25 bp, Mus musculus
agatttcaccagtcttaccaacagc

SEQ ID NO: 163913 - DNA, 25 bp, Mus musculus
agatttcaccctatatctttgcagg

SEQ ID NO: 163914 - DNA, 25 bp, Mus musculus
agatttcaccctttatctttgcagg

SEQ ID NO: 163915 - DNA, 25 bp, Mus musculus
agatttcactatatctccagatgtg

SEQ ID NO: 163916 - DNA, 25 bp, Mus musculus
agatttcactatttctccagatgtg

SEQ ID NO: 163917 - DNA, 25 bp, Mus musculus
agatttcactgtatccttatgctgt

SEQ ID NO: 163918 - DNA, 25 bp, Mus musculus
agatttcactgtttccttatgctgt

SEQ ID NO: 163919 - DNA, 25 bp, Mus musculus
agatttcagactctcagacttccaa

SEQ ID NO: 163920 - DNA, 25 bp, Mus musculus
agatttcagactgtcagacttccaa

SEQ ID NO: 163921 - DNA, 25 bp, Mus musculus
agatttcagaggctccatgaccagc

SEQ ID NO: 163922 - DNA, 25 bp, Mus musculus
agatttcagagggtccatgaccagc

SEQ ID NO: 163923 - DNA, 25 bp, Mus musculus
agatttcagattaacgaagctttga

SEQ ID NO: 163924 - DNA, 25 bp, Mus musculus
agatttcagatttacgaagctttga

SEQ ID NO: 163925 - DNA, 25 bp, Mus musculus
agatttcagcaaacatcaggcattt

SEQ ID NO: 163926 - DNA, 25 bp, Mus musculus
agatttcagcaatcatcaggcattt

SEQ ID NO: 163927 - DNA, 25 bp, Mus musculus
agatttcagcccacctaaagctggg

SEQ ID NO: 163928 - DNA, 25 bp, Mus musculus
agatttcagccctcctaaagctggg

SEQ ID NO: 163929 - DNA, 25 bp, Mus musculus
agatttcagctcaaagcctcactaa

SEQ ID NO: 163930 - DNA, 25 bp, Mus musculus
agatttcagctctaagcctcactaa

SEQ ID NO: 163931 - DNA, 25 bp, Mus musculus
agatttcagcttcccatcaaaactg

SEQ ID NO: 163932 - DNA, 25 bp, Mus musculus
agatttcagcttgccatcaaaactg

SEQ ID NO: 163933 - DNA, 25 bp, Mus musculus
agatttcaggaaaatcacattcagc

SEQ ID NO: 163934 - DNA, 25 bp, Mus musculus
agatttcaggaatatcacattcagc

SEQ ID NO: 163935 - DNA, 25 bp, Mus musculus
agatttcagggcctgtctttaccca

SEQ ID NO: 163936 - DNA, 25 bp, Mus musculus
agatttcagggcgtgtctttaccca

SEQ ID NO: 163937 - DNA, 25 bp, Mus musculus
agatttcagtatccatagtttacga

SEQ ID NO: 163938 - DNA, 25 bp, Mus musculus
agatttcagtatgcatagtttacga

SEQ ID NO: 163939 - DNA, 25 bp, Mus musculus
agatttcagtccaccatcttaacct

SEQ ID NO: 163940 - DNA, 25 bp, Mus musculus
agatttcagtcctccatcttaacct

SEQ ID NO: 163941 - DNA, 25 bp, Mus musculus
agatttcagtctcaacgatgccctg

SEQ ID NO: 163942 - DNA, 25 bp, Mus musculus
agatttcagtctgaacgatgccctg

SEQ ID NO: 163943 - DNA, 25 bp, Mus musculus
agatttcatacgacatttgatggag

SEQ ID NO: 163944 - DNA, 25 bp, Mus musculus
agatttcatacgtcatttgatggag

SEQ ID NO: 163945 - DNA, 25 bp, Mus musculus
agatttcatttcagtcccgatgcta

SEQ ID NO: 163946 - DNA, 25 bp, Mus musculus
agatttcatttctgtcccgatgcta

SEQ ID NO: 163947 - DNA, 25 bp, Mus musculus
agatttccaattcacgccccacttt

SEQ ID NO: 163948 - DNA, 25 bp, Mus musculus
agatttccaattgacgccccacttt

SEQ ID NO: 163949 - DNA, 25 bp, Mus musculus
agatttccacaaccaagtcactagt

SEQ ID NO: 163950 - DNA, 25 bp, Mus musculus
agatttccacaagcaagtcactagt

SEQ ID NO: 163951 - DNA, 25 bp, Mus musculus
agatttccacaccttcaaagagaag

SEQ ID NO: 163952 - DNA, 25 bp, Mus musculus
agatttccacacgttcaaagagaag

SEQ ID NO: 163953 - DNA, 25 bp, Mus musculus
agatttccaggaaggtcccacatag

SEQ ID NO: 163954 - DNA, 25 bp, Mus musculus
agatttccaggatggtcccacatag

SEQ ID NO: 163955 - DNA, 25 bp, Mus musculus
agatttccagttcagtggctccatt

SEQ ID NO: 163956 - DNA, 25 bp, Mus musculus
agatttccagttgagtggctccatt

SEQ ID NO: 163957 - DNA, 25 bp, Mus musculus
agatttccatgtaccagctctggga

SEQ ID NO: 163958 - DNA, 25 bp, Mus musculus
agatttccatgttccagctctggga

SEQ ID NO: 163959 - DNA, 25 bp, Mus musculus
agatttcccaccagaagcaagggag

SEQ ID NO: 163960 - DNA, 25 bp, Mus musculus
agatttcccacctgaagcaagggag

SEQ ID NO: 163961 - DNA, 25 bp, Mus musculus
agatttcccatactaccatgacgac

SEQ ID NO: 163962 - DNA, 25 bp, Mus musculus
agatttcccatagtaccatgacgac

SEQ ID NO: 163963 - DNA, 25 bp, Mus musculus
agatttccccttagatcctcggatg

SEQ ID NO: 163964 - DNA, 25 bp, Mus musculus
agatttcccctttgatcctcggatg

SEQ ID NO: 163965 - DNA, 25 bp, Mus musculus
agatttcccgtaaactttctcgcag

SEQ ID NO: 163966 - DNA, 25 bp, Mus musculus
agatttcccgtatactttctcgcag

SEQ ID NO: 163967 - DNA, 25 bp, Mus musculus
agatttccctgtatctcagttcaca

SEQ ID NO: 163968 - DNA, 25 bp, Mus musculus
agatttccctgtttctcagttcaca

SEQ ID NO: 163969 - DNA, 25 bp, Mus musculus
agatttccgagcactgtacccagtt

SEQ ID NO: 163970 - DNA, 25 bp, Mus musculus
agatttccgagctctgtacccagtt

SEQ ID NO: 163971 - DNA, 25 bp, Mus musculus
agatttccgcggactcttttgaagc

SEQ ID NO: 163972 - DNA, 25 bp, Mus musculus
agatttccgcggtctcttttgaagc

SEQ ID NO: 163973 - DNA, 25 bp, Mus musculus
agatttcctacaatgacttcctgcg

SEQ ID NO: 163974 - DNA, 25 bp, Mus musculus
agatttcctacacggatgacctgct

SEQ ID NO: 163975 - DNA, 25 bp, Mus musculus
agatttcctacagggatgacctgct

SEQ ID NO: 163976 - DNA, 25 bp, Mus musculus
agatttcctacattgacttcctgcg

SEQ ID NO: 163977 - DNA, 25 bp, Mus musculus
agatttcctactagaagcccttgcc

SEQ ID NO: 163978 - DNA, 25 bp, Mus musculus
agatttcctacttgaagcccttgcc

SEQ ID NO: 163979 - DNA, 25 bp, Mus musculus
agatttcctagaaatcttttgatgt

SEQ ID NO: 163980 - DNA, 25 bp, Mus musculus
agatttcctagatatcttttgatgt

SEQ ID NO: 163981 - DNA, 25 bp, Mus musculus
agatttcctgagaacactctggcct

SEQ ID NO: 163982 - DNA, 25 bp, Mus musculus
agatttcctgagcagtgcttgcgga

SEQ ID NO: 163983 - DNA, 25 bp, Mus musculus
agatttcctgaggagtgcttgcgga

SEQ ID NO: 163984 - DNA, 25 bp, Mus musculus
agatttcctgagtacactctggcct

SEQ ID NO: 163985 - DNA, 25 bp, Mus musculus
agatttccttaacacagtggctctt

SEQ ID NO: 163986 - DNA, 25 bp, Mus musculus
agatttccttaagacagtggctctt

SEQ ID NO: 163987 - DNA, 25 bp, Mus musculus
agatttccttagcatttctgccagc

SEQ ID NO: 163988 - DNA, 25 bp, Mus musculus
agatttccttaggatttctgccagc

SEQ ID NO: 163989 - DNA, 25 bp, Mus musculus
agatttcctttgctacagtttttgt

SEQ ID NO: 163990 - DNA, 25 bp, Mus musculus
agatttcctttggtacagtttttgt

SEQ ID NO: 163991 - DNA, 25 bp, Mus musculus
agatttcgaagacatgaggaaggct

SEQ ID NO: 163992 - DNA, 25 bp, Mus musculus
agatttcgaagagatgaggaaggct

SEQ ID NO: 163993 - DNA, 25 bp, Mus musculus
agatttcgtgccctgagctttaacc

SEQ ID NO: 163994 - DNA, 25 bp, Mus musculus
agatttcgtgccgtgagctttaacc

SEQ ID NO: 163995 - DNA, 25 bp, Mus musculus
agatttctagctcccgcttcgcaag

SEQ ID NO: 163996 - DNA, 25 bp, Mus musculus
agatttctagctgccgcttcgcaag

SEQ ID NO: 163997 - DNA, 25 bp, Mus musculus
agatttctatctacattattggaaa

SEQ ID NO: 163998 - DNA, 25 bp, Mus musculus
agatttctatcttcattattggaaa

SEQ ID NO: 163999 - DNA, 25 bp, Mus musculus
agatttctatggcaattggcaagca

SEQ ID NO: 164000 - DNA, 25 bp, Mus musculus
agatttctatgggaattggcaagca

SEQ ID NO: 164001 - DNA, 25 bp, Mus musculus
agatttctcagcagatgaggcgcta

SEQ ID NO: 164002 - DNA, 25 bp, Mus musculus
agatttctcagctgatgaggcgcta

SEQ ID NO: 164003 - DNA, 25 bp, Mus musculus
agatttctccagcatgtccttagag

SEQ ID NO: 164004 - DNA, 25 bp, Mus musculus
agatttctccagctggttgcagcca

SEQ ID NO: 164005 - DNA, 25 bp, Mus musculus
agatttctccaggatgtccttagag

SEQ ID NO: 164006 - DNA, 25 bp, Mus musculus
agatttctccaggtggttgcagcca

SEQ ID NO: 164007 - DNA, 25 bp, Mus musculus
agatttctcccaactaggttggcaa

SEQ ID NO: 164008 - DNA, 25 bp, Mus musculus
agatttctcccatctaggttggcaa

SEQ ID NO: 164009 - DNA, 25 bp, Mus musculus
agatttctcgagagcaggtgcccag

SEQ ID NO: 164010 - DNA, 25 bp, Mus musculus
agatttctcgagtgcaggtgcccag

SEQ ID NO: 164011 - DNA, 25 bp, Mus musculus
agatttctctagacccagagcttaa

SEQ ID NO: 164012 - DNA, 25 bp, Mus musculus
agatttctctagtcccagagcttaa

SEQ ID NO: 164013 - DNA, 25 bp, Mus musculus
agatttctctgtcacctcaccctgg

SEQ ID NO: 164014 - DNA, 25 bp, Mus musculus
agatttctctgtgacctcaccctgg

SEQ ID NO: 164015 - DNA, 25 bp, Mus musculus
agatttctgaaaccctagataggtc

SEQ ID NO: 164016 - DNA, 25 bp, Mus musculus
agatttctgaaagcctagataggtc

SEQ ID NO: 164017 - DNA, 25 bp, Mus musculus
agatttctgaatcacctatgtgtag

SEQ ID NO: 164018 - DNA, 25 bp, Mus musculus
agatttctgaatgacctatgtgtag

SEQ ID NO: 164019 - DNA, 25 bp, Mus musculus
agatttctgagacaagccctgtgta

SEQ ID NO: 164020 - DNA, 25 bp, Mus musculus
agatttctgagagaagccctgtgta

SEQ ID NO: 164021 - DNA, 25 bp, Mus musculus
agatttctgaggcacccagtttacc

SEQ ID NO: 164022 - DNA, 25 bp, Mus musculus
agatttctgagggacccagtttacc

SEQ ID NO: 164023 - DNA, 25 bp, Mus musculus
agatttctgcagatctggactcagg

SEQ ID NO: 164024 - DNA, 25 bp, Mus musculus
agatttctgcagttctggactcagg

SEQ ID NO: 164025 - DNA, 25 bp, Mus musculus
agatttctgccacgtctacattcag

SEQ ID NO: 164026 - DNA, 25 bp, Mus musculus
agatttctgccaggtctacattcag

SEQ ID NO: 164027 - DNA, 25 bp, Mus musculus
agatttctggagatccccaaatctt

SEQ ID NO: 164028 - DNA, 25 bp, Mus musculus
agatttctggagttccccaaatctt

SEQ ID NO: 164029 - DNA, 25 bp, Mus musculus
agatttctggccaaacctactcagg

SEQ ID NO: 164030 - DNA, 25 bp, Mus musculus
agatttctggcctaacctactcagg

SEQ ID NO: 164031 - DNA, 25 bp, Mus musculus
agatttctgggtctctaccagctac

SEQ ID NO: 164032 - DNA, 25 bp, Mus musculus
agatttctgggtgtctaccagctac

SEQ ID NO: 164033 - DNA, 25 bp, Mus musculus
agatttctggtgaaccctgtggtta

SEQ ID NO: 164034 - DNA, 25 bp, Mus musculus
agatttctggtgtaccctgtggtta

SEQ ID NO: 164035 - DNA, 25 bp, Mus musculus
agatttctgtgtcaatcttggcgcc

SEQ ID NO: 164036 - DNA, 25 bp, Mus musculus
agatttctgtgtgaatcttggcgcc

SEQ ID NO: 164037 - DNA, 25 bp, Mus musculus
agatttcttacaccatctactcgac

SEQ ID NO: 164038 - DNA, 25 bp, Mus musculus
agatttcttacagcatctactcgac

SEQ ID NO: 164039 - DNA, 25 bp, Mus musculus
agatttcttcacatgctttcttcct

SEQ ID NO: 164040 - DNA, 25 bp, Mus musculus
agatttcttcacttgctttcttcct

SEQ ID NO: 164041 - DNA, 25 bp, Mus musculus
agatttcttgaccactttaccttgc

SEQ ID NO: 164042 - DNA, 25 bp, Mus musculus
agatttcttgacgactttaccttgc

SEQ ID NO: 164043 - DNA, 25 bp, Mus musculus
agatttcttgatcacccctgacttc

SEQ ID NO: 164044 - DNA, 25 bp, Mus musculus
agatttcttgatgacccctgacttc

SEQ ID NO: 164045 - DNA, 25 bp, Mus musculus
agatttcttggtctgctggtgtatt

SEQ ID NO: 164046 - DNA, 25 bp, Mus musculus
agatttcttggtgtgctggtgtatt

SEQ ID NO: 164047 - DNA, 25 bp, Mus musculus
agatttctttctaccactggtggag

SEQ ID NO: 164048 - DNA, 25 bp, Mus musculus
agatttctttcttccactggtggag

SEQ ID NO: 164049 - DNA, 25 bp, Mus musculus
agatttgaaagtagtggtgagccac

SEQ ID NO: 164050 - DNA, 25 bp, Mus musculus
agatttgaaagttgtggtgagccac

SEQ ID NO: 164051 - DNA, 25 bp, Mus musculus
agatttgaccggcaggcttcagcag

SEQ ID NO: 164052 - DNA, 25 bp, Mus musculus
agatttgaccgggaggcttcagcag

SEQ ID NO: 164053 - DNA, 25 bp, Mus musculus
agatttgagcagaggcctcttctgc

SEQ ID NO: 164054 - DNA, 25 bp, Mus musculus
agatttgagcagtggcctcttctgc

SEQ ID NO: 164055 - DNA, 25 bp, Mus musculus
agatttgaggacacgttgtgtacct

SEQ ID NO: 164056 - DNA, 25 bp, Mus musculus
agatttgaggactcgttgtgtacct

SEQ ID NO: 164057 - DNA, 25 bp, Mus musculus
agatttgagtatacagacagcgctg

SEQ ID NO: 164058 - DNA, 25 bp, Mus musculus
agatttgagtattcagacagcgctg

SEQ ID NO: 164059 - DNA, 25 bp, Mus musculus
agatttgatgaccttgccggactgt

SEQ ID NO: 164060 - DNA, 25 bp, Mus musculus
agatttgatgacgttgccggactgt

SEQ ID NO: 164061 - DNA, 25 bp, Mus musculus
agatttgatgccacgcaggcctttg

SEQ ID NO: 164062 - DNA, 25 bp, Mus musculus
agatttgatgcctcgcaggcctttg

SEQ ID NO: 164063 - DNA, 25 bp, Mus musculus
agatttgatgtacaccacccaactg

SEQ ID NO: 164064 - DNA, 25 bp, Mus musculus
agatttgatgtagaccacccaactg

SEQ ID NO: 164065 - DNA, 25 bp, Mus musculus
agatttgattctagaaaagcagcct

SEQ ID NO: 164066 - DNA, 25 bp, Mus musculus
agatttgattcttgaaaagcagcct

SEQ ID NO: 164067 - DNA, 25 bp, Mus musculus
agatttgattggctgctcagtcaca

SEQ ID NO: 164068 - DNA, 25 bp, Mus musculus
agatttgattgggtgctcagtcaca

SEQ ID NO: 164069 - DNA, 25 bp, Mus musculus
agatttgcaacccatgttacttagg

SEQ ID NO: 164070 - DNA, 25 bp, Mus musculus
agatttgcaaccgatgttacttagg

SEQ ID NO: 164071 - DNA, 25 bp, Mus musculus
agatttgcactaatgttcctcccct

SEQ ID NO: 164072 - DNA, 25 bp, Mus musculus
agatttgcactattgttcctcccct

SEQ ID NO: 164073 - DNA, 25 bp, Mus musculus
agatttgcagtaatccccatctggc

SEQ ID NO: 164074 - DNA, 25 bp, Mus musculus
agatttgcagtattccccatctggc

SEQ ID NO: 164075 - DNA, 25 bp, Mus musculus
agatttgcatacagcctcatacagt

SEQ ID NO: 164076 - DNA, 25 bp, Mus musculus
agatttgcatactgcctcatacagt

SEQ ID NO: 164077 - DNA, 25 bp, Mus musculus
agatttgcatccattgtgccacgtc

SEQ ID NO: 164078 - DNA, 25 bp, Mus musculus
agatttgcatcctttgtgccacgtc

SEQ ID NO: 164079 - DNA, 25 bp, Mus musculus
agatttgcccagaagagccatccca

SEQ ID NO: 164080 - DNA, 25 bp, Mus musculus
agatttgcccagtagagccatccca

SEQ ID NO: 164081 - DNA, 25 bp, Mus musculus
agatttgccctgaaacgtctgattc

SEQ ID NO: 164082 - DNA, 25 bp, Mus musculus
agatttgccctgtaacgtctgattc

SEQ ID NO: 164083 - DNA, 25 bp, Mus musculus
agatttgcgctgagaactccccaag

SEQ ID NO: 164084 - DNA, 25 bp, Mus musculus
agatttgcgctgtgaactccccaag

SEQ ID NO: 164085 - DNA, 25 bp, Mus musculus
agatttgctcccagtatgtgccttt

SEQ ID NO: 164086 - DNA, 25 bp, Mus musculus
agatttgctccctgtatgtgccttt

SEQ ID NO: 164087 - DNA, 25 bp, Mus musculus
agatttgctcctatgagatctagca

SEQ ID NO: 164088 - DNA, 25 bp, Mus musculus
agatttgctcctttgagatctagca

SEQ ID NO: 164089 - DNA, 25 bp, Mus musculus
agatttgctcttcccactgtaatgt

SEQ ID NO: 164090 - DNA, 25 bp, Mus musculus
agatttgctcttcccatcaattcat

SEQ ID NO: 164091 - DNA, 25 bp, Mus musculus
agatttgctcttgccactgtaatgt

SEQ ID NO: 164092 - DNA, 25 bp, Mus musculus
agatttgctcttgccatcaattcat

SEQ ID NO: 164093 - DNA, 25 bp, Mus musculus
agatttgctgtcatcccattagaga

SEQ ID NO: 164094 - DNA, 25 bp, Mus musculus
agatttgctgtcttcccattagaga

SEQ ID NO: 164095 - DNA, 25 bp, Mus musculus
agatttgctgtgaagtcttggtgtg

SEQ ID NO: 164096 - DNA, 25 bp, Mus musculus
agatttgctgtgtagtcttggtgtg

SEQ ID NO: 164097 - DNA, 25 bp, Mus musculus
agatttgcttagattctccttctgt

SEQ ID NO: 164098 - DNA, 25 bp, Mus musculus
agatttgcttagtttctccttctgt

SEQ ID NO: 164099 - DNA, 25 bp, Mus musculus
agatttgcttgccacatctgcatgt

SEQ ID NO: 164100 - DNA, 25 bp, Mus musculus
agatttgcttgcgacatctgcatgt

SEQ ID NO: 164101 - DNA, 25 bp, Mus musculus
agatttgcttttaaagactcctcaa

SEQ ID NO: 164102 - DNA, 25 bp, Mus musculus
agatttgctttttaagactcctcaa

SEQ ID NO: 164103 - DNA, 25 bp, Mus musculus
agatttggacctcagcagcgaggct

SEQ ID NO: 164104 - DNA, 25 bp, Mus musculus
agatttggacctgagcagcgaggct

SEQ ID NO: 164105 - DNA, 25 bp, Mus musculus
agatttggagccctgtttcttgcac

SEQ ID NO: 164106 - DNA, 25 bp, Mus musculus
agatttggagccgtgtttcttgcac

SEQ ID NO: 164107 - DNA, 25 bp, Mus musculus
agatttggagtcagcccaggcactg

SEQ ID NO: 164108 - DNA, 25 bp, Mus musculus
agatttggagtctgcccaggcactg

SEQ ID NO: 164109 - DNA, 25 bp, Mus musculus
agatttggatttacccatggatcca

SEQ ID NO: 164110 - DNA, 25 bp, Mus musculus
agatttggattttcccatggatcca

SEQ ID NO: 164111 - DNA, 25 bp, Mus musculus
agatttggccaacagcgacaaagct

SEQ ID NO: 164112 - DNA, 25 bp, Mus musculus
agatttggccaagagcgacaaagct

SEQ ID NO: 164113 - DNA, 25 bp, Mus musculus
agatttggccccactgtggttagac

SEQ ID NO: 164114 - DNA, 25 bp, Mus musculus
agatttggcccctctgtggttagac

SEQ ID NO: 164115 - DNA, 25 bp, Mus musculus
agatttggctacagctctctgctat

SEQ ID NO: 164116 - DNA, 25 bp, Mus musculus
agatttggctactgctctctgctat

SEQ ID NO: 164117 - DNA, 25 bp, Mus musculus
agatttgggatgagaacccgaggaa

SEQ ID NO: 164118 - DNA, 25 bp, Mus musculus
agatttgggatgtgaacccgaggaa

SEQ ID NO: 164119 - DNA, 25 bp, Mus musculus
agatttgggcacagtaatgactata

SEQ ID NO: 164120 - DNA, 25 bp, Mus musculus
agatttgggcactgtaatgactata

SEQ ID NO: 164121 - DNA, 25 bp, Mus musculus
agatttgggcctcagtctctagtcc

SEQ ID NO: 164122 - DNA, 25 bp, Mus musculus
agatttgggcctcgcagtcatgcat

SEQ ID NO: 164123 - DNA, 25 bp, Mus musculus
agatttgggcctgagtctctagtcc

SEQ ID NO: 164124 - DNA, 25 bp, Mus musculus
agatttgggcctggcagtcatgcat

SEQ ID NO: 164125 - DNA, 25 bp, Mus musculus
agatttggtggcagcattccatcca

SEQ ID NO: 164126 - DNA, 25 bp, Mus musculus
agatttggtggctgcattccatcca

SEQ ID NO: 164127 - DNA, 25 bp, Mus musculus
agatttgtacagcacttcttcttct

SEQ ID NO: 164128 - DNA, 25 bp, Mus musculus
agatttgtacaggacttcttcttct

SEQ ID NO: 164129 - DNA, 25 bp, Mus musculus
agatttgtacgacgagccagagaag

SEQ ID NO: 164130 - DNA, 25 bp, Mus musculus
agatttgtacgaggagccagagaag

SEQ ID NO: 164131 - DNA, 25 bp, Mus musculus
agatttgtcctaattgcagtgagaa

SEQ ID NO: 164132 - DNA, 25 bp, Mus musculus
agatttgtcctatttgcagtgagaa

SEQ ID NO: 164133 - DNA, 25 bp, Mus musculus
agatttgtcgtcactcagaggttat

SEQ ID NO: 164134 - DNA, 25 bp, Mus musculus
agatttgtcgtctctcagaggttat

SEQ ID NO: 164135 - DNA, 25 bp, Mus musculus
agatttgtctcaccaagcacagtta

SEQ ID NO: 164136 - DNA, 25 bp, Mus musculus
agatttgtctcagcaagcacagtta

SEQ ID NO: 164137 - DNA, 25 bp, Mus musculus
agatttgtgatcatgtctttggcct

SEQ ID NO: 164138 - DNA, 25 bp, Mus musculus
agatttgtgatcttgtctttggcct

SEQ ID NO: 164139 - DNA, 25 bp, Mus musculus
agatttgtgctacaggtccctttca

SEQ ID NO: 164140 - DNA, 25 bp, Mus musculus
agatttgtgctagaggtccctttca

SEQ ID NO: 164141 - DNA, 25 bp, Mus musculus
agatttgtgggtctagctaccagtc

SEQ ID NO: 164142 - DNA, 25 bp, Mus musculus
agatttgtgggtgtagctaccagtc

SEQ ID NO: 164143 - DNA, 25 bp, Mus musculus
agatttgtggtaattcccagggcac

SEQ ID NO: 164144 - DNA, 25 bp, Mus musculus
agatttgtggtatttcccagggcac

SEQ ID NO: 164145 - DNA, 25 bp, Mus musculus
agatttgtgtagctcattcagatga

SEQ ID NO: 164146 - DNA, 25 bp, Mus musculus
agatttgtgtaggtcattcagatga

SEQ ID NO: 164147 - DNA, 25 bp, Mus musculus
agatttgtgttcatccaaactcaga

SEQ ID NO: 164148 - DNA, 25 bp, Mus musculus
agatttgtgttcttccaaactcaga

SEQ ID NO: 164149 - DNA, 25 bp, Mus musculus
agatttgtgttgaggccgagcactt

SEQ ID NO: 164150 - DNA, 25 bp, Mus musculus
agatttgtgttgctgtactttgcat

SEQ ID NO: 164151 - DNA, 25 bp, Mus musculus
agatttgtgttggtgtactttgcat

SEQ ID NO: 164152 - DNA, 25 bp, Mus musculus
agatttgtgttgtggccgagcactt

SEQ ID NO: 164153 - DNA, 25 bp, Mus musculus
agatttgttagcaactttgaccagt

SEQ ID NO: 164154 - DNA, 25 bp, Mus musculus
agatttgttagctactttgaccagt

SEQ ID NO: 164155 - DNA, 25 bp, Mus musculus
agatttgttgatacattggtgggaa

SEQ ID NO: 164156 - DNA, 25 bp, Mus musculus
agatttgttgattcattggtgggaa

SEQ ID NO: 164157 - DNA, 25 bp, Mus musculus
agatttgttggtctagcctttgcca

SEQ ID NO: 164158 - DNA, 25 bp, Mus musculus
agatttgttggtgtagcctttgcca

SEQ ID NO: 164159 - DNA, 25 bp, Mus musculus
agatttgtttacaagggcccagaga

SEQ ID NO: 164160 - DNA, 25 bp, Mus musculus
agatttgtttactagggcccagaga

SEQ ID NO: 164161 - DNA, 25 bp, Mus musculus
agattttaaagtacttctctactca

SEQ ID NO: 164162 - DNA, 25 bp, Mus musculus
agattttaaagttcttctctactca

SEQ ID NO: 164163 - DNA, 25 bp, Mus musculus
agattttacccaatcctccagccat

SEQ ID NO: 164164 - DNA, 25 bp, Mus musculus
agattttacccattcctccagccat

SEQ ID NO: 164165 - DNA, 25 bp, Mus musculus
agattttactgcagccattgccgag

SEQ ID NO: 164166 - DNA, 25 bp, Mus musculus
agattttactgctgccattgccgag

SEQ ID NO: 164167 - DNA, 25 bp, Mus musculus
agattttagattactccttcccaca

SEQ ID NO: 164168 - DNA, 25 bp, Mus musculus
agattttagatttctccttcccaca

SEQ ID NO: 164169 - DNA, 25 bp, Mus musculus
agattttatatgaaagcacccacct

SEQ ID NO: 164170 - DNA, 25 bp, Mus musculus
agattttatatgtaagcacccacct

SEQ ID NO: 164171 - DNA, 25 bp, Mus musculus
agattttatcgtcctccggagatca

SEQ ID NO: 164172 - DNA, 25 bp, Mus musculus
agattttatcgtgctccggagatca

SEQ ID NO: 164173 - DNA, 25 bp, Mus musculus
agattttcacagacctacagccaat

SEQ ID NO: 164174 - DNA, 25 bp, Mus musculus
agattttcacagtcctacagccaat

SEQ ID NO: 164175 - DNA, 25 bp, Mus musculus
agattttcacatagctatttccagc

SEQ ID NO: 164176 - DNA, 25 bp, Mus musculus
agattttcacattgctatttccagc

SEQ ID NO: 164177 - DNA, 25 bp, Mus musculus
agattttcagaaccatctggatggg

SEQ ID NO: 164178 - DNA, 25 bp, Mus musculus
agattttcagaagcatctggatggg

SEQ ID NO: 164179 - DNA, 25 bp, Mus musculus
agattttcagtcaggcctggttgct

SEQ ID NO: 164180 - DNA, 25 bp, Mus musculus
agattttcagtctggcctggttgct

SEQ ID NO: 164181 - DNA, 25 bp, Mus musculus
agattttccactcatgtaccaatgt

SEQ ID NO: 164182 - DNA, 25 bp, Mus musculus
agattttccactgatgtaccaatgt

SEQ ID NO: 164183 - DNA, 25 bp, Mus musculus
agattttcccatactgcaattcaca

SEQ ID NO: 164184 - DNA, 25 bp, Mus musculus
agattttcccattctgcaattcaca

SEQ ID NO: 164185 - DNA, 25 bp, Mus musculus
agattttcccttcgtatcttccagt

SEQ ID NO: 164186 - DNA, 25 bp, Mus musculus
agattttcccttggtatcttccagt

SEQ ID NO: 164187 - DNA, 25 bp, Mus musculus
agattttccgccctatgtacagaca

SEQ ID NO: 164188 - DNA, 25 bp, Mus musculus
agattttccgccgtatgtacagaca

SEQ ID NO: 164189 - DNA, 25 bp, Mus musculus
agattttcctacagttcatgtgatt

SEQ ID NO: 164190 - DNA, 25 bp, Mus musculus
agattttcctactgttcatgtgatt

SEQ ID NO: 164191 - DNA, 25 bp, Mus musculus
agattttctcctccctatctgaatg

SEQ ID NO: 164192 - DNA, 25 bp, Mus musculus
agattttctcctgcctatctgaatg

SEQ ID NO: 164193 - DNA, 25 bp, Mus musculus
agattttctgggatcccctgaaatc

SEQ ID NO: 164194 - DNA, 25 bp, Mus musculus
agattttctgggttcccctgaaatc

SEQ ID NO: 164195 - DNA, 25 bp, Mus musculus
agattttctgtaacgtacctccatg

SEQ ID NO: 164196 - DNA, 25 bp, Mus musculus
agattttctgtatcgtacctccatg

SEQ ID NO: 164197 - DNA, 25 bp, Mus musculus
agattttcttacatgcacacataaa

SEQ ID NO: 164198 - DNA, 25 bp, Mus musculus
agattttcttacttgcacacataaa

SEQ ID NO: 164199 - DNA, 25 bp, Mus musculus
agattttcttctcaggtgtgctgcc

SEQ ID NO: 164200 - DNA, 25 bp, Mus musculus
agattttcttctgaggtgtgctgcc

SEQ ID NO: 164201 - DNA, 25 bp, Mus musculus
agattttctttgagtaatgcatgat

SEQ ID NO: 164202 - DNA, 25 bp, Mus musculus
agattttctttgtgtaatgcatgat

SEQ ID NO: 164203 - DNA, 25 bp, Mus musculus
agattttgaactccttccagtgtgc

SEQ ID NO: 164204 - DNA, 25 bp, Mus musculus
agattttgaactgcttccagtgtgc

SEQ ID NO: 164205 - DNA, 25 bp, Mus musculus
agattttgaagcactttctctcttt

SEQ ID NO: 164206 - DNA, 25 bp, Mus musculus
agattttgaagctctttctctcttt

SEQ ID NO: 164207 - DNA, 25 bp, Mus musculus
agattttgagcactgccagctctgc

SEQ ID NO: 164208 - DNA, 25 bp, Mus musculus
agattttgagcagtgccagctctgc

SEQ ID NO: 164209 - DNA, 25 bp, Mus musculus
agattttgagtccatgtttcccata

SEQ ID NO: 164210 - DNA, 25 bp, Mus musculus
agattttgagtcgatgtttcccata

SEQ ID NO: 164211 - DNA, 25 bp, Mus musculus
agattttgccatcccgttcccattt

SEQ ID NO: 164212 - DNA, 25 bp, Mus musculus
agattttgccatgccgttcccattt

SEQ ID NO: 164213 - DNA, 25 bp, Mus musculus
agattttgcctgacagcagctcata

SEQ ID NO: 164214 - DNA, 25 bp, Mus musculus
agattttgcctgtcagcagctcata

SEQ ID NO: 164215 - DNA, 25 bp, Mus musculus
agattttgctctacaaacaccgcgc

SEQ ID NO: 164216 - DNA, 25 bp, Mus musculus
agattttgctcttcaaacaccgcgc

SEQ ID NO: 164217 - DNA, 25 bp, Mus musculus
agattttggcttcgtttcttgcctc

SEQ ID NO: 164218 - DNA, 25 bp, Mus musculus
agattttggcttggtttcttgcctc

SEQ ID NO: 164219 - DNA, 25 bp, Mus musculus
agattttgggaaaatagtgcaaaga

SEQ ID NO: 164220 - DNA, 25 bp, Mus musculus
agattttgggaaaattctcttaaat

SEQ ID NO: 164221 - DNA, 25 bp, Mus musculus
agattttgggaatatagtgcaaaga

SEQ ID NO: 164222 - DNA, 25 bp, Mus musculus
agattttgggaatattctcttaaat

SEQ ID NO: 164223 - DNA, 25 bp, Mus musculus
agattttggtgcaatgggctgtgta

SEQ ID NO: 164224 - DNA, 25 bp, Mus musculus
agattttggtgctatgggctgtgta

SEQ ID NO: 164225 - DNA, 25 bp, Mus musculus
agattttgtaaaactttctcagact

SEQ ID NO: 164226 - DNA, 25 bp, Mus musculus
agattttgtaaatctttctcagact

SEQ ID NO: 164227 - DNA, 25 bp, Mus musculus
agattttgtctcacagaacccacag

SEQ ID NO: 164228 - DNA, 25 bp, Mus musculus
agattttgtctctcagaacccacag

SEQ ID NO: 164229 - DNA, 25 bp, Mus musculus
agattttgtcttaagaagtgccaca

SEQ ID NO: 164230 - DNA, 25 bp, Mus musculus
agattttgtctttagaagtgccaca

SEQ ID NO: 164231 - DNA, 25 bp, Mus musculus
agattttgttaaaggcgatggcact

SEQ ID NO: 164232 - DNA, 25 bp, Mus musculus
agattttgttaatggcgatggcact

SEQ ID NO: 164233 - DNA, 25 bp, Mus musculus
agatttttactcagcgttttcataa

SEQ ID NO: 164234 - DNA, 25 bp, Mus musculus
agatttttactctgcgttttcataa

SEQ ID NO: 164235 - DNA, 25 bp, Mus musculus
agatttttcatcatggtttctgaat

SEQ ID NO: 164236 - DNA, 25 bp, Mus musculus
agatttttcatcttggtttctgaat

SEQ ID NO: 164237 - DNA, 25 bp, Mus musculus
agatttttcatgatcctcctttgcc

SEQ ID NO: 164238 - DNA, 25 bp, Mus musculus
agatttttcatgttcctcctttgcc

SEQ ID NO: 164239 - DNA, 25 bp, Mus musculus
agatttttcggacgccccactgatg

SEQ ID NO: 164240 - DNA, 25 bp, Mus musculus
agatttttcggaggccccactgatg

SEQ ID NO: 164241 - DNA, 25 bp, Mus musculus
agatttttctcacacaaccgtatcc

SEQ ID NO: 164242 - DNA, 25 bp, Mus musculus
agatttttctcagacaaccgtatcc

SEQ ID NO: 164243 - DNA, 25 bp, Mus musculus
agatttttctgtcacaagaatccac

SEQ ID NO: 164244 - DNA, 25 bp, Mus musculus
agatttttctgtgacaagaatccac

SEQ ID NO: 164245 - DNA, 25 bp, Mus musculus
agatttttcttgatggcttgacctt

SEQ ID NO: 164246 - DNA, 25 bp, Mus musculus
agatttttcttgttggcttgacctt

SEQ ID NO: 164247 - DNA, 25 bp, Mus musculus
agatttttgtcactgacgtttctgt

SEQ ID NO: 164248 - DNA, 25 bp, Mus musculus
agatttttgtcagtgacgtttctgt

SEQ ID NO: 164249 - DNA, 25 bp, Mus musculus
agatttttgttcagcaaggatgagc

SEQ ID NO: 164250 - DNA, 25 bp, Mus musculus
agatttttgttctgcaaggatgagc

SEQ ID NO: 164251 - DNA, 25 bp, Mus musculus
agattttttctgacgcactcctatg

SEQ ID NO: 164252 - DNA, 25 bp, Mus musculus
agattttttctgtcgcactcctatg

SEQ ID NO: 164253 - DNA, 25 bp, Mus musculus
agcaaaaatcccacccatgctagag

SEQ ID NO: 164254 - DNA, 25 bp, Mus musculus
agcaaaaatccctcccatgctagag

SEQ ID NO: 164255 - DNA, 25 bp, Mus musculus
agcaaaacaactcttggtcatcctt

SEQ ID NO: 164256 - DNA, 25 bp, Mus musculus
agcaaaacaactgttggtcatcctt

SEQ ID NO: 164257 - DNA, 25 bp, Mus musculus
agcaaaacattcacccgtgtgtctg

SEQ ID NO: 164258 - DNA, 25 bp, Mus musculus
agcaaaacattctcccgtgtgtctg

SEQ ID NO: 164259 - DNA, 25 bp, Mus musculus
agcaaaagaggcactggccctcaca

SEQ ID NO: 164260 - DNA, 25 bp, Mus musculus
agcaaaagaggctctggccctcaca

SEQ ID NO: 164261 - DNA, 25 bp, Mus musculus
agcaaaagccacagatttctactat

SEQ ID NO: 164262 - DNA, 25 bp, Mus musculus
agcaaaagccactgatttctactat

SEQ ID NO: 164263 - DNA, 25 bp, Mus musculus
agcaaaagcgggagcccgttcggct

SEQ ID NO: 164264 - DNA, 25 bp, Mus musculus
agcaaaagcgggtgcccgttcggct

SEQ ID NO: 164265 - DNA, 25 bp, Mus musculus
agcaaaagcgtcaccaaactctctg

SEQ ID NO: 164266 - DNA, 25 bp, Mus musculus
agcaaaagcgtctccaaactctctg

SEQ ID NO: 164267 - DNA, 25 bp, Mus musculus
agcaaaaggagcaggcacttggctg

SEQ ID NO: 164268 - DNA, 25 bp, Mus musculus
agcaaaaggagctggcacttggctg

SEQ ID NO: 164269 - DNA, 25 bp, Mus musculus
agcaaaaggcctaccctgcatggac

SEQ ID NO: 164270 - DNA, 25 bp, Mus musculus
agcaaaaggccttccctgcatggac

SEQ ID NO: 164271 - DNA, 25 bp, Mus musculus
agcaaaaggctaagggagtctggta

SEQ ID NO: 164272 - DNA, 25 bp, Mus musculus
agcaaaaggctatgggagtctggta

SEQ ID NO: 164273 - DNA, 25 bp, Mus musculus
agcaaaaggtgacggtctctcttcc

SEQ ID NO: 164274 - DNA, 25 bp, Mus musculus
agcaaaaggtgagggtctctcttcc

SEQ ID NO: 164275 - DNA, 25 bp, Mus musculus
agcaaaagtatgactcttgatgggt

SEQ ID NO: 164276 - DNA, 25 bp, Mus musculus
agcaaaagtatgtctcttgatgggt

SEQ ID NO: 164277 - DNA, 25 bp, Mus musculus
agcaaaagttttcctactgcccctg

SEQ ID NO: 164278 - DNA, 25 bp, Mus musculus
agcaaaagttttgctactgcccctg

SEQ ID NO: 164279 - DNA, 25 bp, Mus musculus
agcaaaatcctacccagactgtgag

SEQ ID NO: 164280 - DNA, 25 bp, Mus musculus
agcaaaatcctagccagactgtgag

SEQ ID NO: 164281 - DNA, 25 bp, Mus musculus
agcaaaatgaaaagcctcaggcctt

SEQ ID NO: 164282 - DNA, 25 bp, Mus musculus
agcaaaatgaaatgcctcaggcctt

SEQ ID NO: 164283 - DNA, 25 bp, Mus musculus
agcaaaatgccacaaacccacaaac

SEQ ID NO: 164284 - DNA, 25 bp, Mus musculus
agcaaaatgccagaaacccacaaac

SEQ ID NO: 164285 - DNA, 25 bp, Mus musculus
agcaaacaaatgcacccctggtttt

SEQ ID NO: 164286 - DNA, 25 bp, Mus musculus
agcaaacaaatggacccctggtttt

SEQ ID NO: 164287 - DNA, 25 bp, Mus musculus
agcaaacaaggcacttctcaggcca

SEQ ID NO: 164288 - DNA, 25 bp, Mus musculus
agcaaacaaggctcttctcaggcca

SEQ ID NO: 164289 - DNA, 25 bp, Mus musculus
agcaaacacaggaccagaccccaga

SEQ ID NO: 164290 - DNA, 25 bp, Mus musculus
agcaaacacaggtccagaccccaga

SEQ ID NO: 164291 - DNA, 25 bp, Mus musculus
agcaaacacgtgactgccgaagctt

SEQ ID NO: 164292 - DNA, 25 bp, Mus musculus
agcaaacacgtgtctgccgaagctt

SEQ ID NO: 164293 - DNA, 25 bp, Mus musculus
agcaaacactcaagcttttaaagca

SEQ ID NO: 164294 - DNA, 25 bp, Mus musculus
agcaaacactcatgcttttaaagca

SEQ ID NO: 164295 - DNA, 25 bp, Mus musculus
agcaaacagaggagactcagctgac

SEQ ID NO: 164296 - DNA, 25 bp, Mus musculus
agcaaacagaggtgactcagctgac

SEQ ID NO: 164297 - DNA, 25 bp, Mus musculus
agcaaacagcaaatgattgactgag

SEQ ID NO: 164298 - DNA, 25 bp, Mus musculus
agcaaacagcaattgattgactgag

SEQ ID NO: 164299 - DNA, 25 bp, Mus musculus
agcaaacatctaaacctgccatgcc

SEQ ID NO: 164300 - DNA, 25 bp, Mus musculus
agcaaacatctatacctgccatgcc

SEQ ID NO: 164301 - DNA, 25 bp, Mus musculus
agcaaaccaagccaaggctccgttg

SEQ ID NO: 164302 - DNA, 25 bp, Mus musculus
agcaaaccaagcgaaggctccgttg

SEQ ID NO: 164303 - DNA, 25 bp, Mus musculus
agcaaaccccacaactggaagcctg

SEQ ID NO: 164304 - DNA, 25 bp, Mus musculus
agcaaaccccactactggaagcctg

SEQ ID NO: 164305 - DNA, 25 bp, Mus musculus
agcaaaccctatcccagagtaactg

SEQ ID NO: 164306 - DNA, 25 bp, Mus musculus
agcaaaccctatcccatgcgttgga

SEQ ID NO: 164307 - DNA, 25 bp, Mus musculus
agcaaaccctatgccagagtaactg

SEQ ID NO: 164308 - DNA, 25 bp, Mus musculus
agcaaaccctatgccatgcgttgga

SEQ ID NO: 164309 - DNA, 25 bp, Mus musculus
agcaaaccgccaccacatttgtgtc

SEQ ID NO: 164310 - DNA, 25 bp, Mus musculus
agcaaaccgccagcacatttgtgtc

SEQ ID NO: 164311 - DNA, 25 bp, Mus musculus
agcaaacctgcgcagatcggaatca

SEQ ID NO: 164312 - DNA, 25 bp, Mus musculus
agcaaacctgcggagatcggaatca

SEQ ID NO: 164313 - DNA, 25 bp, Mus musculus
agcaaacctgtcctaccaaagtctt

SEQ ID NO: 164314 - DNA, 25 bp, Mus musculus
agcaaacctgtcgtaccaaagtctt

SEQ ID NO: 164315 - DNA, 25 bp, Mus musculus
agcaaacctttgaacactggaattt

SEQ ID NO: 164316 - DNA, 25 bp, Mus musculus
agcaaacctttgtacactggaattt

SEQ ID NO: 164317 - DNA, 25 bp, Mus musculus
agcaaacgagtcaaggccctactga

SEQ ID NO: 164318 - DNA, 25 bp, Mus musculus
agcaaacgagtctaggccctactga

SEQ ID NO: 164319 - DNA, 25 bp, Mus musculus
agcaaacgctgaaaactctctctct

SEQ ID NO: 164320 - DNA, 25 bp, Mus musculus
agcaaacgctgataactctctctct

SEQ ID NO: 164321 - DNA, 25 bp, Mus musculus
agcaaacgctgtccacagccacaag

SEQ ID NO: 164322 - DNA, 25 bp, Mus musculus
agcaaacgctgtgcacagccacaag

SEQ ID NO: 164323 - DNA, 25 bp, Mus musculus
agcaaacggatgacccagagccaga

SEQ ID NO: 164324 - DNA, 25 bp, Mus musculus
agcaaacggatgtcccagagccaga

SEQ ID NO: 164325 - DNA, 25 bp, Mus musculus
agcaaacggctccaagttcctgaga

SEQ ID NO: 164326 - DNA, 25 bp, Mus musculus
agcaaacggctcgaagttcctgaga

SEQ ID NO: 164327 - DNA, 25 bp, Mus musculus
agcaaacgggaaccccatggcaata

SEQ ID NO: 164328 - DNA, 25 bp, Mus musculus
agcaaacgggaagcccatggcaata

SEQ ID NO: 164329 - DNA, 25 bp, Mus musculus
agcaaacgtacgcatcctgcaggaa

SEQ ID NO: 164330 - DNA, 25 bp, Mus musculus
agcaaacgtacggatcctgcaggaa

SEQ ID NO: 164331 - DNA, 25 bp, Mus musculus
agcaaacgtcttactctagtgatga

SEQ ID NO: 164332 - DNA, 25 bp, Mus musculus
agcaaacgtctttctctagtgatga

SEQ ID NO: 164333 - DNA, 25 bp, Mus musculus
agcaaacgttaaacccttacataga

SEQ ID NO: 164334 - DNA, 25 bp, Mus musculus
agcaaacgttaatcccttacataga

SEQ ID NO: 164335 - DNA, 25 bp, Mus musculus
agcaaacgttctaccacagaccttt

SEQ ID NO: 164336 - DNA, 25 bp, Mus musculus
agcaaacgttcttccacagaccttt

SEQ ID NO: 164337 - DNA, 25 bp, Mus musculus
agcaaactaagcatcctaaccggga

SEQ ID NO: 164338 - DNA, 25 bp, Mus musculus
agcaaactaagcttcctaaccggga

SEQ ID NO: 164339 - DNA, 25 bp, Mus musculus
agcaaactcgccaaacaaatgaatg

SEQ ID NO: 164340 - DNA, 25 bp, Mus musculus
agcaaactcgcctaacaaatgaatg

SEQ ID NO: 164341 - DNA, 25 bp, Mus musculus
agcaaactctagatctgggtcagga

SEQ ID NO: 164342 - DNA, 25 bp, Mus musculus
agcaaactctagttctgggtcagga

SEQ ID NO: 164343 - DNA, 25 bp, Mus musculus
agcaaactctttctcagatgcctat

SEQ ID NO: 164344 - DNA, 25 bp, Mus musculus
agcaaactctttgtcagatgcctat

SEQ ID NO: 164345 - DNA, 25 bp, Mus musculus
agcaaactgtccagaggcaggcgaa

SEQ ID NO: 164346 - DNA, 25 bp, Mus musculus
agcaaactgtcctgaggcaggcgaa

SEQ ID NO: 164347 - DNA, 25 bp, Mus musculus
agcaaactttcccaggcctggtcct

SEQ ID NO: 164348 - DNA, 25 bp, Mus musculus
agcaaactttccgaggcctggtcct

SEQ ID NO: 164349 - DNA, 25 bp, Mus musculus
agcaaactttgaactgacactcagg

SEQ ID NO: 164350 - DNA, 25 bp, Mus musculus
agcaaactttgatctgacactcagg

SEQ ID NO: 164351 - DNA, 25 bp, Mus musculus
agcaaagaacccagccatagttttg

SEQ ID NO: 164352 - DNA, 25 bp, Mus musculus
agcaaagaaccctgccatagttttg

SEQ ID NO: 164353 - DNA, 25 bp, Mus musculus
agcaaagaattgactccagggcttt

SEQ ID NO: 164354 - DNA, 25 bp, Mus musculus
agcaaagaattgtctccagggcttt

SEQ ID NO: 164355 - DNA, 25 bp, Mus musculus
agcaaagacccaaactagtgcattt

SEQ ID NO: 164356 - DNA, 25 bp, Mus musculus
agcaaagacccatactagtgcattt

SEQ ID NO: 164357 - DNA, 25 bp, Mus musculus
agcaaagactcactgctgcccaggt

SEQ ID NO: 164358 - DNA, 25 bp, Mus musculus
agcaaagactcagtgctgcccaggt

SEQ ID NO: 164359 - DNA, 25 bp, Mus musculus
agcaaagactctcctgcactgaaga

SEQ ID NO: 164360 - DNA, 25 bp, Mus musculus
agcaaagactctgctgcactgaaga

SEQ ID NO: 164361 - DNA, 25 bp, Mus musculus
agcaaagagagtaacgagctgcgtt

SEQ ID NO: 164362 - DNA, 25 bp, Mus musculus
agcaaagagagttacgagctgcgtt

SEQ ID NO: 164363 - DNA, 25 bp, Mus musculus
agcaaagagccgatttcttcccttg

SEQ ID NO: 164364 - DNA, 25 bp, Mus musculus
agcaaagagccgttttcttcccttg

SEQ ID NO: 164365 - DNA, 25 bp, Mus musculus
agcaaagagctgactactggagaga

SEQ ID NO: 164366 - DNA, 25 bp, Mus musculus
agcaaagagctgtctactggagaga

SEQ ID NO: 164367 - DNA, 25 bp, Mus musculus
agcaaagagtcaaccattttcagtg

SEQ ID NO: 164368 - DNA, 25 bp, Mus musculus
agcaaagagtcatccattttcagtg

SEQ ID NO: 164369 - DNA, 25 bp, Mus musculus
agcaaagatgtaaccagccaatgtg

SEQ ID NO: 164370 - DNA, 25 bp, Mus musculus
agcaaagatgtatccagccaatgtg

SEQ ID NO: 164371 - DNA, 25 bp, Mus musculus
agcaaagattggctcccagcacttt

SEQ ID NO: 164372 - DNA, 25 bp, Mus musculus
agcaaagattgggtcccagcacttt

SEQ ID NO: 164373 - DNA, 25 bp, Mus musculus
agcaaagcaaacaacctagattgtt

SEQ ID NO: 164374 - DNA, 25 bp, Mus musculus
agcaaagcaaactacctagattgtt

SEQ ID NO: 164375 - DNA, 25 bp, Mus musculus
agcaaagcaaatattgggtttgttt

SEQ ID NO: 164376 - DNA, 25 bp, Mus musculus
agcaaagcaaattttgggtttgttt

SEQ ID NO: 164377 - DNA, 25 bp, Mus musculus
agcaaagcacttagtctggctgcgt

SEQ ID NO: 164378 - DNA, 25 bp, Mus musculus
agcaaagcactttgtctggctgcgt

SEQ ID NO: 164379 - DNA, 25 bp, Mus musculus
agcaaagcatctcttgacaccattc

SEQ ID NO: 164380 - DNA, 25 bp, Mus musculus
agcaaagcatctgttgacaccattc

SEQ ID NO: 164381 - DNA, 25 bp, Mus musculus
agcaaagcatgaacactccgatcct

SEQ ID NO: 164382 - DNA, 25 bp, Mus musculus
agcaaagcatgatcactccgatcct

SEQ ID NO: 164383 - DNA, 25 bp, Mus musculus
agcaaagccaccaactatggaagct

SEQ ID NO: 164384 - DNA, 25 bp, Mus musculus
agcaaagccacctactatggaagct

SEQ ID NO: 164385 - DNA, 25 bp, Mus musculus
agcaaagccaggactagccgtgacc

SEQ ID NO: 164386 - DNA, 25 bp, Mus musculus
agcaaagccaggtctagccgtgacc

SEQ ID NO: 164387 - DNA, 25 bp, Mus musculus
agcaaagccgggatgttttcaagaa

SEQ ID NO: 164388 - DNA, 25 bp, Mus musculus
agcaaagccgggttgttttcaagaa

SEQ ID NO: 164389 - DNA, 25 bp, Mus musculus
agcaaagccttccaaactgtctgac

SEQ ID NO: 164390 - DNA, 25 bp, Mus musculus
agcaaagccttcgaaactgtctgac

SEQ ID NO: 164391 - DNA, 25 bp, Mus musculus
agcaaagcgacgactatttctgttc

SEQ ID NO: 164392 - DNA, 25 bp, Mus musculus
agcaaagcgacgtctatttctgttc

SEQ ID NO: 164393 - DNA, 25 bp, Mus musculus
agcaaagcgtgcactggacccctga

SEQ ID NO: 164394 - DNA, 25 bp, Mus musculus
agcaaagcgtgctctggacccctga

SEQ ID NO: 164395 - DNA, 25 bp, Mus musculus
agcaaagcgtttatccaggtggaca

SEQ ID NO: 164396 - DNA, 25 bp, Mus musculus
agcaaagcgtttttccaggtggaca

SEQ ID NO: 164397 - DNA, 25 bp, Mus musculus
agcaaagctcctagatctgtgccat

SEQ ID NO: 164398 - DNA, 25 bp, Mus musculus
agcaaagctccttgatctgtgccat

SEQ ID NO: 164399 - DNA, 25 bp, Mus musculus
agcaaagctctgagactgaatcata

SEQ ID NO: 164400 - DNA, 25 bp, Mus musculus
agcaaagctctgctcttctttcaag

SEQ ID NO: 164401 - DNA, 25 bp, Mus musculus
agcaaagctctggtcttctttcaag

SEQ ID NO: 164402 - DNA, 25 bp, Mus musculus
agcaaagctctgtgactgaatcata

SEQ ID NO: 164403 - DNA, 25 bp, Mus musculus
agcaaagctcttacctcttaattaa

SEQ ID NO: 164404 - DNA, 25 bp, Mus musculus
agcaaagctcttcttcttggccaga

SEQ ID NO: 164405 - DNA, 25 bp, Mus musculus
agcaaagctcttgttcttggccaga

SEQ ID NO: 164406 - DNA, 25 bp, Mus musculus
agcaaagctctttcctcttaattaa

SEQ ID NO: 164407 - DNA, 25 bp, Mus musculus
agcaaagcttccagctggatcagct

SEQ ID NO: 164408 - DNA, 25 bp, Mus musculus
agcaaagcttcctgctggatcagct

SEQ ID NO: 164409 - DNA, 25 bp, Mus musculus
agcaaaggacaacctgagaccccag

SEQ ID NO: 164410 - DNA, 25 bp, Mus musculus
agcaaaggacaagctgagaccccag

SEQ ID NO: 164411 - DNA, 25 bp, Mus musculus
agcaaaggcgctatccttgtacctt

SEQ ID NO: 164412 - DNA, 25 bp, Mus musculus
agcaaaggcgctttccttgtacctt

SEQ ID NO: 164413 - DNA, 25 bp, Mus musculus
agcaaaggctagatagcttggttaa

SEQ ID NO: 164414 - DNA, 25 bp, Mus musculus
agcaaaggctagttagcttggttaa

SEQ ID NO: 164415 - DNA, 25 bp, Mus musculus
agcaaaggcttgagagctgtccttc

SEQ ID NO: 164416 - DNA, 25 bp, Mus musculus
agcaaaggcttgtgagctgtccttc

SEQ ID NO: 164417 - DNA, 25 bp, Mus musculus
agcaaagggtctctgggtcaccgac

SEQ ID NO: 164418 - DNA, 25 bp, Mus musculus
agcaaagggtctgtgggtcaccgac

SEQ ID NO: 164419 - DNA, 25 bp, Mus musculus
agcaaagggtgtcgcatctctggat

SEQ ID NO: 164420 - DNA, 25 bp, Mus musculus
agcaaagggtgtggcatctctggat

SEQ ID NO: 164421 - DNA, 25 bp, Mus musculus
agcaaaggtatgatctgtggtacag

SEQ ID NO: 164422 - DNA, 25 bp, Mus musculus
agcaaaggtatgttctgtggtacag

SEQ ID NO: 164423 - DNA, 25 bp, Mus musculus
agcaaaggtcaacccacagatagaa

SEQ ID NO: 164424 - DNA, 25 bp, Mus musculus
agcaaaggtcaagccacagatagaa

SEQ ID NO: 164425 - DNA, 25 bp, Mus musculus
agcaaaggttgcagaccctgactta

SEQ ID NO: 164426 - DNA, 25 bp, Mus musculus
agcaaaggttgctgaccctgactta

SEQ ID NO: 164427 - DNA, 25 bp, Mus musculus
agcaaagtatgaaggccctgtagcc

SEQ ID NO: 164428 - DNA, 25 bp, Mus musculus
agcaaagtatgatggccctgtagcc

SEQ ID NO: 164429 - DNA, 25 bp, Mus musculus
agcaaagtcaaccagtggaccacta

SEQ ID NO: 164430 - DNA, 25 bp, Mus musculus
agcaaagtcaacgagtggaccacta

SEQ ID NO: 164431 - DNA, 25 bp, Mus musculus
agcaaagtcactatttgtcccttcc

SEQ ID NO: 164432 - DNA, 25 bp, Mus musculus
agcaaagtcactttttgtcccttcc

SEQ ID NO: 164433 - DNA, 25 bp, Mus musculus
agcaaagtccccacggatcgtgagg

SEQ ID NO: 164434 - DNA, 25 bp, Mus musculus
agcaaagtcccctcggatcgtgagg

SEQ ID NO: 164435 - DNA, 25 bp, Mus musculus
agcaaagtccctctgtgcggtgata

SEQ ID NO: 164436 - DNA, 25 bp, Mus musculus
agcaaagtccctgtgtgcggtgata

SEQ ID NO: 164437 - DNA, 25 bp, Mus musculus
agcaaagtctaccttctcttcatac

SEQ ID NO: 164438 - DNA, 25 bp, Mus musculus
agcaaagtctacgttctcttcatac

SEQ ID NO: 164439 - DNA, 25 bp, Mus musculus
agcaaagtctcacaaggatcttgaa

SEQ ID NO: 164440 - DNA, 25 bp, Mus musculus
agcaaagtctcagaaggatcttgaa

SEQ ID NO: 164441 - DNA, 25 bp, Mus musculus
agcaaagtggccatggacttcaggg

SEQ ID NO: 164442 - DNA, 25 bp, Mus musculus
agcaaagtggccttggacttcaggg

SEQ ID NO: 164443 - DNA, 25 bp, Mus musculus
agcaaagttaccatgcagcatccag

SEQ ID NO: 164444 - DNA, 25 bp, Mus musculus
agcaaagttaccttgcagcatccag

SEQ ID NO: 164445 - DNA, 25 bp, Mus musculus
agcaaagttccactttcttcgaggg

SEQ ID NO: 164446 - DNA, 25 bp, Mus musculus
agcaaagttccagtttcttcgaggg

SEQ ID NO: 164447 - DNA, 25 bp, Mus musculus
agcaaagttccccatatctagagac

SEQ ID NO: 164448 - DNA, 25 bp, Mus musculus
agcaaagttcccgatatctagagac

SEQ ID NO: 164449 - DNA, 25 bp, Mus musculus
agcaaagttgtaaccctcactccca

SEQ ID NO: 164450 - DNA, 25 bp, Mus musculus
agcaaagttgtatccctcactccca

SEQ ID NO: 164451 - DNA, 25 bp, Mus musculus
agcaaagtttcaaacctggtgactt

SEQ ID NO: 164452 - DNA, 25 bp, Mus musculus
agcaaagtttcatacctggtgactt

SEQ ID NO: 164453 - DNA, 25 bp, Mus musculus
agcaaataacttcctgtggcccttc

SEQ ID NO: 164454 - DNA, 25 bp, Mus musculus
agcaaataacttgctgtggcccttc

SEQ ID NO: 164455 - DNA, 25 bp, Mus musculus
agcaaatacacacatttcctcttct

SEQ ID NO: 164456 - DNA, 25 bp, Mus musculus
agcaaatacacagatttcctcttct

SEQ ID NO: 164457 - DNA, 25 bp, Mus musculus
agcaaatacgctcaagttacccttg

SEQ ID NO: 164458 - DNA, 25 bp, Mus musculus
agcaaatacgctgaagttacccttg

SEQ ID NO: 164459 - DNA, 25 bp, Mus musculus
agcaaatacgttaaatctctaagcc

SEQ ID NO: 164460 - DNA, 25 bp, Mus musculus
agcaaatacgttcgctggagcagta

SEQ ID NO: 164461 - DNA, 25 bp, Mus musculus
agcaaatacgttggctggagcagta

SEQ ID NO: 164462 - DNA, 25 bp, Mus musculus
agcaaatacgtttaatctctaagcc

SEQ ID NO: 164463 - DNA, 25 bp, Mus musculus
agcaaatactggacactcttaacgt

SEQ ID NO: 164464 - DNA, 25 bp, Mus musculus
agcaaatactggtcactcttaacgt

SEQ ID NO: 164465 - DNA, 25 bp, Mus musculus
agcaaatattttcaagggccgtgaa

SEQ ID NO: 164466 - DNA, 25 bp, Mus musculus
agcaaatattttgaagggccgtgaa

SEQ ID NO: 164467 - DNA, 25 bp, Mus musculus
agcaaatcacgcattctcagttttc

SEQ ID NO: 164468 - DNA, 25 bp, Mus musculus
agcaaatcacgctttctcagttttc

SEQ ID NO: 164469 - DNA, 25 bp, Mus musculus
agcaaatcccggagaagggcaagct

SEQ ID NO: 164470 - DNA, 25 bp, Mus musculus
agcaaatcccggtgaagggcaagct

SEQ ID NO: 164471 - DNA, 25 bp, Mus musculus
agcaaatcctacatcttcaggcagc

SEQ ID NO: 164472 - DNA, 25 bp, Mus musculus
agcaaatcctacttcttcaggcagc

SEQ ID NO: 164473 - DNA, 25 bp, Mus musculus
agcaaatcctagagagcctttccac

SEQ ID NO: 164474 - DNA, 25 bp, Mus musculus
agcaaatcctagtgagcctttccac

SEQ ID NO: 164475 - DNA, 25 bp, Mus musculus
agcaaatccttactcccacaaggaa

SEQ ID NO: 164476 - DNA, 25 bp, Mus musculus
agcaaatccttagtcccacaaggaa

SEQ ID NO: 164477 - DNA, 25 bp, Mus musculus
agcaaatcggtgcactgatcgctgc

SEQ ID NO: 164478 - DNA, 25 bp, Mus musculus
agcaaatcggtggactgatcgctgc

SEQ ID NO: 164479 - DNA, 25 bp, Mus musculus
agcaaatctgctctggtctcccttt

SEQ ID NO: 164480 - DNA, 25 bp, Mus musculus
agcaaatctgctgtggtctcccttt

SEQ ID NO: 164481 - DNA, 25 bp, Mus musculus
agcaaatctggaactcattcgcctc

SEQ ID NO: 164482 - DNA, 25 bp, Mus musculus
agcaaatctggatctcattcgcctc

SEQ ID NO: 164483 - DNA, 25 bp, Mus musculus
agcaaatctggcctattgtatagaa

SEQ ID NO: 164484 - DNA, 25 bp, Mus musculus
agcaaatctggcgtattgtatagaa

SEQ ID NO: 164485 - DNA, 25 bp, Mus musculus
agcaaatgcaagaccgactgtgaat

SEQ ID NO: 164486 - DNA, 25 bp, Mus musculus
agcaaatgcaagtccgactgtgaat

SEQ ID NO: 164487 - DNA, 25 bp, Mus musculus
agcaaatgctgcaggccctcgccgg

SEQ ID NO: 164488 - DNA, 25 bp, Mus musculus
agcaaatgctgctggccctcgccgg

SEQ ID NO: 164489 - DNA, 25 bp, Mus musculus
agcaaatggcttaactattgtggca

SEQ ID NO: 164490 - DNA, 25 bp, Mus musculus
agcaaatggctttactattgtggca

SEQ ID NO: 164491 - DNA, 25 bp, Mus musculus
agcaaatgtaccctggtaccaggaa

SEQ ID NO: 164492 - DNA, 25 bp, Mus musculus
agcaaatgtaccgtggtaccaggaa

SEQ ID NO: 164493 - DNA, 25 bp, Mus musculus
agcaaatgtcttaacacgaactaat

SEQ ID NO: 164494 - DNA, 25 bp, Mus musculus
agcaaatgtctttacacgaactaat

SEQ ID NO: 164495 - DNA, 25 bp, Mus musculus
agcaaattatatcctcaccttacca

SEQ ID NO: 164496 - DNA, 25 bp, Mus musculus
agcaaattatatgctcaccttacca

SEQ ID NO: 164497 - DNA, 25 bp, Mus musculus
agcaaattcaaactcacctcttcag

SEQ ID NO: 164498 - DNA, 25 bp, Mus musculus
agcaaattcaaagtcacctcttcag

SEQ ID NO: 164499 - DNA, 25 bp, Mus musculus
agcaaattctggactcgaaaccggc

SEQ ID NO: 164500 - DNA, 25 bp, Mus musculus
agcaaattctggtctcgaaaccggc

SEQ ID NO: 164501 - DNA, 25 bp, Mus musculus
agcaaattgtcgatactgtgtttac

SEQ ID NO: 164502 - DNA, 25 bp, Mus musculus
agcaaattgtcgttactgtgtttac

SEQ ID NO: 164503 - DNA, 25 bp, Mus musculus
agcaaatttcctcccactaaatgtt

SEQ ID NO: 164504 - DNA, 25 bp, Mus musculus
agcaaatttcctgccactaaatgtt

SEQ ID NO: 164505 - DNA, 25 bp, Mus musculus
agcaacaaaaatatcctggtggagc

SEQ ID NO: 164506 - DNA, 25 bp, Mus musculus
agcaacaaaaatttcctggtggagc

SEQ ID NO: 164507 - DNA, 25 bp, Mus musculus
agcaacaaactaaggcaggcaagca

SEQ ID NO: 164508 - DNA, 25 bp, Mus musculus
agcaacaaactatggcaggcaagca

SEQ ID NO: 164509 - DNA, 25 bp, Mus musculus
agcaacaacaacacttggtctggga

SEQ ID NO: 164510 - DNA, 25 bp, Mus musculus
agcaacaacaacagtcactcttcct

SEQ ID NO: 164511 - DNA, 25 bp, Mus musculus
agcaacaacaactcttggtctggga

SEQ ID NO: 164512 - DNA, 25 bp, Mus musculus
agcaacaacaactgtcactcttcct

SEQ ID NO: 164513 - DNA, 25 bp, Mus musculus
agcaacaacatactgctcattttgt

SEQ ID NO: 164514 - DNA, 25 bp, Mus musculus
agcaacaacatagtgctcattttgt

SEQ ID NO: 164515 - DNA, 25 bp, Mus musculus
agcaacaaccctatctcttgtagag

SEQ ID NO: 164516 - DNA, 25 bp, Mus musculus
agcaacaaccctttctcttgtagag

SEQ ID NO: 164517 - DNA, 25 bp, Mus musculus
agcaacaagctcacatcctgtaatc

SEQ ID NO: 164518 - DNA, 25 bp, Mus musculus
agcaacaagctctcatcctgtaatc

SEQ ID NO: 164519 - DNA, 25 bp, Mus musculus
agcaacaagggtccctcccaggcgg

SEQ ID NO: 164520 - DNA, 25 bp, Mus musculus
agcaacaagggtgcctcccaggcgg

SEQ ID NO: 164521 - DNA, 25 bp, Mus musculus
agcaacaaggtgcactcttttcctg

SEQ ID NO: 164522 - DNA, 25 bp, Mus musculus
agcaacaaggtggactcttttcctg

SEQ ID NO: 164523 - DNA, 25 bp, Mus musculus
agcaacaagtgcactcgcctgctta

SEQ ID NO: 164524 - DNA, 25 bp, Mus musculus
agcaacaagtgctctcgcctgctta

SEQ ID NO: 164525 - DNA, 25 bp, Mus musculus
agcaacacacaacatccctgattat

SEQ ID NO: 164526 - DNA, 25 bp, Mus musculus
agcaacacacaagatccctgattat

SEQ ID NO: 164527 - DNA, 25 bp, Mus musculus
agcaacacagttcttacctgctgac

SEQ ID NO: 164528 - DNA, 25 bp, Mus musculus
agcaacacagttgttacctgctgac

SEQ ID NO: 164529 - DNA, 25 bp, Mus musculus
agcaacacatgcccaccttcaggaa

SEQ ID NO: 164530 - DNA, 25 bp, Mus musculus
agcaacacatgcgcaccttcaggaa

SEQ ID NO: 164531 - DNA, 25 bp, Mus musculus
agcaacactggcagagcttgggtca

SEQ ID NO: 164532 - DNA, 25 bp, Mus musculus
agcaacactggctgagcttgggtca

SEQ ID NO: 164533 - DNA, 25 bp, Mus musculus
agcaacactgtgagataacatccac

SEQ ID NO: 164534 - DNA, 25 bp, Mus musculus
agcaacactgtgtgataacatccac

SEQ ID NO: 164535 - DNA, 25 bp, Mus musculus
agcaacagaccaacctcatgctgaa

SEQ ID NO: 164536 - DNA, 25 bp, Mus musculus
agcaacagaccatcctcatgctgaa

SEQ ID NO: 164537 - DNA, 25 bp, Mus musculus
agcaacagacctcggctgtttccct

SEQ ID NO: 164538 - DNA, 25 bp, Mus musculus
agcaacagacctgggctgtttccct

SEQ ID NO: 164539 - DNA, 25 bp, Mus musculus
agcaacagacgaatcaccctggcag

SEQ ID NO: 164540 - DNA, 25 bp, Mus musculus
agcaacagacgattcaccctggcag

SEQ ID NO: 164541 - DNA, 25 bp, Mus musculus
agcaacagatcgattttctctgaaa

SEQ ID NO: 164542 - DNA, 25 bp, Mus musculus
agcaacagatcgtttttctctgaaa

SEQ ID NO: 164543 - DNA, 25 bp, Mus musculus
agcaacagatttaggagtgtccgaa

SEQ ID NO: 164544 - DNA, 25 bp, Mus musculus
agcaacagattttggagtgtccgaa

SEQ ID NO: 164545 - DNA, 25 bp, Mus musculus
agcaacagcagccttgtgtcttcca

SEQ ID NO: 164546 - DNA, 25 bp, Mus musculus
agcaacagcagcgttgtgtcttcca

SEQ ID NO: 164547 - DNA, 25 bp, Mus musculus
agcaacagcatgctgtccagactct

SEQ ID NO: 164548 - DNA, 25 bp, Mus musculus
agcaacagcatggtgtccagactct

SEQ ID NO: 164549 - DNA, 25 bp, Mus musculus
agcaacagccaccagctccagggtg

SEQ ID NO: 164550 - DNA, 25 bp, Mus musculus
agcaacagccacgagctccagggtg

SEQ ID NO: 164551 - DNA, 25 bp, Mus musculus
agcaacagccagcttgaccttctcg

SEQ ID NO: 164552 - DNA, 25 bp, Mus musculus
agcaacagccaggttgaccttctcg

SEQ ID NO: 164553 - DNA, 25 bp, Mus musculus
agcaacagctccaagattatcagaa

SEQ ID NO: 164554 - DNA, 25 bp, Mus musculus
agcaacagctcctagattatcagaa

SEQ ID NO: 164555 - DNA, 25 bp, Mus musculus
agcaacagctctagcttcctctcca

SEQ ID NO: 164556 - DNA, 25 bp, Mus musculus
agcaacagctcttgcttcctctcca

SEQ ID NO: 164557 - DNA, 25 bp, Mus musculus
agcaacagggaaccgggcagccaca

SEQ ID NO: 164558 - DNA, 25 bp, Mus musculus
agcaacagggaagcgggcagccaca

SEQ ID NO: 164559 - DNA, 25 bp, Mus musculus
agcaacagtatccatggctctgcct

SEQ ID NO: 164560 - DNA, 25 bp, Mus musculus
agcaacagtatcgatggctctgcct

SEQ ID NO: 164561 - DNA, 25 bp, Mus musculus
agcaacatccagatcttaagacaga

SEQ ID NO: 164562 - DNA, 25 bp, Mus musculus
agcaacatccagttcttaagacaga

SEQ ID NO: 164563 - DNA, 25 bp, Mus musculus
agcaacatcctgaattaagaaccaa

SEQ ID NO: 164564 - DNA, 25 bp, Mus musculus
agcaacatcctgtattaagaaccaa

SEQ ID NO: 164565 - DNA, 25 bp, Mus musculus
agcaacatccttagtacaatgcaga

SEQ ID NO: 164566 - DNA, 25 bp, Mus musculus
agcaacatcctttgtacaatgcaga

SEQ ID NO: 164567 - DNA, 25 bp, Mus musculus
agcaacatcgtacataaggaactct

SEQ ID NO: 164568 - DNA, 25 bp, Mus musculus
agcaacatcgtagataaggaactct

SEQ ID NO: 164569 - DNA, 25 bp, Mus musculus
agcaacatctgccacaatctgaagt

SEQ ID NO: 164570 - DNA, 25 bp, Mus musculus
agcaacatctgcgacaatctgaagt

SEQ ID NO: 164571 - DNA, 25 bp, Mus musculus
agcaacatgcacagcccggcaagag

SEQ ID NO: 164572 - DNA, 25 bp, Mus musculus
agcaacatgcactgcccggcaagag

SEQ ID NO: 164573 - DNA, 25 bp, Mus musculus
agcaacatgggaattgatgggccac

SEQ ID NO: 164574 - DNA, 25 bp, Mus musculus
agcaacatgggatttgatgggccac

SEQ ID NO: 164575 - DNA, 25 bp, Mus musculus
agcaacatgggccatcacaactgat

SEQ ID NO: 164576 - DNA, 25 bp, Mus musculus
agcaacatgggcgatcacaactgat

SEQ ID NO: 164577 - DNA, 25 bp, Mus musculus
agcaacatgtctctcctgctatata

SEQ ID NO: 164578 - DNA, 25 bp, Mus musculus
agcaacatgtctgtcctgctatata

SEQ ID NO: 164579 - DNA, 25 bp, Mus musculus
agcaacatgttgctgtcccttacaa

SEQ ID NO: 164580 - DNA, 25 bp, Mus musculus
agcaacatgttggtgtcccttacaa

SEQ ID NO: 164581 - DNA, 25 bp, Mus musculus
agcaacattgccattgagaatcaga

SEQ ID NO: 164582 - DNA, 25 bp, Mus musculus
agcaacattgcctttgagaatcaga

SEQ ID NO: 164583 - DNA, 25 bp, Mus musculus
agcaacattggccaactatccttat

SEQ ID NO: 164584 - DNA, 25 bp, Mus musculus
agcaacattggcgaactatccttat

SEQ ID NO: 164585 - DNA, 25 bp, Mus musculus
agcaacattgtgctgctctgttctg

SEQ ID NO: 164586 - DNA, 25 bp, Mus musculus
agcaacattgtggtgctctgttctg

SEQ ID NO: 164587 - DNA, 25 bp, Mus musculus
agcaaccaagagaagcaggtcccct

SEQ ID NO: 164588 - DNA, 25 bp, Mus musculus
agcaaccaagagagtgcccaagctg

SEQ ID NO: 164589 - DNA, 25 bp, Mus musculus
agcaaccaagagtagcaggtcccct

SEQ ID NO: 164590 - DNA, 25 bp, Mus musculus
agcaaccaagagtgtgcccaagctg

SEQ ID NO: 164591 - DNA, 25 bp, Mus musculus
agcaaccaatgaagccagttcctgg

SEQ ID NO: 164592 - DNA, 25 bp, Mus musculus
agcaaccaatgatgccagttcctgg

SEQ ID NO: 164593 - DNA, 25 bp, Mus musculus
agcaaccacaacagtgtctcctaag

SEQ ID NO: 164594 - DNA, 25 bp, Mus musculus
agcaaccacaactgtgtctcctaag

SEQ ID NO: 164595 - DNA, 25 bp, Mus musculus
agcaaccacggcaagtacatcactt

SEQ ID NO: 164596 - DNA, 25 bp, Mus musculus
agcaaccacggctagtacatcactt

SEQ ID NO: 164597 - DNA, 25 bp, Mus musculus
agcaaccactttacaagcatattgt

SEQ ID NO: 164598 - DNA, 25 bp, Mus musculus
agcaaccacttttcaagcatattgt

SEQ ID NO: 164599 - DNA, 25 bp, Mus musculus
agcaaccagaagctgtgcagaagca

SEQ ID NO: 164600 - DNA, 25 bp, Mus musculus
agcaaccagaaggtgtgcagaagca

SEQ ID NO: 164601 - DNA, 25 bp, Mus musculus
agcaaccagtatcctcctttaaatt

SEQ ID NO: 164602 - DNA, 25 bp, Mus musculus
agcaaccagtatgctcctttaaatt

SEQ ID NO: 164603 - DNA, 25 bp, Mus musculus
agcaaccatgccagctgaagcactt

SEQ ID NO: 164604 - DNA, 25 bp, Mus musculus
agcaaccatgcctgctgaagcactt

SEQ ID NO: 164605 - DNA, 25 bp, Mus musculus
agcaaccatgctcgaacacctgagt

SEQ ID NO: 164606 - DNA, 25 bp, Mus musculus
agcaaccatgctggaacacctgagt

SEQ ID NO: 164607 - DNA, 25 bp, Mus musculus
agcaaccattggactgggtagccca

SEQ ID NO: 164608 - DNA, 25 bp, Mus musculus
agcaaccattggtctgggtagccca

SEQ ID NO: 164609 - DNA, 25 bp, Mus musculus
agcaaccatttgacgagacagcatt

SEQ ID NO: 164610 - DNA, 25 bp, Mus musculus
agcaaccatttgtcgagacagcatt

SEQ ID NO: 164611 - DNA, 25 bp, Mus musculus
agcaacccaaaaccttgttctggag

SEQ ID NO: 164612 - DNA, 25 bp, Mus musculus
agcaacccaaaagcttgttctggag

SEQ ID NO: 164613 - DNA, 25 bp, Mus musculus
agcaacccagagattgcgtgcggga

SEQ ID NO: 164614 - DNA, 25 bp, Mus musculus
agcaacccagagtttgcgtgcggga

SEQ ID NO: 164615 - DNA, 25 bp, Mus musculus
agcaacccatccaagaactgttcta

SEQ ID NO: 164616 - DNA, 25 bp, Mus musculus
agcaacccatcctagaactgttcta

SEQ ID NO: 164617 - DNA, 25 bp, Mus musculus
agcaacccgcgtctgccggtggcaa

SEQ ID NO: 164618 - DNA, 25 bp, Mus musculus
agcaacccgcgtgtgccggtggcaa

SEQ ID NO: 164619 - DNA, 25 bp, Mus musculus
agcaaccctagaccctgattgttaa

SEQ ID NO: 164620 - DNA, 25 bp, Mus musculus
agcaaccctagagcctgattgttaa

SEQ ID NO: 164621 - DNA, 25 bp, Mus musculus
agcaaccctcaccaggaagttctgt

SEQ ID NO: 164622 - DNA, 25 bp, Mus musculus
agcaaccctcacgaggaagttctgt

SEQ ID NO: 164623 - DNA, 25 bp, Mus musculus
agcaaccctgaccttggagacagtg

SEQ ID NO: 164624 - DNA, 25 bp, Mus musculus
agcaaccctgacgttggagacagtg

SEQ ID NO: 164625 - DNA, 25 bp, Mus musculus
agcaaccctggcaggtagaggcctg

SEQ ID NO: 164626 - DNA, 25 bp, Mus musculus
agcaaccctggctggtagaggcctg

SEQ ID NO: 164627 - DNA, 25 bp, Mus musculus
agcaacccttagcagcctttcattc

SEQ ID NO: 164628 - DNA, 25 bp, Mus musculus
agcaacccttaggagcctttcattc

SEQ ID NO: 164629 - DNA, 25 bp, Mus musculus
agcaaccgagctctggtgaagtaca

SEQ ID NO: 164630 - DNA, 25 bp, Mus musculus
agcaaccgagctgtggtgaagtaca

SEQ ID NO: 164631 - DNA, 25 bp, Mus musculus
agcaaccgcaagcctgagcagaggt

SEQ ID NO: 164632 - DNA, 25 bp, Mus musculus
agcaaccgcaaggctgagcagaggt

SEQ ID NO: 164633 - DNA, 25 bp, Mus musculus
agcaaccgcagcaggccagagggat

SEQ ID NO: 164634 - DNA, 25 bp, Mus musculus
agcaaccgcagctggccagagggat

SEQ ID NO: 164635 - DNA, 25 bp, Mus musculus
agcaaccgccaacagctgttagcac

SEQ ID NO: 164636 - DNA, 25 bp, Mus musculus
agcaaccgccaagagctgttagcac

SEQ ID NO: 164637 - DNA, 25 bp, Mus musculus
agcaaccgcgtcctgtcctctgagg

SEQ ID NO: 164638 - DNA, 25 bp, Mus musculus
agcaaccgcgtcgtgtcctctgagg

SEQ ID NO: 164639 - DNA, 25 bp, Mus musculus
agcaaccgtgccattctgtctttgg

SEQ ID NO: 164640 - DNA, 25 bp, Mus musculus
agcaaccgtgcctttctgtctttgg

SEQ ID NO: 164641 - DNA, 25 bp, Mus musculus
agcaacctacagacagcggattata

SEQ ID NO: 164642 - DNA, 25 bp, Mus musculus
agcaacctacagtcagcggattata

SEQ ID NO: 164643 - DNA, 25 bp, Mus musculus
agcaacctaggacaatctcgagcag

SEQ ID NO: 164644 - DNA, 25 bp, Mus musculus
agcaacctaggagaatctcgagcag

SEQ ID NO: 164645 - DNA, 25 bp, Mus musculus
agcaacctgtaaccacagttccagg

SEQ ID NO: 164646 - DNA, 25 bp, Mus musculus
agcaacctgtaagcacagttccagg

SEQ ID NO: 164647 - DNA, 25 bp, Mus musculus
agcaaccttgacaaactcttcccat

SEQ ID NO: 164648 - DNA, 25 bp, Mus musculus
agcaaccttgactaactcttcccat

SEQ ID NO: 164649 - DNA, 25 bp, Mus musculus
agcaaccttgagacttcagagccta

SEQ ID NO: 164650 - DNA, 25 bp, Mus musculus
agcaaccttgagtcttcagagccta

SEQ ID NO: 164651 - DNA, 25 bp, Mus musculus
agcaaccttggcaacttgcagttta

SEQ ID NO: 164652 - DNA, 25 bp, Mus musculus
agcaaccttggctacttgcagttta

SEQ ID NO: 164653 - DNA, 25 bp, Mus musculus
agcaacgaacatacccaatcctata

SEQ ID NO: 164654 - DNA, 25 bp, Mus musculus
agcaacgaacattcccaatcctata

SEQ ID NO: 164655 - DNA, 25 bp, Mus musculus
agcaacgagccccacataaagcgtc

SEQ ID NO: 164656 - DNA, 25 bp, Mus musculus
agcaacgagcccgacataaagcgtc

SEQ ID NO: 164657 - DNA, 25 bp, Mus musculus
agcaacgataacaaggtggcaccaa

SEQ ID NO: 164658 - DNA, 25 bp, Mus musculus
agcaacgataactaggtggcaccaa

SEQ ID NO: 164659 - DNA, 25 bp, Mus musculus
agcaacgcacttagaaacatagcaa

SEQ ID NO: 164660 - DNA, 25 bp, Mus musculus
agcaacgcactttgaaacatagcaa

SEQ ID NO: 164661 - DNA, 25 bp, Mus musculus
agcaacgcataccatgcccaagtgg

SEQ ID NO: 164662 - DNA, 25 bp, Mus musculus
agcaacgcatacgatgcccaagtgg

SEQ ID NO: 164663 - DNA, 25 bp, Mus musculus
agcaacgccgaaaatacgcaacttc

SEQ ID NO: 164664 - DNA, 25 bp, Mus musculus
agcaacgccgaatatacgcaacttc

SEQ ID NO: 164665 - DNA, 25 bp, Mus musculus
agcaacgcctacctaattcggattt

SEQ ID NO: 164666 - DNA, 25 bp, Mus musculus
agcaacgcctacgtaattcggattt

SEQ ID NO: 164667 - DNA, 25 bp, Mus musculus
agcaacgctaccacgaggacatttt

SEQ ID NO: 164668 - DNA, 25 bp, Mus musculus
agcaacgctacctcgaggacatttt

SEQ ID NO: 164669 - DNA, 25 bp, Mus musculus
agcaacgcttcacccaggtttccga

SEQ ID NO: 164670 - DNA, 25 bp, Mus musculus
agcaacgcttcagccaggtttccga

SEQ ID NO: 164671 - DNA, 25 bp, Mus musculus
agcaacggagagaccttggctaccc

SEQ ID NO: 164672 - DNA, 25 bp, Mus musculus
agcaacggagagtccttggctaccc

SEQ ID NO: 164673 - DNA, 25 bp, Mus musculus
agcaacggatgcaggtgacacccga

SEQ ID NO: 164674 - DNA, 25 bp, Mus musculus
agcaacggatgctggtgacacccga

SEQ ID NO: 164675 - DNA, 25 bp, Mus musculus
agcaacggctacctcagcacgctgg

SEQ ID NO: 164676 - DNA, 25 bp, Mus musculus
agcaacggctacgtcagcacgctgg

SEQ ID NO: 164677 - DNA, 25 bp, Mus musculus
agcaacggcttcactcagctgttct

SEQ ID NO: 164678 - DNA, 25 bp, Mus musculus
agcaacggcttctctcagctgttct

SEQ ID NO: 164679 - DNA, 25 bp, Mus musculus
agcaacgtgacactgcatatgctaa

SEQ ID NO: 164680 - DNA, 25 bp, Mus musculus
agcaacgtgacagtgcatatgctaa

SEQ ID NO: 164681 - DNA, 25 bp, Mus musculus
agcaacgttcttaatctctgcttcc

SEQ ID NO: 164682 - DNA, 25 bp, Mus musculus
agcaacgttctttatctctgcttcc

SEQ ID NO: 164683 - DNA, 25 bp, Mus musculus
agcaacgttgtcactgaagtaccca

SEQ ID NO: 164684 - DNA, 25 bp, Mus musculus
agcaacgttgtctctgaagtaccca

SEQ ID NO: 164685 - DNA, 25 bp, Mus musculus
agcaactacaatcccagctgccagt

SEQ ID NO: 164686 - DNA, 25 bp, Mus musculus
agcaactacaatgccagctgccagt

SEQ ID NO: 164687 - DNA, 25 bp, Mus musculus
agcaactaccttctttcatgcgtat

SEQ ID NO: 164688 - DNA, 25 bp, Mus musculus
agcaactaccttgtttcatgcgtat

SEQ ID NO: 164689 - DNA, 25 bp, Mus musculus
agcaactactatcgactgacactct

SEQ ID NO: 164690 - DNA, 25 bp, Mus musculus
agcaactactatggactgacactct

SEQ ID NO: 164691 - DNA, 25 bp, Mus musculus
agcaactactctagcttgtcctcag

SEQ ID NO: 164692 - DNA, 25 bp, Mus musculus
agcaactactcttgcttgtcctcag

SEQ ID NO: 164693 - DNA, 25 bp, Mus musculus
agcaactactgcatattaacacaaa

SEQ ID NO: 164694 - DNA, 25 bp, Mus musculus
agcaactactgcttattaacacaaa

SEQ ID NO: 164695 - DNA, 25 bp, Mus musculus
agcaactagagtcagctgacagcta

SEQ ID NO: 164696 - DNA, 25 bp, Mus musculus
agcaactagagtgagctgacagcta

SEQ ID NO: 164697 - DNA, 25 bp, Mus musculus
agcaactagcttaagccactcaggc

SEQ ID NO: 164698 - DNA, 25 bp, Mus musculus
agcaactagctttagccactcaggc

SEQ ID NO: 164699 - DNA, 25 bp, Mus musculus
agcaactaggtcagggctttctcat

SEQ ID NO: 164700 - DNA, 25 bp, Mus musculus
agcaactaggtctgggctttctcat

SEQ ID NO: 164701 - DNA, 25 bp, Mus musculus
agcaactatgatcgcccactgtggg

SEQ ID NO: 164702 - DNA, 25 bp, Mus musculus
agcaactatgatggcccactgtggg

SEQ ID NO: 164703 - DNA, 25 bp, Mus musculus
agcaactatgtgctgccctggctga

SEQ ID NO: 164704 - DNA, 25 bp, Mus musculus
agcaactatgtggtgccctggctga

SEQ ID NO: 164705 - DNA, 25 bp, Mus musculus
agcaactcaatcatggtgtcacaga

SEQ ID NO: 164706 - DNA, 25 bp, Mus musculus
agcaactcaatcttggtgtcacaga

SEQ ID NO: 164707 - DNA, 25 bp, Mus musculus
agcaactcagccaggcacgagcaca

SEQ ID NO: 164708 - DNA, 25 bp, Mus musculus
agcaactcagcctggcacgagcaca

SEQ ID NO: 164709 - DNA, 25 bp, Mus musculus
agcaactcagctagcacccatgggt

SEQ ID NO: 164710 - DNA, 25 bp, Mus musculus
agcaactcagcttgcacccatgggt

SEQ ID NO: 164711 - DNA, 25 bp, Mus musculus
agcaactcagtaagtgttatcggct

SEQ ID NO: 164712 - DNA, 25 bp, Mus musculus
agcaactcagtatgtgttatcggct

SEQ ID NO: 164713 - DNA, 25 bp, Mus musculus
agcaactcagttaagcactgccaat

SEQ ID NO: 164714 - DNA, 25 bp, Mus musculus
agcaactcagttcccttgggctggg

SEQ ID NO: 164715 - DNA, 25 bp, Mus musculus
agcaactcagttgccttgggctggg

SEQ ID NO: 164716 - DNA, 25 bp, Mus musculus
agcaactcagtttagcactgccaat

SEQ ID NO: 164717 - DNA, 25 bp, Mus musculus
agcaactccagaacccaggttggtg

SEQ ID NO: 164718 - DNA, 25 bp, Mus musculus
agcaactccagatcccaggttggtg

SEQ ID NO: 164719 - DNA, 25 bp, Mus musculus
agcaactccaggctgttcatgctag

SEQ ID NO: 164720 - DNA, 25 bp, Mus musculus
agcaactccagggtgttcatgctag

SEQ ID NO: 164721 - DNA, 25 bp, Mus musculus
agcaactccatgcaggccaccagat

SEQ ID NO: 164722 - DNA, 25 bp, Mus musculus
agcaactccatggaggccaccagat

SEQ ID NO: 164723 - DNA, 25 bp, Mus musculus
agcaactcccatcatttctgaaaat

SEQ ID NO: 164724 - DNA, 25 bp, Mus musculus
agcaactcccatgatttctgaaaat

SEQ ID NO: 164725 - DNA, 25 bp, Mus musculus
agcaactccctaaatccagcatgaa

SEQ ID NO: 164726 - DNA, 25 bp, Mus musculus
agcaactccctatatccagcatgaa

SEQ ID NO: 164727 - DNA, 25 bp, Mus musculus
agcaactccgatactcttaaacact

SEQ ID NO: 164728 - DNA, 25 bp, Mus musculus
agcaactccgatatggctcctctga

SEQ ID NO: 164729 - DNA, 25 bp, Mus musculus
agcaactccgattctcttaaacact

SEQ ID NO: 164730 - DNA, 25 bp, Mus musculus
agcaactccgatttggctcctctga

SEQ ID NO: 164731 - DNA, 25 bp, Mus musculus
agcaactcctgcagaccgatgtgag

SEQ ID NO: 164732 - DNA, 25 bp, Mus musculus
agcaactcctgctgaccgatgtgag

SEQ ID NO: 164733 - DNA, 25 bp, Mus musculus
agcaactccttgacaggccctctta

SEQ ID NO: 164734 - DNA, 25 bp, Mus musculus
agcaactccttgacgccaggaacag

SEQ ID NO: 164735 - DNA, 25 bp, Mus musculus
agcaactccttgacgtcctcggcgg

SEQ ID NO: 164736 - DNA, 25 bp, Mus musculus
agcaactccttgtcaggccctctta

SEQ ID NO: 164737 - DNA, 25 bp, Mus musculus
agcaactccttgtcgccaggaacag

SEQ ID NO: 164738 - DNA, 25 bp, Mus musculus
agcaactccttgtcgtcctcggcgg

SEQ ID NO: 164739 - DNA, 25 bp, Mus musculus
agcaactctcggattcagatggctg

SEQ ID NO: 164740 - DNA, 25 bp, Mus musculus
agcaactctcggtttcagatggctg

SEQ ID NO: 164741 - DNA, 25 bp, Mus musculus
agcaactctcttcctttgaggcaaa

SEQ ID NO: 164742 - DNA, 25 bp, Mus musculus
agcaactctcttgctttgaggcaaa

SEQ ID NO: 164743 - DNA, 25 bp, Mus musculus
agcaactcttacagccaggaaactt

SEQ ID NO: 164744 - DNA, 25 bp, Mus musculus
agcaactcttactgccaggaaactt

SEQ ID NO: 164745 - DNA, 25 bp, Mus musculus
agcaactctttgcacctagactaga

SEQ ID NO: 164746 - DNA, 25 bp, Mus musculus
agcaactctttggacctagactaga

SEQ ID NO: 164747 - DNA, 25 bp, Mus musculus
agcaactgcaagaagcccagtcctt

SEQ ID NO: 164748 - DNA, 25 bp, Mus musculus
agcaactgcaagtagcccagtcctt

SEQ ID NO: 164749 - DNA, 25 bp, Mus musculus
agcaactgcagcagcactcgtccga

SEQ ID NO: 164750 - DNA, 25 bp, Mus musculus
agcaactgcagcatgagctgtgggt

SEQ ID NO: 164751 - DNA, 25 bp, Mus musculus
agcaactgcagctgcactcgtccga

SEQ ID NO: 164752 - DNA, 25 bp, Mus musculus
agcaactgcagcttgagctgtgggt

SEQ ID NO: 164753 - DNA, 25 bp, Mus musculus
agcaactgccatcttggtagttcag

SEQ ID NO: 164754 - DNA, 25 bp, Mus musculus
agcaactgccatgttggtagttcag

SEQ ID NO: 164755 - DNA, 25 bp, Mus musculus
agcaactgcgagcacgaaggccgta

SEQ ID NO: 164756 - DNA, 25 bp, Mus musculus
agcaactgcgaggacgaaggccgta

SEQ ID NO: 164757 - DNA, 25 bp, Mus musculus
agcaactgctccactcaaattatag

SEQ ID NO: 164758 - DNA, 25 bp, Mus musculus
agcaactgctcctctcaaattatag

SEQ ID NO: 164759 - DNA, 25 bp, Mus musculus
agcaactgcttcattcttacactaa

SEQ ID NO: 164760 - DNA, 25 bp, Mus musculus
agcaactgcttctttcttacactaa

SEQ ID NO: 164761 - DNA, 25 bp, Mus musculus
agcaactgcttgcttcccaagtaga

SEQ ID NO: 164762 - DNA, 25 bp, Mus musculus
agcaactgcttggttcccaagtaga

SEQ ID NO: 164763 - DNA, 25 bp, Mus musculus
agcaactggacccagctgtgccagc

SEQ ID NO: 164764 - DNA, 25 bp, Mus musculus
agcaactggaccgagctgtgccagc

SEQ ID NO: 164765 - DNA, 25 bp, Mus musculus
agcaactggcggaaagtcggctgca

SEQ ID NO: 164766 - DNA, 25 bp, Mus musculus
agcaactggcggtaagtcggctgca

SEQ ID NO: 164767 - DNA, 25 bp, Mus musculus
agcaactggtccacagcactgggta

SEQ ID NO: 164768 - DNA, 25 bp, Mus musculus
agcaactggtcctcagcactgggta

SEQ ID NO: 164769 - DNA, 25 bp, Mus musculus
agcaactgtgcacgctgccacactg

SEQ ID NO: 164770 - DNA, 25 bp, Mus musculus
agcaactgtgcaggctgccacactg

SEQ ID NO: 164771 - DNA, 25 bp, Mus musculus
agcaactgtggccaggtaccttgag

SEQ ID NO: 164772 - DNA, 25 bp, Mus musculus
agcaactgtggcgaggtaccttgag

SEQ ID NO: 164773 - DNA, 25 bp, Mus musculus
agcaactgtggtacacccacgagaa

SEQ ID NO: 164774 - DNA, 25 bp, Mus musculus
agcaactgtggtcggtttgaatcct

SEQ ID NO: 164775 - DNA, 25 bp, Mus musculus
agcaactgtggtgggtttgaatcct

SEQ ID NO: 164776 - DNA, 25 bp, Mus musculus
agcaactgtggttcacccacgagaa

SEQ ID NO: 164777 - DNA, 25 bp, Mus musculus
agcaactgttatcgaatactttcac

SEQ ID NO: 164778 - DNA, 25 bp, Mus musculus
agcaactgttatggaatactttcac

SEQ ID NO: 164779 - DNA, 25 bp, Mus musculus
agcaactgttccagatcaccagcct

SEQ ID NO: 164780 - DNA, 25 bp, Mus musculus
agcaactgttcctgatcaccagcct

SEQ ID NO: 164781 - DNA, 25 bp, Mus musculus
agcaacttaggaagtaatctgaccc

SEQ ID NO: 164782 - DNA, 25 bp, Mus musculus
agcaacttaggatgtaatctgaccc

SEQ ID NO: 164783 - DNA, 25 bp, Mus musculus
agcaacttcaaaacttgtctttcaa

SEQ ID NO: 164784 - DNA, 25 bp, Mus musculus
agcaacttcaaatcttgtctttcaa

SEQ ID NO: 164785 - DNA, 25 bp, Mus musculus
agcaacttccagagacagggcctta

SEQ ID NO: 164786 - DNA, 25 bp, Mus musculus
agcaacttccagtgacagggcctta

SEQ ID NO: 164787 - DNA, 25 bp, Mus musculus
agcaacttctacctgaggatgcaga

SEQ ID NO: 164788 - DNA, 25 bp, Mus musculus
agcaacttctacgtgaggatgcaga

SEQ ID NO: 164789 - DNA, 25 bp, Mus musculus
agcaacttctccatgtgatcacggt

SEQ ID NO: 164790 - DNA, 25 bp, Mus musculus
agcaacttctccttgtgatcacggt

SEQ ID NO: 164791 - DNA, 25 bp, Mus musculus
agcaacttgagcacctctgaggttc

SEQ ID NO: 164792 - DNA, 25 bp, Mus musculus
agcaacttgagctcctctgaggttc

SEQ ID NO: 164793 - DNA, 25 bp, Mus musculus
agcaacttgcttctaggcctcagag

SEQ ID NO: 164794 - DNA, 25 bp, Mus musculus
agcaacttgcttgtaggcctcagag

SEQ ID NO: 164795 - DNA, 25 bp, Mus musculus
agcaacttggaaagctgataagagc

SEQ ID NO: 164796 - DNA, 25 bp, Mus musculus
agcaacttggaatgctgataagagc

SEQ ID NO: 164797 - DNA, 25 bp, Mus musculus
agcaactttcccaagtgcgtggagg

SEQ ID NO: 164798 - DNA, 25 bp, Mus musculus
agcaactttccctagtgcgtggagg

SEQ ID NO: 164799 - DNA, 25 bp, Mus musculus
agcaactttgcaattctccctgaac

SEQ ID NO: 164800 - DNA, 25 bp, Mus musculus
agcaactttgcatttctccctgaac

SEQ ID NO: 164801 - DNA, 25 bp, Mus musculus
agcaacttttcaagtctgcaaataa

SEQ ID NO: 164802 - DNA, 25 bp, Mus musculus
agcaacttttcatgtctgcaaataa

SEQ ID NO: 164803 - DNA, 25 bp, Mus musculus
agcaactttttgcaaactctggccc

SEQ ID NO: 164804 - DNA, 25 bp, Mus musculus
agcaactttttggaaactctggccc

SEQ ID NO: 164805 - DNA, 25 bp, Mus musculus
agcaagaaaaggaggcccgggccat

SEQ ID NO: 164806 - DNA, 25 bp, Mus musculus
agcaagaaaaggtggcccgggccat

SEQ ID NO: 164807 - DNA, 25 bp, Mus musculus
agcaagaaagccaccaagggcaagg

SEQ ID NO: 164808 - DNA, 25 bp, Mus musculus
agcaagaaagcctccaagggcaagg

SEQ ID NO: 164809 - DNA, 25 bp, Mus musculus
agcaagaaaggtacccctgcagtct

SEQ ID NO: 164810 - DNA, 25 bp, Mus musculus
agcaagaaaggttcccctgcagtct

SEQ ID NO: 164811 - DNA, 25 bp, Mus musculus
agcaagaaccctctatgcactttgg

SEQ ID NO: 164812 - DNA, 25 bp, Mus musculus
agcaagaaccctgtatgcactttgg

SEQ ID NO: 164813 - DNA, 25 bp, Mus musculus
agcaagaactccagcatcgcggatc

SEQ ID NO: 164814 - DNA, 25 bp, Mus musculus
agcaagaactccagcctgagcgcct

SEQ ID NO: 164815 - DNA, 25 bp, Mus musculus
agcaagaactcctgcatcgcggatc

SEQ ID NO: 164816 - DNA, 25 bp, Mus musculus
agcaagaactcctgcctgagcgcct

SEQ ID NO: 164817 - DNA, 25 bp, Mus musculus
agcaagaactgtagagagcctctct

SEQ ID NO: 164818 - DNA, 25 bp, Mus musculus
agcaagaactgttgagagcctctct

SEQ ID NO: 164819 - DNA, 25 bp, Mus musculus
agcaagaactttatcggcgcgtaat

SEQ ID NO: 164820 - DNA, 25 bp, Mus musculus
agcaagaactttttcggcgcgtaat

SEQ ID NO: 164821 - DNA, 25 bp, Mus musculus
agcaagaagagcactcatcctgtcc

SEQ ID NO: 164822 - DNA, 25 bp, Mus musculus
agcaagaagagctctcatcctgtcc

SEQ ID NO: 164823 - DNA, 25 bp, Mus musculus
agcaagaagcatcggtgttcctatt

SEQ ID NO: 164824 - DNA, 25 bp, Mus musculus
agcaagaagcatgggtgttcctatt

SEQ ID NO: 164825 - DNA, 25 bp, Mus musculus
agcaagaagctcataagggcccctt

SEQ ID NO: 164826 - DNA, 25 bp, Mus musculus
agcaagaagctcttaagggcccctt

SEQ ID NO: 164827 - DNA, 25 bp, Mus musculus
agcaagaagtgcacaagctgcagga

SEQ ID NO: 164828 - DNA, 25 bp, Mus musculus
agcaagaagtgctcaagctgcagga

SEQ ID NO: 164829 - DNA, 25 bp, Mus musculus
agcaagaatcctcgtccgctgagct

SEQ ID NO: 164830 - DNA, 25 bp, Mus musculus
agcaagaatcctggtccgctgagct

SEQ ID NO: 164831 - DNA, 25 bp, Mus musculus
agcaagaatgccagccatgggcact

SEQ ID NO: 164832 - DNA, 25 bp, Mus musculus
agcaagaatgcctgccatgggcact

SEQ ID NO: 164833 - DNA, 25 bp, Mus musculus
agcaagacagatccaaactaccaga

SEQ ID NO: 164834 - DNA, 25 bp, Mus musculus
agcaagacagatgcaaactaccaga

SEQ ID NO: 164835 - DNA, 25 bp, Mus musculus
agcaagaccaagctctcatttaagg

SEQ ID NO: 164836 - DNA, 25 bp, Mus musculus
agcaagaccaaggtctcatttaagg

SEQ ID NO: 164837 - DNA, 25 bp, Mus musculus
agcaagaccatcagtgtggcttcta

SEQ ID NO: 164838 - DNA, 25 bp, Mus musculus
agcaagaccatctgtgtggcttcta

SEQ ID NO: 164839 - DNA, 25 bp, Mus musculus
agcaagaccctcaagtgatcctgta

SEQ ID NO: 164840 - DNA, 25 bp, Mus musculus
agcaagaccctctagtgatcctgta

SEQ ID NO: 164841 - DNA, 25 bp, Mus musculus
agcaagaccctgcagtatctcaaga

SEQ ID NO: 164842 - DNA, 25 bp, Mus musculus
agcaagaccctggagtatctcaaga

SEQ ID NO: 164843 - DNA, 25 bp, Mus musculus
agcaagacctgaactctcacaagtt

SEQ ID NO: 164844 - DNA, 25 bp, Mus musculus
agcaagacctgacccttcttcactt

SEQ ID NO: 164845 - DNA, 25 bp, Mus musculus
agcaagacctgagccttcttcactt

SEQ ID NO: 164846 - DNA, 25 bp, Mus musculus
agcaagacctgatctctcacaagtt

SEQ ID NO: 164847 - DNA, 25 bp, Mus musculus
agcaagaccttgctggatggctacg

SEQ ID NO: 164848 - DNA, 25 bp, Mus musculus
agcaagaccttggtggatggctacg

SEQ ID NO: 164849 - DNA, 25 bp, Mus musculus
agcaagactcctctgtgcctgactg

SEQ ID NO: 164850 - DNA, 25 bp, Mus musculus
agcaagactcctgtgtgcctgactg

SEQ ID NO: 164851 - DNA, 25 bp, Mus musculus
agcaagactcggcatcactcagatg

SEQ ID NO: 164852 - DNA, 25 bp, Mus musculus
agcaagactcgggatcactcagatg

SEQ ID NO: 164853 - DNA, 25 bp, Mus musculus
agcaagacttatatgctaccatatg

SEQ ID NO: 164854 - DNA, 25 bp, Mus musculus
agcaagacttatttgctaccatatg

SEQ ID NO: 164855 - DNA, 25 bp, Mus musculus
agcaagagagcacgcctaccaagaa

SEQ ID NO: 164856 - DNA, 25 bp, Mus musculus
agcaagagagcaggcctaccaagaa

SEQ ID NO: 164857 - DNA, 25 bp, Mus musculus
agcaagagcaagcagcctaccaggc

SEQ ID NO: 164858 - DNA, 25 bp, Mus musculus
agcaagagcaaggagcctaccaggc

SEQ ID NO: 164859 - DNA, 25 bp, Mus musculus
agcaagagccatacggctgctttct

SEQ ID NO: 164860 - DNA, 25 bp, Mus musculus
agcaagagccattcggctgctttct

SEQ ID NO: 164861 - DNA, 25 bp, Mus musculus
agcaagagctctcgcaactgcagca

SEQ ID NO: 164862 - DNA, 25 bp, Mus musculus
agcaagagctctggcaactgcagca

SEQ ID NO: 164863 - DNA, 25 bp, Mus musculus
agcaagagcttccagacctctgact

SEQ ID NO: 164864 - DNA, 25 bp, Mus musculus
agcaagagcttcgagacctctgact

SEQ ID NO: 164865 - DNA, 25 bp, Mus musculus
agcaagagctttaacaccaacccca

SEQ ID NO: 164866 - DNA, 25 bp, Mus musculus
agcaagagcttttacaccaacccca

SEQ ID NO: 164867 - DNA, 25 bp, Mus musculus
agcaagaggaacctggcctgatccc

SEQ ID NO: 164868 - DNA, 25 bp, Mus musculus
agcaagaggaacgtggcctgatccc

SEQ ID NO: 164869 - DNA, 25 bp, Mus musculus
agcaagaggttcatgagctcagagt

SEQ ID NO: 164870 - DNA, 25 bp, Mus musculus
agcaagaggttcttgagctcagagt

SEQ ID NO: 164871 - DNA, 25 bp, Mus musculus
agcaagagttgcctgtctcggtcca

SEQ ID NO: 164872 - DNA, 25 bp, Mus musculus
agcaagagttgcgtgtctcggtcca

SEQ ID NO: 164873 - DNA, 25 bp, Mus musculus
agcaagatactcacgagtggccaga

SEQ ID NO: 164874 - DNA, 25 bp, Mus musculus
agcaagatactctcgagtggccaga

SEQ ID NO: 164875 - DNA, 25 bp, Mus musculus
agcaagatcatactgcaatcgagag

SEQ ID NO: 164876 - DNA, 25 bp, Mus musculus
agcaagatcatagtgcaatcgagag

SEQ ID NO: 164877 - DNA, 25 bp, Mus musculus
agcaagatcatccagcgggctgaga

SEQ ID NO: 164878 - DNA, 25 bp, Mus musculus
agcaagatcatcgagcgggctgaga

SEQ ID NO: 164879 - DNA, 25 bp, Mus musculus
agcaagatccgacccatgcaagata

SEQ ID NO: 164880 - DNA, 25 bp, Mus musculus
agcaagatccgagccatgcaagata

SEQ ID NO: 164881 - DNA, 25 bp, Mus musculus
agcaagatggcacttcagtcacacc

SEQ ID NO: 164882 - DNA, 25 bp, Mus musculus
agcaagatggcagttcagtcacacc

SEQ ID NO: 164883 - DNA, 25 bp, Mus musculus
agcaagatggctaccgccaccaggg

SEQ ID NO: 164884 - DNA, 25 bp, Mus musculus
agcaagatggcttccgccaccaggg

SEQ ID NO: 164885 - DNA, 25 bp, Mus musculus
agcaagatgtcccttacagccataa

SEQ ID NO: 164886 - DNA, 25 bp, Mus musculus
agcaagatgtccgttacagccataa

SEQ ID NO: 164887 - DNA, 25 bp, Mus musculus
agcaagatgtgcattctattccagg

SEQ ID NO: 164888 - DNA, 25 bp, Mus musculus
agcaagatgtgctttctattccagg

SEQ ID NO: 164889 - DNA, 25 bp, Mus musculus
agcaagattcgactgcaccctcggg

SEQ ID NO: 164890 - DNA, 25 bp, Mus musculus
agcaagattcgagtgcaccctcggg

SEQ ID NO: 164891 - DNA, 25 bp, Mus musculus
agcaagattcttatgaccagcagtc

SEQ ID NO: 164892 - DNA, 25 bp, Mus musculus
agcaagattcttttgaccagcagtc

SEQ ID NO: 164893 - DNA, 25 bp, Mus musculus
agcaagcaaaacacgcgtacacatg

SEQ ID NO: 164894 - DNA, 25 bp, Mus musculus
agcaagcaaaactcgcgtacacatg

SEQ ID NO: 164895 - DNA, 25 bp, Mus musculus
agcaagcaacatcccattgtgccca

SEQ ID NO: 164896 - DNA, 25 bp, Mus musculus
agcaagcaacatgccattgtgccca

SEQ ID NO: 164897 - DNA, 25 bp, Mus musculus
agcaagcaagtcaagcccgtggctt

SEQ ID NO: 164898 - DNA, 25 bp, Mus musculus
agcaagcaagtctagcccgtggctt

SEQ ID NO: 164899 - DNA, 25 bp, Mus musculus
agcaagcacagcatgaatatcctca

SEQ ID NO: 164900 - DNA, 25 bp, Mus musculus
agcaagcacagcttgaatatcctca

SEQ ID NO: 164901 - DNA, 25 bp, Mus musculus
agcaagcacagtaagcagctgctga

SEQ ID NO: 164902 - DNA, 25 bp, Mus musculus
agcaagcacagttagcagctgctga

SEQ ID NO: 164903 - DNA, 25 bp, Mus musculus
agcaagcaccttctgtgaagttcta

SEQ ID NO: 164904 - DNA, 25 bp, Mus musculus
agcaagcaccttgtgtgaagttcta

SEQ ID NO: 164905 - DNA, 25 bp, Mus musculus
agcaagcactgacccgtgaggccaa

SEQ ID NO: 164906 - DNA, 25 bp, Mus musculus
agcaagcactgagccgtgaggccaa

SEQ ID NO: 164907 - DNA, 25 bp, Mus musculus
agcaagcacttgcaacactccgtca

SEQ ID NO: 164908 - DNA, 25 bp, Mus musculus
agcaagcacttggaacactccgtca

SEQ ID NO: 164909 - DNA, 25 bp, Mus musculus
agcaagcagcagagttcaaacgttc

SEQ ID NO: 164910 - DNA, 25 bp, Mus musculus
agcaagcagcagtgttcaaacgttc

SEQ ID NO: 164911 - DNA, 25 bp, Mus musculus
agcaagcagccaacacagaaagaag

SEQ ID NO: 164912 - DNA, 25 bp, Mus musculus
agcaagcagccatcacagaaagaag

SEQ ID NO: 164913 - DNA, 25 bp, Mus musculus
agcaagcatagaatgggcatccctg

SEQ ID NO: 164914 - DNA, 25 bp, Mus musculus
agcaagcatagattgggcatccctg

SEQ ID NO: 164915 - DNA, 25 bp, Mus musculus
agcaagcatctgagtgtacctgcca

SEQ ID NO: 164916 - DNA, 25 bp, Mus musculus
agcaagcatctgtgtgtacctgcca

SEQ ID NO: 164917 - DNA, 25 bp, Mus musculus
agcaagcatgaaaggcggccaacct

SEQ ID NO: 164918 - DNA, 25 bp, Mus musculus
agcaagcatgaatggcggccaacct

SEQ ID NO: 164919 - DNA, 25 bp, Mus musculus
agcaagcatgcaagtagtgtacata

SEQ ID NO: 164920 - DNA, 25 bp, Mus musculus
agcaagcatgcatgtagtgtacata

SEQ ID NO: 164921 - DNA, 25 bp, Mus musculus
agcaagcatggtactaggctcagga

SEQ ID NO: 164922 - DNA, 25 bp, Mus musculus
agcaagcatggttctaggctcagga

SEQ ID NO: 164923 - DNA, 25 bp, Mus musculus
agcaagcatgtaccagttgtctctg

SEQ ID NO: 164924 - DNA, 25 bp, Mus musculus
agcaagcatgtagcagttgtctctg

SEQ ID NO: 164925 - DNA, 25 bp, Mus musculus
agcaagcatttcacctaaagcatat

SEQ ID NO: 164926 - DNA, 25 bp, Mus musculus
agcaagcatttctcctaaagcatat

SEQ ID NO: 164927 - DNA, 25 bp, Mus musculus
agcaagccactgcactatcctagct

SEQ ID NO: 164928 - DNA, 25 bp, Mus musculus
agcaagccactggactatcctagct

SEQ ID NO: 164929 - DNA, 25 bp, Mus musculus
agcaagccagatcgccacaagggcc

SEQ ID NO: 164930 - DNA, 25 bp, Mus musculus
agcaagccagatggccacaagggcc

SEQ ID NO: 164931 - DNA, 25 bp, Mus musculus
agcaagccaggccacagagtcatag

SEQ ID NO: 164932 - DNA, 25 bp, Mus musculus
agcaagccaggcgacagagtcatag

SEQ ID NO: 164933 - DNA, 25 bp, Mus musculus
agcaagccatggactggttccgggc

SEQ ID NO: 164934 - DNA, 25 bp, Mus musculus
agcaagccatggtctggttccgggc

SEQ ID NO: 164935 - DNA, 25 bp, Mus musculus
agcaagcccagcctctgatggagaa

SEQ ID NO: 164936 - DNA, 25 bp, Mus musculus
agcaagcccagcgtctgatggagaa

SEQ ID NO: 164937 - DNA, 25 bp, Mus musculus
agcaagcccatgcagatactgtggt

SEQ ID NO: 164938 - DNA, 25 bp, Mus musculus
agcaagcccatggagatactgtggt

SEQ ID NO: 164939 - DNA, 25 bp, Mus musculus
agcaagccctgcatcagagcacgta

SEQ ID NO: 164940 - DNA, 25 bp, Mus musculus
agcaagccctgcttcagagcacgta

SEQ ID NO: 164941 - DNA, 25 bp, Mus musculus
agcaagcccttcaaagtcatggtga

SEQ ID NO: 164942 - DNA, 25 bp, Mus musculus
agcaagcccttctaagtcatggtga

SEQ ID NO: 164943 - DNA, 25 bp, Mus musculus
agcaagccgactagccctggctggc

SEQ ID NO: 164944 - DNA, 25 bp, Mus musculus
agcaagccgacttgccctggctggc

SEQ ID NO: 164945 - DNA, 25 bp, Mus musculus
agcaagcctattccgatatgagtac

SEQ ID NO: 164946 - DNA, 25 bp, Mus musculus
agcaagcctattgcgatatgagtac

SEQ ID NO: 164947 - DNA, 25 bp, Mus musculus
agcaagcctcttcccggattagatt

SEQ ID NO: 164948 - DNA, 25 bp, Mus musculus
agcaagcctcttgccggattagatt

SEQ ID NO: 164949 - DNA, 25 bp, Mus musculus
agcaagcctggaactgtgccgattg

SEQ ID NO: 164950 - DNA, 25 bp, Mus musculus
agcaagcctggatctgtgccgattg

SEQ ID NO: 164951 - DNA, 25 bp, Mus musculus
agcaagcctgtgaccatgccaagga

SEQ ID NO: 164952 - DNA, 25 bp, Mus musculus
agcaagcctgtgtccatgccaagga

SEQ ID NO: 164953 - DNA, 25 bp, Mus musculus
agcaagcctttgaagtactagcatt

SEQ ID NO: 164954 - DNA, 25 bp, Mus musculus
agcaagcctttgtagtactagcatt

SEQ ID NO: 164955 - DNA, 25 bp, Mus musculus
agcaagcgatggcttgtttcggcaa

SEQ ID NO: 164956 - DNA, 25 bp, Mus musculus
agcaagcgatgggttgtttcggcaa

SEQ ID NO: 164957 - DNA, 25 bp, Mus musculus
agcaagcgcaagcatctagctttgc

SEQ ID NO: 164958 - DNA, 25 bp, Mus musculus
agcaagcgcaaggatctagctttgc

SEQ ID NO: 164959 - DNA, 25 bp, Mus musculus
agcaagcgggatatggcggcctcac

SEQ ID NO: 164960 - DNA, 25 bp, Mus musculus
agcaagcgggatttggcggcctcac

SEQ ID NO: 164961 - DNA, 25 bp, Mus musculus
agcaagcgtggcctttgtttgtagc

SEQ ID NO: 164962 - DNA, 25 bp, Mus musculus
agcaagcgtggcgtttgtttgtagc

SEQ ID NO: 164963 - DNA, 25 bp, Mus musculus
agcaagctatgtacacggcagacag

SEQ ID NO: 164964 - DNA, 25 bp, Mus musculus
agcaagctatgttcacggcagacag

SEQ ID NO: 164965 - DNA, 25 bp, Mus musculus
agcaagctattcacacaaactcagg

SEQ ID NO: 164966 - DNA, 25 bp, Mus musculus
agcaagctattctcacaaactcagg

SEQ ID NO: 164967 - DNA, 25 bp, Mus musculus
agcaagctcaagatcagatccgtat

SEQ ID NO: 164968 - DNA, 25 bp, Mus musculus
agcaagctcaagttcagatccgtat

SEQ ID NO: 164969 - DNA, 25 bp, Mus musculus
agcaagctcagcagcagtcgccgcg

SEQ ID NO: 164970 - DNA, 25 bp, Mus musculus
agcaagctcagctgcagtcgccgcg

SEQ ID NO: 164971 - DNA, 25 bp, Mus musculus
agcaagctcctgcactactgcaagt

SEQ ID NO: 164972 - DNA, 25 bp, Mus musculus
agcaagctcctggactactgcaagt

SEQ ID NO: 164973 - DNA, 25 bp, Mus musculus
agcaagctcgagaacatgcgttgtc

SEQ ID NO: 164974 - DNA, 25 bp, Mus musculus
agcaagctcgagtacatgcgttgtc

SEQ ID NO: 164975 - DNA, 25 bp, Mus musculus
agcaagctcggtcctccactgagtg

SEQ ID NO: 164976 - DNA, 25 bp, Mus musculus
agcaagctcggtgctccactgagtg

SEQ ID NO: 164977 - DNA, 25 bp, Mus musculus
agcaagctgaggagcggcgaccgca

SEQ ID NO: 164978 - DNA, 25 bp, Mus musculus
agcaagctgaggtgcggcgaccgca

SEQ ID NO: 164979 - DNA, 25 bp, Mus musculus
agcaagctggaacccgtggtgactt

SEQ ID NO: 164980 - DNA, 25 bp, Mus musculus
agcaagctggaagccgtggtgactt

SEQ ID NO: 164981 - DNA, 25 bp, Mus musculus
agcaagctggacatcaaagacacaa

SEQ ID NO: 164982 - DNA, 25 bp, Mus musculus
agcaagctggacttcaaagacacaa

SEQ ID NO: 164983 - DNA, 25 bp, Mus musculus
agcaagctggagctctgaaggccaa

SEQ ID NO: 164984 - DNA, 25 bp, Mus musculus
agcaagctggaggtctgaaggccaa

SEQ ID NO: 164985 - DNA, 25 bp, Mus musculus
agcaagctggccaatctgctcttca

SEQ ID NO: 164986 - DNA, 25 bp, Mus musculus
agcaagctggcctatctgctcttca

SEQ ID NO: 164987 - DNA, 25 bp, Mus musculus
agcaagctggctacagtgcctgagt

SEQ ID NO: 164988 - DNA, 25 bp, Mus musculus
agcaagctggcttcagtgcctgagt

SEQ ID NO: 164989 - DNA, 25 bp, Mus musculus
agcaagctgggtccaagcatcttca

SEQ ID NO: 164990 - DNA, 25 bp, Mus musculus
agcaagctgggtgcaagcatcttca

SEQ ID NO: 164991 - DNA, 25 bp, Mus musculus
agcaagctggttacatctgactaca

SEQ ID NO: 164992 - DNA, 25 bp, Mus musculus
agcaagctggtttcatctgactaca

SEQ ID NO: 164993 - DNA, 25 bp, Mus musculus
agcaagctgtacatcatcaggaaag

SEQ ID NO: 164994 - DNA, 25 bp, Mus musculus
agcaagctgtacttcatcaggaaag

SEQ ID NO: 164995 - DNA, 25 bp, Mus musculus
agcaagcttctacgttctctctctc

SEQ ID NO: 164996 - DNA, 25 bp, Mus musculus
agcaagcttctaggttctctctctc

SEQ ID NO: 164997 - DNA, 25 bp, Mus musculus
agcaagcttggaacatcgtctttga

SEQ ID NO: 164998 - DNA, 25 bp, Mus musculus
agcaagcttggatcatcgtctttga

SEQ ID NO: 164999 - DNA, 25 bp, Mus musculus
agcaaggaaaagctagcacggtctt

SEQ ID NO: 165000 - DNA, 25 bp, Mus musculus
agcaaggaaaaggtagcacggtctt

SEQ ID NO: 165001 - DNA, 25 bp, Mus musculus
agcaaggaccttctgccggatgcca

SEQ ID NO: 165002 - DNA, 25 bp, Mus musculus
agcaaggaccttgtgccggatgcca

SEQ ID NO: 165003 - DNA, 25 bp, Mus musculus
agcaaggacgtactcggcagcacct

SEQ ID NO: 165004 - DNA, 25 bp, Mus musculus
agcaaggacgtagtcggcagcacct

SEQ ID NO: 165005 - DNA, 25 bp, Mus musculus
agcaaggacttgatgggccgttttg

SEQ ID NO: 165006 - DNA, 25 bp, Mus musculus
agcaaggacttgcagcaccgggtca

SEQ ID NO: 165007 - DNA, 25 bp, Mus musculus
agcaaggacttggagcaccgggtca

SEQ ID NO: 165008 - DNA, 25 bp, Mus musculus
agcaaggacttgttgggccgttttg

SEQ ID NO: 165009 - DNA, 25 bp, Mus musculus
agcaaggagccaccatatcgcctct

SEQ ID NO: 165010 - DNA, 25 bp, Mus musculus
agcaaggagccagcatatcgcctct

SEQ ID NO: 165011 - DNA, 25 bp, Mus musculus
agcaaggaggccctcacctttgggc

SEQ ID NO: 165012 - DNA, 25 bp, Mus musculus
agcaaggaggccgtcacctttgggc

SEQ ID NO: 165013 - DNA, 25 bp, Mus musculus
agcaaggagtgaccagccagtgtcc

SEQ ID NO: 165014 - DNA, 25 bp, Mus musculus
agcaaggagtgagcagccagtgtcc

SEQ ID NO: 165015 - DNA, 25 bp, Mus musculus
agcaaggatcaccacatgtgttgtg

SEQ ID NO: 165016 - DNA, 25 bp, Mus musculus
agcaaggatcacgacatgtgttgtg

SEQ ID NO: 165017 - DNA, 25 bp, Mus musculus
agcaaggcaaatcacttttcatttg

SEQ ID NO: 165018 - DNA, 25 bp, Mus musculus
agcaaggcaaatgacttttcatttg

SEQ ID NO: 165019 - DNA, 25 bp, Mus musculus
agcaaggcaagtccgttctggagct

SEQ ID NO: 165020 - DNA, 25 bp, Mus musculus
agcaaggcaagtgcgttctggagct

SEQ ID NO: 165021 - DNA, 25 bp, Mus musculus
agcaaggcaataccttctaaccctc

SEQ ID NO: 165022 - DNA, 25 bp, Mus musculus
agcaaggcaatagcttctaaccctc

SEQ ID NO: 165023 - DNA, 25 bp, Mus musculus
agcaaggcacatcagaagactccca

SEQ ID NO: 165024 - DNA, 25 bp, Mus musculus
agcaaggcacatgagaagactccca

SEQ ID NO: 165025 - DNA, 25 bp, Mus musculus
agcaaggcagccagtttcctaaacc

SEQ ID NO: 165026 - DNA, 25 bp, Mus musculus
agcaaggcagcctgtttcctaaacc

SEQ ID NO: 165027 - DNA, 25 bp, Mus musculus
agcaaggcaggacaccaaggctgat

SEQ ID NO: 165028 - DNA, 25 bp, Mus musculus
agcaaggcaggagaccaaggctgat

SEQ ID NO: 165029 - DNA, 25 bp, Mus musculus
agcaaggcagttagccatcaaggca

SEQ ID NO: 165030 - DNA, 25 bp, Mus musculus
agcaaggcagtttgccatcaaggca

SEQ ID NO: 165031 - DNA, 25 bp, Mus musculus
agcaaggccagacctcatgtcccaa

SEQ ID NO: 165032 - DNA, 25 bp, Mus musculus
agcaaggccagagctcatgtcccaa

SEQ ID NO: 165033 - DNA, 25 bp, Mus musculus
agcaaggccagtctccttcctgaga

SEQ ID NO: 165034 - DNA, 25 bp, Mus musculus
agcaaggccagtgtccttcctgaga

SEQ ID NO: 165035 - DNA, 25 bp, Mus musculus
agcaaggccatgaccttagcaggaa

SEQ ID NO: 165036 - DNA, 25 bp, Mus musculus
agcaaggccatgtccttagcaggaa

SEQ ID NO: 165037 - DNA, 25 bp, Mus musculus
agcaaggcctgcaacctctatggac

SEQ ID NO: 165038 - DNA, 25 bp, Mus musculus
agcaaggcctgctacctctatggac

SEQ ID NO: 165039 - DNA, 25 bp, Mus musculus
agcaaggcctggagcggaacccgga

SEQ ID NO: 165040 - DNA, 25 bp, Mus musculus
agcaaggcctggtgcggaacccgga

SEQ ID NO: 165041 - DNA, 25 bp, Mus musculus
agcaaggcctgtagtatggctgcct

SEQ ID NO: 165042 - DNA, 25 bp, Mus musculus
agcaaggcctgttgtatggctgcct

SEQ ID NO: 165043 - DNA, 25 bp, Mus musculus
agcaaggccttcaggcagaggtccc

SEQ ID NO: 165044 - DNA, 25 bp, Mus musculus
agcaaggccttctggcagaggtccc

SEQ ID NO: 165045 - DNA, 25 bp, Mus musculus
agcaaggcgatgactgttggcccct

SEQ ID NO: 165046 - DNA, 25 bp, Mus musculus
agcaaggcgatgtctgttggcccct

SEQ ID NO: 165047 - DNA, 25 bp, Mus musculus
agcaaggcgattatagctggctctt

SEQ ID NO: 165048 - DNA, 25 bp, Mus musculus
agcaaggcgattttagctggctctt

SEQ ID NO: 165049 - DNA, 25 bp, Mus musculus
agcaaggcgccaatgcatctttggt

SEQ ID NO: 165050 - DNA, 25 bp, Mus musculus
agcaaggcgccattgcatctttggt

SEQ ID NO: 165051 - DNA, 25 bp, Mus musculus
agcaaggctccacatacacaacagt

SEQ ID NO: 165052 - DNA, 25 bp, Mus musculus
agcaaggctccagatacacaacagt

SEQ ID NO: 165053 - DNA, 25 bp, Mus musculus
agcaaggcttgactatccactgtgt

SEQ ID NO: 165054 - DNA, 25 bp, Mus musculus
agcaaggcttgagtatccactgtgt

SEQ ID NO: 165055 - DNA, 25 bp, Mus musculus
agcaagggaagaccctgactcggaa

SEQ ID NO: 165056 - DNA, 25 bp, Mus musculus
agcaagggaagagcctgactcggaa

SEQ ID NO: 165057 - DNA, 25 bp, Mus musculus
agcaagggatggagttcactcagtg

SEQ ID NO: 165058 - DNA, 25 bp, Mus musculus
agcaagggatggtgttcactcagtg

SEQ ID NO: 165059 - DNA, 25 bp, Mus musculus
agcaagggcagccttagcttcatat

SEQ ID NO: 165060 - DNA, 25 bp, Mus musculus
agcaagggcagcgttagcttcatat

SEQ ID NO: 165061 - DNA, 25 bp, Mus musculus
agcaagggcatgactccaccaaaat

SEQ ID NO: 165062 - DNA, 25 bp, Mus musculus
agcaagggcatgtctccaccaaaat

SEQ ID NO: 165063 - DNA, 25 bp, Mus musculus
agcaagggcctaccatcttgtattt

SEQ ID NO: 165064 - DNA, 25 bp, Mus musculus
agcaagggcctagcatcttgtattt

SEQ ID NO: 165065 - DNA, 25 bp, Mus musculus
agcaagggcctcaggtaagaaggaa

SEQ ID NO: 165066 - DNA, 25 bp, Mus musculus
agcaagggcctctggtaagaaggaa

SEQ ID NO: 165067 - DNA, 25 bp, Mus musculus
agcaagggcgcaagctcccggctta

SEQ ID NO: 165068 - DNA, 25 bp, Mus musculus
agcaagggcgcatgctcccggctta

SEQ ID NO: 165069 - DNA, 25 bp, Mus musculus
agcaagggcttgaaactgctgagcc

SEQ ID NO: 165070 - DNA, 25 bp, Mus musculus
agcaagggcttgtaactgctgagcc

SEQ ID NO: 165071 - DNA, 25 bp, Mus musculus
agcaagggtgctacaatctgacaaa

SEQ ID NO: 165072 - DNA, 25 bp, Mus musculus
agcaagggtgcttcaatctgacaaa

SEQ ID NO: 165073 - DNA, 25 bp, Mus musculus
agcaaggtccacaatgtgtttgtac

SEQ ID NO: 165074 - DNA, 25 bp, Mus musculus
agcaaggtccactatgtgtttgtac

SEQ ID NO: 165075 - DNA, 25 bp, Mus musculus
agcaaggtcgccagcgcactgccaa

SEQ ID NO: 165076 - DNA, 25 bp, Mus musculus
agcaaggtcgcctgcgcactgccaa

SEQ ID NO: 165077 - DNA, 25 bp, Mus musculus
agcaaggtcgctcggccttggcctc

SEQ ID NO: 165078 - DNA, 25 bp, Mus musculus
agcaaggtcgctgggccttggcctc

SEQ ID NO: 165079 - DNA, 25 bp, Mus musculus
agcaaggtcgtccaggataggcaca

SEQ ID NO: 165080 - DNA, 25 bp, Mus musculus
agcaaggtcgtcgaggataggcaca

SEQ ID NO: 165081 - DNA, 25 bp, Mus musculus
agcaaggtgccacaggctcctgtga

SEQ ID NO: 165082 - DNA, 25 bp, Mus musculus
agcaaggtgccagaggctcctgtga

SEQ ID NO: 165083 - DNA, 25 bp, Mus musculus
agcaaggtgcggctgtgatttccat

SEQ ID NO: 165084 - DNA, 25 bp, Mus musculus
agcaaggtgcgggtgtgatttccat

SEQ ID NO: 165085 - DNA, 25 bp, Mus musculus
agcaaggtgtctagcagtctcagga

SEQ ID NO: 165086 - DNA, 25 bp, Mus musculus
agcaaggtgtcttgcagtctcagga

SEQ ID NO: 165087 - DNA, 25 bp, Mus musculus
agcaaggtgtgcatcatgtctccag

SEQ ID NO: 165088 - DNA, 25 bp, Mus musculus
agcaaggtgtgcttcatgtctccag

SEQ ID NO: 165089 - DNA, 25 bp, Mus musculus
agcaaggttggtccttcgtgacaac

SEQ ID NO: 165090 - DNA, 25 bp, Mus musculus
agcaaggttggtgcttcgtgacaac

SEQ ID NO: 165091 - DNA, 25 bp, Mus musculus
agcaaggtttgcacactgcatcagt

SEQ ID NO: 165092 - DNA, 25 bp, Mus musculus
agcaaggtttgctcactgcatcagt

SEQ ID NO: 165093 - DNA, 25 bp, Mus musculus
agcaagtaactgagtgtcctggcac

SEQ ID NO: 165094 - DNA, 25 bp, Mus musculus
agcaagtaactgtgtgtcctggcac

SEQ ID NO: 165095 - DNA, 25 bp, Mus musculus
agcaagtaacttctttctgcacaaa

SEQ ID NO: 165096 - DNA, 25 bp, Mus musculus
agcaagtaacttgtttctgcacaaa

SEQ ID NO: 165097 - DNA, 25 bp, Mus musculus
agcaagtacaccatgtctggtcgtg

SEQ ID NO: 165098 - DNA, 25 bp, Mus musculus
agcaagtacaccttgtctggtcgtg

SEQ ID NO: 165099 - DNA, 25 bp, Mus musculus
agcaagtacagaccgaggcccagga

SEQ ID NO: 165100 - DNA, 25 bp, Mus musculus
agcaagtacagagcgaggcccagga

SEQ ID NO: 165101 - DNA, 25 bp, Mus musculus
agcaagtacctcagactcagggcca

SEQ ID NO: 165102 - DNA, 25 bp, Mus musculus
agcaagtacctctgactcagggcca

SEQ ID NO: 165103 - DNA, 25 bp, Mus musculus
agcaagtactctatccattaaccct

SEQ ID NO: 165104 - DNA, 25 bp, Mus musculus
agcaagtactctttccattaaccct

SEQ ID NO: 165105 - DNA, 25 bp, Mus musculus
agcaagtactgtcagctaacggtat

SEQ ID NO: 165106 - DNA, 25 bp, Mus musculus
agcaagtactgtgagctaacggtat

SEQ ID NO: 165107 - DNA, 25 bp, Mus musculus
agcaagtactttaccagccgactac

SEQ ID NO: 165108 - DNA, 25 bp, Mus musculus
agcaagtacttttccagccgactac

SEQ ID NO: 165109 - DNA, 25 bp, Mus musculus
agcaagtagctactccacaggagga

SEQ ID NO: 165110 - DNA, 25 bp, Mus musculus
agcaagtagctagtccacaggagga

SEQ ID NO: 165111 - DNA, 25 bp, Mus musculus
agcaagtagttcctgtcgctctcct

SEQ ID NO: 165112 - DNA, 25 bp, Mus musculus
agcaagtagttcgtgtcgctctcct

SEQ ID NO: 165113 - DNA, 25 bp, Mus musculus
agcaagtagttgctgttcattctct

SEQ ID NO: 165114 - DNA, 25 bp, Mus musculus
agcaagtagttggtgttcattctct

SEQ ID NO: 165115 - DNA, 25 bp, Mus musculus
agcaagtattacaaactgctgggct

SEQ ID NO: 165116 - DNA, 25 bp, Mus musculus
agcaagtattactaactgctgggct

SEQ ID NO: 165117 - DNA, 25 bp, Mus musculus
agcaagtcactcacagtgcaggaca

SEQ ID NO: 165118 - DNA, 25 bp, Mus musculus
agcaagtcactctcagtgcaggaca

SEQ ID NO: 165119 - DNA, 25 bp, Mus musculus
agcaagtcagagatcgtcagccgag

SEQ ID NO: 165120 - DNA, 25 bp, Mus musculus
agcaagtcagagttcgtcagccgag

SEQ ID NO: 165121 - DNA, 25 bp, Mus musculus
agcaagtcaggactcaaactgctgc

SEQ ID NO: 165122 - DNA, 25 bp, Mus musculus
agcaagtcaggagtcaaactgctgc

SEQ ID NO: 165123 - DNA, 25 bp, Mus musculus
agcaagtcagtgactcacaagggca

SEQ ID NO: 165124 - DNA, 25 bp, Mus musculus
agcaagtcagtgtctcacaagggca

SEQ ID NO: 165125 - DNA, 25 bp, Mus musculus
agcaagtccaaacctgctccgtgga

SEQ ID NO: 165126 - DNA, 25 bp, Mus musculus
agcaagtccaaagctgctccgtgga

SEQ ID NO: 165127 - DNA, 25 bp, Mus musculus
agcaagtccacaagcgacgccatcg

SEQ ID NO: 165128 - DNA, 25 bp, Mus musculus
agcaagtccacatgcgacgccatcg

SEQ ID NO: 165129 - DNA, 25 bp, Mus musculus
agcaagtcccagcattagtttccaa

SEQ ID NO: 165130 - DNA, 25 bp, Mus musculus
agcaagtcccaggattagtttccaa

SEQ ID NO: 165131 - DNA, 25 bp, Mus musculus
agcaagtccctaaatacctagaaat

SEQ ID NO: 165132 - DNA, 25 bp, Mus musculus
agcaagtccctatatacctagaaat

SEQ ID NO: 165133 - DNA, 25 bp, Mus musculus
agcaagtccctgagctgtgcttcaa

SEQ ID NO: 165134 - DNA, 25 bp, Mus musculus
agcaagtccctgtgctgtgcttcaa

SEQ ID NO: 165135 - DNA, 25 bp, Mus musculus
agcaagtcccttcgccatctgatgc

SEQ ID NO: 165136 - DNA, 25 bp, Mus musculus
agcaagtcccttggccatctgatgc

SEQ ID NO: 165137 - DNA, 25 bp, Mus musculus
agcaagtccgagctgaatgctggcc

SEQ ID NO: 165138 - DNA, 25 bp, Mus musculus
agcaagtccgaggtgaatgctggcc

SEQ ID NO: 165139 - DNA, 25 bp, Mus musculus
agcaagtcctaactgctgggcgctg

SEQ ID NO: 165140 - DNA, 25 bp, Mus musculus
agcaagtcctaagtgctgggcgctg

SEQ ID NO: 165141 - DNA, 25 bp, Mus musculus
agcaagtcctgcacggttgcagcaa

SEQ ID NO: 165142 - DNA, 25 bp, Mus musculus
agcaagtcctgctcggttgcagcaa

SEQ ID NO: 165143 - DNA, 25 bp, Mus musculus
agcaagtcctggaagacgtggagac

SEQ ID NO: 165144 - DNA, 25 bp, Mus musculus
agcaagtcctggtagacgtggagac

SEQ ID NO: 165145 - DNA, 25 bp, Mus musculus
agcaagtcgttcaattttaattctc

SEQ ID NO: 165146 - DNA, 25 bp, Mus musculus
agcaagtcgttctattttaattctc

SEQ ID NO: 165147 - DNA, 25 bp, Mus musculus
agcaagtctaggcattggcacctat

SEQ ID NO: 165148 - DNA, 25 bp, Mus musculus
agcaagtctagggattggcacctat

SEQ ID NO: 165149 - DNA, 25 bp, Mus musculus
agcaagtctcgaatcttgttctcca

SEQ ID NO: 165150 - DNA, 25 bp, Mus musculus
agcaagtctcgattcttgttctcca

SEQ ID NO: 165151 - DNA, 25 bp, Mus musculus
agcaagtctttaacaatgtcatatg

SEQ ID NO: 165152 - DNA, 25 bp, Mus musculus
agcaagtctttatcaatgtcatatg

SEQ ID NO: 165153 - DNA, 25 bp, Mus musculus
agcaagtgaaccaagcctgaaacgt

SEQ ID NO: 165154 - DNA, 25 bp, Mus musculus
agcaagtgaacctagcctgaaacgt

SEQ ID NO: 165155 - DNA, 25 bp, Mus musculus
agcaagtgaccactgacttcacccg

SEQ ID NO: 165156 - DNA, 25 bp, Mus musculus
agcaagtgaccagtgacttcacccg

SEQ ID NO: 165157 - DNA, 25 bp, Mus musculus
agcaagtgacttaagttctctcccc

SEQ ID NO: 165158 - DNA, 25 bp, Mus musculus
agcaagtgactttagttctctcccc

SEQ ID NO: 165159 - DNA, 25 bp, Mus musculus
agcaagtgcaacagcccagcatgtg

SEQ ID NO: 165160 - DNA, 25 bp, Mus musculus
agcaagtgcaactgcccagcatgtg

SEQ ID NO: 165161 - DNA, 25 bp, Mus musculus
agcaagtgcacgaaccgaattcctt

SEQ ID NO: 165162 - DNA, 25 bp, Mus musculus
agcaagtgcacgtaccgaattcctt

SEQ ID NO: 165163 - DNA, 25 bp, Mus musculus
agcaagtgccatcctgcagcctctg

SEQ ID NO: 165164 - DNA, 25 bp, Mus musculus
agcaagtgccatgctgcagcctctg

SEQ ID NO: 165165 - DNA, 25 bp, Mus musculus
agcaagtgcgtaccatcctggatga

SEQ ID NO: 165166 - DNA, 25 bp, Mus musculus
agcaagtgcgtagcatcctggatga

SEQ ID NO: 165167 - DNA, 25 bp, Mus musculus
agcaagtgctgcagagtgctctcct

SEQ ID NO: 165168 - DNA, 25 bp, Mus musculus
agcaagtgctgctgagtgctctcct

SEQ ID NO: 165169 - DNA, 25 bp, Mus musculus
agcaagtgctttaggcctggctcta

SEQ ID NO: 165170 - DNA, 25 bp, Mus musculus
agcaagtgctttcaactcctgtgct

SEQ ID NO: 165171 - DNA, 25 bp, Mus musculus
agcaagtgctttgaactcctgtgct

SEQ ID NO: 165172 - DNA, 25 bp, Mus musculus
agcaagtgcttttggcctggctcta

SEQ ID NO: 165173 - DNA, 25 bp, Mus musculus
agcaagtggctccaacgcagttcct

SEQ ID NO: 165174 - DNA, 25 bp, Mus musculus
agcaagtggctcgaacgcagttcct

SEQ ID NO: 165175 - DNA, 25 bp, Mus musculus
agcaagtgtgctcaagtcttagtgt

SEQ ID NO: 165176 - DNA, 25 bp, Mus musculus
agcaagtgtgctgaagtcttagtgt

SEQ ID NO: 165177 - DNA, 25 bp, Mus musculus
agcaagtgtgggatgcagagcccac

SEQ ID NO: 165178 - DNA, 25 bp, Mus musculus
agcaagtgtgggttgcagagcccac

SEQ ID NO: 165179 - DNA, 25 bp, Mus musculus
agcaagtgttatcaggagtttccta

SEQ ID NO: 165180 - DNA, 25 bp, Mus musculus
agcaagtgttatgaggagtttccta

SEQ ID NO: 165181 - DNA, 25 bp, Mus musculus
agcaagtgttctcggaattcctata

SEQ ID NO: 165182 - DNA, 25 bp, Mus musculus
agcaagtgttctgggaattcctata

SEQ ID NO: 165183 - DNA, 25 bp, Mus musculus
agcaagtgttgcaatgggccaaagg

SEQ ID NO: 165184 - DNA, 25 bp, Mus musculus
agcaagtgttgctatgggccaaagg

SEQ ID NO: 165185 - DNA, 25 bp, Mus musculus
agcaagttcaggataccccaacaca

SEQ ID NO: 165186 - DNA, 25 bp, Mus musculus
agcaagttcaggttaccccaacaca

SEQ ID NO: 165187 - DNA, 25 bp, Mus musculus
agcaagttccagcacccagcatcta

SEQ ID NO: 165188 - DNA, 25 bp, Mus musculus
agcaagttccaggacccagcatcta

SEQ ID NO: 165189 - DNA, 25 bp, Mus musculus
agcaagttccttcgtagccagagct

SEQ ID NO: 165190 - DNA, 25 bp, Mus musculus
agcaagttccttggtagccagagct

SEQ ID NO: 165191 - DNA, 25 bp, Mus musculus
agcaagttcttccacgatcctatgt

SEQ ID NO: 165192 - DNA, 25 bp, Mus musculus
agcaagttcttcgacgatcctatgt

SEQ ID NO: 165193 - DNA, 25 bp, Mus musculus
agcaagttgattctggaggcctcgc

SEQ ID NO: 165194 - DNA, 25 bp, Mus musculus
agcaagttgattgtggaggcctcgc

SEQ ID NO: 165195 - DNA, 25 bp, Mus musculus
agcaagtttccaccttgatctgcca

SEQ ID NO: 165196 - DNA, 25 bp, Mus musculus
agcaagtttccagcttgatctgcca

SEQ ID NO: 165197 - DNA, 25 bp, Mus musculus
agcaagtttctcaaaggtatcaggt

SEQ ID NO: 165198 - DNA, 25 bp, Mus musculus
agcaagtttctctaaggtatcaggt

SEQ ID NO: 165199 - DNA, 25 bp, Mus musculus
agcaagtttgatcaagcctggacta

SEQ ID NO: 165200 - DNA, 25 bp, Mus musculus
agcaagtttgatgaagcctggacta

SEQ ID NO: 165201 - DNA, 25 bp, Mus musculus
agcaagtttttcatcagctctgcac

SEQ ID NO: 165202 - DNA, 25 bp, Mus musculus
agcaagtttttcttcagctctgcac

SEQ ID NO: 165203 - DNA, 25 bp, Mus musculus
agcaataaacccatccacagagcat

SEQ ID NO: 165204 - DNA, 25 bp, Mus musculus
agcaataaacccttccacagagcat

SEQ ID NO: 165205 - DNA, 25 bp, Mus musculus
agcaataatatcctactgccccagg

SEQ ID NO: 165206 - DNA, 25 bp, Mus musculus
agcaataatatcgtactgccccagg

SEQ ID NO: 165207 - DNA, 25 bp, Mus musculus
agcaatacatgccaggatctttatt

SEQ ID NO: 165208 - DNA, 25 bp, Mus musculus
agcaatacatgcgaggatctttatt

SEQ ID NO: 165209 - DNA, 25 bp, Mus musculus
agcaataccaggctaccggatttct

SEQ ID NO: 165210 - DNA, 25 bp, Mus musculus
agcaataccagggtaccggatttct

SEQ ID NO: 165211 - DNA, 25 bp, Mus musculus
agcaatagcagacagtgggtcccat

SEQ ID NO: 165212 - DNA, 25 bp, Mus musculus
agcaatagcagagagtgggtcccat

SEQ ID NO: 165213 - DNA, 25 bp, Mus musculus
agcaatagccaactccctgcctatg

SEQ ID NO: 165214 - DNA, 25 bp, Mus musculus
agcaatagccaagtccctgcctatg

SEQ ID NO: 165215 - DNA, 25 bp, Mus musculus
agcaataggcaaacagggcttggtt

SEQ ID NO: 165216 - DNA, 25 bp, Mus musculus
agcaataggcaatcagggcttggtt

SEQ ID NO: 165217 - DNA, 25 bp, Mus musculus
agcaataggcgtcaatctctgtgag

SEQ ID NO: 165218 - DNA, 25 bp, Mus musculus
agcaataggcgtgaatctctgtgag

SEQ ID NO: 165219 - DNA, 25 bp, Mus musculus
agcaatagtaggctcatgccactgc

SEQ ID NO: 165220 - DNA, 25 bp, Mus musculus
agcaatagtagggtcatgccactgc

SEQ ID NO: 165221 - DNA, 25 bp, Mus musculus
agcaatagtcacagtgtcaccccaa

SEQ ID NO: 165222 - DNA, 25 bp, Mus musculus
agcaatagtcactgtgtcaccccaa

SEQ ID NO: 165223 - DNA, 25 bp, Mus musculus
agcaatatcctaactgcctgcagta

SEQ ID NO: 165224 - DNA, 25 bp, Mus musculus
agcaatatcctatctgcctgcagta

SEQ ID NO: 165225 - DNA, 25 bp, Mus musculus
agcaatatccttctccaacagtcac

SEQ ID NO: 165226 - DNA, 25 bp, Mus musculus
agcaatatccttgtccaacagtcac

SEQ ID NO: 165227 - DNA, 25 bp, Mus musculus
agcaatatctctccatggtcttcag

SEQ ID NO: 165228 - DNA, 25 bp, Mus musculus
agcaatatctctgcatggtcttcag

SEQ ID NO: 165229 - DNA, 25 bp, Mus musculus
agcaatatgttcagcctgggattcc

SEQ ID NO: 165230 - DNA, 25 bp, Mus musculus
agcaatatgttctgcctgggattcc

SEQ ID NO: 165231 - DNA, 25 bp, Mus musculus
agcaatcaagccaccaaacagcaga

SEQ ID NO: 165232 - DNA, 25 bp, Mus musculus
agcaatcaagcctccaaacagcaga

SEQ ID NO: 165233 - DNA, 25 bp, Mus musculus
agcaatcaatatatctacttatgtt

SEQ ID NO: 165234 - DNA, 25 bp, Mus musculus
agcaatcaatatttctacttatgtt

SEQ ID NO: 165235 - DNA, 25 bp, Mus musculus
agcaatcagattaggttcaccggat

SEQ ID NO: 165236 - DNA, 25 bp, Mus musculus
agcaatcagatttggttcaccggat

SEQ ID NO: 165237 - DNA, 25 bp, Mus musculus
agcaatcagcatcggcggcttcatc

SEQ ID NO: 165238 - DNA, 25 bp, Mus musculus
agcaatcagcatgggcggcttcatc

SEQ ID NO: 165239 - DNA, 25 bp, Mus musculus
agcaatcagtcacatattacatcat

SEQ ID NO: 165240 - DNA, 25 bp, Mus musculus
agcaatcagtcagatattacatcat

SEQ ID NO: 165241 - DNA, 25 bp, Mus musculus
agcaatcattagagactttcacagt

SEQ ID NO: 165242 - DNA, 25 bp, Mus musculus
agcaatcattagtgactttcacagt

SEQ ID NO: 165243 - DNA, 25 bp, Mus musculus
agcaatcattatctggcctggcttg

SEQ ID NO: 165244 - DNA, 25 bp, Mus musculus
agcaatcattatgtggcctggcttg

SEQ ID NO: 165245 - DNA, 25 bp, Mus musculus
agcaatccaaagagcaggccgtctg

SEQ ID NO: 165246 - DNA, 25 bp, Mus musculus
agcaatccaaagtgcaggccgtctg

SEQ ID NO: 165247 - DNA, 25 bp, Mus musculus
agcaatccaaataacttccagcaga

SEQ ID NO: 165248 - DNA, 25 bp, Mus musculus
agcaatccaaattacttccagcaga

SEQ ID NO: 165249 - DNA, 25 bp, Mus musculus
agcaatccacccataggtgggcttt

SEQ ID NO: 165250 - DNA, 25 bp, Mus musculus
agcaatccacccttaggtgggcttt

SEQ ID NO: 165251 - DNA, 25 bp, Mus musculus
agcaatccaggcagccactatcaaa

SEQ ID NO: 165252 - DNA, 25 bp, Mus musculus
agcaatccaggctgccactatcaaa

SEQ ID NO: 165253 - DNA, 25 bp, Mus musculus
agcaatccagttaatcttcaagtct

SEQ ID NO: 165254 - DNA, 25 bp, Mus musculus
agcaatccagtttatcttcaagtct

SEQ ID NO: 165255 - DNA, 25 bp, Mus musculus
agcaatccatatcgctttatctgta

SEQ ID NO: 165256 - DNA, 25 bp, Mus musculus
agcaatccatatggctttatctgta

SEQ ID NO: 165257 - DNA, 25 bp, Mus musculus
agcaatcccaggaggtggttcacta

SEQ ID NO: 165258 - DNA, 25 bp, Mus musculus
agcaatcccaggtggtggttcacta

SEQ ID NO: 165259 - DNA, 25 bp, Mus musculus
agcaatcccagtccctgtgagctct

SEQ ID NO: 165260 - DNA, 25 bp, Mus musculus
agcaatcccagtgcctgtgagctct

SEQ ID NO: 165261 - DNA, 25 bp, Mus musculus
agcaatcccgagcactaagttagtc

SEQ ID NO: 165262 - DNA, 25 bp, Mus musculus
agcaatcccgaggactaagttagtc

SEQ ID NO: 165263 - DNA, 25 bp, Mus musculus
agcaatcccggaaggacaactccaa

SEQ ID NO: 165264 - DNA, 25 bp, Mus musculus
agcaatcccggatggacaactccaa

SEQ ID NO: 165265 - DNA, 25 bp, Mus musculus
agcaatccggttagtcctcaggcta

SEQ ID NO: 165266 - DNA, 25 bp, Mus musculus
agcaatccggtttgtcctcaggcta

SEQ ID NO: 165267 - DNA, 25 bp, Mus musculus
agcaatccgtgcattgcgaacacaa

SEQ ID NO: 165268 - DNA, 25 bp, Mus musculus
agcaatccgtgctttgcgaacacaa

SEQ ID NO: 165269 - DNA, 25 bp, Mus musculus
agcaatcctaatctactcagcaatg

SEQ ID NO: 165270 - DNA, 25 bp, Mus musculus
agcaatcctaatgtactcagcaatg

SEQ ID NO: 165271 - DNA, 25 bp, Mus musculus
agcaatcctggaatcttctttctca

SEQ ID NO: 165272 - DNA, 25 bp, Mus musculus
agcaatcctggattcttctttctca

SEQ ID NO: 165273 - DNA, 25 bp, Mus musculus
agcaatcgcgtgagtgccgtgagca

SEQ ID NO: 165274 - DNA, 25 bp, Mus musculus
agcaatcgcgtgtgtgccgtgagca

SEQ ID NO: 165275 - DNA, 25 bp, Mus musculus
agcaatcgtagaaacttaccttcag

SEQ ID NO: 165276 - DNA, 25 bp, Mus musculus
agcaatcgtagatacttaccttcag

SEQ ID NO: 165277 - DNA, 25 bp, Mus musculus
agcaatctaaacacgtggaacacat

SEQ ID NO: 165278 - DNA, 25 bp, Mus musculus
agcaatctaaactcgtggaacacat

SEQ ID NO: 165279 - DNA, 25 bp, Mus musculus
agcaatctatccaatttttatccat

SEQ ID NO: 165280 - DNA, 25 bp, Mus musculus
agcaatctatcctatttttatccat

SEQ ID NO: 165281 - DNA, 25 bp, Mus musculus
agcaatctcagaacctcatcatgac

SEQ ID NO: 165282 - DNA, 25 bp, Mus musculus
agcaatctcagatcctcatcatgac

SEQ ID NO: 165283 - DNA, 25 bp, Mus musculus
agcaatctcaggactagttcaaaat

SEQ ID NO: 165284 - DNA, 25 bp, Mus musculus
agcaatctcaggtctagttcaaaat

SEQ ID NO: 165285 - DNA, 25 bp, Mus musculus
agcaatctggatcaagcctcttgtc

SEQ ID NO: 165286 - DNA, 25 bp, Mus musculus
agcaatctggatgaagcctcttgtc

SEQ ID NO: 165287 - DNA, 25 bp, Mus musculus
agcaatctggcccatacaatactta

SEQ ID NO: 165288 - DNA, 25 bp, Mus musculus
agcaatctggccgatacaatactta

SEQ ID NO: 165289 - DNA, 25 bp, Mus musculus
agcaatctgtgtacagagactggca

SEQ ID NO: 165290 - DNA, 25 bp, Mus musculus
agcaatctgtgttcagagactggca

SEQ ID NO: 165291 - DNA, 25 bp, Mus musculus
agcaatcttcttcatcatgtccaga

SEQ ID NO: 165292 - DNA, 25 bp, Mus musculus
agcaatcttcttgatcatgtccaga

SEQ ID NO: 165293 - DNA, 25 bp, Mus musculus
agcaatcttgcaagccgtccagagg

SEQ ID NO: 165294 - DNA, 25 bp, Mus musculus
agcaatcttgcaagtctatcatgga

SEQ ID NO: 165295 - DNA, 25 bp, Mus musculus
agcaatcttgcatgccgtccagagg

SEQ ID NO: 165296 - DNA, 25 bp, Mus musculus
agcaatcttgcatgtctatcatgga

SEQ ID NO: 165297 - DNA, 25 bp, Mus musculus
agcaatcttgtcactcagatcatat

SEQ ID NO: 165298 - DNA, 25 bp, Mus musculus
agcaatcttgtctctcagatcatat

SEQ ID NO: 165299 - DNA, 25 bp, Mus musculus
agcaatctttctattatgttttctt

SEQ ID NO: 165300 - DNA, 25 bp, Mus musculus
agcaatctttcttttatgttttctt

SEQ ID NO: 165301 - DNA, 25 bp, Mus musculus
agcaatgaaagtcgctccttcctct

SEQ ID NO: 165302 - DNA, 25 bp, Mus musculus
agcaatgaaagtggctccttcctct

SEQ ID NO: 165303 - DNA, 25 bp, Mus musculus
agcaatgaacacatcaccccgggaa

SEQ ID NO: 165304 - DNA, 25 bp, Mus musculus
agcaatgaacacttcaccccgggaa

SEQ ID NO: 165305 - DNA, 25 bp, Mus musculus
agcaatgacactccccttctgtggg

SEQ ID NO: 165306 - DNA, 25 bp, Mus musculus
agcaatgacactgcccttctgtggg

SEQ ID NO: 165307 - DNA, 25 bp, Mus musculus
agcaatgacccacagggaaggacca

SEQ ID NO: 165308 - DNA, 25 bp, Mus musculus
agcaatgacccagagggaaggacca

SEQ ID NO: 165309 - DNA, 25 bp, Mus musculus
agcaatgacctcatcctttcaagtg

SEQ ID NO: 165310 - DNA, 25 bp, Mus musculus
agcaatgacctcttcctttcaagtg

SEQ ID NO: 165311 - DNA, 25 bp, Mus musculus
agcaatgacttgagttagccgtaga

SEQ ID NO: 165312 - DNA, 25 bp, Mus musculus
agcaatgacttgtgttagccgtaga

SEQ ID NO: 165313 - DNA, 25 bp, Mus musculus
agcaatgagagccacagccatcttt

SEQ ID NO: 165314 - DNA, 25 bp, Mus musculus
agcaatgagagcgacagccatcttt

SEQ ID NO: 165315 - DNA, 25 bp, Mus musculus
agcaatgaggagctctctgcccagc

SEQ ID NO: 165316 - DNA, 25 bp, Mus musculus
agcaatgaggaggtctctgcccagc

SEQ ID NO: 165317 - DNA, 25 bp, Mus musculus
agcaatgagtgcacttagtcgaaaa

SEQ ID NO: 165318 - DNA, 25 bp, Mus musculus
agcaatgagtgctcttagtcgaaaa

SEQ ID NO: 165319 - DNA, 25 bp, Mus musculus
agcaatgattccagagtcctctctc

SEQ ID NO: 165320 - DNA, 25 bp, Mus musculus
agcaatgattcctgagtcctctctc

SEQ ID NO: 165321 - DNA, 25 bp, Mus musculus
agcaatgcacatactgactggttat

SEQ ID NO: 165322 - DNA, 25 bp, Mus musculus
agcaatgcacattctgactggttat

SEQ ID NO: 165323 - DNA, 25 bp, Mus musculus
agcaatgcagtaccaagcagcctgg

SEQ ID NO: 165324 - DNA, 25 bp, Mus musculus
agcaatgcagtagcaagcagcctgg

SEQ ID NO: 165325 - DNA, 25 bp, Mus musculus
agcaatgccaaaacctaactaagag

SEQ ID NO: 165326 - DNA, 25 bp, Mus musculus
agcaatgccaaatcctaactaagag

SEQ ID NO: 165327 - DNA, 25 bp, Mus musculus
agcaatgccatgagcccctgtgagt

SEQ ID NO: 165328 - DNA, 25 bp, Mus musculus
agcaatgccatgtgcccctgtgagt

SEQ ID NO: 165329 - DNA, 25 bp, Mus musculus
agcaatgcccagagtcgagagcgat

SEQ ID NO: 165330 - DNA, 25 bp, Mus musculus
agcaatgcccagtgtcgagagcgat

SEQ ID NO: 165331 - DNA, 25 bp, Mus musculus
agcaatgctacaaagacgactctca

SEQ ID NO: 165332 - DNA, 25 bp, Mus musculus
agcaatgctacatagacgactctca

SEQ ID NO: 165333 - DNA, 25 bp, Mus musculus
agcaatgctactctacacgtggtga

SEQ ID NO: 165334 - DNA, 25 bp, Mus musculus
agcaatgctactgtacacgtggtga

SEQ ID NO: 165335 - DNA, 25 bp, Mus musculus
agcaatgctcatccttcaggatctt

SEQ ID NO: 165336 - DNA, 25 bp, Mus musculus
agcaatgctcatgcttcaggatctt

SEQ ID NO: 165337 - DNA, 25 bp, Mus musculus
agcaatgctgccagactgggtttcc

SEQ ID NO: 165338 - DNA, 25 bp, Mus musculus
agcaatgctgcctgactgggtttcc

SEQ ID NO: 165339 - DNA, 25 bp, Mus musculus
agcaatgctgtccatttgtttgtgt

SEQ ID NO: 165340 - DNA, 25 bp, Mus musculus
agcaatgctgtcgatttgtttgtgt

SEQ ID NO: 165341 - DNA, 25 bp, Mus musculus
agcaatgctgttctctgggaaatat

SEQ ID NO: 165342 - DNA, 25 bp, Mus musculus
agcaatgctgttgtctgggaaatat

SEQ ID NO: 165343 - DNA, 25 bp, Mus musculus
agcaatggacccacactgacgatgt

SEQ ID NO: 165344 - DNA, 25 bp, Mus musculus
agcaatggaccctcactgacgatgt

SEQ ID NO: 165345 - DNA, 25 bp, Mus musculus
agcaatggactacatctgaaatgag

SEQ ID NO: 165346 - DNA, 25 bp, Mus musculus
agcaatggactagatctgaaatgag

SEQ ID NO: 165347 - DNA, 25 bp, Mus musculus
agcaatggagacaccgtgacccaga

SEQ ID NO: 165348 - DNA, 25 bp, Mus musculus
agcaatggagactccgtgacccaga

SEQ ID NO: 165349 - DNA, 25 bp, Mus musculus
agcaatggcactctgactgtcagga

SEQ ID NO: 165350 - DNA, 25 bp, Mus musculus
agcaatggcactgtgactgtcagga

SEQ ID NO: 165351 - DNA, 25 bp, Mus musculus
agcaatggctgaacctttctcagtg

SEQ ID NO: 165352 - DNA, 25 bp, Mus musculus
agcaatggctgatcctttctcagtg

SEQ ID NO: 165353 - DNA, 25 bp, Mus musculus
agcaatggctgtctcagctgggcct

SEQ ID NO: 165354 - DNA, 25 bp, Mus musculus
agcaatggctgtgtcagctgggcct

SEQ ID NO: 165355 - DNA, 25 bp, Mus musculus
agcaatgggattatatggtgagatt

SEQ ID NO: 165356 - DNA, 25 bp, Mus musculus
agcaatgggattttatggtgagatt

SEQ ID NO: 165357 - DNA, 25 bp, Mus musculus
agcaatgggcccatcaggttcaagg

SEQ ID NO: 165358 - DNA, 25 bp, Mus musculus
agcaatgggcccttcaggttcaagg

SEQ ID NO: 165359 - DNA, 25 bp, Mus musculus
agcaatgggtagattcagctgccag

SEQ ID NO: 165360 - DNA, 25 bp, Mus musculus
agcaatgggtagtttcagctgccag

SEQ ID NO: 165361 - DNA, 25 bp, Mus musculus
agcaatgggtgtcgcctctgtagac

SEQ ID NO: 165362 - DNA, 25 bp, Mus musculus
agcaatgggtgtggcctctgtagac

SEQ ID NO: 165363 - DNA, 25 bp, Mus musculus
agcaatggtcttagcccttaaagat

SEQ ID NO: 165364 - DNA, 25 bp, Mus musculus
agcaatggtctttgcccttaaagat

SEQ ID NO: 165365 - DNA, 25 bp, Mus musculus
agcaatggttagatttatgaattac

SEQ ID NO: 165366 - DNA, 25 bp, Mus musculus
agcaatggttagttttatgaattac

SEQ ID NO: 165367 - DNA, 25 bp, Mus musculus
agcaatggttgcagagatcgcagag

SEQ ID NO: 165368 - DNA, 25 bp, Mus musculus
agcaatggttgctgagatcgcagag

SEQ ID NO: 165369 - DNA, 25 bp, Mus musculus
agcaatgtaccacttcagccaatat

SEQ ID NO: 165370 - DNA, 25 bp, Mus musculus
agcaatgtaccagttcagccaatat

SEQ ID NO: 165371 - DNA, 25 bp, Mus musculus
agcaatgtagacaccagttctctct

SEQ ID NO: 165372 - DNA, 25 bp, Mus musculus
agcaatgtagactccagttctctct

SEQ ID NO: 165373 - DNA, 25 bp, Mus musculus
agcaatgtcatcaagtgggtggtca

SEQ ID NO: 165374 - DNA, 25 bp, Mus musculus
agcaatgtcatctagtgggtggtca

SEQ ID NO: 165375 - DNA, 25 bp, Mus musculus
agcaatgtcctcacttataggaatg

SEQ ID NO: 165376 - DNA, 25 bp, Mus musculus
agcaatgtcctctcttataggaatg

SEQ ID NO: 165377 - DNA, 25 bp, Mus musculus
agcaatgtcggcaactaccagcagt

SEQ ID NO: 165378 - DNA, 25 bp, Mus musculus
agcaatgtcggctactaccagcagt

SEQ ID NO: 165379 - DNA, 25 bp, Mus musculus
agcaatgtcgtcaaggtctctgcct

SEQ ID NO: 165380 - DNA, 25 bp, Mus musculus
agcaatgtcgtctaggtctctgcct

SEQ ID NO: 165381 - DNA, 25 bp, Mus musculus
agcaatgtgcctcctgaaagcctgc

SEQ ID NO: 165382 - DNA, 25 bp, Mus musculus
agcaatgtgcctgctgaaagcctgc

SEQ ID NO: 165383 - DNA, 25 bp, Mus musculus
agcaatgtgctccagagtacccctc

SEQ ID NO: 165384 - DNA, 25 bp, Mus musculus
agcaatgtgctcgagagtacccctc

SEQ ID NO: 165385 - DNA, 25 bp, Mus musculus
agcaatgttcttaccaggcctgaga

SEQ ID NO: 165386 - DNA, 25 bp, Mus musculus
agcaatgttctttccaggcctgaga

SEQ ID NO: 165387 - DNA, 25 bp, Mus musculus
agcaatgtttacagactgcgctaaa

SEQ ID NO: 165388 - DNA, 25 bp, Mus musculus
agcaatgtttactgactgcgctaaa

SEQ ID NO: 165389 - DNA, 25 bp, Mus musculus
agcaattaacatcggtttggctaca

SEQ ID NO: 165390 - DNA, 25 bp, Mus musculus
agcaattaacatgggtttggctaca

SEQ ID NO: 165391 - DNA, 25 bp, Mus musculus
agcaattaagatacgtggagtcctg

SEQ ID NO: 165392 - DNA, 25 bp, Mus musculus
agcaattaagattcgtggagtcctg

SEQ ID NO: 165393 - DNA, 25 bp, Mus musculus
agcaattacctactgtttttcctca

SEQ ID NO: 165394 - DNA, 25 bp, Mus musculus
agcaattacctagtgtttttcctca

SEQ ID NO: 165395 - DNA, 25 bp, Mus musculus
agcaattagcccatctagtaatggc

SEQ ID NO: 165396 - DNA, 25 bp, Mus musculus
agcaattagcccttctagtaatggc

SEQ ID NO: 165397 - DNA, 25 bp, Mus musculus
agcaattaggatcttccttcctgta

SEQ ID NO: 165398 - DNA, 25 bp, Mus musculus
agcaattaggatgttccttcctgta

SEQ ID NO: 165399 - DNA, 25 bp, Mus musculus
agcaattcaaataaggcatccatct

SEQ ID NO: 165400 - DNA, 25 bp, Mus musculus
agcaattcaaattaggcatccatct

SEQ ID NO: 165401 - DNA, 25 bp, Mus musculus
agcaattccgaactcatccctcatt

SEQ ID NO: 165402 - DNA, 25 bp, Mus musculus
agcaattccgaagtcatccctcatt

SEQ ID NO: 165403 - DNA, 25 bp, Mus musculus
agcaattccggcagttgatctggga

SEQ ID NO: 165404 - DNA, 25 bp, Mus musculus
agcaattccggctgttgatctggga

SEQ ID NO: 165405 - DNA, 25 bp, Mus musculus
agcaattccggtactgccaacggta

SEQ ID NO: 165406 - DNA, 25 bp, Mus musculus
agcaattccggttctgccaacggta

SEQ ID NO: 165407 - DNA, 25 bp, Mus musculus
agcaattcctgtctcaatccctttg

SEQ ID NO: 165408 - DNA, 25 bp, Mus musculus
agcaattcctgtgtcaatccctttg

SEQ ID NO: 165409 - DNA, 25 bp, Mus musculus
agcaattctattattctagagaaga

SEQ ID NO: 165410 - DNA, 25 bp, Mus musculus
agcaattctatttttctagagaaga

SEQ ID NO: 165411 - DNA, 25 bp, Mus musculus
agcaattctggtaggaggagctaga

SEQ ID NO: 165412 - DNA, 25 bp, Mus musculus
agcaattctggttggaggagctaga

SEQ ID NO: 165413 - DNA, 25 bp, Mus musculus
agcaattctgtgaggcggcggcgca

SEQ ID NO: 165414 - DNA, 25 bp, Mus musculus
agcaattctgtgtggcggcggcgca

SEQ ID NO: 165415 - DNA, 25 bp, Mus musculus
agcaattcttggcagttccttagtt

SEQ ID NO: 165416 - DNA, 25 bp, Mus musculus
agcaattcttgggagttccttagtt

SEQ ID NO: 165417 - DNA, 25 bp, Mus musculus
agcaattcttgtactccactaaacg

SEQ ID NO: 165418 - DNA, 25 bp, Mus musculus
agcaattcttgttctccactaaacg

SEQ ID NO: 165419 - DNA, 25 bp, Mus musculus
agcaattgagcaccattttcttttc

SEQ ID NO: 165420 - DNA, 25 bp, Mus musculus
agcaattgagcagcattttcttttc

SEQ ID NO: 165421 - DNA, 25 bp, Mus musculus
agcaattgctgacccagtcattgga

SEQ ID NO: 165422 - DNA, 25 bp, Mus musculus
agcaattgctgagccagtcattgga

SEQ ID NO: 165423 - DNA, 25 bp, Mus musculus
agcaattgctgcactagtggaggaa

SEQ ID NO: 165424 - DNA, 25 bp, Mus musculus
agcaattgctgctctagtggaggaa

SEQ ID NO: 165425 - DNA, 25 bp, Mus musculus
agcaattggaacagttttctctttt

SEQ ID NO: 165426 - DNA, 25 bp, Mus musculus
agcaattggaactgttttctctttt

SEQ ID NO: 165427 - DNA, 25 bp, Mus musculus
agcaattggtgtctgtttaattcaa

SEQ ID NO: 165428 - DNA, 25 bp, Mus musculus
agcaattggtgtgtgtttaattcaa

SEQ ID NO: 165429 - DNA, 25 bp, Mus musculus
agcaattgtataccagtcttcagtg

SEQ ID NO: 165430 - DNA, 25 bp, Mus musculus
agcaattgtatagcagtcttcagtg

SEQ ID NO: 165431 - DNA, 25 bp, Mus musculus
agcaattgttctcgaggtgtggata

SEQ ID NO: 165432 - DNA, 25 bp, Mus musculus
agcaattgttctggaggtgtggata

SEQ ID NO: 165433 - DNA, 25 bp, Mus musculus
agcaatttccacatcaggctttgca

SEQ ID NO: 165434 - DNA, 25 bp, Mus musculus
agcaatttccacttcaggctttgca

SEQ ID NO: 165435 - DNA, 25 bp, Mus musculus
agcaatttccagcattctgtgacat

SEQ ID NO: 165436 - DNA, 25 bp, Mus musculus
agcaatttccaggattctgtgacat

SEQ ID NO: 165437 - DNA, 25 bp, Mus musculus
agcaatttccctcccaggatggaag

SEQ ID NO: 165438 - DNA, 25 bp, Mus musculus
agcaatttccctgccaggatggaag

SEQ ID NO: 165439 - DNA, 25 bp, Mus musculus
agcaatttccttccactacgtgtgg

SEQ ID NO: 165440 - DNA, 25 bp, Mus musculus
agcaatttccttgcactacgtgtgg

SEQ ID NO: 165441 - DNA, 25 bp, Mus musculus
agcaatttctgaatgccctgcttcc

SEQ ID NO: 165442 - DNA, 25 bp, Mus musculus
agcaatttctgattgccctgcttcc

SEQ ID NO: 165443 - DNA, 25 bp, Mus musculus
agcaatttgcttatccatcctatta

SEQ ID NO: 165444 - DNA, 25 bp, Mus musculus
agcaatttgcttttccatcctatta

SEQ ID NO: 165445 - DNA, 25 bp, Mus musculus
agcaatttggtcctagctttacatt

SEQ ID NO: 165446 - DNA, 25 bp, Mus musculus
agcaatttggtcgtagctttacatt

SEQ ID NO: 165447 - DNA, 25 bp, Mus musculus
agcaattttggacggtgctgaccct

SEQ ID NO: 165448 - DNA, 25 bp, Mus musculus
agcaattttggagggtgctgaccct

SEQ ID NO: 165449 - DNA, 25 bp, Mus musculus
agcacaaaactacttattccgatgg

SEQ ID NO: 165450 - DNA, 25 bp, Mus musculus
agcacaaaactagttattccgatgg

SEQ ID NO: 165451 - DNA, 25 bp, Mus musculus
agcacaaaatctccattgcttggtc

SEQ ID NO: 165452 - DNA, 25 bp, Mus musculus
agcacaaaatctgcattgcttggtc

SEQ ID NO: 165453 - DNA, 25 bp, Mus musculus
agcacaaaattgcattcctcctcct

SEQ ID NO: 165454 - DNA, 25 bp, Mus musculus
agcacaaaattggattcctcctcct

SEQ ID NO: 165455 - DNA, 25 bp, Mus musculus
agcacaaacagaacttgccgcggca

SEQ ID NO: 165456 - DNA, 25 bp, Mus musculus
agcacaaacagatcttgccgcggca

SEQ ID NO: 165457 - DNA, 25 bp, Mus musculus
agcacaaagaccagtttagctgcct

SEQ ID NO: 165458 - DNA, 25 bp, Mus musculus
agcacaaagacctgtttagctgcct

SEQ ID NO: 165459 - DNA, 25 bp, Mus musculus
agcacaaagctcagatcaaactgaa

SEQ ID NO: 165460 - DNA, 25 bp, Mus musculus
agcacaaagctctgatcaaactgaa

SEQ ID NO: 165461 - DNA, 25 bp, Mus musculus
agcacaaagtctcttctgggcttgc

SEQ ID NO: 165462 - DNA, 25 bp, Mus musculus
agcacaaagtctgttctgggcttgc

SEQ ID NO: 165463 - DNA, 25 bp, Mus musculus
agcacaaatcgaccggtggcagcct

SEQ ID NO: 165464 - DNA, 25 bp, Mus musculus
agcacaaatcgagcggtggcagcct

SEQ ID NO: 165465 - DNA, 25 bp, Mus musculus
agcacaacaactccatggccagtca

SEQ ID NO: 165466 - DNA, 25 bp, Mus musculus
agcacaacaactgcatggccagtca

SEQ ID NO: 165467 - DNA, 25 bp, Mus musculus
agcacaacagacagtcttcaccatc

SEQ ID NO: 165468 - DNA, 25 bp, Mus musculus
agcacaacagactgtcttcaccatc

SEQ ID NO: 165469 - DNA, 25 bp, Mus musculus
agcacaacagagaacgggcctcctt

SEQ ID NO: 165470 - DNA, 25 bp, Mus musculus
agcacaacagagtacgggcctcctt

SEQ ID NO: 165471 - DNA, 25 bp, Mus musculus
agcacaacctcccagttttgtaaga

SEQ ID NO: 165472 - DNA, 25 bp, Mus musculus
agcacaacctccgagttttgtaaga

SEQ ID NO: 165473 - DNA, 25 bp, Mus musculus
agcacaacgtgaattcccatacttg

SEQ ID NO: 165474 - DNA, 25 bp, Mus musculus
agcacaacgtgatttcccatacttg

SEQ ID NO: 165475 - DNA, 25 bp, Mus musculus
agcacaactcttcagtggaattttc

SEQ ID NO: 165476 - DNA, 25 bp, Mus musculus
agcacaactcttgagtggaattttc

SEQ ID NO: 165477 - DNA, 25 bp, Mus musculus
agcacaactgtaacccctgggctgg

SEQ ID NO: 165478 - DNA, 25 bp, Mus musculus
agcacaactgtaacctagtttaaga

SEQ ID NO: 165479 - DNA, 25 bp, Mus musculus
agcacaactgtatcccctgggctgg

SEQ ID NO: 165480 - DNA, 25 bp, Mus musculus
agcacaactgtatcctagtttaaga

SEQ ID NO: 165481 - DNA, 25 bp, Mus musculus
agcacaacttgcacggtgctacaag

SEQ ID NO: 165482 - DNA, 25 bp, Mus musculus
agcacaacttgctcggtgctacaag

SEQ ID NO: 165483 - DNA, 25 bp, Mus musculus
agcacaacttggcagcctcgtagac

SEQ ID NO: 165484 - DNA, 25 bp, Mus musculus
agcacaacttgggagcctcgtagac

SEQ ID NO: 165485 - DNA, 25 bp, Mus musculus
agcacaacttttactaccaggtcct

SEQ ID NO: 165486 - DNA, 25 bp, Mus musculus
agcacaactttttctaccaggtcct

SEQ ID NO: 165487 - DNA, 25 bp, Mus musculus
agcacaagaaccaccggactctgga

SEQ ID NO: 165488 - DNA, 25 bp, Mus musculus
agcacaagaacctccggactctgga

SEQ ID NO: 165489 - DNA, 25 bp, Mus musculus
agcacaagaagcacgcaggcgccga

SEQ ID NO: 165490 - DNA, 25 bp, Mus musculus
agcacaagaagctcgcaggcgccga

SEQ ID NO: 165491 - DNA, 25 bp, Mus musculus
agcacaagatttatcacccagacac

SEQ ID NO: 165492 - DNA, 25 bp, Mus musculus
agcacaagatttttcacccagacac

SEQ ID NO: 165493 - DNA, 25 bp, Mus musculus
agcacaagcattagtggcccgtttc

SEQ ID NO: 165494 - DNA, 25 bp, Mus musculus
agcacaagcatttgtggcccgtttc

SEQ ID NO: 165495 - DNA, 25 bp, Mus musculus
agcacaagcccacaaggagtggaga

SEQ ID NO: 165496 - DNA, 25 bp, Mus musculus
agcacaagcccagaaggagtggaga

SEQ ID NO: 165497 - DNA, 25 bp, Mus musculus
agcacaagcctcagcttagctttga

SEQ ID NO: 165498 - DNA, 25 bp, Mus musculus
agcacaagcctctgcttagctttga

SEQ ID NO: 165499 - DNA, 25 bp, Mus musculus
agcacaagctcaacagtttgacctc

SEQ ID NO: 165500 - DNA, 25 bp, Mus musculus
agcacaagctcatcagtttgacctc

SEQ ID NO: 165501 - DNA, 25 bp, Mus musculus
agcacaagctgtcactaaggttaga

SEQ ID NO: 165502 - DNA, 25 bp, Mus musculus
agcacaagctgtgactaaggttaga

SEQ ID NO: 165503 - DNA, 25 bp, Mus musculus
agcacaagggtacctgctggcagca

SEQ ID NO: 165504 - DNA, 25 bp, Mus musculus
agcacaagggtagctgctggcagca

SEQ ID NO: 165505 - DNA, 25 bp, Mus musculus
agcacaaggtttcttgcagcttcct

SEQ ID NO: 165506 - DNA, 25 bp, Mus musculus
agcacaaggtttgttgcagcttcct

SEQ ID NO: 165507 - DNA, 25 bp, Mus musculus
agcacaagtgacatgttgggtttca

SEQ ID NO: 165508 - DNA, 25 bp, Mus musculus
agcacaagtgacttgttgggtttca

SEQ ID NO: 165509 - DNA, 25 bp, Mus musculus
agcacaatcgtcctcattgcaaggc

SEQ ID NO: 165510 - DNA, 25 bp, Mus musculus
agcacaatcgtcgtcattgcaaggc

SEQ ID NO: 165511 - DNA, 25 bp, Mus musculus
agcacaatctacatgaagaggctat

SEQ ID NO: 165512 - DNA, 25 bp, Mus musculus
agcacaatctacttgaagaggctat

SEQ ID NO: 165513 - DNA, 25 bp, Mus musculus
agcacaatctgtactactcttaatg

SEQ ID NO: 165514 - DNA, 25 bp, Mus musculus
agcacaatctgttctactcttaatg

SEQ ID NO: 165515 - DNA, 25 bp, Mus musculus
agcacaatgggaactgccaaccaaa

SEQ ID NO: 165516 - DNA, 25 bp, Mus musculus
agcacaatgggatctgccaaccaaa

SEQ ID NO: 165517 - DNA, 25 bp, Mus musculus
agcacaatggtgagaggttctacgc

SEQ ID NO: 165518 - DNA, 25 bp, Mus musculus
agcacaatggtgtgaggttctacgc

SEQ ID NO: 165519 - DNA, 25 bp, Mus musculus
agcacaatgttcagcaggtccagtt

SEQ ID NO: 165520 - DNA, 25 bp, Mus musculus
agcacaatgttctgcaggtccagtt

SEQ ID NO: 165521 - DNA, 25 bp, Mus musculus
agcacaattgctacagcacctgctt

SEQ ID NO: 165522 - DNA, 25 bp, Mus musculus
agcacaattgcttcagcacctgctt

SEQ ID NO: 165523 - DNA, 25 bp, Mus musculus
agcacaatttggagcgtccgtggta

SEQ ID NO: 165524 - DNA, 25 bp, Mus musculus
agcacaatttggtgcgtccgtggta

SEQ ID NO: 165525 - DNA, 25 bp, Mus musculus
agcacacaaggcaggcctggcattt

SEQ ID NO: 165526 - DNA, 25 bp, Mus musculus
agcacacaaggctggcctggcattt

SEQ ID NO: 165527 - DNA, 25 bp, Mus musculus
agcacacaatcacctataactccag

SEQ ID NO: 165528 - DNA, 25 bp, Mus musculus
agcacacaatcagctataactccag

SEQ ID NO: 165529 - DNA, 25 bp, Mus musculus
agcacacacagcagtacatccgtac

SEQ ID NO: 165530 - DNA, 25 bp, Mus musculus
agcacacacagctgtacatccgtac

SEQ ID NO: 165531 - DNA, 25 bp, Mus musculus
agcacacactagctcatgaaactgt

SEQ ID NO: 165532 - DNA, 25 bp, Mus musculus
agcacacactaggtcatgaaactgt

SEQ ID NO: 165533 - DNA, 25 bp, Mus musculus
agcacacactccacaacagttttgg

SEQ ID NO: 165534 - DNA, 25 bp, Mus musculus
agcacacactcctcaacagttttgg

SEQ ID NO: 165535 - DNA, 25 bp, Mus musculus
agcacacacttcaccgttgtcaatt

SEQ ID NO: 165536 - DNA, 25 bp, Mus musculus
agcacacacttctccgttgtcaatt

SEQ ID NO: 165537 - DNA, 25 bp, Mus musculus
agcacacagaccatcagctcggagt

SEQ ID NO: 165538 - DNA, 25 bp, Mus musculus
agcacacagaccttcagctcggagt

SEQ ID NO: 165539 - DNA, 25 bp, Mus musculus
agcacacagaggatcccaacttgat

SEQ ID NO: 165540 - DNA, 25 bp, Mus musculus
agcacacagaggttcccaacttgat

SEQ ID NO: 165541 - DNA, 25 bp, Mus musculus
agcacacagccaatagcacagggcc

SEQ ID NO: 165542 - DNA, 25 bp, Mus musculus
agcacacagccattagcacagggcc

SEQ ID NO: 165543 - DNA, 25 bp, Mus musculus
agcacacagctcacttactgggaag

SEQ ID NO: 165544 - DNA, 25 bp, Mus musculus
agcacacagctctcttactgggaag

SEQ ID NO: 165545 - DNA, 25 bp, Mus musculus
agcacacaggtgcaggatctgaccc

SEQ ID NO: 165546 - DNA, 25 bp, Mus musculus
agcacacaggtggaggatctgaccc

SEQ ID NO: 165547 - DNA, 25 bp, Mus musculus
agcacacagtatctgcgcctgctga

SEQ ID NO: 165548 - DNA, 25 bp, Mus musculus
agcacacagtatgtgcgcctgctga

SEQ ID NO: 165549 - DNA, 25 bp, Mus musculus
agcacacagttccaagtcaaccagt

SEQ ID NO: 165550 - DNA, 25 bp, Mus musculus
agcacacagttcgaagtcaaccagt

SEQ ID NO: 165551 - DNA, 25 bp, Mus musculus
agcacacagtttacctacactgtac

SEQ ID NO: 165552 - DNA, 25 bp, Mus musculus
agcacacagttttcctacactgtac

SEQ ID NO: 165553 - DNA, 25 bp, Mus musculus
agcacacatcacagccaacagggag

SEQ ID NO: 165554 - DNA, 25 bp, Mus musculus
agcacacatcactgccaacagggag

SEQ ID NO: 165555 - DNA, 25 bp, Mus musculus
agcacacatcgcatgaggacagaga

SEQ ID NO: 165556 - DNA, 25 bp, Mus musculus
agcacacatcgcttgaggacagaga

SEQ ID NO: 165557 - DNA, 25 bp, Mus musculus
agcacacatctaagccagcgaggat

SEQ ID NO: 165558 - DNA, 25 bp, Mus musculus
agcacacatctatgccagcgaggat

SEQ ID NO: 165559 - DNA, 25 bp, Mus musculus
agcacacatgtgaggtcttagtata

SEQ ID NO: 165560 - DNA, 25 bp, Mus musculus
agcacacatgtgtggtcttagtata

SEQ ID NO: 165561 - DNA, 25 bp, Mus musculus
agcacaccaaacacttgtctgtatt

SEQ ID NO: 165562 - DNA, 25 bp, Mus musculus
agcacaccaaactcttgtctgtatt

SEQ ID NO: 165563 - DNA, 25 bp, Mus musculus
agcacaccaacacaggaccacttgt

SEQ ID NO: 165564 - DNA, 25 bp, Mus musculus
agcacaccaacagaggaccacttgt

SEQ ID NO: 165565 - DNA, 25 bp, Mus musculus
agcacaccactgcatgtcttagaat

SEQ ID NO: 165566 - DNA, 25 bp, Mus musculus
agcacaccactggatgtcttagaat

SEQ ID NO: 165567 - DNA, 25 bp, Mus musculus
agcacaccaggtagcctggaccaga

SEQ ID NO: 165568 - DNA, 25 bp, Mus musculus
agcacaccaggttgcctggaccaga

SEQ ID NO: 165569 - DNA, 25 bp, Mus musculus
agcacaccagtgaatcaggtctctg

SEQ ID NO: 165570 - DNA, 25 bp, Mus musculus
agcacaccagtgtatcaggtctctg

SEQ ID NO: 165571 - DNA, 25 bp, Mus musculus
agcacacccaagcacatgtgcctgt

SEQ ID NO: 165572 - DNA, 25 bp, Mus musculus
agcacacccaaggacatgtgcctgt

SEQ ID NO: 165573 - DNA, 25 bp, Mus musculus
agcacacccaatcgtttcactaact

SEQ ID NO: 165574 - DNA, 25 bp, Mus musculus
agcacacccaatggtttcactaact

SEQ ID NO: 165575 - DNA, 25 bp, Mus musculus
agcacaccgcagaccagaaagtctc

SEQ ID NO: 165576 - DNA, 25 bp, Mus musculus
agcacaccgcagtccagaaagtctc

SEQ ID NO: 165577 - DNA, 25 bp, Mus musculus
agcacaccgctccaagattgacagg

SEQ ID NO: 165578 - DNA, 25 bp, Mus musculus
agcacaccgctcgaagattgacagg

SEQ ID NO: 165579 - DNA, 25 bp, Mus musculus
agcacaccgtccaaaggcggccaaa

SEQ ID NO: 165580 - DNA, 25 bp, Mus musculus
agcacaccgtcctaaggcggccaaa

SEQ ID NO: 165581 - DNA, 25 bp, Mus musculus
agcacacctgaacctttctattcac

SEQ ID NO: 165582 - DNA, 25 bp, Mus musculus
agcacacctgaagctttctattcac

SEQ ID NO: 165583 - DNA, 25 bp, Mus musculus
agcacacctgacagtaccttggaaa

SEQ ID NO: 165584 - DNA, 25 bp, Mus musculus
agcacacctgacagtatttgcatca

SEQ ID NO: 165585 - DNA, 25 bp, Mus musculus
agcacacctgactgtaccttggaaa

SEQ ID NO: 165586 - DNA, 25 bp, Mus musculus
agcacacctgactgtatttgcatca

SEQ ID NO: 165587 - DNA, 25 bp, Mus musculus
agcacacctggacatgttctctcgg

SEQ ID NO: 165588 - DNA, 25 bp, Mus musculus
agcacacctggagatgttctctcgg

SEQ ID NO: 165589 - DNA, 25 bp, Mus musculus
agcacacctgtgcagcatgtacgct

SEQ ID NO: 165590 - DNA, 25 bp, Mus musculus
agcacacctgtggagcatgtacgct

SEQ ID NO: 165591 - DNA, 25 bp, Mus musculus
agcacaccttagacattatctctgt

SEQ ID NO: 165592 - DNA, 25 bp, Mus musculus
agcacaccttagtcattatctctgt

SEQ ID NO: 165593 - DNA, 25 bp, Mus musculus
agcacaccttccagtgactgcgttt

SEQ ID NO: 165594 - DNA, 25 bp, Mus musculus
agcacaccttcctgtgactgcgttt

SEQ ID NO: 165595 - DNA, 25 bp, Mus musculus
agcacaccttctatgcctaagagaa

SEQ ID NO: 165596 - DNA, 25 bp, Mus musculus
agcacaccttctttgcctaagagaa

SEQ ID NO: 165597 - DNA, 25 bp, Mus musculus
agcacacgcacacgtagtcagtcac

SEQ ID NO: 165598 - DNA, 25 bp, Mus musculus
agcacacgcacaggtagtcagtcac

SEQ ID NO: 165599 - DNA, 25 bp, Mus musculus
agcacacgccacagtttaggatgat

SEQ ID NO: 165600 - DNA, 25 bp, Mus musculus
agcacacgccactgtttaggatgat

SEQ ID NO: 165601 - DNA, 25 bp, Mus musculus
agcacacgctgaactggcaatttct

SEQ ID NO: 165602 - DNA, 25 bp, Mus musculus
agcacacgctgatctggcaatttct

SEQ ID NO: 165603 - DNA, 25 bp, Mus musculus
agcacacggaacacggcatctactg

SEQ ID NO: 165604 - DNA, 25 bp, Mus musculus
agcacacggaactcggcatctactg

SEQ ID NO: 165605 - DNA, 25 bp, Mus musculus
agcacacggcacacaaaggtacaaa

SEQ ID NO: 165606 - DNA, 25 bp, Mus musculus
agcacacggcactcaaaggtacaaa

SEQ ID NO: 165607 - DNA, 25 bp, Mus musculus
agcacacggctcatcttaaaattga

SEQ ID NO: 165608 - DNA, 25 bp, Mus musculus
agcacacggctcttcttaaaattga

SEQ ID NO: 165609 - DNA, 25 bp, Mus musculus
agcacacgggccatattatctgtgg

SEQ ID NO: 165610 - DNA, 25 bp, Mus musculus
agcacacgggccttattatctgtgg

SEQ ID NO: 165611 - DNA, 25 bp, Mus musculus
agcacacgggtgcagacacgaataa

SEQ ID NO: 165612 - DNA, 25 bp, Mus musculus
agcacacgggtggagacacgaataa

SEQ ID NO: 165613 - DNA, 25 bp, Mus musculus
agcacacgtggaaacaagcacccaa

SEQ ID NO: 165614 - DNA, 25 bp, Mus musculus
agcacacgtggatacaagcacccaa

SEQ ID NO: 165615 - DNA, 25 bp, Mus musculus
agcacactcagtctttttcctgctt

SEQ ID NO: 165616 - DNA, 25 bp, Mus musculus
agcacactcagtgtttttcctgctt

SEQ ID NO: 165617 - DNA, 25 bp, Mus musculus
agcacactccgacttcaaggactga

SEQ ID NO: 165618 - DNA, 25 bp, Mus musculus
agcacactccgagttcaaggactga

SEQ ID NO: 165619 - DNA, 25 bp, Mus musculus
agcacactcgttcgaatctttccca

SEQ ID NO: 165620 - DNA, 25 bp, Mus musculus
agcacactcgttggaatctttccca

SEQ ID NO: 165621 - DNA, 25 bp, Mus musculus
agcacactgcctatccggccagcat

SEQ ID NO: 165622 - DNA, 25 bp, Mus musculus
agcacactgcctttccggccagcat

SEQ ID NO: 165623 - DNA, 25 bp, Mus musculus
agcacactggtgatcccaattctgg

SEQ ID NO: 165624 - DNA, 25 bp, Mus musculus
agcacactggtgttcccaattctgg

SEQ ID NO: 165625 - DNA, 25 bp, Mus musculus
agcacacttagtaattttactcaga

SEQ ID NO: 165626 - DNA, 25 bp, Mus musculus
agcacacttagttattttactcaga

SEQ ID NO: 165627 - DNA, 25 bp, Mus musculus
agcacacttgacctgaacacttaat

SEQ ID NO: 165628 - DNA, 25 bp, Mus musculus
agcacacttgacgtgaacacttaat

SEQ ID NO: 165629 - DNA, 25 bp, Mus musculus
agcacacttgcaagtctcatactgg

SEQ ID NO: 165630 - DNA, 25 bp, Mus musculus
agcacacttgcatgtctcatactgg

SEQ ID NO: 165631 - DNA, 25 bp, Mus musculus
agcacacttgtcacctgggatctgt

SEQ ID NO: 165632 - DNA, 25 bp, Mus musculus
agcacacttgtctcctgggatctgt

SEQ ID NO: 165633 - DNA, 25 bp, Mus musculus
agcacagaagtcatccagagtgagt

SEQ ID NO: 165634 - DNA, 25 bp, Mus musculus
agcacagaagtcttccagagtgagt

SEQ ID NO: 165635 - DNA, 25 bp, Mus musculus
agcacagaatacatggcttcccaga

SEQ ID NO: 165636 - DNA, 25 bp, Mus musculus
agcacagaatacttggcttcccaga

SEQ ID NO: 165637 - DNA, 25 bp, Mus musculus
agcacagaatgcagactgccctaaa

SEQ ID NO: 165638 - DNA, 25 bp, Mus musculus
agcacagaatgctgactgccctaaa

SEQ ID NO: 165639 - DNA, 25 bp, Mus musculus
agcacagacactcgcgagcatcttg

SEQ ID NO: 165640 - DNA, 25 bp, Mus musculus
agcacagacactggcgagcatcttg

SEQ ID NO: 165641 - DNA, 25 bp, Mus musculus
agcacagacgcccttgtgggggctt

SEQ ID NO: 165642 - DNA, 25 bp, Mus musculus
agcacagacgccgttgtgggggctt

SEQ ID NO: 165643 - DNA, 25 bp, Mus musculus
agcacagacgtacgcctgaggaaga

SEQ ID NO: 165644 - DNA, 25 bp, Mus musculus
agcacagacgtaggcctgaggaaga

SEQ ID NO: 165645 - DNA, 25 bp, Mus musculus
agcacagagaatcgttttacaaaga

SEQ ID NO: 165646 - DNA, 25 bp, Mus musculus
agcacagagaatggttttacaaaga

SEQ ID NO: 165647 - DNA, 25 bp, Mus musculus
agcacagagcctccattttgcagta

SEQ ID NO: 165648 - DNA, 25 bp, Mus musculus
agcacagagcctgcattttgcagta

SEQ ID NO: 165649 - DNA, 25 bp, Mus musculus
agcacagagcgccacagagctcctt

SEQ ID NO: 165650 - DNA, 25 bp, Mus musculus
agcacagagcgcgacagagctcctt

SEQ ID NO: 165651 - DNA, 25 bp, Mus musculus
agcacagaggcccagtgtctatgaa

SEQ ID NO: 165652 - DNA, 25 bp, Mus musculus
agcacagaggccgagtgtctatgaa

SEQ ID NO: 165653 - DNA, 25 bp, Mus musculus
agcacagagttcacagcgtgggcca

SEQ ID NO: 165654 - DNA, 25 bp, Mus musculus
agcacagagttctcagcgtgggcca

SEQ ID NO: 165655 - DNA, 25 bp, Mus musculus
agcacagatatcatgggcactaacc

SEQ ID NO: 165656 - DNA, 25 bp, Mus musculus
agcacagatatcttgggcactaacc

SEQ ID NO: 165657 - DNA, 25 bp, Mus musculus
agcacagatcgtctcagaacagcag

SEQ ID NO: 165658 - DNA, 25 bp, Mus musculus
agcacagatcgtgtcagaacagcag

SEQ ID NO: 165659 - DNA, 25 bp, Mus musculus
agcacagatgtgaaatttcagtcct

SEQ ID NO: 165660 - DNA, 25 bp, Mus musculus
agcacagatgtgtaatttcagtcct

SEQ ID NO: 165661 - DNA, 25 bp, Mus musculus
agcacagattccatttggcctagga

SEQ ID NO: 165662 - DNA, 25 bp, Mus musculus
agcacagattccttttggcctagga

SEQ ID NO: 165663 - DNA, 25 bp, Mus musculus
agcacagcacacctgacagacggtt

SEQ ID NO: 165664 - DNA, 25 bp, Mus musculus
agcacagcacacgtgacagacggtt

SEQ ID NO: 165665 - DNA, 25 bp, Mus musculus
agcacagcactcattgaactgttga

SEQ ID NO: 165666 - DNA, 25 bp, Mus musculus
agcacagcactctttgaactgttga

SEQ ID NO: 165667 - DNA, 25 bp, Mus musculus
agcacagcagcaagaccaatcttgt

SEQ ID NO: 165668 - DNA, 25 bp, Mus musculus
agcacagcagcatgaccaatcttgt

SEQ ID NO: 165669 - DNA, 25 bp, Mus musculus
agcacagcagtcatctagcatcaac

SEQ ID NO: 165670 - DNA, 25 bp, Mus musculus
agcacagcagtcttctagcatcaac

SEQ ID NO: 165671 - DNA, 25 bp, Mus musculus
agcacagcatcacgtgccccagatg

SEQ ID NO: 165672 - DNA, 25 bp, Mus musculus
agcacagcatcaggtgccccagatg

SEQ ID NO: 165673 - DNA, 25 bp, Mus musculus
agcacagcatgcatgttcctgtaac

SEQ ID NO: 165674 - DNA, 25 bp, Mus musculus
agcacagcatgcttgttcctgtaac

SEQ ID NO: 165675 - DNA, 25 bp, Mus musculus
agcacagcatggagagcgtctccac

SEQ ID NO: 165676 - DNA, 25 bp, Mus musculus
agcacagcatggtgagcgtctccac

SEQ ID NO: 165677 - DNA, 25 bp, Mus musculus
agcacagcatgtcgctctactgctt

SEQ ID NO: 165678 - DNA, 25 bp, Mus musculus
agcacagcatgtggctctactgctt

SEQ ID NO: 165679 - DNA, 25 bp, Mus musculus
agcacagccactagattttgaaaat

SEQ ID NO: 165680 - DNA, 25 bp, Mus musculus
agcacagccacttgattttgaaaat

SEQ ID NO: 165681 - DNA, 25 bp, Mus musculus
agcacagccatgcagggccctctgg

SEQ ID NO: 165682 - DNA, 25 bp, Mus musculus
agcacagccatggagggccctctgg

SEQ ID NO: 165683 - DNA, 25 bp, Mus musculus
agcacagcccacctgaagagcagcg

SEQ ID NO: 165684 - DNA, 25 bp, Mus musculus
agcacagcccacgtgaagagcagcg

SEQ ID NO: 165685 - DNA, 25 bp, Mus musculus
agcacagcccctactggagaacagt

SEQ ID NO: 165686 - DNA, 25 bp, Mus musculus
agcacagccccttctggagaacagt

SEQ ID NO: 165687 - DNA, 25 bp, Mus musculus
agcacagccgcacagagggtttaca

SEQ ID NO: 165688 - DNA, 25 bp, Mus musculus
agcacagccgcagagagggtttaca

SEQ ID NO: 165689 - DNA, 25 bp, Mus musculus
agcacagccggccttcagaagtgtt

SEQ ID NO: 165690 - DNA, 25 bp, Mus musculus
agcacagccggcgttcagaagtgtt

SEQ ID NO: 165691 - DNA, 25 bp, Mus musculus
agcacagccgtcacttttgaggaat

SEQ ID NO: 165692 - DNA, 25 bp, Mus musculus
agcacagccgtctcttttgaggaat

SEQ ID NO: 165693 - DNA, 25 bp, Mus musculus
agcacagcctctagattggcatcta

SEQ ID NO: 165694 - DNA, 25 bp, Mus musculus
agcacagcctcttgattggcatcta

SEQ ID NO: 165695 - DNA, 25 bp, Mus musculus
agcacagcgcctaaggtgctggcca

SEQ ID NO: 165696 - DNA, 25 bp, Mus musculus
agcacagcgccttaggtgctggcca

SEQ ID NO: 165697 - DNA, 25 bp, Mus musculus
agcacagcggatattattccccaga

SEQ ID NO: 165698 - DNA, 25 bp, Mus musculus
agcacagcggattttattccccaga

SEQ ID NO: 165699 - DNA, 25 bp, Mus musculus
agcacagctagcctgccctggttaa

SEQ ID NO: 165700 - DNA, 25 bp, Mus musculus
agcacagctagcgtgccctggttaa

SEQ ID NO: 165701 - DNA, 25 bp, Mus musculus
agcacagctcctcatgatgagaagc

SEQ ID NO: 165702 - DNA, 25 bp, Mus musculus
agcacagctcctgatgatgagaagc

SEQ ID NO: 165703 - DNA, 25 bp, Mus musculus
agcacagctcgaagaggaaaccaat

SEQ ID NO: 165704 - DNA, 25 bp, Mus musculus
agcacagctcgatgaggaaaccaat

SEQ ID NO: 165705 - DNA, 25 bp, Mus musculus
agcacagctctgcactatcttcttt

SEQ ID NO: 165706 - DNA, 25 bp, Mus musculus
agcacagctctggactatcttcttt

SEQ ID NO: 165707 - DNA, 25 bp, Mus musculus
agcacagctcttcattcacagtcaa

SEQ ID NO: 165708 - DNA, 25 bp, Mus musculus
agcacagctcttgattcacagtcaa

SEQ ID NO: 165709 - DNA, 25 bp, Mus musculus
agcacagctgccctatattctggga

SEQ ID NO: 165710 - DNA, 25 bp, Mus musculus
agcacagctgccgtatattctggga

SEQ ID NO: 165711 - DNA, 25 bp, Mus musculus
agcacagctgtgatggcggcactct

SEQ ID NO: 165712 - DNA, 25 bp, Mus musculus
agcacagctgtgttggcggcactct

SEQ ID NO: 165713 - DNA, 25 bp, Mus musculus
agcacagcttccatgtgttctaacg

SEQ ID NO: 165714 - DNA, 25 bp, Mus musculus
agcacagcttccttgtgttctaacg

SEQ ID NO: 165715 - DNA, 25 bp, Mus musculus
agcacagctttaaagccacaccttc

SEQ ID NO: 165716 - DNA, 25 bp, Mus musculus
agcacagctttaacacacatcctga

SEQ ID NO: 165717 - DNA, 25 bp, Mus musculus
agcacagctttatagccacaccttc

SEQ ID NO: 165718 - DNA, 25 bp, Mus musculus
agcacagctttatcacacatcctga

SEQ ID NO: 165719 - DNA, 25 bp, Mus musculus
agcacaggaaacaccacgaacccag

SEQ ID NO: 165720 - DNA, 25 bp, Mus musculus
agcacaggaaactccacgaacccag

SEQ ID NO: 165721 - DNA, 25 bp, Mus musculus
agcacaggactaacaactctggtct

SEQ ID NO: 165722 - DNA, 25 bp, Mus musculus
agcacaggactatcaactctggtct

SEQ ID NO: 165723 - DNA, 25 bp, Mus musculus
agcacaggagccagtttcatatttg

SEQ ID NO: 165724 - DNA, 25 bp, Mus musculus
agcacaggagcctgtttcatatttg

SEQ ID NO: 165725 - DNA, 25 bp, Mus musculus
agcacaggatgccttccaaggatga

SEQ ID NO: 165726 - DNA, 25 bp, Mus musculus
agcacaggatgcgttccaaggatga

SEQ ID NO: 165727 - DNA, 25 bp, Mus musculus
agcacaggcagtcagcaccttggag

SEQ ID NO: 165728 - DNA, 25 bp, Mus musculus
agcacaggcagtgagcaccttggag

SEQ ID NO: 165729 - DNA, 25 bp, Mus musculus
agcacaggcgttacagcagttgatg

SEQ ID NO: 165730 - DNA, 25 bp, Mus musculus
agcacaggcgtttcagcagttgatg

SEQ ID NO: 165731 - DNA, 25 bp, Mus musculus
agcacaggctagaggttgtcctgga

SEQ ID NO: 165732 - DNA, 25 bp, Mus musculus
agcacaggctagtggttgtcctgga

SEQ ID NO: 165733 - DNA, 25 bp, Mus musculus
agcacaggctcccttgtgtaattat

SEQ ID NO: 165734 - DNA, 25 bp, Mus musculus
agcacaggctccgttgtgtaattat

SEQ ID NO: 165735 - DNA, 25 bp, Mus musculus
agcacagggaggcagaaaccacaca

SEQ ID NO: 165736 - DNA, 25 bp, Mus musculus
agcacagggagggagaaaccacaca

SEQ ID NO: 165737 - DNA, 25 bp, Mus musculus
agcacagggagtatcttggtttaca

SEQ ID NO: 165738 - DNA, 25 bp, Mus musculus
agcacagggagtttcttggtttaca

SEQ ID NO: 165739 - DNA, 25 bp, Mus musculus
agcacagggattcgcacttgtctta

SEQ ID NO: 165740 - DNA, 25 bp, Mus musculus
agcacagggattggcacttgtctta

SEQ ID NO: 165741 - DNA, 25 bp, Mus musculus
agcacagggcctacgtggagctcag

SEQ ID NO: 165742 - DNA, 25 bp, Mus musculus
agcacagggccttcgtggagctcag

SEQ ID NO: 165743 - DNA, 25 bp, Mus musculus
agcacagggctaagttttagtccat

SEQ ID NO: 165744 - DNA, 25 bp, Mus musculus
agcacagggctacacttacattaca

SEQ ID NO: 165745 - DNA, 25 bp, Mus musculus
agcacagggctagacttacattaca

SEQ ID NO: 165746 - DNA, 25 bp, Mus musculus
agcacagggctatgttttagtccat

SEQ ID NO: 165747 - DNA, 25 bp, Mus musculus
agcacaggggccactatgtctgaat

SEQ ID NO: 165748 - DNA, 25 bp, Mus musculus
agcacaggggcctctatgtctgaat

SEQ ID NO: 165749 - DNA, 25 bp, Mus musculus
agcacagggtatctcagcagcgtta

SEQ ID NO: 165750 - DNA, 25 bp, Mus musculus
agcacagggtatgtcagcagcgtta

SEQ ID NO: 165751 - DNA, 25 bp, Mus musculus
agcacagggtccagcaggcatgcat

SEQ ID NO: 165752 - DNA, 25 bp, Mus musculus
agcacagggtcctgcaggcatgcat

SEQ ID NO: 165753 - DNA, 25 bp, Mus musculus
agcacagggttgacagcagggaaca

SEQ ID NO: 165754 - DNA, 25 bp, Mus musculus
agcacagggttgtcagcagggaaca

SEQ ID NO: 165755 - DNA, 25 bp, Mus musculus
agcacaggtacgacagtttgattcc

SEQ ID NO: 165756 - DNA, 25 bp, Mus musculus
agcacaggtacgtcagtttgattcc

SEQ ID NO: 165757 - DNA, 25 bp, Mus musculus
agcacaggtcgtaactttcagtaca

SEQ ID NO: 165758 - DNA, 25 bp, Mus musculus
agcacaggtcgttactttcagtaca

SEQ ID NO: 165759 - DNA, 25 bp, Mus musculus
agcacaggtgctcatgaggtaccat

SEQ ID NO: 165760 - DNA, 25 bp, Mus musculus
agcacaggtgctgatgaggtaccat

SEQ ID NO: 165761 - DNA, 25 bp, Mus musculus
agcacaggtttcaggagcttcctcc

SEQ ID NO: 165762 - DNA, 25 bp, Mus musculus
agcacaggtttctggagcttcctcc

SEQ ID NO: 165763 - DNA, 25 bp, Mus musculus
agcacagtactcatcactctgggta

SEQ ID NO: 165764 - DNA, 25 bp, Mus musculus
agcacagtactcttcactctgggta

SEQ ID NO: 165765 - DNA, 25 bp, Mus musculus
agcacagtagggagcttccgctcac

SEQ ID NO: 165766 - DNA, 25 bp, Mus musculus
agcacagtagggtgcttccgctcac

SEQ ID NO: 165767 - DNA, 25 bp, Mus musculus
agcacagtatcaaagcttccgctta

SEQ ID NO: 165768 - DNA, 25 bp, Mus musculus
agcacagtatcatagcttccgctta

SEQ ID NO: 165769 - DNA, 25 bp, Mus musculus
agcacagtatccacactgccaagtg

SEQ ID NO: 165770 - DNA, 25 bp, Mus musculus
agcacagtatcctcactgccaagtg

SEQ ID NO: 165771 - DNA, 25 bp, Mus musculus
agcacagtcactagtattccagttg

SEQ ID NO: 165772 - DNA, 25 bp, Mus musculus
agcacagtcactcgcgatctgaaaa

SEQ ID NO: 165773 - DNA, 25 bp, Mus musculus
agcacagtcactggcgatctgaaaa

SEQ ID NO: 165774 - DNA, 25 bp, Mus musculus
agcacagtcacttgtattccagttg

SEQ ID NO: 165775 - DNA, 25 bp, Mus musculus
agcacagtctctagttagggccggt

SEQ ID NO: 165776 - DNA, 25 bp, Mus musculus
agcacagtctcttgttagggccggt

SEQ ID NO: 165777 - DNA, 25 bp, Mus musculus
agcacagtctgcaacatttctcttg

SEQ ID NO: 165778 - DNA, 25 bp, Mus musculus
agcacagtctgctacatttctcttg

SEQ ID NO: 165779 - DNA, 25 bp, Mus musculus
agcacagtctggaactggcccggct

SEQ ID NO: 165780 - DNA, 25 bp, Mus musculus
agcacagtctggtactggcccggct

SEQ ID NO: 165781 - DNA, 25 bp, Mus musculus
agcacagtctttactaggtcttggg

SEQ ID NO: 165782 - DNA, 25 bp, Mus musculus
agcacagtcttttctaggtcttggg

SEQ ID NO: 165783 - DNA, 25 bp, Mus musculus
agcacagtgacacgcgtggctgcta

SEQ ID NO: 165784 - DNA, 25 bp, Mus musculus
agcacagtgacactgctgtccccag

SEQ ID NO: 165785 - DNA, 25 bp, Mus musculus
agcacagtgacaggcgtggctgcta

SEQ ID NO: 165786 - DNA, 25 bp, Mus musculus
agcacagtgacagtgctgtccccag

SEQ ID NO: 165787 - DNA, 25 bp, Mus musculus
agcacagtgacgctagcttctccaa

SEQ ID NO: 165788 - DNA, 25 bp, Mus musculus
agcacagtgacggtagcttctccaa

SEQ ID NO: 165789 - DNA, 25 bp, Mus musculus
agcacagtgactacctcgagagagt

SEQ ID NO: 165790 - DNA, 25 bp, Mus musculus
agcacagtgacttcctcgagagagt

SEQ ID NO: 165791 - DNA, 25 bp, Mus musculus
agcacagtgattacccacggtttcc

SEQ ID NO: 165792 - DNA, 25 bp, Mus musculus
agcacagtgatttcccacggtttcc

SEQ ID NO: 165793 - DNA, 25 bp, Mus musculus
agcacagtgccactgttgtacacac

SEQ ID NO: 165794 - DNA, 25 bp, Mus musculus
agcacagtgccagtgttgtacacac

SEQ ID NO: 165795 - DNA, 25 bp, Mus musculus
agcacagtgcggctttggttcacag

SEQ ID NO: 165796 - DNA, 25 bp, Mus musculus
agcacagtgcgggtttggttcacag

SEQ ID NO: 165797 - DNA, 25 bp, Mus musculus
agcacagtgggacttcgagcagcaa

SEQ ID NO: 165798 - DNA, 25 bp, Mus musculus
agcacagtgggagttcgagcagcaa

SEQ ID NO: 165799 - DNA, 25 bp, Mus musculus
agcacagtgtgcaagctccatagaa

SEQ ID NO: 165800 - DNA, 25 bp, Mus musculus
agcacagtgtgctagctccatagaa

SEQ ID NO: 165801 - DNA, 25 bp, Mus musculus
agcacagttatgattgagccattga

SEQ ID NO: 165802 - DNA, 25 bp, Mus musculus
agcacagttatgtttgagccattga

SEQ ID NO: 165803 - DNA, 25 bp, Mus musculus
agcacagttctgaagccagtgtctc

SEQ ID NO: 165804 - DNA, 25 bp, Mus musculus
agcacagttctgtagccagtgtctc

SEQ ID NO: 165805 - DNA, 25 bp, Mus musculus
agcacagttgctacctggaaaccaa

SEQ ID NO: 165806 - DNA, 25 bp, Mus musculus
agcacagttgcttcctggaaaccaa

SEQ ID NO: 165807 - DNA, 25 bp, Mus musculus
agcacagttggaacctcgaggtcct

SEQ ID NO: 165808 - DNA, 25 bp, Mus musculus
agcacagttggatcctcgaggtcct

SEQ ID NO: 165809 - DNA, 25 bp, Mus musculus
agcacataagctactagaaacattc

SEQ ID NO: 165810 - DNA, 25 bp, Mus musculus
agcacataagcttctagaaacattc

SEQ ID NO: 165811 - DNA, 25 bp, Mus musculus
agcacataccctcttttgttctcta

SEQ ID NO: 165812 - DNA, 25 bp, Mus musculus
agcacataccctgttttgttctcta

SEQ ID NO: 165813 - DNA, 25 bp, Mus musculus
agcacatatctgaaacgtcagccct

SEQ ID NO: 165814 - DNA, 25 bp, Mus musculus
agcacatatctgtaacgtcagccct

SEQ ID NO: 165815 - DNA, 25 bp, Mus musculus
agcacatcaaatcaaaggcactcat

SEQ ID NO: 165816 - DNA, 25 bp, Mus musculus
agcacatcaaatgaaaggcactcat

SEQ ID NO: 165817 - DNA, 25 bp, Mus musculus
agcacatcaagcactcaaagagcag

SEQ ID NO: 165818 - DNA, 25 bp, Mus musculus
agcacatcaagctctcaaagagcag

SEQ ID NO: 165819 - DNA, 25 bp, Mus musculus
agcacatcattaatgggctcctggc

SEQ ID NO: 165820 - DNA, 25 bp, Mus musculus
agcacatcattacccctttgtgtgt

SEQ ID NO: 165821 - DNA, 25 bp, Mus musculus
agcacatcattagccctttgtgtgt

SEQ ID NO: 165822 - DNA, 25 bp, Mus musculus
agcacatcattattgggctcctggc

SEQ ID NO: 165823 - DNA, 25 bp, Mus musculus
agcacatcattcatttggtggctta

SEQ ID NO: 165824 - DNA, 25 bp, Mus musculus
agcacatcattcttttggtggctta

SEQ ID NO: 165825 - DNA, 25 bp, Mus musculus
agcacatcccagcagtggtaattcg

SEQ ID NO: 165826 - DNA, 25 bp, Mus musculus
agcacatcccaggagtggtaattcg

SEQ ID NO: 165827 - DNA, 25 bp, Mus musculus
agcacatccggaaggtccaccctga

SEQ ID NO: 165828 - DNA, 25 bp, Mus musculus
agcacatccggatggtccaccctga

SEQ ID NO: 165829 - DNA, 25 bp, Mus musculus
agcacatccgggacatgcatgaccc

SEQ ID NO: 165830 - DNA, 25 bp, Mus musculus
agcacatccgggtcatgcatgaccc

SEQ ID NO: 165831 - DNA, 25 bp, Mus musculus
agcacatcctctcattgttcgtggg

SEQ ID NO: 165832 - DNA, 25 bp, Mus musculus
agcacatcctctgattgttcgtggg

SEQ ID NO: 165833 - DNA, 25 bp, Mus musculus
agcacatcgctcacaagacggaaga

SEQ ID NO: 165834 - DNA, 25 bp, Mus musculus
agcacatcgctcagtagccaaacta

SEQ ID NO: 165835 - DNA, 25 bp, Mus musculus
agcacatcgctctcaagacggaaga

SEQ ID NO: 165836 - DNA, 25 bp, Mus musculus
agcacatcgctctgtagccaaacta

SEQ ID NO: 165837 - DNA, 25 bp, Mus musculus
agcacatcggccctgttagctgaca

SEQ ID NO: 165838 - DNA, 25 bp, Mus musculus
agcacatcggccgtgttagctgaca

SEQ ID NO: 165839 - DNA, 25 bp, Mus musculus
agcacatcggctcagcatcggctgt

SEQ ID NO: 165840 - DNA, 25 bp, Mus musculus
agcacatcggctgagcatcggctgt

SEQ ID NO: 165841 - DNA, 25 bp, Mus musculus
agcacatctccgatggcacactgga

SEQ ID NO: 165842 - DNA, 25 bp, Mus musculus
agcacatctccgttggcacactgga

SEQ ID NO: 165843 - DNA, 25 bp, Mus musculus
agcacatctgcaagcctaaagcatg

SEQ ID NO: 165844 - DNA, 25 bp, Mus musculus
agcacatctgcatgcctaaagcatg

SEQ ID NO: 165845 - DNA, 25 bp, Mus musculus
agcacatctgggaatcagactccaa

SEQ ID NO: 165846 - DNA, 25 bp, Mus musculus
agcacatctgggtatcagactccaa

SEQ ID NO: 165847 - DNA, 25 bp, Mus musculus
agcacatctgtgactccaggaactg

SEQ ID NO: 165848 - DNA, 25 bp, Mus musculus
agcacatctgtgtctccaggaactg

SEQ ID NO: 165849 - DNA, 25 bp, Mus musculus
agcacatcttgcaactggctttaga

SEQ ID NO: 165850 - DNA, 25 bp, Mus musculus
agcacatcttgctactggctttaga

SEQ ID NO: 165851 - DNA, 25 bp, Mus musculus
agcacatctttacccagttactaat

SEQ ID NO: 165852 - DNA, 25 bp, Mus musculus
agcacatctttagccagttactaat

SEQ ID NO: 165853 - DNA, 25 bp, Mus musculus
agcacatgaagactccagggcacca

SEQ ID NO: 165854 - DNA, 25 bp, Mus musculus
agcacatgaagagtccagggcacca

SEQ ID NO: 165855 - DNA, 25 bp, Mus musculus
agcacatgacataaaaaagattctc

SEQ ID NO: 165856 - DNA, 25 bp, Mus musculus
agcacatgacattaaaaagattctc

SEQ ID NO: 165857 - DNA, 25 bp, Mus musculus
agcacatgacctatcctttttattt

SEQ ID NO: 165858 - DNA, 25 bp, Mus musculus
agcacatgacctttcctttttattt

SEQ ID NO: 165859 - DNA, 25 bp, Mus musculus
agcacatgatgcaagggtctacagc

SEQ ID NO: 165860 - DNA, 25 bp, Mus musculus
agcacatgatgctagggtctacagc

SEQ ID NO: 165861 - DNA, 25 bp, Mus musculus
agcacatgatgtcgatctcaccctg

SEQ ID NO: 165862 - DNA, 25 bp, Mus musculus
agcacatgatgtggatctcaccctg

SEQ ID NO: 165863 - DNA, 25 bp, Mus musculus
agcacatgcaaaaaactgccatttt

SEQ ID NO: 165864 - DNA, 25 bp, Mus musculus
agcacatgcaaaaatctaactctgt

SEQ ID NO: 165865 - DNA, 25 bp, Mus musculus
agcacatgcaaataactgccatttt

SEQ ID NO: 165866 - DNA, 25 bp, Mus musculus
agcacatgcaaatatctaactctgt

SEQ ID NO: 165867 - DNA, 25 bp, Mus musculus
agcacatgcactctagcctatatcc

SEQ ID NO: 165868 - DNA, 25 bp, Mus musculus
agcacatgcactgtagcctatatcc

SEQ ID NO: 165869 - DNA, 25 bp, Mus musculus
agcacatgccaacctgtcagggctg

SEQ ID NO: 165870 - DNA, 25 bp, Mus musculus
agcacatgccaactttcaggaggat

SEQ ID NO: 165871 - DNA, 25 bp, Mus musculus
agcacatgccaagctgtcagggctg

SEQ ID NO: 165872 - DNA, 25 bp, Mus musculus
agcacatgccaagtttcaggaggat

SEQ ID NO: 165873 - DNA, 25 bp, Mus musculus
agcacatgctctctgctccaggaac

SEQ ID NO: 165874 - DNA, 25 bp, Mus musculus
agcacatgctctgtgctccaggaac

SEQ ID NO: 165875 - DNA, 25 bp, Mus musculus
agcacatgctggatcctgggctctg

SEQ ID NO: 165876 - DNA, 25 bp, Mus musculus
agcacatgctggttcctgggctctg

SEQ ID NO: 165877 - DNA, 25 bp, Mus musculus
agcacatgctttacctcaggctgga

SEQ ID NO: 165878 - DNA, 25 bp, Mus musculus
agcacatgcttttcctcaggctgga

SEQ ID NO: 165879 - DNA, 25 bp, Mus musculus
agcacatggacgcacggacacgatc

SEQ ID NO: 165880 - DNA, 25 bp, Mus musculus
agcacatggacggacggacacgatc

SEQ ID NO: 165881 - DNA, 25 bp, Mus musculus
agcacatggaggcttttcatgcccc

SEQ ID NO: 165882 - DNA, 25 bp, Mus musculus
agcacatggagggttttcatgcccc

SEQ ID NO: 165883 - DNA, 25 bp, Mus musculus
agcacatggagtctcatggcaccca

SEQ ID NO: 165884 - DNA, 25 bp, Mus musculus
agcacatggagtgtcatggcaccca

SEQ ID NO: 165885 - DNA, 25 bp, Mus musculus
agcacatggcaactggagtcagctc

SEQ ID NO: 165886 - DNA, 25 bp, Mus musculus
agcacatggcaagtggagtcagctc

SEQ ID NO: 165887 - DNA, 25 bp, Mus musculus
agcacatgggatattgggtctttgt

SEQ ID NO: 165888 - DNA, 25 bp, Mus musculus
agcacatgggattttgggtctttgt

SEQ ID NO: 165889 - DNA, 25 bp, Mus musculus
agcacatggtttcactttcctgcat

SEQ ID NO: 165890 - DNA, 25 bp, Mus musculus
agcacatggtttgactttcctgcat

SEQ ID NO: 165891 - DNA, 25 bp, Mus musculus
agcacatgtgagaccttggatttaa

SEQ ID NO: 165892 - DNA, 25 bp, Mus musculus
agcacatgtgagtccttggatttaa

SEQ ID NO: 165893 - DNA, 25 bp, Mus musculus
agcacatgtgatcacttccccaggg

SEQ ID NO: 165894 - DNA, 25 bp, Mus musculus
agcacatgtgatgacttccccaggg

SEQ ID NO: 165895 - DNA, 25 bp, Mus musculus
agcacatgttctagggactgaggca

SEQ ID NO: 165896 - DNA, 25 bp, Mus musculus
agcacatgttcttgggactgaggca

SEQ ID NO: 165897 - DNA, 25 bp, Mus musculus
agcacattaagcactctaagagccg

SEQ ID NO: 165898 - DNA, 25 bp, Mus musculus
agcacattaagctctctaagagccg

SEQ ID NO: 165899 - DNA, 25 bp, Mus musculus
agcacattaatgagtcaccctccta

SEQ ID NO: 165900 - DNA, 25 bp, Mus musculus
agcacattaatgtgtcaccctccta

SEQ ID NO: 165901 - DNA, 25 bp, Mus musculus
agcacattacccacgaatctacaat

SEQ ID NO: 165902 - DNA, 25 bp, Mus musculus
agcacattaccctcgaatctacaat

SEQ ID NO: 165903 - DNA, 25 bp, Mus musculus
agcacattagcactgacacacttta

SEQ ID NO: 165904 - DNA, 25 bp, Mus musculus
agcacattagcagtgacacacttta

SEQ ID NO: 165905 - DNA, 25 bp, Mus musculus
agcacattatcaattcagagaggtt

SEQ ID NO: 165906 - DNA, 25 bp, Mus musculus
agcacattatcatttcagagaggtt

SEQ ID NO: 165907 - DNA, 25 bp, Mus musculus
agcacattcagaagccaggagctgg

SEQ ID NO: 165908 - DNA, 25 bp, Mus musculus
agcacattcagatgccaggagctgg

SEQ ID NO: 165909 - DNA, 25 bp, Mus musculus
agcacattccaacctgagataaaat

SEQ ID NO: 165910 - DNA, 25 bp, Mus musculus
agcacattccaagctgagataaaat

SEQ ID NO: 165911 - DNA, 25 bp, Mus musculus
agcacattccatacccacttaattt

SEQ ID NO: 165912 - DNA, 25 bp, Mus musculus
agcacattccattcccacttaattt

SEQ ID NO: 165913 - DNA, 25 bp, Mus musculus
agcacattcggcctcaggttggcaa

SEQ ID NO: 165914 - DNA, 25 bp, Mus musculus
agcacattcggcgtcaggttggcaa

SEQ ID NO: 165915 - DNA, 25 bp, Mus musculus
agcacattctctcgctgctggcaca

SEQ ID NO: 165916 - DNA, 25 bp, Mus musculus
agcacattctctggctgctggcaca

SEQ ID NO: 165917 - DNA, 25 bp, Mus musculus
agcacatttgctacctcttgaaact

SEQ ID NO: 165918 - DNA, 25 bp, Mus musculus
agcacatttgcttcctcttgaaact

SEQ ID NO: 165919 - DNA, 25 bp, Mus musculus
agcacattttgtacctttatatctg

SEQ ID NO: 165920 - DNA, 25 bp, Mus musculus
agcacattttgttcctttatatctg

SEQ ID NO: 165921 - DNA, 25 bp, Mus musculus
agcaccaaactcaacaccaattgtg

SEQ ID NO: 165922 - DNA, 25 bp, Mus musculus
agcaccaaactctacaccaattgtg

SEQ ID NO: 165923 - DNA, 25 bp, Mus musculus
agcaccaaagatccctcaggtttta

SEQ ID NO: 165924 - DNA, 25 bp, Mus musculus
agcaccaaagatgcctcaggtttta

SEQ ID NO: 165925 - DNA, 25 bp, Mus musculus
agcaccaaatgcacaactcctaatt

SEQ ID NO: 165926 - DNA, 25 bp, Mus musculus
agcaccaaatgctcaactcctaatt

SEQ ID NO: 165927 - DNA, 25 bp, Mus musculus
agcaccaaatggctatggcagcagc

SEQ ID NO: 165928 - DNA, 25 bp, Mus musculus
agcaccaaatgggtatggcagcagc

SEQ ID NO: 165929 - DNA, 25 bp, Mus musculus
agcaccaacagtcagctgggttcca

SEQ ID NO: 165930 - DNA, 25 bp, Mus musculus
agcaccaacagtgagctgggttcca

SEQ ID NO: 165931 - DNA, 25 bp, Mus musculus
agcaccaacgaacactgtcacatta

SEQ ID NO: 165932 - DNA, 25 bp, Mus musculus
agcaccaacgaagactgtcacatta

SEQ ID NO: 165933 - DNA, 25 bp, Mus musculus
agcaccaagggcatctgagatcctg

SEQ ID NO: 165934 - DNA, 25 bp, Mus musculus
agcaccaagggcttctgagatcctg

SEQ ID NO: 165935 - DNA, 25 bp, Mus musculus
agcaccaaggtacactctgagcaca

SEQ ID NO: 165936 - DNA, 25 bp, Mus musculus
agcaccaaggtagactctgagcaca

SEQ ID NO: 165937 - DNA, 25 bp, Mus musculus
agcaccaatgctactagttaacagg

SEQ ID NO: 165938 - DNA, 25 bp, Mus musculus
agcaccaatgcttctagttaacagg

SEQ ID NO: 165939 - DNA, 25 bp, Mus musculus
agcaccaatggtctttttgcactca

SEQ ID NO: 165940 - DNA, 25 bp, Mus musculus
agcaccaatggtgtttttgcactca

SEQ ID NO: 165941 - DNA, 25 bp, Mus musculus
agcaccaatgtgctcatgctctact

SEQ ID NO: 165942 - DNA, 25 bp, Mus musculus
agcaccaatgtggtcatgctctact

SEQ ID NO: 165943 - DNA, 25 bp, Mus musculus
agcaccaattggataagcctgattt

SEQ ID NO: 165944 - DNA, 25 bp, Mus musculus
agcaccaattggttaagcctgattt

SEQ ID NO: 165945 - DNA, 25 bp, Mus musculus
agcaccacaaggcagcttacaactg

SEQ ID NO: 165946 - DNA, 25 bp, Mus musculus
agcaccacaagggagcttacaactg

SEQ ID NO: 165947 - DNA, 25 bp, Mus musculus
agcaccacacaacctttgcacattt

SEQ ID NO: 165948 - DNA, 25 bp, Mus musculus
agcaccacacaagctttgcacattt

SEQ ID NO: 165949 - DNA, 25 bp, Mus musculus
agcaccacactgactctgtcatttc

SEQ ID NO: 165950 - DNA, 25 bp, Mus musculus
agcaccacactgtctctgtcatttc

SEQ ID NO: 165951 - DNA, 25 bp, Mus musculus
agcaccacagcgaacgtgtatgacc

SEQ ID NO: 165952 - DNA, 25 bp, Mus musculus
agcaccacagcgtacgtgtatgacc

SEQ ID NO: 165953 - DNA, 25 bp, Mus musculus
agcaccacagtcagccttcaataat

SEQ ID NO: 165954 - DNA, 25 bp, Mus musculus
agcaccacagtctgccttcaataat

SEQ ID NO: 165955 - DNA, 25 bp, Mus musculus
agcaccaccacactgttgagatgga

SEQ ID NO: 165956 - DNA, 25 bp, Mus musculus
agcaccaccacagtgttgagatgga

SEQ ID NO: 165957 - DNA, 25 bp, Mus musculus
agcaccaccatcagaccgtgaagaa

SEQ ID NO: 165958 - DNA, 25 bp, Mus musculus
agcaccaccatctgaccgtgaagaa

SEQ ID NO: 165959 - DNA, 25 bp, Mus musculus
agcaccacctgaactacagttggaa

SEQ ID NO: 165960 - DNA, 25 bp, Mus musculus
agcaccacctgatctacagttggaa

SEQ ID NO: 165961 - DNA, 25 bp, Mus musculus
agcaccacgcacagcaaggtgggct

SEQ ID NO: 165962 - DNA, 25 bp, Mus musculus
agcaccacgcactgcaaggtgggct

SEQ ID NO: 165963 - DNA, 25 bp, Mus musculus
agcaccacggtcattacttgccaaa

SEQ ID NO: 165964 - DNA, 25 bp, Mus musculus
agcaccacggtctttacttgccaaa

SEQ ID NO: 165965 - DNA, 25 bp, Mus musculus
agcaccacgtatcctgggtatggaa

SEQ ID NO: 165966 - DNA, 25 bp, Mus musculus
agcaccacgtatgctgggtatggaa

SEQ ID NO: 165967 - DNA, 25 bp, Mus musculus
agcaccacgtggagaaatgccccag

SEQ ID NO: 165968 - DNA, 25 bp, Mus musculus
agcaccacgtggatatactccagtt

SEQ ID NO: 165969 - DNA, 25 bp, Mus musculus
agcaccacgtggtgaaatgccccag

SEQ ID NO: 165970 - DNA, 25 bp, Mus musculus
agcaccacgtggttatactccagtt

SEQ ID NO: 165971 - DNA, 25 bp, Mus musculus
agcaccactccacaggctaagaggt

SEQ ID NO: 165972 - DNA, 25 bp, Mus musculus
agcaccactccagaggctaagaggt

SEQ ID NO: 165973 - DNA, 25 bp, Mus musculus
agcaccactgacactttagtcaggg

SEQ ID NO: 165974 - DNA, 25 bp, Mus musculus
agcaccactgactctttagtcaggg

SEQ ID NO: 165975 - DNA, 25 bp, Mus musculus
agcaccactggcacatctttgaggg

SEQ ID NO: 165976 - DNA, 25 bp, Mus musculus
agcaccactggctcatctttgaggg

SEQ ID NO: 165977 - DNA, 25 bp, Mus musculus
agcaccagaatgcattccagcttct

SEQ ID NO: 165978 - DNA, 25 bp, Mus musculus
agcaccagaatggattccagcttct

SEQ ID NO: 165979 - DNA, 25 bp, Mus musculus
agcaccagcaccaacttcagaaaca

SEQ ID NO: 165980 - DNA, 25 bp, Mus musculus
agcaccagcacctacttcagaaaca

SEQ ID NO: 165981 - DNA, 25 bp, Mus musculus
agcaccagcaggctttgggatcccc

SEQ ID NO: 165982 - DNA, 25 bp, Mus musculus
agcaccagcagggtttgggatcccc

SEQ ID NO: 165983 - DNA, 25 bp, Mus musculus
agcaccagctgacggcaaagccaac

SEQ ID NO: 165984 - DNA, 25 bp, Mus musculus
agcaccagctgagggcaaagccaac

SEQ ID NO: 165985 - DNA, 25 bp, Mus musculus
agcaccagctgcactaaaggcaaat

SEQ ID NO: 165986 - DNA, 25 bp, Mus musculus
agcaccagctgcatttctgaggact

SEQ ID NO: 165987 - DNA, 25 bp, Mus musculus
agcaccagctgctctaaaggcaaat

SEQ ID NO: 165988 - DNA, 25 bp, Mus musculus
agcaccagctgcttttctgaggact

SEQ ID NO: 165989 - DNA, 25 bp, Mus musculus
agcaccaggaccactaagtccaatg

SEQ ID NO: 165990 - DNA, 25 bp, Mus musculus
agcaccaggacctctaagtccaatg

SEQ ID NO: 165991 - DNA, 25 bp, Mus musculus
agcaccagggaaatagctccgacca

SEQ ID NO: 165992 - DNA, 25 bp, Mus musculus
agcaccagggaattagctccgacca

SEQ ID NO: 165993 - DNA, 25 bp, Mus musculus
agcaccagggtcatgtcacatatga

SEQ ID NO: 165994 - DNA, 25 bp, Mus musculus
agcaccagggtcttgtcacatatga

SEQ ID NO: 165995 - DNA, 25 bp, Mus musculus
agcaccaggtacaaagacagcccca

SEQ ID NO: 165996 - DNA, 25 bp, Mus musculus
agcaccaggtactaagacagcccca

SEQ ID NO: 165997 - DNA, 25 bp, Mus musculus
agcaccaggtggacgtttggaagct

SEQ ID NO: 165998 - DNA, 25 bp, Mus musculus
agcaccaggtggtcgtttggaagct

SEQ ID NO: 165999 - DNA, 25 bp, Mus musculus
agcaccagtccacttgcagctacta

SEQ ID NO: 166000 - DNA, 25 bp, Mus musculus
agcaccagtccagttgcagctacta

SEQ ID NO: 166001 - DNA, 25 bp, Mus musculus
agcaccagtcgccatgtctgcgggt

SEQ ID NO: 166002 - DNA, 25 bp, Mus musculus
agcaccagtcgcgatgtctgcgggt

SEQ ID NO: 166003 - DNA, 25 bp, Mus musculus
agcaccagtgagatcaacttgcagc

SEQ ID NO: 166004 - DNA, 25 bp, Mus musculus
agcaccagtgagttcaacttgcagc

SEQ ID NO: 166005 - DNA, 25 bp, Mus musculus
agcaccagtgctaccaatgaaacat

SEQ ID NO: 166006 - DNA, 25 bp, Mus musculus
agcaccagtgcttccaatgaaacat

SEQ ID NO: 166007 - DNA, 25 bp, Mus musculus
agcaccagtggtcctatagtaatcc

SEQ ID NO: 166008 - DNA, 25 bp, Mus musculus
agcaccagtggtgctatagtaatcc

SEQ ID NO: 166009 - DNA, 25 bp, Mus musculus
agcaccatactcactaaggcagtgc

SEQ ID NO: 166010 - DNA, 25 bp, Mus musculus
agcaccatactctctaaggcagtgc

SEQ ID NO: 166011 - DNA, 25 bp, Mus musculus
agcaccatcagaagtgggctctctc

SEQ ID NO: 166012 - DNA, 25 bp, Mus musculus
agcaccatcagatgtgggctctctc

SEQ ID NO: 166013 - DNA, 25 bp, Mus musculus
agcaccatcagcacaaaattctttg

SEQ ID NO: 166014 - DNA, 25 bp, Mus musculus
agcaccatcagctcaaaattctttg

SEQ ID NO: 166015 - DNA, 25 bp, Mus musculus
agcaccatcatccataattttgtct

SEQ ID NO: 166016 - DNA, 25 bp, Mus musculus
agcaccatcatcgataattttgtct

SEQ ID NO: 166017 - DNA, 25 bp, Mus musculus
agcaccatccgacatgtgtctctga

SEQ ID NO: 166018 - DNA, 25 bp, Mus musculus
agcaccatccgagatgtgtctctga

SEQ ID NO: 166019 - DNA, 25 bp, Mus musculus
agcaccatccggaagtttttagtga

SEQ ID NO: 166020 - DNA, 25 bp, Mus musculus
agcaccatccggtagtttttagtga

SEQ ID NO: 166021 - DNA, 25 bp, Mus musculus
agcaccatctagcaaaggacttttt

SEQ ID NO: 166022 - DNA, 25 bp, Mus musculus
agcaccatctaggaaaggacttttt

SEQ ID NO: 166023 - DNA, 25 bp, Mus musculus
agcaccatctgtaaagagtacccca

SEQ ID NO: 166024 - DNA, 25 bp, Mus musculus
agcaccatctgttaagagtacccca

SEQ ID NO: 166025 - DNA, 25 bp, Mus musculus
agcaccatgcagagaatccttacca

SEQ ID NO: 166026 - DNA, 25 bp, Mus musculus
agcaccatgcagtgaatccttacca

SEQ ID NO: 166027 - DNA, 25 bp, Mus musculus
agcaccatgcatatggacctcatct

SEQ ID NO: 166028 - DNA, 25 bp, Mus musculus
agcaccatgcatttggacctcatct

SEQ ID NO: 166029 - DNA, 25 bp, Mus musculus
agcaccatgcctcgaacagtaacgt

SEQ ID NO: 166030 - DNA, 25 bp, Mus musculus
agcaccatgcctggaacagtaacgt

SEQ ID NO: 166031 - DNA, 25 bp, Mus musculus
agcaccatggacagcatcccgggac

SEQ ID NO: 166032 - DNA, 25 bp, Mus musculus
agcaccatggactgcatcccgggac

SEQ ID NO: 166033 - DNA, 25 bp, Mus musculus
agcaccatggccagataccgatgct

SEQ ID NO: 166034 - DNA, 25 bp, Mus musculus
agcaccatggcctgataccgatgct

SEQ ID NO: 166035 - DNA, 25 bp, Mus musculus
agcaccatggtcattgtcttttcta

SEQ ID NO: 166036 - DNA, 25 bp, Mus musculus
agcaccatggtctttgtcttttcta

SEQ ID NO: 166037 - DNA, 25 bp, Mus musculus
agcaccatggtgacccgtcactgtg

SEQ ID NO: 166038 - DNA, 25 bp, Mus musculus
agcaccatggtgtcccgtcactgtg

SEQ ID NO: 166039 - DNA, 25 bp, Mus musculus
agcaccattcagaaatacagcctta

SEQ ID NO: 166040 - DNA, 25 bp, Mus musculus
agcaccattcagtaatacagcctta

SEQ ID NO: 166041 - DNA, 25 bp, Mus musculus
agcaccattcatccgtctagcatgt

SEQ ID NO: 166042 - DNA, 25 bp, Mus musculus
agcaccattcatgcgtctagcatgt

SEQ ID NO: 166043 - DNA, 25 bp, Mus musculus
agcaccattcctcgtcatgcaaaac

SEQ ID NO: 166044 - DNA, 25 bp, Mus musculus
agcaccattcctggtcatgcaaaac

SEQ ID NO: 166045 - DNA, 25 bp, Mus musculus
agcaccatttccaaaggtccagcgt

SEQ ID NO: 166046 - DNA, 25 bp, Mus musculus
agcaccatttcctaaggtccagcgt

SEQ ID NO: 166047 - DNA, 25 bp, Mus musculus
agcaccattttaattgatctttgat

SEQ ID NO: 166048 - DNA, 25 bp, Mus musculus
agcaccattttatttgatctttgat

SEQ ID NO: 166049 - DNA, 25 bp, Mus musculus
agcaccattttgaccttccagatac

SEQ ID NO: 166050 - DNA, 25 bp, Mus musculus
agcaccattttgtccttccagatac

SEQ ID NO: 166051 - DNA, 25 bp, Mus musculus
agcaccatttttcatggaggaccca

SEQ ID NO: 166052 - DNA, 25 bp, Mus musculus
agcaccatttttgatggaggaccca

SEQ ID NO: 166053 - DNA, 25 bp, Mus musculus
agcacccaaagactcagtagtgaca

SEQ ID NO: 166054 - DNA, 25 bp, Mus musculus
agcacccaaagagtcagtagtgaca

SEQ ID NO: 166055 - DNA, 25 bp, Mus musculus
agcacccaatacagacacaggcagc

SEQ ID NO: 166056 - DNA, 25 bp, Mus musculus
agcacccaatactgacacaggcagc

SEQ ID NO: 166057 - DNA, 25 bp, Mus musculus
agcacccacagaaggcatcggagga

SEQ ID NO: 166058 - DNA, 25 bp, Mus musculus
agcacccacagatggcatcggagga

SEQ ID NO: 166059 - DNA, 25 bp, Mus musculus
agcacccaccaccaatagaaaacaa

SEQ ID NO: 166060 - DNA, 25 bp, Mus musculus
agcacccaccacgaatagaaaacaa

SEQ ID NO: 166061 - DNA, 25 bp, Mus musculus
agcacccactgaaacaggcaagcag

SEQ ID NO: 166062 - DNA, 25 bp, Mus musculus
agcacccactgatacaggcaagcag

SEQ ID NO: 166063 - DNA, 25 bp, Mus musculus
agcacccacttccttaatgtcattt

SEQ ID NO: 166064 - DNA, 25 bp, Mus musculus
agcacccacttcgttaatgtcattt

SEQ ID NO: 166065 - DNA, 25 bp, Mus musculus
agcacccacttgatggctgtgaacc

SEQ ID NO: 166066 - DNA, 25 bp, Mus musculus
agcacccacttgttggctgtgaacc

SEQ ID NO: 166067 - DNA, 25 bp, Mus musculus
agcacccactttctgaggtagctct

SEQ ID NO: 166068 - DNA, 25 bp, Mus musculus
agcacccactttgtgaggtagctct

SEQ ID NO: 166069 - DNA, 25 bp, Mus musculus
agcacccagaccagatgatggcagt

SEQ ID NO: 166070 - DNA, 25 bp, Mus musculus
agcacccagacctgatgatggcagt

SEQ ID NO: 166071 - DNA, 25 bp, Mus musculus
agcacccagatccagcctgtgtgat

SEQ ID NO: 166072 - DNA, 25 bp, Mus musculus
agcacccagatcgagcctgtgtgat

SEQ ID NO: 166073 - DNA, 25 bp, Mus musculus
agcacccaggagctactggcacaga

SEQ ID NO: 166074 - DNA, 25 bp, Mus musculus
agcacccaggaggtactggcacaga

SEQ ID NO: 166075 - DNA, 25 bp, Mus musculus
agcacccagtatatctatgacagac

SEQ ID NO: 166076 - DNA, 25 bp, Mus musculus
agcacccagtatccatggatgctga

SEQ ID NO: 166077 - DNA, 25 bp, Mus musculus
agcacccagtatgcatggatgctga

SEQ ID NO: 166078 - DNA, 25 bp, Mus musculus
agcacccagtatttctatgacagac

SEQ ID NO: 166079 - DNA, 25 bp, Mus musculus
agcacccagtcacccataattttta

SEQ ID NO: 166080 - DNA, 25 bp, Mus musculus
agcacccagtcagccataattttta

SEQ ID NO: 166081 - DNA, 25 bp, Mus musculus
agcacccagttacaacagcctctgt

SEQ ID NO: 166082 - DNA, 25 bp, Mus musculus
agcacccagttagaacagcctctgt

SEQ ID NO: 166083 - DNA, 25 bp, Mus musculus
agcacccatacaacaacgtctggta

SEQ ID NO: 166084 - DNA, 25 bp, Mus musculus
agcacccatacatcaacgtctggta

SEQ ID NO: 166085 - DNA, 25 bp, Mus musculus
agcacccatgagcaattatttagat

SEQ ID NO: 166086 - DNA, 25 bp, Mus musculus
agcacccatgaggaattatttagat

SEQ ID NO: 166087 - DNA, 25 bp, Mus musculus
agcacccatgccaaaagcagctggt

SEQ ID NO: 166088 - DNA, 25 bp, Mus musculus
agcacccatgcctaaagcagctggt

SEQ ID NO: 166089 - DNA, 25 bp, Mus musculus
agcacccatgtcagatgatccccaa

SEQ ID NO: 166090 - DNA, 25 bp, Mus musculus
agcacccatgtctgatgatccccaa

SEQ ID NO: 166091 - DNA, 25 bp, Mus musculus
agcacccatgtgctcagggtaatgt

SEQ ID NO: 166092 - DNA, 25 bp, Mus musculus
agcacccatgtggtcagggtaatgt

SEQ ID NO: 166093 - DNA, 25 bp, Mus musculus
agcacccattagaagctagctcaca

SEQ ID NO: 166094 - DNA, 25 bp, Mus musculus
agcacccattagtagctagctcaca

SEQ ID NO: 166095 - DNA, 25 bp, Mus musculus
agcacccattgcagagccttattat

SEQ ID NO: 166096 - DNA, 25 bp, Mus musculus
agcacccattgctgagccttattat

SEQ ID NO: 166097 - DNA, 25 bp, Mus musculus
agcacccatttgaacactctagttt

SEQ ID NO: 166098 - DNA, 25 bp, Mus musculus
agcacccatttgtacactctagttt

SEQ ID NO: 166099 - DNA, 25 bp, Mus musculus
agcaccccaaagaaggacctcattc

SEQ ID NO: 166100 - DNA, 25 bp, Mus musculus
agcaccccaaagtaggacctcattc

SEQ ID NO: 166101 - DNA, 25 bp, Mus musculus
agcaccccaacaaggtagcactgtt

SEQ ID NO: 166102 - DNA, 25 bp, Mus musculus
agcaccccaacatggtagcactgtt

SEQ ID NO: 166103 - DNA, 25 bp, Mus musculus
agcaccccagtcaatagttcaagtt

SEQ ID NO: 166104 - DNA, 25 bp, Mus musculus
agcaccccagtctatagttcaagtt

SEQ ID NO: 166105 - DNA, 25 bp, Mus musculus
agcaccccggcacaaaatccaagaa

SEQ ID NO: 166106 - DNA, 25 bp, Mus musculus
agcaccccggcagaaaatccaagaa

SEQ ID NO: 166107 - DNA, 25 bp, Mus musculus
agcacccctcatcgatgccctgaaa

SEQ ID NO: 166108 - DNA, 25 bp, Mus musculus
agcacccctcatggatgccctgaaa

SEQ ID NO: 166109 - DNA, 25 bp, Mus musculus
agcacccctgcacatagtcagagca

SEQ ID NO: 166110 - DNA, 25 bp, Mus musculus
agcacccctgcagatagtcagagca

SEQ ID NO: 166111 - DNA, 25 bp, Mus musculus
agcacccctggaatttacatgttct

SEQ ID NO: 166112 - DNA, 25 bp, Mus musculus
agcacccctggattttacatgttct

SEQ ID NO: 166113 - DNA, 25 bp, Mus musculus
agcacccctgtacatcatcaaactg

SEQ ID NO: 166114 - DNA, 25 bp, Mus musculus
agcacccctgtagatcatcaaactg

SEQ ID NO: 166115 - DNA, 25 bp, Mus musculus
agcaccccttagacataccttatga

SEQ ID NO: 166116 - DNA, 25 bp, Mus musculus
agcaccccttagtcataccttatga

SEQ ID NO: 166117 - DNA, 25 bp, Mus musculus
agcacccgaagactgtactgtatga

SEQ ID NO: 166118 - DNA, 25 bp, Mus musculus
agcacccgaagagtgtactgtatga

SEQ ID NO: 166119 - DNA, 25 bp, Mus musculus
agcacccgaatcactcgaagtcaac

SEQ ID NO: 166120 - DNA, 25 bp, Mus musculus
agcacccgaatctctcgaagtcaac

SEQ ID NO: 166121 - DNA, 25 bp, Mus musculus
agcacccgcacacgttgatgtggaa

SEQ ID NO: 166122 - DNA, 25 bp, Mus musculus
agcacccgcacaggttgatgtggaa

SEQ ID NO: 166123 - DNA, 25 bp, Mus musculus
agcacccgcactcgaaaatactgtt

SEQ ID NO: 166124 - DNA, 25 bp, Mus musculus
agcacccgcactggaaaatactgtt

SEQ ID NO: 166125 - DNA, 25 bp, Mus musculus
agcacccggctgctagtgatgcaga

SEQ ID NO: 166126 - DNA, 25 bp, Mus musculus
agcacccggctggtagtgatgcaga

SEQ ID NO: 166127 - DNA, 25 bp, Mus musculus
agcacccgggatcccaggcagtatg

SEQ ID NO: 166128 - DNA, 25 bp, Mus musculus
agcacccgggatgccaggcagtatg

SEQ ID NO: 166129 - DNA, 25 bp, Mus musculus
agcacccgggtacgcctagaagata

SEQ ID NO: 166130 - DNA, 25 bp, Mus musculus
agcacccgggtaggcctagaagata

SEQ ID NO: 166131 - DNA, 25 bp, Mus musculus
agcacccgtactatgatgacttgga

SEQ ID NO: 166132 - DNA, 25 bp, Mus musculus
agcacccgtactttgatgacttgga

SEQ ID NO: 166133 - DNA, 25 bp, Mus musculus
agcaccctaatcaagtggctcatcc

SEQ ID NO: 166134 - DNA, 25 bp, Mus musculus
agcaccctaatctagtggctcatcc

SEQ ID NO: 166135 - DNA, 25 bp, Mus musculus
agcaccctacatctgcactgagtgt

SEQ ID NO: 166136 - DNA, 25 bp, Mus musculus
agcaccctacatgtgcactgagtgt

SEQ ID NO: 166137 - DNA, 25 bp, Mus musculus
agcaccctagagacccaggcctggg

SEQ ID NO: 166138 - DNA, 25 bp, Mus musculus
agcaccctagagtcccaggcctggg

SEQ ID NO: 166139 - DNA, 25 bp, Mus musculus
agcaccctagctatcttagacaatc

SEQ ID NO: 166140 - DNA, 25 bp, Mus musculus
agcaccctagctttcttagacaatc

SEQ ID NO: 166141 - DNA, 25 bp, Mus musculus
agcaccctaggtattttagcttcta

SEQ ID NO: 166142 - DNA, 25 bp, Mus musculus
agcaccctaggtctgataattgaag

SEQ ID NO: 166143 - DNA, 25 bp, Mus musculus
agcaccctaggtgtgataattgaag

SEQ ID NO: 166144 - DNA, 25 bp, Mus musculus
agcaccctaggttttttagcttcta

SEQ ID NO: 166145 - DNA, 25 bp, Mus musculus
agcaccctcatgatgctaatcttta

SEQ ID NO: 166146 - DNA, 25 bp, Mus musculus
agcaccctcatgttgctaatcttta

SEQ ID NO: 166147 - DNA, 25 bp, Mus musculus
agcaccctccaccattgtgatagtg

SEQ ID NO: 166148 - DNA, 25 bp, Mus musculus
agcaccctccacgattgtgatagtg

SEQ ID NO: 166149 - DNA, 25 bp, Mus musculus
agcaccctctctcttaaggcagcag

SEQ ID NO: 166150 - DNA, 25 bp, Mus musculus
agcaccctctctgttaaggcagcag

SEQ ID NO: 166151 - DNA, 25 bp, Mus musculus
agcaccctcttgaccacactaggtt

SEQ ID NO: 166152 - DNA, 25 bp, Mus musculus
agcaccctcttgtccacactaggtt

SEQ ID NO: 166153 - DNA, 25 bp, Mus musculus
agcaccctgattaccatcaagcaag

SEQ ID NO: 166154 - DNA, 25 bp, Mus musculus
agcaccctgatttccatcaagcaag

SEQ ID NO: 166155 - DNA, 25 bp, Mus musculus
agcaccctgcagatgtccatcctga

SEQ ID NO: 166156 - DNA, 25 bp, Mus musculus
agcaccctgcagttgtccatcctga

SEQ ID NO: 166157 - DNA, 25 bp, Mus musculus
agcaccctgcgcacggaagatggtc

SEQ ID NO: 166158 - DNA, 25 bp, Mus musculus
agcaccctgcgctcggaagatggtc

SEQ ID NO: 166159 - DNA, 25 bp, Mus musculus
agcaccctggcgctcatttaggttc

SEQ ID NO: 166160 - DNA, 25 bp, Mus musculus
agcaccctggcggtcatttaggttc

SEQ ID NO: 166161 - DNA, 25 bp, Mus musculus
agcaccctgggtatttacatgtttg

SEQ ID NO: 166162 - DNA, 25 bp, Mus musculus
agcaccctgggtttttacatgtttg

SEQ ID NO: 166163 - DNA, 25 bp, Mus musculus
agcaccctggtgcaagaagcttgga

SEQ ID NO: 166164 - DNA, 25 bp, Mus musculus
agcaccctggtggaagaagcttgga

SEQ ID NO: 166165 - DNA, 25 bp, Mus musculus
agcaccctgtatctatgtttccttt

SEQ ID NO: 166166 - DNA, 25 bp, Mus musculus
agcaccctgtatgtatgtttccttt

SEQ ID NO: 166167 - DNA, 25 bp, Mus musculus
agcaccctgtggcagatactgaaaa

SEQ ID NO: 166168 - DNA, 25 bp, Mus musculus
agcaccctgtgggagatactgaaaa

SEQ ID NO: 166169 - DNA, 25 bp, Mus musculus
agcaccctgtgtatgcacatgctgt

SEQ ID NO: 166170 - DNA, 25 bp, Mus musculus
agcaccctgtgtttgcacatgctgt

SEQ ID NO: 166171 - DNA, 25 bp, Mus musculus
agcaccctgttacatcagcggctgg

SEQ ID NO: 166172 - DNA, 25 bp, Mus musculus
agcaccctgttagatcagcggctgg

SEQ ID NO: 166173 - DNA, 25 bp, Mus musculus
agcaccctgtttctcaggacgaatg

SEQ ID NO: 166174 - DNA, 25 bp, Mus musculus
agcaccctgtttgtcaggacgaatg

SEQ ID NO: 166175 - DNA, 25 bp, Mus musculus
agcacccttactctagaactaggaa

SEQ ID NO: 166176 - DNA, 25 bp, Mus musculus
agcacccttactgtagaactaggaa

SEQ ID NO: 166177 - DNA, 25 bp, Mus musculus
agcacccttgctatattgaaacacc

SEQ ID NO: 166178 - DNA, 25 bp, Mus musculus
agcacccttgctttattgaaacacc

SEQ ID NO: 166179 - DNA, 25 bp, Mus musculus
agcaccgagtgccatcagtggtata

SEQ ID NO: 166180 - DNA, 25 bp, Mus musculus
agcaccgagtgcgatcagtggtata

SEQ ID NO: 166181 - DNA, 25 bp, Mus musculus
agcaccgattggacagcaaaagctt

SEQ ID NO: 166182 - DNA, 25 bp, Mus musculus
agcaccgattggtcagcaaaagctt

SEQ ID NO: 166183 - DNA, 25 bp, Mus musculus
agcaccgcaaatataacggcctcac

SEQ ID NO: 166184 - DNA, 25 bp, Mus musculus
agcaccgcaaatttaacggcctcac

SEQ ID NO: 166185 - DNA, 25 bp, Mus musculus
agcaccgcacacaggttctaaggct

SEQ ID NO: 166186 - DNA, 25 bp, Mus musculus
agcaccgcacactggttctaaggct

SEQ ID NO: 166187 - DNA, 25 bp, Mus musculus
agcaccgcacttctacatacaaggt

SEQ ID NO: 166188 - DNA, 25 bp, Mus musculus
agcaccgcacttgtacatacaaggt

SEQ ID NO: 166189 - DNA, 25 bp, Mus musculus
agcaccgccgtccacagatgaaatg

SEQ ID NO: 166190 - DNA, 25 bp, Mus musculus
agcaccgccgtcgacagatgaaatg

SEQ ID NO: 166191 - DNA, 25 bp, Mus musculus
agcaccgcctttcaaactgacaaag

SEQ ID NO: 166192 - DNA, 25 bp, Mus musculus
agcaccgcctttgaaactgacaaag

SEQ ID NO: 166193 - DNA, 25 bp, Mus musculus
agcaccgcgggtcgtagtagttcaa

SEQ ID NO: 166194 - DNA, 25 bp, Mus musculus
agcaccgcgggtggtagtagttcaa

SEQ ID NO: 166195 - DNA, 25 bp, Mus musculus
agcaccgcgtgcagagcataaatcg

SEQ ID NO: 166196 - DNA, 25 bp, Mus musculus
agcaccgcgtgctgagcataaatcg

SEQ ID NO: 166197 - DNA, 25 bp, Mus musculus
agcaccgctattcaggagctgttca

SEQ ID NO: 166198 - DNA, 25 bp, Mus musculus
agcaccgctattgaggagctgttca

SEQ ID NO: 166199 - DNA, 25 bp, Mus musculus
agcaccgcttcgagggacaattgtt

SEQ ID NO: 166200 - DNA, 25 bp, Mus musculus
agcaccgcttcgtgggacaattgtt

SEQ ID NO: 166201 - DNA, 25 bp, Mus musculus
agcaccggactactcttccaaacgt

SEQ ID NO: 166202 - DNA, 25 bp, Mus musculus
agcaccggactagtcttccaaacgt

SEQ ID NO: 166203 - DNA, 25 bp, Mus musculus
agcaccggactgaaggaggtacaga

SEQ ID NO: 166204 - DNA, 25 bp, Mus musculus
agcaccggactgtaggaggtacaga

SEQ ID NO: 166205 - DNA, 25 bp, Mus musculus
agcaccggaggcacaccagggaatg

SEQ ID NO: 166206 - DNA, 25 bp, Mus musculus
agcaccggaggctcaccagggaatg

SEQ ID NO: 166207 - DNA, 25 bp, Mus musculus
agcaccggccagcaatacaaataca

SEQ ID NO: 166208 - DNA, 25 bp, Mus musculus
agcaccggccaggaatacaaataca

SEQ ID NO: 166209 - DNA, 25 bp, Mus musculus
agcaccgggatcataatactgtatc

SEQ ID NO: 166210 - DNA, 25 bp, Mus musculus
agcaccgggatcttaatactgtatc

SEQ ID NO: 166211 - DNA, 25 bp, Mus musculus
agcaccgtattgatttgactctctt

SEQ ID NO: 166212 - DNA, 25 bp, Mus musculus
agcaccgtattgttttgactctctt

SEQ ID NO: 166213 - DNA, 25 bp, Mus musculus
agcaccgtccagctgatttgggcaa

SEQ ID NO: 166214 - DNA, 25 bp, Mus musculus
agcaccgtccaggtgatttgggcaa

SEQ ID NO: 166215 - DNA, 25 bp, Mus musculus
agcaccgtgaacatgaccctggagg

SEQ ID NO: 166216 - DNA, 25 bp, Mus musculus
agcaccgtgaacttgaccctggagg

SEQ ID NO: 166217 - DNA, 25 bp, Mus musculus
agcaccgtgaatactcagggctcct

SEQ ID NO: 166218 - DNA, 25 bp, Mus musculus
agcaccgtgaattctcagggctcct

SEQ ID NO: 166219 - DNA, 25 bp, Mus musculus
agcaccgtgctgagactttttgaga

SEQ ID NO: 166220 - DNA, 25 bp, Mus musculus
agcaccgtgctgtgactttttgaga

SEQ ID NO: 166221 - DNA, 25 bp, Mus musculus
agcaccgtgcttcctggaggctttg

SEQ ID NO: 166222 - DNA, 25 bp, Mus musculus
agcaccgtgcttgctggaggctttg

SEQ ID NO: 166223 - DNA, 25 bp, Mus musculus
agcaccgtggtcctgacctcagcgg

SEQ ID NO: 166224 - DNA, 25 bp, Mus musculus
agcaccgtggtcgtgacctcagcgg

SEQ ID NO: 166225 - DNA, 25 bp, Mus musculus
agcaccgttcagattcattcagatg

SEQ ID NO: 166226 - DNA, 25 bp, Mus musculus
agcaccgttcagtttcattcagatg

SEQ ID NO: 166227 - DNA, 25 bp, Mus musculus
agcacctaaagccacccttgggaga

SEQ ID NO: 166228 - DNA, 25 bp, Mus musculus
agcacctaaagcgacccttgggaga

SEQ ID NO: 166229 - DNA, 25 bp, Mus musculus
agcacctaagtactgttcaaatcat

SEQ ID NO: 166230 - DNA, 25 bp, Mus musculus
agcacctaagtagtgttcaaatcat

SEQ ID NO: 166231 - DNA, 25 bp, Mus musculus
agcacctacctgaggccagtggcac

SEQ ID NO: 166232 - DNA, 25 bp, Mus musculus
agcacctacctgtggccagtggcac

SEQ ID NO: 166233 - DNA, 25 bp, Mus musculus
agcacctacggacctcagtgattga

SEQ ID NO: 166234 - DNA, 25 bp, Mus musculus
agcacctacggagctcagtgattga

SEQ ID NO: 166235 - DNA, 25 bp, Mus musculus
agcacctacgttctttccgtatatt

SEQ ID NO: 166236 - DNA, 25 bp, Mus musculus
agcacctacgttgtttccgtatatt

SEQ ID NO: 166237 - DNA, 25 bp, Mus musculus
agcacctactatacttgaatattga

SEQ ID NO: 166238 - DNA, 25 bp, Mus musculus
agcacctactattcttgaatattga

SEQ ID NO: 166239 - DNA, 25 bp, Mus musculus
agcacctactctaaatagcttagtc

SEQ ID NO: 166240 - DNA, 25 bp, Mus musculus
agcacctactctatcttgtgtgatc

SEQ ID NO: 166241 - DNA, 25 bp, Mus musculus
agcacctactcttaatagcttagtc

SEQ ID NO: 166242 - DNA, 25 bp, Mus musculus
agcacctactctttcttgtgtgatc

SEQ ID NO: 166243 - DNA, 25 bp, Mus musculus
agcacctacttcaaggcaggcatga

SEQ ID NO: 166244 - DNA, 25 bp, Mus musculus
agcacctacttctaggcaggcatga

SEQ ID NO: 166245 - DNA, 25 bp, Mus musculus
agcacctagggtacaggtccaggct

SEQ ID NO: 166246 - DNA, 25 bp, Mus musculus
agcacctagggttcaggtccaggct

SEQ ID NO: 166247 - DNA, 25 bp, Mus musculus
agcacctatagaccgaaaccaacaa

SEQ ID NO: 166248 - DNA, 25 bp, Mus musculus
agcacctatagagcgaaaccaacaa

SEQ ID NO: 166249 - DNA, 25 bp, Mus musculus
agcacctatattccatggattctct

SEQ ID NO: 166250 - DNA, 25 bp, Mus musculus
agcacctatattgcatggattctct

SEQ ID NO: 166251 - DNA, 25 bp, Mus musculus
agcacctcaaggctctaagtttcta

SEQ ID NO: 166252 - DNA, 25 bp, Mus musculus
agcacctcaagggtctaagtttcta

SEQ ID NO: 166253 - DNA, 25 bp, Mus musculus
agcacctcagacctggcaaggcctg

SEQ ID NO: 166254 - DNA, 25 bp, Mus musculus
agcacctcagacgtggcaaggcctg

SEQ ID NO: 166255 - DNA, 25 bp, Mus musculus
agcacctcagatcatgtacttcaga

SEQ ID NO: 166256 - DNA, 25 bp, Mus musculus
agcacctcagatctccttcagtttt

SEQ ID NO: 166257 - DNA, 25 bp, Mus musculus
agcacctcagatgatgtacttcaga

SEQ ID NO: 166258 - DNA, 25 bp, Mus musculus
agcacctcagatgtccttcagtttt

SEQ ID NO: 166259 - DNA, 25 bp, Mus musculus
agcacctcaggaagtcacagatagc

SEQ ID NO: 166260 - DNA, 25 bp, Mus musculus
agcacctcaggatgtcacagatagc

SEQ ID NO: 166261 - DNA, 25 bp, Mus musculus
agcacctcataactatctggcgaat

SEQ ID NO: 166262 - DNA, 25 bp, Mus musculus
agcacctcataagtatctggcgaat

SEQ ID NO: 166263 - DNA, 25 bp, Mus musculus
agcacctcatgcaggtttgtaggcc

SEQ ID NO: 166264 - DNA, 25 bp, Mus musculus
agcacctcatgctggtttgtaggcc

SEQ ID NO: 166265 - DNA, 25 bp, Mus musculus
agcacctccaaccaaataagacttc

SEQ ID NO: 166266 - DNA, 25 bp, Mus musculus
agcacctccaacgaaataagacttc

SEQ ID NO: 166267 - DNA, 25 bp, Mus musculus
agcacctccatgaacttcaagcagt

SEQ ID NO: 166268 - DNA, 25 bp, Mus musculus
agcacctccatgtacttcaagcagt

SEQ ID NO: 166269 - DNA, 25 bp, Mus musculus
agcacctccccacatgtgtgtgcat

SEQ ID NO: 166270 - DNA, 25 bp, Mus musculus
agcacctccccagatgtgtgtgcat

SEQ ID NO: 166271 - DNA, 25 bp, Mus musculus
agcacctcccctcgaggaactgata

SEQ ID NO: 166272 - DNA, 25 bp, Mus musculus
agcacctcccctggaggaactgata

SEQ ID NO: 166273 - DNA, 25 bp, Mus musculus
agcacctccctgagtgggacagtga

SEQ ID NO: 166274 - DNA, 25 bp, Mus musculus
agcacctccctgtgtgggacagtga

SEQ ID NO: 166275 - DNA, 25 bp, Mus musculus
agcacctcctctaagcctaattcta

SEQ ID NO: 166276 - DNA, 25 bp, Mus musculus
agcacctcctcttagcctaattcta

SEQ ID NO: 166277 - DNA, 25 bp, Mus musculus
agcacctcctgccatgattagacct

SEQ ID NO: 166278 - DNA, 25 bp, Mus musculus
agcacctcctgcgatgattagacct

SEQ ID NO: 166279 - DNA, 25 bp, Mus musculus
agcacctcgaataagtctggctgag

SEQ ID NO: 166280 - DNA, 25 bp, Mus musculus
agcacctcgaattagtctggctgag

SEQ ID NO: 166281 - DNA, 25 bp, Mus musculus
agcacctcgcctactgaaagatttg

SEQ ID NO: 166282 - DNA, 25 bp, Mus musculus
agcacctcgccttctgaaagatttg

SEQ ID NO: 166283 - DNA, 25 bp, Mus musculus
agcacctcgtaacagtcgacagcag

SEQ ID NO: 166284 - DNA, 25 bp, Mus musculus
agcacctcgtaagagtcgacagcag

SEQ ID NO: 166285 - DNA, 25 bp, Mus musculus
agcacctctaagcagcagcctgtgt

SEQ ID NO: 166286 - DNA, 25 bp, Mus musculus
agcacctctaaggagcagcctgtgt

SEQ ID NO: 166287 - DNA, 25 bp, Mus musculus
agcacctctgagatgtttggcaaga

SEQ ID NO: 166288 - DNA, 25 bp, Mus musculus
agcacctctgagttgtttggcaaga

SEQ ID NO: 166289 - DNA, 25 bp, Mus musculus
agcacctgaagccttgagtgtcaca

SEQ ID NO: 166290 - DNA, 25 bp, Mus musculus
agcacctgaagcgttgagtgtcaca

SEQ ID NO: 166291 - DNA, 25 bp, Mus musculus
agcacctgaattaatctcctctgat

SEQ ID NO: 166292 - DNA, 25 bp, Mus musculus
agcacctgaatttatctcctctgat

SEQ ID NO: 166293 - DNA, 25 bp, Mus musculus
agcacctgacaaccccaatgtttat

SEQ ID NO: 166294 - DNA, 25 bp, Mus musculus
agcacctgacaagcccaatgtttat

SEQ ID NO: 166295 - DNA, 25 bp, Mus musculus
agcacctgactacagagcacattca

SEQ ID NO: 166296 - DNA, 25 bp, Mus musculus
agcacctgactagagagcacattca

SEQ ID NO: 166297 - DNA, 25 bp, Mus musculus
agcacctgagctactaacggcaaaa

SEQ ID NO: 166298 - DNA, 25 bp, Mus musculus
agcacctgagcttctaacggcaaaa

SEQ ID NO: 166299 - DNA, 25 bp, Mus musculus
agcacctgatacactcaggcctgat

SEQ ID NO: 166300 - DNA, 25 bp, Mus musculus
agcacctgatactctcaggcctgat

SEQ ID NO: 166301 - DNA, 25 bp, Mus musculus
agcacctgcatgaatcaccatcctg

SEQ ID NO: 166302 - DNA, 25 bp, Mus musculus
agcacctgcatgtatcaccatcctg

SEQ ID NO: 166303 - DNA, 25 bp, Mus musculus
agcacctgcctcatatcaacaaggg

SEQ ID NO: 166304 - DNA, 25 bp, Mus musculus
agcacctgcctcttatcaacaaggg

SEQ ID NO: 166305 - DNA, 25 bp, Mus musculus
agcacctgcgatacctcatccattt

SEQ ID NO: 166306 - DNA, 25 bp, Mus musculus
agcacctgcgattcctcatccattt

SEQ ID NO: 166307 - DNA, 25 bp, Mus musculus
agcacctgcgtacccgcacgtggta

SEQ ID NO: 166308 - DNA, 25 bp, Mus musculus
agcacctgcgtagccgcacgtggta

SEQ ID NO: 166309 - DNA, 25 bp, Mus musculus
agcacctgctggcagtttccaggga

SEQ ID NO: 166310 - DNA, 25 bp, Mus musculus
agcacctgctgggagtttccaggga

SEQ ID NO: 166311 - DNA, 25 bp, Mus musculus
agcacctgcttgaactgggcattga

SEQ ID NO: 166312 - DNA, 25 bp, Mus musculus
agcacctgcttgtactgggcattga

SEQ ID NO: 166313 - DNA, 25 bp, Mus musculus
agcacctggagcaaaataacttcgt

SEQ ID NO: 166314 - DNA, 25 bp, Mus musculus
agcacctggagctaaataacttcgt

SEQ ID NO: 166315 - DNA, 25 bp, Mus musculus
agcacctggaggatggaattcccct

SEQ ID NO: 166316 - DNA, 25 bp, Mus musculus
agcacctggaggttggaattcccct

SEQ ID NO: 166317 - DNA, 25 bp, Mus musculus
agcacctggctgattcaaagcttcc

SEQ ID NO: 166318 - DNA, 25 bp, Mus musculus
agcacctggctgtttcaaagcttcc

SEQ ID NO: 166319 - DNA, 25 bp, Mus musculus
agcacctggtagctctgttccaaag

SEQ ID NO: 166320 - DNA, 25 bp, Mus musculus
agcacctggtaggtctgttccaaag

SEQ ID NO: 166321 - DNA, 25 bp, Mus musculus
agcacctggtgcaagggagcgacaa

SEQ ID NO: 166322 - DNA, 25 bp, Mus musculus
agcacctggtgctagggagcgacaa

SEQ ID NO: 166323 - DNA, 25 bp, Mus musculus
agcacctggtgtctttgtcgccata

SEQ ID NO: 166324 - DNA, 25 bp, Mus musculus
agcacctggtgtgtttgtcgccata

SEQ ID NO: 166325 - DNA, 25 bp, Mus musculus
agcacctgtactcaaaatgttcctg

SEQ ID NO: 166326 - DNA, 25 bp, Mus musculus
agcacctgtactgaaaatgttcctg

SEQ ID NO: 166327 - DNA, 25 bp, Mus musculus
agcacctgtgctctcgtagccgagg

SEQ ID NO: 166328 - DNA, 25 bp, Mus musculus
agcacctgtgctgtcgtagccgagg

SEQ ID NO: 166329 - DNA, 25 bp, Mus musculus
agcacctgtgtcaagcagctaactt

SEQ ID NO: 166330 - DNA, 25 bp, Mus musculus
agcacctgtgtctagcagctaactt

SEQ ID NO: 166331 - DNA, 25 bp, Mus musculus
agcacctgtgttagatgacagctgc

SEQ ID NO: 166332 - DNA, 25 bp, Mus musculus
agcacctgtgtttgatgacagctgc

SEQ ID NO: 166333 - DNA, 25 bp, Mus musculus
agcaccttaacgctcatttctattg

SEQ ID NO: 166334 - DNA, 25 bp, Mus musculus
agcaccttaacggtcatttctattg

SEQ ID NO: 166335 - DNA, 25 bp, Mus musculus
agcaccttagtcaccatgtcataga

SEQ ID NO: 166336 - DNA, 25 bp, Mus musculus
agcaccttagtctccatgtcataga

SEQ ID NO: 166337 - DNA, 25 bp, Mus musculus
agcaccttcaaaagtgggagtccca

SEQ ID NO: 166338 - DNA, 25 bp, Mus musculus
agcaccttcaaatgtgggagtccca

SEQ ID NO: 166339 - DNA, 25 bp, Mus musculus
agcaccttccttctggcattgtttt

SEQ ID NO: 166340 - DNA, 25 bp, Mus musculus
agcaccttccttgtggcattgtttt

SEQ ID NO: 166341 - DNA, 25 bp, Mus musculus
agcaccttcgtgcttacataaggta

SEQ ID NO: 166342 - DNA, 25 bp, Mus musculus
agcaccttcgtggttacataaggta

SEQ ID NO: 166343 - DNA, 25 bp, Mus musculus
agcaccttgaaccagaagacgccat

SEQ ID NO: 166344 - DNA, 25 bp, Mus musculus
agcaccttgaacgagaagacgccat

SEQ ID NO: 166345 - DNA, 25 bp, Mus musculus
agcaccttgcccattaaagtctatg

SEQ ID NO: 166346 - DNA, 25 bp, Mus musculus
agcaccttgccctttaaagtctatg

SEQ ID NO: 166347 - DNA, 25 bp, Mus musculus
agcaccttgctgcacacgtgttcaa

SEQ ID NO: 166348 - DNA, 25 bp, Mus musculus
agcaccttgctggacacgtgttcaa

SEQ ID NO: 166349 - DNA, 25 bp, Mus musculus
agcaccttggaaatcagcgcccgag

SEQ ID NO: 166350 - DNA, 25 bp, Mus musculus
agcaccttggaattcagcgcccgag

SEQ ID NO: 166351 - DNA, 25 bp, Mus musculus
agcaccttgtatctatattacctca

SEQ ID NO: 166352 - DNA, 25 bp, Mus musculus
agcaccttgtatcttgaagtcttca

SEQ ID NO: 166353 - DNA, 25 bp, Mus musculus
agcaccttgtatgtatattacctca

SEQ ID NO: 166354 - DNA, 25 bp, Mus musculus
agcaccttgtatgttgaagtcttca

SEQ ID NO: 166355 - DNA, 25 bp, Mus musculus
agcaccttgtgcagcgtctccaggt

SEQ ID NO: 166356 - DNA, 25 bp, Mus musculus
agcaccttgtgctgcgtctccaggt

SEQ ID NO: 166357 - DNA, 25 bp, Mus musculus
agcaccttgttacctggacagattt

SEQ ID NO: 166358 - DNA, 25 bp, Mus musculus
agcaccttgttagctggacagattt

SEQ ID NO: 166359 - DNA, 25 bp, Mus musculus
agcacctttaccctttgagacatct

SEQ ID NO: 166360 - DNA, 25 bp, Mus musculus
agcacctttaccgtttgagacatct

SEQ ID NO: 166361 - DNA, 25 bp, Mus musculus
agcacctttctgcactagtagctga

SEQ ID NO: 166362 - DNA, 25 bp, Mus musculus
agcacctttctggactagtagctga

SEQ ID NO: 166363 - DNA, 25 bp, Mus musculus
agcacctttgacctgaacatgaagc

SEQ ID NO: 166364 - DNA, 25 bp, Mus musculus
agcacctttgacgtgaacatgaagc

SEQ ID NO: 166365 - DNA, 25 bp, Mus musculus
agcacctttggcctgagagaaaact

SEQ ID NO: 166366 - DNA, 25 bp, Mus musculus
agcacctttggcgtgagagaaaact

SEQ ID NO: 166367 - DNA, 25 bp, Mus musculus
agcaccttttacaggttttgcagac

SEQ ID NO: 166368 - DNA, 25 bp, Mus musculus
agcaccttttactggttttgcagac

SEQ ID NO: 166369 - DNA, 25 bp, Mus musculus
agcaccttttataaaccagtttcag

SEQ ID NO: 166370 - DNA, 25 bp, Mus musculus
agcaccttttattaaccagtttcag

SEQ ID NO: 166371 - DNA, 25 bp, Mus musculus
agcaccttttggctttgcgatacca

SEQ ID NO: 166372 - DNA, 25 bp, Mus musculus
agcaccttttgggtttgcgatacca

SEQ ID NO: 166373 - DNA, 25 bp, Mus musculus
agcacgaagaacctcatgcccaaag

SEQ ID NO: 166374 - DNA, 25 bp, Mus musculus
agcacgaagaacgtcatgcccaaag

SEQ ID NO: 166375 - DNA, 25 bp, Mus musculus
agcacgaagatgacctccctgagaa

SEQ ID NO: 166376 - DNA, 25 bp, Mus musculus
agcacgaagatgtcctccctgagaa

SEQ ID NO: 166377 - DNA, 25 bp, Mus musculus
agcacgaccaccacgaggcgcagaa

SEQ ID NO: 166378 - DNA, 25 bp, Mus musculus
agcacgaccacctcgaggcgcagaa

SEQ ID NO: 166379 - DNA, 25 bp, Mus musculus
agcacgactgagagtcatggacaat

SEQ ID NO: 166380 - DNA, 25 bp, Mus musculus
agcacgactgagtgtcatggacaat

SEQ ID NO: 166381 - DNA, 25 bp, Mus musculus
agcacgactgcaatcaaactactac

SEQ ID NO: 166382 - DNA, 25 bp, Mus musculus
agcacgactgcattcaaactactac

SEQ ID NO: 166383 - DNA, 25 bp, Mus musculus
agcacgactgggactactgcgagca

SEQ ID NO: 166384 - DNA, 25 bp, Mus musculus
agcacgactgggtctactgcgagca

SEQ ID NO: 166385 - DNA, 25 bp, Mus musculus
agcacgagacaactcacactggtga

SEQ ID NO: 166386 - DNA, 25 bp, Mus musculus
agcacgagacaagtcacactggtga

SEQ ID NO: 166387 - DNA, 25 bp, Mus musculus
agcacgagagacagatcgcgcgcgt

SEQ ID NO: 166388 - DNA, 25 bp, Mus musculus
agcacgagagactgatcgcgcgcgt

SEQ ID NO: 166389 - DNA, 25 bp, Mus musculus
agcacgagcgcgagctacagaagct

SEQ ID NO: 166390 - DNA, 25 bp, Mus musculus
agcacgagcgcgtgctacagaagct

SEQ ID NO: 166391 - DNA, 25 bp, Mus musculus
agcacgagctgaacggtctgcgatt

SEQ ID NO: 166392 - DNA, 25 bp, Mus musculus
agcacgagctgatcggtctgcgatt

SEQ ID NO: 166393 - DNA, 25 bp, Mus musculus
agcacgatgacaactacgccaggcg

SEQ ID NO: 166394 - DNA, 25 bp, Mus musculus
agcacgatgacatctacgccaggcg

SEQ ID NO: 166395 - DNA, 25 bp, Mus musculus
agcacgatgggtccatggcttccct

SEQ ID NO: 166396 - DNA, 25 bp, Mus musculus
agcacgatgggtgcatggcttccct

SEQ ID NO: 166397 - DNA, 25 bp, Mus musculus
agcacgattcctaggcaggcagcga

SEQ ID NO: 166398 - DNA, 25 bp, Mus musculus
agcacgattccttggcaggcagcga

SEQ ID NO: 166399 - DNA, 25 bp, Mus musculus
agcacgcagatcagctggtttcaga

SEQ ID NO: 166400 - DNA, 25 bp, Mus musculus
agcacgcagatctgctggtttcaga

SEQ ID NO: 166401 - DNA, 25 bp, Mus musculus
agcacgcagcccagttgcaatcagg

SEQ ID NO: 166402 - DNA, 25 bp, Mus musculus
agcacgcagccctgttgcaatcagg

SEQ ID NO: 166403 - DNA, 25 bp, Mus musculus
agcacgcagtgtctgtcttctgata

SEQ ID NO: 166404 - DNA, 25 bp, Mus musculus
agcacgcagtgtgtgtcttctgata

SEQ ID NO: 166405 - DNA, 25 bp, Mus musculus
agcacgcatggtagtccttcagact

SEQ ID NO: 166406 - DNA, 25 bp, Mus musculus
agcacgcatggttgtccttcagact

SEQ ID NO: 166407 - DNA, 25 bp, Mus musculus
agcacgccattgattgcagacctga

SEQ ID NO: 166408 - DNA, 25 bp, Mus musculus
agcacgccattgtttgcagacctga

SEQ ID NO: 166409 - DNA, 25 bp, Mus musculus
agcacgcccactaaagcatgacatg

SEQ ID NO: 166410 - DNA, 25 bp, Mus musculus
agcacgcccacttaagcatgacatg

SEQ ID NO: 166411 - DNA, 25 bp, Mus musculus
agcacgcctactccttcaggataag

SEQ ID NO: 166412 - DNA, 25 bp, Mus musculus
agcacgcctactgcttcaggataag

SEQ ID NO: 166413 - DNA, 25 bp, Mus musculus
agcacgcctcggctatctgggtttg

SEQ ID NO: 166414 - DNA, 25 bp, Mus musculus
agcacgcctcgggtatctgggtttg

SEQ ID NO: 166415 - DNA, 25 bp, Mus musculus
agcacgcggtgtcggagggcaccaa

SEQ ID NO: 166416 - DNA, 25 bp, Mus musculus
agcacgcggtgtgggagggcaccaa

SEQ ID NO: 166417 - DNA, 25 bp, Mus musculus
agcacgctcaccagcagagggcgca

SEQ ID NO: 166418 - DNA, 25 bp, Mus musculus
agcacgctcacctgcagagggcgca

SEQ ID NO: 166419 - DNA, 25 bp, Mus musculus
agcacgctcttaatagttaagctag

SEQ ID NO: 166420 - DNA, 25 bp, Mus musculus
agcacgctcttattagttaagctag

SEQ ID NO: 166421 - DNA, 25 bp, Mus musculus
agcacgctgaatcagatctactttg

SEQ ID NO: 166422 - DNA, 25 bp, Mus musculus
agcacgctgaatgagatctactttg

SEQ ID NO: 166423 - DNA, 25 bp, Mus musculus
agcacgctgcataagtcattttcaa

SEQ ID NO: 166424 - DNA, 25 bp, Mus musculus
agcacgctgcattagtcattttcaa

SEQ ID NO: 166425 - DNA, 25 bp, Mus musculus
agcacgctggcacagctgaactgta

SEQ ID NO: 166426 - DNA, 25 bp, Mus musculus
agcacgctggcagagctgaactgta

SEQ ID NO: 166427 - DNA, 25 bp, Mus musculus
agcacgctggtgctcatctatgggc

SEQ ID NO: 166428 - DNA, 25 bp, Mus musculus
agcacgctggtggtcatctatgggc

SEQ ID NO: 166429 - DNA, 25 bp, Mus musculus
agcacgctgtggagacagcccgtcg

SEQ ID NO: 166430 - DNA, 25 bp, Mus musculus
agcacgctgtggtgacagcccgtcg

SEQ ID NO: 166431 - DNA, 25 bp, Mus musculus
agcacgctgtttctttgacgagtac

SEQ ID NO: 166432 - DNA, 25 bp, Mus musculus
agcacgctgtttgtttgacgagtac

SEQ ID NO: 166433 - DNA, 25 bp, Mus musculus
agcacgcttactaccttcagtataa

SEQ ID NO: 166434 - DNA, 25 bp, Mus musculus
agcacgcttacttccttcagtataa

SEQ ID NO: 166435 - DNA, 25 bp, Mus musculus
agcacgcttgaaatcaggcttcagt

SEQ ID NO: 166436 - DNA, 25 bp, Mus musculus
agcacgcttgaattcaggcttcagt

SEQ ID NO: 166437 - DNA, 25 bp, Mus musculus
agcacggaacaaatttatatctata

SEQ ID NO: 166438 - DNA, 25 bp, Mus musculus
agcacggaacaattttatatctata

SEQ ID NO: 166439 - DNA, 25 bp, Mus musculus
agcacggaacttatggctgtccaag

SEQ ID NO: 166440 - DNA, 25 bp, Mus musculus
agcacggaacttttggctgtccaag

SEQ ID NO: 166441 - DNA, 25 bp, Mus musculus
agcacggagcacctttttactttgg

SEQ ID NO: 166442 - DNA, 25 bp, Mus musculus
agcacggagcacgtttttactttgg

SEQ ID NO: 166443 - DNA, 25 bp, Mus musculus
agcacggagccacccgtcttctcag

SEQ ID NO: 166444 - DNA, 25 bp, Mus musculus
agcacggagccagccgtcttctcag

SEQ ID NO: 166445 - DNA, 25 bp, Mus musculus
agcacggagctcatacatggataca

SEQ ID NO: 166446 - DNA, 25 bp, Mus musculus
agcacggagctcttacatggataca

SEQ ID NO: 166447 - DNA, 25 bp, Mus musculus
agcacggaggctcactctcagtgac

SEQ ID NO: 166448 - DNA, 25 bp, Mus musculus
agcacggaggctgactctcagtgac

SEQ ID NO: 166449 - DNA, 25 bp, Mus musculus
agcacggagtcgctgtgtattcttg

SEQ ID NO: 166450 - DNA, 25 bp, Mus musculus
agcacggagtcggtgtgtattcttg

SEQ ID NO: 166451 - DNA, 25 bp, Mus musculus
agcacggccggacccaagatgaaaa

SEQ ID NO: 166452 - DNA, 25 bp, Mus musculus
agcacggccggagccaagatgaaaa

SEQ ID NO: 166453 - DNA, 25 bp, Mus musculus
agcacggcctacactacgaggtgaa

SEQ ID NO: 166454 - DNA, 25 bp, Mus musculus
agcacggcctactctacgaggtgaa

SEQ ID NO: 166455 - DNA, 25 bp, Mus musculus
agcacggcggctacggaaagcagaa

SEQ ID NO: 166456 - DNA, 25 bp, Mus musculus
agcacggcggcttcggaaagcagaa

SEQ ID NO: 166457 - DNA, 25 bp, Mus musculus
agcacgggcaaccttgggacttact

SEQ ID NO: 166458 - DNA, 25 bp, Mus musculus
agcacgggcaacgttgggacttact

SEQ ID NO: 166459 - DNA, 25 bp, Mus musculus
agcacgggtaggctttcaggtttca

SEQ ID NO: 166460 - DNA, 25 bp, Mus musculus
agcacgggtagggtttcaggtttca

SEQ ID NO: 166461 - DNA, 25 bp, Mus musculus
agcacgggtcttaccatccagagct

SEQ ID NO: 166462 - DNA, 25 bp, Mus musculus
agcacgggtctttccatccagagct

SEQ ID NO: 166463 - DNA, 25 bp, Mus musculus
agcacggtaccactttacaacattg

SEQ ID NO: 166464 - DNA, 25 bp, Mus musculus
agcacggtaccagtttacaacattg

SEQ ID NO: 166465 - DNA, 25 bp, Mus musculus
agcacggtcaacagctctatgccag

SEQ ID NO: 166466 - DNA, 25 bp, Mus musculus
agcacggtcaactgctctatgccag

SEQ ID NO: 166467 - DNA, 25 bp, Mus musculus
agcacggtcccgagtggagagtaca

SEQ ID NO: 166468 - DNA, 25 bp, Mus musculus
agcacggtcccgtgtggagagtaca

SEQ ID NO: 166469 - DNA, 25 bp, Mus musculus
agcacggtctgtctccagtgtacaa

SEQ ID NO: 166470 - DNA, 25 bp, Mus musculus
agcacggtctgtgtccagtgtacaa

SEQ ID NO: 166471 - DNA, 25 bp, Mus musculus
agcacggtgatgcacggcctgtaat

SEQ ID NO: 166472 - DNA, 25 bp, Mus musculus
agcacggtgatggacggcctgtaat

SEQ ID NO: 166473 - DNA, 25 bp, Mus musculus
agcacggttcggatcctcctctgta

SEQ ID NO: 166474 - DNA, 25 bp, Mus musculus
agcacggttcggttcctcctctgta

SEQ ID NO: 166475 - DNA, 25 bp, Mus musculus
agcacgtaaatgacctatatccaag

SEQ ID NO: 166476 - DNA, 25 bp, Mus musculus
agcacgtaaatgtcctatatccaag

SEQ ID NO: 166477 - DNA, 25 bp, Mus musculus
agcacgtagtgtcctgttaccgatg

SEQ ID NO: 166478 - DNA, 25 bp, Mus musculus
agcacgtagtgtgctgttaccgatg

SEQ ID NO: 166479 - DNA, 25 bp, Mus musculus
agcacgtattcaccctctcggagaa

SEQ ID NO: 166480 - DNA, 25 bp, Mus musculus
agcacgtattcagcctctcggagaa

SEQ ID NO: 166481 - DNA, 25 bp, Mus musculus
agcacgtattggacttcttgaagga

SEQ ID NO: 166482 - DNA, 25 bp, Mus musculus
agcacgtattggtcttcttgaagga

SEQ ID NO: 166483 - DNA, 25 bp, Mus musculus
agcacgtcacgtcgtgggtttgact

SEQ ID NO: 166484 - DNA, 25 bp, Mus musculus
agcacgtcacgtggtgggtttgact

SEQ ID NO: 166485 - DNA, 25 bp, Mus musculus
agcacgtcatagaaatatctccttc

SEQ ID NO: 166486 - DNA, 25 bp, Mus musculus
agcacgtcatagtaatatctccttc

SEQ ID NO: 166487 - DNA, 25 bp, Mus musculus
agcacgtctccacccagagctgaga

SEQ ID NO: 166488 - DNA, 25 bp, Mus musculus
agcacgtctccagccagagctgaga

SEQ ID NO: 166489 - DNA, 25 bp, Mus musculus
agcacgtgcctaagacaggtctctt

SEQ ID NO: 166490 - DNA, 25 bp, Mus musculus
agcacgtgcctatgacaggtctctt

SEQ ID NO: 166491 - DNA, 25 bp, Mus musculus
agcacgtgctgcctaaagagctctg

SEQ ID NO: 166492 - DNA, 25 bp, Mus musculus
agcacgtgctgcgtaaagagctctg

SEQ ID NO: 166493 - DNA, 25 bp, Mus musculus
agcacgtgctttaagtcagctctgt

SEQ ID NO: 166494 - DNA, 25 bp, Mus musculus
agcacgtgcttttagtcagctctgt

SEQ ID NO: 166495 - DNA, 25 bp, Mus musculus
agcacgtggagcatgcaggctatat

SEQ ID NO: 166496 - DNA, 25 bp, Mus musculus
agcacgtggagcttgcaggctatat

SEQ ID NO: 166497 - DNA, 25 bp, Mus musculus
agcacgtggccgaaatgttgcgaac

SEQ ID NO: 166498 - DNA, 25 bp, Mus musculus
agcacgtggccgtaatgttgcgaac

SEQ ID NO: 166499 - DNA, 25 bp, Mus musculus
agcacgtggctcagtgccgaatgga

SEQ ID NO: 166500 - DNA, 25 bp, Mus musculus
agcacgtggctctgtgccgaatgga

SEQ ID NO: 166501 - DNA, 25 bp, Mus musculus
agcacgtgggcaattgtttccatct

SEQ ID NO: 166502 - DNA, 25 bp, Mus musculus
agcacgtgggcatttgtttccatct

SEQ ID NO: 166503 - DNA, 25 bp, Mus musculus
agcacgtgggctatggaccttggca

SEQ ID NO: 166504 - DNA, 25 bp, Mus musculus
agcacgtgggctttggaccttggca

SEQ ID NO: 166505 - DNA, 25 bp, Mus musculus
agcacgtggtggactctgttttatt

SEQ ID NO: 166506 - DNA, 25 bp, Mus musculus
agcacgtggtggtctctgttttatt

SEQ ID NO: 166507 - DNA, 25 bp, Mus musculus
agcacgtgtgtccatttggaggcca

SEQ ID NO: 166508 - DNA, 25 bp, Mus musculus
agcacgtgtgtcgatttggaggcca

SEQ ID NO: 166509 - DNA, 25 bp, Mus musculus
agcacgtgttacaagctccacatgg

SEQ ID NO: 166510 - DNA, 25 bp, Mus musculus
agcacgtgttactagctccacatgg

SEQ ID NO: 166511 - DNA, 25 bp, Mus musculus
agcacgtgttccacactagaagaaa

SEQ ID NO: 166512 - DNA, 25 bp, Mus musculus
agcacgtgttcctcactagaagaaa

SEQ ID NO: 166513 - DNA, 25 bp, Mus musculus
agcacgttttccatataggatccct

SEQ ID NO: 166514 - DNA, 25 bp, Mus musculus
agcacgttttccttataggatccct

SEQ ID NO: 166515 - DNA, 25 bp, Mus musculus
agcacgtttttcatatgatcaggga

SEQ ID NO: 166516 - DNA, 25 bp, Mus musculus
agcacgtttttcttatgatcaggga

SEQ ID NO: 166517 - DNA, 25 bp, Mus musculus
agcactaaaaaacccctgtgtattt

SEQ ID NO: 166518 - DNA, 25 bp, Mus musculus
agcactaaaaaagccctgtgtattt

SEQ ID NO: 166519 - DNA, 25 bp, Mus musculus
agcactaaaatgcaaccctgtatat

SEQ ID NO: 166520 - DNA, 25 bp, Mus musculus
agcactaaaatggaaccctgtatat

SEQ ID NO: 166521 - DNA, 25 bp, Mus musculus
agcactaacccacccttcaattaga

SEQ ID NO: 166522 - DNA, 25 bp, Mus musculus
agcactaacccagccttcaattaga

SEQ ID NO: 166523 - DNA, 25 bp, Mus musculus
agcactaaccttagaggccaatgtc

SEQ ID NO: 166524 - DNA, 25 bp, Mus musculus
agcactaacctttgaggccaatgtc

SEQ ID NO: 166525 - DNA, 25 bp, Mus musculus
agcactaactaaactgttgggttca

SEQ ID NO: 166526 - DNA, 25 bp, Mus musculus
agcactaactaatctgttgggttca

SEQ ID NO: 166527 - DNA, 25 bp, Mus musculus
agcactaagcaaatgcatcctgtga

SEQ ID NO: 166528 - DNA, 25 bp, Mus musculus
agcactaagcaattgcatcctgtga

SEQ ID NO: 166529 - DNA, 25 bp, Mus musculus
agcactaagtagacccaagctctct

SEQ ID NO: 166530 - DNA, 25 bp, Mus musculus
agcactaagtagtcccaagctctct

SEQ ID NO: 166531 - DNA, 25 bp, Mus musculus
agcactaagttcatctgtttgttgt

SEQ ID NO: 166532 - DNA, 25 bp, Mus musculus
agcactaagttcttctgtttgttgt

SEQ ID NO: 166533 - DNA, 25 bp, Mus musculus
agcactaatatgctgtttctcatta

SEQ ID NO: 166534 - DNA, 25 bp, Mus musculus
agcactaatatggtgtttctcatta

SEQ ID NO: 166535 - DNA, 25 bp, Mus musculus
agcactaattgcacagccctatagt

SEQ ID NO: 166536 - DNA, 25 bp, Mus musculus
agcactaattgctcagccctatagt

SEQ ID NO: 166537 - DNA, 25 bp, Mus musculus
agcactacagggactggtctggtta

SEQ ID NO: 166538 - DNA, 25 bp, Mus musculus
agcactacagggtctggtctggtta

SEQ ID NO: 166539 - DNA, 25 bp, Mus musculus
agcactacatacaggccatcttgaa

SEQ ID NO: 166540 - DNA, 25 bp, Mus musculus
agcactacatactggccatcttgaa

SEQ ID NO: 166541 - DNA, 25 bp, Mus musculus
agcactacccctcagtgctttggag

SEQ ID NO: 166542 - DNA, 25 bp, Mus musculus
agcactacccctgagtgctttggag

SEQ ID NO: 166543 - DNA, 25 bp, Mus musculus
agcactaccgggacctgggcagcgt

SEQ ID NO: 166544 - DNA, 25 bp, Mus musculus
agcactaccgggtcctgggcagcgt

SEQ ID NO: 166545 - DNA, 25 bp, Mus musculus
agcactaccggtaggtcctcgttct

SEQ ID NO: 166546 - DNA, 25 bp, Mus musculus
agcactaccggttggtcctcgttct

SEQ ID NO: 166547 - DNA, 25 bp, Mus musculus
agcactacctagatggagactccca

SEQ ID NO: 166548 - DNA, 25 bp, Mus musculus
agcactacctagttggagactccca

SEQ ID NO: 166549 - DNA, 25 bp, Mus musculus
agcactacctcgaggactggaacac

SEQ ID NO: 166550 - DNA, 25 bp, Mus musculus
agcactacctcgtggactggaacac

SEQ ID NO: 166551 - DNA, 25 bp, Mus musculus
agcactacgagaagcacttctgaaa

SEQ ID NO: 166552 - DNA, 25 bp, Mus musculus
agcactacgagatgcacttctgaaa

SEQ ID NO: 166553 - DNA, 25 bp, Mus musculus
agcactactaacagcactggagggt

SEQ ID NO: 166554 - DNA, 25 bp, Mus musculus
agcactactaactgcactggagggt

SEQ ID NO: 166555 - DNA, 25 bp, Mus musculus
agcactactgaaaacttctttctga

SEQ ID NO: 166556 - DNA, 25 bp, Mus musculus
agcactactgaatacttctttctga

SEQ ID NO: 166557 - DNA, 25 bp, Mus musculus
agcactactgatctgtcctgggttg

SEQ ID NO: 166558 - DNA, 25 bp, Mus musculus
agcactactgatgtgtcctgggttg

SEQ ID NO: 166559 - DNA, 25 bp, Mus musculus
agcactacttacatgaacttgtcat

SEQ ID NO: 166560 - DNA, 25 bp, Mus musculus
agcactacttacttgaacttgtcat

SEQ ID NO: 166561 - DNA, 25 bp, Mus musculus
agcactagctgcagtactcagctct

SEQ ID NO: 166562 - DNA, 25 bp, Mus musculus
agcactagctgctgtactcagctct

SEQ ID NO: 166563 - DNA, 25 bp, Mus musculus
agcactaggagacagcggtccccag

SEQ ID NO: 166564 - DNA, 25 bp, Mus musculus
agcactaggagagagcggtccccag

SEQ ID NO: 166565 - DNA, 25 bp, Mus musculus
agcactaggctgcaccttgtgtcac

SEQ ID NO: 166566 - DNA, 25 bp, Mus musculus
agcactaggctggaccttgtgtcac

SEQ ID NO: 166567 - DNA, 25 bp, Mus musculus
agcactaggcttcttgtttaatgga

SEQ ID NO: 166568 - DNA, 25 bp, Mus musculus
agcactaggcttgttgtttaatgga

SEQ ID NO: 166569 - DNA, 25 bp, Mus musculus
agcactagtactctgttgccatggc

SEQ ID NO: 166570 - DNA, 25 bp, Mus musculus
agcactagtactgtgttgccatggc

SEQ ID NO: 166571 - DNA, 25 bp, Mus musculus
agcactagtgaactcagtcacctga

SEQ ID NO: 166572 - DNA, 25 bp, Mus musculus
agcactagtgaagtcagtcacctga

SEQ ID NO: 166573 - DNA, 25 bp, Mus musculus
agcactagtgtacggttcctacaga

SEQ ID NO: 166574 - DNA, 25 bp, Mus musculus
agcactagtgtagggttcctacaga

SEQ ID NO: 166575 - DNA, 25 bp, Mus musculus
agcactatactaccatctgaaacag

SEQ ID NO: 166576 - DNA, 25 bp, Mus musculus
agcactatactagcatctgaaacag

SEQ ID NO: 166577 - DNA, 25 bp, Mus musculus
agcactatagtgacctctgctggca

SEQ ID NO: 166578 - DNA, 25 bp, Mus musculus
agcactatagtgtcctctgctggca

SEQ ID NO: 166579 - DNA, 25 bp, Mus musculus
agcactatatacacaggcttatgtg

SEQ ID NO: 166580 - DNA, 25 bp, Mus musculus
agcactatatactcaggcttatgtg

SEQ ID NO: 166581 - DNA, 25 bp, Mus musculus
agcactatcttaattcctgcccctg

SEQ ID NO: 166582 - DNA, 25 bp, Mus musculus
agcactatcttatttcctgcccctg

SEQ ID NO: 166583 - DNA, 25 bp, Mus musculus
agcactatgacaaagcagccacaga

SEQ ID NO: 166584 - DNA, 25 bp, Mus musculus
agcactatgacacagaccattccgg

SEQ ID NO: 166585 - DNA, 25 bp, Mus musculus
agcactatgacagagaccattccgg

SEQ ID NO: 166586 - DNA, 25 bp, Mus musculus
agcactatgacatagcagccacaga

SEQ ID NO: 166587 - DNA, 25 bp, Mus musculus
agcactatggctaacgtctctggtg

SEQ ID NO: 166588 - DNA, 25 bp, Mus musculus
agcactatggcttacgtctctggtg

SEQ ID NO: 166589 - DNA, 25 bp, Mus musculus
agcactatgggaatgcttccgtatc

SEQ ID NO: 166590 - DNA, 25 bp, Mus musculus
agcactatgggattgcttccgtatc

SEQ ID NO: 166591 - DNA, 25 bp, Mus musculus
agcactatgtctccaactttacatc

SEQ ID NO: 166592 - DNA, 25 bp, Mus musculus
agcactatgtctgcaactttacatc

SEQ ID NO: 166593 - DNA, 25 bp, Mus musculus
agcactattgcaatcgctgtggctt

SEQ ID NO: 166594 - DNA, 25 bp, Mus musculus
agcactattgcattcgctgtggctt

SEQ ID NO: 166595 - DNA, 25 bp, Mus musculus
agcactatttctaaaattgcctata

SEQ ID NO: 166596 - DNA, 25 bp, Mus musculus
agcactatttcttaaattgcctata

SEQ ID NO: 166597 - DNA, 25 bp, Mus musculus
agcactcacagcagcgctgataggc

SEQ ID NO: 166598 - DNA, 25 bp, Mus musculus
agcactcacagctgcgctgataggc

SEQ ID NO: 166599 - DNA, 25 bp, Mus musculus
agcactcagactatctcataacctt

SEQ ID NO: 166600 - DNA, 25 bp, Mus musculus
agcactcagactttctcataacctt

SEQ ID NO: 166601 - DNA, 25 bp, Mus musculus
agcactcagcagactggagaatcca

SEQ ID NO: 166602 - DNA, 25 bp, Mus musculus
agcactcagcagattccgtgtggaa

SEQ ID NO: 166603 - DNA, 25 bp, Mus musculus
agcactcagcagctactttcagcaa

SEQ ID NO: 166604 - DNA, 25 bp, Mus musculus
agcactcagcaggtactttcagcaa

SEQ ID NO: 166605 - DNA, 25 bp, Mus musculus
agcactcagcagtctggagaatcca

SEQ ID NO: 166606 - DNA, 25 bp, Mus musculus
agcactcagcagtttccgtgtggaa

SEQ ID NO: 166607 - DNA, 25 bp, Mus musculus
agcactcagctaaaccacaaaacac

SEQ ID NO: 166608 - DNA, 25 bp, Mus musculus
agcactcagctataccacaaaacac

SEQ ID NO: 166609 - DNA, 25 bp, Mus musculus
agcactcaggaactcggttgaataa

SEQ ID NO: 166610 - DNA, 25 bp, Mus musculus
agcactcaggaagtcggttgaataa

SEQ ID NO: 166611 - DNA, 25 bp, Mus musculus
agcactcaggtcacatggcttcgca

SEQ ID NO: 166612 - DNA, 25 bp, Mus musculus
agcactcaggtctcatggcttcgca

SEQ ID NO: 166613 - DNA, 25 bp, Mus musculus
agcactcagtacagagtctggcctg

SEQ ID NO: 166614 - DNA, 25 bp, Mus musculus
agcactcagtactgagtctggcctg

SEQ ID NO: 166615 - DNA, 25 bp, Mus musculus
agcactcagttgatcccagtcaaat

SEQ ID NO: 166616 - DNA, 25 bp, Mus musculus
agcactcagttgttcccagtcaaat

SEQ ID NO: 166617 - DNA, 25 bp, Mus musculus
agcactcatactcataaaacaagaa

SEQ ID NO: 166618 - DNA, 25 bp, Mus musculus
agcactcatactgataaaacaagaa

SEQ ID NO: 166619 - DNA, 25 bp, Mus musculus
agcactcatgtcagcatttaccaga

SEQ ID NO: 166620 - DNA, 25 bp, Mus musculus
agcactcatgtctgcatttaccaga

SEQ ID NO: 166621 - DNA, 25 bp, Mus musculus
agcactcattaaagccctaggatcc

SEQ ID NO: 166622 - DNA, 25 bp, Mus musculus
agcactcattaatgccctaggatcc

SEQ ID NO: 166623 - DNA, 25 bp, Mus musculus
agcactcattgccagggtcacagaa

SEQ ID NO: 166624 - DNA, 25 bp, Mus musculus
agcactcattgcgagggtcacagaa

SEQ ID NO: 166625 - DNA, 25 bp, Mus musculus
agcactccacttatgtacacataaa

SEQ ID NO: 166626 - DNA, 25 bp, Mus musculus
agcactccacttttgtacacataaa

SEQ ID NO: 166627 - DNA, 25 bp, Mus musculus
agcactccagacacagaactcagaa

SEQ ID NO: 166628 - DNA, 25 bp, Mus musculus
agcactccagactcagaactcagaa

SEQ ID NO: 166629 - DNA, 25 bp, Mus musculus
agcactccagtaacaagtggatact

SEQ ID NO: 166630 - DNA, 25 bp, Mus musculus
agcactccagtatcaagtggatact

SEQ ID NO: 166631 - DNA, 25 bp, Mus musculus
agcactccagtcatcaatggttcag

SEQ ID NO: 166632 - DNA, 25 bp, Mus musculus
agcactccagtcttcaatggttcag

SEQ ID NO: 166633 - DNA, 25 bp, Mus musculus
agcactcccaccatcgggttatata

SEQ ID NO: 166634 - DNA, 25 bp, Mus musculus
agcactcccaccttcgggttatata

SEQ ID NO: 166635 - DNA, 25 bp, Mus musculus
agcactccccctaaatatgtatttg

SEQ ID NO: 166636 - DNA, 25 bp, Mus musculus
agcactcccccttaatatgtatttg

SEQ ID NO: 166637 - DNA, 25 bp, Mus musculus
agcactccctctccaaagggctttt

SEQ ID NO: 166638 - DNA, 25 bp, Mus musculus
agcactccctctgcaaagggctttt

SEQ ID NO: 166639 - DNA, 25 bp, Mus musculus
agcactcctaacagactagtgtgat

SEQ ID NO: 166640 - DNA, 25 bp, Mus musculus
agcactcctaactgactagtgtgat

SEQ ID NO: 166641 - DNA, 25 bp, Mus musculus
agcactcctagccatagccaaagtt

SEQ ID NO: 166642 - DNA, 25 bp, Mus musculus
agcactcctagcgatagccaaagtt

SEQ ID NO: 166643 - DNA, 25 bp, Mus musculus
agcactcctcacagcttcaaggtaa

SEQ ID NO: 166644 - DNA, 25 bp, Mus musculus
agcactcctcactgcttcaaggtaa

SEQ ID NO: 166645 - DNA, 25 bp, Mus musculus
agcactcgaagaaggttctttccct

SEQ ID NO: 166646 - DNA, 25 bp, Mus musculus
agcactcgaagatggttctttccct

SEQ ID NO: 166647 - DNA, 25 bp, Mus musculus
agcactcgggagcaggtgagcaatt

SEQ ID NO: 166648 - DNA, 25 bp, Mus musculus
agcactcgggaggaggtgagcaatt

SEQ ID NO: 166649 - DNA, 25 bp, Mus musculus
agcactcgggatctctggttcagca

SEQ ID NO: 166650 - DNA, 25 bp, Mus musculus
agcactcgggatgtctggttcagca

SEQ ID NO: 166651 - DNA, 25 bp, Mus musculus
agcactcggtggaggcttttgtcct

SEQ ID NO: 166652 - DNA, 25 bp, Mus musculus
agcactcggtggtggcttttgtcct

SEQ ID NO: 166653 - DNA, 25 bp, Mus musculus
agcactcgtgttagtatgtactgga

SEQ ID NO: 166654 - DNA, 25 bp, Mus musculus
agcactcgtgtttgtatgtactgga

SEQ ID NO: 166655 - DNA, 25 bp, Mus musculus
agcactctacctaaggcccaggctg

SEQ ID NO: 166656 - DNA, 25 bp, Mus musculus
agcactctacctatgggctacagct

SEQ ID NO: 166657 - DNA, 25 bp, Mus musculus
agcactctaccttaggcccaggctg

SEQ ID NO: 166658 - DNA, 25 bp, Mus musculus
agcactctacctttgggctacagct

SEQ ID NO: 166659 - DNA, 25 bp, Mus musculus
agcactctacttctacccagttaat

SEQ ID NO: 166660 - DNA, 25 bp, Mus musculus
agcactctacttgtacccagttaat

SEQ ID NO: 166661 - DNA, 25 bp, Mus musculus
agcactctatgtcctcattctctat

SEQ ID NO: 166662 - DNA, 25 bp, Mus musculus
agcactctatgtgctcattctctat

SEQ ID NO: 166663 - DNA, 25 bp, Mus musculus
agcactctcactaccctgagggaag

SEQ ID NO: 166664 - DNA, 25 bp, Mus musculus
agcactctcacttccctgagggaag

SEQ ID NO: 166665 - DNA, 25 bp, Mus musculus
agcactctcagcagggtgatgaaac

SEQ ID NO: 166666 - DNA, 25 bp, Mus musculus
agcactctcagctgggtgatgaaac

SEQ ID NO: 166667 - DNA, 25 bp, Mus musculus
agcactctcattaagcctcataata

SEQ ID NO: 166668 - DNA, 25 bp, Mus musculus
agcactctcatttagcctcataata

SEQ ID NO: 166669 - DNA, 25 bp, Mus musculus
agcactctccggaccgagagacaag

SEQ ID NO: 166670 - DNA, 25 bp, Mus musculus
agcactctccggtccgagagacaag

SEQ ID NO: 166671 - DNA, 25 bp, Mus musculus
agcactctcggcacaggtggatcca

SEQ ID NO: 166672 - DNA, 25 bp, Mus musculus
agcactctcggctcaggtggatcca

SEQ ID NO: 166673 - DNA, 25 bp, Mus musculus
agcactctctgcagtggcaatggca

SEQ ID NO: 166674 - DNA, 25 bp, Mus musculus
agcactctctgcctacgaggactgg

SEQ ID NO: 166675 - DNA, 25 bp, Mus musculus
agcactctctgcgtacgaggactgg

SEQ ID NO: 166676 - DNA, 25 bp, Mus musculus
agcactctctgctgtggcaatggca

SEQ ID NO: 166677 - DNA, 25 bp, Mus musculus
agcactctggaaacagtggatcctc

SEQ ID NO: 166678 - DNA, 25 bp, Mus musculus
agcactctggaatcagtggatcctc

SEQ ID NO: 166679 - DNA, 25 bp, Mus musculus
agcactctggagacctagacaggtg

SEQ ID NO: 166680 - DNA, 25 bp, Mus musculus
agcactctggagtcctagacaggtg

SEQ ID NO: 166681 - DNA, 25 bp, Mus musculus
agcactcttagtctgaacttactga

SEQ ID NO: 166682 - DNA, 25 bp, Mus musculus
agcactcttagtgtgaacttactga

SEQ ID NO: 166683 - DNA, 25 bp, Mus musculus
agcactcttcatcataacgatcagg

SEQ ID NO: 166684 - DNA, 25 bp, Mus musculus
agcactcttcatgataacgatcagg

SEQ ID NO: 166685 - DNA, 25 bp, Mus musculus
agcactcttcccacctagtttggaa

SEQ ID NO: 166686 - DNA, 25 bp, Mus musculus
agcactcttccctcctagtttggaa

SEQ ID NO: 166687 - DNA, 25 bp, Mus musculus
agcactcttcctctggtactcaaat

SEQ ID NO: 166688 - DNA, 25 bp, Mus musculus
agcactcttcctgtggtactcaaat

SEQ ID NO: 166689 - DNA, 25 bp, Mus musculus
agcactcttcgacctatgggatatc

SEQ ID NO: 166690 - DNA, 25 bp, Mus musculus
agcactcttcgagctatgggatatc

SEQ ID NO: 166691 - DNA, 25 bp, Mus musculus
agcactcttctgaacactgggatgt

SEQ ID NO: 166692 - DNA, 25 bp, Mus musculus
agcactcttctgtacactgggatgt

SEQ ID NO: 166693 - DNA, 25 bp, Mus musculus
agcactcttgctcattctgtggtaa

SEQ ID NO: 166694 - DNA, 25 bp, Mus musculus
agcactcttgctgattctgtggtaa

SEQ ID NO: 166695 - DNA, 25 bp, Mus musculus
agcactctttctactcggattcttt

SEQ ID NO: 166696 - DNA, 25 bp, Mus musculus
agcactctttcttctcggattcttt

SEQ ID NO: 166697 - DNA, 25 bp, Mus musculus
agcactgaaagtctacgtccggaaa

SEQ ID NO: 166698 - DNA, 25 bp, Mus musculus
agcactgaaagtgtacgtccggaaa

SEQ ID NO: 166699 - DNA, 25 bp, Mus musculus
agcactgaaattcccaaggctgttc

SEQ ID NO: 166700 - DNA, 25 bp, Mus musculus
agcactgaaattgccaaggctgttc

SEQ ID NO: 166701 - DNA, 25 bp, Mus musculus
agcactgaacagctcgtgtgacggc

SEQ ID NO: 166702 - DNA, 25 bp, Mus musculus
agcactgaacaggtcgtgtgacggc

SEQ ID NO: 166703 - DNA, 25 bp, Mus musculus
agcactgaatccacaccagagagtt

SEQ ID NO: 166704 - DNA, 25 bp, Mus musculus
agcactgaatcctcaccagagagtt

SEQ ID NO: 166705 - DNA, 25 bp, Mus musculus
agcactgacaagagcgcctcctcat

SEQ ID NO: 166706 - DNA, 25 bp, Mus musculus
agcactgacaagtgcgcctcctcat

SEQ ID NO: 166707 - DNA, 25 bp, Mus musculus
agcactgacacgaatctcttctatt

SEQ ID NO: 166708 - DNA, 25 bp, Mus musculus
agcactgacacgtatctcttctatt

SEQ ID NO: 166709 - DNA, 25 bp, Mus musculus
agcactgacatgaatctcttctcta

SEQ ID NO: 166710 - DNA, 25 bp, Mus musculus
agcactgacatgtatctcttctcta

SEQ ID NO: 166711 - DNA, 25 bp, Mus musculus
agcactgacctacactgtggcctca

SEQ ID NO: 166712 - DNA, 25 bp, Mus musculus
agcactgacctagactgtggcctca

SEQ ID NO: 166713 - DNA, 25 bp, Mus musculus
agcactgacgctcaattttgttcat

SEQ ID NO: 166714 - DNA, 25 bp, Mus musculus
agcactgacgctgaattttgttcat

SEQ ID NO: 166715 - DNA, 25 bp, Mus musculus
agcactgacgtgagacaggcctcta

SEQ ID NO: 166716 - DNA, 25 bp, Mus musculus
agcactgacgtgtgacaggcctcta

SEQ ID NO: 166717 - DNA, 25 bp, Mus musculus
agcactgagcgaaactccagtcttg

SEQ ID NO: 166718 - DNA, 25 bp, Mus musculus
agcactgagcgacctgttaattcct

SEQ ID NO: 166719 - DNA, 25 bp, Mus musculus
agcactgagcgagctgttaattcct

SEQ ID NO: 166720 - DNA, 25 bp, Mus musculus
agcactgagcgatactccagtcttg

SEQ ID NO: 166721 - DNA, 25 bp, Mus musculus
agcactgagcgccaaatcaaaagaa

SEQ ID NO: 166722 - DNA, 25 bp, Mus musculus
agcactgagcgcgaaatcaaaagaa

SEQ ID NO: 166723 - DNA, 25 bp, Mus musculus
agcactgaggctagagcgttttata

SEQ ID NO: 166724 - DNA, 25 bp, Mus musculus
agcactgaggcttgagcgttttata

SEQ ID NO: 166725 - DNA, 25 bp, Mus musculus
agcactgagttacaggcatgggcca

SEQ ID NO: 166726 - DNA, 25 bp, Mus musculus
agcactgagttagaggcatgggcca

SEQ ID NO: 166727 - DNA, 25 bp, Mus musculus
agcactgatcaacatctttagcaag

SEQ ID NO: 166728 - DNA, 25 bp, Mus musculus
agcactgatcaagatctttagcaag

SEQ ID NO: 166729 - DNA, 25 bp, Mus musculus
agcactgatcatacacacagcatgg

SEQ ID NO: 166730 - DNA, 25 bp, Mus musculus
agcactgatcattcacacagcatgg

SEQ ID NO: 166731 - DNA, 25 bp, Mus musculus
agcactgatctcagtatagtcccca

SEQ ID NO: 166732 - DNA, 25 bp, Mus musculus
agcactgatctcattgcagtaccgc

SEQ ID NO: 166733 - DNA, 25 bp, Mus musculus
agcactgatctctgtatagtcccca

SEQ ID NO: 166734 - DNA, 25 bp, Mus musculus
agcactgatctctttgcagtaccgc

SEQ ID NO: 166735 - DNA, 25 bp, Mus musculus
agcactgatttactcggcatcctac

SEQ ID NO: 166736 - DNA, 25 bp, Mus musculus
agcactgatttagtcggcatcctac

SEQ ID NO: 166737 - DNA, 25 bp, Mus musculus
agcactgcactcctataaaagattt

SEQ ID NO: 166738 - DNA, 25 bp, Mus musculus
agcactgcactcgtataaaagattt

SEQ ID NO: 166739 - DNA, 25 bp, Mus musculus
agcactgcagacagggcatctctgt

SEQ ID NO: 166740 - DNA, 25 bp, Mus musculus
agcactgcagacatcacttcctgag

SEQ ID NO: 166741 - DNA, 25 bp, Mus musculus
agcactgcagactgggcatctctgt

SEQ ID NO: 166742 - DNA, 25 bp, Mus musculus
agcactgcagacttcacttcctgag

SEQ ID NO: 166743 - DNA, 25 bp, Mus musculus
agcactgcagagcagcctttctgat

SEQ ID NO: 166744 - DNA, 25 bp, Mus musculus
agcactgcagaggagcctttctgat

SEQ ID NO: 166745 - DNA, 25 bp, Mus musculus
agcactgcagcgagattcttaaaga

SEQ ID NO: 166746 - DNA, 25 bp, Mus musculus
agcactgcagcgtgattcttaaaga

SEQ ID NO: 166747 - DNA, 25 bp, Mus musculus
agcactgcagggatcagcatggcaa

SEQ ID NO: 166748 - DNA, 25 bp, Mus musculus
agcactgcagggttcagcatggcaa

SEQ ID NO: 166749 - DNA, 25 bp, Mus musculus
agcactgcaggtcgcatttggatca

SEQ ID NO: 166750 - DNA, 25 bp, Mus musculus
agcactgcaggtggcatttggatca

SEQ ID NO: 166751 - DNA, 25 bp, Mus musculus
agcactgcagtaactgtgaaatgtt

SEQ ID NO: 166752 - DNA, 25 bp, Mus musculus
agcactgcagtatctgtgaaatgtt

SEQ ID NO: 166753 - DNA, 25 bp, Mus musculus
agcactgcagtgatgctatatagca

SEQ ID NO: 166754 - DNA, 25 bp, Mus musculus
agcactgcagtgatggacaaattct

SEQ ID NO: 166755 - DNA, 25 bp, Mus musculus
agcactgcagtgttgctatatagca

SEQ ID NO: 166756 - DNA, 25 bp, Mus musculus
agcactgcagtgttggacaaattct

SEQ ID NO: 166757 - DNA, 25 bp, Mus musculus
agcactgcattcaccttactgagca

SEQ ID NO: 166758 - DNA, 25 bp, Mus musculus
agcactgcattctccttactgagca

SEQ ID NO: 166759 - DNA, 25 bp, Mus musculus
agcactgccaatccccaagaagatg

SEQ ID NO: 166760 - DNA, 25 bp, Mus musculus
agcactgccaatgcccaagaagatg

SEQ ID NO: 166761 - DNA, 25 bp, Mus musculus
agcactgccgagacctttttctaga

SEQ ID NO: 166762 - DNA, 25 bp, Mus musculus
agcactgccgagtcctttttctaga

SEQ ID NO: 166763 - DNA, 25 bp, Mus musculus
agcactgccgttctctaaagtaccg

SEQ ID NO: 166764 - DNA, 25 bp, Mus musculus
agcactgccgttgtctaaagtaccg

SEQ ID NO: 166765 - DNA, 25 bp, Mus musculus
agcactgcctccaactaaagtggat

SEQ ID NO: 166766 - DNA, 25 bp, Mus musculus
agcactgcctcctactaaagtggat

SEQ ID NO: 166767 - DNA, 25 bp, Mus musculus
agcactgcgccgagggcagacccta

SEQ ID NO: 166768 - DNA, 25 bp, Mus musculus
agcactgcgccgtgggcagacccta

SEQ ID NO: 166769 - DNA, 25 bp, Mus musculus
agcactgcgcttaaactatgttttg

SEQ ID NO: 166770 - DNA, 25 bp, Mus musculus
agcactgcgctttaactatgttttg

SEQ ID NO: 166771 - DNA, 25 bp, Mus musculus
agcactgcggtcctcactaaacaaa

SEQ ID NO: 166772 - DNA, 25 bp, Mus musculus
agcactgcggtcgtcactaaacaaa

SEQ ID NO: 166773 - DNA, 25 bp, Mus musculus
agcactgcggtgacactgcctgggt

SEQ ID NO: 166774 - DNA, 25 bp, Mus musculus
agcactgcggtgtcactgcctgggt

SEQ ID NO: 166775 - DNA, 25 bp, Mus musculus
agcactgctatgagtgtctggctac

SEQ ID NO: 166776 - DNA, 25 bp, Mus musculus
agcactgctatgtgtgtctggctac

SEQ ID NO: 166777 - DNA, 25 bp, Mus musculus
agcactgctctcattgagattctag

SEQ ID NO: 166778 - DNA, 25 bp, Mus musculus
agcactgctctctttgagattctag

SEQ ID NO: 166779 - DNA, 25 bp, Mus musculus
agcactgctgagctttgacacgcca

SEQ ID NO: 166780 - DNA, 25 bp, Mus musculus
agcactgctgaggtttgacacgcca

SEQ ID NO: 166781 - DNA, 25 bp, Mus musculus
agcactgctgctcaccatggaggac

SEQ ID NO: 166782 - DNA, 25 bp, Mus musculus
agcactgctgctgaccatggaggac

SEQ ID NO: 166783 - DNA, 25 bp, Mus musculus
agcactgctggcacttgggttcttt

SEQ ID NO: 166784 - DNA, 25 bp, Mus musculus
agcactgctggctcttgggttcttt

SEQ ID NO: 166785 - DNA, 25 bp, Mus musculus
agcactgcttacacttcccagagtt

SEQ ID NO: 166786 - DNA, 25 bp, Mus musculus
agcactgcttactcttcccagagtt

SEQ ID NO: 166787 - DNA, 25 bp, Mus musculus
agcactgcttagcttctgaggtgtg

SEQ ID NO: 166788 - DNA, 25 bp, Mus musculus
agcactgcttaggttctgaggtgtg

SEQ ID NO: 166789 - DNA, 25 bp, Mus musculus
agcactgcttgaattagacctggaa

SEQ ID NO: 166790 - DNA, 25 bp, Mus musculus
agcactgcttgatttagacctggaa

SEQ ID NO: 166791 - DNA, 25 bp, Mus musculus
agcactggacataagctcagcatgt

SEQ ID NO: 166792 - DNA, 25 bp, Mus musculus
agcactggacattagctcagcatgt

SEQ ID NO: 166793 - DNA, 25 bp, Mus musculus
agcactggaccaagtgggtctggcc

SEQ ID NO: 166794 - DNA, 25 bp, Mus musculus
agcactggaccatgtgggtctggcc

SEQ ID NO: 166795 - DNA, 25 bp, Mus musculus
agcactggagagctttttgcaatat

SEQ ID NO: 166796 - DNA, 25 bp, Mus musculus
agcactggagaggtttttgcaatat

SEQ ID NO: 166797 - DNA, 25 bp, Mus musculus
agcactggagccagcaccggtggtg

SEQ ID NO: 166798 - DNA, 25 bp, Mus musculus
agcactggagcctgcaccggtggtg

SEQ ID NO: 166799 - DNA, 25 bp, Mus musculus
agcactggaggcaagcagctggata

SEQ ID NO: 166800 - DNA, 25 bp, Mus musculus
agcactggaggcagcccgtatttgt

SEQ ID NO: 166801 - DNA, 25 bp, Mus musculus
agcactggaggctagcagctggata

SEQ ID NO: 166802 - DNA, 25 bp, Mus musculus
agcactggaggctgcccgtatttgt

SEQ ID NO: 166803 - DNA, 25 bp, Mus musculus
agcactggatacaggtctttttaag

SEQ ID NO: 166804 - DNA, 25 bp, Mus musculus
agcactggatactggtctttttaag

SEQ ID NO: 166805 - DNA, 25 bp, Mus musculus
agcactggattcactgactctggac

SEQ ID NO: 166806 - DNA, 25 bp, Mus musculus
agcactggattccaccaagtttctc

SEQ ID NO: 166807 - DNA, 25 bp, Mus musculus
agcactggattcgaccaagtttctc

SEQ ID NO: 166808 - DNA, 25 bp, Mus musculus
agcactggattctctgactctggac

SEQ ID NO: 166809 - DNA, 25 bp, Mus musculus
agcactggcagtaggctttctgaaa

SEQ ID NO: 166810 - DNA, 25 bp, Mus musculus
agcactggcagttggctttctgaaa

SEQ ID NO: 166811 - DNA, 25 bp, Mus musculus
agcactggcatcactgtgtacacag

SEQ ID NO: 166812 - DNA, 25 bp, Mus musculus
agcactggcatctctgtgtacacag

SEQ ID NO: 166813 - DNA, 25 bp, Mus musculus
agcactggccagagtctcactgttg

SEQ ID NO: 166814 - DNA, 25 bp, Mus musculus
agcactggccagtgtctcactgttg

SEQ ID NO: 166815 - DNA, 25 bp, Mus musculus
agcactggccgtacttccagctgat

SEQ ID NO: 166816 - DNA, 25 bp, Mus musculus
agcactggccgttcttccagctgat

SEQ ID NO: 166817 - DNA, 25 bp, Mus musculus
agcactggcctcagtctcaggacat

SEQ ID NO: 166818 - DNA, 25 bp, Mus musculus
agcactggcctctgtctcaggacat

SEQ ID NO: 166819 - DNA, 25 bp, Mus musculus
agcactggcctgaaaacatctgaca

SEQ ID NO: 166820 - DNA, 25 bp, Mus musculus
agcactggcctgtaaacatctgaca

SEQ ID NO: 166821 - DNA, 25 bp, Mus musculus
agcactggctgacccttacagtatt

SEQ ID NO: 166822 - DNA, 25 bp, Mus musculus
agcactggctgagccttacagtatt

SEQ ID NO: 166823 - DNA, 25 bp, Mus musculus
agcactggcttgatcctttttagtt

SEQ ID NO: 166824 - DNA, 25 bp, Mus musculus
agcactggcttgttcctttttagtt

SEQ ID NO: 166825 - DNA, 25 bp, Mus musculus
agcactgggcagacatgctggccca

SEQ ID NO: 166826 - DNA, 25 bp, Mus musculus
agcactgggcagtcatgctggccca

SEQ ID NO: 166827 - DNA, 25 bp, Mus musculus
agcactgggcccatagttgctgggc

SEQ ID NO: 166828 - DNA, 25 bp, Mus musculus
agcactgggcccttagttgctgggc

SEQ ID NO: 166829 - DNA, 25 bp, Mus musculus
agcactgggccgacagggtactttc

SEQ ID NO: 166830 - DNA, 25 bp, Mus musculus
agcactgggccgtcagggtactttc

SEQ ID NO: 166831 - DNA, 25 bp, Mus musculus
agcactgggctaaactccatgaggt

SEQ ID NO: 166832 - DNA, 25 bp, Mus musculus
agcactgggctatactccatgaggt

SEQ ID NO: 166833 - DNA, 25 bp, Mus musculus
agcactgggtgcacaagtcatgaca

SEQ ID NO: 166834 - DNA, 25 bp, Mus musculus
agcactgggtgctcaagtcatgaca

SEQ ID NO: 166835 - DNA, 25 bp, Mus musculus
agcactggtcagcatgctcagcagt

SEQ ID NO: 166836 - DNA, 25 bp, Mus musculus
agcactggtcaggatgctcagcagt

SEQ ID NO: 166837 - DNA, 25 bp, Mus musculus
agcactggtccgaaagcgggcattc

SEQ ID NO: 166838 - DNA, 25 bp, Mus musculus
agcactggtccgtaagcgggcattc

SEQ ID NO: 166839 - DNA, 25 bp, Mus musculus
agcactggtgggatcattgactgtc

SEQ ID NO: 166840 - DNA, 25 bp, Mus musculus
agcactggtgggttcattgactgtc

SEQ ID NO: 166841 - DNA, 25 bp, Mus musculus
agcactggttgacatggccacatcc

SEQ ID NO: 166842 - DNA, 25 bp, Mus musculus
agcactggttgagatggccacatcc

SEQ ID NO: 166843 - DNA, 25 bp, Mus musculus
agcactggttgtcttgcaactaact

SEQ ID NO: 166844 - DNA, 25 bp, Mus musculus
agcactggttgtgttgcaactaact

SEQ ID NO: 166845 - DNA, 25 bp, Mus musculus
agcactgtacaaatgcactgaagtc

SEQ ID NO: 166846 - DNA, 25 bp, Mus musculus
agcactgtacaattgcactgaagtc

SEQ ID NO: 166847 - DNA, 25 bp, Mus musculus
agcactgtagttatcaaggcccagt

SEQ ID NO: 166848 - DNA, 25 bp, Mus musculus
agcactgtagttctctgggatctgt

SEQ ID NO: 166849 - DNA, 25 bp, Mus musculus
agcactgtagttgtctgggatctgt

SEQ ID NO: 166850 - DNA, 25 bp, Mus musculus
agcactgtagttttcaaggcccagt

SEQ ID NO: 166851 - DNA, 25 bp, Mus musculus
agcactgtcactctgggccctttat

SEQ ID NO: 166852 - DNA, 25 bp, Mus musculus
agcactgtcactgtgggccctttat

SEQ ID NO: 166853 - DNA, 25 bp, Mus musculus
agcactgtcatcatttagtagccaa

SEQ ID NO: 166854 - DNA, 25 bp, Mus musculus
agcactgtcatcttttagtagccaa

SEQ ID NO: 166855 - DNA, 25 bp, Mus musculus
agcactgtccttacagctcatgaat

SEQ ID NO: 166856 - DNA, 25 bp, Mus musculus
agcactgtcctttcagctcatgaat

SEQ ID NO: 166857 - DNA, 25 bp, Mus musculus
agcactgtcttcaggaagctcacgc

SEQ ID NO: 166858 - DNA, 25 bp, Mus musculus
agcactgtcttctggaagctcacgc

SEQ ID NO: 166859 - DNA, 25 bp, Mus musculus
agcactgtgaaactctctcctgtag

SEQ ID NO: 166860 - DNA, 25 bp, Mus musculus
agcactgtgaaagtctctcctgtag

SEQ ID NO: 166861 - DNA, 25 bp, Mus musculus
agcactgtgaccaatcttactggat

SEQ ID NO: 166862 - DNA, 25 bp, Mus musculus
agcactgtgaccatccatcttcctt

SEQ ID NO: 166863 - DNA, 25 bp, Mus musculus
agcactgtgacctatcttactggat

SEQ ID NO: 166864 - DNA, 25 bp, Mus musculus
agcactgtgaccttccatcttcctt

SEQ ID NO: 166865 - DNA, 25 bp, Mus musculus
agcactgtgactacatttggcgttt

SEQ ID NO: 166866 - DNA, 25 bp, Mus musculus
agcactgtgacttcatttggcgttt

SEQ ID NO: 166867 - DNA, 25 bp, Mus musculus
agcactgtgattagaaccaggaact

SEQ ID NO: 166868 - DNA, 25 bp, Mus musculus
agcactgtgatttgaaccaggaact

SEQ ID NO: 166869 - DNA, 25 bp, Mus musculus
agcactgtgcagatgtccaagggac

SEQ ID NO: 166870 - DNA, 25 bp, Mus musculus
agcactgtgcagattggatatttca

SEQ ID NO: 166871 - DNA, 25 bp, Mus musculus
agcactgtgcagttgtccaagggac

SEQ ID NO: 166872 - DNA, 25 bp, Mus musculus
agcactgtgcagtttggatatttca

SEQ ID NO: 166873 - DNA, 25 bp, Mus musculus
agcactgtgccacggatacatccct

SEQ ID NO: 166874 - DNA, 25 bp, Mus musculus
agcactgtgccagggatacatccct

SEQ ID NO: 166875 - DNA, 25 bp, Mus musculus
agcactgtgcctaaatggctcttag

SEQ ID NO: 166876 - DNA, 25 bp, Mus musculus
agcactgtgccttaatggctcttag

SEQ ID NO: 166877 - DNA, 25 bp, Mus musculus
agcactgtgctacgactgttgtcaa

SEQ ID NO: 166878 - DNA, 25 bp, Mus musculus
agcactgtgctaggactgttgtcaa

SEQ ID NO: 166879 - DNA, 25 bp, Mus musculus
agcactgtggacctttcttcaagta

SEQ ID NO: 166880 - DNA, 25 bp, Mus musculus
agcactgtggacgtttcttcaagta

SEQ ID NO: 166881 - DNA, 25 bp, Mus musculus
agcactgtggcccacttttggcgca

SEQ ID NO: 166882 - DNA, 25 bp, Mus musculus
agcactgtggccgacttttggcgca

SEQ ID NO: 166883 - DNA, 25 bp, Mus musculus
agcactgtggctcttgccctttgcc

SEQ ID NO: 166884 - DNA, 25 bp, Mus musculus
agcactgtggctgttgccctttgcc

SEQ ID NO: 166885 - DNA, 25 bp, Mus musculus
agcactgtggtgcactcttctatga

SEQ ID NO: 166886 - DNA, 25 bp, Mus musculus
agcactgtggtggactcttctatga

SEQ ID NO: 166887 - DNA, 25 bp, Mus musculus
agcactgtgtagctgtgtctgtttt

SEQ ID NO: 166888 - DNA, 25 bp, Mus musculus
agcactgtgtaggtgtgtctgtttt

SEQ ID NO: 166889 - DNA, 25 bp, Mus musculus
agcactgtgtccctgggaagcagca

SEQ ID NO: 166890 - DNA, 25 bp, Mus musculus
agcactgtgtccgtgggaagcagca

SEQ ID NO: 166891 - DNA, 25 bp, Mus musculus
agcactgtgtgacatctgcctaatg

SEQ ID NO: 166892 - DNA, 25 bp, Mus musculus
agcactgtgtgagatctgcctaatg

SEQ ID NO: 166893 - DNA, 25 bp, Mus musculus
agcactgtgttcagaatcaccgtag

SEQ ID NO: 166894 - DNA, 25 bp, Mus musculus
agcactgtgttctgaatcaccgtag

SEQ ID NO: 166895 - DNA, 25 bp, Mus musculus
agcactgttaaaattatccgaggca

SEQ ID NO: 166896 - DNA, 25 bp, Mus musculus
agcactgttaaatttatccgaggca

SEQ ID NO: 166897 - DNA, 25 bp, Mus musculus
agcactgttcatagccattctgtaa

SEQ ID NO: 166898 - DNA, 25 bp, Mus musculus
agcactgttcattgccattctgtaa

SEQ ID NO: 166899 - DNA, 25 bp, Mus musculus
agcactgttggtctggacattccac

SEQ ID NO: 166900 - DNA, 25 bp, Mus musculus
agcactgttggtgtggacattccac

SEQ ID NO: 166901 - DNA, 25 bp, Mus musculus
agcactgtttatcccacatctatta

SEQ ID NO: 166902 - DNA, 25 bp, Mus musculus
agcactgtttatgccacatctatta

SEQ ID NO: 166903 - DNA, 25 bp, Mus musculus
agcacttaacaactgacaccccaaa

SEQ ID NO: 166904 - DNA, 25 bp, Mus musculus
agcacttaacaagtgacaccccaaa

SEQ ID NO: 166905 - DNA, 25 bp, Mus musculus
agcacttaaggacctgcctagccca

SEQ ID NO: 166906 - DNA, 25 bp, Mus musculus
agcacttaaggagctgcctagccca

SEQ ID NO: 166907 - DNA, 25 bp, Mus musculus
agcacttacactctgtttaacctca

SEQ ID NO: 166908 - DNA, 25 bp, Mus musculus
agcacttacactgtgtttaacctca

SEQ ID NO: 166909 - DNA, 25 bp, Mus musculus
agcacttaccccagacaatggtttc

SEQ ID NO: 166910 - DNA, 25 bp, Mus musculus
agcacttacccctgacaatggtttc

SEQ ID NO: 166911 - DNA, 25 bp, Mus musculus
agcacttacctacctcgtgtgtggc

SEQ ID NO: 166912 - DNA, 25 bp, Mus musculus
agcacttacctagctcgtgtgtggc

SEQ ID NO: 166913 - DNA, 25 bp, Mus musculus
agcacttacgcccaccaggaaggat

SEQ ID NO: 166914 - DNA, 25 bp, Mus musculus
agcacttacgccgaccaggaaggat

SEQ ID NO: 166915 - DNA, 25 bp, Mus musculus
agcacttacggcaaggcgtcccgag

SEQ ID NO: 166916 - DNA, 25 bp, Mus musculus
agcacttacggctaggcgtcccgag

SEQ ID NO: 166917 - DNA, 25 bp, Mus musculus
agcacttacttcattctctagttct

SEQ ID NO: 166918 - DNA, 25 bp, Mus musculus
agcacttacttctttctctagttct

SEQ ID NO: 166919 - DNA, 25 bp, Mus musculus
agcacttacttgagtgccactcagc

SEQ ID NO: 166920 - DNA, 25 bp, Mus musculus
agcacttacttgtgtgccactcagc

SEQ ID NO: 166921 - DNA, 25 bp, Mus musculus
agcacttagaaaaaccactgcccca

SEQ ID NO: 166922 - DNA, 25 bp, Mus musculus
agcacttagaaataccactgcccca

SEQ ID NO: 166923 - DNA, 25 bp, Mus musculus
agcacttagactcatgtggcaagca

SEQ ID NO: 166924 - DNA, 25 bp, Mus musculus
agcacttagactgatgtggcaagca

SEQ ID NO: 166925 - DNA, 25 bp, Mus musculus
agcacttagagcagcctattctgta

SEQ ID NO: 166926 - DNA, 25 bp, Mus musculus
agcacttagagctgcctattctgta

SEQ ID NO: 166927 - DNA, 25 bp, Mus musculus
agcacttagcccatcctgacggcat

SEQ ID NO: 166928 - DNA, 25 bp, Mus musculus
agcacttagcccttcctgacggcat

SEQ ID NO: 166929 - DNA, 25 bp, Mus musculus
agcacttaggaaccttctccaacct

SEQ ID NO: 166930 - DNA, 25 bp, Mus musculus
agcacttaggaagcttctccaacct

SEQ ID NO: 166931 - DNA, 25 bp, Mus musculus
agcacttaggcacgcggatctgtgt

SEQ ID NO: 166932 - DNA, 25 bp, Mus musculus
agcacttaggcaggcggatctgtgt

SEQ ID NO: 166933 - DNA, 25 bp, Mus musculus
agcacttaggttcgcttagctgcag

SEQ ID NO: 166934 - DNA, 25 bp, Mus musculus
agcacttaggttggcttagctgcag

SEQ ID NO: 166935 - DNA, 25 bp, Mus musculus
agcacttatcaaactccaattccct

SEQ ID NO: 166936 - DNA, 25 bp, Mus musculus
agcacttatcaatctccaattccct

SEQ ID NO: 166937 - DNA, 25 bp, Mus musculus
agcacttatcgcaggaggtcttggg

SEQ ID NO: 166938 - DNA, 25 bp, Mus musculus
agcacttatcgctggaggtcttggg

SEQ ID NO: 166939 - DNA, 25 bp, Mus musculus
agcacttattccaagctactgttaa

SEQ ID NO: 166940 - DNA, 25 bp, Mus musculus
agcacttattcctagctactgttaa

SEQ ID NO: 166941 - DNA, 25 bp, Mus musculus
agcacttattgtacctccggaggat

SEQ ID NO: 166942 - DNA, 25 bp, Mus musculus
agcacttattgttcctccggaggat

SEQ ID NO: 166943 - DNA, 25 bp, Mus musculus
agcacttattttagcagccccattt

SEQ ID NO: 166944 - DNA, 25 bp, Mus musculus
agcacttatttttgcagccccattt

SEQ ID NO: 166945 - DNA, 25 bp, Mus musculus
agcacttcacaacactcaaggcaag

SEQ ID NO: 166946 - DNA, 25 bp, Mus musculus
agcacttcacaagactcaaggcaag

SEQ ID NO: 166947 - DNA, 25 bp, Mus musculus
agcacttcacctccacgaagggatg

SEQ ID NO: 166948 - DNA, 25 bp, Mus musculus
agcacttcacctgcacgaagggatg

SEQ ID NO: 166949 - DNA, 25 bp, Mus musculus
agcacttcatcgagggtggccggac

SEQ ID NO: 166950 - DNA, 25 bp, Mus musculus
agcacttcatcgtgggtggccggac

SEQ ID NO: 166951 - DNA, 25 bp, Mus musculus
agcacttccaccaggactcaagttg

SEQ ID NO: 166952 - DNA, 25 bp, Mus musculus
agcacttccacctggactcaagttg

SEQ ID NO: 166953 - DNA, 25 bp, Mus musculus
agcacttcccagcatgtgttttgaa

SEQ ID NO: 166954 - DNA, 25 bp, Mus musculus
agcacttcccaggatgtgttttgaa

SEQ ID NO: 166955 - DNA, 25 bp, Mus musculus
agcacttcctatctgccagcaattt

SEQ ID NO: 166956 - DNA, 25 bp, Mus musculus
agcacttcctatcttctcaggtcac

SEQ ID NO: 166957 - DNA, 25 bp, Mus musculus
agcacttcctatgtgccagcaattt

SEQ ID NO: 166958 - DNA, 25 bp, Mus musculus
agcacttcctatgttctcaggtcac

SEQ ID NO: 166959 - DNA, 25 bp, Mus musculus
agcacttcctgcagttacctggctt

SEQ ID NO: 166960 - DNA, 25 bp, Mus musculus
agcacttcctgctgttacctggctt

SEQ ID NO: 166961 - DNA, 25 bp, Mus musculus
agcacttcgccaaggccaggaaggt

SEQ ID NO: 166962 - DNA, 25 bp, Mus musculus
agcacttcgccatggccaggaaggt

SEQ ID NO: 166963 - DNA, 25 bp, Mus musculus
agcacttcggacagcgccccaggct

SEQ ID NO: 166964 - DNA, 25 bp, Mus musculus
agcacttcggactgcgccccaggct

SEQ ID NO: 166965 - DNA, 25 bp, Mus musculus
agcacttctaatatgtacgctcagt

SEQ ID NO: 166966 - DNA, 25 bp, Mus musculus
agcacttctaatttgtacgctcagt

SEQ ID NO: 166967 - DNA, 25 bp, Mus musculus
agcacttctactatcagcacaactt

SEQ ID NO: 166968 - DNA, 25 bp, Mus musculus
agcacttctactttcagcacaactt

SEQ ID NO: 166969 - DNA, 25 bp, Mus musculus
agcacttctcggatattgggccaac

SEQ ID NO: 166970 - DNA, 25 bp, Mus musculus
agcacttctcggttattgggccaac

SEQ ID NO: 166971 - DNA, 25 bp, Mus musculus
agcacttctctaattactctattgg

SEQ ID NO: 166972 - DNA, 25 bp, Mus musculus
agcacttctctatttactctattgg

SEQ ID NO: 166973 - DNA, 25 bp, Mus musculus
agcacttctgcacctcgggagcctg

SEQ ID NO: 166974 - DNA, 25 bp, Mus musculus
agcacttctgcagctcgggagcctg

SEQ ID NO: 166975 - DNA, 25 bp, Mus musculus
agcacttctgctcctttgactgcga

SEQ ID NO: 166976 - DNA, 25 bp, Mus musculus
agcacttctgctgctttgactgcga

SEQ ID NO: 166977 - DNA, 25 bp, Mus musculus
agcacttcttggaggcttctccggg

SEQ ID NO: 166978 - DNA, 25 bp, Mus musculus
agcacttcttggtggcttctccggg

SEQ ID NO: 166979 - DNA, 25 bp, Mus musculus
agcacttgacgcacttaaagaggaa

SEQ ID NO: 166980 - DNA, 25 bp, Mus musculus
agcacttgacgctcttaaagaggaa

SEQ ID NO: 166981 - DNA, 25 bp, Mus musculus
agcacttgatgcatttctagctcaa

SEQ ID NO: 166982 - DNA, 25 bp, Mus musculus
agcacttgatgcttttctagctcaa

SEQ ID NO: 166983 - DNA, 25 bp, Mus musculus
agcacttgatgtattatctttttgg

SEQ ID NO: 166984 - DNA, 25 bp, Mus musculus
agcacttgatgttttatctttttgg

SEQ ID NO: 166985 - DNA, 25 bp, Mus musculus
agcacttgcagccatgtgtgctaag

SEQ ID NO: 166986 - DNA, 25 bp, Mus musculus
agcacttgcagcgatgtgtgctaag

SEQ ID NO: 166987 - DNA, 25 bp, Mus musculus
agcacttgcccgccactgaggtagg

SEQ ID NO: 166988 - DNA, 25 bp, Mus musculus
agcacttgcccggcactgaggtagg

SEQ ID NO: 166989 - DNA, 25 bp, Mus musculus
agcacttgcctaccttgctggaagc

SEQ ID NO: 166990 - DNA, 25 bp, Mus musculus
agcacttgcctagcttgctggaagc

SEQ ID NO: 166991 - DNA, 25 bp, Mus musculus
agcacttgcctgaatatcctggaaa

SEQ ID NO: 166992 - DNA, 25 bp, Mus musculus
agcacttgcctgtatatcctggaaa

SEQ ID NO: 166993 - DNA, 25 bp, Mus musculus
agcacttgctgcatgggttcaattc

SEQ ID NO: 166994 - DNA, 25 bp, Mus musculus
agcacttgctgccttcaaatttatg

SEQ ID NO: 166995 - DNA, 25 bp, Mus musculus
agcacttgctgcgttcaaatttatg

SEQ ID NO: 166996 - DNA, 25 bp, Mus musculus
agcacttgctgcttgggttcaattc

SEQ ID NO: 166997 - DNA, 25 bp, Mus musculus
agcacttgctgtcatccagatgtcg

SEQ ID NO: 166998 - DNA, 25 bp, Mus musculus
agcacttgctgtgatccagatgtcg

SEQ ID NO: 166999 - DNA, 25 bp, Mus musculus
agcacttgcttcactggcacaggac

SEQ ID NO: 167000 - DNA, 25 bp, Mus musculus
agcacttgcttctctggcacaggac

SEQ ID NO: 167001 - DNA, 25 bp, Mus musculus
agcacttggagaaccccagcttggg

SEQ ID NO: 167002 - DNA, 25 bp, Mus musculus
agcacttggagatccccagcttggg

SEQ ID NO: 167003 - DNA, 25 bp, Mus musculus
agcacttggatacagttaacttata

SEQ ID NO: 167004 - DNA, 25 bp, Mus musculus
agcacttggatagagttaacttata

SEQ ID NO: 167005 - DNA, 25 bp, Mus musculus
agcacttggcatctctgtggacttc

SEQ ID NO: 167006 - DNA, 25 bp, Mus musculus
agcacttggcatgtctgtggacttc

SEQ ID NO: 167007 - DNA, 25 bp, Mus musculus
agcacttgggatcactgtcctgcgg

SEQ ID NO: 167008 - DNA, 25 bp, Mus musculus
agcacttgggatgactgtcctgcgg

SEQ ID NO: 167009 - DNA, 25 bp, Mus musculus
agcacttggtaccacattgtgtcta

SEQ ID NO: 167010 - DNA, 25 bp, Mus musculus
agcacttggtacgacattgtgtcta

SEQ ID NO: 167011 - DNA, 25 bp, Mus musculus
agcacttggtgacgataaggccaga

SEQ ID NO: 167012 - DNA, 25 bp, Mus musculus
agcacttggtgaggataaggccaga

SEQ ID NO: 167013 - DNA, 25 bp, Mus musculus
agcacttggtggagtaactgttcaa

SEQ ID NO: 167014 - DNA, 25 bp, Mus musculus
agcacttggtggtgtaactgttcaa

SEQ ID NO: 167015 - DNA, 25 bp, Mus musculus
agcacttgtggacagccagggacca

SEQ ID NO: 167016 - DNA, 25 bp, Mus musculus
agcacttgtggagagccagggacca

SEQ ID NO: 167017 - DNA, 25 bp, Mus musculus
agcacttgtgttacctcagggcctt

SEQ ID NO: 167018 - DNA, 25 bp, Mus musculus
agcacttgtgtttcctcagggcctt

SEQ ID NO: 167019 - DNA, 25 bp, Mus musculus
agcacttgtttaccgagcattttcc

SEQ ID NO: 167020 - DNA, 25 bp, Mus musculus
agcacttgtttagcgagcattttcc

SEQ ID NO: 167021 - DNA, 25 bp, Mus musculus
agcacttgtttgagtctgtagggac

SEQ ID NO: 167022 - DNA, 25 bp, Mus musculus
agcacttgtttgtgtctgtagggac

SEQ ID NO: 167023 - DNA, 25 bp, Mus musculus
agcactttacacacattccatggaa

SEQ ID NO: 167024 - DNA, 25 bp, Mus musculus
agcactttacactcattccatggaa

SEQ ID NO: 167025 - DNA, 25 bp, Mus musculus
agcactttacggcatggtacactga

SEQ ID NO: 167026 - DNA, 25 bp, Mus musculus
agcactttacgggatggtacactga

SEQ ID NO: 167027 - DNA, 25 bp, Mus musculus
agcactttagttatctactggttca

SEQ ID NO: 167028 - DNA, 25 bp, Mus musculus
agcactttagttttctactggttca

SEQ ID NO: 167029 - DNA, 25 bp, Mus musculus
agcactttatgcagtctgtaatgga

SEQ ID NO: 167030 - DNA, 25 bp, Mus musculus
agcactttatgctgtctgtaatgga

SEQ ID NO: 167031 - DNA, 25 bp, Mus musculus
agcactttcatgaatatgtagcaga

SEQ ID NO: 167032 - DNA, 25 bp, Mus musculus
agcactttcatgtatatgtagcaga

SEQ ID NO: 167033 - DNA, 25 bp, Mus musculus
agcactttccagcagtcctatggag

SEQ ID NO: 167034 - DNA, 25 bp, Mus musculus
agcactttccaggagtcctatggag

SEQ ID NO: 167035 - DNA, 25 bp, Mus musculus
agcactttcgcaaggagctggtgaa

SEQ ID NO: 167036 - DNA, 25 bp, Mus musculus
agcactttcgcatggagctggtgaa

SEQ ID NO: 167037 - DNA, 25 bp, Mus musculus
agcactttcggaccagggactagac

SEQ ID NO: 167038 - DNA, 25 bp, Mus musculus
agcactttcggagcagggactagac

SEQ ID NO: 167039 - DNA, 25 bp, Mus musculus
agcactttcgtaattatttggttat

SEQ ID NO: 167040 - DNA, 25 bp, Mus musculus
agcactttcgtatttatttggttat

SEQ ID NO: 167041 - DNA, 25 bp, Mus musculus
agcactttctagagctgcttgctcg

SEQ ID NO: 167042 - DNA, 25 bp, Mus musculus
agcactttctagtgctgcttgctcg

SEQ ID NO: 167043 - DNA, 25 bp, Mus musculus
agcactttctctaataagtctcttt

SEQ ID NO: 167044 - DNA, 25 bp, Mus musculus
agcactttctctcgtatgactcttt

SEQ ID NO: 167045 - DNA, 25 bp, Mus musculus
agcactttctctggtatgactcttt

SEQ ID NO: 167046 - DNA, 25 bp, Mus musculus
agcactttctcttataagtctcttt

SEQ ID NO: 167047 - DNA, 25 bp, Mus musculus
agcactttcttaactttatggcact

SEQ ID NO: 167048 - DNA, 25 bp, Mus musculus
agcactttcttatctttatggcact

SEQ ID NO: 167049 - DNA, 25 bp, Mus musculus
agcactttgaagctgactcctcaag

SEQ ID NO: 167050 - DNA, 25 bp, Mus musculus
agcactttgaaggtgactcctcaag

SEQ ID NO: 167051 - DNA, 25 bp, Mus musculus
agcactttgaataatagccccgaga

SEQ ID NO: 167052 - DNA, 25 bp, Mus musculus
agcactttgaattatagccccgaga

SEQ ID NO: 167053 - DNA, 25 bp, Mus musculus
agcactttgagaccaagcaccctaa

SEQ ID NO: 167054 - DNA, 25 bp, Mus musculus
agcactttgagagcaagcaccctaa

SEQ ID NO: 167055 - DNA, 25 bp, Mus musculus
agcactttgccccaaaagctgagag

SEQ ID NO: 167056 - DNA, 25 bp, Mus musculus
agcactttgcccgaaaagctgagag

SEQ ID NO: 167057 - DNA, 25 bp, Mus musculus
agcactttgcctacaactccatgca

SEQ ID NO: 167058 - DNA, 25 bp, Mus musculus
agcactttgccttcaactccatgca

SEQ ID NO: 167059 - DNA, 25 bp, Mus musculus
agcactttgcgtcagtgtcgtactg

SEQ ID NO: 167060 - DNA, 25 bp, Mus musculus
agcactttgcgtgagtgtcgtactg

SEQ ID NO: 167061 - DNA, 25 bp, Mus musculus
agcactttgctccatcgctatggaa

SEQ ID NO: 167062 - DNA, 25 bp, Mus musculus
agcactttgctcgatcgctatggaa

SEQ ID NO: 167063 - DNA, 25 bp, Mus musculus
agcactttggagatataaaccactt

SEQ ID NO: 167064 - DNA, 25 bp, Mus musculus
agcactttggagttataaaccactt

SEQ ID NO: 167065 - DNA, 25 bp, Mus musculus
agcactttgtaaactgcgggtttca

SEQ ID NO: 167066 - DNA, 25 bp, Mus musculus
agcactttgtaatctgcgggtttca

SEQ ID NO: 167067 - DNA, 25 bp, Mus musculus
agcactttgtatctggtttactgga

SEQ ID NO: 167068 - DNA, 25 bp, Mus musculus
agcactttgtatgtggtttactgga

SEQ ID NO: 167069 - DNA, 25 bp, Mus musculus
agcactttgtctcttattgtcagca

SEQ ID NO: 167070 - DNA, 25 bp, Mus musculus
agcactttgtctgttattgtcagca

SEQ ID NO: 167071 - DNA, 25 bp, Mus musculus
agcacttttccaaggctctgcttca

SEQ ID NO: 167072 - DNA, 25 bp, Mus musculus
agcacttttccatggctctgcttca

SEQ ID NO: 167073 - DNA, 25 bp, Mus musculus
agcacttttgctcaatgtctgtatg

SEQ ID NO: 167074 - DNA, 25 bp, Mus musculus
agcacttttgctgaatgtctgtatg

SEQ ID NO: 167075 - DNA, 25 bp, Mus musculus
agcacttttgtcctgtaactgtaga

SEQ ID NO: 167076 - DNA, 25 bp, Mus musculus
agcacttttgtcgtgtaactgtaga

SEQ ID NO: 167077 - DNA, 25 bp, Mus musculus
agcacttttgttactaagtatcacc

SEQ ID NO: 167078 - DNA, 25 bp, Mus musculus
agcacttttgtttctaagtatcacc

SEQ ID NO: 167079 - DNA, 25 bp, Mus musculus
agcagaaaaatacccatccttcctg

SEQ ID NO: 167080 - DNA, 25 bp, Mus musculus
agcagaaaaatagccatccttcctg

SEQ ID NO: 167081 - DNA, 25 bp, Mus musculus
agcagaaaacttcctcgccatgtcc

SEQ ID NO: 167082 - DNA, 25 bp, Mus musculus
agcagaaaacttgctcgccatgtcc

SEQ ID NO: 167083 - DNA, 25 bp, Mus musculus
agcagaaaagctaactccttccgca

SEQ ID NO: 167084 - DNA, 25 bp, Mus musculus
agcagaaaagcttactccttccgca

SEQ ID NO: 167085 - DNA, 25 bp, Mus musculus
agcagaaacagcacacttccacaag

SEQ ID NO: 167086 - DNA, 25 bp, Mus musculus
agcagaaacagctcacttccacaag

SEQ ID NO: 167087 - DNA, 25 bp, Mus musculus
agcagaaaccccaagattccatcct

SEQ ID NO: 167088 - DNA, 25 bp, Mus musculus
agcagaaacccctagattccatcct

SEQ ID NO: 167089 - DNA, 25 bp, Mus musculus
agcagaaagctgatggtctcctcaa

SEQ ID NO: 167090 - DNA, 25 bp, Mus musculus
agcagaaagctgttggtctcctcaa

SEQ ID NO: 167091 - DNA, 25 bp, Mus musculus
agcagaaaggccctcctttacccag

SEQ ID NO: 167092 - DNA, 25 bp, Mus musculus
agcagaaaggccgtcctttacccag

SEQ ID NO: 167093 - DNA, 25 bp, Mus musculus
agcagaaagtatagtgttcttcact

SEQ ID NO: 167094 - DNA, 25 bp, Mus musculus
agcagaaagtattgtgttcttcact

SEQ ID NO: 167095 - DNA, 25 bp, Mus musculus
agcagaaagtcaaggcacagcagat

SEQ ID NO: 167096 - DNA, 25 bp, Mus musculus
agcagaaagtcatggcacagcagat

SEQ ID NO: 167097 - DNA, 25 bp, Mus musculus
agcagaaatctaatccttttcacag

SEQ ID NO: 167098 - DNA, 25 bp, Mus musculus
agcagaaatctattccttttcacag

SEQ ID NO: 167099 - DNA, 25 bp, Mus musculus
agcagaaattctcgcagctaggaaa

SEQ ID NO: 167100 - DNA, 25 bp, Mus musculus
agcagaaattctggcagctaggaaa

SEQ ID NO: 167101 - DNA, 25 bp, Mus musculus
agcagaaatttcaaaccagcccctc

SEQ ID NO: 167102 - DNA, 25 bp, Mus musculus
agcagaaatttctaaccagcccctc

SEQ ID NO: 167103 - DNA, 25 bp, Mus musculus
agcagaacaacacctagttgcccct

SEQ ID NO: 167104 - DNA, 25 bp, Mus musculus
agcagaacaacagctagttgcccct

SEQ ID NO: 167105 - DNA, 25 bp, Mus musculus
agcagaacccagcttttgctcaggt

SEQ ID NO: 167106 - DNA, 25 bp, Mus musculus
agcagaacccaggttttgctcaggt

SEQ ID NO: 167107 - DNA, 25 bp, Mus musculus
agcagaaccgcgaccttttgctagt

SEQ ID NO: 167108 - DNA, 25 bp, Mus musculus
agcagaaccgcgtccttttgctagt

SEQ ID NO: 167109 - DNA, 25 bp, Mus musculus
agcagaacctggattcagatggtcc

SEQ ID NO: 167110 - DNA, 25 bp, Mus musculus
agcagaacctggtttcagatggtcc

SEQ ID NO: 167111 - DNA, 25 bp, Mus musculus
agcagaacctttcgtcatgccagcg

SEQ ID NO: 167112 - DNA, 25 bp, Mus musculus
agcagaacctttggtcatgccagcg

SEQ ID NO: 167113 - DNA, 25 bp, Mus musculus
agcagaactcctcaagcctacatgt

SEQ ID NO: 167114 - DNA, 25 bp, Mus musculus
agcagaactcctgaagcctacatgt

SEQ ID NO: 167115 - DNA, 25 bp, Mus musculus
agcagaactctaaacccctaataag

SEQ ID NO: 167116 - DNA, 25 bp, Mus musculus
agcagaactctatacccctaataag

SEQ ID NO: 167117 - DNA, 25 bp, Mus musculus
agcagaactctcagtgttcaagacc

SEQ ID NO: 167118 - DNA, 25 bp, Mus musculus
agcagaactctctgtgttcaagacc

SEQ ID NO: 167119 - DNA, 25 bp, Mus musculus
agcagaactcttactaggcatagga

SEQ ID NO: 167120 - DNA, 25 bp, Mus musculus
agcagaactcttctctgtcagtcca

SEQ ID NO: 167121 - DNA, 25 bp, Mus musculus
agcagaactcttgtctgtcagtcca

SEQ ID NO: 167122 - DNA, 25 bp, Mus musculus
agcagaactctttctaggcatagga

SEQ ID NO: 167123 - DNA, 25 bp, Mus musculus
agcagaactgcaacctggtggcaag

SEQ ID NO: 167124 - DNA, 25 bp, Mus musculus
agcagaactgcatcctggtggcaag

SEQ ID NO: 167125 - DNA, 25 bp, Mus musculus
agcagaactgctcttgttagacaag

SEQ ID NO: 167126 - DNA, 25 bp, Mus musculus
agcagaactgctgttgttagacaag

SEQ ID NO: 167127 - DNA, 25 bp, Mus musculus
agcagaactttcattcgagaagtaa

SEQ ID NO: 167128 - DNA, 25 bp, Mus musculus
agcagaactttctttcgagaagtaa

SEQ ID NO: 167129 - DNA, 25 bp, Mus musculus
agcagaagacttccaaaccctttaa

SEQ ID NO: 167130 - DNA, 25 bp, Mus musculus
agcagaagacttgcaaaccctttaa

SEQ ID NO: 167131 - DNA, 25 bp, Mus musculus
agcagaagagctaaattgtgttttc

SEQ ID NO: 167132 - DNA, 25 bp, Mus musculus
agcagaagagctcttcgcctctgtg

SEQ ID NO: 167133 - DNA, 25 bp, Mus musculus
agcagaagagctgttcgcctctgtg

SEQ ID NO: 167134 - DNA, 25 bp, Mus musculus
agcagaagagcttaattgtgttttc

SEQ ID NO: 167135 - DNA, 25 bp, Mus musculus
agcagaagcactatgctgccaagcc

SEQ ID NO: 167136 - DNA, 25 bp, Mus musculus
agcagaagcactttgctgccaagcc

SEQ ID NO: 167137 - DNA, 25 bp, Mus musculus
agcagaagcaggcacatttctcagt

SEQ ID NO: 167138 - DNA, 25 bp, Mus musculus
agcagaagcagggacatttctcagt

SEQ ID NO: 167139 - DNA, 25 bp, Mus musculus
agcagaagcgttacgatttcaaatt

SEQ ID NO: 167140 - DNA, 25 bp, Mus musculus
agcagaagcgtttcgatttcaaatt

SEQ ID NO: 167141 - DNA, 25 bp, Mus musculus
agcagaaggaccaggcgttcgcaca

SEQ ID NO: 167142 - DNA, 25 bp, Mus musculus
agcagaaggacctggcgttcgcaca

SEQ ID NO: 167143 - DNA, 25 bp, Mus musculus
agcagaaggcttctctattggtgat

SEQ ID NO: 167144 - DNA, 25 bp, Mus musculus
agcagaaggcttgtctattggtgat

SEQ ID NO: 167145 - DNA, 25 bp, Mus musculus
agcagaagggtcacctcagatcaga

SEQ ID NO: 167146 - DNA, 25 bp, Mus musculus
agcagaagggtctcctcagatcaga

SEQ ID NO: 167147 - DNA, 25 bp, Mus musculus
agcagaagtacaccttggtctttat

SEQ ID NO: 167148 - DNA, 25 bp, Mus musculus
agcagaagtacagcttggtctttat

SEQ ID NO: 167149 - DNA, 25 bp, Mus musculus
agcagaagtctcctatccaggccat

SEQ ID NO: 167150 - DNA, 25 bp, Mus musculus
agcagaagtctcgtatccaggccat

SEQ ID NO: 167151 - DNA, 25 bp, Mus musculus
agcagaagtggaattagttgttcaa

SEQ ID NO: 167152 - DNA, 25 bp, Mus musculus
agcagaagtggatttagttgttcaa

SEQ ID NO: 167153 - DNA, 25 bp, Mus musculus
agcagaatcccaagggcacgcctgg

SEQ ID NO: 167154 - DNA, 25 bp, Mus musculus
agcagaatcccaaggtgtctctcca

SEQ ID NO: 167155 - DNA, 25 bp, Mus musculus
agcagaatcccatgggcacgcctgg

SEQ ID NO: 167156 - DNA, 25 bp, Mus musculus
agcagaatcccatggtgtctctcca

SEQ ID NO: 167157 - DNA, 25 bp, Mus musculus
agcagaatctacctgttactcggat

SEQ ID NO: 167158 - DNA, 25 bp, Mus musculus
agcagaatctacgtgttactcggat

SEQ ID NO: 167159 - DNA, 25 bp, Mus musculus
agcagaatctctacacatttcctat

SEQ ID NO: 167160 - DNA, 25 bp, Mus musculus
agcagaatctcttcacatttcctat

SEQ ID NO: 167161 - DNA, 25 bp, Mus musculus
agcagaatctgtctacacgtcccta

SEQ ID NO: 167162 - DNA, 25 bp, Mus musculus
agcagaatctgtgtacacgtcccta

SEQ ID NO: 167163 - DNA, 25 bp, Mus musculus
agcagaatgcatcggacatttgtcc

SEQ ID NO: 167164 - DNA, 25 bp, Mus musculus
agcagaatgcatgggacatttgtcc

SEQ ID NO: 167165 - DNA, 25 bp, Mus musculus
agcagaatgtcacaatcctcgcacc

SEQ ID NO: 167166 - DNA, 25 bp, Mus musculus
agcagaatgtcagaatcctcgcacc

SEQ ID NO: 167167 - DNA, 25 bp, Mus musculus
agcagaatgttcagtaattacccag

SEQ ID NO: 167168 - DNA, 25 bp, Mus musculus
agcagaatgttctgtaattacccag

SEQ ID NO: 167169 - DNA, 25 bp, Mus musculus
agcagacaaaccagagcaagtgctt

SEQ ID NO: 167170 - DNA, 25 bp, Mus musculus
agcagacaaacctgagcaagtgctt

SEQ ID NO: 167171 - DNA, 25 bp, Mus musculus
agcagacaactccttgtcagaagaa

SEQ ID NO: 167172 - DNA, 25 bp, Mus musculus
agcagacaactcgttgtcagaagaa

SEQ ID NO: 167173 - DNA, 25 bp, Mus musculus
agcagacaagaaatccagtaagact

SEQ ID NO: 167174 - DNA, 25 bp, Mus musculus
agcagacaagaattccagtaagact

SEQ ID NO: 167175 - DNA, 25 bp, Mus musculus
agcagacacaggcagaccacaggcc

SEQ ID NO: 167176 - DNA, 25 bp, Mus musculus
agcagacacagggagaccacaggcc

SEQ ID NO: 167177 - DNA, 25 bp, Mus musculus
agcagacacatcaggcccacgagga

SEQ ID NO: 167178 - DNA, 25 bp, Mus musculus
agcagacacatctggcccacgagga

SEQ ID NO: 167179 - DNA, 25 bp, Mus musculus
agcagacaccatcagcttgcgttgt

SEQ ID NO: 167180 - DNA, 25 bp, Mus musculus
agcagacaccatgagcttgcgttgt

SEQ ID NO: 167181 - DNA, 25 bp, Mus musculus
agcagacacctgcagcattcttatt

SEQ ID NO: 167182 - DNA, 25 bp, Mus musculus
agcagacacctggagcattcttatt

SEQ ID NO: 167183 - DNA, 25 bp, Mus musculus
agcagacacgacaccagtgtcagag

SEQ ID NO: 167184 - DNA, 25 bp, Mus musculus
agcagacacgactccagtgtcagag

SEQ ID NO: 167185 - DNA, 25 bp, Mus musculus
agcagacactatcttcactgaccct

SEQ ID NO: 167186 - DNA, 25 bp, Mus musculus
agcagacactatgttcactgaccct

SEQ ID NO: 167187 - DNA, 25 bp, Mus musculus
agcagacactggactttgagcccct

SEQ ID NO: 167188 - DNA, 25 bp, Mus musculus
agcagacactggtctttgagcccct

SEQ ID NO: 167189 - DNA, 25 bp, Mus musculus
agcagacacttcagaccatcaagtc

SEQ ID NO: 167190 - DNA, 25 bp, Mus musculus
agcagacacttctgaccatcaagtc

SEQ ID NO: 167191 - DNA, 25 bp, Mus musculus
agcagacacttgctgagcagctcca

SEQ ID NO: 167192 - DNA, 25 bp, Mus musculus
agcagacacttggtgagcagctcca

SEQ ID NO: 167193 - DNA, 25 bp, Mus musculus
agcagacactttcggcacagctcat

SEQ ID NO: 167194 - DNA, 25 bp, Mus musculus
agcagacactttgggcacagctcat

SEQ ID NO: 167195 - DNA, 25 bp, Mus musculus
agcagacagaccatccttgtaatgc

SEQ ID NO: 167196 - DNA, 25 bp, Mus musculus
agcagacagaccttccttgtaatgc

SEQ ID NO: 167197 - DNA, 25 bp, Mus musculus
agcagacagatgaccgtaagttcca

SEQ ID NO: 167198 - DNA, 25 bp, Mus musculus
agcagacagatgtccgtaagttcca

SEQ ID NO: 167199 - DNA, 25 bp, Mus musculus
agcagacagcttcttccacagcagg

SEQ ID NO: 167200 - DNA, 25 bp, Mus musculus
agcagacagcttgttccacagcagg

SEQ ID NO: 167201 - DNA, 25 bp, Mus musculus
agcagacaggtacaagatggagcct

SEQ ID NO: 167202 - DNA, 25 bp, Mus musculus
agcagacaggtagaagatggagcct

SEQ ID NO: 167203 - DNA, 25 bp, Mus musculus
agcagacaggtgctctctgagtcct

SEQ ID NO: 167204 - DNA, 25 bp, Mus musculus
agcagacaggtggtctctgagtcct

SEQ ID NO: 167205 - DNA, 25 bp, Mus musculus
agcagacagtccatccgcatggcaa

SEQ ID NO: 167206 - DNA, 25 bp, Mus musculus
agcagacagtccttccgcatggcaa

SEQ ID NO: 167207 - DNA, 25 bp, Mus musculus
agcagacagtgtccgctcagttgtc

SEQ ID NO: 167208 - DNA, 25 bp, Mus musculus
agcagacagtgtgcgctcagttgtc

SEQ ID NO: 167209 - DNA, 25 bp, Mus musculus
agcagacatccgcacaattcattgt

SEQ ID NO: 167210 - DNA, 25 bp, Mus musculus
agcagacatccggacaattcattgt

SEQ ID NO: 167211 - DNA, 25 bp, Mus musculus
agcagacatctgatccatgcactag

SEQ ID NO: 167212 - DNA, 25 bp, Mus musculus
agcagacatctgttccatgcactag

SEQ ID NO: 167213 - DNA, 25 bp, Mus musculus
agcagacatcttctgtgcgtgttac

SEQ ID NO: 167214 - DNA, 25 bp, Mus musculus
agcagacatcttgtgtgcgtgttac

SEQ ID NO: 167215 - DNA, 25 bp, Mus musculus
agcagacatgcaatgactgtgacat

SEQ ID NO: 167216 - DNA, 25 bp, Mus musculus
agcagacatgcattgactgtgacat

SEQ ID NO: 167217 - DNA, 25 bp, Mus musculus
agcagaccagccagatgcagtcagt

SEQ ID NO: 167218 - DNA, 25 bp, Mus musculus
agcagaccagcctgatgcagtcagt

SEQ ID NO: 167219 - DNA, 25 bp, Mus musculus
agcagacccattacagacactcgaa

SEQ ID NO: 167220 - DNA, 25 bp, Mus musculus
agcagacccatttcagacactcgaa

SEQ ID NO: 167221 - DNA, 25 bp, Mus musculus
agcagaccccaacaggcagaagaca

SEQ ID NO: 167222 - DNA, 25 bp, Mus musculus
agcagaccccaagaggcagaagaca

SEQ ID NO: 167223 - DNA, 25 bp, Mus musculus
agcagaccctacacacgtatgtttg

SEQ ID NO: 167224 - DNA, 25 bp, Mus musculus
agcagaccctactcacgtatgtttg

SEQ ID NO: 167225 - DNA, 25 bp, Mus musculus
agcagaccctcgctgtggccaatcc

SEQ ID NO: 167226 - DNA, 25 bp, Mus musculus
agcagaccctcggtgtggccaatcc

SEQ ID NO: 167227 - DNA, 25 bp, Mus musculus
agcagaccctttagttgtccaccag

SEQ ID NO: 167228 - DNA, 25 bp, Mus musculus
agcagaccctttcagtcatttcaca

SEQ ID NO: 167229 - DNA, 25 bp, Mus musculus
agcagaccctttgagtcatttcaca

SEQ ID NO: 167230 - DNA, 25 bp, Mus musculus
agcagacccttttgttgtccaccag

SEQ ID NO: 167231 - DNA, 25 bp, Mus musculus
agcagaccgacacacttaagcttca

SEQ ID NO: 167232 - DNA, 25 bp, Mus musculus
agcagaccgacagacttaagcttca

SEQ ID NO: 167233 - DNA, 25 bp, Mus musculus
agcagacctggcagtcaccctgcaa

SEQ ID NO: 167234 - DNA, 25 bp, Mus musculus
agcagacctggctgtcaccctgcaa

SEQ ID NO: 167235 - DNA, 25 bp, Mus musculus
agcagaccttgcctcacataagagt

SEQ ID NO: 167236 - DNA, 25 bp, Mus musculus
agcagaccttgcgtcacataagagt

SEQ ID NO: 167237 - DNA, 25 bp, Mus musculus
agcagacgaactctatcacgtggaa

SEQ ID NO: 167238 - DNA, 25 bp, Mus musculus
agcagacgaactgtatcacgtggaa

SEQ ID NO: 167239 - DNA, 25 bp, Mus musculus
agcagacgccagcacatggctcttg

SEQ ID NO: 167240 - DNA, 25 bp, Mus musculus
agcagacgccaggacatggctcttg

SEQ ID NO: 167241 - DNA, 25 bp, Mus musculus
agcagacgccggacgatgtctactc

SEQ ID NO: 167242 - DNA, 25 bp, Mus musculus
agcagacgccggtcgatgtctactc

SEQ ID NO: 167243 - DNA, 25 bp, Mus musculus
agcagacgcgcaccaagcaggcaga

SEQ ID NO: 167244 - DNA, 25 bp, Mus musculus
agcagacgcgcagcaagcaggcaga

SEQ ID NO: 167245 - DNA, 25 bp, Mus musculus
agcagacgctagctcaggatgctca

SEQ ID NO: 167246 - DNA, 25 bp, Mus musculus
agcagacgctaggtcaggatgctca

SEQ ID NO: 167247 - DNA, 25 bp, Mus musculus
agcagacggtctaagaaccttcaca

SEQ ID NO: 167248 - DNA, 25 bp, Mus musculus
agcagacggtcttagaaccttcaca

SEQ ID NO: 167249 - DNA, 25 bp, Mus musculus
agcagacgtcttctgtgatcacaat

SEQ ID NO: 167250 - DNA, 25 bp, Mus musculus
agcagacgtcttgtgtgatcacaat

SEQ ID NO: 167251 - DNA, 25 bp, Mus musculus
agcagacgtgatcgcttcacatcaa

SEQ ID NO: 167252 - DNA, 25 bp, Mus musculus
agcagacgtgatggcttcacatcaa

SEQ ID NO: 167253 - DNA, 25 bp, Mus musculus
agcagacgtttacatttgcacctct

SEQ ID NO: 167254 - DNA, 25 bp, Mus musculus
agcagacgtttagatttgcacctct

SEQ ID NO: 167255 - DNA, 25 bp, Mus musculus
agcagactatgtagctcatgccacc

SEQ ID NO: 167256 - DNA, 25 bp, Mus musculus
agcagactatgttgctcatgccacc

SEQ ID NO: 167257 - DNA, 25 bp, Mus musculus
agcagactccaccaaggaacccttt

SEQ ID NO: 167258 - DNA, 25 bp, Mus musculus
agcagactccacgaaggaacccttt

SEQ ID NO: 167259 - DNA, 25 bp, Mus musculus
agcagactccatacctgttgtgttt

SEQ ID NO: 167260 - DNA, 25 bp, Mus musculus
agcagactccatcacgttcgtgaca

SEQ ID NO: 167261 - DNA, 25 bp, Mus musculus
agcagactccatcagcaaggcaagt

SEQ ID NO: 167262 - DNA, 25 bp, Mus musculus
agcagactccatgacgttcgtgaca

SEQ ID NO: 167263 - DNA, 25 bp, Mus musculus
agcagactccatgagcaaggcaagt

SEQ ID NO: 167264 - DNA, 25 bp, Mus musculus
agcagactccattcctgttgtgttt

SEQ ID NO: 167265 - DNA, 25 bp, Mus musculus
agcagactcctcacatctctggtaa

SEQ ID NO: 167266 - DNA, 25 bp, Mus musculus
agcagactcctctcatctctggtaa

SEQ ID NO: 167267 - DNA, 25 bp, Mus musculus
agcagactcctgaaggcagtgctgc

SEQ ID NO: 167268 - DNA, 25 bp, Mus musculus
agcagactcctgtaggcagtgctgc

SEQ ID NO: 167269 - DNA, 25 bp, Mus musculus
agcagactctccatcagggtttatt

SEQ ID NO: 167270 - DNA, 25 bp, Mus musculus
agcagactctccttcagggtttatt

SEQ ID NO: 167271 - DNA, 25 bp, Mus musculus
agcagactgaataagccatgggaat

SEQ ID NO: 167272 - DNA, 25 bp, Mus musculus
agcagactgaatacacagcacgtgt

SEQ ID NO: 167273 - DNA, 25 bp, Mus musculus
agcagactgaattagccatgggaat

SEQ ID NO: 167274 - DNA, 25 bp, Mus musculus
agcagactgaattcacagcacgtgt

SEQ ID NO: 167275 - DNA, 25 bp, Mus musculus
agcagactgacactggcttctctgt

SEQ ID NO: 167276 - DNA, 25 bp, Mus musculus
agcagactgacagtggcttctctgt

SEQ ID NO: 167277 - DNA, 25 bp, Mus musculus
agcagactgagcctgttcccaggac

SEQ ID NO: 167278 - DNA, 25 bp, Mus musculus
agcagactgagcgtgttcccaggac

SEQ ID NO: 167279 - DNA, 25 bp, Mus musculus
agcagactgatactacgtggaaaac

SEQ ID NO: 167280 - DNA, 25 bp, Mus musculus
agcagactgatagtacgtggaaaac

SEQ ID NO: 167281 - DNA, 25 bp, Mus musculus
agcagactgatccatatcctcaaca

SEQ ID NO: 167282 - DNA, 25 bp, Mus musculus
agcagactgatcgatatcctcaaca

SEQ ID NO: 167283 - DNA, 25 bp, Mus musculus
agcagactggacacagagcggagaa

SEQ ID NO: 167284 - DNA, 25 bp, Mus musculus
agcagactggactcagagcggagaa

SEQ ID NO: 167285 - DNA, 25 bp, Mus musculus
agcagactgtataggtgtttcgaga

SEQ ID NO: 167286 - DNA, 25 bp, Mus musculus
agcagactgtattggtgtttcgaga

SEQ ID NO: 167287 - DNA, 25 bp, Mus musculus
agcagactgtggctgcacctatcaa

SEQ ID NO: 167288 - DNA, 25 bp, Mus musculus
agcagactgtgggtgcacctatcaa

SEQ ID NO: 167289 - DNA, 25 bp, Mus musculus
agcagacttcaaatcctaggactcc

SEQ ID NO: 167290 - DNA, 25 bp, Mus musculus
agcagacttcaattcctaggactcc

SEQ ID NO: 167291 - DNA, 25 bp, Mus musculus
agcagacttgtcatcatccagagat

SEQ ID NO: 167292 - DNA, 25 bp, Mus musculus
agcagacttgtcttcatccagagat

SEQ ID NO: 167293 - DNA, 25 bp, Mus musculus
agcagactttgtcagctaagctttg

SEQ ID NO: 167294 - DNA, 25 bp, Mus musculus
agcagactttgtgagctaagctttg

SEQ ID NO: 167295 - DNA, 25 bp, Mus musculus
agcagagaagagcaggaaccctcct

SEQ ID NO: 167296 - DNA, 25 bp, Mus musculus
agcagagaagaggaggaaccctcct

SEQ ID NO: 167297 - DNA, 25 bp, Mus musculus
agcagagaagttcaaggtgccctca

SEQ ID NO: 167298 - DNA, 25 bp, Mus musculus
agcagagaagttgaaggtgccctca

SEQ ID NO: 167299 - DNA, 25 bp, Mus musculus
agcagagaatgcactgccaatacct

SEQ ID NO: 167300 - DNA, 25 bp, Mus musculus
agcagagaatgctctgccaatacct

SEQ ID NO: 167301 - DNA, 25 bp, Mus musculus
agcagagaattccttacctaaccaa

SEQ ID NO: 167302 - DNA, 25 bp, Mus musculus
agcagagaattcgttacctaaccaa

SEQ ID NO: 167303 - DNA, 25 bp, Mus musculus
agcagagaatttctgtccttttgaa

SEQ ID NO: 167304 - DNA, 25 bp, Mus musculus
agcagagaatttgtgtccttttgaa

SEQ ID NO: 167305 - DNA, 25 bp, Mus musculus
agcagagaccacatccggaacaggg

SEQ ID NO: 167306 - DNA, 25 bp, Mus musculus
agcagagaccacttccggaacaggg

SEQ ID NO: 167307 - DNA, 25 bp, Mus musculus
agcagagacggcaaggccaccgtgt

SEQ ID NO: 167308 - DNA, 25 bp, Mus musculus
agcagagacggctaggccaccgtgt

SEQ ID NO: 167309 - DNA, 25 bp, Mus musculus
agcagagactacatctacagcccag

SEQ ID NO: 167310 - DNA, 25 bp, Mus musculus
agcagagactacatggacctggctg

SEQ ID NO: 167311 - DNA, 25 bp, Mus musculus
agcagagactacttctacagcccag

SEQ ID NO: 167312 - DNA, 25 bp, Mus musculus
agcagagactacttggacctggctg

SEQ ID NO: 167313 - DNA, 25 bp, Mus musculus
agcagagactctacagggacaattt

SEQ ID NO: 167314 - DNA, 25 bp, Mus musculus
agcagagactctatcctcagggtta

SEQ ID NO: 167315 - DNA, 25 bp, Mus musculus
agcagagactcttcagggacaattt

SEQ ID NO: 167316 - DNA, 25 bp, Mus musculus
agcagagactctttcctcagggtta

SEQ ID NO: 167317 - DNA, 25 bp, Mus musculus
agcagagacttgcagcaccactgag

SEQ ID NO: 167318 - DNA, 25 bp, Mus musculus
agcagagacttggagcaccactgag

SEQ ID NO: 167319 - DNA, 25 bp, Mus musculus
agcagagagaggcaccccacatgtc

SEQ ID NO: 167320 - DNA, 25 bp, Mus musculus
agcagagagagggaccccacatgtc

SEQ ID NO: 167321 - DNA, 25 bp, Mus musculus
agcagagagattccagccttcttcc

SEQ ID NO: 167322 - DNA, 25 bp, Mus musculus
agcagagagattgcagccttcttcc

SEQ ID NO: 167323 - DNA, 25 bp, Mus musculus
agcagagagccaccgacatggagat

SEQ ID NO: 167324 - DNA, 25 bp, Mus musculus
agcagagagccagcgacatggagat

SEQ ID NO: 167325 - DNA, 25 bp, Mus musculus
agcagagatcatcgtggacacagac

SEQ ID NO: 167326 - DNA, 25 bp, Mus musculus
agcagagatcatggtggacacagac

SEQ ID NO: 167327 - DNA, 25 bp, Mus musculus
agcagagattccaccattcactgtg

SEQ ID NO: 167328 - DNA, 25 bp, Mus musculus
agcagagattcctccattcactgtg

SEQ ID NO: 167329 - DNA, 25 bp, Mus musculus
agcagagcaacaaccgaagtcttca

SEQ ID NO: 167330 - DNA, 25 bp, Mus musculus
agcagagcaacatccgaagtcttca

SEQ ID NO: 167331 - DNA, 25 bp, Mus musculus
agcagagcaatgactgactccaccg

SEQ ID NO: 167332 - DNA, 25 bp, Mus musculus
agcagagcaatgtctgactccaccg

SEQ ID NO: 167333 - DNA, 25 bp, Mus musculus
agcagagcacacacctgaatgaaga

SEQ ID NO: 167334 - DNA, 25 bp, Mus musculus
agcagagcacactcctgaatgaaga

SEQ ID NO: 167335 - DNA, 25 bp, Mus musculus
agcagagcacttccctgccatgtga

SEQ ID NO: 167336 - DNA, 25 bp, Mus musculus
agcagagcacttgcctgccatgtga

SEQ ID NO: 167337 - DNA, 25 bp, Mus musculus
agcagagcagaaaacccagagagaa

SEQ ID NO: 167338 - DNA, 25 bp, Mus musculus
agcagagcagaatacccagagagaa

SEQ ID NO: 167339 - DNA, 25 bp, Mus musculus
agcagagcagacaccagtaaccctt

SEQ ID NO: 167340 - DNA, 25 bp, Mus musculus
agcagagcagactccagtaaccctt

SEQ ID NO: 167341 - DNA, 25 bp, Mus musculus
agcagagcagcccttcttctgtcct

SEQ ID NO: 167342 - DNA, 25 bp, Mus musculus
agcagagcagccgttcttctgtcct

SEQ ID NO: 167343 - DNA, 25 bp, Mus musculus
agcagagcagctactcaaatagtac

SEQ ID NO: 167344 - DNA, 25 bp, Mus musculus
agcagagcagcttctcaaatagtac

SEQ ID NO: 167345 - DNA, 25 bp, Mus musculus
agcagagcagggaaccccgcgggaa

SEQ ID NO: 167346 - DNA, 25 bp, Mus musculus
agcagagcagggtaccccgcgggaa

SEQ ID NO: 167347 - DNA, 25 bp, Mus musculus
agcagagcaggtacccacatacatc

SEQ ID NO: 167348 - DNA, 25 bp, Mus musculus
agcagagcaggttcccacatacatc

SEQ ID NO: 167349 - DNA, 25 bp, Mus musculus
agcagagcattgatacttgtttaat

SEQ ID NO: 167350 - DNA, 25 bp, Mus musculus
agcagagcattgttacttgtttaat

SEQ ID NO: 167351 - DNA, 25 bp, Mus musculus
agcagagccatgcaaagagccttga

SEQ ID NO: 167352 - DNA, 25 bp, Mus musculus
agcagagccatggaaagagccttga

SEQ ID NO: 167353 - DNA, 25 bp, Mus musculus
agcagagcctccatgtggggacagc

SEQ ID NO: 167354 - DNA, 25 bp, Mus musculus
agcagagcctccttgtggggacagc

SEQ ID NO: 167355 - DNA, 25 bp, Mus musculus
agcagagcctctcaactccgtagca

SEQ ID NO: 167356 - DNA, 25 bp, Mus musculus
agcagagcctctgaactccgtagca

SEQ ID NO: 167357 - DNA, 25 bp, Mus musculus
agcagagcctggagacggatcagct

SEQ ID NO: 167358 - DNA, 25 bp, Mus musculus
agcagagcctggtgacggatcagct

SEQ ID NO: 167359 - DNA, 25 bp, Mus musculus
agcagagccttcacacagcaggatg

SEQ ID NO: 167360 - DNA, 25 bp, Mus musculus
agcagagccttctcacagcaggatg

SEQ ID NO: 167361 - DNA, 25 bp, Mus musculus
agcagagcgcatacaggcagggccc

SEQ ID NO: 167362 - DNA, 25 bp, Mus musculus
agcagagcgcattcaggcagggccc

SEQ ID NO: 167363 - DNA, 25 bp, Mus musculus
agcagagcgcccatggatggatgcc

SEQ ID NO: 167364 - DNA, 25 bp, Mus musculus
agcagagcgcccttggatggatgcc

SEQ ID NO: 167365 - DNA, 25 bp, Mus musculus
agcagagcgctcagggtccgtgaaa

SEQ ID NO: 167366 - DNA, 25 bp, Mus musculus
agcagagcgctctgggtccgtgaaa

SEQ ID NO: 167367 - DNA, 25 bp, Mus musculus
agcagagcgtggactccgaccgatg

SEQ ID NO: 167368 - DNA, 25 bp, Mus musculus
agcagagcgtggtctccgaccgatg

SEQ ID NO: 167369 - DNA, 25 bp, Mus musculus
agcagagctactactttgggttgtt

SEQ ID NO: 167370 - DNA, 25 bp, Mus musculus
agcagagctactattcatatggagt

SEQ ID NO: 167371 - DNA, 25 bp, Mus musculus
agcagagctacttctttgggttgtt

SEQ ID NO: 167372 - DNA, 25 bp, Mus musculus
agcagagctacttttcatatggagt

SEQ ID NO: 167373 - DNA, 25 bp, Mus musculus
agcagagctcgcatctgtcggtgtt

SEQ ID NO: 167374 - DNA, 25 bp, Mus musculus
agcagagctcgcttctgtcggtgtt

SEQ ID NO: 167375 - DNA, 25 bp, Mus musculus
agcagagctctcaagctgttctggg

SEQ ID NO: 167376 - DNA, 25 bp, Mus musculus
agcagagctctctagctgttctggg

SEQ ID NO: 167377 - DNA, 25 bp, Mus musculus
agcagagctctgacgcaggtgatga

SEQ ID NO: 167378 - DNA, 25 bp, Mus musculus
agcagagctctgagacccaggacct

SEQ ID NO: 167379 - DNA, 25 bp, Mus musculus
agcagagctctgtcgcaggtgatga

SEQ ID NO: 167380 - DNA, 25 bp, Mus musculus
agcagagctctgtgacccaggacct

SEQ ID NO: 167381 - DNA, 25 bp, Mus musculus
agcagagctgacaatgcctgggatt

SEQ ID NO: 167382 - DNA, 25 bp, Mus musculus
agcagagctgactatgcctgggatt

SEQ ID NO: 167383 - DNA, 25 bp, Mus musculus
agcagagctgccaacttgtatcaag

SEQ ID NO: 167384 - DNA, 25 bp, Mus musculus
agcagagctgcctacttgtatcaag

SEQ ID NO: 167385 - DNA, 25 bp, Mus musculus
agcagagctggtccaaccacagttc

SEQ ID NO: 167386 - DNA, 25 bp, Mus musculus
agcagagctggtccggtctaatttc

SEQ ID NO: 167387 - DNA, 25 bp, Mus musculus
agcagagctggtgcaaccacagttc

SEQ ID NO: 167388 - DNA, 25 bp, Mus musculus
agcagagctggtgcggtctaatttc

SEQ ID NO: 167389 - DNA, 25 bp, Mus musculus
agcagagcttctaacccacaaggaa

SEQ ID NO: 167390 - DNA, 25 bp, Mus musculus
agcagagcttcttacccacaaggaa

SEQ ID NO: 167391 - DNA, 25 bp, Mus musculus
agcagagcttgtagcttcctcagtg

SEQ ID NO: 167392 - DNA, 25 bp, Mus musculus
agcagagcttgttgcttcctcagtg

SEQ ID NO: 167393 - DNA, 25 bp, Mus musculus
agcagagctttcatttcagcaccat

SEQ ID NO: 167394 - DNA, 25 bp, Mus musculus
agcagagctttcttttcagcaccat

SEQ ID NO: 167395 - DNA, 25 bp, Mus musculus
agcagaggaccacgatgtgaggctg

SEQ ID NO: 167396 - DNA, 25 bp, Mus musculus
agcagaggaccaggatgtgaggctg

SEQ ID NO: 167397 - DNA, 25 bp, Mus musculus
agcagaggaggcagagcacccttca

SEQ ID NO: 167398 - DNA, 25 bp, Mus musculus
agcagaggaggctgagcacccttca

SEQ ID NO: 167399 - DNA, 25 bp, Mus musculus
agcagaggagtacttaccttgtaat

SEQ ID NO: 167400 - DNA, 25 bp, Mus musculus
agcagaggagtagttaccttgtaat

SEQ ID NO: 167401 - DNA, 25 bp, Mus musculus
agcagaggatgtccgttaccctgga

SEQ ID NO: 167402 - DNA, 25 bp, Mus musculus
agcagaggatgtgcgttaccctgga

SEQ ID NO: 167403 - DNA, 25 bp, Mus musculus
agcagaggcccactagcaccgaatg

SEQ ID NO: 167404 - DNA, 25 bp, Mus musculus
agcagaggcccagtagcaccgaatg

SEQ ID NO: 167405 - DNA, 25 bp, Mus musculus
agcagaggccgcaaagaacgctttg

SEQ ID NO: 167406 - DNA, 25 bp, Mus musculus
agcagaggccgcaggctcgctacaa

SEQ ID NO: 167407 - DNA, 25 bp, Mus musculus
agcagaggccgctaagaacgctttg

SEQ ID NO: 167408 - DNA, 25 bp, Mus musculus
agcagaggccgctggctcgctacaa

SEQ ID NO: 167409 - DNA, 25 bp, Mus musculus
agcagaggccggctgaccccttcag

SEQ ID NO: 167410 - DNA, 25 bp, Mus musculus
agcagaggccgggtgaccccttcag

SEQ ID NO: 167411 - DNA, 25 bp, Mus musculus
agcagaggctacaaaaactaaccct

SEQ ID NO: 167412 - DNA, 25 bp, Mus musculus
agcagaggctactaaaactaaccct

SEQ ID NO: 167413 - DNA, 25 bp, Mus musculus
agcagaggctctcgagctccacatc

SEQ ID NO: 167414 - DNA, 25 bp, Mus musculus
agcagaggctctggagctccacatc

SEQ ID NO: 167415 - DNA, 25 bp, Mus musculus
agcagaggctgaaattcgcgggcaa

SEQ ID NO: 167416 - DNA, 25 bp, Mus musculus
agcagaggctgatattcgcgggcaa

SEQ ID NO: 167417 - DNA, 25 bp, Mus musculus
agcagaggctggcagaccattgcag

SEQ ID NO: 167418 - DNA, 25 bp, Mus musculus
agcagaggctgggagaccattgcag

SEQ ID NO: 167419 - DNA, 25 bp, Mus musculus
agcagaggctgtattccaaggctcc

SEQ ID NO: 167420 - DNA, 25 bp, Mus musculus
agcagaggctgttttccaaggctcc

SEQ ID NO: 167421 - DNA, 25 bp, Mus musculus
agcagagggcctagttcctcttgaa

SEQ ID NO: 167422 - DNA, 25 bp, Mus musculus
agcagagggccttgttcctcttgaa

SEQ ID NO: 167423 - DNA, 25 bp, Mus musculus
agcagagggctgattattgcccttc

SEQ ID NO: 167424 - DNA, 25 bp, Mus musculus
agcagagggctgtttattgcccttc

SEQ ID NO: 167425 - DNA, 25 bp, Mus musculus
agcagagggtgcacacttcatgttg

SEQ ID NO: 167426 - DNA, 25 bp, Mus musculus
agcagagggtgctcacttcatgttg

SEQ ID NO: 167427 - DNA, 25 bp, Mus musculus
agcagaggtctcagcgtcatccagc

SEQ ID NO: 167428 - DNA, 25 bp, Mus musculus
agcagaggtctctgcgtcatccagc

SEQ ID NO: 167429 - DNA, 25 bp, Mus musculus
agcagaggttccagaactgccgttc

SEQ ID NO: 167430 - DNA, 25 bp, Mus musculus
agcagaggttcctgaactgccgttc

SEQ ID NO: 167431 - DNA, 25 bp, Mus musculus
agcagagtcaccacggtcacttcag

SEQ ID NO: 167432 - DNA, 25 bp, Mus musculus
agcagagtcacctcggtcacttcag

SEQ ID NO: 167433 - DNA, 25 bp, Mus musculus
agcagagtcagcacggagcacccag

SEQ ID NO: 167434 - DNA, 25 bp, Mus musculus
agcagagtcagctcggagcacccag

SEQ ID NO: 167435 - DNA, 25 bp, Mus musculus
agcagagtcgctcttgttttgttct

SEQ ID NO: 167436 - DNA, 25 bp, Mus musculus
agcagagtcgctgttgttttgttct

SEQ ID NO: 167437 - DNA, 25 bp, Mus musculus
agcagagtctggaaacataagtcaa

SEQ ID NO: 167438 - DNA, 25 bp, Mus musculus
agcagagtctggtaacataagtcaa

SEQ ID NO: 167439 - DNA, 25 bp, Mus musculus
agcagagtcttgctccactttgaag

SEQ ID NO: 167440 - DNA, 25 bp, Mus musculus
agcagagtcttggtccactttgaag

SEQ ID NO: 167441 - DNA, 25 bp, Mus musculus
agcagagtgtacaatcagtcactga

SEQ ID NO: 167442 - DNA, 25 bp, Mus musculus
agcagagtgtaccagctgctgtgtt

SEQ ID NO: 167443 - DNA, 25 bp, Mus musculus
agcagagtgtacgagctgctgtgtt

SEQ ID NO: 167444 - DNA, 25 bp, Mus musculus
agcagagtgtactatcagtcactga

SEQ ID NO: 167445 - DNA, 25 bp, Mus musculus
agcagagtgttacgtcagacagcaa

SEQ ID NO: 167446 - DNA, 25 bp, Mus musculus
agcagagtgttaggtcagacagcaa

SEQ ID NO: 167447 - DNA, 25 bp, Mus musculus
agcagagttacaactgtgccctcat

SEQ ID NO: 167448 - DNA, 25 bp, Mus musculus
agcagagttacatctgtgccctcat

SEQ ID NO: 167449 - DNA, 25 bp, Mus musculus
agcagagttcggaaggtcactccaa

SEQ ID NO: 167450 - DNA, 25 bp, Mus musculus
agcagagttcggtaggtcactccaa

SEQ ID NO: 167451 - DNA, 25 bp, Mus musculus
agcagagttgccaagtaccactcaa

SEQ ID NO: 167452 - DNA, 25 bp, Mus musculus
agcagagttgcctagtaccactcaa

SEQ ID NO: 167453 - DNA, 25 bp, Mus musculus
agcagagttgtgattactatcttga

SEQ ID NO: 167454 - DNA, 25 bp, Mus musculus
agcagagttgtgtttactatcttga

SEQ ID NO: 167455 - DNA, 25 bp, Mus musculus
agcagagtttagagggctcctacgt

SEQ ID NO: 167456 - DNA, 25 bp, Mus musculus
agcagagtttagtgggctcctacgt

SEQ ID NO: 167457 - DNA, 25 bp, Mus musculus
agcagataaccccagcagcaaacta

SEQ ID NO: 167458 - DNA, 25 bp, Mus musculus
agcagataacccgagcagcaaacta

SEQ ID NO: 167459 - DNA, 25 bp, Mus musculus
agcagataatgccacttttccttcc

SEQ ID NO: 167460 - DNA, 25 bp, Mus musculus
agcagataatgcgacttttccttcc

SEQ ID NO: 167461 - DNA, 25 bp, Mus musculus
agcagatacactcttacgtttctaa

SEQ ID NO: 167462 - DNA, 25 bp, Mus musculus
agcagatacactgttacgtttctaa

SEQ ID NO: 167463 - DNA, 25 bp, Mus musculus
agcagatacaggcagcagaaccaga

SEQ ID NO: 167464 - DNA, 25 bp, Mus musculus
agcagatacagggagcagaaccaga

SEQ ID NO: 167465 - DNA, 25 bp, Mus musculus
agcagatattcccaaaacatttcac

SEQ ID NO: 167466 - DNA, 25 bp, Mus musculus
agcagatattccgaaaacatttcac

SEQ ID NO: 167467 - DNA, 25 bp, Mus musculus
agcagatcaagcctgttagccctgt

SEQ ID NO: 167468 - DNA, 25 bp, Mus musculus
agcagatcaagcgtgttagccctgt

SEQ ID NO: 167469 - DNA, 25 bp, Mus musculus
agcagatcatccaatgtccagcaag

SEQ ID NO: 167470 - DNA, 25 bp, Mus musculus
agcagatcatcctatgtccagcaag

SEQ ID NO: 167471 - DNA, 25 bp, Mus musculus
agcagatccaagatgccaggctgat

SEQ ID NO: 167472 - DNA, 25 bp, Mus musculus
agcagatccaagttgccaggctgat

SEQ ID NO: 167473 - DNA, 25 bp, Mus musculus
agcagatccacgagggtatcctgag

SEQ ID NO: 167474 - DNA, 25 bp, Mus musculus
agcagatccacgtgggtatcctgag

SEQ ID NO: 167475 - DNA, 25 bp, Mus musculus
agcagatccatcagaaccgggaatt

SEQ ID NO: 167476 - DNA, 25 bp, Mus musculus
agcagatccatctgaaccgggaatt

SEQ ID NO: 167477 - DNA, 25 bp, Mus musculus
agcagatcccttcttgagcgcctgg

SEQ ID NO: 167478 - DNA, 25 bp, Mus musculus
agcagatcccttgttgagcgcctgg

SEQ ID NO: 167479 - DNA, 25 bp, Mus musculus
agcagatcctccaagtatctggatg

SEQ ID NO: 167480 - DNA, 25 bp, Mus musculus
agcagatcctccctgtgaatctctc

SEQ ID NO: 167481 - DNA, 25 bp, Mus musculus
agcagatcctccgtgtgaatctctc

SEQ ID NO: 167482 - DNA, 25 bp, Mus musculus
agcagatcctcctagtatctggatg

SEQ ID NO: 167483 - DNA, 25 bp, Mus musculus
agcagatcctttacaattacctcaa

SEQ ID NO: 167484 - DNA, 25 bp, Mus musculus
agcagatccttttcaattacctcaa

SEQ ID NO: 167485 - DNA, 25 bp, Mus musculus
agcagatcgaatcccggaagcggct

SEQ ID NO: 167486 - DNA, 25 bp, Mus musculus
agcagatcgaatgccggaagcggct

SEQ ID NO: 167487 - DNA, 25 bp, Mus musculus
agcagatcgagaatggcaggcccag

SEQ ID NO: 167488 - DNA, 25 bp, Mus musculus
agcagatcgagattggcaggcccag

SEQ ID NO: 167489 - DNA, 25 bp, Mus musculus
agcagatcgcaaacctggaggaggt

SEQ ID NO: 167490 - DNA, 25 bp, Mus musculus
agcagatcgcaatcctggaggaggt

SEQ ID NO: 167491 - DNA, 25 bp, Mus musculus
agcagatcggagacccggacctgga

SEQ ID NO: 167492 - DNA, 25 bp, Mus musculus
agcagatcggagtcccggacctgga

SEQ ID NO: 167493 - DNA, 25 bp, Mus musculus
agcagatcgtctagaaaaggccaat

SEQ ID NO: 167494 - DNA, 25 bp, Mus musculus
agcagatcgtcttgaaaaggccaat

SEQ ID NO: 167495 - DNA, 25 bp, Mus musculus
agcagatctacgctcagtttttccc

SEQ ID NO: 167496 - DNA, 25 bp, Mus musculus
agcagatctacggtcagtttttccc

SEQ ID NO: 167497 - DNA, 25 bp, Mus musculus
agcagatctctccacgggtcacgat

SEQ ID NO: 167498 - DNA, 25 bp, Mus musculus
agcagatctctcgacgggtcacgat

SEQ ID NO: 167499 - DNA, 25 bp, Mus musculus
agcagatctgccaaatatatttttg

SEQ ID NO: 167500 - DNA, 25 bp, Mus musculus
agcagatctgcctaatatatttttg

SEQ ID NO: 167501 - DNA, 25 bp, Mus musculus
agcagatctgctaggaactcctttc

SEQ ID NO: 167502 - DNA, 25 bp, Mus musculus
agcagatctgcttggaactcctttc

SEQ ID NO: 167503 - DNA, 25 bp, Mus musculus
agcagatctggcatcttctggtaac

SEQ ID NO: 167504 - DNA, 25 bp, Mus musculus
agcagatctggcttcttctggtaac

SEQ ID NO: 167505 - DNA, 25 bp, Mus musculus
agcagatgaggccttggattcaagt

SEQ ID NO: 167506 - DNA, 25 bp, Mus musculus
agcagatgaggcgttggattcaagt

SEQ ID NO: 167507 - DNA, 25 bp, Mus musculus
agcagatgatgaagatcgtcacacc

SEQ ID NO: 167508 - DNA, 25 bp, Mus musculus
agcagatgatgatgatcgtcacacc

SEQ ID NO: 167509 - DNA, 25 bp, Mus musculus
agcagatgatgtctgtcctcatgaa

SEQ ID NO: 167510 - DNA, 25 bp, Mus musculus
agcagatgatgtgtgtcctcatgaa

SEQ ID NO: 167511 - DNA, 25 bp, Mus musculus
agcagatgcagcaagggctcttcat

SEQ ID NO: 167512 - DNA, 25 bp, Mus musculus
agcagatgcagcaccctgtgagatc

SEQ ID NO: 167513 - DNA, 25 bp, Mus musculus
agcagatgcagcaggcttttgcagc

SEQ ID NO: 167514 - DNA, 25 bp, Mus musculus
agcagatgcagctagggctcttcat

SEQ ID NO: 167515 - DNA, 25 bp, Mus musculus
agcagatgcagctccctgtgagatc

SEQ ID NO: 167516 - DNA, 25 bp, Mus musculus
agcagatgcagctggcttttgcagc

SEQ ID NO: 167517 - DNA, 25 bp, Mus musculus
agcagatgccacaccatgtgtgggt

SEQ ID NO: 167518 - DNA, 25 bp, Mus musculus
agcagatgccactccatgtgtgggt

SEQ ID NO: 167519 - DNA, 25 bp, Mus musculus
agcagatgccatacggactcccaga

SEQ ID NO: 167520 - DNA, 25 bp, Mus musculus
agcagatgccattcggactcccaga

SEQ ID NO: 167521 - DNA, 25 bp, Mus musculus
agcagatgccctcggaaggctccag

SEQ ID NO: 167522 - DNA, 25 bp, Mus musculus
agcagatgccctgggaaggctccag

SEQ ID NO: 167523 - DNA, 25 bp, Mus musculus
agcagatgccgccttgcactttaac

SEQ ID NO: 167524 - DNA, 25 bp, Mus musculus
agcagatgccgcgttgcactttaac

SEQ ID NO: 167525 - DNA, 25 bp, Mus musculus
agcagatgctgaccctcttcacatc

SEQ ID NO: 167526 - DNA, 25 bp, Mus musculus
agcagatgctgagcctcttcacatc

SEQ ID NO: 167527 - DNA, 25 bp, Mus musculus
agcagatgctggacatgtgctatga

SEQ ID NO: 167528 - DNA, 25 bp, Mus musculus
agcagatgctggtcatgtgctatga

SEQ ID NO: 167529 - DNA, 25 bp, Mus musculus
agcagatggcataggcacccgtact

SEQ ID NO: 167530 - DNA, 25 bp, Mus musculus
agcagatggcattggcacccgtact

SEQ ID NO: 167531 - DNA, 25 bp, Mus musculus
agcagatgggaaagactctccggaa

SEQ ID NO: 167532 - DNA, 25 bp, Mus musculus
agcagatgggaatgactctccggaa

SEQ ID NO: 167533 - DNA, 25 bp, Mus musculus
agcagatgggtaagcggcatccctc

SEQ ID NO: 167534 - DNA, 25 bp, Mus musculus
agcagatgggtatgcggcatccctc

SEQ ID NO: 167535 - DNA, 25 bp, Mus musculus
agcagatgggtgactggcttccaga

SEQ ID NO: 167536 - DNA, 25 bp, Mus musculus
agcagatgggtgtctggcttccaga

SEQ ID NO: 167537 - DNA, 25 bp, Mus musculus
agcagatgtcacacagacgataaat

SEQ ID NO: 167538 - DNA, 25 bp, Mus musculus
agcagatgtcactcagacgataaat

SEQ ID NO: 167539 - DNA, 25 bp, Mus musculus
agcagatgtcagaggaagcaacaga

SEQ ID NO: 167540 - DNA, 25 bp, Mus musculus
agcagatgtcagtggaagcaacaga

SEQ ID NO: 167541 - DNA, 25 bp, Mus musculus
agcagatgtcgaaagccctcagtag

SEQ ID NO: 167542 - DNA, 25 bp, Mus musculus
agcagatgtcgatagccctcagtag

SEQ ID NO: 167543 - DNA, 25 bp, Mus musculus
agcagatgtcgcagtttcctcagaa

SEQ ID NO: 167544 - DNA, 25 bp, Mus musculus
agcagatgtcgctgtttcctcagaa

SEQ ID NO: 167545 - DNA, 25 bp, Mus musculus
agcagatgtgcaatgttgaaccaga

SEQ ID NO: 167546 - DNA, 25 bp, Mus musculus
agcagatgtgcattgttgaaccaga

SEQ ID NO: 167547 - DNA, 25 bp, Mus musculus
agcagatgttacacgaccttttgtc

SEQ ID NO: 167548 - DNA, 25 bp, Mus musculus
agcagatgttactcgaccttttgtc

SEQ ID NO: 167549 - DNA, 25 bp, Mus musculus
agcagatgtttgagcagcgggtcaa

SEQ ID NO: 167550 - DNA, 25 bp, Mus musculus
agcagatgtttgtgcagcgggtcaa

SEQ ID NO: 167551 - DNA, 25 bp, Mus musculus
agcagattacttccatcagtattga

SEQ ID NO: 167552 - DNA, 25 bp, Mus musculus
agcagattacttgcatcagtattga

SEQ ID NO: 167553 - DNA, 25 bp, Mus musculus
agcagattcagtagcagatgccgtt

SEQ ID NO: 167554 - DNA, 25 bp, Mus musculus
agcagattcagttgcagatgccgtt

SEQ ID NO: 167555 - DNA, 25 bp, Mus musculus
agcagattccacaggcagggcgaac

SEQ ID NO: 167556 - DNA, 25 bp, Mus musculus
agcagattccactggcagggcgaac

SEQ ID NO: 167557 - DNA, 25 bp, Mus musculus
agcagattcccacctgagtagatca

SEQ ID NO: 167558 - DNA, 25 bp, Mus musculus
agcagattcccagctgagtagatca

SEQ ID NO: 167559 - DNA, 25 bp, Mus musculus
agcagattcgcaaccatttttaaat

SEQ ID NO: 167560 - DNA, 25 bp, Mus musculus
agcagattcgcatccatttttaaat

SEQ ID NO: 167561 - DNA, 25 bp, Mus musculus
agcagattgaggaccttgccaagta

SEQ ID NO: 167562 - DNA, 25 bp, Mus musculus
agcagattgaggtccttgccaagta

SEQ ID NO: 167563 - DNA, 25 bp, Mus musculus
agcagattgccccacacactggagg

SEQ ID NO: 167564 - DNA, 25 bp, Mus musculus
agcagattgcccgacacactggagg

SEQ ID NO: 167565 - DNA, 25 bp, Mus musculus
agcagattggctcagacgacttttg

SEQ ID NO: 167566 - DNA, 25 bp, Mus musculus
agcagattggctgagacgacttttg

SEQ ID NO: 167567 - DNA, 25 bp, Mus musculus
agcagattggttacacgcgtcaggt

SEQ ID NO: 167568 - DNA, 25 bp, Mus musculus
agcagattggtttcacgcgtcaggt

SEQ ID NO: 167569 - DNA, 25 bp, Mus musculus
agcagattgtagagacccagaggtg

SEQ ID NO: 167570 - DNA, 25 bp, Mus musculus
agcagattgtagtgacccagaggtg

SEQ ID NO: 167571 - DNA, 25 bp, Mus musculus
agcagattgtggaccccattcatga

SEQ ID NO: 167572 - DNA, 25 bp, Mus musculus
agcagattgtggtccccattcatga

SEQ ID NO: 167573 - DNA, 25 bp, Mus musculus
agcagatttaagcactcacatggaa

SEQ ID NO: 167574 - DNA, 25 bp, Mus musculus
agcagatttaaggactcacatggaa

SEQ ID NO: 167575 - DNA, 25 bp, Mus musculus
agcagatttataccagccagggaca

SEQ ID NO: 167576 - DNA, 25 bp, Mus musculus
agcagatttatagcagccagggaca

SEQ ID NO: 167577 - DNA, 25 bp, Mus musculus
agcagatttggaatgccctgcctga

SEQ ID NO: 167578 - DNA, 25 bp, Mus musculus
agcagatttggattgccctgcctga

SEQ ID NO: 167579 - DNA, 25 bp, Mus musculus
agcagattttccacacctattgtac

SEQ ID NO: 167580 - DNA, 25 bp, Mus musculus
agcagattttcctcacctattgtac

SEQ ID NO: 167581 - DNA, 25 bp, Mus musculus
agcagattttgcatcatccaggaag

SEQ ID NO: 167582 - DNA, 25 bp, Mus musculus
agcagattttgcttcatccaggaag

SEQ ID NO: 167583 - DNA, 25 bp, Mus musculus
agcagattttggaagcagctcataa

SEQ ID NO: 167584 - DNA, 25 bp, Mus musculus
agcagattttggtagcagctcataa

SEQ ID NO: 167585 - DNA, 25 bp, Mus musculus
agcagcaaaatgctcttaagagctg

SEQ ID NO: 167586 - DNA, 25 bp, Mus musculus
agcagcaaaatggtcttaagagctg

SEQ ID NO: 167587 - DNA, 25 bp, Mus musculus
agcagcaaagcacggtctggcacct

SEQ ID NO: 167588 - DNA, 25 bp, Mus musculus
agcagcaaagcagggtctggcacct

SEQ ID NO: 167589 - DNA, 25 bp, Mus musculus
agcagcaaatgtcacgttactcacc

SEQ ID NO: 167590 - DNA, 25 bp, Mus musculus
agcagcaaatgtgacgttactcacc

SEQ ID NO: 167591 - DNA, 25 bp, Mus musculus
agcagcaacactctgcatgaagatg

SEQ ID NO: 167592 - DNA, 25 bp, Mus musculus
agcagcaacactgtgcatgaagatg

SEQ ID NO: 167593 - DNA, 25 bp, Mus musculus
agcagcaactcaaccctgagtgcac

SEQ ID NO: 167594 - DNA, 25 bp, Mus musculus
agcagcaactcatccctgagtgcac

SEQ ID NO: 167595 - DNA, 25 bp, Mus musculus
agcagcaacttgaagcatgtgacca

SEQ ID NO: 167596 - DNA, 25 bp, Mus musculus
agcagcaacttgtagcatgtgacca

SEQ ID NO: 167597 - DNA, 25 bp, Mus musculus
agcagcaagaaactgttttgcccaa

SEQ ID NO: 167598 - DNA, 25 bp, Mus musculus
agcagcaagaaagtgttttgcccaa

SEQ ID NO: 167599 - DNA, 25 bp, Mus musculus
agcagcaagcacaaggctaagccat

SEQ ID NO: 167600 - DNA, 25 bp, Mus musculus
agcagcaagcactaggctaagccat

SEQ ID NO: 167601 - DNA, 25 bp, Mus musculus
agcagcaagcatatttaggtttaaa

SEQ ID NO: 167602 - DNA, 25 bp, Mus musculus
agcagcaagcatttttaggtttaaa

SEQ ID NO: 167603 - DNA, 25 bp, Mus musculus
agcagcaagcccaccgagggacagc

SEQ ID NO: 167604 - DNA, 25 bp, Mus musculus
agcagcaagccctccgagggacagc

SEQ ID NO: 167605 - DNA, 25 bp, Mus musculus
agcagcaagctcagggacaaggact

SEQ ID NO: 167606 - DNA, 25 bp, Mus musculus
agcagcaagctctgggacaaggact

SEQ ID NO: 167607 - DNA, 25 bp, Mus musculus
agcagcaagctgagcagatctcaat

SEQ ID NO: 167608 - DNA, 25 bp, Mus musculus
agcagcaagctgtgcagatctcaat

SEQ ID NO: 167609 - DNA, 25 bp, Mus musculus
agcagcaaggacatccggatgaaaa

SEQ ID NO: 167610 - DNA, 25 bp, Mus musculus
agcagcaaggacttccggatgaaaa

SEQ ID NO: 167611 - DNA, 25 bp, Mus musculus
agcagcaaggagacggcaggcccca

SEQ ID NO: 167612 - DNA, 25 bp, Mus musculus
agcagcaaggagtcggcaggcccca

SEQ ID NO: 167613 - DNA, 25 bp, Mus musculus
agcagcaaggctccacaggtgagaa

SEQ ID NO: 167614 - DNA, 25 bp, Mus musculus
agcagcaaggctcctgatccctgag

SEQ ID NO: 167615 - DNA, 25 bp, Mus musculus
agcagcaaggctgcacaggtgagaa

SEQ ID NO: 167616 - DNA, 25 bp, Mus musculus
agcagcaaggctgctgatccctgag

SEQ ID NO: 167617 - DNA, 25 bp, Mus musculus
agcagcaagggaagtcctgtgagca

SEQ ID NO: 167618 - DNA, 25 bp, Mus musculus
agcagcaagggatgtcctgtgagca

SEQ ID NO: 167619 - DNA, 25 bp, Mus musculus
agcagcaatatccagtgaccacttc

SEQ ID NO: 167620 - DNA, 25 bp, Mus musculus
agcagcaatatcgagtgaccacttc

SEQ ID NO: 167621 - DNA, 25 bp, Mus musculus
agcagcaatctcatcggacctgagt

SEQ ID NO: 167622 - DNA, 25 bp, Mus musculus
agcagcaatctcttcggacctgagt

SEQ ID NO: 167623 - DNA, 25 bp, Mus musculus
agcagcaatctgcattcaggtaaaa

SEQ ID NO: 167624 - DNA, 25 bp, Mus musculus
agcagcaatctggattcaggtaaaa

SEQ ID NO: 167625 - DNA, 25 bp, Mus musculus
agcagcaatgcaacacagtctcaga

SEQ ID NO: 167626 - DNA, 25 bp, Mus musculus
agcagcaatgcatcacagtctcaga

SEQ ID NO: 167627 - DNA, 25 bp, Mus musculus
agcagcaatgctaaccttatgactc

SEQ ID NO: 167628 - DNA, 25 bp, Mus musculus
agcagcaatgcttaccttatgactc

SEQ ID NO: 167629 - DNA, 25 bp, Mus musculus
agcagcaatgttaatttccaatctt

SEQ ID NO: 167630 - DNA, 25 bp, Mus musculus
agcagcaatgtttatttccaatctt

SEQ ID NO: 167631 - DNA, 25 bp, Mus musculus
agcagcacaataaccgacttagcga

SEQ ID NO: 167632 - DNA, 25 bp, Mus musculus
agcagcacaatatccgacttagcga

SEQ ID NO: 167633 - DNA, 25 bp, Mus musculus
agcagcacacgaagcagcactgggc

SEQ ID NO: 167634 - DNA, 25 bp, Mus musculus
agcagcacacgatgcagcactgggc

SEQ ID NO: 167635 - DNA, 25 bp, Mus musculus
agcagcacagcaagtctccaaggaa

SEQ ID NO: 167636 - DNA, 25 bp, Mus musculus
agcagcacagcatgtctccaaggaa

SEQ ID NO: 167637 - DNA, 25 bp, Mus musculus
agcagcacagcccaggagggtattt

SEQ ID NO: 167638 - DNA, 25 bp, Mus musculus
agcagcacagccgaggagggtattt

SEQ ID NO: 167639 - DNA, 25 bp, Mus musculus
agcagcacagctatatcaggaaaac

SEQ ID NO: 167640 - DNA, 25 bp, Mus musculus
agcagcacagctttatcaggaaaac

SEQ ID NO: 167641 - DNA, 25 bp, Mus musculus
agcagcacaggaaacagtccgtcaa

SEQ ID NO: 167642 - DNA, 25 bp, Mus musculus
agcagcacaggatacagtccgtcaa

SEQ ID NO: 167643 - DNA, 25 bp, Mus musculus
agcagcaccaggacatcaccggcgt

SEQ ID NO: 167644 - DNA, 25 bp, Mus musculus
agcagcaccaggcactgtgtggcca

SEQ ID NO: 167645 - DNA, 25 bp, Mus musculus
agcagcaccagggactgtgtggcca

SEQ ID NO: 167646 - DNA, 25 bp, Mus musculus
agcagcaccaggtcatcaccggcgt

SEQ ID NO: 167647 - DNA, 25 bp, Mus musculus
agcagcaccagtcaggaagcatcac

SEQ ID NO: 167648 - DNA, 25 bp, Mus musculus
agcagcaccagtgaggaagcatcac

SEQ ID NO: 167649 - DNA, 25 bp, Mus musculus
agcagcacccagctctcagatggac

SEQ ID NO: 167650 - DNA, 25 bp, Mus musculus
agcagcacccaggtctcagatggac

SEQ ID NO: 167651 - DNA, 25 bp, Mus musculus
agcagcaccccactttataaaaaga

SEQ ID NO: 167652 - DNA, 25 bp, Mus musculus
agcagcaccccagtttataaaaaga

SEQ ID NO: 167653 - DNA, 25 bp, Mus musculus
agcagcacgcgcacttaaccatgga

SEQ ID NO: 167654 - DNA, 25 bp, Mus musculus
agcagcacgcgctcttaaccatgga

SEQ ID NO: 167655 - DNA, 25 bp, Mus musculus
agcagcacgtaccttcttctggaca

SEQ ID NO: 167656 - DNA, 25 bp, Mus musculus
agcagcacgtacgttcttctggaca

SEQ ID NO: 167657 - DNA, 25 bp, Mus musculus
agcagcactaacatgaccttttcgt

SEQ ID NO: 167658 - DNA, 25 bp, Mus musculus
agcagcactaacttgaccttttcgt

SEQ ID NO: 167659 - DNA, 25 bp, Mus musculus
agcagcactaagaggagtgttcaca

SEQ ID NO: 167660 - DNA, 25 bp, Mus musculus
agcagcactaagtggagtgttcaca

SEQ ID NO: 167661 - DNA, 25 bp, Mus musculus
agcagcactagcagtagcagtgaga

SEQ ID NO: 167662 - DNA, 25 bp, Mus musculus
agcagcactagctgtagcagtgaga

SEQ ID NO: 167663 - DNA, 25 bp, Mus musculus
agcagcactgaaagcccctgattga

SEQ ID NO: 167664 - DNA, 25 bp, Mus musculus
agcagcactgaatgcccctgattga

SEQ ID NO: 167665 - DNA, 25 bp, Mus musculus
agcagcactggcatgccctcatatg

SEQ ID NO: 167666 - DNA, 25 bp, Mus musculus
agcagcactggcttgccctcatatg

SEQ ID NO: 167667 - DNA, 25 bp, Mus musculus
agcagcactggtcatctactggttg

SEQ ID NO: 167668 - DNA, 25 bp, Mus musculus
agcagcactggtgatctactggttg

SEQ ID NO: 167669 - DNA, 25 bp, Mus musculus
agcagcactgtgaccgtgggaagca

SEQ ID NO: 167670 - DNA, 25 bp, Mus musculus
agcagcactgtgtccgtgggaagca

SEQ ID NO: 167671 - DNA, 25 bp, Mus musculus
agcagcactttaaacagggtcagga

SEQ ID NO: 167672 - DNA, 25 bp, Mus musculus
agcagcactttaagttaggtctcag

SEQ ID NO: 167673 - DNA, 25 bp, Mus musculus
agcagcactttatacagggtcagga

SEQ ID NO: 167674 - DNA, 25 bp, Mus musculus
agcagcactttatgttaggtctcag

SEQ ID NO: 167675 - DNA, 25 bp, Mus musculus
agcagcagacaccttcctgaatctc

SEQ ID NO: 167676 - DNA, 25 bp, Mus musculus
agcagcagacacgttcctgaatctc

SEQ ID NO: 167677 - DNA, 25 bp, Mus musculus
agcagcagacagactcttaccttcc

SEQ ID NO: 167678 - DNA, 25 bp, Mus musculus
agcagcagacagtctcttaccttcc

SEQ ID NO: 167679 - DNA, 25 bp, Mus musculus
agcagcagacccataaatgtgtaat

SEQ ID NO: 167680 - DNA, 25 bp, Mus musculus
agcagcagacccttaaatgtgtaat

SEQ ID NO: 167681 - DNA, 25 bp, Mus musculus
agcagcagagacatggccgtggtct

SEQ ID NO: 167682 - DNA, 25 bp, Mus musculus
agcagcagagacttggccgtggtct

SEQ ID NO: 167683 - DNA, 25 bp, Mus musculus
agcagcagagccaccctttaaagca

SEQ ID NO: 167684 - DNA, 25 bp, Mus musculus
agcagcagagcctccctttaaagca

SEQ ID NO: 167685 - DNA, 25 bp, Mus musculus
agcagcagagctatggtccttcgca

SEQ ID NO: 167686 - DNA, 25 bp, Mus musculus
agcagcagagctccatccataagac

SEQ ID NO: 167687 - DNA, 25 bp, Mus musculus
agcagcagagctgcatccataagac

SEQ ID NO: 167688 - DNA, 25 bp, Mus musculus
agcagcagagctttggtccttcgca

SEQ ID NO: 167689 - DNA, 25 bp, Mus musculus
agcagcagaggaaccacaccaagga

SEQ ID NO: 167690 - DNA, 25 bp, Mus musculus
agcagcagaggatccacaccaagga

SEQ ID NO: 167691 - DNA, 25 bp, Mus musculus
agcagcagagggagctcatccttgc

SEQ ID NO: 167692 - DNA, 25 bp, Mus musculus
agcagcagagggtgctcatccttgc

SEQ ID NO: 167693 - DNA, 25 bp, Mus musculus
agcagcagatccaaagccaaccttt

SEQ ID NO: 167694 - DNA, 25 bp, Mus musculus
agcagcagatccagacctaccagcg

SEQ ID NO: 167695 - DNA, 25 bp, Mus musculus
agcagcagatcctaagccaaccttt

SEQ ID NO: 167696 - DNA, 25 bp, Mus musculus
agcagcagatcctgacctaccagcg

SEQ ID NO: 167697 - DNA, 25 bp, Mus musculus
agcagcagatcgaggccatggagca

SEQ ID NO: 167698 - DNA, 25 bp, Mus musculus
agcagcagatcgtggccatggagca

SEQ ID NO: 167699 - DNA, 25 bp, Mus musculus
agcagcagatgcacatgtggttact

SEQ ID NO: 167700 - DNA, 25 bp, Mus musculus
agcagcagatgctcatgtggttact

SEQ ID NO: 167701 - DNA, 25 bp, Mus musculus
agcagcagatggaactcaaccgaga

SEQ ID NO: 167702 - DNA, 25 bp, Mus musculus
agcagcagatggtactcaaccgaga

SEQ ID NO: 167703 - DNA, 25 bp, Mus musculus
agcagcagattactcctcacagaaa

SEQ ID NO: 167704 - DNA, 25 bp, Mus musculus
agcagcagattagtcctcacagaaa

SEQ ID NO: 167705 - DNA, 25 bp, Mus musculus
agcagcagcagacatgacaacatgt

SEQ ID NO: 167706 - DNA, 25 bp, Mus musculus
agcagcagcagagatgacaacatgt

SEQ ID NO: 167707 - DNA, 25 bp, Mus musculus
agcagcagcatcctagagtcttgag

SEQ ID NO: 167708 - DNA, 25 bp, Mus musculus
agcagcagcatcgtagagtcttgag

SEQ ID NO: 167709 - DNA, 25 bp, Mus musculus
agcagcagcattctgagatcgatct

SEQ ID NO: 167710 - DNA, 25 bp, Mus musculus
agcagcagcattgtgagatcgatct

SEQ ID NO: 167711 - DNA, 25 bp, Mus musculus
agcagcagccagagaccagggctga

SEQ ID NO: 167712 - DNA, 25 bp, Mus musculus
agcagcagccagtgaccagggctga

SEQ ID NO: 167713 - DNA, 25 bp, Mus musculus
agcagcagccctactcatgagcgct

SEQ ID NO: 167714 - DNA, 25 bp, Mus musculus
agcagcagcccttctcatgagcgct

SEQ ID NO: 167715 - DNA, 25 bp, Mus musculus
agcagcagcctgctaagttctgaca

SEQ ID NO: 167716 - DNA, 25 bp, Mus musculus
agcagcagcctggtaagttctgaca

SEQ ID NO: 167717 - DNA, 25 bp, Mus musculus
agcagcagcgagaacttctgtcgtg

SEQ ID NO: 167718 - DNA, 25 bp, Mus musculus
agcagcagcgagctcaggcacatta

SEQ ID NO: 167719 - DNA, 25 bp, Mus musculus
agcagcagcgaggtcaggcacatta

SEQ ID NO: 167720 - DNA, 25 bp, Mus musculus
agcagcagcgagtacttctgtcgtg

SEQ ID NO: 167721 - DNA, 25 bp, Mus musculus
agcagcagcgctatcatccaggcaa

SEQ ID NO: 167722 - DNA, 25 bp, Mus musculus
agcagcagcgctttcatccaggcaa

SEQ ID NO: 167723 - DNA, 25 bp, Mus musculus
agcagcagctaacttcacacggcgg

SEQ ID NO: 167724 - DNA, 25 bp, Mus musculus
agcagcagctaagttcacacggcgg

SEQ ID NO: 167725 - DNA, 25 bp, Mus musculus
agcagcagctcacgttgcaggagtc

SEQ ID NO: 167726 - DNA, 25 bp, Mus musculus
agcagcagctcaggttgcaggagtc

SEQ ID NO: 167727 - DNA, 25 bp, Mus musculus
agcagcagctctacaggatgcactg

SEQ ID NO: 167728 - DNA, 25 bp, Mus musculus
agcagcagctcttcaggatgcactg

SEQ ID NO: 167729 - DNA, 25 bp, Mus musculus
agcagcagctgcaagctaaggctct

SEQ ID NO: 167730 - DNA, 25 bp, Mus musculus
agcagcagctgcatgcgctcggagt

SEQ ID NO: 167731 - DNA, 25 bp, Mus musculus
agcagcagctgctagctaaggctct

SEQ ID NO: 167732 - DNA, 25 bp, Mus musculus
agcagcagctgcttgcgctcggagt

SEQ ID NO: 167733 - DNA, 25 bp, Mus musculus
agcagcagcttcagatgtgaccctt

SEQ ID NO: 167734 - DNA, 25 bp, Mus musculus
agcagcagcttctgatgtgaccctt

SEQ ID NO: 167735 - DNA, 25 bp, Mus musculus
agcagcaggcccagtggatggaaca

SEQ ID NO: 167736 - DNA, 25 bp, Mus musculus
agcagcaggccctgtggatggaaca

SEQ ID NO: 167737 - DNA, 25 bp, Mus musculus
agcagcaggcgcagagtcgtagctt

SEQ ID NO: 167738 - DNA, 25 bp, Mus musculus
agcagcaggcgctgagtcgtagctt

SEQ ID NO: 167739 - DNA, 25 bp, Mus musculus
agcagcaggctcctagccagaaaat

SEQ ID NO: 167740 - DNA, 25 bp, Mus musculus
agcagcaggctcgtagccagaaaat

SEQ ID NO: 167741 - DNA, 25 bp, Mus musculus
agcagcaggctgatattgttttcaa

SEQ ID NO: 167742 - DNA, 25 bp, Mus musculus
agcagcaggctgttattgttttcaa

SEQ ID NO: 167743 - DNA, 25 bp, Mus musculus
agcagcagggatactcacaatgaca

SEQ ID NO: 167744 - DNA, 25 bp, Mus musculus
agcagcagggattctcacaatgaca

SEQ ID NO: 167745 - DNA, 25 bp, Mus musculus
agcagcaggtgacgcccctgtatgt

SEQ ID NO: 167746 - DNA, 25 bp, Mus musculus
agcagcaggtgaggcccctgtatgt

SEQ ID NO: 167747 - DNA, 25 bp, Mus musculus
agcagcaggtgccagaacgcaacct

SEQ ID NO: 167748 - DNA, 25 bp, Mus musculus
agcagcaggtgcgagaacgcaacct

SEQ ID NO: 167749 - DNA, 25 bp, Mus musculus
agcagcagtagcaatggcagtggca

SEQ ID NO: 167750 - DNA, 25 bp, Mus musculus
agcagcagtagctatggcagtggca

SEQ ID NO: 167751 - DNA, 25 bp, Mus musculus
agcagcagtattacttgggatttgg

SEQ ID NO: 167752 - DNA, 25 bp, Mus musculus
agcagcagtatttcttgggatttgg

SEQ ID NO: 167753 - DNA, 25 bp, Mus musculus
agcagcagtcagaccgtctggccaa

SEQ ID NO: 167754 - DNA, 25 bp, Mus musculus
agcagcagtcagcagtggcttccat

SEQ ID NO: 167755 - DNA, 25 bp, Mus musculus
agcagcagtcaggagtggcttccat

SEQ ID NO: 167756 - DNA, 25 bp, Mus musculus
agcagcagtcagtccgtctggccaa

SEQ ID NO: 167757 - DNA, 25 bp, Mus musculus
agcagcagtgatcccgatgaccact

SEQ ID NO: 167758 - DNA, 25 bp, Mus musculus
agcagcagtgatgccgatgaccact

SEQ ID NO: 167759 - DNA, 25 bp, Mus musculus
agcagcagtggaactctaagaatta

SEQ ID NO: 167760 - DNA, 25 bp, Mus musculus
agcagcagtggaccggaaacttcct

SEQ ID NO: 167761 - DNA, 25 bp, Mus musculus
agcagcagtggagcggaaacttcct

SEQ ID NO: 167762 - DNA, 25 bp, Mus musculus
agcagcagtggatctctaagaatta

SEQ ID NO: 167763 - DNA, 25 bp, Mus musculus
agcagcagttcaccagggcgcaaga

SEQ ID NO: 167764 - DNA, 25 bp, Mus musculus
agcagcagttcagcagggcgcaaga

SEQ ID NO: 167765 - DNA, 25 bp, Mus musculus
agcagcagttgtaggtcaggaatgt

SEQ ID NO: 167766 - DNA, 25 bp, Mus musculus
agcagcagttgttggtcaggaatgt

SEQ ID NO: 167767 - DNA, 25 bp, Mus musculus
agcagcagtttccagggcaaccgta

SEQ ID NO: 167768 - DNA, 25 bp, Mus musculus
agcagcagtttcgagggcaaccgta

SEQ ID NO: 167769 - DNA, 25 bp, Mus musculus
agcagcataatcaatttcacttagt

SEQ ID NO: 167770 - DNA, 25 bp, Mus musculus
agcagcataatcaggacccccgaga

SEQ ID NO: 167771 - DNA, 25 bp, Mus musculus
agcagcataatctatttcacttagt

SEQ ID NO: 167772 - DNA, 25 bp, Mus musculus
agcagcataatctggacccccgaga

SEQ ID NO: 167773 - DNA, 25 bp, Mus musculus
agcagcatacctccgtattgtgaag

SEQ ID NO: 167774 - DNA, 25 bp, Mus musculus
agcagcatacctgcgtattgtgaag

SEQ ID NO: 167775 - DNA, 25 bp, Mus musculus
agcagcatattgaaccgctatccct

SEQ ID NO: 167776 - DNA, 25 bp, Mus musculus
agcagcatattgaaggctgtcaggt

SEQ ID NO: 167777 - DNA, 25 bp, Mus musculus
agcagcatattgtaccgctatccct

SEQ ID NO: 167778 - DNA, 25 bp, Mus musculus
agcagcatattgtaggctgtcaggt

SEQ ID NO: 167779 - DNA, 25 bp, Mus musculus
agcagcatcaggctctgtacatatg

SEQ ID NO: 167780 - DNA, 25 bp, Mus musculus
agcagcatcagggtctgtacatatg

SEQ ID NO: 167781 - DNA, 25 bp, Mus musculus
agcagcatccgtacttgtttaaacc

SEQ ID NO: 167782 - DNA, 25 bp, Mus musculus
agcagcatccgttcttgtttaaacc

SEQ ID NO: 167783 - DNA, 25 bp, Mus musculus
agcagcatctctagcatctctcgat

SEQ ID NO: 167784 - DNA, 25 bp, Mus musculus
agcagcatctcttgcatctctcgat

SEQ ID NO: 167785 - DNA, 25 bp, Mus musculus
agcagcatctgacacacgtcgagaa

SEQ ID NO: 167786 - DNA, 25 bp, Mus musculus
agcagcatctgagacacgtcgagaa

SEQ ID NO: 167787 - DNA, 25 bp, Mus musculus
agcagcatctggagtctcagctgac

SEQ ID NO: 167788 - DNA, 25 bp, Mus musculus
agcagcatctggtgtctcagctgac

SEQ ID NO: 167789 - DNA, 25 bp, Mus musculus
agcagcatctgtagcaggtgggtta

SEQ ID NO: 167790 - DNA, 25 bp, Mus musculus
agcagcatctgttgcaggtgggtta

SEQ ID NO: 167791 - DNA, 25 bp, Mus musculus
agcagcatctttattggtccttgtc

SEQ ID NO: 167792 - DNA, 25 bp, Mus musculus
agcagcatcttttttggtccttgtc

SEQ ID NO: 167793 - DNA, 25 bp, Mus musculus
agcagcatgactcgctcagagctct

SEQ ID NO: 167794 - DNA, 25 bp, Mus musculus
agcagcatgactggctcagagctct

SEQ ID NO: 167795 - DNA, 25 bp, Mus musculus
agcagcatgcctcaccaatgggcac

SEQ ID NO: 167796 - DNA, 25 bp, Mus musculus
agcagcatgcctgaccaatgggcac

SEQ ID NO: 167797 - DNA, 25 bp, Mus musculus
agcagcatggacacagcatctgttc

SEQ ID NO: 167798 - DNA, 25 bp, Mus musculus
agcagcatggactcagcatctgttc

SEQ ID NO: 167799 - DNA, 25 bp, Mus musculus
agcagcatggctaggactgtgtcat

SEQ ID NO: 167800 - DNA, 25 bp, Mus musculus
agcagcatggcttggactgtgtcat

SEQ ID NO: 167801 - DNA, 25 bp, Mus musculus
agcagcatgggaaacgtttggcagt

SEQ ID NO: 167802 - DNA, 25 bp, Mus musculus
agcagcatgggatacgtttggcagt

SEQ ID NO: 167803 - DNA, 25 bp, Mus musculus
agcagcatgtataggaggctttcca

SEQ ID NO: 167804 - DNA, 25 bp, Mus musculus
agcagcatgtattggaggctttcca

SEQ ID NO: 167805 - DNA, 25 bp, Mus musculus
agcagcatgtgccacaaggctcgaa

SEQ ID NO: 167806 - DNA, 25 bp, Mus musculus
agcagcatgtgcgacaaggctcgaa

SEQ ID NO: 167807 - DNA, 25 bp, Mus musculus
agcagcatgtggcagctgtcccatt

SEQ ID NO: 167808 - DNA, 25 bp, Mus musculus
agcagcatgtgggagctgtcccatt

SEQ ID NO: 167809 - DNA, 25 bp, Mus musculus
agcagcatgtttcctgtttcgtgac

SEQ ID NO: 167810 - DNA, 25 bp, Mus musculus
agcagcatgtttgctgtttcgtgac

SEQ ID NO: 167811 - DNA, 25 bp, Mus musculus
agcagcattcccaacagatgctgaa

SEQ ID NO: 167812 - DNA, 25 bp, Mus musculus
agcagcattccctacagatgctgaa

SEQ ID NO: 167813 - DNA, 25 bp, Mus musculus
agcagcattcttactgtactgacca

SEQ ID NO: 167814 - DNA, 25 bp, Mus musculus
agcagcattctttctgtactgacca

SEQ ID NO: 167815 - DNA, 25 bp, Mus musculus
agcagcatttgaaaaaaggttcact

SEQ ID NO: 167816 - DNA, 25 bp, Mus musculus
agcagcatttgataaaaggttcact

SEQ ID NO: 167817 - DNA, 25 bp, Mus musculus
agcagcattttgattacagggcttg

SEQ ID NO: 167818 - DNA, 25 bp, Mus musculus
agcagcattttgtttacagggcttg

SEQ ID NO: 167819 - DNA, 25 bp, Mus musculus
agcagccaaactccagaagcaacgt

SEQ ID NO: 167820 - DNA, 25 bp, Mus musculus
agcagccaaactgcagaagcaacgt

SEQ ID NO: 167821 - DNA, 25 bp, Mus musculus
agcagccaacttatagcagcacaga

SEQ ID NO: 167822 - DNA, 25 bp, Mus musculus
agcagccaacttttagcagcacaga

SEQ ID NO: 167823 - DNA, 25 bp, Mus musculus
agcagccaagcgacttcggatggac

SEQ ID NO: 167824 - DNA, 25 bp, Mus musculus
agcagccaagcgtcttcggatggac

SEQ ID NO: 167825 - DNA, 25 bp, Mus musculus
agcagccaatgccttccatgtgtat

SEQ ID NO: 167826 - DNA, 25 bp, Mus musculus
agcagccaatgcgttccatgtgtat

SEQ ID NO: 167827 - DNA, 25 bp, Mus musculus
agcagccacatacgccatgaaggtg

SEQ ID NO: 167828 - DNA, 25 bp, Mus musculus
agcagccacataggccatgaaggtg

SEQ ID NO: 167829 - DNA, 25 bp, Mus musculus
agcagccaccctactgagcagtcag

SEQ ID NO: 167830 - DNA, 25 bp, Mus musculus
agcagccacccttctgagcagtcag

SEQ ID NO: 167831 - DNA, 25 bp, Mus musculus
agcagccaccttcgaaacgtcagct

SEQ ID NO: 167832 - DNA, 25 bp, Mus musculus
agcagccaccttggaaacgtcagct

SEQ ID NO: 167833 - DNA, 25 bp, Mus musculus
agcagccacgaaacagctctgttct

SEQ ID NO: 167834 - DNA, 25 bp, Mus musculus
agcagccacgaatcagctctgttct

SEQ ID NO: 167835 - DNA, 25 bp, Mus musculus
agcagccactgtaggatacgtttct

SEQ ID NO: 167836 - DNA, 25 bp, Mus musculus
agcagccactgttggatacgtttct

SEQ ID NO: 167837 - DNA, 25 bp, Mus musculus
agcagccagaataccacgagaagtt

SEQ ID NO: 167838 - DNA, 25 bp, Mus musculus
agcagccagaattccacgagaagtt

SEQ ID NO: 167839 - DNA, 25 bp, Mus musculus
agcagccagactcaactaaaattca

SEQ ID NO: 167840 - DNA, 25 bp, Mus musculus
agcagccagactgaactaaaattca

SEQ ID NO: 167841 - DNA, 25 bp, Mus musculus
agcagccagcagaccagaggtgtta

SEQ ID NO: 167842 - DNA, 25 bp, Mus musculus
agcagccagcagtccagaggtgtta

SEQ ID NO: 167843 - DNA, 25 bp, Mus musculus
agcagccagcggctcacagtggtcc

SEQ ID NO: 167844 - DNA, 25 bp, Mus musculus
agcagccagcgggtcacagtggtcc

SEQ ID NO: 167845 - DNA, 25 bp, Mus musculus
agcagccagcgtcccagagagacag

SEQ ID NO: 167846 - DNA, 25 bp, Mus musculus
agcagccagcgtgccagagagacag

SEQ ID NO: 167847 - DNA, 25 bp, Mus musculus
agcagccagctcataaattgtctta

SEQ ID NO: 167848 - DNA, 25 bp, Mus musculus
agcagccagctcttaaattgtctta

SEQ ID NO: 167849 - DNA, 25 bp, Mus musculus
agcagccaggcaacgcatgaacaaa

SEQ ID NO: 167850 - DNA, 25 bp, Mus musculus
agcagccaggcatcgcatgaacaaa

SEQ ID NO: 167851 - DNA, 25 bp, Mus musculus
agcagccagtacagattaccacaag

SEQ ID NO: 167852 - DNA, 25 bp, Mus musculus
agcagccagtactgattaccacaag

SEQ ID NO: 167853 - DNA, 25 bp, Mus musculus
agcagccagtagcacgtgaggtctt

SEQ ID NO: 167854 - DNA, 25 bp, Mus musculus
agcagccagtaggacgtgaggtctt

SEQ ID NO: 167855 - DNA, 25 bp, Mus musculus
agcagccagtgccatctcggagttg

SEQ ID NO: 167856 - DNA, 25 bp, Mus musculus
agcagccagtgcgatctcggagttg

SEQ ID NO: 167857 - DNA, 25 bp, Mus musculus
agcagccatagcagacctcatatta

SEQ ID NO: 167858 - DNA, 25 bp, Mus musculus
agcagccatagctgacctcatatta

SEQ ID NO: 167859 - DNA, 25 bp, Mus musculus
agcagccatcaaattatgaggatct

SEQ ID NO: 167860 - DNA, 25 bp, Mus musculus
agcagccatcaatttatgaggatct

SEQ ID NO: 167861 - DNA, 25 bp, Mus musculus
agcagccatccacagtccagctaaa

SEQ ID NO: 167862 - DNA, 25 bp, Mus musculus
agcagccatccagagtccagctaaa

SEQ ID NO: 167863 - DNA, 25 bp, Mus musculus
agcagccattttatgaagacccaac

SEQ ID NO: 167864 - DNA, 25 bp, Mus musculus
agcagccattttttgaagacccaac

SEQ ID NO: 167865 - DNA, 25 bp, Mus musculus
agcagcccacccatgaagttaggac

SEQ ID NO: 167866 - DNA, 25 bp, Mus musculus
agcagcccacccttgaagttaggac

SEQ ID NO: 167867 - DNA, 25 bp, Mus musculus
agcagcccagaacatctctttgatt

SEQ ID NO: 167868 - DNA, 25 bp, Mus musculus
agcagcccagaagatctctttgatt

SEQ ID NO: 167869 - DNA, 25 bp, Mus musculus
agcagcccagatctcttacagccta

SEQ ID NO: 167870 - DNA, 25 bp, Mus musculus
agcagcccagatgtcttacagccta

SEQ ID NO: 167871 - DNA, 25 bp, Mus musculus
agcagcccagccaggtgcggcacca

SEQ ID NO: 167872 - DNA, 25 bp, Mus musculus
agcagcccagcctggtgcggcacca

SEQ ID NO: 167873 - DNA, 25 bp, Mus musculus
agcagccccaagaacaattgctcct

SEQ ID NO: 167874 - DNA, 25 bp, Mus musculus
agcagccccaagattgcactcaagg

SEQ ID NO: 167875 - DNA, 25 bp, Mus musculus
agcagccccaagtacaattgctcct

SEQ ID NO: 167876 - DNA, 25 bp, Mus musculus
agcagccccaagtttgcactcaagg

SEQ ID NO: 167877 - DNA, 25 bp, Mus musculus
agcagccccacacacgtggagcaaa

SEQ ID NO: 167878 - DNA, 25 bp, Mus musculus
agcagccccacagacgtggagcaaa

SEQ ID NO: 167879 - DNA, 25 bp, Mus musculus
agcagccccagcactgatgggagac

SEQ ID NO: 167880 - DNA, 25 bp, Mus musculus
agcagccccagctctgatgggagac

SEQ ID NO: 167881 - DNA, 25 bp, Mus musculus
agcagccccatccttgggaatgaaa

SEQ ID NO: 167882 - DNA, 25 bp, Mus musculus
agcagccccatcgttgggaatgaaa

SEQ ID NO: 167883 - DNA, 25 bp, Mus musculus
agcagccccgtgcaataggcatgac

SEQ ID NO: 167884 - DNA, 25 bp, Mus musculus
agcagccccgtggaataggcatgac

SEQ ID NO: 167885 - DNA, 25 bp, Mus musculus
agcagcccctcacggaatggttcga

SEQ ID NO: 167886 - DNA, 25 bp, Mus musculus
agcagcccctcagggaatggttcga

SEQ ID NO: 167887 - DNA, 25 bp, Mus musculus
agcagcccctgtacatttgtgacat

SEQ ID NO: 167888 - DNA, 25 bp, Mus musculus
agcagcccctgttcatttgtgacat

SEQ ID NO: 167889 - DNA, 25 bp, Mus musculus
agcagcccgcacaagaggaggtcag

SEQ ID NO: 167890 - DNA, 25 bp, Mus musculus
agcagcccgcactagaggaggtcag

SEQ ID NO: 167891 - DNA, 25 bp, Mus musculus
agcagcccggcaaagaagaacaaat

SEQ ID NO: 167892 - DNA, 25 bp, Mus musculus
agcagcccggcatagaagaacaaat

SEQ ID NO: 167893 - DNA, 25 bp, Mus musculus
agcagcccgggtaacagtggtgcca

SEQ ID NO: 167894 - DNA, 25 bp, Mus musculus
agcagcccgggttacagtggtgcca

SEQ ID NO: 167895 - DNA, 25 bp, Mus musculus
agcagcccgtgcacttaaagatgga

SEQ ID NO: 167896 - DNA, 25 bp, Mus musculus
agcagcccgtgctcttaaagatgga

SEQ ID NO: 167897 - DNA, 25 bp, Mus musculus
agcagccctaatatctactgtcttg

SEQ ID NO: 167898 - DNA, 25 bp, Mus musculus
agcagccctaatttctactgtcttg

SEQ ID NO: 167899 - DNA, 25 bp, Mus musculus
agcagccctacgagaccaaggtgaa

SEQ ID NO: 167900 - DNA, 25 bp, Mus musculus
agcagccctacgtgaccaaggtgaa

SEQ ID NO: 167901 - DNA, 25 bp, Mus musculus
agcagccctgaacgtcatgaccatg

SEQ ID NO: 167902 - DNA, 25 bp, Mus musculus
agcagccctgaaggtcatgaccatg

SEQ ID NO: 167903 - DNA, 25 bp, Mus musculus
agcagccctggcatgagactgaaga

SEQ ID NO: 167904 - DNA, 25 bp, Mus musculus
agcagccctggcttgagactgaaga

SEQ ID NO: 167905 - DNA, 25 bp, Mus musculus
agcagcccttgcataggaacctgag

SEQ ID NO: 167906 - DNA, 25 bp, Mus musculus
agcagcccttgcttaggaacctgag

SEQ ID NO: 167907 - DNA, 25 bp, Mus musculus
agcagccgaatacatgaatcaggat

SEQ ID NO: 167908 - DNA, 25 bp, Mus musculus
agcagccgaatagatgaatcaggat

SEQ ID NO: 167909 - DNA, 25 bp, Mus musculus
agcagccgagcacctctggatggca

SEQ ID NO: 167910 - DNA, 25 bp, Mus musculus
agcagccgagcagctctggatggca

SEQ ID NO: 167911 - DNA, 25 bp, Mus musculus
agcagccgatctagagcgctttttt

SEQ ID NO: 167912 - DNA, 25 bp, Mus musculus
agcagccgatcttgagcgctttttt

SEQ ID NO: 167913 - DNA, 25 bp, Mus musculus
agcagccgcacaaacagcccagcta

SEQ ID NO: 167914 - DNA, 25 bp, Mus musculus
agcagccgcacaaacttacttgcgg

SEQ ID NO: 167915 - DNA, 25 bp, Mus musculus
agcagccgcacatacagcccagcta

SEQ ID NO: 167916 - DNA, 25 bp, Mus musculus
agcagccgcacatacttacttgcgg

SEQ ID NO: 167917 - DNA, 25 bp, Mus musculus
agcagccgcagccagatttatccaa

SEQ ID NO: 167918 - DNA, 25 bp, Mus musculus
agcagccgcagcgagatttatccaa

SEQ ID NO: 167919 - DNA, 25 bp, Mus musculus
agcagccgtctgatgagcatgcgca

SEQ ID NO: 167920 - DNA, 25 bp, Mus musculus
agcagccgtctgttgagcatgcgca

SEQ ID NO: 167921 - DNA, 25 bp, Mus musculus
agcagccgtgcaagcagcagtcgaa

SEQ ID NO: 167922 - DNA, 25 bp, Mus musculus
agcagccgtgcatgcagcagtcgaa

SEQ ID NO: 167923 - DNA, 25 bp, Mus musculus
agcagccgtgtcactatccactggt

SEQ ID NO: 167924 - DNA, 25 bp, Mus musculus
agcagccgtgtctctatccactggt

SEQ ID NO: 167925 - DNA, 25 bp, Mus musculus
agcagccgttacctgtacatttgca

SEQ ID NO: 167926 - DNA, 25 bp, Mus musculus
agcagccgttacgtgtacatttgca

SEQ ID NO: 167927 - DNA, 25 bp, Mus musculus
agcagcctaaagattaatcagttgg

SEQ ID NO: 167928 - DNA, 25 bp, Mus musculus
agcagcctaaagtttaatcagttgg

SEQ ID NO: 167929 - DNA, 25 bp, Mus musculus
agcagcctacaccaaacgtgatgga

SEQ ID NO: 167930 - DNA, 25 bp, Mus musculus
agcagcctacacctgcctgtaatct

SEQ ID NO: 167931 - DNA, 25 bp, Mus musculus
agcagcctacacgaaacgtgatgga

SEQ ID NO: 167932 - DNA, 25 bp, Mus musculus
agcagcctacacgtgcctgtaatct

SEQ ID NO: 167933 - DNA, 25 bp, Mus musculus
agcagcctatccaggagcggtggac

SEQ ID NO: 167934 - DNA, 25 bp, Mus musculus
agcagcctatcctggagcggtggac

SEQ ID NO: 167935 - DNA, 25 bp, Mus musculus
agcagcctcaccatgggtgaatcaa

SEQ ID NO: 167936 - DNA, 25 bp, Mus musculus
agcagcctcaccttgggtgaatcaa

SEQ ID NO: 167937 - DNA, 25 bp, Mus musculus
agcagcctcactcacgtaggtgtga

SEQ ID NO: 167938 - DNA, 25 bp, Mus musculus
agcagcctcactgacgtaggtgtga

SEQ ID NO: 167939 - DNA, 25 bp, Mus musculus
agcagcctcagcacatagagtctgt

SEQ ID NO: 167940 - DNA, 25 bp, Mus musculus
agcagcctcagctcatagagtctgt

SEQ ID NO: 167941 - DNA, 25 bp, Mus musculus
agcagcctcaggaactaccttgtaa

SEQ ID NO: 167942 - DNA, 25 bp, Mus musculus
agcagcctcaggcacagtactggca

SEQ ID NO: 167943 - DNA, 25 bp, Mus musculus
agcagcctcagggacagtactggca

SEQ ID NO: 167944 - DNA, 25 bp, Mus musculus
agcagcctcaggtactaccttgtaa

SEQ ID NO: 167945 - DNA, 25 bp, Mus musculus
agcagcctcatacaagcacattctt

SEQ ID NO: 167946 - DNA, 25 bp, Mus musculus
agcagcctcatagaagcacattctt

SEQ ID NO: 167947 - DNA, 25 bp, Mus musculus
agcagcctccagcacgggctcttta

SEQ ID NO: 167948 - DNA, 25 bp, Mus musculus
agcagcctccaggacgggctcttta

SEQ ID NO: 167949 - DNA, 25 bp, Mus musculus
agcagcctcctactgttcacaacaa

SEQ ID NO: 167950 - DNA, 25 bp, Mus musculus
agcagcctcctagtgttcacaacaa

SEQ ID NO: 167951 - DNA, 25 bp, Mus musculus
agcagcctcgcactattccgattca

SEQ ID NO: 167952 - DNA, 25 bp, Mus musculus
agcagcctcgcagtattccgattca

SEQ ID NO: 167953 - DNA, 25 bp, Mus musculus
agcagcctcgggaactcatgttttc

SEQ ID NO: 167954 - DNA, 25 bp, Mus musculus
agcagcctcgggtactcatgttttc

SEQ ID NO: 167955 - DNA, 25 bp, Mus musculus
agcagcctctgcagttgcctgagta

SEQ ID NO: 167956 - DNA, 25 bp, Mus musculus
agcagcctctgctgttgcctgagta

SEQ ID NO: 167957 - DNA, 25 bp, Mus musculus
agcagcctctggcttccattcaagc

SEQ ID NO: 167958 - DNA, 25 bp, Mus musculus
agcagcctctgggttccattcaagc

SEQ ID NO: 167959 - DNA, 25 bp, Mus musculus
agcagcctgagaccctactgggaaa

SEQ ID NO: 167960 - DNA, 25 bp, Mus musculus
agcagcctgagagcctactgggaaa

SEQ ID NO: 167961 - DNA, 25 bp, Mus musculus
agcagcctgagcagcgactacactg

SEQ ID NO: 167962 - DNA, 25 bp, Mus musculus
agcagcctgagctgcgactacactg

SEQ ID NO: 167963 - DNA, 25 bp, Mus musculus
agcagcctgaggagttcttcatccc

SEQ ID NO: 167964 - DNA, 25 bp, Mus musculus
agcagcctgaggtgttcttcatccc

SEQ ID NO: 167965 - DNA, 25 bp, Mus musculus
agcagcctgatgatgagccaagtca

SEQ ID NO: 167966 - DNA, 25 bp, Mus musculus
agcagcctgatgttgagccaagtca

SEQ ID NO: 167967 - DNA, 25 bp, Mus musculus
agcagcctgcacatcttgaaagact

SEQ ID NO: 167968 - DNA, 25 bp, Mus musculus
agcagcctgcacttcttgaaagact

SEQ ID NO: 167969 - DNA, 25 bp, Mus musculus
agcagcctgcctacctgagttgcaa

SEQ ID NO: 167970 - DNA, 25 bp, Mus musculus
agcagcctgccttcctgagttgcaa

SEQ ID NO: 167971 - DNA, 25 bp, Mus musculus
agcagcctggctatgagtctggagc

SEQ ID NO: 167972 - DNA, 25 bp, Mus musculus
agcagcctggctcgctaatgctgag

SEQ ID NO: 167973 - DNA, 25 bp, Mus musculus
agcagcctggctggctaatgctgag

SEQ ID NO: 167974 - DNA, 25 bp, Mus musculus
agcagcctggctttgagtctggagc

SEQ ID NO: 167975 - DNA, 25 bp, Mus musculus
agcagcctgggactatatgcacgca

SEQ ID NO: 167976 - DNA, 25 bp, Mus musculus
agcagcctgggagtatatgcacgca

SEQ ID NO: 167977 - DNA, 25 bp, Mus musculus
agcagcctgggcagtgaccattttc

SEQ ID NO: 167978 - DNA, 25 bp, Mus musculus
agcagcctgggctgtgaccattttc

SEQ ID NO: 167979 - DNA, 25 bp, Mus musculus
agcagcctgggtcattctcaaagac

SEQ ID NO: 167980 - DNA, 25 bp, Mus musculus
agcagcctgggtgattctcaaagac

SEQ ID NO: 167981 - DNA, 25 bp, Mus musculus
agcagcctgtgactccccagtcagg

SEQ ID NO: 167982 - DNA, 25 bp, Mus musculus
agcagcctgtgagtccccagtcagg

SEQ ID NO: 167983 - DNA, 25 bp, Mus musculus
agcagccttaacctttagcctatag

SEQ ID NO: 167984 - DNA, 25 bp, Mus musculus
agcagccttaacgtttagcctatag

SEQ ID NO: 167985 - DNA, 25 bp, Mus musculus
agcagccttacacggtggcgaagca

SEQ ID NO: 167986 - DNA, 25 bp, Mus musculus
agcagccttacagggtggcgaagca

SEQ ID NO: 167987 - DNA, 25 bp, Mus musculus
agcagccttatcctgggtctgtggt

SEQ ID NO: 167988 - DNA, 25 bp, Mus musculus
agcagccttatcgtgggtctgtggt

SEQ ID NO: 167989 - DNA, 25 bp, Mus musculus
agcagccttcctcattatcagaaat

SEQ ID NO: 167990 - DNA, 25 bp, Mus musculus
agcagccttcctgattatcagaaat

SEQ ID NO: 167991 - DNA, 25 bp, Mus musculus
agcagccttcgtcagtctagttgtg

SEQ ID NO: 167992 - DNA, 25 bp, Mus musculus
agcagccttcgtcagtctgttggta

SEQ ID NO: 167993 - DNA, 25 bp, Mus musculus
agcagccttcgtgagtctagttgtg

SEQ ID NO: 167994 - DNA, 25 bp, Mus musculus
agcagccttcgtgagtctgttggta

SEQ ID NO: 167995 - DNA, 25 bp, Mus musculus
agcagccttgctagaggaacgccca

SEQ ID NO: 167996 - DNA, 25 bp, Mus musculus
agcagccttgcttgaggaacgccca

SEQ ID NO: 167997 - DNA, 25 bp, Mus musculus
agcagccttggcacctgagagaggt

SEQ ID NO: 167998 - DNA, 25 bp, Mus musculus
agcagccttggctcctgagagaggt

SEQ ID NO: 167999 - DNA, 25 bp, Mus musculus
agcagccttgtacgtgctgggatct

SEQ ID NO: 168000 - DNA, 25 bp, Mus musculus
agcagccttgtaggtgctgggatct

SEQ ID NO: 168001 - DNA, 25 bp, Mus musculus
agcagccttgtcatatgggttccct

SEQ ID NO: 168002 - DNA, 25 bp, Mus musculus
agcagccttgtcttatgggttccct

SEQ ID NO: 168003 - DNA, 25 bp, Mus musculus
agcagcgaaagcatccacgaggaaa

SEQ ID NO: 168004 - DNA, 25 bp, Mus musculus
agcagcgaaagcttccacgaggaaa

SEQ ID NO: 168005 - DNA, 25 bp, Mus musculus
agcagcgaatgtagcagcttcttgt

SEQ ID NO: 168006 - DNA, 25 bp, Mus musculus
agcagcgaatgttgcagcttcttgt

SEQ ID NO: 168007 - DNA, 25 bp, Mus musculus
agcagcgacaccaccagcagggaaa

SEQ ID NO: 168008 - DNA, 25 bp, Mus musculus
agcagcgacacctccagcagggaaa

SEQ ID NO: 168009 - DNA, 25 bp, Mus musculus
agcagcgacagactgggcaagcctt

SEQ ID NO: 168010 - DNA, 25 bp, Mus musculus
agcagcgacagagtgggcaagcctt

SEQ ID NO: 168011 - DNA, 25 bp, Mus musculus
agcagcgacatgatgggccagagta

SEQ ID NO: 168012 - DNA, 25 bp, Mus musculus
agcagcgacatgttgggccagagta

SEQ ID NO: 168013 - DNA, 25 bp, Mus musculus
agcagcgaccatcgcagtcacagac

SEQ ID NO: 168014 - DNA, 25 bp, Mus musculus
agcagcgaccatggcagtcacagac

SEQ ID NO: 168015 - DNA, 25 bp, Mus musculus
agcagcgacggtagcctgtccgcca

SEQ ID NO: 168016 - DNA, 25 bp, Mus musculus
agcagcgacggttgcctgtccgcca

SEQ ID NO: 168017 - DNA, 25 bp, Mus musculus
agcagcgagccaaatgcttggagga

SEQ ID NO: 168018 - DNA, 25 bp, Mus musculus
agcagcgagccatatgcttggagga

SEQ ID NO: 168019 - DNA, 25 bp, Mus musculus
agcagcgagtcgacatccagtggga

SEQ ID NO: 168020 - DNA, 25 bp, Mus musculus
agcagcgagtcgtcatccagtggga

SEQ ID NO: 168021 - DNA, 25 bp, Mus musculus
agcagcgatctactttcattaaaaa

SEQ ID NO: 168022 - DNA, 25 bp, Mus musculus
agcagcgatctagtttcattaaaaa

SEQ ID NO: 168023 - DNA, 25 bp, Mus musculus
agcagcgccaatatgatgtcaggga

SEQ ID NO: 168024 - DNA, 25 bp, Mus musculus
agcagcgccaatttgatgtcaggga

SEQ ID NO: 168025 - DNA, 25 bp, Mus musculus
agcagcgccggcaagctcagaagca

SEQ ID NO: 168026 - DNA, 25 bp, Mus musculus
agcagcgccggctagctcagaagca

SEQ ID NO: 168027 - DNA, 25 bp, Mus musculus
agcagcgcctgtaggaagaccgcaa

SEQ ID NO: 168028 - DNA, 25 bp, Mus musculus
agcagcgcctgttggaagaccgcaa

SEQ ID NO: 168029 - DNA, 25 bp, Mus musculus
agcagcgcgtgaacgtaagccctga

SEQ ID NO: 168030 - DNA, 25 bp, Mus musculus
agcagcgcgtgatcgtaagccctga

SEQ ID NO: 168031 - DNA, 25 bp, Mus musculus
agcagcgctcgtccaaggacggcct

SEQ ID NO: 168032 - DNA, 25 bp, Mus musculus
agcagcgctcgtgcaaggacggcct

SEQ ID NO: 168033 - DNA, 25 bp, Mus musculus
agcagcgctgcacgcacagagctga

SEQ ID NO: 168034 - DNA, 25 bp, Mus musculus
agcagcgctgcaggcacagagctga

SEQ ID NO: 168035 - DNA, 25 bp, Mus musculus
agcagcgcttgtcacaagtctgact

SEQ ID NO: 168036 - DNA, 25 bp, Mus musculus
agcagcgcttgtgacaagtctgact

SEQ ID NO: 168037 - DNA, 25 bp, Mus musculus
agcagcggcaccatgaagaacagga

SEQ ID NO: 168038 - DNA, 25 bp, Mus musculus
agcagcggcaccttgaagaacagga

SEQ ID NO: 168039 - DNA, 25 bp, Mus musculus
agcagcggcagcacttgtgttctgg

SEQ ID NO: 168040 - DNA, 25 bp, Mus musculus
agcagcggcagctcttgtgttctgg

SEQ ID NO: 168041 - DNA, 25 bp, Mus musculus
agcagcggcgctatgacctgtttga

SEQ ID NO: 168042 - DNA, 25 bp, Mus musculus
agcagcggcgctttgacctgtttga

SEQ ID NO: 168043 - DNA, 25 bp, Mus musculus
agcagcggctcaactacagtggcaa

SEQ ID NO: 168044 - DNA, 25 bp, Mus musculus
agcagcggctcatctacagtggcaa

SEQ ID NO: 168045 - DNA, 25 bp, Mus musculus
agcagcggctccctcactgtgaatg

SEQ ID NO: 168046 - DNA, 25 bp, Mus musculus
agcagcggctccgtcactgtgaatg

SEQ ID NO: 168047 - DNA, 25 bp, Mus musculus
agcagcggctgcctatggtcccgat

SEQ ID NO: 168048 - DNA, 25 bp, Mus musculus
agcagcggctgcgtatggtcccgat

SEQ ID NO: 168049 - DNA, 25 bp, Mus musculus
agcagcggctggacatcgacacggt

SEQ ID NO: 168050 - DNA, 25 bp, Mus musculus
agcagcggctggtcatcgacacggt

SEQ ID NO: 168051 - DNA, 25 bp, Mus musculus
agcagcgggctcagtgccatgcact

SEQ ID NO: 168052 - DNA, 25 bp, Mus musculus
agcagcgggctctgtgccatgcact

SEQ ID NO: 168053 - DNA, 25 bp, Mus musculus
agcagcgtaaacacaaccagcgggt

SEQ ID NO: 168054 - DNA, 25 bp, Mus musculus
agcagcgtaaactcaaccagcgggt

SEQ ID NO: 168055 - DNA, 25 bp, Mus musculus
agcagcgtaggtacagctccaccag

SEQ ID NO: 168056 - DNA, 25 bp, Mus musculus
agcagcgtaggttcagctccaccag

SEQ ID NO: 168057 - DNA, 25 bp, Mus musculus
agcagcgtcaagcaaaggctccggc

SEQ ID NO: 168058 - DNA, 25 bp, Mus musculus
agcagcgtcaaggaaaggctccggc

SEQ ID NO: 168059 - DNA, 25 bp, Mus musculus
agcagcgtccagacttgcgggccaa

SEQ ID NO: 168060 - DNA, 25 bp, Mus musculus
agcagcgtccagtcttgcgggccaa

SEQ ID NO: 168061 - DNA, 25 bp, Mus musculus
agcagcgtcgccaacaggagaatat

SEQ ID NO: 168062 - DNA, 25 bp, Mus musculus
agcagcgtcgcctacaggagaatat

SEQ ID NO: 168063 - DNA, 25 bp, Mus musculus
agcagcgtgattcgcttccatatca

SEQ ID NO: 168064 - DNA, 25 bp, Mus musculus
agcagcgtgattggcttccatatca

SEQ ID NO: 168065 - DNA, 25 bp, Mus musculus
agcagcgtgtacatccgtagtgtgg

SEQ ID NO: 168066 - DNA, 25 bp, Mus musculus
agcagcgtgtacttccgtagtgtgg

SEQ ID NO: 168067 - DNA, 25 bp, Mus musculus
agcagcgtgttcagtgacccactaa

SEQ ID NO: 168068 - DNA, 25 bp, Mus musculus
agcagcgtgttctgtgacccactaa

SEQ ID NO: 168069 - DNA, 25 bp, Mus musculus
agcagctaaaatctcttctaccttt

SEQ ID NO: 168070 - DNA, 25 bp, Mus musculus
agcagctaaaatgtcttctaccttt

SEQ ID NO: 168071 - DNA, 25 bp, Mus musculus
agcagctaactcagaactgttagag

SEQ ID NO: 168072 - DNA, 25 bp, Mus musculus
agcagctaactctgaactgttagag

SEQ ID NO: 168073 - DNA, 25 bp, Mus musculus
agcagctaagaaccataagccctag

SEQ ID NO: 168074 - DNA, 25 bp, Mus musculus
agcagctaagaagcataagccctag

SEQ ID NO: 168075 - DNA, 25 bp, Mus musculus
agcagctacagtctttgaagccgtt

SEQ ID NO: 168076 - DNA, 25 bp, Mus musculus
agcagctacagtgtttgaagccgtt

SEQ ID NO: 168077 - DNA, 25 bp, Mus musculus
agcagctaccagagccggatgcaga

SEQ ID NO: 168078 - DNA, 25 bp, Mus musculus
agcagctaccagtgccggatgcaga

SEQ ID NO: 168079 - DNA, 25 bp, Mus musculus
agcagctaccatcgcttagcatcat

SEQ ID NO: 168080 - DNA, 25 bp, Mus musculus
agcagctaccatggcttagcatcat

SEQ ID NO: 168081 - DNA, 25 bp, Mus musculus
agcagctacctccatcacaagaaga

SEQ ID NO: 168082 - DNA, 25 bp, Mus musculus
agcagctacctcgatcacaagaaga

SEQ ID NO: 168083 - DNA, 25 bp, Mus musculus
agcagctacgcacggctgggattta

SEQ ID NO: 168084 - DNA, 25 bp, Mus musculus
agcagctacgcagggctgggattta

SEQ ID NO: 168085 - DNA, 25 bp, Mus musculus
agcagctacgccagtgtgaattagt

SEQ ID NO: 168086 - DNA, 25 bp, Mus musculus
agcagctacgcctgtgtgaattagt

SEQ ID NO: 168087 - DNA, 25 bp, Mus musculus
agcagctacgttcattctgtacgct

SEQ ID NO: 168088 - DNA, 25 bp, Mus musculus
agcagctacgttgattctgtacgct

SEQ ID NO: 168089 - DNA, 25 bp, Mus musculus
agcagctactacagtgttcctgagc

SEQ ID NO: 168090 - DNA, 25 bp, Mus musculus
agcagctactactgtgttcctgagc

SEQ ID NO: 168091 - DNA, 25 bp, Mus musculus
agcagctactagctcagtgtgctca

SEQ ID NO: 168092 - DNA, 25 bp, Mus musculus
agcagctactaggtcagtgtgctca

SEQ ID NO: 168093 - DNA, 25 bp, Mus musculus
agcagctactcccactaattgtaaa

SEQ ID NO: 168094 - DNA, 25 bp, Mus musculus
agcagctactccgactaattgtaaa

SEQ ID NO: 168095 - DNA, 25 bp, Mus musculus
agcagctactgcactggcaaccaaa

SEQ ID NO: 168096 - DNA, 25 bp, Mus musculus
agcagctactgctctggcaaccaaa

SEQ ID NO: 168097 - DNA, 25 bp, Mus musculus
agcagctagaccatggaaagtagat

SEQ ID NO: 168098 - DNA, 25 bp, Mus musculus
agcagctagaccttggaaagtagat

SEQ ID NO: 168099 - DNA, 25 bp, Mus musculus
agcagctaggccacttctgtagcgt

SEQ ID NO: 168100 - DNA, 25 bp, Mus musculus
agcagctaggcctcttctgtagcgt

SEQ ID NO: 168101 - DNA, 25 bp, Mus musculus
agcagctagtggagccagagagact

SEQ ID NO: 168102 - DNA, 25 bp, Mus musculus
agcagctagtggtgccagagagact

SEQ ID NO: 168103 - DNA, 25 bp, Mus musculus
agcagctatccgctgtctcctggaa

SEQ ID NO: 168104 - DNA, 25 bp, Mus musculus
agcagctatccggtgtctcctggaa

SEQ ID NO: 168105 - DNA, 25 bp, Mus musculus
agcagctattttaataagggccacc

SEQ ID NO: 168106 - DNA, 25 bp, Mus musculus
agcagctatttttataagggccacc

SEQ ID NO: 168107 - DNA, 25 bp, Mus musculus
agcagctcaagcattctgttgcctt

SEQ ID NO: 168108 - DNA, 25 bp, Mus musculus
agcagctcaagccatttctaccgag

SEQ ID NO: 168109 - DNA, 25 bp, Mus musculus
agcagctcaagcgatttctaccgag

SEQ ID NO: 168110 - DNA, 25 bp, Mus musculus
agcagctcaagctttctgttgcctt

SEQ ID NO: 168111 - DNA, 25 bp, Mus musculus
agcagctcaaggacaagttccgaac

SEQ ID NO: 168112 - DNA, 25 bp, Mus musculus
agcagctcaaggtcaagttccgaac

SEQ ID NO: 168113 - DNA, 25 bp, Mus musculus
agcagctcagagattcaacaggagt

SEQ ID NO: 168114 - DNA, 25 bp, Mus musculus
agcagctcagagtttcaacaggagt

SEQ ID NO: 168115 - DNA, 25 bp, Mus musculus
agcagctcaggaagatgccgtgaag

SEQ ID NO: 168116 - DNA, 25 bp, Mus musculus
agcagctcaggatgatgccgtgaag

SEQ ID NO: 168117 - DNA, 25 bp, Mus musculus
agcagctcagtcagtgccactgtca

SEQ ID NO: 168118 - DNA, 25 bp, Mus musculus
agcagctcagtctgtgccactgtca

SEQ ID NO: 168119 - DNA, 25 bp, Mus musculus
agcagctcatttagaatcccttctc

SEQ ID NO: 168120 - DNA, 25 bp, Mus musculus
agcagctcattttgaatcccttctc

SEQ ID NO: 168121 - DNA, 25 bp, Mus musculus
agcagctccaacagtgcacagcaaa

SEQ ID NO: 168122 - DNA, 25 bp, Mus musculus
agcagctccaactgtgcacagcaaa

SEQ ID NO: 168123 - DNA, 25 bp, Mus musculus
agcagctccagcacgagtgggagca

SEQ ID NO: 168124 - DNA, 25 bp, Mus musculus
agcagctccagctcgagtgggagca

SEQ ID NO: 168125 - DNA, 25 bp, Mus musculus
agcagctcccagagaagatgagtcc

SEQ ID NO: 168126 - DNA, 25 bp, Mus musculus
agcagctcccagagatgctgtgttt

SEQ ID NO: 168127 - DNA, 25 bp, Mus musculus
agcagctcccagtgaagatgagtcc

SEQ ID NO: 168128 - DNA, 25 bp, Mus musculus
agcagctcccagtgatgctgtgttt

SEQ ID NO: 168129 - DNA, 25 bp, Mus musculus
agcagctcccgtcgtggagttgtgt

SEQ ID NO: 168130 - DNA, 25 bp, Mus musculus
agcagctcccgtggtggagttgtgt

SEQ ID NO: 168131 - DNA, 25 bp, Mus musculus
agcagctccgcaccgggtcctcgag

SEQ ID NO: 168132 - DNA, 25 bp, Mus musculus
agcagctccgcagcgggtcctcgag

SEQ ID NO: 168133 - DNA, 25 bp, Mus musculus
agcagctcctaccatggacaggtgg

SEQ ID NO: 168134 - DNA, 25 bp, Mus musculus
agcagctcctacgatggacaggtgg

SEQ ID NO: 168135 - DNA, 25 bp, Mus musculus
agcagctcctatatagccttagcag

SEQ ID NO: 168136 - DNA, 25 bp, Mus musculus
agcagctcctatttagccttagcag

SEQ ID NO: 168137 - DNA, 25 bp, Mus musculus
agcagctcctggatatatagctcca

SEQ ID NO: 168138 - DNA, 25 bp, Mus musculus
agcagctcctggttatatagctcca

SEQ ID NO: 168139 - DNA, 25 bp, Mus musculus
agcagctcctgtcgaggctactttt

SEQ ID NO: 168140 - DNA, 25 bp, Mus musculus
agcagctcctgtggaggctactttt

SEQ ID NO: 168141 - DNA, 25 bp, Mus musculus
agcagctccttgactggcaaagcaa

SEQ ID NO: 168142 - DNA, 25 bp, Mus musculus
agcagctccttgtctggcaaagcaa

SEQ ID NO: 168143 - DNA, 25 bp, Mus musculus
agcagctcctttagcttcacatgag

SEQ ID NO: 168144 - DNA, 25 bp, Mus musculus
agcagctccttttgcttcacatgag

SEQ ID NO: 168145 - DNA, 25 bp, Mus musculus
agcagctcgcagcagattcgcactt

SEQ ID NO: 168146 - DNA, 25 bp, Mus musculus
agcagctcgcaggagattcgcactt

SEQ ID NO: 168147 - DNA, 25 bp, Mus musculus
agcagctcgccgacgtggaggcaaa

SEQ ID NO: 168148 - DNA, 25 bp, Mus musculus
agcagctcgccgtcgtggaggcaaa

SEQ ID NO: 168149 - DNA, 25 bp, Mus musculus
agcagctcggcacctgttatgttga

SEQ ID NO: 168150 - DNA, 25 bp, Mus musculus
agcagctcggcagctgttatgttga

SEQ ID NO: 168151 - DNA, 25 bp, Mus musculus
agcagctcgtcaatggtattcctga

SEQ ID NO: 168152 - DNA, 25 bp, Mus musculus
agcagctcgtcattggtattcctga

SEQ ID NO: 168153 - DNA, 25 bp, Mus musculus
agcagctctatgctattctgtggcc

SEQ ID NO: 168154 - DNA, 25 bp, Mus musculus
agcagctctatggtattctgtggcc

SEQ ID NO: 168155 - DNA, 25 bp, Mus musculus
agcagctctccgctcgatttctgga

SEQ ID NO: 168156 - DNA, 25 bp, Mus musculus
agcagctctccggtcgatttctgga

SEQ ID NO: 168157 - DNA, 25 bp, Mus musculus
agcagctctctaaggacggttgtat

SEQ ID NO: 168158 - DNA, 25 bp, Mus musculus
agcagctctctatggacggttgtat

SEQ ID NO: 168159 - DNA, 25 bp, Mus musculus
agcagctctctgcaggtatttggaa

SEQ ID NO: 168160 - DNA, 25 bp, Mus musculus
agcagctctctggaggtatttggaa

SEQ ID NO: 168161 - DNA, 25 bp, Mus musculus
agcagctctgaccaggcatctgaaa

SEQ ID NO: 168162 - DNA, 25 bp, Mus musculus
agcagctctgacgaggcatctgaaa

SEQ ID NO: 168163 - DNA, 25 bp, Mus musculus
agcagctctgagacgtgtccgcctt

SEQ ID NO: 168164 - DNA, 25 bp, Mus musculus
agcagctctgagtcgtgtccgcctt

SEQ ID NO: 168165 - DNA, 25 bp, Mus musculus
agcagctctgataatgctctagctt

SEQ ID NO: 168166 - DNA, 25 bp, Mus musculus
agcagctctgattatgctctagctt

SEQ ID NO: 168167 - DNA, 25 bp, Mus musculus
agcagctcttcaaggcctttcagaa

SEQ ID NO: 168168 - DNA, 25 bp, Mus musculus
agcagctcttcatggcctttcagaa

SEQ ID NO: 168169 - DNA, 25 bp, Mus musculus
agcagctcttgcatctgaatccagt

SEQ ID NO: 168170 - DNA, 25 bp, Mus musculus
agcagctcttgcttctgaatccagt

SEQ ID NO: 168171 - DNA, 25 bp, Mus musculus
agcagctgaaacactcccatgacag

SEQ ID NO: 168172 - DNA, 25 bp, Mus musculus
agcagctgaaactctcccatgacag

SEQ ID NO: 168173 - DNA, 25 bp, Mus musculus
agcagctgaaagagaccgacccata

SEQ ID NO: 168174 - DNA, 25 bp, Mus musculus
agcagctgaaagtgaccgacccata

SEQ ID NO: 168175 - DNA, 25 bp, Mus musculus
agcagctgaagcctaccaccttgct

SEQ ID NO: 168176 - DNA, 25 bp, Mus musculus
agcagctgaagcgtaccaccttgct

SEQ ID NO: 168177 - DNA, 25 bp, Mus musculus
agcagctgaagtacaatcttgatga

SEQ ID NO: 168178 - DNA, 25 bp, Mus musculus
agcagctgaagttcaatcttgatga

SEQ ID NO: 168179 - DNA, 25 bp, Mus musculus
agcagctgacgtccttgctagtttt

SEQ ID NO: 168180 - DNA, 25 bp, Mus musculus
agcagctgacgtgcttgctagtttt

SEQ ID NO: 168181 - DNA, 25 bp, Mus musculus
agcagctgactaagtgtgatttcct

SEQ ID NO: 168182 - DNA, 25 bp, Mus musculus
agcagctgactatgtgtgatttcct

SEQ ID NO: 168183 - DNA, 25 bp, Mus musculus
agcagctgagataggaagcctccat

SEQ ID NO: 168184 - DNA, 25 bp, Mus musculus
agcagctgagatctgtcactatcac

SEQ ID NO: 168185 - DNA, 25 bp, Mus musculus
agcagctgagatgtgtcactatcac

SEQ ID NO: 168186 - DNA, 25 bp, Mus musculus
agcagctgagattggaagcctccat

SEQ ID NO: 168187 - DNA, 25 bp, Mus musculus
agcagctgatgaagcaggtgacaca

SEQ ID NO: 168188 - DNA, 25 bp, Mus musculus
agcagctgatgatgcaggtgacaca

SEQ ID NO: 168189 - DNA, 25 bp, Mus musculus
agcagctgcagaacttagagaaaca

SEQ ID NO: 168190 - DNA, 25 bp, Mus musculus
agcagctgcagacatgtttgggaat

SEQ ID NO: 168191 - DNA, 25 bp, Mus musculus
agcagctgcagacggtaccttcagc

SEQ ID NO: 168192 - DNA, 25 bp, Mus musculus
agcagctgcagagatgtttgggaat

SEQ ID NO: 168193 - DNA, 25 bp, Mus musculus
agcagctgcagagggtaccttcagc

SEQ ID NO: 168194 - DNA, 25 bp, Mus musculus
agcagctgcagatcttagagaaaca

SEQ ID NO: 168195 - DNA, 25 bp, Mus musculus
agcagctgcataatctatacacact

SEQ ID NO: 168196 - DNA, 25 bp, Mus musculus
agcagctgcatattctatacacact

SEQ ID NO: 168197 - DNA, 25 bp, Mus musculus
agcagctgccagaggagttgtttct

SEQ ID NO: 168198 - DNA, 25 bp, Mus musculus
agcagctgccagtggagttgtttct

SEQ ID NO: 168199 - DNA, 25 bp, Mus musculus
agcagctgcgcgatgtcatgttcta

SEQ ID NO: 168200 - DNA, 25 bp, Mus musculus
agcagctgcgcgttgtcatgttcta

SEQ ID NO: 168201 - DNA, 25 bp, Mus musculus
agcagctgcgtgatcgaccaacatt

SEQ ID NO: 168202 - DNA, 25 bp, Mus musculus
agcagctgcgtgttcgaccaacatt

SEQ ID NO: 168203 - DNA, 25 bp, Mus musculus
agcagctgctatacttttgtttaca

SEQ ID NO: 168204 - DNA, 25 bp, Mus musculus
agcagctgctattcttttgtttaca

SEQ ID NO: 168205 - DNA, 25 bp, Mus musculus
agcagctgctgcaagtgttacagca

SEQ ID NO: 168206 - DNA, 25 bp, Mus musculus
agcagctgctgccataccaatatgc

SEQ ID NO: 168207 - DNA, 25 bp, Mus musculus
agcagctgctgcgataccaatatgc

SEQ ID NO: 168208 - DNA, 25 bp, Mus musculus
agcagctgctgctagtgttacagca

SEQ ID NO: 168209 - DNA, 25 bp, Mus musculus
agcagctgctggctgtatatccaat

SEQ ID NO: 168210 - DNA, 25 bp, Mus musculus
agcagctgctgggtgtatatccaat

SEQ ID NO: 168211 - DNA, 25 bp, Mus musculus
agcagctgcttacccagaaaccgtc

SEQ ID NO: 168212 - DNA, 25 bp, Mus musculus
agcagctgcttagccagaaaccgtc

SEQ ID NO: 168213 - DNA, 25 bp, Mus musculus
agcagctggacccaattgattcact

SEQ ID NO: 168214 - DNA, 25 bp, Mus musculus
agcagctggaccgaattgattcact

SEQ ID NO: 168215 - DNA, 25 bp, Mus musculus
agcagctggacgaccaccaatgacc

SEQ ID NO: 168216 - DNA, 25 bp, Mus musculus
agcagctggacgtccaccaatgacc

SEQ ID NO: 168217 - DNA, 25 bp, Mus musculus
agcagctggagaacgtgtgcctcat

SEQ ID NO: 168218 - DNA, 25 bp, Mus musculus
agcagctggagacgaccggaatcac

SEQ ID NO: 168219 - DNA, 25 bp, Mus musculus
agcagctggagaggaccggaatcac

SEQ ID NO: 168220 - DNA, 25 bp, Mus musculus
agcagctggagatcgtgtgcctcat

SEQ ID NO: 168221 - DNA, 25 bp, Mus musculus
agcagctggaggcatcgtgtctcac

SEQ ID NO: 168222 - DNA, 25 bp, Mus musculus
agcagctggagggatcgtgtctcac

SEQ ID NO: 168223 - DNA, 25 bp, Mus musculus
agcagctggagtccataggcacccc

SEQ ID NO: 168224 - DNA, 25 bp, Mus musculus
agcagctggagtgcataggcacccc

SEQ ID NO: 168225 - DNA, 25 bp, Mus musculus
agcagctggcacatctcctcagagg

SEQ ID NO: 168226 - DNA, 25 bp, Mus musculus
agcagctggcacttctcctcagagg

SEQ ID NO: 168227 - DNA, 25 bp, Mus musculus
agcagctgggaccagtcctagcccc

SEQ ID NO: 168228 - DNA, 25 bp, Mus musculus
agcagctgggacgagtcctagcccc

SEQ ID NO: 168229 - DNA, 25 bp, Mus musculus
agcagctggtatccctggatccttc

SEQ ID NO: 168230 - DNA, 25 bp, Mus musculus
agcagctggtatgcctggatccttc

SEQ ID NO: 168231 - DNA, 25 bp, Mus musculus
agcagctggtctcggacaagtgccc

SEQ ID NO: 168232 - DNA, 25 bp, Mus musculus
agcagctggtctgggacaagtgccc

SEQ ID NO: 168233 - DNA, 25 bp, Mus musculus
agcagctggtgcaagactgtgagat

SEQ ID NO: 168234 - DNA, 25 bp, Mus musculus
agcagctggtgcactctcccaatgg

SEQ ID NO: 168235 - DNA, 25 bp, Mus musculus
agcagctggtgctagactgtgagat

SEQ ID NO: 168236 - DNA, 25 bp, Mus musculus
agcagctggtgctctctcccaatgg

SEQ ID NO: 168237 - DNA, 25 bp, Mus musculus
agcagctggtgtcagcgtcgaacct

SEQ ID NO: 168238 - DNA, 25 bp, Mus musculus
agcagctggtgtgagcgtcgaacct

SEQ ID NO: 168239 - DNA, 25 bp, Mus musculus
agcagctgtaaacatgtcacacccc

SEQ ID NO: 168240 - DNA, 25 bp, Mus musculus
agcagctgtaaagatgtcacacccc

SEQ ID NO: 168241 - DNA, 25 bp, Mus musculus
agcagctgtaccatccagtaatcgc

SEQ ID NO: 168242 - DNA, 25 bp, Mus musculus
agcagctgtaccttccagtaatcgc

SEQ ID NO: 168243 - DNA, 25 bp, Mus musculus
agcagctgtagtatcccaaagtccc

SEQ ID NO: 168244 - DNA, 25 bp, Mus musculus
agcagctgtagtttcccaaagtccc

SEQ ID NO: 168245 - DNA, 25 bp, Mus musculus
agcagctgtctgcatttgctatatg

SEQ ID NO: 168246 - DNA, 25 bp, Mus musculus
agcagctgtctggatttgctatatg

SEQ ID NO: 168247 - DNA, 25 bp, Mus musculus
agcagctgtggtaatcccagttcca

SEQ ID NO: 168248 - DNA, 25 bp, Mus musculus
agcagctgtggttatcccagttcca

SEQ ID NO: 168249 - DNA, 25 bp, Mus musculus
agcagctgtgtcatcctttcctgga

SEQ ID NO: 168250 - DNA, 25 bp, Mus musculus
agcagctgtgtcatggagtgagaat

SEQ ID NO: 168251 - DNA, 25 bp, Mus musculus
agcagctgtgtcttcctttcctgga

SEQ ID NO: 168252 - DNA, 25 bp, Mus musculus
agcagctgtgtcttggagtgagaat

SEQ ID NO: 168253 - DNA, 25 bp, Mus musculus
agcagctgtgtgatgatccgagtta

SEQ ID NO: 168254 - DNA, 25 bp, Mus musculus
agcagctgtgtgttgatccgagtta

SEQ ID NO: 168255 - DNA, 25 bp, Mus musculus
agcagctgttaaactcccagcagct

SEQ ID NO: 168256 - DNA, 25 bp, Mus musculus
agcagctgttaatctcccagcagct

SEQ ID NO: 168257 - DNA, 25 bp, Mus musculus
agcagctgttctcaggccccactag

SEQ ID NO: 168258 - DNA, 25 bp, Mus musculus
agcagctgttctgaggccccactag

SEQ ID NO: 168259 - DNA, 25 bp, Mus musculus
agcagcttacccacaggcatatggt

SEQ ID NO: 168260 - DNA, 25 bp, Mus musculus
agcagcttaccctcaggcatatggt

SEQ ID NO: 168261 - DNA, 25 bp, Mus musculus
agcagcttactaaacagacaagagt

SEQ ID NO: 168262 - DNA, 25 bp, Mus musculus
agcagcttactatacagacaagagt

SEQ ID NO: 168263 - DNA, 25 bp, Mus musculus
agcagcttagcaatttgccgcctga

SEQ ID NO: 168264 - DNA, 25 bp, Mus musculus
agcagcttagcattttgccgcctga

SEQ ID NO: 168265 - DNA, 25 bp, Mus musculus
agcagcttagctctttgcaggaaga

SEQ ID NO: 168266 - DNA, 25 bp, Mus musculus
agcagcttagctgtttgcaggaaga

SEQ ID NO: 168267 - DNA, 25 bp, Mus musculus
agcagcttatggcactttgtttaaa

SEQ ID NO: 168268 - DNA, 25 bp, Mus musculus
agcagcttatgggactttgtttaaa

SEQ ID NO: 168269 - DNA, 25 bp, Mus musculus
agcagcttcaagattcagaccagag

SEQ ID NO: 168270 - DNA, 25 bp, Mus musculus
agcagcttcaagtttcagaccagag

SEQ ID NO: 168271 - DNA, 25 bp, Mus musculus
agcagcttcaccatgccagagatgc

SEQ ID NO: 168272 - DNA, 25 bp, Mus musculus
agcagcttcaccttgccagagatgc

SEQ ID NO: 168273 - DNA, 25 bp, Mus musculus
agcagcttcagacgtgccttggttt

SEQ ID NO: 168274 - DNA, 25 bp, Mus musculus
agcagcttcagaggtgccttggttt

SEQ ID NO: 168275 - DNA, 25 bp, Mus musculus
agcagcttcatccagcagttgatgg

SEQ ID NO: 168276 - DNA, 25 bp, Mus musculus
agcagcttcatcgagcagttgatgg

SEQ ID NO: 168277 - DNA, 25 bp, Mus musculus
agcagcttccgtactaaaatatgat

SEQ ID NO: 168278 - DNA, 25 bp, Mus musculus
agcagcttccgtagacatgtgttta

SEQ ID NO: 168279 - DNA, 25 bp, Mus musculus
agcagcttccgtctggtcatacgcc

SEQ ID NO: 168280 - DNA, 25 bp, Mus musculus
agcagcttccgtgtggtcatacgcc

SEQ ID NO: 168281 - DNA, 25 bp, Mus musculus
agcagcttccgttctaaaatatgat

SEQ ID NO: 168282 - DNA, 25 bp, Mus musculus
agcagcttccgttgacatgtgttta

SEQ ID NO: 168283 - DNA, 25 bp, Mus musculus
agcagcttcctgagtccattagtga

SEQ ID NO: 168284 - DNA, 25 bp, Mus musculus
agcagcttcctgcatcgatggctga

SEQ ID NO: 168285 - DNA, 25 bp, Mus musculus
agcagcttcctggatcgatggctga

SEQ ID NO: 168286 - DNA, 25 bp, Mus musculus
agcagcttcctgtgtccattagtga

SEQ ID NO: 168287 - DNA, 25 bp, Mus musculus
agcagcttcgagagcacacactaca

SEQ ID NO: 168288 - DNA, 25 bp, Mus musculus
agcagcttcgagaggatgctctgga

SEQ ID NO: 168289 - DNA, 25 bp, Mus musculus
agcagcttcgagtgcacacactaca

SEQ ID NO: 168290 - DNA, 25 bp, Mus musculus
agcagcttcgagtggatgctctgga

SEQ ID NO: 168291 - DNA, 25 bp, Mus musculus
agcagcttcgcaactttttctttgg

SEQ ID NO: 168292 - DNA, 25 bp, Mus musculus
agcagcttcgcatctttttctttgg

SEQ ID NO: 168293 - DNA, 25 bp, Mus musculus
agcagcttcgctaacgaccgagagt

SEQ ID NO: 168294 - DNA, 25 bp, Mus musculus
agcagcttcgcttacgaccgagagt

SEQ ID NO: 168295 - DNA, 25 bp, Mus musculus
agcagcttctacctagtggagcagt

SEQ ID NO: 168296 - DNA, 25 bp, Mus musculus
agcagcttctacgtagtggagcagt

SEQ ID NO: 168297 - DNA, 25 bp, Mus musculus
agcagcttgagcagttgcttcttgc

SEQ ID NO: 168298 - DNA, 25 bp, Mus musculus
agcagcttgagctgttgcttcttgc

SEQ ID NO: 168299 - DNA, 25 bp, Mus musculus
agcagcttgccacaaaatcagcact

SEQ ID NO: 168300 - DNA, 25 bp, Mus musculus
agcagcttgccagaaaatcagcact

SEQ ID NO: 168301 - DNA, 25 bp, Mus musculus
agcagcttgcgcaaacagaaccttg

SEQ ID NO: 168302 - DNA, 25 bp, Mus musculus
agcagcttgcgctaacagaaccttg

SEQ ID NO: 168303 - DNA, 25 bp, Mus musculus
agcagcttgctgagattgacataaa

SEQ ID NO: 168304 - DNA, 25 bp, Mus musculus
agcagcttgctgcactagacaaatt

SEQ ID NO: 168305 - DNA, 25 bp, Mus musculus
agcagcttgctggactagacaaatt

SEQ ID NO: 168306 - DNA, 25 bp, Mus musculus
agcagcttgctgtgattgacataaa

SEQ ID NO: 168307 - DNA, 25 bp, Mus musculus
agcagcttgggcacagtagactgga

SEQ ID NO: 168308 - DNA, 25 bp, Mus musculus
agcagcttgggctcagtagactgga

SEQ ID NO: 168309 - DNA, 25 bp, Mus musculus
agcagctttaagatgtccgtaatca

SEQ ID NO: 168310 - DNA, 25 bp, Mus musculus
agcagctttaagttgtccgtaatca

SEQ ID NO: 168311 - DNA, 25 bp, Mus musculus
agcagctttcccagaggtaggagtc

SEQ ID NO: 168312 - DNA, 25 bp, Mus musculus
agcagctttccctgaggtaggagtc

SEQ ID NO: 168313 - DNA, 25 bp, Mus musculus
agcagctttcctagaatgtgttgta

SEQ ID NO: 168314 - DNA, 25 bp, Mus musculus
agcagctttccttgaatgtgttgta

SEQ ID NO: 168315 - DNA, 25 bp, Mus musculus
agcagctttctgaacctcatttaaa

SEQ ID NO: 168316 - DNA, 25 bp, Mus musculus
agcagctttctgtacctcatttaaa

SEQ ID NO: 168317 - DNA, 25 bp, Mus musculus
agcagctttgagagcgcctcggagc

SEQ ID NO: 168318 - DNA, 25 bp, Mus musculus
agcagctttgagtgcgcctcggagc

SEQ ID NO: 168319 - DNA, 25 bp, Mus musculus
agcagctttgctccaagatacacaa

SEQ ID NO: 168320 - DNA, 25 bp, Mus musculus
agcagctttgctgcaagatacacaa

SEQ ID NO: 168321 - DNA, 25 bp, Mus musculus
agcagcttttccatcatgagtcaga

SEQ ID NO: 168322 - DNA, 25 bp, Mus musculus
agcagcttttccttcatgagtcaga

SEQ ID NO: 168323 - DNA, 25 bp, Mus musculus
agcagctttttactcccttaacagt

SEQ ID NO: 168324 - DNA, 25 bp, Mus musculus
agcagctttttagtcccttaacagt

SEQ ID NO: 168325 - DNA, 25 bp, Mus musculus
agcaggaacacgcagatggtcttct

SEQ ID NO: 168326 - DNA, 25 bp, Mus musculus
agcaggaacacggagatggtcttct

SEQ ID NO: 168327 - DNA, 25 bp, Mus musculus
agcaggaacccacaggtgtgagctt

SEQ ID NO: 168328 - DNA, 25 bp, Mus musculus
agcaggaacccagaggtgtgagctt

SEQ ID NO: 168329 - DNA, 25 bp, Mus musculus
agcaggaactacctttctgaacccg

SEQ ID NO: 168330 - DNA, 25 bp, Mus musculus
agcaggaactacgtttctgaacccg

SEQ ID NO: 168331 - DNA, 25 bp, Mus musculus
agcaggaactagacatgaggcttct

SEQ ID NO: 168332 - DNA, 25 bp, Mus musculus
agcaggaactagtcatgaggcttct

SEQ ID NO: 168333 - DNA, 25 bp, Mus musculus
agcaggaagctaatctatcaccagc

SEQ ID NO: 168334 - DNA, 25 bp, Mus musculus
agcaggaagctattctatcaccagc

SEQ ID NO: 168335 - DNA, 25 bp, Mus musculus
agcaggaaggttctcctcccagtgt

SEQ ID NO: 168336 - DNA, 25 bp, Mus musculus
agcaggaaggttgtcctcccagtgt

SEQ ID NO: 168337 - DNA, 25 bp, Mus musculus
agcaggaatattcgcagaagatttt

SEQ ID NO: 168338 - DNA, 25 bp, Mus musculus
agcaggaatattggcagaagatttt

SEQ ID NO: 168339 - DNA, 25 bp, Mus musculus
agcaggaatcttcgcatgggaataa

SEQ ID NO: 168340 - DNA, 25 bp, Mus musculus
agcaggaatcttggcatgggaataa

SEQ ID NO: 168341 - DNA, 25 bp, Mus musculus
agcaggaatggtccttcaactccct

SEQ ID NO: 168342 - DNA, 25 bp, Mus musculus
agcaggaatggtgcttcaactccct

SEQ ID NO: 168343 - DNA, 25 bp, Mus musculus
agcaggacactacggcgtctccaag

SEQ ID NO: 168344 - DNA, 25 bp, Mus musculus
agcaggacactagggcgtctccaag

SEQ ID NO: 168345 - DNA, 25 bp, Mus musculus
agcaggacactgatgatgaatcaca

SEQ ID NO: 168346 - DNA, 25 bp, Mus musculus
agcaggacactgttgatgaatcaca

SEQ ID NO: 168347 - DNA, 25 bp, Mus musculus
agcaggacattcaactctctttcaa

SEQ ID NO: 168348 - DNA, 25 bp, Mus musculus
agcaggacattctactctctttcaa

SEQ ID NO: 168349 - DNA, 25 bp, Mus musculus
agcaggacattgatccaggccttgt

SEQ ID NO: 168350 - DNA, 25 bp, Mus musculus
agcaggacattgttccaggccttgt

SEQ ID NO: 168351 - DNA, 25 bp, Mus musculus
agcaggaccagtaagggaccttcaa

SEQ ID NO: 168352 - DNA, 25 bp, Mus musculus
agcaggaccagttagggaccttcaa

SEQ ID NO: 168353 - DNA, 25 bp, Mus musculus
agcaggaccctcacttggtcgtgga

SEQ ID NO: 168354 - DNA, 25 bp, Mus musculus
agcaggaccctctcttggtcgtgga

SEQ ID NO: 168355 - DNA, 25 bp, Mus musculus
agcaggaccctgaacaacgacatca

SEQ ID NO: 168356 - DNA, 25 bp, Mus musculus
agcaggaccctgtacaacgacatca

SEQ ID NO: 168357 - DNA, 25 bp, Mus musculus
agcaggaccgccacgtgcagagcag

SEQ ID NO: 168358 - DNA, 25 bp, Mus musculus
agcaggaccgcctcgtgcagagcag

SEQ ID NO: 168359 - DNA, 25 bp, Mus musculus
agcaggacctgcaccataaccagga

SEQ ID NO: 168360 - DNA, 25 bp, Mus musculus
agcaggacctgctccataaccagga

SEQ ID NO: 168361 - DNA, 25 bp, Mus musculus
agcaggacctgtactgtttcgccta

SEQ ID NO: 168362 - DNA, 25 bp, Mus musculus
agcaggacctgttctgtttcgccta

SEQ ID NO: 168363 - DNA, 25 bp, Mus musculus
agcaggacctttagtactcagtgag

SEQ ID NO: 168364 - DNA, 25 bp, Mus musculus
agcaggaccttttgtactcagtgag

SEQ ID NO: 168365 - DNA, 25 bp, Mus musculus
agcaggacgggtcttcaggccttac

SEQ ID NO: 168366 - DNA, 25 bp, Mus musculus
agcaggacgggtgttcaggccttac

SEQ ID NO: 168367 - DNA, 25 bp, Mus musculus
agcaggacgttaagacacctcttcc

SEQ ID NO: 168368 - DNA, 25 bp, Mus musculus
agcaggacgttatgacacctcttcc

SEQ ID NO: 168369 - DNA, 25 bp, Mus musculus
agcaggactcctaaactctaaacaa

SEQ ID NO: 168370 - DNA, 25 bp, Mus musculus
agcaggactccttaactctaaacaa

SEQ ID NO: 168371 - DNA, 25 bp, Mus musculus
agcaggactcgaatgcagtgcagtg

SEQ ID NO: 168372 - DNA, 25 bp, Mus musculus
agcaggactcgattgcagtgcagtg

SEQ ID NO: 168373 - DNA, 25 bp, Mus musculus
agcaggactctccttgcagcagcgg

SEQ ID NO: 168374 - DNA, 25 bp, Mus musculus
agcaggactctcgttgcagcagcgg

SEQ ID NO: 168375 - DNA, 25 bp, Mus musculus
agcaggacttcaccacagtgtttga

SEQ ID NO: 168376 - DNA, 25 bp, Mus musculus
agcaggacttcagcacagtgtttga

SEQ ID NO: 168377 - DNA, 25 bp, Mus musculus
agcaggacttgaagtgcccttcccc

SEQ ID NO: 168378 - DNA, 25 bp, Mus musculus
agcaggacttgatgtgcccttcccc

SEQ ID NO: 168379 - DNA, 25 bp, Mus musculus
agcaggacttgcaacttcgagagcc

SEQ ID NO: 168380 - DNA, 25 bp, Mus musculus
agcaggacttgctacttcgagagcc

SEQ ID NO: 168381 - DNA, 25 bp, Mus musculus
agcaggagaagtcccacactctgtt

SEQ ID NO: 168382 - DNA, 25 bp, Mus musculus
agcaggagaagtgccacactctgtt

SEQ ID NO: 168383 - DNA, 25 bp, Mus musculus
agcaggagaattctttccaggcgag

SEQ ID NO: 168384 - DNA, 25 bp, Mus musculus
agcaggagaattgtttccaggcgag

SEQ ID NO: 168385 - DNA, 25 bp, Mus musculus
agcaggagacatcccaaccgagtgg

SEQ ID NO: 168386 - DNA, 25 bp, Mus musculus
agcaggagacatgccaaccgagtgg

SEQ ID NO: 168387 - DNA, 25 bp, Mus musculus
agcaggagcaagagacgagttatac

SEQ ID NO: 168388 - DNA, 25 bp, Mus musculus
agcaggagcaagtgacgagttatac

SEQ ID NO: 168389 - DNA, 25 bp, Mus musculus
agcaggagcacaagagcatctcggg

SEQ ID NO: 168390 - DNA, 25 bp, Mus musculus
agcaggagcacatgagcatctcggg

SEQ ID NO: 168391 - DNA, 25 bp, Mus musculus
agcaggagcaggcacagcaactccg

SEQ ID NO: 168392 - DNA, 25 bp, Mus musculus
agcaggagcagggacagcaactccg

SEQ ID NO: 168393 - DNA, 25 bp, Mus musculus
agcaggagcgacagttgggcctcta

SEQ ID NO: 168394 - DNA, 25 bp, Mus musculus
agcaggagcgactgttgggcctcta

SEQ ID NO: 168395 - DNA, 25 bp, Mus musculus
agcaggagcgcacgttcctcatgag

SEQ ID NO: 168396 - DNA, 25 bp, Mus musculus
agcaggagcgcaggttcctcatgag

SEQ ID NO: 168397 - DNA, 25 bp, Mus musculus
agcaggagctacacgcgcagagtga

SEQ ID NO: 168398 - DNA, 25 bp, Mus musculus
agcaggagctacagtccccattgat

SEQ ID NO: 168399 - DNA, 25 bp, Mus musculus
agcaggagctactcgcgcagagtga

SEQ ID NO: 168400 - DNA, 25 bp, Mus musculus
agcaggagctactgtccccattgat

SEQ ID NO: 168401 - DNA, 25 bp, Mus musculus
agcaggagctccagggtgacccaac

SEQ ID NO: 168402 - DNA, 25 bp, Mus musculus
agcaggagctccatggatgggaact

SEQ ID NO: 168403 - DNA, 25 bp, Mus musculus
agcaggagctcctgggtgacccaac

SEQ ID NO: 168404 - DNA, 25 bp, Mus musculus
agcaggagctccttggatgggaact

SEQ ID NO: 168405 - DNA, 25 bp, Mus musculus
agcaggagctcgatgctgccatctg

SEQ ID NO: 168406 - DNA, 25 bp, Mus musculus
agcaggagctcgttgctgccatctg

SEQ ID NO: 168407 - DNA, 25 bp, Mus musculus
agcaggaggatcactttcaaaagtt

SEQ ID NO: 168408 - DNA, 25 bp, Mus musculus
agcaggaggatctctttcaaaagtt

SEQ ID NO: 168409 - DNA, 25 bp, Mus musculus
agcaggaggcatcccatcacagctt

SEQ ID NO: 168410 - DNA, 25 bp, Mus musculus
agcaggaggcatgccatcacagctt

SEQ ID NO: 168411 - DNA, 25 bp, Mus musculus
agcaggaggcccaaggttctcggct

SEQ ID NO: 168412 - DNA, 25 bp, Mus musculus
agcaggaggccctaggttctcggct

SEQ ID NO: 168413 - DNA, 25 bp, Mus musculus
agcaggagggtcattcttagagaat

SEQ ID NO: 168414 - DNA, 25 bp, Mus musculus
agcaggagggtctttcttagagaat

SEQ ID NO: 168415 - DNA, 25 bp, Mus musculus
agcaggagtcatagccatgttgccc

SEQ ID NO: 168416 - DNA, 25 bp, Mus musculus
agcaggagtcattgccatgttgccc

SEQ ID NO: 168417 - DNA, 25 bp, Mus musculus
agcaggagtccacaccggagacgcc

SEQ ID NO: 168418 - DNA, 25 bp, Mus musculus
agcaggagtccagaccggagacgcc

SEQ ID NO: 168419 - DNA, 25 bp, Mus musculus
agcaggagtctccttttgtcttgtt

SEQ ID NO: 168420 - DNA, 25 bp, Mus musculus
agcaggagtctcgttttgtcttgtt

SEQ ID NO: 168421 - DNA, 25 bp, Mus musculus
agcaggagtgatactctgccatcag

SEQ ID NO: 168422 - DNA, 25 bp, Mus musculus
agcaggagtgattctctgccatcag

SEQ ID NO: 168423 - DNA, 25 bp, Mus musculus
agcaggagtgctacacagcagtcct

SEQ ID NO: 168424 - DNA, 25 bp, Mus musculus
agcaggagtgcttcacagcagtcct

SEQ ID NO: 168425 - DNA, 25 bp, Mus musculus
agcaggagttgcactggtctttaaa

SEQ ID NO: 168426 - DNA, 25 bp, Mus musculus
agcaggagttgctctggtctttaaa

SEQ ID NO: 168427 - DNA, 25 bp, Mus musculus
agcaggagttggagtgcccaagcca

SEQ ID NO: 168428 - DNA, 25 bp, Mus musculus
agcaggagttggtgtgcccaagcca

SEQ ID NO: 168429 - DNA, 25 bp, Mus musculus
agcaggagtttcagcgggcccaagc

SEQ ID NO: 168430 - DNA, 25 bp, Mus musculus
agcaggagtttctgcgggcccaagc

SEQ ID NO: 168431 - DNA, 25 bp, Mus musculus
agcaggatcccaccaaataaaccag

SEQ ID NO: 168432 - DNA, 25 bp, Mus musculus
agcaggatcccagcaaataaaccag

SEQ ID NO: 168433 - DNA, 25 bp, Mus musculus
agcaggatccctcgagtcggctcag

SEQ ID NO: 168434 - DNA, 25 bp, Mus musculus
agcaggatccctggagtcggctcag

SEQ ID NO: 168435 - DNA, 25 bp, Mus musculus
agcaggatctggatgcccagaccta

SEQ ID NO: 168436 - DNA, 25 bp, Mus musculus
agcaggatctggttgcccagaccta

SEQ ID NO: 168437 - DNA, 25 bp, Mus musculus
agcaggatcttgaactcctggttct

SEQ ID NO: 168438 - DNA, 25 bp, Mus musculus
agcaggatcttgaccagccgccgca

SEQ ID NO: 168439 - DNA, 25 bp, Mus musculus
agcaggatcttgtactcctggttct

SEQ ID NO: 168440 - DNA, 25 bp, Mus musculus
agcaggatcttgtccagccgccgca

SEQ ID NO: 168441 - DNA, 25 bp, Mus musculus
agcaggatgctcattttataaggtc

SEQ ID NO: 168442 - DNA, 25 bp, Mus musculus
agcaggatgctctttttataaggtc

SEQ ID NO: 168443 - DNA, 25 bp, Mus musculus
agcaggatgcttatgtacacttaga

SEQ ID NO: 168444 - DNA, 25 bp, Mus musculus
agcaggatgcttttgtacacttaga

SEQ ID NO: 168445 - DNA, 25 bp, Mus musculus
agcaggatggagagatacagcctca

SEQ ID NO: 168446 - DNA, 25 bp, Mus musculus
agcaggatggagtgatacagcctca

SEQ ID NO: 168447 - DNA, 25 bp, Mus musculus
agcaggatggccagccgaggcggaa

SEQ ID NO: 168448 - DNA, 25 bp, Mus musculus
agcaggatggcctgccgaggcggaa

SEQ ID NO: 168449 - DNA, 25 bp, Mus musculus
agcaggatgggcaacatggatccaa

SEQ ID NO: 168450 - DNA, 25 bp, Mus musculus
agcaggatgggctacatggatccaa

SEQ ID NO: 168451 - DNA, 25 bp, Mus musculus
agcaggatggtgagtttctatccaa

SEQ ID NO: 168452 - DNA, 25 bp, Mus musculus
agcaggatggtgtgtttctatccaa

SEQ ID NO: 168453 - DNA, 25 bp, Mus musculus
agcaggatggttacaaagtcgagtt

SEQ ID NO: 168454 - DNA, 25 bp, Mus musculus
agcaggatggtttcaaagtcgagtt

SEQ ID NO: 168455 - DNA, 25 bp, Mus musculus
agcaggatgtccagttggccggacc

SEQ ID NO: 168456 - DNA, 25 bp, Mus musculus
agcaggatgtcctgttggccggacc

SEQ ID NO: 168457 - DNA, 25 bp, Mus musculus
agcaggattcctattgatacacaat

SEQ ID NO: 168458 - DNA, 25 bp, Mus musculus
agcaggattccttttgatacacaat

SEQ ID NO: 168459 - DNA, 25 bp, Mus musculus
agcaggattgttaccgtttgtctgg

SEQ ID NO: 168460 - DNA, 25 bp, Mus musculus
agcaggattgtttccgtttgtctgg

SEQ ID NO: 168461 - DNA, 25 bp, Mus musculus
agcaggattttgcccgcagtagtag

SEQ ID NO: 168462 - DNA, 25 bp, Mus musculus
agcaggattttggccgcagtagtag

SEQ ID NO: 168463 - DNA, 25 bp, Mus musculus
agcaggcaaacaaccacagacagtg

SEQ ID NO: 168464 - DNA, 25 bp, Mus musculus
agcaggcaaacatccacagacagtg

SEQ ID NO: 168465 - DNA, 25 bp, Mus musculus
agcaggcaatgcaggaaccattcct

SEQ ID NO: 168466 - DNA, 25 bp, Mus musculus
agcaggcaatgctggaaccattcct

SEQ ID NO: 168467 - DNA, 25 bp, Mus musculus
agcaggcacacaagttcccaaggga

SEQ ID NO: 168468 - DNA, 25 bp, Mus musculus
agcaggcacacatgttcccaaggga

SEQ ID NO: 168469 - DNA, 25 bp, Mus musculus
agcaggcacagcaactccggaaaaa

SEQ ID NO: 168470 - DNA, 25 bp, Mus musculus
agcaggcacagctactccggaaaaa

SEQ ID NO: 168471 - DNA, 25 bp, Mus musculus
agcaggcacccacgctttagagaag

SEQ ID NO: 168472 - DNA, 25 bp, Mus musculus
agcaggcacccaggctttagagaag

SEQ ID NO: 168473 - DNA, 25 bp, Mus musculus
agcaggcacttacagtgaacacaag

SEQ ID NO: 168474 - DNA, 25 bp, Mus musculus
agcaggcacttagagtgaacacaag

SEQ ID NO: 168475 - DNA, 25 bp, Mus musculus
agcaggcagaaaaccactcatctac

SEQ ID NO: 168476 - DNA, 25 bp, Mus musculus
agcaggcagaaatccactcatctac

SEQ ID NO: 168477 - DNA, 25 bp, Mus musculus
agcaggcagaccctaggcacttgtg

SEQ ID NO: 168478 - DNA, 25 bp, Mus musculus
agcaggcagaccgtaggcacttgtg

SEQ ID NO: 168479 - DNA, 25 bp, Mus musculus
agcaggcagactattgctctctgag

SEQ ID NO: 168480 - DNA, 25 bp, Mus musculus
agcaggcagacttttgctctctgag

SEQ ID NO: 168481 - DNA, 25 bp, Mus musculus
agcaggcagaggaacttgctgtgta

SEQ ID NO: 168482 - DNA, 25 bp, Mus musculus
agcaggcagaggtacttgctgtgta

SEQ ID NO: 168483 - DNA, 25 bp, Mus musculus
agcaggcagcacagacagagcactt

SEQ ID NO: 168484 - DNA, 25 bp, Mus musculus
agcaggcagcactgacagagcactt

SEQ ID NO: 168485 - DNA, 25 bp, Mus musculus
agcaggcagcccactgagggttatg

SEQ ID NO: 168486 - DNA, 25 bp, Mus musculus
agcaggcagccctctgagggttatg

SEQ ID NO: 168487 - DNA, 25 bp, Mus musculus
agcaggcagccgcaggcccaattgt

SEQ ID NO: 168488 - DNA, 25 bp, Mus musculus
agcaggcagccggaggcccaattgt

SEQ ID NO: 168489 - DNA, 25 bp, Mus musculus
agcaggcagctacgctaacctctga

SEQ ID NO: 168490 - DNA, 25 bp, Mus musculus
agcaggcagctaggctaacctctga

SEQ ID NO: 168491 - DNA, 25 bp, Mus musculus
agcaggcagctgctccaagacctct

SEQ ID NO: 168492 - DNA, 25 bp, Mus musculus
agcaggcagctgctgtctctctgga

SEQ ID NO: 168493 - DNA, 25 bp, Mus musculus
agcaggcagctggtccaagacctct

SEQ ID NO: 168494 - DNA, 25 bp, Mus musculus
agcaggcagctggtgtctctctgga

SEQ ID NO: 168495 - DNA, 25 bp, Mus musculus
agcaggcagcttctgaatttttgtt

SEQ ID NO: 168496 - DNA, 25 bp, Mus musculus
agcaggcagcttgtgaatttttgtt

SEQ ID NO: 168497 - DNA, 25 bp, Mus musculus
agcaggcaggccctctgtactattt

SEQ ID NO: 168498 - DNA, 25 bp, Mus musculus
agcaggcaggccgtctgtactattt

SEQ ID NO: 168499 - DNA, 25 bp, Mus musculus
agcaggcagggacggccgcaggttc

SEQ ID NO: 168500 - DNA, 25 bp, Mus musculus
agcaggcagggagggccgcaggttc

SEQ ID NO: 168501 - DNA, 25 bp, Mus musculus
agcaggcaggtcactttggaggcca

SEQ ID NO: 168502 - DNA, 25 bp, Mus musculus
agcaggcaggtctctttggaggcca

SEQ ID NO: 168503 - DNA, 25 bp, Mus musculus
agcaggcatccaaaactaatacaat

SEQ ID NO: 168504 - DNA, 25 bp, Mus musculus
agcaggcatccataactaatacaat

SEQ ID NO: 168505 - DNA, 25 bp, Mus musculus
agcaggcatggcatcaggagtgcaa

SEQ ID NO: 168506 - DNA, 25 bp, Mus musculus
agcaggcatggcttcaggagtgcaa

SEQ ID NO: 168507 - DNA, 25 bp, Mus musculus
agcaggcattagagtggatccacga

SEQ ID NO: 168508 - DNA, 25 bp, Mus musculus
agcaggcattagtgtggatccacga

SEQ ID NO: 168509 - DNA, 25 bp, Mus musculus
agcaggcattggaagcccactggtg

SEQ ID NO: 168510 - DNA, 25 bp, Mus musculus
agcaggcattggtagcccactggtg

SEQ ID NO: 168511 - DNA, 25 bp, Mus musculus
agcaggccagacagcactcgaatgt

SEQ ID NO: 168512 - DNA, 25 bp, Mus musculus
agcaggccagactgcactcgaatgt

SEQ ID NO: 168513 - DNA, 25 bp, Mus musculus
agcaggccagagcaacaccaatggg

SEQ ID NO: 168514 - DNA, 25 bp, Mus musculus
agcaggccagaggaacaccaatggg

SEQ ID NO: 168515 - DNA, 25 bp, Mus musculus
agcaggccagttaactgttcctctg

SEQ ID NO: 168516 - DNA, 25 bp, Mus musculus
agcaggccagtttactgttcctctg

SEQ ID NO: 168517 - DNA, 25 bp, Mus musculus
agcaggccatccatgtgagggattt

SEQ ID NO: 168518 - DNA, 25 bp, Mus musculus
agcaggccatccttgtgagggattt

SEQ ID NO: 168519 - DNA, 25 bp, Mus musculus
agcaggccatgaatcactcctataa

SEQ ID NO: 168520 - DNA, 25 bp, Mus musculus
agcaggccatgattcactcctataa

SEQ ID NO: 168521 - DNA, 25 bp, Mus musculus
agcaggccattgcaccgaggaccag

SEQ ID NO: 168522 - DNA, 25 bp, Mus musculus
agcaggccattggaccgaggaccag

SEQ ID NO: 168523 - DNA, 25 bp, Mus musculus
agcaggccccaactgcatcatggga

SEQ ID NO: 168524 - DNA, 25 bp, Mus musculus
agcaggccccaagtgcatcatggga

SEQ ID NO: 168525 - DNA, 25 bp, Mus musculus
agcaggcccgcacccaggtgaacga

SEQ ID NO: 168526 - DNA, 25 bp, Mus musculus
agcaggcccgcagccaggtgaacga

SEQ ID NO: 168527 - DNA, 25 bp, Mus musculus
agcaggccctttatgagctatcttc

SEQ ID NO: 168528 - DNA, 25 bp, Mus musculus
agcaggccctttttgagctatcttc

SEQ ID NO: 168529 - DNA, 25 bp, Mus musculus
agcaggccgcttacagagacagatg

SEQ ID NO: 168530 - DNA, 25 bp, Mus musculus
agcaggccgctttcagagacagatg

SEQ ID NO: 168531 - DNA, 25 bp, Mus musculus
agcaggcctccaacgtgttgggcag

SEQ ID NO: 168532 - DNA, 25 bp, Mus musculus
agcaggcctccatcgtgttgggcag

SEQ ID NO: 168533 - DNA, 25 bp, Mus musculus
agcaggcctctgaacttagacccta

SEQ ID NO: 168534 - DNA, 25 bp, Mus musculus
agcaggcctctgctatgatccagag

SEQ ID NO: 168535 - DNA, 25 bp, Mus musculus
agcaggcctctggtatgatccagag

SEQ ID NO: 168536 - DNA, 25 bp, Mus musculus
agcaggcctctgtacttagacccta

SEQ ID NO: 168537 - DNA, 25 bp, Mus musculus
agcaggcctgtcatgcctctgtttg

SEQ ID NO: 168538 - DNA, 25 bp, Mus musculus
agcaggcctgtcttgcctctgtttg

SEQ ID NO: 168539 - DNA, 25 bp, Mus musculus
agcaggccttacacattactgtctc

SEQ ID NO: 168540 - DNA, 25 bp, Mus musculus
agcaggccttactcattactgtctc

SEQ ID NO: 168541 - DNA, 25 bp, Mus musculus
agcaggccttagaggactacccagg

SEQ ID NO: 168542 - DNA, 25 bp, Mus musculus
agcaggccttagtggactacccagg

SEQ ID NO: 168543 - DNA, 25 bp, Mus musculus
agcaggccttgcagcctgtggtgga

SEQ ID NO: 168544 - DNA, 25 bp, Mus musculus
agcaggccttgctgcctgtggtgga

SEQ ID NO: 168545 - DNA, 25 bp, Mus musculus
agcaggcctttaacttgtattcaac

SEQ ID NO: 168546 - DNA, 25 bp, Mus musculus
agcaggcctttatcttgtattcaac

SEQ ID NO: 168547 - DNA, 25 bp, Mus musculus
agcaggcgatacacagcagcaggtc

SEQ ID NO: 168548 - DNA, 25 bp, Mus musculus
agcaggcgatactcagcagcaggtc

SEQ ID NO: 168549 - DNA, 25 bp, Mus musculus
agcaggcgcagactcgtagcttgaa

SEQ ID NO: 168550 - DNA, 25 bp, Mus musculus
agcaggcgcagagtcgtagcttgaa

SEQ ID NO: 168551 - DNA, 25 bp, Mus musculus
agcaggcgccacctcatcaggattg

SEQ ID NO: 168552 - DNA, 25 bp, Mus musculus
agcaggcgccacgtcatcaggattg

SEQ ID NO: 168553 - DNA, 25 bp, Mus musculus
agcaggcgcgagactcttgaagaca

SEQ ID NO: 168554 - DNA, 25 bp, Mus musculus
agcaggcgcgagtctcttgaagaca

SEQ ID NO: 168555 - DNA, 25 bp, Mus musculus
agcaggcggtgaatggcccagctct

SEQ ID NO: 168556 - DNA, 25 bp, Mus musculus
agcaggcggtgattggcccagctct

SEQ ID NO: 168557 - DNA, 25 bp, Mus musculus
agcaggcgtcatagaaactcttcga

SEQ ID NO: 168558 - DNA, 25 bp, Mus musculus
agcaggcgtcattgaaactcttcga

SEQ ID NO: 168559 - DNA, 25 bp, Mus musculus
agcaggcgttcgatcgactgtctga

SEQ ID NO: 168560 - DNA, 25 bp, Mus musculus
agcaggcgttcgttcgactgtctga

SEQ ID NO: 168561 - DNA, 25 bp, Mus musculus
agcaggctaaggatgtaactcaggg

SEQ ID NO: 168562 - DNA, 25 bp, Mus musculus
agcaggctaaggttgtaactcaggg

SEQ ID NO: 168563 - DNA, 25 bp, Mus musculus
agcaggctaattccaagggcgagca

SEQ ID NO: 168564 - DNA, 25 bp, Mus musculus
agcaggctaattgcaagggcgagca

SEQ ID NO: 168565 - DNA, 25 bp, Mus musculus
agcaggctacgtattcgttctgtgc

SEQ ID NO: 168566 - DNA, 25 bp, Mus musculus
agcaggctacgttttcgttctgtgc

SEQ ID NO: 168567 - DNA, 25 bp, Mus musculus
agcaggctccagaactagagaccga

SEQ ID NO: 168568 - DNA, 25 bp, Mus musculus
agcaggctccagtactagagaccga

SEQ ID NO: 168569 - DNA, 25 bp, Mus musculus
agcaggctcccaagggcatctttgt

SEQ ID NO: 168570 - DNA, 25 bp, Mus musculus
agcaggctcccacagagctggcaga

SEQ ID NO: 168571 - DNA, 25 bp, Mus musculus
agcaggctcccagagagctggcaga

SEQ ID NO: 168572 - DNA, 25 bp, Mus musculus
agcaggctcccatgggcatctttgt

SEQ ID NO: 168573 - DNA, 25 bp, Mus musculus
agcaggctcggcaaggctcccaagg

SEQ ID NO: 168574 - DNA, 25 bp, Mus musculus
agcaggctcggctaggctcccaagg

SEQ ID NO: 168575 - DNA, 25 bp, Mus musculus
agcaggctctgcaacttggagtggt

SEQ ID NO: 168576 - DNA, 25 bp, Mus musculus
agcaggctctgcctcggtgtccctt

SEQ ID NO: 168577 - DNA, 25 bp, Mus musculus
agcaggctctgcgtcggtgtccctt

SEQ ID NO: 168578 - DNA, 25 bp, Mus musculus
agcaggctctgctacttggagtggt

SEQ ID NO: 168579 - DNA, 25 bp, Mus musculus
agcaggctctgtcgatacctcagtg

SEQ ID NO: 168580 - DNA, 25 bp, Mus musculus
agcaggctctgtggatacctcagtg

SEQ ID NO: 168581 - DNA, 25 bp, Mus musculus
agcaggctcttgagcccttagaaga

SEQ ID NO: 168582 - DNA, 25 bp, Mus musculus
agcaggctcttgtgcccttagaaga

SEQ ID NO: 168583 - DNA, 25 bp, Mus musculus
agcaggctctttcttcagtttttaa

SEQ ID NO: 168584 - DNA, 25 bp, Mus musculus
agcaggctctttcttttgtacatac

SEQ ID NO: 168585 - DNA, 25 bp, Mus musculus
agcaggctctttgttcagtttttaa

SEQ ID NO: 168586 - DNA, 25 bp, Mus musculus
agcaggctctttgttttgtacatac

SEQ ID NO: 168587 - DNA, 25 bp, Mus musculus
agcaggctgagccagaagttgacct

SEQ ID NO: 168588 - DNA, 25 bp, Mus musculus
agcaggctgagcgagaagttgacct

SEQ ID NO: 168589 - DNA, 25 bp, Mus musculus
agcaggctgcaaactggcccacggc

SEQ ID NO: 168590 - DNA, 25 bp, Mus musculus
agcaggctgcaatctggcccacggc

SEQ ID NO: 168591 - DNA, 25 bp, Mus musculus
agcaggctgcagactggattcgcat

SEQ ID NO: 168592 - DNA, 25 bp, Mus musculus
agcaggctgcagtctggattcgcat

SEQ ID NO: 168593 - DNA, 25 bp, Mus musculus
agcaggctgctaacacccaaggtgt

SEQ ID NO: 168594 - DNA, 25 bp, Mus musculus
agcaggctgctatcacccaaggtgt

SEQ ID NO: 168595 - DNA, 25 bp, Mus musculus
agcaggctggaacgcaagtgtccca

SEQ ID NO: 168596 - DNA, 25 bp, Mus musculus
agcaggctggaaggcaagtgtccca

SEQ ID NO: 168597 - DNA, 25 bp, Mus musculus
agcaggctggctcagtatcaacccc

SEQ ID NO: 168598 - DNA, 25 bp, Mus musculus
agcaggctggctctgagaacgctca

SEQ ID NO: 168599 - DNA, 25 bp, Mus musculus
agcaggctggctgagtatcaacccc

SEQ ID NO: 168600 - DNA, 25 bp, Mus musculus
agcaggctggctgtgagaacgctca

SEQ ID NO: 168601 - DNA, 25 bp, Mus musculus
agcaggctggtcagtattctctcag

SEQ ID NO: 168602 - DNA, 25 bp, Mus musculus
agcaggctggtctgtattctctcag

SEQ ID NO: 168603 - DNA, 25 bp, Mus musculus
agcaggctgtcaatcagcaggctct

SEQ ID NO: 168604 - DNA, 25 bp, Mus musculus
agcaggctgtcattcagcaggctct

SEQ ID NO: 168605 - DNA, 25 bp, Mus musculus
agcaggctgtctactatggcattga

SEQ ID NO: 168606 - DNA, 25 bp, Mus musculus
agcaggctgtcttctatggcattga

SEQ ID NO: 168607 - DNA, 25 bp, Mus musculus
agcaggctgtgtcggtttcaattcc

SEQ ID NO: 168608 - DNA, 25 bp, Mus musculus
agcaggctgtgtgggtttcaattcc

SEQ ID NO: 168609 - DNA, 25 bp, Mus musculus
agcaggcttagtcgctgtttactca

SEQ ID NO: 168610 - DNA, 25 bp, Mus musculus
agcaggcttagtggctgtttactca

SEQ ID NO: 168611 - DNA, 25 bp, Mus musculus
agcaggcttcaaagtcgccgcagcg

SEQ ID NO: 168612 - DNA, 25 bp, Mus musculus
agcaggcttcaatgtcgccgcagcg

SEQ ID NO: 168613 - DNA, 25 bp, Mus musculus
agcaggcttcagcaggcttcaggac

SEQ ID NO: 168614 - DNA, 25 bp, Mus musculus
agcaggcttcaggaggcttcaggac

SEQ ID NO: 168615 - DNA, 25 bp, Mus musculus
agcaggcttccaattttcggacaga

SEQ ID NO: 168616 - DNA, 25 bp, Mus musculus
agcaggcttccatttttcggacaga

SEQ ID NO: 168617 - DNA, 25 bp, Mus musculus
agcaggcttctcattggtctctgaa

SEQ ID NO: 168618 - DNA, 25 bp, Mus musculus
agcaggcttctctttggtctctgaa

SEQ ID NO: 168619 - DNA, 25 bp, Mus musculus
agcaggcttctgaaaacttccaggt

SEQ ID NO: 168620 - DNA, 25 bp, Mus musculus
agcaggcttctgtaaacttccaggt

SEQ ID NO: 168621 - DNA, 25 bp, Mus musculus
agcaggcttgagattaaatgggaga

SEQ ID NO: 168622 - DNA, 25 bp, Mus musculus
agcaggcttgagtttaaatgggaga

SEQ ID NO: 168623 - DNA, 25 bp, Mus musculus
agcaggcttgcactatgtccagctg

SEQ ID NO: 168624 - DNA, 25 bp, Mus musculus
agcaggcttgcagtatgtccagctg

SEQ ID NO: 168625 - DNA, 25 bp, Mus musculus
agcaggcttgctcttaagtcccaag

SEQ ID NO: 168626 - DNA, 25 bp, Mus musculus
agcaggcttgctgttaagtcccaag

SEQ ID NO: 168627 - DNA, 25 bp, Mus musculus
agcaggcttgggagcaactgaaaga

SEQ ID NO: 168628 - DNA, 25 bp, Mus musculus
agcaggcttgggtgcaactgaaaga

SEQ ID NO: 168629 - DNA, 25 bp, Mus musculus
agcaggctttgtaccagacagactc

SEQ ID NO: 168630 - DNA, 25 bp, Mus musculus
agcaggctttgttccagacagactc

SEQ ID NO: 168631 - DNA, 25 bp, Mus musculus
agcagggaatcacttctcaaccttc

SEQ ID NO: 168632 - DNA, 25 bp, Mus musculus
agcagggaatcagttctcaaccttc

SEQ ID NO: 168633 - DNA, 25 bp, Mus musculus
agcagggaatggagtctcttagaac

SEQ ID NO: 168634 - DNA, 25 bp, Mus musculus
agcagggaatggtgtctcttagaac

SEQ ID NO: 168635 - DNA, 25 bp, Mus musculus
agcagggacctcatttccttcatca

SEQ ID NO: 168636 - DNA, 25 bp, Mus musculus
agcagggacctcttttccttcatca

SEQ ID NO: 168637 - DNA, 25 bp, Mus musculus
agcagggactgcagaagcctctcgt

SEQ ID NO: 168638 - DNA, 25 bp, Mus musculus
agcagggactgctgaagcctctcgt

SEQ ID NO: 168639 - DNA, 25 bp, Mus musculus
agcagggacttgaagaagaaaccat

SEQ ID NO: 168640 - DNA, 25 bp, Mus musculus
agcagggacttgctccagggagtgg

SEQ ID NO: 168641 - DNA, 25 bp, Mus musculus
agcagggacttgctgggtccaacac

SEQ ID NO: 168642 - DNA, 25 bp, Mus musculus
agcagggacttggtccagggagtgg

SEQ ID NO: 168643 - DNA, 25 bp, Mus musculus
agcagggacttggtgggtccaacac

SEQ ID NO: 168644 - DNA, 25 bp, Mus musculus
agcagggacttgtagaagaaaccat

SEQ ID NO: 168645 - DNA, 25 bp, Mus musculus
agcagggagactagaggtgtccaca

SEQ ID NO: 168646 - DNA, 25 bp, Mus musculus
agcagggagacttgaggtgtccaca

SEQ ID NO: 168647 - DNA, 25 bp, Mus musculus
agcagggagagcacgcaggccacct

SEQ ID NO: 168648 - DNA, 25 bp, Mus musculus
agcagggagagctcgcaggccacct

SEQ ID NO: 168649 - DNA, 25 bp, Mus musculus
agcagggagccaagtatgatttcca

SEQ ID NO: 168650 - DNA, 25 bp, Mus musculus
agcagggagccatgtatgatttcca

SEQ ID NO: 168651 - DNA, 25 bp, Mus musculus
agcagggcaactacaacttcttttt

SEQ ID NO: 168652 - DNA, 25 bp, Mus musculus
agcagggcaactacaaggccaccta

SEQ ID NO: 168653 - DNA, 25 bp, Mus musculus
agcagggcaacttcaacttcttttt

SEQ ID NO: 168654 - DNA, 25 bp, Mus musculus
agcagggcaacttcaaggccaccta

SEQ ID NO: 168655 - DNA, 25 bp, Mus musculus
agcagggcagagacaggctgatccc

SEQ ID NO: 168656 - DNA, 25 bp, Mus musculus
agcagggcagagtcaggctgatccc

SEQ ID NO: 168657 - DNA, 25 bp, Mus musculus
agcagggcagatccaggccagacca

SEQ ID NO: 168658 - DNA, 25 bp, Mus musculus
agcagggcagatgcaggccagacca

SEQ ID NO: 168659 - DNA, 25 bp, Mus musculus
agcagggcagccagtgaacccagaa

SEQ ID NO: 168660 - DNA, 25 bp, Mus musculus
agcagggcagcctgtgaacccagaa

SEQ ID NO: 168661 - DNA, 25 bp, Mus musculus
agcagggcaggacacttgccactga

SEQ ID NO: 168662 - DNA, 25 bp, Mus musculus
agcagggcaggagacttgccactga

SEQ ID NO: 168663 - DNA, 25 bp, Mus musculus
agcagggccagaaccccaatgtata

SEQ ID NO: 168664 - DNA, 25 bp, Mus musculus
agcagggccagatccccaatgtata

SEQ ID NO: 168665 - DNA, 25 bp, Mus musculus
agcagggccccgatctcagaagagg

SEQ ID NO: 168666 - DNA, 25 bp, Mus musculus
agcagggccccgttctcagaagagg

SEQ ID NO: 168667 - DNA, 25 bp, Mus musculus
agcagggccctgagctggtaacagc

SEQ ID NO: 168668 - DNA, 25 bp, Mus musculus
agcagggccctgtgctggtaacagc

SEQ ID NO: 168669 - DNA, 25 bp, Mus musculus
agcagggccgctatgcacccagcta

SEQ ID NO: 168670 - DNA, 25 bp, Mus musculus
agcagggccgctttgcacccagcta

SEQ ID NO: 168671 - DNA, 25 bp, Mus musculus
agcagggcctatcaacagagagatg

SEQ ID NO: 168672 - DNA, 25 bp, Mus musculus
agcagggcctatgaacagagagatg

SEQ ID NO: 168673 - DNA, 25 bp, Mus musculus
agcagggcctcaattatggctgtta

SEQ ID NO: 168674 - DNA, 25 bp, Mus musculus
agcagggcctcatttatggctgtta

SEQ ID NO: 168675 - DNA, 25 bp, Mus musculus
agcagggcctgactacctcttacag

SEQ ID NO: 168676 - DNA, 25 bp, Mus musculus
agcagggcctgagtacctcttacag

SEQ ID NO: 168677 - DNA, 25 bp, Mus musculus
agcagggcgagaaacagctgtttga

SEQ ID NO: 168678 - DNA, 25 bp, Mus musculus
agcagggcgagatacagctgtttga

SEQ ID NO: 168679 - DNA, 25 bp, Mus musculus
agcagggcgtccagggagcttcatt

SEQ ID NO: 168680 - DNA, 25 bp, Mus musculus
agcagggcgtcctgggagcttcatt

SEQ ID NO: 168681 - DNA, 25 bp, Mus musculus
agcagggcgtgtccctagcatccat

SEQ ID NO: 168682 - DNA, 25 bp, Mus musculus
agcagggcgtgtgcctagcatccat

SEQ ID NO: 168683 - DNA, 25 bp, Mus musculus
agcagggctcttcttactttctaaa

SEQ ID NO: 168684 - DNA, 25 bp, Mus musculus
agcagggctcttgttactttctaaa

SEQ ID NO: 168685 - DNA, 25 bp, Mus musculus
agcagggctgcccactgcattctct

SEQ ID NO: 168686 - DNA, 25 bp, Mus musculus
agcagggctgccgactgcattctct

SEQ ID NO: 168687 - DNA, 25 bp, Mus musculus
agcagggctggcagagtttcctacc

SEQ ID NO: 168688 - DNA, 25 bp, Mus musculus
agcagggctggcctctacagagaat

SEQ ID NO: 168689 - DNA, 25 bp, Mus musculus
agcagggctggcgtctacagagaat

SEQ ID NO: 168690 - DNA, 25 bp, Mus musculus
agcagggctggctgagtttcctacc

SEQ ID NO: 168691 - DNA, 25 bp, Mus musculus
agcagggctgggaccctggcactaa

SEQ ID NO: 168692 - DNA, 25 bp, Mus musculus
agcagggctgggtccctggcactaa

SEQ ID NO: 168693 - DNA, 25 bp, Mus musculus
agcagggctgtgaactatcaccaca

SEQ ID NO: 168694 - DNA, 25 bp, Mus musculus
agcagggctgtgtactatcaccaca

SEQ ID NO: 168695 - DNA, 25 bp, Mus musculus
agcagggctgttcaaatcaccaaga

SEQ ID NO: 168696 - DNA, 25 bp, Mus musculus
agcagggctgttgaaatcaccaaga

SEQ ID NO: 168697 - DNA, 25 bp, Mus musculus
agcagggcttacagcggcagctacg

SEQ ID NO: 168698 - DNA, 25 bp, Mus musculus
agcagggcttactgcggcagctacg

SEQ ID NO: 168699 - DNA, 25 bp, Mus musculus
agcagggctttaccaatcagtcaca

SEQ ID NO: 168700 - DNA, 25 bp, Mus musculus
agcagggctttagcaatcagtcaca

SEQ ID NO: 168701 - DNA, 25 bp, Mus musculus
agcagggtatgcaccagttaggatt

SEQ ID NO: 168702 - DNA, 25 bp, Mus musculus
agcagggtatgctccagttaggatt

SEQ ID NO: 168703 - DNA, 25 bp, Mus musculus
agcagggtcagaccctttactatct

SEQ ID NO: 168704 - DNA, 25 bp, Mus musculus
agcagggtcagagcctttactatct

SEQ ID NO: 168705 - DNA, 25 bp, Mus musculus
agcagggtcagtattacacaccgaa

SEQ ID NO: 168706 - DNA, 25 bp, Mus musculus
agcagggtcagttttacacaccgaa

SEQ ID NO: 168707 - DNA, 25 bp, Mus musculus
agcagggtccctatgatttagctgg

SEQ ID NO: 168708 - DNA, 25 bp, Mus musculus
agcagggtccctttgatttagctgg

SEQ ID NO: 168709 - DNA, 25 bp, Mus musculus
agcagggtcctcacgtccggcagct

SEQ ID NO: 168710 - DNA, 25 bp, Mus musculus
agcagggtcctctcgtccggcagct

SEQ ID NO: 168711 - DNA, 25 bp, Mus musculus
agcagggtctgcagcccatagtgaa

SEQ ID NO: 168712 - DNA, 25 bp, Mus musculus
agcagggtctgctgcccatagtgaa

SEQ ID NO: 168713 - DNA, 25 bp, Mus musculus
agcagggtgaatatacccctctact

SEQ ID NO: 168714 - DNA, 25 bp, Mus musculus
agcagggtgaatctttcccctttgc

SEQ ID NO: 168715 - DNA, 25 bp, Mus musculus
agcagggtgaatgtttcccctttgc

SEQ ID NO: 168716 - DNA, 25 bp, Mus musculus
agcagggtgaatttacccctctact

SEQ ID NO: 168717 - DNA, 25 bp, Mus musculus
agcagggtggcaaggctcgcgccaa

SEQ ID NO: 168718 - DNA, 25 bp, Mus musculus
agcagggtggcatggctcgcgccaa

SEQ ID NO: 168719 - DNA, 25 bp, Mus musculus
agcagggtggcgctgatgatgctag

SEQ ID NO: 168720 - DNA, 25 bp, Mus musculus
agcagggtggcggtgatgatgctag

SEQ ID NO: 168721 - DNA, 25 bp, Mus musculus
agcagggtggctagctgtacatctg

SEQ ID NO: 168722 - DNA, 25 bp, Mus musculus
agcagggtggcttgctgtacatctg

SEQ ID NO: 168723 - DNA, 25 bp, Mus musculus
agcagggttcttccttccatgacag

SEQ ID NO: 168724 - DNA, 25 bp, Mus musculus
agcagggttcttgcttccatgacag

SEQ ID NO: 168725 - DNA, 25 bp, Mus musculus
agcagggttgcaacagcactggtca

SEQ ID NO: 168726 - DNA, 25 bp, Mus musculus
agcagggttgcatcagcactggtca

SEQ ID NO: 168727 - DNA, 25 bp, Mus musculus
agcagggttggtccctcaggaccac

SEQ ID NO: 168728 - DNA, 25 bp, Mus musculus
agcagggttggtgcctcaggaccac

SEQ ID NO: 168729 - DNA, 25 bp, Mus musculus
agcagggtttccactggtttctgtt

SEQ ID NO: 168730 - DNA, 25 bp, Mus musculus
agcagggtttcctctggtttctgtt

SEQ ID NO: 168731 - DNA, 25 bp, Mus musculus
agcaggtaaaataccactttggtag

SEQ ID NO: 168732 - DNA, 25 bp, Mus musculus
agcaggtaaaattccactttggtag

SEQ ID NO: 168733 - DNA, 25 bp, Mus musculus
agcaggtaaagcagtttgacaccaa

SEQ ID NO: 168734 - DNA, 25 bp, Mus musculus
agcaggtaaagctgtttgacaccaa

SEQ ID NO: 168735 - DNA, 25 bp, Mus musculus
agcaggtaaaggaccttggcgccaa

SEQ ID NO: 168736 - DNA, 25 bp, Mus musculus
agcaggtaaaggtccttggcgccaa

SEQ ID NO: 168737 - DNA, 25 bp, Mus musculus
agcaggtaatacactgtgtttcccc

SEQ ID NO: 168738 - DNA, 25 bp, Mus musculus
agcaggtaatactctgtgtttcccc

SEQ ID NO: 168739 - DNA, 25 bp, Mus musculus
agcaggtacttacatcacggttttc

SEQ ID NO: 168740 - DNA, 25 bp, Mus musculus
agcaggtacttagatcacggttttc

SEQ ID NO: 168741 - DNA, 25 bp, Mus musculus
agcaggtagaacactcatgccttct

SEQ ID NO: 168742 - DNA, 25 bp, Mus musculus
agcaggtagaactctcatgccttct

SEQ ID NO: 168743 - DNA, 25 bp, Mus musculus
agcaggtagcggaagctcccggact

SEQ ID NO: 168744 - DNA, 25 bp, Mus musculus
agcaggtagcggtagctcccggact

SEQ ID NO: 168745 - DNA, 25 bp, Mus musculus
agcaggtataccatagacagttttt

SEQ ID NO: 168746 - DNA, 25 bp, Mus musculus
agcaggtataccttagacagttttt

SEQ ID NO: 168747 - DNA, 25 bp, Mus musculus
agcaggtatatgaaagggccctcct

SEQ ID NO: 168748 - DNA, 25 bp, Mus musculus
agcaggtatatgtaagggccctcct

SEQ ID NO: 168749 - DNA, 25 bp, Mus musculus
agcaggtatcccctaagctcatgga

SEQ ID NO: 168750 - DNA, 25 bp, Mus musculus
agcaggtatcccgtaagctcatgga

SEQ ID NO: 168751 - DNA, 25 bp, Mus musculus
agcaggtatgtgaagatgcgccaga

SEQ ID NO: 168752 - DNA, 25 bp, Mus musculus
agcaggtatgtgtagatgcgccaga

SEQ ID NO: 168753 - DNA, 25 bp, Mus musculus
agcaggtcaaaaacctagtccccag

SEQ ID NO: 168754 - DNA, 25 bp, Mus musculus
agcaggtcaaaatcctagtccccag

SEQ ID NO: 168755 - DNA, 25 bp, Mus musculus
agcaggtcacgaactcggaccagaa

SEQ ID NO: 168756 - DNA, 25 bp, Mus musculus
agcaggtcacgatctcggaccagaa

SEQ ID NO: 168757 - DNA, 25 bp, Mus musculus
agcaggtcacgtctgcacagcaggc

SEQ ID NO: 168758 - DNA, 25 bp, Mus musculus
agcaggtcacgtgtgcacagcaggc

SEQ ID NO: 168759 - DNA, 25 bp, Mus musculus
agcaggtcaggccattgctgccaag

SEQ ID NO: 168760 - DNA, 25 bp, Mus musculus
agcaggtcaggcgattgctgccaag

SEQ ID NO: 168761 - DNA, 25 bp, Mus musculus
agcaggtccagtccatggttgcttg

SEQ ID NO: 168762 - DNA, 25 bp, Mus musculus
agcaggtccagtgcatggttgcttg

SEQ ID NO: 168763 - DNA, 25 bp, Mus musculus
agcaggtccctgatttgttctgtct

SEQ ID NO: 168764 - DNA, 25 bp, Mus musculus
agcaggtccctgttttgttctgtct

SEQ ID NO: 168765 - DNA, 25 bp, Mus musculus
agcaggtccgcaaggtgagacaatt

SEQ ID NO: 168766 - DNA, 25 bp, Mus musculus
agcaggtccgcatggtgagacaatt

SEQ ID NO: 168767 - DNA, 25 bp, Mus musculus
agcaggtccgtgaggcctatgagta

SEQ ID NO: 168768 - DNA, 25 bp, Mus musculus
agcaggtccgtgtggcctatgagta

SEQ ID NO: 168769 - DNA, 25 bp, Mus musculus
agcaggtcgaggacagcaggctctt

SEQ ID NO: 168770 - DNA, 25 bp, Mus musculus
agcaggtcgaggtcagcaggctctt

SEQ ID NO: 168771 - DNA, 25 bp, Mus musculus
agcaggtcgccaaggccgaagccga

SEQ ID NO: 168772 - DNA, 25 bp, Mus musculus
agcaggtcgccatggccgaagccga

SEQ ID NO: 168773 - DNA, 25 bp, Mus musculus
agcaggtcgtggaccctagagacta

SEQ ID NO: 168774 - DNA, 25 bp, Mus musculus
agcaggtcgtggtccctagagacta

SEQ ID NO: 168775 - DNA, 25 bp, Mus musculus
agcaggtctaggcactgaagccagt

SEQ ID NO: 168776 - DNA, 25 bp, Mus musculus
agcaggtctagggactgaagccagt

SEQ ID NO: 168777 - DNA, 25 bp, Mus musculus
agcaggtctataatcgggcagcccg

SEQ ID NO: 168778 - DNA, 25 bp, Mus musculus
agcaggtctatattcgggcagcccg

SEQ ID NO: 168779 - DNA, 25 bp, Mus musculus
agcaggtctcacattctcgaaatta

SEQ ID NO: 168780 - DNA, 25 bp, Mus musculus
agcaggtctcactttctcgaaatta

SEQ ID NO: 168781 - DNA, 25 bp, Mus musculus
agcaggtctgatatctgtggaccaa

SEQ ID NO: 168782 - DNA, 25 bp, Mus musculus
agcaggtctgatttctgtggaccaa

SEQ ID NO: 168783 - DNA, 25 bp, Mus musculus
agcaggtctgcacgtgcccagcctg

SEQ ID NO: 168784 - DNA, 25 bp, Mus musculus
agcaggtctgcactgtgctcaagca

SEQ ID NO: 168785 - DNA, 25 bp, Mus musculus
agcaggtctgcaggtgcccagcctg

SEQ ID NO: 168786 - DNA, 25 bp, Mus musculus
agcaggtctgcagtgtgctcaagca

SEQ ID NO: 168787 - DNA, 25 bp, Mus musculus
agcaggtgaaaacttcacacactgt

SEQ ID NO: 168788 - DNA, 25 bp, Mus musculus
agcaggtgaaaagttcacacactgt

SEQ ID NO: 168789 - DNA, 25 bp, Mus musculus
agcaggtgaatcattcttgtggtac

SEQ ID NO: 168790 - DNA, 25 bp, Mus musculus
agcaggtgaatctttcttgtggtac

SEQ ID NO: 168791 - DNA, 25 bp, Mus musculus
agcaggtgacaccttcacttgaagc

SEQ ID NO: 168792 - DNA, 25 bp, Mus musculus
agcaggtgacacgttcacttgaagc

SEQ ID NO: 168793 - DNA, 25 bp, Mus musculus
agcaggtgagaacggtctgtcctcc

SEQ ID NO: 168794 - DNA, 25 bp, Mus musculus
agcaggtgagaagggtctgtcctcc

SEQ ID NO: 168795 - DNA, 25 bp, Mus musculus
agcaggtgatggatgatgacgaatc

SEQ ID NO: 168796 - DNA, 25 bp, Mus musculus
agcaggtgatggttgatgacgaatc

SEQ ID NO: 168797 - DNA, 25 bp, Mus musculus
agcaggtgcaccataatgctggcgg

SEQ ID NO: 168798 - DNA, 25 bp, Mus musculus
agcaggtgcaccttaatgctggcgg

SEQ ID NO: 168799 - DNA, 25 bp, Mus musculus
agcaggtgcctgatagtgctaccat

SEQ ID NO: 168800 - DNA, 25 bp, Mus musculus
agcaggtgcctgttagtgctaccat

SEQ ID NO: 168801 - DNA, 25 bp, Mus musculus
agcaggtgccttagaggcctttgat

SEQ ID NO: 168802 - DNA, 25 bp, Mus musculus
agcaggtgccttatttcctttgaat

SEQ ID NO: 168803 - DNA, 25 bp, Mus musculus
agcaggtgcctttgaggcctttgat

SEQ ID NO: 168804 - DNA, 25 bp, Mus musculus
agcaggtgccttttttcctttgaat

SEQ ID NO: 168805 - DNA, 25 bp, Mus musculus
agcaggtggcaacgccaaataaacc

SEQ ID NO: 168806 - DNA, 25 bp, Mus musculus
agcaggtggcaaggccaaataaacc

SEQ ID NO: 168807 - DNA, 25 bp, Mus musculus
agcaggtggcctcttgaagtcagtt

SEQ ID NO: 168808 - DNA, 25 bp, Mus musculus
agcaggtggcctgttgaagtcagtt

SEQ ID NO: 168809 - DNA, 25 bp, Mus musculus
agcaggtggtccagccctggcattc

SEQ ID NO: 168810 - DNA, 25 bp, Mus musculus
agcaggtggtccatgagtcccgcag

SEQ ID NO: 168811 - DNA, 25 bp, Mus musculus
agcaggtggtcctgccctggcattc

SEQ ID NO: 168812 - DNA, 25 bp, Mus musculus
agcaggtggtccttgagtcccgcag

SEQ ID NO: 168813 - DNA, 25 bp, Mus musculus
agcaggtgtatgaagaacagccaga

SEQ ID NO: 168814 - DNA, 25 bp, Mus musculus
agcaggtgtatgtagaacagccaga

SEQ ID NO: 168815 - DNA, 25 bp, Mus musculus
agcaggtgtgacactttaagaccat

SEQ ID NO: 168816 - DNA, 25 bp, Mus musculus
agcaggtgtgactctttaagaccat

SEQ ID NO: 168817 - DNA, 25 bp, Mus musculus
agcaggtgtgctacattacaaatat

SEQ ID NO: 168818 - DNA, 25 bp, Mus musculus
agcaggtgtgcttcattacaaatat

SEQ ID NO: 168819 - DNA, 25 bp, Mus musculus
agcaggttatcacccagcagaaaca

SEQ ID NO: 168820 - DNA, 25 bp, Mus musculus
agcaggttatcagccagcagaaaca

SEQ ID NO: 168821 - DNA, 25 bp, Mus musculus
agcaggttatctatttcccgtggtg

SEQ ID NO: 168822 - DNA, 25 bp, Mus musculus
agcaggttatctttttcccgtggtg

SEQ ID NO: 168823 - DNA, 25 bp, Mus musculus
agcaggttcaccaactctgtcctag

SEQ ID NO: 168824 - DNA, 25 bp, Mus musculus
agcaggttcacctactctgtcctag

SEQ ID NO: 168825 - DNA, 25 bp, Mus musculus
agcaggttcaggatgtctccgagca

SEQ ID NO: 168826 - DNA, 25 bp, Mus musculus
agcaggttcaggttgtctccgagca

SEQ ID NO: 168827 - DNA, 25 bp, Mus musculus
agcaggttcatacagcaggcgttcc

SEQ ID NO: 168828 - DNA, 25 bp, Mus musculus
agcaggttcatagagcaggcgttcc

SEQ ID NO: 168829 - DNA, 25 bp, Mus musculus
agcaggttccataaactccccagat

SEQ ID NO: 168830 - DNA, 25 bp, Mus musculus
agcaggttccattaactccccagat

SEQ ID NO: 168831 - DNA, 25 bp, Mus musculus
agcaggttccgcatgtgctgctaga

SEQ ID NO: 168832 - DNA, 25 bp, Mus musculus
agcaggttccgcttgtgctgctaga

SEQ ID NO: 168833 - DNA, 25 bp, Mus musculus
agcaggttctgtagtgtttccagca

SEQ ID NO: 168834 - DNA, 25 bp, Mus musculus
agcaggttctgtcatgctaccacat

SEQ ID NO: 168835 - DNA, 25 bp, Mus musculus
agcaggttctgtgatgctaccacat

SEQ ID NO: 168836 - DNA, 25 bp, Mus musculus
agcaggttctgttgtgtttccagca

SEQ ID NO: 168837 - DNA, 25 bp, Mus musculus
agcaggttgctgctaccctcaggtt

SEQ ID NO: 168838 - DNA, 25 bp, Mus musculus
agcaggttgctggtaccctcaggtt

SEQ ID NO: 168839 - DNA, 25 bp, Mus musculus
agcaggtttaacacacagatcttag

SEQ ID NO: 168840 - DNA, 25 bp, Mus musculus
agcaggtttaactcacagatcttag

SEQ ID NO: 168841 - DNA, 25 bp, Mus musculus
agcaggtttcagatccttactggga

SEQ ID NO: 168842 - DNA, 25 bp, Mus musculus
agcaggtttcagatcggagtcacac

SEQ ID NO: 168843 - DNA, 25 bp, Mus musculus
agcaggtttcagttccttactggga

SEQ ID NO: 168844 - DNA, 25 bp, Mus musculus
agcaggtttcagttcggagtcacac

SEQ ID NO: 168845 - DNA, 25 bp, Mus musculus
agcaggtttctactgtgagcttgtg

SEQ ID NO: 168846 - DNA, 25 bp, Mus musculus
agcaggtttctagtgtgagcttgtg

SEQ ID NO: 168847 - DNA, 25 bp, Mus musculus
agcaggtttgacagagccggaatta

SEQ ID NO: 168848 - DNA, 25 bp, Mus musculus
agcaggtttgactgagccggaatta

SEQ ID NO: 168849 - DNA, 25 bp, Mus musculus
agcaggttttagagccttgacctgg

SEQ ID NO: 168850 - DNA, 25 bp, Mus musculus
agcaggttttagtgccttgacctgg

SEQ ID NO: 168851 - DNA, 25 bp, Mus musculus
agcagtaaaaccctaggcagtgaat

SEQ ID NO: 168852 - DNA, 25 bp, Mus musculus
agcagtaaaaccgtaggcagtgaat

SEQ ID NO: 168853 - DNA, 25 bp, Mus musculus
agcagtaaactcctaggtcaccttg

SEQ ID NO: 168854 - DNA, 25 bp, Mus musculus
agcagtaaactcgtaggtcaccttg

SEQ ID NO: 168855 - DNA, 25 bp, Mus musculus
agcagtaacccaaatctacagtccc

SEQ ID NO: 168856 - DNA, 25 bp, Mus musculus
agcagtaacccatatctacagtccc

SEQ ID NO: 168857 - DNA, 25 bp, Mus musculus
agcagtaagaacatcagagccccag

SEQ ID NO: 168858 - DNA, 25 bp, Mus musculus
agcagtaagaacttcagagccccag

SEQ ID NO: 168859 - DNA, 25 bp, Mus musculus
agcagtaagagtacatcagggccaa

SEQ ID NO: 168860 - DNA, 25 bp, Mus musculus
agcagtaagagttcatcagggccaa

SEQ ID NO: 168861 - DNA, 25 bp, Mus musculus
agcagtaagtgcactcaatagctga

SEQ ID NO: 168862 - DNA, 25 bp, Mus musculus
agcagtaagtgctctcaatagctga

SEQ ID NO: 168863 - DNA, 25 bp, Mus musculus
agcagtacaacaccttcgtgtccct

SEQ ID NO: 168864 - DNA, 25 bp, Mus musculus
agcagtacaacagcttcgtgtccct

SEQ ID NO: 168865 - DNA, 25 bp, Mus musculus
agcagtacacatacccgtggacatt

SEQ ID NO: 168866 - DNA, 25 bp, Mus musculus
agcagtacacattcccgtggacatt

SEQ ID NO: 168867 - DNA, 25 bp, Mus musculus
agcagtacagagcatccctgtgttt

SEQ ID NO: 168868 - DNA, 25 bp, Mus musculus
agcagtacagaggatccctgtgttt

SEQ ID NO: 168869 - DNA, 25 bp, Mus musculus
agcagtacatctagtgcatgcaaaa

SEQ ID NO: 168870 - DNA, 25 bp, Mus musculus
agcagtacatcttgtgcatgcaaaa

SEQ ID NO: 168871 - DNA, 25 bp, Mus musculus
agcagtacattcacttatcctctag

SEQ ID NO: 168872 - DNA, 25 bp, Mus musculus
agcagtacattctcttatcctctag

SEQ ID NO: 168873 - DNA, 25 bp, Mus musculus
agcagtacatttcctccagttgtgt

SEQ ID NO: 168874 - DNA, 25 bp, Mus musculus
agcagtacatttgctccagttgtgt

SEQ ID NO: 168875 - DNA, 25 bp, Mus musculus
agcagtaccaccatcctggatgaat

SEQ ID NO: 168876 - DNA, 25 bp, Mus musculus
agcagtaccaccttcctggatgaat

SEQ ID NO: 168877 - DNA, 25 bp, Mus musculus
agcagtaccttacggttttgccatt

SEQ ID NO: 168878 - DNA, 25 bp, Mus musculus
agcagtaccttagggttttgccatt

SEQ ID NO: 168879 - DNA, 25 bp, Mus musculus
agcagtactgccacaaagctgtgag

SEQ ID NO: 168880 - DNA, 25 bp, Mus musculus
agcagtactgcctcaaagctgtgag

SEQ ID NO: 168881 - DNA, 25 bp, Mus musculus
agcagtactgtcctattcaataaaa

SEQ ID NO: 168882 - DNA, 25 bp, Mus musculus
agcagtactgtcgtattcaataaaa

SEQ ID NO: 168883 - DNA, 25 bp, Mus musculus
agcagtacttccagtgccgtggttc

SEQ ID NO: 168884 - DNA, 25 bp, Mus musculus
agcagtacttcctgtgccgtggttc

SEQ ID NO: 168885 - DNA, 25 bp, Mus musculus
agcagtagacacacgctgttaccca

SEQ ID NO: 168886 - DNA, 25 bp, Mus musculus
agcagtagacactcgctgttaccca

SEQ ID NO: 168887 - DNA, 25 bp, Mus musculus
agcagtagagccaagtgcgcacttt

SEQ ID NO: 168888 - DNA, 25 bp, Mus musculus
agcagtagagccacacctgccagta

SEQ ID NO: 168889 - DNA, 25 bp, Mus musculus
agcagtagagcctagtgcgcacttt

SEQ ID NO: 168890 - DNA, 25 bp, Mus musculus
agcagtagagcctcacctgccagta

SEQ ID NO: 168891 - DNA, 25 bp, Mus musculus
agcagtagcaatcagcgcccggaca

SEQ ID NO: 168892 - DNA, 25 bp, Mus musculus
agcagtagcaatgagcgcccggaca

SEQ ID NO: 168893 - DNA, 25 bp, Mus musculus
agcagtagcagcacctctgagtctg

SEQ ID NO: 168894 - DNA, 25 bp, Mus musculus
agcagtagcagctcctctgagtctg

SEQ ID NO: 168895 - DNA, 25 bp, Mus musculus
agcagtagcagtaagctcctgagga

SEQ ID NO: 168896 - DNA, 25 bp, Mus musculus
agcagtagcagttagctcctgagga

SEQ ID NO: 168897 - DNA, 25 bp, Mus musculus
agcagtagcctcacgtgctgaccag

SEQ ID NO: 168898 - DNA, 25 bp, Mus musculus
agcagtagcctctcgtgctgaccag

SEQ ID NO: 168899 - DNA, 25 bp, Mus musculus
agcagtagctcactcctgggacaga

SEQ ID NO: 168900 - DNA, 25 bp, Mus musculus
agcagtagctcagtcctgggacaga

SEQ ID NO: 168901 - DNA, 25 bp, Mus musculus
agcagtagggctacttgacaggtcc

SEQ ID NO: 168902 - DNA, 25 bp, Mus musculus
agcagtagggcttcttgacaggtcc

SEQ ID NO: 168903 - DNA, 25 bp, Mus musculus
agcagtagtagcatcttcctcagag

SEQ ID NO: 168904 - DNA, 25 bp, Mus musculus
agcagtagtagcttcttcctcagag

SEQ ID NO: 168905 - DNA, 25 bp, Mus musculus
agcagtagtcgtcttggtacaccac

SEQ ID NO: 168906 - DNA, 25 bp, Mus musculus
agcagtagtcgtgttggtacaccac

SEQ ID NO: 168907 - DNA, 25 bp, Mus musculus
agcagtagtgccatgttggcttgtt

SEQ ID NO: 168908 - DNA, 25 bp, Mus musculus
agcagtagtgccttgttggcttgtt

SEQ ID NO: 168909 - DNA, 25 bp, Mus musculus
agcagtagtggtacagccgctctca

SEQ ID NO: 168910 - DNA, 25 bp, Mus musculus
agcagtagtggttcagccgctctca

SEQ ID NO: 168911 - DNA, 25 bp, Mus musculus
agcagtataactatcagggagcacc

SEQ ID NO: 168912 - DNA, 25 bp, Mus musculus
agcagtataactttcagggagcacc

SEQ ID NO: 168913 - DNA, 25 bp, Mus musculus
agcagtatacggagcacctggcagc

SEQ ID NO: 168914 - DNA, 25 bp, Mus musculus
agcagtatacggtgcacctggcagc

SEQ ID NO: 168915 - DNA, 25 bp, Mus musculus
agcagtatagctcctctggcaaggg

SEQ ID NO: 168916 - DNA, 25 bp, Mus musculus
agcagtatagctgctctggcaaggg

SEQ ID NO: 168917 - DNA, 25 bp, Mus musculus
agcagtatcctgctttgctttgatt

SEQ ID NO: 168918 - DNA, 25 bp, Mus musculus
agcagtatcctggtttgctttgatt

SEQ ID NO: 168919 - DNA, 25 bp, Mus musculus
agcagtatcttcagcatggtaagga

SEQ ID NO: 168920 - DNA, 25 bp, Mus musculus
agcagtatcttcagtcctgctgtcc

SEQ ID NO: 168921 - DNA, 25 bp, Mus musculus
agcagtatcttctgcatggtaagga

SEQ ID NO: 168922 - DNA, 25 bp, Mus musculus
agcagtatcttctgtcctgctgtcc

SEQ ID NO: 168923 - DNA, 25 bp, Mus musculus
agcagtatgcatattctctatgttc

SEQ ID NO: 168924 - DNA, 25 bp, Mus musculus
agcagtatgcattttctctatgttc

SEQ ID NO: 168925 - DNA, 25 bp, Mus musculus
agcagtatgcctcggagtcctcagc

SEQ ID NO: 168926 - DNA, 25 bp, Mus musculus
agcagtatgcctgggagtcctcagc

SEQ ID NO: 168927 - DNA, 25 bp, Mus musculus
agcagtatggccagactcacgggac

SEQ ID NO: 168928 - DNA, 25 bp, Mus musculus
agcagtatggcctgactcacgggac

SEQ ID NO: 168929 - DNA, 25 bp, Mus musculus
agcagtatttagaagtcgaactttg

SEQ ID NO: 168930 - DNA, 25 bp, Mus musculus
agcagtatttagtagtcgaactttg

SEQ ID NO: 168931 - DNA, 25 bp, Mus musculus
agcagtatttgcatggccttagcct

SEQ ID NO: 168932 - DNA, 25 bp, Mus musculus
agcagtatttgcttggccttagcct

SEQ ID NO: 168933 - DNA, 25 bp, Mus musculus
agcagtcaaactcaggccttataaa

SEQ ID NO: 168934 - DNA, 25 bp, Mus musculus
agcagtcaaactgaggccttataaa

SEQ ID NO: 168935 - DNA, 25 bp, Mus musculus
agcagtcaacaacctccgtgaggat

SEQ ID NO: 168936 - DNA, 25 bp, Mus musculus
agcagtcaacaagctccgtgaggat

SEQ ID NO: 168937 - DNA, 25 bp, Mus musculus
agcagtcaattacctcctcagtagg

SEQ ID NO: 168938 - DNA, 25 bp, Mus musculus
agcagtcaattagctcctcagtagg

SEQ ID NO: 168939 - DNA, 25 bp, Mus musculus
agcagtcaccaccaggtagtcccaa

SEQ ID NO: 168940 - DNA, 25 bp, Mus musculus
agcagtcaccacgaggtagtcccaa

SEQ ID NO: 168941 - DNA, 25 bp, Mus musculus
agcagtcaccgactcactgggcaag

SEQ ID NO: 168942 - DNA, 25 bp, Mus musculus
agcagtcaccgagtcactgggcaag

SEQ ID NO: 168943 - DNA, 25 bp, Mus musculus
agcagtcaccttagagatacctggg

SEQ ID NO: 168944 - DNA, 25 bp, Mus musculus
agcagtcacctttgagatacctggg

SEQ ID NO: 168945 - DNA, 25 bp, Mus musculus
agcagtcacgagacatctccaggac

SEQ ID NO: 168946 - DNA, 25 bp, Mus musculus
agcagtcacgagtcatctccaggac

SEQ ID NO: 168947 - DNA, 25 bp, Mus musculus
agcagtcactcaatgacagcgatgt

SEQ ID NO: 168948 - DNA, 25 bp, Mus musculus
agcagtcactcattgacagcgatgt

SEQ ID NO: 168949 - DNA, 25 bp, Mus musculus
agcagtcacttgctatgccttggat

SEQ ID NO: 168950 - DNA, 25 bp, Mus musculus
agcagtcacttggtatgccttggat

SEQ ID NO: 168951 - DNA, 25 bp, Mus musculus
agcagtcagcaaccatgaggctaac

SEQ ID NO: 168952 - DNA, 25 bp, Mus musculus
agcagtcagcaagcatgaggctaac

SEQ ID NO: 168953 - DNA, 25 bp, Mus musculus
agcagtcagcgaacctttttgtaaa

SEQ ID NO: 168954 - DNA, 25 bp, Mus musculus
agcagtcagcgatcctttttgtaaa

SEQ ID NO: 168955 - DNA, 25 bp, Mus musculus
agcagtcagctaatttatggcatac

SEQ ID NO: 168956 - DNA, 25 bp, Mus musculus
agcagtcagctattttatggcatac

SEQ ID NO: 168957 - DNA, 25 bp, Mus musculus
agcagtcagctcagagtggacttga

SEQ ID NO: 168958 - DNA, 25 bp, Mus musculus
agcagtcagctctgagtggacttga

SEQ ID NO: 168959 - DNA, 25 bp, Mus musculus
agcagtcagctgcttgtctgaagct

SEQ ID NO: 168960 - DNA, 25 bp, Mus musculus
agcagtcagctggttgtctgaagct

SEQ ID NO: 168961 - DNA, 25 bp, Mus musculus
agcagtcaggacagatcgtctccag

SEQ ID NO: 168962 - DNA, 25 bp, Mus musculus
agcagtcaggactgatcgtctccag

SEQ ID NO: 168963 - DNA, 25 bp, Mus musculus
agcagtcaggtcacttaggcaggag

SEQ ID NO: 168964 - DNA, 25 bp, Mus musculus
agcagtcaggtctcttaggcaggag

SEQ ID NO: 168965 - DNA, 25 bp, Mus musculus
agcagtcagtcacggcatcttggaa

SEQ ID NO: 168966 - DNA, 25 bp, Mus musculus
agcagtcagtcagggcatcttggaa

SEQ ID NO: 168967 - DNA, 25 bp, Mus musculus
agcagtcagttcaatgacaccccat

SEQ ID NO: 168968 - DNA, 25 bp, Mus musculus
agcagtcagttctatgacaccccat

SEQ ID NO: 168969 - DNA, 25 bp, Mus musculus
agcagtcatctgcagatatcacccc

SEQ ID NO: 168970 - DNA, 25 bp, Mus musculus
agcagtcatctggagatatcacccc

SEQ ID NO: 168971 - DNA, 25 bp, Mus musculus
agcagtcatggtccacatcctaact

SEQ ID NO: 168972 - DNA, 25 bp, Mus musculus
agcagtcatggtgcacatcctaact

SEQ ID NO: 168973 - DNA, 25 bp, Mus musculus
agcagtccaaaaacgctgtgtttca

SEQ ID NO: 168974 - DNA, 25 bp, Mus musculus
agcagtccaaaatcgctgtgtttca

SEQ ID NO: 168975 - DNA, 25 bp, Mus musculus
agcagtccaacaatccagcaataac

SEQ ID NO: 168976 - DNA, 25 bp, Mus musculus
agcagtccaacattccagcaataac

SEQ ID NO: 168977 - DNA, 25 bp, Mus musculus
agcagtccaagaagaaaccccgcct

SEQ ID NO: 168978 - DNA, 25 bp, Mus musculus
agcagtccaagatgaaaccccgcct

SEQ ID NO: 168979 - DNA, 25 bp, Mus musculus
agcagtccagcaatccgaattcttg

SEQ ID NO: 168980 - DNA, 25 bp, Mus musculus
agcagtccagcattccgaattcttg

SEQ ID NO: 168981 - DNA, 25 bp, Mus musculus
agcagtccattcaggtcaggtgaca

SEQ ID NO: 168982 - DNA, 25 bp, Mus musculus
agcagtccattctggtcaggtgaca

SEQ ID NO: 168983 - DNA, 25 bp, Mus musculus
agcagtcccaaaagtacttggcact

SEQ ID NO: 168984 - DNA, 25 bp, Mus musculus
agcagtcccaaatgtacttggcact

SEQ ID NO: 168985 - DNA, 25 bp, Mus musculus
agcagtcccaagcttgctttttgaa

SEQ ID NO: 168986 - DNA, 25 bp, Mus musculus
agcagtcccaaggttgctttttgaa

SEQ ID NO: 168987 - DNA, 25 bp, Mus musculus
agcagtcccagaactgccaggccat

SEQ ID NO: 168988 - DNA, 25 bp, Mus musculus
agcagtcccagacccgagtgcttgc

SEQ ID NO: 168989 - DNA, 25 bp, Mus musculus
agcagtcccagagccgagtgcttgc

SEQ ID NO: 168990 - DNA, 25 bp, Mus musculus
agcagtcccagatctgccaggccat

SEQ ID NO: 168991 - DNA, 25 bp, Mus musculus
agcagtcccggcaacgctaccagaa

SEQ ID NO: 168992 - DNA, 25 bp, Mus musculus
agcagtcccggctacgctaccagaa

SEQ ID NO: 168993 - DNA, 25 bp, Mus musculus
agcagtcccttgagtccaccagaga

SEQ ID NO: 168994 - DNA, 25 bp, Mus musculus
agcagtcccttgtgtccaccagaga

SEQ ID NO: 168995 - DNA, 25 bp, Mus musculus
agcagtcctaagagtatctctctct

SEQ ID NO: 168996 - DNA, 25 bp, Mus musculus
agcagtcctaagtgtatctctctct

SEQ ID NO: 168997 - DNA, 25 bp, Mus musculus
agcagtcctcaaagcccggagatcg

SEQ ID NO: 168998 - DNA, 25 bp, Mus musculus
agcagtcctcaacagtcagttttcc

SEQ ID NO: 168999 - DNA, 25 bp, Mus musculus
agcagtcctcaagagtcagttttcc

SEQ ID NO: 169000 - DNA, 25 bp, Mus musculus
agcagtcctcaatgcccggagatcg

SEQ ID NO: 169001 - DNA, 25 bp, Mus musculus
agcagtcctcatagtaccttttaag

SEQ ID NO: 169002 - DNA, 25 bp, Mus musculus
agcagtcctcattgtaccttttaag

SEQ ID NO: 169003 - DNA, 25 bp, Mus musculus
agcagtcctgcacttccagagagag

SEQ ID NO: 169004 - DNA, 25 bp, Mus musculus
agcagtcctgcagttccagagagag

SEQ ID NO: 169005 - DNA, 25 bp, Mus musculus
agcagtcctgccaggtattgaacca

SEQ ID NO: 169006 - DNA, 25 bp, Mus musculus
agcagtcctgccatttaaatcttgt

SEQ ID NO: 169007 - DNA, 25 bp, Mus musculus
agcagtcctgcctggtattgaacca

SEQ ID NO: 169008 - DNA, 25 bp, Mus musculus
agcagtcctgccttttaaatcttgt

SEQ ID NO: 169009 - DNA, 25 bp, Mus musculus
agcagtcctgctaagtaccgttgaa

SEQ ID NO: 169010 - DNA, 25 bp, Mus musculus
agcagtcctgcttagtaccgttgaa

SEQ ID NO: 169011 - DNA, 25 bp, Mus musculus
agcagtccttcgaccatgcatcatg

SEQ ID NO: 169012 - DNA, 25 bp, Mus musculus
agcagtccttcgtccatgcatcatg

SEQ ID NO: 169013 - DNA, 25 bp, Mus musculus
agcagtcggagtacgttgttcctga

SEQ ID NO: 169014 - DNA, 25 bp, Mus musculus
agcagtcggagttcgttgttcctga

SEQ ID NO: 169015 - DNA, 25 bp, Mus musculus
agcagtcggtacaagtcacacttca

SEQ ID NO: 169016 - DNA, 25 bp, Mus musculus
agcagtcggtactagtcacacttca

SEQ ID NO: 169017 - DNA, 25 bp, Mus musculus
agcagtcggtgaccatcaatggtgt

SEQ ID NO: 169018 - DNA, 25 bp, Mus musculus
agcagtcggtgagcatcaatggtgt

SEQ ID NO: 169019 - DNA, 25 bp, Mus musculus
agcagtcgtaatctggctattagcc

SEQ ID NO: 169020 - DNA, 25 bp, Mus musculus
agcagtcgtaatgtggctattagcc

SEQ ID NO: 169021 - DNA, 25 bp, Mus musculus
agcagtctacttccctagcaactgg

SEQ ID NO: 169022 - DNA, 25 bp, Mus musculus
agcagtctacttgcctagcaactgg

SEQ ID NO: 169023 - DNA, 25 bp, Mus musculus
agcagtctaggacggctgccttcag

SEQ ID NO: 169024 - DNA, 25 bp, Mus musculus
agcagtctaggagggctgccttcag

SEQ ID NO: 169025 - DNA, 25 bp, Mus musculus
agcagtctcacacaatcgacacaga

SEQ ID NO: 169026 - DNA, 25 bp, Mus musculus
agcagtctcacagaatcgacacaga

SEQ ID NO: 169027 - DNA, 25 bp, Mus musculus
agcagtctcaggaggcccattcagg

SEQ ID NO: 169028 - DNA, 25 bp, Mus musculus
agcagtctcaggtggcccattcagg

SEQ ID NO: 169029 - DNA, 25 bp, Mus musculus
agcagtctccagagaacagaatcct

SEQ ID NO: 169030 - DNA, 25 bp, Mus musculus
agcagtctccagtgaacagaatcct

SEQ ID NO: 169031 - DNA, 25 bp, Mus musculus
agcagtctcgggaaaagctatccta

SEQ ID NO: 169032 - DNA, 25 bp, Mus musculus
agcagtctcgggtaaagctatccta

SEQ ID NO: 169033 - DNA, 25 bp, Mus musculus
agcagtctctaaacatctcgctgta

SEQ ID NO: 169034 - DNA, 25 bp, Mus musculus
agcagtctctaatcatctcgctgta

SEQ ID NO: 169035 - DNA, 25 bp, Mus musculus
agcagtctgaataaagtcacctctt

SEQ ID NO: 169036 - DNA, 25 bp, Mus musculus
agcagtctgaattaagtcacctctt

SEQ ID NO: 169037 - DNA, 25 bp, Mus musculus
agcagtctgcctattaatttccttg

SEQ ID NO: 169038 - DNA, 25 bp, Mus musculus
agcagtctgccttttaatttccttg

SEQ ID NO: 169039 - DNA, 25 bp, Mus musculus
agcagtctggcaactcctaaggcgg

SEQ ID NO: 169040 - DNA, 25 bp, Mus musculus
agcagtctggcatctcctaaggcgg

SEQ ID NO: 169041 - DNA, 25 bp, Mus musculus
agcagtctggctccacaaagtacca

SEQ ID NO: 169042 - DNA, 25 bp, Mus musculus
agcagtctggctgcacaaagtacca

SEQ ID NO: 169043 - DNA, 25 bp, Mus musculus
agcagtctgtctcaatccttaccag

SEQ ID NO: 169044 - DNA, 25 bp, Mus musculus
agcagtctgtctgaatccttaccag

SEQ ID NO: 169045 - DNA, 25 bp, Mus musculus
agcagtcttagaccgcttgagtcca

SEQ ID NO: 169046 - DNA, 25 bp, Mus musculus
agcagtcttagagcgcttgagtcca

SEQ ID NO: 169047 - DNA, 25 bp, Mus musculus
agcagtcttctccagctgcagtttg

SEQ ID NO: 169048 - DNA, 25 bp, Mus musculus
agcagtcttctcgagctgcagtttg

SEQ ID NO: 169049 - DNA, 25 bp, Mus musculus
agcagtcttgagcaggccattccgt

SEQ ID NO: 169050 - DNA, 25 bp, Mus musculus
agcagtcttgaggaggccattccgt

SEQ ID NO: 169051 - DNA, 25 bp, Mus musculus
agcagtcttgctcagcagagtgctt

SEQ ID NO: 169052 - DNA, 25 bp, Mus musculus
agcagtcttgctgagcagagtgctt

SEQ ID NO: 169053 - DNA, 25 bp, Mus musculus
agcagtctttacaggccaccactgg

SEQ ID NO: 169054 - DNA, 25 bp, Mus musculus
agcagtctttactggccaccactgg

SEQ ID NO: 169055 - DNA, 25 bp, Mus musculus
agcagtctttgcaccaagccagctg

SEQ ID NO: 169056 - DNA, 25 bp, Mus musculus
agcagtctttgcattcctctggaaa

SEQ ID NO: 169057 - DNA, 25 bp, Mus musculus
agcagtctttgctccaagccagctg

SEQ ID NO: 169058 - DNA, 25 bp, Mus musculus
agcagtctttgctttcctctggaaa

SEQ ID NO: 169059 - DNA, 25 bp, Mus musculus
agcagtcttttgcaccttgctctct

SEQ ID NO: 169060 - DNA, 25 bp, Mus musculus
agcagtcttttggaccttgctctct

SEQ ID NO: 169061 - DNA, 25 bp, Mus musculus
agcagtctttttcagccatgcaggc

SEQ ID NO: 169062 - DNA, 25 bp, Mus musculus
agcagtctttttgagccatgcaggc

SEQ ID NO: 169063 - DNA, 25 bp, Mus musculus
agcagtgaaatcaccaggtctctct

SEQ ID NO: 169064 - DNA, 25 bp, Mus musculus
agcagtgaaatctccaggtctctct

SEQ ID NO: 169065 - DNA, 25 bp, Mus musculus
agcagtgaagcccagtagaagcaat

SEQ ID NO: 169066 - DNA, 25 bp, Mus musculus
agcagtgaagccgagtagaagcaat

SEQ ID NO: 169067 - DNA, 25 bp, Mus musculus
agcagtgaatcaatggaaagagacc

SEQ ID NO: 169068 - DNA, 25 bp, Mus musculus
agcagtgaatcattggaaagagacc

SEQ ID NO: 169069 - DNA, 25 bp, Mus musculus
agcagtgacactagttcagagcgca

SEQ ID NO: 169070 - DNA, 25 bp, Mus musculus
agcagtgacacttgttcagagcgca

SEQ ID NO: 169071 - DNA, 25 bp, Mus musculus
agcagtgacagaacgccaggccaat

SEQ ID NO: 169072 - DNA, 25 bp, Mus musculus
agcagtgacagatcgccaggccaat

SEQ ID NO: 169073 - DNA, 25 bp, Mus musculus
agcagtgaccacattaggccgtagg

SEQ ID NO: 169074 - DNA, 25 bp, Mus musculus
agcagtgaccactttaggccgtagg

SEQ ID NO: 169075 - DNA, 25 bp, Mus musculus
agcagtgaccatcttgcagcagcta

SEQ ID NO: 169076 - DNA, 25 bp, Mus musculus
agcagtgaccatgttgcagcagcta

SEQ ID NO: 169077 - DNA, 25 bp, Mus musculus
agcagtgaccggacctgatgcagga

SEQ ID NO: 169078 - DNA, 25 bp, Mus musculus
agcagtgaccggtcctgatgcagga

SEQ ID NO: 169079 - DNA, 25 bp, Mus musculus
agcagtgacgaacgcttctctgaca

SEQ ID NO: 169080 - DNA, 25 bp, Mus musculus
agcagtgacgaaggcttctctgaca

SEQ ID NO: 169081 - DNA, 25 bp, Mus musculus
agcagtgactccctcaggtgtgaac

SEQ ID NO: 169082 - DNA, 25 bp, Mus musculus
agcagtgactccgtcaggtgtgaac

SEQ ID NO: 169083 - DNA, 25 bp, Mus musculus
agcagtgagagtatcttggccagca

SEQ ID NO: 169084 - DNA, 25 bp, Mus musculus
agcagtgagagtttcttggccagca

SEQ ID NO: 169085 - DNA, 25 bp, Mus musculus
agcagtgagatcacgcagttagctg

SEQ ID NO: 169086 - DNA, 25 bp, Mus musculus
agcagtgagatctcgcagttagctg

SEQ ID NO: 169087 - DNA, 25 bp, Mus musculus
agcagtgagcatccgcatctctctg

SEQ ID NO: 169088 - DNA, 25 bp, Mus musculus
agcagtgagcatgcgcatctctctg

SEQ ID NO: 169089 - DNA, 25 bp, Mus musculus
agcagtgaggcgagctccctgagct

SEQ ID NO: 169090 - DNA, 25 bp, Mus musculus
agcagtgaggcgtgctccctgagct

SEQ ID NO: 169091 - DNA, 25 bp, Mus musculus
agcagtgagtgcattgatgactttc

SEQ ID NO: 169092 - DNA, 25 bp, Mus musculus
agcagtgagtgctttgatgactttc

SEQ ID NO: 169093 - DNA, 25 bp, Mus musculus
agcagtgagtttcctgggttctgca

SEQ ID NO: 169094 - DNA, 25 bp, Mus musculus
agcagtgagtttgctgggttctgca

SEQ ID NO: 169095 - DNA, 25 bp, Mus musculus
agcagtgatcagctgagctgcccag

SEQ ID NO: 169096 - DNA, 25 bp, Mus musculus
agcagtgatcaggtgagctgcccag

SEQ ID NO: 169097 - DNA, 25 bp, Mus musculus
agcagtgatgggaccacaacatgga

SEQ ID NO: 169098 - DNA, 25 bp, Mus musculus
agcagtgatgggtccacaacatgga

SEQ ID NO: 169099 - DNA, 25 bp, Mus musculus
agcagtgatgtcatatatatctttt

SEQ ID NO: 169100 - DNA, 25 bp, Mus musculus
agcagtgatgtcttatatatctttt

SEQ ID NO: 169101 - DNA, 25 bp, Mus musculus
agcagtgatgttacactacaggaaa

SEQ ID NO: 169102 - DNA, 25 bp, Mus musculus
agcagtgatgtttcactacaggaaa

SEQ ID NO: 169103 - DNA, 25 bp, Mus musculus
agcagtgattggatggctcttcctg

SEQ ID NO: 169104 - DNA, 25 bp, Mus musculus
agcagtgattggttggctcttcctg

SEQ ID NO: 169105 - DNA, 25 bp, Mus musculus
agcagtgcacgacgccatccttgag

SEQ ID NO: 169106 - DNA, 25 bp, Mus musculus
agcagtgcacgaggccatccttgag

SEQ ID NO: 169107 - DNA, 25 bp, Mus musculus
agcagtgcagtgagcccgggctaca

SEQ ID NO: 169108 - DNA, 25 bp, Mus musculus
agcagtgcagtgtgcccgggctaca

SEQ ID NO: 169109 - DNA, 25 bp, Mus musculus
agcagtgccaaaaggtggatggcca

SEQ ID NO: 169110 - DNA, 25 bp, Mus musculus
agcagtgccaaatggtggatggcca

SEQ ID NO: 169111 - DNA, 25 bp, Mus musculus
agcagtgccaaccactgtttgcttt

SEQ ID NO: 169112 - DNA, 25 bp, Mus musculus
agcagtgccaacgactgtttgcttt

SEQ ID NO: 169113 - DNA, 25 bp, Mus musculus
agcagtgccacgagatcccacagat

SEQ ID NO: 169114 - DNA, 25 bp, Mus musculus
agcagtgccacgtgatcccacagat

SEQ ID NO: 169115 - DNA, 25 bp, Mus musculus
agcagtgccactcttgggcccaggt

SEQ ID NO: 169116 - DNA, 25 bp, Mus musculus
agcagtgccactgttgggcccaggt

SEQ ID NO: 169117 - DNA, 25 bp, Mus musculus
agcagtgccagaagtccaagcagaa

SEQ ID NO: 169118 - DNA, 25 bp, Mus musculus
agcagtgccagatgtccaagcagaa

SEQ ID NO: 169119 - DNA, 25 bp, Mus musculus
agcagtgccagtcctgccatgctcc

SEQ ID NO: 169120 - DNA, 25 bp, Mus musculus
agcagtgccagtgctgccatgctcc

SEQ ID NO: 169121 - DNA, 25 bp, Mus musculus
agcagtgcccaacattatctgtaaa

SEQ ID NO: 169122 - DNA, 25 bp, Mus musculus
agcagtgcccaagattatctgtaaa

SEQ ID NO: 169123 - DNA, 25 bp, Mus musculus
agcagtgcccatagcaaagcatcag

SEQ ID NO: 169124 - DNA, 25 bp, Mus musculus
agcagtgcccattgcaaagcatcag

SEQ ID NO: 169125 - DNA, 25 bp, Mus musculus
agcagtgccgagctgtcaccaacac

SEQ ID NO: 169126 - DNA, 25 bp, Mus musculus
agcagtgccgaggtgtcaccaacac

SEQ ID NO: 169127 - DNA, 25 bp, Mus musculus
agcagtgcctctagtcttggagaca

SEQ ID NO: 169128 - DNA, 25 bp, Mus musculus
agcagtgcctcttgtcttggagaca

SEQ ID NO: 169129 - DNA, 25 bp, Mus musculus
agcagtgcctgacccaagtactcta

SEQ ID NO: 169130 - DNA, 25 bp, Mus musculus
agcagtgcctgaccttgcccttgta

SEQ ID NO: 169131 - DNA, 25 bp, Mus musculus
agcagtgcctgagccaagtactcta

SEQ ID NO: 169132 - DNA, 25 bp, Mus musculus
agcagtgcctgagcttgcccttgta

SEQ ID NO: 169133 - DNA, 25 bp, Mus musculus
agcagtgcctgtattaggcgccagg

SEQ ID NO: 169134 - DNA, 25 bp, Mus musculus
agcagtgcctgtcccttaaaataca

SEQ ID NO: 169135 - DNA, 25 bp, Mus musculus
agcagtgcctgtgccttaaaataca

SEQ ID NO: 169136 - DNA, 25 bp, Mus musculus
agcagtgcctgttttaggcgccagg

SEQ ID NO: 169137 - DNA, 25 bp, Mus musculus
agcagtgccttgatcaacgggttac

SEQ ID NO: 169138 - DNA, 25 bp, Mus musculus
agcagtgccttgttcaacgggttac

SEQ ID NO: 169139 - DNA, 25 bp, Mus musculus
agcagtgcgggcaaccaaatttctg

SEQ ID NO: 169140 - DNA, 25 bp, Mus musculus
agcagtgcgggctaccaaatttctg

SEQ ID NO: 169141 - DNA, 25 bp, Mus musculus
agcagtgctagtctccatgcaagaa

SEQ ID NO: 169142 - DNA, 25 bp, Mus musculus
agcagtgctagtgtccatgcaagaa

SEQ ID NO: 169143 - DNA, 25 bp, Mus musculus
agcagtgctattaatgtttgtcatt

SEQ ID NO: 169144 - DNA, 25 bp, Mus musculus
agcagtgctatttatgtttgtcatt

SEQ ID NO: 169145 - DNA, 25 bp, Mus musculus
agcagtgctccacttgctgggctta

SEQ ID NO: 169146 - DNA, 25 bp, Mus musculus
agcagtgctccagttgctgggctta

SEQ ID NO: 169147 - DNA, 25 bp, Mus musculus
agcagtgctcgtcgtaacttctgta

SEQ ID NO: 169148 - DNA, 25 bp, Mus musculus
agcagtgctcgtggtaacttctgta

SEQ ID NO: 169149 - DNA, 25 bp, Mus musculus
agcagtgctggcaggtcgccacaga

SEQ ID NO: 169150 - DNA, 25 bp, Mus musculus
agcagtgctggctggtcgccacaga

SEQ ID NO: 169151 - DNA, 25 bp, Mus musculus
agcagtgctttcacatgcatccata

SEQ ID NO: 169152 - DNA, 25 bp, Mus musculus
agcagtgctttctcatgcatccata

SEQ ID NO: 169153 - DNA, 25 bp, Mus musculus
agcagtggaaacctgacgtcctttt

SEQ ID NO: 169154 - DNA, 25 bp, Mus musculus
agcagtggaaacgtgacgtcctttt

SEQ ID NO: 169155 - DNA, 25 bp, Mus musculus
agcagtggatccaggccaggttcgc

SEQ ID NO: 169156 - DNA, 25 bp, Mus musculus
agcagtggatcctggccaggttcgc

SEQ ID NO: 169157 - DNA, 25 bp, Mus musculus
agcagtggcaggagctacacacata

SEQ ID NO: 169158 - DNA, 25 bp, Mus musculus
agcagtggcaggtgctacacacata

SEQ ID NO: 169159 - DNA, 25 bp, Mus musculus
agcagtggccatccatccagtcctg

SEQ ID NO: 169160 - DNA, 25 bp, Mus musculus
agcagtggccatgcatccagtcctg

SEQ ID NO: 169161 - DNA, 25 bp, Mus musculus
agcagtggcccgagacattcaagaa

SEQ ID NO: 169162 - DNA, 25 bp, Mus musculus
agcagtggcccgtgacattcaagaa

SEQ ID NO: 169163 - DNA, 25 bp, Mus musculus
agcagtggccgcaatctgagtatag

SEQ ID NO: 169164 - DNA, 25 bp, Mus musculus
agcagtggccgctatctgagtatag

SEQ ID NO: 169165 - DNA, 25 bp, Mus musculus
agcagtggcctcagtggcttagaat

SEQ ID NO: 169166 - DNA, 25 bp, Mus musculus
agcagtggcctctgtggcttagaat

SEQ ID NO: 169167 - DNA, 25 bp, Mus musculus
agcagtggcctgacatgtgtagtct

SEQ ID NO: 169168 - DNA, 25 bp, Mus musculus
agcagtggcctgtcatgtgtagtct

SEQ ID NO: 169169 - DNA, 25 bp, Mus musculus
agcagtggctaacctcatcgaagtt

SEQ ID NO: 169170 - DNA, 25 bp, Mus musculus
agcagtggctaagctcatcgaagtt

SEQ ID NO: 169171 - DNA, 25 bp, Mus musculus
agcagtggctgacctcccatgccat

SEQ ID NO: 169172 - DNA, 25 bp, Mus musculus
agcagtggctgagctcccatgccat

SEQ ID NO: 169173 - DNA, 25 bp, Mus musculus
agcagtggctgtcaaatcctcccaa

SEQ ID NO: 169174 - DNA, 25 bp, Mus musculus
agcagtggctgtgaaatcctcccaa

SEQ ID NO: 169175 - DNA, 25 bp, Mus musculus
agcagtgggtccagcccgtgaagaa

SEQ ID NO: 169176 - DNA, 25 bp, Mus musculus
agcagtgggtcctgcccgtgaagaa

SEQ ID NO: 169177 - DNA, 25 bp, Mus musculus
agcagtgggtttcccacacgtttga

SEQ ID NO: 169178 - DNA, 25 bp, Mus musculus
agcagtgggtttgccacacgtttga

SEQ ID NO: 169179 - DNA, 25 bp, Mus musculus
agcagtggtaatacggagaaatggg

SEQ ID NO: 169180 - DNA, 25 bp, Mus musculus
agcagtggtaattcggagaaatggg

SEQ ID NO: 169181 - DNA, 25 bp, Mus musculus
agcagtggtactcaacctgggctct

SEQ ID NO: 169182 - DNA, 25 bp, Mus musculus
agcagtggtactgaacctgggctct

SEQ ID NO: 169183 - DNA, 25 bp, Mus musculus
agcagtggtcacagtcaccactagt

SEQ ID NO: 169184 - DNA, 25 bp, Mus musculus
agcagtggtcactgtcaccactagt

SEQ ID NO: 169185 - DNA, 25 bp, Mus musculus
agcagtggtccacggtatggcctat

SEQ ID NO: 169186 - DNA, 25 bp, Mus musculus
agcagtggtccagggtatggcctat

SEQ ID NO: 169187 - DNA, 25 bp, Mus musculus
agcagtggtcgcatctaatctaaaa

SEQ ID NO: 169188 - DNA, 25 bp, Mus musculus
agcagtggtcgcttctaatctaaaa

SEQ ID NO: 169189 - DNA, 25 bp, Mus musculus
agcagtggtcgtctcacagtgaaaa

SEQ ID NO: 169190 - DNA, 25 bp, Mus musculus
agcagtggtcgtcttcttttcctga

SEQ ID NO: 169191 - DNA, 25 bp, Mus musculus
agcagtggtcgtgtcacagtgaaaa

SEQ ID NO: 169192 - DNA, 25 bp, Mus musculus
agcagtggtcgtgttcttttcctga

SEQ ID NO: 169193 - DNA, 25 bp, Mus musculus
agcagtggttgtacttaaagtggtt

SEQ ID NO: 169194 - DNA, 25 bp, Mus musculus
agcagtggttgttcttaaagtggtt

SEQ ID NO: 169195 - DNA, 25 bp, Mus musculus
agcagtggtttgactctcggagtag

SEQ ID NO: 169196 - DNA, 25 bp, Mus musculus
agcagtggtttgtctctcggagtag

SEQ ID NO: 169197 - DNA, 25 bp, Mus musculus
agcagtgtatttcagaatcccatca

SEQ ID NO: 169198 - DNA, 25 bp, Mus musculus
agcagtgtatttgagaatcccatca

SEQ ID NO: 169199 - DNA, 25 bp, Mus musculus
agcagtgtcaaaaaattttggattt

SEQ ID NO: 169200 - DNA, 25 bp, Mus musculus
agcagtgtcaaataattttggattt

SEQ ID NO: 169201 - DNA, 25 bp, Mus musculus
agcagtgtcaggacaaactcctccc

SEQ ID NO: 169202 - DNA, 25 bp, Mus musculus
agcagtgtcaggtcaaactcctccc

SEQ ID NO: 169203 - DNA, 25 bp, Mus musculus
agcagtgtcatcacagttactcctg

SEQ ID NO: 169204 - DNA, 25 bp, Mus musculus
agcagtgtcatctcagttactcctg

SEQ ID NO: 169205 - DNA, 25 bp, Mus musculus
agcagtgtccgtctttggcagtgta

SEQ ID NO: 169206 - DNA, 25 bp, Mus musculus
agcagtgtccgtgtttggcagtgta

SEQ ID NO: 169207 - DNA, 25 bp, Mus musculus
agcagtgtcgtgctttgagccacta

SEQ ID NO: 169208 - DNA, 25 bp, Mus musculus
agcagtgtcgtggtttgagccacta

SEQ ID NO: 169209 - DNA, 25 bp, Mus musculus
agcagtgtctcaacacacaggcaag

SEQ ID NO: 169210 - DNA, 25 bp, Mus musculus
agcagtgtctcatcacacaggcaag

SEQ ID NO: 169211 - DNA, 25 bp, Mus musculus
agcagtgtctccctgtacacgagaa

SEQ ID NO: 169212 - DNA, 25 bp, Mus musculus
agcagtgtctccgtgtacacgagaa

SEQ ID NO: 169213 - DNA, 25 bp, Mus musculus
agcagtgtctctcaggactaaaaag

SEQ ID NO: 169214 - DNA, 25 bp, Mus musculus
agcagtgtctctgaggactaaaaag

SEQ ID NO: 169215 - DNA, 25 bp, Mus musculus
agcagtgtctgaaacatcaccacga

SEQ ID NO: 169216 - DNA, 25 bp, Mus musculus
agcagtgtctgatacatcaccacga

SEQ ID NO: 169217 - DNA, 25 bp, Mus musculus
agcagtgtgatccaaaccttcctga

SEQ ID NO: 169218 - DNA, 25 bp, Mus musculus
agcagtgtgatcgaaaccttcctga

SEQ ID NO: 169219 - DNA, 25 bp, Mus musculus
agcagtgtgcatagtcagtccctaa

SEQ ID NO: 169220 - DNA, 25 bp, Mus musculus
agcagtgtgcattgtcagtccctaa

SEQ ID NO: 169221 - DNA, 25 bp, Mus musculus
agcagtgtggcaacggcgctgctac

SEQ ID NO: 169222 - DNA, 25 bp, Mus musculus
agcagtgtggcatcggcgctgctac

SEQ ID NO: 169223 - DNA, 25 bp, Mus musculus
agcagtgtggctagacgtgaaatga

SEQ ID NO: 169224 - DNA, 25 bp, Mus musculus
agcagtgtggcttgacgtgaaatga

SEQ ID NO: 169225 - DNA, 25 bp, Mus musculus
agcagtgtgtaacccactttttaat

SEQ ID NO: 169226 - DNA, 25 bp, Mus musculus
agcagtgtgtaagccactttttaat

SEQ ID NO: 169227 - DNA, 25 bp, Mus musculus
agcagtgtgtctagcggacccagaa

SEQ ID NO: 169228 - DNA, 25 bp, Mus musculus
agcagtgtgtcttgcggacccagaa

SEQ ID NO: 169229 - DNA, 25 bp, Mus musculus
agcagtgtgtgacaagcgcacacat

SEQ ID NO: 169230 - DNA, 25 bp, Mus musculus
agcagtgtgtgagaagcgcacacat

SEQ ID NO: 169231 - DNA, 25 bp, Mus musculus
agcagtgttcacagcctttaaatag

SEQ ID NO: 169232 - DNA, 25 bp, Mus musculus
agcagtgttcactgcctttaaatag

SEQ ID NO: 169233 - DNA, 25 bp, Mus musculus
agcagtgttcccaaattcctagcaa

SEQ ID NO: 169234 - DNA, 25 bp, Mus musculus
agcagtgttccctaattcctagcaa

SEQ ID NO: 169235 - DNA, 25 bp, Mus musculus
agcagttaacacatgctcaaggtga

SEQ ID NO: 169236 - DNA, 25 bp, Mus musculus
agcagttaacacttgctcaaggtga

SEQ ID NO: 169237 - DNA, 25 bp, Mus musculus
agcagttaacctcaaggactcccat

SEQ ID NO: 169238 - DNA, 25 bp, Mus musculus
agcagttaacctgaaggactcccat

SEQ ID NO: 169239 - DNA, 25 bp, Mus musculus
agcagttaaggcctttctgggctcc

SEQ ID NO: 169240 - DNA, 25 bp, Mus musculus
agcagttaaggcgtttctgggctcc

SEQ ID NO: 169241 - DNA, 25 bp, Mus musculus
agcagttacaacactaccaaaccac

SEQ ID NO: 169242 - DNA, 25 bp, Mus musculus
agcagttacaactctaccaaaccac

SEQ ID NO: 169243 - DNA, 25 bp, Mus musculus
agcagttacacacttgcatcagcca

SEQ ID NO: 169244 - DNA, 25 bp, Mus musculus
agcagttacacagttgcatcagcca

SEQ ID NO: 169245 - DNA, 25 bp, Mus musculus
agcagttacagtacagccctaagga

SEQ ID NO: 169246 - DNA, 25 bp, Mus musculus
agcagttacagtcttacaaatggtt

SEQ ID NO: 169247 - DNA, 25 bp, Mus musculus
agcagttacagtgttacaaatggtt

SEQ ID NO: 169248 - DNA, 25 bp, Mus musculus
agcagttacagttcagccctaagga

SEQ ID NO: 169249 - DNA, 25 bp, Mus musculus
agcagttacataccagctgtggcaa

SEQ ID NO: 169250 - DNA, 25 bp, Mus musculus
agcagttacatagcagctgtggcaa

SEQ ID NO: 169251 - DNA, 25 bp, Mus musculus
agcagttaccatcgagcacatctcg

SEQ ID NO: 169252 - DNA, 25 bp, Mus musculus
agcagttaccatggagcacatctcg

SEQ ID NO: 169253 - DNA, 25 bp, Mus musculus
agcagttacctgcatggctttgcca

SEQ ID NO: 169254 - DNA, 25 bp, Mus musculus
agcagttacctggatggctttgcca

SEQ ID NO: 169255 - DNA, 25 bp, Mus musculus
agcagttacggcaggaggctaaaag

SEQ ID NO: 169256 - DNA, 25 bp, Mus musculus
agcagttacggctggaggctaaaag

SEQ ID NO: 169257 - DNA, 25 bp, Mus musculus
agcagttactggctcaactcggtat

SEQ ID NO: 169258 - DNA, 25 bp, Mus musculus
agcagttactgggtcaactcggtat

SEQ ID NO: 169259 - DNA, 25 bp, Mus musculus
agcagttaggagcagcccaccagaa

SEQ ID NO: 169260 - DNA, 25 bp, Mus musculus
agcagttaggaggagcccaccagaa

SEQ ID NO: 169261 - DNA, 25 bp, Mus musculus
agcagttatgagctcatctcgcaag

SEQ ID NO: 169262 - DNA, 25 bp, Mus musculus
agcagttatgaggtcatctcgcaag

SEQ ID NO: 169263 - DNA, 25 bp, Mus musculus
agcagttatgtcaagctctggagct

SEQ ID NO: 169264 - DNA, 25 bp, Mus musculus
agcagttatgtctagctctggagct

SEQ ID NO: 169265 - DNA, 25 bp, Mus musculus
agcagttattggacctcaagagatc

SEQ ID NO: 169266 - DNA, 25 bp, Mus musculus
agcagttattggtcctcaagagatc

SEQ ID NO: 169267 - DNA, 25 bp, Mus musculus
agcagttatttgcttatctggtaac

SEQ ID NO: 169268 - DNA, 25 bp, Mus musculus
agcagttatttggttatctggtaac

SEQ ID NO: 169269 - DNA, 25 bp, Mus musculus
agcagttcaacaacctcactcaaaa

SEQ ID NO: 169270 - DNA, 25 bp, Mus musculus
agcagttcaacatcctcactcaaaa

SEQ ID NO: 169271 - DNA, 25 bp, Mus musculus
agcagttcaagcctgcccgaaggcc

SEQ ID NO: 169272 - DNA, 25 bp, Mus musculus
agcagttcaagcgtgcccgaaggcc

SEQ ID NO: 169273 - DNA, 25 bp, Mus musculus
agcagttcagaaattcttccttgaa

SEQ ID NO: 169274 - DNA, 25 bp, Mus musculus
agcagttcagaatttcttccttgaa

SEQ ID NO: 169275 - DNA, 25 bp, Mus musculus
agcagttcatacatcgtataacaat

SEQ ID NO: 169276 - DNA, 25 bp, Mus musculus
agcagttcatacttcgtataacaat

SEQ ID NO: 169277 - DNA, 25 bp, Mus musculus
agcagttcatatagattattggcta

SEQ ID NO: 169278 - DNA, 25 bp, Mus musculus
agcagttcatattgattattggcta

SEQ ID NO: 169279 - DNA, 25 bp, Mus musculus
agcagttcatgaagtaagaaagcct

SEQ ID NO: 169280 - DNA, 25 bp, Mus musculus
agcagttcatgatgtaagaaagcct

SEQ ID NO: 169281 - DNA, 25 bp, Mus musculus
agcagttccacgaccagcagcttac

SEQ ID NO: 169282 - DNA, 25 bp, Mus musculus
agcagttccacgtccagcagcttac

SEQ ID NO: 169283 - DNA, 25 bp, Mus musculus
agcagttccagtctggagagctccc

SEQ ID NO: 169284 - DNA, 25 bp, Mus musculus
agcagttccagtgtggagagctccc

SEQ ID NO: 169285 - DNA, 25 bp, Mus musculus
agcagttccatcataaagtgttcaa

SEQ ID NO: 169286 - DNA, 25 bp, Mus musculus
agcagttccatcttaaagtgttcaa

SEQ ID NO: 169287 - DNA, 25 bp, Mus musculus
agcagttccatgacttttagttata

SEQ ID NO: 169288 - DNA, 25 bp, Mus musculus
agcagttccatgtcttttagttata

SEQ ID NO: 169289 - DNA, 25 bp, Mus musculus
agcagttcccatcagtgaaccctga

SEQ ID NO: 169290 - DNA, 25 bp, Mus musculus
agcagttcccatgagtgaaccctga

SEQ ID NO: 169291 - DNA, 25 bp, Mus musculus
agcagttccccacggaagactggag

SEQ ID NO: 169292 - DNA, 25 bp, Mus musculus
agcagttccccagggaagactggag

SEQ ID NO: 169293 - DNA, 25 bp, Mus musculus
agcagttccctccaagacatctgga

SEQ ID NO: 169294 - DNA, 25 bp, Mus musculus
agcagttccctcgaagacatctgga

SEQ ID NO: 169295 - DNA, 25 bp, Mus musculus
agcagttccctgctcactaaatgac

SEQ ID NO: 169296 - DNA, 25 bp, Mus musculus
agcagttccctggtcactaaatgac

SEQ ID NO: 169297 - DNA, 25 bp, Mus musculus
agcagttccgagagttccgggatct

SEQ ID NO: 169298 - DNA, 25 bp, Mus musculus
agcagttccgagtgttccgggatct

SEQ ID NO: 169299 - DNA, 25 bp, Mus musculus
agcagttcctcactcaggccttgac

SEQ ID NO: 169300 - DNA, 25 bp, Mus musculus
agcagttcctcagtcaggccttgac

SEQ ID NO: 169301 - DNA, 25 bp, Mus musculus
agcagttcctccagtcggacatcaa

SEQ ID NO: 169302 - DNA, 25 bp, Mus musculus
agcagttcctcctgtcggacatcaa

SEQ ID NO: 169303 - DNA, 25 bp, Mus musculus
agcagttcctgcaacacactacagt

SEQ ID NO: 169304 - DNA, 25 bp, Mus musculus
agcagttcctgctacacactacagt

SEQ ID NO: 169305 - DNA, 25 bp, Mus musculus
agcagttccttgattactttaagac

SEQ ID NO: 169306 - DNA, 25 bp, Mus musculus
agcagttccttgtttactttaagac

SEQ ID NO: 169307 - DNA, 25 bp, Mus musculus
agcagttcgctcctttagtaattat

SEQ ID NO: 169308 - DNA, 25 bp, Mus musculus
agcagttcgctcgtttagtaattat

SEQ ID NO: 169309 - DNA, 25 bp, Mus musculus
agcagttcgggcaaatgacattaac

SEQ ID NO: 169310 - DNA, 25 bp, Mus musculus
agcagttcgggctaatgacattaac

SEQ ID NO: 169311 - DNA, 25 bp, Mus musculus
agcagttctactacaggtcctattt

SEQ ID NO: 169312 - DNA, 25 bp, Mus musculus
agcagttctacttcaggtcctattt

SEQ ID NO: 169313 - DNA, 25 bp, Mus musculus
agcagttctcaaactgcatggcaga

SEQ ID NO: 169314 - DNA, 25 bp, Mus musculus
agcagttctcaatctgcatggcaga

SEQ ID NO: 169315 - DNA, 25 bp, Mus musculus
agcagttctcccatgcgcagagaga

SEQ ID NO: 169316 - DNA, 25 bp, Mus musculus
agcagttctcccttgcgcagagaga

SEQ ID NO: 169317 - DNA, 25 bp, Mus musculus
agcagttctgcccatttaaatgtga

SEQ ID NO: 169318 - DNA, 25 bp, Mus musculus
agcagttctgccgatttaaatgtga

SEQ ID NO: 169319 - DNA, 25 bp, Mus musculus
agcagttctggcatgtttgcggcag

SEQ ID NO: 169320 - DNA, 25 bp, Mus musculus
agcagttctggcttgtttgcggcag

SEQ ID NO: 169321 - DNA, 25 bp, Mus musculus
agcagttctgggactggccaagcca

SEQ ID NO: 169322 - DNA, 25 bp, Mus musculus
agcagttctgggtctggccaagcca

SEQ ID NO: 169323 - DNA, 25 bp, Mus musculus
agcagttctgtcaagtctttttctc

SEQ ID NO: 169324 - DNA, 25 bp, Mus musculus
agcagttctgtctagtctttttctc

SEQ ID NO: 169325 - DNA, 25 bp, Mus musculus
agcagttcttcactagctatgcaga

SEQ ID NO: 169326 - DNA, 25 bp, Mus musculus
agcagttcttcagtagctatgcaga

SEQ ID NO: 169327 - DNA, 25 bp, Mus musculus
agcagttcttcgcaccagggacacg

SEQ ID NO: 169328 - DNA, 25 bp, Mus musculus
agcagttcttcggaccagggacacg

SEQ ID NO: 169329 - DNA, 25 bp, Mus musculus
agcagttctttccatgtcaactttc

SEQ ID NO: 169330 - DNA, 25 bp, Mus musculus
agcagttctttcgatgtcaactttc

SEQ ID NO: 169331 - DNA, 25 bp, Mus musculus
agcagttgaataacacacttagcag

SEQ ID NO: 169332 - DNA, 25 bp, Mus musculus
agcagttgaatatcacacttagcag

SEQ ID NO: 169333 - DNA, 25 bp, Mus musculus
agcagttgacagaaacagcccctct

SEQ ID NO: 169334 - DNA, 25 bp, Mus musculus
agcagttgacagtaacagcccctct

SEQ ID NO: 169335 - DNA, 25 bp, Mus musculus
agcagttgagagcacatgttcatat

SEQ ID NO: 169336 - DNA, 25 bp, Mus musculus
agcagttgagaggacatgttcatat

SEQ ID NO: 169337 - DNA, 25 bp, Mus musculus
agcagttgatgcctccctactagga

SEQ ID NO: 169338 - DNA, 25 bp, Mus musculus
agcagttgatgcgtccctactagga

SEQ ID NO: 169339 - DNA, 25 bp, Mus musculus
agcagttgatggctggtttctgttt

SEQ ID NO: 169340 - DNA, 25 bp, Mus musculus
agcagttgatgggtggtttctgttt

SEQ ID NO: 169341 - DNA, 25 bp, Mus musculus
agcagttgcactagagaatcctttc

SEQ ID NO: 169342 - DNA, 25 bp, Mus musculus
agcagttgcacttgagaatcctttc

SEQ ID NO: 169343 - DNA, 25 bp, Mus musculus
agcagttgccacagacaggatcctg

SEQ ID NO: 169344 - DNA, 25 bp, Mus musculus
agcagttgccactgacaggatcctg

SEQ ID NO: 169345 - DNA, 25 bp, Mus musculus
agcagttgcgccctgattgcgatgc

SEQ ID NO: 169346 - DNA, 25 bp, Mus musculus
agcagttgcgccgtgattgcgatgc

SEQ ID NO: 169347 - DNA, 25 bp, Mus musculus
agcagttgcgtgacatgggcatcca

SEQ ID NO: 169348 - DNA, 25 bp, Mus musculus
agcagttgcgtgtcatgggcatcca

SEQ ID NO: 169349 - DNA, 25 bp, Mus musculus
agcagttgctacaaagcctagcgcc

SEQ ID NO: 169350 - DNA, 25 bp, Mus musculus
agcagttgctactaagcctagcgcc

SEQ ID NO: 169351 - DNA, 25 bp, Mus musculus
agcagttgctgcacatgcctagggc

SEQ ID NO: 169352 - DNA, 25 bp, Mus musculus
agcagttgctgctcatgcctagggc

SEQ ID NO: 169353 - DNA, 25 bp, Mus musculus
agcagttgctgtcacaatgccccgc

SEQ ID NO: 169354 - DNA, 25 bp, Mus musculus
agcagttgctgtgacaatgccccgc

SEQ ID NO: 169355 - DNA, 25 bp, Mus musculus
agcagttgcttgacagggaagcatg

SEQ ID NO: 169356 - DNA, 25 bp, Mus musculus
agcagttgcttgtcagggaagcatg

SEQ ID NO: 169357 - DNA, 25 bp, Mus musculus
agcagttggaaaatattagcttaac

SEQ ID NO: 169358 - DNA, 25 bp, Mus musculus
agcagttggaaattattagcttaac

SEQ ID NO: 169359 - DNA, 25 bp, Mus musculus
agcagttggaagagagcgcgctctc

SEQ ID NO: 169360 - DNA, 25 bp, Mus musculus
agcagttggaagtgagcgcgctctc

SEQ ID NO: 169361 - DNA, 25 bp, Mus musculus
agcagttggcagcttattcccgtca

SEQ ID NO: 169362 - DNA, 25 bp, Mus musculus
agcagttggcaggttattcccgtca

SEQ ID NO: 169363 - DNA, 25 bp, Mus musculus
agcagttggcatctgacggctgtca

SEQ ID NO: 169364 - DNA, 25 bp, Mus musculus
agcagttggcatgtgacggctgtca

SEQ ID NO: 169365 - DNA, 25 bp, Mus musculus
agcagttgggacaagcctttgatca

SEQ ID NO: 169366 - DNA, 25 bp, Mus musculus
agcagttgggactagcctttgatca

SEQ ID NO: 169367 - DNA, 25 bp, Mus musculus
agcagttggtgtagatgtcttgtca

SEQ ID NO: 169368 - DNA, 25 bp, Mus musculus
agcagttggtgttgatgtcttgtca

SEQ ID NO: 169369 - DNA, 25 bp, Mus musculus
agcagttgtttgctcctccaggaag

SEQ ID NO: 169370 - DNA, 25 bp, Mus musculus
agcagttgtttggtcctccaggaag

SEQ ID NO: 169371 - DNA, 25 bp, Mus musculus
agcagtttagcaattcctagccaat

SEQ ID NO: 169372 - DNA, 25 bp, Mus musculus
agcagtttagcatttcctagccaat

SEQ ID NO: 169373 - DNA, 25 bp, Mus musculus
agcagtttcaggatcacagtttgct

SEQ ID NO: 169374 - DNA, 25 bp, Mus musculus
agcagtttcaggttcacagtttgct

SEQ ID NO: 169375 - DNA, 25 bp, Mus musculus
agcagtttccaactgccagcaactg

SEQ ID NO: 169376 - DNA, 25 bp, Mus musculus
agcagtttccaagtgccagcaactg

SEQ ID NO: 169377 - DNA, 25 bp, Mus musculus
agcagtttcccaccagcacaacaga

SEQ ID NO: 169378 - DNA, 25 bp, Mus musculus
agcagtttcccagcagcacaacaga

SEQ ID NO: 169379 - DNA, 25 bp, Mus musculus
agcagtttctacatcagttctaaga

SEQ ID NO: 169380 - DNA, 25 bp, Mus musculus
agcagtttctacttcagttctaaga

SEQ ID NO: 169381 - DNA, 25 bp, Mus musculus
agcagtttctagactactttaagac

SEQ ID NO: 169382 - DNA, 25 bp, Mus musculus
agcagtttctagtctactttaagac

SEQ ID NO: 169383 - DNA, 25 bp, Mus musculus
agcagtttctgcaataatatgaccc

SEQ ID NO: 169384 - DNA, 25 bp, Mus musculus
agcagtttctgctataatatgaccc

SEQ ID NO: 169385 - DNA, 25 bp, Mus musculus
agcagtttgataactccttgttaca

SEQ ID NO: 169386 - DNA, 25 bp, Mus musculus
agcagtttgatatctccttgttaca

SEQ ID NO: 169387 - DNA, 25 bp, Mus musculus
agcagtttgcagcacatgcttcccc

SEQ ID NO: 169388 - DNA, 25 bp, Mus musculus
agcagtttgcaggacatgcttcccc

SEQ ID NO: 169389 - DNA, 25 bp, Mus musculus
agcagtttgctcagggatcccatga

SEQ ID NO: 169390 - DNA, 25 bp, Mus musculus
agcagtttgctctgggatcccatga

SEQ ID NO: 169391 - DNA, 25 bp, Mus musculus
agcagtttgcttcttgtgattgaac

SEQ ID NO: 169392 - DNA, 25 bp, Mus musculus
agcagtttgcttgttgtgattgaac

SEQ ID NO: 169393 - DNA, 25 bp, Mus musculus
agcagtttggagatgtggacacagc

SEQ ID NO: 169394 - DNA, 25 bp, Mus musculus
agcagtttggagttgtggacacagc

SEQ ID NO: 169395 - DNA, 25 bp, Mus musculus
agcagtttggcgaatcgggctgttc

SEQ ID NO: 169396 - DNA, 25 bp, Mus musculus
agcagtttggcgtatcgggctgttc

SEQ ID NO: 169397 - DNA, 25 bp, Mus musculus
agcagtttgtatatgacctacattc

SEQ ID NO: 169398 - DNA, 25 bp, Mus musculus
agcagtttgtatttgacctacattc

SEQ ID NO: 169399 - DNA, 25 bp, Mus musculus
agcagtttgtgcagcagtcgcacgc

SEQ ID NO: 169400 - DNA, 25 bp, Mus musculus
agcagtttgtgctgcagtcgcacgc

SEQ ID NO: 169401 - DNA, 25 bp, Mus musculus
agcagttttaccctgacctcattag

SEQ ID NO: 169402 - DNA, 25 bp, Mus musculus
agcagttttaccgtgacctcattag

SEQ ID NO: 169403 - DNA, 25 bp, Mus musculus
agcagttttcatattcatcttttac

SEQ ID NO: 169404 - DNA, 25 bp, Mus musculus
agcagttttcattttcatcttttac

SEQ ID NO: 169405 - DNA, 25 bp, Mus musculus
agcagttttgctactgagtccagga

SEQ ID NO: 169406 - DNA, 25 bp, Mus musculus
agcagttttgcttctgagtccagga

SEQ ID NO: 169407 - DNA, 25 bp, Mus musculus
agcataaaaaccaccctcttcaatt

SEQ ID NO: 169408 - DNA, 25 bp, Mus musculus
agcataaaaacctccctcttcaatt

SEQ ID NO: 169409 - DNA, 25 bp, Mus musculus
agcataaagagcactgcctccaagt

SEQ ID NO: 169410 - DNA, 25 bp, Mus musculus
agcataaagagctctgcctccaagt

SEQ ID NO: 169411 - DNA, 25 bp, Mus musculus
agcataaatgatccaaacctctctg

SEQ ID NO: 169412 - DNA, 25 bp, Mus musculus
agcataaatgatgcaaacctctctg

SEQ ID NO: 169413 - DNA, 25 bp, Mus musculus
agcataaattaacctcttacattgg

SEQ ID NO: 169414 - DNA, 25 bp, Mus musculus
agcataaattaagctcttacattgg

SEQ ID NO: 169415 - DNA, 25 bp, Mus musculus
agcataacagatagtatctaacttt

SEQ ID NO: 169416 - DNA, 25 bp, Mus musculus
agcataacagattgtatctaacttt

SEQ ID NO: 169417 - DNA, 25 bp, Mus musculus
agcataacccaaagcctcaggcata

SEQ ID NO: 169418 - DNA, 25 bp, Mus musculus
agcataacccaatgcctcaggcata

SEQ ID NO: 169419 - DNA, 25 bp, Mus musculus
agcataaccgtcactggtggcacat

SEQ ID NO: 169420 - DNA, 25 bp, Mus musculus
agcataaccgtctctggtggcacat

SEQ ID NO: 169421 - DNA, 25 bp, Mus musculus
agcataactatgctgcccgttttcc

SEQ ID NO: 169422 - DNA, 25 bp, Mus musculus
agcataactatggtgcccgttttcc

SEQ ID NO: 169423 - DNA, 25 bp, Mus musculus
agcataactcatatacctgtatact

SEQ ID NO: 169424 - DNA, 25 bp, Mus musculus
agcataactcatttacctgtatact

SEQ ID NO: 169425 - DNA, 25 bp, Mus musculus
agcataagaacaaccagcctcgtct

SEQ ID NO: 169426 - DNA, 25 bp, Mus musculus
agcataagaacatccagcctcgtct

SEQ ID NO: 169427 - DNA, 25 bp, Mus musculus
agcataagataacaaagccgctttg

SEQ ID NO: 169428 - DNA, 25 bp, Mus musculus
agcataagataagaaagccgctttg

SEQ ID NO: 169429 - DNA, 25 bp, Mus musculus
agcataagccaccatcatgatcctg

SEQ ID NO: 169430 - DNA, 25 bp, Mus musculus
agcataagccacgatcatgatcctg

SEQ ID NO: 169431 - DNA, 25 bp, Mus musculus
agcataagctgtcgctaccatttat

SEQ ID NO: 169432 - DNA, 25 bp, Mus musculus
agcataagctgtggctaccatttat

SEQ ID NO: 169433 - DNA, 25 bp, Mus musculus
agcataaggatcacgaatccccggt

SEQ ID NO: 169434 - DNA, 25 bp, Mus musculus
agcataaggatctcgaatccccggt

SEQ ID NO: 169435 - DNA, 25 bp, Mus musculus
agcataataatacaacgactattct

SEQ ID NO: 169436 - DNA, 25 bp, Mus musculus
agcataataatagaacgactattct

SEQ ID NO: 169437 - DNA, 25 bp, Mus musculus
agcataatttctcgcttgtctcctc

SEQ ID NO: 169438 - DNA, 25 bp, Mus musculus
agcataatttctggcttgtctcctc

SEQ ID NO: 169439 - DNA, 25 bp, Mus musculus
agcatacaatgcactgacattccaa

SEQ ID NO: 169440 - DNA, 25 bp, Mus musculus
agcatacaatgctctgacattccaa

SEQ ID NO: 169441 - DNA, 25 bp, Mus musculus
agcatacacactatgttgccttgcc

SEQ ID NO: 169442 - DNA, 25 bp, Mus musculus
agcatacacactttgttgccttgcc

SEQ ID NO: 169443 - DNA, 25 bp, Mus musculus
agcatacaccataccaggagcacct

SEQ ID NO: 169444 - DNA, 25 bp, Mus musculus
agcatacaccattccaggagcacct

SEQ ID NO: 169445 - DNA, 25 bp, Mus musculus
agcatacacctgagcactgaaagag

SEQ ID NO: 169446 - DNA, 25 bp, Mus musculus
agcatacacctgtgcactgaaagag

SEQ ID NO: 169447 - DNA, 25 bp, Mus musculus
agcatacagagcagggtttcccagt

SEQ ID NO: 169448 - DNA, 25 bp, Mus musculus
agcatacagagctgggtttcccagt

SEQ ID NO: 169449 - DNA, 25 bp, Mus musculus
agcatacaggtcctggcatcttgtc

SEQ ID NO: 169450 - DNA, 25 bp, Mus musculus
agcatacaggtcgtggcatcttgtc

SEQ ID NO: 169451 - DNA, 25 bp, Mus musculus
agcatacatagcagcctgttgactg

SEQ ID NO: 169452 - DNA, 25 bp, Mus musculus
agcatacatagctgcctgttgactg

SEQ ID NO: 169453 - DNA, 25 bp, Mus musculus
agcatacatgtaagcttgttcactt

SEQ ID NO: 169454 - DNA, 25 bp, Mus musculus
agcatacatgtatgcttgttcactt

SEQ ID NO: 169455 - DNA, 25 bp, Mus musculus
agcataccaattacttctgtcatcc

SEQ ID NO: 169456 - DNA, 25 bp, Mus musculus
agcataccaatttcttctgtcatcc

SEQ ID NO: 169457 - DNA, 25 bp, Mus musculus
agcataccagagaatgatgctgtct

SEQ ID NO: 169458 - DNA, 25 bp, Mus musculus
agcataccagagtatgatgctgtct

SEQ ID NO: 169459 - DNA, 25 bp, Mus musculus
agcataccatccaaacagacagcaa

SEQ ID NO: 169460 - DNA, 25 bp, Mus musculus
agcataccatcctaacagacagcaa

SEQ ID NO: 169461 - DNA, 25 bp, Mus musculus
agcataccatcgcttgcttttctct

SEQ ID NO: 169462 - DNA, 25 bp, Mus musculus
agcataccatcggttgcttttctct

SEQ ID NO: 169463 - DNA, 25 bp, Mus musculus
agcataccccagctggttttttaca

SEQ ID NO: 169464 - DNA, 25 bp, Mus musculus
agcataccccaggtggttttttaca

SEQ ID NO: 169465 - DNA, 25 bp, Mus musculus
agcataccccggcaaatccctgtgg

SEQ ID NO: 169466 - DNA, 25 bp, Mus musculus
agcataccccgggaaatccctgtgg

SEQ ID NO: 169467 - DNA, 25 bp, Mus musculus
agcataccccttcctggaccatgag

SEQ ID NO: 169468 - DNA, 25 bp, Mus musculus
agcataccccttgctggaccatgag

SEQ ID NO: 169469 - DNA, 25 bp, Mus musculus
agcataccctttactgaggacctgg

SEQ ID NO: 169470 - DNA, 25 bp, Mus musculus
agcatacccttttctgaggacctgg

SEQ ID NO: 169471 - DNA, 25 bp, Mus musculus
agcatacctaccaggacaaactcaa

SEQ ID NO: 169472 - DNA, 25 bp, Mus musculus
agcatacctacctggacaaactcaa

SEQ ID NO: 169473 - DNA, 25 bp, Mus musculus
agcataccttggacaccaaccagaa

SEQ ID NO: 169474 - DNA, 25 bp, Mus musculus
agcataccttggtcaccaaccagaa

SEQ ID NO: 169475 - DNA, 25 bp, Mus musculus
agcatacggaaacatgatcctcctc

SEQ ID NO: 169476 - DNA, 25 bp, Mus musculus
agcatacggaaagatgatcctcctc

SEQ ID NO: 169477 - DNA, 25 bp, Mus musculus
agcatacgtttcctttctgccttgg

SEQ ID NO: 169478 - DNA, 25 bp, Mus musculus
agcatacgtttcgtttctgccttgg

SEQ ID NO: 169479 - DNA, 25 bp, Mus musculus
agcatactgggcaggcatcttctcc

SEQ ID NO: 169480 - DNA, 25 bp, Mus musculus
agcatactgggctggcatcttctcc

SEQ ID NO: 169481 - DNA, 25 bp, Mus musculus
agcatactggttcttaatccttatc

SEQ ID NO: 169482 - DNA, 25 bp, Mus musculus
agcatactggttgttaatccttatc

SEQ ID NO: 169483 - DNA, 25 bp, Mus musculus
agcatactgtgcatgggcctggcca

SEQ ID NO: 169484 - DNA, 25 bp, Mus musculus
agcatactgtgcttgggcctggcca

SEQ ID NO: 169485 - DNA, 25 bp, Mus musculus
agcatactgtttataccctgaacct

SEQ ID NO: 169486 - DNA, 25 bp, Mus musculus
agcatactgtttttaccctgaacct

SEQ ID NO: 169487 - DNA, 25 bp, Mus musculus
agcatacttcacacctgattctgag

SEQ ID NO: 169488 - DNA, 25 bp, Mus musculus
agcatacttcactcctgattctgag

SEQ ID NO: 169489 - DNA, 25 bp, Mus musculus
agcatacttgaacctgagcgcaccc

SEQ ID NO: 169490 - DNA, 25 bp, Mus musculus
agcatacttgaagctgagcgcaccc

SEQ ID NO: 169491 - DNA, 25 bp, Mus musculus
agcatacttgctcccaggacaacat

SEQ ID NO: 169492 - DNA, 25 bp, Mus musculus
agcatacttgctgccaggacaacat

SEQ ID NO: 169493 - DNA, 25 bp, Mus musculus
agcatacttggtcttggagcctcca

SEQ ID NO: 169494 - DNA, 25 bp, Mus musculus
agcatacttggtgttggagcctcca

SEQ ID NO: 169495 - DNA, 25 bp, Mus musculus
agcatacttgttccattgtctctgc

SEQ ID NO: 169496 - DNA, 25 bp, Mus musculus
agcatacttgttgcattgtctctgc

SEQ ID NO: 169497 - DNA, 25 bp, Mus musculus
agcatagagactcaacatttcgcca

SEQ ID NO: 169498 - DNA, 25 bp, Mus musculus
agcatagagactgaacatttcgcca

SEQ ID NO: 169499 - DNA, 25 bp, Mus musculus
agcatagagcttacgtgggcaataa

SEQ ID NO: 169500 - DNA, 25 bp, Mus musculus
agcatagagctttcgtgggcaataa

SEQ ID NO: 169501 - DNA, 25 bp, Mus musculus
agcatagatgttcacgtccgctgac

SEQ ID NO: 169502 - DNA, 25 bp, Mus musculus
agcatagatgttgacgtccgctgac

SEQ ID NO: 169503 - DNA, 25 bp, Mus musculus
agcatagcatcacggcgcaggacca

SEQ ID NO: 169504 - DNA, 25 bp, Mus musculus
agcatagcatcagggcgcaggacca

SEQ ID NO: 169505 - DNA, 25 bp, Mus musculus
agcatagcatggacacactgggaaa

SEQ ID NO: 169506 - DNA, 25 bp, Mus musculus
agcatagcatggtcacactgggaaa

SEQ ID NO: 169507 - DNA, 25 bp, Mus musculus
agcatagcccttcctctcaagtaaa

SEQ ID NO: 169508 - DNA, 25 bp, Mus musculus
agcatagcccttgctctcaagtaaa

SEQ ID NO: 169509 - DNA, 25 bp, Mus musculus
agcatagcctatcacttgccttcca

SEQ ID NO: 169510 - DNA, 25 bp, Mus musculus
agcatagcctatgacttgccttcca

SEQ ID NO: 169511 - DNA, 25 bp, Mus musculus
agcatagcgccaaacgttactttat

SEQ ID NO: 169512 - DNA, 25 bp, Mus musculus
agcatagcgccatacgttactttat

SEQ ID NO: 169513 - DNA, 25 bp, Mus musculus
agcatagctcgcagtgagcggccgc

SEQ ID NO: 169514 - DNA, 25 bp, Mus musculus
agcatagctcgctgtgagcggccgc

SEQ ID NO: 169515 - DNA, 25 bp, Mus musculus
agcatagctggtctcagccagggca

SEQ ID NO: 169516 - DNA, 25 bp, Mus musculus
agcatagctggtgtcagccagggca

SEQ ID NO: 169517 - DNA, 25 bp, Mus musculus
agcataggaaacctgtctccccgtg

SEQ ID NO: 169518 - DNA, 25 bp, Mus musculus
agcataggaaacgtgtctccccgtg

SEQ ID NO: 169519 - DNA, 25 bp, Mus musculus
agcataggaacaatccccaggctct

SEQ ID NO: 169520 - DNA, 25 bp, Mus musculus
agcataggaacattccccaggctct

SEQ ID NO: 169521 - DNA, 25 bp, Mus musculus
agcataggacaaaactcctgcccca

SEQ ID NO: 169522 - DNA, 25 bp, Mus musculus
agcataggacaatactcctgcccca

SEQ ID NO: 169523 - DNA, 25 bp, Mus musculus
agcataggcatccttgcacatctct

SEQ ID NO: 169524 - DNA, 25 bp, Mus musculus
agcataggcatcgttgcacatctct

SEQ ID NO: 169525 - DNA, 25 bp, Mus musculus
agcataggccccaggtgggctacat

SEQ ID NO: 169526 - DNA, 25 bp, Mus musculus
agcataggcccctggtgggctacat

SEQ ID NO: 169527 - DNA, 25 bp, Mus musculus
agcataggcctgactctttcgttaa

SEQ ID NO: 169528 - DNA, 25 bp, Mus musculus
agcataggcctgtctctttcgttaa

SEQ ID NO: 169529 - DNA, 25 bp, Mus musculus
agcatagggaagaacctctgccatg

SEQ ID NO: 169530 - DNA, 25 bp, Mus musculus
agcatagggaagtacctctgccatg

SEQ ID NO: 169531 - DNA, 25 bp, Mus musculus
agcataggtgttcttgctgcgtcac

SEQ ID NO: 169532 - DNA, 25 bp, Mus musculus
agcataggtgttgttgctgcgtcac

SEQ ID NO: 169533 - DNA, 25 bp, Mus musculus
agcataggttttctgctcctgcata

SEQ ID NO: 169534 - DNA, 25 bp, Mus musculus
agcataggttttgtgctcctgcata

SEQ ID NO: 169535 - DNA, 25 bp, Mus musculus
agcatagtaggaatctggcatcagt

SEQ ID NO: 169536 - DNA, 25 bp, Mus musculus
agcatagtaggattctggcatcagt

SEQ ID NO: 169537 - DNA, 25 bp, Mus musculus
agcatagttacaatttccatcttta

SEQ ID NO: 169538 - DNA, 25 bp, Mus musculus
agcatagttacattttccatcttta

SEQ ID NO: 169539 - DNA, 25 bp, Mus musculus
agcatagttggtacagcacagcaga

SEQ ID NO: 169540 - DNA, 25 bp, Mus musculus
agcatagttggttcagcacagcaga

SEQ ID NO: 169541 - DNA, 25 bp, Mus musculus
agcatatactgtctaccttctcttc

SEQ ID NO: 169542 - DNA, 25 bp, Mus musculus
agcatatactgtgtaccttctcttc

SEQ ID NO: 169543 - DNA, 25 bp, Mus musculus
agcatatagtgtccacctgtccctc

SEQ ID NO: 169544 - DNA, 25 bp, Mus musculus
agcatatagtgtgcacctgtccctc

SEQ ID NO: 169545 - DNA, 25 bp, Mus musculus
agcatatataagacctcagagcctg

SEQ ID NO: 169546 - DNA, 25 bp, Mus musculus
agcatatataagtcctcagagcctg

SEQ ID NO: 169547 - DNA, 25 bp, Mus musculus
agcatatattttcccacctacttaa

SEQ ID NO: 169548 - DNA, 25 bp, Mus musculus
agcatatattttgccacctacttaa

SEQ ID NO: 169549 - DNA, 25 bp, Mus musculus
agcatatcctttacatatcacaatt

SEQ ID NO: 169550 - DNA, 25 bp, Mus musculus
agcatatccttttcatatcacaatt

SEQ ID NO: 169551 - DNA, 25 bp, Mus musculus
agcatatgacctaagagtgacctct

SEQ ID NO: 169552 - DNA, 25 bp, Mus musculus
agcatatgaccttagagtgacctct

SEQ ID NO: 169553 - DNA, 25 bp, Mus musculus
agcatatgatacctcattccttcct

SEQ ID NO: 169554 - DNA, 25 bp, Mus musculus
agcatatgatacgtcattccttcct

SEQ ID NO: 169555 - DNA, 25 bp, Mus musculus
agcatatgatggaccttaccctggg

SEQ ID NO: 169556 - DNA, 25 bp, Mus musculus
agcatatgatggtccttaccctggg

SEQ ID NO: 169557 - DNA, 25 bp, Mus musculus
agcatatgatgtaactagcagtctt

SEQ ID NO: 169558 - DNA, 25 bp, Mus musculus
agcatatgatgttactagcagtctt

SEQ ID NO: 169559 - DNA, 25 bp, Mus musculus
agcatatgcacaagactgtcttaac

SEQ ID NO: 169560 - DNA, 25 bp, Mus musculus
agcatatgcacatgactgtcttaac

SEQ ID NO: 169561 - DNA, 25 bp, Mus musculus
agcatatgcccaaagaagaaccttt

SEQ ID NO: 169562 - DNA, 25 bp, Mus musculus
agcatatgcccatagaagaaccttt

SEQ ID NO: 169563 - DNA, 25 bp, Mus musculus
agcatatgccttaagttggttgggt

SEQ ID NO: 169564 - DNA, 25 bp, Mus musculus
agcatatgcctttagttggttgggt

SEQ ID NO: 169565 - DNA, 25 bp, Mus musculus
agcatatgcttaacccttgagccgg

SEQ ID NO: 169566 - DNA, 25 bp, Mus musculus
agcatatgcttatcccttgagccgg

SEQ ID NO: 169567 - DNA, 25 bp, Mus musculus
agcatatgggacaaaggcctcctgt

SEQ ID NO: 169568 - DNA, 25 bp, Mus musculus
agcatatgggactaaggcctcctgt

SEQ ID NO: 169569 - DNA, 25 bp, Mus musculus
agcatatgttccagatcagccttca

SEQ ID NO: 169570 - DNA, 25 bp, Mus musculus
agcatatgttcctgatcagccttca

SEQ ID NO: 169571 - DNA, 25 bp, Mus musculus
agcatattactgagtccttctgttg

SEQ ID NO: 169572 - DNA, 25 bp, Mus musculus
agcatattactgtgtccttctgttg

SEQ ID NO: 169573 - DNA, 25 bp, Mus musculus
agcatattcacaaaagcattacccc

SEQ ID NO: 169574 - DNA, 25 bp, Mus musculus
agcatattcacataagcattacccc

SEQ ID NO: 169575 - DNA, 25 bp, Mus musculus
agcatattcttgaattcccattctt

SEQ ID NO: 169576 - DNA, 25 bp, Mus musculus
agcatattcttgtattcccattctt

SEQ ID NO: 169577 - DNA, 25 bp, Mus musculus
agcatattgtgtactgagtgaatcc

SEQ ID NO: 169578 - DNA, 25 bp, Mus musculus
agcatattgtgttctgagtgaatcc

SEQ ID NO: 169579 - DNA, 25 bp, Mus musculus
agcatatttctaagctgcatctcag

SEQ ID NO: 169580 - DNA, 25 bp, Mus musculus
agcatatttctatgctgcatctcag

SEQ ID NO: 169581 - DNA, 25 bp, Mus musculus
agcatatttgctcggcttacagcta

SEQ ID NO: 169582 - DNA, 25 bp, Mus musculus
agcatatttgctgggcttacagcta

SEQ ID NO: 169583 - DNA, 25 bp, Mus musculus
agcatatttggcaggtgtatcttcc

SEQ ID NO: 169584 - DNA, 25 bp, Mus musculus
agcatatttggctggtgtatcttcc

SEQ ID NO: 169585 - DNA, 25 bp, Mus musculus
agcatcaaaagaccccgagaagaca

SEQ ID NO: 169586 - DNA, 25 bp, Mus musculus
agcatcaaaagagcccgagaagaca

SEQ ID NO: 169587 - DNA, 25 bp, Mus musculus
agcatcaaatgcctgcctggacacc

SEQ ID NO: 169588 - DNA, 25 bp, Mus musculus
agcatcaaatgcgtgcctggacacc

SEQ ID NO: 169589 - DNA, 25 bp, Mus musculus
agcatcaacaccagctggcctagta

SEQ ID NO: 169590 - DNA, 25 bp, Mus musculus
agcatcaacacctgctggcctagta

SEQ ID NO: 169591 - DNA, 25 bp, Mus musculus
agcatcaactccaaagccgtgtatt

SEQ ID NO: 169592 - DNA, 25 bp, Mus musculus
agcatcaactcctaagccgtgtatt

SEQ ID NO: 169593 - DNA, 25 bp, Mus musculus
agcatcaactggctagggctcgttg

SEQ ID NO: 169594 - DNA, 25 bp, Mus musculus
agcatcaactgggtagggctcgttg

SEQ ID NO: 169595 - DNA, 25 bp, Mus musculus
agcatcaacttaatgctgggagcaa

SEQ ID NO: 169596 - DNA, 25 bp, Mus musculus
agcatcaacttattgctgggagcaa

SEQ ID NO: 169597 - DNA, 25 bp, Mus musculus
agcatcaactttcaggatcctgctg

SEQ ID NO: 169598 - DNA, 25 bp, Mus musculus
agcatcaactttgaggatcctgctg

SEQ ID NO: 169599 - DNA, 25 bp, Mus musculus
agcatcaagctcacagtactccagg

SEQ ID NO: 169600 - DNA, 25 bp, Mus musculus
agcatcaagctctcagtactccagg

SEQ ID NO: 169601 - DNA, 25 bp, Mus musculus
agcatcaaggctacctaccgttttg

SEQ ID NO: 169602 - DNA, 25 bp, Mus musculus
agcatcaaggctactgtggtctctt

SEQ ID NO: 169603 - DNA, 25 bp, Mus musculus
agcatcaaggcttcctaccgttttg

SEQ ID NO: 169604 - DNA, 25 bp, Mus musculus
agcatcaaggcttctgtggtctctt

SEQ ID NO: 169605 - DNA, 25 bp, Mus musculus
agcatcaaggttcctgtatctgacc

SEQ ID NO: 169606 - DNA, 25 bp, Mus musculus
agcatcaaggttgctgtatctgacc

SEQ ID NO: 169607 - DNA, 25 bp, Mus musculus
agcatcaccactaagctgaattgaa

SEQ ID NO: 169608 - DNA, 25 bp, Mus musculus
agcatcaccacttagctgaattgaa

SEQ ID NO: 169609 - DNA, 25 bp, Mus musculus
agcatcaccatactctccatctaat

SEQ ID NO: 169610 - DNA, 25 bp, Mus musculus
agcatcaccatagtctccatctaat

SEQ ID NO: 169611 - DNA, 25 bp, Mus musculus
agcatcacccacatgggcatacgtg

SEQ ID NO: 169612 - DNA, 25 bp, Mus musculus
agcatcacccacttgggcatacgtg

SEQ ID NO: 169613 - DNA, 25 bp, Mus musculus
agcatcacccagaaagtctttagat

SEQ ID NO: 169614 - DNA, 25 bp, Mus musculus
agcatcacccagtaagtctttagat

SEQ ID NO: 169615 - DNA, 25 bp, Mus musculus
agcatcacctttaaactcagtcttt

SEQ ID NO: 169616 - DNA, 25 bp, Mus musculus
agcatcaccttttaactcagtcttt

SEQ ID NO: 169617 - DNA, 25 bp, Mus musculus
agcatcacgtccactgacagattgg

SEQ ID NO: 169618 - DNA, 25 bp, Mus musculus
agcatcacgtcctctgacagattgg

SEQ ID NO: 169619 - DNA, 25 bp, Mus musculus
agcatcactgaacagagcgccttgt

SEQ ID NO: 169620 - DNA, 25 bp, Mus musculus
agcatcactgaagagagcgccttgt

SEQ ID NO: 169621 - DNA, 25 bp, Mus musculus
agcatcactggacaacagcctggca

SEQ ID NO: 169622 - DNA, 25 bp, Mus musculus
agcatcactggagaacagcctggca

SEQ ID NO: 169623 - DNA, 25 bp, Mus musculus
agcatcactggtcgttacctggcat

SEQ ID NO: 169624 - DNA, 25 bp, Mus musculus
agcatcactggtggttacctggcat

SEQ ID NO: 169625 - DNA, 25 bp, Mus musculus
agcatcagaaacagtcggctcctgc

SEQ ID NO: 169626 - DNA, 25 bp, Mus musculus
agcatcagaaactgtcggctcctgc

SEQ ID NO: 169627 - DNA, 25 bp, Mus musculus
agcatcagagaaatcccggggatcc

SEQ ID NO: 169628 - DNA, 25 bp, Mus musculus
agcatcagagaattcccggggatcc

SEQ ID NO: 169629 - DNA, 25 bp, Mus musculus
agcatcagaggccacccaggcggta

SEQ ID NO: 169630 - DNA, 25 bp, Mus musculus
agcatcagaggcgacccaggcggta

SEQ ID NO: 169631 - DNA, 25 bp, Mus musculus
agcatcagagggagcattctagaga

SEQ ID NO: 169632 - DNA, 25 bp, Mus musculus
agcatcagagggtgcattctagaga

SEQ ID NO: 169633 - DNA, 25 bp, Mus musculus
agcatcagcatcacttccaaattat

SEQ ID NO: 169634 - DNA, 25 bp, Mus musculus
agcatcagcatccagctgcttgctg

SEQ ID NO: 169635 - DNA, 25 bp, Mus musculus
agcatcagcatcgagctgcttgctg

SEQ ID NO: 169636 - DNA, 25 bp, Mus musculus
agcatcagcatctcttccaaattat

SEQ ID NO: 169637 - DNA, 25 bp, Mus musculus
agcatcagcctaacacttcctacgt

SEQ ID NO: 169638 - DNA, 25 bp, Mus musculus
agcatcagcctatcacttcctacgt

SEQ ID NO: 169639 - DNA, 25 bp, Mus musculus
agcatcaggattccggattatctca

SEQ ID NO: 169640 - DNA, 25 bp, Mus musculus
agcatcaggattgcggattatctca

SEQ ID NO: 169641 - DNA, 25 bp, Mus musculus
agcatcaggccacgtgattctcact

SEQ ID NO: 169642 - DNA, 25 bp, Mus musculus
agcatcaggccaggtgattctcact

SEQ ID NO: 169643 - DNA, 25 bp, Mus musculus
agcatcaggctgcacaatggacaag

SEQ ID NO: 169644 - DNA, 25 bp, Mus musculus
agcatcaggctggacaatggacaag

SEQ ID NO: 169645 - DNA, 25 bp, Mus musculus
agcatcagggacctaaggcttgaat

SEQ ID NO: 169646 - DNA, 25 bp, Mus musculus
agcatcagggacgtaaggcttgaat

SEQ ID NO: 169647 - DNA, 25 bp, Mus musculus
agcatcaggtgcagtgccatggaca

SEQ ID NO: 169648 - DNA, 25 bp, Mus musculus
agcatcaggtgctgtgccatggaca

SEQ ID NO: 169649 - DNA, 25 bp, Mus musculus
agcatcaggtggatccagaggccaa

SEQ ID NO: 169650 - DNA, 25 bp, Mus musculus
agcatcaggtggttccagaggccaa

SEQ ID NO: 169651 - DNA, 25 bp, Mus musculus
agcatcagtaccagctgccttaaaa

SEQ ID NO: 169652 - DNA, 25 bp, Mus musculus
agcatcagtaccatctccagggcaa

SEQ ID NO: 169653 - DNA, 25 bp, Mus musculus
agcatcagtacctgctgccttaaaa

SEQ ID NO: 169654 - DNA, 25 bp, Mus musculus
agcatcagtaccttctccagggcaa

SEQ ID NO: 169655 - DNA, 25 bp, Mus musculus
agcatcagtgaccttgacgaccaca

SEQ ID NO: 169656 - DNA, 25 bp, Mus musculus
agcatcagtgacgttgacgaccaca

SEQ ID NO: 169657 - DNA, 25 bp, Mus musculus
agcatcagtggcctcgtcaagagca

SEQ ID NO: 169658 - DNA, 25 bp, Mus musculus
agcatcagtggcgtcgtcaagagca

SEQ ID NO: 169659 - DNA, 25 bp, Mus musculus
agcatcataaagagcactacacagt

SEQ ID NO: 169660 - DNA, 25 bp, Mus musculus
agcatcataaagtgcactacacagt

SEQ ID NO: 169661 - DNA, 25 bp, Mus musculus
agcatcatacatctttctgtcaatg

SEQ ID NO: 169662 - DNA, 25 bp, Mus musculus
agcatcatacatgtttctgtcaatg

SEQ ID NO: 169663 - DNA, 25 bp, Mus musculus
agcatcatcattccggtgtgcctga

SEQ ID NO: 169664 - DNA, 25 bp, Mus musculus
agcatcatcattgcggtgtgcctga

SEQ ID NO: 169665 - DNA, 25 bp, Mus musculus
agcatcatcgtcattccttgaagta

SEQ ID NO: 169666 - DNA, 25 bp, Mus musculus
agcatcatcgtctttccttgaagta

SEQ ID NO: 169667 - DNA, 25 bp, Mus musculus
agcatcatctataaacctcttccag

SEQ ID NO: 169668 - DNA, 25 bp, Mus musculus
agcatcatctattaacctcttccag

SEQ ID NO: 169669 - DNA, 25 bp, Mus musculus
agcatcatgcacatgaaccacacag

SEQ ID NO: 169670 - DNA, 25 bp, Mus musculus
agcatcatgcacttgaaccacacag

SEQ ID NO: 169671 - DNA, 25 bp, Mus musculus
agcatcatgctaactctgaacgaac

SEQ ID NO: 169672 - DNA, 25 bp, Mus musculus
agcatcatgctatctctgaacgaac

SEQ ID NO: 169673 - DNA, 25 bp, Mus musculus
agcatcatgtctatggaaccacttg

SEQ ID NO: 169674 - DNA, 25 bp, Mus musculus
agcatcatgtctttggaaccacttg

SEQ ID NO: 169675 - DNA, 25 bp, Mus musculus
agcatcatgtgtctacttctcatag

SEQ ID NO: 169676 - DNA, 25 bp, Mus musculus
agcatcatgtgtgtacttctcatag

SEQ ID NO: 169677 - DNA, 25 bp, Mus musculus
agcatcatgtttcactggagccgga

SEQ ID NO: 169678 - DNA, 25 bp, Mus musculus
agcatcatgtttgactggagccgga

SEQ ID NO: 169679 - DNA, 25 bp, Mus musculus
agcatcattagtccttcatggcctc

SEQ ID NO: 169680 - DNA, 25 bp, Mus musculus
agcatcattagtgcttcatggcctc

SEQ ID NO: 169681 - DNA, 25 bp, Mus musculus
agcatcatttccaacatggtctgtt

SEQ ID NO: 169682 - DNA, 25 bp, Mus musculus
agcatcatttcctacatggtctgtt

SEQ ID NO: 169683 - DNA, 25 bp, Mus musculus
agcatccaacaaccagctgggaaga

SEQ ID NO: 169684 - DNA, 25 bp, Mus musculus
agcatccaacaagcagctgggaaga

SEQ ID NO: 169685 - DNA, 25 bp, Mus musculus
agcatccaaggaacactgcctgtgt

SEQ ID NO: 169686 - DNA, 25 bp, Mus musculus
agcatccaaggatcactgcctgtgt

SEQ ID NO: 169687 - DNA, 25 bp, Mus musculus
agcatccacatgatcctggttgctt

SEQ ID NO: 169688 - DNA, 25 bp, Mus musculus
agcatccacatgttcctggttgctt

SEQ ID NO: 169689 - DNA, 25 bp, Mus musculus
agcatccacgtgatggctcagccag

SEQ ID NO: 169690 - DNA, 25 bp, Mus musculus
agcatccacgtgttggctcagccag

SEQ ID NO: 169691 - DNA, 25 bp, Mus musculus
agcatccactcgcaaactggttctt

SEQ ID NO: 169692 - DNA, 25 bp, Mus musculus
agcatccactcggaaactggttctt

SEQ ID NO: 169693 - DNA, 25 bp, Mus musculus
agcatccactgtcttcaagggtgtg

SEQ ID NO: 169694 - DNA, 25 bp, Mus musculus
agcatccactgtgttcaagggtgtg

SEQ ID NO: 169695 - DNA, 25 bp, Mus musculus
agcatccactttaggagcactctca

SEQ ID NO: 169696 - DNA, 25 bp, Mus musculus
agcatccacttttggagcactctca

SEQ ID NO: 169697 - DNA, 25 bp, Mus musculus
agcatccagaaaccccgagcctgaa

SEQ ID NO: 169698 - DNA, 25 bp, Mus musculus
agcatccagaaagcccgagcctgaa

SEQ ID NO: 169699 - DNA, 25 bp, Mus musculus
agcatccagagtactgtgcctaaga

SEQ ID NO: 169700 - DNA, 25 bp, Mus musculus
agcatccagagttctgtgcctaaga

SEQ ID NO: 169701 - DNA, 25 bp, Mus musculus
agcatccagcacagccatctggaag

SEQ ID NO: 169702 - DNA, 25 bp, Mus musculus
agcatccagcactgccatctggaag

SEQ ID NO: 169703 - DNA, 25 bp, Mus musculus
agcatccagcagatcctgtttagct

SEQ ID NO: 169704 - DNA, 25 bp, Mus musculus
agcatccagcagttcctgtttagct

SEQ ID NO: 169705 - DNA, 25 bp, Mus musculus
agcatccaggctactgaggtttctg

SEQ ID NO: 169706 - DNA, 25 bp, Mus musculus
agcatccaggcttctgaggtttctg

SEQ ID NO: 169707 - DNA, 25 bp, Mus musculus
agcatccagtgacaagaggctgtac

SEQ ID NO: 169708 - DNA, 25 bp, Mus musculus
agcatccagtgagaagaggctgtac

SEQ ID NO: 169709 - DNA, 25 bp, Mus musculus
agcatccagtgcatttctaccgtct

SEQ ID NO: 169710 - DNA, 25 bp, Mus musculus
agcatccagtgcttttctaccgtct

SEQ ID NO: 169711 - DNA, 25 bp, Mus musculus
agcatccatacacgcctcagtggtc

SEQ ID NO: 169712 - DNA, 25 bp, Mus musculus
agcatccatacaggcctcagtggtc

SEQ ID NO: 169713 - DNA, 25 bp, Mus musculus
agcatccatatccatcgacttttaa

SEQ ID NO: 169714 - DNA, 25 bp, Mus musculus
agcatccatatcgatcgacttttaa

SEQ ID NO: 169715 - DNA, 25 bp, Mus musculus
agcatccatctaactcaagttaagt

SEQ ID NO: 169716 - DNA, 25 bp, Mus musculus
agcatccatctatctcaagttaagt

SEQ ID NO: 169717 - DNA, 25 bp, Mus musculus
agcatccatgtcagcattgcaaacc

SEQ ID NO: 169718 - DNA, 25 bp, Mus musculus
agcatccatgtctgcattgcaaacc

SEQ ID NO: 169719 - DNA, 25 bp, Mus musculus
agcatcccaaagcttgagtctggct

SEQ ID NO: 169720 - DNA, 25 bp, Mus musculus
agcatcccaaaggttgagtctggct

SEQ ID NO: 169721 - DNA, 25 bp, Mus musculus
agcatcccagaaaactgtttgtcta

SEQ ID NO: 169722 - DNA, 25 bp, Mus musculus
agcatcccagaatactgtttgtcta

SEQ ID NO: 169723 - DNA, 25 bp, Mus musculus
agcatcccaggcacgaagggcagac

SEQ ID NO: 169724 - DNA, 25 bp, Mus musculus
agcatcccaggctcgaagggcagac

SEQ ID NO: 169725 - DNA, 25 bp, Mus musculus
agcatcccatatccagttgctgggt

SEQ ID NO: 169726 - DNA, 25 bp, Mus musculus
agcatcccatatgcagttgctgggt

SEQ ID NO: 169727 - DNA, 25 bp, Mus musculus
agcatccccaggctgagatccaggc

SEQ ID NO: 169728 - DNA, 25 bp, Mus musculus
agcatccccagggtgagatccaggc

SEQ ID NO: 169729 - DNA, 25 bp, Mus musculus
agcatcccccagaacaagaaggtga

SEQ ID NO: 169730 - DNA, 25 bp, Mus musculus
agcatcccccagtacaagaaggtga

SEQ ID NO: 169731 - DNA, 25 bp, Mus musculus
agcatccccgcacctcggatgaagg

SEQ ID NO: 169732 - DNA, 25 bp, Mus musculus
agcatccccgcagctcggatgaagg

SEQ ID NO: 169733 - DNA, 25 bp, Mus musculus
agcatcccgtgacctgatgggctta

SEQ ID NO: 169734 - DNA, 25 bp, Mus musculus
agcatcccgtgagctgatgggctta

SEQ ID NO: 169735 - DNA, 25 bp, Mus musculus
agcatccctaaaccagagcgatctg

SEQ ID NO: 169736 - DNA, 25 bp, Mus musculus
agcatccctaaagcagagcgatctg

SEQ ID NO: 169737 - DNA, 25 bp, Mus musculus
agcatccctacaagatgtgttccac

SEQ ID NO: 169738 - DNA, 25 bp, Mus musculus
agcatccctacatgatgtgttccac

SEQ ID NO: 169739 - DNA, 25 bp, Mus musculus
agcatccctaccatcaacatggaga

SEQ ID NO: 169740 - DNA, 25 bp, Mus musculus
agcatccctaccttcaacatggaga

SEQ ID NO: 169741 - DNA, 25 bp, Mus musculus
agcatccctcatcgaggctcataac

SEQ ID NO: 169742 - DNA, 25 bp, Mus musculus
agcatccctcatggaggctcataac

SEQ ID NO: 169743 - DNA, 25 bp, Mus musculus
agcatccctctcagatggagtttga

SEQ ID NO: 169744 - DNA, 25 bp, Mus musculus
agcatccctctctgatggagtttga

SEQ ID NO: 169745 - DNA, 25 bp, Mus musculus
agcatccctcttcggtagttcactg

SEQ ID NO: 169746 - DNA, 25 bp, Mus musculus
agcatccctcttgggtagttcactg

SEQ ID NO: 169747 - DNA, 25 bp, Mus musculus
agcatccctggaatgcagagttctg

SEQ ID NO: 169748 - DNA, 25 bp, Mus musculus
agcatccctggattgcagagttctg

SEQ ID NO: 169749 - DNA, 25 bp, Mus musculus
agcatccctggcataatccataggt

SEQ ID NO: 169750 - DNA, 25 bp, Mus musculus
agcatccctggcttaatccataggt

SEQ ID NO: 169751 - DNA, 25 bp, Mus musculus
agcatccctgtgacggtctaaaaag

SEQ ID NO: 169752 - DNA, 25 bp, Mus musculus
agcatccctgtgtcggtctaaaaag

SEQ ID NO: 169753 - DNA, 25 bp, Mus musculus
agcatcccttcgctcaatggatttg

SEQ ID NO: 169754 - DNA, 25 bp, Mus musculus
agcatcccttcggtcaatggatttg

SEQ ID NO: 169755 - DNA, 25 bp, Mus musculus
agcatccgagacaacagcgttcaga

SEQ ID NO: 169756 - DNA, 25 bp, Mus musculus
agcatccgagactacagcgttcaga

SEQ ID NO: 169757 - DNA, 25 bp, Mus musculus
agcatccgagcaccatcagcagcga

SEQ ID NO: 169758 - DNA, 25 bp, Mus musculus
agcatccgagcagcatcagcagcga

SEQ ID NO: 169759 - DNA, 25 bp, Mus musculus
agcatccgctcgagatcctgtgtgt

SEQ ID NO: 169760 - DNA, 25 bp, Mus musculus
agcatccgctcgtgatcctgtgtgt

SEQ ID NO: 169761 - DNA, 25 bp, Mus musculus
agcatccgggttatctcctccagga

SEQ ID NO: 169762 - DNA, 25 bp, Mus musculus
agcatccgggttttctcctccagga

SEQ ID NO: 169763 - DNA, 25 bp, Mus musculus
agcatccgtatacgttcggatcggg

SEQ ID NO: 169764 - DNA, 25 bp, Mus musculus
agcatccgtataggttcggatcggg

SEQ ID NO: 169765 - DNA, 25 bp, Mus musculus
agcatccgtctgaacatatgttgta

SEQ ID NO: 169766 - DNA, 25 bp, Mus musculus
agcatccgtctgtacatatgttgta

SEQ ID NO: 169767 - DNA, 25 bp, Mus musculus
agcatccgtgtaaggaggcttctga

SEQ ID NO: 169768 - DNA, 25 bp, Mus musculus
agcatccgtgtatggaggcttctga

SEQ ID NO: 169769 - DNA, 25 bp, Mus musculus
agcatcctaactaattcagcatcat

SEQ ID NO: 169770 - DNA, 25 bp, Mus musculus
agcatcctaacttattcagcatcat

SEQ ID NO: 169771 - DNA, 25 bp, Mus musculus
agcatcctactcaggagctgtcatc

SEQ ID NO: 169772 - DNA, 25 bp, Mus musculus
agcatcctactctggagctgtcatc

SEQ ID NO: 169773 - DNA, 25 bp, Mus musculus
agcatcctcaggactatgggaacca

SEQ ID NO: 169774 - DNA, 25 bp, Mus musculus
agcatcctcaggtctatgggaacca

SEQ ID NO: 169775 - DNA, 25 bp, Mus musculus
agcatcctcagtctggcagttcggg

SEQ ID NO: 169776 - DNA, 25 bp, Mus musculus
agcatcctcagtgtggcagttcggg

SEQ ID NO: 169777 - DNA, 25 bp, Mus musculus
agcatcctcctgatagaggcctaat

SEQ ID NO: 169778 - DNA, 25 bp, Mus musculus
agcatcctcctgttagaggcctaat

SEQ ID NO: 169779 - DNA, 25 bp, Mus musculus
agcatcctcgtacctgccttgtagt

SEQ ID NO: 169780 - DNA, 25 bp, Mus musculus
agcatcctcgtagctgccttgtagt

SEQ ID NO: 169781 - DNA, 25 bp, Mus musculus
agcatcctctcgcttcaactttttt

SEQ ID NO: 169782 - DNA, 25 bp, Mus musculus
agcatcctctcggttcaactttttt

SEQ ID NO: 169783 - DNA, 25 bp, Mus musculus
agcatcctctctaccgatcgataca

SEQ ID NO: 169784 - DNA, 25 bp, Mus musculus
agcatcctctcttccgatcgataca

SEQ ID NO: 169785 - DNA, 25 bp, Mus musculus
agcatcctctggatgatctcaccct

SEQ ID NO: 169786 - DNA, 25 bp, Mus musculus
agcatcctctggttgatctcaccct

SEQ ID NO: 169787 - DNA, 25 bp, Mus musculus
agcatcctctttcccaaagcaaagt

SEQ ID NO: 169788 - DNA, 25 bp, Mus musculus
agcatcctctttgccaaagcaaagt

SEQ ID NO: 169789 - DNA, 25 bp, Mus musculus
agcatcctgactcgcgtgaactatg

SEQ ID NO: 169790 - DNA, 25 bp, Mus musculus
agcatcctgactggcgtgaactatg

SEQ ID NO: 169791 - DNA, 25 bp, Mus musculus
agcatcctgatgcttgttatcacca

SEQ ID NO: 169792 - DNA, 25 bp, Mus musculus
agcatcctgatggttgttatcacca

SEQ ID NO: 169793 - DNA, 25 bp, Mus musculus
agcatcctgcctattcgacaagtag

SEQ ID NO: 169794 - DNA, 25 bp, Mus musculus
agcatcctgccttttcgacaagtag

SEQ ID NO: 169795 - DNA, 25 bp, Mus musculus
agcatcctgctacttcttgactatg

SEQ ID NO: 169796 - DNA, 25 bp, Mus musculus
agcatcctgctagttcttgactatg

SEQ ID NO: 169797 - DNA, 25 bp, Mus musculus
agcatcctgctcaatcactgttatt

SEQ ID NO: 169798 - DNA, 25 bp, Mus musculus
agcatcctgctctatcactgttatt

SEQ ID NO: 169799 - DNA, 25 bp, Mus musculus
agcatcctggaaaagtacggtggcc

SEQ ID NO: 169800 - DNA, 25 bp, Mus musculus
agcatcctggaatagtacggtggcc

SEQ ID NO: 169801 - DNA, 25 bp, Mus musculus
agcatcctggacacgttgagcaaca

SEQ ID NO: 169802 - DNA, 25 bp, Mus musculus
agcatcctggactcgttgagcaaca

SEQ ID NO: 169803 - DNA, 25 bp, Mus musculus
agcatcctggcacctgtactgggaa

SEQ ID NO: 169804 - DNA, 25 bp, Mus musculus
agcatcctggcagctgtactgggaa

SEQ ID NO: 169805 - DNA, 25 bp, Mus musculus
agcatcctgggaacttcttcttgaa

SEQ ID NO: 169806 - DNA, 25 bp, Mus musculus
agcatcctgggatcttcttcttgaa

SEQ ID NO: 169807 - DNA, 25 bp, Mus musculus
agcatcctggtcaggctgcaaaggg

SEQ ID NO: 169808 - DNA, 25 bp, Mus musculus
agcatcctggtctggctgcaaaggg

SEQ ID NO: 169809 - DNA, 25 bp, Mus musculus
agcatccttcagatcacggcttcat

SEQ ID NO: 169810 - DNA, 25 bp, Mus musculus
agcatccttcagttcacggcttcat

SEQ ID NO: 169811 - DNA, 25 bp, Mus musculus
agcatccttctcaaaacttgcctca

SEQ ID NO: 169812 - DNA, 25 bp, Mus musculus
agcatccttctctaaacttgcctca

SEQ ID NO: 169813 - DNA, 25 bp, Mus musculus
agcatccttctgaaattcccttttt

SEQ ID NO: 169814 - DNA, 25 bp, Mus musculus
agcatccttctgatggtccaaggga

SEQ ID NO: 169815 - DNA, 25 bp, Mus musculus
agcatccttctgtaattcccttttt

SEQ ID NO: 169816 - DNA, 25 bp, Mus musculus
agcatccttctgttggtccaaggga

SEQ ID NO: 169817 - DNA, 25 bp, Mus musculus
agcatccttgagactatgtagtata

SEQ ID NO: 169818 - DNA, 25 bp, Mus musculus
agcatccttgagactgctcagcaga

SEQ ID NO: 169819 - DNA, 25 bp, Mus musculus
agcatccttgagtctatgtagtata

SEQ ID NO: 169820 - DNA, 25 bp, Mus musculus
agcatccttgagtctgctcagcaga

SEQ ID NO: 169821 - DNA, 25 bp, Mus musculus
agcatccttggacaacagcctagaa

SEQ ID NO: 169822 - DNA, 25 bp, Mus musculus
agcatccttggagaacagcctagaa

SEQ ID NO: 169823 - DNA, 25 bp, Mus musculus
agcatccttggcagcagtcagtaaa

SEQ ID NO: 169824 - DNA, 25 bp, Mus musculus
agcatccttggctgcagtcagtaaa

SEQ ID NO: 169825 - DNA, 25 bp, Mus musculus
agcatccttgttcggtagttcaggg

SEQ ID NO: 169826 - DNA, 25 bp, Mus musculus
agcatccttgttgggtagttcaggg

SEQ ID NO: 169827 - DNA, 25 bp, Mus musculus
agcatcctttagagtctccaaccta

SEQ ID NO: 169828 - DNA, 25 bp, Mus musculus
agcatcctttagtgtctccaaccta

SEQ ID NO: 169829 - DNA, 25 bp, Mus musculus
agcatcgactacatgagcttcaatg

SEQ ID NO: 169830 - DNA, 25 bp, Mus musculus
agcatcgactacttgagcttcaatg

SEQ ID NO: 169831 - DNA, 25 bp, Mus musculus
agcatcgagatcctaggcctgtgat

SEQ ID NO: 169832 - DNA, 25 bp, Mus musculus
agcatcgagatcgtaggcctgtgat

SEQ ID NO: 169833 - DNA, 25 bp, Mus musculus
agcatcgagattaatgtccccgagg

SEQ ID NO: 169834 - DNA, 25 bp, Mus musculus
agcatcgagatttatgtccccgagg

SEQ ID NO: 169835 - DNA, 25 bp, Mus musculus
agcatcgagtgtcttctttgtcttc

SEQ ID NO: 169836 - DNA, 25 bp, Mus musculus
agcatcgagtgtgttctttgtcttc

SEQ ID NO: 169837 - DNA, 25 bp, Mus musculus
agcatcgcacatctgtacagtctgg

SEQ ID NO: 169838 - DNA, 25 bp, Mus musculus
agcatcgcacatgtgtacagtctgg

SEQ ID NO: 169839 - DNA, 25 bp, Mus musculus
agcatcgccattatcatctactttt

SEQ ID NO: 169840 - DNA, 25 bp, Mus musculus
agcatcgccattttcatctactttt

SEQ ID NO: 169841 - DNA, 25 bp, Mus musculus
agcatcgctgtgctctggcaagcac

SEQ ID NO: 169842 - DNA, 25 bp, Mus musculus
agcatcgctgtggtctggcaagcac

SEQ ID NO: 169843 - DNA, 25 bp, Mus musculus
agcatcgggtttatctttccatgat

SEQ ID NO: 169844 - DNA, 25 bp, Mus musculus
agcatcgggtttttctttccatgat

SEQ ID NO: 169845 - DNA, 25 bp, Mus musculus
agcatcgtaaaacccgttgactctt

SEQ ID NO: 169846 - DNA, 25 bp, Mus musculus
agcatcgtaaaagccgttgactctt

SEQ ID NO: 169847 - DNA, 25 bp, Mus musculus
agcatcgtccaccaggtccctgtga

SEQ ID NO: 169848 - DNA, 25 bp, Mus musculus
agcatcgtccacgaggtccctgtga

SEQ ID NO: 169849 - DNA, 25 bp, Mus musculus
agcatcgtgaagctccaggcctggt

SEQ ID NO: 169850 - DNA, 25 bp, Mus musculus
agcatcgtgaaggtccaggcctggt

SEQ ID NO: 169851 - DNA, 25 bp, Mus musculus
agcatcgtggatcaggtacggcctc

SEQ ID NO: 169852 - DNA, 25 bp, Mus musculus
agcatcgtggatgaggtacggcctc

SEQ ID NO: 169853 - DNA, 25 bp, Mus musculus
agcatcgtgtacactctgcttttca

SEQ ID NO: 169854 - DNA, 25 bp, Mus musculus
agcatcgtgtactctctgcttttca

SEQ ID NO: 169855 - DNA, 25 bp, Mus musculus
agcatcgttatcattacacttcata

SEQ ID NO: 169856 - DNA, 25 bp, Mus musculus
agcatcgttatctttacacttcata

SEQ ID NO: 169857 - DNA, 25 bp, Mus musculus
agcatcgttcacagcacttactatg

SEQ ID NO: 169858 - DNA, 25 bp, Mus musculus
agcatcgttcactgcacttactatg

SEQ ID NO: 169859 - DNA, 25 bp, Mus musculus
agcatcgtttacacccaagggctga

SEQ ID NO: 169860 - DNA, 25 bp, Mus musculus
agcatcgtttactcccaagggctga

SEQ ID NO: 169861 - DNA, 25 bp, Mus musculus
agcatctaccctacacgtaatagtg

SEQ ID NO: 169862 - DNA, 25 bp, Mus musculus
agcatctacccttcacgtaatagtg

SEQ ID NO: 169863 - DNA, 25 bp, Mus musculus
agcatctacctaagagaaagccaga

SEQ ID NO: 169864 - DNA, 25 bp, Mus musculus
agcatctacctatgagaaagccaga

SEQ ID NO: 169865 - DNA, 25 bp, Mus musculus
agcatctacctgctttttagtccca

SEQ ID NO: 169866 - DNA, 25 bp, Mus musculus
agcatctacctggtttttagtccca

SEQ ID NO: 169867 - DNA, 25 bp, Mus musculus
agcatctacgtgctagctccaaacc

SEQ ID NO: 169868 - DNA, 25 bp, Mus musculus
agcatctacgtggtagctccaaacc

SEQ ID NO: 169869 - DNA, 25 bp, Mus musculus
agcatctaggctcacattcaaggct

SEQ ID NO: 169870 - DNA, 25 bp, Mus musculus
agcatctaggctgacattcaaggct

SEQ ID NO: 169871 - DNA, 25 bp, Mus musculus
agcatctagttacggtgcgcagaca

SEQ ID NO: 169872 - DNA, 25 bp, Mus musculus
agcatctagttagggtgcgcagaca

SEQ ID NO: 169873 - DNA, 25 bp, Mus musculus
agcatctatcagacccatggcacaa

SEQ ID NO: 169874 - DNA, 25 bp, Mus musculus
agcatctatcagtcccatggcacaa

SEQ ID NO: 169875 - DNA, 25 bp, Mus musculus
agcatctatctacctcgtgggtagc

SEQ ID NO: 169876 - DNA, 25 bp, Mus musculus
agcatctatctagctcgtgggtagc

SEQ ID NO: 169877 - DNA, 25 bp, Mus musculus
agcatctatggtcagcgcttcccag

SEQ ID NO: 169878 - DNA, 25 bp, Mus musculus
agcatctatggtgagcgcttcccag

SEQ ID NO: 169879 - DNA, 25 bp, Mus musculus
agcatctcaccgctttggatttcta

SEQ ID NO: 169880 - DNA, 25 bp, Mus musculus
agcatctcaccggtttggatttcta

SEQ ID NO: 169881 - DNA, 25 bp, Mus musculus
agcatctcagctagtccgttagaaa

SEQ ID NO: 169882 - DNA, 25 bp, Mus musculus
agcatctcagcttgtccgttagaaa

SEQ ID NO: 169883 - DNA, 25 bp, Mus musculus
agcatctcatagctgtgctccttcc

SEQ ID NO: 169884 - DNA, 25 bp, Mus musculus
agcatctcataggtgtgctccttcc

SEQ ID NO: 169885 - DNA, 25 bp, Mus musculus
agcatctccaagcactgtttcgagt

SEQ ID NO: 169886 - DNA, 25 bp, Mus musculus
agcatctccaaggactgtttcgagt

SEQ ID NO: 169887 - DNA, 25 bp, Mus musculus
agcatctccaatcccttttagttaa

SEQ ID NO: 169888 - DNA, 25 bp, Mus musculus
agcatctccaatgccttttagttaa

SEQ ID NO: 169889 - DNA, 25 bp, Mus musculus
agcatctccactctcaacttgagga

SEQ ID NO: 169890 - DNA, 25 bp, Mus musculus
agcatctccactgtcaacttgagga

SEQ ID NO: 169891 - DNA, 25 bp, Mus musculus
agcatctcccaccatgttagacaaa

SEQ ID NO: 169892 - DNA, 25 bp, Mus musculus
agcatctcccacgatgttagacaaa

SEQ ID NO: 169893 - DNA, 25 bp, Mus musculus
agcatctccctgacagactgcaaga

SEQ ID NO: 169894 - DNA, 25 bp, Mus musculus
agcatctccctgtcagactgcaaga

SEQ ID NO: 169895 - DNA, 25 bp, Mus musculus
agcatctcctcacaggcggcgatgg

SEQ ID NO: 169896 - DNA, 25 bp, Mus musculus
agcatctcctcagaggcggcgatgg

SEQ ID NO: 169897 - DNA, 25 bp, Mus musculus
agcatctcctgacgcagggttgtgc

SEQ ID NO: 169898 - DNA, 25 bp, Mus musculus
agcatctcctgaggcagggttgtgc

SEQ ID NO: 169899 - DNA, 25 bp, Mus musculus
agcatctctaacatccaccaggaag

SEQ ID NO: 169900 - DNA, 25 bp, Mus musculus
agcatctctaacttccaccaggaag

SEQ ID NO: 169901 - DNA, 25 bp, Mus musculus
agcatctctgagataacgctatatg

SEQ ID NO: 169902 - DNA, 25 bp, Mus musculus
agcatctctgagttaacgctatatg

SEQ ID NO: 169903 - DNA, 25 bp, Mus musculus
agcatctctgcaagatttccacctg

SEQ ID NO: 169904 - DNA, 25 bp, Mus musculus
agcatctctgcatgatttccacctg

SEQ ID NO: 169905 - DNA, 25 bp, Mus musculus
agcatctctggaattggtctgataa

SEQ ID NO: 169906 - DNA, 25 bp, Mus musculus
agcatctctggatttggtctgataa

SEQ ID NO: 169907 - DNA, 25 bp, Mus musculus
agcatctcttgtacctgctatgttg

SEQ ID NO: 169908 - DNA, 25 bp, Mus musculus
agcatctcttgttcctgctatgttg

SEQ ID NO: 169909 - DNA, 25 bp, Mus musculus
agcatctgagctccaggcactggga

SEQ ID NO: 169910 - DNA, 25 bp, Mus musculus
agcatctgagctgcaggcactggga

SEQ ID NO: 169911 - DNA, 25 bp, Mus musculus
agcatctgcactcggctgtgactgt

SEQ ID NO: 169912 - DNA, 25 bp, Mus musculus
agcatctgcactgggctgtgactgt

SEQ ID NO: 169913 - DNA, 25 bp, Mus musculus
agcatctgcaggactgttttctgtc

SEQ ID NO: 169914 - DNA, 25 bp, Mus musculus
agcatctgcaggtctgttttctgtc

SEQ ID NO: 169915 - DNA, 25 bp, Mus musculus
agcatctgccacaactgaggaacat

SEQ ID NO: 169916 - DNA, 25 bp, Mus musculus
agcatctgccactactgaggaacat

SEQ ID NO: 169917 - DNA, 25 bp, Mus musculus
agcatctgccgactggagacgctat

SEQ ID NO: 169918 - DNA, 25 bp, Mus musculus
agcatctgccgagtggagacgctat

SEQ ID NO: 169919 - DNA, 25 bp, Mus musculus
agcatctgcggcagtccctgaggag

SEQ ID NO: 169920 - DNA, 25 bp, Mus musculus
agcatctgcggctgtccctgaggag

SEQ ID NO: 169921 - DNA, 25 bp, Mus musculus
agcatctggagaccgaatatcccca

SEQ ID NO: 169922 - DNA, 25 bp, Mus musculus
agcatctggagagcgaatatcccca

SEQ ID NO: 169923 - DNA, 25 bp, Mus musculus
agcatctggagtctcagctgacggc

SEQ ID NO: 169924 - DNA, 25 bp, Mus musculus
agcatctggagtgtcagctgacggc

SEQ ID NO: 169925 - DNA, 25 bp, Mus musculus
agcatctgggataaagtggacttgg

SEQ ID NO: 169926 - DNA, 25 bp, Mus musculus
agcatctgggattaagtggacttgg

SEQ ID NO: 169927 - DNA, 25 bp, Mus musculus
agcatctgtactaggcttgccttga

SEQ ID NO: 169928 - DNA, 25 bp, Mus musculus
agcatctgtacttggcttgccttga

SEQ ID NO: 169929 - DNA, 25 bp, Mus musculus
agcatctgtagacgcgtattgtaat

SEQ ID NO: 169930 - DNA, 25 bp, Mus musculus
agcatctgtagaggcgtattgtaat

SEQ ID NO: 169931 - DNA, 25 bp, Mus musculus
agcatctgtagcactcacaggctga

SEQ ID NO: 169932 - DNA, 25 bp, Mus musculus
agcatctgtagctctcacaggctga

SEQ ID NO: 169933 - DNA, 25 bp, Mus musculus
agcatctgtctcactagaatccgga

SEQ ID NO: 169934 - DNA, 25 bp, Mus musculus
agcatctgtctctctagaatccgga

SEQ ID NO: 169935 - DNA, 25 bp, Mus musculus
agcatctgtggaacgccagaggtcc

SEQ ID NO: 169936 - DNA, 25 bp, Mus musculus
agcatctgtggatcgccagaggtcc

SEQ ID NO: 169937 - DNA, 25 bp, Mus musculus
agcatctgtgtcagcttacaaagaa

SEQ ID NO: 169938 - DNA, 25 bp, Mus musculus
agcatctgtgtctgcttacaaagaa

SEQ ID NO: 169939 - DNA, 25 bp, Mus musculus
agcatctgtgttcctgtcatctctg

SEQ ID NO: 169940 - DNA, 25 bp, Mus musculus
agcatctgtgttgctgtcatctctg

SEQ ID NO: 169941 - DNA, 25 bp, Mus musculus
agcatctgttccagcttatccgaac

SEQ ID NO: 169942 - DNA, 25 bp, Mus musculus
agcatctgttcctgcttatccgaac

SEQ ID NO: 169943 - DNA, 25 bp, Mus musculus
agcatctgttgaccttgcactccaa

SEQ ID NO: 169944 - DNA, 25 bp, Mus musculus
agcatctgttgagcttgcactccaa

SEQ ID NO: 169945 - DNA, 25 bp, Mus musculus
agcatctgttttacctagactgtcc

SEQ ID NO: 169946 - DNA, 25 bp, Mus musculus
agcatctgtttttcctagactgtcc

SEQ ID NO: 169947 - DNA, 25 bp, Mus musculus
agcatcttaaatcggattcgggtcc

SEQ ID NO: 169948 - DNA, 25 bp, Mus musculus
agcatcttaaatgggattcgggtcc

SEQ ID NO: 169949 - DNA, 25 bp, Mus musculus
agcatcttacccaggagctaatccg

SEQ ID NO: 169950 - DNA, 25 bp, Mus musculus
agcatcttaccctggagctaatccg

SEQ ID NO: 169951 - DNA, 25 bp, Mus musculus
agcatcttcaggaaaccagactttc

SEQ ID NO: 169952 - DNA, 25 bp, Mus musculus
agcatcttcaggagccaggaaacgg

SEQ ID NO: 169953 - DNA, 25 bp, Mus musculus
agcatcttcaggtaaccagactttc

SEQ ID NO: 169954 - DNA, 25 bp, Mus musculus
agcatcttcaggtgccaggaaacgg

SEQ ID NO: 169955 - DNA, 25 bp, Mus musculus
agcatcttcagtacgcaccataagc

SEQ ID NO: 169956 - DNA, 25 bp, Mus musculus
agcatcttcagtcaggctaggccta

SEQ ID NO: 169957 - DNA, 25 bp, Mus musculus
agcatcttcagtgaggctaggccta

SEQ ID NO: 169958 - DNA, 25 bp, Mus musculus
agcatcttcagttcgcaccataagc

SEQ ID NO: 169959 - DNA, 25 bp, Mus musculus
agcatcttcatgatactgagaccat

SEQ ID NO: 169960 - DNA, 25 bp, Mus musculus
agcatcttcatgcaaccaacctgtc

SEQ ID NO: 169961 - DNA, 25 bp, Mus musculus
agcatcttcatggaaccaacctgtc

SEQ ID NO: 169962 - DNA, 25 bp, Mus musculus
agcatcttcatgttactgagaccat

SEQ ID NO: 169963 - DNA, 25 bp, Mus musculus
agcatcttccagattgccatctgga

SEQ ID NO: 169964 - DNA, 25 bp, Mus musculus
agcatcttccagtttgccatctgga

SEQ ID NO: 169965 - DNA, 25 bp, Mus musculus
agcatcttcggactggccagccggt

SEQ ID NO: 169966 - DNA, 25 bp, Mus musculus
agcatcttcggactgttacctacca

SEQ ID NO: 169967 - DNA, 25 bp, Mus musculus
agcatcttcggagtggccagccggt

SEQ ID NO: 169968 - DNA, 25 bp, Mus musculus
agcatcttcggagtgttacctacca

SEQ ID NO: 169969 - DNA, 25 bp, Mus musculus
agcatcttctctctgtacctggcat

SEQ ID NO: 169970 - DNA, 25 bp, Mus musculus
agcatcttctctgtgtacctggcat

SEQ ID NO: 169971 - DNA, 25 bp, Mus musculus
agcatcttctgtcgcttctaagaaa

SEQ ID NO: 169972 - DNA, 25 bp, Mus musculus
agcatcttctgtggcttctaagaaa

SEQ ID NO: 169973 - DNA, 25 bp, Mus musculus
agcatcttgcagattgtagcctccc

SEQ ID NO: 169974 - DNA, 25 bp, Mus musculus
agcatcttgcagtttgtagcctccc

SEQ ID NO: 169975 - DNA, 25 bp, Mus musculus
agcatcttggccctcctgtaatgag

SEQ ID NO: 169976 - DNA, 25 bp, Mus musculus
agcatcttggccgtcctgtaatgag

SEQ ID NO: 169977 - DNA, 25 bp, Mus musculus
agcatcttggctatttcctggtcca

SEQ ID NO: 169978 - DNA, 25 bp, Mus musculus
agcatcttggctttttcctggtcca

SEQ ID NO: 169979 - DNA, 25 bp, Mus musculus
agcatcttgggcagtcaggtgcaga

SEQ ID NO: 169980 - DNA, 25 bp, Mus musculus
agcatcttgggctgtcaggtgcaga

SEQ ID NO: 169981 - DNA, 25 bp, Mus musculus
agcatctttcatatggtaggaacca

SEQ ID NO: 169982 - DNA, 25 bp, Mus musculus
agcatctttcatttggtaggaacca

SEQ ID NO: 169983 - DNA, 25 bp, Mus musculus
agcatctttcctaaatcaaaagcaa

SEQ ID NO: 169984 - DNA, 25 bp, Mus musculus
agcatctttccttaatcaaaagcaa

SEQ ID NO: 169985 - DNA, 25 bp, Mus musculus
agcatctttgctatagcctgtccag

SEQ ID NO: 169986 - DNA, 25 bp, Mus musculus
agcatctttgctttagcctgtccag

SEQ ID NO: 169987 - DNA, 25 bp, Mus musculus
agcatctttggaattgccctcacca

SEQ ID NO: 169988 - DNA, 25 bp, Mus musculus
agcatctttggatttgccctcacca

SEQ ID NO: 169989 - DNA, 25 bp, Mus musculus
agcatctttggcatgggctgaggcc

SEQ ID NO: 169990 - DNA, 25 bp, Mus musculus
agcatctttggcttgggctgaggcc

SEQ ID NO: 169991 - DNA, 25 bp, Mus musculus
agcatctttgttacattcctgttga

SEQ ID NO: 169992 - DNA, 25 bp, Mus musculus
agcatctttgtttcattcctgttga

SEQ ID NO: 169993 - DNA, 25 bp, Mus musculus
agcatcttttctaagccatccaagc

SEQ ID NO: 169994 - DNA, 25 bp, Mus musculus
agcatcttttcttagccatccaagc

SEQ ID NO: 169995 - DNA, 25 bp, Mus musculus
agcatgaacagtcggcatcacctcc

SEQ ID NO: 169996 - DNA, 25 bp, Mus musculus
agcatgaacagtgggcatcacctcc

SEQ ID NO: 169997 - DNA, 25 bp, Mus musculus
agcatgaaccgactttatgttgtat

SEQ ID NO: 169998 - DNA, 25 bp, Mus musculus
agcatgaaccgagtttatgttgtat

SEQ ID NO: 169999 - DNA, 25 bp, Mus musculus
agcatgaactgcaaccactggaaat

SEQ ID NO: 170000 - DNA, 25 bp, Mus musculus
agcatgaactgctaccactggaaat

SEQ ID NO: 170001 - DNA, 25 bp, Mus musculus
agcatgaagcacaccagaacgacta

SEQ ID NO: 170002 - DNA, 25 bp, Mus musculus
agcatgaagcactccagaacgacta

SEQ ID NO: 170003 - DNA, 25 bp, Mus musculus
agcatgaagccacagaaccaagcct

SEQ ID NO: 170004 - DNA, 25 bp, Mus musculus
agcatgaagccagagaaccaagcct

SEQ ID NO: 170005 - DNA, 25 bp, Mus musculus
agcatgaagcctacactgtgtttcc

SEQ ID NO: 170006 - DNA, 25 bp, Mus musculus
agcatgaagccttcactgtgtttcc

SEQ ID NO: 170007 - DNA, 25 bp, Mus musculus
agcatgaagtagaagcccctctcca

SEQ ID NO: 170008 - DNA, 25 bp, Mus musculus
agcatgaagtagtagcccctctcca

SEQ ID NO: 170009 - DNA, 25 bp, Mus musculus
agcatgaagtgcacagggcctagct

SEQ ID NO: 170010 - DNA, 25 bp, Mus musculus
agcatgaagtgctcagggcctagct

SEQ ID NO: 170011 - DNA, 25 bp, Mus musculus
agcatgaatcggcattgcgcttcat

SEQ ID NO: 170012 - DNA, 25 bp, Mus musculus
agcatgaatcgggattgcgcttcat

SEQ ID NO: 170013 - DNA, 25 bp, Mus musculus
agcatgaatctcatcaatgtggtgg

SEQ ID NO: 170014 - DNA, 25 bp, Mus musculus
agcatgaatctcttcaatgtggtgg

SEQ ID NO: 170015 - DNA, 25 bp, Mus musculus
agcatgaatgctactctgtagtaat

SEQ ID NO: 170016 - DNA, 25 bp, Mus musculus
agcatgaatgcttctctgtagtaat

SEQ ID NO: 170017 - DNA, 25 bp, Mus musculus
agcatgaatggccgccaacctaacc

SEQ ID NO: 170018 - DNA, 25 bp, Mus musculus
agcatgaatggcggccaacctaacc

SEQ ID NO: 170019 - DNA, 25 bp, Mus musculus
agcatgacaaccacttcttcgtgta

SEQ ID NO: 170020 - DNA, 25 bp, Mus musculus
agcatgacaacctcttcttcgtgta

SEQ ID NO: 170021 - DNA, 25 bp, Mus musculus
agcatgacaagcacaagaaaggcga

SEQ ID NO: 170022 - DNA, 25 bp, Mus musculus
agcatgacaagctcaagaaaggcga

SEQ ID NO: 170023 - DNA, 25 bp, Mus musculus
agcatgacaagtctatcgcaatact

SEQ ID NO: 170024 - DNA, 25 bp, Mus musculus
agcatgacaagtgtatcgcaatact

SEQ ID NO: 170025 - DNA, 25 bp, Mus musculus
agcatgacccagatgtcactgctgt

SEQ ID NO: 170026 - DNA, 25 bp, Mus musculus
agcatgacccagttgtcactgctgt

SEQ ID NO: 170027 - DNA, 25 bp, Mus musculus
agcatgacctccagctctaagatgg

SEQ ID NO: 170028 - DNA, 25 bp, Mus musculus
agcatgacctcctgctctaagatgg

SEQ ID NO: 170029 - DNA, 25 bp, Mus musculus
agcatgacctgcagaggctggcaaa

SEQ ID NO: 170030 - DNA, 25 bp, Mus musculus
agcatgacctgctgaggctggcaaa

SEQ ID NO: 170031 - DNA, 25 bp, Mus musculus
agcatgacctggagcgtctgcgtga

SEQ ID NO: 170032 - DNA, 25 bp, Mus musculus
agcatgacctggtgcgtctgcgtga

SEQ ID NO: 170033 - DNA, 25 bp, Mus musculus
agcatgaccttgaccttttgatctt

SEQ ID NO: 170034 - DNA, 25 bp, Mus musculus
agcatgaccttgtccttttgatctt

SEQ ID NO: 170035 - DNA, 25 bp, Mus musculus
agcatgactcagcatactacggaca

SEQ ID NO: 170036 - DNA, 25 bp, Mus musculus
agcatgactcaggatactacggaca

SEQ ID NO: 170037 - DNA, 25 bp, Mus musculus
agcatgactggtaccatggtgccat

SEQ ID NO: 170038 - DNA, 25 bp, Mus musculus
agcatgactggttccatggtgccat

SEQ ID NO: 170039 - DNA, 25 bp, Mus musculus
agcatgacttatctctcctagcttc

SEQ ID NO: 170040 - DNA, 25 bp, Mus musculus
agcatgacttatgtctcctagcttc

SEQ ID NO: 170041 - DNA, 25 bp, Mus musculus
agcatgagacaccttccttctgaag

SEQ ID NO: 170042 - DNA, 25 bp, Mus musculus
agcatgagacacgttccttctgaag

SEQ ID NO: 170043 - DNA, 25 bp, Mus musculus
agcatgagacccagtgttcttcaca

SEQ ID NO: 170044 - DNA, 25 bp, Mus musculus
agcatgagaccctgtgttcttcaca

SEQ ID NO: 170045 - DNA, 25 bp, Mus musculus
agcatgagagaaaacccagctcggc

SEQ ID NO: 170046 - DNA, 25 bp, Mus musculus
agcatgagagaatacccagctcggc

SEQ ID NO: 170047 - DNA, 25 bp, Mus musculus
agcatgagctaccaagcccaagctg

SEQ ID NO: 170048 - DNA, 25 bp, Mus musculus
agcatgagctacgaagcccaagctg

SEQ ID NO: 170049 - DNA, 25 bp, Mus musculus
agcatgagctgtacaggtgacgact

SEQ ID NO: 170050 - DNA, 25 bp, Mus musculus
agcatgagctgttcaggtgacgact

SEQ ID NO: 170051 - DNA, 25 bp, Mus musculus
agcatgaggagcaaaaacccgtttc

SEQ ID NO: 170052 - DNA, 25 bp, Mus musculus
agcatgaggagctaaaacccgtttc

SEQ ID NO: 170053 - DNA, 25 bp, Mus musculus
agcatgaggtccctacgcgtccgaa

SEQ ID NO: 170054 - DNA, 25 bp, Mus musculus
agcatgaggtccgtacgcgtccgaa

SEQ ID NO: 170055 - DNA, 25 bp, Mus musculus
agcatgagtctgacgctgtgttcac

SEQ ID NO: 170056 - DNA, 25 bp, Mus musculus
agcatgagtctgtcgctgtgttcac

SEQ ID NO: 170057 - DNA, 25 bp, Mus musculus
agcatgagttctatgtgtctgtaaa

SEQ ID NO: 170058 - DNA, 25 bp, Mus musculus
agcatgagttctttgtgtctgtaaa

SEQ ID NO: 170059 - DNA, 25 bp, Mus musculus
agcatgatatacataggtctctaca

SEQ ID NO: 170060 - DNA, 25 bp, Mus musculus
agcatgatatacttaggtctctaca

SEQ ID NO: 170061 - DNA, 25 bp, Mus musculus
agcatgatcagcaagtcgctcggat

SEQ ID NO: 170062 - DNA, 25 bp, Mus musculus
agcatgatcagctagtcgctcggat

SEQ ID NO: 170063 - DNA, 25 bp, Mus musculus
agcatgatcaggaagccatcgccac

SEQ ID NO: 170064 - DNA, 25 bp, Mus musculus
agcatgatcaggtagccatcgccac

SEQ ID NO: 170065 - DNA, 25 bp, Mus musculus
agcatgatcagtcgcctcgttacca

SEQ ID NO: 170066 - DNA, 25 bp, Mus musculus
agcatgatcagtggcctcgttacca

SEQ ID NO: 170067 - DNA, 25 bp, Mus musculus
agcatgattacacggccactgacac

SEQ ID NO: 170068 - DNA, 25 bp, Mus musculus
agcatgattacagggccactgacac

SEQ ID NO: 170069 - DNA, 25 bp, Mus musculus
agcatgattggaatgatgttggaca

SEQ ID NO: 170070 - DNA, 25 bp, Mus musculus
agcatgattggattgatgttggaca

SEQ ID NO: 170071 - DNA, 25 bp, Mus musculus
agcatgatttgtcctgaggcagacg

SEQ ID NO: 170072 - DNA, 25 bp, Mus musculus
agcatgatttgtgctgaggcagacg

SEQ ID NO: 170073 - DNA, 25 bp, Mus musculus
agcatgatttttcggaagttacgcc

SEQ ID NO: 170074 - DNA, 25 bp, Mus musculus
agcatgatttttgggaagttacgcc

SEQ ID NO: 170075 - DNA, 25 bp, Mus musculus
agcatgcaaggaattgagccctata

SEQ ID NO: 170076 - DNA, 25 bp, Mus musculus
agcatgcaaggatttgagccctata

SEQ ID NO: 170077 - DNA, 25 bp, Mus musculus
agcatgcaagtgctccacagttcta

SEQ ID NO: 170078 - DNA, 25 bp, Mus musculus
agcatgcaagtggtccacagttcta

SEQ ID NO: 170079 - DNA, 25 bp, Mus musculus
agcatgcacacacccatcaatggct

SEQ ID NO: 170080 - DNA, 25 bp, Mus musculus
agcatgcacacagccatcaatggct

SEQ ID NO: 170081 - DNA, 25 bp, Mus musculus
agcatgcactataatctgacttgaa

SEQ ID NO: 170082 - DNA, 25 bp, Mus musculus
agcatgcactattatctgacttgaa

SEQ ID NO: 170083 - DNA, 25 bp, Mus musculus
agcatgcagacacgcagctttccca

SEQ ID NO: 170084 - DNA, 25 bp, Mus musculus
agcatgcagacaggcagctttccca

SEQ ID NO: 170085 - DNA, 25 bp, Mus musculus
agcatgcagactcctctgttctcac

SEQ ID NO: 170086 - DNA, 25 bp, Mus musculus
agcatgcagactgctctgttctcac

SEQ ID NO: 170087 - DNA, 25 bp, Mus musculus
agcatgcagagcagtagcgtcctgt

SEQ ID NO: 170088 - DNA, 25 bp, Mus musculus
agcatgcagagctgtagcgtcctgt

SEQ ID NO: 170089 - DNA, 25 bp, Mus musculus
agcatgcagcacacagtcttgttag

SEQ ID NO: 170090 - DNA, 25 bp, Mus musculus
agcatgcagcactcagtcttgttag

SEQ ID NO: 170091 - DNA, 25 bp, Mus musculus
agcatgcagggaagtttgctgtaga

SEQ ID NO: 170092 - DNA, 25 bp, Mus musculus
agcatgcagggatgtttgctgtaga

SEQ ID NO: 170093 - DNA, 25 bp, Mus musculus
agcatgcaggtcacagttctcatca

SEQ ID NO: 170094 - DNA, 25 bp, Mus musculus
agcatgcaggtctcagttctcatca

SEQ ID NO: 170095 - DNA, 25 bp, Mus musculus
agcatgcagtctataatcacaaaaa

SEQ ID NO: 170096 - DNA, 25 bp, Mus musculus
agcatgcagtctttaatcacaaaaa

SEQ ID NO: 170097 - DNA, 25 bp, Mus musculus
agcatgcatagacagtgagaagatt

SEQ ID NO: 170098 - DNA, 25 bp, Mus musculus
agcatgcatagagagtgagaagatt

SEQ ID NO: 170099 - DNA, 25 bp, Mus musculus
agcatgcatgaacctgtggcactat

SEQ ID NO: 170100 - DNA, 25 bp, Mus musculus
agcatgcatgaagctgtggcactat

SEQ ID NO: 170101 - DNA, 25 bp, Mus musculus
agcatgcatgggatttctacatctc

SEQ ID NO: 170102 - DNA, 25 bp, Mus musculus
agcatgcatgggttttctacatctc

SEQ ID NO: 170103 - DNA, 25 bp, Mus musculus
agcatgccaacgcttcatttgttca

SEQ ID NO: 170104 - DNA, 25 bp, Mus musculus
agcatgccaacggttcatttgttca

SEQ ID NO: 170105 - DNA, 25 bp, Mus musculus
agcatgccaagaaccattgagagat

SEQ ID NO: 170106 - DNA, 25 bp, Mus musculus
agcatgccaagatccattgagagat

SEQ ID NO: 170107 - DNA, 25 bp, Mus musculus
agcatgccaatcagatgaaatccca

SEQ ID NO: 170108 - DNA, 25 bp, Mus musculus
agcatgccaatctgatgaaatccca

SEQ ID NO: 170109 - DNA, 25 bp, Mus musculus
agcatgccaccgctggagatattgg

SEQ ID NO: 170110 - DNA, 25 bp, Mus musculus
agcatgccaccggtggagatattgg

SEQ ID NO: 170111 - DNA, 25 bp, Mus musculus
agcatgccactgagatagccactgc

SEQ ID NO: 170112 - DNA, 25 bp, Mus musculus
agcatgccactgtgatagccactgc

SEQ ID NO: 170113 - DNA, 25 bp, Mus musculus
agcatgccaggacccctaggtttgc

SEQ ID NO: 170114 - DNA, 25 bp, Mus musculus
agcatgccaggagccctaggtttgc

SEQ ID NO: 170115 - DNA, 25 bp, Mus musculus
agcatgccatatatagtttgtctag

SEQ ID NO: 170116 - DNA, 25 bp, Mus musculus
agcatgccatatttagtttgtctag

SEQ ID NO: 170117 - DNA, 25 bp, Mus musculus
agcatgcccaatctaagcctgtgtg

SEQ ID NO: 170118 - DNA, 25 bp, Mus musculus
agcatgcccaatgtaagcctgtgtg

SEQ ID NO: 170119 - DNA, 25 bp, Mus musculus
agcatgcccattatctgaagtgtcc

SEQ ID NO: 170120 - DNA, 25 bp, Mus musculus
agcatgcccattttctgaagtgtcc

SEQ ID NO: 170121 - DNA, 25 bp, Mus musculus
agcatgccccatcgagacatttaac

SEQ ID NO: 170122 - DNA, 25 bp, Mus musculus
agcatgccccatggagacatttaac

SEQ ID NO: 170123 - DNA, 25 bp, Mus musculus
agcatgccccttcgcttgaaagcat

SEQ ID NO: 170124 - DNA, 25 bp, Mus musculus
agcatgccccttggcttgaaagcat

SEQ ID NO: 170125 - DNA, 25 bp, Mus musculus
agcatgcccgggaacaggagcagca

SEQ ID NO: 170126 - DNA, 25 bp, Mus musculus
agcatgcccgggtacaggagcagca

SEQ ID NO: 170127 - DNA, 25 bp, Mus musculus
agcatgccctccaatagcagctgta

SEQ ID NO: 170128 - DNA, 25 bp, Mus musculus
agcatgccctcctatagcagctgta

SEQ ID NO: 170129 - DNA, 25 bp, Mus musculus
agcatgcccttgaagtttctcttga

SEQ ID NO: 170130 - DNA, 25 bp, Mus musculus
agcatgcccttgtagtttctcttga

SEQ ID NO: 170131 - DNA, 25 bp, Mus musculus
agcatgccgccgacggtatgtcagc

SEQ ID NO: 170132 - DNA, 25 bp, Mus musculus
agcatgccgccgtcggtatgtcagc

SEQ ID NO: 170133 - DNA, 25 bp, Mus musculus
agcatgccgtatcctatctgatgta

SEQ ID NO: 170134 - DNA, 25 bp, Mus musculus
agcatgccgtatgctatctgatgta

SEQ ID NO: 170135 - DNA, 25 bp, Mus musculus
agcatgcctaccacacagcttcatt

SEQ ID NO: 170136 - DNA, 25 bp, Mus musculus
agcatgcctacctcacagcttcatt

SEQ ID NO: 170137 - DNA, 25 bp, Mus musculus
agcatgcctcctctaagagttctgg

SEQ ID NO: 170138 - DNA, 25 bp, Mus musculus
agcatgcctcctgtaagagttctgg

SEQ ID NO: 170139 - DNA, 25 bp, Mus musculus
agcatgcctctaaattctactatag

SEQ ID NO: 170140 - DNA, 25 bp, Mus musculus
agcatgcctctatattctactatag

SEQ ID NO: 170141 - DNA, 25 bp, Mus musculus
agcatgcctgacatatcatcaccaa

SEQ ID NO: 170142 - DNA, 25 bp, Mus musculus
agcatgcctgacttatcatcaccaa

SEQ ID NO: 170143 - DNA, 25 bp, Mus musculus
agcatgcctgggaagtatcctcaca

SEQ ID NO: 170144 - DNA, 25 bp, Mus musculus
agcatgcctgggtagtatcctcaca

SEQ ID NO: 170145 - DNA, 25 bp, Mus musculus
agcatgccttatacacacacatata

SEQ ID NO: 170146 - DNA, 25 bp, Mus musculus
agcatgccttattcacacacatata

SEQ ID NO: 170147 - DNA, 25 bp, Mus musculus
agcatgccttcaaagacattcctgc

SEQ ID NO: 170148 - DNA, 25 bp, Mus musculus
agcatgccttcatagacattcctgc

SEQ ID NO: 170149 - DNA, 25 bp, Mus musculus
agcatgccttgcagcgcctgggact

SEQ ID NO: 170150 - DNA, 25 bp, Mus musculus
agcatgccttgctgcgcctgggact

SEQ ID NO: 170151 - DNA, 25 bp, Mus musculus
agcatgcgcagcaacaggctttcta

SEQ ID NO: 170152 - DNA, 25 bp, Mus musculus
agcatgcgcagctacaggctttcta

SEQ ID NO: 170153 - DNA, 25 bp, Mus musculus
agcatgcgccacctagagctctggg

SEQ ID NO: 170154 - DNA, 25 bp, Mus musculus
agcatgcgccacgtagagctctggg

SEQ ID NO: 170155 - DNA, 25 bp, Mus musculus
agcatgcgcgcacgcatacgggcga

SEQ ID NO: 170156 - DNA, 25 bp, Mus musculus
agcatgcgcgcaggcatacgggcga

SEQ ID NO: 170157 - DNA, 25 bp, Mus musculus
agcatgcgggataccctcattgaca

SEQ ID NO: 170158 - DNA, 25 bp, Mus musculus
agcatgcgggattccctcattgaca

SEQ ID NO: 170159 - DNA, 25 bp, Mus musculus
agcatgcgtcttaagctcatcgcca

SEQ ID NO: 170160 - DNA, 25 bp, Mus musculus
agcatgcgtctttagctcatcgcca

SEQ ID NO: 170161 - DNA, 25 bp, Mus musculus
agcatgctaatcaggtgtctttata

SEQ ID NO: 170162 - DNA, 25 bp, Mus musculus
agcatgctaatctggtgtctttata

SEQ ID NO: 170163 - DNA, 25 bp, Mus musculus
agcatgctacagatggtgcgcgagc

SEQ ID NO: 170164 - DNA, 25 bp, Mus musculus
agcatgctacagttggtgcgcgagc

SEQ ID NO: 170165 - DNA, 25 bp, Mus musculus
agcatgctagttactgaattgtgta

SEQ ID NO: 170166 - DNA, 25 bp, Mus musculus
agcatgctagtttctgaattgtgta

SEQ ID NO: 170167 - DNA, 25 bp, Mus musculus
agcatgctcagtatcattgtggaga

SEQ ID NO: 170168 - DNA, 25 bp, Mus musculus
agcatgctcagtttcattgtggaga

SEQ ID NO: 170169 - DNA, 25 bp, Mus musculus
agcatgctctttagtgctactcatg

SEQ ID NO: 170170 - DNA, 25 bp, Mus musculus
agcatgctcttttgtgctactcatg

SEQ ID NO: 170171 - DNA, 25 bp, Mus musculus
agcatgctgaagaccttgccgcctg

SEQ ID NO: 170172 - DNA, 25 bp, Mus musculus
agcatgctgaagtccttgccgcctg

SEQ ID NO: 170173 - DNA, 25 bp, Mus musculus
agcatgctgaccaaggctgtgtccg

SEQ ID NO: 170174 - DNA, 25 bp, Mus musculus
agcatgctgacctaggctgtgtccg

SEQ ID NO: 170175 - DNA, 25 bp, Mus musculus
agcatgctgatcaggttggtgttct

SEQ ID NO: 170176 - DNA, 25 bp, Mus musculus
agcatgctgatctggttggtgttct

SEQ ID NO: 170177 - DNA, 25 bp, Mus musculus
agcatgctgcagcttctgtgttaaa

SEQ ID NO: 170178 - DNA, 25 bp, Mus musculus
agcatgctgcaggttctgtgttaaa

SEQ ID NO: 170179 - DNA, 25 bp, Mus musculus
agcatgctgggcaagcttgtgccag

SEQ ID NO: 170180 - DNA, 25 bp, Mus musculus
agcatgctgggctagcttgtgccag

SEQ ID NO: 170181 - DNA, 25 bp, Mus musculus
agcatgctgtcacttataacctgcc

SEQ ID NO: 170182 - DNA, 25 bp, Mus musculus
agcatgctgtcagttataacctgcc

SEQ ID NO: 170183 - DNA, 25 bp, Mus musculus
agcatgctgtgccaaactttgtttt

SEQ ID NO: 170184 - DNA, 25 bp, Mus musculus
agcatgctgtgcgaaactttgtttt

SEQ ID NO: 170185 - DNA, 25 bp, Mus musculus
agcatgctttccaattttgagggag

SEQ ID NO: 170186 - DNA, 25 bp, Mus musculus
agcatgctttcctattttgagggag

SEQ ID NO: 170187 - DNA, 25 bp, Mus musculus
agcatggaacgaactcaagtggaat

SEQ ID NO: 170188 - DNA, 25 bp, Mus musculus
agcatggaacgatctcaagtggaat

SEQ ID NO: 170189 - DNA, 25 bp, Mus musculus
agcatggaacgtaacgcccttgtgt

SEQ ID NO: 170190 - DNA, 25 bp, Mus musculus
agcatggaacgttacgcccttgtgt

SEQ ID NO: 170191 - DNA, 25 bp, Mus musculus
agcatggaacttcttagcagatcaa

SEQ ID NO: 170192 - DNA, 25 bp, Mus musculus
agcatggaacttgttagcagatcaa

SEQ ID NO: 170193 - DNA, 25 bp, Mus musculus
agcatggaagtaccacccagtacca

SEQ ID NO: 170194 - DNA, 25 bp, Mus musculus
agcatggaagtagcacccagtacca

SEQ ID NO: 170195 - DNA, 25 bp, Mus musculus
agcatggactggagtgttcctgttt

SEQ ID NO: 170196 - DNA, 25 bp, Mus musculus
agcatggactggtgtgttcctgttt

SEQ ID NO: 170197 - DNA, 25 bp, Mus musculus
agcatggactgtcccaaacacccag

SEQ ID NO: 170198 - DNA, 25 bp, Mus musculus
agcatggactgtgccaaacacccag

SEQ ID NO: 170199 - DNA, 25 bp, Mus musculus
agcatggagactaaacagactattc

SEQ ID NO: 170200 - DNA, 25 bp, Mus musculus
agcatggagacttaacagactattc

SEQ ID NO: 170201 - DNA, 25 bp, Mus musculus
agcatggagagactttcacttgtct

SEQ ID NO: 170202 - DNA, 25 bp, Mus musculus
agcatggagagagtttcacttgtct

SEQ ID NO: 170203 - DNA, 25 bp, Mus musculus
agcatggaggcccaagatgctgcca

SEQ ID NO: 170204 - DNA, 25 bp, Mus musculus
agcatggaggccgaagatgctgcca

SEQ ID NO: 170205 - DNA, 25 bp, Mus musculus
agcatggagggcatgtccaagaata

SEQ ID NO: 170206 - DNA, 25 bp, Mus musculus
agcatggagggcttgtccaagaata

SEQ ID NO: 170207 - DNA, 25 bp, Mus musculus
agcatggagtccaccttagggcaga

SEQ ID NO: 170208 - DNA, 25 bp, Mus musculus
agcatggagtcctccttagggcaga

SEQ ID NO: 170209 - DNA, 25 bp, Mus musculus
agcatggattgcagtttctaccttc

SEQ ID NO: 170210 - DNA, 25 bp, Mus musculus
agcatggattgctgtttctaccttc

SEQ ID NO: 170211 - DNA, 25 bp, Mus musculus
agcatggcaactcggcatcaataaa

SEQ ID NO: 170212 - DNA, 25 bp, Mus musculus
agcatggcaactgggcatcaataaa

SEQ ID NO: 170213 - DNA, 25 bp, Mus musculus
agcatggccagcacagcattctgaa

SEQ ID NO: 170214 - DNA, 25 bp, Mus musculus
agcatggccagcacgccgatgtggt

SEQ ID NO: 170215 - DNA, 25 bp, Mus musculus
agcatggccagctcagcattctgaa

SEQ ID NO: 170216 - DNA, 25 bp, Mus musculus
agcatggccagctcgccgatgtggt

SEQ ID NO: 170217 - DNA, 25 bp, Mus musculus
agcatggcccacacgaattcaagat

SEQ ID NO: 170218 - DNA, 25 bp, Mus musculus
agcatggcccactcgaattcaagat

SEQ ID NO: 170219 - DNA, 25 bp, Mus musculus
agcatggccgtacctataatcccag

SEQ ID NO: 170220 - DNA, 25 bp, Mus musculus
agcatggccgtagctataatcccag

SEQ ID NO: 170221 - DNA, 25 bp, Mus musculus
agcatggccttaatctagactcaca

SEQ ID NO: 170222 - DNA, 25 bp, Mus musculus
agcatggccttaccatacttctgta

SEQ ID NO: 170223 - DNA, 25 bp, Mus musculus
agcatggccttagcatacttctgta

SEQ ID NO: 170224 - DNA, 25 bp, Mus musculus
agcatggccttattctagactcaca

SEQ ID NO: 170225 - DNA, 25 bp, Mus musculus
agcatggcgccgagcattggatgta

SEQ ID NO: 170226 - DNA, 25 bp, Mus musculus
agcatggcgccgtgcattggatgta

SEQ ID NO: 170227 - DNA, 25 bp, Mus musculus
agcatggcggcaaacataggtaaat

SEQ ID NO: 170228 - DNA, 25 bp, Mus musculus
agcatggcggcatacataggtaaat

SEQ ID NO: 170229 - DNA, 25 bp, Mus musculus
agcatggcgtagagcccagcctgga

SEQ ID NO: 170230 - DNA, 25 bp, Mus musculus
agcatggcgtagtgcccagcctgga

SEQ ID NO: 170231 - DNA, 25 bp, Mus musculus
agcatggctattagcccgtgaccaa

SEQ ID NO: 170232 - DNA, 25 bp, Mus musculus
agcatggctatttgcccgtgaccaa

SEQ ID NO: 170233 - DNA, 25 bp, Mus musculus
agcatggctcgcacggtgaccctgg

SEQ ID NO: 170234 - DNA, 25 bp, Mus musculus
agcatggctcgctcggtgaccctgg

SEQ ID NO: 170235 - DNA, 25 bp, Mus musculus
agcatggctctgaagaactcaccgt

SEQ ID NO: 170236 - DNA, 25 bp, Mus musculus
agcatggctctgagacacagcacag

SEQ ID NO: 170237 - DNA, 25 bp, Mus musculus
agcatggctctgcattgttttgaca

SEQ ID NO: 170238 - DNA, 25 bp, Mus musculus
agcatggctctggattgttttgaca

SEQ ID NO: 170239 - DNA, 25 bp, Mus musculus
agcatggctctgtagaactcaccgt

SEQ ID NO: 170240 - DNA, 25 bp, Mus musculus
agcatggctctgtgacacagcacag

SEQ ID NO: 170241 - DNA, 25 bp, Mus musculus
agcatggctgcccaatagtcgtcca

SEQ ID NO: 170242 - DNA, 25 bp, Mus musculus
agcatggctgccgaatagtcgtcca

SEQ ID NO: 170243 - DNA, 25 bp, Mus musculus
agcatggctgctcgcctctgggctt

SEQ ID NO: 170244 - DNA, 25 bp, Mus musculus
agcatggctgctggcctctgggctt

SEQ ID NO: 170245 - DNA, 25 bp, Mus musculus
agcatgggacaccctggttccaaac

SEQ ID NO: 170246 - DNA, 25 bp, Mus musculus
agcatgggacacgctggttccaaac

SEQ ID NO: 170247 - DNA, 25 bp, Mus musculus
agcatgggccaaccagtcaaattaa

SEQ ID NO: 170248 - DNA, 25 bp, Mus musculus
agcatgggccaagcagtcaaattaa

SEQ ID NO: 170249 - DNA, 25 bp, Mus musculus
agcatgggcccaaacaaggcagtca

SEQ ID NO: 170250 - DNA, 25 bp, Mus musculus
agcatgggcccatacaaggcagtca

SEQ ID NO: 170251 - DNA, 25 bp, Mus musculus
agcatgggccggcagtctcgccact

SEQ ID NO: 170252 - DNA, 25 bp, Mus musculus
agcatgggccgggagtctcgccact

SEQ ID NO: 170253 - DNA, 25 bp, Mus musculus
agcatgggcgcgatcaacgatccgt

SEQ ID NO: 170254 - DNA, 25 bp, Mus musculus
agcatgggcgcgttcaacgatccgt

SEQ ID NO: 170255 - DNA, 25 bp, Mus musculus
agcatgggctagagactgaaacctt

SEQ ID NO: 170256 - DNA, 25 bp, Mus musculus
agcatgggctagtgactgaaacctt

SEQ ID NO: 170257 - DNA, 25 bp, Mus musculus
agcatggtagggacccttcttaaca

SEQ ID NO: 170258 - DNA, 25 bp, Mus musculus
agcatggtagggtcccttcttaaca

SEQ ID NO: 170259 - DNA, 25 bp, Mus musculus
agcatggtattccaagctcctgatc

SEQ ID NO: 170260 - DNA, 25 bp, Mus musculus
agcatggtattcgaagctcctgatc

SEQ ID NO: 170261 - DNA, 25 bp, Mus musculus
agcatggtcaatccgcctaaggttt

SEQ ID NO: 170262 - DNA, 25 bp, Mus musculus
agcatggtcaatgcgcctaaggttt

SEQ ID NO: 170263 - DNA, 25 bp, Mus musculus
agcatggtcccacgcagtgtctttg

SEQ ID NO: 170264 - DNA, 25 bp, Mus musculus
agcatggtcccaggcagtgtctttg

SEQ ID NO: 170265 - DNA, 25 bp, Mus musculus
agcatggtcggaactcatcctcctg

SEQ ID NO: 170266 - DNA, 25 bp, Mus musculus
agcatggtcggatctcatcctcctg

SEQ ID NO: 170267 - DNA, 25 bp, Mus musculus
agcatggtcttcagtgtgaactcct

SEQ ID NO: 170268 - DNA, 25 bp, Mus musculus
agcatggtcttctgtgtgaactcct

SEQ ID NO: 170269 - DNA, 25 bp, Mus musculus
agcatggtgagcctgccagtgttca

SEQ ID NO: 170270 - DNA, 25 bp, Mus musculus
agcatggtgagcgtgccagtgttca

SEQ ID NO: 170271 - DNA, 25 bp, Mus musculus
agcatggtgcgccttgttatacctc

SEQ ID NO: 170272 - DNA, 25 bp, Mus musculus
agcatggtgcgcgttgttatacctc

SEQ ID NO: 170273 - DNA, 25 bp, Mus musculus
agcatggtgcttagctgtgcaatac

SEQ ID NO: 170274 - DNA, 25 bp, Mus musculus
agcatggtgctttgctgtgcaatac

SEQ ID NO: 170275 - DNA, 25 bp, Mus musculus
agcatggtggagctactagctgacc

SEQ ID NO: 170276 - DNA, 25 bp, Mus musculus
agcatggtggaggtactagctgacc

SEQ ID NO: 170277 - DNA, 25 bp, Mus musculus
agcatggttaatagtcagggtagaa

SEQ ID NO: 170278 - DNA, 25 bp, Mus musculus
agcatggttaattgtcagggtagaa

SEQ ID NO: 170279 - DNA, 25 bp, Mus musculus
agcatggttatgaggctctcctcag

SEQ ID NO: 170280 - DNA, 25 bp, Mus musculus
agcatggttatgtggctctcctcag

SEQ ID NO: 170281 - DNA, 25 bp, Mus musculus
agcatggttcataagttctaccggg

SEQ ID NO: 170282 - DNA, 25 bp, Mus musculus
agcatggttcattagttctaccggg

SEQ ID NO: 170283 - DNA, 25 bp, Mus musculus
agcatggtttataggtatctgtaat

SEQ ID NO: 170284 - DNA, 25 bp, Mus musculus
agcatggtttattggtatctgtaat

SEQ ID NO: 170285 - DNA, 25 bp, Mus musculus
agcatggtttgtcccatggcagtca

SEQ ID NO: 170286 - DNA, 25 bp, Mus musculus
agcatggtttgtgccatggcagtca

SEQ ID NO: 170287 - DNA, 25 bp, Mus musculus
agcatgtaacaactgggcccagtca

SEQ ID NO: 170288 - DNA, 25 bp, Mus musculus
agcatgtaacaagtgggcccagtca

SEQ ID NO: 170289 - DNA, 25 bp, Mus musculus
agcatgtaatgccattcgtttcatg

SEQ ID NO: 170290 - DNA, 25 bp, Mus musculus
agcatgtaatgcgattcgtttcatg

SEQ ID NO: 170291 - DNA, 25 bp, Mus musculus
agcatgtactctcgcggcttgagaa

SEQ ID NO: 170292 - DNA, 25 bp, Mus musculus
agcatgtactctggcggcttgagaa

SEQ ID NO: 170293 - DNA, 25 bp, Mus musculus
agcatgtactttatccaggtggtat

SEQ ID NO: 170294 - DNA, 25 bp, Mus musculus
agcatgtactttttccaggtggtat

SEQ ID NO: 170295 - DNA, 25 bp, Mus musculus
agcatgtagcccaaattttggagac

SEQ ID NO: 170296 - DNA, 25 bp, Mus musculus
agcatgtagccctaattttggagac

SEQ ID NO: 170297 - DNA, 25 bp, Mus musculus
agcatgtagcctaaaatgatccttc

SEQ ID NO: 170298 - DNA, 25 bp, Mus musculus
agcatgtagccttaaatgatccttc

SEQ ID NO: 170299 - DNA, 25 bp, Mus musculus
agcatgtatctgattttgcccctga

SEQ ID NO: 170300 - DNA, 25 bp, Mus musculus
agcatgtatctgtttttgcccctga

SEQ ID NO: 170301 - DNA, 25 bp, Mus musculus
agcatgtcaacaaaccatcgccagg

SEQ ID NO: 170302 - DNA, 25 bp, Mus musculus
agcatgtcaacataccatcgccagg

SEQ ID NO: 170303 - DNA, 25 bp, Mus musculus
agcatgtcaagaaaatttcacaaag

SEQ ID NO: 170304 - DNA, 25 bp, Mus musculus
agcatgtcaagaaaggtcaaccctg

SEQ ID NO: 170305 - DNA, 25 bp, Mus musculus
agcatgtcaagataatttcacaaag

SEQ ID NO: 170306 - DNA, 25 bp, Mus musculus
agcatgtcaagataggtcaaccctg

SEQ ID NO: 170307 - DNA, 25 bp, Mus musculus
agcatgtcaaggacctaggttccat

SEQ ID NO: 170308 - DNA, 25 bp, Mus musculus
agcatgtcaaggtcctaggttccat

SEQ ID NO: 170309 - DNA, 25 bp, Mus musculus
agcatgtccagtcctgtcctggcaa

SEQ ID NO: 170310 - DNA, 25 bp, Mus musculus
agcatgtccagtgctgtcctggcaa

SEQ ID NO: 170311 - DNA, 25 bp, Mus musculus
agcatgtcccaaacctacaacgact

SEQ ID NO: 170312 - DNA, 25 bp, Mus musculus
agcatgtcccaatcctacaacgact

SEQ ID NO: 170313 - DNA, 25 bp, Mus musculus
agcatgtcccatccatgttaagtat

SEQ ID NO: 170314 - DNA, 25 bp, Mus musculus
agcatgtcccatgcatgttaagtat

SEQ ID NO: 170315 - DNA, 25 bp, Mus musculus
agcatgtccctaccagaggccctag

SEQ ID NO: 170316 - DNA, 25 bp, Mus musculus
agcatgtccctagcagaggccctag

SEQ ID NO: 170317 - DNA, 25 bp, Mus musculus
agcatgtccctgacccctcagtgga

SEQ ID NO: 170318 - DNA, 25 bp, Mus musculus
agcatgtccctgtcccctcagtgga

SEQ ID NO: 170319 - DNA, 25 bp, Mus musculus
agcatgtctacaccatgcctggtgt

SEQ ID NO: 170320 - DNA, 25 bp, Mus musculus
agcatgtctacagcatgcctggtgt

SEQ ID NO: 170321 - DNA, 25 bp, Mus musculus
agcatgtctagcatctttctatttc

SEQ ID NO: 170322 - DNA, 25 bp, Mus musculus
agcatgtctagcttctttctatttc

SEQ ID NO: 170323 - DNA, 25 bp, Mus musculus
agcatgtctctcagttgtccgtcac

SEQ ID NO: 170324 - DNA, 25 bp, Mus musculus
agcatgtctctctgttgtccgtcac

SEQ ID NO: 170325 - DNA, 25 bp, Mus musculus
agcatgtctttaagatttcctgcat

SEQ ID NO: 170326 - DNA, 25 bp, Mus musculus
agcatgtctttatgatttcctgcat

SEQ ID NO: 170327 - DNA, 25 bp, Mus musculus
agcatgtgagtcagtcttagcaaaa

SEQ ID NO: 170328 - DNA, 25 bp, Mus musculus
agcatgtgagtctgtcttagcaaaa

SEQ ID NO: 170329 - DNA, 25 bp, Mus musculus
agcatgtgcataatccaggcccaga

SEQ ID NO: 170330 - DNA, 25 bp, Mus musculus
agcatgtgcatattccaggcccaga

SEQ ID NO: 170331 - DNA, 25 bp, Mus musculus
agcatgtgcctgctgtgaacagctc

SEQ ID NO: 170332 - DNA, 25 bp, Mus musculus
agcatgtgcctggtgtgaacagctc

SEQ ID NO: 170333 - DNA, 25 bp, Mus musculus
agcatgtgctaacagtcttcaggaa

SEQ ID NO: 170334 - DNA, 25 bp, Mus musculus
agcatgtgctaagagtcttcaggaa

SEQ ID NO: 170335 - DNA, 25 bp, Mus musculus
agcatgtgctgcacttaacaggacc

SEQ ID NO: 170336 - DNA, 25 bp, Mus musculus
agcatgtgctgctcttaacaggacc

SEQ ID NO: 170337 - DNA, 25 bp, Mus musculus
agcatgtgctggctcaactccgtat

SEQ ID NO: 170338 - DNA, 25 bp, Mus musculus
agcatgtgctgggtcaactccgtat

SEQ ID NO: 170339 - DNA, 25 bp, Mus musculus
agcatgtgcttgcaaatcagatgtc

SEQ ID NO: 170340 - DNA, 25 bp, Mus musculus
agcatgtgcttggaaatcagatgtc

SEQ ID NO: 170341 - DNA, 25 bp, Mus musculus
agcatgtggcttacagtctgagtta

SEQ ID NO: 170342 - DNA, 25 bp, Mus musculus
agcatgtggctttcagtctgagtta

SEQ ID NO: 170343 - DNA, 25 bp, Mus musculus
agcatgtggtgacagttggcatcct

SEQ ID NO: 170344 - DNA, 25 bp, Mus musculus
agcatgtggtgagagttggcatcct

SEQ ID NO: 170345 - DNA, 25 bp, Mus musculus
agcatgtggttgcttcactcctgga

SEQ ID NO: 170346 - DNA, 25 bp, Mus musculus
agcatgtggttggttcactcctgga

SEQ ID NO: 170347 - DNA, 25 bp, Mus musculus
agcatgtggtttccagtcaatccca

SEQ ID NO: 170348 - DNA, 25 bp, Mus musculus
agcatgtggtttgcagtcaatccca

SEQ ID NO: 170349 - DNA, 25 bp, Mus musculus
agcatgtgtccactccaagacctgc

SEQ ID NO: 170350 - DNA, 25 bp, Mus musculus
agcatgtgtccagtccaagacctgc

SEQ ID NO: 170351 - DNA, 25 bp, Mus musculus
agcatgtgtgatctattgatcccta

SEQ ID NO: 170352 - DNA, 25 bp, Mus musculus
agcatgtgtgatgtattgatcccta

SEQ ID NO: 170353 - DNA, 25 bp, Mus musculus
agcatgtgtgctacctttcatttgc

SEQ ID NO: 170354 - DNA, 25 bp, Mus musculus
agcatgtgtgcttcctttcatttgc

SEQ ID NO: 170355 - DNA, 25 bp, Mus musculus
agcatgttccataaaatgtagttaa

SEQ ID NO: 170356 - DNA, 25 bp, Mus musculus
agcatgttccattaaatgtagttaa

SEQ ID NO: 170357 - DNA, 25 bp, Mus musculus
agcatgttcctaaagttatttgtat

SEQ ID NO: 170358 - DNA, 25 bp, Mus musculus
agcatgttcctatagttatttgtat

SEQ ID NO: 170359 - DNA, 25 bp, Mus musculus
agcatgttccttccaaccaaagaga

SEQ ID NO: 170360 - DNA, 25 bp, Mus musculus
agcatgttccttgcaaccaaagaga

SEQ ID NO: 170361 - DNA, 25 bp, Mus musculus
agcatgttcgcgcttagtgtcagag

SEQ ID NO: 170362 - DNA, 25 bp, Mus musculus
agcatgttcgcggttagtgtcagag

SEQ ID NO: 170363 - DNA, 25 bp, Mus musculus
agcatgttgcccaaagctttcactt

SEQ ID NO: 170364 - DNA, 25 bp, Mus musculus
agcatgttgcccactaatttaaaaa

SEQ ID NO: 170365 - DNA, 25 bp, Mus musculus
agcatgttgccctaagctttcactt

SEQ ID NO: 170366 - DNA, 25 bp, Mus musculus
agcatgttgccctctaatttaaaaa

SEQ ID NO: 170367 - DNA, 25 bp, Mus musculus
agcatgttgtagctaccggtggcca

SEQ ID NO: 170368 - DNA, 25 bp, Mus musculus
agcatgttgtaggtaccggtggcca

SEQ ID NO: 170369 - DNA, 25 bp, Mus musculus
agcatgtttataattccatccctgc

SEQ ID NO: 170370 - DNA, 25 bp, Mus musculus
agcatgtttatatttccatccctgc

SEQ ID NO: 170371 - DNA, 25 bp, Mus musculus
agcatgtttcttctcctattgttta

SEQ ID NO: 170372 - DNA, 25 bp, Mus musculus
agcatgtttcttgtcctattgttta

SEQ ID NO: 170373 - DNA, 25 bp, Mus musculus
agcatgtttggactgctggaccagt

SEQ ID NO: 170374 - DNA, 25 bp, Mus musculus
agcatgtttggagtgctggaccagt

SEQ ID NO: 170375 - DNA, 25 bp, Mus musculus
agcatgttttccacatgtccgatag

SEQ ID NO: 170376 - DNA, 25 bp, Mus musculus
agcatgttttcctcatgtccgatag

SEQ ID NO: 170377 - DNA, 25 bp, Mus musculus
agcatgttttctaaatgtgaaactc

SEQ ID NO: 170378 - DNA, 25 bp, Mus musculus
agcatgttttctccaccgatggcca

SEQ ID NO: 170379 - DNA, 25 bp, Mus musculus
agcatgttttctgcaccgatggcca

SEQ ID NO: 170380 - DNA, 25 bp, Mus musculus
agcatgttttcttaatgtgaaactc

SEQ ID NO: 170381 - DNA, 25 bp, Mus musculus
agcattaaacataccccaagcattc

SEQ ID NO: 170382 - DNA, 25 bp, Mus musculus
agcattaaacattccccaagcattc

SEQ ID NO: 170383 - DNA, 25 bp, Mus musculus
agcattaagagcataactgctttaa

SEQ ID NO: 170384 - DNA, 25 bp, Mus musculus
agcattaagagcttaactgctttaa

SEQ ID NO: 170385 - DNA, 25 bp, Mus musculus
agcattaatcgcatctgcctcgtga

SEQ ID NO: 170386 - DNA, 25 bp, Mus musculus
agcattaatcgcttctgcctcgtga

SEQ ID NO: 170387 - DNA, 25 bp, Mus musculus
agcattaatggtactccccaccaga

SEQ ID NO: 170388 - DNA, 25 bp, Mus musculus
agcattaatggttctccccaccaga

SEQ ID NO: 170389 - DNA, 25 bp, Mus musculus
agcattaattctatgcttccattat

SEQ ID NO: 170390 - DNA, 25 bp, Mus musculus
agcattaattctttgcttccattat

SEQ ID NO: 170391 - DNA, 25 bp, Mus musculus
agcattacacccctcaaatatgaat

SEQ ID NO: 170392 - DNA, 25 bp, Mus musculus
agcattacacccgtcaaatatgaat

SEQ ID NO: 170393 - DNA, 25 bp, Mus musculus
agcattactatgaccgatcccagag

SEQ ID NO: 170394 - DNA, 25 bp, Mus musculus
agcattactatgtccgatcccagag

SEQ ID NO: 170395 - DNA, 25 bp, Mus musculus
agcattactccaacatttcagctaa

SEQ ID NO: 170396 - DNA, 25 bp, Mus musculus
agcattactccatcatttcagctaa

SEQ ID NO: 170397 - DNA, 25 bp, Mus musculus
agcattactccgagtttccataagg

SEQ ID NO: 170398 - DNA, 25 bp, Mus musculus
agcattactccgtgtttccataagg

SEQ ID NO: 170399 - DNA, 25 bp, Mus musculus
agcattacttctcttccaaaggtca

SEQ ID NO: 170400 - DNA, 25 bp, Mus musculus
agcattacttctgttccaaaggtca

SEQ ID NO: 170401 - DNA, 25 bp, Mus musculus
agcattacttggatggtcccgatga

SEQ ID NO: 170402 - DNA, 25 bp, Mus musculus
agcattacttggttggtcccgatga

SEQ ID NO: 170403 - DNA, 25 bp, Mus musculus
agcattagattaaaccggccttggt

SEQ ID NO: 170404 - DNA, 25 bp, Mus musculus
agcattagattataccggccttggt

SEQ ID NO: 170405 - DNA, 25 bp, Mus musculus
agcattagcgctcgttttaagggcc

SEQ ID NO: 170406 - DNA, 25 bp, Mus musculus
agcattagcgctggttttaagggcc

SEQ ID NO: 170407 - DNA, 25 bp, Mus musculus
agcattagcggtatcctcctgaaaa

SEQ ID NO: 170408 - DNA, 25 bp, Mus musculus
agcattagcggtttcctcctgaaaa

SEQ ID NO: 170409 - DNA, 25 bp, Mus musculus
agcattagctacagaaggacatggc

SEQ ID NO: 170410 - DNA, 25 bp, Mus musculus
agcattagctactgaaggacatggc

SEQ ID NO: 170411 - DNA, 25 bp, Mus musculus
agcattagctgcaggccggcagaac

SEQ ID NO: 170412 - DNA, 25 bp, Mus musculus
agcattagctgctggccggcagaac

SEQ ID NO: 170413 - DNA, 25 bp, Mus musculus
agcattaggcttattcccttttcag

SEQ ID NO: 170414 - DNA, 25 bp, Mus musculus
agcattaggctttttcccttttcag

SEQ ID NO: 170415 - DNA, 25 bp, Mus musculus
agcattaggtttagatcactttttc

SEQ ID NO: 170416 - DNA, 25 bp, Mus musculus
agcattaggttttgatcactttttc

SEQ ID NO: 170417 - DNA, 25 bp, Mus musculus
agcattagtggtactgtggaggcct

SEQ ID NO: 170418 - DNA, 25 bp, Mus musculus
agcattagtggttctgtggaggcct

SEQ ID NO: 170419 - DNA, 25 bp, Mus musculus
agcattataccaagggctgtcctgt

SEQ ID NO: 170420 - DNA, 25 bp, Mus musculus
agcattataccatgggctgtcctgt

SEQ ID NO: 170421 - DNA, 25 bp, Mus musculus
agcattatgccaagttcatacctga

SEQ ID NO: 170422 - DNA, 25 bp, Mus musculus
agcattatgccatgttcatacctga

SEQ ID NO: 170423 - DNA, 25 bp, Mus musculus
agcattatgcttaccaggttaactg

SEQ ID NO: 170424 - DNA, 25 bp, Mus musculus
agcattatgctttccaggttaactg

SEQ ID NO: 170425 - DNA, 25 bp, Mus musculus
agcattattacaaccttctttcatc

SEQ ID NO: 170426 - DNA, 25 bp, Mus musculus
agcattattacatccttctttcatc

SEQ ID NO: 170427 - DNA, 25 bp, Mus musculus
agcattcaaaatctttacccatcaa

SEQ ID NO: 170428 - DNA, 25 bp, Mus musculus
agcattcaaaatgtttacccatcaa

SEQ ID NO: 170429 - DNA, 25 bp, Mus musculus
agcattcaactcagtctactgttag

SEQ ID NO: 170430 - DNA, 25 bp, Mus musculus
agcattcaactctgtctactgttag

SEQ ID NO: 170431 - DNA, 25 bp, Mus musculus
agcattcaagcacatggcctggtgt

SEQ ID NO: 170432 - DNA, 25 bp, Mus musculus
agcattcaagcagatggcctggtgt

SEQ ID NO: 170433 - DNA, 25 bp, Mus musculus
agcattcaccgtacgtattctcttt

SEQ ID NO: 170434 - DNA, 25 bp, Mus musculus
agcattcaccgttcgtattctcttt

SEQ ID NO: 170435 - DNA, 25 bp, Mus musculus
agcattcagactcatgccggacggg

SEQ ID NO: 170436 - DNA, 25 bp, Mus musculus
agcattcagactgatgccggacggg

SEQ ID NO: 170437 - DNA, 25 bp, Mus musculus
agcattcagataaacgagcccacaa

SEQ ID NO: 170438 - DNA, 25 bp, Mus musculus
agcattcagatatacgagcccacaa

SEQ ID NO: 170439 - DNA, 25 bp, Mus musculus
agcattcaggatcgagagaccggca

SEQ ID NO: 170440 - DNA, 25 bp, Mus musculus
agcattcaggatggagagaccggca

SEQ ID NO: 170441 - DNA, 25 bp, Mus musculus
agcattcatacaacttcggccaaag

SEQ ID NO: 170442 - DNA, 25 bp, Mus musculus
agcattcatacatcttcggccaaag

SEQ ID NO: 170443 - DNA, 25 bp, Mus musculus
agcattcatcagcatcacagaggtg

SEQ ID NO: 170444 - DNA, 25 bp, Mus musculus
agcattcatcaggatcacagaggtg

SEQ ID NO: 170445 - DNA, 25 bp, Mus musculus
agcattcatccactattctctctgt

SEQ ID NO: 170446 - DNA, 25 bp, Mus musculus
agcattcatccagtattctctctgt

SEQ ID NO: 170447 - DNA, 25 bp, Mus musculus
agcattcatcggcttgtcctgggaa

SEQ ID NO: 170448 - DNA, 25 bp, Mus musculus
agcattcatcgggttgtcctgggaa

SEQ ID NO: 170449 - DNA, 25 bp, Mus musculus
agcattcatggacatcccctctgtg

SEQ ID NO: 170450 - DNA, 25 bp, Mus musculus
agcattcatggagatcccctctgtg

SEQ ID NO: 170451 - DNA, 25 bp, Mus musculus
agcattcatttgaggtaggagtcag

SEQ ID NO: 170452 - DNA, 25 bp, Mus musculus
agcattcatttgtggtaggagtcag

SEQ ID NO: 170453 - DNA, 25 bp, Mus musculus
agcattccaagaaccaagagccatt

SEQ ID NO: 170454 - DNA, 25 bp, Mus musculus
agcattccaagatccaagagccatt

SEQ ID NO: 170455 - DNA, 25 bp, Mus musculus
agcattccaccaactcagaacagag

SEQ ID NO: 170456 - DNA, 25 bp, Mus musculus
agcattccaccatctcagaacagag

SEQ ID NO: 170457 - DNA, 25 bp, Mus musculus
agcattccagaaacctaccatatta

SEQ ID NO: 170458 - DNA, 25 bp, Mus musculus
agcattccagaatcctaccatatta

SEQ ID NO: 170459 - DNA, 25 bp, Mus musculus
agcattccagctatgatcatgttga

SEQ ID NO: 170460 - DNA, 25 bp, Mus musculus
agcattccagctttgatcatgttga

SEQ ID NO: 170461 - DNA, 25 bp, Mus musculus
agcattcccagtcctaagctgtcca

SEQ ID NO: 170462 - DNA, 25 bp, Mus musculus
agcattcccagtgctaagctgtcca

SEQ ID NO: 170463 - DNA, 25 bp, Mus musculus
agcattcccctcactaaaatgtcaa

SEQ ID NO: 170464 - DNA, 25 bp, Mus musculus
agcattcccctctctaaaatgtcaa

SEQ ID NO: 170465 - DNA, 25 bp, Mus musculus
agcattcccgttctgaatcctgatt

SEQ ID NO: 170466 - DNA, 25 bp, Mus musculus
agcattcccgttgtgaatcctgatt

SEQ ID NO: 170467 - DNA, 25 bp, Mus musculus
agcattccctccatcttgcgatgga

SEQ ID NO: 170468 - DNA, 25 bp, Mus musculus
agcattccctccttcttgcgatgga

SEQ ID NO: 170469 - DNA, 25 bp, Mus musculus
agcattcctcacagctcacaaaggc

SEQ ID NO: 170470 - DNA, 25 bp, Mus musculus
agcattcctcactgctcacaaaggc

SEQ ID NO: 170471 - DNA, 25 bp, Mus musculus
agcattcctcatactgtcatggtga

SEQ ID NO: 170472 - DNA, 25 bp, Mus musculus
agcattcctcattctgtcatggtga

SEQ ID NO: 170473 - DNA, 25 bp, Mus musculus
agcattcctcccaataaatataaaa

SEQ ID NO: 170474 - DNA, 25 bp, Mus musculus
agcattcctccctataaatataaaa

SEQ ID NO: 170475 - DNA, 25 bp, Mus musculus
agcattcctcgaaatggcttcacag

SEQ ID NO: 170476 - DNA, 25 bp, Mus musculus
agcattcctcgatatggcttcacag

SEQ ID NO: 170477 - DNA, 25 bp, Mus musculus
agcattcctgagatgcctaactttt

SEQ ID NO: 170478 - DNA, 25 bp, Mus musculus
agcattcctgagttgcctaactttt

SEQ ID NO: 170479 - DNA, 25 bp, Mus musculus
agcattcctgtcagaaggctcacaa

SEQ ID NO: 170480 - DNA, 25 bp, Mus musculus
agcattcctgtctgaaggctcacaa

SEQ ID NO: 170481 - DNA, 25 bp, Mus musculus
agcattcctgttacgttcagctgca

SEQ ID NO: 170482 - DNA, 25 bp, Mus musculus
agcattcctgtttcgttcagctgca

SEQ ID NO: 170483 - DNA, 25 bp, Mus musculus
agcattccttgcacatgtagcttag

SEQ ID NO: 170484 - DNA, 25 bp, Mus musculus
agcattccttgctcatgtagcttag

SEQ ID NO: 170485 - DNA, 25 bp, Mus musculus
agcattcgctgcacgaggaggacac

SEQ ID NO: 170486 - DNA, 25 bp, Mus musculus
agcattcgctgctcgaggaggacac

SEQ ID NO: 170487 - DNA, 25 bp, Mus musculus
agcattcggcagctcttcactatta

SEQ ID NO: 170488 - DNA, 25 bp, Mus musculus
agcattcggcaggtcttcactatta

SEQ ID NO: 170489 - DNA, 25 bp, Mus musculus
agcattctaactaaaggttcccaag

SEQ ID NO: 170490 - DNA, 25 bp, Mus musculus
agcattctaacttaaggttcccaag

SEQ ID NO: 170491 - DNA, 25 bp, Mus musculus
agcattctcaacaaacctggacaag

SEQ ID NO: 170492 - DNA, 25 bp, Mus musculus
agcattctcaactaacctggacaag

SEQ ID NO: 170493 - DNA, 25 bp, Mus musculus
agcattctcagcctgtggcagtaaa

SEQ ID NO: 170494 - DNA, 25 bp, Mus musculus
agcattctcagcgtgtggcagtaaa

SEQ ID NO: 170495 - DNA, 25 bp, Mus musculus
agcattctcatgcttctagtctgtc

SEQ ID NO: 170496 - DNA, 25 bp, Mus musculus
agcattctcatggttctagtctgtc

SEQ ID NO: 170497 - DNA, 25 bp, Mus musculus
agcattctctaactttggattcaaa

SEQ ID NO: 170498 - DNA, 25 bp, Mus musculus
agcattctctaagtttggattcaaa

SEQ ID NO: 170499 - DNA, 25 bp, Mus musculus
agcattctgacacctgccttactaa

SEQ ID NO: 170500 - DNA, 25 bp, Mus musculus
agcattctgacagctgccttactaa

SEQ ID NO: 170501 - DNA, 25 bp, Mus musculus
agcattctgccacggaatagtttta

SEQ ID NO: 170502 - DNA, 25 bp, Mus musculus
agcattctgccagggaatagtttta

SEQ ID NO: 170503 - DNA, 25 bp, Mus musculus
agcattctgcccctgagctaggctt

SEQ ID NO: 170504 - DNA, 25 bp, Mus musculus
agcattctgcccgtgagctaggctt

SEQ ID NO: 170505 - DNA, 25 bp, Mus musculus
agcattctggttcataggcgttttg

SEQ ID NO: 170506 - DNA, 25 bp, Mus musculus
agcattctggttgataggcgttttg

SEQ ID NO: 170507 - DNA, 25 bp, Mus musculus
agcattctgtgacagcgtgtccctt

SEQ ID NO: 170508 - DNA, 25 bp, Mus musculus
agcattctgtgagagcgtgtccctt

SEQ ID NO: 170509 - DNA, 25 bp, Mus musculus
agcattctgtgcagcccttgggttt

SEQ ID NO: 170510 - DNA, 25 bp, Mus musculus
agcattctgtgctgcccttgggttt

SEQ ID NO: 170511 - DNA, 25 bp, Mus musculus
agcattctgttgatgtttcttcgtt

SEQ ID NO: 170512 - DNA, 25 bp, Mus musculus
agcattctgttgttgtttcttcgtt

SEQ ID NO: 170513 - DNA, 25 bp, Mus musculus
agcattgaactgaattatgtgtttt

SEQ ID NO: 170514 - DNA, 25 bp, Mus musculus
agcattgaactgtattatgtgtttt

SEQ ID NO: 170515 - DNA, 25 bp, Mus musculus
agcattgaagcaacgtgcggtgtcc

SEQ ID NO: 170516 - DNA, 25 bp, Mus musculus
agcattgaagcatcgtgcggtgtcc

SEQ ID NO: 170517 - DNA, 25 bp, Mus musculus
agcattgaatacaactgtctcacaa

SEQ ID NO: 170518 - DNA, 25 bp, Mus musculus
agcattgaatactactgtctcacaa

SEQ ID NO: 170519 - DNA, 25 bp, Mus musculus
agcattgaatggatgcaccaccatt

SEQ ID NO: 170520 - DNA, 25 bp, Mus musculus
agcattgaatggttgcaccaccatt

SEQ ID NO: 170521 - DNA, 25 bp, Mus musculus
agcattgaccttcagtatgtgcccc

SEQ ID NO: 170522 - DNA, 25 bp, Mus musculus
agcattgaccttgagtatgtgcccc

SEQ ID NO: 170523 - DNA, 25 bp, Mus musculus
agcattgacttcaattgggctttga

SEQ ID NO: 170524 - DNA, 25 bp, Mus musculus
agcattgacttctattgggctttga

SEQ ID NO: 170525 - DNA, 25 bp, Mus musculus
agcattgaggtaccccaagagtcac

SEQ ID NO: 170526 - DNA, 25 bp, Mus musculus
agcattgaggtagcccaagagtcac

SEQ ID NO: 170527 - DNA, 25 bp, Mus musculus
agcattgaggtcaaagggcctccgg

SEQ ID NO: 170528 - DNA, 25 bp, Mus musculus
agcattgaggtctaagggcctccgg

SEQ ID NO: 170529 - DNA, 25 bp, Mus musculus
agcattgagtttacacttctgttaa

SEQ ID NO: 170530 - DNA, 25 bp, Mus musculus
agcattgagttttcacttctgttaa

SEQ ID NO: 170531 - DNA, 25 bp, Mus musculus
agcattgatccactgccacggcacg

SEQ ID NO: 170532 - DNA, 25 bp, Mus musculus
agcattgatccagtgccacggcacg

SEQ ID NO: 170533 - DNA, 25 bp, Mus musculus
agcattgattccaagggagctgact

SEQ ID NO: 170534 - DNA, 25 bp, Mus musculus
agcattgattcctagggagctgact

SEQ ID NO: 170535 - DNA, 25 bp, Mus musculus
agcattgcaaaaacccagtgctccc

SEQ ID NO: 170536 - DNA, 25 bp, Mus musculus
agcattgcaaaatcccagtgctccc

SEQ ID NO: 170537 - DNA, 25 bp, Mus musculus
agcattgcacaacacccggcctgaa

SEQ ID NO: 170538 - DNA, 25 bp, Mus musculus
agcattgcacaagacccggcctgaa

SEQ ID NO: 170539 - DNA, 25 bp, Mus musculus
agcattgcaccaagggttctcctgt

SEQ ID NO: 170540 - DNA, 25 bp, Mus musculus
agcattgcaccatgggttctcctgt

SEQ ID NO: 170541 - DNA, 25 bp, Mus musculus
agcattgcactgctgttgacgcatg

SEQ ID NO: 170542 - DNA, 25 bp, Mus musculus
agcattgcactggtgttgacgcatg

SEQ ID NO: 170543 - DNA, 25 bp, Mus musculus
agcattgcatgtatgtgacacgtaa

SEQ ID NO: 170544 - DNA, 25 bp, Mus musculus
agcattgcatgtttgtgacacgtaa

SEQ ID NO: 170545 - DNA, 25 bp, Mus musculus
agcattgccaaaaaacccctgattt

SEQ ID NO: 170546 - DNA, 25 bp, Mus musculus
agcattgccaaataacccctgattt

SEQ ID NO: 170547 - DNA, 25 bp, Mus musculus
agcattgcctagacccagcaggacc

SEQ ID NO: 170548 - DNA, 25 bp, Mus musculus
agcattgcctagtcccagcaggacc

SEQ ID NO: 170549 - DNA, 25 bp, Mus musculus
agcattgcctgtcttgtttgagatt

SEQ ID NO: 170550 - DNA, 25 bp, Mus musculus
agcattgcctgtgttgtttgagatt

SEQ ID NO: 170551 - DNA, 25 bp, Mus musculus
agcattgctaatcccaaagccgagg

SEQ ID NO: 170552 - DNA, 25 bp, Mus musculus
agcattgctaatgccaaagccgagg

SEQ ID NO: 170553 - DNA, 25 bp, Mus musculus
agcattgctcttattatgtacgtca

SEQ ID NO: 170554 - DNA, 25 bp, Mus musculus
agcattgctctttttatgtacgtca

SEQ ID NO: 170555 - DNA, 25 bp, Mus musculus
agcattgctgtaaagtttctcccac

SEQ ID NO: 170556 - DNA, 25 bp, Mus musculus
agcattgctgtatagtttctcccac

SEQ ID NO: 170557 - DNA, 25 bp, Mus musculus
agcattgctgttaccctgtgtttgg

SEQ ID NO: 170558 - DNA, 25 bp, Mus musculus
agcattgctgtttccctgtgtttgg

SEQ ID NO: 170559 - DNA, 25 bp, Mus musculus
agcattgcttctcctctggagctga

SEQ ID NO: 170560 - DNA, 25 bp, Mus musculus
agcattgcttctgctctggagctga

SEQ ID NO: 170561 - DNA, 25 bp, Mus musculus
agcattgcttttcagtgctctgtga

SEQ ID NO: 170562 - DNA, 25 bp, Mus musculus
agcattgcttttgagtgctctgtga

SEQ ID NO: 170563 - DNA, 25 bp, Mus musculus
agcattggaaatagggttctccttc

SEQ ID NO: 170564 - DNA, 25 bp, Mus musculus
agcattggaaattgggttctccttc

SEQ ID NO: 170565 - DNA, 25 bp, Mus musculus
agcattggagatccactcatcctct

SEQ ID NO: 170566 - DNA, 25 bp, Mus musculus
agcattggagatgcactcatcctct

SEQ ID NO: 170567 - DNA, 25 bp, Mus musculus
agcattggattcaggtcaaagacca

SEQ ID NO: 170568 - DNA, 25 bp, Mus musculus
agcattggattctggtcaaagacca

SEQ ID NO: 170569 - DNA, 25 bp, Mus musculus
agcattggcaatactgtttgtatac

SEQ ID NO: 170570 - DNA, 25 bp, Mus musculus
agcattggcaattctgtttgtatac

SEQ ID NO: 170571 - DNA, 25 bp, Mus musculus
agcattggcgataataaattttctt

SEQ ID NO: 170572 - DNA, 25 bp, Mus musculus
agcattggcgattataaattttctt

SEQ ID NO: 170573 - DNA, 25 bp, Mus musculus
agcattgggatcaagctgctgcttc

SEQ ID NO: 170574 - DNA, 25 bp, Mus musculus
agcattgggatctagctgctgcttc

SEQ ID NO: 170575 - DNA, 25 bp, Mus musculus
agcattgggccaaccagtgaccaag

SEQ ID NO: 170576 - DNA, 25 bp, Mus musculus
agcattgggccatccagtgaccaag

SEQ ID NO: 170577 - DNA, 25 bp, Mus musculus
agcattgggtagagacgccccttgg

SEQ ID NO: 170578 - DNA, 25 bp, Mus musculus
agcattgggtagtgacgccccttgg

SEQ ID NO: 170579 - DNA, 25 bp, Mus musculus
agcattggtgaaatgcctgctgccc

SEQ ID NO: 170580 - DNA, 25 bp, Mus musculus
agcattggtgaattgcctgctgccc

SEQ ID NO: 170581 - DNA, 25 bp, Mus musculus
agcattgtaccaactaaccttccat

SEQ ID NO: 170582 - DNA, 25 bp, Mus musculus
agcattgtaccatctaaccttccat

SEQ ID NO: 170583 - DNA, 25 bp, Mus musculus
agcattgtacgacctgacgcgtgta

SEQ ID NO: 170584 - DNA, 25 bp, Mus musculus
agcattgtacgagctgacgcgtgta

SEQ ID NO: 170585 - DNA, 25 bp, Mus musculus
agcattgtactcactctaccctagt

SEQ ID NO: 170586 - DNA, 25 bp, Mus musculus
agcattgtactctctctaccctagt

SEQ ID NO: 170587 - DNA, 25 bp, Mus musculus
agcattgtaggaaagggtcagtcac

SEQ ID NO: 170588 - DNA, 25 bp, Mus musculus
agcattgtaggatagggtcagtcac

SEQ ID NO: 170589 - DNA, 25 bp, Mus musculus
agcattgtatcacagccagacttct

SEQ ID NO: 170590 - DNA, 25 bp, Mus musculus
agcattgtatcagagccagacttct

SEQ ID NO: 170591 - DNA, 25 bp, Mus musculus
agcattgtatttactcgcatccctt

SEQ ID NO: 170592 - DNA, 25 bp, Mus musculus
agcattgtattttctcgcatccctt

SEQ ID NO: 170593 - DNA, 25 bp, Mus musculus
agcattgtcaatctagagtaccagt

SEQ ID NO: 170594 - DNA, 25 bp, Mus musculus
agcattgtcaatgtagagtaccagt

SEQ ID NO: 170595 - DNA, 25 bp, Mus musculus
agcattgtcattcgcccgctggagc

SEQ ID NO: 170596 - DNA, 25 bp, Mus musculus
agcattgtcattggcccgctggagc

SEQ ID NO: 170597 - DNA, 25 bp, Mus musculus
agcattgtcctccatggagccactt

SEQ ID NO: 170598 - DNA, 25 bp, Mus musculus
agcattgtcctcgatggagccactt

SEQ ID NO: 170599 - DNA, 25 bp, Mus musculus
agcattgtccttctgactcttagac

SEQ ID NO: 170600 - DNA, 25 bp, Mus musculus
agcattgtccttgtgactcttagac

SEQ ID NO: 170601 - DNA, 25 bp, Mus musculus
agcattgtctcaagggctcatttta

SEQ ID NO: 170602 - DNA, 25 bp, Mus musculus
agcattgtctcatgggctcatttta

SEQ ID NO: 170603 - DNA, 25 bp, Mus musculus
agcattgtctgccacatgggtgtac

SEQ ID NO: 170604 - DNA, 25 bp, Mus musculus
agcattgtctgcgacatgggtgtac

SEQ ID NO: 170605 - DNA, 25 bp, Mus musculus
agcattgtgcacacagagaccgtat

SEQ ID NO: 170606 - DNA, 25 bp, Mus musculus
agcattgtgcactcagagaccgtat

SEQ ID NO: 170607 - DNA, 25 bp, Mus musculus
agcattgtgcataggtcagctctgc

SEQ ID NO: 170608 - DNA, 25 bp, Mus musculus
agcattgtgcattggtcagctctgc

SEQ ID NO: 170609 - DNA, 25 bp, Mus musculus
agcattgtggttactcctaacgtgt

SEQ ID NO: 170610 - DNA, 25 bp, Mus musculus
agcattgtggtttctcctaacgtgt

SEQ ID NO: 170611 - DNA, 25 bp, Mus musculus
agcattgtgtgccattccagtgata

SEQ ID NO: 170612 - DNA, 25 bp, Mus musculus
agcattgtgtgcgattccagtgata

SEQ ID NO: 170613 - DNA, 25 bp, Mus musculus
agcattgttcatatccagtatagag

SEQ ID NO: 170614 - DNA, 25 bp, Mus musculus
agcattgttcatttccagtatagag

SEQ ID NO: 170615 - DNA, 25 bp, Mus musculus
agcattgttccacgcaattttgaga

SEQ ID NO: 170616 - DNA, 25 bp, Mus musculus
agcattgttccaggcaattttgaga

SEQ ID NO: 170617 - DNA, 25 bp, Mus musculus
agcattgttggtctcttggctggcc

SEQ ID NO: 170618 - DNA, 25 bp, Mus musculus
agcattgttggtgtcttggctggcc

SEQ ID NO: 170619 - DNA, 25 bp, Mus musculus
agcattgttgtgcaggccctgagct

SEQ ID NO: 170620 - DNA, 25 bp, Mus musculus
agcattgttgtggaggccctgagct

SEQ ID NO: 170621 - DNA, 25 bp, Mus musculus
agcattgttgttcctgtgcctcaag

SEQ ID NO: 170622 - DNA, 25 bp, Mus musculus
agcattgttgttgctgtgcctcaag

SEQ ID NO: 170623 - DNA, 25 bp, Mus musculus
agcattgtttaacccagcgctggca

SEQ ID NO: 170624 - DNA, 25 bp, Mus musculus
agcattgtttaagccagcgctggca

SEQ ID NO: 170625 - DNA, 25 bp, Mus musculus
agcattgtttctacactccaggctt

SEQ ID NO: 170626 - DNA, 25 bp, Mus musculus
agcattgtttcttcactccaggctt

SEQ ID NO: 170627 - DNA, 25 bp, Mus musculus
agcattgtttgcacatagtatgtgt

SEQ ID NO: 170628 - DNA, 25 bp, Mus musculus
agcattgtttgcatattgttccaag

SEQ ID NO: 170629 - DNA, 25 bp, Mus musculus
agcattgtttgctcatagtatgtgt

SEQ ID NO: 170630 - DNA, 25 bp, Mus musculus
agcattgtttgcttattgttccaag

SEQ ID NO: 170631 - DNA, 25 bp, Mus musculus
agcattgttttcaattcagacctcc

SEQ ID NO: 170632 - DNA, 25 bp, Mus musculus
agcattgttttctattcagacctcc

SEQ ID NO: 170633 - DNA, 25 bp, Mus musculus
agcatttaactactctttgtgatga

SEQ ID NO: 170634 - DNA, 25 bp, Mus musculus
agcatttaactagtctttgtgatga

SEQ ID NO: 170635 - DNA, 25 bp, Mus musculus
agcatttaagctctgaccactgtac

SEQ ID NO: 170636 - DNA, 25 bp, Mus musculus
agcatttaagctgtgaccactgtac

SEQ ID NO: 170637 - DNA, 25 bp, Mus musculus
agcatttaagtgagttccttcctcc

SEQ ID NO: 170638 - DNA, 25 bp, Mus musculus
agcatttaagtgtgttccttcctcc

SEQ ID NO: 170639 - DNA, 25 bp, Mus musculus
agcatttaataaccttcatacctga

SEQ ID NO: 170640 - DNA, 25 bp, Mus musculus
agcatttaataagcttcatacctga

SEQ ID NO: 170641 - DNA, 25 bp, Mus musculus
agcatttaattcactgacctggaag

SEQ ID NO: 170642 - DNA, 25 bp, Mus musculus
agcatttaattctctgacctggaag

SEQ ID NO: 170643 - DNA, 25 bp, Mus musculus
agcatttacctaattgcccaagcct

SEQ ID NO: 170644 - DNA, 25 bp, Mus musculus
agcatttacctactggtgttcccaa

SEQ ID NO: 170645 - DNA, 25 bp, Mus musculus
agcatttacctagtggtgttcccaa

SEQ ID NO: 170646 - DNA, 25 bp, Mus musculus
agcatttacctatttgcccaagcct

SEQ ID NO: 170647 - DNA, 25 bp, Mus musculus
agcatttacctgactgtccaagctg

SEQ ID NO: 170648 - DNA, 25 bp, Mus musculus
agcatttacctgtctgtccaagctg

SEQ ID NO: 170649 - DNA, 25 bp, Mus musculus
agcatttactgaactcgtgactccg

SEQ ID NO: 170650 - DNA, 25 bp, Mus musculus
agcatttactgatctcgtgactccg

SEQ ID NO: 170651 - DNA, 25 bp, Mus musculus
agcatttaggtgactgttcagcagt

SEQ ID NO: 170652 - DNA, 25 bp, Mus musculus
agcatttaggtgtctgttcagcagt

SEQ ID NO: 170653 - DNA, 25 bp, Mus musculus
agcatttatcttaacctctgaccat

SEQ ID NO: 170654 - DNA, 25 bp, Mus musculus
agcatttatcttcttgatttcttac

SEQ ID NO: 170655 - DNA, 25 bp, Mus musculus
agcatttatcttgttgatttcttac

SEQ ID NO: 170656 - DNA, 25 bp, Mus musculus
agcatttatctttacctctgaccat

SEQ ID NO: 170657 - DNA, 25 bp, Mus musculus
agcatttatgaacctcttggttcaa

SEQ ID NO: 170658 - DNA, 25 bp, Mus musculus
agcatttatgaagctcttggttcaa

SEQ ID NO: 170659 - DNA, 25 bp, Mus musculus
agcatttatttccatagtgttgttt

SEQ ID NO: 170660 - DNA, 25 bp, Mus musculus
agcatttatttcgatagtgttgttt

SEQ ID NO: 170661 - DNA, 25 bp, Mus musculus
agcatttcaacaaagaccatcaatt

SEQ ID NO: 170662 - DNA, 25 bp, Mus musculus
agcatttcaacatagaccatcaatt

SEQ ID NO: 170663 - DNA, 25 bp, Mus musculus
agcatttcacctagtttttcagaga

SEQ ID NO: 170664 - DNA, 25 bp, Mus musculus
agcatttcaccttgtttttcagaga

SEQ ID NO: 170665 - DNA, 25 bp, Mus musculus
agcatttcatctactactttctgga

SEQ ID NO: 170666 - DNA, 25 bp, Mus musculus
agcatttcatcttctactttctgga

SEQ ID NO: 170667 - DNA, 25 bp, Mus musculus
agcatttcatgtataattgtgtgaa

SEQ ID NO: 170668 - DNA, 25 bp, Mus musculus
agcatttcatgtttaattgtgtgaa

SEQ ID NO: 170669 - DNA, 25 bp, Mus musculus
agcatttccagcaccagacgcagag

SEQ ID NO: 170670 - DNA, 25 bp, Mus musculus
agcatttccagctccagacgcagag

SEQ ID NO: 170671 - DNA, 25 bp, Mus musculus
agcatttccctgaacccttggagtg

SEQ ID NO: 170672 - DNA, 25 bp, Mus musculus
agcatttccctgtacccttggagtg

SEQ ID NO: 170673 - DNA, 25 bp, Mus musculus
agcatttcctcccttcatgaactct

SEQ ID NO: 170674 - DNA, 25 bp, Mus musculus
agcatttcctccgttcatgaactct

SEQ ID NO: 170675 - DNA, 25 bp, Mus musculus
agcatttcggacactgttatttttt

SEQ ID NO: 170676 - DNA, 25 bp, Mus musculus
agcatttcggactctgttatttttt

SEQ ID NO: 170677 - DNA, 25 bp, Mus musculus
agcatttctcacatacattatatat

SEQ ID NO: 170678 - DNA, 25 bp, Mus musculus
agcatttctcacttacattatatat

SEQ ID NO: 170679 - DNA, 25 bp, Mus musculus
agcatttctctcagatcttgccagc

SEQ ID NO: 170680 - DNA, 25 bp, Mus musculus
agcatttctctctgatcttgccagc

SEQ ID NO: 170681 - DNA, 25 bp, Mus musculus
agcatttctcttcgtacttcttcag

SEQ ID NO: 170682 - DNA, 25 bp, Mus musculus
agcatttctcttggtacttcttcag

SEQ ID NO: 170683 - DNA, 25 bp, Mus musculus
agcatttctgaaattgtccattgtc

SEQ ID NO: 170684 - DNA, 25 bp, Mus musculus
agcatttctgaatttgtccattgtc

SEQ ID NO: 170685 - DNA, 25 bp, Mus musculus
agcatttctgcgactacactgagga

SEQ ID NO: 170686 - DNA, 25 bp, Mus musculus
agcatttctgcgtctacactgagga

SEQ ID NO: 170687 - DNA, 25 bp, Mus musculus
agcatttcttgcatcttcattcttt

SEQ ID NO: 170688 - DNA, 25 bp, Mus musculus
agcatttcttgcttcttcattcttt

SEQ ID NO: 170689 - DNA, 25 bp, Mus musculus
agcatttgaaaacatctaccccatc

SEQ ID NO: 170690 - DNA, 25 bp, Mus musculus
agcatttgaaaagatctaccccatc

SEQ ID NO: 170691 - DNA, 25 bp, Mus musculus
agcatttgactgcaggtgcagaccc

SEQ ID NO: 170692 - DNA, 25 bp, Mus musculus
agcatttgactggaggtgcagaccc

SEQ ID NO: 170693 - DNA, 25 bp, Mus musculus
agcatttgagcaactgtccagcgta

SEQ ID NO: 170694 - DNA, 25 bp, Mus musculus
agcatttgagcatctgtccagcgta

SEQ ID NO: 170695 - DNA, 25 bp, Mus musculus
agcatttgaggcagtatcatatttc

SEQ ID NO: 170696 - DNA, 25 bp, Mus musculus
agcatttgaggctgtatcatatttc

SEQ ID NO: 170697 - DNA, 25 bp, Mus musculus
agcatttgagtgaccacgtgaggcc

SEQ ID NO: 170698 - DNA, 25 bp, Mus musculus
agcatttgagtgtccacgtgaggcc

SEQ ID NO: 170699 - DNA, 25 bp, Mus musculus
agcatttgataccttcactgttttt

SEQ ID NO: 170700 - DNA, 25 bp, Mus musculus
agcatttgatacgttcactgttttt

SEQ ID NO: 170701 - DNA, 25 bp, Mus musculus
agcatttgcatcaggttgttgccca

SEQ ID NO: 170702 - DNA, 25 bp, Mus musculus
agcatttgcatctggttgttgccca

SEQ ID NO: 170703 - DNA, 25 bp, Mus musculus
agcatttgccaacaatgttttcatt

SEQ ID NO: 170704 - DNA, 25 bp, Mus musculus
agcatttgccaagaatgttttcatt

SEQ ID NO: 170705 - DNA, 25 bp, Mus musculus
agcatttgctgcagaatcacatttt

SEQ ID NO: 170706 - DNA, 25 bp, Mus musculus
agcatttgctgctgaatcacatttt

SEQ ID NO: 170707 - DNA, 25 bp, Mus musculus
agcatttgctgtactgaagggccct

SEQ ID NO: 170708 - DNA, 25 bp, Mus musculus
agcatttgctgttctgaagggccct

SEQ ID NO: 170709 - DNA, 25 bp, Mus musculus
agcatttgggttactctacttcttc

SEQ ID NO: 170710 - DNA, 25 bp, Mus musculus
agcatttgggtttctctacttcttc

SEQ ID NO: 170711 - DNA, 25 bp, Mus musculus
agcatttgtaagatactcttgtcaa

SEQ ID NO: 170712 - DNA, 25 bp, Mus musculus
agcatttgtaagttactcttgtcaa

SEQ ID NO: 170713 - DNA, 25 bp, Mus musculus
agcatttgtcccctggaggatccac

SEQ ID NO: 170714 - DNA, 25 bp, Mus musculus
agcatttgtcccgtggaggatccac

SEQ ID NO: 170715 - DNA, 25 bp, Mus musculus
agcatttgtcttacccgttttatat

SEQ ID NO: 170716 - DNA, 25 bp, Mus musculus
agcatttgtctttcccgttttatat

SEQ ID NO: 170717 - DNA, 25 bp, Mus musculus
agcatttgtgccatctgattcagca

SEQ ID NO: 170718 - DNA, 25 bp, Mus musculus
agcatttgtgccttctgattcagca

SEQ ID NO: 170719 - DNA, 25 bp, Mus musculus
agcatttgtggcaggttaccctctg

SEQ ID NO: 170720 - DNA, 25 bp, Mus musculus
agcatttgtggctggttaccctctg

SEQ ID NO: 170721 - DNA, 25 bp, Mus musculus
agcatttgttgcacttggtccagtc

SEQ ID NO: 170722 - DNA, 25 bp, Mus musculus
agcatttgttgctcttggtccagtc

SEQ ID NO: 170723 - DNA, 25 bp, Mus musculus
agcattttactacctgtgacctttc

SEQ ID NO: 170724 - DNA, 25 bp, Mus musculus
agcattttactagctgtgacctttc

SEQ ID NO: 170725 - DNA, 25 bp, Mus musculus
agcattttacttcggcctatggaat

SEQ ID NO: 170726 - DNA, 25 bp, Mus musculus
agcattttacttgggcctatggaat

SEQ ID NO: 170727 - DNA, 25 bp, Mus musculus
agcattttccacaagggagaccatt

SEQ ID NO: 170728 - DNA, 25 bp, Mus musculus
agcattttccactagggagaccatt

SEQ ID NO: 170729 - DNA, 25 bp, Mus musculus
agcattttctgtagcctttggccct

SEQ ID NO: 170730 - DNA, 25 bp, Mus musculus
agcattttctgttgcctttggccct

SEQ ID NO: 170731 - DNA, 25 bp, Mus musculus
agcattttgcgtctaacctttgtgg

SEQ ID NO: 170732 - DNA, 25 bp, Mus musculus
agcattttgcgtgtaacctttgtgg

SEQ ID NO: 170733 - DNA, 25 bp, Mus musculus
agcattttgctcctcatttcttaat

SEQ ID NO: 170734 - DNA, 25 bp, Mus musculus
agcattttgctcgtcatttcttaat

SEQ ID NO: 170735 - DNA, 25 bp, Mus musculus
agcattttgctgaattagtttcttt

SEQ ID NO: 170736 - DNA, 25 bp, Mus musculus
agcattttgctgtattagtttcttt

SEQ ID NO: 170737 - DNA, 25 bp, Mus musculus
agcattttggcgctctatgttgatt

SEQ ID NO: 170738 - DNA, 25 bp, Mus musculus
agcattttggcggtctatgttgatt

SEQ ID NO: 170739 - DNA, 25 bp, Mus musculus
agcattttgtctacagatctctgtt

SEQ ID NO: 170740 - DNA, 25 bp, Mus musculus
agcattttgtcttcagatctctgtt

SEQ ID NO: 170741 - DNA, 25 bp, Mus musculus
agcatttttactctgtcttctttag

SEQ ID NO: 170742 - DNA, 25 bp, Mus musculus
agcatttttactgtgtcttctttag

SEQ ID NO: 170743 - DNA, 25 bp, Mus musculus
agcatttttataacactttcatcaa

SEQ ID NO: 170744 - DNA, 25 bp, Mus musculus
agcatttttatatcactttcatcaa

SEQ ID NO: 170745 - DNA, 25 bp, Mus musculus
agccaaaaaattccagctcctttct

SEQ ID NO: 170746 - DNA, 25 bp, Mus musculus
agccaaaaaattgcagctcctttct

SEQ ID NO: 170747 - DNA, 25 bp, Mus musculus
agccaaaacaagaatgccctgtctt

SEQ ID NO: 170748 - DNA, 25 bp, Mus musculus
agccaaaacaagtatgccctgtctt

SEQ ID NO: 170749 - DNA, 25 bp, Mus musculus
agccaaaacattactgactccatca

SEQ ID NO: 170750 - DNA, 25 bp, Mus musculus
agccaaaacatttctgactccatca

SEQ ID NO: 170751 - DNA, 25 bp, Mus musculus
agccaaaagtttactcctcactact

SEQ ID NO: 170752 - DNA, 25 bp, Mus musculus
agccaaaagttttctcctcactact

SEQ ID NO: 170753 - DNA, 25 bp, Mus musculus
agccaaaatcacaagcaggatcctt

SEQ ID NO: 170754 - DNA, 25 bp, Mus musculus
agccaaaatcactagcaggatcctt

SEQ ID NO: 170755 - DNA, 25 bp, Mus musculus
agccaaacaaaaactgtgtctctaa

SEQ ID NO: 170756 - DNA, 25 bp, Mus musculus
agccaaacaaaatctgtgtctctaa

SEQ ID NO: 170757 - DNA, 25 bp, Mus musculus
agccaaacaccaacagtctgcagca

SEQ ID NO: 170758 - DNA, 25 bp, Mus musculus
agccaaacaccatcagtctgcagca

SEQ ID NO: 170759 - DNA, 25 bp, Mus musculus
agccaaacagctcatttattcattt

SEQ ID NO: 170760 - DNA, 25 bp, Mus musculus
agccaaacagctgatttattcattt

SEQ ID NO: 170761 - DNA, 25 bp, Mus musculus
agccaaacagttagctgaggaaaac

SEQ ID NO: 170762 - DNA, 25 bp, Mus musculus
agccaaacagtttgctgaggaaaac

SEQ ID NO: 170763 - DNA, 25 bp, Mus musculus
agccaaacatagagagctctgtctc

SEQ ID NO: 170764 - DNA, 25 bp, Mus musculus
agccaaacatagtgagctctgtctc

SEQ ID NO: 170765 - DNA, 25 bp, Mus musculus
agccaaacatgcaggtgcacacctt

SEQ ID NO: 170766 - DNA, 25 bp, Mus musculus
agccaaacatgctggtgcacacctt

SEQ ID NO: 170767 - DNA, 25 bp, Mus musculus
agccaaacgggtcatcatctccgcc

SEQ ID NO: 170768 - DNA, 25 bp, Mus musculus
agccaaacgggtgatcatctccgcc

SEQ ID NO: 170769 - DNA, 25 bp, Mus musculus
agccaaactacaccatccagacatg

SEQ ID NO: 170770 - DNA, 25 bp, Mus musculus
agccaaactacagcatccagacatg

SEQ ID NO: 170771 - DNA, 25 bp, Mus musculus
agccaaactgcgactgaatgtcgat

SEQ ID NO: 170772 - DNA, 25 bp, Mus musculus
agccaaactgcgtctgaatgtcgat

SEQ ID NO: 170773 - DNA, 25 bp, Mus musculus
agccaaacttctcaacgggaccaga

SEQ ID NO: 170774 - DNA, 25 bp, Mus musculus
agccaaacttctgaacgggaccaga

SEQ ID NO: 170775 - DNA, 25 bp, Mus musculus
agccaaagactacccatagcctctt

SEQ ID NO: 170776 - DNA, 25 bp, Mus musculus
agccaaagactagccatagcctctt

SEQ ID NO: 170777 - DNA, 25 bp, Mus musculus
agccaaagctcacgtccggctaaac

SEQ ID NO: 170778 - DNA, 25 bp, Mus musculus
agccaaagctcaggtccggctaaac

SEQ ID NO: 170779 - DNA, 25 bp, Mus musculus
agccaaagctctcaggtctccctgt

SEQ ID NO: 170780 - DNA, 25 bp, Mus musculus
agccaaagctctgaggtctccctgt

SEQ ID NO: 170781 - DNA, 25 bp, Mus musculus
agccaaaggcttcactctgacctag

SEQ ID NO: 170782 - DNA, 25 bp, Mus musculus
agccaaaggcttcgaaggccccagc

SEQ ID NO: 170783 - DNA, 25 bp, Mus musculus
agccaaaggcttgactctgacctag

SEQ ID NO: 170784 - DNA, 25 bp, Mus musculus
agccaaaggcttggaaggccccagc

SEQ ID NO: 170785 - DNA, 25 bp, Mus musculus
agccaaaggtccacctggagttgtt

SEQ ID NO: 170786 - DNA, 25 bp, Mus musculus
agccaaaggtcctcctggagttgtt

SEQ ID NO: 170787 - DNA, 25 bp, Mus musculus
agccaaagtatacccctcactgtaa

SEQ ID NO: 170788 - DNA, 25 bp, Mus musculus
agccaaagtatagccctcactgtaa

SEQ ID NO: 170789 - DNA, 25 bp, Mus musculus
agccaaagtcccctggaatcatatc

SEQ ID NO: 170790 - DNA, 25 bp, Mus musculus
agccaaagtcccgtggaatcatatc

SEQ ID NO: 170791 - DNA, 25 bp, Mus musculus
agccaaagtgtcacagctatgccct

SEQ ID NO: 170792 - DNA, 25 bp, Mus musculus
agccaaagtgtctcagctatgccct

SEQ ID NO: 170793 - DNA, 25 bp, Mus musculus
agccaaagttgcatcctcgggattc

SEQ ID NO: 170794 - DNA, 25 bp, Mus musculus
agccaaagttgcttcctcgggattc

SEQ ID NO: 170795 - DNA, 25 bp, Mus musculus
agccaaatagtgatcatcttcagtg

SEQ ID NO: 170796 - DNA, 25 bp, Mus musculus
agccaaatagtgttcatcttcagtg

SEQ ID NO: 170797 - DNA, 25 bp, Mus musculus
agccaaatcagtcgcggctgtgcca

SEQ ID NO: 170798 - DNA, 25 bp, Mus musculus
agccaaatcagtggcggctgtgcca

SEQ ID NO: 170799 - DNA, 25 bp, Mus musculus
agccaaatcggaaccgggagtcttt

SEQ ID NO: 170800 - DNA, 25 bp, Mus musculus
agccaaatcggatccgggagtcttt

SEQ ID NO: 170801 - DNA, 25 bp, Mus musculus
agccaaatctccagtaaacgcactc

SEQ ID NO: 170802 - DNA, 25 bp, Mus musculus
agccaaatctcctgtaaacgcactc

SEQ ID NO: 170803 - DNA, 25 bp, Mus musculus
agccaaatggctaactcctaagaat

SEQ ID NO: 170804 - DNA, 25 bp, Mus musculus
agccaaatggcttactcctaagaat

SEQ ID NO: 170805 - DNA, 25 bp, Mus musculus
agccaaatgtgtcccgtctaagagt

SEQ ID NO: 170806 - DNA, 25 bp, Mus musculus
agccaaatgtgtgccgtctaagagt

SEQ ID NO: 170807 - DNA, 25 bp, Mus musculus
agccaaattatgcatcctggattga

SEQ ID NO: 170808 - DNA, 25 bp, Mus musculus
agccaaattatggatcctggattga

SEQ ID NO: 170809 - DNA, 25 bp, Mus musculus
agccaaattggaaatgtgtcccgaa

SEQ ID NO: 170810 - DNA, 25 bp, Mus musculus
agccaaattggatatgtgtcccgaa

SEQ ID NO: 170811 - DNA, 25 bp, Mus musculus
agccaacaacaactgcctgattttt

SEQ ID NO: 170812 - DNA, 25 bp, Mus musculus
agccaacaacaagtgcctgattttt

SEQ ID NO: 170813 - DNA, 25 bp, Mus musculus
agccaacaacccagttccaaaggat

SEQ ID NO: 170814 - DNA, 25 bp, Mus musculus
agccaacaaccctgttccaaaggat

SEQ ID NO: 170815 - DNA, 25 bp, Mus musculus
agccaacacactatctgagctttct

SEQ ID NO: 170816 - DNA, 25 bp, Mus musculus
agccaacacactttctgagctttct

SEQ ID NO: 170817 - DNA, 25 bp, Mus musculus
agccaacacagtcccttacaagagg

SEQ ID NO: 170818 - DNA, 25 bp, Mus musculus
agccaacacagtgccttacaagagg

SEQ ID NO: 170819 - DNA, 25 bp, Mus musculus
agccaacaccccaagaatccagatg

SEQ ID NO: 170820 - DNA, 25 bp, Mus musculus
agccaacacccctagaatccagatg

SEQ ID NO: 170821 - DNA, 25 bp, Mus musculus
agccaacacggtccccattaaggat

SEQ ID NO: 170822 - DNA, 25 bp, Mus musculus
agccaacacggtgcccattaaggat

SEQ ID NO: 170823 - DNA, 25 bp, Mus musculus
agccaacactggcatcccgaaaaga

SEQ ID NO: 170824 - DNA, 25 bp, Mus musculus
agccaacactgggatcccgaaaaga

SEQ ID NO: 170825 - DNA, 25 bp, Mus musculus
agccaacagacaaggccgcagtggc

SEQ ID NO: 170826 - DNA, 25 bp, Mus musculus
agccaacagacatggccgcagtggc

SEQ ID NO: 170827 - DNA, 25 bp, Mus musculus
agccaacagatacctgctgaccaca

SEQ ID NO: 170828 - DNA, 25 bp, Mus musculus
agccaacagatagctgctgaccaca

SEQ ID NO: 170829 - DNA, 25 bp, Mus musculus
agccaacagctgaaccacaactgga

SEQ ID NO: 170830 - DNA, 25 bp, Mus musculus
agccaacagctgtaccacaactgga

SEQ ID NO: 170831 - DNA, 25 bp, Mus musculus
agccaacaggacagctcttggacaa

SEQ ID NO: 170832 - DNA, 25 bp, Mus musculus
agccaacaggactgctcttggacaa

SEQ ID NO: 170833 - DNA, 25 bp, Mus musculus
agccaacagtgtaatctttacccct

SEQ ID NO: 170834 - DNA, 25 bp, Mus musculus
agccaacagtgttatctttacccct

SEQ ID NO: 170835 - DNA, 25 bp, Mus musculus
agccaacatcatacttaacggagga

SEQ ID NO: 170836 - DNA, 25 bp, Mus musculus
agccaacatcattcttaacggagga

SEQ ID NO: 170837 - DNA, 25 bp, Mus musculus
agccaacatgcaagctactttaatg

SEQ ID NO: 170838 - DNA, 25 bp, Mus musculus
agccaacatgcatgctactttaatg

SEQ ID NO: 170839 - DNA, 25 bp, Mus musculus
agccaacattccactgcttcatagg

SEQ ID NO: 170840 - DNA, 25 bp, Mus musculus
agccaacattcctctgcttcatagg

SEQ ID NO: 170841 - DNA, 25 bp, Mus musculus
agccaaccacttcactgagtgtcct

SEQ ID NO: 170842 - DNA, 25 bp, Mus musculus
agccaaccacttgactgagtgtcct

SEQ ID NO: 170843 - DNA, 25 bp, Mus musculus
agccaaccaggccaaagggatgttt

SEQ ID NO: 170844 - DNA, 25 bp, Mus musculus
agccaaccaggcgaaagggatgttt

SEQ ID NO: 170845 - DNA, 25 bp, Mus musculus
agccaacccctacaatatgcttgtt

SEQ ID NO: 170846 - DNA, 25 bp, Mus musculus
agccaacccctagaatatgcttgtt

SEQ ID NO: 170847 - DNA, 25 bp, Mus musculus
agccaaccctgcctttgaggctaat

SEQ ID NO: 170848 - DNA, 25 bp, Mus musculus
agccaaccctgcgtttgaggctaat

SEQ ID NO: 170849 - DNA, 25 bp, Mus musculus
agccaaccgtgcctttgatgttaat

SEQ ID NO: 170850 - DNA, 25 bp, Mus musculus
agccaaccgtgcgtttgatgttaat

SEQ ID NO: 170851 - DNA, 25 bp, Mus musculus
agccaaccgtttacacagacgtgga

SEQ ID NO: 170852 - DNA, 25 bp, Mus musculus
agccaaccgttttcacagacgtgga

SEQ ID NO: 170853 - DNA, 25 bp, Mus musculus
agccaacctagaccctggtgcaaca

SEQ ID NO: 170854 - DNA, 25 bp, Mus musculus
agccaacctagagcctggtgcaaca

SEQ ID NO: 170855 - DNA, 25 bp, Mus musculus
agccaacctagtactctctatttag

SEQ ID NO: 170856 - DNA, 25 bp, Mus musculus
agccaacctagttctctctatttag

SEQ ID NO: 170857 - DNA, 25 bp, Mus musculus
agccaacgatcccagtccgaaatgg

SEQ ID NO: 170858 - DNA, 25 bp, Mus musculus
agccaacgatccgagtccgaaatgg

SEQ ID NO: 170859 - DNA, 25 bp, Mus musculus
agccaacggaatcgtcagatctcac

SEQ ID NO: 170860 - DNA, 25 bp, Mus musculus
agccaacggaatggtcagatctcac

SEQ ID NO: 170861 - DNA, 25 bp, Mus musculus
agccaacgtaggaggagctctatga

SEQ ID NO: 170862 - DNA, 25 bp, Mus musculus
agccaacgtaggtggagctctatga

SEQ ID NO: 170863 - DNA, 25 bp, Mus musculus
agccaactacagcaggccgaggtcc

SEQ ID NO: 170864 - DNA, 25 bp, Mus musculus
agccaactacaggaggccgaggtcc

SEQ ID NO: 170865 - DNA, 25 bp, Mus musculus
agccaactatctattaccccaaaag

SEQ ID NO: 170866 - DNA, 25 bp, Mus musculus
agccaactatcttttaccccaaaag

SEQ ID NO: 170867 - DNA, 25 bp, Mus musculus
agccaactatttagtcacactccta

SEQ ID NO: 170868 - DNA, 25 bp, Mus musculus
agccaactattttgtcacactccta

SEQ ID NO: 170869 - DNA, 25 bp, Mus musculus
agccaactcaaaacggaggtgtcaa

SEQ ID NO: 170870 - DNA, 25 bp, Mus musculus
agccaactcaaatcggaggtgtcaa

SEQ ID NO: 170871 - DNA, 25 bp, Mus musculus
agccaactcagactccagtgaagat

SEQ ID NO: 170872 - DNA, 25 bp, Mus musculus
agccaactcagagtccagtgaagat

SEQ ID NO: 170873 - DNA, 25 bp, Mus musculus
agccaactcatgacctgtgcagagg

SEQ ID NO: 170874 - DNA, 25 bp, Mus musculus
agccaactcatgtcctgtgcagagg

SEQ ID NO: 170875 - DNA, 25 bp, Mus musculus
agccaactcccgagaatcctgtaaa

SEQ ID NO: 170876 - DNA, 25 bp, Mus musculus
agccaactcccgtgaatcctgtaaa

SEQ ID NO: 170877 - DNA, 25 bp, Mus musculus
agccaactctacaacagaatcctgc

SEQ ID NO: 170878 - DNA, 25 bp, Mus musculus
agccaactctactacagaatcctgc

SEQ ID NO: 170879 - DNA, 25 bp, Mus musculus
agccaactcttgcaaccttgactgg

SEQ ID NO: 170880 - DNA, 25 bp, Mus musculus
agccaactcttgcactgagcatgag

SEQ ID NO: 170881 - DNA, 25 bp, Mus musculus
agccaactcttggaaccttgactgg

SEQ ID NO: 170882 - DNA, 25 bp, Mus musculus
agccaactcttggactgagcatgag

SEQ ID NO: 170883 - DNA, 25 bp, Mus musculus
agccaactgcgacacattcgtctag

SEQ ID NO: 170884 - DNA, 25 bp, Mus musculus
agccaactgcgagacattcgtctag

SEQ ID NO: 170885 - DNA, 25 bp, Mus musculus
agccaactggccagcagcggaggaa

SEQ ID NO: 170886 - DNA, 25 bp, Mus musculus
agccaactggcctgcagcggaggaa

SEQ ID NO: 170887 - DNA, 25 bp, Mus musculus
agccaactggtcacatctaccagca

SEQ ID NO: 170888 - DNA, 25 bp, Mus musculus
agccaactggtctcatctaccagca

SEQ ID NO: 170889 - DNA, 25 bp, Mus musculus
agccaacttcatactgcttcttcat

SEQ ID NO: 170890 - DNA, 25 bp, Mus musculus
agccaacttcattctgcttcttcat

SEQ ID NO: 170891 - DNA, 25 bp, Mus musculus
agccaagagcacagatcccacttag

SEQ ID NO: 170892 - DNA, 25 bp, Mus musculus
agccaagagcacagtcagggatatt

SEQ ID NO: 170893 - DNA, 25 bp, Mus musculus
agccaagagcactgatcccacttag

SEQ ID NO: 170894 - DNA, 25 bp, Mus musculus
agccaagagcactgtcagggatatt

SEQ ID NO: 170895 - DNA, 25 bp, Mus musculus
agccaagagcttccattgatcacag

SEQ ID NO: 170896 - DNA, 25 bp, Mus musculus
agccaagagcttgcattgatcacag

SEQ ID NO: 170897 - DNA, 25 bp, Mus musculus
agccaagagttgctgctgttcactc

SEQ ID NO: 170898 - DNA, 25 bp, Mus musculus
agccaagagttggtgctgttcactc

SEQ ID NO: 170899 - DNA, 25 bp, Mus musculus
agccaagagtttcaaggaggtctga

SEQ ID NO: 170900 - DNA, 25 bp, Mus musculus
agccaagagtttcctgacatgtcag

SEQ ID NO: 170901 - DNA, 25 bp, Mus musculus
agccaagagtttgaaggaggtctga

SEQ ID NO: 170902 - DNA, 25 bp, Mus musculus
agccaagagtttgctgacatgtcag

SEQ ID NO: 170903 - DNA, 25 bp, Mus musculus
agccaagatcaaagtgcgctggttc

SEQ ID NO: 170904 - DNA, 25 bp, Mus musculus
agccaagatcaatgtgcgctggttc

SEQ ID NO: 170905 - DNA, 25 bp, Mus musculus
agccaagatgagagcctgcctggga

SEQ ID NO: 170906 - DNA, 25 bp, Mus musculus
agccaagatgagtgcctgcctggga

SEQ ID NO: 170907 - DNA, 25 bp, Mus musculus
agccaagcaggcagacagtatgaga

SEQ ID NO: 170908 - DNA, 25 bp, Mus musculus
agccaagcaggctgacagtatgaga

SEQ ID NO: 170909 - DNA, 25 bp, Mus musculus
agccaagccaagacctggagcttag

SEQ ID NO: 170910 - DNA, 25 bp, Mus musculus
agccaagccaagtcctggagcttag

SEQ ID NO: 170911 - DNA, 25 bp, Mus musculus
agccaagccaatccacccagaaaat

SEQ ID NO: 170912 - DNA, 25 bp, Mus musculus
agccaagccaatgcacccagaaaat

SEQ ID NO: 170913 - DNA, 25 bp, Mus musculus
agccaagccataagtgatctcctag

SEQ ID NO: 170914 - DNA, 25 bp, Mus musculus
agccaagccatatgtgatctcctag

SEQ ID NO: 170915 - DNA, 25 bp, Mus musculus
agccaagccattccgaggtccggag

SEQ ID NO: 170916 - DNA, 25 bp, Mus musculus
agccaagccattgcgaggtccggag

SEQ ID NO: 170917 - DNA, 25 bp, Mus musculus
agccaagccctcataagtcagacag

SEQ ID NO: 170918 - DNA, 25 bp, Mus musculus
agccaagccctcttaagtcagacag

SEQ ID NO: 170919 - DNA, 25 bp, Mus musculus
agccaagcccttcgtacacagcaag

SEQ ID NO: 170920 - DNA, 25 bp, Mus musculus
agccaagcccttggtacacagcaag

SEQ ID NO: 170921 - DNA, 25 bp, Mus musculus
agccaagccggaatcagctagctaa

SEQ ID NO: 170922 - DNA, 25 bp, Mus musculus
agccaagccggattcagctagctaa

SEQ ID NO: 170923 - DNA, 25 bp, Mus musculus
agccaagccggcatcagctgatttc

SEQ ID NO: 170924 - DNA, 25 bp, Mus musculus
agccaagccggcttcagctgatttc

SEQ ID NO: 170925 - DNA, 25 bp, Mus musculus
agccaagcctgcaggcggcgatttt

SEQ ID NO: 170926 - DNA, 25 bp, Mus musculus
agccaagcctgctggcggcgatttt

SEQ ID NO: 170927 - DNA, 25 bp, Mus musculus
agccaagcctgtctggaacacctca

SEQ ID NO: 170928 - DNA, 25 bp, Mus musculus
agccaagcctgtgtggaacacctca

SEQ ID NO: 170929 - DNA, 25 bp, Mus musculus
agccaagccttgaccgcattcttca

SEQ ID NO: 170930 - DNA, 25 bp, Mus musculus
agccaagccttgtccgcattcttca

SEQ ID NO: 170931 - DNA, 25 bp, Mus musculus
agccaagctacaacacaatttacat

SEQ ID NO: 170932 - DNA, 25 bp, Mus musculus
agccaagctacatcacaatttacat

SEQ ID NO: 170933 - DNA, 25 bp, Mus musculus
agccaagctactctccttgctggaa

SEQ ID NO: 170934 - DNA, 25 bp, Mus musculus
agccaagctactgtccttgctggaa

SEQ ID NO: 170935 - DNA, 25 bp, Mus musculus
agccaagctatccaagcagccttca

SEQ ID NO: 170936 - DNA, 25 bp, Mus musculus
agccaagctatcgaagcagccttca

SEQ ID NO: 170937 - DNA, 25 bp, Mus musculus
agccaagctatgctagaatccccag

SEQ ID NO: 170938 - DNA, 25 bp, Mus musculus
agccaagctatggtagaatccccag

SEQ ID NO: 170939 - DNA, 25 bp, Mus musculus
agccaagctggcaggtttgatcaga

SEQ ID NO: 170940 - DNA, 25 bp, Mus musculus
agccaagctggctggtttgatcaga

SEQ ID NO: 170941 - DNA, 25 bp, Mus musculus
agccaagcttccagtttgtctcaaa

SEQ ID NO: 170942 - DNA, 25 bp, Mus musculus
agccaagcttcctgtttgtctcaaa

SEQ ID NO: 170943 - DNA, 25 bp, Mus musculus
agccaagcttggaactgttttcaca

SEQ ID NO: 170944 - DNA, 25 bp, Mus musculus
agccaagcttggtactgttttcaca

SEQ ID NO: 170945 - DNA, 25 bp, Mus musculus
agccaaggatgaatgcttatgccta

SEQ ID NO: 170946 - DNA, 25 bp, Mus musculus
agccaaggatgattgcttatgccta

SEQ ID NO: 170947 - DNA, 25 bp, Mus musculus
agccaaggccctctcacgggaaatc

SEQ ID NO: 170948 - DNA, 25 bp, Mus musculus
agccaaggccctgtcacgggaaatc

SEQ ID NO: 170949 - DNA, 25 bp, Mus musculus
agccaaggcctcaacatttcaaaag

SEQ ID NO: 170950 - DNA, 25 bp, Mus musculus
agccaaggcctcctgaaaactccat

SEQ ID NO: 170951 - DNA, 25 bp, Mus musculus
agccaaggcctcgtgaaaactccat

SEQ ID NO: 170952 - DNA, 25 bp, Mus musculus
agccaaggcctctacatttcaaaag

SEQ ID NO: 170953 - DNA, 25 bp, Mus musculus
agccaaggctatacttgaactctga

SEQ ID NO: 170954 - DNA, 25 bp, Mus musculus
agccaaggctattcttgaactctga

SEQ ID NO: 170955 - DNA, 25 bp, Mus musculus
agccaaggctgcagttaacaagctg

SEQ ID NO: 170956 - DNA, 25 bp, Mus musculus
agccaaggctgctgttaacaagctg

SEQ ID NO: 170957 - DNA, 25 bp, Mus musculus
agccaaggctggcatctgatgactc

SEQ ID NO: 170958 - DNA, 25 bp, Mus musculus
agccaaggctgggatctgatgactc

SEQ ID NO: 170959 - DNA, 25 bp, Mus musculus
agccaaggctgtagtggctgtgctt

SEQ ID NO: 170960 - DNA, 25 bp, Mus musculus
agccaaggctgttgtggctgtgctt

SEQ ID NO: 170961 - DNA, 25 bp, Mus musculus
agccaagggccgactgcagtgagta

SEQ ID NO: 170962 - DNA, 25 bp, Mus musculus
agccaagggccgtctgcagtgagta

SEQ ID NO: 170963 - DNA, 25 bp, Mus musculus
agccaaggtgatctgaccagttgca

SEQ ID NO: 170964 - DNA, 25 bp, Mus musculus
agccaaggtgatgtgaccagttgca

SEQ ID NO: 170965 - DNA, 25 bp, Mus musculus
agccaaggtggcctcagtgattcca

SEQ ID NO: 170966 - DNA, 25 bp, Mus musculus
agccaaggtggcgtcagtgattcca

SEQ ID NO: 170967 - DNA, 25 bp, Mus musculus
agccaaggttgacctgtaacggttg

SEQ ID NO: 170968 - DNA, 25 bp, Mus musculus
agccaaggttgagctgtaacggttg

SEQ ID NO: 170969 - DNA, 25 bp, Mus musculus
agccaaggtttgacccagagcgttt

SEQ ID NO: 170970 - DNA, 25 bp, Mus musculus
agccaaggtttgtcccagagcgttt

SEQ ID NO: 170971 - DNA, 25 bp, Mus musculus
agccaagtagacacctgccggtgag

SEQ ID NO: 170972 - DNA, 25 bp, Mus musculus
agccaagtagactcctgccggtgag

SEQ ID NO: 170973 - DNA, 25 bp, Mus musculus
agccaagtaggcaggtatacatgac

SEQ ID NO: 170974 - DNA, 25 bp, Mus musculus
agccaagtaggctggtatacatgac

SEQ ID NO: 170975 - DNA, 25 bp, Mus musculus
agccaagtgaatctcccgatgcatg

SEQ ID NO: 170976 - DNA, 25 bp, Mus musculus
agccaagtgaatgtcccgatgcatg

SEQ ID NO: 170977 - DNA, 25 bp, Mus musculus
agccaagtggagcagggaagtgtct

SEQ ID NO: 170978 - DNA, 25 bp, Mus musculus
agccaagtggagctgtagttgaatt

SEQ ID NO: 170979 - DNA, 25 bp, Mus musculus
agccaagtggaggagggaagtgtct

SEQ ID NO: 170980 - DNA, 25 bp, Mus musculus
agccaagtggaggtgtagttgaatt

SEQ ID NO: 170981 - DNA, 25 bp, Mus musculus
agccaagtggccaagtcaagagaat

SEQ ID NO: 170982 - DNA, 25 bp, Mus musculus
agccaagtggcctagtcaagagaat

SEQ ID NO: 170983 - DNA, 25 bp, Mus musculus
agccaagtgtcgcaatcgtgcctgc

SEQ ID NO: 170984 - DNA, 25 bp, Mus musculus
agccaagtgtcggaatcgtgcctgc

SEQ ID NO: 170985 - DNA, 25 bp, Mus musculus
agccaagtgtgacctggtgtgtcca

SEQ ID NO: 170986 - DNA, 25 bp, Mus musculus
agccaagtgtgagctggtgtgtcca

SEQ ID NO: 170987 - DNA, 25 bp, Mus musculus
agccaagttcaaaggttctgggaca

SEQ ID NO: 170988 - DNA, 25 bp, Mus musculus
agccaagttcaatggttctgggaca

SEQ ID NO: 170989 - DNA, 25 bp, Mus musculus
agccaagtttccagggctcctgcca

SEQ ID NO: 170990 - DNA, 25 bp, Mus musculus
agccaagtttcctgggctcctgcca

SEQ ID NO: 170991 - DNA, 25 bp, Mus musculus
agccaataatacactaatcctctcc

SEQ ID NO: 170992 - DNA, 25 bp, Mus musculus
agccaataatactctaatcctctcc

SEQ ID NO: 170993 - DNA, 25 bp, Mus musculus
agccaatcaaatcattgcgcaccac

SEQ ID NO: 170994 - DNA, 25 bp, Mus musculus
agccaatcaaatgattgcgcaccac

SEQ ID NO: 170995 - DNA, 25 bp, Mus musculus
agccaatcaactcccctgatgaact

SEQ ID NO: 170996 - DNA, 25 bp, Mus musculus
agccaatcaactgccctgatgaact

SEQ ID NO: 170997 - DNA, 25 bp, Mus musculus
agccaatcaaggacccgtatccaat

SEQ ID NO: 170998 - DNA, 25 bp, Mus musculus
agccaatcaaggtcccgtatccaat

SEQ ID NO: 170999 - DNA, 25 bp, Mus musculus
agccaatcactgatctcattgtcag

SEQ ID NO: 171000 - DNA, 25 bp, Mus musculus
agccaatcactgctgggcagcctca

SEQ ID NO: 171001 - DNA, 25 bp, Mus musculus
agccaatcactggtgggcagcctca

SEQ ID NO: 171002 - DNA, 25 bp, Mus musculus
agccaatcactgttctcattgtcag

SEQ ID NO: 171003 - DNA, 25 bp, Mus musculus
agccaatcagccatctgcaggtttg

SEQ ID NO: 171004 - DNA, 25 bp, Mus musculus
agccaatcagccttctgcaggtttg

SEQ ID NO: 171005 - DNA, 25 bp, Mus musculus
agccaatcaggtagagtcattgcct

SEQ ID NO: 171006 - DNA, 25 bp, Mus musculus
agccaatcaggttgagtcattgcct

SEQ ID NO: 171007 - DNA, 25 bp, Mus musculus
agccaatcgccgcaggagagccaag

SEQ ID NO: 171008 - DNA, 25 bp, Mus musculus
agccaatcgccggaggagagccaag

SEQ ID NO: 171009 - DNA, 25 bp, Mus musculus
agccaatctcctctgcagatagcag

SEQ ID NO: 171010 - DNA, 25 bp, Mus musculus
agccaatctcctgtgcagatagcag

SEQ ID NO: 171011 - DNA, 25 bp, Mus musculus
agccaatcttggatttcaacatgat

SEQ ID NO: 171012 - DNA, 25 bp, Mus musculus
agccaatcttggttttcaacatgat

SEQ ID NO: 171013 - DNA, 25 bp, Mus musculus
agccaatgaaggactacgcccctga

SEQ ID NO: 171014 - DNA, 25 bp, Mus musculus
agccaatgaaggtctacgcccctga

SEQ ID NO: 171015 - DNA, 25 bp, Mus musculus
agccaatgaggtcactccactctta

SEQ ID NO: 171016 - DNA, 25 bp, Mus musculus
agccaatgaggtgactccactctta

SEQ ID NO: 171017 - DNA, 25 bp, Mus musculus
agccaatgatacctaccctagtaac

SEQ ID NO: 171018 - DNA, 25 bp, Mus musculus
agccaatgatacgtaccctagtaac

SEQ ID NO: 171019 - DNA, 25 bp, Mus musculus
agccaatggcgactatcgagacact

SEQ ID NO: 171020 - DNA, 25 bp, Mus musculus
agccaatggcgagtatcgagacact

SEQ ID NO: 171021 - DNA, 25 bp, Mus musculus
agccaatggctacagcagcttccag

SEQ ID NO: 171022 - DNA, 25 bp, Mus musculus
agccaatggctagagcagcttccag

SEQ ID NO: 171023 - DNA, 25 bp, Mus musculus
agccaatgtggcagcacttcaagga

SEQ ID NO: 171024 - DNA, 25 bp, Mus musculus
agccaatgtggctgcacttcaagga

SEQ ID NO: 171025 - DNA, 25 bp, Mus musculus
agccaatgtggtcatccgccagagc

SEQ ID NO: 171026 - DNA, 25 bp, Mus musculus
agccaatgtggtgatccgccagagc

SEQ ID NO: 171027 - DNA, 25 bp, Mus musculus
agccaattatgcaaaaggtcacagg

SEQ ID NO: 171028 - DNA, 25 bp, Mus musculus
agccaattatgctaaaggtcacagg

SEQ ID NO: 171029 - DNA, 25 bp, Mus musculus
agccaattcttcctgagctctttaa

SEQ ID NO: 171030 - DNA, 25 bp, Mus musculus
agccaattcttcgtgagctctttaa

SEQ ID NO: 171031 - DNA, 25 bp, Mus musculus
agccaatttcagatgccttgaccaa

SEQ ID NO: 171032 - DNA, 25 bp, Mus musculus
agccaatttcagttgccttgaccaa

SEQ ID NO: 171033 - DNA, 25 bp, Mus musculus
agccaattttgtatcgctttgcaaa

SEQ ID NO: 171034 - DNA, 25 bp, Mus musculus
agccaattttgtttcgctttgcaaa

SEQ ID NO: 171035 - DNA, 25 bp, Mus musculus
agccacaaaattactcactgcaggt

SEQ ID NO: 171036 - DNA, 25 bp, Mus musculus
agccacaaaatttctcactgcaggt

SEQ ID NO: 171037 - DNA, 25 bp, Mus musculus
agccacaaacagctgtaggcaagtt

SEQ ID NO: 171038 - DNA, 25 bp, Mus musculus
agccacaaacaggtgtaggcaagtt

SEQ ID NO: 171039 - DNA, 25 bp, Mus musculus
agccacaaagttatcctggtctctg

SEQ ID NO: 171040 - DNA, 25 bp, Mus musculus
agccacaaagttttcctggtctctg

SEQ ID NO: 171041 - DNA, 25 bp, Mus musculus
agccacaaccctatgcagtgcatgg

SEQ ID NO: 171042 - DNA, 25 bp, Mus musculus
agccacaaccctttgcagtgcatgg

SEQ ID NO: 171043 - DNA, 25 bp, Mus musculus
agccacaacttacatggacttcagt

SEQ ID NO: 171044 - DNA, 25 bp, Mus musculus
agccacaacttagatggacttcagt

SEQ ID NO: 171045 - DNA, 25 bp, Mus musculus
agccacaaggagaagcagagcttct

SEQ ID NO: 171046 - DNA, 25 bp, Mus musculus
agccacaaggagtagcagagcttct

SEQ ID NO: 171047 - DNA, 25 bp, Mus musculus
agccacaatgctagattcccagaaa

SEQ ID NO: 171048 - DNA, 25 bp, Mus musculus
agccacaatgcttgattcccagaaa

SEQ ID NO: 171049 - DNA, 25 bp, Mus musculus
agccacacaaccagaggaccttttt

SEQ ID NO: 171050 - DNA, 25 bp, Mus musculus
agccacacaacctgaggaccttttt

SEQ ID NO: 171051 - DNA, 25 bp, Mus musculus
agccacacacctactataatttcgt

SEQ ID NO: 171052 - DNA, 25 bp, Mus musculus
agccacacaccttctataatttcgt

SEQ ID NO: 171053 - DNA, 25 bp, Mus musculus
agccacacagaccaatgctctcgtt

SEQ ID NO: 171054 - DNA, 25 bp, Mus musculus
agccacacagacgaatgctctcgtt

SEQ ID NO: 171055 - DNA, 25 bp, Mus musculus
agccacaccatcatagagccttagt

SEQ ID NO: 171056 - DNA, 25 bp, Mus musculus
agccacaccatcttagagccttagt

SEQ ID NO: 171057 - DNA, 25 bp, Mus musculus
agccacacctcactttgagcctgga

SEQ ID NO: 171058 - DNA, 25 bp, Mus musculus
agccacacctcagtttgagcctgga

SEQ ID NO: 171059 - DNA, 25 bp, Mus musculus
agccacacggcacggatgactcggt

SEQ ID NO: 171060 - DNA, 25 bp, Mus musculus
agccacacggcagggatgactcggt

SEQ ID NO: 171061 - DNA, 25 bp, Mus musculus
agccacactgctattactcctggga

SEQ ID NO: 171062 - DNA, 25 bp, Mus musculus
agccacactgcttttactcctggga

SEQ ID NO: 171063 - DNA, 25 bp, Mus musculus
agccacacttcactatctactaatg

SEQ ID NO: 171064 - DNA, 25 bp, Mus musculus
agccacacttcagtatctactaatg

SEQ ID NO: 171065 - DNA, 25 bp, Mus musculus
agccacagaaacagtttattcagaa

SEQ ID NO: 171066 - DNA, 25 bp, Mus musculus
agccacagaaactgtttattcagaa

SEQ ID NO: 171067 - DNA, 25 bp, Mus musculus
agccacagaaccacagttgaattta

SEQ ID NO: 171068 - DNA, 25 bp, Mus musculus
agccacagaacctcagttgaattta

SEQ ID NO: 171069 - DNA, 25 bp, Mus musculus
agccacagaagtccagttccctgta

SEQ ID NO: 171070 - DNA, 25 bp, Mus musculus
agccacagaagtgcagttccctgta

SEQ ID NO: 171071 - DNA, 25 bp, Mus musculus
agccacagacacattcggtgtttca

SEQ ID NO: 171072 - DNA, 25 bp, Mus musculus
agccacagacactttcggtgtttca

SEQ ID NO: 171073 - DNA, 25 bp, Mus musculus
agccacagagaacaaggatcacaca

SEQ ID NO: 171074 - DNA, 25 bp, Mus musculus
agccacagagaagaaggatcacaca

SEQ ID NO: 171075 - DNA, 25 bp, Mus musculus
agccacagagctaccttctagaagt

SEQ ID NO: 171076 - DNA, 25 bp, Mus musculus
agccacagagctactctttggattt

SEQ ID NO: 171077 - DNA, 25 bp, Mus musculus
agccacagagcttccttctagaagt

SEQ ID NO: 171078 - DNA, 25 bp, Mus musculus
agccacagagcttctctttggattt

SEQ ID NO: 171079 - DNA, 25 bp, Mus musculus
agccacagattaccttcttgcttgc

SEQ ID NO: 171080 - DNA, 25 bp, Mus musculus
agccacagattagcttcttgcttgc

SEQ ID NO: 171081 - DNA, 25 bp, Mus musculus
agccacagcaggagtccaggaacct

SEQ ID NO: 171082 - DNA, 25 bp, Mus musculus
agccacagcaggtgtccaggaacct

SEQ ID NO: 171083 - DNA, 25 bp, Mus musculus
agccacagcagtctacaaggtctct

SEQ ID NO: 171084 - DNA, 25 bp, Mus musculus
agccacagcagtgtacaaggtctct

SEQ ID NO: 171085 - DNA, 25 bp, Mus musculus
agccacagccagaattgcaggagcc

SEQ ID NO: 171086 - DNA, 25 bp, Mus musculus
agccacagccagtattgcaggagcc

SEQ ID NO: 171087 - DNA, 25 bp, Mus musculus
agccacagccctacaatgtcataaa

SEQ ID NO: 171088 - DNA, 25 bp, Mus musculus
agccacagcccttcaatgtcataaa

SEQ ID NO: 171089 - DNA, 25 bp, Mus musculus
agccacagcgctcgtgtgagactca

SEQ ID NO: 171090 - DNA, 25 bp, Mus musculus
agccacagcgctggtgtgagactca

SEQ ID NO: 171091 - DNA, 25 bp, Mus musculus
agccacagcgtcatttctcagaact

SEQ ID NO: 171092 - DNA, 25 bp, Mus musculus
agccacagcgtcttttctcagaact

SEQ ID NO: 171093 - DNA, 25 bp, Mus musculus
agccacagcgttatttcccagacaa

SEQ ID NO: 171094 - DNA, 25 bp, Mus musculus
agccacagcgttttttcccagacaa

SEQ ID NO: 171095 - DNA, 25 bp, Mus musculus
agccacagctgtacgagtttcttgc

SEQ ID NO: 171096 - DNA, 25 bp, Mus musculus
agccacagctgttcgagtttcttgc

SEQ ID NO: 171097 - DNA, 25 bp, Mus musculus
agccacaggagcctatgttctgtca

SEQ ID NO: 171098 - DNA, 25 bp, Mus musculus
agccacaggagcgtatgttctgtca

SEQ ID NO: 171099 - DNA, 25 bp, Mus musculus
agccacaggccgatggcatggctgt

SEQ ID NO: 171100 - DNA, 25 bp, Mus musculus
agccacaggccgttggcatggctgt

SEQ ID NO: 171101 - DNA, 25 bp, Mus musculus
agccacagggccacgtaaacccaag

SEQ ID NO: 171102 - DNA, 25 bp, Mus musculus
agccacagggcctcgtaaacccaag

SEQ ID NO: 171103 - DNA, 25 bp, Mus musculus
agccacagggctatatttttcattt

SEQ ID NO: 171104 - DNA, 25 bp, Mus musculus
agccacagggctttatttttcattt

SEQ ID NO: 171105 - DNA, 25 bp, Mus musculus
agccacagtaagacgccagcatata

SEQ ID NO: 171106 - DNA, 25 bp, Mus musculus
agccacagtaagtcgccagcatata

SEQ ID NO: 171107 - DNA, 25 bp, Mus musculus
agccacagtatacaggctccccaga

SEQ ID NO: 171108 - DNA, 25 bp, Mus musculus
agccacagtatagaggctccccaga

SEQ ID NO: 171109 - DNA, 25 bp, Mus musculus
agccacagtcagagagatcgtgctc

SEQ ID NO: 171110 - DNA, 25 bp, Mus musculus
agccacagtcagtgagatcgtgctc

SEQ ID NO: 171111 - DNA, 25 bp, Mus musculus
agccacagtctgaatctcatttatt

SEQ ID NO: 171112 - DNA, 25 bp, Mus musculus
agccacagtctgtatctcatttatt

SEQ ID NO: 171113 - DNA, 25 bp, Mus musculus
agccacagtcttagaagccgttcct

SEQ ID NO: 171114 - DNA, 25 bp, Mus musculus
agccacagtctttgaagccgttcct

SEQ ID NO: 171115 - DNA, 25 bp, Mus musculus
agccacagtgtgacaattccttttg

SEQ ID NO: 171116 - DNA, 25 bp, Mus musculus
agccacagtgtgtcaattccttttg

SEQ ID NO: 171117 - DNA, 25 bp, Mus musculus
agccacagttcaaacttgctttgaa

SEQ ID NO: 171118 - DNA, 25 bp, Mus musculus
agccacagttcatacttgctttgaa

SEQ ID NO: 171119 - DNA, 25 bp, Mus musculus
agccacatagccagggcctggctgt

SEQ ID NO: 171120 - DNA, 25 bp, Mus musculus
agccacatagcctgggcctggctgt

SEQ ID NO: 171121 - DNA, 25 bp, Mus musculus
agccacatattgaattatgaaattc

SEQ ID NO: 171122 - DNA, 25 bp, Mus musculus
agccacatattgtattatgaaattc

SEQ ID NO: 171123 - DNA, 25 bp, Mus musculus
agccacatcatgctttgaggatcat

SEQ ID NO: 171124 - DNA, 25 bp, Mus musculus
agccacatcatggtttgaggatcat

SEQ ID NO: 171125 - DNA, 25 bp, Mus musculus
agccacatccacatgtcaataaagg

SEQ ID NO: 171126 - DNA, 25 bp, Mus musculus
agccacatccacttgtcaataaagg

SEQ ID NO: 171127 - DNA, 25 bp, Mus musculus
agccacatcctcatgaactctttga

SEQ ID NO: 171128 - DNA, 25 bp, Mus musculus
agccacatcctcttgaactctttga

SEQ ID NO: 171129 - DNA, 25 bp, Mus musculus
agccacatctggacaatcaacacca

SEQ ID NO: 171130 - DNA, 25 bp, Mus musculus
agccacatctggtcaatcaacacca

SEQ ID NO: 171131 - DNA, 25 bp, Mus musculus
agccacatgaagcacttgtcctatg

SEQ ID NO: 171132 - DNA, 25 bp, Mus musculus
agccacatgaaggacttgtcctatg

SEQ ID NO: 171133 - DNA, 25 bp, Mus musculus
agccacatgcgtctattggtccact

SEQ ID NO: 171134 - DNA, 25 bp, Mus musculus
agccacatgcgtgtattggtccact

SEQ ID NO: 171135 - DNA, 25 bp, Mus musculus
agccacatgcttagggtatctgtca

SEQ ID NO: 171136 - DNA, 25 bp, Mus musculus
agccacatgctttgggtatctgtca

SEQ ID NO: 171137 - DNA, 25 bp, Mus musculus
agccacatggtgaaattttgtccaa

SEQ ID NO: 171138 - DNA, 25 bp, Mus musculus
agccacatggtgtaattttgtccaa

SEQ ID NO: 171139 - DNA, 25 bp, Mus musculus
agccacatgtttagtttatgagggt

SEQ ID NO: 171140 - DNA, 25 bp, Mus musculus
agccacatgttttgtttatgagggt

SEQ ID NO: 171141 - DNA, 25 bp, Mus musculus
agccacattattcctttgaattgat

SEQ ID NO: 171142 - DNA, 25 bp, Mus musculus
agccacattattgctttgaattgat

SEQ ID NO: 171143 - DNA, 25 bp, Mus musculus
agccacattgttatgatgactccaa

SEQ ID NO: 171144 - DNA, 25 bp, Mus musculus
agccacattgttcttgggaaccttg

SEQ ID NO: 171145 - DNA, 25 bp, Mus musculus
agccacattgttgttgggaaccttg

SEQ ID NO: 171146 - DNA, 25 bp, Mus musculus
agccacattgttttgatgactccaa

SEQ ID NO: 171147 - DNA, 25 bp, Mus musculus
agccacatttgcagttgggaatccc

SEQ ID NO: 171148 - DNA, 25 bp, Mus musculus
agccacatttgctgttgggaatccc

SEQ ID NO: 171149 - DNA, 25 bp, Mus musculus
agccaccaaaatctcaagtagcaaa

SEQ ID NO: 171150 - DNA, 25 bp, Mus musculus
agccaccaaaatgtcaagtagcaaa

SEQ ID NO: 171151 - DNA, 25 bp, Mus musculus
agccaccaaagaactcaaataaagt

SEQ ID NO: 171152 - DNA, 25 bp, Mus musculus
agccaccaaagatctcaaataaagt

SEQ ID NO: 171153 - DNA, 25 bp, Mus musculus
agccaccaaggcacattgaaagtat

SEQ ID NO: 171154 - DNA, 25 bp, Mus musculus
agccaccaaggcagctccgaggtaa

SEQ ID NO: 171155 - DNA, 25 bp, Mus musculus
agccaccaaggctcattgaaagtat

SEQ ID NO: 171156 - DNA, 25 bp, Mus musculus
agccaccaaggctgctccgaggtaa

SEQ ID NO: 171157 - DNA, 25 bp, Mus musculus
agccaccacagcagacattggtgtt

SEQ ID NO: 171158 - DNA, 25 bp, Mus musculus
agccaccacagctgacattggtgtt

SEQ ID NO: 171159 - DNA, 25 bp, Mus musculus
agccaccaccttcgacagttcttgt

SEQ ID NO: 171160 - DNA, 25 bp, Mus musculus
agccaccaccttggacagttcttgt

SEQ ID NO: 171161 - DNA, 25 bp, Mus musculus
agccaccacttcagtgtggtttgga

SEQ ID NO: 171162 - DNA, 25 bp, Mus musculus
agccaccacttctgtgtggtttgga

SEQ ID NO: 171163 - DNA, 25 bp, Mus musculus
agccaccagcagcactggttactac

SEQ ID NO: 171164 - DNA, 25 bp, Mus musculus
agccaccagcaggactggttactac

SEQ ID NO: 171165 - DNA, 25 bp, Mus musculus
agccaccagccaccaggtgtgtgta

SEQ ID NO: 171166 - DNA, 25 bp, Mus musculus
agccaccagccagcaggtgtgtgta

SEQ ID NO: 171167 - DNA, 25 bp, Mus musculus
agccaccagcctacttctgggtctg

SEQ ID NO: 171168 - DNA, 25 bp, Mus musculus
agccaccagccttcttctgggtctg

SEQ ID NO: 171169 - DNA, 25 bp, Mus musculus
agccaccagctcagtgcacagtgaa

SEQ ID NO: 171170 - DNA, 25 bp, Mus musculus
agccaccagctctgtgcacagtgaa

SEQ ID NO: 171171 - DNA, 25 bp, Mus musculus
agccaccagcttatgtactaggaat

SEQ ID NO: 171172 - DNA, 25 bp, Mus musculus
agccaccagcttttgtactaggaat

SEQ ID NO: 171173 - DNA, 25 bp, Mus musculus
agccaccaggctactagagtcgtct

SEQ ID NO: 171174 - DNA, 25 bp, Mus musculus
agccaccaggcttctagagtcgtct

SEQ ID NO: 171175 - DNA, 25 bp, Mus musculus
agccaccagggcagggaatctcact

SEQ ID NO: 171176 - DNA, 25 bp, Mus musculus
agccaccagggctgggaatctcact

SEQ ID NO: 171177 - DNA, 25 bp, Mus musculus
agccaccagtggcagtctacagtag

SEQ ID NO: 171178 - DNA, 25 bp, Mus musculus
agccaccagtgggagtctacagtag

SEQ ID NO: 171179 - DNA, 25 bp, Mus musculus
agccaccatccacttttaagcaaaa

SEQ ID NO: 171180 - DNA, 25 bp, Mus musculus
agccaccatccagttttaagcaaaa

SEQ ID NO: 171181 - DNA, 25 bp, Mus musculus
agccaccatggaaagattctctttc

SEQ ID NO: 171182 - DNA, 25 bp, Mus musculus
agccaccatggatagattctctttc

SEQ ID NO: 171183 - DNA, 25 bp, Mus musculus
agccaccatggcagttttgtgctgt

SEQ ID NO: 171184 - DNA, 25 bp, Mus musculus
agccaccatggctgttttgtgctgt

SEQ ID NO: 171185 - DNA, 25 bp, Mus musculus
agccaccatggtcccttgcaaagaa

SEQ ID NO: 171186 - DNA, 25 bp, Mus musculus
agccaccatggtgccttgcaaagaa

SEQ ID NO: 171187 - DNA, 25 bp, Mus musculus
agccaccatgtacttctagaaaccg

SEQ ID NO: 171188 - DNA, 25 bp, Mus musculus
agccaccatgtagttctagaaaccg

SEQ ID NO: 171189 - DNA, 25 bp, Mus musculus
agccaccattgcaaggagtgagcat

SEQ ID NO: 171190 - DNA, 25 bp, Mus musculus
agccaccattgctaggagtgagcat

SEQ ID NO: 171191 - DNA, 25 bp, Mus musculus
agccacccacaacctcattagaaag

SEQ ID NO: 171192 - DNA, 25 bp, Mus musculus
agccacccacaagctcattagaaag

SEQ ID NO: 171193 - DNA, 25 bp, Mus musculus
agccacccatgccttagggaagagg

SEQ ID NO: 171194 - DNA, 25 bp, Mus musculus
agccacccatgcgttagggaagagg

SEQ ID NO: 171195 - DNA, 25 bp, Mus musculus
agccaccccgtcagcaataaaatga

SEQ ID NO: 171196 - DNA, 25 bp, Mus musculus
agccaccccgtctgcaataaaatga

SEQ ID NO: 171197 - DNA, 25 bp, Mus musculus
agccacccctggcatcagtcggaga

SEQ ID NO: 171198 - DNA, 25 bp, Mus musculus
agccacccctgggatcagtcggaga

SEQ ID NO: 171199 - DNA, 25 bp, Mus musculus
agccaccctcagcaggtaagttcta

SEQ ID NO: 171200 - DNA, 25 bp, Mus musculus
agccaccctcaggaggtaagttcta

SEQ ID NO: 171201 - DNA, 25 bp, Mus musculus
agccaccctccaccaagggaggaga

SEQ ID NO: 171202 - DNA, 25 bp, Mus musculus
agccaccctccagcaagggaggaga

SEQ ID NO: 171203 - DNA, 25 bp, Mus musculus
agccaccctgggacagtgaagtcac

SEQ ID NO: 171204 - DNA, 25 bp, Mus musculus
agccaccctgggtcagtgaagtcac

SEQ ID NO: 171205 - DNA, 25 bp, Mus musculus
agccaccctggtcacagtgactatg

SEQ ID NO: 171206 - DNA, 25 bp, Mus musculus
agccaccctggtgacagtgactatg

SEQ ID NO: 171207 - DNA, 25 bp, Mus musculus
agccaccctgtgctcataagggcac

SEQ ID NO: 171208 - DNA, 25 bp, Mus musculus
agccaccctgtggtcataagggcac

SEQ ID NO: 171209 - DNA, 25 bp, Mus musculus
agccacccttgcaagaagtgctggt

SEQ ID NO: 171210 - DNA, 25 bp, Mus musculus
agccacccttgctagaagtgctggt

SEQ ID NO: 171211 - DNA, 25 bp, Mus musculus
agccaccgaagactacttttagtag

SEQ ID NO: 171212 - DNA, 25 bp, Mus musculus
agccaccgaagagtacttttagtag

SEQ ID NO: 171213 - DNA, 25 bp, Mus musculus
agccaccgacagattcaggtttcat

SEQ ID NO: 171214 - DNA, 25 bp, Mus musculus
agccaccgacagtttcaggtttcat

SEQ ID NO: 171215 - DNA, 25 bp, Mus musculus
agccaccgctatagaggactgacct

SEQ ID NO: 171216 - DNA, 25 bp, Mus musculus
agccaccgctattgaggactgacct

SEQ ID NO: 171217 - DNA, 25 bp, Mus musculus
agccaccggcagatctttgagtaga

SEQ ID NO: 171218 - DNA, 25 bp, Mus musculus
agccaccggcagttctttgagtaga

SEQ ID NO: 171219 - DNA, 25 bp, Mus musculus
agccaccgtctcagtggatgtttaa

SEQ ID NO: 171220 - DNA, 25 bp, Mus musculus
agccaccgtctctgtggatgtttaa

SEQ ID NO: 171221 - DNA, 25 bp, Mus musculus
agccaccgtggacatccagagacag

SEQ ID NO: 171222 - DNA, 25 bp, Mus musculus
agccaccgtggagatccagagacag

SEQ ID NO: 171223 - DNA, 25 bp, Mus musculus
agccaccgtgttcgtggtgtgaact

SEQ ID NO: 171224 - DNA, 25 bp, Mus musculus
agccaccgtgttggtggtgtgaact

SEQ ID NO: 171225 - DNA, 25 bp, Mus musculus
agccaccgttggcaatggtcagtag

SEQ ID NO: 171226 - DNA, 25 bp, Mus musculus
agccaccgttgggaatggtcagtag

SEQ ID NO: 171227 - DNA, 25 bp, Mus musculus
agccacctccatcttgttgtgcagg

SEQ ID NO: 171228 - DNA, 25 bp, Mus musculus
agccacctccatgttgttgtgcagg

SEQ ID NO: 171229 - DNA, 25 bp, Mus musculus
agccacctctttcagcagagcagcg

SEQ ID NO: 171230 - DNA, 25 bp, Mus musculus
agccacctctttgagcagagcagcg

SEQ ID NO: 171231 - DNA, 25 bp, Mus musculus
agccacctgataagttggtaactga

SEQ ID NO: 171232 - DNA, 25 bp, Mus musculus
agccacctgatatgttggtaactga

SEQ ID NO: 171233 - DNA, 25 bp, Mus musculus
agccacctgattacccctaagaagg

SEQ ID NO: 171234 - DNA, 25 bp, Mus musculus
agccacctgattagggtgttagaaa

SEQ ID NO: 171235 - DNA, 25 bp, Mus musculus
agccacctgatttcccctaagaagg

SEQ ID NO: 171236 - DNA, 25 bp, Mus musculus
agccacctgatttgggtgttagaaa

SEQ ID NO: 171237 - DNA, 25 bp, Mus musculus
agccacctggagaactatgtcactg

SEQ ID NO: 171238 - DNA, 25 bp, Mus musculus
agccacctggagtactatgtcactg

SEQ ID NO: 171239 - DNA, 25 bp, Mus musculus
agccacctgtaactggttattcaga

SEQ ID NO: 171240 - DNA, 25 bp, Mus musculus
agccacctgtaagtggttattcaga

SEQ ID NO: 171241 - DNA, 25 bp, Mus musculus
agccaccttaccagctagagttgga

SEQ ID NO: 171242 - DNA, 25 bp, Mus musculus
agccaccttacctgctagagttgga

SEQ ID NO: 171243 - DNA, 25 bp, Mus musculus
agccaccttctgagggtgagccttt

SEQ ID NO: 171244 - DNA, 25 bp, Mus musculus
agccaccttctgtgggtgagccttt

SEQ ID NO: 171245 - DNA, 25 bp, Mus musculus
agccaccttggtagaatgcttctca

SEQ ID NO: 171246 - DNA, 25 bp, Mus musculus
agccaccttggttgaatgcttctca

SEQ ID NO: 171247 - DNA, 25 bp, Mus musculus
agccacgacaaacctctctgagagg

SEQ ID NO: 171248 - DNA, 25 bp, Mus musculus
agccacgacaaagctctctgagagg

SEQ ID NO: 171249 - DNA, 25 bp, Mus musculus
agccacgagattactgtactatgaa

SEQ ID NO: 171250 - DNA, 25 bp, Mus musculus
agccacgagatttctgtactatgaa

SEQ ID NO: 171251 - DNA, 25 bp, Mus musculus
agccacgagcgtctttctgagtaca

SEQ ID NO: 171252 - DNA, 25 bp, Mus musculus
agccacgagcgtgtttctgagtaca

SEQ ID NO: 171253 - DNA, 25 bp, Mus musculus
agccacgcatagaacgtatgccctt

SEQ ID NO: 171254 - DNA, 25 bp, Mus musculus
agccacgcatagtacgtatgccctt

SEQ ID NO: 171255 - DNA, 25 bp, Mus musculus
agccacgcccagaaattccgaaagg

SEQ ID NO: 171256 - DNA, 25 bp, Mus musculus
agccacgcccagtaattccgaaagg

SEQ ID NO: 171257 - DNA, 25 bp, Mus musculus
agccacgccccacagtgttctgaaa

SEQ ID NO: 171258 - DNA, 25 bp, Mus musculus
agccacgccccagagtgttctgaaa

SEQ ID NO: 171259 - DNA, 25 bp, Mus musculus
agccacgcccgtaaggagtactctg

SEQ ID NO: 171260 - DNA, 25 bp, Mus musculus
agccacgcccgttaggagtactctg

SEQ ID NO: 171261 - DNA, 25 bp, Mus musculus
agccacgctgccatatgatgacatg

SEQ ID NO: 171262 - DNA, 25 bp, Mus musculus
agccacgctgccttatgatgacatg

SEQ ID NO: 171263 - DNA, 25 bp, Mus musculus
agccacggagacatacaaccagtaa

SEQ ID NO: 171264 - DNA, 25 bp, Mus musculus
agccacggagacttacaaccagtaa

SEQ ID NO: 171265 - DNA, 25 bp, Mus musculus
agccacggagttccactcagtggtt

SEQ ID NO: 171266 - DNA, 25 bp, Mus musculus
agccacggagttgcactcagtggtt

SEQ ID NO: 171267 - DNA, 25 bp, Mus musculus
agccacggccttcgactgcaacgtg

SEQ ID NO: 171268 - DNA, 25 bp, Mus musculus
agccacggccttggactgcaacgtg

SEQ ID NO: 171269 - DNA, 25 bp, Mus musculus
agccacgggcagagcttgaactgac

SEQ ID NO: 171270 - DNA, 25 bp, Mus musculus
agccacgggcagtgcttgaactgac

SEQ ID NO: 171271 - DNA, 25 bp, Mus musculus
agccacggtgtaattttccacttgg

SEQ ID NO: 171272 - DNA, 25 bp, Mus musculus
agccacggtgtatttttccacttgg

SEQ ID NO: 171273 - DNA, 25 bp, Mus musculus
agccacgtccaaagtctattagcag

SEQ ID NO: 171274 - DNA, 25 bp, Mus musculus
agccacgtccaatgtctattagcag

SEQ ID NO: 171275 - DNA, 25 bp, Mus musculus
agccacgtccttcatccgagaagat

SEQ ID NO: 171276 - DNA, 25 bp, Mus musculus
agccacgtccttgatccgagaagat

SEQ ID NO: 171277 - DNA, 25 bp, Mus musculus
agccacgtctccagctcctgagtga

SEQ ID NO: 171278 - DNA, 25 bp, Mus musculus
agccacgtctcctgctcctgagtga

SEQ ID NO: 171279 - DNA, 25 bp, Mus musculus
agccacgtgagcatctagctatcta

SEQ ID NO: 171280 - DNA, 25 bp, Mus musculus
agccacgtgagcttctagctatcta

SEQ ID NO: 171281 - DNA, 25 bp, Mus musculus
agccacgtgattcctgctcaaaggt

SEQ ID NO: 171282 - DNA, 25 bp, Mus musculus
agccacgtgattgctgctcaaaggt

SEQ ID NO: 171283 - DNA, 25 bp, Mus musculus
agccacgtgggacatggagcctcct

SEQ ID NO: 171284 - DNA, 25 bp, Mus musculus
agccacgtgggagatggagcctcct

SEQ ID NO: 171285 - DNA, 25 bp, Mus musculus
agccacgtgttccaggagctgactc

SEQ ID NO: 171286 - DNA, 25 bp, Mus musculus
agccacgtgttcgaggagctgactc

SEQ ID NO: 171287 - DNA, 25 bp, Mus musculus
agccactaacctagcctggtacagt

SEQ ID NO: 171288 - DNA, 25 bp, Mus musculus
agccactaaccttgcctggtacagt

SEQ ID NO: 171289 - DNA, 25 bp, Mus musculus
agccactaattcacaggattccttc

SEQ ID NO: 171290 - DNA, 25 bp, Mus musculus
agccactaattctcaggattccttc

SEQ ID NO: 171291 - DNA, 25 bp, Mus musculus
agccactaattgcttgctattttaa

SEQ ID NO: 171292 - DNA, 25 bp, Mus musculus
agccactaattggttgctattttaa

SEQ ID NO: 171293 - DNA, 25 bp, Mus musculus
agccactagagaccgcttgggtttt

SEQ ID NO: 171294 - DNA, 25 bp, Mus musculus
agccactagagagcgcttgggtttt

SEQ ID NO: 171295 - DNA, 25 bp, Mus musculus
agccactagcaacagcatttccaac

SEQ ID NO: 171296 - DNA, 25 bp, Mus musculus
agccactagcaagagcatttccaac

SEQ ID NO: 171297 - DNA, 25 bp, Mus musculus
agccactagcgtccagctttacaaa

SEQ ID NO: 171298 - DNA, 25 bp, Mus musculus
agccactagcgtgcagctttacaaa

SEQ ID NO: 171299 - DNA, 25 bp, Mus musculus
agccactagctcagatccagtgaaa

SEQ ID NO: 171300 - DNA, 25 bp, Mus musculus
agccactagctctgatccagtgaaa

SEQ ID NO: 171301 - DNA, 25 bp, Mus musculus
agccactcaagacacccgggaagaa

SEQ ID NO: 171302 - DNA, 25 bp, Mus musculus
agccactcaagagacccgggaagaa

SEQ ID NO: 171303 - DNA, 25 bp, Mus musculus
agccactcaagcaactgccatcttg

SEQ ID NO: 171304 - DNA, 25 bp, Mus musculus
agccactcaagctactgccatcttg

SEQ ID NO: 171305 - DNA, 25 bp, Mus musculus
agccactcaggaagccaccaacaag

SEQ ID NO: 171306 - DNA, 25 bp, Mus musculus
agccactcaggatgccaccaacaag

SEQ ID NO: 171307 - DNA, 25 bp, Mus musculus
agccactcagtgagatttagattta

SEQ ID NO: 171308 - DNA, 25 bp, Mus musculus
agccactcagtgtgatttagattta

SEQ ID NO: 171309 - DNA, 25 bp, Mus musculus
agccactcgagtcactgtcattgga

SEQ ID NO: 171310 - DNA, 25 bp, Mus musculus
agccactcgagtgactgtcattgga

SEQ ID NO: 171311 - DNA, 25 bp, Mus musculus
agccactcgcacattggttagcttg

SEQ ID NO: 171312 - DNA, 25 bp, Mus musculus
agccactcgcactttggttagcttg

SEQ ID NO: 171313 - DNA, 25 bp, Mus musculus
agccactcggctattggcttgtcgg

SEQ ID NO: 171314 - DNA, 25 bp, Mus musculus
agccactcggcttttggcttgtcgg

SEQ ID NO: 171315 - DNA, 25 bp, Mus musculus
agccactctgagatcacttgtgcaa

SEQ ID NO: 171316 - DNA, 25 bp, Mus musculus
agccactctgagttcacttgtgcaa

SEQ ID NO: 171317 - DNA, 25 bp, Mus musculus
agccactcttccaggagaacctgaa

SEQ ID NO: 171318 - DNA, 25 bp, Mus musculus
agccactcttcctggagaacctgaa

SEQ ID NO: 171319 - DNA, 25 bp, Mus musculus
agccactcttttcaatcacttagca

SEQ ID NO: 171320 - DNA, 25 bp, Mus musculus
agccactcttttgaatcacttagca

SEQ ID NO: 171321 - DNA, 25 bp, Mus musculus
agccactgagctaatttctattaag

SEQ ID NO: 171322 - DNA, 25 bp, Mus musculus
agccactgagcttatttctattaag

SEQ ID NO: 171323 - DNA, 25 bp, Mus musculus
agccactgagggatgcccagcaaga

SEQ ID NO: 171324 - DNA, 25 bp, Mus musculus
agccactgagggttgcccagcaaga

SEQ ID NO: 171325 - DNA, 25 bp, Mus musculus
agccactgagtccatgaacttcctt

SEQ ID NO: 171326 - DNA, 25 bp, Mus musculus
agccactgagtcgatgaacttcctt

SEQ ID NO: 171327 - DNA, 25 bp, Mus musculus
agccactgatttacactgttgtgaa

SEQ ID NO: 171328 - DNA, 25 bp, Mus musculus
agccactgattttcactgttgtgaa

SEQ ID NO: 171329 - DNA, 25 bp, Mus musculus
agccactgcattctccagtgtctgt

SEQ ID NO: 171330 - DNA, 25 bp, Mus musculus
agccactgcattgtccagtgtctgt

SEQ ID NO: 171331 - DNA, 25 bp, Mus musculus
agccactgcgctaatcgagaagagt

SEQ ID NO: 171332 - DNA, 25 bp, Mus musculus
agccactgcgcttatcgagaagagt

SEQ ID NO: 171333 - DNA, 25 bp, Mus musculus
agccactgctgtatactgttagact

SEQ ID NO: 171334 - DNA, 25 bp, Mus musculus
agccactgctgtttactgttagact

SEQ ID NO: 171335 - DNA, 25 bp, Mus musculus
agccactggcacatagcgctggttg

SEQ ID NO: 171336 - DNA, 25 bp, Mus musculus
agccactggcacttagcgctggttg

SEQ ID NO: 171337 - DNA, 25 bp, Mus musculus
agccactggccacacacaggcctgc

SEQ ID NO: 171338 - DNA, 25 bp, Mus musculus
agccactggccagacacaggcctgc

SEQ ID NO: 171339 - DNA, 25 bp, Mus musculus
agccactgggcccaactaatgtctg

SEQ ID NO: 171340 - DNA, 25 bp, Mus musculus
agccactgggccgaactaatgtctg

SEQ ID NO: 171341 - DNA, 25 bp, Mus musculus
agccactgggtaagcctgtcaggaa

SEQ ID NO: 171342 - DNA, 25 bp, Mus musculus
agccactgggtatgcctgtcaggaa

SEQ ID NO: 171343 - DNA, 25 bp, Mus musculus
agccactggtagattcatttagaaa

SEQ ID NO: 171344 - DNA, 25 bp, Mus musculus
agccactggtagtttcatttagaaa

SEQ ID NO: 171345 - DNA, 25 bp, Mus musculus
agccactgtagcagttcacattaac

SEQ ID NO: 171346 - DNA, 25 bp, Mus musculus
agccactgtagctgttcacattaac

SEQ ID NO: 171347 - DNA, 25 bp, Mus musculus
agccactgtatgcatgtgtccacca

SEQ ID NO: 171348 - DNA, 25 bp, Mus musculus
agccactgtatggatgtgtccacca

SEQ ID NO: 171349 - DNA, 25 bp, Mus musculus
agccactgtcatcgcaaagccagct

SEQ ID NO: 171350 - DNA, 25 bp, Mus musculus
agccactgtcatggcaaagccagct

SEQ ID NO: 171351 - DNA, 25 bp, Mus musculus
agccactgtcctaaggtgccaagtc

SEQ ID NO: 171352 - DNA, 25 bp, Mus musculus
agccactgtccttaggtgccaagtc

SEQ ID NO: 171353 - DNA, 25 bp, Mus musculus
agccactgtgagcactacaagctaa

SEQ ID NO: 171354 - DNA, 25 bp, Mus musculus
agccactgtgaggactacaagctaa

SEQ ID NO: 171355 - DNA, 25 bp, Mus musculus
agccactgtgcaccttagctctagt

SEQ ID NO: 171356 - DNA, 25 bp, Mus musculus
agccactgtgcagcttagctctagt

SEQ ID NO: 171357 - DNA, 25 bp, Mus musculus
agccactgtgccatagccagtcctg

SEQ ID NO: 171358 - DNA, 25 bp, Mus musculus
agccactgtgccttagccagtcctg

SEQ ID NO: 171359 - DNA, 25 bp, Mus musculus
agccactgtggaaatatttgtactt

SEQ ID NO: 171360 - DNA, 25 bp, Mus musculus
agccactgtggatatatttgtactt

SEQ ID NO: 171361 - DNA, 25 bp, Mus musculus
agccactgtggccataggtcctaat

SEQ ID NO: 171362 - DNA, 25 bp, Mus musculus
agccactgtggcgataggtcctaat

SEQ ID NO: 171363 - DNA, 25 bp, Mus musculus
agccactgtggtattgcctttgcca

SEQ ID NO: 171364 - DNA, 25 bp, Mus musculus
agccactgtggttttgcctttgcca

SEQ ID NO: 171365 - DNA, 25 bp, Mus musculus
agccactgtttgagtttgaaaccaa

SEQ ID NO: 171366 - DNA, 25 bp, Mus musculus
agccactgtttgtgtttgaaaccaa

SEQ ID NO: 171367 - DNA, 25 bp, Mus musculus
agccacttaacccaggcaagatctc

SEQ ID NO: 171368 - DNA, 25 bp, Mus musculus
agccacttaaccgaggcaagatctc

SEQ ID NO: 171369 - DNA, 25 bp, Mus musculus
agccacttaacgatgtgctcaagat

SEQ ID NO: 171370 - DNA, 25 bp, Mus musculus
agccacttaacgttgtgctcaagat

SEQ ID NO: 171371 - DNA, 25 bp, Mus musculus
agccacttaagcagcatgggtaaag

SEQ ID NO: 171372 - DNA, 25 bp, Mus musculus
agccacttaagctgcatgggtaaag

SEQ ID NO: 171373 - DNA, 25 bp, Mus musculus
agccacttaattagcatttcgccct

SEQ ID NO: 171374 - DNA, 25 bp, Mus musculus
agccacttaatttgcatttcgccct

SEQ ID NO: 171375 - DNA, 25 bp, Mus musculus
agccacttagacatttcacacacta

SEQ ID NO: 171376 - DNA, 25 bp, Mus musculus
agccacttagacttttcacacacta

SEQ ID NO: 171377 - DNA, 25 bp, Mus musculus
agccacttagcacatcatcagtctg

SEQ ID NO: 171378 - DNA, 25 bp, Mus musculus
agccacttagcagatcatcagtctg

SEQ ID NO: 171379 - DNA, 25 bp, Mus musculus
agccacttagctaaatcttttcagt

SEQ ID NO: 171380 - DNA, 25 bp, Mus musculus
agccacttagcttaatcttttcagt

SEQ ID NO: 171381 - DNA, 25 bp, Mus musculus
agccacttagtgctttgtcctggac

SEQ ID NO: 171382 - DNA, 25 bp, Mus musculus
agccacttagtggtttgtcctggac

SEQ ID NO: 171383 - DNA, 25 bp, Mus musculus
agccacttctatctccgtccagtga

SEQ ID NO: 171384 - DNA, 25 bp, Mus musculus
agccacttctatgtccgtccagtga

SEQ ID NO: 171385 - DNA, 25 bp, Mus musculus
agccacttgaaaccgcggcctctat

SEQ ID NO: 171386 - DNA, 25 bp, Mus musculus
agccacttgaaagcgcggcctctat

SEQ ID NO: 171387 - DNA, 25 bp, Mus musculus
agccacttgagacagtcccctgaga

SEQ ID NO: 171388 - DNA, 25 bp, Mus musculus
agccacttgagagagtcccctgaga

SEQ ID NO: 171389 - DNA, 25 bp, Mus musculus
agccacttgcagcaggaggtttatc

SEQ ID NO: 171390 - DNA, 25 bp, Mus musculus
agccacttgcaggaggaggtttatc

SEQ ID NO: 171391 - DNA, 25 bp, Mus musculus
agccacttggctattatttgttcta

SEQ ID NO: 171392 - DNA, 25 bp, Mus musculus
agccacttggcttttatttgttcta

SEQ ID NO: 171393 - DNA, 25 bp, Mus musculus
agccacttgtggcaatttcttattc

SEQ ID NO: 171394 - DNA, 25 bp, Mus musculus
agccacttgtgggaatttcttattc

SEQ ID NO: 171395 - DNA, 25 bp, Mus musculus
agccactttaacacttctctattgc

SEQ ID NO: 171396 - DNA, 25 bp, Mus musculus
agccactttaactcttctctattgc

SEQ ID NO: 171397 - DNA, 25 bp, Mus musculus
agccactttctgaatctcaggcaaa

SEQ ID NO: 171398 - DNA, 25 bp, Mus musculus
agccactttctgtatctcaggcaaa

SEQ ID NO: 171399 - DNA, 25 bp, Mus musculus
agccactttgatcccttatgttctt

SEQ ID NO: 171400 - DNA, 25 bp, Mus musculus
agccactttgatgccttatgttctt

SEQ ID NO: 171401 - DNA, 25 bp, Mus musculus
agccactttgctatatcactcttta

SEQ ID NO: 171402 - DNA, 25 bp, Mus musculus
agccactttgctttatcactcttta

SEQ ID NO: 171403 - DNA, 25 bp, Mus musculus
agccagaaaaatacaagttgtccca

SEQ ID NO: 171404 - DNA, 25 bp, Mus musculus
agccagaaaaattcaagttgtccca

SEQ ID NO: 171405 - DNA, 25 bp, Mus musculus
agccagaaactgcaggctctgtatt

SEQ ID NO: 171406 - DNA, 25 bp, Mus musculus
agccagaaactggaggctctgtatt

SEQ ID NO: 171407 - DNA, 25 bp, Mus musculus
agccagaaacttagcttcctcagtc

SEQ ID NO: 171408 - DNA, 25 bp, Mus musculus
agccagaaactttgcttcctcagtc

SEQ ID NO: 171409 - DNA, 25 bp, Mus musculus
agccagaaagtacaacagtcctaaa

SEQ ID NO: 171410 - DNA, 25 bp, Mus musculus
agccagaaagtagaacagtcctaaa

SEQ ID NO: 171411 - DNA, 25 bp, Mus musculus
agccagaacaagactgtcttctgca

SEQ ID NO: 171412 - DNA, 25 bp, Mus musculus
agccagaacaagtctgtcttctgca

SEQ ID NO: 171413 - DNA, 25 bp, Mus musculus
agccagaaccctaatgactgctgtg

SEQ ID NO: 171414 - DNA, 25 bp, Mus musculus
agccagaacccttatgactgctgtg

SEQ ID NO: 171415 - DNA, 25 bp, Mus musculus
agccagaagagcctagtagcccatc

SEQ ID NO: 171416 - DNA, 25 bp, Mus musculus
agccagaagagcgtagtagcccatc

SEQ ID NO: 171417 - DNA, 25 bp, Mus musculus
agccagaagaggaggttgcacagaa

SEQ ID NO: 171418 - DNA, 25 bp, Mus musculus
agccagaagaggtggttgcacagaa

SEQ ID NO: 171419 - DNA, 25 bp, Mus musculus
agccagaaggcgactatttttcccg

SEQ ID NO: 171420 - DNA, 25 bp, Mus musculus
agccagaaggcgtctatttttcccg

SEQ ID NO: 171421 - DNA, 25 bp, Mus musculus
agccagaaggtgaagagcaagtgaa

SEQ ID NO: 171422 - DNA, 25 bp, Mus musculus
agccagaaggtgtagagcaagtgaa

SEQ ID NO: 171423 - DNA, 25 bp, Mus musculus
agccagaatttcaactatgcataga

SEQ ID NO: 171424 - DNA, 25 bp, Mus musculus
agccagaatttcagcgcaagcgcaa

SEQ ID NO: 171425 - DNA, 25 bp, Mus musculus
agccagaatttctactatgcataga

SEQ ID NO: 171426 - DNA, 25 bp, Mus musculus
agccagaatttctgcgcaagcgcaa

SEQ ID NO: 171427 - DNA, 25 bp, Mus musculus
agccagaattttcctgttcctgtca

SEQ ID NO: 171428 - DNA, 25 bp, Mus musculus
agccagaattttgctgttcctgtca

SEQ ID NO: 171429 - DNA, 25 bp, Mus musculus
agccagacagatcccatgtttcctt

SEQ ID NO: 171430 - DNA, 25 bp, Mus musculus
agccagacagatgccatgtttcctt

SEQ ID NO: 171431 - DNA, 25 bp, Mus musculus
agccagacaggcatggtctttggaa

SEQ ID NO: 171432 - DNA, 25 bp, Mus musculus
agccagacaggcttggtctttggaa

SEQ ID NO: 171433 - DNA, 25 bp, Mus musculus
agccagacagtgaaacttctctcat

SEQ ID NO: 171434 - DNA, 25 bp, Mus musculus
agccagacagtgtaacttctctcat

SEQ ID NO: 171435 - DNA, 25 bp, Mus musculus
agccagacataaacttgcccaagaa

SEQ ID NO: 171436 - DNA, 25 bp, Mus musculus
agccagacataatcttgcccaagaa

SEQ ID NO: 171437 - DNA, 25 bp, Mus musculus
agccagacatggagatatatactta

SEQ ID NO: 171438 - DNA, 25 bp, Mus musculus
agccagacatggtgatatatactta

SEQ ID NO: 171439 - DNA, 25 bp, Mus musculus
agccagacctcactaggcagcagct

SEQ ID NO: 171440 - DNA, 25 bp, Mus musculus
agccagacctcagtaggcagcagct

SEQ ID NO: 171441 - DNA, 25 bp, Mus musculus
agccagacctgaccgttgctgccga

SEQ ID NO: 171442 - DNA, 25 bp, Mus musculus
agccagacctgagcgttgctgccga

SEQ ID NO: 171443 - DNA, 25 bp, Mus musculus
agccagacctgcagatgctgaatca

SEQ ID NO: 171444 - DNA, 25 bp, Mus musculus
agccagacctgctgatgctgaatca

SEQ ID NO: 171445 - DNA, 25 bp, Mus musculus
agccagacctgtcaccatgggtaga

SEQ ID NO: 171446 - DNA, 25 bp, Mus musculus
agccagacctgtgaccatgggtaga

SEQ ID NO: 171447 - DNA, 25 bp, Mus musculus
agccagactccaagcagttctagaa

SEQ ID NO: 171448 - DNA, 25 bp, Mus musculus
agccagactccatgcagttctagaa

SEQ ID NO: 171449 - DNA, 25 bp, Mus musculus
agccagactcttacaaccacaaggg

SEQ ID NO: 171450 - DNA, 25 bp, Mus musculus
agccagactctttcaaccacaaggg

SEQ ID NO: 171451 - DNA, 25 bp, Mus musculus
agccagactgagctacagagttcca

SEQ ID NO: 171452 - DNA, 25 bp, Mus musculus
agccagactgaggtacagagttcca

SEQ ID NO: 171453 - DNA, 25 bp, Mus musculus
agccagactggcaatttgtcatcaa

SEQ ID NO: 171454 - DNA, 25 bp, Mus musculus
agccagactggccatgttggatcaa

SEQ ID NO: 171455 - DNA, 25 bp, Mus musculus
agccagactggcgatgttggatcaa

SEQ ID NO: 171456 - DNA, 25 bp, Mus musculus
agccagactggctatttgtcatcaa

SEQ ID NO: 171457 - DNA, 25 bp, Mus musculus
agccagactgttatattcttgttga

SEQ ID NO: 171458 - DNA, 25 bp, Mus musculus
agccagactgttttattcttgttga

SEQ ID NO: 171459 - DNA, 25 bp, Mus musculus
agccagagaaacctccccggagtgc

SEQ ID NO: 171460 - DNA, 25 bp, Mus musculus
agccagagaaacgtccccggagtgc

SEQ ID NO: 171461 - DNA, 25 bp, Mus musculus
agccagagacaaacagagccatttt

SEQ ID NO: 171462 - DNA, 25 bp, Mus musculus
agccagagacaatcagagccatttt

SEQ ID NO: 171463 - DNA, 25 bp, Mus musculus
agccagagagccaggtcccgcaggt

SEQ ID NO: 171464 - DNA, 25 bp, Mus musculus
agccagagagcctggtcccgcaggt

SEQ ID NO: 171465 - DNA, 25 bp, Mus musculus
agccagagagtgctcaacctcacag

SEQ ID NO: 171466 - DNA, 25 bp, Mus musculus
agccagagagtggtcaacctcacag

SEQ ID NO: 171467 - DNA, 25 bp, Mus musculus
agccagagattcagctcatagagaa

SEQ ID NO: 171468 - DNA, 25 bp, Mus musculus
agccagagattctgctcatagagaa

SEQ ID NO: 171469 - DNA, 25 bp, Mus musculus
agccagagcattctacagttttctt

SEQ ID NO: 171470 - DNA, 25 bp, Mus musculus
agccagagcattgtacagttttctt

SEQ ID NO: 171471 - DNA, 25 bp, Mus musculus
agccagagcgtcagtcgtcgggatc

SEQ ID NO: 171472 - DNA, 25 bp, Mus musculus
agccagagcgtctgtcgtcgggatc

SEQ ID NO: 171473 - DNA, 25 bp, Mus musculus
agccagagctgcacagagaaccctg

SEQ ID NO: 171474 - DNA, 25 bp, Mus musculus
agccagagctgctcagagaaccctg

SEQ ID NO: 171475 - DNA, 25 bp, Mus musculus
agccagaggcagatcttaccgagta

SEQ ID NO: 171476 - DNA, 25 bp, Mus musculus
agccagaggcagttcttaccgagta

SEQ ID NO: 171477 - DNA, 25 bp, Mus musculus
agccagaggcggacgactcccggaa

SEQ ID NO: 171478 - DNA, 25 bp, Mus musculus
agccagaggcggtcgactcccggaa

SEQ ID NO: 171479 - DNA, 25 bp, Mus musculus
agccagagggaaaggaagacaccaa

SEQ ID NO: 171480 - DNA, 25 bp, Mus musculus
agccagagggaatggaagacaccaa

SEQ ID NO: 171481 - DNA, 25 bp, Mus musculus
agccagaggtacaatcccaaattaa

SEQ ID NO: 171482 - DNA, 25 bp, Mus musculus
agccagaggtactatcccaaattaa

SEQ ID NO: 171483 - DNA, 25 bp, Mus musculus
agccagaggtcccatgtccttggca

SEQ ID NO: 171484 - DNA, 25 bp, Mus musculus
agccagaggtccgatgtccttggca

SEQ ID NO: 171485 - DNA, 25 bp, Mus musculus
agccagaggtggcagcatgcattca

SEQ ID NO: 171486 - DNA, 25 bp, Mus musculus
agccagaggtgggagcatgcattca

SEQ ID NO: 171487 - DNA, 25 bp, Mus musculus
agccagagtcaaactgatcctttat

SEQ ID NO: 171488 - DNA, 25 bp, Mus musculus
agccagagtcaatctgatcctttat

SEQ ID NO: 171489 - DNA, 25 bp, Mus musculus
agccagagtcggagttcggtttcta

SEQ ID NO: 171490 - DNA, 25 bp, Mus musculus
agccagagtcggtgttcggtttcta

SEQ ID NO: 171491 - DNA, 25 bp, Mus musculus
agccagagtctaaaggaggtgtcct

SEQ ID NO: 171492 - DNA, 25 bp, Mus musculus
agccagagtctataggaggtgtcct

SEQ ID NO: 171493 - DNA, 25 bp, Mus musculus
agccagagtctccctcagatatttt

SEQ ID NO: 171494 - DNA, 25 bp, Mus musculus
agccagagtctcgctcagatatttt

SEQ ID NO: 171495 - DNA, 25 bp, Mus musculus
agccagagtgaaaacagtgcggagt

SEQ ID NO: 171496 - DNA, 25 bp, Mus musculus
agccagagtgaatacagtgcggagt

SEQ ID NO: 171497 - DNA, 25 bp, Mus musculus
agccagagtgtcacagcactgttat

SEQ ID NO: 171498 - DNA, 25 bp, Mus musculus
agccagagtgtctcagcactgttat

SEQ ID NO: 171499 - DNA, 25 bp, Mus musculus
agccagatagagaacctctgagtca

SEQ ID NO: 171500 - DNA, 25 bp, Mus musculus
agccagatagagtacctctgagtca

SEQ ID NO: 171501 - DNA, 25 bp, Mus musculus
agccagatatcacaacgcccttatt

SEQ ID NO: 171502 - DNA, 25 bp, Mus musculus
agccagatatcagaacgcccttatt

SEQ ID NO: 171503 - DNA, 25 bp, Mus musculus
agccagatatttaacatgctctaag

SEQ ID NO: 171504 - DNA, 25 bp, Mus musculus
agccagatattttacatgctctaag

SEQ ID NO: 171505 - DNA, 25 bp, Mus musculus
agccagatcgtcatggtgagaccct

SEQ ID NO: 171506 - DNA, 25 bp, Mus musculus
agccagatcgtcttggtgagaccct

SEQ ID NO: 171507 - DNA, 25 bp, Mus musculus
agccagatctgccttggattacatg

SEQ ID NO: 171508 - DNA, 25 bp, Mus musculus
agccagatctgcgttggattacatg

SEQ ID NO: 171509 - DNA, 25 bp, Mus musculus
agccagatgcttatacgaggtacca

SEQ ID NO: 171510 - DNA, 25 bp, Mus musculus
agccagatgcttttacgaggtacca

SEQ ID NO: 171511 - DNA, 25 bp, Mus musculus
agccagatggctcagcggaagatcc

SEQ ID NO: 171512 - DNA, 25 bp, Mus musculus
agccagatggctgagcggaagatcc

SEQ ID NO: 171513 - DNA, 25 bp, Mus musculus
agccagatgtggcacgcacctttca

SEQ ID NO: 171514 - DNA, 25 bp, Mus musculus
agccagatgtgggacgcacctttca

SEQ ID NO: 171515 - DNA, 25 bp, Mus musculus
agccagattccgctgagtatatcaa

SEQ ID NO: 171516 - DNA, 25 bp, Mus musculus
agccagattccggtgagtatatcaa

SEQ ID NO: 171517 - DNA, 25 bp, Mus musculus
agccagattgcccaatggttccttt

SEQ ID NO: 171518 - DNA, 25 bp, Mus musculus
agccagattgccgaatggttccttt

SEQ ID NO: 171519 - DNA, 25 bp, Mus musculus
agccagattggcacacttctgcaag

SEQ ID NO: 171520 - DNA, 25 bp, Mus musculus
agccagattggctcacttctgcaag

SEQ ID NO: 171521 - DNA, 25 bp, Mus musculus
agccagatttccattgagttgtttg

SEQ ID NO: 171522 - DNA, 25 bp, Mus musculus
agccagatttcctttgagttgtttg

SEQ ID NO: 171523 - DNA, 25 bp, Mus musculus
agccagcaaaaaatattcacttgtg

SEQ ID NO: 171524 - DNA, 25 bp, Mus musculus
agccagcaaaaattattcacttgtg

SEQ ID NO: 171525 - DNA, 25 bp, Mus musculus
agccagcaagagcaactcgggtatc

SEQ ID NO: 171526 - DNA, 25 bp, Mus musculus
agccagcaagaggaactcgggtatc

SEQ ID NO: 171527 - DNA, 25 bp, Mus musculus
agccagcaagctacttttggttgtt

SEQ ID NO: 171528 - DNA, 25 bp, Mus musculus
agccagcaagcttcttttggttgtt

SEQ ID NO: 171529 - DNA, 25 bp, Mus musculus
agccagcaaggccaagtatcagact

SEQ ID NO: 171530 - DNA, 25 bp, Mus musculus
agccagcaaggcgaagtatcagact

SEQ ID NO: 171531 - DNA, 25 bp, Mus musculus
agccagcaattcagagcagttttaa

SEQ ID NO: 171532 - DNA, 25 bp, Mus musculus
agccagcaattctgagcagttttaa

SEQ ID NO: 171533 - DNA, 25 bp, Mus musculus
agccagcaccagctagagaacttgg

SEQ ID NO: 171534 - DNA, 25 bp, Mus musculus
agccagcaccagctgagggcaaagc

SEQ ID NO: 171535 - DNA, 25 bp, Mus musculus
agccagcaccaggtagagaacttgg

SEQ ID NO: 171536 - DNA, 25 bp, Mus musculus
agccagcaccaggtgagggcaaagc

SEQ ID NO: 171537 - DNA, 25 bp, Mus musculus
agccagcacctgaatatccgacttg

SEQ ID NO: 171538 - DNA, 25 bp, Mus musculus
agccagcacctgcatattccagaaa

SEQ ID NO: 171539 - DNA, 25 bp, Mus musculus
agccagcacctggatattccagaaa

SEQ ID NO: 171540 - DNA, 25 bp, Mus musculus
agccagcacctgtatatccgacttg

SEQ ID NO: 171541 - DNA, 25 bp, Mus musculus
agccagcactcgaactacataggat

SEQ ID NO: 171542 - DNA, 25 bp, Mus musculus
agccagcactcgtactacataggat

SEQ ID NO: 171543 - DNA, 25 bp, Mus musculus
agccagcactctcatactttggtgg

SEQ ID NO: 171544 - DNA, 25 bp, Mus musculus
agccagcactctccttactttaaag

SEQ ID NO: 171545 - DNA, 25 bp, Mus musculus
agccagcactctgatactttggtgg

SEQ ID NO: 171546 - DNA, 25 bp, Mus musculus
agccagcactctgcttactttaaag

SEQ ID NO: 171547 - DNA, 25 bp, Mus musculus
agccagcactggaagggcacatttt

SEQ ID NO: 171548 - DNA, 25 bp, Mus musculus
agccagcactggtagggcacatttt

SEQ ID NO: 171549 - DNA, 25 bp, Mus musculus
agccagcagccacaatctcgagtag

SEQ ID NO: 171550 - DNA, 25 bp, Mus musculus
agccagcagccagaatctcgagtag

SEQ ID NO: 171551 - DNA, 25 bp, Mus musculus
agccagcagcgacaatccctggact

SEQ ID NO: 171552 - DNA, 25 bp, Mus musculus
agccagcagcgagaatccctggact

SEQ ID NO: 171553 - DNA, 25 bp, Mus musculus
agccagcagctgaatatttgacaaa

SEQ ID NO: 171554 - DNA, 25 bp, Mus musculus
agccagcagctgtatatttgacaaa

SEQ ID NO: 171555 - DNA, 25 bp, Mus musculus
agccagcagttcatcttgggaccag

SEQ ID NO: 171556 - DNA, 25 bp, Mus musculus
agccagcagttcttcttgggaccag

SEQ ID NO: 171557 - DNA, 25 bp, Mus musculus
agccagcagtttactcctgaatgga

SEQ ID NO: 171558 - DNA, 25 bp, Mus musculus
agccagcagtttcctctgtgagcac

SEQ ID NO: 171559 - DNA, 25 bp, Mus musculus
agccagcagtttctaatgtcaccga

SEQ ID NO: 171560 - DNA, 25 bp, Mus musculus
agccagcagtttgctctgtgagcac

SEQ ID NO: 171561 - DNA, 25 bp, Mus musculus
agccagcagtttgtaatgtcaccga

SEQ ID NO: 171562 - DNA, 25 bp, Mus musculus
agccagcagttttctcctgaatgga

SEQ ID NO: 171563 - DNA, 25 bp, Mus musculus
agccagcatacacacagcatcaaag

SEQ ID NO: 171564 - DNA, 25 bp, Mus musculus
agccagcatacagacagcatcaaag

SEQ ID NO: 171565 - DNA, 25 bp, Mus musculus
agccagcatcacatgcacttaaatc

SEQ ID NO: 171566 - DNA, 25 bp, Mus musculus
agccagcatcacttgcacttaaatc

SEQ ID NO: 171567 - DNA, 25 bp, Mus musculus
agccagcatccgagagtgagcagcc

SEQ ID NO: 171568 - DNA, 25 bp, Mus musculus
agccagcatccgtgagtgagcagcc

SEQ ID NO: 171569 - DNA, 25 bp, Mus musculus
agccagcatgtgctcgatgggacct

SEQ ID NO: 171570 - DNA, 25 bp, Mus musculus
agccagcatgtggtcgatgggacct

SEQ ID NO: 171571 - DNA, 25 bp, Mus musculus
agccagccacggaactttaccaggg

SEQ ID NO: 171572 - DNA, 25 bp, Mus musculus
agccagccacggtactttaccaggg

SEQ ID NO: 171573 - DNA, 25 bp, Mus musculus
agccagccagaaagttcatgataat

SEQ ID NO: 171574 - DNA, 25 bp, Mus musculus
agccagccagaatgttcatgataat

SEQ ID NO: 171575 - DNA, 25 bp, Mus musculus
agccagccagataaccacagggtgc

SEQ ID NO: 171576 - DNA, 25 bp, Mus musculus
agccagccagattaccacagggtgc

SEQ ID NO: 171577 - DNA, 25 bp, Mus musculus
agccagccaggcatcaaacactgtc

SEQ ID NO: 171578 - DNA, 25 bp, Mus musculus
agccagccaggcctttagtgtcttt

SEQ ID NO: 171579 - DNA, 25 bp, Mus musculus
agccagccaggcgtttagtgtcttt

SEQ ID NO: 171580 - DNA, 25 bp, Mus musculus
agccagccaggcttcaaacactgtc

SEQ ID NO: 171581 - DNA, 25 bp, Mus musculus
agccagccagtcaggtctctggtcc

SEQ ID NO: 171582 - DNA, 25 bp, Mus musculus
agccagccagtctggtctctggtcc

SEQ ID NO: 171583 - DNA, 25 bp, Mus musculus
agccagccatccctaaggaatattt

SEQ ID NO: 171584 - DNA, 25 bp, Mus musculus
agccagccatccgtaaggaatattt

SEQ ID NO: 171585 - DNA, 25 bp, Mus musculus
agccagccatggagcgcatcaacgc

SEQ ID NO: 171586 - DNA, 25 bp, Mus musculus
agccagccatggtgcgcatcaacgc

SEQ ID NO: 171587 - DNA, 25 bp, Mus musculus
agccagccatgtctccagaagacaa

SEQ ID NO: 171588 - DNA, 25 bp, Mus musculus
agccagccatgtgtccagaagacaa

SEQ ID NO: 171589 - DNA, 25 bp, Mus musculus
agccagccccaaatggtttcttttg

SEQ ID NO: 171590 - DNA, 25 bp, Mus musculus
agccagccccaattggtttcttttg

SEQ ID NO: 171591 - DNA, 25 bp, Mus musculus
agccagcccctgatcctgggaggag

SEQ ID NO: 171592 - DNA, 25 bp, Mus musculus
agccagcccctgttcctgggaggag

SEQ ID NO: 171593 - DNA, 25 bp, Mus musculus
agccagccctgcatgtggtgagcgt

SEQ ID NO: 171594 - DNA, 25 bp, Mus musculus
agccagccctgcttgtggtgagcgt

SEQ ID NO: 171595 - DNA, 25 bp, Mus musculus
agccagccctggctagatgtgactg

SEQ ID NO: 171596 - DNA, 25 bp, Mus musculus
agccagccctgggtagatgtgactg

SEQ ID NO: 171597 - DNA, 25 bp, Mus musculus
agccagccctgtcttagtttataga

SEQ ID NO: 171598 - DNA, 25 bp, Mus musculus
agccagccctgtgttagtttataga

SEQ ID NO: 171599 - DNA, 25 bp, Mus musculus
agccagccgtctacctgtggatata

SEQ ID NO: 171600 - DNA, 25 bp, Mus musculus
agccagccgtcttcctgtggatata

SEQ ID NO: 171601 - DNA, 25 bp, Mus musculus
agccagcctactataaccactgaac

SEQ ID NO: 171602 - DNA, 25 bp, Mus musculus
agccagcctactttaaccactgaac

SEQ ID NO: 171603 - DNA, 25 bp, Mus musculus
agccagcctaggatgcataagacct

SEQ ID NO: 171604 - DNA, 25 bp, Mus musculus
agccagcctaggttgcataagacct

SEQ ID NO: 171605 - DNA, 25 bp, Mus musculus
agccagcctcaaaccaactttaaat

SEQ ID NO: 171606 - DNA, 25 bp, Mus musculus
agccagcctcaatccaactttaaat

SEQ ID NO: 171607 - DNA, 25 bp, Mus musculus
agccagcctgacagcttaaccagga

SEQ ID NO: 171608 - DNA, 25 bp, Mus musculus
agccagcctgactgcttaaccagga

SEQ ID NO: 171609 - DNA, 25 bp, Mus musculus
agccagcctggaatcttcaaatgac

SEQ ID NO: 171610 - DNA, 25 bp, Mus musculus
agccagcctggattcttcaaatgac

SEQ ID NO: 171611 - DNA, 25 bp, Mus musculus
agccagcctgtacccctcaataaag

SEQ ID NO: 171612 - DNA, 25 bp, Mus musculus
agccagcctgtagccctcaataaag

SEQ ID NO: 171613 - DNA, 25 bp, Mus musculus
agccagcctgtgagaaatgagggtt

SEQ ID NO: 171614 - DNA, 25 bp, Mus musculus
agccagcctgtgtgaaatgagggtt

SEQ ID NO: 171615 - DNA, 25 bp, Mus musculus
agccagcctgttccaccaggttcta

SEQ ID NO: 171616 - DNA, 25 bp, Mus musculus
agccagcctgttgcaccaggttcta

SEQ ID NO: 171617 - DNA, 25 bp, Mus musculus
agccagccttgcagagggagctctc

SEQ ID NO: 171618 - DNA, 25 bp, Mus musculus
agccagccttgctgagggagctctc

SEQ ID NO: 171619 - DNA, 25 bp, Mus musculus
agccagcgccccaaggagatttatg

SEQ ID NO: 171620 - DNA, 25 bp, Mus musculus
agccagcgcccctaggagatttatg

SEQ ID NO: 171621 - DNA, 25 bp, Mus musculus
agccagcgccggaagagctcgtcca

SEQ ID NO: 171622 - DNA, 25 bp, Mus musculus
agccagcgccggtagagctcgtcca

SEQ ID NO: 171623 - DNA, 25 bp, Mus musculus
agccagcgctgaagtctcctttctt

SEQ ID NO: 171624 - DNA, 25 bp, Mus musculus
agccagcgctgatgtctcctttctt

SEQ ID NO: 171625 - DNA, 25 bp, Mus musculus
agccagcgtactcttttttgtggaa

SEQ ID NO: 171626 - DNA, 25 bp, Mus musculus
agccagcgtactgttttttgtggaa

SEQ ID NO: 171627 - DNA, 25 bp, Mus musculus
agccagcgtagaccctgggcctcag

SEQ ID NO: 171628 - DNA, 25 bp, Mus musculus
agccagcgtagagcctgggcctcag

SEQ ID NO: 171629 - DNA, 25 bp, Mus musculus
agccagctacatccagagcaagttt

SEQ ID NO: 171630 - DNA, 25 bp, Mus musculus
agccagctacatgcagagcaagttt

SEQ ID NO: 171631 - DNA, 25 bp, Mus musculus
agccagctagacaactaacacttct

SEQ ID NO: 171632 - DNA, 25 bp, Mus musculus
agccagctagactactaacacttct

SEQ ID NO: 171633 - DNA, 25 bp, Mus musculus
agccagctagctcgtacgctagaga

SEQ ID NO: 171634 - DNA, 25 bp, Mus musculus
agccagctagctggtacgctagaga

SEQ ID NO: 171635 - DNA, 25 bp, Mus musculus
agccagctcactagtgaacgcgaca

SEQ ID NO: 171636 - DNA, 25 bp, Mus musculus
agccagctcacttgtgaacgcgaca

SEQ ID NO: 171637 - DNA, 25 bp, Mus musculus
agccagctcaggctgtgacttgcag

SEQ ID NO: 171638 - DNA, 25 bp, Mus musculus
agccagctcagggtgtgacttgcag

SEQ ID NO: 171639 - DNA, 25 bp, Mus musculus
agccagctcattaaagtctaggtca

SEQ ID NO: 171640 - DNA, 25 bp, Mus musculus
agccagctcatttaagtctaggtca

SEQ ID NO: 171641 - DNA, 25 bp, Mus musculus
agccagctcctgaagcacataggca

SEQ ID NO: 171642 - DNA, 25 bp, Mus musculus
agccagctcctgatttcaatgccaa

SEQ ID NO: 171643 - DNA, 25 bp, Mus musculus
agccagctcctgtagcacataggca

SEQ ID NO: 171644 - DNA, 25 bp, Mus musculus
agccagctcctgttttcaatgccaa

SEQ ID NO: 171645 - DNA, 25 bp, Mus musculus
agccagctctcccagcagagtgaac

SEQ ID NO: 171646 - DNA, 25 bp, Mus musculus
agccagctctccgagcagagtgaac

SEQ ID NO: 171647 - DNA, 25 bp, Mus musculus
agccagctctctctacatttgctag

SEQ ID NO: 171648 - DNA, 25 bp, Mus musculus
agccagctctctgtacatttgctag

SEQ ID NO: 171649 - DNA, 25 bp, Mus musculus
agccagctctggacaacaactaaca

SEQ ID NO: 171650 - DNA, 25 bp, Mus musculus
agccagctctggtcaacaactaaca

SEQ ID NO: 171651 - DNA, 25 bp, Mus musculus
agccagctgaggagtccgtctccat

SEQ ID NO: 171652 - DNA, 25 bp, Mus musculus
agccagctgaggtgtccgtctccat

SEQ ID NO: 171653 - DNA, 25 bp, Mus musculus
agccagctgcccaaaggcaggcact

SEQ ID NO: 171654 - DNA, 25 bp, Mus musculus
agccagctgccctaaggcaggcact

SEQ ID NO: 171655 - DNA, 25 bp, Mus musculus
agccagctgctgcacctgtagttcc

SEQ ID NO: 171656 - DNA, 25 bp, Mus musculus
agccagctgctggacctgtagttcc

SEQ ID NO: 171657 - DNA, 25 bp, Mus musculus
agccagctggcacaaccaaacggat

SEQ ID NO: 171658 - DNA, 25 bp, Mus musculus
agccagctggcagaaccaaacggat

SEQ ID NO: 171659 - DNA, 25 bp, Mus musculus
agccagctggctcgatgtgcccaga

SEQ ID NO: 171660 - DNA, 25 bp, Mus musculus
agccagctggctggatgtgcccaga

SEQ ID NO: 171661 - DNA, 25 bp, Mus musculus
agccagctgggcagaagctgcatgt

SEQ ID NO: 171662 - DNA, 25 bp, Mus musculus
agccagctgggctgaagctgcatgt

SEQ ID NO: 171663 - DNA, 25 bp, Mus musculus
agccagctgttccacactgtattat

SEQ ID NO: 171664 - DNA, 25 bp, Mus musculus
agccagctgttcgacactgtattat

SEQ ID NO: 171665 - DNA, 25 bp, Mus musculus
agccagcttaaacccatacaatgta

SEQ ID NO: 171666 - DNA, 25 bp, Mus musculus
agccagcttaaagccatacaatgta

SEQ ID NO: 171667 - DNA, 25 bp, Mus musculus
agccagcttaagataccctgagtgc

SEQ ID NO: 171668 - DNA, 25 bp, Mus musculus
agccagcttaagttaccctgagtgc

SEQ ID NO: 171669 - DNA, 25 bp, Mus musculus
agccagcttgccatgttgaatttaa

SEQ ID NO: 171670 - DNA, 25 bp, Mus musculus
agccagcttgccttgttgaatttaa

SEQ ID NO: 171671 - DNA, 25 bp, Mus musculus
agccagcttgggatctctgtctaag

SEQ ID NO: 171672 - DNA, 25 bp, Mus musculus
agccagcttgggttctctgtctaag

SEQ ID NO: 171673 - DNA, 25 bp, Mus musculus
agccagcttgtgcagctcctgtaga

SEQ ID NO: 171674 - DNA, 25 bp, Mus musculus
agccagcttgtggagctcctgtaga

SEQ ID NO: 171675 - DNA, 25 bp, Mus musculus
agccaggaacgtcgactcggttctt

SEQ ID NO: 171676 - DNA, 25 bp, Mus musculus
agccaggaacgtggactcggttctt

SEQ ID NO: 171677 - DNA, 25 bp, Mus musculus
agccaggacagaccctattagtgtc

SEQ ID NO: 171678 - DNA, 25 bp, Mus musculus
agccaggacagagcctattagtgtc

SEQ ID NO: 171679 - DNA, 25 bp, Mus musculus
agccaggacccaccggtttcatgca

SEQ ID NO: 171680 - DNA, 25 bp, Mus musculus
agccaggacccagcggtttcatgca

SEQ ID NO: 171681 - DNA, 25 bp, Mus musculus
agccaggacctgcatcctacagcgt

SEQ ID NO: 171682 - DNA, 25 bp, Mus musculus
agccaggacctggatcctacagcgt

SEQ ID NO: 171683 - DNA, 25 bp, Mus musculus
agccaggacgtgacactccttcatg

SEQ ID NO: 171684 - DNA, 25 bp, Mus musculus
agccaggacgtgtcactccttcatg

SEQ ID NO: 171685 - DNA, 25 bp, Mus musculus
agccaggactaaagagaccccatct

SEQ ID NO: 171686 - DNA, 25 bp, Mus musculus
agccaggactaatgagaccccatct

SEQ ID NO: 171687 - DNA, 25 bp, Mus musculus
agccaggacttcacatcctatttat

SEQ ID NO: 171688 - DNA, 25 bp, Mus musculus
agccaggacttctcatcctatttat

SEQ ID NO: 171689 - DNA, 25 bp, Mus musculus
agccaggagggtctctatgccagca

SEQ ID NO: 171690 - DNA, 25 bp, Mus musculus
agccaggagggtgtctatgccagca

SEQ ID NO: 171691 - DNA, 25 bp, Mus musculus
agccaggagtcacggcagcacaaga

SEQ ID NO: 171692 - DNA, 25 bp, Mus musculus
agccaggagtcagggcagcacaaga

SEQ ID NO: 171693 - DNA, 25 bp, Mus musculus
agccaggagtggcactttccaaaga

SEQ ID NO: 171694 - DNA, 25 bp, Mus musculus
agccaggagtgggactttccaaaga

SEQ ID NO: 171695 - DNA, 25 bp, Mus musculus
agccaggagtgtcgaagcctactgt

SEQ ID NO: 171696 - DNA, 25 bp, Mus musculus
agccaggagtgtggaagcctactgt

SEQ ID NO: 171697 - DNA, 25 bp, Mus musculus
agccaggatagcctcagaatcacta

SEQ ID NO: 171698 - DNA, 25 bp, Mus musculus
agccaggatagcgtcagaatcacta

SEQ ID NO: 171699 - DNA, 25 bp, Mus musculus
agccaggatctcacatcaagttggg

SEQ ID NO: 171700 - DNA, 25 bp, Mus musculus
agccaggatctctcatcaagttggg

SEQ ID NO: 171701 - DNA, 25 bp, Mus musculus
agccaggatctgctcttttcgtgtt

SEQ ID NO: 171702 - DNA, 25 bp, Mus musculus
agccaggatctggtcttttcgtgtt

SEQ ID NO: 171703 - DNA, 25 bp, Mus musculus
agccaggatggcagccagtgagctc

SEQ ID NO: 171704 - DNA, 25 bp, Mus musculus
agccaggatggctgccagtgagctc

SEQ ID NO: 171705 - DNA, 25 bp, Mus musculus
agccaggcaaaaatactctgactga

SEQ ID NO: 171706 - DNA, 25 bp, Mus musculus
agccaggcaaaattactctgactga

SEQ ID NO: 171707 - DNA, 25 bp, Mus musculus
agccaggcacgaccacagcgtggat

SEQ ID NO: 171708 - DNA, 25 bp, Mus musculus
agccaggcacgagcacagcgtggat

SEQ ID NO: 171709 - DNA, 25 bp, Mus musculus
agccaggcactcacagggatgcgct

SEQ ID NO: 171710 - DNA, 25 bp, Mus musculus
agccaggcactctcagggatgcgct

SEQ ID NO: 171711 - DNA, 25 bp, Mus musculus
agccaggcactgctgatttagtaaa

SEQ ID NO: 171712 - DNA, 25 bp, Mus musculus
agccaggcactggtgatttagtaaa

SEQ ID NO: 171713 - DNA, 25 bp, Mus musculus
agccaggcaggccacgcgggctcta

SEQ ID NO: 171714 - DNA, 25 bp, Mus musculus
agccaggcaggcgacgcgggctcta

SEQ ID NO: 171715 - DNA, 25 bp, Mus musculus
agccaggcatccaggtcttgttcgg

SEQ ID NO: 171716 - DNA, 25 bp, Mus musculus
agccaggcatcctggtcttgttcgg

SEQ ID NO: 171717 - DNA, 25 bp, Mus musculus
agccaggccataatatcaaacccat

SEQ ID NO: 171718 - DNA, 25 bp, Mus musculus
agccaggccatattatcaaacccat

SEQ ID NO: 171719 - DNA, 25 bp, Mus musculus
agccaggccattcctttccagaaat

SEQ ID NO: 171720 - DNA, 25 bp, Mus musculus
agccaggccattgctttccagaaat

SEQ ID NO: 171721 - DNA, 25 bp, Mus musculus
agccaggcccttagtcgtgtgttag

SEQ ID NO: 171722 - DNA, 25 bp, Mus musculus
agccaggccctttgtcgtgtgttag

SEQ ID NO: 171723 - DNA, 25 bp, Mus musculus
agccaggcctatcctgaagccaaag

SEQ ID NO: 171724 - DNA, 25 bp, Mus musculus
agccaggcctatgctgaagccaaag

SEQ ID NO: 171725 - DNA, 25 bp, Mus musculus
agccaggcctgaccagggattcata

SEQ ID NO: 171726 - DNA, 25 bp, Mus musculus
agccaggcctgagcagggattcata

SEQ ID NO: 171727 - DNA, 25 bp, Mus musculus
agccaggccttgcattctgtcattg

SEQ ID NO: 171728 - DNA, 25 bp, Mus musculus
agccaggccttggattctgtcattg

SEQ ID NO: 171729 - DNA, 25 bp, Mus musculus
agccaggcctttaaagctatttaga

SEQ ID NO: 171730 - DNA, 25 bp, Mus musculus
agccaggcctttcttgagcagggca

SEQ ID NO: 171731 - DNA, 25 bp, Mus musculus
agccaggcctttgttgagcagggca

SEQ ID NO: 171732 - DNA, 25 bp, Mus musculus
agccaggccttttaagctatttaga

SEQ ID NO: 171733 - DNA, 25 bp, Mus musculus
agccaggcgaggcagccaccaccta

SEQ ID NO: 171734 - DNA, 25 bp, Mus musculus
agccaggcgagggagccaccaccta

SEQ ID NO: 171735 - DNA, 25 bp, Mus musculus
agccaggcgatgacgtggtctccaa

SEQ ID NO: 171736 - DNA, 25 bp, Mus musculus
agccaggcgatgtcgtggtctccaa

SEQ ID NO: 171737 - DNA, 25 bp, Mus musculus
agccaggctcataataaaaacgtca

SEQ ID NO: 171738 - DNA, 25 bp, Mus musculus
agccaggctcattataaaaacgtca

SEQ ID NO: 171739 - DNA, 25 bp, Mus musculus
agccaggctcccagagggaagtctg

SEQ ID NO: 171740 - DNA, 25 bp, Mus musculus
agccaggctccctgagggaagtctg

SEQ ID NO: 171741 - DNA, 25 bp, Mus musculus
agccaggctcctactggaggaattg

SEQ ID NO: 171742 - DNA, 25 bp, Mus musculus
agccaggctccttctggaggaattg

SEQ ID NO: 171743 - DNA, 25 bp, Mus musculus
agccaggctctgatgcagatggttc

SEQ ID NO: 171744 - DNA, 25 bp, Mus musculus
agccaggctctgttgcagatggttc

SEQ ID NO: 171745 - DNA, 25 bp, Mus musculus
agccaggctgccaagttctgaatac

SEQ ID NO: 171746 - DNA, 25 bp, Mus musculus
agccaggctgcctagttctgaatac

SEQ ID NO: 171747 - DNA, 25 bp, Mus musculus
agccaggctgctaccttgacacctt

SEQ ID NO: 171748 - DNA, 25 bp, Mus musculus
agccaggctgctatcgaggagctta

SEQ ID NO: 171749 - DNA, 25 bp, Mus musculus
agccaggctgcttccttgacacctt

SEQ ID NO: 171750 - DNA, 25 bp, Mus musculus
agccaggctgctttcgaggagctta

SEQ ID NO: 171751 - DNA, 25 bp, Mus musculus
agccaggctgtaaatgcagtgcagt

SEQ ID NO: 171752 - DNA, 25 bp, Mus musculus
agccaggctgtactgtccaactaat

SEQ ID NO: 171753 - DNA, 25 bp, Mus musculus
agccaggctgtagtgtccaactaat

SEQ ID NO: 171754 - DNA, 25 bp, Mus musculus
agccaggctgtatatgcagtgcagt

SEQ ID NO: 171755 - DNA, 25 bp, Mus musculus
agccaggctgttctgttgcagtgca

SEQ ID NO: 171756 - DNA, 25 bp, Mus musculus
agccaggctgttgtgttgcagtgca

SEQ ID NO: 171757 - DNA, 25 bp, Mus musculus
agccaggcttcaaacactgtcaaca

SEQ ID NO: 171758 - DNA, 25 bp, Mus musculus
agccaggcttcatacactgtcaaca

SEQ ID NO: 171759 - DNA, 25 bp, Mus musculus
agccaggcttgacagtgaacgacgc

SEQ ID NO: 171760 - DNA, 25 bp, Mus musculus
agccaggcttgaccgaaaggtgcct

SEQ ID NO: 171761 - DNA, 25 bp, Mus musculus
agccaggcttgagagtgaacgacgc

SEQ ID NO: 171762 - DNA, 25 bp, Mus musculus
agccaggcttgagcgaaaggtgcct

SEQ ID NO: 171763 - DNA, 25 bp, Mus musculus
agccaggctttcagtgacttacaga

SEQ ID NO: 171764 - DNA, 25 bp, Mus musculus
agccaggctttctgtgacttacaga

SEQ ID NO: 171765 - DNA, 25 bp, Mus musculus
agccagggaacacgctcatgccaga

SEQ ID NO: 171766 - DNA, 25 bp, Mus musculus
agccagggaacaggctcatgccaga

SEQ ID NO: 171767 - DNA, 25 bp, Mus musculus
agccagggagacatcagcttccatt

SEQ ID NO: 171768 - DNA, 25 bp, Mus musculus
agccagggagacttcagcttccatt

SEQ ID NO: 171769 - DNA, 25 bp, Mus musculus
agccagggagcccaagcagtgcttc

SEQ ID NO: 171770 - DNA, 25 bp, Mus musculus
agccagggagccgaagcagtgcttc

SEQ ID NO: 171771 - DNA, 25 bp, Mus musculus
agccagggagttcattggtctccac

SEQ ID NO: 171772 - DNA, 25 bp, Mus musculus
agccagggagttgattggtctccac

SEQ ID NO: 171773 - DNA, 25 bp, Mus musculus
agccagggcacaaagaacattgcta

SEQ ID NO: 171774 - DNA, 25 bp, Mus musculus
agccagggcacatagaacattgcta

SEQ ID NO: 171775 - DNA, 25 bp, Mus musculus
agccagggcagacgtcattgccaga

SEQ ID NO: 171776 - DNA, 25 bp, Mus musculus
agccagggcagaggtcattgccaga

SEQ ID NO: 171777 - DNA, 25 bp, Mus musculus
agccagggcccaatagaaacatgtt

SEQ ID NO: 171778 - DNA, 25 bp, Mus musculus
agccagggcccattagaaacatgtt

SEQ ID NO: 171779 - DNA, 25 bp, Mus musculus
agccagggtatgcaccagagtgaac

SEQ ID NO: 171780 - DNA, 25 bp, Mus musculus
agccagggtatggaccagagtgaac

SEQ ID NO: 171781 - DNA, 25 bp, Mus musculus
agccagggtcttagctggcctggaa

SEQ ID NO: 171782 - DNA, 25 bp, Mus musculus
agccagggtctttgctggcctggaa

SEQ ID NO: 171783 - DNA, 25 bp, Mus musculus
agccagggtggcaatgaccgctact

SEQ ID NO: 171784 - DNA, 25 bp, Mus musculus
agccagggtggcatgtgctctgaca

SEQ ID NO: 171785 - DNA, 25 bp, Mus musculus
agccagggtggctatgaccgctact

SEQ ID NO: 171786 - DNA, 25 bp, Mus musculus
agccagggtggcttgtgctctgaca

SEQ ID NO: 171787 - DNA, 25 bp, Mus musculus
agccagggttacctcagagtcaact

SEQ ID NO: 171788 - DNA, 25 bp, Mus musculus
agccagggttacgtcagagtcaact

SEQ ID NO: 171789 - DNA, 25 bp, Mus musculus
agccagggtttacatgcaagcatct

SEQ ID NO: 171790 - DNA, 25 bp, Mus musculus
agccagggtttagatgcaagcatct

SEQ ID NO: 171791 - DNA, 25 bp, Mus musculus
agccagggtttgattcgagtgtacg

SEQ ID NO: 171792 - DNA, 25 bp, Mus musculus
agccagggtttgtttcgagtgtacg

SEQ ID NO: 171793 - DNA, 25 bp, Mus musculus
agccagggttttcgacatgctccac

SEQ ID NO: 171794 - DNA, 25 bp, Mus musculus
agccagggttttggacatgctccac

SEQ ID NO: 171795 - DNA, 25 bp, Mus musculus
agccaggtactgagcccttgactta

SEQ ID NO: 171796 - DNA, 25 bp, Mus musculus
agccaggtactgtgcccttgactta

SEQ ID NO: 171797 - DNA, 25 bp, Mus musculus
agccaggtagacattgtctgcatat

SEQ ID NO: 171798 - DNA, 25 bp, Mus musculus
agccaggtagactttgtctgcatat

SEQ ID NO: 171799 - DNA, 25 bp, Mus musculus
agccaggtatgtaggtacactacac

SEQ ID NO: 171800 - DNA, 25 bp, Mus musculus
agccaggtatgttggtacactacac

SEQ ID NO: 171801 - DNA, 25 bp, Mus musculus
agccaggtcagacaagccctgctgg

SEQ ID NO: 171802 - DNA, 25 bp, Mus musculus
agccaggtcagagaagccctgctgg

SEQ ID NO: 171803 - DNA, 25 bp, Mus musculus
agccaggtctttagtcagctgtgga

SEQ ID NO: 171804 - DNA, 25 bp, Mus musculus
agccaggtcttttgtcagctgtgga

SEQ ID NO: 171805 - DNA, 25 bp, Mus musculus
agccaggtgacacattccattccta

SEQ ID NO: 171806 - DNA, 25 bp, Mus musculus
agccaggtgacagattccattccta

SEQ ID NO: 171807 - DNA, 25 bp, Mus musculus
agccaggtgcgcagacattcctcct

SEQ ID NO: 171808 - DNA, 25 bp, Mus musculus
agccaggtgcgctgacattcctcct

SEQ ID NO: 171809 - DNA, 25 bp, Mus musculus
agccaggtgctcaagcacacacctg

SEQ ID NO: 171810 - DNA, 25 bp, Mus musculus
agccaggtgctcagcacatgcgcag

SEQ ID NO: 171811 - DNA, 25 bp, Mus musculus
agccaggtgctctagcacacacctg

SEQ ID NO: 171812 - DNA, 25 bp, Mus musculus
agccaggtgctctgcacatgcgcag

SEQ ID NO: 171813 - DNA, 25 bp, Mus musculus
agccaggtgcttagaggttttcaat

SEQ ID NO: 171814 - DNA, 25 bp, Mus musculus
agccaggtgctttgaggttttcaat

SEQ ID NO: 171815 - DNA, 25 bp, Mus musculus
agccaggtggtcactgttctgtgct

SEQ ID NO: 171816 - DNA, 25 bp, Mus musculus
agccaggtggtctctgttctgtgct

SEQ ID NO: 171817 - DNA, 25 bp, Mus musculus
agccaggtgtgtagactgactcaat

SEQ ID NO: 171818 - DNA, 25 bp, Mus musculus
agccaggtgtgttgactgactcaat

SEQ ID NO: 171819 - DNA, 25 bp, Mus musculus
agccaggttaccctgggaacctgtg

SEQ ID NO: 171820 - DNA, 25 bp, Mus musculus
agccaggttaccgtgggaacctgtg

SEQ ID NO: 171821 - DNA, 25 bp, Mus musculus
agccaggttctcagacaggagcaga

SEQ ID NO: 171822 - DNA, 25 bp, Mus musculus
agccaggttctctgacaggagcaga

SEQ ID NO: 171823 - DNA, 25 bp, Mus musculus
agccaggtttaaaggtcattgtcta

SEQ ID NO: 171824 - DNA, 25 bp, Mus musculus
agccaggtttaatggtcattgtcta

SEQ ID NO: 171825 - DNA, 25 bp, Mus musculus
agccaggtttccatgacagcaagaa

SEQ ID NO: 171826 - DNA, 25 bp, Mus musculus
agccaggtttccttgacagcaagaa

SEQ ID NO: 171827 - DNA, 25 bp, Mus musculus
agccagtaactaccattttacttat

SEQ ID NO: 171828 - DNA, 25 bp, Mus musculus
agccagtaactagcattttacttat

SEQ ID NO: 171829 - DNA, 25 bp, Mus musculus
agccagtaactcatccttgttgttt

SEQ ID NO: 171830 - DNA, 25 bp, Mus musculus
agccagtaactcttccttgttgttt

SEQ ID NO: 171831 - DNA, 25 bp, Mus musculus
agccagtaactgacaagatccacaa

SEQ ID NO: 171832 - DNA, 25 bp, Mus musculus
agccagtaactgtcaagatccacaa

SEQ ID NO: 171833 - DNA, 25 bp, Mus musculus
agccagtacactcgagtcccgtgtt

SEQ ID NO: 171834 - DNA, 25 bp, Mus musculus
agccagtacactggagtcccgtgtt

SEQ ID NO: 171835 - DNA, 25 bp, Mus musculus
agccagtacagcagcacatgtctgt

SEQ ID NO: 171836 - DNA, 25 bp, Mus musculus
agccagtacagcagccgcaagtagg

SEQ ID NO: 171837 - DNA, 25 bp, Mus musculus
agccagtacagctgcacatgtctgt

SEQ ID NO: 171838 - DNA, 25 bp, Mus musculus
agccagtacagctgccgcaagtagg

SEQ ID NO: 171839 - DNA, 25 bp, Mus musculus
agccagtagtgaattgtccaaagaa

SEQ ID NO: 171840 - DNA, 25 bp, Mus musculus
agccagtagtgatttgtccaaagaa

SEQ ID NO: 171841 - DNA, 25 bp, Mus musculus
agccagtatgatcgtgttccatgcc

SEQ ID NO: 171842 - DNA, 25 bp, Mus musculus
agccagtatgatggtgttccatgcc

SEQ ID NO: 171843 - DNA, 25 bp, Mus musculus
agccagtatgcacgtgtcactgaac

SEQ ID NO: 171844 - DNA, 25 bp, Mus musculus
agccagtatgcaggtgtcactgaac

SEQ ID NO: 171845 - DNA, 25 bp, Mus musculus
agccagtatggtatcggtcctgccc

SEQ ID NO: 171846 - DNA, 25 bp, Mus musculus
agccagtatggtttcggtcctgccc

SEQ ID NO: 171847 - DNA, 25 bp, Mus musculus
agccagtattaaccatcattcctca

SEQ ID NO: 171848 - DNA, 25 bp, Mus musculus
agccagtattaagcatcattcctca

SEQ ID NO: 171849 - DNA, 25 bp, Mus musculus
agccagtattgcaaatcctcacagc

SEQ ID NO: 171850 - DNA, 25 bp, Mus musculus
agccagtattgctaatcctcacagc

SEQ ID NO: 171851 - DNA, 25 bp, Mus musculus
agccagtcaaaaagctttcatgata

SEQ ID NO: 171852 - DNA, 25 bp, Mus musculus
agccagtcaaaatgctttcatgata

SEQ ID NO: 171853 - DNA, 25 bp, Mus musculus
agccagtcagtcacctaatgctgaa

SEQ ID NO: 171854 - DNA, 25 bp, Mus musculus
agccagtcagtctcctaatgctgaa

SEQ ID NO: 171855 - DNA, 25 bp, Mus musculus
agccagtcagtgaagcgcgcgtgca

SEQ ID NO: 171856 - DNA, 25 bp, Mus musculus
agccagtcagtgtagcgcgcgtgca

SEQ ID NO: 171857 - DNA, 25 bp, Mus musculus
agccagtcccagagtcttagtcagg

SEQ ID NO: 171858 - DNA, 25 bp, Mus musculus
agccagtcccagtgtcttagtcagg

SEQ ID NO: 171859 - DNA, 25 bp, Mus musculus
agccagtcccatagttgtacgcgat

SEQ ID NO: 171860 - DNA, 25 bp, Mus musculus
agccagtcccattgttgtacgcgat

SEQ ID NO: 171861 - DNA, 25 bp, Mus musculus
agccagtcccgtagtgtccttgctt

SEQ ID NO: 171862 - DNA, 25 bp, Mus musculus
agccagtcccgttgtgtccttgctt

SEQ ID NO: 171863 - DNA, 25 bp, Mus musculus
agccagtcctcacatacaatgacaa

SEQ ID NO: 171864 - DNA, 25 bp, Mus musculus
agccagtcctcagatacaatgacaa

SEQ ID NO: 171865 - DNA, 25 bp, Mus musculus
agccagtcctcccaagactcattta

SEQ ID NO: 171866 - DNA, 25 bp, Mus musculus
agccagtcctccgaagactcattta

SEQ ID NO: 171867 - DNA, 25 bp, Mus musculus
agccagtctagccagttggcaggta

SEQ ID NO: 171868 - DNA, 25 bp, Mus musculus
agccagtctagcgagttggcaggta

SEQ ID NO: 171869 - DNA, 25 bp, Mus musculus
agccagtctccccaggttggaagag

SEQ ID NO: 171870 - DNA, 25 bp, Mus musculus
agccagtctcccgaggttggaagag

SEQ ID NO: 171871 - DNA, 25 bp, Mus musculus
agccagtctgtaagaagtgctacga

SEQ ID NO: 171872 - DNA, 25 bp, Mus musculus
agccagtctgtatgaagtgctacga

SEQ ID NO: 171873 - DNA, 25 bp, Mus musculus
agccagtctttccttgaactagaaa

SEQ ID NO: 171874 - DNA, 25 bp, Mus musculus
agccagtctttcgttgaactagaaa

SEQ ID NO: 171875 - DNA, 25 bp, Mus musculus
agccagtgacggaatgtgctctcct

SEQ ID NO: 171876 - DNA, 25 bp, Mus musculus
agccagtgacggtatgtgctctcct

SEQ ID NO: 171877 - DNA, 25 bp, Mus musculus
agccagtgagagacagtgtacccaa

SEQ ID NO: 171878 - DNA, 25 bp, Mus musculus
agccagtgagagtcagtgtacccaa

SEQ ID NO: 171879 - DNA, 25 bp, Mus musculus
agccagtgatggagaaacttaagtg

SEQ ID NO: 171880 - DNA, 25 bp, Mus musculus
agccagtgatggtgaaacttaagtg

SEQ ID NO: 171881 - DNA, 25 bp, Mus musculus
agccagtgcctacatccgaaaggat

SEQ ID NO: 171882 - DNA, 25 bp, Mus musculus
agccagtgcctagatccgaaaggat

SEQ ID NO: 171883 - DNA, 25 bp, Mus musculus
agccagtgctctctgattgctgtga

SEQ ID NO: 171884 - DNA, 25 bp, Mus musculus
agccagtgctctgtgattgctgtga

SEQ ID NO: 171885 - DNA, 25 bp, Mus musculus
agccagtgctgtagtcatctctcta

SEQ ID NO: 171886 - DNA, 25 bp, Mus musculus
agccagtgctgttgtcatctctcta

SEQ ID NO: 171887 - DNA, 25 bp, Mus musculus
agccagtgcttcatttgtcttgata

SEQ ID NO: 171888 - DNA, 25 bp, Mus musculus
agccagtgcttcttttgtcttgata

SEQ ID NO: 171889 - DNA, 25 bp, Mus musculus
agccagtggcctcaactttgaaacc

SEQ ID NO: 171890 - DNA, 25 bp, Mus musculus
agccagtggcctgaactttgaaacc

SEQ ID NO: 171891 - DNA, 25 bp, Mus musculus
agccagtgtgggactgaacatcccc

SEQ ID NO: 171892 - DNA, 25 bp, Mus musculus
agccagtgtgggtctgaacatcccc

SEQ ID NO: 171893 - DNA, 25 bp, Mus musculus
agccagtgtggtagtctctttttct

SEQ ID NO: 171894 - DNA, 25 bp, Mus musculus
agccagtgtggtcaggtcctcctga

SEQ ID NO: 171895 - DNA, 25 bp, Mus musculus
agccagtgtggtgaggtcctcctga

SEQ ID NO: 171896 - DNA, 25 bp, Mus musculus
agccagtgtggttgtctctttttct

SEQ ID NO: 171897 - DNA, 25 bp, Mus musculus
agccagtgtgttcctccaagcccat

SEQ ID NO: 171898 - DNA, 25 bp, Mus musculus
agccagtgtgttgctccaagcccat

SEQ ID NO: 171899 - DNA, 25 bp, Mus musculus
agccagtgttggaagatgacctttt

SEQ ID NO: 171900 - DNA, 25 bp, Mus musculus
agccagtgttggtagatgacctttt

SEQ ID NO: 171901 - DNA, 25 bp, Mus musculus
agccagttcaaaatgtcctcgttgc

SEQ ID NO: 171902 - DNA, 25 bp, Mus musculus
agccagttcaaattgtcctcgttgc

SEQ ID NO: 171903 - DNA, 25 bp, Mus musculus
agccagttcagacgaccccaaagtc

SEQ ID NO: 171904 - DNA, 25 bp, Mus musculus
agccagttcagaggaccccaaagtc

SEQ ID NO: 171905 - DNA, 25 bp, Mus musculus
agccagttccccactggagaagata

SEQ ID NO: 171906 - DNA, 25 bp, Mus musculus
agccagttcccctctggagaagata

SEQ ID NO: 171907 - DNA, 25 bp, Mus musculus
agccagttctaactcatcctttgtc

SEQ ID NO: 171908 - DNA, 25 bp, Mus musculus
agccagttctaagtcatcctttgtc

SEQ ID NO: 171909 - DNA, 25 bp, Mus musculus
agccagttctacagggtcctcatga

SEQ ID NO: 171910 - DNA, 25 bp, Mus musculus
agccagttctactgggtcctcatga

SEQ ID NO: 171911 - DNA, 25 bp, Mus musculus
agccagttctgcacacctgtgaatg

SEQ ID NO: 171912 - DNA, 25 bp, Mus musculus
agccagttctgcctggagtcactac

SEQ ID NO: 171913 - DNA, 25 bp, Mus musculus
agccagttctgcgtggagtcactac

SEQ ID NO: 171914 - DNA, 25 bp, Mus musculus
agccagttctgctcacctgtgaatg

SEQ ID NO: 171915 - DNA, 25 bp, Mus musculus
agccagttctgtcgcaaaggaggat

SEQ ID NO: 171916 - DNA, 25 bp, Mus musculus
agccagttctgtggcaaaggaggat

SEQ ID NO: 171917 - DNA, 25 bp, Mus musculus
agccagttgattcttagtacagttt

SEQ ID NO: 171918 - DNA, 25 bp, Mus musculus
agccagttgattgttagtacagttt

SEQ ID NO: 171919 - DNA, 25 bp, Mus musculus
agccagttgttgagctgcccatgtt

SEQ ID NO: 171920 - DNA, 25 bp, Mus musculus
agccagttgttgtgctgcccatgtt

SEQ ID NO: 171921 - DNA, 25 bp, Mus musculus
agccagtttaaaactaagctcactc

SEQ ID NO: 171922 - DNA, 25 bp, Mus musculus
agccagtttaaatctaagctcactc

SEQ ID NO: 171923 - DNA, 25 bp, Mus musculus
agccagtttccaaggtgtttccaga

SEQ ID NO: 171924 - DNA, 25 bp, Mus musculus
agccagtttccatggtgtttccaga

SEQ ID NO: 171925 - DNA, 25 bp, Mus musculus
agccagtttcttcgtgtgggcttga

SEQ ID NO: 171926 - DNA, 25 bp, Mus musculus
agccagtttcttggtgtgggcttga

SEQ ID NO: 171927 - DNA, 25 bp, Mus musculus
agccagtttgcaacttagccagctg

SEQ ID NO: 171928 - DNA, 25 bp, Mus musculus
agccagtttgcatcttagccagctg

SEQ ID NO: 171929 - DNA, 25 bp, Mus musculus
agccagtttggccaaagccttgaat

SEQ ID NO: 171930 - DNA, 25 bp, Mus musculus
agccagtttggccttgtggacatcc

SEQ ID NO: 171931 - DNA, 25 bp, Mus musculus
agccagtttggcgaaagccttgaat

SEQ ID NO: 171932 - DNA, 25 bp, Mus musculus
agccagtttggcgttgtggacatcc

SEQ ID NO: 171933 - DNA, 25 bp, Mus musculus
agccagtttgtcatacatcctgtaa

SEQ ID NO: 171934 - DNA, 25 bp, Mus musculus
agccagtttgtcttacatcctgtaa

SEQ ID NO: 171935 - DNA, 25 bp, Mus musculus
agccagtttgttaggccatgtgaca

SEQ ID NO: 171936 - DNA, 25 bp, Mus musculus
agccagtttgtttggccatgtgaca

SEQ ID NO: 171937 - DNA, 25 bp, Mus musculus
agccataaacacatctctcagcgga

SEQ ID NO: 171938 - DNA, 25 bp, Mus musculus
agccataaacacttctctcagcgga

SEQ ID NO: 171939 - DNA, 25 bp, Mus musculus
agccataactcaatcccttagcaag

SEQ ID NO: 171940 - DNA, 25 bp, Mus musculus
agccataactcattcccttagcaag

SEQ ID NO: 171941 - DNA, 25 bp, Mus musculus
agccataagatgatcctgctcaagg

SEQ ID NO: 171942 - DNA, 25 bp, Mus musculus
agccataagatgttcctgctcaagg

SEQ ID NO: 171943 - DNA, 25 bp, Mus musculus
agccatacacggctagtgtcccttt

SEQ ID NO: 171944 - DNA, 25 bp, Mus musculus
agccatacacgggtagtgtcccttt

SEQ ID NO: 171945 - DNA, 25 bp, Mus musculus
agccatacatggatcctgtttcggg

SEQ ID NO: 171946 - DNA, 25 bp, Mus musculus
agccatacatggttcctgtttcggg

SEQ ID NO: 171947 - DNA, 25 bp, Mus musculus
agccataccacaatgagctgtgaat

SEQ ID NO: 171948 - DNA, 25 bp, Mus musculus
agccataccacattgagctgtgaat

SEQ ID NO: 171949 - DNA, 25 bp, Mus musculus
agccatactccacggcacagggcag

SEQ ID NO: 171950 - DNA, 25 bp, Mus musculus
agccatactccagggcacagggcag

SEQ ID NO: 171951 - DNA, 25 bp, Mus musculus
agccataggcgcagaaggcttcagt

SEQ ID NO: 171952 - DNA, 25 bp, Mus musculus
agccataggcgctgaaggcttcagt

SEQ ID NO: 171953 - DNA, 25 bp, Mus musculus
agccataggctacacctgaagcagt

SEQ ID NO: 171954 - DNA, 25 bp, Mus musculus
agccataggctagacctgaagcagt

SEQ ID NO: 171955 - DNA, 25 bp, Mus musculus
agccatagtcctagatctatcctgc

SEQ ID NO: 171956 - DNA, 25 bp, Mus musculus
agccatagtccttgatctatcctgc

SEQ ID NO: 171957 - DNA, 25 bp, Mus musculus
agccatagtgatcaggcagcctgtt

SEQ ID NO: 171958 - DNA, 25 bp, Mus musculus
agccatagtgatgaggcagcctgtt

SEQ ID NO: 171959 - DNA, 25 bp, Mus musculus
agccatagtgcccatcagttctgtt

SEQ ID NO: 171960 - DNA, 25 bp, Mus musculus
agccatagtgccgatcagttctgtt

SEQ ID NO: 171961 - DNA, 25 bp, Mus musculus
agccatatagctaatagttgtcatt

SEQ ID NO: 171962 - DNA, 25 bp, Mus musculus
agccatatagcttatagttgtcatt

SEQ ID NO: 171963 - DNA, 25 bp, Mus musculus
agccatatccagagggtctctaacc

SEQ ID NO: 171964 - DNA, 25 bp, Mus musculus
agccatatccagtgggtctctaacc

SEQ ID NO: 171965 - DNA, 25 bp, Mus musculus
agccatatcctcaattcacagttac

SEQ ID NO: 171966 - DNA, 25 bp, Mus musculus
agccatatcctctattcacagttac

SEQ ID NO: 171967 - DNA, 25 bp, Mus musculus
agccatatgcacaacaacagccgtt

SEQ ID NO: 171968 - DNA, 25 bp, Mus musculus
agccatatgcactacaacagccgtt

SEQ ID NO: 171969 - DNA, 25 bp, Mus musculus
agccatatggagcacttcaaacagg

SEQ ID NO: 171970 - DNA, 25 bp, Mus musculus
agccatatggaggacttcaaacagg

SEQ ID NO: 171971 - DNA, 25 bp, Mus musculus
agccatatgtccaaatcttttcaaa

SEQ ID NO: 171972 - DNA, 25 bp, Mus musculus
agccatatgtcctaatcttttcaaa

SEQ ID NO: 171973 - DNA, 25 bp, Mus musculus
agccatattcctatccaaaacggtg

SEQ ID NO: 171974 - DNA, 25 bp, Mus musculus
agccatattcctttccaaaacggtg

SEQ ID NO: 171975 - DNA, 25 bp, Mus musculus
agccatattggaactgcactcagga

SEQ ID NO: 171976 - DNA, 25 bp, Mus musculus
agccatattggatctgcactcagga

SEQ ID NO: 171977 - DNA, 25 bp, Mus musculus
agccatcaaatccaaagctgcggat

SEQ ID NO: 171978 - DNA, 25 bp, Mus musculus
agccatcaaatcgaaagctgcggat

SEQ ID NO: 171979 - DNA, 25 bp, Mus musculus
agccatcaacaacaactgtggtcat

SEQ ID NO: 171980 - DNA, 25 bp, Mus musculus
agccatcaacaagaactgtggtcat

SEQ ID NO: 171981 - DNA, 25 bp, Mus musculus
agccatcaacgcaatgttcagtgac

SEQ ID NO: 171982 - DNA, 25 bp, Mus musculus
agccatcaacgctatgttcagtgac

SEQ ID NO: 171983 - DNA, 25 bp, Mus musculus
agccatcaaggtatgagcccctgct

SEQ ID NO: 171984 - DNA, 25 bp, Mus musculus
agccatcaaggtttgagcccctgct

SEQ ID NO: 171985 - DNA, 25 bp, Mus musculus
agccatcaataactcactgcagttt

SEQ ID NO: 171986 - DNA, 25 bp, Mus musculus
agccatcaataagtcactgcagttt

SEQ ID NO: 171987 - DNA, 25 bp, Mus musculus
agccatcaatccatcatgtgaaagc

SEQ ID NO: 171988 - DNA, 25 bp, Mus musculus
agccatcaatccttcatgtgaaagc

SEQ ID NO: 171989 - DNA, 25 bp, Mus musculus
agccatcaatggatactttagtaaa

SEQ ID NO: 171990 - DNA, 25 bp, Mus musculus
agccatcaatggttactttagtaaa

SEQ ID NO: 171991 - DNA, 25 bp, Mus musculus
agccatcacacaatcaaggttctag

SEQ ID NO: 171992 - DNA, 25 bp, Mus musculus
agccatcacacattcaaggttctag

SEQ ID NO: 171993 - DNA, 25 bp, Mus musculus
agccatcaccccattggtagaggaa

SEQ ID NO: 171994 - DNA, 25 bp, Mus musculus
agccatcacccctttggtagaggaa

SEQ ID NO: 171995 - DNA, 25 bp, Mus musculus
agccatcagaagaggcaacgtgcta

SEQ ID NO: 171996 - DNA, 25 bp, Mus musculus
agccatcagaagtggcaacgtgcta

SEQ ID NO: 171997 - DNA, 25 bp, Mus musculus
agccatcagaccacatgtatcacaa

SEQ ID NO: 171998 - DNA, 25 bp, Mus musculus
agccatcagacctcatgtatcacaa

SEQ ID NO: 171999 - DNA, 25 bp, Mus musculus
agccatcagcaactgggtccagttt

SEQ ID NO: 172000 - DNA, 25 bp, Mus musculus
agccatcagcaagtgggtccagttt

SEQ ID NO: 172001 - DNA, 25 bp, Mus musculus
agccatcagcccctgaggaagttat

SEQ ID NO: 172002 - DNA, 25 bp, Mus musculus
agccatcagcccgtgaggaagttat

SEQ ID NO: 172003 - DNA, 25 bp, Mus musculus
agccatcagcctagaccaagggtat

SEQ ID NO: 172004 - DNA, 25 bp, Mus musculus
agccatcagccttgaccaagggtat

SEQ ID NO: 172005 - DNA, 25 bp, Mus musculus
agccatcaggaaagcagccctgcca

SEQ ID NO: 172006 - DNA, 25 bp, Mus musculus
agccatcaggaatgcagccctgcca

SEQ ID NO: 172007 - DNA, 25 bp, Mus musculus
agccatcagggcagctgtgtactgg

SEQ ID NO: 172008 - DNA, 25 bp, Mus musculus
agccatcagggctgctgtgtactgg

SEQ ID NO: 172009 - DNA, 25 bp, Mus musculus
agccatcagtcaattctcttaacag

SEQ ID NO: 172010 - DNA, 25 bp, Mus musculus
agccatcagtcatttctcttaacag

SEQ ID NO: 172011 - DNA, 25 bp, Mus musculus
agccatcatatccaagaccaaacag

SEQ ID NO: 172012 - DNA, 25 bp, Mus musculus
agccatcatatcgaagaccaaacag

SEQ ID NO: 172013 - DNA, 25 bp, Mus musculus
agccatcatctaagtttgcctaaca

SEQ ID NO: 172014 - DNA, 25 bp, Mus musculus
agccatcatctatgtttgcctaaca

SEQ ID NO: 172015 - DNA, 25 bp, Mus musculus
agccatcatgatagcatctttctat

SEQ ID NO: 172016 - DNA, 25 bp, Mus musculus
agccatcatgattgcatctttctat

SEQ ID NO: 172017 - DNA, 25 bp, Mus musculus
agccatcatgttctgaattgaactc

SEQ ID NO: 172018 - DNA, 25 bp, Mus musculus
agccatcatgttgtgaattgaactc

SEQ ID NO: 172019 - DNA, 25 bp, Mus musculus
agccatcattttactacatctgtga

SEQ ID NO: 172020 - DNA, 25 bp, Mus musculus
agccatcatttttctacatctgtga

SEQ ID NO: 172021 - DNA, 25 bp, Mus musculus
agccatccaggaatgtcacagtgaa

SEQ ID NO: 172022 - DNA, 25 bp, Mus musculus
agccatccaggattgtcacagtgaa

SEQ ID NO: 172023 - DNA, 25 bp, Mus musculus
agccatccatggctaatgccacatt

SEQ ID NO: 172024 - DNA, 25 bp, Mus musculus
agccatccatgggtaatgccacatt

SEQ ID NO: 172025 - DNA, 25 bp, Mus musculus
agccatcccactcctgttttagaga

SEQ ID NO: 172026 - DNA, 25 bp, Mus musculus
agccatcccactgctgttttagaga

SEQ ID NO: 172027 - DNA, 25 bp, Mus musculus
agccatcccaggattgtgaactgct

SEQ ID NO: 172028 - DNA, 25 bp, Mus musculus
agccatcccaggtttgtgaactgct

SEQ ID NO: 172029 - DNA, 25 bp, Mus musculus
agccatccctcacgcccaggcagag

SEQ ID NO: 172030 - DNA, 25 bp, Mus musculus
agccatccctcaggcccaggcagag

SEQ ID NO: 172031 - DNA, 25 bp, Mus musculus
agccatcccttaactccaggaagat

SEQ ID NO: 172032 - DNA, 25 bp, Mus musculus
agccatcccttatctccaggaagat

SEQ ID NO: 172033 - DNA, 25 bp, Mus musculus
agccatccgaggagagcagtggact

SEQ ID NO: 172034 - DNA, 25 bp, Mus musculus
agccatccgaggtgagcagtggact

SEQ ID NO: 172035 - DNA, 25 bp, Mus musculus
agccatcctctccaaaatgcaggtg

SEQ ID NO: 172036 - DNA, 25 bp, Mus musculus
agccatcctctcgaaaatgcaggtg

SEQ ID NO: 172037 - DNA, 25 bp, Mus musculus
agccatcctctgaccataagataag

SEQ ID NO: 172038 - DNA, 25 bp, Mus musculus
agccatcctctgtccataagataag

SEQ ID NO: 172039 - DNA, 25 bp, Mus musculus
agccatcctgaaccggtagccaagg

SEQ ID NO: 172040 - DNA, 25 bp, Mus musculus
agccatcctgaagcggtagccaagg

SEQ ID NO: 172041 - DNA, 25 bp, Mus musculus
agccatcctgcaactagttacagat

SEQ ID NO: 172042 - DNA, 25 bp, Mus musculus
agccatcctgcatctagttacagat

SEQ ID NO: 172043 - DNA, 25 bp, Mus musculus
agccatcctgctcaaaacaacgaag

SEQ ID NO: 172044 - DNA, 25 bp, Mus musculus
agccatcctgctgaaaacaacgaag

SEQ ID NO: 172045 - DNA, 25 bp, Mus musculus
agccatcctggaatctatgagacaa

SEQ ID NO: 172046 - DNA, 25 bp, Mus musculus
agccatcctggattctatgagacaa

SEQ ID NO: 172047 - DNA, 25 bp, Mus musculus
agccatcctttcatttctgacctaa

SEQ ID NO: 172048 - DNA, 25 bp, Mus musculus
agccatcctttcttttctgacctaa

SEQ ID NO: 172049 - DNA, 25 bp, Mus musculus
agccatcgagatcgaactttccaaa

SEQ ID NO: 172050 - DNA, 25 bp, Mus musculus
agccatcgagatggaactttccaaa

SEQ ID NO: 172051 - DNA, 25 bp, Mus musculus
agccatcgaggcatagagttggcga

SEQ ID NO: 172052 - DNA, 25 bp, Mus musculus
agccatcgaggcttagagttggcga

SEQ ID NO: 172053 - DNA, 25 bp, Mus musculus
agccatcgctctcttatacttactg

SEQ ID NO: 172054 - DNA, 25 bp, Mus musculus
agccatcgctctgttatacttactg

SEQ ID NO: 172055 - DNA, 25 bp, Mus musculus
agccatcggaggctgcctacgagaa

SEQ ID NO: 172056 - DNA, 25 bp, Mus musculus
agccatcggagggtgcctacgagaa

SEQ ID NO: 172057 - DNA, 25 bp, Mus musculus
agccatcgtaacacactaacaggga

SEQ ID NO: 172058 - DNA, 25 bp, Mus musculus
agccatcgtaactcactaacaggga

SEQ ID NO: 172059 - DNA, 25 bp, Mus musculus
agccatcgtcaccaatgtagaccac

SEQ ID NO: 172060 - DNA, 25 bp, Mus musculus
agccatcgtcacgaatgtagaccac

SEQ ID NO: 172061 - DNA, 25 bp, Mus musculus
agccatcgtgatcaggaccgtacac

SEQ ID NO: 172062 - DNA, 25 bp, Mus musculus
agccatcgtgatgaggaccgtacac

SEQ ID NO: 172063 - DNA, 25 bp, Mus musculus
agccatcgtgctctgtagttatttt

SEQ ID NO: 172064 - DNA, 25 bp, Mus musculus
agccatcgtgctgtgtagttatttt

SEQ ID NO: 172065 - DNA, 25 bp, Mus musculus
agccatctaaggagaagccccgaat

SEQ ID NO: 172066 - DNA, 25 bp, Mus musculus
agccatctaaggtgaagccccgaat

SEQ ID NO: 172067 - DNA, 25 bp, Mus musculus
agccatctaataagtttccattgta

SEQ ID NO: 172068 - DNA, 25 bp, Mus musculus
agccatctaatatgtttccattgta

SEQ ID NO: 172069 - DNA, 25 bp, Mus musculus
agccatctagacaaccagaatgtat

SEQ ID NO: 172070 - DNA, 25 bp, Mus musculus
agccatctagactaccagaatgtat

SEQ ID NO: 172071 - DNA, 25 bp, Mus musculus
agccatctcccacggcatgcataga

SEQ ID NO: 172072 - DNA, 25 bp, Mus musculus
agccatctcccagggcatgcataga

SEQ ID NO: 172073 - DNA, 25 bp, Mus musculus
agccatctccccagaatgggaattt

SEQ ID NO: 172074 - DNA, 25 bp, Mus musculus
agccatctcccctgaatgggaattt

SEQ ID NO: 172075 - DNA, 25 bp, Mus musculus
agccatctcctgagtggtcataggg

SEQ ID NO: 172076 - DNA, 25 bp, Mus musculus
agccatctcctgtgtggtcataggg

SEQ ID NO: 172077 - DNA, 25 bp, Mus musculus
agccatctctagctgaccaatattg

SEQ ID NO: 172078 - DNA, 25 bp, Mus musculus
agccatctctaggtgaccaatattg

SEQ ID NO: 172079 - DNA, 25 bp, Mus musculus
agccatctctgcctggtatgaagaa

SEQ ID NO: 172080 - DNA, 25 bp, Mus musculus
agccatctctgcgtggtatgaagaa

SEQ ID NO: 172081 - DNA, 25 bp, Mus musculus
agccatctctgtagcacctgaatag

SEQ ID NO: 172082 - DNA, 25 bp, Mus musculus
agccatctctgttgcacctgaatag

SEQ ID NO: 172083 - DNA, 25 bp, Mus musculus
agccatctctttaggccctactttc

SEQ ID NO: 172084 - DNA, 25 bp, Mus musculus
agccatctcttttggccctactttc

SEQ ID NO: 172085 - DNA, 25 bp, Mus musculus
agccatctgcttaggaaaatgactt

SEQ ID NO: 172086 - DNA, 25 bp, Mus musculus
agccatctgcttcagactgacgatg

SEQ ID NO: 172087 - DNA, 25 bp, Mus musculus
agccatctgcttgagactgacgatg

SEQ ID NO: 172088 - DNA, 25 bp, Mus musculus
agccatctgctttggaaaatgactt

SEQ ID NO: 172089 - DNA, 25 bp, Mus musculus
agccatctggacaccgacagagcaa

SEQ ID NO: 172090 - DNA, 25 bp, Mus musculus
agccatctggactccgacagagcaa

SEQ ID NO: 172091 - DNA, 25 bp, Mus musculus
agccatctggctactgatgtcatga

SEQ ID NO: 172092 - DNA, 25 bp, Mus musculus
agccatctggctcaatctgtttaaa

SEQ ID NO: 172093 - DNA, 25 bp, Mus musculus
agccatctggctgaatctgtttaaa

SEQ ID NO: 172094 - DNA, 25 bp, Mus musculus
agccatctggcttctgatgtcatga

SEQ ID NO: 172095 - DNA, 25 bp, Mus musculus
agccatctgtatcggattggttccc

SEQ ID NO: 172096 - DNA, 25 bp, Mus musculus
agccatctgtatgggattggttccc

SEQ ID NO: 172097 - DNA, 25 bp, Mus musculus
agccatctgtggacaaggttgtctc

SEQ ID NO: 172098 - DNA, 25 bp, Mus musculus
agccatctgtggtcaaggttgtctc

SEQ ID NO: 172099 - DNA, 25 bp, Mus musculus
agccatcttactatggttccaggat

SEQ ID NO: 172100 - DNA, 25 bp, Mus musculus
agccatcttactcgttctgtgaatt

SEQ ID NO: 172101 - DNA, 25 bp, Mus musculus
agccatcttactggttctgtgaatt

SEQ ID NO: 172102 - DNA, 25 bp, Mus musculus
agccatcttactttggttccaggat

SEQ ID NO: 172103 - DNA, 25 bp, Mus musculus
agccatcttcagaagattcttcaaa

SEQ ID NO: 172104 - DNA, 25 bp, Mus musculus
agccatcttcagtagattcttcaaa

SEQ ID NO: 172105 - DNA, 25 bp, Mus musculus
agccatcttgctactgatttttcat

SEQ ID NO: 172106 - DNA, 25 bp, Mus musculus
agccatcttgctcgtacttgaacta

SEQ ID NO: 172107 - DNA, 25 bp, Mus musculus
agccatcttgctggtacttgaacta

SEQ ID NO: 172108 - DNA, 25 bp, Mus musculus
agccatcttgcttctgatttttcat

SEQ ID NO: 172109 - DNA, 25 bp, Mus musculus
agccatcttggtctgcatttgcaaa

SEQ ID NO: 172110 - DNA, 25 bp, Mus musculus
agccatcttggtgtgcatttgcaaa

SEQ ID NO: 172111 - DNA, 25 bp, Mus musculus
agccatcttgtcagccttagttgaa

SEQ ID NO: 172112 - DNA, 25 bp, Mus musculus
agccatcttgtctgccttagttgaa

SEQ ID NO: 172113 - DNA, 25 bp, Mus musculus
agccatcttgtgagtgccaatgtat

SEQ ID NO: 172114 - DNA, 25 bp, Mus musculus
agccatcttgtgtgtgccaatgtat

SEQ ID NO: 172115 - DNA, 25 bp, Mus musculus
agccatgaaccaacgaagtctgata

SEQ ID NO: 172116 - DNA, 25 bp, Mus musculus
agccatgaaccatcgaagtctgata

SEQ ID NO: 172117 - DNA, 25 bp, Mus musculus
agccatgagaagatgctcgtacctt

SEQ ID NO: 172118 - DNA, 25 bp, Mus musculus
agccatgagaagttgctcgtacctt

SEQ ID NO: 172119 - DNA, 25 bp, Mus musculus
agccatgagcttcggtgacctggac

SEQ ID NO: 172120 - DNA, 25 bp, Mus musculus
agccatgagcttgggtgacctggac

SEQ ID NO: 172121 - DNA, 25 bp, Mus musculus
agccatgaggaacgcggcggccaag

SEQ ID NO: 172122 - DNA, 25 bp, Mus musculus
agccatgaggaaggcggcggccaag

SEQ ID NO: 172123 - DNA, 25 bp, Mus musculus
agccatgaggagcagaccttgccca

SEQ ID NO: 172124 - DNA, 25 bp, Mus musculus
agccatgaggaggagaccttgccca

SEQ ID NO: 172125 - DNA, 25 bp, Mus musculus
agccatgaggctatgaggtccccag

SEQ ID NO: 172126 - DNA, 25 bp, Mus musculus
agccatgaggctttgaggtccccag

SEQ ID NO: 172127 - DNA, 25 bp, Mus musculus
agccatgatactcaccctaagagaa

SEQ ID NO: 172128 - DNA, 25 bp, Mus musculus
agccatgatactgaccctaagagaa

SEQ ID NO: 172129 - DNA, 25 bp, Mus musculus
agccatgatgaaagtgcgcgaccag

SEQ ID NO: 172130 - DNA, 25 bp, Mus musculus
agccatgatgaatgtgcgcgaccag

SEQ ID NO: 172131 - DNA, 25 bp, Mus musculus
agccatgatggcaagcttaagaaga

SEQ ID NO: 172132 - DNA, 25 bp, Mus musculus
agccatgatggcagatacttttgat

SEQ ID NO: 172133 - DNA, 25 bp, Mus musculus
agccatgatggctagcttaagaaga

SEQ ID NO: 172134 - DNA, 25 bp, Mus musculus
agccatgatggctgatacttttgat

SEQ ID NO: 172135 - DNA, 25 bp, Mus musculus
agccatgatttcatggccccaggta

SEQ ID NO: 172136 - DNA, 25 bp, Mus musculus
agccatgatttcttggccccaggta

SEQ ID NO: 172137 - DNA, 25 bp, Mus musculus
agccatgcaacacagacccacttgt

SEQ ID NO: 172138 - DNA, 25 bp, Mus musculus
agccatgcaacagagacccacttgt

SEQ ID NO: 172139 - DNA, 25 bp, Mus musculus
agccatgcactgaagcccctcggga

SEQ ID NO: 172140 - DNA, 25 bp, Mus musculus
agccatgcactgtagcccctcggga

SEQ ID NO: 172141 - DNA, 25 bp, Mus musculus
agccatgcagcacttagttccaaat

SEQ ID NO: 172142 - DNA, 25 bp, Mus musculus
agccatgcagcagttagttccaaat

SEQ ID NO: 172143 - DNA, 25 bp, Mus musculus
agccatgcaggcaacaagctacaca

SEQ ID NO: 172144 - DNA, 25 bp, Mus musculus
agccatgcaggctacaagctacaca

SEQ ID NO: 172145 - DNA, 25 bp, Mus musculus
agccatgcattcctgatacaatcca

SEQ ID NO: 172146 - DNA, 25 bp, Mus musculus
agccatgcattcgtgatacaatcca

SEQ ID NO: 172147 - DNA, 25 bp, Mus musculus
agccatgcattgatctgtgatctct

SEQ ID NO: 172148 - DNA, 25 bp, Mus musculus
agccatgcattgttctgtgatctct

SEQ ID NO: 172149 - DNA, 25 bp, Mus musculus
agccatgcatttacaggtacttaat

SEQ ID NO: 172150 - DNA, 25 bp, Mus musculus
agccatgcatttacttgattctaag

SEQ ID NO: 172151 - DNA, 25 bp, Mus musculus
agccatgcattttcaggtacttaat

SEQ ID NO: 172152 - DNA, 25 bp, Mus musculus
agccatgcattttcttgattctaag

SEQ ID NO: 172153 - DNA, 25 bp, Mus musculus
agccatgcccagcatcaattctaga

SEQ ID NO: 172154 - DNA, 25 bp, Mus musculus
agccatgcccaggatcaattctaga

SEQ ID NO: 172155 - DNA, 25 bp, Mus musculus
agccatgcggccagtgcgaaagatc

SEQ ID NO: 172156 - DNA, 25 bp, Mus musculus
agccatgcggcctgtgcgaaagatc

SEQ ID NO: 172157 - DNA, 25 bp, Mus musculus
agccatgctcgccttgggtgtaaga

SEQ ID NO: 172158 - DNA, 25 bp, Mus musculus
agccatgctcgcgttgggtgtaaga

SEQ ID NO: 172159 - DNA, 25 bp, Mus musculus
agccatgctctcatctagttagtat

SEQ ID NO: 172160 - DNA, 25 bp, Mus musculus
agccatgctctcttctagttagtat

SEQ ID NO: 172161 - DNA, 25 bp, Mus musculus
agccatgctcttatttcacgtgtat

SEQ ID NO: 172162 - DNA, 25 bp, Mus musculus
agccatgctcttttttcacgtgtat

SEQ ID NO: 172163 - DNA, 25 bp, Mus musculus
agccatgctgagcacctagggaatc

SEQ ID NO: 172164 - DNA, 25 bp, Mus musculus
agccatgctgaggacctagggaatc

SEQ ID NO: 172165 - DNA, 25 bp, Mus musculus
agccatgctgtcctgacatttcttc

SEQ ID NO: 172166 - DNA, 25 bp, Mus musculus
agccatgctgtcgtgacatttcttc

SEQ ID NO: 172167 - DNA, 25 bp, Mus musculus
agccatgcttctcccaggaggagga

SEQ ID NO: 172168 - DNA, 25 bp, Mus musculus
agccatgcttctgccaggaggagga

SEQ ID NO: 172169 - DNA, 25 bp, Mus musculus
agccatggagcgatacacactgtac

SEQ ID NO: 172170 - DNA, 25 bp, Mus musculus
agccatggagcgttacacactgtac

SEQ ID NO: 172171 - DNA, 25 bp, Mus musculus
agccatggagctcacctcttaggag

SEQ ID NO: 172172 - DNA, 25 bp, Mus musculus
agccatggagctgacctcttaggag

SEQ ID NO: 172173 - DNA, 25 bp, Mus musculus
agccatggagttcctcaaagtgtcc

SEQ ID NO: 172174 - DNA, 25 bp, Mus musculus
agccatggagttgctcaaagtgtcc

SEQ ID NO: 172175 - DNA, 25 bp, Mus musculus
agccatggatggcatttgccccgtt

SEQ ID NO: 172176 - DNA, 25 bp, Mus musculus
agccatggatgggatttgccccgtt

SEQ ID NO: 172177 - DNA, 25 bp, Mus musculus
agccatggattcagtcccagatctt

SEQ ID NO: 172178 - DNA, 25 bp, Mus musculus
agccatggattctgtcccagatctt

SEQ ID NO: 172179 - DNA, 25 bp, Mus musculus
agccatggcaggatttgagttacaa

SEQ ID NO: 172180 - DNA, 25 bp, Mus musculus
agccatggcaggttttgagttacaa

SEQ ID NO: 172181 - DNA, 25 bp, Mus musculus
agccatggcatgagaagctcataca

SEQ ID NO: 172182 - DNA, 25 bp, Mus musculus
agccatggcatgtgaagctcataca

SEQ ID NO: 172183 - DNA, 25 bp, Mus musculus
agccatggccagacaattcctgttc

SEQ ID NO: 172184 - DNA, 25 bp, Mus musculus
agccatggccagtcaattcctgttc

SEQ ID NO: 172185 - DNA, 25 bp, Mus musculus
agccatggcctacaaacccttgtca

SEQ ID NO: 172186 - DNA, 25 bp, Mus musculus
agccatggcctagaaacccttgtca

SEQ ID NO: 172187 - DNA, 25 bp, Mus musculus
agccatggctgaacacttttggtca

SEQ ID NO: 172188 - DNA, 25 bp, Mus musculus
agccatggctgatcacttttggtca

SEQ ID NO: 172189 - DNA, 25 bp, Mus musculus
agccatggctgtccgaatactctct

SEQ ID NO: 172190 - DNA, 25 bp, Mus musculus
agccatggctgtgcgaatactctct

SEQ ID NO: 172191 - DNA, 25 bp, Mus musculus
agccatgggacacgccacacagtgt

SEQ ID NO: 172192 - DNA, 25 bp, Mus musculus
agccatgggacaggccacacagtgt

SEQ ID NO: 172193 - DNA, 25 bp, Mus musculus
agccatgggcacagttgcctttcta

SEQ ID NO: 172194 - DNA, 25 bp, Mus musculus
agccatgggcactgttgcctttcta

SEQ ID NO: 172195 - DNA, 25 bp, Mus musculus
agccatgggtatcccttttctcaag

SEQ ID NO: 172196 - DNA, 25 bp, Mus musculus
agccatgggtatgccttttctcaag

SEQ ID NO: 172197 - DNA, 25 bp, Mus musculus
agccatggtaatccccgctcatcta

SEQ ID NO: 172198 - DNA, 25 bp, Mus musculus
agccatggtaatgcccgctcatcta

SEQ ID NO: 172199 - DNA, 25 bp, Mus musculus
agccatggtctaagaaaacatttca

SEQ ID NO: 172200 - DNA, 25 bp, Mus musculus
agccatggtctatgaaaacatttca

SEQ ID NO: 172201 - DNA, 25 bp, Mus musculus
agccatggtctgcatgggttccaga

SEQ ID NO: 172202 - DNA, 25 bp, Mus musculus
agccatggtctggatgggttccaga

SEQ ID NO: 172203 - DNA, 25 bp, Mus musculus
agccatggtgatagagatagccaac

SEQ ID NO: 172204 - DNA, 25 bp, Mus musculus
agccatggtgattgagatagccaac

SEQ ID NO: 172205 - DNA, 25 bp, Mus musculus
agccatggtggacacagcttcagtc

SEQ ID NO: 172206 - DNA, 25 bp, Mus musculus
agccatggtggagacagcttcagtc

SEQ ID NO: 172207 - DNA, 25 bp, Mus musculus
agccatggtgtcaatccccaaaggg

SEQ ID NO: 172208 - DNA, 25 bp, Mus musculus
agccatggtgtctatccccaaaggg

SEQ ID NO: 172209 - DNA, 25 bp, Mus musculus
agccatggtgtgctctttggagaac

SEQ ID NO: 172210 - DNA, 25 bp, Mus musculus
agccatggtgtggtctttggagaac

SEQ ID NO: 172211 - DNA, 25 bp, Mus musculus
agccatgtacatagttcatgctcag

SEQ ID NO: 172212 - DNA, 25 bp, Mus musculus
agccatgtacattgttcatgctcag

SEQ ID NO: 172213 - DNA, 25 bp, Mus musculus
agccatgtagctatcttttgaggag

SEQ ID NO: 172214 - DNA, 25 bp, Mus musculus
agccatgtagctttcttttgaggag

SEQ ID NO: 172215 - DNA, 25 bp, Mus musculus
agccatgtatgaaattcacttctag

SEQ ID NO: 172216 - DNA, 25 bp, Mus musculus
agccatgtatgatattcacttctag

SEQ ID NO: 172217 - DNA, 25 bp, Mus musculus
agccatgtcataaccagtgactagt

SEQ ID NO: 172218 - DNA, 25 bp, Mus musculus
agccatgtcatatccagtgactagt

SEQ ID NO: 172219 - DNA, 25 bp, Mus musculus
agccatgtcatgatctgtgtttcag

SEQ ID NO: 172220 - DNA, 25 bp, Mus musculus
agccatgtcatgttctgtgtttcag

SEQ ID NO: 172221 - DNA, 25 bp, Mus musculus
agccatgtccagaatgagtgatgtt

SEQ ID NO: 172222 - DNA, 25 bp, Mus musculus
agccatgtccagtatgagtgatgtt

SEQ ID NO: 172223 - DNA, 25 bp, Mus musculus
agccatgtcccactgtagtctggat

SEQ ID NO: 172224 - DNA, 25 bp, Mus musculus
agccatgtcccagtgtagtctggat

SEQ ID NO: 172225 - DNA, 25 bp, Mus musculus
agccatgtccccatcacaaaggagt

SEQ ID NO: 172226 - DNA, 25 bp, Mus musculus
agccatgtccccttcacaaaggagt

SEQ ID NO: 172227 - DNA, 25 bp, Mus musculus
agccatgtcctacggtttccacaga

SEQ ID NO: 172228 - DNA, 25 bp, Mus musculus
agccatgtcctagggtttccacaga

SEQ ID NO: 172229 - DNA, 25 bp, Mus musculus
agccatgtctaaacttaactccgaa

SEQ ID NO: 172230 - DNA, 25 bp, Mus musculus
agccatgtctaatcttaactccgaa

SEQ ID NO: 172231 - DNA, 25 bp, Mus musculus
agccatgtctgcacttgaaagccac

SEQ ID NO: 172232 - DNA, 25 bp, Mus musculus
agccatgtctgctcttgaaagccac

SEQ ID NO: 172233 - DNA, 25 bp, Mus musculus
agccatgtgacaacctggacagcag

SEQ ID NO: 172234 - DNA, 25 bp, Mus musculus
agccatgtgacatcctggacagcag

SEQ ID NO: 172235 - DNA, 25 bp, Mus musculus
agccatgtggccaactctgtcaagt

SEQ ID NO: 172236 - DNA, 25 bp, Mus musculus
agccatgtggcctactctgtcaagt

SEQ ID NO: 172237 - DNA, 25 bp, Mus musculus
agccatgtggtaacatcctttgttt

SEQ ID NO: 172238 - DNA, 25 bp, Mus musculus
agccatgtggtatcatcctttgttt

SEQ ID NO: 172239 - DNA, 25 bp, Mus musculus
agccatgtgtaacagagcttagaca

SEQ ID NO: 172240 - DNA, 25 bp, Mus musculus
agccatgtgtaagagagcttagaca

SEQ ID NO: 172241 - DNA, 25 bp, Mus musculus
agccatgtgtcaacacggttgtgag

SEQ ID NO: 172242 - DNA, 25 bp, Mus musculus
agccatgtgtcaatctaactccaga

SEQ ID NO: 172243 - DNA, 25 bp, Mus musculus
agccatgtgtcatcacggttgtgag

SEQ ID NO: 172244 - DNA, 25 bp, Mus musculus
agccatgtgtcattctaactccaga

SEQ ID NO: 172245 - DNA, 25 bp, Mus musculus
agccatgtgtggaagctactccact

SEQ ID NO: 172246 - DNA, 25 bp, Mus musculus
agccatgtgtggtagctactccact

SEQ ID NO: 172247 - DNA, 25 bp, Mus musculus
agccatgttagtaagaattccacgc

SEQ ID NO: 172248 - DNA, 25 bp, Mus musculus
agccatgttagttagaattccacgc

SEQ ID NO: 172249 - DNA, 25 bp, Mus musculus
agccatgttattcccttaatcccta

SEQ ID NO: 172250 - DNA, 25 bp, Mus musculus
agccatgttattgccttaatcccta

SEQ ID NO: 172251 - DNA, 25 bp, Mus musculus
agccatgttccaattgcccttttgt

SEQ ID NO: 172252 - DNA, 25 bp, Mus musculus
agccatgttccatttgcccttttgt

SEQ ID NO: 172253 - DNA, 25 bp, Mus musculus
agccatgttgagcattagtaccttg

SEQ ID NO: 172254 - DNA, 25 bp, Mus musculus
agccatgttgaggattagtaccttg

SEQ ID NO: 172255 - DNA, 25 bp, Mus musculus
agccatgttgatcgcacattgttaa

SEQ ID NO: 172256 - DNA, 25 bp, Mus musculus
agccatgttgatggcacattgttaa

SEQ ID NO: 172257 - DNA, 25 bp, Mus musculus
agccatgttgttatgagcagccgga

SEQ ID NO: 172258 - DNA, 25 bp, Mus musculus
agccatgttgttttgagcagccgga

SEQ ID NO: 172259 - DNA, 25 bp, Mus musculus
agccatgtttagaaggcacacctgt

SEQ ID NO: 172260 - DNA, 25 bp, Mus musculus
agccatgtttagtaggcacacctgt

SEQ ID NO: 172261 - DNA, 25 bp, Mus musculus
agccatgtttccaggtgttcccggt

SEQ ID NO: 172262 - DNA, 25 bp, Mus musculus
agccatgtttcctggtgttcccggt

SEQ ID NO: 172263 - DNA, 25 bp, Mus musculus
agccatgttttcagtaccctgaagg

SEQ ID NO: 172264 - DNA, 25 bp, Mus musculus
agccatgttttctgtaccctgaagg

SEQ ID NO: 172265 - DNA, 25 bp, Mus musculus
agccattaaagcagcagccgttgca

SEQ ID NO: 172266 - DNA, 25 bp, Mus musculus
agccattaaagctgcagccgttgca

SEQ ID NO: 172267 - DNA, 25 bp, Mus musculus
agccattaatgtagtctcgccagaa

SEQ ID NO: 172268 - DNA, 25 bp, Mus musculus
agccattaatgttgtctcgccagaa

SEQ ID NO: 172269 - DNA, 25 bp, Mus musculus
agccattaattactgaccaccaaat

SEQ ID NO: 172270 - DNA, 25 bp, Mus musculus
agccattaattagtgaccaccaaat

SEQ ID NO: 172271 - DNA, 25 bp, Mus musculus
agccattaccagacaaccagtgcag

SEQ ID NO: 172272 - DNA, 25 bp, Mus musculus
agccattaccagtcaaccagtgcag

SEQ ID NO: 172273 - DNA, 25 bp, Mus musculus
agccattagtatatgctattcataa

SEQ ID NO: 172274 - DNA, 25 bp, Mus musculus
agccattagtatttgctattcataa

SEQ ID NO: 172275 - DNA, 25 bp, Mus musculus
agccattatcccagttcccagttga

SEQ ID NO: 172276 - DNA, 25 bp, Mus musculus
agccattatccctgttcccagttga

SEQ ID NO: 172277 - DNA, 25 bp, Mus musculus
agccattatcgtctctcagtgggac

SEQ ID NO: 172278 - DNA, 25 bp, Mus musculus
agccattatcgtgtctcagtgggac

SEQ ID NO: 172279 - DNA, 25 bp, Mus musculus
agccattattcaaggtttcttactt

SEQ ID NO: 172280 - DNA, 25 bp, Mus musculus
agccattattcatggtttcttactt

SEQ ID NO: 172281 - DNA, 25 bp, Mus musculus
agccattcaaccaagaacaccttag

SEQ ID NO: 172282 - DNA, 25 bp, Mus musculus
agccattcaacctagaacaccttag

SEQ ID NO: 172283 - DNA, 25 bp, Mus musculus
agccattcaagaaatacctgtactt

SEQ ID NO: 172284 - DNA, 25 bp, Mus musculus
agccattcaagatatacctgtactt

SEQ ID NO: 172285 - DNA, 25 bp, Mus musculus
agccattcagccagcagctgtgatg

SEQ ID NO: 172286 - DNA, 25 bp, Mus musculus
agccattcagcctgcagctgtgatg

SEQ ID NO: 172287 - DNA, 25 bp, Mus musculus
agccattcagttagcccaccacaga

SEQ ID NO: 172288 - DNA, 25 bp, Mus musculus
agccattcagttattcaagtcccta

SEQ ID NO: 172289 - DNA, 25 bp, Mus musculus
agccattcagtttgcccaccacaga

SEQ ID NO: 172290 - DNA, 25 bp, Mus musculus
agccattcagtttttcaagtcccta

SEQ ID NO: 172291 - DNA, 25 bp, Mus musculus
agccattcatggaaacgtccctgct

SEQ ID NO: 172292 - DNA, 25 bp, Mus musculus
agccattcatggtaacgtccctgct

SEQ ID NO: 172293 - DNA, 25 bp, Mus musculus
agccattccacacttacttccagag

SEQ ID NO: 172294 - DNA, 25 bp, Mus musculus
agccattccacagttacttccagag

SEQ ID NO: 172295 - DNA, 25 bp, Mus musculus
agccattccatcactctgtatctgg

SEQ ID NO: 172296 - DNA, 25 bp, Mus musculus
agccattccatctctctgtatctgg

SEQ ID NO: 172297 - DNA, 25 bp, Mus musculus
agccattcctagaattccactgtca

SEQ ID NO: 172298 - DNA, 25 bp, Mus musculus
agccattcctagtattccactgtca

SEQ ID NO: 172299 - DNA, 25 bp, Mus musculus
agccattctcagctgttacctaaat

SEQ ID NO: 172300 - DNA, 25 bp, Mus musculus
agccattctcaggtgttacctaaat

SEQ ID NO: 172301 - DNA, 25 bp, Mus musculus
agccattctgcgaactaactcagcg

SEQ ID NO: 172302 - DNA, 25 bp, Mus musculus
agccattctgcgtactaactcagcg

SEQ ID NO: 172303 - DNA, 25 bp, Mus musculus
agccattgagctatttcaggcacaa

SEQ ID NO: 172304 - DNA, 25 bp, Mus musculus
agccattgagctttttcaggcacaa

SEQ ID NO: 172305 - DNA, 25 bp, Mus musculus
agccattgagtccacatctttattt

SEQ ID NO: 172306 - DNA, 25 bp, Mus musculus
agccattgagtcgacatctttattt

SEQ ID NO: 172307 - DNA, 25 bp, Mus musculus
agccattgatggctgtgtgcatgct

SEQ ID NO: 172308 - DNA, 25 bp, Mus musculus
agccattgatgggtgtgtgcatgct

SEQ ID NO: 172309 - DNA, 25 bp, Mus musculus
agccattgcaaactcctgaaccttg

SEQ ID NO: 172310 - DNA, 25 bp, Mus musculus
agccattgcaaagtcctgaaccttg

SEQ ID NO: 172311 - DNA, 25 bp, Mus musculus
agccattgcattcatgcgctcagtg

SEQ ID NO: 172312 - DNA, 25 bp, Mus musculus
agccattgcattgatgcgctcagtg

SEQ ID NO: 172313 - DNA, 25 bp, Mus musculus
agccattgcctcataatttatagcc

SEQ ID NO: 172314 - DNA, 25 bp, Mus musculus
agccattgcctcttaatttatagcc

SEQ ID NO: 172315 - DNA, 25 bp, Mus musculus
agccattgcctgagtgtggtgatat

SEQ ID NO: 172316 - DNA, 25 bp, Mus musculus
agccattgcctgtgtgtggtgatat

SEQ ID NO: 172317 - DNA, 25 bp, Mus musculus
agccattgctatccttgagaaagaa

SEQ ID NO: 172318 - DNA, 25 bp, Mus musculus
agccattgctatgcttgagaaagaa

SEQ ID NO: 172319 - DNA, 25 bp, Mus musculus
agccattgctgccaaggagccagaa

SEQ ID NO: 172320 - DNA, 25 bp, Mus musculus
agccattgctgcgaaggagccagaa

SEQ ID NO: 172321 - DNA, 25 bp, Mus musculus
agccattggcacacagaggagtcag

SEQ ID NO: 172322 - DNA, 25 bp, Mus musculus
agccattggcactcagaggagtcag

SEQ ID NO: 172323 - DNA, 25 bp, Mus musculus
agccattggcctcggttctggagca

SEQ ID NO: 172324 - DNA, 25 bp, Mus musculus
agccattggcctgggttctggagca

SEQ ID NO: 172325 - DNA, 25 bp, Mus musculus
agccattggctcacctgataattgg

SEQ ID NO: 172326 - DNA, 25 bp, Mus musculus
agccattggctctcctgataattgg

SEQ ID NO: 172327 - DNA, 25 bp, Mus musculus
agccattgggctctagactggtgtc

SEQ ID NO: 172328 - DNA, 25 bp, Mus musculus
agccattgggctgtagactggtgtc

SEQ ID NO: 172329 - DNA, 25 bp, Mus musculus
agccattggtaactcactgtgtggt

SEQ ID NO: 172330 - DNA, 25 bp, Mus musculus
agccattggtaagtcactgtgtggt

SEQ ID NO: 172331 - DNA, 25 bp, Mus musculus
agccattggtcaatgtatctgccat

SEQ ID NO: 172332 - DNA, 25 bp, Mus musculus
agccattggtcattgtatctgccat

SEQ ID NO: 172333 - DNA, 25 bp, Mus musculus
agccattggtggatctagctcctta

SEQ ID NO: 172334 - DNA, 25 bp, Mus musculus
agccattggtggttctagctcctta

SEQ ID NO: 172335 - DNA, 25 bp, Mus musculus
agccattgtgctatgtgatactaat

SEQ ID NO: 172336 - DNA, 25 bp, Mus musculus
agccattgtgctttgtgatactaat

SEQ ID NO: 172337 - DNA, 25 bp, Mus musculus
agccattgtggtcggcgtggagctt

SEQ ID NO: 172338 - DNA, 25 bp, Mus musculus
agccattgtggtgggcgtggagctt

SEQ ID NO: 172339 - DNA, 25 bp, Mus musculus
agccattgtgttccaactcagctct

SEQ ID NO: 172340 - DNA, 25 bp, Mus musculus
agccattgtgttgcaactcagctct

SEQ ID NO: 172341 - DNA, 25 bp, Mus musculus
agccattgttgacatggtccctgga

SEQ ID NO: 172342 - DNA, 25 bp, Mus musculus
agccattgttgagatggtccctgga

SEQ ID NO: 172343 - DNA, 25 bp, Mus musculus
agccatttaccaccttgggcagttt

SEQ ID NO: 172344 - DNA, 25 bp, Mus musculus
agccatttaccagcttgggcagttt

SEQ ID NO: 172345 - DNA, 25 bp, Mus musculus
agccatttactaaggagttaaagat

SEQ ID NO: 172346 - DNA, 25 bp, Mus musculus
agccatttactatggagttaaagat

SEQ ID NO: 172347 - DNA, 25 bp, Mus musculus
agccatttaggacatgtcccttcaa

SEQ ID NO: 172348 - DNA, 25 bp, Mus musculus
agccatttaggagatgtcccttcaa

SEQ ID NO: 172349 - DNA, 25 bp, Mus musculus
agccatttaggccaatcatcagtgt

SEQ ID NO: 172350 - DNA, 25 bp, Mus musculus
agccatttaggcgaatcatcagtgt

SEQ ID NO: 172351 - DNA, 25 bp, Mus musculus
agccatttatctagctgtctggtag

SEQ ID NO: 172352 - DNA, 25 bp, Mus musculus
agccatttatcttgctgtctggtag

SEQ ID NO: 172353 - DNA, 25 bp, Mus musculus
agccatttatttcacctctctgagc

SEQ ID NO: 172354 - DNA, 25 bp, Mus musculus
agccatttatttgacctctctgagc

SEQ ID NO: 172355 - DNA, 25 bp, Mus musculus
agccatttcataatctagcacttag

SEQ ID NO: 172356 - DNA, 25 bp, Mus musculus
agccatttcatattctagcacttag

SEQ ID NO: 172357 - DNA, 25 bp, Mus musculus
agccatttccataatgacaataatg

SEQ ID NO: 172358 - DNA, 25 bp, Mus musculus
agccatttccattatgacaataatg

SEQ ID NO: 172359 - DNA, 25 bp, Mus musculus
agccatttcctcaaatgccctaagc

SEQ ID NO: 172360 - DNA, 25 bp, Mus musculus
agccatttcctctaatgccctaagc

SEQ ID NO: 172361 - DNA, 25 bp, Mus musculus
agccatttctacagctgtggacaat

SEQ ID NO: 172362 - DNA, 25 bp, Mus musculus
agccatttctactgctgtggacaat

SEQ ID NO: 172363 - DNA, 25 bp, Mus musculus
agccatttctccagtgcttatgtgt

SEQ ID NO: 172364 - DNA, 25 bp, Mus musculus
agccatttctcctgtgcttatgtgt

SEQ ID NO: 172365 - DNA, 25 bp, Mus musculus
agccatttgcctctgtggtattggt

SEQ ID NO: 172366 - DNA, 25 bp, Mus musculus
agccatttgcctgtgtggtattggt

SEQ ID NO: 172367 - DNA, 25 bp, Mus musculus
agccatttgcttcctcagggaacat

SEQ ID NO: 172368 - DNA, 25 bp, Mus musculus
agccatttgcttgctcagggaacat

SEQ ID NO: 172369 - DNA, 25 bp, Mus musculus
agccatttgggccaggtgaagcaac

SEQ ID NO: 172370 - DNA, 25 bp, Mus musculus
agccatttgggcgaggtgaagcaac

SEQ ID NO: 172371 - DNA, 25 bp, Mus musculus
agccattttagcatgctctgaaccg

SEQ ID NO: 172372 - DNA, 25 bp, Mus musculus
agccattttagcttgctctgaaccg

SEQ ID NO: 172373 - DNA, 25 bp, Mus musculus
agccattttgcactgtagggaacat

SEQ ID NO: 172374 - DNA, 25 bp, Mus musculus
agccattttgcagtgtagggaacat

SEQ ID NO: 172375 - DNA, 25 bp, Mus musculus
agccattttgctatagccggtcagc

SEQ ID NO: 172376 - DNA, 25 bp, Mus musculus
agccattttgctttagccggtcagc

SEQ ID NO: 172377 - DNA, 25 bp, Mus musculus
agcccaaaatgcagttctttcaatt

SEQ ID NO: 172378 - DNA, 25 bp, Mus musculus
agcccaaaatgctgttctttcaatt

SEQ ID NO: 172379 - DNA, 25 bp, Mus musculus
agcccaaactagagagtgaaatcct

SEQ ID NO: 172380 - DNA, 25 bp, Mus musculus
agcccaaactagtgagtgaaatcct

SEQ ID NO: 172381 - DNA, 25 bp, Mus musculus
agcccaaactatcctcactatggag

SEQ ID NO: 172382 - DNA, 25 bp, Mus musculus
agcccaaactatgctcactatggag

SEQ ID NO: 172383 - DNA, 25 bp, Mus musculus
agcccaaatctgctctgttcttgtt

SEQ ID NO: 172384 - DNA, 25 bp, Mus musculus
agcccaaatctggtctgttcttgtt

SEQ ID NO: 172385 - DNA, 25 bp, Mus musculus
agcccaacaacgagccaggtgtatg

SEQ ID NO: 172386 - DNA, 25 bp, Mus musculus
agcccaacaacgtgccaggtgtatg

SEQ ID NO: 172387 - DNA, 25 bp, Mus musculus
agcccaacagaaccttctagtaaaa

SEQ ID NO: 172388 - DNA, 25 bp, Mus musculus
agcccaacagaagcttctagtaaaa

SEQ ID NO: 172389 - DNA, 25 bp, Mus musculus
agcccaacatcacatcatcagagtt

SEQ ID NO: 172390 - DNA, 25 bp, Mus musculus
agcccaacatcagatcatcagagtt

SEQ ID NO: 172391 - DNA, 25 bp, Mus musculus
agcccaacccgaatcttaggacatt

SEQ ID NO: 172392 - DNA, 25 bp, Mus musculus
agcccaacccgattcttaggacatt

SEQ ID NO: 172393 - DNA, 25 bp, Mus musculus
agcccaaccctgagaaaaatgcctg

SEQ ID NO: 172394 - DNA, 25 bp, Mus musculus
agcccaaccctgtgaaaaatgcctg

SEQ ID NO: 172395 - DNA, 25 bp, Mus musculus
agcccaacttgcactcagaatgtta

SEQ ID NO: 172396 - DNA, 25 bp, Mus musculus
agcccaacttgctctcagaatgtta

SEQ ID NO: 172397 - DNA, 25 bp, Mus musculus
agcccaagaatacagcatcctgcag

SEQ ID NO: 172398 - DNA, 25 bp, Mus musculus
agcccaagaatagagcatcctgcag

SEQ ID NO: 172399 - DNA, 25 bp, Mus musculus
agcccaagacagctgcccacacatc

SEQ ID NO: 172400 - DNA, 25 bp, Mus musculus
agcccaagacaggtgcccacacatc

SEQ ID NO: 172401 - DNA, 25 bp, Mus musculus
agcccaagagccaggacatctacct

SEQ ID NO: 172402 - DNA, 25 bp, Mus musculus
agcccaagagccaggtactacattt

SEQ ID NO: 172403 - DNA, 25 bp, Mus musculus
agcccaagagcctggacatctacct

SEQ ID NO: 172404 - DNA, 25 bp, Mus musculus
agcccaagagcctggtactacattt

SEQ ID NO: 172405 - DNA, 25 bp, Mus musculus
agcccaagatcaagaggagaccctt

SEQ ID NO: 172406 - DNA, 25 bp, Mus musculus
agcccaagatcatgaggagaccctt

SEQ ID NO: 172407 - DNA, 25 bp, Mus musculus
agcccaagcaaacgtctttaggaag

SEQ ID NO: 172408 - DNA, 25 bp, Mus musculus
agcccaagcaaaggtctttaggaag

SEQ ID NO: 172409 - DNA, 25 bp, Mus musculus
agcccaagcaacagagaagacattg

SEQ ID NO: 172410 - DNA, 25 bp, Mus musculus
agcccaagcaactgagaagacattg

SEQ ID NO: 172411 - DNA, 25 bp, Mus musculus
agcccaagcccacgattctttatat

SEQ ID NO: 172412 - DNA, 25 bp, Mus musculus
agcccaagcccaggattctttatat

SEQ ID NO: 172413 - DNA, 25 bp, Mus musculus
agcccaagctccaccagatggagaa

SEQ ID NO: 172414 - DNA, 25 bp, Mus musculus
agcccaagctcctccagatggagaa

SEQ ID NO: 172415 - DNA, 25 bp, Mus musculus
agcccaaggagacaccggcgcctga

SEQ ID NO: 172416 - DNA, 25 bp, Mus musculus
agcccaaggagagaccggcgcctga

SEQ ID NO: 172417 - DNA, 25 bp, Mus musculus
agcccaaggatcagtaagcataatg

SEQ ID NO: 172418 - DNA, 25 bp, Mus musculus
agcccaaggatctgtaagcataatg

SEQ ID NO: 172419 - DNA, 25 bp, Mus musculus
agcccaagggccctgccatgttttc

SEQ ID NO: 172420 - DNA, 25 bp, Mus musculus
agcccaagggccgtgccatgttttc

SEQ ID NO: 172421 - DNA, 25 bp, Mus musculus
agcccaagtatcacaaccagttcct

SEQ ID NO: 172422 - DNA, 25 bp, Mus musculus
agcccaagtatctcaaccagttcct

SEQ ID NO: 172423 - DNA, 25 bp, Mus musculus
agcccaagtctccaagtactctaag

SEQ ID NO: 172424 - DNA, 25 bp, Mus musculus
agcccaagtctcgaagtactctaag

SEQ ID NO: 172425 - DNA, 25 bp, Mus musculus
agcccaagtcttcgccatgctgact

SEQ ID NO: 172426 - DNA, 25 bp, Mus musculus
agcccaagtcttggccatgctgact

SEQ ID NO: 172427 - DNA, 25 bp, Mus musculus
agcccaagtgcccaagtgcattagg

SEQ ID NO: 172428 - DNA, 25 bp, Mus musculus
agcccaagtgccgaagtgcattagg

SEQ ID NO: 172429 - DNA, 25 bp, Mus musculus
agcccaataccaattactgctgcct

SEQ ID NO: 172430 - DNA, 25 bp, Mus musculus
agcccaataccatttactgctgcct

SEQ ID NO: 172431 - DNA, 25 bp, Mus musculus
agcccaatcgtcaccaagaagggat

SEQ ID NO: 172432 - DNA, 25 bp, Mus musculus
agcccaatcgtctccaagaagggat

SEQ ID NO: 172433 - DNA, 25 bp, Mus musculus
agcccaatgaccataactctctatg

SEQ ID NO: 172434 - DNA, 25 bp, Mus musculus
agcccaatgaccttaactctctatg

SEQ ID NO: 172435 - DNA, 25 bp, Mus musculus
agcccaatgagtatgccagtcagat

SEQ ID NO: 172436 - DNA, 25 bp, Mus musculus
agcccaatgagtttgccagtcagat

SEQ ID NO: 172437 - DNA, 25 bp, Mus musculus
agcccaatgcctccttgaaatttaa

SEQ ID NO: 172438 - DNA, 25 bp, Mus musculus
agcccaatgcctgcttgaaatttaa

SEQ ID NO: 172439 - DNA, 25 bp, Mus musculus
agcccaatggccagagttctaatcc

SEQ ID NO: 172440 - DNA, 25 bp, Mus musculus
agcccaatggcctgagttctaatcc

SEQ ID NO: 172441 - DNA, 25 bp, Mus musculus
agcccaattgggaatgacttgaact

SEQ ID NO: 172442 - DNA, 25 bp, Mus musculus
agcccaattgggtatgacttgaact

SEQ ID NO: 172443 - DNA, 25 bp, Mus musculus
agcccacaaatcctgaatttctcac

SEQ ID NO: 172444 - DNA, 25 bp, Mus musculus
agcccacaaatcgtgaatttctcac

SEQ ID NO: 172445 - DNA, 25 bp, Mus musculus
agcccacaagcacattgaattcctc

SEQ ID NO: 172446 - DNA, 25 bp, Mus musculus
agcccacaagcagattgaattcctc

SEQ ID NO: 172447 - DNA, 25 bp, Mus musculus
agcccacaagctctgatgctttcac

SEQ ID NO: 172448 - DNA, 25 bp, Mus musculus
agcccacaagctgtgatgctttcac

SEQ ID NO: 172449 - DNA, 25 bp, Mus musculus
agcccacaatatatctactccataa

SEQ ID NO: 172450 - DNA, 25 bp, Mus musculus
agcccacaatatttctactccataa

SEQ ID NO: 172451 - DNA, 25 bp, Mus musculus
agcccacacgtgcagtgttagctga

SEQ ID NO: 172452 - DNA, 25 bp, Mus musculus
agcccacacgtggagtgttagctga

SEQ ID NO: 172453 - DNA, 25 bp, Mus musculus
agcccacacttcactctagaaatgt

SEQ ID NO: 172454 - DNA, 25 bp, Mus musculus
agcccacacttctctctagaaatgt

SEQ ID NO: 172455 - DNA, 25 bp, Mus musculus
agcccacagacgagctttgactcag

SEQ ID NO: 172456 - DNA, 25 bp, Mus musculus
agcccacagacgtgctttgactcag

SEQ ID NO: 172457 - DNA, 25 bp, Mus musculus
agcccacagatcattcctgataggt

SEQ ID NO: 172458 - DNA, 25 bp, Mus musculus
agcccacagatctttcctgataggt

SEQ ID NO: 172459 - DNA, 25 bp, Mus musculus
agcccacagatgacactagtgtcac

SEQ ID NO: 172460 - DNA, 25 bp, Mus musculus
agcccacagatgtcactagtgtcac

SEQ ID NO: 172461 - DNA, 25 bp, Mus musculus
agcccacagctactggttgctcaaa

SEQ ID NO: 172462 - DNA, 25 bp, Mus musculus
agcccacagctagtggttgctcaaa

SEQ ID NO: 172463 - DNA, 25 bp, Mus musculus
agcccacaggcgctgccatagcaaa

SEQ ID NO: 172464 - DNA, 25 bp, Mus musculus
agcccacaggcggtgccatagcaaa

SEQ ID NO: 172465 - DNA, 25 bp, Mus musculus
agcccacatccacagtaacacgtgt

SEQ ID NO: 172466 - DNA, 25 bp, Mus musculus
agcccacatccagagtaacacgtgt

SEQ ID NO: 172467 - DNA, 25 bp, Mus musculus
agcccacattacaccatcttgaagg

SEQ ID NO: 172468 - DNA, 25 bp, Mus musculus
agcccacattactccatcttgaagg

SEQ ID NO: 172469 - DNA, 25 bp, Mus musculus
agcccacattccaaattcagagcag

SEQ ID NO: 172470 - DNA, 25 bp, Mus musculus
agcccacattcctaattcagagcag

SEQ ID NO: 172471 - DNA, 25 bp, Mus musculus
agcccaccaccgaattccagaatat

SEQ ID NO: 172472 - DNA, 25 bp, Mus musculus
agcccaccaccgtattccagaatat

SEQ ID NO: 172473 - DNA, 25 bp, Mus musculus
agcccaccacgccacgttttgaaat

SEQ ID NO: 172474 - DNA, 25 bp, Mus musculus
agcccaccacgcgacgttttgaaat

SEQ ID NO: 172475 - DNA, 25 bp, Mus musculus
agcccaccagctcgccactaaaagc

SEQ ID NO: 172476 - DNA, 25 bp, Mus musculus
agcccaccagctggccactaaaagc

SEQ ID NO: 172477 - DNA, 25 bp, Mus musculus
agcccacccatgaatgagtactgag

SEQ ID NO: 172478 - DNA, 25 bp, Mus musculus
agcccacccatgcatgcatagtgag

SEQ ID NO: 172479 - DNA, 25 bp, Mus musculus
agcccacccatggatgcatagtgag

SEQ ID NO: 172480 - DNA, 25 bp, Mus musculus
agcccacccatgtatgagtactgag

SEQ ID NO: 172481 - DNA, 25 bp, Mus musculus
agcccacccattcctataattgtat

SEQ ID NO: 172482 - DNA, 25 bp, Mus musculus
agcccacccattgctataattgtat

SEQ ID NO: 172483 - DNA, 25 bp, Mus musculus
agcccacccgcgctgagcaagaaag

SEQ ID NO: 172484 - DNA, 25 bp, Mus musculus
agcccacccgcggtgagcaagaaag

SEQ ID NO: 172485 - DNA, 25 bp, Mus musculus
agcccaccctacactgatgtataga

SEQ ID NO: 172486 - DNA, 25 bp, Mus musculus
agcccaccctactctgatgtataga

SEQ ID NO: 172487 - DNA, 25 bp, Mus musculus
agcccacctggtagatgttggcggc

SEQ ID NO: 172488 - DNA, 25 bp, Mus musculus
agcccacctggttgatgttggcggc

SEQ ID NO: 172489 - DNA, 25 bp, Mus musculus
agcccaccttacatagatcagagaa

SEQ ID NO: 172490 - DNA, 25 bp, Mus musculus
agcccaccttacttagatcagagaa

SEQ ID NO: 172491 - DNA, 25 bp, Mus musculus
agcccacctttgatagtttcatact

SEQ ID NO: 172492 - DNA, 25 bp, Mus musculus
agcccacctttgttagtttcatact

SEQ ID NO: 172493 - DNA, 25 bp, Mus musculus
agcccacgcccacagagaggtatgg

SEQ ID NO: 172494 - DNA, 25 bp, Mus musculus
agcccacgcccagagagaggtatgg

SEQ ID NO: 172495 - DNA, 25 bp, Mus musculus
agcccacgctgacctgtgtgtagta

SEQ ID NO: 172496 - DNA, 25 bp, Mus musculus
agcccacgctgactttctgaggagt

SEQ ID NO: 172497 - DNA, 25 bp, Mus musculus
agcccacgctgagctgtgtgtagta

SEQ ID NO: 172498 - DNA, 25 bp, Mus musculus
agcccacgctgagtttctgaggagt

SEQ ID NO: 172499 - DNA, 25 bp, Mus musculus
agcccacgggtaatgctgctcaaag

SEQ ID NO: 172500 - DNA, 25 bp, Mus musculus
agcccacgggtattgctgctcaaag

SEQ ID NO: 172501 - DNA, 25 bp, Mus musculus
agcccacgtgttcctttgttaccag

SEQ ID NO: 172502 - DNA, 25 bp, Mus musculus
agcccacgtgttgctttgttaccag

SEQ ID NO: 172503 - DNA, 25 bp, Mus musculus
agcccactaaacatgcttggcactt

SEQ ID NO: 172504 - DNA, 25 bp, Mus musculus
agcccactaaacttgcttggcactt

SEQ ID NO: 172505 - DNA, 25 bp, Mus musculus
agcccactataaaccaaagacatac

SEQ ID NO: 172506 - DNA, 25 bp, Mus musculus
agcccactataatccaaagacatac

SEQ ID NO: 172507 - DNA, 25 bp, Mus musculus
agcccactcagtcctctagactagt

SEQ ID NO: 172508 - DNA, 25 bp, Mus musculus
agcccactcagtgctctagactagt

SEQ ID NO: 172509 - DNA, 25 bp, Mus musculus
agcccactccacatgatgcacatga

SEQ ID NO: 172510 - DNA, 25 bp, Mus musculus
agcccactccacttgatgcacatga

SEQ ID NO: 172511 - DNA, 25 bp, Mus musculus
agcccactgaggaaggacccaggga

SEQ ID NO: 172512 - DNA, 25 bp, Mus musculus
agcccactgaggtaggacccaggga

SEQ ID NO: 172513 - DNA, 25 bp, Mus musculus
agcccactgctgatggatggttttg

SEQ ID NO: 172514 - DNA, 25 bp, Mus musculus
agcccactgctgttggatggttttg

SEQ ID NO: 172515 - DNA, 25 bp, Mus musculus
agcccactgggcattgttcacaggg

SEQ ID NO: 172516 - DNA, 25 bp, Mus musculus
agcccactgggctttgttcacaggg

SEQ ID NO: 172517 - DNA, 25 bp, Mus musculus
agcccactgggtattatcatcttct

SEQ ID NO: 172518 - DNA, 25 bp, Mus musculus
agcccactgggttttatcatcttct

SEQ ID NO: 172519 - DNA, 25 bp, Mus musculus
agcccactgtaccttgagaagacaa

SEQ ID NO: 172520 - DNA, 25 bp, Mus musculus
agcccactgtacgttgagaagacaa

SEQ ID NO: 172521 - DNA, 25 bp, Mus musculus
agcccactgtccatgatatcgaatg

SEQ ID NO: 172522 - DNA, 25 bp, Mus musculus
agcccactgtccttgatatcgaatg

SEQ ID NO: 172523 - DNA, 25 bp, Mus musculus
agcccacttccgaatcaataaaaag

SEQ ID NO: 172524 - DNA, 25 bp, Mus musculus
agcccacttccgtatcaataaaaag

SEQ ID NO: 172525 - DNA, 25 bp, Mus musculus
agcccacttcttctgtgtgcgtgcg

SEQ ID NO: 172526 - DNA, 25 bp, Mus musculus
agcccacttcttgtgtgtgcgtgcg

SEQ ID NO: 172527 - DNA, 25 bp, Mus musculus
agcccacttgacagtgcagactcag

SEQ ID NO: 172528 - DNA, 25 bp, Mus musculus
agcccacttgacataagttttcttg

SEQ ID NO: 172529 - DNA, 25 bp, Mus musculus
agcccacttgactgtgcagactcag

SEQ ID NO: 172530 - DNA, 25 bp, Mus musculus
agcccacttgacttaagttttcttg

SEQ ID NO: 172531 - DNA, 25 bp, Mus musculus
agcccacttgctacttttggattgc

SEQ ID NO: 172532 - DNA, 25 bp, Mus musculus
agcccacttgcttcttttggattgc

SEQ ID NO: 172533 - DNA, 25 bp, Mus musculus
agcccacttggacagctataaaaag

SEQ ID NO: 172534 - DNA, 25 bp, Mus musculus
agcccacttggagagctataaaaag

SEQ ID NO: 172535 - DNA, 25 bp, Mus musculus
agcccactttgcacatttcttatct

SEQ ID NO: 172536 - DNA, 25 bp, Mus musculus
agcccactttgctcatttcttatct

SEQ ID NO: 172537 - DNA, 25 bp, Mus musculus
agcccagaaaatctttatccctaag

SEQ ID NO: 172538 - DNA, 25 bp, Mus musculus
agcccagaaaatgtttatccctaag

SEQ ID NO: 172539 - DNA, 25 bp, Mus musculus
agcccagaaactacctcagtggtgg

SEQ ID NO: 172540 - DNA, 25 bp, Mus musculus
agcccagaaacttcctcagtggtgg

SEQ ID NO: 172541 - DNA, 25 bp, Mus musculus
agcccagaaatactgaaagcttatt

SEQ ID NO: 172542 - DNA, 25 bp, Mus musculus
agcccagaaatagtgaaagcttatt

SEQ ID NO: 172543 - DNA, 25 bp, Mus musculus
agcccagaacataatgcagtccttt

SEQ ID NO: 172544 - DNA, 25 bp, Mus musculus
agcccagaacattatgcagtccttt

SEQ ID NO: 172545 - DNA, 25 bp, Mus musculus
agcccagaaggcacaggtgccaatt

SEQ ID NO: 172546 - DNA, 25 bp, Mus musculus
agcccagaaggctcaggtgccaatt

SEQ ID NO: 172547 - DNA, 25 bp, Mus musculus
agcccagacaacaggctcagtgtat

SEQ ID NO: 172548 - DNA, 25 bp, Mus musculus
agcccagacaactggctcagtgtat

SEQ ID NO: 172549 - DNA, 25 bp, Mus musculus
agcccagacatgcagggctggcctt

SEQ ID NO: 172550 - DNA, 25 bp, Mus musculus
agcccagacatggagggctggcctt

SEQ ID NO: 172551 - DNA, 25 bp, Mus musculus
agcccagacccgaagcagttcagtt

SEQ ID NO: 172552 - DNA, 25 bp, Mus musculus
agcccagacccgtagcagttcagtt

SEQ ID NO: 172553 - DNA, 25 bp, Mus musculus
agcccagacgtgaagccatgtgcat

SEQ ID NO: 172554 - DNA, 25 bp, Mus musculus
agcccagacgtgtagccatgtgcat

SEQ ID NO: 172555 - DNA, 25 bp, Mus musculus
agcccagactttaggcatttcaccc

SEQ ID NO: 172556 - DNA, 25 bp, Mus musculus
agcccagacttttggcatttcaccc

SEQ ID NO: 172557 - DNA, 25 bp, Mus musculus
agcccagagactctcgcaggatgca

SEQ ID NO: 172558 - DNA, 25 bp, Mus musculus
agcccagagactgtcgcaggatgca

SEQ ID NO: 172559 - DNA, 25 bp, Mus musculus
agcccagagagaaaactgtatttat

SEQ ID NO: 172560 - DNA, 25 bp, Mus musculus
agcccagagagataactgtatttat

SEQ ID NO: 172561 - DNA, 25 bp, Mus musculus
agcccagagcatactcctgtgaaac

SEQ ID NO: 172562 - DNA, 25 bp, Mus musculus
agcccagagcattctcctgtgaaac

SEQ ID NO: 172563 - DNA, 25 bp, Mus musculus
agcccagagctgagaccgagtgctg

SEQ ID NO: 172564 - DNA, 25 bp, Mus musculus
agcccagagctgtgaccgagtgctg

SEQ ID NO: 172565 - DNA, 25 bp, Mus musculus
agcccagaggaacagctcgtaacaa

SEQ ID NO: 172566 - DNA, 25 bp, Mus musculus
agcccagaggaagagctcgtaacaa

SEQ ID NO: 172567 - DNA, 25 bp, Mus musculus
agcccagagggacggaccctgttct

SEQ ID NO: 172568 - DNA, 25 bp, Mus musculus
agcccagagggagggaccctgttct

SEQ ID NO: 172569 - DNA, 25 bp, Mus musculus
agcccagagtatcccacctgctgta

SEQ ID NO: 172570 - DNA, 25 bp, Mus musculus
agcccagagtatgccacctgctgta

SEQ ID NO: 172571 - DNA, 25 bp, Mus musculus
agcccagagtgcagggtctaagtca

SEQ ID NO: 172572 - DNA, 25 bp, Mus musculus
agcccagagtgctgggtctaagtca

SEQ ID NO: 172573 - DNA, 25 bp, Mus musculus
agcccagatgttcgctggtccagtg

SEQ ID NO: 172574 - DNA, 25 bp, Mus musculus
agcccagatgttggctggtccagtg

SEQ ID NO: 172575 - DNA, 25 bp, Mus musculus
agcccagcaagaaagcctccaaggg

SEQ ID NO: 172576 - DNA, 25 bp, Mus musculus
agcccagcaagatagcctccaaggg

SEQ ID NO: 172577 - DNA, 25 bp, Mus musculus
agcccagcaagcagctagggatgct

SEQ ID NO: 172578 - DNA, 25 bp, Mus musculus
agcccagcaagctgctagggatgct

SEQ ID NO: 172579 - DNA, 25 bp, Mus musculus
agcccagcagccacgaatctgtaaa

SEQ ID NO: 172580 - DNA, 25 bp, Mus musculus
agcccagcagcctcgaatctgtaaa

SEQ ID NO: 172581 - DNA, 25 bp, Mus musculus
agcccagcatccatttggtacataa

SEQ ID NO: 172582 - DNA, 25 bp, Mus musculus
agcccagcatccttttggtacataa

SEQ ID NO: 172583 - DNA, 25 bp, Mus musculus
agcccagcatttaggactcaagtgt

SEQ ID NO: 172584 - DNA, 25 bp, Mus musculus
agcccagcatttcgcaggctctttt

SEQ ID NO: 172585 - DNA, 25 bp, Mus musculus
agcccagcatttggcaggctctttt

SEQ ID NO: 172586 - DNA, 25 bp, Mus musculus
agcccagcattttggactcaagtgt

SEQ ID NO: 172587 - DNA, 25 bp, Mus musculus
agcccagccgcaaagagaacagtat

SEQ ID NO: 172588 - DNA, 25 bp, Mus musculus
agcccagccgcatagagaacagtat

SEQ ID NO: 172589 - DNA, 25 bp, Mus musculus
agcccagcctgaagtagagctctga

SEQ ID NO: 172590 - DNA, 25 bp, Mus musculus
agcccagcctgatgtagagctctga

SEQ ID NO: 172591 - DNA, 25 bp, Mus musculus
agcccagcctggacgaataccggcg

SEQ ID NO: 172592 - DNA, 25 bp, Mus musculus
agcccagcctggaggccgaactttt

SEQ ID NO: 172593 - DNA, 25 bp, Mus musculus
agcccagcctggtcgaataccggcg

SEQ ID NO: 172594 - DNA, 25 bp, Mus musculus
agcccagcctggtggccgaactttt

SEQ ID NO: 172595 - DNA, 25 bp, Mus musculus
agcccagcctgtagtgtagttctac

SEQ ID NO: 172596 - DNA, 25 bp, Mus musculus
agcccagcctgttgtgtagttctac

SEQ ID NO: 172597 - DNA, 25 bp, Mus musculus
agcccagcgaaccacgtggagagat

SEQ ID NO: 172598 - DNA, 25 bp, Mus musculus
agcccagcgaacgacgtggagagat

SEQ ID NO: 172599 - DNA, 25 bp, Mus musculus
agcccagcgaccagaggagcgcgaa

SEQ ID NO: 172600 - DNA, 25 bp, Mus musculus
agcccagcgaccatggcgtctttag

SEQ ID NO: 172601 - DNA, 25 bp, Mus musculus
agcccagcgacctgaggagcgcgaa

SEQ ID NO: 172602 - DNA, 25 bp, Mus musculus
agcccagcgaccttggcgtctttag

SEQ ID NO: 172603 - DNA, 25 bp, Mus musculus
agcccagcgctgcatagagcaactg

SEQ ID NO: 172604 - DNA, 25 bp, Mus musculus
agcccagcgctggatagagcaactg

SEQ ID NO: 172605 - DNA, 25 bp, Mus musculus
agcccagcggtccagtcaacatgga

SEQ ID NO: 172606 - DNA, 25 bp, Mus musculus
agcccagcggtcgagtcaacatgga

SEQ ID NO: 172607 - DNA, 25 bp, Mus musculus
agcccagcgtcaaggaggacgacat

SEQ ID NO: 172608 - DNA, 25 bp, Mus musculus
agcccagcgtcatggaggacgacat

SEQ ID NO: 172609 - DNA, 25 bp, Mus musculus
agcccagctgtgactactgtaatat

SEQ ID NO: 172610 - DNA, 25 bp, Mus musculus
agcccagctgtgtctactgtaatat

SEQ ID NO: 172611 - DNA, 25 bp, Mus musculus
agcccagcttacaggagcgtaggca

SEQ ID NO: 172612 - DNA, 25 bp, Mus musculus
agcccagcttactggagcgtaggca

SEQ ID NO: 172613 - DNA, 25 bp, Mus musculus
agcccaggaaagaacttggcatctt

SEQ ID NO: 172614 - DNA, 25 bp, Mus musculus
agcccaggaaagtacttggcatctt

SEQ ID NO: 172615 - DNA, 25 bp, Mus musculus
agcccaggacacaaagagcacccaa

SEQ ID NO: 172616 - DNA, 25 bp, Mus musculus
agcccaggacactaagagcacccaa

SEQ ID NO: 172617 - DNA, 25 bp, Mus musculus
agcccaggactcatgaatgacgact

SEQ ID NO: 172618 - DNA, 25 bp, Mus musculus
agcccaggactcttgaatgacgact

SEQ ID NO: 172619 - DNA, 25 bp, Mus musculus
agcccaggacttagccatcattgtg

SEQ ID NO: 172620 - DNA, 25 bp, Mus musculus
agcccaggactttgccatcattgtg

SEQ ID NO: 172621 - DNA, 25 bp, Mus musculus
agcccaggaggactacatcaagcgc

SEQ ID NO: 172622 - DNA, 25 bp, Mus musculus
agcccaggaggagtacatcaagcgc

SEQ ID NO: 172623 - DNA, 25 bp, Mus musculus
agcccaggcacgaggtccaaaggtg

SEQ ID NO: 172624 - DNA, 25 bp, Mus musculus
agcccaggcacgtggtccaaaggtg

SEQ ID NO: 172625 - DNA, 25 bp, Mus musculus
agcccaggcctgagaggagtacctc

SEQ ID NO: 172626 - DNA, 25 bp, Mus musculus
agcccaggcctgtgaggagtacctc

SEQ ID NO: 172627 - DNA, 25 bp, Mus musculus
agcccaggctaacccagtcagtgtt

SEQ ID NO: 172628 - DNA, 25 bp, Mus musculus
agcccaggctaagccagtcagtgtt

SEQ ID NO: 172629 - DNA, 25 bp, Mus musculus
agcccaggctacataacaacagaga

SEQ ID NO: 172630 - DNA, 25 bp, Mus musculus
agcccaggctacttaacaacagaga

SEQ ID NO: 172631 - DNA, 25 bp, Mus musculus
agcccaggctggagttagactccat

SEQ ID NO: 172632 - DNA, 25 bp, Mus musculus
agcccaggctggtgttagactccat

SEQ ID NO: 172633 - DNA, 25 bp, Mus musculus
agcccaggctgtactatgtccttat

SEQ ID NO: 172634 - DNA, 25 bp, Mus musculus
agcccaggctgtactcatcatgtag

SEQ ID NO: 172635 - DNA, 25 bp, Mus musculus
agcccaggctgtcgtttcagtcagg

SEQ ID NO: 172636 - DNA, 25 bp, Mus musculus
agcccaggctgtggtttcagtcagg

SEQ ID NO: 172637 - DNA, 25 bp, Mus musculus
agcccaggctgttctatgtccttat

SEQ ID NO: 172638 - DNA, 25 bp, Mus musculus
agcccaggctgttctcatcatgtag

SEQ ID NO: 172639 - DNA, 25 bp, Mus musculus
agcccaggcttactgtgaactcact

SEQ ID NO: 172640 - DNA, 25 bp, Mus musculus
agcccaggcttagtgtgaactcact

SEQ ID NO: 172641 - DNA, 25 bp, Mus musculus
agcccaggctttccagttctttgga

SEQ ID NO: 172642 - DNA, 25 bp, Mus musculus
agcccaggctttgcagttctttgga

SEQ ID NO: 172643 - DNA, 25 bp, Mus musculus
agcccagggagacgcttttgctgaa

SEQ ID NO: 172644 - DNA, 25 bp, Mus musculus
agcccagggagaggcttttgctgaa

SEQ ID NO: 172645 - DNA, 25 bp, Mus musculus
agcccagggcataggtagagccact

SEQ ID NO: 172646 - DNA, 25 bp, Mus musculus
agcccagggcatcaacctcttatgt

SEQ ID NO: 172647 - DNA, 25 bp, Mus musculus
agcccagggcatgaacctcttatgt

SEQ ID NO: 172648 - DNA, 25 bp, Mus musculus
agcccagggcattggtagagccact

SEQ ID NO: 172649 - DNA, 25 bp, Mus musculus
agcccagggcggaaaggcaccacca

SEQ ID NO: 172650 - DNA, 25 bp, Mus musculus
agcccagggcggtaaggcaccacca

SEQ ID NO: 172651 - DNA, 25 bp, Mus musculus
agcccagggctgactagatccggag

SEQ ID NO: 172652 - DNA, 25 bp, Mus musculus
agcccagggctgtctagatccggag

SEQ ID NO: 172653 - DNA, 25 bp, Mus musculus
agcccagggtagaagttggtccagt

SEQ ID NO: 172654 - DNA, 25 bp, Mus musculus
agcccagggtagtagttggtccagt

SEQ ID NO: 172655 - DNA, 25 bp, Mus musculus
agcccaggtcaaccattcgagtatc

SEQ ID NO: 172656 - DNA, 25 bp, Mus musculus
agcccaggtcaagcattcgagtatc

SEQ ID NO: 172657 - DNA, 25 bp, Mus musculus
agcccaggtcatcgtcacagccatg

SEQ ID NO: 172658 - DNA, 25 bp, Mus musculus
agcccaggtcatggtcacagccatg

SEQ ID NO: 172659 - DNA, 25 bp, Mus musculus
agcccaggtcgcagcaggagtgtaa

SEQ ID NO: 172660 - DNA, 25 bp, Mus musculus
agcccaggtcgctgcaggagtgtaa

SEQ ID NO: 172661 - DNA, 25 bp, Mus musculus
agcccaggttagaatatagcacatg

SEQ ID NO: 172662 - DNA, 25 bp, Mus musculus
agcccaggttagtatatagcacatg

SEQ ID NO: 172663 - DNA, 25 bp, Mus musculus
agcccaggttttcttcgatataccg

SEQ ID NO: 172664 - DNA, 25 bp, Mus musculus
agcccaggttttgttcgatataccg

SEQ ID NO: 172665 - DNA, 25 bp, Mus musculus
agcccagtaaagcagacttgccaag

SEQ ID NO: 172666 - DNA, 25 bp, Mus musculus
agcccagtaaaggagacttgccaag

SEQ ID NO: 172667 - DNA, 25 bp, Mus musculus
agcccagtaccgcaggctgctggaa

SEQ ID NO: 172668 - DNA, 25 bp, Mus musculus
agcccagtaccggaggctgctggaa

SEQ ID NO: 172669 - DNA, 25 bp, Mus musculus
agcccagtacttaagtcgagttaat

SEQ ID NO: 172670 - DNA, 25 bp, Mus musculus
agcccagtactttagtcgagttaat

SEQ ID NO: 172671 - DNA, 25 bp, Mus musculus
agcccagtccacatgtaacacatcg

SEQ ID NO: 172672 - DNA, 25 bp, Mus musculus
agcccagtccacttgtaacacatcg

SEQ ID NO: 172673 - DNA, 25 bp, Mus musculus
agcccagtccatattactgaagttg

SEQ ID NO: 172674 - DNA, 25 bp, Mus musculus
agcccagtccattttactgaagttg

SEQ ID NO: 172675 - DNA, 25 bp, Mus musculus
agcccagtccttaaacttatccgtg

SEQ ID NO: 172676 - DNA, 25 bp, Mus musculus
agcccagtcctttaacttatccgtg

SEQ ID NO: 172677 - DNA, 25 bp, Mus musculus
agcccagtctggacccgaagttatg

SEQ ID NO: 172678 - DNA, 25 bp, Mus musculus
agcccagtctggcttgtagtgccaa

SEQ ID NO: 172679 - DNA, 25 bp, Mus musculus
agcccagtctgggttgtagtgccaa

SEQ ID NO: 172680 - DNA, 25 bp, Mus musculus
agcccagtctggtcccgaagttatg

SEQ ID NO: 172681 - DNA, 25 bp, Mus musculus
agcccagtctttcttaggttccagc

SEQ ID NO: 172682 - DNA, 25 bp, Mus musculus
agcccagtctttgttaggttccagc

SEQ ID NO: 172683 - DNA, 25 bp, Mus musculus
agcccagtgaccctgagcaagaaca

SEQ ID NO: 172684 - DNA, 25 bp, Mus musculus
agcccagtgaccgtgagcaagaaca

SEQ ID NO: 172685 - DNA, 25 bp, Mus musculus
agcccagtgcatcctggtggctctg

SEQ ID NO: 172686 - DNA, 25 bp, Mus musculus
agcccagtgcatgctggtggctctg

SEQ ID NO: 172687 - DNA, 25 bp, Mus musculus
agcccagtgccgactactaattatg

SEQ ID NO: 172688 - DNA, 25 bp, Mus musculus
agcccagtgccgtctactaattatg

SEQ ID NO: 172689 - DNA, 25 bp, Mus musculus
agcccagtgcgcaatggtgtgtacc

SEQ ID NO: 172690 - DNA, 25 bp, Mus musculus
agcccagtgcgctatggtgtgtacc

SEQ ID NO: 172691 - DNA, 25 bp, Mus musculus
agcccagtggccatgtcagcaggac

SEQ ID NO: 172692 - DNA, 25 bp, Mus musculus
agcccagtggccttgtcagcaggac

SEQ ID NO: 172693 - DNA, 25 bp, Mus musculus
agcccagtggctagctgcagcttta

SEQ ID NO: 172694 - DNA, 25 bp, Mus musculus
agcccagtggcttgctgcagcttta

SEQ ID NO: 172695 - DNA, 25 bp, Mus musculus
agcccagtggtcctttcatttctat

SEQ ID NO: 172696 - DNA, 25 bp, Mus musculus
agcccagtggtcgtttcatttctat

SEQ ID NO: 172697 - DNA, 25 bp, Mus musculus
agcccagtggtgaagagccagccct

SEQ ID NO: 172698 - DNA, 25 bp, Mus musculus
agcccagtggtgtagagccagccct

SEQ ID NO: 172699 - DNA, 25 bp, Mus musculus
agcccagtgtatatattttccatta

SEQ ID NO: 172700 - DNA, 25 bp, Mus musculus
agcccagtgtatttattttccatta

SEQ ID NO: 172701 - DNA, 25 bp, Mus musculus
agcccagtgttaccaccaagaaggt

SEQ ID NO: 172702 - DNA, 25 bp, Mus musculus
agcccagtgttagcaccaagaaggt

SEQ ID NO: 172703 - DNA, 25 bp, Mus musculus
agcccagttaacatgtagagcatgg

SEQ ID NO: 172704 - DNA, 25 bp, Mus musculus
agcccagttaacttgtagagcatgg

SEQ ID NO: 172705 - DNA, 25 bp, Mus musculus
agcccagttctgcttttttctgagg

SEQ ID NO: 172706 - DNA, 25 bp, Mus musculus
agcccagttctggttttttctgagg

SEQ ID NO: 172707 - DNA, 25 bp, Mus musculus
agcccataaagtactctgtgccaag

SEQ ID NO: 172708 - DNA, 25 bp, Mus musculus
agcccataaagttctctgtgccaag

SEQ ID NO: 172709 - DNA, 25 bp, Mus musculus
agcccataagctctgatgtcgggcc

SEQ ID NO: 172710 - DNA, 25 bp, Mus musculus
agcccataagctgtgatgtcgggcc

SEQ ID NO: 172711 - DNA, 25 bp, Mus musculus
agcccataaggactgctcacttgga

SEQ ID NO: 172712 - DNA, 25 bp, Mus musculus
agcccataaggagtgctcacttgga

SEQ ID NO: 172713 - DNA, 25 bp, Mus musculus
agcccataagggatccatctgtctc

SEQ ID NO: 172714 - DNA, 25 bp, Mus musculus
agcccataagggatgtgctgcctgt

SEQ ID NO: 172715 - DNA, 25 bp, Mus musculus
agcccataagggttccatctgtctc

SEQ ID NO: 172716 - DNA, 25 bp, Mus musculus
agcccataagggttgtgctgcctgt

SEQ ID NO: 172717 - DNA, 25 bp, Mus musculus
agcccataatccaactgaagcactc

SEQ ID NO: 172718 - DNA, 25 bp, Mus musculus
agcccataatcctactgaagcactc

SEQ ID NO: 172719 - DNA, 25 bp, Mus musculus
agcccatagaacagcctgttaaaga

SEQ ID NO: 172720 - DNA, 25 bp, Mus musculus
agcccatagaactgcctgttaaaga

SEQ ID NO: 172721 - DNA, 25 bp, Mus musculus
agcccatagttaacatgactcctga

SEQ ID NO: 172722 - DNA, 25 bp, Mus musculus
agcccatagttatcatgactcctga

SEQ ID NO: 172723 - DNA, 25 bp, Mus musculus
agcccatatacactgcttggcatgc

SEQ ID NO: 172724 - DNA, 25 bp, Mus musculus
agcccatatacagtgcttggcatgc

SEQ ID NO: 172725 - DNA, 25 bp, Mus musculus
agcccatatctgaactttggtttat

SEQ ID NO: 172726 - DNA, 25 bp, Mus musculus
agcccatatctgtactttggtttat

SEQ ID NO: 172727 - DNA, 25 bp, Mus musculus
agcccatatgccactactcagtaag

SEQ ID NO: 172728 - DNA, 25 bp, Mus musculus
agcccatatgcctctactcagtaag

SEQ ID NO: 172729 - DNA, 25 bp, Mus musculus
agcccatcaaggagatctgcataaa

SEQ ID NO: 172730 - DNA, 25 bp, Mus musculus
agcccatcaaggtgatctgcataaa

SEQ ID NO: 172731 - DNA, 25 bp, Mus musculus
agcccatcaccaacttccaggagcg

SEQ ID NO: 172732 - DNA, 25 bp, Mus musculus
agcccatcaccatcttccaggagcg

SEQ ID NO: 172733 - DNA, 25 bp, Mus musculus
agcccatcagaacgtaccaccgata

SEQ ID NO: 172734 - DNA, 25 bp, Mus musculus
agcccatcagaaggtaccaccgata

SEQ ID NO: 172735 - DNA, 25 bp, Mus musculus
agcccatcagcacggaaactacagc

SEQ ID NO: 172736 - DNA, 25 bp, Mus musculus
agcccatcagcagggaaactacagc

SEQ ID NO: 172737 - DNA, 25 bp, Mus musculus
agcccatcaggcaaagatttctatg

SEQ ID NO: 172738 - DNA, 25 bp, Mus musculus
agcccatcaggctaagatttctatg

SEQ ID NO: 172739 - DNA, 25 bp, Mus musculus
agcccatcaggtcggatcagcatct

SEQ ID NO: 172740 - DNA, 25 bp, Mus musculus
agcccatcaggtgggatcagcatct

SEQ ID NO: 172741 - DNA, 25 bp, Mus musculus
agcccatcatctcagtgtgtccgag

SEQ ID NO: 172742 - DNA, 25 bp, Mus musculus
agcccatcatctgagtgtgtccgag

SEQ ID NO: 172743 - DNA, 25 bp, Mus musculus
agcccatccaacaagagctggctag

SEQ ID NO: 172744 - DNA, 25 bp, Mus musculus
agcccatccaactagagctggctag

SEQ ID NO: 172745 - DNA, 25 bp, Mus musculus
agcccatccccaattgggctgtgac

SEQ ID NO: 172746 - DNA, 25 bp, Mus musculus
agcccatccccatttgggctgtgac

SEQ ID NO: 172747 - DNA, 25 bp, Mus musculus
agcccatcccccaaaatctataatt

SEQ ID NO: 172748 - DNA, 25 bp, Mus musculus
agcccatccccctaaatctataatt

SEQ ID NO: 172749 - DNA, 25 bp, Mus musculus
agcccatcgagaacctgtgaagcag

SEQ ID NO: 172750 - DNA, 25 bp, Mus musculus
agcccatcgagatcctgtgaagcag

SEQ ID NO: 172751 - DNA, 25 bp, Mus musculus
agcccatctaccataacactaattt

SEQ ID NO: 172752 - DNA, 25 bp, Mus musculus
agcccatctaccttaacactaattt

SEQ ID NO: 172753 - DNA, 25 bp, Mus musculus
agcccatctcggcataatggtgtgt

SEQ ID NO: 172754 - DNA, 25 bp, Mus musculus
agcccatctcgggataatggtgtgt

SEQ ID NO: 172755 - DNA, 25 bp, Mus musculus
agcccatctctccagataagcttgt

SEQ ID NO: 172756 - DNA, 25 bp, Mus musculus
agcccatctctcgagataagcttgt

SEQ ID NO: 172757 - DNA, 25 bp, Mus musculus
agcccatctgctcacataggaacta

SEQ ID NO: 172758 - DNA, 25 bp, Mus musculus
agcccatctgctgacataggaacta

SEQ ID NO: 172759 - DNA, 25 bp, Mus musculus
agcccatctggcagtgtgacgtcag

SEQ ID NO: 172760 - DNA, 25 bp, Mus musculus
agcccatctggctgtgtgacgtcag

SEQ ID NO: 172761 - DNA, 25 bp, Mus musculus
agcccatcttcaccactttttatat

SEQ ID NO: 172762 - DNA, 25 bp, Mus musculus
agcccatcttcagcactttttatat

SEQ ID NO: 172763 - DNA, 25 bp, Mus musculus
agcccatcttccagcaattgacaga

SEQ ID NO: 172764 - DNA, 25 bp, Mus musculus
agcccatcttcctgcaattgacaga

SEQ ID NO: 172765 - DNA, 25 bp, Mus musculus
agcccatctttgatgacatgctgca

SEQ ID NO: 172766 - DNA, 25 bp, Mus musculus
agcccatctttgttgacatgctgca

SEQ ID NO: 172767 - DNA, 25 bp, Mus musculus
agcccatgagtgactgactgctcta

SEQ ID NO: 172768 - DNA, 25 bp, Mus musculus
agcccatgagtgtctgactgctcta

SEQ ID NO: 172769 - DNA, 25 bp, Mus musculus
agcccatgatgcaggatctcttgtt

SEQ ID NO: 172770 - DNA, 25 bp, Mus musculus
agcccatgatgctggatctcttgtt

SEQ ID NO: 172771 - DNA, 25 bp, Mus musculus
agcccatgcagcagacactggttgg

SEQ ID NO: 172772 - DNA, 25 bp, Mus musculus
agcccatgcagcagatcattgtaaa

SEQ ID NO: 172773 - DNA, 25 bp, Mus musculus
agcccatgcagctgacactggttgg

SEQ ID NO: 172774 - DNA, 25 bp, Mus musculus
agcccatgcagctgatcattgtaaa

SEQ ID NO: 172775 - DNA, 25 bp, Mus musculus
agcccatgcatgactacactgttaa

SEQ ID NO: 172776 - DNA, 25 bp, Mus musculus
agcccatgcatgtctacactgttaa

SEQ ID NO: 172777 - DNA, 25 bp, Mus musculus
agcccatgccccatttacttaatct

SEQ ID NO: 172778 - DNA, 25 bp, Mus musculus
agcccatgccccttttacttaatct

SEQ ID NO: 172779 - DNA, 25 bp, Mus musculus
agcccatgcgccctgggacttgaga

SEQ ID NO: 172780 - DNA, 25 bp, Mus musculus
agcccatgcgccgtgggacttgaga

SEQ ID NO: 172781 - DNA, 25 bp, Mus musculus
agcccatgcgcgactgtggcaggtt

SEQ ID NO: 172782 - DNA, 25 bp, Mus musculus
agcccatgcgcgtctgtggcaggtt

SEQ ID NO: 172783 - DNA, 25 bp, Mus musculus
agcccatgctaaaacctttaatccc

SEQ ID NO: 172784 - DNA, 25 bp, Mus musculus
agcccatgctaatacctttaatccc

SEQ ID NO: 172785 - DNA, 25 bp, Mus musculus
agcccatgctggaatttttctgtga

SEQ ID NO: 172786 - DNA, 25 bp, Mus musculus
agcccatgctggtatttttctgtga

SEQ ID NO: 172787 - DNA, 25 bp, Mus musculus
agcccatggaagctggcaagttctg

SEQ ID NO: 172788 - DNA, 25 bp, Mus musculus
agcccatggaaggtggcaagttctg

SEQ ID NO: 172789 - DNA, 25 bp, Mus musculus
agcccatggaggaaggcccagcaat

SEQ ID NO: 172790 - DNA, 25 bp, Mus musculus
agcccatggaggtaggcccagcaat

SEQ ID NO: 172791 - DNA, 25 bp, Mus musculus
agcccatggcccctggagtctttct

SEQ ID NO: 172792 - DNA, 25 bp, Mus musculus
agcccatggcccgtggagtctttct

SEQ ID NO: 172793 - DNA, 25 bp, Mus musculus
agcccatggcttcaataaacgtttt

SEQ ID NO: 172794 - DNA, 25 bp, Mus musculus
agcccatggcttgaataaacgtttt

SEQ ID NO: 172795 - DNA, 25 bp, Mus musculus
agcccatgggctctataactagaca

SEQ ID NO: 172796 - DNA, 25 bp, Mus musculus
agcccatgggctgtataactagaca

SEQ ID NO: 172797 - DNA, 25 bp, Mus musculus
agcccatgtaaccagcaccggaaag

SEQ ID NO: 172798 - DNA, 25 bp, Mus musculus
agcccatgtaacgagcaccggaaag

SEQ ID NO: 172799 - DNA, 25 bp, Mus musculus
agcccatgtaagcaggacccagtct

SEQ ID NO: 172800 - DNA, 25 bp, Mus musculus
agcccatgtaaggaggacccagtct

SEQ ID NO: 172801 - DNA, 25 bp, Mus musculus
agcccatgtggcaaaagaacaatgc

SEQ ID NO: 172802 - DNA, 25 bp, Mus musculus
agcccatgtggctaaagaacaatgc

SEQ ID NO: 172803 - DNA, 25 bp, Mus musculus
agcccatgtgtgagcctcagtaaga

SEQ ID NO: 172804 - DNA, 25 bp, Mus musculus
agcccatgtgtgtgcctcagtaaga

SEQ ID NO: 172805 - DNA, 25 bp, Mus musculus
agcccatgttccataacagtcctcg

SEQ ID NO: 172806 - DNA, 25 bp, Mus musculus
agcccatgttccttaacagtcctcg

SEQ ID NO: 172807 - DNA, 25 bp, Mus musculus
agcccatgtttgattctcactaaca

SEQ ID NO: 172808 - DNA, 25 bp, Mus musculus
agcccatgtttgtttctcactaaca

SEQ ID NO: 172809 - DNA, 25 bp, Mus musculus
agcccatgttttcctgcagccttat

SEQ ID NO: 172810 - DNA, 25 bp, Mus musculus
agcccatgttttgctgcagccttat

SEQ ID NO: 172811 - DNA, 25 bp, Mus musculus
agcccattagtgagtactggtcaga

SEQ ID NO: 172812 - DNA, 25 bp, Mus musculus
agcccattagtgtgtactggtcaga

SEQ ID NO: 172813 - DNA, 25 bp, Mus musculus
agcccattcagtagccgagtcttgt

SEQ ID NO: 172814 - DNA, 25 bp, Mus musculus
agcccattcagttgccgagtcttgt

SEQ ID NO: 172815 - DNA, 25 bp, Mus musculus
agcccattctccaattctcaaggga

SEQ ID NO: 172816 - DNA, 25 bp, Mus musculus
agcccattctcctattctcaaggga

SEQ ID NO: 172817 - DNA, 25 bp, Mus musculus
agcccattctctcccttagtgtaac

SEQ ID NO: 172818 - DNA, 25 bp, Mus musculus
agcccattctctgccttagtgtaac

SEQ ID NO: 172819 - DNA, 25 bp, Mus musculus
agcccattctttagcattccttttg

SEQ ID NO: 172820 - DNA, 25 bp, Mus musculus
agcccattcttttgcattccttttg

SEQ ID NO: 172821 - DNA, 25 bp, Mus musculus
agcccattgatgagtattgtgtgca

SEQ ID NO: 172822 - DNA, 25 bp, Mus musculus
agcccattgatgtgtattgtgtgca

SEQ ID NO: 172823 - DNA, 25 bp, Mus musculus
agcccattggcactgagactctaga

SEQ ID NO: 172824 - DNA, 25 bp, Mus musculus
agcccattggcagtgagactctaga

SEQ ID NO: 172825 - DNA, 25 bp, Mus musculus
agcccattgtgacatagggaccaag

SEQ ID NO: 172826 - DNA, 25 bp, Mus musculus
agcccattgtgagatagggaccaag

SEQ ID NO: 172827 - DNA, 25 bp, Mus musculus
agcccatttctgaatttgaggttag

SEQ ID NO: 172828 - DNA, 25 bp, Mus musculus
agcccatttctgtatttgaggttag

SEQ ID NO: 172829 - DNA, 25 bp, Mus musculus
agcccatttcttcttagatacctga

SEQ ID NO: 172830 - DNA, 25 bp, Mus musculus
agcccatttcttgttagatacctga

SEQ ID NO: 172831 - DNA, 25 bp, Mus musculus
agcccatttgctattccttggccag

SEQ ID NO: 172832 - DNA, 25 bp, Mus musculus
agcccatttgcttttccttggccag

SEQ ID NO: 172833 - DNA, 25 bp, Mus musculus
agcccatttgggactgagggttcca

SEQ ID NO: 172834 - DNA, 25 bp, Mus musculus
agcccatttgggtctgagggttcca

SEQ ID NO: 172835 - DNA, 25 bp, Mus musculus
agcccatttttaagactttctgcag

SEQ ID NO: 172836 - DNA, 25 bp, Mus musculus
agcccatttttatgactttctgcag

SEQ ID NO: 172837 - DNA, 25 bp, Mus musculus
agccccaaacttagtttacactgct

SEQ ID NO: 172838 - DNA, 25 bp, Mus musculus
agccccaaactttgtttacactgct

SEQ ID NO: 172839 - DNA, 25 bp, Mus musculus
agccccaaaggcacgggatttcaga

SEQ ID NO: 172840 - DNA, 25 bp, Mus musculus
agccccaaaggctcgggatttcaga

SEQ ID NO: 172841 - DNA, 25 bp, Mus musculus
agccccaacaagcagatgacatcac

SEQ ID NO: 172842 - DNA, 25 bp, Mus musculus
agccccaacaaggagatgacatcac

SEQ ID NO: 172843 - DNA, 25 bp, Mus musculus
agccccaacctgattgtccagaatg

SEQ ID NO: 172844 - DNA, 25 bp, Mus musculus
agccccaacctgtttgtccagaatg

SEQ ID NO: 172845 - DNA, 25 bp, Mus musculus
agccccaagattacatagcttcact

SEQ ID NO: 172846 - DNA, 25 bp, Mus musculus
agccccaagatttcatagcttcact

SEQ ID NO: 172847 - DNA, 25 bp, Mus musculus
agccccaagcacaagagcgagcaga

SEQ ID NO: 172848 - DNA, 25 bp, Mus musculus
agccccaagcactagagcgagcaga

SEQ ID NO: 172849 - DNA, 25 bp, Mus musculus
agccccaagctaactaacattctat

SEQ ID NO: 172850 - DNA, 25 bp, Mus musculus
agccccaagctatctaacattctat

SEQ ID NO: 172851 - DNA, 25 bp, Mus musculus
agccccaagtacaattgctcctttt

SEQ ID NO: 172852 - DNA, 25 bp, Mus musculus
agccccaagtactattgctcctttt

SEQ ID NO: 172853 - DNA, 25 bp, Mus musculus
agccccaatggcataggttgaggtt

SEQ ID NO: 172854 - DNA, 25 bp, Mus musculus
agccccaatggcctattctgtcaga

SEQ ID NO: 172855 - DNA, 25 bp, Mus musculus
agccccaatggcgtattctgtcaga

SEQ ID NO: 172856 - DNA, 25 bp, Mus musculus
agccccaatggcttaggttgaggtt

SEQ ID NO: 172857 - DNA, 25 bp, Mus musculus
agccccaatgtgagcctttattagg

SEQ ID NO: 172858 - DNA, 25 bp, Mus musculus
agccccaatgtgtgcctttattagg

SEQ ID NO: 172859 - DNA, 25 bp, Mus musculus
agccccacaattcgtcttgtgtaac

SEQ ID NO: 172860 - DNA, 25 bp, Mus musculus
agccccacaattggtcttgtgtaac

SEQ ID NO: 172861 - DNA, 25 bp, Mus musculus
agccccacacaaactacagacgatg

SEQ ID NO: 172862 - DNA, 25 bp, Mus musculus
agccccacacaatctacagacgatg

SEQ ID NO: 172863 - DNA, 25 bp, Mus musculus
agccccacaggaaatttctccaggg

SEQ ID NO: 172864 - DNA, 25 bp, Mus musculus
agccccacaggatatttctccaggg

SEQ ID NO: 172865 - DNA, 25 bp, Mus musculus
agccccacatccagggagaaacgaa

SEQ ID NO: 172866 - DNA, 25 bp, Mus musculus
agccccacatcctgggagaaacgaa

SEQ ID NO: 172867 - DNA, 25 bp, Mus musculus
agccccacatggaaagctctaagaa

SEQ ID NO: 172868 - DNA, 25 bp, Mus musculus
agccccacatggtaagctctaagaa

SEQ ID NO: 172869 - DNA, 25 bp, Mus musculus
agccccacctgacttggatgcagct

SEQ ID NO: 172870 - DNA, 25 bp, Mus musculus
agccccacctgagttggatgcagct

SEQ ID NO: 172871 - DNA, 25 bp, Mus musculus
agccccacctgccatggaaggcaaa

SEQ ID NO: 172872 - DNA, 25 bp, Mus musculus
agccccacctgcgatggaaggcaaa

SEQ ID NO: 172873 - DNA, 25 bp, Mus musculus
agccccactggaattgaccaattgt

SEQ ID NO: 172874 - DNA, 25 bp, Mus musculus
agccccactggatttgaccaattgt

SEQ ID NO: 172875 - DNA, 25 bp, Mus musculus
agccccactggcctatgaatggtct

SEQ ID NO: 172876 - DNA, 25 bp, Mus musculus
agccccactggcgtatgaatggtct

SEQ ID NO: 172877 - DNA, 25 bp, Mus musculus
agccccagaaatcgtgctacttata

SEQ ID NO: 172878 - DNA, 25 bp, Mus musculus
agccccagaaatggtgctacttata

SEQ ID NO: 172879 - DNA, 25 bp, Mus musculus
agccccagaatcattcaagaccttg

SEQ ID NO: 172880 - DNA, 25 bp, Mus musculus
agccccagaatctttcaagaccttg

SEQ ID NO: 172881 - DNA, 25 bp, Mus musculus
agccccagaggcacgcccacttcta

SEQ ID NO: 172882 - DNA, 25 bp, Mus musculus
agccccagaggctcgcccacttcta

SEQ ID NO: 172883 - DNA, 25 bp, Mus musculus
agccccagaggtcgttatctatcag

SEQ ID NO: 172884 - DNA, 25 bp, Mus musculus
agccccagaggtggttatctatcag

SEQ ID NO: 172885 - DNA, 25 bp, Mus musculus
agccccagatgacatttccagtgaa

SEQ ID NO: 172886 - DNA, 25 bp, Mus musculus
agccccagatgagatttccagtgaa

SEQ ID NO: 172887 - DNA, 25 bp, Mus musculus
agccccagccagcttactgggttag

SEQ ID NO: 172888 - DNA, 25 bp, Mus musculus
agccccagccaggttactgggttag

SEQ ID NO: 172889 - DNA, 25 bp, Mus musculus
agccccagcgctatgggcgtctgct

SEQ ID NO: 172890 - DNA, 25 bp, Mus musculus
agccccagcgctttgggcgtctgct

SEQ ID NO: 172891 - DNA, 25 bp, Mus musculus
agccccagcttccatagcatagata

SEQ ID NO: 172892 - DNA, 25 bp, Mus musculus
agccccagcttcgatagcatagata

SEQ ID NO: 172893 - DNA, 25 bp, Mus musculus
agccccagcttgactttgtgttcag

SEQ ID NO: 172894 - DNA, 25 bp, Mus musculus
agccccagcttgcttaagcagtgta

SEQ ID NO: 172895 - DNA, 25 bp, Mus musculus
agccccagcttggttaagcagtgta

SEQ ID NO: 172896 - DNA, 25 bp, Mus musculus
agccccagcttgtctttgtgttcag

SEQ ID NO: 172897 - DNA, 25 bp, Mus musculus
agccccaggaacacttttgtctcta

SEQ ID NO: 172898 - DNA, 25 bp, Mus musculus
agccccaggaactcttttgtctcta

SEQ ID NO: 172899 - DNA, 25 bp, Mus musculus
agccccaggaagaattgtctccaag

SEQ ID NO: 172900 - DNA, 25 bp, Mus musculus
agccccaggaagtattgtctccaag

SEQ ID NO: 172901 - DNA, 25 bp, Mus musculus
agccccaggactctagaggcaaaag

SEQ ID NO: 172902 - DNA, 25 bp, Mus musculus
agccccaggactgtagaggcaaaag

SEQ ID NO: 172903 - DNA, 25 bp, Mus musculus
agccccaggaggagtgtgttcagaa

SEQ ID NO: 172904 - DNA, 25 bp, Mus musculus
agccccaggaggtgtgtgttcagaa

SEQ ID NO: 172905 - DNA, 25 bp, Mus musculus
agccccaggcatctatcctctattg

SEQ ID NO: 172906 - DNA, 25 bp, Mus musculus
agccccaggcatgtatcctctattg

SEQ ID NO: 172907 - DNA, 25 bp, Mus musculus
agccccagggaccaatgtcctatta

SEQ ID NO: 172908 - DNA, 25 bp, Mus musculus
agccccagggacgaatgtcctatta

SEQ ID NO: 172909 - DNA, 25 bp, Mus musculus
agccccagggtaactgtgttcacat

SEQ ID NO: 172910 - DNA, 25 bp, Mus musculus
agccccagggtatctgtgttcacat

SEQ ID NO: 172911 - DNA, 25 bp, Mus musculus
agccccagggtcagtgctttaggga

SEQ ID NO: 172912 - DNA, 25 bp, Mus musculus
agccccagggtctgtgctttaggga

SEQ ID NO: 172913 - DNA, 25 bp, Mus musculus
agccccaggttgcaactgacatcca

SEQ ID NO: 172914 - DNA, 25 bp, Mus musculus
agccccaggttggaactgacatcca

SEQ ID NO: 172915 - DNA, 25 bp, Mus musculus
agccccagtaaaccaaatgatttat

SEQ ID NO: 172916 - DNA, 25 bp, Mus musculus
agccccagtaaagcaaatgatttat

SEQ ID NO: 172917 - DNA, 25 bp, Mus musculus
agccccagtgacattcagtgttgga

SEQ ID NO: 172918 - DNA, 25 bp, Mus musculus
agccccagtgactttcagtgttgga

SEQ ID NO: 172919 - DNA, 25 bp, Mus musculus
agccccagttgaccactttctaaat

SEQ ID NO: 172920 - DNA, 25 bp, Mus musculus
agccccagttgagcactttctaaat

SEQ ID NO: 172921 - DNA, 25 bp, Mus musculus
agccccatcacacgctatgacattg

SEQ ID NO: 172922 - DNA, 25 bp, Mus musculus
agccccatcacaggctatgacattg

SEQ ID NO: 172923 - DNA, 25 bp, Mus musculus
agccccatcggtcagcctggagtga

SEQ ID NO: 172924 - DNA, 25 bp, Mus musculus
agccccatcggtgagcctggagtga

SEQ ID NO: 172925 - DNA, 25 bp, Mus musculus
agccccatctctcctggagagtaga

SEQ ID NO: 172926 - DNA, 25 bp, Mus musculus
agccccatctctgctggagagtaga

SEQ ID NO: 172927 - DNA, 25 bp, Mus musculus
agccccatgactatgcaagaaacag

SEQ ID NO: 172928 - DNA, 25 bp, Mus musculus
agccccatgactttgcaagaaacag

SEQ ID NO: 172929 - DNA, 25 bp, Mus musculus
agccccatgcccctgtttggaaatg

SEQ ID NO: 172930 - DNA, 25 bp, Mus musculus
agccccatgcccgtgtttggaaatg

SEQ ID NO: 172931 - DNA, 25 bp, Mus musculus
agccccatgcggaagacctgcagaa

SEQ ID NO: 172932 - DNA, 25 bp, Mus musculus
agccccatgcggtagacctgcagaa

SEQ ID NO: 172933 - DNA, 25 bp, Mus musculus
agccccatgtaaatgtgagcaccac

SEQ ID NO: 172934 - DNA, 25 bp, Mus musculus
agccccatgtaattgtgagcaccac

SEQ ID NO: 172935 - DNA, 25 bp, Mus musculus
agccccattccccatgggagggaag

SEQ ID NO: 172936 - DNA, 25 bp, Mus musculus
agccccattcccgatgggagggaag

SEQ ID NO: 172937 - DNA, 25 bp, Mus musculus
agccccattggtcgtataaagggat

SEQ ID NO: 172938 - DNA, 25 bp, Mus musculus
agccccattggtggtataaagggat

SEQ ID NO: 172939 - DNA, 25 bp, Mus musculus
agccccatttgcacagattttcagt

SEQ ID NO: 172940 - DNA, 25 bp, Mus musculus
agccccatttgctcagattttcagt

SEQ ID NO: 172941 - DNA, 25 bp, Mus musculus
agccccatttggatctcaataaagt

SEQ ID NO: 172942 - DNA, 25 bp, Mus musculus
agccccatttggttctcaataaagt

SEQ ID NO: 172943 - DNA, 25 bp, Mus musculus
agccccatttttctagcggtcactg

SEQ ID NO: 172944 - DNA, 25 bp, Mus musculus
agccccatttttgtagcggtcactg

SEQ ID NO: 172945 - DNA, 25 bp, Mus musculus
agcccccaagatcagttttcttctt

SEQ ID NO: 172946 - DNA, 25 bp, Mus musculus
agcccccaagatgagttttcttctt

SEQ ID NO: 172947 - DNA, 25 bp, Mus musculus
agcccccactgtatacatcctttta

SEQ ID NO: 172948 - DNA, 25 bp, Mus musculus
agcccccactgtttacatcctttta

SEQ ID NO: 172949 - DNA, 25 bp, Mus musculus
agcccccatcttaagtctttcctga

SEQ ID NO: 172950 - DNA, 25 bp, Mus musculus
agcccccatctttagtctttcctga

SEQ ID NO: 172951 - DNA, 25 bp, Mus musculus
agccccgacagcaatgctgtgtctg

SEQ ID NO: 172952 - DNA, 25 bp, Mus musculus
agccccgacagctatgctgtgtctg

SEQ ID NO: 172953 - DNA, 25 bp, Mus musculus
agccccgacaggaaggcagcgagaa

SEQ ID NO: 172954 - DNA, 25 bp, Mus musculus
agccccgacaggtaggcagcgagaa

SEQ ID NO: 172955 - DNA, 25 bp, Mus musculus
agccccgactgtacgagtgctccag

SEQ ID NO: 172956 - DNA, 25 bp, Mus musculus
agccccgactgttcgagtgctccag

SEQ ID NO: 172957 - DNA, 25 bp, Mus musculus
agccccgactttacagtcttcatga

SEQ ID NO: 172958 - DNA, 25 bp, Mus musculus
agccccgacttttcagtcttcatga

SEQ ID NO: 172959 - DNA, 25 bp, Mus musculus
agccccgagaaccagccaagttcaa

SEQ ID NO: 172960 - DNA, 25 bp, Mus musculus
agccccgagaacgagccaagttcaa

SEQ ID NO: 172961 - DNA, 25 bp, Mus musculus
agccccgagcctctggaagtactgg

SEQ ID NO: 172962 - DNA, 25 bp, Mus musculus
agccccgagcctgtggaagtactgg

SEQ ID NO: 172963 - DNA, 25 bp, Mus musculus
agccccgagctgagctgcctttggg

SEQ ID NO: 172964 - DNA, 25 bp, Mus musculus
agccccgagctgtgctgcctttggg

SEQ ID NO: 172965 - DNA, 25 bp, Mus musculus
agccccgaggatcgactacaggaca

SEQ ID NO: 172966 - DNA, 25 bp, Mus musculus
agccccgaggatggactacaggaca

SEQ ID NO: 172967 - DNA, 25 bp, Mus musculus
agccccgcaagtagacagctgtgtg

SEQ ID NO: 172968 - DNA, 25 bp, Mus musculus
agccccgcaagttgacagctgtgtg

SEQ ID NO: 172969 - DNA, 25 bp, Mus musculus
agccccgccctcagtgggtgtggac

SEQ ID NO: 172970 - DNA, 25 bp, Mus musculus
agccccgccctctgtgggtgtggac

SEQ ID NO: 172971 - DNA, 25 bp, Mus musculus
agccccgctaggaaaccctgctagg

SEQ ID NO: 172972 - DNA, 25 bp, Mus musculus
agccccgctaggtaaccctgctagg

SEQ ID NO: 172973 - DNA, 25 bp, Mus musculus
agccccgctcccagatgtaaagaac

SEQ ID NO: 172974 - DNA, 25 bp, Mus musculus
agccccgctccctgatgtaaagaac

SEQ ID NO: 172975 - DNA, 25 bp, Mus musculus
agccccgctgtcatccaagtattat

SEQ ID NO: 172976 - DNA, 25 bp, Mus musculus
agccccgctgtcttccaagtattat

SEQ ID NO: 172977 - DNA, 25 bp, Mus musculus
agccccggagtgaaattgccttgtt

SEQ ID NO: 172978 - DNA, 25 bp, Mus musculus
agccccggagtgtaattgccttgtt

SEQ ID NO: 172979 - DNA, 25 bp, Mus musculus
agccccggctaacagctgcatcatg

SEQ ID NO: 172980 - DNA, 25 bp, Mus musculus
agccccggctaagagctgcatcatg

SEQ ID NO: 172981 - DNA, 25 bp, Mus musculus
agccccggctgtatctacatgaaaa

SEQ ID NO: 172982 - DNA, 25 bp, Mus musculus
agccccggctgtcaagtggaccaag

SEQ ID NO: 172983 - DNA, 25 bp, Mus musculus
agccccggctgtgaagtggaccaag

SEQ ID NO: 172984 - DNA, 25 bp, Mus musculus
agccccggctgtttctacatgaaaa

SEQ ID NO: 172985 - DNA, 25 bp, Mus musculus
agccccggtgcactgtttcttgtga

SEQ ID NO: 172986 - DNA, 25 bp, Mus musculus
agccccggtgcagtgtttcttgtga

SEQ ID NO: 172987 - DNA, 25 bp, Mus musculus
agccccggttgcagacatgctgcac

SEQ ID NO: 172988 - DNA, 25 bp, Mus musculus
agccccggttgctgacatgctgcac

SEQ ID NO: 172989 - DNA, 25 bp, Mus musculus
agccccgttccaattgatttatgtc

SEQ ID NO: 172990 - DNA, 25 bp, Mus musculus
agccccgttccatttgatttatgtc

SEQ ID NO: 172991 - DNA, 25 bp, Mus musculus
agccccgttcttctgaatgttgtgt

SEQ ID NO: 172992 - DNA, 25 bp, Mus musculus
agccccgttcttgtgaatgttgtgt

SEQ ID NO: 172993 - DNA, 25 bp, Mus musculus
agccccgtttctaggatcgtaagcg

SEQ ID NO: 172994 - DNA, 25 bp, Mus musculus
agccccgtttcttggatcgtaagcg

SEQ ID NO: 172995 - DNA, 25 bp, Mus musculus
agcccctaccagaatgtctgcgatt

SEQ ID NO: 172996 - DNA, 25 bp, Mus musculus
agcccctaccagtatgtctgcgatt

SEQ ID NO: 172997 - DNA, 25 bp, Mus musculus
agcccctagaatcctttcttacaca

SEQ ID NO: 172998 - DNA, 25 bp, Mus musculus
agcccctagaatgctttcttacaca

SEQ ID NO: 172999 - DNA, 25 bp, Mus musculus
agcccctagacaaggccgcaggaag

SEQ ID NO: 173000 - DNA, 25 bp, Mus musculus
agcccctagacatggccgcaggaag

SEQ ID NO: 173001 - DNA, 25 bp, Mus musculus
agcccctatcagaaactctagacaa

SEQ ID NO: 173002 - DNA, 25 bp, Mus musculus
agcccctatcagtaactctagacaa

SEQ ID NO: 173003 - DNA, 25 bp, Mus musculus
agcccctatggaccacattttcatg

SEQ ID NO: 173004 - DNA, 25 bp, Mus musculus
agcccctatggagcacattttcatg

SEQ ID NO: 173005 - DNA, 25 bp, Mus musculus
agcccctatgtcaggtaccaagata

SEQ ID NO: 173006 - DNA, 25 bp, Mus musculus
agcccctatgtctggtaccaagata

SEQ ID NO: 173007 - DNA, 25 bp, Mus musculus
agcccctcaaacaacttaggtggca

SEQ ID NO: 173008 - DNA, 25 bp, Mus musculus
agcccctcaaactacttaggtggca

SEQ ID NO: 173009 - DNA, 25 bp, Mus musculus
agcccctcaaggaccgggaatatga

SEQ ID NO: 173010 - DNA, 25 bp, Mus musculus
agcccctcaaggtccgggaatatga

SEQ ID NO: 173011 - DNA, 25 bp, Mus musculus
agcccctcaccactgggatttcaaa

SEQ ID NO: 173012 - DNA, 25 bp, Mus musculus
agcccctcaccagtgggatttcaaa

SEQ ID NO: 173013 - DNA, 25 bp, Mus musculus
agcccctcataaacagaatctagtc

SEQ ID NO: 173014 - DNA, 25 bp, Mus musculus
agcccctcataatcagaatctagtc

SEQ ID NO: 173015 - DNA, 25 bp, Mus musculus
agcccctccatgcaaagaaagcgcc

SEQ ID NO: 173016 - DNA, 25 bp, Mus musculus
agcccctccatggaaagaaagcgcc

SEQ ID NO: 173017 - DNA, 25 bp, Mus musculus
agcccctccctcattggatagtgat

SEQ ID NO: 173018 - DNA, 25 bp, Mus musculus
agcccctccctctttggatagtgat

SEQ ID NO: 173019 - DNA, 25 bp, Mus musculus
agcccctcctgtacaatggaaggca

SEQ ID NO: 173020 - DNA, 25 bp, Mus musculus
agcccctcctgttcaatggaaggca

SEQ ID NO: 173021 - DNA, 25 bp, Mus musculus
agcccctcgcatagaggtagcgtaa

SEQ ID NO: 173022 - DNA, 25 bp, Mus musculus
agcccctcgcattgaggtagcgtaa

SEQ ID NO: 173023 - DNA, 25 bp, Mus musculus
agcccctcggaaacaggtctcatta

SEQ ID NO: 173024 - DNA, 25 bp, Mus musculus
agcccctcggaatcaggtctcatta

SEQ ID NO: 173025 - DNA, 25 bp, Mus musculus
agcccctctaacatgactacctaaa

SEQ ID NO: 173026 - DNA, 25 bp, Mus musculus
agcccctctaacttgactacctaaa

SEQ ID NO: 173027 - DNA, 25 bp, Mus musculus
agcccctctcctatactagaggagg

SEQ ID NO: 173028 - DNA, 25 bp, Mus musculus
agcccctctcctttactagaggagg

SEQ ID NO: 173029 - DNA, 25 bp, Mus musculus
agcccctctgaaaggctgttatctc

SEQ ID NO: 173030 - DNA, 25 bp, Mus musculus
agcccctctgaatggctgttatctc

SEQ ID NO: 173031 - DNA, 25 bp, Mus musculus
agcccctctgctaagatagaactgg

SEQ ID NO: 173032 - DNA, 25 bp, Mus musculus
agcccctctgctaatggtcaaatag

SEQ ID NO: 173033 - DNA, 25 bp, Mus musculus
agcccctctgcttagatagaactgg

SEQ ID NO: 173034 - DNA, 25 bp, Mus musculus
agcccctctgcttatggtcaaatag

SEQ ID NO: 173035 - DNA, 25 bp, Mus musculus
agcccctctggaaagatggcatcag

SEQ ID NO: 173036 - DNA, 25 bp, Mus musculus
agcccctctggatagatggcatcag

SEQ ID NO: 173037 - DNA, 25 bp, Mus musculus
agcccctctggcatgttaaaaaaga

SEQ ID NO: 173038 - DNA, 25 bp, Mus musculus
agcccctctggcttgttaaaaaaga

SEQ ID NO: 173039 - DNA, 25 bp, Mus musculus
agcccctctggtcacggagttttgc

SEQ ID NO: 173040 - DNA, 25 bp, Mus musculus
agcccctctggtgacggagttttgc

SEQ ID NO: 173041 - DNA, 25 bp, Mus musculus
agcccctctgtaagatggtgagcca

SEQ ID NO: 173042 - DNA, 25 bp, Mus musculus
agcccctctgtatgatggtgagcca

SEQ ID NO: 173043 - DNA, 25 bp, Mus musculus
agcccctcttatatcttctgtagag

SEQ ID NO: 173044 - DNA, 25 bp, Mus musculus
agcccctcttatttcttctgtagag

SEQ ID NO: 173045 - DNA, 25 bp, Mus musculus
agcccctcttggactcagctaggta

SEQ ID NO: 173046 - DNA, 25 bp, Mus musculus
agcccctcttggtctcagctaggta

SEQ ID NO: 173047 - DNA, 25 bp, Mus musculus
agcccctgaaacaagagttgtggat

SEQ ID NO: 173048 - DNA, 25 bp, Mus musculus
agcccctgaaaccaggttcggagag

SEQ ID NO: 173049 - DNA, 25 bp, Mus musculus
agcccctgaaacgaggttcggagag

SEQ ID NO: 173050 - DNA, 25 bp, Mus musculus
agcccctgaaactagagttgtggat

SEQ ID NO: 173051 - DNA, 25 bp, Mus musculus
agcccctgaactcagccatcaaagg

SEQ ID NO: 173052 - DNA, 25 bp, Mus musculus
agcccctgaactgagccatcaaagg

SEQ ID NO: 173053 - DNA, 25 bp, Mus musculus
agcccctgaatccaaccagatggag

SEQ ID NO: 173054 - DNA, 25 bp, Mus musculus
agcccctgaatcgaaccagatggag

SEQ ID NO: 173055 - DNA, 25 bp, Mus musculus
agcccctgaatgagacggtgatccg

SEQ ID NO: 173056 - DNA, 25 bp, Mus musculus
agcccctgaatgattttatagtagt

SEQ ID NO: 173057 - DNA, 25 bp, Mus musculus
agcccctgaatgtgacggtgatccg

SEQ ID NO: 173058 - DNA, 25 bp, Mus musculus
agcccctgaatgtttttatagtagt

SEQ ID NO: 173059 - DNA, 25 bp, Mus musculus
agcccctgacaactgggatcctgca

SEQ ID NO: 173060 - DNA, 25 bp, Mus musculus
agcccctgacaagtgggatcctgca

SEQ ID NO: 173061 - DNA, 25 bp, Mus musculus
agcccctgacacattgggaaccagt

SEQ ID NO: 173062 - DNA, 25 bp, Mus musculus
agcccctgacactttgggaaccagt

SEQ ID NO: 173063 - DNA, 25 bp, Mus musculus
agcccctgagcacaggacatggagc

SEQ ID NO: 173064 - DNA, 25 bp, Mus musculus
agcccctgagcagaggacatggagc

SEQ ID NO: 173065 - DNA, 25 bp, Mus musculus
agcccctgagtgactatgtgtgtga

SEQ ID NO: 173066 - DNA, 25 bp, Mus musculus
agcccctgagtgtctatgtgtgtga

SEQ ID NO: 173067 - DNA, 25 bp, Mus musculus
agcccctgatgtctttgtactgatt

SEQ ID NO: 173068 - DNA, 25 bp, Mus musculus
agcccctgatgtgtttgtactgatt

SEQ ID NO: 173069 - DNA, 25 bp, Mus musculus
agcccctgattgaacgtgggagcag

SEQ ID NO: 173070 - DNA, 25 bp, Mus musculus
agcccctgattgtacgtgggagcag

SEQ ID NO: 173071 - DNA, 25 bp, Mus musculus
agcccctgcagtaccttctgggaag

SEQ ID NO: 173072 - DNA, 25 bp, Mus musculus
agcccctgcagttccttctgggaag

SEQ ID NO: 173073 - DNA, 25 bp, Mus musculus
agcccctgccataacttggattgta

SEQ ID NO: 173074 - DNA, 25 bp, Mus musculus
agcccctgccattacttggattgta

SEQ ID NO: 173075 - DNA, 25 bp, Mus musculus
agcccctgctcacattgagctgaag

SEQ ID NO: 173076 - DNA, 25 bp, Mus musculus
agcccctgctcacgtgctgcctctg

SEQ ID NO: 173077 - DNA, 25 bp, Mus musculus
agcccctgctcagattgagctgaag

SEQ ID NO: 173078 - DNA, 25 bp, Mus musculus
agcccctgctcaggtgctgcctctg

SEQ ID NO: 173079 - DNA, 25 bp, Mus musculus
agcccctgctgaataccattgaaat

SEQ ID NO: 173080 - DNA, 25 bp, Mus musculus
agcccctgctgacaatgcactgatt

SEQ ID NO: 173081 - DNA, 25 bp, Mus musculus
agcccctgctgagaatgcactgatt

SEQ ID NO: 173082 - DNA, 25 bp, Mus musculus
agcccctgctgattaccattgaaat

SEQ ID NO: 173083 - DNA, 25 bp, Mus musculus
agcccctggaacctgtgctgaaaaa

SEQ ID NO: 173084 - DNA, 25 bp, Mus musculus
agcccctggaacgtgtgctgaaaaa

SEQ ID NO: 173085 - DNA, 25 bp, Mus musculus
agcccctggacccatgtggtggaaa

SEQ ID NO: 173086 - DNA, 25 bp, Mus musculus
agcccctggaccgatgtggtggaaa

SEQ ID NO: 173087 - DNA, 25 bp, Mus musculus
agcccctggagacctagcatgcagt

SEQ ID NO: 173088 - DNA, 25 bp, Mus musculus
agcccctggagagctagcatgcagt

SEQ ID NO: 173089 - DNA, 25 bp, Mus musculus
agcccctggcagctactgatacagt

SEQ ID NO: 173090 - DNA, 25 bp, Mus musculus
agcccctggcaggtactgatacagt

SEQ ID NO: 173091 - DNA, 25 bp, Mus musculus
agcccctggccgagtggaatccatg

SEQ ID NO: 173092 - DNA, 25 bp, Mus musculus
agcccctggccgtgtggaatccatg

SEQ ID NO: 173093 - DNA, 25 bp, Mus musculus
agcccctgggagcttgcctagtagc

SEQ ID NO: 173094 - DNA, 25 bp, Mus musculus
agcccctgggaggttgcctagtagc

SEQ ID NO: 173095 - DNA, 25 bp, Mus musculus
agcccctggtgaaactgttgacaac

SEQ ID NO: 173096 - DNA, 25 bp, Mus musculus
agcccctggtgatactgttgacaac

SEQ ID NO: 173097 - DNA, 25 bp, Mus musculus
agcccctggttgatctaacattctt

SEQ ID NO: 173098 - DNA, 25 bp, Mus musculus
agcccctggttgttctaacattctt

SEQ ID NO: 173099 - DNA, 25 bp, Mus musculus
agcccctgtaagaggacccagccat

SEQ ID NO: 173100 - DNA, 25 bp, Mus musculus
agcccctgtaagtggacccagccat

SEQ ID NO: 173101 - DNA, 25 bp, Mus musculus
agcccctgtctgagtaagtttcatc

SEQ ID NO: 173102 - DNA, 25 bp, Mus musculus
agcccctgtctgtgtaagtttcatc

SEQ ID NO: 173103 - DNA, 25 bp, Mus musculus
agcccctgtgctcttagaatggtct

SEQ ID NO: 173104 - DNA, 25 bp, Mus musculus
agcccctgtgctgttagaatggtct

SEQ ID NO: 173105 - DNA, 25 bp, Mus musculus
agcccctgtggacacgcctccagag

SEQ ID NO: 173106 - DNA, 25 bp, Mus musculus
agcccctgtggagacgcctccagag

SEQ ID NO: 173107 - DNA, 25 bp, Mus musculus
agcccctgttctagtgccaaaatgg

SEQ ID NO: 173108 - DNA, 25 bp, Mus musculus
agcccctgttcttgtgccaaaatgg

SEQ ID NO: 173109 - DNA, 25 bp, Mus musculus
agcccctgttttactgctgtttaca

SEQ ID NO: 173110 - DNA, 25 bp, Mus musculus
agcccctgtttttctgctgtttaca

SEQ ID NO: 173111 - DNA, 25 bp, Mus musculus
agccccttatgcaggtcttaggtgt

SEQ ID NO: 173112 - DNA, 25 bp, Mus musculus
agccccttatgctggtcttaggtgt

SEQ ID NO: 173113 - DNA, 25 bp, Mus musculus
agccccttctccattttataagact

SEQ ID NO: 173114 - DNA, 25 bp, Mus musculus
agccccttctcctttttataagact

SEQ ID NO: 173115 - DNA, 25 bp, Mus musculus
agccccttctctagcatttgcattt

SEQ ID NO: 173116 - DNA, 25 bp, Mus musculus
agccccttctcttgcatttgcattt

SEQ ID NO: 173117 - DNA, 25 bp, Mus musculus
agccccttctgtcttatgtcatctc

SEQ ID NO: 173118 - DNA, 25 bp, Mus musculus
agccccttctgtgttatgtcatctc

SEQ ID NO: 173119 - DNA, 25 bp, Mus musculus
agccccttcttcaccaagagccaca

SEQ ID NO: 173120 - DNA, 25 bp, Mus musculus
agccccttcttctccaagagccaca

SEQ ID NO: 173121 - DNA, 25 bp, Mus musculus
agccccttctttctagcacttctag

SEQ ID NO: 173122 - DNA, 25 bp, Mus musculus
agccccttctttgtagcacttctag

SEQ ID NO: 173123 - DNA, 25 bp, Mus musculus
agccccttgagcactcatgactggg

SEQ ID NO: 173124 - DNA, 25 bp, Mus musculus
agccccttgagctctcatgactggg

SEQ ID NO: 173125 - DNA, 25 bp, Mus musculus
agccccttgcctcacgtgggtgctg

SEQ ID NO: 173126 - DNA, 25 bp, Mus musculus
agccccttgcctgacgtgggtgctg

SEQ ID NO: 173127 - DNA, 25 bp, Mus musculus
agccccttgggcagtgtcaggtcca

SEQ ID NO: 173128 - DNA, 25 bp, Mus musculus
agccccttgggctgtgtcaggtcca

SEQ ID NO: 173129 - DNA, 25 bp, Mus musculus
agccccttggttcggccatagagca

SEQ ID NO: 173130 - DNA, 25 bp, Mus musculus
agccccttggttgggccatagagca

SEQ ID NO: 173131 - DNA, 25 bp, Mus musculus
agccccttgtagatccttctttctc

SEQ ID NO: 173132 - DNA, 25 bp, Mus musculus
agccccttgtagttccttctttctc

SEQ ID NO: 173133 - DNA, 25 bp, Mus musculus
agccccttgtggacatattcagtga

SEQ ID NO: 173134 - DNA, 25 bp, Mus musculus
agccccttgtggtcatattcagtga

SEQ ID NO: 173135 - DNA, 25 bp, Mus musculus
agcccctttactaaccaaatatgct

SEQ ID NO: 173136 - DNA, 25 bp, Mus musculus
agcccctttacttaccaaatatgct

SEQ ID NO: 173137 - DNA, 25 bp, Mus musculus
agcccctttgagcaggtacagcaga

SEQ ID NO: 173138 - DNA, 25 bp, Mus musculus
agcccctttgaggaggtacagcaga

SEQ ID NO: 173139 - DNA, 25 bp, Mus musculus
agcccctttgccaagtcatatagat

SEQ ID NO: 173140 - DNA, 25 bp, Mus musculus
agcccctttgccaatcttagtgatg

SEQ ID NO: 173141 - DNA, 25 bp, Mus musculus
agcccctttgcctagtcatatagat

SEQ ID NO: 173142 - DNA, 25 bp, Mus musculus
agcccctttgcctatcttagtgatg

SEQ ID NO: 173143 - DNA, 25 bp, Mus musculus
agcccctttggccagtgcaggctga

SEQ ID NO: 173144 - DNA, 25 bp, Mus musculus
agcccctttggcgagtgcaggctga

SEQ ID NO: 173145 - DNA, 25 bp, Mus musculus
agccccttttcgaggagtttgcaga

SEQ ID NO: 173146 - DNA, 25 bp, Mus musculus
agccccttttcgtggagtttgcaga

SEQ ID NO: 173147 - DNA, 25 bp, Mus musculus
agcccgaaccgcagctcaatgacag

SEQ ID NO: 173148 - DNA, 25 bp, Mus musculus
agcccgaaccgctgctcaatgacag

SEQ ID NO: 173149 - DNA, 25 bp, Mus musculus
agcccgaatgttagagatctctgag

SEQ ID NO: 173150 - DNA, 25 bp, Mus musculus
agcccgaatgtttgagatctctgag

SEQ ID NO: 173151 - DNA, 25 bp, Mus musculus
agcccgaccagcctgcaagtagaat

SEQ ID NO: 173152 - DNA, 25 bp, Mus musculus
agcccgaccagcgtgcaagtagaat

SEQ ID NO: 173153 - DNA, 25 bp, Mus musculus
agcccgacgtgaaggatgctctcag

SEQ ID NO: 173154 - DNA, 25 bp, Mus musculus
agcccgacgtgatggatgctctcag

SEQ ID NO: 173155 - DNA, 25 bp, Mus musculus
agcccgagccgaacgcgtgttggaa

SEQ ID NO: 173156 - DNA, 25 bp, Mus musculus
agcccgagccgatcgcgtgttggaa

SEQ ID NO: 173157 - DNA, 25 bp, Mus musculus
agcccgaggaaaacgcagataagtt

SEQ ID NO: 173158 - DNA, 25 bp, Mus musculus
agcccgaggaaatcgcagataagtt

SEQ ID NO: 173159 - DNA, 25 bp, Mus musculus
agcccgagtattaccaacgtcattt

SEQ ID NO: 173160 - DNA, 25 bp, Mus musculus
agcccgagtatttccaacgtcattt

SEQ ID NO: 173161 - DNA, 25 bp, Mus musculus
agcccgagtggcatcttccttgtgt

SEQ ID NO: 173162 - DNA, 25 bp, Mus musculus
agcccgagtggcttcttccttgtgt

SEQ ID NO: 173163 - DNA, 25 bp, Mus musculus
agcccgagttccaacagacctaagc

SEQ ID NO: 173164 - DNA, 25 bp, Mus musculus
agcccgagttcctacagacctaagc

SEQ ID NO: 173165 - DNA, 25 bp, Mus musculus
agcccgataattcagttggattccc

SEQ ID NO: 173166 - DNA, 25 bp, Mus musculus
agcccgataattgagttggattccc

SEQ ID NO: 173167 - DNA, 25 bp, Mus musculus
agcccgatattcaggatcttcttca

SEQ ID NO: 173168 - DNA, 25 bp, Mus musculus
agcccgatattctggatcttcttca

SEQ ID NO: 173169 - DNA, 25 bp, Mus musculus
agcccgatggtgactctgtgcacac

SEQ ID NO: 173170 - DNA, 25 bp, Mus musculus
agcccgatggtgtctctgtgcacac

SEQ ID NO: 173171 - DNA, 25 bp, Mus musculus
agcccgcagaggagtcgccatgagc

SEQ ID NO: 173172 - DNA, 25 bp, Mus musculus
agcccgcagaggtgtcgccatgagc

SEQ ID NO: 173173 - DNA, 25 bp, Mus musculus
agcccgcaggatccaagcagagtac

SEQ ID NO: 173174 - DNA, 25 bp, Mus musculus
agcccgcaggatgcaagcagagtac

SEQ ID NO: 173175 - DNA, 25 bp, Mus musculus
agcccgcagtttactgtgtgctttt

SEQ ID NO: 173176 - DNA, 25 bp, Mus musculus
agcccgcagttttctgtgtgctttt

SEQ ID NO: 173177 - DNA, 25 bp, Mus musculus
agcccgccacttatagttgcatttc

SEQ ID NO: 173178 - DNA, 25 bp, Mus musculus
agcccgccacttttagttgcatttc

SEQ ID NO: 173179 - DNA, 25 bp, Mus musculus
agcccgccccacagggttggcagtg

SEQ ID NO: 173180 - DNA, 25 bp, Mus musculus
agcccgccccactgggttggcagtg

SEQ ID NO: 173181 - DNA, 25 bp, Mus musculus
agcccgccctgcagacattggatga

SEQ ID NO: 173182 - DNA, 25 bp, Mus musculus
agcccgccctgctgacattggatga

SEQ ID NO: 173183 - DNA, 25 bp, Mus musculus
agcccgccgctgaggccaatagata

SEQ ID NO: 173184 - DNA, 25 bp, Mus musculus
agcccgccgctgtggccaatagata

SEQ ID NO: 173185 - DNA, 25 bp, Mus musculus
agcccgcgtagccactatgaaggca

SEQ ID NO: 173186 - DNA, 25 bp, Mus musculus
agcccgcgtagcgactatgaaggca

SEQ ID NO: 173187 - DNA, 25 bp, Mus musculus
agcccgcgtagtcgcacttgtgctt

SEQ ID NO: 173188 - DNA, 25 bp, Mus musculus
agcccgcgtagtggcacttgtgctt

SEQ ID NO: 173189 - DNA, 25 bp, Mus musculus
agcccgctactgagatctcaggaag

SEQ ID NO: 173190 - DNA, 25 bp, Mus musculus
agcccgctactgtgatctcaggaag

SEQ ID NO: 173191 - DNA, 25 bp, Mus musculus
agcccgctagctccagatagaacta

SEQ ID NO: 173192 - DNA, 25 bp, Mus musculus
agcccgctagctgcagatagaacta

SEQ ID NO: 173193 - DNA, 25 bp, Mus musculus
agcccgctctcgagaggtactttga

SEQ ID NO: 173194 - DNA, 25 bp, Mus musculus
agcccgctctcgtgaggtactttga

SEQ ID NO: 173195 - DNA, 25 bp, Mus musculus
agcccgctgaagcttcaccggacag

SEQ ID NO: 173196 - DNA, 25 bp, Mus musculus
agcccgctgaaggttcaccggacag

SEQ ID NO: 173197 - DNA, 25 bp, Mus musculus
agcccgctttctctttgattggatg

SEQ ID NO: 173198 - DNA, 25 bp, Mus musculus
agcccgctttctgtttgattggatg

SEQ ID NO: 173199 - DNA, 25 bp, Mus musculus
agcccggaagctatgctcactcagc

SEQ ID NO: 173200 - DNA, 25 bp, Mus musculus
agcccggaagctttgctcactcagc

SEQ ID NO: 173201 - DNA, 25 bp, Mus musculus
agcccggaccgaccaacaggttagc

SEQ ID NO: 173202 - DNA, 25 bp, Mus musculus
agcccggaccgagcaacaggttagc

SEQ ID NO: 173203 - DNA, 25 bp, Mus musculus
agcccggacgaccactctaaatgag

SEQ ID NO: 173204 - DNA, 25 bp, Mus musculus
agcccggacgacgactctaaatgag

SEQ ID NO: 173205 - DNA, 25 bp, Mus musculus
agcccggagtcgactatgtgtacaa

SEQ ID NO: 173206 - DNA, 25 bp, Mus musculus
agcccggagtcgtctatgtgtacaa

SEQ ID NO: 173207 - DNA, 25 bp, Mus musculus
agcccggatggacatgcttatcgaa

SEQ ID NO: 173208 - DNA, 25 bp, Mus musculus
agcccggatggagatgcttatcgaa

SEQ ID NO: 173209 - DNA, 25 bp, Mus musculus
agcccggcaatgctgccattcaaga

SEQ ID NO: 173210 - DNA, 25 bp, Mus musculus
agcccggcaatggtgccattcaaga

SEQ ID NO: 173211 - DNA, 25 bp, Mus musculus
agcccggcagcactatgagagacat

SEQ ID NO: 173212 - DNA, 25 bp, Mus musculus
agcccggcagcagtatgagagacat

SEQ ID NO: 173213 - DNA, 25 bp, Mus musculus
agcccggccgaacctaggatctttt

SEQ ID NO: 173214 - DNA, 25 bp, Mus musculus
agcccggccgaagctaggatctttt

SEQ ID NO: 173215 - DNA, 25 bp, Mus musculus
agcccggctctgctgtgtagagact

SEQ ID NO: 173216 - DNA, 25 bp, Mus musculus
agcccggctctggtgtgtagagact

SEQ ID NO: 173217 - DNA, 25 bp, Mus musculus
agcccggctgtgagagtccctgtga

SEQ ID NO: 173218 - DNA, 25 bp, Mus musculus
agcccggctgtgtgagtccctgtga

SEQ ID NO: 173219 - DNA, 25 bp, Mus musculus
agcccggctgttctccatggaaagg

SEQ ID NO: 173220 - DNA, 25 bp, Mus musculus
agcccggctgttgtccatggaaagg

SEQ ID NO: 173221 - DNA, 25 bp, Mus musculus
agcccggcttctaggaactttcaat

SEQ ID NO: 173222 - DNA, 25 bp, Mus musculus
agcccggcttcttggaactttcaat

SEQ ID NO: 173223 - DNA, 25 bp, Mus musculus
agcccggctttgagtagtactctta

SEQ ID NO: 173224 - DNA, 25 bp, Mus musculus
agcccggctttgtgtagtactctta

SEQ ID NO: 173225 - DNA, 25 bp, Mus musculus
agcccgggattcactgtgagcgcag

SEQ ID NO: 173226 - DNA, 25 bp, Mus musculus
agcccgggattctctgtgagcgcag

SEQ ID NO: 173227 - DNA, 25 bp, Mus musculus
agcccgggcaggaccaaacagtact

SEQ ID NO: 173228 - DNA, 25 bp, Mus musculus
agcccgggcaggtccaaacagtact

SEQ ID NO: 173229 - DNA, 25 bp, Mus musculus
agcccgggtttaatcaggtgacata

SEQ ID NO: 173230 - DNA, 25 bp, Mus musculus
agcccgggtttattcaggtgacata

SEQ ID NO: 173231 - DNA, 25 bp, Mus musculus
agcccggtccaaaacacgttacctg

SEQ ID NO: 173232 - DNA, 25 bp, Mus musculus
agcccggtccaatacacgttacctg

SEQ ID NO: 173233 - DNA, 25 bp, Mus musculus
agcccggtgctgagatcggtgccct

SEQ ID NO: 173234 - DNA, 25 bp, Mus musculus
agcccggtgctgtgatcggtgccct

SEQ ID NO: 173235 - DNA, 25 bp, Mus musculus
agcccgtaaaaccaagatctcttct

SEQ ID NO: 173236 - DNA, 25 bp, Mus musculus
agcccgtaaaacgaagatctcttct

SEQ ID NO: 173237 - DNA, 25 bp, Mus musculus
agcccgtcacacagagacacaagtg

SEQ ID NO: 173238 - DNA, 25 bp, Mus musculus
agcccgtcacactgagacacaagtg

SEQ ID NO: 173239 - DNA, 25 bp, Mus musculus
agcccgtcaggtcctatgagctgct

SEQ ID NO: 173240 - DNA, 25 bp, Mus musculus
agcccgtcaggtgctatgagctgct

SEQ ID NO: 173241 - DNA, 25 bp, Mus musculus
agcccgtcatctccatagtaggatg

SEQ ID NO: 173242 - DNA, 25 bp, Mus musculus
agcccgtcatctgcatagtaggatg

SEQ ID NO: 173243 - DNA, 25 bp, Mus musculus
agcccgtctcacatagtttctgatt

SEQ ID NO: 173244 - DNA, 25 bp, Mus musculus
agcccgtctcacttagtttctgatt

SEQ ID NO: 173245 - DNA, 25 bp, Mus musculus
agcccgtcttaactccgattgatga

SEQ ID NO: 173246 - DNA, 25 bp, Mus musculus
agcccgtcttaagtccgattgatga

SEQ ID NO: 173247 - DNA, 25 bp, Mus musculus
agcccgtgagcacacccagacatag

SEQ ID NO: 173248 - DNA, 25 bp, Mus musculus
agcccgtgagcagacccagacatag

SEQ ID NO: 173249 - DNA, 25 bp, Mus musculus
agcccgtggactcgagtaccgacta

SEQ ID NO: 173250 - DNA, 25 bp, Mus musculus
agcccgtggactggagtaccgacta

SEQ ID NO: 173251 - DNA, 25 bp, Mus musculus
agcccgtgggctacccgtgcagcaa

SEQ ID NO: 173252 - DNA, 25 bp, Mus musculus
agcccgtgggcttcccgtgcagcaa

SEQ ID NO: 173253 - DNA, 25 bp, Mus musculus
agcccgtgggtcaagaatcagtgaa

SEQ ID NO: 173254 - DNA, 25 bp, Mus musculus
agcccgtgggtctagaatcagtgaa

SEQ ID NO: 173255 - DNA, 25 bp, Mus musculus
agcccgtggtccattcatttatgga

SEQ ID NO: 173256 - DNA, 25 bp, Mus musculus
agcccgtggtcctttcatttatgga

SEQ ID NO: 173257 - DNA, 25 bp, Mus musculus
agcccgtggtgtacctggagagatt

SEQ ID NO: 173258 - DNA, 25 bp, Mus musculus
agcccgtggtgttcctggagagatt

SEQ ID NO: 173259 - DNA, 25 bp, Mus musculus
agcccgtgtcggagtttattacagt

SEQ ID NO: 173260 - DNA, 25 bp, Mus musculus
agcccgtgtcggtgtttattacagt

SEQ ID NO: 173261 - DNA, 25 bp, Mus musculus
agcccgtgtctaacactccaaagca

SEQ ID NO: 173262 - DNA, 25 bp, Mus musculus
agcccgtgtctatcactccaaagca

SEQ ID NO: 173263 - DNA, 25 bp, Mus musculus
agcccgtgtgatagatgtgtctaat

SEQ ID NO: 173264 - DNA, 25 bp, Mus musculus
agcccgtgtgattgatgtgtctaat

SEQ ID NO: 173265 - DNA, 25 bp, Mus musculus
agcccgttcgagctaattccagcaa

SEQ ID NO: 173266 - DNA, 25 bp, Mus musculus
agcccgttcgaggtaattccagcaa

SEQ ID NO: 173267 - DNA, 25 bp, Mus musculus
agcccgttgaggagctgcaaaaagt

SEQ ID NO: 173268 - DNA, 25 bp, Mus musculus
agcccgttgaggtgctgcaaaaagt

SEQ ID NO: 173269 - DNA, 25 bp, Mus musculus
agcccgttgcctcctatttttccgt

SEQ ID NO: 173270 - DNA, 25 bp, Mus musculus
agcccgttgcctgctatttttccgt

SEQ ID NO: 173271 - DNA, 25 bp, Mus musculus
agcccgttttctccgaagtgaggtc

SEQ ID NO: 173272 - DNA, 25 bp, Mus musculus
agcccgttttctgcgaagtgaggtc

SEQ ID NO: 173273 - DNA, 25 bp, Mus musculus
agccctaaaattactccagtacagt

SEQ ID NO: 173274 - DNA, 25 bp, Mus musculus
agccctaaaatttctccagtacagt

SEQ ID NO: 173275 - DNA, 25 bp, Mus musculus
agccctaagaatcagtctccaggaa

SEQ ID NO: 173276 - DNA, 25 bp, Mus musculus
agccctaagaatgagtctccaggaa

SEQ ID NO: 173277 - DNA, 25 bp, Mus musculus
agccctaagccaccatctgaggtgt

SEQ ID NO: 173278 - DNA, 25 bp, Mus musculus
agccctaagccagcatctgaggtgt

SEQ ID NO: 173279 - DNA, 25 bp, Mus musculus
agccctaagtccactgtggttggta

SEQ ID NO: 173280 - DNA, 25 bp, Mus musculus
agccctaagtcctctgtggttggta

SEQ ID NO: 173281 - DNA, 25 bp, Mus musculus
agccctaagtctcctcctttattat

SEQ ID NO: 173282 - DNA, 25 bp, Mus musculus
agccctaagtctgctcctttattat

SEQ ID NO: 173283 - DNA, 25 bp, Mus musculus
agccctaatcctacaatgtgatgat

SEQ ID NO: 173284 - DNA, 25 bp, Mus musculus
agccctaatccttcaatgtgatgat

SEQ ID NO: 173285 - DNA, 25 bp, Mus musculus
agccctaatggcagcctaccaatct

SEQ ID NO: 173286 - DNA, 25 bp, Mus musculus
agccctaatggctgcctaccaatct

SEQ ID NO: 173287 - DNA, 25 bp, Mus musculus
agccctacattcaatgagcaccgag

SEQ ID NO: 173288 - DNA, 25 bp, Mus musculus
agccctacattctatgagcaccgag

SEQ ID NO: 173289 - DNA, 25 bp, Mus musculus
agccctaccaagcactactgcttag

SEQ ID NO: 173290 - DNA, 25 bp, Mus musculus
agccctaccaaggactactgcttag

SEQ ID NO: 173291 - DNA, 25 bp, Mus musculus
agccctaccataccccgattgtgaa

SEQ ID NO: 173292 - DNA, 25 bp, Mus musculus
agccctaccatagcccgattgtgaa

SEQ ID NO: 173293 - DNA, 25 bp, Mus musculus
agccctacccagataatgtgccaaa

SEQ ID NO: 173294 - DNA, 25 bp, Mus musculus
agccctacccagttaatgtgccaaa

SEQ ID NO: 173295 - DNA, 25 bp, Mus musculus
agccctacctaccttgtccaggaga

SEQ ID NO: 173296 - DNA, 25 bp, Mus musculus
agccctacctacgttgtccaggaga

SEQ ID NO: 173297 - DNA, 25 bp, Mus musculus
agccctacctagacttcttgggtga

SEQ ID NO: 173298 - DNA, 25 bp, Mus musculus
agccctacctagtcttcttgggtga

SEQ ID NO: 173299 - DNA, 25 bp, Mus musculus
agccctacctggacgaattccagaa

SEQ ID NO: 173300 - DNA, 25 bp, Mus musculus
agccctacctggtcgaattccagaa

SEQ ID NO: 173301 - DNA, 25 bp, Mus musculus
agccctacgaggcagcctgaggaca

SEQ ID NO: 173302 - DNA, 25 bp, Mus musculus
agccctacgagggagcctgaggaca

SEQ ID NO: 173303 - DNA, 25 bp, Mus musculus
agccctacgcttctggcagagtatg

SEQ ID NO: 173304 - DNA, 25 bp, Mus musculus
agccctacgcttgtggcagagtatg

SEQ ID NO: 173305 - DNA, 25 bp, Mus musculus
agccctactgctccggtgagtgcga

SEQ ID NO: 173306 - DNA, 25 bp, Mus musculus
agccctactgctgcggtgagtgcga

SEQ ID NO: 173307 - DNA, 25 bp, Mus musculus
agccctactgttcgaatagttcagg

SEQ ID NO: 173308 - DNA, 25 bp, Mus musculus
agccctactgttggaatagttcagg

SEQ ID NO: 173309 - DNA, 25 bp, Mus musculus
agccctagatcacgagatcattgag

SEQ ID NO: 173310 - DNA, 25 bp, Mus musculus
agccctagatcaggagatcattgag

SEQ ID NO: 173311 - DNA, 25 bp, Mus musculus
agccctagatctcgttttgtaatga

SEQ ID NO: 173312 - DNA, 25 bp, Mus musculus
agccctagatctggttttgtaatga

SEQ ID NO: 173313 - DNA, 25 bp, Mus musculus
agccctagcatcacttatttttctt

SEQ ID NO: 173314 - DNA, 25 bp, Mus musculus
agccctagcatctcttatttttctt

SEQ ID NO: 173315 - DNA, 25 bp, Mus musculus
agccctagcatgatggaaatctttg

SEQ ID NO: 173316 - DNA, 25 bp, Mus musculus
agccctagcatgttggaaatctttg

SEQ ID NO: 173317 - DNA, 25 bp, Mus musculus
agccctagctacagtacttgtctaa

SEQ ID NO: 173318 - DNA, 25 bp, Mus musculus
agccctagctactgtacttgtctaa

SEQ ID NO: 173319 - DNA, 25 bp, Mus musculus
agccctagcttcctgcaggcagata

SEQ ID NO: 173320 - DNA, 25 bp, Mus musculus
agccctagcttcgtgcaggcagata

SEQ ID NO: 173321 - DNA, 25 bp, Mus musculus
agccctaggcccctgtctatactag

SEQ ID NO: 173322 - DNA, 25 bp, Mus musculus
agccctaggcccgtgtctatactag

SEQ ID NO: 173323 - DNA, 25 bp, Mus musculus
agccctaggcttcatgttgccacac

SEQ ID NO: 173324 - DNA, 25 bp, Mus musculus
agccctaggcttgatgttgccacac

SEQ ID NO: 173325 - DNA, 25 bp, Mus musculus
agccctagggatagtacatcctcca

SEQ ID NO: 173326 - DNA, 25 bp, Mus musculus
agccctagggattgtacatcctcca

SEQ ID NO: 173327 - DNA, 25 bp, Mus musculus
agccctagtatcctatgaagctcag

SEQ ID NO: 173328 - DNA, 25 bp, Mus musculus
agccctagtatcgtatgaagctcag

SEQ ID NO: 173329 - DNA, 25 bp, Mus musculus
agccctagtcgcaggacttcactta

SEQ ID NO: 173330 - DNA, 25 bp, Mus musculus
agccctagtcgctggacttcactta

SEQ ID NO: 173331 - DNA, 25 bp, Mus musculus
agccctagtctcacacaacagtgag

SEQ ID NO: 173332 - DNA, 25 bp, Mus musculus
agccctagtctctcacaacagtgag

SEQ ID NO: 173333 - DNA, 25 bp, Mus musculus
agccctataaatccgtggactgcgg

SEQ ID NO: 173334 - DNA, 25 bp, Mus musculus
agccctataaatgcgtggactgcgg

SEQ ID NO: 173335 - DNA, 25 bp, Mus musculus
agccctataagaacgccgctcggtg

SEQ ID NO: 173336 - DNA, 25 bp, Mus musculus
agccctataagatcgccgctcggtg

SEQ ID NO: 173337 - DNA, 25 bp, Mus musculus
agccctatcgtcacctatcggatga

SEQ ID NO: 173338 - DNA, 25 bp, Mus musculus
agccctatcgtctcctatcggatga

SEQ ID NO: 173339 - DNA, 25 bp, Mus musculus
agccctatctaccataacactgagg

SEQ ID NO: 173340 - DNA, 25 bp, Mus musculus
agccctatctacgataacactgagg

SEQ ID NO: 173341 - DNA, 25 bp, Mus musculus
agccctatgccgagacatctttgaa

SEQ ID NO: 173342 - DNA, 25 bp, Mus musculus
agccctatgccgtgacatctttgaa

SEQ ID NO: 173343 - DNA, 25 bp, Mus musculus
agccctatggttatcccattgctag

SEQ ID NO: 173344 - DNA, 25 bp, Mus musculus
agccctatggttttcccattgctag

SEQ ID NO: 173345 - DNA, 25 bp, Mus musculus
agccctattaccctagaacttcagg

SEQ ID NO: 173346 - DNA, 25 bp, Mus musculus
agccctattaccgtagaacttcagg

SEQ ID NO: 173347 - DNA, 25 bp, Mus musculus
agccctattggtcaaacactcgtga

SEQ ID NO: 173348 - DNA, 25 bp, Mus musculus
agccctattggtgaaacactcgtga

SEQ ID NO: 173349 - DNA, 25 bp, Mus musculus
agccctattttcctaattctaagca

SEQ ID NO: 173350 - DNA, 25 bp, Mus musculus
agccctattttcgtaattctaagca

SEQ ID NO: 173351 - DNA, 25 bp, Mus musculus
agccctcaaaagacctcaactaatt

SEQ ID NO: 173352 - DNA, 25 bp, Mus musculus
agccctcaaaagtcctcaactaatt

SEQ ID NO: 173353 - DNA, 25 bp, Mus musculus
agccctcaaacaactcctgtaaaga

SEQ ID NO: 173354 - DNA, 25 bp, Mus musculus
agccctcaaacatctcctgtaaaga

SEQ ID NO: 173355 - DNA, 25 bp, Mus musculus
agccctcaaatcagtcctctaagat

SEQ ID NO: 173356 - DNA, 25 bp, Mus musculus
agccctcaaatctgtcctctaagat

SEQ ID NO: 173357 - DNA, 25 bp, Mus musculus
agccctcaagggaggtgtctgcaat

SEQ ID NO: 173358 - DNA, 25 bp, Mus musculus
agccctcaagggtggtgtctgcaat

SEQ ID NO: 173359 - DNA, 25 bp, Mus musculus
agccctcaagtacagtgctatcctg

SEQ ID NO: 173360 - DNA, 25 bp, Mus musculus
agccctcaagtagagtgctatcctg

SEQ ID NO: 173361 - DNA, 25 bp, Mus musculus
agccctcacactcgtcaatttacaa

SEQ ID NO: 173362 - DNA, 25 bp, Mus musculus
agccctcacactggtcaatttacaa

SEQ ID NO: 173363 - DNA, 25 bp, Mus musculus
agccctcacaggaccaaacaggaac

SEQ ID NO: 173364 - DNA, 25 bp, Mus musculus
agccctcacaggtccaaacaggaac

SEQ ID NO: 173365 - DNA, 25 bp, Mus musculus
agccctcaccacaccagtaagtgat

SEQ ID NO: 173366 - DNA, 25 bp, Mus musculus
agccctcaccactccagtaagtgat

SEQ ID NO: 173367 - DNA, 25 bp, Mus musculus
agccctcaccatctagcagagtatg

SEQ ID NO: 173368 - DNA, 25 bp, Mus musculus
agccctcaccatgtagcagagtatg

SEQ ID NO: 173369 - DNA, 25 bp, Mus musculus
agccctcactatccgatggtgtggg

SEQ ID NO: 173370 - DNA, 25 bp, Mus musculus
agccctcactatgcgatggtgtggg

SEQ ID NO: 173371 - DNA, 25 bp, Mus musculus
agccctcactggagtccctatagta

SEQ ID NO: 173372 - DNA, 25 bp, Mus musculus
agccctcactggtgtccctatagta

SEQ ID NO: 173373 - DNA, 25 bp, Mus musculus
agccctcacttgcttttccatataa

SEQ ID NO: 173374 - DNA, 25 bp, Mus musculus
agccctcacttggttttccatataa

SEQ ID NO: 173375 - DNA, 25 bp, Mus musculus
agccctcagataaattcatctcctt

SEQ ID NO: 173376 - DNA, 25 bp, Mus musculus
agccctcagatatattcatctcctt

SEQ ID NO: 173377 - DNA, 25 bp, Mus musculus
agccctcaggacaagtctcagacga

SEQ ID NO: 173378 - DNA, 25 bp, Mus musculus
agccctcaggactagtctcagacga

SEQ ID NO: 173379 - DNA, 25 bp, Mus musculus
agccctcaggcaatttacaatcaaa

SEQ ID NO: 173380 - DNA, 25 bp, Mus musculus
agccctcaggcattttacaatcaaa

SEQ ID NO: 173381 - DNA, 25 bp, Mus musculus
agccctcagggtcacgaaagcccgt

SEQ ID NO: 173382 - DNA, 25 bp, Mus musculus
agccctcagggtgacgaaagcccgt

SEQ ID NO: 173383 - DNA, 25 bp, Mus musculus
agccctcagtagaagccatagtacc

SEQ ID NO: 173384 - DNA, 25 bp, Mus musculus
agccctcagtagtagccatagtacc

SEQ ID NO: 173385 - DNA, 25 bp, Mus musculus
agccctcatgcactgtcttgacatt

SEQ ID NO: 173386 - DNA, 25 bp, Mus musculus
agccctcatgcacttcagaatcttt

SEQ ID NO: 173387 - DNA, 25 bp, Mus musculus
agccctcatgcacttgttgctacga

SEQ ID NO: 173388 - DNA, 25 bp, Mus musculus
agccctcatgcagtgtcttgacatt

SEQ ID NO: 173389 - DNA, 25 bp, Mus musculus
agccctcatgcagttcagaatcttt

SEQ ID NO: 173390 - DNA, 25 bp, Mus musculus
agccctcatgcagttgttgctacga

SEQ ID NO: 173391 - DNA, 25 bp, Mus musculus
agccctcatgccagattccttaaac

SEQ ID NO: 173392 - DNA, 25 bp, Mus musculus
agccctcatgcctgattccttaaac

SEQ ID NO: 173393 - DNA, 25 bp, Mus musculus
agccctcatggaaagcagcacagct

SEQ ID NO: 173394 - DNA, 25 bp, Mus musculus
agccctcatggatagcagcacagct

SEQ ID NO: 173395 - DNA, 25 bp, Mus musculus
agccctccaattcgtagtgtctgtc

SEQ ID NO: 173396 - DNA, 25 bp, Mus musculus
agccctccaattggtagtgtctgtc

SEQ ID NO: 173397 - DNA, 25 bp, Mus musculus
agccctccagaaagatgtgtggcaa

SEQ ID NO: 173398 - DNA, 25 bp, Mus musculus
agccctccagaatgatgtgtggcaa

SEQ ID NO: 173399 - DNA, 25 bp, Mus musculus
agccctccatagcaagcagtgtgca

SEQ ID NO: 173400 - DNA, 25 bp, Mus musculus
agccctccataggaagcagtgtgca

SEQ ID NO: 173401 - DNA, 25 bp, Mus musculus
agccctccatgtcggaagtgtgatt

SEQ ID NO: 173402 - DNA, 25 bp, Mus musculus
agccctccatgtgggaagtgtgatt

SEQ ID NO: 173403 - DNA, 25 bp, Mus musculus
agccctcccgagctgttggaagcga

SEQ ID NO: 173404 - DNA, 25 bp, Mus musculus
agccctcccgaggtgttggaagcga

SEQ ID NO: 173405 - DNA, 25 bp, Mus musculus
agccctccctacaacagttcaatga

SEQ ID NO: 173406 - DNA, 25 bp, Mus musculus
agccctccctactacagttcaatga

SEQ ID NO: 173407 - DNA, 25 bp, Mus musculus
agccctccggacacggatgacagga

SEQ ID NO: 173408 - DNA, 25 bp, Mus musculus
agccctccggactcggatgacagga

SEQ ID NO: 173409 - DNA, 25 bp, Mus musculus
agccctcctataattgtctgcagaa

SEQ ID NO: 173410 - DNA, 25 bp, Mus musculus
agccctcctatatttgtctgcagaa

SEQ ID NO: 173411 - DNA, 25 bp, Mus musculus
agccctcctctcagtgggtgagtga

SEQ ID NO: 173412 - DNA, 25 bp, Mus musculus
agccctcctctctgtgggtgagtga

SEQ ID NO: 173413 - DNA, 25 bp, Mus musculus
agccctcctctgctctgggtggctt

SEQ ID NO: 173414 - DNA, 25 bp, Mus musculus
agccctcctctggtctgggtggctt

SEQ ID NO: 173415 - DNA, 25 bp, Mus musculus
agccctcctggcaccagaggaaatc

SEQ ID NO: 173416 - DNA, 25 bp, Mus musculus
agccctcctggctccagaggaaatc

SEQ ID NO: 173417 - DNA, 25 bp, Mus musculus
agccctcctgttctgctgaaatagg

SEQ ID NO: 173418 - DNA, 25 bp, Mus musculus
agccctcctgttgtgctgaaatagg

SEQ ID NO: 173419 - DNA, 25 bp, Mus musculus
agccctcgagcgcacgatttgaaga

SEQ ID NO: 173420 - DNA, 25 bp, Mus musculus
agccctcgagcggacgatttgaaga

SEQ ID NO: 173421 - DNA, 25 bp, Mus musculus
agccctcgatgccaattctcggaag

SEQ ID NO: 173422 - DNA, 25 bp, Mus musculus
agccctcgatgcgaattctcggaag

SEQ ID NO: 173423 - DNA, 25 bp, Mus musculus
agccctctaaggattcctgcatctt

SEQ ID NO: 173424 - DNA, 25 bp, Mus musculus
agccctctaaggtttcctgcatctt

SEQ ID NO: 173425 - DNA, 25 bp, Mus musculus
agccctctagttcctgtttgaggat

SEQ ID NO: 173426 - DNA, 25 bp, Mus musculus
agccctctagttgctgtttgaggat

SEQ ID NO: 173427 - DNA, 25 bp, Mus musculus
agccctctcacaaacacttgttggt

SEQ ID NO: 173428 - DNA, 25 bp, Mus musculus
agccctctcacatacacttgttggt

SEQ ID NO: 173429 - DNA, 25 bp, Mus musculus
agccctctcactactgagaacttca

SEQ ID NO: 173430 - DNA, 25 bp, Mus musculus
agccctctcacttctgagaacttca

SEQ ID NO: 173431 - DNA, 25 bp, Mus musculus
agccctctctccataactctataac

SEQ ID NO: 173432 - DNA, 25 bp, Mus musculus
agccctctctccttaactctataac

SEQ ID NO: 173433 - DNA, 25 bp, Mus musculus
agccctctgagtactggattatatc

SEQ ID NO: 173434 - DNA, 25 bp, Mus musculus
agccctctgagttctggattatatc

SEQ ID NO: 173435 - DNA, 25 bp, Mus musculus
agccctctgcatcactgaggttggg

SEQ ID NO: 173436 - DNA, 25 bp, Mus musculus
agccctctgcatgactgaggttggg

SEQ ID NO: 173437 - DNA, 25 bp, Mus musculus
agccctctggctccaagtaggaatt

SEQ ID NO: 173438 - DNA, 25 bp, Mus musculus
agccctctggctgcaagtaggaatt

SEQ ID NO: 173439 - DNA, 25 bp, Mus musculus
agccctctgtacagttagggattga

SEQ ID NO: 173440 - DNA, 25 bp, Mus musculus
agccctctgtactgttagggattga

SEQ ID NO: 173441 - DNA, 25 bp, Mus musculus
agccctctgtcaaggacgacattga

SEQ ID NO: 173442 - DNA, 25 bp, Mus musculus
agccctctgtcatggacgacattga

SEQ ID NO: 173443 - DNA, 25 bp, Mus musculus
agccctctgtgtatatggaaccttg

SEQ ID NO: 173444 - DNA, 25 bp, Mus musculus
agccctctgtgtttatggaaccttg

SEQ ID NO: 173445 - DNA, 25 bp, Mus musculus
agccctcttaacatttaggtccacg

SEQ ID NO: 173446 - DNA, 25 bp, Mus musculus
agccctcttaacttttaggtccacg

SEQ ID NO: 173447 - DNA, 25 bp, Mus musculus
agccctcttaggataattctgtata

SEQ ID NO: 173448 - DNA, 25 bp, Mus musculus
agccctcttaggttaattctgtata

SEQ ID NO: 173449 - DNA, 25 bp, Mus musculus
agccctcttcgaagaaccagcgttt

SEQ ID NO: 173450 - DNA, 25 bp, Mus musculus
agccctcttcgatgaaccagcgttt

SEQ ID NO: 173451 - DNA, 25 bp, Mus musculus
agccctcttgagaatgtctttactt

SEQ ID NO: 173452 - DNA, 25 bp, Mus musculus
agccctcttgagtatgtctttactt

SEQ ID NO: 173453 - DNA, 25 bp, Mus musculus
agccctcttgggaatattcggtcag

SEQ ID NO: 173454 - DNA, 25 bp, Mus musculus
agccctcttgggtatattcggtcag

SEQ ID NO: 173455 - DNA, 25 bp, Mus musculus
agccctctttgactacgatcctaag

SEQ ID NO: 173456 - DNA, 25 bp, Mus musculus
agccctctttgagtacgatcctaag

SEQ ID NO: 173457 - DNA, 25 bp, Mus musculus
agccctgaaaagatggccctgacgc

SEQ ID NO: 173458 - DNA, 25 bp, Mus musculus
agccctgaaaagttggccctgacgc

SEQ ID NO: 173459 - DNA, 25 bp, Mus musculus
agccctgaaattagctgacgctcat

SEQ ID NO: 173460 - DNA, 25 bp, Mus musculus
agccctgaaattctagtttcccatc

SEQ ID NO: 173461 - DNA, 25 bp, Mus musculus
agccctgaaattgtagtttcccatc

SEQ ID NO: 173462 - DNA, 25 bp, Mus musculus
agccctgaaatttgctgacgctcat

SEQ ID NO: 173463 - DNA, 25 bp, Mus musculus
agccctgaagagcatcgttcatctt

SEQ ID NO: 173464 - DNA, 25 bp, Mus musculus
agccctgaagaggatcgttcatctt

SEQ ID NO: 173465 - DNA, 25 bp, Mus musculus
agccctgaaggccaatccgtttggg

SEQ ID NO: 173466 - DNA, 25 bp, Mus musculus
agccctgaaggcgaatccgtttggg

SEQ ID NO: 173467 - DNA, 25 bp, Mus musculus
agccctgaatgcaggattcttaagc

SEQ ID NO: 173468 - DNA, 25 bp, Mus musculus
agccctgaatgcctgtcatactatg

SEQ ID NO: 173469 - DNA, 25 bp, Mus musculus
agccctgaatgcgtgtcatactatg

SEQ ID NO: 173470 - DNA, 25 bp, Mus musculus
agccctgaatgctggattcttaagc

SEQ ID NO: 173471 - DNA, 25 bp, Mus musculus
agccctgaatgtcgtcaaccctcat

SEQ ID NO: 173472 - DNA, 25 bp, Mus musculus
agccctgaatgtggtcaaccctcat

SEQ ID NO: 173473 - DNA, 25 bp, Mus musculus
agccctgacaggcatggaactcata

SEQ ID NO: 173474 - DNA, 25 bp, Mus musculus
agccctgacagggatggaactcata

SEQ ID NO: 173475 - DNA, 25 bp, Mus musculus
agccctgaccacatgtgttgctaat

SEQ ID NO: 173476 - DNA, 25 bp, Mus musculus
agccctgaccacttgtgttgctaat

SEQ ID NO: 173477 - DNA, 25 bp, Mus musculus
agccctgacctcctagaccttatag

SEQ ID NO: 173478 - DNA, 25 bp, Mus musculus
agccctgacctcgtagaccttatag

SEQ ID NO: 173479 - DNA, 25 bp, Mus musculus
agccctgactccatagacaaattta

SEQ ID NO: 173480 - DNA, 25 bp, Mus musculus
agccctgactccttagacaaattta

SEQ ID NO: 173481 - DNA, 25 bp, Mus musculus
agccctgagaaactgggtgctcttc

SEQ ID NO: 173482 - DNA, 25 bp, Mus musculus
agccctgagaaagtgggtgctcttc

SEQ ID NO: 173483 - DNA, 25 bp, Mus musculus
agccctgagacactacctggacaag

SEQ ID NO: 173484 - DNA, 25 bp, Mus musculus
agccctgagacagtacctggacaag

SEQ ID NO: 173485 - DNA, 25 bp, Mus musculus
agccctgagccacgtggcacaggac

SEQ ID NO: 173486 - DNA, 25 bp, Mus musculus
agccctgagccaggtggcacaggac

SEQ ID NO: 173487 - DNA, 25 bp, Mus musculus
agccctgagccccaagatagcaaag

SEQ ID NO: 173488 - DNA, 25 bp, Mus musculus
agccctgagcccgaagatagcaaag

SEQ ID NO: 173489 - DNA, 25 bp, Mus musculus
agccctgagccgcaagcacacaatt

SEQ ID NO: 173490 - DNA, 25 bp, Mus musculus
agccctgagccggaagcacacaatt

SEQ ID NO: 173491 - DNA, 25 bp, Mus musculus
agccctgagtacatgggtggtgcac

SEQ ID NO: 173492 - DNA, 25 bp, Mus musculus
agccctgagtacttgggtggtgcac

SEQ ID NO: 173493 - DNA, 25 bp, Mus musculus
agccctgagtcacccagaggaagga

SEQ ID NO: 173494 - DNA, 25 bp, Mus musculus
agccctgagtcagccagaggaagga

SEQ ID NO: 173495 - DNA, 25 bp, Mus musculus
agccctgagtctcggtatgtgctta

SEQ ID NO: 173496 - DNA, 25 bp, Mus musculus
agccctgagtctgggtatgtgctta

SEQ ID NO: 173497 - DNA, 25 bp, Mus musculus
agccctgatgaaactcaaaagcctg

SEQ ID NO: 173498 - DNA, 25 bp, Mus musculus
agccctgatgaatctcaaaagcctg

SEQ ID NO: 173499 - DNA, 25 bp, Mus musculus
agccctgatgatactggagagtggt

SEQ ID NO: 173500 - DNA, 25 bp, Mus musculus
agccctgatgattctggagagtggt

SEQ ID NO: 173501 - DNA, 25 bp, Mus musculus
agccctgatgctactcactgagaag

SEQ ID NO: 173502 - DNA, 25 bp, Mus musculus
agccctgatgcttctcactgagaag

SEQ ID NO: 173503 - DNA, 25 bp, Mus musculus
agccctgatgtactgaccagcccag

SEQ ID NO: 173504 - DNA, 25 bp, Mus musculus
agccctgatgtagtgaccagcccag

SEQ ID NO: 173505 - DNA, 25 bp, Mus musculus
agccctgcacatctctgcatgaatg

SEQ ID NO: 173506 - DNA, 25 bp, Mus musculus
agccctgcacatgtctgcatgaatg

SEQ ID NO: 173507 - DNA, 25 bp, Mus musculus
agccctgcaccaagatgaccatgag

SEQ ID NO: 173508 - DNA, 25 bp, Mus musculus
agccctgcaccatgatgaccatgag

SEQ ID NO: 173509 - DNA, 25 bp, Mus musculus
agccctgcagacacattagatctct

SEQ ID NO: 173510 - DNA, 25 bp, Mus musculus
agccctgcagacagccacgaaagag

SEQ ID NO: 173511 - DNA, 25 bp, Mus musculus
agccctgcagactcattagatctct

SEQ ID NO: 173512 - DNA, 25 bp, Mus musculus
agccctgcagactgccacgaaagag

SEQ ID NO: 173513 - DNA, 25 bp, Mus musculus
agccctgcagcaagcccgaaaagat

SEQ ID NO: 173514 - DNA, 25 bp, Mus musculus
agccctgcagcatgcccgaaaagat

SEQ ID NO: 173515 - DNA, 25 bp, Mus musculus
agccctgcatgcaaagcagactgca

SEQ ID NO: 173516 - DNA, 25 bp, Mus musculus
agccctgcatgctaagcagactgca

SEQ ID NO: 173517 - DNA, 25 bp, Mus musculus
agccctgcatgtagcctggcttgga

SEQ ID NO: 173518 - DNA, 25 bp, Mus musculus
agccctgcatgttgcctggcttgga

SEQ ID NO: 173519 - DNA, 25 bp, Mus musculus
agccctgccagtaactcatggattg

SEQ ID NO: 173520 - DNA, 25 bp, Mus musculus
agccctgccagttactcatggattg

SEQ ID NO: 173521 - DNA, 25 bp, Mus musculus
agccctgccatgagcctgagaagca

SEQ ID NO: 173522 - DNA, 25 bp, Mus musculus
agccctgccatgagctggtaacatg

SEQ ID NO: 173523 - DNA, 25 bp, Mus musculus
agccctgccatgtgcctgagaagca

SEQ ID NO: 173524 - DNA, 25 bp, Mus musculus
agccctgccatgtgctggtaacatg

SEQ ID NO: 173525 - DNA, 25 bp, Mus musculus
agccctgcccggataagttgacata

SEQ ID NO: 173526 - DNA, 25 bp, Mus musculus
agccctgcccggttaagttgacata

SEQ ID NO: 173527 - DNA, 25 bp, Mus musculus
agccctgcccttcttgctgggagga

SEQ ID NO: 173528 - DNA, 25 bp, Mus musculus
agccctgcccttgttgctgggagga

SEQ ID NO: 173529 - DNA, 25 bp, Mus musculus
agccctgcctcaaccatgtgattgg

SEQ ID NO: 173530 - DNA, 25 bp, Mus musculus
agccctgcctcatccatgtgattgg

SEQ ID NO: 173531 - DNA, 25 bp, Mus musculus
agccctgcctgcagatagatgcatg

SEQ ID NO: 173532 - DNA, 25 bp, Mus musculus
agccctgcctgctgatagatgcatg

SEQ ID NO: 173533 - DNA, 25 bp, Mus musculus
agccctgcctggacaagttccatga

SEQ ID NO: 173534 - DNA, 25 bp, Mus musculus
agccctgcctggtcaagttccatga

SEQ ID NO: 173535 - DNA, 25 bp, Mus musculus
agccctgccttaatgaatcttacac

SEQ ID NO: 173536 - DNA, 25 bp, Mus musculus
agccctgccttattgaatcttacac

SEQ ID NO: 173537 - DNA, 25 bp, Mus musculus
agccctgcgattcagctgcatggta

SEQ ID NO: 173538 - DNA, 25 bp, Mus musculus
agccctgcgattgagctgcatggta

SEQ ID NO: 173539 - DNA, 25 bp, Mus musculus
agccctgcgcacctaggactgaatt

SEQ ID NO: 173540 - DNA, 25 bp, Mus musculus
agccctgcgcacgtaggactgaatt

SEQ ID NO: 173541 - DNA, 25 bp, Mus musculus
agccctgctacactgagtgtgtctc

SEQ ID NO: 173542 - DNA, 25 bp, Mus musculus
agccctgctacagtgagtgtgtctc

SEQ ID NO: 173543 - DNA, 25 bp, Mus musculus
agccctgctcagcaatcgaggagtc

SEQ ID NO: 173544 - DNA, 25 bp, Mus musculus
agccctgctcaggaatcgaggagtc

SEQ ID NO: 173545 - DNA, 25 bp, Mus musculus
agccctgctcctagttcattgtaaa

SEQ ID NO: 173546 - DNA, 25 bp, Mus musculus
agccctgctccttgttcattgtaaa

SEQ ID NO: 173547 - DNA, 25 bp, Mus musculus
agccctgctctaagggaaatgtccc

SEQ ID NO: 173548 - DNA, 25 bp, Mus musculus
agccctgctctatgggaaatgtccc

SEQ ID NO: 173549 - DNA, 25 bp, Mus musculus
agccctgctgcacacgaagaaccag

SEQ ID NO: 173550 - DNA, 25 bp, Mus musculus
agccctgctgcacccggtgcttgga

SEQ ID NO: 173551 - DNA, 25 bp, Mus musculus
agccctgctgcagacgaagaaccag

SEQ ID NO: 173552 - DNA, 25 bp, Mus musculus
agccctgctgcagccggtgcttgga

SEQ ID NO: 173553 - DNA, 25 bp, Mus musculus
agccctgctggcaagattacgagct

SEQ ID NO: 173554 - DNA, 25 bp, Mus musculus
agccctgctggctagattacgagct

SEQ ID NO: 173555 - DNA, 25 bp, Mus musculus
agccctgctgtaaaaacttgcactt

SEQ ID NO: 173556 - DNA, 25 bp, Mus musculus
agccctgctgtataaacttgcactt

SEQ ID NO: 173557 - DNA, 25 bp, Mus musculus
agccctgcttcacacaaaccaggag

SEQ ID NO: 173558 - DNA, 25 bp, Mus musculus
agccctgcttcagacaaaccaggag

SEQ ID NO: 173559 - DNA, 25 bp, Mus musculus
agccctgctttccatgtaacactga

SEQ ID NO: 173560 - DNA, 25 bp, Mus musculus
agccctgctttcgatgtaacactga

SEQ ID NO: 173561 - DNA, 25 bp, Mus musculus
agccctggacatcatttacacactg

SEQ ID NO: 173562 - DNA, 25 bp, Mus musculus
agccctggacatgatttacacactg

SEQ ID NO: 173563 - DNA, 25 bp, Mus musculus
agccctggacgcaggtgacagtcag

SEQ ID NO: 173564 - DNA, 25 bp, Mus musculus
agccctggacgctggtgacagtcag

SEQ ID NO: 173565 - DNA, 25 bp, Mus musculus
agccctggaggaagctatgacacca

SEQ ID NO: 173566 - DNA, 25 bp, Mus musculus
agccctggaggatgctatgacacca

SEQ ID NO: 173567 - DNA, 25 bp, Mus musculus
agccctggatccactgttcagaatc

SEQ ID NO: 173568 - DNA, 25 bp, Mus musculus
agccctggatcctctgttcagaatc

SEQ ID NO: 173569 - DNA, 25 bp, Mus musculus
agccctggcaaaccctatgtgcgaa

SEQ ID NO: 173570 - DNA, 25 bp, Mus musculus
agccctggcaaagcctatgtgcgaa

SEQ ID NO: 173571 - DNA, 25 bp, Mus musculus
agccctggcagcagtggttcgtccc

SEQ ID NO: 173572 - DNA, 25 bp, Mus musculus
agccctggcagctgtggttcgtccc

SEQ ID NO: 173573 - DNA, 25 bp, Mus musculus
agccctggccacacagtaggttaag

SEQ ID NO: 173574 - DNA, 25 bp, Mus musculus
agccctggccactcagtaggttaag

SEQ ID NO: 173575 - DNA, 25 bp, Mus musculus
agccctggccagatcagtaagtcaa

SEQ ID NO: 173576 - DNA, 25 bp, Mus musculus
agccctggccagttcagtaagtcaa

SEQ ID NO: 173577 - DNA, 25 bp, Mus musculus
agccctggccttcatcaattctgtg

SEQ ID NO: 173578 - DNA, 25 bp, Mus musculus
agccctggccttgatcaattctgtg

SEQ ID NO: 173579 - DNA, 25 bp, Mus musculus
agccctggctacaaccttcagaagt

SEQ ID NO: 173580 - DNA, 25 bp, Mus musculus
agccctggctactaccttcagaagt

SEQ ID NO: 173581 - DNA, 25 bp, Mus musculus
agccctggctctctggttttgtgtc

SEQ ID NO: 173582 - DNA, 25 bp, Mus musculus
agccctggctctgtggttttgtgtc

SEQ ID NO: 173583 - DNA, 25 bp, Mus musculus
agccctggctgcataggagcgctta

SEQ ID NO: 173584 - DNA, 25 bp, Mus musculus
agccctggctgcatcttgaattaag

SEQ ID NO: 173585 - DNA, 25 bp, Mus musculus
agccctggctgcttaggagcgctta

SEQ ID NO: 173586 - DNA, 25 bp, Mus musculus
agccctggctgcttcttgaattaag

SEQ ID NO: 173587 - DNA, 25 bp, Mus musculus
agccctggctgtatgcttcatagca

SEQ ID NO: 173588 - DNA, 25 bp, Mus musculus
agccctggctgtctgagatcatgaa

SEQ ID NO: 173589 - DNA, 25 bp, Mus musculus
agccctggctgtgtgagatcatgaa

SEQ ID NO: 173590 - DNA, 25 bp, Mus musculus
agccctggctgtttgcttcatagca

SEQ ID NO: 173591 - DNA, 25 bp, Mus musculus
agccctggcttcagctacggaatga

SEQ ID NO: 173592 - DNA, 25 bp, Mus musculus
agccctggcttctgctacggaatga

SEQ ID NO: 173593 - DNA, 25 bp, Mus musculus
agccctgggaatctgcaccgaggaa

SEQ ID NO: 173594 - DNA, 25 bp, Mus musculus
agccctgggaatgtgcaccgaggaa

SEQ ID NO: 173595 - DNA, 25 bp, Mus musculus
agccctgggctcagagacttatgtt

SEQ ID NO: 173596 - DNA, 25 bp, Mus musculus
agccctgggctctgagacttatgtt

SEQ ID NO: 173597 - DNA, 25 bp, Mus musculus
agccctgggctgctgaaataataaa

SEQ ID NO: 173598 - DNA, 25 bp, Mus musculus
agccctgggctggtgaaataataaa

SEQ ID NO: 173599 - DNA, 25 bp, Mus musculus
agccctgggtagaaaggccactgcc

SEQ ID NO: 173600 - DNA, 25 bp, Mus musculus
agccctgggtagtaaggccactgcc

SEQ ID NO: 173601 - DNA, 25 bp, Mus musculus
agccctggtacactactctagatgt

SEQ ID NO: 173602 - DNA, 25 bp, Mus musculus
agccctggtacagtactctagatgt

SEQ ID NO: 173603 - DNA, 25 bp, Mus musculus
agccctggtcaccattggcgtgaga

SEQ ID NO: 173604 - DNA, 25 bp, Mus musculus
agccctggtcacgattggcgtgaga

SEQ ID NO: 173605 - DNA, 25 bp, Mus musculus
agccctggtcagctgcttaaggaaa

SEQ ID NO: 173606 - DNA, 25 bp, Mus musculus
agccctggtcaggtgcttaaggaaa

SEQ ID NO: 173607 - DNA, 25 bp, Mus musculus
agccctggtgccatgggtgagattc

SEQ ID NO: 173608 - DNA, 25 bp, Mus musculus
agccctggtgccttgggtgagattc

SEQ ID NO: 173609 - DNA, 25 bp, Mus musculus
agccctggtgcgaagactgtgtgaa

SEQ ID NO: 173610 - DNA, 25 bp, Mus musculus
agccctggtgcgctgcaatatgaag

SEQ ID NO: 173611 - DNA, 25 bp, Mus musculus
agccctggtgcggtgcaatatgaag

SEQ ID NO: 173612 - DNA, 25 bp, Mus musculus
agccctggtgcgtagactgtgtgaa

SEQ ID NO: 173613 - DNA, 25 bp, Mus musculus
agccctggttagcatgtgaccttca

SEQ ID NO: 173614 - DNA, 25 bp, Mus musculus
agccctggttaggatgtgaccttca

SEQ ID NO: 173615 - DNA, 25 bp, Mus musculus
agccctggttccagtatgcactcct

SEQ ID NO: 173616 - DNA, 25 bp, Mus musculus
agccctggttcctgtatgcactcct

SEQ ID NO: 173617 - DNA, 25 bp, Mus musculus
agccctgtaaggaagttcttgccca

SEQ ID NO: 173618 - DNA, 25 bp, Mus musculus
agccctgtaaggtagttcttgccca

SEQ ID NO: 173619 - DNA, 25 bp, Mus musculus
agccctgtagaactcgcccgaataa

SEQ ID NO: 173620 - DNA, 25 bp, Mus musculus
agccctgtagaagtcgcccgaataa

SEQ ID NO: 173621 - DNA, 25 bp, Mus musculus
agccctgtatctcgcacttggttta

SEQ ID NO: 173622 - DNA, 25 bp, Mus musculus
agccctgtatctggcacttggttta

SEQ ID NO: 173623 - DNA, 25 bp, Mus musculus
agccctgtcaggaactgggaccctc

SEQ ID NO: 173624 - DNA, 25 bp, Mus musculus
agccctgtcaggtactgggaccctc

SEQ ID NO: 173625 - DNA, 25 bp, Mus musculus
agccctgtcagtatcttgtaagtca

SEQ ID NO: 173626 - DNA, 25 bp, Mus musculus
agccctgtcagtttcttgtaagtca

SEQ ID NO: 173627 - DNA, 25 bp, Mus musculus
agccctgtccgactctgttctataa

SEQ ID NO: 173628 - DNA, 25 bp, Mus musculus
agccctgtccgagtctgttctataa

SEQ ID NO: 173629 - DNA, 25 bp, Mus musculus
agccctgtcctcagatggaccaaac

SEQ ID NO: 173630 - DNA, 25 bp, Mus musculus
agccctgtcctctgatggaccaaac

SEQ ID NO: 173631 - DNA, 25 bp, Mus musculus
agccctgtcctgctgggttctagaa

SEQ ID NO: 173632 - DNA, 25 bp, Mus musculus
agccctgtcctggtgggttctagaa

SEQ ID NO: 173633 - DNA, 25 bp, Mus musculus
agccctgtctcaaggcataagcatg

SEQ ID NO: 173634 - DNA, 25 bp, Mus musculus
agccctgtctcactgacactcatat

SEQ ID NO: 173635 - DNA, 25 bp, Mus musculus
agccctgtctcagtgacactcatat

SEQ ID NO: 173636 - DNA, 25 bp, Mus musculus
agccctgtctcatggcataagcatg

SEQ ID NO: 173637 - DNA, 25 bp, Mus musculus
agccctgtgaaacctagatcctttt

SEQ ID NO: 173638 - DNA, 25 bp, Mus musculus
agccctgtgaaagctagatcctttt

SEQ ID NO: 173639 - DNA, 25 bp, Mus musculus
agccctgtgaagagagaatgtctct

SEQ ID NO: 173640 - DNA, 25 bp, Mus musculus
agccctgtgaagtgagaatgtctct

SEQ ID NO: 173641 - DNA, 25 bp, Mus musculus
agccctgtgggaagcttcggatgaa

SEQ ID NO: 173642 - DNA, 25 bp, Mus musculus
agccctgtgggatgcttcggatgaa

SEQ ID NO: 173643 - DNA, 25 bp, Mus musculus
agccctgtgggtactcatgtggaaa

SEQ ID NO: 173644 - DNA, 25 bp, Mus musculus
agccctgtgggttctcatgtggaaa

SEQ ID NO: 173645 - DNA, 25 bp, Mus musculus
agccctgtggtgatcacgacgcaca

SEQ ID NO: 173646 - DNA, 25 bp, Mus musculus
agccctgtggtgttcacgacgcaca

SEQ ID NO: 173647 - DNA, 25 bp, Mus musculus
agccctgtggttcgcagtctcatga

SEQ ID NO: 173648 - DNA, 25 bp, Mus musculus
agccctgtggttggcagtctcatga

SEQ ID NO: 173649 - DNA, 25 bp, Mus musculus
agccctgtgtggagaccctgtctgt

SEQ ID NO: 173650 - DNA, 25 bp, Mus musculus
agccctgtgtggtgaccctgtctgt

SEQ ID NO: 173651 - DNA, 25 bp, Mus musculus
agccctgttagaaggtccctttgca

SEQ ID NO: 173652 - DNA, 25 bp, Mus musculus
agccctgttagatggtccctttgca

SEQ ID NO: 173653 - DNA, 25 bp, Mus musculus
agccctgttaggcagcttgagacag

SEQ ID NO: 173654 - DNA, 25 bp, Mus musculus
agccctgttagggagcttgagacag

SEQ ID NO: 173655 - DNA, 25 bp, Mus musculus
agccctgttccgaagcaatacaaag

SEQ ID NO: 173656 - DNA, 25 bp, Mus musculus
agccctgttccgtagcaatacaaag

SEQ ID NO: 173657 - DNA, 25 bp, Mus musculus
agccctgttctgaccaaatcacgat

SEQ ID NO: 173658 - DNA, 25 bp, Mus musculus
agccctgttctgtccaaatcacgat

SEQ ID NO: 173659 - DNA, 25 bp, Mus musculus
agccctgttgccataatagagctgg

SEQ ID NO: 173660 - DNA, 25 bp, Mus musculus
agccctgttgccttaatagagctgg

SEQ ID NO: 173661 - DNA, 25 bp, Mus musculus
agccctgttgctagggaggtagcta

SEQ ID NO: 173662 - DNA, 25 bp, Mus musculus
agccctgttgcttgggaggtagcta

SEQ ID NO: 173663 - DNA, 25 bp, Mus musculus
agccctgttgtccaccattctagtg

SEQ ID NO: 173664 - DNA, 25 bp, Mus musculus
agccctgttgtcgaccattctagtg

SEQ ID NO: 173665 - DNA, 25 bp, Mus musculus
agcccttaaaggcagagtactaaca

SEQ ID NO: 173666 - DNA, 25 bp, Mus musculus
agcccttaaagggagagtactaaca

SEQ ID NO: 173667 - DNA, 25 bp, Mus musculus
agcccttaaagtcaggagtcttatg

SEQ ID NO: 173668 - DNA, 25 bp, Mus musculus
agcccttaaagtgaggagtcttatg

SEQ ID NO: 173669 - DNA, 25 bp, Mus musculus
agcccttacagtaacccttgatggt

SEQ ID NO: 173670 - DNA, 25 bp, Mus musculus
agcccttacagttacccttgatggt

SEQ ID NO: 173671 - DNA, 25 bp, Mus musculus
agcccttaggagctctgaaagttca

SEQ ID NO: 173672 - DNA, 25 bp, Mus musculus
agcccttaggaggtctgaaagttca

SEQ ID NO: 173673 - DNA, 25 bp, Mus musculus
agcccttaggccaattgaacttact

SEQ ID NO: 173674 - DNA, 25 bp, Mus musculus
agcccttaggcctattgaacttact

SEQ ID NO: 173675 - DNA, 25 bp, Mus musculus
agcccttagggtcagcatactcaaa

SEQ ID NO: 173676 - DNA, 25 bp, Mus musculus
agcccttagggtgagcatactcaaa

SEQ ID NO: 173677 - DNA, 25 bp, Mus musculus
agcccttaggtcaggagtcagcaga

SEQ ID NO: 173678 - DNA, 25 bp, Mus musculus
agcccttaggtctggagtcagcaga

SEQ ID NO: 173679 - DNA, 25 bp, Mus musculus
agcccttagtgaacatgtgctattg

SEQ ID NO: 173680 - DNA, 25 bp, Mus musculus
agcccttagtgatcatgtgctattg

SEQ ID NO: 173681 - DNA, 25 bp, Mus musculus
agcccttatcttataaatattgtgg

SEQ ID NO: 173682 - DNA, 25 bp, Mus musculus
agcccttatcttttaaatattgtgg

SEQ ID NO: 173683 - DNA, 25 bp, Mus musculus
agcccttcaagaacacaggagtgtt

SEQ ID NO: 173684 - DNA, 25 bp, Mus musculus
agcccttcaagatcacaggagtgtt

SEQ ID NO: 173685 - DNA, 25 bp, Mus musculus
agcccttcaagtctggagcgtttta

SEQ ID NO: 173686 - DNA, 25 bp, Mus musculus
agcccttcaagtgtggagcgtttta

SEQ ID NO: 173687 - DNA, 25 bp, Mus musculus
agcccttcaatccagtatgcagcag

SEQ ID NO: 173688 - DNA, 25 bp, Mus musculus
agcccttcaatcgagtatgcagcag

SEQ ID NO: 173689 - DNA, 25 bp, Mus musculus
agcccttcacccctgtgataacagg

SEQ ID NO: 173690 - DNA, 25 bp, Mus musculus
agcccttcacccgtgtgataacagg

SEQ ID NO: 173691 - DNA, 25 bp, Mus musculus
agcccttcagaacagagcccggtat

SEQ ID NO: 173692 - DNA, 25 bp, Mus musculus
agcccttcagaagagagcccggtat

SEQ ID NO: 173693 - DNA, 25 bp, Mus musculus
agcccttcagataccggcagtgata

SEQ ID NO: 173694 - DNA, 25 bp, Mus musculus
agcccttcagattccggcagtgata

SEQ ID NO: 173695 - DNA, 25 bp, Mus musculus
agcccttcaggcctgatgcctcagg

SEQ ID NO: 173696 - DNA, 25 bp, Mus musculus
agcccttcaggcgtgatgcctcagg

SEQ ID NO: 173697 - DNA, 25 bp, Mus musculus
agcccttcatcccatggaccatgga

SEQ ID NO: 173698 - DNA, 25 bp, Mus musculus
agcccttcatccgatggaccatgga

SEQ ID NO: 173699 - DNA, 25 bp, Mus musculus
agcccttcattcagagctgtagcga

SEQ ID NO: 173700 - DNA, 25 bp, Mus musculus
agcccttcattctgagctgtagcga

SEQ ID NO: 173701 - DNA, 25 bp, Mus musculus
agcccttccaaaccatgttcgatgt

SEQ ID NO: 173702 - DNA, 25 bp, Mus musculus
agcccttccaaagcatgttcgatgt

SEQ ID NO: 173703 - DNA, 25 bp, Mus musculus
agcccttccagaaacccaagtgtgg

SEQ ID NO: 173704 - DNA, 25 bp, Mus musculus
agcccttccagaagggtgtcttggg

SEQ ID NO: 173705 - DNA, 25 bp, Mus musculus
agcccttccagatacccaagtgtgg

SEQ ID NO: 173706 - DNA, 25 bp, Mus musculus
agcccttccagatgggtgtcttggg

SEQ ID NO: 173707 - DNA, 25 bp, Mus musculus
agcccttccatcacatacgatatca

SEQ ID NO: 173708 - DNA, 25 bp, Mus musculus
agcccttccatctcatacgatatca

SEQ ID NO: 173709 - DNA, 25 bp, Mus musculus
agcccttcctgaagctgtggtagac

SEQ ID NO: 173710 - DNA, 25 bp, Mus musculus
agcccttcctgatgctgtggtagac

SEQ ID NO: 173711 - DNA, 25 bp, Mus musculus
agcccttcctgtagattacataagc

SEQ ID NO: 173712 - DNA, 25 bp, Mus musculus
agcccttcctgttgattacataagc

SEQ ID NO: 173713 - DNA, 25 bp, Mus musculus
agcccttccttgaattgacttagca

SEQ ID NO: 173714 - DNA, 25 bp, Mus musculus
agcccttccttgtattgacttagca

SEQ ID NO: 173715 - DNA, 25 bp, Mus musculus
agcccttctagtacctcttgagtta

SEQ ID NO: 173716 - DNA, 25 bp, Mus musculus
agcccttctagttcctcttgagtta

SEQ ID NO: 173717 - DNA, 25 bp, Mus musculus
agcccttgactcaactacttaaact

SEQ ID NO: 173718 - DNA, 25 bp, Mus musculus
agcccttgactctactacttaaact

SEQ ID NO: 173719 - DNA, 25 bp, Mus musculus
agcccttgacttcgtagaactcctt

SEQ ID NO: 173720 - DNA, 25 bp, Mus musculus
agcccttgacttggtagaactcctt

SEQ ID NO: 173721 - DNA, 25 bp, Mus musculus
agcccttgagttccctgcttttgtt

SEQ ID NO: 173722 - DNA, 25 bp, Mus musculus
agcccttgagttgcctgcttttgtt

SEQ ID NO: 173723 - DNA, 25 bp, Mus musculus
agcccttgatacagatgaacctgat

SEQ ID NO: 173724 - DNA, 25 bp, Mus musculus
agcccttgatactgatgaacctgat

SEQ ID NO: 173725 - DNA, 25 bp, Mus musculus
agcccttgcagactagttcctgtga

SEQ ID NO: 173726 - DNA, 25 bp, Mus musculus
agcccttgcagagtagttcctgtga

SEQ ID NO: 173727 - DNA, 25 bp, Mus musculus
agcccttgctggagcatcagtactg

SEQ ID NO: 173728 - DNA, 25 bp, Mus musculus
agcccttgctggtgcatcagtactg

SEQ ID NO: 173729 - DNA, 25 bp, Mus musculus
agcccttgcttgaagctctcttgga

SEQ ID NO: 173730 - DNA, 25 bp, Mus musculus
agcccttgcttgtagctctcttgga

SEQ ID NO: 173731 - DNA, 25 bp, Mus musculus
agcccttggcctaggaagcgggcaa

SEQ ID NO: 173732 - DNA, 25 bp, Mus musculus
agcccttggccttggaagcgggcaa

SEQ ID NO: 173733 - DNA, 25 bp, Mus musculus
agcccttggctgaactgagcaaatg

SEQ ID NO: 173734 - DNA, 25 bp, Mus musculus
agcccttggctgtactgagcaaatg

SEQ ID NO: 173735 - DNA, 25 bp, Mus musculus
agcccttgggcactcgtcccaaatt

SEQ ID NO: 173736 - DNA, 25 bp, Mus musculus
agcccttgggcagtcgtcccaaatt

SEQ ID NO: 173737 - DNA, 25 bp, Mus musculus
agcccttggggccaccacatagagc

SEQ ID NO: 173738 - DNA, 25 bp, Mus musculus
agcccttggggcgaccacatagagc

SEQ ID NO: 173739 - DNA, 25 bp, Mus musculus
agcccttgtcaacagcctctgtgga

SEQ ID NO: 173740 - DNA, 25 bp, Mus musculus
agcccttgtcaagagcctctgtgga

SEQ ID NO: 173741 - DNA, 25 bp, Mus musculus
agccctttaaacctggtagcacata

SEQ ID NO: 173742 - DNA, 25 bp, Mus musculus
agccctttaaacgtggtagcacata

SEQ ID NO: 173743 - DNA, 25 bp, Mus musculus
agccctttaccaaagcagcatagag

SEQ ID NO: 173744 - DNA, 25 bp, Mus musculus
agccctttaccactaacagctttag

SEQ ID NO: 173745 - DNA, 25 bp, Mus musculus
agccctttaccagtaacagctttag

SEQ ID NO: 173746 - DNA, 25 bp, Mus musculus
agccctttaccatagcagcatagag

SEQ ID NO: 173747 - DNA, 25 bp, Mus musculus
agccctttcagacgctttcctcctt

SEQ ID NO: 173748 - DNA, 25 bp, Mus musculus
agccctttcagaggctttcctcctt

SEQ ID NO: 173749 - DNA, 25 bp, Mus musculus
agccctttcctccaacgagagatga

SEQ ID NO: 173750 - DNA, 25 bp, Mus musculus
agccctttcctcgaacgagagatga

SEQ ID NO: 173751 - DNA, 25 bp, Mus musculus
agccctttcctgacatttgtgtgtt

SEQ ID NO: 173752 - DNA, 25 bp, Mus musculus
agccctttcctgtcatttgtgtgtt

SEQ ID NO: 173753 - DNA, 25 bp, Mus musculus
agccctttccttcaggtactgtgtt

SEQ ID NO: 173754 - DNA, 25 bp, Mus musculus
agccctttccttgaggtactgtgtt

SEQ ID NO: 173755 - DNA, 25 bp, Mus musculus
agccctttctcaactgctataaaac

SEQ ID NO: 173756 - DNA, 25 bp, Mus musculus
agccctttctcatctgctataaaac

SEQ ID NO: 173757 - DNA, 25 bp, Mus musculus
agccctttctggagcctctgggcat

SEQ ID NO: 173758 - DNA, 25 bp, Mus musculus
agccctttctggtgcctctgggcat

SEQ ID NO: 173759 - DNA, 25 bp, Mus musculus
agccctttgagcagggcaacaccac

SEQ ID NO: 173760 - DNA, 25 bp, Mus musculus
agccctttgagctgggcaacaccac

SEQ ID NO: 173761 - DNA, 25 bp, Mus musculus
agccctttgagtcccaaacctgtgg

SEQ ID NO: 173762 - DNA, 25 bp, Mus musculus
agccctttgagtctacagtatgtgc

SEQ ID NO: 173763 - DNA, 25 bp, Mus musculus
agccctttgagtgccaaacctgtgg

SEQ ID NO: 173764 - DNA, 25 bp, Mus musculus
agccctttgagtgtacagtatgtgc

SEQ ID NO: 173765 - DNA, 25 bp, Mus musculus
agccctttggatacctaacacacag

SEQ ID NO: 173766 - DNA, 25 bp, Mus musculus
agccctttggattcctaacacacag

SEQ ID NO: 173767 - DNA, 25 bp, Mus musculus
agccctttggccatacatgtgtgtg

SEQ ID NO: 173768 - DNA, 25 bp, Mus musculus
agccctttggccttacatgtgtgtg

SEQ ID NO: 173769 - DNA, 25 bp, Mus musculus
agccctttgtgaacatgcctacaat

SEQ ID NO: 173770 - DNA, 25 bp, Mus musculus
agccctttgtgatcatgcctacaat

SEQ ID NO: 173771 - DNA, 25 bp, Mus musculus
agccctttgtgcacactaaaacaag

SEQ ID NO: 173772 - DNA, 25 bp, Mus musculus
agccctttgtgctcactaaaacaag

SEQ ID NO: 173773 - DNA, 25 bp, Mus musculus
agcccttttagtcacgtttcatttg

SEQ ID NO: 173774 - DNA, 25 bp, Mus musculus
agcccttttagtgacgtttcatttg

SEQ ID NO: 173775 - DNA, 25 bp, Mus musculus
agcccttttcaaaggctcctttata

SEQ ID NO: 173776 - DNA, 25 bp, Mus musculus
agcccttttcaatggctcctttata

SEQ ID NO: 173777 - DNA, 25 bp, Mus musculus
agcccttttcacacaaatatactac

SEQ ID NO: 173778 - DNA, 25 bp, Mus musculus
agcccttttcactcaaatatactac

SEQ ID NO: 173779 - DNA, 25 bp, Mus musculus
agcccttttctgcaatctgaggtct

SEQ ID NO: 173780 - DNA, 25 bp, Mus musculus
agcccttttctggaatctgaggtct

SEQ ID NO: 173781 - DNA, 25 bp, Mus musculus
agcccttttgctcagatggtcagaa

SEQ ID NO: 173782 - DNA, 25 bp, Mus musculus
agcccttttgctgagatggtcagaa

SEQ ID NO: 173783 - DNA, 25 bp, Mus musculus
agccctttttatctcttggtgctag

SEQ ID NO: 173784 - DNA, 25 bp, Mus musculus
agccctttttatgtcttggtgctag

SEQ ID NO: 173785 - DNA, 25 bp, Mus musculus
agccctttttctcccagtaatgcac

SEQ ID NO: 173786 - DNA, 25 bp, Mus musculus
agccctttttctgccagtaatgcac

SEQ ID NO: 173787 - DNA, 25 bp, Mus musculus
agccgaaaaggcatcacattcttac

SEQ ID NO: 173788 - DNA, 25 bp, Mus musculus
agccgaaaaggcttcacattcttac

SEQ ID NO: 173789 - DNA, 25 bp, Mus musculus
agccgaaaagtcaatcagtgtgagt

SEQ ID NO: 173790 - DNA, 25 bp, Mus musculus
agccgaaaagtctatcagtgtgagt

SEQ ID NO: 173791 - DNA, 25 bp, Mus musculus
agccgaaactctacatcattcaggc

SEQ ID NO: 173792 - DNA, 25 bp, Mus musculus
agccgaaactcttcatcattcaggc

SEQ ID NO: 173793 - DNA, 25 bp, Mus musculus
agccgaaagctaaatcaatctcatt

SEQ ID NO: 173794 - DNA, 25 bp, Mus musculus
agccgaaagctatatcaatctcatt

SEQ ID NO: 173795 - DNA, 25 bp, Mus musculus
agccgaacagaaactccttgtgcca

SEQ ID NO: 173796 - DNA, 25 bp, Mus musculus
agccgaacagaatctccttgtgcca

SEQ ID NO: 173797 - DNA, 25 bp, Mus musculus
agccgaagaggcagtgttcagcagt

SEQ ID NO: 173798 - DNA, 25 bp, Mus musculus
agccgaagaggctgtgttcagcagt

SEQ ID NO: 173799 - DNA, 25 bp, Mus musculus
agccgaagctcaaactgtggcttac

SEQ ID NO: 173800 - DNA, 25 bp, Mus musculus
agccgaagctcatactgtggcttac

SEQ ID NO: 173801 - DNA, 25 bp, Mus musculus
agccgaagtcgcagggtcagcttga

SEQ ID NO: 173802 - DNA, 25 bp, Mus musculus
agccgaagtcgctgggtcagcttga

SEQ ID NO: 173803 - DNA, 25 bp, Mus musculus
agccgaatcaggatcaggccacgtt

SEQ ID NO: 173804 - DNA, 25 bp, Mus musculus
agccgaatcaggttcaggccacgtt

SEQ ID NO: 173805 - DNA, 25 bp, Mus musculus
agccgaatctttcatgtcctcctac

SEQ ID NO: 173806 - DNA, 25 bp, Mus musculus
agccgaatctttgatgtcctcctac

SEQ ID NO: 173807 - DNA, 25 bp, Mus musculus
agccgaatttgtcaatgtctcctaa

SEQ ID NO: 173808 - DNA, 25 bp, Mus musculus
agccgaatttgtgaatgtctcctaa

SEQ ID NO: 173809 - DNA, 25 bp, Mus musculus
agccgacattgtcttcgtgctcaaa

SEQ ID NO: 173810 - DNA, 25 bp, Mus musculus
agccgacattgtgttcgtgctcaaa

SEQ ID NO: 173811 - DNA, 25 bp, Mus musculus
agccgacattttaatggcatccaaa

SEQ ID NO: 173812 - DNA, 25 bp, Mus musculus
agccgacatttttatggcatccaaa

SEQ ID NO: 173813 - DNA, 25 bp, Mus musculus
agccgaccagcgcaggattctactt

SEQ ID NO: 173814 - DNA, 25 bp, Mus musculus
agccgaccagcggaggattctactt

SEQ ID NO: 173815 - DNA, 25 bp, Mus musculus
agccgaccgaccatcagcaaaagta

SEQ ID NO: 173816 - DNA, 25 bp, Mus musculus
agccgaccgaccttcagcaaaagta

SEQ ID NO: 173817 - DNA, 25 bp, Mus musculus
agccgacctcctaatggaaaagctg

SEQ ID NO: 173818 - DNA, 25 bp, Mus musculus
agccgacctccttatggaaaagctg

SEQ ID NO: 173819 - DNA, 25 bp, Mus musculus
agccgaccttgcagattgtcacaag

SEQ ID NO: 173820 - DNA, 25 bp, Mus musculus
agccgaccttgctgattgtcacaag

SEQ ID NO: 173821 - DNA, 25 bp, Mus musculus
agccgacgagaaccgatttgcccag

SEQ ID NO: 173822 - DNA, 25 bp, Mus musculus
agccgacgagaagcgatttgcccag

SEQ ID NO: 173823 - DNA, 25 bp, Mus musculus
agccgacgtagtcacattctcctgt

SEQ ID NO: 173824 - DNA, 25 bp, Mus musculus
agccgacgtagtgacattctcctgt

SEQ ID NO: 173825 - DNA, 25 bp, Mus musculus
agccgactagaaaagctgttccttt

SEQ ID NO: 173826 - DNA, 25 bp, Mus musculus
agccgactagaatagctgttccttt

SEQ ID NO: 173827 - DNA, 25 bp, Mus musculus
agccgactcaacctaagtgtttgat

SEQ ID NO: 173828 - DNA, 25 bp, Mus musculus
agccgactcaacgtaagtgtttgat

SEQ ID NO: 173829 - DNA, 25 bp, Mus musculus
agccgactcctgcaagctgaggcat

SEQ ID NO: 173830 - DNA, 25 bp, Mus musculus
agccgactcctggaagctgaggcat

SEQ ID NO: 173831 - DNA, 25 bp, Mus musculus
agccgactgagtctacaagcatcct

SEQ ID NO: 173832 - DNA, 25 bp, Mus musculus
agccgactgagtgtacaagcatcct

SEQ ID NO: 173833 - DNA, 25 bp, Mus musculus
agccgactggatctcctgggtgcct

SEQ ID NO: 173834 - DNA, 25 bp, Mus musculus
agccgactggatgtcctgggtgcct

SEQ ID NO: 173835 - DNA, 25 bp, Mus musculus
agccgagaaactctatttttccact

SEQ ID NO: 173836 - DNA, 25 bp, Mus musculus
agccgagaaactgtatttttccact

SEQ ID NO: 173837 - DNA, 25 bp, Mus musculus
agccgagaactcctgactattaaga

SEQ ID NO: 173838 - DNA, 25 bp, Mus musculus
agccgagaactcgtgactattaaga

SEQ ID NO: 173839 - DNA, 25 bp, Mus musculus
agccgagaagcgcaagaggtcttcc

SEQ ID NO: 173840 - DNA, 25 bp, Mus musculus
agccgagaagcggaagaggtcttcc

SEQ ID NO: 173841 - DNA, 25 bp, Mus musculus
agccgagaattccagttagaccagc

SEQ ID NO: 173842 - DNA, 25 bp, Mus musculus
agccgagaattcgagttagaccagc

SEQ ID NO: 173843 - DNA, 25 bp, Mus musculus
agccgagacctccaggaatccataa

SEQ ID NO: 173844 - DNA, 25 bp, Mus musculus
agccgagacctcgaggaatccataa

SEQ ID NO: 173845 - DNA, 25 bp, Mus musculus
agccgagactggcacaggactcacc

SEQ ID NO: 173846 - DNA, 25 bp, Mus musculus
agccgagactgggacaggactcacc

SEQ ID NO: 173847 - DNA, 25 bp, Mus musculus
agccgagagcatcgactgcttctta

SEQ ID NO: 173848 - DNA, 25 bp, Mus musculus
agccgagagcatggactgcttctta

SEQ ID NO: 173849 - DNA, 25 bp, Mus musculus
agccgagatgatacaggttctgggc

SEQ ID NO: 173850 - DNA, 25 bp, Mus musculus
agccgagatgattcaggttctgggc

SEQ ID NO: 173851 - DNA, 25 bp, Mus musculus
agccgagattagaaccttggtcttt

SEQ ID NO: 173852 - DNA, 25 bp, Mus musculus
agccgagattagtaccttggtcttt

SEQ ID NO: 173853 - DNA, 25 bp, Mus musculus
agccgagcagacaccgggtatcaga

SEQ ID NO: 173854 - DNA, 25 bp, Mus musculus
agccgagcagactccgggtatcaga

SEQ ID NO: 173855 - DNA, 25 bp, Mus musculus
agccgagcagccagctagcaggtga

SEQ ID NO: 173856 - DNA, 25 bp, Mus musculus
agccgagcagcctgctagcaggtga

SEQ ID NO: 173857 - DNA, 25 bp, Mus musculus
agccgagcagtgatcaccgagcgag

SEQ ID NO: 173858 - DNA, 25 bp, Mus musculus
agccgagcagtgttcaccgagcgag

SEQ ID NO: 173859 - DNA, 25 bp, Mus musculus
agccgagccgtcaccataagtaaat

SEQ ID NO: 173860 - DNA, 25 bp, Mus musculus
agccgagccgtctccataagtaaat

SEQ ID NO: 173861 - DNA, 25 bp, Mus musculus
agccgagctccacggacttggtgtt

SEQ ID NO: 173862 - DNA, 25 bp, Mus musculus
agccgagctccagggacttggtgtt

SEQ ID NO: 173863 - DNA, 25 bp, Mus musculus
agccgaggagagaggataagtcaca

SEQ ID NO: 173864 - DNA, 25 bp, Mus musculus
agccgaggagagtggataagtcaca

SEQ ID NO: 173865 - DNA, 25 bp, Mus musculus
agccgaggcaaccactgtgcagcgt

SEQ ID NO: 173866 - DNA, 25 bp, Mus musculus
agccgaggcaacgactgtgcagcgt

SEQ ID NO: 173867 - DNA, 25 bp, Mus musculus
agccgaggcagcagttttcctggga

SEQ ID NO: 173868 - DNA, 25 bp, Mus musculus
agccgaggcagctgttttcctggga

SEQ ID NO: 173869 - DNA, 25 bp, Mus musculus
agccgaggtgggataacatgttcta

SEQ ID NO: 173870 - DNA, 25 bp, Mus musculus
agccgaggtgggttaacatgttcta

SEQ ID NO: 173871 - DNA, 25 bp, Mus musculus
agccgagtacagagacagctcttac

SEQ ID NO: 173872 - DNA, 25 bp, Mus musculus
agccgagtacagtgacagctcttac

SEQ ID NO: 173873 - DNA, 25 bp, Mus musculus
agccgagtcttacccctgagagatt

SEQ ID NO: 173874 - DNA, 25 bp, Mus musculus
agccgagtcttagccctgagagatt

SEQ ID NO: 173875 - DNA, 25 bp, Mus musculus
agccgagtgaggcttccccactgtt

SEQ ID NO: 173876 - DNA, 25 bp, Mus musculus
agccgagtgagggttccccactgtt

SEQ ID NO: 173877 - DNA, 25 bp, Mus musculus
agccgagtggaacgtgcaccccgaa

SEQ ID NO: 173878 - DNA, 25 bp, Mus musculus
agccgagtggaaggtgcaccccgaa

SEQ ID NO: 173879 - DNA, 25 bp, Mus musculus
agccgagtgtgcagtagaccgcaga

SEQ ID NO: 173880 - DNA, 25 bp, Mus musculus
agccgagtgtgctgtagaccgcaga

SEQ ID NO: 173881 - DNA, 25 bp, Mus musculus
agccgagtgttcaaatgcctgagac

SEQ ID NO: 173882 - DNA, 25 bp, Mus musculus
agccgagtgttctaatgcctgagac

SEQ ID NO: 173883 - DNA, 25 bp, Mus musculus
agccgatacttacgtcttcagccaa

SEQ ID NO: 173884 - DNA, 25 bp, Mus musculus
agccgatacttaggtcttcagccaa

SEQ ID NO: 173885 - DNA, 25 bp, Mus musculus
agccgatcgttgatcagtggccaga

SEQ ID NO: 173886 - DNA, 25 bp, Mus musculus
agccgatcgttgttcagtggccaga

SEQ ID NO: 173887 - DNA, 25 bp, Mus musculus
agccgatgcagtactgggcgttctc

SEQ ID NO: 173888 - DNA, 25 bp, Mus musculus
agccgatgcagttctgggcgttctc

SEQ ID NO: 173889 - DNA, 25 bp, Mus musculus
agccgatgccccaggtgggaaagaa

SEQ ID NO: 173890 - DNA, 25 bp, Mus musculus
agccgatgcccctggtgggaaagaa

SEQ ID NO: 173891 - DNA, 25 bp, Mus musculus
agccgatgcctgagcagtctgcact

SEQ ID NO: 173892 - DNA, 25 bp, Mus musculus
agccgatgcctgtgcagtctgcact

SEQ ID NO: 173893 - DNA, 25 bp, Mus musculus
agccgatggcagagaacgccactgt

SEQ ID NO: 173894 - DNA, 25 bp, Mus musculus
agccgatggcagtgaacgccactgt

SEQ ID NO: 173895 - DNA, 25 bp, Mus musculus
agccgatgtatgaatccctgtacaa

SEQ ID NO: 173896 - DNA, 25 bp, Mus musculus
agccgatgtatgtatccctgtacaa

SEQ ID NO: 173897 - DNA, 25 bp, Mus musculus
agccgatgtggcaatctgtctgcct

SEQ ID NO: 173898 - DNA, 25 bp, Mus musculus
agccgatgtggctatctgtctgcct

SEQ ID NO: 173899 - DNA, 25 bp, Mus musculus
agccgatgtttaacctccacgagta

SEQ ID NO: 173900 - DNA, 25 bp, Mus musculus
agccgatgtttatcctccacgagta

SEQ ID NO: 173901 - DNA, 25 bp, Mus musculus
agccgattaagacccaggtgctgct

SEQ ID NO: 173902 - DNA, 25 bp, Mus musculus
agccgattaagagccaggtgctgct

SEQ ID NO: 173903 - DNA, 25 bp, Mus musculus
agccgattatcactgggtcacttga

SEQ ID NO: 173904 - DNA, 25 bp, Mus musculus
agccgattatcagtgggtcacttga

SEQ ID NO: 173905 - DNA, 25 bp, Mus musculus
agccgattcattaaccacctgtgtg

SEQ ID NO: 173906 - DNA, 25 bp, Mus musculus
agccgattcatttaccacctgtgtg

SEQ ID NO: 173907 - DNA, 25 bp, Mus musculus
agccgattgtccaatctccagcggc

SEQ ID NO: 173908 - DNA, 25 bp, Mus musculus
agccgattgtcctatctccagcggc

SEQ ID NO: 173909 - DNA, 25 bp, Mus musculus
agccgattttaacgagacacttctt

SEQ ID NO: 173910 - DNA, 25 bp, Mus musculus
agccgattttaaggagacacttctt

SEQ ID NO: 173911 - DNA, 25 bp, Mus musculus
agccgcaaaatgatcttcaatggac

SEQ ID NO: 173912 - DNA, 25 bp, Mus musculus
agccgcaaaatgttcttcaatggac

SEQ ID NO: 173913 - DNA, 25 bp, Mus musculus
agccgcacaagaacctaccatgaag

SEQ ID NO: 173914 - DNA, 25 bp, Mus musculus
agccgcacaagatcctaccatgaag

SEQ ID NO: 173915 - DNA, 25 bp, Mus musculus
agccgcacagctcggagtggcatca

SEQ ID NO: 173916 - DNA, 25 bp, Mus musculus
agccgcacagctgggagtggcatca

SEQ ID NO: 173917 - DNA, 25 bp, Mus musculus
agccgcaggagcagctgacgctaga

SEQ ID NO: 173918 - DNA, 25 bp, Mus musculus
agccgcaggagctgctgacgctaga

SEQ ID NO: 173919 - DNA, 25 bp, Mus musculus
agccgcaggccgacaaatgttttgg

SEQ ID NO: 173920 - DNA, 25 bp, Mus musculus
agccgcaggccgtcaaatgttttgg

SEQ ID NO: 173921 - DNA, 25 bp, Mus musculus
agccgcagtcaaaatcactttccag

SEQ ID NO: 173922 - DNA, 25 bp, Mus musculus
agccgcagtcaatatcactttccag

SEQ ID NO: 173923 - DNA, 25 bp, Mus musculus
agccgcagtgacctctggagctatg

SEQ ID NO: 173924 - DNA, 25 bp, Mus musculus
agccgcagtgacgtctggagctatg

SEQ ID NO: 173925 - DNA, 25 bp, Mus musculus
agccgcatcaatattgtccttcaga

SEQ ID NO: 173926 - DNA, 25 bp, Mus musculus
agccgcatcaattttgtccttcaga

SEQ ID NO: 173927 - DNA, 25 bp, Mus musculus
agccgcatcagaatctgacctatgg

SEQ ID NO: 173928 - DNA, 25 bp, Mus musculus
agccgcatcagattctgacctatgg

SEQ ID NO: 173929 - DNA, 25 bp, Mus musculus
agccgcatccagagccatggcaagt

SEQ ID NO: 173930 - DNA, 25 bp, Mus musculus
agccgcatccagtgccatggcaagt

SEQ ID NO: 173931 - DNA, 25 bp, Mus musculus
agccgcatctacaacgagaacgttc

SEQ ID NO: 173932 - DNA, 25 bp, Mus musculus
agccgcatctactacgagaacgttc

SEQ ID NO: 173933 - DNA, 25 bp, Mus musculus
agccgcatttatccctgtcttcagt

SEQ ID NO: 173934 - DNA, 25 bp, Mus musculus
agccgcatttatgcctgtcttcagt

SEQ ID NO: 173935 - DNA, 25 bp, Mus musculus
agccgccaacgcacaagagtggttc

SEQ ID NO: 173936 - DNA, 25 bp, Mus musculus
agccgccaacgctcaagagtggttc

SEQ ID NO: 173937 - DNA, 25 bp, Mus musculus
agccgccacctcaaaatcctgaagt

SEQ ID NO: 173938 - DNA, 25 bp, Mus musculus
agccgccacctctaaatcctgaagt

SEQ ID NO: 173939 - DNA, 25 bp, Mus musculus
agccgccagagcacatgtttctcta

SEQ ID NO: 173940 - DNA, 25 bp, Mus musculus
agccgccagagctcatgtttctcta

SEQ ID NO: 173941 - DNA, 25 bp, Mus musculus
agccgccagcatactgtgtagagca

SEQ ID NO: 173942 - DNA, 25 bp, Mus musculus
agccgccagcattctgtgtagagca

SEQ ID NO: 173943 - DNA, 25 bp, Mus musculus
agccgccagggcctgttaagaagtt

SEQ ID NO: 173944 - DNA, 25 bp, Mus musculus
agccgccagggcgtgttaagaagtt

SEQ ID NO: 173945 - DNA, 25 bp, Mus musculus
agccgcccagagaatgccattattt

SEQ ID NO: 173946 - DNA, 25 bp, Mus musculus
agccgcccagagtatgccattattt

SEQ ID NO: 173947 - DNA, 25 bp, Mus musculus
agccgcccagccactgagagtcagg

SEQ ID NO: 173948 - DNA, 25 bp, Mus musculus
agccgcccagcctctgagagtcagg

SEQ ID NO: 173949 - DNA, 25 bp, Mus musculus
agccgcccgtttacggtagcagctt

SEQ ID NO: 173950 - DNA, 25 bp, Mus musculus
agccgcccgttttcggtagcagctt

SEQ ID NO: 173951 - DNA, 25 bp, Mus musculus
agccgccctggaaagtactgagtga

SEQ ID NO: 173952 - DNA, 25 bp, Mus musculus
agccgccctggatagtactgagtga

SEQ ID NO: 173953 - DNA, 25 bp, Mus musculus
agccgccctgtgagcttcagtaaag

SEQ ID NO: 173954 - DNA, 25 bp, Mus musculus
agccgccctgtgtgcttcagtaaag

SEQ ID NO: 173955 - DNA, 25 bp, Mus musculus
agccgcccttatagtgtgtgtactg

SEQ ID NO: 173956 - DNA, 25 bp, Mus musculus
agccgcccttatcggtgtaagatca

SEQ ID NO: 173957 - DNA, 25 bp, Mus musculus
agccgcccttatgggtgtaagatca

SEQ ID NO: 173958 - DNA, 25 bp, Mus musculus
agccgcccttattgtgtgtgtactg

SEQ ID NO: 173959 - DNA, 25 bp, Mus musculus
agccgcccttgtcatgttacttctg

SEQ ID NO: 173960 - DNA, 25 bp, Mus musculus
agccgcccttgtgatgttacttctg

SEQ ID NO: 173961 - DNA, 25 bp, Mus musculus
agccgccgctggaacagtcgtggga

SEQ ID NO: 173962 - DNA, 25 bp, Mus musculus
agccgccgctggtacagtcgtggga

SEQ ID NO: 173963 - DNA, 25 bp, Mus musculus
agccgccgtcttcacaaaggacctg

SEQ ID NO: 173964 - DNA, 25 bp, Mus musculus
agccgccgtcttgacaaaggacctg

SEQ ID NO: 173965 - DNA, 25 bp, Mus musculus
agccgcctcagcaagaggcagccag

SEQ ID NO: 173966 - DNA, 25 bp, Mus musculus
agccgcctcagctagaggcagccag

SEQ ID NO: 173967 - DNA, 25 bp, Mus musculus
agccgcctctaacccgtttggaagg

SEQ ID NO: 173968 - DNA, 25 bp, Mus musculus
agccgcctctaagccgtttggaagg

SEQ ID NO: 173969 - DNA, 25 bp, Mus musculus
agccgcctcttgcatggctgtggca

SEQ ID NO: 173970 - DNA, 25 bp, Mus musculus
agccgcctcttggatggctgtggca

SEQ ID NO: 173971 - DNA, 25 bp, Mus musculus
agccgcctggtccacatattgggag

SEQ ID NO: 173972 - DNA, 25 bp, Mus musculus
agccgcctggtcgacatattgggag

SEQ ID NO: 173973 - DNA, 25 bp, Mus musculus
agccgcctgtccaggttagatggtt

SEQ ID NO: 173974 - DNA, 25 bp, Mus musculus
agccgcctgtcctggttagatggtt

SEQ ID NO: 173975 - DNA, 25 bp, Mus musculus
agccgcgaacagcaggacatcttca

SEQ ID NO: 173976 - DNA, 25 bp, Mus musculus
agccgcgaacaggaggacatcttca

SEQ ID NO: 173977 - DNA, 25 bp, Mus musculus
agccgcgaacctcgcgtgtcctggt

SEQ ID NO: 173978 - DNA, 25 bp, Mus musculus
agccgcgaacctggcgtgtcctggt

SEQ ID NO: 173979 - DNA, 25 bp, Mus musculus
agccgcgacgttcgtttctagatat

SEQ ID NO: 173980 - DNA, 25 bp, Mus musculus
agccgcgacgttggtttctagatat

SEQ ID NO: 173981 - DNA, 25 bp, Mus musculus
agccgcgatctaaactttctgttca

SEQ ID NO: 173982 - DNA, 25 bp, Mus musculus
agccgcgatctatactttctgttca

SEQ ID NO: 173983 - DNA, 25 bp, Mus musculus
agccgcgcttgtcctgtgctgagaa

SEQ ID NO: 173984 - DNA, 25 bp, Mus musculus
agccgcgcttgtgctgtgctgagaa

SEQ ID NO: 173985 - DNA, 25 bp, Mus musculus
agccgcggccttactgaacacaatg

SEQ ID NO: 173986 - DNA, 25 bp, Mus musculus
agccgcggcctttctgaacacaatg

SEQ ID NO: 173987 - DNA, 25 bp, Mus musculus
agccgcgtataacccgactggaatt

SEQ ID NO: 173988 - DNA, 25 bp, Mus musculus
agccgcgtataagccgactggaatt

SEQ ID NO: 173989 - DNA, 25 bp, Mus musculus
agccgcgtcagtcggaactcatcca

SEQ ID NO: 173990 - DNA, 25 bp, Mus musculus
agccgcgtcagtgggaactcatcca

SEQ ID NO: 173991 - DNA, 25 bp, Mus musculus
agccgcgtgcctcaagttgaattag

SEQ ID NO: 173992 - DNA, 25 bp, Mus musculus
agccgcgtgcctgaagttgaattag

SEQ ID NO: 173993 - DNA, 25 bp, Mus musculus
agccgctacagtctgatcccgcaga

SEQ ID NO: 173994 - DNA, 25 bp, Mus musculus
agccgctacagtgtgatcccgcaga

SEQ ID NO: 173995 - DNA, 25 bp, Mus musculus
agccgctatgccacagtggagaagg

SEQ ID NO: 173996 - DNA, 25 bp, Mus musculus
agccgctatgcctcagtggagaagg

SEQ ID NO: 173997 - DNA, 25 bp, Mus musculus
agccgctatgttcatggactcttcc

SEQ ID NO: 173998 - DNA, 25 bp, Mus musculus
agccgctatgttgatggactcttcc

SEQ ID NO: 173999 - DNA, 25 bp, Mus musculus
agccgctattagcgtgtgtggactc

SEQ ID NO: 174000 - DNA, 25 bp, Mus musculus
agccgctattagggtgtgtggactc

SEQ ID NO: 174001 - DNA, 25 bp, Mus musculus
agccgctcgctgagttcgagtttaa

SEQ ID NO: 174002 - DNA, 25 bp, Mus musculus
agccgctcgctgcagaaggttggta

SEQ ID NO: 174003 - DNA, 25 bp, Mus musculus
agccgctcgctggagaaggttggta

SEQ ID NO: 174004 - DNA, 25 bp, Mus musculus
agccgctcgctgtgttcgagtttaa

SEQ ID NO: 174005 - DNA, 25 bp, Mus musculus
agccgctctcggatacctggcttac

SEQ ID NO: 174006 - DNA, 25 bp, Mus musculus
agccgctctcggttacctggcttac

SEQ ID NO: 174007 - DNA, 25 bp, Mus musculus
agccgctctctccagaagcaaggat

SEQ ID NO: 174008 - DNA, 25 bp, Mus musculus
agccgctctctcgagaagcaaggat

SEQ ID NO: 174009 - DNA, 25 bp, Mus musculus
agccgctctcttaagcacatggcaa

SEQ ID NO: 174010 - DNA, 25 bp, Mus musculus
agccgctctctttagcacatggcaa

SEQ ID NO: 174011 - DNA, 25 bp, Mus musculus
agccgctctggccaagagtagctat

SEQ ID NO: 174012 - DNA, 25 bp, Mus musculus
agccgctctggcgaagagtagctat

SEQ ID NO: 174013 - DNA, 25 bp, Mus musculus
agccgctgacagacttcaggattga

SEQ ID NO: 174014 - DNA, 25 bp, Mus musculus
agccgctgacagtcttcaggattga

SEQ ID NO: 174015 - DNA, 25 bp, Mus musculus
agccgctgagcacactaagttttct

SEQ ID NO: 174016 - DNA, 25 bp, Mus musculus
agccgctgagcagactaagttttct

SEQ ID NO: 174017 - DNA, 25 bp, Mus musculus
agccgctgcctcagtagttagggaa

SEQ ID NO: 174018 - DNA, 25 bp, Mus musculus
agccgctgcctctgtagttagggaa

SEQ ID NO: 174019 - DNA, 25 bp, Mus musculus
agccgctgcctgatacagtgcagga

SEQ ID NO: 174020 - DNA, 25 bp, Mus musculus
agccgctgcctgttacagtgcagga

SEQ ID NO: 174021 - DNA, 25 bp, Mus musculus
agccgctgctgtcgttactgaaagc

SEQ ID NO: 174022 - DNA, 25 bp, Mus musculus
agccgctgctgtggttactgaaagc

SEQ ID NO: 174023 - DNA, 25 bp, Mus musculus
agccgctggatactctgcagttcgc

SEQ ID NO: 174024 - DNA, 25 bp, Mus musculus
agccgctggatagtctgcagttcgc

SEQ ID NO: 174025 - DNA, 25 bp, Mus musculus
agccgctgtattctgtttgacccag

SEQ ID NO: 174026 - DNA, 25 bp, Mus musculus
agccgctgtattgtgtttgacccag

SEQ ID NO: 174027 - DNA, 25 bp, Mus musculus
agccgctgtcttagcgggagtcgcc

SEQ ID NO: 174028 - DNA, 25 bp, Mus musculus
agccgctgtctttgcgggagtcgcc

SEQ ID NO: 174029 - DNA, 25 bp, Mus musculus
agccgcttctgcaaagagtcactgt

SEQ ID NO: 174030 - DNA, 25 bp, Mus musculus
agccgcttctgctaagagtcactgt

SEQ ID NO: 174031 - DNA, 25 bp, Mus musculus
agccgcttggccagtggagtgattg

SEQ ID NO: 174032 - DNA, 25 bp, Mus musculus
agccgcttggcctgtggagtgattg

SEQ ID NO: 174033 - DNA, 25 bp, Mus musculus
agccggaaatgaaccagccctggag

SEQ ID NO: 174034 - DNA, 25 bp, Mus musculus
agccggaaatgatccagccctggag

SEQ ID NO: 174035 - DNA, 25 bp, Mus musculus
agccggaagcctccttgggtctgat

SEQ ID NO: 174036 - DNA, 25 bp, Mus musculus
agccggaagcctgcttgggtctgat

SEQ ID NO: 174037 - DNA, 25 bp, Mus musculus
agccggaagcgcaggatcattgcca

SEQ ID NO: 174038 - DNA, 25 bp, Mus musculus
agccggaagcgctggatcattgcca

SEQ ID NO: 174039 - DNA, 25 bp, Mus musculus
agccggacctgaagtcggacactgt

SEQ ID NO: 174040 - DNA, 25 bp, Mus musculus
agccggacctgatgtcggacactgt

SEQ ID NO: 174041 - DNA, 25 bp, Mus musculus
agccggagaactcgccacagtctgt

SEQ ID NO: 174042 - DNA, 25 bp, Mus musculus
agccggagaactggccacagtctgt

SEQ ID NO: 174043 - DNA, 25 bp, Mus musculus
agccggagagtcatgctggatttga

SEQ ID NO: 174044 - DNA, 25 bp, Mus musculus
agccggagagtcttgctggatttga

SEQ ID NO: 174045 - DNA, 25 bp, Mus musculus
agccggagcaacaagctgcactttg

SEQ ID NO: 174046 - DNA, 25 bp, Mus musculus
agccggagcaactagctgcactttg

SEQ ID NO: 174047 - DNA, 25 bp, Mus musculus
agccggagccagagcgagtgtagca

SEQ ID NO: 174048 - DNA, 25 bp, Mus musculus
agccggagccagtgcgagtgtagca

SEQ ID NO: 174049 - DNA, 25 bp, Mus musculus
agccggagccatatggctgagccat

SEQ ID NO: 174050 - DNA, 25 bp, Mus musculus
agccggagccatttggctgagccat

SEQ ID NO: 174051 - DNA, 25 bp, Mus musculus
agccggagtggtaggtaagtcctct

SEQ ID NO: 174052 - DNA, 25 bp, Mus musculus
agccggagtggttggtaagtcctct

SEQ ID NO: 174053 - DNA, 25 bp, Mus musculus
agccggataactcgcatggacatat

SEQ ID NO: 174054 - DNA, 25 bp, Mus musculus
agccggataactggcatggacatat

SEQ ID NO: 174055 - DNA, 25 bp, Mus musculus
agccggatactcaaataacgtgttc

SEQ ID NO: 174056 - DNA, 25 bp, Mus musculus
agccggatactctaataacgtgttc

SEQ ID NO: 174057 - DNA, 25 bp, Mus musculus
agccggatcacaatacctggtctac

SEQ ID NO: 174058 - DNA, 25 bp, Mus musculus
agccggatcacattacctggtctac

SEQ ID NO: 174059 - DNA, 25 bp, Mus musculus
agccggcaaggacctgttctctgaa

SEQ ID NO: 174060 - DNA, 25 bp, Mus musculus
agccggcaaggagctgttctctgaa

SEQ ID NO: 174061 - DNA, 25 bp, Mus musculus
agccggcacaagataggtcctcggc

SEQ ID NO: 174062 - DNA, 25 bp, Mus musculus
agccggcacaagttaggtcctcggc

SEQ ID NO: 174063 - DNA, 25 bp, Mus musculus
agccggcacaatcgactcagtcagg

SEQ ID NO: 174064 - DNA, 25 bp, Mus musculus
agccggcacaatggactcagtcagg

SEQ ID NO: 174065 - DNA, 25 bp, Mus musculus
agccggcacaggacaatgcatcgtt

SEQ ID NO: 174066 - DNA, 25 bp, Mus musculus
agccggcacaggtcaatgcatcgtt

SEQ ID NO: 174067 - DNA, 25 bp, Mus musculus
agccggcagcaccagagcagtatga

SEQ ID NO: 174068 - DNA, 25 bp, Mus musculus
agccggcagcacgagagcagtatga

SEQ ID NO: 174069 - DNA, 25 bp, Mus musculus
agccggcaggttagtgtctgctgtt

SEQ ID NO: 174070 - DNA, 25 bp, Mus musculus
agccggcaggtttgtgtctgctgtt

SEQ ID NO: 174071 - DNA, 25 bp, Mus musculus
agccggcatggccagaccactgtgt

SEQ ID NO: 174072 - DNA, 25 bp, Mus musculus
agccggcatggcgagaccactgtgt

SEQ ID NO: 174073 - DNA, 25 bp, Mus musculus
agccggcattccattgggtatgaga

SEQ ID NO: 174074 - DNA, 25 bp, Mus musculus
agccggcattcctttgggtatgaga

SEQ ID NO: 174075 - DNA, 25 bp, Mus musculus
agccggcattttaaccctgattcta

SEQ ID NO: 174076 - DNA, 25 bp, Mus musculus
agccggcatttttaccctgattcta

SEQ ID NO: 174077 - DNA, 25 bp, Mus musculus
agccggccaggacacgagcactaga

SEQ ID NO: 174078 - DNA, 25 bp, Mus musculus
agccggccaggagacgagcactaga

SEQ ID NO: 174079 - DNA, 25 bp, Mus musculus
agccggcctgtaaagcaaactgtga

SEQ ID NO: 174080 - DNA, 25 bp, Mus musculus
agccggcctgtatagcaaactgtga

SEQ ID NO: 174081 - DNA, 25 bp, Mus musculus
agccggctctgcctactgctgctga

SEQ ID NO: 174082 - DNA, 25 bp, Mus musculus
agccggctctgcgtactgctgctga

SEQ ID NO: 174083 - DNA, 25 bp, Mus musculus
agccggctcttcatggctgttagca

SEQ ID NO: 174084 - DNA, 25 bp, Mus musculus
agccggctcttcttggctgttagca

SEQ ID NO: 174085 - DNA, 25 bp, Mus musculus
agccggctgagaatgtccatcaact

SEQ ID NO: 174086 - DNA, 25 bp, Mus musculus
agccggctgagattgtccatcaact

SEQ ID NO: 174087 - DNA, 25 bp, Mus musculus
agccggctgcatcgtactagcatat

SEQ ID NO: 174088 - DNA, 25 bp, Mus musculus
agccggctgcatggtactagcatat

SEQ ID NO: 174089 - DNA, 25 bp, Mus musculus
agccggctgcgcacgggtaaagatc

SEQ ID NO: 174090 - DNA, 25 bp, Mus musculus
agccggctgcgctcgggtaaagatc

SEQ ID NO: 174091 - DNA, 25 bp, Mus musculus
agccggcttactctttcgagtacat

SEQ ID NO: 174092 - DNA, 25 bp, Mus musculus
agccggcttactgtttcgagtacat

SEQ ID NO: 174093 - DNA, 25 bp, Mus musculus
agccgggactacctggaccacctgg

SEQ ID NO: 174094 - DNA, 25 bp, Mus musculus
agccgggactacgtggaccacctgg

SEQ ID NO: 174095 - DNA, 25 bp, Mus musculus
agccgggagcgaccaatcacaaaac

SEQ ID NO: 174096 - DNA, 25 bp, Mus musculus
agccgggagcgagcaatcacaaaac

SEQ ID NO: 174097 - DNA, 25 bp, Mus musculus
agccgggcatagaaggtacacacct

SEQ ID NO: 174098 - DNA, 25 bp, Mus musculus
agccgggcatagtaggtacacacct

SEQ ID NO: 174099 - DNA, 25 bp, Mus musculus
agccgggccatcatcagaaccattt

SEQ ID NO: 174100 - DNA, 25 bp, Mus musculus
agccgggccatcttcagaaccattt

SEQ ID NO: 174101 - DNA, 25 bp, Mus musculus
agccgggcctaacacccaggcaaag

SEQ ID NO: 174102 - DNA, 25 bp, Mus musculus
agccgggcctaagacccaggcaaag

SEQ ID NO: 174103 - DNA, 25 bp, Mus musculus
agccgggcgatcagtcaggtcgatt

SEQ ID NO: 174104 - DNA, 25 bp, Mus musculus
agccgggcgatctgtcaggtcgatt

SEQ ID NO: 174105 - DNA, 25 bp, Mus musculus
agccgggtaaggagctcatcgttga

SEQ ID NO: 174106 - DNA, 25 bp, Mus musculus
agccgggtaaggtgctcatcgttga

SEQ ID NO: 174107 - DNA, 25 bp, Mus musculus
agccgggtactaccattctacagta

SEQ ID NO: 174108 - DNA, 25 bp, Mus musculus
agccgggtactagcattctacagta

SEQ ID NO: 174109 - DNA, 25 bp, Mus musculus
agccgggtcttaaagcgccatggaa

SEQ ID NO: 174110 - DNA, 25 bp, Mus musculus
agccgggtcttatagcgccatggaa

SEQ ID NO: 174111 - DNA, 25 bp, Mus musculus
agccgggttattcgcaggtgtcctc

SEQ ID NO: 174112 - DNA, 25 bp, Mus musculus
agccgggttattggcaggtgtcctc

SEQ ID NO: 174113 - DNA, 25 bp, Mus musculus
agccgggttgaacccaagctatact

SEQ ID NO: 174114 - DNA, 25 bp, Mus musculus
agccgggttgaagccaagctatact

SEQ ID NO: 174115 - DNA, 25 bp, Mus musculus
agccggtaagcccagccgtctcgag

SEQ ID NO: 174116 - DNA, 25 bp, Mus musculus
agccggtaagccgagccgtctcgag

SEQ ID NO: 174117 - DNA, 25 bp, Mus musculus
agccggtaccccagtgaatatttag

SEQ ID NO: 174118 - DNA, 25 bp, Mus musculus
agccggtacccctgtgaatatttag

SEQ ID NO: 174119 - DNA, 25 bp, Mus musculus
agccggtagcccatggtacgcgaag

SEQ ID NO: 174120 - DNA, 25 bp, Mus musculus
agccggtagcccttggtacgcgaag

SEQ ID NO: 174121 - DNA, 25 bp, Mus musculus
agccggtagcttccttccgcaggag

SEQ ID NO: 174122 - DNA, 25 bp, Mus musculus
agccggtagcttgcttccgcaggag

SEQ ID NO: 174123 - DNA, 25 bp, Mus musculus
agccggtagggcatcttattaatta

SEQ ID NO: 174124 - DNA, 25 bp, Mus musculus
agccggtagggcttcttattaatta

SEQ ID NO: 174125 - DNA, 25 bp, Mus musculus
agccggtatcgaagtgggtctccag

SEQ ID NO: 174126 - DNA, 25 bp, Mus musculus
agccggtatcgatgtgggtctccag

SEQ ID NO: 174127 - DNA, 25 bp, Mus musculus
agccggtcatctccgtgttcttaga

SEQ ID NO: 174128 - DNA, 25 bp, Mus musculus
agccggtcatctgcgtgttcttaga

SEQ ID NO: 174129 - DNA, 25 bp, Mus musculus
agccggtcccagatacctgtaagag

SEQ ID NO: 174130 - DNA, 25 bp, Mus musculus
agccggtcccagttacctgtaagag

SEQ ID NO: 174131 - DNA, 25 bp, Mus musculus
agccggtcctggacaatcccgctga

SEQ ID NO: 174132 - DNA, 25 bp, Mus musculus
agccggtcctggtcaatcccgctga

SEQ ID NO: 174133 - DNA, 25 bp, Mus musculus
agccggtctttgattatgtccagca

SEQ ID NO: 174134 - DNA, 25 bp, Mus musculus
agccggtctttgtttatgtccagca

SEQ ID NO: 174135 - DNA, 25 bp, Mus musculus
agccggtgcttgcaatactatcaac

SEQ ID NO: 174136 - DNA, 25 bp, Mus musculus
agccggtgcttggaatactatcaac

SEQ ID NO: 174137 - DNA, 25 bp, Mus musculus
agccggtgggctctgatttacacca

SEQ ID NO: 174138 - DNA, 25 bp, Mus musculus
agccggtgggctgtgatttacacca

SEQ ID NO: 174139 - DNA, 25 bp, Mus musculus
agccggtgtactacgtgtcagagag

SEQ ID NO: 174140 - DNA, 25 bp, Mus musculus
agccggtgtacttcgtgtcagagag

SEQ ID NO: 174141 - DNA, 25 bp, Mus musculus
agccggtttctcagagccgctgcaa

SEQ ID NO: 174142 - DNA, 25 bp, Mus musculus
agccggtttctctgagccgctgcaa

SEQ ID NO: 174143 - DNA, 25 bp, Mus musculus
agccgtaaatccagcatcgttttca

SEQ ID NO: 174144 - DNA, 25 bp, Mus musculus
agccgtaaatcctgcatcgttttca

SEQ ID NO: 174145 - DNA, 25 bp, Mus musculus
agccgtaactgcactgaatgttcac

SEQ ID NO: 174146 - DNA, 25 bp, Mus musculus
agccgtaactgctctgaatgttcac

SEQ ID NO: 174147 - DNA, 25 bp, Mus musculus
agccgtaagcgcactcaatcactga

SEQ ID NO: 174148 - DNA, 25 bp, Mus musculus
agccgtaagcgctctcaatcactga

SEQ ID NO: 174149 - DNA, 25 bp, Mus musculus
agccgtaccctgacagcagtgcacg

SEQ ID NO: 174150 - DNA, 25 bp, Mus musculus
agccgtaccctgtcagcagtgcacg

SEQ ID NO: 174151 - DNA, 25 bp, Mus musculus
agccgtacctcactgaacagcgcaa

SEQ ID NO: 174152 - DNA, 25 bp, Mus musculus
agccgtacctcagtgaacagcgcaa

SEQ ID NO: 174153 - DNA, 25 bp, Mus musculus
agccgtactcctatttgtcctttga

SEQ ID NO: 174154 - DNA, 25 bp, Mus musculus
agccgtactcctttttgtcctttga

SEQ ID NO: 174155 - DNA, 25 bp, Mus musculus
agccgtagggagcactctcctggat

SEQ ID NO: 174156 - DNA, 25 bp, Mus musculus
agccgtagggaggactctcctggat

SEQ ID NO: 174157 - DNA, 25 bp, Mus musculus
agccgtataacaaagactggatcaa

SEQ ID NO: 174158 - DNA, 25 bp, Mus musculus
agccgtataacatagactggatcaa

SEQ ID NO: 174159 - DNA, 25 bp, Mus musculus
agccgtatgcctcctgtgagaggta

SEQ ID NO: 174160 - DNA, 25 bp, Mus musculus
agccgtatgcctgctgtgagaggta

SEQ ID NO: 174161 - DNA, 25 bp, Mus musculus
agccgtatgtgaatggagccctgta

SEQ ID NO: 174162 - DNA, 25 bp, Mus musculus
agccgtatgtgattggagccctgta

SEQ ID NO: 174163 - DNA, 25 bp, Mus musculus
agccgtcacagtagaacttcagcct

SEQ ID NO: 174164 - DNA, 25 bp, Mus musculus
agccgtcacagttgaacttcagcct

SEQ ID NO: 174165 - DNA, 25 bp, Mus musculus
agccgtcatctcaagttatttccct

SEQ ID NO: 174166 - DNA, 25 bp, Mus musculus
agccgtcatctctagttatttccct

SEQ ID NO: 174167 - DNA, 25 bp, Mus musculus
agccgtccaaacatcgggctcgcct

SEQ ID NO: 174168 - DNA, 25 bp, Mus musculus
agccgtccaaacttcgggctcgcct

SEQ ID NO: 174169 - DNA, 25 bp, Mus musculus
agccgtcctcagctttagagatttt

SEQ ID NO: 174170 - DNA, 25 bp, Mus musculus
agccgtcctcaggtttagagatttt

SEQ ID NO: 174171 - DNA, 25 bp, Mus musculus
agccgtccttcaaatgcagtgtctt

SEQ ID NO: 174172 - DNA, 25 bp, Mus musculus
agccgtccttcatatgcagtgtctt

SEQ ID NO: 174173 - DNA, 25 bp, Mus musculus
agccgtcctttccttgttgaatttg

SEQ ID NO: 174174 - DNA, 25 bp, Mus musculus
agccgtcctttcgttgttgaatttg

SEQ ID NO: 174175 - DNA, 25 bp, Mus musculus
agccgtctccttaagcacaggtgca

SEQ ID NO: 174176 - DNA, 25 bp, Mus musculus
agccgtctcctttagcacaggtgca

SEQ ID NO: 174177 - DNA, 25 bp, Mus musculus
agccgtctgctgcagtacacaccta

SEQ ID NO: 174178 - DNA, 25 bp, Mus musculus
agccgtctgctggagtacacaccta

SEQ ID NO: 174179 - DNA, 25 bp, Mus musculus
agccgtctgttgaggtcaggtttcc

SEQ ID NO: 174180 - DNA, 25 bp, Mus musculus
agccgtctgttgtggtcaggtttcc

SEQ ID NO: 174181 - DNA, 25 bp, Mus musculus
agccgtgaacacaaagccgatcaga

SEQ ID NO: 174182 - DNA, 25 bp, Mus musculus
agccgtgaacactaagccgatcaga

SEQ ID NO: 174183 - DNA, 25 bp, Mus musculus
agccgtgaacatcacctcctgaagg

SEQ ID NO: 174184 - DNA, 25 bp, Mus musculus
agccgtgaacatgacctcctgaagg

SEQ ID NO: 174185 - DNA, 25 bp, Mus musculus
agccgtgacctgaaacgcaaactga

SEQ ID NO: 174186 - DNA, 25 bp, Mus musculus
agccgtgacctgtaacgcaaactga

SEQ ID NO: 174187 - DNA, 25 bp, Mus musculus
agccgtgactcgcacagttctggag

SEQ ID NO: 174188 - DNA, 25 bp, Mus musculus
agccgtgactcggacagttctggag

SEQ ID NO: 174189 - DNA, 25 bp, Mus musculus
agccgtgactttactggttcctatt

SEQ ID NO: 174190 - DNA, 25 bp, Mus musculus
agccgtgacttttctggttcctatt

SEQ ID NO: 174191 - DNA, 25 bp, Mus musculus
agccgtgcggctagcttcttgtggc

SEQ ID NO: 174192 - DNA, 25 bp, Mus musculus
agccgtgcggcttgcttcttgtggc

SEQ ID NO: 174193 - DNA, 25 bp, Mus musculus
agccgtggagagctagtgctcactt

SEQ ID NO: 174194 - DNA, 25 bp, Mus musculus
agccgtggagaggtagtgctcactt

SEQ ID NO: 174195 - DNA, 25 bp, Mus musculus
agccgtggccagctgttccaaactg

SEQ ID NO: 174196 - DNA, 25 bp, Mus musculus
agccgtggccaggtgttccaaactg

SEQ ID NO: 174197 - DNA, 25 bp, Mus musculus
agccgtggctgccacactcaacaat

SEQ ID NO: 174198 - DNA, 25 bp, Mus musculus
agccgtggctgcgacactcaacaat

SEQ ID NO: 174199 - DNA, 25 bp, Mus musculus
agccgtggctggatgtgtttgcttc

SEQ ID NO: 174200 - DNA, 25 bp, Mus musculus
agccgtggctggttgtgtttgcttc

SEQ ID NO: 174201 - DNA, 25 bp, Mus musculus
agccgtgggcacaggagacaattgt

SEQ ID NO: 174202 - DNA, 25 bp, Mus musculus
agccgtgggcactggagacaattgt

SEQ ID NO: 174203 - DNA, 25 bp, Mus musculus
agccgtgggtccatgcagcaggtcc

SEQ ID NO: 174204 - DNA, 25 bp, Mus musculus
agccgtgggtccttgcagcaggtcc

SEQ ID NO: 174205 - DNA, 25 bp, Mus musculus
agccgtgggtgcacagcaaaggaca

SEQ ID NO: 174206 - DNA, 25 bp, Mus musculus
agccgtgggtgctcagcaaaggaca

SEQ ID NO: 174207 - DNA, 25 bp, Mus musculus
agccgtggtaacaactgtctgggtc

SEQ ID NO: 174208 - DNA, 25 bp, Mus musculus
agccgtggtaactactgtctgggtc

SEQ ID NO: 174209 - DNA, 25 bp, Mus musculus
agccgtgtgtccatagatattagtt

SEQ ID NO: 174210 - DNA, 25 bp, Mus musculus
agccgtgtgtccttagatattagtt

SEQ ID NO: 174211 - DNA, 25 bp, Mus musculus
agccgtgtgtgtctggttgccacac

SEQ ID NO: 174212 - DNA, 25 bp, Mus musculus
agccgtgtgtgtgtggttgccacac

SEQ ID NO: 174213 - DNA, 25 bp, Mus musculus
agccgtgtttctctagtgcccttaa

SEQ ID NO: 174214 - DNA, 25 bp, Mus musculus
agccgtgtttctgtagtgcccttaa

SEQ ID NO: 174215 - DNA, 25 bp, Mus musculus
agccgtgttttcctgccgatcgtct

SEQ ID NO: 174216 - DNA, 25 bp, Mus musculus
agccgtgttttcgtgccgatcgtct

SEQ ID NO: 174217 - DNA, 25 bp, Mus musculus
agccgttaggaaactgcaccatgcg

SEQ ID NO: 174218 - DNA, 25 bp, Mus musculus
agccgttaggaatctgcaccatgcg

SEQ ID NO: 174219 - DNA, 25 bp, Mus musculus
agccgttcagacaggcagatcttct

SEQ ID NO: 174220 - DNA, 25 bp, Mus musculus
agccgttcagactggcagatcttct

SEQ ID NO: 174221 - DNA, 25 bp, Mus musculus
agccgttgaagtcgtgagcattcac

SEQ ID NO: 174222 - DNA, 25 bp, Mus musculus
agccgttgaagtggtgagcattcac

SEQ ID NO: 174223 - DNA, 25 bp, Mus musculus
agccgtttctgcagaatgtgccttg

SEQ ID NO: 174224 - DNA, 25 bp, Mus musculus
agccgtttctgctgaatgtgccttg

SEQ ID NO: 174225 - DNA, 25 bp, Mus musculus
agccgtttctgtccgcaggaagtag

SEQ ID NO: 174226 - DNA, 25 bp, Mus musculus
agccgtttctgtgcgcaggaagtag

SEQ ID NO: 174227 - DNA, 25 bp, Mus musculus
agccgtttgctgagtgagacctctc

SEQ ID NO: 174228 - DNA, 25 bp, Mus musculus
agccgtttgctgtgtgagacctctc

SEQ ID NO: 174229 - DNA, 25 bp, Mus musculus
agcctaaaattgatgcagtcctcta

SEQ ID NO: 174230 - DNA, 25 bp, Mus musculus
agcctaaaattgttgcagtcctcta

SEQ ID NO: 174231 - DNA, 25 bp, Mus musculus
agcctaaagaacattcttggctcac

SEQ ID NO: 174232 - DNA, 25 bp, Mus musculus
agcctaaagaactttcttggctcac

SEQ ID NO: 174233 - DNA, 25 bp, Mus musculus
agcctaaagcgcatttcattatgct

SEQ ID NO: 174234 - DNA, 25 bp, Mus musculus
agcctaaagcgcttttcattatgct

SEQ ID NO: 174235 - DNA, 25 bp, Mus musculus
agcctaacagtcagagctcaatccc

SEQ ID NO: 174236 - DNA, 25 bp, Mus musculus
agcctaacagtctgagctcaatccc

SEQ ID NO: 174237 - DNA, 25 bp, Mus musculus
agcctaacctcaccctgcaaagatg

SEQ ID NO: 174238 - DNA, 25 bp, Mus musculus
agcctaacctcagcctgcaaagatg

SEQ ID NO: 174239 - DNA, 25 bp, Mus musculus
agcctaacttgacccgggtggaaga

SEQ ID NO: 174240 - DNA, 25 bp, Mus musculus
agcctaacttgagccgggtggaaga

SEQ ID NO: 174241 - DNA, 25 bp, Mus musculus
agcctaagaatgacatccagtacct

SEQ ID NO: 174242 - DNA, 25 bp, Mus musculus
agcctaagaatgtcatccagtacct

SEQ ID NO: 174243 - DNA, 25 bp, Mus musculus
agcctaagatagataaccacctgag

SEQ ID NO: 174244 - DNA, 25 bp, Mus musculus
agcctaagatagttaaccacctgag

SEQ ID NO: 174245 - DNA, 25 bp, Mus musculus
agcctaagatcgatcactgctggag

SEQ ID NO: 174246 - DNA, 25 bp, Mus musculus
agcctaagatcgttcactgctggag

SEQ ID NO: 174247 - DNA, 25 bp, Mus musculus
agcctaagcagtacctatgacctca

SEQ ID NO: 174248 - DNA, 25 bp, Mus musculus
agcctaagcagttcctatgacctca

SEQ ID NO: 174249 - DNA, 25 bp, Mus musculus
agcctaagcatcatctatttcctga

SEQ ID NO: 174250 - DNA, 25 bp, Mus musculus
agcctaagcatcttctatttcctga

SEQ ID NO: 174251 - DNA, 25 bp, Mus musculus
agcctaagccttagaagagctggtg

SEQ ID NO: 174252 - DNA, 25 bp, Mus musculus
agcctaagcctttgaagagctggtg

SEQ ID NO: 174253 - DNA, 25 bp, Mus musculus
agcctaaggacaccacagcttctag

SEQ ID NO: 174254 - DNA, 25 bp, Mus musculus
agcctaaggacagcacagcttctag

SEQ ID NO: 174255 - DNA, 25 bp, Mus musculus
agcctaagtattatcctaccccaag

SEQ ID NO: 174256 - DNA, 25 bp, Mus musculus
agcctaagtattttcctaccccaag

SEQ ID NO: 174257 - DNA, 25 bp, Mus musculus
agcctaatacagacactcatgctta

SEQ ID NO: 174258 - DNA, 25 bp, Mus musculus
agcctaatacagtcactcatgctta

SEQ ID NO: 174259 - DNA, 25 bp, Mus musculus
agcctaatcaagcagccgacacgtc

SEQ ID NO: 174260 - DNA, 25 bp, Mus musculus
agcctaatcaaggagccgacacgtc

SEQ ID NO: 174261 - DNA, 25 bp, Mus musculus
agcctaatcatgattccagcgttca

SEQ ID NO: 174262 - DNA, 25 bp, Mus musculus
agcctaatcatgtttccagcgttca

SEQ ID NO: 174263 - DNA, 25 bp, Mus musculus
agcctaatgcccatgctccatacta

SEQ ID NO: 174264 - DNA, 25 bp, Mus musculus
agcctaatgcccttgctccatacta

SEQ ID NO: 174265 - DNA, 25 bp, Mus musculus
agcctaatgctgatgtgtaatgtgt

SEQ ID NO: 174266 - DNA, 25 bp, Mus musculus
agcctaatgctgttgtgtaatgtgt

SEQ ID NO: 174267 - DNA, 25 bp, Mus musculus
agcctaatgttacacggccttgtga

SEQ ID NO: 174268 - DNA, 25 bp, Mus musculus
agcctaatgttaccttgcaccatga

SEQ ID NO: 174269 - DNA, 25 bp, Mus musculus
agcctaatgttagacggccttgtga

SEQ ID NO: 174270 - DNA, 25 bp, Mus musculus
agcctaatgttagcttgcaccatga

SEQ ID NO: 174271 - DNA, 25 bp, Mus musculus
agcctaattcttaggccatcgtatt

SEQ ID NO: 174272 - DNA, 25 bp, Mus musculus
agcctaattctttggccatcgtatt

SEQ ID NO: 174273 - DNA, 25 bp, Mus musculus
agcctaattttactctagcagaaga

SEQ ID NO: 174274 - DNA, 25 bp, Mus musculus
agcctaattttagtctagcagaaga

SEQ ID NO: 174275 - DNA, 25 bp, Mus musculus
agcctacaagctcgaaatggttttc

SEQ ID NO: 174276 - DNA, 25 bp, Mus musculus
agcctacaagctggaaatggttttc

SEQ ID NO: 174277 - DNA, 25 bp, Mus musculus
agcctacactgcctgaggatcaagg

SEQ ID NO: 174278 - DNA, 25 bp, Mus musculus
agcctacactgcgtgaggatcaagg

SEQ ID NO: 174279 - DNA, 25 bp, Mus musculus
agcctacagacaacaaagctgacaa

SEQ ID NO: 174280 - DNA, 25 bp, Mus musculus
agcctacagacatcaaagctgacaa

SEQ ID NO: 174281 - DNA, 25 bp, Mus musculus
agcctacaggccctgctaaaaagca

SEQ ID NO: 174282 - DNA, 25 bp, Mus musculus
agcctacaggccgtgctaaaaagca

SEQ ID NO: 174283 - DNA, 25 bp, Mus musculus
agcctacagtagatgcatattatgc

SEQ ID NO: 174284 - DNA, 25 bp, Mus musculus
agcctacagtagttgcatattatgc

SEQ ID NO: 174285 - DNA, 25 bp, Mus musculus
agcctacagttgctgccgagggaca

SEQ ID NO: 174286 - DNA, 25 bp, Mus musculus
agcctacagttggtgccgagggaca

SEQ ID NO: 174287 - DNA, 25 bp, Mus musculus
agcctacatatcaaatccctgaacc

SEQ ID NO: 174288 - DNA, 25 bp, Mus musculus
agcctacatatctaatccctgaacc

SEQ ID NO: 174289 - DNA, 25 bp, Mus musculus
agcctacatcccatggtgactggta

SEQ ID NO: 174290 - DNA, 25 bp, Mus musculus
agcctacatcccttggtgactggta

SEQ ID NO: 174291 - DNA, 25 bp, Mus musculus
agcctaccaggtacttacagcagga

SEQ ID NO: 174292 - DNA, 25 bp, Mus musculus
agcctaccaggttcttacagcagga

SEQ ID NO: 174293 - DNA, 25 bp, Mus musculus
agcctaccggtcaacatggtgttga

SEQ ID NO: 174294 - DNA, 25 bp, Mus musculus
agcctaccggtctacatggtgttga

SEQ ID NO: 174295 - DNA, 25 bp, Mus musculus
agcctaccgtagctacaatctgcta

SEQ ID NO: 174296 - DNA, 25 bp, Mus musculus
agcctaccgtaggtacaatctgcta

SEQ ID NO: 174297 - DNA, 25 bp, Mus musculus
agcctacctagaatctacacctgtt

SEQ ID NO: 174298 - DNA, 25 bp, Mus musculus
agcctacctagattctacacctgtt

SEQ ID NO: 174299 - DNA, 25 bp, Mus musculus
agcctacctcccaacctgggtagag

SEQ ID NO: 174300 - DNA, 25 bp, Mus musculus
agcctacctccctacctgggtagag

SEQ ID NO: 174301 - DNA, 25 bp, Mus musculus
agcctacctgtcacagtagtgggtt

SEQ ID NO: 174302 - DNA, 25 bp, Mus musculus
agcctacctgtctcagtagtgggtt

SEQ ID NO: 174303 - DNA, 25 bp, Mus musculus
agcctacctttaagtgccagcattt

SEQ ID NO: 174304 - DNA, 25 bp, Mus musculus
agcctacctttatgtgccagcattt

SEQ ID NO: 174305 - DNA, 25 bp, Mus musculus
agcctacgaactcctcagtgattag

SEQ ID NO: 174306 - DNA, 25 bp, Mus musculus
agcctacgaactgctcagtgattag

SEQ ID NO: 174307 - DNA, 25 bp, Mus musculus
agcctacgaggccattgcagacgat

SEQ ID NO: 174308 - DNA, 25 bp, Mus musculus
agcctacgaggcgattgcagacgat

SEQ ID NO: 174309 - DNA, 25 bp, Mus musculus
agcctacgggctcaatgtgaggaac

SEQ ID NO: 174310 - DNA, 25 bp, Mus musculus
agcctacgggctgaatgtgaggaac

SEQ ID NO: 174311 - DNA, 25 bp, Mus musculus
agcctactatccacatgcccagaga

SEQ ID NO: 174312 - DNA, 25 bp, Mus musculus
agcctactatcctcatgcccagaga

SEQ ID NO: 174313 - DNA, 25 bp, Mus musculus
agcctactcattatgttcagggcaa

SEQ ID NO: 174314 - DNA, 25 bp, Mus musculus
agcctactcattttgttcagggcaa

SEQ ID NO: 174315 - DNA, 25 bp, Mus musculus
agcctactccagagaccagtgactc

SEQ ID NO: 174316 - DNA, 25 bp, Mus musculus
agcctactccagtgaccagtgactc

SEQ ID NO: 174317 - DNA, 25 bp, Mus musculus
agcctactccctcaatacctttagg

SEQ ID NO: 174318 - DNA, 25 bp, Mus musculus
agcctactccctgaatacctttagg

SEQ ID NO: 174319 - DNA, 25 bp, Mus musculus
agcctactctacacctagacagaag

SEQ ID NO: 174320 - DNA, 25 bp, Mus musculus
agcctactctactcctagacagaag

SEQ ID NO: 174321 - DNA, 25 bp, Mus musculus
agcctactgagactggcagccctga

SEQ ID NO: 174322 - DNA, 25 bp, Mus musculus
agcctactgagagtggcagccctga

SEQ ID NO: 174323 - DNA, 25 bp, Mus musculus
agcctacttgccactgttagcattg

SEQ ID NO: 174324 - DNA, 25 bp, Mus musculus
agcctacttgcctctgttagcattg

SEQ ID NO: 174325 - DNA, 25 bp, Mus musculus
agcctagaaactccctgctcaaagg

SEQ ID NO: 174326 - DNA, 25 bp, Mus musculus
agcctagaaactgcctgctcaaagg

SEQ ID NO: 174327 - DNA, 25 bp, Mus musculus
agcctagaatataacaacatacttt

SEQ ID NO: 174328 - DNA, 25 bp, Mus musculus
agcctagaatattacaacatacttt

SEQ ID NO: 174329 - DNA, 25 bp, Mus musculus
agcctagacaagaacctccgtttgg

SEQ ID NO: 174330 - DNA, 25 bp, Mus musculus
agcctagacaagtacctccgtttgg

SEQ ID NO: 174331 - DNA, 25 bp, Mus musculus
agcctagacctcactataagtctgg

SEQ ID NO: 174332 - DNA, 25 bp, Mus musculus
agcctagacctctctataagtctgg

SEQ ID NO: 174333 - DNA, 25 bp, Mus musculus
agcctagacctgagaaatctgaagt

SEQ ID NO: 174334 - DNA, 25 bp, Mus musculus
agcctagacctgtgaaatctgaagt

SEQ ID NO: 174335 - DNA, 25 bp, Mus musculus
agcctagacgtcagccaatgtgtat

SEQ ID NO: 174336 - DNA, 25 bp, Mus musculus
agcctagacgtctgccaatgtgtat

SEQ ID NO: 174337 - DNA, 25 bp, Mus musculus
agcctagagcacatactgagagcaa

SEQ ID NO: 174338 - DNA, 25 bp, Mus musculus
agcctagagcacttactgagagcaa

SEQ ID NO: 174339 - DNA, 25 bp, Mus musculus
agcctagagctcagttttagtttaa

SEQ ID NO: 174340 - DNA, 25 bp, Mus musculus
agcctagagctctgttttagtttaa

SEQ ID NO: 174341 - DNA, 25 bp, Mus musculus
agcctagcaggtaccttcaggagct

SEQ ID NO: 174342 - DNA, 25 bp, Mus musculus
agcctagcaggttccttcaggagct

SEQ ID NO: 174343 - DNA, 25 bp, Mus musculus
agcctagcattcatgtgcaaaagca

SEQ ID NO: 174344 - DNA, 25 bp, Mus musculus
agcctagcattcttgtgcaaaagca

SEQ ID NO: 174345 - DNA, 25 bp, Mus musculus
agcctagcccggacttctgtgagca

SEQ ID NO: 174346 - DNA, 25 bp, Mus musculus
agcctagcccggtcttctgtgagca

SEQ ID NO: 174347 - DNA, 25 bp, Mus musculus
agcctagccctacagtatggtcttt

SEQ ID NO: 174348 - DNA, 25 bp, Mus musculus
agcctagccctagagtatggtcttt

SEQ ID NO: 174349 - DNA, 25 bp, Mus musculus
agcctagcccttaggaaatagtccg

SEQ ID NO: 174350 - DNA, 25 bp, Mus musculus
agcctagccctttggaaatagtccg

SEQ ID NO: 174351 - DNA, 25 bp, Mus musculus
agcctagcctgcattgcttaatgag

SEQ ID NO: 174352 - DNA, 25 bp, Mus musculus
agcctagcctgctttgcttaatgag

SEQ ID NO: 174353 - DNA, 25 bp, Mus musculus
agcctagctccacaaagcctggtgt

SEQ ID NO: 174354 - DNA, 25 bp, Mus musculus
agcctagctccagaaagcctggtgt

SEQ ID NO: 174355 - DNA, 25 bp, Mus musculus
agcctagctggtcatttctttgtaa

SEQ ID NO: 174356 - DNA, 25 bp, Mus musculus
agcctagctggtgatttctttgtaa

SEQ ID NO: 174357 - DNA, 25 bp, Mus musculus
agcctagctgtaaaactcgagttcc

SEQ ID NO: 174358 - DNA, 25 bp, Mus musculus
agcctagctgtaatcgcaatcctgg

SEQ ID NO: 174359 - DNA, 25 bp, Mus musculus
agcctagctgtataactcgagttcc

SEQ ID NO: 174360 - DNA, 25 bp, Mus musculus
agcctagctgtattcgcaatcctgg

SEQ ID NO: 174361 - DNA, 25 bp, Mus musculus
agcctagcttaaaacttctctcagt

SEQ ID NO: 174362 - DNA, 25 bp, Mus musculus
agcctagcttaatacttctctcagt

SEQ ID NO: 174363 - DNA, 25 bp, Mus musculus
agcctaggaggcattccgaagcaag

SEQ ID NO: 174364 - DNA, 25 bp, Mus musculus
agcctaggaggctttccgaagcaag

SEQ ID NO: 174365 - DNA, 25 bp, Mus musculus
agcctaggccagagaccctgaaacc

SEQ ID NO: 174366 - DNA, 25 bp, Mus musculus
agcctaggccagagatcccgaaacc

SEQ ID NO: 174367 - DNA, 25 bp, Mus musculus
agcctaggccagtgaccctgaaacc

SEQ ID NO: 174368 - DNA, 25 bp, Mus musculus
agcctaggccagtgatcccgaaacc

SEQ ID NO: 174369 - DNA, 25 bp, Mus musculus
agcctaggcgggaggcttcttcaga

SEQ ID NO: 174370 - DNA, 25 bp, Mus musculus
agcctaggcgggtggcttcttcaga

SEQ ID NO: 174371 - DNA, 25 bp, Mus musculus
agcctaggctttcgctgccgctgga

SEQ ID NO: 174372 - DNA, 25 bp, Mus musculus
agcctaggctttggctgccgctgga

SEQ ID NO: 174373 - DNA, 25 bp, Mus musculus
agcctagggcacataacaagtctca

SEQ ID NO: 174374 - DNA, 25 bp, Mus musculus
agcctagggcacttaacaagtctca

SEQ ID NO: 174375 - DNA, 25 bp, Mus musculus
agcctagggctacttttacatctgg

SEQ ID NO: 174376 - DNA, 25 bp, Mus musculus
agcctagggctagttttacatctgg

SEQ ID NO: 174377 - DNA, 25 bp, Mus musculus
agcctagggctgcagtacattcaaa

SEQ ID NO: 174378 - DNA, 25 bp, Mus musculus
agcctagggctggagtacattcaaa

SEQ ID NO: 174379 - DNA, 25 bp, Mus musculus
agcctaggtcagcaattcaggagtt

SEQ ID NO: 174380 - DNA, 25 bp, Mus musculus
agcctaggtcaggaattcaggagtt

SEQ ID NO: 174381 - DNA, 25 bp, Mus musculus
agcctaggttctatgaggccccagc

SEQ ID NO: 174382 - DNA, 25 bp, Mus musculus
agcctaggttctttgaggccccagc

SEQ ID NO: 174383 - DNA, 25 bp, Mus musculus
agcctaggttgtccaaagctcacta

SEQ ID NO: 174384 - DNA, 25 bp, Mus musculus
agcctaggttgtgcaaagctcacta

SEQ ID NO: 174385 - DNA, 25 bp, Mus musculus
agcctagtctatatcaagagttcca

SEQ ID NO: 174386 - DNA, 25 bp, Mus musculus
agcctagtctatttcaagagttcca

SEQ ID NO: 174387 - DNA, 25 bp, Mus musculus
agcctagtctccactcacagaagag

SEQ ID NO: 174388 - DNA, 25 bp, Mus musculus
agcctagtctcctctcacagaagag

SEQ ID NO: 174389 - DNA, 25 bp, Mus musculus
agcctagtgaacctggctagaatgc

SEQ ID NO: 174390 - DNA, 25 bp, Mus musculus
agcctagtgaacgtggctagaatgc

SEQ ID NO: 174391 - DNA, 25 bp, Mus musculus
agcctagtggccctaatccatgata

SEQ ID NO: 174392 - DNA, 25 bp, Mus musculus
agcctagtggccgtaatccatgata

SEQ ID NO: 174393 - DNA, 25 bp, Mus musculus
agcctagtgttgatctctgtggtgg

SEQ ID NO: 174394 - DNA, 25 bp, Mus musculus
agcctagtgttgttctctgtggtgg

SEQ ID NO: 174395 - DNA, 25 bp, Mus musculus
agcctatactgccagttgccactgg

SEQ ID NO: 174396 - DNA, 25 bp, Mus musculus
agcctatactgcgagttgccactgg

SEQ ID NO: 174397 - DNA, 25 bp, Mus musculus
agcctatagaagacgttgcagtttt

SEQ ID NO: 174398 - DNA, 25 bp, Mus musculus
agcctatagaagtcgttgcagtttt

SEQ ID NO: 174399 - DNA, 25 bp, Mus musculus
agcctataggccaatcagcatttta

SEQ ID NO: 174400 - DNA, 25 bp, Mus musculus
agcctataggcctatcagcatttta

SEQ ID NO: 174401 - DNA, 25 bp, Mus musculus
agcctatatttgcttttcttcctat

SEQ ID NO: 174402 - DNA, 25 bp, Mus musculus
agcctatatttggttttcttcctat

SEQ ID NO: 174403 - DNA, 25 bp, Mus musculus
agcctatcacatacgctacaagatg

SEQ ID NO: 174404 - DNA, 25 bp, Mus musculus
agcctatcacattcgctacaagatg

SEQ ID NO: 174405 - DNA, 25 bp, Mus musculus
agcctatcaccgagcaggtttggaa

SEQ ID NO: 174406 - DNA, 25 bp, Mus musculus
agcctatcaccgtgcaggtttggaa

SEQ ID NO: 174407 - DNA, 25 bp, Mus musculus
agcctatccttcctgagactgctgg

SEQ ID NO: 174408 - DNA, 25 bp, Mus musculus
agcctatccttcgtgagactgctgg

SEQ ID NO: 174409 - DNA, 25 bp, Mus musculus
agcctatctctaactgtgagtccta

SEQ ID NO: 174410 - DNA, 25 bp, Mus musculus
agcctatctctatctgtgagtccta

SEQ ID NO: 174411 - DNA, 25 bp, Mus musculus
agcctatctgccatactttattata

SEQ ID NO: 174412 - DNA, 25 bp, Mus musculus
agcctatctgccttactttattata

SEQ ID NO: 174413 - DNA, 25 bp, Mus musculus
agcctatgcctacctcatcaggtag

SEQ ID NO: 174414 - DNA, 25 bp, Mus musculus
agcctatgcctagctcatcaggtag

SEQ ID NO: 174415 - DNA, 25 bp, Mus musculus
agcctatgctgtatcaaaactatga

SEQ ID NO: 174416 - DNA, 25 bp, Mus musculus
agcctatgctgtttcaaaactatga

SEQ ID NO: 174417 - DNA, 25 bp, Mus musculus
agcctatggcgtcctacatgctaaa

SEQ ID NO: 174418 - DNA, 25 bp, Mus musculus
agcctatggcgtgctacatgctaaa

SEQ ID NO: 174419 - DNA, 25 bp, Mus musculus
agcctatggttcaggctggcagcat

SEQ ID NO: 174420 - DNA, 25 bp, Mus musculus
agcctatggttctggctggcagcat

SEQ ID NO: 174421 - DNA, 25 bp, Mus musculus
agcctatgtctcagcattttattaa

SEQ ID NO: 174422 - DNA, 25 bp, Mus musculus
agcctatgtctctgcattttattaa

SEQ ID NO: 174423 - DNA, 25 bp, Mus musculus
agcctatgtctgcattccccagaat

SEQ ID NO: 174424 - DNA, 25 bp, Mus musculus
agcctatgtctggattccccagaat

SEQ ID NO: 174425 - DNA, 25 bp, Mus musculus
agcctatgtggcaaagagcccataa

SEQ ID NO: 174426 - DNA, 25 bp, Mus musculus
agcctatgtggctaagagcccataa

SEQ ID NO: 174427 - DNA, 25 bp, Mus musculus
agcctattaatacaagccctgtgat

SEQ ID NO: 174428 - DNA, 25 bp, Mus musculus
agcctattaatagaagccctgtgat

SEQ ID NO: 174429 - DNA, 25 bp, Mus musculus
agcctattcacaaaagcttttccta

SEQ ID NO: 174430 - DNA, 25 bp, Mus musculus
agcctattcacataagcttttccta

SEQ ID NO: 174431 - DNA, 25 bp, Mus musculus
agcctattcaccaaactcacgatgt

SEQ ID NO: 174432 - DNA, 25 bp, Mus musculus
agcctattcacctaactcacgatgt

SEQ ID NO: 174433 - DNA, 25 bp, Mus musculus
agcctattccacaacactaaatctg

SEQ ID NO: 174434 - DNA, 25 bp, Mus musculus
agcctattccactacactaaatctg

SEQ ID NO: 174435 - DNA, 25 bp, Mus musculus
agcctattgaatagccctctggtga

SEQ ID NO: 174436 - DNA, 25 bp, Mus musculus
agcctattgaattgccctctggtga

SEQ ID NO: 174437 - DNA, 25 bp, Mus musculus
agcctattggatccggtcaactgtc

SEQ ID NO: 174438 - DNA, 25 bp, Mus musculus
agcctattggatgcggtcaactgtc

SEQ ID NO: 174439 - DNA, 25 bp, Mus musculus
agcctattgtagctggtgctggccc

SEQ ID NO: 174440 - DNA, 25 bp, Mus musculus
agcctattgtaggtggtgctggccc

SEQ ID NO: 174441 - DNA, 25 bp, Mus musculus
agcctcaaagtacccacctaagata

SEQ ID NO: 174442 - DNA, 25 bp, Mus musculus
agcctcaaagtacccctgaactgtt

SEQ ID NO: 174443 - DNA, 25 bp, Mus musculus
agcctcaaagtagccacctaagata

SEQ ID NO: 174444 - DNA, 25 bp, Mus musculus
agcctcaaagtagccctgaactgtt

SEQ ID NO: 174445 - DNA, 25 bp, Mus musculus
agcctcaacagcagcagacagaccg

SEQ ID NO: 174446 - DNA, 25 bp, Mus musculus
agcctcaacagctgcagacagaccg

SEQ ID NO: 174447 - DNA, 25 bp, Mus musculus
agcctcaaccccatcgttgttattt

SEQ ID NO: 174448 - DNA, 25 bp, Mus musculus
agcctcaaccccttcgttgttattt

SEQ ID NO: 174449 - DNA, 25 bp, Mus musculus
agcctcaagattccgctggagctgg

SEQ ID NO: 174450 - DNA, 25 bp, Mus musculus
agcctcaagattgcgctggagctgg

SEQ ID NO: 174451 - DNA, 25 bp, Mus musculus
agcctcaagcttctactatagccaa

SEQ ID NO: 174452 - DNA, 25 bp, Mus musculus
agcctcaagcttgtactatagccaa

SEQ ID NO: 174453 - DNA, 25 bp, Mus musculus
agcctcaaggacatcttctttagca

SEQ ID NO: 174454 - DNA, 25 bp, Mus musculus
agcctcaaggacttcttctttagca

SEQ ID NO: 174455 - DNA, 25 bp, Mus musculus
agcctcaaggagacactgctttaaa

SEQ ID NO: 174456 - DNA, 25 bp, Mus musculus
agcctcaaggagtcactgctttaaa

SEQ ID NO: 174457 - DNA, 25 bp, Mus musculus
agcctcaaggtcatcaacaaccagc

SEQ ID NO: 174458 - DNA, 25 bp, Mus musculus
agcctcaaggtcttcaacaaccagc

SEQ ID NO: 174459 - DNA, 25 bp, Mus musculus
agcctcaataagcactaagaatttt

SEQ ID NO: 174460 - DNA, 25 bp, Mus musculus
agcctcaataaggactaagaatttt

SEQ ID NO: 174461 - DNA, 25 bp, Mus musculus
agcctcaatgggatcacagaaacaa

SEQ ID NO: 174462 - DNA, 25 bp, Mus musculus
agcctcaatgggttcacagaaacaa

SEQ ID NO: 174463 - DNA, 25 bp, Mus musculus
agcctcaattcaacatttcagggtt

SEQ ID NO: 174464 - DNA, 25 bp, Mus musculus
agcctcaattcatcatttcagggtt

SEQ ID NO: 174465 - DNA, 25 bp, Mus musculus
agcctcaattgtctggctgacccca

SEQ ID NO: 174466 - DNA, 25 bp, Mus musculus
agcctcaattgtgtggctgacccca

SEQ ID NO: 174467 - DNA, 25 bp, Mus musculus
agcctcacaagacgttcgcacacat

SEQ ID NO: 174468 - DNA, 25 bp, Mus musculus
agcctcacaagaggttcgcacacat

SEQ ID NO: 174469 - DNA, 25 bp, Mus musculus
agcctcacacagatgccaggtggca

SEQ ID NO: 174470 - DNA, 25 bp, Mus musculus
agcctcacacagttgccaggtggca

SEQ ID NO: 174471 - DNA, 25 bp, Mus musculus
agcctcaccaacactgatgacaaaa

SEQ ID NO: 174472 - DNA, 25 bp, Mus musculus
agcctcaccaactctgatgacaaaa

SEQ ID NO: 174473 - DNA, 25 bp, Mus musculus
agcctcaccacaaacatgctgtgtg

SEQ ID NO: 174474 - DNA, 25 bp, Mus musculus
agcctcaccacatacatgctgtgtg

SEQ ID NO: 174475 - DNA, 25 bp, Mus musculus
agcctcacctgcatagtaagaccct

SEQ ID NO: 174476 - DNA, 25 bp, Mus musculus
agcctcacctgcttagtaagaccct

SEQ ID NO: 174477 - DNA, 25 bp, Mus musculus
agcctcactgtgcatgctcgggcaa

SEQ ID NO: 174478 - DNA, 25 bp, Mus musculus
agcctcactgtggatgctcgggcaa

SEQ ID NO: 174479 - DNA, 25 bp, Mus musculus
agcctcacttgaataccatcttgct

SEQ ID NO: 174480 - DNA, 25 bp, Mus musculus
agcctcacttgattaccatcttgct

SEQ ID NO: 174481 - DNA, 25 bp, Mus musculus
agcctcactttccagagacaagctt

SEQ ID NO: 174482 - DNA, 25 bp, Mus musculus
agcctcactttcgagagacaagctt

SEQ ID NO: 174483 - DNA, 25 bp, Mus musculus
agcctcagaaatactacgctcttct

SEQ ID NO: 174484 - DNA, 25 bp, Mus musculus
agcctcagaaattctacgctcttct

SEQ ID NO: 174485 - DNA, 25 bp, Mus musculus
agcctcagaaccctgctctgagaag

SEQ ID NO: 174486 - DNA, 25 bp, Mus musculus
agcctcagaaccgtgctctgagaag

SEQ ID NO: 174487 - DNA, 25 bp, Mus musculus
agcctcagactgaacagagccagac

SEQ ID NO: 174488 - DNA, 25 bp, Mus musculus
agcctcagactgaatgtggactcaa

SEQ ID NO: 174489 - DNA, 25 bp, Mus musculus
agcctcagactgtacagagccagac

SEQ ID NO: 174490 - DNA, 25 bp, Mus musculus
agcctcagactgtatgtggactcaa

SEQ ID NO: 174491 - DNA, 25 bp, Mus musculus
agcctcagaggtatccaggagcttc

SEQ ID NO: 174492 - DNA, 25 bp, Mus musculus
agcctcagaggtttccaggagcttc

SEQ ID NO: 174493 - DNA, 25 bp, Mus musculus
agcctcagcacccttaagtagcttt

SEQ ID NO: 174494 - DNA, 25 bp, Mus musculus
agcctcagcaccgttaagtagcttt

SEQ ID NO: 174495 - DNA, 25 bp, Mus musculus
agcctcagcactccaaaaacaagtt

SEQ ID NO: 174496 - DNA, 25 bp, Mus musculus
agcctcagcactgcaaaaacaagtt

SEQ ID NO: 174497 - DNA, 25 bp, Mus musculus
agcctcagcaggatgttatcagccc

SEQ ID NO: 174498 - DNA, 25 bp, Mus musculus
agcctcagcaggttgttatcagccc

SEQ ID NO: 174499 - DNA, 25 bp, Mus musculus
agcctcagccatactctagtgtaaa

SEQ ID NO: 174500 - DNA, 25 bp, Mus musculus
agcctcagccattctctagtgtaaa

SEQ ID NO: 174501 - DNA, 25 bp, Mus musculus
agcctcagcctgagtgtttagtcac

SEQ ID NO: 174502 - DNA, 25 bp, Mus musculus
agcctcagcctgtgtgtttagtcac

SEQ ID NO: 174503 - DNA, 25 bp, Mus musculus
agcctcagctacatggtaactttca

SEQ ID NO: 174504 - DNA, 25 bp, Mus musculus
agcctcagctacttggtaactttca

SEQ ID NO: 174505 - DNA, 25 bp, Mus musculus
agcctcaggagcaccatgaacagat

SEQ ID NO: 174506 - DNA, 25 bp, Mus musculus
agcctcaggagctccatgaacagat

SEQ ID NO: 174507 - DNA, 25 bp, Mus musculus
agcctcaggcagctcagacagtgct

SEQ ID NO: 174508 - DNA, 25 bp, Mus musculus
agcctcaggcaggtcagacagtgct

SEQ ID NO: 174509 - DNA, 25 bp, Mus musculus
agcctcaggccaacttcaaggttaa

SEQ ID NO: 174510 - DNA, 25 bp, Mus musculus
agcctcaggccatcttcaaggttaa

SEQ ID NO: 174511 - DNA, 25 bp, Mus musculus
agcctcaggtcgagccatccggaag

SEQ ID NO: 174512 - DNA, 25 bp, Mus musculus
agcctcaggtcgtgccatccggaag

SEQ ID NO: 174513 - DNA, 25 bp, Mus musculus
agcctcaggtgactcagctcatctg

SEQ ID NO: 174514 - DNA, 25 bp, Mus musculus
agcctcaggtgagtcagctcatctg

SEQ ID NO: 174515 - DNA, 25 bp, Mus musculus
agcctcagtattcgtgctctggttg

SEQ ID NO: 174516 - DNA, 25 bp, Mus musculus
agcctcagtattggtgctctggttg

SEQ ID NO: 174517 - DNA, 25 bp, Mus musculus
agcctcagtgctactagacattcct

SEQ ID NO: 174518 - DNA, 25 bp, Mus musculus
agcctcagtgcttctagacattcct

SEQ ID NO: 174519 - DNA, 25 bp, Mus musculus
agcctcagtgtcctgaaagctgcca

SEQ ID NO: 174520 - DNA, 25 bp, Mus musculus
agcctcagtgtcgtgaaagctgcca

SEQ ID NO: 174521 - DNA, 25 bp, Mus musculus
agcctcagtgttaggagggccccaa

SEQ ID NO: 174522 - DNA, 25 bp, Mus musculus
agcctcagtgtttggagggccccaa

SEQ ID NO: 174523 - DNA, 25 bp, Mus musculus
agcctcatagctaatacctcttttg

SEQ ID NO: 174524 - DNA, 25 bp, Mus musculus
agcctcatagcttatacctcttttg

SEQ ID NO: 174525 - DNA, 25 bp, Mus musculus
agcctcatcaccagcgggagagtct

SEQ ID NO: 174526 - DNA, 25 bp, Mus musculus
agcctcatcacctgcgggagagtct

SEQ ID NO: 174527 - DNA, 25 bp, Mus musculus
agcctcatcgtcatcagaatgcgaa

SEQ ID NO: 174528 - DNA, 25 bp, Mus musculus
agcctcatcgtcttcagaatgcgaa

SEQ ID NO: 174529 - DNA, 25 bp, Mus musculus
agcctcatgacccagtgctggaatg

SEQ ID NO: 174530 - DNA, 25 bp, Mus musculus
agcctcatgaccgagtgctggaatg

SEQ ID NO: 174531 - DNA, 25 bp, Mus musculus
agcctcatggctcagttcagcgtcg

SEQ ID NO: 174532 - DNA, 25 bp, Mus musculus
agcctcatggctgagttcagcgtcg

SEQ ID NO: 174533 - DNA, 25 bp, Mus musculus
agcctcatgggcacctcagagcagg

SEQ ID NO: 174534 - DNA, 25 bp, Mus musculus
agcctcatgggctcctcagagcagg

SEQ ID NO: 174535 - DNA, 25 bp, Mus musculus
agcctcatgtgtatccctattctat

SEQ ID NO: 174536 - DNA, 25 bp, Mus musculus
agcctcatgtgtttccctattctat

SEQ ID NO: 174537 - DNA, 25 bp, Mus musculus
agcctcattcatcacgctgctgaag

SEQ ID NO: 174538 - DNA, 25 bp, Mus musculus
agcctcattcatcactgctgagctt

SEQ ID NO: 174539 - DNA, 25 bp, Mus musculus
agcctcattcatgacgctgctgaag

SEQ ID NO: 174540 - DNA, 25 bp, Mus musculus
agcctcattcatgactgctgagctt

SEQ ID NO: 174541 - DNA, 25 bp, Mus musculus
agcctcatttcaagccatggctgca

SEQ ID NO: 174542 - DNA, 25 bp, Mus musculus
agcctcatttcacgtctgagttcag

SEQ ID NO: 174543 - DNA, 25 bp, Mus musculus
agcctcatttcaggtctgagttcag

SEQ ID NO: 174544 - DNA, 25 bp, Mus musculus
agcctcatttcatgccatggctgca

SEQ ID NO: 174545 - DNA, 25 bp, Mus musculus
agcctcattttgattctgtggtcga

SEQ ID NO: 174546 - DNA, 25 bp, Mus musculus
agcctcattttgtttctgtggtcga

SEQ ID NO: 174547 - DNA, 25 bp, Mus musculus
agcctcatttttctttcagcagcag

SEQ ID NO: 174548 - DNA, 25 bp, Mus musculus
agcctcatttttgtttcagcagcag

SEQ ID NO: 174549 - DNA, 25 bp, Mus musculus
agcctccaactcactgggatttgtg

SEQ ID NO: 174550 - DNA, 25 bp, Mus musculus
agcctccaactctctgggatttgtg

SEQ ID NO: 174551 - DNA, 25 bp, Mus musculus
agcctccaagtgctccaagatccaa

SEQ ID NO: 174552 - DNA, 25 bp, Mus musculus
agcctccaagtggtccaagatccaa

SEQ ID NO: 174553 - DNA, 25 bp, Mus musculus
agcctccacacgagtgttctagtac

SEQ ID NO: 174554 - DNA, 25 bp, Mus musculus
agcctccacacgtgtgttctagtac

SEQ ID NO: 174555 - DNA, 25 bp, Mus musculus
agcctccaccgaactgggcagaagc

SEQ ID NO: 174556 - DNA, 25 bp, Mus musculus
agcctccaccgatctgggcagaagc

SEQ ID NO: 174557 - DNA, 25 bp, Mus musculus
agcctccacttcagcttgatatacg

SEQ ID NO: 174558 - DNA, 25 bp, Mus musculus
agcctccacttctgcttgatatacg

SEQ ID NO: 174559 - DNA, 25 bp, Mus musculus
agcctccagagaagaaaccactttt

SEQ ID NO: 174560 - DNA, 25 bp, Mus musculus
agcctccagagatgaaaccactttt

SEQ ID NO: 174561 - DNA, 25 bp, Mus musculus
agcctccagatcagtgtgggcagtt

SEQ ID NO: 174562 - DNA, 25 bp, Mus musculus
agcctccagatctgtgtgggcagtt

SEQ ID NO: 174563 - DNA, 25 bp, Mus musculus
agcctccagcaaacagttcagcttg

SEQ ID NO: 174564 - DNA, 25 bp, Mus musculus
agcctccagcaatcagttcagcttg

SEQ ID NO: 174565 - DNA, 25 bp, Mus musculus
agcctccagcgtcagttcttccagg

SEQ ID NO: 174566 - DNA, 25 bp, Mus musculus
agcctccagcgtgagttcttccagg

SEQ ID NO: 174567 - DNA, 25 bp, Mus musculus
agcctccaggctcaatgtcaattgc

SEQ ID NO: 174568 - DNA, 25 bp, Mus musculus
agcctccaggctgaatgtcaattgc

SEQ ID NO: 174569 - DNA, 25 bp, Mus musculus
agcctccagggcctcagtagccagt

SEQ ID NO: 174570 - DNA, 25 bp, Mus musculus
agcctccagggcgtcagtagccagt

SEQ ID NO: 174571 - DNA, 25 bp, Mus musculus
agcctccaggtcatgtccagggaaa

SEQ ID NO: 174572 - DNA, 25 bp, Mus musculus
agcctccaggtcttgtccagggaaa

SEQ ID NO: 174573 - DNA, 25 bp, Mus musculus
agcctccagttcagctgcactagaa

SEQ ID NO: 174574 - DNA, 25 bp, Mus musculus
agcctccagttctgctgcactagaa

SEQ ID NO: 174575 - DNA, 25 bp, Mus musculus
agcctccatcacagccaagtgttgg

SEQ ID NO: 174576 - DNA, 25 bp, Mus musculus
agcctccatcactgccaagtgttgg

SEQ ID NO: 174577 - DNA, 25 bp, Mus musculus
agcctcccagtcattcctctgattt

SEQ ID NO: 174578 - DNA, 25 bp, Mus musculus
agcctcccagtctttcctctgattt

SEQ ID NO: 174579 - DNA, 25 bp, Mus musculus
agcctccccagtcattagtgtgtta

SEQ ID NO: 174580 - DNA, 25 bp, Mus musculus
agcctccccagtgattagtgtgtta

SEQ ID NO: 174581 - DNA, 25 bp, Mus musculus
agcctcccgccaagggtaatgagga

SEQ ID NO: 174582 - DNA, 25 bp, Mus musculus
agcctcccgccatgggtaatgagga

SEQ ID NO: 174583 - DNA, 25 bp, Mus musculus
agcctcccggaaatagcttgcttct

SEQ ID NO: 174584 - DNA, 25 bp, Mus musculus
agcctcccggaattagcttgcttct

SEQ ID NO: 174585 - DNA, 25 bp, Mus musculus
agcctccctacaatctttattttga

SEQ ID NO: 174586 - DNA, 25 bp, Mus musculus
agcctccctacattctttattttga

SEQ ID NO: 174587 - DNA, 25 bp, Mus musculus
agcctccctatcaactgcatgaggt

SEQ ID NO: 174588 - DNA, 25 bp, Mus musculus
agcctccctatctactgcatgaggt

SEQ ID NO: 174589 - DNA, 25 bp, Mus musculus
agcctccctatgctaacctgatttt

SEQ ID NO: 174590 - DNA, 25 bp, Mus musculus
agcctccctatggtaacctgatttt

SEQ ID NO: 174591 - DNA, 25 bp, Mus musculus
agcctccctcaaaatagtcctatta

SEQ ID NO: 174592 - DNA, 25 bp, Mus musculus
agcctccctcaatatagtcctatta

SEQ ID NO: 174593 - DNA, 25 bp, Mus musculus
agcctccctcctatagattagtgtt

SEQ ID NO: 174594 - DNA, 25 bp, Mus musculus
agcctccctcctttagattagtgtt

SEQ ID NO: 174595 - DNA, 25 bp, Mus musculus
agcctccctgaacctgaccttgaaa

SEQ ID NO: 174596 - DNA, 25 bp, Mus musculus
agcctccctgaagctgaccttgaaa

SEQ ID NO: 174597 - DNA, 25 bp, Mus musculus
agcctccgacacactgcaggaagta

SEQ ID NO: 174598 - DNA, 25 bp, Mus musculus
agcctccgacactctgcaggaagta

SEQ ID NO: 174599 - DNA, 25 bp, Mus musculus
agcctccgggtgacactcggagaaa

SEQ ID NO: 174600 - DNA, 25 bp, Mus musculus
agcctccgggtgtcactcggagaaa

SEQ ID NO: 174601 - DNA, 25 bp, Mus musculus
agcctccggtttaggtgtctccatc

SEQ ID NO: 174602 - DNA, 25 bp, Mus musculus
agcctccggttttggtgtctccatc

SEQ ID NO: 174603 - DNA, 25 bp, Mus musculus
agcctccgtgccctagcccaatcga

SEQ ID NO: 174604 - DNA, 25 bp, Mus musculus
agcctccgtgccgtagcccaatcga

SEQ ID NO: 174605 - DNA, 25 bp, Mus musculus
agcctcctaagcaactggaactaga

SEQ ID NO: 174606 - DNA, 25 bp, Mus musculus
agcctcctaagctactggaactaga

SEQ ID NO: 174607 - DNA, 25 bp, Mus musculus
agcctcctacacctattagatactg

SEQ ID NO: 174608 - DNA, 25 bp, Mus musculus
agcctcctacacgtattagatactg

SEQ ID NO: 174609 - DNA, 25 bp, Mus musculus
agcctcctacctacagcaactgatg

SEQ ID NO: 174610 - DNA, 25 bp, Mus musculus
agcctcctaccttcagcaactgatg

SEQ ID NO: 174611 - DNA, 25 bp, Mus musculus
agcctcctccagaacagatgacaga

SEQ ID NO: 174612 - DNA, 25 bp, Mus musculus
agcctcctccagtacagatgacaga

SEQ ID NO: 174613 - DNA, 25 bp, Mus musculus
agcctcctcgtgagtactgtactgt

SEQ ID NO: 174614 - DNA, 25 bp, Mus musculus
agcctcctcgtgtgtactgtactgt

SEQ ID NO: 174615 - DNA, 25 bp, Mus musculus
agcctcctctaactcagcaatgagt

SEQ ID NO: 174616 - DNA, 25 bp, Mus musculus
agcctcctctaagtcagcaatgagt

SEQ ID NO: 174617 - DNA, 25 bp, Mus musculus
agcctcctgacactataaatggaaa

SEQ ID NO: 174618 - DNA, 25 bp, Mus musculus
agcctcctgacactgcatttggaaa

SEQ ID NO: 174619 - DNA, 25 bp, Mus musculus
agcctcctgacagtataaatggaaa

SEQ ID NO: 174620 - DNA, 25 bp, Mus musculus
agcctcctgacagtgcatttggaaa

SEQ ID NO: 174621 - DNA, 25 bp, Mus musculus
agcctcctgactatcagggttgcaa

SEQ ID NO: 174622 - DNA, 25 bp, Mus musculus
agcctcctgactttcagggttgcaa

SEQ ID NO: 174623 - DNA, 25 bp, Mus musculus
agcctcctgagcagtctacaggtaa

SEQ ID NO: 174624 - DNA, 25 bp, Mus musculus
agcctcctgagctgtctacaggtaa

SEQ ID NO: 174625 - DNA, 25 bp, Mus musculus
agcctcctgataactaaattcttgt

SEQ ID NO: 174626 - DNA, 25 bp, Mus musculus
agcctcctgatatctaaattcttgt

SEQ ID NO: 174627 - DNA, 25 bp, Mus musculus
agcctcctgatgacaactctgaact

SEQ ID NO: 174628 - DNA, 25 bp, Mus musculus
agcctcctgatgcttcaaacaacac

SEQ ID NO: 174629 - DNA, 25 bp, Mus musculus
agcctcctgatggttcaaacaacac

SEQ ID NO: 174630 - DNA, 25 bp, Mus musculus
agcctcctgatgtcaactctgaact

SEQ ID NO: 174631 - DNA, 25 bp, Mus musculus
agcctcctgcacaatgagtttctgc

SEQ ID NO: 174632 - DNA, 25 bp, Mus musculus
agcctcctgcactatgagtttctgc

SEQ ID NO: 174633 - DNA, 25 bp, Mus musculus
agcctcctgcccatagtgagtttca

SEQ ID NO: 174634 - DNA, 25 bp, Mus musculus
agcctcctgcccttagtgagtttca

SEQ ID NO: 174635 - DNA, 25 bp, Mus musculus
agcctcctgctcacagacataggtc

SEQ ID NO: 174636 - DNA, 25 bp, Mus musculus
agcctcctgctctcagacataggtc

SEQ ID NO: 174637 - DNA, 25 bp, Mus musculus
agcctcctgcttcgtatggtgttca

SEQ ID NO: 174638 - DNA, 25 bp, Mus musculus
agcctcctgcttggtatggtgttca

SEQ ID NO: 174639 - DNA, 25 bp, Mus musculus
agcctcctggagatgaagtgattca

SEQ ID NO: 174640 - DNA, 25 bp, Mus musculus
agcctcctggagttgaagtgattca

SEQ ID NO: 174641 - DNA, 25 bp, Mus musculus
agcctcctgggaaaagtgtgagagc

SEQ ID NO: 174642 - DNA, 25 bp, Mus musculus
agcctcctgggaaacgtggcatgtc

SEQ ID NO: 174643 - DNA, 25 bp, Mus musculus
agcctcctgggataagtgtgagagc

SEQ ID NO: 174644 - DNA, 25 bp, Mus musculus
agcctcctgggatacgtggcatgtc

SEQ ID NO: 174645 - DNA, 25 bp, Mus musculus
agcctcctgggccatgagctttttt

SEQ ID NO: 174646 - DNA, 25 bp, Mus musculus
agcctcctgggcgatgagctttttt

SEQ ID NO: 174647 - DNA, 25 bp, Mus musculus
agcctcctgtccataactaaattag

SEQ ID NO: 174648 - DNA, 25 bp, Mus musculus
agcctcctgtccttaactaaattag

SEQ ID NO: 174649 - DNA, 25 bp, Mus musculus
agcctcctgtggacatctgtctgag

SEQ ID NO: 174650 - DNA, 25 bp, Mus musculus
agcctcctgtggtcatctgtctgag

SEQ ID NO: 174651 - DNA, 25 bp, Mus musculus
agcctcctgtttctggaagcacctg

SEQ ID NO: 174652 - DNA, 25 bp, Mus musculus
agcctcctgtttgtggaagcacctg

SEQ ID NO: 174653 - DNA, 25 bp, Mus musculus
agcctccttgagaagaatttcccgg

SEQ ID NO: 174654 - DNA, 25 bp, Mus musculus
agcctccttgagtagaatttcccgg

SEQ ID NO: 174655 - DNA, 25 bp, Mus musculus
agcctccttgtgcaactgttggatc

SEQ ID NO: 174656 - DNA, 25 bp, Mus musculus
agcctccttgtggaactgttggatc

SEQ ID NO: 174657 - DNA, 25 bp, Mus musculus
agcctcctttatatcatacagaatc

SEQ ID NO: 174658 - DNA, 25 bp, Mus musculus
agcctcctttatttcatacagaatc

SEQ ID NO: 174659 - DNA, 25 bp, Mus musculus
agcctcctttgtctaactagtcatg

SEQ ID NO: 174660 - DNA, 25 bp, Mus musculus
agcctcctttgtgtaactagtcatg

SEQ ID NO: 174661 - DNA, 25 bp, Mus musculus
agcctccttttaacagctctttgca

SEQ ID NO: 174662 - DNA, 25 bp, Mus musculus
agcctccttttatcagctctttgca

SEQ ID NO: 174663 - DNA, 25 bp, Mus musculus
agcctcgaaactcagctgggaccag

SEQ ID NO: 174664 - DNA, 25 bp, Mus musculus
agcctcgaaactccgatgacgaagt

SEQ ID NO: 174665 - DNA, 25 bp, Mus musculus
agcctcgaaactgagctgggaccag

SEQ ID NO: 174666 - DNA, 25 bp, Mus musculus
agcctcgaaactgcgatgacgaagt

SEQ ID NO: 174667 - DNA, 25 bp, Mus musculus
agcctcgaactccagaggagccaga

SEQ ID NO: 174668 - DNA, 25 bp, Mus musculus
agcctcgaactcgagaggagccaga

SEQ ID NO: 174669 - DNA, 25 bp, Mus musculus
agcctcgaagccagaatgccagtgc

SEQ ID NO: 174670 - DNA, 25 bp, Mus musculus
agcctcgaagcctgaatgccagtgc

SEQ ID NO: 174671 - DNA, 25 bp, Mus musculus
agcctcgagtccacgcgggacgcag

SEQ ID NO: 174672 - DNA, 25 bp, Mus musculus
agcctcgagtcctcgcgggacgcag

SEQ ID NO: 174673 - DNA, 25 bp, Mus musculus
agcctcgatatcctcccaggttagt

SEQ ID NO: 174674 - DNA, 25 bp, Mus musculus
agcctcgatatcgtcccaggttagt

SEQ ID NO: 174675 - DNA, 25 bp, Mus musculus
agcctcgcacaaactctcagggtta

SEQ ID NO: 174676 - DNA, 25 bp, Mus musculus
agcctcgcacaatctctcagggtta

SEQ ID NO: 174677 - DNA, 25 bp, Mus musculus
agcctcgcagcacttgatggcgccg

SEQ ID NO: 174678 - DNA, 25 bp, Mus musculus
agcctcgcagcagttgatggcgccg

SEQ ID NO: 174679 - DNA, 25 bp, Mus musculus
agcctcgccccactgaatgggagaa

SEQ ID NO: 174680 - DNA, 25 bp, Mus musculus
agcctcgccccagtgaatgggagaa

SEQ ID NO: 174681 - DNA, 25 bp, Mus musculus
agcctcgcctgtagtgtcagaatca

SEQ ID NO: 174682 - DNA, 25 bp, Mus musculus
agcctcgcctgttgtgtcagaatca

SEQ ID NO: 174683 - DNA, 25 bp, Mus musculus
agcctcgctgacagttgactgtaca

SEQ ID NO: 174684 - DNA, 25 bp, Mus musculus
agcctcgctgactgttgactgtaca

SEQ ID NO: 174685 - DNA, 25 bp, Mus musculus
agcctcgcttcaatgtgtatagtta

SEQ ID NO: 174686 - DNA, 25 bp, Mus musculus
agcctcgcttcattgtgtatagtta

SEQ ID NO: 174687 - DNA, 25 bp, Mus musculus
agcctcggaaatctagcctttgtca

SEQ ID NO: 174688 - DNA, 25 bp, Mus musculus
agcctcggaaatgtagcctttgtca

SEQ ID NO: 174689 - DNA, 25 bp, Mus musculus
agcctcggaccaagactgactatgg

SEQ ID NO: 174690 - DNA, 25 bp, Mus musculus
agcctcggaccatgactgactatgg

SEQ ID NO: 174691 - DNA, 25 bp, Mus musculus
agcctcggagcccttggagttcacg

SEQ ID NO: 174692 - DNA, 25 bp, Mus musculus
agcctcggagccgttggagttcacg

SEQ ID NO: 174693 - DNA, 25 bp, Mus musculus
agcctcggctagctttcacttctaa

SEQ ID NO: 174694 - DNA, 25 bp, Mus musculus
agcctcggctaggtttcacttctaa

SEQ ID NO: 174695 - DNA, 25 bp, Mus musculus
agcctcgggtgccattcctcaggag

SEQ ID NO: 174696 - DNA, 25 bp, Mus musculus
agcctcgggtgcgattcctcaggag

SEQ ID NO: 174697 - DNA, 25 bp, Mus musculus
agcctcggtccaattattcctgtgg

SEQ ID NO: 174698 - DNA, 25 bp, Mus musculus
agcctcggtccatttattcctgtgg

SEQ ID NO: 174699 - DNA, 25 bp, Mus musculus
agcctcgtatacctaatattttata

SEQ ID NO: 174700 - DNA, 25 bp, Mus musculus
agcctcgtatacgtaatattttata

SEQ ID NO: 174701 - DNA, 25 bp, Mus musculus
agcctcgtcattattactttccata

SEQ ID NO: 174702 - DNA, 25 bp, Mus musculus
agcctcgtcatttttactttccata

SEQ ID NO: 174703 - DNA, 25 bp, Mus musculus
agcctcgtctccatagccgttattg

SEQ ID NO: 174704 - DNA, 25 bp, Mus musculus
agcctcgtctccttagccgttattg

SEQ ID NO: 174705 - DNA, 25 bp, Mus musculus
agcctcgtcttcacagggagagcct

SEQ ID NO: 174706 - DNA, 25 bp, Mus musculus
agcctcgtcttctcagggagagcct

SEQ ID NO: 174707 - DNA, 25 bp, Mus musculus
agcctcgtgcagactgccttcattt

SEQ ID NO: 174708 - DNA, 25 bp, Mus musculus
agcctcgtgcagtctgccttcattt

SEQ ID NO: 174709 - DNA, 25 bp, Mus musculus
agcctcgtgcgaattgaatttatgc

SEQ ID NO: 174710 - DNA, 25 bp, Mus musculus
agcctcgtgcgatttgaatttatgc

SEQ ID NO: 174711 - DNA, 25 bp, Mus musculus
agcctcgtgctgagaaaacttgtga

SEQ ID NO: 174712 - DNA, 25 bp, Mus musculus
agcctcgtgctgtgaaaacttgtga

SEQ ID NO: 174713 - DNA, 25 bp, Mus musculus
agcctctaaaggaaatgccagcccc

SEQ ID NO: 174714 - DNA, 25 bp, Mus musculus
agcctctaaaggtaatgccagcccc

SEQ ID NO: 174715 - DNA, 25 bp, Mus musculus
agcctctaagtaactcaatcttttg

SEQ ID NO: 174716 - DNA, 25 bp, Mus musculus
agcctctaagtatctcaatcttttg

SEQ ID NO: 174717 - DNA, 25 bp, Mus musculus
agcctctacatactaagccccaaga

SEQ ID NO: 174718 - DNA, 25 bp, Mus musculus
agcctctacatagtaagccccaaga

SEQ ID NO: 174719 - DNA, 25 bp, Mus musculus
agcctctactccacgctatggagag

SEQ ID NO: 174720 - DNA, 25 bp, Mus musculus
agcctctactcctcgctatggagag

SEQ ID NO: 174721 - DNA, 25 bp, Mus musculus
agcctctagcccaggaaaaagcttg

SEQ ID NO: 174722 - DNA, 25 bp, Mus musculus
agcctctagccctggaaaaagcttg

SEQ ID NO: 174723 - DNA, 25 bp, Mus musculus
agcctctagtagaccctgctctttt

SEQ ID NO: 174724 - DNA, 25 bp, Mus musculus
agcctctagtagtccctgctctttt

SEQ ID NO: 174725 - DNA, 25 bp, Mus musculus
agcctctatgtaatcattcctgcat

SEQ ID NO: 174726 - DNA, 25 bp, Mus musculus
agcctctatgtattcattcctgcat

SEQ ID NO: 174727 - DNA, 25 bp, Mus musculus
agcctctcaattcaatgtgcccatg

SEQ ID NO: 174728 - DNA, 25 bp, Mus musculus
agcctctcaattgaatgtgcccatg

SEQ ID NO: 174729 - DNA, 25 bp, Mus musculus
agcctctcagccatgacttgtaagc

SEQ ID NO: 174730 - DNA, 25 bp, Mus musculus
agcctctcagccttgacttgtaagc

SEQ ID NO: 174731 - DNA, 25 bp, Mus musculus
agcctctcagctacattgtttgttt

SEQ ID NO: 174732 - DNA, 25 bp, Mus musculus
agcctctcagcttcattgtttgttt

SEQ ID NO: 174733 - DNA, 25 bp, Mus musculus
agcctctcatccatgtctttgcaaa

SEQ ID NO: 174734 - DNA, 25 bp, Mus musculus
agcctctcatccttgtctttgcaaa

SEQ ID NO: 174735 - DNA, 25 bp, Mus musculus
agcctctcatggattccttgtcgga

SEQ ID NO: 174736 - DNA, 25 bp, Mus musculus
agcctctcatggtttccttgtcgga

SEQ ID NO: 174737 - DNA, 25 bp, Mus musculus
agcctctccaatactgcgatggtct

SEQ ID NO: 174738 - DNA, 25 bp, Mus musculus
agcctctccaattctgcgatggtct

SEQ ID NO: 174739 - DNA, 25 bp, Mus musculus
agcctctccactatcctttgaagga

SEQ ID NO: 174740 - DNA, 25 bp, Mus musculus
agcctctccactttcctttgaagga

SEQ ID NO: 174741 - DNA, 25 bp, Mus musculus
agcctctcccgaaggttatgattgc

SEQ ID NO: 174742 - DNA, 25 bp, Mus musculus
agcctctcccgatggttatgattgc

SEQ ID NO: 174743 - DNA, 25 bp, Mus musculus
agcctctccctactggaatcatagg

SEQ ID NO: 174744 - DNA, 25 bp, Mus musculus
agcctctccctagtggaatcatagg

SEQ ID NO: 174745 - DNA, 25 bp, Mus musculus
agcctctccgggagtctgctttgtg

SEQ ID NO: 174746 - DNA, 25 bp, Mus musculus
agcctctccgggtgtctgctttgtg

SEQ ID NO: 174747 - DNA, 25 bp, Mus musculus
agcctctcctgcacgggatgacaaa

SEQ ID NO: 174748 - DNA, 25 bp, Mus musculus
agcctctcctgctcgggatgacaaa

SEQ ID NO: 174749 - DNA, 25 bp, Mus musculus
agcctctcctggcttgatttcaaag

SEQ ID NO: 174750 - DNA, 25 bp, Mus musculus
agcctctcctgggttgatttcaaag

SEQ ID NO: 174751 - DNA, 25 bp, Mus musculus
agcctctcctttaattagaacggca

SEQ ID NO: 174752 - DNA, 25 bp, Mus musculus
agcctctcctttactggtcacaaag

SEQ ID NO: 174753 - DNA, 25 bp, Mus musculus
agcctctccttttattagaacggca

SEQ ID NO: 174754 - DNA, 25 bp, Mus musculus
agcctctccttttctggtcacaaag

SEQ ID NO: 174755 - DNA, 25 bp, Mus musculus
agcctctctcccctaagaaagagta

SEQ ID NO: 174756 - DNA, 25 bp, Mus musculus
agcctctctcccgtaagaaagagta

SEQ ID NO: 174757 - DNA, 25 bp, Mus musculus
agcctctctcttctatcacaagaag

SEQ ID NO: 174758 - DNA, 25 bp, Mus musculus
agcctctctcttgtatcacaagaag

SEQ ID NO: 174759 - DNA, 25 bp, Mus musculus
agcctctctgacatggttgtctgtg

SEQ ID NO: 174760 - DNA, 25 bp, Mus musculus
agcctctctgacttggttgtctgtg

SEQ ID NO: 174761 - DNA, 25 bp, Mus musculus
agcctctctgtgaacttactgcaca

SEQ ID NO: 174762 - DNA, 25 bp, Mus musculus
agcctctctgtgtacttactgcaca

SEQ ID NO: 174763 - DNA, 25 bp, Mus musculus
agcctctcttaccagatcagtgtta

SEQ ID NO: 174764 - DNA, 25 bp, Mus musculus
agcctctcttacgagatcagtgtta

SEQ ID NO: 174765 - DNA, 25 bp, Mus musculus
agcctctcttttcctacacgtatat

SEQ ID NO: 174766 - DNA, 25 bp, Mus musculus
agcctctcttttgctacacgtatat

SEQ ID NO: 174767 - DNA, 25 bp, Mus musculus
agcctctgaagtaccagctggtctg

SEQ ID NO: 174768 - DNA, 25 bp, Mus musculus
agcctctgaagttccagctggtctg

SEQ ID NO: 174769 - DNA, 25 bp, Mus musculus
agcctctgagctataggtacgtcac

SEQ ID NO: 174770 - DNA, 25 bp, Mus musculus
agcctctgagctttaggtacgtcac

SEQ ID NO: 174771 - DNA, 25 bp, Mus musculus
agcctctgatttataatttgcataa

SEQ ID NO: 174772 - DNA, 25 bp, Mus musculus
agcctctgatttttaatttgcataa

SEQ ID NO: 174773 - DNA, 25 bp, Mus musculus
agcctctgcacccagggaaaatgtt

SEQ ID NO: 174774 - DNA, 25 bp, Mus musculus
agcctctgcaccgagggaaaatgtt

SEQ ID NO: 174775 - DNA, 25 bp, Mus musculus
agcctctgcataacatacccaaagt

SEQ ID NO: 174776 - DNA, 25 bp, Mus musculus
agcctctgcatatcatacccaaagt

SEQ ID NO: 174777 - DNA, 25 bp, Mus musculus
agcctctgcctgagaagtcagttga

SEQ ID NO: 174778 - DNA, 25 bp, Mus musculus
agcctctgcctgtgaagtcagttga

SEQ ID NO: 174779 - DNA, 25 bp, Mus musculus
agcctctgctcgacaaccaggttgg

SEQ ID NO: 174780 - DNA, 25 bp, Mus musculus
agcctctgctcgtcaaccaggttgg

SEQ ID NO: 174781 - DNA, 25 bp, Mus musculus
agcctctgctggaagcatgctgcag

SEQ ID NO: 174782 - DNA, 25 bp, Mus musculus
agcctctgctggtagcatgctgcag

SEQ ID NO: 174783 - DNA, 25 bp, Mus musculus
agcctctggacactgagactggaag

SEQ ID NO: 174784 - DNA, 25 bp, Mus musculus
agcctctggacagtgagactggaag

SEQ ID NO: 174785 - DNA, 25 bp, Mus musculus
agcctctggatcatgctggcgcttt

SEQ ID NO: 174786 - DNA, 25 bp, Mus musculus
agcctctggatcttgctggcgcttt

SEQ ID NO: 174787 - DNA, 25 bp, Mus musculus
agcctctggattatgggatgggaaa

SEQ ID NO: 174788 - DNA, 25 bp, Mus musculus
agcctctggattttgggatgggaaa

SEQ ID NO: 174789 - DNA, 25 bp, Mus musculus
agcctctggcacaatgaacaacgca

SEQ ID NO: 174790 - DNA, 25 bp, Mus musculus
agcctctggcactatgaacaacgca

SEQ ID NO: 174791 - DNA, 25 bp, Mus musculus
agcctctggcttctaacatttttat

SEQ ID NO: 174792 - DNA, 25 bp, Mus musculus
agcctctggcttctatccaggtatt

SEQ ID NO: 174793 - DNA, 25 bp, Mus musculus
agcctctggcttgtaacatttttat

SEQ ID NO: 174794 - DNA, 25 bp, Mus musculus
agcctctggcttgtatccaggtatt

SEQ ID NO: 174795 - DNA, 25 bp, Mus musculus
agcctctgggctctgaccacagata

SEQ ID NO: 174796 - DNA, 25 bp, Mus musculus
agcctctgggctgtgaccacagata

SEQ ID NO: 174797 - DNA, 25 bp, Mus musculus
agcctctgtatgagatgtttctcct

SEQ ID NO: 174798 - DNA, 25 bp, Mus musculus
agcctctgtatgtgatgtttctcct

SEQ ID NO: 174799 - DNA, 25 bp, Mus musculus
agcctctgtcagataagattcaaca

SEQ ID NO: 174800 - DNA, 25 bp, Mus musculus
agcctctgtcagttaagattcaaca

SEQ ID NO: 174801 - DNA, 25 bp, Mus musculus
agcctctgtcctaagctagcacagg

SEQ ID NO: 174802 - DNA, 25 bp, Mus musculus
agcctctgtccttagctagcacagg

SEQ ID NO: 174803 - DNA, 25 bp, Mus musculus
agcctctgtgctcgaaggcagcaga

SEQ ID NO: 174804 - DNA, 25 bp, Mus musculus
agcctctgtgctggaaggcagcaga

SEQ ID NO: 174805 - DNA, 25 bp, Mus musculus
agcctctgtgtgagcgtaataaaag

SEQ ID NO: 174806 - DNA, 25 bp, Mus musculus
agcctctgtgtgtgcgtaataaaag

SEQ ID NO: 174807 - DNA, 25 bp, Mus musculus
agcctctgttgcaggatatcaccta

SEQ ID NO: 174808 - DNA, 25 bp, Mus musculus
agcctctgttgctggatatcaccta

SEQ ID NO: 174809 - DNA, 25 bp, Mus musculus
agcctctgtttcaacctgggactca

SEQ ID NO: 174810 - DNA, 25 bp, Mus musculus
agcctctgtttctacctgggactca

SEQ ID NO: 174811 - DNA, 25 bp, Mus musculus
agcctcttaataaatctagccttgg

SEQ ID NO: 174812 - DNA, 25 bp, Mus musculus
agcctcttaatatatctagccttgg

SEQ ID NO: 174813 - DNA, 25 bp, Mus musculus
agcctcttagacaaaactggccttg

SEQ ID NO: 174814 - DNA, 25 bp, Mus musculus
agcctcttagactaaactggccttg

SEQ ID NO: 174815 - DNA, 25 bp, Mus musculus
agcctcttagcccttcttcaaaaat

SEQ ID NO: 174816 - DNA, 25 bp, Mus musculus
agcctcttagccgttcttcaaaaat

SEQ ID NO: 174817 - DNA, 25 bp, Mus musculus
agcctcttcaacagggagttcaacc

SEQ ID NO: 174818 - DNA, 25 bp, Mus musculus
agcctcttcaactgggagttcaacc

SEQ ID NO: 174819 - DNA, 25 bp, Mus musculus
agcctcttcacaccagagtccaaat

SEQ ID NO: 174820 - DNA, 25 bp, Mus musculus
agcctcttcacagcagagtccaaat

SEQ ID NO: 174821 - DNA, 25 bp, Mus musculus
agcctcttccgtctgcaggagcagt

SEQ ID NO: 174822 - DNA, 25 bp, Mus musculus
agcctcttccgtgtgcaggagcagt

SEQ ID NO: 174823 - DNA, 25 bp, Mus musculus
agcctcttcctcaataaacactgac

SEQ ID NO: 174824 - DNA, 25 bp, Mus musculus
agcctcttcctctataaacactgac

SEQ ID NO: 174825 - DNA, 25 bp, Mus musculus
agcctcttcgaaaagttgcccttag

SEQ ID NO: 174826 - DNA, 25 bp, Mus musculus
agcctcttcgaatagttgcccttag

SEQ ID NO: 174827 - DNA, 25 bp, Mus musculus
agcctcttctatagtattcttccta

SEQ ID NO: 174828 - DNA, 25 bp, Mus musculus
agcctcttctattgtattcttccta

SEQ ID NO: 174829 - DNA, 25 bp, Mus musculus
agcctcttctcacacttaggcacag

SEQ ID NO: 174830 - DNA, 25 bp, Mus musculus
agcctcttctcagacttaggcacag

SEQ ID NO: 174831 - DNA, 25 bp, Mus musculus
agcctcttctctactaagaactaca

SEQ ID NO: 174832 - DNA, 25 bp, Mus musculus
agcctcttctcttctaagaactaca

SEQ ID NO: 174833 - DNA, 25 bp, Mus musculus
agcctcttgaggatgcagttgaaaa

SEQ ID NO: 174834 - DNA, 25 bp, Mus musculus
agcctcttgaggttgcagttgaaaa

SEQ ID NO: 174835 - DNA, 25 bp, Mus musculus
agcctcttgccacctaaattgagct

SEQ ID NO: 174836 - DNA, 25 bp, Mus musculus
agcctcttgccagctaaattgagct

SEQ ID NO: 174837 - DNA, 25 bp, Mus musculus
agcctcttgctcaaaacacttgtgc

SEQ ID NO: 174838 - DNA, 25 bp, Mus musculus
agcctcttgctctaaacacttgtgc

SEQ ID NO: 174839 - DNA, 25 bp, Mus musculus
agcctcttggagactctgaactatt

SEQ ID NO: 174840 - DNA, 25 bp, Mus musculus
agcctcttggagtctctgaactatt

SEQ ID NO: 174841 - DNA, 25 bp, Mus musculus
agcctcttgggaccttttcaattag

SEQ ID NO: 174842 - DNA, 25 bp, Mus musculus
agcctcttgggagcttttcaattag

SEQ ID NO: 174843 - DNA, 25 bp, Mus musculus
agcctcttgggcattcttaagtcca

SEQ ID NO: 174844 - DNA, 25 bp, Mus musculus
agcctcttgggctttcttaagtcca

SEQ ID NO: 174845 - DNA, 25 bp, Mus musculus
agcctcttgtccaagcaggcatatt

SEQ ID NO: 174846 - DNA, 25 bp, Mus musculus
agcctcttgtccatgtagatgcatc

SEQ ID NO: 174847 - DNA, 25 bp, Mus musculus
agcctcttgtcctagcaggcatatt

SEQ ID NO: 174848 - DNA, 25 bp, Mus musculus
agcctcttgtccttgtagatgcatc

SEQ ID NO: 174849 - DNA, 25 bp, Mus musculus
agcctcttgtctagaacgtgtcagg

SEQ ID NO: 174850 - DNA, 25 bp, Mus musculus
agcctcttgtcttgaacgtgtcagg

SEQ ID NO: 174851 - DNA, 25 bp, Mus musculus
agcctcttgtggaaagcgcccagct

SEQ ID NO: 174852 - DNA, 25 bp, Mus musculus
agcctcttgtggagagaatagccct

SEQ ID NO: 174853 - DNA, 25 bp, Mus musculus
agcctcttgtggtaagcgcccagct

SEQ ID NO: 174854 - DNA, 25 bp, Mus musculus
agcctcttgtggtgagaatagccct

SEQ ID NO: 174855 - DNA, 25 bp, Mus musculus
agcctcttgttgctcctaattaggg

SEQ ID NO: 174856 - DNA, 25 bp, Mus musculus
agcctcttgttggtcctaattaggg

SEQ ID NO: 174857 - DNA, 25 bp, Mus musculus
agcctctttagtactgggattttag

SEQ ID NO: 174858 - DNA, 25 bp, Mus musculus
agcctctttagttctgggattttag

SEQ ID NO: 174859 - DNA, 25 bp, Mus musculus
agcctctttatcattgcaactctag

SEQ ID NO: 174860 - DNA, 25 bp, Mus musculus
agcctctttatctttgcaactctag

SEQ ID NO: 174861 - DNA, 25 bp, Mus musculus
agcctctttcaccagtagtttagcg

SEQ ID NO: 174862 - DNA, 25 bp, Mus musculus
agcctctttcacgagtagtttagcg

SEQ ID NO: 174863 - DNA, 25 bp, Mus musculus
agcctctttcctaggacgcatgtta

SEQ ID NO: 174864 - DNA, 25 bp, Mus musculus
agcctctttccttggacgcatgtta

SEQ ID NO: 174865 - DNA, 25 bp, Mus musculus
agcctctttgctaaattgtgtatcc

SEQ ID NO: 174866 - DNA, 25 bp, Mus musculus
agcctctttgcttaattgtgtatcc

SEQ ID NO: 174867 - DNA, 25 bp, Mus musculus
agcctctttggcatgtaggagttcc

SEQ ID NO: 174868 - DNA, 25 bp, Mus musculus
agcctctttggccacctctggttag

SEQ ID NO: 174869 - DNA, 25 bp, Mus musculus
agcctctttggcgacctctggttag

SEQ ID NO: 174870 - DNA, 25 bp, Mus musculus
agcctctttggcttgtaggagttcc

SEQ ID NO: 174871 - DNA, 25 bp, Mus musculus
agcctctttgtacccacttggaata

SEQ ID NO: 174872 - DNA, 25 bp, Mus musculus
agcctctttgtagccacttggaata

SEQ ID NO: 174873 - DNA, 25 bp, Mus musculus
agcctgaaaagcatcgaggagggca

SEQ ID NO: 174874 - DNA, 25 bp, Mus musculus
agcctgaaaagcttcgaggagggca

SEQ ID NO: 174875 - DNA, 25 bp, Mus musculus
agcctgaaatggctcttcagtagta

SEQ ID NO: 174876 - DNA, 25 bp, Mus musculus
agcctgaaatgggtcttcagtagta

SEQ ID NO: 174877 - DNA, 25 bp, Mus musculus
agcctgaaattaagctccagaagaa

SEQ ID NO: 174878 - DNA, 25 bp, Mus musculus
agcctgaaattatgctccagaagaa

SEQ ID NO: 174879 - DNA, 25 bp, Mus musculus
agcctgaacctgaagcccttagagg

SEQ ID NO: 174880 - DNA, 25 bp, Mus musculus
agcctgaacctgtagcccttagagg

SEQ ID NO: 174881 - DNA, 25 bp, Mus musculus
agcctgaacggaatggagttgctcc

SEQ ID NO: 174882 - DNA, 25 bp, Mus musculus
agcctgaacggattggagttgctcc

SEQ ID NO: 174883 - DNA, 25 bp, Mus musculus
agcctgaactggaatggctcctcca

SEQ ID NO: 174884 - DNA, 25 bp, Mus musculus
agcctgaactggtatggctcctcca

SEQ ID NO: 174885 - DNA, 25 bp, Mus musculus
agcctgaacttacccctgatgctgg

SEQ ID NO: 174886 - DNA, 25 bp, Mus musculus
agcctgaacttagccctgatgctgg

SEQ ID NO: 174887 - DNA, 25 bp, Mus musculus
agcctgaagaagcaagctgcgagaa

SEQ ID NO: 174888 - DNA, 25 bp, Mus musculus
agcctgaagaaggaagctgcgagaa

SEQ ID NO: 174889 - DNA, 25 bp, Mus musculus
agcctgaagattcccactgagaaaa

SEQ ID NO: 174890 - DNA, 25 bp, Mus musculus
agcctgaagattgccactgagaaaa

SEQ ID NO: 174891 - DNA, 25 bp, Mus musculus
agcctgaaggatctgtacttttatc

SEQ ID NO: 174892 - DNA, 25 bp, Mus musculus
agcctgaaggatgtgtacttttatc

SEQ ID NO: 174893 - DNA, 25 bp, Mus musculus
agcctgaagttcactgagaagccca

SEQ ID NO: 174894 - DNA, 25 bp, Mus musculus
agcctgaagttctctgagaagccca

SEQ ID NO: 174895 - DNA, 25 bp, Mus musculus
agcctgaatggcaatctcctggtac

SEQ ID NO: 174896 - DNA, 25 bp, Mus musculus
agcctgaatggctatctcctggtac

SEQ ID NO: 174897 - DNA, 25 bp, Mus musculus
agcctgacaacaatgctcacatgaa

SEQ ID NO: 174898 - DNA, 25 bp, Mus musculus
agcctgacaacattgctcacatgaa

SEQ ID NO: 174899 - DNA, 25 bp, Mus musculus
agcctgacaaccaggagtgacatgg

SEQ ID NO: 174900 - DNA, 25 bp, Mus musculus
agcctgacaacctggagtgacatgg

SEQ ID NO: 174901 - DNA, 25 bp, Mus musculus
agcctgacagagatccgtcttcatg

SEQ ID NO: 174902 - DNA, 25 bp, Mus musculus
agcctgacagagttccgtcttcatg

SEQ ID NO: 174903 - DNA, 25 bp, Mus musculus
agcctgacatgcctgagatgccaag

SEQ ID NO: 174904 - DNA, 25 bp, Mus musculus
agcctgacatgcgtgagatgccaag

SEQ ID NO: 174905 - DNA, 25 bp, Mus musculus
agcctgacatttatctgtatgggat

SEQ ID NO: 174906 - DNA, 25 bp, Mus musculus
agcctgacatttttctgtatgggat

SEQ ID NO: 174907 - DNA, 25 bp, Mus musculus
agcctgaccaaacgacaccacttgg

SEQ ID NO: 174908 - DNA, 25 bp, Mus musculus
agcctgaccaaaggacaccacttgg

SEQ ID NO: 174909 - DNA, 25 bp, Mus musculus
agcctgacctcaccatgattgtggt

SEQ ID NO: 174910 - DNA, 25 bp, Mus musculus
agcctgacctcagcatgattgtggt

SEQ ID NO: 174911 - DNA, 25 bp, Mus musculus
agcctgacctgtatacgtggtactg

SEQ ID NO: 174912 - DNA, 25 bp, Mus musculus
agcctgacctgtttacgtggtactg

SEQ ID NO: 174913 - DNA, 25 bp, Mus musculus
agcctgacgaagacttgttccccac

SEQ ID NO: 174914 - DNA, 25 bp, Mus musculus
agcctgacgaagtcttgttccccac

SEQ ID NO: 174915 - DNA, 25 bp, Mus musculus
agcctgactatgaggccactagtcg

SEQ ID NO: 174916 - DNA, 25 bp, Mus musculus
agcctgactatgtggccactagtcg

SEQ ID NO: 174917 - DNA, 25 bp, Mus musculus
agcctgactcttagaacctgggtat

SEQ ID NO: 174918 - DNA, 25 bp, Mus musculus
agcctgactctttgaacctgggtat

SEQ ID NO: 174919 - DNA, 25 bp, Mus musculus
agcctgactgacatagcaagtttca

SEQ ID NO: 174920 - DNA, 25 bp, Mus musculus
agcctgactgacttagcaagtttca

SEQ ID NO: 174921 - DNA, 25 bp, Mus musculus
agcctgactggaacgctatctgcta

SEQ ID NO: 174922 - DNA, 25 bp, Mus musculus
agcctgactggatcgctatctgcta

SEQ ID NO: 174923 - DNA, 25 bp, Mus musculus
agcctgactggcctgacgtggactt

SEQ ID NO: 174924 - DNA, 25 bp, Mus musculus
agcctgactggcgtgacgtggactt

SEQ ID NO: 174925 - DNA, 25 bp, Mus musculus
agcctgactgtcactttgaagcttt

SEQ ID NO: 174926 - DNA, 25 bp, Mus musculus
agcctgactgtctctttgaagcttt

SEQ ID NO: 174927 - DNA, 25 bp, Mus musculus
agcctgacttgcattgtcctcagaa

SEQ ID NO: 174928 - DNA, 25 bp, Mus musculus
agcctgacttgctttgtcctcagaa

SEQ ID NO: 174929 - DNA, 25 bp, Mus musculus
agcctgacttttccacctttgaaat

SEQ ID NO: 174930 - DNA, 25 bp, Mus musculus
agcctgacttttgcacctttgaaat

SEQ ID NO: 174931 - DNA, 25 bp, Mus musculus
agcctgagacacatgagacttcatt

SEQ ID NO: 174932 - DNA, 25 bp, Mus musculus
agcctgagacacttgagacttcatt

SEQ ID NO: 174933 - DNA, 25 bp, Mus musculus
agcctgagaccaagggcagcagctc

SEQ ID NO: 174934 - DNA, 25 bp, Mus musculus
agcctgagaccatgggcagcagctc

SEQ ID NO: 174935 - DNA, 25 bp, Mus musculus
agcctgagaccgaaattgattcttt

SEQ ID NO: 174936 - DNA, 25 bp, Mus musculus
agcctgagaccgtaattgattcttt

SEQ ID NO: 174937 - DNA, 25 bp, Mus musculus
agcctgagactacctggatgccacc

SEQ ID NO: 174938 - DNA, 25 bp, Mus musculus
agcctgagactagctggatgccacc

SEQ ID NO: 174939 - DNA, 25 bp, Mus musculus
agcctgagactcacaactgttagcc

SEQ ID NO: 174940 - DNA, 25 bp, Mus musculus
agcctgagactctcaactgttagcc

SEQ ID NO: 174941 - DNA, 25 bp, Mus musculus
agcctgagactgcttactctatcac

SEQ ID NO: 174942 - DNA, 25 bp, Mus musculus
agcctgagactggttactctatcac

SEQ ID NO: 174943 - DNA, 25 bp, Mus musculus
agcctgagaggccagtatctaaatg

SEQ ID NO: 174944 - DNA, 25 bp, Mus musculus
agcctgagaggcgagtatctaaatg

SEQ ID NO: 174945 - DNA, 25 bp, Mus musculus
agcctgagatgtagactgacttatg

SEQ ID NO: 174946 - DNA, 25 bp, Mus musculus
agcctgagatgttgactgacttatg

SEQ ID NO: 174947 - DNA, 25 bp, Mus musculus
agcctgagcagtatgcagttccgtt

SEQ ID NO: 174948 - DNA, 25 bp, Mus musculus
agcctgagcagtttgcagttccgtt

SEQ ID NO: 174949 - DNA, 25 bp, Mus musculus
agcctgagcatcaccacagaagcct

SEQ ID NO: 174950 - DNA, 25 bp, Mus musculus
agcctgagcatctccacagaagcct

SEQ ID NO: 174951 - DNA, 25 bp, Mus musculus
agcctgagccccatattgagactta

SEQ ID NO: 174952 - DNA, 25 bp, Mus musculus
agcctgagccccttattgagactta

SEQ ID NO: 174953 - DNA, 25 bp, Mus musculus
agcctgagctagataagaccacgaa

SEQ ID NO: 174954 - DNA, 25 bp, Mus musculus
agcctgagctagctacccaagtggg

SEQ ID NO: 174955 - DNA, 25 bp, Mus musculus
agcctgagctaggtacccaagtggg

SEQ ID NO: 174956 - DNA, 25 bp, Mus musculus
agcctgagctagttaagaccacgaa

SEQ ID NO: 174957 - DNA, 25 bp, Mus musculus
agcctgaggccgcaggatgacaaat

SEQ ID NO: 174958 - DNA, 25 bp, Mus musculus
agcctgaggccggaggatgacaaat

SEQ ID NO: 174959 - DNA, 25 bp, Mus musculus
agcctgagggttactgctcctacat

SEQ ID NO: 174960 - DNA, 25 bp, Mus musculus
agcctgagggtttctgctcctacat

SEQ ID NO: 174961 - DNA, 25 bp, Mus musculus
agcctgaggtaaacgggcgctggcc

SEQ ID NO: 174962 - DNA, 25 bp, Mus musculus
agcctgaggtaatcgggcgctggcc

SEQ ID NO: 174963 - DNA, 25 bp, Mus musculus
agcctgagttatctttaaagaccca

SEQ ID NO: 174964 - DNA, 25 bp, Mus musculus
agcctgagttatgtttaaagaccca

SEQ ID NO: 174965 - DNA, 25 bp, Mus musculus
agcctgatacaccagtgctctggga

SEQ ID NO: 174966 - DNA, 25 bp, Mus musculus
agcctgatacacgagtgctctggga

SEQ ID NO: 174967 - DNA, 25 bp, Mus musculus
agcctgatatgtaaatttctccaaa

SEQ ID NO: 174968 - DNA, 25 bp, Mus musculus
agcctgatatgttaatttctccaaa

SEQ ID NO: 174969 - DNA, 25 bp, Mus musculus
agcctgatcccaatcgtgtacagat

SEQ ID NO: 174970 - DNA, 25 bp, Mus musculus
agcctgatcccattcgtgtacagat

SEQ ID NO: 174971 - DNA, 25 bp, Mus musculus
agcctgatccgcatctggaaacagt

SEQ ID NO: 174972 - DNA, 25 bp, Mus musculus
agcctgatccgcttctggaaacagt

SEQ ID NO: 174973 - DNA, 25 bp, Mus musculus
agcctgatcctactggtgtacatgc

SEQ ID NO: 174974 - DNA, 25 bp, Mus musculus
agcctgatcctagtggtgtacatgc

SEQ ID NO: 174975 - DNA, 25 bp, Mus musculus
agcctgatcctgagctagagcttgt

SEQ ID NO: 174976 - DNA, 25 bp, Mus musculus
agcctgatcctgtgctagagcttgt

SEQ ID NO: 174977 - DNA, 25 bp, Mus musculus
agcctgatctatcccatctagtggt

SEQ ID NO: 174978 - DNA, 25 bp, Mus musculus
agcctgatctatgccatctagtggt

SEQ ID NO: 174979 - DNA, 25 bp, Mus musculus
agcctgatctccatagcaaattcca

SEQ ID NO: 174980 - DNA, 25 bp, Mus musculus
agcctgatctccttagcaaattcca

SEQ ID NO: 174981 - DNA, 25 bp, Mus musculus
agcctgatgctgctagctttgctgc

SEQ ID NO: 174982 - DNA, 25 bp, Mus musculus
agcctgatgctggtagctttgctgc

SEQ ID NO: 174983 - DNA, 25 bp, Mus musculus
agcctgatgggactctgcctggtaa

SEQ ID NO: 174984 - DNA, 25 bp, Mus musculus
agcctgatgggagtctgcctggtaa

SEQ ID NO: 174985 - DNA, 25 bp, Mus musculus
agcctgatggttattctccgttctc

SEQ ID NO: 174986 - DNA, 25 bp, Mus musculus
agcctgatggtttttctccgttctc

SEQ ID NO: 174987 - DNA, 25 bp, Mus musculus
agcctgattgtgagttgcgccttct

SEQ ID NO: 174988 - DNA, 25 bp, Mus musculus
agcctgattgtgtgttgcgccttct

SEQ ID NO: 174989 - DNA, 25 bp, Mus musculus
agcctgatttccaagaacttctgcg

SEQ ID NO: 174990 - DNA, 25 bp, Mus musculus
agcctgatttcctagaacttctgcg

SEQ ID NO: 174991 - DNA, 25 bp, Mus musculus
agcctgcaaacacttcaccagtttt

SEQ ID NO: 174992 - DNA, 25 bp, Mus musculus
agcctgcaaacagttcaccagtttt

SEQ ID NO: 174993 - DNA, 25 bp, Mus musculus
agcctgcaaagactgtgtaccatgg

SEQ ID NO: 174994 - DNA, 25 bp, Mus musculus
agcctgcaaagagtgtgtaccatgg

SEQ ID NO: 174995 - DNA, 25 bp, Mus musculus
agcctgcaaagcagaggtcacgcct

SEQ ID NO: 174996 - DNA, 25 bp, Mus musculus
agcctgcaaagctgaggtcacgcct

SEQ ID NO: 174997 - DNA, 25 bp, Mus musculus
agcctgcaacagcatggccattctg

SEQ ID NO: 174998 - DNA, 25 bp, Mus musculus
agcctgcaacaggatggccattctg

SEQ ID NO: 174999 - DNA, 25 bp, Mus musculus
agcctgcaagcgctgcctacgggat

SEQ ID NO: 175000 - DNA, 25 bp, Mus musculus
agcctgcaagcggtgcctacgggat

SEQ ID NO: 175001 - DNA, 25 bp, Mus musculus
agcctgcaaggcagtttgtggaaga

SEQ ID NO: 175002 - DNA, 25 bp, Mus musculus
agcctgcaaggctgtttgtggaaga

SEQ ID NO: 175003 - DNA, 25 bp, Mus musculus
agcctgcactgaaaaccgtttgtct

SEQ ID NO: 175004 - DNA, 25 bp, Mus musculus
agcctgcactgataaccgtttgtct

SEQ ID NO: 175005 - DNA, 25 bp, Mus musculus
agcctgcactggctgatggagctat

SEQ ID NO: 175006 - DNA, 25 bp, Mus musculus
agcctgcactgggtgatggagctat

SEQ ID NO: 175007 - DNA, 25 bp, Mus musculus
agcctgcagcagctccagttgacag

SEQ ID NO: 175008 - DNA, 25 bp, Mus musculus
agcctgcagcaggtccagttgacag

SEQ ID NO: 175009 - DNA, 25 bp, Mus musculus
agcctgcagcccaagttcaataaac

SEQ ID NO: 175010 - DNA, 25 bp, Mus musculus
agcctgcagccctagttcaataaac

SEQ ID NO: 175011 - DNA, 25 bp, Mus musculus
agcctgcagctaccaaaataatatt

SEQ ID NO: 175012 - DNA, 25 bp, Mus musculus
agcctgcagctagcaaaataatatt

SEQ ID NO: 175013 - DNA, 25 bp, Mus musculus
agcctgcagctgcattacgcaacag

SEQ ID NO: 175014 - DNA, 25 bp, Mus musculus
agcctgcagctggattacgcaacag

SEQ ID NO: 175015 - DNA, 25 bp, Mus musculus
agcctgcagcttaactttttcgaag

SEQ ID NO: 175016 - DNA, 25 bp, Mus musculus
agcctgcagctttactttttcgaag

SEQ ID NO: 175017 - DNA, 25 bp, Mus musculus
agcctgcagtacaccatggtcatgg

SEQ ID NO: 175018 - DNA, 25 bp, Mus musculus
agcctgcagtactccatggtcatgg

SEQ ID NO: 175019 - DNA, 25 bp, Mus musculus
agcctgcagtgcactttgaccccag

SEQ ID NO: 175020 - DNA, 25 bp, Mus musculus
agcctgcagtgctctttgaccccag

SEQ ID NO: 175021 - DNA, 25 bp, Mus musculus
agcctgcagttgattgcttctgaga

SEQ ID NO: 175022 - DNA, 25 bp, Mus musculus
agcctgcagttgtttgcttctgaga

SEQ ID NO: 175023 - DNA, 25 bp, Mus musculus
agcctgcatagtctgctgtttcgaa

SEQ ID NO: 175024 - DNA, 25 bp, Mus musculus
agcctgcatagtgtgctgtttcgaa

SEQ ID NO: 175025 - DNA, 25 bp, Mus musculus
agcctgcatgatccctctgtattaa

SEQ ID NO: 175026 - DNA, 25 bp, Mus musculus
agcctgcatgatgcctctgtattaa

SEQ ID NO: 175027 - DNA, 25 bp, Mus musculus
agcctgcatgtgatgagagagactt

SEQ ID NO: 175028 - DNA, 25 bp, Mus musculus
agcctgcatgtgttgagagagactt

SEQ ID NO: 175029 - DNA, 25 bp, Mus musculus
agcctgcattctatagtgcttctag

SEQ ID NO: 175030 - DNA, 25 bp, Mus musculus
agcctgcattctttagtgcttctag

SEQ ID NO: 175031 - DNA, 25 bp, Mus musculus
agcctgcatttaaagatacctacaa

SEQ ID NO: 175032 - DNA, 25 bp, Mus musculus
agcctgcatttatagatacctacaa

SEQ ID NO: 175033 - DNA, 25 bp, Mus musculus
agcctgccaccactagcttttagca

SEQ ID NO: 175034 - DNA, 25 bp, Mus musculus
agcctgccaccagtagcttttagca

SEQ ID NO: 175035 - DNA, 25 bp, Mus musculus
agcctgccacggaggtactgtctga

SEQ ID NO: 175036 - DNA, 25 bp, Mus musculus
agcctgccacggtggtactgtctga

SEQ ID NO: 175037 - DNA, 25 bp, Mus musculus
agcctgccagcaatttctcaaacga

SEQ ID NO: 175038 - DNA, 25 bp, Mus musculus
agcctgccagcacatgttcctcaga

SEQ ID NO: 175039 - DNA, 25 bp, Mus musculus
agcctgccagcagatgttcctcaga

SEQ ID NO: 175040 - DNA, 25 bp, Mus musculus
agcctgccagcattttctcaaacga

SEQ ID NO: 175041 - DNA, 25 bp, Mus musculus
agcctgccatcccatttggatgtat

SEQ ID NO: 175042 - DNA, 25 bp, Mus musculus
agcctgccatccgatttggatgtat

SEQ ID NO: 175043 - DNA, 25 bp, Mus musculus
agcctgccatctcttattcctcagt

SEQ ID NO: 175044 - DNA, 25 bp, Mus musculus
agcctgccatctgttattcctcagt

SEQ ID NO: 175045 - DNA, 25 bp, Mus musculus
agcctgccatggctgctgccagctg

SEQ ID NO: 175046 - DNA, 25 bp, Mus musculus
agcctgccatgggtgctgccagctg

SEQ ID NO: 175047 - DNA, 25 bp, Mus musculus
agcctgcccaaaccacttgtttatg

SEQ ID NO: 175048 - DNA, 25 bp, Mus musculus
agcctgcccaaagcacttgtttatg

SEQ ID NO: 175049 - DNA, 25 bp, Mus musculus
agcctgcccacgcagcagtttgagg

SEQ ID NO: 175050 - DNA, 25 bp, Mus musculus
agcctgcccacggagcagtttgagg

SEQ ID NO: 175051 - DNA, 25 bp, Mus musculus
agcctgcccatgagctttggcaaag

SEQ ID NO: 175052 - DNA, 25 bp, Mus musculus
agcctgcccatgtgctttggcaaag

SEQ ID NO: 175053 - DNA, 25 bp, Mus musculus
agcctgcccgggaggaaggtcgaat

SEQ ID NO: 175054 - DNA, 25 bp, Mus musculus
agcctgcccgggtggaaggtcgaat

SEQ ID NO: 175055 - DNA, 25 bp, Mus musculus
agcctgccgggactgaagaaatctt

SEQ ID NO: 175056 - DNA, 25 bp, Mus musculus
agcctgccgggagtgaagaaatctt

SEQ ID NO: 175057 - DNA, 25 bp, Mus musculus
agcctgcctagaagcccatttatgt

SEQ ID NO: 175058 - DNA, 25 bp, Mus musculus
agcctgcctagatgcccatttatgt

SEQ ID NO: 175059 - DNA, 25 bp, Mus musculus
agcctgcctagtactttttgctcat

SEQ ID NO: 175060 - DNA, 25 bp, Mus musculus
agcctgcctagttctttttgctcat

SEQ ID NO: 175061 - DNA, 25 bp, Mus musculus
agcctgcctcatcagcttgggttat

SEQ ID NO: 175062 - DNA, 25 bp, Mus musculus
agcctgcctcatgagcttgggttat

SEQ ID NO: 175063 - DNA, 25 bp, Mus musculus
agcctgcctcctctaagggacaaga

SEQ ID NO: 175064 - DNA, 25 bp, Mus musculus
agcctgcctcctgtaagggacaaga

SEQ ID NO: 175065 - DNA, 25 bp, Mus musculus
agcctgcctggacaagcctaggttt

SEQ ID NO: 175066 - DNA, 25 bp, Mus musculus
agcctgcctggagaagcctaggttt

SEQ ID NO: 175067 - DNA, 25 bp, Mus musculus
agcctgcctgtgacatggtcctgga

SEQ ID NO: 175068 - DNA, 25 bp, Mus musculus
agcctgcctgtgctggtgtctacaa

SEQ ID NO: 175069 - DNA, 25 bp, Mus musculus
agcctgcctgtggtggtgtctacaa

SEQ ID NO: 175070 - DNA, 25 bp, Mus musculus
agcctgcctgtgtcatggtcctgga

SEQ ID NO: 175071 - DNA, 25 bp, Mus musculus
agcctgcctttgaggagatctgtga

SEQ ID NO: 175072 - DNA, 25 bp, Mus musculus
agcctgcctttgtggagatctgtga

SEQ ID NO: 175073 - DNA, 25 bp, Mus musculus
agcctgccttttactgatcattgag

SEQ ID NO: 175074 - DNA, 25 bp, Mus musculus
agcctgccttttctcacatagtctt

SEQ ID NO: 175075 - DNA, 25 bp, Mus musculus
agcctgccttttgtcacatagtctt

SEQ ID NO: 175076 - DNA, 25 bp, Mus musculus
agcctgcctttttctgatcattgag

SEQ ID NO: 175077 - DNA, 25 bp, Mus musculus
agcctgcgaccgctggagttcaaga

SEQ ID NO: 175078 - DNA, 25 bp, Mus musculus
agcctgcgaccggtggagttcaaga

SEQ ID NO: 175079 - DNA, 25 bp, Mus musculus
agcctgcgctctcgaagctggaacc

SEQ ID NO: 175080 - DNA, 25 bp, Mus musculus
agcctgcgctctggaagctggaacc

SEQ ID NO: 175081 - DNA, 25 bp, Mus musculus
agcctgcggccacctggaacacaga

SEQ ID NO: 175082 - DNA, 25 bp, Mus musculus
agcctgcggccagctggaacacaga

SEQ ID NO: 175083 - DNA, 25 bp, Mus musculus
agcctgcgtcatcatggtgtacaaa

SEQ ID NO: 175084 - DNA, 25 bp, Mus musculus
agcctgcgtcatgatggtgtacaaa

SEQ ID NO: 175085 - DNA, 25 bp, Mus musculus
agcctgcgtcctaaagtttgcttta

SEQ ID NO: 175086 - DNA, 25 bp, Mus musculus
agcctgcgtccttaagtttgcttta

SEQ ID NO: 175087 - DNA, 25 bp, Mus musculus
agcctgcgtcttcatggtgtacctt

SEQ ID NO: 175088 - DNA, 25 bp, Mus musculus
agcctgcgtcttgatggtgtacctt

SEQ ID NO: 175089 - DNA, 25 bp, Mus musculus
agcctgcgtgtgacagcgtgtgaca

SEQ ID NO: 175090 - DNA, 25 bp, Mus musculus
agcctgcgtgtgtcagcgtgtgaca

SEQ ID NO: 175091 - DNA, 25 bp, Mus musculus
agcctgctaaacagtgaactgacct

SEQ ID NO: 175092 - DNA, 25 bp, Mus musculus
agcctgctaaactgtgaactgacct

SEQ ID NO: 175093 - DNA, 25 bp, Mus musculus
agcctgctaagcactgggtagttgt

SEQ ID NO: 175094 - DNA, 25 bp, Mus musculus
agcctgctaagctctgggtagttgt

SEQ ID NO: 175095 - DNA, 25 bp, Mus musculus
agcctgctaaggaacaatgccacct

SEQ ID NO: 175096 - DNA, 25 bp, Mus musculus
agcctgctaaggtacaatgccacct

SEQ ID NO: 175097 - DNA, 25 bp, Mus musculus
agcctgctagctagctcaactattg

SEQ ID NO: 175098 - DNA, 25 bp, Mus musculus
agcctgctagcttgctcaactattg

SEQ ID NO: 175099 - DNA, 25 bp, Mus musculus
agcctgctaggcagtgacggaacag

SEQ ID NO: 175100 - DNA, 25 bp, Mus musculus
agcctgctaggctgtgacggaacag

SEQ ID NO: 175101 - DNA, 25 bp, Mus musculus
agcctgctagtgctagtgtcctggc

SEQ ID NO: 175102 - DNA, 25 bp, Mus musculus
agcctgctagtggtagtgtcctggc

SEQ ID NO: 175103 - DNA, 25 bp, Mus musculus
agcctgctatttactacacatttcc

SEQ ID NO: 175104 - DNA, 25 bp, Mus musculus
agcctgctattttctacacatttcc

SEQ ID NO: 175105 - DNA, 25 bp, Mus musculus
agcctgctcagtagctctggagtag

SEQ ID NO: 175106 - DNA, 25 bp, Mus musculus
agcctgctcagtagtgaattcatca

SEQ ID NO: 175107 - DNA, 25 bp, Mus musculus
agcctgctcagttgctctggagtag

SEQ ID NO: 175108 - DNA, 25 bp, Mus musculus
agcctgctcagttgtgaattcatca

SEQ ID NO: 175109 - DNA, 25 bp, Mus musculus
agcctgctccagctttgagatagcg

SEQ ID NO: 175110 - DNA, 25 bp, Mus musculus
agcctgctccaggtttgagatagcg

SEQ ID NO: 175111 - DNA, 25 bp, Mus musculus
agcctgctctaactgagaggtttct

SEQ ID NO: 175112 - DNA, 25 bp, Mus musculus
agcctgctctaagtgagaggtttct

SEQ ID NO: 175113 - DNA, 25 bp, Mus musculus
agcctgctgagacaatgcatctgca

SEQ ID NO: 175114 - DNA, 25 bp, Mus musculus
agcctgctgagagaatgcatctgca

SEQ ID NO: 175115 - DNA, 25 bp, Mus musculus
agcctgctgcatatgtcatacatgt

SEQ ID NO: 175116 - DNA, 25 bp, Mus musculus
agcctgctgcatttgtcatacatgt

SEQ ID NO: 175117 - DNA, 25 bp, Mus musculus
agcctgctgcgtatgtctgataact

SEQ ID NO: 175118 - DNA, 25 bp, Mus musculus
agcctgctgcgtttgtctgataact

SEQ ID NO: 175119 - DNA, 25 bp, Mus musculus
agcctgctgcttagctgagttacca

SEQ ID NO: 175120 - DNA, 25 bp, Mus musculus
agcctgctgctttgctgagttacca

SEQ ID NO: 175121 - DNA, 25 bp, Mus musculus
agcctgctgggaagcccacctgtga

SEQ ID NO: 175122 - DNA, 25 bp, Mus musculus
agcctgctgggatgcccacctgtga

SEQ ID NO: 175123 - DNA, 25 bp, Mus musculus
agcctgctgggcacctggtcggata

SEQ ID NO: 175124 - DNA, 25 bp, Mus musculus
agcctgctgggctcctggtcggata

SEQ ID NO: 175125 - DNA, 25 bp, Mus musculus
agcctgctgtggacttaacattgcc

SEQ ID NO: 175126 - DNA, 25 bp, Mus musculus
agcctgctgtggtcttaacattgcc

SEQ ID NO: 175127 - DNA, 25 bp, Mus musculus
agcctgctgtgtaggtcaatggact

SEQ ID NO: 175128 - DNA, 25 bp, Mus musculus
agcctgctgtgttggtcaatggact

SEQ ID NO: 175129 - DNA, 25 bp, Mus musculus
agcctgctgttcatgtgcaaggtca

SEQ ID NO: 175130 - DNA, 25 bp, Mus musculus
agcctgctgttcttgtgcaaggtca

SEQ ID NO: 175131 - DNA, 25 bp, Mus musculus
agcctgcttcaacggcggcgctagc

SEQ ID NO: 175132 - DNA, 25 bp, Mus musculus
agcctgcttcaagggcggcgctagc

SEQ ID NO: 175133 - DNA, 25 bp, Mus musculus
agcctgcttgctctttaaatgttag

SEQ ID NO: 175134 - DNA, 25 bp, Mus musculus
agcctgcttgctgtttaaatgttag

SEQ ID NO: 175135 - DNA, 25 bp, Mus musculus
agcctgcttggaagagtataataac

SEQ ID NO: 175136 - DNA, 25 bp, Mus musculus
agcctgcttggatgagtataataac

SEQ ID NO: 175137 - DNA, 25 bp, Mus musculus
agcctgctttgccataggccactct

SEQ ID NO: 175138 - DNA, 25 bp, Mus musculus
agcctgctttgcgataggccactct

SEQ ID NO: 175139 - DNA, 25 bp, Mus musculus
agcctggaaactcagttgatctctc

SEQ ID NO: 175140 - DNA, 25 bp, Mus musculus
agcctggaaactcgagctaagctca

SEQ ID NO: 175141 - DNA, 25 bp, Mus musculus
agcctggaaactgagttgatctctc

SEQ ID NO: 175142 - DNA, 25 bp, Mus musculus
agcctggaaactggagctaagctca

SEQ ID NO: 175143 - DNA, 25 bp, Mus musculus
agcctggaagacaggattctagctt

SEQ ID NO: 175144 - DNA, 25 bp, Mus musculus
agcctggaagactggattctagctt

SEQ ID NO: 175145 - DNA, 25 bp, Mus musculus
agcctggaagatcagattctgggac

SEQ ID NO: 175146 - DNA, 25 bp, Mus musculus
agcctggaagatgagattctgggac

SEQ ID NO: 175147 - DNA, 25 bp, Mus musculus
agcctggaagtgcattgactctaga

SEQ ID NO: 175148 - DNA, 25 bp, Mus musculus
agcctggaagtggattgactctaga

SEQ ID NO: 175149 - DNA, 25 bp, Mus musculus
agcctggaatccatggagcctgacc

SEQ ID NO: 175150 - DNA, 25 bp, Mus musculus
agcctggaatccttggagcctgacc

SEQ ID NO: 175151 - DNA, 25 bp, Mus musculus
agcctggaatctatagtctaacgaa

SEQ ID NO: 175152 - DNA, 25 bp, Mus musculus
agcctggaatctttagtctaacgaa

SEQ ID NO: 175153 - DNA, 25 bp, Mus musculus
agcctggacacaccttagcgttcta

SEQ ID NO: 175154 - DNA, 25 bp, Mus musculus
agcctggacacagcttagcgttcta

SEQ ID NO: 175155 - DNA, 25 bp, Mus musculus
agcctggacaccatggtcctgagac

SEQ ID NO: 175156 - DNA, 25 bp, Mus musculus
agcctggacaccttggtcctgagac

SEQ ID NO: 175157 - DNA, 25 bp, Mus musculus
agcctggaccacacggttagaatgc

SEQ ID NO: 175158 - DNA, 25 bp, Mus musculus
agcctggaccactcggttagaatgc

SEQ ID NO: 175159 - DNA, 25 bp, Mus musculus
agcctggacctcaggtcctccgtgt

SEQ ID NO: 175160 - DNA, 25 bp, Mus musculus
agcctggacctctggtcctccgtgt

SEQ ID NO: 175161 - DNA, 25 bp, Mus musculus
agcctggacgacagtaccgggtgat

SEQ ID NO: 175162 - DNA, 25 bp, Mus musculus
agcctggacgactgtaccgggtgat

SEQ ID NO: 175163 - DNA, 25 bp, Mus musculus
agcctggactacatggtaagatttt

SEQ ID NO: 175164 - DNA, 25 bp, Mus musculus
agcctggactacttggtaagatttt

SEQ ID NO: 175165 - DNA, 25 bp, Mus musculus
agcctggactagatagcaaccctgt

SEQ ID NO: 175166 - DNA, 25 bp, Mus musculus
agcctggactagttagcaaccctgt

SEQ ID NO: 175167 - DNA, 25 bp, Mus musculus
agcctggactccctagtgaattcca

SEQ ID NO: 175168 - DNA, 25 bp, Mus musculus
agcctggactccgtagtgaattcca

SEQ ID NO: 175169 - DNA, 25 bp, Mus musculus
agcctggactgactttgcccagctt

SEQ ID NO: 175170 - DNA, 25 bp, Mus musculus
agcctggactgagtttgcccagctt

SEQ ID NO: 175171 - DNA, 25 bp, Mus musculus
agcctggactgtaaggtgccttcaa

SEQ ID NO: 175172 - DNA, 25 bp, Mus musculus
agcctggactgtaccaccgttttct

SEQ ID NO: 175173 - DNA, 25 bp, Mus musculus
agcctggactgttaggtgccttcaa

SEQ ID NO: 175174 - DNA, 25 bp, Mus musculus
agcctggactgttccaccgttttct

SEQ ID NO: 175175 - DNA, 25 bp, Mus musculus
agcctggactttccctgttggacag

SEQ ID NO: 175176 - DNA, 25 bp, Mus musculus
agcctggactttgcctgttggacag

SEQ ID NO: 175177 - DNA, 25 bp, Mus musculus
agcctggagaatagttttcagcagt

SEQ ID NO: 175178 - DNA, 25 bp, Mus musculus
agcctggagaattgttttcagcagt

SEQ ID NO: 175179 - DNA, 25 bp, Mus musculus
agcctggagacgacgctttagctga

SEQ ID NO: 175180 - DNA, 25 bp, Mus musculus
agcctggagacgtcgctttagctga

SEQ ID NO: 175181 - DNA, 25 bp, Mus musculus
agcctggagagtaagaaggctgccc

SEQ ID NO: 175182 - DNA, 25 bp, Mus musculus
agcctggagagttagaaggctgccc

SEQ ID NO: 175183 - DNA, 25 bp, Mus musculus
agcctggagcagcaaatgtcaagat

SEQ ID NO: 175184 - DNA, 25 bp, Mus musculus
agcctggagcaggaaatgtcaagat

SEQ ID NO: 175185 - DNA, 25 bp, Mus musculus
agcctggagggtctgattttttaag

SEQ ID NO: 175186 - DNA, 25 bp, Mus musculus
agcctggagggtgtgattttttaag

SEQ ID NO: 175187 - DNA, 25 bp, Mus musculus
agcctggatacaagagggtctgcat

SEQ ID NO: 175188 - DNA, 25 bp, Mus musculus
agcctggatacatgagggtctgcat

SEQ ID NO: 175189 - DNA, 25 bp, Mus musculus
agcctggatagactggctcctcttg

SEQ ID NO: 175190 - DNA, 25 bp, Mus musculus
agcctggatagagtggctcctcttg

SEQ ID NO: 175191 - DNA, 25 bp, Mus musculus
agcctggattccagcatgatagtct

SEQ ID NO: 175192 - DNA, 25 bp, Mus musculus
agcctggattcctgcatgatagtct

SEQ ID NO: 175193 - DNA, 25 bp, Mus musculus
agcctggcaaacctgctggattgct

SEQ ID NO: 175194 - DNA, 25 bp, Mus musculus
agcctggcaaacgtgctggattgct

SEQ ID NO: 175195 - DNA, 25 bp, Mus musculus
agcctggcaaagctctttgagacct

SEQ ID NO: 175196 - DNA, 25 bp, Mus musculus
agcctggcaaaggtctttgagacct

SEQ ID NO: 175197 - DNA, 25 bp, Mus musculus
agcctggcacaccaagtggattcac

SEQ ID NO: 175198 - DNA, 25 bp, Mus musculus
agcctggcacacgaagtggattcac

SEQ ID NO: 175199 - DNA, 25 bp, Mus musculus
agcctggcacagagttctgtttcat

SEQ ID NO: 175200 - DNA, 25 bp, Mus musculus
agcctggcacagatgtggtcccagc

SEQ ID NO: 175201 - DNA, 25 bp, Mus musculus
agcctggcacagtgttctgtttcat

SEQ ID NO: 175202 - DNA, 25 bp, Mus musculus
agcctggcacagttgtggtcccagc

SEQ ID NO: 175203 - DNA, 25 bp, Mus musculus
agcctggcagatcattatccccatt

SEQ ID NO: 175204 - DNA, 25 bp, Mus musculus
agcctggcagatgattatccccatt

SEQ ID NO: 175205 - DNA, 25 bp, Mus musculus
agcctggcatccctgggaaggcata

SEQ ID NO: 175206 - DNA, 25 bp, Mus musculus
agcctggcatccgtgggaaggcata

SEQ ID NO: 175207 - DNA, 25 bp, Mus musculus
agcctggcatgtagaatactccttt

SEQ ID NO: 175208 - DNA, 25 bp, Mus musculus
agcctggcatgttgaatactccttt

SEQ ID NO: 175209 - DNA, 25 bp, Mus musculus
agcctggccaaaacggcatttgatg

SEQ ID NO: 175210 - DNA, 25 bp, Mus musculus
agcctggccaaatcggcatttgatg

SEQ ID NO: 175211 - DNA, 25 bp, Mus musculus
agcctggccacgcaagaaggtgaat

SEQ ID NO: 175212 - DNA, 25 bp, Mus musculus
agcctggccacggaagaaggtgaat

SEQ ID NO: 175213 - DNA, 25 bp, Mus musculus
agcctggccactagacggtgctgct

SEQ ID NO: 175214 - DNA, 25 bp, Mus musculus
agcctggccacttgacggtgctgct

SEQ ID NO: 175215 - DNA, 25 bp, Mus musculus
agcctggcccttatgattatgttag

SEQ ID NO: 175216 - DNA, 25 bp, Mus musculus
agcctggcccttttgattatgttag

SEQ ID NO: 175217 - DNA, 25 bp, Mus musculus
agcctggccgctctttgtcttggtg

SEQ ID NO: 175218 - DNA, 25 bp, Mus musculus
agcctggccgctgtttgtcttggtg

SEQ ID NO: 175219 - DNA, 25 bp, Mus musculus
agcctggccgtacactttgttcaac

SEQ ID NO: 175220 - DNA, 25 bp, Mus musculus
agcctggccgtagactttgttcaac

SEQ ID NO: 175221 - DNA, 25 bp, Mus musculus
agcctggcctaaaactcatggtcct

SEQ ID NO: 175222 - DNA, 25 bp, Mus musculus
agcctggcctaatactcatggtcct

SEQ ID NO: 175223 - DNA, 25 bp, Mus musculus
agcctggcctccaatgtagcaagct

SEQ ID NO: 175224 - DNA, 25 bp, Mus musculus
agcctggcctccatagagacagttt

SEQ ID NO: 175225 - DNA, 25 bp, Mus musculus
agcctggcctcctatgtagcaagct

SEQ ID NO: 175226 - DNA, 25 bp, Mus musculus
agcctggcctccttagagacagttt

SEQ ID NO: 175227 - DNA, 25 bp, Mus musculus
agcctggcgaagaagaattcctttt

SEQ ID NO: 175228 - DNA, 25 bp, Mus musculus
agcctggcgaagtagaattcctttt

SEQ ID NO: 175229 - DNA, 25 bp, Mus musculus
agcctggcgctgagacggagctgga

SEQ ID NO: 175230 - DNA, 25 bp, Mus musculus
agcctggcgctgtgacggagctgga

SEQ ID NO: 175231 - DNA, 25 bp, Mus musculus
agcctggcgtctagtgtgcatgaag

SEQ ID NO: 175232 - DNA, 25 bp, Mus musculus
agcctggcgtcttgtgtgcatgaag

SEQ ID NO: 175233 - DNA, 25 bp, Mus musculus
agcctggctactaagacccagtctc

SEQ ID NO: 175234 - DNA, 25 bp, Mus musculus
agcctggctacttagacccagtctc

SEQ ID NO: 175235 - DNA, 25 bp, Mus musculus
agcctggctcaaaattagaactgca

SEQ ID NO: 175236 - DNA, 25 bp, Mus musculus
agcctggctcaatattagaactgca

SEQ ID NO: 175237 - DNA, 25 bp, Mus musculus
agcctggctcaccacttgtgcatat

SEQ ID NO: 175238 - DNA, 25 bp, Mus musculus
agcctggctcacgacttgtgcatat

SEQ ID NO: 175239 - DNA, 25 bp, Mus musculus
agcctggctctgacatgacgtgttg

SEQ ID NO: 175240 - DNA, 25 bp, Mus musculus
agcctggctctgtcatgacgtgttg

SEQ ID NO: 175241 - DNA, 25 bp, Mus musculus
agcctggctgacagagactccatgc

SEQ ID NO: 175242 - DNA, 25 bp, Mus musculus
agcctggctgactgagactccatgc

SEQ ID NO: 175243 - DNA, 25 bp, Mus musculus
agcctggctgatcgtcattgacaca

SEQ ID NO: 175244 - DNA, 25 bp, Mus musculus
agcctggctgatggtcattgacaca

SEQ ID NO: 175245 - DNA, 25 bp, Mus musculus
agcctggctgctagccctgtggtgt

SEQ ID NO: 175246 - DNA, 25 bp, Mus musculus
agcctggctgcttgccctgtggtgt

SEQ ID NO: 175247 - DNA, 25 bp, Mus musculus
agcctggctggacatgcgtgttaac

SEQ ID NO: 175248 - DNA, 25 bp, Mus musculus
agcctggctggagatgcgtgttaac

SEQ ID NO: 175249 - DNA, 25 bp, Mus musculus
agcctggctgtactgatgtactttc

SEQ ID NO: 175250 - DNA, 25 bp, Mus musculus
agcctggctgtagtgatgtactttc

SEQ ID NO: 175251 - DNA, 25 bp, Mus musculus
agcctggctgtcacaaagctttctt

SEQ ID NO: 175252 - DNA, 25 bp, Mus musculus
agcctggctgtctcaaagctttctt

SEQ ID NO: 175253 - DNA, 25 bp, Mus musculus
agcctggctgttataagtaccgtcg

SEQ ID NO: 175254 - DNA, 25 bp, Mus musculus
agcctggctgttttaagtaccgtcg

SEQ ID NO: 175255 - DNA, 25 bp, Mus musculus
agcctggcttacatctatagtttga

SEQ ID NO: 175256 - DNA, 25 bp, Mus musculus
agcctggcttacttctatagtttga

SEQ ID NO: 175257 - DNA, 25 bp, Mus musculus
agcctggcttcaagtgatcagtggg

SEQ ID NO: 175258 - DNA, 25 bp, Mus musculus
agcctggcttcatgtgatcagtggg

SEQ ID NO: 175259 - DNA, 25 bp, Mus musculus
agcctggcttctctatctagtttga

SEQ ID NO: 175260 - DNA, 25 bp, Mus musculus
agcctggcttctgtatctagtttga

SEQ ID NO: 175261 - DNA, 25 bp, Mus musculus
agcctgggaacaccgatgccatggg

SEQ ID NO: 175262 - DNA, 25 bp, Mus musculus
agcctgggaacagcgatgccatggg

SEQ ID NO: 175263 - DNA, 25 bp, Mus musculus
agcctgggaaggagcaccaacctag

SEQ ID NO: 175264 - DNA, 25 bp, Mus musculus
agcctgggaaggtgcaccaacctag

SEQ ID NO: 175265 - DNA, 25 bp, Mus musculus
agcctgggagctctagatactgtat

SEQ ID NO: 175266 - DNA, 25 bp, Mus musculus
agcctgggagctgtagatactgtat

SEQ ID NO: 175267 - DNA, 25 bp, Mus musculus
agcctgggaggtcctgaagccttct

SEQ ID NO: 175268 - DNA, 25 bp, Mus musculus
agcctgggaggtgctgaagccttct

SEQ ID NO: 175269 - DNA, 25 bp, Mus musculus
agcctgggatgacacctcttccaga

SEQ ID NO: 175270 - DNA, 25 bp, Mus musculus
agcctgggatgagacctcttccaga

SEQ ID NO: 175271 - DNA, 25 bp, Mus musculus
agcctgggattcaaaggtgtggact

SEQ ID NO: 175272 - DNA, 25 bp, Mus musculus
agcctgggattctaaggtgtggact

SEQ ID NO: 175273 - DNA, 25 bp, Mus musculus
agcctgggcaaaaagatcctgaatt

SEQ ID NO: 175274 - DNA, 25 bp, Mus musculus
agcctgggcaaatagatcctgaatt

SEQ ID NO: 175275 - DNA, 25 bp, Mus musculus
agcctgggcaagaccttgtccaaaa

SEQ ID NO: 175276 - DNA, 25 bp, Mus musculus
agcctgggcaagattcaaccacata

SEQ ID NO: 175277 - DNA, 25 bp, Mus musculus
agcctgggcaagtccttgtccaaaa

SEQ ID NO: 175278 - DNA, 25 bp, Mus musculus
agcctgggcaagtttcaaccacata

SEQ ID NO: 175279 - DNA, 25 bp, Mus musculus
agcctgggcatcaccttgttagagg

SEQ ID NO: 175280 - DNA, 25 bp, Mus musculus
agcctgggcatctccttgttagagg

SEQ ID NO: 175281 - DNA, 25 bp, Mus musculus
agcctgggcattagtttccctcaaa

SEQ ID NO: 175282 - DNA, 25 bp, Mus musculus
agcctgggcatttgtttccctcaaa

SEQ ID NO: 175283 - DNA, 25 bp, Mus musculus
agcctgggcctcaggcgcacagcag

SEQ ID NO: 175284 - DNA, 25 bp, Mus musculus
agcctgggcctctggcgcacagcag

SEQ ID NO: 175285 - DNA, 25 bp, Mus musculus
agcctgggcctgatgctacacacag

SEQ ID NO: 175286 - DNA, 25 bp, Mus musculus
agcctgggcctgttgctacacacag

SEQ ID NO: 175287 - DNA, 25 bp, Mus musculus
agcctgggctacatgcagtgttcag

SEQ ID NO: 175288 - DNA, 25 bp, Mus musculus
agcctgggctacctaataactctaa

SEQ ID NO: 175289 - DNA, 25 bp, Mus musculus
agcctgggctacgtaataactctaa

SEQ ID NO: 175290 - DNA, 25 bp, Mus musculus
agcctgggctacttgcagtgttcag

SEQ ID NO: 175291 - DNA, 25 bp, Mus musculus
agcctgggctataacccacaggaac

SEQ ID NO: 175292 - DNA, 25 bp, Mus musculus
agcctgggctattacccacaggaac

SEQ ID NO: 175293 - DNA, 25 bp, Mus musculus
agcctgggctccatgagaagaccca

SEQ ID NO: 175294 - DNA, 25 bp, Mus musculus
agcctgggctccttgagaagaccca

SEQ ID NO: 175295 - DNA, 25 bp, Mus musculus
agcctgggtacaaaccttgcccatt

SEQ ID NO: 175296 - DNA, 25 bp, Mus musculus
agcctgggtacataccttgcccatt

SEQ ID NO: 175297 - DNA, 25 bp, Mus musculus
agcctgggtactagagagcttccct

SEQ ID NO: 175298 - DNA, 25 bp, Mus musculus
agcctgggtacttgagagcttccct

SEQ ID NO: 175299 - DNA, 25 bp, Mus musculus
agcctgggttacaccttgtgttgga

SEQ ID NO: 175300 - DNA, 25 bp, Mus musculus
agcctgggttactccttgtgttgga

SEQ ID NO: 175301 - DNA, 25 bp, Mus musculus
agcctgggttcaaacactctcttac

SEQ ID NO: 175302 - DNA, 25 bp, Mus musculus
agcctgggttcatacactctcttac

SEQ ID NO: 175303 - DNA, 25 bp, Mus musculus
agcctggtagcaaccgcattgaagt

SEQ ID NO: 175304 - DNA, 25 bp, Mus musculus
agcctggtagcatccgcattgaagt

SEQ ID NO: 175305 - DNA, 25 bp, Mus musculus
agcctggtatagcaattacgtctta

SEQ ID NO: 175306 - DNA, 25 bp, Mus musculus
agcctggtataggaattacgtctta

SEQ ID NO: 175307 - DNA, 25 bp, Mus musculus
agcctggtcaacacaacagaccgtg

SEQ ID NO: 175308 - DNA, 25 bp, Mus musculus
agcctggtcaactcaacagaccgtg

SEQ ID NO: 175309 - DNA, 25 bp, Mus musculus
agcctggtcagaccaccggaagttc

SEQ ID NO: 175310 - DNA, 25 bp, Mus musculus
agcctggtcagagcaccggaagttc

SEQ ID NO: 175311 - DNA, 25 bp, Mus musculus
agcctggtcccaactgtttagggaa

SEQ ID NO: 175312 - DNA, 25 bp, Mus musculus
agcctggtcccatctgtttagggaa

SEQ ID NO: 175313 - DNA, 25 bp, Mus musculus
agcctggtccggcatctgtatgaga

SEQ ID NO: 175314 - DNA, 25 bp, Mus musculus
agcctggtccgggatctgtatgaga

SEQ ID NO: 175315 - DNA, 25 bp, Mus musculus
agcctggtcgtgctcttagaataca

SEQ ID NO: 175316 - DNA, 25 bp, Mus musculus
agcctggtcgtggtcttagaataca

SEQ ID NO: 175317 - DNA, 25 bp, Mus musculus
agcctggtctacctgcgttttttct

SEQ ID NO: 175318 - DNA, 25 bp, Mus musculus
agcctggtctacgtgcgttttttct

SEQ ID NO: 175319 - DNA, 25 bp, Mus musculus
agcctggtctatatcctaaaaccct

SEQ ID NO: 175320 - DNA, 25 bp, Mus musculus
agcctggtctatttcctaaaaccct

SEQ ID NO: 175321 - DNA, 25 bp, Mus musculus
agcctggtctgcagtaaaattaggt

SEQ ID NO: 175322 - DNA, 25 bp, Mus musculus
agcctggtctgctgtaaaattaggt

SEQ ID NO: 175323 - DNA, 25 bp, Mus musculus
agcctggtcttacatttaattgtcc

SEQ ID NO: 175324 - DNA, 25 bp, Mus musculus
agcctggtcttagatttaattgtcc

SEQ ID NO: 175325 - DNA, 25 bp, Mus musculus
agcctggtgaccacagtgggccaaa

SEQ ID NO: 175326 - DNA, 25 bp, Mus musculus
agcctggtgacctcagtgggccaaa

SEQ ID NO: 175327 - DNA, 25 bp, Mus musculus
agcctggtggcgacttcgagtgaaa

SEQ ID NO: 175328 - DNA, 25 bp, Mus musculus
agcctggtggcgtcttcgagtgaaa

SEQ ID NO: 175329 - DNA, 25 bp, Mus musculus
agcctggtggctatagtcctggaca

SEQ ID NO: 175330 - DNA, 25 bp, Mus musculus
agcctggtggctttagtcctggaca

SEQ ID NO: 175331 - DNA, 25 bp, Mus musculus
agcctggtgggcactgtctcaatga

SEQ ID NO: 175332 - DNA, 25 bp, Mus musculus
agcctggtgggctctgtctcaatga

SEQ ID NO: 175333 - DNA, 25 bp, Mus musculus
agcctggtggtgagggagggatctc

SEQ ID NO: 175334 - DNA, 25 bp, Mus musculus
agcctggtggtgtgggagggatctc

SEQ ID NO: 175335 - DNA, 25 bp, Mus musculus
agcctggtgtagatccagcccatca

SEQ ID NO: 175336 - DNA, 25 bp, Mus musculus
agcctggtgtagttccagcccatca

SEQ ID NO: 175337 - DNA, 25 bp, Mus musculus
agcctggtgtgcactgccctccggg

SEQ ID NO: 175338 - DNA, 25 bp, Mus musculus
agcctggtgtgctctgccctccggg

SEQ ID NO: 175339 - DNA, 25 bp, Mus musculus
agcctggttacacagcccatggtgg

SEQ ID NO: 175340 - DNA, 25 bp, Mus musculus
agcctggttacagagcccatggtgg

SEQ ID NO: 175341 - DNA, 25 bp, Mus musculus
agcctggttagcaaggttactgcat

SEQ ID NO: 175342 - DNA, 25 bp, Mus musculus
agcctggttagctaggttactgcat

SEQ ID NO: 175343 - DNA, 25 bp, Mus musculus
agcctggttccaaaatagtctataa

SEQ ID NO: 175344 - DNA, 25 bp, Mus musculus
agcctggttccataatagtctataa

SEQ ID NO: 175345 - DNA, 25 bp, Mus musculus
agcctggttggcatggagcagtgtt

SEQ ID NO: 175346 - DNA, 25 bp, Mus musculus
agcctggttggcttggagcagtgtt

SEQ ID NO: 175347 - DNA, 25 bp, Mus musculus
agcctgtaacctcgaggtgcttgga

SEQ ID NO: 175348 - DNA, 25 bp, Mus musculus
agcctgtaacctggaggtgcttgga

SEQ ID NO: 175349 - DNA, 25 bp, Mus musculus
agcctgtaatgccatctactcagag

SEQ ID NO: 175350 - DNA, 25 bp, Mus musculus
agcctgtaatgcgatctactcagag

SEQ ID NO: 175351 - DNA, 25 bp, Mus musculus
agcctgtaccacctgtaagctggag

SEQ ID NO: 175352 - DNA, 25 bp, Mus musculus
agcctgtaccacgtgtaagctggag

SEQ ID NO: 175353 - DNA, 25 bp, Mus musculus
agcctgtaccagagagtgcctgtct

SEQ ID NO: 175354 - DNA, 25 bp, Mus musculus
agcctgtaccagtgagtgcctgtct

SEQ ID NO: 175355 - DNA, 25 bp, Mus musculus
agcctgtagagtcgcctgggctgaa

SEQ ID NO: 175356 - DNA, 25 bp, Mus musculus
agcctgtagagtggcctgggctgaa

SEQ ID NO: 175357 - DNA, 25 bp, Mus musculus
agcctgtagcctcaccgcactagtg

SEQ ID NO: 175358 - DNA, 25 bp, Mus musculus
agcctgtagcctgaccgcactagtg

SEQ ID NO: 175359 - DNA, 25 bp, Mus musculus
agcctgtagctgattctagtctcac

SEQ ID NO: 175360 - DNA, 25 bp, Mus musculus
agcctgtagctgtttctagtctcac

SEQ ID NO: 175361 - DNA, 25 bp, Mus musculus
agcctgtaggatcgtgcgacaaatc

SEQ ID NO: 175362 - DNA, 25 bp, Mus musculus
agcctgtaggatggtgcgacaaatc

SEQ ID NO: 175363 - DNA, 25 bp, Mus musculus
agcctgtaggcgcatctgctagata

SEQ ID NO: 175364 - DNA, 25 bp, Mus musculus
agcctgtaggcggatctgctagata

SEQ ID NO: 175365 - DNA, 25 bp, Mus musculus
agcctgtaggctaccaccatacatg

SEQ ID NO: 175366 - DNA, 25 bp, Mus musculus
agcctgtaggcttccaccatacatg

SEQ ID NO: 175367 - DNA, 25 bp, Mus musculus
agcctgtatcctcggcgattgggta

SEQ ID NO: 175368 - DNA, 25 bp, Mus musculus
agcctgtatcctgggcgattgggta

SEQ ID NO: 175369 - DNA, 25 bp, Mus musculus
agcctgtatgacagtaccctccttc

SEQ ID NO: 175370 - DNA, 25 bp, Mus musculus
agcctgtatgactgtaccctccttc

SEQ ID NO: 175371 - DNA, 25 bp, Mus musculus
agcctgtattttctaatccttgaac

SEQ ID NO: 175372 - DNA, 25 bp, Mus musculus
agcctgtattttgtaatccttgaac

SEQ ID NO: 175373 - DNA, 25 bp, Mus musculus
agcctgtcactcaagctcagcctgg

SEQ ID NO: 175374 - DNA, 25 bp, Mus musculus
agcctgtcactctagctcagcctgg

SEQ ID NO: 175375 - DNA, 25 bp, Mus musculus
agcctgtcagaacttcagccgtgtg

SEQ ID NO: 175376 - DNA, 25 bp, Mus musculus
agcctgtcagaagttcagccgtgtg

SEQ ID NO: 175377 - DNA, 25 bp, Mus musculus
agcctgtcatccctttgtctatggt

SEQ ID NO: 175378 - DNA, 25 bp, Mus musculus
agcctgtcatccgtttgtctatggt

SEQ ID NO: 175379 - DNA, 25 bp, Mus musculus
agcctgtccaccagcgttcagctgt

SEQ ID NO: 175380 - DNA, 25 bp, Mus musculus
agcctgtccacctgcgttcagctgt

SEQ ID NO: 175381 - DNA, 25 bp, Mus musculus
agcctgtcccataactgagtcgagc

SEQ ID NO: 175382 - DNA, 25 bp, Mus musculus
agcctgtcccattactgagtcgagc

SEQ ID NO: 175383 - DNA, 25 bp, Mus musculus
agcctgtcctgtcgccagaatacac

SEQ ID NO: 175384 - DNA, 25 bp, Mus musculus
agcctgtcctgtggccagaatacac

SEQ ID NO: 175385 - DNA, 25 bp, Mus musculus
agcctgtcgggactgtgtttcccct

SEQ ID NO: 175386 - DNA, 25 bp, Mus musculus
agcctgtcgggagtgtgtttcccct

SEQ ID NO: 175387 - DNA, 25 bp, Mus musculus
agcctgtcgtctatttactggatag

SEQ ID NO: 175388 - DNA, 25 bp, Mus musculus
agcctgtcgtctttttactggatag

SEQ ID NO: 175389 - DNA, 25 bp, Mus musculus
agcctgtctattcctctgttctggg

SEQ ID NO: 175390 - DNA, 25 bp, Mus musculus
agcctgtctattcctgtgcttagaa

SEQ ID NO: 175391 - DNA, 25 bp, Mus musculus
agcctgtctattgctctgttctggg

SEQ ID NO: 175392 - DNA, 25 bp, Mus musculus
agcctgtctattgctgtgcttagaa

SEQ ID NO: 175393 - DNA, 25 bp, Mus musculus
agcctgtctcttcacatgagtcaga

SEQ ID NO: 175394 - DNA, 25 bp, Mus musculus
agcctgtctcttccatggagcgaag

SEQ ID NO: 175395 - DNA, 25 bp, Mus musculus
agcctgtctcttgacatgagtcaga

SEQ ID NO: 175396 - DNA, 25 bp, Mus musculus
agcctgtctcttgcatggagcgaag

SEQ ID NO: 175397 - DNA, 25 bp, Mus musculus
agcctgtctgacactttttgtatat

SEQ ID NO: 175398 - DNA, 25 bp, Mus musculus
agcctgtctgacatagtcttccaat

SEQ ID NO: 175399 - DNA, 25 bp, Mus musculus
agcctgtctgactctttttgtatat

SEQ ID NO: 175400 - DNA, 25 bp, Mus musculus
agcctgtctgacttagtcttccaat

SEQ ID NO: 175401 - DNA, 25 bp, Mus musculus
agcctgtctgagaacagccctttcc

SEQ ID NO: 175402 - DNA, 25 bp, Mus musculus
agcctgtctgagtacagccctttcc

SEQ ID NO: 175403 - DNA, 25 bp, Mus musculus
agcctgtctgctctatttggagaag

SEQ ID NO: 175404 - DNA, 25 bp, Mus musculus
agcctgtctgctgtatttggagaag

SEQ ID NO: 175405 - DNA, 25 bp, Mus musculus
agcctgtctgttcacttggtcgaag

SEQ ID NO: 175406 - DNA, 25 bp, Mus musculus
agcctgtctgttgacttggtcgaag

SEQ ID NO: 175407 - DNA, 25 bp, Mus musculus
agcctgtcttcacatctgtgggatg

SEQ ID NO: 175408 - DNA, 25 bp, Mus musculus
agcctgtcttcagatctgtgggatg

SEQ ID NO: 175409 - DNA, 25 bp, Mus musculus
agcctgtcttgtaggtgggacccta

SEQ ID NO: 175410 - DNA, 25 bp, Mus musculus
agcctgtcttgttggtgggacccta

SEQ ID NO: 175411 - DNA, 25 bp, Mus musculus
agcctgtctttccaagttgacttat

SEQ ID NO: 175412 - DNA, 25 bp, Mus musculus
agcctgtctttcgaagttgacttat

SEQ ID NO: 175413 - DNA, 25 bp, Mus musculus
agcctgtgacacatgttggtactgt

SEQ ID NO: 175414 - DNA, 25 bp, Mus musculus
agcctgtgacacttgttggtactgt

SEQ ID NO: 175415 - DNA, 25 bp, Mus musculus
agcctgtgacctaggcagctgatgg

SEQ ID NO: 175416 - DNA, 25 bp, Mus musculus
agcctgtgacctcccagcatgtcaa

SEQ ID NO: 175417 - DNA, 25 bp, Mus musculus
agcctgtgacctgccagcatgtcaa

SEQ ID NO: 175418 - DNA, 25 bp, Mus musculus
agcctgtgaccttggcagctgatgg

SEQ ID NO: 175419 - DNA, 25 bp, Mus musculus
agcctgtgcactacggccgtttcta

SEQ ID NO: 175420 - DNA, 25 bp, Mus musculus
agcctgtgcacttcggccgtttcta

SEQ ID NO: 175421 - DNA, 25 bp, Mus musculus
agcctgtgcaggctgtgcatgacac

SEQ ID NO: 175422 - DNA, 25 bp, Mus musculus
agcctgtgcaggctttggccttcac

SEQ ID NO: 175423 - DNA, 25 bp, Mus musculus
agcctgtgcagggtgtgcatgacac

SEQ ID NO: 175424 - DNA, 25 bp, Mus musculus
agcctgtgcagggtttggccttcac

SEQ ID NO: 175425 - DNA, 25 bp, Mus musculus
agcctgtgcagtcgatggaatctac

SEQ ID NO: 175426 - DNA, 25 bp, Mus musculus
agcctgtgcagtggatggaatctac

SEQ ID NO: 175427 - DNA, 25 bp, Mus musculus
agcctgtgccacatgtctataatct

SEQ ID NO: 175428 - DNA, 25 bp, Mus musculus
agcctgtgccacttgtctataatct

SEQ ID NO: 175429 - DNA, 25 bp, Mus musculus
agcctgtgcgtgatcttagaaatca

SEQ ID NO: 175430 - DNA, 25 bp, Mus musculus
agcctgtgcgtgttcttagaaatca

SEQ ID NO: 175431 - DNA, 25 bp, Mus musculus
agcctgtgctgtattcaagtctctg

SEQ ID NO: 175432 - DNA, 25 bp, Mus musculus
agcctgtgctgttttcaagtctctg

SEQ ID NO: 175433 - DNA, 25 bp, Mus musculus
agcctgtggactctgcgcattgata

SEQ ID NO: 175434 - DNA, 25 bp, Mus musculus
agcctgtggactgtgcgcattgata

SEQ ID NO: 175435 - DNA, 25 bp, Mus musculus
agcctgtggagcagagcgacaccat

SEQ ID NO: 175436 - DNA, 25 bp, Mus musculus
agcctgtggagctgagcgacaccat

SEQ ID NO: 175437 - DNA, 25 bp, Mus musculus
agcctgtggagtccagcgcctttga

SEQ ID NO: 175438 - DNA, 25 bp, Mus musculus
agcctgtggagtgcagcgcctttga

SEQ ID NO: 175439 - DNA, 25 bp, Mus musculus
agcctgtggatactagcgcccgtct

SEQ ID NO: 175440 - DNA, 25 bp, Mus musculus
agcctgtggatagtagcgcccgtct

SEQ ID NO: 175441 - DNA, 25 bp, Mus musculus
agcctgtgggcgaaggtgcactcac

SEQ ID NO: 175442 - DNA, 25 bp, Mus musculus
agcctgtgggcgtaggtgcactcac

SEQ ID NO: 175443 - DNA, 25 bp, Mus musculus
agcctgtggtccaaggcaggtcaaa

SEQ ID NO: 175444 - DNA, 25 bp, Mus musculus
agcctgtggtcctaggcaggtcaaa

SEQ ID NO: 175445 - DNA, 25 bp, Mus musculus
agcctgtgtgatccaacaggtcggg

SEQ ID NO: 175446 - DNA, 25 bp, Mus musculus
agcctgtgtgatgcaacaggtcggg

SEQ ID NO: 175447 - DNA, 25 bp, Mus musculus
agcctgtgtgctactagtgtataaa

SEQ ID NO: 175448 - DNA, 25 bp, Mus musculus
agcctgtgtgcttctagtgtataaa

SEQ ID NO: 175449 - DNA, 25 bp, Mus musculus
agcctgtgtggcacctcggagaatg

SEQ ID NO: 175450 - DNA, 25 bp, Mus musculus
agcctgtgtggctcctcggagaatg

SEQ ID NO: 175451 - DNA, 25 bp, Mus musculus
agcctgtgtggtagctgccattgaa

SEQ ID NO: 175452 - DNA, 25 bp, Mus musculus
agcctgtgtggttgctgccattgaa

SEQ ID NO: 175453 - DNA, 25 bp, Mus musculus
agcctgtgttctaaagtagcattat

SEQ ID NO: 175454 - DNA, 25 bp, Mus musculus
agcctgtgttcttaagtagcattat

SEQ ID NO: 175455 - DNA, 25 bp, Mus musculus
agcctgttatctattaattgcatga

SEQ ID NO: 175456 - DNA, 25 bp, Mus musculus
agcctgttatcttttaattgcatga

SEQ ID NO: 175457 - DNA, 25 bp, Mus musculus
agcctgttcacccaaagttcttgat

SEQ ID NO: 175458 - DNA, 25 bp, Mus musculus
agcctgttcaccgaaagttcttgat

SEQ ID NO: 175459 - DNA, 25 bp, Mus musculus
agcctgttcccacggtgcaatgata

SEQ ID NO: 175460 - DNA, 25 bp, Mus musculus
agcctgttcccagggtgcaatgata

SEQ ID NO: 175461 - DNA, 25 bp, Mus musculus
agcctgttcctaccttaaggcctct

SEQ ID NO: 175462 - DNA, 25 bp, Mus musculus
agcctgttcctagcttaaggcctct

SEQ ID NO: 175463 - DNA, 25 bp, Mus musculus
agcctgttcctcatgaccaacaaag

SEQ ID NO: 175464 - DNA, 25 bp, Mus musculus
agcctgttcctcttgaccaacaaag

SEQ ID NO: 175465 - DNA, 25 bp, Mus musculus
agcctgttctacaccaagagggtct

SEQ ID NO: 175466 - DNA, 25 bp, Mus musculus
agcctgttctactccaagagggtct

SEQ ID NO: 175467 - DNA, 25 bp, Mus musculus
agcctgttctccagttgcattattt

SEQ ID NO: 175468 - DNA, 25 bp, Mus musculus
agcctgttctcctgttgcattattt

SEQ ID NO: 175469 - DNA, 25 bp, Mus musculus
agcctgttctggcatgtgaataata

SEQ ID NO: 175470 - DNA, 25 bp, Mus musculus
agcctgttctgggatgtgaataata

SEQ ID NO: 175471 - DNA, 25 bp, Mus musculus
agcctgttgactctgcttaaggtta

SEQ ID NO: 175472 - DNA, 25 bp, Mus musculus
agcctgttgactgtgcttaaggtta

SEQ ID NO: 175473 - DNA, 25 bp, Mus musculus
agcctgttgatgctttcagtgtatg

SEQ ID NO: 175474 - DNA, 25 bp, Mus musculus
agcctgttgatggtttcagtgtatg

SEQ ID NO: 175475 - DNA, 25 bp, Mus musculus
agcctgttgcaccaggttctagggt

SEQ ID NO: 175476 - DNA, 25 bp, Mus musculus
agcctgttgcacgaggttctagggt

SEQ ID NO: 175477 - DNA, 25 bp, Mus musculus
agcctgttgcagcagtaacttagaa

SEQ ID NO: 175478 - DNA, 25 bp, Mus musculus
agcctgttgcaggagtaacttagaa

SEQ ID NO: 175479 - DNA, 25 bp, Mus musculus
agcctgttggttcccatgtgttaag

SEQ ID NO: 175480 - DNA, 25 bp, Mus musculus
agcctgttggttgccatgtgttaag

SEQ ID NO: 175481 - DNA, 25 bp, Mus musculus
agcctgttttgcatctgggcaagga

SEQ ID NO: 175482 - DNA, 25 bp, Mus musculus
agcctgttttgcttctgggcaagga

SEQ ID NO: 175483 - DNA, 25 bp, Mus musculus
agccttaaaaagagttgcacacatt

SEQ ID NO: 175484 - DNA, 25 bp, Mus musculus
agccttaaaaagtgttgcacacatt

SEQ ID NO: 175485 - DNA, 25 bp, Mus musculus
agccttaaatatcacgctttctcgg

SEQ ID NO: 175486 - DNA, 25 bp, Mus musculus
agccttaaatatgacgctttctcgg

SEQ ID NO: 175487 - DNA, 25 bp, Mus musculus
agccttaagcacaccagacttttct

SEQ ID NO: 175488 - DNA, 25 bp, Mus musculus
agccttaagcactccagacttttct

SEQ ID NO: 175489 - DNA, 25 bp, Mus musculus
agccttaagctgacttgtgctagca

SEQ ID NO: 175490 - DNA, 25 bp, Mus musculus
agccttaagctgtcttgtgctagca

SEQ ID NO: 175491 - DNA, 25 bp, Mus musculus
agccttaaggctcacagtgacttca

SEQ ID NO: 175492 - DNA, 25 bp, Mus musculus
agccttaaggctgacagtgacttca

SEQ ID NO: 175493 - DNA, 25 bp, Mus musculus
agccttaccgtgcagtgaagcctgt

SEQ ID NO: 175494 - DNA, 25 bp, Mus musculus
agccttaccgtggagtgaagcctgt

SEQ ID NO: 175495 - DNA, 25 bp, Mus musculus
agccttacctgtactatttcttgat

SEQ ID NO: 175496 - DNA, 25 bp, Mus musculus
agccttacctgttctatttcttgat

SEQ ID NO: 175497 - DNA, 25 bp, Mus musculus
agccttactatcaagtgtcttcctc

SEQ ID NO: 175498 - DNA, 25 bp, Mus musculus
agccttactatctagtgtcttcctc

SEQ ID NO: 175499 - DNA, 25 bp, Mus musculus
agccttactattaatgcccaagtac

SEQ ID NO: 175500 - DNA, 25 bp, Mus musculus
agccttactatttatgcccaagtac

SEQ ID NO: 175501 - DNA, 25 bp, Mus musculus
agccttactctgaatacctacctat

SEQ ID NO: 175502 - DNA, 25 bp, Mus musculus
agccttactctgtatacctacctat

SEQ ID NO: 175503 - DNA, 25 bp, Mus musculus
agccttactgggatacttgtcaaca

SEQ ID NO: 175504 - DNA, 25 bp, Mus musculus
agccttactgggttacttgtcaaca

SEQ ID NO: 175505 - DNA, 25 bp, Mus musculus
agccttagctatataaaaccatgtc

SEQ ID NO: 175506 - DNA, 25 bp, Mus musculus
agccttagctatttaaaaccatgtc

SEQ ID NO: 175507 - DNA, 25 bp, Mus musculus
agccttagctgcagcttgtaggttt

SEQ ID NO: 175508 - DNA, 25 bp, Mus musculus
agccttagctgctgcttgtaggttt

SEQ ID NO: 175509 - DNA, 25 bp, Mus musculus
agccttagctttcttccctagcaaa

SEQ ID NO: 175510 - DNA, 25 bp, Mus musculus
agccttagctttgttccctagcaaa

SEQ ID NO: 175511 - DNA, 25 bp, Mus musculus
agccttagggtgatctgctagtgca

SEQ ID NO: 175512 - DNA, 25 bp, Mus musculus
agccttagggtgttctgctagtgca

SEQ ID NO: 175513 - DNA, 25 bp, Mus musculus
agccttagttcccacagaggacgga

SEQ ID NO: 175514 - DNA, 25 bp, Mus musculus
agccttagttcccattggtcaatta

SEQ ID NO: 175515 - DNA, 25 bp, Mus musculus
agccttagttccgacagaggacgga

SEQ ID NO: 175516 - DNA, 25 bp, Mus musculus
agccttagttccgattggtcaatta

SEQ ID NO: 175517 - DNA, 25 bp, Mus musculus
agccttataatgacttacgttgaca

SEQ ID NO: 175518 - DNA, 25 bp, Mus musculus
agccttataatgtcttacgttgaca

SEQ ID NO: 175519 - DNA, 25 bp, Mus musculus
agccttatactgaggtgctttcaga

SEQ ID NO: 175520 - DNA, 25 bp, Mus musculus
agccttatactgtggtgctttcaga

SEQ ID NO: 175521 - DNA, 25 bp, Mus musculus
agccttatccaccttcacagaagac

SEQ ID NO: 175522 - DNA, 25 bp, Mus musculus
agccttatccacgttcacagaagac

SEQ ID NO: 175523 - DNA, 25 bp, Mus musculus
agccttatcctgatggtggaatact

SEQ ID NO: 175524 - DNA, 25 bp, Mus musculus
agccttatcctgttggtggaatact

SEQ ID NO: 175525 - DNA, 25 bp, Mus musculus
agccttatgcaaaaattcaccttca

SEQ ID NO: 175526 - DNA, 25 bp, Mus musculus
agccttatgcaataattcaccttca

SEQ ID NO: 175527 - DNA, 25 bp, Mus musculus
agccttatgcctagattgacaccac

SEQ ID NO: 175528 - DNA, 25 bp, Mus musculus
agccttatgccttgattgacaccac

SEQ ID NO: 175529 - DNA, 25 bp, Mus musculus
agccttatgggacgacagtggtata

SEQ ID NO: 175530 - DNA, 25 bp, Mus musculus
agccttatgggaggacagtggtata

SEQ ID NO: 175531 - DNA, 25 bp, Mus musculus
agccttattccgattcttgatgttt

SEQ ID NO: 175532 - DNA, 25 bp, Mus musculus
agccttattccgtttcttgatgttt

SEQ ID NO: 175533 - DNA, 25 bp, Mus musculus
agccttcaaagaagtagccctcgtc

SEQ ID NO: 175534 - DNA, 25 bp, Mus musculus
agccttcaaagatgtagccctcgtc

SEQ ID NO: 175535 - DNA, 25 bp, Mus musculus
agccttcaaaggatgtcggacttct

SEQ ID NO: 175536 - DNA, 25 bp, Mus musculus
agccttcaaaggttgtcggacttct

SEQ ID NO: 175537 - DNA, 25 bp, Mus musculus
agccttcaaagtacctgggatcaca

SEQ ID NO: 175538 - DNA, 25 bp, Mus musculus
agccttcaaagttcctgggatcaca

SEQ ID NO: 175539 - DNA, 25 bp, Mus musculus
agccttcaacacaacaatagactgt

SEQ ID NO: 175540 - DNA, 25 bp, Mus musculus
agccttcaacactacaatagactgt

SEQ ID NO: 175541 - DNA, 25 bp, Mus musculus
agccttcaagtgaaccagcaattcc

SEQ ID NO: 175542 - DNA, 25 bp, Mus musculus
agccttcaagtgtaccagcaattcc

SEQ ID NO: 175543 - DNA, 25 bp, Mus musculus
agccttcaatttctttattttctat

SEQ ID NO: 175544 - DNA, 25 bp, Mus musculus
agccttcaatttgtttattttctat

SEQ ID NO: 175545 - DNA, 25 bp, Mus musculus
agccttcacagtactccaagcagga

SEQ ID NO: 175546 - DNA, 25 bp, Mus musculus
agccttcacagttctccaagcagga

SEQ ID NO: 175547 - DNA, 25 bp, Mus musculus
agccttcaccgaaacaagaccatgt

SEQ ID NO: 175548 - DNA, 25 bp, Mus musculus
agccttcaccgatacaagaccatgt

SEQ ID NO: 175549 - DNA, 25 bp, Mus musculus
agccttcacggacgtgctacagaac

SEQ ID NO: 175550 - DNA, 25 bp, Mus musculus
agccttcacggaggtgctacagaac

SEQ ID NO: 175551 - DNA, 25 bp, Mus musculus
agccttcagcaaatacggactccag

SEQ ID NO: 175552 - DNA, 25 bp, Mus musculus
agccttcagcaattacggactccag

SEQ ID NO: 175553 - DNA, 25 bp, Mus musculus
agccttcagtctaccatctgcaaaa

SEQ ID NO: 175554 - DNA, 25 bp, Mus musculus
agccttcagtcttccatctgcaaaa

SEQ ID NO: 175555 - DNA, 25 bp, Mus musculus
agccttcataatattggagcatctg

SEQ ID NO: 175556 - DNA, 25 bp, Mus musculus
agccttcataattttggagcatctg

SEQ ID NO: 175557 - DNA, 25 bp, Mus musculus
agccttcatagccatgtttctccca

SEQ ID NO: 175558 - DNA, 25 bp, Mus musculus
agccttcatagcgatgtttctccca

SEQ ID NO: 175559 - DNA, 25 bp, Mus musculus
agccttcatcacagggcaaatggga

SEQ ID NO: 175560 - DNA, 25 bp, Mus musculus
agccttcatcactgggcaaatggga

SEQ ID NO: 175561 - DNA, 25 bp, Mus musculus
agccttcatgcccaggcaatggaat

SEQ ID NO: 175562 - DNA, 25 bp, Mus musculus
agccttcatgccgaggcaatggaat

SEQ ID NO: 175563 - DNA, 25 bp, Mus musculus
agccttcatggcagttaagcggatg

SEQ ID NO: 175564 - DNA, 25 bp, Mus musculus
agccttcatggctgttaagcggatg

SEQ ID NO: 175565 - DNA, 25 bp, Mus musculus
agccttccaagcatacaggactgaa

SEQ ID NO: 175566 - DNA, 25 bp, Mus musculus
agccttccaagcttacaggactgaa

SEQ ID NO: 175567 - DNA, 25 bp, Mus musculus
agccttccaggcatacttgctttta

SEQ ID NO: 175568 - DNA, 25 bp, Mus musculus
agccttccaggcttacttgctttta

SEQ ID NO: 175569 - DNA, 25 bp, Mus musculus
agccttcccatgctgtttggaatcc

SEQ ID NO: 175570 - DNA, 25 bp, Mus musculus
agccttcccatggtgtttggaatcc

SEQ ID NO: 175571 - DNA, 25 bp, Mus musculus
agccttcccattcgattgcactttg

SEQ ID NO: 175572 - DNA, 25 bp, Mus musculus
agccttcccattggattgcactttg

SEQ ID NO: 175573 - DNA, 25 bp, Mus musculus
agccttcctaacagcccaggtgagg

SEQ ID NO: 175574 - DNA, 25 bp, Mus musculus
agccttcctaactgcccaggtgagg

SEQ ID NO: 175575 - DNA, 25 bp, Mus musculus
agccttcctactcttaattattttg

SEQ ID NO: 175576 - DNA, 25 bp, Mus musculus
agccttcctactgttaattattttg

SEQ ID NO: 175577 - DNA, 25 bp, Mus musculus
agccttcctccacctgcgaaggtat

SEQ ID NO: 175578 - DNA, 25 bp, Mus musculus
agccttcctccagctgcgaaggtat

SEQ ID NO: 175579 - DNA, 25 bp, Mus musculus
agccttcctcgcagagcgaagggca

SEQ ID NO: 175580 - DNA, 25 bp, Mus musculus
agccttcctcgctgagcgaagggca

SEQ ID NO: 175581 - DNA, 25 bp, Mus musculus
agccttcctcttagtatgcttttgg

SEQ ID NO: 175582 - DNA, 25 bp, Mus musculus
agccttcctctttgtatgcttttgg

SEQ ID NO: 175583 - DNA, 25 bp, Mus musculus
agccttcctgacatgtataatcctg

SEQ ID NO: 175584 - DNA, 25 bp, Mus musculus
agccttcctgacttgtataatcctg

SEQ ID NO: 175585 - DNA, 25 bp, Mus musculus
agccttcctgcaccatgtggtactg

SEQ ID NO: 175586 - DNA, 25 bp, Mus musculus
agccttcctgcagcatgtggtactg

SEQ ID NO: 175587 - DNA, 25 bp, Mus musculus
agccttcctgccagctaaatggtaa

SEQ ID NO: 175588 - DNA, 25 bp, Mus musculus
agccttcctgcctgctaaatggtaa

SEQ ID NO: 175589 - DNA, 25 bp, Mus musculus
agccttccttccaagtgggatgttt

SEQ ID NO: 175590 - DNA, 25 bp, Mus musculus
agccttccttcctagtgggatgttt

SEQ ID NO: 175591 - DNA, 25 bp, Mus musculus
agccttccttgtcggcgtgtacggc

SEQ ID NO: 175592 - DNA, 25 bp, Mus musculus
agccttccttgtgggcgtgtacggc

SEQ ID NO: 175593 - DNA, 25 bp, Mus musculus
agccttcgagcacaggaagcttcct

SEQ ID NO: 175594 - DNA, 25 bp, Mus musculus
agccttcgagcagaggaagcttcct

SEQ ID NO: 175595 - DNA, 25 bp, Mus musculus
agccttcgcctacacaccaggaccc

SEQ ID NO: 175596 - DNA, 25 bp, Mus musculus
agccttcgcctagacaccaggaccc

SEQ ID NO: 175597 - DNA, 25 bp, Mus musculus
agccttcgctccagtctgaaactaa

SEQ ID NO: 175598 - DNA, 25 bp, Mus musculus
agccttcgctcctgtctgaaactaa

SEQ ID NO: 175599 - DNA, 25 bp, Mus musculus
agccttcggcttccggcagcagaag

SEQ ID NO: 175600 - DNA, 25 bp, Mus musculus
agccttcggcttgcggcagcagaag

SEQ ID NO: 175601 - DNA, 25 bp, Mus musculus
agccttcgtaagcttggacagcgat

SEQ ID NO: 175602 - DNA, 25 bp, Mus musculus
agccttcgtaaggttggacagcgat

SEQ ID NO: 175603 - DNA, 25 bp, Mus musculus
agccttctacacatcttctagtaac

SEQ ID NO: 175604 - DNA, 25 bp, Mus musculus
agccttctacacttcttctagtaac

SEQ ID NO: 175605 - DNA, 25 bp, Mus musculus
agccttctagcacgcaaggacccgg

SEQ ID NO: 175606 - DNA, 25 bp, Mus musculus
agccttctagcaggcaaggacccgg

SEQ ID NO: 175607 - DNA, 25 bp, Mus musculus
agccttctagctataagtgatggag

SEQ ID NO: 175608 - DNA, 25 bp, Mus musculus
agccttctagctctgactccagaag

SEQ ID NO: 175609 - DNA, 25 bp, Mus musculus
agccttctagctgtgactccagaag

SEQ ID NO: 175610 - DNA, 25 bp, Mus musculus
agccttctagctttaagtgatggag

SEQ ID NO: 175611 - DNA, 25 bp, Mus musculus
agccttctatatcttacaccgtcgc

SEQ ID NO: 175612 - DNA, 25 bp, Mus musculus
agccttctatatgttacaccgtcgc

SEQ ID NO: 175613 - DNA, 25 bp, Mus musculus
agccttctccccattgtagggtcag

SEQ ID NO: 175614 - DNA, 25 bp, Mus musculus
agccttctcccctttgtagggtcag

SEQ ID NO: 175615 - DNA, 25 bp, Mus musculus
agccttctccttagctaatctgaat

SEQ ID NO: 175616 - DNA, 25 bp, Mus musculus
agccttctcctttgctaatctgaat

SEQ ID NO: 175617 - DNA, 25 bp, Mus musculus
agccttctctctacctcaggaaaat

SEQ ID NO: 175618 - DNA, 25 bp, Mus musculus
agccttctctcttcctcaggaaaat

SEQ ID NO: 175619 - DNA, 25 bp, Mus musculus
agccttctctgaactgctcttacaa

SEQ ID NO: 175620 - DNA, 25 bp, Mus musculus
agccttctctgatctgctcttacaa

SEQ ID NO: 175621 - DNA, 25 bp, Mus musculus
agccttctctgtactgacaatccat

SEQ ID NO: 175622 - DNA, 25 bp, Mus musculus
agccttctctgttctgacaatccat

SEQ ID NO: 175623 - DNA, 25 bp, Mus musculus
agccttctcttcaggattccttgta

SEQ ID NO: 175624 - DNA, 25 bp, Mus musculus
agccttctcttctggattccttgta

SEQ ID NO: 175625 - DNA, 25 bp, Mus musculus
agccttctctttattcttctaccat

SEQ ID NO: 175626 - DNA, 25 bp, Mus musculus
agccttctcttttttcttctaccat

SEQ ID NO: 175627 - DNA, 25 bp, Mus musculus
agccttctgacccttcgataagata

SEQ ID NO: 175628 - DNA, 25 bp, Mus musculus
agccttctgaccgttcgataagata

SEQ ID NO: 175629 - DNA, 25 bp, Mus musculus
agccttctgacgctgtggattttta

SEQ ID NO: 175630 - DNA, 25 bp, Mus musculus
agccttctgacggtgtggattttta

SEQ ID NO: 175631 - DNA, 25 bp, Mus musculus
agccttctgagtagctgttgctgca

SEQ ID NO: 175632 - DNA, 25 bp, Mus musculus
agccttctgagttgctgttgctgca

SEQ ID NO: 175633 - DNA, 25 bp, Mus musculus
agccttctgcaactatgatggtggg

SEQ ID NO: 175634 - DNA, 25 bp, Mus musculus
agccttctgcaagtatgatggtggg

SEQ ID NO: 175635 - DNA, 25 bp, Mus musculus
agccttctgcatagcacacgtgaac

SEQ ID NO: 175636 - DNA, 25 bp, Mus musculus
agccttctgcattgcacacgtgaac

SEQ ID NO: 175637 - DNA, 25 bp, Mus musculus
agccttctgccacctttgaagacct

SEQ ID NO: 175638 - DNA, 25 bp, Mus musculus
agccttctgccagctttgaagacct

SEQ ID NO: 175639 - DNA, 25 bp, Mus musculus
agccttctgcttcgagacagttact

SEQ ID NO: 175640 - DNA, 25 bp, Mus musculus
agccttctgcttggagacagttact

SEQ ID NO: 175641 - DNA, 25 bp, Mus musculus
agccttctggtgctgcatgcctgta

SEQ ID NO: 175642 - DNA, 25 bp, Mus musculus
agccttctggtggtgcatgcctgta

SEQ ID NO: 175643 - DNA, 25 bp, Mus musculus
agccttctgtccatagctcaggaga

SEQ ID NO: 175644 - DNA, 25 bp, Mus musculus
agccttctgtccttagctcaggaga

SEQ ID NO: 175645 - DNA, 25 bp, Mus musculus
agccttctgtctcacggtggctgga

SEQ ID NO: 175646 - DNA, 25 bp, Mus musculus
agccttctgtctgacggtggctgga

SEQ ID NO: 175647 - DNA, 25 bp, Mus musculus
agccttctgtgactaactcctaact

SEQ ID NO: 175648 - DNA, 25 bp, Mus musculus
agccttctgtgagtaactcctaact

SEQ ID NO: 175649 - DNA, 25 bp, Mus musculus
agccttcttcacatgcctctctgtg

SEQ ID NO: 175650 - DNA, 25 bp, Mus musculus
agccttcttcacttgcctctctgtg

SEQ ID NO: 175651 - DNA, 25 bp, Mus musculus
agccttgaacacataccctagtcag

SEQ ID NO: 175652 - DNA, 25 bp, Mus musculus
agccttgaacacttaccctagtcag

SEQ ID NO: 175653 - DNA, 25 bp, Mus musculus
agccttgaactaaaatcactgccaa

SEQ ID NO: 175654 - DNA, 25 bp, Mus musculus
agccttgaactataatcactgccaa

SEQ ID NO: 175655 - DNA, 25 bp, Mus musculus
agccttgaactcaggatagccttga

SEQ ID NO: 175656 - DNA, 25 bp, Mus musculus
agccttgaactctggatagccttga

SEQ ID NO: 175657 - DNA, 25 bp, Mus musculus
agccttgacactcctggtacaaatg

SEQ ID NO: 175658 - DNA, 25 bp, Mus musculus
agccttgacactgctggtacaaatg

SEQ ID NO: 175659 - DNA, 25 bp, Mus musculus
agccttgacattacttctaccttat

SEQ ID NO: 175660 - DNA, 25 bp, Mus musculus
agccttgacatttcttctaccttat

SEQ ID NO: 175661 - DNA, 25 bp, Mus musculus
agccttgactatccatgctgctttc

SEQ ID NO: 175662 - DNA, 25 bp, Mus musculus
agccttgactatgcatgctgctttc

SEQ ID NO: 175663 - DNA, 25 bp, Mus musculus
agccttgactgaacgctgagtccta

SEQ ID NO: 175664 - DNA, 25 bp, Mus musculus
agccttgactgatcgctgagtccta

SEQ ID NO: 175665 - DNA, 25 bp, Mus musculus
agccttgagtgtcgtttttctccta

SEQ ID NO: 175666 - DNA, 25 bp, Mus musculus
agccttgagtgtggtttttctccta

SEQ ID NO: 175667 - DNA, 25 bp, Mus musculus
agccttgatcacagatgacctcaca

SEQ ID NO: 175668 - DNA, 25 bp, Mus musculus
agccttgatcactgatgacctcaca

SEQ ID NO: 175669 - DNA, 25 bp, Mus musculus
agccttgatgagctcatacagtctc

SEQ ID NO: 175670 - DNA, 25 bp, Mus musculus
agccttgatgaggtcatacagtctc

SEQ ID NO: 175671 - DNA, 25 bp, Mus musculus
agccttgatgttatgtgtttcccag

SEQ ID NO: 175672 - DNA, 25 bp, Mus musculus
agccttgatgttttgtgtttcccag

SEQ ID NO: 175673 - DNA, 25 bp, Mus musculus
agccttgattcaaacctttctttgt

SEQ ID NO: 175674 - DNA, 25 bp, Mus musculus
agccttgattcatacctttctttgt

SEQ ID NO: 175675 - DNA, 25 bp, Mus musculus
agccttgattttcactaggtttcca

SEQ ID NO: 175676 - DNA, 25 bp, Mus musculus
agccttgattttgactaggtttcca

SEQ ID NO: 175677 - DNA, 25 bp, Mus musculus
agccttgcacatcctgatcatcagt

SEQ ID NO: 175678 - DNA, 25 bp, Mus musculus
agccttgcacatgctgatcatcagt

SEQ ID NO: 175679 - DNA, 25 bp, Mus musculus
agccttgcagcgacaacaaccagat

SEQ ID NO: 175680 - DNA, 25 bp, Mus musculus
agccttgcagcgtcaacaaccagat

SEQ ID NO: 175681 - DNA, 25 bp, Mus musculus
agccttgcatgacagttgtcctaga

SEQ ID NO: 175682 - DNA, 25 bp, Mus musculus
agccttgcatgagagttgtcctaga

SEQ ID NO: 175683 - DNA, 25 bp, Mus musculus
agccttgcattgacaccctaagcga

SEQ ID NO: 175684 - DNA, 25 bp, Mus musculus
agccttgcattgtcaccctaagcga

SEQ ID NO: 175685 - DNA, 25 bp, Mus musculus
agccttgccagcctgcggctcaagt

SEQ ID NO: 175686 - DNA, 25 bp, Mus musculus
agccttgccagcgtgcggctcaagt

SEQ ID NO: 175687 - DNA, 25 bp, Mus musculus
agccttgccctcactaggtaaggag

SEQ ID NO: 175688 - DNA, 25 bp, Mus musculus
agccttgccctctctaggtaaggag

SEQ ID NO: 175689 - DNA, 25 bp, Mus musculus
agccttgcctaaccctggcgtcttt

SEQ ID NO: 175690 - DNA, 25 bp, Mus musculus
agccttgcctaagcctggcgtcttt

SEQ ID NO: 175691 - DNA, 25 bp, Mus musculus
agccttgcctttcggattgctgaac

SEQ ID NO: 175692 - DNA, 25 bp, Mus musculus
agccttgcctttctaatttgacttc

SEQ ID NO: 175693 - DNA, 25 bp, Mus musculus
agccttgcctttctagtgcacggag

SEQ ID NO: 175694 - DNA, 25 bp, Mus musculus
agccttgcctttgggattgctgaac

SEQ ID NO: 175695 - DNA, 25 bp, Mus musculus
agccttgcctttgtaatttgacttc

SEQ ID NO: 175696 - DNA, 25 bp, Mus musculus
agccttgcctttgtagtgcacggag

SEQ ID NO: 175697 - DNA, 25 bp, Mus musculus
agccttgcgtgtatgcagctccaga

SEQ ID NO: 175698 - DNA, 25 bp, Mus musculus
agccttgcgtgtttgcagctccaga

SEQ ID NO: 175699 - DNA, 25 bp, Mus musculus
agccttgctagcatttggacatgaa

SEQ ID NO: 175700 - DNA, 25 bp, Mus musculus
agccttgctagcttttggacatgaa

SEQ ID NO: 175701 - DNA, 25 bp, Mus musculus
agccttgctcgcagcagcagaagaa

SEQ ID NO: 175702 - DNA, 25 bp, Mus musculus
agccttgctcgctgcagcagaagaa

SEQ ID NO: 175703 - DNA, 25 bp, Mus musculus
agccttgctctcagaagtggtccaa

SEQ ID NO: 175704 - DNA, 25 bp, Mus musculus
agccttgctctctgaagtggtccaa

SEQ ID NO: 175705 - DNA, 25 bp, Mus musculus
agccttgctgaaagtttctcttggt

SEQ ID NO: 175706 - DNA, 25 bp, Mus musculus
agccttgctgaatgtttctcttggt

SEQ ID NO: 175707 - DNA, 25 bp, Mus musculus
agccttgctgtcaaaccacctgctg

SEQ ID NO: 175708 - DNA, 25 bp, Mus musculus
agccttgctgtctaaccacctgctg

SEQ ID NO: 175709 - DNA, 25 bp, Mus musculus
agccttgcttatccccgagttaatt

SEQ ID NO: 175710 - DNA, 25 bp, Mus musculus
agccttgcttatgcccgagttaatt

SEQ ID NO: 175711 - DNA, 25 bp, Mus musculus
agccttggaccactgttggagctga

SEQ ID NO: 175712 - DNA, 25 bp, Mus musculus
agccttggaccagtgttggagctga

SEQ ID NO: 175713 - DNA, 25 bp, Mus musculus
agccttggagacaacaattacaata

SEQ ID NO: 175714 - DNA, 25 bp, Mus musculus
agccttggagactacaattacaata

SEQ ID NO: 175715 - DNA, 25 bp, Mus musculus
agccttggagtgcactctgggaaac

SEQ ID NO: 175716 - DNA, 25 bp, Mus musculus
agccttggagtggactctgggaaac

SEQ ID NO: 175717 - DNA, 25 bp, Mus musculus
agccttggagttcaccctgaagaaa

SEQ ID NO: 175718 - DNA, 25 bp, Mus musculus
agccttggagttcgtgacatacctt

SEQ ID NO: 175719 - DNA, 25 bp, Mus musculus
agccttggagttgaccctgaagaaa

SEQ ID NO: 175720 - DNA, 25 bp, Mus musculus
agccttggagttggtgacatacctt

SEQ ID NO: 175721 - DNA, 25 bp, Mus musculus
agccttggatgtctgccctactgaa

SEQ ID NO: 175722 - DNA, 25 bp, Mus musculus
agccttggatgtgtgccctactgaa

SEQ ID NO: 175723 - DNA, 25 bp, Mus musculus
agccttggcattagatggccactag

SEQ ID NO: 175724 - DNA, 25 bp, Mus musculus
agccttggcatttgatggccactag

SEQ ID NO: 175725 - DNA, 25 bp, Mus musculus
agccttggccttcaggtggatgcca

SEQ ID NO: 175726 - DNA, 25 bp, Mus musculus
agccttggccttgaggtggatgcca

SEQ ID NO: 175727 - DNA, 25 bp, Mus musculus
agccttggcggcaactgctcggagc

SEQ ID NO: 175728 - DNA, 25 bp, Mus musculus
agccttggcggctactgctcggagc

SEQ ID NO: 175729 - DNA, 25 bp, Mus musculus
agccttggctgacaagtaccactaa

SEQ ID NO: 175730 - DNA, 25 bp, Mus musculus
agccttggctgacatggactcgcta

SEQ ID NO: 175731 - DNA, 25 bp, Mus musculus
agccttggctgagaagtaccactaa

SEQ ID NO: 175732 - DNA, 25 bp, Mus musculus
agccttggctgagatggactcgcta

SEQ ID NO: 175733 - DNA, 25 bp, Mus musculus
agccttggctgcactaatggtcagt

SEQ ID NO: 175734 - DNA, 25 bp, Mus musculus
agccttggctgctctaatggtcagt

SEQ ID NO: 175735 - DNA, 25 bp, Mus musculus
agccttggcttaaagactctctgca

SEQ ID NO: 175736 - DNA, 25 bp, Mus musculus
agccttggcttatagactctctgca

SEQ ID NO: 175737 - DNA, 25 bp, Mus musculus
agccttggcttcactagttggttac

SEQ ID NO: 175738 - DNA, 25 bp, Mus musculus
agccttggcttctctagttggttac

SEQ ID NO: 175739 - DNA, 25 bp, Mus musculus
agccttgggaaaccaccgtgggtat

SEQ ID NO: 175740 - DNA, 25 bp, Mus musculus
agccttgggaaagcaccgtgggtat

SEQ ID NO: 175741 - DNA, 25 bp, Mus musculus
agccttgggattagatttgacttaa

SEQ ID NO: 175742 - DNA, 25 bp, Mus musculus
agccttgggatttgatttgacttaa

SEQ ID NO: 175743 - DNA, 25 bp, Mus musculus
agccttgggcacaacttcaaccaag

SEQ ID NO: 175744 - DNA, 25 bp, Mus musculus
agccttgggcactacttcaaccaag

SEQ ID NO: 175745 - DNA, 25 bp, Mus musculus
agccttgggcatacttgtatctcct

SEQ ID NO: 175746 - DNA, 25 bp, Mus musculus
agccttgggcatagatgctgggacc

SEQ ID NO: 175747 - DNA, 25 bp, Mus musculus
agccttgggcattcttgtatctcct

SEQ ID NO: 175748 - DNA, 25 bp, Mus musculus
agccttgggcattgatgctgggacc

SEQ ID NO: 175749 - DNA, 25 bp, Mus musculus
agccttgggtccagtgtgtcttcca

SEQ ID NO: 175750 - DNA, 25 bp, Mus musculus
agccttgggtcctgtgtgtcttcca

SEQ ID NO: 175751 - DNA, 25 bp, Mus musculus
agccttgggtttcatctgagcagaa

SEQ ID NO: 175752 - DNA, 25 bp, Mus musculus
agccttgggtttgatctgagcagaa

SEQ ID NO: 175753 - DNA, 25 bp, Mus musculus
agccttggtactccgaggtctacaa

SEQ ID NO: 175754 - DNA, 25 bp, Mus musculus
agccttggtactgcgaggtctacaa

SEQ ID NO: 175755 - DNA, 25 bp, Mus musculus
agccttggtccgactggattacaga

SEQ ID NO: 175756 - DNA, 25 bp, Mus musculus
agccttggtccgtctggattacaga

SEQ ID NO: 175757 - DNA, 25 bp, Mus musculus
agccttggtgctaagatctgtgtca

SEQ ID NO: 175758 - DNA, 25 bp, Mus musculus
agccttggtgcttagatctgtgtca

SEQ ID NO: 175759 - DNA, 25 bp, Mus musculus
agccttggtggcaagtcactaggaa

SEQ ID NO: 175760 - DNA, 25 bp, Mus musculus
agccttggtggctagtcactaggaa

SEQ ID NO: 175761 - DNA, 25 bp, Mus musculus
agccttgtccagatgggtgggccta

SEQ ID NO: 175762 - DNA, 25 bp, Mus musculus
agccttgtccagttgggtgggccta

SEQ ID NO: 175763 - DNA, 25 bp, Mus musculus
agccttgtccggcattcatgtagac

SEQ ID NO: 175764 - DNA, 25 bp, Mus musculus
agccttgtccgggattcatgtagac

SEQ ID NO: 175765 - DNA, 25 bp, Mus musculus
agccttgtctacagactggtttcaa

SEQ ID NO: 175766 - DNA, 25 bp, Mus musculus
agccttgtctactgactggtttcaa

SEQ ID NO: 175767 - DNA, 25 bp, Mus musculus
agccttgtcttaacgcctgtcctgt

SEQ ID NO: 175768 - DNA, 25 bp, Mus musculus
agccttgtcttatcgcctgtcctgt

SEQ ID NO: 175769 - DNA, 25 bp, Mus musculus
agccttgtgactcgattaaaatttc

SEQ ID NO: 175770 - DNA, 25 bp, Mus musculus
agccttgtgactggattaaaatttc

SEQ ID NO: 175771 - DNA, 25 bp, Mus musculus
agccttgtgcgccactgtgacatca

SEQ ID NO: 175772 - DNA, 25 bp, Mus musculus
agccttgtgcgcgactgtgacatca

SEQ ID NO: 175773 - DNA, 25 bp, Mus musculus
agccttgtggctaagaatcctctgc

SEQ ID NO: 175774 - DNA, 25 bp, Mus musculus
agccttgtggcttagaatcctctgc

SEQ ID NO: 175775 - DNA, 25 bp, Mus musculus
agccttgttcatagttctttcatcc

SEQ ID NO: 175776 - DNA, 25 bp, Mus musculus
agccttgttcattgttctttcatcc

SEQ ID NO: 175777 - DNA, 25 bp, Mus musculus
agccttgttctcatagttctgagtc

SEQ ID NO: 175778 - DNA, 25 bp, Mus musculus
agccttgttctcttagttctgagtc

SEQ ID NO: 175779 - DNA, 25 bp, Mus musculus
agccttgtttggcaaacctatgact

SEQ ID NO: 175780 - DNA, 25 bp, Mus musculus
agccttgtttgggaaacctatgact

SEQ ID NO: 175781 - DNA, 25 bp, Mus musculus
agcctttaccctacatcagagaatc

SEQ ID NO: 175782 - DNA, 25 bp, Mus musculus
agcctttacccttcatcagagaatc

SEQ ID NO: 175783 - DNA, 25 bp, Mus musculus
agcctttactgaagcgtcttggtgc

SEQ ID NO: 175784 - DNA, 25 bp, Mus musculus
agcctttactgatgcgtcttggtgc

SEQ ID NO: 175785 - DNA, 25 bp, Mus musculus
agcctttatagccaagtagccccag

SEQ ID NO: 175786 - DNA, 25 bp, Mus musculus
agcctttatagcgaagtagccccag

SEQ ID NO: 175787 - DNA, 25 bp, Mus musculus
agcctttatcttagcatacatgttc

SEQ ID NO: 175788 - DNA, 25 bp, Mus musculus
agcctttatctttgcatacatgttc

SEQ ID NO: 175789 - DNA, 25 bp, Mus musculus
agcctttattacattattcactcat

SEQ ID NO: 175790 - DNA, 25 bp, Mus musculus
agcctttattactttattcactcat

SEQ ID NO: 175791 - DNA, 25 bp, Mus musculus
agcctttatttcatgcctatttctc

SEQ ID NO: 175792 - DNA, 25 bp, Mus musculus
agcctttatttcttgcctatttctc

SEQ ID NO: 175793 - DNA, 25 bp, Mus musculus
agcctttcaataatgttcctctaat

SEQ ID NO: 175794 - DNA, 25 bp, Mus musculus
agcctttcaatattgttcctctaat

SEQ ID NO: 175795 - DNA, 25 bp, Mus musculus
agcctttcagcccatagactgtatt

SEQ ID NO: 175796 - DNA, 25 bp, Mus musculus
agcctttcagccgatagactgtatt

SEQ ID NO: 175797 - DNA, 25 bp, Mus musculus
agcctttcaggcatatcatatctgt

SEQ ID NO: 175798 - DNA, 25 bp, Mus musculus
agcctttcaggcttatcatatctgt

SEQ ID NO: 175799 - DNA, 25 bp, Mus musculus
agcctttcattaatgcccagatgtt

SEQ ID NO: 175800 - DNA, 25 bp, Mus musculus
agcctttcattattgcccagatgtt

SEQ ID NO: 175801 - DNA, 25 bp, Mus musculus
agcctttcattgctcaggttgctgc

SEQ ID NO: 175802 - DNA, 25 bp, Mus musculus
agcctttcattggtcaggttgctgc

SEQ ID NO: 175803 - DNA, 25 bp, Mus musculus
agcctttccagaactctacccagga

SEQ ID NO: 175804 - DNA, 25 bp, Mus musculus
agcctttccagatctctacccagga

SEQ ID NO: 175805 - DNA, 25 bp, Mus musculus
agcctttccagcaggttttagtgcc

SEQ ID NO: 175806 - DNA, 25 bp, Mus musculus
agcctttccagctggttttagtgcc

SEQ ID NO: 175807 - DNA, 25 bp, Mus musculus
agcctttccataattttgatgagag

SEQ ID NO: 175808 - DNA, 25 bp, Mus musculus
agcctttccatatttttgatgagag

SEQ ID NO: 175809 - DNA, 25 bp, Mus musculus
agcctttccatgatcatcctgaaaa

SEQ ID NO: 175810 - DNA, 25 bp, Mus musculus
agcctttccatgttcatcctgaaaa

SEQ ID NO: 175811 - DNA, 25 bp, Mus musculus
agcctttcgtacagatagcctattg

SEQ ID NO: 175812 - DNA, 25 bp, Mus musculus
agcctttcgtactgatagcctattg

SEQ ID NO: 175813 - DNA, 25 bp, Mus musculus
agcctttctcccacattagggttag

SEQ ID NO: 175814 - DNA, 25 bp, Mus musculus
agcctttctccctcattagggttag

SEQ ID NO: 175815 - DNA, 25 bp, Mus musculus
agcctttcttctcagacttaccgta

SEQ ID NO: 175816 - DNA, 25 bp, Mus musculus
agcctttcttctgagacttaccgta

SEQ ID NO: 175817 - DNA, 25 bp, Mus musculus
agcctttcttgtacacttcgccata

SEQ ID NO: 175818 - DNA, 25 bp, Mus musculus
agcctttcttgttcacttcgccata

SEQ ID NO: 175819 - DNA, 25 bp, Mus musculus
agcctttctttcaggacataatgaa

SEQ ID NO: 175820 - DNA, 25 bp, Mus musculus
agcctttctttctggacataatgaa

SEQ ID NO: 175821 - DNA, 25 bp, Mus musculus
agcctttgaaagctcccgctgggag

SEQ ID NO: 175822 - DNA, 25 bp, Mus musculus
agcctttgaaaggtcccgctgggag

SEQ ID NO: 175823 - DNA, 25 bp, Mus musculus
agcctttgaagccagctctttggag

SEQ ID NO: 175824 - DNA, 25 bp, Mus musculus
agcctttgaagcgagctctttggag

SEQ ID NO: 175825 - DNA, 25 bp, Mus musculus
agcctttgacttacttggacatctg

SEQ ID NO: 175826 - DNA, 25 bp, Mus musculus
agcctttgactttcttggacatctg

SEQ ID NO: 175827 - DNA, 25 bp, Mus musculus
agcctttgagagctgaggtcacccc

SEQ ID NO: 175828 - DNA, 25 bp, Mus musculus
agcctttgagaggtgaggtcacccc

SEQ ID NO: 175829 - DNA, 25 bp, Mus musculus
agcctttgagcaaggtacgtgctta

SEQ ID NO: 175830 - DNA, 25 bp, Mus musculus
agcctttgagcatggtacgtgctta

SEQ ID NO: 175831 - DNA, 25 bp, Mus musculus
agcctttgaggtagatagctgatca

SEQ ID NO: 175832 - DNA, 25 bp, Mus musculus
agcctttgaggttgatagctgatca

SEQ ID NO: 175833 - DNA, 25 bp, Mus musculus
agcctttgcaatattggcctatttt

SEQ ID NO: 175834 - DNA, 25 bp, Mus musculus
agcctttgcaattttggcctatttt

SEQ ID NO: 175835 - DNA, 25 bp, Mus musculus
agcctttgccaaagccttgtccaag

SEQ ID NO: 175836 - DNA, 25 bp, Mus musculus
agcctttgccaatgccttgtccaag

SEQ ID NO: 175837 - DNA, 25 bp, Mus musculus
agcctttgccctactatctagatat

SEQ ID NO: 175838 - DNA, 25 bp, Mus musculus
agcctttgcccttctatctagatat

SEQ ID NO: 175839 - DNA, 25 bp, Mus musculus
agcctttgctgcagagattcctaag

SEQ ID NO: 175840 - DNA, 25 bp, Mus musculus
agcctttgctgcagcttttctacta

SEQ ID NO: 175841 - DNA, 25 bp, Mus musculus
agcctttgctgctgagattcctaag

SEQ ID NO: 175842 - DNA, 25 bp, Mus musculus
agcctttgctgctgcttttctacta

SEQ ID NO: 175843 - DNA, 25 bp, Mus musculus
agcctttgcttcaaatgtgtacatc

SEQ ID NO: 175844 - DNA, 25 bp, Mus musculus
agcctttgcttcaatggagtcccag

SEQ ID NO: 175845 - DNA, 25 bp, Mus musculus
agcctttgcttctaatgtgtacatc

SEQ ID NO: 175846 - DNA, 25 bp, Mus musculus
agcctttgcttctatggagtcccag

SEQ ID NO: 175847 - DNA, 25 bp, Mus musculus
agcctttgctttaactcgtttcaat

SEQ ID NO: 175848 - DNA, 25 bp, Mus musculus
agcctttgcttttactcgtttcaat

SEQ ID NO: 175849 - DNA, 25 bp, Mus musculus
agcctttggatgatttcatactctt

SEQ ID NO: 175850 - DNA, 25 bp, Mus musculus
agcctttggatgttttcatactctt

SEQ ID NO: 175851 - DNA, 25 bp, Mus musculus
agcctttggctgaagtcccagtttc

SEQ ID NO: 175852 - DNA, 25 bp, Mus musculus
agcctttggctgtagtcccagtttc

SEQ ID NO: 175853 - DNA, 25 bp, Mus musculus
agcctttgggtaactgggatgacat

SEQ ID NO: 175854 - DNA, 25 bp, Mus musculus
agcctttgggtatctgggatgacat

SEQ ID NO: 175855 - DNA, 25 bp, Mus musculus
agcctttgggtcaccctcagctgag

SEQ ID NO: 175856 - DNA, 25 bp, Mus musculus
agcctttgggtctccctcagctgag

SEQ ID NO: 175857 - DNA, 25 bp, Mus musculus
agcctttggtgactctagtctgggc

SEQ ID NO: 175858 - DNA, 25 bp, Mus musculus
agcctttggtgagtctagtctgggc

SEQ ID NO: 175859 - DNA, 25 bp, Mus musculus
agcctttggtgtctctgttataatg

SEQ ID NO: 175860 - DNA, 25 bp, Mus musculus
agcctttggtgtgtctgttataatg

SEQ ID NO: 175861 - DNA, 25 bp, Mus musculus
agcctttgtcaaaaaaccctctatg

SEQ ID NO: 175862 - DNA, 25 bp, Mus musculus
agcctttgtcaataaaccctctatg

SEQ ID NO: 175863 - DNA, 25 bp, Mus musculus
agcctttgtcacatgaaccacaggt

SEQ ID NO: 175864 - DNA, 25 bp, Mus musculus
agcctttgtcacctttgtccagttc

SEQ ID NO: 175865 - DNA, 25 bp, Mus musculus
agcctttgtcacgtttgtccagttc

SEQ ID NO: 175866 - DNA, 25 bp, Mus musculus
agcctttgtcacttgaaccacaggt

SEQ ID NO: 175867 - DNA, 25 bp, Mus musculus
agcctttgtccccaagttggactgt

SEQ ID NO: 175868 - DNA, 25 bp, Mus musculus
agcctttgtcccgaagttggactgt

SEQ ID NO: 175869 - DNA, 25 bp, Mus musculus
agcctttgtctacgtaaaggaggca

SEQ ID NO: 175870 - DNA, 25 bp, Mus musculus
agcctttgtctaggtaaaggaggca

SEQ ID NO: 175871 - DNA, 25 bp, Mus musculus
agcctttgtggaagctgtacacaaa

SEQ ID NO: 175872 - DNA, 25 bp, Mus musculus
agcctttgtggatgctgtacacaaa

SEQ ID NO: 175873 - DNA, 25 bp, Mus musculus
agcctttgtggtccctgatcaaaat

SEQ ID NO: 175874 - DNA, 25 bp, Mus musculus
agcctttgtggtgcctgatcaaaat

SEQ ID NO: 175875 - DNA, 25 bp, Mus musculus
agcctttgttcaagcctttgcaatt

SEQ ID NO: 175876 - DNA, 25 bp, Mus musculus
agcctttgttcatgcctttgcaatt

SEQ ID NO: 175877 - DNA, 25 bp, Mus musculus
agcctttgttccattttaactcaga

SEQ ID NO: 175878 - DNA, 25 bp, Mus musculus
agcctttgttcctttttaactcaga

SEQ ID NO: 175879 - DNA, 25 bp, Mus musculus
agcctttgttttcacaacctatctc

SEQ ID NO: 175880 - DNA, 25 bp, Mus musculus
agcctttgttttgacaacctatctc

SEQ ID NO: 175881 - DNA, 25 bp, Mus musculus
agccttttaccactaatgactccta

SEQ ID NO: 175882 - DNA, 25 bp, Mus musculus
agccttttaccagtaatgactccta

SEQ ID NO: 175883 - DNA, 25 bp, Mus musculus
agccttttactcactttgattccta

SEQ ID NO: 175884 - DNA, 25 bp, Mus musculus
agccttttactctctttgattccta

SEQ ID NO: 175885 - DNA, 25 bp, Mus musculus
agccttttatgcatagctgcttaaa

SEQ ID NO: 175886 - DNA, 25 bp, Mus musculus
agccttttatgcttagctgcttaaa

SEQ ID NO: 175887 - DNA, 25 bp, Mus musculus
agccttttattcctacgccagagat

SEQ ID NO: 175888 - DNA, 25 bp, Mus musculus
agccttttattcgtacgccagagat

SEQ ID NO: 175889 - DNA, 25 bp, Mus musculus
agccttttcacaatagtagcctcta

SEQ ID NO: 175890 - DNA, 25 bp, Mus musculus
agccttttcacattagtagcctcta

SEQ ID NO: 175891 - DNA, 25 bp, Mus musculus
agccttttccgtctggtatgtacag

SEQ ID NO: 175892 - DNA, 25 bp, Mus musculus
agccttttccgtgtggtatgtacag

SEQ ID NO: 175893 - DNA, 25 bp, Mus musculus
agccttttctacaccacagagaaca

SEQ ID NO: 175894 - DNA, 25 bp, Mus musculus
agccttttctactccacagagaaca

SEQ ID NO: 175895 - DNA, 25 bp, Mus musculus
agccttttctgaagcgttttcatcc

SEQ ID NO: 175896 - DNA, 25 bp, Mus musculus
agccttttctgatgcgttttcatcc

SEQ ID NO: 175897 - DNA, 25 bp, Mus musculus
agccttttctggacgctcagttcgg

SEQ ID NO: 175898 - DNA, 25 bp, Mus musculus
agccttttctggattacctacaatg

SEQ ID NO: 175899 - DNA, 25 bp, Mus musculus
agccttttctggtcgctcagttcgg

SEQ ID NO: 175900 - DNA, 25 bp, Mus musculus
agccttttctggtttacctacaatg

SEQ ID NO: 175901 - DNA, 25 bp, Mus musculus
agccttttgaagactctgactctga

SEQ ID NO: 175902 - DNA, 25 bp, Mus musculus
agccttttgaagtctctgactctga

SEQ ID NO: 175903 - DNA, 25 bp, Mus musculus
agccttttgctcagttgcttcgaaa

SEQ ID NO: 175904 - DNA, 25 bp, Mus musculus
agccttttgctctgttgcttcgaaa

SEQ ID NO: 175905 - DNA, 25 bp, Mus musculus
agccttttgtcaagccgaacagttg

SEQ ID NO: 175906 - DNA, 25 bp, Mus musculus
agccttttgtcaatgggcttggata

SEQ ID NO: 175907 - DNA, 25 bp, Mus musculus
agccttttgtcatgccgaacagttg

SEQ ID NO: 175908 - DNA, 25 bp, Mus musculus
agccttttgtcattgggcttggata

SEQ ID NO: 175909 - DNA, 25 bp, Mus musculus
agccttttgtggcatctgggagtca

SEQ ID NO: 175910 - DNA, 25 bp, Mus musculus
agccttttgtgggatctgggagtca

SEQ ID NO: 175911 - DNA, 25 bp, Mus musculus
agcctttttctaaaccagcacagaa

SEQ ID NO: 175912 - DNA, 25 bp, Mus musculus
agcctttttctataccagcacagaa

SEQ ID NO: 175913 - DNA, 25 bp, Mus musculus
agcctttttcttatgatactagaat

SEQ ID NO: 175914 - DNA, 25 bp, Mus musculus
agcctttttcttttgatactagaat

SEQ ID NO: 175915 - DNA, 25 bp, Mus musculus
agcctttttgctctggatcccatca

SEQ ID NO: 175916 - DNA, 25 bp, Mus musculus
agcctttttgctgtggatcccatca

SEQ ID NO: 175917 - DNA, 25 bp, Mus musculus
agccttttttatcggtctcatggcc

SEQ ID NO: 175918 - DNA, 25 bp, Mus musculus
agccttttttatgggtctcatggcc

SEQ ID NO: 175919 - DNA, 25 bp, Mus musculus
agcgaaacctggctgcatctgcagc

SEQ ID NO: 175920 - DNA, 25 bp, Mus musculus
agcgaaacctgggtgcatctgcagc

SEQ ID NO: 175921 - DNA, 25 bp, Mus musculus
agcgaaactgctaatcaccttcact

SEQ ID NO: 175922 - DNA, 25 bp, Mus musculus
agcgaaactgcttatcaccttcact

SEQ ID NO: 175923 - DNA, 25 bp, Mus musculus
agcgaaagagctaactgattccagt

SEQ ID NO: 175924 - DNA, 25 bp, Mus musculus
agcgaaagagcttactgattccagt

SEQ ID NO: 175925 - DNA, 25 bp, Mus musculus
agcgaaagcgagagcagagctgcat

SEQ ID NO: 175926 - DNA, 25 bp, Mus musculus
agcgaaagcgagtgcagagctgcat

SEQ ID NO: 175927 - DNA, 25 bp, Mus musculus
agcgaaagtcagcactaccaccgac

SEQ ID NO: 175928 - DNA, 25 bp, Mus musculus
agcgaaagtcaggactaccaccgac

SEQ ID NO: 175929 - DNA, 25 bp, Mus musculus
agcgaaagtctgacttcgaccgaca

SEQ ID NO: 175930 - DNA, 25 bp, Mus musculus
agcgaaagtctgtcttcgaccgaca

SEQ ID NO: 175931 - DNA, 25 bp, Mus musculus
agcgaaatccagagcagtgctgttt

SEQ ID NO: 175932 - DNA, 25 bp, Mus musculus
agcgaaatccagtgcagtgctgttt

SEQ ID NO: 175933 - DNA, 25 bp, Mus musculus
agcgaaatcctcaacactgtcttaa

SEQ ID NO: 175934 - DNA, 25 bp, Mus musculus
agcgaaatcctctacactgtcttaa

SEQ ID NO: 175935 - DNA, 25 bp, Mus musculus
agcgaaatgagtagttccggcggcc

SEQ ID NO: 175936 - DNA, 25 bp, Mus musculus
agcgaaatgagttgttccggcggcc

SEQ ID NO: 175937 - DNA, 25 bp, Mus musculus
agcgaacagttacatcccagcaatc

SEQ ID NO: 175938 - DNA, 25 bp, Mus musculus
agcgaacagttagatcccagcaatc

SEQ ID NO: 175939 - DNA, 25 bp, Mus musculus
agcgaagaacttcaagcctttcctg

SEQ ID NO: 175940 - DNA, 25 bp, Mus musculus
agcgaagaacttgaagcctttcctg

SEQ ID NO: 175941 - DNA, 25 bp, Mus musculus
agcgaagaccttcgtcacatgccaa

SEQ ID NO: 175942 - DNA, 25 bp, Mus musculus
agcgaagaccttggtcacatgccaa

SEQ ID NO: 175943 - DNA, 25 bp, Mus musculus
agcgaagagcttacaaggcatcctt

SEQ ID NO: 175944 - DNA, 25 bp, Mus musculus
agcgaagagctttcaaggcatcctt

SEQ ID NO: 175945 - DNA, 25 bp, Mus musculus
agcgaagagtcaccccagacaggag

SEQ ID NO: 175946 - DNA, 25 bp, Mus musculus
agcgaagagtcagcccagacaggag

SEQ ID NO: 175947 - DNA, 25 bp, Mus musculus
agcgaagatacaatccaacttttaa

SEQ ID NO: 175948 - DNA, 25 bp, Mus musculus
agcgaagatacattccaacttttaa

SEQ ID NO: 175949 - DNA, 25 bp, Mus musculus
agcgaagcaccaactgatgacaaaa

SEQ ID NO: 175950 - DNA, 25 bp, Mus musculus
agcgaagcaccatctgatgacaaaa

SEQ ID NO: 175951 - DNA, 25 bp, Mus musculus
agcgaagcccctctttatctgagag

SEQ ID NO: 175952 - DNA, 25 bp, Mus musculus
agcgaagcccctgtttatctgagag

SEQ ID NO: 175953 - DNA, 25 bp, Mus musculus
agcgaagctcgcacaggcctggaat

SEQ ID NO: 175954 - DNA, 25 bp, Mus musculus
agcgaagctcgctcaggcctggaat

SEQ ID NO: 175955 - DNA, 25 bp, Mus musculus
agcgaagctcggcatgtcccagatt

SEQ ID NO: 175956 - DNA, 25 bp, Mus musculus
agcgaagctcgggatgtcccagatt

SEQ ID NO: 175957 - DNA, 25 bp, Mus musculus
agcgaagggcatcacctcaggctcc

SEQ ID NO: 175958 - DNA, 25 bp, Mus musculus
agcgaagggcatgacctcaggctcc

SEQ ID NO: 175959 - DNA, 25 bp, Mus musculus
agcgaaggtcccactctggaggcag

SEQ ID NO: 175960 - DNA, 25 bp, Mus musculus
agcgaaggtccctctctggaggcag

SEQ ID NO: 175961 - DNA, 25 bp, Mus musculus
agcgaagtgccacggtccgttatca

SEQ ID NO: 175962 - DNA, 25 bp, Mus musculus
agcgaagtgccagggtccgttatca

SEQ ID NO: 175963 - DNA, 25 bp, Mus musculus
agcgaagttcctccttggtaaccta

SEQ ID NO: 175964 - DNA, 25 bp, Mus musculus
agcgaagttcctgcttggtaaccta

SEQ ID NO: 175965 - DNA, 25 bp, Mus musculus
agcgaataaagtatccagcttctat

SEQ ID NO: 175966 - DNA, 25 bp, Mus musculus
agcgaataaagtttccagcttctat

SEQ ID NO: 175967 - DNA, 25 bp, Mus musculus
agcgaatacgcacaggaccaggcca

SEQ ID NO: 175968 - DNA, 25 bp, Mus musculus
agcgaatacgcagaggaccaggcca

SEQ ID NO: 175969 - DNA, 25 bp, Mus musculus
agcgaatcccagaccagcttggcta

SEQ ID NO: 175970 - DNA, 25 bp, Mus musculus
agcgaatcccagtccagcttggcta

SEQ ID NO: 175971 - DNA, 25 bp, Mus musculus
agcgaatctcacctatctccatctt

SEQ ID NO: 175972 - DNA, 25 bp, Mus musculus
agcgaatctcacgtatctccatctt

SEQ ID NO: 175973 - DNA, 25 bp, Mus musculus
agcgacaaaccccaagacttcatgg

SEQ ID NO: 175974 - DNA, 25 bp, Mus musculus
agcgacaaacccgaagacttcatgg

SEQ ID NO: 175975 - DNA, 25 bp, Mus musculus
agcgacaaacttacatccaggcctg

SEQ ID NO: 175976 - DNA, 25 bp, Mus musculus
agcgacaaactttcatccaggcctg

SEQ ID NO: 175977 - DNA, 25 bp, Mus musculus
agcgacacacggactgccctgagct

SEQ ID NO: 175978 - DNA, 25 bp, Mus musculus
agcgacacacggtctgccctgagct

SEQ ID NO: 175979 - DNA, 25 bp, Mus musculus
agcgacacataaattccgttcacac

SEQ ID NO: 175980 - DNA, 25 bp, Mus musculus
agcgacacataatttccgttcacac

SEQ ID NO: 175981 - DNA, 25 bp, Mus musculus
agcgacacgctcacgggtggagaaa

SEQ ID NO: 175982 - DNA, 25 bp, Mus musculus
agcgacacgctctcgggtggagaaa

SEQ ID NO: 175983 - DNA, 25 bp, Mus musculus
agcgacactcggacttgcagcggaa

SEQ ID NO: 175984 - DNA, 25 bp, Mus musculus
agcgacactcggtcttgcagcggaa

SEQ ID NO: 175985 - DNA, 25 bp, Mus musculus
agcgacagcggtcactcagctaaca

SEQ ID NO: 175986 - DNA, 25 bp, Mus musculus
agcgacagcggtgactcagctaaca

SEQ ID NO: 175987 - DNA, 25 bp, Mus musculus
agcgacagggtaattcttccatgca

SEQ ID NO: 175988 - DNA, 25 bp, Mus musculus
agcgacagggtatttcttccatgca

SEQ ID NO: 175989 - DNA, 25 bp, Mus musculus
agcgacagtcctcgcaaatctgtct

SEQ ID NO: 175990 - DNA, 25 bp, Mus musculus
agcgacagtcctggcaaatctgtct

SEQ ID NO: 175991 - DNA, 25 bp, Mus musculus
agcgacatcatgctattccccttac

SEQ ID NO: 175992 - DNA, 25 bp, Mus musculus
agcgacatcatggtattccccttac

SEQ ID NO: 175993 - DNA, 25 bp, Mus musculus
agcgacatctccacatttgatgttg

SEQ ID NO: 175994 - DNA, 25 bp, Mus musculus
agcgacatctcctcatttgatgttg

SEQ ID NO: 175995 - DNA, 25 bp, Mus musculus
agcgacatgcaaccaaataccactc

SEQ ID NO: 175996 - DNA, 25 bp, Mus musculus
agcgacatgcaagcaaataccactc

SEQ ID NO: 175997 - DNA, 25 bp, Mus musculus
agcgaccaagatcaagtcaagaccc

SEQ ID NO: 175998 - DNA, 25 bp, Mus musculus
agcgaccaagatgaagtcaagaccc

SEQ ID NO: 175999 - DNA, 25 bp, Mus musculus
agcgaccactgtagagttttcctga

SEQ ID NO: 176000 - DNA, 25 bp, Mus musculus
agcgaccactgttgagttttcctga

SEQ ID NO: 176001 - DNA, 25 bp, Mus musculus
agcgaccagcctatgcttggtatat

SEQ ID NO: 176002 - DNA, 25 bp, Mus musculus
agcgaccagcctttgcttggtatat

SEQ ID NO: 176003 - DNA, 25 bp, Mus musculus
agcgacccattcactatattcaaag

SEQ ID NO: 176004 - DNA, 25 bp, Mus musculus
agcgacccattctctatattcaaag

SEQ ID NO: 176005 - DNA, 25 bp, Mus musculus
agcgaccctttaactgactcattta

SEQ ID NO: 176006 - DNA, 25 bp, Mus musculus
agcgaccctttatctgactcattta

SEQ ID NO: 176007 - DNA, 25 bp, Mus musculus
agcgaccgtgagagttctggcaaca

SEQ ID NO: 176008 - DNA, 25 bp, Mus musculus
agcgaccgtgagtgttctggcaaca

SEQ ID NO: 176009 - DNA, 25 bp, Mus musculus
agcgacctccataatgttacatctg

SEQ ID NO: 176010 - DNA, 25 bp, Mus musculus
agcgacctccattatgttacatctg

SEQ ID NO: 176011 - DNA, 25 bp, Mus musculus
agcgacctcggcagcaagcacttag

SEQ ID NO: 176012 - DNA, 25 bp, Mus musculus
agcgacctcggctgcaagcacttag

SEQ ID NO: 176013 - DNA, 25 bp, Mus musculus
agcgacctgcctcaccgaagcgttg

SEQ ID NO: 176014 - DNA, 25 bp, Mus musculus
agcgacctgcctgaccgaagcgttg

SEQ ID NO: 176015 - DNA, 25 bp, Mus musculus
agcgacctggaacgtgcagaggagc

SEQ ID NO: 176016 - DNA, 25 bp, Mus musculus
agcgacctggaaggtgcagaggagc

SEQ ID NO: 176017 - DNA, 25 bp, Mus musculus
agcgacctgggcatggaacacagtg

SEQ ID NO: 176018 - DNA, 25 bp, Mus musculus
agcgacctgggcttggaacacagtg

SEQ ID NO: 176019 - DNA, 25 bp, Mus musculus
agcgaccttctgagagacattagtt

SEQ ID NO: 176020 - DNA, 25 bp, Mus musculus
agcgaccttctgtgagacattagtt

SEQ ID NO: 176021 - DNA, 25 bp, Mus musculus
agcgaccttgaaaagccagacaccg

SEQ ID NO: 176022 - DNA, 25 bp, Mus musculus
agcgaccttgaatagccagacaccg

SEQ ID NO: 176023 - DNA, 25 bp, Mus musculus
agcgacctttccagaactggatcta

SEQ ID NO: 176024 - DNA, 25 bp, Mus musculus
agcgacctttcctgaactggatcta

SEQ ID NO: 176025 - DNA, 25 bp, Mus musculus
agcgacgacacgcaggttagtccga

SEQ ID NO: 176026 - DNA, 25 bp, Mus musculus
agcgacgacacggaggttagtccga

SEQ ID NO: 176027 - DNA, 25 bp, Mus musculus
agcgacgctagtcaagggcttctgc

SEQ ID NO: 176028 - DNA, 25 bp, Mus musculus
agcgacgctagtgaagggcttctgc

SEQ ID NO: 176029 - DNA, 25 bp, Mus musculus
agcgacggcggacgaaacatgctcc

SEQ ID NO: 176030 - DNA, 25 bp, Mus musculus
agcgacggcggaggaaacatgctcc

SEQ ID NO: 176031 - DNA, 25 bp, Mus musculus
agcgacgggcttatgtgacgccctg

SEQ ID NO: 176032 - DNA, 25 bp, Mus musculus
agcgacgggcttttgtgacgccctg

SEQ ID NO: 176033 - DNA, 25 bp, Mus musculus
agcgacgtccgacgtcttcgtgtgc

SEQ ID NO: 176034 - DNA, 25 bp, Mus musculus
agcgacgtccgaggtcttcgtgtgc

SEQ ID NO: 176035 - DNA, 25 bp, Mus musculus
agcgacgtctcgcacagcgacagtg

SEQ ID NO: 176036 - DNA, 25 bp, Mus musculus
agcgacgtctcggacagcgacagtg

SEQ ID NO: 176037 - DNA, 25 bp, Mus musculus
agcgacgtgcgtcccgacatagagc

SEQ ID NO: 176038 - DNA, 25 bp, Mus musculus
agcgacgtgcgtgccgacatagagc

SEQ ID NO: 176039 - DNA, 25 bp, Mus musculus
agcgactaactgaccaaccgttggg

SEQ ID NO: 176040 - DNA, 25 bp, Mus musculus
agcgactaactgtccaaccgttggg

SEQ ID NO: 176041 - DNA, 25 bp, Mus musculus
agcgactacctgatcgcgctgggta

SEQ ID NO: 176042 - DNA, 25 bp, Mus musculus
agcgactacctgttcgcgctgggta

SEQ ID NO: 176043 - DNA, 25 bp, Mus musculus
agcgactatggaactctgtgggaat

SEQ ID NO: 176044 - DNA, 25 bp, Mus musculus
agcgactatggatctctgtgggaat

SEQ ID NO: 176045 - DNA, 25 bp, Mus musculus
agcgactcacatccagactgacatc

SEQ ID NO: 176046 - DNA, 25 bp, Mus musculus
agcgactcacatgcagactgacatc

SEQ ID NO: 176047 - DNA, 25 bp, Mus musculus
agcgactcacgaccgttttggatct

SEQ ID NO: 176048 - DNA, 25 bp, Mus musculus
agcgactcacgagcgttttggatct

SEQ ID NO: 176049 - DNA, 25 bp, Mus musculus
agcgactccgacacggccctgtgag

SEQ ID NO: 176050 - DNA, 25 bp, Mus musculus
agcgactccgactcggccctgtgag

SEQ ID NO: 176051 - DNA, 25 bp, Mus musculus
agcgactccggtctgcatgcctgtc

SEQ ID NO: 176052 - DNA, 25 bp, Mus musculus
agcgactccggtgtgcatgcctgtc

SEQ ID NO: 176053 - DNA, 25 bp, Mus musculus
agcgactcctacctggaactcagcg

SEQ ID NO: 176054 - DNA, 25 bp, Mus musculus
agcgactcctacgtggaactcagcg

SEQ ID NO: 176055 - DNA, 25 bp, Mus musculus
agcgactcgagcctcggagttaacc

SEQ ID NO: 176056 - DNA, 25 bp, Mus musculus
agcgactcgagcgtcggagttaacc

SEQ ID NO: 176057 - DNA, 25 bp, Mus musculus
agcgactcttctagctcctctagtt

SEQ ID NO: 176058 - DNA, 25 bp, Mus musculus
agcgactcttcttgctcctctagtt

SEQ ID NO: 176059 - DNA, 25 bp, Mus musculus
agcgactgactgaccaggtctggag

SEQ ID NO: 176060 - DNA, 25 bp, Mus musculus
agcgactgactgtccaggtctggag

SEQ ID NO: 176061 - DNA, 25 bp, Mus musculus
agcgactgccgcattgtcagtgact

SEQ ID NO: 176062 - DNA, 25 bp, Mus musculus
agcgactgccgctttgtcagtgact

SEQ ID NO: 176063 - DNA, 25 bp, Mus musculus
agcgactgcggcctgaatctcaaac

SEQ ID NO: 176064 - DNA, 25 bp, Mus musculus
agcgactgcggcgtgaatctcaaac

SEQ ID NO: 176065 - DNA, 25 bp, Mus musculus
agcgactgtgccaacgtctgtgagc

SEQ ID NO: 176066 - DNA, 25 bp, Mus musculus
agcgactgtgccagaatgaccctga

SEQ ID NO: 176067 - DNA, 25 bp, Mus musculus
agcgactgtgcctacgtctgtgagc

SEQ ID NO: 176068 - DNA, 25 bp, Mus musculus
agcgactgtgcctgaatgaccctga

SEQ ID NO: 176069 - DNA, 25 bp, Mus musculus
agcgacttccgaccatgcgtgtgaa

SEQ ID NO: 176070 - DNA, 25 bp, Mus musculus
agcgacttccgagcatgcgtgtgaa

SEQ ID NO: 176071 - DNA, 25 bp, Mus musculus
agcgacttcggcaggatgctgccca

SEQ ID NO: 176072 - DNA, 25 bp, Mus musculus
agcgacttcggctggatgctgccca

SEQ ID NO: 176073 - DNA, 25 bp, Mus musculus
agcgacttgcctactccaacaagga

SEQ ID NO: 176074 - DNA, 25 bp, Mus musculus
agcgacttgccttctccaacaagga

SEQ ID NO: 176075 - DNA, 25 bp, Mus musculus
agcgacttgcgactagactttaaac

SEQ ID NO: 176076 - DNA, 25 bp, Mus musculus
agcgacttgcgagtagactttaaac

SEQ ID NO: 176077 - DNA, 25 bp, Mus musculus
agcgacttgtaacgctgtcacagtt

SEQ ID NO: 176078 - DNA, 25 bp, Mus musculus
agcgacttgtaaggctgtcacagtt

SEQ ID NO: 176079 - DNA, 25 bp, Mus musculus
agcgacttgttactcctcgtgtcct

SEQ ID NO: 176080 - DNA, 25 bp, Mus musculus
agcgacttgttagtcctcgtgtcct

SEQ ID NO: 176081 - DNA, 25 bp, Mus musculus
agcgactttgggatgtcccgcgaag

SEQ ID NO: 176082 - DNA, 25 bp, Mus musculus
agcgactttgggttgtcccgcgaag

SEQ ID NO: 176083 - DNA, 25 bp, Mus musculus
agcgagaaggacacgtggcaccaaa

SEQ ID NO: 176084 - DNA, 25 bp, Mus musculus
agcgagaaggactcgtggcaccaaa

SEQ ID NO: 176085 - DNA, 25 bp, Mus musculus
agcgagaaggctagctgcactccag

SEQ ID NO: 176086 - DNA, 25 bp, Mus musculus
agcgagaaggcttgctgcactccag

SEQ ID NO: 176087 - DNA, 25 bp, Mus musculus
agcgagaagggcatctcaccttttt

SEQ ID NO: 176088 - DNA, 25 bp, Mus musculus
agcgagaagggcttctcaccttttt

SEQ ID NO: 176089 - DNA, 25 bp, Mus musculus
agcgagaccgtcacctgcaacgttg

SEQ ID NO: 176090 - DNA, 25 bp, Mus musculus
agcgagaccgtctcctgcaacgttg

SEQ ID NO: 176091 - DNA, 25 bp, Mus musculus
agcgagactctgactgcccagtgag

SEQ ID NO: 176092 - DNA, 25 bp, Mus musculus
agcgagactctgtctgcccagtgag

SEQ ID NO: 176093 - DNA, 25 bp, Mus musculus
agcgagagatctacagcaacttctg

SEQ ID NO: 176094 - DNA, 25 bp, Mus musculus
agcgagagatcttcagcaacttctg

SEQ ID NO: 176095 - DNA, 25 bp, Mus musculus
agcgagaggtccaggcctctagccc

SEQ ID NO: 176096 - DNA, 25 bp, Mus musculus
agcgagaggtcctggcctctagccc

SEQ ID NO: 176097 - DNA, 25 bp, Mus musculus
agcgagatacctctctgagctgcag

SEQ ID NO: 176098 - DNA, 25 bp, Mus musculus
agcgagatacctgtctgagctgcag

SEQ ID NO: 176099 - DNA, 25 bp, Mus musculus
agcgagatctcccagctcaggcgca

SEQ ID NO: 176100 - DNA, 25 bp, Mus musculus
agcgagatctccgagctcaggcgca

SEQ ID NO: 176101 - DNA, 25 bp, Mus musculus
agcgagatggcaaccctcttttcct

SEQ ID NO: 176102 - DNA, 25 bp, Mus musculus
agcgagatggcatccctcttttcct

SEQ ID NO: 176103 - DNA, 25 bp, Mus musculus
agcgagcagatgagcttcctaagta

SEQ ID NO: 176104 - DNA, 25 bp, Mus musculus
agcgagcagatgtgcttcctaagta

SEQ ID NO: 176105 - DNA, 25 bp, Mus musculus
agcgagcagcccatgacttcttggg

SEQ ID NO: 176106 - DNA, 25 bp, Mus musculus
agcgagcagcccttgacttcttggg

SEQ ID NO: 176107 - DNA, 25 bp, Mus musculus
agcgagcagtctcggaactcccgga

SEQ ID NO: 176108 - DNA, 25 bp, Mus musculus
agcgagcagtctgggaactcccgga

SEQ ID NO: 176109 - DNA, 25 bp, Mus musculus
agcgagcatgctagtcactacattt

SEQ ID NO: 176110 - DNA, 25 bp, Mus musculus
agcgagcatgcttgtcactacattt

SEQ ID NO: 176111 - DNA, 25 bp, Mus musculus
agcgagccacttctgggtgttccat

SEQ ID NO: 176112 - DNA, 25 bp, Mus musculus
agcgagccacttgtgggtgttccat

SEQ ID NO: 176113 - DNA, 25 bp, Mus musculus
agcgagccagccctctatttctgac

SEQ ID NO: 176114 - DNA, 25 bp, Mus musculus
agcgagccagccgtctatttctgac

SEQ ID NO: 176115 - DNA, 25 bp, Mus musculus
agcgagccatgtatcacggaggaga

SEQ ID NO: 176116 - DNA, 25 bp, Mus musculus
agcgagccatgtttcacggaggaga

SEQ ID NO: 176117 - DNA, 25 bp, Mus musculus
agcgagcccggaaaacgaaatgtgt

SEQ ID NO: 176118 - DNA, 25 bp, Mus musculus
agcgagcccggataacgaaatgtgt

SEQ ID NO: 176119 - DNA, 25 bp, Mus musculus
agcgagccgagacttaactgcagcg

SEQ ID NO: 176120 - DNA, 25 bp, Mus musculus
agcgagccgagagttaactgcagcg

SEQ ID NO: 176121 - DNA, 25 bp, Mus musculus
agcgagcctggcatgtgctctgagc

SEQ ID NO: 176122 - DNA, 25 bp, Mus musculus
agcgagcctggcttgtgctctgagc

SEQ ID NO: 176123 - DNA, 25 bp, Mus musculus
agcgagcctgttctccgaagtgtaa

SEQ ID NO: 176124 - DNA, 25 bp, Mus musculus
agcgagcctgttgtccgaagtgtaa

SEQ ID NO: 176125 - DNA, 25 bp, Mus musculus
agcgagccttcgcatttgatgccaa

SEQ ID NO: 176126 - DNA, 25 bp, Mus musculus
agcgagccttcggatttgatgccaa

SEQ ID NO: 176127 - DNA, 25 bp, Mus musculus
agcgagcctttgacaagtatgagaa

SEQ ID NO: 176128 - DNA, 25 bp, Mus musculus
agcgagcctttgtcaagtatgagaa

SEQ ID NO: 176129 - DNA, 25 bp, Mus musculus
agcgagcgtggcagcacttgtacgc

SEQ ID NO: 176130 - DNA, 25 bp, Mus musculus
agcgagcgtggctgcacttgtacgc

SEQ ID NO: 176131 - DNA, 25 bp, Mus musculus
agcgagctaagcatcgtgaaattga

SEQ ID NO: 176132 - DNA, 25 bp, Mus musculus
agcgagctaagcttcgtgaaattga

SEQ ID NO: 176133 - DNA, 25 bp, Mus musculus
agcgagctgccccatgagattgaca

SEQ ID NO: 176134 - DNA, 25 bp, Mus musculus
agcgagctgcccgatgagattgaca

SEQ ID NO: 176135 - DNA, 25 bp, Mus musculus
agcgagctgtggaactggctccagt

SEQ ID NO: 176136 - DNA, 25 bp, Mus musculus
agcgagctgtggtactggctccagt

SEQ ID NO: 176137 - DNA, 25 bp, Mus musculus
agcgagcttatacgcgccacctttt

SEQ ID NO: 176138 - DNA, 25 bp, Mus musculus
agcgagcttataggcgccacctttt

SEQ ID NO: 176139 - DNA, 25 bp, Mus musculus
agcgagcttgctattctctagtcgt

SEQ ID NO: 176140 - DNA, 25 bp, Mus musculus
agcgagcttgcttttctctagtcgt

SEQ ID NO: 176141 - DNA, 25 bp, Mus musculus
agcgagcttttaccagcgtgctttg

SEQ ID NO: 176142 - DNA, 25 bp, Mus musculus
agcgagcttttagcagcgtgctttg

SEQ ID NO: 176143 - DNA, 25 bp, Mus musculus
agcgaggaagaccactcacctgcac

SEQ ID NO: 176144 - DNA, 25 bp, Mus musculus
agcgaggaagacgactcacctgcac

SEQ ID NO: 176145 - DNA, 25 bp, Mus musculus
agcgaggacagacggatacctccca

SEQ ID NO: 176146 - DNA, 25 bp, Mus musculus
agcgaggacagagggatacctccca

SEQ ID NO: 176147 - DNA, 25 bp, Mus musculus
agcgaggacagcaatcacggctctg

SEQ ID NO: 176148 - DNA, 25 bp, Mus musculus
agcgaggacagctatcacggctctg

SEQ ID NO: 176149 - DNA, 25 bp, Mus musculus
agcgaggaccaaacctcaaggctgt

SEQ ID NO: 176150 - DNA, 25 bp, Mus musculus
agcgaggaccaatcctcaaggctgt

SEQ ID NO: 176151 - DNA, 25 bp, Mus musculus
agcgaggaccctcagatctccgagg

SEQ ID NO: 176152 - DNA, 25 bp, Mus musculus
agcgaggaccctgagatctccgagg

SEQ ID NO: 176153 - DNA, 25 bp, Mus musculus
agcgaggacctaatgatgtttgtta

SEQ ID NO: 176154 - DNA, 25 bp, Mus musculus
agcgaggacctattgatgtttgtta

SEQ ID NO: 176155 - DNA, 25 bp, Mus musculus
agcgaggagagcactatggatcgaa

SEQ ID NO: 176156 - DNA, 25 bp, Mus musculus
agcgaggagagctctatggatcgaa

SEQ ID NO: 176157 - DNA, 25 bp, Mus musculus
agcgaggaggagcagttctactcta

SEQ ID NO: 176158 - DNA, 25 bp, Mus musculus
agcgaggaggaggagttctactcta

SEQ ID NO: 176159 - DNA, 25 bp, Mus musculus
agcgaggatcgaccagaacacagtt

SEQ ID NO: 176160 - DNA, 25 bp, Mus musculus
agcgaggatcgagcagaacacagtt

SEQ ID NO: 176161 - DNA, 25 bp, Mus musculus
agcgaggattctacaaggacttgga

SEQ ID NO: 176162 - DNA, 25 bp, Mus musculus
agcgaggattcttcaaggacttgga

SEQ ID NO: 176163 - DNA, 25 bp, Mus musculus
agcgaggcaaaacaccagaggacgt

SEQ ID NO: 176164 - DNA, 25 bp, Mus musculus
agcgaggcaaaagaccagaggacgt

SEQ ID NO: 176165 - DNA, 25 bp, Mus musculus
agcgaggcacgccatgtttccctga

SEQ ID NO: 176166 - DNA, 25 bp, Mus musculus
agcgaggcacgcgatgtttccctga

SEQ ID NO: 176167 - DNA, 25 bp, Mus musculus
agcgaggctgcgagaaggcggcggt

SEQ ID NO: 176168 - DNA, 25 bp, Mus musculus
agcgaggctgcgtgaaggcggcggt

SEQ ID NO: 176169 - DNA, 25 bp, Mus musculus
agcgagggactcagtgcactttatc

SEQ ID NO: 176170 - DNA, 25 bp, Mus musculus
agcgagggactctgtgcactttatc

SEQ ID NO: 176171 - DNA, 25 bp, Mus musculus
agcgagggagttcgacgttctccta

SEQ ID NO: 176172 - DNA, 25 bp, Mus musculus
agcgagggagttggacgttctccta

SEQ ID NO: 176173 - DNA, 25 bp, Mus musculus
agcgagggcgagacgcccgccttca

SEQ ID NO: 176174 - DNA, 25 bp, Mus musculus
agcgagggcgagtcgcccgccttca

SEQ ID NO: 176175 - DNA, 25 bp, Mus musculus
agcgagggctccatcgggcttggga

SEQ ID NO: 176176 - DNA, 25 bp, Mus musculus
agcgagggctccttcgggcttggga

SEQ ID NO: 176177 - DNA, 25 bp, Mus musculus
agcgagggtctaccagctcctgaga

SEQ ID NO: 176178 - DNA, 25 bp, Mus musculus
agcgagggtctagcagctcctgaga

SEQ ID NO: 176179 - DNA, 25 bp, Mus musculus
agcgagggtgtcagctctgttttac

SEQ ID NO: 176180 - DNA, 25 bp, Mus musculus
agcgagggtgtctgctctgttttac

SEQ ID NO: 176181 - DNA, 25 bp, Mus musculus
agcgaggtcactagcaactctccgc

SEQ ID NO: 176182 - DNA, 25 bp, Mus musculus
agcgaggtcacttgcaactctccgc

SEQ ID NO: 176183 - DNA, 25 bp, Mus musculus
agcgaggtcaggacagtcgccagaa

SEQ ID NO: 176184 - DNA, 25 bp, Mus musculus
agcgaggtcaggtcagtcgccagaa

SEQ ID NO: 176185 - DNA, 25 bp, Mus musculus
agcgaggtccatcttgtggcaccaa

SEQ ID NO: 176186 - DNA, 25 bp, Mus musculus
agcgaggtccatgttgtggcaccaa

SEQ ID NO: 176187 - DNA, 25 bp, Mus musculus
agcgaggtgtggatttatgcctatc

SEQ ID NO: 176188 - DNA, 25 bp, Mus musculus
agcgaggtgtggttttatgcctatc

SEQ ID NO: 176189 - DNA, 25 bp, Mus musculus
agcgagtactttccgctgttcctcg

SEQ ID NO: 176190 - DNA, 25 bp, Mus musculus
agcgagtactttgcgctgttcctcg

SEQ ID NO: 176191 - DNA, 25 bp, Mus musculus
agcgagtccagcacaaagggccgaa

SEQ ID NO: 176192 - DNA, 25 bp, Mus musculus
agcgagtccagctcaaagggccgaa

SEQ ID NO: 176193 - DNA, 25 bp, Mus musculus
agcgagtccatactggaagtattaa

SEQ ID NO: 176194 - DNA, 25 bp, Mus musculus
agcgagtccatagtggaagtattaa

SEQ ID NO: 176195 - DNA, 25 bp, Mus musculus
agcgagtccccgacgggagacgcgc

SEQ ID NO: 176196 - DNA, 25 bp, Mus musculus
agcgagtccccgtcgggagacgcgc

SEQ ID NO: 176197 - DNA, 25 bp, Mus musculus
agcgagtccttgacctgggctgagt

SEQ ID NO: 176198 - DNA, 25 bp, Mus musculus
agcgagtccttgtcctgggctgagt

SEQ ID NO: 176199 - DNA, 25 bp, Mus musculus
agcgagtcttacaggctgtggataa

SEQ ID NO: 176200 - DNA, 25 bp, Mus musculus
agcgagtcttactggctgtggataa

SEQ ID NO: 176201 - DNA, 25 bp, Mus musculus
agcgagtcttgaacaggctccatca

SEQ ID NO: 176202 - DNA, 25 bp, Mus musculus
agcgagtcttgatcaggctccatca

SEQ ID NO: 176203 - DNA, 25 bp, Mus musculus
agcgagtgcaacagctttatttctg

SEQ ID NO: 176204 - DNA, 25 bp, Mus musculus
agcgagtgcaactgctttatttctg

SEQ ID NO: 176205 - DNA, 25 bp, Mus musculus
agcgagtgtgaaccccgacactggc

SEQ ID NO: 176206 - DNA, 25 bp, Mus musculus
agcgagtgtgaagcccgacactggc

SEQ ID NO: 176207 - DNA, 25 bp, Mus musculus
agcgagttactgagaatggacattc

SEQ ID NO: 176208 - DNA, 25 bp, Mus musculus
agcgagttactgtgaatggacattc

SEQ ID NO: 176209 - DNA, 25 bp, Mus musculus
agcgagttcgatagcttctcagacc

SEQ ID NO: 176210 - DNA, 25 bp, Mus musculus
agcgagttcgattgcttctcagacc

SEQ ID NO: 176211 - DNA, 25 bp, Mus musculus
agcgagttctggatgcaggttgctc

SEQ ID NO: 176212 - DNA, 25 bp, Mus musculus
agcgagttctggttgcaggttgctc

SEQ ID NO: 176213 - DNA, 25 bp, Mus musculus
agcgagttgctcaacgtcatgatct

SEQ ID NO: 176214 - DNA, 25 bp, Mus musculus
agcgagttgctctacgtcatgatct

SEQ ID NO: 176215 - DNA, 25 bp, Mus musculus
agcgataaggctcgagagttgactc

SEQ ID NO: 176216 - DNA, 25 bp, Mus musculus
agcgataaggctggagagttgactc

SEQ ID NO: 176217 - DNA, 25 bp, Mus musculus
agcgatacttgactttcacactttg

SEQ ID NO: 176218 - DNA, 25 bp, Mus musculus
agcgatacttgagtttcacactttg

SEQ ID NO: 176219 - DNA, 25 bp, Mus musculus
agcgatagcatgagccttgaattct

SEQ ID NO: 176220 - DNA, 25 bp, Mus musculus
agcgatagcatgtgccttgaattct

SEQ ID NO: 176221 - DNA, 25 bp, Mus musculus
agcgatagctacagaacttggttca

SEQ ID NO: 176222 - DNA, 25 bp, Mus musculus
agcgatagctactgaacttggttca

SEQ ID NO: 176223 - DNA, 25 bp, Mus musculus
agcgatatgagaccgggactttcca

SEQ ID NO: 176224 - DNA, 25 bp, Mus musculus
agcgatatgagagcgggactttcca

SEQ ID NO: 176225 - DNA, 25 bp, Mus musculus
agcgatcaaaaacccactgtgatgt

SEQ ID NO: 176226 - DNA, 25 bp, Mus musculus
agcgatcaaaaagccactgtgatgt

SEQ ID NO: 176227 - DNA, 25 bp, Mus musculus
agcgatcactagcatctccccaggt

SEQ ID NO: 176228 - DNA, 25 bp, Mus musculus
agcgatcactaggatctccccaggt

SEQ ID NO: 176229 - DNA, 25 bp, Mus musculus
agcgatcatgatcacctggattgat

SEQ ID NO: 176230 - DNA, 25 bp, Mus musculus
agcgatcatgatgacctggattgat

SEQ ID NO: 176231 - DNA, 25 bp, Mus musculus
agcgatcccagcacagggctgaagt

SEQ ID NO: 176232 - DNA, 25 bp, Mus musculus
agcgatcccagctcagggctgaagt

SEQ ID NO: 176233 - DNA, 25 bp, Mus musculus
agcgatccctgcactgtctgaggtg

SEQ ID NO: 176234 - DNA, 25 bp, Mus musculus
agcgatccctgctctgtctgaggtg

SEQ ID NO: 176235 - DNA, 25 bp, Mus musculus
agcgatcctgatattttccttctgc

SEQ ID NO: 176236 - DNA, 25 bp, Mus musculus
agcgatcctgattttttccttctgc

SEQ ID NO: 176237 - DNA, 25 bp, Mus musculus
agcgatctacataagtgccctgtca

SEQ ID NO: 176238 - DNA, 25 bp, Mus musculus
agcgatctacattagtgccctgtca

SEQ ID NO: 176239 - DNA, 25 bp, Mus musculus
agcgatctagctacaaggctggcga

SEQ ID NO: 176240 - DNA, 25 bp, Mus musculus
agcgatctagcttcaaggctggcga

SEQ ID NO: 176241 - DNA, 25 bp, Mus musculus
agcgatctctttcgtccacattcag

SEQ ID NO: 176242 - DNA, 25 bp, Mus musculus
agcgatctctttggtccacattcag

SEQ ID NO: 176243 - DNA, 25 bp, Mus musculus
agcgatgagactaaacaggcaacaa

SEQ ID NO: 176244 - DNA, 25 bp, Mus musculus
agcgatgagacttaacaggcaacaa

SEQ ID NO: 176245 - DNA, 25 bp, Mus musculus
agcgatgaggtgcttctttgtacaa

SEQ ID NO: 176246 - DNA, 25 bp, Mus musculus
agcgatgaggtggttctttgtacaa

SEQ ID NO: 176247 - DNA, 25 bp, Mus musculus
agcgatgcccagagaatataaacga

SEQ ID NO: 176248 - DNA, 25 bp, Mus musculus
agcgatgcccagtgaatataaacga

SEQ ID NO: 176249 - DNA, 25 bp, Mus musculus
agcgatgccccaactgtggaaccca

SEQ ID NO: 176250 - DNA, 25 bp, Mus musculus
agcgatgccccatctgtggaaccca

SEQ ID NO: 176251 - DNA, 25 bp, Mus musculus
agcgatgcctggcccacctagtcat

SEQ ID NO: 176252 - DNA, 25 bp, Mus musculus
agcgatgcctgggccacctagtcat

SEQ ID NO: 176253 - DNA, 25 bp, Mus musculus
agcgatgcggccagttgagagcact

SEQ ID NO: 176254 - DNA, 25 bp, Mus musculus
agcgatgcggcctgttgagagcact

SEQ ID NO: 176255 - DNA, 25 bp, Mus musculus
agcgatgcgtgcatgcattgaccaa

SEQ ID NO: 176256 - DNA, 25 bp, Mus musculus
agcgatgcgtgcttgcattgaccaa

SEQ ID NO: 176257 - DNA, 25 bp, Mus musculus
agcgatgctctactctctcaggttg

SEQ ID NO: 176258 - DNA, 25 bp, Mus musculus
agcgatgctctagtctctcaggttg

SEQ ID NO: 176259 - DNA, 25 bp, Mus musculus
agcgatgctgtgactttccaaggca

SEQ ID NO: 176260 - DNA, 25 bp, Mus musculus
agcgatgctgtgtctttccaaggca

SEQ ID NO: 176261 - DNA, 25 bp, Mus musculus
agcgatggcgatatttctacttcag

SEQ ID NO: 176262 - DNA, 25 bp, Mus musculus
agcgatggcgatttttctacttcag

SEQ ID NO: 176263 - DNA, 25 bp, Mus musculus
agcgatggcttgattcggcaacgta

SEQ ID NO: 176264 - DNA, 25 bp, Mus musculus
agcgatggcttgtttcggcaacgta

SEQ ID NO: 176265 - DNA, 25 bp, Mus musculus
agcgatgggagtcatgtctctcttt

SEQ ID NO: 176266 - DNA, 25 bp, Mus musculus
agcgatgggagtgatgtctctcttt

SEQ ID NO: 176267 - DNA, 25 bp, Mus musculus
agcgatgtaacaccaaaggcgacct

SEQ ID NO: 176268 - DNA, 25 bp, Mus musculus
agcgatgtaacagcaaaggcgacct

SEQ ID NO: 176269 - DNA, 25 bp, Mus musculus
agcgatgtatttagactcttggatt

SEQ ID NO: 176270 - DNA, 25 bp, Mus musculus
agcgatgtattttgactcttggatt

SEQ ID NO: 176271 - DNA, 25 bp, Mus musculus
agcgatgttcagatgtataccttga

SEQ ID NO: 176272 - DNA, 25 bp, Mus musculus
agcgatgttcagttgtataccttga

SEQ ID NO: 176273 - DNA, 25 bp, Mus musculus
agcgattatcacaatgcctcagcaa

SEQ ID NO: 176274 - DNA, 25 bp, Mus musculus
agcgattatcactatgcctcagcaa

SEQ ID NO: 176275 - DNA, 25 bp, Mus musculus
agcgattcacgcccagttccctgag

SEQ ID NO: 176276 - DNA, 25 bp, Mus musculus
agcgattcacgcgcagttccctgag

SEQ ID NO: 176277 - DNA, 25 bp, Mus musculus
agcgattcccgcacatgtttagcaa

SEQ ID NO: 176278 - DNA, 25 bp, Mus musculus
agcgattcccgctcatgtttagcaa

SEQ ID NO: 176279 - DNA, 25 bp, Mus musculus
agcgattccgggaggccatcaagga

SEQ ID NO: 176280 - DNA, 25 bp, Mus musculus
agcgattccgggtggccatcaagga

SEQ ID NO: 176281 - DNA, 25 bp, Mus musculus
agcgattcttttatcctggtgttac

SEQ ID NO: 176282 - DNA, 25 bp, Mus musculus
agcgattcttttttcctggtgttac

SEQ ID NO: 176283 - DNA, 25 bp, Mus musculus
agcgattgtccgagtggcccacgat

SEQ ID NO: 176284 - DNA, 25 bp, Mus musculus
agcgattgtccgtgtggcccacgat

SEQ ID NO: 176285 - DNA, 25 bp, Mus musculus
agcgatttactgacatcctggcaca

SEQ ID NO: 176286 - DNA, 25 bp, Mus musculus
agcgatttactgtcatcctggcaca

SEQ ID NO: 176287 - DNA, 25 bp, Mus musculus
agcgattttacaccctcaagttttt

SEQ ID NO: 176288 - DNA, 25 bp, Mus musculus
agcgattttacagcctcaagttttt

SEQ ID NO: 176289 - DNA, 25 bp, Mus musculus
agcgattttggtacatgaatcccag

SEQ ID NO: 176290 - DNA, 25 bp, Mus musculus
agcgattttggttcatgaatcccag

SEQ ID NO: 176291 - DNA, 25 bp, Mus musculus
agcgcaaatcttctcataacatctc

SEQ ID NO: 176292 - DNA, 25 bp, Mus musculus
agcgcaaatcttgtcataacatctc

SEQ ID NO: 176293 - DNA, 25 bp, Mus musculus
agcgcaaatgccagtacttcacgtg

SEQ ID NO: 176294 - DNA, 25 bp, Mus musculus
agcgcaaatgcctgtacttcacgtg

SEQ ID NO: 176295 - DNA, 25 bp, Mus musculus
agcgcaacagcaccctgcagctgga

SEQ ID NO: 176296 - DNA, 25 bp, Mus musculus
agcgcaacagcagcctgcagctgga

SEQ ID NO: 176297 - DNA, 25 bp, Mus musculus
agcgcaaccagaactcatcttagac

SEQ ID NO: 176298 - DNA, 25 bp, Mus musculus
agcgcaaccagatctcatcttagac

SEQ ID NO: 176299 - DNA, 25 bp, Mus musculus
agcgcaaccgggacaagttggtcaa

SEQ ID NO: 176300 - DNA, 25 bp, Mus musculus
agcgcaaccgggtcaagttggtcaa

SEQ ID NO: 176301 - DNA, 25 bp, Mus musculus
agcgcaactctgctctgtaaacttg

SEQ ID NO: 176302 - DNA, 25 bp, Mus musculus
agcgcaactctggtctgtaaacttg

SEQ ID NO: 176303 - DNA, 25 bp, Mus musculus
agcgcaacttctcatgctcagagga

SEQ ID NO: 176304 - DNA, 25 bp, Mus musculus
agcgcaacttctgatgctcagagga

SEQ ID NO: 176305 - DNA, 25 bp, Mus musculus
agcgcaagaccgacaccgccatgga

SEQ ID NO: 176306 - DNA, 25 bp, Mus musculus
agcgcaagaccgtcaccgccatgga

SEQ ID NO: 176307 - DNA, 25 bp, Mus musculus
agcgcaagcgaacgcctcatggaga

SEQ ID NO: 176308 - DNA, 25 bp, Mus musculus
agcgcaagcgaaggcctcatggaga

SEQ ID NO: 176309 - DNA, 25 bp, Mus musculus
agcgcaagcgggacgggcccaacat

SEQ ID NO: 176310 - DNA, 25 bp, Mus musculus
agcgcaagcgggtcgggcccaacat

SEQ ID NO: 176311 - DNA, 25 bp, Mus musculus
agcgcaaggccacgcgggaggccaa

SEQ ID NO: 176312 - DNA, 25 bp, Mus musculus
agcgcaaggccaggcgggaggccaa

SEQ ID NO: 176313 - DNA, 25 bp, Mus musculus
agcgcaagtgcccagtcagcactgt

SEQ ID NO: 176314 - DNA, 25 bp, Mus musculus
agcgcaagtgccgagtcagcactgt

SEQ ID NO: 176315 - DNA, 25 bp, Mus musculus
agcgcaagtttgatcgttggtgcat

SEQ ID NO: 176316 - DNA, 25 bp, Mus musculus
agcgcaagtttgttcgttggtgcat

SEQ ID NO: 176317 - DNA, 25 bp, Mus musculus
agcgcaatgggcacctcaatgaggc

SEQ ID NO: 176318 - DNA, 25 bp, Mus musculus
agcgcaatgggctcctcaatgaggc

SEQ ID NO: 176319 - DNA, 25 bp, Mus musculus
agcgcacacaacaagccaggaggca

SEQ ID NO: 176320 - DNA, 25 bp, Mus musculus
agcgcacacaactagccaggaggca

SEQ ID NO: 176321 - DNA, 25 bp, Mus musculus
agcgcacacacgacgagattgctct

SEQ ID NO: 176322 - DNA, 25 bp, Mus musculus
agcgcacacacgtcgagattgctct

SEQ ID NO: 176323 - DNA, 25 bp, Mus musculus
agcgcacacagtcccttgtgatggc

SEQ ID NO: 176324 - DNA, 25 bp, Mus musculus
agcgcacacagtgccttgtgatggc

SEQ ID NO: 176325 - DNA, 25 bp, Mus musculus
agcgcacacccaacatcgtcatgat

SEQ ID NO: 176326 - DNA, 25 bp, Mus musculus
agcgcacacccatcatcgtcatgat

SEQ ID NO: 176327 - DNA, 25 bp, Mus musculus
agcgcaccatccagcagtgttgtga

SEQ ID NO: 176328 - DNA, 25 bp, Mus musculus
agcgcaccatcctgcagtgttgtga

SEQ ID NO: 176329 - DNA, 25 bp, Mus musculus
agcgcacctattacagctgtcattc

SEQ ID NO: 176330 - DNA, 25 bp, Mus musculus
agcgcacctatttcagctgtcattc

SEQ ID NO: 176331 - DNA, 25 bp, Mus musculus
agcgcacctcccctggataggttta

SEQ ID NO: 176332 - DNA, 25 bp, Mus musculus
agcgcacctcccgtggataggttta

SEQ ID NO: 176333 - DNA, 25 bp, Mus musculus
agcgcacgggcgagagaagctccaa

SEQ ID NO: 176334 - DNA, 25 bp, Mus musculus
agcgcacgggcgtgagaagctccaa

SEQ ID NO: 176335 - DNA, 25 bp, Mus musculus
agcgcacggtccaggtgctactaaa

SEQ ID NO: 176336 - DNA, 25 bp, Mus musculus
agcgcacggtcctggtgctactaaa

SEQ ID NO: 176337 - DNA, 25 bp, Mus musculus
agcgcacgtgcaaagatacctgctg

SEQ ID NO: 176338 - DNA, 25 bp, Mus musculus
agcgcacgtgcatagatacctgctg

SEQ ID NO: 176339 - DNA, 25 bp, Mus musculus
agcgcactgcacattttgtttgaat

SEQ ID NO: 176340 - DNA, 25 bp, Mus musculus
agcgcactgcactttttgtttgaat

SEQ ID NO: 176341 - DNA, 25 bp, Mus musculus
agcgcactgcatcggctccaagatt

SEQ ID NO: 176342 - DNA, 25 bp, Mus musculus
agcgcactgcatgggctccaagatt

SEQ ID NO: 176343 - DNA, 25 bp, Mus musculus
agcgcactgccaacctaggcgctgg

SEQ ID NO: 176344 - DNA, 25 bp, Mus musculus
agcgcactgccatcctaggcgctgg

SEQ ID NO: 176345 - DNA, 25 bp, Mus musculus
agcgcactttcccatggagatgcag

SEQ ID NO: 176346 - DNA, 25 bp, Mus musculus
agcgcactttccgatggagatgcag

SEQ ID NO: 176347 - DNA, 25 bp, Mus musculus
agcgcagacaccagcagtggtgact

SEQ ID NO: 176348 - DNA, 25 bp, Mus musculus
agcgcagacacctgcagtggtgact

SEQ ID NO: 176349 - DNA, 25 bp, Mus musculus
agcgcagacccaagacaagttcgag

SEQ ID NO: 176350 - DNA, 25 bp, Mus musculus
agcgcagacccatgacaagttcgag

SEQ ID NO: 176351 - DNA, 25 bp, Mus musculus
agcgcagaccgcagaggccctgcag

SEQ ID NO: 176352 - DNA, 25 bp, Mus musculus
agcgcagaccgctgaggccctgcag

SEQ ID NO: 176353 - DNA, 25 bp, Mus musculus
agcgcagagcccagcaacagagtca

SEQ ID NO: 176354 - DNA, 25 bp, Mus musculus
agcgcagagccctgcaacagagtca

SEQ ID NO: 176355 - DNA, 25 bp, Mus musculus
agcgcagagtgaaggaactcaccta

SEQ ID NO: 176356 - DNA, 25 bp, Mus musculus
agcgcagagtgatggaactcaccta

SEQ ID NO: 176357 - DNA, 25 bp, Mus musculus
agcgcagattcaacgcgttattttt

SEQ ID NO: 176358 - DNA, 25 bp, Mus musculus
agcgcagattcatcgcgttattttt

SEQ ID NO: 176359 - DNA, 25 bp, Mus musculus
agcgcagcaaacaccttctgtggga

SEQ ID NO: 176360 - DNA, 25 bp, Mus musculus
agcgcagcaaactccttctgtggga

SEQ ID NO: 176361 - DNA, 25 bp, Mus musculus
agcgcagcagtgaccacatgaccaa

SEQ ID NO: 176362 - DNA, 25 bp, Mus musculus
agcgcagcagtgtccacatgaccaa

SEQ ID NO: 176363 - DNA, 25 bp, Mus musculus
agcgcagcccctagggcagtgtcag

SEQ ID NO: 176364 - DNA, 25 bp, Mus musculus
agcgcagccccttgggcagtgtcag

SEQ ID NO: 176365 - DNA, 25 bp, Mus musculus
agcgcagcgaatcctggccactgga

SEQ ID NO: 176366 - DNA, 25 bp, Mus musculus
agcgcagcgaatgctggccactgga

SEQ ID NO: 176367 - DNA, 25 bp, Mus musculus
agcgcagctacgacagctactacta

SEQ ID NO: 176368 - DNA, 25 bp, Mus musculus
agcgcagctacgtcagctactacta

SEQ ID NO: 176369 - DNA, 25 bp, Mus musculus
agcgcaggcccaattagaatgcaat

SEQ ID NO: 176370 - DNA, 25 bp, Mus musculus
agcgcaggcccatttagaatgcaat

SEQ ID NO: 176371 - DNA, 25 bp, Mus musculus
agcgcaggctgactgccggaacacc

SEQ ID NO: 176372 - DNA, 25 bp, Mus musculus
agcgcaggctgagtgccggaacacc

SEQ ID NO: 176373 - DNA, 25 bp, Mus musculus
agcgcagtactgattttccttcccg

SEQ ID NO: 176374 - DNA, 25 bp, Mus musculus
agcgcagtactgtttttccttcccg

SEQ ID NO: 176375 - DNA, 25 bp, Mus musculus
agcgcagtagttactgtgtctcatc

SEQ ID NO: 176376 - DNA, 25 bp, Mus musculus
agcgcagtagtttctgtgtctcatc

SEQ ID NO: 176377 - DNA, 25 bp, Mus musculus
agcgcagtatcccagagctccatga

SEQ ID NO: 176378 - DNA, 25 bp, Mus musculus
agcgcagtatccgagagctccatga

SEQ ID NO: 176379 - DNA, 25 bp, Mus musculus
agcgcagtcgcaagaagcctagtga

SEQ ID NO: 176380 - DNA, 25 bp, Mus musculus
agcgcagtcgcatgaagcctagtga

SEQ ID NO: 176381 - DNA, 25 bp, Mus musculus
agcgcagtggacaccagtcagctgt

SEQ ID NO: 176382 - DNA, 25 bp, Mus musculus
agcgcagtggactccagtcagctgt

SEQ ID NO: 176383 - DNA, 25 bp, Mus musculus
agcgcatacgcaagactacattaca

SEQ ID NO: 176384 - DNA, 25 bp, Mus musculus
agcgcatacgcatgactacattaca

SEQ ID NO: 176385 - DNA, 25 bp, Mus musculus
agcgcatactctagacattgacgtc

SEQ ID NO: 176386 - DNA, 25 bp, Mus musculus
agcgcatactcttgacattgacgtc

SEQ ID NO: 176387 - DNA, 25 bp, Mus musculus
agcgcatacttaactctctggtcaa

SEQ ID NO: 176388 - DNA, 25 bp, Mus musculus
agcgcatacttatctctctggtcaa

SEQ ID NO: 176389 - DNA, 25 bp, Mus musculus
agcgcatatcccagttacccataca

SEQ ID NO: 176390 - DNA, 25 bp, Mus musculus
agcgcatatccctgttacccataca

SEQ ID NO: 176391 - DNA, 25 bp, Mus musculus
agcgcatccacacgcagtgggaatg

SEQ ID NO: 176392 - DNA, 25 bp, Mus musculus
agcgcatccacaggcagtgggaatg

SEQ ID NO: 176393 - DNA, 25 bp, Mus musculus
agcgcatccgaccagacttgcagga

SEQ ID NO: 176394 - DNA, 25 bp, Mus musculus
agcgcatccgacgagacttgcagga

SEQ ID NO: 176395 - DNA, 25 bp, Mus musculus
agcgcatcctaactggtggcaaaga

SEQ ID NO: 176396 - DNA, 25 bp, Mus musculus
agcgcatcctaagtggtggcaaaga

SEQ ID NO: 176397 - DNA, 25 bp, Mus musculus
agcgcatcctggacgcccgcggtga

SEQ ID NO: 176398 - DNA, 25 bp, Mus musculus
agcgcatcctggtcgcccgcggtga

SEQ ID NO: 176399 - DNA, 25 bp, Mus musculus
agcgcatctcctactgtctggacat

SEQ ID NO: 176400 - DNA, 25 bp, Mus musculus
agcgcatctccttctgtctggacat

SEQ ID NO: 176401 - DNA, 25 bp, Mus musculus
agcgcatctctgagcagtttacggc

SEQ ID NO: 176402 - DNA, 25 bp, Mus musculus
agcgcatctctgtgcagtttacggc

SEQ ID NO: 176403 - DNA, 25 bp, Mus musculus
agcgcatcttctacctgaagctaga

SEQ ID NO: 176404 - DNA, 25 bp, Mus musculus
agcgcatcttcttcctgaagctaga

SEQ ID NO: 176405 - DNA, 25 bp, Mus musculus
agcgcatgcagacgcgcaccaggtt

SEQ ID NO: 176406 - DNA, 25 bp, Mus musculus
agcgcatgcagaggcgcaccaggtt

SEQ ID NO: 176407 - DNA, 25 bp, Mus musculus
agcgcattatcacctgccgaatctc

SEQ ID NO: 176408 - DNA, 25 bp, Mus musculus
agcgcattatcagctgccgaatctc

SEQ ID NO: 176409 - DNA, 25 bp, Mus musculus
agcgcattctaaatcagtcagtgga

SEQ ID NO: 176410 - DNA, 25 bp, Mus musculus
agcgcattctaattcagtcagtgga

SEQ ID NO: 176411 - DNA, 25 bp, Mus musculus
agcgcattgaccactaccagcaggc

SEQ ID NO: 176412 - DNA, 25 bp, Mus musculus
agcgcattgacctctaccagcaggc

SEQ ID NO: 176413 - DNA, 25 bp, Mus musculus
agcgccaagatcctgaagcccaatg

SEQ ID NO: 176414 - DNA, 25 bp, Mus musculus
agcgccaagatcgtgaagcccaatg

SEQ ID NO: 176415 - DNA, 25 bp, Mus musculus
agcgccaagttgatttgcttaacca

SEQ ID NO: 176416 - DNA, 25 bp, Mus musculus
agcgccaagttgttttgcttaacca

SEQ ID NO: 176417 - DNA, 25 bp, Mus musculus
agcgccaccagcaggtaggtcaggt

SEQ ID NO: 176418 - DNA, 25 bp, Mus musculus
agcgccaccagctggtaggtcaggt

SEQ ID NO: 176419 - DNA, 25 bp, Mus musculus
agcgccaccgacatgctggtgtcag

SEQ ID NO: 176420 - DNA, 25 bp, Mus musculus
agcgccaccgacttgctggtgtcag

SEQ ID NO: 176421 - DNA, 25 bp, Mus musculus
agcgccacctggctgtgaacttcct

SEQ ID NO: 176422 - DNA, 25 bp, Mus musculus
agcgccacctgggtgtgaacttcct

SEQ ID NO: 176423 - DNA, 25 bp, Mus musculus
agcgccacggctaacattcattata

SEQ ID NO: 176424 - DNA, 25 bp, Mus musculus
agcgccacggcttacattcattata

SEQ ID NO: 176425 - DNA, 25 bp, Mus musculus
agcgccagaggcaggcaatgataca

SEQ ID NO: 176426 - DNA, 25 bp, Mus musculus
agcgccagaggctggcaatgataca

SEQ ID NO: 176427 - DNA, 25 bp, Mus musculus
agcgccagcagcctgtgcttctaca

SEQ ID NO: 176428 - DNA, 25 bp, Mus musculus
agcgccagcagcgtgtgcttctaca

SEQ ID NO: 176429 - DNA, 25 bp, Mus musculus
agcgccagccaaaccaatcaatttt

SEQ ID NO: 176430 - DNA, 25 bp, Mus musculus
agcgccagccaatccaatcaatttt

SEQ ID NO: 176431 - DNA, 25 bp, Mus musculus
agcgccaggaacagattgccaagag

SEQ ID NO: 176432 - DNA, 25 bp, Mus musculus
agcgccaggaactgattgccaagag

SEQ ID NO: 176433 - DNA, 25 bp, Mus musculus
agcgccaggacgaggctgagatcac

SEQ ID NO: 176434 - DNA, 25 bp, Mus musculus
agcgccaggacgtggctgagatcac

SEQ ID NO: 176435 - DNA, 25 bp, Mus musculus
agcgccaggatacacttggtgcaca

SEQ ID NO: 176436 - DNA, 25 bp, Mus musculus
agcgccaggatagacttggtgcaca

SEQ ID NO: 176437 - DNA, 25 bp, Mus musculus
agcgccaggccacggtcaaagcctg

SEQ ID NO: 176438 - DNA, 25 bp, Mus musculus
agcgccaggccagggtcaaagcctg

SEQ ID NO: 176439 - DNA, 25 bp, Mus musculus
agcgccaggcggacatcatcgggaa

SEQ ID NO: 176440 - DNA, 25 bp, Mus musculus
agcgccaggcggtcatcatcgggaa

SEQ ID NO: 176441 - DNA, 25 bp, Mus musculus
agcgccagggcaatatgcttctaat

SEQ ID NO: 176442 - DNA, 25 bp, Mus musculus
agcgccagggcattatgcttctaat

SEQ ID NO: 176443 - DNA, 25 bp, Mus musculus
agcgccagggccctactctgtacgg

SEQ ID NO: 176444 - DNA, 25 bp, Mus musculus
agcgccagggccgtactctgtacgg

SEQ ID NO: 176445 - DNA, 25 bp, Mus musculus
agcgccagtaatcccagacgcatgg

SEQ ID NO: 176446 - DNA, 25 bp, Mus musculus
agcgccagtaatgccagacgcatgg

SEQ ID NO: 176447 - DNA, 25 bp, Mus musculus
agcgccatcacacggaagttcaagc

SEQ ID NO: 176448 - DNA, 25 bp, Mus musculus
agcgccatcacagggaagttcaagc

SEQ ID NO: 176449 - DNA, 25 bp, Mus musculus
agcgccatcgccatcgagggactgg

SEQ ID NO: 176450 - DNA, 25 bp, Mus musculus
agcgccatcgccttcgagggactgg

SEQ ID NO: 176451 - DNA, 25 bp, Mus musculus
agcgccatctgtactgcggtgggca

SEQ ID NO: 176452 - DNA, 25 bp, Mus musculus
agcgccatctgttctgcggtgggca

SEQ ID NO: 176453 - DNA, 25 bp, Mus musculus
agcgccatgtcgaggcatcttcagt

SEQ ID NO: 176454 - DNA, 25 bp, Mus musculus
agcgccatgtcgtggcatcttcagt

SEQ ID NO: 176455 - DNA, 25 bp, Mus musculus
agcgccattaatagcatttttcccc

SEQ ID NO: 176456 - DNA, 25 bp, Mus musculus
agcgccattaattgcatttttcccc

SEQ ID NO: 176457 - DNA, 25 bp, Mus musculus
agcgccattgagagtttcccatata

SEQ ID NO: 176458 - DNA, 25 bp, Mus musculus
agcgccattgagtgtttcccatata

SEQ ID NO: 176459 - DNA, 25 bp, Mus musculus
agcgcccacctgcaatacttgagga

SEQ ID NO: 176460 - DNA, 25 bp, Mus musculus
agcgcccacctggaatacttgagga

SEQ ID NO: 176461 - DNA, 25 bp, Mus musculus
agcgcccagagtacatcccgtatca

SEQ ID NO: 176462 - DNA, 25 bp, Mus musculus
agcgcccagagttcatcccgtatca

SEQ ID NO: 176463 - DNA, 25 bp, Mus musculus
agcgcccagataacagaggccctga

SEQ ID NO: 176464 - DNA, 25 bp, Mus musculus
agcgcccagatatcagaggccctga

SEQ ID NO: 176465 - DNA, 25 bp, Mus musculus
agcgcccagcaaattagccttttaa

SEQ ID NO: 176466 - DNA, 25 bp, Mus musculus
agcgcccagcaatttagccttttaa

SEQ ID NO: 176467 - DNA, 25 bp, Mus musculus
agcgcccagctaacttacttgtgag

SEQ ID NO: 176468 - DNA, 25 bp, Mus musculus
agcgcccagctatcttacttgtgag

SEQ ID NO: 176469 - DNA, 25 bp, Mus musculus
agcgcccagcttagcctgagatcaa

SEQ ID NO: 176470 - DNA, 25 bp, Mus musculus
agcgcccagctttgcctgagatcaa

SEQ ID NO: 176471 - DNA, 25 bp, Mus musculus
agcgcccaggcgagcccatgggatt

SEQ ID NO: 176472 - DNA, 25 bp, Mus musculus
agcgcccaggcgtgcccatgggatt

SEQ ID NO: 176473 - DNA, 25 bp, Mus musculus
agcgcccaggtcacgaggtagtgta

SEQ ID NO: 176474 - DNA, 25 bp, Mus musculus
agcgcccaggtctcgaggtagtgta

SEQ ID NO: 176475 - DNA, 25 bp, Mus musculus
agcgccccggagaatggtgcccgca

SEQ ID NO: 176476 - DNA, 25 bp, Mus musculus
agcgccccggagtatggtgcccgca

SEQ ID NO: 176477 - DNA, 25 bp, Mus musculus
agcgccccttgtcgacagtgtgagt

SEQ ID NO: 176478 - DNA, 25 bp, Mus musculus
agcgccccttgtggacagtgtgagt

SEQ ID NO: 176479 - DNA, 25 bp, Mus musculus
agcgcccgatataaggcttccttgc

SEQ ID NO: 176480 - DNA, 25 bp, Mus musculus
agcgcccgatattaggcttccttgc

SEQ ID NO: 176481 - DNA, 25 bp, Mus musculus
agcgcccgtggcagatggttgacaa

SEQ ID NO: 176482 - DNA, 25 bp, Mus musculus
agcgcccgtggctgatggttgacaa

SEQ ID NO: 176483 - DNA, 25 bp, Mus musculus
agcgccctagtgattttagtgctat

SEQ ID NO: 176484 - DNA, 25 bp, Mus musculus
agcgccctagtgtttttagtgctat

SEQ ID NO: 176485 - DNA, 25 bp, Mus musculus
agcgccctgacacccgattggaaaa

SEQ ID NO: 176486 - DNA, 25 bp, Mus musculus
agcgccctgacagccgattggaaaa

SEQ ID NO: 176487 - DNA, 25 bp, Mus musculus
agcgccctttttctgggagtcagct

SEQ ID NO: 176488 - DNA, 25 bp, Mus musculus
agcgccctttttgtgggagtcagct

SEQ ID NO: 176489 - DNA, 25 bp, Mus musculus
agcgccgattacctccgcgagaagc

SEQ ID NO: 176490 - DNA, 25 bp, Mus musculus
agcgccgattacgtccgcgagaagc

SEQ ID NO: 176491 - DNA, 25 bp, Mus musculus
agcgccgcttctagcgccagaagta

SEQ ID NO: 176492 - DNA, 25 bp, Mus musculus
agcgccgcttcttgcgccagaagta

SEQ ID NO: 176493 - DNA, 25 bp, Mus musculus
agcgccgggctgaaaacctgagacg

SEQ ID NO: 176494 - DNA, 25 bp, Mus musculus
agcgccgggctgtaaacctgagacg

SEQ ID NO: 176495 - DNA, 25 bp, Mus musculus
agcgccgtagaaactggaaactgaa

SEQ ID NO: 176496 - DNA, 25 bp, Mus musculus
agcgccgtagaatctggaaactgaa

SEQ ID NO: 176497 - DNA, 25 bp, Mus musculus
agcgccgtggctcactgtagataag

SEQ ID NO: 176498 - DNA, 25 bp, Mus musculus
agcgccgtggctgactgtagataag

SEQ ID NO: 176499 - DNA, 25 bp, Mus musculus
agcgccgtttgaactcttccaagat

SEQ ID NO: 176500 - DNA, 25 bp, Mus musculus
agcgccgtttgatctcttccaagat

SEQ ID NO: 176501 - DNA, 25 bp, Mus musculus
agcgccgtttggaccagatgtcaac

SEQ ID NO: 176502 - DNA, 25 bp, Mus musculus
agcgccgtttggtccagatgtcaac

SEQ ID NO: 176503 - DNA, 25 bp, Mus musculus
agcgcctaacctaatgcctggcata

SEQ ID NO: 176504 - DNA, 25 bp, Mus musculus
agcgcctaaccttatgcctggcata

SEQ ID NO: 176505 - DNA, 25 bp, Mus musculus
agcgcctaagatagcttttgtagaa

SEQ ID NO: 176506 - DNA, 25 bp, Mus musculus
agcgcctaagattgcttttgtagaa

SEQ ID NO: 176507 - DNA, 25 bp, Mus musculus
agcgcctagtctactccacgtgttc

SEQ ID NO: 176508 - DNA, 25 bp, Mus musculus
agcgcctagtcttctccacgtgttc

SEQ ID NO: 176509 - DNA, 25 bp, Mus musculus
agcgcctatcttcgataacagcttt

SEQ ID NO: 176510 - DNA, 25 bp, Mus musculus
agcgcctatcttggataacagcttt

SEQ ID NO: 176511 - DNA, 25 bp, Mus musculus
agcgcctcatggcaaaagtcatgat

SEQ ID NO: 176512 - DNA, 25 bp, Mus musculus
agcgcctcatgggaaaagtcatgat

SEQ ID NO: 176513 - DNA, 25 bp, Mus musculus
agcgcctccgttcttgacaagtgac

SEQ ID NO: 176514 - DNA, 25 bp, Mus musculus
agcgcctccgttgttgacaagtgac

SEQ ID NO: 176515 - DNA, 25 bp, Mus musculus
agcgcctcggttccaaggtcagaat

SEQ ID NO: 176516 - DNA, 25 bp, Mus musculus
agcgcctcggttgcaaggtcagaat

SEQ ID NO: 176517 - DNA, 25 bp, Mus musculus
agcgcctcgtgcacactagagaaaa

SEQ ID NO: 176518 - DNA, 25 bp, Mus musculus
agcgcctcgtgctcactagagaaaa

SEQ ID NO: 176519 - DNA, 25 bp, Mus musculus
agcgcctctccactgttaagcaagg

SEQ ID NO: 176520 - DNA, 25 bp, Mus musculus
agcgcctctccagtgttaagcaagg

SEQ ID NO: 176521 - DNA, 25 bp, Mus musculus
agcgcctgatgtattagcgatcccg

SEQ ID NO: 176522 - DNA, 25 bp, Mus musculus
agcgcctgatgttttagcgatcccg

SEQ ID NO: 176523 - DNA, 25 bp, Mus musculus
agcgcctgatttacgcctgtggatg

SEQ ID NO: 176524 - DNA, 25 bp, Mus musculus
agcgcctgattttcgcctgtggatg

SEQ ID NO: 176525 - DNA, 25 bp, Mus musculus
agcgcctgccatatcgtggcactaa

SEQ ID NO: 176526 - DNA, 25 bp, Mus musculus
agcgcctgccatttcgtggcactaa

SEQ ID NO: 176527 - DNA, 25 bp, Mus musculus
agcgcctgctaacgaatcttcccga

SEQ ID NO: 176528 - DNA, 25 bp, Mus musculus
agcgcctgctaaggaatcttcccga

SEQ ID NO: 176529 - DNA, 25 bp, Mus musculus
agcgcctggagtatgctcttttgaa

SEQ ID NO: 176530 - DNA, 25 bp, Mus musculus
agcgcctggagtttgctcttttgaa

SEQ ID NO: 176531 - DNA, 25 bp, Mus musculus
agcgcctggccgacatgagtgatgt

SEQ ID NO: 176532 - DNA, 25 bp, Mus musculus
agcgcctggccgtcatgagtgatgt

SEQ ID NO: 176533 - DNA, 25 bp, Mus musculus
agcgcctggctgagctcaagagcaa

SEQ ID NO: 176534 - DNA, 25 bp, Mus musculus
agcgcctggctgtgctcaagagcaa

SEQ ID NO: 176535 - DNA, 25 bp, Mus musculus
agcgcctggtggatcagtgtcgcca

SEQ ID NO: 176536 - DNA, 25 bp, Mus musculus
agcgcctggtggttcagtgtcgcca

SEQ ID NO: 176537 - DNA, 25 bp, Mus musculus
agcgcctggtgtaccgagagtgaca

SEQ ID NO: 176538 - DNA, 25 bp, Mus musculus
agcgcctggtgttccgagagtgaca

SEQ ID NO: 176539 - DNA, 25 bp, Mus musculus
agcgcctgtccaagagaacctacaa

SEQ ID NO: 176540 - DNA, 25 bp, Mus musculus
agcgcctgtccatgagaacctacaa

SEQ ID NO: 176541 - DNA, 25 bp, Mus musculus
agcgcctgtcttatgtgcggttttt

SEQ ID NO: 176542 - DNA, 25 bp, Mus musculus
agcgcctgtcttttgtgcggttttt

SEQ ID NO: 176543 - DNA, 25 bp, Mus musculus
agcgcctgtgttctgcctgtgtcaa

SEQ ID NO: 176544 - DNA, 25 bp, Mus musculus
agcgcctgtgttgtgcctgtgtcaa

SEQ ID NO: 176545 - DNA, 25 bp, Mus musculus
agcgccttacaaataccccagaaag

SEQ ID NO: 176546 - DNA, 25 bp, Mus musculus
agcgccttacaattaccccagaaag

SEQ ID NO: 176547 - DNA, 25 bp, Mus musculus
agcgccttagcaatggttctttact

SEQ ID NO: 176548 - DNA, 25 bp, Mus musculus
agcgccttagcattggttctttact

SEQ ID NO: 176549 - DNA, 25 bp, Mus musculus
agcgccttcaatcattgctttgcga

SEQ ID NO: 176550 - DNA, 25 bp, Mus musculus
agcgccttcaatgattgctttgcga

SEQ ID NO: 176551 - DNA, 25 bp, Mus musculus
agcgccttgcatcccgaggagagtc

SEQ ID NO: 176552 - DNA, 25 bp, Mus musculus
agcgccttgcatgccgaggagagtc

SEQ ID NO: 176553 - DNA, 25 bp, Mus musculus
agcgccttgtccagtttgtgcaggt

SEQ ID NO: 176554 - DNA, 25 bp, Mus musculus
agcgccttgtcctgtttgtgcaggt

SEQ ID NO: 176555 - DNA, 25 bp, Mus musculus
agcgccttgtctaccaatttgtgca

SEQ ID NO: 176556 - DNA, 25 bp, Mus musculus
agcgccttgtcttccaatttgtgca

SEQ ID NO: 176557 - DNA, 25 bp, Mus musculus
agcgccttgttgacgatggtcttgc

SEQ ID NO: 176558 - DNA, 25 bp, Mus musculus
agcgccttgttgtcgatggtcttgc

SEQ ID NO: 176559 - DNA, 25 bp, Mus musculus
agcgcctttctgatctggccaagat

SEQ ID NO: 176560 - DNA, 25 bp, Mus musculus
agcgcctttctgttctggccaagat

SEQ ID NO: 176561 - DNA, 25 bp, Mus musculus
agcgcctttgggacctggattcagc

SEQ ID NO: 176562 - DNA, 25 bp, Mus musculus
agcgcctttgggtcctggattcagc

SEQ ID NO: 176563 - DNA, 25 bp, Mus musculus
agcgcgagctagaccagtgcagtga

SEQ ID NO: 176564 - DNA, 25 bp, Mus musculus
agcgcgagctagtccagtgcagtga

SEQ ID NO: 176565 - DNA, 25 bp, Mus musculus
agcgcgataaggaatttgcaaattc

SEQ ID NO: 176566 - DNA, 25 bp, Mus musculus
agcgcgataaggtatttgcaaattc

SEQ ID NO: 176567 - DNA, 25 bp, Mus musculus
agcgcgatggtcaggccgctctgca

SEQ ID NO: 176568 - DNA, 25 bp, Mus musculus
agcgcgatggtctggccgctctgca

SEQ ID NO: 176569 - DNA, 25 bp, Mus musculus
agcgcgcatgcgcacccaagagact

SEQ ID NO: 176570 - DNA, 25 bp, Mus musculus
agcgcgcatgcggacccaagagact

SEQ ID NO: 176571 - DNA, 25 bp, Mus musculus
agcgcgccaatccagagtgaggacc

SEQ ID NO: 176572 - DNA, 25 bp, Mus musculus
agcgcgccaatcgagagtgaggacc

SEQ ID NO: 176573 - DNA, 25 bp, Mus musculus
agcgcgccccagaaagaaagggctt

SEQ ID NO: 176574 - DNA, 25 bp, Mus musculus
agcgcgccccagtaagaaagggctt

SEQ ID NO: 176575 - DNA, 25 bp, Mus musculus
agcgcgcccttcaggacctacggaa

SEQ ID NO: 176576 - DNA, 25 bp, Mus musculus
agcgcgcccttctggacctacggaa

SEQ ID NO: 176577 - DNA, 25 bp, Mus musculus
agcgcgcctggaaacattttagcct

SEQ ID NO: 176578 - DNA, 25 bp, Mus musculus
agcgcgcctggatacattttagcct

SEQ ID NO: 176579 - DNA, 25 bp, Mus musculus
agcgcgctcgtgaaagcttgccgtc

SEQ ID NO: 176580 - DNA, 25 bp, Mus musculus
agcgcgctcgtgtaagcttgccgtc

SEQ ID NO: 176581 - DNA, 25 bp, Mus musculus
agcgcgctgtgtagggttcaagcaa

SEQ ID NO: 176582 - DNA, 25 bp, Mus musculus
agcgcgctgtgttgggttcaagcaa

SEQ ID NO: 176583 - DNA, 25 bp, Mus musculus
agcgcgcttgtgaagaacctgcagt

SEQ ID NO: 176584 - DNA, 25 bp, Mus musculus
agcgcgcttgtgtagaacctgcagt

SEQ ID NO: 176585 - DNA, 25 bp, Mus musculus
agcgcgggactcaacaactatgtgg

SEQ ID NO: 176586 - DNA, 25 bp, Mus musculus
agcgcgggactctacaactatgtgg

SEQ ID NO: 176587 - DNA, 25 bp, Mus musculus
agcgcgggcgctcattgacctaaga

SEQ ID NO: 176588 - DNA, 25 bp, Mus musculus
agcgcgggcgctgattgacctaaga

SEQ ID NO: 176589 - DNA, 25 bp, Mus musculus
agcgcggtagttaatgcacaatctg

SEQ ID NO: 176590 - DNA, 25 bp, Mus musculus
agcgcggtagtttatgcacaatctg

SEQ ID NO: 176591 - DNA, 25 bp, Mus musculus
agcgcgtaaggaagaccccttgcac

SEQ ID NO: 176592 - DNA, 25 bp, Mus musculus
agcgcgtaaggatgaccccttgcac

SEQ ID NO: 176593 - DNA, 25 bp, Mus musculus
agcgcgtcagcgaacttgtttaaat

SEQ ID NO: 176594 - DNA, 25 bp, Mus musculus
agcgcgtcagcgtacttgtttaaat

SEQ ID NO: 176595 - DNA, 25 bp, Mus musculus
agcgcgtccactcaagcaggatctt

SEQ ID NO: 176596 - DNA, 25 bp, Mus musculus
agcgcgtccactgaagcaggatctt

SEQ ID NO: 176597 - DNA, 25 bp, Mus musculus
agcgcgtcctgtatgtgcagtgcac

SEQ ID NO: 176598 - DNA, 25 bp, Mus musculus
agcgcgtcctgtttgtgcagtgcac

SEQ ID NO: 176599 - DNA, 25 bp, Mus musculus
agcgcgtcggctaaaaacacaatgg

SEQ ID NO: 176600 - DNA, 25 bp, Mus musculus
agcgcgtcggcttaaaacacaatgg

SEQ ID NO: 176601 - DNA, 25 bp, Mus musculus
agcgcgtcttcccagcccaggtaaa

SEQ ID NO: 176602 - DNA, 25 bp, Mus musculus
agcgcgtcttccgagcccaggtaaa

SEQ ID NO: 176603 - DNA, 25 bp, Mus musculus
agcgcgtgaaggcacttggcaccaa

SEQ ID NO: 176604 - DNA, 25 bp, Mus musculus
agcgcgtgaagggacttggcaccaa

SEQ ID NO: 176605 - DNA, 25 bp, Mus musculus
agcgcgtgctgcaggtgtccttcaa

SEQ ID NO: 176606 - DNA, 25 bp, Mus musculus
agcgcgtgctgctggtgtccttcaa

SEQ ID NO: 176607 - DNA, 25 bp, Mus musculus
agcgcgtggatcattcagtgctggt

SEQ ID NO: 176608 - DNA, 25 bp, Mus musculus
agcgcgtggatctttcagtgctggt

SEQ ID NO: 176609 - DNA, 25 bp, Mus musculus
agcgcgtggcggaaccggaggagtc

SEQ ID NO: 176610 - DNA, 25 bp, Mus musculus
agcgcgtggcggtaccggaggagtc

SEQ ID NO: 176611 - DNA, 25 bp, Mus musculus
agcgcgtgtgccaccttatttagct

SEQ ID NO: 176612 - DNA, 25 bp, Mus musculus
agcgcgtgtgcctccttatttagct

SEQ ID NO: 176613 - DNA, 25 bp, Mus musculus
agcgcgtttacgacgagaccacagt

SEQ ID NO: 176614 - DNA, 25 bp, Mus musculus
agcgcgtttacgtcgagaccacagt

SEQ ID NO: 176615 - DNA, 25 bp, Mus musculus
agcgcgtttgtcactggccggtttg

SEQ ID NO: 176616 - DNA, 25 bp, Mus musculus
agcgcgtttgtctctggccggtttg

SEQ ID NO: 176617 - DNA, 25 bp, Mus musculus
agcgctaacccacaggccagtggaa

SEQ ID NO: 176618 - DNA, 25 bp, Mus musculus
agcgctaacccagaggccagtggaa

SEQ ID NO: 176619 - DNA, 25 bp, Mus musculus
agcgctaccaccagttttcaagaga

SEQ ID NO: 176620 - DNA, 25 bp, Mus musculus
agcgctaccacctgttttcaagaga

SEQ ID NO: 176621 - DNA, 25 bp, Mus musculus
agcgctacgaatcacagcttcggga

SEQ ID NO: 176622 - DNA, 25 bp, Mus musculus
agcgctacgaatgacagcttcggga

SEQ ID NO: 176623 - DNA, 25 bp, Mus musculus
agcgctacgtttactaagttactat

SEQ ID NO: 176624 - DNA, 25 bp, Mus musculus
agcgctacgttttctaagttactat

SEQ ID NO: 176625 - DNA, 25 bp, Mus musculus
agcgctactctaagcctggaactct

SEQ ID NO: 176626 - DNA, 25 bp, Mus musculus
agcgctactctatgcctggaactct

SEQ ID NO: 176627 - DNA, 25 bp, Mus musculus
agcgctactgcacaatattgttttc

SEQ ID NO: 176628 - DNA, 25 bp, Mus musculus
agcgctactgcagaatattgttttc

SEQ ID NO: 176629 - DNA, 25 bp, Mus musculus
agcgctattgcaacctccaggagta

SEQ ID NO: 176630 - DNA, 25 bp, Mus musculus
agcgctattgcatcctccaggagta

SEQ ID NO: 176631 - DNA, 25 bp, Mus musculus
agcgctatttcacctgtaagccgaa

SEQ ID NO: 176632 - DNA, 25 bp, Mus musculus
agcgctatttcagctgtaagccgaa

SEQ ID NO: 176633 - DNA, 25 bp, Mus musculus
agcgctcaacgccagaggactacaa

SEQ ID NO: 176634 - DNA, 25 bp, Mus musculus
agcgctcaacgcgagaggactacaa

SEQ ID NO: 176635 - DNA, 25 bp, Mus musculus
agcgctcacctccataaactttggg

SEQ ID NO: 176636 - DNA, 25 bp, Mus musculus
agcgctcacctcgataaactttggg

SEQ ID NO: 176637 - DNA, 25 bp, Mus musculus
agcgctcactttatgtatttaaata

SEQ ID NO: 176638 - DNA, 25 bp, Mus musculus
agcgctcactttttgtatttaaata

SEQ ID NO: 176639 - DNA, 25 bp, Mus musculus
agcgctcagccaccaggattcggga

SEQ ID NO: 176640 - DNA, 25 bp, Mus musculus
agcgctcagccagcaggattcggga

SEQ ID NO: 176641 - DNA, 25 bp, Mus musculus
agcgctcagttccttttgtatggta

SEQ ID NO: 176642 - DNA, 25 bp, Mus musculus
agcgctcagttcgttttgtatggta

SEQ ID NO: 176643 - DNA, 25 bp, Mus musculus
agcgctcatgagctgtgactatctg

SEQ ID NO: 176644 - DNA, 25 bp, Mus musculus
agcgctcatgaggtgtgactatctg

SEQ ID NO: 176645 - DNA, 25 bp, Mus musculus
agcgctccacggaacagtgtctgtg

SEQ ID NO: 176646 - DNA, 25 bp, Mus musculus
agcgctccacggtacagtgtctgtg

SEQ ID NO: 176647 - DNA, 25 bp, Mus musculus
agcgctccgactcagcaaggccaga

SEQ ID NO: 176648 - DNA, 25 bp, Mus musculus
agcgctccgactgagcaaggccaga

SEQ ID NO: 176649 - DNA, 25 bp, Mus musculus
agcgctcctgtaagaggctatttca

SEQ ID NO: 176650 - DNA, 25 bp, Mus musculus
agcgctcctgtatgaggctatttca

SEQ ID NO: 176651 - DNA, 25 bp, Mus musculus
agcgctcgcttcacaatcaattaaa

SEQ ID NO: 176652 - DNA, 25 bp, Mus musculus
agcgctcgcttctcaatcaattaaa

SEQ ID NO: 176653 - DNA, 25 bp, Mus musculus
agcgctcggaccaggcgtgttggca

SEQ ID NO: 176654 - DNA, 25 bp, Mus musculus
agcgctcggacctggcgtgttggca

SEQ ID NO: 176655 - DNA, 25 bp, Mus musculus
agcgctctgactcacgtggcgccgg

SEQ ID NO: 176656 - DNA, 25 bp, Mus musculus
agcgctctgactgacgtggcgccgg

SEQ ID NO: 176657 - DNA, 25 bp, Mus musculus
agcgctctgatcaggttaaccatca

SEQ ID NO: 176658 - DNA, 25 bp, Mus musculus
agcgctctgatctggttaaccatca

SEQ ID NO: 176659 - DNA, 25 bp, Mus musculus
agcgctgagcatccccgaggacgct

SEQ ID NO: 176660 - DNA, 25 bp, Mus musculus
agcgctgagcatgcccgaggacgct

SEQ ID NO: 176661 - DNA, 25 bp, Mus musculus
agcgctgagccacactacggagttt

SEQ ID NO: 176662 - DNA, 25 bp, Mus musculus
agcgctgagccagactacggagttt

SEQ ID NO: 176663 - DNA, 25 bp, Mus musculus
agcgctgagttcagggtcactgttc

SEQ ID NO: 176664 - DNA, 25 bp, Mus musculus
agcgctgagttctgggtcactgttc

SEQ ID NO: 176665 - DNA, 25 bp, Mus musculus
agcgctgatagcacttagcctcaga

SEQ ID NO: 176666 - DNA, 25 bp, Mus musculus
agcgctgatagctcttagcctcaga

SEQ ID NO: 176667 - DNA, 25 bp, Mus musculus
agcgctgatcacaggtttctcttat

SEQ ID NO: 176668 - DNA, 25 bp, Mus musculus
agcgctgatcactggtttctcttat

SEQ ID NO: 176669 - DNA, 25 bp, Mus musculus
agcgctgatggtcaaagcctctcaa

SEQ ID NO: 176670 - DNA, 25 bp, Mus musculus
agcgctgatggtgaaagcctctcaa

SEQ ID NO: 176671 - DNA, 25 bp, Mus musculus
agcgctgcatatctcgtggcttcac

SEQ ID NO: 176672 - DNA, 25 bp, Mus musculus
agcgctgcatatgtcgtggcttcac

SEQ ID NO: 176673 - DNA, 25 bp, Mus musculus
agcgctgccaccacgtgtaaatagt

SEQ ID NO: 176674 - DNA, 25 bp, Mus musculus
agcgctgccacctcgtgtaaatagt

SEQ ID NO: 176675 - DNA, 25 bp, Mus musculus
agcgctgcccctaaggctgtgggtc

SEQ ID NO: 176676 - DNA, 25 bp, Mus musculus
agcgctgccccttaggctgtgggtc

SEQ ID NO: 176677 - DNA, 25 bp, Mus musculus
agcgctgcctgacccttgagggcca

SEQ ID NO: 176678 - DNA, 25 bp, Mus musculus
agcgctgcctgagccttgagggcca

SEQ ID NO: 176679 - DNA, 25 bp, Mus musculus
agcgctgctccgatggtgatggcct

SEQ ID NO: 176680 - DNA, 25 bp, Mus musculus
agcgctgctccgttggtgatggcct

SEQ ID NO: 176681 - DNA, 25 bp, Mus musculus
agcgctgcttccctaggacaaagtc

SEQ ID NO: 176682 - DNA, 25 bp, Mus musculus
agcgctgcttccgtaggacaaagtc

SEQ ID NO: 176683 - DNA, 25 bp, Mus musculus
agcgctggcacacgttagtcaagga

SEQ ID NO: 176684 - DNA, 25 bp, Mus musculus
agcgctggcacaggttagtcaagga

SEQ ID NO: 176685 - DNA, 25 bp, Mus musculus
agcgctgtacatcgacaaggacctg

SEQ ID NO: 176686 - DNA, 25 bp, Mus musculus
agcgctgtacatggacaaggacctg

SEQ ID NO: 176687 - DNA, 25 bp, Mus musculus
agcgctgtagatacagtgtgaccag

SEQ ID NO: 176688 - DNA, 25 bp, Mus musculus
agcgctgtagattcagtgtgaccag

SEQ ID NO: 176689 - DNA, 25 bp, Mus musculus
agcgctgtcagcaggcatacatgca

SEQ ID NO: 176690 - DNA, 25 bp, Mus musculus
agcgctgtcagctggcatacatgca

SEQ ID NO: 176691 - DNA, 25 bp, Mus musculus
agcgctgtcagtcttctcgaggaaa

SEQ ID NO: 176692 - DNA, 25 bp, Mus musculus
agcgctgtcagtgttctcgaggaaa

SEQ ID NO: 176693 - DNA, 25 bp, Mus musculus
agcgctgtgtgaccatgcccctggt

SEQ ID NO: 176694 - DNA, 25 bp, Mus musculus
agcgctgtgtgagcatgcccctggt

SEQ ID NO: 176695 - DNA, 25 bp, Mus musculus
agcgctgtgtggcttgcctgtctca

SEQ ID NO: 176696 - DNA, 25 bp, Mus musculus
agcgctgtgtgggttgcctgtctca

SEQ ID NO: 176697 - DNA, 25 bp, Mus musculus
agcgcttagcttcggagtcagttta

SEQ ID NO: 176698 - DNA, 25 bp, Mus musculus
agcgcttagcttgggagtcagttta

SEQ ID NO: 176699 - DNA, 25 bp, Mus musculus
agcgcttcagccagcgactcaagct

SEQ ID NO: 176700 - DNA, 25 bp, Mus musculus
agcgcttcagcctgcgactcaagct

SEQ ID NO: 176701 - DNA, 25 bp, Mus musculus
agcgcttcatcccactggtgtgcaa

SEQ ID NO: 176702 - DNA, 25 bp, Mus musculus
agcgcttcatccgactggtgtgcaa

SEQ ID NO: 176703 - DNA, 25 bp, Mus musculus
agcgcttccaagacgtgagtccagt

SEQ ID NO: 176704 - DNA, 25 bp, Mus musculus
agcgcttccaagtcgtgagtccagt

SEQ ID NO: 176705 - DNA, 25 bp, Mus musculus
agcgcttccattctctacagtgtat

SEQ ID NO: 176706 - DNA, 25 bp, Mus musculus
agcgcttccattgtctacagtgtat

SEQ ID NO: 176707 - DNA, 25 bp, Mus musculus
agcgcttccccgaggtgaacacagc

SEQ ID NO: 176708 - DNA, 25 bp, Mus musculus
agcgcttccccgtggtgaacacagc

SEQ ID NO: 176709 - DNA, 25 bp, Mus musculus
agcgcttccctgctttgtccttgga

SEQ ID NO: 176710 - DNA, 25 bp, Mus musculus
agcgcttccctggtttgtccttgga

SEQ ID NO: 176711 - DNA, 25 bp, Mus musculus
agcgcttcgatacgctcaactggcc

SEQ ID NO: 176712 - DNA, 25 bp, Mus musculus
agcgcttcgataggctcaactggcc

SEQ ID NO: 176713 - DNA, 25 bp, Mus musculus
agcgcttctggccatgaaattccta

SEQ ID NO: 176714 - DNA, 25 bp, Mus musculus
agcgcttctggcgatgaaattccta

SEQ ID NO: 176715 - DNA, 25 bp, Mus musculus
agcgcttctttcctggcaaatgtga

SEQ ID NO: 176716 - DNA, 25 bp, Mus musculus
agcgcttctttcgtggcaaatgtga

SEQ ID NO: 176717 - DNA, 25 bp, Mus musculus
agcgcttgaagcacggagttacagt

SEQ ID NO: 176718 - DNA, 25 bp, Mus musculus
agcgcttgaagctcggagttacagt

SEQ ID NO: 176719 - DNA, 25 bp, Mus musculus
agcgcttgagagaatcactcctgga

SEQ ID NO: 176720 - DNA, 25 bp, Mus musculus
agcgcttgagagtatcactcctgga

SEQ ID NO: 176721 - DNA, 25 bp, Mus musculus
agcgcttgagcccaggattccagag

SEQ ID NO: 176722 - DNA, 25 bp, Mus musculus
agcgcttgagccgaggattccagag

SEQ ID NO: 176723 - DNA, 25 bp, Mus musculus
agcgcttgcctcagaaatagacatg

SEQ ID NO: 176724 - DNA, 25 bp, Mus musculus
agcgcttgcctctgaaatagacatg

SEQ ID NO: 176725 - DNA, 25 bp, Mus musculus
agcgcttgcgtcaaagcacagatcg

SEQ ID NO: 176726 - DNA, 25 bp, Mus musculus
agcgcttgcgtctaagcacagatcg

SEQ ID NO: 176727 - DNA, 25 bp, Mus musculus
agcgcttgctccagggagatcgtca

SEQ ID NO: 176728 - DNA, 25 bp, Mus musculus
agcgcttgctcctgggagatcgtca

SEQ ID NO: 176729 - DNA, 25 bp, Mus musculus
agcgcttggcccctggcatccaagc

SEQ ID NO: 176730 - DNA, 25 bp, Mus musculus
agcgcttggcccgtggcatccaagc

SEQ ID NO: 176731 - DNA, 25 bp, Mus musculus
agcgctttcccaacatacacctttt

SEQ ID NO: 176732 - DNA, 25 bp, Mus musculus
agcgctttcccatcatacacctttt

SEQ ID NO: 176733 - DNA, 25 bp, Mus musculus
agcgctttccttacagaagtccagt

SEQ ID NO: 176734 - DNA, 25 bp, Mus musculus
agcgctttcctttcagaagtccagt

SEQ ID NO: 176735 - DNA, 25 bp, Mus musculus
agcgctttgggaaccacatccgcca

SEQ ID NO: 176736 - DNA, 25 bp, Mus musculus
agcgctttgggatccacatccgcca

SEQ ID NO: 176737 - DNA, 25 bp, Mus musculus
agcgcttttcttatgcatacaatgt

SEQ ID NO: 176738 - DNA, 25 bp, Mus musculus
agcgcttttcttttgcatacaatgt

SEQ ID NO: 176739 - DNA, 25 bp, Mus musculus
agcggaaacgcgatgtccagaggtt

SEQ ID NO: 176740 - DNA, 25 bp, Mus musculus
agcggaaacgcgttgtccagaggtt

SEQ ID NO: 176741 - DNA, 25 bp, Mus musculus
agcggaaaggcccactggcctgact

SEQ ID NO: 176742 - DNA, 25 bp, Mus musculus
agcggaaaggccgactggcctgact

SEQ ID NO: 176743 - DNA, 25 bp, Mus musculus
agcggaaccagcaatagtttctgaa

SEQ ID NO: 176744 - DNA, 25 bp, Mus musculus
agcggaaccagctatagtttctgaa

SEQ ID NO: 176745 - DNA, 25 bp, Mus musculus
agcggaacggacaacgtggctttgt

SEQ ID NO: 176746 - DNA, 25 bp, Mus musculus
agcggaacggactacgtggctttgt

SEQ ID NO: 176747 - DNA, 25 bp, Mus musculus
agcggaaggaggagctcgtagctgt

SEQ ID NO: 176748 - DNA, 25 bp, Mus musculus
agcggaaggaggtgctcgtagctgt

SEQ ID NO: 176749 - DNA, 25 bp, Mus musculus
agcggaagggagctccaacgtcttc

SEQ ID NO: 176750 - DNA, 25 bp, Mus musculus
agcggaagggaggtccaacgtcttc

SEQ ID NO: 176751 - DNA, 25 bp, Mus musculus
agcggaagttccaaccaagctttct

SEQ ID NO: 176752 - DNA, 25 bp, Mus musculus
agcggaagttcctaccaagctttct

SEQ ID NO: 176753 - DNA, 25 bp, Mus musculus
agcggaatcgccagtgtgaccttct

SEQ ID NO: 176754 - DNA, 25 bp, Mus musculus
agcggaatcgcctgtgtgaccttct

SEQ ID NO: 176755 - DNA, 25 bp, Mus musculus
agcggaattcttaacaacacttgac

SEQ ID NO: 176756 - DNA, 25 bp, Mus musculus
agcggaattctttacaacacttgac

SEQ ID NO: 176757 - DNA, 25 bp, Mus musculus
agcggacaaagaccagtgcgcaact

SEQ ID NO: 176758 - DNA, 25 bp, Mus musculus
agcggacaaagagcagtgcgcaact

SEQ ID NO: 176759 - DNA, 25 bp, Mus musculus
agcggaccacaaactgcttggagat

SEQ ID NO: 176760 - DNA, 25 bp, Mus musculus
agcggaccacaatctgcttggagat

SEQ ID NO: 176761 - DNA, 25 bp, Mus musculus
agcggactcattagctgttccatgt

SEQ ID NO: 176762 - DNA, 25 bp, Mus musculus
agcggactcatttgctgttccatgt

SEQ ID NO: 176763 - DNA, 25 bp, Mus musculus
agcggactcgacaattggtggccag

SEQ ID NO: 176764 - DNA, 25 bp, Mus musculus
agcggactcgactattggtggccag

SEQ ID NO: 176765 - DNA, 25 bp, Mus musculus
agcggactgctgaaaccaatggtga

SEQ ID NO: 176766 - DNA, 25 bp, Mus musculus
agcggactgctgtaaccaatggtga

SEQ ID NO: 176767 - DNA, 25 bp, Mus musculus
agcggacttttgagactatgcagat

SEQ ID NO: 176768 - DNA, 25 bp, Mus musculus
agcggacttttgtgactatgcagat

SEQ ID NO: 176769 - DNA, 25 bp, Mus musculus
agcggagaaataaggtacacctctt

SEQ ID NO: 176770 - DNA, 25 bp, Mus musculus
agcggagaaatatggtacacctctt

SEQ ID NO: 176771 - DNA, 25 bp, Mus musculus
agcggagaagataccttgacccaaa

SEQ ID NO: 176772 - DNA, 25 bp, Mus musculus
agcggagaagattccttgacccaaa

SEQ ID NO: 176773 - DNA, 25 bp, Mus musculus
agcggagaccttccatgatagagta

SEQ ID NO: 176774 - DNA, 25 bp, Mus musculus
agcggagaccttgcatgatagagta

SEQ ID NO: 176775 - DNA, 25 bp, Mus musculus
agcggagagattctgtgaccccttc

SEQ ID NO: 176776 - DNA, 25 bp, Mus musculus
agcggagagattgtgtgaccccttc

SEQ ID NO: 176777 - DNA, 25 bp, Mus musculus
agcggagagcacctatggaattcat

SEQ ID NO: 176778 - DNA, 25 bp, Mus musculus
agcggagagcacgtatggaattcat

SEQ ID NO: 176779 - DNA, 25 bp, Mus musculus
agcggagatccgactttgttttgga

SEQ ID NO: 176780 - DNA, 25 bp, Mus musculus
agcggagatccgtctttgttttgga

SEQ ID NO: 176781 - DNA, 25 bp, Mus musculus
agcggagcatagcagacatggcact

SEQ ID NO: 176782 - DNA, 25 bp, Mus musculus
agcggagcataggagacatggcact

SEQ ID NO: 176783 - DNA, 25 bp, Mus musculus
agcggagccctgctctacgaggaca

SEQ ID NO: 176784 - DNA, 25 bp, Mus musculus
agcggagccctggtctacgaggaca

SEQ ID NO: 176785 - DNA, 25 bp, Mus musculus
agcggagctcatagttcagtgctgg

SEQ ID NO: 176786 - DNA, 25 bp, Mus musculus
agcggagctcattgttcagtgctgg

SEQ ID NO: 176787 - DNA, 25 bp, Mus musculus
agcggaggccgcatccgtgtgatct

SEQ ID NO: 176788 - DNA, 25 bp, Mus musculus
agcggaggccgcttccgtgtgatct

SEQ ID NO: 176789 - DNA, 25 bp, Mus musculus
agcggaggctcaaggtgtctcatta

SEQ ID NO: 176790 - DNA, 25 bp, Mus musculus
agcggaggctcatggtgtctcatta

SEQ ID NO: 176791 - DNA, 25 bp, Mus musculus
agcggaggtctgatcgctaagccca

SEQ ID NO: 176792 - DNA, 25 bp, Mus musculus
agcggaggtctgttcgctaagccca

SEQ ID NO: 176793 - DNA, 25 bp, Mus musculus
agcggaggtgctagcgtaatttctt

SEQ ID NO: 176794 - DNA, 25 bp, Mus musculus
agcggaggtgctagttacatgagaa

SEQ ID NO: 176795 - DNA, 25 bp, Mus musculus
agcggaggtgcttgcgtaatttctt

SEQ ID NO: 176796 - DNA, 25 bp, Mus musculus
agcggaggtgcttgttacatgagaa

SEQ ID NO: 176797 - DNA, 25 bp, Mus musculus
agcggagtacagacacagctgccag

SEQ ID NO: 176798 - DNA, 25 bp, Mus musculus
agcggagtacagtcacagctgccag

SEQ ID NO: 176799 - DNA, 25 bp, Mus musculus
agcggagtccctctgatgtggcaca

SEQ ID NO: 176800 - DNA, 25 bp, Mus musculus
agcggagtccctgtgatgtggcaca

SEQ ID NO: 176801 - DNA, 25 bp, Mus musculus
agcggagtctctctgttacatatac

SEQ ID NO: 176802 - DNA, 25 bp, Mus musculus
agcggagtctctgtgttacatatac

SEQ ID NO: 176803 - DNA, 25 bp, Mus musculus
agcggagtgctcactggcgggaaac

SEQ ID NO: 176804 - DNA, 25 bp, Mus musculus
agcggagtgctctctggcgggaaac

SEQ ID NO: 176805 - DNA, 25 bp, Mus musculus
agcggataactcagccacaggcttt

SEQ ID NO: 176806 - DNA, 25 bp, Mus musculus
agcggataactctgccacaggcttt

SEQ ID NO: 176807 - DNA, 25 bp, Mus musculus
agcggatccattactaactcttgta

SEQ ID NO: 176808 - DNA, 25 bp, Mus musculus
agcggatccatttctaactcttgta

SEQ ID NO: 176809 - DNA, 25 bp, Mus musculus
agcggatcctatactttgtcttata

SEQ ID NO: 176810 - DNA, 25 bp, Mus musculus
agcggatcctattctttgtcttata

SEQ ID NO: 176811 - DNA, 25 bp, Mus musculus
agcggatctattcctttatttcctc

SEQ ID NO: 176812 - DNA, 25 bp, Mus musculus
agcggatctattgctttatttcctc

SEQ ID NO: 176813 - DNA, 25 bp, Mus musculus
agcggatctctgaggacgaagcctt

SEQ ID NO: 176814 - DNA, 25 bp, Mus musculus
agcggatctctgagggtttaaggcc

SEQ ID NO: 176815 - DNA, 25 bp, Mus musculus
agcggatctctgtggacgaagcctt

SEQ ID NO: 176816 - DNA, 25 bp, Mus musculus
agcggatctctgtgggtttaaggcc

SEQ ID NO: 176817 - DNA, 25 bp, Mus musculus
agcggatctgccatgctgatgttgc

SEQ ID NO: 176818 - DNA, 25 bp, Mus musculus
agcggatctgccttgctgatgttgc

SEQ ID NO: 176819 - DNA, 25 bp, Mus musculus
agcggatgaagcaacccagctctgt

SEQ ID NO: 176820 - DNA, 25 bp, Mus musculus
agcggatgaagctacccagctctgt

SEQ ID NO: 176821 - DNA, 25 bp, Mus musculus
agcggatgatgcaaactcactgtaa

SEQ ID NO: 176822 - DNA, 25 bp, Mus musculus
agcggatgatgctaactcactgtaa

SEQ ID NO: 176823 - DNA, 25 bp, Mus musculus
agcggatggtgactgactgcttcca

SEQ ID NO: 176824 - DNA, 25 bp, Mus musculus
agcggatggtgagtgactgcttcca

SEQ ID NO: 176825 - DNA, 25 bp, Mus musculus
agcggatggtttaattggtcactac

SEQ ID NO: 176826 - DNA, 25 bp, Mus musculus
agcggatggttttattggtcactac

SEQ ID NO: 176827 - DNA, 25 bp, Mus musculus
agcggattccggaagtcgccagctt

SEQ ID NO: 176828 - DNA, 25 bp, Mus musculus
agcggattccggtagtcgccagctt

SEQ ID NO: 176829 - DNA, 25 bp, Mus musculus
agcggattctgacgacgacgacgat

SEQ ID NO: 176830 - DNA, 25 bp, Mus musculus
agcggattctgaggacgacgacgat

SEQ ID NO: 176831 - DNA, 25 bp, Mus musculus
agcggattggatagcctgaggaaaa

SEQ ID NO: 176832 - DNA, 25 bp, Mus musculus
agcggattggattgcctgaggaaaa

SEQ ID NO: 176833 - DNA, 25 bp, Mus musculus
agcggattgggcctttcagaacatt

SEQ ID NO: 176834 - DNA, 25 bp, Mus musculus
agcggattgggcgtttcagaacatt

SEQ ID NO: 176835 - DNA, 25 bp, Mus musculus
agcggcaagtagacagctctgtctc

SEQ ID NO: 176836 - DNA, 25 bp, Mus musculus
agcggcaagtagtcagctctgtctc

SEQ ID NO: 176837 - DNA, 25 bp, Mus musculus
agcggcaagttgagcagactccaaa

SEQ ID NO: 176838 - DNA, 25 bp, Mus musculus
agcggcaagttgtgcagactccaaa

SEQ ID NO: 176839 - DNA, 25 bp, Mus musculus
agcggcaatactccatccttcggta

SEQ ID NO: 176840 - DNA, 25 bp, Mus musculus
agcggcaatactgcatccttcggta

SEQ ID NO: 176841 - DNA, 25 bp, Mus musculus
agcggcacagtgcatgttaagcatg

SEQ ID NO: 176842 - DNA, 25 bp, Mus musculus
agcggcacagtggatgttaagcatg

SEQ ID NO: 176843 - DNA, 25 bp, Mus musculus
agcggcaccctcaaggctggcaagg

SEQ ID NO: 176844 - DNA, 25 bp, Mus musculus
agcggcaccctctaggctggcaagg

SEQ ID NO: 176845 - DNA, 25 bp, Mus musculus
agcggcacgctcagctcggtaaggc

SEQ ID NO: 176846 - DNA, 25 bp, Mus musculus
agcggcacgctctgctcggtaaggc

SEQ ID NO: 176847 - DNA, 25 bp, Mus musculus
agcggcagaaacacatcagtaggaa

SEQ ID NO: 176848 - DNA, 25 bp, Mus musculus
agcggcagaaactcatcagtaggaa

SEQ ID NO: 176849 - DNA, 25 bp, Mus musculus
agcggcagacggcaaacagcgtatt

SEQ ID NO: 176850 - DNA, 25 bp, Mus musculus
agcggcagacgggaaacagcgtatt

SEQ ID NO: 176851 - DNA, 25 bp, Mus musculus
agcggcagactgaatcattgttgga

SEQ ID NO: 176852 - DNA, 25 bp, Mus musculus
agcggcagactgtatcattgttgga

SEQ ID NO: 176853 - DNA, 25 bp, Mus musculus
agcggcagcgctaccaagacgtgag

SEQ ID NO: 176854 - DNA, 25 bp, Mus musculus
agcggcagcgcttccaagacgtgag

SEQ ID NO: 176855 - DNA, 25 bp, Mus musculus
agcggcagcggcatgcctttatcca

SEQ ID NO: 176856 - DNA, 25 bp, Mus musculus
agcggcagcggcttgcctttatcca

SEQ ID NO: 176857 - DNA, 25 bp, Mus musculus
agcggcagctcgaataactcgcttc

SEQ ID NO: 176858 - DNA, 25 bp, Mus musculus
agcggcagctcgtataactcgcttc

SEQ ID NO: 176859 - DNA, 25 bp, Mus musculus
agcggcaggataagtccctggagct

SEQ ID NO: 176860 - DNA, 25 bp, Mus musculus
agcggcaggatatgtccctggagct

SEQ ID NO: 176861 - DNA, 25 bp, Mus musculus
agcggcaggcctccatgtatgccag

SEQ ID NO: 176862 - DNA, 25 bp, Mus musculus
agcggcaggcctgcatgtatgccag

SEQ ID NO: 176863 - DNA, 25 bp, Mus musculus
agcggcaggcgcaaagcacaacagg

SEQ ID NO: 176864 - DNA, 25 bp, Mus musculus
agcggcaggcgctaagcacaacagg

SEQ ID NO: 176865 - DNA, 25 bp, Mus musculus
agcggcaggtggatagcgttccctc

SEQ ID NO: 176866 - DNA, 25 bp, Mus musculus
agcggcaggtggttagcgttccctc

SEQ ID NO: 176867 - DNA, 25 bp, Mus musculus
agcggcaggttcaccactctggaca

SEQ ID NO: 176868 - DNA, 25 bp, Mus musculus
agcggcaggttctccactctggaca

SEQ ID NO: 176869 - DNA, 25 bp, Mus musculus
agcggcagtattctgtacagtagac

SEQ ID NO: 176870 - DNA, 25 bp, Mus musculus
agcggcagtattgtgtacagtagac

SEQ ID NO: 176871 - DNA, 25 bp, Mus musculus
agcggcagtcctattgatccagtca

SEQ ID NO: 176872 - DNA, 25 bp, Mus musculus
agcggcagtccttttgatccagtca

SEQ ID NO: 176873 - DNA, 25 bp, Mus musculus
agcggcagtgggaccttgacttgca

SEQ ID NO: 176874 - DNA, 25 bp, Mus musculus
agcggcagtgggtccttgacttgca

SEQ ID NO: 176875 - DNA, 25 bp, Mus musculus
agcggcatacctccgagtgtgacaa

SEQ ID NO: 176876 - DNA, 25 bp, Mus musculus
agcggcatacctgcgagtgtgacaa

SEQ ID NO: 176877 - DNA, 25 bp, Mus musculus
agcggcatctccaggattgagcagt

SEQ ID NO: 176878 - DNA, 25 bp, Mus musculus
agcggcatctcctggattgagcagt

SEQ ID NO: 176879 - DNA, 25 bp, Mus musculus
agcggcatctgcaatgaagtctcaa

SEQ ID NO: 176880 - DNA, 25 bp, Mus musculus
agcggcatctgcatggactccggag

SEQ ID NO: 176881 - DNA, 25 bp, Mus musculus
agcggcatctgctatgaagtctcaa

SEQ ID NO: 176882 - DNA, 25 bp, Mus musculus
agcggcatctgcttggactccggag

SEQ ID NO: 176883 - DNA, 25 bp, Mus musculus
agcggcatgcccatacggattgaaa

SEQ ID NO: 176884 - DNA, 25 bp, Mus musculus
agcggcatgcccttacggattgaaa

SEQ ID NO: 176885 - DNA, 25 bp, Mus musculus
agcggcatgcctatatccaatggca

SEQ ID NO: 176886 - DNA, 25 bp, Mus musculus
agcggcatgcctttatccaatggca

SEQ ID NO: 176887 - DNA, 25 bp, Mus musculus
agcggcatggccattattggaactt

SEQ ID NO: 176888 - DNA, 25 bp, Mus musculus
agcggcatggcctttattggaactt

SEQ ID NO: 176889 - DNA, 25 bp, Mus musculus
agcggcatggcgatgttcaggttca

SEQ ID NO: 176890 - DNA, 25 bp, Mus musculus
agcggcatggcgttgttcaggttca

SEQ ID NO: 176891 - DNA, 25 bp, Mus musculus
agcggcatttgtctggtgctcaatc

SEQ ID NO: 176892 - DNA, 25 bp, Mus musculus
agcggcatttgtgtggtgctcaatc

SEQ ID NO: 176893 - DNA, 25 bp, Mus musculus
agcggccacaaactaaccctgagca

SEQ ID NO: 176894 - DNA, 25 bp, Mus musculus
agcggccacaaagtaaccctgagca

SEQ ID NO: 176895 - DNA, 25 bp, Mus musculus
agcggccagcaacctttcagggctc

SEQ ID NO: 176896 - DNA, 25 bp, Mus musculus
agcggccagcaagctttcagggctc

SEQ ID NO: 176897 - DNA, 25 bp, Mus musculus
agcggccagtttacctgaatgcggt

SEQ ID NO: 176898 - DNA, 25 bp, Mus musculus
agcggccagttttcctgaatgcggt

SEQ ID NO: 176899 - DNA, 25 bp, Mus musculus
agcggcccacacaaagaaaggactg

SEQ ID NO: 176900 - DNA, 25 bp, Mus musculus
agcggcccacactaagaaaggactg

SEQ ID NO: 176901 - DNA, 25 bp, Mus musculus
agcggccctatacctgtgaccagtg

SEQ ID NO: 176902 - DNA, 25 bp, Mus musculus
agcggccctatagctgtgaccagtg

SEQ ID NO: 176903 - DNA, 25 bp, Mus musculus
agcggccggcgcatgcgcaacatgc

SEQ ID NO: 176904 - DNA, 25 bp, Mus musculus
agcggccggcgcttgcgcaacatgc

SEQ ID NO: 176905 - DNA, 25 bp, Mus musculus
agcggcctccatatggttactattg

SEQ ID NO: 176906 - DNA, 25 bp, Mus musculus
agcggcctccatttggttactattg

SEQ ID NO: 176907 - DNA, 25 bp, Mus musculus
agcggcctcccgagaagccaaggaa

SEQ ID NO: 176908 - DNA, 25 bp, Mus musculus
agcggcctcccgtgaagccaaggaa

SEQ ID NO: 176909 - DNA, 25 bp, Mus musculus
agcggcctccctaacagggtgagag

SEQ ID NO: 176910 - DNA, 25 bp, Mus musculus
agcggcctcccttacagggtgagag

SEQ ID NO: 176911 - DNA, 25 bp, Mus musculus
agcggcctgtccagatgactttttt

SEQ ID NO: 176912 - DNA, 25 bp, Mus musculus
agcggcctgtcctgatgactttttt

SEQ ID NO: 176913 - DNA, 25 bp, Mus musculus
agcggccttagcagagactgacggc

SEQ ID NO: 176914 - DNA, 25 bp, Mus musculus
agcggccttagctgagactgacggc

SEQ ID NO: 176915 - DNA, 25 bp, Mus musculus
agcggcctttcaaccagaagctgtt

SEQ ID NO: 176916 - DNA, 25 bp, Mus musculus
agcggcctttcatccagaagctgtt

SEQ ID NO: 176917 - DNA, 25 bp, Mus musculus
agcggcgagaatctcatggcctcct

SEQ ID NO: 176918 - DNA, 25 bp, Mus musculus
agcggcgagaatgtcatggcctcct

SEQ ID NO: 176919 - DNA, 25 bp, Mus musculus
agcggcgattcgacttccagaagta

SEQ ID NO: 176920 - DNA, 25 bp, Mus musculus
agcggcgattcgtcttccagaagta

SEQ ID NO: 176921 - DNA, 25 bp, Mus musculus
agcggcgcatcaagctgggtttcac

SEQ ID NO: 176922 - DNA, 25 bp, Mus musculus
agcggcgcatcatgctgggtttcac

SEQ ID NO: 176923 - DNA, 25 bp, Mus musculus
agcggcgccagtcgtccggattttc

SEQ ID NO: 176924 - DNA, 25 bp, Mus musculus
agcggcgccagtggtccggattttc

SEQ ID NO: 176925 - DNA, 25 bp, Mus musculus
agcggcgccgctcccttcgcccgcg

SEQ ID NO: 176926 - DNA, 25 bp, Mus musculus
agcggcgccgctgccttcgcccgcg

SEQ ID NO: 176927 - DNA, 25 bp, Mus musculus
agcggcgcgcgcacaagagcaagaa

SEQ ID NO: 176928 - DNA, 25 bp, Mus musculus
agcggcgcgcgctcaagagcaagaa

SEQ ID NO: 176929 - DNA, 25 bp, Mus musculus
agcggcgcggagcacgggctgctgc

SEQ ID NO: 176930 - DNA, 25 bp, Mus musculus
agcggcgcggaggacgggctgctgc

SEQ ID NO: 176931 - DNA, 25 bp, Mus musculus
agcggcggaccccgaacatcatgac

SEQ ID NO: 176932 - DNA, 25 bp, Mus musculus
agcggcggacccggaacatcatgac

SEQ ID NO: 176933 - DNA, 25 bp, Mus musculus
agcggcggcgtaatcattgctggaa

SEQ ID NO: 176934 - DNA, 25 bp, Mus musculus
agcggcggcgtattcattgctggaa

SEQ ID NO: 176935 - DNA, 25 bp, Mus musculus
agcggcggttccacagcatggacga

SEQ ID NO: 176936 - DNA, 25 bp, Mus musculus
agcggcggttcctcagcatggacga

SEQ ID NO: 176937 - DNA, 25 bp, Mus musculus
agcggctaccgcacagtgaagcagc

SEQ ID NO: 176938 - DNA, 25 bp, Mus musculus
agcggctaccgctcagtgaagcagc

SEQ ID NO: 176939 - DNA, 25 bp, Mus musculus
agcggctactcactggctagacaca

SEQ ID NO: 176940 - DNA, 25 bp, Mus musculus
agcggctactcagtggctagacaca

SEQ ID NO: 176941 - DNA, 25 bp, Mus musculus
agcggctagaatacgagagttttca

SEQ ID NO: 176942 - DNA, 25 bp, Mus musculus
agcggctagaattcgagagttttca

SEQ ID NO: 176943 - DNA, 25 bp, Mus musculus
agcggctagcgcctcgtaacggttc

SEQ ID NO: 176944 - DNA, 25 bp, Mus musculus
agcggctagcgcgtcgtaacggttc

SEQ ID NO: 176945 - DNA, 25 bp, Mus musculus
agcggctagtgcaatactttgttac

SEQ ID NO: 176946 - DNA, 25 bp, Mus musculus
agcggctagtgctatactttgttac

SEQ ID NO: 176947 - DNA, 25 bp, Mus musculus
agcggctcaggacccttagtaactg

SEQ ID NO: 176948 - DNA, 25 bp, Mus musculus
agcggctcaggagccttagtaactg

SEQ ID NO: 176949 - DNA, 25 bp, Mus musculus
agcggctcatgtatgttaacccttc

SEQ ID NO: 176950 - DNA, 25 bp, Mus musculus
agcggctcatgtttgttaacccttc

SEQ ID NO: 176951 - DNA, 25 bp, Mus musculus
agcggctcgaccacagaacacaagt

SEQ ID NO: 176952 - DNA, 25 bp, Mus musculus
agcggctcgacctcagaacacaagt

SEQ ID NO: 176953 - DNA, 25 bp, Mus musculus
agcggctcgggcagctgcttgaaca

SEQ ID NO: 176954 - DNA, 25 bp, Mus musculus
agcggctcgggctgctgcttgaaca

SEQ ID NO: 176955 - DNA, 25 bp, Mus musculus
agcggctctctgaactagactggat

SEQ ID NO: 176956 - DNA, 25 bp, Mus musculus
agcggctctctgtactagactggat

SEQ ID NO: 176957 - DNA, 25 bp, Mus musculus
agcggctctgccagcttaagggatc

SEQ ID NO: 176958 - DNA, 25 bp, Mus musculus
agcggctctgcctgcttaagggatc

SEQ ID NO: 176959 - DNA, 25 bp, Mus musculus
agcggctctggtctttgttttgcaa

SEQ ID NO: 176960 - DNA, 25 bp, Mus musculus
agcggctctggtgtttgttttgcaa

SEQ ID NO: 176961 - DNA, 25 bp, Mus musculus
agcggctgacctacaagatgcgctt

SEQ ID NO: 176962 - DNA, 25 bp, Mus musculus
agcggctgaccttcaagatgcgctt

SEQ ID NO: 176963 - DNA, 25 bp, Mus musculus
agcggctgactcaagatcggttaaa

SEQ ID NO: 176964 - DNA, 25 bp, Mus musculus
agcggctgactctagatcggttaaa

SEQ ID NO: 176965 - DNA, 25 bp, Mus musculus
agcggctgagtaaccatccttgaaa

SEQ ID NO: 176966 - DNA, 25 bp, Mus musculus
agcggctgagtatccatccttgaaa

SEQ ID NO: 176967 - DNA, 25 bp, Mus musculus
agcggctgcacaagcgggtcactga

SEQ ID NO: 176968 - DNA, 25 bp, Mus musculus
agcggctgcacatgcgggtcactga

SEQ ID NO: 176969 - DNA, 25 bp, Mus musculus
agcggctgcccgcaacaggatgtat

SEQ ID NO: 176970 - DNA, 25 bp, Mus musculus
agcggctgcccggaacaggatgtat

SEQ ID NO: 176971 - DNA, 25 bp, Mus musculus
agcggctggagaccctgaacaatct

SEQ ID NO: 176972 - DNA, 25 bp, Mus musculus
agcggctggagagcctgaacaatct

SEQ ID NO: 176973 - DNA, 25 bp, Mus musculus
agcggctgtaacacggcccgatact

SEQ ID NO: 176974 - DNA, 25 bp, Mus musculus
agcggctgtaactcggcccgatact

SEQ ID NO: 176975 - DNA, 25 bp, Mus musculus
agcggctgtagccttagcaaatttg

SEQ ID NO: 176976 - DNA, 25 bp, Mus musculus
agcggctgtagcgttagcaaatttg

SEQ ID NO: 176977 - DNA, 25 bp, Mus musculus
agcggcttaaagacctgttgtagta

SEQ ID NO: 176978 - DNA, 25 bp, Mus musculus
agcggcttaaagtcctgttgtagta

SEQ ID NO: 176979 - DNA, 25 bp, Mus musculus
agcggcttaggcagcgactgaccaa

SEQ ID NO: 176980 - DNA, 25 bp, Mus musculus
agcggcttaggctgcgactgaccaa

SEQ ID NO: 176981 - DNA, 25 bp, Mus musculus
agcggcttcagacacagtgtaccta

SEQ ID NO: 176982 - DNA, 25 bp, Mus musculus
agcggcttcagagacagtgtaccta

SEQ ID NO: 176983 - DNA, 25 bp, Mus musculus
agcggcttccttcgcaaggacacaa

SEQ ID NO: 176984 - DNA, 25 bp, Mus musculus
agcggcttccttggcaaggacacaa

SEQ ID NO: 176985 - DNA, 25 bp, Mus musculus
agcggcttcggaatgcttatggatc

SEQ ID NO: 176986 - DNA, 25 bp, Mus musculus
agcggcttcggattgcttatggatc

SEQ ID NO: 176987 - DNA, 25 bp, Mus musculus
agcggctttgatagtgtcctcacat

SEQ ID NO: 176988 - DNA, 25 bp, Mus musculus
agcggctttgattgtgtcctcacat

SEQ ID NO: 176989 - DNA, 25 bp, Mus musculus
agcgggaaagcaacctgaagctcct

SEQ ID NO: 176990 - DNA, 25 bp, Mus musculus
agcgggaaagcatcctgaagctcct

SEQ ID NO: 176991 - DNA, 25 bp, Mus musculus
agcgggaacaggacctgcctgcctg

SEQ ID NO: 176992 - DNA, 25 bp, Mus musculus
agcgggaacaggtcctgcctgcctg

SEQ ID NO: 176993 - DNA, 25 bp, Mus musculus
agcgggaagccaacagaggttttac

SEQ ID NO: 176994 - DNA, 25 bp, Mus musculus
agcgggaagccatcagaggttttac

SEQ ID NO: 176995 - DNA, 25 bp, Mus musculus
agcgggaagctgaatttggttgatt

SEQ ID NO: 176996 - DNA, 25 bp, Mus musculus
agcgggaagctgtatttggttgatt

SEQ ID NO: 176997 - DNA, 25 bp, Mus musculus
agcgggaatagcagtgagaaacaca

SEQ ID NO: 176998 - DNA, 25 bp, Mus musculus
agcgggaatagctgtgagaaacaca

SEQ ID NO: 176999 - DNA, 25 bp, Mus musculus
agcgggaccccaacttgtcacattt

SEQ ID NO: 177000 - DNA, 25 bp, Mus musculus
agcgggaccccatcttgtcacattt

SEQ ID NO: 177001 - DNA, 25 bp, Mus musculus
agcgggactcaaagcctggacactg

SEQ ID NO: 177002 - DNA, 25 bp, Mus musculus
agcgggactcaatgcctggacactg

SEQ ID NO: 177003 - DNA, 25 bp, Mus musculus
agcgggactgatactgtgtcttgcc

SEQ ID NO: 177004 - DNA, 25 bp, Mus musculus
agcgggactgattctgtgtcttgcc

SEQ ID NO: 177005 - DNA, 25 bp, Mus musculus
agcgggacttcgatccgggcaaatg

SEQ ID NO: 177006 - DNA, 25 bp, Mus musculus
agcgggacttcgttccgggcaaatg

SEQ ID NO: 177007 - DNA, 25 bp, Mus musculus
agcgggagaggcagtgaccactcat

SEQ ID NO: 177008 - DNA, 25 bp, Mus musculus
agcgggagaggctgtgaccactcat

SEQ ID NO: 177009 - DNA, 25 bp, Mus musculus
agcgggagcgcaaagtgcaaacgta

SEQ ID NO: 177010 - DNA, 25 bp, Mus musculus
agcgggagcgcatagtgcaaacgta

SEQ ID NO: 177011 - DNA, 25 bp, Mus musculus
agcgggagtaacaccaatgtgacca

SEQ ID NO: 177012 - DNA, 25 bp, Mus musculus
agcgggagtaactccaatgtgacca

SEQ ID NO: 177013 - DNA, 25 bp, Mus musculus
agcgggatataaccctagaagcatc

SEQ ID NO: 177014 - DNA, 25 bp, Mus musculus
agcgggatataagcctagaagcatc

SEQ ID NO: 177015 - DNA, 25 bp, Mus musculus
agcgggatctccactaggccctcgg

SEQ ID NO: 177016 - DNA, 25 bp, Mus musculus
agcgggatctcctctaggccctcgg

SEQ ID NO: 177017 - DNA, 25 bp, Mus musculus
agcgggcactccataaacttggtag

SEQ ID NO: 177018 - DNA, 25 bp, Mus musculus
agcgggcactccttaaacttggtag

SEQ ID NO: 177019 - DNA, 25 bp, Mus musculus
agcgggcagtaccagcgctcgctgg

SEQ ID NO: 177020 - DNA, 25 bp, Mus musculus
agcgggcagtacgagcgctcgctgg

SEQ ID NO: 177021 - DNA, 25 bp, Mus musculus
agcgggcagtctagggacccttcaa

SEQ ID NO: 177022 - DNA, 25 bp, Mus musculus
agcgggcagtcttgggacccttcaa

SEQ ID NO: 177023 - DNA, 25 bp, Mus musculus
agcgggcattatagctccatattgg

SEQ ID NO: 177024 - DNA, 25 bp, Mus musculus
agcgggcattattgctccatattgg

SEQ ID NO: 177025 - DNA, 25 bp, Mus musculus
agcgggccaaagaactgagcgtcat

SEQ ID NO: 177026 - DNA, 25 bp, Mus musculus
agcgggccaaagtactgagcgtcat

SEQ ID NO: 177027 - DNA, 25 bp, Mus musculus
agcgggccaccaaccatgttatcca

SEQ ID NO: 177028 - DNA, 25 bp, Mus musculus
agcgggccaccatccatgttatcca

SEQ ID NO: 177029 - DNA, 25 bp, Mus musculus
agcgggccaggtctgtctatgtaac

SEQ ID NO: 177030 - DNA, 25 bp, Mus musculus
agcgggccaggtgtgtctatgtaac

SEQ ID NO: 177031 - DNA, 25 bp, Mus musculus
agcgggcccattacaacaatcaacc

SEQ ID NO: 177032 - DNA, 25 bp, Mus musculus
agcgggcccatttcaacaatcaacc

SEQ ID NO: 177033 - DNA, 25 bp, Mus musculus
agcgggccttgaccacactactaaa

SEQ ID NO: 177034 - DNA, 25 bp, Mus musculus
agcgggccttgagcacactactaaa

SEQ ID NO: 177035 - DNA, 25 bp, Mus musculus
agcgggcctttgaacattggtatgt

SEQ ID NO: 177036 - DNA, 25 bp, Mus musculus
agcgggcctttgtacattggtatgt

SEQ ID NO: 177037 - DNA, 25 bp, Mus musculus
agcgggctcaggagtcttcccagaa

SEQ ID NO: 177038 - DNA, 25 bp, Mus musculus
agcgggctcaggtgtcttcccagaa

SEQ ID NO: 177039 - DNA, 25 bp, Mus musculus
agcgggctccatatggacatctaga

SEQ ID NO: 177040 - DNA, 25 bp, Mus musculus
agcgggctccatttggacatctaga

SEQ ID NO: 177041 - DNA, 25 bp, Mus musculus
agcgggctgggtcaagtggctcgca

SEQ ID NO: 177042 - DNA, 25 bp, Mus musculus
agcgggctgggtgaagtggctcgca

SEQ ID NO: 177043 - DNA, 25 bp, Mus musculus
agcgggctggtgaatcatgttcctc

SEQ ID NO: 177044 - DNA, 25 bp, Mus musculus
agcgggctggtgtatcatgttcctc

SEQ ID NO: 177045 - DNA, 25 bp, Mus musculus
agcgggctgtccatacaagactgat

SEQ ID NO: 177046 - DNA, 25 bp, Mus musculus
agcgggctgtccttacaagactgat

SEQ ID NO: 177047 - DNA, 25 bp, Mus musculus
agcgggctttccatattgaggagca

SEQ ID NO: 177048 - DNA, 25 bp, Mus musculus
agcgggctttccttattgaggagca

SEQ ID NO: 177049 - DNA, 25 bp, Mus musculus
agcgggtattctcgtccagggcctc

SEQ ID NO: 177050 - DNA, 25 bp, Mus musculus
agcgggtattctggtccagggcctc

SEQ ID NO: 177051 - DNA, 25 bp, Mus musculus
agcgggtcaaggagaaagaagccat

SEQ ID NO: 177052 - DNA, 25 bp, Mus musculus
agcgggtcaaggtgaaagaagccat

SEQ ID NO: 177053 - DNA, 25 bp, Mus musculus
agcgggtcagcgagctcaacttcca

SEQ ID NO: 177054 - DNA, 25 bp, Mus musculus
agcgggtcagcgtgctcaacttcca

SEQ ID NO: 177055 - DNA, 25 bp, Mus musculus
agcgggtgacctcgtgaccaagtta

SEQ ID NO: 177056 - DNA, 25 bp, Mus musculus
agcgggtgacctggtgaccaagtta

SEQ ID NO: 177057 - DNA, 25 bp, Mus musculus
agcgggtgcgtgagtactgtctcaa

SEQ ID NO: 177058 - DNA, 25 bp, Mus musculus
agcgggtgcgtgtgtactgtctcaa

SEQ ID NO: 177059 - DNA, 25 bp, Mus musculus
agcgggttctcacagctcagtgccg

SEQ ID NO: 177060 - DNA, 25 bp, Mus musculus
agcgggttctcagagctcagtgccg

SEQ ID NO: 177061 - DNA, 25 bp, Mus musculus
agcgggttgaggatcccaatactgc

SEQ ID NO: 177062 - DNA, 25 bp, Mus musculus
agcgggttgaggttcccaatactgc

SEQ ID NO: 177063 - DNA, 25 bp, Mus musculus
agcggtaaaggccacttgtcaacaa

SEQ ID NO: 177064 - DNA, 25 bp, Mus musculus
agcggtaaaggcgacttgtcaacaa

SEQ ID NO: 177065 - DNA, 25 bp, Mus musculus
agcggtacatgcaactgtgcgtgca

SEQ ID NO: 177066 - DNA, 25 bp, Mus musculus
agcggtacatgctactgtgcgtgca

SEQ ID NO: 177067 - DNA, 25 bp, Mus musculus
agcggtaccacactgagagccttca

SEQ ID NO: 177068 - DNA, 25 bp, Mus musculus
agcggtaccacagtgagagccttca

SEQ ID NO: 177069 - DNA, 25 bp, Mus musculus
agcggtagtgagatattttcctttc

SEQ ID NO: 177070 - DNA, 25 bp, Mus musculus
agcggtagtgagttattttcctttc

SEQ ID NO: 177071 - DNA, 25 bp, Mus musculus
agcggtatcgctcgaccacggatcg

SEQ ID NO: 177072 - DNA, 25 bp, Mus musculus
agcggtatcgctggaccacggatcg

SEQ ID NO: 177073 - DNA, 25 bp, Mus musculus
agcggtcaagatagcagcctgtgcc

SEQ ID NO: 177074 - DNA, 25 bp, Mus musculus
agcggtcaagattgcagcctgtgcc

SEQ ID NO: 177075 - DNA, 25 bp, Mus musculus
agcggtcaatggagtatgtcctcat

SEQ ID NO: 177076 - DNA, 25 bp, Mus musculus
agcggtcaatggtgtatgtcctcat

SEQ ID NO: 177077 - DNA, 25 bp, Mus musculus
agcggtcactgtatgtttgatttat

SEQ ID NO: 177078 - DNA, 25 bp, Mus musculus
agcggtcactgtttgtttgatttat

SEQ ID NO: 177079 - DNA, 25 bp, Mus musculus
agcggtcatatgagccagtgtgaac

SEQ ID NO: 177080 - DNA, 25 bp, Mus musculus
agcggtcatatgtgccagtgtgaac

SEQ ID NO: 177081 - DNA, 25 bp, Mus musculus
agcggtcatcaccatggtctaacat

SEQ ID NO: 177082 - DNA, 25 bp, Mus musculus
agcggtcatcacgatggtctaacat

SEQ ID NO: 177083 - DNA, 25 bp, Mus musculus
agcggtcatgacattctgtggattg

SEQ ID NO: 177084 - DNA, 25 bp, Mus musculus
agcggtcatgactttctgtggattg

SEQ ID NO: 177085 - DNA, 25 bp, Mus musculus
agcggtcattatagtgtctgtttgt

SEQ ID NO: 177086 - DNA, 25 bp, Mus musculus
agcggtcattattgtgtctgtttgt

SEQ ID NO: 177087 - DNA, 25 bp, Mus musculus
agcggtccaggacacctagagataa

SEQ ID NO: 177088 - DNA, 25 bp, Mus musculus
agcggtccaggagacctagagataa

SEQ ID NO: 177089 - DNA, 25 bp, Mus musculus
agcggtcccagtagtgttcagatgg

SEQ ID NO: 177090 - DNA, 25 bp, Mus musculus
agcggtcccagttgtgttcagatgg

SEQ ID NO: 177091 - DNA, 25 bp, Mus musculus
agcggtcccgaaccagttacacgcg

SEQ ID NO: 177092 - DNA, 25 bp, Mus musculus
agcggtcccgaagcagttacacgcg

SEQ ID NO: 177093 - DNA, 25 bp, Mus musculus
agcggtcccgtgattgactttgatt

SEQ ID NO: 177094 - DNA, 25 bp, Mus musculus
agcggtcccgtgtttgactttgatt

SEQ ID NO: 177095 - DNA, 25 bp, Mus musculus
agcggtccctgcaagagcctgtgtc

SEQ ID NO: 177096 - DNA, 25 bp, Mus musculus
agcggtccctgctagagcctgtgtc

SEQ ID NO: 177097 - DNA, 25 bp, Mus musculus
agcggtccgcacacgagtggctctt

SEQ ID NO: 177098 - DNA, 25 bp, Mus musculus
agcggtccgcactcgagtggctctt

SEQ ID NO: 177099 - DNA, 25 bp, Mus musculus
agcggtctcaagagtcccacatgct

SEQ ID NO: 177100 - DNA, 25 bp, Mus musculus
agcggtctcaagtgtcccacatgct

SEQ ID NO: 177101 - DNA, 25 bp, Mus musculus
agcggtctcatcactatgggatcac

SEQ ID NO: 177102 - DNA, 25 bp, Mus musculus
agcggtctcatctctatgggatcac

SEQ ID NO: 177103 - DNA, 25 bp, Mus musculus
agcggtctgggtcacgatatcctgt

SEQ ID NO: 177104 - DNA, 25 bp, Mus musculus
agcggtctgggtgacgatatcctgt

SEQ ID NO: 177105 - DNA, 25 bp, Mus musculus
agcggtctggtgaccctgattgtcc

SEQ ID NO: 177106 - DNA, 25 bp, Mus musculus
agcggtctggtgtccctgattgtcc

SEQ ID NO: 177107 - DNA, 25 bp, Mus musculus
agcggtgaagccagtatcctctaaa

SEQ ID NO: 177108 - DNA, 25 bp, Mus musculus
agcggtgaagcctgtatcctctaaa

SEQ ID NO: 177109 - DNA, 25 bp, Mus musculus
agcggtgatggactcattgcaacca

SEQ ID NO: 177110 - DNA, 25 bp, Mus musculus
agcggtgatggagtcattgcaacca

SEQ ID NO: 177111 - DNA, 25 bp, Mus musculus
agcggtgccttcagcacgaaacgtg

SEQ ID NO: 177112 - DNA, 25 bp, Mus musculus
agcggtgccttctgcacgaaacgtg

SEQ ID NO: 177113 - DNA, 25 bp, Mus musculus
agcggtggatgaagccattgccttt

SEQ ID NO: 177114 - DNA, 25 bp, Mus musculus
agcggtggatgatgccattgccttt

SEQ ID NO: 177115 - DNA, 25 bp, Mus musculus
agcggtggcgatccggcgggcgtga

SEQ ID NO: 177116 - DNA, 25 bp, Mus musculus
agcggtggcgatgcggcgggcgtga

SEQ ID NO: 177117 - DNA, 25 bp, Mus musculus
agcggtggcgccaatgctacgtggg

SEQ ID NO: 177118 - DNA, 25 bp, Mus musculus
agcggtggcgcctatgctacgtggg

SEQ ID NO: 177119 - DNA, 25 bp, Mus musculus
agcggtggttccatgcagcagttac

SEQ ID NO: 177120 - DNA, 25 bp, Mus musculus
agcggtggttccttgcagcagttac

SEQ ID NO: 177121 - DNA, 25 bp, Mus musculus
agcggtgtaagacctgagagctctc

SEQ ID NO: 177122 - DNA, 25 bp, Mus musculus
agcggtgtaagagctgagagctctc

SEQ ID NO: 177123 - DNA, 25 bp, Mus musculus
agcggtgtccctcatctatgtaaga

SEQ ID NO: 177124 - DNA, 25 bp, Mus musculus
agcggtgtccctgatctatgtaaga

SEQ ID NO: 177125 - DNA, 25 bp, Mus musculus
agcggtgtctataatggcagcacat

SEQ ID NO: 177126 - DNA, 25 bp, Mus musculus
agcggtgtctattatggcagcacat

SEQ ID NO: 177127 - DNA, 25 bp, Mus musculus
agcggtgtggccctgcatctctatt

SEQ ID NO: 177128 - DNA, 25 bp, Mus musculus
agcggtgtggccgtgcatctctatt

SEQ ID NO: 177129 - DNA, 25 bp, Mus musculus
agcggtgtgggcagccctccattca

SEQ ID NO: 177130 - DNA, 25 bp, Mus musculus
agcggtgtgggctgccctccattca

SEQ ID NO: 177131 - DNA, 25 bp, Mus musculus
agcggttatctcagttcctatggat

SEQ ID NO: 177132 - DNA, 25 bp, Mus musculus
agcggttatctctgttcctatggat

SEQ ID NO: 177133 - DNA, 25 bp, Mus musculus
agcggttccagacaagcccgtgaag

SEQ ID NO: 177134 - DNA, 25 bp, Mus musculus
agcggttccagagaagcccgtgaag

SEQ ID NO: 177135 - DNA, 25 bp, Mus musculus
agcggttcgctgattgtttccctga

SEQ ID NO: 177136 - DNA, 25 bp, Mus musculus
agcggttcgctgtttgtttccctga

SEQ ID NO: 177137 - DNA, 25 bp, Mus musculus
agcggttctcctccttctgttaaat

SEQ ID NO: 177138 - DNA, 25 bp, Mus musculus
agcggttctcctgcttctgttaaat

SEQ ID NO: 177139 - DNA, 25 bp, Mus musculus
agcggttgacctaggtatctccctg

SEQ ID NO: 177140 - DNA, 25 bp, Mus musculus
agcggttgacctcggcatatgacag

SEQ ID NO: 177141 - DNA, 25 bp, Mus musculus
agcggttgacctgggcatatgacag

SEQ ID NO: 177142 - DNA, 25 bp, Mus musculus
agcggttgaccttggtatctccctg

SEQ ID NO: 177143 - DNA, 25 bp, Mus musculus
agcggttgagctaatgcccattgta

SEQ ID NO: 177144 - DNA, 25 bp, Mus musculus
agcggttgagcttatgcccattgta

SEQ ID NO: 177145 - DNA, 25 bp, Mus musculus
agcggttgtttacctagcttcctga

SEQ ID NO: 177146 - DNA, 25 bp, Mus musculus
agcggttgtttagctagcttcctga

SEQ ID NO: 177147 - DNA, 25 bp, Mus musculus
agcggtttgggcatgaacatcaatt

SEQ ID NO: 177148 - DNA, 25 bp, Mus musculus
agcggtttgggcttgaacatcaatt

SEQ ID NO: 177149 - DNA, 25 bp, Mus musculus
agcggtttttcgctagtggagcaca

SEQ ID NO: 177150 - DNA, 25 bp, Mus musculus
agcggtttttcggtagtggagcaca

SEQ ID NO: 177151 - DNA, 25 bp, Mus musculus
agcgtaaactctccttttcctaaag

SEQ ID NO: 177152 - DNA, 25 bp, Mus musculus
agcgtaaactctgcttttcctaaag

SEQ ID NO: 177153 - DNA, 25 bp, Mus musculus
agcgtaaatactctgtctggattgg

SEQ ID NO: 177154 - DNA, 25 bp, Mus musculus
agcgtaaatactgtgtctggattgg

SEQ ID NO: 177155 - DNA, 25 bp, Mus musculus
agcgtaacaatcaccagtgacttcc

SEQ ID NO: 177156 - DNA, 25 bp, Mus musculus
agcgtaacaatctccagtgacttcc

SEQ ID NO: 177157 - DNA, 25 bp, Mus musculus
agcgtaatctctaggctgtttatac

SEQ ID NO: 177158 - DNA, 25 bp, Mus musculus
agcgtaatctcttggctgtttatac

SEQ ID NO: 177159 - DNA, 25 bp, Mus musculus
agcgtaccgcagaatgcaggaactt

SEQ ID NO: 177160 - DNA, 25 bp, Mus musculus
agcgtaccgcagtatgcaggaactt

SEQ ID NO: 177161 - DNA, 25 bp, Mus musculus
agcgtacctgctcctaaggttttca

SEQ ID NO: 177162 - DNA, 25 bp, Mus musculus
agcgtacctgctgctaaggttttca

SEQ ID NO: 177163 - DNA, 25 bp, Mus musculus
agcgtacgaaggactcagtggcaca

SEQ ID NO: 177164 - DNA, 25 bp, Mus musculus
agcgtacgaaggtctcagtggcaca

SEQ ID NO: 177165 - DNA, 25 bp, Mus musculus
agcgtacgagacattctggttacct

SEQ ID NO: 177166 - DNA, 25 bp, Mus musculus
agcgtacgagactttctggttacct

SEQ ID NO: 177167 - DNA, 25 bp, Mus musculus
agcgtacgttttactcctgattgtt

SEQ ID NO: 177168 - DNA, 25 bp, Mus musculus
agcgtacgtttttctcctgattgtt

SEQ ID NO: 177169 - DNA, 25 bp, Mus musculus
agcgtactctcaccactcagttggg

SEQ ID NO: 177170 - DNA, 25 bp, Mus musculus
agcgtactctcagcactcagttggg

SEQ ID NO: 177171 - DNA, 25 bp, Mus musculus
agcgtactgcttactgaatacttga

SEQ ID NO: 177172 - DNA, 25 bp, Mus musculus
agcgtactgctttctgaatacttga

SEQ ID NO: 177173 - DNA, 25 bp, Mus musculus
agcgtagagcgcctgaacctttatg

SEQ ID NO: 177174 - DNA, 25 bp, Mus musculus
agcgtagagcgcgtgaacctttatg

SEQ ID NO: 177175 - DNA, 25 bp, Mus musculus
agcgtagcactgagccgaggtcttc

SEQ ID NO: 177176 - DNA, 25 bp, Mus musculus
agcgtagcactgtgccgaggtcttc

SEQ ID NO: 177177 - DNA, 25 bp, Mus musculus
agcgtagcctacatggaccagcaga

SEQ ID NO: 177178 - DNA, 25 bp, Mus musculus
agcgtagcctacttggaccagcaga

SEQ ID NO: 177179 - DNA, 25 bp, Mus musculus
agcgtagctctaccgaccatctcag

SEQ ID NO: 177180 - DNA, 25 bp, Mus musculus
agcgtagctctagcgaccatctcag

SEQ ID NO: 177181 - DNA, 25 bp, Mus musculus
agcgtaggtaatccgggctctcccc

SEQ ID NO: 177182 - DNA, 25 bp, Mus musculus
agcgtaggtaatgcgggctctcccc

SEQ ID NO: 177183 - DNA, 25 bp, Mus musculus
agcgtatcgattactcaataaatgt

SEQ ID NO: 177184 - DNA, 25 bp, Mus musculus
agcgtatcgatttctcaataaatgt

SEQ ID NO: 177185 - DNA, 25 bp, Mus musculus
agcgtatcgcagagtgcatggccaa

SEQ ID NO: 177186 - DNA, 25 bp, Mus musculus
agcgtatcgcagtgtgcatggccaa

SEQ ID NO: 177187 - DNA, 25 bp, Mus musculus
agcgtcaagaggctcctgctggatc

SEQ ID NO: 177188 - DNA, 25 bp, Mus musculus
agcgtcaagagggtcctgctggatc

SEQ ID NO: 177189 - DNA, 25 bp, Mus musculus
agcgtcaagcggctcagcgtgctca

SEQ ID NO: 177190 - DNA, 25 bp, Mus musculus
agcgtcaagcgggtcagcgtgctca

SEQ ID NO: 177191 - DNA, 25 bp, Mus musculus
agcgtcaaggaaaggctccggcctg

SEQ ID NO: 177192 - DNA, 25 bp, Mus musculus
agcgtcaaggaatggctccggcctg

SEQ ID NO: 177193 - DNA, 25 bp, Mus musculus
agcgtcaagtgccagccttcacggg

SEQ ID NO: 177194 - DNA, 25 bp, Mus musculus
agcgtcaagtgcgagccttcacggg

SEQ ID NO: 177195 - DNA, 25 bp, Mus musculus
agcgtcacagtccagtggctactcc

SEQ ID NO: 177196 - DNA, 25 bp, Mus musculus
agcgtcacagtcgagtggctactcc

SEQ ID NO: 177197 - DNA, 25 bp, Mus musculus
agcgtcaccgctcgtggaatgcctt

SEQ ID NO: 177198 - DNA, 25 bp, Mus musculus
agcgtcaccgctggtggaatgcctt

SEQ ID NO: 177199 - DNA, 25 bp, Mus musculus
agcgtcacgacaaggattgggagca

SEQ ID NO: 177200 - DNA, 25 bp, Mus musculus
agcgtcacgacatggattgggagca

SEQ ID NO: 177201 - DNA, 25 bp, Mus musculus
agcgtcagaacaatagctgctctct

SEQ ID NO: 177202 - DNA, 25 bp, Mus musculus
agcgtcagaacattagctgctctct

SEQ ID NO: 177203 - DNA, 25 bp, Mus musculus
agcgtcagcgacagcagcggcttca

SEQ ID NO: 177204 - DNA, 25 bp, Mus musculus
agcgtcagcgactgcagcggcttca

SEQ ID NO: 177205 - DNA, 25 bp, Mus musculus
agcgtcagctacagctgggtctctt

SEQ ID NO: 177206 - DNA, 25 bp, Mus musculus
agcgtcagctactgctgggtctctt

SEQ ID NO: 177207 - DNA, 25 bp, Mus musculus
agcgtcagtccactccctggatggc

SEQ ID NO: 177208 - DNA, 25 bp, Mus musculus
agcgtcagtccagtccctggatggc

SEQ ID NO: 177209 - DNA, 25 bp, Mus musculus
agcgtcagtctccaaagctctgctt

SEQ ID NO: 177210 - DNA, 25 bp, Mus musculus
agcgtcagtctcgaaagctctgctt

SEQ ID NO: 177211 - DNA, 25 bp, Mus musculus
agcgtcagtgtgcaacgtgctccat

SEQ ID NO: 177212 - DNA, 25 bp, Mus musculus
agcgtcagtgtggaacgtgctccat

SEQ ID NO: 177213 - DNA, 25 bp, Mus musculus
agcgtcatctctcatgtgaaatctt

SEQ ID NO: 177214 - DNA, 25 bp, Mus musculus
agcgtcatctctgatgtgaaatctt

SEQ ID NO: 177215 - DNA, 25 bp, Mus musculus
agcgtcatggatccctgtcagtaga

SEQ ID NO: 177216 - DNA, 25 bp, Mus musculus
agcgtcatggatgcctgtcagtaga

SEQ ID NO: 177217 - DNA, 25 bp, Mus musculus
agcgtcattcttcaggtggtctagg

SEQ ID NO: 177218 - DNA, 25 bp, Mus musculus
agcgtcattcttgaggtggtctagg

SEQ ID NO: 177219 - DNA, 25 bp, Mus musculus
agcgtccacaagactgaggccctgt

SEQ ID NO: 177220 - DNA, 25 bp, Mus musculus
agcgtccacaagtctgaggccctgt

SEQ ID NO: 177221 - DNA, 25 bp, Mus musculus
agcgtccaccacagtgtattcaaga

SEQ ID NO: 177222 - DNA, 25 bp, Mus musculus
agcgtccaccactgtgtattcaaga

SEQ ID NO: 177223 - DNA, 25 bp, Mus musculus
agcgtccaggctcagtgtgaacaga

SEQ ID NO: 177224 - DNA, 25 bp, Mus musculus
agcgtccaggctgagtgtgaacaga

SEQ ID NO: 177225 - DNA, 25 bp, Mus musculus
agcgtccaggtccagcagcagcgat

SEQ ID NO: 177226 - DNA, 25 bp, Mus musculus
agcgtccaggtcgagcagcagcgat

SEQ ID NO: 177227 - DNA, 25 bp, Mus musculus
agcgtccattgcctgcttggcgtta

SEQ ID NO: 177228 - DNA, 25 bp, Mus musculus
agcgtccattgcgtgcttggcgtta

SEQ ID NO: 177229 - DNA, 25 bp, Mus musculus
agcgtcccactgagcaggagtttag

SEQ ID NO: 177230 - DNA, 25 bp, Mus musculus
agcgtcccactgtgcaggagtttag

SEQ ID NO: 177231 - DNA, 25 bp, Mus musculus
agcgtccccacgaggctgaagttga

SEQ ID NO: 177232 - DNA, 25 bp, Mus musculus
agcgtccccacgtggctgaagttga

SEQ ID NO: 177233 - DNA, 25 bp, Mus musculus
agcgtccccgccagctactggtggg

SEQ ID NO: 177234 - DNA, 25 bp, Mus musculus
agcgtccccgcctgctactggtggg

SEQ ID NO: 177235 - DNA, 25 bp, Mus musculus
agcgtcccgactcctgcacttgtga

SEQ ID NO: 177236 - DNA, 25 bp, Mus musculus
agcgtcccgactgctgcacttgtga

SEQ ID NO: 177237 - DNA, 25 bp, Mus musculus
agcgtccctggcattcgagagacag

SEQ ID NO: 177238 - DNA, 25 bp, Mus musculus
agcgtccctggctttcgagagacag

SEQ ID NO: 177239 - DNA, 25 bp, Mus musculus
agcgtccctgtgaatgtcggactga

SEQ ID NO: 177240 - DNA, 25 bp, Mus musculus
agcgtccctgtgtatgtcggactga

SEQ ID NO: 177241 - DNA, 25 bp, Mus musculus
agcgtcctaattactgtgtctacac

SEQ ID NO: 177242 - DNA, 25 bp, Mus musculus
agcgtcctaatttctgtgtctacac

SEQ ID NO: 177243 - DNA, 25 bp, Mus musculus
agcgtcctagagaaccttccaggtg

SEQ ID NO: 177244 - DNA, 25 bp, Mus musculus
agcgtcctagagtaccttccaggtg

SEQ ID NO: 177245 - DNA, 25 bp, Mus musculus
agcgtcctcaccatcctatggagga

SEQ ID NO: 177246 - DNA, 25 bp, Mus musculus
agcgtcctcaccttcctatggagga

SEQ ID NO: 177247 - DNA, 25 bp, Mus musculus
agcgtcctcctaatagctcagtagg

SEQ ID NO: 177248 - DNA, 25 bp, Mus musculus
agcgtcctcctattagctcagtagg

SEQ ID NO: 177249 - DNA, 25 bp, Mus musculus
agcgtcctgtgtacttgttccacaa

SEQ ID NO: 177250 - DNA, 25 bp, Mus musculus
agcgtcctgtgttcttgttccacaa

SEQ ID NO: 177251 - DNA, 25 bp, Mus musculus
agcgtcggctcaactgtttgtcctt

SEQ ID NO: 177252 - DNA, 25 bp, Mus musculus
agcgtcggctcatctgtttgtcctt

SEQ ID NO: 177253 - DNA, 25 bp, Mus musculus
agcgtcgggatcagtcagccactag

SEQ ID NO: 177254 - DNA, 25 bp, Mus musculus
agcgtcgggatctgtcagccactag

SEQ ID NO: 177255 - DNA, 25 bp, Mus musculus
agcgtcgggtgcagtcctgatcatg

SEQ ID NO: 177256 - DNA, 25 bp, Mus musculus
agcgtcgggtgctgtcctgatcatg

SEQ ID NO: 177257 - DNA, 25 bp, Mus musculus
agcgtcggtcttatgctactcgtgg

SEQ ID NO: 177258 - DNA, 25 bp, Mus musculus
agcgtcggtcttttgctactcgtgg

SEQ ID NO: 177259 - DNA, 25 bp, Mus musculus
agcgtcggtgaacctccgcgcgtca

SEQ ID NO: 177260 - DNA, 25 bp, Mus musculus
agcgtcggtgaagctccgcgcgtca

SEQ ID NO: 177261 - DNA, 25 bp, Mus musculus
agcgtcgtgcggcaatatttttagc

SEQ ID NO: 177262 - DNA, 25 bp, Mus musculus
agcgtcgtgcgggaatatttttagc

SEQ ID NO: 177263 - DNA, 25 bp, Mus musculus
agcgtcgtgtgcaaccatcagctgg

SEQ ID NO: 177264 - DNA, 25 bp, Mus musculus
agcgtcgtgtgctaccatcagctgg

SEQ ID NO: 177265 - DNA, 25 bp, Mus musculus
agcgtctcgagtacaggctgtattt

SEQ ID NO: 177266 - DNA, 25 bp, Mus musculus
agcgtctcgagttcaggctgtattt

SEQ ID NO: 177267 - DNA, 25 bp, Mus musculus
agcgtctcttccagaggtgctcaga

SEQ ID NO: 177268 - DNA, 25 bp, Mus musculus
agcgtctcttcctgaggtgctcaga

SEQ ID NO: 177269 - DNA, 25 bp, Mus musculus
agcgtctgaagcaggaccatcaata

SEQ ID NO: 177270 - DNA, 25 bp, Mus musculus
agcgtctgaagctggaccatcaata

SEQ ID NO: 177271 - DNA, 25 bp, Mus musculus
agcgtctgatcaaggcctaagttgg

SEQ ID NO: 177272 - DNA, 25 bp, Mus musculus
agcgtctgatcatggcctaagttgg

SEQ ID NO: 177273 - DNA, 25 bp, Mus musculus
agcgtctgcaaccaattacgtgaga

SEQ ID NO: 177274 - DNA, 25 bp, Mus musculus
agcgtctgcaacgaattacgtgaga

SEQ ID NO: 177275 - DNA, 25 bp, Mus musculus
agcgtctgggctctcagaagttctt

SEQ ID NO: 177276 - DNA, 25 bp, Mus musculus
agcgtctgggctgtcagaagttctt

SEQ ID NO: 177277 - DNA, 25 bp, Mus musculus
agcgtctgttctagtctgttctcga

SEQ ID NO: 177278 - DNA, 25 bp, Mus musculus
agcgtctgttcttgtctgttctcga

SEQ ID NO: 177279 - DNA, 25 bp, Mus musculus
agcgtcttaacactgctacactggt

SEQ ID NO: 177280 - DNA, 25 bp, Mus musculus
agcgtcttaacagtgctacactggt

SEQ ID NO: 177281 - DNA, 25 bp, Mus musculus
agcgtcttcaagctttccaaggtta

SEQ ID NO: 177282 - DNA, 25 bp, Mus musculus
agcgtcttcaaggtttccaaggtta

SEQ ID NO: 177283 - DNA, 25 bp, Mus musculus
agcgtcttctgcagctttaataagg

SEQ ID NO: 177284 - DNA, 25 bp, Mus musculus
agcgtcttctgctgctttaataagg

SEQ ID NO: 177285 - DNA, 25 bp, Mus musculus
agcgtctttaaactatcttctaaag

SEQ ID NO: 177286 - DNA, 25 bp, Mus musculus
agcgtctttaaagtatcttctaaag

SEQ ID NO: 177287 - DNA, 25 bp, Mus musculus
agcgtctttgtcatacctggcattt

SEQ ID NO: 177288 - DNA, 25 bp, Mus musculus
agcgtctttgtcttacctggcattt

SEQ ID NO: 177289 - DNA, 25 bp, Mus musculus
agcgtgaacaatcatgctctgctct

SEQ ID NO: 177290 - DNA, 25 bp, Mus musculus
agcgtgaacaatgatgctctgctct

SEQ ID NO: 177291 - DNA, 25 bp, Mus musculus
agcgtgaagggacctgtccagactc

SEQ ID NO: 177292 - DNA, 25 bp, Mus musculus
agcgtgaagggagctgtccagactc

SEQ ID NO: 177293 - DNA, 25 bp, Mus musculus
agcgtgacgttgaaacctggcagga

SEQ ID NO: 177294 - DNA, 25 bp, Mus musculus
agcgtgacgttgtaacctggcagga

SEQ ID NO: 177295 - DNA, 25 bp, Mus musculus
agcgtgagcaggctaagcagacctt

SEQ ID NO: 177296 - DNA, 25 bp, Mus musculus
agcgtgagcagggtaagcagacctt

SEQ ID NO: 177297 - DNA, 25 bp, Mus musculus
agcgtgagccgacaccaagccttgc

SEQ ID NO: 177298 - DNA, 25 bp, Mus musculus
agcgtgagccgagaccaagccttgc

SEQ ID NO: 177299 - DNA, 25 bp, Mus musculus
agcgtgagccgcagagactgtagaa

SEQ ID NO: 177300 - DNA, 25 bp, Mus musculus
agcgtgagccgctgagactgtagaa

SEQ ID NO: 177301 - DNA, 25 bp, Mus musculus
agcgtgagcctcaccgtgacgcaga

SEQ ID NO: 177302 - DNA, 25 bp, Mus musculus
agcgtgagcctctccgtgacgcaga

SEQ ID NO: 177303 - DNA, 25 bp, Mus musculus
agcgtgagccttcagccagttacaa

SEQ ID NO: 177304 - DNA, 25 bp, Mus musculus
agcgtgagccttgagccagttacaa

SEQ ID NO: 177305 - DNA, 25 bp, Mus musculus
agcgtgagtctcagtcctacaaact

SEQ ID NO: 177306 - DNA, 25 bp, Mus musculus
agcgtgagtctctgtcctacaaact

SEQ ID NO: 177307 - DNA, 25 bp, Mus musculus
agcgtgatagctcttagccttacat

SEQ ID NO: 177308 - DNA, 25 bp, Mus musculus
agcgtgatagctgttagccttacat

SEQ ID NO: 177309 - DNA, 25 bp, Mus musculus
agcgtgatcctaacaaaggccggga

SEQ ID NO: 177310 - DNA, 25 bp, Mus musculus
agcgtgatcctatcaaaggccggga

SEQ ID NO: 177311 - DNA, 25 bp, Mus musculus
agcgtgatcgtcatcgggagacaca

SEQ ID NO: 177312 - DNA, 25 bp, Mus musculus
agcgtgatcgtcttcgggagacaca

SEQ ID NO: 177313 - DNA, 25 bp, Mus musculus
agcgtgatgccaagactgccgagga

SEQ ID NO: 177314 - DNA, 25 bp, Mus musculus
agcgtgatgccatgactgccgagga

SEQ ID NO: 177315 - DNA, 25 bp, Mus musculus
agcgtgcaaggaattctttagcaag

SEQ ID NO: 177316 - DNA, 25 bp, Mus musculus
agcgtgcaaggatttctttagcaag

SEQ ID NO: 177317 - DNA, 25 bp, Mus musculus
agcgtgcacctgactgaacatcgga

SEQ ID NO: 177318 - DNA, 25 bp, Mus musculus
agcgtgcacctgtctgaacatcgga

SEQ ID NO: 177319 - DNA, 25 bp, Mus musculus
agcgtgcacggaagcggcggctgca

SEQ ID NO: 177320 - DNA, 25 bp, Mus musculus
agcgtgcacggatgcggcggctgca

SEQ ID NO: 177321 - DNA, 25 bp, Mus musculus
agcgtgcatctgctggagtcttttt

SEQ ID NO: 177322 - DNA, 25 bp, Mus musculus
agcgtgcatctggtggagtcttttt

SEQ ID NO: 177323 - DNA, 25 bp, Mus musculus
agcgtgccagccagacttgagtgac

SEQ ID NO: 177324 - DNA, 25 bp, Mus musculus
agcgtgccagcctgacttgagtgac

SEQ ID NO: 177325 - DNA, 25 bp, Mus musculus
agcgtgcccgggagtatatctacat

SEQ ID NO: 177326 - DNA, 25 bp, Mus musculus
agcgtgcccgggtgtatatctacat

SEQ ID NO: 177327 - DNA, 25 bp, Mus musculus
agcgtgcccgtaccagtgcatacag

SEQ ID NO: 177328 - DNA, 25 bp, Mus musculus
agcgtgcccgtagcagtgcatacag

SEQ ID NO: 177329 - DNA, 25 bp, Mus musculus
agcgtgccgcctatgcagagaatgt

SEQ ID NO: 177330 - DNA, 25 bp, Mus musculus
agcgtgccgcctttgcagagaatgt

SEQ ID NO: 177331 - DNA, 25 bp, Mus musculus
agcgtgcctctaatcgcaggcagga

SEQ ID NO: 177332 - DNA, 25 bp, Mus musculus
agcgtgcctctattcgcaggcagga

SEQ ID NO: 177333 - DNA, 25 bp, Mus musculus
agcgtgcctgacaatcatcttaatg

SEQ ID NO: 177334 - DNA, 25 bp, Mus musculus
agcgtgcctgactatcatcttaatg

SEQ ID NO: 177335 - DNA, 25 bp, Mus musculus
agcgtgcctgctagtctcttaactc

SEQ ID NO: 177336 - DNA, 25 bp, Mus musculus
agcgtgcctgcttgtctcttaactc

SEQ ID NO: 177337 - DNA, 25 bp, Mus musculus
agcgtgccttgcagttaacgatggg

SEQ ID NO: 177338 - DNA, 25 bp, Mus musculus
agcgtgccttgctgttaacgatggg

SEQ ID NO: 177339 - DNA, 25 bp, Mus musculus
agcgtgccttgtatcctgggagaga

SEQ ID NO: 177340 - DNA, 25 bp, Mus musculus
agcgtgccttgtttcctgggagaga

SEQ ID NO: 177341 - DNA, 25 bp, Mus musculus
agcgtgcgtgtgcaaacgcctcttc

SEQ ID NO: 177342 - DNA, 25 bp, Mus musculus
agcgtgcgtgtggaaacgcctcttc

SEQ ID NO: 177343 - DNA, 25 bp, Mus musculus
agcgtgctactcatgatcatctaca

SEQ ID NO: 177344 - DNA, 25 bp, Mus musculus
agcgtgctactcttgatcatctaca

SEQ ID NO: 177345 - DNA, 25 bp, Mus musculus
agcgtgctatggataccctgatttt

SEQ ID NO: 177346 - DNA, 25 bp, Mus musculus
agcgtgctatggttaccctgatttt

SEQ ID NO: 177347 - DNA, 25 bp, Mus musculus
agcgtgctcactcaaagctctcact

SEQ ID NO: 177348 - DNA, 25 bp, Mus musculus
agcgtgctcactgaaagctctcact

SEQ ID NO: 177349 - DNA, 25 bp, Mus musculus
agcgtgctcgtaaacgccgtgagga

SEQ ID NO: 177350 - DNA, 25 bp, Mus musculus
agcgtgctcgtatacgccgtgagga

SEQ ID NO: 177351 - DNA, 25 bp, Mus musculus
agcgtgctctagaggttcttgctgc

SEQ ID NO: 177352 - DNA, 25 bp, Mus musculus
agcgtgctctagtggttcttgctgc

SEQ ID NO: 177353 - DNA, 25 bp, Mus musculus
agcgtgctctgtctggatgccctga

SEQ ID NO: 177354 - DNA, 25 bp, Mus musculus
agcgtgctctgtgtggatgccctga

SEQ ID NO: 177355 - DNA, 25 bp, Mus musculus
agcgtgctgaacacgagccacatgt

SEQ ID NO: 177356 - DNA, 25 bp, Mus musculus
agcgtgctgaactcgagccacatgt

SEQ ID NO: 177357 - DNA, 25 bp, Mus musculus
agcgtgcttgaaccagcagcctgca

SEQ ID NO: 177358 - DNA, 25 bp, Mus musculus
agcgtgcttgaagcagcagcctgca

SEQ ID NO: 177359 - DNA, 25 bp, Mus musculus
agcgtgcttgagacccatgttcaga

SEQ ID NO: 177360 - DNA, 25 bp, Mus musculus
agcgtgcttgagtcccatgttcaga

SEQ ID NO: 177361 - DNA, 25 bp, Mus musculus
agcgtgctttgcaggccaatgctct

SEQ ID NO: 177362 - DNA, 25 bp, Mus musculus
agcgtgctttgctggccaatgctct

SEQ ID NO: 177363 - DNA, 25 bp, Mus musculus
agcgtgcttttcagcagagcttgat

SEQ ID NO: 177364 - DNA, 25 bp, Mus musculus
agcgtgcttttctgcagagcttgat

SEQ ID NO: 177365 - DNA, 25 bp, Mus musculus
agcgtggaacataacatccccttgg

SEQ ID NO: 177366 - DNA, 25 bp, Mus musculus
agcgtggaacattacatccccttgg

SEQ ID NO: 177367 - DNA, 25 bp, Mus musculus
agcgtggaatccataagtatgtgaa

SEQ ID NO: 177368 - DNA, 25 bp, Mus musculus
agcgtggaatccttaagtatgtgaa

SEQ ID NO: 177369 - DNA, 25 bp, Mus musculus
agcgtggaattcactcgatgtcgtc

SEQ ID NO: 177370 - DNA, 25 bp, Mus musculus
agcgtggaattctctcgatgtcgtc

SEQ ID NO: 177371 - DNA, 25 bp, Mus musculus
agcgtggaccacctagtgcagctca

SEQ ID NO: 177372 - DNA, 25 bp, Mus musculus
agcgtggaccacgtagtgcagctca

SEQ ID NO: 177373 - DNA, 25 bp, Mus musculus
agcgtggacccaacagaccagaaga

SEQ ID NO: 177374 - DNA, 25 bp, Mus musculus
agcgtggacccatcagaccagaaga

SEQ ID NO: 177375 - DNA, 25 bp, Mus musculus
agcgtggacctaaagcctctgcatt

SEQ ID NO: 177376 - DNA, 25 bp, Mus musculus
agcgtggacctatagcctctgcatt

SEQ ID NO: 177377 - DNA, 25 bp, Mus musculus
agcgtggactgactgcatcctaaat

SEQ ID NO: 177378 - DNA, 25 bp, Mus musculus
agcgtggactgagtgcatcctaaat

SEQ ID NO: 177379 - DNA, 25 bp, Mus musculus
agcgtggacttgatgcagtgacaac

SEQ ID NO: 177380 - DNA, 25 bp, Mus musculus
agcgtggacttgttgcagtgacaac

SEQ ID NO: 177381 - DNA, 25 bp, Mus musculus
agcgtggatgacaactgaccagcct

SEQ ID NO: 177382 - DNA, 25 bp, Mus musculus
agcgtggatgactactgaccagcct

SEQ ID NO: 177383 - DNA, 25 bp, Mus musculus
agcgtggccatcataggctcggctc

SEQ ID NO: 177384 - DNA, 25 bp, Mus musculus
agcgtggccatcttaggctcggctc

SEQ ID NO: 177385 - DNA, 25 bp, Mus musculus
agcgtggcgctgaggacctgataac

SEQ ID NO: 177386 - DNA, 25 bp, Mus musculus
agcgtggcgctgtggacctgataac

SEQ ID NO: 177387 - DNA, 25 bp, Mus musculus
agcgtggctagcaaagctatccttc

SEQ ID NO: 177388 - DNA, 25 bp, Mus musculus
agcgtggctagctaagctatccttc

SEQ ID NO: 177389 - DNA, 25 bp, Mus musculus
agcgtggctcgaagtggtcatgatt

SEQ ID NO: 177390 - DNA, 25 bp, Mus musculus
agcgtggctcgatgtggtcatgatt

SEQ ID NO: 177391 - DNA, 25 bp, Mus musculus
agcgtggcttcaccagcctggacac

SEQ ID NO: 177392 - DNA, 25 bp, Mus musculus
agcgtggcttcagcagcctggacac

SEQ ID NO: 177393 - DNA, 25 bp, Mus musculus
agcgtgggcatcaggccttaaagcc

SEQ ID NO: 177394 - DNA, 25 bp, Mus musculus
agcgtgggcatctggccttaaagcc

SEQ ID NO: 177395 - DNA, 25 bp, Mus musculus
agcgtgggccacaggcacagataga

SEQ ID NO: 177396 - DNA, 25 bp, Mus musculus
agcgtgggccactggcacagataga

SEQ ID NO: 177397 - DNA, 25 bp, Mus musculus
agcgtgggcctcctccattgatgcc

SEQ ID NO: 177398 - DNA, 25 bp, Mus musculus
agcgtgggcctcgtccattgatgcc

SEQ ID NO: 177399 - DNA, 25 bp, Mus musculus
agcgtgggcttcatcaacttgaggc

SEQ ID NO: 177400 - DNA, 25 bp, Mus musculus
agcgtgggcttcttcaacttgaggc

SEQ ID NO: 177401 - DNA, 25 bp, Mus musculus
agcgtgggtttcctgggaaatctca

SEQ ID NO: 177402 - DNA, 25 bp, Mus musculus
agcgtgggtttcgtgggaaatctca

SEQ ID NO: 177403 - DNA, 25 bp, Mus musculus
agcgtggtacctatgtggaccctag

SEQ ID NO: 177404 - DNA, 25 bp, Mus musculus
agcgtggtacctttgtggaccctag

SEQ ID NO: 177405 - DNA, 25 bp, Mus musculus
agcgtggtccaccatgggcgttcct

SEQ ID NO: 177406 - DNA, 25 bp, Mus musculus
agcgtggtccacgatgggcgttcct

SEQ ID NO: 177407 - DNA, 25 bp, Mus musculus
agcgtggtgcatcgctttgctgaaa

SEQ ID NO: 177408 - DNA, 25 bp, Mus musculus
agcgtggtgcatggctttgctgaaa

SEQ ID NO: 177409 - DNA, 25 bp, Mus musculus
agcgtggtgttgaagcctatattcc

SEQ ID NO: 177410 - DNA, 25 bp, Mus musculus
agcgtggtgttgtagcctatattcc

SEQ ID NO: 177411 - DNA, 25 bp, Mus musculus
agcgtgtaatgtctccccttctaca

SEQ ID NO: 177412 - DNA, 25 bp, Mus musculus
agcgtgtaatgtgtccccttctaca

SEQ ID NO: 177413 - DNA, 25 bp, Mus musculus
agcgtgtaccagaagctccgggagc

SEQ ID NO: 177414 - DNA, 25 bp, Mus musculus
agcgtgtaccagtagctccgggagc

SEQ ID NO: 177415 - DNA, 25 bp, Mus musculus
agcgtgtaccttagaatgtgagctc

SEQ ID NO: 177416 - DNA, 25 bp, Mus musculus
agcgtgtacctttgaatgtgagctc

SEQ ID NO: 177417 - DNA, 25 bp, Mus musculus
agcgtgtacgttctcaggtggacca

SEQ ID NO: 177418 - DNA, 25 bp, Mus musculus
agcgtgtacgttgtcaggtggacca

SEQ ID NO: 177419 - DNA, 25 bp, Mus musculus
agcgtgtcacaccatgggaagcaca

SEQ ID NO: 177420 - DNA, 25 bp, Mus musculus
agcgtgtcacacgatgggaagcaca

SEQ ID NO: 177421 - DNA, 25 bp, Mus musculus
agcgtgtctgacaatctgacttaat

SEQ ID NO: 177422 - DNA, 25 bp, Mus musculus
agcgtgtctgactatctgacttaat

SEQ ID NO: 177423 - DNA, 25 bp, Mus musculus
agcgtgtctggaactgcaggtgatt

SEQ ID NO: 177424 - DNA, 25 bp, Mus musculus
agcgtgtctggatctgcaggtgatt

SEQ ID NO: 177425 - DNA, 25 bp, Mus musculus
agcgtgtgaagcagcccatgttcta

SEQ ID NO: 177426 - DNA, 25 bp, Mus musculus
agcgtgtgaagctgcccatgttcta

SEQ ID NO: 177427 - DNA, 25 bp, Mus musculus
agcgtgtgactgaacatgccacctt

SEQ ID NO: 177428 - DNA, 25 bp, Mus musculus
agcgtgtgactgtacatgccacctt

SEQ ID NO: 177429 - DNA, 25 bp, Mus musculus
agcgtgtgcacaattcagaatacta

SEQ ID NO: 177430 - DNA, 25 bp, Mus musculus
agcgtgtgcacatttcagaatacta

SEQ ID NO: 177431 - DNA, 25 bp, Mus musculus
agcgtgtgcatacgtggtctctgac

SEQ ID NO: 177432 - DNA, 25 bp, Mus musculus
agcgtgtgcataggtggtctctgac

SEQ ID NO: 177433 - DNA, 25 bp, Mus musculus
agcgtgtgcctaccctgcgccggca

SEQ ID NO: 177434 - DNA, 25 bp, Mus musculus
agcgtgtgcctagcctgcgccggca

SEQ ID NO: 177435 - DNA, 25 bp, Mus musculus
agcgtgtgctaacgccttgtttgaa

SEQ ID NO: 177436 - DNA, 25 bp, Mus musculus
agcgtgtgctaaggccttgtttgaa

SEQ ID NO: 177437 - DNA, 25 bp, Mus musculus
agcgtgtggaccatccgtgtctctt

SEQ ID NO: 177438 - DNA, 25 bp, Mus musculus
agcgtgtggaccttccgtgtctctt

SEQ ID NO: 177439 - DNA, 25 bp, Mus musculus
agcgtgtgtctgaccgtacttcctg

SEQ ID NO: 177440 - DNA, 25 bp, Mus musculus
agcgtgtgtctgtccgtacttcctg

SEQ ID NO: 177441 - DNA, 25 bp, Mus musculus
agcgtgttcataccagcgttgcctg

SEQ ID NO: 177442 - DNA, 25 bp, Mus musculus
agcgtgttcatagcagcgttgcctg

SEQ ID NO: 177443 - DNA, 25 bp, Mus musculus
agcgtgttcctgacacacagtggac

SEQ ID NO: 177444 - DNA, 25 bp, Mus musculus
agcgtgttcctgtcacacagtggac

SEQ ID NO: 177445 - DNA, 25 bp, Mus musculus
agcgtgttcgagatcgagtctgcga

SEQ ID NO: 177446 - DNA, 25 bp, Mus musculus
agcgtgttcgagttcgagtctgcga

SEQ ID NO: 177447 - DNA, 25 bp, Mus musculus
agcgtgtttaccatttcctataaga

SEQ ID NO: 177448 - DNA, 25 bp, Mus musculus
agcgtgtttaccttttcctataaga

SEQ ID NO: 177449 - DNA, 25 bp, Mus musculus
agcgttaagtgccatttggagacaa

SEQ ID NO: 177450 - DNA, 25 bp, Mus musculus
agcgttaagtgcgatttggagacaa

SEQ ID NO: 177451 - DNA, 25 bp, Mus musculus
agcgttaccggcagcttggcaatag

SEQ ID NO: 177452 - DNA, 25 bp, Mus musculus
agcgttaccggctgcttggcaatag

SEQ ID NO: 177453 - DNA, 25 bp, Mus musculus
agcgttacctggagcatgtcactga

SEQ ID NO: 177454 - DNA, 25 bp, Mus musculus
agcgttacctggtgcatgtcactga

SEQ ID NO: 177455 - DNA, 25 bp, Mus musculus
agcgttactataccttttgctcttc

SEQ ID NO: 177456 - DNA, 25 bp, Mus musculus
agcgttactatagcttttgctcttc

SEQ ID NO: 177457 - DNA, 25 bp, Mus musculus
agcgttactgacctgcagtgactga

SEQ ID NO: 177458 - DNA, 25 bp, Mus musculus
agcgttactgacgtgcagtgactga

SEQ ID NO: 177459 - DNA, 25 bp, Mus musculus
agcgttagactcaaatagttttgtc

SEQ ID NO: 177460 - DNA, 25 bp, Mus musculus
agcgttagactctaatagttttgtc

SEQ ID NO: 177461 - DNA, 25 bp, Mus musculus
agcgttaggactccccacgtgagcc

SEQ ID NO: 177462 - DNA, 25 bp, Mus musculus
agcgttaggactgcccacgtgagcc

SEQ ID NO: 177463 - DNA, 25 bp, Mus musculus
agcgttatgtagcactgctgcctcc

SEQ ID NO: 177464 - DNA, 25 bp, Mus musculus
agcgttatgtaggactgctgcctcc

SEQ ID NO: 177465 - DNA, 25 bp, Mus musculus
agcgttcaaaccactctgtcaatgg

SEQ ID NO: 177466 - DNA, 25 bp, Mus musculus
agcgttcaaacctctctgtcaatgg

SEQ ID NO: 177467 - DNA, 25 bp, Mus musculus
agcgttcaacctctccacagagggt

SEQ ID NO: 177468 - DNA, 25 bp, Mus musculus
agcgttcaacctgtccacagagggt

SEQ ID NO: 177469 - DNA, 25 bp, Mus musculus
agcgttcaaggtctgcttagcctgt

SEQ ID NO: 177470 - DNA, 25 bp, Mus musculus
agcgttcaaggtgtgcttagcctgt

SEQ ID NO: 177471 - DNA, 25 bp, Mus musculus
agcgttcagaccagctcctggacat

SEQ ID NO: 177472 - DNA, 25 bp, Mus musculus
agcgttcagacctgctcctggacat

SEQ ID NO: 177473 - DNA, 25 bp, Mus musculus
agcgttcagtttaagatggcacccg

SEQ ID NO: 177474 - DNA, 25 bp, Mus musculus
agcgttcagttttagatggcacccg

SEQ ID NO: 177475 - DNA, 25 bp, Mus musculus
agcgttccatctaatgatccttctg

SEQ ID NO: 177476 - DNA, 25 bp, Mus musculus
agcgttccatcttatgatccttctg

SEQ ID NO: 177477 - DNA, 25 bp, Mus musculus
agcgttcccattagagttgctcttg

SEQ ID NO: 177478 - DNA, 25 bp, Mus musculus
agcgttcccatttgagttgctcttg

SEQ ID NO: 177479 - DNA, 25 bp, Mus musculus
agcgttcgtcatacacaagatggat

SEQ ID NO: 177480 - DNA, 25 bp, Mus musculus
agcgttcgtcattcacaagatggat

SEQ ID NO: 177481 - DNA, 25 bp, Mus musculus
agcgttcgtgcccaatgatggctgc

SEQ ID NO: 177482 - DNA, 25 bp, Mus musculus
agcgttcgtgccgaatgatggctgc

SEQ ID NO: 177483 - DNA, 25 bp, Mus musculus
agcgttctacgtctatagttctcca

SEQ ID NO: 177484 - DNA, 25 bp, Mus musculus
agcgttctacgtgtatagttctcca

SEQ ID NO: 177485 - DNA, 25 bp, Mus musculus
agcgttctagaaacatctggcatct

SEQ ID NO: 177486 - DNA, 25 bp, Mus musculus
agcgttctagaatcatctggcatct

SEQ ID NO: 177487 - DNA, 25 bp, Mus musculus
agcgttctgacgcaggctctgagca

SEQ ID NO: 177488 - DNA, 25 bp, Mus musculus
agcgttctgacggaggctctgagca

SEQ ID NO: 177489 - DNA, 25 bp, Mus musculus
agcgttctgcaaccttctcatagat

SEQ ID NO: 177490 - DNA, 25 bp, Mus musculus
agcgttctgcaagcttctcatagat

SEQ ID NO: 177491 - DNA, 25 bp, Mus musculus
agcgttctggtcacacttgatggta

SEQ ID NO: 177492 - DNA, 25 bp, Mus musculus
agcgttctggtctcacttgatggta

SEQ ID NO: 177493 - DNA, 25 bp, Mus musculus
agcgttgacccactgagtctttaag

SEQ ID NO: 177494 - DNA, 25 bp, Mus musculus
agcgttgacccagtgagtctttaag

SEQ ID NO: 177495 - DNA, 25 bp, Mus musculus
agcgttgacttacgtgctccactag

SEQ ID NO: 177496 - DNA, 25 bp, Mus musculus
agcgttgacttaggtgctccactag

SEQ ID NO: 177497 - DNA, 25 bp, Mus musculus
agcgttgattttaatgaagccatgg

SEQ ID NO: 177498 - DNA, 25 bp, Mus musculus
agcgttgatttttatgaagccatgg

SEQ ID NO: 177499 - DNA, 25 bp, Mus musculus
agcgttgccttccatcctgatggca

SEQ ID NO: 177500 - DNA, 25 bp, Mus musculus
agcgttgccttcgatcctgatggca

SEQ ID NO: 177501 - DNA, 25 bp, Mus musculus
agcgttgcttaaaaccagctgtgat

SEQ ID NO: 177502 - DNA, 25 bp, Mus musculus
agcgttgcttaataccagctgtgat

SEQ ID NO: 177503 - DNA, 25 bp, Mus musculus
agcgttgggaaccacggctgttaca

SEQ ID NO: 177504 - DNA, 25 bp, Mus musculus
agcgttgggaacgacggctgttaca

SEQ ID NO: 177505 - DNA, 25 bp, Mus musculus
agcgttggtaggcaaactcccagga

SEQ ID NO: 177506 - DNA, 25 bp, Mus musculus
agcgttggtagggaaactcccagga

SEQ ID NO: 177507 - DNA, 25 bp, Mus musculus
agcgttggtttgatccctgtcttag

SEQ ID NO: 177508 - DNA, 25 bp, Mus musculus
agcgttggtttgttccctgtcttag

SEQ ID NO: 177509 - DNA, 25 bp, Mus musculus
agcgttgtagaaagcggtgcgctct

SEQ ID NO: 177510 - DNA, 25 bp, Mus musculus
agcgttgtagaatgcggtgcgctct

SEQ ID NO: 177511 - DNA, 25 bp, Mus musculus
agcgttgtcgctacttcctgtttgt

SEQ ID NO: 177512 - DNA, 25 bp, Mus musculus
agcgttgtcgcttcttcctgtttgt

SEQ ID NO: 177513 - DNA, 25 bp, Mus musculus
agcgtttagatgaagaagagttcca

SEQ ID NO: 177514 - DNA, 25 bp, Mus musculus
agcgtttagatgtagaagagttcca

SEQ ID NO: 177515 - DNA, 25 bp, Mus musculus
agcgtttaggctcggtgcacgcctc

SEQ ID NO: 177516 - DNA, 25 bp, Mus musculus
agcgtttaggctgggtgcacgcctc

SEQ ID NO: 177517 - DNA, 25 bp, Mus musculus
agcgtttcaataacacatgtgggta

SEQ ID NO: 177518 - DNA, 25 bp, Mus musculus
agcgtttcaatatcacatgtgggta

SEQ ID NO: 177519 - DNA, 25 bp, Mus musculus
agcgtttcagccacacacaaagaga

SEQ ID NO: 177520 - DNA, 25 bp, Mus musculus
agcgtttcagcctcacacaaagaga

SEQ ID NO: 177521 - DNA, 25 bp, Mus musculus
agcgtttccaccaggatgtgcgcaa

SEQ ID NO: 177522 - DNA, 25 bp, Mus musculus
agcgtttccacctggatgtgcgcaa

SEQ ID NO: 177523 - DNA, 25 bp, Mus musculus
agcgtttcctccctgaattgaagta

SEQ ID NO: 177524 - DNA, 25 bp, Mus musculus
agcgtttcctccgtgaattgaagta

SEQ ID NO: 177525 - DNA, 25 bp, Mus musculus
agcgtttctggaatcgctcttttct

SEQ ID NO: 177526 - DNA, 25 bp, Mus musculus
agcgtttctggattcgctcttttct

SEQ ID NO: 177527 - DNA, 25 bp, Mus musculus
agcgtttcttccctaagtctgaact

SEQ ID NO: 177528 - DNA, 25 bp, Mus musculus
agcgtttcttccgtaagtctgaact

SEQ ID NO: 177529 - DNA, 25 bp, Mus musculus
agcgtttcttctagaccaagtcaca

SEQ ID NO: 177530 - DNA, 25 bp, Mus musculus
agcgtttcttcttgaccaagtcaca

SEQ ID NO: 177531 - DNA, 25 bp, Mus musculus
agcgtttgcaggacgcagacccagg

SEQ ID NO: 177532 - DNA, 25 bp, Mus musculus
agcgtttgcaggtcgcagacccagg

SEQ ID NO: 177533 - DNA, 25 bp, Mus musculus
agcgtttgccatcttttgggcacac

SEQ ID NO: 177534 - DNA, 25 bp, Mus musculus
agcgtttgccatgttttgggcacac

SEQ ID NO: 177535 - DNA, 25 bp, Mus musculus
agcgtttggcgcacgcgacgcgcta

SEQ ID NO: 177536 - DNA, 25 bp, Mus musculus
agcgtttggcgctcgcgacgcgcta

SEQ ID NO: 177537 - DNA, 25 bp, Mus musculus
agcgtttggtacctgcctcctatga

SEQ ID NO: 177538 - DNA, 25 bp, Mus musculus
agcgtttggtacgtgcctcctatga

SEQ ID NO: 177539 - DNA, 25 bp, Mus musculus
agcgtttgtaatctggcattcccag

SEQ ID NO: 177540 - DNA, 25 bp, Mus musculus
agcgtttgtaatgtggcattcccag

SEQ ID NO: 177541 - DNA, 25 bp, Mus musculus
agcgtttgttccagtcacatggtgc

SEQ ID NO: 177542 - DNA, 25 bp, Mus musculus
agcgtttgttcctgtcacatggtgc

SEQ ID NO: 177543 - DNA, 25 bp, Mus musculus
agcgttttcagcacatactaggccc

SEQ ID NO: 177544 - DNA, 25 bp, Mus musculus
agcgttttcagctcatactaggccc

SEQ ID NO: 177545 - DNA, 25 bp, Mus musculus
agcgttttgtacaccttccactgac

SEQ ID NO: 177546 - DNA, 25 bp, Mus musculus
agcgttttgtactccttccactgac

SEQ ID NO: 177547 - DNA, 25 bp, Mus musculus
agctaaaaatctcttcttcccttgg

SEQ ID NO: 177548 - DNA, 25 bp, Mus musculus
agctaaaaatctgttcttcccttgg

SEQ ID NO: 177549 - DNA, 25 bp, Mus musculus
agctaaaaccttatggtgcctctgt

SEQ ID NO: 177550 - DNA, 25 bp, Mus musculus
agctaaaaccttttggtgcctctgt

SEQ ID NO: 177551 - DNA, 25 bp, Mus musculus
agctaaaagagcaggcagccgccgg

SEQ ID NO: 177552 - DNA, 25 bp, Mus musculus
agctaaaagagctggcagccgccgg

SEQ ID NO: 177553 - DNA, 25 bp, Mus musculus
agctaaaagcatctgctgcacacct

SEQ ID NO: 177554 - DNA, 25 bp, Mus musculus
agctaaaagcatgtgctgcacacct

SEQ ID NO: 177555 - DNA, 25 bp, Mus musculus
agctaaaagccaatctctgactcag

SEQ ID NO: 177556 - DNA, 25 bp, Mus musculus
agctaaaagccattctctgactcag

SEQ ID NO: 177557 - DNA, 25 bp, Mus musculus
agctaaaagccccttgccttatgta

SEQ ID NO: 177558 - DNA, 25 bp, Mus musculus
agctaaaagcccgttgccttatgta

SEQ ID NO: 177559 - DNA, 25 bp, Mus musculus
agctaaaaggctccttggattcccc

SEQ ID NO: 177560 - DNA, 25 bp, Mus musculus
agctaaaaggctgcttggattcccc

SEQ ID NO: 177561 - DNA, 25 bp, Mus musculus
agctaaaagtcaagttcgagttttt

SEQ ID NO: 177562 - DNA, 25 bp, Mus musculus
agctaaaagtcatgttcgagttttt

SEQ ID NO: 177563 - DNA, 25 bp, Mus musculus
agctaaaatagtattgctccaaccc

SEQ ID NO: 177564 - DNA, 25 bp, Mus musculus
agctaaaatagttttgctccaaccc

SEQ ID NO: 177565 - DNA, 25 bp, Mus musculus
agctaaaatcggaaacatcgtttct

SEQ ID NO: 177566 - DNA, 25 bp, Mus musculus
agctaaaatcggtaacatcgtttct

SEQ ID NO: 177567 - DNA, 25 bp, Mus musculus
agctaaaatgctacagtctcaaatt

SEQ ID NO: 177568 - DNA, 25 bp, Mus musculus
agctaaaatgcttcagtctcaaatt

SEQ ID NO: 177569 - DNA, 25 bp, Mus musculus
agctaaacacatctcctctggtaaa

SEQ ID NO: 177570 - DNA, 25 bp, Mus musculus
agctaaacacatgtcctctggtaaa

SEQ ID NO: 177571 - DNA, 25 bp, Mus musculus
agctaaacaccaatggccactatga

SEQ ID NO: 177572 - DNA, 25 bp, Mus musculus
agctaaacaccattggccactatga

SEQ ID NO: 177573 - DNA, 25 bp, Mus musculus
agctaaacattcatcgatcatcggt

SEQ ID NO: 177574 - DNA, 25 bp, Mus musculus
agctaaacattcttcgatcatcggt

SEQ ID NO: 177575 - DNA, 25 bp, Mus musculus
agctaaacctagctaagcccatgcc

SEQ ID NO: 177576 - DNA, 25 bp, Mus musculus
agctaaacctaggtaagcccatgcc

SEQ ID NO: 177577 - DNA, 25 bp, Mus musculus
agctaaactcgcacaatctgtcttt

SEQ ID NO: 177578 - DNA, 25 bp, Mus musculus
agctaaactcgctcaatctgtcttt

SEQ ID NO: 177579 - DNA, 25 bp, Mus musculus
agctaaagcagccaacactcctagg

SEQ ID NO: 177580 - DNA, 25 bp, Mus musculus
agctaaagcagcgaacactcctagg

SEQ ID NO: 177581 - DNA, 25 bp, Mus musculus
agctaaagcttgagttgttttccca

SEQ ID NO: 177582 - DNA, 25 bp, Mus musculus
agctaaagcttgtgttgttttccca

SEQ ID NO: 177583 - DNA, 25 bp, Mus musculus
agctaaaggtctacgggcccctcat

SEQ ID NO: 177584 - DNA, 25 bp, Mus musculus
agctaaaggtcttcgggcccctcat

SEQ ID NO: 177585 - DNA, 25 bp, Mus musculus
agctaaataaatccaagaggtgttt

SEQ ID NO: 177586 - DNA, 25 bp, Mus musculus
agctaaataaatgcaagaggtgttt

SEQ ID NO: 177587 - DNA, 25 bp, Mus musculus
agctaaatgcatagggtaccaccca

SEQ ID NO: 177588 - DNA, 25 bp, Mus musculus
agctaaatgcattgggtaccaccca

SEQ ID NO: 177589 - DNA, 25 bp, Mus musculus
agctaaatgtctccactaggtgcaa

SEQ ID NO: 177590 - DNA, 25 bp, Mus musculus
agctaaatgtctgcactaggtgcaa

SEQ ID NO: 177591 - DNA, 25 bp, Mus musculus
agctaacaggtcagtgtgtgacaca

SEQ ID NO: 177592 - DNA, 25 bp, Mus musculus
agctaacaggtctgtgtgtgacaca

SEQ ID NO: 177593 - DNA, 25 bp, Mus musculus
agctaacattacattgcattccata

SEQ ID NO: 177594 - DNA, 25 bp, Mus musculus
agctaacattactttgcattccata

SEQ ID NO: 177595 - DNA, 25 bp, Mus musculus
agctaaccagctatgagaagccctt

SEQ ID NO: 177596 - DNA, 25 bp, Mus musculus
agctaaccagctttgagaagccctt

SEQ ID NO: 177597 - DNA, 25 bp, Mus musculus
agctaacctaggatggatgcacatt

SEQ ID NO: 177598 - DNA, 25 bp, Mus musculus
agctaacctaggctttggcggctga

SEQ ID NO: 177599 - DNA, 25 bp, Mus musculus
agctaacctagggtttggcggctga

SEQ ID NO: 177600 - DNA, 25 bp, Mus musculus
agctaacctaggttggatgcacatt

SEQ ID NO: 177601 - DNA, 25 bp, Mus musculus
agctaacctcccaagaatacagtca

SEQ ID NO: 177602 - DNA, 25 bp, Mus musculus
agctaacctccctagaatacagtca

SEQ ID NO: 177603 - DNA, 25 bp, Mus musculus
agctaacctgtaatcctgcttcaga

SEQ ID NO: 177604 - DNA, 25 bp, Mus musculus
agctaacctgtattcctgcttcaga

SEQ ID NO: 177605 - DNA, 25 bp, Mus musculus
agctaacggataaccccaaacactt

SEQ ID NO: 177606 - DNA, 25 bp, Mus musculus
agctaacggatatccccaaacactt

SEQ ID NO: 177607 - DNA, 25 bp, Mus musculus
agctaacgttccagcttgagcccaa

SEQ ID NO: 177608 - DNA, 25 bp, Mus musculus
agctaacgttcctgcttgagcccaa

SEQ ID NO: 177609 - DNA, 25 bp, Mus musculus
agctaactatgtactttgttcctga

SEQ ID NO: 177610 - DNA, 25 bp, Mus musculus
agctaactatgttctttgttcctga

SEQ ID NO: 177611 - DNA, 25 bp, Mus musculus
agctaactccaaaggtggcttcact

SEQ ID NO: 177612 - DNA, 25 bp, Mus musculus
agctaactccaaattttcatcttta

SEQ ID NO: 177613 - DNA, 25 bp, Mus musculus
agctaactccaatggtggcttcact

SEQ ID NO: 177614 - DNA, 25 bp, Mus musculus
agctaactccaatttttcatcttta

SEQ ID NO: 177615 - DNA, 25 bp, Mus musculus
agctaactctagatgatgacttcaa

SEQ ID NO: 177616 - DNA, 25 bp, Mus musculus
agctaactctagttgatgacttcaa

SEQ ID NO: 177617 - DNA, 25 bp, Mus musculus
agctaactctttccacggtgtgtgt

SEQ ID NO: 177618 - DNA, 25 bp, Mus musculus
agctaactctttgcacggtgtgtgt

SEQ ID NO: 177619 - DNA, 25 bp, Mus musculus
agctaactgcctctgtaacctgtaa

SEQ ID NO: 177620 - DNA, 25 bp, Mus musculus
agctaactgcctgtgtaacctgtaa

SEQ ID NO: 177621 - DNA, 25 bp, Mus musculus
agctaactgctgcttctatactgaa

SEQ ID NO: 177622 - DNA, 25 bp, Mus musculus
agctaactgctggttctatactgaa

SEQ ID NO: 177623 - DNA, 25 bp, Mus musculus
agctaacttagcctactcagtgtat

SEQ ID NO: 177624 - DNA, 25 bp, Mus musculus
agctaacttagcgtactcagtgtat

SEQ ID NO: 177625 - DNA, 25 bp, Mus musculus
agctaacttgctaggaatttgttaa

SEQ ID NO: 177626 - DNA, 25 bp, Mus musculus
agctaacttgcttggaatttgttaa

SEQ ID NO: 177627 - DNA, 25 bp, Mus musculus
agctaacttgtgatatggctccata

SEQ ID NO: 177628 - DNA, 25 bp, Mus musculus
agctaacttgtgttatggctccata

SEQ ID NO: 177629 - DNA, 25 bp, Mus musculus
agctaagaagatagagatcggcgat

SEQ ID NO: 177630 - DNA, 25 bp, Mus musculus
agctaagaagattgagatcggcgat

SEQ ID NO: 177631 - DNA, 25 bp, Mus musculus
agctaagactcaccctatggtcgcc

SEQ ID NO: 177632 - DNA, 25 bp, Mus musculus
agctaagactcagcctatggtcgcc

SEQ ID NO: 177633 - DNA, 25 bp, Mus musculus
agctaagactctatgggttacaata

SEQ ID NO: 177634 - DNA, 25 bp, Mus musculus
agctaagactctttgggttacaata

SEQ ID NO: 177635 - DNA, 25 bp, Mus musculus
agctaagactttcctgacttccgta

SEQ ID NO: 177636 - DNA, 25 bp, Mus musculus
agctaagactttgctgacttccgta

SEQ ID NO: 177637 - DNA, 25 bp, Mus musculus
agctaagagcatatgtcctgatgat

SEQ ID NO: 177638 - DNA, 25 bp, Mus musculus
agctaagagcatttgtcctgatgat

SEQ ID NO: 177639 - DNA, 25 bp, Mus musculus
agctaagagccccaagaaggcaaag

SEQ ID NO: 177640 - DNA, 25 bp, Mus musculus
agctaagagcccgaagaaggcaaag

SEQ ID NO: 177641 - DNA, 25 bp, Mus musculus
agctaagatcatctgctgtgcaaac

SEQ ID NO: 177642 - DNA, 25 bp, Mus musculus
agctaagatcatgtgctgtgcaaac

SEQ ID NO: 177643 - DNA, 25 bp, Mus musculus
agctaagatgacagccacttgctgt

SEQ ID NO: 177644 - DNA, 25 bp, Mus musculus
agctaagatgactgccacttgctgt

SEQ ID NO: 177645 - DNA, 25 bp, Mus musculus
agctaagcagttatgatgcttgctg

SEQ ID NO: 177646 - DNA, 25 bp, Mus musculus
agctaagcagttttgatgcttgctg

SEQ ID NO: 177647 - DNA, 25 bp, Mus musculus
agctaagcatcaaaactgggctctt

SEQ ID NO: 177648 - DNA, 25 bp, Mus musculus
agctaagcatcataactgggctctt

SEQ ID NO: 177649 - DNA, 25 bp, Mus musculus
agctaagcccacatcttcatcttca

SEQ ID NO: 177650 - DNA, 25 bp, Mus musculus
agctaagcccacttcttcatcttca

SEQ ID NO: 177651 - DNA, 25 bp, Mus musculus
agctaagccctgaattgtgcatatc

SEQ ID NO: 177652 - DNA, 25 bp, Mus musculus
agctaagccctgtattgtgcatatc

SEQ ID NO: 177653 - DNA, 25 bp, Mus musculus
agctaagcctgtctgcagcatcagt

SEQ ID NO: 177654 - DNA, 25 bp, Mus musculus
agctaagcctgtgtgcagcatcagt

SEQ ID NO: 177655 - DNA, 25 bp, Mus musculus
agctaagctagcactgctgctgcag

SEQ ID NO: 177656 - DNA, 25 bp, Mus musculus
agctaagctagctctgctgctgcag

SEQ ID NO: 177657 - DNA, 25 bp, Mus musculus
agctaagctcagcttttgttttggg

SEQ ID NO: 177658 - DNA, 25 bp, Mus musculus
agctaagctcaggttttgttttggg

SEQ ID NO: 177659 - DNA, 25 bp, Mus musculus
agctaagctctcaaagctggcctgg

SEQ ID NO: 177660 - DNA, 25 bp, Mus musculus
agctaagctctctaagctggcctgg

SEQ ID NO: 177661 - DNA, 25 bp, Mus musculus
agctaagctcttcgactccacgact

SEQ ID NO: 177662 - DNA, 25 bp, Mus musculus
agctaagctcttggactccacgact

SEQ ID NO: 177663 - DNA, 25 bp, Mus musculus
agctaagctggcaggacgacctcat

SEQ ID NO: 177664 - DNA, 25 bp, Mus musculus
agctaagctggctggacgacctcat

SEQ ID NO: 177665 - DNA, 25 bp, Mus musculus
agctaagctgtcctgcggtttctgc

SEQ ID NO: 177666 - DNA, 25 bp, Mus musculus
agctaagctgtcgtgcggtttctgc

SEQ ID NO: 177667 - DNA, 25 bp, Mus musculus
agctaaggaccaaagattccagtac

SEQ ID NO: 177668 - DNA, 25 bp, Mus musculus
agctaaggaccatagattccagtac

SEQ ID NO: 177669 - DNA, 25 bp, Mus musculus
agctaaggcagaagggccagttcaa

SEQ ID NO: 177670 - DNA, 25 bp, Mus musculus
agctaaggcagatgggccagttcaa

SEQ ID NO: 177671 - DNA, 25 bp, Mus musculus
agctaaggctgacttggaagactca

SEQ ID NO: 177672 - DNA, 25 bp, Mus musculus
agctaaggctgagttggaagactca

SEQ ID NO: 177673 - DNA, 25 bp, Mus musculus
agctaaggtatccttctcttgggct

SEQ ID NO: 177674 - DNA, 25 bp, Mus musculus
agctaaggtatcgttctcttgggct

SEQ ID NO: 177675 - DNA, 25 bp, Mus musculus
agctaaggtgatcacttcatttgga

SEQ ID NO: 177676 - DNA, 25 bp, Mus musculus
agctaaggtgatgacttcatttgga

SEQ ID NO: 177677 - DNA, 25 bp, Mus musculus
agctaaggtgtacccctcttggctg

SEQ ID NO: 177678 - DNA, 25 bp, Mus musculus
agctaaggtgtagccctcttggctg

SEQ ID NO: 177679 - DNA, 25 bp, Mus musculus
agctaagtaaccatctgctaccaac

SEQ ID NO: 177680 - DNA, 25 bp, Mus musculus
agctaagtaaccttctgctaccaac

SEQ ID NO: 177681 - DNA, 25 bp, Mus musculus
agctaagtagcccagagtgccatcc

SEQ ID NO: 177682 - DNA, 25 bp, Mus musculus
agctaagtagccgagagtgccatcc

SEQ ID NO: 177683 - DNA, 25 bp, Mus musculus
agctaagtattgcaccgtgacttta

SEQ ID NO: 177684 - DNA, 25 bp, Mus musculus
agctaagtattggaccgtgacttta

SEQ ID NO: 177685 - DNA, 25 bp, Mus musculus
agctaagtcattactagatcctgaa

SEQ ID NO: 177686 - DNA, 25 bp, Mus musculus
agctaagtcatttctagatcctgaa

SEQ ID NO: 177687 - DNA, 25 bp, Mus musculus
agctaagtgaagaccccattgtgga

SEQ ID NO: 177688 - DNA, 25 bp, Mus musculus
agctaagtgaagtccccattgtgga

SEQ ID NO: 177689 - DNA, 25 bp, Mus musculus
agctaagtgagccagggtatgaata

SEQ ID NO: 177690 - DNA, 25 bp, Mus musculus
agctaagtgagcgagggtatgaata

SEQ ID NO: 177691 - DNA, 25 bp, Mus musculus
agctaagtgctcagacctatctaca

SEQ ID NO: 177692 - DNA, 25 bp, Mus musculus
agctaagtgctctgacctatctaca

SEQ ID NO: 177693 - DNA, 25 bp, Mus musculus
agctaagtggaacgcagttgtgttt

SEQ ID NO: 177694 - DNA, 25 bp, Mus musculus
agctaagtggaaggcagttgtgttt

SEQ ID NO: 177695 - DNA, 25 bp, Mus musculus
agctaagtgtctccgaggcccgaga

SEQ ID NO: 177696 - DNA, 25 bp, Mus musculus
agctaagtgtctgcgaggcccgaga

SEQ ID NO: 177697 - DNA, 25 bp, Mus musculus
agctaataaaccatacctcacctta

SEQ ID NO: 177698 - DNA, 25 bp, Mus musculus
agctaataaaccttacctcacctta

SEQ ID NO: 177699 - DNA, 25 bp, Mus musculus
agctaatacccaaggcactgcagcg

SEQ ID NO: 177700 - DNA, 25 bp, Mus musculus
agctaatacccatggcactgcagcg

SEQ ID NO: 177701 - DNA, 25 bp, Mus musculus
agctaatcagataggcctcagaaaa

SEQ ID NO: 177702 - DNA, 25 bp, Mus musculus
agctaatcagattggcctcagaaaa

SEQ ID NO: 177703 - DNA, 25 bp, Mus musculus
agctaatcatggatattttgggaaa

SEQ ID NO: 177704 - DNA, 25 bp, Mus musculus
agctaatcatggttattttgggaaa

SEQ ID NO: 177705 - DNA, 25 bp, Mus musculus
agctaatccgcactgccaagtggaa

SEQ ID NO: 177706 - DNA, 25 bp, Mus musculus
agctaatccgcagtgccaagtggaa

SEQ ID NO: 177707 - DNA, 25 bp, Mus musculus
agctaatcgcggagattggagacga

SEQ ID NO: 177708 - DNA, 25 bp, Mus musculus
agctaatcgcggtgattggagacga

SEQ ID NO: 177709 - DNA, 25 bp, Mus musculus
agctaatctcctccatgaccgaggt

SEQ ID NO: 177710 - DNA, 25 bp, Mus musculus
agctaatctcctgcatgaccgaggt

SEQ ID NO: 177711 - DNA, 25 bp, Mus musculus
agctaatgacatctccccgggaaat

SEQ ID NO: 177712 - DNA, 25 bp, Mus musculus
agctaatgacatgtccccgggaaat

SEQ ID NO: 177713 - DNA, 25 bp, Mus musculus
agctaatgagctctgcctcatcgtg

SEQ ID NO: 177714 - DNA, 25 bp, Mus musculus
agctaatgagctgtgcctcatcgtg

SEQ ID NO: 177715 - DNA, 25 bp, Mus musculus
agctaatgctcgctgccctggtcac

SEQ ID NO: 177716 - DNA, 25 bp, Mus musculus
agctaatgctcggtgccctggtcac

SEQ ID NO: 177717 - DNA, 25 bp, Mus musculus
agctaatggctaagttctttttgga

SEQ ID NO: 177718 - DNA, 25 bp, Mus musculus
agctaatggctatgttctttttgga

SEQ ID NO: 177719 - DNA, 25 bp, Mus musculus
agctaatgggtcagtgggttctttt

SEQ ID NO: 177720 - DNA, 25 bp, Mus musculus
agctaatgggtctgtgggttctttt

SEQ ID NO: 177721 - DNA, 25 bp, Mus musculus
agctaatgggtgatgtggccgcact

SEQ ID NO: 177722 - DNA, 25 bp, Mus musculus
agctaatgggtgttgtggccgcact

SEQ ID NO: 177723 - DNA, 25 bp, Mus musculus
agctaattcttgacctgtgattgtg

SEQ ID NO: 177724 - DNA, 25 bp, Mus musculus
agctaattcttgtcctgtgattgtg

SEQ ID NO: 177725 - DNA, 25 bp, Mus musculus
agctaattggcaaacttattgacca

SEQ ID NO: 177726 - DNA, 25 bp, Mus musculus
agctaattggcatacttattgacca

SEQ ID NO: 177727 - DNA, 25 bp, Mus musculus
agctaatttacaacccacaacgcat

SEQ ID NO: 177728 - DNA, 25 bp, Mus musculus
agctaatttacatcccacaacgcat

SEQ ID NO: 177729 - DNA, 25 bp, Mus musculus
agctaatttcccagtagtctgctcc

SEQ ID NO: 177730 - DNA, 25 bp, Mus musculus
agctaatttccctgtagtctgctcc

SEQ ID NO: 177731 - DNA, 25 bp, Mus musculus
agctaattttacaacattgtttgcc

SEQ ID NO: 177732 - DNA, 25 bp, Mus musculus
agctaattttactacattgtttgcc

SEQ ID NO: 177733 - DNA, 25 bp, Mus musculus
agctacaactccaaaggtctggttt

SEQ ID NO: 177734 - DNA, 25 bp, Mus musculus
agctacaactcctaaggtctggttt

SEQ ID NO: 177735 - DNA, 25 bp, Mus musculus
agctacaagctacaggccatacctt

SEQ ID NO: 177736 - DNA, 25 bp, Mus musculus
agctacaagctagaggccatacctt

SEQ ID NO: 177737 - DNA, 25 bp, Mus musculus
agctacaataataaccctaccgcaa

SEQ ID NO: 177738 - DNA, 25 bp, Mus musculus
agctacaataattaccctaccgcaa

SEQ ID NO: 177739 - DNA, 25 bp, Mus musculus
agctacaattgtatgacagtccaaa

SEQ ID NO: 177740 - DNA, 25 bp, Mus musculus
agctacaattgtttgacagtccaaa

SEQ ID NO: 177741 - DNA, 25 bp, Mus musculus
agctacacacaacggccactataaa

SEQ ID NO: 177742 - DNA, 25 bp, Mus musculus
agctacacacaagggccactataaa

SEQ ID NO: 177743 - DNA, 25 bp, Mus musculus
agctacacacccagtcatttgttaa

SEQ ID NO: 177744 - DNA, 25 bp, Mus musculus
agctacacaccctgtcatttgttaa

SEQ ID NO: 177745 - DNA, 25 bp, Mus musculus
agctacacacggcttctgagcagtt

SEQ ID NO: 177746 - DNA, 25 bp, Mus musculus
agctacacacgggttctgagcagtt

SEQ ID NO: 177747 - DNA, 25 bp, Mus musculus
agctacacccgacgcttgtcttaaa

SEQ ID NO: 177748 - DNA, 25 bp, Mus musculus
agctacacccgaggcttgtcttaaa

SEQ ID NO: 177749 - DNA, 25 bp, Mus musculus
agctacacgaggcaagcctgcagtc

SEQ ID NO: 177750 - DNA, 25 bp, Mus musculus
agctacacgagggaagcctgcagtc

SEQ ID NO: 177751 - DNA, 25 bp, Mus musculus
agctacactgcgcaggctcagggta

SEQ ID NO: 177752 - DNA, 25 bp, Mus musculus
agctacactgcggaggctcagggta

SEQ ID NO: 177753 - DNA, 25 bp, Mus musculus
agctacactgtactttatactctgc

SEQ ID NO: 177754 - DNA, 25 bp, Mus musculus
agctacactgtagtttatactctgc

SEQ ID NO: 177755 - DNA, 25 bp, Mus musculus
agctacagacagatgcgagtcacag

SEQ ID NO: 177756 - DNA, 25 bp, Mus musculus
agctacagacagttgcgagtcacag

SEQ ID NO: 177757 - DNA, 25 bp, Mus musculus
agctacagagaacctgtttgcaccc

SEQ ID NO: 177758 - DNA, 25 bp, Mus musculus
agctacagagaagctgtttgcaccc

SEQ ID NO: 177759 - DNA, 25 bp, Mus musculus
agctacagagctctgcctctggcca

SEQ ID NO: 177760 - DNA, 25 bp, Mus musculus
agctacagagctgtgcctctggcca

SEQ ID NO: 177761 - DNA, 25 bp, Mus musculus
agctacagagtccaggccactggac

SEQ ID NO: 177762 - DNA, 25 bp, Mus musculus
agctacagagtcgaggccactggac

SEQ ID NO: 177763 - DNA, 25 bp, Mus musculus
agctacagcaggaggctcacaccat

SEQ ID NO: 177764 - DNA, 25 bp, Mus musculus
agctacagcaggtggctcacaccat

SEQ ID NO: 177765 - DNA, 25 bp, Mus musculus
agctacagccaaagcactcttgaat

SEQ ID NO: 177766 - DNA, 25 bp, Mus musculus
agctacagccaatgcactcttgaat

SEQ ID NO: 177767 - DNA, 25 bp, Mus musculus
agctacagctacacttcacacacag

SEQ ID NO: 177768 - DNA, 25 bp, Mus musculus
agctacagctactcttcacacacag

SEQ ID NO: 177769 - DNA, 25 bp, Mus musculus
agctacagctggactgagtttgcaa

SEQ ID NO: 177770 - DNA, 25 bp, Mus musculus
agctacagctggtctgagtttgcaa

SEQ ID NO: 177771 - DNA, 25 bp, Mus musculus
agctacaggcgcatcctcatgggaa

SEQ ID NO: 177772 - DNA, 25 bp, Mus musculus
agctacaggcgcttcctcatgggaa

SEQ ID NO: 177773 - DNA, 25 bp, Mus musculus
agctacagggtacatgggacttgat

SEQ ID NO: 177774 - DNA, 25 bp, Mus musculus
agctacagggtagatgggacttgat

SEQ ID NO: 177775 - DNA, 25 bp, Mus musculus
agctacaggtgacacaccctagcag

SEQ ID NO: 177776 - DNA, 25 bp, Mus musculus
agctacaggtgagacaccctagcag

SEQ ID NO: 177777 - DNA, 25 bp, Mus musculus
agctacagtatgactcttagagcgc

SEQ ID NO: 177778 - DNA, 25 bp, Mus musculus
agctacagtatgtctcttagagcgc

SEQ ID NO: 177779 - DNA, 25 bp, Mus musculus
agctacagtgaacttgctgggcgat

SEQ ID NO: 177780 - DNA, 25 bp, Mus musculus
agctacagtgaagttgctgggcgat

SEQ ID NO: 177781 - DNA, 25 bp, Mus musculus
agctacagtgtacttacatataata

SEQ ID NO: 177782 - DNA, 25 bp, Mus musculus
agctacagtgtagttacatataata

SEQ ID NO: 177783 - DNA, 25 bp, Mus musculus
agctacagtgtcacttatgattttt

SEQ ID NO: 177784 - DNA, 25 bp, Mus musculus
agctacagtgtctcttatgattttt

SEQ ID NO: 177785 - DNA, 25 bp, Mus musculus
agctacatagctattccatttcatt

SEQ ID NO: 177786 - DNA, 25 bp, Mus musculus
agctacatagcttttccatttcatt

SEQ ID NO: 177787 - DNA, 25 bp, Mus musculus
agctacatccttcagcccttaattc

SEQ ID NO: 177788 - DNA, 25 bp, Mus musculus
agctacatccttgagcccttaattc

SEQ ID NO: 177789 - DNA, 25 bp, Mus musculus
agctacatcgctcgttctgtgcttc

SEQ ID NO: 177790 - DNA, 25 bp, Mus musculus
agctacatcgctggttctgtgcttc

SEQ ID NO: 177791 - DNA, 25 bp, Mus musculus
agctacatcgtcctgtgcattgaga

SEQ ID NO: 177792 - DNA, 25 bp, Mus musculus
agctacatcgtcgtgtgcattgaga

SEQ ID NO: 177793 - DNA, 25 bp, Mus musculus
agctacatctgcacgtgccctgtct

SEQ ID NO: 177794 - DNA, 25 bp, Mus musculus
agctacatctgctcgtgccctgtct

SEQ ID NO: 177795 - DNA, 25 bp, Mus musculus
agctacatctttccgcttacattgt

SEQ ID NO: 177796 - DNA, 25 bp, Mus musculus
agctacatctttctcacaacagtgt

SEQ ID NO: 177797 - DNA, 25 bp, Mus musculus
agctacatctttgcgcttacattgt

SEQ ID NO: 177798 - DNA, 25 bp, Mus musculus
agctacatctttgtcacaacagtgt

SEQ ID NO: 177799 - DNA, 25 bp, Mus musculus
agctacatgacaccccggtgggcga

SEQ ID NO: 177800 - DNA, 25 bp, Mus musculus
agctacatgacagcccggtgggcga

SEQ ID NO: 177801 - DNA, 25 bp, Mus musculus
agctacatgagcactgggcctgtgg

SEQ ID NO: 177802 - DNA, 25 bp, Mus musculus
agctacatgagctctgggcctgtgg

SEQ ID NO: 177803 - DNA, 25 bp, Mus musculus
agctacatgcttcccaccttttggg

SEQ ID NO: 177804 - DNA, 25 bp, Mus musculus
agctacatgcttgccaccttttggg

SEQ ID NO: 177805 - DNA, 25 bp, Mus musculus
agctacattagtcaatctgctgaat

SEQ ID NO: 177806 - DNA, 25 bp, Mus musculus
agctacattagtgaatctgctgaat

SEQ ID NO: 177807 - DNA, 25 bp, Mus musculus
agctacatttccaagtcacagactc

SEQ ID NO: 177808 - DNA, 25 bp, Mus musculus
agctacatttcctagtcacagactc

SEQ ID NO: 177809 - DNA, 25 bp, Mus musculus
agctaccaaaacaaaatgggctgtt

SEQ ID NO: 177810 - DNA, 25 bp, Mus musculus
agctaccaaaactaaatgggctgtt

SEQ ID NO: 177811 - DNA, 25 bp, Mus musculus
agctaccaacatagttccctacttt

SEQ ID NO: 177812 - DNA, 25 bp, Mus musculus
agctaccaacattgttccctacttt

SEQ ID NO: 177813 - DNA, 25 bp, Mus musculus
agctaccaaccactgtcttaataaa

SEQ ID NO: 177814 - DNA, 25 bp, Mus musculus
agctaccaaccagtgtcttaataaa

SEQ ID NO: 177815 - DNA, 25 bp, Mus musculus
agctaccaagagcatgctcgccgct

SEQ ID NO: 177816 - DNA, 25 bp, Mus musculus
agctaccaagaggatgctcgccgct

SEQ ID NO: 177817 - DNA, 25 bp, Mus musculus
agctaccaagtaatcatttctgagg

SEQ ID NO: 177818 - DNA, 25 bp, Mus musculus
agctaccaagtattcatttctgagg

SEQ ID NO: 177819 - DNA, 25 bp, Mus musculus
agctaccacagcaaacgcctaagag

SEQ ID NO: 177820 - DNA, 25 bp, Mus musculus
agctaccacagctaacgcctaagag

SEQ ID NO: 177821 - DNA, 25 bp, Mus musculus
agctaccactctatgagctcgatgg

SEQ ID NO: 177822 - DNA, 25 bp, Mus musculus
agctaccactctttgagctcgatgg

SEQ ID NO: 177823 - DNA, 25 bp, Mus musculus
agctaccagagaaagccttaaactt

SEQ ID NO: 177824 - DNA, 25 bp, Mus musculus
agctaccagagatagccttaaactt

SEQ ID NO: 177825 - DNA, 25 bp, Mus musculus
agctaccagtcaaagttaggcccgt

SEQ ID NO: 177826 - DNA, 25 bp, Mus musculus
agctaccagtcatagttaggcccgt

SEQ ID NO: 177827 - DNA, 25 bp, Mus musculus
agctaccagtgtcgctgcccgacga

SEQ ID NO: 177828 - DNA, 25 bp, Mus musculus
agctaccagtgtggctgcccgacga

SEQ ID NO: 177829 - DNA, 25 bp, Mus musculus
agctaccagtttacattatgtcctt

SEQ ID NO: 177830 - DNA, 25 bp, Mus musculus
agctaccagttttcattatgtcctt

SEQ ID NO: 177831 - DNA, 25 bp, Mus musculus
agctaccataatacctttcctgata

SEQ ID NO: 177832 - DNA, 25 bp, Mus musculus
agctaccataattcctttcctgata

SEQ ID NO: 177833 - DNA, 25 bp, Mus musculus
agctaccatggaacagttacctgtt

SEQ ID NO: 177834 - DNA, 25 bp, Mus musculus
agctaccatggatcagttacctgtt

SEQ ID NO: 177835 - DNA, 25 bp, Mus musculus
agctaccattgtcccctcatgcata

SEQ ID NO: 177836 - DNA, 25 bp, Mus musculus
agctaccattgtgccctcatgcata

SEQ ID NO: 177837 - DNA, 25 bp, Mus musculus
agctacccaacacttattcttttct

SEQ ID NO: 177838 - DNA, 25 bp, Mus musculus
agctacccaacagttattcttttct

SEQ ID NO: 177839 - DNA, 25 bp, Mus musculus
agctacccacatagcactgagcttg

SEQ ID NO: 177840 - DNA, 25 bp, Mus musculus
agctacccacattgcactgagcttg

SEQ ID NO: 177841 - DNA, 25 bp, Mus musculus
agctacccacctagatctagatctg

SEQ ID NO: 177842 - DNA, 25 bp, Mus musculus
agctacccaccttgatctagatctg

SEQ ID NO: 177843 - DNA, 25 bp, Mus musculus
agctacccacgaaaaatactgtatt

SEQ ID NO: 177844 - DNA, 25 bp, Mus musculus
agctacccacgataaatactgtatt

SEQ ID NO: 177845 - DNA, 25 bp, Mus musculus
agctacccactgcaacaggatttct

SEQ ID NO: 177846 - DNA, 25 bp, Mus musculus
agctacccactggaacaggatttct

SEQ ID NO: 177847 - DNA, 25 bp, Mus musculus
agctacccagtcaatgccagtcaat

SEQ ID NO: 177848 - DNA, 25 bp, Mus musculus
agctacccagtctatgccagtcaat

SEQ ID NO: 177849 - DNA, 25 bp, Mus musculus
agctaccccaggacttcagttagag

SEQ ID NO: 177850 - DNA, 25 bp, Mus musculus
agctaccccaggtcttcagttagag

SEQ ID NO: 177851 - DNA, 25 bp, Mus musculus
agctaccccgagcatctttgagatg

SEQ ID NO: 177852 - DNA, 25 bp, Mus musculus
agctaccccgaggatctttgagatg

SEQ ID NO: 177853 - DNA, 25 bp, Mus musculus
agctacccctgtattgagcagcaat

SEQ ID NO: 177854 - DNA, 25 bp, Mus musculus
agctacccctgttttgagcagcaat

SEQ ID NO: 177855 - DNA, 25 bp, Mus musculus
agctacccctttatagtatggcgag

SEQ ID NO: 177856 - DNA, 25 bp, Mus musculus
agctacccctttttagtatggcgag

SEQ ID NO: 177857 - DNA, 25 bp, Mus musculus
agctaccctatgctgttacacgtgg

SEQ ID NO: 177858 - DNA, 25 bp, Mus musculus
agctaccctatggtgttacacgtgg

SEQ ID NO: 177859 - DNA, 25 bp, Mus musculus
agctaccctcctctttgacttcttg

SEQ ID NO: 177860 - DNA, 25 bp, Mus musculus
agctaccctcctgtttgacttcttg

SEQ ID NO: 177861 - DNA, 25 bp, Mus musculus
agctaccctgtgcattggcacctga

SEQ ID NO: 177862 - DNA, 25 bp, Mus musculus
agctaccctgtggattggcacctga

SEQ ID NO: 177863 - DNA, 25 bp, Mus musculus
agctaccctgttaagtttgactcta

SEQ ID NO: 177864 - DNA, 25 bp, Mus musculus
agctaccctgtttagtttgactcta

SEQ ID NO: 177865 - DNA, 25 bp, Mus musculus
agctacccttcaattgctcataggc

SEQ ID NO: 177866 - DNA, 25 bp, Mus musculus
agctacccttcatttgctcataggc

SEQ ID NO: 177867 - DNA, 25 bp, Mus musculus
agctaccgaagtatctggctgtgtg

SEQ ID NO: 177868 - DNA, 25 bp, Mus musculus
agctaccgaagtttctggctgtgtg

SEQ ID NO: 177869 - DNA, 25 bp, Mus musculus
agctaccgaatcaccaggactcaag

SEQ ID NO: 177870 - DNA, 25 bp, Mus musculus
agctaccgaatctccaggactcaag

SEQ ID NO: 177871 - DNA, 25 bp, Mus musculus
agctaccgcagtcccaacttcatgg

SEQ ID NO: 177872 - DNA, 25 bp, Mus musculus
agctaccgcagtgccaacttcatgg

SEQ ID NO: 177873 - DNA, 25 bp, Mus musculus
agctaccgcgttagtgctgactgct

SEQ ID NO: 177874 - DNA, 25 bp, Mus musculus
agctaccgcgtttgtgctgactgct

SEQ ID NO: 177875 - DNA, 25 bp, Mus musculus
agctacctagtgattgagcccctaa

SEQ ID NO: 177876 - DNA, 25 bp, Mus musculus
agctacctagtgtttgagcccctaa

SEQ ID NO: 177877 - DNA, 25 bp, Mus musculus
agctacctccacatcacgaagaaga

SEQ ID NO: 177878 - DNA, 25 bp, Mus musculus
agctacctccacttcacgaagaaga

SEQ ID NO: 177879 - DNA, 25 bp, Mus musculus
agctacctcttcaagtccagggagc

SEQ ID NO: 177880 - DNA, 25 bp, Mus musculus
agctacctcttctagtccagggagc

SEQ ID NO: 177881 - DNA, 25 bp, Mus musculus
agctacctgacaaggtctgccggga

SEQ ID NO: 177882 - DNA, 25 bp, Mus musculus
agctacctgacatggtctgccggga

SEQ ID NO: 177883 - DNA, 25 bp, Mus musculus
agctacctgaccaggctacgcttta

SEQ ID NO: 177884 - DNA, 25 bp, Mus musculus
agctacctgacctggctacgcttta

SEQ ID NO: 177885 - DNA, 25 bp, Mus musculus
agctacctgagcaatgtgccttcaa

SEQ ID NO: 177886 - DNA, 25 bp, Mus musculus
agctacctgagctatgtgccttcaa

SEQ ID NO: 177887 - DNA, 25 bp, Mus musculus
agctacctgctcagattatttttat

SEQ ID NO: 177888 - DNA, 25 bp, Mus musculus
agctacctgctctgattatttttat

SEQ ID NO: 177889 - DNA, 25 bp, Mus musculus
agctacctggagaactcggcttcct

SEQ ID NO: 177890 - DNA, 25 bp, Mus musculus
agctacctggagtactcggcttcct

SEQ ID NO: 177891 - DNA, 25 bp, Mus musculus
agctacctgtcaccttgtttatgaa

SEQ ID NO: 177892 - DNA, 25 bp, Mus musculus
agctacctgtcagcttgtttatgaa

SEQ ID NO: 177893 - DNA, 25 bp, Mus musculus
agctaccttatgatactgtttctta

SEQ ID NO: 177894 - DNA, 25 bp, Mus musculus
agctaccttatgttactgtttctta

SEQ ID NO: 177895 - DNA, 25 bp, Mus musculus
agctaccttctgatggttgttgcag

SEQ ID NO: 177896 - DNA, 25 bp, Mus musculus
agctaccttctgttggttgttgcag

SEQ ID NO: 177897 - DNA, 25 bp, Mus musculus
agctaccttgggaccctggaacatc

SEQ ID NO: 177898 - DNA, 25 bp, Mus musculus
agctaccttgggtccctggaacatc

SEQ ID NO: 177899 - DNA, 25 bp, Mus musculus
agctacctttccactctgtgtcgtt

SEQ ID NO: 177900 - DNA, 25 bp, Mus musculus
agctacctttcctctctgtgtcgtt

SEQ ID NO: 177901 - DNA, 25 bp, Mus musculus
agctacctttctactgttgtcagtc

SEQ ID NO: 177902 - DNA, 25 bp, Mus musculus
agctacctttcttctgttgtcagtc

SEQ ID NO: 177903 - DNA, 25 bp, Mus musculus
agctacctttttagtcaagacagat

SEQ ID NO: 177904 - DNA, 25 bp, Mus musculus
agctaccttttttgtcaagacagat

SEQ ID NO: 177905 - DNA, 25 bp, Mus musculus
agctacgaagatcctgtagtcccgc

SEQ ID NO: 177906 - DNA, 25 bp, Mus musculus
agctacgaagatgctgtagtcccgc

SEQ ID NO: 177907 - DNA, 25 bp, Mus musculus
agctacgatagtagtgaccgcctca

SEQ ID NO: 177908 - DNA, 25 bp, Mus musculus
agctacgatagttgtgaccgcctca

SEQ ID NO: 177909 - DNA, 25 bp, Mus musculus
agctacgatgctagccagggtgaca

SEQ ID NO: 177910 - DNA, 25 bp, Mus musculus
agctacgatgcttgccagggtgaca

SEQ ID NO: 177911 - DNA, 25 bp, Mus musculus
agctacgcagagagtccaagtcggc

SEQ ID NO: 177912 - DNA, 25 bp, Mus musculus
agctacgcagagtgtccaagtcggc

SEQ ID NO: 177913 - DNA, 25 bp, Mus musculus
agctacgcatccctggtgagagagc

SEQ ID NO: 177914 - DNA, 25 bp, Mus musculus
agctacgcatcccttcacttcattg

SEQ ID NO: 177915 - DNA, 25 bp, Mus musculus
agctacgcatccgtggtgagagagc

SEQ ID NO: 177916 - DNA, 25 bp, Mus musculus
agctacgcatccgttcacttcattg

SEQ ID NO: 177917 - DNA, 25 bp, Mus musculus
agctacgcggctctgaaaggtgatt

SEQ ID NO: 177918 - DNA, 25 bp, Mus musculus
agctacgcggctgtgaaaggtgatt

SEQ ID NO: 177919 - DNA, 25 bp, Mus musculus
agctacgctgacaccgggccgtgaa

SEQ ID NO: 177920 - DNA, 25 bp, Mus musculus
agctacgctgactccgggccgtgaa

SEQ ID NO: 177921 - DNA, 25 bp, Mus musculus
agctacggatcaaaaccctgtcagg

SEQ ID NO: 177922 - DNA, 25 bp, Mus musculus
agctacggatcataaccctgtcagg

SEQ ID NO: 177923 - DNA, 25 bp, Mus musculus
agctacggctggagcgagcagccct

SEQ ID NO: 177924 - DNA, 25 bp, Mus musculus
agctacggctggtgcgagcagccct

SEQ ID NO: 177925 - DNA, 25 bp, Mus musculus
agctacgggaaccatttgtctcacc

SEQ ID NO: 177926 - DNA, 25 bp, Mus musculus
agctacgggaacgatttgtctcacc

SEQ ID NO: 177927 - DNA, 25 bp, Mus musculus
agctactaaccaacggcttcgagga

SEQ ID NO: 177928 - DNA, 25 bp, Mus musculus
agctactaaccatcggcttcgagga

SEQ ID NO: 177929 - DNA, 25 bp, Mus musculus
agctactaaggcagaggcttccaag

SEQ ID NO: 177930 - DNA, 25 bp, Mus musculus
agctactaaggctgaggcttccaag

SEQ ID NO: 177931 - DNA, 25 bp, Mus musculus
agctactaatgtacctgccaatgtg

SEQ ID NO: 177932 - DNA, 25 bp, Mus musculus
agctactaatgttcctgccaatgtg

SEQ ID NO: 177933 - DNA, 25 bp, Mus musculus
agctactacaaccacaaacctgtta

SEQ ID NO: 177934 - DNA, 25 bp, Mus musculus
agctactacaacgacaaacctgtta

SEQ ID NO: 177935 - DNA, 25 bp, Mus musculus
agctactactgcagctatcactgct

SEQ ID NO: 177936 - DNA, 25 bp, Mus musculus
agctactactgccttggttaaagag

SEQ ID NO: 177937 - DNA, 25 bp, Mus musculus
agctactactgcctttcaatttctg

SEQ ID NO: 177938 - DNA, 25 bp, Mus musculus
agctactactgcgttggttaaagag

SEQ ID NO: 177939 - DNA, 25 bp, Mus musculus
agctactactgcgtttcaatttctg

SEQ ID NO: 177940 - DNA, 25 bp, Mus musculus
agctactactgctgctatcactgct

SEQ ID NO: 177941 - DNA, 25 bp, Mus musculus
agctactagacactcagttcttaaa

SEQ ID NO: 177942 - DNA, 25 bp, Mus musculus
agctactagacagtcagttcttaaa

SEQ ID NO: 177943 - DNA, 25 bp, Mus musculus
agctactagcaaaccataaccaacc

SEQ ID NO: 177944 - DNA, 25 bp, Mus musculus
agctactagcaatccataaccaacc

SEQ ID NO: 177945 - DNA, 25 bp, Mus musculus
agctactagcagattacttctgaga

SEQ ID NO: 177946 - DNA, 25 bp, Mus musculus
agctactagcagtttacttctgaga

SEQ ID NO: 177947 - DNA, 25 bp, Mus musculus
agctactatgttcaggtttccacca

SEQ ID NO: 177948 - DNA, 25 bp, Mus musculus
agctactatgttgaggtttccacca

SEQ ID NO: 177949 - DNA, 25 bp, Mus musculus
agctactcagctactcaggtagtcc

SEQ ID NO: 177950 - DNA, 25 bp, Mus musculus
agctactcagcttctcaggtagtcc

SEQ ID NO: 177951 - DNA, 25 bp, Mus musculus
agctactcaggtaacgtctgcctgg

SEQ ID NO: 177952 - DNA, 25 bp, Mus musculus
agctactcaggttacgtctgcctgg

SEQ ID NO: 177953 - DNA, 25 bp, Mus musculus
agctactccaatccgacaattggct

SEQ ID NO: 177954 - DNA, 25 bp, Mus musculus
agctactccaatgcgacaattggct

SEQ ID NO: 177955 - DNA, 25 bp, Mus musculus
agctactccaccagaaggaccggtg

SEQ ID NO: 177956 - DNA, 25 bp, Mus musculus
agctactccacctgaaggaccggtg

SEQ ID NO: 177957 - DNA, 25 bp, Mus musculus
agctactccaggaacgtaggtgcca

SEQ ID NO: 177958 - DNA, 25 bp, Mus musculus
agctactccaggtacgtaggtgcca

SEQ ID NO: 177959 - DNA, 25 bp, Mus musculus
agctactcctccctgatatgaaaaa

SEQ ID NO: 177960 - DNA, 25 bp, Mus musculus
agctactcctccgtgatatgaaaaa

SEQ ID NO: 177961 - DNA, 25 bp, Mus musculus
agctactcgggtcaacaagcgggca

SEQ ID NO: 177962 - DNA, 25 bp, Mus musculus
agctactcgggtgaacaagcgggca

SEQ ID NO: 177963 - DNA, 25 bp, Mus musculus
agctactctcaaaggtcactcaaca

SEQ ID NO: 177964 - DNA, 25 bp, Mus musculus
agctactctcaatggtcactcaaca

SEQ ID NO: 177965 - DNA, 25 bp, Mus musculus
agctactctgctctggtgtgatgga

SEQ ID NO: 177966 - DNA, 25 bp, Mus musculus
agctactctgctgtggtgtgatgga

SEQ ID NO: 177967 - DNA, 25 bp, Mus musculus
agctactctggtcaggacactggga

SEQ ID NO: 177968 - DNA, 25 bp, Mus musculus
agctactctggtgaggacactggga

SEQ ID NO: 177969 - DNA, 25 bp, Mus musculus
agctactctgttccattttttcaag

SEQ ID NO: 177970 - DNA, 25 bp, Mus musculus
agctactctgttgcattttttcaag

SEQ ID NO: 177971 - DNA, 25 bp, Mus musculus
agctactgactgaataaccactttt

SEQ ID NO: 177972 - DNA, 25 bp, Mus musculus
agctactgactgtataaccactttt

SEQ ID NO: 177973 - DNA, 25 bp, Mus musculus
agctactgaggcagagtccgtgaga

SEQ ID NO: 177974 - DNA, 25 bp, Mus musculus
agctactgaggctgagtccgtgaga

SEQ ID NO: 177975 - DNA, 25 bp, Mus musculus
agctactgattgaacttcatggctt

SEQ ID NO: 177976 - DNA, 25 bp, Mus musculus
agctactgattgtacttcatggctt

SEQ ID NO: 177977 - DNA, 25 bp, Mus musculus
agctactgatttactttgtcctgtt

SEQ ID NO: 177978 - DNA, 25 bp, Mus musculus
agctactgattttctttgtcctgtt

SEQ ID NO: 177979 - DNA, 25 bp, Mus musculus
agctactgcgggagcattatgtcga

SEQ ID NO: 177980 - DNA, 25 bp, Mus musculus
agctactgcgggtgcattatgtcga

SEQ ID NO: 177981 - DNA, 25 bp, Mus musculus
agctactgctgtatgcctcatgact

SEQ ID NO: 177982 - DNA, 25 bp, Mus musculus
agctactgctgtttgcctcatgact

SEQ ID NO: 177983 - DNA, 25 bp, Mus musculus
agctactggactcttggcctttggt

SEQ ID NO: 177984 - DNA, 25 bp, Mus musculus
agctactggactgttggcctttggt

SEQ ID NO: 177985 - DNA, 25 bp, Mus musculus
agctactggcgcagtctgtgaacca

SEQ ID NO: 177986 - DNA, 25 bp, Mus musculus
agctactggcgctgtctgtgaacca

SEQ ID NO: 177987 - DNA, 25 bp, Mus musculus
agctactgggtaaactcctacaaga

SEQ ID NO: 177988 - DNA, 25 bp, Mus musculus
agctactgggtatactcctacaaga

SEQ ID NO: 177989 - DNA, 25 bp, Mus musculus
agctactgtcatccccatttaatgt

SEQ ID NO: 177990 - DNA, 25 bp, Mus musculus
agctactgtcatgcccatttaatgt

SEQ ID NO: 177991 - DNA, 25 bp, Mus musculus
agctactgtctgaactgtgctgact

SEQ ID NO: 177992 - DNA, 25 bp, Mus musculus
agctactgtctgtactgtgctgact

SEQ ID NO: 177993 - DNA, 25 bp, Mus musculus
agctactgtgatctctgtctcctga

SEQ ID NO: 177994 - DNA, 25 bp, Mus musculus
agctactgtgatgtctgtctcctga

SEQ ID NO: 177995 - DNA, 25 bp, Mus musculus
agctactgtgctatattgactttat

SEQ ID NO: 177996 - DNA, 25 bp, Mus musculus
agctactgtgctttattgactttat

SEQ ID NO: 177997 - DNA, 25 bp, Mus musculus
agctactgttatcccatgtgacact

SEQ ID NO: 177998 - DNA, 25 bp, Mus musculus
agctactgttatgccatgtgacact

SEQ ID NO: 177999 - DNA, 25 bp, Mus musculus
agctactgtttgagtgctaggaacc

SEQ ID NO: 178000 - DNA, 25 bp, Mus musculus
agctactgtttgtgtgctaggaacc

SEQ ID NO: 178001 - DNA, 25 bp, Mus musculus
agctactgttttctctgagtcctga

SEQ ID NO: 178002 - DNA, 25 bp, Mus musculus
agctactgttttgtctgagtcctga

SEQ ID NO: 178003 - DNA, 25 bp, Mus musculus
agctacttacccctcagagaataaa

SEQ ID NO: 178004 - DNA, 25 bp, Mus musculus
agctacttacccgtcagagaataaa

SEQ ID NO: 178005 - DNA, 25 bp, Mus musculus
agctacttagcaagactctgtcggg

SEQ ID NO: 178006 - DNA, 25 bp, Mus musculus
agctacttagcatgactctgtcggg

SEQ ID NO: 178007 - DNA, 25 bp, Mus musculus
agctacttcagtcgcgagggccaga

SEQ ID NO: 178008 - DNA, 25 bp, Mus musculus
agctacttcagtggcgagggccaga

SEQ ID NO: 178009 - DNA, 25 bp, Mus musculus
agctacttcattacactcacatggc

SEQ ID NO: 178010 - DNA, 25 bp, Mus musculus
agctacttcatttcactcacatggc

SEQ ID NO: 178011 - DNA, 25 bp, Mus musculus
agctacttcccacagtacacaggac

SEQ ID NO: 178012 - DNA, 25 bp, Mus musculus
agctacttcccagagtacacaggac

SEQ ID NO: 178013 - DNA, 25 bp, Mus musculus
agctacttccctcccagaaggtcgg

SEQ ID NO: 178014 - DNA, 25 bp, Mus musculus
agctacttccctgccagaaggtcgg

SEQ ID NO: 178015 - DNA, 25 bp, Mus musculus
agctacttcctacatgacacaacaa

SEQ ID NO: 178016 - DNA, 25 bp, Mus musculus
agctacttcctagatgacacaacaa

SEQ ID NO: 178017 - DNA, 25 bp, Mus musculus
agctacttctcaagctccatgtcta

SEQ ID NO: 178018 - DNA, 25 bp, Mus musculus
agctacttctcatgctccatgtcta

SEQ ID NO: 178019 - DNA, 25 bp, Mus musculus
agctacttctggaactcgaagattt

SEQ ID NO: 178020 - DNA, 25 bp, Mus musculus
agctacttctggtactcgaagattt

SEQ ID NO: 178021 - DNA, 25 bp, Mus musculus
agctacttcttgcagaattcctctg

SEQ ID NO: 178022 - DNA, 25 bp, Mus musculus
agctacttcttggagaattcctctg

SEQ ID NO: 178023 - DNA, 25 bp, Mus musculus
agctacttgcccagaggctttgtag

SEQ ID NO: 178024 - DNA, 25 bp, Mus musculus
agctacttgccctgaggctttgtag

SEQ ID NO: 178025 - DNA, 25 bp, Mus musculus
agctacttgctgactccgatcggtg

SEQ ID NO: 178026 - DNA, 25 bp, Mus musculus
agctacttgctgtctccgatcggtg

SEQ ID NO: 178027 - DNA, 25 bp, Mus musculus
agctacttggtcaccaggtacattt

SEQ ID NO: 178028 - DNA, 25 bp, Mus musculus
agctacttggtctccaggtacattt

SEQ ID NO: 178029 - DNA, 25 bp, Mus musculus
agctacttgtttcaccatggcagac

SEQ ID NO: 178030 - DNA, 25 bp, Mus musculus
agctacttgtttgaccatggcagac

SEQ ID NO: 178031 - DNA, 25 bp, Mus musculus
agctactttcttcgccggagggtca

SEQ ID NO: 178032 - DNA, 25 bp, Mus musculus
agctactttcttggccggagggtca

SEQ ID NO: 178033 - DNA, 25 bp, Mus musculus
agctactttgacatgcacactgcct

SEQ ID NO: 178034 - DNA, 25 bp, Mus musculus
agctactttgacttgcacactgcct

SEQ ID NO: 178035 - DNA, 25 bp, Mus musculus
agctactttgtcaccacgatgtcct

SEQ ID NO: 178036 - DNA, 25 bp, Mus musculus
agctactttgtctccacgatgtcct

SEQ ID NO: 178037 - DNA, 25 bp, Mus musculus
agctacttttttctgatgtttcata

SEQ ID NO: 178038 - DNA, 25 bp, Mus musculus
agctacttttttgtgatgtttcata

SEQ ID NO: 178039 - DNA, 25 bp, Mus musculus
agctagaaacctacctactgccgct

SEQ ID NO: 178040 - DNA, 25 bp, Mus musculus
agctagaaaccttcctactgccgct

SEQ ID NO: 178041 - DNA, 25 bp, Mus musculus
agctagaaccctatgtatactaaat

SEQ ID NO: 178042 - DNA, 25 bp, Mus musculus
agctagaaccctttgtatactaaat

SEQ ID NO: 178043 - DNA, 25 bp, Mus musculus
agctagaagaacactgagggcagag

SEQ ID NO: 178044 - DNA, 25 bp, Mus musculus
agctagaagaactctgagggcagag

SEQ ID NO: 178045 - DNA, 25 bp, Mus musculus
agctagaagccactactctgcctga

SEQ ID NO: 178046 - DNA, 25 bp, Mus musculus
agctagaagccagtactctgcctga

SEQ ID NO: 178047 - DNA, 25 bp, Mus musculus
agctagaagctgctcttcactgtgc

SEQ ID NO: 178048 - DNA, 25 bp, Mus musculus
agctagaagctggtcttcactgtgc

SEQ ID NO: 178049 - DNA, 25 bp, Mus musculus
agctagaccagtcctgtaccacaga

SEQ ID NO: 178050 - DNA, 25 bp, Mus musculus
agctagaccagtgctgtaccacaga

SEQ ID NO: 178051 - DNA, 25 bp, Mus musculus
agctagactacaacgtcccaagagt

SEQ ID NO: 178052 - DNA, 25 bp, Mus musculus
agctagactacatcgtcccaagagt

SEQ ID NO: 178053 - DNA, 25 bp, Mus musculus
agctagactcaaccctgcaggtaac

SEQ ID NO: 178054 - DNA, 25 bp, Mus musculus
agctagactcaagcctgcaggtaac

SEQ ID NO: 178055 - DNA, 25 bp, Mus musculus
agctagactgcacggattctcttcc

SEQ ID NO: 178056 - DNA, 25 bp, Mus musculus
agctagactgcagggattctcttcc

SEQ ID NO: 178057 - DNA, 25 bp, Mus musculus
agctagactgtcatactggcaaatt

SEQ ID NO: 178058 - DNA, 25 bp, Mus musculus
agctagactgtcttactggcaaatt

SEQ ID NO: 178059 - DNA, 25 bp, Mus musculus
agctagagaactagcctaccgtggt

SEQ ID NO: 178060 - DNA, 25 bp, Mus musculus
agctagagaacttgcctaccgtggt

SEQ ID NO: 178061 - DNA, 25 bp, Mus musculus
agctagagaatcagatgcccctgtc

SEQ ID NO: 178062 - DNA, 25 bp, Mus musculus
agctagagaatctgatgcccctgtc

SEQ ID NO: 178063 - DNA, 25 bp, Mus musculus
agctagagactactatccctgtggg

SEQ ID NO: 178064 - DNA, 25 bp, Mus musculus
agctagagactagtatccctgtggg

SEQ ID NO: 178065 - DNA, 25 bp, Mus musculus
agctagagagccagatctacctgga

SEQ ID NO: 178066 - DNA, 25 bp, Mus musculus
agctagagagccagtcagccatcga

SEQ ID NO: 178067 - DNA, 25 bp, Mus musculus
agctagagagcctgatctacctgga

SEQ ID NO: 178068 - DNA, 25 bp, Mus musculus
agctagagagcctgtcagccatcga

SEQ ID NO: 178069 - DNA, 25 bp, Mus musculus
agctagagatttcgtggcccattca

SEQ ID NO: 178070 - DNA, 25 bp, Mus musculus
agctagagatttggtggcccattca

SEQ ID NO: 178071 - DNA, 25 bp, Mus musculus
agctagagcaagattcggagaacca

SEQ ID NO: 178072 - DNA, 25 bp, Mus musculus
agctagagcaagtttcggagaacca

SEQ ID NO: 178073 - DNA, 25 bp, Mus musculus
agctagagccatctaccacaaaaga

SEQ ID NO: 178074 - DNA, 25 bp, Mus musculus
agctagagccatgtaccacaaaaga

SEQ ID NO: 178075 - DNA, 25 bp, Mus musculus
agctagagctccataggcatctctt

SEQ ID NO: 178076 - DNA, 25 bp, Mus musculus
agctagagctccttaggcatctctt

SEQ ID NO: 178077 - DNA, 25 bp, Mus musculus
agctagaggcttactggcttggtca

SEQ ID NO: 178078 - DNA, 25 bp, Mus musculus
agctagaggctttctggcttggtca

SEQ ID NO: 178079 - DNA, 25 bp, Mus musculus
agctagaggtcaacaaatctcggga

SEQ ID NO: 178080 - DNA, 25 bp, Mus musculus
agctagaggtcatcaaatctcggga

SEQ ID NO: 178081 - DNA, 25 bp, Mus musculus
agctagatgaccatcaacactcaga

SEQ ID NO: 178082 - DNA, 25 bp, Mus musculus
agctagatgaccttcaacactcaga

SEQ ID NO: 178083 - DNA, 25 bp, Mus musculus
agctagatgggtatctctttacctt

SEQ ID NO: 178084 - DNA, 25 bp, Mus musculus
agctagatgggtttctctttacctt

SEQ ID NO: 178085 - DNA, 25 bp, Mus musculus
agctagatgtcacagaaaccctttc

SEQ ID NO: 178086 - DNA, 25 bp, Mus musculus
agctagatgtcagagaaaccctttc

SEQ ID NO: 178087 - DNA, 25 bp, Mus musculus
agctagattttaccatagccccgac

SEQ ID NO: 178088 - DNA, 25 bp, Mus musculus
agctagattttagcatagccccgac

SEQ ID NO: 178089 - DNA, 25 bp, Mus musculus
agctagcaacagaagtaacaagagt

SEQ ID NO: 178090 - DNA, 25 bp, Mus musculus
agctagcaacagtagtaacaagagt

SEQ ID NO: 178091 - DNA, 25 bp, Mus musculus
agctagcacaggatcagggcagtca

SEQ ID NO: 178092 - DNA, 25 bp, Mus musculus
agctagcacaggttcagggcagtca

SEQ ID NO: 178093 - DNA, 25 bp, Mus musculus
agctagcaggctcagtttacaaacc

SEQ ID NO: 178094 - DNA, 25 bp, Mus musculus
agctagcaggctgagtttacaaacc

SEQ ID NO: 178095 - DNA, 25 bp, Mus musculus
agctagcagttcactcactgagcca

SEQ ID NO: 178096 - DNA, 25 bp, Mus musculus
agctagcagttctctcactgagcca

SEQ ID NO: 178097 - DNA, 25 bp, Mus musculus
agctagcatgccaggttggtcttta

SEQ ID NO: 178098 - DNA, 25 bp, Mus musculus
agctagcatgcctggttggtcttta

SEQ ID NO: 178099 - DNA, 25 bp, Mus musculus
agctagccctgactccactggagag

SEQ ID NO: 178100 - DNA, 25 bp, Mus musculus
agctagccctgagtccactggagag

SEQ ID NO: 178101 - DNA, 25 bp, Mus musculus
agctagcctatgatgttcccacgat

SEQ ID NO: 178102 - DNA, 25 bp, Mus musculus
agctagcctatgttgttcccacgat

SEQ ID NO: 178103 - DNA, 25 bp, Mus musculus
agctagcctgcaattgttttgtctt

SEQ ID NO: 178104 - DNA, 25 bp, Mus musculus
agctagcctgcatttgttttgtctt

SEQ ID NO: 178105 - DNA, 25 bp, Mus musculus
agctagcctgggagtaccttttaag

SEQ ID NO: 178106 - DNA, 25 bp, Mus musculus
agctagcctgggtgtaccttttaag

SEQ ID NO: 178107 - DNA, 25 bp, Mus musculus
agctagcgactcagaggttgtgcac

SEQ ID NO: 178108 - DNA, 25 bp, Mus musculus
agctagcgactctgaggttgtgcac

SEQ ID NO: 178109 - DNA, 25 bp, Mus musculus
agctagcgagtgcagcagtcctgaa

SEQ ID NO: 178110 - DNA, 25 bp, Mus musculus
agctagcgagtggagcagtcctgaa

SEQ ID NO: 178111 - DNA, 25 bp, Mus musculus
agctagcgccaacttcattcagaaa

SEQ ID NO: 178112 - DNA, 25 bp, Mus musculus
agctagcgccaagttcattcagaaa

SEQ ID NO: 178113 - DNA, 25 bp, Mus musculus
agctagctaagactcaccaatcagg

SEQ ID NO: 178114 - DNA, 25 bp, Mus musculus
agctagctaagagtcaccaatcagg

SEQ ID NO: 178115 - DNA, 25 bp, Mus musculus
agctagctaattaatctgtataact

SEQ ID NO: 178116 - DNA, 25 bp, Mus musculus
agctagctaatttatctgtataact

SEQ ID NO: 178117 - DNA, 25 bp, Mus musculus
agctagctcaacaattggggtctct

SEQ ID NO: 178118 - DNA, 25 bp, Mus musculus
agctagctcaacacttagttcttat

SEQ ID NO: 178119 - DNA, 25 bp, Mus musculus
agctagctcaactattggggtctct

SEQ ID NO: 178120 - DNA, 25 bp, Mus musculus
agctagctcaactcttagttcttat

SEQ ID NO: 178121 - DNA, 25 bp, Mus musculus
agctagctcaggctcttcactgcaa

SEQ ID NO: 178122 - DNA, 25 bp, Mus musculus
agctagctcagggtcttcactgcaa

SEQ ID NO: 178123 - DNA, 25 bp, Mus musculus
agctagctccaaaactgcagggaca

SEQ ID NO: 178124 - DNA, 25 bp, Mus musculus
agctagctccaatactgcagggaca

SEQ ID NO: 178125 - DNA, 25 bp, Mus musculus
agctagctcgtccatcttaatcaat

SEQ ID NO: 178126 - DNA, 25 bp, Mus musculus
agctagctcgtcgatcttaatcaat

SEQ ID NO: 178127 - DNA, 25 bp, Mus musculus
agctagctctgaaacattcattcta

SEQ ID NO: 178128 - DNA, 25 bp, Mus musculus
agctagctctgatacattcattcta

SEQ ID NO: 178129 - DNA, 25 bp, Mus musculus
agctagctctggctgcgattcttca

SEQ ID NO: 178130 - DNA, 25 bp, Mus musculus
agctagctctgggtgcgattcttca

SEQ ID NO: 178131 - DNA, 25 bp, Mus musculus
agctagctgcaccagaaaccgtctg

SEQ ID NO: 178132 - DNA, 25 bp, Mus musculus
agctagctgcacgagaaaccgtctg

SEQ ID NO: 178133 - DNA, 25 bp, Mus musculus
agctagctggctactttaagtctgt

SEQ ID NO: 178134 - DNA, 25 bp, Mus musculus
agctagctggcttctttaagtctgt

SEQ ID NO: 178135 - DNA, 25 bp, Mus musculus
agctagcttagcatgtgtaggtaac

SEQ ID NO: 178136 - DNA, 25 bp, Mus musculus
agctagcttagcttgtgtaggtaac

SEQ ID NO: 178137 - DNA, 25 bp, Mus musculus
agctagcttgacatggtgtttcctt

SEQ ID NO: 178138 - DNA, 25 bp, Mus musculus
agctagcttgacttggtgtttcctt

SEQ ID NO: 178139 - DNA, 25 bp, Mus musculus
agctagcttgctactttcctgtctt

SEQ ID NO: 178140 - DNA, 25 bp, Mus musculus
agctagcttgcttctttcctgtctt

SEQ ID NO: 178141 - DNA, 25 bp, Mus musculus
agctaggacaggcactcctggccat

SEQ ID NO: 178142 - DNA, 25 bp, Mus musculus
agctaggacagggactcctggccat

SEQ ID NO: 178143 - DNA, 25 bp, Mus musculus
agctaggactcaaacctgggttctc

SEQ ID NO: 178144 - DNA, 25 bp, Mus musculus
agctaggactcaccagtgagttcat

SEQ ID NO: 178145 - DNA, 25 bp, Mus musculus
agctaggactcagcagtgagttcat

SEQ ID NO: 178146 - DNA, 25 bp, Mus musculus
agctaggactcatacctgggttctc

SEQ ID NO: 178147 - DNA, 25 bp, Mus musculus
agctaggactttagctccacaactg

SEQ ID NO: 178148 - DNA, 25 bp, Mus musculus
agctaggacttttgctccacaactg

SEQ ID NO: 178149 - DNA, 25 bp, Mus musculus
agctaggagcacatactcaattctc

SEQ ID NO: 178150 - DNA, 25 bp, Mus musculus
agctaggagcacttactcaattctc

SEQ ID NO: 178151 - DNA, 25 bp, Mus musculus
agctaggatcaaaggcctgcatcac

SEQ ID NO: 178152 - DNA, 25 bp, Mus musculus
agctaggatcaatggcctgcatcac

SEQ ID NO: 178153 - DNA, 25 bp, Mus musculus
agctaggcaatgctgggaccacaga

SEQ ID NO: 178154 - DNA, 25 bp, Mus musculus
agctaggcaatggtgggaccacaga

SEQ ID NO: 178155 - DNA, 25 bp, Mus musculus
agctaggcagatcacttgacccact

SEQ ID NO: 178156 - DNA, 25 bp, Mus musculus
agctaggcagatgacttgacccact

SEQ ID NO: 178157 - DNA, 25 bp, Mus musculus
agctaggcattcacccaacaaaagt

SEQ ID NO: 178158 - DNA, 25 bp, Mus musculus
agctaggcattctcccaacaaaagt

SEQ ID NO: 178159 - DNA, 25 bp, Mus musculus
agctaggcctccatcagtaggctgt

SEQ ID NO: 178160 - DNA, 25 bp, Mus musculus
agctaggcctccttcagtaggctgt

SEQ ID NO: 178161 - DNA, 25 bp, Mus musculus
agctaggccttcagctcaaaactgt

SEQ ID NO: 178162 - DNA, 25 bp, Mus musculus
agctaggccttctgctcaaaactgt

SEQ ID NO: 178163 - DNA, 25 bp, Mus musculus
agctaggcgactatagctgggccgt

SEQ ID NO: 178164 - DNA, 25 bp, Mus musculus
agctaggcgactttagctgggccgt

SEQ ID NO: 178165 - DNA, 25 bp, Mus musculus
agctaggctaaccagggaacctctc

SEQ ID NO: 178166 - DNA, 25 bp, Mus musculus
agctaggctaacgagggaacctctc

SEQ ID NO: 178167 - DNA, 25 bp, Mus musculus
agctaggctgccacttgagttctgg

SEQ ID NO: 178168 - DNA, 25 bp, Mus musculus
agctaggctgcctcttgagttctgg

SEQ ID NO: 178169 - DNA, 25 bp, Mus musculus
agctaggctgtcatatcaggtctca

SEQ ID NO: 178170 - DNA, 25 bp, Mus musculus
agctaggctgtcttatcaggtctca

SEQ ID NO: 178171 - DNA, 25 bp, Mus musculus
agctagggaagtctccaaggacgca

SEQ ID NO: 178172 - DNA, 25 bp, Mus musculus
agctagggaagtgtccaaggacgca

SEQ ID NO: 178173 - DNA, 25 bp, Mus musculus
agctagggccttcgtgtgcactcca

SEQ ID NO: 178174 - DNA, 25 bp, Mus musculus
agctagggccttggtgtgcactcca

SEQ ID NO: 178175 - DNA, 25 bp, Mus musculus
agctagggctctagggtggttcttt

SEQ ID NO: 178176 - DNA, 25 bp, Mus musculus
agctagggctcttgggtggttcttt

SEQ ID NO: 178177 - DNA, 25 bp, Mus musculus
agctagggctgtccggccccatatt

SEQ ID NO: 178178 - DNA, 25 bp, Mus musculus
agctagggctgtgcggccccatatt

SEQ ID NO: 178179 - DNA, 25 bp, Mus musculus
agctagggtctgacatcaggcccca

SEQ ID NO: 178180 - DNA, 25 bp, Mus musculus
agctagggtctgtcatcaggcccca

SEQ ID NO: 178181 - DNA, 25 bp, Mus musculus
agctaggtactcatgttctttttta

SEQ ID NO: 178182 - DNA, 25 bp, Mus musculus
agctaggtactcttgttctttttta

SEQ ID NO: 178183 - DNA, 25 bp, Mus musculus
agctaggtgactccatgcggacgct

SEQ ID NO: 178184 - DNA, 25 bp, Mus musculus
agctaggtgactgcatgcggacgct

SEQ ID NO: 178185 - DNA, 25 bp, Mus musculus
agctaggtgccccaagaacgtcatg

SEQ ID NO: 178186 - DNA, 25 bp, Mus musculus
agctaggtgcccgaagaacgtcatg

SEQ ID NO: 178187 - DNA, 25 bp, Mus musculus
agctaggttgctaaacctcccctct

SEQ ID NO: 178188 - DNA, 25 bp, Mus musculus
agctaggttgcttaacctcccctct

SEQ ID NO: 178189 - DNA, 25 bp, Mus musculus
agctaggtttggagggctgggttca

SEQ ID NO: 178190 - DNA, 25 bp, Mus musculus
agctaggtttggtgggctgggttca

SEQ ID NO: 178191 - DNA, 25 bp, Mus musculus
agctagtaagtcagccataacaaat

SEQ ID NO: 178192 - DNA, 25 bp, Mus musculus
agctagtaagtctgccataacaaat

SEQ ID NO: 178193 - DNA, 25 bp, Mus musculus
agctagtacgttcactttctcctac

SEQ ID NO: 178194 - DNA, 25 bp, Mus musculus
agctagtacgttgactttctcctac

SEQ ID NO: 178195 - DNA, 25 bp, Mus musculus
agctagtatagcagtgtcacttatt

SEQ ID NO: 178196 - DNA, 25 bp, Mus musculus
agctagtatagctgtgtcacttatt

SEQ ID NO: 178197 - DNA, 25 bp, Mus musculus
agctagtcccaccagcttagtggga

SEQ ID NO: 178198 - DNA, 25 bp, Mus musculus
agctagtcccacgagcttagtggga

SEQ ID NO: 178199 - DNA, 25 bp, Mus musculus
agctagtcgatcagcatgcccgata

SEQ ID NO: 178200 - DNA, 25 bp, Mus musculus
agctagtcgatctgcatgcccgata

SEQ ID NO: 178201 - DNA, 25 bp, Mus musculus
agctagtctggaagcttaagcggaa

SEQ ID NO: 178202 - DNA, 25 bp, Mus musculus
agctagtctggatgcttaagcggaa

SEQ ID NO: 178203 - DNA, 25 bp, Mus musculus
agctagtgaaaacttgactcttgta

SEQ ID NO: 178204 - DNA, 25 bp, Mus musculus
agctagtgaaaagttgactcttgta

SEQ ID NO: 178205 - DNA, 25 bp, Mus musculus
agctagtgcctgaatgtgcaccata

SEQ ID NO: 178206 - DNA, 25 bp, Mus musculus
agctagtgcctgtatgtgcaccata

SEQ ID NO: 178207 - DNA, 25 bp, Mus musculus
agctagtgctagcacctggaaccca

SEQ ID NO: 178208 - DNA, 25 bp, Mus musculus
agctagtgctaggacctggaaccca

SEQ ID NO: 178209 - DNA, 25 bp, Mus musculus
agctagtgctcactggtctgcagga

SEQ ID NO: 178210 - DNA, 25 bp, Mus musculus
agctagtgctcagtggtctgcagga

SEQ ID NO: 178211 - DNA, 25 bp, Mus musculus
agctagtgctgcacaacccgtacgc

SEQ ID NO: 178212 - DNA, 25 bp, Mus musculus
agctagtgctgcagtggtaacctca

SEQ ID NO: 178213 - DNA, 25 bp, Mus musculus
agctagtgctgctcaacccgtacgc

SEQ ID NO: 178214 - DNA, 25 bp, Mus musculus
agctagtgctgctgtggtaacctca

SEQ ID NO: 178215 - DNA, 25 bp, Mus musculus
agctagtggctgagatgtggcacca

SEQ ID NO: 178216 - DNA, 25 bp, Mus musculus
agctagtggctgtgatgtggcacca

SEQ ID NO: 178217 - DNA, 25 bp, Mus musculus
agctagtgtcttacatggcaatccc

SEQ ID NO: 178218 - DNA, 25 bp, Mus musculus
agctagtgtctttcatggcaatccc

SEQ ID NO: 178219 - DNA, 25 bp, Mus musculus
agctagttcatgcatccagcgttcc

SEQ ID NO: 178220 - DNA, 25 bp, Mus musculus
agctagttcatggatccagcgttcc

SEQ ID NO: 178221 - DNA, 25 bp, Mus musculus
agctagttcctgctttgttttgttc

SEQ ID NO: 178222 - DNA, 25 bp, Mus musculus
agctagttcctggtttgttttgttc

SEQ ID NO: 178223 - DNA, 25 bp, Mus musculus
agctagttcgcacagatgctctgca

SEQ ID NO: 178224 - DNA, 25 bp, Mus musculus
agctagttcgcagagatgctctgca

SEQ ID NO: 178225 - DNA, 25 bp, Mus musculus
agctagttggtccttgccttattta

SEQ ID NO: 178226 - DNA, 25 bp, Mus musculus
agctagttggtcgttgccttattta

SEQ ID NO: 178227 - DNA, 25 bp, Mus musculus
agctataactgtccctgtgctcttc

SEQ ID NO: 178228 - DNA, 25 bp, Mus musculus
agctataactgtgcctgtgctcttc

SEQ ID NO: 178229 - DNA, 25 bp, Mus musculus
agctatacagtcagtttcaaactgg

SEQ ID NO: 178230 - DNA, 25 bp, Mus musculus
agctatacagtctgtttcaaactgg

SEQ ID NO: 178231 - DNA, 25 bp, Mus musculus
agctataccaagaggctcgggagtg

SEQ ID NO: 178232 - DNA, 25 bp, Mus musculus
agctataccaagtggctcgggagtg

SEQ ID NO: 178233 - DNA, 25 bp, Mus musculus
agctatactacacactgcacaattg

SEQ ID NO: 178234 - DNA, 25 bp, Mus musculus
agctatactacagactgcacaattg

SEQ ID NO: 178235 - DNA, 25 bp, Mus musculus
agctatacttcacccttacagtgag

SEQ ID NO: 178236 - DNA, 25 bp, Mus musculus
agctatacttcagccttacagtgag

SEQ ID NO: 178237 - DNA, 25 bp, Mus musculus
agctatagagcaagtaccctttctt

SEQ ID NO: 178238 - DNA, 25 bp, Mus musculus
agctatagagcatgtaccctttctt

SEQ ID NO: 178239 - DNA, 25 bp, Mus musculus
agctataggccaaaccgctgatgca

SEQ ID NO: 178240 - DNA, 25 bp, Mus musculus
agctataggccataccgctgatgca

SEQ ID NO: 178241 - DNA, 25 bp, Mus musculus
agctatataacacacccctctggtg

SEQ ID NO: 178242 - DNA, 25 bp, Mus musculus
agctatataacagacccctctggtg

SEQ ID NO: 178243 - DNA, 25 bp, Mus musculus
agctatatagcaatacctgtctcaa

SEQ ID NO: 178244 - DNA, 25 bp, Mus musculus
agctatatagcattacctgtctcaa

SEQ ID NO: 178245 - DNA, 25 bp, Mus musculus
agctatatgatccaatgcctgtttt

SEQ ID NO: 178246 - DNA, 25 bp, Mus musculus
agctatatgatcgaatgcctgtttt

SEQ ID NO: 178247 - DNA, 25 bp, Mus musculus
agctatattataaccacctcacaga

SEQ ID NO: 178248 - DNA, 25 bp, Mus musculus
agctatattatatccacctcacaga

SEQ ID NO: 178249 - DNA, 25 bp, Mus musculus
agctatattcccacgggagctgagg

SEQ ID NO: 178250 - DNA, 25 bp, Mus musculus
agctatattccctcgggagctgagg

SEQ ID NO: 178251 - DNA, 25 bp, Mus musculus
agctatatttctcccctctataagc

SEQ ID NO: 178252 - DNA, 25 bp, Mus musculus
agctatatttctgccctctataagc

SEQ ID NO: 178253 - DNA, 25 bp, Mus musculus
agctatatttttctgtgtaatctga

SEQ ID NO: 178254 - DNA, 25 bp, Mus musculus
agctatatttttgtgtgtaatctga

SEQ ID NO: 178255 - DNA, 25 bp, Mus musculus
agctatcacactcgcttctcaaaag

SEQ ID NO: 178256 - DNA, 25 bp, Mus musculus
agctatcacactggcttctcaaaag

SEQ ID NO: 178257 - DNA, 25 bp, Mus musculus
agctatcaccataccctgagttggg

SEQ ID NO: 178258 - DNA, 25 bp, Mus musculus
agctatcaccattccctgagttggg

SEQ ID NO: 178259 - DNA, 25 bp, Mus musculus
agctatcactacaactgtggaatga

SEQ ID NO: 178260 - DNA, 25 bp, Mus musculus
agctatcactactactgtggaatga

SEQ ID NO: 178261 - DNA, 25 bp, Mus musculus
agctatcagactctttaccagactc

SEQ ID NO: 178262 - DNA, 25 bp, Mus musculus
agctatcagactgtttaccagactc

SEQ ID NO: 178263 - DNA, 25 bp, Mus musculus
agctatcagcctaagaacctcagcg

SEQ ID NO: 178264 - DNA, 25 bp, Mus musculus
agctatcagccttagaacctcagcg

SEQ ID NO: 178265 - DNA, 25 bp, Mus musculus
agctatcaggatcctcccttggaaa

SEQ ID NO: 178266 - DNA, 25 bp, Mus musculus
agctatcaggatgctcccttggaaa

SEQ ID NO: 178267 - DNA, 25 bp, Mus musculus
agctatcagtatcccttcagtcagt

SEQ ID NO: 178268 - DNA, 25 bp, Mus musculus
agctatcagtatgccttcagtcagt

SEQ ID NO: 178269 - DNA, 25 bp, Mus musculus
agctatccagcactacacagaaaag

SEQ ID NO: 178270 - DNA, 25 bp, Mus musculus
agctatccagcagtacacagaaaag

SEQ ID NO: 178271 - DNA, 25 bp, Mus musculus
agctatcccacaacagcttagcaga

SEQ ID NO: 178272 - DNA, 25 bp, Mus musculus
agctatcccacatcagcttagcaga

SEQ ID NO: 178273 - DNA, 25 bp, Mus musculus
agctatccccgtctggttagtgaag

SEQ ID NO: 178274 - DNA, 25 bp, Mus musculus
agctatccccgtgtggttagtgaag

SEQ ID NO: 178275 - DNA, 25 bp, Mus musculus
agctatccgaaactggccgtgaata

SEQ ID NO: 178276 - DNA, 25 bp, Mus musculus
agctatccgaaagtggccgtgaata

SEQ ID NO: 178277 - DNA, 25 bp, Mus musculus
agctatcctatcaagcagtttgaga

SEQ ID NO: 178278 - DNA, 25 bp, Mus musculus
agctatcctatctagcagtttgaga

SEQ ID NO: 178279 - DNA, 25 bp, Mus musculus
agctatcctcacagcttgagtttta

SEQ ID NO: 178280 - DNA, 25 bp, Mus musculus
agctatcctcactgcttgagtttta

SEQ ID NO: 178281 - DNA, 25 bp, Mus musculus
agctatcctcttactgccatcgaga

SEQ ID NO: 178282 - DNA, 25 bp, Mus musculus
agctatcctctttctgccatcgaga

SEQ ID NO: 178283 - DNA, 25 bp, Mus musculus
agctatcctgccacatgcagtagta

SEQ ID NO: 178284 - DNA, 25 bp, Mus musculus
agctatcctgcctcatgcagtagta

SEQ ID NO: 178285 - DNA, 25 bp, Mus musculus
agctatcctggacgacttgttgaaa

SEQ ID NO: 178286 - DNA, 25 bp, Mus musculus
agctatcctggaggacttgttgaaa

SEQ ID NO: 178287 - DNA, 25 bp, Mus musculus
agctatcctgtaaagccctctgtta

SEQ ID NO: 178288 - DNA, 25 bp, Mus musculus
agctatcctgtatagccctctgtta

SEQ ID NO: 178289 - DNA, 25 bp, Mus musculus
agctatccttcaaacgctgttgact

SEQ ID NO: 178290 - DNA, 25 bp, Mus musculus
agctatccttcatacgctgttgact

SEQ ID NO: 178291 - DNA, 25 bp, Mus musculus
agctatccttctctatgcaaatgcg

SEQ ID NO: 178292 - DNA, 25 bp, Mus musculus
agctatccttctgtatgcaaatgcg

SEQ ID NO: 178293 - DNA, 25 bp, Mus musculus
agctatcgctatacaccgaggcatg

SEQ ID NO: 178294 - DNA, 25 bp, Mus musculus
agctatcgctatagccatgctgtag

SEQ ID NO: 178295 - DNA, 25 bp, Mus musculus
agctatcgctattcaccgaggcatg

SEQ ID NO: 178296 - DNA, 25 bp, Mus musculus
agctatcgctattgccatgctgtag

SEQ ID NO: 178297 - DNA, 25 bp, Mus musculus
agctatctcatgatgcttgatgttc

SEQ ID NO: 178298 - DNA, 25 bp, Mus musculus
agctatctcatgttgcttgatgttc

SEQ ID NO: 178299 - DNA, 25 bp, Mus musculus
agctatctcctacagggcaagtgac

SEQ ID NO: 178300 - DNA, 25 bp, Mus musculus
agctatctcctagagggcaagtgac

SEQ ID NO: 178301 - DNA, 25 bp, Mus musculus
agctatctctctagctcttaaaaag

SEQ ID NO: 178302 - DNA, 25 bp, Mus musculus
agctatctctcttgctcttaaaaag

SEQ ID NO: 178303 - DNA, 25 bp, Mus musculus
agctatctgaatatggtcttcttgt

SEQ ID NO: 178304 - DNA, 25 bp, Mus musculus
agctatctgaatttggtcttcttgt

SEQ ID NO: 178305 - DNA, 25 bp, Mus musculus
agctatctgacaaaactattcccca

SEQ ID NO: 178306 - DNA, 25 bp, Mus musculus
agctatctgacataactattcccca

SEQ ID NO: 178307 - DNA, 25 bp, Mus musculus
agctatctggcaagcatgtgtactt

SEQ ID NO: 178308 - DNA, 25 bp, Mus musculus
agctatctggcatgcatgtgtactt

SEQ ID NO: 178309 - DNA, 25 bp, Mus musculus
agctatcttcacacgggtgtctgtg

SEQ ID NO: 178310 - DNA, 25 bp, Mus musculus
agctatcttcactcgggtgtctgtg

SEQ ID NO: 178311 - DNA, 25 bp, Mus musculus
agctatcttcatcattttttcagga

SEQ ID NO: 178312 - DNA, 25 bp, Mus musculus
agctatcttcatgattttttcagga

SEQ ID NO: 178313 - DNA, 25 bp, Mus musculus
agctatcttcctcaagtagcgccag

SEQ ID NO: 178314 - DNA, 25 bp, Mus musculus
agctatcttcctgaagtagcgccag

SEQ ID NO: 178315 - DNA, 25 bp, Mus musculus
agctatcttgatactttcttggcca

SEQ ID NO: 178316 - DNA, 25 bp, Mus musculus
agctatcttgattctttcttggcca

SEQ ID NO: 178317 - DNA, 25 bp, Mus musculus
agctatctttctcagatggcattca

SEQ ID NO: 178318 - DNA, 25 bp, Mus musculus
agctatctttctgagatggcattca

SEQ ID NO: 178319 - DNA, 25 bp, Mus musculus
agctatgaacctcacctggattcat

SEQ ID NO: 178320 - DNA, 25 bp, Mus musculus
agctatgaacctgacctggattcat

SEQ ID NO: 178321 - DNA, 25 bp, Mus musculus
agctatgaactcagacttttgattt

SEQ ID NO: 178322 - DNA, 25 bp, Mus musculus
agctatgaactctgacttttgattt

SEQ ID NO: 178323 - DNA, 25 bp, Mus musculus
agctatgaagatacaggcctcctgt

SEQ ID NO: 178324 - DNA, 25 bp, Mus musculus
agctatgaagattcaggcctcctgt

SEQ ID NO: 178325 - DNA, 25 bp, Mus musculus
agctatgacaagcatgtcagcagag

SEQ ID NO: 178326 - DNA, 25 bp, Mus musculus
agctatgacaaggatgtcagcagag

SEQ ID NO: 178327 - DNA, 25 bp, Mus musculus
agctatgacactcctcactgaacgg

SEQ ID NO: 178328 - DNA, 25 bp, Mus musculus
agctatgacactgctcactgaacgg

SEQ ID NO: 178329 - DNA, 25 bp, Mus musculus
agctatgaccctcaaattgggcgtt

SEQ ID NO: 178330 - DNA, 25 bp, Mus musculus
agctatgaccctgaaattgggcgtt

SEQ ID NO: 178331 - DNA, 25 bp, Mus musculus
agctatgacctcctgttagttccca

SEQ ID NO: 178332 - DNA, 25 bp, Mus musculus
agctatgacctcgtgttagttccca

SEQ ID NO: 178333 - DNA, 25 bp, Mus musculus
agctatgacgtacctgaatctcccc

SEQ ID NO: 178334 - DNA, 25 bp, Mus musculus
agctatgacgtagctgaatctcccc

SEQ ID NO: 178335 - DNA, 25 bp, Mus musculus
agctatgactttatatctgttgatt

SEQ ID NO: 178336 - DNA, 25 bp, Mus musculus
agctatgactttttatctgttgatt

SEQ ID NO: 178337 - DNA, 25 bp, Mus musculus
agctatgagccgcaattccacggat

SEQ ID NO: 178338 - DNA, 25 bp, Mus musculus
agctatgagccggaattccacggat

SEQ ID NO: 178339 - DNA, 25 bp, Mus musculus
agctatgagggccatgctgtttgta

SEQ ID NO: 178340 - DNA, 25 bp, Mus musculus
agctatgagggcgatgctgtttgta

SEQ ID NO: 178341 - DNA, 25 bp, Mus musculus
agctatgagtggacgctcagcccga

SEQ ID NO: 178342 - DNA, 25 bp, Mus musculus
agctatgagtggtcgctcagcccga

SEQ ID NO: 178343 - DNA, 25 bp, Mus musculus
agctatgagtttctgtgggacccaa

SEQ ID NO: 178344 - DNA, 25 bp, Mus musculus
agctatgagtttgtgtgggacccaa

SEQ ID NO: 178345 - DNA, 25 bp, Mus musculus
agctatgatcagaactgcctgctgt

SEQ ID NO: 178346 - DNA, 25 bp, Mus musculus
agctatgatcagtactgcctgctgt

SEQ ID NO: 178347 - DNA, 25 bp, Mus musculus
agctatgatcgaacttcagggcccc

SEQ ID NO: 178348 - DNA, 25 bp, Mus musculus
agctatgatcgatcttcagggcccc

SEQ ID NO: 178349 - DNA, 25 bp, Mus musculus
agctatgatgctactcaggcccgta

SEQ ID NO: 178350 - DNA, 25 bp, Mus musculus
agctatgatgcttctcaggcccgta

SEQ ID NO: 178351 - DNA, 25 bp, Mus musculus
agctatgatgtacccaggacgtgaa

SEQ ID NO: 178352 - DNA, 25 bp, Mus musculus
agctatgatgtagccaggacgtgaa

SEQ ID NO: 178353 - DNA, 25 bp, Mus musculus
agctatgattctcagggtccacatg

SEQ ID NO: 178354 - DNA, 25 bp, Mus musculus
agctatgattctgagggtccacatg

SEQ ID NO: 178355 - DNA, 25 bp, Mus musculus
agctatgcacgcaaatgtgggacca

SEQ ID NO: 178356 - DNA, 25 bp, Mus musculus
agctatgcacgctaatgtgggacca

SEQ ID NO: 178357 - DNA, 25 bp, Mus musculus
agctatgcacttagtggaccacagt

SEQ ID NO: 178358 - DNA, 25 bp, Mus musculus
agctatgcactttgtggaccacagt

SEQ ID NO: 178359 - DNA, 25 bp, Mus musculus
agctatgcatttagtcatcagatgt

SEQ ID NO: 178360 - DNA, 25 bp, Mus musculus
agctatgcattttgtcatcagatgt

SEQ ID NO: 178361 - DNA, 25 bp, Mus musculus
agctatgcctggaggcctagcctaa

SEQ ID NO: 178362 - DNA, 25 bp, Mus musculus
agctatgcctggtggcctagcctaa

SEQ ID NO: 178363 - DNA, 25 bp, Mus musculus
agctatgctcatagataccatgtat

SEQ ID NO: 178364 - DNA, 25 bp, Mus musculus
agctatgctcattgataccatgtat

SEQ ID NO: 178365 - DNA, 25 bp, Mus musculus
agctatgctgatacctgtaacttga

SEQ ID NO: 178366 - DNA, 25 bp, Mus musculus
agctatgctgattcctgtaacttga

SEQ ID NO: 178367 - DNA, 25 bp, Mus musculus
agctatgctgtgatgtatgttggtt

SEQ ID NO: 178368 - DNA, 25 bp, Mus musculus
agctatgctgtgttgtatgttggtt

SEQ ID NO: 178369 - DNA, 25 bp, Mus musculus
agctatgcttacactcctgaggagg

SEQ ID NO: 178370 - DNA, 25 bp, Mus musculus
agctatgcttactctcctgaggagg

SEQ ID NO: 178371 - DNA, 25 bp, Mus musculus
agctatgcttagagaggtctgtaca

SEQ ID NO: 178372 - DNA, 25 bp, Mus musculus
agctatgcttagtgaggtctgtaca

SEQ ID NO: 178373 - DNA, 25 bp, Mus musculus
agctatgcttgcaggcctgctgtcc

SEQ ID NO: 178374 - DNA, 25 bp, Mus musculus
agctatgcttgctggcctgctgtcc

SEQ ID NO: 178375 - DNA, 25 bp, Mus musculus
agctatgctttgaagctcaacaccc

SEQ ID NO: 178376 - DNA, 25 bp, Mus musculus
agctatgctttgtagctcaacaccc

SEQ ID NO: 178377 - DNA, 25 bp, Mus musculus
agctatggaccactgctcaatgcag

SEQ ID NO: 178378 - DNA, 25 bp, Mus musculus
agctatggaccagtgctcaatgcag

SEQ ID NO: 178379 - DNA, 25 bp, Mus musculus
agctatggagctcttagttcctgac

SEQ ID NO: 178380 - DNA, 25 bp, Mus musculus
agctatggagctgttagttcctgac

SEQ ID NO: 178381 - DNA, 25 bp, Mus musculus
agctatggaggcacatgccagcgtt

SEQ ID NO: 178382 - DNA, 25 bp, Mus musculus
agctatggaggctcatgccagcgtt

SEQ ID NO: 178383 - DNA, 25 bp, Mus musculus
agctatggcagcacagtaagaccct

SEQ ID NO: 178384 - DNA, 25 bp, Mus musculus
agctatggcagcatgtcccgagggc

SEQ ID NO: 178385 - DNA, 25 bp, Mus musculus
agctatggcagctcagtaagaccct

SEQ ID NO: 178386 - DNA, 25 bp, Mus musculus
agctatggcagcttgtcccgagggc

SEQ ID NO: 178387 - DNA, 25 bp, Mus musculus
agctatggcattcttgggttcttta

SEQ ID NO: 178388 - DNA, 25 bp, Mus musculus
agctatggcattgttgggttcttta

SEQ ID NO: 178389 - DNA, 25 bp, Mus musculus
agctatggccagcttatctctgcta

SEQ ID NO: 178390 - DNA, 25 bp, Mus musculus
agctatggccaggttatctctgcta

SEQ ID NO: 178391 - DNA, 25 bp, Mus musculus
agctatggctgcatttcccaagaag

SEQ ID NO: 178392 - DNA, 25 bp, Mus musculus
agctatggctgcttttcccaagaag

SEQ ID NO: 178393 - DNA, 25 bp, Mus musculus
agctatgggtatcggtgtcctcctc

SEQ ID NO: 178394 - DNA, 25 bp, Mus musculus
agctatgggtatgggtgtcctcctc

SEQ ID NO: 178395 - DNA, 25 bp, Mus musculus
agctatggtccacagagctctcttt

SEQ ID NO: 178396 - DNA, 25 bp, Mus musculus
agctatggtccagagagctctcttt

SEQ ID NO: 178397 - DNA, 25 bp, Mus musculus
agctatggtctactttttcccttat

SEQ ID NO: 178398 - DNA, 25 bp, Mus musculus
agctatggtctagtttttcccttat

SEQ ID NO: 178399 - DNA, 25 bp, Mus musculus
agctatggtgatagtctaagttgaa

SEQ ID NO: 178400 - DNA, 25 bp, Mus musculus
agctatggtgattgtctaagttgaa

SEQ ID NO: 178401 - DNA, 25 bp, Mus musculus
agctatggtggcactgctttacctg

SEQ ID NO: 178402 - DNA, 25 bp, Mus musculus
agctatggtggctctgctttacctg

SEQ ID NO: 178403 - DNA, 25 bp, Mus musculus
agctatgtaggccagcaaactcatg

SEQ ID NO: 178404 - DNA, 25 bp, Mus musculus
agctatgtaggcgagcaaactcatg

SEQ ID NO: 178405 - DNA, 25 bp, Mus musculus
agctatgtcactctttctggctcat

SEQ ID NO: 178406 - DNA, 25 bp, Mus musculus
agctatgtcactgtttctggctcat

SEQ ID NO: 178407 - DNA, 25 bp, Mus musculus
agctatgtcagtattattgcttata

SEQ ID NO: 178408 - DNA, 25 bp, Mus musculus
agctatgtcagttttattgcttata

SEQ ID NO: 178409 - DNA, 25 bp, Mus musculus
agctatgtcttcatgagttttacca

SEQ ID NO: 178410 - DNA, 25 bp, Mus musculus
agctatgtcttcttgagttttacca

SEQ ID NO: 178411 - DNA, 25 bp, Mus musculus
agctatgtgactctgggcaagttca

SEQ ID NO: 178412 - DNA, 25 bp, Mus musculus
agctatgtgactgtgggcaagttca

SEQ ID NO: 178413 - DNA, 25 bp, Mus musculus
agctatgtgcgcctaacatgacaga

SEQ ID NO: 178414 - DNA, 25 bp, Mus musculus
agctatgtgcgcgtaacatgacaga

SEQ ID NO: 178415 - DNA, 25 bp, Mus musculus
agctatgtggcaacccaacacgaag

SEQ ID NO: 178416 - DNA, 25 bp, Mus musculus
agctatgtggcatcccaacacgaag

SEQ ID NO: 178417 - DNA, 25 bp, Mus musculus
agctatgtgtcaccttactgagcca

SEQ ID NO: 178418 - DNA, 25 bp, Mus musculus
agctatgtgtcagcttactgagcca

SEQ ID NO: 178419 - DNA, 25 bp, Mus musculus
agctatgttctcacatgtaagctgt

SEQ ID NO: 178420 - DNA, 25 bp, Mus musculus
agctatgttctctcatgtaagctgt

SEQ ID NO: 178421 - DNA, 25 bp, Mus musculus
agctatgttgatcgctcatgagtac

SEQ ID NO: 178422 - DNA, 25 bp, Mus musculus
agctatgttgatggctcatgagtac

SEQ ID NO: 178423 - DNA, 25 bp, Mus musculus
agctatgttttcacacacaggcaca

SEQ ID NO: 178424 - DNA, 25 bp, Mus musculus
agctatgttttctcacacaggcaca

SEQ ID NO: 178425 - DNA, 25 bp, Mus musculus
agctattacgctactgacggcattc

SEQ ID NO: 178426 - DNA, 25 bp, Mus musculus
agctattacgcttctgacggcattc

SEQ ID NO: 178427 - DNA, 25 bp, Mus musculus
agctattactcaaaaattcaggttc

SEQ ID NO: 178428 - DNA, 25 bp, Mus musculus
agctattactcataaattcaggttc

SEQ ID NO: 178429 - DNA, 25 bp, Mus musculus
agctattcaatgcagctgctctgaa

SEQ ID NO: 178430 - DNA, 25 bp, Mus musculus
agctattcaatggagctgctctgaa

SEQ ID NO: 178431 - DNA, 25 bp, Mus musculus
agctattcatgtatctcagagacga

SEQ ID NO: 178432 - DNA, 25 bp, Mus musculus
agctattcatgtttctcagagacga

SEQ ID NO: 178433 - DNA, 25 bp, Mus musculus
agctattccaagaggcttcatgcac

SEQ ID NO: 178434 - DNA, 25 bp, Mus musculus
agctattccaagtggcttcatgcac

SEQ ID NO: 178435 - DNA, 25 bp, Mus musculus
agctattcctaaactggcaacttct

SEQ ID NO: 178436 - DNA, 25 bp, Mus musculus
agctattcctaatctggcaacttct

SEQ ID NO: 178437 - DNA, 25 bp, Mus musculus
agctattcctacatgtttaagtcac

SEQ ID NO: 178438 - DNA, 25 bp, Mus musculus
agctattcctacttgtttaagtcac

SEQ ID NO: 178439 - DNA, 25 bp, Mus musculus
agctattcgctcacattaacaagtc

SEQ ID NO: 178440 - DNA, 25 bp, Mus musculus
agctattcgctctcattaacaagtc

SEQ ID NO: 178441 - DNA, 25 bp, Mus musculus
agctattcgggaaatcacattcaaa

SEQ ID NO: 178442 - DNA, 25 bp, Mus musculus
agctattcgggatatcacattcaaa

SEQ ID NO: 178443 - DNA, 25 bp, Mus musculus
agctattctagaaaccctcatctct

SEQ ID NO: 178444 - DNA, 25 bp, Mus musculus
agctattctagataccctcatctct

SEQ ID NO: 178445 - DNA, 25 bp, Mus musculus
agctattctgttacggatggttcca

SEQ ID NO: 178446 - DNA, 25 bp, Mus musculus
agctattctgtttcggatggttcca

SEQ ID NO: 178447 - DNA, 25 bp, Mus musculus
agctattctttaagattcaagcaaa

SEQ ID NO: 178448 - DNA, 25 bp, Mus musculus
agctattctttatgattcaagcaaa

SEQ ID NO: 178449 - DNA, 25 bp, Mus musculus
agctattgaactaatgcccatttgc

SEQ ID NO: 178450 - DNA, 25 bp, Mus musculus
agctattgaacttatgcccatttgc

SEQ ID NO: 178451 - DNA, 25 bp, Mus musculus
agctattgaagcaataacctgattt

SEQ ID NO: 178452 - DNA, 25 bp, Mus musculus
agctattgaagctataacctgattt

SEQ ID NO: 178453 - DNA, 25 bp, Mus musculus
agctattgagcgcagtactaggcaa

SEQ ID NO: 178454 - DNA, 25 bp, Mus musculus
agctattgagcggagtactaggcaa

SEQ ID NO: 178455 - DNA, 25 bp, Mus musculus
agctattgatctatccactttccgt

SEQ ID NO: 178456 - DNA, 25 bp, Mus musculus
agctattgatctttccactttccgt

SEQ ID NO: 178457 - DNA, 25 bp, Mus musculus
agctattgctgtcgctaagccacag

SEQ ID NO: 178458 - DNA, 25 bp, Mus musculus
agctattgctgtggctaagccacag

SEQ ID NO: 178459 - DNA, 25 bp, Mus musculus
agctattgtgcccatgctgaagaat

SEQ ID NO: 178460 - DNA, 25 bp, Mus musculus
agctattgtgccgatgctgaagaat

SEQ ID NO: 178461 - DNA, 25 bp, Mus musculus
agctattgttggatgcattgcggca

SEQ ID NO: 178462 - DNA, 25 bp, Mus musculus
agctattgttggttgcattgcggca

SEQ ID NO: 178463 - DNA, 25 bp, Mus musculus
agctatttacatcgcttcccaggct

SEQ ID NO: 178464 - DNA, 25 bp, Mus musculus
agctatttacatggcttcccaggct

SEQ ID NO: 178465 - DNA, 25 bp, Mus musculus
agctatttagttctgttgtcaatca

SEQ ID NO: 178466 - DNA, 25 bp, Mus musculus
agctatttagttgtgttgtcaatca

SEQ ID NO: 178467 - DNA, 25 bp, Mus musculus
agctatttccccactttcaatgtag

SEQ ID NO: 178468 - DNA, 25 bp, Mus musculus
agctatttcccctctttcaatgtag

SEQ ID NO: 178469 - DNA, 25 bp, Mus musculus
agctatttcctgagtcggtcttcat

SEQ ID NO: 178470 - DNA, 25 bp, Mus musculus
agctatttcctgtgtcggtcttcat

SEQ ID NO: 178471 - DNA, 25 bp, Mus musculus
agctatttctagatgccctttaaca

SEQ ID NO: 178472 - DNA, 25 bp, Mus musculus
agctatttctagttgccctttaaca

SEQ ID NO: 178473 - DNA, 25 bp, Mus musculus
agctatttcttgaggtctgagtgac

SEQ ID NO: 178474 - DNA, 25 bp, Mus musculus
agctatttcttgtggtctgagtgac

SEQ ID NO: 178475 - DNA, 25 bp, Mus musculus
agctatttgagcagatcccagggcc

SEQ ID NO: 178476 - DNA, 25 bp, Mus musculus
agctatttgagctgatcccagggcc

SEQ ID NO: 178477 - DNA, 25 bp, Mus musculus
agctatttgtccagagatgtatttt

SEQ ID NO: 178478 - DNA, 25 bp, Mus musculus
agctatttgtcctgagatgtatttt

SEQ ID NO: 178479 - DNA, 25 bp, Mus musculus
agctatttgtctctttggttgttta

SEQ ID NO: 178480 - DNA, 25 bp, Mus musculus
agctatttgtctgtttggttgttta

SEQ ID NO: 178481 - DNA, 25 bp, Mus musculus
agctattttcttaatgtctttttca

SEQ ID NO: 178482 - DNA, 25 bp, Mus musculus
agctattttctttatgtctttttca

SEQ ID NO: 178483 - DNA, 25 bp, Mus musculus
agctattttggtatccaggcctttt

SEQ ID NO: 178484 - DNA, 25 bp, Mus musculus
agctattttggtttccaggcctttt

SEQ ID NO: 178485 - DNA, 25 bp, Mus musculus
agctatttttagcagggcttcgccc

SEQ ID NO: 178486 - DNA, 25 bp, Mus musculus
agctatttttaggagggcttcgccc

SEQ ID NO: 178487 - DNA, 25 bp, Mus musculus
agctatttttatatccttggtatga

SEQ ID NO: 178488 - DNA, 25 bp, Mus musculus
agctatttttatttccttggtatga

SEQ ID NO: 178489 - DNA, 25 bp, Mus musculus
agctattttttcctgcattttggat

SEQ ID NO: 178490 - DNA, 25 bp, Mus musculus
agctattttttcgtgcattttggat

SEQ ID NO: 178491 - DNA, 25 bp, Mus musculus
agctcaaaacctcccctgggttaga

SEQ ID NO: 178492 - DNA, 25 bp, Mus musculus
agctcaaaacctgccctgggttaga

SEQ ID NO: 178493 - DNA, 25 bp, Mus musculus
agctcaaaactgacgatctttagga

SEQ ID NO: 178494 - DNA, 25 bp, Mus musculus
agctcaaaactgtcgatctttagga

SEQ ID NO: 178495 - DNA, 25 bp, Mus musculus
agctcaaaagaacaagacggaccga

SEQ ID NO: 178496 - DNA, 25 bp, Mus musculus
agctcaaaagaagaagacggaccga

SEQ ID NO: 178497 - DNA, 25 bp, Mus musculus
agctcaaaccatcaatctactgtta

SEQ ID NO: 178498 - DNA, 25 bp, Mus musculus
agctcaaaccatgaatctactgtta

SEQ ID NO: 178499 - DNA, 25 bp, Mus musculus
agctcaaacctcacactggatattt

SEQ ID NO: 178500 - DNA, 25 bp, Mus musculus
agctcaaacctctcactggatattt

SEQ ID NO: 178501 - DNA, 25 bp, Mus musculus
agctcaaactggcttggcaagggca

SEQ ID NO: 178502 - DNA, 25 bp, Mus musculus
agctcaaactgggttggcaagggca

SEQ ID NO: 178503 - DNA, 25 bp, Mus musculus
agctcaaagagtcacatatgtccct

SEQ ID NO: 178504 - DNA, 25 bp, Mus musculus
agctcaaagagtgacatatgtccct

SEQ ID NO: 178505 - DNA, 25 bp, Mus musculus
agctcaaagttgacgttttaagaga

SEQ ID NO: 178506 - DNA, 25 bp, Mus musculus
agctcaaagttgtcgttttaagaga

SEQ ID NO: 178507 - DNA, 25 bp, Mus musculus
agctcaaatcctacctggtgcctaa

SEQ ID NO: 178508 - DNA, 25 bp, Mus musculus
agctcaaatccttcctggtgcctaa

SEQ ID NO: 178509 - DNA, 25 bp, Mus musculus
agctcaaatctgcagtcaccaacat

SEQ ID NO: 178510 - DNA, 25 bp, Mus musculus
agctcaaatctggagtcaccaacat

SEQ ID NO: 178511 - DNA, 25 bp, Mus musculus
agctcaaatgttcctacctagttgt

SEQ ID NO: 178512 - DNA, 25 bp, Mus musculus
agctcaaatgttgctacctagttgt

SEQ ID NO: 178513 - DNA, 25 bp, Mus musculus
agctcaacagacctttcctcatctt

SEQ ID NO: 178514 - DNA, 25 bp, Mus musculus
agctcaacagacgtttcctcatctt

SEQ ID NO: 178515 - DNA, 25 bp, Mus musculus
agctcaacagatcgttattattcct

SEQ ID NO: 178516 - DNA, 25 bp, Mus musculus
agctcaacagatggttattattcct

SEQ ID NO: 178517 - DNA, 25 bp, Mus musculus
agctcaaccaagaacatctgggtca

SEQ ID NO: 178518 - DNA, 25 bp, Mus musculus
agctcaaccaagtacatctgggtca

SEQ ID NO: 178519 - DNA, 25 bp, Mus musculus
agctcaaccagaacacattccatga

SEQ ID NO: 178520 - DNA, 25 bp, Mus musculus
agctcaaccagatcacattccatga

SEQ ID NO: 178521 - DNA, 25 bp, Mus musculus
agctcaaccagcaactcaaagaggt

SEQ ID NO: 178522 - DNA, 25 bp, Mus musculus
agctcaaccagctactcaaagaggt

SEQ ID NO: 178523 - DNA, 25 bp, Mus musculus
agctcaaccaggctcacttggaggt

SEQ ID NO: 178524 - DNA, 25 bp, Mus musculus
agctcaaccagggtcacttggaggt

SEQ ID NO: 178525 - DNA, 25 bp, Mus musculus
agctcaacccggaggcgctgggctt

SEQ ID NO: 178526 - DNA, 25 bp, Mus musculus
agctcaacccggtggcgctgggctt

SEQ ID NO: 178527 - DNA, 25 bp, Mus musculus
agctcaaccgagagttgggcttcaa

SEQ ID NO: 178528 - DNA, 25 bp, Mus musculus
agctcaaccgagtgttgggcttcaa

SEQ ID NO: 178529 - DNA, 25 bp, Mus musculus
agctcaaccgccagctgaagggaca

SEQ ID NO: 178530 - DNA, 25 bp, Mus musculus
agctcaaccgcctgctgaagggaca

SEQ ID NO: 178531 - DNA, 25 bp, Mus musculus
agctcaacctgtatgtagtggcaca

SEQ ID NO: 178532 - DNA, 25 bp, Mus musculus
agctcaacctgtttgtagtggcaca

SEQ ID NO: 178533 - DNA, 25 bp, Mus musculus
agctcaacctttctgctgacataat

SEQ ID NO: 178534 - DNA, 25 bp, Mus musculus
agctcaacctttgtgctgacataat

SEQ ID NO: 178535 - DNA, 25 bp, Mus musculus
agctcaacgcagagacctcattaac

SEQ ID NO: 178536 - DNA, 25 bp, Mus musculus
agctcaacgcagtgacctcattaac

SEQ ID NO: 178537 - DNA, 25 bp, Mus musculus
agctcaacggctcggctacttctta

SEQ ID NO: 178538 - DNA, 25 bp, Mus musculus
agctcaacggctgggctacttctta

SEQ ID NO: 178539 - DNA, 25 bp, Mus musculus
agctcaactactccaggaccagctt

SEQ ID NO: 178540 - DNA, 25 bp, Mus musculus
agctcaactactgcaggaccagctt

SEQ ID NO: 178541 - DNA, 25 bp, Mus musculus
agctcaactcatccctttttgatac

SEQ ID NO: 178542 - DNA, 25 bp, Mus musculus
agctcaactcatgcctttttgatac

SEQ ID NO: 178543 - DNA, 25 bp, Mus musculus
agctcaactgatatcttgtccattg

SEQ ID NO: 178544 - DNA, 25 bp, Mus musculus
agctcaactgatttcttgtccattg

SEQ ID NO: 178545 - DNA, 25 bp, Mus musculus
agctcaacttgtatactgatggaac

SEQ ID NO: 178546 - DNA, 25 bp, Mus musculus
agctcaacttgtttactgatggaac

SEQ ID NO: 178547 - DNA, 25 bp, Mus musculus
agctcaagaattctaagactccatt

SEQ ID NO: 178548 - DNA, 25 bp, Mus musculus
agctcaagaattgtaagactccatt

SEQ ID NO: 178549 - DNA, 25 bp, Mus musculus
agctcaagagccactcagcagctag

SEQ ID NO: 178550 - DNA, 25 bp, Mus musculus
agctcaagagccagatgggcagatc

SEQ ID NO: 178551 - DNA, 25 bp, Mus musculus
agctcaagagcccatgtcaccacag

SEQ ID NO: 178552 - DNA, 25 bp, Mus musculus
agctcaagagccgatgtcaccacag

SEQ ID NO: 178553 - DNA, 25 bp, Mus musculus
agctcaagagcctctcagcagctag

SEQ ID NO: 178554 - DNA, 25 bp, Mus musculus
agctcaagagcctgatgggcagatc

SEQ ID NO: 178555 - DNA, 25 bp, Mus musculus
agctcaagcagacgcctacacaatt

SEQ ID NO: 178556 - DNA, 25 bp, Mus musculus
agctcaagcagaggcctacacaatt

SEQ ID NO: 178557 - DNA, 25 bp, Mus musculus
agctcaagcagtacctcggctggct

SEQ ID NO: 178558 - DNA, 25 bp, Mus musculus
agctcaagcagttcctcggctggct

SEQ ID NO: 178559 - DNA, 25 bp, Mus musculus
agctcaagccggatacttcttttct

SEQ ID NO: 178560 - DNA, 25 bp, Mus musculus
agctcaagccggttacttcttttct

SEQ ID NO: 178561 - DNA, 25 bp, Mus musculus
agctcaaggaaactgttcttctgca

SEQ ID NO: 178562 - DNA, 25 bp, Mus musculus
agctcaaggaaagtgttcttctgca

SEQ ID NO: 178563 - DNA, 25 bp, Mus musculus
agctcaaggactacgggccggagac

SEQ ID NO: 178564 - DNA, 25 bp, Mus musculus
agctcaaggactatctaggactttg

SEQ ID NO: 178565 - DNA, 25 bp, Mus musculus
agctcaaggacttcgggccggagac

SEQ ID NO: 178566 - DNA, 25 bp, Mus musculus
agctcaaggactttctaggactttg

SEQ ID NO: 178567 - DNA, 25 bp, Mus musculus
agctcaaggagcaactgaccaggga

SEQ ID NO: 178568 - DNA, 25 bp, Mus musculus
agctcaaggagctactgaccaggga

SEQ ID NO: 178569 - DNA, 25 bp, Mus musculus
agctcaaggattatgactgctatca

SEQ ID NO: 178570 - DNA, 25 bp, Mus musculus
agctcaaggattttgactgctatca

SEQ ID NO: 178571 - DNA, 25 bp, Mus musculus
agctcaaggcatcccgcattggcaa

SEQ ID NO: 178572 - DNA, 25 bp, Mus musculus
agctcaaggcatgccgcattggcaa

SEQ ID NO: 178573 - DNA, 25 bp, Mus musculus
agctcaaggctacctgtaaacccag

SEQ ID NO: 178574 - DNA, 25 bp, Mus musculus
agctcaaggctagctgtaaacccag

SEQ ID NO: 178575 - DNA, 25 bp, Mus musculus
agctcaaggctcagtctcaggtgtt

SEQ ID NO: 178576 - DNA, 25 bp, Mus musculus
agctcaaggctctgtctcaggtgtt

SEQ ID NO: 178577 - DNA, 25 bp, Mus musculus
agctcaaggcttcctgacattatca

SEQ ID NO: 178578 - DNA, 25 bp, Mus musculus
agctcaaggcttgctgacattatca

SEQ ID NO: 178579 - DNA, 25 bp, Mus musculus
agctcaagggcaagtgcgtggtcat

SEQ ID NO: 178580 - DNA, 25 bp, Mus musculus
agctcaagggcatgtgcgtggtcat

SEQ ID NO: 178581 - DNA, 25 bp, Mus musculus
agctcaagggccataccatttgggt

SEQ ID NO: 178582 - DNA, 25 bp, Mus musculus
agctcaagggccttaccatttgggt

SEQ ID NO: 178583 - DNA, 25 bp, Mus musculus
agctcaagtggtatggacacgcccc

SEQ ID NO: 178584 - DNA, 25 bp, Mus musculus
agctcaagtggtttggacacgcccc

SEQ ID NO: 178585 - DNA, 25 bp, Mus musculus
agctcaagttgtcctgggcagtggt

SEQ ID NO: 178586 - DNA, 25 bp, Mus musculus
agctcaagttgtgctgggcagtggt

SEQ ID NO: 178587 - DNA, 25 bp, Mus musculus
agctcaatgaaaacacggttcctgt

SEQ ID NO: 178588 - DNA, 25 bp, Mus musculus
agctcaatgaaatcacggttcctgt

SEQ ID NO: 178589 - DNA, 25 bp, Mus musculus
agctcaatgaccacaaagcctgtgt

SEQ ID NO: 178590 - DNA, 25 bp, Mus musculus
agctcaatgaccctgttcactggga

SEQ ID NO: 178591 - DNA, 25 bp, Mus musculus
agctcaatgaccgtgttcactggga

SEQ ID NO: 178592 - DNA, 25 bp, Mus musculus
agctcaatgacctcaaagcctgtgt

SEQ ID NO: 178593 - DNA, 25 bp, Mus musculus
agctcaatgagcaggccgagtttgc

SEQ ID NO: 178594 - DNA, 25 bp, Mus musculus
agctcaatgagctggccgagtttgc

SEQ ID NO: 178595 - DNA, 25 bp, Mus musculus
agctcaatggcgactcccgtgggag

SEQ ID NO: 178596 - DNA, 25 bp, Mus musculus
agctcaatggcgtctcccgtgggag

SEQ ID NO: 178597 - DNA, 25 bp, Mus musculus
agctcaatgggaaggtcttctgtcc

SEQ ID NO: 178598 - DNA, 25 bp, Mus musculus
agctcaatgggatggtcttctgtcc

SEQ ID NO: 178599 - DNA, 25 bp, Mus musculus
agctcaatggtacaacacttgttta

SEQ ID NO: 178600 - DNA, 25 bp, Mus musculus
agctcaatggtagaacacttgttta

SEQ ID NO: 178601 - DNA, 25 bp, Mus musculus
agctcaatgtaaacctgctccagtt

SEQ ID NO: 178602 - DNA, 25 bp, Mus musculus
agctcaatgtaatcctgctccagtt

SEQ ID NO: 178603 - DNA, 25 bp, Mus musculus
agctcaatgttaccctgatgtcctt

SEQ ID NO: 178604 - DNA, 25 bp, Mus musculus
agctcaatgttagcctgatgtcctt

SEQ ID NO: 178605 - DNA, 25 bp, Mus musculus
agctcaattcagacactcgttttcc

SEQ ID NO: 178606 - DNA, 25 bp, Mus musculus
agctcaattcagtcactcgttttcc

SEQ ID NO: 178607 - DNA, 25 bp, Mus musculus
agctcaattctactcctatctatgc

SEQ ID NO: 178608 - DNA, 25 bp, Mus musculus
agctcaattctagtcctatctatgc

SEQ ID NO: 178609 - DNA, 25 bp, Mus musculus
agctcacaaccaaatgactcaggat

SEQ ID NO: 178610 - DNA, 25 bp, Mus musculus
agctcacaaccatatgactcaggat

SEQ ID NO: 178611 - DNA, 25 bp, Mus musculus
agctcacaactgcacagcaggcagc

SEQ ID NO: 178612 - DNA, 25 bp, Mus musculus
agctcacaactggacagcaggcagc

SEQ ID NO: 178613 - DNA, 25 bp, Mus musculus
agctcacaacttctcaagggttgga

SEQ ID NO: 178614 - DNA, 25 bp, Mus musculus
agctcacaacttgtcaagggttgga

SEQ ID NO: 178615 - DNA, 25 bp, Mus musculus
agctcacaagacactggtcccaggg

SEQ ID NO: 178616 - DNA, 25 bp, Mus musculus
agctcacaagactctggtcccaggg

SEQ ID NO: 178617 - DNA, 25 bp, Mus musculus
agctcacaagcacgaattcctctaa

SEQ ID NO: 178618 - DNA, 25 bp, Mus musculus
agctcacaagcaggaattcctctaa

SEQ ID NO: 178619 - DNA, 25 bp, Mus musculus
agctcacaaggaagtgtagcctgtt

SEQ ID NO: 178620 - DNA, 25 bp, Mus musculus
agctcacaaggatgtgtagcctgtt

SEQ ID NO: 178621 - DNA, 25 bp, Mus musculus
agctcacaatttcgcttcatacttt

SEQ ID NO: 178622 - DNA, 25 bp, Mus musculus
agctcacaatttggcttcatacttt

SEQ ID NO: 178623 - DNA, 25 bp, Mus musculus
agctcacacacactttgtcagacca

SEQ ID NO: 178624 - DNA, 25 bp, Mus musculus
agctcacacacagtttgtcagacca

SEQ ID NO: 178625 - DNA, 25 bp, Mus musculus
agctcacacacccttggaattcttc

SEQ ID NO: 178626 - DNA, 25 bp, Mus musculus
agctcacacacccttggaatttttc

SEQ ID NO: 178627 - DNA, 25 bp, Mus musculus
agctcacacaccgttggaattcttc

SEQ ID NO: 178628 - DNA, 25 bp, Mus musculus
agctcacacaccgttggaatttttc

SEQ ID NO: 178629 - DNA, 25 bp, Mus musculus
agctcacacctgaattcactcaggt

SEQ ID NO: 178630 - DNA, 25 bp, Mus musculus
agctcacacctgtattcactcaggt

SEQ ID NO: 178631 - DNA, 25 bp, Mus musculus
agctcacacggtcctctacaaggag

SEQ ID NO: 178632 - DNA, 25 bp, Mus musculus
agctcacacggtgctctacaaggag

SEQ ID NO: 178633 - DNA, 25 bp, Mus musculus
agctcacagagaacggaaggttcaa

SEQ ID NO: 178634 - DNA, 25 bp, Mus musculus
agctcacagagatcggaaggttcaa

SEQ ID NO: 178635 - DNA, 25 bp, Mus musculus
agctcacagcgccttactatgcaag

SEQ ID NO: 178636 - DNA, 25 bp, Mus musculus
agctcacagcgcgttactatgcaag

SEQ ID NO: 178637 - DNA, 25 bp, Mus musculus
agctcacagctgcttttactggcga

SEQ ID NO: 178638 - DNA, 25 bp, Mus musculus
agctcacagctggttttactggcga

SEQ ID NO: 178639 - DNA, 25 bp, Mus musculus
agctcacagtcgatgtcatatcttc

SEQ ID NO: 178640 - DNA, 25 bp, Mus musculus
agctcacagtcgttgtcatatcttc

SEQ ID NO: 178641 - DNA, 25 bp, Mus musculus
agctcacagtctcctaagacctttg

SEQ ID NO: 178642 - DNA, 25 bp, Mus musculus
agctcacagtctgctaagacctttg

SEQ ID NO: 178643 - DNA, 25 bp, Mus musculus
agctcacagttcaaactacagcctg

SEQ ID NO: 178644 - DNA, 25 bp, Mus musculus
agctcacagttctaactacagcctg

SEQ ID NO: 178645 - DNA, 25 bp, Mus musculus
agctcacatctcaaagggcgcgcgc

SEQ ID NO: 178646 - DNA, 25 bp, Mus musculus
agctcacatctctaagggcgcgcgc

SEQ ID NO: 178647 - DNA, 25 bp, Mus musculus
agctcacatctgagtcggcatcaga

SEQ ID NO: 178648 - DNA, 25 bp, Mus musculus
agctcacatctgtgtcggcatcaga

SEQ ID NO: 178649 - DNA, 25 bp, Mus musculus
agctcacatggcagttttgtctatt

SEQ ID NO: 178650 - DNA, 25 bp, Mus musculus
agctcacatggctgttttgtctatt

SEQ ID NO: 178651 - DNA, 25 bp, Mus musculus
agctcacatttaccgatttctgacc

SEQ ID NO: 178652 - DNA, 25 bp, Mus musculus
agctcacatttagcgatttctgacc

SEQ ID NO: 178653 - DNA, 25 bp, Mus musculus
agctcacattttagcccaagccttt

SEQ ID NO: 178654 - DNA, 25 bp, Mus musculus
agctcacatttttgcccaagccttt

SEQ ID NO: 178655 - DNA, 25 bp, Mus musculus
agctcaccagagaacaccccagctt

SEQ ID NO: 178656 - DNA, 25 bp, Mus musculus
agctcaccagagtacaccccagctt

SEQ ID NO: 178657 - DNA, 25 bp, Mus musculus
agctcaccagcgattgcagctgaaa

SEQ ID NO: 178658 - DNA, 25 bp, Mus musculus
agctcaccagcgtttgcagctgaaa

SEQ ID NO: 178659 - DNA, 25 bp, Mus musculus
agctcaccatgtctgaaagtcctat

SEQ ID NO: 178660 - DNA, 25 bp, Mus musculus
agctcaccatgtgtgaaagtcctat

SEQ ID NO: 178661 - DNA, 25 bp, Mus musculus
agctcaccctgtatctgttggactt

SEQ ID NO: 178662 - DNA, 25 bp, Mus musculus
agctcaccctgtttctgttggactt

SEQ ID NO: 178663 - DNA, 25 bp, Mus musculus
agctcaccgtacacactcagaaaat

SEQ ID NO: 178664 - DNA, 25 bp, Mus musculus
agctcaccgtactcactcagaaaat

SEQ ID NO: 178665 - DNA, 25 bp, Mus musculus
agctcacctactctctgcctgagat

SEQ ID NO: 178666 - DNA, 25 bp, Mus musculus
agctcacctactgtctgcctgagat

SEQ ID NO: 178667 - DNA, 25 bp, Mus musculus
agctcacctagacggcagggaccat

SEQ ID NO: 178668 - DNA, 25 bp, Mus musculus
agctcacctagagggcagggaccat

SEQ ID NO: 178669 - DNA, 25 bp, Mus musculus
agctcacctatcaagcacaaaatga

SEQ ID NO: 178670 - DNA, 25 bp, Mus musculus
agctcacctatctagcacaaaatga

SEQ ID NO: 178671 - DNA, 25 bp, Mus musculus
agctcacctattcgccatcagggaa

SEQ ID NO: 178672 - DNA, 25 bp, Mus musculus
agctcacctattggccatcagggaa

SEQ ID NO: 178673 - DNA, 25 bp, Mus musculus
agctcacctccacggtacttagaga

SEQ ID NO: 178674 - DNA, 25 bp, Mus musculus
agctcacctccagggtacttagaga

SEQ ID NO: 178675 - DNA, 25 bp, Mus musculus
agctcacctcctagaccaagaagtt

SEQ ID NO: 178676 - DNA, 25 bp, Mus musculus
agctcacctccttgaccaagaagtt

SEQ ID NO: 178677 - DNA, 25 bp, Mus musculus
agctcacctgcaacctcaagggtga

SEQ ID NO: 178678 - DNA, 25 bp, Mus musculus
agctcacctgcatcctcaagggtga

SEQ ID NO: 178679 - DNA, 25 bp, Mus musculus
agctcaccttccaactgtgtgggat

SEQ ID NO: 178680 - DNA, 25 bp, Mus musculus
agctcaccttcctactgtgtgggat

SEQ ID NO: 178681 - DNA, 25 bp, Mus musculus
agctcaccttttagagtgcttgcta

SEQ ID NO: 178682 - DNA, 25 bp, Mus musculus
agctcacctttttgagtgcttgcta

SEQ ID NO: 178683 - DNA, 25 bp, Mus musculus
agctcacgccagaggtgcaactcgc

SEQ ID NO: 178684 - DNA, 25 bp, Mus musculus
agctcacgccagtggtgcaactcgc

SEQ ID NO: 178685 - DNA, 25 bp, Mus musculus
agctcacggaccctggttacaaatt

SEQ ID NO: 178686 - DNA, 25 bp, Mus musculus
agctcacggaccgtggttacaaatt

SEQ ID NO: 178687 - DNA, 25 bp, Mus musculus
agctcacggcatctgttgtagccca

SEQ ID NO: 178688 - DNA, 25 bp, Mus musculus
agctcacggcatgtgttgtagccca

SEQ ID NO: 178689 - DNA, 25 bp, Mus musculus
agctcacggccaacagtagttactc

SEQ ID NO: 178690 - DNA, 25 bp, Mus musculus
agctcacggccatcagtagttactc

SEQ ID NO: 178691 - DNA, 25 bp, Mus musculus
agctcacgtatcaaagcagccatga

SEQ ID NO: 178692 - DNA, 25 bp, Mus musculus
agctcacgtatctaagcagccatga

SEQ ID NO: 178693 - DNA, 25 bp, Mus musculus
agctcacgtgtgaccttagtgcagt

SEQ ID NO: 178694 - DNA, 25 bp, Mus musculus
agctcacgtgtgtccttagtgcagt

SEQ ID NO: 178695 - DNA, 25 bp, Mus musculus
agctcactaagtactccttggatgc

SEQ ID NO: 178696 - DNA, 25 bp, Mus musculus
agctcactaagttctccttggatgc

SEQ ID NO: 178697 - DNA, 25 bp, Mus musculus
agctcactatccatccacatgcttg

SEQ ID NO: 178698 - DNA, 25 bp, Mus musculus
agctcactatccttccacatgcttg

SEQ ID NO: 178699 - DNA, 25 bp, Mus musculus
agctcactcatcaaggcgcctgagt

SEQ ID NO: 178700 - DNA, 25 bp, Mus musculus
agctcactcatctaggcgcctgagt

SEQ ID NO: 178701 - DNA, 25 bp, Mus musculus
agctcactcccgcagtcaggtgaag

SEQ ID NO: 178702 - DNA, 25 bp, Mus musculus
agctcactcccggagtcaggtgaag

SEQ ID NO: 178703 - DNA, 25 bp, Mus musculus
agctcactccgtatgtggcagactt

SEQ ID NO: 178704 - DNA, 25 bp, Mus musculus
agctcactccgtttgtggcagactt

SEQ ID NO: 178705 - DNA, 25 bp, Mus musculus
agctcactcggcacataggcggaga

SEQ ID NO: 178706 - DNA, 25 bp, Mus musculus
agctcactcggcctctagacaagag

SEQ ID NO: 178707 - DNA, 25 bp, Mus musculus
agctcactcggcgtctagacaagag

SEQ ID NO: 178708 - DNA, 25 bp, Mus musculus
agctcactcggctcataggcggaga

SEQ ID NO: 178709 - DNA, 25 bp, Mus musculus
agctcactcgtgatttgctttttac

SEQ ID NO: 178710 - DNA, 25 bp, Mus musculus
agctcactcgtgttttgctttttac

SEQ ID NO: 178711 - DNA, 25 bp, Mus musculus
agctcactcgttagtgaagctgtcc

SEQ ID NO: 178712 - DNA, 25 bp, Mus musculus
agctcactcgtttgtgaagctgtcc

SEQ ID NO: 178713 - DNA, 25 bp, Mus musculus
agctcactctgacgaggctgttgct

SEQ ID NO: 178714 - DNA, 25 bp, Mus musculus
agctcactctgaggaggctgttgct

SEQ ID NO: 178715 - DNA, 25 bp, Mus musculus
agctcactctgtcactctgtcgtct

SEQ ID NO: 178716 - DNA, 25 bp, Mus musculus
agctcactctgtgactctgtcgtct

SEQ ID NO: 178717 - DNA, 25 bp, Mus musculus
agctcactcttgattgggagcctga

SEQ ID NO: 178718 - DNA, 25 bp, Mus musculus
agctcactcttgtttgggagcctga

SEQ ID NO: 178719 - DNA, 25 bp, Mus musculus
agctcactctttacagttgccatct

SEQ ID NO: 178720 - DNA, 25 bp, Mus musculus
agctcactcttttcagttgccatct

SEQ ID NO: 178721 - DNA, 25 bp, Mus musculus
agctcactgactcaatgccatccag

SEQ ID NO: 178722 - DNA, 25 bp, Mus musculus
agctcactgactgaatgccatccag

SEQ ID NO: 178723 - DNA, 25 bp, Mus musculus
agctcactgccgctgatggtgttca

SEQ ID NO: 178724 - DNA, 25 bp, Mus musculus
agctcactgccggtgatggtgttca

SEQ ID NO: 178725 - DNA, 25 bp, Mus musculus
agctcactgcttagtcaagttgctg

SEQ ID NO: 178726 - DNA, 25 bp, Mus musculus
agctcactgctttgtcaagttgctg

SEQ ID NO: 178727 - DNA, 25 bp, Mus musculus
agctcactgtgcatgcatgaactct

SEQ ID NO: 178728 - DNA, 25 bp, Mus musculus
agctcactgtgcttgcatgaactct

SEQ ID NO: 178729 - DNA, 25 bp, Mus musculus
agctcacttaacacagaatgcgtcc

SEQ ID NO: 178730 - DNA, 25 bp, Mus musculus
agctcacttaactcagaatgcgtcc

SEQ ID NO: 178731 - DNA, 25 bp, Mus musculus
agctcacttattcctgcggttgcag

SEQ ID NO: 178732 - DNA, 25 bp, Mus musculus
agctcacttattgctgcggttgcag

SEQ ID NO: 178733 - DNA, 25 bp, Mus musculus
agctcacttccgcagagacgagttt

SEQ ID NO: 178734 - DNA, 25 bp, Mus musculus
agctcacttccggagagacgagttt

SEQ ID NO: 178735 - DNA, 25 bp, Mus musculus
agctcacttctgataccttgacctc

SEQ ID NO: 178736 - DNA, 25 bp, Mus musculus
agctcacttctgctgtcggctgtgc

SEQ ID NO: 178737 - DNA, 25 bp, Mus musculus
agctcacttctggtgtcggctgtgc

SEQ ID NO: 178738 - DNA, 25 bp, Mus musculus
agctcacttctgttaccttgacctc

SEQ ID NO: 178739 - DNA, 25 bp, Mus musculus
agctcacttcttaaggtgtgtcaac

SEQ ID NO: 178740 - DNA, 25 bp, Mus musculus
agctcacttctttaggtgtgtcaac

SEQ ID NO: 178741 - DNA, 25 bp, Mus musculus
agctcacttgctccagtgtcatagc

SEQ ID NO: 178742 - DNA, 25 bp, Mus musculus
agctcacttgctgcagtgtcatagc

SEQ ID NO: 178743 - DNA, 25 bp, Mus musculus
agctcagaagttagccacttaccat

SEQ ID NO: 178744 - DNA, 25 bp, Mus musculus
agctcagaagtttgccacttaccat

SEQ ID NO: 178745 - DNA, 25 bp, Mus musculus
agctcagacagcactcagagtctct

SEQ ID NO: 178746 - DNA, 25 bp, Mus musculus
agctcagacagctctcagagtctct

SEQ ID NO: 178747 - DNA, 25 bp, Mus musculus
agctcagacctgcaggagccatcca

SEQ ID NO: 178748 - DNA, 25 bp, Mus musculus
agctcagacctggaggagccatcca

SEQ ID NO: 178749 - DNA, 25 bp, Mus musculus
agctcagactccaaacaggtagcag

SEQ ID NO: 178750 - DNA, 25 bp, Mus musculus
agctcagactcctaacaggtagcag

SEQ ID NO: 178751 - DNA, 25 bp, Mus musculus
agctcagactctcgttcgaattctc

SEQ ID NO: 178752 - DNA, 25 bp, Mus musculus
agctcagactctggttcgaattctc

SEQ ID NO: 178753 - DNA, 25 bp, Mus musculus
agctcagactgaccttgaatgtata

SEQ ID NO: 178754 - DNA, 25 bp, Mus musculus
agctcagactgagcttgaatgtata

SEQ ID NO: 178755 - DNA, 25 bp, Mus musculus
agctcagagagaaggccagccttct

SEQ ID NO: 178756 - DNA, 25 bp, Mus musculus
agctcagagagatggccagccttct

SEQ ID NO: 178757 - DNA, 25 bp, Mus musculus
agctcagagcctattgacacttcaa

SEQ ID NO: 178758 - DNA, 25 bp, Mus musculus
agctcagagccttttgacacttcaa

SEQ ID NO: 178759 - DNA, 25 bp, Mus musculus
agctcagagcttacatatgatccat

SEQ ID NO: 178760 - DNA, 25 bp, Mus musculus
agctcagagctttcatatgatccat

SEQ ID NO: 178761 - DNA, 25 bp, Mus musculus
agctcagaggaactgccgttagcct

SEQ ID NO: 178762 - DNA, 25 bp, Mus musculus
agctcagaggaagtgccgttagcct

SEQ ID NO: 178763 - DNA, 25 bp, Mus musculus
agctcagaggacactgcctcgggat

SEQ ID NO: 178764 - DNA, 25 bp, Mus musculus
agctcagaggactctgcctcgggat

SEQ ID NO: 178765 - DNA, 25 bp, Mus musculus
agctcagaggctatggtacagaatt

SEQ ID NO: 178766 - DNA, 25 bp, Mus musculus
agctcagaggctttggtacagaatt

SEQ ID NO: 178767 - DNA, 25 bp, Mus musculus
agctcagagtacctatctcagcaaa

SEQ ID NO: 178768 - DNA, 25 bp, Mus musculus
agctcagagtacgtatctcagcaaa

SEQ ID NO: 178769 - DNA, 25 bp, Mus musculus
agctcagagtcaccaggtcccctaa

SEQ ID NO: 178770 - DNA, 25 bp, Mus musculus
agctcagagtcagcaggtcccctaa

SEQ ID NO: 178771 - DNA, 25 bp, Mus musculus
agctcagagtggctccacgcagaga

SEQ ID NO: 178772 - DNA, 25 bp, Mus musculus
agctcagagtgggtccacgcagaga

SEQ ID NO: 178773 - DNA, 25 bp, Mus musculus
agctcagatctcatctcatctctgg

SEQ ID NO: 178774 - DNA, 25 bp, Mus musculus
agctcagatctcttctcatctctgg

SEQ ID NO: 178775 - DNA, 25 bp, Mus musculus
agctcagatgagaaatggaccacct

SEQ ID NO: 178776 - DNA, 25 bp, Mus musculus
agctcagatgagtaatggaccacct

SEQ ID NO: 178777 - DNA, 25 bp, Mus musculus
agctcagcaagaaatctctctccta

SEQ ID NO: 178778 - DNA, 25 bp, Mus musculus
agctcagcaagatatctctctccta

SEQ ID NO: 178779 - DNA, 25 bp, Mus musculus
agctcagcaagcaagaggcagcact

SEQ ID NO: 178780 - DNA, 25 bp, Mus musculus
agctcagcaagctagaggcagcact

SEQ ID NO: 178781 - DNA, 25 bp, Mus musculus
agctcagcacacctcctataagaat

SEQ ID NO: 178782 - DNA, 25 bp, Mus musculus
agctcagcacacgtcctataagaat

SEQ ID NO: 178783 - DNA, 25 bp, Mus musculus
agctcagcagaaatgggaacatacc

SEQ ID NO: 178784 - DNA, 25 bp, Mus musculus
agctcagcagaattgggaacatacc

SEQ ID NO: 178785 - DNA, 25 bp, Mus musculus
agctcagcagcaacagtgggcagca

SEQ ID NO: 178786 - DNA, 25 bp, Mus musculus
agctcagcagcatcagtgggcagca

SEQ ID NO: 178787 - DNA, 25 bp, Mus musculus
agctcagcagctatggtatgccatc

SEQ ID NO: 178788 - DNA, 25 bp, Mus musculus
agctcagcagctttggtatgccatc

SEQ ID NO: 178789 - DNA, 25 bp, Mus musculus
agctcagcaggtcccggaaggactc

SEQ ID NO: 178790 - DNA, 25 bp, Mus musculus
agctcagcaggtgccggaaggactc

SEQ ID NO: 178791 - DNA, 25 bp, Mus musculus
agctcagcatatatgggtcccacag

SEQ ID NO: 178792 - DNA, 25 bp, Mus musculus
agctcagcatatttgggtcccacag

SEQ ID NO: 178793 - DNA, 25 bp, Mus musculus
agctcagcatgactttccatttccc

SEQ ID NO: 178794 - DNA, 25 bp, Mus musculus
agctcagcatgagtttccatttccc

SEQ ID NO: 178795 - DNA, 25 bp, Mus musculus
agctcagcatgtcctagtagtcagt

SEQ ID NO: 178796 - DNA, 25 bp, Mus musculus
agctcagcatgtgctagtagtcagt

SEQ ID NO: 178797 - DNA, 25 bp, Mus musculus
agctcagcatttcgaggccagttct

SEQ ID NO: 178798 - DNA, 25 bp, Mus musculus
agctcagcatttggaggccagttct

SEQ ID NO: 178799 - DNA, 25 bp, Mus musculus
agctcagccccaagtgttgtgtgaa

SEQ ID NO: 178800 - DNA, 25 bp, Mus musculus
agctcagccccatgtgttgtgtgaa

SEQ ID NO: 178801 - DNA, 25 bp, Mus musculus
agctcagcccggatcaagcctaggg

SEQ ID NO: 178802 - DNA, 25 bp, Mus musculus
agctcagcccggttcaagcctaggg

SEQ ID NO: 178803 - DNA, 25 bp, Mus musculus
agctcagccgttagtaactccagta

SEQ ID NO: 178804 - DNA, 25 bp, Mus musculus
agctcagccgtttgtaactccagta

SEQ ID NO: 178805 - DNA, 25 bp, Mus musculus
agctcagcctctacgtgttggacag

SEQ ID NO: 178806 - DNA, 25 bp, Mus musculus
agctcagcctctatcgttgccttcg

SEQ ID NO: 178807 - DNA, 25 bp, Mus musculus
agctcagcctcttcgtgttggacag

SEQ ID NO: 178808 - DNA, 25 bp, Mus musculus
agctcagcctctttcgttgccttcg

SEQ ID NO: 178809 - DNA, 25 bp, Mus musculus
agctcagcgattcgcacacgggcct

SEQ ID NO: 178810 - DNA, 25 bp, Mus musculus
agctcagcgattggcacacgggcct

SEQ ID NO: 178811 - DNA, 25 bp, Mus musculus
agctcagcgcttactattgcgaaaa

SEQ ID NO: 178812 - DNA, 25 bp, Mus musculus
agctcagcgctttctattgcgaaaa

SEQ ID NO: 178813 - DNA, 25 bp, Mus musculus
agctcagcgttgctctggcgcatat

SEQ ID NO: 178814 - DNA, 25 bp, Mus musculus
agctcagcgttggtctggcgcatat

SEQ ID NO: 178815 - DNA, 25 bp, Mus musculus
agctcagctattatccatctaggtc

SEQ ID NO: 178816 - DNA, 25 bp, Mus musculus
agctcagctattttccatctaggtc

SEQ ID NO: 178817 - DNA, 25 bp, Mus musculus
agctcagctcatagaggccaggtca

SEQ ID NO: 178818 - DNA, 25 bp, Mus musculus
agctcagctcattgaggccaggtca

SEQ ID NO: 178819 - DNA, 25 bp, Mus musculus
agctcagctccgcaaaggacctctt

SEQ ID NO: 178820 - DNA, 25 bp, Mus musculus
agctcagctccggaaaggacctctt

SEQ ID NO: 178821 - DNA, 25 bp, Mus musculus
agctcagctctcatgcctgaaggag

SEQ ID NO: 178822 - DNA, 25 bp, Mus musculus
agctcagctctcttgcctgaaggag

SEQ ID NO: 178823 - DNA, 25 bp, Mus musculus
agctcagctctgatacctatgctat

SEQ ID NO: 178824 - DNA, 25 bp, Mus musculus
agctcagctctgttacctatgctat

SEQ ID NO: 178825 - DNA, 25 bp, Mus musculus
agctcagctgataaacccagcctgg

SEQ ID NO: 178826 - DNA, 25 bp, Mus musculus
agctcagctgattaacccagcctgg

SEQ ID NO: 178827 - DNA, 25 bp, Mus musculus
agctcagctgcacatgcttttctca

SEQ ID NO: 178828 - DNA, 25 bp, Mus musculus
agctcagctgcagatgcttttctca

SEQ ID NO: 178829 - DNA, 25 bp, Mus musculus
agctcagcttcaacggattacccgg

SEQ ID NO: 178830 - DNA, 25 bp, Mus musculus
agctcagcttcatcggattacccgg

SEQ ID NO: 178831 - DNA, 25 bp, Mus musculus
agctcagcttggattgcgcctagta

SEQ ID NO: 178832 - DNA, 25 bp, Mus musculus
agctcagcttggtttgcgcctagta

SEQ ID NO: 178833 - DNA, 25 bp, Mus musculus
agctcaggacacaggttacacagtt

SEQ ID NO: 178834 - DNA, 25 bp, Mus musculus
agctcaggacactggttacacagtt

SEQ ID NO: 178835 - DNA, 25 bp, Mus musculus
agctcaggacagcagggtagccacc

SEQ ID NO: 178836 - DNA, 25 bp, Mus musculus
agctcaggacaggagggtagccacc

SEQ ID NO: 178837 - DNA, 25 bp, Mus musculus
agctcaggagacaccggtctaggat

SEQ ID NO: 178838 - DNA, 25 bp, Mus musculus
agctcaggagactccggtctaggat

SEQ ID NO: 178839 - DNA, 25 bp, Mus musculus
agctcaggagctatgtcttgttcaa

SEQ ID NO: 178840 - DNA, 25 bp, Mus musculus
agctcaggagctttgtcttgttcaa

SEQ ID NO: 178841 - DNA, 25 bp, Mus musculus
agctcaggatggatccaggcagcct

SEQ ID NO: 178842 - DNA, 25 bp, Mus musculus
agctcaggatggttccaggcagcct

SEQ ID NO: 178843 - DNA, 25 bp, Mus musculus
agctcaggccctacaaactattaac

SEQ ID NO: 178844 - DNA, 25 bp, Mus musculus
agctcaggcccttcaaactattaac

SEQ ID NO: 178845 - DNA, 25 bp, Mus musculus
agctcaggccggagctctgctgctg

SEQ ID NO: 178846 - DNA, 25 bp, Mus musculus
agctcaggccggtgctctgctgctg

SEQ ID NO: 178847 - DNA, 25 bp, Mus musculus
agctcaggcctcacagtacataaaa

SEQ ID NO: 178848 - DNA, 25 bp, Mus musculus
agctcaggcctctcagtacataaaa

SEQ ID NO: 178849 - DNA, 25 bp, Mus musculus
agctcaggccttagcagcgtagtga

SEQ ID NO: 178850 - DNA, 25 bp, Mus musculus
agctcaggcctttgcagcgtagtga

SEQ ID NO: 178851 - DNA, 25 bp, Mus musculus
agctcaggctacagttattttccaa

SEQ ID NO: 178852 - DNA, 25 bp, Mus musculus
agctcaggctactgttattttccaa

SEQ ID NO: 178853 - DNA, 25 bp, Mus musculus
agctcaggctccaaagctggagttc

SEQ ID NO: 178854 - DNA, 25 bp, Mus musculus
agctcaggctcctaagctggagttc

SEQ ID NO: 178855 - DNA, 25 bp, Mus musculus
agctcaggcttaaaaccccagtgac

SEQ ID NO: 178856 - DNA, 25 bp, Mus musculus
agctcaggcttataaccccagtgac

SEQ ID NO: 178857 - DNA, 25 bp, Mus musculus
agctcaggctttaggatagcaggga

SEQ ID NO: 178858 - DNA, 25 bp, Mus musculus
agctcaggctttcttagcgctgaca

SEQ ID NO: 178859 - DNA, 25 bp, Mus musculus
agctcaggctttgttagcgctgaca

SEQ ID NO: 178860 - DNA, 25 bp, Mus musculus
agctcaggcttttggatagcaggga

SEQ ID NO: 178861 - DNA, 25 bp, Mus musculus
agctcagggaacatattgcaggtca

SEQ ID NO: 178862 - DNA, 25 bp, Mus musculus
agctcagggaacttattgcaggtca

SEQ ID NO: 178863 - DNA, 25 bp, Mus musculus
agctcagggaccaaggtgctggcca

SEQ ID NO: 178864 - DNA, 25 bp, Mus musculus
agctcagggacctaggtgctggcca

SEQ ID NO: 178865 - DNA, 25 bp, Mus musculus
agctcagggagcaaccagagaaaaa

SEQ ID NO: 178866 - DNA, 25 bp, Mus musculus
agctcagggagctaccagagaaaaa

SEQ ID NO: 178867 - DNA, 25 bp, Mus musculus
agctcagggcctcttactggagaaa

SEQ ID NO: 178868 - DNA, 25 bp, Mus musculus
agctcagggcctgttactggagaaa

SEQ ID NO: 178869 - DNA, 25 bp, Mus musculus
agctcagggctaagactgtgctttg

SEQ ID NO: 178870 - DNA, 25 bp, Mus musculus
agctcagggctatgactgtgctttg

SEQ ID NO: 178871 - DNA, 25 bp, Mus musculus
agctcagggcttagtgctcaccgga

SEQ ID NO: 178872 - DNA, 25 bp, Mus musculus
agctcagggctttgtgctcaccgga

SEQ ID NO: 178873 - DNA, 25 bp, Mus musculus
agctcagggtctacatttcactcaa

SEQ ID NO: 178874 - DNA, 25 bp, Mus musculus
agctcagggtcttcatttcactcaa

SEQ ID NO: 178875 - DNA, 25 bp, Mus musculus
agctcaggtaacattgactccaatg

SEQ ID NO: 178876 - DNA, 25 bp, Mus musculus
agctcaggtaactttgactccaatg

SEQ ID NO: 178877 - DNA, 25 bp, Mus musculus
agctcaggtactcgctgtcattgca

SEQ ID NO: 178878 - DNA, 25 bp, Mus musculus
agctcaggtactggctgtcattgca

SEQ ID NO: 178879 - DNA, 25 bp, Mus musculus
agctcaggtcccagggctcccgggt

SEQ ID NO: 178880 - DNA, 25 bp, Mus musculus
agctcaggtccctgggctcccgggt

SEQ ID NO: 178881 - DNA, 25 bp, Mus musculus
agctcaggtctgctagtaacatttc

SEQ ID NO: 178882 - DNA, 25 bp, Mus musculus
agctcaggtctggtagtaacatttc

SEQ ID NO: 178883 - DNA, 25 bp, Mus musculus
agctcaggtgatagacatgcatgtc

SEQ ID NO: 178884 - DNA, 25 bp, Mus musculus
agctcaggtgattgacatgcatgtc

SEQ ID NO: 178885 - DNA, 25 bp, Mus musculus
agctcagtagagatgccttttctca

SEQ ID NO: 178886 - DNA, 25 bp, Mus musculus
agctcagtagagttgccttttctca

SEQ ID NO: 178887 - DNA, 25 bp, Mus musculus
agctcagtaggtactctcatgctgc

SEQ ID NO: 178888 - DNA, 25 bp, Mus musculus
agctcagtaggttctctcatgctgc

SEQ ID NO: 178889 - DNA, 25 bp, Mus musculus
agctcagtatacatcagcatgccca

SEQ ID NO: 178890 - DNA, 25 bp, Mus musculus
agctcagtatacttcagcatgccca

SEQ ID NO: 178891 - DNA, 25 bp, Mus musculus
agctcagtcaagaccgtgttggcgg

SEQ ID NO: 178892 - DNA, 25 bp, Mus musculus
agctcagtcaagtccgtgttggcgg

SEQ ID NO: 178893 - DNA, 25 bp, Mus musculus
agctcagtcatcaccattggagcag

SEQ ID NO: 178894 - DNA, 25 bp, Mus musculus
agctcagtcatctccattggagcag

SEQ ID NO: 178895 - DNA, 25 bp, Mus musculus
agctcagtccagcacagctaggaaa

SEQ ID NO: 178896 - DNA, 25 bp, Mus musculus
agctcagtccaggacagctaggaaa

SEQ ID NO: 178897 - DNA, 25 bp, Mus musculus
agctcagtcctgagtcttgtacttg

SEQ ID NO: 178898 - DNA, 25 bp, Mus musculus
agctcagtcctgtgtcttgtacttg

SEQ ID NO: 178899 - DNA, 25 bp, Mus musculus
agctcagtccttctccaactggtga

SEQ ID NO: 178900 - DNA, 25 bp, Mus musculus
agctcagtccttgtccaactggtga

SEQ ID NO: 178901 - DNA, 25 bp, Mus musculus
agctcagtctcaaagatctcggcaa

SEQ ID NO: 178902 - DNA, 25 bp, Mus musculus
agctcagtctcatagatctcggcaa

SEQ ID NO: 178903 - DNA, 25 bp, Mus musculus
agctcagtctgccacagtcactgtg

SEQ ID NO: 178904 - DNA, 25 bp, Mus musculus
agctcagtctgcgacagtcactgtg

SEQ ID NO: 178905 - DNA, 25 bp, Mus musculus
agctcagtctggcttatacaacaaa

SEQ ID NO: 178906 - DNA, 25 bp, Mus musculus
agctcagtctgggttatacaacaaa

SEQ ID NO: 178907 - DNA, 25 bp, Mus musculus
agctcagtctttattcatatcttag

SEQ ID NO: 178908 - DNA, 25 bp, Mus musculus
agctcagtcttttttcatatcttag

SEQ ID NO: 178909 - DNA, 25 bp, Mus musculus
agctcagtgataccacttgcctcgg

SEQ ID NO: 178910 - DNA, 25 bp, Mus musculus
agctcagtgatagcacttgcctcgg

SEQ ID NO: 178911 - DNA, 25 bp, Mus musculus
agctcagtgatgatccagctcctgg

SEQ ID NO: 178912 - DNA, 25 bp, Mus musculus
agctcagtgatgttccagctcctgg

SEQ ID NO: 178913 - DNA, 25 bp, Mus musculus
agctcagtgctaactggaggacaca

SEQ ID NO: 178914 - DNA, 25 bp, Mus musculus
agctcagtgctatctggaggacaca

SEQ ID NO: 178915 - DNA, 25 bp, Mus musculus
agctcagtgctgagggttcaaaagt

SEQ ID NO: 178916 - DNA, 25 bp, Mus musculus
agctcagtgctgtgggttcaaaagt

SEQ ID NO: 178917 - DNA, 25 bp, Mus musculus
agctcagtggagcacatgcctggcc

SEQ ID NO: 178918 - DNA, 25 bp, Mus musculus
agctcagtggaggacatgcctggcc

SEQ ID NO: 178919 - DNA, 25 bp, Mus musculus
agctcagtggctaatatttctcgca

SEQ ID NO: 178920 - DNA, 25 bp, Mus musculus
agctcagtggctatagaggtgttta

SEQ ID NO: 178921 - DNA, 25 bp, Mus musculus
agctcagtggcttatatttctcgca

SEQ ID NO: 178922 - DNA, 25 bp, Mus musculus
agctcagtggctttagaggtgttta

SEQ ID NO: 178923 - DNA, 25 bp, Mus musculus
agctcagtgggtatacgttgacgga

SEQ ID NO: 178924 - DNA, 25 bp, Mus musculus
agctcagtgggtttacgttgacgga

SEQ ID NO: 178925 - DNA, 25 bp, Mus musculus
agctcagtgtagaaactcagggttt

SEQ ID NO: 178926 - DNA, 25 bp, Mus musculus
agctcagtgtagtaactcagggttt

SEQ ID NO: 178927 - DNA, 25 bp, Mus musculus
agctcagtgtgcagctcttttactc

SEQ ID NO: 178928 - DNA, 25 bp, Mus musculus
agctcagtgtgctgctcttttactc

SEQ ID NO: 178929 - DNA, 25 bp, Mus musculus
agctcagttaagagtccaggcctca

SEQ ID NO: 178930 - DNA, 25 bp, Mus musculus
agctcagttaagtgtccaggcctca

SEQ ID NO: 178931 - DNA, 25 bp, Mus musculus
agctcagttattacctttctcttac

SEQ ID NO: 178932 - DNA, 25 bp, Mus musculus
agctcagttatttcctttctcttac

SEQ ID NO: 178933 - DNA, 25 bp, Mus musculus
agctcagttcataaaggaccgggtt

SEQ ID NO: 178934 - DNA, 25 bp, Mus musculus
agctcagttcattaaggaccgggtt

SEQ ID NO: 178935 - DNA, 25 bp, Mus musculus
agctcagttctcaggacatgaaact

SEQ ID NO: 178936 - DNA, 25 bp, Mus musculus
agctcagttctctggacatgaaact

SEQ ID NO: 178937 - DNA, 25 bp, Mus musculus
agctcagttctgacacttgcaggga

SEQ ID NO: 178938 - DNA, 25 bp, Mus musculus
agctcagttctgtcacttgcaggga

SEQ ID NO: 178939 - DNA, 25 bp, Mus musculus
agctcagttgacattttctggcacc

SEQ ID NO: 178940 - DNA, 25 bp, Mus musculus
agctcagttgactttttctggcacc

SEQ ID NO: 178941 - DNA, 25 bp, Mus musculus
agctcagttgcacagcactggctta

SEQ ID NO: 178942 - DNA, 25 bp, Mus musculus
agctcagttgcagagcactggctta

SEQ ID NO: 178943 - DNA, 25 bp, Mus musculus
agctcagtttgactctttccagaag

SEQ ID NO: 178944 - DNA, 25 bp, Mus musculus
agctcagtttgagtctttccagaag

SEQ ID NO: 178945 - DNA, 25 bp, Mus musculus
agctcagttttcagtgcctttgaca

SEQ ID NO: 178946 - DNA, 25 bp, Mus musculus
agctcagttttctgtgcctttgaca

SEQ ID NO: 178947 - DNA, 25 bp, Mus musculus
agctcagttttgacttccgcattga

SEQ ID NO: 178948 - DNA, 25 bp, Mus musculus
agctcagttttgtcttccgcattga

SEQ ID NO: 178949 - DNA, 25 bp, Mus musculus
agctcataaagtccagcttgtcccc

SEQ ID NO: 178950 - DNA, 25 bp, Mus musculus
agctcataaagtgcagcttgtcccc

SEQ ID NO: 178951 - DNA, 25 bp, Mus musculus
agctcataattacatcaccagactt

SEQ ID NO: 178952 - DNA, 25 bp, Mus musculus
agctcataattagatcaccagactt

SEQ ID NO: 178953 - DNA, 25 bp, Mus musculus
agctcataatttagcacatctttta

SEQ ID NO: 178954 - DNA, 25 bp, Mus musculus
agctcataattttgcacatctttta

SEQ ID NO: 178955 - DNA, 25 bp, Mus musculus
agctcatacctactatcttctaatg

SEQ ID NO: 178956 - DNA, 25 bp, Mus musculus
agctcatacctagtatcttctaatg

SEQ ID NO: 178957 - DNA, 25 bp, Mus musculus
agctcatagccaataagccagaatt

SEQ ID NO: 178958 - DNA, 25 bp, Mus musculus
agctcatagccattaagccagaatt

SEQ ID NO: 178959 - DNA, 25 bp, Mus musculus
agctcataggcaaaactcacaggtt

SEQ ID NO: 178960 - DNA, 25 bp, Mus musculus
agctcataggcataactcacaggtt

SEQ ID NO: 178961 - DNA, 25 bp, Mus musculus
agctcataggtcagtcaccggagtc

SEQ ID NO: 178962 - DNA, 25 bp, Mus musculus
agctcataggtctgtcaccggagtc

SEQ ID NO: 178963 - DNA, 25 bp, Mus musculus
agctcatagtgactgtctatcccac

SEQ ID NO: 178964 - DNA, 25 bp, Mus musculus
agctcatagtgagtgtctatcccac

SEQ ID NO: 178965 - DNA, 25 bp, Mus musculus
agctcatagtttatagcatcagtga

SEQ ID NO: 178966 - DNA, 25 bp, Mus musculus
agctcatagtttcagtagcatttgt

SEQ ID NO: 178967 - DNA, 25 bp, Mus musculus
agctcatagtttgagtagcatttgt

SEQ ID NO: 178968 - DNA, 25 bp, Mus musculus
agctcatagtttttagcatcagtga

SEQ ID NO: 178969 - DNA, 25 bp, Mus musculus
agctcatatttaacctctgtttgga

SEQ ID NO: 178970 - DNA, 25 bp, Mus musculus
agctcatatttatcctctgtttgga

SEQ ID NO: 178971 - DNA, 25 bp, Mus musculus
agctcatcaacaaggtctaactaag

SEQ ID NO: 178972 - DNA, 25 bp, Mus musculus
agctcatcaacatggtctaactaag

SEQ ID NO: 178973 - DNA, 25 bp, Mus musculus
agctcatcatatcgagtcccgtgcg

SEQ ID NO: 178974 - DNA, 25 bp, Mus musculus
agctcatcatatggagtcccgtgcg

SEQ ID NO: 178975 - DNA, 25 bp, Mus musculus
agctcatcatctcttactttcttga

SEQ ID NO: 178976 - DNA, 25 bp, Mus musculus
agctcatcatctgttactttcttga

SEQ ID NO: 178977 - DNA, 25 bp, Mus musculus
agctcatcccagagcgggttgatgt

SEQ ID NO: 178978 - DNA, 25 bp, Mus musculus
agctcatcccagtgcgggttgatgt

SEQ ID NO: 178979 - DNA, 25 bp, Mus musculus
agctcatcccggcagtacagagtga

SEQ ID NO: 178980 - DNA, 25 bp, Mus musculus
agctcatcccgggagtacagagtga

SEQ ID NO: 178981 - DNA, 25 bp, Mus musculus
agctcatccgatatcactttttcac

SEQ ID NO: 178982 - DNA, 25 bp, Mus musculus
agctcatccgatttcactttttcac

SEQ ID NO: 178983 - DNA, 25 bp, Mus musculus
agctcatcctaccagtgtgcatgtt

SEQ ID NO: 178984 - DNA, 25 bp, Mus musculus
agctcatcctacgagtgtgcatgtt

SEQ ID NO: 178985 - DNA, 25 bp, Mus musculus
agctcatcctatccgtctggaaaac

SEQ ID NO: 178986 - DNA, 25 bp, Mus musculus
agctcatcctatgcgtctggaaaac

SEQ ID NO: 178987 - DNA, 25 bp, Mus musculus
agctcatcctgtagggagtcctgga

SEQ ID NO: 178988 - DNA, 25 bp, Mus musculus
agctcatcctgttgggagtcctgga

SEQ ID NO: 178989 - DNA, 25 bp, Mus musculus
agctcatcctttcgtagccatagca

SEQ ID NO: 178990 - DNA, 25 bp, Mus musculus
agctcatcctttggtagccatagca

SEQ ID NO: 178991 - DNA, 25 bp, Mus musculus
agctcatcgaaccaggacttgcctc

SEQ ID NO: 178992 - DNA, 25 bp, Mus musculus
agctcatcgaacgaggacttgcctc

SEQ ID NO: 178993 - DNA, 25 bp, Mus musculus
agctcatctccaaacgtgtggtcag

SEQ ID NO: 178994 - DNA, 25 bp, Mus musculus
agctcatctccatacgtgtggtcag

SEQ ID NO: 178995 - DNA, 25 bp, Mus musculus
agctcatctcgaaccttgtgggttg

SEQ ID NO: 178996 - DNA, 25 bp, Mus musculus
agctcatctcgatccttgtgggttg

SEQ ID NO: 178997 - DNA, 25 bp, Mus musculus
agctcatctctacgtgctgcctgat

SEQ ID NO: 178998 - DNA, 25 bp, Mus musculus
agctcatctctaggtgctgcctgat

SEQ ID NO: 178999 - DNA, 25 bp, Mus musculus
agctcatctcttacctaccatatga

SEQ ID NO: 179000 - DNA, 25 bp, Mus musculus
agctcatctctttcctaccatatga

SEQ ID NO: 179001 - DNA, 25 bp, Mus musculus
agctcatcttcacaagtctgccggg

SEQ ID NO: 179002 - DNA, 25 bp, Mus musculus
agctcatcttcacaggccggcgact

SEQ ID NO: 179003 - DNA, 25 bp, Mus musculus
agctcatcttcagaagtctgccggg

SEQ ID NO: 179004 - DNA, 25 bp, Mus musculus
agctcatcttcagaggccggcgact

SEQ ID NO: 179005 - DNA, 25 bp, Mus musculus
agctcatctttgaattcctcatctc

SEQ ID NO: 179006 - DNA, 25 bp, Mus musculus
agctcatctttgcaaggtagccatt

SEQ ID NO: 179007 - DNA, 25 bp, Mus musculus
agctcatctttggaaggtagccatt

SEQ ID NO: 179008 - DNA, 25 bp, Mus musculus
agctcatctttgtattcctcatctc

SEQ ID NO: 179009 - DNA, 25 bp, Mus musculus
agctcatgaactccctcaggctgtg

SEQ ID NO: 179010 - DNA, 25 bp, Mus musculus
agctcatgaactgcctcaggctgtg

SEQ ID NO: 179011 - DNA, 25 bp, Mus musculus
agctcatgacctcttaactccagtt

SEQ ID NO: 179012 - DNA, 25 bp, Mus musculus
agctcatgacctgttaactccagtt

SEQ ID NO: 179013 - DNA, 25 bp, Mus musculus
agctcatgagctctgttaaacctta

SEQ ID NO: 179014 - DNA, 25 bp, Mus musculus
agctcatgagctgtgttaaacctta

SEQ ID NO: 179015 - DNA, 25 bp, Mus musculus
agctcatgaggcaagcggtgctgta

SEQ ID NO: 179016 - DNA, 25 bp, Mus musculus
agctcatgaggctagcggtgctgta

SEQ ID NO: 179017 - DNA, 25 bp, Mus musculus
agctcatgattgcttgccacctgga

SEQ ID NO: 179018 - DNA, 25 bp, Mus musculus
agctcatgattggttgccacctgga

SEQ ID NO: 179019 - DNA, 25 bp, Mus musculus
agctcatgcatgcactactggaact

SEQ ID NO: 179020 - DNA, 25 bp, Mus musculus
agctcatgcatggactactggaact

SEQ ID NO: 179021 - DNA, 25 bp, Mus musculus
agctcatgccccattgttctttttt

SEQ ID NO: 179022 - DNA, 25 bp, Mus musculus
agctcatgcccctttgttctttttt

SEQ ID NO: 179023 - DNA, 25 bp, Mus musculus
agctcatgcgcaatgagttcaagaa

SEQ ID NO: 179024 - DNA, 25 bp, Mus musculus
agctcatgcgcattgagttcaagaa

SEQ ID NO: 179025 - DNA, 25 bp, Mus musculus
agctcatgcttcagtgttgtccctt

SEQ ID NO: 179026 - DNA, 25 bp, Mus musculus
agctcatgcttctgtgttgtccctt

SEQ ID NO: 179027 - DNA, 25 bp, Mus musculus
agctcatgcttgaactagttccctt

SEQ ID NO: 179028 - DNA, 25 bp, Mus musculus
agctcatgcttgatacgtggaatga

SEQ ID NO: 179029 - DNA, 25 bp, Mus musculus
agctcatgcttgtactagttccctt

SEQ ID NO: 179030 - DNA, 25 bp, Mus musculus
agctcatgcttgttacgtggaatga

SEQ ID NO: 179031 - DNA, 25 bp, Mus musculus
agctcatggacgactgttcctgcat

SEQ ID NO: 179032 - DNA, 25 bp, Mus musculus
agctcatggacgtctgttcctgcat

SEQ ID NO: 179033 - DNA, 25 bp, Mus musculus
agctcatggagtagaagctgctcat

SEQ ID NO: 179034 - DNA, 25 bp, Mus musculus
agctcatggagttgaagctgctcat

SEQ ID NO: 179035 - DNA, 25 bp, Mus musculus
agctcatggcctcctcagaggaaga

SEQ ID NO: 179036 - DNA, 25 bp, Mus musculus
agctcatggcctctgcagtgtcaga

SEQ ID NO: 179037 - DNA, 25 bp, Mus musculus
agctcatggcctgctcagaggaaga

SEQ ID NO: 179038 - DNA, 25 bp, Mus musculus
agctcatggcctgtgcagtgtcaga

SEQ ID NO: 179039 - DNA, 25 bp, Mus musculus
agctcatgggcaacttttctattct

SEQ ID NO: 179040 - DNA, 25 bp, Mus musculus
agctcatgggcatcttttctattct

SEQ ID NO: 179041 - DNA, 25 bp, Mus musculus
agctcatgggctccttgggtgtcac

SEQ ID NO: 179042 - DNA, 25 bp, Mus musculus
agctcatgggctgcttgggtgtcac

SEQ ID NO: 179043 - DNA, 25 bp, Mus musculus
agctcatggtggctgcttcacggat

SEQ ID NO: 179044 - DNA, 25 bp, Mus musculus
agctcatggtggctggagtcttccc

SEQ ID NO: 179045 - DNA, 25 bp, Mus musculus
agctcatggtgggtgcttcacggat

SEQ ID NO: 179046 - DNA, 25 bp, Mus musculus
agctcatggtgggtggagtcttccc

SEQ ID NO: 179047 - DNA, 25 bp, Mus musculus
agctcatgtcagcagataggatctg

SEQ ID NO: 179048 - DNA, 25 bp, Mus musculus
agctcatgtcaggagataggatctg

SEQ ID NO: 179049 - DNA, 25 bp, Mus musculus
agctcatgtgcgagaatgcatgcaa

SEQ ID NO: 179050 - DNA, 25 bp, Mus musculus
agctcatgtgcgtgaatgcatgcaa

SEQ ID NO: 179051 - DNA, 25 bp, Mus musculus
agctcatgtggccattaatcccctt

SEQ ID NO: 179052 - DNA, 25 bp, Mus musculus
agctcatgtggcgattaatcccctt

SEQ ID NO: 179053 - DNA, 25 bp, Mus musculus
agctcattagcacagggattcctat

SEQ ID NO: 179054 - DNA, 25 bp, Mus musculus
agctcattagcagagggattcctat

SEQ ID NO: 179055 - DNA, 25 bp, Mus musculus
agctcattagcgagtgtcctttgga

SEQ ID NO: 179056 - DNA, 25 bp, Mus musculus
agctcattagcgtgtgtcctttgga

SEQ ID NO: 179057 - DNA, 25 bp, Mus musculus
agctcattcataatccttatgcctc

SEQ ID NO: 179058 - DNA, 25 bp, Mus musculus
agctcattcatattccttatgcctc

SEQ ID NO: 179059 - DNA, 25 bp, Mus musculus
agctcattccttagtctactaactt

SEQ ID NO: 179060 - DNA, 25 bp, Mus musculus
agctcattcctttgtctactaactt

SEQ ID NO: 179061 - DNA, 25 bp, Mus musculus
agctcattcgcccaaggacggcagt

SEQ ID NO: 179062 - DNA, 25 bp, Mus musculus
agctcattcgccgaaggacggcagt

SEQ ID NO: 179063 - DNA, 25 bp, Mus musculus
agctcattcggtctgcccaggaaat

SEQ ID NO: 179064 - DNA, 25 bp, Mus musculus
agctcattcggtgtgcccaggaaat

SEQ ID NO: 179065 - DNA, 25 bp, Mus musculus
agctcattctgtcaccagcctcaga

SEQ ID NO: 179066 - DNA, 25 bp, Mus musculus
agctcattctgtgaccagcctcaga

SEQ ID NO: 179067 - DNA, 25 bp, Mus musculus
agctcattgaacagcacttgctgca

SEQ ID NO: 179068 - DNA, 25 bp, Mus musculus
agctcattgaactgcacttgctgca

SEQ ID NO: 179069 - DNA, 25 bp, Mus musculus
agctcattgactcttaggttgttca

SEQ ID NO: 179070 - DNA, 25 bp, Mus musculus
agctcattgactgttaggttgttca

SEQ ID NO: 179071 - DNA, 25 bp, Mus musculus
agctcattgcttagggcatatgcct

SEQ ID NO: 179072 - DNA, 25 bp, Mus musculus
agctcattgctttgggcatatgcct

SEQ ID NO: 179073 - DNA, 25 bp, Mus musculus
agctcattggaaacgtgtgcataca

SEQ ID NO: 179074 - DNA, 25 bp, Mus musculus
agctcattggaatcgtgtgcataca

SEQ ID NO: 179075 - DNA, 25 bp, Mus musculus
agctcattggtacgttgaagtaaat

SEQ ID NO: 179076 - DNA, 25 bp, Mus musculus
agctcattggtaggttgaagtaaat

SEQ ID NO: 179077 - DNA, 25 bp, Mus musculus
agctcatttcatcgctggttcacat

SEQ ID NO: 179078 - DNA, 25 bp, Mus musculus
agctcatttcatggctggttcacat

SEQ ID NO: 179079 - DNA, 25 bp, Mus musculus
agctcatttccccttgttgtttgtt

SEQ ID NO: 179080 - DNA, 25 bp, Mus musculus
agctcatttcccgttgttgtttgtt

SEQ ID NO: 179081 - DNA, 25 bp, Mus musculus
agctcatttcgaccctgcttataca

SEQ ID NO: 179082 - DNA, 25 bp, Mus musculus
agctcatttcgagcctgcttataca

SEQ ID NO: 179083 - DNA, 25 bp, Mus musculus
agctcatttctaatcattactgcat

SEQ ID NO: 179084 - DNA, 25 bp, Mus musculus
agctcatttctattcattactgcat

SEQ ID NO: 179085 - DNA, 25 bp, Mus musculus
agctcatttgggaatctttgttttc

SEQ ID NO: 179086 - DNA, 25 bp, Mus musculus
agctcatttgggtatctttgttttc

SEQ ID NO: 179087 - DNA, 25 bp, Mus musculus
agctcattttatcattagagtccat

SEQ ID NO: 179088 - DNA, 25 bp, Mus musculus
agctcattttatgattagagtccat

SEQ ID NO: 179089 - DNA, 25 bp, Mus musculus
agctcattttctacccaagccattg

SEQ ID NO: 179090 - DNA, 25 bp, Mus musculus
agctcattttcttcccaagccattg

SEQ ID NO: 179091 - DNA, 25 bp, Mus musculus
agctccaaacacagaccaggcactg

SEQ ID NO: 179092 - DNA, 25 bp, Mus musculus
agctccaaacactgaccaggcactg

SEQ ID NO: 179093 - DNA, 25 bp, Mus musculus
agctccaaactgaccttgaaggtag

SEQ ID NO: 179094 - DNA, 25 bp, Mus musculus
agctccaaactgtccttgaaggtag

SEQ ID NO: 179095 - DNA, 25 bp, Mus musculus
agctccaaagagctgtctctgtctc

SEQ ID NO: 179096 - DNA, 25 bp, Mus musculus
agctccaaagaggtgtctctgtctc

SEQ ID NO: 179097 - DNA, 25 bp, Mus musculus
agctccaaagctacccaagtccagg

SEQ ID NO: 179098 - DNA, 25 bp, Mus musculus
agctccaaagcttcccaagtccagg

SEQ ID NO: 179099 - DNA, 25 bp, Mus musculus
agctccaaatagatcagtggccagt

SEQ ID NO: 179100 - DNA, 25 bp, Mus musculus
agctccaaatagttcagtggccagt

SEQ ID NO: 179101 - DNA, 25 bp, Mus musculus
agctccaaatgtcactacctgaagg

SEQ ID NO: 179102 - DNA, 25 bp, Mus musculus
agctccaaatgtgactacctgaagg

SEQ ID NO: 179103 - DNA, 25 bp, Mus musculus
agctccaacagcaggatgtggcttt

SEQ ID NO: 179104 - DNA, 25 bp, Mus musculus
agctccaacagctggatgtggcttt

SEQ ID NO: 179105 - DNA, 25 bp, Mus musculus
agctccaacgacaacagcagccaag

SEQ ID NO: 179106 - DNA, 25 bp, Mus musculus
agctccaacgactacagcagccaag

SEQ ID NO: 179107 - DNA, 25 bp, Mus musculus
agctccaactacaggcaccaaaagg

SEQ ID NO: 179108 - DNA, 25 bp, Mus musculus
agctccaactactggcaccaaaagg

SEQ ID NO: 179109 - DNA, 25 bp, Mus musculus
agctccaagcacaactcacgtagtg

SEQ ID NO: 179110 - DNA, 25 bp, Mus musculus
agctccaagcactactcacgtagtg

SEQ ID NO: 179111 - DNA, 25 bp, Mus musculus
agctccaagcttacctgactatgaa

SEQ ID NO: 179112 - DNA, 25 bp, Mus musculus
agctccaagctttcctgactatgaa

SEQ ID NO: 179113 - DNA, 25 bp, Mus musculus
agctccaaggagctgcacgcgtttg

SEQ ID NO: 179114 - DNA, 25 bp, Mus musculus
agctccaaggaggtgcacgcgtttg

SEQ ID NO: 179115 - DNA, 25 bp, Mus musculus
agctccaaggtaagagctgctaccc

SEQ ID NO: 179116 - DNA, 25 bp, Mus musculus
agctccaaggtatgagctgctaccc

SEQ ID NO: 179117 - DNA, 25 bp, Mus musculus
agctccaagtcaccaactgttaaag

SEQ ID NO: 179118 - DNA, 25 bp, Mus musculus
agctccaagtcagcaactgttaaag

SEQ ID NO: 179119 - DNA, 25 bp, Mus musculus
agctccaagtgaatgctgctttcct

SEQ ID NO: 179120 - DNA, 25 bp, Mus musculus
agctccaagtgattgctgctttcct

SEQ ID NO: 179121 - DNA, 25 bp, Mus musculus
agctccaatgtcacttcctcaaggg

SEQ ID NO: 179122 - DNA, 25 bp, Mus musculus
agctccaatgtctcttcctcaaggg

SEQ ID NO: 179123 - DNA, 25 bp, Mus musculus
agctccaatgtgctgttccattctc

SEQ ID NO: 179124 - DNA, 25 bp, Mus musculus
agctccaatgtggtgttccattctc

SEQ ID NO: 179125 - DNA, 25 bp, Mus musculus
agctccaattaccttgtgctggtag

SEQ ID NO: 179126 - DNA, 25 bp, Mus musculus
agctccaattacgttgtgctggtag

SEQ ID NO: 179127 - DNA, 25 bp, Mus musculus
agctccacaaaacgcggcggtccat

SEQ ID NO: 179128 - DNA, 25 bp, Mus musculus
agctccacaaaaggcggcggtccat

SEQ ID NO: 179129 - DNA, 25 bp, Mus musculus
agctccacaacgcagtgtttctaag

SEQ ID NO: 179130 - DNA, 25 bp, Mus musculus
agctccacaacggagtgtttctaag

SEQ ID NO: 179131 - DNA, 25 bp, Mus musculus
agctccacacagctaacaagggcat

SEQ ID NO: 179132 - DNA, 25 bp, Mus musculus
agctccacacaggtaacaagggcat

SEQ ID NO: 179133 - DNA, 25 bp, Mus musculus
agctccacagaactgtatcccatga

SEQ ID NO: 179134 - DNA, 25 bp, Mus musculus
agctccacagaagtgtatcccatga

SEQ ID NO: 179135 - DNA, 25 bp, Mus musculus
agctccacagagacggctgcaattg

SEQ ID NO: 179136 - DNA, 25 bp, Mus musculus
agctccacagagtcggctgcaattg

SEQ ID NO: 179137 - DNA, 25 bp, Mus musculus
agctccacatgcaaaggactccact

SEQ ID NO: 179138 - DNA, 25 bp, Mus musculus
agctccacatgctaaggactccact

SEQ ID NO: 179139 - DNA, 25 bp, Mus musculus
agctccacatgtatctagttaatag

SEQ ID NO: 179140 - DNA, 25 bp, Mus musculus
agctccacatgtttctagttaatag

SEQ ID NO: 179141 - DNA, 25 bp, Mus musculus
agctccacatttcccgaagccagga

SEQ ID NO: 179142 - DNA, 25 bp, Mus musculus
agctccacatttgccgaagccagga

SEQ ID NO: 179143 - DNA, 25 bp, Mus musculus
agctccacctatcccctagaagtta

SEQ ID NO: 179144 - DNA, 25 bp, Mus musculus
agctccacctatgccctagaagtta

SEQ ID NO: 179145 - DNA, 25 bp, Mus musculus
agctccacctcactgcttgattcag

SEQ ID NO: 179146 - DNA, 25 bp, Mus musculus
agctccacctcagtgcttgattcag

SEQ ID NO: 179147 - DNA, 25 bp, Mus musculus
agctccacctgccatatgtgaaaac

SEQ ID NO: 179148 - DNA, 25 bp, Mus musculus
agctccacctgcgatatgtgaaaac

SEQ ID NO: 179149 - DNA, 25 bp, Mus musculus
agctccacggccagaatatcaacta

SEQ ID NO: 179150 - DNA, 25 bp, Mus musculus
agctccacggcctgaatatcaacta

SEQ ID NO: 179151 - DNA, 25 bp, Mus musculus
agctccactattctaagtaaccaca

SEQ ID NO: 179152 - DNA, 25 bp, Mus musculus
agctccactattgtaagtaaccaca

SEQ ID NO: 179153 - DNA, 25 bp, Mus musculus
agctccactgctatgtctcaagcca

SEQ ID NO: 179154 - DNA, 25 bp, Mus musculus
agctccactgctttgtctcaagcca

SEQ ID NO: 179155 - DNA, 25 bp, Mus musculus
agctccagaactatatattgctgta

SEQ ID NO: 179156 - DNA, 25 bp, Mus musculus
agctccagaactttatattgctgta

SEQ ID NO: 179157 - DNA, 25 bp, Mus musculus
agctccagaggtacggtccattatc

SEQ ID NO: 179158 - DNA, 25 bp, Mus musculus
agctccagaggttcggtccattatc

SEQ ID NO: 179159 - DNA, 25 bp, Mus musculus
agctccagagtgctcttgtgtttgg

SEQ ID NO: 179160 - DNA, 25 bp, Mus musculus
agctccagagtggtcttgtgtttgg

SEQ ID NO: 179161 - DNA, 25 bp, Mus musculus
agctccagatgacttttcaaacaag

SEQ ID NO: 179162 - DNA, 25 bp, Mus musculus
agctccagatgagttttcaaacaag

SEQ ID NO: 179163 - DNA, 25 bp, Mus musculus
agctccagcagtctcctgcaggaaa

SEQ ID NO: 179164 - DNA, 25 bp, Mus musculus
agctccagcagtgtcctgcaggaaa

SEQ ID NO: 179165 - DNA, 25 bp, Mus musculus
agctccagcatcaagctgcttgaga

SEQ ID NO: 179166 - DNA, 25 bp, Mus musculus
agctccagcatctagctgcttgaga

SEQ ID NO: 179167 - DNA, 25 bp, Mus musculus
agctccagccctaaagggttaagca

SEQ ID NO: 179168 - DNA, 25 bp, Mus musculus
agctccagcccttaagggttaagca

SEQ ID NO: 179169 - DNA, 25 bp, Mus musculus
agctccagcctgaaaccagatgtgg

SEQ ID NO: 179170 - DNA, 25 bp, Mus musculus
agctccagcctgtaaccagatgtgg

SEQ ID NO: 179171 - DNA, 25 bp, Mus musculus
agctccagctaaacagctatccatt

SEQ ID NO: 179172 - DNA, 25 bp, Mus musculus
agctccagctaatcagctatccatt

SEQ ID NO: 179173 - DNA, 25 bp, Mus musculus
agctccagctggacaaagactctgt

SEQ ID NO: 179174 - DNA, 25 bp, Mus musculus
agctccagctggtcaaagactctgt

SEQ ID NO: 179175 - DNA, 25 bp, Mus musculus
agctccagcttcagagcctggcatc

SEQ ID NO: 179176 - DNA, 25 bp, Mus musculus
agctccagcttctgagcctggcatc

SEQ ID NO: 179177 - DNA, 25 bp, Mus musculus
agctccaggactctgactctaacag

SEQ ID NO: 179178 - DNA, 25 bp, Mus musculus
agctccaggactgtgactctaacag

SEQ ID NO: 179179 - DNA, 25 bp, Mus musculus
agctccaggaggcactgctgaacct

SEQ ID NO: 179180 - DNA, 25 bp, Mus musculus
agctccaggagggactgctgaacct

SEQ ID NO: 179181 - DNA, 25 bp, Mus musculus
agctccaggattctcggctgtaaaa

SEQ ID NO: 179182 - DNA, 25 bp, Mus musculus
agctccaggattgtcggctgtaaaa

SEQ ID NO: 179183 - DNA, 25 bp, Mus musculus
agctccaggctgagtaaaggcagga

SEQ ID NO: 179184 - DNA, 25 bp, Mus musculus
agctccaggctgtgtaaaggcagga

SEQ ID NO: 179185 - DNA, 25 bp, Mus musculus
agctccagggacaccaaaggctaat

SEQ ID NO: 179186 - DNA, 25 bp, Mus musculus
agctccagggactccaaaggctaat

SEQ ID NO: 179187 - DNA, 25 bp, Mus musculus
agctccagggctcttaaggctcagg

SEQ ID NO: 179188 - DNA, 25 bp, Mus musculus
agctccagggctgttaaggctcagg

SEQ ID NO: 179189 - DNA, 25 bp, Mus musculus
agctccagggtaatctgccctttgt

SEQ ID NO: 179190 - DNA, 25 bp, Mus musculus
agctccagggtaattaacaccacct

SEQ ID NO: 179191 - DNA, 25 bp, Mus musculus
agctccagggtattctgccctttgt

SEQ ID NO: 179192 - DNA, 25 bp, Mus musculus
agctccagggtatttaacaccacct

SEQ ID NO: 179193 - DNA, 25 bp, Mus musculus
agctccaggttcagtcttaaataag

SEQ ID NO: 179194 - DNA, 25 bp, Mus musculus
agctccaggttctgtcttaaataag

SEQ ID NO: 179195 - DNA, 25 bp, Mus musculus
agctccagtgaacctcacttaggaa

SEQ ID NO: 179196 - DNA, 25 bp, Mus musculus
agctccagtgaagctcacttaggaa

SEQ ID NO: 179197 - DNA, 25 bp, Mus musculus
agctccagtgatagctgcaggctga

SEQ ID NO: 179198 - DNA, 25 bp, Mus musculus
agctccagtgatcaacctgttccct

SEQ ID NO: 179199 - DNA, 25 bp, Mus musculus
agctccagtgatgaacctgttccct

SEQ ID NO: 179200 - DNA, 25 bp, Mus musculus
agctccagtgattgctgcaggctga

SEQ ID NO: 179201 - DNA, 25 bp, Mus musculus
agctccagtttcctgcagtgatcag

SEQ ID NO: 179202 - DNA, 25 bp, Mus musculus
agctccagtttcgtgcagtgatcag

SEQ ID NO: 179203 - DNA, 25 bp, Mus musculus
agctccagttttctgaaccatgccg

SEQ ID NO: 179204 - DNA, 25 bp, Mus musculus
agctccagttttgtgaaccatgccg

SEQ ID NO: 179205 - DNA, 25 bp, Mus musculus
agctccatacgtattcttcattgtg

SEQ ID NO: 179206 - DNA, 25 bp, Mus musculus
agctccatacgttttcttcattgtg

SEQ ID NO: 179207 - DNA, 25 bp, Mus musculus
agctccatagaacaggtgactacat

SEQ ID NO: 179208 - DNA, 25 bp, Mus musculus
agctccatagaagaggtgactacat

SEQ ID NO: 179209 - DNA, 25 bp, Mus musculus
agctccatagctacatagctgcata

SEQ ID NO: 179210 - DNA, 25 bp, Mus musculus
agctccatagcttcatagctgcata

SEQ ID NO: 179211 - DNA, 25 bp, Mus musculus
agctccatagttatttgttcttttg

SEQ ID NO: 179212 - DNA, 25 bp, Mus musculus
agctccatagttttttgttcttttg

SEQ ID NO: 179213 - DNA, 25 bp, Mus musculus
agctccatatggcttagctcggatt

SEQ ID NO: 179214 - DNA, 25 bp, Mus musculus
agctccatatgggttagctcggatt

SEQ ID NO: 179215 - DNA, 25 bp, Mus musculus
agctccatcaggagtgtgcaatctt

SEQ ID NO: 179216 - DNA, 25 bp, Mus musculus
agctccatcaggtgtgtgcaatctt

SEQ ID NO: 179217 - DNA, 25 bp, Mus musculus
agctccatcatcaccctgaagagcg

SEQ ID NO: 179218 - DNA, 25 bp, Mus musculus
agctccatcatctccctgaagagcg

SEQ ID NO: 179219 - DNA, 25 bp, Mus musculus
agctccatcattaccggaaccggct

SEQ ID NO: 179220 - DNA, 25 bp, Mus musculus
agctccatcatttccggaaccggct

SEQ ID NO: 179221 - DNA, 25 bp, Mus musculus
agctccatcgatcggtgtccctgag

SEQ ID NO: 179222 - DNA, 25 bp, Mus musculus
agctccatcgatgggtgtccctgag

SEQ ID NO: 179223 - DNA, 25 bp, Mus musculus
agctccatcggaaaccgtctttgtt

SEQ ID NO: 179224 - DNA, 25 bp, Mus musculus
agctccatcggataccgtctttgtt

SEQ ID NO: 179225 - DNA, 25 bp, Mus musculus
agctccatctacaaacaatgctgtt

SEQ ID NO: 179226 - DNA, 25 bp, Mus musculus
agctccatctactaacaatgctgtt

SEQ ID NO: 179227 - DNA, 25 bp, Mus musculus
agctccatgacaagtgtcccagatg

SEQ ID NO: 179228 - DNA, 25 bp, Mus musculus
agctccatgacatgtgtcccagatg

SEQ ID NO: 179229 - DNA, 25 bp, Mus musculus
agctccatgcatccccccttgtgga

SEQ ID NO: 179230 - DNA, 25 bp, Mus musculus
agctccatgcatgcccccttgtgga

SEQ ID NO: 179231 - DNA, 25 bp, Mus musculus
agctccatggctaccttcaggcaaa

SEQ ID NO: 179232 - DNA, 25 bp, Mus musculus
agctccatggcttccttcaggcaaa

SEQ ID NO: 179233 - DNA, 25 bp, Mus musculus
agctccatgggaatgcactaactat

SEQ ID NO: 179234 - DNA, 25 bp, Mus musculus
agctccatgggattgcactaactat

SEQ ID NO: 179235 - DNA, 25 bp, Mus musculus
agctccatgtggatgctagcactag

SEQ ID NO: 179236 - DNA, 25 bp, Mus musculus
agctccatgtggttgctagcactag

SEQ ID NO: 179237 - DNA, 25 bp, Mus musculus
agctccattactcgcagagagggcc

SEQ ID NO: 179238 - DNA, 25 bp, Mus musculus
agctccattactggcagagagggcc

SEQ ID NO: 179239 - DNA, 25 bp, Mus musculus
agctccattcacctatatgccaggg

SEQ ID NO: 179240 - DNA, 25 bp, Mus musculus
agctccattcacgtatatgccaggg

SEQ ID NO: 179241 - DNA, 25 bp, Mus musculus
agctccattccacttgtccctttgg

SEQ ID NO: 179242 - DNA, 25 bp, Mus musculus
agctccattccagttgtccctttgg

SEQ ID NO: 179243 - DNA, 25 bp, Mus musculus
agctccattcggaacttgaggccag

SEQ ID NO: 179244 - DNA, 25 bp, Mus musculus
agctccattcggtacttgaggccag

SEQ ID NO: 179245 - DNA, 25 bp, Mus musculus
agctccattctaaactggaacgcca

SEQ ID NO: 179246 - DNA, 25 bp, Mus musculus
agctccattctatactggaacgcca

SEQ ID NO: 179247 - DNA, 25 bp, Mus musculus
agctccattgcaagccagcatcaag

SEQ ID NO: 179248 - DNA, 25 bp, Mus musculus
agctccattgcatgccagcatcaag

SEQ ID NO: 179249 - DNA, 25 bp, Mus musculus
agctccatttctcttcttcctgagt

SEQ ID NO: 179250 - DNA, 25 bp, Mus musculus
agctccatttctgttcttcctgagt

SEQ ID NO: 179251 - DNA, 25 bp, Mus musculus
agctccattttaatcgccattatct

SEQ ID NO: 179252 - DNA, 25 bp, Mus musculus
agctccattttattcgccattatct

SEQ ID NO: 179253 - DNA, 25 bp, Mus musculus
agctcccaaatgaacttgcctctaa

SEQ ID NO: 179254 - DNA, 25 bp, Mus musculus
agctcccaaatgtacttgcctctaa

SEQ ID NO: 179255 - DNA, 25 bp, Mus musculus
agctcccaacttcataattctgtga

SEQ ID NO: 179256 - DNA, 25 bp, Mus musculus
agctcccaacttgataattctgtga

SEQ ID NO: 179257 - DNA, 25 bp, Mus musculus
agctcccaaggactatactttattg

SEQ ID NO: 179258 - DNA, 25 bp, Mus musculus
agctcccaaggagtatactttattg

SEQ ID NO: 179259 - DNA, 25 bp, Mus musculus
agctcccaatctcccattttaaagt

SEQ ID NO: 179260 - DNA, 25 bp, Mus musculus
agctcccaatctgccattttaaagt

SEQ ID NO: 179261 - DNA, 25 bp, Mus musculus
agctcccacatcacagtacagaatg

SEQ ID NO: 179262 - DNA, 25 bp, Mus musculus
agctcccacatctcagtacagaatg

SEQ ID NO: 179263 - DNA, 25 bp, Mus musculus
agctcccaccctcctttatgtgaga

SEQ ID NO: 179264 - DNA, 25 bp, Mus musculus
agctcccaccctgctttatgtgaga

SEQ ID NO: 179265 - DNA, 25 bp, Mus musculus
agctcccagagcaacaacacatgtt

SEQ ID NO: 179266 - DNA, 25 bp, Mus musculus
agctcccagagctacaacacatgtt

SEQ ID NO: 179267 - DNA, 25 bp, Mus musculus
agctcccaggatccttttctgtatt

SEQ ID NO: 179268 - DNA, 25 bp, Mus musculus
agctcccaggatgcttttctgtatt

SEQ ID NO: 179269 - DNA, 25 bp, Mus musculus
agctcccaggccacaagaattgcat

SEQ ID NO: 179270 - DNA, 25 bp, Mus musculus
agctcccaggcctcaagaattgcat

SEQ ID NO: 179271 - DNA, 25 bp, Mus musculus
agctcccagggaaaggaacagacct

SEQ ID NO: 179272 - DNA, 25 bp, Mus musculus
agctcccagggataggaacagacct

SEQ ID NO: 179273 - DNA, 25 bp, Mus musculus
agctcccagggccacttgaatttgt

SEQ ID NO: 179274 - DNA, 25 bp, Mus musculus
agctcccagggcgacttgaatttgt

SEQ ID NO: 179275 - DNA, 25 bp, Mus musculus
agctcccaggttctcatctgtatga

SEQ ID NO: 179276 - DNA, 25 bp, Mus musculus
agctcccaggttgtcatctgtatga

SEQ ID NO: 179277 - DNA, 25 bp, Mus musculus
agctcccagtctatagtctattcta

SEQ ID NO: 179278 - DNA, 25 bp, Mus musculus
agctcccagtctttagtctattcta

SEQ ID NO: 179279 - DNA, 25 bp, Mus musculus
agctcccagtgcctacattaaagaa

SEQ ID NO: 179280 - DNA, 25 bp, Mus musculus
agctcccagtgcgtacattaaagaa

SEQ ID NO: 179281 - DNA, 25 bp, Mus musculus
agctcccagttcactctgacagtga

SEQ ID NO: 179282 - DNA, 25 bp, Mus musculus
agctcccagttctctctgacagtga

SEQ ID NO: 179283 - DNA, 25 bp, Mus musculus
agctcccatattcttttaaagattg

SEQ ID NO: 179284 - DNA, 25 bp, Mus musculus
agctcccatattgttttaaagattg

SEQ ID NO: 179285 - DNA, 25 bp, Mus musculus
agctcccatggtccagtctgtattg

SEQ ID NO: 179286 - DNA, 25 bp, Mus musculus
agctcccatggtgcagtctgtattg

SEQ ID NO: 179287 - DNA, 25 bp, Mus musculus
agctcccatgttcatactgtctaag

SEQ ID NO: 179288 - DNA, 25 bp, Mus musculus
agctcccatgttgatactgtctaag

SEQ ID NO: 179289 - DNA, 25 bp, Mus musculus
agctccccacccaggtatatataca

SEQ ID NO: 179290 - DNA, 25 bp, Mus musculus
agctccccaccctggtatatataca

SEQ ID NO: 179291 - DNA, 25 bp, Mus musculus
agctccccacgaagtaccagagtca

SEQ ID NO: 179292 - DNA, 25 bp, Mus musculus
agctccccacgatgtaccagagtca

SEQ ID NO: 179293 - DNA, 25 bp, Mus musculus
agctccccacttcgcagtttggaag

SEQ ID NO: 179294 - DNA, 25 bp, Mus musculus
agctccccacttggcagtttggaag

SEQ ID NO: 179295 - DNA, 25 bp, Mus musculus
agctccccagagattacgtatgttg

SEQ ID NO: 179296 - DNA, 25 bp, Mus musculus
agctccccagagtttacgtatgttg

SEQ ID NO: 179297 - DNA, 25 bp, Mus musculus
agctccccagtgcttggatttcatg

SEQ ID NO: 179298 - DNA, 25 bp, Mus musculus
agctccccagtggttggatttcatg

SEQ ID NO: 179299 - DNA, 25 bp, Mus musculus
agctccccatctctgggattacagc

SEQ ID NO: 179300 - DNA, 25 bp, Mus musculus
agctccccatctgtgggattacagc

SEQ ID NO: 179301 - DNA, 25 bp, Mus musculus
agctccccgcagatgaggaatcctt

SEQ ID NO: 179302 - DNA, 25 bp, Mus musculus
agctccccgcagttgaggaatcctt

SEQ ID NO: 179303 - DNA, 25 bp, Mus musculus
agctccccggttatccaaggagaca

SEQ ID NO: 179304 - DNA, 25 bp, Mus musculus
agctccccggttttccaaggagaca

SEQ ID NO: 179305 - DNA, 25 bp, Mus musculus
agctcccctgagagctagataatat

SEQ ID NO: 179306 - DNA, 25 bp, Mus musculus
agctcccctgagagtttcggaacag

SEQ ID NO: 179307 - DNA, 25 bp, Mus musculus
agctcccctgagtgctagataatat

SEQ ID NO: 179308 - DNA, 25 bp, Mus musculus
agctcccctgagtgtttcggaacag

SEQ ID NO: 179309 - DNA, 25 bp, Mus musculus
agctcccctgcacatagcaactgga

SEQ ID NO: 179310 - DNA, 25 bp, Mus musculus
agctcccctgcagatagcaactgga

SEQ ID NO: 179311 - DNA, 25 bp, Mus musculus
agctcccctggaccagattccagtg

SEQ ID NO: 179312 - DNA, 25 bp, Mus musculus
agctcccctggagcagattccagtg

SEQ ID NO: 179313 - DNA, 25 bp, Mus musculus
agctccccttacaaaggagtgctgt

SEQ ID NO: 179314 - DNA, 25 bp, Mus musculus
agctccccttactaaggagtgctgt

SEQ ID NO: 179315 - DNA, 25 bp, Mus musculus
agctcccctttcacgaatcaaatat

SEQ ID NO: 179316 - DNA, 25 bp, Mus musculus
agctcccctttctcgaatcaaatat

SEQ ID NO: 179317 - DNA, 25 bp, Mus musculus
agctcccgaggacacagtcaatatt

SEQ ID NO: 179318 - DNA, 25 bp, Mus musculus
agctcccgaggagacagtcaatatt

SEQ ID NO: 179319 - DNA, 25 bp, Mus musculus
agctcccgaggcaccagcgaggcgt

SEQ ID NO: 179320 - DNA, 25 bp, Mus musculus
agctcccgaggctccagcgaggcgt

SEQ ID NO: 179321 - DNA, 25 bp, Mus musculus
agctcccgatacattggtcttgttc

SEQ ID NO: 179322 - DNA, 25 bp, Mus musculus
agctcccgatactttggtcttgttc

SEQ ID NO: 179323 - DNA, 25 bp, Mus musculus
agctcccgcacaaccatgcctttga

SEQ ID NO: 179324 - DNA, 25 bp, Mus musculus
agctcccgcacatccatgcctttga

SEQ ID NO: 179325 - DNA, 25 bp, Mus musculus
agctcccgctctctcagggaattaa

SEQ ID NO: 179326 - DNA, 25 bp, Mus musculus
agctcccgctctgtcagggaattaa

SEQ ID NO: 179327 - DNA, 25 bp, Mus musculus
agctcccggcttactatagttaagt

SEQ ID NO: 179328 - DNA, 25 bp, Mus musculus
agctcccggctttctatagttaagt

SEQ ID NO: 179329 - DNA, 25 bp, Mus musculus
agctcccggtggctcagataataca

SEQ ID NO: 179330 - DNA, 25 bp, Mus musculus
agctcccggtgggtcagataataca

SEQ ID NO: 179331 - DNA, 25 bp, Mus musculus
agctcccgtgagacagatggcatct

SEQ ID NO: 179332 - DNA, 25 bp, Mus musculus
agctcccgtgagtcagatggcatct

SEQ ID NO: 179333 - DNA, 25 bp, Mus musculus
agctcccgtgtcatttaactactat

SEQ ID NO: 179334 - DNA, 25 bp, Mus musculus
agctcccgtgtcttttaactactat

SEQ ID NO: 179335 - DNA, 25 bp, Mus musculus
agctcccgttaaattctcctgtgac

SEQ ID NO: 179336 - DNA, 25 bp, Mus musculus
agctcccgttaatttctcctgtgac

SEQ ID NO: 179337 - DNA, 25 bp, Mus musculus
agctccctattcatcaaacgtttac

SEQ ID NO: 179338 - DNA, 25 bp, Mus musculus
agctccctattcttcaaacgtttac

SEQ ID NO: 179339 - DNA, 25 bp, Mus musculus
agctccctcacaattgtggttgaca

SEQ ID NO: 179340 - DNA, 25 bp, Mus musculus
agctccctcacatttgtggttgaca

SEQ ID NO: 179341 - DNA, 25 bp, Mus musculus
agctccctccagagaatagtgcatc

SEQ ID NO: 179342 - DNA, 25 bp, Mus musculus
agctccctccagtgaatagtgcatc

SEQ ID NO: 179343 - DNA, 25 bp, Mus musculus
agctccctcctacaaccaaggatga

SEQ ID NO: 179344 - DNA, 25 bp, Mus musculus
agctccctcctagaaccaaggatga

SEQ ID NO: 179345 - DNA, 25 bp, Mus musculus
agctccctgaagattcagctaaggc

SEQ ID NO: 179346 - DNA, 25 bp, Mus musculus
agctccctgaagctgtgatcagttt

SEQ ID NO: 179347 - DNA, 25 bp, Mus musculus
agctccctgaaggtgtgatcagttt

SEQ ID NO: 179348 - DNA, 25 bp, Mus musculus
agctccctgaagtttcagctaaggc

SEQ ID NO: 179349 - DNA, 25 bp, Mus musculus
agctccctggcacccatgaaattga

SEQ ID NO: 179350 - DNA, 25 bp, Mus musculus
agctccctggcagccatgaaattga

SEQ ID NO: 179351 - DNA, 25 bp, Mus musculus
agctccctgtggaagtccagattca

SEQ ID NO: 179352 - DNA, 25 bp, Mus musculus
agctccctgtggagactcatgcaca

SEQ ID NO: 179353 - DNA, 25 bp, Mus musculus
agctccctgtggtagtccagattca

SEQ ID NO: 179354 - DNA, 25 bp, Mus musculus
agctccctgtggtgactcatgcaca

SEQ ID NO: 179355 - DNA, 25 bp, Mus musculus
agctcccttacaattgggatacctt

SEQ ID NO: 179356 - DNA, 25 bp, Mus musculus
agctcccttacatttgggatacctt

SEQ ID NO: 179357 - DNA, 25 bp, Mus musculus
agctcccttcccatttagcttattt

SEQ ID NO: 179358 - DNA, 25 bp, Mus musculus
agctcccttcccttttagcttattt

SEQ ID NO: 179359 - DNA, 25 bp, Mus musculus
agctcccttctgattccaatgagga

SEQ ID NO: 179360 - DNA, 25 bp, Mus musculus
agctcccttctgtttccaatgagga

SEQ ID NO: 179361 - DNA, 25 bp, Mus musculus
agctcccttgccatttggtttccag

SEQ ID NO: 179362 - DNA, 25 bp, Mus musculus
agctcccttgccttttggtttccag

SEQ ID NO: 179363 - DNA, 25 bp, Mus musculus
agctcccttgtcctggtttaaacag

SEQ ID NO: 179364 - DNA, 25 bp, Mus musculus
agctcccttgtcgtggtttaaacag

SEQ ID NO: 179365 - DNA, 25 bp, Mus musculus
agctcccttgttagccatgtagttg

SEQ ID NO: 179366 - DNA, 25 bp, Mus musculus
agctcccttgtttgccatgtagttg

SEQ ID NO: 179367 - DNA, 25 bp, Mus musculus
agctccgaactcagtctcaggtgtt

SEQ ID NO: 179368 - DNA, 25 bp, Mus musculus
agctccgaactctgtctcaggtgtt

SEQ ID NO: 179369 - DNA, 25 bp, Mus musculus
agctccgacgctagtctgttcagac

SEQ ID NO: 179370 - DNA, 25 bp, Mus musculus
agctccgacgcttgtctgttcagac

SEQ ID NO: 179371 - DNA, 25 bp, Mus musculus
agctccgactctacccagtacaggt

SEQ ID NO: 179372 - DNA, 25 bp, Mus musculus
agctccgactcttcccagtacaggt

SEQ ID NO: 179373 - DNA, 25 bp, Mus musculus
agctccgagcccaatatggatggtt

SEQ ID NO: 179374 - DNA, 25 bp, Mus musculus
agctccgagccctatatggatggtt

SEQ ID NO: 179375 - DNA, 25 bp, Mus musculus
agctccgcagggagttccagggcct

SEQ ID NO: 179376 - DNA, 25 bp, Mus musculus
agctccgcagggtgttccagggcct

SEQ ID NO: 179377 - DNA, 25 bp, Mus musculus
agctccgcccatcgatgttcgtcag

SEQ ID NO: 179378 - DNA, 25 bp, Mus musculus
agctccgcccatggatgttcgtcag

SEQ ID NO: 179379 - DNA, 25 bp, Mus musculus
agctccgccccaagagtggactaat

SEQ ID NO: 179380 - DNA, 25 bp, Mus musculus
agctccgccccatgagtggactaat

SEQ ID NO: 179381 - DNA, 25 bp, Mus musculus
agctccggactgagcctgtgggcaa

SEQ ID NO: 179382 - DNA, 25 bp, Mus musculus
agctccggactgtgcctgtgggcaa

SEQ ID NO: 179383 - DNA, 25 bp, Mus musculus
agctccggagtacatctggtttaaa

SEQ ID NO: 179384 - DNA, 25 bp, Mus musculus
agctccggagtagatctggtttaaa

SEQ ID NO: 179385 - DNA, 25 bp, Mus musculus
agctccggcacaaactgtcaatgtt

SEQ ID NO: 179386 - DNA, 25 bp, Mus musculus
agctccggcacatactgtcaatgtt

SEQ ID NO: 179387 - DNA, 25 bp, Mus musculus
agctccggcagcacgcgtacgcggt

SEQ ID NO: 179388 - DNA, 25 bp, Mus musculus
agctccggcagctcgcgtacgcggt

SEQ ID NO: 179389 - DNA, 25 bp, Mus musculus
agctccggccgcagatacggctctg

SEQ ID NO: 179390 - DNA, 25 bp, Mus musculus
agctccggccgctgatacggctctg

SEQ ID NO: 179391 - DNA, 25 bp, Mus musculus
agctccggctatcaaactacttatc

SEQ ID NO: 179392 - DNA, 25 bp, Mus musculus
agctccggctatgaaactacttatc

SEQ ID NO: 179393 - DNA, 25 bp, Mus musculus
agctccggctctcggtgctgtaaaa

SEQ ID NO: 179394 - DNA, 25 bp, Mus musculus
agctccggctctgggtgctgtaaaa

SEQ ID NO: 179395 - DNA, 25 bp, Mus musculus
agctccgggatgctgtgctccttgt

SEQ ID NO: 179396 - DNA, 25 bp, Mus musculus
agctccgggatggtgtgctccttgt

SEQ ID NO: 179397 - DNA, 25 bp, Mus musculus
agctccggtctgatatccaaaaacg

SEQ ID NO: 179398 - DNA, 25 bp, Mus musculus
agctccggtctgttatccaaaaacg

SEQ ID NO: 179399 - DNA, 25 bp, Mus musculus
agctccggttctcagtcctggagaa

SEQ ID NO: 179400 - DNA, 25 bp, Mus musculus
agctccggttctgagtcctggagaa

SEQ ID NO: 179401 - DNA, 25 bp, Mus musculus
agctccgtaatgcacgtggtttggt

SEQ ID NO: 179402 - DNA, 25 bp, Mus musculus
agctccgtaatggacgtggtttggt

SEQ ID NO: 179403 - DNA, 25 bp, Mus musculus
agctccgtactcacatgtgctgtgg

SEQ ID NO: 179404 - DNA, 25 bp, Mus musculus
agctccgtactctcatgtgctgtgg

SEQ ID NO: 179405 - DNA, 25 bp, Mus musculus
agctccgtccggagtatcaggtgag

SEQ ID NO: 179406 - DNA, 25 bp, Mus musculus
agctccgtccggtgtatcaggtgag

SEQ ID NO: 179407 - DNA, 25 bp, Mus musculus
agctccgtcggccatcaaggacagt

SEQ ID NO: 179408 - DNA, 25 bp, Mus musculus
agctccgtcggcgatcaaggacagt

SEQ ID NO: 179409 - DNA, 25 bp, Mus musculus
agctccgtctggaagccagcaggaa

SEQ ID NO: 179410 - DNA, 25 bp, Mus musculus
agctccgtctggtagccagcaggaa

SEQ ID NO: 179411 - DNA, 25 bp, Mus musculus
agctccgtgacaactagccagtgga

SEQ ID NO: 179412 - DNA, 25 bp, Mus musculus
agctccgtgacatctagccagtgga

SEQ ID NO: 179413 - DNA, 25 bp, Mus musculus
agctccgtgcatattgccatcagtg

SEQ ID NO: 179414 - DNA, 25 bp, Mus musculus
agctccgtgcattttgccatcagtg

SEQ ID NO: 179415 - DNA, 25 bp, Mus musculus
agctccgtgcccatgaactttaagg

SEQ ID NO: 179416 - DNA, 25 bp, Mus musculus
agctccgtgcccatttagaaggtga

SEQ ID NO: 179417 - DNA, 25 bp, Mus musculus
agctccgtgcccttgaactttaagg

SEQ ID NO: 179418 - DNA, 25 bp, Mus musculus
agctccgtgcccttttagaaggtga

SEQ ID NO: 179419 - DNA, 25 bp, Mus musculus
agctccgtggtcatctgtcaagtgc

SEQ ID NO: 179420 - DNA, 25 bp, Mus musculus
agctccgtggtcttctgtcaagtgc

SEQ ID NO: 179421 - DNA, 25 bp, Mus musculus
agctccgtggtgaggcttgtagcaa

SEQ ID NO: 179422 - DNA, 25 bp, Mus musculus
agctccgtggtgtggcttgtagcaa

SEQ ID NO: 179423 - DNA, 25 bp, Mus musculus
agctccgtgtgcacactaccaaaga

SEQ ID NO: 179424 - DNA, 25 bp, Mus musculus
agctccgtgtgctcactaccaaaga

SEQ ID NO: 179425 - DNA, 25 bp, Mus musculus
agctccgtgtttccatgtgtagata

SEQ ID NO: 179426 - DNA, 25 bp, Mus musculus
agctccgtgtttgcatgtgtagata

SEQ ID NO: 179427 - DNA, 25 bp, Mus musculus
agctccgttgctcaaggctccggga

SEQ ID NO: 179428 - DNA, 25 bp, Mus musculus
agctccgttgctgaaggctccggga

SEQ ID NO: 179429 - DNA, 25 bp, Mus musculus
agctcctaaaggctgagttcctcct

SEQ ID NO: 179430 - DNA, 25 bp, Mus musculus
agctcctaaagggtgagttcctcct

SEQ ID NO: 179431 - DNA, 25 bp, Mus musculus
agctcctaagtgcttcagaaggaaa

SEQ ID NO: 179432 - DNA, 25 bp, Mus musculus
agctcctaagtggttcagaaggaaa

SEQ ID NO: 179433 - DNA, 25 bp, Mus musculus
agctcctacaggacttgcaggtgga

SEQ ID NO: 179434 - DNA, 25 bp, Mus musculus
agctcctacaggtcttgcaggtgga

SEQ ID NO: 179435 - DNA, 25 bp, Mus musculus
agctcctacagtcgtccatcaaggc

SEQ ID NO: 179436 - DNA, 25 bp, Mus musculus
agctcctacagtggtccatcaaggc

SEQ ID NO: 179437 - DNA, 25 bp, Mus musculus
agctcctacatgacttgcattctaa

SEQ ID NO: 179438 - DNA, 25 bp, Mus musculus
agctcctacatgtcttgcattctaa

SEQ ID NO: 179439 - DNA, 25 bp, Mus musculus
agctcctacccacgactgcagatgg

SEQ ID NO: 179440 - DNA, 25 bp, Mus musculus
agctcctacccaggactgcagatgg

SEQ ID NO: 179441 - DNA, 25 bp, Mus musculus
agctcctagcgtcagcatctgtgag

SEQ ID NO: 179442 - DNA, 25 bp, Mus musculus
agctcctagcgtccatgaattcgtg

SEQ ID NO: 179443 - DNA, 25 bp, Mus musculus
agctcctagcgtgagcatctgtgag

SEQ ID NO: 179444 - DNA, 25 bp, Mus musculus
agctcctagcgtgcatgaattcgtg

SEQ ID NO: 179445 - DNA, 25 bp, Mus musculus
agctcctagctgctcagttactata

SEQ ID NO: 179446 - DNA, 25 bp, Mus musculus
agctcctagctggtcagttactata

SEQ ID NO: 179447 - DNA, 25 bp, Mus musculus
agctcctaggctctggtcaagtatt

SEQ ID NO: 179448 - DNA, 25 bp, Mus musculus
agctcctaggctgtggtcaagtatt

SEQ ID NO: 179449 - DNA, 25 bp, Mus musculus
agctcctattttacccacaaatcgt

SEQ ID NO: 179450 - DNA, 25 bp, Mus musculus
agctcctattttcattccacgtgga

SEQ ID NO: 179451 - DNA, 25 bp, Mus musculus
agctcctattttgattccacgtgga

SEQ ID NO: 179452 - DNA, 25 bp, Mus musculus
agctcctatttttcccacaaatcgt

SEQ ID NO: 179453 - DNA, 25 bp, Mus musculus
agctcctcacggatcattttttcag

SEQ ID NO: 179454 - DNA, 25 bp, Mus musculus
agctcctcacggttcattttttcag

SEQ ID NO: 179455 - DNA, 25 bp, Mus musculus
agctcctcagaaacccggacagatt

SEQ ID NO: 179456 - DNA, 25 bp, Mus musculus
agctcctcagaatcccggacagatt

SEQ ID NO: 179457 - DNA, 25 bp, Mus musculus
agctcctcagtccttgtatgttaac

SEQ ID NO: 179458 - DNA, 25 bp, Mus musculus
agctcctcagtcgttgtatgttaac

SEQ ID NO: 179459 - DNA, 25 bp, Mus musculus
agctcctccccgagaaggaattggg

SEQ ID NO: 179460 - DNA, 25 bp, Mus musculus
agctcctccccgtgaaggaattggg

SEQ ID NO: 179461 - DNA, 25 bp, Mus musculus
agctcctcccgcaagagcaggtgga

SEQ ID NO: 179462 - DNA, 25 bp, Mus musculus
agctcctcccgctagagcaggtgga

SEQ ID NO: 179463 - DNA, 25 bp, Mus musculus
agctcctccgtacataccagtagta

SEQ ID NO: 179464 - DNA, 25 bp, Mus musculus
agctcctccgtagataccagtagta

SEQ ID NO: 179465 - DNA, 25 bp, Mus musculus
agctcctcctgtctatccaaaattt

SEQ ID NO: 179466 - DNA, 25 bp, Mus musculus
agctcctcctgtgtatccaaaattt

SEQ ID NO: 179467 - DNA, 25 bp, Mus musculus
agctcctcgagccaaatctgaccgg

SEQ ID NO: 179468 - DNA, 25 bp, Mus musculus
agctcctcgagcgaaatctgaccgg

SEQ ID NO: 179469 - DNA, 25 bp, Mus musculus
agctcctctcccaagtgtctgggtt

SEQ ID NO: 179470 - DNA, 25 bp, Mus musculus
agctcctctccctagtgtctgggtt

SEQ ID NO: 179471 - DNA, 25 bp, Mus musculus
agctcctctcctaaagaagtactag

SEQ ID NO: 179472 - DNA, 25 bp, Mus musculus
agctcctctccttaagaagtactag

SEQ ID NO: 179473 - DNA, 25 bp, Mus musculus
agctcctctgatagtgactgtggca

SEQ ID NO: 179474 - DNA, 25 bp, Mus musculus
agctcctctgattgtgactgtggca

SEQ ID NO: 179475 - DNA, 25 bp, Mus musculus
agctcctctgtacgagcagcaggta

SEQ ID NO: 179476 - DNA, 25 bp, Mus musculus
agctcctctgtaggagcagcaggta

SEQ ID NO: 179477 - DNA, 25 bp, Mus musculus
agctcctctttaagtcttatagtta

SEQ ID NO: 179478 - DNA, 25 bp, Mus musculus
agctcctctttatgtcttatagtta

SEQ ID NO: 179479 - DNA, 25 bp, Mus musculus
agctcctgaaatctgcctttcttgg

SEQ ID NO: 179480 - DNA, 25 bp, Mus musculus
agctcctgaaatgtgcctttcttgg

SEQ ID NO: 179481 - DNA, 25 bp, Mus musculus
agctcctgaagccatcaactttggt

SEQ ID NO: 179482 - DNA, 25 bp, Mus musculus
agctcctgaagcgatcaactttggt

SEQ ID NO: 179483 - DNA, 25 bp, Mus musculus
agctcctgaatgaccttaggtggat

SEQ ID NO: 179484 - DNA, 25 bp, Mus musculus
agctcctgaatgtccttaggtggat

SEQ ID NO: 179485 - DNA, 25 bp, Mus musculus
agctcctgagagacaacctgacgct

SEQ ID NO: 179486 - DNA, 25 bp, Mus musculus
agctcctgagagtcaacctgacgct

SEQ ID NO: 179487 - DNA, 25 bp, Mus musculus
agctcctgagctagcctgacagcat

SEQ ID NO: 179488 - DNA, 25 bp, Mus musculus
agctcctgagcttgcctgacagcat

SEQ ID NO: 179489 - DNA, 25 bp, Mus musculus
agctcctgaggaatacggcaagaat

SEQ ID NO: 179490 - DNA, 25 bp, Mus musculus
agctcctgaggattacggcaagaat

SEQ ID NO: 179491 - DNA, 25 bp, Mus musculus
agctcctgattaaatgctttcattt

SEQ ID NO: 179492 - DNA, 25 bp, Mus musculus
agctcctgattatatgctttcattt

SEQ ID NO: 179493 - DNA, 25 bp, Mus musculus
agctcctgcagacgtgtttcaccaa

SEQ ID NO: 179494 - DNA, 25 bp, Mus musculus
agctcctgcagaggtgtttcaccaa

SEQ ID NO: 179495 - DNA, 25 bp, Mus musculus
agctcctgcatcatatcttttgtgg

SEQ ID NO: 179496 - DNA, 25 bp, Mus musculus
agctcctgcatcttatcttttgtgg

SEQ ID NO: 179497 - DNA, 25 bp, Mus musculus
agctcctgccagcaagcttgaagac

SEQ ID NO: 179498 - DNA, 25 bp, Mus musculus
agctcctgccaggaagcttgaagac

SEQ ID NO: 179499 - DNA, 25 bp, Mus musculus
agctcctgcgggatggcctgtgtac

SEQ ID NO: 179500 - DNA, 25 bp, Mus musculus
agctcctgcgggttggcctgtgtac

SEQ ID NO: 179501 - DNA, 25 bp, Mus musculus
agctcctgctttcgtatactgatgg

SEQ ID NO: 179502 - DNA, 25 bp, Mus musculus
agctcctgctttggtatactgatgg

SEQ ID NO: 179503 - DNA, 25 bp, Mus musculus
agctcctggaagattgctgggacgc

SEQ ID NO: 179504 - DNA, 25 bp, Mus musculus
agctcctggaagtttgctgggacgc

SEQ ID NO: 179505 - DNA, 25 bp, Mus musculus
agctcctggagtatccaagctagac

SEQ ID NO: 179506 - DNA, 25 bp, Mus musculus
agctcctggagtttccaagctagac

SEQ ID NO: 179507 - DNA, 25 bp, Mus musculus
agctcctggatccaccaataacaaa

SEQ ID NO: 179508 - DNA, 25 bp, Mus musculus
agctcctggatcgaccaataacaaa

SEQ ID NO: 179509 - DNA, 25 bp, Mus musculus
agctcctgggaaaggcctatgggaa

SEQ ID NO: 179510 - DNA, 25 bp, Mus musculus
agctcctgggaatggcctatgggaa

SEQ ID NO: 179511 - DNA, 25 bp, Mus musculus
agctcctgggatcagaccacccatg

SEQ ID NO: 179512 - DNA, 25 bp, Mus musculus
agctcctgggatgagaccacccatg

SEQ ID NO: 179513 - DNA, 25 bp, Mus musculus
agctcctggtctatgctgcaacaaa

SEQ ID NO: 179514 - DNA, 25 bp, Mus musculus
agctcctggtctttgctgcaacaaa

SEQ ID NO: 179515 - DNA, 25 bp, Mus musculus
agctcctggtttacagattggctct

SEQ ID NO: 179516 - DNA, 25 bp, Mus musculus
agctcctggttttcagattggctct

SEQ ID NO: 179517 - DNA, 25 bp, Mus musculus
agctcctgtaccagcgtgggtggct

SEQ ID NO: 179518 - DNA, 25 bp, Mus musculus
agctcctgtacctgcgtgggtggct

SEQ ID NO: 179519 - DNA, 25 bp, Mus musculus
agctcctgtagcaccgaatgagcac

SEQ ID NO: 179520 - DNA, 25 bp, Mus musculus
agctcctgtagctccgaatgagcac

SEQ ID NO: 179521 - DNA, 25 bp, Mus musculus
agctcctgtcccacgagtcaggaaa

SEQ ID NO: 179522 - DNA, 25 bp, Mus musculus
agctcctgtccctcgagtcaggaaa

SEQ ID NO: 179523 - DNA, 25 bp, Mus musculus
agctcctgtggtagagacggtttgc

SEQ ID NO: 179524 - DNA, 25 bp, Mus musculus
agctcctgtggttgagacggtttgc

SEQ ID NO: 179525 - DNA, 25 bp, Mus musculus
agctcctgtgtgacatgttcaaaaa

SEQ ID NO: 179526 - DNA, 25 bp, Mus musculus
agctcctgtgtgtcatgttcaaaaa

SEQ ID NO: 179527 - DNA, 25 bp, Mus musculus
agctcctgtgttccgtgttctgtct

SEQ ID NO: 179528 - DNA, 25 bp, Mus musculus
agctcctgtgttgcgtgttctgtct

SEQ ID NO: 179529 - DNA, 25 bp, Mus musculus
agctcctgttccatgtagatccatg

SEQ ID NO: 179530 - DNA, 25 bp, Mus musculus
agctcctgttccttgtagatccatg

SEQ ID NO: 179531 - DNA, 25 bp, Mus musculus
agctcctgtttcctggttacttgaa

SEQ ID NO: 179532 - DNA, 25 bp, Mus musculus
agctcctgtttcgtggttacttgaa

SEQ ID NO: 179533 - DNA, 25 bp, Mus musculus
agctccttaccacacggtttctgtt

SEQ ID NO: 179534 - DNA, 25 bp, Mus musculus
agctccttaccagacggtttctgtt

SEQ ID NO: 179535 - DNA, 25 bp, Mus musculus
agctccttagctagcgaattgcgat

SEQ ID NO: 179536 - DNA, 25 bp, Mus musculus
agctccttagcttgcgaattgcgat

SEQ ID NO: 179537 - DNA, 25 bp, Mus musculus
agctccttaggcacttcggaggctg

SEQ ID NO: 179538 - DNA, 25 bp, Mus musculus
agctccttaggctcttcggaggctg

SEQ ID NO: 179539 - DNA, 25 bp, Mus musculus
agctccttatacagggcacccggcc

SEQ ID NO: 179540 - DNA, 25 bp, Mus musculus
agctccttatactgggcacccggcc

SEQ ID NO: 179541 - DNA, 25 bp, Mus musculus
agctccttatcccaaggtaatccac

SEQ ID NO: 179542 - DNA, 25 bp, Mus musculus
agctccttatccgaaggtaatccac

SEQ ID NO: 179543 - DNA, 25 bp, Mus musculus
agctccttcaaactccagcattggc

SEQ ID NO: 179544 - DNA, 25 bp, Mus musculus
agctccttcaaagtccagcattggc

SEQ ID NO: 179545 - DNA, 25 bp, Mus musculus
agctccttcaagctactgctgctgg

SEQ ID NO: 179546 - DNA, 25 bp, Mus musculus
agctccttcaaggtactgctgctgg

SEQ ID NO: 179547 - DNA, 25 bp, Mus musculus
agctccttcattagccaacgtattt

SEQ ID NO: 179548 - DNA, 25 bp, Mus musculus
agctccttcatttgccaacgtattt

SEQ ID NO: 179549 - DNA, 25 bp, Mus musculus
agctccttccaacaaaagcaagagt

SEQ ID NO: 179550 - DNA, 25 bp, Mus musculus
agctccttccaagaaaagcaagagt

SEQ ID NO: 179551 - DNA, 25 bp, Mus musculus
agctccttctcgacagtaggcgagt

SEQ ID NO: 179552 - DNA, 25 bp, Mus musculus
agctccttctcgtcagtaggcgagt

SEQ ID NO: 179553 - DNA, 25 bp, Mus musculus
agctccttctgcaagggacttgtca

SEQ ID NO: 179554 - DNA, 25 bp, Mus musculus
agctccttctgcatacttttattag

SEQ ID NO: 179555 - DNA, 25 bp, Mus musculus
agctccttctgctagggacttgtca

SEQ ID NO: 179556 - DNA, 25 bp, Mus musculus
agctccttctgcttacttttattag

SEQ ID NO: 179557 - DNA, 25 bp, Mus musculus
agctccttctgtatcttggcatcag

SEQ ID NO: 179558 - DNA, 25 bp, Mus musculus
agctccttctgtttcttggcatcag

SEQ ID NO: 179559 - DNA, 25 bp, Mus musculus
agctccttgacaactaatctctgta

SEQ ID NO: 179560 - DNA, 25 bp, Mus musculus
agctccttgacatctaatctctgta

SEQ ID NO: 179561 - DNA, 25 bp, Mus musculus
agctccttgactaagacccagaagt

SEQ ID NO: 179562 - DNA, 25 bp, Mus musculus
agctccttgacttagacccagaagt

SEQ ID NO: 179563 - DNA, 25 bp, Mus musculus
agctccttggaaatggttacttatt

SEQ ID NO: 179564 - DNA, 25 bp, Mus musculus
agctccttggaattggttacttatt

SEQ ID NO: 179565 - DNA, 25 bp, Mus musculus
agctccttggacagtgcaaccagag

SEQ ID NO: 179566 - DNA, 25 bp, Mus musculus
agctccttggactgtgcaaccagag

SEQ ID NO: 179567 - DNA, 25 bp, Mus musculus
agctccttggagaattcagaaatct

SEQ ID NO: 179568 - DNA, 25 bp, Mus musculus
agctccttggagtattcagaaatct

SEQ ID NO: 179569 - DNA, 25 bp, Mus musculus
agctccttgggcaagcacagtaagc

SEQ ID NO: 179570 - DNA, 25 bp, Mus musculus
agctccttgggctagcacagtaagc

SEQ ID NO: 179571 - DNA, 25 bp, Mus musculus
agctccttgtcaccgagagatagaa

SEQ ID NO: 179572 - DNA, 25 bp, Mus musculus
agctccttgtcacgcagcgtacagt

SEQ ID NO: 179573 - DNA, 25 bp, Mus musculus
agctccttgtcacggcttcagatga

SEQ ID NO: 179574 - DNA, 25 bp, Mus musculus
agctccttgtcagcgagagatagaa

SEQ ID NO: 179575 - DNA, 25 bp, Mus musculus
agctccttgtcaggcagcgtacagt

SEQ ID NO: 179576 - DNA, 25 bp, Mus musculus
agctccttgtcagggcttcagatga

SEQ ID NO: 179577 - DNA, 25 bp, Mus musculus
agctccttgtgtcacttgttaccta

SEQ ID NO: 179578 - DNA, 25 bp, Mus musculus
agctccttgtgtgacttgttaccta

SEQ ID NO: 179579 - DNA, 25 bp, Mus musculus
agctcctttagaatacgcaccgcga

SEQ ID NO: 179580 - DNA, 25 bp, Mus musculus
agctcctttagattacgcaccgcga

SEQ ID NO: 179581 - DNA, 25 bp, Mus musculus
agctcctttatgagccctacagtag

SEQ ID NO: 179582 - DNA, 25 bp, Mus musculus
agctcctttatgtgccctacagtag

SEQ ID NO: 179583 - DNA, 25 bp, Mus musculus
agctcctttgagactgctgtccaga

SEQ ID NO: 179584 - DNA, 25 bp, Mus musculus
agctcctttgagtctgctgtccaga

SEQ ID NO: 179585 - DNA, 25 bp, Mus musculus
agctcctttggccatattaaccaca

SEQ ID NO: 179586 - DNA, 25 bp, Mus musculus
agctcctttggcgatattaaccaca

SEQ ID NO: 179587 - DNA, 25 bp, Mus musculus
agctcctttgggagatctgacctca

SEQ ID NO: 179588 - DNA, 25 bp, Mus musculus
agctcctttgggtgatctgacctca

SEQ ID NO: 179589 - DNA, 25 bp, Mus musculus
agctccttttctacaggtccagtga

SEQ ID NO: 179590 - DNA, 25 bp, Mus musculus
agctccttttcttcaggtccagtga

SEQ ID NO: 179591 - DNA, 25 bp, Mus musculus
agctccttttgtctggccatcgggt

SEQ ID NO: 179592 - DNA, 25 bp, Mus musculus
agctccttttgtgtggccatcgggt

SEQ ID NO: 179593 - DNA, 25 bp, Mus musculus
agctcgaaaatcaaatgtgtcctat

SEQ ID NO: 179594 - DNA, 25 bp, Mus musculus
agctcgaaaatctaatgtgtcctat

SEQ ID NO: 179595 - DNA, 25 bp, Mus musculus
agctcgaacatcaaacaccagagac

SEQ ID NO: 179596 - DNA, 25 bp, Mus musculus
agctcgaacatctaacaccagagac

SEQ ID NO: 179597 - DNA, 25 bp, Mus musculus
agctcgaaggttccgttaatcttgc

SEQ ID NO: 179598 - DNA, 25 bp, Mus musculus
agctcgaaggttgcgttaatcttgc

SEQ ID NO: 179599 - DNA, 25 bp, Mus musculus
agctcgaatctgctacacgcataaa

SEQ ID NO: 179600 - DNA, 25 bp, Mus musculus
agctcgaatctggtacacgcataaa

SEQ ID NO: 179601 - DNA, 25 bp, Mus musculus
agctcgaccaagaccacgaagtctt

SEQ ID NO: 179602 - DNA, 25 bp, Mus musculus
agctcgaccaagtccacgaagtctt

SEQ ID NO: 179603 - DNA, 25 bp, Mus musculus
agctcgactggacaccaggctgtca

SEQ ID NO: 179604 - DNA, 25 bp, Mus musculus
agctcgactggagaccaggctgtca

SEQ ID NO: 179605 - DNA, 25 bp, Mus musculus
agctcgagagtactgtaggctcccc

SEQ ID NO: 179606 - DNA, 25 bp, Mus musculus
agctcgagagtagtgtaggctcccc

SEQ ID NO: 179607 - DNA, 25 bp, Mus musculus
agctcgagcgccaagatcgtgaagc

SEQ ID NO: 179608 - DNA, 25 bp, Mus musculus
agctcgagcgcctagatcgtgaagc

SEQ ID NO: 179609 - DNA, 25 bp, Mus musculus
agctcgagcggcaccttcttaaagg

SEQ ID NO: 179610 - DNA, 25 bp, Mus musculus
agctcgagcggctccttcttaaagg

SEQ ID NO: 179611 - DNA, 25 bp, Mus musculus
agctcgagctacaagacaagccctg

SEQ ID NO: 179612 - DNA, 25 bp, Mus musculus
agctcgagctactagacaagccctg

SEQ ID NO: 179613 - DNA, 25 bp, Mus musculus
agctcgagggataacatggccagaa

SEQ ID NO: 179614 - DNA, 25 bp, Mus musculus
agctcgagggattacatggccagaa

SEQ ID NO: 179615 - DNA, 25 bp, Mus musculus
agctcgagtcggctgttcactgtga

SEQ ID NO: 179616 - DNA, 25 bp, Mus musculus
agctcgagtcgggtgttcactgtga

SEQ ID NO: 179617 - DNA, 25 bp, Mus musculus
agctcgagtgtaccctgctcagttg

SEQ ID NO: 179618 - DNA, 25 bp, Mus musculus
agctcgagtgtagcctgctcagttg

SEQ ID NO: 179619 - DNA, 25 bp, Mus musculus
agctcgcaatctctcctatgtaaga

SEQ ID NO: 179620 - DNA, 25 bp, Mus musculus
agctcgcaatctgtcctatgtaaga

SEQ ID NO: 179621 - DNA, 25 bp, Mus musculus
agctcgcaggacacgggactgtgct

SEQ ID NO: 179622 - DNA, 25 bp, Mus musculus
agctcgcaggactcgggactgtgct

SEQ ID NO: 179623 - DNA, 25 bp, Mus musculus
agctcgcaggagattcgcacttact

SEQ ID NO: 179624 - DNA, 25 bp, Mus musculus
agctcgcaggagtttcgcacttact

SEQ ID NO: 179625 - DNA, 25 bp, Mus musculus
agctcgccacatatcacagcagagt

SEQ ID NO: 179626 - DNA, 25 bp, Mus musculus
agctcgccacatttcacagcagagt

SEQ ID NO: 179627 - DNA, 25 bp, Mus musculus
agctcgccccgaataaaccggatga

SEQ ID NO: 179628 - DNA, 25 bp, Mus musculus
agctcgccccgattaaaccggatga

SEQ ID NO: 179629 - DNA, 25 bp, Mus musculus
agctcgcccctgcaattcgatgagg

SEQ ID NO: 179630 - DNA, 25 bp, Mus musculus
agctcgcccctggaattcgatgagg

SEQ ID NO: 179631 - DNA, 25 bp, Mus musculus
agctcgcctggaactgactccaagt

SEQ ID NO: 179632 - DNA, 25 bp, Mus musculus
agctcgcctggatctgactccaagt

SEQ ID NO: 179633 - DNA, 25 bp, Mus musculus
agctcgcgcgcgaatgtgcgcctgc

SEQ ID NO: 179634 - DNA, 25 bp, Mus musculus
agctcgcgcgcgtatgtgcgcctgc

SEQ ID NO: 179635 - DNA, 25 bp, Mus musculus
agctcgctcttacgtggtgacaatt

SEQ ID NO: 179636 - DNA, 25 bp, Mus musculus
agctcgctcttaggtggtgacaatt

SEQ ID NO: 179637 - DNA, 25 bp, Mus musculus
agctcgctgagcacaaacagccgaa

SEQ ID NO: 179638 - DNA, 25 bp, Mus musculus
agctcgctgagctcaaacagccgaa

SEQ ID NO: 179639 - DNA, 25 bp, Mus musculus
agctcgctgcccagggagtgaccga

SEQ ID NO: 179640 - DNA, 25 bp, Mus musculus
agctcgctgccctgggagtgaccga

SEQ ID NO: 179641 - DNA, 25 bp, Mus musculus
agctcggaaaagctgcttctataag

SEQ ID NO: 179642 - DNA, 25 bp, Mus musculus
agctcggaaaaggtgcttctataag

SEQ ID NO: 179643 - DNA, 25 bp, Mus musculus
agctcggaactcaaccctggtagga

SEQ ID NO: 179644 - DNA, 25 bp, Mus musculus
agctcggaactctaccctggtagga

SEQ ID NO: 179645 - DNA, 25 bp, Mus musculus
agctcggagaccagggtagatgtac

SEQ ID NO: 179646 - DNA, 25 bp, Mus musculus
agctcggagacctgggtagatgtac

SEQ ID NO: 179647 - DNA, 25 bp, Mus musculus
agctcggagctgacagaggcgcaca

SEQ ID NO: 179648 - DNA, 25 bp, Mus musculus
agctcggagctgtcagaggcgcaca

SEQ ID NO: 179649 - DNA, 25 bp, Mus musculus
agctcggatgccagatggcccgcca

SEQ ID NO: 179650 - DNA, 25 bp, Mus musculus
agctcggatgcctgatggcccgcca

SEQ ID NO: 179651 - DNA, 25 bp, Mus musculus
agctcggattgcatgagaccaccca

SEQ ID NO: 179652 - DNA, 25 bp, Mus musculus
agctcggattgcttgagaccaccca

SEQ ID NO: 179653 - DNA, 25 bp, Mus musculus
agctcggcagacaagaaaggctgtt

SEQ ID NO: 179654 - DNA, 25 bp, Mus musculus
agctcggcagactagaaaggctgtt

SEQ ID NO: 179655 - DNA, 25 bp, Mus musculus
agctcggcatctctgcctggacaag

SEQ ID NO: 179656 - DNA, 25 bp, Mus musculus
agctcggcatctgtgcctggacaag

SEQ ID NO: 179657 - DNA, 25 bp, Mus musculus
agctcggcgccccacgatgcggttt

SEQ ID NO: 179658 - DNA, 25 bp, Mus musculus
agctcggcgcccgacgatgcggttt

SEQ ID NO: 179659 - DNA, 25 bp, Mus musculus
agctcggctgccaagttaatgcaca

SEQ ID NO: 179660 - DNA, 25 bp, Mus musculus
agctcggctgcctagttaatgcaca

SEQ ID NO: 179661 - DNA, 25 bp, Mus musculus
agctcgggacttcctgtggtctcac

SEQ ID NO: 179662 - DNA, 25 bp, Mus musculus
agctcgggacttgctgtggtctcac

SEQ ID NO: 179663 - DNA, 25 bp, Mus musculus
agctcgggcaaaattgcggactccc

SEQ ID NO: 179664 - DNA, 25 bp, Mus musculus
agctcgggcaaatttgcggactccc

SEQ ID NO: 179665 - DNA, 25 bp, Mus musculus
agctcgggcctgaaaagatggctcc

SEQ ID NO: 179666 - DNA, 25 bp, Mus musculus
agctcgggcctgtaaagatggctcc

SEQ ID NO: 179667 - DNA, 25 bp, Mus musculus
agctcgggtgctaataaccgtggta

SEQ ID NO: 179668 - DNA, 25 bp, Mus musculus
agctcgggtgcttataaccgtggta

SEQ ID NO: 179669 - DNA, 25 bp, Mus musculus
agctcgggtggaatcttaattacta

SEQ ID NO: 179670 - DNA, 25 bp, Mus musculus
agctcgggtggattcttaattacta

SEQ ID NO: 179671 - DNA, 25 bp, Mus musculus
agctcgggttgaacagccagaatga

SEQ ID NO: 179672 - DNA, 25 bp, Mus musculus
agctcgggttgatcagccagaatga

SEQ ID NO: 179673 - DNA, 25 bp, Mus musculus
agctcgggttgcaccgcgtacgcga

SEQ ID NO: 179674 - DNA, 25 bp, Mus musculus
agctcgggttgctccgcgtacgcga

SEQ ID NO: 179675 - DNA, 25 bp, Mus musculus
agctcggtctttactgatacaccca

SEQ ID NO: 179676 - DNA, 25 bp, Mus musculus
agctcggtcttttctgatacaccca

SEQ ID NO: 179677 - DNA, 25 bp, Mus musculus
agctcggtgaagactagtctttgta

SEQ ID NO: 179678 - DNA, 25 bp, Mus musculus
agctcggtgaagtctagtctttgta

SEQ ID NO: 179679 - DNA, 25 bp, Mus musculus
agctcggttgctatatctattaagt

SEQ ID NO: 179680 - DNA, 25 bp, Mus musculus
agctcggttgctttatctattaagt

SEQ ID NO: 179681 - DNA, 25 bp, Mus musculus
agctcgtagaccagcgcttgcgaga

SEQ ID NO: 179682 - DNA, 25 bp, Mus musculus
agctcgtagacctgcgcttgcgaga

SEQ ID NO: 179683 - DNA, 25 bp, Mus musculus
agctcgtaggtgacctggcgctcgt

SEQ ID NO: 179684 - DNA, 25 bp, Mus musculus
agctcgtaggtgtcctggcgctcgt

SEQ ID NO: 179685 - DNA, 25 bp, Mus musculus
agctcgtcacagaggcagcctggct

SEQ ID NO: 179686 - DNA, 25 bp, Mus musculus
agctcgtcacagtggcagcctggct

SEQ ID NO: 179687 - DNA, 25 bp, Mus musculus
agctcgtcagtgaggccaccagaaa

SEQ ID NO: 179688 - DNA, 25 bp, Mus musculus
agctcgtcagtgtggccaccagaaa

SEQ ID NO: 179689 - DNA, 25 bp, Mus musculus
agctcgtccccaaagccttggaatg

SEQ ID NO: 179690 - DNA, 25 bp, Mus musculus
agctcgtccccatagccttggaatg

SEQ ID NO: 179691 - DNA, 25 bp, Mus musculus
agctcgtcctccagcagaaggttca

SEQ ID NO: 179692 - DNA, 25 bp, Mus musculus
agctcgtcctcctgcagaaggttca

SEQ ID NO: 179693 - DNA, 25 bp, Mus musculus
agctcgtcctgccaaatacttaaac

SEQ ID NO: 179694 - DNA, 25 bp, Mus musculus
agctcgtcctgccagcttcgtgcag

SEQ ID NO: 179695 - DNA, 25 bp, Mus musculus
agctcgtcctgcgaaatacttaaac

SEQ ID NO: 179696 - DNA, 25 bp, Mus musculus
agctcgtcctgcgagcttcgtgcag

SEQ ID NO: 179697 - DNA, 25 bp, Mus musculus
agctcgtcttgtccagacagtcagg

SEQ ID NO: 179698 - DNA, 25 bp, Mus musculus
agctcgtcttgtgcagacagtcagg

SEQ ID NO: 179699 - DNA, 25 bp, Mus musculus
agctcgtgactacattgaaacttga

SEQ ID NO: 179700 - DNA, 25 bp, Mus musculus
agctcgtgactagattgaaacttga

SEQ ID NO: 179701 - DNA, 25 bp, Mus musculus
agctcgtgactgctcctgcacagga

SEQ ID NO: 179702 - DNA, 25 bp, Mus musculus
agctcgtgactggtcctgcacagga

SEQ ID NO: 179703 - DNA, 25 bp, Mus musculus
agctcgtgcactatgcttgggagca

SEQ ID NO: 179704 - DNA, 25 bp, Mus musculus
agctcgtgcactttgcttgggagca

SEQ ID NO: 179705 - DNA, 25 bp, Mus musculus
agctcgtggctcatcgaggatggca

SEQ ID NO: 179706 - DNA, 25 bp, Mus musculus
agctcgtggctcttcgaggatggca

SEQ ID NO: 179707 - DNA, 25 bp, Mus musculus
agctcgtggtgcaccagcggacgca

SEQ ID NO: 179708 - DNA, 25 bp, Mus musculus
agctcgtggtgctccagcggacgca

SEQ ID NO: 179709 - DNA, 25 bp, Mus musculus
agctcgtgtatacctgcaagcgcta

SEQ ID NO: 179710 - DNA, 25 bp, Mus musculus
agctcgtgtatagctgcaagcgcta

SEQ ID NO: 179711 - DNA, 25 bp, Mus musculus
agctcgtgtgtgaacatcctggaga

SEQ ID NO: 179712 - DNA, 25 bp, Mus musculus
agctcgtgtgtgtacatcctggaga

SEQ ID NO: 179713 - DNA, 25 bp, Mus musculus
agctcgttcagccatcattgaagat

SEQ ID NO: 179714 - DNA, 25 bp, Mus musculus
agctcgttcagcgatcattgaagat

SEQ ID NO: 179715 - DNA, 25 bp, Mus musculus
agctctaaaattctcttgctttgtc

SEQ ID NO: 179716 - DNA, 25 bp, Mus musculus
agctctaaaattgtcttgctttgtc

SEQ ID NO: 179717 - DNA, 25 bp, Mus musculus
agctctaaagagacaggctgccact

SEQ ID NO: 179718 - DNA, 25 bp, Mus musculus
agctctaaagagtcaggctgccact

SEQ ID NO: 179719 - DNA, 25 bp, Mus musculus
agctctaactggctttatgtccatt

SEQ ID NO: 179720 - DNA, 25 bp, Mus musculus
agctctaactgggtttatgtccatt

SEQ ID NO: 179721 - DNA, 25 bp, Mus musculus
agctctaacttcattgtgggtcaca

SEQ ID NO: 179722 - DNA, 25 bp, Mus musculus
agctctaacttctttgtgggtcaca

SEQ ID NO: 179723 - DNA, 25 bp, Mus musculus
agctctaagaggctttgtgacatct

SEQ ID NO: 179724 - DNA, 25 bp, Mus musculus
agctctaagagggtttgtgacatct

SEQ ID NO: 179725 - DNA, 25 bp, Mus musculus
agctctaagcacacaggcattttca

SEQ ID NO: 179726 - DNA, 25 bp, Mus musculus
agctctaagcactcaggcattttca

SEQ ID NO: 179727 - DNA, 25 bp, Mus musculus
agctctaagcgccacacttgctggg

SEQ ID NO: 179728 - DNA, 25 bp, Mus musculus
agctctaagcgcgacacttgctggg

SEQ ID NO: 179729 - DNA, 25 bp, Mus musculus
agctctaagggccacctctgagaaa

SEQ ID NO: 179730 - DNA, 25 bp, Mus musculus
agctctaagggcgacctctgagaaa

SEQ ID NO: 179731 - DNA, 25 bp, Mus musculus
agctctaatatgattaccctcggat

SEQ ID NO: 179732 - DNA, 25 bp, Mus musculus
agctctaatatgtttaccctcggat

SEQ ID NO: 179733 - DNA, 25 bp, Mus musculus
agctctaatccaagtcttaaaccct

SEQ ID NO: 179734 - DNA, 25 bp, Mus musculus
agctctaatccatgtcttaaaccct

SEQ ID NO: 179735 - DNA, 25 bp, Mus musculus
agctctacaagcacagaggtctcca

SEQ ID NO: 179736 - DNA, 25 bp, Mus musculus
agctctacaagctcagaggtctcca

SEQ ID NO: 179737 - DNA, 25 bp, Mus musculus
agctctacccaaacctctggaggaa

SEQ ID NO: 179738 - DNA, 25 bp, Mus musculus
agctctacccaatcctctggaggaa

SEQ ID NO: 179739 - DNA, 25 bp, Mus musculus
agctctacccgaaaacattccagta

SEQ ID NO: 179740 - DNA, 25 bp, Mus musculus
agctctacccgataacattccagta

SEQ ID NO: 179741 - DNA, 25 bp, Mus musculus
agctctacccgtctatatttctagt

SEQ ID NO: 179742 - DNA, 25 bp, Mus musculus
agctctacccgtgtatatttctagt

SEQ ID NO: 179743 - DNA, 25 bp, Mus musculus
agctctaccctcagagcaggtgttg

SEQ ID NO: 179744 - DNA, 25 bp, Mus musculus
agctctaccctctgagcaggtgttg

SEQ ID NO: 179745 - DNA, 25 bp, Mus musculus
agctctaccgcgcttggtatcggga

SEQ ID NO: 179746 - DNA, 25 bp, Mus musculus
agctctaccgcggttggtatcggga

SEQ ID NO: 179747 - DNA, 25 bp, Mus musculus
agctctacctagataagtctctctg

SEQ ID NO: 179748 - DNA, 25 bp, Mus musculus
agctctacctagttaagtctctctg

SEQ ID NO: 179749 - DNA, 25 bp, Mus musculus
agctctacgaggagcacccacatgg

SEQ ID NO: 179750 - DNA, 25 bp, Mus musculus
agctctacgaggtgcacccacatgg

SEQ ID NO: 179751 - DNA, 25 bp, Mus musculus
agctctactcaaaaccatcatggcc

SEQ ID NO: 179752 - DNA, 25 bp, Mus musculus
agctctactcaataccatcatggcc

SEQ ID NO: 179753 - DNA, 25 bp, Mus musculus
agctctactcctaacctagtatctt

SEQ ID NO: 179754 - DNA, 25 bp, Mus musculus
agctctactccttacctagtatctt

SEQ ID NO: 179755 - DNA, 25 bp, Mus musculus
agctctactctgcttacacggatca

SEQ ID NO: 179756 - DNA, 25 bp, Mus musculus
agctctactctggttacacggatca

SEQ ID NO: 179757 - DNA, 25 bp, Mus musculus
agctctactgggacttagtattcca

SEQ ID NO: 179758 - DNA, 25 bp, Mus musculus
agctctactgggtcttagtattcca

SEQ ID NO: 179759 - DNA, 25 bp, Mus musculus
agctctactgttaaacaagcgccat

SEQ ID NO: 179760 - DNA, 25 bp, Mus musculus
agctctactgtttaacaagcgccat

SEQ ID NO: 179761 - DNA, 25 bp, Mus musculus
agctctacttctcctgatagatttg

SEQ ID NO: 179762 - DNA, 25 bp, Mus musculus
agctctacttctgctgatagatttg

SEQ ID NO: 179763 - DNA, 25 bp, Mus musculus
agctctacttggctatttaagcaaa

SEQ ID NO: 179764 - DNA, 25 bp, Mus musculus
agctctacttgggtatttaagcaaa

SEQ ID NO: 179765 - DNA, 25 bp, Mus musculus
agctctactttgctgaaggctcaaa

SEQ ID NO: 179766 - DNA, 25 bp, Mus musculus
agctctactttggtgaaggctcaaa

SEQ ID NO: 179767 - DNA, 25 bp, Mus musculus
agctctagacccagaaccagcaagt

SEQ ID NO: 179768 - DNA, 25 bp, Mus musculus
agctctagaccctgaaccagcaagt

SEQ ID NO: 179769 - DNA, 25 bp, Mus musculus
agctctagactgatcttgggagaaa

SEQ ID NO: 179770 - DNA, 25 bp, Mus musculus
agctctagactgttcttgggagaaa

SEQ ID NO: 179771 - DNA, 25 bp, Mus musculus
agctctagcatgcacctacgtgtga

SEQ ID NO: 179772 - DNA, 25 bp, Mus musculus
agctctagcatggacctacgtgtga

SEQ ID NO: 179773 - DNA, 25 bp, Mus musculus
agctctagccatatgtgacaaccac

SEQ ID NO: 179774 - DNA, 25 bp, Mus musculus
agctctagccatttgtgacaaccac

SEQ ID NO: 179775 - DNA, 25 bp, Mus musculus
agctctagcgtgacttctctgtgta

SEQ ID NO: 179776 - DNA, 25 bp, Mus musculus
agctctagcgtgtcttctctgtgta

SEQ ID NO: 179777 - DNA, 25 bp, Mus musculus
agctctagctcgcttggtacagggc

SEQ ID NO: 179778 - DNA, 25 bp, Mus musculus
agctctagctcggttggtacagggc

SEQ ID NO: 179779 - DNA, 25 bp, Mus musculus
agctctagctgtcttggaattcacc

SEQ ID NO: 179780 - DNA, 25 bp, Mus musculus
agctctagctgtgttggaattcacc

SEQ ID NO: 179781 - DNA, 25 bp, Mus musculus
agctctagctttcggatctacctta

SEQ ID NO: 179782 - DNA, 25 bp, Mus musculus
agctctagctttgggatctacctta

SEQ ID NO: 179783 - DNA, 25 bp, Mus musculus
agctctaggcacagggaggctgttt

SEQ ID NO: 179784 - DNA, 25 bp, Mus musculus
agctctaggcactgggaggctgttt

SEQ ID NO: 179785 - DNA, 25 bp, Mus musculus
agctctagggccaccagggtttgag

SEQ ID NO: 179786 - DNA, 25 bp, Mus musculus
agctctagggcctccagggtttgag

SEQ ID NO: 179787 - DNA, 25 bp, Mus musculus
agctctagggctacaagccggcgct

SEQ ID NO: 179788 - DNA, 25 bp, Mus musculus
agctctagggcttcaagccggcgct

SEQ ID NO: 179789 - DNA, 25 bp, Mus musculus
agctctagtattctacttgattcag

SEQ ID NO: 179790 - DNA, 25 bp, Mus musculus
agctctagtattgtacttgattcag

SEQ ID NO: 179791 - DNA, 25 bp, Mus musculus
agctctagtcgtagcactttttcag

SEQ ID NO: 179792 - DNA, 25 bp, Mus musculus
agctctagtcgttgcactttttcag

SEQ ID NO: 179793 - DNA, 25 bp, Mus musculus
agctctagttccatcttacgttttg

SEQ ID NO: 179794 - DNA, 25 bp, Mus musculus
agctctagttccttcttacgttttg

SEQ ID NO: 179795 - DNA, 25 bp, Mus musculus
agctctagttctaattactctgctt

SEQ ID NO: 179796 - DNA, 25 bp, Mus musculus
agctctagttcttattactctgctt

SEQ ID NO: 179797 - DNA, 25 bp, Mus musculus
agctctagtttaatcccagactgga

SEQ ID NO: 179798 - DNA, 25 bp, Mus musculus
agctctagtttattcccagactgga

SEQ ID NO: 179799 - DNA, 25 bp, Mus musculus
agctctatactccgagaactagcat

SEQ ID NO: 179800 - DNA, 25 bp, Mus musculus
agctctatactcggagaactagcat

SEQ ID NO: 179801 - DNA, 25 bp, Mus musculus
agctctatcacacctgaggaagcca

SEQ ID NO: 179802 - DNA, 25 bp, Mus musculus
agctctatcacagctgaggaagcca

SEQ ID NO: 179803 - DNA, 25 bp, Mus musculus
agctctatcactatactttttgagg

SEQ ID NO: 179804 - DNA, 25 bp, Mus musculus
agctctatcactttactttttgagg

SEQ ID NO: 179805 - DNA, 25 bp, Mus musculus
agctctatcaggatggcctggcgct

SEQ ID NO: 179806 - DNA, 25 bp, Mus musculus
agctctatcaggttggcctggcgct

SEQ ID NO: 179807 - DNA, 25 bp, Mus musculus
agctctatgcctctcttggagcaaa

SEQ ID NO: 179808 - DNA, 25 bp, Mus musculus
agctctatgcctgtcttggagcaaa

SEQ ID NO: 179809 - DNA, 25 bp, Mus musculus
agctctatgctgaaccctggataaa

SEQ ID NO: 179810 - DNA, 25 bp, Mus musculus
agctctatgctgattttaatgcaca

SEQ ID NO: 179811 - DNA, 25 bp, Mus musculus
agctctatgctgtaccctggataaa

SEQ ID NO: 179812 - DNA, 25 bp, Mus musculus
agctctatgctgtttttaatgcaca

SEQ ID NO: 179813 - DNA, 25 bp, Mus musculus
agctctatggctaactggtgcttcg

SEQ ID NO: 179814 - DNA, 25 bp, Mus musculus
agctctatggctatgacatcctcat

SEQ ID NO: 179815 - DNA, 25 bp, Mus musculus
agctctatggcttactggtgcttcg

SEQ ID NO: 179816 - DNA, 25 bp, Mus musculus
agctctatggctttgacatcctcat

SEQ ID NO: 179817 - DNA, 25 bp, Mus musculus
agctctattataagcagtgatggtt

SEQ ID NO: 179818 - DNA, 25 bp, Mus musculus
agctctattatatgcagtgatggtt

SEQ ID NO: 179819 - DNA, 25 bp, Mus musculus
agctctattcttctgttaacttctc

SEQ ID NO: 179820 - DNA, 25 bp, Mus musculus
agctctattcttgtgttaacttctc

SEQ ID NO: 179821 - DNA, 25 bp, Mus musculus
agctctatttagactgcggaatgat

SEQ ID NO: 179822 - DNA, 25 bp, Mus musculus
agctctatttagtctgcggaatgat

SEQ ID NO: 179823 - DNA, 25 bp, Mus musculus
agctctcaaccaaatcttacacctt

SEQ ID NO: 179824 - DNA, 25 bp, Mus musculus
agctctcaaccatatcttacacctt

SEQ ID NO: 179825 - DNA, 25 bp, Mus musculus
agctctcaacccataattgctgcag

SEQ ID NO: 179826 - DNA, 25 bp, Mus musculus
agctctcaacccttaattgctgcag

SEQ ID NO: 179827 - DNA, 25 bp, Mus musculus
agctctcaactaacgaacttcattt

SEQ ID NO: 179828 - DNA, 25 bp, Mus musculus
agctctcaactatcgaacttcattt

SEQ ID NO: 179829 - DNA, 25 bp, Mus musculus
agctctcaatataactacctttcca

SEQ ID NO: 179830 - DNA, 25 bp, Mus musculus
agctctcaatattactacctttcca

SEQ ID NO: 179831 - DNA, 25 bp, Mus musculus
agctctcacagaccaaaacctattc

SEQ ID NO: 179832 - DNA, 25 bp, Mus musculus
agctctcacagagcaaaacctattc

SEQ ID NO: 179833 - DNA, 25 bp, Mus musculus
agctctcaccgccatgatgttttga

SEQ ID NO: 179834 - DNA, 25 bp, Mus musculus
agctctcaccgcgatgatgttttga

SEQ ID NO: 179835 - DNA, 25 bp, Mus musculus
agctctcacctgagggtgtagggca

SEQ ID NO: 179836 - DNA, 25 bp, Mus musculus
agctctcacctgtgggtgtagggca

SEQ ID NO: 179837 - DNA, 25 bp, Mus musculus
agctctcactatctagagtcagctg

SEQ ID NO: 179838 - DNA, 25 bp, Mus musculus
agctctcactatgtagagtcagctg

SEQ ID NO: 179839 - DNA, 25 bp, Mus musculus
agctctcacttcaaaccatgtcaaa

SEQ ID NO: 179840 - DNA, 25 bp, Mus musculus
agctctcacttctaaccatgtcaaa

SEQ ID NO: 179841 - DNA, 25 bp, Mus musculus
agctctcactttactggatactctg

SEQ ID NO: 179842 - DNA, 25 bp, Mus musculus
agctctcacttttctggatactctg

SEQ ID NO: 179843 - DNA, 25 bp, Mus musculus
agctctcagcaaacatgtatcctca

SEQ ID NO: 179844 - DNA, 25 bp, Mus musculus
agctctcagcaatcatgtatcctca

SEQ ID NO: 179845 - DNA, 25 bp, Mus musculus
agctctcagctcatgtgcaaagaga

SEQ ID NO: 179846 - DNA, 25 bp, Mus musculus
agctctcagctcttgtgcaaagaga

SEQ ID NO: 179847 - DNA, 25 bp, Mus musculus
agctctcaggggcttccacaaaatt

SEQ ID NO: 179848 - DNA, 25 bp, Mus musculus
agctctcagggggttccacaaaatt

SEQ ID NO: 179849 - DNA, 25 bp, Mus musculus
agctctcagtcgctaagacattgtt

SEQ ID NO: 179850 - DNA, 25 bp, Mus musculus
agctctcagtcggtaagacattgtt

SEQ ID NO: 179851 - DNA, 25 bp, Mus musculus
agctctcagtttcagtgccattgaa

SEQ ID NO: 179852 - DNA, 25 bp, Mus musculus
agctctcagtttgagtgccattgaa

SEQ ID NO: 179853 - DNA, 25 bp, Mus musculus
agctctcatataaacgttctgtgca

SEQ ID NO: 179854 - DNA, 25 bp, Mus musculus
agctctcatatatacgttctgtgca

SEQ ID NO: 179855 - DNA, 25 bp, Mus musculus
agctctcatccacgctacttttaga

SEQ ID NO: 179856 - DNA, 25 bp, Mus musculus
agctctcatccaggctacttttaga

SEQ ID NO: 179857 - DNA, 25 bp, Mus musculus
agctctcatctaagactacgaggga

SEQ ID NO: 179858 - DNA, 25 bp, Mus musculus
agctctcatctatgactacgaggga

SEQ ID NO: 179859 - DNA, 25 bp, Mus musculus
agctctccaaagaactccatatatc

SEQ ID NO: 179860 - DNA, 25 bp, Mus musculus
agctctccaaagtactccatatatc

SEQ ID NO: 179861 - DNA, 25 bp, Mus musculus
agctctccaacactgaggcgatcga

SEQ ID NO: 179862 - DNA, 25 bp, Mus musculus
agctctccaacagtgaggcgatcga

SEQ ID NO: 179863 - DNA, 25 bp, Mus musculus
agctctccaagaacaggcctaggtg

SEQ ID NO: 179864 - DNA, 25 bp, Mus musculus
agctctccaagatcaggcctaggtg

SEQ ID NO: 179865 - DNA, 25 bp, Mus musculus
agctctccaagtaactgattttaag

SEQ ID NO: 179866 - DNA, 25 bp, Mus musculus
agctctccaagttactgattttaag

SEQ ID NO: 179867 - DNA, 25 bp, Mus musculus
agctctccaatcaatatgccatatc

SEQ ID NO: 179868 - DNA, 25 bp, Mus musculus
agctctccaatctatatgccatatc

SEQ ID NO: 179869 - DNA, 25 bp, Mus musculus
agctctccactcatggattctgaga

SEQ ID NO: 179870 - DNA, 25 bp, Mus musculus
agctctccactcttggattctgaga

SEQ ID NO: 179871 - DNA, 25 bp, Mus musculus
agctctccactgacctcagaagaca

SEQ ID NO: 179872 - DNA, 25 bp, Mus musculus
agctctccactgtcctcagaagaca

SEQ ID NO: 179873 - DNA, 25 bp, Mus musculus
agctctccagagccacagacaggca

SEQ ID NO: 179874 - DNA, 25 bp, Mus musculus
agctctccagaggcacagacaggca

SEQ ID NO: 179875 - DNA, 25 bp, Mus musculus
agctctccagatccagaggcaggtt

SEQ ID NO: 179876 - DNA, 25 bp, Mus musculus
agctctccagatctttcaatagcaa

SEQ ID NO: 179877 - DNA, 25 bp, Mus musculus
agctctccagatgcagaggcaggtt

SEQ ID NO: 179878 - DNA, 25 bp, Mus musculus
agctctccagatgtttcaatagcaa

SEQ ID NO: 179879 - DNA, 25 bp, Mus musculus
agctctcccagaaccgaggtggcga

SEQ ID NO: 179880 - DNA, 25 bp, Mus musculus
agctctcccagatccgaggtggcga

SEQ ID NO: 179881 - DNA, 25 bp, Mus musculus
agctctcccatactgaataccgaat

SEQ ID NO: 179882 - DNA, 25 bp, Mus musculus
agctctcccatagtgaataccgaat

SEQ ID NO: 179883 - DNA, 25 bp, Mus musculus
agctctccccagattgatgtttgct

SEQ ID NO: 179884 - DNA, 25 bp, Mus musculus
agctctccccagtttgatgtttgct

SEQ ID NO: 179885 - DNA, 25 bp, Mus musculus
agctctccccataccttatttttat

SEQ ID NO: 179886 - DNA, 25 bp, Mus musculus
agctctccccattccttatttttat

SEQ ID NO: 179887 - DNA, 25 bp, Mus musculus
agctctccctacagtgctcaaaagg

SEQ ID NO: 179888 - DNA, 25 bp, Mus musculus
agctctccctactgtgctcaaaagg

SEQ ID NO: 179889 - DNA, 25 bp, Mus musculus
agctctccctagatgaaaaggtcct

SEQ ID NO: 179890 - DNA, 25 bp, Mus musculus
agctctccctagttgaaaaggtcct

SEQ ID NO: 179891 - DNA, 25 bp, Mus musculus
agctctccctgacagcagtagtgac

SEQ ID NO: 179892 - DNA, 25 bp, Mus musculus
agctctccctgagagcagtagtgac

SEQ ID NO: 179893 - DNA, 25 bp, Mus musculus
agctctccctgcatttagtggtggg

SEQ ID NO: 179894 - DNA, 25 bp, Mus musculus
agctctccctgcttttagtggtggg

SEQ ID NO: 179895 - DNA, 25 bp, Mus musculus
agctctccctgtaaagcactgtggt

SEQ ID NO: 179896 - DNA, 25 bp, Mus musculus
agctctccctgttaagcactgtggt

SEQ ID NO: 179897 - DNA, 25 bp, Mus musculus
agctctccgccaagtggagtgagtt

SEQ ID NO: 179898 - DNA, 25 bp, Mus musculus
agctctccgccatgtggagtgagtt

SEQ ID NO: 179899 - DNA, 25 bp, Mus musculus
agctctcctagcagtatcattcgtt

SEQ ID NO: 179900 - DNA, 25 bp, Mus musculus
agctctcctagctgtatcattcgtt

SEQ ID NO: 179901 - DNA, 25 bp, Mus musculus
agctctcctatcctgaatgcatttg

SEQ ID NO: 179902 - DNA, 25 bp, Mus musculus
agctctcctatcgtgaatgcatttg

SEQ ID NO: 179903 - DNA, 25 bp, Mus musculus
agctctcctcaacaatctttcaggc

SEQ ID NO: 179904 - DNA, 25 bp, Mus musculus
agctctcctcaagaatctttcaggc

SEQ ID NO: 179905 - DNA, 25 bp, Mus musculus
agctctcctgcaaacttaggtgctt

SEQ ID NO: 179906 - DNA, 25 bp, Mus musculus
agctctcctgcaccatcttggaaat

SEQ ID NO: 179907 - DNA, 25 bp, Mus musculus
agctctcctgcagcatcttggaaat

SEQ ID NO: 179908 - DNA, 25 bp, Mus musculus
agctctcctgcatacttaggtgctt

SEQ ID NO: 179909 - DNA, 25 bp, Mus musculus
agctctcctgggagtctccattaaa

SEQ ID NO: 179910 - DNA, 25 bp, Mus musculus
agctctcctgggtgtctccattaaa

SEQ ID NO: 179911 - DNA, 25 bp, Mus musculus
agctctcctggtctgggtggtctct

SEQ ID NO: 179912 - DNA, 25 bp, Mus musculus
agctctcctggtgtgggtggtctct

SEQ ID NO: 179913 - DNA, 25 bp, Mus musculus
agctctcctgtcaatgatagcacca

SEQ ID NO: 179914 - DNA, 25 bp, Mus musculus
agctctcctgtctatgatagcacca

SEQ ID NO: 179915 - DNA, 25 bp, Mus musculus
agctctccttcaacactgatacgct

SEQ ID NO: 179916 - DNA, 25 bp, Mus musculus
agctctccttcatcactgatacgct

SEQ ID NO: 179917 - DNA, 25 bp, Mus musculus
agctctccttggcaaccatgttata

SEQ ID NO: 179918 - DNA, 25 bp, Mus musculus
agctctccttgggaaccatgttata

SEQ ID NO: 179919 - DNA, 25 bp, Mus musculus
agctctcgaagcagaatggctcctc

SEQ ID NO: 179920 - DNA, 25 bp, Mus musculus
agctctcgaagctgaatggctcctc

SEQ ID NO: 179921 - DNA, 25 bp, Mus musculus
agctctcgaggtaatctgatatctt

SEQ ID NO: 179922 - DNA, 25 bp, Mus musculus
agctctcgaggttatctgatatctt

SEQ ID NO: 179923 - DNA, 25 bp, Mus musculus
agctctcgccgaagttcatcagtga

SEQ ID NO: 179924 - DNA, 25 bp, Mus musculus
agctctcgccgatgttcatcagtga

SEQ ID NO: 179925 - DNA, 25 bp, Mus musculus
agctctcgctttccagtttgtttca

SEQ ID NO: 179926 - DNA, 25 bp, Mus musculus
agctctcgctttgcagtttgtttca

SEQ ID NO: 179927 - DNA, 25 bp, Mus musculus
agctctcgggaaaatcctaccatca

SEQ ID NO: 179928 - DNA, 25 bp, Mus musculus
agctctcgggaatatcctaccatca

SEQ ID NO: 179929 - DNA, 25 bp, Mus musculus
agctctcgtgctctactgggttgaa

SEQ ID NO: 179930 - DNA, 25 bp, Mus musculus
agctctcgtgctgtactgggttgaa

SEQ ID NO: 179931 - DNA, 25 bp, Mus musculus
agctctctacacatcctggttggag

SEQ ID NO: 179932 - DNA, 25 bp, Mus musculus
agctctctacacttcctggttggag

SEQ ID NO: 179933 - DNA, 25 bp, Mus musculus
agctctctagtgataagtccataat

SEQ ID NO: 179934 - DNA, 25 bp, Mus musculus
agctctctagtgttaagtccataat

SEQ ID NO: 179935 - DNA, 25 bp, Mus musculus
agctctctataaaagtctgtttcgc

SEQ ID NO: 179936 - DNA, 25 bp, Mus musculus
agctctctataatagtctgtttcgc

SEQ ID NO: 179937 - DNA, 25 bp, Mus musculus
agctctctccggagcagcgaggcgt

SEQ ID NO: 179938 - DNA, 25 bp, Mus musculus
agctctctccggctcctaggtaggg

SEQ ID NO: 179939 - DNA, 25 bp, Mus musculus
agctctctccgggtcctaggtaggg

SEQ ID NO: 179940 - DNA, 25 bp, Mus musculus
agctctctccggtgcagcgaggcgt

SEQ ID NO: 179941 - DNA, 25 bp, Mus musculus
agctctctcctgacttgtattgtgg

SEQ ID NO: 179942 - DNA, 25 bp, Mus musculus
agctctctcctgtcttgtattgtgg

SEQ ID NO: 179943 - DNA, 25 bp, Mus musculus
agctctctcgaacgagatctgcgca

SEQ ID NO: 179944 - DNA, 25 bp, Mus musculus
agctctctcgaaggagatctgcgca

SEQ ID NO: 179945 - DNA, 25 bp, Mus musculus
agctctctcgccatgttcacaatgt

SEQ ID NO: 179946 - DNA, 25 bp, Mus musculus
agctctctcgccttgttcacaatgt

SEQ ID NO: 179947 - DNA, 25 bp, Mus musculus
agctctctcgctcagatgagccaat

SEQ ID NO: 179948 - DNA, 25 bp, Mus musculus
agctctctcgctgagatgagccaat

SEQ ID NO: 179949 - DNA, 25 bp, Mus musculus
agctctctcggcacgtttttaatat

SEQ ID NO: 179950 - DNA, 25 bp, Mus musculus
agctctctcggctcgtttttaatat

SEQ ID NO: 179951 - DNA, 25 bp, Mus musculus
agctctctctgcatgatattcaatg

SEQ ID NO: 179952 - DNA, 25 bp, Mus musculus
agctctctctgcttgatattcaatg

SEQ ID NO: 179953 - DNA, 25 bp, Mus musculus
agctctctgaagaactttggaccat

SEQ ID NO: 179954 - DNA, 25 bp, Mus musculus
agctctctgaagtactttggaccat

SEQ ID NO: 179955 - DNA, 25 bp, Mus musculus
agctctctgacaagagtcctgtgtg

SEQ ID NO: 179956 - DNA, 25 bp, Mus musculus
agctctctgacatgagtcctgtgtg

SEQ ID NO: 179957 - DNA, 25 bp, Mus musculus
agctctctgagacactctgggtcca

SEQ ID NO: 179958 - DNA, 25 bp, Mus musculus
agctctctgagaccaggcacctgtc

SEQ ID NO: 179959 - DNA, 25 bp, Mus musculus
agctctctgagagactctgggtcca

SEQ ID NO: 179960 - DNA, 25 bp, Mus musculus
agctctctgagagcaggcacctgtc

SEQ ID NO: 179961 - DNA, 25 bp, Mus musculus
agctctctgagcaaaaggctgtact

SEQ ID NO: 179962 - DNA, 25 bp, Mus musculus
agctctctgagctaaaggctgtact

SEQ ID NO: 179963 - DNA, 25 bp, Mus musculus
agctctctgatcctcattagctaga

SEQ ID NO: 179964 - DNA, 25 bp, Mus musculus
agctctctgatcgtcattagctaga

SEQ ID NO: 179965 - DNA, 25 bp, Mus musculus
agctctctgatgcaggactctggtg

SEQ ID NO: 179966 - DNA, 25 bp, Mus musculus
agctctctgatggaggactctggtg

SEQ ID NO: 179967 - DNA, 25 bp, Mus musculus
agctctctgcatacttggaacaacc

SEQ ID NO: 179968 - DNA, 25 bp, Mus musculus
agctctctgcattcttggaacaacc

SEQ ID NO: 179969 - DNA, 25 bp, Mus musculus
agctctctgcccaaaagtgaccaaa

SEQ ID NO: 179970 - DNA, 25 bp, Mus musculus
agctctctgccctaaagtgaccaaa

SEQ ID NO: 179971 - DNA, 25 bp, Mus musculus
agctctctgcctctcttgcaataaa

SEQ ID NO: 179972 - DNA, 25 bp, Mus musculus
agctctctgcctgtcttgcaataaa

SEQ ID NO: 179973 - DNA, 25 bp, Mus musculus
agctctctgcttataaccctgatta

SEQ ID NO: 179974 - DNA, 25 bp, Mus musculus
agctctctgcttttaaccctgatta

SEQ ID NO: 179975 - DNA, 25 bp, Mus musculus
agctctctggcaagatcttttacaa

SEQ ID NO: 179976 - DNA, 25 bp, Mus musculus
agctctctggcatgatcttttacaa

SEQ ID NO: 179977 - DNA, 25 bp, Mus musculus
agctctctggtactctttgtgttca

SEQ ID NO: 179978 - DNA, 25 bp, Mus musculus
agctctctggtagtctttgtgttca

SEQ ID NO: 179979 - DNA, 25 bp, Mus musculus
agctctctgtaactctgtcatgata

SEQ ID NO: 179980 - DNA, 25 bp, Mus musculus
agctctctgtaagtctgtcatgata

SEQ ID NO: 179981 - DNA, 25 bp, Mus musculus
agctctctgtcaacaagtcatttgg

SEQ ID NO: 179982 - DNA, 25 bp, Mus musculus
agctctctgtcatcaagtcatttgg

SEQ ID NO: 179983 - DNA, 25 bp, Mus musculus
agctctctgtctccaagggcataaa

SEQ ID NO: 179984 - DNA, 25 bp, Mus musculus
agctctctgtctgcaagggcataaa

SEQ ID NO: 179985 - DNA, 25 bp, Mus musculus
agctctctgtggatgccaaagccct

SEQ ID NO: 179986 - DNA, 25 bp, Mus musculus
agctctctgtggctatacagccata

SEQ ID NO: 179987 - DNA, 25 bp, Mus musculus
agctctctgtgggtatacagccata

SEQ ID NO: 179988 - DNA, 25 bp, Mus musculus
agctctctgtggttgccaaagccct

SEQ ID NO: 179989 - DNA, 25 bp, Mus musculus
agctctcttaatacctccttaaatt

SEQ ID NO: 179990 - DNA, 25 bp, Mus musculus
agctctcttaattcctccttaaatt

SEQ ID NO: 179991 - DNA, 25 bp, Mus musculus
agctctcttagcaaggtcttctggg

SEQ ID NO: 179992 - DNA, 25 bp, Mus musculus
agctctcttagctaggtcttctggg

SEQ ID NO: 179993 - DNA, 25 bp, Mus musculus
agctctcttcatctactgggagctg

SEQ ID NO: 179994 - DNA, 25 bp, Mus musculus
agctctcttcatgtactgggagctg

SEQ ID NO: 179995 - DNA, 25 bp, Mus musculus
agctctcttgaaccttgttcatctt

SEQ ID NO: 179996 - DNA, 25 bp, Mus musculus
agctctcttgaagcttgttcatctt

SEQ ID NO: 179997 - DNA, 25 bp, Mus musculus
agctctcttgctctagtacctatga

SEQ ID NO: 179998 - DNA, 25 bp, Mus musculus
agctctcttgctgtagtacctatga

SEQ ID NO: 179999 - DNA, 25 bp, Mus musculus
agctctcttggacttaccattgcca

SEQ ID NO: 180000 - DNA, 25 bp, Mus musculus
agctctcttggagttaccattgcca

SEQ ID NO: 180001 - DNA, 25 bp, Mus musculus
agctctcttttgacccattggtact

SEQ ID NO: 180002 - DNA, 25 bp, Mus musculus
agctctcttttgtcccattggtact

SEQ ID NO: 180003 - DNA, 25 bp, Mus musculus
agctctgaaagcaagcaacctaaaa

SEQ ID NO: 180004 - DNA, 25 bp, Mus musculus
agctctgaaagctagcaacctaaaa

SEQ ID NO: 180005 - DNA, 25 bp, Mus musculus
agctctgaactaataaatgtcttat

SEQ ID NO: 180006 - DNA, 25 bp, Mus musculus
agctctgaactattaaatgtcttat

SEQ ID NO: 180007 - DNA, 25 bp, Mus musculus
agctctgaacttcgctctggatcag

SEQ ID NO: 180008 - DNA, 25 bp, Mus musculus
agctctgaacttggctctggatcag

SEQ ID NO: 180009 - DNA, 25 bp, Mus musculus
agctctgaagccatgttggtaccat

SEQ ID NO: 180010 - DNA, 25 bp, Mus musculus
agctctgaagccttgttggtaccat

SEQ ID NO: 180011 - DNA, 25 bp, Mus musculus
agctctgaagcgctttgctgcccgg

SEQ ID NO: 180012 - DNA, 25 bp, Mus musculus
agctctgaagcggtttgctgcccgg

SEQ ID NO: 180013 - DNA, 25 bp, Mus musculus
agctctgaattgagagtctgcccct

SEQ ID NO: 180014 - DNA, 25 bp, Mus musculus
agctctgaattgtgagtctgcccct

SEQ ID NO: 180015 - DNA, 25 bp, Mus musculus
agctctgacaatcgcccgcaggagt

SEQ ID NO: 180016 - DNA, 25 bp, Mus musculus
agctctgacaatggcccgcaggagt

SEQ ID NO: 180017 - DNA, 25 bp, Mus musculus
agctctgactatattttcctaagaa

SEQ ID NO: 180018 - DNA, 25 bp, Mus musculus
agctctgactattttttcctaagaa

SEQ ID NO: 180019 - DNA, 25 bp, Mus musculus
agctctgactcacggtgccagcaat

SEQ ID NO: 180020 - DNA, 25 bp, Mus musculus
agctctgactcagggtgccagcaat

SEQ ID NO: 180021 - DNA, 25 bp, Mus musculus
agctctgactgaactccagggtgag

SEQ ID NO: 180022 - DNA, 25 bp, Mus musculus
agctctgactgatctccagggtgag

SEQ ID NO: 180023 - DNA, 25 bp, Mus musculus
agctctgactgcaccgttgggccat

SEQ ID NO: 180024 - DNA, 25 bp, Mus musculus
agctctgactgccagtgtatcgatg

SEQ ID NO: 180025 - DNA, 25 bp, Mus musculus
agctctgactgccttgaagatggag

SEQ ID NO: 180026 - DNA, 25 bp, Mus musculus
agctctgactgcgagtgtatcgatg

SEQ ID NO: 180027 - DNA, 25 bp, Mus musculus
agctctgactgcgttgaagatggag

SEQ ID NO: 180028 - DNA, 25 bp, Mus musculus
agctctgactgctccgttgggccat

SEQ ID NO: 180029 - DNA, 25 bp, Mus musculus
agctctgactggagccgtgcactga

SEQ ID NO: 180030 - DNA, 25 bp, Mus musculus
agctctgactggtgccgtgcactga

SEQ ID NO: 180031 - DNA, 25 bp, Mus musculus
agctctgacttgaaaccgtttgcac

SEQ ID NO: 180032 - DNA, 25 bp, Mus musculus
agctctgacttgtaaccgtttgcac

SEQ ID NO: 180033 - DNA, 25 bp, Mus musculus
agctctgactttccctttagactaa

SEQ ID NO: 180034 - DNA, 25 bp, Mus musculus
agctctgactttgcctttagactaa

SEQ ID NO: 180035 - DNA, 25 bp, Mus musculus
agctctgagaaactgcaacacacac

SEQ ID NO: 180036 - DNA, 25 bp, Mus musculus
agctctgagaaagtgcaacacacac

SEQ ID NO: 180037 - DNA, 25 bp, Mus musculus
agctctgagagcctgaagagtcatg

SEQ ID NO: 180038 - DNA, 25 bp, Mus musculus
agctctgagagcgtgaagagtcatg

SEQ ID NO: 180039 - DNA, 25 bp, Mus musculus
agctctgagctcaaggtacctggga

SEQ ID NO: 180040 - DNA, 25 bp, Mus musculus
agctctgagctctaggtacctggga

SEQ ID NO: 180041 - DNA, 25 bp, Mus musculus
agctctgagctgacaacgagacgtt

SEQ ID NO: 180042 - DNA, 25 bp, Mus musculus
agctctgagctgatctgaggttcat

SEQ ID NO: 180043 - DNA, 25 bp, Mus musculus
agctctgagctgtcaacgagacgtt

SEQ ID NO: 180044 - DNA, 25 bp, Mus musculus
agctctgagctgttctgaggttcat

SEQ ID NO: 180045 - DNA, 25 bp, Mus musculus
agctctgaggtgcaactgtgtcttc

SEQ ID NO: 180046 - DNA, 25 bp, Mus musculus
agctctgaggtggaactgtgtcttc

SEQ ID NO: 180047 - DNA, 25 bp, Mus musculus
agctctgagttgactggctcactca

SEQ ID NO: 180048 - DNA, 25 bp, Mus musculus
agctctgagttgagtgtgattagga

SEQ ID NO: 180049 - DNA, 25 bp, Mus musculus
agctctgagttgtctggctcactca

SEQ ID NO: 180050 - DNA, 25 bp, Mus musculus
agctctgagttgtgtgtgattagga

SEQ ID NO: 180051 - DNA, 25 bp, Mus musculus
agctctgatctcagtaataggcccg

SEQ ID NO: 180052 - DNA, 25 bp, Mus musculus
agctctgatctctgtaataggcccg

SEQ ID NO: 180053 - DNA, 25 bp, Mus musculus
agctctgatgatatctgctcttctt

SEQ ID NO: 180054 - DNA, 25 bp, Mus musculus
agctctgatgatttctgctcttctt

SEQ ID NO: 180055 - DNA, 25 bp, Mus musculus
agctctgcaaaaactggccttacta

SEQ ID NO: 180056 - DNA, 25 bp, Mus musculus
agctctgcaaaatctggccttacta

SEQ ID NO: 180057 - DNA, 25 bp, Mus musculus
agctctgcaagcctgaatcaacatg

SEQ ID NO: 180058 - DNA, 25 bp, Mus musculus
agctctgcaagcgtgaatcaacatg

SEQ ID NO: 180059 - DNA, 25 bp, Mus musculus
agctctgcacctactgaaaccataa

SEQ ID NO: 180060 - DNA, 25 bp, Mus musculus
agctctgcaccttctgaaaccataa

SEQ ID NO: 180061 - DNA, 25 bp, Mus musculus
agctctgcacgacgcatgctttgga

SEQ ID NO: 180062 - DNA, 25 bp, Mus musculus
agctctgcacgaggcatgctttgga

SEQ ID NO: 180063 - DNA, 25 bp, Mus musculus
agctctgcagaaagaaagcccagga

SEQ ID NO: 180064 - DNA, 25 bp, Mus musculus
agctctgcagaacctccgtgaatcg

SEQ ID NO: 180065 - DNA, 25 bp, Mus musculus
agctctgcagaagctccgtgaatcg

SEQ ID NO: 180066 - DNA, 25 bp, Mus musculus
agctctgcagaatgaaagcccagga

SEQ ID NO: 180067 - DNA, 25 bp, Mus musculus
agctctgcagatcaccagactaaga

SEQ ID NO: 180068 - DNA, 25 bp, Mus musculus
agctctgcagatgaccagactaaga

SEQ ID NO: 180069 - DNA, 25 bp, Mus musculus
agctctgcagctctccggacagcag

SEQ ID NO: 180070 - DNA, 25 bp, Mus musculus
agctctgcagctgtccggacagcag

SEQ ID NO: 180071 - DNA, 25 bp, Mus musculus
agctctgcaggaacgacttcttggc

SEQ ID NO: 180072 - DNA, 25 bp, Mus musculus
agctctgcaggactctgagacacca

SEQ ID NO: 180073 - DNA, 25 bp, Mus musculus
agctctgcaggagtctgagacacca

SEQ ID NO: 180074 - DNA, 25 bp, Mus musculus
agctctgcaggatcgacttcttggc

SEQ ID NO: 180075 - DNA, 25 bp, Mus musculus
agctctgcagtaagcttgtggcaat

SEQ ID NO: 180076 - DNA, 25 bp, Mus musculus
agctctgcagtatgcttgtggcaat

SEQ ID NO: 180077 - DNA, 25 bp, Mus musculus
agctctgccaagactcagcctgtgg

SEQ ID NO: 180078 - DNA, 25 bp, Mus musculus
agctctgccaagtctcagcctgtgg

SEQ ID NO: 180079 - DNA, 25 bp, Mus musculus
agctctgccactcactggagatgta

SEQ ID NO: 180080 - DNA, 25 bp, Mus musculus
agctctgccactgactggagatgta

SEQ ID NO: 180081 - DNA, 20 bp, Mus musculus
agctctgcccacattcagac

SEQ ID NO: 180082 - DNA, 20 bp, Mus musculus
agctctgcccccattcagac

SEQ ID NO: 180083 - DNA, 25 bp, Mus musculus
agctctgcccgacggaggacatctg

SEQ ID NO: 180084 - DNA, 25 bp, Mus musculus
agctctgcccgagggaggacatctg

SEQ ID NO: 180085 - DNA, 20 bp, Mus musculus
agctctgcccgcattcagac

SEQ ID NO: 180086 - DNA, 25 bp, Mus musculus
agctctgcccggcatggagaatgtc

SEQ ID NO: 180087 - DNA, 25 bp, Mus musculus
agctctgcccgggatggagaatgtc

SEQ ID NO: 180088 - DNA, 25 bp, Mus musculus
agctctgccctaagctcttggtagg

SEQ ID NO: 180089 - DNA, 25 bp, Mus musculus
agctctgccctatgctcttggtagg

SEQ ID NO: 180090 - DNA, 20 bp, Mus musculus
agctctgccctcattcagac

SEQ ID NO: 180091 - DNA, 25 bp, Mus musculus
agctctgcccttaacttcattttct

SEQ ID NO: 180092 - DNA, 25 bp, Mus musculus
agctctgcccttctcataatgttta

SEQ ID NO: 180093 - DNA, 25 bp, Mus musculus
agctctgcccttgtcataatgttta

SEQ ID NO: 180094 - DNA, 25 bp, Mus musculus
agctctgccctttacttcattttct

SEQ ID NO: 180095 - DNA, 25 bp, Mus musculus
agctctgccgacagtgtgtccggaa

SEQ ID NO: 180096 - DNA, 25 bp, Mus musculus
agctctgccgactgtgtgtccggaa

SEQ ID NO: 180097 - DNA, 25 bp, Mus musculus
agctctgccgtcactacagaggaag

SEQ ID NO: 180098 - DNA, 25 bp, Mus musculus
agctctgccgtctctacagaggaag

SEQ ID NO: 180099 - DNA, 25 bp, Mus musculus
agctctgcctcaatatctgcgtcgg

SEQ ID NO: 180100 - DNA, 25 bp, Mus musculus
agctctgcctcattatctgcgtcgg

SEQ ID NO: 180101 - DNA, 25 bp, Mus musculus
agctctgcctgtcacattgcatgga

SEQ ID NO: 180102 - DNA, 25 bp, Mus musculus
agctctgcctgtgacattgcatgga

SEQ ID NO: 180103 - DNA, 25 bp, Mus musculus
agctctgcctttacaacctatttta

SEQ ID NO: 180104 - DNA, 25 bp, Mus musculus
agctctgccttttcaacctatttta

SEQ ID NO: 180105 - DNA, 25 bp, Mus musculus
agctctgcgtacatctggttgggat

SEQ ID NO: 180106 - DNA, 25 bp, Mus musculus
agctctgcgtacttctggttgggat

SEQ ID NO: 180107 - DNA, 25 bp, Mus musculus
agctctgcgtgcctatgaactgaat

SEQ ID NO: 180108 - DNA, 25 bp, Mus musculus
agctctgcgtgcgtatgaactgaat

SEQ ID NO: 180109 - DNA, 25 bp, Mus musculus
agctctgctacgataacatctgtta

SEQ ID NO: 180110 - DNA, 25 bp, Mus musculus
agctctgctacgttaacatctgtta

SEQ ID NO: 180111 - DNA, 25 bp, Mus musculus
agctctgctatcctgatctgtttca

SEQ ID NO: 180112 - DNA, 25 bp, Mus musculus
agctctgctatcgtgatctgtttca

SEQ ID NO: 180113 - DNA, 25 bp, Mus musculus
agctctgctatgacagccactaaat

SEQ ID NO: 180114 - DNA, 25 bp, Mus musculus
agctctgctatgtcagccactaaat

SEQ ID NO: 180115 - DNA, 25 bp, Mus musculus
agctctgctcctatttccaacaaag

SEQ ID NO: 180116 - DNA, 25 bp, Mus musculus
agctctgctcctttttccaacaaag

SEQ ID NO: 180117 - DNA, 25 bp, Mus musculus
agctctgctgagaccctgtgtttga

SEQ ID NO: 180118 - DNA, 25 bp, Mus musculus
agctctgctgagtccctgtgtttga

SEQ ID NO: 180119 - DNA, 25 bp, Mus musculus
agctctgctgccatctcaagaatga

SEQ ID NO: 180120 - DNA, 25 bp, Mus musculus
agctctgctgccttctcaagaatga

SEQ ID NO: 180121 - DNA, 25 bp, Mus musculus
agctctgctgctcataagtggtatg

SEQ ID NO: 180122 - DNA, 25 bp, Mus musculus
agctctgctgctgataagtggtatg

SEQ ID NO: 180123 - DNA, 25 bp, Mus musculus
agctctgctgttataatgcagccta

SEQ ID NO: 180124 - DNA, 25 bp, Mus musculus
agctctgctgttttaatgcagccta

SEQ ID NO: 180125 - DNA, 25 bp, Mus musculus
agctctgcttaaagaacgcgattga

SEQ ID NO: 180126 - DNA, 25 bp, Mus musculus
agctctgcttaatgaacgcgattga

SEQ ID NO: 180127 - DNA, 25 bp, Mus musculus
agctctgcttacattgggacttccc

SEQ ID NO: 180128 - DNA, 25 bp, Mus musculus
agctctgcttactttgggacttccc

SEQ ID NO: 180129 - DNA, 25 bp, Mus musculus
agctctgcttatatgggtcttctca

SEQ ID NO: 180130 - DNA, 25 bp, Mus musculus
agctctgcttatttgggtcttctca

SEQ ID NO: 180131 - DNA, 25 bp, Mus musculus
agctctgcttgcacttgttccagat

SEQ ID NO: 180132 - DNA, 25 bp, Mus musculus
agctctgcttgcagtggtcgaacac

SEQ ID NO: 180133 - DNA, 25 bp, Mus musculus
agctctgcttgctcttgttccagat

SEQ ID NO: 180134 - DNA, 25 bp, Mus musculus
agctctgcttgctgtggtcgaacac

SEQ ID NO: 180135 - DNA, 25 bp, Mus musculus
agctctgctttacacacgctgaaga

SEQ ID NO: 180136 - DNA, 25 bp, Mus musculus
agctctgctttagacacgctgaaga

SEQ ID NO: 180137 - DNA, 25 bp, Mus musculus
agctctgctttgagaaacctcagaa

SEQ ID NO: 180138 - DNA, 25 bp, Mus musculus
agctctgctttgtgaaacctcagaa

SEQ ID NO: 180139 - DNA, 25 bp, Mus musculus
agctctgcttttccatcttgagtta

SEQ ID NO: 180140 - DNA, 25 bp, Mus musculus
agctctgcttttgcatcttgagtta

SEQ ID NO: 180141 - DNA, 25 bp, Mus musculus
agctctggaaccctgcaaagttgca

SEQ ID NO: 180142 - DNA, 25 bp, Mus musculus
agctctggaaccgtgcaaagttgca

SEQ ID NO: 180143 - DNA, 25 bp, Mus musculus
agctctggaagtcacacacctttgt

SEQ ID NO: 180144 - DNA, 25 bp, Mus musculus
agctctggaagtgacacacctttgt

SEQ ID NO: 180145 - DNA, 25 bp, Mus musculus
agctctggacctcttgttgctatga

SEQ ID NO: 180146 - DNA, 25 bp, Mus musculus
agctctggacctgttgttgctatga

SEQ ID NO: 180147 - DNA, 25 bp, Mus musculus
agctctggaggtaccagtggctcct

SEQ ID NO: 180148 - DNA, 25 bp, Mus musculus
agctctggaggttccagtggctcct

SEQ ID NO: 180149 - DNA, 25 bp, Mus musculus
agctctggattaccccagtgagaat

SEQ ID NO: 180150 - DNA, 25 bp, Mus musculus
agctctggattagcccagtgagaat

SEQ ID NO: 180151 - DNA, 25 bp, Mus musculus
agctctggccctaatggtggtggag

SEQ ID NO: 180152 - DNA, 25 bp, Mus musculus
agctctggcccttatggtggtggag

SEQ ID NO: 180153 - DNA, 25 bp, Mus musculus
agctctggcctcctatgagtttgag

SEQ ID NO: 180154 - DNA, 25 bp, Mus musculus
agctctggcctcgtatgagtttgag

SEQ ID NO: 180155 - DNA, 25 bp, Mus musculus
agctctggcgccagggatgacaacc

SEQ ID NO: 180156 - DNA, 25 bp, Mus musculus
agctctggcgcctgggatgacaacc

SEQ ID NO: 180157 - DNA, 25 bp, Mus musculus
agctctggctaccactcggctataa

SEQ ID NO: 180158 - DNA, 25 bp, Mus musculus
agctctggctacgactcggctataa

SEQ ID NO: 180159 - DNA, 25 bp, Mus musculus
agctctggctccagtcttgtgggct

SEQ ID NO: 180160 - DNA, 25 bp, Mus musculus
agctctggctcctgtcttgtgggct

SEQ ID NO: 180161 - DNA, 25 bp, Mus musculus
agctctggctgcacaccatatagga

SEQ ID NO: 180162 - DNA, 25 bp, Mus musculus
agctctggctgcatactttgtatga

SEQ ID NO: 180163 - DNA, 25 bp, Mus musculus
agctctggctgctcaccatatagga

SEQ ID NO: 180164 - DNA, 25 bp, Mus musculus
agctctggctgcttactttgtatga

SEQ ID NO: 180165 - DNA, 25 bp, Mus musculus
agctctggctggaagtggacgttca

SEQ ID NO: 180166 - DNA, 25 bp, Mus musculus
agctctggctggtagtggacgttca

SEQ ID NO: 180167 - DNA, 25 bp, Mus musculus
agctctgggaccacctttgaagtga

SEQ ID NO: 180168 - DNA, 25 bp, Mus musculus
agctctgggacctcctttgaagtga

SEQ ID NO: 180169 - DNA, 25 bp, Mus musculus
agctctgggatgagtagcgcccact

SEQ ID NO: 180170 - DNA, 25 bp, Mus musculus
agctctgggatgtgtagcgcccact

SEQ ID NO: 180171 - DNA, 25 bp, Mus musculus
agctctgggcatatgatgcagcaca

SEQ ID NO: 180172 - DNA, 25 bp, Mus musculus
agctctgggcatcttactgctacta

SEQ ID NO: 180173 - DNA, 25 bp, Mus musculus
agctctgggcatgttactgctacta

SEQ ID NO: 180174 - DNA, 25 bp, Mus musculus
agctctgggcatttgatgcagcaca

SEQ ID NO: 180175 - DNA, 25 bp, Mus musculus
agctctgggctactatgcatcatta

SEQ ID NO: 180176 - DNA, 25 bp, Mus musculus
agctctgggctagtatgcatcatta

SEQ ID NO: 180177 - DNA, 25 bp, Mus musculus
agctctgggctcatttacttctaca

SEQ ID NO: 180178 - DNA, 25 bp, Mus musculus
agctctgggctcttttacttctaca

SEQ ID NO: 180179 - DNA, 25 bp, Mus musculus
agctctggggaacttaattggcctg

SEQ ID NO: 180180 - DNA, 25 bp, Mus musculus
agctctggggaagttaattggcctg

SEQ ID NO: 180181 - DNA, 25 bp, Mus musculus
agctctgggtgactcaagatgtgac

SEQ ID NO: 180182 - DNA, 25 bp, Mus musculus
agctctgggtgagtcaagatgtgac

SEQ ID NO: 180183 - DNA, 25 bp, Mus musculus
agctctggtaccacttcagcactgg

SEQ ID NO: 180184 - DNA, 25 bp, Mus musculus
agctctggtacctcttcagcactgg

SEQ ID NO: 180185 - DNA, 25 bp, Mus musculus
agctctggtattcactttaccttgt

SEQ ID NO: 180186 - DNA, 25 bp, Mus musculus
agctctggtattgactttaccttgt

SEQ ID NO: 180187 - DNA, 25 bp, Mus musculus
agctctggtctcagtattttcaccc

SEQ ID NO: 180188 - DNA, 25 bp, Mus musculus
agctctggtctctgtattttcaccc

SEQ ID NO: 180189 - DNA, 25 bp, Mus musculus
agctctggtggtcaccagccttttt

SEQ ID NO: 180190 - DNA, 25 bp, Mus musculus
agctctggtggtgaccagccttttt

SEQ ID NO: 180191 - DNA, 25 bp, Mus musculus
agctctggtgtcaccacattatgta

SEQ ID NO: 180192 - DNA, 25 bp, Mus musculus
agctctggtgtctccacattatgta

SEQ ID NO: 180193 - DNA, 25 bp, Mus musculus
agctctggttgcaacatctgggcag

SEQ ID NO: 180194 - DNA, 25 bp, Mus musculus
agctctggttgctacatctgggcag

SEQ ID NO: 180195 - DNA, 25 bp, Mus musculus
agctctgtaacaatcattctgaaag

SEQ ID NO: 180196 - DNA, 25 bp, Mus musculus
agctctgtaacattcattctgaaag

SEQ ID NO: 180197 - DNA, 25 bp, Mus musculus
agctctgtaaggaggttccgaacta

SEQ ID NO: 180198 - DNA, 25 bp, Mus musculus
agctctgtaaggatttcatcatgtc

SEQ ID NO: 180199 - DNA, 25 bp, Mus musculus
agctctgtaaggtggttccgaacta

SEQ ID NO: 180200 - DNA, 25 bp, Mus musculus
agctctgtaaggttttcatcatgtc

SEQ ID NO: 180201 - DNA, 25 bp, Mus musculus
agctctgtaatgacctctgggcttg

SEQ ID NO: 180202 - DNA, 25 bp, Mus musculus
agctctgtaatgtcctctgggcttg

SEQ ID NO: 180203 - DNA, 25 bp, Mus musculus
agctctgtacagacatgctgggcct

SEQ ID NO: 180204 - DNA, 25 bp, Mus musculus
agctctgtacagtcatgctgggcct

SEQ ID NO: 180205 - DNA, 25 bp, Mus musculus
agctctgtacatactgaggtccagc

SEQ ID NO: 180206 - DNA, 25 bp, Mus musculus
agctctgtacattctgaggtccagc

SEQ ID NO: 180207 - DNA, 25 bp, Mus musculus
agctctgtagacatcagctacgtta

SEQ ID NO: 180208 - DNA, 25 bp, Mus musculus
agctctgtagacttcagctacgtta

SEQ ID NO: 180209 - DNA, 25 bp, Mus musculus
agctctgtagagctcacctctgtgt

SEQ ID NO: 180210 - DNA, 25 bp, Mus musculus
agctctgtagaggtcacctctgtgt

SEQ ID NO: 180211 - DNA, 25 bp, Mus musculus
agctctgtagctataagggatcggt

SEQ ID NO: 180212 - DNA, 25 bp, Mus musculus
agctctgtagctttaagggatcggt

SEQ ID NO: 180213 - DNA, 25 bp, Mus musculus
agctctgtagtaatagaccactcac

SEQ ID NO: 180214 - DNA, 25 bp, Mus musculus
agctctgtagtattagaccactcac

SEQ ID NO: 180215 - DNA, 25 bp, Mus musculus
agctctgtagtgcatggacttgcct

SEQ ID NO: 180216 - DNA, 25 bp, Mus musculus
agctctgtagtggatggacttgcct

SEQ ID NO: 180217 - DNA, 25 bp, Mus musculus
agctctgtatttagttatggaagtc

SEQ ID NO: 180218 - DNA, 25 bp, Mus musculus
agctctgtattttgttatggaagtc

SEQ ID NO: 180219 - DNA, 25 bp, Mus musculus
agctctgtcacaaccaactgggaat

SEQ ID NO: 180220 - DNA, 25 bp, Mus musculus
agctctgtcacaatcaaggttacca

SEQ ID NO: 180221 - DNA, 25 bp, Mus musculus
agctctgtcacacttcttcagcatt

SEQ ID NO: 180222 - DNA, 25 bp, Mus musculus
agctctgtcacagttcttcagcatt

SEQ ID NO: 180223 - DNA, 25 bp, Mus musculus
agctctgtcacatccaactgggaat

SEQ ID NO: 180224 - DNA, 25 bp, Mus musculus
agctctgtcacattcaaggttacca

SEQ ID NO: 180225 - DNA, 25 bp, Mus musculus
agctctgtcactaaatggctgtgtt

SEQ ID NO: 180226 - DNA, 25 bp, Mus musculus
agctctgtcacttaatggctgtgtt

SEQ ID NO: 180227 - DNA, 25 bp, Mus musculus
agctctgtcagacgacctaacacct

SEQ ID NO: 180228 - DNA, 25 bp, Mus musculus
agctctgtcagaggacctaacacct

SEQ ID NO: 180229 - DNA, 25 bp, Mus musculus
agctctgtccttcagtggcctgcaa

SEQ ID NO: 180230 - DNA, 25 bp, Mus musculus
agctctgtccttgagtggcctgcaa

SEQ ID NO: 180231 - DNA, 25 bp, Mus musculus
agctctgtcgagctctgcgatcttc

SEQ ID NO: 180232 - DNA, 25 bp, Mus musculus
agctctgtcgaggtctgcgatcttc

SEQ ID NO: 180233 - DNA, 25 bp, Mus musculus
agctctgtcgcacgtgatgacgtcc

SEQ ID NO: 180234 - DNA, 25 bp, Mus musculus
agctctgtcgcaggtgatgacgtcc

SEQ ID NO: 180235 - DNA, 25 bp, Mus musculus
agctctgtctccaagttgtggtttc

SEQ ID NO: 180236 - DNA, 25 bp, Mus musculus
agctctgtctcctagttgtggtttc

SEQ ID NO: 180237 - DNA, 25 bp, Mus musculus
agctctgtctgaaatcttagggtat

SEQ ID NO: 180238 - DNA, 25 bp, Mus musculus
agctctgtctgatatcttagggtat

SEQ ID NO: 180239 - DNA, 25 bp, Mus musculus
agctctgtctgtaaatagaatcgca

SEQ ID NO: 180240 - DNA, 25 bp, Mus musculus
agctctgtctgttaatagaatcgca

SEQ ID NO: 180241 - DNA, 25 bp, Mus musculus
agctctgtgactagtgtaactttac

SEQ ID NO: 180242 - DNA, 25 bp, Mus musculus
agctctgtgactcagcgtttgccat

SEQ ID NO: 180243 - DNA, 25 bp, Mus musculus
agctctgtgactgagcgtttgccat

SEQ ID NO: 180244 - DNA, 25 bp, Mus musculus
agctctgtgacttgtgtaactttac

SEQ ID NO: 180245 - DNA, 25 bp, Mus musculus
agctctgtgagcatagtgaccagga

SEQ ID NO: 180246 - DNA, 25 bp, Mus musculus
agctctgtgagcttagtgaccagga

SEQ ID NO: 180247 - DNA, 25 bp, Mus musculus
agctctgtgagtccaagtggagact

SEQ ID NO: 180248 - DNA, 25 bp, Mus musculus
agctctgtgagtgcaagtggagact

SEQ ID NO: 180249 - DNA, 25 bp, Mus musculus
agctctgtgcatacacacgttagca

SEQ ID NO: 180250 - DNA, 25 bp, Mus musculus
agctctgtgcattcacacgttagca

SEQ ID NO: 180251 - DNA, 25 bp, Mus musculus
agctctgtgcctaaacactgccaga

SEQ ID NO: 180252 - DNA, 25 bp, Mus musculus
agctctgtgccttaacactgccaga

SEQ ID NO: 180253 - DNA, 25 bp, Mus musculus
agctctgtgctacagatatcactgt

SEQ ID NO: 180254 - DNA, 25 bp, Mus musculus
agctctgtgctagagatatcactgt

SEQ ID NO: 180255 - DNA, 25 bp, Mus musculus
agctctgtgctcaagacactcatat

SEQ ID NO: 180256 - DNA, 25 bp, Mus musculus
agctctgtgctctagacactcatat

SEQ ID NO: 180257 - DNA, 25 bp, Mus musculus
agctctgtgcttagccccgctaaga

SEQ ID NO: 180258 - DNA, 25 bp, Mus musculus
agctctgtgcttcactgacttggat

SEQ ID NO: 180259 - DNA, 25 bp, Mus musculus
agctctgtgcttgactgacttggat

SEQ ID NO: 180260 - DNA, 25 bp, Mus musculus
agctctgtgctttgccccgctaaga

SEQ ID NO: 180261 - DNA, 25 bp, Mus musculus
agctctgtggacaagatgcctcgac

SEQ ID NO: 180262 - DNA, 25 bp, Mus musculus
agctctgtggactagatgcctcgac

SEQ ID NO: 180263 - DNA, 25 bp, Mus musculus
agctctgtggagaccatgatctgag

SEQ ID NO: 180264 - DNA, 25 bp, Mus musculus
agctctgtggagatatttgctcctt

SEQ ID NO: 180265 - DNA, 25 bp, Mus musculus
agctctgtggagtccatgatctgag

SEQ ID NO: 180266 - DNA, 25 bp, Mus musculus
agctctgtggagttatttgctcctt

SEQ ID NO: 180267 - DNA, 25 bp, Mus musculus
agctctgtggtaacgatttgactgc

SEQ ID NO: 180268 - DNA, 25 bp, Mus musculus
agctctgtggtatcgatttgactgc

SEQ ID NO: 180269 - DNA, 25 bp, Mus musculus
agctctgtggtcacgggatgtacac

SEQ ID NO: 180270 - DNA, 25 bp, Mus musculus
agctctgtggtctcgggatgtacac

SEQ ID NO: 180271 - DNA, 25 bp, Mus musculus
agctctgtggtgacataatctggtc

SEQ ID NO: 180272 - DNA, 25 bp, Mus musculus
agctctgtggtgtcataatctggtc

SEQ ID NO: 180273 - DNA, 25 bp, Mus musculus
agctctgtgtacatgggtgcttctc

SEQ ID NO: 180274 - DNA, 25 bp, Mus musculus
agctctgtgtacttgggtgcttctc

SEQ ID NO: 180275 - DNA, 25 bp, Mus musculus
agctctgtgtagcaccctgtatcta

SEQ ID NO: 180276 - DNA, 25 bp, Mus musculus
agctctgtgtaggaccctgtatcta

SEQ ID NO: 180277 - DNA, 25 bp, Mus musculus
agctctgtgtctcgaattggaggac

SEQ ID NO: 180278 - DNA, 25 bp, Mus musculus
agctctgtgtctggaattggaggac

SEQ ID NO: 180279 - DNA, 25 bp, Mus musculus
agctctgtgtgcctttcctagaagt

SEQ ID NO: 180280 - DNA, 25 bp, Mus musculus
agctctgtgtgcgtttcctagaagt

SEQ ID NO: 180281 - DNA, 25 bp, Mus musculus
agctctgtgtgtacctagtgtccta

SEQ ID NO: 180282 - DNA, 25 bp, Mus musculus
agctctgtgtgttcctagtgtccta

SEQ ID NO: 180283 - DNA, 25 bp, Mus musculus
agctctgtgtttagctggactctgg

SEQ ID NO: 180284 - DNA, 25 bp, Mus musculus
agctctgtgttttgctggactctgg

SEQ ID NO: 180285 - DNA, 25 bp, Mus musculus
agctctgttaacagcatctgctctt

SEQ ID NO: 180286 - DNA, 25 bp, Mus musculus
agctctgttaactgcatctgctctt

SEQ ID NO: 180287 - DNA, 25 bp, Mus musculus
agctctgttacactagggaaccagt

SEQ ID NO: 180288 - DNA, 25 bp, Mus musculus
agctctgttacagtagggaaccagt

SEQ ID NO: 180289 - DNA, 25 bp, Mus musculus
agctctgttcctagcagtaccttga

SEQ ID NO: 180290 - DNA, 25 bp, Mus musculus
agctctgttccttgcagtaccttga

SEQ ID NO: 180291 - DNA, 25 bp, Mus musculus
agctctgttctcatggaagaccctt

SEQ ID NO: 180292 - DNA, 25 bp, Mus musculus
agctctgttctcatgtggccaagtg

SEQ ID NO: 180293 - DNA, 25 bp, Mus musculus
agctctgttctcttggaagaccctt

SEQ ID NO: 180294 - DNA, 25 bp, Mus musculus
agctctgttctcttgtggccaagtg

SEQ ID NO: 180295 - DNA, 25 bp, Mus musculus
agctctgttctgcatggaactctgc

SEQ ID NO: 180296 - DNA, 25 bp, Mus musculus
agctctgttctggatggaactctgc

SEQ ID NO: 180297 - DNA, 25 bp, Mus musculus
agctctgttggtccttcaactgctc

SEQ ID NO: 180298 - DNA, 25 bp, Mus musculus
agctctgttggtctcctggtgctga

SEQ ID NO: 180299 - DNA, 25 bp, Mus musculus
agctctgttggtgcttcaactgctc

SEQ ID NO: 180300 - DNA, 25 bp, Mus musculus
agctctgttggtgtcctggtgctga

SEQ ID NO: 180301 - DNA, 25 bp, Mus musculus
agctctgttgttcgctcttcttggt

SEQ ID NO: 180302 - DNA, 25 bp, Mus musculus
agctctgttgttggctcttcttggt

SEQ ID NO: 180303 - DNA, 25 bp, Mus musculus
agctctgtttataggcctcaattat

SEQ ID NO: 180304 - DNA, 25 bp, Mus musculus
agctctgtttattggcctcaattat

SEQ ID NO: 180305 - DNA, 25 bp, Mus musculus
agctctgtttccaggattcaataac

SEQ ID NO: 180306 - DNA, 25 bp, Mus musculus
agctctgtttcctggattcaataac

SEQ ID NO: 180307 - DNA, 25 bp, Mus musculus
agctctgttttaagtttgcccttgg

SEQ ID NO: 180308 - DNA, 25 bp, Mus musculus
agctctgttttatgtttgcccttgg

SEQ ID NO: 180309 - DNA, 25 bp, Mus musculus
agctctgttttcaggaaatctgaca

SEQ ID NO: 180310 - DNA, 25 bp, Mus musculus
agctctgttttctggaaatctgaca

SEQ ID NO: 180311 - DNA, 25 bp, Mus musculus
agctcttaacgcagtgaccaaagat

SEQ ID NO: 180312 - DNA, 25 bp, Mus musculus
agctcttaacgctgtgaccaaagat

SEQ ID NO: 180313 - DNA, 25 bp, Mus musculus
agctcttaagctcttctatcaaata

SEQ ID NO: 180314 - DNA, 25 bp, Mus musculus
agctcttaagctgttctatcaaata

SEQ ID NO: 180315 - DNA, 25 bp, Mus musculus
agctcttacagaagaaccgacaggc

SEQ ID NO: 180316 - DNA, 25 bp, Mus musculus
agctcttacagatgaaccgacaggc

SEQ ID NO: 180317 - DNA, 25 bp, Mus musculus
agctcttacagtcttttcacggcaa

SEQ ID NO: 180318 - DNA, 25 bp, Mus musculus
agctcttacagtgttttcacggcaa

SEQ ID NO: 180319 - DNA, 25 bp, Mus musculus
agctcttacctgcagggtcttacca

SEQ ID NO: 180320 - DNA, 25 bp, Mus musculus
agctcttacctggagggtcttacca

SEQ ID NO: 180321 - DNA, 25 bp, Mus musculus
agctcttacttgactactccaatta

SEQ ID NO: 180322 - DNA, 25 bp, Mus musculus
agctcttacttgatttgacttgaat

SEQ ID NO: 180323 - DNA, 25 bp, Mus musculus
agctcttacttgtctactccaatta

SEQ ID NO: 180324 - DNA, 25 bp, Mus musculus
agctcttacttgttttgacttgaat

SEQ ID NO: 180325 - DNA, 25 bp, Mus musculus
agctcttagcccattttgatcaatg

SEQ ID NO: 180326 - DNA, 25 bp, Mus musculus
agctcttagccctttttgatcaatg

SEQ ID NO: 180327 - DNA, 25 bp, Mus musculus
agctcttagccgctggtgatgctaa

SEQ ID NO: 180328 - DNA, 25 bp, Mus musculus
agctcttagccggtggtgatgctaa

SEQ ID NO: 180329 - DNA, 25 bp, Mus musculus
agctcttagcctatctatgaaccgt

SEQ ID NO: 180330 - DNA, 25 bp, Mus musculus
agctcttagcctttctatgaaccgt

SEQ ID NO: 180331 - DNA, 25 bp, Mus musculus
agctcttagctgatccaaatgctgt

SEQ ID NO: 180332 - DNA, 25 bp, Mus musculus
agctcttagctgttccaaatgctgt

SEQ ID NO: 180333 - DNA, 25 bp, Mus musculus
agctcttaggaacctgacacccact

SEQ ID NO: 180334 - DNA, 25 bp, Mus musculus
agctcttaggaagctgacacccact

SEQ ID NO: 180335 - DNA, 25 bp, Mus musculus
agctcttagtacctgctagttgcaa

SEQ ID NO: 180336 - DNA, 25 bp, Mus musculus
agctcttagtacgtgctagttgcaa

SEQ ID NO: 180337 - DNA, 25 bp, Mus musculus
agctcttatattcagatttcctggg

SEQ ID NO: 180338 - DNA, 25 bp, Mus musculus
agctcttatattgagatttcctggg

SEQ ID NO: 180339 - DNA, 25 bp, Mus musculus
agctcttcaagtccacagccaagaa

SEQ ID NO: 180340 - DNA, 25 bp, Mus musculus
agctcttcaagtgcacagccaagaa

SEQ ID NO: 180341 - DNA, 25 bp, Mus musculus
agctcttcaatcagggctgcgtagg

SEQ ID NO: 180342 - DNA, 25 bp, Mus musculus
agctcttcaatctgggctgcgtagg

SEQ ID NO: 180343 - DNA, 25 bp, Mus musculus
agctcttcacacctagaaggcacct

SEQ ID NO: 180344 - DNA, 25 bp, Mus musculus
agctcttcacacgtagaaggcacct

SEQ ID NO: 180345 - DNA, 25 bp, Mus musculus
agctcttcacagatcaatcccaatc

SEQ ID NO: 180346 - DNA, 25 bp, Mus musculus
agctcttcacagttcaatcccaatc

SEQ ID NO: 180347 - DNA, 25 bp, Mus musculus
agctcttcacctctgatatcagcag

SEQ ID NO: 180348 - DNA, 25 bp, Mus musculus
agctcttcacctgtgatatcagcag

SEQ ID NO: 180349 - DNA, 25 bp, Mus musculus
agctcttcagagaccgtgaggtcgt

SEQ ID NO: 180350 - DNA, 25 bp, Mus musculus
agctcttcagagcaagcacagtact

SEQ ID NO: 180351 - DNA, 25 bp, Mus musculus
agctcttcagaggaagcacagtact

SEQ ID NO: 180352 - DNA, 25 bp, Mus musculus
agctcttcagagtccgtgaggtcgt

SEQ ID NO: 180353 - DNA, 25 bp, Mus musculus
agctcttcagttcgttgtctttccc

SEQ ID NO: 180354 - DNA, 25 bp, Mus musculus
agctcttcagttggttgtctttccc

SEQ ID NO: 180355 - DNA, 25 bp, Mus musculus
agctcttcataaagctgtgtgtgca

SEQ ID NO: 180356 - DNA, 25 bp, Mus musculus
agctcttcataatgctgtgtgtgca

SEQ ID NO: 180357 - DNA, 25 bp, Mus musculus
agctcttccaaaatgtctggcattg

SEQ ID NO: 180358 - DNA, 25 bp, Mus musculus
agctcttccaaattgtctggcattg

SEQ ID NO: 180359 - DNA, 25 bp, Mus musculus
agctcttccaccatggaacgtggga

SEQ ID NO: 180360 - DNA, 25 bp, Mus musculus
agctcttccaccttggaacgtggga

SEQ ID NO: 180361 - DNA, 25 bp, Mus musculus
agctcttccagacagccgtggaggc

SEQ ID NO: 180362 - DNA, 25 bp, Mus musculus
agctcttccagagagccgtggaggc

SEQ ID NO: 180363 - DNA, 25 bp, Mus musculus
agctcttccaggcacagattctctt

SEQ ID NO: 180364 - DNA, 25 bp, Mus musculus
agctcttccagggacagattctctt

SEQ ID NO: 180365 - DNA, 25 bp, Mus musculus
agctcttcccatcagccagtccaca

SEQ ID NO: 180366 - DNA, 25 bp, Mus musculus
agctcttcccatcggtatccagact

SEQ ID NO: 180367 - DNA, 25 bp, Mus musculus
agctcttcccatgagccagtccaca

SEQ ID NO: 180368 - DNA, 25 bp, Mus musculus
agctcttcccatgggtatccagact

SEQ ID NO: 180369 - DNA, 25 bp, Mus musculus
agctcttccccactgtgatcaggat

SEQ ID NO: 180370 - DNA, 25 bp, Mus musculus
agctcttccccagtgtgatcaggat

SEQ ID NO: 180371 - DNA, 25 bp, Mus musculus
agctcttccgccacaagcagggaga

SEQ ID NO: 180372 - DNA, 25 bp, Mus musculus
agctcttccgcctcaagcagggaga

SEQ ID NO: 180373 - DNA, 25 bp, Mus musculus
agctcttcctccattgtaaagacat

SEQ ID NO: 180374 - DNA, 25 bp, Mus musculus
agctcttcctcctttgtaaagacat

SEQ ID NO: 180375 - DNA, 25 bp, Mus musculus
agctcttcggctctacttgtcttga

SEQ ID NO: 180376 - DNA, 25 bp, Mus musculus
agctcttcggctgtacttgtcttga

SEQ ID NO: 180377 - DNA, 25 bp, Mus musculus
agctcttcgttgaagcttcagcaat

SEQ ID NO: 180378 - DNA, 25 bp, Mus musculus
agctcttcgttgtagcttcagcaat

SEQ ID NO: 180379 - DNA, 25 bp, Mus musculus
agctcttctaaaatgccagacttcc

SEQ ID NO: 180380 - DNA, 25 bp, Mus musculus
agctcttctaaattgccagacttcc

SEQ ID NO: 180381 - DNA, 25 bp, Mus musculus
agctcttctatgctcagtaccacac

SEQ ID NO: 180382 - DNA, 25 bp, Mus musculus
agctcttctatggtcagtaccacac

SEQ ID NO: 180383 - DNA, 25 bp, Mus musculus
agctcttctcccattggaagacacc

SEQ ID NO: 180384 - DNA, 25 bp, Mus musculus
agctcttctccctttggaagacacc

SEQ ID NO: 180385 - DNA, 25 bp, Mus musculus
agctcttctgaaataatggatcgtt

SEQ ID NO: 180386 - DNA, 25 bp, Mus musculus
agctcttctgaattaatggatcgtt

SEQ ID NO: 180387 - DNA, 25 bp, Mus musculus
agctcttctgagaagacactggtca

SEQ ID NO: 180388 - DNA, 25 bp, Mus musculus
agctcttctgagtagacactggtca

SEQ ID NO: 180389 - DNA, 25 bp, Mus musculus
agctcttctgtaactccatgtgttt

SEQ ID NO: 180390 - DNA, 25 bp, Mus musculus
agctcttctgtatctccatgtgttt

SEQ ID NO: 180391 - DNA, 25 bp, Mus musculus
agctcttcttccaggtaggttgcag

SEQ ID NO: 180392 - DNA, 25 bp, Mus musculus
agctcttcttcctggtaggttgcag

SEQ ID NO: 180393 - DNA, 25 bp, Mus musculus
agctcttcttgtcggtgtggtccct

SEQ ID NO: 180394 - DNA, 25 bp, Mus musculus
agctcttcttgtgggtgtggtccct

SEQ ID NO: 180395 - DNA, 25 bp, Mus musculus
agctcttctttcaacttatatgtcc

SEQ ID NO: 180396 - DNA, 25 bp, Mus musculus
agctcttctttctacttatatgtcc

SEQ ID NO: 180397 - DNA, 25 bp, Mus musculus
agctcttctttgatttggcagttac

SEQ ID NO: 180398 - DNA, 25 bp, Mus musculus
agctcttctttgttttggcagttac

SEQ ID NO: 180399 - DNA, 25 bp, Mus musculus
agctcttcttttcaggtttcctgtt

SEQ ID NO: 180400 - DNA, 25 bp, Mus musculus
agctcttcttttgaggtttcctgtt

SEQ ID NO: 180401 - DNA, 25 bp, Mus musculus
agctcttgagaaaggtacatgacca

SEQ ID NO: 180402 - DNA, 25 bp, Mus musculus
agctcttgagaaatgcatccttgta

SEQ ID NO: 180403 - DNA, 25 bp, Mus musculus
agctcttgagaatggtacatgacca

SEQ ID NO: 180404 - DNA, 25 bp, Mus musculus
agctcttgagaattgcatccttgta

SEQ ID NO: 180405 - DNA, 25 bp, Mus musculus
agctcttgagagatggcagtaccat

SEQ ID NO: 180406 - DNA, 25 bp, Mus musculus
agctcttgagagttggcagtaccat

SEQ ID NO: 180407 - DNA, 25 bp, Mus musculus
agctcttgagctatgtttcctattt

SEQ ID NO: 180408 - DNA, 25 bp, Mus musculus
agctcttgagctttgtttcctattt

SEQ ID NO: 180409 - DNA, 25 bp, Mus musculus
agctcttgcatgactgctgtagtgt

SEQ ID NO: 180410 - DNA, 25 bp, Mus musculus
agctcttgcatgtctgctgtagtgt

SEQ ID NO: 180411 - DNA, 25 bp, Mus musculus
agctcttgccgcagcgagggcagaa

SEQ ID NO: 180412 - DNA, 25 bp, Mus musculus
agctcttgccgctgcgagggcagaa

SEQ ID NO: 180413 - DNA, 25 bp, Mus musculus
agctcttgcctcaacaggagagaga

SEQ ID NO: 180414 - DNA, 25 bp, Mus musculus
agctcttgcctctacaggagagaga

SEQ ID NO: 180415 - DNA, 25 bp, Mus musculus
agctcttgccttatggaaacgtgtc

SEQ ID NO: 180416 - DNA, 25 bp, Mus musculus
agctcttgccttttggaaacgtgtc

SEQ ID NO: 180417 - DNA, 25 bp, Mus musculus
agctcttgctaaatcagattccatg

SEQ ID NO: 180418 - DNA, 25 bp, Mus musculus
agctcttgctaattcagattccatg

SEQ ID NO: 180419 - DNA, 25 bp, Mus musculus
agctcttgctcgctctgggatgaag

SEQ ID NO: 180420 - DNA, 25 bp, Mus musculus
agctcttgctcggtctgggatgaag

SEQ ID NO: 180421 - DNA, 25 bp, Mus musculus
agctcttgctgtagggtagtatctg

SEQ ID NO: 180422 - DNA, 25 bp, Mus musculus
agctcttgctgttgggtagtatctg

SEQ ID NO: 180423 - DNA, 25 bp, Mus musculus
agctcttgcttcaaggacaccagat

SEQ ID NO: 180424 - DNA, 25 bp, Mus musculus
agctcttgcttctaggacaccagat

SEQ ID NO: 180425 - DNA, 25 bp, Mus musculus
agctcttggagacgcactgatgaca

SEQ ID NO: 180426 - DNA, 25 bp, Mus musculus
agctcttggagaggcactgatgaca

SEQ ID NO: 180427 - DNA, 25 bp, Mus musculus
agctcttggcgaaatcttcgcgctt

SEQ ID NO: 180428 - DNA, 25 bp, Mus musculus
agctcttggcgatatcttcgcgctt

SEQ ID NO: 180429 - DNA, 25 bp, Mus musculus
agctcttggctactactctggctgg

SEQ ID NO: 180430 - DNA, 25 bp, Mus musculus
agctcttggctagtactctggctgg

SEQ ID NO: 180431 - DNA, 25 bp, Mus musculus
agctcttgggacattcaacaccttt

SEQ ID NO: 180432 - DNA, 25 bp, Mus musculus
agctcttgggactttcaacaccttt

SEQ ID NO: 180433 - DNA, 25 bp, Mus musculus
agctcttgggctcgtgtgcttttca

SEQ ID NO: 180434 - DNA, 25 bp, Mus musculus
agctcttgggctggtgtgcttttca

SEQ ID NO: 180435 - DNA, 25 bp, Mus musculus
agctcttggtctacagttgcccaca

SEQ ID NO: 180436 - DNA, 25 bp, Mus musculus
agctcttggtcttcagttgcccaca

SEQ ID NO: 180437 - DNA, 25 bp, Mus musculus
agctcttggtgcagcttatagaaat

SEQ ID NO: 180438 - DNA, 25 bp, Mus musculus
agctcttggtgctgcttatagaaat

SEQ ID NO: 180439 - DNA, 25 bp, Mus musculus
agctcttgtatcagtgaactttcat

SEQ ID NO: 180440 - DNA, 25 bp, Mus musculus
agctcttgtatctgtgaactttcat

SEQ ID NO: 180441 - DNA, 25 bp, Mus musculus
agctcttgtcagctaatctttcttt

SEQ ID NO: 180442 - DNA, 25 bp, Mus musculus
agctcttgtcaggtaatctttcttt

SEQ ID NO: 180443 - DNA, 25 bp, Mus musculus
agctcttgtcttccctttggagaag

SEQ ID NO: 180444 - DNA, 25 bp, Mus musculus
agctcttgtcttgcctttggagaag

SEQ ID NO: 180445 - DNA, 25 bp, Mus musculus
agctcttgtgaacggcttggtcatc

SEQ ID NO: 180446 - DNA, 25 bp, Mus musculus
agctcttgtgaagggcttggtcatc

SEQ ID NO: 180447 - DNA, 25 bp, Mus musculus
agctcttgtgacattcaaacttggt

SEQ ID NO: 180448 - DNA, 25 bp, Mus musculus
agctcttgtgactttcaaacttggt

SEQ ID NO: 180449 - DNA, 25 bp, Mus musculus
agctcttgtgagaatgaacgttttc

SEQ ID NO: 180450 - DNA, 25 bp, Mus musculus
agctcttgtgagtatgaacgttttc

SEQ ID NO: 180451 - DNA, 25 bp, Mus musculus
agctctttaaagacctcagtgtttg

SEQ ID NO: 180452 - DNA, 25 bp, Mus musculus
agctctttaaagtcctcagtgtttg

SEQ ID NO: 180453 - DNA, 25 bp, Mus musculus
agctctttacctaaggactctcagt

SEQ ID NO: 180454 - DNA, 25 bp, Mus musculus
agctctttaccttaggactctcagt

SEQ ID NO: 180455 - DNA, 25 bp, Mus musculus
agctctttactgaccatggcctaga

SEQ ID NO: 180456 - DNA, 25 bp, Mus musculus
agctctttactgtccatggcctaga

SEQ ID NO: 180457 - DNA, 25 bp, Mus musculus
agctctttagctccgtaggtgaatt

SEQ ID NO: 180458 - DNA, 25 bp, Mus musculus
agctctttagctgcgtaggtgaatt

SEQ ID NO: 180459 - DNA, 25 bp, Mus musculus
agctctttattcctcttatctgtaa

SEQ ID NO: 180460 - DNA, 25 bp, Mus musculus
agctctttattcgtcttatctgtaa

SEQ ID NO: 180461 - DNA, 25 bp, Mus musculus
agctctttcacactgtcctgtgtat

SEQ ID NO: 180462 - DNA, 25 bp, Mus musculus
agctctttcacagtgtcctgtgtat

SEQ ID NO: 180463 - DNA, 25 bp, Mus musculus
agctctttccataaatttctctccg

SEQ ID NO: 180464 - DNA, 25 bp, Mus musculus
agctctttccattaatttctctccg

SEQ ID NO: 180465 - DNA, 25 bp, Mus musculus
agctctttccctcagtctgatttca

SEQ ID NO: 180466 - DNA, 25 bp, Mus musculus
agctctttccctgagtctgatttca

SEQ ID NO: 180467 - DNA, 25 bp, Mus musculus
agctctttccttcaatgctggctcc

SEQ ID NO: 180468 - DNA, 25 bp, Mus musculus
agctctttccttgaatgctggctcc

SEQ ID NO: 180469 - DNA, 25 bp, Mus musculus
agctctttcgcacaaacgcgctggg

SEQ ID NO: 180470 - DNA, 25 bp, Mus musculus
agctctttcgcagaaacgcgctggg

SEQ ID NO: 180471 - DNA, 25 bp, Mus musculus
agctctttctggataggtcactttc

SEQ ID NO: 180472 - DNA, 25 bp, Mus musculus
agctctttctggttaggtcactttc

SEQ ID NO: 180473 - DNA, 25 bp, Mus musculus
agctctttcttgctagtcctttagt

SEQ ID NO: 180474 - DNA, 25 bp, Mus musculus
agctctttcttggtagtcctttagt

SEQ ID NO: 180475 - DNA, 25 bp, Mus musculus
agctctttgaatcaactttttcttg

SEQ ID NO: 180476 - DNA, 25 bp, Mus musculus
agctctttgaatcctgtcatctaca

SEQ ID NO: 180477 - DNA, 25 bp, Mus musculus
agctctttgaatgaactttttcttg

SEQ ID NO: 180478 - DNA, 25 bp, Mus musculus
agctctttgaatgctgtcatctaca

SEQ ID NO: 180479 - DNA, 25 bp, Mus musculus
agctctttgacaccttagtaaattt

SEQ ID NO: 180480 - DNA, 25 bp, Mus musculus
agctctttgacagcttagtaaattt

SEQ ID NO: 180481 - DNA, 25 bp, Mus musculus
agctctttgagccttggttggtcga

SEQ ID NO: 180482 - DNA, 25 bp, Mus musculus
agctctttgagcgttggttggtcga

SEQ ID NO: 180483 - DNA, 25 bp, Mus musculus
agctctttgctaagttactccacta

SEQ ID NO: 180484 - DNA, 25 bp, Mus musculus
agctctttgctatgttactccacta

SEQ ID NO: 180485 - DNA, 25 bp, Mus musculus
agctctttgcttcttccctggatat

SEQ ID NO: 180486 - DNA, 25 bp, Mus musculus
agctctttgcttctttctttcatta

SEQ ID NO: 180487 - DNA, 25 bp, Mus musculus
agctctttgcttgttccctggatat

SEQ ID NO: 180488 - DNA, 25 bp, Mus musculus
agctctttgcttgtttctttcatta

SEQ ID NO: 180489 - DNA, 25 bp, Mus musculus
agctctttggagcaagtcatcagtt

SEQ ID NO: 180490 - DNA, 25 bp, Mus musculus
agctctttggaggaagtcatcagtt

SEQ ID NO: 180491 - DNA, 25 bp, Mus musculus
agctctttggtgaagtgttttctct

SEQ ID NO: 180492 - DNA, 25 bp, Mus musculus
agctctttggtgtagtgttttctct

SEQ ID NO: 180493 - DNA, 25 bp, Mus musculus
agctctttgtctcattgcttaatga

SEQ ID NO: 180494 - DNA, 25 bp, Mus musculus
agctctttgtctgattgcttaatga

SEQ ID NO: 180495 - DNA, 25 bp, Mus musculus
agctctttgttcagtgtgcactttc

SEQ ID NO: 180496 - DNA, 25 bp, Mus musculus
agctctttgttctgtgtgcactttc

SEQ ID NO: 180497 - DNA, 25 bp, Mus musculus
agctctttgttgctgtgtaactgtc

SEQ ID NO: 180498 - DNA, 25 bp, Mus musculus
agctctttgttggtgtgtaactgtc

SEQ ID NO: 180499 - DNA, 25 bp, Mus musculus
agctcttttagcagatactgctcat

SEQ ID NO: 180500 - DNA, 25 bp, Mus musculus
agctcttttagctgatactgctcat

SEQ ID NO: 180501 - DNA, 25 bp, Mus musculus
agctcttttcagcttgtttcaaaaa

SEQ ID NO: 180502 - DNA, 25 bp, Mus musculus
agctcttttcaggttgtttcaaaaa

SEQ ID NO: 180503 - DNA, 25 bp, Mus musculus
agctctttttagaacgtccttccag

SEQ ID NO: 180504 - DNA, 25 bp, Mus musculus
agctctttttagtacgtccttccag

SEQ ID NO: 180505 - DNA, 25 bp, Mus musculus
agctgaaaaggtacctgcccagcct

SEQ ID NO: 180506 - DNA, 25 bp, Mus musculus
agctgaaaaggttcctgcccagcct

SEQ ID NO: 180507 - DNA, 25 bp, Mus musculus
agctgaaacaccactcatctataag

SEQ ID NO: 180508 - DNA, 25 bp, Mus musculus
agctgaaacacctctcatctataag

SEQ ID NO: 180509 - DNA, 25 bp, Mus musculus
agctgaaaccaactgccactccttg

SEQ ID NO: 180510 - DNA, 25 bp, Mus musculus
agctgaaaccaagtgccactccttg

SEQ ID NO: 180511 - DNA, 25 bp, Mus musculus
agctgaaagggcctgtctctctaca

SEQ ID NO: 180512 - DNA, 25 bp, Mus musculus
agctgaaagggcgtgtctctctaca

SEQ ID NO: 180513 - DNA, 25 bp, Mus musculus
agctgaaagtagcagaccggatctt

SEQ ID NO: 180514 - DNA, 25 bp, Mus musculus
agctgaaagtaggagaccggatctt

SEQ ID NO: 180515 - DNA, 25 bp, Mus musculus
agctgaaatcataactagccaatag

SEQ ID NO: 180516 - DNA, 25 bp, Mus musculus
agctgaaatcattactagccaatag

SEQ ID NO: 180517 - DNA, 25 bp, Mus musculus
agctgaacaaatctagcctggcttc

SEQ ID NO: 180518 - DNA, 25 bp, Mus musculus
agctgaacaaatgtagcctggcttc

SEQ ID NO: 180519 - DNA, 25 bp, Mus musculus
agctgaacaagtctctgcgcgccaa

SEQ ID NO: 180520 - DNA, 25 bp, Mus musculus
agctgaacaagtgtctgcgcgccaa

SEQ ID NO: 180521 - DNA, 25 bp, Mus musculus
agctgaacaattcaacggcgctgaa

SEQ ID NO: 180522 - DNA, 25 bp, Mus musculus
agctgaacaattgaacggcgctgaa

SEQ ID NO: 180523 - DNA, 25 bp, Mus musculus
agctgaacactaactcggacatgaa

SEQ ID NO: 180524 - DNA, 25 bp, Mus musculus
agctgaacactatctcggacatgaa

SEQ ID NO: 180525 - DNA, 25 bp, Mus musculus
agctgaaccaagactcctgataaat

SEQ ID NO: 180526 - DNA, 25 bp, Mus musculus
agctgaaccaagtctcctgataaat

SEQ ID NO: 180527 - DNA, 25 bp, Mus musculus
agctgaaccgggaatctgtgcgcgc

SEQ ID NO: 180528 - DNA, 25 bp, Mus musculus
agctgaaccgggtatctgtgcgcgc

SEQ ID NO: 180529 - DNA, 25 bp, Mus musculus
agctgaacctgtctccctgcatgag

SEQ ID NO: 180530 - DNA, 25 bp, Mus musculus
agctgaacctgtgtccctgcatgag

SEQ ID NO: 180531 - DNA, 25 bp, Mus musculus
agctgaacgcgcctatgtagtgaca

SEQ ID NO: 180532 - DNA, 25 bp, Mus musculus
agctgaacgcgcgtatgtagtgaca

SEQ ID NO: 180533 - DNA, 25 bp, Mus musculus
agctgaacgtataactgcctgctgc

SEQ ID NO: 180534 - DNA, 25 bp, Mus musculus
agctgaacgtattactgcctgctgc

SEQ ID NO: 180535 - DNA, 25 bp, Mus musculus
agctgaactatgcttcctctgtgct

SEQ ID NO: 180536 - DNA, 25 bp, Mus musculus
agctgaactatggttcctctgtgct

SEQ ID NO: 180537 - DNA, 25 bp, Mus musculus
agctgaactcccctgtccatggtgg

SEQ ID NO: 180538 - DNA, 25 bp, Mus musculus
agctgaactcccgtgtccatggtgg

SEQ ID NO: 180539 - DNA, 25 bp, Mus musculus
agctgaactctacattttttggtaa

SEQ ID NO: 180540 - DNA, 25 bp, Mus musculus
agctgaactctagattttttggtaa

SEQ ID NO: 180541 - DNA, 25 bp, Mus musculus
agctgaactcttatggaggacaaga

SEQ ID NO: 180542 - DNA, 25 bp, Mus musculus
agctgaactcttttggaggacaaga

SEQ ID NO: 180543 - DNA, 25 bp, Mus musculus
agctgaactgataagctccagtcta

SEQ ID NO: 180544 - DNA, 25 bp, Mus musculus
agctgaactgatatccactttggga

SEQ ID NO: 180545 - DNA, 25 bp, Mus musculus
agctgaactgattagctccagtcta

SEQ ID NO: 180546 - DNA, 25 bp, Mus musculus
agctgaactgatttccactttggga

SEQ ID NO: 180547 - DNA, 25 bp, Mus musculus
agctgaactggaacatcgtctcctt

SEQ ID NO: 180548 - DNA, 25 bp, Mus musculus
agctgaactggatcatcgtctcctt

SEQ ID NO: 180549 - DNA, 25 bp, Mus musculus
agctgaacttcaactaccaagagga

SEQ ID NO: 180550 - DNA, 25 bp, Mus musculus
agctgaacttcatctaccaagagga

SEQ ID NO: 180551 - DNA, 25 bp, Mus musculus
agctgaactttaattgtgggtcttt

SEQ ID NO: 180552 - DNA, 25 bp, Mus musculus
agctgaactttatttgtgggtcttt

SEQ ID NO: 180553 - DNA, 25 bp, Mus musculus
agctgaactttcctcatgatttttt

SEQ ID NO: 180554 - DNA, 25 bp, Mus musculus
agctgaactttcgtcatgatttttt

SEQ ID NO: 180555 - DNA, 25 bp, Mus musculus
agctgaagaagtagcccctgactga

SEQ ID NO: 180556 - DNA, 25 bp, Mus musculus
agctgaagaagttgcccctgactga

SEQ ID NO: 180557 - DNA, 25 bp, Mus musculus
agctgaagacaaattgcagtgactt

SEQ ID NO: 180558 - DNA, 25 bp, Mus musculus
agctgaagacaatttgcagtgactt

SEQ ID NO: 180559 - DNA, 25 bp, Mus musculus
agctgaagacagatgccatcctgga

SEQ ID NO: 180560 - DNA, 25 bp, Mus musculus
agctgaagacagttgccatcctgga

SEQ ID NO: 180561 - DNA, 25 bp, Mus musculus
agctgaagagcaagtccagagcctt

SEQ ID NO: 180562 - DNA, 25 bp, Mus musculus
agctgaagagcatgtccagagcctt

SEQ ID NO: 180563 - DNA, 25 bp, Mus musculus
agctgaagcagaatgtcccatctct

SEQ ID NO: 180564 - DNA, 25 bp, Mus musculus
agctgaagcagattgtcccatctct

SEQ ID NO: 180565 - DNA, 25 bp, Mus musculus
agctgaagctttaattaatgatctc

SEQ ID NO: 180566 - DNA, 25 bp, Mus musculus
agctgaagcttttattaatgatctc

SEQ ID NO: 180567 - DNA, 25 bp, Mus musculus
agctgaaggacgatgaggtcgctca

SEQ ID NO: 180568 - DNA, 25 bp, Mus musculus
agctgaaggacgttgaggtcgctca

SEQ ID NO: 180569 - DNA, 25 bp, Mus musculus
agctgaaggccaactgagacatcca

SEQ ID NO: 180570 - DNA, 25 bp, Mus musculus
agctgaaggccatctgagacatcca

SEQ ID NO: 180571 - DNA, 25 bp, Mus musculus
agctgaaggctgataccgcactgta

SEQ ID NO: 180572 - DNA, 25 bp, Mus musculus
agctgaaggctgttaccgcactgta

SEQ ID NO: 180573 - DNA, 25 bp, Mus musculus
agctgaagggctagtcacacgtcaa

SEQ ID NO: 180574 - DNA, 25 bp, Mus musculus
agctgaagggcttgtcacacgtcaa

SEQ ID NO: 180575 - DNA, 25 bp, Mus musculus
agctgaaggtgcacgactgtgccat

SEQ ID NO: 180576 - DNA, 25 bp, Mus musculus
agctgaaggtgctcgactgtgccat

SEQ ID NO: 180577 - DNA, 25 bp, Mus musculus
agctgaagtactcgcctgccacttt

SEQ ID NO: 180578 - DNA, 25 bp, Mus musculus
agctgaagtactggcctgccacttt

SEQ ID NO: 180579 - DNA, 25 bp, Mus musculus
agctgaatcaatcagccccaggttc

SEQ ID NO: 180580 - DNA, 25 bp, Mus musculus
agctgaatcaatgagccccaggttc

SEQ ID NO: 180581 - DNA, 25 bp, Mus musculus
agctgaatcagacctcgtccggtgc

SEQ ID NO: 180582 - DNA, 25 bp, Mus musculus
agctgaatcagagctcgtccggtgc

SEQ ID NO: 180583 - DNA, 25 bp, Mus musculus
agctgaatgcacagaagcccagcag

SEQ ID NO: 180584 - DNA, 25 bp, Mus musculus
agctgaatgcactgaagcccagcag

SEQ ID NO: 180585 - DNA, 25 bp, Mus musculus
agctgaatgggcataggccctactt

SEQ ID NO: 180586 - DNA, 25 bp, Mus musculus
agctgaatgggcttaggccctactt

SEQ ID NO: 180587 - DNA, 25 bp, Mus musculus
agctgaatgtccctggcaccagaga

SEQ ID NO: 180588 - DNA, 25 bp, Mus musculus
agctgaatgtccgtggcaccagaga

SEQ ID NO: 180589 - DNA, 25 bp, Mus musculus
agctgaatgtttatctaaaggagtt

SEQ ID NO: 180590 - DNA, 25 bp, Mus musculus
agctgaatgtttttctaaaggagtt

SEQ ID NO: 180591 - DNA, 25 bp, Mus musculus
agctgaattcagaccgtgtgggaaa

SEQ ID NO: 180592 - DNA, 25 bp, Mus musculus
agctgaattcagcagaagactaagt

SEQ ID NO: 180593 - DNA, 25 bp, Mus musculus
agctgaattcaggagaagactaagt

SEQ ID NO: 180594 - DNA, 25 bp, Mus musculus
agctgaattcagtccgtgtgggaaa

SEQ ID NO: 180595 - DNA, 25 bp, Mus musculus
agctgaattgctacggtttttaata

SEQ ID NO: 180596 - DNA, 25 bp, Mus musculus
agctgaattgcttcggtttttaata

SEQ ID NO: 180597 - DNA, 25 bp, Mus musculus
agctgaatttgaaccttccatccat

SEQ ID NO: 180598 - DNA, 25 bp, Mus musculus
agctgaatttgatccttccatccat

SEQ ID NO: 180599 - DNA, 25 bp, Mus musculus
agctgaatttggcagctttagccaa

SEQ ID NO: 180600 - DNA, 25 bp, Mus musculus
agctgaatttgggagctttagccaa

SEQ ID NO: 180601 - DNA, 25 bp, Mus musculus
agctgacaaaggagaactgatcaaa

SEQ ID NO: 180602 - DNA, 25 bp, Mus musculus
agctgacaaaggtgaactgatcaaa

SEQ ID NO: 180603 - DNA, 25 bp, Mus musculus
agctgacaaatcagcggcttggctt

SEQ ID NO: 180604 - DNA, 25 bp, Mus musculus
agctgacaaatctgcggcttggctt

SEQ ID NO: 180605 - DNA, 25 bp, Mus musculus
agctgacaacctcctgtaattctag

SEQ ID NO: 180606 - DNA, 25 bp, Mus musculus
agctgacaacctgctgtaattctag

SEQ ID NO: 180607 - DNA, 25 bp, Mus musculus
agctgacaagacatcaatggagttt

SEQ ID NO: 180608 - DNA, 25 bp, Mus musculus
agctgacaagacttcaatggagttt

SEQ ID NO: 180609 - DNA, 25 bp, Mus musculus
agctgacaatctctcgaattggcga

SEQ ID NO: 180610 - DNA, 25 bp, Mus musculus
agctgacaatctgtcgaattggcga

SEQ ID NO: 180611 - DNA, 25 bp, Mus musculus
agctgacacccaatgactctatagt

SEQ ID NO: 180612 - DNA, 25 bp, Mus musculus
agctgacacccattgactctatagt

SEQ ID NO: 180613 - DNA, 25 bp, Mus musculus
agctgacacggaatgaaccctgcaa

SEQ ID NO: 180614 - DNA, 25 bp, Mus musculus
agctgacacggattgaaccctgcaa

SEQ ID NO: 180615 - DNA, 25 bp, Mus musculus
agctgacacgggagttggcttcttt

SEQ ID NO: 180616 - DNA, 25 bp, Mus musculus
agctgacacgggtgttggcttcttt

SEQ ID NO: 180617 - DNA, 25 bp, Mus musculus
agctgacactcacgacgtggtggaa

SEQ ID NO: 180618 - DNA, 25 bp, Mus musculus
agctgacactcaggacgtggtggaa

SEQ ID NO: 180619 - DNA, 25 bp, Mus musculus
agctgacagaacatgctgggtatca

SEQ ID NO: 180620 - DNA, 25 bp, Mus musculus
agctgacagaacttgctgggtatca

SEQ ID NO: 180621 - DNA, 25 bp, Mus musculus
agctgacagaatcgcccagagggca

SEQ ID NO: 180622 - DNA, 25 bp, Mus musculus
agctgacagaatggcccagagggca

SEQ ID NO: 180623 - DNA, 25 bp, Mus musculus
agctgacagaggctgcatccacacc

SEQ ID NO: 180624 - DNA, 25 bp, Mus musculus
agctgacagagggtgcatccacacc

SEQ ID NO: 180625 - DNA, 25 bp, Mus musculus
agctgacagagtcccctacagtgtt

SEQ ID NO: 180626 - DNA, 25 bp, Mus musculus
agctgacagagtgccctacagtgtt

SEQ ID NO: 180627 - DNA, 25 bp, Mus musculus
agctgacagcatcaaggtcctcctg

SEQ ID NO: 180628 - DNA, 25 bp, Mus musculus
agctgacagcatgaaggtcctcctg

SEQ ID NO: 180629 - DNA, 25 bp, Mus musculus
agctgacaggcaagaatgagatcac

SEQ ID NO: 180630 - DNA, 25 bp, Mus musculus
agctgacaggcatgaatgagatcac

SEQ ID NO: 180631 - DNA, 25 bp, Mus musculus
agctgacaggctctgaaatatggaa

SEQ ID NO: 180632 - DNA, 25 bp, Mus musculus
agctgacaggctgtgaaatatggaa

SEQ ID NO: 180633 - DNA, 25 bp, Mus musculus
agctgacagggtctgggtcactcat

SEQ ID NO: 180634 - DNA, 25 bp, Mus musculus
agctgacagggtgtgggtcactcat

SEQ ID NO: 180635 - DNA, 25 bp, Mus musculus
agctgacaggttagggttacatctc

SEQ ID NO: 180636 - DNA, 25 bp, Mus musculus
agctgacaggtttgggttacatctc

SEQ ID NO: 180637 - DNA, 25 bp, Mus musculus
agctgacagtcacccgagggttgca

SEQ ID NO: 180638 - DNA, 25 bp, Mus musculus
agctgacagtcagccgagggttgca

SEQ ID NO: 180639 - DNA, 25 bp, Mus musculus
agctgacagtccagatctcccagga

SEQ ID NO: 180640 - DNA, 25 bp, Mus musculus
agctgacagtcctgatctcccagga

SEQ ID NO: 180641 - DNA, 25 bp, Mus musculus
agctgacagtggctttgccttgatg

SEQ ID NO: 180642 - DNA, 25 bp, Mus musculus
agctgacagtgggtttgccttgatg

SEQ ID NO: 180643 - DNA, 25 bp, Mus musculus
agctgacagtgtccgcttcataaac

SEQ ID NO: 180644 - DNA, 25 bp, Mus musculus
agctgacagtgtgcgcttcataaac

SEQ ID NO: 180645 - DNA, 25 bp, Mus musculus
agctgacatcagctttcatctgtgt

SEQ ID NO: 180646 - DNA, 25 bp, Mus musculus
agctgacatcaggtttcatctgtgt

SEQ ID NO: 180647 - DNA, 25 bp, Mus musculus
agctgacattaccagcctcatggac

SEQ ID NO: 180648 - DNA, 25 bp, Mus musculus
agctgacattacgagcctcatggac

SEQ ID NO: 180649 - DNA, 25 bp, Mus musculus
agctgaccaacaagtaagcccttat

SEQ ID NO: 180650 - DNA, 25 bp, Mus musculus
agctgaccaacatgtaagcccttat

SEQ ID NO: 180651 - DNA, 25 bp, Mus musculus
agctgaccaaccacatacgaaccat

SEQ ID NO: 180652 - DNA, 25 bp, Mus musculus
agctgaccaaccctgttgcccttgg

SEQ ID NO: 180653 - DNA, 25 bp, Mus musculus
agctgaccaaccgtgttgcccttgg

SEQ ID NO: 180654 - DNA, 25 bp, Mus musculus
agctgaccaacctcatacgaaccat

SEQ ID NO: 180655 - DNA, 25 bp, Mus musculus
agctgaccaagcctctaggatgaga

SEQ ID NO: 180656 - DNA, 25 bp, Mus musculus
agctgaccaagcgtctaggatgaga

SEQ ID NO: 180657 - DNA, 25 bp, Mus musculus
agctgaccagccctttgagaatgga

SEQ ID NO: 180658 - DNA, 25 bp, Mus musculus
agctgaccagccgtttgagaatgga

SEQ ID NO: 180659 - DNA, 25 bp, Mus musculus
agctgaccagctagaatcacatatt

SEQ ID NO: 180660 - DNA, 25 bp, Mus musculus
agctgaccagcttgaatcacatatt

SEQ ID NO: 180661 - DNA, 25 bp, Mus musculus
agctgaccagttatctaagcctgaa

SEQ ID NO: 180662 - DNA, 25 bp, Mus musculus
agctgaccagttttctaagcctgaa

SEQ ID NO: 180663 - DNA, 25 bp, Mus musculus
agctgaccatacaggtggcttgcct

SEQ ID NO: 180664 - DNA, 25 bp, Mus musculus
agctgaccatactggtggcttgcct

SEQ ID NO: 180665 - DNA, 25 bp, Mus musculus
agctgaccatcgcagtgtctggatg

SEQ ID NO: 180666 - DNA, 25 bp, Mus musculus
agctgaccatcggagtgtctggatg

SEQ ID NO: 180667 - DNA, 25 bp, Mus musculus
agctgacccacacaggagtgcgtcc

SEQ ID NO: 180668 - DNA, 25 bp, Mus musculus
agctgacccacagaggagtgcgtcc

SEQ ID NO: 180669 - DNA, 25 bp, Mus musculus
agctgacccattacaagaccttagg

SEQ ID NO: 180670 - DNA, 25 bp, Mus musculus
agctgacccatttcaagaccttagg

SEQ ID NO: 180671 - DNA, 25 bp, Mus musculus
agctgaccccagatgatgaggacgt

SEQ ID NO: 180672 - DNA, 25 bp, Mus musculus
agctgaccccagttgatgaggacgt

SEQ ID NO: 180673 - DNA, 25 bp, Mus musculus
agctgaccccatactgaaagtctgg

SEQ ID NO: 180674 - DNA, 25 bp, Mus musculus
agctgaccccattctgaaagtctgg

SEQ ID NO: 180675 - DNA, 25 bp, Mus musculus
agctgaccctgaaccaagtgtgaag

SEQ ID NO: 180676 - DNA, 25 bp, Mus musculus
agctgaccctgatccaagtgtgaag

SEQ ID NO: 180677 - DNA, 25 bp, Mus musculus
agctgacctagcagagccattgctg

SEQ ID NO: 180678 - DNA, 25 bp, Mus musculus
agctgacctagctgagccattgctg

SEQ ID NO: 180679 - DNA, 25 bp, Mus musculus
agctgacctatgagttgctggacat

SEQ ID NO: 180680 - DNA, 25 bp, Mus musculus
agctgacctatgtgttgctggacat

SEQ ID NO: 180681 - DNA, 25 bp, Mus musculus
agctgacctcaaactgcctttaaaa

SEQ ID NO: 180682 - DNA, 25 bp, Mus musculus
agctgacctcaatctgcctttaaaa

SEQ ID NO: 180683 - DNA, 25 bp, Mus musculus
agctgacctgaaacccactggtaga

SEQ ID NO: 180684 - DNA, 25 bp, Mus musculus
agctgacctgaatcccactggtaga

SEQ ID NO: 180685 - DNA, 25 bp, Mus musculus
agctgacctggcacaagggactgtt

SEQ ID NO: 180686 - DNA, 25 bp, Mus musculus
agctgacctggctcaagggactgtt

SEQ ID NO: 180687 - DNA, 25 bp, Mus musculus
agctgaccttgcagcgtaacacgtt

SEQ ID NO: 180688 - DNA, 25 bp, Mus musculus
agctgaccttgctgcgtaacacgtt

SEQ ID NO: 180689 - DNA, 25 bp, Mus musculus
agctgacgagtcctcttcagggagt

SEQ ID NO: 180690 - DNA, 25 bp, Mus musculus
agctgacgagtcgtcttcagggagt

SEQ ID NO: 180691 - DNA, 25 bp, Mus musculus
agctgacggcggagaacgagcggct

SEQ ID NO: 180692 - DNA, 25 bp, Mus musculus
agctgacggcggtgaacgagcggct

SEQ ID NO: 180693 - DNA, 25 bp, Mus musculus
agctgacgtactcccgtgctgggca

SEQ ID NO: 180694 - DNA, 25 bp, Mus musculus
agctgacgtactgccgtgctgggca

SEQ ID NO: 180695 - DNA, 25 bp, Mus musculus
agctgacgtagaccccaaaacagga

SEQ ID NO: 180696 - DNA, 25 bp, Mus musculus
agctgacgtagagcccaaaacagga

SEQ ID NO: 180697 - DNA, 25 bp, Mus musculus
agctgacgtcagagttttctacggc

SEQ ID NO: 180698 - DNA, 25 bp, Mus musculus
agctgacgtcagtgttttctacggc

SEQ ID NO: 180699 - DNA, 25 bp, Mus musculus
agctgacgtctgagaggcccatcat

SEQ ID NO: 180700 - DNA, 25 bp, Mus musculus
agctgacgtctgtgaggcccatcat

SEQ ID NO: 180701 - DNA, 25 bp, Mus musculus
agctgacgtgtcacactctgtaaga

SEQ ID NO: 180702 - DNA, 25 bp, Mus musculus
agctgacgtgtctcactctgtaaga

SEQ ID NO: 180703 - DNA, 25 bp, Mus musculus
agctgactacagcacactacgtggt

SEQ ID NO: 180704 - DNA, 25 bp, Mus musculus
agctgactacaggacactacgtggt

SEQ ID NO: 180705 - DNA, 25 bp, Mus musculus
agctgactacgaaacccagaatcca

SEQ ID NO: 180706 - DNA, 25 bp, Mus musculus
agctgactacgatacccagaatcca

SEQ ID NO: 180707 - DNA, 25 bp, Mus musculus
agctgactatagctggttatccaaa

SEQ ID NO: 180708 - DNA, 25 bp, Mus musculus
agctgactataggtggttatccaaa

SEQ ID NO: 180709 - DNA, 25 bp, Mus musculus
agctgactattgactgagcactcat

SEQ ID NO: 180710 - DNA, 25 bp, Mus musculus
agctgactattgtctgagcactcat

SEQ ID NO: 180711 - DNA, 25 bp, Mus musculus
agctgactcaaacgttttacgcttt

SEQ ID NO: 180712 - DNA, 25 bp, Mus musculus
agctgactcaaaggttttacgcttt

SEQ ID NO: 180713 - DNA, 25 bp, Mus musculus
agctgactcagaccggacttatcct

SEQ ID NO: 180714 - DNA, 25 bp, Mus musculus
agctgactcagagcggacttatcct

SEQ ID NO: 180715 - DNA, 25 bp, Mus musculus
agctgactcagcagctaacagccaa

SEQ ID NO: 180716 - DNA, 25 bp, Mus musculus
agctgactcagctgctaacagccaa

SEQ ID NO: 180717 - DNA, 25 bp, Mus musculus
agctgactcaggaacagtaccctgc

SEQ ID NO: 180718 - DNA, 25 bp, Mus musculus
agctgactcaggtacagtaccctgc

SEQ ID NO: 180719 - DNA, 25 bp, Mus musculus
agctgactccatcctaacagatctg

SEQ ID NO: 180720 - DNA, 25 bp, Mus musculus
agctgactccatgctaacagatctg

SEQ ID NO: 180721 - DNA, 25 bp, Mus musculus
agctgactcctcctgtaagtttttt

SEQ ID NO: 180722 - DNA, 25 bp, Mus musculus
agctgactcctcgtgtaagtttttt

SEQ ID NO: 180723 - DNA, 25 bp, Mus musculus
agctgactcgtcctcattaactgtc

SEQ ID NO: 180724 - DNA, 25 bp, Mus musculus
agctgactcgtcgtcattaactgtc

SEQ ID NO: 180725 - DNA, 25 bp, Mus musculus
agctgactctacagcatttcaactt

SEQ ID NO: 180726 - DNA, 25 bp, Mus musculus
agctgactctactgcatttcaactt

SEQ ID NO: 180727 - DNA, 25 bp, Mus musculus
agctgactctctcctgggcaggaaa

SEQ ID NO: 180728 - DNA, 25 bp, Mus musculus
agctgactctctctccaggagatgc

SEQ ID NO: 180729 - DNA, 25 bp, Mus musculus
agctgactctctgctgggcaggaaa

SEQ ID NO: 180730 - DNA, 25 bp, Mus musculus
agctgactctctgtccaggagatgc

SEQ ID NO: 180731 - DNA, 25 bp, Mus musculus
agctgactgagcagtatcccttagt

SEQ ID NO: 180732 - DNA, 25 bp, Mus musculus
agctgactgagctgtatcccttagt

SEQ ID NO: 180733 - DNA, 25 bp, Mus musculus
agctgactgccacgctccagcatta

SEQ ID NO: 180734 - DNA, 25 bp, Mus musculus
agctgactgccaggctccagcatta

SEQ ID NO: 180735 - DNA, 25 bp, Mus musculus
agctgactgctaatggttgtgagag

SEQ ID NO: 180736 - DNA, 25 bp, Mus musculus
agctgactgctattggttgtgagag

SEQ ID NO: 180737 - DNA, 25 bp, Mus musculus
agctgactgctgaccctggtggaga

SEQ ID NO: 180738 - DNA, 25 bp, Mus musculus
agctgactgctgtccctggtggaga

SEQ ID NO: 180739 - DNA, 25 bp, Mus musculus
agctgactgcttctcctgttgaaat

SEQ ID NO: 180740 - DNA, 25 bp, Mus musculus
agctgactgcttgtcctgttgaaat

SEQ ID NO: 180741 - DNA, 25 bp, Mus musculus
agctgacttagccacctgtacacat

SEQ ID NO: 180742 - DNA, 25 bp, Mus musculus
agctgacttagcgacctgtacacat

SEQ ID NO: 180743 - DNA, 25 bp, Mus musculus
agctgacttcaaacctagcccaggt

SEQ ID NO: 180744 - DNA, 25 bp, Mus musculus
agctgacttcaactaactctatgtc

SEQ ID NO: 180745 - DNA, 25 bp, Mus musculus
agctgacttcaagtaactctatgtc

SEQ ID NO: 180746 - DNA, 25 bp, Mus musculus
agctgacttcaatcctagcccaggt

SEQ ID NO: 180747 - DNA, 25 bp, Mus musculus
agctgacttcagcacacttttgaaa

SEQ ID NO: 180748 - DNA, 25 bp, Mus musculus
agctgacttcaggacacttttgaaa

SEQ ID NO: 180749 - DNA, 25 bp, Mus musculus
agctgacttccaaaaggtcctgcag

SEQ ID NO: 180750 - DNA, 25 bp, Mus musculus
agctgacttccataaggtcctgcag

SEQ ID NO: 180751 - DNA, 25 bp, Mus musculus
agctgacttcttcctataatgtaaa

SEQ ID NO: 180752 - DNA, 25 bp, Mus musculus
agctgacttcttgctataatgtaaa

SEQ ID NO: 180753 - DNA, 25 bp, Mus musculus
agctgacttgcaaggcaacggctct

SEQ ID NO: 180754 - DNA, 25 bp, Mus musculus
agctgacttgcatggcaacggctct

SEQ ID NO: 180755 - DNA, 25 bp, Mus musculus
agctgacttggcagggcctccaaga

SEQ ID NO: 180756 - DNA, 25 bp, Mus musculus
agctgacttggctgggcctccaaga

SEQ ID NO: 180757 - DNA, 25 bp, Mus musculus
agctgactttccaactttgacaggg

SEQ ID NO: 180758 - DNA, 25 bp, Mus musculus
agctgactttcctactttgacaggg

SEQ ID NO: 180759 - DNA, 25 bp, Mus musculus
agctgactttggatttactgtgaac

SEQ ID NO: 180760 - DNA, 25 bp, Mus musculus
agctgactttggttttactgtgaac

SEQ ID NO: 180761 - DNA, 25 bp, Mus musculus
agctgactttttccgaagccataag

SEQ ID NO: 180762 - DNA, 25 bp, Mus musculus
agctgactttttgcgaagccataag

SEQ ID NO: 180763 - DNA, 25 bp, Mus musculus
agctgagaaaagatcctctggcttc

SEQ ID NO: 180764 - DNA, 25 bp, Mus musculus
agctgagaaaagttcctctggcttc

SEQ ID NO: 180765 - DNA, 25 bp, Mus musculus
agctgagaaagtctgtggcatgtac

SEQ ID NO: 180766 - DNA, 25 bp, Mus musculus
agctgagaaagtgtgtggcatgtac

SEQ ID NO: 180767 - DNA, 25 bp, Mus musculus
agctgagaaccccagtctaataatg

SEQ ID NO: 180768 - DNA, 25 bp, Mus musculus
agctgagaacccgagtctaataatg

SEQ ID NO: 180769 - DNA, 25 bp, Mus musculus
agctgagaactaaaccattgccaag

SEQ ID NO: 180770 - DNA, 25 bp, Mus musculus
agctgagaactataccattgccaag

SEQ ID NO: 180771 - DNA, 25 bp, Mus musculus
agctgagaagtcaccttgatgccac

SEQ ID NO: 180772 - DNA, 25 bp, Mus musculus
agctgagaagtctccttgatgccac

SEQ ID NO: 180773 - DNA, 25 bp, Mus musculus
agctgagaccagaggaatcctagat

SEQ ID NO: 180774 - DNA, 25 bp, Mus musculus
agctgagaccagtggaatcctagat

SEQ ID NO: 180775 - DNA, 25 bp, Mus musculus
agctgagacctcaacctttttgtga

SEQ ID NO: 180776 - DNA, 25 bp, Mus musculus
agctgagacctctacctttttgtga

SEQ ID NO: 180777 - DNA, 25 bp, Mus musculus
agctgagacgcccaagtagaagtgt

SEQ ID NO: 180778 - DNA, 25 bp, Mus musculus
agctgagacgccgaagtagaagtgt

SEQ ID NO: 180779 - DNA, 25 bp, Mus musculus
agctgagacggaactgcaccatcta

SEQ ID NO: 180780 - DNA, 25 bp, Mus musculus
agctgagacggatctgcaccatcta

SEQ ID NO: 180781 - DNA, 25 bp, Mus musculus
agctgagactcgacattgccttgat

SEQ ID NO: 180782 - DNA, 25 bp, Mus musculus
agctgagactcgtcattgccttgat

SEQ ID NO: 180783 - DNA, 25 bp, Mus musculus
agctgagactctatctccatgaaca

SEQ ID NO: 180784 - DNA, 25 bp, Mus musculus
agctgagactctttctccatgaaca

SEQ ID NO: 180785 - DNA, 25 bp, Mus musculus
agctgagactgcagagtaatctgaa

SEQ ID NO: 180786 - DNA, 25 bp, Mus musculus
agctgagactgctgagtaatctgaa

SEQ ID NO: 180787 - DNA, 25 bp, Mus musculus
agctgagactgtctgtcataaaaca

SEQ ID NO: 180788 - DNA, 25 bp, Mus musculus
agctgagactgtgtgtcataaaaca

SEQ ID NO: 180789 - DNA, 25 bp, Mus musculus
agctgagagcaaagcacctgcgggt

SEQ ID NO: 180790 - DNA, 25 bp, Mus musculus
agctgagagcaatgcacctgcgggt

SEQ ID NO: 180791 - DNA, 25 bp, Mus musculus
agctgagagcacattcttaacgtaa

SEQ ID NO: 180792 - DNA, 25 bp, Mus musculus
agctgagagcactttcttaacgtaa

SEQ ID NO: 180793 - DNA, 25 bp, Mus musculus
agctgagagcccaggttttagttct

SEQ ID NO: 180794 - DNA, 25 bp, Mus musculus
agctgagagccctggttttagttct

SEQ ID NO: 180795 - DNA, 25 bp, Mus musculus
agctgagagctgaggcccagtttat

SEQ ID NO: 180796 - DNA, 25 bp, Mus musculus
agctgagagctgtggcccagtttat

SEQ ID NO: 180797 - DNA, 25 bp, Mus musculus
agctgagaggtcacttctctcattg

SEQ ID NO: 180798 - DNA, 25 bp, Mus musculus
agctgagaggtctcttctctcattg

SEQ ID NO: 180799 - DNA, 25 bp, Mus musculus
agctgagagtacattctatcctatt

SEQ ID NO: 180800 - DNA, 25 bp, Mus musculus
agctgagagtactttctatcctatt

SEQ ID NO: 180801 - DNA, 25 bp, Mus musculus
agctgagatcagaaaccgcctagtt

SEQ ID NO: 180802 - DNA, 25 bp, Mus musculus
agctgagatcagcacatctgtggcc

SEQ ID NO: 180803 - DNA, 25 bp, Mus musculus
agctgagatcaggacatctgtggcc

SEQ ID NO: 180804 - DNA, 25 bp, Mus musculus
agctgagatcagtaaccgcctagtt

SEQ ID NO: 180805 - DNA, 25 bp, Mus musculus
agctgagatctccactgtgaaccca

SEQ ID NO: 180806 - DNA, 25 bp, Mus musculus
agctgagatctcgactgtgaaccca

SEQ ID NO: 180807 - DNA, 25 bp, Mus musculus
agctgagatctgagtctggcaccat

SEQ ID NO: 180808 - DNA, 25 bp, Mus musculus
agctgagatctgtgtctggcaccat

SEQ ID NO: 180809 - DNA, 25 bp, Mus musculus
agctgagatgctcggttactaaata

SEQ ID NO: 180810 - DNA, 25 bp, Mus musculus
agctgagatgctgggttactaaata

SEQ ID NO: 180811 - DNA, 25 bp, Mus musculus
agctgagatggacgcacgggctcta

SEQ ID NO: 180812 - DNA, 25 bp, Mus musculus
agctgagatggaggcacgggctcta

SEQ ID NO: 180813 - DNA, 25 bp, Mus musculus
agctgagatgtaccatggtccgctt

SEQ ID NO: 180814 - DNA, 25 bp, Mus musculus
agctgagatgtagcatggtccgctt

SEQ ID NO: 180815 - DNA, 25 bp, Mus musculus
agctgagatttcagatctttaaccg

SEQ ID NO: 180816 - DNA, 25 bp, Mus musculus
agctgagatttctgatctttaaccg

SEQ ID NO: 180817 - DNA, 25 bp, Mus musculus
agctgagcaacaagcttccccagat

SEQ ID NO: 180818 - DNA, 25 bp, Mus musculus
agctgagcaacatgcttccccagat

SEQ ID NO: 180819 - DNA, 25 bp, Mus musculus
agctgagcaatgaagatgacttcta

SEQ ID NO: 180820 - DNA, 25 bp, Mus musculus
agctgagcaatgtagatgacttcta

SEQ ID NO: 180821 - DNA, 25 bp, Mus musculus
agctgagcagagcatttcaagtttc

SEQ ID NO: 180822 - DNA, 25 bp, Mus musculus
agctgagcagaggatttcaagtttc

SEQ ID NO: 180823 - DNA, 25 bp, Mus musculus
agctgagcagccactggcaggaaga

SEQ ID NO: 180824 - DNA, 25 bp, Mus musculus
agctgagcagcctctggcaggaaga

SEQ ID NO: 180825 - DNA, 25 bp, Mus musculus
agctgagcatagctcccttgccttg

SEQ ID NO: 180826 - DNA, 25 bp, Mus musculus
agctgagcataggtcccttgccttg

SEQ ID NO: 180827 - DNA, 25 bp, Mus musculus
agctgagcccacagcggatggttca

SEQ ID NO: 180828 - DNA, 25 bp, Mus musculus
agctgagcccactgcggatggttca

SEQ ID NO: 180829 - DNA, 25 bp, Mus musculus
agctgagcccagcttacttggtacc

SEQ ID NO: 180830 - DNA, 25 bp, Mus musculus
agctgagcccaggttacttggtacc

SEQ ID NO: 180831 - DNA, 25 bp, Mus musculus
agctgagcctccatgctaatattaa

SEQ ID NO: 180832 - DNA, 25 bp, Mus musculus
agctgagcctccttgctaatattaa

SEQ ID NO: 180833 - DNA, 25 bp, Mus musculus
agctgagcctgccatttgaagcaag

SEQ ID NO: 180834 - DNA, 25 bp, Mus musculus
agctgagcctgcgatttgaagcaag

SEQ ID NO: 180835 - DNA, 25 bp, Mus musculus
agctgagcgacgagtacaagatgcg

SEQ ID NO: 180836 - DNA, 25 bp, Mus musculus
agctgagcgacgtgtacaagatgcg

SEQ ID NO: 180837 - DNA, 25 bp, Mus musculus
agctgagcgattcgcttcccaaaca

SEQ ID NO: 180838 - DNA, 25 bp, Mus musculus
agctgagcgattggcttcccaaaca

SEQ ID NO: 180839 - DNA, 25 bp, Mus musculus
agctgagcgccaccagctgattgcc

SEQ ID NO: 180840 - DNA, 25 bp, Mus musculus
agctgagcgccagcagctgattgcc

SEQ ID NO: 180841 - DNA, 25 bp, Mus musculus
agctgagcgccgagatgttgcccca

SEQ ID NO: 180842 - DNA, 25 bp, Mus musculus
agctgagcgccgtgatgttgcccca

SEQ ID NO: 180843 - DNA, 25 bp, Mus musculus
agctgagctacaacccggtctgtta

SEQ ID NO: 180844 - DNA, 25 bp, Mus musculus
agctgagctacatcccggtctgtta

SEQ ID NO: 180845 - DNA, 25 bp, Mus musculus
agctgagctattccacacttccttc

SEQ ID NO: 180846 - DNA, 25 bp, Mus musculus
agctgagctattgcacacttccttc

SEQ ID NO: 180847 - DNA, 25 bp, Mus musculus
agctgagctcccaacacagatgaag

SEQ ID NO: 180848 - DNA, 25 bp, Mus musculus
agctgagctccctacacagatgaag

SEQ ID NO: 180849 - DNA, 25 bp, Mus musculus
agctgagctcggcttttctagaaaa

SEQ ID NO: 180850 - DNA, 25 bp, Mus musculus
agctgagctcgggttttctagaaaa

SEQ ID NO: 180851 - DNA, 25 bp, Mus musculus
agctgagctctgagatggacttcca

SEQ ID NO: 180852 - DNA, 25 bp, Mus musculus
agctgagctctgtgatggacttcca

SEQ ID NO: 180853 - DNA, 25 bp, Mus musculus
agctgagctgtaccttatggaaagt

SEQ ID NO: 180854 - DNA, 25 bp, Mus musculus
agctgagctgtagcttatggaaagt

SEQ ID NO: 180855 - DNA, 25 bp, Mus musculus
agctgagctgttataactacttaac

SEQ ID NO: 180856 - DNA, 25 bp, Mus musculus
agctgagctgttttaactacttaac

SEQ ID NO: 180857 - DNA, 25 bp, Mus musculus
agctgagctttcacctttcattgtg

SEQ ID NO: 180858 - DNA, 25 bp, Mus musculus
agctgagctttcatgccagaactga

SEQ ID NO: 180859 - DNA, 25 bp, Mus musculus
agctgagctttccatagacgatggg

SEQ ID NO: 180860 - DNA, 25 bp, Mus musculus
agctgagctttcgatagacgatggg

SEQ ID NO: 180861 - DNA, 25 bp, Mus musculus
agctgagctttctcctttcattgtg

SEQ ID NO: 180862 - DNA, 25 bp, Mus musculus
agctgagctttcttgccagaactga

SEQ ID NO: 180863 - DNA, 25 bp, Mus musculus
agctgaggaactacacggccacact

SEQ ID NO: 180864 - DNA, 25 bp, Mus musculus
agctgaggaacttcacggccacact

SEQ ID NO: 180865 - DNA, 25 bp, Mus musculus
agctgaggaatgagcccctgtccct

SEQ ID NO: 180866 - DNA, 25 bp, Mus musculus
agctgaggaatgtgcccctgtccct

SEQ ID NO: 180867 - DNA, 25 bp, Mus musculus
agctgaggaccaaactgaacatgag

SEQ ID NO: 180868 - DNA, 25 bp, Mus musculus
agctgaggaccatactgaacatgag

SEQ ID NO: 180869 - DNA, 25 bp, Mus musculus
agctgaggagcaactggttagtgac

SEQ ID NO: 180870 - DNA, 25 bp, Mus musculus
agctgaggagcatctggttagtgac

SEQ ID NO: 180871 - DNA, 25 bp, Mus musculus
agctgaggatcacccttccagagtc

SEQ ID NO: 180872 - DNA, 25 bp, Mus musculus
agctgaggatcagccttccagagtc

SEQ ID NO: 180873 - DNA, 25 bp, Mus musculus
agctgaggatctctcactgttgagc

SEQ ID NO: 180874 - DNA, 25 bp, Mus musculus
agctgaggatctgtcactgttgagc

SEQ ID NO: 180875 - DNA, 25 bp, Mus musculus
agctgaggatgcaatgttgcagttt

SEQ ID NO: 180876 - DNA, 25 bp, Mus musculus
agctgaggatgctatgttgcagttt

SEQ ID NO: 180877 - DNA, 25 bp, Mus musculus
agctgaggcagcataagcgatgcgt

SEQ ID NO: 180878 - DNA, 25 bp, Mus musculus
agctgaggcagcttaagcgatgcgt

SEQ ID NO: 180879 - DNA, 25 bp, Mus musculus
agctgaggcatccttcactgatatt

SEQ ID NO: 180880 - DNA, 25 bp, Mus musculus
agctgaggcatcgttcactgatatt

SEQ ID NO: 180881 - DNA, 25 bp, Mus musculus
agctgaggccgcacatttcccattc

SEQ ID NO: 180882 - DNA, 25 bp, Mus musculus
agctgaggccgctcatttcccattc

SEQ ID NO: 180883 - DNA, 25 bp, Mus musculus
agctgaggcgaaactccaggagtgc

SEQ ID NO: 180884 - DNA, 25 bp, Mus musculus
agctgaggcgaatctccaggagtgc

SEQ ID NO: 180885 - DNA, 25 bp, Mus musculus
agctgaggcgagagacctctggtca

SEQ ID NO: 180886 - DNA, 25 bp, Mus musculus
agctgaggcgagtgacctctggtca

SEQ ID NO: 180887 - DNA, 25 bp, Mus musculus
agctgaggcgtgaatcaatcttggt

SEQ ID NO: 180888 - DNA, 25 bp, Mus musculus
agctgaggcgtgagagcctccagca

SEQ ID NO: 180889 - DNA, 25 bp, Mus musculus
agctgaggcgtgtatcaatcttggt

SEQ ID NO: 180890 - DNA, 25 bp, Mus musculus
agctgaggcgtgtgagcctccagca

SEQ ID NO: 180891 - DNA, 25 bp, Mus musculus
agctgaggctaaccactaagcccag

SEQ ID NO: 180892 - DNA, 25 bp, Mus musculus
agctgaggctaactgctgttttatt

SEQ ID NO: 180893 - DNA, 25 bp, Mus musculus
agctgaggctaagcactaagcccag

SEQ ID NO: 180894 - DNA, 25 bp, Mus musculus
agctgaggctaagtgctgttttatt

SEQ ID NO: 180895 - DNA, 25 bp, Mus musculus
agctgaggctctctgaccagaaaca

SEQ ID NO: 180896 - DNA, 25 bp, Mus musculus
agctgaggctctgtgaccagaaaca

SEQ ID NO: 180897 - DNA, 25 bp, Mus musculus
agctgaggctgaatctgaggtttac

SEQ ID NO: 180898 - DNA, 25 bp, Mus musculus
agctgaggctgattctgaggtttac

SEQ ID NO: 180899 - DNA, 25 bp, Mus musculus
agctgaggctgtacattcacttaca

SEQ ID NO: 180900 - DNA, 25 bp, Mus musculus
agctgaggctgttcattcacttaca

SEQ ID NO: 180901 - DNA, 25 bp, Mus musculus
agctgagggagtctccctacttact

SEQ ID NO: 180902 - DNA, 25 bp, Mus musculus
agctgagggagtgtccctacttact

SEQ ID NO: 180903 - DNA, 25 bp, Mus musculus
agctgagggctacatctaggagact

SEQ ID NO: 180904 - DNA, 25 bp, Mus musculus
agctgagggctagatctaggagact

SEQ ID NO: 180905 - DNA, 25 bp, Mus musculus
agctgagggctgacagcctggcact

SEQ ID NO: 180906 - DNA, 25 bp, Mus musculus
agctgagggctgtcagcctggcact

SEQ ID NO: 180907 - DNA, 25 bp, Mus musculus
agctgaggtattagtctgactccct

SEQ ID NO: 180908 - DNA, 25 bp, Mus musculus
agctgaggtatttgtctgactccct

SEQ ID NO: 180909 - DNA, 25 bp, Mus musculus
agctgaggtgtgaccatgctcctaa

SEQ ID NO: 180910 - DNA, 25 bp, Mus musculus
agctgaggtgtgtccatgctcctaa

SEQ ID NO: 180911 - DNA, 25 bp, Mus musculus
agctgagtacctatagcagccatgt

SEQ ID NO: 180912 - DNA, 25 bp, Mus musculus
agctgagtacctttagcagccatgt

SEQ ID NO: 180913 - DNA, 25 bp, Mus musculus
agctgagtatcgcatggacaacccc

SEQ ID NO: 180914 - DNA, 25 bp, Mus musculus
agctgagtatcggatggacaacccc

SEQ ID NO: 180915 - DNA, 25 bp, Mus musculus
agctgagtattcctactacctccat

SEQ ID NO: 180916 - DNA, 25 bp, Mus musculus
agctgagtattcgtactacctccat

SEQ ID NO: 180917 - DNA, 25 bp, Mus musculus
agctgagtccacatttgctctcata

SEQ ID NO: 180918 - DNA, 25 bp, Mus musculus
agctgagtccacttttgctctcata

SEQ ID NO: 180919 - DNA, 25 bp, Mus musculus
agctgagtcctccatcggaagtgga

SEQ ID NO: 180920 - DNA, 25 bp, Mus musculus
agctgagtcctcgatcggaagtgga

SEQ ID NO: 180921 - DNA, 25 bp, Mus musculus
agctgagtctacaatgtctatatta

SEQ ID NO: 180922 - DNA, 25 bp, Mus musculus
agctgagtctactatgtctatatta

SEQ ID NO: 180923 - DNA, 25 bp, Mus musculus
agctgagtctccagtctggtttgtc

SEQ ID NO: 180924 - DNA, 25 bp, Mus musculus
agctgagtctcctgtctggtttgtc

SEQ ID NO: 180925 - DNA, 25 bp, Mus musculus
agctgagtctctcgacgctttgttt

SEQ ID NO: 180926 - DNA, 25 bp, Mus musculus
agctgagtctctggacgctttgttt

SEQ ID NO: 180927 - DNA, 25 bp, Mus musculus
agctgagtcttgacgttgctggtca

SEQ ID NO: 180928 - DNA, 25 bp, Mus musculus
agctgagtcttgtcgttgctggtca

SEQ ID NO: 180929 - DNA, 25 bp, Mus musculus
agctgagtgagcaccgctgtgagat

SEQ ID NO: 180930 - DNA, 25 bp, Mus musculus
agctgagtgagctccgctgtgagat

SEQ ID NO: 180931 - DNA, 25 bp, Mus musculus
agctgagtgataagtgcttactcca

SEQ ID NO: 180932 - DNA, 25 bp, Mus musculus
agctgagtgatatgtgcttactcca

SEQ ID NO: 180933 - DNA, 25 bp, Mus musculus
agctgagtgatccatcttaaaccct

SEQ ID NO: 180934 - DNA, 25 bp, Mus musculus
agctgagtgatcgatcttaaaccct

SEQ ID NO: 180935 - DNA, 25 bp, Mus musculus
agctgagtgcgaaggcccaggcctt

SEQ ID NO: 180936 - DNA, 25 bp, Mus musculus
agctgagtgcgatggcccaggcctt

SEQ ID NO: 180937 - DNA, 25 bp, Mus musculus
agctgagtggctactgttcccaaag

SEQ ID NO: 180938 - DNA, 25 bp, Mus musculus
agctgagtggcttctgttcccaaag

SEQ ID NO: 180939 - DNA, 25 bp, Mus musculus
agctgagtgggtacatcttggtcgc

SEQ ID NO: 180940 - DNA, 25 bp, Mus musculus
agctgagtgggttcatcttggtcgc

SEQ ID NO: 180941 - DNA, 25 bp, Mus musculus
agctgagttcacagtcctcacatga

SEQ ID NO: 180942 - DNA, 25 bp, Mus musculus
agctgagttcactgtcctcacatga

SEQ ID NO: 180943 - DNA, 25 bp, Mus musculus
agctgagttcatccggagacgaaac

SEQ ID NO: 180944 - DNA, 25 bp, Mus musculus
agctgagttcatgcggagacgaaac

SEQ ID NO: 180945 - DNA, 25 bp, Mus musculus
agctgagttcttatgtgcatggcat

SEQ ID NO: 180946 - DNA, 25 bp, Mus musculus
agctgagttcttttgtgcatggcat

SEQ ID NO: 180947 - DNA, 25 bp, Mus musculus
agctgagttgccacttttagtctct

SEQ ID NO: 180948 - DNA, 25 bp, Mus musculus
agctgagttgcctcttttagtctct

SEQ ID NO: 180949 - DNA, 25 bp, Mus musculus
agctgagttgcgacctgtcttccaa

SEQ ID NO: 180950 - DNA, 25 bp, Mus musculus
agctgagttgcgtcctgtcttccaa

SEQ ID NO: 180951 - DNA, 25 bp, Mus musculus
agctgagttgtacagtgtatttcca

SEQ ID NO: 180952 - DNA, 25 bp, Mus musculus
agctgagttgtagagtgtatttcca

SEQ ID NO: 180953 - DNA, 25 bp, Mus musculus
agctgagttttacatctttcattga

SEQ ID NO: 180954 - DNA, 25 bp, Mus musculus
agctgagttttagatctttcattga

SEQ ID NO: 180955 - DNA, 25 bp, Mus musculus
agctgataacctcaccgaccggaga

SEQ ID NO: 180956 - DNA, 25 bp, Mus musculus
agctgataacctgaccgaccggaga

SEQ ID NO: 180957 - DNA, 25 bp, Mus musculus
agctgataagccagtcaccggtacc

SEQ ID NO: 180958 - DNA, 25 bp, Mus musculus
agctgataagcctgtcaccggtacc

SEQ ID NO: 180959 - DNA, 25 bp, Mus musculus
agctgataagctagctgttccccta

SEQ ID NO: 180960 - DNA, 25 bp, Mus musculus
agctgataagctctctccattactg

SEQ ID NO: 180961 - DNA, 25 bp, Mus musculus
agctgataagctgtctccattactg

SEQ ID NO: 180962 - DNA, 25 bp, Mus musculus
agctgataagcttgctgttccccta

SEQ ID NO: 180963 - DNA, 25 bp, Mus musculus
agctgataccttcacagtgtttgta

SEQ ID NO: 180964 - DNA, 25 bp, Mus musculus
agctgataccttgacagtgtttgta

SEQ ID NO: 180965 - DNA, 25 bp, Mus musculus
agctgatcactgcttcagggcttag

SEQ ID NO: 180966 - DNA, 25 bp, Mus musculus
agctgatcactggttcagggcttag

SEQ ID NO: 180967 - DNA, 25 bp, Mus musculus
agctgatcacttaaaactggtttga

SEQ ID NO: 180968 - DNA, 25 bp, Mus musculus
agctgatcactttaaactggtttga

SEQ ID NO: 180969 - DNA, 25 bp, Mus musculus
agctgatcagcactgaggttaccaa

SEQ ID NO: 180970 - DNA, 25 bp, Mus musculus
agctgatcagcagtgaggttaccaa

SEQ ID NO: 180971 - DNA, 25 bp, Mus musculus
agctgatccagcactaccatcgctt

SEQ ID NO: 180972 - DNA, 25 bp, Mus musculus
agctgatccagctctaccatcgctt

SEQ ID NO: 180973 - DNA, 25 bp, Mus musculus
agctgatcccgtaagtgccggctgc

SEQ ID NO: 180974 - DNA, 25 bp, Mus musculus
agctgatcccgttagtgccggctgc

SEQ ID NO: 180975 - DNA, 25 bp, Mus musculus
agctgatcctcactggctgggagcc

SEQ ID NO: 180976 - DNA, 25 bp, Mus musculus
agctgatcctcagtggctgggagcc

SEQ ID NO: 180977 - DNA, 25 bp, Mus musculus
agctgatcgttgctgatgttcttac

SEQ ID NO: 180978 - DNA, 25 bp, Mus musculus
agctgatcgttggtgatgttcttac

SEQ ID NO: 180979 - DNA, 25 bp, Mus musculus
agctgatctacccttggaccaagag

SEQ ID NO: 180980 - DNA, 25 bp, Mus musculus
agctgatctaccgttggaccaagag

SEQ ID NO: 180981 - DNA, 25 bp, Mus musculus
agctgatctctcactcaacagtttt

SEQ ID NO: 180982 - DNA, 25 bp, Mus musculus
agctgatctctctctcaacagtttt

SEQ ID NO: 180983 - DNA, 25 bp, Mus musculus
agctgatctgatagatcaccccaga

SEQ ID NO: 180984 - DNA, 25 bp, Mus musculus
agctgatctgattgatcaccccaga

SEQ ID NO: 180985 - DNA, 25 bp, Mus musculus
agctgatgatagcaggccctgactg

SEQ ID NO: 180986 - DNA, 25 bp, Mus musculus
agctgatgataggaggccctgactg

SEQ ID NO: 180987 - DNA, 25 bp, Mus musculus
agctgatgatgtagtacccctgacc

SEQ ID NO: 180988 - DNA, 25 bp, Mus musculus
agctgatgatgttgtacccctgacc

SEQ ID NO: 180989 - DNA, 25 bp, Mus musculus
agctgatgccatctgcgccctgtgt

SEQ ID NO: 180990 - DNA, 25 bp, Mus musculus
agctgatgccatgtgcgccctgtgt

SEQ ID NO: 180991 - DNA, 25 bp, Mus musculus
agctgatgcctaaatgactcgctct

SEQ ID NO: 180992 - DNA, 25 bp, Mus musculus
agctgatgcctatatgactcgctct

SEQ ID NO: 180993 - DNA, 25 bp, Mus musculus
agctgatgcggtatgatgatcctct

SEQ ID NO: 180994 - DNA, 25 bp, Mus musculus
agctgatgcggtttgatgatcctct

SEQ ID NO: 180995 - DNA, 25 bp, Mus musculus
agctgatgctcaattcctctttttg

SEQ ID NO: 180996 - DNA, 25 bp, Mus musculus
agctgatgctcacctaaagtgccac

SEQ ID NO: 180997 - DNA, 25 bp, Mus musculus
agctgatgctcagctaaagtgccac

SEQ ID NO: 180998 - DNA, 25 bp, Mus musculus
agctgatgctcatttcctctttttg

SEQ ID NO: 180999 - DNA, 25 bp, Mus musculus
agctgatgctgaagtgacctcacct

SEQ ID NO: 181000 - DNA, 25 bp, Mus musculus
agctgatgctgatgtgacctcacct

SEQ ID NO: 181001 - DNA, 25 bp, Mus musculus
agctgatgctggcacatcattttgc

SEQ ID NO: 181002 - DNA, 25 bp, Mus musculus
agctgatgctggctgggacaaacac

SEQ ID NO: 181003 - DNA, 25 bp, Mus musculus
agctgatgctgggacatcattttgc

SEQ ID NO: 181004 - DNA, 25 bp, Mus musculus
agctgatgctgggtgggacaaacac

SEQ ID NO: 181005 - DNA, 25 bp, Mus musculus
agctgatggacactgagacggacat

SEQ ID NO: 181006 - DNA, 25 bp, Mus musculus
agctgatggacagtgagacggacat

SEQ ID NO: 181007 - DNA, 25 bp, Mus musculus
agctgatggccacgaggtcctccaa

SEQ ID NO: 181008 - DNA, 25 bp, Mus musculus
agctgatggccaggaggtcctccaa

SEQ ID NO: 181009 - DNA, 25 bp, Mus musculus
agctgatggcccctggaccgggaaa

SEQ ID NO: 181010 - DNA, 25 bp, Mus musculus
agctgatggcccgtggaccgggaaa

SEQ ID NO: 181011 - DNA, 25 bp, Mus musculus
agctgatgggatcctcattgcagga

SEQ ID NO: 181012 - DNA, 25 bp, Mus musculus
agctgatgggatgctcattgcagga

SEQ ID NO: 181013 - DNA, 25 bp, Mus musculus
agctgatggtggacctgacatcttc

SEQ ID NO: 181014 - DNA, 25 bp, Mus musculus
agctgatggtggtcctgacatcttc

SEQ ID NO: 181015 - DNA, 25 bp, Mus musculus
agctgatgtcagcattccctcaagt

SEQ ID NO: 181016 - DNA, 25 bp, Mus musculus
agctgatgtcaggattccctcaagt

SEQ ID NO: 181017 - DNA, 25 bp, Mus musculus
agctgatgtcctccttgtgagacaa

SEQ ID NO: 181018 - DNA, 25 bp, Mus musculus
agctgatgtcctgcttgtgagacaa

SEQ ID NO: 181019 - DNA, 25 bp, Mus musculus
agctgatgtggcacaggcaccctgg

SEQ ID NO: 181020 - DNA, 25 bp, Mus musculus
agctgatgtggctcaggcaccctgg

SEQ ID NO: 181021 - DNA, 25 bp, Mus musculus
agctgatgtgtgcagaacccaccat

SEQ ID NO: 181022 - DNA, 25 bp, Mus musculus
agctgatgtgtggagaacccaccat

SEQ ID NO: 181023 - DNA, 25 bp, Mus musculus
agctgatgttggcatctatgctagc

SEQ ID NO: 181024 - DNA, 25 bp, Mus musculus
agctgatgttgggatctatgctagc

SEQ ID NO: 181025 - DNA, 25 bp, Mus musculus
agctgattaattacgtttgacctac

SEQ ID NO: 181026 - DNA, 25 bp, Mus musculus
agctgattaatttcgtttgacctac

SEQ ID NO: 181027 - DNA, 25 bp, Mus musculus
agctgattagctagtggaccactca

SEQ ID NO: 181028 - DNA, 25 bp, Mus musculus
agctgattagcttgtggaccactca

SEQ ID NO: 181029 - DNA, 25 bp, Mus musculus
agctgattccagaagaagcactgca

SEQ ID NO: 181030 - DNA, 25 bp, Mus musculus
agctgattccagtagaagcactgca

SEQ ID NO: 181031 - DNA, 25 bp, Mus musculus
agctgattgaatcccttggtcatta

SEQ ID NO: 181032 - DNA, 25 bp, Mus musculus
agctgattgaatgccttggtcatta

SEQ ID NO: 181033 - DNA, 25 bp, Mus musculus
agctgattgagaacgcctccaggga

SEQ ID NO: 181034 - DNA, 25 bp, Mus musculus
agctgattgagatcgcctccaggga

SEQ ID NO: 181035 - DNA, 25 bp, Mus musculus
agctgattgctgaccgagaggtttc

SEQ ID NO: 181036 - DNA, 25 bp, Mus musculus
agctgattgctgacttcaacttgat

SEQ ID NO: 181037 - DNA, 25 bp, Mus musculus
agctgattgctgtccgagaggtttc

SEQ ID NO: 181038 - DNA, 25 bp, Mus musculus
agctgattgctgtcttcaacttgat

SEQ ID NO: 181039 - DNA, 25 bp, Mus musculus
agctgattgtagacaccgtgttgat

SEQ ID NO: 181040 - DNA, 25 bp, Mus musculus
agctgattgtagtcaccgtgttgat

SEQ ID NO: 181041 - DNA, 25 bp, Mus musculus
agctgattgtatattccaccatggg

SEQ ID NO: 181042 - DNA, 25 bp, Mus musculus
agctgattgtattttccaccatggg

SEQ ID NO: 181043 - DNA, 25 bp, Mus musculus
agctgattgtcaatccatatcctca

SEQ ID NO: 181044 - DNA, 25 bp, Mus musculus
agctgattgtcattccatatcctca

SEQ ID NO: 181045 - DNA, 25 bp, Mus musculus
agctgatttcagcatggaccaaaca

SEQ ID NO: 181046 - DNA, 25 bp, Mus musculus
agctgatttcaggatggaccaaaca

SEQ ID NO: 181047 - DNA, 25 bp, Mus musculus
agctgatttcatctgtaacccggtc

SEQ ID NO: 181048 - DNA, 25 bp, Mus musculus
agctgatttcatgtgtaacccggtc

SEQ ID NO: 181049 - DNA, 25 bp, Mus musculus
agctgatttccaattgactgtgtac

SEQ ID NO: 181050 - DNA, 25 bp, Mus musculus
agctgatttccatttgactgtgtac

SEQ ID NO: 181051 - DNA, 25 bp, Mus musculus
agctgcaaacatcctatctttttag

SEQ ID NO: 181052 - DNA, 25 bp, Mus musculus
agctgcaaacatgctatctttttag

SEQ ID NO: 181053 - DNA, 25 bp, Mus musculus
agctgcaaagaaagcggctgctctt

SEQ ID NO: 181054 - DNA, 25 bp, Mus musculus
agctgcaaagaatgcggctgctctt

SEQ ID NO: 181055 - DNA, 25 bp, Mus musculus
agctgcaaagctctctcatggaaca

SEQ ID NO: 181056 - DNA, 25 bp, Mus musculus
agctgcaaagctgtctcatggaaca

SEQ ID NO: 181057 - DNA, 25 bp, Mus musculus
agctgcaaaggcatccggtgcgaga

SEQ ID NO: 181058 - DNA, 25 bp, Mus musculus
agctgcaaaggcttccggtgcgaga

SEQ ID NO: 181059 - DNA, 25 bp, Mus musculus
agctgcaacacacttagaaaggcgt

SEQ ID NO: 181060 - DNA, 25 bp, Mus musculus
agctgcaacacagttagaaaggcgt

SEQ ID NO: 181061 - DNA, 25 bp, Mus musculus
agctgcaacggtaaaggtggtcctt

SEQ ID NO: 181062 - DNA, 25 bp, Mus musculus
agctgcaacggttaaggtggtcctt

SEQ ID NO: 181063 - DNA, 25 bp, Mus musculus
agctgcaactggctagacactgtct

SEQ ID NO: 181064 - DNA, 25 bp, Mus musculus
agctgcaactgggtagacactgtct

SEQ ID NO: 181065 - DNA, 25 bp, Mus musculus
agctgcaacttccagtgctccagga

SEQ ID NO: 181066 - DNA, 25 bp, Mus musculus
agctgcaacttcgagtgctccagga

SEQ ID NO: 181067 - DNA, 25 bp, Mus musculus
agctgcaagagtaatgccatccctt

SEQ ID NO: 181068 - DNA, 25 bp, Mus musculus
agctgcaagagttatgccatccctt

SEQ ID NO: 181069 - DNA, 25 bp, Mus musculus
agctgcaagatgaaagctaagctag

SEQ ID NO: 181070 - DNA, 25 bp, Mus musculus
agctgcaagatgtaagctaagctag

SEQ ID NO: 181071 - DNA, 25 bp, Mus musculus
agctgcaagattcgcctatgtggtg

SEQ ID NO: 181072 - DNA, 25 bp, Mus musculus
agctgcaagattggcctatgtggtg

SEQ ID NO: 181073 - DNA, 25 bp, Mus musculus
agctgcaagcccagcatcctcgtag

SEQ ID NO: 181074 - DNA, 25 bp, Mus musculus
agctgcaagccctgcatcctcgtag

SEQ ID NO: 181075 - DNA, 25 bp, Mus musculus
agctgcaagctgattctcattgtgt

SEQ ID NO: 181076 - DNA, 25 bp, Mus musculus
agctgcaagctgtttctcattgtgt

SEQ ID NO: 181077 - DNA, 25 bp, Mus musculus
agctgcaagggacaccaactctttc

SEQ ID NO: 181078 - DNA, 25 bp, Mus musculus
agctgcaagggacactgtcccctgt

SEQ ID NO: 181079 - DNA, 25 bp, Mus musculus
agctgcaagggagaccaactctttc

SEQ ID NO: 181080 - DNA, 25 bp, Mus musculus
agctgcaagggagactgtcccctgt

SEQ ID NO: 181081 - DNA, 25 bp, Mus musculus
agctgcaagtccctggcaagcttca

SEQ ID NO: 181082 - DNA, 25 bp, Mus musculus
agctgcaagtccgtggcaagcttca

SEQ ID NO: 181083 - DNA, 25 bp, Mus musculus
agctgcaatagtcactggagctgtg

SEQ ID NO: 181084 - DNA, 25 bp, Mus musculus
agctgcaatagtgactggagctgtg

SEQ ID NO: 181085 - DNA, 25 bp, Mus musculus
agctgcaatcccagtgtgtatggct

SEQ ID NO: 181086 - DNA, 25 bp, Mus musculus
agctgcaatccctgtgtgtatggct

SEQ ID NO: 181087 - DNA, 25 bp, Mus musculus
agctgcaatgcactattaatctgac

SEQ ID NO: 181088 - DNA, 25 bp, Mus musculus
agctgcaatgcagtattaatctgac

SEQ ID NO: 181089 - DNA, 25 bp, Mus musculus
agctgcaatgggaaaccgtcgcgcc

SEQ ID NO: 181090 - DNA, 25 bp, Mus musculus
agctgcaatgggtaaccgtcgcgcc

SEQ ID NO: 181091 - DNA, 25 bp, Mus musculus
agctgcaattgtctgttatgacctc

SEQ ID NO: 181092 - DNA, 25 bp, Mus musculus
agctgcaattgtgtgttatgacctc

SEQ ID NO: 181093 - DNA, 25 bp, Mus musculus
agctgcacacacatggagatctcct

SEQ ID NO: 181094 - DNA, 25 bp, Mus musculus
agctgcacacacttggagatctcct

SEQ ID NO: 181095 - DNA, 25 bp, Mus musculus
agctgcacactaagggccgtccatt

SEQ ID NO: 181096 - DNA, 25 bp, Mus musculus
agctgcacactatgggccgtccatt

SEQ ID NO: 181097 - DNA, 25 bp, Mus musculus
agctgcacagcaatcaggcctcata

SEQ ID NO: 181098 - DNA, 25 bp, Mus musculus
agctgcacagcattcaggcctcata

SEQ ID NO: 181099 - DNA, 25 bp, Mus musculus
agctgcacagccaagccagtgagaa

SEQ ID NO: 181100 - DNA, 25 bp, Mus musculus
agctgcacagcctagccagtgagaa

SEQ ID NO: 181101 - DNA, 25 bp, Mus musculus
agctgcacaggaccattcttggaag

SEQ ID NO: 181102 - DNA, 25 bp, Mus musculus
agctgcacaggagcattcttggaag

SEQ ID NO: 181103 - DNA, 25 bp, Mus musculus
agctgcacatgcaagaacgggctgt

SEQ ID NO: 181104 - DNA, 25 bp, Mus musculus
agctgcacatgctagaacgggctgt

SEQ ID NO: 181105 - DNA, 25 bp, Mus musculus
agctgcacatggaggagacgcccac

SEQ ID NO: 181106 - DNA, 25 bp, Mus musculus
agctgcacatggtggagacgcccac

SEQ ID NO: 181107 - DNA, 25 bp, Mus musculus
agctgcacatttcgccttaaagtcc

SEQ ID NO: 181108 - DNA, 25 bp, Mus musculus
agctgcacatttggccttaaagtcc

SEQ ID NO: 181109 - DNA, 25 bp, Mus musculus
agctgcaccactaatgacgcgctga

SEQ ID NO: 181110 - DNA, 25 bp, Mus musculus
agctgcaccacttatgacgcgctga

SEQ ID NO: 181111 - DNA, 25 bp, Mus musculus
agctgcaccatcaattcccagcatg

SEQ ID NO: 181112 - DNA, 25 bp, Mus musculus
agctgcaccatctattcccagcatg

SEQ ID NO: 181113 - DNA, 25 bp, Mus musculus
agctgcacctcgatcagaatggcga

SEQ ID NO: 181114 - DNA, 25 bp, Mus musculus
agctgcacctcgttcagaatggcga

SEQ ID NO: 181115 - DNA, 25 bp, Mus musculus
agctgcacgcacctcatcgaaagtg

SEQ ID NO: 181116 - DNA, 25 bp, Mus musculus
agctgcacgcacgtcatcgaaagtg

SEQ ID NO: 181117 - DNA, 25 bp, Mus musculus
agctgcacgccaagctggatgtaaa

SEQ ID NO: 181118 - DNA, 25 bp, Mus musculus
agctgcacgccatgctggatgtaaa

SEQ ID NO: 181119 - DNA, 25 bp, Mus musculus
agctgcacgcctccgatgactgcgg

SEQ ID NO: 181120 - DNA, 25 bp, Mus musculus
agctgcacgcctgcgatgactgcgg

SEQ ID NO: 181121 - DNA, 25 bp, Mus musculus
agctgcacggctacattaaattggc

SEQ ID NO: 181122 - DNA, 25 bp, Mus musculus
agctgcacggcttcattaaattggc

SEQ ID NO: 181123 - DNA, 25 bp, Mus musculus
agctgcacgggcacaccacagatga

SEQ ID NO: 181124 - DNA, 25 bp, Mus musculus
agctgcacgggctcaccacagatga

SEQ ID NO: 181125 - DNA, 25 bp, Mus musculus
agctgcactcagatgtacatacccc

SEQ ID NO: 181126 - DNA, 25 bp, Mus musculus
agctgcactcagttgtacatacccc

SEQ ID NO: 181127 - DNA, 25 bp, Mus musculus
agctgcactcggcttaacctggagg

SEQ ID NO: 181128 - DNA, 25 bp, Mus musculus
agctgcactcgggttaacctggagg

SEQ ID NO: 181129 - DNA, 25 bp, Mus musculus
agctgcactgagctcatgttctcgg

SEQ ID NO: 181130 - DNA, 25 bp, Mus musculus
agctgcactgaggtcatgttctcgg

SEQ ID NO: 181131 - DNA, 25 bp, Mus musculus
agctgcactgctatctttgtaacgt

SEQ ID NO: 181132 - DNA, 25 bp, Mus musculus
agctgcactgctttctttgtaacgt

SEQ ID NO: 181133 - DNA, 25 bp, Mus musculus
agctgcactgtgatgagttgctctg

SEQ ID NO: 181134 - DNA, 25 bp, Mus musculus
agctgcactgtgttgagttgctctg

SEQ ID NO: 181135 - DNA, 25 bp, Mus musculus
agctgcacttcccagtgttactgta

SEQ ID NO: 181136 - DNA, 25 bp, Mus musculus
agctgcacttccgagtgttactgta

SEQ ID NO: 181137 - DNA, 25 bp, Mus musculus
agctgcacttggcttcttcactctg

SEQ ID NO: 181138 - DNA, 25 bp, Mus musculus
agctgcacttgggttcttcactctg

SEQ ID NO: 181139 - DNA, 25 bp, Mus musculus
agctgcactttaaccctagggcagg

SEQ ID NO: 181140 - DNA, 25 bp, Mus musculus
agctgcactttatccctagggcagg

SEQ ID NO: 181141 - DNA, 25 bp, Mus musculus
agctgcagaccccagtggactactt

SEQ ID NO: 181142 - DNA, 25 bp, Mus musculus
agctgcagacccgagtggactactt

SEQ ID NO: 181143 - DNA, 25 bp, Mus musculus
agctgcagagatatttgccccaggg

SEQ ID NO: 181144 - DNA, 25 bp, Mus musculus
agctgcagagatttttgccccaggg

SEQ ID NO: 181145 - DNA, 25 bp, Mus musculus
agctgcagagctaaggctacaacgg

SEQ ID NO: 181146 - DNA, 25 bp, Mus musculus
agctgcagagctcgtccggtcctgt

SEQ ID NO: 181147 - DNA, 25 bp, Mus musculus
agctgcagagctggtccggtcctgt

SEQ ID NO: 181148 - DNA, 25 bp, Mus musculus
agctgcagagcttaggctacaacgg

SEQ ID NO: 181149 - DNA, 25 bp, Mus musculus
agctgcagaggcaacctgagtacac

SEQ ID NO: 181150 - DNA, 25 bp, Mus musculus
agctgcagaggctacctgagtacac

SEQ ID NO: 181151 - DNA, 25 bp, Mus musculus
agctgcagaggtacatccagtggct

SEQ ID NO: 181152 - DNA, 25 bp, Mus musculus
agctgcagaggttcatccagtggct

SEQ ID NO: 181153 - DNA, 25 bp, Mus musculus
agctgcagatgcagtgtccacagga

SEQ ID NO: 181154 - DNA, 25 bp, Mus musculus
agctgcagatgctgtgtccacagga

SEQ ID NO: 181155 - DNA, 25 bp, Mus musculus
agctgcagattacgttggcctgtct

SEQ ID NO: 181156 - DNA, 25 bp, Mus musculus
agctgcagattaggttggcctgtct

SEQ ID NO: 181157 - DNA, 25 bp, Mus musculus
agctgcagatttagctcacgtgatc

SEQ ID NO: 181158 - DNA, 25 bp, Mus musculus
agctgcagattttgctcacgtgatc

SEQ ID NO: 181159 - DNA, 25 bp, Mus musculus
agctgcagcagcaggttcgggccct

SEQ ID NO: 181160 - DNA, 25 bp, Mus musculus
agctgcagcagctggttcgggccct

SEQ ID NO: 181161 - DNA, 25 bp, Mus musculus
agctgcagcatcagggcatcgagta

SEQ ID NO: 181162 - DNA, 25 bp, Mus musculus
agctgcagcatctgggcatcgagta

SEQ ID NO: 181163 - DNA, 25 bp, Mus musculus
agctgcagcccgcagccatgtgtgt

SEQ ID NO: 181164 - DNA, 25 bp, Mus musculus
agctgcagcccggagccatgtgtgt

SEQ ID NO: 181165 - DNA, 25 bp, Mus musculus
agctgcagccgaccttgaaagtcag

SEQ ID NO: 181166 - DNA, 25 bp, Mus musculus
agctgcagccgagcttgaaagtcag

SEQ ID NO: 181167 - DNA, 25 bp, Mus musculus
agctgcagcctacttaggagcctac

SEQ ID NO: 181168 - DNA, 25 bp, Mus musculus
agctgcagcctagttaggagcctac

SEQ ID NO: 181169 - DNA, 25 bp, Mus musculus
agctgcagcctgcaggccccagtga

SEQ ID NO: 181170 - DNA, 25 bp, Mus musculus
agctgcagcctggaggccccagtga

SEQ ID NO: 181171 - DNA, 25 bp, Mus musculus
agctgcagcgctaggagacagagtt

SEQ ID NO: 181172 - DNA, 25 bp, Mus musculus
agctgcagcgcttggagacagagtt

SEQ ID NO: 181173 - DNA, 25 bp, Mus musculus
agctgcagcggcatcgtgagcactg

SEQ ID NO: 181174 - DNA, 25 bp, Mus musculus
agctgcagcggcttcgtgagcactg

SEQ ID NO: 181175 - DNA, 25 bp, Mus musculus
agctgcagcgtcagagccgagttga

SEQ ID NO: 181176 - DNA, 25 bp, Mus musculus
agctgcagcgtctgagccgagttga

SEQ ID NO: 181177 - DNA, 25 bp, Mus musculus
agctgcagcgtgaccttactggatg

SEQ ID NO: 181178 - DNA, 25 bp, Mus musculus
agctgcagcgtgtccttactggatg

SEQ ID NO: 181179 - DNA, 25 bp, Mus musculus
agctgcagctctcaggtgaccagga

SEQ ID NO: 181180 - DNA, 25 bp, Mus musculus
agctgcagctctgaggtgaccagga

SEQ ID NO: 181181 - DNA, 25 bp, Mus musculus
agctgcaggacacacggacatcttg

SEQ ID NO: 181182 - DNA, 25 bp, Mus musculus
agctgcaggacacggtgagcacaaa

SEQ ID NO: 181183 - DNA, 25 bp, Mus musculus
agctgcaggacagacggacatcttg

SEQ ID NO: 181184 - DNA, 25 bp, Mus musculus
agctgcaggacagggtgagcacaaa

SEQ ID NO: 181185 - DNA, 25 bp, Mus musculus
agctgcaggactagtgctcagtcac

SEQ ID NO: 181186 - DNA, 25 bp, Mus musculus
agctgcaggacttgtgctcagtcac

SEQ ID NO: 181187 - DNA, 25 bp, Mus musculus
agctgcaggagaccgcgcgccagaa

SEQ ID NO: 181188 - DNA, 25 bp, Mus musculus
agctgcaggagagcgcgcgccagaa

SEQ ID NO: 181189 - DNA, 25 bp, Mus musculus
agctgcaggcagacccaagtggaga

SEQ ID NO: 181190 - DNA, 25 bp, Mus musculus
agctgcaggcagtcccaagtggaga

SEQ ID NO: 181191 - DNA, 25 bp, Mus musculus
agctgcaggccacttctgaacaaga

SEQ ID NO: 181192 - DNA, 25 bp, Mus musculus
agctgcaggccagttctgaacaaga

SEQ ID NO: 181193 - DNA, 25 bp, Mus musculus
agctgcaggcccagtgagtgtcctg

SEQ ID NO: 181194 - DNA, 25 bp, Mus musculus
agctgcaggccctgtgagtgtcctg

SEQ ID NO: 181195 - DNA, 25 bp, Mus musculus
agctgcaggcggaagttgagcacct

SEQ ID NO: 181196 - DNA, 25 bp, Mus musculus
agctgcaggcggtagttgagcacct

SEQ ID NO: 181197 - DNA, 25 bp, Mus musculus
agctgcaggctcagctgttttctcc

SEQ ID NO: 181198 - DNA, 25 bp, Mus musculus
agctgcaggctctgctgttttctcc

SEQ ID NO: 181199 - DNA, 25 bp, Mus musculus
agctgcaggctgactggttgtgact

SEQ ID NO: 181200 - DNA, 25 bp, Mus musculus
agctgcaggctgacttcgtcctacg

SEQ ID NO: 181201 - DNA, 25 bp, Mus musculus
agctgcaggctgtctggttgtgact

SEQ ID NO: 181202 - DNA, 25 bp, Mus musculus
agctgcaggctgtcttcgtcctacg

SEQ ID NO: 181203 - DNA, 25 bp, Mus musculus
agctgcagggagataggtacatcaa

SEQ ID NO: 181204 - DNA, 25 bp, Mus musculus
agctgcagggagttaggtacatcaa

SEQ ID NO: 181205 - DNA, 25 bp, Mus musculus
agctgcagggcaatctactaaaatc

SEQ ID NO: 181206 - DNA, 25 bp, Mus musculus
agctgcagggcattctactaaaatc

SEQ ID NO: 181207 - DNA, 25 bp, Mus musculus
agctgcagggccacattagcagtgt

SEQ ID NO: 181208 - DNA, 25 bp, Mus musculus
agctgcagggcctcattagcagtgt

SEQ ID NO: 181209 - DNA, 25 bp, Mus musculus
agctgcagggttcctccagcaggca

SEQ ID NO: 181210 - DNA, 25 bp, Mus musculus
agctgcagggttgctccagcaggca

SEQ ID NO: 181211 - DNA, 25 bp, Mus musculus
agctgcagtattcgcttcacacgag

SEQ ID NO: 181212 - DNA, 25 bp, Mus musculus
agctgcagtattggcttcacacgag

SEQ ID NO: 181213 - DNA, 25 bp, Mus musculus
agctgcagtgacaacacctctggac

SEQ ID NO: 181214 - DNA, 25 bp, Mus musculus
agctgcagtgactacacctctggac

SEQ ID NO: 181215 - DNA, 25 bp, Mus musculus
agctgcagtgccctaaagttctctt

SEQ ID NO: 181216 - DNA, 25 bp, Mus musculus
agctgcagtgccgtaaagttctctt

SEQ ID NO: 181217 - DNA, 25 bp, Mus musculus
agctgcagtgcgagctacagtgctc

SEQ ID NO: 181218 - DNA, 25 bp, Mus musculus
agctgcagtgcgtgctacagtgctc

SEQ ID NO: 181219 - DNA, 25 bp, Mus musculus
agctgcagtgggaatttgtgaacgc

SEQ ID NO: 181220 - DNA, 25 bp, Mus musculus
agctgcagtgggtatttgtgaacgc

SEQ ID NO: 181221 - DNA, 25 bp, Mus musculus
agctgcagtgtgatggctccttgca

SEQ ID NO: 181222 - DNA, 25 bp, Mus musculus
agctgcagtgtgttggctccttgca

SEQ ID NO: 181223 - DNA, 25 bp, Mus musculus
agctgcagttcaagcttgctctgca

SEQ ID NO: 181224 - DNA, 25 bp, Mus musculus
agctgcagttcatgcttgctctgca

SEQ ID NO: 181225 - DNA, 25 bp, Mus musculus
agctgcagttcgagcgcttcgtggt

SEQ ID NO: 181226 - DNA, 25 bp, Mus musculus
agctgcagttcgcacacacggtgaa

SEQ ID NO: 181227 - DNA, 25 bp, Mus musculus
agctgcagttcggacacacggtgaa

SEQ ID NO: 181228 - DNA, 25 bp, Mus musculus
agctgcagttcgtgcgcttcgtggt

SEQ ID NO: 181229 - DNA, 25 bp, Mus musculus
agctgcagttgtagctgccacagcc

SEQ ID NO: 181230 - DNA, 25 bp, Mus musculus
agctgcagttgttgctgccacagcc

SEQ ID NO: 181231 - DNA, 25 bp, Mus musculus
agctgcagtttcattccagaaggat

SEQ ID NO: 181232 - DNA, 25 bp, Mus musculus
agctgcagtttctttccagaaggat

SEQ ID NO: 181233 - DNA, 25 bp, Mus musculus
agctgcagtttgactcttctttgtc

SEQ ID NO: 181234 - DNA, 25 bp, Mus musculus
agctgcagtttgtctcttctttgtc

SEQ ID NO: 181235 - DNA, 25 bp, Mus musculus
agctgcatacagctggactggctgt

SEQ ID NO: 181236 - DNA, 25 bp, Mus musculus
agctgcatacaggtggactggctgt

SEQ ID NO: 181237 - DNA, 25 bp, Mus musculus
agctgcatacttaacctggacactt

SEQ ID NO: 181238 - DNA, 25 bp, Mus musculus
agctgcatactttacctggacactt

SEQ ID NO: 181239 - DNA, 25 bp, Mus musculus
agctgcatagatcatttagtccaac

SEQ ID NO: 181240 - DNA, 25 bp, Mus musculus
agctgcatagatgatttagtccaac

SEQ ID NO: 181241 - DNA, 25 bp, Mus musculus
agctgcatagcaatccattgcatga

SEQ ID NO: 181242 - DNA, 25 bp, Mus musculus
agctgcatagcattccattgcatga

SEQ ID NO: 181243 - DNA, 25 bp, Mus musculus
agctgcatcactcaatggccatctg

SEQ ID NO: 181244 - DNA, 25 bp, Mus musculus
agctgcatcactgaatggccatctg

SEQ ID NO: 181245 - DNA, 25 bp, Mus musculus
agctgcatccgcaggacgggcaata

SEQ ID NO: 181246 - DNA, 25 bp, Mus musculus
agctgcatccgctggacgggcaata

SEQ ID NO: 181247 - DNA, 25 bp, Mus musculus
agctgcatcctaaaattaaaaggga

SEQ ID NO: 181248 - DNA, 25 bp, Mus musculus
agctgcatcctaaacccaaatgtcc

SEQ ID NO: 181249 - DNA, 25 bp, Mus musculus
agctgcatcctataattaaaaggga

SEQ ID NO: 181250 - DNA, 25 bp, Mus musculus
agctgcatcctatacccaaatgtcc

SEQ ID NO: 181251 - DNA, 25 bp, Mus musculus
agctgcatctagagcgccagtggaa

SEQ ID NO: 181252 - DNA, 25 bp, Mus musculus
agctgcatctagtgcgccagtggaa

SEQ ID NO: 181253 - DNA, 25 bp, Mus musculus
agctgcatcttcagaaagagagagg

SEQ ID NO: 181254 - DNA, 25 bp, Mus musculus
agctgcatcttctgaaagagagagg

SEQ ID NO: 181255 - DNA, 25 bp, Mus musculus
agctgcatcttgaagctggtcactt

SEQ ID NO: 181256 - DNA, 25 bp, Mus musculus
agctgcatcttgtagctggtcactt

SEQ ID NO: 181257 - DNA, 25 bp, Mus musculus
agctgcatgatgctagaccacctca

SEQ ID NO: 181258 - DNA, 25 bp, Mus musculus
agctgcatgatggtagaccacctca

SEQ ID NO: 181259 - DNA, 25 bp, Mus musculus
agctgcatgcgcacggagtccttga

SEQ ID NO: 181260 - DNA, 25 bp, Mus musculus
agctgcatgcgctcggagtccttga

SEQ ID NO: 181261 - DNA, 25 bp, Mus musculus
agctgcatggatatcagtgcctatg

SEQ ID NO: 181262 - DNA, 25 bp, Mus musculus
agctgcatggatttcagtgcctatg

SEQ ID NO: 181263 - DNA, 25 bp, Mus musculus
agctgcatggcccagatgctcagtg

SEQ ID NO: 181264 - DNA, 25 bp, Mus musculus
agctgcatggccgagatgctcagtg

SEQ ID NO: 181265 - DNA, 25 bp, Mus musculus
agctgcatgggcatcctgggttcag

SEQ ID NO: 181266 - DNA, 25 bp, Mus musculus
agctgcatgggcttcctgggttcag

SEQ ID NO: 181267 - DNA, 25 bp, Mus musculus
agctgcatgtccagacctgctctga

SEQ ID NO: 181268 - DNA, 25 bp, Mus musculus
agctgcatgtcctgacctgctctga

SEQ ID NO: 181269 - DNA, 25 bp, Mus musculus
agctgcatgtggctcaggacccagc

SEQ ID NO: 181270 - DNA, 25 bp, Mus musculus
agctgcatgtgggtcaggacccagc

SEQ ID NO: 181271 - DNA, 25 bp, Mus musculus
agctgcattctgatccccatagaag

SEQ ID NO: 181272 - DNA, 25 bp, Mus musculus
agctgcattctgttccccatagaag

SEQ ID NO: 181273 - DNA, 25 bp, Mus musculus
agctgcattcttatcctattttttc

SEQ ID NO: 181274 - DNA, 25 bp, Mus musculus
agctgcattcttttcctattttttc

SEQ ID NO: 181275 - DNA, 25 bp, Mus musculus
agctgcattgacatctgggctacag

SEQ ID NO: 181276 - DNA, 25 bp, Mus musculus
agctgcattgacttctgggctacag

SEQ ID NO: 181277 - DNA, 25 bp, Mus musculus
agctgcattgtaaaactcatgttgt

SEQ ID NO: 181278 - DNA, 25 bp, Mus musculus
agctgcattgtataactcatgttgt

SEQ ID NO: 181279 - DNA, 25 bp, Mus musculus
agctgcatttgaagactgctgtcaa

SEQ ID NO: 181280 - DNA, 25 bp, Mus musculus
agctgcatttgatgactgctgtcaa

SEQ ID NO: 181281 - DNA, 25 bp, Mus musculus
agctgccaaaagaaactccaccgaa

SEQ ID NO: 181282 - DNA, 25 bp, Mus musculus
agctgccaaaagtaactccaccgaa

SEQ ID NO: 181283 - DNA, 25 bp, Mus musculus
agctgccaaagcagtgatggactgt

SEQ ID NO: 181284 - DNA, 25 bp, Mus musculus
agctgccaaagctgtgatggactgt

SEQ ID NO: 181285 - DNA, 25 bp, Mus musculus
agctgccaacacacagttcttccac

SEQ ID NO: 181286 - DNA, 25 bp, Mus musculus
agctgccaacactcagttcttccac

SEQ ID NO: 181287 - DNA, 25 bp, Mus musculus
agctgccaacatcagacagtctggt

SEQ ID NO: 181288 - DNA, 25 bp, Mus musculus
agctgccaacatgagacagtctggt

SEQ ID NO: 181289 - DNA, 25 bp, Mus musculus
agctgccaatatagggcaccccaat

SEQ ID NO: 181290 - DNA, 25 bp, Mus musculus
agctgccaatattgggcaccccaat

SEQ ID NO: 181291 - DNA, 25 bp, Mus musculus
agctgccaatggatacttagatgac

SEQ ID NO: 181292 - DNA, 25 bp, Mus musculus
agctgccaatggttacttagatgac

SEQ ID NO: 181293 - DNA, 25 bp, Mus musculus
agctgccaattacttcctctgtttt

SEQ ID NO: 181294 - DNA, 25 bp, Mus musculus
agctgccaattagttcctctgtttt

SEQ ID NO: 181295 - DNA, 25 bp, Mus musculus
agctgccacacacgctatggctttt

SEQ ID NO: 181296 - DNA, 25 bp, Mus musculus
agctgccacacacggtctgttttaa

SEQ ID NO: 181297 - DNA, 25 bp, Mus musculus
agctgccacacaggctatggctttt

SEQ ID NO: 181298 - DNA, 25 bp, Mus musculus
agctgccacacagggtctgttttaa

SEQ ID NO: 181299 - DNA, 25 bp, Mus musculus
agctgccaccggagtgcgagacctt

SEQ ID NO: 181300 - DNA, 25 bp, Mus musculus
agctgccaccggtgtgcgagacctt

SEQ ID NO: 181301 - DNA, 25 bp, Mus musculus
agctgccacctgagaatgtcactag

SEQ ID NO: 181302 - DNA, 25 bp, Mus musculus
agctgccacctgagacacataagag

SEQ ID NO: 181303 - DNA, 25 bp, Mus musculus
agctgccacctgtgaatgtcactag

SEQ ID NO: 181304 - DNA, 25 bp, Mus musculus
agctgccacctgtgacacataagag

SEQ ID NO: 181305 - DNA, 25 bp, Mus musculus
agctgccactctcagtgggcaagga

SEQ ID NO: 181306 - DNA, 25 bp, Mus musculus
agctgccactctgagtgggcaagga

SEQ ID NO: 181307 - DNA, 25 bp, Mus musculus
agctgccacttgacatagccatatt

SEQ ID NO: 181308 - DNA, 25 bp, Mus musculus
agctgccacttgtcatagccatatt

SEQ ID NO: 181309 - DNA, 25 bp, Mus musculus
agctgccagaatagacgcctactac

SEQ ID NO: 181310 - DNA, 25 bp, Mus musculus
agctgccagaattgacgcctactac

SEQ ID NO: 181311 - DNA, 25 bp, Mus musculus
agctgccagacgcacatgaattcaa

SEQ ID NO: 181312 - DNA, 25 bp, Mus musculus
agctgccagacggacatgaattcaa

SEQ ID NO: 181313 - DNA, 25 bp, Mus musculus
agctgccagactctgtcctgcaata

SEQ ID NO: 181314 - DNA, 25 bp, Mus musculus
agctgccagactgtgtcctgcaata

SEQ ID NO: 181315 - DNA, 25 bp, Mus musculus
agctgccagcagatgaggtggacac

SEQ ID NO: 181316 - DNA, 25 bp, Mus musculus
agctgccagcagttgaggtggacac

SEQ ID NO: 181317 - DNA, 25 bp, Mus musculus
agctgccagctgcagcatggtttta

SEQ ID NO: 181318 - DNA, 25 bp, Mus musculus
agctgccagctggagcatggtttta

SEQ ID NO: 181319 - DNA, 25 bp, Mus musculus
agctgccaggtcactcatgaaggtc

SEQ ID NO: 181320 - DNA, 25 bp, Mus musculus
agctgccaggtctctcatgaaggtc

SEQ ID NO: 181321 - DNA, 25 bp, Mus musculus
agctgccagtatctccataactact

SEQ ID NO: 181322 - DNA, 25 bp, Mus musculus
agctgccagtatgtccataactact

SEQ ID NO: 181323 - DNA, 25 bp, Mus musculus
agctgccagtctaactcacgggtta

SEQ ID NO: 181324 - DNA, 25 bp, Mus musculus
agctgccagtctagctgaggtactc

SEQ ID NO: 181325 - DNA, 25 bp, Mus musculus
agctgccagtctctgggctgctgtc

SEQ ID NO: 181326 - DNA, 25 bp, Mus musculus
agctgccagtctgtgggctgctgtc

SEQ ID NO: 181327 - DNA, 25 bp, Mus musculus
agctgccagtcttactcacgggtta

SEQ ID NO: 181328 - DNA, 25 bp, Mus musculus
agctgccagtcttgctgaggtactc

SEQ ID NO: 181329 - DNA, 25 bp, Mus musculus
agctgccagtgaccacgagacaatg

SEQ ID NO: 181330 - DNA, 25 bp, Mus musculus
agctgccagtgagcacgagacaatg

SEQ ID NO: 181331 - DNA, 25 bp, Mus musculus
agctgccagtgtcaccagtcagtaa

SEQ ID NO: 181332 - DNA, 25 bp, Mus musculus
agctgccagtgtgaccagtcagtaa

SEQ ID NO: 181333 - DNA, 25 bp, Mus musculus
agctgccatgctccacttaatgagg

SEQ ID NO: 181334 - DNA, 25 bp, Mus musculus
agctgccatgctgcacttaatgagg

SEQ ID NO: 181335 - DNA, 25 bp, Mus musculus
agctgccatggaatttgctgccttt

SEQ ID NO: 181336 - DNA, 25 bp, Mus musculus
agctgccatggattttgctgccttt

SEQ ID NO: 181337 - DNA, 25 bp, Mus musculus
agctgccatgggaatttcctttctt

SEQ ID NO: 181338 - DNA, 25 bp, Mus musculus
agctgccatgggtatttcctttctt

SEQ ID NO: 181339 - DNA, 25 bp, Mus musculus
agctgccatgtcacttcaagtcact

SEQ ID NO: 181340 - DNA, 25 bp, Mus musculus
agctgccatgtctcttcaagtcact

SEQ ID NO: 181341 - DNA, 25 bp, Mus musculus
agctgccatgtgcatcctcgaaatt

SEQ ID NO: 181342 - DNA, 25 bp, Mus musculus
agctgccatgtggatcctcgaaatt

SEQ ID NO: 181343 - DNA, 25 bp, Mus musculus
agctgccattgcagtaggcttcttc

SEQ ID NO: 181344 - DNA, 25 bp, Mus musculus
agctgccattgctgtaggcttcttc

SEQ ID NO: 181345 - DNA, 25 bp, Mus musculus
agctgccattggcatgaaccatatg

SEQ ID NO: 181346 - DNA, 25 bp, Mus musculus
agctgccattgggatgaaccatatg

SEQ ID NO: 181347 - DNA, 25 bp, Mus musculus
agctgccatttcaaaccatgcttgt

SEQ ID NO: 181348 - DNA, 25 bp, Mus musculus
agctgccatttctaaccatgcttgt

SEQ ID NO: 181349 - DNA, 25 bp, Mus musculus
agctgccatttgatttcctaacttg

SEQ ID NO: 181350 - DNA, 25 bp, Mus musculus
agctgccatttgttttcctaacttg

SEQ ID NO: 181351 - DNA, 25 bp, Mus musculus
agctgcccaaaaatatagagataga

SEQ ID NO: 181352 - DNA, 25 bp, Mus musculus
agctgcccaaaattatagagataga

SEQ ID NO: 181353 - DNA, 25 bp, Mus musculus
agctgcccaaagacgcatctgtttg

SEQ ID NO: 181354 - DNA, 25 bp, Mus musculus
agctgcccaaagtcgcatctgtttg

SEQ ID NO: 181355 - DNA, 25 bp, Mus musculus
agctgcccacctcgagaggcatttg

SEQ ID NO: 181356 - DNA, 25 bp, Mus musculus
agctgcccacctggagaggcatttg

SEQ ID NO: 181357 - DNA, 25 bp, Mus musculus
agctgcccagaacagacactgctgt

SEQ ID NO: 181358 - DNA, 25 bp, Mus musculus
agctgcccagaagagacactgctgt

SEQ ID NO: 181359 - DNA, 25 bp, Mus musculus
agctgcccagagaagttcaagacca

SEQ ID NO: 181360 - DNA, 25 bp, Mus musculus
agctgcccagagtagttcaagacca

SEQ ID NO: 181361 - DNA, 25 bp, Mus musculus
agctgcccagctctcaaggtcagac

SEQ ID NO: 181362 - DNA, 25 bp, Mus musculus
agctgcccagctgtcaaggtcagac

SEQ ID NO: 181363 - DNA, 25 bp, Mus musculus
agctgcccaggcaacttacagtggc

SEQ ID NO: 181364 - DNA, 25 bp, Mus musculus
agctgcccaggcaagacgtaggcta

SEQ ID NO: 181365 - DNA, 25 bp, Mus musculus
agctgcccaggctacttacagtggc

SEQ ID NO: 181366 - DNA, 25 bp, Mus musculus
agctgcccaggctagacgtaggcta

SEQ ID NO: 181367 - DNA, 25 bp, Mus musculus
agctgcccagtacattgggctgttt

SEQ ID NO: 181368 - DNA, 25 bp, Mus musculus
agctgcccagtagattgggctgttt

SEQ ID NO: 181369 - DNA, 25 bp, Mus musculus
agctgcccatttagtgagattttta

SEQ ID NO: 181370 - DNA, 25 bp, Mus musculus
agctgcccattttgtgagattttta

SEQ ID NO: 181371 - DNA, 25 bp, Mus musculus
agctgccccaagcacagtggtctga

SEQ ID NO: 181372 - DNA, 25 bp, Mus musculus
agctgccccaaggacagtggtctga

SEQ ID NO: 181373 - DNA, 25 bp, Mus musculus
agctgcccctgcaagtaattgggaa

SEQ ID NO: 181374 - DNA, 25 bp, Mus musculus
agctgcccctgctagtaattgggaa

SEQ ID NO: 181375 - DNA, 25 bp, Mus musculus
agctgcccggtgctgcgtgtgcgaa

SEQ ID NO: 181376 - DNA, 25 bp, Mus musculus
agctgcccggtggtgcgtgtgcgaa

SEQ ID NO: 181377 - DNA, 25 bp, Mus musculus
agctgccctaaaaaacccttcaaca

SEQ ID NO: 181378 - DNA, 25 bp, Mus musculus
agctgccctaaataacccttcaaca

SEQ ID NO: 181379 - DNA, 25 bp, Mus musculus
agctgccctataatctgggacaggc

SEQ ID NO: 181380 - DNA, 25 bp, Mus musculus
agctgccctatattctgggacaggc

SEQ ID NO: 181381 - DNA, 25 bp, Mus musculus
agctgccctatgatgactgtgtgtt

SEQ ID NO: 181382 - DNA, 25 bp, Mus musculus
agctgccctatgttgactgtgtgtt

SEQ ID NO: 181383 - DNA, 25 bp, Mus musculus
agctgccctcagagcggtggaaccc

SEQ ID NO: 181384 - DNA, 25 bp, Mus musculus
agctgccctcagtgcggtggaaccc

SEQ ID NO: 181385 - DNA, 25 bp, Mus musculus
agctgccctcatcggcctctgagaa

SEQ ID NO: 181386 - DNA, 25 bp, Mus musculus
agctgccctcatgggcctctgagaa

SEQ ID NO: 181387 - DNA, 25 bp, Mus musculus
agctgccctctcaaattttgatgac

SEQ ID NO: 181388 - DNA, 25 bp, Mus musculus
agctgccctctctaattttgatgac

SEQ ID NO: 181389 - DNA, 25 bp, Mus musculus
agctgccctgggatctaagtttagg

SEQ ID NO: 181390 - DNA, 25 bp, Mus musculus
agctgccctgggttctaagtttagg

SEQ ID NO: 181391 - DNA, 25 bp, Mus musculus
agctgccctggtattatatgacatt

SEQ ID NO: 181392 - DNA, 25 bp, Mus musculus
agctgccctggttttatatgacatt

SEQ ID NO: 181393 - DNA, 25 bp, Mus musculus
agctgccctgtcatgcagactgaat

SEQ ID NO: 181394 - DNA, 25 bp, Mus musculus
agctgccctgtcttgcagactgaat

SEQ ID NO: 181395 - DNA, 25 bp, Mus musculus
agctgccctgtgatgggtgagccat

SEQ ID NO: 181396 - DNA, 25 bp, Mus musculus
agctgccctgtgttgggtgagccat

SEQ ID NO: 181397 - DNA, 25 bp, Mus musculus
agctgcccttgaaaacgtttgtgta

SEQ ID NO: 181398 - DNA, 25 bp, Mus musculus
agctgcccttgataacgtttgtgta

SEQ ID NO: 181399 - DNA, 25 bp, Mus musculus
agctgcccttggctatgtgctacca

SEQ ID NO: 181400 - DNA, 25 bp, Mus musculus
agctgcccttgggtatgtgctacca

SEQ ID NO: 181401 - DNA, 25 bp, Mus musculus
agctgccctttaccattggattcga

SEQ ID NO: 181402 - DNA, 25 bp, Mus musculus
agctgccctttagcattggattcga

SEQ ID NO: 181403 - DNA, 25 bp, Mus musculus
agctgccgagtgagttgatcctcct

SEQ ID NO: 181404 - DNA, 25 bp, Mus musculus
agctgccgagtgtgttgatcctcct

SEQ ID NO: 181405 - DNA, 25 bp, Mus musculus
agctgccgcatcctgcacgagtaca

SEQ ID NO: 181406 - DNA, 25 bp, Mus musculus
agctgccgcatcgtgcacgagtaca

SEQ ID NO: 181407 - DNA, 25 bp, Mus musculus
agctgccgggagcatgaagtcatcc

SEQ ID NO: 181408 - DNA, 25 bp, Mus musculus
agctgccgggaggatgaagtcatcc

SEQ ID NO: 181409 - DNA, 25 bp, Mus musculus
agctgccgggcactgtagaaattct

SEQ ID NO: 181410 - DNA, 25 bp, Mus musculus
agctgccgggcagtgtagaaattct

SEQ ID NO: 181411 - DNA, 25 bp, Mus musculus
agctgccgggctccctgttgttttg

SEQ ID NO: 181412 - DNA, 25 bp, Mus musculus
agctgccgggctgcctgttgttttg

SEQ ID NO: 181413 - DNA, 25 bp, Mus musculus
agctgccgttttctaaccctcaatg

SEQ ID NO: 181414 - DNA, 25 bp, Mus musculus
agctgccgttttgtaaccctcaatg

SEQ ID NO: 181415 - DNA, 25 bp, Mus musculus
agctgcctaacacactctgaacttt

SEQ ID NO: 181416 - DNA, 25 bp, Mus musculus
agctgcctaacagactctgaacttt

SEQ ID NO: 181417 - DNA, 25 bp, Mus musculus
agctgcctacaactctgaagatttg

SEQ ID NO: 181418 - DNA, 25 bp, Mus musculus
agctgcctacaagtctgaagatttg

SEQ ID NO: 181419 - DNA, 25 bp, Mus musculus
agctgcctacatcttttgttctttt

SEQ ID NO: 181420 - DNA, 25 bp, Mus musculus
agctgcctacatgttttgttctttt

SEQ ID NO: 181421 - DNA, 25 bp, Mus musculus
agctgcctacctctgaaagtctcaa

SEQ ID NO: 181422 - DNA, 25 bp, Mus musculus
agctgcctacctgtgaaagtctcaa

SEQ ID NO: 181423 - DNA, 25 bp, Mus musculus
agctgcctacttcattcatcataga

SEQ ID NO: 181424 - DNA, 25 bp, Mus musculus
agctgcctacttgattcatcataga

SEQ ID NO: 181425 - DNA, 25 bp, Mus musculus
agctgcctaggaatccctgaaggga

SEQ ID NO: 181426 - DNA, 25 bp, Mus musculus
agctgcctaggattccctgaaggga

SEQ ID NO: 181427 - DNA, 25 bp, Mus musculus
agctgcctagggagtggaagccact

SEQ ID NO: 181428 - DNA, 25 bp, Mus musculus
agctgcctagggtgtggaagccact

SEQ ID NO: 181429 - DNA, 25 bp, Mus musculus
agctgcctaggtctctgttatcaca

SEQ ID NO: 181430 - DNA, 25 bp, Mus musculus
agctgcctaggtgtctgttatcaca

SEQ ID NO: 181431 - DNA, 25 bp, Mus musculus
agctgcctcacaaggatccaatcaa

SEQ ID NO: 181432 - DNA, 25 bp, Mus musculus
agctgcctcacacttactgtgtgga

SEQ ID NO: 181433 - DNA, 25 bp, Mus musculus
agctgcctcacagttactgtgtgga

SEQ ID NO: 181434 - DNA, 25 bp, Mus musculus
agctgcctcacatggatccaatcaa

SEQ ID NO: 181435 - DNA, 25 bp, Mus musculus
agctgcctcaccatgtactatataa

SEQ ID NO: 181436 - DNA, 25 bp, Mus musculus
agctgcctcaccttgtactatataa

SEQ ID NO: 181437 - DNA, 25 bp, Mus musculus
agctgcctcagaccaacttggaagt

SEQ ID NO: 181438 - DNA, 25 bp, Mus musculus
agctgcctcagagcaacttggaagt

SEQ ID NO: 181439 - DNA, 25 bp, Mus musculus
agctgcctcagccagttgtcattga

SEQ ID NO: 181440 - DNA, 25 bp, Mus musculus
agctgcctcagcgagttgtcattga

SEQ ID NO: 181441 - DNA, 25 bp, Mus musculus
agctgcctcaggcaagttctccagt

SEQ ID NO: 181442 - DNA, 25 bp, Mus musculus
agctgcctcagggaagttctccagt

SEQ ID NO: 181443 - DNA, 25 bp, Mus musculus
agctgcctccaactgtgagccaggc

SEQ ID NO: 181444 - DNA, 25 bp, Mus musculus
agctgcctccaagtgtgagccaggc

SEQ ID NO: 181445 - DNA, 25 bp, Mus musculus
agctgcctcctcatagaggacctgt

SEQ ID NO: 181446 - DNA, 25 bp, Mus musculus
agctgcctcctcttagaggacctgt

SEQ ID NO: 181447 - DNA, 25 bp, Mus musculus
agctgcctcctgatttcatctttgg

SEQ ID NO: 181448 - DNA, 25 bp, Mus musculus
agctgcctcctgttttcatctttgg

SEQ ID NO: 181449 - DNA, 25 bp, Mus musculus
agctgcctccttaaaagcttggtgc

SEQ ID NO: 181450 - DNA, 25 bp, Mus musculus
agctgcctccttcgctgcaagacaa

SEQ ID NO: 181451 - DNA, 25 bp, Mus musculus
agctgcctccttggctgcaagacaa

SEQ ID NO: 181452 - DNA, 25 bp, Mus musculus
agctgcctcctttaaagcttggtgc

SEQ ID NO: 181453 - DNA, 25 bp, Mus musculus
agctgcctctagcttcttagcagag

SEQ ID NO: 181454 - DNA, 25 bp, Mus musculus
agctgcctctaggttcttagcagag

SEQ ID NO: 181455 - DNA, 25 bp, Mus musculus
agctgcctgagacagaccatatttg

SEQ ID NO: 181456 - DNA, 25 bp, Mus musculus
agctgcctgagagagaccatatttg

SEQ ID NO: 181457 - DNA, 25 bp, Mus musculus
agctgcctgattagtttatctattc

SEQ ID NO: 181458 - DNA, 25 bp, Mus musculus
agctgcctgatttgtttatctattc

SEQ ID NO: 181459 - DNA, 25 bp, Mus musculus
agctgcctgccgcatggctacaaat

SEQ ID NO: 181460 - DNA, 25 bp, Mus musculus
agctgcctgccggatggctacaaat

SEQ ID NO: 181461 - DNA, 25 bp, Mus musculus
agctgcctgcgaatcaaacttaatt

SEQ ID NO: 181462 - DNA, 25 bp, Mus musculus
agctgcctgcgattcaaacttaatt

SEQ ID NO: 181463 - DNA, 25 bp, Mus musculus
agctgcctgcgtccatgtatgtatg

SEQ ID NO: 181464 - DNA, 25 bp, Mus musculus
agctgcctgcgtgcatgtatgtatg

SEQ ID NO: 181465 - DNA, 25 bp, Mus musculus
agctgcctgctgctatctgctttca

SEQ ID NO: 181466 - DNA, 25 bp, Mus musculus
agctgcctgctggtatctgctttca

SEQ ID NO: 181467 - DNA, 25 bp, Mus musculus
agctgcctggctactattgaaaaga

SEQ ID NO: 181468 - DNA, 25 bp, Mus musculus
agctgcctggcttctattgaaaaga

SEQ ID NO: 181469 - DNA, 25 bp, Mus musculus
agctgcctgggtcaaggtgccctct

SEQ ID NO: 181470 - DNA, 25 bp, Mus musculus
agctgcctgggtgaaggtgccctct

SEQ ID NO: 181471 - DNA, 25 bp, Mus musculus
agctgcctggttattcttcgtatga

SEQ ID NO: 181472 - DNA, 25 bp, Mus musculus
agctgcctggtttttcttcgtatga

SEQ ID NO: 181473 - DNA, 25 bp, Mus musculus
agctgcctgtgacgtgctcctttgg

SEQ ID NO: 181474 - DNA, 25 bp, Mus musculus
agctgcctgtgaggtgctcctttgg

SEQ ID NO: 181475 - DNA, 25 bp, Mus musculus
agctgcctgtgcctacaaactctcg

SEQ ID NO: 181476 - DNA, 25 bp, Mus musculus
agctgcctgtgcgtacaaactctcg

SEQ ID NO: 181477 - DNA, 25 bp, Mus musculus
agctgccttactcataccattcaag

SEQ ID NO: 181478 - DNA, 25 bp, Mus musculus
agctgccttactgataccattcaag

SEQ ID NO: 181479 - DNA, 25 bp, Mus musculus
agctgccttagccattacacaagtg

SEQ ID NO: 181480 - DNA, 25 bp, Mus musculus
agctgccttagcgattacacaagtg

SEQ ID NO: 181481 - DNA, 25 bp, Mus musculus
agctgccttatcaagattgtctcaa

SEQ ID NO: 181482 - DNA, 25 bp, Mus musculus
agctgccttatctagattgtctcaa

SEQ ID NO: 181483 - DNA, 25 bp, Mus musculus
agctgccttattacagtgtgaacag

SEQ ID NO: 181484 - DNA, 25 bp, Mus musculus
agctgccttatttcagtgtgaacag

SEQ ID NO: 181485 - DNA, 25 bp, Mus musculus
agctgccttcatatttgtcctgatg

SEQ ID NO: 181486 - DNA, 25 bp, Mus musculus
agctgccttcatttttgtcctgatg

SEQ ID NO: 181487 - DNA, 25 bp, Mus musculus
agctgccttgcacaagggtccttct

SEQ ID NO: 181488 - DNA, 25 bp, Mus musculus
agctgccttgcagaagggtccttct

SEQ ID NO: 181489 - DNA, 25 bp, Mus musculus
agctgccttgggatgggatgacctc

SEQ ID NO: 181490 - DNA, 25 bp, Mus musculus
agctgccttgggttgggatgacctc

SEQ ID NO: 181491 - DNA, 25 bp, Mus musculus
agctgccttgtactgctgggccaca

SEQ ID NO: 181492 - DNA, 25 bp, Mus musculus
agctgccttgtagtgctgggccaca

SEQ ID NO: 181493 - DNA, 25 bp, Mus musculus
agctgcctttgaacaggtcgctgtc

SEQ ID NO: 181494 - DNA, 25 bp, Mus musculus
agctgcctttgatcaggtcgctgtc

SEQ ID NO: 181495 - DNA, 25 bp, Mus musculus
agctgcctttgtcaatcagccgctc

SEQ ID NO: 181496 - DNA, 25 bp, Mus musculus
agctgcctttgtgaatcagccgctc

SEQ ID NO: 181497 - DNA, 25 bp, Mus musculus
agctgcgaacgaccgctaggccttc

SEQ ID NO: 181498 - DNA, 25 bp, Mus musculus
agctgcgaacgagcgctaggccttc

SEQ ID NO: 181499 - DNA, 25 bp, Mus musculus
agctgcgaacttcatgatgtcctgt

SEQ ID NO: 181500 - DNA, 25 bp, Mus musculus
agctgcgaacttgatgatgtcctgt

SEQ ID NO: 181501 - DNA, 25 bp, Mus musculus
agctgcgaagggacttgccctctgg

SEQ ID NO: 181502 - DNA, 25 bp, Mus musculus
agctgcgaagggtcttgccctctgg

SEQ ID NO: 181503 - DNA, 25 bp, Mus musculus
agctgcgaagtgagtatgaactccc

SEQ ID NO: 181504 - DNA, 25 bp, Mus musculus
agctgcgaagtgtgtatgaactccc

SEQ ID NO: 181505 - DNA, 25 bp, Mus musculus
agctgcgaccacagcagtgatcagg

SEQ ID NO: 181506 - DNA, 25 bp, Mus musculus
agctgcgaccactgcagtgatcagg

SEQ ID NO: 181507 - DNA, 25 bp, Mus musculus
agctgcgacggcacagcgtcctgta

SEQ ID NO: 181508 - DNA, 25 bp, Mus musculus
agctgcgacggctcagcgtcctgta

SEQ ID NO: 181509 - DNA, 25 bp, Mus musculus
agctgcgacgtactgtcactgaaga

SEQ ID NO: 181510 - DNA, 25 bp, Mus musculus
agctgcgacgtagtgtcactgaaga

SEQ ID NO: 181511 - DNA, 25 bp, Mus musculus
agctgcgcatatcttgggatcttca

SEQ ID NO: 181512 - DNA, 25 bp, Mus musculus
agctgcgcatatgttgggatcttca

SEQ ID NO: 181513 - DNA, 25 bp, Mus musculus
agctgcgcatggagccactgggcct

SEQ ID NO: 181514 - DNA, 25 bp, Mus musculus
agctgcgcatggtgccactgggcct

SEQ ID NO: 181515 - DNA, 25 bp, Mus musculus
agctgcgcatgtacctgactatggc

SEQ ID NO: 181516 - DNA, 25 bp, Mus musculus
agctgcgcatgttcctgactatggc

SEQ ID NO: 181517 - DNA, 25 bp, Mus musculus
agctgcgccatcagcagttggctca

SEQ ID NO: 181518 - DNA, 25 bp, Mus musculus
agctgcgccatctgcagttggctca

SEQ ID NO: 181519 - DNA, 25 bp, Mus musculus
agctgcgccctcagtgaggtaacca

SEQ ID NO: 181520 - DNA, 25 bp, Mus musculus
agctgcgccctctgtgaggtaacca

SEQ ID NO: 181521 - DNA, 25 bp, Mus musculus
agctgcgccgtgcagtttcttagaa

SEQ ID NO: 181522 - DNA, 25 bp, Mus musculus
agctgcgccgtggagtttcttagaa

SEQ ID NO: 181523 - DNA, 25 bp, Mus musculus
agctgcgctgttaggatgggccttt

SEQ ID NO: 181524 - DNA, 25 bp, Mus musculus
agctgcgctgttcctgtctgggatt

SEQ ID NO: 181525 - DNA, 25 bp, Mus musculus
agctgcgctgttgctgtctgggatt

SEQ ID NO: 181526 - DNA, 25 bp, Mus musculus
agctgcgctgtttggatgggccttt

SEQ ID NO: 181527 - DNA, 25 bp, Mus musculus
agctgcggcaacataactttattct

SEQ ID NO: 181528 - DNA, 25 bp, Mus musculus
agctgcggcaacttaactttattct

SEQ ID NO: 181529 - DNA, 25 bp, Mus musculus
agctgcggcggcagacacgcctctt

SEQ ID NO: 181530 - DNA, 25 bp, Mus musculus
agctgcggcggctgacacgcctctt

SEQ ID NO: 181531 - DNA, 25 bp, Mus musculus
agctgcggcgtgagtggtcagatac

SEQ ID NO: 181532 - DNA, 25 bp, Mus musculus
agctgcggcgtgtgtggtcagatac

SEQ ID NO: 181533 - DNA, 25 bp, Mus musculus
agctgcggctgcagtatgagtgcaa

SEQ ID NO: 181534 - DNA, 25 bp, Mus musculus
agctgcggctgctgtatgagtgcaa

SEQ ID NO: 181535 - DNA, 25 bp, Mus musculus
agctgcgggccaaattctgggactt

SEQ ID NO: 181536 - DNA, 25 bp, Mus musculus
agctgcgggccaagagccgggacat

SEQ ID NO: 181537 - DNA, 25 bp, Mus musculus
agctgcgggccatattctgggactt

SEQ ID NO: 181538 - DNA, 25 bp, Mus musculus
agctgcgggccatgagccgggacat

SEQ ID NO: 181539 - DNA, 25 bp, Mus musculus
agctgcggtacaattgcccaagttg

SEQ ID NO: 181540 - DNA, 25 bp, Mus musculus
agctgcggtacatttgcccaagttg

SEQ ID NO: 181541 - DNA, 25 bp, Mus musculus
agctgcggtcgaaactcatgaaact

SEQ ID NO: 181542 - DNA, 25 bp, Mus musculus
agctgcggtcgatactcatgaaact

SEQ ID NO: 181543 - DNA, 25 bp, Mus musculus
agctgcggtgctatctgccctatgt

SEQ ID NO: 181544 - DNA, 25 bp, Mus musculus
agctgcggtgctttctgccctatgt

SEQ ID NO: 181545 - DNA, 25 bp, Mus musculus
agctgcggttcaacatctatacctt

SEQ ID NO: 181546 - DNA, 25 bp, Mus musculus
agctgcggttcatcatctatacctt

SEQ ID NO: 181547 - DNA, 25 bp, Mus musculus
agctgcgtacacaggaggactgcga

SEQ ID NO: 181548 - DNA, 25 bp, Mus musculus
agctgcgtacactggaggactgcga

SEQ ID NO: 181549 - DNA, 25 bp, Mus musculus
agctgcgtcactcggcatctgagat

SEQ ID NO: 181550 - DNA, 25 bp, Mus musculus
agctgcgtcactgggcatctgagat

SEQ ID NO: 181551 - DNA, 25 bp, Mus musculus
agctgcgtcccaaacattgttaaat

SEQ ID NO: 181552 - DNA, 25 bp, Mus musculus
agctgcgtcccatacattgttaaat

SEQ ID NO: 181553 - DNA, 25 bp, Mus musculus
agctgcgtccccagggcgataagaa

SEQ ID NO: 181554 - DNA, 25 bp, Mus musculus
agctgcgtcccctgggcgataagaa

SEQ ID NO: 181555 - DNA, 25 bp, Mus musculus
agctgcgttaaacggtcgtatgaat

SEQ ID NO: 181556 - DNA, 25 bp, Mus musculus
agctgcgttaaagggtcgtatgaat

SEQ ID NO: 181557 - DNA, 25 bp, Mus musculus
agctgcgttcacaccagtgtattga

SEQ ID NO: 181558 - DNA, 25 bp, Mus musculus
agctgcgttcactccagtgtattga

SEQ ID NO: 181559 - DNA, 25 bp, Mus musculus
agctgctaacatacaccagattttg

SEQ ID NO: 181560 - DNA, 25 bp, Mus musculus
agctgctaacattcaccagattttg

SEQ ID NO: 181561 - DNA, 25 bp, Mus musculus
agctgctaagatcggctatcggctc

SEQ ID NO: 181562 - DNA, 25 bp, Mus musculus
agctgctaagatgggctatcggctc

SEQ ID NO: 181563 - DNA, 25 bp, Mus musculus
agctgctacagcaggcatgatgacg

SEQ ID NO: 181564 - DNA, 25 bp, Mus musculus
agctgctacagctggcatgatgacg

SEQ ID NO: 181565 - DNA, 25 bp, Mus musculus
agctgctaccgcagcaaaaacagtg

SEQ ID NO: 181566 - DNA, 25 bp, Mus musculus
agctgctaccgctgcaaaaacagtg

SEQ ID NO: 181567 - DNA, 25 bp, Mus musculus
agctgctacgggataggaaattgta

SEQ ID NO: 181568 - DNA, 25 bp, Mus musculus
agctgctacgggttaggaaattgta

SEQ ID NO: 181569 - DNA, 25 bp, Mus musculus
agctgctactgcacaggctgatgtc

SEQ ID NO: 181570 - DNA, 25 bp, Mus musculus
agctgctactgctcaggctgatgtc

SEQ ID NO: 181571 - DNA, 25 bp, Mus musculus
agctgctagatacgtctgacatcca

SEQ ID NO: 181572 - DNA, 25 bp, Mus musculus
agctgctagataggtctgacatcca

SEQ ID NO: 181573 - DNA, 25 bp, Mus musculus
agctgctaggacaccagttgcaggg

SEQ ID NO: 181574 - DNA, 25 bp, Mus musculus
agctgctaggactccagttgcaggg

SEQ ID NO: 181575 - DNA, 25 bp, Mus musculus
agctgctaggtgctggctaccgcat

SEQ ID NO: 181576 - DNA, 25 bp, Mus musculus
agctgctaggtggtggctaccgcat

SEQ ID NO: 181577 - DNA, 25 bp, Mus musculus
agctgctagtgcagaccgggcaaag

SEQ ID NO: 181578 - DNA, 25 bp, Mus musculus
agctgctagtgctgaccgggcaaag

SEQ ID NO: 181579 - DNA, 25 bp, Mus musculus
agctgctatcccacaagcttggtgg

SEQ ID NO: 181580 - DNA, 25 bp, Mus musculus
agctgctatccctcaagcttggtgg

SEQ ID NO: 181581 - DNA, 25 bp, Mus musculus
agctgctatggcaggagctccgcag

SEQ ID NO: 181582 - DNA, 25 bp, Mus musculus
agctgctatggctggagctccgcag

SEQ ID NO: 181583 - DNA, 25 bp, Mus musculus
agctgctattgcagcaaccacatgt

SEQ ID NO: 181584 - DNA, 25 bp, Mus musculus
agctgctattgctgcaaccacatgt

SEQ ID NO: 181585 - DNA, 25 bp, Mus musculus
agctgctcaaagaggacgtccagga

SEQ ID NO: 181586 - DNA, 25 bp, Mus musculus
agctgctcaaagtggacgtccagga

SEQ ID NO: 181587 - DNA, 25 bp, Mus musculus
agctgctcaacgagggcttcctaga

SEQ ID NO: 181588 - DNA, 25 bp, Mus musculus
agctgctcaacgtgggcttcctaga

SEQ ID NO: 181589 - DNA, 25 bp, Mus musculus
agctgctcacaaccttcagttccag

SEQ ID NO: 181590 - DNA, 25 bp, Mus musculus
agctgctcacaacgagatcctggtg

SEQ ID NO: 181591 - DNA, 25 bp, Mus musculus
agctgctcacaagcttcagttccag

SEQ ID NO: 181592 - DNA, 25 bp, Mus musculus
agctgctcacaaggagatcctggtg

SEQ ID NO: 181593 - DNA, 25 bp, Mus musculus
agctgctcacacatccacagagtgg

SEQ ID NO: 181594 - DNA, 25 bp, Mus musculus
agctgctcacacttccacagagtgg

SEQ ID NO: 181595 - DNA, 25 bp, Mus musculus
agctgctcacttactgtgactcaga

SEQ ID NO: 181596 - DNA, 25 bp, Mus musculus
agctgctcactttctgtgactcaga

SEQ ID NO: 181597 - DNA, 25 bp, Mus musculus
agctgctcagagagggtagctagcc

SEQ ID NO: 181598 - DNA, 25 bp, Mus musculus
agctgctcagagtgggtagctagcc

SEQ ID NO: 181599 - DNA, 25 bp, Mus musculus
agctgctcagtgaagtcaccacact

SEQ ID NO: 181600 - DNA, 25 bp, Mus musculus
agctgctcagtgtagtcaccacact

SEQ ID NO: 181601 - DNA, 25 bp, Mus musculus
agctgctcatcgagagtccatgaca

SEQ ID NO: 181602 - DNA, 25 bp, Mus musculus
agctgctcatcgtgagtccatgaca

SEQ ID NO: 181603 - DNA, 25 bp, Mus musculus
agctgctcatttcccacaaggacag

SEQ ID NO: 181604 - DNA, 25 bp, Mus musculus
agctgctcatttgccacaaggacag

SEQ ID NO: 181605 - DNA, 25 bp, Mus musculus
agctgctccccaagtgttcatatgt

SEQ ID NO: 181606 - DNA, 25 bp, Mus musculus
agctgctccccatgtgttcatatgt

SEQ ID NO: 181607 - DNA, 25 bp, Mus musculus
agctgctccccgcagtaaaggcgca

SEQ ID NO: 181608 - DNA, 25 bp, Mus musculus
agctgctccccggagtaaaggcgca

SEQ ID NO: 181609 - DNA, 25 bp, Mus musculus
agctgctccgagcaatgtagtgccc

SEQ ID NO: 181610 - DNA, 25 bp, Mus musculus
agctgctccgaggaatgtagtgccc

SEQ ID NO: 181611 - DNA, 25 bp, Mus musculus
agctgctcctacaggcctttaaata

SEQ ID NO: 181612 - DNA, 25 bp, Mus musculus
agctgctcctactggcctttaaata

SEQ ID NO: 181613 - DNA, 25 bp, Mus musculus
agctgctcctagatcgtcgttgact

SEQ ID NO: 181614 - DNA, 25 bp, Mus musculus
agctgctcctagttcgtcgttgact

SEQ ID NO: 181615 - DNA, 25 bp, Mus musculus
agctgctcctcaatcagagacaggg

SEQ ID NO: 181616 - DNA, 25 bp, Mus musculus
agctgctcctcattcagagacaggg

SEQ ID NO: 181617 - DNA, 25 bp, Mus musculus
agctgctcctctagtggaccaaggt

SEQ ID NO: 181618 - DNA, 25 bp, Mus musculus
agctgctcctctatgtgcatttcaa

SEQ ID NO: 181619 - DNA, 25 bp, Mus musculus
agctgctcctcttgtggaccaaggt

SEQ ID NO: 181620 - DNA, 25 bp, Mus musculus
agctgctcctctttgtgcatttcaa

SEQ ID NO: 181621 - DNA, 25 bp, Mus musculus
agctgctcctgaagttgtggatgga

SEQ ID NO: 181622 - DNA, 25 bp, Mus musculus
agctgctcctgatgttgtggatgga

SEQ ID NO: 181623 - DNA, 25 bp, Mus musculus
agctgctcctgtcaaacctgcacta

SEQ ID NO: 181624 - DNA, 25 bp, Mus musculus
agctgctcctgtgaaacctgcacta

SEQ ID NO: 181625 - DNA, 25 bp, Mus musculus
agctgctcgcacagacctgtgggaa

SEQ ID NO: 181626 - DNA, 25 bp, Mus musculus
agctgctcgcactgacctgtgggaa

SEQ ID NO: 181627 - DNA, 25 bp, Mus musculus
agctgctcgttgacatctggtctct

SEQ ID NO: 181628 - DNA, 25 bp, Mus musculus
agctgctcgttgtcatctggtctct

SEQ ID NO: 181629 - DNA, 25 bp, Mus musculus
agctgctctacactgtaccggacag

SEQ ID NO: 181630 - DNA, 25 bp, Mus musculus
agctgctctacagtgtaccggacag

SEQ ID NO: 181631 - DNA, 25 bp, Mus musculus
agctgctctagactcttctgggaat

SEQ ID NO: 181632 - DNA, 25 bp, Mus musculus
agctgctctagagtcttctgggaat

SEQ ID NO: 181633 - DNA, 25 bp, Mus musculus
agctgctctagccaatgactttgac

SEQ ID NO: 181634 - DNA, 25 bp, Mus musculus
agctgctctagcgaatgactttgac

SEQ ID NO: 181635 - DNA, 25 bp, Mus musculus
agctgctctatccagtgtccagatt

SEQ ID NO: 181636 - DNA, 25 bp, Mus musculus
agctgctctatcgagtgtccagatt

SEQ ID NO: 181637 - DNA, 25 bp, Mus musculus
agctgctctccaagccaaagttcag

SEQ ID NO: 181638 - DNA, 25 bp, Mus musculus
agctgctctccatgccaaagttcag

SEQ ID NO: 181639 - DNA, 25 bp, Mus musculus
agctgctctccccaataagagcatg

SEQ ID NO: 181640 - DNA, 25 bp, Mus musculus
agctgctctcccgaataagagcatg

SEQ ID NO: 181641 - DNA, 25 bp, Mus musculus
agctgctctctgaccggacagggtc

SEQ ID NO: 181642 - DNA, 25 bp, Mus musculus
agctgctctctgactgggtggcatc

SEQ ID NO: 181643 - DNA, 25 bp, Mus musculus
agctgctctctgtccggacagggtc

SEQ ID NO: 181644 - DNA, 25 bp, Mus musculus
agctgctctctgtctgggtggcatc

SEQ ID NO: 181645 - DNA, 25 bp, Mus musculus
agctgctctgacaagcaatatatag

SEQ ID NO: 181646 - DNA, 25 bp, Mus musculus
agctgctctgaccaaacctgtgtag

SEQ ID NO: 181647 - DNA, 25 bp, Mus musculus
agctgctctgacgaaacctgtgtag

SEQ ID NO: 181648 - DNA, 25 bp, Mus musculus
agctgctctgactagcaatatatag

SEQ ID NO: 181649 - DNA, 25 bp, Mus musculus
agctgctctgagatctatcattcat

SEQ ID NO: 181650 - DNA, 25 bp, Mus musculus
agctgctctgagttctatcattcat

SEQ ID NO: 181651 - DNA, 25 bp, Mus musculus
agctgctctgctagaacgcacatgg

SEQ ID NO: 181652 - DNA, 25 bp, Mus musculus
agctgctctgctcgtggcagtgtca

SEQ ID NO: 181653 - DNA, 25 bp, Mus musculus
agctgctctgctctggctagccaat

SEQ ID NO: 181654 - DNA, 25 bp, Mus musculus
agctgctctgctggtggcagtgtca

SEQ ID NO: 181655 - DNA, 25 bp, Mus musculus
agctgctctgctgtggctagccaat

SEQ ID NO: 181656 - DNA, 25 bp, Mus musculus
agctgctctgcttgaacgcacatgg

SEQ ID NO: 181657 - DNA, 25 bp, Mus musculus
agctgctctgtcctcggcagagatg

SEQ ID NO: 181658 - DNA, 25 bp, Mus musculus
agctgctctgtcgtcggcagagatg

SEQ ID NO: 181659 - DNA, 25 bp, Mus musculus
agctgctctgtgcttagccccagag

SEQ ID NO: 181660 - DNA, 25 bp, Mus musculus
agctgctctgtggttagccccagag

SEQ ID NO: 181661 - DNA, 25 bp, Mus musculus
agctgctcttccacgggtcctaagt

SEQ ID NO: 181662 - DNA, 25 bp, Mus musculus
agctgctcttcctcgggtcctaagt

SEQ ID NO: 181663 - DNA, 25 bp, Mus musculus
agctgctcttctagtcacaatcttt

SEQ ID NO: 181664 - DNA, 25 bp, Mus musculus
agctgctcttcttgtcacaatcttt

SEQ ID NO: 181665 - DNA, 25 bp, Mus musculus
agctgctcttgaactagctctgagc

SEQ ID NO: 181666 - DNA, 25 bp, Mus musculus
agctgctcttgatctagctctgagc

SEQ ID NO: 181667 - DNA, 25 bp, Mus musculus
agctgctcttggcttggccacaaag

SEQ ID NO: 181668 - DNA, 25 bp, Mus musculus
agctgctcttgggttggccacaaag

SEQ ID NO: 181669 - DNA, 25 bp, Mus musculus
agctgctcttgtacaatactagtta

SEQ ID NO: 181670 - DNA, 25 bp, Mus musculus
agctgctcttgttcaatactagtta

SEQ ID NO: 181671 - DNA, 25 bp, Mus musculus
agctgctgaaatcacaggagtgctg

SEQ ID NO: 181672 - DNA, 25 bp, Mus musculus
agctgctgaaatgacaggagtgctg

SEQ ID NO: 181673 - DNA, 25 bp, Mus musculus
agctgctgaacacgtgctagcacca

SEQ ID NO: 181674 - DNA, 25 bp, Mus musculus
agctgctgaacaggtgctagcacca

SEQ ID NO: 181675 - DNA, 25 bp, Mus musculus
agctgctgaagaagtaccccatcgt

SEQ ID NO: 181676 - DNA, 25 bp, Mus musculus
agctgctgaagatgtaccccatcgt

SEQ ID NO: 181677 - DNA, 25 bp, Mus musculus
agctgctgaattctccatccgcaag

SEQ ID NO: 181678 - DNA, 25 bp, Mus musculus
agctgctgaattgtccatccgcaag

SEQ ID NO: 181679 - DNA, 25 bp, Mus musculus
agctgctgacatcccatggcatgag

SEQ ID NO: 181680 - DNA, 25 bp, Mus musculus
agctgctgacatgccatggcatgag

SEQ ID NO: 181681 - DNA, 25 bp, Mus musculus
agctgctgaccaagtacttgttgtt

SEQ ID NO: 181682 - DNA, 25 bp, Mus musculus
agctgctgaccatgtacttgttgtt

SEQ ID NO: 181683 - DNA, 25 bp, Mus musculus
agctgctgacgcagattttaatttc

SEQ ID NO: 181684 - DNA, 25 bp, Mus musculus
agctgctgacgctgattttaatttc

SEQ ID NO: 181685 - DNA, 25 bp, Mus musculus
agctgctgatcaattattcactcaa

SEQ ID NO: 181686 - DNA, 25 bp, Mus musculus
agctgctgatcatttattcactcaa

SEQ ID NO: 181687 - DNA, 25 bp, Mus musculus
agctgctgcatacactgtgcttgtt

SEQ ID NO: 181688 - DNA, 25 bp, Mus musculus
agctgctgcatagactgtgcttgtt

SEQ ID NO: 181689 - DNA, 25 bp, Mus musculus
agctgctgccagaggcagagttaac

SEQ ID NO: 181690 - DNA, 25 bp, Mus musculus
agctgctgccagtggcagagttaac

SEQ ID NO: 181691 - DNA, 25 bp, Mus musculus
agctgctgcccaatggaaaggcacg

SEQ ID NO: 181692 - DNA, 25 bp, Mus musculus
agctgctgcccattggaaaggcacg

SEQ ID NO: 181693 - DNA, 25 bp, Mus musculus
agctgctgccctaatggtctagtgc

SEQ ID NO: 181694 - DNA, 25 bp, Mus musculus
agctgctgcccttatggtctagtgc

SEQ ID NO: 181695 - DNA, 25 bp, Mus musculus
agctgctgcctgacaagtggtttga

SEQ ID NO: 181696 - DNA, 25 bp, Mus musculus
agctgctgcctgtcaagtggtttga

SEQ ID NO: 181697 - DNA, 25 bp, Mus musculus
agctgctgcgcacgttcaagaaaca

SEQ ID NO: 181698 - DNA, 25 bp, Mus musculus
agctgctgcgcaggttcaagaaaca

SEQ ID NO: 181699 - DNA, 25 bp, Mus musculus
agctgctgcggcacctagggtctga

SEQ ID NO: 181700 - DNA, 25 bp, Mus musculus
agctgctgcggctcctagggtctga

SEQ ID NO: 181701 - DNA, 25 bp, Mus musculus
agctgctgctggacatcatagactc

SEQ ID NO: 181702 - DNA, 25 bp, Mus musculus
agctgctgctggtcatcatagactc

SEQ ID NO: 181703 - DNA, 25 bp, Mus musculus
agctgctgctgtcatctcttgtgta

SEQ ID NO: 181704 - DNA, 25 bp, Mus musculus
agctgctgctgtgatctcttgtgta

SEQ ID NO: 181705 - DNA, 25 bp, Mus musculus
agctgctgcttgagatgctcacgct

SEQ ID NO: 181706 - DNA, 25 bp, Mus musculus
agctgctgcttgcacctagggtgtc

SEQ ID NO: 181707 - DNA, 25 bp, Mus musculus
agctgctgcttggacctagggtgtc

SEQ ID NO: 181708 - DNA, 25 bp, Mus musculus
agctgctgcttgtgatgctcacgct

SEQ ID NO: 181709 - DNA, 25 bp, Mus musculus
agctgctgctttattagaacttgtt

SEQ ID NO: 181710 - DNA, 25 bp, Mus musculus
agctgctgcttttttagaacttgtt

SEQ ID NO: 181711 - DNA, 25 bp, Mus musculus
agctgctggaaaccactgcttttat

SEQ ID NO: 181712 - DNA, 25 bp, Mus musculus
agctgctggaaagcactgcttttat

SEQ ID NO: 181713 - DNA, 25 bp, Mus musculus
agctgctggaacaatggcttctcgt

SEQ ID NO: 181714 - DNA, 25 bp, Mus musculus
agctgctggaacctattccctatga

SEQ ID NO: 181715 - DNA, 25 bp, Mus musculus
agctgctggaacgtattccctatga

SEQ ID NO: 181716 - DNA, 25 bp, Mus musculus
agctgctggaactatggcttctcgt

SEQ ID NO: 181717 - DNA, 25 bp, Mus musculus
agctgctggaccattccatcttatg

SEQ ID NO: 181718 - DNA, 25 bp, Mus musculus
agctgctggacctttccatcttatg

SEQ ID NO: 181719 - DNA, 25 bp, Mus musculus
agctgctggacgctcccagctggaa

SEQ ID NO: 181720 - DNA, 25 bp, Mus musculus
agctgctggacggtcccagctggaa

SEQ ID NO: 181721 - DNA, 25 bp, Mus musculus
agctgctggcaacctgttggtcact

SEQ ID NO: 181722 - DNA, 25 bp, Mus musculus
agctgctggcaagctgttggtcact

SEQ ID NO: 181723 - DNA, 25 bp, Mus musculus
agctgctggcagcatgaaccaggac

SEQ ID NO: 181724 - DNA, 25 bp, Mus musculus
agctgctggcaggatgaaccaggac

SEQ ID NO: 181725 - DNA, 25 bp, Mus musculus
agctgctgggctagttccgatgtga

SEQ ID NO: 181726 - DNA, 25 bp, Mus musculus
agctgctgggcttgttccgatgtga

SEQ ID NO: 181727 - DNA, 25 bp, Mus musculus
agctgctgggtgaccattgccatat

SEQ ID NO: 181728 - DNA, 25 bp, Mus musculus
agctgctgggtgtccattgccatat

SEQ ID NO: 181729 - DNA, 25 bp, Mus musculus
agctgctggtgtcctacgaagacga

SEQ ID NO: 181730 - DNA, 25 bp, Mus musculus
agctgctggtgtgctacgaagacga

SEQ ID NO: 181731 - DNA, 25 bp, Mus musculus
agctgctggttcaacatcttgttac

SEQ ID NO: 181732 - DNA, 25 bp, Mus musculus
agctgctggttctacatcttgttac

SEQ ID NO: 181733 - DNA, 25 bp, Mus musculus
agctgctgtacacctggcacagttc

SEQ ID NO: 181734 - DNA, 25 bp, Mus musculus
agctgctgtacagctggcacagttc

SEQ ID NO: 181735 - DNA, 25 bp, Mus musculus
agctgctgtaccaggcatgtgttac

SEQ ID NO: 181736 - DNA, 25 bp, Mus musculus
agctgctgtacctggcatgtgttac

SEQ ID NO: 181737 - DNA, 25 bp, Mus musculus
agctgctgtcctctctaaaatgtct

SEQ ID NO: 181738 - DNA, 25 bp, Mus musculus
agctgctgtcctgtctaaaatgtct

SEQ ID NO: 181739 - DNA, 25 bp, Mus musculus
agctgctgtctaaggcctgtgtgca

SEQ ID NO: 181740 - DNA, 25 bp, Mus musculus
agctgctgtctatggcctgtgtgca

SEQ ID NO: 181741 - DNA, 25 bp, Mus musculus
agctgctgtgcaatgttcactgact

SEQ ID NO: 181742 - DNA, 25 bp, Mus musculus
agctgctgtgcattgttcactgact

SEQ ID NO: 181743 - DNA, 25 bp, Mus musculus
agctgctgtgccagtcacactgtgc

SEQ ID NO: 181744 - DNA, 25 bp, Mus musculus
agctgctgtgcctgtcacactgtgc

SEQ ID NO: 181745 - DNA, 25 bp, Mus musculus
agctgctgtgctagttgttactgaa

SEQ ID NO: 181746 - DNA, 25 bp, Mus musculus
agctgctgtgctataaaagttccaa

SEQ ID NO: 181747 - DNA, 25 bp, Mus musculus
agctgctgtgcttgttgttactgaa

SEQ ID NO: 181748 - DNA, 25 bp, Mus musculus
agctgctgtgctttaaaagttccaa

SEQ ID NO: 181749 - DNA, 25 bp, Mus musculus
agctgctgtggacatatcccacacc

SEQ ID NO: 181750 - DNA, 25 bp, Mus musculus
agctgctgtggagatatcccacacc

SEQ ID NO: 181751 - DNA, 25 bp, Mus musculus
agctgctgtgggatctacatcggca

SEQ ID NO: 181752 - DNA, 25 bp, Mus musculus
agctgctgtgggttctacatcggca

SEQ ID NO: 181753 - DNA, 25 bp, Mus musculus
agctgctgttctagcggcggctgca

SEQ ID NO: 181754 - DNA, 25 bp, Mus musculus
agctgctgttcttgcggcggctgca

SEQ ID NO: 181755 - DNA, 25 bp, Mus musculus
agctgctgttgaataaaaccctgat

SEQ ID NO: 181756 - DNA, 25 bp, Mus musculus
agctgctgttgattaaaaccctgat

SEQ ID NO: 181757 - DNA, 25 bp, Mus musculus
agctgctgttggatctaggtgaaga

SEQ ID NO: 181758 - DNA, 25 bp, Mus musculus
agctgctgttggttctaggtgaaga

SEQ ID NO: 181759 - DNA, 25 bp, Mus musculus
agctgctgttttaagacacccagga

SEQ ID NO: 181760 - DNA, 25 bp, Mus musculus
agctgctgttttctgtatgggctta

SEQ ID NO: 181761 - DNA, 25 bp, Mus musculus
agctgctgttttgtgtatgggctta

SEQ ID NO: 181762 - DNA, 25 bp, Mus musculus
agctgctgtttttagacacccagga

SEQ ID NO: 181763 - DNA, 25 bp, Mus musculus
agctgcttaatcatcttcaggtgtt

SEQ ID NO: 181764 - DNA, 25 bp, Mus musculus
agctgcttaatcttcttcaggtgtt

SEQ ID NO: 181765 - DNA, 25 bp, Mus musculus
agctgcttacacaaaatcacctggt

SEQ ID NO: 181766 - DNA, 25 bp, Mus musculus
agctgcttacactaaatcacctggt

SEQ ID NO: 181767 - DNA, 25 bp, Mus musculus
agctgcttagagagaggaacccctg

SEQ ID NO: 181768 - DNA, 25 bp, Mus musculus
agctgcttagagtgaggaacccctg

SEQ ID NO: 181769 - DNA, 25 bp, Mus musculus
agctgcttagctcctgaaggacagt

SEQ ID NO: 181770 - DNA, 25 bp, Mus musculus
agctgcttagctgctgaaggacagt

SEQ ID NO: 181771 - DNA, 25 bp, Mus musculus
agctgcttattacgtggttgctcct

SEQ ID NO: 181772 - DNA, 25 bp, Mus musculus
agctgcttattaggtggttgctcct

SEQ ID NO: 181773 - DNA, 25 bp, Mus musculus
agctgcttattgatcagtcacctgg

SEQ ID NO: 181774 - DNA, 25 bp, Mus musculus
agctgcttattgttcagtcacctgg

SEQ ID NO: 181775 - DNA, 25 bp, Mus musculus
agctgcttcactatgccccacttta

SEQ ID NO: 181776 - DNA, 25 bp, Mus musculus
agctgcttcactttgccccacttta

SEQ ID NO: 181777 - DNA, 25 bp, Mus musculus
agctgcttcagccagatctttgatc

SEQ ID NO: 181778 - DNA, 25 bp, Mus musculus
agctgcttcagcgagatctttgatc

SEQ ID NO: 181779 - DNA, 25 bp, Mus musculus
agctgcttccatcgctttctctttt

SEQ ID NO: 181780 - DNA, 25 bp, Mus musculus
agctgcttccatctggacctgtggc

SEQ ID NO: 181781 - DNA, 25 bp, Mus musculus
agctgcttccatggctttctctttt

SEQ ID NO: 181782 - DNA, 25 bp, Mus musculus
agctgcttccatgtggacctgtggc

SEQ ID NO: 181783 - DNA, 25 bp, Mus musculus
agctgcttcctgcataagcttggta

SEQ ID NO: 181784 - DNA, 25 bp, Mus musculus
agctgcttcctggataagcttggta

SEQ ID NO: 181785 - DNA, 25 bp, Mus musculus
agctgcttccttcatatttgactag

SEQ ID NO: 181786 - DNA, 25 bp, Mus musculus
agctgcttccttgatatttgactag

SEQ ID NO: 181787 - DNA, 25 bp, Mus musculus
agctgcttctaaaatggagtccgtt

SEQ ID NO: 181788 - DNA, 25 bp, Mus musculus
agctgcttctaatatggagtccgtt

SEQ ID NO: 181789 - DNA, 25 bp, Mus musculus
agctgcttctgtctactgctgtctc

SEQ ID NO: 181790 - DNA, 25 bp, Mus musculus
agctgcttctgtgtactgctgtctc

SEQ ID NO: 181791 - DNA, 25 bp, Mus musculus
agctgcttcttgagttattgtactt

SEQ ID NO: 181792 - DNA, 25 bp, Mus musculus
agctgcttcttgtgttattgtactt

SEQ ID NO: 181793 - DNA, 25 bp, Mus musculus
agctgcttgagaagttctctgtggc

SEQ ID NO: 181794 - DNA, 25 bp, Mus musculus
agctgcttgagatgttctctgtggc

SEQ ID NO: 181795 - DNA, 25 bp, Mus musculus
agctgcttgcaaccagttcctatgg

SEQ ID NO: 181796 - DNA, 25 bp, Mus musculus
agctgcttgcaagcagttcctatgg

SEQ ID NO: 181797 - DNA, 25 bp, Mus musculus
agctgcttgccactcatgtgtcttg

SEQ ID NO: 181798 - DNA, 25 bp, Mus musculus
agctgcttgccagtcatgtgtcttg

SEQ ID NO: 181799 - DNA, 25 bp, Mus musculus
agctgcttggtcacttccactgtgt

SEQ ID NO: 181800 - DNA, 25 bp, Mus musculus
agctgcttggtctcttccactgtgt

SEQ ID NO: 181801 - DNA, 25 bp, Mus musculus
agctgcttggttatctgcggtgtaa

SEQ ID NO: 181802 - DNA, 25 bp, Mus musculus
agctgcttggttttctgcggtgtaa

SEQ ID NO: 181803 - DNA, 25 bp, Mus musculus
agctgcttgtaccagcacatcagga

SEQ ID NO: 181804 - DNA, 25 bp, Mus musculus
agctgcttgtacgagcacatcagga

SEQ ID NO: 181805 - DNA, 25 bp, Mus musculus
agctgctttaaactctatgtatctc

SEQ ID NO: 181806 - DNA, 25 bp, Mus musculus
agctgctttaaagtctatgtatctc

SEQ ID NO: 181807 - DNA, 25 bp, Mus musculus
agctgctttaaccactgaggcgcat

SEQ ID NO: 181808 - DNA, 25 bp, Mus musculus
agctgctttaacgactgaggcgcat

SEQ ID NO: 181809 - DNA, 25 bp, Mus musculus
agctgctttaatctgtgcctcacgg

SEQ ID NO: 181810 - DNA, 25 bp, Mus musculus
agctgctttaatgtgtgcctcacgg

SEQ ID NO: 181811 - DNA, 25 bp, Mus musculus
agctgctttacacgctgctagctta

SEQ ID NO: 181812 - DNA, 25 bp, Mus musculus
agctgctttacaggctgctagctta

SEQ ID NO: 181813 - DNA, 25 bp, Mus musculus
agctgctttaccaggtcagcataca

SEQ ID NO: 181814 - DNA, 25 bp, Mus musculus
agctgctttacctggtcagcataca

SEQ ID NO: 181815 - DNA, 25 bp, Mus musculus
agctgctttactaatacctttgaac

SEQ ID NO: 181816 - DNA, 25 bp, Mus musculus
agctgctttacttatacctttgaac

SEQ ID NO: 181817 - DNA, 25 bp, Mus musculus
agctgctttatacccagtctactgc

SEQ ID NO: 181818 - DNA, 25 bp, Mus musculus
agctgctttatagccagtctactgc

SEQ ID NO: 181819 - DNA, 25 bp, Mus musculus
agctgctttatgaacgtacgagcgt

SEQ ID NO: 181820 - DNA, 25 bp, Mus musculus
agctgctttatgtacgtacgagcgt

SEQ ID NO: 181821 - DNA, 25 bp, Mus musculus
agctgctttcagatcatgttctcat

SEQ ID NO: 181822 - DNA, 25 bp, Mus musculus
agctgctttcagttcatgttctcat

SEQ ID NO: 181823 - DNA, 25 bp, Mus musculus
agctgctttccaacatgatgctgca

SEQ ID NO: 181824 - DNA, 25 bp, Mus musculus
agctgctttccatcatgatgctgca

SEQ ID NO: 181825 - DNA, 25 bp, Mus musculus
agctgctttcctaaatctgtctgtc

SEQ ID NO: 181826 - DNA, 25 bp, Mus musculus
agctgctttccttaatctgtctgtc

SEQ ID NO: 181827 - DNA, 25 bp, Mus musculus
agctgctttgcaccagtcctttgaa

SEQ ID NO: 181828 - DNA, 25 bp, Mus musculus
agctgctttgcagcagtcctttgaa

SEQ ID NO: 181829 - DNA, 25 bp, Mus musculus
agctggaaaccccagctgcttgtca

SEQ ID NO: 181830 - DNA, 25 bp, Mus musculus
agctggaaacccgagctgcttgtca

SEQ ID NO: 181831 - DNA, 25 bp, Mus musculus
agctggaaagggacagactccggtt

SEQ ID NO: 181832 - DNA, 25 bp, Mus musculus
agctggaaagggtcagactccggtt

SEQ ID NO: 181833 - DNA, 25 bp, Mus musculus
agctggaactggcacttttcccacg

SEQ ID NO: 181834 - DNA, 25 bp, Mus musculus
agctggaactgggacttttcccacg

SEQ ID NO: 181835 - DNA, 25 bp, Mus musculus
agctggaactgtacgctggatacga

SEQ ID NO: 181836 - DNA, 25 bp, Mus musculus
agctggaactgttcgctggatacga

SEQ ID NO: 181837 - DNA, 25 bp, Mus musculus
agctggaagatgatcttaccttctc

SEQ ID NO: 181838 - DNA, 25 bp, Mus musculus
agctggaagatgttcttaccttctc

SEQ ID NO: 181839 - DNA, 25 bp, Mus musculus
agctggaaggcaatgctggattctc

SEQ ID NO: 181840 - DNA, 25 bp, Mus musculus
agctggaaggcattgctggattctc

SEQ ID NO: 181841 - DNA, 25 bp, Mus musculus
agctggaagtgaacatcgatcgcat

SEQ ID NO: 181842 - DNA, 25 bp, Mus musculus
agctggaagtgatcatcgatcgcat

SEQ ID NO: 181843 - DNA, 25 bp, Mus musculus
agctggaagtggctcgcatcatcga

SEQ ID NO: 181844 - DNA, 25 bp, Mus musculus
agctggaagtgggtcgcatcatcga

SEQ ID NO: 181845 - DNA, 25 bp, Mus musculus
agctggaagtgtactgacatctctg

SEQ ID NO: 181846 - DNA, 25 bp, Mus musculus
agctggaagtgttctgacatctctg

SEQ ID NO: 181847 - DNA, 25 bp, Mus musculus
agctggaatggacgtctctgctcct

SEQ ID NO: 181848 - DNA, 25 bp, Mus musculus
agctggaatggaggtctctgctcct

SEQ ID NO: 181849 - DNA, 25 bp, Mus musculus
agctggaatgttatcccaacctctt

SEQ ID NO: 181850 - DNA, 25 bp, Mus musculus
agctggaatgttttcccaacctctt

SEQ ID NO: 181851 - DNA, 25 bp, Mus musculus
agctggacaatgagtgccttagtac

SEQ ID NO: 181852 - DNA, 25 bp, Mus musculus
agctggacaatgtgtgccttagtac

SEQ ID NO: 181853 - DNA, 25 bp, Mus musculus
agctggacaccaaccgttccactta

SEQ ID NO: 181854 - DNA, 25 bp, Mus musculus
agctggacaccatccgttccactta

SEQ ID NO: 181855 - DNA, 25 bp, Mus musculus
agctggacagcaaagccctacttca

SEQ ID NO: 181856 - DNA, 25 bp, Mus musculus
agctggacagcatagccctacttca

SEQ ID NO: 181857 - DNA, 25 bp, Mus musculus
agctggacagccagcgcgctgacaa

SEQ ID NO: 181858 - DNA, 25 bp, Mus musculus
agctggacagcctgcgcgctgacaa

SEQ ID NO: 181859 - DNA, 25 bp, Mus musculus
agctggacagttatatctacattga

SEQ ID NO: 181860 - DNA, 25 bp, Mus musculus
agctggacagttttatctacattga

SEQ ID NO: 181861 - DNA, 25 bp, Mus musculus
agctggacataactaaccttagaat

SEQ ID NO: 181862 - DNA, 25 bp, Mus musculus
agctggacataagtaaccttagaat

SEQ ID NO: 181863 - DNA, 25 bp, Mus musculus
agctggacatacatgctttgttata

SEQ ID NO: 181864 - DNA, 25 bp, Mus musculus
agctggacatacttgctttgttata

SEQ ID NO: 181865 - DNA, 25 bp, Mus musculus
agctggacatggctgtgcatattcc

SEQ ID NO: 181866 - DNA, 25 bp, Mus musculus
agctggacatgggtgtgcatattcc

SEQ ID NO: 181867 - DNA, 25 bp, Mus musculus
agctggacattcaatggacccgaga

SEQ ID NO: 181868 - DNA, 25 bp, Mus musculus
agctggacattctatggacccgaga

SEQ ID NO: 181869 - DNA, 25 bp, Mus musculus
agctggaccaagatgcagacgacct

SEQ ID NO: 181870 - DNA, 25 bp, Mus musculus
agctggaccaagttgcagacgacct

SEQ ID NO: 181871 - DNA, 25 bp, Mus musculus
agctggacccacagcagtactggac

SEQ ID NO: 181872 - DNA, 25 bp, Mus musculus
agctggacccactgcagtactggac

SEQ ID NO: 181873 - DNA, 25 bp, Mus musculus
agctggacccagcaaagcgccggca

SEQ ID NO: 181874 - DNA, 25 bp, Mus musculus
agctggacccaggaaagcgccggca

SEQ ID NO: 181875 - DNA, 25 bp, Mus musculus
agctggacccttaggagtggaagca

SEQ ID NO: 181876 - DNA, 25 bp, Mus musculus
agctggaccctttggagtggaagca

SEQ ID NO: 181877 - DNA, 25 bp, Mus musculus
agctggaccgaaatgattcactgag

SEQ ID NO: 181878 - DNA, 25 bp, Mus musculus
agctggaccgaattgattcactgag

SEQ ID NO: 181879 - DNA, 25 bp, Mus musculus
agctggaccggaacggctccatgag

SEQ ID NO: 181880 - DNA, 25 bp, Mus musculus
agctggaccggaaggttgccgacca

SEQ ID NO: 181881 - DNA, 25 bp, Mus musculus
agctggaccggatcggctccatgag

SEQ ID NO: 181882 - DNA, 25 bp, Mus musculus
agctggaccggatggttgccgacca

SEQ ID NO: 181883 - DNA, 25 bp, Mus musculus
agctggaccggccatttgtaattcc

SEQ ID NO: 181884 - DNA, 25 bp, Mus musculus
agctggaccggcgatttgtaattcc

SEQ ID NO: 181885 - DNA, 25 bp, Mus musculus
agctggacctgtccaccacagtgct

SEQ ID NO: 181886 - DNA, 25 bp, Mus musculus
agctggacctgtgcaccacagtgct

SEQ ID NO: 181887 - DNA, 25 bp, Mus musculus
agctggacgatcaccgggctcttaa

SEQ ID NO: 181888 - DNA, 25 bp, Mus musculus
agctggacgatctccgggctcttaa

SEQ ID NO: 181889 - DNA, 25 bp, Mus musculus
agctggacgtttacccaagcgtgga

SEQ ID NO: 181890 - DNA, 25 bp, Mus musculus
agctggacgttttcccaagcgtgga

SEQ ID NO: 181891 - DNA, 25 bp, Mus musculus
agctggactcacatgcaggctgagg

SEQ ID NO: 181892 - DNA, 25 bp, Mus musculus
agctggactcacttgcaggctgagg

SEQ ID NO: 181893 - DNA, 25 bp, Mus musculus
agctggactcctacattaacaagtt

SEQ ID NO: 181894 - DNA, 25 bp, Mus musculus
agctggactccttcattaacaagtt

SEQ ID NO: 181895 - DNA, 25 bp, Mus musculus
agctggactcttagtttctcttcat

SEQ ID NO: 181896 - DNA, 25 bp, Mus musculus
agctggactctttgtttctcttcat

SEQ ID NO: 181897 - DNA, 25 bp, Mus musculus
agctggactgccaccagctggctga

SEQ ID NO: 181898 - DNA, 25 bp, Mus musculus
agctggactgcctccagctggctga

SEQ ID NO: 181899 - DNA, 25 bp, Mus musculus
agctggacttcactgctctgtttaa

SEQ ID NO: 181900 - DNA, 25 bp, Mus musculus
agctggacttcactggccaaggctt

SEQ ID NO: 181901 - DNA, 25 bp, Mus musculus
agctggacttcagtgctctgtttaa

SEQ ID NO: 181902 - DNA, 25 bp, Mus musculus
agctggacttcagtggccaaggctt

SEQ ID NO: 181903 - DNA, 25 bp, Mus musculus
agctggactttgaggctatcctaga

SEQ ID NO: 181904 - DNA, 25 bp, Mus musculus
agctggactttgtggctatcctaga

SEQ ID NO: 181905 - DNA, 25 bp, Mus musculus
agctggacttttcttgctttacttt

SEQ ID NO: 181906 - DNA, 25 bp, Mus musculus
agctggacttttgttgctttacttt

SEQ ID NO: 181907 - DNA, 25 bp, Mus musculus
agctggagaagcatatctccctcct

SEQ ID NO: 181908 - DNA, 25 bp, Mus musculus
agctggagaagcttatctccctcct

SEQ ID NO: 181909 - DNA, 25 bp, Mus musculus
agctggagaatgaactgggcactta

SEQ ID NO: 181910 - DNA, 25 bp, Mus musculus
agctggagaatgtactgggcactta

SEQ ID NO: 181911 - DNA, 25 bp, Mus musculus
agctggagagacactgctcgctcac

SEQ ID NO: 181912 - DNA, 25 bp, Mus musculus
agctggagagacctgtgatcctgaa

SEQ ID NO: 181913 - DNA, 25 bp, Mus musculus
agctggagagacgtgtgatcctgaa

SEQ ID NO: 181914 - DNA, 25 bp, Mus musculus
agctggagagactctgctcgctcac

SEQ ID NO: 181915 - DNA, 25 bp, Mus musculus
agctggagagataccaagttcattg

SEQ ID NO: 181916 - DNA, 25 bp, Mus musculus
agctggagagattccaagttcattg

SEQ ID NO: 181917 - DNA, 25 bp, Mus musculus
agctggagcacaaacgcgccgtgga

SEQ ID NO: 181918 - DNA, 25 bp, Mus musculus
agctggagcacatacgcgccgtgga

SEQ ID NO: 181919 - DNA, 25 bp, Mus musculus
agctggagcaccatcaaatctatga

SEQ ID NO: 181920 - DNA, 25 bp, Mus musculus
agctggagcaccttcaaatctatga

SEQ ID NO: 181921 - DNA, 25 bp, Mus musculus
agctggagcactcggaaaatgacac

SEQ ID NO: 181922 - DNA, 25 bp, Mus musculus
agctggagcactgggaaaatgacac

SEQ ID NO: 181923 - DNA, 25 bp, Mus musculus
agctggagcatgagccaaagagcaa

SEQ ID NO: 181924 - DNA, 25 bp, Mus musculus
agctggagcatgtgccaaagagcaa

SEQ ID NO: 181925 - DNA, 25 bp, Mus musculus
agctggagcggtctcattcttctga

SEQ ID NO: 181926 - DNA, 25 bp, Mus musculus
agctggagcggtgtcattcttctga

SEQ ID NO: 181927 - DNA, 25 bp, Mus musculus
agctggaggccaaccggaccgccaa

SEQ ID NO: 181928 - DNA, 25 bp, Mus musculus
agctggaggccaagcacctggagta

SEQ ID NO: 181929 - DNA, 25 bp, Mus musculus
agctggaggccatccggaccgccaa

SEQ ID NO: 181930 - DNA, 25 bp, Mus musculus
agctggaggccatgcacctggagta

SEQ ID NO: 181931 - DNA, 25 bp, Mus musculus
agctggaggcccactgtgagttcaa

SEQ ID NO: 181932 - DNA, 25 bp, Mus musculus
agctggaggccctctgtgagttcaa

SEQ ID NO: 181933 - DNA, 25 bp, Mus musculus
agctggagtcacatcctctagggct

SEQ ID NO: 181934 - DNA, 25 bp, Mus musculus
agctggagtcacttcctctagggct

SEQ ID NO: 181935 - DNA, 25 bp, Mus musculus
agctggagtcggacaaggagaacaa

SEQ ID NO: 181936 - DNA, 25 bp, Mus musculus
agctggagtcggtcaaggagaacaa

SEQ ID NO: 181937 - DNA, 25 bp, Mus musculus
agctggagtgtcatggccttaggaa

SEQ ID NO: 181938 - DNA, 25 bp, Mus musculus
agctggagtgtcttggccttaggaa

SEQ ID NO: 181939 - DNA, 25 bp, Mus musculus
agctggagttcaacctcaggctcca

SEQ ID NO: 181940 - DNA, 25 bp, Mus musculus
agctggagttcatcctcaggctcca

SEQ ID NO: 181941 - DNA, 25 bp, Mus musculus
agctggagtttgaattgcagggcct

SEQ ID NO: 181942 - DNA, 25 bp, Mus musculus
agctggagtttgtattgcagggcct

SEQ ID NO: 181943 - DNA, 25 bp, Mus musculus
agctggatactgattctgattctgt

SEQ ID NO: 181944 - DNA, 25 bp, Mus musculus
agctggatactgtttctgattctgt

SEQ ID NO: 181945 - DNA, 25 bp, Mus musculus
agctggatagacaccgccatcaagt

SEQ ID NO: 181946 - DNA, 25 bp, Mus musculus
agctggatagactccgccatcaagt

SEQ ID NO: 181947 - DNA, 25 bp, Mus musculus
agctggatagtacctgtgttttatt

SEQ ID NO: 181948 - DNA, 25 bp, Mus musculus
agctggatagtagctgtgttttatt

SEQ ID NO: 181949 - DNA, 25 bp, Mus musculus
agctggatattcacaagtttttaga

SEQ ID NO: 181950 - DNA, 25 bp, Mus musculus
agctggatattctcaagtttttaga

SEQ ID NO: 181951 - DNA, 25 bp, Mus musculus
agctggatcagcaccctattgatgg

SEQ ID NO: 181952 - DNA, 25 bp, Mus musculus
agctggatcagctccctattgatgg

SEQ ID NO: 181953 - DNA, 25 bp, Mus musculus
agctggatccccattttgaacaggt

SEQ ID NO: 181954 - DNA, 25 bp, Mus musculus
agctggatcccctttttgaacaggt

SEQ ID NO: 181955 - DNA, 25 bp, Mus musculus
agctggatcctacaccctcacaaag

SEQ ID NO: 181956 - DNA, 25 bp, Mus musculus
agctggatcctagaccctcacaaag

SEQ ID NO: 181957 - DNA, 25 bp, Mus musculus
agctggatctatcctgtccctgagg

SEQ ID NO: 181958 - DNA, 25 bp, Mus musculus
agctggatctatgctgtccctgagg

SEQ ID NO: 181959 - DNA, 25 bp, Mus musculus
agctggatctcacgctttgacttta

SEQ ID NO: 181960 - DNA, 25 bp, Mus musculus
agctggatctcaggctttgacttta

SEQ ID NO: 181961 - DNA, 25 bp, Mus musculus
agctggatcttaacaacgaactctc

SEQ ID NO: 181962 - DNA, 25 bp, Mus musculus
agctggatcttatcaacgaactctc

SEQ ID NO: 181963 - DNA, 25 bp, Mus musculus
agctggatgaccctgcagatgccct

SEQ ID NO: 181964 - DNA, 25 bp, Mus musculus
agctggatgaccgtgcagatgccct

SEQ ID NO: 181965 - DNA, 25 bp, Mus musculus
agctggatgcaaacttttaaatatc

SEQ ID NO: 181966 - DNA, 25 bp, Mus musculus
agctggatgcaatcttttaaatatc

SEQ ID NO: 181967 - DNA, 25 bp, Mus musculus
agctggatggtaagaatttaggaca

SEQ ID NO: 181968 - DNA, 25 bp, Mus musculus
agctggatggtatgaatttaggaca

SEQ ID NO: 181969 - DNA, 25 bp, Mus musculus
agctggatggttaccgttcaggcaa

SEQ ID NO: 181970 - DNA, 25 bp, Mus musculus
agctggatggtttccgttcaggcaa

SEQ ID NO: 181971 - DNA, 25 bp, Mus musculus
agctggattctcagccatttgtaat

SEQ ID NO: 181972 - DNA, 25 bp, Mus musculus
agctggattctctgccatttgtaat

SEQ ID NO: 181973 - DNA, 25 bp, Mus musculus
agctggatttccaggagggtgacca

SEQ ID NO: 181974 - DNA, 25 bp, Mus musculus
agctggatttcctggagggtgacca

SEQ ID NO: 181975 - DNA, 25 bp, Mus musculus
agctggattttgacttcccttgttt

SEQ ID NO: 181976 - DNA, 25 bp, Mus musculus
agctggattttgtcttcccttgttt

SEQ ID NO: 181977 - DNA, 25 bp, Mus musculus
agctggcaaaggctcgtgacctgac

SEQ ID NO: 181978 - DNA, 25 bp, Mus musculus
agctggcaaagggtcgtgacctgac

SEQ ID NO: 181979 - DNA, 25 bp, Mus musculus
agctggcaacagcattgtaattcaa

SEQ ID NO: 181980 - DNA, 25 bp, Mus musculus
agctggcaacaggattgtaattcaa

SEQ ID NO: 181981 - DNA, 25 bp, Mus musculus
agctggcaagataccctattcctgt

SEQ ID NO: 181982 - DNA, 25 bp, Mus musculus
agctggcaagattccctattcctgt

SEQ ID NO: 181983 - DNA, 25 bp, Mus musculus
agctggcacaggacgctcacagaga

SEQ ID NO: 181984 - DNA, 25 bp, Mus musculus
agctggcacaggtcgctcacagaga

SEQ ID NO: 181985 - DNA, 25 bp, Mus musculus
agctggcacggcactatcgcacgca

SEQ ID NO: 181986 - DNA, 25 bp, Mus musculus
agctggcacggctctatcgcacgca

SEQ ID NO: 181987 - DNA, 25 bp, Mus musculus
agctggcacttgctcctcagtggag

SEQ ID NO: 181988 - DNA, 25 bp, Mus musculus
agctggcacttggtcctcagtggag

SEQ ID NO: 181989 - DNA, 25 bp, Mus musculus
agctggcagaatacaggaagtatat

SEQ ID NO: 181990 - DNA, 25 bp, Mus musculus
agctggcagaattcaggaagtatat

SEQ ID NO: 181991 - DNA, 25 bp, Mus musculus
agctggcagagaccatctcagcatt

SEQ ID NO: 181992 - DNA, 25 bp, Mus musculus
agctggcagagagcatctcagcatt

SEQ ID NO: 181993 - DNA, 25 bp, Mus musculus
agctggcagcccctcgtgcgttgct

SEQ ID NO: 181994 - DNA, 25 bp, Mus musculus
agctggcagcccgtcgtgcgttgct

SEQ ID NO: 181995 - DNA, 25 bp, Mus musculus
agctggcagctgatggcacagtcat

SEQ ID NO: 181996 - DNA, 25 bp, Mus musculus
agctggcagctgttggcacagtcat

SEQ ID NO: 181997 - DNA, 25 bp, Mus musculus
agctggcagtatctctgagtgttca

SEQ ID NO: 181998 - DNA, 25 bp, Mus musculus
agctggcagtatgtctgagtgttca

SEQ ID NO: 181999 - DNA, 25 bp, Mus musculus
agctggcagtggagagccacctgac

SEQ ID NO: 182000 - DNA, 25 bp, Mus musculus
agctggcagtggtgagccacctgac

SEQ ID NO: 182001 - DNA, 25 bp, Mus musculus
agctggcatcttcgtctgtgtgaaa

SEQ ID NO: 182002 - DNA, 25 bp, Mus musculus
agctggcatcttggtctgtgtgaaa

SEQ ID NO: 182003 - DNA, 25 bp, Mus musculus
agctggcatgttagtttccctattc

SEQ ID NO: 182004 - DNA, 25 bp, Mus musculus
agctggcatgtttgtttccctattc

SEQ ID NO: 182005 - DNA, 25 bp, Mus musculus
agctggcattgcaaattctgttctc

SEQ ID NO: 182006 - DNA, 25 bp, Mus musculus
agctggcattgctaattctgttctc

SEQ ID NO: 182007 - DNA, 25 bp, Mus musculus
agctggcatttccaagtcgagcaga

SEQ ID NO: 182008 - DNA, 25 bp, Mus musculus
agctggcatttcgaagtcgagcaga

SEQ ID NO: 182009 - DNA, 25 bp, Mus musculus
agctggccaactactttgcttttgt

SEQ ID NO: 182010 - DNA, 25 bp, Mus musculus
agctggccaacttctttgcttttgt

SEQ ID NO: 182011 - DNA, 25 bp, Mus musculus
agctggccaagcacgcggtgtcgga

SEQ ID NO: 182012 - DNA, 25 bp, Mus musculus
agctggccaagctcgcggtgtcgga

SEQ ID NO: 182013 - DNA, 25 bp, Mus musculus
agctggccaaggagcgctcctggat

SEQ ID NO: 182014 - DNA, 25 bp, Mus musculus
agctggccaaggtgcgctcctggat

SEQ ID NO: 182015 - DNA, 25 bp, Mus musculus
agctggccacggaggcttgctcatg

SEQ ID NO: 182016 - DNA, 25 bp, Mus musculus
agctggccacggcagaagtctaaat

SEQ ID NO: 182017 - DNA, 25 bp, Mus musculus
agctggccacgggagaagtctaaat

SEQ ID NO: 182018 - DNA, 25 bp, Mus musculus
agctggccacggtggcttgctcatg

SEQ ID NO: 182019 - DNA, 25 bp, Mus musculus
agctggccagtaatctctaggactt

SEQ ID NO: 182020 - DNA, 25 bp, Mus musculus
agctggccagtattctctaggactt

SEQ ID NO: 182021 - DNA, 25 bp, Mus musculus
agctggccagtcacgtgaaggtcac

SEQ ID NO: 182022 - DNA, 25 bp, Mus musculus
agctggccagtctcgtgaaggtcac

SEQ ID NO: 182023 - DNA, 25 bp, Mus musculus
agctggccagtgaatccacgctgtg

SEQ ID NO: 182024 - DNA, 25 bp, Mus musculus
agctggccagtgtatccacgctgtg

SEQ ID NO: 182025 - DNA, 25 bp, Mus musculus
agctggccatggatgtttcatgtct

SEQ ID NO: 182026 - DNA, 25 bp, Mus musculus
agctggccatggttgtttcatgtct

SEQ ID NO: 182027 - DNA, 25 bp, Mus musculus
agctggcccaagacatcgtgtacct

SEQ ID NO: 182028 - DNA, 25 bp, Mus musculus
agctggcccaagctgcctggcatag

SEQ ID NO: 182029 - DNA, 25 bp, Mus musculus
agctggcccaaggtgcctggcatag

SEQ ID NO: 182030 - DNA, 25 bp, Mus musculus
agctggcccaagtcatcgtgtacct

SEQ ID NO: 182031 - DNA, 25 bp, Mus musculus
agctggcccagcacaaggctgacat

SEQ ID NO: 182032 - DNA, 25 bp, Mus musculus
agctggcccagctcaaggctgacat

SEQ ID NO: 182033 - DNA, 25 bp, Mus musculus
agctggcccattctggcagagttag

SEQ ID NO: 182034 - DNA, 25 bp, Mus musculus
agctggcccattgtggcagagttag

SEQ ID NO: 182035 - DNA, 25 bp, Mus musculus
agctggccccgtcctaagagcaggc

SEQ ID NO: 182036 - DNA, 25 bp, Mus musculus
agctggccccgtgctaagagcaggc

SEQ ID NO: 182037 - DNA, 25 bp, Mus musculus
agctggcccctgatctaaagagtgc

SEQ ID NO: 182038 - DNA, 25 bp, Mus musculus
agctggcccctgttctaaagagtgc

SEQ ID NO: 182039 - DNA, 25 bp, Mus musculus
agctggcccgccatgaactggaagg

SEQ ID NO: 182040 - DNA, 25 bp, Mus musculus
agctggcccgccttgaactggaagg

SEQ ID NO: 182041 - DNA, 25 bp, Mus musculus
agctggcccggtcaccatggagaaa

SEQ ID NO: 182042 - DNA, 25 bp, Mus musculus
agctggcccggtgaccatggagaaa

SEQ ID NO: 182043 - DNA, 25 bp, Mus musculus
agctggccctcccatataaatcatt

SEQ ID NO: 182044 - DNA, 25 bp, Mus musculus
agctggccctccgatataaatcatt

SEQ ID NO: 182045 - DNA, 25 bp, Mus musculus
agctggccgacaaggtgtcctctga

SEQ ID NO: 182046 - DNA, 25 bp, Mus musculus
agctggccgacatggtgtcctctga

SEQ ID NO: 182047 - DNA, 25 bp, Mus musculus
agctggccgcagctctggtcctgca

SEQ ID NO: 182048 - DNA, 25 bp, Mus musculus
agctggccgcaggtctggtcctgca

SEQ ID NO: 182049 - DNA, 25 bp, Mus musculus
agctggccgcttaactcatttaaac

SEQ ID NO: 182050 - DNA, 25 bp, Mus musculus
agctggccgctttactcatttaaac

SEQ ID NO: 182051 - DNA, 25 bp, Mus musculus
agctggccgggcactctgaattgcg

SEQ ID NO: 182052 - DNA, 25 bp, Mus musculus
agctggccgggctctctgaattgcg

SEQ ID NO: 182053 - DNA, 25 bp, Mus musculus
agctggccgtccacatttgtggtaa

SEQ ID NO: 182054 - DNA, 25 bp, Mus musculus
agctggccgtcctcatttgtggtaa

SEQ ID NO: 182055 - DNA, 25 bp, Mus musculus
agctggccgtgcctaaaacaagggc

SEQ ID NO: 182056 - DNA, 25 bp, Mus musculus
agctggccgtgcgtaaaacaagggc

SEQ ID NO: 182057 - DNA, 25 bp, Mus musculus
agctggcctaagatcacacttttgt

SEQ ID NO: 182058 - DNA, 25 bp, Mus musculus
agctggcctaagttcacacttttgt

SEQ ID NO: 182059 - DNA, 25 bp, Mus musculus
agctggcctagtactcctaagacat

SEQ ID NO: 182060 - DNA, 25 bp, Mus musculus
agctggcctagttctcctaagacat

SEQ ID NO: 182061 - DNA, 25 bp, Mus musculus
agctggcctcccatttatatgtcca

SEQ ID NO: 182062 - DNA, 25 bp, Mus musculus
agctggcctcccttttatatgtcca

SEQ ID NO: 182063 - DNA, 25 bp, Mus musculus
agctggcctctaagcaggatgccaa

SEQ ID NO: 182064 - DNA, 25 bp, Mus musculus
agctggcctctatgcaggatgccaa

SEQ ID NO: 182065 - DNA, 25 bp, Mus musculus
agctggcctgaacgaagaggacccc

SEQ ID NO: 182066 - DNA, 25 bp, Mus musculus
agctggcctgaaggaagaggacccc

SEQ ID NO: 182067 - DNA, 25 bp, Mus musculus
agctggcctgacaagacccttgagg

SEQ ID NO: 182068 - DNA, 25 bp, Mus musculus
agctggcctgactagacccttgagg

SEQ ID NO: 182069 - DNA, 25 bp, Mus musculus
agctggcctgatagtagggccctgt

SEQ ID NO: 182070 - DNA, 25 bp, Mus musculus
agctggcctgattgtagggccctgt

SEQ ID NO: 182071 - DNA, 25 bp, Mus musculus
agctggcctggcaacaggttctaaa

SEQ ID NO: 182072 - DNA, 25 bp, Mus musculus
agctggcctggctacaggttctaaa

SEQ ID NO: 182073 - DNA, 25 bp, Mus musculus
agctggcctgtaactacctatgtag

SEQ ID NO: 182074 - DNA, 25 bp, Mus musculus
agctggcctgtatctacctatgtag

SEQ ID NO: 182075 - DNA, 25 bp, Mus musculus
agctggcctgtgagcgtttttagaa

SEQ ID NO: 182076 - DNA, 25 bp, Mus musculus
agctggcctgtgtgcgtttttagaa

SEQ ID NO: 182077 - DNA, 25 bp, Mus musculus
agctggccttcaagcgagtgtactg

SEQ ID NO: 182078 - DNA, 25 bp, Mus musculus
agctggccttcatgcgagtgtactg

SEQ ID NO: 182079 - DNA, 25 bp, Mus musculus
agctggccttggagtgcttatctct

SEQ ID NO: 182080 - DNA, 25 bp, Mus musculus
agctggccttggtgtgcttatctct

SEQ ID NO: 182081 - DNA, 25 bp, Mus musculus
agctggccttgtcgttctcttggat

SEQ ID NO: 182082 - DNA, 25 bp, Mus musculus
agctggccttgtggttctcttggat

SEQ ID NO: 182083 - DNA, 25 bp, Mus musculus
agctggcgcagtcgctaagagcaat

SEQ ID NO: 182084 - DNA, 25 bp, Mus musculus
agctggcgcagtggctaagagcaat

SEQ ID NO: 182085 - DNA, 25 bp, Mus musculus
agctggcgctgtacctggcccggaa

SEQ ID NO: 182086 - DNA, 25 bp, Mus musculus
agctggcgctgttcctggcccggaa

SEQ ID NO: 182087 - DNA, 25 bp, Mus musculus
agctggcggagcaaactcaacccgt

SEQ ID NO: 182088 - DNA, 25 bp, Mus musculus
agctggcggagctaactcaacccgt

SEQ ID NO: 182089 - DNA, 25 bp, Mus musculus
agctggcggctgacactgcagattt

SEQ ID NO: 182090 - DNA, 25 bp, Mus musculus
agctggcggctgtcactgcagattt

SEQ ID NO: 182091 - DNA, 25 bp, Mus musculus
agctggcggtggagatccgccatct

SEQ ID NO: 182092 - DNA, 25 bp, Mus musculus
agctggcggtggtgatccgccatct

SEQ ID NO: 182093 - DNA, 25 bp, Mus musculus
agctggcgtgcgcatttcaggcaaa

SEQ ID NO: 182094 - DNA, 25 bp, Mus musculus
agctggcgtgcggatttcaggcaaa

SEQ ID NO: 182095 - DNA, 25 bp, Mus musculus
agctggcgttctccaccaaagagga

SEQ ID NO: 182096 - DNA, 25 bp, Mus musculus
agctggcgttctgcaccaaagagga

SEQ ID NO: 182097 - DNA, 25 bp, Mus musculus
agctggctagccataaccattcggt

SEQ ID NO: 182098 - DNA, 25 bp, Mus musculus
agctggctagccttaaccattcggt

SEQ ID NO: 182099 - DNA, 25 bp, Mus musculus
agctggctatggagatgcattttct

SEQ ID NO: 182100 - DNA, 25 bp, Mus musculus
agctggctatggctgtccatcatta

SEQ ID NO: 182101 - DNA, 25 bp, Mus musculus
agctggctatgggtgtccatcatta

SEQ ID NO: 182102 - DNA, 25 bp, Mus musculus
agctggctatggtgatgcattttct

SEQ ID NO: 182103 - DNA, 25 bp, Mus musculus
agctggctcagactgcctgtaactc

SEQ ID NO: 182104 - DNA, 25 bp, Mus musculus
agctggctcagagtgcctgtaactc

SEQ ID NO: 182105 - DNA, 25 bp, Mus musculus
agctggctccaaagggcatcagagt

SEQ ID NO: 182106 - DNA, 25 bp, Mus musculus
agctggctccaatgggcatcagagt

SEQ ID NO: 182107 - DNA, 25 bp, Mus musculus
agctggctccatcgtaagagaatta

SEQ ID NO: 182108 - DNA, 25 bp, Mus musculus
agctggctccatggtaagagaatta

SEQ ID NO: 182109 - DNA, 25 bp, Mus musculus
agctggctcttgaacaactagatga

SEQ ID NO: 182110 - DNA, 25 bp, Mus musculus
agctggctcttgcaggcctgtgcat

SEQ ID NO: 182111 - DNA, 25 bp, Mus musculus
agctggctcttggaggcctgtgcat

SEQ ID NO: 182112 - DNA, 25 bp, Mus musculus
agctggctcttgtacaactagatga

SEQ ID NO: 182113 - DNA, 25 bp, Mus musculus
agctggctgaatagcgtgtgttcat

SEQ ID NO: 182114 - DNA, 25 bp, Mus musculus
agctggctgaattgcgtgtgttcat

SEQ ID NO: 182115 - DNA, 25 bp, Mus musculus
agctggctgagtcacggcccaaaga

SEQ ID NO: 182116 - DNA, 25 bp, Mus musculus
agctggctgagtgacggcccaaaga

SEQ ID NO: 182117 - DNA, 25 bp, Mus musculus
agctggctgcatccttgagtgtctg

SEQ ID NO: 182118 - DNA, 25 bp, Mus musculus
agctggctgcatgcttgagtgtctg

SEQ ID NO: 182119 - DNA, 25 bp, Mus musculus
agctggctgcctaatattttagtga

SEQ ID NO: 182120 - DNA, 25 bp, Mus musculus
agctggctgccttatattttagtga

SEQ ID NO: 182121 - DNA, 25 bp, Mus musculus
agctggctgcgcagcctgctttgtc

SEQ ID NO: 182122 - DNA, 25 bp, Mus musculus
agctggctgcgctgcctgctttgtc

SEQ ID NO: 182123 - DNA, 25 bp, Mus musculus
agctggctgctaagctccgtggatc

SEQ ID NO: 182124 - DNA, 25 bp, Mus musculus
agctggctgctatgctccgtggatc

SEQ ID NO: 182125 - DNA, 25 bp, Mus musculus
agctggctggcaatgcttttgcttc

SEQ ID NO: 182126 - DNA, 25 bp, Mus musculus
agctggctggcattgcttttgcttc

SEQ ID NO: 182127 - DNA, 25 bp, Mus musculus
agctggctggccatcgatcaatgat

SEQ ID NO: 182128 - DNA, 25 bp, Mus musculus
agctggctggccttcgatcaatgat

SEQ ID NO: 182129 - DNA, 25 bp, Mus musculus
agctggctggctacatggtgagcac

SEQ ID NO: 182130 - DNA, 25 bp, Mus musculus
agctggctggcttcatggtgagcac

SEQ ID NO: 182131 - DNA, 25 bp, Mus musculus
agctggctgggcacacaaagcttct

SEQ ID NO: 182132 - DNA, 25 bp, Mus musculus
agctggctgggctcacaaagcttct

SEQ ID NO: 182133 - DNA, 25 bp, Mus musculus
agctggctgtgaacacaaggtgaca

SEQ ID NO: 182134 - DNA, 25 bp, Mus musculus
agctggctgtgatcacaaggtgaca

SEQ ID NO: 182135 - DNA, 25 bp, Mus musculus
agctggcttaacacaaaccactatt

SEQ ID NO: 182136 - DNA, 25 bp, Mus musculus
agctggcttaactcaaaccactatt

SEQ ID NO: 182137 - DNA, 25 bp, Mus musculus
agctggcttagaacgatgggaactt

SEQ ID NO: 182138 - DNA, 25 bp, Mus musculus
agctggcttagatcgatgggaactt

SEQ ID NO: 182139 - DNA, 25 bp, Mus musculus
agctggcttattctacccacgggaa

SEQ ID NO: 182140 - DNA, 25 bp, Mus musculus
agctggcttattgtacccacgggaa

SEQ ID NO: 182141 - DNA, 25 bp, Mus musculus
agctggcttccaaaatttgtctctc

SEQ ID NO: 182142 - DNA, 25 bp, Mus musculus
agctggcttccataatttgtctctc

SEQ ID NO: 182143 - DNA, 25 bp, Mus musculus
agctggcttctgatggcagatatct

SEQ ID NO: 182144 - DNA, 25 bp, Mus musculus
agctggcttctgttggcagatatct

SEQ ID NO: 182145 - DNA, 25 bp, Mus musculus
agctggcttgagaatgaggccactt

SEQ ID NO: 182146 - DNA, 25 bp, Mus musculus
agctggcttgagtatgaggccactt

SEQ ID NO: 182147 - DNA, 25 bp, Mus musculus
agctggcttgatcagtttgtttgca

SEQ ID NO: 182148 - DNA, 25 bp, Mus musculus
agctggcttgatgagtttgtttgca

SEQ ID NO: 182149 - DNA, 25 bp, Mus musculus
agctggcttgctatactggcactct

SEQ ID NO: 182150 - DNA, 25 bp, Mus musculus
agctggcttgctccctgggtattgc

SEQ ID NO: 182151 - DNA, 25 bp, Mus musculus
agctggcttgctgcctgggtattgc

SEQ ID NO: 182152 - DNA, 25 bp, Mus musculus
agctggcttgctttactggcactct

SEQ ID NO: 182153 - DNA, 25 bp, Mus musculus
agctggcttgtcctatgtcctgggc

SEQ ID NO: 182154 - DNA, 25 bp, Mus musculus
agctggcttgtcgtatgtcctgggc

SEQ ID NO: 182155 - DNA, 25 bp, Mus musculus
agctggcttgtgcactgctggtcac

SEQ ID NO: 182156 - DNA, 25 bp, Mus musculus
agctggcttgtggactgctggtcac

SEQ ID NO: 182157 - DNA, 25 bp, Mus musculus
agctgggaagcacatgcagaactca

SEQ ID NO: 182158 - DNA, 25 bp, Mus musculus
agctgggaagcagatgcagaactca

SEQ ID NO: 182159 - DNA, 25 bp, Mus musculus
agctgggaagctattgtttgttgtg

SEQ ID NO: 182160 - DNA, 25 bp, Mus musculus
agctgggaagcttttgtttgttgtg

SEQ ID NO: 182161 - DNA, 25 bp, Mus musculus
agctgggaatacagatggctcaatg

SEQ ID NO: 182162 - DNA, 25 bp, Mus musculus
agctgggaatactgatggctcaatg

SEQ ID NO: 182163 - DNA, 25 bp, Mus musculus
agctgggacaatcttctcaagtgtg

SEQ ID NO: 182164 - DNA, 25 bp, Mus musculus
agctgggacaatgttctcaagtgtg

SEQ ID NO: 182165 - DNA, 25 bp, Mus musculus
agctgggacagtaggtcagtagttc

SEQ ID NO: 182166 - DNA, 25 bp, Mus musculus
agctgggacagttggtcagtagttc

SEQ ID NO: 182167 - DNA, 25 bp, Mus musculus
agctgggaccatagtttcgggactc

SEQ ID NO: 182168 - DNA, 25 bp, Mus musculus
agctgggaccattgtttcgggactc

SEQ ID NO: 182169 - DNA, 25 bp, Mus musculus
agctgggacctacgctatcttatta

SEQ ID NO: 182170 - DNA, 25 bp, Mus musculus
agctgggacctaggctatcttatta

SEQ ID NO: 182171 - DNA, 25 bp, Mus musculus
agctgggactctaggtcattgccac

SEQ ID NO: 182172 - DNA, 25 bp, Mus musculus
agctgggactcttggtcattgccac

SEQ ID NO: 182173 - DNA, 25 bp, Mus musculus
agctgggactggagcatccacatca

SEQ ID NO: 182174 - DNA, 25 bp, Mus musculus
agctgggactggtgcatccacatca

SEQ ID NO: 182175 - DNA, 25 bp, Mus musculus
agctgggacttgcaccacggtcata

SEQ ID NO: 182176 - DNA, 25 bp, Mus musculus
agctgggacttggaccacggtcata

SEQ ID NO: 182177 - DNA, 25 bp, Mus musculus
agctgggagaaccatgtgcttctgc

SEQ ID NO: 182178 - DNA, 25 bp, Mus musculus
agctgggagaacgatgtgcttctgc

SEQ ID NO: 182179 - DNA, 25 bp, Mus musculus
agctgggagatacctgttcccttag

SEQ ID NO: 182180 - DNA, 25 bp, Mus musculus
agctgggagatagctgttcccttag

SEQ ID NO: 182181 - DNA, 25 bp, Mus musculus
agctgggaggatagacccacaaggt

SEQ ID NO: 182182 - DNA, 25 bp, Mus musculus
agctgggaggattgacccacaaggt

SEQ ID NO: 182183 - DNA, 25 bp, Mus musculus
agctgggaggtaaactttcttctga

SEQ ID NO: 182184 - DNA, 25 bp, Mus musculus
agctgggaggtatactttcttctga

SEQ ID NO: 182185 - DNA, 25 bp, Mus musculus
agctgggagtaaaatatatgtgtat

SEQ ID NO: 182186 - DNA, 25 bp, Mus musculus
agctgggagtaatatatatgtgtat

SEQ ID NO: 182187 - DNA, 25 bp, Mus musculus
agctgggatattatgccacttttaa

SEQ ID NO: 182188 - DNA, 25 bp, Mus musculus
agctgggatattttgccacttttaa

SEQ ID NO: 182189 - DNA, 25 bp, Mus musculus
agctgggatccaccccttcgggcgt

SEQ ID NO: 182190 - DNA, 25 bp, Mus musculus
agctgggatccagcccttcgggcgt

SEQ ID NO: 182191 - DNA, 25 bp, Mus musculus
agctgggatgccagaagcccaaccc

SEQ ID NO: 182192 - DNA, 25 bp, Mus musculus
agctgggatgcctgaagcccaaccc

SEQ ID NO: 182193 - DNA, 25 bp, Mus musculus
agctgggatggaattctgtttctca

SEQ ID NO: 182194 - DNA, 25 bp, Mus musculus
agctgggatggatttctgtttctca

SEQ ID NO: 182195 - DNA, 25 bp, Mus musculus
agctgggatgtacttaagtctcaac

SEQ ID NO: 182196 - DNA, 25 bp, Mus musculus
agctgggatgtagttaagtctcaac

SEQ ID NO: 182197 - DNA, 25 bp, Mus musculus
agctgggattgaacacccctgaaat

SEQ ID NO: 182198 - DNA, 25 bp, Mus musculus
agctgggattgatcacccctgaaat

SEQ ID NO: 182199 - DNA, 25 bp, Mus musculus
agctgggatttcaggactgtgctct

SEQ ID NO: 182200 - DNA, 25 bp, Mus musculus
agctgggatttctggactgtgctct

SEQ ID NO: 182201 - DNA, 25 bp, Mus musculus
agctgggcaagacgctacctcagtt

SEQ ID NO: 182202 - DNA, 25 bp, Mus musculus
agctgggcaagaggctacctcagtt

SEQ ID NO: 182203 - DNA, 25 bp, Mus musculus
agctgggcacaacagtactactgtc

SEQ ID NO: 182204 - DNA, 25 bp, Mus musculus
agctgggcacaagagtactactgtc

SEQ ID NO: 182205 - DNA, 25 bp, Mus musculus
agctgggcacagcacgctagagcaa

SEQ ID NO: 182206 - DNA, 25 bp, Mus musculus
agctgggcacaggacgctagagcaa

SEQ ID NO: 182207 - DNA, 25 bp, Mus musculus
agctgggcagagagcttagccctct

SEQ ID NO: 182208 - DNA, 25 bp, Mus musculus
agctgggcagagtgcttagccctct

SEQ ID NO: 182209 - DNA, 25 bp, Mus musculus
agctgggcagcactgcctataatga

SEQ ID NO: 182210 - DNA, 25 bp, Mus musculus
agctgggcagcagtgcctataatga

SEQ ID NO: 182211 - DNA, 25 bp, Mus musculus
agctgggcagtcaatcctggcagga

SEQ ID NO: 182212 - DNA, 25 bp, Mus musculus
agctgggcagtctatcctggcagga

SEQ ID NO: 182213 - DNA, 25 bp, Mus musculus
agctgggcatatcaacttctccaag

SEQ ID NO: 182214 - DNA, 25 bp, Mus musculus
agctgggcatatgaacttctccaag

SEQ ID NO: 182215 - DNA, 25 bp, Mus musculus
agctgggcatgcagctggacctgca

SEQ ID NO: 182216 - DNA, 25 bp, Mus musculus
agctgggcatgctgctggacctgca

SEQ ID NO: 182217 - DNA, 25 bp, Mus musculus
agctgggcatggctacactcaacct

SEQ ID NO: 182218 - DNA, 25 bp, Mus musculus
agctgggcatgggtacactcaacct

SEQ ID NO: 182219 - DNA, 25 bp, Mus musculus
agctgggccactcggttgcagtcat

SEQ ID NO: 182220 - DNA, 25 bp, Mus musculus
agctgggccactgggttgcagtcat

SEQ ID NO: 182221 - DNA, 25 bp, Mus musculus
agctgggccagacgtttaattttct

SEQ ID NO: 182222 - DNA, 25 bp, Mus musculus
agctgggccagaggtttaattttct

SEQ ID NO: 182223 - DNA, 25 bp, Mus musculus
agctgggccaggatctagacaaaca

SEQ ID NO: 182224 - DNA, 25 bp, Mus musculus
agctgggccaggttctagacaaaca

SEQ ID NO: 182225 - DNA, 25 bp, Mus musculus
agctgggccagtagtccagagttac

SEQ ID NO: 182226 - DNA, 25 bp, Mus musculus
agctgggccagtctcggatgctcaa

SEQ ID NO: 182227 - DNA, 25 bp, Mus musculus
agctgggccagtgtcggatgctcaa

SEQ ID NO: 182228 - DNA, 25 bp, Mus musculus
agctgggccagttgtccagagttac

SEQ ID NO: 182229 - DNA, 25 bp, Mus musculus
agctgggccattcctaatgctcatt

SEQ ID NO: 182230 - DNA, 25 bp, Mus musculus
agctgggccattgctaatgctcatt

SEQ ID NO: 182231 - DNA, 25 bp, Mus musculus
agctgggcccagatgatgttgtacg

SEQ ID NO: 182232 - DNA, 25 bp, Mus musculus
agctgggcccagttgatgttgtacg

SEQ ID NO: 182233 - DNA, 25 bp, Mus musculus
agctgggcccggaattgattgtgtc

SEQ ID NO: 182234 - DNA, 25 bp, Mus musculus
agctgggcccggtattgattgtgtc

SEQ ID NO: 182235 - DNA, 25 bp, Mus musculus
agctgggccctcataaatcaaatca

SEQ ID NO: 182236 - DNA, 25 bp, Mus musculus
agctgggccctcttaaatcaaatca

SEQ ID NO: 182237 - DNA, 25 bp, Mus musculus
agctgggccgacagaaactcctgag

SEQ ID NO: 182238 - DNA, 25 bp, Mus musculus
agctgggccgactgaaactcctgag

SEQ ID NO: 182239 - DNA, 25 bp, Mus musculus
agctgggcctgtcttcctctgtcgg

SEQ ID NO: 182240 - DNA, 25 bp, Mus musculus
agctgggcctgtgttcctctgtcgg

SEQ ID NO: 182241 - DNA, 25 bp, Mus musculus
agctgggcctttatactgttgggca

SEQ ID NO: 182242 - DNA, 25 bp, Mus musculus
agctgggcctttcaccttgattgag

SEQ ID NO: 182243 - DNA, 25 bp, Mus musculus
agctgggcctttgaccttgattgag

SEQ ID NO: 182244 - DNA, 25 bp, Mus musculus
agctgggcctttttactgttgggca

SEQ ID NO: 182245 - DNA, 25 bp, Mus musculus
agctgggctacaagtgacacccgaa

SEQ ID NO: 182246 - DNA, 25 bp, Mus musculus
agctgggctacatgtgacacccgaa

SEQ ID NO: 182247 - DNA, 25 bp, Mus musculus
agctgggctatgctcagactccaaa

SEQ ID NO: 182248 - DNA, 25 bp, Mus musculus
agctgggctatggtcagactccaaa

SEQ ID NO: 182249 - DNA, 25 bp, Mus musculus
agctgggctcgtagtccagcctggt

SEQ ID NO: 182250 - DNA, 25 bp, Mus musculus
agctgggctcgttgtccagcctggt

SEQ ID NO: 182251 - DNA, 25 bp, Mus musculus
agctgggcttcaacgattacctaga

SEQ ID NO: 182252 - DNA, 25 bp, Mus musculus
agctgggcttcaatcagacaccata

SEQ ID NO: 182253 - DNA, 25 bp, Mus musculus
agctgggcttcatcgattacctaga

SEQ ID NO: 182254 - DNA, 25 bp, Mus musculus
agctgggcttcattcagacaccata

SEQ ID NO: 182255 - DNA, 25 bp, Mus musculus
agctgggctttaccagggactcatt

SEQ ID NO: 182256 - DNA, 25 bp, Mus musculus
agctgggctttagcagggactcatt

SEQ ID NO: 182257 - DNA, 25 bp, Mus musculus
agctgggctttcagagaccaatttc

SEQ ID NO: 182258 - DNA, 25 bp, Mus musculus
agctgggctttctgagaccaatttc

SEQ ID NO: 182259 - DNA, 25 bp, Mus musculus
agctggggtcccctattcagtgctc

SEQ ID NO: 182260 - DNA, 25 bp, Mus musculus
agctggggtcccgtattcagtgctc

SEQ ID NO: 182261 - DNA, 25 bp, Mus musculus
agctgggtacccaagtctggcaact

SEQ ID NO: 182262 - DNA, 25 bp, Mus musculus
agctgggtaccctagtctggcaact

SEQ ID NO: 182263 - DNA, 25 bp, Mus musculus
agctgggtaccgacaattatctagt

SEQ ID NO: 182264 - DNA, 25 bp, Mus musculus
agctgggtaccgtcaattatctagt

SEQ ID NO: 182265 - DNA, 25 bp, Mus musculus
agctgggtacttctcaaactgaatg

SEQ ID NO: 182266 - DNA, 25 bp, Mus musculus
agctgggtacttgtcaaactgaatg

SEQ ID NO: 182267 - DNA, 25 bp, Mus musculus
agctgggtatgaaggcatctcagca

SEQ ID NO: 182268 - DNA, 25 bp, Mus musculus
agctgggtatgatggcatctcagca

SEQ ID NO: 182269 - DNA, 25 bp, Mus musculus
agctgggtatggatgtacacgcctt

SEQ ID NO: 182270 - DNA, 25 bp, Mus musculus
agctgggtatggttgtacacgcctt

SEQ ID NO: 182271 - DNA, 25 bp, Mus musculus
agctgggtcacgaagctcaggtccc

SEQ ID NO: 182272 - DNA, 25 bp, Mus musculus
agctgggtcacgtagctcaggtccc

SEQ ID NO: 182273 - DNA, 25 bp, Mus musculus
agctgggtcccacagacgtgcagca

SEQ ID NO: 182274 - DNA, 25 bp, Mus musculus
agctgggtcccagagacgtgcagca

SEQ ID NO: 182275 - DNA, 25 bp, Mus musculus
agctgggtctagacgtaggcttgcc

SEQ ID NO: 182276 - DNA, 25 bp, Mus musculus
agctgggtctagctagaccttgcca

SEQ ID NO: 182277 - DNA, 25 bp, Mus musculus
agctgggtctaggtagaccttgcca

SEQ ID NO: 182278 - DNA, 25 bp, Mus musculus
agctgggtctagtcgtaggcttgcc

SEQ ID NO: 182279 - DNA, 25 bp, Mus musculus
agctgggtctgactgccccttaagt

SEQ ID NO: 182280 - DNA, 25 bp, Mus musculus
agctgggtctgagtgccccttaagt

SEQ ID NO: 182281 - DNA, 25 bp, Mus musculus
agctgggtctttcaagcacagtgca

SEQ ID NO: 182282 - DNA, 25 bp, Mus musculus
agctgggtctttgaagcacagtgca

SEQ ID NO: 182283 - DNA, 25 bp, Mus musculus
agctgggtgactagggcattaaaca

SEQ ID NO: 182284 - DNA, 25 bp, Mus musculus
agctgggtgacttgggcattaaaca

SEQ ID NO: 182285 - DNA, 25 bp, Mus musculus
agctgggtgcctccatgcggacact

SEQ ID NO: 182286 - DNA, 25 bp, Mus musculus
agctgggtgcctgcatgcggacact

SEQ ID NO: 182287 - DNA, 25 bp, Mus musculus
agctgggtggccaatatgagacata

SEQ ID NO: 182288 - DNA, 25 bp, Mus musculus
agctgggtggcctatatgagacata

SEQ ID NO: 182289 - DNA, 25 bp, Mus musculus
agctgggtggttagtacattcaagt

SEQ ID NO: 182290 - DNA, 25 bp, Mus musculus
agctgggtggtttgtacattcaagt

SEQ ID NO: 182291 - DNA, 25 bp, Mus musculus
agctgggtgtccctactcctctggg

SEQ ID NO: 182292 - DNA, 25 bp, Mus musculus
agctgggtgtccgtactcctctggg

SEQ ID NO: 182293 - DNA, 25 bp, Mus musculus
agctgggtgtggactgtactgctcc

SEQ ID NO: 182294 - DNA, 25 bp, Mus musculus
agctgggtgtggtctgtactgctcc

SEQ ID NO: 182295 - DNA, 25 bp, Mus musculus
agctgggttagacatgtagaccatc

SEQ ID NO: 182296 - DNA, 25 bp, Mus musculus
agctgggttagagatgtagaccatc

SEQ ID NO: 182297 - DNA, 25 bp, Mus musculus
agctgggttcggctctcttttctgg

SEQ ID NO: 182298 - DNA, 25 bp, Mus musculus
agctgggttcgggtctcttttctgg

SEQ ID NO: 182299 - DNA, 25 bp, Mus musculus
agctgggttctcaaaaagttacaag

SEQ ID NO: 182300 - DNA, 25 bp, Mus musculus
agctgggttctcctcagaggacaca

SEQ ID NO: 182301 - DNA, 25 bp, Mus musculus
agctgggttctcgtcagaggacaca

SEQ ID NO: 182302 - DNA, 25 bp, Mus musculus
agctgggttctctaaaagttacaag

SEQ ID NO: 182303 - DNA, 25 bp, Mus musculus
agctgggttttcatggtgcctgcct

SEQ ID NO: 182304 - DNA, 25 bp, Mus musculus
agctgggttttcttggtgcctgcct

SEQ ID NO: 182305 - DNA, 25 bp, Mus musculus
agctgggttttgatattctctagaa

SEQ ID NO: 182306 - DNA, 25 bp, Mus musculus
agctgggttttgttattctctagaa

SEQ ID NO: 182307 - DNA, 25 bp, Mus musculus
agctggtaataaagccctgcttgcc

SEQ ID NO: 182308 - DNA, 25 bp, Mus musculus
agctggtaataatgccctgcttgcc

SEQ ID NO: 182309 - DNA, 25 bp, Mus musculus
agctggtacagcaactaacgtttgc

SEQ ID NO: 182310 - DNA, 25 bp, Mus musculus
agctggtacagctactaacgtttgc

SEQ ID NO: 182311 - DNA, 25 bp, Mus musculus
agctggtaccacctcagacagatgt

SEQ ID NO: 182312 - DNA, 25 bp, Mus musculus
agctggtaccacgtcagacagatgt

SEQ ID NO: 182313 - DNA, 25 bp, Mus musculus
agctggtaccatattgaagctcttc

SEQ ID NO: 182314 - DNA, 25 bp, Mus musculus
agctggtaccattttgaagctcttc

SEQ ID NO: 182315 - DNA, 25 bp, Mus musculus
agctggtacccaaaacgctgctgct

SEQ ID NO: 182316 - DNA, 25 bp, Mus musculus
agctggtacccataacgctgctgct

SEQ ID NO: 182317 - DNA, 25 bp, Mus musculus
agctggtacctcacgcaggattaac

SEQ ID NO: 182318 - DNA, 25 bp, Mus musculus
agctggtacctccagtttgcacagg

SEQ ID NO: 182319 - DNA, 25 bp, Mus musculus
agctggtacctcgagtttgcacagg

SEQ ID NO: 182320 - DNA, 25 bp, Mus musculus
agctggtacctctcgcaggattaac

SEQ ID NO: 182321 - DNA, 25 bp, Mus musculus
agctggtacctgagagttgcatctt

SEQ ID NO: 182322 - DNA, 25 bp, Mus musculus
agctggtacctgtgagttgcatctt

SEQ ID NO: 182323 - DNA, 25 bp, Mus musculus
agctggtacgagacagagccttctt

SEQ ID NO: 182324 - DNA, 25 bp, Mus musculus
agctggtacgagtcagagccttctt

SEQ ID NO: 182325 - DNA, 25 bp, Mus musculus
agctggtagctaatgtactgttact

SEQ ID NO: 182326 - DNA, 25 bp, Mus musculus
agctggtagctattgtactgttact

SEQ ID NO: 182327 - DNA, 25 bp, Mus musculus
agctggtaggagacagacttgctca

SEQ ID NO: 182328 - DNA, 25 bp, Mus musculus
agctggtaggagtcagacttgctca

SEQ ID NO: 182329 - DNA, 25 bp, Mus musculus
agctggtagggcacccttttgagaa

SEQ ID NO: 182330 - DNA, 25 bp, Mus musculus
agctggtagggctcccttttgagaa

SEQ ID NO: 182331 - DNA, 25 bp, Mus musculus
agctggtatgaccttaatttataaa

SEQ ID NO: 182332 - DNA, 25 bp, Mus musculus
agctggtatgacgttaatttataaa

SEQ ID NO: 182333 - DNA, 25 bp, Mus musculus
agctggtattatcccctttgtagac

SEQ ID NO: 182334 - DNA, 25 bp, Mus musculus
agctggtattatgccctttgtagac

SEQ ID NO: 182335 - DNA, 25 bp, Mus musculus
agctggtattgcatactcattatag

SEQ ID NO: 182336 - DNA, 25 bp, Mus musculus
agctggtattgcttactcattatag

SEQ ID NO: 182337 - DNA, 25 bp, Mus musculus
agctggtcacggagcatgcgcagct

SEQ ID NO: 182338 - DNA, 25 bp, Mus musculus
agctggtcacggtgcatgcgcagct

SEQ ID NO: 182339 - DNA, 25 bp, Mus musculus
agctggtccagacatacaacaggat

SEQ ID NO: 182340 - DNA, 25 bp, Mus musculus
agctggtccagagatacaacaggat

SEQ ID NO: 182341 - DNA, 25 bp, Mus musculus
agctggtccagtccctcacagagtt

SEQ ID NO: 182342 - DNA, 25 bp, Mus musculus
agctggtccagtgcctcacagagtt

SEQ ID NO: 182343 - DNA, 25 bp, Mus musculus
agctggtcccggaagcaggtatgct

SEQ ID NO: 182344 - DNA, 25 bp, Mus musculus
agctggtcccggtagcaggtatgct

SEQ ID NO: 182345 - DNA, 25 bp, Mus musculus
agctggtcctccaatgactgtctgc

SEQ ID NO: 182346 - DNA, 25 bp, Mus musculus
agctggtcctcctatgactgtctgc

SEQ ID NO: 182347 - DNA, 25 bp, Mus musculus
agctggtcctgtctagagcatcacc

SEQ ID NO: 182348 - DNA, 25 bp, Mus musculus
agctggtcctgtgtagagcatcacc

SEQ ID NO: 182349 - DNA, 25 bp, Mus musculus
agctggtctaacagcccggaggcac

SEQ ID NO: 182350 - DNA, 25 bp, Mus musculus
agctggtctaactgcccggaggcac

SEQ ID NO: 182351 - DNA, 25 bp, Mus musculus
agctggtctcagaaattatgtatca

SEQ ID NO: 182352 - DNA, 25 bp, Mus musculus
agctggtctcagtaattatgtatca

SEQ ID NO: 182353 - DNA, 25 bp, Mus musculus
agctggtctgggacaagtgcccagc

SEQ ID NO: 182354 - DNA, 25 bp, Mus musculus
agctggtctgggtcaagtgcccagc

SEQ ID NO: 182355 - DNA, 25 bp, Mus musculus
agctggtgaactctagcttgctcac

SEQ ID NO: 182356 - DNA, 25 bp, Mus musculus
agctggtgaactgtagcttgctcac

SEQ ID NO: 182357 - DNA, 25 bp, Mus musculus
agctggtgacctaggcaggctgtgc

SEQ ID NO: 182358 - DNA, 25 bp, Mus musculus
agctggtgaccttggcaggctgtgc

SEQ ID NO: 182359 - DNA, 25 bp, Mus musculus
agctggtgatagcactggactgaaa

SEQ ID NO: 182360 - DNA, 25 bp, Mus musculus
agctggtgataggactggactgaaa

SEQ ID NO: 182361 - DNA, 25 bp, Mus musculus
agctggtgatgaagctccgagccac

SEQ ID NO: 182362 - DNA, 25 bp, Mus musculus
agctggtgatgatgctccgagccac

SEQ ID NO: 182363 - DNA, 25 bp, Mus musculus
agctggtgcagcagggcttcattag

SEQ ID NO: 182364 - DNA, 25 bp, Mus musculus
agctggtgcagctgggcttcattag

SEQ ID NO: 182365 - DNA, 25 bp, Mus musculus
agctggtgcatcacacacttggtct

SEQ ID NO: 182366 - DNA, 25 bp, Mus musculus
agctggtgcatctcacacttggtct

SEQ ID NO: 182367 - DNA, 25 bp, Mus musculus
agctggtgcattactcagggctttc

SEQ ID NO: 182368 - DNA, 25 bp, Mus musculus
agctggtgcattactgaggtctctc

SEQ ID NO: 182369 - DNA, 25 bp, Mus musculus
agctggtgcatttctcagggctttc

SEQ ID NO: 182370 - DNA, 25 bp, Mus musculus
agctggtgcatttctgaggtctctc

SEQ ID NO: 182371 - DNA, 25 bp, Mus musculus
agctggtgccaacccatttagtctt

SEQ ID NO: 182372 - DNA, 25 bp, Mus musculus
agctggtgccaactacatcatgatc

SEQ ID NO: 182373 - DNA, 25 bp, Mus musculus
agctggtgccaagccatttagtctt

SEQ ID NO: 182374 - DNA, 25 bp, Mus musculus
agctggtgccaagtacatcatgatc

SEQ ID NO: 182375 - DNA, 25 bp, Mus musculus
agctggtgccagacattgagttcaa

SEQ ID NO: 182376 - DNA, 25 bp, Mus musculus
agctggtgccagtcattgagttcaa

SEQ ID NO: 182377 - DNA, 25 bp, Mus musculus
agctggtgcccaaagttgaacatga

SEQ ID NO: 182378 - DNA, 25 bp, Mus musculus
agctggtgcccatagttgaacatga

SEQ ID NO: 182379 - DNA, 25 bp, Mus musculus
agctggtgcttgataatctcatcgt

SEQ ID NO: 182380 - DNA, 25 bp, Mus musculus
agctggtgcttgttaatctcatcgt

SEQ ID NO: 182381 - DNA, 25 bp, Mus musculus
agctggtggattcagtgggctcctc

SEQ ID NO: 182382 - DNA, 25 bp, Mus musculus
agctggtggattgagtgggctcctc

SEQ ID NO: 182383 - DNA, 25 bp, Mus musculus
agctggtggcgtcagaacataatct

SEQ ID NO: 182384 - DNA, 25 bp, Mus musculus
agctggtggcgtgagaacataatct

SEQ ID NO: 182385 - DNA, 25 bp, Mus musculus
agctggtgggccaaacagtgctcaa

SEQ ID NO: 182386 - DNA, 25 bp, Mus musculus
agctggtgggcctaacagtgctcaa

SEQ ID NO: 182387 - DNA, 25 bp, Mus musculus
agctggtggtgaaccatcctgcccg

SEQ ID NO: 182388 - DNA, 25 bp, Mus musculus
agctggtggtgatccatcctgcccg

SEQ ID NO: 182389 - DNA, 25 bp, Mus musculus
agctggtggtttccctcaacaacat

SEQ ID NO: 182390 - DNA, 25 bp, Mus musculus
agctggtggtttgcctcaacaacat

SEQ ID NO: 182391 - DNA, 25 bp, Mus musculus
agctggtgtgaactgcctccacggt

SEQ ID NO: 182392 - DNA, 25 bp, Mus musculus
agctggtgtgaagtgcctccacggt

SEQ ID NO: 182393 - DNA, 25 bp, Mus musculus
agctggtgtgagagaccctcttgca

SEQ ID NO: 182394 - DNA, 25 bp, Mus musculus
agctggtgtgagtgaccctcttgca

SEQ ID NO: 182395 - DNA, 25 bp, Mus musculus
agctggtgtgtacgtgttgccccac

SEQ ID NO: 182396 - DNA, 25 bp, Mus musculus
agctggtgtgtaggtgttgccccac

SEQ ID NO: 182397 - DNA, 25 bp, Mus musculus
agctggttaaggctttcatttcact

SEQ ID NO: 182398 - DNA, 25 bp, Mus musculus
agctggttaagggtttcatttcact

SEQ ID NO: 182399 - DNA, 25 bp, Mus musculus
agctggttaccaccctaagaggagg

SEQ ID NO: 182400 - DNA, 25 bp, Mus musculus
agctggttaccagcctaagaggagg

SEQ ID NO: 182401 - DNA, 25 bp, Mus musculus
agctggttacctcccttagttacaa

SEQ ID NO: 182402 - DNA, 25 bp, Mus musculus
agctggttacctgccttagttacaa

SEQ ID NO: 182403 - DNA, 25 bp, Mus musculus
agctggttcagtcctgtcatttaca

SEQ ID NO: 182404 - DNA, 25 bp, Mus musculus
agctggttcagtgctgtcatttaca

SEQ ID NO: 182405 - DNA, 25 bp, Mus musculus
agctggttcctgatttcctgaggga

SEQ ID NO: 182406 - DNA, 25 bp, Mus musculus
agctggttcctgttttcctgaggga

SEQ ID NO: 182407 - DNA, 25 bp, Mus musculus
agctggttctacaccaagtgctgaa

SEQ ID NO: 182408 - DNA, 25 bp, Mus musculus
agctggttctacatgaaactgcgtc

SEQ ID NO: 182409 - DNA, 25 bp, Mus musculus
agctggttctactccaagtgctgaa

SEQ ID NO: 182410 - DNA, 25 bp, Mus musculus
agctggttctacttgaaactgcgtc

SEQ ID NO: 182411 - DNA, 25 bp, Mus musculus
agctggttggctactctgtttgtct

SEQ ID NO: 182412 - DNA, 25 bp, Mus musculus
agctggttggctagctggcatctcc

SEQ ID NO: 182413 - DNA, 25 bp, Mus musculus
agctggttggcttctctgtttgtct

SEQ ID NO: 182414 - DNA, 25 bp, Mus musculus
agctggttggcttgctggcatctcc

SEQ ID NO: 182415 - DNA, 25 bp, Mus musculus
agctggtttagcaggtcattgctca

SEQ ID NO: 182416 - DNA, 25 bp, Mus musculus
agctggtttagctggtcattgctca

SEQ ID NO: 182417 - DNA, 25 bp, Mus musculus
agctggtttcaactatgtgtctgtt

SEQ ID NO: 182418 - DNA, 25 bp, Mus musculus
agctggtttcaagtatgtgtctgtt

SEQ ID NO: 182419 - DNA, 25 bp, Mus musculus
agctggtttgacaatccactctcac

SEQ ID NO: 182420 - DNA, 25 bp, Mus musculus
agctggtttgactatccactctcac

SEQ ID NO: 182421 - DNA, 25 bp, Mus musculus
agctggtttttgatcctggtctttt

SEQ ID NO: 182422 - DNA, 25 bp, Mus musculus
agctggtttttgttcctggtctttt

SEQ ID NO: 182423 - DNA, 25 bp, Mus musculus
agctgtaaagctcttcattcaataa

SEQ ID NO: 182424 - DNA, 25 bp, Mus musculus
agctgtaaagctgttcattcaataa

SEQ ID NO: 182425 - DNA, 25 bp, Mus musculus
agctgtaaattccatccgcagacat

SEQ ID NO: 182426 - DNA, 25 bp, Mus musculus
agctgtaaattcgatccgcagacat

SEQ ID NO: 182427 - DNA, 25 bp, Mus musculus
agctgtaacaacctttggtgctcca

SEQ ID NO: 182428 - DNA, 25 bp, Mus musculus
agctgtaacaacgtttggtgctcca

SEQ ID NO: 182429 - DNA, 25 bp, Mus musculus
agctgtaacagtcgcacgtcctaca

SEQ ID NO: 182430 - DNA, 25 bp, Mus musculus
agctgtaacagtggcacgtcctaca

SEQ ID NO: 182431 - DNA, 25 bp, Mus musculus
agctgtaacctgatgttgctggcgg

SEQ ID NO: 182432 - DNA, 25 bp, Mus musculus
agctgtaacctgttgttgctggcgg

SEQ ID NO: 182433 - DNA, 25 bp, Mus musculus
agctgtaactcgacagacactcggg

SEQ ID NO: 182434 - DNA, 25 bp, Mus musculus
agctgtaactcgtcagacactcggg

SEQ ID NO: 182435 - DNA, 25 bp, Mus musculus
agctgtaactctcactccagcgcat

SEQ ID NO: 182436 - DNA, 25 bp, Mus musculus
agctgtaactctgactccagcgcat

SEQ ID NO: 182437 - DNA, 25 bp, Mus musculus
agctgtaatcaccagggtcacccac

SEQ ID NO: 182438 - DNA, 25 bp, Mus musculus
agctgtaatcacgagggtcacccac

SEQ ID NO: 182439 - DNA, 25 bp, Mus musculus
agctgtaatctgatttgcagcagaa

SEQ ID NO: 182440 - DNA, 25 bp, Mus musculus
agctgtaatctgttttgcagcagaa

SEQ ID NO: 182441 - DNA, 25 bp, Mus musculus
agctgtaatcttctgggtgtggtta

SEQ ID NO: 182442 - DNA, 25 bp, Mus musculus
agctgtaatcttgtgggtgtggtta

SEQ ID NO: 182443 - DNA, 25 bp, Mus musculus
agctgtaattacaactttcatttaa

SEQ ID NO: 182444 - DNA, 25 bp, Mus musculus
agctgtaattactactttcatttaa

SEQ ID NO: 182445 - DNA, 25 bp, Mus musculus
agctgtaattcaactggagccatta

SEQ ID NO: 182446 - DNA, 25 bp, Mus musculus
agctgtaattcatctggagccatta

SEQ ID NO: 182447 - DNA, 25 bp, Mus musculus
agctgtacaaacagcctcactggta

SEQ ID NO: 182448 - DNA, 25 bp, Mus musculus
agctgtacaaaccttttaaagcaca

SEQ ID NO: 182449 - DNA, 25 bp, Mus musculus
agctgtacaaacgttttaaagcaca

SEQ ID NO: 182450 - DNA, 25 bp, Mus musculus
agctgtacaaactgcctcactggta

SEQ ID NO: 182451 - DNA, 25 bp, Mus musculus
agctgtacaatcctttcatcattcg

SEQ ID NO: 182452 - DNA, 25 bp, Mus musculus
agctgtacaatcgtttcatcattcg

SEQ ID NO: 182453 - DNA, 25 bp, Mus musculus
agctgtacaatgattgcctagcatg

SEQ ID NO: 182454 - DNA, 25 bp, Mus musculus
agctgtacaatgtttgcctagcatg

SEQ ID NO: 182455 - DNA, 25 bp, Mus musculus
agctgtacagccactgtgcttagtg

SEQ ID NO: 182456 - DNA, 25 bp, Mus musculus
agctgtacagcctctgtgcttagtg

SEQ ID NO: 182457 - DNA, 25 bp, Mus musculus
agctgtacagctctctaattaatac

SEQ ID NO: 182458 - DNA, 25 bp, Mus musculus
agctgtacagctgtctaattaatac

SEQ ID NO: 182459 - DNA, 25 bp, Mus musculus
agctgtacatacatactggctttgt

SEQ ID NO: 182460 - DNA, 25 bp, Mus musculus
agctgtacatacttactggctttgt

SEQ ID NO: 182461 - DNA, 25 bp, Mus musculus
agctgtacattgatcattctcatga

SEQ ID NO: 182462 - DNA, 25 bp, Mus musculus
agctgtacattgttcattctcatga

SEQ ID NO: 182463 - DNA, 25 bp, Mus musculus
agctgtaccaccacatgatgctgtg

SEQ ID NO: 182464 - DNA, 25 bp, Mus musculus
agctgtaccacctcatgatgctgtg

SEQ ID NO: 182465 - DNA, 25 bp, Mus musculus
agctgtaccaggctcctgaggtcct

SEQ ID NO: 182466 - DNA, 25 bp, Mus musculus
agctgtaccagggtcctgaggtcct

SEQ ID NO: 182467 - DNA, 25 bp, Mus musculus
agctgtaccatccagtaatcgcccg

SEQ ID NO: 182468 - DNA, 25 bp, Mus musculus
agctgtaccatcgagtaatcgcccg

SEQ ID NO: 182469 - DNA, 25 bp, Mus musculus
agctgtaccctgaaacacaaagtgg

SEQ ID NO: 182470 - DNA, 25 bp, Mus musculus
agctgtaccctgtaacacaaagtgg

SEQ ID NO: 182471 - DNA, 25 bp, Mus musculus
agctgtacctatcagccgagtcgct

SEQ ID NO: 182472 - DNA, 25 bp, Mus musculus
agctgtacctatgagccgagtcgct

SEQ ID NO: 182473 - DNA, 25 bp, Mus musculus
agctgtacctcgctgtgggaccaaa

SEQ ID NO: 182474 - DNA, 25 bp, Mus musculus
agctgtacctcggtgtgggaccaaa

SEQ ID NO: 182475 - DNA, 25 bp, Mus musculus
agctgtacctctactccttcatcag

SEQ ID NO: 182476 - DNA, 25 bp, Mus musculus
agctgtacctcttctccttcatcag

SEQ ID NO: 182477 - DNA, 25 bp, Mus musculus
agctgtactcctaaatgtcctcaga

SEQ ID NO: 182478 - DNA, 25 bp, Mus musculus
agctgtactccttaatgtcctcaga

SEQ ID NO: 182479 - DNA, 25 bp, Mus musculus
agctgtactgctaaaaaatcattca

SEQ ID NO: 182480 - DNA, 25 bp, Mus musculus
agctgtactgctccaacatgtggcc

SEQ ID NO: 182481 - DNA, 25 bp, Mus musculus
agctgtactgctgcaacatgtggcc

SEQ ID NO: 182482 - DNA, 25 bp, Mus musculus
agctgtactgcttaaaaatcattca

SEQ ID NO: 182483 - DNA, 25 bp, Mus musculus
agctgtactggtagcttgccacaaa

SEQ ID NO: 182484 - DNA, 25 bp, Mus musculus
agctgtactggttgcttgccacaaa

SEQ ID NO: 182485 - DNA, 25 bp, Mus musculus
agctgtactgtgctgactcaggcct

SEQ ID NO: 182486 - DNA, 25 bp, Mus musculus
agctgtactgtggtgactcaggcct

SEQ ID NO: 182487 - DNA, 25 bp, Mus musculus
agctgtacttcaatcctcgttaaag

SEQ ID NO: 182488 - DNA, 25 bp, Mus musculus
agctgtacttcattcctcgttaaag

SEQ ID NO: 182489 - DNA, 25 bp, Mus musculus
agctgtactttcatgtttggtttaa

SEQ ID NO: 182490 - DNA, 25 bp, Mus musculus
agctgtactttcttgtttggtttaa

SEQ ID NO: 182491 - DNA, 25 bp, Mus musculus
agctgtagaggcatcaactcagtac

SEQ ID NO: 182492 - DNA, 25 bp, Mus musculus
agctgtagaggcttcaactcagtac

SEQ ID NO: 182493 - DNA, 25 bp, Mus musculus
agctgtagcctcaagctattgctta

SEQ ID NO: 182494 - DNA, 25 bp, Mus musculus
agctgtagcctctagctattgctta

SEQ ID NO: 182495 - DNA, 25 bp, Mus musculus
agctgtagcgtcacctggaaaccaa

SEQ ID NO: 182496 - DNA, 25 bp, Mus musculus
agctgtagcgtctcctggaaaccaa

SEQ ID NO: 182497 - DNA, 25 bp, Mus musculus
agctgtagctatcgcctagccagca

SEQ ID NO: 182498 - DNA, 25 bp, Mus musculus
agctgtagctatggcctagccagca

SEQ ID NO: 182499 - DNA, 25 bp, Mus musculus
agctgtagctctaaggctcaaatgg

SEQ ID NO: 182500 - DNA, 25 bp, Mus musculus
agctgtagctctattctgaaccaag

SEQ ID NO: 182501 - DNA, 25 bp, Mus musculus
agctgtagctcttaggctcaaatgg

SEQ ID NO: 182502 - DNA, 25 bp, Mus musculus
agctgtagctcttttctgaaccaag

SEQ ID NO: 182503 - DNA, 25 bp, Mus musculus
agctgtaggaagaccacacgggaga

SEQ ID NO: 182504 - DNA, 25 bp, Mus musculus
agctgtaggaagtccacacgggaga

SEQ ID NO: 182505 - DNA, 25 bp, Mus musculus
agctgtagtaggacctgctgcagtt

SEQ ID NO: 182506 - DNA, 25 bp, Mus musculus
agctgtagtaggtcctgctgcagtt

SEQ ID NO: 182507 - DNA, 25 bp, Mus musculus
agctgtagtgggactttgatcatgg

SEQ ID NO: 182508 - DNA, 25 bp, Mus musculus
agctgtagtgggtctttgatcatgg

SEQ ID NO: 182509 - DNA, 25 bp, Mus musculus
agctgtataaagagtgtgcctggat

SEQ ID NO: 182510 - DNA, 25 bp, Mus musculus
agctgtataaagtgtgtgcctggat

SEQ ID NO: 182511 - DNA, 25 bp, Mus musculus
agctgtatacctaggcttacttttg

SEQ ID NO: 182512 - DNA, 25 bp, Mus musculus
agctgtataccttggcttacttttg

SEQ ID NO: 182513 - DNA, 25 bp, Mus musculus
agctgtatagctctctttgtgtcac

SEQ ID NO: 182514 - DNA, 25 bp, Mus musculus
agctgtatagctgtctttgtgtcac

SEQ ID NO: 182515 - DNA, 25 bp, Mus musculus
agctgtatagttatgcctgtgtgaa

SEQ ID NO: 182516 - DNA, 25 bp, Mus musculus
agctgtatagttttgcctgtgtgaa

SEQ ID NO: 182517 - DNA, 25 bp, Mus musculus
agctgtatcaacaccttaaggagga

SEQ ID NO: 182518 - DNA, 25 bp, Mus musculus
agctgtatcaactccttaaggagga

SEQ ID NO: 182519 - DNA, 25 bp, Mus musculus
agctgtatcactccctttgtttata

SEQ ID NO: 182520 - DNA, 25 bp, Mus musculus
agctgtatcactgcctttgtttata

SEQ ID NO: 182521 - DNA, 25 bp, Mus musculus
agctgtatccacaaaatctccactg

SEQ ID NO: 182522 - DNA, 25 bp, Mus musculus
agctgtatccactaaatctccactg

SEQ ID NO: 182523 - DNA, 25 bp, Mus musculus
agctgtatctaaaggcctgtatcta

SEQ ID NO: 182524 - DNA, 25 bp, Mus musculus
agctgtatctaatggcctgtatcta

SEQ ID NO: 182525 - DNA, 25 bp, Mus musculus
agctgtatctctagttgtctgtatc

SEQ ID NO: 182526 - DNA, 25 bp, Mus musculus
agctgtatctcttgttgtctgtatc

SEQ ID NO: 182527 - DNA, 25 bp, Mus musculus
agctgtatcttgcaacatccacctc

SEQ ID NO: 182528 - DNA, 25 bp, Mus musculus
agctgtatcttggaacatccacctc

SEQ ID NO: 182529 - DNA, 25 bp, Mus musculus
agctgtatctttccaatgtctgcac

SEQ ID NO: 182530 - DNA, 25 bp, Mus musculus
agctgtatctttgcaatgtctgcac

SEQ ID NO: 182531 - DNA, 25 bp, Mus musculus
agctgtatgcagcacttgtgtgagt

SEQ ID NO: 182532 - DNA, 25 bp, Mus musculus
agctgtatgcaggacttgtgtgagt

SEQ ID NO: 182533 - DNA, 25 bp, Mus musculus
agctgtatgctaagaaaaccatgtc

SEQ ID NO: 182534 - DNA, 25 bp, Mus musculus
agctgtatgctatgaaaaccatgtc

SEQ ID NO: 182535 - DNA, 25 bp, Mus musculus
agctgtatggccatttttcctttat

SEQ ID NO: 182536 - DNA, 25 bp, Mus musculus
agctgtatggccttttttcctttat

SEQ ID NO: 182537 - DNA, 25 bp, Mus musculus
agctgtatggctccaaggaagaaga

SEQ ID NO: 182538 - DNA, 25 bp, Mus musculus
agctgtatggctgcaaggaagaaga

SEQ ID NO: 182539 - DNA, 25 bp, Mus musculus
agctgtattcacacccttgtttcca

SEQ ID NO: 182540 - DNA, 25 bp, Mus musculus
agctgtattcactcccttgtttcca

SEQ ID NO: 182541 - DNA, 25 bp, Mus musculus
agctgtattgatcatgtggcccaaa

SEQ ID NO: 182542 - DNA, 25 bp, Mus musculus
agctgtattgatgatgtggcccaaa

SEQ ID NO: 182543 - DNA, 25 bp, Mus musculus
agctgtatttgtcgtctctgtattt

SEQ ID NO: 182544 - DNA, 25 bp, Mus musculus
agctgtatttgtggtctctgtattt

SEQ ID NO: 182545 - DNA, 25 bp, Mus musculus
agctgtcaaccacgccaggaggcga

SEQ ID NO: 182546 - DNA, 25 bp, Mus musculus
agctgtcaaccaggccaggaggcga

SEQ ID NO: 182547 - DNA, 25 bp, Mus musculus
agctgtcaaccgaatttcctttggc

SEQ ID NO: 182548 - DNA, 25 bp, Mus musculus
agctgtcaaccgtatttcctttggc

SEQ ID NO: 182549 - DNA, 25 bp, Mus musculus
agctgtcaagtccttaatgtttaga

SEQ ID NO: 182550 - DNA, 25 bp, Mus musculus
agctgtcaagtcgttaatgtttaga

SEQ ID NO: 182551 - DNA, 25 bp, Mus musculus
agctgtcacaaaagttgagtcccaa

SEQ ID NO: 182552 - DNA, 25 bp, Mus musculus
agctgtcacaaatgttgagtcccaa

SEQ ID NO: 182553 - DNA, 25 bp, Mus musculus
agctgtcacacactgggtacctcta

SEQ ID NO: 182554 - DNA, 25 bp, Mus musculus
agctgtcacacagtgggtacctcta

SEQ ID NO: 182555 - DNA, 25 bp, Mus musculus
agctgtcacagcaggtcccatcaca

SEQ ID NO: 182556 - DNA, 25 bp, Mus musculus
agctgtcacagctggtcccatcaca

SEQ ID NO: 182557 - DNA, 25 bp, Mus musculus
agctgtcaccacatagtaagcactt

SEQ ID NO: 182558 - DNA, 25 bp, Mus musculus
agctgtcaccacttagtaagcactt

SEQ ID NO: 182559 - DNA, 25 bp, Mus musculus
agctgtcaccagcacccactttttt

SEQ ID NO: 182560 - DNA, 25 bp, Mus musculus
agctgtcaccaggacccactttttt

SEQ ID NO: 182561 - DNA, 25 bp, Mus musculus
agctgtcaccgtaggagatttccca

SEQ ID NO: 182562 - DNA, 25 bp, Mus musculus
agctgtcaccgttggagatttccca

SEQ ID NO: 182563 - DNA, 25 bp, Mus musculus
agctgtcactccagtcatggtgtct

SEQ ID NO: 182564 - DNA, 25 bp, Mus musculus
agctgtcactcctgtcatggtgtct

SEQ ID NO: 182565 - DNA, 25 bp, Mus musculus
agctgtcactctcatgaagtaacca

SEQ ID NO: 182566 - DNA, 25 bp, Mus musculus
agctgtcactctgatgaagtaacca

SEQ ID NO: 182567 - DNA, 25 bp, Mus musculus
agctgtcactgtacaagatttgaat

SEQ ID NO: 182568 - DNA, 25 bp, Mus musculus
agctgtcactgtatcttccaaaagt

SEQ ID NO: 182569 - DNA, 25 bp, Mus musculus
agctgtcactgttcaagatttgaat

SEQ ID NO: 182570 - DNA, 25 bp, Mus musculus
agctgtcactgtttcttccaaaagt

SEQ ID NO: 182571 - DNA, 25 bp, Mus musculus
agctgtcagaaaagcctctttgtgg

SEQ ID NO: 182572 - DNA, 25 bp, Mus musculus
agctgtcagaaatgcctctttgtgg

SEQ ID NO: 182573 - DNA, 25 bp, Mus musculus
agctgtcagcagctctgtggttcca

SEQ ID NO: 182574 - DNA, 25 bp, Mus musculus
agctgtcagcaggtctgtggttcca

SEQ ID NO: 182575 - DNA, 25 bp, Mus musculus
agctgtcagcctagctcaactatga

SEQ ID NO: 182576 - DNA, 25 bp, Mus musculus
agctgtcagccttgctcaactatga

SEQ ID NO: 182577 - DNA, 25 bp, Mus musculus
agctgtcaggacattgcgaacctca

SEQ ID NO: 182578 - DNA, 25 bp, Mus musculus
agctgtcaggactttgcgaacctca

SEQ ID NO: 182579 - DNA, 25 bp, Mus musculus
agctgtcagggcatttggtgagcaa

SEQ ID NO: 182580 - DNA, 25 bp, Mus musculus
agctgtcagggcttttggtgagcaa

SEQ ID NO: 182581 - DNA, 25 bp, Mus musculus
agctgtcatcctcgtacggagtgag

SEQ ID NO: 182582 - DNA, 25 bp, Mus musculus
agctgtcatcctggtacggagtgag

SEQ ID NO: 182583 - DNA, 25 bp, Mus musculus
agctgtcattacctttggccaacaa

SEQ ID NO: 182584 - DNA, 25 bp, Mus musculus
agctgtcattacgtttggccaacaa

SEQ ID NO: 182585 - DNA, 25 bp, Mus musculus
agctgtcattctatcgtcatgggaa

SEQ ID NO: 182586 - DNA, 25 bp, Mus musculus
agctgtcattctttcgtcatgggaa

SEQ ID NO: 182587 - DNA, 25 bp, Mus musculus
agctgtcattgtctgaagttggcga

SEQ ID NO: 182588 - DNA, 25 bp, Mus musculus
agctgtcattgtgtgaagttggcga

SEQ ID NO: 182589 - DNA, 25 bp, Mus musculus
agctgtccaacacatacactttcat

SEQ ID NO: 182590 - DNA, 25 bp, Mus musculus
agctgtccaacagatacactttcat

SEQ ID NO: 182591 - DNA, 25 bp, Mus musculus
agctgtccaatcctatttgtgctgg

SEQ ID NO: 182592 - DNA, 25 bp, Mus musculus
agctgtccaatcgtatttgtgctgg

SEQ ID NO: 182593 - DNA, 25 bp, Mus musculus
agctgtccaccaagtctacgagctc

SEQ ID NO: 182594 - DNA, 25 bp, Mus musculus
agctgtccaccatgtctacgagctc

SEQ ID NO: 182595 - DNA, 25 bp, Mus musculus
agctgtccacggagcctaggaagcg

SEQ ID NO: 182596 - DNA, 25 bp, Mus musculus
agctgtccacggtgcctaggaagcg

SEQ ID NO: 182597 - DNA, 25 bp, Mus musculus
agctgtccactgcagacatttctgt

SEQ ID NO: 182598 - DNA, 25 bp, Mus musculus
agctgtccactggagacatttctgt

SEQ ID NO: 182599 - DNA, 25 bp, Mus musculus
agctgtccatcgagttacatacaag

SEQ ID NO: 182600 - DNA, 25 bp, Mus musculus
agctgtccatcgtgttacatacaag

SEQ ID NO: 182601 - DNA, 25 bp, Mus musculus
agctgtccattcaattccaaatatt

SEQ ID NO: 182602 - DNA, 25 bp, Mus musculus
agctgtccattctattccaaatatt

SEQ ID NO: 182603 - DNA, 25 bp, Mus musculus
agctgtccccagactggcaagaggt

SEQ ID NO: 182604 - DNA, 25 bp, Mus musculus
agctgtccccagtctggcaagaggt

SEQ ID NO: 182605 - DNA, 25 bp, Mus musculus
agctgtcccctgaatggacacctgc

SEQ ID NO: 182606 - DNA, 25 bp, Mus musculus
agctgtcccctgtatggacacctgc

SEQ ID NO: 182607 - DNA, 25 bp, Mus musculus
agctgtccccttagctgcagaaaat

SEQ ID NO: 182608 - DNA, 25 bp, Mus musculus
agctgtcccctttgctgcagaaaat

SEQ ID NO: 182609 - DNA, 25 bp, Mus musculus
agctgtccctcaaggtttaagagaa

SEQ ID NO: 182610 - DNA, 25 bp, Mus musculus
agctgtccctcatggtttaagagaa

SEQ ID NO: 182611 - DNA, 25 bp, Mus musculus
agctgtccgcagcttggaagtgtac

SEQ ID NO: 182612 - DNA, 25 bp, Mus musculus
agctgtccgcaggttggaagtgtac

SEQ ID NO: 182613 - DNA, 25 bp, Mus musculus
agctgtccgggacagactctgagca

SEQ ID NO: 182614 - DNA, 25 bp, Mus musculus
agctgtccgggagagactctgagca

SEQ ID NO: 182615 - DNA, 25 bp, Mus musculus
agctgtccgtatatcttcaactaag

SEQ ID NO: 182616 - DNA, 25 bp, Mus musculus
agctgtccgtatttcttcaactaag

SEQ ID NO: 182617 - DNA, 25 bp, Mus musculus
agctgtccgtccaaaagagggcatt

SEQ ID NO: 182618 - DNA, 25 bp, Mus musculus
agctgtccgtcctaaagagggcatt

SEQ ID NO: 182619 - DNA, 25 bp, Mus musculus
agctgtcctacaaagctgagtcttt

SEQ ID NO: 182620 - DNA, 25 bp, Mus musculus
agctgtcctacatagctgagtcttt

SEQ ID NO: 182621 - DNA, 25 bp, Mus musculus
agctgtcctggcagtagcagttcca

SEQ ID NO: 182622 - DNA, 25 bp, Mus musculus
agctgtcctggctgtagcagttcca

SEQ ID NO: 182623 - DNA, 25 bp, Mus musculus
agctgtcctggtcaccatttcaagt

SEQ ID NO: 182624 - DNA, 25 bp, Mus musculus
agctgtcctggtgaccatttcaagt

SEQ ID NO: 182625 - DNA, 25 bp, Mus musculus
agctgtcgacacatcttggtggttt

SEQ ID NO: 182626 - DNA, 25 bp, Mus musculus
agctgtcgacacttcttggtggttt

SEQ ID NO: 182627 - DNA, 25 bp, Mus musculus
agctgtcgagctctagaattttttg

SEQ ID NO: 182628 - DNA, 25 bp, Mus musculus
agctgtcgagctgtagaattttttg

SEQ ID NO: 182629 - DNA, 25 bp, Mus musculus
agctgtcgcagaagcccgagggcat

SEQ ID NO: 182630 - DNA, 25 bp, Mus musculus
agctgtcgcagatgcccgagggcat

SEQ ID NO: 182631 - DNA, 25 bp, Mus musculus
agctgtcgtcatcttggacacaatc

SEQ ID NO: 182632 - DNA, 25 bp, Mus musculus
agctgtcgtcatgttggacacaatc

SEQ ID NO: 182633 - DNA, 25 bp, Mus musculus
agctgtcgtcgtaggtctggcaaga

SEQ ID NO: 182634 - DNA, 25 bp, Mus musculus
agctgtcgtcgttggtctggcaaga

SEQ ID NO: 182635 - DNA, 25 bp, Mus musculus
agctgtctaaccatgctgatggcca

SEQ ID NO: 182636 - DNA, 25 bp, Mus musculus
agctgtctaaccttgctgatggcca

SEQ ID NO: 182637 - DNA, 25 bp, Mus musculus
agctgtctaacgaaacactcctttg

SEQ ID NO: 182638 - DNA, 25 bp, Mus musculus
agctgtctaacgtaacactcctttg

SEQ ID NO: 182639 - DNA, 25 bp, Mus musculus
agctgtctattccatcactttacgt

SEQ ID NO: 182640 - DNA, 25 bp, Mus musculus
agctgtctattcgatcactttacgt

SEQ ID NO: 182641 - DNA, 25 bp, Mus musculus
agctgtctcatgcatctctgatgat

SEQ ID NO: 182642 - DNA, 25 bp, Mus musculus
agctgtctcatggatctctgatgat

SEQ ID NO: 182643 - DNA, 25 bp, Mus musculus
agctgtctccaacttcggctacgat

SEQ ID NO: 182644 - DNA, 25 bp, Mus musculus
agctgtctccaagttcggctacgat

SEQ ID NO: 182645 - DNA, 25 bp, Mus musculus
agctgtctcccaagtgcgtattgtg

SEQ ID NO: 182646 - DNA, 25 bp, Mus musculus
agctgtctcccatgtgcgtattgtg

SEQ ID NO: 182647 - DNA, 25 bp, Mus musculus
agctgtctgagtctgttaaattgtt

SEQ ID NO: 182648 - DNA, 25 bp, Mus musculus
agctgtctgagtgtgttaaattgtt

SEQ ID NO: 182649 - DNA, 25 bp, Mus musculus
agctgtctgcatatgctatatgggt

SEQ ID NO: 182650 - DNA, 25 bp, Mus musculus
agctgtctgcatttgctatatgggt

SEQ ID NO: 182651 - DNA, 25 bp, Mus musculus
agctgtctgcccctagattcaggac

SEQ ID NO: 182652 - DNA, 25 bp, Mus musculus
agctgtctgcccgtagattcaggac

SEQ ID NO: 182653 - DNA, 25 bp, Mus musculus
agctgtctgggtcggtgtttcccaa

SEQ ID NO: 182654 - DNA, 25 bp, Mus musculus
agctgtctgggtgggtgtttcccaa

SEQ ID NO: 182655 - DNA, 25 bp, Mus musculus
agctgtctgtaacattccacacaaa

SEQ ID NO: 182656 - DNA, 25 bp, Mus musculus
agctgtctgtaacttttgcctctgt

SEQ ID NO: 182657 - DNA, 25 bp, Mus musculus
agctgtctgtaagattccacacaaa

SEQ ID NO: 182658 - DNA, 25 bp, Mus musculus
agctgtctgtaagttttgcctctgt

SEQ ID NO: 182659 - DNA, 25 bp, Mus musculus
agctgtctgtacaaacaggtgctgt

SEQ ID NO: 182660 - DNA, 25 bp, Mus musculus
agctgtctgtactaacaggtgctgt

SEQ ID NO: 182661 - DNA, 25 bp, Mus musculus
agctgtctgtagagcagctctggct

SEQ ID NO: 182662 - DNA, 25 bp, Mus musculus
agctgtctgtagtgcagctctggct

SEQ ID NO: 182663 - DNA, 25 bp, Mus musculus
agctgtctgtctcagttggaagttg

SEQ ID NO: 182664 - DNA, 25 bp, Mus musculus
agctgtctgtctcgatgtcactgtc

SEQ ID NO: 182665 - DNA, 25 bp, Mus musculus
agctgtctgtctctatgctagagaa

SEQ ID NO: 182666 - DNA, 25 bp, Mus musculus
agctgtctgtctgagttggaagttg

SEQ ID NO: 182667 - DNA, 25 bp, Mus musculus
agctgtctgtctggatgtcactgtc

SEQ ID NO: 182668 - DNA, 25 bp, Mus musculus
agctgtctgtctgtatgctagagaa

SEQ ID NO: 182669 - DNA, 25 bp, Mus musculus
agctgtctgtgacatcccaccgcgt

SEQ ID NO: 182670 - DNA, 25 bp, Mus musculus
agctgtctgtgacattccacctcgg

SEQ ID NO: 182671 - DNA, 25 bp, Mus musculus
agctgtctgtgagatcccaccgcgt

SEQ ID NO: 182672 - DNA, 25 bp, Mus musculus
agctgtctgtgagattccacctcgg

SEQ ID NO: 182673 - DNA, 25 bp, Mus musculus
agctgtctgtgtcggtcctgtcaat

SEQ ID NO: 182674 - DNA, 25 bp, Mus musculus
agctgtctgtgtgggtcctgtcaat

SEQ ID NO: 182675 - DNA, 25 bp, Mus musculus
agctgtctgtttagttcacgttgta

SEQ ID NO: 182676 - DNA, 25 bp, Mus musculus
agctgtctgttttgttcacgttgta

SEQ ID NO: 182677 - DNA, 25 bp, Mus musculus
agctgtcttaataatcgtgttgtta

SEQ ID NO: 182678 - DNA, 25 bp, Mus musculus
agctgtcttaattatcgtgttgtta

SEQ ID NO: 182679 - DNA, 25 bp, Mus musculus
agctgtcttatcacaagcctggtga

SEQ ID NO: 182680 - DNA, 25 bp, Mus musculus
agctgtcttatctcaagcctggtga

SEQ ID NO: 182681 - DNA, 25 bp, Mus musculus
agctgtcttccaatcatggacatat

SEQ ID NO: 182682 - DNA, 25 bp, Mus musculus
agctgtcttccattcatggacatat

SEQ ID NO: 182683 - DNA, 25 bp, Mus musculus
agctgtcttctgctgtttgtgaact

SEQ ID NO: 182684 - DNA, 25 bp, Mus musculus
agctgtcttctgcttcaaagagtgg

SEQ ID NO: 182685 - DNA, 25 bp, Mus musculus
agctgtcttctggtgtttgtgaact

SEQ ID NO: 182686 - DNA, 25 bp, Mus musculus
agctgtcttctggttcaaagagtgg

SEQ ID NO: 182687 - DNA, 25 bp, Mus musculus
agctgtcttgctcttttgcagttct

SEQ ID NO: 182688 - DNA, 25 bp, Mus musculus
agctgtcttgctgttttgcagttct

SEQ ID NO: 182689 - DNA, 25 bp, Mus musculus
agctgtctttggagacatcccatgc

SEQ ID NO: 182690 - DNA, 25 bp, Mus musculus
agctgtctttggtgacatcccatgc

SEQ ID NO: 182691 - DNA, 25 bp, Mus musculus
agctgtcttttacacccttgaattt

SEQ ID NO: 182692 - DNA, 25 bp, Mus musculus
agctgtcttttagacccttgaattt

SEQ ID NO: 182693 - DNA, 25 bp, Mus musculus
agctgtgaaaatcgcttcctgggaa

SEQ ID NO: 182694 - DNA, 25 bp, Mus musculus
agctgtgaaaatggcttcctgggaa

SEQ ID NO: 182695 - DNA, 25 bp, Mus musculus
agctgtgaaagtaatgtaagccttc

SEQ ID NO: 182696 - DNA, 25 bp, Mus musculus
agctgtgaaagttatgtaagccttc

SEQ ID NO: 182697 - DNA, 25 bp, Mus musculus
agctgtgaacacagggaactgaaca

SEQ ID NO: 182698 - DNA, 25 bp, Mus musculus
agctgtgaacactgggaactgaaca

SEQ ID NO: 182699 - DNA, 25 bp, Mus musculus
agctgtgaacatatgcagcacaatg

SEQ ID NO: 182700 - DNA, 25 bp, Mus musculus
agctgtgaacatttgcagcacaatg

SEQ ID NO: 182701 - DNA, 25 bp, Mus musculus
agctgtgaagatcacccaactgcac

SEQ ID NO: 182702 - DNA, 25 bp, Mus musculus
agctgtgaagatgacccaactgcac

SEQ ID NO: 182703 - DNA, 25 bp, Mus musculus
agctgtgaatccagacatttgctgg

SEQ ID NO: 182704 - DNA, 25 bp, Mus musculus
agctgtgaatcctgacatttgctgg

SEQ ID NO: 182705 - DNA, 25 bp, Mus musculus
agctgtgaattgatccagatggttc

SEQ ID NO: 182706 - DNA, 25 bp, Mus musculus
agctgtgaattgttccagatggttc

SEQ ID NO: 182707 - DNA, 25 bp, Mus musculus
agctgtgaccccacccgtcacaggg

SEQ ID NO: 182708 - DNA, 25 bp, Mus musculus
agctgtgacccctcccgtcacaggg

SEQ ID NO: 182709 - DNA, 25 bp, Mus musculus
agctgtgactatattgactttgaga

SEQ ID NO: 182710 - DNA, 25 bp, Mus musculus
agctgtgactattttgactttgaga

SEQ ID NO: 182711 - DNA, 25 bp, Mus musculus
agctgtgagacaccgtgaagctctc

SEQ ID NO: 182712 - DNA, 25 bp, Mus musculus
agctgtgagacagcgtgaagctctc

SEQ ID NO: 182713 - DNA, 25 bp, Mus musculus
agctgtgagcccaggaacattgctt

SEQ ID NO: 182714 - DNA, 25 bp, Mus musculus
agctgtgagccctggaacattgctt

SEQ ID NO: 182715 - DNA, 25 bp, Mus musculus
agctgtgagctcaggactggtacca

SEQ ID NO: 182716 - DNA, 25 bp, Mus musculus
agctgtgagctcctgacagatgcag

SEQ ID NO: 182717 - DNA, 25 bp, Mus musculus
agctgtgagctcgtgacagatgcag

SEQ ID NO: 182718 - DNA, 25 bp, Mus musculus
agctgtgagctctggactggtacca

SEQ ID NO: 182719 - DNA, 25 bp, Mus musculus
agctgtgaggccatacctacacgga

SEQ ID NO: 182720 - DNA, 25 bp, Mus musculus
agctgtgaggccttacctacacgga

SEQ ID NO: 182721 - DNA, 25 bp, Mus musculus
agctgtgaggtcatcgggatcccaa

SEQ ID NO: 182722 - DNA, 25 bp, Mus musculus
agctgtgaggtcttcgggatcccaa

SEQ ID NO: 182723 - DNA, 25 bp, Mus musculus
agctgtgataatctacccttttggt

SEQ ID NO: 182724 - DNA, 25 bp, Mus musculus
agctgtgataatgtacccttttggt

SEQ ID NO: 182725 - DNA, 25 bp, Mus musculus
agctgtgatcgcaggcggactgatc

SEQ ID NO: 182726 - DNA, 25 bp, Mus musculus
agctgtgatcgctggcggactgatc

SEQ ID NO: 182727 - DNA, 25 bp, Mus musculus
agctgtgatctgagaagccccatct

SEQ ID NO: 182728 - DNA, 25 bp, Mus musculus
agctgtgatctgtgaagccccatct

SEQ ID NO: 182729 - DNA, 25 bp, Mus musculus
agctgtgatcttacctcactgtccc

SEQ ID NO: 182730 - DNA, 25 bp, Mus musculus
agctgtgatctttcctcactgtccc

SEQ ID NO: 182731 - DNA, 25 bp, Mus musculus
agctgtgatgagaacctgggacatg

SEQ ID NO: 182732 - DNA, 25 bp, Mus musculus
agctgtgatgagtacctgggacatg

SEQ ID NO: 182733 - DNA, 25 bp, Mus musculus
agctgtgatgctaggactctggaag

SEQ ID NO: 182734 - DNA, 25 bp, Mus musculus
agctgtgatgcttggactctggaag

SEQ ID NO: 182735 - DNA, 25 bp, Mus musculus
agctgtgcacacagaggcctagcgg

SEQ ID NO: 182736 - DNA, 25 bp, Mus musculus
agctgtgcacactgaggcctagcgg

SEQ ID NO: 182737 - DNA, 25 bp, Mus musculus
agctgtgcacctaacctttcaacca

SEQ ID NO: 182738 - DNA, 25 bp, Mus musculus
agctgtgcaccttacctttcaacca

SEQ ID NO: 182739 - DNA, 25 bp, Mus musculus
agctgtgcactaattatagtccatg

SEQ ID NO: 182740 - DNA, 25 bp, Mus musculus
agctgtgcactatttatagtccatg

SEQ ID NO: 182741 - DNA, 25 bp, Mus musculus
agctgtgcactccaggcttctacaa

SEQ ID NO: 182742 - DNA, 25 bp, Mus musculus
agctgtgcactcgaggcttctacaa

SEQ ID NO: 182743 - DNA, 25 bp, Mus musculus
agctgtgcacttaatttattgaata

SEQ ID NO: 182744 - DNA, 25 bp, Mus musculus
agctgtgcactttatttattgaata

SEQ ID NO: 182745 - DNA, 25 bp, Mus musculus
agctgtgcagccctctagtcaatca

SEQ ID NO: 182746 - DNA, 25 bp, Mus musculus
agctgtgcagccgtctagtcaatca

SEQ ID NO: 182747 - DNA, 25 bp, Mus musculus
agctgtgcagtcctttgctttataa

SEQ ID NO: 182748 - DNA, 25 bp, Mus musculus
agctgtgcagtcgtttgctttataa

SEQ ID NO: 182749 - DNA, 25 bp, Mus musculus
agctgtgcagttaggtagttgctac

SEQ ID NO: 182750 - DNA, 25 bp, Mus musculus
agctgtgcagttataggctttgaaa

SEQ ID NO: 182751 - DNA, 25 bp, Mus musculus
agctgtgcagtttggtagttgctac

SEQ ID NO: 182752 - DNA, 25 bp, Mus musculus
agctgtgcagttttaggctttgaaa

SEQ ID NO: 182753 - DNA, 25 bp, Mus musculus
agctgtgcatacctgtgtctacatt

SEQ ID NO: 182754 - DNA, 25 bp, Mus musculus
agctgtgcatacgtgtgtctacatt

SEQ ID NO: 182755 - DNA, 25 bp, Mus musculus
agctgtgcatgacttcggcttgttc

SEQ ID NO: 182756 - DNA, 25 bp, Mus musculus
agctgtgcatgagttcggcttgttc

SEQ ID NO: 182757 - DNA, 25 bp, Mus musculus
agctgtgccagcaggtgacaacgga

SEQ ID NO: 182758 - DNA, 25 bp, Mus musculus
agctgtgccagccagccatgtttca

SEQ ID NO: 182759 - DNA, 25 bp, Mus musculus
agctgtgccagcgagccatgtttca

SEQ ID NO: 182760 - DNA, 25 bp, Mus musculus
agctgtgccagctggtgacaacgga

SEQ ID NO: 182761 - DNA, 25 bp, Mus musculus
agctgtgccatgagtgtatctgcat

SEQ ID NO: 182762 - DNA, 25 bp, Mus musculus
agctgtgccatgtgtgtatctgcat

SEQ ID NO: 182763 - DNA, 25 bp, Mus musculus
agctgtgccattatgtgaacttgtc

SEQ ID NO: 182764 - DNA, 25 bp, Mus musculus
agctgtgccattttgtgaacttgtc

SEQ ID NO: 182765 - DNA, 25 bp, Mus musculus
agctgtgcctgtactcatcctacat

SEQ ID NO: 182766 - DNA, 25 bp, Mus musculus
agctgtgcctgtagtgactccaaga

SEQ ID NO: 182767 - DNA, 25 bp, Mus musculus
agctgtgcctgttctcatcctacat

SEQ ID NO: 182768 - DNA, 25 bp, Mus musculus
agctgtgcctgttgtgactccaaga

SEQ ID NO: 182769 - DNA, 25 bp, Mus musculus
agctgtgccttacagaagtggtcca

SEQ ID NO: 182770 - DNA, 25 bp, Mus musculus
agctgtgccttagagaagtggtcca

SEQ ID NO: 182771 - DNA, 25 bp, Mus musculus
agctgtgcgatgcttcttggtctta

SEQ ID NO: 182772 - DNA, 25 bp, Mus musculus
agctgtgcgatggttcttggtctta

SEQ ID NO: 182773 - DNA, 25 bp, Mus musculus
agctgtgcggctaacatggcagacg

SEQ ID NO: 182774 - DNA, 25 bp, Mus musculus
agctgtgcggctcaacgaggtcatc

SEQ ID NO: 182775 - DNA, 25 bp, Mus musculus
agctgtgcggctgaacgaggtcatc

SEQ ID NO: 182776 - DNA, 25 bp, Mus musculus
agctgtgcggcttacatggcagacg

SEQ ID NO: 182777 - DNA, 25 bp, Mus musculus
agctgtgctaagctctcagggcctg

SEQ ID NO: 182778 - DNA, 25 bp, Mus musculus
agctgtgctaaggtctcagggcctg

SEQ ID NO: 182779 - DNA, 25 bp, Mus musculus
agctgtgctatgatgctctagactt

SEQ ID NO: 182780 - DNA, 25 bp, Mus musculus
agctgtgctatgttgctctagactt

SEQ ID NO: 182781 - DNA, 25 bp, Mus musculus
agctgtgctccaaggtgtgtagcta

SEQ ID NO: 182782 - DNA, 25 bp, Mus musculus
agctgtgctccatggtgtgtagcta

SEQ ID NO: 182783 - DNA, 25 bp, Mus musculus
agctgtgctcggacatgctacgttt

SEQ ID NO: 182784 - DNA, 25 bp, Mus musculus
agctgtgctcggtcatgctacgttt

SEQ ID NO: 182785 - DNA, 25 bp, Mus musculus
agctgtgctcttcttctggctgagg

SEQ ID NO: 182786 - DNA, 25 bp, Mus musculus
agctgtgctcttgttctggctgagg

SEQ ID NO: 182787 - DNA, 25 bp, Mus musculus
agctgtgctgaaccgcatcctggag

SEQ ID NO: 182788 - DNA, 25 bp, Mus musculus
agctgtgctgaagcgcatcctggag

SEQ ID NO: 182789 - DNA, 25 bp, Mus musculus
agctgtgctgacagtgcagtgaatt

SEQ ID NO: 182790 - DNA, 25 bp, Mus musculus
agctgtgctgactgtgcagtgaatt

SEQ ID NO: 182791 - DNA, 25 bp, Mus musculus
agctgtgctggtcaatactactgta

SEQ ID NO: 182792 - DNA, 25 bp, Mus musculus
agctgtgctggtgaatactactgta

SEQ ID NO: 182793 - DNA, 25 bp, Mus musculus
agctgtgctgtccaaattatcagga

SEQ ID NO: 182794 - DNA, 25 bp, Mus musculus
agctgtgctgtcgaaattatcagga

SEQ ID NO: 182795 - DNA, 25 bp, Mus musculus
agctgtgcttaacaacctggagtca

SEQ ID NO: 182796 - DNA, 25 bp, Mus musculus
agctgtgcttaagaacctggagtca

SEQ ID NO: 182797 - DNA, 25 bp, Mus musculus
agctgtgcttcgctcgccaggagct

SEQ ID NO: 182798 - DNA, 25 bp, Mus musculus
agctgtgcttcggtcgccaggagct

SEQ ID NO: 182799 - DNA, 25 bp, Mus musculus
agctgtggaaatcgctcggtgcttt

SEQ ID NO: 182800 - DNA, 25 bp, Mus musculus
agctgtggaaatggctcggtgcttt

SEQ ID NO: 182801 - DNA, 25 bp, Mus musculus
agctgtggaattacgtccctggact

SEQ ID NO: 182802 - DNA, 25 bp, Mus musculus
agctgtggaatttcgtccctggact

SEQ ID NO: 182803 - DNA, 25 bp, Mus musculus
agctgtggacggagtacgcttcatt

SEQ ID NO: 182804 - DNA, 25 bp, Mus musculus
agctgtggacggtgtacgcttcatt

SEQ ID NO: 182805 - DNA, 25 bp, Mus musculus
agctgtggagatctctgctttgcta

SEQ ID NO: 182806 - DNA, 25 bp, Mus musculus
agctgtggagatgtctgctttgcta

SEQ ID NO: 182807 - DNA, 25 bp, Mus musculus
agctgtggattgcttccttgaccga

SEQ ID NO: 182808 - DNA, 25 bp, Mus musculus
agctgtggattggttccttgaccga

SEQ ID NO: 182809 - DNA, 25 bp, Mus musculus
agctgtggcacaaagttctcataga

SEQ ID NO: 182810 - DNA, 25 bp, Mus musculus
agctgtggcacacggtcaattctgg

SEQ ID NO: 182811 - DNA, 25 bp, Mus musculus
agctgtggcacagggtcaattctgg

SEQ ID NO: 182812 - DNA, 25 bp, Mus musculus
agctgtggcacatagttctcataga

SEQ ID NO: 182813 - DNA, 25 bp, Mus musculus
agctgtggcactaaagaagactgtc

SEQ ID NO: 182814 - DNA, 25 bp, Mus musculus
agctgtggcacttaagaagactgtc

SEQ ID NO: 182815 - DNA, 25 bp, Mus musculus
agctgtggcaggctttgggcccctc

SEQ ID NO: 182816 - DNA, 25 bp, Mus musculus
agctgtggcagggtttgggcccctc

SEQ ID NO: 182817 - DNA, 25 bp, Mus musculus
agctgtggccacagatgttcatcga

SEQ ID NO: 182818 - DNA, 25 bp, Mus musculus
agctgtggccactgatgttcatcga

SEQ ID NO: 182819 - DNA, 25 bp, Mus musculus
agctgtggccatcctgaggtgggca

SEQ ID NO: 182820 - DNA, 25 bp, Mus musculus
agctgtggccatgctgaggtgggca

SEQ ID NO: 182821 - DNA, 25 bp, Mus musculus
agctgtggccctaaatgtactcatg

SEQ ID NO: 182822 - DNA, 25 bp, Mus musculus
agctgtggccctatgtgtctgaccc

SEQ ID NO: 182823 - DNA, 25 bp, Mus musculus
agctgtggcccttaatgtactcatg

SEQ ID NO: 182824 - DNA, 25 bp, Mus musculus
agctgtggccctttgtgtctgaccc

SEQ ID NO: 182825 - DNA, 25 bp, Mus musculus
agctgtggctaacttgttctggagt

SEQ ID NO: 182826 - DNA, 25 bp, Mus musculus
agctgtggctaagttgttctggagt

SEQ ID NO: 182827 - DNA, 25 bp, Mus musculus
agctgtgggaataacctgcctcaac

SEQ ID NO: 182828 - DNA, 25 bp, Mus musculus
agctgtgggaattacctgcctcaac

SEQ ID NO: 182829 - DNA, 25 bp, Mus musculus
agctgtgggagcatcttgtgagcat

SEQ ID NO: 182830 - DNA, 25 bp, Mus musculus
agctgtgggagcttcttgtgagcat

SEQ ID NO: 182831 - DNA, 25 bp, Mus musculus
agctgtgggcatcctgtgtgccacc

SEQ ID NO: 182832 - DNA, 25 bp, Mus musculus
agctgtgggcatgctgtgtgccacc

SEQ ID NO: 182833 - DNA, 25 bp, Mus musculus
agctgtgggcggctcggactcgcgt

SEQ ID NO: 182834 - DNA, 25 bp, Mus musculus
agctgtgggcgggtcggactcgcgt

SEQ ID NO: 182835 - DNA, 25 bp, Mus musculus
agctgtgggtgcacgtctttaaaca

SEQ ID NO: 182836 - DNA, 25 bp, Mus musculus
agctgtgggtgctcgtctttaaaca

SEQ ID NO: 182837 - DNA, 25 bp, Mus musculus
agctgtgggtttagtcaacgatgcc

SEQ ID NO: 182838 - DNA, 25 bp, Mus musculus
agctgtgggttttgtcaacgatgcc

SEQ ID NO: 182839 - DNA, 25 bp, Mus musculus
agctgtggtagtcgcagtaccagaa

SEQ ID NO: 182840 - DNA, 25 bp, Mus musculus
agctgtggtagtggcagtaccagaa

SEQ ID NO: 182841 - DNA, 25 bp, Mus musculus
agctgtggtcagcagcgtcaacaca

SEQ ID NO: 182842 - DNA, 25 bp, Mus musculus
agctgtggtcaggagcgtcaacaca

SEQ ID NO: 182843 - DNA, 25 bp, Mus musculus
agctgtggtcatacctggcatgtga

SEQ ID NO: 182844 - DNA, 25 bp, Mus musculus
agctgtggtcattcctggcatgtga

SEQ ID NO: 182845 - DNA, 25 bp, Mus musculus
agctgtggtcttctaaactgtaaat

SEQ ID NO: 182846 - DNA, 25 bp, Mus musculus
agctgtggtcttgtaaactgtaaat

SEQ ID NO: 182847 - DNA, 25 bp, Mus musculus
agctgtggtgatctcaactttccga

SEQ ID NO: 182848 - DNA, 25 bp, Mus musculus
agctgtggtgatgtcaactttccga

SEQ ID NO: 182849 - DNA, 25 bp, Mus musculus
agctgtggtgctcccttcaggagaa

SEQ ID NO: 182850 - DNA, 25 bp, Mus musculus
agctgtggtgctgccttcaggagaa

SEQ ID NO: 182851 - DNA, 25 bp, Mus musculus
agctgtggtttccatcattccccat

SEQ ID NO: 182852 - DNA, 25 bp, Mus musculus
agctgtggtttcgatcattccccat

SEQ ID NO: 182853 - DNA, 25 bp, Mus musculus
agctgtggttttctgcagcaccata

SEQ ID NO: 182854 - DNA, 25 bp, Mus musculus
agctgtggttttgtgcagcaccata

SEQ ID NO: 182855 - DNA, 25 bp, Mus musculus
agctgtgtaataatccaatgttgtt

SEQ ID NO: 182856 - DNA, 25 bp, Mus musculus
agctgtgtaatattccaatgttgtt

SEQ ID NO: 182857 - DNA, 25 bp, Mus musculus
agctgtgtacaacttccttttttat

SEQ ID NO: 182858 - DNA, 25 bp, Mus musculus
agctgtgtacaagttccttttttat

SEQ ID NO: 182859 - DNA, 25 bp, Mus musculus
agctgtgtacagctttgacccagtg

SEQ ID NO: 182860 - DNA, 25 bp, Mus musculus
agctgtgtacaggtttgacccagtg

SEQ ID NO: 182861 - DNA, 25 bp, Mus musculus
agctgtgtactaatcatactttaaa

SEQ ID NO: 182862 - DNA, 25 bp, Mus musculus
agctgtgtactattcatactttaaa

SEQ ID NO: 182863 - DNA, 25 bp, Mus musculus
agctgtgtactgatgctcctgtttc

SEQ ID NO: 182864 - DNA, 25 bp, Mus musculus
agctgtgtactgttgctcctgtttc

SEQ ID NO: 182865 - DNA, 25 bp, Mus musculus
agctgtgtagctaccttagtcagca

SEQ ID NO: 182866 - DNA, 25 bp, Mus musculus
agctgtgtagctactgtagtctgca

SEQ ID NO: 182867 - DNA, 25 bp, Mus musculus
agctgtgtagcttccttagtcagca

SEQ ID NO: 182868 - DNA, 25 bp, Mus musculus
agctgtgtagcttctgtagtctgca

SEQ ID NO: 182869 - DNA, 25 bp, Mus musculus
agctgtgtattgcatccgttttatc

SEQ ID NO: 182870 - DNA, 25 bp, Mus musculus
agctgtgtattggatccgttttatc

SEQ ID NO: 182871 - DNA, 25 bp, Mus musculus
agctgtgtcagcacacattcagttt

SEQ ID NO: 182872 - DNA, 25 bp, Mus musculus
agctgtgtcagctcacattcagttt

SEQ ID NO: 182873 - DNA, 25 bp, Mus musculus
agctgtgtcctgatatgggcaccct

SEQ ID NO: 182874 - DNA, 25 bp, Mus musculus
agctgtgtcctgttatgggcaccct

SEQ ID NO: 182875 - DNA, 25 bp, Mus musculus
agctgtgtccttcagatcagtgtca

SEQ ID NO: 182876 - DNA, 25 bp, Mus musculus
agctgtgtccttgagatcagtgtca

SEQ ID NO: 182877 - DNA, 25 bp, Mus musculus
agctgtgtcggtagtcaatcttaac

SEQ ID NO: 182878 - DNA, 25 bp, Mus musculus
agctgtgtcggttgtcaatcttaac

SEQ ID NO: 182879 - DNA, 25 bp, Mus musculus
agctgtgtctacaccatcatggact

SEQ ID NO: 182880 - DNA, 25 bp, Mus musculus
agctgtgtctactccatcatggact

SEQ ID NO: 182881 - DNA, 25 bp, Mus musculus
agctgtgtgaccagctgttgccagc

SEQ ID NO: 182882 - DNA, 25 bp, Mus musculus
agctgtgtgacctgctgttgccagc

SEQ ID NO: 182883 - DNA, 25 bp, Mus musculus
agctgtgtgactacaatcccaagag

SEQ ID NO: 182884 - DNA, 25 bp, Mus musculus
agctgtgtgacttcaatcccaagag

SEQ ID NO: 182885 - DNA, 25 bp, Mus musculus
agctgtgtgagcagcgttgtgacat

SEQ ID NO: 182886 - DNA, 25 bp, Mus musculus
agctgtgtgagcataaacctcggga

SEQ ID NO: 182887 - DNA, 25 bp, Mus musculus
agctgtgtgagctgcgttgtgacat

SEQ ID NO: 182888 - DNA, 25 bp, Mus musculus
agctgtgtgagcttaaacctcggga

SEQ ID NO: 182889 - DNA, 25 bp, Mus musculus
agctgtgtgagtcttccctgggtcc

SEQ ID NO: 182890 - DNA, 25 bp, Mus musculus
agctgtgtgagtgttccctgggtcc

SEQ ID NO: 182891 - DNA, 25 bp, Mus musculus
agctgtgtgccaccaggaccaaaaa

SEQ ID NO: 182892 - DNA, 25 bp, Mus musculus
agctgtgtgccagcaggaccaaaaa

SEQ ID NO: 182893 - DNA, 25 bp, Mus musculus
agctgtgtgcgtaccacctggtgga

SEQ ID NO: 182894 - DNA, 25 bp, Mus musculus
agctgtgtgcgttccacctggtgga

SEQ ID NO: 182895 - DNA, 25 bp, Mus musculus
agctgtgtggatcgcttcattgaca

SEQ ID NO: 182896 - DNA, 25 bp, Mus musculus
agctgtgtggatggcttcattgaca

SEQ ID NO: 182897 - DNA, 25 bp, Mus musculus
agctgtgtggccagaatgtattaga

SEQ ID NO: 182898 - DNA, 25 bp, Mus musculus
agctgtgtggccagacccggaggtc

SEQ ID NO: 182899 - DNA, 25 bp, Mus musculus
agctgtgtggcctgaatgtattaga

SEQ ID NO: 182900 - DNA, 25 bp, Mus musculus
agctgtgtggcctgacccggaggtc

SEQ ID NO: 182901 - DNA, 25 bp, Mus musculus
agctgtgtgtctcctagctgccgca

SEQ ID NO: 182902 - DNA, 25 bp, Mus musculus
agctgtgtgtctgctagctgccgca

SEQ ID NO: 182903 - DNA, 25 bp, Mus musculus
agctgtgtgtgcaacagaaggcaga

SEQ ID NO: 182904 - DNA, 25 bp, Mus musculus
agctgtgtgtgctacagaaggcaga

SEQ ID NO: 182905 - DNA, 25 bp, Mus musculus
agctgtgtgtggagtcgcgccctct

SEQ ID NO: 182906 - DNA, 25 bp, Mus musculus
agctgtgtgtggtgtcgcgccctct

SEQ ID NO: 182907 - DNA, 25 bp, Mus musculus
agctgtgttcacacttttatacaaa

SEQ ID NO: 182908 - DNA, 25 bp, Mus musculus
agctgtgttcactcttttatacaaa

SEQ ID NO: 182909 - DNA, 25 bp, Mus musculus
agctgtgttccaagccctacacatc

SEQ ID NO: 182910 - DNA, 25 bp, Mus musculus
agctgtgttccactgtgccgtgctg

SEQ ID NO: 182911 - DNA, 25 bp, Mus musculus
agctgtgttccagtgtgccgtgctg

SEQ ID NO: 182912 - DNA, 25 bp, Mus musculus
agctgtgttccatgccctacacatc

SEQ ID NO: 182913 - DNA, 25 bp, Mus musculus
agctgtgttctcatattgtgtccct

SEQ ID NO: 182914 - DNA, 25 bp, Mus musculus
agctgtgttctcttattgtgtccct

SEQ ID NO: 182915 - DNA, 25 bp, Mus musculus
agctgtgttctgacttagtagtgca

SEQ ID NO: 182916 - DNA, 25 bp, Mus musculus
agctgtgttctgctgtgtgcacttc

SEQ ID NO: 182917 - DNA, 25 bp, Mus musculus
agctgtgttctggtgtgtgcacttc

SEQ ID NO: 182918 - DNA, 25 bp, Mus musculus
agctgtgttctgtcttagtagtgca

SEQ ID NO: 182919 - DNA, 25 bp, Mus musculus
agctgtgttcttcgctgcactgcac

SEQ ID NO: 182920 - DNA, 25 bp, Mus musculus
agctgtgttcttggctgcactgcac

SEQ ID NO: 182921 - DNA, 25 bp, Mus musculus
agctgtgttgtgcttgctataaact

SEQ ID NO: 182922 - DNA, 25 bp, Mus musculus
agctgtgttgtggttgctataaact

SEQ ID NO: 182923 - DNA, 25 bp, Mus musculus
agctgtgtttagctgtcacgtgtga

SEQ ID NO: 182924 - DNA, 25 bp, Mus musculus
agctgtgtttaggtgtcacgtgtga

SEQ ID NO: 182925 - DNA, 25 bp, Mus musculus
agctgtgtttatcataatgctctta

SEQ ID NO: 182926 - DNA, 25 bp, Mus musculus
agctgtgtttatgataatgctctta

SEQ ID NO: 182927 - DNA, 25 bp, Mus musculus
agctgtgttttcctaattgtatata

SEQ ID NO: 182928 - DNA, 25 bp, Mus musculus
agctgtgttttcgtaattgtatata

SEQ ID NO: 182929 - DNA, 25 bp, Mus musculus
agctgttaaatccttcatatgaatt

SEQ ID NO: 182930 - DNA, 25 bp, Mus musculus
agctgttaaatcgttcatatgaatt

SEQ ID NO: 182931 - DNA, 25 bp, Mus musculus
agctgttaacataccttatgatatg

SEQ ID NO: 182932 - DNA, 25 bp, Mus musculus
agctgttaacattccttatgatatg

SEQ ID NO: 182933 - DNA, 25 bp, Mus musculus
agctgttaattcaacccattgtaaa

SEQ ID NO: 182934 - DNA, 25 bp, Mus musculus
agctgttaattctacccattgtaaa

SEQ ID NO: 182935 - DNA, 25 bp, Mus musculus
agctgttaccctaaatgtttgaaag

SEQ ID NO: 182936 - DNA, 25 bp, Mus musculus
agctgttacccttaatgtttgaaag

SEQ ID NO: 182937 - DNA, 25 bp, Mus musculus
agctgttagcccagcagtggtgcct

SEQ ID NO: 182938 - DNA, 25 bp, Mus musculus
agctgttagccctgcagtggtgcct

SEQ ID NO: 182939 - DNA, 25 bp, Mus musculus
agctgttagctcaactcctggagga

SEQ ID NO: 182940 - DNA, 25 bp, Mus musculus
agctgttagctctactcctggagga

SEQ ID NO: 182941 - DNA, 25 bp, Mus musculus
agctgttagtctccaggctctcggc

SEQ ID NO: 182942 - DNA, 25 bp, Mus musculus
agctgttagtctgcaggctctcggc

SEQ ID NO: 182943 - DNA, 25 bp, Mus musculus
agctgttagtgcatcaaccagaaca

SEQ ID NO: 182944 - DNA, 25 bp, Mus musculus
agctgttagtgcttcaaccagaaca

SEQ ID NO: 182945 - DNA, 25 bp, Mus musculus
agctgttatcatcaagtacttggag

SEQ ID NO: 182946 - DNA, 25 bp, Mus musculus
agctgttatcatgaagtacttggag

SEQ ID NO: 182947 - DNA, 25 bp, Mus musculus
agctgttatcttatgaccttcaaat

SEQ ID NO: 182948 - DNA, 25 bp, Mus musculus
agctgttatcttcccaagcctggtt

SEQ ID NO: 182949 - DNA, 25 bp, Mus musculus
agctgttatcttgccaagcctggtt

SEQ ID NO: 182950 - DNA, 25 bp, Mus musculus
agctgttatcttttgaccttcaaat

SEQ ID NO: 182951 - DNA, 25 bp, Mus musculus
agctgttattcgattatgcattttg

SEQ ID NO: 182952 - DNA, 25 bp, Mus musculus
agctgttattcgtttatgcattttg

SEQ ID NO: 182953 - DNA, 25 bp, Mus musculus
agctgttcaactcatttcccaacac

SEQ ID NO: 182954 - DNA, 25 bp, Mus musculus
agctgttcaactgatttcccaacac

SEQ ID NO: 182955 - DNA, 25 bp, Mus musculus
agctgttcacaaacttttgcctgaa

SEQ ID NO: 182956 - DNA, 25 bp, Mus musculus
agctgttcacaactcctgcattgag

SEQ ID NO: 182957 - DNA, 25 bp, Mus musculus
agctgttcacaagtcctgcattgag

SEQ ID NO: 182958 - DNA, 25 bp, Mus musculus
agctgttcacaatcttttgcctgaa

SEQ ID NO: 182959 - DNA, 25 bp, Mus musculus
agctgttcacagcagatgcttggat

SEQ ID NO: 182960 - DNA, 25 bp, Mus musculus
agctgttcacaggagatgcttggat

SEQ ID NO: 182961 - DNA, 25 bp, Mus musculus
agctgttcacttaccatgaagctgt

SEQ ID NO: 182962 - DNA, 25 bp, Mus musculus
agctgttcactttccatgaagctgt

SEQ ID NO: 182963 - DNA, 25 bp, Mus musculus
agctgttcagacctttcattctcag

SEQ ID NO: 182964 - DNA, 25 bp, Mus musculus
agctgttcagacgtttcattctcag

SEQ ID NO: 182965 - DNA, 25 bp, Mus musculus
agctgttcatcaatactgtcccaag

SEQ ID NO: 182966 - DNA, 25 bp, Mus musculus
agctgttcatcattactgtcccaag

SEQ ID NO: 182967 - DNA, 25 bp, Mus musculus
agctgttccagcatcttaatagaca

SEQ ID NO: 182968 - DNA, 25 bp, Mus musculus
agctgttccagcttcttaatagaca

SEQ ID NO: 182969 - DNA, 25 bp, Mus musculus
agctgttccaggagatgctgtgcag

SEQ ID NO: 182970 - DNA, 25 bp, Mus musculus
agctgttccaggtgatgctgtgcag

SEQ ID NO: 182971 - DNA, 25 bp, Mus musculus
agctgttcccagatatacgaccaaa

SEQ ID NO: 182972 - DNA, 25 bp, Mus musculus
agctgttcccagttatacgaccaaa

SEQ ID NO: 182973 - DNA, 25 bp, Mus musculus
agctgttcctaaatgtctctttctg

SEQ ID NO: 182974 - DNA, 25 bp, Mus musculus
agctgttcctaattgtctctttctg

SEQ ID NO: 182975 - DNA, 25 bp, Mus musculus
agctgttcctgaacaccaggacttg

SEQ ID NO: 182976 - DNA, 25 bp, Mus musculus
agctgttcctgatcaccaggacttg

SEQ ID NO: 182977 - DNA, 25 bp, Mus musculus
agctgttcgagcagatcctcatgga

SEQ ID NO: 182978 - DNA, 25 bp, Mus musculus
agctgttcgagctgatcctcatgga

SEQ ID NO: 182979 - DNA, 25 bp, Mus musculus
agctgttcgccaaggtgctccagaa

SEQ ID NO: 182980 - DNA, 25 bp, Mus musculus
agctgttcgccatggtgctccagaa

SEQ ID NO: 182981 - DNA, 25 bp, Mus musculus
agctgttctattccgatcaaccctc

SEQ ID NO: 182982 - DNA, 25 bp, Mus musculus
agctgttctattgcgatcaaccctc

SEQ ID NO: 182983 - DNA, 25 bp, Mus musculus
agctgttctccaatcaacagtgtaa

SEQ ID NO: 182984 - DNA, 25 bp, Mus musculus
agctgttctccattcaacagtgtaa

SEQ ID NO: 182985 - DNA, 25 bp, Mus musculus
agctgttctccgcaggttcagggat

SEQ ID NO: 182986 - DNA, 25 bp, Mus musculus
agctgttctccggaggttcagggat

SEQ ID NO: 182987 - DNA, 25 bp, Mus musculus
agctgttctcgtctgacatatgttc

SEQ ID NO: 182988 - DNA, 25 bp, Mus musculus
agctgttctcgtgtgacatatgttc

SEQ ID NO: 182989 - DNA, 25 bp, Mus musculus
agctgttctctgaaccgaggcttaa

SEQ ID NO: 182990 - DNA, 25 bp, Mus musculus
agctgttctctgtaccgaggcttaa

SEQ ID NO: 182991 - DNA, 25 bp, Mus musculus
agctgttctgagagattcttctggc

SEQ ID NO: 182992 - DNA, 25 bp, Mus musculus
agctgttctgagtgattcttctggc

SEQ ID NO: 182993 - DNA, 25 bp, Mus musculus
agctgttctgcaactgtaacccaca

SEQ ID NO: 182994 - DNA, 25 bp, Mus musculus
agctgttctgcaagtgaatgctgca

SEQ ID NO: 182995 - DNA, 25 bp, Mus musculus
agctgttctgcacgcatgctcatga

SEQ ID NO: 182996 - DNA, 25 bp, Mus musculus
agctgttctgcaggcatgctcatga

SEQ ID NO: 182997 - DNA, 25 bp, Mus musculus
agctgttctgcatctgtaacccaca

SEQ ID NO: 182998 - DNA, 25 bp, Mus musculus
agctgttctgcatgtgaatgctgca

SEQ ID NO: 182999 - DNA, 25 bp, Mus musculus
agctgttctgctaggatttcctacg

SEQ ID NO: 183000 - DNA, 25 bp, Mus musculus
agctgttctgcttggatttcctacg

SEQ ID NO: 183001 - DNA, 25 bp, Mus musculus
agctgttctgttctgtggttcctca

SEQ ID NO: 183002 - DNA, 25 bp, Mus musculus
agctgttctgttgtgtggttcctca

SEQ ID NO: 183003 - DNA, 25 bp, Mus musculus
agctgttcttacagtacatgtatac

SEQ ID NO: 183004 - DNA, 25 bp, Mus musculus
agctgttcttactgtacatgtatac

SEQ ID NO: 183005 - DNA, 25 bp, Mus musculus
agctgttcttcaacttcagtgcaat

SEQ ID NO: 183006 - DNA, 25 bp, Mus musculus
agctgttcttcatcttcagtgcaat

SEQ ID NO: 183007 - DNA, 25 bp, Mus musculus
agctgttcttctacctggtggagca

SEQ ID NO: 183008 - DNA, 25 bp, Mus musculus
agctgttcttcttcctggtggagca

SEQ ID NO: 183009 - DNA, 25 bp, Mus musculus
agctgttgactcacttttataaata

SEQ ID NO: 183010 - DNA, 25 bp, Mus musculus
agctgttgactcctaaatatcctcc

SEQ ID NO: 183011 - DNA, 25 bp, Mus musculus
agctgttgactcgtaaatatcctcc

SEQ ID NO: 183012 - DNA, 25 bp, Mus musculus
agctgttgactctcttttataaata

SEQ ID NO: 183013 - DNA, 25 bp, Mus musculus
agctgttgaggtaggatctgatgac

SEQ ID NO: 183014 - DNA, 25 bp, Mus musculus
agctgttgaggttggatctgatgac

SEQ ID NO: 183015 - DNA, 25 bp, Mus musculus
agctgttgagtgctctgaattagga

SEQ ID NO: 183016 - DNA, 25 bp, Mus musculus
agctgttgagtggtctgaattagga

SEQ ID NO: 183017 - DNA, 25 bp, Mus musculus
agctgttgatatatccactgataga

SEQ ID NO: 183018 - DNA, 25 bp, Mus musculus
agctgttgatatttccactgataga

SEQ ID NO: 183019 - DNA, 25 bp, Mus musculus
agctgttgatggagcatgttgttgc

SEQ ID NO: 183020 - DNA, 25 bp, Mus musculus
agctgttgatggtgcatgttgttgc

SEQ ID NO: 183021 - DNA, 25 bp, Mus musculus
agctgttgatttacctgggtggttt

SEQ ID NO: 183022 - DNA, 25 bp, Mus musculus
agctgttgatttctgaggcctggtt

SEQ ID NO: 183023 - DNA, 25 bp, Mus musculus
agctgttgatttgtgaggcctggtt

SEQ ID NO: 183024 - DNA, 25 bp, Mus musculus
agctgttgattttcctgggtggttt

SEQ ID NO: 183025 - DNA, 25 bp, Mus musculus
agctgttgcaaacgcaggctggtcc

SEQ ID NO: 183026 - DNA, 25 bp, Mus musculus
agctgttgcaaaggcaggctggtcc

SEQ ID NO: 183027 - DNA, 25 bp, Mus musculus
agctgttgcagcatccctttgttac

SEQ ID NO: 183028 - DNA, 25 bp, Mus musculus
agctgttgcagcttccctttgttac

SEQ ID NO: 183029 - DNA, 25 bp, Mus musculus
agctgttgcatcagctgtgctgaag

SEQ ID NO: 183030 - DNA, 25 bp, Mus musculus
agctgttgcatctgctgtgctgaag

SEQ ID NO: 183031 - DNA, 25 bp, Mus musculus
agctgttgcattactagctgctgcc

SEQ ID NO: 183032 - DNA, 25 bp, Mus musculus
agctgttgcatttctagctgctgcc

SEQ ID NO: 183033 - DNA, 25 bp, Mus musculus
agctgttgcccaaatttgcctgaat

SEQ ID NO: 183034 - DNA, 25 bp, Mus musculus
agctgttgcccatatttgcctgaat

SEQ ID NO: 183035 - DNA, 25 bp, Mus musculus
agctgttgcctgctataaccagggc

SEQ ID NO: 183036 - DNA, 25 bp, Mus musculus
agctgttgcctggtataaccagggc

SEQ ID NO: 183037 - DNA, 25 bp, Mus musculus
agctgttgctgcacacgatgttgga

SEQ ID NO: 183038 - DNA, 25 bp, Mus musculus
agctgttgctgctcacgatgttgga

SEQ ID NO: 183039 - DNA, 25 bp, Mus musculus
agctgttgctgtacccctgaagctc

SEQ ID NO: 183040 - DNA, 25 bp, Mus musculus
agctgttgctgttcccctgaagctc

SEQ ID NO: 183041 - DNA, 25 bp, Mus musculus
agctgttggagaaagacattcacga

SEQ ID NO: 183042 - DNA, 25 bp, Mus musculus
agctgttggagatagacattcacga

SEQ ID NO: 183043 - DNA, 25 bp, Mus musculus
agctgttggatcaggtggaattcac

SEQ ID NO: 183044 - DNA, 25 bp, Mus musculus
agctgttggatctggtggaattcac

SEQ ID NO: 183045 - DNA, 25 bp, Mus musculus
agctgttggcacagggcggcctcta

SEQ ID NO: 183046 - DNA, 25 bp, Mus musculus
agctgttggcactgggcggcctcta

SEQ ID NO: 183047 - DNA, 25 bp, Mus musculus
agctgttggccccagactttgagaa

SEQ ID NO: 183048 - DNA, 25 bp, Mus musculus
agctgttggcccgagactttgagaa

SEQ ID NO: 183049 - DNA, 25 bp, Mus musculus
agctgttgggctacactgttaatca

SEQ ID NO: 183050 - DNA, 25 bp, Mus musculus
agctgttgggcttcactgttaatca

SEQ ID NO: 183051 - DNA, 25 bp, Mus musculus
agctgttgtaacacatctaatttca

SEQ ID NO: 183052 - DNA, 25 bp, Mus musculus
agctgttgtaactcatctaatttca

SEQ ID NO: 183053 - DNA, 25 bp, Mus musculus
agctgttgtaccagactcatcttgc

SEQ ID NO: 183054 - DNA, 25 bp, Mus musculus
agctgttgtacctgactcatcttgc

SEQ ID NO: 183055 - DNA, 25 bp, Mus musculus
agctgttgtagtatggacctgaccc

SEQ ID NO: 183056 - DNA, 25 bp, Mus musculus
agctgttgtagtttggacctgaccc

SEQ ID NO: 183057 - DNA, 25 bp, Mus musculus
agctgttgtcagcacatcgaaatga

SEQ ID NO: 183058 - DNA, 25 bp, Mus musculus
agctgttgtcaggacatcgaaatga

SEQ ID NO: 183059 - DNA, 25 bp, Mus musculus
agctgttgtcctagctctggctaat

SEQ ID NO: 183060 - DNA, 25 bp, Mus musculus
agctgttgtccttgctctggctaat

SEQ ID NO: 183061 - DNA, 25 bp, Mus musculus
agctgttgtctgaagcaccatagat

SEQ ID NO: 183062 - DNA, 25 bp, Mus musculus
agctgttgtctgtagcaccatagat

SEQ ID NO: 183063 - DNA, 25 bp, Mus musculus
agctgttgtgctattgaatctttca

SEQ ID NO: 183064 - DNA, 25 bp, Mus musculus
agctgttgtgctcaggcgatgccac

SEQ ID NO: 183065 - DNA, 25 bp, Mus musculus
agctgttgtgctgaggcgatgccac

SEQ ID NO: 183066 - DNA, 25 bp, Mus musculus
agctgttgtgcttttgaatctttca

SEQ ID NO: 183067 - DNA, 25 bp, Mus musculus
agctgttgtgtgaggtaaccccggc

SEQ ID NO: 183068 - DNA, 25 bp, Mus musculus
agctgttgtgtgtggtaaccccggc

SEQ ID NO: 183069 - DNA, 25 bp, Mus musculus
agctgttgtgttaacatttcctaca

SEQ ID NO: 183070 - DNA, 25 bp, Mus musculus
agctgttgtgtttacatttcctaca

SEQ ID NO: 183071 - DNA, 25 bp, Mus musculus
agctgtttagagaagtagggcccca

SEQ ID NO: 183072 - DNA, 25 bp, Mus musculus
agctgtttagagtagtagggcccca

SEQ ID NO: 183073 - DNA, 25 bp, Mus musculus
agctgtttcatgagtgcgtcatcct

SEQ ID NO: 183074 - DNA, 25 bp, Mus musculus
agctgtttcatgcatgtcctcagca

SEQ ID NO: 183075 - DNA, 25 bp, Mus musculus
agctgtttcatggatgtcctcagca

SEQ ID NO: 183076 - DNA, 25 bp, Mus musculus
agctgtttcatgtgtgcgtcatcct

SEQ ID NO: 183077 - DNA, 25 bp, Mus musculus
agctgtttcattcagggaagtgcct

SEQ ID NO: 183078 - DNA, 25 bp, Mus musculus
agctgtttcattgagggaagtgcct

SEQ ID NO: 183079 - DNA, 25 bp, Mus musculus
agctgtttcctacggctgcagaggc

SEQ ID NO: 183080 - DNA, 25 bp, Mus musculus
agctgtttcctagggctgcagaggc

SEQ ID NO: 183081 - DNA, 25 bp, Mus musculus
agctgtttcctgagttacaaaaaga

SEQ ID NO: 183082 - DNA, 25 bp, Mus musculus
agctgtttcctgtgttacaaaaaga

SEQ ID NO: 183083 - DNA, 25 bp, Mus musculus
agctgtttgaccaggttcgaagaat

SEQ ID NO: 183084 - DNA, 25 bp, Mus musculus
agctgtttgacctggttcgaagaat

SEQ ID NO: 183085 - DNA, 25 bp, Mus musculus
agctgtttgactacagttagtttga

SEQ ID NO: 183086 - DNA, 25 bp, Mus musculus
agctgtttgacttcagttagtttga

SEQ ID NO: 183087 - DNA, 25 bp, Mus musculus
agctgtttgcaaccattgcacacca

SEQ ID NO: 183088 - DNA, 25 bp, Mus musculus
agctgtttgcaactctcaccagtga

SEQ ID NO: 183089 - DNA, 25 bp, Mus musculus
agctgtttgcaagcattgcacacca

SEQ ID NO: 183090 - DNA, 25 bp, Mus musculus
agctgtttgcaagtctcaccagtga

SEQ ID NO: 183091 - DNA, 25 bp, Mus musculus
agctgtttgcacagctccaactgtg

SEQ ID NO: 183092 - DNA, 25 bp, Mus musculus
agctgtttgcactgctccaactgtg

SEQ ID NO: 183093 - DNA, 25 bp, Mus musculus
agctgtttggacctgatgtggaccc

SEQ ID NO: 183094 - DNA, 25 bp, Mus musculus
agctgtttggacgtgatgtggaccc

SEQ ID NO: 183095 - DNA, 25 bp, Mus musculus
agctgtttggtcaccgttgaaaaca

SEQ ID NO: 183096 - DNA, 25 bp, Mus musculus
agctgtttggtctccgttgaaaaca

SEQ ID NO: 183097 - DNA, 25 bp, Mus musculus
agctgtttggtgatgtttgtttcca

SEQ ID NO: 183098 - DNA, 25 bp, Mus musculus
agctgtttggtgttgtttgtttcca

SEQ ID NO: 183099 - DNA, 25 bp, Mus musculus
agctgtttggttcctcagtgagaga

SEQ ID NO: 183100 - DNA, 25 bp, Mus musculus
agctgtttggttgctcagtgagaga

SEQ ID NO: 183101 - DNA, 25 bp, Mus musculus
agctgtttgtaaatacttcagtgga

SEQ ID NO: 183102 - DNA, 25 bp, Mus musculus
agctgtttgtaattacttcagtgga

SEQ ID NO: 183103 - DNA, 25 bp, Mus musculus
agctgtttgtatatgtgtgagacat

SEQ ID NO: 183104 - DNA, 25 bp, Mus musculus
agctgtttgtatttgtgtgagacat

SEQ ID NO: 183105 - DNA, 25 bp, Mus musculus
agctgtttgtcacccgttcaaatga

SEQ ID NO: 183106 - DNA, 25 bp, Mus musculus
agctgtttgtcagccgttcaaatga

SEQ ID NO: 183107 - DNA, 25 bp, Mus musculus
agctgtttgtcgaaacttgaaattt

SEQ ID NO: 183108 - DNA, 25 bp, Mus musculus
agctgtttgtcgtaacttgaaattt

SEQ ID NO: 183109 - DNA, 25 bp, Mus musculus
agctgttttaggacttttgggtgag

SEQ ID NO: 183110 - DNA, 25 bp, Mus musculus
agctgttttaggtcttttgggtgag

SEQ ID NO: 183111 - DNA, 25 bp, Mus musculus
agctgttttcagatagtgggtctcg

SEQ ID NO: 183112 - DNA, 25 bp, Mus musculus
agctgttttcagttagtgggtctcg

SEQ ID NO: 183113 - DNA, 25 bp, Mus musculus
agctgttttctgagtttctcagagg

SEQ ID NO: 183114 - DNA, 25 bp, Mus musculus
agctgttttctgtgtttctcagagg

SEQ ID NO: 183115 - DNA, 25 bp, Mus musculus
agctgttttcttagcactgtctgac

SEQ ID NO: 183116 - DNA, 25 bp, Mus musculus
agctgttttctttgcactgtctgac

SEQ ID NO: 183117 - DNA, 25 bp, Mus musculus
agctgttttgatcctgcactgtggc

SEQ ID NO: 183118 - DNA, 25 bp, Mus musculus
agctgttttgatgctgcactgtggc

SEQ ID NO: 183119 - DNA, 25 bp, Mus musculus
agctgttttgtccagcttgcccatg

SEQ ID NO: 183120 - DNA, 25 bp, Mus musculus
agctgttttgtcgagcttgcccatg

SEQ ID NO: 183121 - DNA, 25 bp, Mus musculus
agctgttttttcaggctgacggtcc

SEQ ID NO: 183122 - DNA, 25 bp, Mus musculus
agctgttttttctggctgacggtcc

SEQ ID NO: 183123 - DNA, 25 bp, Mus musculus
agcttaaacactctggccttttggg

SEQ ID NO: 183124 - DNA, 25 bp, Mus musculus
agcttaaacactgtggccttttggg

SEQ ID NO: 183125 - DNA, 25 bp, Mus musculus
agcttaacagcgctgtccttggtgg

SEQ ID NO: 183126 - DNA, 25 bp, Mus musculus
agcttaacagcggtgtccttggtgg

SEQ ID NO: 183127 - DNA, 25 bp, Mus musculus
agcttaacccttcctggactgctga

SEQ ID NO: 183128 - DNA, 25 bp, Mus musculus
agcttaacccttgctggactgctga

SEQ ID NO: 183129 - DNA, 25 bp, Mus musculus
agcttaacttctaattgccccataa

SEQ ID NO: 183130 - DNA, 25 bp, Mus musculus
agcttaacttcttattgccccataa

SEQ ID NO: 183131 - DNA, 25 bp, Mus musculus
agcttaagggtcaacctcactcagc

SEQ ID NO: 183132 - DNA, 25 bp, Mus musculus
agcttaagggtctacctcactcagc

SEQ ID NO: 183133 - DNA, 25 bp, Mus musculus
agcttaaggtctatcagtctatcag

SEQ ID NO: 183134 - DNA, 25 bp, Mus musculus
agcttaaggtctttcagtctatcag

SEQ ID NO: 183135 - DNA, 25 bp, Mus musculus
agcttaaggtttagtcatccataat

SEQ ID NO: 183136 - DNA, 25 bp, Mus musculus
agcttaaggttttgtcatccataat

SEQ ID NO: 183137 - DNA, 25 bp, Mus musculus
agcttaagtgttcccgcgtgctgtc

SEQ ID NO: 183138 - DNA, 25 bp, Mus musculus
agcttaagtgttgccgcgtgctgtc

SEQ ID NO: 183139 - DNA, 25 bp, Mus musculus
agcttaatcaagagcctcagaggag

SEQ ID NO: 183140 - DNA, 25 bp, Mus musculus
agcttaatcaagtgcctcagaggag

SEQ ID NO: 183141 - DNA, 25 bp, Mus musculus
agcttaatcagtccctaccatgtaa

SEQ ID NO: 183142 - DNA, 25 bp, Mus musculus
agcttaatcagtgcctaccatgtaa

SEQ ID NO: 183143 - DNA, 25 bp, Mus musculus
agcttaatcttaatgtgtccaaaca

SEQ ID NO: 183144 - DNA, 25 bp, Mus musculus
agcttaatcttattgtgtccaaaca

SEQ ID NO: 183145 - DNA, 25 bp, Mus musculus
agcttaatcttgagttcgcttcgcg

SEQ ID NO: 183146 - DNA, 25 bp, Mus musculus
agcttaatcttgtgttcgcttcgcg

SEQ ID NO: 183147 - DNA, 25 bp, Mus musculus
agcttaattccaacatctttcttcc

SEQ ID NO: 183148 - DNA, 25 bp, Mus musculus
agcttaattccatcatctttcttcc

SEQ ID NO: 183149 - DNA, 25 bp, Mus musculus
agcttaattgccagggcagcctgaa

SEQ ID NO: 183150 - DNA, 25 bp, Mus musculus
agcttaattgcctgggcagcctgaa

SEQ ID NO: 183151 - DNA, 25 bp, Mus musculus
agcttaattgttagtgtgaccttgg

SEQ ID NO: 183152 - DNA, 25 bp, Mus musculus
agcttaattgtttgtgtgaccttgg

SEQ ID NO: 183153 - DNA, 25 bp, Mus musculus
agcttacaaatacacctgcactacg

SEQ ID NO: 183154 - DNA, 25 bp, Mus musculus
agcttacaaatagacctgcactacg

SEQ ID NO: 183155 - DNA, 25 bp, Mus musculus
agcttacaactgaccttaaccccag

SEQ ID NO: 183156 - DNA, 25 bp, Mus musculus
agcttacaactgtccttaaccccag

SEQ ID NO: 183157 - DNA, 25 bp, Mus musculus
agcttacaatgtctattctggacac

SEQ ID NO: 183158 - DNA, 25 bp, Mus musculus
agcttacaatgtgtattctggacac

SEQ ID NO: 183159 - DNA, 25 bp, Mus musculus
agcttacacacaaacctgggagggc

SEQ ID NO: 183160 - DNA, 25 bp, Mus musculus
agcttacacacatacctgggagggc

SEQ ID NO: 183161 - DNA, 25 bp, Mus musculus
agcttacagaggactccgtatgtcc

SEQ ID NO: 183162 - DNA, 25 bp, Mus musculus
agcttacagaggtctccgtatgtcc

SEQ ID NO: 183163 - DNA, 25 bp, Mus musculus
agcttacagcatccttttccggtgg

SEQ ID NO: 183164 - DNA, 25 bp, Mus musculus
agcttacagcatgcttttccggtgg

SEQ ID NO: 183165 - DNA, 25 bp, Mus musculus
agcttacagggcatattcagttaga

SEQ ID NO: 183166 - DNA, 25 bp, Mus musculus
agcttacagggcttattcagttaga

SEQ ID NO: 183167 - DNA, 25 bp, Mus musculus
agcttacatcacaattcactcacat

SEQ ID NO: 183168 - DNA, 25 bp, Mus musculus
agcttacatcactattcactcacat

SEQ ID NO: 183169 - DNA, 25 bp, Mus musculus
agcttacatgtgatacctaccctga

SEQ ID NO: 183170 - DNA, 25 bp, Mus musculus
agcttacatgtgttacctaccctga

SEQ ID NO: 183171 - DNA, 25 bp, Mus musculus
agcttaccacctagctatgctataa

SEQ ID NO: 183172 - DNA, 25 bp, Mus musculus
agcttaccaccttgctatgctataa

SEQ ID NO: 183173 - DNA, 25 bp, Mus musculus
agcttaccagatccttgatgcctgt

SEQ ID NO: 183174 - DNA, 25 bp, Mus musculus
agcttaccagatgcttgatgcctgt

SEQ ID NO: 183175 - DNA, 25 bp, Mus musculus
agcttaccagtaaattcggttgtca

SEQ ID NO: 183176 - DNA, 25 bp, Mus musculus
agcttaccagtatattcggttgtca

SEQ ID NO: 183177 - DNA, 25 bp, Mus musculus
agcttaccagtgaactcttcgcgtg

SEQ ID NO: 183178 - DNA, 25 bp, Mus musculus
agcttaccagtgtactcttcgcgtg

SEQ ID NO: 183179 - DNA, 25 bp, Mus musculus
agcttaccatgacctgccaagggtt

SEQ ID NO: 183180 - DNA, 25 bp, Mus musculus
agcttaccatgagctgccaagggtt

SEQ ID NO: 183181 - DNA, 25 bp, Mus musculus
agcttacccatcacttacaggttct

SEQ ID NO: 183182 - DNA, 25 bp, Mus musculus
agcttacccatctcttacaggttct

SEQ ID NO: 183183 - DNA, 25 bp, Mus musculus
agcttacctgcaaattgcttccgaa

SEQ ID NO: 183184 - DNA, 25 bp, Mus musculus
agcttacctgcatattgcttccgaa

SEQ ID NO: 183185 - DNA, 25 bp, Mus musculus
agcttacctgctactcattaggagt

SEQ ID NO: 183186 - DNA, 25 bp, Mus musculus
agcttacctgcttctcattaggagt

SEQ ID NO: 183187 - DNA, 25 bp, Mus musculus
agcttaccttcacttcacgtagcag

SEQ ID NO: 183188 - DNA, 25 bp, Mus musculus
agcttaccttcagttcacgtagcag

SEQ ID NO: 183189 - DNA, 25 bp, Mus musculus
agcttacctttcctggctcatctta

SEQ ID NO: 183190 - DNA, 25 bp, Mus musculus
agcttacctttcgtggctcatctta

SEQ ID NO: 183191 - DNA, 25 bp, Mus musculus
agcttacgatgcagctctttcttca

SEQ ID NO: 183192 - DNA, 25 bp, Mus musculus
agcttacgatgctgctctttcttca

SEQ ID NO: 183193 - DNA, 25 bp, Mus musculus
agcttacgccccagttctttttcat

SEQ ID NO: 183194 - DNA, 25 bp, Mus musculus
agcttacgcccctgttctttttcat

SEQ ID NO: 183195 - DNA, 25 bp, Mus musculus
agcttactagcgaatcttgagtggc

SEQ ID NO: 183196 - DNA, 25 bp, Mus musculus
agcttactagcgtatcttgagtggc

SEQ ID NO: 183197 - DNA, 25 bp, Mus musculus
agcttactcaggcacagtgggccat

SEQ ID NO: 183198 - DNA, 25 bp, Mus musculus
agcttactcagggacagtgggccat

SEQ ID NO: 183199 - DNA, 25 bp, Mus musculus
agcttactcattatccaaccatcct

SEQ ID NO: 183200 - DNA, 25 bp, Mus musculus
agcttactcattttccaaccatcct

SEQ ID NO: 183201 - DNA, 25 bp, Mus musculus
agcttactctaaccccattgatact

SEQ ID NO: 183202 - DNA, 25 bp, Mus musculus
agcttactctaagcccattgatact

SEQ ID NO: 183203 - DNA, 25 bp, Mus musculus
agcttacttgcacacgggcactgca

SEQ ID NO: 183204 - DNA, 25 bp, Mus musculus
agcttacttgcagacgggcactgca

SEQ ID NO: 183205 - DNA, 25 bp, Mus musculus
agcttactttccctgagcagtgcct

SEQ ID NO: 183206 - DNA, 25 bp, Mus musculus
agcttactttccgtgagcagtgcct

SEQ ID NO: 183207 - DNA, 25 bp, Mus musculus
agcttagaacgtaatgccctggtgt

SEQ ID NO: 183208 - DNA, 25 bp, Mus musculus
agcttagaacgttatgccctggtgt

SEQ ID NO: 183209 - DNA, 25 bp, Mus musculus
agcttagaagttccttatcctgtgc

SEQ ID NO: 183210 - DNA, 25 bp, Mus musculus
agcttagaagttgcttatcctgtgc

SEQ ID NO: 183211 - DNA, 25 bp, Mus musculus
agcttagaccttcgtaaccctgata

SEQ ID NO: 183212 - DNA, 25 bp, Mus musculus
agcttagaccttggtaaccctgata

SEQ ID NO: 183213 - DNA, 25 bp, Mus musculus
agcttagacgagcacacttctcttc

SEQ ID NO: 183214 - DNA, 25 bp, Mus musculus
agcttagacgaggacacttctcttc

SEQ ID NO: 183215 - DNA, 25 bp, Mus musculus
agcttagacgttaggatttctgttt

SEQ ID NO: 183216 - DNA, 25 bp, Mus musculus
agcttagacgtttggatttctgttt

SEQ ID NO: 183217 - DNA, 25 bp, Mus musculus
agcttagagaacattgggctccttt

SEQ ID NO: 183218 - DNA, 25 bp, Mus musculus
agcttagagaactttgggctccttt

SEQ ID NO: 183219 - DNA, 25 bp, Mus musculus
agcttagaggaacgcaggctcccca

SEQ ID NO: 183220 - DNA, 25 bp, Mus musculus
agcttagaggaaggcaggctcccca

SEQ ID NO: 183221 - DNA, 25 bp, Mus musculus
agcttagatcatcccagctagcaac

SEQ ID NO: 183222 - DNA, 25 bp, Mus musculus
agcttagatcatgccagctagcaac

SEQ ID NO: 183223 - DNA, 25 bp, Mus musculus
agcttagatccaaatgtcctcacct

SEQ ID NO: 183224 - DNA, 25 bp, Mus musculus
agcttagatccatatgtcctcacct

SEQ ID NO: 183225 - DNA, 25 bp, Mus musculus
agcttagatcctcctcaagggctgg

SEQ ID NO: 183226 - DNA, 25 bp, Mus musculus
agcttagatcctgctcaagggctgg

SEQ ID NO: 183227 - DNA, 25 bp, Mus musculus
agcttagatctgctttggattcaat

SEQ ID NO: 183228 - DNA, 25 bp, Mus musculus
agcttagatctggtttggattcaat

SEQ ID NO: 183229 - DNA, 25 bp, Mus musculus
agcttagatgttatgtcttcccctt

SEQ ID NO: 183230 - DNA, 25 bp, Mus musculus
agcttagatgttttgtcttcccctt

SEQ ID NO: 183231 - DNA, 25 bp, Mus musculus
agcttagattctagaccatcgctgg

SEQ ID NO: 183232 - DNA, 25 bp, Mus musculus
agcttagattcttgaccatcgctgg

SEQ ID NO: 183233 - DNA, 25 bp, Mus musculus
agcttagcaatgcttctgtgtggca

SEQ ID NO: 183234 - DNA, 25 bp, Mus musculus
agcttagcaatggttctgtgtggca

SEQ ID NO: 183235 - DNA, 25 bp, Mus musculus
agcttagcacatatgccattgaaat

SEQ ID NO: 183236 - DNA, 25 bp, Mus musculus
agcttagcacatttgccattgaaat

SEQ ID NO: 183237 - DNA, 25 bp, Mus musculus
agcttagcagctactgatttcccac

SEQ ID NO: 183238 - DNA, 25 bp, Mus musculus
agcttagcagcttctgatttcccac

SEQ ID NO: 183239 - DNA, 25 bp, Mus musculus
agcttagcatgcacctgtcacaaag

SEQ ID NO: 183240 - DNA, 25 bp, Mus musculus
agcttagcatgctcctgtcacaaag

SEQ ID NO: 183241 - DNA, 25 bp, Mus musculus
agcttagcccctactgatgtttgtg

SEQ ID NO: 183242 - DNA, 25 bp, Mus musculus
agcttagccccttctgatgtttgtg

SEQ ID NO: 183243 - DNA, 25 bp, Mus musculus
agcttagcgcgtaagcgtgcttgct

SEQ ID NO: 183244 - DNA, 25 bp, Mus musculus
agcttagcgcgttagcgtgcttgct

SEQ ID NO: 183245 - DNA, 25 bp, Mus musculus
agcttagcgtcaactgcatttgaaa

SEQ ID NO: 183246 - DNA, 25 bp, Mus musculus
agcttagcgtcatctgcatttgaaa

SEQ ID NO: 183247 - DNA, 25 bp, Mus musculus
agcttagctcctcatgataccatca

SEQ ID NO: 183248 - DNA, 25 bp, Mus musculus
agcttagctcctgatgataccatca

SEQ ID NO: 183249 - DNA, 25 bp, Mus musculus
agcttagctgcacacatgttcaaag

SEQ ID NO: 183250 - DNA, 25 bp, Mus musculus
agcttagctgcagacatgttcaaag

SEQ ID NO: 183251 - DNA, 25 bp, Mus musculus
agcttagctgctccaaagatatcca

SEQ ID NO: 183252 - DNA, 25 bp, Mus musculus
agcttagctgctgcaaagatatcca

SEQ ID NO: 183253 - DNA, 25 bp, Mus musculus
agcttagctttgacttcttggtgga

SEQ ID NO: 183254 - DNA, 25 bp, Mus musculus
agcttagctttgtcttcttggtgga

SEQ ID NO: 183255 - DNA, 25 bp, Mus musculus
agcttaggcagcagagatttggctt

SEQ ID NO: 183256 - DNA, 25 bp, Mus musculus
agcttaggcagctgagatttggctt

SEQ ID NO: 183257 - DNA, 25 bp, Mus musculus
agcttaggctctcgccttggatcca

SEQ ID NO: 183258 - DNA, 25 bp, Mus musculus
agcttaggctctggccttggatcca

SEQ ID NO: 183259 - DNA, 25 bp, Mus musculus
agcttagggcctctgtgaggacccc

SEQ ID NO: 183260 - DNA, 25 bp, Mus musculus
agcttagggcctgtgtgaggacccc

SEQ ID NO: 183261 - DNA, 25 bp, Mus musculus
agcttagtagttcactatcccgcgt

SEQ ID NO: 183262 - DNA, 25 bp, Mus musculus
agcttagtagttgactatcccgcgt

SEQ ID NO: 183263 - DNA, 25 bp, Mus musculus
agcttagtcagtaggatggcatcag

SEQ ID NO: 183264 - DNA, 25 bp, Mus musculus
agcttagtcagttggatggcatcag

SEQ ID NO: 183265 - DNA, 25 bp, Mus musculus
agcttagtcataccagctcctggag

SEQ ID NO: 183266 - DNA, 25 bp, Mus musculus
agcttagtcatagcagctcctggag

SEQ ID NO: 183267 - DNA, 25 bp, Mus musculus
agcttagtttttcatacctttgtgt

SEQ ID NO: 183268 - DNA, 25 bp, Mus musculus
agcttagtttttgatacctttgtgt

SEQ ID NO: 183269 - DNA, 25 bp, Mus musculus
agcttataatcaagggcacttcttc

SEQ ID NO: 183270 - DNA, 25 bp, Mus musculus
agcttataatcatgggcacttcttc

SEQ ID NO: 183271 - DNA, 25 bp, Mus musculus
agcttatactatacccataccaaag

SEQ ID NO: 183272 - DNA, 25 bp, Mus musculus
agcttatactattcccataccaaag

SEQ ID NO: 183273 - DNA, 25 bp, Mus musculus
agcttatagctgactgattctccag

SEQ ID NO: 183274 - DNA, 25 bp, Mus musculus
agcttatagctgatgtcacttttta

SEQ ID NO: 183275 - DNA, 25 bp, Mus musculus
agcttatagctgtctgattctccag

SEQ ID NO: 183276 - DNA, 25 bp, Mus musculus
agcttatagctgttgtcacttttta

SEQ ID NO: 183277 - DNA, 25 bp, Mus musculus
agcttatagtcccactggtcatgaa

SEQ ID NO: 183278 - DNA, 25 bp, Mus musculus
agcttatagtccgactggtcatgaa

SEQ ID NO: 183279 - DNA, 25 bp, Mus musculus
agcttatatataccctctgtgagtc

SEQ ID NO: 183280 - DNA, 25 bp, Mus musculus
agcttatatatagcctctgtgagtc

SEQ ID NO: 183281 - DNA, 25 bp, Mus musculus
agcttatccgtaaggtgtccacgtc

SEQ ID NO: 183282 - DNA, 25 bp, Mus musculus
agcttatccgtatggtgtccacgtc

SEQ ID NO: 183283 - DNA, 25 bp, Mus musculus
agcttatcctgtcccgcctcgattt

SEQ ID NO: 183284 - DNA, 25 bp, Mus musculus
agcttatcctgtgccgcctcgattt

SEQ ID NO: 183285 - DNA, 25 bp, Mus musculus
agcttatctcgcacccgatgtggat

SEQ ID NO: 183286 - DNA, 25 bp, Mus musculus
agcttatctcgctcccgatgtggat

SEQ ID NO: 183287 - DNA, 25 bp, Mus musculus
agcttatgagccatccagttgtgtc

SEQ ID NO: 183288 - DNA, 25 bp, Mus musculus
agcttatgagccttccagttgtgtc

SEQ ID NO: 183289 - DNA, 25 bp, Mus musculus
agcttatgcaaaagagcagactttc

SEQ ID NO: 183290 - DNA, 25 bp, Mus musculus
agcttatgcaaatgagcagactttc

SEQ ID NO: 183291 - DNA, 25 bp, Mus musculus
agcttatgcaccatgcttggcttaa

SEQ ID NO: 183292 - DNA, 25 bp, Mus musculus
agcttatgcaccttgcttggcttaa

SEQ ID NO: 183293 - DNA, 25 bp, Mus musculus
agcttatgccagactgtcattcatc

SEQ ID NO: 183294 - DNA, 25 bp, Mus musculus
agcttatgccagtctgtcattcatc

SEQ ID NO: 183295 - DNA, 25 bp, Mus musculus
agcttatggccgacctggagcttta

SEQ ID NO: 183296 - DNA, 25 bp, Mus musculus
agcttatggccgtcctggagcttta

SEQ ID NO: 183297 - DNA, 25 bp, Mus musculus
agcttatgggagagagctctctcct

SEQ ID NO: 183298 - DNA, 25 bp, Mus musculus
agcttatgggagtgagctctctcct

SEQ ID NO: 183299 - DNA, 25 bp, Mus musculus
agcttattcaacatccaaccattca

SEQ ID NO: 183300 - DNA, 25 bp, Mus musculus
agcttattcaacttccaaccattca

SEQ ID NO: 183301 - DNA, 25 bp, Mus musculus
agcttattccgtcgtcggcatcaga

SEQ ID NO: 183302 - DNA, 25 bp, Mus musculus
agcttattccgtggtcggcatcaga

SEQ ID NO: 183303 - DNA, 25 bp, Mus musculus
agcttattggccctgcatcattgtc

SEQ ID NO: 183304 - DNA, 25 bp, Mus musculus
agcttattggccgtgcatcattgtc

SEQ ID NO: 183305 - DNA, 25 bp, Mus musculus
agcttattgttaatctatggccaca

SEQ ID NO: 183306 - DNA, 25 bp, Mus musculus
agcttattgttattctatggccaca

SEQ ID NO: 183307 - DNA, 25 bp, Mus musculus
agcttatttgctatgttcttcttca

SEQ ID NO: 183308 - DNA, 25 bp, Mus musculus
agcttatttgctttgttcttcttca

SEQ ID NO: 183309 - DNA, 25 bp, Mus musculus
agcttatttttaagtggtcttatga

SEQ ID NO: 183310 - DNA, 25 bp, Mus musculus
agcttatttttatgtggtcttatga

SEQ ID NO: 183311 - DNA, 25 bp, Mus musculus
agcttcaaaaggcaactacatagtg

SEQ ID NO: 183312 - DNA, 25 bp, Mus musculus
agcttcaaaagggaactacatagtg

SEQ ID NO: 183313 - DNA, 25 bp, Mus musculus
agcttcaaacacacttcctgagcaa

SEQ ID NO: 183314 - DNA, 25 bp, Mus musculus
agcttcaaacactcttcctgagcaa

SEQ ID NO: 183315 - DNA, 25 bp, Mus musculus
agcttcaaacttccaacgtggattt

SEQ ID NO: 183316 - DNA, 25 bp, Mus musculus
agcttcaaacttgcaacgtggattt

SEQ ID NO: 183317 - DNA, 25 bp, Mus musculus
agcttcaaagctaccagaatccact

SEQ ID NO: 183318 - DNA, 25 bp, Mus musculus
agcttcaaagcttccagaatccact

SEQ ID NO: 183319 - DNA, 25 bp, Mus musculus
agcttcaaaggaaagcacacctctg

SEQ ID NO: 183320 - DNA, 25 bp, Mus musculus
agcttcaaaggatagcacacctctg

SEQ ID NO: 183321 - DNA, 25 bp, Mus musculus
agcttcaacaaccatctcgtaacaa

SEQ ID NO: 183322 - DNA, 25 bp, Mus musculus
agcttcaacaacgatctcgtaacaa

SEQ ID NO: 183323 - DNA, 25 bp, Mus musculus
agcttcaacactccatgtccctgag

SEQ ID NO: 183324 - DNA, 25 bp, Mus musculus
agcttcaacactgcatgtccctgag

SEQ ID NO: 183325 - DNA, 25 bp, Mus musculus
agcttcaacagcatccgggttaatc

SEQ ID NO: 183326 - DNA, 25 bp, Mus musculus
agcttcaacagcttccgggttaatc

SEQ ID NO: 183327 - DNA, 25 bp, Mus musculus
agcttcaacatcacaggtgctgagg

SEQ ID NO: 183328 - DNA, 25 bp, Mus musculus
agcttcaacatctcaggtgctgagg

SEQ ID NO: 183329 - DNA, 25 bp, Mus musculus
agcttcaaccataacattgccgttt

SEQ ID NO: 183330 - DNA, 25 bp, Mus musculus
agcttcaaccattacattgccgttt

SEQ ID NO: 183331 - DNA, 25 bp, Mus musculus
agcttcaaggtgaccttcgaggaaa

SEQ ID NO: 183332 - DNA, 25 bp, Mus musculus
agcttcaaggtgtccttcgaggaaa

SEQ ID NO: 183333 - DNA, 25 bp, Mus musculus
agcttcaagtcccaggctgtgtatt

SEQ ID NO: 183334 - DNA, 25 bp, Mus musculus
agcttcaagtccgaggctgtgtatt

SEQ ID NO: 183335 - DNA, 25 bp, Mus musculus
agcttcaagtgcctaaactaagtta

SEQ ID NO: 183336 - DNA, 25 bp, Mus musculus
agcttcaagtgcgtaaactaagtta

SEQ ID NO: 183337 - DNA, 25 bp, Mus musculus
agcttcaagttgagcccgggtgact

SEQ ID NO: 183338 - DNA, 25 bp, Mus musculus
agcttcaagttgtgcccgggtgact

SEQ ID NO: 183339 - DNA, 25 bp, Mus musculus
agcttcaatcagaggccgggatacc

SEQ ID NO: 183340 - DNA, 25 bp, Mus musculus
agcttcaatcagtggccgggatacc

SEQ ID NO: 183341 - DNA, 25 bp, Mus musculus
agcttcaattataaccactcacaga

SEQ ID NO: 183342 - DNA, 25 bp, Mus musculus
agcttcaattattaccactcacaga

SEQ ID NO: 183343 - DNA, 25 bp, Mus musculus
agcttcaatttgacccttggctggg

SEQ ID NO: 183344 - DNA, 25 bp, Mus musculus
agcttcaatttgtcccttggctggg

SEQ ID NO: 183345 - DNA, 25 bp, Mus musculus
agcttcacaccgacagcgtgatgca

SEQ ID NO: 183346 - DNA, 25 bp, Mus musculus
agcttcacaccgtcagcgtgatgca

SEQ ID NO: 183347 - DNA, 25 bp, Mus musculus
agcttcacagacctgatttcatctc

SEQ ID NO: 183348 - DNA, 25 bp, Mus musculus
agcttcacagacgtgatttcatctc

SEQ ID NO: 183349 - DNA, 25 bp, Mus musculus
agcttcacagtgacctctagagtca

SEQ ID NO: 183350 - DNA, 25 bp, Mus musculus
agcttcacagtgtcctctagagtca

SEQ ID NO: 183351 - DNA, 25 bp, Mus musculus
agcttcacatacacttgcatcacac

SEQ ID NO: 183352 - DNA, 25 bp, Mus musculus
agcttcacatactcttgcatcacac

SEQ ID NO: 183353 - DNA, 25 bp, Mus musculus
agcttcacatgaaagaacgcaggca

SEQ ID NO: 183354 - DNA, 25 bp, Mus musculus
agcttcacatgatagaacgcaggca

SEQ ID NO: 183355 - DNA, 25 bp, Mus musculus
agcttcacatgtaccgtggacgttc

SEQ ID NO: 183356 - DNA, 25 bp, Mus musculus
agcttcacatgttccgtggacgttc

SEQ ID NO: 183357 - DNA, 25 bp, Mus musculus
agcttcaccagaactcggaatggac

SEQ ID NO: 183358 - DNA, 25 bp, Mus musculus
agcttcaccagatctcggaatggac

SEQ ID NO: 183359 - DNA, 25 bp, Mus musculus
agcttcacccgacccaggagaaagt

SEQ ID NO: 183360 - DNA, 25 bp, Mus musculus
agcttcacccgagccaggagaaagt

SEQ ID NO: 183361 - DNA, 25 bp, Mus musculus
agcttcaccctgaatttagcttttg

SEQ ID NO: 183362 - DNA, 25 bp, Mus musculus
agcttcaccctgtatttagcttttg

SEQ ID NO: 183363 - DNA, 25 bp, Mus musculus
agcttcacctgacaatgactgttcc

SEQ ID NO: 183364 - DNA, 25 bp, Mus musculus
agcttcacctgagaatgactgttcc

SEQ ID NO: 183365 - DNA, 25 bp, Mus musculus
agcttcaccttaacagaggacaagg

SEQ ID NO: 183366 - DNA, 25 bp, Mus musculus
agcttcaccttatcagaggacaagg

SEQ ID NO: 183367 - DNA, 25 bp, Mus musculus
agcttcactaccatcttgatgtcat

SEQ ID NO: 183368 - DNA, 25 bp, Mus musculus
agcttcactaccttcttgatgtcat

SEQ ID NO: 183369 - DNA, 25 bp, Mus musculus
agcttcactcatcgacctcaattat

SEQ ID NO: 183370 - DNA, 25 bp, Mus musculus
agcttcactcatggacctcaattat

SEQ ID NO: 183371 - DNA, 25 bp, Mus musculus
agcttcactccgaccttcatgtatc

SEQ ID NO: 183372 - DNA, 25 bp, Mus musculus
agcttcactccgtccttcatgtatc

SEQ ID NO: 183373 - DNA, 25 bp, Mus musculus
agcttcactctaatcttacttgttg

SEQ ID NO: 183374 - DNA, 25 bp, Mus musculus
agcttcactctattcttacttgttg

SEQ ID NO: 183375 - DNA, 25 bp, Mus musculus
agcttcacttgcaggaacacatctg

SEQ ID NO: 183376 - DNA, 25 bp, Mus musculus
agcttcacttgctggaacacatctg

SEQ ID NO: 183377 - DNA, 25 bp, Mus musculus
agcttcagaaacacgctggcttcta

SEQ ID NO: 183378 - DNA, 25 bp, Mus musculus
agcttcagaaactcgctggcttcta

SEQ ID NO: 183379 - DNA, 25 bp, Mus musculus
agcttcagaatgcatccccagtgct

SEQ ID NO: 183380 - DNA, 25 bp, Mus musculus
agcttcagaatggatccccagtgct

SEQ ID NO: 183381 - DNA, 25 bp, Mus musculus
agcttcagagccaggcatcccttcc

SEQ ID NO: 183382 - DNA, 25 bp, Mus musculus
agcttcagagcctggcatcccttcc

SEQ ID NO: 183383 - DNA, 25 bp, Mus musculus
agcttcagccatatcaccttgtggg

SEQ ID NO: 183384 - DNA, 25 bp, Mus musculus
agcttcagccatttcaccttgtggg

SEQ ID NO: 183385 - DNA, 25 bp, Mus musculus
agcttcagcttacagctgtcttctg

SEQ ID NO: 183386 - DNA, 25 bp, Mus musculus
agcttcagcttagagctgtcttctg

SEQ ID NO: 183387 - DNA, 25 bp, Mus musculus
agcttcaggcaaagccaggcttcta

SEQ ID NO: 183388 - DNA, 25 bp, Mus musculus
agcttcaggcaatgccaggcttcta

SEQ ID NO: 183389 - DNA, 25 bp, Mus musculus
agcttcaggccgacctgctgaggtg

SEQ ID NO: 183390 - DNA, 25 bp, Mus musculus
agcttcaggccgtcctgctgaggtg

SEQ ID NO: 183391 - DNA, 25 bp, Mus musculus
agcttcagggatcgcgcctatcaga

SEQ ID NO: 183392 - DNA, 25 bp, Mus musculus
agcttcagggatggcgcctatcaga

SEQ ID NO: 183393 - DNA, 25 bp, Mus musculus
agcttcaggttccaagcaggcagta

SEQ ID NO: 183394 - DNA, 25 bp, Mus musculus
agcttcaggttcgaagcaggcagta

SEQ ID NO: 183395 - DNA, 25 bp, Mus musculus
agcttcagtcccacatgtgttgtgg

SEQ ID NO: 183396 - DNA, 25 bp, Mus musculus
agcttcagtccctcatgtgttgtgg

SEQ ID NO: 183397 - DNA, 25 bp, Mus musculus
agcttcagtctgatgctgtcaacgc

SEQ ID NO: 183398 - DNA, 25 bp, Mus musculus
agcttcagtctgttgctgtcaacgc

SEQ ID NO: 183399 - DNA, 25 bp, Mus musculus
agcttcagtgaaagggcgggcccct

SEQ ID NO: 183400 - DNA, 25 bp, Mus musculus
agcttcagtgaatgggcgggcccct

SEQ ID NO: 183401 - DNA, 25 bp, Mus musculus
agcttcagtgtcctggcttctgcat

SEQ ID NO: 183402 - DNA, 25 bp, Mus musculus
agcttcagtgtcgtggcttctgcat

SEQ ID NO: 183403 - DNA, 25 bp, Mus musculus
agcttcagttctaaacactctgttg

SEQ ID NO: 183404 - DNA, 25 bp, Mus musculus
agcttcagttcttaacactctgttg

SEQ ID NO: 183405 - DNA, 25 bp, Mus musculus
agcttcatacgcatcatggatgctt

SEQ ID NO: 183406 - DNA, 25 bp, Mus musculus
agcttcatacgcttcatggatgctt

SEQ ID NO: 183407 - DNA, 25 bp, Mus musculus
agcttcatataaaacctcatgctag

SEQ ID NO: 183408 - DNA, 25 bp, Mus musculus
agcttcatataatacctcatgctag

SEQ ID NO: 183409 - DNA, 25 bp, Mus musculus
agcttcatatcaagccatcggtgtt

SEQ ID NO: 183410 - DNA, 25 bp, Mus musculus
agcttcatatcatgccatcggtgtt

SEQ ID NO: 183411 - DNA, 25 bp, Mus musculus
agcttcatatctccagattcctctg

SEQ ID NO: 183412 - DNA, 25 bp, Mus musculus
agcttcatatctgcagattcctctg

SEQ ID NO: 183413 - DNA, 25 bp, Mus musculus
agcttcatcagccaatgggagcagg

SEQ ID NO: 183414 - DNA, 25 bp, Mus musculus
agcttcatcagcgaatgggagcagg

SEQ ID NO: 183415 - DNA, 25 bp, Mus musculus
agcttcatcatgaccagaagcttga

SEQ ID NO: 183416 - DNA, 25 bp, Mus musculus
agcttcatcatgtccagaagcttga

SEQ ID NO: 183417 - DNA, 25 bp, Mus musculus
agcttcatccagctgtcgtttgtac

SEQ ID NO: 183418 - DNA, 25 bp, Mus musculus
agcttcatccaggtgtcgtttgtac

SEQ ID NO: 183419 - DNA, 25 bp, Mus musculus
agcttcatccgcctttaggagttat

SEQ ID NO: 183420 - DNA, 25 bp, Mus musculus
agcttcatccgcgtttaggagttat

SEQ ID NO: 183421 - DNA, 25 bp, Mus musculus
agcttcatcgcacagcatttggaga

SEQ ID NO: 183422 - DNA, 25 bp, Mus musculus
agcttcatcgcagagcatttggaga

SEQ ID NO: 183423 - DNA, 25 bp, Mus musculus
agcttcatgcctcgacaagccatga

SEQ ID NO: 183424 - DNA, 25 bp, Mus musculus
agcttcatgcctggacaagccatga

SEQ ID NO: 183425 - DNA, 25 bp, Mus musculus
agcttcatgctgaaccgaagcccta

SEQ ID NO: 183426 - DNA, 25 bp, Mus musculus
agcttcatgctgtaccgaagcccta

SEQ ID NO: 183427 - DNA, 25 bp, Mus musculus
agcttcatggcacacctggctggtg

SEQ ID NO: 183428 - DNA, 25 bp, Mus musculus
agcttcatggcagacctggctggtg

SEQ ID NO: 183429 - DNA, 25 bp, Mus musculus
agcttcatgggactaactcatcgcc

SEQ ID NO: 183430 - DNA, 25 bp, Mus musculus
agcttcatgggagtaactcatcgcc

SEQ ID NO: 183431 - DNA, 25 bp, Mus musculus
agcttcatgtatacactcttggcag

SEQ ID NO: 183432 - DNA, 25 bp, Mus musculus
agcttcatgtattcactcttggcag

SEQ ID NO: 183433 - DNA, 25 bp, Mus musculus
agcttcattagtatcttgcagtatt

SEQ ID NO: 183434 - DNA, 25 bp, Mus musculus
agcttcattagtttcttgcagtatt

SEQ ID NO: 183435 - DNA, 25 bp, Mus musculus
agcttcattccacctttctgcacag

SEQ ID NO: 183436 - DNA, 25 bp, Mus musculus
agcttcattccagctttctgcacag

SEQ ID NO: 183437 - DNA, 25 bp, Mus musculus
agcttcattcttcagtatttgtgtg

SEQ ID NO: 183438 - DNA, 25 bp, Mus musculus
agcttcattcttgagtatttgtgtg

SEQ ID NO: 183439 - DNA, 25 bp, Mus musculus
agcttcatttctcttcgttatgcag

SEQ ID NO: 183440 - DNA, 25 bp, Mus musculus
agcttcatttctgttcgttatgcag

SEQ ID NO: 183441 - DNA, 25 bp, Mus musculus
agcttccaaatgctcaggttacaag

SEQ ID NO: 183442 - DNA, 25 bp, Mus musculus
agcttccaaatggtcaggttacaag

SEQ ID NO: 183443 - DNA, 25 bp, Mus musculus
agcttccaaccacagtacagtgtgt

SEQ ID NO: 183444 - DNA, 25 bp, Mus musculus
agcttccaaccagagtacagtgtgt

SEQ ID NO: 183445 - DNA, 25 bp, Mus musculus
agcttccaagctcaggactaacttg

SEQ ID NO: 183446 - DNA, 25 bp, Mus musculus
agcttccaagctgaggactaacttg

SEQ ID NO: 183447 - DNA, 25 bp, Mus musculus
agcttccaaggcatttgtgtacaca

SEQ ID NO: 183448 - DNA, 25 bp, Mus musculus
agcttccaaggcttttgtgtacaca

SEQ ID NO: 183449 - DNA, 25 bp, Mus musculus
agcttccacacaagatacccatatt

SEQ ID NO: 183450 - DNA, 25 bp, Mus musculus
agcttccacacatgatacccatatt

SEQ ID NO: 183451 - DNA, 25 bp, Mus musculus
agcttccacagacaaattatgcact

SEQ ID NO: 183452 - DNA, 25 bp, Mus musculus
agcttccacagagaaattatgcact

SEQ ID NO: 183453 - DNA, 25 bp, Mus musculus
agcttccacagcaaagtggctggag

SEQ ID NO: 183454 - DNA, 25 bp, Mus musculus
agcttccacagctaagtggctggag

SEQ ID NO: 183455 - DNA, 25 bp, Mus musculus
agcttccacctaaacttccaagtag

SEQ ID NO: 183456 - DNA, 25 bp, Mus musculus
agcttccacctatacttccaagtag

SEQ ID NO: 183457 - DNA, 25 bp, Mus musculus
agcttccacctcatctgattaaggg

SEQ ID NO: 183458 - DNA, 25 bp, Mus musculus
agcttccacctcttctgattaaggg

SEQ ID NO: 183459 - DNA, 25 bp, Mus musculus
agcttccacgatctgacctttcaag

SEQ ID NO: 183460 - DNA, 25 bp, Mus musculus
agcttccacgatgtgacctttcaag

SEQ ID NO: 183461 - DNA, 25 bp, Mus musculus
agcttccagaaaccccgtcggatat

SEQ ID NO: 183462 - DNA, 25 bp, Mus musculus
agcttccagaaagcccgtcggatat

SEQ ID NO: 183463 - DNA, 25 bp, Mus musculus
agcttccagataaccacattcatgc

SEQ ID NO: 183464 - DNA, 25 bp, Mus musculus
agcttccagatatccacattcatgc

SEQ ID NO: 183465 - DNA, 25 bp, Mus musculus
agcttccagatcacactagaaatca

SEQ ID NO: 183466 - DNA, 25 bp, Mus musculus
agcttccagatctcactagaaatca

SEQ ID NO: 183467 - DNA, 25 bp, Mus musculus
agcttccagattattcccttgcctc

SEQ ID NO: 183468 - DNA, 25 bp, Mus musculus
agcttccagatttttcccttgcctc

SEQ ID NO: 183469 - DNA, 25 bp, Mus musculus
agcttccagctgaagacgcgcagtg

SEQ ID NO: 183470 - DNA, 25 bp, Mus musculus
agcttccagctgtagacgcgcagtg

SEQ ID NO: 183471 - DNA, 25 bp, Mus musculus
agcttccagcttagacaacagagtc

SEQ ID NO: 183472 - DNA, 25 bp, Mus musculus
agcttccagctttgacaacagagtc

SEQ ID NO: 183473 - DNA, 25 bp, Mus musculus
agcttccaggatcactaccatgaaa

SEQ ID NO: 183474 - DNA, 25 bp, Mus musculus
agcttccaggatgactaccatgaaa

SEQ ID NO: 183475 - DNA, 25 bp, Mus musculus
agcttccaggcaatctctattttat

SEQ ID NO: 183476 - DNA, 25 bp, Mus musculus
agcttccaggcacaggctagcccga

SEQ ID NO: 183477 - DNA, 25 bp, Mus musculus
agcttccaggcagaggctagcccga

SEQ ID NO: 183478 - DNA, 25 bp, Mus musculus
agcttccaggcattctctattttat

SEQ ID NO: 183479 - DNA, 25 bp, Mus musculus
agcttccaggtgacatccctaagaa

SEQ ID NO: 183480 - DNA, 25 bp, Mus musculus
agcttccaggtgtcatccctaagaa

SEQ ID NO: 183481 - DNA, 25 bp, Mus musculus
agcttccatcatatctcttagtata

SEQ ID NO: 183482 - DNA, 25 bp, Mus musculus
agcttccatcatttctcttagtata

SEQ ID NO: 183483 - DNA, 25 bp, Mus musculus
agcttccatgcccatggataccagg

SEQ ID NO: 183484 - DNA, 25 bp, Mus musculus
agcttccatgccgatggataccagg

SEQ ID NO: 183485 - DNA, 25 bp, Mus musculus
agcttccatggactctacgtggtcg

SEQ ID NO: 183486 - DNA, 25 bp, Mus musculus
agcttccatggagtctacgtggtcg

SEQ ID NO: 183487 - DNA, 25 bp, Mus musculus
agcttccattccagtaactagactg

SEQ ID NO: 183488 - DNA, 25 bp, Mus musculus
agcttccattcctgtaactagactg

SEQ ID NO: 183489 - DNA, 25 bp, Mus musculus
agcttcccaatgagtaactggtagt

SEQ ID NO: 183490 - DNA, 25 bp, Mus musculus
agcttcccaatgtgtaactggtagt

SEQ ID NO: 183491 - DNA, 25 bp, Mus musculus
agcttcccacagattgtaacactcc

SEQ ID NO: 183492 - DNA, 25 bp, Mus musculus
agcttcccacagtttgtaacactcc

SEQ ID NO: 183493 - DNA, 25 bp, Mus musculus
agcttcccacatattcagtaccaaa

SEQ ID NO: 183494 - DNA, 25 bp, Mus musculus
agcttcccacattttcagtaccaaa

SEQ ID NO: 183495 - DNA, 25 bp, Mus musculus
agcttcccagtcactcaaagatgct

SEQ ID NO: 183496 - DNA, 25 bp, Mus musculus
agcttcccagtctctcaaagatgct

SEQ ID NO: 183497 - DNA, 25 bp, Mus musculus
agcttcccatcaaaactgcacttca

SEQ ID NO: 183498 - DNA, 25 bp, Mus musculus
agcttcccatcataactgcacttca

SEQ ID NO: 183499 - DNA, 25 bp, Mus musculus
agcttccccactcatctatgtagca

SEQ ID NO: 183500 - DNA, 25 bp, Mus musculus
agcttccccactgatctatgtagca

SEQ ID NO: 183501 - DNA, 25 bp, Mus musculus
agcttccccataagtcctagtgcaa

SEQ ID NO: 183502 - DNA, 25 bp, Mus musculus
agcttccccatatgtcctagtgcaa

SEQ ID NO: 183503 - DNA, 25 bp, Mus musculus
agcttccccatgagcaccatggtgt

SEQ ID NO: 183504 - DNA, 25 bp, Mus musculus
agcttccccatgtgcaccatggtgt

SEQ ID NO: 183505 - DNA, 25 bp, Mus musculus
agcttccccattagaattcaaccga

SEQ ID NO: 183506 - DNA, 25 bp, Mus musculus
agcttccccatttgaattcaaccga

SEQ ID NO: 183507 - DNA, 25 bp, Mus musculus
agcttcccctagcatgcttttaact

SEQ ID NO: 183508 - DNA, 25 bp, Mus musculus
agcttcccctaggatgcttttaact

SEQ ID NO: 183509 - DNA, 25 bp, Mus musculus
agcttcccctgaaggtagactgtga

SEQ ID NO: 183510 - DNA, 25 bp, Mus musculus
agcttcccctgatggtagactgtga

SEQ ID NO: 183511 - DNA, 25 bp, Mus musculus
agcttcccctttcatgggccaggga

SEQ ID NO: 183512 - DNA, 25 bp, Mus musculus
agcttcccctttccagggatctgtg

SEQ ID NO: 183513 - DNA, 25 bp, Mus musculus
agcttcccctttgatgggccaggga

SEQ ID NO: 183514 - DNA, 25 bp, Mus musculus
agcttcccctttgcagggatctgtg

SEQ ID NO: 183515 - DNA, 25 bp, Mus musculus
agcttcccgaagctcttaggacatg

SEQ ID NO: 183516 - DNA, 25 bp, Mus musculus
agcttcccgaaggtcttaggacatg

SEQ ID NO: 183517 - DNA, 25 bp, Mus musculus
agcttcccgcgaactccggagatta

SEQ ID NO: 183518 - DNA, 25 bp, Mus musculus
agcttcccgcgatctccggagatta

SEQ ID NO: 183519 - DNA, 25 bp, Mus musculus
agcttcccggttatgtgattctgaa

SEQ ID NO: 183520 - DNA, 25 bp, Mus musculus
agcttcccggttttgtgattctgaa

SEQ ID NO: 183521 - DNA, 25 bp, Mus musculus
agcttccctccaagttggtcgatga

SEQ ID NO: 183522 - DNA, 25 bp, Mus musculus
agcttccctccatgttggtcgatga

SEQ ID NO: 183523 - DNA, 25 bp, Mus musculus
agcttccctcccactgtaggctgtt

SEQ ID NO: 183524 - DNA, 25 bp, Mus musculus
agcttccctccctctgtaggctgtt

SEQ ID NO: 183525 - DNA, 25 bp, Mus musculus
agcttccctgagcagatctcgaata

SEQ ID NO: 183526 - DNA, 25 bp, Mus musculus
agcttccctgaggagatctcgaata

SEQ ID NO: 183527 - DNA, 25 bp, Mus musculus
agcttccctggaacccattactaat

SEQ ID NO: 183528 - DNA, 25 bp, Mus musculus
agcttccctggatcccattactaat

SEQ ID NO: 183529 - DNA, 25 bp, Mus musculus
agcttccctgttaccagaattgaag

SEQ ID NO: 183530 - DNA, 25 bp, Mus musculus
agcttccctgtttccagaattgaag

SEQ ID NO: 183531 - DNA, 25 bp, Mus musculus
agcttcccttccaagcaatgaggtc

SEQ ID NO: 183532 - DNA, 25 bp, Mus musculus
agcttcccttcctagcaatgaggtc

SEQ ID NO: 183533 - DNA, 25 bp, Mus musculus
agcttcccttttcatggcagtcgga

SEQ ID NO: 183534 - DNA, 25 bp, Mus musculus
agcttcccttttgatggcagtcgga

SEQ ID NO: 183535 - DNA, 25 bp, Mus musculus
agcttccgcgaactgccaagggaca

SEQ ID NO: 183536 - DNA, 25 bp, Mus musculus
agcttccgcgaagtgccaagggaca

SEQ ID NO: 183537 - DNA, 25 bp, Mus musculus
agcttccgctgtctgtcctttgaat

SEQ ID NO: 183538 - DNA, 25 bp, Mus musculus
agcttccgctgtgtgtcctttgaat

SEQ ID NO: 183539 - DNA, 25 bp, Mus musculus
agcttccgggttaccacagactggc

SEQ ID NO: 183540 - DNA, 25 bp, Mus musculus
agcttccgggtttccacagactggc

SEQ ID NO: 183541 - DNA, 25 bp, Mus musculus
agcttccgtgatcctctttatgaaa

SEQ ID NO: 183542 - DNA, 25 bp, Mus musculus
agcttccgtgatgctctttatgaaa

SEQ ID NO: 183543 - DNA, 25 bp, Mus musculus
agcttccgtgtcaagtcagccagag

SEQ ID NO: 183544 - DNA, 25 bp, Mus musculus
agcttccgtgtctagtcagccagag

SEQ ID NO: 183545 - DNA, 25 bp, Mus musculus
agcttcctaacgagattctcctaag

SEQ ID NO: 183546 - DNA, 25 bp, Mus musculus
agcttcctaacgtgattctcctaag

SEQ ID NO: 183547 - DNA, 25 bp, Mus musculus
agcttcctaagacattcctggtgag

SEQ ID NO: 183548 - DNA, 25 bp, Mus musculus
agcttcctaagagattcctggtgag

SEQ ID NO: 183549 - DNA, 25 bp, Mus musculus
agcttcctaagtctgaacggtgtca

SEQ ID NO: 183550 - DNA, 25 bp, Mus musculus
agcttcctaagtgtgaacggtgtca

SEQ ID NO: 183551 - DNA, 25 bp, Mus musculus
agcttcctatagactaatggccatg

SEQ ID NO: 183552 - DNA, 25 bp, Mus musculus
agcttcctatagactcagcacaggg

SEQ ID NO: 183553 - DNA, 25 bp, Mus musculus
agcttcctatagtctaatggccatg

SEQ ID NO: 183554 - DNA, 25 bp, Mus musculus
agcttcctatagtctcagcacaggg

SEQ ID NO: 183555 - DNA, 25 bp, Mus musculus
agcttcctatccatgcactggaatt

SEQ ID NO: 183556 - DNA, 25 bp, Mus musculus
agcttcctatccttgcactggaatt

SEQ ID NO: 183557 - DNA, 25 bp, Mus musculus
agcttcctatggcacagttgtctcc

SEQ ID NO: 183558 - DNA, 25 bp, Mus musculus
agcttcctatgggacagttgtctcc

SEQ ID NO: 183559 - DNA, 25 bp, Mus musculus
agcttcctcaaaatctggaactgag

SEQ ID NO: 183560 - DNA, 25 bp, Mus musculus
agcttcctcaaattctggaactgag

SEQ ID NO: 183561 - DNA, 25 bp, Mus musculus
agcttcctcaatagattgcatgttg

SEQ ID NO: 183562 - DNA, 25 bp, Mus musculus
agcttcctcaattgattgcatgttg

SEQ ID NO: 183563 - DNA, 25 bp, Mus musculus
agcttcctcacccaagtccagcagg

SEQ ID NO: 183564 - DNA, 25 bp, Mus musculus
agcttcctcaccgaagtccagcagg

SEQ ID NO: 183565 - DNA, 25 bp, Mus musculus
agcttcctcatgaacaggatgacca

SEQ ID NO: 183566 - DNA, 25 bp, Mus musculus
agcttcctcatgtacaggatgacca

SEQ ID NO: 183567 - DNA, 25 bp, Mus musculus
agcttcctcattcttcacattcagg

SEQ ID NO: 183568 - DNA, 25 bp, Mus musculus
agcttcctcattgttcacattcagg

SEQ ID NO: 183569 - DNA, 25 bp, Mus musculus
agcttcctccggctaagacttaggc

SEQ ID NO: 183570 - DNA, 25 bp, Mus musculus
agcttcctccgggtaagacttaggc

SEQ ID NO: 183571 - DNA, 25 bp, Mus musculus
agcttcctcctgattctgtgatctg

SEQ ID NO: 183572 - DNA, 25 bp, Mus musculus
agcttcctcctgctcaagaaggctg

SEQ ID NO: 183573 - DNA, 25 bp, Mus musculus
agcttcctcctggtcaagaaggctg

SEQ ID NO: 183574 - DNA, 25 bp, Mus musculus
agcttcctcctgtttctgtgatctg

SEQ ID NO: 183575 - DNA, 25 bp, Mus musculus
agcttcctcgtgctgatttatcata

SEQ ID NO: 183576 - DNA, 25 bp, Mus musculus
agcttcctcgtggtgatttatcata

SEQ ID NO: 183577 - DNA, 25 bp, Mus musculus
agcttcctctacactggctggactt

SEQ ID NO: 183578 - DNA, 25 bp, Mus musculus
agcttcctctactctggctggactt

SEQ ID NO: 183579 - DNA, 25 bp, Mus musculus
agcttcctctatccagggtcgctgt

SEQ ID NO: 183580 - DNA, 25 bp, Mus musculus
agcttcctctatgcagggtcgctgt

SEQ ID NO: 183581 - DNA, 25 bp, Mus musculus
agcttcctcttgctgtgtagggaca

SEQ ID NO: 183582 - DNA, 25 bp, Mus musculus
agcttcctcttggtgtgtagggaca

SEQ ID NO: 183583 - DNA, 25 bp, Mus musculus
agcttcctgagtattcccaaggatg

SEQ ID NO: 183584 - DNA, 25 bp, Mus musculus
agcttcctgagtcaagcctggcttt

SEQ ID NO: 183585 - DNA, 25 bp, Mus musculus
agcttcctgagtccaaaccaaatac

SEQ ID NO: 183586 - DNA, 25 bp, Mus musculus
agcttcctgagtgaagcctggcttt

SEQ ID NO: 183587 - DNA, 25 bp, Mus musculus
agcttcctgagtgcaaaccaaatac

SEQ ID NO: 183588 - DNA, 25 bp, Mus musculus
agcttcctgagttttcccaaggatg

SEQ ID NO: 183589 - DNA, 25 bp, Mus musculus
agcttcctgcgcagaggagacggac

SEQ ID NO: 183590 - DNA, 25 bp, Mus musculus
agcttcctgcgctgaggagacggac

SEQ ID NO: 183591 - DNA, 25 bp, Mus musculus
agcttcctggcacctagtcaccaga

SEQ ID NO: 183592 - DNA, 25 bp, Mus musculus
agcttcctggcagctagtcaccaga

SEQ ID NO: 183593 - DNA, 25 bp, Mus musculus
agcttcctggccatgtttgatagtt

SEQ ID NO: 183594 - DNA, 25 bp, Mus musculus
agcttcctggccttgtttgatagtt

SEQ ID NO: 183595 - DNA, 25 bp, Mus musculus
agcttcctggctccacaaaaactaa

SEQ ID NO: 183596 - DNA, 25 bp, Mus musculus
agcttcctggctgcacaaaaactaa

SEQ ID NO: 183597 - DNA, 25 bp, Mus musculus
agcttcctgggaaaattaccgttgt

SEQ ID NO: 183598 - DNA, 25 bp, Mus musculus
agcttcctgggataattaccgttgt

SEQ ID NO: 183599 - DNA, 25 bp, Mus musculus
agcttcctgggtacccatgaactca

SEQ ID NO: 183600 - DNA, 25 bp, Mus musculus
agcttcctgggttcccatgaactca

SEQ ID NO: 183601 - DNA, 25 bp, Mus musculus
agcttcctggtcatgggccgcaaag

SEQ ID NO: 183602 - DNA, 25 bp, Mus musculus
agcttcctggtcttgggccgcaaag

SEQ ID NO: 183603 - DNA, 25 bp, Mus musculus
agcttcctgtacagttttccgtgtt

SEQ ID NO: 183604 - DNA, 25 bp, Mus musculus
agcttcctgtactgttttccgtgtt

SEQ ID NO: 183605 - DNA, 25 bp, Mus musculus
agcttcctgtccactagttctgctg

SEQ ID NO: 183606 - DNA, 25 bp, Mus musculus
agcttcctgtcctctagttctgctg

SEQ ID NO: 183607 - DNA, 25 bp, Mus musculus
agcttcctgtctcctcatgaaggaa

SEQ ID NO: 183608 - DNA, 25 bp, Mus musculus
agcttcctgtctgctcatgaaggaa

SEQ ID NO: 183609 - DNA, 25 bp, Mus musculus
agcttcctgtggatcaagtcctgga

SEQ ID NO: 183610 - DNA, 25 bp, Mus musculus
agcttcctgtggttcaagtcctgga

SEQ ID NO: 183611 - DNA, 25 bp, Mus musculus
agcttccttagcctttgaggccaaa

SEQ ID NO: 183612 - DNA, 25 bp, Mus musculus
agcttccttagcgtttgaggccaaa

SEQ ID NO: 183613 - DNA, 25 bp, Mus musculus
agcttccttccacggccaggccact

SEQ ID NO: 183614 - DNA, 25 bp, Mus musculus
agcttccttccagggccaggccact

SEQ ID NO: 183615 - DNA, 25 bp, Mus musculus
agcttccttccccttgatagagatg

SEQ ID NO: 183616 - DNA, 25 bp, Mus musculus
agcttccttcccgttgatagagatg

SEQ ID NO: 183617 - DNA, 25 bp, Mus musculus
agcttccttctcatttagatgaaag

SEQ ID NO: 183618 - DNA, 25 bp, Mus musculus
agcttccttctcttttagatgaaag

SEQ ID NO: 183619 - DNA, 25 bp, Mus musculus
agcttccttctgcatgttacctaaa

SEQ ID NO: 183620 - DNA, 25 bp, Mus musculus
agcttccttctggatgttacctaaa

SEQ ID NO: 183621 - DNA, 25 bp, Mus musculus
agcttccttgatcatgtcattccag

SEQ ID NO: 183622 - DNA, 25 bp, Mus musculus
agcttccttgatcctaggcagcaaa

SEQ ID NO: 183623 - DNA, 25 bp, Mus musculus
agcttccttgatgatgtcattccag

SEQ ID NO: 183624 - DNA, 25 bp, Mus musculus
agcttccttgatgctaggcagcaaa

SEQ ID NO: 183625 - DNA, 25 bp, Mus musculus
agcttccttggaacccatctctgat

SEQ ID NO: 183626 - DNA, 25 bp, Mus musculus
agcttccttggatcccatctctgat

SEQ ID NO: 183627 - DNA, 25 bp, Mus musculus
agcttcctttctagtctcttcaggc

SEQ ID NO: 183628 - DNA, 25 bp, Mus musculus
agcttcctttcttgtctcttcaggc

SEQ ID NO: 183629 - DNA, 25 bp, Mus musculus
agcttcctttgtaacagttgccttg

SEQ ID NO: 183630 - DNA, 25 bp, Mus musculus
agcttcctttgttacagttgccttg

SEQ ID NO: 183631 - DNA, 25 bp, Mus musculus
agcttcctttttccactcttggtgt

SEQ ID NO: 183632 - DNA, 25 bp, Mus musculus
agcttcctttttgcactcttggtgt

SEQ ID NO: 183633 - DNA, 25 bp, Mus musculus
agcttcgactatcgcatcttccaga

SEQ ID NO: 183634 - DNA, 25 bp, Mus musculus
agcttcgactatggcatcttccaga

SEQ ID NO: 183635 - DNA, 25 bp, Mus musculus
agcttcgctcacagtggctgagcag

SEQ ID NO: 183636 - DNA, 25 bp, Mus musculus
agcttcgctcactgtggctgagcag

SEQ ID NO: 183637 - DNA, 25 bp, Mus musculus
agcttcgcttttcctaacatccaag

SEQ ID NO: 183638 - DNA, 25 bp, Mus musculus
agcttcgcttttgctaacatccaag

SEQ ID NO: 183639 - DNA, 25 bp, Mus musculus
agcttcggaagcactttggcatcaa

SEQ ID NO: 183640 - DNA, 25 bp, Mus musculus
agcttcggaagctctttggcatcaa

SEQ ID NO: 183641 - DNA, 25 bp, Mus musculus
agcttcgggccaaagttcagaatgg

SEQ ID NO: 183642 - DNA, 25 bp, Mus musculus
agcttcgggccatagttcagaatgg

SEQ ID NO: 183643 - DNA, 25 bp, Mus musculus
agcttcggtctgaatctgcagtatt

SEQ ID NO: 183644 - DNA, 25 bp, Mus musculus
agcttcggtctgtatctgcagtatt

SEQ ID NO: 183645 - DNA, 25 bp, Mus musculus
agcttcggtgggacagtactcctgg

SEQ ID NO: 183646 - DNA, 25 bp, Mus musculus
agcttcggtgggtcagtactcctgg

SEQ ID NO: 183647 - DNA, 25 bp, Mus musculus
agcttcgtaaagacccaggttggca

SEQ ID NO: 183648 - DNA, 25 bp, Mus musculus
agcttcgtaaagtcccaggttggca

SEQ ID NO: 183649 - DNA, 25 bp, Mus musculus
agcttcgtcggcactataagtacac

SEQ ID NO: 183650 - DNA, 25 bp, Mus musculus
agcttcgtcggctctataagtacac

SEQ ID NO: 183651 - DNA, 25 bp, Mus musculus
agcttcgtgctcagacacgtctcaa

SEQ ID NO: 183652 - DNA, 25 bp, Mus musculus
agcttcgtgctctgacacgtctcaa

SEQ ID NO: 183653 - DNA, 25 bp, Mus musculus
agcttcgtggccaatcagcggcggc

SEQ ID NO: 183654 - DNA, 25 bp, Mus musculus
agcttcgtggcctatcagcggcggc

SEQ ID NO: 183655 - DNA, 25 bp, Mus musculus
agcttcgttttcacatgaggttttc

SEQ ID NO: 183656 - DNA, 25 bp, Mus musculus
agcttcgttttctcatgaggttttc

SEQ ID NO: 183657 - DNA, 25 bp, Mus musculus
agcttctaaggaactgggtgcctca

SEQ ID NO: 183658 - DNA, 25 bp, Mus musculus
agcttctaaggatctgggtgcctca

SEQ ID NO: 183659 - DNA, 25 bp, Mus musculus
agcttctaagtgattcctgccatta

SEQ ID NO: 183660 - DNA, 25 bp, Mus musculus
agcttctaagtgtttcctgccatta

SEQ ID NO: 183661 - DNA, 25 bp, Mus musculus
agcttctacaagatgagtccctctt

SEQ ID NO: 183662 - DNA, 25 bp, Mus musculus
agcttctacaagttgagtccctctt

SEQ ID NO: 183663 - DNA, 25 bp, Mus musculus
agcttctacaggcacgggcacacga

SEQ ID NO: 183664 - DNA, 25 bp, Mus musculus
agcttctacagggacgggcacacga

SEQ ID NO: 183665 - DNA, 25 bp, Mus musculus
agcttctactaccaggctctgagtg

SEQ ID NO: 183666 - DNA, 25 bp, Mus musculus
agcttctactacgaggctctgagtg

SEQ ID NO: 183667 - DNA, 25 bp, Mus musculus
agcttctactgactgaactgctgat

SEQ ID NO: 183668 - DNA, 25 bp, Mus musculus
agcttctactgagtgaactgctgat

SEQ ID NO: 183669 - DNA, 25 bp, Mus musculus
agcttctactggatatggttgggtc

SEQ ID NO: 183670 - DNA, 25 bp, Mus musculus
agcttctactggttatggttgggtc

SEQ ID NO: 183671 - DNA, 25 bp, Mus musculus
agcttctacttcctggatgaccggc

SEQ ID NO: 183672 - DNA, 25 bp, Mus musculus
agcttctacttcgtggatgaccggc

SEQ ID NO: 183673 - DNA, 25 bp, Mus musculus
agcttctagaagagtcgcagcacgt

SEQ ID NO: 183674 - DNA, 25 bp, Mus musculus
agcttctagaagtgtcgcagcacgt

SEQ ID NO: 183675 - DNA, 25 bp, Mus musculus
agcttctagacaagcgggaacctgt

SEQ ID NO: 183676 - DNA, 25 bp, Mus musculus
agcttctagacatgcgggaacctgt

SEQ ID NO: 183677 - DNA, 25 bp, Mus musculus
agcttctagattctttgtattgtga

SEQ ID NO: 183678 - DNA, 25 bp, Mus musculus
agcttctagattgtttgtattgtga

SEQ ID NO: 183679 - DNA, 25 bp, Mus musculus
agcttctagcatcttccacggatgg

SEQ ID NO: 183680 - DNA, 25 bp, Mus musculus
agcttctagcatgttccacggatgg

SEQ ID NO: 183681 - DNA, 25 bp, Mus musculus
agcttctagtgtactccagcaattc

SEQ ID NO: 183682 - DNA, 25 bp, Mus musculus
agcttctagtgttctccagcaattc

SEQ ID NO: 183683 - DNA, 25 bp, Mus musculus
agcttctatatgatctccctttgtt

SEQ ID NO: 183684 - DNA, 25 bp, Mus musculus
agcttctatatgttctccctttgtt

SEQ ID NO: 183685 - DNA, 25 bp, Mus musculus
agcttctatccccagaatacagctg

SEQ ID NO: 183686 - DNA, 25 bp, Mus musculus
agcttctatcccgagaatacagctg

SEQ ID NO: 183687 - DNA, 25 bp, Mus musculus
agcttctatcctacttgtctttgta

SEQ ID NO: 183688 - DNA, 25 bp, Mus musculus
agcttctatccttcttgtctttgta

SEQ ID NO: 183689 - DNA, 25 bp, Mus musculus
agcttctatctcagcagacctatga

SEQ ID NO: 183690 - DNA, 25 bp, Mus musculus
agcttctatctctgcagacctatga

SEQ ID NO: 183691 - DNA, 25 bp, Mus musculus
agcttctatgaacgccaggctgtgt

SEQ ID NO: 183692 - DNA, 25 bp, Mus musculus
agcttctatgaaggccaggctgtgt

SEQ ID NO: 183693 - DNA, 25 bp, Mus musculus
agcttctatgttcgcctgggcacac

SEQ ID NO: 183694 - DNA, 25 bp, Mus musculus
agcttctatgttggcctgggcacac

SEQ ID NO: 183695 - DNA, 25 bp, Mus musculus
agcttctattgtacttcccctattt

SEQ ID NO: 183696 - DNA, 25 bp, Mus musculus
agcttctattgttcttcccctattt

SEQ ID NO: 183697 - DNA, 25 bp, Mus musculus
agcttctcaaaacccatggaaagta

SEQ ID NO: 183698 - DNA, 25 bp, Mus musculus
agcttctcaaaactgcctgccacag

SEQ ID NO: 183699 - DNA, 25 bp, Mus musculus
agcttctcaaaagccatggaaagta

SEQ ID NO: 183700 - DNA, 25 bp, Mus musculus
agcttctcaaaagtgcctgccacag

SEQ ID NO: 183701 - DNA, 25 bp, Mus musculus
agcttctcaaagctgcggtgctcct

SEQ ID NO: 183702 - DNA, 25 bp, Mus musculus
agcttctcaaaggtgcggtgctcct

SEQ ID NO: 183703 - DNA, 25 bp, Mus musculus
agcttctcagacagctgcttttgtg

SEQ ID NO: 183704 - DNA, 25 bp, Mus musculus
agcttctcagacatttccactagtt

SEQ ID NO: 183705 - DNA, 25 bp, Mus musculus
agcttctcagactgctgcttttgtg

SEQ ID NO: 183706 - DNA, 25 bp, Mus musculus
agcttctcagacttttccactagtt

SEQ ID NO: 183707 - DNA, 25 bp, Mus musculus
agcttctcatcaacagcgccagatt

SEQ ID NO: 183708 - DNA, 25 bp, Mus musculus
agcttctcatcatcagcgccagatt

SEQ ID NO: 183709 - DNA, 25 bp, Mus musculus
agcttctcatggcacaatcccacag

SEQ ID NO: 183710 - DNA, 25 bp, Mus musculus
agcttctcatgggacaatcccacag

SEQ ID NO: 183711 - DNA, 25 bp, Mus musculus
agcttctccaagaagtctgtctcaa

SEQ ID NO: 183712 - DNA, 25 bp, Mus musculus
agcttctccaagtagtctgtctcaa

SEQ ID NO: 183713 - DNA, 25 bp, Mus musculus
agcttctccagcacagtgggccagg

SEQ ID NO: 183714 - DNA, 25 bp, Mus musculus
agcttctccagctcagtgggccagg

SEQ ID NO: 183715 - DNA, 25 bp, Mus musculus
agcttctcctcactgtagtaaagca

SEQ ID NO: 183716 - DNA, 25 bp, Mus musculus
agcttctcctcagtgtagtaaagca

SEQ ID NO: 183717 - DNA, 25 bp, Mus musculus
agcttctcctttagaggccttatta

SEQ ID NO: 183718 - DNA, 25 bp, Mus musculus
agcttctccttttgaggccttatta

SEQ ID NO: 183719 - DNA, 25 bp, Mus musculus
agcttctcggttcaaactcctgaag

SEQ ID NO: 183720 - DNA, 25 bp, Mus musculus
agcttctcggttgaaactcctgaag

SEQ ID NO: 183721 - DNA, 25 bp, Mus musculus
agcttctcgtcacctctggaggttg

SEQ ID NO: 183722 - DNA, 25 bp, Mus musculus
agcttctcgtcagctctggaggttg

SEQ ID NO: 183723 - DNA, 25 bp, Mus musculus
agcttctctcatcaggctgaggtca

SEQ ID NO: 183724 - DNA, 25 bp, Mus musculus
agcttctctcatgaggctgaggtca

SEQ ID NO: 183725 - DNA, 25 bp, Mus musculus
agcttctctccaccaaagatttcat

SEQ ID NO: 183726 - DNA, 25 bp, Mus musculus
agcttctctccagcaaagatttcat

SEQ ID NO: 183727 - DNA, 25 bp, Mus musculus
agcttctctccccagacatgaagaa

SEQ ID NO: 183728 - DNA, 25 bp, Mus musculus
agcttctctcccgagacatgaagaa

SEQ ID NO: 183729 - DNA, 25 bp, Mus musculus
agcttctctgcaaagtaacttccct

SEQ ID NO: 183730 - DNA, 25 bp, Mus musculus
agcttctctgcatagtaacttccct

SEQ ID NO: 183731 - DNA, 25 bp, Mus musculus
agcttctctgttaagatctgcctgc

SEQ ID NO: 183732 - DNA, 25 bp, Mus musculus
agcttctctgtttagatctgcctgc

SEQ ID NO: 183733 - DNA, 25 bp, Mus musculus
agcttctgaaacagtcaactctgtt

SEQ ID NO: 183734 - DNA, 25 bp, Mus musculus
agcttctgaaactgtcaactctgtt

SEQ ID NO: 183735 - DNA, 25 bp, Mus musculus
agcttctgaccaactaagggcggga

SEQ ID NO: 183736 - DNA, 25 bp, Mus musculus
agcttctgaccatctaagggcggga

SEQ ID NO: 183737 - DNA, 25 bp, Mus musculus
agcttctgagaactcctaccagtga

SEQ ID NO: 183738 - DNA, 25 bp, Mus musculus
agcttctgagaagtcctaccagtga

SEQ ID NO: 183739 - DNA, 25 bp, Mus musculus
agcttctgcattaaataggttagaa

SEQ ID NO: 183740 - DNA, 25 bp, Mus musculus
agcttctgcatttaataggttagaa

SEQ ID NO: 183741 - DNA, 25 bp, Mus musculus
agcttctgccagactctgggttcag

SEQ ID NO: 183742 - DNA, 25 bp, Mus musculus
agcttctgccagtctctgggttcag

SEQ ID NO: 183743 - DNA, 25 bp, Mus musculus
agcttctgcgaccacatgttcaaca

SEQ ID NO: 183744 - DNA, 25 bp, Mus musculus
agcttctgcgacgacatgttcaaca

SEQ ID NO: 183745 - DNA, 25 bp, Mus musculus
agcttctgctccagtccgaagaaag

SEQ ID NO: 183746 - DNA, 25 bp, Mus musculus
agcttctgctcccagatctgtgatc

SEQ ID NO: 183747 - DNA, 25 bp, Mus musculus
agcttctgctccgagatctgtgatc

SEQ ID NO: 183748 - DNA, 25 bp, Mus musculus
agcttctgctcctgtccgaagaaag

SEQ ID NO: 183749 - DNA, 25 bp, Mus musculus
agcttctgcttaaaggcccgattcc

SEQ ID NO: 183750 - DNA, 25 bp, Mus musculus
agcttctgcttataggcccgattcc

SEQ ID NO: 183751 - DNA, 25 bp, Mus musculus
agcttctgctttatgccaacttaaa

SEQ ID NO: 183752 - DNA, 25 bp, Mus musculus
agcttctgctttttgccaacttaaa

SEQ ID NO: 183753 - DNA, 25 bp, Mus musculus
agcttctggaacatcccgttggtat

SEQ ID NO: 183754 - DNA, 25 bp, Mus musculus
agcttctggaacttcccgttggtat

SEQ ID NO: 183755 - DNA, 25 bp, Mus musculus
agcttctggaagacgctggtattga

SEQ ID NO: 183756 - DNA, 25 bp, Mus musculus
agcttctggaagtcgctggtattga

SEQ ID NO: 183757 - DNA, 25 bp, Mus musculus
agcttctggagtagctgctgagagt

SEQ ID NO: 183758 - DNA, 25 bp, Mus musculus
agcttctggagttgctgctgagagt

SEQ ID NO: 183759 - DNA, 25 bp, Mus musculus
agcttctgggatctgcttctgtgct

SEQ ID NO: 183760 - DNA, 25 bp, Mus musculus
agcttctgggatgtgcttctgtgct

SEQ ID NO: 183761 - DNA, 25 bp, Mus musculus
agcttctgggctatgaccgctgcga

SEQ ID NO: 183762 - DNA, 25 bp, Mus musculus
agcttctgggctttgaccgctgcga

SEQ ID NO: 183763 - DNA, 25 bp, Mus musculus
agcttctggtccaagcagagcgaaa

SEQ ID NO: 183764 - DNA, 25 bp, Mus musculus
agcttctggtcctagcagagcgaaa

SEQ ID NO: 183765 - DNA, 25 bp, Mus musculus
agcttctgtaagaggctgttcccaa

SEQ ID NO: 183766 - DNA, 25 bp, Mus musculus
agcttctgtaagtggctgttcccaa

SEQ ID NO: 183767 - DNA, 25 bp, Mus musculus
agcttctgtagcatcagccaggcaa

SEQ ID NO: 183768 - DNA, 25 bp, Mus musculus
agcttctgtagcttcagccaggcaa

SEQ ID NO: 183769 - DNA, 25 bp, Mus musculus
agcttctgtagtccatctgtgcaga

SEQ ID NO: 183770 - DNA, 25 bp, Mus musculus
agcttctgtagtgcatctgtgcaga

SEQ ID NO: 183771 - DNA, 25 bp, Mus musculus
agcttctgtcggacaacactgatga

SEQ ID NO: 183772 - DNA, 25 bp, Mus musculus
agcttctgtcggtcaacactgatga

SEQ ID NO: 183773 - DNA, 25 bp, Mus musculus
agcttctgtctacctgggttagtca

SEQ ID NO: 183774 - DNA, 25 bp, Mus musculus
agcttctgtctagctgggttagtca

SEQ ID NO: 183775 - DNA, 25 bp, Mus musculus
agcttctgtctcaagccacaggagc

SEQ ID NO: 183776 - DNA, 25 bp, Mus musculus
agcttctgtctctagccacaggagc

SEQ ID NO: 183777 - DNA, 25 bp, Mus musculus
agcttctgtgagcttcctagccata

SEQ ID NO: 183778 - DNA, 25 bp, Mus musculus
agcttctgtgaggttcctagccata

SEQ ID NO: 183779 - DNA, 25 bp, Mus musculus
agcttctgtgatagagaccctcggc

SEQ ID NO: 183780 - DNA, 25 bp, Mus musculus
agcttctgtgattgagaccctcggc

SEQ ID NO: 183781 - DNA, 25 bp, Mus musculus
agcttctgtgctatccagccacaag

SEQ ID NO: 183782 - DNA, 25 bp, Mus musculus
agcttctgtgctcagtgctgctgtg

SEQ ID NO: 183783 - DNA, 25 bp, Mus musculus
agcttctgtgctgagtgctgctgtg

SEQ ID NO: 183784 - DNA, 25 bp, Mus musculus
agcttctgtgctttccagccacaag

SEQ ID NO: 183785 - DNA, 25 bp, Mus musculus
agcttctgtggccaggtcacaccag

SEQ ID NO: 183786 - DNA, 25 bp, Mus musculus
agcttctgtggcgaggtcacaccag

SEQ ID NO: 183787 - DNA, 25 bp, Mus musculus
agcttctgtggtcagtttatatgac

SEQ ID NO: 183788 - DNA, 25 bp, Mus musculus
agcttctgtggtgagtttatatgac

SEQ ID NO: 183789 - DNA, 25 bp, Mus musculus
agcttctgttccctgttaacactag

SEQ ID NO: 183790 - DNA, 25 bp, Mus musculus
agcttctgttccgtgttaacactag

SEQ ID NO: 183791 - DNA, 25 bp, Mus musculus
agcttctgttgtctgtgcctcttca

SEQ ID NO: 183792 - DNA, 25 bp, Mus musculus
agcttctgttgtgtgtgcctcttca

SEQ ID NO: 183793 - DNA, 25 bp, Mus musculus
agcttctgtttcatcatggaccata

SEQ ID NO: 183794 - DNA, 25 bp, Mus musculus
agcttctgtttcttcatggaccata

SEQ ID NO: 183795 - DNA, 25 bp, Mus musculus
agcttcttaaaaacttactgttgga

SEQ ID NO: 183796 - DNA, 25 bp, Mus musculus
agcttcttaaaatcttactgttgga

SEQ ID NO: 183797 - DNA, 25 bp, Mus musculus
agcttcttaaatcactcttcaccct

SEQ ID NO: 183798 - DNA, 25 bp, Mus musculus
agcttcttaaatgactcttcaccct

SEQ ID NO: 183799 - DNA, 25 bp, Mus musculus
agcttcttaagaccctgtaggtcct

SEQ ID NO: 183800 - DNA, 25 bp, Mus musculus
agcttcttaagagcctgtaggtcct

SEQ ID NO: 183801 - DNA, 25 bp, Mus musculus
agcttcttactgacagagcttgcct

SEQ ID NO: 183802 - DNA, 25 bp, Mus musculus
agcttcttactgtcagagcttgcct

SEQ ID NO: 183803 - DNA, 25 bp, Mus musculus
agcttcttagctaaactagcccttg

SEQ ID NO: 183804 - DNA, 25 bp, Mus musculus
agcttcttagcttaactagcccttg

SEQ ID NO: 183805 - DNA, 25 bp, Mus musculus
agcttcttatgtcagtgtcaggaaa

SEQ ID NO: 183806 - DNA, 25 bp, Mus musculus
agcttcttatgtgagtgtcaggaaa

SEQ ID NO: 183807 - DNA, 25 bp, Mus musculus
agcttcttcagaattagggaaacat

SEQ ID NO: 183808 - DNA, 25 bp, Mus musculus
agcttcttcagatttagggaaacat

SEQ ID NO: 183809 - DNA, 25 bp, Mus musculus
agcttcttccaaccaagcatgagga

SEQ ID NO: 183810 - DNA, 25 bp, Mus musculus
agcttcttccaagcaagcatgagga

SEQ ID NO: 183811 - DNA, 25 bp, Mus musculus
agcttcttccccaggaatatcaagg

SEQ ID NO: 183812 - DNA, 25 bp, Mus musculus
agcttcttcccctggaatatcaagg

SEQ ID NO: 183813 - DNA, 25 bp, Mus musculus
agcttcttccctcgctagatatgta

SEQ ID NO: 183814 - DNA, 25 bp, Mus musculus
agcttcttccctggctagatatgta

SEQ ID NO: 183815 - DNA, 25 bp, Mus musculus
agcttcttcgaccactgggcttcag

SEQ ID NO: 183816 - DNA, 25 bp, Mus musculus
agcttcttcgacgactgggcttcag

SEQ ID NO: 183817 - DNA, 25 bp, Mus musculus
agcttcttgacaaggctgacaacaa

SEQ ID NO: 183818 - DNA, 25 bp, Mus musculus
agcttcttgacatggctgacaacaa

SEQ ID NO: 183819 - DNA, 25 bp, Mus musculus
agcttcttgccaacttttactacag

SEQ ID NO: 183820 - DNA, 25 bp, Mus musculus
agcttcttgccatcttttactacag

SEQ ID NO: 183821 - DNA, 25 bp, Mus musculus
agcttcttgcccagagttatattta

SEQ ID NO: 183822 - DNA, 25 bp, Mus musculus
agcttcttgccctgagttatattta

SEQ ID NO: 183823 - DNA, 25 bp, Mus musculus
agcttcttgcgtaattttgcaccta

SEQ ID NO: 183824 - DNA, 25 bp, Mus musculus
agcttcttgcgttattttgcaccta

SEQ ID NO: 183825 - DNA, 25 bp, Mus musculus
agcttcttgtctacccacaggagct

SEQ ID NO: 183826 - DNA, 25 bp, Mus musculus
agcttcttgtctactgcgaatgagg

SEQ ID NO: 183827 - DNA, 25 bp, Mus musculus
agcttcttgtcttcccacaggagct

SEQ ID NO: 183828 - DNA, 25 bp, Mus musculus
agcttcttgtcttctgcgaatgagg

SEQ ID NO: 183829 - DNA, 25 bp, Mus musculus
agcttcttgtggcacttccatctgt

SEQ ID NO: 183830 - DNA, 25 bp, Mus musculus
agcttcttgtgggacttccatctgt

SEQ ID NO: 183831 - DNA, 25 bp, Mus musculus
agcttcttgttcactggattcttaa

SEQ ID NO: 183832 - DNA, 25 bp, Mus musculus
agcttcttgttctctggattcttaa

SEQ ID NO: 183833 - DNA, 25 bp, Mus musculus
agcttcttgttgatctctgggatga

SEQ ID NO: 183834 - DNA, 25 bp, Mus musculus
agcttcttgttgttctctgggatga

SEQ ID NO: 183835 - DNA, 25 bp, Mus musculus
agcttctttaagagtcctgtgttct

SEQ ID NO: 183836 - DNA, 25 bp, Mus musculus
agcttctttaagtgtcctgtgttct

SEQ ID NO: 183837 - DNA, 25 bp, Mus musculus
agcttctttataacgagtcactccc

SEQ ID NO: 183838 - DNA, 25 bp, Mus musculus
agcttctttatatcgagtcactccc

SEQ ID NO: 183839 - DNA, 25 bp, Mus musculus
agcttctttatcaggctctgcactt

SEQ ID NO: 183840 - DNA, 25 bp, Mus musculus
agcttctttatctggctctgcactt

SEQ ID NO: 183841 - DNA, 25 bp, Mus musculus
agcttctttcccagtggcttaggga

SEQ ID NO: 183842 - DNA, 25 bp, Mus musculus
agcttctttccctgtggcttaggga

SEQ ID NO: 183843 - DNA, 25 bp, Mus musculus
agcttctttttcaattgtccttctg

SEQ ID NO: 183844 - DNA, 25 bp, Mus musculus
agcttctttttctattgtccttctg

SEQ ID NO: 183845 - DNA, 25 bp, Mus musculus
agcttctttttgagcctctgttctc

SEQ ID NO: 183846 - DNA, 25 bp, Mus musculus
agcttctttttgtgcctctgttctc

SEQ ID NO: 183847 - DNA, 25 bp, Mus musculus
agcttgaaatctcctgtggtcactt

SEQ ID NO: 183848 - DNA, 25 bp, Mus musculus
agcttgaaatctgctgtggtcactt

SEQ ID NO: 183849 - DNA, 25 bp, Mus musculus
agcttgaagttaaggaggccacgcc

SEQ ID NO: 183850 - DNA, 25 bp, Mus musculus
agcttgaagttatggaggccacgcc

SEQ ID NO: 183851 - DNA, 25 bp, Mus musculus
agcttgaatttgatattcctcttta

SEQ ID NO: 183852 - DNA, 25 bp, Mus musculus
agcttgaatttgttattcctcttta

SEQ ID NO: 183853 - DNA, 25 bp, Mus musculus
agcttgacaattcccaccgtcagat

SEQ ID NO: 183854 - DNA, 25 bp, Mus musculus
agcttgacaattgccaccgtcagat

SEQ ID NO: 183855 - DNA, 25 bp, Mus musculus
agcttgacagcaacactggagtatg

SEQ ID NO: 183856 - DNA, 25 bp, Mus musculus
agcttgacagcatcactggagtatg

SEQ ID NO: 183857 - DNA, 25 bp, Mus musculus
agcttgacatggagatttccatgaa

SEQ ID NO: 183858 - DNA, 25 bp, Mus musculus
agcttgacatggtgatttccatgaa

SEQ ID NO: 183859 - DNA, 25 bp, Mus musculus
agcttgaccacaatctgtatcggcc

SEQ ID NO: 183860 - DNA, 25 bp, Mus musculus
agcttgaccacattctgtatcggcc

SEQ ID NO: 183861 - DNA, 25 bp, Mus musculus
agcttgacccttctagactttggca

SEQ ID NO: 183862 - DNA, 25 bp, Mus musculus
agcttgacccttgtagactttggca

SEQ ID NO: 183863 - DNA, 25 bp, Mus musculus
agcttgacggatcccatcaggaact

SEQ ID NO: 183864 - DNA, 25 bp, Mus musculus
agcttgacggatgccatcaggaact

SEQ ID NO: 183865 - DNA, 25 bp, Mus musculus
agcttgactacaacagaacacacag

SEQ ID NO: 183866 - DNA, 25 bp, Mus musculus
agcttgactacatcagaacacacag

SEQ ID NO: 183867 - DNA, 25 bp, Mus musculus
agcttgactactcgacacacactga

SEQ ID NO: 183868 - DNA, 25 bp, Mus musculus
agcttgactactggacacacactga

SEQ ID NO: 183869 - DNA, 25 bp, Mus musculus
agcttgactgctccctaactctgta

SEQ ID NO: 183870 - DNA, 25 bp, Mus musculus
agcttgactgctgcctaactctgta

SEQ ID NO: 183871 - DNA, 25 bp, Mus musculus
agcttgactttaaagccctgcctat

SEQ ID NO: 183872 - DNA, 25 bp, Mus musculus
agcttgactttatagccctgcctat

SEQ ID NO: 183873 - DNA, 25 bp, Mus musculus
agcttgagaaacactgttggcatca

SEQ ID NO: 183874 - DNA, 25 bp, Mus musculus
agcttgagaaactctgttggcatca

SEQ ID NO: 183875 - DNA, 25 bp, Mus musculus
agcttgagacacctaggatacggtt

SEQ ID NO: 183876 - DNA, 25 bp, Mus musculus
agcttgagacacgtaggatacggtt

SEQ ID NO: 183877 - DNA, 25 bp, Mus musculus
agcttgagagttactgataacccag

SEQ ID NO: 183878 - DNA, 25 bp, Mus musculus
agcttgagagtttctgataacccag

SEQ ID NO: 183879 - DNA, 25 bp, Mus musculus
agcttgagccctctgtataatttac

SEQ ID NO: 183880 - DNA, 25 bp, Mus musculus
agcttgagccctgtgtataatttac

SEQ ID NO: 183881 - DNA, 25 bp, Mus musculus
agcttgagctccatgcgtgattggt

SEQ ID NO: 183882 - DNA, 25 bp, Mus musculus
agcttgagctccttgcgtgattggt

SEQ ID NO: 183883 - DNA, 25 bp, Mus musculus
agcttgaggagcaggctggcccttt

SEQ ID NO: 183884 - DNA, 25 bp, Mus musculus
agcttgaggagctggctggcccttt

SEQ ID NO: 183885 - DNA, 25 bp, Mus musculus
agcttgagggcaacctaggctacaa

SEQ ID NO: 183886 - DNA, 25 bp, Mus musculus
agcttgagggcaatctggcctacat

SEQ ID NO: 183887 - DNA, 25 bp, Mus musculus
agcttgagggcatcctaggctacaa

SEQ ID NO: 183888 - DNA, 25 bp, Mus musculus
agcttgagggcattctggcctacat

SEQ ID NO: 183889 - DNA, 25 bp, Mus musculus
agcttgaggtccctgtgaatgtctc

SEQ ID NO: 183890 - DNA, 25 bp, Mus musculus
agcttgaggtccgtgtgaatgtctc

SEQ ID NO: 183891 - DNA, 25 bp, Mus musculus
agcttgagtcatcttctgtcctgtt

SEQ ID NO: 183892 - DNA, 25 bp, Mus musculus
agcttgagtcatgttctgtcctgtt

SEQ ID NO: 183893 - DNA, 25 bp, Mus musculus
agcttgagtcctccagtgaacacac

SEQ ID NO: 183894 - DNA, 25 bp, Mus musculus
agcttgagtcctgcagtgaacacac

SEQ ID NO: 183895 - DNA, 25 bp, Mus musculus
agcttgagtgggactgctccgctgt

SEQ ID NO: 183896 - DNA, 25 bp, Mus musculus
agcttgagtgggtctgctccgctgt

SEQ ID NO: 183897 - DNA, 25 bp, Mus musculus
agcttgatccctcagtggttcttga

SEQ ID NO: 183898 - DNA, 25 bp, Mus musculus
agcttgatccctgagtggttcttga

SEQ ID NO: 183899 - DNA, 25 bp, Mus musculus
agcttgatcctgatttgaatttttt

SEQ ID NO: 183900 - DNA, 25 bp, Mus musculus
agcttgatcctgttttgaatttttt

SEQ ID NO: 183901 - DNA, 25 bp, Mus musculus
agcttgatctgtaactccaggccag

SEQ ID NO: 183902 - DNA, 25 bp, Mus musculus
agcttgatctgttactccaggccag

SEQ ID NO: 183903 - DNA, 25 bp, Mus musculus
agcttgatctttatcctaagaagtg

SEQ ID NO: 183904 - DNA, 25 bp, Mus musculus
agcttgatctttttcctaagaagtg

SEQ ID NO: 183905 - DNA, 25 bp, Mus musculus
agcttgatgcggatggaccatctct

SEQ ID NO: 183906 - DNA, 25 bp, Mus musculus
agcttgatgcggttggaccatctct

SEQ ID NO: 183907 - DNA, 25 bp, Mus musculus
agcttgattagtactcacactttta

SEQ ID NO: 183908 - DNA, 25 bp, Mus musculus
agcttgattagttctcacactttta

SEQ ID NO: 183909 - DNA, 25 bp, Mus musculus
agcttgattcggcttcctctctgca

SEQ ID NO: 183910 - DNA, 25 bp, Mus musculus
agcttgattcgggttcctctctgca

SEQ ID NO: 183911 - DNA, 25 bp, Mus musculus
agcttgcaaccccaggagtgtgaat

SEQ ID NO: 183912 - DNA, 25 bp, Mus musculus
agcttgcaacccgaggagtgtgaat

SEQ ID NO: 183913 - DNA, 25 bp, Mus musculus
agcttgcactgtacttggcacgcag

SEQ ID NO: 183914 - DNA, 25 bp, Mus musculus
agcttgcactgtatctacttggtat

SEQ ID NO: 183915 - DNA, 25 bp, Mus musculus
agcttgcactgttcttggcacgcag

SEQ ID NO: 183916 - DNA, 25 bp, Mus musculus
agcttgcactgtttctacttggtat

SEQ ID NO: 183917 - DNA, 25 bp, Mus musculus
agcttgcagccaccatggaataata

SEQ ID NO: 183918 - DNA, 25 bp, Mus musculus
agcttgcagccagcatggaataata

SEQ ID NO: 183919 - DNA, 25 bp, Mus musculus
agcttgcaggtaatggctttttcca

SEQ ID NO: 183920 - DNA, 25 bp, Mus musculus
agcttgcaggtattggctttttcca

SEQ ID NO: 183921 - DNA, 25 bp, Mus musculus
agcttgcagtggctggccctatgca

SEQ ID NO: 183922 - DNA, 25 bp, Mus musculus
agcttgcagtgggtggccctatgca

SEQ ID NO: 183923 - DNA, 25 bp, Mus musculus
agcttgcatcacaggcaggcagcag

SEQ ID NO: 183924 - DNA, 25 bp, Mus musculus
agcttgcatcactggcaggcagcag

SEQ ID NO: 183925 - DNA, 25 bp, Mus musculus
agcttgcatctcattacagttttca

SEQ ID NO: 183926 - DNA, 25 bp, Mus musculus
agcttgcatctctttacagttttca

SEQ ID NO: 183927 - DNA, 25 bp, Mus musculus
agcttgcatgctctccctgaaagtg

SEQ ID NO: 183928 - DNA, 25 bp, Mus musculus
agcttgcatgctgtccctgaaagtg

SEQ ID NO: 183929 - DNA, 25 bp, Mus musculus
agcttgcatgtgaatcccggctaat

SEQ ID NO: 183930 - DNA, 25 bp, Mus musculus
agcttgcatgtgtatcccggctaat

SEQ ID NO: 183931 - DNA, 25 bp, Mus musculus
agcttgcattggcttcagatgatat

SEQ ID NO: 183932 - DNA, 25 bp, Mus musculus
agcttgcattgggttcagatgatat

SEQ ID NO: 183933 - DNA, 25 bp, Mus musculus
agcttgccaaccagccagatctata

SEQ ID NO: 183934 - DNA, 25 bp, Mus musculus
agcttgccaacctgccagatctata

SEQ ID NO: 183935 - DNA, 25 bp, Mus musculus
agcttgccagccacagagtacagaa

SEQ ID NO: 183936 - DNA, 25 bp, Mus musculus
agcttgccagcctcagagtacagaa

SEQ ID NO: 183937 - DNA, 25 bp, Mus musculus
agcttgccaggcctatatagtgtga

SEQ ID NO: 183938 - DNA, 25 bp, Mus musculus
agcttgccaggcgtatatagtgtga

SEQ ID NO: 183939 - DNA, 25 bp, Mus musculus
agcttgcccagtcctgagatgatgt

SEQ ID NO: 183940 - DNA, 25 bp, Mus musculus
agcttgcccagtgctgagatgatgt

SEQ ID NO: 183941 - DNA, 25 bp, Mus musculus
agcttgccccgaaagtggctcagga

SEQ ID NO: 183942 - DNA, 25 bp, Mus musculus
agcttgccccgaaggatgttaaaat

SEQ ID NO: 183943 - DNA, 25 bp, Mus musculus
agcttgccccgatagtggctcagga

SEQ ID NO: 183944 - DNA, 25 bp, Mus musculus
agcttgccccgatggatgttaaaat

SEQ ID NO: 183945 - DNA, 25 bp, Mus musculus
agcttgccctggacactaacaaacc

SEQ ID NO: 183946 - DNA, 25 bp, Mus musculus
agcttgccctggtcactaacaaacc

SEQ ID NO: 183947 - DNA, 25 bp, Mus musculus
agcttgcccttcagacctggtataa

SEQ ID NO: 183948 - DNA, 25 bp, Mus musculus
agcttgcccttctgacctggtataa

SEQ ID NO: 183949 - DNA, 25 bp, Mus musculus
agcttgccgaatccgctatgaacgg

SEQ ID NO: 183950 - DNA, 25 bp, Mus musculus
agcttgccgaatgcgctatgaacgg

SEQ ID NO: 183951 - DNA, 25 bp, Mus musculus
agcttgcctttgctaagtaaccctg

SEQ ID NO: 183952 - DNA, 25 bp, Mus musculus
agcttgcctttggtaagtaaccctg

SEQ ID NO: 183953 - DNA, 25 bp, Mus musculus
agcttgccttttcgtagactcattt

SEQ ID NO: 183954 - DNA, 25 bp, Mus musculus
agcttgccttttggtagactcattt

SEQ ID NO: 183955 - DNA, 25 bp, Mus musculus
agcttgcgctcacgtatgatggtgt

SEQ ID NO: 183956 - DNA, 25 bp, Mus musculus
agcttgcgctcaggtatgatggtgt

SEQ ID NO: 183957 - DNA, 25 bp, Mus musculus
agcttgcggcaacgaaactccacct

SEQ ID NO: 183958 - DNA, 25 bp, Mus musculus
agcttgcggcaaggaaactccacct

SEQ ID NO: 183959 - DNA, 25 bp, Mus musculus
agcttgcgttgaataagtccctgcc

SEQ ID NO: 183960 - DNA, 25 bp, Mus musculus
agcttgcgttgattaagtccctgcc

SEQ ID NO: 183961 - DNA, 25 bp, Mus musculus
agcttgctaaaaatacagcctccag

SEQ ID NO: 183962 - DNA, 25 bp, Mus musculus
agcttgctaaaattacagcctccag

SEQ ID NO: 183963 - DNA, 25 bp, Mus musculus
agcttgctaacaacctactctggaa

SEQ ID NO: 183964 - DNA, 25 bp, Mus musculus
agcttgctaacatcctactctggaa

SEQ ID NO: 183965 - DNA, 25 bp, Mus musculus
agcttgctagctatctatttcctta

SEQ ID NO: 183966 - DNA, 25 bp, Mus musculus
agcttgctagctttctatttcctta

SEQ ID NO: 183967 - DNA, 25 bp, Mus musculus
agcttgctatgcaggttccctaact

SEQ ID NO: 183968 - DNA, 25 bp, Mus musculus
agcttgctatgctggttccctaact

SEQ ID NO: 183969 - DNA, 25 bp, Mus musculus
agcttgctcaatcgagtcactcctg

SEQ ID NO: 183970 - DNA, 25 bp, Mus musculus
agcttgctcaatggagtcactcctg

SEQ ID NO: 183971 - DNA, 25 bp, Mus musculus
agcttgctcagactagtcactgtgc

SEQ ID NO: 183972 - DNA, 25 bp, Mus musculus
agcttgctcagagtagtcactgtgc

SEQ ID NO: 183973 - DNA, 25 bp, Mus musculus
agcttgctcattctgtttgatttgg

SEQ ID NO: 183974 - DNA, 25 bp, Mus musculus
agcttgctcattgtgtttgatttgg

SEQ ID NO: 183975 - DNA, 25 bp, Mus musculus
agcttgctcctgctagtgcattaca

SEQ ID NO: 183976 - DNA, 25 bp, Mus musculus
agcttgctcctggtagtgcattaca

SEQ ID NO: 183977 - DNA, 25 bp, Mus musculus
agcttgctccttaccattgtcttcc

SEQ ID NO: 183978 - DNA, 25 bp, Mus musculus
agcttgctcctttccattgtcttcc

SEQ ID NO: 183979 - DNA, 25 bp, Mus musculus
agcttgctcttgagcatgtttccaa

SEQ ID NO: 183980 - DNA, 25 bp, Mus musculus
agcttgctcttgtgcatgtttccaa

SEQ ID NO: 183981 - DNA, 25 bp, Mus musculus
agcttgctgcagaaaggcggctcca

SEQ ID NO: 183982 - DNA, 25 bp, Mus musculus
agcttgctgcagtaaggcggctcca

SEQ ID NO: 183983 - DNA, 25 bp, Mus musculus
agcttgctgcttctgccagttgacg

SEQ ID NO: 183984 - DNA, 25 bp, Mus musculus
agcttgctgcttgtgccagttgacg

SEQ ID NO: 183985 - DNA, 25 bp, Mus musculus
agcttgctggccacttgggaaagtg

SEQ ID NO: 183986 - DNA, 25 bp, Mus musculus
agcttgctggcctcttgggaaagtg

SEQ ID NO: 183987 - DNA, 25 bp, Mus musculus
agcttgctgtagatggttctcttct

SEQ ID NO: 183988 - DNA, 25 bp, Mus musculus
agcttgctgtagttggttctcttct

SEQ ID NO: 183989 - DNA, 25 bp, Mus musculus
agcttgctgtctccatgaacctctg

SEQ ID NO: 183990 - DNA, 25 bp, Mus musculus
agcttgctgtctgcatgaacctctg

SEQ ID NO: 183991 - DNA, 25 bp, Mus musculus
agcttgctgtggagaccccgtggct

SEQ ID NO: 183992 - DNA, 25 bp, Mus musculus
agcttgctgtggtgaccccgtggct

SEQ ID NO: 183993 - DNA, 25 bp, Mus musculus
agcttgctgttcatggaaacctccg

SEQ ID NO: 183994 - DNA, 25 bp, Mus musculus
agcttgctgttcttggaaacctccg

SEQ ID NO: 183995 - DNA, 25 bp, Mus musculus
agcttgcttattccttttctggcta

SEQ ID NO: 183996 - DNA, 25 bp, Mus musculus
agcttgcttattgcttttctggcta

SEQ ID NO: 183997 - DNA, 25 bp, Mus musculus
agcttgcttcttatggcactcagaa

SEQ ID NO: 183998 - DNA, 25 bp, Mus musculus
agcttgcttcttttggcactcagaa

SEQ ID NO: 183999 - DNA, 25 bp, Mus musculus
agcttgctttggacatgtcctcatg

SEQ ID NO: 184000 - DNA, 25 bp, Mus musculus
agcttgctttggtcatgtcctcatg

SEQ ID NO: 184001 - DNA, 25 bp, Mus musculus
agcttgcttttcactagtcgttgag

SEQ ID NO: 184002 - DNA, 25 bp, Mus musculus
agcttgcttttcacttgtgtcctgt

SEQ ID NO: 184003 - DNA, 25 bp, Mus musculus
agcttgcttttctctagtcgttgag

SEQ ID NO: 184004 - DNA, 25 bp, Mus musculus
agcttgcttttctcttgtgtcctgt

SEQ ID NO: 184005 - DNA, 25 bp, Mus musculus
agcttggaacggcttgctgttgcca

SEQ ID NO: 184006 - DNA, 25 bp, Mus musculus
agcttggaacgggttgctgttgcca

SEQ ID NO: 184007 - DNA, 25 bp, Mus musculus
agcttggaacttcgcagcagccttt

SEQ ID NO: 184008 - DNA, 25 bp, Mus musculus
agcttggaacttggcagcagccttt

SEQ ID NO: 184009 - DNA, 25 bp, Mus musculus
agcttggaattcacgaggactctca

SEQ ID NO: 184010 - DNA, 25 bp, Mus musculus
agcttggaattctcgaggactctca

SEQ ID NO: 184011 - DNA, 25 bp, Mus musculus
agcttggacaaaccctatctttcct

SEQ ID NO: 184012 - DNA, 25 bp, Mus musculus
agcttggacaaagcctatctttcct

SEQ ID NO: 184013 - DNA, 25 bp, Mus musculus
agcttggaccaaaccagactatttg

SEQ ID NO: 184014 - DNA, 25 bp, Mus musculus
agcttggaccaatccagactatttg

SEQ ID NO: 184015 - DNA, 25 bp, Mus musculus
agcttggaccacacattgccctttt

SEQ ID NO: 184016 - DNA, 25 bp, Mus musculus
agcttggaccactcattgccctttt

SEQ ID NO: 184017 - DNA, 25 bp, Mus musculus
agcttggacccaatcattaacctgc

SEQ ID NO: 184018 - DNA, 25 bp, Mus musculus
agcttggacccattcattaacctgc

SEQ ID NO: 184019 - DNA, 25 bp, Mus musculus
agcttggagagtacaccacgttcct

SEQ ID NO: 184020 - DNA, 25 bp, Mus musculus
agcttggagagttcaccacgttcct

SEQ ID NO: 184021 - DNA, 25 bp, Mus musculus
agcttggagcataggttcttgttag

SEQ ID NO: 184022 - DNA, 25 bp, Mus musculus
agcttggagcattggttcttgttag

SEQ ID NO: 184023 - DNA, 25 bp, Mus musculus
agcttggagctgacacactagcgca

SEQ ID NO: 184024 - DNA, 25 bp, Mus musculus
agcttggagctgtcacactagcgca

SEQ ID NO: 184025 - DNA, 25 bp, Mus musculus
agcttggaggaaaggcgagcaccac

SEQ ID NO: 184026 - DNA, 25 bp, Mus musculus
agcttggaggaatggcgagcaccac

SEQ ID NO: 184027 - DNA, 25 bp, Mus musculus
agcttggatattagctctgctgctt

SEQ ID NO: 184028 - DNA, 25 bp, Mus musculus
agcttggatatttgctctgctgctt

SEQ ID NO: 184029 - DNA, 25 bp, Mus musculus
agcttggatggcaagctgctgcttc

SEQ ID NO: 184030 - DNA, 25 bp, Mus musculus
agcttggatggctagctgctgcttc

SEQ ID NO: 184031 - DNA, 25 bp, Mus musculus
agcttggcaaaacccaaccctgttg

SEQ ID NO: 184032 - DNA, 25 bp, Mus musculus
agcttggcaaaagccaaccctgttg

SEQ ID NO: 184033 - DNA, 25 bp, Mus musculus
agcttggcaactcgtctgtattcct

SEQ ID NO: 184034 - DNA, 25 bp, Mus musculus
agcttggcaactggtctgtattcct

SEQ ID NO: 184035 - DNA, 25 bp, Mus musculus
agcttggcacctaccaacactcaga

SEQ ID NO: 184036 - DNA, 25 bp, Mus musculus
agcttggcaccttccaacactcaga

SEQ ID NO: 184037 - DNA, 25 bp, Mus musculus
agcttggcagccatcttctcatagg

SEQ ID NO: 184038 - DNA, 25 bp, Mus musculus
agcttggcagccttcttctcatagg

SEQ ID NO: 184039 - DNA, 25 bp, Mus musculus
agcttggcagggagcaggccctctt

SEQ ID NO: 184040 - DNA, 25 bp, Mus musculus
agcttggcagggtgcaggccctctt

SEQ ID NO: 184041 - DNA, 25 bp, Mus musculus
agcttggcatctccaaaaccgagtt

SEQ ID NO: 184042 - DNA, 25 bp, Mus musculus
agcttggcatctgcaaaaccgagtt

SEQ ID NO: 184043 - DNA, 25 bp, Mus musculus
agcttggcatttctacccatttgat

SEQ ID NO: 184044 - DNA, 25 bp, Mus musculus
agcttggcatttgtacccatttgat

SEQ ID NO: 184045 - DNA, 25 bp, Mus musculus
agcttggccccacgcacattctgct

SEQ ID NO: 184046 - DNA, 25 bp, Mus musculus
agcttggccccaggcacattctgct

SEQ ID NO: 184047 - DNA, 25 bp, Mus musculus
agcttggccctcacatgtgccagtt

SEQ ID NO: 184048 - DNA, 25 bp, Mus musculus
agcttggccctctcatgtgccagtt

SEQ ID NO: 184049 - DNA, 25 bp, Mus musculus
agcttggccgtaaggtgcagctcca

SEQ ID NO: 184050 - DNA, 25 bp, Mus musculus
agcttggccgtatggtgcagctcca

SEQ ID NO: 184051 - DNA, 25 bp, Mus musculus
agcttggcctacactgtggataaat

SEQ ID NO: 184052 - DNA, 25 bp, Mus musculus
agcttggcctactctgtggataaat

SEQ ID NO: 184053 - DNA, 25 bp, Mus musculus
agcttggctgcaatgtctttgtggt

SEQ ID NO: 184054 - DNA, 25 bp, Mus musculus
agcttggctgcattgtctttgtggt

SEQ ID NO: 184055 - DNA, 25 bp, Mus musculus
agcttggcttggctcaacataatgt

SEQ ID NO: 184056 - DNA, 25 bp, Mus musculus
agcttggcttgggtcaacataatgt

SEQ ID NO: 184057 - DNA, 25 bp, Mus musculus
agcttggctttgctctgattctaaa

SEQ ID NO: 184058 - DNA, 25 bp, Mus musculus
agcttggctttggtctgattctaaa

SEQ ID NO: 184059 - DNA, 25 bp, Mus musculus
agcttgggaactactccatccacat

SEQ ID NO: 184060 - DNA, 25 bp, Mus musculus
agcttgggaacttctccatccacat

SEQ ID NO: 184061 - DNA, 25 bp, Mus musculus
agcttgggaccacaggccatgtgat

SEQ ID NO: 184062 - DNA, 25 bp, Mus musculus
agcttgggaccagaggccatgtgat

SEQ ID NO: 184063 - DNA, 25 bp, Mus musculus
agcttgggagtcagtttagatcaaa

SEQ ID NO: 184064 - DNA, 25 bp, Mus musculus
agcttgggagtctgtttagatcaaa

SEQ ID NO: 184065 - DNA, 25 bp, Mus musculus
agcttgggcaaaacgcttaaccttc

SEQ ID NO: 184066 - DNA, 25 bp, Mus musculus
agcttgggcaaatcgcttaaccttc

SEQ ID NO: 184067 - DNA, 25 bp, Mus musculus
agcttgggcctgagacaatccacaa

SEQ ID NO: 184068 - DNA, 25 bp, Mus musculus
agcttgggcctgtgacaatccacaa

SEQ ID NO: 184069 - DNA, 25 bp, Mus musculus
agcttgggcgacactatccagacac

SEQ ID NO: 184070 - DNA, 25 bp, Mus musculus
agcttgggcgactctatccagacac

SEQ ID NO: 184071 - DNA, 25 bp, Mus musculus
agcttgggctaaaggacggaacaaa

SEQ ID NO: 184072 - DNA, 25 bp, Mus musculus
agcttgggctaatggacggaacaaa

SEQ ID NO: 184073 - DNA, 25 bp, Mus musculus
agcttgggctttacaacagggtcct

SEQ ID NO: 184074 - DNA, 25 bp, Mus musculus
agcttgggcttttcaacagggtcct

SEQ ID NO: 184075 - DNA, 25 bp, Mus musculus
agcttgggtcacattcgtatctgga

SEQ ID NO: 184076 - DNA, 25 bp, Mus musculus
agcttgggtcactttcgtatctgga

SEQ ID NO: 184077 - DNA, 25 bp, Mus musculus
agcttgggtcttcgcgcggcgcgaa

SEQ ID NO: 184078 - DNA, 25 bp, Mus musculus
agcttgggtcttggcgcggcgcgaa

SEQ ID NO: 184079 - DNA, 25 bp, Mus musculus
agcttggtaagaacactttcatcag

SEQ ID NO: 184080 - DNA, 25 bp, Mus musculus
agcttggtaagatcactttcatcag

SEQ ID NO: 184081 - DNA, 25 bp, Mus musculus
agcttggtactcctctgctaggaga

SEQ ID NO: 184082 - DNA, 25 bp, Mus musculus
agcttggtactcgtctgctaggaga

SEQ ID NO: 184083 - DNA, 25 bp, Mus musculus
agcttggtatatctgtgaggccttt

SEQ ID NO: 184084 - DNA, 25 bp, Mus musculus
agcttggtatatgtgtgaggccttt

SEQ ID NO: 184085 - DNA, 25 bp, Mus musculus
agcttggtctacacgaccgccaggg

SEQ ID NO: 184086 - DNA, 25 bp, Mus musculus
agcttggtctactcgaccgccaggg

SEQ ID NO: 184087 - DNA, 25 bp, Mus musculus
agcttggtctctcttggaagcacca

SEQ ID NO: 184088 - DNA, 25 bp, Mus musculus
agcttggtctctgttggaagcacca

SEQ ID NO: 184089 - DNA, 25 bp, Mus musculus
agcttggtcttcatgagggccccaa

SEQ ID NO: 184090 - DNA, 25 bp, Mus musculus
agcttggtcttcttgagggccccaa

SEQ ID NO: 184091 - DNA, 25 bp, Mus musculus
agcttggtgcaccatgaacctggtc

SEQ ID NO: 184092 - DNA, 25 bp, Mus musculus
agcttggtgcacgatgaacctggtc

SEQ ID NO: 184093 - DNA, 25 bp, Mus musculus
agcttggtgttaaatcatacagtgt

SEQ ID NO: 184094 - DNA, 25 bp, Mus musculus
agcttggtgttatatcatacagtgt

SEQ ID NO: 184095 - DNA, 25 bp, Mus musculus
agcttggttttcactggtgaatctc

SEQ ID NO: 184096 - DNA, 25 bp, Mus musculus
agcttggttttctctggtgaatctc

SEQ ID NO: 184097 - DNA, 25 bp, Mus musculus
agcttggttttgctactaaggaaca

SEQ ID NO: 184098 - DNA, 25 bp, Mus musculus
agcttggttttggtactaaggaaca

SEQ ID NO: 184099 - DNA, 25 bp, Mus musculus
agcttgtaacggctgttcatggtgc

SEQ ID NO: 184100 - DNA, 25 bp, Mus musculus
agcttgtaacgggtgttcatggtgc

SEQ ID NO: 184101 - DNA, 25 bp, Mus musculus
agcttgtaatttccctcatgatttg

SEQ ID NO: 184102 - DNA, 25 bp, Mus musculus
agcttgtaatttgcctcatgatttg

SEQ ID NO: 184103 - DNA, 25 bp, Mus musculus
agcttgtacagccttatgacagttt

SEQ ID NO: 184104 - DNA, 25 bp, Mus musculus
agcttgtacagcgttatgacagttt

SEQ ID NO: 184105 - DNA, 25 bp, Mus musculus
agcttgtactacacctatcgtgatc

SEQ ID NO: 184106 - DNA, 25 bp, Mus musculus
agcttgtactactcctatcgtgatc

SEQ ID NO: 184107 - DNA, 25 bp, Mus musculus
agcttgtactggcattcttgtctga

SEQ ID NO: 184108 - DNA, 25 bp, Mus musculus
agcttgtactgggattcttgtctga

SEQ ID NO: 184109 - DNA, 25 bp, Mus musculus
agcttgtagatcatgtgacttccct

SEQ ID NO: 184110 - DNA, 25 bp, Mus musculus
agcttgtagatcttgtgacttccct

SEQ ID NO: 184111 - DNA, 25 bp, Mus musculus
agcttgtatcgaagcgtccacaaga

SEQ ID NO: 184112 - DNA, 25 bp, Mus musculus
agcttgtatcgaagtctctttaata

SEQ ID NO: 184113 - DNA, 25 bp, Mus musculus
agcttgtatcgatgcgtccacaaga

SEQ ID NO: 184114 - DNA, 25 bp, Mus musculus
agcttgtatcgatgtctctttaata

SEQ ID NO: 184115 - DNA, 25 bp, Mus musculus
agcttgtatgcgaggactcctgcga

SEQ ID NO: 184116 - DNA, 25 bp, Mus musculus
agcttgtatgcgtggactcctgcga

SEQ ID NO: 184117 - DNA, 25 bp, Mus musculus
agcttgtcaactcgtacctgaagga

SEQ ID NO: 184118 - DNA, 25 bp, Mus musculus
agcttgtcaactggtacctgaagga

SEQ ID NO: 184119 - DNA, 25 bp, Mus musculus
agcttgtcagatacaccatgctact

SEQ ID NO: 184120 - DNA, 25 bp, Mus musculus
agcttgtcagattcaccatgctact

SEQ ID NO: 184121 - DNA, 25 bp, Mus musculus
agcttgtccaagagctccttatgtg

SEQ ID NO: 184122 - DNA, 25 bp, Mus musculus
agcttgtccaagtgctccttatgtg

SEQ ID NO: 184123 - DNA, 25 bp, Mus musculus
agcttgtccatgctggagttcgcac

SEQ ID NO: 184124 - DNA, 25 bp, Mus musculus
agcttgtccatggtggagttcgcac

SEQ ID NO: 184125 - DNA, 25 bp, Mus musculus
agcttgtccggaagattgcaaatac

SEQ ID NO: 184126 - DNA, 25 bp, Mus musculus
agcttgtccggatgattgcaaatac

SEQ ID NO: 184127 - DNA, 25 bp, Mus musculus
agcttgtctctactactggcgtgca

SEQ ID NO: 184128 - DNA, 25 bp, Mus musculus
agcttgtctctagtactggcgtgca

SEQ ID NO: 184129 - DNA, 25 bp, Mus musculus
agcttgtctctgctcccagatgtca

SEQ ID NO: 184130 - DNA, 25 bp, Mus musculus
agcttgtctctggtcccagatgtca

SEQ ID NO: 184131 - DNA, 25 bp, Mus musculus
agcttgtctgacatgcttgcttgtc

SEQ ID NO: 184132 - DNA, 25 bp, Mus musculus
agcttgtctgacattttggaagtat

SEQ ID NO: 184133 - DNA, 25 bp, Mus musculus
agcttgtctgacttgcttgcttgtc

SEQ ID NO: 184134 - DNA, 25 bp, Mus musculus
agcttgtctgactttttggaagtat

SEQ ID NO: 184135 - DNA, 25 bp, Mus musculus
agcttgtctgctcccaatgatttca

SEQ ID NO: 184136 - DNA, 25 bp, Mus musculus
agcttgtctgctgccaatgatttca

SEQ ID NO: 184137 - DNA, 25 bp, Mus musculus
agcttgtgacaactgcattatggaa

SEQ ID NO: 184138 - DNA, 25 bp, Mus musculus
agcttgtgacaagtgcattatggaa

SEQ ID NO: 184139 - DNA, 25 bp, Mus musculus
agcttgtgcacaatcatttttcgat

SEQ ID NO: 184140 - DNA, 25 bp, Mus musculus
agcttgtgcacattcatttttcgat

SEQ ID NO: 184141 - DNA, 25 bp, Mus musculus
agcttgtgcatgaggcaagccttga

SEQ ID NO: 184142 - DNA, 25 bp, Mus musculus
agcttgtgcatgtggcaagccttga

SEQ ID NO: 184143 - DNA, 25 bp, Mus musculus
agcttgtgccaactcagggctgtgt

SEQ ID NO: 184144 - DNA, 25 bp, Mus musculus
agcttgtgccaagtcagggctgtgt

SEQ ID NO: 184145 - DNA, 25 bp, Mus musculus
agcttgtgccccattgggtgtcgct

SEQ ID NO: 184146 - DNA, 25 bp, Mus musculus
agcttgtgcccctttgggtgtcgct

SEQ ID NO: 184147 - DNA, 25 bp, Mus musculus
agcttgtgccttcctgccaggatag

SEQ ID NO: 184148 - DNA, 25 bp, Mus musculus
agcttgtgccttgctgccaggatag

SEQ ID NO: 184149 - DNA, 25 bp, Mus musculus
agcttgtgctcaccgctgtaaacca

SEQ ID NO: 184150 - DNA, 25 bp, Mus musculus
agcttgtgctcagcgctgtaaacca

SEQ ID NO: 184151 - DNA, 25 bp, Mus musculus
agcttgtgcttgcaatgcaatttaa

SEQ ID NO: 184152 - DNA, 25 bp, Mus musculus
agcttgtgcttggaatgcaatttaa

SEQ ID NO: 184153 - DNA, 25 bp, Mus musculus
agcttgtggaaacacgcgccgcgct

SEQ ID NO: 184154 - DNA, 25 bp, Mus musculus
agcttgtggaaagacgcgccgcgct

SEQ ID NO: 184155 - DNA, 25 bp, Mus musculus
agcttgtggctaacttactgtgttc

SEQ ID NO: 184156 - DNA, 25 bp, Mus musculus
agcttgtggctatcttactgtgttc

SEQ ID NO: 184157 - DNA, 25 bp, Mus musculus
agcttgtgtaatattgtcaatttca

SEQ ID NO: 184158 - DNA, 25 bp, Mus musculus
agcttgtgtaattttgtcaatttca

SEQ ID NO: 184159 - DNA, 25 bp, Mus musculus
agcttgtgtattactctgtgatatt

SEQ ID NO: 184160 - DNA, 25 bp, Mus musculus
agcttgtgtatttctctgtgatatt

SEQ ID NO: 184161 - DNA, 25 bp, Mus musculus
agcttgttccagcattctgaggcag

SEQ ID NO: 184162 - DNA, 25 bp, Mus musculus
agcttgttccaggattctgaggcag

SEQ ID NO: 184163 - DNA, 25 bp, Mus musculus
agcttgttccctaggcaattgatca

SEQ ID NO: 184164 - DNA, 25 bp, Mus musculus
agcttgttcccttggcaattgatca

SEQ ID NO: 184165 - DNA, 25 bp, Mus musculus
agcttgttctacagaagggtcaccc

SEQ ID NO: 184166 - DNA, 25 bp, Mus musculus
agcttgttctactgaagggtcaccc

SEQ ID NO: 184167 - DNA, 25 bp, Mus musculus
agcttgttcttaatgtcttgggccc

SEQ ID NO: 184168 - DNA, 25 bp, Mus musculus
agcttgttcttattgtcttgggccc

SEQ ID NO: 184169 - DNA, 25 bp, Mus musculus
agcttgttgaagagtcctctgctcc

SEQ ID NO: 184170 - DNA, 25 bp, Mus musculus
agcttgttgaagtgtcctctgctcc

SEQ ID NO: 184171 - DNA, 25 bp, Mus musculus
agcttgttgactctcaccaggttca

SEQ ID NO: 184172 - DNA, 25 bp, Mus musculus
agcttgttgactgtcaccaggttca

SEQ ID NO: 184173 - DNA, 25 bp, Mus musculus
agcttgttgagcattctttgtgatc

SEQ ID NO: 184174 - DNA, 25 bp, Mus musculus
agcttgttgagctttctttgtgatc

SEQ ID NO: 184175 - DNA, 25 bp, Mus musculus
agcttgttgatcactgcactctgga

SEQ ID NO: 184176 - DNA, 25 bp, Mus musculus
agcttgttgatctctgcactctgga

SEQ ID NO: 184177 - DNA, 25 bp, Mus musculus
agcttgttgcatccttatctctgca

SEQ ID NO: 184178 - DNA, 25 bp, Mus musculus
agcttgttgcatgcttatctctgca

SEQ ID NO: 184179 - DNA, 25 bp, Mus musculus
agcttgttgctgagctcaggtagtt

SEQ ID NO: 184180 - DNA, 25 bp, Mus musculus
agcttgttgctgtgctcaggtagtt

SEQ ID NO: 184181 - DNA, 25 bp, Mus musculus
agcttgttgcttaacccagtattaa

SEQ ID NO: 184182 - DNA, 25 bp, Mus musculus
agcttgttgctttacccagtattaa

SEQ ID NO: 184183 - DNA, 25 bp, Mus musculus
agcttgttgggacttcattgtgtaa

SEQ ID NO: 184184 - DNA, 25 bp, Mus musculus
agcttgttgggagttcattgtgtaa

SEQ ID NO: 184185 - DNA, 25 bp, Mus musculus
agcttgtttacaagcttattccatg

SEQ ID NO: 184186 - DNA, 25 bp, Mus musculus
agcttgtttacatgcttattccatg

SEQ ID NO: 184187 - DNA, 25 bp, Mus musculus
agcttgtttcaaccggggagtgcca

SEQ ID NO: 184188 - DNA, 25 bp, Mus musculus
agcttgtttcaagcggggagtgcca

SEQ ID NO: 184189 - DNA, 25 bp, Mus musculus
agcttgttttctaaggcagggccta

SEQ ID NO: 184190 - DNA, 25 bp, Mus musculus
agcttgttttctctgctggcatgtg

SEQ ID NO: 184191 - DNA, 25 bp, Mus musculus
agcttgttttctgtgctggcatgtg

SEQ ID NO: 184192 - DNA, 25 bp, Mus musculus
agcttgttttcttaggcagggccta

SEQ ID NO: 184193 - DNA, 25 bp, Mus musculus
agctttaaaacaccaggcacagcct

SEQ ID NO: 184194 - DNA, 25 bp, Mus musculus
agctttaaaacagcaggcacagcct

SEQ ID NO: 184195 - DNA, 25 bp, Mus musculus
agctttaaacccaagtaattacatg

SEQ ID NO: 184196 - DNA, 25 bp, Mus musculus
agctttaaaccctagtaattacatg

SEQ ID NO: 184197 - DNA, 25 bp, Mus musculus
agctttaaactcctcatcctcgagg

SEQ ID NO: 184198 - DNA, 25 bp, Mus musculus
agctttaaactcgtcatcctcgagg

SEQ ID NO: 184199 - DNA, 25 bp, Mus musculus
agctttaaagtaacacctccatgga

SEQ ID NO: 184200 - DNA, 25 bp, Mus musculus
agctttaaagtatcacctccatgga

SEQ ID NO: 184201 - DNA, 25 bp, Mus musculus
agctttaacaggcttgccactccat

SEQ ID NO: 184202 - DNA, 25 bp, Mus musculus
agctttaacagggttgccactccat

SEQ ID NO: 184203 - DNA, 25 bp, Mus musculus
agctttaaccatctgatatccatag

SEQ ID NO: 184204 - DNA, 25 bp, Mus musculus
agctttaaccatgtgatatccatag

SEQ ID NO: 184205 - DNA, 25 bp, Mus musculus
agctttaacctgctggcaatggcga

SEQ ID NO: 184206 - DNA, 25 bp, Mus musculus
agctttaacctggtggcaatggcga

SEQ ID NO: 184207 - DNA, 25 bp, Mus musculus
agctttaactccacgggatcatggt

SEQ ID NO: 184208 - DNA, 25 bp, Mus musculus
agctttaactcctcgggatcatggt

SEQ ID NO: 184209 - DNA, 25 bp, Mus musculus
agctttaaggatagttcagttctct

SEQ ID NO: 184210 - DNA, 25 bp, Mus musculus
agctttaaggattgttcagttctct

SEQ ID NO: 184211 - DNA, 25 bp, Mus musculus
agctttaaggctagttggctttaat

SEQ ID NO: 184212 - DNA, 25 bp, Mus musculus
agctttaaggcttgttggctttaat

SEQ ID NO: 184213 - DNA, 25 bp, Mus musculus
agctttaatgcaattggtgtcctca

SEQ ID NO: 184214 - DNA, 25 bp, Mus musculus
agctttaatgcatttggtgtcctca

SEQ ID NO: 184215 - DNA, 25 bp, Mus musculus
agctttaattgccatgattcccctc

SEQ ID NO: 184216 - DNA, 25 bp, Mus musculus
agctttaattgcgatgattcccctc

SEQ ID NO: 184217 - DNA, 25 bp, Mus musculus
agctttacactccactggcttgttt

SEQ ID NO: 184218 - DNA, 25 bp, Mus musculus
agctttacactcgactggcttgttt

SEQ ID NO: 184219 - DNA, 25 bp, Mus musculus
agctttacagccatgaaaactattg

SEQ ID NO: 184220 - DNA, 25 bp, Mus musculus
agctttacagccttgaaaactattg

SEQ ID NO: 184221 - DNA, 25 bp, Mus musculus
agctttacagctacttatatggtac

SEQ ID NO: 184222 - DNA, 25 bp, Mus musculus
agctttacagcttcttatatggtac

SEQ ID NO: 184223 - DNA, 25 bp, Mus musculus
agctttacagtgcagcagcaaccca

SEQ ID NO: 184224 - DNA, 25 bp, Mus musculus
agctttacagtggagcagcaaccca

SEQ ID NO: 184225 - DNA, 25 bp, Mus musculus
agctttaccaagaaggaattcctgc

SEQ ID NO: 184226 - DNA, 25 bp, Mus musculus
agctttaccaagtaggaattcctgc

SEQ ID NO: 184227 - DNA, 25 bp, Mus musculus
agctttacccagaaatcttgctaaa

SEQ ID NO: 184228 - DNA, 25 bp, Mus musculus
agctttacccagtaatcttgctaaa

SEQ ID NO: 184229 - DNA, 25 bp, Mus musculus
agctttaccgtcatcactgttcagt

SEQ ID NO: 184230 - DNA, 25 bp, Mus musculus
agctttaccgtcttcactgttcagt

SEQ ID NO: 184231 - DNA, 25 bp, Mus musculus
agctttacctgcatattccacagca

SEQ ID NO: 184232 - DNA, 25 bp, Mus musculus
agctttacctgcttattccacagca

SEQ ID NO: 184233 - DNA, 25 bp, Mus musculus
agctttacttacattccttgtccta

SEQ ID NO: 184234 - DNA, 25 bp, Mus musculus
agctttacttactttccttgtccta

SEQ ID NO: 184235 - DNA, 25 bp, Mus musculus
agctttagacaacagcatgccttaa

SEQ ID NO: 184236 - DNA, 25 bp, Mus musculus
agctttagacaagagcatgccttaa

SEQ ID NO: 184237 - DNA, 25 bp, Mus musculus
agctttagacccagacacgtggatg

SEQ ID NO: 184238 - DNA, 25 bp, Mus musculus
agctttagaccctgacacgtggatg

SEQ ID NO: 184239 - DNA, 25 bp, Mus musculus
agctttagcttaccttgtcttggca

SEQ ID NO: 184240 - DNA, 25 bp, Mus musculus
agctttagcttagcttgtcttggca

SEQ ID NO: 184241 - DNA, 25 bp, Mus musculus
agctttagggcgaagcactattcca

SEQ ID NO: 184242 - DNA, 25 bp, Mus musculus
agctttagggcgtagcactattcca

SEQ ID NO: 184243 - DNA, 25 bp, Mus musculus
agctttagggtcacaatagtgtcac

SEQ ID NO: 184244 - DNA, 25 bp, Mus musculus
agctttagggtctcaatagtgtcac

SEQ ID NO: 184245 - DNA, 25 bp, Mus musculus
agctttaggtaccagttcatctcca

SEQ ID NO: 184246 - DNA, 25 bp, Mus musculus
agctttaggtaccatgttgctgaaa

SEQ ID NO: 184247 - DNA, 25 bp, Mus musculus
agctttaggtacgagttcatctcca

SEQ ID NO: 184248 - DNA, 25 bp, Mus musculus
agctttaggtacgatgttgctgaaa

SEQ ID NO: 184249 - DNA, 25 bp, Mus musculus
agctttaggtccaccagactcactt

SEQ ID NO: 184250 - DNA, 25 bp, Mus musculus
agctttaggtcctccagactcactt

SEQ ID NO: 184251 - DNA, 25 bp, Mus musculus
agctttagttaacctactccatggg

SEQ ID NO: 184252 - DNA, 25 bp, Mus musculus
agctttagttaagctactccatggg

SEQ ID NO: 184253 - DNA, 25 bp, Mus musculus
agctttagtttaactgtcttcctga

SEQ ID NO: 184254 - DNA, 25 bp, Mus musculus
agctttagtttatctgtcttcctga

SEQ ID NO: 184255 - DNA, 25 bp, Mus musculus
agctttataaatcggactgtgtgaa

SEQ ID NO: 184256 - DNA, 25 bp, Mus musculus
agctttataaatgggactgtgtgaa

SEQ ID NO: 184257 - DNA, 25 bp, Mus musculus
agctttatatgaaatacccttctaa

SEQ ID NO: 184258 - DNA, 25 bp, Mus musculus
agctttatatgatatacccttctaa

SEQ ID NO: 184259 - DNA, 25 bp, Mus musculus
agctttatcactaacaatatagaca

SEQ ID NO: 184260 - DNA, 25 bp, Mus musculus
agctttatcacttacaatatagaca

SEQ ID NO: 184261 - DNA, 25 bp, Mus musculus
agctttatggacctccacttcagac

SEQ ID NO: 184262 - DNA, 25 bp, Mus musculus
agctttatggacgtccacttcagac

SEQ ID NO: 184263 - DNA, 25 bp, Mus musculus
agctttatgttcatggagcttacgc

SEQ ID NO: 184264 - DNA, 25 bp, Mus musculus
agctttatgttcttggagcttacgc

SEQ ID NO: 184265 - DNA, 25 bp, Mus musculus
agctttattagccttgcatccactt

SEQ ID NO: 184266 - DNA, 25 bp, Mus musculus
agctttattagcgttgcatccactt

SEQ ID NO: 184267 - DNA, 25 bp, Mus musculus
agctttattccaaccttaaccatag

SEQ ID NO: 184268 - DNA, 25 bp, Mus musculus
agctttattccatccttaaccatag

SEQ ID NO: 184269 - DNA, 25 bp, Mus musculus
agctttattctgagtcccttctttt

SEQ ID NO: 184270 - DNA, 25 bp, Mus musculus
agctttattctgtgtcccttctttt

SEQ ID NO: 184271 - DNA, 25 bp, Mus musculus
agctttattcttaagtgctgcataa

SEQ ID NO: 184272 - DNA, 25 bp, Mus musculus
agctttattctttagtgctgcataa

SEQ ID NO: 184273 - DNA, 25 bp, Mus musculus
agctttattgggaagattcatgttc

SEQ ID NO: 184274 - DNA, 25 bp, Mus musculus
agctttattgggtagattcatgttc

SEQ ID NO: 184275 - DNA, 25 bp, Mus musculus
agctttcaaaaactccattactagg

SEQ ID NO: 184276 - DNA, 25 bp, Mus musculus
agctttcaaaaagtccattactagg

SEQ ID NO: 184277 - DNA, 25 bp, Mus musculus
agctttcaagcaagaatccatcctt

SEQ ID NO: 184278 - DNA, 25 bp, Mus musculus
agctttcaagcatgaatccatcctt

SEQ ID NO: 184279 - DNA, 25 bp, Mus musculus
agctttcacatcatgggagtttcac

SEQ ID NO: 184280 - DNA, 25 bp, Mus musculus
agctttcacatcttgggagtttcac

SEQ ID NO: 184281 - DNA, 25 bp, Mus musculus
agctttcacttgctcacacagggac

SEQ ID NO: 184282 - DNA, 25 bp, Mus musculus
agctttcacttggtcacacagggac

SEQ ID NO: 184283 - DNA, 25 bp, Mus musculus
agctttcagaaaccctgcactgcct

SEQ ID NO: 184284 - DNA, 25 bp, Mus musculus
agctttcagaaagcctgcactgcct

SEQ ID NO: 184285 - DNA, 25 bp, Mus musculus
agctttcagaatactggtgcccaga

SEQ ID NO: 184286 - DNA, 25 bp, Mus musculus
agctttcagaatcgtgttccctgcc

SEQ ID NO: 184287 - DNA, 25 bp, Mus musculus
agctttcagaatggtgttccctgcc

SEQ ID NO: 184288 - DNA, 25 bp, Mus musculus
agctttcagaattctggtgcccaga

SEQ ID NO: 184289 - DNA, 25 bp, Mus musculus
agctttcagagcagttgcggtacta

SEQ ID NO: 184290 - DNA, 25 bp, Mus musculus
agctttcagagctgttgcggtacta

SEQ ID NO: 184291 - DNA, 25 bp, Mus musculus
agctttcaggaaaggtcactaatac

SEQ ID NO: 184292 - DNA, 25 bp, Mus musculus
agctttcaggaatggtcactaatac

SEQ ID NO: 184293 - DNA, 25 bp, Mus musculus
agctttcaggatacagttctcgcct

SEQ ID NO: 184294 - DNA, 25 bp, Mus musculus
agctttcaggattcagttctcgcct

SEQ ID NO: 184295 - DNA, 25 bp, Mus musculus
agctttcaggccatagtgtcgactt

SEQ ID NO: 184296 - DNA, 25 bp, Mus musculus
agctttcaggccttagtgtcgactt

SEQ ID NO: 184297 - DNA, 25 bp, Mus musculus
agctttcaggtgactgctataagtc

SEQ ID NO: 184298 - DNA, 25 bp, Mus musculus
agctttcaggtgcacttgtacattt

SEQ ID NO: 184299 - DNA, 25 bp, Mus musculus
agctttcaggtggacttgtacattt

SEQ ID NO: 184300 - DNA, 25 bp, Mus musculus
agctttcaggtgtctgctataagtc

SEQ ID NO: 184301 - DNA, 25 bp, Mus musculus
agctttcagtagcaggccctgtgtg

SEQ ID NO: 184302 - DNA, 25 bp, Mus musculus
agctttcagtaggaggccctgtgtg

SEQ ID NO: 184303 - DNA, 25 bp, Mus musculus
agctttcatccccaggaaactgctg

SEQ ID NO: 184304 - DNA, 25 bp, Mus musculus
agctttcatcccgaggaaactgctg

SEQ ID NO: 184305 - DNA, 25 bp, Mus musculus
agctttcatctgaattgtcttaacg

SEQ ID NO: 184306 - DNA, 25 bp, Mus musculus
agctttcatctgtattgtcttaacg

SEQ ID NO: 184307 - DNA, 25 bp, Mus musculus
agctttcatcttcatcctttccaag

SEQ ID NO: 184308 - DNA, 25 bp, Mus musculus
agctttcatcttgatcctttccaag

SEQ ID NO: 184309 - DNA, 25 bp, Mus musculus
agctttcatggcactgactccctac

SEQ ID NO: 184310 - DNA, 25 bp, Mus musculus
agctttcatggctctgactccctac

SEQ ID NO: 184311 - DNA, 25 bp, Mus musculus
agctttcatggtattgactccctat

SEQ ID NO: 184312 - DNA, 25 bp, Mus musculus
agctttcatggttttgactccctat

SEQ ID NO: 184313 - DNA, 25 bp, Mus musculus
agctttcattgaagatggcgccagt

SEQ ID NO: 184314 - DNA, 25 bp, Mus musculus
agctttcattgatgatggcgccagt

SEQ ID NO: 184315 - DNA, 25 bp, Mus musculus
agctttccaaatccactctgcttgt

SEQ ID NO: 184316 - DNA, 25 bp, Mus musculus
agctttccaaatgcactctgcttgt

SEQ ID NO: 184317 - DNA, 25 bp, Mus musculus
agctttccaactcagatgtattttg

SEQ ID NO: 184318 - DNA, 25 bp, Mus musculus
agctttccaactgagatgtattttg

SEQ ID NO: 184319 - DNA, 25 bp, Mus musculus
agctttccaattccttgagttatag

SEQ ID NO: 184320 - DNA, 25 bp, Mus musculus
agctttccaattgcttgagttatag

SEQ ID NO: 184321 - DNA, 25 bp, Mus musculus
agctttccacccatcgagagagtac

SEQ ID NO: 184322 - DNA, 25 bp, Mus musculus
agctttccacccttcgagagagtac

SEQ ID NO: 184323 - DNA, 25 bp, Mus musculus
agctttccagagactcaattctcag

SEQ ID NO: 184324 - DNA, 25 bp, Mus musculus
agctttccagagtctcaattctcag

SEQ ID NO: 184325 - DNA, 25 bp, Mus musculus
agctttccagatcatcaattctcag

SEQ ID NO: 184326 - DNA, 25 bp, Mus musculus
agctttccagatgatcaattctcag

SEQ ID NO: 184327 - DNA, 25 bp, Mus musculus
agctttccaggcctgttctgctaga

SEQ ID NO: 184328 - DNA, 25 bp, Mus musculus
agctttccaggcgtgttctgctaga

SEQ ID NO: 184329 - DNA, 25 bp, Mus musculus
agctttccatttcttatgcaggtca

SEQ ID NO: 184330 - DNA, 25 bp, Mus musculus
agctttccatttgttatgcaggtca

SEQ ID NO: 184331 - DNA, 25 bp, Mus musculus
agctttcccaaaatccgtcatttca

SEQ ID NO: 184332 - DNA, 25 bp, Mus musculus
agctttcccaaattccgtcatttca

SEQ ID NO: 184333 - DNA, 25 bp, Mus musculus
agctttcccagcaggttaaagaagc

SEQ ID NO: 184334 - DNA, 25 bp, Mus musculus
agctttcccagctggttaaagaagc

SEQ ID NO: 184335 - DNA, 25 bp, Mus musculus
agctttcccctgagcaaggaccttt

SEQ ID NO: 184336 - DNA, 25 bp, Mus musculus
agctttcccctgtgcaaggaccttt

SEQ ID NO: 184337 - DNA, 25 bp, Mus musculus
agctttccctagcagaggttttttg

SEQ ID NO: 184338 - DNA, 25 bp, Mus musculus
agctttccctaggagaggttttttg

SEQ ID NO: 184339 - DNA, 25 bp, Mus musculus
agctttcctaaccagtcttttcaga

SEQ ID NO: 184340 - DNA, 25 bp, Mus musculus
agctttcctaacgagtcttttcaga

SEQ ID NO: 184341 - DNA, 25 bp, Mus musculus
agctttcctgagacctctgagttct

SEQ ID NO: 184342 - DNA, 25 bp, Mus musculus
agctttcctgagcaccgtgtgcttt

SEQ ID NO: 184343 - DNA, 25 bp, Mus musculus
agctttcctgaggaccgtgtgcttt

SEQ ID NO: 184344 - DNA, 25 bp, Mus musculus
agctttcctgagtcctctgagttct

SEQ ID NO: 184345 - DNA, 25 bp, Mus musculus
agctttcctggactatctatacaca

SEQ ID NO: 184346 - DNA, 25 bp, Mus musculus
agctttcctggagtatctatacaca

SEQ ID NO: 184347 - DNA, 25 bp, Mus musculus
agctttcctttcatggtgtggctta

SEQ ID NO: 184348 - DNA, 25 bp, Mus musculus
agctttcctttcttggtgtggctta

SEQ ID NO: 184349 - DNA, 25 bp, Mus musculus
agctttcgacgtccactatcgtgga

SEQ ID NO: 184350 - DNA, 25 bp, Mus musculus
agctttcgacgtgcactatcgtgga

SEQ ID NO: 184351 - DNA, 25 bp, Mus musculus
agctttcgcaggattggaccccttg

SEQ ID NO: 184352 - DNA, 25 bp, Mus musculus
agctttcgcaggtttggaccccttg

SEQ ID NO: 184353 - DNA, 25 bp, Mus musculus
agctttcgtagcagtttataccata

SEQ ID NO: 184354 - DNA, 25 bp, Mus musculus
agctttcgtagctgtttataccata

SEQ ID NO: 184355 - DNA, 25 bp, Mus musculus
agctttcgtcaaatctgagtccctt

SEQ ID NO: 184356 - DNA, 25 bp, Mus musculus
agctttcgtcaattctgagtccctt

SEQ ID NO: 184357 - DNA, 25 bp, Mus musculus
agctttctaaacctcacatcctgat

SEQ ID NO: 184358 - DNA, 25 bp, Mus musculus
agctttctaaacgtcacatcctgat

SEQ ID NO: 184359 - DNA, 25 bp, Mus musculus
agctttctaacaactgtctccaggg

SEQ ID NO: 184360 - DNA, 25 bp, Mus musculus
agctttctaacatctgtctccaggg

SEQ ID NO: 184361 - DNA, 25 bp, Mus musculus
agctttctaatcaatacacagtcta

SEQ ID NO: 184362 - DNA, 25 bp, Mus musculus
agctttctaatctatacacagtcta

SEQ ID NO: 184363 - DNA, 25 bp, Mus musculus
agctttctagctaatcactgtttat

SEQ ID NO: 184364 - DNA, 25 bp, Mus musculus
agctttctagcttatcactgtttat

SEQ ID NO: 184365 - DNA, 25 bp, Mus musculus
agctttctattactgtgttgccttc

SEQ ID NO: 184366 - DNA, 25 bp, Mus musculus
agctttctattagtgtgttgccttc

SEQ ID NO: 184367 - DNA, 25 bp, Mus musculus
agctttctcctcaagcctgacaaaa

SEQ ID NO: 184368 - DNA, 25 bp, Mus musculus
agctttctcctctagcctgacaaaa

SEQ ID NO: 184369 - DNA, 25 bp, Mus musculus
agctttctccttcattgcactgtag

SEQ ID NO: 184370 - DNA, 25 bp, Mus musculus
agctttctccttgattgcactgtag

SEQ ID NO: 184371 - DNA, 25 bp, Mus musculus
agctttctctacacactactgtgga

SEQ ID NO: 184372 - DNA, 25 bp, Mus musculus
agctttctctactcactactgtgga

SEQ ID NO: 184373 - DNA, 25 bp, Mus musculus
agctttctctcacaccagtgtgact

SEQ ID NO: 184374 - DNA, 25 bp, Mus musculus
agctttctctcagaccagtgtgact

SEQ ID NO: 184375 - DNA, 25 bp, Mus musculus
agctttctctggatcatttgattgc

SEQ ID NO: 184376 - DNA, 25 bp, Mus musculus
agctttctctggttcatttgattgc

SEQ ID NO: 184377 - DNA, 25 bp, Mus musculus
agctttctcttgaatttgagccagt

SEQ ID NO: 184378 - DNA, 25 bp, Mus musculus
agctttctcttgcttctgctactcc

SEQ ID NO: 184379 - DNA, 25 bp, Mus musculus
agctttctcttggttctgctactcc

SEQ ID NO: 184380 - DNA, 25 bp, Mus musculus
agctttctcttgtatttgagccagt

SEQ ID NO: 184381 - DNA, 25 bp, Mus musculus
agctttctgactcttgaggtaaata

SEQ ID NO: 184382 - DNA, 25 bp, Mus musculus
agctttctgactgttgaggtaaata

SEQ ID NO: 184383 - DNA, 25 bp, Mus musculus
agctttctgagcacggaaccattgt

SEQ ID NO: 184384 - DNA, 25 bp, Mus musculus
agctttctgagctcggaaccattgt

SEQ ID NO: 184385 - DNA, 25 bp, Mus musculus
agctttctgcagaggagttggacgc

SEQ ID NO: 184386 - DNA, 25 bp, Mus musculus
agctttctgcagtggagttggacgc

SEQ ID NO: 184387 - DNA, 25 bp, Mus musculus
agctttctggaacggtgtgagccac

SEQ ID NO: 184388 - DNA, 25 bp, Mus musculus
agctttctggaagggtgtgagccac

SEQ ID NO: 184389 - DNA, 25 bp, Mus musculus
agctttctggagactgtattattgg

SEQ ID NO: 184390 - DNA, 25 bp, Mus musculus
agctttctggagtctgtattattgg

SEQ ID NO: 184391 - DNA, 25 bp, Mus musculus
agctttctggcaacccgattctgtg

SEQ ID NO: 184392 - DNA, 25 bp, Mus musculus
agctttctggcatcccgattctgtg

SEQ ID NO: 184393 - DNA, 25 bp, Mus musculus
agctttctggccaatgaagacccct

SEQ ID NO: 184394 - DNA, 25 bp, Mus musculus
agctttctggcctatgaagacccct

SEQ ID NO: 184395 - DNA, 25 bp, Mus musculus
agctttctgttcctttcattatttg

SEQ ID NO: 184396 - DNA, 25 bp, Mus musculus
agctttctgttcgtttcattatttg

SEQ ID NO: 184397 - DNA, 25 bp, Mus musculus
agctttctgtttctgctcaactctt

SEQ ID NO: 184398 - DNA, 25 bp, Mus musculus
agctttctgtttgtgctcaactctt

SEQ ID NO: 184399 - DNA, 25 bp, Mus musculus
agctttcttacactaaccaccaatg

SEQ ID NO: 184400 - DNA, 25 bp, Mus musculus
agctttcttacagtaaccaccaatg

SEQ ID NO: 184401 - DNA, 25 bp, Mus musculus
agctttcttattactgtacccaatc

SEQ ID NO: 184402 - DNA, 25 bp, Mus musculus
agctttcttatttctgtacccaatc

SEQ ID NO: 184403 - DNA, 25 bp, Mus musculus
agctttcttcatcgttctttttgca

SEQ ID NO: 184404 - DNA, 25 bp, Mus musculus
agctttcttcatcttgttatggtac

SEQ ID NO: 184405 - DNA, 25 bp, Mus musculus
agctttcttcatggttctttttgca

SEQ ID NO: 184406 - DNA, 25 bp, Mus musculus
agctttcttcatgttgttatggtac

SEQ ID NO: 184407 - DNA, 25 bp, Mus musculus
agctttcttcctcatgtgagctttt

SEQ ID NO: 184408 - DNA, 25 bp, Mus musculus
agctttcttcctgatgtgagctttt

SEQ ID NO: 184409 - DNA, 25 bp, Mus musculus
agctttcttcttatgtgttcaggaa

SEQ ID NO: 184410 - DNA, 25 bp, Mus musculus
agctttcttcttttgtgttcaggaa

SEQ ID NO: 184411 - DNA, 25 bp, Mus musculus
agctttgaactccttgtgtagccaa

SEQ ID NO: 184412 - DNA, 25 bp, Mus musculus
agctttgaactcgttgtgtagccaa

SEQ ID NO: 184413 - DNA, 25 bp, Mus musculus
agctttgaagacagtccctggcata

SEQ ID NO: 184414 - DNA, 25 bp, Mus musculus
agctttgaagactgtccctggcata

SEQ ID NO: 184415 - DNA, 25 bp, Mus musculus
agctttgaagcaactggcccaggga

SEQ ID NO: 184416 - DNA, 25 bp, Mus musculus
agctttgaagcactacttggcgtct

SEQ ID NO: 184417 - DNA, 25 bp, Mus musculus
agctttgaagcagtacttggcgtct

SEQ ID NO: 184418 - DNA, 25 bp, Mus musculus
agctttgaagcatctggcccaggga

SEQ ID NO: 184419 - DNA, 25 bp, Mus musculus
agctttgacaatagcctcctggcca

SEQ ID NO: 184420 - DNA, 25 bp, Mus musculus
agctttgacaattgcctcctggcca

SEQ ID NO: 184421 - DNA, 25 bp, Mus musculus
agctttgacctccttgatgctgtct

SEQ ID NO: 184422 - DNA, 25 bp, Mus musculus
agctttgacctcgttgatgctgtct

SEQ ID NO: 184423 - DNA, 25 bp, Mus musculus
agctttgaccttctggttgcagacc

SEQ ID NO: 184424 - DNA, 25 bp, Mus musculus
agctttgaccttgtggttgcagacc

SEQ ID NO: 184425 - DNA, 25 bp, Mus musculus
agctttgagagtctgtagcctcacc

SEQ ID NO: 184426 - DNA, 25 bp, Mus musculus
agctttgagagtgtgtagcctcacc

SEQ ID NO: 184427 - DNA, 25 bp, Mus musculus
agctttgagctcacggcttttgttt

SEQ ID NO: 184428 - DNA, 25 bp, Mus musculus
agctttgagctctcggcttttgttt

SEQ ID NO: 184429 - DNA, 25 bp, Mus musculus
agctttgagctgatgcgggaaccct

SEQ ID NO: 184430 - DNA, 25 bp, Mus musculus
agctttgagctgttgcgggaaccct

SEQ ID NO: 184431 - DNA, 25 bp, Mus musculus
agctttgaggtacaggagctgttta

SEQ ID NO: 184432 - DNA, 25 bp, Mus musculus
agctttgaggtagaggagctgttta

SEQ ID NO: 184433 - DNA, 25 bp, Mus musculus
agctttgataacatgacctgtggta

SEQ ID NO: 184434 - DNA, 25 bp, Mus musculus
agctttgataacttgacctgtggta

SEQ ID NO: 184435 - DNA, 25 bp, Mus musculus
agctttgatcaacgtcgtcttttaa

SEQ ID NO: 184436 - DNA, 25 bp, Mus musculus
agctttgatcaaggtcgtcttttaa

SEQ ID NO: 184437 - DNA, 25 bp, Mus musculus
agctttgatcatctgacctgactga

SEQ ID NO: 184438 - DNA, 25 bp, Mus musculus
agctttgatcatgtgacctgactga

SEQ ID NO: 184439 - DNA, 25 bp, Mus musculus
agctttgatctcatggtgatcggtg

SEQ ID NO: 184440 - DNA, 25 bp, Mus musculus
agctttgatctcttggtgatcggtg

SEQ ID NO: 184441 - DNA, 25 bp, Mus musculus
agctttgatcttattggcctagtcc

SEQ ID NO: 184442 - DNA, 25 bp, Mus musculus
agctttgatctttttggcctagtcc

SEQ ID NO: 184443 - DNA, 25 bp, Mus musculus
agctttgatgtccagacttcgttta

SEQ ID NO: 184444 - DNA, 25 bp, Mus musculus
agctttgatgtcgagacttcgttta

SEQ ID NO: 184445 - DNA, 25 bp, Mus musculus
agctttgatgttcaagccgctgtat

SEQ ID NO: 184446 - DNA, 25 bp, Mus musculus
agctttgatgttgaagccgctgtat

SEQ ID NO: 184447 - DNA, 25 bp, Mus musculus
agctttgatttgatactcgtggttt

SEQ ID NO: 184448 - DNA, 25 bp, Mus musculus
agctttgatttgttactcgtggttt

SEQ ID NO: 184449 - DNA, 25 bp, Mus musculus
agctttgcaaagcttttatccatta

SEQ ID NO: 184450 - DNA, 25 bp, Mus musculus
agctttgcaaaggttttatccatta

SEQ ID NO: 184451 - DNA, 25 bp, Mus musculus
agctttgcagaaacccgctcttatg

SEQ ID NO: 184452 - DNA, 25 bp, Mus musculus
agctttgcagaatcccgctcttatg

SEQ ID NO: 184453 - DNA, 25 bp, Mus musculus
agctttgcatggctactagggaatc

SEQ ID NO: 184454 - DNA, 25 bp, Mus musculus
agctttgcatgggtactagggaatc

SEQ ID NO: 184455 - DNA, 25 bp, Mus musculus
agctttgcatgtatccttcctggga

SEQ ID NO: 184456 - DNA, 25 bp, Mus musculus
agctttgcatgtttccttcctggga

SEQ ID NO: 184457 - DNA, 25 bp, Mus musculus
agctttgccaatctgttctttcttt

SEQ ID NO: 184458 - DNA, 25 bp, Mus musculus
agctttgccaatgtgttctttcttt

SEQ ID NO: 184459 - DNA, 25 bp, Mus musculus
agctttgccacacctttgatagtac

SEQ ID NO: 184460 - DNA, 25 bp, Mus musculus
agctttgccacagctttgatagtac

SEQ ID NO: 184461 - DNA, 25 bp, Mus musculus
agctttgccctgagatgaagccagg

SEQ ID NO: 184462 - DNA, 25 bp, Mus musculus
agctttgccctgtgatgaagccagg

SEQ ID NO: 184463 - DNA, 25 bp, Mus musculus
agctttgccgtcagacttggtcctc

SEQ ID NO: 184464 - DNA, 25 bp, Mus musculus
agctttgccgtctgacttggtcctc

SEQ ID NO: 184465 - DNA, 25 bp, Mus musculus
agctttgcctgtcaagtgctacaag

SEQ ID NO: 184466 - DNA, 25 bp, Mus musculus
agctttgcctgtgaagtgctacaag

SEQ ID NO: 184467 - DNA, 25 bp, Mus musculus
agctttgctattagtccttgtagat

SEQ ID NO: 184468 - DNA, 25 bp, Mus musculus
agctttgctatttgtccttgtagat

SEQ ID NO: 184469 - DNA, 25 bp, Mus musculus
agctttgctccaattaatatcttga

SEQ ID NO: 184470 - DNA, 25 bp, Mus musculus
agctttgctccatttaatatcttga

SEQ ID NO: 184471 - DNA, 25 bp, Mus musculus
agctttgctctcaacactaatgaca

SEQ ID NO: 184472 - DNA, 25 bp, Mus musculus
agctttgctctctacactaatgaca

SEQ ID NO: 184473 - DNA, 25 bp, Mus musculus
agctttgctcttatgttttcgatgt

SEQ ID NO: 184474 - DNA, 25 bp, Mus musculus
agctttgctcttttgttttcgatgt

SEQ ID NO: 184475 - DNA, 25 bp, Mus musculus
agctttgctgagctttcgctgagga

SEQ ID NO: 184476 - DNA, 25 bp, Mus musculus
agctttgctgaggtttcgctgagga

SEQ ID NO: 184477 - DNA, 25 bp, Mus musculus
agctttgctgataaatggatacctt

SEQ ID NO: 184478 - DNA, 25 bp, Mus musculus
agctttgctgattaatggatacctt

SEQ ID NO: 184479 - DNA, 25 bp, Mus musculus
agctttgctgcacaatttgaatgta

SEQ ID NO: 184480 - DNA, 25 bp, Mus musculus
agctttgctgcagaatttgaatgta

SEQ ID NO: 184481 - DNA, 25 bp, Mus musculus
agctttgctgctaggctgcccgtaa

SEQ ID NO: 184482 - DNA, 25 bp, Mus musculus
agctttgctgctatataggtgttat

SEQ ID NO: 184483 - DNA, 25 bp, Mus musculus
agctttgctgcttggctgcccgtaa

SEQ ID NO: 184484 - DNA, 25 bp, Mus musculus
agctttgctgctttataggtgttat

SEQ ID NO: 184485 - DNA, 25 bp, Mus musculus
agctttgctgtacaccccataaatg

SEQ ID NO: 184486 - DNA, 25 bp, Mus musculus
agctttgctgtacactccaacgagg

SEQ ID NO: 184487 - DNA, 25 bp, Mus musculus
agctttgctgtagaccccataaatg

SEQ ID NO: 184488 - DNA, 25 bp, Mus musculus
agctttgctgtagactccaacgagg

SEQ ID NO: 184489 - DNA, 25 bp, Mus musculus
agctttgctgtcagtcgcctacata

SEQ ID NO: 184490 - DNA, 25 bp, Mus musculus
agctttgctgtctgtcgcctacata

SEQ ID NO: 184491 - DNA, 25 bp, Mus musculus
agctttgctgttagatccttctctg

SEQ ID NO: 184492 - DNA, 25 bp, Mus musculus
agctttgctgtttgatccttctctg

SEQ ID NO: 184493 - DNA, 25 bp, Mus musculus
agctttgcttggaatcctcagggca

SEQ ID NO: 184494 - DNA, 25 bp, Mus musculus
agctttgcttggtatcctcagggca

SEQ ID NO: 184495 - DNA, 25 bp, Mus musculus
agctttgctttcaatatttcccatg

SEQ ID NO: 184496 - DNA, 25 bp, Mus musculus
agctttgctttctatatttcccatg

SEQ ID NO: 184497 - DNA, 25 bp, Mus musculus
agctttggaaaacgcttgcaagcta

SEQ ID NO: 184498 - DNA, 25 bp, Mus musculus
agctttggaaaaggcttgcaagcta

SEQ ID NO: 184499 - DNA, 25 bp, Mus musculus
agctttggagacagacgctgggtca

SEQ ID NO: 184500 - DNA, 25 bp, Mus musculus
agctttggagactgacgctgggtca

SEQ ID NO: 184501 - DNA, 25 bp, Mus musculus
agctttggaggtacctaggtacctg

SEQ ID NO: 184502 - DNA, 25 bp, Mus musculus
agctttggaggttcctaggtacctg

SEQ ID NO: 184503 - DNA, 25 bp, Mus musculus
agctttggattcacaggcgcatccg

SEQ ID NO: 184504 - DNA, 25 bp, Mus musculus
agctttggattctcaggcgcatccg

SEQ ID NO: 184505 - DNA, 25 bp, Mus musculus
agctttggattgattctaccgtgtt

SEQ ID NO: 184506 - DNA, 25 bp, Mus musculus
agctttggattgtttctaccgtgtt

SEQ ID NO: 184507 - DNA, 25 bp, Mus musculus
agctttggcagcaacggaagaacca

SEQ ID NO: 184508 - DNA, 25 bp, Mus musculus
agctttggcagctacggaagaacca

SEQ ID NO: 184509 - DNA, 25 bp, Mus musculus
agctttggcattatccagcattaat

SEQ ID NO: 184510 - DNA, 25 bp, Mus musculus
agctttggcattttccagcattaat

SEQ ID NO: 184511 - DNA, 25 bp, Mus musculus
agctttggctgcatccctgagtgat

SEQ ID NO: 184512 - DNA, 25 bp, Mus musculus
agctttggctgcttccctgagtgat

SEQ ID NO: 184513 - DNA, 25 bp, Mus musculus
agctttggcttcagcgtttgcctga

SEQ ID NO: 184514 - DNA, 25 bp, Mus musculus
agctttggcttctgcgtttgcctga

SEQ ID NO: 184515 - DNA, 25 bp, Mus musculus
agctttgggagtacctcatttccac

SEQ ID NO: 184516 - DNA, 25 bp, Mus musculus
agctttgggagttcctcatttccac

SEQ ID NO: 184517 - DNA, 25 bp, Mus musculus
agctttgggctgctagctgcttcaa

SEQ ID NO: 184518 - DNA, 25 bp, Mus musculus
agctttgggctggtagctgcttcaa

SEQ ID NO: 184519 - DNA, 25 bp, Mus musculus
agctttgggttcctgtagctcctgc

SEQ ID NO: 184520 - DNA, 25 bp, Mus musculus
agctttgggttcgtgtagctcctgc

SEQ ID NO: 184521 - DNA, 25 bp, Mus musculus
agctttggtccacatgatggtcaca

SEQ ID NO: 184522 - DNA, 25 bp, Mus musculus
agctttggtccagatgatggtcaca

SEQ ID NO: 184523 - DNA, 25 bp, Mus musculus
agctttggtgatcctaaggaagcag

SEQ ID NO: 184524 - DNA, 25 bp, Mus musculus
agctttggtgatgctaaggaagcag

SEQ ID NO: 184525 - DNA, 25 bp, Mus musculus
agctttggtgcaatgtgagtgtcaa

SEQ ID NO: 184526 - DNA, 25 bp, Mus musculus
agctttggtgcattgtgagtgtcaa

SEQ ID NO: 184527 - DNA, 25 bp, Mus musculus
agctttggtttcctggatgcctcta

SEQ ID NO: 184528 - DNA, 25 bp, Mus musculus
agctttggtttcgtggatgcctcta

SEQ ID NO: 184529 - DNA, 25 bp, Mus musculus
agctttgtaattcctgttctctggc

SEQ ID NO: 184530 - DNA, 25 bp, Mus musculus
agctttgtaattgctgttctctggc

SEQ ID NO: 184531 - DNA, 25 bp, Mus musculus
agctttgtagttcctttgtcttgca

SEQ ID NO: 184532 - DNA, 25 bp, Mus musculus
agctttgtagttgctttgtcttgca

SEQ ID NO: 184533 - DNA, 25 bp, Mus musculus
agctttgtatctcagctgctcactg

SEQ ID NO: 184534 - DNA, 25 bp, Mus musculus
agctttgtatctgagctgctcactg

SEQ ID NO: 184535 - DNA, 25 bp, Mus musculus
agctttgtcaatatggtctcctgca

SEQ ID NO: 184536 - DNA, 25 bp, Mus musculus
agctttgtcaatttggtctcctgca

SEQ ID NO: 184537 - DNA, 25 bp, Mus musculus
agctttgtcactctctacacacaca

SEQ ID NO: 184538 - DNA, 25 bp, Mus musculus
agctttgtcactgtctacacacaca

SEQ ID NO: 184539 - DNA, 25 bp, Mus musculus
agctttgtcttcactgttttccaaa

SEQ ID NO: 184540 - DNA, 25 bp, Mus musculus
agctttgtcttctctgttttccaaa

SEQ ID NO: 184541 - DNA, 25 bp, Mus musculus
agctttgtgaccattttctcatatt

SEQ ID NO: 184542 - DNA, 25 bp, Mus musculus
agctttgtgacctttttctcatatt

SEQ ID NO: 184543 - DNA, 25 bp, Mus musculus
agctttgtgatcagtcacgccgtag

SEQ ID NO: 184544 - DNA, 25 bp, Mus musculus
agctttgtgatcatcctacaccagg

SEQ ID NO: 184545 - DNA, 25 bp, Mus musculus
agctttgtgatctgtcacgccgtag

SEQ ID NO: 184546 - DNA, 25 bp, Mus musculus
agctttgtgatcttcctacaccagg

SEQ ID NO: 184547 - DNA, 25 bp, Mus musculus
agctttgtgattctccattgttcct

SEQ ID NO: 184548 - DNA, 25 bp, Mus musculus
agctttgtgattgtccattgttcct

SEQ ID NO: 184549 - DNA, 25 bp, Mus musculus
agctttgtggctccctaaatggaca

SEQ ID NO: 184550 - DNA, 25 bp, Mus musculus
agctttgtggctgcctaaatggaca

SEQ ID NO: 184551 - DNA, 25 bp, Mus musculus
agctttgtgggtctgtatcctgtca

SEQ ID NO: 184552 - DNA, 25 bp, Mus musculus
agctttgtgggtgtgtatcctgtca

SEQ ID NO: 184553 - DNA, 25 bp, Mus musculus
agctttgtggtacaacatgtgccta

SEQ ID NO: 184554 - DNA, 25 bp, Mus musculus
agctttgtggtagaacatgtgccta

SEQ ID NO: 184555 - DNA, 25 bp, Mus musculus
agctttgtggtccaaactctggctc

SEQ ID NO: 184556 - DNA, 25 bp, Mus musculus
agctttgtggtcgaaactctggctc

SEQ ID NO: 184557 - DNA, 25 bp, Mus musculus
agctttgtgtaactggcacttctct

SEQ ID NO: 184558 - DNA, 25 bp, Mus musculus
agctttgtgtaagtggcacttctct

SEQ ID NO: 184559 - DNA, 25 bp, Mus musculus
agctttgtgtatcacttctgccttg

SEQ ID NO: 184560 - DNA, 25 bp, Mus musculus
agctttgtgtatgacttctgccttg

SEQ ID NO: 184561 - DNA, 25 bp, Mus musculus
agctttgtgtgcacgatgtaataaa

SEQ ID NO: 184562 - DNA, 25 bp, Mus musculus
agctttgtgtgctcgatgtaataaa

SEQ ID NO: 184563 - DNA, 25 bp, Mus musculus
agctttgttcctcaagacttgccat

SEQ ID NO: 184564 - DNA, 25 bp, Mus musculus
agctttgttcctgaagacttgccat

SEQ ID NO: 184565 - DNA, 25 bp, Mus musculus
agctttgttgacagtacccctttat

SEQ ID NO: 184566 - DNA, 25 bp, Mus musculus
agctttgttgactgtacccctttat

SEQ ID NO: 184567 - DNA, 25 bp, Mus musculus
agctttgtttacatgcttgggtcat

SEQ ID NO: 184568 - DNA, 25 bp, Mus musculus
agctttgtttacttgcttgggtcat

SEQ ID NO: 184569 - DNA, 25 bp, Mus musculus
agctttgtttcaactgggacctgat

SEQ ID NO: 184570 - DNA, 25 bp, Mus musculus
agctttgtttcatctgggacctgat

SEQ ID NO: 184571 - DNA, 25 bp, Mus musculus
agctttgtttgaaattacttttcca

SEQ ID NO: 184572 - DNA, 25 bp, Mus musculus
agctttgtttgatattacttttcca

SEQ ID NO: 184573 - DNA, 25 bp, Mus musculus
agcttttaaagaagcccagccctgg

SEQ ID NO: 184574 - DNA, 25 bp, Mus musculus
agcttttaaagatgcccagccctgg

SEQ ID NO: 184575 - DNA, 25 bp, Mus musculus
agcttttaactaccaacttgccaca

SEQ ID NO: 184576 - DNA, 25 bp, Mus musculus
agcttttaactagcaacttgccaca

SEQ ID NO: 184577 - DNA, 25 bp, Mus musculus
agcttttaagttcttgggtccactg

SEQ ID NO: 184578 - DNA, 25 bp, Mus musculus
agcttttaagttgttgggtccactg

SEQ ID NO: 184579 - DNA, 25 bp, Mus musculus
agcttttacattatgaactcttcag

SEQ ID NO: 184580 - DNA, 25 bp, Mus musculus
agcttttacattttgaactcttcag

SEQ ID NO: 184581 - DNA, 25 bp, Mus musculus
agcttttactacaatctccagtggc

SEQ ID NO: 184582 - DNA, 25 bp, Mus musculus
agcttttactactatctccagtggc

SEQ ID NO: 184583 - DNA, 25 bp, Mus musculus
agcttttagagacctgccttagttc

SEQ ID NO: 184584 - DNA, 25 bp, Mus musculus
agcttttagagagctgccttagttc

SEQ ID NO: 184585 - DNA, 25 bp, Mus musculus
agcttttatactactcgttcattaa

SEQ ID NO: 184586 - DNA, 25 bp, Mus musculus
agcttttatacttctcgttcattaa

SEQ ID NO: 184587 - DNA, 25 bp, Mus musculus
agcttttatatcatcactgtcctgg

SEQ ID NO: 184588 - DNA, 25 bp, Mus musculus
agcttttatatcttcactgtcctgg

SEQ ID NO: 184589 - DNA, 25 bp, Mus musculus
agcttttatcgtatattctggcaga

SEQ ID NO: 184590 - DNA, 25 bp, Mus musculus
agcttttatcgtttattctggcaga

SEQ ID NO: 184591 - DNA, 25 bp, Mus musculus
agcttttatttgcttctggaaggag

SEQ ID NO: 184592 - DNA, 25 bp, Mus musculus
agcttttatttggttctggaaggag

SEQ ID NO: 184593 - DNA, 25 bp, Mus musculus
agcttttcacaaatgtcttctcctg

SEQ ID NO: 184594 - DNA, 25 bp, Mus musculus
agcttttcacaattgtcttctcctg

SEQ ID NO: 184595 - DNA, 25 bp, Mus musculus
agcttttcagcgcagaagacgtact

SEQ ID NO: 184596 - DNA, 25 bp, Mus musculus
agcttttcagcggagaagacgtact

SEQ ID NO: 184597 - DNA, 25 bp, Mus musculus
agcttttcagggacctttgctaata

SEQ ID NO: 184598 - DNA, 25 bp, Mus musculus
agcttttcagggagtgtgagcgtat

SEQ ID NO: 184599 - DNA, 25 bp, Mus musculus
agcttttcagggtcctttgctaata

SEQ ID NO: 184600 - DNA, 25 bp, Mus musculus
agcttttcagggtgtgtgagcgtat

SEQ ID NO: 184601 - DNA, 25 bp, Mus musculus
agcttttcatggacacattctgttt

SEQ ID NO: 184602 - DNA, 25 bp, Mus musculus
agcttttcatggtcacattctgttt

SEQ ID NO: 184603 - DNA, 25 bp, Mus musculus
agcttttccaacctggaagggctgc

SEQ ID NO: 184604 - DNA, 25 bp, Mus musculus
agcttttccaacgtggaagggctgc

SEQ ID NO: 184605 - DNA, 25 bp, Mus musculus
agcttttccaagaacattccactca

SEQ ID NO: 184606 - DNA, 25 bp, Mus musculus
agcttttccaagtacattccactca

SEQ ID NO: 184607 - DNA, 25 bp, Mus musculus
agcttttccatgatgcttgtacaca

SEQ ID NO: 184608 - DNA, 25 bp, Mus musculus
agcttttccatgttgcttgtacaca

SEQ ID NO: 184609 - DNA, 25 bp, Mus musculus
agcttttcctggaaaggcagaccca

SEQ ID NO: 184610 - DNA, 25 bp, Mus musculus
agcttttcctggaatccatgaccat

SEQ ID NO: 184611 - DNA, 25 bp, Mus musculus
agcttttcctggtaaggcagaccca

SEQ ID NO: 184612 - DNA, 25 bp, Mus musculus
agcttttcctggtatccatgaccat

SEQ ID NO: 184613 - DNA, 25 bp, Mus musculus
agcttttcctttctgagatctgttt

SEQ ID NO: 184614 - DNA, 25 bp, Mus musculus
agcttttcctttgtgagatctgttt

SEQ ID NO: 184615 - DNA, 25 bp, Mus musculus
agcttttcgtgcagcctgtttgaag

SEQ ID NO: 184616 - DNA, 25 bp, Mus musculus
agcttttcgtgctgcctgtttgaag

SEQ ID NO: 184617 - DNA, 25 bp, Mus musculus
agcttttctctgagcacattataga

SEQ ID NO: 184618 - DNA, 25 bp, Mus musculus
agcttttctctgtgcacattataga

SEQ ID NO: 184619 - DNA, 25 bp, Mus musculus
agcttttctgcaccgtccgagcatc

SEQ ID NO: 184620 - DNA, 25 bp, Mus musculus
agcttttctgcagcgtccgagcatc

SEQ ID NO: 184621 - DNA, 25 bp, Mus musculus
agcttttctggactacaatctttca

SEQ ID NO: 184622 - DNA, 25 bp, Mus musculus
agcttttctggagtacaatctttca

SEQ ID NO: 184623 - DNA, 25 bp, Mus musculus
agcttttctggcagagttttgctaa

SEQ ID NO: 184624 - DNA, 25 bp, Mus musculus
agcttttctggcctaacctgagaga

SEQ ID NO: 184625 - DNA, 25 bp, Mus musculus
agcttttctggcgtaacctgagaga

SEQ ID NO: 184626 - DNA, 25 bp, Mus musculus
agcttttctggctgagttttgctaa

SEQ ID NO: 184627 - DNA, 25 bp, Mus musculus
agcttttcttcaatatggccgttgt

SEQ ID NO: 184628 - DNA, 25 bp, Mus musculus
agcttttcttcaatgcctttgcaca

SEQ ID NO: 184629 - DNA, 25 bp, Mus musculus
agcttttcttcattatggccgttgt

SEQ ID NO: 184630 - DNA, 25 bp, Mus musculus
agcttttcttcattgcctttgcaca

SEQ ID NO: 184631 - DNA, 25 bp, Mus musculus
agcttttcttctctgaacagatgtg

SEQ ID NO: 184632 - DNA, 25 bp, Mus musculus
agcttttcttctgtgaacagatgtg

SEQ ID NO: 184633 - DNA, 25 bp, Mus musculus
agcttttcttgaagagaaccttcat

SEQ ID NO: 184634 - DNA, 25 bp, Mus musculus
agcttttcttgatgagaaccttcat

SEQ ID NO: 184635 - DNA, 25 bp, Mus musculus
agcttttgaactctgtgcctgctca

SEQ ID NO: 184636 - DNA, 25 bp, Mus musculus
agcttttgaactgtgtgcctgctca

SEQ ID NO: 184637 - DNA, 25 bp, Mus musculus
agcttttgacggactctgacttgaa

SEQ ID NO: 184638 - DNA, 25 bp, Mus musculus
agcttttgacggtctctgacttgaa

SEQ ID NO: 184639 - DNA, 25 bp, Mus musculus
agcttttgcatgcttaaggatccca

SEQ ID NO: 184640 - DNA, 25 bp, Mus musculus
agcttttgcatggttaaggatccca

SEQ ID NO: 184641 - DNA, 25 bp, Mus musculus
agcttttgcattacaaggctgtaca

SEQ ID NO: 184642 - DNA, 25 bp, Mus musculus
agcttttgcatttcaaggctgtaca

SEQ ID NO: 184643 - DNA, 25 bp, Mus musculus
agcttttgccaaaatcacatgtcag

SEQ ID NO: 184644 - DNA, 25 bp, Mus musculus
agcttttgccaatatcacatgtcag

SEQ ID NO: 184645 - DNA, 25 bp, Mus musculus
agcttttgccttcttgcactacata

SEQ ID NO: 184646 - DNA, 25 bp, Mus musculus
agcttttgccttgttgcactacata

SEQ ID NO: 184647 - DNA, 25 bp, Mus musculus
agcttttgcgtaattccttctatgg

SEQ ID NO: 184648 - DNA, 25 bp, Mus musculus
agcttttgcgtatttccttctatgg

SEQ ID NO: 184649 - DNA, 25 bp, Mus musculus
agcttttgctcaacacagttatctc

SEQ ID NO: 184650 - DNA, 25 bp, Mus musculus
agcttttgctcatcacagttatctc

SEQ ID NO: 184651 - DNA, 25 bp, Mus musculus
agcttttggaatccccagacggagg

SEQ ID NO: 184652 - DNA, 25 bp, Mus musculus
agcttttggaatgcccagacggagg

SEQ ID NO: 184653 - DNA, 25 bp, Mus musculus
agcttttggaggcagattcaggtct

SEQ ID NO: 184654 - DNA, 25 bp, Mus musculus
agcttttggagggagattcaggtct

SEQ ID NO: 184655 - DNA, 25 bp, Mus musculus
agcttttggctactttccttgtcaa

SEQ ID NO: 184656 - DNA, 25 bp, Mus musculus
agcttttggctagtttccttgtcaa

SEQ ID NO: 184657 - DNA, 25 bp, Mus musculus
agcttttggctcagcatcccagcat

SEQ ID NO: 184658 - DNA, 25 bp, Mus musculus
agcttttggctctgcatcccagcat

SEQ ID NO: 184659 - DNA, 25 bp, Mus musculus
agcttttgggatagcccctgcacca

SEQ ID NO: 184660 - DNA, 25 bp, Mus musculus
agcttttgggatcacaacgctggca

SEQ ID NO: 184661 - DNA, 25 bp, Mus musculus
agcttttgggatgacaacgctggca

SEQ ID NO: 184662 - DNA, 25 bp, Mus musculus
agcttttgggattgcccctgcacca

SEQ ID NO: 184663 - DNA, 25 bp, Mus musculus
agcttttgggccagaggccttgtgt

SEQ ID NO: 184664 - DNA, 25 bp, Mus musculus
agcttttgggccagccacgcagatt

SEQ ID NO: 184665 - DNA, 25 bp, Mus musculus
agcttttgggcctgaggccttgtgt

SEQ ID NO: 184666 - DNA, 25 bp, Mus musculus
agcttttgggcctgccacgcagatt

SEQ ID NO: 184667 - DNA, 25 bp, Mus musculus
agcttttgtcaacattacatttttg

SEQ ID NO: 184668 - DNA, 25 bp, Mus musculus
agcttttgtcaagattacatttttg

SEQ ID NO: 184669 - DNA, 25 bp, Mus musculus
agcttttgtgtgctccagcgacatc

SEQ ID NO: 184670 - DNA, 25 bp, Mus musculus
agcttttgtgtggtccagcgacatc

SEQ ID NO: 184671 - DNA, 25 bp, Mus musculus
agctttttaccccacgatagattgt

SEQ ID NO: 184672 - DNA, 25 bp, Mus musculus
agctttttacccgacgatagattgt

SEQ ID NO: 184673 - DNA, 25 bp, Mus musculus
agctttttatagagagttcctgtct

SEQ ID NO: 184674 - DNA, 25 bp, Mus musculus
agctttttatagtgagttcctgtct

SEQ ID NO: 184675 - DNA, 25 bp, Mus musculus
agctttttcttgaccagagtgccct

SEQ ID NO: 184676 - DNA, 25 bp, Mus musculus
agctttttcttgtccagagtgccct

SEQ ID NO: 184677 - DNA, 25 bp, Mus musculus
agctttttggtgactactgattttc

SEQ ID NO: 184678 - DNA, 25 bp, Mus musculus
agctttttggtgtctactgattttc

SEQ ID NO: 184679 - DNA, 25 bp, Mus musculus
agctttttgtagatttgtgctctat

SEQ ID NO: 184680 - DNA, 25 bp, Mus musculus
agctttttgtagttttgtgctctat

SEQ ID NO: 184681 - DNA, 25 bp, Mus musculus
agcttttttatgactgtacccaatc

SEQ ID NO: 184682 - DNA, 25 bp, Mus musculus
agcttttttatgtctgtacccaatc

SEQ ID NO: 184683 - DNA, 25 bp, Mus musculus
agcttttttcagaagaagacccttg

SEQ ID NO: 184684 - DNA, 25 bp, Mus musculus
agcttttttcagtagaagacccttg

SEQ ID NO: 184685 - DNA, 25 bp, Mus musculus
agcttttttcccatagcccttgcac

SEQ ID NO: 184686 - DNA, 25 bp, Mus musculus
agcttttttcccttagcccttgcac

SEQ ID NO: 184687 - DNA, 25 bp, Mus musculus
agcttttttgccctgcgtgaccaga

SEQ ID NO: 184688 - DNA, 25 bp, Mus musculus
agcttttttgccgtgcgtgaccaga

SEQ ID NO: 184689 - DNA, 25 bp, Mus musculus
aggaaaaaagccaggcgctgagacg

SEQ ID NO: 184690 - DNA, 25 bp, Mus musculus
aggaaaaaagcctggcgctgagacg

SEQ ID NO: 184691 - DNA, 25 bp, Mus musculus
aggaaaacaagactcccattatgat

SEQ ID NO: 184692 - DNA, 25 bp, Mus musculus
aggaaaacaagagtcccattatgat

SEQ ID NO: 184693 - DNA, 25 bp, Mus musculus
aggaaaacaatcctttgtggacaga

SEQ ID NO: 184694 - DNA, 25 bp, Mus musculus
aggaaaacaatcgtttgtggacaga

SEQ ID NO: 184695 - DNA, 25 bp, Mus musculus
aggaaaacaccccttcatatgcttg

SEQ ID NO: 184696 - DNA, 25 bp, Mus musculus
aggaaaacacccgttcatatgcttg

SEQ ID NO: 184697 - DNA, 25 bp, Mus musculus
aggaaaacactacctgtctcctatg

SEQ ID NO: 184698 - DNA, 25 bp, Mus musculus
aggaaaacactagctgtctcctatg

SEQ ID NO: 184699 - DNA, 25 bp, Mus musculus
aggaaaacactcagactccaaccgt

SEQ ID NO: 184700 - DNA, 25 bp, Mus musculus
aggaaaacactctgactccaaccgt

SEQ ID NO: 184701 - DNA, 25 bp, Mus musculus
aggaaaacagaaattccgagcagtg

SEQ ID NO: 184702 - DNA, 25 bp, Mus musculus
aggaaaacagaatttccgagcagtg

SEQ ID NO: 184703 - DNA, 25 bp, Mus musculus
aggaaaacagcactgtccgccattt

SEQ ID NO: 184704 - DNA, 25 bp, Mus musculus
aggaaaacagcagtgtccgccattt

SEQ ID NO: 184705 - DNA, 25 bp, Mus musculus
aggaaaacagccacgttgactccac

SEQ ID NO: 184706 - DNA, 25 bp, Mus musculus
aggaaaacagcctcgttgactccac

SEQ ID NO: 184707 - DNA, 25 bp, Mus musculus
aggaaaacagctcttgtggccggtt

SEQ ID NO: 184708 - DNA, 25 bp, Mus musculus
aggaaaacagctgttgtggccggtt

SEQ ID NO: 184709 - DNA, 25 bp, Mus musculus
aggaaaacaggcaggcccctgtgca

SEQ ID NO: 184710 - DNA, 25 bp, Mus musculus
aggaaaacaggctggcccctgtgca

SEQ ID NO: 184711 - DNA, 25 bp, Mus musculus
aggaaaacatgcctttgtcgctgct

SEQ ID NO: 184712 - DNA, 25 bp, Mus musculus
aggaaaacatgcgtttgtcgctgct

SEQ ID NO: 184713 - DNA, 25 bp, Mus musculus
aggaaaaccagccaatccctgaact

SEQ ID NO: 184714 - DNA, 25 bp, Mus musculus
aggaaaaccagcgaatccctgaact

SEQ ID NO: 184715 - DNA, 25 bp, Mus musculus
aggaaaaccattcccacagtccctg

SEQ ID NO: 184716 - DNA, 25 bp, Mus musculus
aggaaaaccattgccacagtccctg

SEQ ID NO: 184717 - DNA, 25 bp, Mus musculus
aggaaaacgacaaccagctttggca

SEQ ID NO: 184718 - DNA, 25 bp, Mus musculus
aggaaaacgacatccagctttggca

SEQ ID NO: 184719 - DNA, 25 bp, Mus musculus
aggaaaactatgatgtgtgcgcgcg

SEQ ID NO: 184720 - DNA, 25 bp, Mus musculus
aggaaaactatgttgtgtgcgcgcg

SEQ ID NO: 184721 - DNA, 25 bp, Mus musculus
aggaaaactccgcagcctgtgcagc

SEQ ID NO: 184722 - DNA, 25 bp, Mus musculus
aggaaaactccggagcctgtgcagc

SEQ ID NO: 184723 - DNA, 25 bp, Mus musculus
aggaaaactgcacaaccttagccaa

SEQ ID NO: 184724 - DNA, 25 bp, Mus musculus
aggaaaactgcagaaccttagccaa

SEQ ID NO: 184725 - DNA, 25 bp, Mus musculus
aggaaaactgctctcccgtgacctt

SEQ ID NO: 184726 - DNA, 25 bp, Mus musculus
aggaaaactgctgtcccgtgacctt

SEQ ID NO: 184727 - DNA, 25 bp, Mus musculus
aggaaaactgtactgcctacctttg

SEQ ID NO: 184728 - DNA, 25 bp, Mus musculus
aggaaaactgtagtgcctacctttg

SEQ ID NO: 184729 - DNA, 25 bp, Mus musculus
aggaaaagaatcatgctgttttcag

SEQ ID NO: 184730 - DNA, 25 bp, Mus musculus
aggaaaagaatcttgctgttttcag

SEQ ID NO: 184731 - DNA, 25 bp, Mus musculus
aggaaaagacgcctgtttgtgtgac

SEQ ID NO: 184732 - DNA, 25 bp, Mus musculus
aggaaaagacgcgtgtttgtgtgac

SEQ ID NO: 184733 - DNA, 25 bp, Mus musculus
aggaaaagagccctccactgctagt

SEQ ID NO: 184734 - DNA, 25 bp, Mus musculus
aggaaaagagccgtccactgctagt

SEQ ID NO: 184735 - DNA, 25 bp, Mus musculus
aggaaaagatgcaaccgccgacggt

SEQ ID NO: 184736 - DNA, 25 bp, Mus musculus
aggaaaagatgctaccgccgacggt

SEQ ID NO: 184737 - DNA, 25 bp, Mus musculus
aggaaaagattcacgcggctgccaa

SEQ ID NO: 184738 - DNA, 25 bp, Mus musculus
aggaaaagattctcgcggctgccaa

SEQ ID NO: 184739 - DNA, 25 bp, Mus musculus
aggaaaagcccaactgatacaacag

SEQ ID NO: 184740 - DNA, 25 bp, Mus musculus
aggaaaagcccatctgatacaacag

SEQ ID NO: 184741 - DNA, 25 bp, Mus musculus
aggaaaagcccgagcggttgccgct

SEQ ID NO: 184742 - DNA, 25 bp, Mus musculus
aggaaaagcccgtgcggttgccgct

SEQ ID NO: 184743 - DNA, 25 bp, Mus musculus
aggaaaagccctaacatgtccctgg

SEQ ID NO: 184744 - DNA, 25 bp, Mus musculus
aggaaaagcccttacatgtccctgg

SEQ ID NO: 184745 - DNA, 25 bp, Mus musculus
aggaaaagcctcaggccagggtgaa

SEQ ID NO: 184746 - DNA, 25 bp, Mus musculus
aggaaaagcctctggccagggtgaa

SEQ ID NO: 184747 - DNA, 25 bp, Mus musculus
aggaaaagccttacttcagctctgg

SEQ ID NO: 184748 - DNA, 25 bp, Mus musculus
aggaaaagcctttcttcagctctgg

SEQ ID NO: 184749 - DNA, 25 bp, Mus musculus
aggaaaagctacacatcccactcgt

SEQ ID NO: 184750 - DNA, 25 bp, Mus musculus
aggaaaagctactcatcccactcgt

SEQ ID NO: 184751 - DNA, 25 bp, Mus musculus
aggaaaagctccagtgacccatagg

SEQ ID NO: 184752 - DNA, 25 bp, Mus musculus
aggaaaagctcctgtgacccatagg

SEQ ID NO: 184753 - DNA, 25 bp, Mus musculus
aggaaaagtagcctctctgggtcca

SEQ ID NO: 184754 - DNA, 25 bp, Mus musculus
aggaaaagtagcgtctctgggtcca

SEQ ID NO: 184755 - DNA, 25 bp, Mus musculus
aggaaaagtcctcctttgggccctg

SEQ ID NO: 184756 - DNA, 25 bp, Mus musculus
aggaaaagtcctgctttgggccctg

SEQ ID NO: 184757 - DNA, 25 bp, Mus musculus
aggaaaataactccctcagattaga

SEQ ID NO: 184758 - DNA, 25 bp, Mus musculus
aggaaaataactgcctcagattaga

SEQ ID NO: 184759 - DNA, 25 bp, Mus musculus
aggaaaatacccacaggtgtgccca

SEQ ID NO: 184760 - DNA, 25 bp, Mus musculus
aggaaaataccctcaggtgtgccca

SEQ ID NO: 184761 - DNA, 25 bp, Mus musculus
aggaaaatcagcctctcctagcagg

SEQ ID NO: 184762 - DNA, 25 bp, Mus musculus
aggaaaatcagcgtctcctagcagg

SEQ ID NO: 184763 - DNA, 25 bp, Mus musculus
aggaaaatcggtcaccatggtgctt

SEQ ID NO: 184764 - DNA, 25 bp, Mus musculus
aggaaaatcggtgaccatggtgctt

SEQ ID NO: 184765 - DNA, 25 bp, Mus musculus
aggaaaatctcacgccactagggaa

SEQ ID NO: 184766 - DNA, 25 bp, Mus musculus
aggaaaatctcaggccactagggaa

SEQ ID NO: 184767 - DNA, 25 bp, Mus musculus
aggaaaatgaaacgcccctctgctc

SEQ ID NO: 184768 - DNA, 25 bp, Mus musculus
aggaaaatgaaaggcccctctgctc

SEQ ID NO: 184769 - DNA, 25 bp, Mus musculus
aggaaacaaacacctgcagttaaag

SEQ ID NO: 184770 - DNA, 25 bp, Mus musculus
aggaaacaaacagctgcagttaaag

SEQ ID NO: 184771 - DNA, 25 bp, Mus musculus
aggaaacaaactcgacctttctgag

SEQ ID NO: 184772 - DNA, 25 bp, Mus musculus
aggaaacaaactggacctttctgag

SEQ ID NO: 184773 - DNA, 25 bp, Mus musculus
aggaaacaacccatagctctgcagt

SEQ ID NO: 184774 - DNA, 25 bp, Mus musculus
aggaaacaacccttagctctgcagt

SEQ ID NO: 184775 - DNA, 25 bp, Mus musculus
aggaaacaagtgatgccccatctgc

SEQ ID NO: 184776 - DNA, 25 bp, Mus musculus
aggaaacaagtgttgccccatctgc

SEQ ID NO: 184777 - DNA, 25 bp, Mus musculus
aggaaacaattgatcaaccgcctcg

SEQ ID NO: 184778 - DNA, 25 bp, Mus musculus
aggaaacaattgttcaaccgcctcg

SEQ ID NO: 184779 - DNA, 25 bp, Mus musculus
aggaaacacactcgctggcccatgt

SEQ ID NO: 184780 - DNA, 25 bp, Mus musculus
aggaaacacactggctggcccatgt

SEQ ID NO: 184781 - DNA, 25 bp, Mus musculus
aggaaacacagaccttagcgatttt

SEQ ID NO: 184782 - DNA, 25 bp, Mus musculus
aggaaacacagagcttagcgatttt

SEQ ID NO: 184783 - DNA, 25 bp, Mus musculus
aggaaacacattccccagtgtgcat

SEQ ID NO: 184784 - DNA, 25 bp, Mus musculus
aggaaacacattgcccagtgtgcat

SEQ ID NO: 184785 - DNA, 25 bp, Mus musculus
aggaaacagattcctctgtcttgta

SEQ ID NO: 184786 - DNA, 25 bp, Mus musculus
aggaaacagattgctctgtcttgta

SEQ ID NO: 184787 - DNA, 25 bp, Mus musculus
aggaaacaggatcttcctcacctgg

SEQ ID NO: 184788 - DNA, 25 bp, Mus musculus
aggaaacaggatgttcctcacctgg

SEQ ID NO: 184789 - DNA, 25 bp, Mus musculus
aggaaacatcataagtatccctttg

SEQ ID NO: 184790 - DNA, 25 bp, Mus musculus
aggaaacatcattagtatccctttg

SEQ ID NO: 184791 - DNA, 25 bp, Mus musculus
aggaaacatgtcaccactggcaacc

SEQ ID NO: 184792 - DNA, 25 bp, Mus musculus
aggaaacatgtctccactggcaacc

SEQ ID NO: 184793 - DNA, 25 bp, Mus musculus
aggaaacattcgctcatgcatcctc

SEQ ID NO: 184794 - DNA, 25 bp, Mus musculus
aggaaacattcggtcatgcatcctc

SEQ ID NO: 184795 - DNA, 25 bp, Mus musculus
aggaaacatttcaacacctcctcaa

SEQ ID NO: 184796 - DNA, 25 bp, Mus musculus
aggaaacatttctacacctcctcaa

SEQ ID NO: 184797 - DNA, 25 bp, Mus musculus
aggaaaccaacacggttctggccag

SEQ ID NO: 184798 - DNA, 25 bp, Mus musculus
aggaaaccaacagggttctggccag

SEQ ID NO: 184799 - DNA, 25 bp, Mus musculus
aggaaaccagaacccgaacaagtga

SEQ ID NO: 184800 - DNA, 25 bp, Mus musculus
aggaaaccagaagccgaacaagtga

SEQ ID NO: 184801 - DNA, 25 bp, Mus musculus
aggaaaccagatataccttatagat

SEQ ID NO: 184802 - DNA, 25 bp, Mus musculus
aggaaaccagatttaccttatagat

SEQ ID NO: 184803 - DNA, 25 bp, Mus musculus
aggaaaccagcaactctactacttg

SEQ ID NO: 184804 - DNA, 25 bp, Mus musculus
aggaaaccagcatctctactacttg

SEQ ID NO: 184805 - DNA, 25 bp, Mus musculus
aggaaacccaagatgatgtactcgg

SEQ ID NO: 184806 - DNA, 25 bp, Mus musculus
aggaaacccaagttgatgtactcgg

SEQ ID NO: 184807 - DNA, 25 bp, Mus musculus
aggaaacccagaaccttttcgatgc

SEQ ID NO: 184808 - DNA, 25 bp, Mus musculus
aggaaacccagatccttttcgatgc

SEQ ID NO: 184809 - DNA, 25 bp, Mus musculus
aggaaaccctgcactggattcaagg

SEQ ID NO: 184810 - DNA, 25 bp, Mus musculus
aggaaaccctgctctggattcaagg

SEQ ID NO: 184811 - DNA, 25 bp, Mus musculus
aggaaaccgctgacgtgagtcgctt

SEQ ID NO: 184812 - DNA, 25 bp, Mus musculus
aggaaaccgctgtcgtgagtcgctt

SEQ ID NO: 184813 - DNA, 25 bp, Mus musculus
aggaaacctcacagcccagtggaac

SEQ ID NO: 184814 - DNA, 25 bp, Mus musculus
aggaaacctcactgcccagtggaac

SEQ ID NO: 184815 - DNA, 25 bp, Mus musculus
aggaaacctccaaccctgcaaagga

SEQ ID NO: 184816 - DNA, 25 bp, Mus musculus
aggaaacctccatccctgcaaagga

SEQ ID NO: 184817 - DNA, 25 bp, Mus musculus
aggaaacctgggagaggccaccatc

SEQ ID NO: 184818 - DNA, 25 bp, Mus musculus
aggaaacctgggtgaggccaccatc

SEQ ID NO: 184819 - DNA, 25 bp, Mus musculus
aggaaacctgtgaagtccattctta

SEQ ID NO: 184820 - DNA, 25 bp, Mus musculus
aggaaacctgtgtagtccattctta

SEQ ID NO: 184821 - DNA, 25 bp, Mus musculus
aggaaaccttatcaatctgtctctg

SEQ ID NO: 184822 - DNA, 25 bp, Mus musculus
aggaaaccttatgaatctgtctctg

SEQ ID NO: 184823 - DNA, 25 bp, Mus musculus
aggaaacgccctctagctctggaag

SEQ ID NO: 184824 - DNA, 25 bp, Mus musculus
aggaaacgccctgtagctctggaag

SEQ ID NO: 184825 - DNA, 25 bp, Mus musculus
aggaaacgggaccatgaatctactt

SEQ ID NO: 184826 - DNA, 25 bp, Mus musculus
aggaaacgggacgatgaatctactt

SEQ ID NO: 184827 - DNA, 25 bp, Mus musculus
aggaaacgtgtcaccccgtgtatat

SEQ ID NO: 184828 - DNA, 25 bp, Mus musculus
aggaaacgtgtctccccgtgtatat

SEQ ID NO: 184829 - DNA, 25 bp, Mus musculus
aggaaactaatcactcggagttata

SEQ ID NO: 184830 - DNA, 25 bp, Mus musculus
aggaaactaatctctcggagttata

SEQ ID NO: 184831 - DNA, 25 bp, Mus musculus
aggaaactacatcgctctggtaaat

SEQ ID NO: 184832 - DNA, 25 bp, Mus musculus
aggaaactacatggctctggtaaat

SEQ ID NO: 184833 - DNA, 25 bp, Mus musculus
aggaaactatccagccaaatacttt

SEQ ID NO: 184834 - DNA, 25 bp, Mus musculus
aggaaactatcctgccaaatacttt

SEQ ID NO: 184835 - DNA, 25 bp, Mus musculus
aggaaactcagcagtccgttgactc

SEQ ID NO: 184836 - DNA, 25 bp, Mus musculus
aggaaactcagctgtccgttgactc

SEQ ID NO: 184837 - DNA, 25 bp, Mus musculus
aggaaactcaggacccgtagtctgt

SEQ ID NO: 184838 - DNA, 25 bp, Mus musculus
aggaaactcaggtcccgtagtctgt

SEQ ID NO: 184839 - DNA, 25 bp, Mus musculus
aggaaactccttcgctgaacagcga

SEQ ID NO: 184840 - DNA, 25 bp, Mus musculus
aggaaactccttggctgaacagcga

SEQ ID NO: 184841 - DNA, 25 bp, Mus musculus
aggaaactcggacgctccggcagct

SEQ ID NO: 184842 - DNA, 25 bp, Mus musculus
aggaaactcggaggctccggcagct

SEQ ID NO: 184843 - DNA, 25 bp, Mus musculus
aggaaactctccatcccaagagatg

SEQ ID NO: 184844 - DNA, 25 bp, Mus musculus
aggaaactctccttcccaagagatg

SEQ ID NO: 184845 - DNA, 25 bp, Mus musculus
aggaaactgatactgcttcctttga

SEQ ID NO: 184846 - DNA, 25 bp, Mus musculus
aggaaactgatagtgcttcctttga

SEQ ID NO: 184847 - DNA, 25 bp, Mus musculus
aggaaactgatgatcttgcaagcaa

SEQ ID NO: 184848 - DNA, 25 bp, Mus musculus
aggaaactgatgttcttgcaagcaa

SEQ ID NO: 184849 - DNA, 25 bp, Mus musculus
aggaaactgccccagtccttggtct

SEQ ID NO: 184850 - DNA, 25 bp, Mus musculus
aggaaactgcccgagtccttggtct

SEQ ID NO: 184851 - DNA, 25 bp, Mus musculus
aggaaactgcttctctattgtgccc

SEQ ID NO: 184852 - DNA, 25 bp, Mus musculus
aggaaactgcttgtctattgtgccc

SEQ ID NO: 184853 - DNA, 25 bp, Mus musculus
aggaaactggctctccatgctctct

SEQ ID NO: 184854 - DNA, 25 bp, Mus musculus
aggaaactggctgtccatgctctct

SEQ ID NO: 184855 - DNA, 25 bp, Mus musculus
aggaaactgggcagtctggcaaagc

SEQ ID NO: 184856 - DNA, 25 bp, Mus musculus
aggaaactgggctgtctggcaaagc

SEQ ID NO: 184857 - DNA, 25 bp, Mus musculus
aggaaactggttatagcaccaatgt

SEQ ID NO: 184858 - DNA, 25 bp, Mus musculus
aggaaactggttttagcaccaatgt

SEQ ID NO: 184859 - DNA, 25 bp, Mus musculus
aggaaactgtcaaattctctcttgg

SEQ ID NO: 184860 - DNA, 25 bp, Mus musculus
aggaaactgtcatattctctcttgg

SEQ ID NO: 184861 - DNA, 25 bp, Mus musculus
aggaaactgtccagaaccgggcaca

SEQ ID NO: 184862 - DNA, 25 bp, Mus musculus
aggaaactgtcctgaaccgggcaca

SEQ ID NO: 184863 - DNA, 25 bp, Mus musculus
aggaaacttagccaccatgtcccta

SEQ ID NO: 184864 - DNA, 25 bp, Mus musculus
aggaaacttagcgaccatgtcccta

SEQ ID NO: 184865 - DNA, 25 bp, Mus musculus
aggaaacttcaaactggaacttatc

SEQ ID NO: 184866 - DNA, 25 bp, Mus musculus
aggaaacttcaatctggaacttatc

SEQ ID NO: 184867 - DNA, 25 bp, Mus musculus
aggaaacttggaatcaacactcttt

SEQ ID NO: 184868 - DNA, 25 bp, Mus musculus
aggaaacttggattcaacactcttt

SEQ ID NO: 184869 - DNA, 25 bp, Mus musculus
aggaaacttggtactgtggacaggc

SEQ ID NO: 184870 - DNA, 25 bp, Mus musculus
aggaaacttggttctgtggacaggc

SEQ ID NO: 184871 - DNA, 25 bp, Mus musculus
aggaaacttgtacccctggagtgat

SEQ ID NO: 184872 - DNA, 25 bp, Mus musculus
aggaaacttgtagccctggagtgat

SEQ ID NO: 184873 - DNA, 25 bp, Mus musculus
aggaaagacacacgccaacctgagg

SEQ ID NO: 184874 - DNA, 25 bp, Mus musculus
aggaaagacacaggccaacctgagg

SEQ ID NO: 184875 - DNA, 25 bp, Mus musculus
aggaaagaccctaggagcttgtgca

SEQ ID NO: 184876 - DNA, 25 bp, Mus musculus
aggaaagacccttggagcttgtgca

SEQ ID NO: 184877 - DNA, 25 bp, Mus musculus
aggaaagactcaagcttccactcac

SEQ ID NO: 184878 - DNA, 25 bp, Mus musculus
aggaaagactcatgcttccactcac

SEQ ID NO: 184879 - DNA, 25 bp, Mus musculus
aggaaagacttacctgaataccaga

SEQ ID NO: 184880 - DNA, 25 bp, Mus musculus
aggaaagacttagctgaataccaga

SEQ ID NO: 184881 - DNA, 25 bp, Mus musculus
aggaaagagatcagccctggcctca

SEQ ID NO: 184882 - DNA, 25 bp, Mus musculus
aggaaagagatctgccctggcctca

SEQ ID NO: 184883 - DNA, 25 bp, Mus musculus
aggaaagagtatcgcttccctggct

SEQ ID NO: 184884 - DNA, 25 bp, Mus musculus
aggaaagagtatggcttccctggct

SEQ ID NO: 184885 - DNA, 25 bp, Mus musculus
aggaaagatatgcttctcggcctca

SEQ ID NO: 184886 - DNA, 25 bp, Mus musculus
aggaaagatatggttctcggcctca

SEQ ID NO: 184887 - DNA, 25 bp, Mus musculus
aggaaagcaacaagggctgagccat

SEQ ID NO: 184888 - DNA, 25 bp, Mus musculus
aggaaagcaacatgggctgagccat

SEQ ID NO: 184889 - DNA, 25 bp, Mus musculus
aggaaagcacaaccagcgtggccaa

SEQ ID NO: 184890 - DNA, 25 bp, Mus musculus
aggaaagcacaagcagcgtggccaa

SEQ ID NO: 184891 - DNA, 25 bp, Mus musculus
aggaaagcacttatctcacatagag

SEQ ID NO: 184892 - DNA, 25 bp, Mus musculus
aggaaagcacttttctcacatagag

SEQ ID NO: 184893 - DNA, 25 bp, Mus musculus
aggaaagcaggtcactctcgggtcc

SEQ ID NO: 184894 - DNA, 25 bp, Mus musculus
aggaaagcaggtgactctcgggtcc

SEQ ID NO: 184895 - DNA, 25 bp, Mus musculus
aggaaagcatgaagctccaagtggt

SEQ ID NO: 184896 - DNA, 25 bp, Mus musculus
aggaaagcatgatgctccaagtggt

SEQ ID NO: 184897 - DNA, 25 bp, Mus musculus
aggaaagcatgcctgtgccacctca

SEQ ID NO: 184898 - DNA, 25 bp, Mus musculus
aggaaagcatgcgtgtgccacctca

SEQ ID NO: 184899 - DNA, 25 bp, Mus musculus
aggaaagccacaagctccgagtgca

SEQ ID NO: 184900 - DNA, 25 bp, Mus musculus
aggaaagccacatgctccgagtgca

SEQ ID NO: 184901 - DNA, 25 bp, Mus musculus
aggaaagccagtcgtgccgaagcac

SEQ ID NO: 184902 - DNA, 25 bp, Mus musculus
aggaaagccagtggtgccgaagcac

SEQ ID NO: 184903 - DNA, 25 bp, Mus musculus
aggaaagccctccttcatgggtctg

SEQ ID NO: 184904 - DNA, 25 bp, Mus musculus
aggaaagccctcgttcatgggtctg

SEQ ID NO: 184905 - DNA, 25 bp, Mus musculus
aggaaagccgcccagaatctgagaa

SEQ ID NO: 184906 - DNA, 25 bp, Mus musculus
aggaaagccgccgagaatctgagaa

SEQ ID NO: 184907 - DNA, 25 bp, Mus musculus
aggaaagccttcagtctttcagaga

SEQ ID NO: 184908 - DNA, 25 bp, Mus musculus
aggaaagccttctgtctttcagaga

SEQ ID NO: 184909 - DNA, 25 bp, Mus musculus
aggaaagctaacagccactttgtaa

SEQ ID NO: 184910 - DNA, 25 bp, Mus musculus
aggaaagctaactgccactttgtaa

SEQ ID NO: 184911 - DNA, 25 bp, Mus musculus
aggaaagctactcatgtggtacttg

SEQ ID NO: 184912 - DNA, 25 bp, Mus musculus
aggaaagctactgatgtggtacttg

SEQ ID NO: 184913 - DNA, 25 bp, Mus musculus
aggaaagctcaccttgcttctggca

SEQ ID NO: 184914 - DNA, 25 bp, Mus musculus
aggaaagctcacgttgcttctggca

SEQ ID NO: 184915 - DNA, 25 bp, Mus musculus
aggaaagctctaccagtctccaggg

SEQ ID NO: 184916 - DNA, 25 bp, Mus musculus
aggaaagctctagcagtctccaggg

SEQ ID NO: 184917 - DNA, 25 bp, Mus musculus
aggaaagctgccagtttgccatggt

SEQ ID NO: 184918 - DNA, 25 bp, Mus musculus
aggaaagctgcctgtttgccatggt

SEQ ID NO: 184919 - DNA, 25 bp, Mus musculus
aggaaagctggcaacttctatgtgc

SEQ ID NO: 184920 - DNA, 25 bp, Mus musculus
aggaaagctggctacttctatgtgc

SEQ ID NO: 184921 - DNA, 25 bp, Mus musculus
aggaaagcttctagccctttatcct

SEQ ID NO: 184922 - DNA, 25 bp, Mus musculus
aggaaagcttcttgccctttatcct

SEQ ID NO: 184923 - DNA, 25 bp, Mus musculus
aggaaagcttggatgcagccctact

SEQ ID NO: 184924 - DNA, 25 bp, Mus musculus
aggaaagcttggttgcagccctact

SEQ ID NO: 184925 - DNA, 25 bp, Mus musculus
aggaaaggaacaactcccgcaagct

SEQ ID NO: 184926 - DNA, 25 bp, Mus musculus
aggaaaggaacatctcccgcaagct

SEQ ID NO: 184927 - DNA, 25 bp, Mus musculus
aggaaaggaaggctaccagactcca

SEQ ID NO: 184928 - DNA, 25 bp, Mus musculus
aggaaaggaagggtaccagactcca

SEQ ID NO: 184929 - DNA, 25 bp, Mus musculus
aggaaaggacgccagctgacaacag

SEQ ID NO: 184930 - DNA, 25 bp, Mus musculus
aggaaaggacgcgagctgacaacag

SEQ ID NO: 184931 - DNA, 25 bp, Mus musculus
aggaaaggactcaccctgcattgga

SEQ ID NO: 184932 - DNA, 25 bp, Mus musculus
aggaaaggactctccctgcattgga

SEQ ID NO: 184933 - DNA, 25 bp, Mus musculus
aggaaaggcaaccaacatctggatc

SEQ ID NO: 184934 - DNA, 25 bp, Mus musculus
aggaaaggcaacgaacatctggatc

SEQ ID NO: 184935 - DNA, 25 bp, Mus musculus
aggaaaggccagactgtgtgtaaat

SEQ ID NO: 184936 - DNA, 25 bp, Mus musculus
aggaaaggccagtctgtgtgtaaat

SEQ ID NO: 184937 - DNA, 25 bp, Mus musculus
aggaaaggcgccatcacacgtgggc

SEQ ID NO: 184938 - DNA, 25 bp, Mus musculus
aggaaaggcgccttcacacgtgggc

SEQ ID NO: 184939 - DNA, 25 bp, Mus musculus
aggaaaggctagacccattcctcct

SEQ ID NO: 184940 - DNA, 25 bp, Mus musculus
aggaaaggctagtcccattcctcct

SEQ ID NO: 184941 - DNA, 25 bp, Mus musculus
aggaaaggctatagagacagtcccc

SEQ ID NO: 184942 - DNA, 25 bp, Mus musculus
aggaaaggctattgagacagtcccc

SEQ ID NO: 184943 - DNA, 25 bp, Mus musculus
aggaaaggcttcctatctgttttga

SEQ ID NO: 184944 - DNA, 25 bp, Mus musculus
aggaaaggcttcgtatctgttttga

SEQ ID NO: 184945 - DNA, 25 bp, Mus musculus
aggaaaggcttgctctgtgtctgct

SEQ ID NO: 184946 - DNA, 25 bp, Mus musculus
aggaaaggcttggtctgtgtctgct

SEQ ID NO: 184947 - DNA, 25 bp, Mus musculus
aggaaagggctcatcgcctagcaga

SEQ ID NO: 184948 - DNA, 25 bp, Mus musculus
aggaaagggctcttcgcctagcaga

SEQ ID NO: 184949 - DNA, 25 bp, Mus musculus
aggaaagggcttcgccagtgtccca

SEQ ID NO: 184950 - DNA, 25 bp, Mus musculus
aggaaagggcttggccagtgtccca

SEQ ID NO: 184951 - DNA, 25 bp, Mus musculus
aggaaaggtgacaagcccttctcgt

SEQ ID NO: 184952 - DNA, 25 bp, Mus musculus
aggaaaggtgactagcccttctcgt

SEQ ID NO: 184953 - DNA, 25 bp, Mus musculus
aggaaagtacctacaatgatcagag

SEQ ID NO: 184954 - DNA, 25 bp, Mus musculus
aggaaagtaccttcaatgatcagag

SEQ ID NO: 184955 - DNA, 25 bp, Mus musculus
aggaaagtcacccagacacctctgc

SEQ ID NO: 184956 - DNA, 25 bp, Mus musculus
aggaaagtcaccgagacacctctgc

SEQ ID NO: 184957 - DNA, 25 bp, Mus musculus
aggaaagtcccacgatcagaagaaa

SEQ ID NO: 184958 - DNA, 25 bp, Mus musculus
aggaaagtcccaggatcagaagaaa

SEQ ID NO: 184959 - DNA, 25 bp, Mus musculus
aggaaagtccgtctctgctgacagc

SEQ ID NO: 184960 - DNA, 25 bp, Mus musculus
aggaaagtccgtgtctgctgacagc

SEQ ID NO: 184961 - DNA, 25 bp, Mus musculus
aggaaagtctttctgccataaggaa

SEQ ID NO: 184962 - DNA, 25 bp, Mus musculus
aggaaagtctttgtgccataaggaa

SEQ ID NO: 184963 - DNA, 25 bp, Mus musculus
aggaaagtgctcactttgttataga

SEQ ID NO: 184964 - DNA, 25 bp, Mus musculus
aggaaagtgctctctttgttataga

SEQ ID NO: 184965 - DNA, 25 bp, Mus musculus
aggaaagtgctgacacctctctccg

SEQ ID NO: 184966 - DNA, 25 bp, Mus musculus
aggaaagtgctgtcacctctctccg

SEQ ID NO: 184967 - DNA, 25 bp, Mus musculus
aggaaagtggatccaaaccccagtg

SEQ ID NO: 184968 - DNA, 25 bp, Mus musculus
aggaaagtggatgcaaaccccagtg

SEQ ID NO: 184969 - DNA, 25 bp, Mus musculus
aggaaagtgtgtagctcaagaccag

SEQ ID NO: 184970 - DNA, 25 bp, Mus musculus
aggaaagtgtgttgctcaagaccag

SEQ ID NO: 184971 - DNA, 25 bp, Mus musculus
aggaaagttcctcagttgccaccgg

SEQ ID NO: 184972 - DNA, 25 bp, Mus musculus
aggaaagttcctgagttgccaccgg

SEQ ID NO: 184973 - DNA, 25 bp, Mus musculus
aggaaagtttccagtctccgttctg

SEQ ID NO: 184974 - DNA, 25 bp, Mus musculus
aggaaagtttcctgtctccgttctg

SEQ ID NO: 184975 - DNA, 25 bp, Mus musculus
aggaaataattaaccatctgaaaag

SEQ ID NO: 184976 - DNA, 25 bp, Mus musculus
aggaaataattatccatctgaaaag

SEQ ID NO: 184977 - DNA, 25 bp, Mus musculus
aggaaatacaaacatgtccattcac

SEQ ID NO: 184978 - DNA, 25 bp, Mus musculus
aggaaatacaaagatgtccattcac

SEQ ID NO: 184979 - DNA, 25 bp, Mus musculus
aggaaatacaccacctgcttcttca

SEQ ID NO: 184980 - DNA, 25 bp, Mus musculus
aggaaatacacctcctgcttcttca

SEQ ID NO: 184981 - DNA, 25 bp, Mus musculus
aggaaatacagtcagccaagtggct

SEQ ID NO: 184982 - DNA, 25 bp, Mus musculus
aggaaatacagtgagccaagtggct

SEQ ID NO: 184983 - DNA, 25 bp, Mus musculus
aggaaatacatgacccctgttcatt

SEQ ID NO: 184984 - DNA, 25 bp, Mus musculus
aggaaatacatgtcccctgttcatt

SEQ ID NO: 184985 - DNA, 25 bp, Mus musculus
aggaaatactttcacctgctctgtg

SEQ ID NO: 184986 - DNA, 25 bp, Mus musculus
aggaaatactttgacctgctctgtg

SEQ ID NO: 184987 - DNA, 25 bp, Mus musculus
aggaaatagcctccttgcctgacac

SEQ ID NO: 184988 - DNA, 25 bp, Mus musculus
aggaaatagcctgcttgcctgacac

SEQ ID NO: 184989 - DNA, 25 bp, Mus musculus
aggaaataggcccacaccaccgcgt

SEQ ID NO: 184990 - DNA, 25 bp, Mus musculus
aggaaataggccgacaccaccgcgt

SEQ ID NO: 184991 - DNA, 25 bp, Mus musculus
aggaaatattctataatccagttgc

SEQ ID NO: 184992 - DNA, 25 bp, Mus musculus
aggaaatattctttaatccagttgc

SEQ ID NO: 184993 - DNA, 25 bp, Mus musculus
aggaaatcaaggacatttttccctg

SEQ ID NO: 184994 - DNA, 25 bp, Mus musculus
aggaaatcaaggtcatttttccctg

SEQ ID NO: 184995 - DNA, 25 bp, Mus musculus
aggaaatccaggagtatctgattac

SEQ ID NO: 184996 - DNA, 25 bp, Mus musculus
aggaaatccaggcttgcctgagccg

SEQ ID NO: 184997 - DNA, 25 bp, Mus musculus
aggaaatccagggttgcctgagccg

SEQ ID NO: 184998 - DNA, 25 bp, Mus musculus
aggaaatccaggtgtatctgattac

SEQ ID NO: 184999 - DNA, 25 bp, Mus musculus
aggaaatcctaactacccacatgag

SEQ ID NO: 185000 - DNA, 25 bp, Mus musculus
aggaaatcctaagtacccacatgag

SEQ ID NO: 185001 - DNA, 25 bp, Mus musculus
aggaaatcctctcccaatgtgggtt

SEQ ID NO: 185002 - DNA, 25 bp, Mus musculus
aggaaatcctctgccaatgtgggtt

SEQ ID NO: 185003 - DNA, 25 bp, Mus musculus
aggaaatccttacgatgctgatgac

SEQ ID NO: 185004 - DNA, 25 bp, Mus musculus
aggaaatccttaggatgctgatgac

SEQ ID NO: 185005 - DNA, 25 bp, Mus musculus
aggaaatcgagcagaccccatacaa

SEQ ID NO: 185006 - DNA, 25 bp, Mus musculus
aggaaatcgagctgaccccatacaa

SEQ ID NO: 185007 - DNA, 25 bp, Mus musculus
aggaaatcgttccttgagcaatttt

SEQ ID NO: 185008 - DNA, 25 bp, Mus musculus
aggaaatcgttcgttgagcaatttt

SEQ ID NO: 185009 - DNA, 25 bp, Mus musculus
aggaaatctatcaccctgtcatgtg

SEQ ID NO: 185010 - DNA, 25 bp, Mus musculus
aggaaatctatctccctgtcatgtg

SEQ ID NO: 185011 - DNA, 25 bp, Mus musculus
aggaaatctcccattcctgtcgtgt

SEQ ID NO: 185012 - DNA, 25 bp, Mus musculus
aggaaatctccctttcctgtcgtgt

SEQ ID NO: 185013 - DNA, 25 bp, Mus musculus
aggaaatctctgaactcttgactta

SEQ ID NO: 185014 - DNA, 25 bp, Mus musculus
aggaaatctctgtactcttgactta

SEQ ID NO: 185015 - DNA, 25 bp, Mus musculus
aggaaatgaagcctctgccttgcat

SEQ ID NO: 185016 - DNA, 25 bp, Mus musculus
aggaaatgaagcgtctgccttgcat

SEQ ID NO: 185017 - DNA, 25 bp, Mus musculus
aggaaatgaattacccctctcccag

SEQ ID NO: 185018 - DNA, 25 bp, Mus musculus
aggaaatgaatttcccctctcccag

SEQ ID NO: 185019 - DNA, 25 bp, Mus musculus
aggaaatgacatccgctggtcctct

SEQ ID NO: 185020 - DNA, 25 bp, Mus musculus
aggaaatgacatgcgctggtcctct

SEQ ID NO: 185021 - DNA, 25 bp, Mus musculus
aggaaatgagaaccgcctgctgctt

SEQ ID NO: 185022 - DNA, 25 bp, Mus musculus
aggaaatgagaagcgcctgctgctt

SEQ ID NO: 185023 - DNA, 25 bp, Mus musculus
aggaaatgcaccacggagaaattac

SEQ ID NO: 185024 - DNA, 25 bp, Mus musculus
aggaaatgcacctcggagaaattac

SEQ ID NO: 185025 - DNA, 25 bp, Mus musculus
aggaaatgccttcttctgagcttga

SEQ ID NO: 185026 - DNA, 25 bp, Mus musculus
aggaaatgccttgttctgagcttga

SEQ ID NO: 185027 - DNA, 25 bp, Mus musculus
aggaaatgctaaccccaggaagaca

SEQ ID NO: 185028 - DNA, 25 bp, Mus musculus
aggaaatgctaagcccaggaagaca

SEQ ID NO: 185029 - DNA, 25 bp, Mus musculus
aggaaatgctcacgtggtgccagcc

SEQ ID NO: 185030 - DNA, 25 bp, Mus musculus
aggaaatgctcaggtggtgccagcc

SEQ ID NO: 185031 - DNA, 25 bp, Mus musculus
aggaaatgctcgatagcctgcaagg

SEQ ID NO: 185032 - DNA, 25 bp, Mus musculus
aggaaatgctcgttagcctgcaagg

SEQ ID NO: 185033 - DNA, 25 bp, Mus musculus
aggaaatgctgacccaacccttaga

SEQ ID NO: 185034 - DNA, 25 bp, Mus musculus
aggaaatgctgagccaacccttaga

SEQ ID NO: 185035 - DNA, 25 bp, Mus musculus
aggaaatggcaactcagctcgcctt

SEQ ID NO: 185036 - DNA, 25 bp, Mus musculus
aggaaatggcaagtcagctcgcctt

SEQ ID NO: 185037 - DNA, 25 bp, Mus musculus
aggaaatggcagacatgctttcttc

SEQ ID NO: 185038 - DNA, 25 bp, Mus musculus
aggaaatggcagtcatgctttcttc

SEQ ID NO: 185039 - DNA, 25 bp, Mus musculus
aggaaatggcctctgggctcacaaa

SEQ ID NO: 185040 - DNA, 25 bp, Mus musculus
aggaaatggcctgtgggctcacaaa

SEQ ID NO: 185041 - DNA, 25 bp, Mus musculus
aggaaatgggctcgccagatgtctc

SEQ ID NO: 185042 - DNA, 25 bp, Mus musculus
aggaaatgggctggccagatgtctc

SEQ ID NO: 185043 - DNA, 25 bp, Mus musculus
aggaaatgtcccctcgcagagaccc

SEQ ID NO: 185044 - DNA, 25 bp, Mus musculus
aggaaatgtcccgtcgcagagaccc

SEQ ID NO: 185045 - DNA, 25 bp, Mus musculus
aggaaatgtgctactgttttgccag

SEQ ID NO: 185046 - DNA, 25 bp, Mus musculus
aggaaatgtgcttctgttttgccag

SEQ ID NO: 185047 - DNA, 25 bp, Mus musculus
aggaaattgaccaggagcacctcca

SEQ ID NO: 185048 - DNA, 25 bp, Mus musculus
aggaaattgacctggagcacctcca

SEQ ID NO: 185049 - DNA, 25 bp, Mus musculus
aggaaattgtccagcctttaactct

SEQ ID NO: 185050 - DNA, 25 bp, Mus musculus
aggaaattgtcctgcctttaactct

SEQ ID NO: 185051 - DNA, 25 bp, Mus musculus
aggaaatttcatcgtttcacctata

SEQ ID NO: 185052 - DNA, 25 bp, Mus musculus
aggaaatttcatggtttcacctata

SEQ ID NO: 185053 - DNA, 25 bp, Mus musculus
aggaaatttctgagatcttctattc

SEQ ID NO: 185054 - DNA, 25 bp, Mus musculus
aggaaatttctgtgatcttctattc

SEQ ID NO: 185055 - DNA, 25 bp, Mus musculus
aggaaatttcttagtgagcttgact

SEQ ID NO: 185056 - DNA, 25 bp, Mus musculus
aggaaatttctttgtgagcttgact

SEQ ID NO: 185057 - DNA, 25 bp, Mus musculus
aggaaatttgtccatgtgccttcag

SEQ ID NO: 185058 - DNA, 25 bp, Mus musculus
aggaaatttgtcgatgtgccttcag

SEQ ID NO: 185059 - DNA, 25 bp, Mus musculus
aggaaatttttcagcacaggaaaag

SEQ ID NO: 185060 - DNA, 25 bp, Mus musculus
aggaaatttttctgcacaggaaaag

SEQ ID NO: 185061 - DNA, 25 bp, Mus musculus
aggaaattttttcctcttgaagagg

SEQ ID NO: 185062 - DNA, 25 bp, Mus musculus
aggaaattttttgctcttgaagagg

SEQ ID NO: 185063 - DNA, 25 bp, Mus musculus
aggaacaacattctcttctttcttt

SEQ ID NO: 185064 - DNA, 25 bp, Mus musculus
aggaacaacattgtcttctttcttt

SEQ ID NO: 185065 - DNA, 25 bp, Mus musculus
aggaacaactcaactgccttgcagt

SEQ ID NO: 185066 - DNA, 25 bp, Mus musculus
aggaacaactcatctgccttgcagt

SEQ ID NO: 185067 - DNA, 25 bp, Mus musculus
aggaacaactctactgtcctttcag

SEQ ID NO: 185068 - DNA, 25 bp, Mus musculus
aggaacaactcttctgtcctttcag

SEQ ID NO: 185069 - DNA, 25 bp, Mus musculus
aggaacaacttcacagcactttaca

SEQ ID NO: 185070 - DNA, 25 bp, Mus musculus
aggaacaacttctcagcactttaca

SEQ ID NO: 185071 - DNA, 25 bp, Mus musculus
aggaacaagaggcaggcaagcatct

SEQ ID NO: 185072 - DNA, 25 bp, Mus musculus
aggaacaagagggaggcaagcatct

SEQ ID NO: 185073 - DNA, 25 bp, Mus musculus
aggaacaagttcacccgctgtttgg

SEQ ID NO: 185074 - DNA, 25 bp, Mus musculus
aggaacaagttccaggctgagcctc

SEQ ID NO: 185075 - DNA, 25 bp, Mus musculus
aggaacaagttcgaggctgagcctc

SEQ ID NO: 185076 - DNA, 25 bp, Mus musculus
aggaacaagttctcccgctgtttgg

SEQ ID NO: 185077 - DNA, 25 bp, Mus musculus
aggaacacacaccaacattagacag

SEQ ID NO: 185078 - DNA, 25 bp, Mus musculus
aggaacacacacgaacattagacag

SEQ ID NO: 185079 - DNA, 25 bp, Mus musculus
aggaacacactcacacgtgcatgcg

SEQ ID NO: 185080 - DNA, 25 bp, Mus musculus
aggaacacactctcacgtgcatgcg

SEQ ID NO: 185081 - DNA, 25 bp, Mus musculus
aggaacacaggaatgagctgacctc

SEQ ID NO: 185082 - DNA, 25 bp, Mus musculus
aggaacacaggattgagctgacctc

SEQ ID NO: 185083 - DNA, 25 bp, Mus musculus
aggaacacatgcacgatggcaggtt

SEQ ID NO: 185084 - DNA, 25 bp, Mus musculus
aggaacacatgctcgatggcaggtt

SEQ ID NO: 185085 - DNA, 25 bp, Mus musculus
aggaacacatggcagaactaggatt

SEQ ID NO: 185086 - DNA, 25 bp, Mus musculus
aggaacacatgggagaactaggatt

SEQ ID NO: 185087 - DNA, 25 bp, Mus musculus
aggaacaccccgaacttgttgcagc

SEQ ID NO: 185088 - DNA, 25 bp, Mus musculus
aggaacaccccgtacttgttgcagc

SEQ ID NO: 185089 - DNA, 25 bp, Mus musculus
aggaacaccctgctggctgacgaga

SEQ ID NO: 185090 - DNA, 25 bp, Mus musculus
aggaacaccctggtggctgacgaga

SEQ ID NO: 185091 - DNA, 25 bp, Mus musculus
aggaacaccgtcacgctgctggagg

SEQ ID NO: 185092 - DNA, 25 bp, Mus musculus
aggaacaccgtctcgctgctggagg

SEQ ID NO: 185093 - DNA, 25 bp, Mus musculus
aggaacaccttgactcagatttgag

SEQ ID NO: 185094 - DNA, 25 bp, Mus musculus
aggaacaccttgtctcagatttgag

SEQ ID NO: 185095 - DNA, 25 bp, Mus musculus
aggaacacgggcctctctggctttg

SEQ ID NO: 185096 - DNA, 25 bp, Mus musculus
aggaacacgggcgtctctggctttg

SEQ ID NO: 185097 - DNA, 25 bp, Mus musculus
aggaacactaggctgcttggtttct

SEQ ID NO: 185098 - DNA, 25 bp, Mus musculus
aggaacactagggtgcttggtttct

SEQ ID NO: 185099 - DNA, 25 bp, Mus musculus
aggaacactgagcacccatactaag

SEQ ID NO: 185100 - DNA, 25 bp, Mus musculus
aggaacactgaggacccatactaag

SEQ ID NO: 185101 - DNA, 25 bp, Mus musculus
aggaacactgtcactagcacactgg

SEQ ID NO: 185102 - DNA, 25 bp, Mus musculus
aggaacactgtctctagcacactgg

SEQ ID NO: 185103 - DNA, 25 bp, Mus musculus
aggaacactgttactttgcccatgt

SEQ ID NO: 185104 - DNA, 25 bp, Mus musculus
aggaacactgtttctttgcccatgt

SEQ ID NO: 185105 - DNA, 25 bp, Mus musculus
aggaacacttcactgcgcagtgagt

SEQ ID NO: 185106 - DNA, 25 bp, Mus musculus
aggaacacttcagtgcgcagtgagt

SEQ ID NO: 185107 - DNA, 25 bp, Mus musculus
aggaacagaagaccccacaatatcg

SEQ ID NO: 185108 - DNA, 25 bp, Mus musculus
aggaacagaagagcccacaatatcg

SEQ ID NO: 185109 - DNA, 25 bp, Mus musculus
aggaacagaggactcccgtggttct

SEQ ID NO: 185110 - DNA, 25 bp, Mus musculus
aggaacagaggagtcccgtggttct

SEQ ID NO: 185111 - DNA, 25 bp, Mus musculus
aggaacagatccctgggtttgcctc

SEQ ID NO: 185112 - DNA, 25 bp, Mus musculus
aggaacagatccgtgggtttgcctc

SEQ ID NO: 185113 - DNA, 25 bp, Mus musculus
aggaacagccccacgtgcggacaga

SEQ ID NO: 185114 - DNA, 25 bp, Mus musculus
aggaacagcccctcgtgcggacaga

SEQ ID NO: 185115 - DNA, 25 bp, Mus musculus
aggaacagccctcaactcacacgtg

SEQ ID NO: 185116 - DNA, 25 bp, Mus musculus
aggaacagccctgaactcacacgtg

SEQ ID NO: 185117 - DNA, 25 bp, Mus musculus
aggaacagcctgacgcatgcccatc

SEQ ID NO: 185118 - DNA, 25 bp, Mus musculus
aggaacagcctgtcgcatgcccatc

SEQ ID NO: 185119 - DNA, 25 bp, Mus musculus
aggaacagcgcaccggccttatcta

SEQ ID NO: 185120 - DNA, 25 bp, Mus musculus
aggaacagcgcagcggccttatcta

SEQ ID NO: 185121 - DNA, 25 bp, Mus musculus
aggaacagcgttcgtcattcacaag

SEQ ID NO: 185122 - DNA, 25 bp, Mus musculus
aggaacagcgttggtcattcacaag

SEQ ID NO: 185123 - DNA, 25 bp, Mus musculus
aggaacagctaaatccgcaggccag

SEQ ID NO: 185124 - DNA, 25 bp, Mus musculus
aggaacagctaattccgcaggccag

SEQ ID NO: 185125 - DNA, 25 bp, Mus musculus
aggaacagctcaaggccgtgcatga

SEQ ID NO: 185126 - DNA, 25 bp, Mus musculus
aggaacagctcatggccgtgcatga

SEQ ID NO: 185127 - DNA, 25 bp, Mus musculus
aggaacaggaagcactctgcctaga

SEQ ID NO: 185128 - DNA, 25 bp, Mus musculus
aggaacaggaaggactctgcctaga

SEQ ID NO: 185129 - DNA, 25 bp, Mus musculus
aggaacaggactcagcgcctctgct

SEQ ID NO: 185130 - DNA, 25 bp, Mus musculus
aggaacaggactgagcgcctctgct

SEQ ID NO: 185131 - DNA, 25 bp, Mus musculus
aggaacaggccgacatgctagatga

SEQ ID NO: 185132 - DNA, 25 bp, Mus musculus
aggaacaggccgtcatgctagatga

SEQ ID NO: 185133 - DNA, 25 bp, Mus musculus
aggaacaggcgtctcttcaagtctt

SEQ ID NO: 185134 - DNA, 25 bp, Mus musculus
aggaacaggcgtgtcttcaagtctt

SEQ ID NO: 185135 - DNA, 25 bp, Mus musculus
aggaacagtacgatgctgagctgca

SEQ ID NO: 185136 - DNA, 25 bp, Mus musculus
aggaacagtacgttgctgagctgca

SEQ ID NO: 185137 - DNA, 25 bp, Mus musculus
aggaacagtcaaccttccagtcccg

SEQ ID NO: 185138 - DNA, 25 bp, Mus musculus
aggaacagtcaagcttccagtcccg

SEQ ID NO: 185139 - DNA, 25 bp, Mus musculus
aggaacagtccaaggccttctcagg

SEQ ID NO: 185140 - DNA, 25 bp, Mus musculus
aggaacagtccatggccttctcagg

SEQ ID NO: 185141 - DNA, 25 bp, Mus musculus
aggaacagtgatcgctcaggagacc

SEQ ID NO: 185142 - DNA, 25 bp, Mus musculus
aggaacagtgatggctcaggagacc

SEQ ID NO: 185143 - DNA, 25 bp, Mus musculus
aggaacagtttgcttggagacattt

SEQ ID NO: 185144 - DNA, 25 bp, Mus musculus
aggaacagtttggttggagacattt

SEQ ID NO: 185145 - DNA, 25 bp, Mus musculus
aggaacataactcccttcatcaagg

SEQ ID NO: 185146 - DNA, 25 bp, Mus musculus
aggaacataactgccttcatcaagg

SEQ ID NO: 185147 - DNA, 25 bp, Mus musculus
aggaacatcctccttctctagctca

SEQ ID NO: 185148 - DNA, 25 bp, Mus musculus
aggaacatcctcgttctctagctca

SEQ ID NO: 185149 - DNA, 25 bp, Mus musculus
aggaacatgactcctggactgggct

SEQ ID NO: 185150 - DNA, 25 bp, Mus musculus
aggaacatgactgctggactgggct

SEQ ID NO: 185151 - DNA, 25 bp, Mus musculus
aggaacatgcatcgccctcaggatg

SEQ ID NO: 185152 - DNA, 25 bp, Mus musculus
aggaacatgcatggccctcaggatg

SEQ ID NO: 185153 - DNA, 25 bp, Mus musculus
aggaacatgcggctgagcagacttt

SEQ ID NO: 185154 - DNA, 25 bp, Mus musculus
aggaacatgcgggtgagcagacttt

SEQ ID NO: 185155 - DNA, 25 bp, Mus musculus
aggaacatgcgtccctatctgtgtg

SEQ ID NO: 185156 - DNA, 25 bp, Mus musculus
aggaacatgcgtgcctatctgtgtg

SEQ ID NO: 185157 - DNA, 25 bp, Mus musculus
aggaacatgctgatgggacaccaac

SEQ ID NO: 185158 - DNA, 25 bp, Mus musculus
aggaacatgctgttgggacaccaac

SEQ ID NO: 185159 - DNA, 25 bp, Mus musculus
aggaacatgggaatgccagctgaat

SEQ ID NO: 185160 - DNA, 25 bp, Mus musculus
aggaacatgggattgccagctgaat

SEQ ID NO: 185161 - DNA, 25 bp, Mus musculus
aggaacatgggcagtccccgaccaa

SEQ ID NO: 185162 - DNA, 25 bp, Mus musculus
aggaacatgggctgtccccgaccaa

SEQ ID NO: 185163 - DNA, 25 bp, Mus musculus
aggaacatgtctcctccactgagac

SEQ ID NO: 185164 - DNA, 25 bp, Mus musculus
aggaacatgtctgctccactgagac

SEQ ID NO: 185165 - DNA, 25 bp, Mus musculus
aggaacattccaagcctctgctggt

SEQ ID NO: 185166 - DNA, 25 bp, Mus musculus
aggaacattccatgcctctgctggt

SEQ ID NO: 185167 - DNA, 25 bp, Mus musculus
aggaacatttgtccctcgtgtgcac

SEQ ID NO: 185168 - DNA, 25 bp, Mus musculus
aggaacatttgtgcctcgtgtgcac

SEQ ID NO: 185169 - DNA, 25 bp, Mus musculus
aggaaccaaagcactcatggatgaa

SEQ ID NO: 185170 - DNA, 25 bp, Mus musculus
aggaaccaaagctctcatggatgaa

SEQ ID NO: 185171 - DNA, 25 bp, Mus musculus
aggaaccaagacaggtcgctgcatc

SEQ ID NO: 185172 - DNA, 25 bp, Mus musculus
aggaaccaagactggtcgctgcatc

SEQ ID NO: 185173 - DNA, 25 bp, Mus musculus
aggaaccaatctctctaagctttag

SEQ ID NO: 185174 - DNA, 25 bp, Mus musculus
aggaaccaatctgtctaagctttag

SEQ ID NO: 185175 - DNA, 25 bp, Mus musculus
aggaaccacactacagtgaccactt

SEQ ID NO: 185176 - DNA, 25 bp, Mus musculus
aggaaccacacttcagtgaccactt

SEQ ID NO: 185177 - DNA, 25 bp, Mus musculus
aggaaccacagcatagcagcccatc

SEQ ID NO: 185178 - DNA, 25 bp, Mus musculus
aggaaccacagcttagcagcccatc

SEQ ID NO: 185179 - DNA, 25 bp, Mus musculus
aggaaccacatgcatatcaccacac

SEQ ID NO: 185180 - DNA, 25 bp, Mus musculus
aggaaccacatggatatcaccacac

SEQ ID NO: 185181 - DNA, 25 bp, Mus musculus
aggaaccacccacggtagcaagaca

SEQ ID NO: 185182 - DNA, 25 bp, Mus musculus
aggaaccacccagggtagcaagaca

SEQ ID NO: 185183 - DNA, 25 bp, Mus musculus
aggaaccactaacccacgttgatgt

SEQ ID NO: 185184 - DNA, 25 bp, Mus musculus
aggaaccactaagccacgttgatgt

SEQ ID NO: 185185 - DNA, 25 bp, Mus musculus
aggaaccaggcacgctacttcatgc

SEQ ID NO: 185186 - DNA, 25 bp, Mus musculus
aggaaccaggcaggctacttcatgc

SEQ ID NO: 185187 - DNA, 25 bp, Mus musculus
aggaaccagtgaaccctgtcatgtc

SEQ ID NO: 185188 - DNA, 25 bp, Mus musculus
aggaaccagtgatccctgtcatgtc

SEQ ID NO: 185189 - DNA, 25 bp, Mus musculus
aggaaccatcagctgcagtaactgt

SEQ ID NO: 185190 - DNA, 25 bp, Mus musculus
aggaaccatcaggtgcagtaactgt

SEQ ID NO: 185191 - DNA, 25 bp, Mus musculus
aggaaccatgaaaaaagagctactt

SEQ ID NO: 185192 - DNA, 25 bp, Mus musculus
aggaaccatgaataaagagctactt

SEQ ID NO: 185193 - DNA, 25 bp, Mus musculus
aggaaccatgttagcggcctgtgac

SEQ ID NO: 185194 - DNA, 25 bp, Mus musculus
aggaaccatgtttgcggcctgtgac

SEQ ID NO: 185195 - DNA, 25 bp, Mus musculus
aggaaccattgtacgagctttgtac

SEQ ID NO: 185196 - DNA, 25 bp, Mus musculus
aggaaccattgttcgagctttgtac

SEQ ID NO: 185197 - DNA, 25 bp, Mus musculus
aggaacccaaagacctcggcctatg

SEQ ID NO: 185198 - DNA, 25 bp, Mus musculus
aggaacccaaagtcctcggcctatg

SEQ ID NO: 185199 - DNA, 25 bp, Mus musculus
aggaacccaagcctgacctggttat

SEQ ID NO: 185200 - DNA, 25 bp, Mus musculus
aggaacccaagcgtgacctggttat

SEQ ID NO: 185201 - DNA, 25 bp, Mus musculus
aggaacccaccgctagagatggtcg

SEQ ID NO: 185202 - DNA, 25 bp, Mus musculus
aggaacccaccggtagagatggtcg

SEQ ID NO: 185203 - DNA, 25 bp, Mus musculus
aggaacccacgcatgtacagacagt

SEQ ID NO: 185204 - DNA, 25 bp, Mus musculus
aggaacccacgcttgtacagacagt

SEQ ID NO: 185205 - DNA, 25 bp, Mus musculus
aggaacccagatcccaccttctgaa

SEQ ID NO: 185206 - DNA, 25 bp, Mus musculus
aggaacccagatgccaccttctgaa

SEQ ID NO: 185207 - DNA, 25 bp, Mus musculus
aggaacccaggcatctaatgctgat

SEQ ID NO: 185208 - DNA, 25 bp, Mus musculus
aggaacccaggcttctaatgctgat

SEQ ID NO: 185209 - DNA, 25 bp, Mus musculus
aggaacccatctactgttaggaaat

SEQ ID NO: 185210 - DNA, 25 bp, Mus musculus
aggaacccatcttctgttaggaaat

SEQ ID NO: 185211 - DNA, 25 bp, Mus musculus
aggaacccatgcctcatgcttggtc

SEQ ID NO: 185212 - DNA, 25 bp, Mus musculus
aggaacccatgcgtcatgcttggtc

SEQ ID NO: 185213 - DNA, 25 bp, Mus musculus
aggaaccccaaactcaaactgtatg

SEQ ID NO: 185214 - DNA, 25 bp, Mus musculus
aggaaccccaaagtcaaactgtatg

SEQ ID NO: 185215 - DNA, 25 bp, Mus musculus
aggaaccccagcagcggtgtggtcc

SEQ ID NO: 185216 - DNA, 25 bp, Mus musculus
aggaaccccagctgcggtgtggtcc

SEQ ID NO: 185217 - DNA, 25 bp, Mus musculus
aggaacccggatagcctctagatgg

SEQ ID NO: 185218 - DNA, 25 bp, Mus musculus
aggaacccggattgcctctagatgg

SEQ ID NO: 185219 - DNA, 25 bp, Mus musculus
aggaacccgtggacagcgatgaaga

SEQ ID NO: 185220 - DNA, 25 bp, Mus musculus
aggaacccgtggtcagcgatgaaga

SEQ ID NO: 185221 - DNA, 25 bp, Mus musculus
aggaaccctgccagatgcctgaggg

SEQ ID NO: 185222 - DNA, 25 bp, Mus musculus
aggaaccctgcctgatgcctgaggg

SEQ ID NO: 185223 - DNA, 25 bp, Mus musculus
aggaaccctgctaggtattagatga

SEQ ID NO: 185224 - DNA, 25 bp, Mus musculus
aggaaccctgcttggtattagatga

SEQ ID NO: 185225 - DNA, 25 bp, Mus musculus
aggaaccctgtaacacagtggtcct

SEQ ID NO: 185226 - DNA, 25 bp, Mus musculus
aggaaccctgtatcacagtggtcct

SEQ ID NO: 185227 - DNA, 25 bp, Mus musculus
aggaaccgaaagactggccatcaga

SEQ ID NO: 185228 - DNA, 25 bp, Mus musculus
aggaaccgaaagtctggccatcaga

SEQ ID NO: 185229 - DNA, 25 bp, Mus musculus
aggaaccgcacgcagaggctctcag

SEQ ID NO: 185230 - DNA, 25 bp, Mus musculus
aggaaccgcacggagaggctctcag

SEQ ID NO: 185231 - DNA, 25 bp, Mus musculus
aggaaccgcaggcacttactggcgt

SEQ ID NO: 185232 - DNA, 25 bp, Mus musculus
aggaaccgcagggacttactggcgt

SEQ ID NO: 185233 - DNA, 25 bp, Mus musculus
aggaaccgcctgaagtgccgccaac

SEQ ID NO: 185234 - DNA, 25 bp, Mus musculus
aggaaccgcctgtagtgccgccaac

SEQ ID NO: 185235 - DNA, 25 bp, Mus musculus
aggaaccgcgctaggtggtttccag

SEQ ID NO: 185236 - DNA, 25 bp, Mus musculus
aggaaccgcgcttggtggtttccag

SEQ ID NO: 185237 - DNA, 25 bp, Mus musculus
aggaaccgggcgcagcggccaacat

SEQ ID NO: 185238 - DNA, 25 bp, Mus musculus
aggaaccgggcggagcggccaacat

SEQ ID NO: 185239 - DNA, 25 bp, Mus musculus
aggaaccggtggagaccgaccgcat

SEQ ID NO: 185240 - DNA, 25 bp, Mus musculus
aggaaccggtggtgaccgaccgcat

SEQ ID NO: 185241 - DNA, 25 bp, Mus musculus
aggaacctaaacaggcagccgtggt

SEQ ID NO: 185242 - DNA, 25 bp, Mus musculus
aggaacctaaactggcagccgtggt

SEQ ID NO: 185243 - DNA, 25 bp, Mus musculus
aggaacctacctcggtagctcacaa

SEQ ID NO: 185244 - DNA, 25 bp, Mus musculus
aggaacctacctgggtagctcacaa

SEQ ID NO: 185245 - DNA, 25 bp, Mus musculus
aggaacctactgctacatcatgaag

SEQ ID NO: 185246 - DNA, 25 bp, Mus musculus
aggaacctactggtacatcatgaag

SEQ ID NO: 185247 - DNA, 25 bp, Mus musculus
aggaacctaggtataagccacacag

SEQ ID NO: 185248 - DNA, 25 bp, Mus musculus
aggaacctaggtttaagccacacag

SEQ ID NO: 185249 - DNA, 25 bp, Mus musculus
aggaacctattcactaagtgcgcag

SEQ ID NO: 185250 - DNA, 25 bp, Mus musculus
aggaacctattctctaagtgcgcag

SEQ ID NO: 185251 - DNA, 25 bp, Mus musculus
aggaacctcaccagctcatgaggtt

SEQ ID NO: 185252 - DNA, 25 bp, Mus musculus
aggaacctcacctgctcatgaggtt

SEQ ID NO: 185253 - DNA, 25 bp, Mus musculus
aggaacctcagtcacagtctctgca

SEQ ID NO: 185254 - DNA, 25 bp, Mus musculus
aggaacctcagtgacagtctctgca

SEQ ID NO: 185255 - DNA, 25 bp, Mus musculus
aggaacctccccagttgcaaagcag

SEQ ID NO: 185256 - DNA, 25 bp, Mus musculus
aggaacctcccctgttgcaaagcag

SEQ ID NO: 185257 - DNA, 25 bp, Mus musculus
aggaacctcctgagggcaaataaga

SEQ ID NO: 185258 - DNA, 25 bp, Mus musculus
aggaacctcctgtgggcaaataaga

SEQ ID NO: 185259 - DNA, 25 bp, Mus musculus
aggaacctctgaagcccatttatct

SEQ ID NO: 185260 - DNA, 25 bp, Mus musculus
aggaacctctgatgcccatttatct

SEQ ID NO: 185261 - DNA, 25 bp, Mus musculus
aggaacctctgcagacatcattttc

SEQ ID NO: 185262 - DNA, 25 bp, Mus musculus
aggaacctctgctgacatcattttc

SEQ ID NO: 185263 - DNA, 25 bp, Mus musculus
aggaacctgactcgagcctaccata

SEQ ID NO: 185264 - DNA, 25 bp, Mus musculus
aggaacctgactggagcctaccata

SEQ ID NO: 185265 - DNA, 25 bp, Mus musculus
aggaacctgatgagcctgccggaca

SEQ ID NO: 185266 - DNA, 25 bp, Mus musculus
aggaacctgatgtgcctgccggaca

SEQ ID NO: 185267 - DNA, 25 bp, Mus musculus
aggaacctgctactattggagtaaa

SEQ ID NO: 185268 - DNA, 25 bp, Mus musculus
aggaacctgctagtattggagtaaa

SEQ ID NO: 185269 - DNA, 25 bp, Mus musculus
aggaacctgctcctcttgagtggca

SEQ ID NO: 185270 - DNA, 25 bp, Mus musculus
aggaacctgctcgtcttgagtggca

SEQ ID NO: 185271 - DNA, 25 bp, Mus musculus
aggaacctggacatttgtgatgcca

SEQ ID NO: 185272 - DNA, 25 bp, Mus musculus
aggaacctggacttttgtgatgcca

SEQ ID NO: 185273 - DNA, 25 bp, Mus musculus
aggaacctggtcaaggctagctcct

SEQ ID NO: 185274 - DNA, 25 bp, Mus musculus
aggaacctggtctaggctagctcct

SEQ ID NO: 185275 - DNA, 25 bp, Mus musculus
aggaacctgtaaaagcctctctctt

SEQ ID NO: 185276 - DNA, 25 bp, Mus musculus
aggaacctgtaatagcctctctctt

SEQ ID NO: 185277 - DNA, 25 bp, Mus musculus
aggaacctgtgtacacaccggagta

SEQ ID NO: 185278 - DNA, 25 bp, Mus musculus
aggaacctgtgttcacaccggagta

SEQ ID NO: 185279 - DNA, 25 bp, Mus musculus
aggaaccttcgcatcgctatctgat

SEQ ID NO: 185280 - DNA, 25 bp, Mus musculus
aggaaccttcgcttcgctatctgat

SEQ ID NO: 185281 - DNA, 25 bp, Mus musculus
aggaaccttgaacagggctgcttca

SEQ ID NO: 185282 - DNA, 25 bp, Mus musculus
aggaaccttgaagagggctgcttca

SEQ ID NO: 185283 - DNA, 25 bp, Mus musculus
aggaaccttggaccctggtgcccca

SEQ ID NO: 185284 - DNA, 25 bp, Mus musculus
aggaaccttggacctcaggcacact

SEQ ID NO: 185285 - DNA, 25 bp, Mus musculus
aggaaccttggactgtacaaatgtt

SEQ ID NO: 185286 - DNA, 25 bp, Mus musculus
aggaaccttggagcctggtgcccca

SEQ ID NO: 185287 - DNA, 25 bp, Mus musculus
aggaaccttggagctcaggcacact

SEQ ID NO: 185288 - DNA, 25 bp, Mus musculus
aggaaccttggagtgtacaaatgtt

SEQ ID NO: 185289 - DNA, 25 bp, Mus musculus
aggaacctttgtcgcagtctttcag

SEQ ID NO: 185290 - DNA, 25 bp, Mus musculus
aggaacctttgtggcagtctttcag

SEQ ID NO: 185291 - DNA, 25 bp, Mus musculus
aggaacgaccgcaagacttaagtgt

SEQ ID NO: 185292 - DNA, 25 bp, Mus musculus
aggaacgaccgctagacttaagtgt

SEQ ID NO: 185293 - DNA, 25 bp, Mus musculus
aggaacgactacctgcacgcgctgg

SEQ ID NO: 185294 - DNA, 25 bp, Mus musculus
aggaacgactacgtgcacgcgctgg

SEQ ID NO: 185295 - DNA, 25 bp, Mus musculus
aggaacgagtcgctaacggccaccg

SEQ ID NO: 185296 - DNA, 25 bp, Mus musculus
aggaacgagtcggtaacggccaccg

SEQ ID NO: 185297 - DNA, 25 bp, Mus musculus
aggaacgagttgctatcagtggtca

SEQ ID NO: 185298 - DNA, 25 bp, Mus musculus
aggaacgagttggtatcagtggtca

SEQ ID NO: 185299 - DNA, 25 bp, Mus musculus
aggaacgatatcatgtacacggcac

SEQ ID NO: 185300 - DNA, 25 bp, Mus musculus
aggaacgatatcttgtacacggcac

SEQ ID NO: 185301 - DNA, 25 bp, Mus musculus
aggaacgcacttagactctgcagga

SEQ ID NO: 185302 - DNA, 25 bp, Mus musculus
aggaacgcactttgactctgcagga

SEQ ID NO: 185303 - DNA, 25 bp, Mus musculus
aggaacgcagctcatctggatgaca

SEQ ID NO: 185304 - DNA, 25 bp, Mus musculus
aggaacgcagctgatctggatgaca

SEQ ID NO: 185305 - DNA, 25 bp, Mus musculus
aggaacgccttcagctcgcttgggc

SEQ ID NO: 185306 - DNA, 25 bp, Mus musculus
aggaacgccttctgctcgcttgggc

SEQ ID NO: 185307 - DNA, 25 bp, Mus musculus
aggaacgctgaaagtagcaaggcta

SEQ ID NO: 185308 - DNA, 25 bp, Mus musculus
aggaacgctgaatgtagcaaggcta

SEQ ID NO: 185309 - DNA, 25 bp, Mus musculus
aggaacgctttgactgtaaacactc

SEQ ID NO: 185310 - DNA, 25 bp, Mus musculus
aggaacgctttgtctgtaaacactc

SEQ ID NO: 185311 - DNA, 25 bp, Mus musculus
aggaacggacagaggctcagataaa

SEQ ID NO: 185312 - DNA, 25 bp, Mus musculus
aggaacggacagtggctcagataaa

SEQ ID NO: 185313 - DNA, 25 bp, Mus musculus
aggaacggactcaactgacctggta

SEQ ID NO: 185314 - DNA, 25 bp, Mus musculus
aggaacggactctactgacctggta

SEQ ID NO: 185315 - DNA, 25 bp, Mus musculus
aggaacggaggaaggccaataatgc

SEQ ID NO: 185316 - DNA, 25 bp, Mus musculus
aggaacggaggatggccaataatgc

SEQ ID NO: 185317 - DNA, 25 bp, Mus musculus
aggaacggcagcatgcggatcgccc

SEQ ID NO: 185318 - DNA, 25 bp, Mus musculus
aggaacggcagcttgcggatcgccc

SEQ ID NO: 185319 - DNA, 25 bp, Mus musculus
aggaacggcccacctttgaatacat

SEQ ID NO: 185320 - DNA, 25 bp, Mus musculus
aggaacggcccagctttgaatacat

SEQ ID NO: 185321 - DNA, 25 bp, Mus musculus
aggaacggccggacatctgatggtc

SEQ ID NO: 185322 - DNA, 25 bp, Mus musculus
aggaacggccggtcatctgatggtc

SEQ ID NO: 185323 - DNA, 25 bp, Mus musculus
aggaacggctgcagcagcgctttgg

SEQ ID NO: 185324 - DNA, 25 bp, Mus musculus
aggaacggctgctgcagcgctttgg

SEQ ID NO: 185325 - DNA, 25 bp, Mus musculus
aggaacggctgtactccacgtggat

SEQ ID NO: 185326 - DNA, 25 bp, Mus musculus
aggaacggctgttctccacgtggat

SEQ ID NO: 185327 - DNA, 25 bp, Mus musculus
aggaacgggtaaagctcgcttgtgt

SEQ ID NO: 185328 - DNA, 25 bp, Mus musculus
aggaacgggtaatgctcgcttgtgt

SEQ ID NO: 185329 - DNA, 25 bp, Mus musculus
aggaacgggttcagtccttcctcat

SEQ ID NO: 185330 - DNA, 25 bp, Mus musculus
aggaacgggttctgtccttcctcat

SEQ ID NO: 185331 - DNA, 25 bp, Mus musculus
aggaacggtctcagggatctggcct

SEQ ID NO: 185332 - DNA, 25 bp, Mus musculus
aggaacggtctctgggatctggcct

SEQ ID NO: 185333 - DNA, 25 bp, Mus musculus
aggaacggtgtgattcaacatgaca

SEQ ID NO: 185334 - DNA, 25 bp, Mus musculus
aggaacggtgtgtttcaacatgaca

SEQ ID NO: 185335 - DNA, 25 bp, Mus musculus
aggaacgtagctcgatctgcccacc

SEQ ID NO: 185336 - DNA, 25 bp, Mus musculus
aggaacgtagctggatctgcccacc

SEQ ID NO: 185337 - DNA, 25 bp, Mus musculus
aggaacgtagttctcctgctctgaa

SEQ ID NO: 185338 - DNA, 25 bp, Mus musculus
aggaacgtagttgtcctgctctgaa

SEQ ID NO: 185339 - DNA, 25 bp, Mus musculus
aggaacgtattgacgcttctggctc

SEQ ID NO: 185340 - DNA, 25 bp, Mus musculus
aggaacgtattgtcgcttctggctc

SEQ ID NO: 185341 - DNA, 25 bp, Mus musculus
aggaacgtcagtattctgtgacaaa

SEQ ID NO: 185342 - DNA, 25 bp, Mus musculus
aggaacgtcagttttctgtgacaaa

SEQ ID NO: 185343 - DNA, 25 bp, Mus musculus
aggaacgtcggcagaggctcctgac

SEQ ID NO: 185344 - DNA, 25 bp, Mus musculus
aggaacgtcggctgaggctcctgac

SEQ ID NO: 185345 - DNA, 25 bp, Mus musculus
aggaacgtgaaaccagccgactcaa

SEQ ID NO: 185346 - DNA, 25 bp, Mus musculus
aggaacgtgaaagcagccgactcaa

SEQ ID NO: 185347 - DNA, 25 bp, Mus musculus
aggaacgttcatattgttctcacgt

SEQ ID NO: 185348 - DNA, 25 bp, Mus musculus
aggaacgttcatcgatgtgtcagat

SEQ ID NO: 185349 - DNA, 25 bp, Mus musculus
aggaacgttcatggatgtgtcagat

SEQ ID NO: 185350 - DNA, 25 bp, Mus musculus
aggaacgttcattttgttctcacgt

SEQ ID NO: 185351 - DNA, 25 bp, Mus musculus
aggaactaactccactctcaagatc

SEQ ID NO: 185352 - DNA, 25 bp, Mus musculus
aggaactaactcgactctcaagatc

SEQ ID NO: 185353 - DNA, 25 bp, Mus musculus
aggaactaatcacaacatgcacaga

SEQ ID NO: 185354 - DNA, 25 bp, Mus musculus
aggaactaatcagaacatgcacaga

SEQ ID NO: 185355 - DNA, 25 bp, Mus musculus
aggaactacacaccctcgaggtgac

SEQ ID NO: 185356 - DNA, 25 bp, Mus musculus
aggaactacacagcctcgaggtgac

SEQ ID NO: 185357 - DNA, 25 bp, Mus musculus
aggaactacactctggtcatgtcca

SEQ ID NO: 185358 - DNA, 25 bp, Mus musculus
aggaactacactgtggtcatgtcca

SEQ ID NO: 185359 - DNA, 25 bp, Mus musculus
aggaactacatcagcaactcggccc

SEQ ID NO: 185360 - DNA, 25 bp, Mus musculus
aggaactacatctgcaactcggccc

SEQ ID NO: 185361 - DNA, 25 bp, Mus musculus
aggaactacgaaaattggacttggg

SEQ ID NO: 185362 - DNA, 25 bp, Mus musculus
aggaactacgaatattggacttggg

SEQ ID NO: 185363 - DNA, 25 bp, Mus musculus
aggaactactgcaagttggcatggg

SEQ ID NO: 185364 - DNA, 25 bp, Mus musculus
aggaactactgctagttggcatggg

SEQ ID NO: 185365 - DNA, 25 bp, Mus musculus
aggaactagaccacccgaagggcag

SEQ ID NO: 185366 - DNA, 25 bp, Mus musculus
aggaactagacctcccgaagggcag

SEQ ID NO: 185367 - DNA, 25 bp, Mus musculus
aggaactaggacattgcttttgcaa

SEQ ID NO: 185368 - DNA, 25 bp, Mus musculus
aggaactaggactttgcttttgcaa

SEQ ID NO: 185369 - DNA, 25 bp, Mus musculus
aggaactaggccaaccttcaggatg

SEQ ID NO: 185370 - DNA, 25 bp, Mus musculus
aggaactaggccaccattagcacaa

SEQ ID NO: 185371 - DNA, 25 bp, Mus musculus
aggaactaggcctaccttcaggatg

SEQ ID NO: 185372 - DNA, 25 bp, Mus musculus
aggaactaggcctccattagcacaa

SEQ ID NO: 185373 - DNA, 25 bp, Mus musculus
aggaactagtcaactgggatgggat

SEQ ID NO: 185374 - DNA, 25 bp, Mus musculus
aggaactagtcatctgggatgggat

SEQ ID NO: 185375 - DNA, 25 bp, Mus musculus
aggaactattctacagtgcccttct

SEQ ID NO: 185376 - DNA, 25 bp, Mus musculus
aggaactattcttcagtgcccttct

SEQ ID NO: 185377 - DNA, 25 bp, Mus musculus
aggaactatttcacagtgcttgccc

SEQ ID NO: 185378 - DNA, 25 bp, Mus musculus
aggaactatttctcagtgcttgccc

SEQ ID NO: 185379 - DNA, 25 bp, Mus musculus
aggaactcaaagacaaggttctggg

SEQ ID NO: 185380 - DNA, 25 bp, Mus musculus
aggaactcaaagtcaaggttctggg

SEQ ID NO: 185381 - DNA, 25 bp, Mus musculus
aggaactcaaggaatctcatctcga

SEQ ID NO: 185382 - DNA, 25 bp, Mus musculus
aggaactcaaggacttccgctcttg

SEQ ID NO: 185383 - DNA, 25 bp, Mus musculus
aggaactcaaggtatctcatctcga

SEQ ID NO: 185384 - DNA, 25 bp, Mus musculus
aggaactcaaggtcttccgctcttg

SEQ ID NO: 185385 - DNA, 25 bp, Mus musculus
aggaactcaatcagggtcctcagca

SEQ ID NO: 185386 - DNA, 25 bp, Mus musculus
aggaactcaatctgggtcctcagca

SEQ ID NO: 185387 - DNA, 25 bp, Mus musculus
aggaactcacacagaaccaagttgt

SEQ ID NO: 185388 - DNA, 25 bp, Mus musculus
aggaactcacactgaaccaagttgt

SEQ ID NO: 185389 - DNA, 25 bp, Mus musculus
aggaactcagaaccctgcgtttgat

SEQ ID NO: 185390 - DNA, 25 bp, Mus musculus
aggaactcagaagcctgcgtttgat

SEQ ID NO: 185391 - DNA, 25 bp, Mus musculus
aggaactcagagactacgctccatg

SEQ ID NO: 185392 - DNA, 25 bp, Mus musculus
aggaactcagagtctacgctccatg

SEQ ID NO: 185393 - DNA, 25 bp, Mus musculus
aggaactcaggcagccctcgaagtc

SEQ ID NO: 185394 - DNA, 25 bp, Mus musculus
aggaactcaggctgccctcgaagtc

SEQ ID NO: 185395 - DNA, 25 bp, Mus musculus
aggaactcatatcctcctgaggcac

SEQ ID NO: 185396 - DNA, 25 bp, Mus musculus
aggaactcatatgctcctgaggcac

SEQ ID NO: 185397 - DNA, 25 bp, Mus musculus
aggaactccaaaatgcaagcagtgt

SEQ ID NO: 185398 - DNA, 25 bp, Mus musculus
aggaactccaaattgcaagcagtgt

SEQ ID NO: 185399 - DNA, 25 bp, Mus musculus
aggaactccagcatgggtactccgt

SEQ ID NO: 185400 - DNA, 25 bp, Mus musculus
aggaactccagcttgggtactccgt

SEQ ID NO: 185401 - DNA, 25 bp, Mus musculus
aggaactcctgcacagtatcctgtc

SEQ ID NO: 185402 - DNA, 25 bp, Mus musculus
aggaactcctgctcagtatcctgtc

SEQ ID NO: 185403 - DNA, 25 bp, Mus musculus
aggaactccttcaaaggccatgctg

SEQ ID NO: 185404 - DNA, 25 bp, Mus musculus
aggaactccttcagtgactactcgg

SEQ ID NO: 185405 - DNA, 25 bp, Mus musculus
aggaactccttctaaggccatgctg

SEQ ID NO: 185406 - DNA, 25 bp, Mus musculus
aggaactccttctgtgactactcgg

SEQ ID NO: 185407 - DNA, 25 bp, Mus musculus
aggaactcgataacctgctgccgtt

SEQ ID NO: 185408 - DNA, 25 bp, Mus musculus
aggaactcgatatcctgctgccgtt

SEQ ID NO: 185409 - DNA, 25 bp, Mus musculus
aggaactctatcatcttgtctggat

SEQ ID NO: 185410 - DNA, 25 bp, Mus musculus
aggaactctatcttcttgtctggat

SEQ ID NO: 185411 - DNA, 25 bp, Mus musculus
aggaactcttacactgcctatttac

SEQ ID NO: 185412 - DNA, 25 bp, Mus musculus
aggaactcttactctgcctatttac

SEQ ID NO: 185413 - DNA, 25 bp, Mus musculus
aggaactctttcctgatggcaacgc

SEQ ID NO: 185414 - DNA, 25 bp, Mus musculus
aggaactctttcgtgatggcaacgc

SEQ ID NO: 185415 - DNA, 25 bp, Mus musculus
aggaactgaaacacagcggtcacag

SEQ ID NO: 185416 - DNA, 25 bp, Mus musculus
aggaactgaaactcagcggtcacag

SEQ ID NO: 185417 - DNA, 25 bp, Mus musculus
aggaactgaaagacaacggtgaatt

SEQ ID NO: 185418 - DNA, 25 bp, Mus musculus
aggaactgaaagtcaacggtgaatt

SEQ ID NO: 185419 - DNA, 25 bp, Mus musculus
aggaactgaactctgctctccttat

SEQ ID NO: 185420 - DNA, 25 bp, Mus musculus
aggaactgaactgtgctctccttat

SEQ ID NO: 185421 - DNA, 25 bp, Mus musculus
aggaactgaccgacaccactgagaa

SEQ ID NO: 185422 - DNA, 25 bp, Mus musculus
aggaactgaccgtcaccactgagaa

SEQ ID NO: 185423 - DNA, 25 bp, Mus musculus
aggaactgacttcccttgtgtctct

SEQ ID NO: 185424 - DNA, 25 bp, Mus musculus
aggaactgacttgccttgtgtctct

SEQ ID NO: 185425 - DNA, 25 bp, Mus musculus
aggaactgagcacctcctgtgagga

SEQ ID NO: 185426 - DNA, 25 bp, Mus musculus
aggaactgagcagctcctgtgagga

SEQ ID NO: 185427 - DNA, 25 bp, Mus musculus
aggaactgagtgaagatccagccac

SEQ ID NO: 185428 - DNA, 25 bp, Mus musculus
aggaactgagtgtagatccagccac

SEQ ID NO: 185429 - DNA, 25 bp, Mus musculus
aggaactgatccagccaagggctcc

SEQ ID NO: 185430 - DNA, 25 bp, Mus musculus
aggaactgatcctgccaagggctcc

SEQ ID NO: 185431 - DNA, 25 bp, Mus musculus
aggaactgcagtcttttggtacaac

SEQ ID NO: 185432 - DNA, 25 bp, Mus musculus
aggaactgcagtgttttggtacaac

SEQ ID NO: 185433 - DNA, 25 bp, Mus musculus
aggaactgccacaatgctctgtaga

SEQ ID NO: 185434 - DNA, 25 bp, Mus musculus
aggaactgccactatgctctgtaga

SEQ ID NO: 185435 - DNA, 25 bp, Mus musculus
aggaactgccttcccgaggtcagcc

SEQ ID NO: 185436 - DNA, 25 bp, Mus musculus
aggaactgccttgccgaggtcagcc

SEQ ID NO: 185437 - DNA, 25 bp, Mus musculus
aggaactggagaccactgtggcaca

SEQ ID NO: 185438 - DNA, 25 bp, Mus musculus
aggaactggagagcactgtggcaca

SEQ ID NO: 185439 - DNA, 25 bp, Mus musculus
aggaactggcagacggaactgtttc

SEQ ID NO: 185440 - DNA, 25 bp, Mus musculus
aggaactggcagtcggaactgtttc

SEQ ID NO: 185441 - DNA, 25 bp, Mus musculus
aggaactggccaacagtctgcggca

SEQ ID NO: 185442 - DNA, 25 bp, Mus musculus
aggaactggccatcagtctgcggca

SEQ ID NO: 185443 - DNA, 25 bp, Mus musculus
aggaactggccgacgctgtcctggc

SEQ ID NO: 185444 - DNA, 25 bp, Mus musculus
aggaactggccgtcgctgtcctggc

SEQ ID NO: 185445 - DNA, 25 bp, Mus musculus
aggaactggcgaaggtcactatcaa

SEQ ID NO: 185446 - DNA, 25 bp, Mus musculus
aggaactggcgatggtcactatcaa

SEQ ID NO: 185447 - DNA, 25 bp, Mus musculus
aggaactggctacacacctgcagga

SEQ ID NO: 185448 - DNA, 25 bp, Mus musculus
aggaactggctagacacctgcagga

SEQ ID NO: 185449 - DNA, 25 bp, Mus musculus
aggaactggctgagtgcttccgcat

SEQ ID NO: 185450 - DNA, 25 bp, Mus musculus
aggaactggctgtgtgcttccgcat

SEQ ID NO: 185451 - DNA, 25 bp, Mus musculus
aggaactggcttcatacctgaccac

SEQ ID NO: 185452 - DNA, 25 bp, Mus musculus
aggaactggcttgatacctgaccac

SEQ ID NO: 185453 - DNA, 25 bp, Mus musculus
aggaactggtgaaagtcttgctaca

SEQ ID NO: 185454 - DNA, 25 bp, Mus musculus
aggaactggtgatagtcttgctaca

SEQ ID NO: 185455 - DNA, 25 bp, Mus musculus
aggaactgtagacacaattatcacc

SEQ ID NO: 185456 - DNA, 25 bp, Mus musculus
aggaactgtagagacaattatcacc

SEQ ID NO: 185457 - DNA, 25 bp, Mus musculus
aggaactgtctgaaccaactgggta

SEQ ID NO: 185458 - DNA, 25 bp, Mus musculus
aggaactgtctgagggatcattttt

SEQ ID NO: 185459 - DNA, 25 bp, Mus musculus
aggaactgtctgtaccaactgggta

SEQ ID NO: 185460 - DNA, 25 bp, Mus musculus
aggaactgtctgtgggatcattttt

SEQ ID NO: 185461 - DNA, 25 bp, Mus musculus
aggaactgtttgaaggacaccttgg

SEQ ID NO: 185462 - DNA, 25 bp, Mus musculus
aggaactgtttgtaggacaccttgg

SEQ ID NO: 185463 - DNA, 25 bp, Mus musculus
aggaacttactaagcggccacagtt

SEQ ID NO: 185464 - DNA, 25 bp, Mus musculus
aggaacttactatgcggccacagtt

SEQ ID NO: 185465 - DNA, 25 bp, Mus musculus
aggaacttactcacttaactccact

SEQ ID NO: 185466 - DNA, 25 bp, Mus musculus
aggaacttactctcttaactccact

SEQ ID NO: 185467 - DNA, 25 bp, Mus musculus
aggaacttcaaaacgctactgccaa

SEQ ID NO: 185468 - DNA, 25 bp, Mus musculus
aggaacttcaaatcgctactgccaa

SEQ ID NO: 185469 - DNA, 25 bp, Mus musculus
aggaacttcgtgacacctacatatc

SEQ ID NO: 185470 - DNA, 25 bp, Mus musculus
aggaacttcgtgtcacctacatatc

SEQ ID NO: 185471 - DNA, 25 bp, Mus musculus
aggaacttctggaacggctctacag

SEQ ID NO: 185472 - DNA, 25 bp, Mus musculus
aggaacttctggtacggctctacag

SEQ ID NO: 185473 - DNA, 25 bp, Mus musculus
aggaacttcttcagccaagctataa

SEQ ID NO: 185474 - DNA, 25 bp, Mus musculus
aggaacttcttctgccaagctataa

SEQ ID NO: 185475 - DNA, 25 bp, Mus musculus
aggaacttgcaaatctggccacttt

SEQ ID NO: 185476 - DNA, 25 bp, Mus musculus
aggaacttgcaattctggccacttt

SEQ ID NO: 185477 - DNA, 25 bp, Mus musculus
aggaacttggcacgtgcagttagaa

SEQ ID NO: 185478 - DNA, 25 bp, Mus musculus
aggaacttggcaggtgcagttagaa

SEQ ID NO: 185479 - DNA, 25 bp, Mus musculus
aggaacttgggaatcatcctgctct

SEQ ID NO: 185480 - DNA, 25 bp, Mus musculus
aggaacttgggattcatcctgctct

SEQ ID NO: 185481 - DNA, 25 bp, Mus musculus
aggaacttgtatccttcgcctgttg

SEQ ID NO: 185482 - DNA, 25 bp, Mus musculus
aggaacttgtatctctctgtcagaa

SEQ ID NO: 185483 - DNA, 25 bp, Mus musculus
aggaacttgtatgcttcgcctgttg

SEQ ID NO: 185484 - DNA, 25 bp, Mus musculus
aggaacttgtatgtctctgtcagaa

SEQ ID NO: 185485 - DNA, 25 bp, Mus musculus
aggaactttctgagtgtctgatgac

SEQ ID NO: 185486 - DNA, 25 bp, Mus musculus
aggaactttctgtgtgtctgatgac

SEQ ID NO: 185487 - DNA, 25 bp, Mus musculus
aggaactttcttatggagatggcca

SEQ ID NO: 185488 - DNA, 25 bp, Mus musculus
aggaactttcttttggagatggcca

SEQ ID NO: 185489 - DNA, 25 bp, Mus musculus
aggaactttgacaacactgctcgaa

SEQ ID NO: 185490 - DNA, 25 bp, Mus musculus
aggaactttgactacactgctcgaa

SEQ ID NO: 185491 - DNA, 25 bp, Mus musculus
aggaagaaaaatcctgttgtctcat

SEQ ID NO: 185492 - DNA, 25 bp, Mus musculus
aggaagaaaaatgctgttgtctcat

SEQ ID NO: 185493 - DNA, 25 bp, Mus musculus
aggaagaaccatctgcagtagctat

SEQ ID NO: 185494 - DNA, 25 bp, Mus musculus
aggaagaaccatgtgcagtagctat

SEQ ID NO: 185495 - DNA, 25 bp, Mus musculus
aggaagaacccacagattagccaaa

SEQ ID NO: 185496 - DNA, 25 bp, Mus musculus
aggaagaacccagagattagccaaa

SEQ ID NO: 185497 - DNA, 25 bp, Mus musculus
aggaagaacctgataaagcagcacc

SEQ ID NO: 185498 - DNA, 25 bp, Mus musculus
aggaagaacctgttaaagcagcacc

SEQ ID NO: 185499 - DNA, 25 bp, Mus musculus
aggaagaagaccctgctgtcctcat

SEQ ID NO: 185500 - DNA, 25 bp, Mus musculus
aggaagaagaccgtgctgtcctcat

SEQ ID NO: 185501 - DNA, 25 bp, Mus musculus
aggaagaatatgatacccgccaagc

SEQ ID NO: 185502 - DNA, 25 bp, Mus musculus
aggaagaatatgttacccgccaagc

SEQ ID NO: 185503 - DNA, 25 bp, Mus musculus
aggaagaatggccaacatcccgaag

SEQ ID NO: 185504 - DNA, 25 bp, Mus musculus
aggaagaatggcgaacatcccgaag

SEQ ID NO: 185505 - DNA, 25 bp, Mus musculus
aggaagaatttaatgcaaactctca

SEQ ID NO: 185506 - DNA, 25 bp, Mus musculus
aggaagaatttattgcaaactctca

SEQ ID NO: 185507 - DNA, 25 bp, Mus musculus
aggaagacagccatttatgcatagc

SEQ ID NO: 185508 - DNA, 25 bp, Mus musculus
aggaagacagccttttatgcatagc

SEQ ID NO: 185509 - DNA, 25 bp, Mus musculus
aggaagacatctcttgtcaacctct

SEQ ID NO: 185510 - DNA, 25 bp, Mus musculus
aggaagacatctgttgtcaacctct

SEQ ID NO: 185511 - DNA, 25 bp, Mus musculus
aggaagacatttcgcccatcgtgaa

SEQ ID NO: 185512 - DNA, 25 bp, Mus musculus
aggaagacatttggcccatcgtgaa

SEQ ID NO: 185513 - DNA, 25 bp, Mus musculus
aggaagaccaggactggcacgccga

SEQ ID NO: 185514 - DNA, 25 bp, Mus musculus
aggaagaccaggtctggcacgccga

SEQ ID NO: 185515 - DNA, 25 bp, Mus musculus
aggaagaccccactgacagctggat

SEQ ID NO: 185516 - DNA, 25 bp, Mus musculus
aggaagaccccagtgacagctggat

SEQ ID NO: 185517 - DNA, 25 bp, Mus musculus
aggaagacccctctactgcctgtgg

SEQ ID NO: 185518 - DNA, 25 bp, Mus musculus
aggaagacccctgtactgcctgtgg

SEQ ID NO: 185519 - DNA, 25 bp, Mus musculus
aggaagacccgcagagcagcagctg

SEQ ID NO: 185520 - DNA, 25 bp, Mus musculus
aggaagacccgctgagcagcagctg

SEQ ID NO: 185521 - DNA, 25 bp, Mus musculus
aggaagaccctgaagttcactgcta

SEQ ID NO: 185522 - DNA, 25 bp, Mus musculus
aggaagaccctgaggaatgccctct

SEQ ID NO: 185523 - DNA, 25 bp, Mus musculus
aggaagaccctgtagttcactgcta

SEQ ID NO: 185524 - DNA, 25 bp, Mus musculus
aggaagaccctgtggaatgccctct

SEQ ID NO: 185525 - DNA, 25 bp, Mus musculus
aggaagacctccagactgggaacct

SEQ ID NO: 185526 - DNA, 25 bp, Mus musculus
aggaagacctcctgactgggaacct

SEQ ID NO: 185527 - DNA, 25 bp, Mus musculus
aggaagacctggaactagcccctag

SEQ ID NO: 185528 - DNA, 25 bp, Mus musculus
aggaagacctggtactagcccctag

SEQ ID NO: 185529 - DNA, 25 bp, Mus musculus
aggaagacggcaaggctgtgcacat

SEQ ID NO: 185530 - DNA, 25 bp, Mus musculus
aggaagacggcatggctgtgcacat

SEQ ID NO: 185531 - DNA, 25 bp, Mus musculus
aggaagactcccagctggctatgaa

SEQ ID NO: 185532 - DNA, 25 bp, Mus musculus
aggaagactccctgctggctatgaa

SEQ ID NO: 185533 - DNA, 25 bp, Mus musculus
aggaagactgaccttagctcccatt

SEQ ID NO: 185534 - DNA, 25 bp, Mus musculus
aggaagactgacgttagctcccatt

SEQ ID NO: 185535 - DNA, 25 bp, Mus musculus
aggaagactgatccttggccatcct

SEQ ID NO: 185536 - DNA, 25 bp, Mus musculus
aggaagactgatgcttggccatcct

SEQ ID NO: 185537 - DNA, 25 bp, Mus musculus
aggaagactgctccacactcgaggc

SEQ ID NO: 185538 - DNA, 25 bp, Mus musculus
aggaagactgctgcacactcgaggc

SEQ ID NO: 185539 - DNA, 25 bp, Mus musculus
aggaagactgtactgggcccaacac

SEQ ID NO: 185540 - DNA, 25 bp, Mus musculus
aggaagactgtagtgggcccaacac

SEQ ID NO: 185541 - DNA, 25 bp, Mus musculus
aggaagactgtcacacacctggtat

SEQ ID NO: 185542 - DNA, 25 bp, Mus musculus
aggaagactgtctcacacctggtat

SEQ ID NO: 185543 - DNA, 25 bp, Mus musculus
aggaagacttcgagttgctctgccc

SEQ ID NO: 185544 - DNA, 25 bp, Mus musculus
aggaagacttcgtgttgctctgccc

SEQ ID NO: 185545 - DNA, 25 bp, Mus musculus
aggaagagcaacagtcaccccggag

SEQ ID NO: 185546 - DNA, 25 bp, Mus musculus
aggaagagcaactgtcaccccggag

SEQ ID NO: 185547 - DNA, 25 bp, Mus musculus
aggaagagcacaacactggggtcga

SEQ ID NO: 185548 - DNA, 25 bp, Mus musculus
aggaagagcacatcactggggtcga

SEQ ID NO: 185549 - DNA, 25 bp, Mus musculus
aggaagagcatccttgcctcaggtt

SEQ ID NO: 185550 - DNA, 25 bp, Mus musculus
aggaagagcatcgttgcctcaggtt

SEQ ID NO: 185551 - DNA, 25 bp, Mus musculus
aggaagagcccaccagcactgagct

SEQ ID NO: 185552 - DNA, 25 bp, Mus musculus
aggaagagcccagcagcactgagct

SEQ ID NO: 185553 - DNA, 25 bp, Mus musculus
aggaagagcgccagaagaccttgct

SEQ ID NO: 185554 - DNA, 25 bp, Mus musculus
aggaagagcgcctgaagaccttgct

SEQ ID NO: 185555 - DNA, 25 bp, Mus musculus
aggaagagctaacgatgcccgagac

SEQ ID NO: 185556 - DNA, 25 bp, Mus musculus
aggaagagctaaggatgcccgagac

SEQ ID NO: 185557 - DNA, 25 bp, Mus musculus
aggaagagctgtcctccactgagga

SEQ ID NO: 185558 - DNA, 25 bp, Mus musculus
aggaagagctgtgctccactgagga

SEQ ID NO: 185559 - DNA, 25 bp, Mus musculus
aggaagagctttactcctctcatgc

SEQ ID NO: 185560 - DNA, 25 bp, Mus musculus
aggaagagcttttctcctctcatgc

SEQ ID NO: 185561 - DNA, 25 bp, Mus musculus
aggaagaggagcaaatcccggtgaa

SEQ ID NO: 185562 - DNA, 25 bp, Mus musculus
aggaagaggagctaatcccggtgaa

SEQ ID NO: 185563 - DNA, 25 bp, Mus musculus
aggaagaggcacatggcacagctaa

SEQ ID NO: 185564 - DNA, 25 bp, Mus musculus
aggaagaggcacttggcacagctaa

SEQ ID NO: 185565 - DNA, 25 bp, Mus musculus
aggaagaggcatccatcaacctcaa

SEQ ID NO: 185566 - DNA, 25 bp, Mus musculus
aggaagaggcatgcatcaacctcaa

SEQ ID NO: 185567 - DNA, 25 bp, Mus musculus
aggaagaggccaagctccagaaccc

SEQ ID NO: 185568 - DNA, 25 bp, Mus musculus
aggaagaggccatgctccagaaccc

SEQ ID NO: 185569 - DNA, 25 bp, Mus musculus
aggaagaggctcaccgcatcagtga

SEQ ID NO: 185570 - DNA, 25 bp, Mus musculus
aggaagaggctctccgcatcagtga

SEQ ID NO: 185571 - DNA, 25 bp, Mus musculus
aggaagaggcttcatggatctctat

SEQ ID NO: 185572 - DNA, 25 bp, Mus musculus
aggaagaggcttgatggatctctat

SEQ ID NO: 185573 - DNA, 25 bp, Mus musculus
aggaagagggttcaggcacttccca

SEQ ID NO: 185574 - DNA, 25 bp, Mus musculus
aggaagagggttgaggcacttccca

SEQ ID NO: 185575 - DNA, 25 bp, Mus musculus
aggaagaggttgatagtatcactgg

SEQ ID NO: 185576 - DNA, 25 bp, Mus musculus
aggaagaggttgttagtatcactgg

SEQ ID NO: 185577 - DNA, 25 bp, Mus musculus
aggaagagtcccatcgtccatgtac

SEQ ID NO: 185578 - DNA, 25 bp, Mus musculus
aggaagagtcccttcgtccatgtac

SEQ ID NO: 185579 - DNA, 25 bp, Mus musculus
aggaagagttatattgctggacccc

SEQ ID NO: 185580 - DNA, 25 bp, Mus musculus
aggaagagttattttgctggacccc

SEQ ID NO: 185581 - DNA, 25 bp, Mus musculus
aggaagatacagagctccagcagga

SEQ ID NO: 185582 - DNA, 25 bp, Mus musculus
aggaagatacagtgctccagcagga

SEQ ID NO: 185583 - DNA, 25 bp, Mus musculus
aggaagatcactcgaacccactggt

SEQ ID NO: 185584 - DNA, 25 bp, Mus musculus
aggaagatcactggaacccactggt

SEQ ID NO: 185585 - DNA, 25 bp, Mus musculus
aggaagatcatgacttcccctcttt

SEQ ID NO: 185586 - DNA, 25 bp, Mus musculus
aggaagatcatgtcttcccctcttt

SEQ ID NO: 185587 - DNA, 25 bp, Mus musculus
aggaagatccagctgctgccacgag

SEQ ID NO: 185588 - DNA, 25 bp, Mus musculus
aggaagatccaggtgctgccacgag

SEQ ID NO: 185589 - DNA, 25 bp, Mus musculus
aggaagatctctacctgggacaagg

SEQ ID NO: 185590 - DNA, 25 bp, Mus musculus
aggaagatctcttcctgggacaagg

SEQ ID NO: 185591 - DNA, 25 bp, Mus musculus
aggaagatctgtactctgtgggtga

SEQ ID NO: 185592 - DNA, 25 bp, Mus musculus
aggaagatctgttctctgtgggtga

SEQ ID NO: 185593 - DNA, 25 bp, Mus musculus
aggaagatgacgaagagccccgcgc

SEQ ID NO: 185594 - DNA, 25 bp, Mus musculus
aggaagatgacgtagagccccgcgc

SEQ ID NO: 185595 - DNA, 25 bp, Mus musculus
aggaagatggtaccctgctgttagt

SEQ ID NO: 185596 - DNA, 25 bp, Mus musculus
aggaagatggtagcctgctgttagt

SEQ ID NO: 185597 - DNA, 25 bp, Mus musculus
aggaagattcctcttctcagcccac

SEQ ID NO: 185598 - DNA, 25 bp, Mus musculus
aggaagattcctgttctcagcccac

SEQ ID NO: 185599 - DNA, 25 bp, Mus musculus
aggaagattgcaaccactccatcaa

SEQ ID NO: 185600 - DNA, 25 bp, Mus musculus
aggaagattgcatccactccatcaa

SEQ ID NO: 185601 - DNA, 25 bp, Mus musculus
aggaagatttccactccaagctttt

SEQ ID NO: 185602 - DNA, 25 bp, Mus musculus
aggaagatttcctctccaagctttt

SEQ ID NO: 185603 - DNA, 25 bp, Mus musculus
aggaagcaaaatccccatcactttg

SEQ ID NO: 185604 - DNA, 25 bp, Mus musculus
aggaagcaaaatgcccatcactttg

SEQ ID NO: 185605 - DNA, 25 bp, Mus musculus
aggaagcaagaacaggaccccagtg

SEQ ID NO: 185606 - DNA, 25 bp, Mus musculus
aggaagcaagaagaggaccccagtg

SEQ ID NO: 185607 - DNA, 25 bp, Mus musculus
aggaagcaagcgatttctccatcac

SEQ ID NO: 185608 - DNA, 25 bp, Mus musculus
aggaagcaagcgttttctccatcac

SEQ ID NO: 185609 - DNA, 25 bp, Mus musculus
aggaagcaagttatcctgtctcact

SEQ ID NO: 185610 - DNA, 25 bp, Mus musculus
aggaagcaagttttcctgtctcact

SEQ ID NO: 185611 - DNA, 25 bp, Mus musculus
aggaagcaatttattactcatgtaa

SEQ ID NO: 185612 - DNA, 25 bp, Mus musculus
aggaagcaattttttactcatgtaa

SEQ ID NO: 185613 - DNA, 25 bp, Mus musculus
aggaagcacaggatctctggctgag

SEQ ID NO: 185614 - DNA, 25 bp, Mus musculus
aggaagcacaggctttctgccatcc

SEQ ID NO: 185615 - DNA, 25 bp, Mus musculus
aggaagcacagggtttctgccatcc

SEQ ID NO: 185616 - DNA, 25 bp, Mus musculus
aggaagcacaggttctctggctgag

SEQ ID NO: 185617 - DNA, 25 bp, Mus musculus
aggaagcaccttagtctccatgtca

SEQ ID NO: 185618 - DNA, 25 bp, Mus musculus
aggaagcacctttgtctccatgtca

SEQ ID NO: 185619 - DNA, 25 bp, Mus musculus
aggaagcacgggaagcccaaggcca

SEQ ID NO: 185620 - DNA, 25 bp, Mus musculus
aggaagcacgggtagcccaaggcca

SEQ ID NO: 185621 - DNA, 25 bp, Mus musculus
aggaagcactctcagccttgttggg

SEQ ID NO: 185622 - DNA, 25 bp, Mus musculus
aggaagcactctgagccttgttggg

SEQ ID NO: 185623 - DNA, 25 bp, Mus musculus
aggaagcacttcattctgaagtcaa

SEQ ID NO: 185624 - DNA, 25 bp, Mus musculus
aggaagcacttctttctgaagtcaa

SEQ ID NO: 185625 - DNA, 25 bp, Mus musculus
aggaagcagcacagaaagcccctga

SEQ ID NO: 185626 - DNA, 25 bp, Mus musculus
aggaagcagcactgaaagcccctga

SEQ ID NO: 185627 - DNA, 25 bp, Mus musculus
aggaagcagcctatatcttgctcac

SEQ ID NO: 185628 - DNA, 25 bp, Mus musculus
aggaagcagcctttatcttgctcac

SEQ ID NO: 185629 - DNA, 25 bp, Mus musculus
aggaagcagcggcactacgcctcac

SEQ ID NO: 185630 - DNA, 25 bp, Mus musculus
aggaagcagcgggactacgcctcac

SEQ ID NO: 185631 - DNA, 25 bp, Mus musculus
aggaagcagctgctaggaaaacctg

SEQ ID NO: 185632 - DNA, 25 bp, Mus musculus
aggaagcagctggtaggaaaacctg

SEQ ID NO: 185633 - DNA, 25 bp, Mus musculus
aggaagcaggccacgggcatcttgt

SEQ ID NO: 185634 - DNA, 25 bp, Mus musculus
aggaagcaggcctcgggcatcttgt

SEQ ID NO: 185635 - DNA, 25 bp, Mus musculus
aggaagcatctcagaatgactttct

SEQ ID NO: 185636 - DNA, 25 bp, Mus musculus
aggaagcatctctgaatgactttct

SEQ ID NO: 185637 - DNA, 25 bp, Mus musculus
aggaagcatgcaagcagcactgctc

SEQ ID NO: 185638 - DNA, 25 bp, Mus musculus
aggaagcatgcatgcagcactgctc

SEQ ID NO: 185639 - DNA, 25 bp, Mus musculus
aggaagcatgctctcacgtgacaca

SEQ ID NO: 185640 - DNA, 25 bp, Mus musculus
aggaagcatgctgtcacgtgacaca

SEQ ID NO: 185641 - DNA, 25 bp, Mus musculus
aggaagccaaaactgccgcaagtgt

SEQ ID NO: 185642 - DNA, 25 bp, Mus musculus
aggaagccaaaagtgccgcaagtgt

SEQ ID NO: 185643 - DNA, 25 bp, Mus musculus
aggaagccaagacaatagagatgcc

SEQ ID NO: 185644 - DNA, 25 bp, Mus musculus
aggaagccaagagaatagagatgcc

SEQ ID NO: 185645 - DNA, 25 bp, Mus musculus
aggaagccacccagagcggaccctg

SEQ ID NO: 185646 - DNA, 25 bp, Mus musculus
aggaagccaccctgagcggaccctg

SEQ ID NO: 185647 - DNA, 25 bp, Mus musculus
aggaagccacgtctcttagtttctt

SEQ ID NO: 185648 - DNA, 25 bp, Mus musculus
aggaagccacgtgtcttagtttctt

SEQ ID NO: 185649 - DNA, 25 bp, Mus musculus
aggaagccagcactgagatgttccc

SEQ ID NO: 185650 - DNA, 25 bp, Mus musculus
aggaagccagcagtgagatgttccc

SEQ ID NO: 185651 - DNA, 25 bp, Mus musculus
aggaagccagttccctatcccagta

SEQ ID NO: 185652 - DNA, 25 bp, Mus musculus
aggaagccagttgcctatcccagta

SEQ ID NO: 185653 - DNA, 25 bp, Mus musculus
aggaagccatatcctgctatcccag

SEQ ID NO: 185654 - DNA, 25 bp, Mus musculus
aggaagccatatgctgctatcccag

SEQ ID NO: 185655 - DNA, 25 bp, Mus musculus
aggaagccatctatatcctggcgcg

SEQ ID NO: 185656 - DNA, 25 bp, Mus musculus
aggaagccatctcccgagtgactga

SEQ ID NO: 185657 - DNA, 25 bp, Mus musculus
aggaagccatctgccgagtgactga

SEQ ID NO: 185658 - DNA, 25 bp, Mus musculus
aggaagccatctttatcctggcgcg

SEQ ID NO: 185659 - DNA, 25 bp, Mus musculus
aggaagccatgtacttcagacccgg

SEQ ID NO: 185660 - DNA, 25 bp, Mus musculus
aggaagccatgtatggaagaccagc

SEQ ID NO: 185661 - DNA, 25 bp, Mus musculus
aggaagccatgttcttcagacccgg

SEQ ID NO: 185662 - DNA, 25 bp, Mus musculus
aggaagccatgtttggaagaccagc

SEQ ID NO: 185663 - DNA, 25 bp, Mus musculus
aggaagccattgcccaggactccat

SEQ ID NO: 185664 - DNA, 25 bp, Mus musculus
aggaagccattggccaggactccat

SEQ ID NO: 185665 - DNA, 25 bp, Mus musculus
aggaagcccacaactgttcacttgg

SEQ ID NO: 185666 - DNA, 25 bp, Mus musculus
aggaagcccacatctgttcacttgg

SEQ ID NO: 185667 - DNA, 25 bp, Mus musculus
aggaagcccaccactgacctttgat

SEQ ID NO: 185668 - DNA, 25 bp, Mus musculus
aggaagcccacctctgacctttgat

SEQ ID NO: 185669 - DNA, 25 bp, Mus musculus
aggaagcccacgctgttcactcgag

SEQ ID NO: 185670 - DNA, 25 bp, Mus musculus
aggaagcccacggtgttcactcgag

SEQ ID NO: 185671 - DNA, 25 bp, Mus musculus
aggaagcccagcctttctgagagga

SEQ ID NO: 185672 - DNA, 25 bp, Mus musculus
aggaagcccagcgtttctgagagga

SEQ ID NO: 185673 - DNA, 25 bp, Mus musculus
aggaagcccgaccagcattgacaag

SEQ ID NO: 185674 - DNA, 25 bp, Mus musculus
aggaagcccgacgagcattgacaag

SEQ ID NO: 185675 - DNA, 25 bp, Mus musculus
aggaagcccggacaggtcatctaca

SEQ ID NO: 185676 - DNA, 25 bp, Mus musculus
aggaagcccggagaggtcatctaca

SEQ ID NO: 185677 - DNA, 25 bp, Mus musculus
aggaagcccgtgaacagcacagcaa

SEQ ID NO: 185678 - DNA, 25 bp, Mus musculus
aggaagcccgtgtacagcacagcaa

SEQ ID NO: 185679 - DNA, 25 bp, Mus musculus
aggaagccctgaaagcaaactgtaa

SEQ ID NO: 185680 - DNA, 25 bp, Mus musculus
aggaagccctgatagcaaactgtaa

SEQ ID NO: 185681 - DNA, 25 bp, Mus musculus
aggaagcctagtagatcagaagcag

SEQ ID NO: 185682 - DNA, 25 bp, Mus musculus
aggaagcctagttgatcagaagcag

SEQ ID NO: 185683 - DNA, 25 bp, Mus musculus
aggaagcctctgcttcccagacgaa

SEQ ID NO: 185684 - DNA, 25 bp, Mus musculus
aggaagcctctggttcccagacgaa

SEQ ID NO: 185685 - DNA, 25 bp, Mus musculus
aggaagcctgccatcactaagggtt

SEQ ID NO: 185686 - DNA, 25 bp, Mus musculus
aggaagcctgccttcactaagggtt

SEQ ID NO: 185687 - DNA, 25 bp, Mus musculus
aggaagcctggaatgttcaaccact

SEQ ID NO: 185688 - DNA, 25 bp, Mus musculus
aggaagcctggattgttcaaccact

SEQ ID NO: 185689 - DNA, 25 bp, Mus musculus
aggaagcctgtgaatttaacttgaa

SEQ ID NO: 185690 - DNA, 25 bp, Mus musculus
aggaagcctgtgtatttaacttgaa

SEQ ID NO: 185691 - DNA, 25 bp, Mus musculus
aggaagccttacacatggcctcttg

SEQ ID NO: 185692 - DNA, 25 bp, Mus musculus
aggaagccttactcatggcctcttg

SEQ ID NO: 185693 - DNA, 25 bp, Mus musculus
aggaagccttcacaatcatggacca

SEQ ID NO: 185694 - DNA, 25 bp, Mus musculus
aggaagccttcagaatcatggacca

SEQ ID NO: 185695 - DNA, 25 bp, Mus musculus
aggaagcctttaccactttgagtgc

SEQ ID NO: 185696 - DNA, 25 bp, Mus musculus
aggaagcctttagcactttgagtgc

SEQ ID NO: 185697 - DNA, 25 bp, Mus musculus
aggaagcctttcaggcagcactgct

SEQ ID NO: 185698 - DNA, 25 bp, Mus musculus
aggaagcctttctggcagcactgct

SEQ ID NO: 185699 - DNA, 25 bp, Mus musculus
aggaagcgactcacttgtctttcat

SEQ ID NO: 185700 - DNA, 25 bp, Mus musculus
aggaagcgactctcttgtctttcat

SEQ ID NO: 185701 - DNA, 25 bp, Mus musculus
aggaagcgaggtcggacacacaccc

SEQ ID NO: 185702 - DNA, 25 bp, Mus musculus
aggaagcgaggtgggacacacaccc

SEQ ID NO: 185703 - DNA, 25 bp, Mus musculus
aggaagcgccagcaggccctgacaa

SEQ ID NO: 185704 - DNA, 25 bp, Mus musculus
aggaagcgccaggaggccctgacaa

SEQ ID NO: 185705 - DNA, 25 bp, Mus musculus
aggaagcgcctgaatcttctcacta

SEQ ID NO: 185706 - DNA, 25 bp, Mus musculus
aggaagcgcctgtatcttctcacta

SEQ ID NO: 185707 - DNA, 25 bp, Mus musculus
aggaagcgctacaggcccttctgga

SEQ ID NO: 185708 - DNA, 25 bp, Mus musculus
aggaagcgctactggcccttctgga

SEQ ID NO: 185709 - DNA, 25 bp, Mus musculus
aggaagcgggacatgcacctctgca

SEQ ID NO: 185710 - DNA, 25 bp, Mus musculus
aggaagcgggacttgcacctctgca

SEQ ID NO: 185711 - DNA, 25 bp, Mus musculus
aggaagctaatcaatcaccagcaaa

SEQ ID NO: 185712 - DNA, 25 bp, Mus musculus
aggaagctaatctatcaccagcaaa

SEQ ID NO: 185713 - DNA, 25 bp, Mus musculus
aggaagctaccccgcgctgcgaact

SEQ ID NO: 185714 - DNA, 25 bp, Mus musculus
aggaagctacccggcgctgcgaact

SEQ ID NO: 185715 - DNA, 25 bp, Mus musculus
aggaagctactcaaggcccagggaa

SEQ ID NO: 185716 - DNA, 25 bp, Mus musculus
aggaagctactctaggcccagggaa

SEQ ID NO: 185717 - DNA, 25 bp, Mus musculus
aggaagctagccaatggcgtgcacc

SEQ ID NO: 185718 - DNA, 25 bp, Mus musculus
aggaagctagcctatggcgtgcacc

SEQ ID NO: 185719 - DNA, 25 bp, Mus musculus
aggaagctattcattcttgcaatca

SEQ ID NO: 185720 - DNA, 25 bp, Mus musculus
aggaagctattctttcttgcaatca

SEQ ID NO: 185721 - DNA, 25 bp, Mus musculus
aggaagctcactagcccactgcagc

SEQ ID NO: 185722 - DNA, 25 bp, Mus musculus
aggaagctcacttgcccactgcagc

SEQ ID NO: 185723 - DNA, 25 bp, Mus musculus
aggaagctcctgctctgggagacca

SEQ ID NO: 185724 - DNA, 25 bp, Mus musculus
aggaagctcctggtctgggagacca

SEQ ID NO: 185725 - DNA, 25 bp, Mus musculus
aggaagctctgaagggcagcgctct

SEQ ID NO: 185726 - DNA, 25 bp, Mus musculus
aggaagctctgatgggcagcgctct

SEQ ID NO: 185727 - DNA, 25 bp, Mus musculus
aggaagctctgcagccctataccac

SEQ ID NO: 185728 - DNA, 25 bp, Mus musculus
aggaagctctgctgccctataccac

SEQ ID NO: 185729 - DNA, 25 bp, Mus musculus
aggaagctgacaacccaaatacggg

SEQ ID NO: 185730 - DNA, 25 bp, Mus musculus
aggaagctgacatcccaaatacggg

SEQ ID NO: 185731 - DNA, 25 bp, Mus musculus
aggaagctgactattctagaacaaa

SEQ ID NO: 185732 - DNA, 25 bp, Mus musculus
aggaagctgacttttctagaacaaa

SEQ ID NO: 185733 - DNA, 25 bp, Mus musculus
aggaagctgagccaaaggacttcat

SEQ ID NO: 185734 - DNA, 25 bp, Mus musculus
aggaagctgagccttgcctacctag

SEQ ID NO: 185735 - DNA, 25 bp, Mus musculus
aggaagctgagcgaaaggacttcat

SEQ ID NO: 185736 - DNA, 25 bp, Mus musculus
aggaagctgagcgttgcctacctag

SEQ ID NO: 185737 - DNA, 25 bp, Mus musculus
aggaagctgccgcgagactacctga

SEQ ID NO: 185738 - DNA, 25 bp, Mus musculus
aggaagctgccgggagactacctga

SEQ ID NO: 185739 - DNA, 25 bp, Mus musculus
aggaagctgcgactggtctatgaca

SEQ ID NO: 185740 - DNA, 25 bp, Mus musculus
aggaagctgcgagtggtctatgaca

SEQ ID NO: 185741 - DNA, 25 bp, Mus musculus
aggaagctgctgactggccacttga

SEQ ID NO: 185742 - DNA, 25 bp, Mus musculus
aggaagctgctgctgtaggaatacc

SEQ ID NO: 185743 - DNA, 25 bp, Mus musculus
aggaagctgctggtgtaggaatacc

SEQ ID NO: 185744 - DNA, 25 bp, Mus musculus
aggaagctgctgtctggccacttga

SEQ ID NO: 185745 - DNA, 25 bp, Mus musculus
aggaagctggaactggcacttttcc

SEQ ID NO: 185746 - DNA, 25 bp, Mus musculus
aggaagctggaagtggcacttttcc

SEQ ID NO: 185747 - DNA, 25 bp, Mus musculus
aggaagctggcccaggcctgctcct

SEQ ID NO: 185748 - DNA, 25 bp, Mus musculus
aggaagctggccgaggcctgctcct

SEQ ID NO: 185749 - DNA, 25 bp, Mus musculus
aggaagctgggcacctcctcaaagg

SEQ ID NO: 185750 - DNA, 25 bp, Mus musculus
aggaagctgggctcctcctcaaagg

SEQ ID NO: 185751 - DNA, 25 bp, Mus musculus
aggaagctgtcaaggccgcaatcgt

SEQ ID NO: 185752 - DNA, 25 bp, Mus musculus
aggaagctgtcaatgtgagatgtgt

SEQ ID NO: 185753 - DNA, 25 bp, Mus musculus
aggaagctgtcaattccctcatgtc

SEQ ID NO: 185754 - DNA, 25 bp, Mus musculus
aggaagctgtcatggccgcaatcgt

SEQ ID NO: 185755 - DNA, 25 bp, Mus musculus
aggaagctgtcattgtgagatgtgt

SEQ ID NO: 185756 - DNA, 25 bp, Mus musculus
aggaagctgtcatttccctcatgtc

SEQ ID NO: 185757 - DNA, 25 bp, Mus musculus
aggaagctgtccaatgatcctgctt

SEQ ID NO: 185758 - DNA, 25 bp, Mus musculus
aggaagctgtcctatgatcctgctt

SEQ ID NO: 185759 - DNA, 25 bp, Mus musculus
aggaagctgtttcaactcgcccgag

SEQ ID NO: 185760 - DNA, 25 bp, Mus musculus
aggaagctgtttgaactcgcccgag

SEQ ID NO: 185761 - DNA, 25 bp, Mus musculus
aggaagctttccagcacggttcttt

SEQ ID NO: 185762 - DNA, 25 bp, Mus musculus
aggaagctttccagttcagacgccc

SEQ ID NO: 185763 - DNA, 25 bp, Mus musculus
aggaagctttcctgcacggttcttt

SEQ ID NO: 185764 - DNA, 25 bp, Mus musculus
aggaagctttcctgttcagacgccc

SEQ ID NO: 185765 - DNA, 25 bp, Mus musculus
aggaagctttctccctattcgataa

SEQ ID NO: 185766 - DNA, 25 bp, Mus musculus
aggaagctttctgcctattcgataa

SEQ ID NO: 185767 - DNA, 25 bp, Mus musculus
aggaaggaaaatccccacggcagtg

SEQ ID NO: 185768 - DNA, 25 bp, Mus musculus
aggaaggaaaatgcccacggcagtg

SEQ ID NO: 185769 - DNA, 25 bp, Mus musculus
aggaaggacacaacagcatcctcac

SEQ ID NO: 185770 - DNA, 25 bp, Mus musculus
aggaaggacacacatccacttggcc

SEQ ID NO: 185771 - DNA, 25 bp, Mus musculus
aggaaggacacagatccacttggcc

SEQ ID NO: 185772 - DNA, 25 bp, Mus musculus
aggaaggacacatcagcatcctcac

SEQ ID NO: 185773 - DNA, 25 bp, Mus musculus
aggaaggaccctctgcgcaggctca

SEQ ID NO: 185774 - DNA, 25 bp, Mus musculus
aggaaggaccctgtgcgcaggctca

SEQ ID NO: 185775 - DNA, 25 bp, Mus musculus
aggaaggagaaaaagcgatgcaaac

SEQ ID NO: 185776 - DNA, 25 bp, Mus musculus
aggaaggagaaatagcgatgcaaac

SEQ ID NO: 185777 - DNA, 25 bp, Mus musculus
aggaaggagaccatgatccatcctt

SEQ ID NO: 185778 - DNA, 25 bp, Mus musculus
aggaaggagaccttgatccatcctt

SEQ ID NO: 185779 - DNA, 25 bp, Mus musculus
aggaaggaggctactgcttgccctg

SEQ ID NO: 185780 - DNA, 25 bp, Mus musculus
aggaaggaggcttctgcttgccctg

SEQ ID NO: 185781 - DNA, 25 bp, Mus musculus
aggaaggagggcatccagactgact

SEQ ID NO: 185782 - DNA, 25 bp, Mus musculus
aggaaggagggcttccagactgact

SEQ ID NO: 185783 - DNA, 25 bp, Mus musculus
aggaaggatcacatcaatccgctgc

SEQ ID NO: 185784 - DNA, 25 bp, Mus musculus
aggaaggatcacttcaatccgctgc

SEQ ID NO: 185785 - DNA, 25 bp, Mus musculus
aggaaggatccactctacctgcctc

SEQ ID NO: 185786 - DNA, 25 bp, Mus musculus
aggaaggatccagtctacctgcctc

SEQ ID NO: 185787 - DNA, 25 bp, Mus musculus
aggaaggatgtacccactctgctgt

SEQ ID NO: 185788 - DNA, 25 bp, Mus musculus
aggaaggatgtagccactctgctgt

SEQ ID NO: 185789 - DNA, 25 bp, Mus musculus
aggaaggattaaccacgtctgtggt

SEQ ID NO: 185790 - DNA, 25 bp, Mus musculus
aggaaggattaagcacgtctgtggt

SEQ ID NO: 185791 - DNA, 25 bp, Mus musculus
aggaaggattggacctcctgcacgc

SEQ ID NO: 185792 - DNA, 25 bp, Mus musculus
aggaaggattggtcctcctgcacgc

SEQ ID NO: 185793 - DNA, 25 bp, Mus musculus
aggaaggcaacgaagacatccgaga

SEQ ID NO: 185794 - DNA, 25 bp, Mus musculus
aggaaggcaacgtagacatccgaga

SEQ ID NO: 185795 - DNA, 25 bp, Mus musculus
aggaaggcacagaccaggaacccac

SEQ ID NO: 185796 - DNA, 25 bp, Mus musculus
aggaaggcacagtccaggaacccac

SEQ ID NO: 185797 - DNA, 25 bp, Mus musculus
aggaaggcaccgaagcagctgcgac

SEQ ID NO: 185798 - DNA, 25 bp, Mus musculus
aggaaggcaccgtagcagctgcgac

SEQ ID NO: 185799 - DNA, 25 bp, Mus musculus
aggaaggcatctcctcacctccagt

SEQ ID NO: 185800 - DNA, 25 bp, Mus musculus
aggaaggcatctgctcacctccagt

SEQ ID NO: 185801 - DNA, 25 bp, Mus musculus
aggaaggccaaacccacacttgctt

SEQ ID NO: 185802 - DNA, 25 bp, Mus musculus
aggaaggccaaagccacacttgctt

SEQ ID NO: 185803 - DNA, 25 bp, Mus musculus
aggaaggccattacagttgtgctga

SEQ ID NO: 185804 - DNA, 25 bp, Mus musculus
aggaaggccatttcagttgtgctga

SEQ ID NO: 185805 - DNA, 25 bp, Mus musculus
aggaaggccgtgaacctgcgtgctt

SEQ ID NO: 185806 - DNA, 25 bp, Mus musculus
aggaaggccgtgtacctgcgtgctt

SEQ ID NO: 185807 - DNA, 25 bp, Mus musculus
aggaaggcctgcacgcccctgctgg

SEQ ID NO: 185808 - DNA, 25 bp, Mus musculus
aggaaggcctgctcgcccctgctgg

SEQ ID NO: 185809 - DNA, 25 bp, Mus musculus
aggaaggcctggaaactcctgaact

SEQ ID NO: 185810 - DNA, 25 bp, Mus musculus
aggaaggcctggtaactcctgaact

SEQ ID NO: 185811 - DNA, 25 bp, Mus musculus
aggaaggcgtcacctttctgttttc

SEQ ID NO: 185812 - DNA, 25 bp, Mus musculus
aggaaggcgtcagctttctgttttc

SEQ ID NO: 185813 - DNA, 25 bp, Mus musculus
aggaaggcgtccactcctgatagct

SEQ ID NO: 185814 - DNA, 25 bp, Mus musculus
aggaaggcgtcctctcctgatagct

SEQ ID NO: 185815 - DNA, 25 bp, Mus musculus
aggaaggctatgaccaaactgggtc

SEQ ID NO: 185816 - DNA, 25 bp, Mus musculus
aggaaggctatgtccaaactgggtc

SEQ ID NO: 185817 - DNA, 25 bp, Mus musculus
aggaaggctcacactgccaatgctg

SEQ ID NO: 185818 - DNA, 25 bp, Mus musculus
aggaaggctcactctgccaatgctg

SEQ ID NO: 185819 - DNA, 25 bp, Mus musculus
aggaaggctcagctatctttcccag

SEQ ID NO: 185820 - DNA, 25 bp, Mus musculus
aggaaggctcaggtatctttcccag

SEQ ID NO: 185821 - DNA, 25 bp, Mus musculus
aggaaggctccgagtctgagtcccg

SEQ ID NO: 185822 - DNA, 25 bp, Mus musculus
aggaaggctccgtgtctgagtcccg

SEQ ID NO: 185823 - DNA, 25 bp, Mus musculus
aggaaggctcctccactgtataatc

SEQ ID NO: 185824 - DNA, 25 bp, Mus musculus
aggaaggctcctgcactgtataatc

SEQ ID NO: 185825 - DNA, 25 bp, Mus musculus
aggaaggctgtgacacccaactctt

SEQ ID NO: 185826 - DNA, 25 bp, Mus musculus
aggaaggctgtgtcacccaactctt

SEQ ID NO: 185827 - DNA, 25 bp, Mus musculus
aggaaggctgttctccctggaccag

SEQ ID NO: 185828 - DNA, 25 bp, Mus musculus
aggaaggctgttgtccctggaccag

SEQ ID NO: 185829 - DNA, 25 bp, Mus musculus
aggaaggcttctacaacctgctgac

SEQ ID NO: 185830 - DNA, 25 bp, Mus musculus
aggaaggcttcttcaacctgctgac

SEQ ID NO: 185831 - DNA, 25 bp, Mus musculus
aggaagggccatcttctcagaatat

SEQ ID NO: 185832 - DNA, 25 bp, Mus musculus
aggaagggccatgttctcagaatat

SEQ ID NO: 185833 - DNA, 25 bp, Mus musculus
aggaagggctgcaggtcactttcga

SEQ ID NO: 185834 - DNA, 25 bp, Mus musculus
aggaagggctgctggtcactttcga

SEQ ID NO: 185835 - DNA, 25 bp, Mus musculus
aggaagggcttcagtgtcccttgga

SEQ ID NO: 185836 - DNA, 25 bp, Mus musculus
aggaagggcttctgtgtcccttgga

SEQ ID NO: 185837 - DNA, 25 bp, Mus musculus
aggaagggtagccaacctctcgcct

SEQ ID NO: 185838 - DNA, 25 bp, Mus musculus
aggaagggtagcgaacctctcgcct

SEQ ID NO: 185839 - DNA, 25 bp, Mus musculus
aggaagggtcgaccacttacaccca

SEQ ID NO: 185840 - DNA, 25 bp, Mus musculus
aggaagggtcgagcacttacaccca

SEQ ID NO: 185841 - DNA, 25 bp, Mus musculus
aggaagggtgatacaaagccaccaa

SEQ ID NO: 185842 - DNA, 25 bp, Mus musculus
aggaagggtgattcaaagccaccaa

SEQ ID NO: 185843 - DNA, 25 bp, Mus musculus
aggaaggtatgcattgttgtctcaa

SEQ ID NO: 185844 - DNA, 25 bp, Mus musculus
aggaaggtatgctttgttgtctcaa

SEQ ID NO: 185845 - DNA, 25 bp, Mus musculus
aggaaggtcaaaccatttaagaaca

SEQ ID NO: 185846 - DNA, 25 bp, Mus musculus
aggaaggtcaaagcatttaagaaca

SEQ ID NO: 185847 - DNA, 25 bp, Mus musculus
aggaaggtcactccttaccgtgtac

SEQ ID NO: 185848 - DNA, 25 bp, Mus musculus
aggaaggtcactgcttaccgtgtac

SEQ ID NO: 185849 - DNA, 25 bp, Mus musculus
aggaaggtcattcgtcgctggtcac

SEQ ID NO: 185850 - DNA, 25 bp, Mus musculus
aggaaggtcattggtcgctggtcac

SEQ ID NO: 185851 - DNA, 25 bp, Mus musculus
aggaaggtcgagcttctgcctgcct

SEQ ID NO: 185852 - DNA, 25 bp, Mus musculus
aggaaggtcgaggttctgcctgcct

SEQ ID NO: 185853 - DNA, 25 bp, Mus musculus
aggaaggtctccattttgcattgtt

SEQ ID NO: 185854 - DNA, 25 bp, Mus musculus
aggaaggtctcctttttgcattgtt

SEQ ID NO: 185855 - DNA, 25 bp, Mus musculus
aggaaggtctctagtttctcaacac

SEQ ID NO: 185856 - DNA, 25 bp, Mus musculus
aggaaggtctcttgtttctcaacac

SEQ ID NO: 185857 - DNA, 25 bp, Mus musculus
aggaaggtctgccttggctgtccca

SEQ ID NO: 185858 - DNA, 25 bp, Mus musculus
aggaaggtctgcgttggctgtccca

SEQ ID NO: 185859 - DNA, 25 bp, Mus musculus
aggaaggtcttaagcatgtaatgtc

SEQ ID NO: 185860 - DNA, 25 bp, Mus musculus
aggaaggtcttatgcatgtaatgtc

SEQ ID NO: 185861 - DNA, 25 bp, Mus musculus
aggaaggtgacaattcttagtctct

SEQ ID NO: 185862 - DNA, 25 bp, Mus musculus
aggaaggtgacatttcttagtctct

SEQ ID NO: 185863 - DNA, 25 bp, Mus musculus
aggaaggtgcctcttgcctgctttt

SEQ ID NO: 185864 - DNA, 25 bp, Mus musculus
aggaaggtgcctgttgcctgctttt

SEQ ID NO: 185865 - DNA, 25 bp, Mus musculus
aggaaggtggacatgccgctctcgc

SEQ ID NO: 185866 - DNA, 25 bp, Mus musculus
aggaaggtggacttgccgctctcgc

SEQ ID NO: 185867 - DNA, 25 bp, Mus musculus
aggaaggtggctactgcatgctcct

SEQ ID NO: 185868 - DNA, 25 bp, Mus musculus
aggaaggtggctcccttgatcgctt

SEQ ID NO: 185869 - DNA, 25 bp, Mus musculus
aggaaggtggctgccttgatcgctt

SEQ ID NO: 185870 - DNA, 25 bp, Mus musculus
aggaaggtggcttctgcatgctcct

SEQ ID NO: 185871 - DNA, 25 bp, Mus musculus
aggaaggttcctactgacagtttgg

SEQ ID NO: 185872 - DNA, 25 bp, Mus musculus
aggaaggttccttctgacagtttgg

SEQ ID NO: 185873 - DNA, 25 bp, Mus musculus
aggaaggttctcaggcaactttctc

SEQ ID NO: 185874 - DNA, 25 bp, Mus musculus
aggaaggttctctggcaactttctc

SEQ ID NO: 185875 - DNA, 25 bp, Mus musculus
aggaaggttgccactcctttagact

SEQ ID NO: 185876 - DNA, 25 bp, Mus musculus
aggaaggttgcctctcctttagact

SEQ ID NO: 185877 - DNA, 25 bp, Mus musculus
aggaaggttgtcctgcctattccat

SEQ ID NO: 185878 - DNA, 25 bp, Mus musculus
aggaaggttgtcgtgcctattccat

SEQ ID NO: 185879 - DNA, 25 bp, Mus musculus
aggaagtaaatacggctgccatcat

SEQ ID NO: 185880 - DNA, 25 bp, Mus musculus
aggaagtaaatagggctgccatcat

SEQ ID NO: 185881 - DNA, 25 bp, Mus musculus
aggaagtaccatccgggttccatgc

SEQ ID NO: 185882 - DNA, 25 bp, Mus musculus
aggaagtaccatgcgggttccatgc

SEQ ID NO: 185883 - DNA, 25 bp, Mus musculus
aggaagtagatgcaaagcccacccc

SEQ ID NO: 185884 - DNA, 25 bp, Mus musculus
aggaagtagatggaaagcccacccc

SEQ ID NO: 185885 - DNA, 25 bp, Mus musculus
aggaagtagcttcagctgcctcctc

SEQ ID NO: 185886 - DNA, 25 bp, Mus musculus
aggaagtagcttgagctgcctcctc

SEQ ID NO: 185887 - DNA, 25 bp, Mus musculus
aggaagtagggtatgctcgctgtca

SEQ ID NO: 185888 - DNA, 25 bp, Mus musculus
aggaagtagggtttgctcgctgtca

SEQ ID NO: 185889 - DNA, 25 bp, Mus musculus
aggaagtatacaatccaaccctcag

SEQ ID NO: 185890 - DNA, 25 bp, Mus musculus
aggaagtatacattccaaccctcag

SEQ ID NO: 185891 - DNA, 25 bp, Mus musculus
aggaagtcacagctctaaggtcaga

SEQ ID NO: 185892 - DNA, 25 bp, Mus musculus
aggaagtcacaggtctaaggtcaga

SEQ ID NO: 185893 - DNA, 25 bp, Mus musculus
aggaagtcaccacaacgcttcgaga

SEQ ID NO: 185894 - DNA, 25 bp, Mus musculus
aggaagtcaccagaacgcttcgaga

SEQ ID NO: 185895 - DNA, 25 bp, Mus musculus
aggaagtcacccctcatgcatctga

SEQ ID NO: 185896 - DNA, 25 bp, Mus musculus
aggaagtcacccgtcatgcatctga

SEQ ID NO: 185897 - DNA, 25 bp, Mus musculus
aggaagtcatggacccaccctaatg

SEQ ID NO: 185898 - DNA, 25 bp, Mus musculus
aggaagtcatggtcccaccctaatg

SEQ ID NO: 185899 - DNA, 25 bp, Mus musculus
aggaagtcattcatgctataagcat

SEQ ID NO: 185900 - DNA, 25 bp, Mus musculus
aggaagtcattcttgctataagcat

SEQ ID NO: 185901 - DNA, 25 bp, Mus musculus
aggaagtccataccacaggctgctt

SEQ ID NO: 185902 - DNA, 25 bp, Mus musculus
aggaagtccatagcacaggctgctt

SEQ ID NO: 185903 - DNA, 25 bp, Mus musculus
aggaagtccatgatttaccattgaa

SEQ ID NO: 185904 - DNA, 25 bp, Mus musculus
aggaagtccatgttttaccattgaa

SEQ ID NO: 185905 - DNA, 25 bp, Mus musculus
aggaagtccttcacgccttagtgtt

SEQ ID NO: 185906 - DNA, 25 bp, Mus musculus
aggaagtccttctcgccttagtgtt

SEQ ID NO: 185907 - DNA, 25 bp, Mus musculus
aggaagtcctttaaccatctgttga

SEQ ID NO: 185908 - DNA, 25 bp, Mus musculus
aggaagtccttttaccatctgttga

SEQ ID NO: 185909 - DNA, 25 bp, Mus musculus
aggaagtcgattccttcacctggat

SEQ ID NO: 185910 - DNA, 25 bp, Mus musculus
aggaagtcgattgcttcacctggat

SEQ ID NO: 185911 - DNA, 25 bp, Mus musculus
aggaagtcgcaaagaccctccagag

SEQ ID NO: 185912 - DNA, 25 bp, Mus musculus
aggaagtcgcaacgccagctttcta

SEQ ID NO: 185913 - DNA, 25 bp, Mus musculus
aggaagtcgcaaggccagctttcta

SEQ ID NO: 185914 - DNA, 25 bp, Mus musculus
aggaagtcgcaatgaccctccagag

SEQ ID NO: 185915 - DNA, 25 bp, Mus musculus
aggaagtcggctagactcccgcact

SEQ ID NO: 185916 - DNA, 25 bp, Mus musculus
aggaagtcggcttgactcccgcact

SEQ ID NO: 185917 - DNA, 25 bp, Mus musculus
aggaagtcgtgtagctttgggcctc

SEQ ID NO: 185918 - DNA, 25 bp, Mus musculus
aggaagtcgtgttgctttgggcctc

SEQ ID NO: 185919 - DNA, 25 bp, Mus musculus
aggaagtctagtcgtctgctcatga

SEQ ID NO: 185920 - DNA, 25 bp, Mus musculus
aggaagtctagtggtctgctcatga

SEQ ID NO: 185921 - DNA, 25 bp, Mus musculus
aggaagtctcagaactccaggctac

SEQ ID NO: 185922 - DNA, 25 bp, Mus musculus
aggaagtctcagtactccaggctac

SEQ ID NO: 185923 - DNA, 25 bp, Mus musculus
aggaagtctgatcccctcacacaca

SEQ ID NO: 185924 - DNA, 25 bp, Mus musculus
aggaagtctgatgccctcacacaca

SEQ ID NO: 185925 - DNA, 25 bp, Mus musculus
aggaagtcttggagccgctggacac

SEQ ID NO: 185926 - DNA, 25 bp, Mus musculus
aggaagtcttggtgccgctggacac

SEQ ID NO: 185927 - DNA, 25 bp, Mus musculus
aggaagtgaacaacaagttgactca

SEQ ID NO: 185928 - DNA, 25 bp, Mus musculus
aggaagtgaacatcaagttgactca

SEQ ID NO: 185929 - DNA, 25 bp, Mus musculus
aggaagtgagcaacttcctcaccga

SEQ ID NO: 185930 - DNA, 25 bp, Mus musculus
aggaagtgagcaattgcttttttct

SEQ ID NO: 185931 - DNA, 25 bp, Mus musculus
aggaagtgagcatcttcctcaccga

SEQ ID NO: 185932 - DNA, 25 bp, Mus musculus
aggaagtgagcatttgcttttttct

SEQ ID NO: 185933 - DNA, 25 bp, Mus musculus
aggaagtgagcgatcagctgctgct

SEQ ID NO: 185934 - DNA, 25 bp, Mus musculus
aggaagtgagcgttcagctgctgct

SEQ ID NO: 185935 - DNA, 25 bp, Mus musculus
aggaagtgatgcatctatccttggg

SEQ ID NO: 185936 - DNA, 25 bp, Mus musculus
aggaagtgatgcttctatccttggg

SEQ ID NO: 185937 - DNA, 25 bp, Mus musculus
aggaagtgccacatgctttgcatat

SEQ ID NO: 185938 - DNA, 25 bp, Mus musculus
aggaagtgccacttgctttgcatat

SEQ ID NO: 185939 - DNA, 25 bp, Mus musculus
aggaagtgccggacagcatcgacgc

SEQ ID NO: 185940 - DNA, 25 bp, Mus musculus
aggaagtgccggtcagcatcgacgc

SEQ ID NO: 185941 - DNA, 25 bp, Mus musculus
aggaagtgcctccaaactggaacat

SEQ ID NO: 185942 - DNA, 25 bp, Mus musculus
aggaagtgcctcgaaactggaacat

SEQ ID NO: 185943 - DNA, 25 bp, Mus musculus
aggaagtgctcaacagttacccttc

SEQ ID NO: 185944 - DNA, 25 bp, Mus musculus
aggaagtgctcatcagttacccttc

SEQ ID NO: 185945 - DNA, 25 bp, Mus musculus
aggaagtggactattggactgagct

SEQ ID NO: 185946 - DNA, 25 bp, Mus musculus
aggaagtggacttttggactgagct

SEQ ID NO: 185947 - DNA, 25 bp, Mus musculus
aggaagtgggcccagcatccccaca

SEQ ID NO: 185948 - DNA, 25 bp, Mus musculus
aggaagtgggccgagcatccccaca

SEQ ID NO: 185949 - DNA, 25 bp, Mus musculus
aggaagtggtgtactggcctgctat

SEQ ID NO: 185950 - DNA, 25 bp, Mus musculus
aggaagtggtgttctggcctgctat

SEQ ID NO: 185951 - DNA, 25 bp, Mus musculus
aggaagttaagcaggtttctgccaa

SEQ ID NO: 185952 - DNA, 25 bp, Mus musculus
aggaagttaagctggtttctgccaa

SEQ ID NO: 185953 - DNA, 25 bp, Mus musculus
aggaagttacttaagataatctctc

SEQ ID NO: 185954 - DNA, 25 bp, Mus musculus
aggaagttactttagataatctctc

SEQ ID NO: 185955 - DNA, 25 bp, Mus musculus
aggaagttagacagtgcctgcacct

SEQ ID NO: 185956 - DNA, 25 bp, Mus musculus
aggaagttagactgtgcctgcacct

SEQ ID NO: 185957 - DNA, 25 bp, Mus musculus
aggaagttagggagctcagttaaca

SEQ ID NO: 185958 - DNA, 25 bp, Mus musculus
aggaagttagggtgctcagttaaca

SEQ ID NO: 185959 - DNA, 25 bp, Mus musculus
aggaagttcaccaacccactgcagt

SEQ ID NO: 185960 - DNA, 25 bp, Mus musculus
aggaagttcacctacccactgcagt

SEQ ID NO: 185961 - DNA, 25 bp, Mus musculus
aggaagttcatgcatcctccctgtc

SEQ ID NO: 185962 - DNA, 25 bp, Mus musculus
aggaagttcatggatcctccctgtc

SEQ ID NO: 185963 - DNA, 25 bp, Mus musculus
aggaagttcctaactcaagcagcga

SEQ ID NO: 185964 - DNA, 25 bp, Mus musculus
aggaagttcctatctcaagcagcga

SEQ ID NO: 185965 - DNA, 25 bp, Mus musculus
aggaagttcctccaagctatccacc

SEQ ID NO: 185966 - DNA, 25 bp, Mus musculus
aggaagttcctcgaagctatccacc

SEQ ID NO: 185967 - DNA, 25 bp, Mus musculus
aggaagttcctgaaactggtccaca

SEQ ID NO: 185968 - DNA, 25 bp, Mus musculus
aggaagttcctgtaactggtccaca

SEQ ID NO: 185969 - DNA, 25 bp, Mus musculus
aggaagttcgtgatttccagtccct

SEQ ID NO: 185970 - DNA, 25 bp, Mus musculus
aggaagttcgtgttttccagtccct

SEQ ID NO: 185971 - DNA, 25 bp, Mus musculus
aggaagttcttgctcacctcctcct

SEQ ID NO: 185972 - DNA, 25 bp, Mus musculus
aggaagttcttggtcacctcctcct

SEQ ID NO: 185973 - DNA, 25 bp, Mus musculus
aggaagttgaacactgtagtacata

SEQ ID NO: 185974 - DNA, 25 bp, Mus musculus
aggaagttgaactctgtagtacata

SEQ ID NO: 185975 - DNA, 25 bp, Mus musculus
aggaagttgactccatttcccaagc

SEQ ID NO: 185976 - DNA, 25 bp, Mus musculus
aggaagttgactgcatttcccaagc

SEQ ID NO: 185977 - DNA, 25 bp, Mus musculus
aggaagttggtacgtctctgcagac

SEQ ID NO: 185978 - DNA, 25 bp, Mus musculus
aggaagttggtaggtctctgcagac

SEQ ID NO: 185979 - DNA, 25 bp, Mus musculus
aggaagttgtatccggatgccctcc

SEQ ID NO: 185980 - DNA, 25 bp, Mus musculus
aggaagttgtatgcggatgccctcc

SEQ ID NO: 185981 - DNA, 25 bp, Mus musculus
aggaagtttactagagacctggtgg

SEQ ID NO: 185982 - DNA, 25 bp, Mus musculus
aggaagtttacttgagacctggtgg

SEQ ID NO: 185983 - DNA, 25 bp, Mus musculus
aggaagtttataacccctcacaggt

SEQ ID NO: 185984 - DNA, 25 bp, Mus musculus
aggaagtttatatcccctcacaggt

SEQ ID NO: 185985 - DNA, 25 bp, Mus musculus
aggaagtttgagcatccccagagca

SEQ ID NO: 185986 - DNA, 25 bp, Mus musculus
aggaagtttgaggatccccagagca

SEQ ID NO: 185987 - DNA, 25 bp, Mus musculus
aggaagttttaccacatgaagaatg

SEQ ID NO: 185988 - DNA, 25 bp, Mus musculus
aggaagttttacgacatgaagaatg

SEQ ID NO: 185989 - DNA, 25 bp, Mus musculus
aggaagttttccagcatgttctttg

SEQ ID NO: 185990 - DNA, 25 bp, Mus musculus
aggaagttttccagcttgtttgaat

SEQ ID NO: 185991 - DNA, 25 bp, Mus musculus
aggaagttttcctgcatgttctttg

SEQ ID NO: 185992 - DNA, 25 bp, Mus musculus
aggaagttttcctgcttgtttgaat

SEQ ID NO: 185993 - DNA, 25 bp, Mus musculus
aggaagtttttcaatttgtcgcaag

SEQ ID NO: 185994 - DNA, 25 bp, Mus musculus
aggaagtttttctatttgtcgcaag

SEQ ID NO: 185995 - DNA, 25 bp, Mus musculus
aggaataaaatcatgctaacagcaa

SEQ ID NO: 185996 - DNA, 25 bp, Mus musculus
aggaataaaatcttgctaacagcaa

SEQ ID NO: 185997 - DNA, 25 bp, Mus musculus
aggaataaacctacttgctcctctg

SEQ ID NO: 185998 - DNA, 25 bp, Mus musculus
aggaataaaccttcttgctcctctg

SEQ ID NO: 185999 - DNA, 25 bp, Mus musculus
aggaataacctcaccagcagaccct

SEQ ID NO: 186000 - DNA, 25 bp, Mus musculus
aggaataacctctccagcagaccct

SEQ ID NO: 186001 - DNA, 25 bp, Mus musculus
aggaataactctaccctcatggtgc

SEQ ID NO: 186002 - DNA, 25 bp, Mus musculus
aggaataactcttccctcatggtgc

SEQ ID NO: 186003 - DNA, 25 bp, Mus musculus
aggaataagaatcccctcccaccgg

SEQ ID NO: 186004 - DNA, 25 bp, Mus musculus
aggaataagaatgccctcccaccgg

SEQ ID NO: 186005 - DNA, 25 bp, Mus musculus
aggaataagagtcctccatctcggg

SEQ ID NO: 186006 - DNA, 25 bp, Mus musculus
aggaataagagtgctccatctcggg

SEQ ID NO: 186007 - DNA, 25 bp, Mus musculus
aggaataaggtgacctctgcccaca

SEQ ID NO: 186008 - DNA, 25 bp, Mus musculus
aggaataaggtgtcctctgcccaca

SEQ ID NO: 186009 - DNA, 25 bp, Mus musculus
aggaataagtttccccactctgctt

SEQ ID NO: 186010 - DNA, 25 bp, Mus musculus
aggaataagtttgcccactctgctt

SEQ ID NO: 186011 - DNA, 25 bp, Mus musculus
aggaatacaagaagctgttggacat

SEQ ID NO: 186012 - DNA, 25 bp, Mus musculus
aggaatacaagatgctgttggacat

SEQ ID NO: 186013 - DNA, 25 bp, Mus musculus
aggaataccccgctcctgtaagtag

SEQ ID NO: 186014 - DNA, 25 bp, Mus musculus
aggaataccccggtcctgtaagtag

SEQ ID NO: 186015 - DNA, 25 bp, Mus musculus
aggaatacggctagctggctcacct

SEQ ID NO: 186016 - DNA, 25 bp, Mus musculus
aggaatacggcttgctggctcacct

SEQ ID NO: 186017 - DNA, 25 bp, Mus musculus
aggaatactaacagctcatttctca

SEQ ID NO: 186018 - DNA, 25 bp, Mus musculus
aggaatactaactgctcatttctca

SEQ ID NO: 186019 - DNA, 25 bp, Mus musculus
aggaatacttggatctcacccagcc

SEQ ID NO: 186020 - DNA, 25 bp, Mus musculus
aggaatacttggttctcacccagcc

SEQ ID NO: 186021 - DNA, 25 bp, Mus musculus
aggaatactttcacagtttctgagt

SEQ ID NO: 186022 - DNA, 25 bp, Mus musculus
aggaatactttctcagtttctgagt

SEQ ID NO: 186023 - DNA, 25 bp, Mus musculus
aggaatagcctcatatttggaagaa

SEQ ID NO: 186024 - DNA, 25 bp, Mus musculus
aggaatagcctcttatttggaagaa

SEQ ID NO: 186025 - DNA, 25 bp, Mus musculus
aggaatagctagctctgcaggtgca

SEQ ID NO: 186026 - DNA, 25 bp, Mus musculus
aggaatagctaggtctgcaggtgca

SEQ ID NO: 186027 - DNA, 25 bp, Mus musculus
aggaatagtttgacagcactttgta

SEQ ID NO: 186028 - DNA, 25 bp, Mus musculus
aggaatagtttgtcagcactttgta

SEQ ID NO: 186029 - DNA, 25 bp, Mus musculus
aggaatataactcccgctgttccct

SEQ ID NO: 186030 - DNA, 25 bp, Mus musculus
aggaatataactgccgctgttccct

SEQ ID NO: 186031 - DNA, 25 bp, Mus musculus
aggaatatactaacacaggtgctta

SEQ ID NO: 186032 - DNA, 25 bp, Mus musculus
aggaatatactatcacaggtgctta

SEQ ID NO: 186033 - DNA, 25 bp, Mus musculus
aggaatatcaagcctgcacctcctg

SEQ ID NO: 186034 - DNA, 25 bp, Mus musculus
aggaatatcaaggctgcacctcctg

SEQ ID NO: 186035 - DNA, 25 bp, Mus musculus
aggaatatggcgaccgctactcgcg

SEQ ID NO: 186036 - DNA, 25 bp, Mus musculus
aggaatatggcgtccgctactcgcg

SEQ ID NO: 186037 - DNA, 25 bp, Mus musculus
aggaatatggctcttcaacctgcct

SEQ ID NO: 186038 - DNA, 25 bp, Mus musculus
aggaatatggctgttcaacctgcct

SEQ ID NO: 186039 - DNA, 25 bp, Mus musculus
aggaatatgtccaaagtgccggtat

SEQ ID NO: 186040 - DNA, 25 bp, Mus musculus
aggaatatgtcctaagtgccggtat

SEQ ID NO: 186041 - DNA, 25 bp, Mus musculus
aggaatatgttcacagctcactgct

SEQ ID NO: 186042 - DNA, 25 bp, Mus musculus
aggaatatgttctcagctcactgct

SEQ ID NO: 186043 - DNA, 25 bp, Mus musculus
aggaatattacacgaggctcggagt

SEQ ID NO: 186044 - DNA, 25 bp, Mus musculus
aggaatattacaggaggctcggagt

SEQ ID NO: 186045 - DNA, 25 bp, Mus musculus
aggaatattctcaagacttcagtgt

SEQ ID NO: 186046 - DNA, 25 bp, Mus musculus
aggaatattctcacatcacagctaa

SEQ ID NO: 186047 - DNA, 25 bp, Mus musculus
aggaatattctctagacttcagtgt

SEQ ID NO: 186048 - DNA, 25 bp, Mus musculus
aggaatattctctcatcacagctaa

SEQ ID NO: 186049 - DNA, 25 bp, Mus musculus
aggaatattgttcagatgtccagct

SEQ ID NO: 186050 - DNA, 25 bp, Mus musculus
aggaatattgttgagatgtccagct

SEQ ID NO: 186051 - DNA, 25 bp, Mus musculus
aggaatcaatgtcgctcctcccttt

SEQ ID NO: 186052 - DNA, 25 bp, Mus musculus
aggaatcaatgtggctcctcccttt

SEQ ID NO: 186053 - DNA, 25 bp, Mus musculus
aggaatcacagcaccactttcgttt

SEQ ID NO: 186054 - DNA, 25 bp, Mus musculus
aggaatcacagctccactttcgttt

SEQ ID NO: 186055 - DNA, 25 bp, Mus musculus
aggaatcacccacttgcaatctgtt

SEQ ID NO: 186056 - DNA, 25 bp, Mus musculus
aggaatcacccagttgcaatctgtt

SEQ ID NO: 186057 - DNA, 25 bp, Mus musculus
aggaatcacctaagttttcaacagt

SEQ ID NO: 186058 - DNA, 25 bp, Mus musculus
aggaatcacctatgttttcaacagt

SEQ ID NO: 186059 - DNA, 25 bp, Mus musculus
aggaatcactcaccagaacagccag

SEQ ID NO: 186060 - DNA, 25 bp, Mus musculus
aggaatcactcagcagaacagccag

SEQ ID NO: 186061 - DNA, 25 bp, Mus musculus
aggaatcactgtacgctaaccaaag

SEQ ID NO: 186062 - DNA, 25 bp, Mus musculus
aggaatcactgttcgctaaccaaag

SEQ ID NO: 186063 - DNA, 25 bp, Mus musculus
aggaatcagattcacggaggcagaa

SEQ ID NO: 186064 - DNA, 25 bp, Mus musculus
aggaatcagattcatgactgcagtc

SEQ ID NO: 186065 - DNA, 25 bp, Mus musculus
aggaatcagattgacggaggcagaa

SEQ ID NO: 186066 - DNA, 25 bp, Mus musculus
aggaatcagattgatgactgcagtc

SEQ ID NO: 186067 - DNA, 25 bp, Mus musculus
aggaatcagctacgtccaggtggta

SEQ ID NO: 186068 - DNA, 25 bp, Mus musculus
aggaatcagctaggtccaggtggta

SEQ ID NO: 186069 - DNA, 25 bp, Mus musculus
aggaatcagtcaatccctgttgcct

SEQ ID NO: 186070 - DNA, 25 bp, Mus musculus
aggaatcagtcattccctgttgcct

SEQ ID NO: 186071 - DNA, 25 bp, Mus musculus
aggaatcattgtaggtctatagaaa

SEQ ID NO: 186072 - DNA, 25 bp, Mus musculus
aggaatcattgttggtctatagaaa

SEQ ID NO: 186073 - DNA, 25 bp, Mus musculus
aggaatccaacaaacccagctgagg

SEQ ID NO: 186074 - DNA, 25 bp, Mus musculus
aggaatccaacatacccagctgagg

SEQ ID NO: 186075 - DNA, 25 bp, Mus musculus
aggaatccaactccagtcactggaa

SEQ ID NO: 186076 - DNA, 25 bp, Mus musculus
aggaatccaactgcagtcactggaa

SEQ ID NO: 186077 - DNA, 25 bp, Mus musculus
aggaatccacttcacttctttcagc

SEQ ID NO: 186078 - DNA, 25 bp, Mus musculus
aggaatccacttgacttctttcagc

SEQ ID NO: 186079 - DNA, 25 bp, Mus musculus
aggaatccagcacgtgcaccaggca

SEQ ID NO: 186080 - DNA, 25 bp, Mus musculus
aggaatccagcaggtgcaccaggca

SEQ ID NO: 186081 - DNA, 25 bp, Mus musculus
aggaatccagtcatgtcattacata

SEQ ID NO: 186082 - DNA, 25 bp, Mus musculus
aggaatccagtcttgtcattacata

SEQ ID NO: 186083 - DNA, 25 bp, Mus musculus
aggaatcccattcttaagccgcgat

SEQ ID NO: 186084 - DNA, 25 bp, Mus musculus
aggaatcccattgttaagccgcgat

SEQ ID NO: 186085 - DNA, 25 bp, Mus musculus
aggaatccgagacaccttctggtga

SEQ ID NO: 186086 - DNA, 25 bp, Mus musculus
aggaatccgagagaccttctggtga

SEQ ID NO: 186087 - DNA, 25 bp, Mus musculus
aggaatccgtaaaacacatctttaa

SEQ ID NO: 186088 - DNA, 25 bp, Mus musculus
aggaatccgtaatacacatctttaa

SEQ ID NO: 186089 - DNA, 25 bp, Mus musculus
aggaatcctaggcagccgtgctcaa

SEQ ID NO: 186090 - DNA, 25 bp, Mus musculus
aggaatcctagggagccgtgctcaa

SEQ ID NO: 186091 - DNA, 25 bp, Mus musculus
aggaatcctcggcagataaactgga

SEQ ID NO: 186092 - DNA, 25 bp, Mus musculus
aggaatcctcgggagataaactgga

SEQ ID NO: 186093 - DNA, 25 bp, Mus musculus
aggaatccttggacctgagggccca

SEQ ID NO: 186094 - DNA, 25 bp, Mus musculus
aggaatccttggtcctgagggccca

SEQ ID NO: 186095 - DNA, 25 bp, Mus musculus
aggaatcctttgattcatccctgag

SEQ ID NO: 186096 - DNA, 25 bp, Mus musculus
aggaatcctttgtttcatccctgag

SEQ ID NO: 186097 - DNA, 25 bp, Mus musculus
aggaatcgtcttctatatacaggaa

SEQ ID NO: 186098 - DNA, 25 bp, Mus musculus
aggaatcgtcttgtatatacaggaa

SEQ ID NO: 186099 - DNA, 25 bp, Mus musculus
aggaatcgtgtgcatcctctctgct

SEQ ID NO: 186100 - DNA, 25 bp, Mus musculus
aggaatcgtgtggatcctctctgct

SEQ ID NO: 186101 - DNA, 25 bp, Mus musculus
aggaatctaacaacactatgctgat

SEQ ID NO: 186102 - DNA, 25 bp, Mus musculus
aggaatctaacatcactatgctgat

SEQ ID NO: 186103 - DNA, 25 bp, Mus musculus
aggaatctagtgatgcctcttgcct

SEQ ID NO: 186104 - DNA, 25 bp, Mus musculus
aggaatctagtgttgcctcttgcct

SEQ ID NO: 186105 - DNA, 25 bp, Mus musculus
aggaatctcaatagggacagcaggc

SEQ ID NO: 186106 - DNA, 25 bp, Mus musculus
aggaatctcaattgggacagcaggc

SEQ ID NO: 186107 - DNA, 25 bp, Mus musculus
aggaatctcaggattctcacaccct

SEQ ID NO: 186108 - DNA, 25 bp, Mus musculus
aggaatctcaggtttctcacaccct

SEQ ID NO: 186109 - DNA, 25 bp, Mus musculus
aggaatctcatcacccagcatcgtg

SEQ ID NO: 186110 - DNA, 25 bp, Mus musculus
aggaatctcatcagagccttgaccc

SEQ ID NO: 186111 - DNA, 25 bp, Mus musculus
aggaatctcatctcccagcatcgtg

SEQ ID NO: 186112 - DNA, 25 bp, Mus musculus
aggaatctcatctgagccttgaccc

SEQ ID NO: 186113 - DNA, 25 bp, Mus musculus
aggaatctctccaaaggtcctgcag

SEQ ID NO: 186114 - DNA, 25 bp, Mus musculus
aggaatctctcctaaggtcctgcag

SEQ ID NO: 186115 - DNA, 25 bp, Mus musculus
aggaatctctgactgtctccttaga

SEQ ID NO: 186116 - DNA, 25 bp, Mus musculus
aggaatctctgagtgtctccttaga

SEQ ID NO: 186117 - DNA, 25 bp, Mus musculus
aggaatctctgccaccctaagaaat

SEQ ID NO: 186118 - DNA, 25 bp, Mus musculus
aggaatctctgcgaccctaagaaat

SEQ ID NO: 186119 - DNA, 25 bp, Mus musculus
aggaatctcttcctcttgtttgcta

SEQ ID NO: 186120 - DNA, 25 bp, Mus musculus
aggaatctcttcgtcttgtttgcta

SEQ ID NO: 186121 - DNA, 25 bp, Mus musculus
aggaatctgaatatttgtgtctgga

SEQ ID NO: 186122 - DNA, 25 bp, Mus musculus
aggaatctgaatttttgtgtctgga

SEQ ID NO: 186123 - DNA, 25 bp, Mus musculus
aggaatctgactctgacttctctga

SEQ ID NO: 186124 - DNA, 25 bp, Mus musculus
aggaatctgactgtgacttctctga

SEQ ID NO: 186125 - DNA, 25 bp, Mus musculus
aggaatctgccacgaaggtctgata

SEQ ID NO: 186126 - DNA, 25 bp, Mus musculus
aggaatctgccaggaaggtctgata

SEQ ID NO: 186127 - DNA, 25 bp, Mus musculus
aggaatctgcctacactgtaacgtc

SEQ ID NO: 186128 - DNA, 25 bp, Mus musculus
aggaatctgccttcactgtaacgtc

SEQ ID NO: 186129 - DNA, 25 bp, Mus musculus
aggaatctgctcatttttcttggga

SEQ ID NO: 186130 - DNA, 25 bp, Mus musculus
aggaatctgctcttttttcttggga

SEQ ID NO: 186131 - DNA, 25 bp, Mus musculus
aggaatctggccctgtctaatggtc

SEQ ID NO: 186132 - DNA, 25 bp, Mus musculus
aggaatctggccgtgtctaatggtc

SEQ ID NO: 186133 - DNA, 25 bp, Mus musculus
aggaatctgggcctattgtctactc

SEQ ID NO: 186134 - DNA, 25 bp, Mus musculus
aggaatctgggcgtattgtctactc

SEQ ID NO: 186135 - DNA, 25 bp, Mus musculus
aggaatcttccaaatagctcgctga

SEQ ID NO: 186136 - DNA, 25 bp, Mus musculus
aggaatcttccatatagctcgctga

SEQ ID NO: 186137 - DNA, 25 bp, Mus musculus
aggaatcttccccaactctgagcca

SEQ ID NO: 186138 - DNA, 25 bp, Mus musculus
aggaatcttcccgaactctgagcca

SEQ ID NO: 186139 - DNA, 25 bp, Mus musculus
aggaatcttgcacgaggctggacat

SEQ ID NO: 186140 - DNA, 25 bp, Mus musculus
aggaatcttgcaggaggctggacat

SEQ ID NO: 186141 - DNA, 25 bp, Mus musculus
aggaatctttccagtatcggaccag

SEQ ID NO: 186142 - DNA, 25 bp, Mus musculus
aggaatctttcctgtatcggaccag

SEQ ID NO: 186143 - DNA, 25 bp, Mus musculus
aggaatctttgacgccacagctcat

SEQ ID NO: 186144 - DNA, 25 bp, Mus musculus
aggaatctttgaggccacagctcat

SEQ ID NO: 186145 - DNA, 25 bp, Mus musculus
aggaatgaacggctccacatcccac

SEQ ID NO: 186146 - DNA, 25 bp, Mus musculus
aggaatgaacgggtccacatcccac

SEQ ID NO: 186147 - DNA, 25 bp, Mus musculus
aggaatgaatccatgccttgccttg

SEQ ID NO: 186148 - DNA, 25 bp, Mus musculus
aggaatgaatccttgccttgccttg

SEQ ID NO: 186149 - DNA, 25 bp, Mus musculus
aggaatgaatctcccatcagcttcg

SEQ ID NO: 186150 - DNA, 25 bp, Mus musculus
aggaatgaatctgccatcagcttcg

SEQ ID NO: 186151 - DNA, 25 bp, Mus musculus
aggaatgactttacatttgcctaaa

SEQ ID NO: 186152 - DNA, 25 bp, Mus musculus
aggaatgacttttcatttgcctaaa

SEQ ID NO: 186153 - DNA, 25 bp, Mus musculus
aggaatgagggtcaccttcatcctg

SEQ ID NO: 186154 - DNA, 25 bp, Mus musculus
aggaatgagggtgaccttcatcctg

SEQ ID NO: 186155 - DNA, 25 bp, Mus musculus
aggaatgatactactggccgacaaa

SEQ ID NO: 186156 - DNA, 25 bp, Mus musculus
aggaatgatacttctggccgacaaa

SEQ ID NO: 186157 - DNA, 25 bp, Mus musculus
aggaatgatgtcatgagaaggcccc

SEQ ID NO: 186158 - DNA, 25 bp, Mus musculus
aggaatgatgtcttgagaaggcccc

SEQ ID NO: 186159 - DNA, 25 bp, Mus musculus
aggaatgcaccaatccctgtcggga

SEQ ID NO: 186160 - DNA, 25 bp, Mus musculus
aggaatgcaccattccctgtcggga

SEQ ID NO: 186161 - DNA, 25 bp, Mus musculus
aggaatgcacgcactggcttcaagc

SEQ ID NO: 186162 - DNA, 25 bp, Mus musculus
aggaatgcacgctctggcttcaagc

SEQ ID NO: 186163 - DNA, 25 bp, Mus musculus
aggaatgcagtcactggcagggaaa

SEQ ID NO: 186164 - DNA, 25 bp, Mus musculus
aggaatgcagtctctggcagggaaa

SEQ ID NO: 186165 - DNA, 25 bp, Mus musculus
aggaatgccaacagccaaggaggtg

SEQ ID NO: 186166 - DNA, 25 bp, Mus musculus
aggaatgccaactgccaaggaggtg

SEQ ID NO: 186167 - DNA, 25 bp, Mus musculus
aggaatgccaccaggagactgccag

SEQ ID NO: 186168 - DNA, 25 bp, Mus musculus
aggaatgccacctggagactgccag

SEQ ID NO: 186169 - DNA, 25 bp, Mus musculus
aggaatgccatgcacacaggcctga

SEQ ID NO: 186170 - DNA, 25 bp, Mus musculus
aggaatgccatggacacaggcctga

SEQ ID NO: 186171 - DNA, 25 bp, Mus musculus
aggaatgccctcaggactcgagcct

SEQ ID NO: 186172 - DNA, 25 bp, Mus musculus
aggaatgccctctggactcgagcct

SEQ ID NO: 186173 - DNA, 25 bp, Mus musculus
aggaatgccgatcttgaagccagaa

SEQ ID NO: 186174 - DNA, 25 bp, Mus musculus
aggaatgccgatgttgaagccagaa

SEQ ID NO: 186175 - DNA, 25 bp, Mus musculus
aggaatgcctacaagccattttgct

SEQ ID NO: 186176 - DNA, 25 bp, Mus musculus
aggaatgcctactagccattttgct

SEQ ID NO: 186177 - DNA, 25 bp, Mus musculus
aggaatgcctatcggaacctacgac

SEQ ID NO: 186178 - DNA, 25 bp, Mus musculus
aggaatgcctatgggaacctacgac

SEQ ID NO: 186179 - DNA, 25 bp, Mus musculus
aggaatgcctctaaactcatacccg

SEQ ID NO: 186180 - DNA, 25 bp, Mus musculus
aggaatgcctctactggctgagcac

SEQ ID NO: 186181 - DNA, 25 bp, Mus musculus
aggaatgcctcttaactcatacccg

SEQ ID NO: 186182 - DNA, 25 bp, Mus musculus
aggaatgcctcttctggctgagcac

SEQ ID NO: 186183 - DNA, 25 bp, Mus musculus
aggaatgctaacagctcacttgcag

SEQ ID NO: 186184 - DNA, 25 bp, Mus musculus
aggaatgctaactgctcacttgcag

SEQ ID NO: 186185 - DNA, 25 bp, Mus musculus
aggaatgctaggatcaggaaatcat

SEQ ID NO: 186186 - DNA, 25 bp, Mus musculus
aggaatgctaggttcaggaaatcat

SEQ ID NO: 186187 - DNA, 25 bp, Mus musculus
aggaatgctgccaggaggtcataaa

SEQ ID NO: 186188 - DNA, 25 bp, Mus musculus
aggaatgctgcctggaggtcataaa

SEQ ID NO: 186189 - DNA, 25 bp, Mus musculus
aggaatgctggccagtcagtctagc

SEQ ID NO: 186190 - DNA, 25 bp, Mus musculus
aggaatgctggcgagtcagtctagc

SEQ ID NO: 186191 - DNA, 25 bp, Mus musculus
aggaatgctggtcctcttctttgca

SEQ ID NO: 186192 - DNA, 25 bp, Mus musculus
aggaatgctggtgctcttctttgca

SEQ ID NO: 186193 - DNA, 25 bp, Mus musculus
aggaatgcttccactgtgacaggct

SEQ ID NO: 186194 - DNA, 25 bp, Mus musculus
aggaatgcttcctctgtgacaggct

SEQ ID NO: 186195 - DNA, 25 bp, Mus musculus
aggaatggacccagatgcttcacgg

SEQ ID NO: 186196 - DNA, 25 bp, Mus musculus
aggaatggaccctgatgcttcacgg

SEQ ID NO: 186197 - DNA, 25 bp, Mus musculus
aggaatggagctaccctcagtcttc

SEQ ID NO: 186198 - DNA, 25 bp, Mus musculus
aggaatggagcttccctcagtcttc

SEQ ID NO: 186199 - DNA, 25 bp, Mus musculus
aggaatggcactacccacagagggt

SEQ ID NO: 186200 - DNA, 25 bp, Mus musculus
aggaatggcacttcccacagagggt

SEQ ID NO: 186201 - DNA, 25 bp, Mus musculus
aggaatggcattccgggtgccaacc

SEQ ID NO: 186202 - DNA, 25 bp, Mus musculus
aggaatggcattctcgtgttgcttc

SEQ ID NO: 186203 - DNA, 25 bp, Mus musculus
aggaatggcattgcgggtgccaacc

SEQ ID NO: 186204 - DNA, 25 bp, Mus musculus
aggaatggcattgtcgtgttgcttc

SEQ ID NO: 186205 - DNA, 25 bp, Mus musculus
aggaatggccaaccctgctttgtgt

SEQ ID NO: 186206 - DNA, 25 bp, Mus musculus
aggaatggccaagcctgctttgtgt

SEQ ID NO: 186207 - DNA, 25 bp, Mus musculus
aggaatggcctcaattggctggcct

SEQ ID NO: 186208 - DNA, 25 bp, Mus musculus
aggaatggcctctattggctggcct

SEQ ID NO: 186209 - DNA, 25 bp, Mus musculus
aggaatggccttccccaggaatgcc

SEQ ID NO: 186210 - DNA, 25 bp, Mus musculus
aggaatggccttgcccaggaatgcc

SEQ ID NO: 186211 - DNA, 25 bp, Mus musculus
aggaatggcttgattggtctttatc

SEQ ID NO: 186212 - DNA, 25 bp, Mus musculus
aggaatggcttgtttggtctttatc

SEQ ID NO: 186213 - DNA, 25 bp, Mus musculus
aggaatgggaccagggaccctgcac

SEQ ID NO: 186214 - DNA, 25 bp, Mus musculus
aggaatgggacctgggaccctgcac

SEQ ID NO: 186215 - DNA, 25 bp, Mus musculus
aggaatggtactccctcactgaccg

SEQ ID NO: 186216 - DNA, 25 bp, Mus musculus
aggaatggtactgcctcactgaccg

SEQ ID NO: 186217 - DNA, 25 bp, Mus musculus
aggaatggtatgatctgtgcatcat

SEQ ID NO: 186218 - DNA, 25 bp, Mus musculus
aggaatggtatgttctgtgcatcat

SEQ ID NO: 186219 - DNA, 25 bp, Mus musculus
aggaatggtattagtggcttttcga

SEQ ID NO: 186220 - DNA, 25 bp, Mus musculus
aggaatggtatttgtggcttttcga

SEQ ID NO: 186221 - DNA, 25 bp, Mus musculus
aggaatggtccacctgtcgatccaa

SEQ ID NO: 186222 - DNA, 25 bp, Mus musculus
aggaatggtccagctgtcgatccaa

SEQ ID NO: 186223 - DNA, 25 bp, Mus musculus
aggaatggtcctcatctgcttgggc

SEQ ID NO: 186224 - DNA, 25 bp, Mus musculus
aggaatggtcctgatctgcttgggc

SEQ ID NO: 186225 - DNA, 25 bp, Mus musculus
aggaatggtcttctgccacttgcat

SEQ ID NO: 186226 - DNA, 25 bp, Mus musculus
aggaatggtcttgtgccacttgcat

SEQ ID NO: 186227 - DNA, 25 bp, Mus musculus
aggaatggtgacagcctcatcgcct

SEQ ID NO: 186228 - DNA, 25 bp, Mus musculus
aggaatggtgactgcctcatcgcct

SEQ ID NO: 186229 - DNA, 25 bp, Mus musculus
aggaatggtgcccaaggctagcctc

SEQ ID NO: 186230 - DNA, 25 bp, Mus musculus
aggaatggtgccgaaggctagcctc

SEQ ID NO: 186231 - DNA, 25 bp, Mus musculus
aggaatggtggtaagagctgacata

SEQ ID NO: 186232 - DNA, 25 bp, Mus musculus
aggaatggtggtcccaccttaccct

SEQ ID NO: 186233 - DNA, 25 bp, Mus musculus
aggaatggtggtgccaccttaccct

SEQ ID NO: 186234 - DNA, 25 bp, Mus musculus
aggaatggtggttagagctgacata

SEQ ID NO: 186235 - DNA, 25 bp, Mus musculus
aggaatgtaattaccctctgccttc

SEQ ID NO: 186236 - DNA, 25 bp, Mus musculus
aggaatgtaatttccctctgccttc

SEQ ID NO: 186237 - DNA, 25 bp, Mus musculus
aggaatgtagttccagcttttaaca

SEQ ID NO: 186238 - DNA, 25 bp, Mus musculus
aggaatgtagttgcagcttttaaca

SEQ ID NO: 186239 - DNA, 25 bp, Mus musculus
aggaatgtatcacagaccgtcaccc

SEQ ID NO: 186240 - DNA, 25 bp, Mus musculus
aggaatgtatcacctcttccacctg

SEQ ID NO: 186241 - DNA, 25 bp, Mus musculus
aggaatgtatcagagaccgtcaccc

SEQ ID NO: 186242 - DNA, 25 bp, Mus musculus
aggaatgtatcagctcttccacctg

SEQ ID NO: 186243 - DNA, 25 bp, Mus musculus
aggaatgtcatcctgaccagcggct

SEQ ID NO: 186244 - DNA, 25 bp, Mus musculus
aggaatgtcatcgtgaccagcggct

SEQ ID NO: 186245 - DNA, 25 bp, Mus musculus
aggaatgtcctgcacttaatagaaa

SEQ ID NO: 186246 - DNA, 25 bp, Mus musculus
aggaatgtcctggacttaatagaaa

SEQ ID NO: 186247 - DNA, 25 bp, Mus musculus
aggaatgtcgaaatgattgtgataa

SEQ ID NO: 186248 - DNA, 25 bp, Mus musculus
aggaatgtcgaattgattgtgataa

SEQ ID NO: 186249 - DNA, 25 bp, Mus musculus
aggaatgtctataagtccctcttct

SEQ ID NO: 186250 - DNA, 25 bp, Mus musculus
aggaatgtctattagtccctcttct

SEQ ID NO: 186251 - DNA, 25 bp, Mus musculus
aggaatgtctcaaaatgccgtattt

SEQ ID NO: 186252 - DNA, 25 bp, Mus musculus
aggaatgtctcataatgccgtattt

SEQ ID NO: 186253 - DNA, 25 bp, Mus musculus
aggaatgtgactcttcatcttctaa

SEQ ID NO: 186254 - DNA, 25 bp, Mus musculus
aggaatgtgactgttcatcttctaa

SEQ ID NO: 186255 - DNA, 25 bp, Mus musculus
aggaatgtgatcacgggacctgcct

SEQ ID NO: 186256 - DNA, 25 bp, Mus musculus
aggaatgtgatctcgggacctgcct

SEQ ID NO: 186257 - DNA, 25 bp, Mus musculus
aggaatgtgcatcccacccatctaa

SEQ ID NO: 186258 - DNA, 25 bp, Mus musculus
aggaatgtgcatgccacccatctaa

SEQ ID NO: 186259 - DNA, 25 bp, Mus musculus
aggaatgtgcccctgtcccttcctg

SEQ ID NO: 186260 - DNA, 25 bp, Mus musculus
aggaatgtgcccgtgtcccttcctg

SEQ ID NO: 186261 - DNA, 25 bp, Mus musculus
aggaatgtgcttcaacagactctct

SEQ ID NO: 186262 - DNA, 25 bp, Mus musculus
aggaatgtgcttgaacagactctct

SEQ ID NO: 186263 - DNA, 25 bp, Mus musculus
aggaatgtggcccagccttcctcac

SEQ ID NO: 186264 - DNA, 25 bp, Mus musculus
aggaatgtggccgagccttcctcac

SEQ ID NO: 186265 - DNA, 25 bp, Mus musculus
aggaatgttcacctgtcttttactt

SEQ ID NO: 186266 - DNA, 25 bp, Mus musculus
aggaatgttcacgtgtcttttactt

SEQ ID NO: 186267 - DNA, 25 bp, Mus musculus
aggaatgttcctacgagcagctgga

SEQ ID NO: 186268 - DNA, 25 bp, Mus musculus
aggaatgttccttcgagcagctgga

SEQ ID NO: 186269 - DNA, 25 bp, Mus musculus
aggaatgttctcagggtcgtcgtcc

SEQ ID NO: 186270 - DNA, 25 bp, Mus musculus
aggaatgttctctgggtcgtcgtcc

SEQ ID NO: 186271 - DNA, 25 bp, Mus musculus
aggaatgtttcgcagttctttcttt

SEQ ID NO: 186272 - DNA, 25 bp, Mus musculus
aggaatgtttcggagttctttcttt

SEQ ID NO: 186273 - DNA, 25 bp, Mus musculus
aggaattactccatgaggcccatgg

SEQ ID NO: 186274 - DNA, 25 bp, Mus musculus
aggaattactccttgaggcccatgg

SEQ ID NO: 186275 - DNA, 25 bp, Mus musculus
aggaattatccgaagctctgaccag

SEQ ID NO: 186276 - DNA, 25 bp, Mus musculus
aggaattatccgtagctctgaccag

SEQ ID NO: 186277 - DNA, 25 bp, Mus musculus
aggaattatctcatatccatttata

SEQ ID NO: 186278 - DNA, 25 bp, Mus musculus
aggaattatctcttatccatttata

SEQ ID NO: 186279 - DNA, 25 bp, Mus musculus
aggaattattgacccgataccagca

SEQ ID NO: 186280 - DNA, 25 bp, Mus musculus
aggaattattgagccgataccagca

SEQ ID NO: 186281 - DNA, 25 bp, Mus musculus
aggaattcaactactggtgctatat

SEQ ID NO: 186282 - DNA, 25 bp, Mus musculus
aggaattcaacttctggtgctatat

SEQ ID NO: 186283 - DNA, 25 bp, Mus musculus
aggaattcatcaatattcacagcta

SEQ ID NO: 186284 - DNA, 25 bp, Mus musculus
aggaattcatcattattcacagcta

SEQ ID NO: 186285 - DNA, 25 bp, Mus musculus
aggaattccaaaactcaaagtcaga

SEQ ID NO: 186286 - DNA, 25 bp, Mus musculus
aggaattccaaatctcaaagtcaga

SEQ ID NO: 186287 - DNA, 25 bp, Mus musculus
aggaattcccaacccacaagcaaag

SEQ ID NO: 186288 - DNA, 25 bp, Mus musculus
aggaattcccaagccacaagcaaag

SEQ ID NO: 186289 - DNA, 25 bp, Mus musculus
aggaattcctagcacatccattgtc

SEQ ID NO: 186290 - DNA, 25 bp, Mus musculus
aggaattcctaggacatccattgtc

SEQ ID NO: 186291 - DNA, 25 bp, Mus musculus
aggaattcgctcagcagtgacgctg

SEQ ID NO: 186292 - DNA, 25 bp, Mus musculus
aggaattcgctctgcagtgacgctg

SEQ ID NO: 186293 - DNA, 25 bp, Mus musculus
aggaattctaccatgtttccagaat

SEQ ID NO: 186294 - DNA, 25 bp, Mus musculus
aggaattctaccttgtttccagaat

SEQ ID NO: 186295 - DNA, 25 bp, Mus musculus
aggaattctctaatcacctgaggag

SEQ ID NO: 186296 - DNA, 25 bp, Mus musculus
aggaattctctattcacctgaggag

SEQ ID NO: 186297 - DNA, 25 bp, Mus musculus
aggaattctgaacgtgttgccctct

SEQ ID NO: 186298 - DNA, 25 bp, Mus musculus
aggaattctgaaggtgttgccctct

SEQ ID NO: 186299 - DNA, 25 bp, Mus musculus
aggaattcttacagcttttcccaag

SEQ ID NO: 186300 - DNA, 25 bp, Mus musculus
aggaattcttactgcttttcccaag

SEQ ID NO: 186301 - DNA, 25 bp, Mus musculus
aggaattcttccatcctcagcaaga

SEQ ID NO: 186302 - DNA, 25 bp, Mus musculus
aggaattcttccttcctcagcaaga

SEQ ID NO: 186303 - DNA, 25 bp, Mus musculus
aggaattgagtacccatccattatt

SEQ ID NO: 186304 - DNA, 25 bp, Mus musculus
aggaattgagtagccatccattatt

SEQ ID NO: 186305 - DNA, 25 bp, Mus musculus
aggaattgctagaccaaggctggcc

SEQ ID NO: 186306 - DNA, 25 bp, Mus musculus
aggaattgctagtccaaggctggcc

SEQ ID NO: 186307 - DNA, 25 bp, Mus musculus
aggaattggcagctacagtacacag

SEQ ID NO: 186308 - DNA, 25 bp, Mus musculus
aggaattggcaggtacagtacacag

SEQ ID NO: 186309 - DNA, 25 bp, Mus musculus
aggaattgtctgctctagttggaaa

SEQ ID NO: 186310 - DNA, 25 bp, Mus musculus
aggaattgtctggtctagttggaaa

SEQ ID NO: 186311 - DNA, 25 bp, Mus musculus
aggaattgttttagagacaggatct

SEQ ID NO: 186312 - DNA, 25 bp, Mus musculus
aggaattgtttttgagacaggatct

SEQ ID NO: 186313 - DNA, 25 bp, Mus musculus
aggaatttataaaatccaggcttct

SEQ ID NO: 186314 - DNA, 25 bp, Mus musculus
aggaatttataatatccaggcttct

SEQ ID NO: 186315 - DNA, 25 bp, Mus musculus
aggaatttccaacgcgaccctctca

SEQ ID NO: 186316 - DNA, 25 bp, Mus musculus
aggaatttccaaggcgaccctctca

SEQ ID NO: 186317 - DNA, 25 bp, Mus musculus
aggaatttcccaatggtggccttct

SEQ ID NO: 186318 - DNA, 25 bp, Mus musculus
aggaatttcccattggtggccttct

SEQ ID NO: 186319 - DNA, 25 bp, Mus musculus
aggaatttctttcatcctgtggaaa

SEQ ID NO: 186320 - DNA, 25 bp, Mus musculus
aggaatttctttgatcctgtggaaa

SEQ ID NO: 186321 - DNA, 25 bp, Mus musculus
aggaatttgacaagcactctcccac

SEQ ID NO: 186322 - DNA, 25 bp, Mus musculus
aggaatttgacatgcactctcccac

SEQ ID NO: 186323 - DNA, 25 bp, Mus musculus
aggaatttggtgctgatgtccgatt

SEQ ID NO: 186324 - DNA, 25 bp, Mus musculus
aggaatttggtggtgatgtccgatt

SEQ ID NO: 186325 - DNA, 25 bp, Mus musculus
aggaatttgtgtctactgtgactca

SEQ ID NO: 186326 - DNA, 25 bp, Mus musculus
aggaatttgtgtgtactgtgactca

SEQ ID NO: 186327 - DNA, 25 bp, Mus musculus
aggaatttgtttctgcaccatggat

SEQ ID NO: 186328 - DNA, 25 bp, Mus musculus
aggaatttgtttgtgcaccatggat

SEQ ID NO: 186329 - DNA, 25 bp, Mus musculus
aggaattttattacatggcttatta

SEQ ID NO: 186330 - DNA, 25 bp, Mus musculus
aggaattttatttcatggcttatta

SEQ ID NO: 186331 - DNA, 25 bp, Mus musculus
aggaattttctcagcatagctttgc

SEQ ID NO: 186332 - DNA, 25 bp, Mus musculus
aggaattttctctgcatagctttgc

SEQ ID NO: 186333 - DNA, 25 bp, Mus musculus
aggaattttcttcccactggatagt

SEQ ID NO: 186334 - DNA, 25 bp, Mus musculus
aggaattttcttgccactggatagt

SEQ ID NO: 186335 - DNA, 25 bp, Mus musculus
aggacaaaaaccacacctgtgcgtt

SEQ ID NO: 186336 - DNA, 25 bp, Mus musculus
aggacaaaaacctcacctgtgcgtt

SEQ ID NO: 186337 - DNA, 25 bp, Mus musculus
aggacaaaaggcatggctcacccac

SEQ ID NO: 186338 - DNA, 25 bp, Mus musculus
aggacaaaaggcttggctcacccac

SEQ ID NO: 186339 - DNA, 25 bp, Mus musculus
aggacaaacactcaaaaaacatctg

SEQ ID NO: 186340 - DNA, 25 bp, Mus musculus
aggacaaacactgaaaaaacatctg

SEQ ID NO: 186341 - DNA, 25 bp, Mus musculus
aggacaaacattcgattgatatttc

SEQ ID NO: 186342 - DNA, 25 bp, Mus musculus
aggacaaacattggattgatatttc

SEQ ID NO: 186343 - DNA, 25 bp, Mus musculus
aggacaaactgcactgtgaggacat

SEQ ID NO: 186344 - DNA, 25 bp, Mus musculus
aggacaaactgctctgtgaggacat

SEQ ID NO: 186345 - DNA, 25 bp, Mus musculus
aggacaaactgtacgcacgcctagc

SEQ ID NO: 186346 - DNA, 25 bp, Mus musculus
aggacaaactgttcgcacgcctagc

SEQ ID NO: 186347 - DNA, 25 bp, Mus musculus
aggacaaagcccacaaacgccatct

SEQ ID NO: 186348 - DNA, 25 bp, Mus musculus
aggacaaagcccagttatgccacca

SEQ ID NO: 186349 - DNA, 25 bp, Mus musculus
aggacaaagccctcaaacgccatct

SEQ ID NO: 186350 - DNA, 25 bp, Mus musculus
aggacaaagccctgttatgccacca

SEQ ID NO: 186351 - DNA, 25 bp, Mus musculus
aggacaaaggacctcttcctcaaga

SEQ ID NO: 186352 - DNA, 25 bp, Mus musculus
aggacaaaggacgtcttcctcaaga

SEQ ID NO: 186353 - DNA, 25 bp, Mus musculus
aggacaaaggcaactaccgcctgct

SEQ ID NO: 186354 - DNA, 25 bp, Mus musculus
aggacaaaggcatctaccgcctgct

SEQ ID NO: 186355 - DNA, 25 bp, Mus musculus
aggacaaaggccatctcttcgacac

SEQ ID NO: 186356 - DNA, 25 bp, Mus musculus
aggacaaaggccttctcttcgacac

SEQ ID NO: 186357 - DNA, 25 bp, Mus musculus
aggacaaagtcccatggcatgccac

SEQ ID NO: 186358 - DNA, 25 bp, Mus musculus
aggacaaagtccgatggcatgccac

SEQ ID NO: 186359 - DNA, 25 bp, Mus musculus
aggacaaatctactcaggtgaatgg

SEQ ID NO: 186360 - DNA, 25 bp, Mus musculus
aggacaaatctagtcaggtgaatgg

SEQ ID NO: 186361 - DNA, 25 bp, Mus musculus
aggacaaatgccaggaccgaggtca

SEQ ID NO: 186362 - DNA, 25 bp, Mus musculus
aggacaaatgccctctgttccttga

SEQ ID NO: 186363 - DNA, 25 bp, Mus musculus
aggacaaatgccgtctgttccttga

SEQ ID NO: 186364 - DNA, 25 bp, Mus musculus
aggacaaatgcctggaccgaggtca

SEQ ID NO: 186365 - DNA, 25 bp, Mus musculus
aggacaaatgctccacctgtgactt

SEQ ID NO: 186366 - DNA, 25 bp, Mus musculus
aggacaaatgctgcacctgtgactt

SEQ ID NO: 186367 - DNA, 25 bp, Mus musculus
aggacaacaaatcaccaggacactg

SEQ ID NO: 186368 - DNA, 25 bp, Mus musculus
aggacaacaaatgaccaggacactg

SEQ ID NO: 186369 - DNA, 25 bp, Mus musculus
aggacaacacctcctcgtgacgtca

SEQ ID NO: 186370 - DNA, 25 bp, Mus musculus
aggacaacacctgctcgtgacgtca

SEQ ID NO: 186371 - DNA, 25 bp, Mus musculus
aggacaacattcatttctgtgggac

SEQ ID NO: 186372 - DNA, 25 bp, Mus musculus
aggacaacattcttttctgtgggac

SEQ ID NO: 186373 - DNA, 25 bp, Mus musculus
aggacaaccagcaggtagccgcgct

SEQ ID NO: 186374 - DNA, 25 bp, Mus musculus
aggacaaccagctggtagccgcgct

SEQ ID NO: 186375 - DNA, 25 bp, Mus musculus
aggacaaccattactgagccaggct

SEQ ID NO: 186376 - DNA, 25 bp, Mus musculus
aggacaaccatttctgagccaggct

SEQ ID NO: 186377 - DNA, 25 bp, Mus musculus
aggacaacccacaatgagctggccc

SEQ ID NO: 186378 - DNA, 25 bp, Mus musculus
aggacaacccactatgagctggccc

SEQ ID NO: 186379 - DNA, 25 bp, Mus musculus
aggacaacccgacagcaagagaact

SEQ ID NO: 186380 - DNA, 25 bp, Mus musculus
aggacaacccgagagcaagagaact

SEQ ID NO: 186381 - DNA, 25 bp, Mus musculus
aggacaaccgtgcagatcacccttg

SEQ ID NO: 186382 - DNA, 25 bp, Mus musculus
aggacaaccgtggagatcacccttg

SEQ ID NO: 186383 - DNA, 25 bp, Mus musculus
aggacaacctctcgtgctggtcctt

SEQ ID NO: 186384 - DNA, 25 bp, Mus musculus
aggacaacctctggtgctggtcctt

SEQ ID NO: 186385 - DNA, 25 bp, Mus musculus
aggacaacctgtacacaaggcccct

SEQ ID NO: 186386 - DNA, 25 bp, Mus musculus
aggacaacctgttcacaaggcccct

SEQ ID NO: 186387 - DNA, 25 bp, Mus musculus
aggacaaccttcagaatgcttggag

SEQ ID NO: 186388 - DNA, 25 bp, Mus musculus
aggacaaccttctgaatgcttggag

SEQ ID NO: 186389 - DNA, 25 bp, Mus musculus
aggacaaccttgactgtcgttcaca

SEQ ID NO: 186390 - DNA, 25 bp, Mus musculus
aggacaaccttgtctgtcgttcaca

SEQ ID NO: 186391 - DNA, 25 bp, Mus musculus
aggacaacgactacggccgtgcagt

SEQ ID NO: 186392 - DNA, 25 bp, Mus musculus
aggacaacgacttcggccgtgcagt

SEQ ID NO: 186393 - DNA, 25 bp, Mus musculus
aggacaacggagctgtgcctttctg

SEQ ID NO: 186394 - DNA, 25 bp, Mus musculus
aggacaacggaggtgtgcctttctg

SEQ ID NO: 186395 - DNA, 25 bp, Mus musculus
aggacaacgtcgatcttgtagagtt

SEQ ID NO: 186396 - DNA, 25 bp, Mus musculus
aggacaacgtcgttcttgtagagtt

SEQ ID NO: 186397 - DNA, 25 bp, Mus musculus
aggacaactgccagctgctagggtc

SEQ ID NO: 186398 - DNA, 25 bp, Mus musculus
aggacaactgcctgctgctagggtc

SEQ ID NO: 186399 - DNA, 25 bp, Mus musculus
aggacaacttgtcggcatgctattc

SEQ ID NO: 186400 - DNA, 25 bp, Mus musculus
aggacaacttgtgggcatgctattc

SEQ ID NO: 186401 - DNA, 25 bp, Mus musculus
aggacaagaagcagccgcccttgct

SEQ ID NO: 186402 - DNA, 25 bp, Mus musculus
aggacaagaagccactcctcctggg

SEQ ID NO: 186403 - DNA, 25 bp, Mus musculus
aggacaagaagcgactcctcctggg

SEQ ID NO: 186404 - DNA, 25 bp, Mus musculus
aggacaagaagctgccgcccttgct

SEQ ID NO: 186405 - DNA, 25 bp, Mus musculus
aggacaagacatcgcctccctgtag

SEQ ID NO: 186406 - DNA, 25 bp, Mus musculus
aggacaagacatggcctccctgtag

SEQ ID NO: 186407 - DNA, 25 bp, Mus musculus
aggacaagacgtccttctacggcga

SEQ ID NO: 186408 - DNA, 25 bp, Mus musculus
aggacaagacgtgcttctacggcga

SEQ ID NO: 186409 - DNA, 25 bp, Mus musculus
aggacaagactgatggaccagtatt

SEQ ID NO: 186410 - DNA, 25 bp, Mus musculus
aggacaagactgttggaccagtatt

SEQ ID NO: 186411 - DNA, 25 bp, Mus musculus
aggacaagacttcctctgccttgag

SEQ ID NO: 186412 - DNA, 25 bp, Mus musculus
aggacaagacttgctctgccttgag

SEQ ID NO: 186413 - DNA, 25 bp, Mus musculus
aggacaagatgtacagtgctgggca

SEQ ID NO: 186414 - DNA, 25 bp, Mus musculus
aggacaagatgttcagtgctgggca

SEQ ID NO: 186415 - DNA, 25 bp, Mus musculus
aggacaagccaacgacactctaagt

SEQ ID NO: 186416 - DNA, 25 bp, Mus musculus
aggacaagccaaggacactctaagt

SEQ ID NO: 186417 - DNA, 25 bp, Mus musculus
aggacaagccacatctgttcagtag

SEQ ID NO: 186418 - DNA, 25 bp, Mus musculus
aggacaagccacttctgttcagtag

SEQ ID NO: 186419 - DNA, 25 bp, Mus musculus
aggacaagccttcacgtaggagaca

SEQ ID NO: 186420 - DNA, 25 bp, Mus musculus
aggacaagccttgacgtaggagaca

SEQ ID NO: 186421 - DNA, 25 bp, Mus musculus
aggacaagcgcgcactcaagttcat

SEQ ID NO: 186422 - DNA, 25 bp, Mus musculus
aggacaagcgcggactcaagttcat

SEQ ID NO: 186423 - DNA, 25 bp, Mus musculus
aggacaaggatgacacccctttcgt

SEQ ID NO: 186424 - DNA, 25 bp, Mus musculus
aggacaaggatgtcacccctttcgt

SEQ ID NO: 186425 - DNA, 25 bp, Mus musculus
aggacaaggctacactccaggccat

SEQ ID NO: 186426 - DNA, 25 bp, Mus musculus
aggacaaggctagactccaggccat

SEQ ID NO: 186427 - DNA, 25 bp, Mus musculus
aggacaagggttccctgttcacatt

SEQ ID NO: 186428 - DNA, 25 bp, Mus musculus
aggacaagggttgcctgttcacatt

SEQ ID NO: 186429 - DNA, 25 bp, Mus musculus
aggacaaggttgaggcaggccacat

SEQ ID NO: 186430 - DNA, 25 bp, Mus musculus
aggacaaggttgtggcaggccacat

SEQ ID NO: 186431 - DNA, 25 bp, Mus musculus
aggacaagtacaacggagccccact

SEQ ID NO: 186432 - DNA, 25 bp, Mus musculus
aggacaagtacatcggagccccact

SEQ ID NO: 186433 - DNA, 25 bp, Mus musculus
aggacaagtatacccatcttattgg

SEQ ID NO: 186434 - DNA, 25 bp, Mus musculus
aggacaagtatagccatcttattgg

SEQ ID NO: 186435 - DNA, 25 bp, Mus musculus
aggacaagtgagaccctccatgagc

SEQ ID NO: 186436 - DNA, 25 bp, Mus musculus
aggacaagtgagtccctccatgagc

SEQ ID NO: 186437 - DNA, 25 bp, Mus musculus
aggacaagttcaacgaagcgctcga

SEQ ID NO: 186438 - DNA, 25 bp, Mus musculus
aggacaagttcatcgaagcgctcga

SEQ ID NO: 186439 - DNA, 25 bp, Mus musculus
aggacaataaaacacataccactgt

SEQ ID NO: 186440 - DNA, 25 bp, Mus musculus
aggacaataaaagacataccactgt

SEQ ID NO: 186441 - DNA, 25 bp, Mus musculus
aggacaatagtgagctaccaccctt

SEQ ID NO: 186442 - DNA, 25 bp, Mus musculus
aggacaatagtgtgctaccaccctt

SEQ ID NO: 186443 - DNA, 25 bp, Mus musculus
aggacaatcacaacccaagtgctaa

SEQ ID NO: 186444 - DNA, 25 bp, Mus musculus
aggacaatcacatcccaagtgctaa

SEQ ID NO: 186445 - DNA, 25 bp, Mus musculus
aggacaatcagaccctgtcacattc

SEQ ID NO: 186446 - DNA, 25 bp, Mus musculus
aggacaatcagagcctgtcacattc

SEQ ID NO: 186447 - DNA, 25 bp, Mus musculus
aggacaatccccaacacagggctat

SEQ ID NO: 186448 - DNA, 25 bp, Mus musculus
aggacaatcccctacacagggctat

SEQ ID NO: 186449 - DNA, 25 bp, Mus musculus
aggacaatccgtcgcacagctgcat

SEQ ID NO: 186450 - DNA, 25 bp, Mus musculus
aggacaatccgtggcacagctgcat

SEQ ID NO: 186451 - DNA, 25 bp, Mus musculus
aggacaatcggaacctgtttgaagt

SEQ ID NO: 186452 - DNA, 25 bp, Mus musculus
aggacaatcggatcctgtttgaagt

SEQ ID NO: 186453 - DNA, 25 bp, Mus musculus
aggacaatctctacaggagtcttca

SEQ ID NO: 186454 - DNA, 25 bp, Mus musculus
aggacaatctcttcaggagtcttca

SEQ ID NO: 186455 - DNA, 25 bp, Mus musculus
aggacaatgaatccttcctgttttt

SEQ ID NO: 186456 - DNA, 25 bp, Mus musculus
aggacaatgaatgcttcctgttttt

SEQ ID NO: 186457 - DNA, 25 bp, Mus musculus
aggacaatgactatgggcgagcagt

SEQ ID NO: 186458 - DNA, 25 bp, Mus musculus
aggacaatgactttgggcgagcagt

SEQ ID NO: 186459 - DNA, 25 bp, Mus musculus
aggacaatgcaccaccaagaggctc

SEQ ID NO: 186460 - DNA, 25 bp, Mus musculus
aggacaatgcacgaccaagaggctc

SEQ ID NO: 186461 - DNA, 25 bp, Mus musculus
aggacaatgccaaggacactccttc

SEQ ID NO: 186462 - DNA, 25 bp, Mus musculus
aggacaatgccatggacactccttc

SEQ ID NO: 186463 - DNA, 25 bp, Mus musculus
aggacaatgcccagtatcagcagct

SEQ ID NO: 186464 - DNA, 25 bp, Mus musculus
aggacaatgccctgtatcagcagct

SEQ ID NO: 186465 - DNA, 25 bp, Mus musculus
aggacaatgctcaggaagacctcat

SEQ ID NO: 186466 - DNA, 25 bp, Mus musculus
aggacaatgctctggaagacctcat

SEQ ID NO: 186467 - DNA, 25 bp, Mus musculus
aggacaatggtgcatgccagcaaga

SEQ ID NO: 186468 - DNA, 25 bp, Mus musculus
aggacaatggtggatgccagcaaga

SEQ ID NO: 186469 - DNA, 25 bp, Mus musculus
aggacaattagacagcccagcaaag

SEQ ID NO: 186470 - DNA, 25 bp, Mus musculus
aggacaattagagagcccagcaaag

SEQ ID NO: 186471 - DNA, 25 bp, Mus musculus
aggacaattcctatcagacctgcct

SEQ ID NO: 186472 - DNA, 25 bp, Mus musculus
aggacaattcctttcagacctgcct

SEQ ID NO: 186473 - DNA, 25 bp, Mus musculus
aggacaatttcaccactaccatttt

SEQ ID NO: 186474 - DNA, 25 bp, Mus musculus
aggacaatttcagcactaccatttt

SEQ ID NO: 186475 - DNA, 25 bp, Mus musculus
aggacaatttcgacggcgacgactt

SEQ ID NO: 186476 - DNA, 25 bp, Mus musculus
aggacaatttcgtcggcgacgactt

SEQ ID NO: 186477 - DNA, 25 bp, Mus musculus
aggacacaaactagattgcccaaag

SEQ ID NO: 186478 - DNA, 25 bp, Mus musculus
aggacacaaacttgattgcccaaag

SEQ ID NO: 186479 - DNA, 25 bp, Mus musculus
aggacacaaagcatagcccagccag

SEQ ID NO: 186480 - DNA, 25 bp, Mus musculus
aggacacaaagcttagcccagccag

SEQ ID NO: 186481 - DNA, 25 bp, Mus musculus
aggacacaacagacaaggctttaaa

SEQ ID NO: 186482 - DNA, 25 bp, Mus musculus
aggacacaacagtcaaggctttaaa

SEQ ID NO: 186483 - DNA, 25 bp, Mus musculus
aggacacaagctatgacttcttcaa

SEQ ID NO: 186484 - DNA, 25 bp, Mus musculus
aggacacaagctttgacttcttcaa

SEQ ID NO: 186485 - DNA, 25 bp, Mus musculus
aggacacaaggtctgtgtggcctcc

SEQ ID NO: 186486 - DNA, 25 bp, Mus musculus
aggacacaaggtgtgtgtggcctcc

SEQ ID NO: 186487 - DNA, 25 bp, Mus musculus
aggacacaatcaaggtctccgagcc

SEQ ID NO: 186488 - DNA, 25 bp, Mus musculus
aggacacaatcatggtctccgagcc

SEQ ID NO: 186489 - DNA, 25 bp, Mus musculus
aggacacaatgcacctgaggcaaca

SEQ ID NO: 186490 - DNA, 25 bp, Mus musculus
aggacacaatgctcctgaggcaaca

SEQ ID NO: 186491 - DNA, 25 bp, Mus musculus
aggacacacctgattatacttctgc

SEQ ID NO: 186492 - DNA, 25 bp, Mus musculus
aggacacacctgtttatacttctgc

SEQ ID NO: 186493 - DNA, 25 bp, Mus musculus
aggacacacgttattaaagcatggc

SEQ ID NO: 186494 - DNA, 25 bp, Mus musculus
aggacacacgtttttaaagcatggc

SEQ ID NO: 186495 - DNA, 25 bp, Mus musculus
aggacacactagctatccattgaaa

SEQ ID NO: 186496 - DNA, 25 bp, Mus musculus
aggacacactaggtatccattgaaa

SEQ ID NO: 186497 - DNA, 25 bp, Mus musculus
aggacacactgcacactaacttgat

SEQ ID NO: 186498 - DNA, 25 bp, Mus musculus
aggacacactgctcactaacttgat

SEQ ID NO: 186499 - DNA, 25 bp, Mus musculus
aggacacactgtcttgccagagggc

SEQ ID NO: 186500 - DNA, 25 bp, Mus musculus
aggacacactgtgttgccagagggc

SEQ ID NO: 186501 - DNA, 25 bp, Mus musculus
aggacacagaagatgttggcgcttt

SEQ ID NO: 186502 - DNA, 25 bp, Mus musculus
aggacacagaagttgttggcgcttt

SEQ ID NO: 186503 - DNA, 25 bp, Mus musculus
aggacacagactcgtttcttccaaa

SEQ ID NO: 186504 - DNA, 25 bp, Mus musculus
aggacacagactggtttcttccaaa

SEQ ID NO: 186505 - DNA, 25 bp, Mus musculus
aggacacagatcatgtttgcacaat

SEQ ID NO: 186506 - DNA, 25 bp, Mus musculus
aggacacagatcttgtttgcacaat

SEQ ID NO: 186507 - DNA, 25 bp, Mus musculus
aggacacagattccttcgcctgcga

SEQ ID NO: 186508 - DNA, 25 bp, Mus musculus
aggacacagattgcttcgcctgcga

SEQ ID NO: 186509 - DNA, 25 bp, Mus musculus
aggacacagcctaacatacccacgt

SEQ ID NO: 186510 - DNA, 25 bp, Mus musculus
aggacacagccttacatacccacgt

SEQ ID NO: 186511 - DNA, 25 bp, Mus musculus
aggacacaggacacgagctgctaca

SEQ ID NO: 186512 - DNA, 25 bp, Mus musculus
aggacacaggactcgagctgctaca

SEQ ID NO: 186513 - DNA, 25 bp, Mus musculus
aggacacaggtcatgtgcaactctg

SEQ ID NO: 186514 - DNA, 25 bp, Mus musculus
aggacacaggtcttgtgcaactctg

SEQ ID NO: 186515 - DNA, 25 bp, Mus musculus
aggacacagtacagggtgctgttct

SEQ ID NO: 186516 - DNA, 25 bp, Mus musculus
aggacacagtactgggtgctgttct

SEQ ID NO: 186517 - DNA, 25 bp, Mus musculus
aggacacagtagaaactcgccttcc

SEQ ID NO: 186518 - DNA, 25 bp, Mus musculus
aggacacagtagtaactcgccttcc

SEQ ID NO: 186519 - DNA, 25 bp, Mus musculus
aggacacagtccacagggcatctgt

SEQ ID NO: 186520 - DNA, 25 bp, Mus musculus
aggacacagtccaggtgcgtagcag

SEQ ID NO: 186521 - DNA, 25 bp, Mus musculus
aggacacagtccctatcttctaggt

SEQ ID NO: 186522 - DNA, 25 bp, Mus musculus
aggacacagtccgtatcttctaggt

SEQ ID NO: 186523 - DNA, 25 bp, Mus musculus
aggacacagtcctcagggcatctgt

SEQ ID NO: 186524 - DNA, 25 bp, Mus musculus
aggacacagtcctggtgcgtagcag

SEQ ID NO: 186525 - DNA, 25 bp, Mus musculus
aggacacagtgaaaatgcccagcaa

SEQ ID NO: 186526 - DNA, 25 bp, Mus musculus
aggacacagtgataatgcccagcaa

SEQ ID NO: 186527 - DNA, 25 bp, Mus musculus
aggacacagtggaaatgcctctccc

SEQ ID NO: 186528 - DNA, 25 bp, Mus musculus
aggacacagtggtaatgcctctccc

SEQ ID NO: 186529 - DNA, 25 bp, Mus musculus
aggacacagtttactctacagcatg

SEQ ID NO: 186530 - DNA, 25 bp, Mus musculus
aggacacagttttctctacagcatg

SEQ ID NO: 186531 - DNA, 25 bp, Mus musculus
aggacacatagcattccccagtgcc

SEQ ID NO: 186532 - DNA, 25 bp, Mus musculus
aggacacatagctttccccagtgcc

SEQ ID NO: 186533 - DNA, 25 bp, Mus musculus
aggacacatcacactttttcataac

SEQ ID NO: 186534 - DNA, 25 bp, Mus musculus
aggacacatcactctttttcataac

SEQ ID NO: 186535 - DNA, 25 bp, Mus musculus
aggacacatcagatgggcctgccac

SEQ ID NO: 186536 - DNA, 25 bp, Mus musculus
aggacacatcagttgggcctgccac

SEQ ID NO: 186537 - DNA, 25 bp, Mus musculus
aggacacatcataggctgctctgaa

SEQ ID NO: 186538 - DNA, 25 bp, Mus musculus
aggacacatcattggctgctctgaa

SEQ ID NO: 186539 - DNA, 25 bp, Mus musculus
aggacacatggaaactgataactgc

SEQ ID NO: 186540 - DNA, 25 bp, Mus musculus
aggacacatggatactgataactgc

SEQ ID NO: 186541 - DNA, 25 bp, Mus musculus
aggacacatgttctccaccccaggg

SEQ ID NO: 186542 - DNA, 25 bp, Mus musculus
aggacacatgttgtccaccccaggg

SEQ ID NO: 186543 - DNA, 25 bp, Mus musculus
aggacacattggcaacctctgccac

SEQ ID NO: 186544 - DNA, 25 bp, Mus musculus
aggacacattgggaacctctgccac

SEQ ID NO: 186545 - DNA, 25 bp, Mus musculus
aggacacatttcaaatgcccaaggg

SEQ ID NO: 186546 - DNA, 25 bp, Mus musculus
aggacacatttctaatgcccaaggg

SEQ ID NO: 186547 - DNA, 25 bp, Mus musculus
aggacaccaaagaggagccctgcca

SEQ ID NO: 186548 - DNA, 25 bp, Mus musculus
aggacaccaaagtggagccctgcca

SEQ ID NO: 186549 - DNA, 25 bp, Mus musculus
aggacaccacctaacttatattatt

SEQ ID NO: 186550 - DNA, 25 bp, Mus musculus
aggacaccaccttacttatattatt

SEQ ID NO: 186551 - DNA, 25 bp, Mus musculus
aggacaccactcagaaatgccaggg

SEQ ID NO: 186552 - DNA, 25 bp, Mus musculus
aggacaccactctgaaatgccaggg

SEQ ID NO: 186553 - DNA, 25 bp, Mus musculus
aggacaccagacctgatttctgtct

SEQ ID NO: 186554 - DNA, 25 bp, Mus musculus
aggacaccagacgtgatttctgtct

SEQ ID NO: 186555 - DNA, 25 bp, Mus musculus
aggacaccagagacagcacacagca

SEQ ID NO: 186556 - DNA, 25 bp, Mus musculus
aggacaccagagtcagcacacagca

SEQ ID NO: 186557 - DNA, 25 bp, Mus musculus
aggacaccattacactcatcgagaa

SEQ ID NO: 186558 - DNA, 25 bp, Mus musculus
aggacaccattagactcatcgagaa

SEQ ID NO: 186559 - DNA, 25 bp, Mus musculus
aggacacccagtccccattctgtat

SEQ ID NO: 186560 - DNA, 25 bp, Mus musculus
aggacacccagtgcccattctgtat

SEQ ID NO: 186561 - DNA, 25 bp, Mus musculus
aggacaccccacaaggactgaggca

SEQ ID NO: 186562 - DNA, 25 bp, Mus musculus
aggacaccccacacattgcttgaca

SEQ ID NO: 186563 - DNA, 25 bp, Mus musculus
aggacaccccactaggactgaggca

SEQ ID NO: 186564 - DNA, 25 bp, Mus musculus
aggacaccccactcattgcttgaca

SEQ ID NO: 186565 - DNA, 25 bp, Mus musculus
aggacacccccaactatactgagtt

SEQ ID NO: 186566 - DNA, 25 bp, Mus musculus
aggacacccccatctatactgagtt

SEQ ID NO: 186567 - DNA, 25 bp, Mus musculus
aggacacccgaaagcagcggcagcg

SEQ ID NO: 186568 - DNA, 25 bp, Mus musculus
aggacacccgaatgcagcggcagcg

SEQ ID NO: 186569 - DNA, 25 bp, Mus musculus
aggacacccgagacaccatgaagag

SEQ ID NO: 186570 - DNA, 25 bp, Mus musculus
aggacacccgagtcaccatgaagag

SEQ ID NO: 186571 - DNA, 25 bp, Mus musculus
aggacaccctccactagagagtggt

SEQ ID NO: 186572 - DNA, 25 bp, Mus musculus
aggacaccctcctctagagagtggt

SEQ ID NO: 186573 - DNA, 25 bp, Mus musculus
aggacaccctgcctatgcagaagtt

SEQ ID NO: 186574 - DNA, 25 bp, Mus musculus
aggacaccctgcgtatgcagaagtt

SEQ ID NO: 186575 - DNA, 25 bp, Mus musculus
aggacaccgacgaggagccgctgtc

SEQ ID NO: 186576 - DNA, 25 bp, Mus musculus
aggacaccgacgtggagccgctgtc

SEQ ID NO: 186577 - DNA, 25 bp, Mus musculus
aggacaccggtactgctgtaggcac

SEQ ID NO: 186578 - DNA, 25 bp, Mus musculus
aggacaccggtagtgctgtaggcac

SEQ ID NO: 186579 - DNA, 25 bp, Mus musculus
aggacaccgtggctgctctcctgaa

SEQ ID NO: 186580 - DNA, 25 bp, Mus musculus
aggacaccgtgggtgctctcctgaa

SEQ ID NO: 186581 - DNA, 25 bp, Mus musculus
aggacacctagcaccataagttaca

SEQ ID NO: 186582 - DNA, 25 bp, Mus musculus
aggacacctagctccataagttaca

SEQ ID NO: 186583 - DNA, 25 bp, Mus musculus
aggacacctccgctgctgctggtgt

SEQ ID NO: 186584 - DNA, 25 bp, Mus musculus
aggacacctccggtgctgctggtgt

SEQ ID NO: 186585 - DNA, 25 bp, Mus musculus
aggacacctctcaagggacgctact

SEQ ID NO: 186586 - DNA, 25 bp, Mus musculus
aggacacctctctagggacgctact

SEQ ID NO: 186587 - DNA, 25 bp, Mus musculus
aggacacctgacactttcacacata

SEQ ID NO: 186588 - DNA, 25 bp, Mus musculus
aggacacctgactctttcacacata

SEQ ID NO: 186589 - DNA, 25 bp, Mus musculus
aggacacctgagctacaccgggtaa

SEQ ID NO: 186590 - DNA, 25 bp, Mus musculus
aggacacctgaggtacaccgggtaa

SEQ ID NO: 186591 - DNA, 25 bp, Mus musculus
aggacacctgccctgaatacaagac

SEQ ID NO: 186592 - DNA, 25 bp, Mus musculus
aggacacctgccgtgaatacaagac

SEQ ID NO: 186593 - DNA, 25 bp, Mus musculus
aggacacctgctcaaaaccaaggct

SEQ ID NO: 186594 - DNA, 25 bp, Mus musculus
aggacacctgctgaaaaccaaggct

SEQ ID NO: 186595 - DNA, 25 bp, Mus musculus
aggacacctggaagctgaattggat

SEQ ID NO: 186596 - DNA, 25 bp, Mus musculus
aggacacctggatgctgaattggat

SEQ ID NO: 186597 - DNA, 25 bp, Mus musculus
aggacacctggtacgcagctgggat

SEQ ID NO: 186598 - DNA, 25 bp, Mus musculus
aggacacctggttcgcagctgggat

SEQ ID NO: 186599 - DNA, 25 bp, Mus musculus
aggacaccttgccagagtcagttct

SEQ ID NO: 186600 - DNA, 25 bp, Mus musculus
aggacaccttgcgagagtcagttct

SEQ ID NO: 186601 - DNA, 25 bp, Mus musculus
aggacacctttgagcacatctggaa

SEQ ID NO: 186602 - DNA, 25 bp, Mus musculus
aggacacctttgtgcacatctggaa

SEQ ID NO: 186603 - DNA, 25 bp, Mus musculus
aggacacgagtgagcggtcatttcc

SEQ ID NO: 186604 - DNA, 25 bp, Mus musculus
aggacacgagtgtgcggtcatttcc

SEQ ID NO: 186605 - DNA, 25 bp, Mus musculus
aggacacgatccacagttactcgct

SEQ ID NO: 186606 - DNA, 25 bp, Mus musculus
aggacacgatcctcagttactcgct

SEQ ID NO: 186607 - DNA, 25 bp, Mus musculus
aggacacggcacctattgcatatgt

SEQ ID NO: 186608 - DNA, 25 bp, Mus musculus
aggacacggcacgtattgcatatgt

SEQ ID NO: 186609 - DNA, 25 bp, Mus musculus
aggacacgggtcaggaggagacact

SEQ ID NO: 186610 - DNA, 25 bp, Mus musculus
aggacacgggtctggaggagacact

SEQ ID NO: 186611 - DNA, 25 bp, Mus musculus
aggacacgtcctactatctcagact

SEQ ID NO: 186612 - DNA, 25 bp, Mus musculus
aggacacgtccttctatctcagact

SEQ ID NO: 186613 - DNA, 25 bp, Mus musculus
aggacacgtgacagagctagcccag

SEQ ID NO: 186614 - DNA, 25 bp, Mus musculus
aggacacgtgactgagctagcccag

SEQ ID NO: 186615 - DNA, 25 bp, Mus musculus
aggacacgtgatccatttccagtgg

SEQ ID NO: 186616 - DNA, 25 bp, Mus musculus
aggacacgtgatgcatttccagtgg

SEQ ID NO: 186617 - DNA, 25 bp, Mus musculus
aggacactaaggatcccaacgcctg

SEQ ID NO: 186618 - DNA, 25 bp, Mus musculus
aggacactaaggttcccaacgcctg

SEQ ID NO: 186619 - DNA, 25 bp, Mus musculus
aggacactaccacggagtactcaga

SEQ ID NO: 186620 - DNA, 25 bp, Mus musculus
aggacactaccagggagtactcaga

SEQ ID NO: 186621 - DNA, 25 bp, Mus musculus
aggacactacttagttttcctgtgt

SEQ ID NO: 186622 - DNA, 25 bp, Mus musculus
aggacactactttgttttcctgtgt

SEQ ID NO: 186623 - DNA, 25 bp, Mus musculus
aggacactagtaccctgtgttttca

SEQ ID NO: 186624 - DNA, 25 bp, Mus musculus
aggacactagtagcctgtgttttca

SEQ ID NO: 186625 - DNA, 25 bp, Mus musculus
aggacactcagcatggatcagttcc

SEQ ID NO: 186626 - DNA, 25 bp, Mus musculus
aggacactcagcttggatcagttcc

SEQ ID NO: 186627 - DNA, 25 bp, Mus musculus
aggacactcaggagtctcatgccct

SEQ ID NO: 186628 - DNA, 25 bp, Mus musculus
aggacactcaggtgtctcatgccct

SEQ ID NO: 186629 - DNA, 25 bp, Mus musculus
aggacactccccagtcaggtggttt

SEQ ID NO: 186630 - DNA, 25 bp, Mus musculus
aggacactcccctgtcaggtggttt

SEQ ID NO: 186631 - DNA, 25 bp, Mus musculus
aggacactccgccattggccggact

SEQ ID NO: 186632 - DNA, 25 bp, Mus musculus
aggacactccgcgattggccggact

SEQ ID NO: 186633 - DNA, 25 bp, Mus musculus
aggacactccttctctcgagagaca

SEQ ID NO: 186634 - DNA, 25 bp, Mus musculus
aggacactccttgtctcgagagaca

SEQ ID NO: 186635 - DNA, 25 bp, Mus musculus
aggacactctaactctttggccttc

SEQ ID NO: 186636 - DNA, 25 bp, Mus musculus
aggacactctaagtctttggccttc

SEQ ID NO: 186637 - DNA, 25 bp, Mus musculus
aggacactctcccatctgctaggct

SEQ ID NO: 186638 - DNA, 25 bp, Mus musculus
aggacactctccctattttcttagt

SEQ ID NO: 186639 - DNA, 25 bp, Mus musculus
aggacactctccgatctgctaggct

SEQ ID NO: 186640 - DNA, 25 bp, Mus musculus
aggacactctccgtattttcttagt

SEQ ID NO: 186641 - DNA, 25 bp, Mus musculus
aggacactgaaccttcatgcaatca

SEQ ID NO: 186642 - DNA, 25 bp, Mus musculus
aggacactgaacgttcatgcaatca

SEQ ID NO: 186643 - DNA, 25 bp, Mus musculus
aggacactgagcactttctgccttg

SEQ ID NO: 186644 - DNA, 25 bp, Mus musculus
aggacactgagctctttctgccttg

SEQ ID NO: 186645 - DNA, 25 bp, Mus musculus
aggacactgattcaacccttcactt

SEQ ID NO: 186646 - DNA, 25 bp, Mus musculus
aggacactgattgaacccttcactt

SEQ ID NO: 186647 - DNA, 25 bp, Mus musculus
aggacactgccaagtaccgggagta

SEQ ID NO: 186648 - DNA, 25 bp, Mus musculus
aggacactgccatgtaccgggagta

SEQ ID NO: 186649 - DNA, 25 bp, Mus musculus
aggacactgcgaacacttgttcaga

SEQ ID NO: 186650 - DNA, 25 bp, Mus musculus
aggacactgcgatcacttgttcaga

SEQ ID NO: 186651 - DNA, 25 bp, Mus musculus
aggacactgctgaagaaacaccttt

SEQ ID NO: 186652 - DNA, 25 bp, Mus musculus
aggacactgctgaagatgcctttgt

SEQ ID NO: 186653 - DNA, 25 bp, Mus musculus
aggacactgctgtagaaacaccttt

SEQ ID NO: 186654 - DNA, 25 bp, Mus musculus
aggacactgctgtagatgcctttgt

SEQ ID NO: 186655 - DNA, 25 bp, Mus musculus
aggacactggaacgcaccatctttg

SEQ ID NO: 186656 - DNA, 25 bp, Mus musculus
aggacactggaaggcaccatctttg

SEQ ID NO: 186657 - DNA, 25 bp, Mus musculus
aggacactggacaaaatgattgccc

SEQ ID NO: 186658 - DNA, 25 bp, Mus musculus
aggacactggacacaccattccgga

SEQ ID NO: 186659 - DNA, 25 bp, Mus musculus
aggacactggactaaatgattgccc

SEQ ID NO: 186660 - DNA, 25 bp, Mus musculus
aggacactggactcaccattccgga

SEQ ID NO: 186661 - DNA, 25 bp, Mus musculus
aggacactggctccaatctgcagca

SEQ ID NO: 186662 - DNA, 25 bp, Mus musculus
aggacactggctgcaatctgcagca

SEQ ID NO: 186663 - DNA, 25 bp, Mus musculus
aggacactgggaacatttaccagga

SEQ ID NO: 186664 - DNA, 25 bp, Mus musculus
aggacactgggatcatttaccagga

SEQ ID NO: 186665 - DNA, 25 bp, Mus musculus
aggacactggtactttgggctctag

SEQ ID NO: 186666 - DNA, 25 bp, Mus musculus
aggacactggtagtttgggctctag

SEQ ID NO: 186667 - DNA, 25 bp, Mus musculus
aggacacttatacccatagttctgt

SEQ ID NO: 186668 - DNA, 25 bp, Mus musculus
aggacacttatagccatagttctgt

SEQ ID NO: 186669 - DNA, 25 bp, Mus musculus
aggacacttcacagccattttctat

SEQ ID NO: 186670 - DNA, 25 bp, Mus musculus
aggacacttcactgccattttctat

SEQ ID NO: 186671 - DNA, 25 bp, Mus musculus
aggacacttccaaaggccttgaacg

SEQ ID NO: 186672 - DNA, 25 bp, Mus musculus
aggacacttccataggccttgaacg

SEQ ID NO: 186673 - DNA, 25 bp, Mus musculus
aggacacttctcatcctgaaggcct

SEQ ID NO: 186674 - DNA, 25 bp, Mus musculus
aggacacttctcttcctgaaggcct

SEQ ID NO: 186675 - DNA, 25 bp, Mus musculus
aggacacttgcaaatctggacccag

SEQ ID NO: 186676 - DNA, 25 bp, Mus musculus
aggacacttgcatatctggacccag

SEQ ID NO: 186677 - DNA, 25 bp, Mus musculus
aggacacttgctcaagtcacttctt

SEQ ID NO: 186678 - DNA, 25 bp, Mus musculus
aggacacttgctgaagtcacttctt

SEQ ID NO: 186679 - DNA, 25 bp, Mus musculus
aggacactttcaacgcagacctggt

SEQ ID NO: 186680 - DNA, 25 bp, Mus musculus
aggacactttcaagtctgtttcacc

SEQ ID NO: 186681 - DNA, 25 bp, Mus musculus
aggacactttcatcgcagacctggt

SEQ ID NO: 186682 - DNA, 25 bp, Mus musculus
aggacactttcatgtctgtttcacc

SEQ ID NO: 186683 - DNA, 25 bp, Mus musculus
aggacactttgcacattaaagcatc

SEQ ID NO: 186684 - DNA, 25 bp, Mus musculus
aggacactttgctcattaaagcatc

SEQ ID NO: 186685 - DNA, 25 bp, Mus musculus
aggacagaaccaaccacgctttcag

SEQ ID NO: 186686 - DNA, 25 bp, Mus musculus
aggacagaaccatccacgctttcag

SEQ ID NO: 186687 - DNA, 25 bp, Mus musculus
aggacagaacccagtagactcctgc

SEQ ID NO: 186688 - DNA, 25 bp, Mus musculus
aggacagaaccctgtagactcctgc

SEQ ID NO: 186689 - DNA, 25 bp, Mus musculus
aggacagaactgagcgtgcctctgt

SEQ ID NO: 186690 - DNA, 25 bp, Mus musculus
aggacagaactgtgcgtgcctctgt

SEQ ID NO: 186691 - DNA, 25 bp, Mus musculus
aggacagaagccctgaactctacct

SEQ ID NO: 186692 - DNA, 25 bp, Mus musculus
aggacagaagccgtgaactctacct

SEQ ID NO: 186693 - DNA, 25 bp, Mus musculus
aggacagaagtcagcctaaggcttt

SEQ ID NO: 186694 - DNA, 25 bp, Mus musculus
aggacagaagtccttacagctaatt

SEQ ID NO: 186695 - DNA, 25 bp, Mus musculus
aggacagaagtcgttacagctaatt

SEQ ID NO: 186696 - DNA, 25 bp, Mus musculus
aggacagaagtctgcctaaggcttt

SEQ ID NO: 186697 - DNA, 25 bp, Mus musculus
aggacagaatacctttctagcttct

SEQ ID NO: 186698 - DNA, 25 bp, Mus musculus
aggacagaatacgtttctagcttct

SEQ ID NO: 186699 - DNA, 25 bp, Mus musculus
aggacagacaaccagctcgacaaaa

SEQ ID NO: 186700 - DNA, 25 bp, Mus musculus
aggacagacaacgagctcgacaaaa

SEQ ID NO: 186701 - DNA, 25 bp, Mus musculus
aggacagaccataccgtgcaataac

SEQ ID NO: 186702 - DNA, 25 bp, Mus musculus
aggacagaccattccgtgcaataac

SEQ ID NO: 186703 - DNA, 25 bp, Mus musculus
aggacagaccgtcagtatcccgtgt

SEQ ID NO: 186704 - DNA, 25 bp, Mus musculus
aggacagaccgtgagtatcccgtgt

SEQ ID NO: 186705 - DNA, 25 bp, Mus musculus
aggacagacgacctcaagacatcgc

SEQ ID NO: 186706 - DNA, 25 bp, Mus musculus
aggacagacgacgtcaagacatcgc

SEQ ID NO: 186707 - DNA, 25 bp, Mus musculus
aggacagacggcatttgccctgaaa

SEQ ID NO: 186708 - DNA, 25 bp, Mus musculus
aggacagacggcttttgccctgaaa

SEQ ID NO: 186709 - DNA, 25 bp, Mus musculus
aggacagactccacacatggccatt

SEQ ID NO: 186710 - DNA, 25 bp, Mus musculus
aggacagactccctcagctctctga

SEQ ID NO: 186711 - DNA, 25 bp, Mus musculus
aggacagactccgtcagctctctga

SEQ ID NO: 186712 - DNA, 25 bp, Mus musculus
aggacagactcctcacatggccatt

SEQ ID NO: 186713 - DNA, 25 bp, Mus musculus
aggacagactcgatgacgccgccca

SEQ ID NO: 186714 - DNA, 25 bp, Mus musculus
aggacagactcgttgacgccgccca

SEQ ID NO: 186715 - DNA, 25 bp, Mus musculus
aggacagactgacactgggccccag

SEQ ID NO: 186716 - DNA, 25 bp, Mus musculus
aggacagactgagactgggccccag

SEQ ID NO: 186717 - DNA, 25 bp, Mus musculus
aggacagactttcccagatctggac

SEQ ID NO: 186718 - DNA, 25 bp, Mus musculus
aggacagactttgccagatctggac

SEQ ID NO: 186719 - DNA, 25 bp, Mus musculus
aggacagagaacacctagcaggaat

SEQ ID NO: 186720 - DNA, 25 bp, Mus musculus
aggacagagaactcctagcaggaat

SEQ ID NO: 186721 - DNA, 25 bp, Mus musculus
aggacagagatacagtgtgtgcaca

SEQ ID NO: 186722 - DNA, 25 bp, Mus musculus
aggacagagatagagtgtgtgcaca

SEQ ID NO: 186723 - DNA, 25 bp, Mus musculus
aggacagaggctccagtgctctgct

SEQ ID NO: 186724 - DNA, 25 bp, Mus musculus
aggacagaggctgcagtgctctgct

SEQ ID NO: 186725 - DNA, 25 bp, Mus musculus
aggacagagggcacccaaatccttt

SEQ ID NO: 186726 - DNA, 25 bp, Mus musculus
aggacagagggctcccaaatccttt

SEQ ID NO: 186727 - DNA, 25 bp, Mus musculus
aggacagaggtcctgccaaacagcc

SEQ ID NO: 186728 - DNA, 25 bp, Mus musculus
aggacagaggtcgtgccaaacagcc

SEQ ID NO: 186729 - DNA, 25 bp, Mus musculus
aggacagagtagaagggccattttc

SEQ ID NO: 186730 - DNA, 25 bp, Mus musculus
aggacagagtagtagggccattttc

SEQ ID NO: 186731 - DNA, 25 bp, Mus musculus
aggacagatccgattcacctatgcc

SEQ ID NO: 186732 - DNA, 25 bp, Mus musculus
aggacagatccgtttcacctatgcc

SEQ ID NO: 186733 - DNA, 25 bp, Mus musculus
aggacagatctacagccccaagtat

SEQ ID NO: 186734 - DNA, 25 bp, Mus musculus
aggacagatctagagccccaagtat

SEQ ID NO: 186735 - DNA, 25 bp, Mus musculus
aggacagattcacgatactagaggt

SEQ ID NO: 186736 - DNA, 25 bp, Mus musculus
aggacagattcaggatactagaggt

SEQ ID NO: 186737 - DNA, 25 bp, Mus musculus
aggacagatttgactgcatcatcat

SEQ ID NO: 186738 - DNA, 25 bp, Mus musculus
aggacagatttgtctgcatcatcat

SEQ ID NO: 186739 - DNA, 25 bp, Mus musculus
aggacagcaaatcgcgcagggacat

SEQ ID NO: 186740 - DNA, 25 bp, Mus musculus
aggacagcaaatggcgcagggacat

SEQ ID NO: 186741 - DNA, 25 bp, Mus musculus
aggacagcaaccagattggccccga

SEQ ID NO: 186742 - DNA, 25 bp, Mus musculus
aggacagcaacctgattggccccga

SEQ ID NO: 186743 - DNA, 25 bp, Mus musculus
aggacagcacagagccgcggcgtac

SEQ ID NO: 186744 - DNA, 25 bp, Mus musculus
aggacagcacagtgccgcggcgtac

SEQ ID NO: 186745 - DNA, 25 bp, Mus musculus
aggacagcaccaagactttcctcat

SEQ ID NO: 186746 - DNA, 25 bp, Mus musculus
aggacagcaccatgactttcctcat

SEQ ID NO: 186747 - DNA, 25 bp, Mus musculus
aggacagcagcacttacagctccaa

SEQ ID NO: 186748 - DNA, 25 bp, Mus musculus
aggacagcagcagttacagctccaa

SEQ ID NO: 186749 - DNA, 25 bp, Mus musculus
aggacagcagctagttcgtgtttct

SEQ ID NO: 186750 - DNA, 25 bp, Mus musculus
aggacagcagctcggctacatgcct

SEQ ID NO: 186751 - DNA, 25 bp, Mus musculus
aggacagcagctgggctacatgcct

SEQ ID NO: 186752 - DNA, 25 bp, Mus musculus
aggacagcagcttgttcgtgtttct

SEQ ID NO: 186753 - DNA, 25 bp, Mus musculus
aggacagcatgtataattcggtctg

SEQ ID NO: 186754 - DNA, 25 bp, Mus musculus
aggacagcatgtcgccactgggcac

SEQ ID NO: 186755 - DNA, 25 bp, Mus musculus
aggacagcatgtggccactgggcac

SEQ ID NO: 186756 - DNA, 25 bp, Mus musculus
aggacagcatgtttaattcggtctg

SEQ ID NO: 186757 - DNA, 25 bp, Mus musculus
aggacagccaacagggctgactgcc

SEQ ID NO: 186758 - DNA, 25 bp, Mus musculus
aggacagccaactgggctgactgcc

SEQ ID NO: 186759 - DNA, 25 bp, Mus musculus
aggacagccccgaggcctgtgatta

SEQ ID NO: 186760 - DNA, 25 bp, Mus musculus
aggacagccccgtggcctgtgatta

SEQ ID NO: 186761 - DNA, 25 bp, Mus musculus
aggacagcccgaagccaaaattcca

SEQ ID NO: 186762 - DNA, 25 bp, Mus musculus
aggacagcccgatgccaaaattcca

SEQ ID NO: 186763 - DNA, 25 bp, Mus musculus
aggacagccctcagcaagacaaagc

SEQ ID NO: 186764 - DNA, 25 bp, Mus musculus
aggacagccctctgcaagacaaagc

SEQ ID NO: 186765 - DNA, 25 bp, Mus musculus
aggacagccctgagacttagtgacg

SEQ ID NO: 186766 - DNA, 25 bp, Mus musculus
aggacagccctgtgacttagtgacg

SEQ ID NO: 186767 - DNA, 25 bp, Mus musculus
aggacagccgctctgataaggtgca

SEQ ID NO: 186768 - DNA, 25 bp, Mus musculus
aggacagccgctgtgataaggtgca

SEQ ID NO: 186769 - DNA, 25 bp, Mus musculus
aggacagccgtaaccacagcactat

SEQ ID NO: 186770 - DNA, 25 bp, Mus musculus
aggacagccgtatccacagcactat

SEQ ID NO: 186771 - DNA, 25 bp, Mus musculus
aggacagcctgcacatcgaggagta

SEQ ID NO: 186772 - DNA, 25 bp, Mus musculus
aggacagcctgctcatcgaggagta

SEQ ID NO: 186773 - DNA, 25 bp, Mus musculus
aggacagcctgtctgtaccccagta

SEQ ID NO: 186774 - DNA, 25 bp, Mus musculus
aggacagcctgtgtgtaccccagta

SEQ ID NO: 186775 - DNA, 25 bp, Mus musculus
aggacagcgcccatcgcttgttcat

SEQ ID NO: 186776 - DNA, 25 bp, Mus musculus
aggacagcgcccttcgcttgttcat

SEQ ID NO: 186777 - DNA, 25 bp, Mus musculus
aggacagcgctgaaggaagaccagc

SEQ ID NO: 186778 - DNA, 25 bp, Mus musculus
aggacagcgctgtaggaagaccagc

SEQ ID NO: 186779 - DNA, 25 bp, Mus musculus
aggacagcgcttcctggaagatcaa

SEQ ID NO: 186780 - DNA, 25 bp, Mus musculus
aggacagcgcttgctggaagatcaa

SEQ ID NO: 186781 - DNA, 25 bp, Mus musculus
aggacagcgtgcagactctgtcaca

SEQ ID NO: 186782 - DNA, 25 bp, Mus musculus
aggacagcgtgctgactctgtcaca

SEQ ID NO: 186783 - DNA, 25 bp, Mus musculus
aggacagctactaatttctttgaga

SEQ ID NO: 186784 - DNA, 25 bp, Mus musculus
aggacagctacttatttctttgaga

SEQ ID NO: 186785 - DNA, 25 bp, Mus musculus
aggacagctatgcacaagagtggac

SEQ ID NO: 186786 - DNA, 25 bp, Mus musculus
aggacagctatggacaagagtggac

SEQ ID NO: 186787 - DNA, 25 bp, Mus musculus
aggacagctcataggcacaactctt

SEQ ID NO: 186788 - DNA, 25 bp, Mus musculus
aggacagctcattggcacaactctt

SEQ ID NO: 186789 - DNA, 25 bp, Mus musculus
aggacagctcccagacccaggatga

SEQ ID NO: 186790 - DNA, 25 bp, Mus musculus
aggacagctccctgacccaggatga

SEQ ID NO: 186791 - DNA, 25 bp, Mus musculus
aggacagctgaccagtgcctgtttc

SEQ ID NO: 186792 - DNA, 25 bp, Mus musculus
aggacagctgacgagtgcctgtttc

SEQ ID NO: 186793 - DNA, 25 bp, Mus musculus
aggacagctgcgatgggcacacagt

SEQ ID NO: 186794 - DNA, 25 bp, Mus musculus
aggacagctgcgttgggcacacagt

SEQ ID NO: 186795 - DNA, 25 bp, Mus musculus
aggacagctgggactccaagtggca

SEQ ID NO: 186796 - DNA, 25 bp, Mus musculus
aggacagctgggtctccaagtggca

SEQ ID NO: 186797 - DNA, 25 bp, Mus musculus
aggacagctgtcaaatctcaaaagt

SEQ ID NO: 186798 - DNA, 25 bp, Mus musculus
aggacagctgtctaatctcaaaagt

SEQ ID NO: 186799 - DNA, 25 bp, Mus musculus
aggacagcttcactcagaggaggat

SEQ ID NO: 186800 - DNA, 25 bp, Mus musculus
aggacagcttcagtcagaggaggat

SEQ ID NO: 186801 - DNA, 25 bp, Mus musculus
aggacagcttccacggtcaaataaa

SEQ ID NO: 186802 - DNA, 25 bp, Mus musculus
aggacagcttccagagttttcccaa

SEQ ID NO: 186803 - DNA, 25 bp, Mus musculus
aggacagcttcctcggtcaaataaa

SEQ ID NO: 186804 - DNA, 25 bp, Mus musculus
aggacagcttcctgagttttcccaa

SEQ ID NO: 186805 - DNA, 25 bp, Mus musculus
aggacagcttgcctggacagcacac

SEQ ID NO: 186806 - DNA, 25 bp, Mus musculus
aggacagcttgcgtggacagcacac

SEQ ID NO: 186807 - DNA, 25 bp, Mus musculus
aggacagcttgtaccctttgcaggt

SEQ ID NO: 186808 - DNA, 25 bp, Mus musculus
aggacagcttgttccctttgcaggt

SEQ ID NO: 186809 - DNA, 25 bp, Mus musculus
aggacaggaaagaactcccactcca

SEQ ID NO: 186810 - DNA, 25 bp, Mus musculus
aggacaggaaagtactcccactcca

SEQ ID NO: 186811 - DNA, 25 bp, Mus musculus
aggacaggaagacgcaagtatcccc

SEQ ID NO: 186812 - DNA, 25 bp, Mus musculus
aggacaggaagaggcaagtatcccc

SEQ ID NO: 186813 - DNA, 25 bp, Mus musculus
aggacaggacatatacagtcccaga

SEQ ID NO: 186814 - DNA, 25 bp, Mus musculus
aggacaggacatttacagtcccaga

SEQ ID NO: 186815 - DNA, 25 bp, Mus musculus
aggacaggagacatgtccctacctc

SEQ ID NO: 186816 - DNA, 25 bp, Mus musculus
aggacaggagacttgtccctacctc

SEQ ID NO: 186817 - DNA, 25 bp, Mus musculus
aggacaggaggtcgcttcccttcag

SEQ ID NO: 186818 - DNA, 25 bp, Mus musculus
aggacaggaggtggcttcccttcag

SEQ ID NO: 186819 - DNA, 25 bp, Mus musculus
aggacaggagtcacctcaaacccag

SEQ ID NO: 186820 - DNA, 25 bp, Mus musculus
aggacaggagtctcctcaaacccag

SEQ ID NO: 186821 - DNA, 25 bp, Mus musculus
aggacaggattcaggtccctagacc

SEQ ID NO: 186822 - DNA, 25 bp, Mus musculus
aggacaggattctggtccctagacc

SEQ ID NO: 186823 - DNA, 25 bp, Mus musculus
aggacaggatttacacaaatgtatt

SEQ ID NO: 186824 - DNA, 25 bp, Mus musculus
aggacaggattttcacaaatgtatt

SEQ ID NO: 186825 - DNA, 25 bp, Mus musculus
aggacaggcagaattgggcaaagaa

SEQ ID NO: 186826 - DNA, 25 bp, Mus musculus
aggacaggcagatttgggcaaagaa

SEQ ID NO: 186827 - DNA, 25 bp, Mus musculus
aggacaggcatccatgtcacgtctt

SEQ ID NO: 186828 - DNA, 25 bp, Mus musculus
aggacaggcatcgatgtcacgtctt

SEQ ID NO: 186829 - DNA, 25 bp, Mus musculus
aggacaggccagaacttcatgagta

SEQ ID NO: 186830 - DNA, 25 bp, Mus musculus
aggacaggccagtacttcatgagta

SEQ ID NO: 186831 - DNA, 25 bp, Mus musculus
aggacaggccatcttttctcagacc

SEQ ID NO: 186832 - DNA, 25 bp, Mus musculus
aggacaggccatgttttctcagacc

SEQ ID NO: 186833 - DNA, 25 bp, Mus musculus
aggacaggccccaaagctgagctct

SEQ ID NO: 186834 - DNA, 25 bp, Mus musculus
aggacaggcccctaagctgagctct

SEQ ID NO: 186835 - DNA, 25 bp, Mus musculus
aggacaggctatatttgccataaat

SEQ ID NO: 186836 - DNA, 25 bp, Mus musculus
aggacaggctatttttgccataaat

SEQ ID NO: 186837 - DNA, 25 bp, Mus musculus
aggacaggctcaattctaagtgtga

SEQ ID NO: 186838 - DNA, 25 bp, Mus musculus
aggacaggctcatttctaagtgtga

SEQ ID NO: 186839 - DNA, 25 bp, Mus musculus
aggacagggactcgaccctatcctg

SEQ ID NO: 186840 - DNA, 25 bp, Mus musculus
aggacagggactggaccctatcctg

SEQ ID NO: 186841 - DNA, 25 bp, Mus musculus
aggacagggcccagttcactgttac

SEQ ID NO: 186842 - DNA, 25 bp, Mus musculus
aggacagggccctgttcactgttac

SEQ ID NO: 186843 - DNA, 25 bp, Mus musculus
aggacagggcctctgccaaacagaa

SEQ ID NO: 186844 - DNA, 25 bp, Mus musculus
aggacagggcctgtgccaaacagaa

SEQ ID NO: 186845 - DNA, 25 bp, Mus musculus
aggacagggctgctgttttgaaaca

SEQ ID NO: 186846 - DNA, 25 bp, Mus musculus
aggacagggctggtgttttgaaaca

SEQ ID NO: 186847 - DNA, 25 bp, Mus musculus
aggacagggtccatggtgctacaca

SEQ ID NO: 186848 - DNA, 25 bp, Mus musculus
aggacagggtccttggtgctacaca

SEQ ID NO: 186849 - DNA, 25 bp, Mus musculus
aggacaggtacgagttctcatccca

SEQ ID NO: 186850 - DNA, 25 bp, Mus musculus
aggacaggtacgtgttctcatccca

SEQ ID NO: 186851 - DNA, 25 bp, Mus musculus
aggacaggtggcaactattgccact

SEQ ID NO: 186852 - DNA, 25 bp, Mus musculus
aggacaggtggctactattgccact

SEQ ID NO: 186853 - DNA, 25 bp, Mus musculus
aggacaggtgtcagtgagccccgct

SEQ ID NO: 186854 - DNA, 25 bp, Mus musculus
aggacaggtgtctgtgagccccgct

SEQ ID NO: 186855 - DNA, 25 bp, Mus musculus
aggacaggtgtgaccttctggtccc

SEQ ID NO: 186856 - DNA, 25 bp, Mus musculus
aggacaggtgtgactcccagttgta

SEQ ID NO: 186857 - DNA, 25 bp, Mus musculus
aggacaggtgtgtccttctggtccc

SEQ ID NO: 186858 - DNA, 25 bp, Mus musculus
aggacaggtgtgtctcccagttgta

SEQ ID NO: 186859 - DNA, 25 bp, Mus musculus
aggacaggtttacctctggctcaga

SEQ ID NO: 186860 - DNA, 25 bp, Mus musculus
aggacaggtttagctctggctcaga

SEQ ID NO: 186861 - DNA, 25 bp, Mus musculus
aggacagtaacacttttcaaagacg

SEQ ID NO: 186862 - DNA, 25 bp, Mus musculus
aggacagtaacagttttcaaagacg

SEQ ID NO: 186863 - DNA, 25 bp, Mus musculus
aggacagtaagaacggtgctaccat

SEQ ID NO: 186864 - DNA, 25 bp, Mus musculus
aggacagtaagatcggtgctaccat

SEQ ID NO: 186865 - DNA, 25 bp, Mus musculus
aggacagtaagcctccacagatctc

SEQ ID NO: 186866 - DNA, 25 bp, Mus musculus
aggacagtaagcgtccacagatctc

SEQ ID NO: 186867 - DNA, 25 bp, Mus musculus
aggacagtaccacgcagttcgtgca

SEQ ID NO: 186868 - DNA, 25 bp, Mus musculus
aggacagtaccaggcagttcgtgca

SEQ ID NO: 186869 - DNA, 25 bp, Mus musculus
aggacagtacctctacaggcacggg

SEQ ID NO: 186870 - DNA, 25 bp, Mus musculus
aggacagtacctgtacaggcacggg

SEQ ID NO: 186871 - DNA, 25 bp, Mus musculus
aggacagtactgaatcatacctctg

SEQ ID NO: 186872 - DNA, 25 bp, Mus musculus
aggacagtactgtatcatacctctg

SEQ ID NO: 186873 - DNA, 25 bp, Mus musculus
aggacagtagttctcacgtcacggg

SEQ ID NO: 186874 - DNA, 25 bp, Mus musculus
aggacagtagttgtcacgtcacggg

SEQ ID NO: 186875 - DNA, 25 bp, Mus musculus
aggacagtcaaccttgtacccaaca

SEQ ID NO: 186876 - DNA, 25 bp, Mus musculus
aggacagtcaacgttgtacccaaca

SEQ ID NO: 186877 - DNA, 25 bp, Mus musculus
aggacagtccataggcctcagcaaa

SEQ ID NO: 186878 - DNA, 25 bp, Mus musculus
aggacagtccattggcctcagcaaa

SEQ ID NO: 186879 - DNA, 25 bp, Mus musculus
aggacagtccccattgcagggtatg

SEQ ID NO: 186880 - DNA, 25 bp, Mus musculus
aggacagtcccctttgcagggtatg

SEQ ID NO: 186881 - DNA, 25 bp, Mus musculus
aggacagtcgccatgtgaagaccga

SEQ ID NO: 186882 - DNA, 25 bp, Mus musculus
aggacagtcgccttgtgaagaccga

SEQ ID NO: 186883 - DNA, 25 bp, Mus musculus
aggacagtcggaactgtgcaggaca

SEQ ID NO: 186884 - DNA, 25 bp, Mus musculus
aggacagtcggatctgtgcaggaca

SEQ ID NO: 186885 - DNA, 25 bp, Mus musculus
aggacagtcttcaccggtgaccatg

SEQ ID NO: 186886 - DNA, 25 bp, Mus musculus
aggacagtcttctccggtgaccatg

SEQ ID NO: 186887 - DNA, 25 bp, Mus musculus
aggacagtgcaacgcctttctaaga

SEQ ID NO: 186888 - DNA, 25 bp, Mus musculus
aggacagtgcaaggcctttctaaga

SEQ ID NO: 186889 - DNA, 25 bp, Mus musculus
aggacagtgcacatacaggttgact

SEQ ID NO: 186890 - DNA, 25 bp, Mus musculus
aggacagtgcacttacaggttgact

SEQ ID NO: 186891 - DNA, 25 bp, Mus musculus
aggacagtgcagaaacagccagaat

SEQ ID NO: 186892 - DNA, 25 bp, Mus musculus
aggacagtgcagaaagcctggttcg

SEQ ID NO: 186893 - DNA, 25 bp, Mus musculus
aggacagtgcagtaacagccagaat

SEQ ID NO: 186894 - DNA, 25 bp, Mus musculus
aggacagtgcagtaagcctggttcg

SEQ ID NO: 186895 - DNA, 25 bp, Mus musculus
aggacagtgccacgctgcagcgcct

SEQ ID NO: 186896 - DNA, 25 bp, Mus musculus
aggacagtgccacttcaatgtaccc

SEQ ID NO: 186897 - DNA, 25 bp, Mus musculus
aggacagtgccaggctgcagcgcct

SEQ ID NO: 186898 - DNA, 25 bp, Mus musculus
aggacagtgccagttcaatgtaccc

SEQ ID NO: 186899 - DNA, 25 bp, Mus musculus
aggacagtgcccatgagctgatgta

SEQ ID NO: 186900 - DNA, 25 bp, Mus musculus
aggacagtgcccttgagctgatgta

SEQ ID NO: 186901 - DNA, 25 bp, Mus musculus
aggacagtggtgacctgcaccacaa

SEQ ID NO: 186902 - DNA, 25 bp, Mus musculus
aggacagtggtgtcctgcaccacaa

SEQ ID NO: 186903 - DNA, 25 bp, Mus musculus
aggacagtgtccacaagtactccgg

SEQ ID NO: 186904 - DNA, 25 bp, Mus musculus
aggacagtgtcctcaagtactccgg

SEQ ID NO: 186905 - DNA, 25 bp, Mus musculus
aggacagttcatcaacctaaaaggc

SEQ ID NO: 186906 - DNA, 25 bp, Mus musculus
aggacagttcatgaacctaaaaggc

SEQ ID NO: 186907 - DNA, 25 bp, Mus musculus
aggacagttggtcactccttttctg

SEQ ID NO: 186908 - DNA, 25 bp, Mus musculus
aggacagttggtgactccttttctg

SEQ ID NO: 186909 - DNA, 25 bp, Mus musculus
aggacagtttggactttgttgtgaa

SEQ ID NO: 186910 - DNA, 25 bp, Mus musculus
aggacagtttggtctttgttgtgaa

SEQ ID NO: 186911 - DNA, 25 bp, Mus musculus
aggacataaaacattaggctcgggt

SEQ ID NO: 186912 - DNA, 25 bp, Mus musculus
aggacataaaactttaggctcgggt

SEQ ID NO: 186913 - DNA, 25 bp, Mus musculus
aggacataagcaccgctctgcgagc

SEQ ID NO: 186914 - DNA, 25 bp, Mus musculus
aggacataagcagcgctctgcgagc

SEQ ID NO: 186915 - DNA, 25 bp, Mus musculus
aggacatacaagactggtaccagca

SEQ ID NO: 186916 - DNA, 25 bp, Mus musculus
aggacatacaagtctggtaccagca

SEQ ID NO: 186917 - DNA, 25 bp, Mus musculus
aggacatacagtcttccaggtaccc

SEQ ID NO: 186918 - DNA, 25 bp, Mus musculus
aggacatacagtgttccaggtaccc

SEQ ID NO: 186919 - DNA, 25 bp, Mus musculus
aggacatacatgaagctcaatggta

SEQ ID NO: 186920 - DNA, 25 bp, Mus musculus
aggacatacatgtagctcaatggta

SEQ ID NO: 186921 - DNA, 25 bp, Mus musculus
aggacataccggcagaaaccccgag

SEQ ID NO: 186922 - DNA, 25 bp, Mus musculus
aggacataccgggagaaaccccgag

SEQ ID NO: 186923 - DNA, 25 bp, Mus musculus
aggacatactaaactgatctgttca

SEQ ID NO: 186924 - DNA, 25 bp, Mus musculus
aggacatactaatctgatctgttca

SEQ ID NO: 186925 - DNA, 25 bp, Mus musculus
aggacatacttcagcccacagtgaa

SEQ ID NO: 186926 - DNA, 25 bp, Mus musculus
aggacatacttctgcccacagtgaa

SEQ ID NO: 186927 - DNA, 25 bp, Mus musculus
aggacatagatccagtcgccttggt

SEQ ID NO: 186928 - DNA, 25 bp, Mus musculus
aggacatagatcgagtcgccttggt

SEQ ID NO: 186929 - DNA, 25 bp, Mus musculus
aggacatagccaccaagcgcatctt

SEQ ID NO: 186930 - DNA, 25 bp, Mus musculus
aggacatagccaccactgaagctgg

SEQ ID NO: 186931 - DNA, 25 bp, Mus musculus
aggacatagccagcaagcgcatctt

SEQ ID NO: 186932 - DNA, 25 bp, Mus musculus
aggacatagccagcactgaagctgg

SEQ ID NO: 186933 - DNA, 25 bp, Mus musculus
aggacatagcctcccggtgtacagc

SEQ ID NO: 186934 - DNA, 25 bp, Mus musculus
aggacatagcctgccggtgtacagc

SEQ ID NO: 186935 - DNA, 25 bp, Mus musculus
aggacatagctcagtattagagcac

SEQ ID NO: 186936 - DNA, 25 bp, Mus musculus
aggacatagctctgtattagagcac

SEQ ID NO: 186937 - DNA, 25 bp, Mus musculus
aggacatatcctagtaccacagaca

SEQ ID NO: 186938 - DNA, 25 bp, Mus musculus
aggacatatccttgtaccacagaca

SEQ ID NO: 186939 - DNA, 25 bp, Mus musculus
aggacatatgagatacaaccccaga

SEQ ID NO: 186940 - DNA, 25 bp, Mus musculus
aggacatatgagttacaaccccaga

SEQ ID NO: 186941 - DNA, 25 bp, Mus musculus
aggacatatgcaaaggaccactctc

SEQ ID NO: 186942 - DNA, 25 bp, Mus musculus
aggacatatgcataggaccactctc

SEQ ID NO: 186943 - DNA, 25 bp, Mus musculus
aggacatcaacaacgtgcagttcta

SEQ ID NO: 186944 - DNA, 25 bp, Mus musculus
aggacatcaacatcgtgcagttcta

SEQ ID NO: 186945 - DNA, 25 bp, Mus musculus
aggacatcacacactcaacactgtg

SEQ ID NO: 186946 - DNA, 25 bp, Mus musculus
aggacatcacactctcaacactgtg

SEQ ID NO: 186947 - DNA, 25 bp, Mus musculus
aggacatcacctcaaaacccatctt

SEQ ID NO: 186948 - DNA, 25 bp, Mus musculus
aggacatcacctgaaaacccatctt

SEQ ID NO: 186949 - DNA, 25 bp, Mus musculus
aggacatcagtgaggatccccgctg

SEQ ID NO: 186950 - DNA, 25 bp, Mus musculus
aggacatcagtgtggatccccgctg

SEQ ID NO: 186951 - DNA, 25 bp, Mus musculus
aggacatcattcattgcctgcagtc

SEQ ID NO: 186952 - DNA, 25 bp, Mus musculus
aggacatcattctttgcctgcagtc

SEQ ID NO: 186953 - DNA, 25 bp, Mus musculus
aggacatccaggaatcttttcatga

SEQ ID NO: 186954 - DNA, 25 bp, Mus musculus
aggacatccaggtatcttttcatga

SEQ ID NO: 186955 - DNA, 25 bp, Mus musculus
aggacatccatacccaagtgaatgt

SEQ ID NO: 186956 - DNA, 25 bp, Mus musculus
aggacatccatagccaagtgaatgt

SEQ ID NO: 186957 - DNA, 25 bp, Mus musculus
aggacatccattaatttggaggcag

SEQ ID NO: 186958 - DNA, 25 bp, Mus musculus
aggacatccatttatttggaggcag

SEQ ID NO: 186959 - DNA, 25 bp, Mus musculus
aggacatccgagcttctcctgtgga

SEQ ID NO: 186960 - DNA, 25 bp, Mus musculus
aggacatccgaggttctcctgtgga

SEQ ID NO: 186961 - DNA, 25 bp, Mus musculus
aggacatcctgcctggttttggcct

SEQ ID NO: 186962 - DNA, 25 bp, Mus musculus
aggacatcctgcgtggttttggcct

SEQ ID NO: 186963 - DNA, 25 bp, Mus musculus
aggacatcctggacgacagtggcta

SEQ ID NO: 186964 - DNA, 25 bp, Mus musculus
aggacatcctggtcgacagtggcta

SEQ ID NO: 186965 - DNA, 25 bp, Mus musculus
aggacatcgagcaggagctgtgtaa

SEQ ID NO: 186966 - DNA, 25 bp, Mus musculus
aggacatcgagctggagctgtgtaa

SEQ ID NO: 186967 - DNA, 25 bp, Mus musculus
aggacatcgatgagtctcctagact

SEQ ID NO: 186968 - DNA, 25 bp, Mus musculus
aggacatcgatgtgtctcctagact

SEQ ID NO: 186969 - DNA, 25 bp, Mus musculus
aggacatcgcctacaagatcgtcag

SEQ ID NO: 186970 - DNA, 25 bp, Mus musculus
aggacatcgccttcaagatcgtcag

SEQ ID NO: 186971 - DNA, 25 bp, Mus musculus
aggacatctaccagcggctgcttgt

SEQ ID NO: 186972 - DNA, 25 bp, Mus musculus
aggacatctacctgcggctgcttgt

SEQ ID NO: 186973 - DNA, 25 bp, Mus musculus
aggacatctgagacgggcccgagaa

SEQ ID NO: 186974 - DNA, 25 bp, Mus musculus
aggacatctgagtcgggcccgagaa

SEQ ID NO: 186975 - DNA, 25 bp, Mus musculus
aggacatctggactcacagctgccc

SEQ ID NO: 186976 - DNA, 25 bp, Mus musculus
aggacatctggagtcacagctgccc

SEQ ID NO: 186977 - DNA, 25 bp, Mus musculus
aggacatctgtcacagtgaatccag

SEQ ID NO: 186978 - DNA, 25 bp, Mus musculus
aggacatctgtctcagtgaatccag

SEQ ID NO: 186979 - DNA, 25 bp, Mus musculus
aggacatcttaaatgaccccactca

SEQ ID NO: 186980 - DNA, 25 bp, Mus musculus
aggacatcttaattgaccccactca

SEQ ID NO: 186981 - DNA, 25 bp, Mus musculus
aggacatcttctagcactcattttt

SEQ ID NO: 186982 - DNA, 25 bp, Mus musculus
aggacatcttcttgcactcattttt

SEQ ID NO: 186983 - DNA, 25 bp, Mus musculus
aggacatcttgacgccacggagaac

SEQ ID NO: 186984 - DNA, 25 bp, Mus musculus
aggacatcttgaggccacggagaac

SEQ ID NO: 186985 - DNA, 25 bp, Mus musculus
aggacatcttgtctctgtgctcagt

SEQ ID NO: 186986 - DNA, 25 bp, Mus musculus
aggacatcttgtgtctgtgctcagt

SEQ ID NO: 186987 - DNA, 25 bp, Mus musculus
aggacatgaaacaggctctcacccc

SEQ ID NO: 186988 - DNA, 25 bp, Mus musculus
aggacatgaaactggctctcacccc

SEQ ID NO: 186989 - DNA, 25 bp, Mus musculus
aggacatgaataactggcccagaaa

SEQ ID NO: 186990 - DNA, 25 bp, Mus musculus
aggacatgaatatctggcccagaaa

SEQ ID NO: 186991 - DNA, 25 bp, Mus musculus
aggacatgactgctgaagagcttca

SEQ ID NO: 186992 - DNA, 25 bp, Mus musculus
aggacatgactggtgaagagcttca

SEQ ID NO: 186993 - DNA, 25 bp, Mus musculus
aggacatgagtacatttcccaccac

SEQ ID NO: 186994 - DNA, 25 bp, Mus musculus
aggacatgagtagatttcccaccac

SEQ ID NO: 186995 - DNA, 25 bp, Mus musculus
aggacatgatccctgtggctgacgt

SEQ ID NO: 186996 - DNA, 25 bp, Mus musculus
aggacatgatccgtgtggctgacgt

SEQ ID NO: 186997 - DNA, 25 bp, Mus musculus
aggacatgcaccaggtgaccgatgg

SEQ ID NO: 186998 - DNA, 25 bp, Mus musculus
aggacatgcacctggtgaccgatgg

SEQ ID NO: 186999 - DNA, 25 bp, Mus musculus
aggacatgccagcaggttctctagt

SEQ ID NO: 187000 - DNA, 25 bp, Mus musculus
aggacatgccaggaggttctctagt

SEQ ID NO: 187001 - DNA, 25 bp, Mus musculus
aggacatgcctacggctctggctta

SEQ ID NO: 187002 - DNA, 25 bp, Mus musculus
aggacatgcctagggctctggctta

SEQ ID NO: 187003 - DNA, 25 bp, Mus musculus
aggacatgctcacgtgcccgcagct

SEQ ID NO: 187004 - DNA, 25 bp, Mus musculus
aggacatgctcaggtgcccgcagct

SEQ ID NO: 187005 - DNA, 25 bp, Mus musculus
aggacatgctgtaccagtccctgaa

SEQ ID NO: 187006 - DNA, 25 bp, Mus musculus
aggacatgctgttccagtccctgaa

SEQ ID NO: 187007 - DNA, 25 bp, Mus musculus
aggacatggagtcctcagacacaca

SEQ ID NO: 187008 - DNA, 25 bp, Mus musculus
aggacatggagtgctcagacacaca

SEQ ID NO: 187009 - DNA, 25 bp, Mus musculus
aggacatggccgactttgccattct

SEQ ID NO: 187010 - DNA, 25 bp, Mus musculus
aggacatggccgtctttgccattct

SEQ ID NO: 187011 - DNA, 25 bp, Mus musculus
aggacatggcttcttagcttgggct

SEQ ID NO: 187012 - DNA, 25 bp, Mus musculus
aggacatggcttgttagcttgggct

SEQ ID NO: 187013 - DNA, 25 bp, Mus musculus
aggacatgggcaagcttaggtgtta

SEQ ID NO: 187014 - DNA, 25 bp, Mus musculus
aggacatgggcatgcttaggtgtta

SEQ ID NO: 187015 - DNA, 25 bp, Mus musculus
aggacatgggttctatgcctgccat

SEQ ID NO: 187016 - DNA, 25 bp, Mus musculus
aggacatgggttgtatgcctgccat

SEQ ID NO: 187017 - DNA, 25 bp, Mus musculus
aggacatgtacgcaagcagcccctt

SEQ ID NO: 187018 - DNA, 25 bp, Mus musculus
aggacatgtacggaagcagcccctt

SEQ ID NO: 187019 - DNA, 25 bp, Mus musculus
aggacatgtactaaggccgcagccc

SEQ ID NO: 187020 - DNA, 25 bp, Mus musculus
aggacatgtacttaggccgcagccc

SEQ ID NO: 187021 - DNA, 25 bp, Mus musculus
aggacatgtgaaatccccaccatga

SEQ ID NO: 187022 - DNA, 25 bp, Mus musculus
aggacatgtgaattccccaccatga

SEQ ID NO: 187023 - DNA, 25 bp, Mus musculus
aggacatgttatctgcaggcaacca

SEQ ID NO: 187024 - DNA, 25 bp, Mus musculus
aggacatgttatgtgcaggcaacca

SEQ ID NO: 187025 - DNA, 25 bp, Mus musculus
aggacatgttcgagaagggcaacta

SEQ ID NO: 187026 - DNA, 25 bp, Mus musculus
aggacatgttcgtgaagggcaacta

SEQ ID NO: 187027 - DNA, 25 bp, Mus musculus
aggacatgttgcattactgtaggat

SEQ ID NO: 187028 - DNA, 25 bp, Mus musculus
aggacatgttgctttactgtaggat

SEQ ID NO: 187029 - DNA, 25 bp, Mus musculus
aggacattaaacactgacgtcagat

SEQ ID NO: 187030 - DNA, 25 bp, Mus musculus
aggacattaaactctgacgtcagat

SEQ ID NO: 187031 - DNA, 25 bp, Mus musculus
aggacattaagtaccacggtgtaca

SEQ ID NO: 187032 - DNA, 25 bp, Mus musculus
aggacattaagttccacggtgtaca

SEQ ID NO: 187033 - DNA, 25 bp, Mus musculus
aggacattatccacattttactaat

SEQ ID NO: 187034 - DNA, 25 bp, Mus musculus
aggacattatcctcattttactaat

SEQ ID NO: 187035 - DNA, 25 bp, Mus musculus
aggacattccagctactttctcctt

SEQ ID NO: 187036 - DNA, 25 bp, Mus musculus
aggacattccaggtactttctcctt

SEQ ID NO: 187037 - DNA, 25 bp, Mus musculus
aggacattcccacctattctaaaat

SEQ ID NO: 187038 - DNA, 25 bp, Mus musculus
aggacattcccagctattctaaaat

SEQ ID NO: 187039 - DNA, 25 bp, Mus musculus
aggacattcggcactggagagcaga

SEQ ID NO: 187040 - DNA, 25 bp, Mus musculus
aggacattcggctctggagagcaga

SEQ ID NO: 187041 - DNA, 25 bp, Mus musculus
aggacattggcactaactgccctaa

SEQ ID NO: 187042 - DNA, 25 bp, Mus musculus
aggacattggcagtaactgccctaa

SEQ ID NO: 187043 - DNA, 25 bp, Mus musculus
aggacattggctaccgtgctgtggc

SEQ ID NO: 187044 - DNA, 25 bp, Mus musculus
aggacattggcttccgtgctgtggc

SEQ ID NO: 187045 - DNA, 25 bp, Mus musculus
aggacattgtgaaacctggttcatt

SEQ ID NO: 187046 - DNA, 25 bp, Mus musculus
aggacattgtgatacctggttcatt

SEQ ID NO: 187047 - DNA, 25 bp, Mus musculus
aggacatttccaactcagtgagcca

SEQ ID NO: 187048 - DNA, 25 bp, Mus musculus
aggacatttccatctcagtgagcca

SEQ ID NO: 187049 - DNA, 25 bp, Mus musculus
aggacatttcctcaagcacggtgcc

SEQ ID NO: 187050 - DNA, 25 bp, Mus musculus
aggacatttcctgaagcacggtgcc

SEQ ID NO: 187051 - DNA, 25 bp, Mus musculus
aggacatttgccaagtgtgcctaag

SEQ ID NO: 187052 - DNA, 25 bp, Mus musculus
aggacatttgcctagtgtgcctaag

SEQ ID NO: 187053 - DNA, 25 bp, Mus musculus
aggacatttgttcgtctgacttaat

SEQ ID NO: 187054 - DNA, 25 bp, Mus musculus
aggacatttgttggtctgacttaat

SEQ ID NO: 187055 - DNA, 25 bp, Mus musculus
aggaccaaatacaggaggtggcttt

SEQ ID NO: 187056 - DNA, 25 bp, Mus musculus
aggaccaaatactggaggtggcttt

SEQ ID NO: 187057 - DNA, 25 bp, Mus musculus
aggaccaaatctcgcaacatcttgc

SEQ ID NO: 187058 - DNA, 25 bp, Mus musculus
aggaccaaatctggcaacatcttgc

SEQ ID NO: 187059 - DNA, 25 bp, Mus musculus
aggaccaacctcagttccatggaac

SEQ ID NO: 187060 - DNA, 25 bp, Mus musculus
aggaccaacctctgttccatggaac

SEQ ID NO: 187061 - DNA, 25 bp, Mus musculus
aggaccaacgatactgagcgaggag

SEQ ID NO: 187062 - DNA, 25 bp, Mus musculus
aggaccaacgattctgagcgaggag

SEQ ID NO: 187063 - DNA, 25 bp, Mus musculus
aggaccaagaaccagcaatgtgaat

SEQ ID NO: 187064 - DNA, 25 bp, Mus musculus
aggaccaagaacgagcaatgtgaat

SEQ ID NO: 187065 - DNA, 25 bp, Mus musculus
aggaccaagactcttctgtatttta

SEQ ID NO: 187066 - DNA, 25 bp, Mus musculus
aggaccaagactgttctgtatttta

SEQ ID NO: 187067 - DNA, 25 bp, Mus musculus
aggaccaagattaatgtagctgcaa

SEQ ID NO: 187068 - DNA, 25 bp, Mus musculus
aggaccaagatttatgtagctgcaa

SEQ ID NO: 187069 - DNA, 25 bp, Mus musculus
aggaccaagcacaggaggtggcttt

SEQ ID NO: 187070 - DNA, 25 bp, Mus musculus
aggaccaagcactggaggtggcttt

SEQ ID NO: 187071 - DNA, 25 bp, Mus musculus
aggaccaagccaaatgtctttctat

SEQ ID NO: 187072 - DNA, 25 bp, Mus musculus
aggaccaagccatatgtctttctat

SEQ ID NO: 187073 - DNA, 25 bp, Mus musculus
aggaccaaggatcttgacctgggat

SEQ ID NO: 187074 - DNA, 25 bp, Mus musculus
aggaccaaggatgttgacctgggat

SEQ ID NO: 187075 - DNA, 25 bp, Mus musculus
aggaccaaggctccttactgcttca

SEQ ID NO: 187076 - DNA, 25 bp, Mus musculus
aggaccaaggctgcttactgcttca

SEQ ID NO: 187077 - DNA, 25 bp, Mus musculus
aggaccaagtaccacactgctcttg

SEQ ID NO: 187078 - DNA, 25 bp, Mus musculus
aggaccaagtacgacactgctcttg

SEQ ID NO: 187079 - DNA, 25 bp, Mus musculus
aggaccaagtagatccagcttaaaa

SEQ ID NO: 187080 - DNA, 25 bp, Mus musculus
aggaccaagtagttccagcttaaaa

SEQ ID NO: 187081 - DNA, 25 bp, Mus musculus
aggaccaatagaccttcctgtcatt

SEQ ID NO: 187082 - DNA, 25 bp, Mus musculus
aggaccaatagagcttcctgtcatt

SEQ ID NO: 187083 - DNA, 25 bp, Mus musculus
aggaccaatgctcccaatttcgtgg

SEQ ID NO: 187084 - DNA, 25 bp, Mus musculus
aggaccaatgctgccaatttcgtgg

SEQ ID NO: 187085 - DNA, 25 bp, Mus musculus
aggaccaattttaatttgcagctta

SEQ ID NO: 187086 - DNA, 25 bp, Mus musculus
aggaccaatttttatttgcagctta

SEQ ID NO: 187087 - DNA, 25 bp, Mus musculus
aggaccacaaacacagtccatcggt

SEQ ID NO: 187088 - DNA, 25 bp, Mus musculus
aggaccacaaactcagtccatcggt

SEQ ID NO: 187089 - DNA, 25 bp, Mus musculus
aggaccacaaatcctgagacagact

SEQ ID NO: 187090 - DNA, 25 bp, Mus musculus
aggaccacaaatgctgagacagact

SEQ ID NO: 187091 - DNA, 25 bp, Mus musculus
aggaccacaccaaacttatcctgtg

SEQ ID NO: 187092 - DNA, 25 bp, Mus musculus
aggaccacaccatacttatcctgtg

SEQ ID NO: 187093 - DNA, 25 bp, Mus musculus
aggaccacactaatgccactggcag

SEQ ID NO: 187094 - DNA, 25 bp, Mus musculus
aggaccacactattgccactggcag

SEQ ID NO: 187095 - DNA, 25 bp, Mus musculus
aggaccacagctagatctgcttagt

SEQ ID NO: 187096 - DNA, 25 bp, Mus musculus
aggaccacagctctacatgtcaaag

SEQ ID NO: 187097 - DNA, 25 bp, Mus musculus
aggaccacagctgtacatgtcaaag

SEQ ID NO: 187098 - DNA, 25 bp, Mus musculus
aggaccacagcttgatctgcttagt

SEQ ID NO: 187099 - DNA, 25 bp, Mus musculus
aggaccacagtaacttaccttgatg

SEQ ID NO: 187100 - DNA, 25 bp, Mus musculus
aggaccacagtatcttaccttgatg

SEQ ID NO: 187101 - DNA, 25 bp, Mus musculus
aggaccacagtcatgaggagttctt

SEQ ID NO: 187102 - DNA, 25 bp, Mus musculus
aggaccacagtcttgaggagttctt

SEQ ID NO: 187103 - DNA, 25 bp, Mus musculus
aggaccacatcaacacgagctgatt

SEQ ID NO: 187104 - DNA, 25 bp, Mus musculus
aggaccacatcatcacgagctgatt

SEQ ID NO: 187105 - DNA, 25 bp, Mus musculus
aggaccaccacaacttttacagaag

SEQ ID NO: 187106 - DNA, 25 bp, Mus musculus
aggaccaccacatcttttacagaag

SEQ ID NO: 187107 - DNA, 25 bp, Mus musculus
aggaccacccaaactcgaggctgag

SEQ ID NO: 187108 - DNA, 25 bp, Mus musculus
aggaccacccaatctcgaggctgag

SEQ ID NO: 187109 - DNA, 25 bp, Mus musculus
aggaccaccgacctggacttgagtg

SEQ ID NO: 187110 - DNA, 25 bp, Mus musculus
aggaccaccgacgtggacttgagtg

SEQ ID NO: 187111 - DNA, 25 bp, Mus musculus
aggaccacctgaactacgtgacaga

SEQ ID NO: 187112 - DNA, 25 bp, Mus musculus
aggaccacctgatctacgtgacaga

SEQ ID NO: 187113 - DNA, 25 bp, Mus musculus
aggaccacgaaacagccccagcctg

SEQ ID NO: 187114 - DNA, 25 bp, Mus musculus
aggaccacgaaagagccccagcctg

SEQ ID NO: 187115 - DNA, 25 bp, Mus musculus
aggaccacgagacggtacacacagg

SEQ ID NO: 187116 - DNA, 25 bp, Mus musculus
aggaccacgagagggtacacacagg

SEQ ID NO: 187117 - DNA, 25 bp, Mus musculus
aggaccacgcgaaccactgagaaaa

SEQ ID NO: 187118 - DNA, 25 bp, Mus musculus
aggaccacgcgatccactgagaaaa

SEQ ID NO: 187119 - DNA, 25 bp, Mus musculus
aggaccacggacactctcattaaag

SEQ ID NO: 187120 - DNA, 25 bp, Mus musculus
aggaccacggactctctcattaaag

SEQ ID NO: 187121 - DNA, 25 bp, Mus musculus
aggaccacgtttaatttattgtgct

SEQ ID NO: 187122 - DNA, 25 bp, Mus musculus
aggaccacgttttatttattgtgct

SEQ ID NO: 187123 - DNA, 25 bp, Mus musculus
aggaccactatcagcgtgcgcggaa

SEQ ID NO: 187124 - DNA, 25 bp, Mus musculus
aggaccactatccacaaaaaacgtg

SEQ ID NO: 187125 - DNA, 25 bp, Mus musculus
aggaccactatcgacaaaaaacgtg

SEQ ID NO: 187126 - DNA, 25 bp, Mus musculus
aggaccactatctgcgtgcgcggaa

SEQ ID NO: 187127 - DNA, 25 bp, Mus musculus
aggaccactctacacctgagtcgag

SEQ ID NO: 187128 - DNA, 25 bp, Mus musculus
aggaccactctagacctgagtcgag

SEQ ID NO: 187129 - DNA, 25 bp, Mus musculus
aggaccactgccaagcatattatca

SEQ ID NO: 187130 - DNA, 25 bp, Mus musculus
aggaccactgccctgaagtacgtga

SEQ ID NO: 187131 - DNA, 25 bp, Mus musculus
aggaccactgccgtgaagtacgtga

SEQ ID NO: 187132 - DNA, 25 bp, Mus musculus
aggaccactgcctagcatattatca

SEQ ID NO: 187133 - DNA, 25 bp, Mus musculus
aggaccactgtgacctgacttactt

SEQ ID NO: 187134 - DNA, 25 bp, Mus musculus
aggaccactgtgtcctgacttactt

SEQ ID NO: 187135 - DNA, 25 bp, Mus musculus
aggaccagaactagtgccatcatgt

SEQ ID NO: 187136 - DNA, 25 bp, Mus musculus
aggaccagaacttgtgccatcatgt

SEQ ID NO: 187137 - DNA, 25 bp, Mus musculus
aggaccagagcccagctgtgctgta

SEQ ID NO: 187138 - DNA, 25 bp, Mus musculus
aggaccagagccgagctgtgctgta

SEQ ID NO: 187139 - DNA, 25 bp, Mus musculus
aggaccagagtccaccctgtcaggc

SEQ ID NO: 187140 - DNA, 25 bp, Mus musculus
aggaccagagtcgaccctgtcaggc

SEQ ID NO: 187141 - DNA, 25 bp, Mus musculus
aggaccagatccacaataacctaag

SEQ ID NO: 187142 - DNA, 25 bp, Mus musculus
aggaccagatcctcaataacctaag

SEQ ID NO: 187143 - DNA, 25 bp, Mus musculus
aggaccagccacctcaagatgtgaa

SEQ ID NO: 187144 - DNA, 25 bp, Mus musculus
aggaccagccacgtcaagatgtgaa

SEQ ID NO: 187145 - DNA, 25 bp, Mus musculus
aggaccagccccaggtggaggccaa

SEQ ID NO: 187146 - DNA, 25 bp, Mus musculus
aggaccagcccctggtggaggccaa

SEQ ID NO: 187147 - DNA, 25 bp, Mus musculus
aggaccagccttcgttatatagcaa

SEQ ID NO: 187148 - DNA, 25 bp, Mus musculus
aggaccagccttggttatatagcaa

SEQ ID NO: 187149 - DNA, 25 bp, Mus musculus
aggaccaggaagactgtttcacaga

SEQ ID NO: 187150 - DNA, 25 bp, Mus musculus
aggaccaggaagtctgtttcacaga

SEQ ID NO: 187151 - DNA, 25 bp, Mus musculus
aggaccaggataagcccctcccttt

SEQ ID NO: 187152 - DNA, 25 bp, Mus musculus
aggaccaggatatgcccctcccttt

SEQ ID NO: 187153 - DNA, 25 bp, Mus musculus
aggaccaggcagatgtatactttag

SEQ ID NO: 187154 - DNA, 25 bp, Mus musculus
aggaccaggcagttgtatactttag

SEQ ID NO: 187155 - DNA, 25 bp, Mus musculus
aggaccaggccgatatcaaccacat

SEQ ID NO: 187156 - DNA, 25 bp, Mus musculus
aggaccaggccgttatcaaccacat

SEQ ID NO: 187157 - DNA, 25 bp, Mus musculus
aggaccaggctcagaatgccagcat

SEQ ID NO: 187158 - DNA, 25 bp, Mus musculus
aggaccaggctctgaatgccagcat

SEQ ID NO: 187159 - DNA, 25 bp, Mus musculus
aggaccaggtggactccacggactt

SEQ ID NO: 187160 - DNA, 25 bp, Mus musculus
aggaccaggtggtctccacggactt

SEQ ID NO: 187161 - DNA, 25 bp, Mus musculus
aggaccaggttgactcctgcgactt

SEQ ID NO: 187162 - DNA, 25 bp, Mus musculus
aggaccaggttgtctcctgcgactt

SEQ ID NO: 187163 - DNA, 25 bp, Mus musculus
aggaccagtcctaccggaggagagt

SEQ ID NO: 187164 - DNA, 25 bp, Mus musculus
aggaccagtccttccggaggagagt

SEQ ID NO: 187165 - DNA, 25 bp, Mus musculus
aggaccagtctgcaaagcaactcac

SEQ ID NO: 187166 - DNA, 25 bp, Mus musculus
aggaccagtctggaaagcaactcac

SEQ ID NO: 187167 - DNA, 25 bp, Mus musculus
aggaccagtgagagccgtgacttat

SEQ ID NO: 187168 - DNA, 25 bp, Mus musculus
aggaccagtgagtgccgtgacttat

SEQ ID NO: 187169 - DNA, 25 bp, Mus musculus
aggaccagttcaaggtgcctcggga

SEQ ID NO: 187170 - DNA, 25 bp, Mus musculus
aggaccagttcatggtgcctcggga

SEQ ID NO: 187171 - DNA, 25 bp, Mus musculus
aggaccatagtcaccaacggcgtca

SEQ ID NO: 187172 - DNA, 25 bp, Mus musculus
aggaccatagtctccaacggcgtca

SEQ ID NO: 187173 - DNA, 25 bp, Mus musculus
aggaccatatggaggagggaactat

SEQ ID NO: 187174 - DNA, 25 bp, Mus musculus
aggaccatatggtggagggaactat

SEQ ID NO: 187175 - DNA, 25 bp, Mus musculus
aggaccatcacaaccattaagacgt

SEQ ID NO: 187176 - DNA, 25 bp, Mus musculus
aggaccatcacatccattaagacgt

SEQ ID NO: 187177 - DNA, 25 bp, Mus musculus
aggaccatcagaccagcacagagtc

SEQ ID NO: 187178 - DNA, 25 bp, Mus musculus
aggaccatcagagcagcacagagtc

SEQ ID NO: 187179 - DNA, 25 bp, Mus musculus
aggaccatccctcttgtattcaaag

SEQ ID NO: 187180 - DNA, 25 bp, Mus musculus
aggaccatccctgttgtattcaaag

SEQ ID NO: 187181 - DNA, 25 bp, Mus musculus
aggaccatccgtacatctctgaaat

SEQ ID NO: 187182 - DNA, 25 bp, Mus musculus
aggaccatccgttcatctctgaaat

SEQ ID NO: 187183 - DNA, 25 bp, Mus musculus
aggaccatcctcacacaagaaatat

SEQ ID NO: 187184 - DNA, 25 bp, Mus musculus
aggaccatcctctcacaagaaatat

SEQ ID NO: 187185 - DNA, 25 bp, Mus musculus
aggaccatgagacctgttgtgaatc

SEQ ID NO: 187186 - DNA, 25 bp, Mus musculus
aggaccatgagagctgttgtgaatc

SEQ ID NO: 187187 - DNA, 25 bp, Mus musculus
aggaccatgagtcagcctttagcct

SEQ ID NO: 187188 - DNA, 25 bp, Mus musculus
aggaccatgagtgagcctttagcct

SEQ ID NO: 187189 - DNA, 25 bp, Mus musculus
aggaccatgattcctttggcctcag

SEQ ID NO: 187190 - DNA, 25 bp, Mus musculus
aggaccatgattgctttggcctcag

SEQ ID NO: 187191 - DNA, 25 bp, Mus musculus
aggaccatgccaattgtactcacag

SEQ ID NO: 187192 - DNA, 25 bp, Mus musculus
aggaccatgccatttgtactcacag

SEQ ID NO: 187193 - DNA, 25 bp, Mus musculus
aggaccatgctcacaagtggcgatt

SEQ ID NO: 187194 - DNA, 25 bp, Mus musculus
aggaccatgctctcaagtggcgatt

SEQ ID NO: 187195 - DNA, 25 bp, Mus musculus
aggaccatgggcagagctccttaac

SEQ ID NO: 187196 - DNA, 25 bp, Mus musculus
aggaccatgggctgagctccttaac

SEQ ID NO: 187197 - DNA, 25 bp, Mus musculus
aggaccatgtcacgtgtctcttggc

SEQ ID NO: 187198 - DNA, 25 bp, Mus musculus
aggaccatgtcaggtgtctcttggc

SEQ ID NO: 187199 - DNA, 25 bp, Mus musculus
aggaccattaaaacgcggagagcta

SEQ ID NO: 187200 - DNA, 25 bp, Mus musculus
aggaccattaaatcgcggagagcta

SEQ ID NO: 187201 - DNA, 25 bp, Mus musculus
aggaccattacgatgctacagcaat

SEQ ID NO: 187202 - DNA, 25 bp, Mus musculus
aggaccattacgttgctacagcaat

SEQ ID NO: 187203 - DNA, 25 bp, Mus musculus
aggaccattcaaatcatctttattt

SEQ ID NO: 187204 - DNA, 25 bp, Mus musculus
aggaccattcaattcatctttattt

SEQ ID NO: 187205 - DNA, 25 bp, Mus musculus
aggaccattgacagcttacagatac

SEQ ID NO: 187206 - DNA, 25 bp, Mus musculus
aggaccattgactgcttacagatac

SEQ ID NO: 187207 - DNA, 25 bp, Mus musculus
aggaccatttgcagtgcctgaccac

SEQ ID NO: 187208 - DNA, 25 bp, Mus musculus
aggaccatttgctgtgcctgaccac

SEQ ID NO: 187209 - DNA, 25 bp, Mus musculus
aggaccatttttcgcattccgacag

SEQ ID NO: 187210 - DNA, 25 bp, Mus musculus
aggaccatttttggcattccgacag

SEQ ID NO: 187211 - DNA, 25 bp, Mus musculus
aggacccaaattaaccatctctgac

SEQ ID NO: 187212 - DNA, 25 bp, Mus musculus
aggacccaaatttaccatctctgac

SEQ ID NO: 187213 - DNA, 25 bp, Mus musculus
aggacccacacgagctaaactgcag

SEQ ID NO: 187214 - DNA, 25 bp, Mus musculus
aggacccacacgcagaaggcgagaa

SEQ ID NO: 187215 - DNA, 25 bp, Mus musculus
aggacccacacggagaaggcgagaa

SEQ ID NO: 187216 - DNA, 25 bp, Mus musculus
aggacccacacgtgctaaactgcag

SEQ ID NO: 187217 - DNA, 25 bp, Mus musculus
aggacccacatgaaagcccacaggc

SEQ ID NO: 187218 - DNA, 25 bp, Mus musculus
aggacccacatgacatttaataacc

SEQ ID NO: 187219 - DNA, 25 bp, Mus musculus
aggacccacatgtaagcccacaggc

SEQ ID NO: 187220 - DNA, 25 bp, Mus musculus
aggacccacatgtcatttaataacc

SEQ ID NO: 187221 - DNA, 25 bp, Mus musculus
aggacccacgagattgagcgggcac

SEQ ID NO: 187222 - DNA, 25 bp, Mus musculus
aggacccacgagtttgagcgggcac

SEQ ID NO: 187223 - DNA, 25 bp, Mus musculus
aggacccagaaaccgcagagcttgt

SEQ ID NO: 187224 - DNA, 25 bp, Mus musculus
aggacccagaaagcgcagagcttgt

SEQ ID NO: 187225 - DNA, 25 bp, Mus musculus
aggacccagaccaattcatcttaga

SEQ ID NO: 187226 - DNA, 25 bp, Mus musculus
aggacccagacctattcatcttaga

SEQ ID NO: 187227 - DNA, 25 bp, Mus musculus
aggacccagccgatcttcaaatcct

SEQ ID NO: 187228 - DNA, 25 bp, Mus musculus
aggacccagccgttcttcaaatcct

SEQ ID NO: 187229 - DNA, 25 bp, Mus musculus
aggacccagctccatcattctgtgg

SEQ ID NO: 187230 - DNA, 25 bp, Mus musculus
aggacccagctcgatcattctgtgg

SEQ ID NO: 187231 - DNA, 25 bp, Mus musculus
aggacccaggtaccagtatgtttat

SEQ ID NO: 187232 - DNA, 25 bp, Mus musculus
aggacccaggtagcagtatgtttat

SEQ ID NO: 187233 - DNA, 25 bp, Mus musculus
aggacccagtgcaggtctaactaga

SEQ ID NO: 187234 - DNA, 25 bp, Mus musculus
aggacccagtgctggtctaactaga

SEQ ID NO: 187235 - DNA, 25 bp, Mus musculus
aggacccagttcagcttctttctta

SEQ ID NO: 187236 - DNA, 25 bp, Mus musculus
aggacccagttctgcttctttctta

SEQ ID NO: 187237 - DNA, 25 bp, Mus musculus
aggacccatagtagagtgccactca

SEQ ID NO: 187238 - DNA, 25 bp, Mus musculus
aggacccatagttgagtgccactca

SEQ ID NO: 187239 - DNA, 25 bp, Mus musculus
aggacccatatgctcaactgtatca

SEQ ID NO: 187240 - DNA, 25 bp, Mus musculus
aggacccatatggtcaactgtatca

SEQ ID NO: 187241 - DNA, 25 bp, Mus musculus
aggacccatctgaacacggaggagg

SEQ ID NO: 187242 - DNA, 25 bp, Mus musculus
aggacccatctgtacacggaggagg

SEQ ID NO: 187243 - DNA, 25 bp, Mus musculus
aggacccatggtattgacaagccct

SEQ ID NO: 187244 - DNA, 25 bp, Mus musculus
aggacccatggttttgacaagccct

SEQ ID NO: 187245 - DNA, 25 bp, Mus musculus
aggaccccaaacacatcggttatgt

SEQ ID NO: 187246 - DNA, 25 bp, Mus musculus
aggaccccaaactcatcggttatgt

SEQ ID NO: 187247 - DNA, 25 bp, Mus musculus
aggaccccaaccagctctacaatga

SEQ ID NO: 187248 - DNA, 25 bp, Mus musculus
aggaccccaacctgctctacaatga

SEQ ID NO: 187249 - DNA, 25 bp, Mus musculus
aggaccccaaggacgagcccacaga

SEQ ID NO: 187250 - DNA, 25 bp, Mus musculus
aggaccccaaggtcgagcccacaga

SEQ ID NO: 187251 - DNA, 25 bp, Mus musculus
aggaccccactcaaggctatgtcag

SEQ ID NO: 187252 - DNA, 25 bp, Mus musculus
aggaccccactctaggctatgtcag

SEQ ID NO: 187253 - DNA, 25 bp, Mus musculus
aggaccccagatcctgctctgagct

SEQ ID NO: 187254 - DNA, 25 bp, Mus musculus
aggaccccagatgctgctctgagct

SEQ ID NO: 187255 - DNA, 25 bp, Mus musculus
aggaccccattcaggaggatggaga

SEQ ID NO: 187256 - DNA, 25 bp, Mus musculus
aggaccccattctggaggatggaga

SEQ ID NO: 187257 - DNA, 25 bp, Mus musculus
aggaccccctgtatgtgctggagca

SEQ ID NO: 187258 - DNA, 25 bp, Mus musculus
aggaccccctgtttgtgctggagca

SEQ ID NO: 187259 - DNA, 25 bp, Mus musculus
aggaccccgaagcaccagggcatgt

SEQ ID NO: 187260 - DNA, 25 bp, Mus musculus
aggaccccgaaggaccagggcatgt

SEQ ID NO: 187261 - DNA, 25 bp, Mus musculus
aggaccccgcctctatcgagtagca

SEQ ID NO: 187262 - DNA, 25 bp, Mus musculus
aggaccccgcctgtatcgagtagca

SEQ ID NO: 187263 - DNA, 25 bp, Mus musculus
aggaccccgctgagcaagctgggaa

SEQ ID NO: 187264 - DNA, 25 bp, Mus musculus
aggaccccgctgtgcaagctgggaa

SEQ ID NO: 187265 - DNA, 25 bp, Mus musculus
aggaccccggagacttgcatggtag

SEQ ID NO: 187266 - DNA, 25 bp, Mus musculus
aggaccccggagtcttgcatggtag

SEQ ID NO: 187267 - DNA, 25 bp, Mus musculus
aggacccctggaccgtatcgatttc

SEQ ID NO: 187268 - DNA, 25 bp, Mus musculus
aggacccctggagcgtatcgatttc

SEQ ID NO: 187269 - DNA, 25 bp, Mus musculus
aggacccgcatcctggaagggacct

SEQ ID NO: 187270 - DNA, 25 bp, Mus musculus
aggacccgcatcgtggaagggacct

SEQ ID NO: 187271 - DNA, 25 bp, Mus musculus
aggacccgcggcacagagacttaat

SEQ ID NO: 187272 - DNA, 25 bp, Mus musculus
aggacccgcggctcagagacttaat

SEQ ID NO: 187273 - DNA, 25 bp, Mus musculus
aggacccggactccccacatagata

SEQ ID NO: 187274 - DNA, 25 bp, Mus musculus
aggacccggactgcccacatagata

SEQ ID NO: 187275 - DNA, 25 bp, Mus musculus
aggacccgtggaatctcaggcatgt

SEQ ID NO: 187276 - DNA, 25 bp, Mus musculus
aggacccgtggattctcaggcatgt

SEQ ID NO: 187277 - DNA, 25 bp, Mus musculus
aggaccctaaacatcattagcttca

SEQ ID NO: 187278 - DNA, 25 bp, Mus musculus
aggaccctaaacttcattagcttca

SEQ ID NO: 187279 - DNA, 25 bp, Mus musculus
aggaccctactcctcagaacttagc

SEQ ID NO: 187280 - DNA, 25 bp, Mus musculus
aggaccctactcgtcagaacttagc

SEQ ID NO: 187281 - DNA, 25 bp, Mus musculus
aggaccctagtcattgtacttgatg

SEQ ID NO: 187282 - DNA, 25 bp, Mus musculus
aggaccctagtctttgtacttgatg

SEQ ID NO: 187283 - DNA, 25 bp, Mus musculus
aggaccctattaaggccatgcaggc

SEQ ID NO: 187284 - DNA, 25 bp, Mus musculus
aggaccctattatggccatgcaggc

SEQ ID NO: 187285 - DNA, 25 bp, Mus musculus
aggaccctcatcaagttaacaggag

SEQ ID NO: 187286 - DNA, 25 bp, Mus musculus
aggaccctcatctagttaacaggag

SEQ ID NO: 187287 - DNA, 25 bp, Mus musculus
aggaccctcgtccacacttggaata

SEQ ID NO: 187288 - DNA, 25 bp, Mus musculus
aggaccctcgtcgacacttggaata

SEQ ID NO: 187289 - DNA, 25 bp, Mus musculus
aggaccctcgtgaaggtcctgcgca

SEQ ID NO: 187290 - DNA, 25 bp, Mus musculus
aggaccctcgtgtaggtcctgcgca

SEQ ID NO: 187291 - DNA, 25 bp, Mus musculus
aggaccctctccacgtaggcctaga

SEQ ID NO: 187292 - DNA, 25 bp, Mus musculus
aggaccctctcctcgtaggcctaga

SEQ ID NO: 187293 - DNA, 25 bp, Mus musculus
aggaccctcttgatcttgtcattgt

SEQ ID NO: 187294 - DNA, 25 bp, Mus musculus
aggaccctcttgttcttgtcattgt

SEQ ID NO: 187295 - DNA, 25 bp, Mus musculus
aggaccctgaacaacgacatcatgc

SEQ ID NO: 187296 - DNA, 25 bp, Mus musculus
aggaccctgaactacgacatcatgc

SEQ ID NO: 187297 - DNA, 25 bp, Mus musculus
aggaccctgaatcatttggagccca

SEQ ID NO: 187298 - DNA, 25 bp, Mus musculus
aggaccctgaatgatttggagccca

SEQ ID NO: 187299 - DNA, 25 bp, Mus musculus
aggaccctgatcacctcaagatctt

SEQ ID NO: 187300 - DNA, 25 bp, Mus musculus
aggaccctgatcattcactgtgaca

SEQ ID NO: 187301 - DNA, 25 bp, Mus musculus
aggaccctgatctcctcaagatctt

SEQ ID NO: 187302 - DNA, 25 bp, Mus musculus
aggaccctgatctttcactgtgaca

SEQ ID NO: 187303 - DNA, 25 bp, Mus musculus
aggaccctgcataccagcggataaa

SEQ ID NO: 187304 - DNA, 25 bp, Mus musculus
aggaccctgcattccagcggataaa

SEQ ID NO: 187305 - DNA, 25 bp, Mus musculus
aggaccctgctgcttatcctaagat

SEQ ID NO: 187306 - DNA, 25 bp, Mus musculus
aggaccctgctggttatcctaagat

SEQ ID NO: 187307 - DNA, 25 bp, Mus musculus
aggaccctgggcacattcttgttgg

SEQ ID NO: 187308 - DNA, 25 bp, Mus musculus
aggaccctgggcatgcaaggcaagt

SEQ ID NO: 187309 - DNA, 25 bp, Mus musculus
aggaccctgggctcattcttgttgg

SEQ ID NO: 187310 - DNA, 25 bp, Mus musculus
aggaccctgggcttgcaaggcaagt

SEQ ID NO: 187311 - DNA, 25 bp, Mus musculus
aggaccctgttcattgcttatttgc

SEQ ID NO: 187312 - DNA, 25 bp, Mus musculus
aggaccctgttctttgcttatttgc

SEQ ID NO: 187313 - DNA, 25 bp, Mus musculus
aggaccctgtttaggatttggagag

SEQ ID NO: 187314 - DNA, 25 bp, Mus musculus
aggaccctgtttctaaagtgctagt

SEQ ID NO: 187315 - DNA, 25 bp, Mus musculus
aggaccctgtttgtaaagtgctagt

SEQ ID NO: 187316 - DNA, 25 bp, Mus musculus
aggaccctgttttggatttggagag

SEQ ID NO: 187317 - DNA, 25 bp, Mus musculus
aggacccttaggaaatgtgcaaatg

SEQ ID NO: 187318 - DNA, 25 bp, Mus musculus
aggacccttaggtaatgtgcaaatg

SEQ ID NO: 187319 - DNA, 25 bp, Mus musculus
aggacccttagtaactgcagttcag

SEQ ID NO: 187320 - DNA, 25 bp, Mus musculus
aggacccttagtctgatcccagcac

SEQ ID NO: 187321 - DNA, 25 bp, Mus musculus
aggacccttagtgtgatcccagcac

SEQ ID NO: 187322 - DNA, 25 bp, Mus musculus
aggacccttagttactgcagttcag

SEQ ID NO: 187323 - DNA, 25 bp, Mus musculus
aggacccttggaaagagttcagctg

SEQ ID NO: 187324 - DNA, 25 bp, Mus musculus
aggacccttggatagagttcagctg

SEQ ID NO: 187325 - DNA, 25 bp, Mus musculus
aggacccttggtcatatttctcatc

SEQ ID NO: 187326 - DNA, 25 bp, Mus musculus
aggacccttggtgatatttctcatc

SEQ ID NO: 187327 - DNA, 25 bp, Mus musculus
aggacccttgttcctacctggttct

SEQ ID NO: 187328 - DNA, 25 bp, Mus musculus
aggacccttgttgctacctggttct

SEQ ID NO: 187329 - DNA, 25 bp, Mus musculus
aggacccttttcagtggcattagat

SEQ ID NO: 187330 - DNA, 25 bp, Mus musculus
aggacccttttctgtggcattagat

SEQ ID NO: 187331 - DNA, 25 bp, Mus musculus
aggaccgaagtcaaaagatcatcaa

SEQ ID NO: 187332 - DNA, 25 bp, Mus musculus
aggaccgaagtcacttctggaaagt

SEQ ID NO: 187333 - DNA, 25 bp, Mus musculus
aggaccgaagtctaaagatcatcaa

SEQ ID NO: 187334 - DNA, 25 bp, Mus musculus
aggaccgaagtctcttctggaaagt

SEQ ID NO: 187335 - DNA, 25 bp, Mus musculus
aggaccgagattcgctgcctggcca

SEQ ID NO: 187336 - DNA, 25 bp, Mus musculus
aggaccgagattggctgcctggcca

SEQ ID NO: 187337 - DNA, 25 bp, Mus musculus
aggaccgaggacctgagccccatgc

SEQ ID NO: 187338 - DNA, 25 bp, Mus musculus
aggaccgaggacgtgagccccatgc

SEQ ID NO: 187339 - DNA, 25 bp, Mus musculus
aggaccgagtggacccagatccaaa

SEQ ID NO: 187340 - DNA, 25 bp, Mus musculus
aggaccgagtggtcccagatccaaa

SEQ ID NO: 187341 - DNA, 25 bp, Mus musculus
aggaccgattccacttcaatgagat

SEQ ID NO: 187342 - DNA, 25 bp, Mus musculus
aggaccgattcctcttcaatgagat

SEQ ID NO: 187343 - DNA, 25 bp, Mus musculus
aggaccgcccggcaggtcacttctg

SEQ ID NO: 187344 - DNA, 25 bp, Mus musculus
aggaccgcccgggaggtcacttctg

SEQ ID NO: 187345 - DNA, 25 bp, Mus musculus
aggaccgccgctatgcaggcttgaa

SEQ ID NO: 187346 - DNA, 25 bp, Mus musculus
aggaccgccgctttgcaggcttgaa

SEQ ID NO: 187347 - DNA, 25 bp, Mus musculus
aggaccgccgtgatgctgtcagctt

SEQ ID NO: 187348 - DNA, 25 bp, Mus musculus
aggaccgccgtgttgctgtcagctt

SEQ ID NO: 187349 - DNA, 25 bp, Mus musculus
aggaccgcgtctatggacactcggg

SEQ ID NO: 187350 - DNA, 25 bp, Mus musculus
aggaccgcgtctttggacactcggg

SEQ ID NO: 187351 - DNA, 25 bp, Mus musculus
aggaccgctaccatagctattcaag

SEQ ID NO: 187352 - DNA, 25 bp, Mus musculus
aggaccgctaccttagctattcaag

SEQ ID NO: 187353 - DNA, 25 bp, Mus musculus
aggaccgctactaggacctgggagc

SEQ ID NO: 187354 - DNA, 25 bp, Mus musculus
aggaccgctacttggacctgggagc

SEQ ID NO: 187355 - DNA, 25 bp, Mus musculus
aggaccgctagcaaagagactctta

SEQ ID NO: 187356 - DNA, 25 bp, Mus musculus
aggaccgctagctaagagactctta

SEQ ID NO: 187357 - DNA, 25 bp, Mus musculus
aggaccgctgttctccttaaggatg

SEQ ID NO: 187358 - DNA, 25 bp, Mus musculus
aggaccgctgttgtccttaaggatg

SEQ ID NO: 187359 - DNA, 25 bp, Mus musculus
aggaccggaatcacaggctcagggc

SEQ ID NO: 187360 - DNA, 25 bp, Mus musculus
aggaccggaatctcaggctcagggc

SEQ ID NO: 187361 - DNA, 25 bp, Mus musculus
aggaccggatcgatatccgcttctt

SEQ ID NO: 187362 - DNA, 25 bp, Mus musculus
aggaccggatcgttatccgcttctt

SEQ ID NO: 187363 - DNA, 25 bp, Mus musculus
aggaccggcaacattggattcttcg

SEQ ID NO: 187364 - DNA, 25 bp, Mus musculus
aggaccggcaactttggattcttcg

SEQ ID NO: 187365 - DNA, 25 bp, Mus musculus
aggaccggccaactgttgtttgctg

SEQ ID NO: 187366 - DNA, 25 bp, Mus musculus
aggaccggccaagtgttgtttgctg

SEQ ID NO: 187367 - DNA, 25 bp, Mus musculus
aggaccggccttaactgagctgtca

SEQ ID NO: 187368 - DNA, 25 bp, Mus musculus
aggaccggcctttactgagctgtca

SEQ ID NO: 187369 - DNA, 25 bp, Mus musculus
aggaccggctcgctcagcgactaca

SEQ ID NO: 187370 - DNA, 25 bp, Mus musculus
aggaccggctcggtcagcgactaca

SEQ ID NO: 187371 - DNA, 25 bp, Mus musculus
aggaccgggaccaccagtgacaccg

SEQ ID NO: 187372 - DNA, 25 bp, Mus musculus
aggaccgggacctccagtgacaccg

SEQ ID NO: 187373 - DNA, 25 bp, Mus musculus
aggaccggtgtcaaatcagctgctc

SEQ ID NO: 187374 - DNA, 25 bp, Mus musculus
aggaccggtgtctaatcagctgctc

SEQ ID NO: 187375 - DNA, 25 bp, Mus musculus
aggaccgtattcaataacatgagtg

SEQ ID NO: 187376 - DNA, 25 bp, Mus musculus
aggaccgtattctataacatgagtg

SEQ ID NO: 187377 - DNA, 25 bp, Mus musculus
aggaccgtgttcacctgaggagcag

SEQ ID NO: 187378 - DNA, 25 bp, Mus musculus
aggaccgtgttctcctgaggagcag

SEQ ID NO: 187379 - DNA, 25 bp, Mus musculus
aggaccgttcaacagcctttgctaa

SEQ ID NO: 187380 - DNA, 25 bp, Mus musculus
aggaccgttcaagagcctttgctaa

SEQ ID NO: 187381 - DNA, 25 bp, Mus musculus
aggacctaaaggatgtgacccgaga

SEQ ID NO: 187382 - DNA, 25 bp, Mus musculus
aggacctaaaggttgtgacccgaga

SEQ ID NO: 187383 - DNA, 25 bp, Mus musculus
aggacctaaatgaacctgcgcacct

SEQ ID NO: 187384 - DNA, 25 bp, Mus musculus
aggacctaaatgtacctgcgcacct

SEQ ID NO: 187385 - DNA, 25 bp, Mus musculus
aggacctaaggcatctagactttat

SEQ ID NO: 187386 - DNA, 25 bp, Mus musculus
aggacctaaggcttctagactttat

SEQ ID NO: 187387 - DNA, 25 bp, Mus musculus
aggacctacacccagagatgtgaag

SEQ ID NO: 187388 - DNA, 25 bp, Mus musculus
aggacctacaccgagagatgtgaag

SEQ ID NO: 187389 - DNA, 25 bp, Mus musculus
aggacctacagcatggtaactccat

SEQ ID NO: 187390 - DNA, 25 bp, Mus musculus
aggacctacagcttggtaactccat

SEQ ID NO: 187391 - DNA, 25 bp, Mus musculus
aggacctacgacattcagggcttgg

SEQ ID NO: 187392 - DNA, 25 bp, Mus musculus
aggacctacgactttcagggcttgg

SEQ ID NO: 187393 - DNA, 25 bp, Mus musculus
aggacctactttatctatgactgga

SEQ ID NO: 187394 - DNA, 25 bp, Mus musculus
aggacctactttttctatgactgga

SEQ ID NO: 187395 - DNA, 25 bp, Mus musculus
aggacctagaccacgaaaatcaatg

SEQ ID NO: 187396 - DNA, 25 bp, Mus musculus
aggacctagacctcgaaaatcaatg

SEQ ID NO: 187397 - DNA, 25 bp, Mus musculus
aggacctagcggcacaatcttgtct

SEQ ID NO: 187398 - DNA, 25 bp, Mus musculus
aggacctagcgggacaatcttgtct

SEQ ID NO: 187399 - DNA, 25 bp, Mus musculus
aggacctagctacccagacttacat

SEQ ID NO: 187400 - DNA, 25 bp, Mus musculus
aggacctagctagccagacttacat

SEQ ID NO: 187401 - DNA, 25 bp, Mus musculus
aggacctaggctctggcagaaacca

SEQ ID NO: 187402 - DNA, 25 bp, Mus musculus
aggacctaggctgtggcagaaacca

SEQ ID NO: 187403 - DNA, 25 bp, Mus musculus
aggacctagtagaactggaccctga

SEQ ID NO: 187404 - DNA, 25 bp, Mus musculus
aggacctagtagtactggaccctga

SEQ ID NO: 187405 - DNA, 25 bp, Mus musculus
aggacctatctgcaatggcccacag

SEQ ID NO: 187406 - DNA, 25 bp, Mus musculus
aggacctatctggaatggcccacag

SEQ ID NO: 187407 - DNA, 25 bp, Mus musculus
aggacctatgacaagtttgcatatg

SEQ ID NO: 187408 - DNA, 25 bp, Mus musculus
aggacctatgactagtttgcatatg

SEQ ID NO: 187409 - DNA, 25 bp, Mus musculus
aggacctatgcaaggctttggcttc

SEQ ID NO: 187410 - DNA, 25 bp, Mus musculus
aggacctatgcatggctttggcttc

SEQ ID NO: 187411 - DNA, 25 bp, Mus musculus
aggacctcaaggaacagggctgtaa

SEQ ID NO: 187412 - DNA, 25 bp, Mus musculus
aggacctcaaggtacagggctgtaa

SEQ ID NO: 187413 - DNA, 25 bp, Mus musculus
aggacctcaatcaagcctaagctac

SEQ ID NO: 187414 - DNA, 25 bp, Mus musculus
aggacctcaatctagcctaagctac

SEQ ID NO: 187415 - DNA, 25 bp, Mus musculus
aggacctcacacatgattgacagat

SEQ ID NO: 187416 - DNA, 25 bp, Mus musculus
aggacctcacacttgattgacagat

SEQ ID NO: 187417 - DNA, 25 bp, Mus musculus
aggacctcacataagctggctgatg

SEQ ID NO: 187418 - DNA, 25 bp, Mus musculus
aggacctcacattagctggctgatg

SEQ ID NO: 187419 - DNA, 25 bp, Mus musculus
aggacctcactacagataccagact

SEQ ID NO: 187420 - DNA, 25 bp, Mus musculus
aggacctcactagagataccagact

SEQ ID NO: 187421 - DNA, 25 bp, Mus musculus
aggacctcactgaaagttgaaggga

SEQ ID NO: 187422 - DNA, 25 bp, Mus musculus
aggacctcactgtaagttgaaggga

SEQ ID NO: 187423 - DNA, 25 bp, Mus musculus
aggacctcagagaagctgggttgca

SEQ ID NO: 187424 - DNA, 25 bp, Mus musculus
aggacctcagagtagctgggttgca

SEQ ID NO: 187425 - DNA, 25 bp, Mus musculus
aggacctcagtcctgaagaggccta

SEQ ID NO: 187426 - DNA, 25 bp, Mus musculus
aggacctcagtcgtgaagaggccta

SEQ ID NO: 187427 - DNA, 25 bp, Mus musculus
aggacctcagtgacacatcgagctc

SEQ ID NO: 187428 - DNA, 25 bp, Mus musculus
aggacctcagtgtcacatcgagctc

SEQ ID NO: 187429 - DNA, 25 bp, Mus musculus
aggacctcatgaacacctgagagca

SEQ ID NO: 187430 - DNA, 25 bp, Mus musculus
aggacctcatgatcacctgagagca

SEQ ID NO: 187431 - DNA, 25 bp, Mus musculus
aggacctccagcaaggtgtgctgca

SEQ ID NO: 187432 - DNA, 25 bp, Mus musculus
aggacctccagctaggtgtgctgca

SEQ ID NO: 187433 - DNA, 25 bp, Mus musculus
aggacctccctccaagagaaaagat

SEQ ID NO: 187434 - DNA, 25 bp, Mus musculus
aggacctccctcgaagagaaaagat

SEQ ID NO: 187435 - DNA, 25 bp, Mus musculus
aggacctcgggaagctctgatccag

SEQ ID NO: 187436 - DNA, 25 bp, Mus musculus
aggacctcgggatgctctgatccag

SEQ ID NO: 187437 - DNA, 25 bp, Mus musculus
aggacctctcttcgcaagtcatcta

SEQ ID NO: 187438 - DNA, 25 bp, Mus musculus
aggacctctcttggcaagtcatcta

SEQ ID NO: 187439 - DNA, 25 bp, Mus musculus
aggacctctgctacagatctgcctt

SEQ ID NO: 187440 - DNA, 25 bp, Mus musculus
aggacctctgcttcagatctgcctt

SEQ ID NO: 187441 - DNA, 25 bp, Mus musculus
aggacctctggcattatgtgacttc

SEQ ID NO: 187442 - DNA, 25 bp, Mus musculus
aggacctctggctttatgtgacttc

SEQ ID NO: 187443 - DNA, 25 bp, Mus musculus
aggacctctggtatgcttcgagaag

SEQ ID NO: 187444 - DNA, 25 bp, Mus musculus
aggacctctggtttgcttcgagaag

SEQ ID NO: 187445 - DNA, 25 bp, Mus musculus
aggacctctgtactgagaactttat

SEQ ID NO: 187446 - DNA, 25 bp, Mus musculus
aggacctctgtagtgagaactttat

SEQ ID NO: 187447 - DNA, 25 bp, Mus musculus
aggacctctgtcatattcataaaag

SEQ ID NO: 187448 - DNA, 25 bp, Mus musculus
aggacctctgtcttattcataaaag

SEQ ID NO: 187449 - DNA, 25 bp, Mus musculus
aggacctcttgcagtcttgaaggtt

SEQ ID NO: 187450 - DNA, 25 bp, Mus musculus
aggacctcttgctgtcttgaaggtt

SEQ ID NO: 187451 - DNA, 25 bp, Mus musculus
aggacctcttgtcgccattgtggac

SEQ ID NO: 187452 - DNA, 25 bp, Mus musculus
aggacctcttgtggccattgtggac

SEQ ID NO: 187453 - DNA, 25 bp, Mus musculus
aggacctctttcctctactgtatgc

SEQ ID NO: 187454 - DNA, 25 bp, Mus musculus
aggacctctttcgtctactgtatgc

SEQ ID NO: 187455 - DNA, 25 bp, Mus musculus
aggacctgacctctgccttcatctt

SEQ ID NO: 187456 - DNA, 25 bp, Mus musculus
aggacctgacctgtgccttcatctt

SEQ ID NO: 187457 - DNA, 25 bp, Mus musculus
aggacctgagaccaccttgagtgga

SEQ ID NO: 187458 - DNA, 25 bp, Mus musculus
aggacctgagacgaccttgagtgga

SEQ ID NO: 187459 - DNA, 25 bp, Mus musculus
aggacctgagctattttcacactta

SEQ ID NO: 187460 - DNA, 25 bp, Mus musculus
aggacctgagcttttttcacactta

SEQ ID NO: 187461 - DNA, 25 bp, Mus musculus
aggacctgagtgatgaactgattga

SEQ ID NO: 187462 - DNA, 25 bp, Mus musculus
aggacctgagtgttgaactgattga

SEQ ID NO: 187463 - DNA, 25 bp, Mus musculus
aggacctgatcactctgggaactgg

SEQ ID NO: 187464 - DNA, 25 bp, Mus musculus
aggacctgatcagtctgggaactgg

SEQ ID NO: 187465 - DNA, 25 bp, Mus musculus
aggacctgatgcaaagattacaaat

SEQ ID NO: 187466 - DNA, 25 bp, Mus musculus
aggacctgatgctaagattacaaat

SEQ ID NO: 187467 - DNA, 25 bp, Mus musculus
aggacctgattgcacctctggcatg

SEQ ID NO: 187468 - DNA, 25 bp, Mus musculus
aggacctgattggacctctggcatg

SEQ ID NO: 187469 - DNA, 25 bp, Mus musculus
aggacctgcagtacggtatcctgga

SEQ ID NO: 187470 - DNA, 25 bp, Mus musculus
aggacctgcagttcggtatcctgga

SEQ ID NO: 187471 - DNA, 25 bp, Mus musculus
aggacctgcatccagccttcagtag

SEQ ID NO: 187472 - DNA, 25 bp, Mus musculus
aggacctgcatcgagccttcagtag

SEQ ID NO: 187473 - DNA, 25 bp, Mus musculus
aggacctgccagacccaatggagaa

SEQ ID NO: 187474 - DNA, 25 bp, Mus musculus
aggacctgccagacgagtacatcca

SEQ ID NO: 187475 - DNA, 25 bp, Mus musculus
aggacctgccagtcccaatggagaa

SEQ ID NO: 187476 - DNA, 25 bp, Mus musculus
aggacctgccagtcgagtacatcca

SEQ ID NO: 187477 - DNA, 25 bp, Mus musculus
aggacctgccatatgcacttttgaa

SEQ ID NO: 187478 - DNA, 25 bp, Mus musculus
aggacctgccatttgcacttttgaa

SEQ ID NO: 187479 - DNA, 25 bp, Mus musculus
aggacctgcgcaatattctctggag

SEQ ID NO: 187480 - DNA, 25 bp, Mus musculus
aggacctgcgcattattctctggag

SEQ ID NO: 187481 - DNA, 25 bp, Mus musculus
aggacctgctagcactcaaaccttg

SEQ ID NO: 187482 - DNA, 25 bp, Mus musculus
aggacctgctaggactcaaaccttg

SEQ ID NO: 187483 - DNA, 25 bp, Mus musculus
aggacctgctctctaactcagtagg

SEQ ID NO: 187484 - DNA, 25 bp, Mus musculus
aggacctgctctctgatctagactc

SEQ ID NO: 187485 - DNA, 25 bp, Mus musculus
aggacctgctctgtaactcagtagg

SEQ ID NO: 187486 - DNA, 25 bp, Mus musculus
aggacctgctctgtgatctagactc

SEQ ID NO: 187487 - DNA, 25 bp, Mus musculus
aggacctgctgaagaagttccagac

SEQ ID NO: 187488 - DNA, 25 bp, Mus musculus
aggacctgctgaaggacgtcatgca

SEQ ID NO: 187489 - DNA, 25 bp, Mus musculus
aggacctgctgatgaagttccagac

SEQ ID NO: 187490 - DNA, 25 bp, Mus musculus
aggacctgctgatggacgtcatgca

SEQ ID NO: 187491 - DNA, 25 bp, Mus musculus
aggacctgcttccaatctgttacac

SEQ ID NO: 187492 - DNA, 25 bp, Mus musculus
aggacctgcttcgaatctgttacac

SEQ ID NO: 187493 - DNA, 25 bp, Mus musculus
aggacctggaacagcgccagttcaa

SEQ ID NO: 187494 - DNA, 25 bp, Mus musculus
aggacctggaactgcgccagttcaa

SEQ ID NO: 187495 - DNA, 25 bp, Mus musculus
aggacctggactatcattttctgtg

SEQ ID NO: 187496 - DNA, 25 bp, Mus musculus
aggacctggactttcattttctgtg

SEQ ID NO: 187497 - DNA, 25 bp, Mus musculus
aggacctggagaaatacgctggagc

SEQ ID NO: 187498 - DNA, 25 bp, Mus musculus
aggacctggagatatacgctggagc

SEQ ID NO: 187499 - DNA, 25 bp, Mus musculus
aggacctggagtatgtgtacgagac

SEQ ID NO: 187500 - DNA, 25 bp, Mus musculus
aggacctggagtttgtgtacgagac

SEQ ID NO: 187501 - DNA, 25 bp, Mus musculus
aggacctggataagctgccctgggt

SEQ ID NO: 187502 - DNA, 25 bp, Mus musculus
aggacctggatatgctgccctgggt

SEQ ID NO: 187503 - DNA, 25 bp, Mus musculus
aggacctggattcgcctgcgtgcac

SEQ ID NO: 187504 - DNA, 25 bp, Mus musculus
aggacctggattggcctgcgtgcac

SEQ ID NO: 187505 - DNA, 25 bp, Mus musculus
aggacctggcagatttctctctgtg

SEQ ID NO: 187506 - DNA, 25 bp, Mus musculus
aggacctggcagttttctctctgtg

SEQ ID NO: 187507 - DNA, 25 bp, Mus musculus
aggacctggcctactccgggatgga

SEQ ID NO: 187508 - DNA, 25 bp, Mus musculus
aggacctggccttctccgggatgga

SEQ ID NO: 187509 - DNA, 25 bp, Mus musculus
aggacctggctgagccccgcatgtg

SEQ ID NO: 187510 - DNA, 25 bp, Mus musculus
aggacctggctgtgccccgcatgtg

SEQ ID NO: 187511 - DNA, 25 bp, Mus musculus
aggacctgggacaacgggacacttg

SEQ ID NO: 187512 - DNA, 25 bp, Mus musculus
aggacctgggactacgggacacttg

SEQ ID NO: 187513 - DNA, 25 bp, Mus musculus
aggacctgggctccaagtttggcat

SEQ ID NO: 187514 - DNA, 25 bp, Mus musculus
aggacctgggctgcaagtttggcat

SEQ ID NO: 187515 - DNA, 25 bp, Mus musculus
aggacctgtaggactgaaccattaa

SEQ ID NO: 187516 - DNA, 25 bp, Mus musculus
aggacctgtaggtctgaaccattaa

SEQ ID NO: 187517 - DNA, 25 bp, Mus musculus
aggacctgtattctcagggacaaag

SEQ ID NO: 187518 - DNA, 25 bp, Mus musculus
aggacctgtattgtcagggacaaag

SEQ ID NO: 187519 - DNA, 25 bp, Mus musculus
aggacctgtctgatcagggctacag

SEQ ID NO: 187520 - DNA, 25 bp, Mus musculus
aggacctgtctgttcagggctacag

SEQ ID NO: 187521 - DNA, 25 bp, Mus musculus
aggacctgtcttactgcagtgccaa

SEQ ID NO: 187522 - DNA, 25 bp, Mus musculus
aggacctgtctttctgcagtgccaa

SEQ ID NO: 187523 - DNA, 25 bp, Mus musculus
aggacctgtgccaggcttagaggac

SEQ ID NO: 187524 - DNA, 25 bp, Mus musculus
aggacctgtgcctggcttagaggac

SEQ ID NO: 187525 - DNA, 25 bp, Mus musculus
aggacctgtgctcccctaaagccaa

SEQ ID NO: 187526 - DNA, 25 bp, Mus musculus
aggacctgtgctgccctaaagccaa

SEQ ID NO: 187527 - DNA, 25 bp, Mus musculus
aggacctgtggaactgtagccattc

SEQ ID NO: 187528 - DNA, 25 bp, Mus musculus
aggacctgtggatctgtagccattc

SEQ ID NO: 187529 - DNA, 25 bp, Mus musculus
aggacctgtggccaagttcttagta

SEQ ID NO: 187530 - DNA, 25 bp, Mus musculus
aggacctgtggcgaagttcttagta

SEQ ID NO: 187531 - DNA, 25 bp, Mus musculus
aggacctgttccagcctgctattcc

SEQ ID NO: 187532 - DNA, 25 bp, Mus musculus
aggacctgttcctgcctgctattcc

SEQ ID NO: 187533 - DNA, 25 bp, Mus musculus
aggaccttactactccattcagcac

SEQ ID NO: 187534 - DNA, 25 bp, Mus musculus
aggaccttactagtccattcagcac

SEQ ID NO: 187535 - DNA, 25 bp, Mus musculus
aggaccttagagaagagtgggcttt

SEQ ID NO: 187536 - DNA, 25 bp, Mus musculus
aggaccttagagtagagtgggcttt

SEQ ID NO: 187537 - DNA, 25 bp, Mus musculus
aggaccttcaacctatcatcgcaag

SEQ ID NO: 187538 - DNA, 25 bp, Mus musculus
aggaccttcaacgtatcatcgcaag

SEQ ID NO: 187539 - DNA, 25 bp, Mus musculus
aggaccttccatataggtgtaagag

SEQ ID NO: 187540 - DNA, 25 bp, Mus musculus
aggaccttccatttaggtgtaagag

SEQ ID NO: 187541 - DNA, 25 bp, Mus musculus
aggaccttcctaattatgtgccctc

SEQ ID NO: 187542 - DNA, 25 bp, Mus musculus
aggaccttcctatttatgtgccctc

SEQ ID NO: 187543 - DNA, 25 bp, Mus musculus
aggaccttccttccttggacagcag

SEQ ID NO: 187544 - DNA, 25 bp, Mus musculus
aggaccttccttgcttggacagcag

SEQ ID NO: 187545 - DNA, 25 bp, Mus musculus
aggaccttcggtaggcaggaccctg

SEQ ID NO: 187546 - DNA, 25 bp, Mus musculus
aggaccttcggttggcaggaccctg

SEQ ID NO: 187547 - DNA, 25 bp, Mus musculus
aggaccttctgaccagatcctagat

SEQ ID NO: 187548 - DNA, 25 bp, Mus musculus
aggaccttctgaccgatcggaacaa

SEQ ID NO: 187549 - DNA, 25 bp, Mus musculus
aggaccttctgagcagatcctagat

SEQ ID NO: 187550 - DNA, 25 bp, Mus musculus
aggaccttctgagcgatcggaacaa

SEQ ID NO: 187551 - DNA, 25 bp, Mus musculus
aggaccttgatgatcttgccatcct

SEQ ID NO: 187552 - DNA, 25 bp, Mus musculus
aggaccttgatgttcttgccatcct

SEQ ID NO: 187553 - DNA, 25 bp, Mus musculus
aggaccttgcctacctaaatggcag

SEQ ID NO: 187554 - DNA, 25 bp, Mus musculus
aggaccttgccttcctaaatggcag

SEQ ID NO: 187555 - DNA, 25 bp, Mus musculus
aggaccttggagcaatgctgctgaa

SEQ ID NO: 187556 - DNA, 25 bp, Mus musculus
aggaccttggaggaatgctgctgaa

SEQ ID NO: 187557 - DNA, 25 bp, Mus musculus
aggaccttggctaagtgtctctgac

SEQ ID NO: 187558 - DNA, 25 bp, Mus musculus
aggaccttggctaggcctggtgact

SEQ ID NO: 187559 - DNA, 25 bp, Mus musculus
aggaccttggctatatcttcaactt

SEQ ID NO: 187560 - DNA, 25 bp, Mus musculus
aggaccttggcttagtgtctctgac

SEQ ID NO: 187561 - DNA, 25 bp, Mus musculus
aggaccttggcttggcctggtgact

SEQ ID NO: 187562 - DNA, 25 bp, Mus musculus
aggaccttggctttatcttcaactt

SEQ ID NO: 187563 - DNA, 25 bp, Mus musculus
aggaccttggtaactaaggccgtct

SEQ ID NO: 187564 - DNA, 25 bp, Mus musculus
aggaccttggtatctaaggccgtct

SEQ ID NO: 187565 - DNA, 25 bp, Mus musculus
aggaccttggtccaatgaatgccca

SEQ ID NO: 187566 - DNA, 25 bp, Mus musculus
aggaccttggtcgaatgaatgccca

SEQ ID NO: 187567 - DNA, 25 bp, Mus musculus
aggaccttgtgcacatcctcctagg

SEQ ID NO: 187568 - DNA, 25 bp, Mus musculus
aggaccttgtgctcatcctcctagg

SEQ ID NO: 187569 - DNA, 25 bp, Mus musculus
aggaccttgtggcagctttgatatg

SEQ ID NO: 187570 - DNA, 25 bp, Mus musculus
aggaccttgtgggagctttgatatg

SEQ ID NO: 187571 - DNA, 25 bp, Mus musculus
aggaccttgtgtctgctaaccatag

SEQ ID NO: 187572 - DNA, 25 bp, Mus musculus
aggaccttgtgtgtgctaaccatag

SEQ ID NO: 187573 - DNA, 25 bp, Mus musculus
aggaccttgttcacaagtccaggaa

SEQ ID NO: 187574 - DNA, 25 bp, Mus musculus
aggaccttgttctcaagtccaggaa

SEQ ID NO: 187575 - DNA, 25 bp, Mus musculus
aggacctttcatattcttagctcta

SEQ ID NO: 187576 - DNA, 25 bp, Mus musculus
aggacctttcattttcttagctcta

SEQ ID NO: 187577 - DNA, 25 bp, Mus musculus
aggacctttgatcccaacacaggga

SEQ ID NO: 187578 - DNA, 25 bp, Mus musculus
aggacctttgatgccaacacaggga

SEQ ID NO: 187579 - DNA, 25 bp, Mus musculus
aggacctttgcacttcatcttgcag

SEQ ID NO: 187580 - DNA, 25 bp, Mus musculus
aggacctttgcagttcatcttgcag

SEQ ID NO: 187581 - DNA, 25 bp, Mus musculus
aggacctttgtaattcatttcacaa

SEQ ID NO: 187582 - DNA, 25 bp, Mus musculus
aggacctttgtatttcatttcacaa

SEQ ID NO: 187583 - DNA, 25 bp, Mus musculus
aggaccttttgcattctcttcagac

SEQ ID NO: 187584 - DNA, 25 bp, Mus musculus
aggaccttttgctttctcttcagac

SEQ ID NO: 187585 - DNA, 25 bp, Mus musculus
aggaccttttttccgctgctgccgc

SEQ ID NO: 187586 - DNA, 25 bp, Mus musculus
aggaccttttttgcgctgctgccgc

SEQ ID NO: 187587 - DNA, 25 bp, Mus musculus
aggacgaacgagcaggacttgcttt

SEQ ID NO: 187588 - DNA, 25 bp, Mus musculus
aggacgaacgaggaggacttgcttt

SEQ ID NO: 187589 - DNA, 25 bp, Mus musculus
aggacgaagtggctcttctggctac

SEQ ID NO: 187590 - DNA, 25 bp, Mus musculus
aggacgaagtgggtcttctggctac

SEQ ID NO: 187591 - DNA, 25 bp, Mus musculus
aggacgaatggcactccacactgga

SEQ ID NO: 187592 - DNA, 25 bp, Mus musculus
aggacgaatggctctccacactgga

SEQ ID NO: 187593 - DNA, 25 bp, Mus musculus
aggacgaatgtcagcagttcactgc

SEQ ID NO: 187594 - DNA, 25 bp, Mus musculus
aggacgaatgtctgcagttcactgc

SEQ ID NO: 187595 - DNA, 25 bp, Mus musculus
aggacgaatgtgagtctgttaccac

SEQ ID NO: 187596 - DNA, 25 bp, Mus musculus
aggacgaatgtgtgtctgttaccac

SEQ ID NO: 187597 - DNA, 25 bp, Mus musculus
aggacgacaacaacatcttctctgt

SEQ ID NO: 187598 - DNA, 25 bp, Mus musculus
aggacgacaacatcatcttctctgt

SEQ ID NO: 187599 - DNA, 25 bp, Mus musculus
aggacgacatggctactctcctggg

SEQ ID NO: 187600 - DNA, 25 bp, Mus musculus
aggacgacatgggtactctcctggg

SEQ ID NO: 187601 - DNA, 25 bp, Mus musculus
aggacgacccagctattctcataca

SEQ ID NO: 187602 - DNA, 25 bp, Mus musculus
aggacgacccaggtattctcataca

SEQ ID NO: 187603 - DNA, 25 bp, Mus musculus
aggacgacctctctacccagttctt

SEQ ID NO: 187604 - DNA, 25 bp, Mus musculus
aggacgacctctgtacccagttctt

SEQ ID NO: 187605 - DNA, 25 bp, Mus musculus
aggacgacctgcatactgtatttgt

SEQ ID NO: 187606 - DNA, 25 bp, Mus musculus
aggacgacctgcttactgtatttgt

SEQ ID NO: 187607 - DNA, 25 bp, Mus musculus
aggacgacgacgaccatgacgaagg

SEQ ID NO: 187608 - DNA, 25 bp, Mus musculus
aggacgacgacgtccatgacgaagg

SEQ ID NO: 187609 - DNA, 25 bp, Mus musculus
aggacgacgcccaattattcaaaat

SEQ ID NO: 187610 - DNA, 25 bp, Mus musculus
aggacgacgccctattattcaaaat

SEQ ID NO: 187611 - DNA, 25 bp, Mus musculus
aggacgactttcaggagttcgcgaa

SEQ ID NO: 187612 - DNA, 25 bp, Mus musculus
aggacgactttctggagttcgcgaa

SEQ ID NO: 187613 - DNA, 25 bp, Mus musculus
aggacgagaggcacatcacccggct

SEQ ID NO: 187614 - DNA, 25 bp, Mus musculus
aggacgagaggctcatcacccggct

SEQ ID NO: 187615 - DNA, 25 bp, Mus musculus
aggacgagagtcacctcggcactga

SEQ ID NO: 187616 - DNA, 25 bp, Mus musculus
aggacgagagtctcctcggcactga

SEQ ID NO: 187617 - DNA, 25 bp, Mus musculus
aggacgagccgtacgccgagcccta

SEQ ID NO: 187618 - DNA, 25 bp, Mus musculus
aggacgagccgttcgccgagcccta

SEQ ID NO: 187619 - DNA, 25 bp, Mus musculus
aggacgagccttactcggtacagag

SEQ ID NO: 187620 - DNA, 25 bp, Mus musculus
aggacgagcctttctcggtacagag

SEQ ID NO: 187621 - DNA, 25 bp, Mus musculus
aggacgaggtatcggcatctctctc

SEQ ID NO: 187622 - DNA, 25 bp, Mus musculus
aggacgaggtatgggcatctctctc

SEQ ID NO: 187623 - DNA, 25 bp, Mus musculus
aggacgaggtgaacgacttctctca

SEQ ID NO: 187624 - DNA, 25 bp, Mus musculus
aggacgaggtgatcgacttctctca

SEQ ID NO: 187625 - DNA, 25 bp, Mus musculus
aggacgatcctaatcagtggcacaa

SEQ ID NO: 187626 - DNA, 25 bp, Mus musculus
aggacgatcctattcagtggcacaa

SEQ ID NO: 187627 - DNA, 25 bp, Mus musculus
aggacgatgcctccaaaggacgatg

SEQ ID NO: 187628 - DNA, 25 bp, Mus musculus
aggacgatgcctgcaaaggacgatg

SEQ ID NO: 187629 - DNA, 25 bp, Mus musculus
aggacgatgctgctgattgcccaca

SEQ ID NO: 187630 - DNA, 25 bp, Mus musculus
aggacgatgctggtgattgcccaca

SEQ ID NO: 187631 - DNA, 25 bp, Mus musculus
aggacgattaagaggttcccacaca

SEQ ID NO: 187632 - DNA, 25 bp, Mus musculus
aggacgattaagtggttcccacaca

SEQ ID NO: 187633 - DNA, 25 bp, Mus musculus
aggacgatttccagcgaagcctgga

SEQ ID NO: 187634 - DNA, 25 bp, Mus musculus
aggacgatttcctgcgaagcctgga

SEQ ID NO: 187635 - DNA, 25 bp, Mus musculus
aggacgcactgaccgatcattacaa

SEQ ID NO: 187636 - DNA, 25 bp, Mus musculus
aggacgcactgagcgatcattacaa

SEQ ID NO: 187637 - DNA, 25 bp, Mus musculus
aggacgcagcttaccaaagtcatac

SEQ ID NO: 187638 - DNA, 25 bp, Mus musculus
aggacgcagcttccatcgcctatat

SEQ ID NO: 187639 - DNA, 25 bp, Mus musculus
aggacgcagcttgcatcgcctatat

SEQ ID NO: 187640 - DNA, 25 bp, Mus musculus
aggacgcagctttccaaagtcatac

SEQ ID NO: 187641 - DNA, 25 bp, Mus musculus
aggacgcatgtcatcctttgcctcg

SEQ ID NO: 187642 - DNA, 25 bp, Mus musculus
aggacgcatgtcttcctttgcctcg

SEQ ID NO: 187643 - DNA, 25 bp, Mus musculus
aggacgccaagaccacactgaggat

SEQ ID NO: 187644 - DNA, 25 bp, Mus musculus
aggacgccaagagcacactgaggat

SEQ ID NO: 187645 - DNA, 25 bp, Mus musculus
aggacgccaagtctggtctctcctc

SEQ ID NO: 187646 - DNA, 25 bp, Mus musculus
aggacgccaagtgtggtctctcctc

SEQ ID NO: 187647 - DNA, 25 bp, Mus musculus
aggacgccagaaacgccagacaact

SEQ ID NO: 187648 - DNA, 25 bp, Mus musculus
aggacgccagaatcgccagacaact

SEQ ID NO: 187649 - DNA, 25 bp, Mus musculus
aggacgccataaaccgcatccagga

SEQ ID NO: 187650 - DNA, 25 bp, Mus musculus
aggacgccataatccgcatccagga

SEQ ID NO: 187651 - DNA, 25 bp, Mus musculus
aggacgccatcactcagccctaggg

SEQ ID NO: 187652 - DNA, 25 bp, Mus musculus
aggacgccatcagtcagccctaggg

SEQ ID NO: 187653 - DNA, 25 bp, Mus musculus
aggacgccatcgcagtgctcagtgt

SEQ ID NO: 187654 - DNA, 25 bp, Mus musculus
aggacgccatcggagtgctcagtgt

SEQ ID NO: 187655 - DNA, 25 bp, Mus musculus
aggacgccattgagcaagctgtgaa

SEQ ID NO: 187656 - DNA, 25 bp, Mus musculus
aggacgccattgtgcaagctgtgaa

SEQ ID NO: 187657 - DNA, 25 bp, Mus musculus
aggacgcccaccaggctactcaata

SEQ ID NO: 187658 - DNA, 25 bp, Mus musculus
aggacgcccacctggctactcaata

SEQ ID NO: 187659 - DNA, 25 bp, Mus musculus
aggacgccccgtacactttaggcag

SEQ ID NO: 187660 - DNA, 25 bp, Mus musculus
aggacgccccgttcactttaggcag

SEQ ID NO: 187661 - DNA, 25 bp, Mus musculus
aggacgccgcgaatttgccttcaat

SEQ ID NO: 187662 - DNA, 25 bp, Mus musculus
aggacgccgcgattttgccttcaat

SEQ ID NO: 187663 - DNA, 25 bp, Mus musculus
aggacgcctctgagcatgctattaa

SEQ ID NO: 187664 - DNA, 25 bp, Mus musculus
aggacgcctctgtgcatgctattaa

SEQ ID NO: 187665 - DNA, 25 bp, Mus musculus
aggacgcctgagcttgacctttggc

SEQ ID NO: 187666 - DNA, 25 bp, Mus musculus
aggacgcctgaggttgacctttggc

SEQ ID NO: 187667 - DNA, 25 bp, Mus musculus
aggacgcctgctctatatcttcaag

SEQ ID NO: 187668 - DNA, 25 bp, Mus musculus
aggacgcctgctgtatatcttcaag

SEQ ID NO: 187669 - DNA, 25 bp, Mus musculus
aggacgccttcacctctttcttcat

SEQ ID NO: 187670 - DNA, 25 bp, Mus musculus
aggacgccttcagctctttcttcat

SEQ ID NO: 187671 - DNA, 25 bp, Mus musculus
aggacgccttccctgaggtgtacga

SEQ ID NO: 187672 - DNA, 25 bp, Mus musculus
aggacgccttccgtgaggtgtacga

SEQ ID NO: 187673 - DNA, 25 bp, Mus musculus
aggacgcgcagacggaacgttccca

SEQ ID NO: 187674 - DNA, 25 bp, Mus musculus
aggacgcgcagagggaacgttccca

SEQ ID NO: 187675 - DNA, 25 bp, Mus musculus
aggacgctaagaaggcgctcggcct

SEQ ID NO: 187676 - DNA, 25 bp, Mus musculus
aggacgctaagatggcgctcggcct

SEQ ID NO: 187677 - DNA, 25 bp, Mus musculus
aggacgctacgtcgatgtgactctt

SEQ ID NO: 187678 - DNA, 25 bp, Mus musculus
aggacgctacgtggatgtgactctt

SEQ ID NO: 187679 - DNA, 25 bp, Mus musculus
aggacgctgaagatggctgttgcca

SEQ ID NO: 187680 - DNA, 25 bp, Mus musculus
aggacgctgaagttggctgttgcca

SEQ ID NO: 187681 - DNA, 25 bp, Mus musculus
aggacgcttcatacaggccgggcac

SEQ ID NO: 187682 - DNA, 25 bp, Mus musculus
aggacgcttcattcaggccgggcac

SEQ ID NO: 187683 - DNA, 25 bp, Mus musculus
aggacgcttcctcatttttgctaca

SEQ ID NO: 187684 - DNA, 25 bp, Mus musculus
aggacgcttcctgatttttgctaca

SEQ ID NO: 187685 - DNA, 25 bp, Mus musculus
aggacggacgccaggccacttacgg

SEQ ID NO: 187686 - DNA, 25 bp, Mus musculus
aggacggacgcctggccacttacgg

SEQ ID NO: 187687 - DNA, 25 bp, Mus musculus
aggacggagcccctgatctctatac

SEQ ID NO: 187688 - DNA, 25 bp, Mus musculus
aggacggagcccgtgatctctatac

SEQ ID NO: 187689 - DNA, 25 bp, Mus musculus
aggacggagccgagttcgacctcag

SEQ ID NO: 187690 - DNA, 25 bp, Mus musculus
aggacggagccgtgttcgacctcag

SEQ ID NO: 187691 - DNA, 25 bp, Mus musculus
aggacggaggacctcactcctgtga

SEQ ID NO: 187692 - DNA, 25 bp, Mus musculus
aggacggaggacgtcactcctgtga

SEQ ID NO: 187693 - DNA, 25 bp, Mus musculus
aggacggagtccacctaggccaggc

SEQ ID NO: 187694 - DNA, 25 bp, Mus musculus
aggacggagtcctcctaggccaggc

SEQ ID NO: 187695 - DNA, 25 bp, Mus musculus
aggacggatgtgataattgacttaa

SEQ ID NO: 187696 - DNA, 25 bp, Mus musculus
aggacggatgtgttaattgacttaa

SEQ ID NO: 187697 - DNA, 25 bp, Mus musculus
aggacggcaactccattcgctcaag

SEQ ID NO: 187698 - DNA, 25 bp, Mus musculus
aggacggcaactgcattcgctcaag

SEQ ID NO: 187699 - DNA, 25 bp, Mus musculus
aggacggcattaactacacccagga

SEQ ID NO: 187700 - DNA, 25 bp, Mus musculus
aggacggcattatctacacccagga

SEQ ID NO: 187701 - DNA, 25 bp, Mus musculus
aggacggcccgtaggtagcgactct

SEQ ID NO: 187702 - DNA, 25 bp, Mus musculus
aggacggcccgttggtagcgactct

SEQ ID NO: 187703 - DNA, 25 bp, Mus musculus
aggacggccgctattctgtggacta

SEQ ID NO: 187704 - DNA, 25 bp, Mus musculus
aggacggccgcttttctgtggacta

SEQ ID NO: 187705 - DNA, 25 bp, Mus musculus
aggacggcctctaagtgtgagcgca

SEQ ID NO: 187706 - DNA, 25 bp, Mus musculus
aggacggcctcttagtgtgagcgca

SEQ ID NO: 187707 - DNA, 25 bp, Mus musculus
aggacggcgtcacaggcctacccta

SEQ ID NO: 187708 - DNA, 25 bp, Mus musculus
aggacggcgtcagaggcctacccta

SEQ ID NO: 187709 - DNA, 25 bp, Mus musculus
aggacggcgtctattacctctactg

SEQ ID NO: 187710 - DNA, 25 bp, Mus musculus
aggacggcgtcttttacctctactg

SEQ ID NO: 187711 - DNA, 25 bp, Mus musculus
aggacggctgcaacactaaggagga

SEQ ID NO: 187712 - DNA, 25 bp, Mus musculus
aggacggctgcatcactaaggagga

SEQ ID NO: 187713 - DNA, 25 bp, Mus musculus
aggacggcttccatggttgtatgat

SEQ ID NO: 187714 - DNA, 25 bp, Mus musculus
aggacggcttccttggttgtatgat

SEQ ID NO: 187715 - DNA, 25 bp, Mus musculus
aggacgggcgggatcatcacactgc

SEQ ID NO: 187716 - DNA, 25 bp, Mus musculus
aggacgggcgggttcatcacactgc

SEQ ID NO: 187717 - DNA, 25 bp, Mus musculus
aggacgggtcgcactgcgcccactg

SEQ ID NO: 187718 - DNA, 25 bp, Mus musculus
aggacgggtcgctctgcgcccactg

SEQ ID NO: 187719 - DNA, 25 bp, Mus musculus
aggacggtaatccagagcacacctg

SEQ ID NO: 187720 - DNA, 25 bp, Mus musculus
aggacggtaatcgagagcacacctg

SEQ ID NO: 187721 - DNA, 25 bp, Mus musculus
aggacggtagctacgagcagcccaa

SEQ ID NO: 187722 - DNA, 25 bp, Mus musculus
aggacggtagcttcgagcagcccaa

SEQ ID NO: 187723 - DNA, 25 bp, Mus musculus
aggacggtcactcgtcagatgccat

SEQ ID NO: 187724 - DNA, 25 bp, Mus musculus
aggacggtcactggtcagatgccat

SEQ ID NO: 187725 - DNA, 25 bp, Mus musculus
aggacggtcattaacgagatacctc

SEQ ID NO: 187726 - DNA, 25 bp, Mus musculus
aggacggtcatttacgagatacctc

SEQ ID NO: 187727 - DNA, 25 bp, Mus musculus
aggacggtctcaacttttcctgcca

SEQ ID NO: 187728 - DNA, 25 bp, Mus musculus
aggacggtctcatcttttcctgcca

SEQ ID NO: 187729 - DNA, 25 bp, Mus musculus
aggacggtcttactgatggataact

SEQ ID NO: 187730 - DNA, 25 bp, Mus musculus
aggacggtcttagtgatggataact

SEQ ID NO: 187731 - DNA, 25 bp, Mus musculus
aggacggtgccaagagcattgccaa

SEQ ID NO: 187732 - DNA, 25 bp, Mus musculus
aggacggtgccatgagcattgccaa

SEQ ID NO: 187733 - DNA, 25 bp, Mus musculus
aggacgtaccacatccaagcggaag

SEQ ID NO: 187734 - DNA, 25 bp, Mus musculus
aggacgtaccacttccaagcggaag

SEQ ID NO: 187735 - DNA, 25 bp, Mus musculus
aggacgtagtatattcagctttgta

SEQ ID NO: 187736 - DNA, 25 bp, Mus musculus
aggacgtagtattttcagctttgta

SEQ ID NO: 187737 - DNA, 25 bp, Mus musculus
aggacgtcactgagaagttcacctg

SEQ ID NO: 187738 - DNA, 25 bp, Mus musculus
aggacgtcactgtgaagttcacctg

SEQ ID NO: 187739 - DNA, 25 bp, Mus musculus
aggacgtcattcagtctttgtggtt

SEQ ID NO: 187740 - DNA, 25 bp, Mus musculus
aggacgtcattctgtctttgtggtt

SEQ ID NO: 187741 - DNA, 25 bp, Mus musculus
aggacgtcctcgcactagccaagag

SEQ ID NO: 187742 - DNA, 25 bp, Mus musculus
aggacgtcctcggactagccaagag

SEQ ID NO: 187743 - DNA, 25 bp, Mus musculus
aggacgtctgtccatcttgaatgcc

SEQ ID NO: 187744 - DNA, 25 bp, Mus musculus
aggacgtctgtcgatcttgaatgcc

SEQ ID NO: 187745 - DNA, 25 bp, Mus musculus
aggacgtcttgaaggccgccaggct

SEQ ID NO: 187746 - DNA, 25 bp, Mus musculus
aggacgtcttgatggccgccaggct

SEQ ID NO: 187747 - DNA, 25 bp, Mus musculus
aggacgtgaagcagcaatggcccct

SEQ ID NO: 187748 - DNA, 25 bp, Mus musculus
aggacgtgaagctgcaatggcccct

SEQ ID NO: 187749 - DNA, 25 bp, Mus musculus
aggacgtgatgactcccctcaggga

SEQ ID NO: 187750 - DNA, 25 bp, Mus musculus
aggacgtgatgagtcccctcaggga

SEQ ID NO: 187751 - DNA, 25 bp, Mus musculus
aggacgtgccctcgaatttcaaagg

SEQ ID NO: 187752 - DNA, 25 bp, Mus musculus
aggacgtgccctggaatttcaaagg

SEQ ID NO: 187753 - DNA, 25 bp, Mus musculus
aggacgtgcctgagttgctgcgaca

SEQ ID NO: 187754 - DNA, 25 bp, Mus musculus
aggacgtgcctgtgttgctgcgaca

SEQ ID NO: 187755 - DNA, 25 bp, Mus musculus
aggacgtttgtactacactgctctt

SEQ ID NO: 187756 - DNA, 25 bp, Mus musculus
aggacgtttgtagtacactgctctt

SEQ ID NO: 187757 - DNA, 25 bp, Mus musculus
aggactaaaatcatccaagggacga

SEQ ID NO: 187758 - DNA, 25 bp, Mus musculus
aggactaaaatcttccaagggacga

SEQ ID NO: 187759 - DNA, 25 bp, Mus musculus
aggactaaaggtctcatctgcccag

SEQ ID NO: 187760 - DNA, 25 bp, Mus musculus
aggactaaaggtgtcatctgcccag

SEQ ID NO: 187761 - DNA, 25 bp, Mus musculus
aggactaaagtgctggactcctcag

SEQ ID NO: 187762 - DNA, 25 bp, Mus musculus
aggactaaagtggtggactcctcag

SEQ ID NO: 187763 - DNA, 25 bp, Mus musculus
aggactaacaacactggtcttaaca

SEQ ID NO: 187764 - DNA, 25 bp, Mus musculus
aggactaacaactctggtcttaaca

SEQ ID NO: 187765 - DNA, 25 bp, Mus musculus
aggactaacacgagcaaagtattta

SEQ ID NO: 187766 - DNA, 25 bp, Mus musculus
aggactaacacgtgcaaagtattta

SEQ ID NO: 187767 - DNA, 25 bp, Mus musculus
aggactaagcttccatgctgggttt

SEQ ID NO: 187768 - DNA, 25 bp, Mus musculus
aggactaagcttgcatgctgggttt

SEQ ID NO: 187769 - DNA, 25 bp, Mus musculus
aggactacaagactactaataccaa

SEQ ID NO: 187770 - DNA, 25 bp, Mus musculus
aggactacaagagtactaataccaa

SEQ ID NO: 187771 - DNA, 25 bp, Mus musculus
aggactacaccaatcatgatactgt

SEQ ID NO: 187772 - DNA, 25 bp, Mus musculus
aggactacaccattcatgatactgt

SEQ ID NO: 187773 - DNA, 25 bp, Mus musculus
aggactacacgcaggtggactacct

SEQ ID NO: 187774 - DNA, 25 bp, Mus musculus
aggactacacgctggtggactacct

SEQ ID NO: 187775 - DNA, 25 bp, Mus musculus
aggactacagtccagtagcttccac

SEQ ID NO: 187776 - DNA, 25 bp, Mus musculus
aggactacagtcgagtagcttccac

SEQ ID NO: 187777 - DNA, 25 bp, Mus musculus
aggactacagtgatctctacgttgt

SEQ ID NO: 187778 - DNA, 25 bp, Mus musculus
aggactacagtgttctctacgttgt

SEQ ID NO: 187779 - DNA, 25 bp, Mus musculus
aggactacatacatcaactgtgctg

SEQ ID NO: 187780 - DNA, 25 bp, Mus musculus
aggactacatacttcaactgtgctg

SEQ ID NO: 187781 - DNA, 25 bp, Mus musculus
aggactacatttcccaataacaagc

SEQ ID NO: 187782 - DNA, 25 bp, Mus musculus
aggactacatttgccaataacaagc

SEQ ID NO: 187783 - DNA, 25 bp, Mus musculus
aggactaccaatacgaactgacaaa

SEQ ID NO: 187784 - DNA, 25 bp, Mus musculus
aggactaccaattcgaactgacaaa

SEQ ID NO: 187785 - DNA, 25 bp, Mus musculus
aggactacctggaacagtcacacca

SEQ ID NO: 187786 - DNA, 25 bp, Mus musculus
aggactacctggagcagatattcca

SEQ ID NO: 187787 - DNA, 25 bp, Mus musculus
aggactacctggtacagtcacacca

SEQ ID NO: 187788 - DNA, 25 bp, Mus musculus
aggactacctggtgcagatattcca

SEQ ID NO: 187789 - DNA, 25 bp, Mus musculus
aggactacggcaaaggtgtcatctt

SEQ ID NO: 187790 - DNA, 25 bp, Mus musculus
aggactacggcataggtgtcatctt

SEQ ID NO: 187791 - DNA, 25 bp, Mus musculus
aggactactcctaactctagaacag

SEQ ID NO: 187792 - DNA, 25 bp, Mus musculus
aggactactccttactctagaacag

SEQ ID NO: 187793 - DNA, 25 bp, Mus musculus
aggactactcttatgctgttttatc

SEQ ID NO: 187794 - DNA, 25 bp, Mus musculus
aggactactcttttgctgttttatc

SEQ ID NO: 187795 - DNA, 25 bp, Mus musculus
aggactactgtacctcaaatactag

SEQ ID NO: 187796 - DNA, 25 bp, Mus musculus
aggactactgtagctcaaatactag

SEQ ID NO: 187797 - DNA, 25 bp, Mus musculus
aggactactgttcaagagtttttga

SEQ ID NO: 187798 - DNA, 25 bp, Mus musculus
aggactactgttgaagagtttttga

SEQ ID NO: 187799 - DNA, 25 bp, Mus musculus
aggactacttgaccgtggatctcgt

SEQ ID NO: 187800 - DNA, 25 bp, Mus musculus
aggactacttgagcgtggatctcgt

SEQ ID NO: 187801 - DNA, 25 bp, Mus musculus
aggactagatttactttcgcaggat

SEQ ID NO: 187802 - DNA, 25 bp, Mus musculus
aggactagattttctttcgcaggat

SEQ ID NO: 187803 - DNA, 25 bp, Mus musculus
aggactagccttatgtactctaaca

SEQ ID NO: 187804 - DNA, 25 bp, Mus musculus
aggactagccttttgtactctaaca

SEQ ID NO: 187805 - DNA, 25 bp, Mus musculus
aggactagctcgctcacactgtcag

SEQ ID NO: 187806 - DNA, 25 bp, Mus musculus
aggactagctcggtcacactgtcag

SEQ ID NO: 187807 - DNA, 25 bp, Mus musculus
aggactagtcaccaagtttcttagg

SEQ ID NO: 187808 - DNA, 25 bp, Mus musculus
aggactagtcacgaagtttcttagg

SEQ ID NO: 187809 - DNA, 25 bp, Mus musculus
aggactagtgctcccataactccct

SEQ ID NO: 187810 - DNA, 25 bp, Mus musculus
aggactagtgctgccataactccct

SEQ ID NO: 187811 - DNA, 25 bp, Mus musculus
aggactatcgtcctctgtgttagtt

SEQ ID NO: 187812 - DNA, 25 bp, Mus musculus
aggactatcgtcgtctgtgttagtt

SEQ ID NO: 187813 - DNA, 25 bp, Mus musculus
aggactatctcccaagaaagcccag

SEQ ID NO: 187814 - DNA, 25 bp, Mus musculus
aggactatctccgaagaaagcccag

SEQ ID NO: 187815 - DNA, 25 bp, Mus musculus
aggactatcttgctctctatccaga

SEQ ID NO: 187816 - DNA, 25 bp, Mus musculus
aggactatcttggtctctatccaga

SEQ ID NO: 187817 - DNA, 25 bp, Mus musculus
aggactatgagcacccgcggttgca

SEQ ID NO: 187818 - DNA, 25 bp, Mus musculus
aggactatgagcagggccgacagaa

SEQ ID NO: 187819 - DNA, 25 bp, Mus musculus
aggactatgagctcccgcggttgca

SEQ ID NO: 187820 - DNA, 25 bp, Mus musculus
aggactatgagctgggccgacagaa

SEQ ID NO: 187821 - DNA, 25 bp, Mus musculus
aggactatgcttcagattctaatga

SEQ ID NO: 187822 - DNA, 25 bp, Mus musculus
aggactatgcttgagattctaatga

SEQ ID NO: 187823 - DNA, 25 bp, Mus musculus
aggactatgtagcaagatcgtgtct

SEQ ID NO: 187824 - DNA, 25 bp, Mus musculus
aggactatgtaggaagatcgtgtct

SEQ ID NO: 187825 - DNA, 25 bp, Mus musculus
aggactatgtgtccccagtcttgga

SEQ ID NO: 187826 - DNA, 25 bp, Mus musculus
aggactatgtgtgcccagtcttgga

SEQ ID NO: 187827 - DNA, 25 bp, Mus musculus
aggactattgacctagctctttaac

SEQ ID NO: 187828 - DNA, 25 bp, Mus musculus
aggactattgacgtagctctttaac

SEQ ID NO: 187829 - DNA, 25 bp, Mus musculus
aggactattgttcatttatactcag

SEQ ID NO: 187830 - DNA, 25 bp, Mus musculus
aggactattgttgatttatactcag

SEQ ID NO: 187831 - DNA, 25 bp, Mus musculus
aggactatttacaagactgctgagc

SEQ ID NO: 187832 - DNA, 25 bp, Mus musculus
aggactatttactagactgctgagc

SEQ ID NO: 187833 - DNA, 25 bp, Mus musculus
aggactcaacccaagtcatttgtct

SEQ ID NO: 187834 - DNA, 25 bp, Mus musculus
aggactcaaccctagtcatttgtct

SEQ ID NO: 187835 - DNA, 25 bp, Mus musculus
aggactcaactgagctttgctctgt

SEQ ID NO: 187836 - DNA, 25 bp, Mus musculus
aggactcaactgtgctttgctctgt

SEQ ID NO: 187837 - DNA, 25 bp, Mus musculus
aggactcaagatacactccgctcta

SEQ ID NO: 187838 - DNA, 25 bp, Mus musculus
aggactcaagattcactccgctcta

SEQ ID NO: 187839 - DNA, 25 bp, Mus musculus
aggactcacagcagaccctttcagt

SEQ ID NO: 187840 - DNA, 25 bp, Mus musculus
aggactcacagctgaccctttcagt

SEQ ID NO: 187841 - DNA, 25 bp, Mus musculus
aggactcaccagaatgctttgaccc

SEQ ID NO: 187842 - DNA, 25 bp, Mus musculus
aggactcaccagtatgctttgaccc

SEQ ID NO: 187843 - DNA, 25 bp, Mus musculus
aggactcacccaatcttatttattt

SEQ ID NO: 187844 - DNA, 25 bp, Mus musculus
aggactcacccattcttatttattt

SEQ ID NO: 187845 - DNA, 25 bp, Mus musculus
aggactcaccccactgtgagaggta

SEQ ID NO: 187846 - DNA, 25 bp, Mus musculus
aggactcacccctctgtgagaggta

SEQ ID NO: 187847 - DNA, 25 bp, Mus musculus
aggactcacggccacgaagtggcat

SEQ ID NO: 187848 - DNA, 25 bp, Mus musculus
aggactcacggcgacgaagtggcat

SEQ ID NO: 187849 - DNA, 25 bp, Mus musculus
aggactcactctaggcatctggtag

SEQ ID NO: 187850 - DNA, 25 bp, Mus musculus
aggactcactcttggcatctggtag

SEQ ID NO: 187851 - DNA, 25 bp, Mus musculus
aggactcactgcagtctagatttga

SEQ ID NO: 187852 - DNA, 25 bp, Mus musculus
aggactcactgctgtctagatttga

SEQ ID NO: 187853 - DNA, 25 bp, Mus musculus
aggactcagaacaaggctctcccag

SEQ ID NO: 187854 - DNA, 25 bp, Mus musculus
aggactcagaactaggctctcccag

SEQ ID NO: 187855 - DNA, 25 bp, Mus musculus
aggactcagcaacaggtcttcactg

SEQ ID NO: 187856 - DNA, 25 bp, Mus musculus
aggactcagcaagaggtcttcactg

SEQ ID NO: 187857 - DNA, 25 bp, Mus musculus
aggactcagcataggttccatggac

SEQ ID NO: 187858 - DNA, 25 bp, Mus musculus
aggactcagcattggttccatggac

SEQ ID NO: 187859 - DNA, 25 bp, Mus musculus
aggactcagcccagggaccatttgt

SEQ ID NO: 187860 - DNA, 25 bp, Mus musculus
aggactcagccctgggaccatttgt

SEQ ID NO: 187861 - DNA, 25 bp, Mus musculus
aggactcagctcagaccagtgatac

SEQ ID NO: 187862 - DNA, 25 bp, Mus musculus
aggactcagctctgaccagtgatac

SEQ ID NO: 187863 - DNA, 25 bp, Mus musculus
aggactcaggtccttgccagttgca

SEQ ID NO: 187864 - DNA, 25 bp, Mus musculus
aggactcaggtcgttgccagttgca

SEQ ID NO: 187865 - DNA, 25 bp, Mus musculus
aggactcataacacgtagggcccag

SEQ ID NO: 187866 - DNA, 25 bp, Mus musculus
aggactcataactcgtagggcccag

SEQ ID NO: 187867 - DNA, 25 bp, Mus musculus
aggactcatcaacggcaggcccatt

SEQ ID NO: 187868 - DNA, 25 bp, Mus musculus
aggactcatcaagggcaggcccatt

SEQ ID NO: 187869 - DNA, 25 bp, Mus musculus
aggactcatcccagatgcagatgca

SEQ ID NO: 187870 - DNA, 25 bp, Mus musculus
aggactcatccctgatgcagatgca

SEQ ID NO: 187871 - DNA, 25 bp, Mus musculus
aggactcatctgcaaatataccaat

SEQ ID NO: 187872 - DNA, 25 bp, Mus musculus
aggactcatctggaaatataccaat

SEQ ID NO: 187873 - DNA, 25 bp, Mus musculus
aggactcatggcctactgcagagat

SEQ ID NO: 187874 - DNA, 25 bp, Mus musculus
aggactcatggcgtactgcagagat

SEQ ID NO: 187875 - DNA, 25 bp, Mus musculus
aggactcatggtagactggtcgctt

SEQ ID NO: 187876 - DNA, 25 bp, Mus musculus
aggactcatggtcctcagtgcctgc

SEQ ID NO: 187877 - DNA, 25 bp, Mus musculus
aggactcatggtgctcagtgcctgc

SEQ ID NO: 187878 - DNA, 25 bp, Mus musculus
aggactcatggttgactggtcgctt

SEQ ID NO: 187879 - DNA, 25 bp, Mus musculus
aggactcattccctagtgatcggct

SEQ ID NO: 187880 - DNA, 25 bp, Mus musculus
aggactcattccgtagtgatcggct

SEQ ID NO: 187881 - DNA, 25 bp, Mus musculus
aggactccactgacttgcagaatac

SEQ ID NO: 187882 - DNA, 25 bp, Mus musculus
aggactccactgtcttgcagaatac

SEQ ID NO: 187883 - DNA, 25 bp, Mus musculus
aggactccagagaaagaggccatga

SEQ ID NO: 187884 - DNA, 25 bp, Mus musculus
aggactccagagtaagaggccatga

SEQ ID NO: 187885 - DNA, 25 bp, Mus musculus
aggactccagcacctgacttcggca

SEQ ID NO: 187886 - DNA, 25 bp, Mus musculus
aggactccagcagctgacttcggca

SEQ ID NO: 187887 - DNA, 25 bp, Mus musculus
aggactccagtgagggccatccaga

SEQ ID NO: 187888 - DNA, 25 bp, Mus musculus
aggactccagtgtgggccatccaga

SEQ ID NO: 187889 - DNA, 25 bp, Mus musculus
aggactccatttacaacttcagggt

SEQ ID NO: 187890 - DNA, 25 bp, Mus musculus
aggactccattttcaacttcagggt

SEQ ID NO: 187891 - DNA, 25 bp, Mus musculus
aggactcccactagcaagatgttgg

SEQ ID NO: 187892 - DNA, 25 bp, Mus musculus
aggactcccacttgcaagatgttgg

SEQ ID NO: 187893 - DNA, 25 bp, Mus musculus
aggactcccggtcctgggctgctaa

SEQ ID NO: 187894 - DNA, 25 bp, Mus musculus
aggactcccggtgctgggctgctaa

SEQ ID NO: 187895 - DNA, 25 bp, Mus musculus
aggactccctgcatgatggtgtgca

SEQ ID NO: 187896 - DNA, 25 bp, Mus musculus
aggactccctgcttgatggtgtgca

SEQ ID NO: 187897 - DNA, 25 bp, Mus musculus
aggactccgcagaacaagctgtcat

SEQ ID NO: 187898 - DNA, 25 bp, Mus musculus
aggactccgcagtacaagctgtcat

SEQ ID NO: 187899 - DNA, 25 bp, Mus musculus
aggactccgtctaaaactagcattt

SEQ ID NO: 187900 - DNA, 25 bp, Mus musculus
aggactccgtcttaaactagcattt

SEQ ID NO: 187901 - DNA, 25 bp, Mus musculus
aggactccgtgcctctctgaggaga

SEQ ID NO: 187902 - DNA, 25 bp, Mus musculus
aggactccgtgcgtctctgaggaga

SEQ ID NO: 187903 - DNA, 25 bp, Mus musculus
aggactcctctgagctgatgaactt

SEQ ID NO: 187904 - DNA, 25 bp, Mus musculus
aggactcctctgtgctgatgaactt

SEQ ID NO: 187905 - DNA, 25 bp, Mus musculus
aggactcctgccataaaggattgag

SEQ ID NO: 187906 - DNA, 25 bp, Mus musculus
aggactcctgccctgaggccacatg

SEQ ID NO: 187907 - DNA, 25 bp, Mus musculus
aggactcctgccgtgaggccacatg

SEQ ID NO: 187908 - DNA, 25 bp, Mus musculus
aggactcctgccttaaaggattgag

SEQ ID NO: 187909 - DNA, 25 bp, Mus musculus
aggactcgaataccgatactctcaa

SEQ ID NO: 187910 - DNA, 25 bp, Mus musculus
aggactcgaatagcgatactctcaa

SEQ ID NO: 187911 - DNA, 25 bp, Mus musculus
aggactcgagaaaagcttaatatag

SEQ ID NO: 187912 - DNA, 25 bp, Mus musculus
aggactcgagaatagcttaatatag

SEQ ID NO: 187913 - DNA, 25 bp, Mus musculus
aggactcgagccacctttggttgag

SEQ ID NO: 187914 - DNA, 25 bp, Mus musculus
aggactcgagcctcctttggttgag

SEQ ID NO: 187915 - DNA, 25 bp, Mus musculus
aggactcgaggcaggaccgacatct

SEQ ID NO: 187916 - DNA, 25 bp, Mus musculus
aggactcgaggctggaccgacatct

SEQ ID NO: 187917 - DNA, 25 bp, Mus musculus
aggactcgcaccaggtacttacaga

SEQ ID NO: 187918 - DNA, 25 bp, Mus musculus
aggactcgcacctggtacttacaga

SEQ ID NO: 187919 - DNA, 25 bp, Mus musculus
aggactcgccagactgatgccagga

SEQ ID NO: 187920 - DNA, 25 bp, Mus musculus
aggactcgccagtctgatgccagga

SEQ ID NO: 187921 - DNA, 25 bp, Mus musculus
aggactcgctgcatttctcaagcaa

SEQ ID NO: 187922 - DNA, 25 bp, Mus musculus
aggactcgctgcttttctcaagcaa

SEQ ID NO: 187923 - DNA, 25 bp, Mus musculus
aggactcgcttaacaatcttcagaa

SEQ ID NO: 187924 - DNA, 25 bp, Mus musculus
aggactcgcttatcaatcttcagaa

SEQ ID NO: 187925 - DNA, 25 bp, Mus musculus
aggactcggctcctcgagttgttca

SEQ ID NO: 187926 - DNA, 25 bp, Mus musculus
aggactcggctcgtcgagttgttca

SEQ ID NO: 187927 - DNA, 25 bp, Mus musculus
aggactcgtcagcaagctggataac

SEQ ID NO: 187928 - DNA, 25 bp, Mus musculus
aggactcgtcaggaagctggataac

SEQ ID NO: 187929 - DNA, 25 bp, Mus musculus
aggactcgtgctatccacagtgagc

SEQ ID NO: 187930 - DNA, 25 bp, Mus musculus
aggactcgtgctttccacagtgagc

SEQ ID NO: 187931 - DNA, 25 bp, Mus musculus
aggactcgtgtgattatcttaaaat

SEQ ID NO: 187932 - DNA, 25 bp, Mus musculus
aggactcgtgtgtttatcttaaaat

SEQ ID NO: 187933 - DNA, 25 bp, Mus musculus
aggactctaacaccagctgtaccat

SEQ ID NO: 187934 - DNA, 25 bp, Mus musculus
aggactctaacagcagctgtaccat

SEQ ID NO: 187935 - DNA, 25 bp, Mus musculus
aggactctataaccagtggaagtat

SEQ ID NO: 187936 - DNA, 25 bp, Mus musculus
aggactctataactccaggtcaggg

SEQ ID NO: 187937 - DNA, 25 bp, Mus musculus
aggactctataagcagtggaagtat

SEQ ID NO: 187938 - DNA, 25 bp, Mus musculus
aggactctataagtccaggtcaggg

SEQ ID NO: 187939 - DNA, 25 bp, Mus musculus
aggactctcacaagcaactgtggct

SEQ ID NO: 187940 - DNA, 25 bp, Mus musculus
aggactctcacatgcaactgtggct

SEQ ID NO: 187941 - DNA, 25 bp, Mus musculus
aggactctcagcagtgccagtgctg

SEQ ID NO: 187942 - DNA, 25 bp, Mus musculus
aggactctcagctgtgccagtgctg

SEQ ID NO: 187943 - DNA, 25 bp, Mus musculus
aggactctccccatgttgggagttc

SEQ ID NO: 187944 - DNA, 25 bp, Mus musculus
aggactctccccttgttgggagttc

SEQ ID NO: 187945 - DNA, 25 bp, Mus musculus
aggactctgaaacgctgagctgctt

SEQ ID NO: 187946 - DNA, 25 bp, Mus musculus
aggactctgaaaggctgagctgctt

SEQ ID NO: 187947 - DNA, 25 bp, Mus musculus
aggactctgaagagccagtggccct

SEQ ID NO: 187948 - DNA, 25 bp, Mus musculus
aggactctgaagtgccagtggccct

SEQ ID NO: 187949 - DNA, 25 bp, Mus musculus
aggactctgactaccgcctgagcaa

SEQ ID NO: 187950 - DNA, 25 bp, Mus musculus
aggactctgacttccgcctgagcaa

SEQ ID NO: 187951 - DNA, 25 bp, Mus musculus
aggactctgcacattctgagcagct

SEQ ID NO: 187952 - DNA, 25 bp, Mus musculus
aggactctgcactttctgagcagct

SEQ ID NO: 187953 - DNA, 25 bp, Mus musculus
aggactctgccaagtgtgcctggtc

SEQ ID NO: 187954 - DNA, 25 bp, Mus musculus
aggactctgccatgtgtgcctggtc

SEQ ID NO: 187955 - DNA, 25 bp, Mus musculus
aggactctgcttctggaacagctat

SEQ ID NO: 187956 - DNA, 25 bp, Mus musculus
aggactctgcttgtggaacagctat

SEQ ID NO: 187957 - DNA, 25 bp, Mus musculus
aggactctgggcaccctagtcttgc

SEQ ID NO: 187958 - DNA, 25 bp, Mus musculus
aggactctgggctccctagtcttgc

SEQ ID NO: 187959 - DNA, 25 bp, Mus musculus
aggactctgtagctgactggcagat

SEQ ID NO: 187960 - DNA, 25 bp, Mus musculus
aggactctgtaggtgactggcagat

SEQ ID NO: 187961 - DNA, 25 bp, Mus musculus
aggactctgtgcacctgttgtgtgt

SEQ ID NO: 187962 - DNA, 25 bp, Mus musculus
aggactctgtgctcctgttgtgtgt

SEQ ID NO: 187963 - DNA, 25 bp, Mus musculus
aggactctgtggctgtaccacgtcg

SEQ ID NO: 187964 - DNA, 25 bp, Mus musculus
aggactctgtgggtgtaccacgtcg

SEQ ID NO: 187965 - DNA, 25 bp, Mus musculus
aggactctgtttccatggcttcttc

SEQ ID NO: 187966 - DNA, 25 bp, Mus musculus
aggactctgtttgcatggcttcttc

SEQ ID NO: 187967 - DNA, 25 bp, Mus musculus
aggactcttaaaaccttcaggagat

SEQ ID NO: 187968 - DNA, 25 bp, Mus musculus
aggactcttaaatccttcaggagat

SEQ ID NO: 187969 - DNA, 25 bp, Mus musculus
aggactcttaagagcgctgtgcctg

SEQ ID NO: 187970 - DNA, 25 bp, Mus musculus
aggactcttaagtgcgctgtgcctg

SEQ ID NO: 187971 - DNA, 25 bp, Mus musculus
aggactcttactaggcagtcaccag

SEQ ID NO: 187972 - DNA, 25 bp, Mus musculus
aggactcttacttggcagtcaccag

SEQ ID NO: 187973 - DNA, 25 bp, Mus musculus
aggactcttcacaggtagcttagca

SEQ ID NO: 187974 - DNA, 25 bp, Mus musculus
aggactcttcactggtagcttagca

SEQ ID NO: 187975 - DNA, 25 bp, Mus musculus
aggactcttgcaaaaggcttctgga

SEQ ID NO: 187976 - DNA, 25 bp, Mus musculus
aggactcttgcacggttttgtaagc

SEQ ID NO: 187977 - DNA, 25 bp, Mus musculus
aggactcttgcagggttttgtaagc

SEQ ID NO: 187978 - DNA, 25 bp, Mus musculus
aggactcttgcataaggcttctgga

SEQ ID NO: 187979 - DNA, 25 bp, Mus musculus
aggactcttgtgaagacccagtgtc

SEQ ID NO: 187980 - DNA, 25 bp, Mus musculus
aggactcttgtgtagacccagtgtc

SEQ ID NO: 187981 - DNA, 25 bp, Mus musculus
aggactcttgttcctcaaggctttt

SEQ ID NO: 187982 - DNA, 25 bp, Mus musculus
aggactcttgttgctcaaggctttt

SEQ ID NO: 187983 - DNA, 25 bp, Mus musculus
aggactctttagctaagaccattta

SEQ ID NO: 187984 - DNA, 25 bp, Mus musculus
aggactctttaggtaagaccattta

SEQ ID NO: 187985 - DNA, 25 bp, Mus musculus
aggactctttgtcctgcagacccct

SEQ ID NO: 187986 - DNA, 25 bp, Mus musculus
aggactctttgtgctgcagacccct

SEQ ID NO: 187987 - DNA, 25 bp, Mus musculus
aggactgaaagtcccagcctatccc

SEQ ID NO: 187988 - DNA, 25 bp, Mus musculus
aggactgaaagtgccagcctatccc

SEQ ID NO: 187989 - DNA, 25 bp, Mus musculus
aggactgaacccaaagccctttgca

SEQ ID NO: 187990 - DNA, 25 bp, Mus musculus
aggactgaaccctaagccctttgca

SEQ ID NO: 187991 - DNA, 25 bp, Mus musculus
aggactgaagctaactttctgccca

SEQ ID NO: 187992 - DNA, 25 bp, Mus musculus
aggactgaagcttactttctgccca

SEQ ID NO: 187993 - DNA, 25 bp, Mus musculus
aggactgaatccacgcgctgggact

SEQ ID NO: 187994 - DNA, 25 bp, Mus musculus
aggactgaatcctcgcgctgggact

SEQ ID NO: 187995 - DNA, 25 bp, Mus musculus
aggactgaccacacagacacgggaa

SEQ ID NO: 187996 - DNA, 25 bp, Mus musculus
aggactgaccactcagacacgggaa

SEQ ID NO: 187997 - DNA, 25 bp, Mus musculus
aggactgaccctctaaagatcgaga

SEQ ID NO: 187998 - DNA, 25 bp, Mus musculus
aggactgaccctgtaaagatcgaga

SEQ ID NO: 187999 - DNA, 25 bp, Mus musculus
aggactgaccgtcttacctgcgtgg

SEQ ID NO: 188000 - DNA, 25 bp, Mus musculus
aggactgaccgtgttacctgcgtgg

SEQ ID NO: 188001 - DNA, 25 bp, Mus musculus
aggactgacgggaaatgctcttctc

SEQ ID NO: 188002 - DNA, 25 bp, Mus musculus
aggactgacgggtaatgctcttctc

SEQ ID NO: 188003 - DNA, 25 bp, Mus musculus
aggactgactccatctgaacttgaa

SEQ ID NO: 188004 - DNA, 25 bp, Mus musculus
aggactgactccttctgaacttgaa

SEQ ID NO: 188005 - DNA, 25 bp, Mus musculus
aggactgactgcaggcacccaagat

SEQ ID NO: 188006 - DNA, 25 bp, Mus musculus
aggactgactgctggcacccaagat

SEQ ID NO: 188007 - DNA, 25 bp, Mus musculus
aggactgacttgaatcctgcaccag

SEQ ID NO: 188008 - DNA, 25 bp, Mus musculus
aggactgacttgtatcctgcaccag

SEQ ID NO: 188009 - DNA, 25 bp, Mus musculus
aggactgactttactactcgtgcat

SEQ ID NO: 188010 - DNA, 25 bp, Mus musculus
aggactgacttttctactcgtgcat

SEQ ID NO: 188011 - DNA, 25 bp, Mus musculus
aggactgagcagattgagtgaccgt

SEQ ID NO: 188012 - DNA, 25 bp, Mus musculus
aggactgagcagtttgagtgaccgt

SEQ ID NO: 188013 - DNA, 25 bp, Mus musculus
aggactgagctcagccctgtaaagc

SEQ ID NO: 188014 - DNA, 25 bp, Mus musculus
aggactgagctctgccctgtaaagc

SEQ ID NO: 188015 - DNA, 25 bp, Mus musculus
aggactgagggcatcctgccaagaa

SEQ ID NO: 188016 - DNA, 25 bp, Mus musculus
aggactgagggcttcctgccaagaa

SEQ ID NO: 188017 - DNA, 25 bp, Mus musculus
aggactgatagacgacttccctgtg

SEQ ID NO: 188018 - DNA, 25 bp, Mus musculus
aggactgatagaggacttccctgtg

SEQ ID NO: 188019 - DNA, 25 bp, Mus musculus
aggactgatgcaatctttgcggaat

SEQ ID NO: 188020 - DNA, 25 bp, Mus musculus
aggactgatgcattctttgcggaat

SEQ ID NO: 188021 - DNA, 25 bp, Mus musculus
aggactgatggaaccttccataccg

SEQ ID NO: 188022 - DNA, 25 bp, Mus musculus
aggactgatggatccttccataccg

SEQ ID NO: 188023 - DNA, 25 bp, Mus musculus
aggactgatggccttcctgttccca

SEQ ID NO: 188024 - DNA, 25 bp, Mus musculus
aggactgatggcgttcctgttccca

SEQ ID NO: 188025 - DNA, 25 bp, Mus musculus
aggactgatgtcagcacactcgcag

SEQ ID NO: 188026 - DNA, 25 bp, Mus musculus
aggactgatgtctgcacactcgcag

SEQ ID NO: 188027 - DNA, 25 bp, Mus musculus
aggactgcaaagactggcttcatgt

SEQ ID NO: 188028 - DNA, 25 bp, Mus musculus
aggactgcaaagtctggcttcatgt

SEQ ID NO: 188029 - DNA, 25 bp, Mus musculus
aggactgcagcaaccctttcgaggg

SEQ ID NO: 188030 - DNA, 25 bp, Mus musculus
aggactgcagcacatccaagggcat

SEQ ID NO: 188031 - DNA, 25 bp, Mus musculus
aggactgcagcagatccaagggcat

SEQ ID NO: 188032 - DNA, 25 bp, Mus musculus
aggactgcagcatccctttcgaggg

SEQ ID NO: 188033 - DNA, 25 bp, Mus musculus
aggactgcagccatgaccaggaaaa

SEQ ID NO: 188034 - DNA, 25 bp, Mus musculus
aggactgcagccttgaccaggaaaa

SEQ ID NO: 188035 - DNA, 25 bp, Mus musculus
aggactgcagggatatgttgagtaa

SEQ ID NO: 188036 - DNA, 25 bp, Mus musculus
aggactgcagggttatgttgagtaa

SEQ ID NO: 188037 - DNA, 25 bp, Mus musculus
aggactgcatccaaattccaaatac

SEQ ID NO: 188038 - DNA, 25 bp, Mus musculus
aggactgcatcctaattccaaatac

SEQ ID NO: 188039 - DNA, 25 bp, Mus musculus
aggactgcatgcctcttgtcttagc

SEQ ID NO: 188040 - DNA, 25 bp, Mus musculus
aggactgcatgcgtcttgtcttagc

SEQ ID NO: 188041 - DNA, 25 bp, Mus musculus
aggactgccaatcagggcctagttt

SEQ ID NO: 188042 - DNA, 25 bp, Mus musculus
aggactgccaatgagggcctagttt

SEQ ID NO: 188043 - DNA, 25 bp, Mus musculus
aggactgccctcatgagcaggacca

SEQ ID NO: 188044 - DNA, 25 bp, Mus musculus
aggactgccctcttgagcaggacca

SEQ ID NO: 188045 - DNA, 25 bp, Mus musculus
aggactgcccttcacacagtaggta

SEQ ID NO: 188046 - DNA, 25 bp, Mus musculus
aggactgcccttgacacagtaggta

SEQ ID NO: 188047 - DNA, 25 bp, Mus musculus
aggactgcctgcattgtttctgttt

SEQ ID NO: 188048 - DNA, 25 bp, Mus musculus
aggactgcctgctttgtttctgttt

SEQ ID NO: 188049 - DNA, 25 bp, Mus musculus
aggactgcgagcagcccaggctcca

SEQ ID NO: 188050 - DNA, 25 bp, Mus musculus
aggactgcgagctgcccaggctcca

SEQ ID NO: 188051 - DNA, 25 bp, Mus musculus
aggactgcgtgtcgtggccatccaa

SEQ ID NO: 188052 - DNA, 25 bp, Mus musculus
aggactgcgtgtggtggccatccaa

SEQ ID NO: 188053 - DNA, 25 bp, Mus musculus
aggactgcgttaaagtttgcaagac

SEQ ID NO: 188054 - DNA, 25 bp, Mus musculus
aggactgcgttatagtttgcaagac

SEQ ID NO: 188055 - DNA, 25 bp, Mus musculus
aggactgcgttcacatgagaccctt

SEQ ID NO: 188056 - DNA, 25 bp, Mus musculus
aggactgcgttctcatgagaccctt

SEQ ID NO: 188057 - DNA, 25 bp, Mus musculus
aggactgctattaaagccctcgctg

SEQ ID NO: 188058 - DNA, 25 bp, Mus musculus
aggactgctatttaagccctcgctg

SEQ ID NO: 188059 - DNA, 25 bp, Mus musculus
aggactgctcaaagggaccccgctg

SEQ ID NO: 188060 - DNA, 25 bp, Mus musculus
aggactgctcaatgggaccccgctg

SEQ ID NO: 188061 - DNA, 25 bp, Mus musculus
aggactgctcagcaatgccccgtgc

SEQ ID NO: 188062 - DNA, 25 bp, Mus musculus
aggactgctcaggaatgccccgtgc

SEQ ID NO: 188063 - DNA, 25 bp, Mus musculus
aggactgctgctatctatacctcct

SEQ ID NO: 188064 - DNA, 25 bp, Mus musculus
aggactgctgctttctatacctcct

SEQ ID NO: 188065 - DNA, 25 bp, Mus musculus
aggactgctggacaccacagtacaa

SEQ ID NO: 188066 - DNA, 25 bp, Mus musculus
aggactgctggagaccacagtacaa

SEQ ID NO: 188067 - DNA, 25 bp, Mus musculus
aggactgctgggacagatctgtgcc

SEQ ID NO: 188068 - DNA, 25 bp, Mus musculus
aggactgctgggtcagatctgtgcc

SEQ ID NO: 188069 - DNA, 25 bp, Mus musculus
aggactgcttacatcatactgctga

SEQ ID NO: 188070 - DNA, 25 bp, Mus musculus
aggactgcttacttcatactgctga

SEQ ID NO: 188071 - DNA, 25 bp, Mus musculus
aggactgcttagctcacttgttagc

SEQ ID NO: 188072 - DNA, 25 bp, Mus musculus
aggactgcttaggtcacttgttagc

SEQ ID NO: 188073 - DNA, 25 bp, Mus musculus
aggactgctttaacagaatttatat

SEQ ID NO: 188074 - DNA, 25 bp, Mus musculus
aggactgctttatcagaatttatat

SEQ ID NO: 188075 - DNA, 25 bp, Mus musculus
aggactgctttcagtggttctcaaa

SEQ ID NO: 188076 - DNA, 25 bp, Mus musculus
aggactgctttcctggctgaggact

SEQ ID NO: 188077 - DNA, 25 bp, Mus musculus
aggactgctttcgtggctgaggact

SEQ ID NO: 188078 - DNA, 25 bp, Mus musculus
aggactgctttctgtggttctcaaa

SEQ ID NO: 188079 - DNA, 25 bp, Mus musculus
aggactgcttttaccatcctgtggg

SEQ ID NO: 188080 - DNA, 25 bp, Mus musculus
aggactgctttttccatcctgtggg

SEQ ID NO: 188081 - DNA, 25 bp, Mus musculus
aggactggaagtatgcgttcccatc

SEQ ID NO: 188082 - DNA, 25 bp, Mus musculus
aggactggaagtttgcgttcccatc

SEQ ID NO: 188083 - DNA, 25 bp, Mus musculus
aggactggacatagagagtgtgcca

SEQ ID NO: 188084 - DNA, 25 bp, Mus musculus
aggactggacattgagagtgtgcca

SEQ ID NO: 188085 - DNA, 25 bp, Mus musculus
aggactggacccatcttgctcagtg

SEQ ID NO: 188086 - DNA, 25 bp, Mus musculus
aggactggacccttcttgctcagtg

SEQ ID NO: 188087 - DNA, 25 bp, Mus musculus
aggactggacttagcctccctaggt

SEQ ID NO: 188088 - DNA, 25 bp, Mus musculus
aggactggactttgcctccctaggt

SEQ ID NO: 188089 - DNA, 25 bp, Mus musculus
aggactggagcacaggtgccactca

SEQ ID NO: 188090 - DNA, 25 bp, Mus musculus
aggactggagcagaggtgccactca

SEQ ID NO: 188091 - DNA, 25 bp, Mus musculus
aggactggagtgaacagagctcaac

SEQ ID NO: 188092 - DNA, 25 bp, Mus musculus
aggactggagtgtacagagctcaac

SEQ ID NO: 188093 - DNA, 25 bp, Mus musculus
aggactggattgcagccggcttccc

SEQ ID NO: 188094 - DNA, 25 bp, Mus musculus
aggactggattggagccggcttccc

SEQ ID NO: 188095 - DNA, 25 bp, Mus musculus
aggactggcaaccacactgtgaaat

SEQ ID NO: 188096 - DNA, 25 bp, Mus musculus
aggactggcaacgacactgtgaaat

SEQ ID NO: 188097 - DNA, 25 bp, Mus musculus
aggactggcaggaaagtcacctctg

SEQ ID NO: 188098 - DNA, 25 bp, Mus musculus
aggactggcaggtaagtcacctctg

SEQ ID NO: 188099 - DNA, 25 bp, Mus musculus
aggactggcatgaactcgcactagc

SEQ ID NO: 188100 - DNA, 25 bp, Mus musculus
aggactggcatgtactcgcactagc

SEQ ID NO: 188101 - DNA, 25 bp, Mus musculus
aggactggccacattaggagcgact

SEQ ID NO: 188102 - DNA, 25 bp, Mus musculus
aggactggccactttaggagcgact

SEQ ID NO: 188103 - DNA, 25 bp, Mus musculus
aggactggccatacaaggtcactgt

SEQ ID NO: 188104 - DNA, 25 bp, Mus musculus
aggactggccattcaaggtcactgt

SEQ ID NO: 188105 - DNA, 25 bp, Mus musculus
aggactggccctaggtaagcatgga

SEQ ID NO: 188106 - DNA, 25 bp, Mus musculus
aggactggcccttggtaagcatgga

SEQ ID NO: 188107 - DNA, 25 bp, Mus musculus
aggactggccgcagcagagctgtta

SEQ ID NO: 188108 - DNA, 25 bp, Mus musculus
aggactggccgctgcagagctgtta

SEQ ID NO: 188109 - DNA, 25 bp, Mus musculus
aggactggcctgctacgttttcatc

SEQ ID NO: 188110 - DNA, 25 bp, Mus musculus
aggactggcctggtacgttttcatc

SEQ ID NO: 188111 - DNA, 25 bp, Mus musculus
aggactggctacatggactcccgga

SEQ ID NO: 188112 - DNA, 25 bp, Mus musculus
aggactggctacttggactcccgga

SEQ ID NO: 188113 - DNA, 25 bp, Mus musculus
aggactggctgcctaagaacccaca

SEQ ID NO: 188114 - DNA, 25 bp, Mus musculus
aggactggctgcgtaagaacccaca

SEQ ID NO: 188115 - DNA, 25 bp, Mus musculus
aggactgggaatcgcttttgtgaat

SEQ ID NO: 188116 - DNA, 25 bp, Mus musculus
aggactgggaatggcttttgtgaat

SEQ ID NO: 188117 - DNA, 25 bp, Mus musculus
aggactgggaccatgttctctagag

SEQ ID NO: 188118 - DNA, 25 bp, Mus musculus
aggactgggaccttgttctctagag

SEQ ID NO: 188119 - DNA, 25 bp, Mus musculus
aggactgggactatgaggcctttgt

SEQ ID NO: 188120 - DNA, 25 bp, Mus musculus
aggactgggactttgaggcctttgt

SEQ ID NO: 188121 - DNA, 25 bp, Mus musculus
aggactgggcacactcatatgccgt

SEQ ID NO: 188122 - DNA, 25 bp, Mus musculus
aggactgggcactctcatatgccgt

SEQ ID NO: 188123 - DNA, 25 bp, Mus musculus
aggactgggccacatgaccaccaac

SEQ ID NO: 188124 - DNA, 25 bp, Mus musculus
aggactgggccagatgaccaccaac

SEQ ID NO: 188125 - DNA, 25 bp, Mus musculus
aggactgggctgacatcaaggagaa

SEQ ID NO: 188126 - DNA, 25 bp, Mus musculus
aggactgggctgtcatcaaggagaa

SEQ ID NO: 188127 - DNA, 25 bp, Mus musculus
aggactgggttcacagcaggcattc

SEQ ID NO: 188128 - DNA, 25 bp, Mus musculus
aggactgggttctcagcaggcattc

SEQ ID NO: 188129 - DNA, 25 bp, Mus musculus
aggactggtcgcagtgttcagccct

SEQ ID NO: 188130 - DNA, 25 bp, Mus musculus
aggactggtcgctgtgttcagccct

SEQ ID NO: 188131 - DNA, 25 bp, Mus musculus
aggactggttttcggttctgtacat

SEQ ID NO: 188132 - DNA, 25 bp, Mus musculus
aggactggttttgggttctgtacat

SEQ ID NO: 188133 - DNA, 25 bp, Mus musculus
aggactgtactaaggctctctcgtg

SEQ ID NO: 188134 - DNA, 25 bp, Mus musculus
aggactgtactatggctctctcgtg

SEQ ID NO: 188135 - DNA, 25 bp, Mus musculus
aggactgtatacaggcccaagccgt

SEQ ID NO: 188136 - DNA, 25 bp, Mus musculus
aggactgtatactggcccaagccgt

SEQ ID NO: 188137 - DNA, 25 bp, Mus musculus
aggactgtcacactttgttctgata

SEQ ID NO: 188138 - DNA, 25 bp, Mus musculus
aggactgtcacagtttgttctgata

SEQ ID NO: 188139 - DNA, 25 bp, Mus musculus
aggactgtcagtcatgactcgccct

SEQ ID NO: 188140 - DNA, 25 bp, Mus musculus
aggactgtcagtgatgactcgccct

SEQ ID NO: 188141 - DNA, 25 bp, Mus musculus
aggactgtctctacactattgccag

SEQ ID NO: 188142 - DNA, 25 bp, Mus musculus
aggactgtctcttcactattgccag

SEQ ID NO: 188143 - DNA, 25 bp, Mus musculus
aggactgtctgtaggcacccactgg

SEQ ID NO: 188144 - DNA, 25 bp, Mus musculus
aggactgtctgtccccgctgtcgcg

SEQ ID NO: 188145 - DNA, 25 bp, Mus musculus
aggactgtctgtgcccgctgtcgcg

SEQ ID NO: 188146 - DNA, 25 bp, Mus musculus
aggactgtctgttggcacccactgg

SEQ ID NO: 188147 - DNA, 25 bp, Mus musculus
aggactgtgaaactctctgttcaaa

SEQ ID NO: 188148 - DNA, 25 bp, Mus musculus
aggactgtgaaagtctctgttcaaa

SEQ ID NO: 188149 - DNA, 25 bp, Mus musculus
aggactgtgaccctcacatctccag

SEQ ID NO: 188150 - DNA, 25 bp, Mus musculus
aggactgtgaccgtcacatctccag

SEQ ID NO: 188151 - DNA, 25 bp, Mus musculus
aggactgtggctacttccccaatgg

SEQ ID NO: 188152 - DNA, 25 bp, Mus musculus
aggactgtggcttcttccccaatgg

SEQ ID NO: 188153 - DNA, 25 bp, Mus musculus
aggactgtgggactagcttcgtcac

SEQ ID NO: 188154 - DNA, 25 bp, Mus musculus
aggactgtgggagtagcttcgtcac

SEQ ID NO: 188155 - DNA, 25 bp, Mus musculus
aggactgtggttaggattgaatcca

SEQ ID NO: 188156 - DNA, 25 bp, Mus musculus
aggactgtggtttggattgaatcca

SEQ ID NO: 188157 - DNA, 25 bp, Mus musculus
aggactgtgtcgctgccatataaga

SEQ ID NO: 188158 - DNA, 25 bp, Mus musculus
aggactgtgtcggtgccatataaga

SEQ ID NO: 188159 - DNA, 25 bp, Mus musculus
aggactgtgtctaaactctatattc

SEQ ID NO: 188160 - DNA, 25 bp, Mus musculus
aggactgtgtcttaactctatattc

SEQ ID NO: 188161 - DNA, 25 bp, Mus musculus
aggactgttaagctcctttgcagtt

SEQ ID NO: 188162 - DNA, 25 bp, Mus musculus
aggactgttaaggtcctttgcagtt

SEQ ID NO: 188163 - DNA, 25 bp, Mus musculus
aggactgttaccaccagagcactga

SEQ ID NO: 188164 - DNA, 25 bp, Mus musculus
aggactgttacctccagagcactga

SEQ ID NO: 188165 - DNA, 25 bp, Mus musculus
aggactgttcttctccccagggaag

SEQ ID NO: 188166 - DNA, 25 bp, Mus musculus
aggactgttcttgtccccagggaag

SEQ ID NO: 188167 - DNA, 25 bp, Mus musculus
aggacttaagcgcttccaggccaat

SEQ ID NO: 188168 - DNA, 25 bp, Mus musculus
aggacttaagcggttccaggccaat

SEQ ID NO: 188169 - DNA, 25 bp, Mus musculus
aggacttacagaatgatgctggaac

SEQ ID NO: 188170 - DNA, 25 bp, Mus musculus
aggacttacagattgatgctggaac

SEQ ID NO: 188171 - DNA, 25 bp, Mus musculus
aggacttacatactttctagtagaa

SEQ ID NO: 188172 - DNA, 25 bp, Mus musculus
aggacttacatagtttctagtagaa

SEQ ID NO: 188173 - DNA, 25 bp, Mus musculus
aggacttaccaccacagaaaatcat

SEQ ID NO: 188174 - DNA, 25 bp, Mus musculus
aggacttaccacgacagaaaatcat

SEQ ID NO: 188175 - DNA, 25 bp, Mus musculus
aggacttaccagctcttcagaggtg

SEQ ID NO: 188176 - DNA, 25 bp, Mus musculus
aggacttaccaggtcttcagaggtg

SEQ ID NO: 188177 - DNA, 25 bp, Mus musculus
aggacttacctacgtctagcttcca

SEQ ID NO: 188178 - DNA, 25 bp, Mus musculus
aggacttacctaggtctagcttcca

SEQ ID NO: 188179 - DNA, 25 bp, Mus musculus
aggacttactccatggatgactgaa

SEQ ID NO: 188180 - DNA, 25 bp, Mus musculus
aggacttactccttggatgactgaa

SEQ ID NO: 188181 - DNA, 25 bp, Mus musculus
aggacttagaacatggcacagggaa

SEQ ID NO: 188182 - DNA, 25 bp, Mus musculus
aggacttagaacttggcacagggaa

SEQ ID NO: 188183 - DNA, 25 bp, Mus musculus
aggacttagaggatgccaataaaaa

SEQ ID NO: 188184 - DNA, 25 bp, Mus musculus
aggacttagaggttgccaataaaaa

SEQ ID NO: 188185 - DNA, 25 bp, Mus musculus
aggacttagcagagccaggccgact

SEQ ID NO: 188186 - DNA, 25 bp, Mus musculus
aggacttagcagtgccaggccgact

SEQ ID NO: 188187 - DNA, 25 bp, Mus musculus
aggacttagctaacttgttcttgca

SEQ ID NO: 188188 - DNA, 25 bp, Mus musculus
aggacttagctatcttgttcttgca

SEQ ID NO: 188189 - DNA, 25 bp, Mus musculus
aggacttataacagtgtcattgata

SEQ ID NO: 188190 - DNA, 25 bp, Mus musculus
aggacttataactgtgtcattgata

SEQ ID NO: 188191 - DNA, 25 bp, Mus musculus
aggacttatactatgcagcgccact

SEQ ID NO: 188192 - DNA, 25 bp, Mus musculus
aggacttatactttgcagcgccact

SEQ ID NO: 188193 - DNA, 25 bp, Mus musculus
aggacttatagactgccaagagcca

SEQ ID NO: 188194 - DNA, 25 bp, Mus musculus
aggacttatagagtgccaagagcca

SEQ ID NO: 188195 - DNA, 25 bp, Mus musculus
aggacttatatgaccctctgagtaa

SEQ ID NO: 188196 - DNA, 25 bp, Mus musculus
aggacttatatgtccctctgagtaa

SEQ ID NO: 188197 - DNA, 25 bp, Mus musculus
aggacttatgaaccaccgggctctc

SEQ ID NO: 188198 - DNA, 25 bp, Mus musculus
aggacttatgaagcaccgggctctc

SEQ ID NO: 188199 - DNA, 25 bp, Mus musculus
aggacttcaaaacagatctgcgctt

SEQ ID NO: 188200 - DNA, 25 bp, Mus musculus
aggacttcaaaagagatctgcgctt

SEQ ID NO: 188201 - DNA, 25 bp, Mus musculus
aggacttcaaccagttacccacgtg

SEQ ID NO: 188202 - DNA, 25 bp, Mus musculus
aggacttcaacctgttacccacgtg

SEQ ID NO: 188203 - DNA, 25 bp, Mus musculus
aggacttcaaggagacgctgcagca

SEQ ID NO: 188204 - DNA, 25 bp, Mus musculus
aggacttcaaggtgacgctgcagca

SEQ ID NO: 188205 - DNA, 25 bp, Mus musculus
aggacttcacagagcctggacaggt

SEQ ID NO: 188206 - DNA, 25 bp, Mus musculus
aggacttcacagattcactttctat

SEQ ID NO: 188207 - DNA, 25 bp, Mus musculus
aggacttcacagtgcctggacaggt

SEQ ID NO: 188208 - DNA, 25 bp, Mus musculus
aggacttcacagtttcactttctat

SEQ ID NO: 188209 - DNA, 25 bp, Mus musculus
aggacttcaccgagcctatgtggca

SEQ ID NO: 188210 - DNA, 25 bp, Mus musculus
aggacttcaccgtgcctatgtggca

SEQ ID NO: 188211 - DNA, 25 bp, Mus musculus
aggacttcacggatttctgcatcaa

SEQ ID NO: 188212 - DNA, 25 bp, Mus musculus
aggacttcacggttttctgcatcaa

SEQ ID NO: 188213 - DNA, 25 bp, Mus musculus
aggacttcactgaagattcacgtgc

SEQ ID NO: 188214 - DNA, 25 bp, Mus musculus
aggacttcactgtagattcacgtgc

SEQ ID NO: 188215 - DNA, 25 bp, Mus musculus
aggacttcacttaagcctgcctacc

SEQ ID NO: 188216 - DNA, 25 bp, Mus musculus
aggacttcactttagcctgcctacc

SEQ ID NO: 188217 - DNA, 25 bp, Mus musculus
aggacttcagctatgctccccagga

SEQ ID NO: 188218 - DNA, 25 bp, Mus musculus
aggacttcagctttgctccccagga

SEQ ID NO: 188219 - DNA, 25 bp, Mus musculus
aggacttcagggacatctctgtgag

SEQ ID NO: 188220 - DNA, 25 bp, Mus musculus
aggacttcagggtcatctctgtgag

SEQ ID NO: 188221 - DNA, 25 bp, Mus musculus
aggacttcatccatctcaacataaa

SEQ ID NO: 188222 - DNA, 25 bp, Mus musculus
aggacttcatccttctcaacataaa

SEQ ID NO: 188223 - DNA, 25 bp, Mus musculus
aggacttcattccaagcccgtctct

SEQ ID NO: 188224 - DNA, 25 bp, Mus musculus
aggacttcattcgaagcccgtctct

SEQ ID NO: 188225 - DNA, 25 bp, Mus musculus
aggacttcattgagaatgcccgtct

SEQ ID NO: 188226 - DNA, 25 bp, Mus musculus
aggacttcattgtgaatgcccgtct

SEQ ID NO: 188227 - DNA, 25 bp, Mus musculus
aggacttccaggctcgtcgctgccg

SEQ ID NO: 188228 - DNA, 25 bp, Mus musculus
aggacttccagggtcgtcgctgccg

SEQ ID NO: 188229 - DNA, 25 bp, Mus musculus
aggacttcccttaccatgcggaata

SEQ ID NO: 188230 - DNA, 25 bp, Mus musculus
aggacttccctttccatgcggaata

SEQ ID NO: 188231 - DNA, 25 bp, Mus musculus
aggacttccgttctctgatggtgga

SEQ ID NO: 188232 - DNA, 25 bp, Mus musculus
aggacttccgttgtctgatggtgga

SEQ ID NO: 188233 - DNA, 25 bp, Mus musculus
aggacttcctagcattaagctccac

SEQ ID NO: 188234 - DNA, 25 bp, Mus musculus
aggacttcctaggattaagctccac

SEQ ID NO: 188235 - DNA, 25 bp, Mus musculus
aggacttcctgaaaggcgaatgtgt

SEQ ID NO: 188236 - DNA, 25 bp, Mus musculus
aggacttcctgaagatctggcaggg

SEQ ID NO: 188237 - DNA, 25 bp, Mus musculus
aggacttcctgataggcgaatgtgt

SEQ ID NO: 188238 - DNA, 25 bp, Mus musculus
aggacttcctgatgatctggcaggg

SEQ ID NO: 188239 - DNA, 25 bp, Mus musculus
aggacttccttgatgaacattatga

SEQ ID NO: 188240 - DNA, 25 bp, Mus musculus
aggacttccttgttgaacattatga

SEQ ID NO: 188241 - DNA, 25 bp, Mus musculus
aggacttcgagaaggttcagctgga

SEQ ID NO: 188242 - DNA, 25 bp, Mus musculus
aggacttcgagatggttcagctgga

SEQ ID NO: 188243 - DNA, 25 bp, Mus musculus
aggacttcgatcctgtgcagcgcta

SEQ ID NO: 188244 - DNA, 25 bp, Mus musculus
aggacttcgatcgtgtgcagcgcta

SEQ ID NO: 188245 - DNA, 25 bp, Mus musculus
aggacttcgccaacatggacttgga

SEQ ID NO: 188246 - DNA, 25 bp, Mus musculus
aggacttcgccatcatggacttgga

SEQ ID NO: 188247 - DNA, 25 bp, Mus musculus
aggacttctaggcaccaagggactc

SEQ ID NO: 188248 - DNA, 25 bp, Mus musculus
aggacttctagggaccaagggactc

SEQ ID NO: 188249 - DNA, 25 bp, Mus musculus
aggacttctccaagtttgccttcta

SEQ ID NO: 188250 - DNA, 25 bp, Mus musculus
aggacttctccatgtttgccttcta

SEQ ID NO: 188251 - DNA, 25 bp, Mus musculus
aggacttctcctcttatagcagcaa

SEQ ID NO: 188252 - DNA, 25 bp, Mus musculus
aggacttctcctgttatagcagcaa

SEQ ID NO: 188253 - DNA, 25 bp, Mus musculus
aggacttctcgcctttggaaccact

SEQ ID NO: 188254 - DNA, 25 bp, Mus musculus
aggacttctcgcgtttggaaccact

SEQ ID NO: 188255 - DNA, 25 bp, Mus musculus
aggacttctcttatttcttccctga

SEQ ID NO: 188256 - DNA, 25 bp, Mus musculus
aggacttctcttttttcttccctga

SEQ ID NO: 188257 - DNA, 25 bp, Mus musculus
aggacttctgaacgaccagctacct

SEQ ID NO: 188258 - DNA, 25 bp, Mus musculus
aggacttctgaaggaccagctacct

SEQ ID NO: 188259 - DNA, 25 bp, Mus musculus
aggacttctgagatgccctctccac

SEQ ID NO: 188260 - DNA, 25 bp, Mus musculus
aggacttctgagttgccctctccac

SEQ ID NO: 188261 - DNA, 25 bp, Mus musculus
aggacttctggtaggctgttcatgc

SEQ ID NO: 188262 - DNA, 25 bp, Mus musculus
aggacttctggttggctgttcatgc

SEQ ID NO: 188263 - DNA, 25 bp, Mus musculus
aggacttctgttaggattattcatt

SEQ ID NO: 188264 - DNA, 25 bp, Mus musculus
aggacttctgtttggattattcatt

SEQ ID NO: 188265 - DNA, 25 bp, Mus musculus
aggacttcttatacttgggtgccaa

SEQ ID NO: 188266 - DNA, 25 bp, Mus musculus
aggacttcttattcttgggtgccaa

SEQ ID NO: 188267 - DNA, 25 bp, Mus musculus
aggacttcttcaacccttgtggaac

SEQ ID NO: 188268 - DNA, 25 bp, Mus musculus
aggacttcttcatcccttgtggaac

SEQ ID NO: 188269 - DNA, 25 bp, Mus musculus
aggacttcttcgattgttcttccag

SEQ ID NO: 188270 - DNA, 25 bp, Mus musculus
aggacttcttcgtttgttcttccag

SEQ ID NO: 188271 - DNA, 25 bp, Mus musculus
aggacttcttctctgagcccagcag

SEQ ID NO: 188272 - DNA, 25 bp, Mus musculus
aggacttcttctgtgagcccagcag

SEQ ID NO: 188273 - DNA, 25 bp, Mus musculus
aggacttgacccctatcttgttggc

SEQ ID NO: 188274 - DNA, 25 bp, Mus musculus
aggacttgacccgtatcttgttggc

SEQ ID NO: 188275 - DNA, 25 bp, Mus musculus
aggacttgagtaattccgacctcac

SEQ ID NO: 188276 - DNA, 25 bp, Mus musculus
aggacttgagtatttccgacctcac

SEQ ID NO: 188277 - DNA, 25 bp, Mus musculus
aggacttgatcccaaagctgtttaa

SEQ ID NO: 188278 - DNA, 25 bp, Mus musculus
aggacttgatccgaaagctgtttaa

SEQ ID NO: 188279 - DNA, 25 bp, Mus musculus
aggacttgcacacccacgttgtcaa

SEQ ID NO: 188280 - DNA, 25 bp, Mus musculus
aggacttgcacagccacgttgtcaa

SEQ ID NO: 188281 - DNA, 25 bp, Mus musculus
aggacttgcccacgcgtctcagagg

SEQ ID NO: 188282 - DNA, 25 bp, Mus musculus
aggacttgcccaggcgtctcagagg

SEQ ID NO: 188283 - DNA, 25 bp, Mus musculus
aggacttgctccaaggtctgagcaa

SEQ ID NO: 188284 - DNA, 25 bp, Mus musculus
aggacttgctcctaggtctgagcaa

SEQ ID NO: 188285 - DNA, 25 bp, Mus musculus
aggacttgctggagctcattgctga

SEQ ID NO: 188286 - DNA, 25 bp, Mus musculus
aggacttgctggtgctcattgctga

SEQ ID NO: 188287 - DNA, 25 bp, Mus musculus
aggacttgcttgaccttaggatcat

SEQ ID NO: 188288 - DNA, 25 bp, Mus musculus
aggacttgcttgtccttaggatcat

SEQ ID NO: 188289 - DNA, 25 bp, Mus musculus
aggacttggaaccttaccggcagca

SEQ ID NO: 188290 - DNA, 25 bp, Mus musculus
aggacttggaacgttaccggcagca

SEQ ID NO: 188291 - DNA, 25 bp, Mus musculus
aggacttgtaatcttttttgctaat

SEQ ID NO: 188292 - DNA, 25 bp, Mus musculus
aggacttgtaatgttttttgctaat

SEQ ID NO: 188293 - DNA, 25 bp, Mus musculus
aggacttgtactcagctgcttctag

SEQ ID NO: 188294 - DNA, 25 bp, Mus musculus
aggacttgtactgagctgcttctag

SEQ ID NO: 188295 - DNA, 25 bp, Mus musculus
aggacttgtcagagtcattccctct

SEQ ID NO: 188296 - DNA, 25 bp, Mus musculus
aggacttgtcagtgtcattccctct

SEQ ID NO: 188297 - DNA, 25 bp, Mus musculus
aggacttgtgaaccttggcccacag

SEQ ID NO: 188298 - DNA, 25 bp, Mus musculus
aggacttgtgaagcttggcccacag

SEQ ID NO: 188299 - DNA, 25 bp, Mus musculus
aggacttgtgctatgtctttactcc

SEQ ID NO: 188300 - DNA, 25 bp, Mus musculus
aggacttgtgctttgtctttactcc

SEQ ID NO: 188301 - DNA, 25 bp, Mus musculus
aggacttgtgtaactattttactgt

SEQ ID NO: 188302 - DNA, 25 bp, Mus musculus
aggacttgtgtatctattttactgt

SEQ ID NO: 188303 - DNA, 25 bp, Mus musculus
aggactttacagaattcagccctaa

SEQ ID NO: 188304 - DNA, 25 bp, Mus musculus
aggactttacagtattcagccctaa

SEQ ID NO: 188305 - DNA, 25 bp, Mus musculus
aggactttagccatgctcccttttc

SEQ ID NO: 188306 - DNA, 25 bp, Mus musculus
aggactttagccttgctcccttttc

SEQ ID NO: 188307 - DNA, 25 bp, Mus musculus
aggactttaggcactccaacacagt

SEQ ID NO: 188308 - DNA, 25 bp, Mus musculus
aggactttaggctctccaacacagt

SEQ ID NO: 188309 - DNA, 25 bp, Mus musculus
aggactttagtcagtcacagtctgg

SEQ ID NO: 188310 - DNA, 25 bp, Mus musculus
aggactttagtctgtcacagtctgg

SEQ ID NO: 188311 - DNA, 25 bp, Mus musculus
aggactttcaaaagccacctgatcc

SEQ ID NO: 188312 - DNA, 25 bp, Mus musculus
aggactttcaaatgccacctgatcc

SEQ ID NO: 188313 - DNA, 25 bp, Mus musculus
aggactttcagcctgaggccgagct

SEQ ID NO: 188314 - DNA, 25 bp, Mus musculus
aggactttcagcgtgaggccgagct

SEQ ID NO: 188315 - DNA, 25 bp, Mus musculus
aggactttccaacttagcatcttac

SEQ ID NO: 188316 - DNA, 25 bp, Mus musculus
aggactttccaagttagcatcttac

SEQ ID NO: 188317 - DNA, 25 bp, Mus musculus
aggactttccatacagaacacatct

SEQ ID NO: 188318 - DNA, 25 bp, Mus musculus
aggactttccattcagaacacatct

SEQ ID NO: 188319 - DNA, 25 bp, Mus musculus
aggactttccttaggatatggtgtc

SEQ ID NO: 188320 - DNA, 25 bp, Mus musculus
aggactttcctttggatatggtgtc

SEQ ID NO: 188321 - DNA, 25 bp, Mus musculus
aggactttcgagcacattgcccggg

SEQ ID NO: 188322 - DNA, 25 bp, Mus musculus
aggactttcgaggacattgcccggg

SEQ ID NO: 188323 - DNA, 25 bp, Mus musculus
aggactttcttcacagtgagcgtag

SEQ ID NO: 188324 - DNA, 25 bp, Mus musculus
aggactttcttctcagtgagcgtag

SEQ ID NO: 188325 - DNA, 25 bp, Mus musculus
aggactttgagaccactccgagcca

SEQ ID NO: 188326 - DNA, 25 bp, Mus musculus
aggactttgagagcactccgagcca

SEQ ID NO: 188327 - DNA, 25 bp, Mus musculus
aggactttgcgcagggtcattccca

SEQ ID NO: 188328 - DNA, 25 bp, Mus musculus
aggactttgcgctgggtcattccca

SEQ ID NO: 188329 - DNA, 25 bp, Mus musculus
aggactttggaaccctggtctcatt

SEQ ID NO: 188330 - DNA, 25 bp, Mus musculus
aggactttggaagcctggtctcatt

SEQ ID NO: 188331 - DNA, 25 bp, Mus musculus
aggactttggacaccacgtaccgag

SEQ ID NO: 188332 - DNA, 25 bp, Mus musculus
aggactttggactccacgtaccgag

SEQ ID NO: 188333 - DNA, 25 bp, Mus musculus
aggacttttaccctcagagagatca

SEQ ID NO: 188334 - DNA, 25 bp, Mus musculus
aggacttttaccgtcagagagatca

SEQ ID NO: 188335 - DNA, 25 bp, Mus musculus
aggacttttattatgcctggctgtg

SEQ ID NO: 188336 - DNA, 25 bp, Mus musculus
aggacttttattttgcctggctgtg

SEQ ID NO: 188337 - DNA, 25 bp, Mus musculus
aggacttttcttagtactgctacat

SEQ ID NO: 188338 - DNA, 25 bp, Mus musculus
aggacttttctttgtactgctacat

SEQ ID NO: 188339 - DNA, 25 bp, Mus musculus
aggacttttgacagtttagtgctta

SEQ ID NO: 188340 - DNA, 25 bp, Mus musculus
aggacttttgactgtttagtgctta

SEQ ID NO: 188341 - DNA, 25 bp, Mus musculus
aggacttttttccaattggacagat

SEQ ID NO: 188342 - DNA, 25 bp, Mus musculus
aggacttttttcgaattggacagat

SEQ ID NO: 188343 - DNA, 25 bp, Mus musculus
aggagaaaaccgcaggcactcgcct

SEQ ID NO: 188344 - DNA, 25 bp, Mus musculus
aggagaaaaccggaggcactcgcct

SEQ ID NO: 188345 - DNA, 25 bp, Mus musculus
aggagaaaagcccttccacaggatg

SEQ ID NO: 188346 - DNA, 25 bp, Mus musculus
aggagaaaagccctttgtcccagct

SEQ ID NO: 188347 - DNA, 25 bp, Mus musculus
aggagaaaagccgttccacaggatg

SEQ ID NO: 188348 - DNA, 25 bp, Mus musculus
aggagaaaagccgtttgtcccagct

SEQ ID NO: 188349 - DNA, 25 bp, Mus musculus
aggagaaaatggactccctggccct

SEQ ID NO: 188350 - DNA, 25 bp, Mus musculus
aggagaaaatggtctccctggccct

SEQ ID NO: 188351 - DNA, 25 bp, Mus musculus
aggagaaacattcggctctgcacag

SEQ ID NO: 188352 - DNA, 25 bp, Mus musculus
aggagaaacattgggctctgcacag

SEQ ID NO: 188353 - DNA, 25 bp, Mus musculus
aggagaaaccctcagacacagaaga

SEQ ID NO: 188354 - DNA, 25 bp, Mus musculus
aggagaaaccctccagctgcggaag

SEQ ID NO: 188355 - DNA, 25 bp, Mus musculus
aggagaaaccctgagacacagaaga

SEQ ID NO: 188356 - DNA, 25 bp, Mus musculus
aggagaaaccctgcagctgcggaag

SEQ ID NO: 188357 - DNA, 25 bp, Mus musculus
aggagaaactgcacgcgctcttcag

SEQ ID NO: 188358 - DNA, 25 bp, Mus musculus
aggagaaactgctcgcgctcttcag

SEQ ID NO: 188359 - DNA, 25 bp, Mus musculus
aggagaaagctaacttcccctcttg

SEQ ID NO: 188360 - DNA, 25 bp, Mus musculus
aggagaaagctatcttcccctcttg

SEQ ID NO: 188361 - DNA, 25 bp, Mus musculus
aggagaaagctccaagcccagtaaa

SEQ ID NO: 188362 - DNA, 25 bp, Mus musculus
aggagaaagctcgaagcccagtaaa

SEQ ID NO: 188363 - DNA, 25 bp, Mus musculus
aggagaaagttcacggctgctgccg

SEQ ID NO: 188364 - DNA, 25 bp, Mus musculus
aggagaaagttctcggctgctgccg

SEQ ID NO: 188365 - DNA, 25 bp, Mus musculus
aggagaaatctacctgccgttccct

SEQ ID NO: 188366 - DNA, 25 bp, Mus musculus
aggagaaatctagctgccgttccct

SEQ ID NO: 188367 - DNA, 25 bp, Mus musculus
aggagaaatgtcacggctcttccgg

SEQ ID NO: 188368 - DNA, 25 bp, Mus musculus
aggagaaatgtctcggctcttccgg

SEQ ID NO: 188369 - DNA, 25 bp, Mus musculus
aggagaacaactccgcttccaactg

SEQ ID NO: 188370 - DNA, 25 bp, Mus musculus
aggagaacaactgcgcttccaactg

SEQ ID NO: 188371 - DNA, 25 bp, Mus musculus
aggagaacactgctaggtgctgtca

SEQ ID NO: 188372 - DNA, 25 bp, Mus musculus
aggagaacactggtaggtgctgtca

SEQ ID NO: 188373 - DNA, 25 bp, Mus musculus
aggagaaccaacacctgtctataat

SEQ ID NO: 188374 - DNA, 25 bp, Mus musculus
aggagaaccaactcctgtctataat

SEQ ID NO: 188375 - DNA, 25 bp, Mus musculus
aggagaaccagcctggccactctag

SEQ ID NO: 188376 - DNA, 25 bp, Mus musculus
aggagaaccagcgtggccactctag

SEQ ID NO: 188377 - DNA, 25 bp, Mus musculus
aggagaaccccaacatgcggctgtc

SEQ ID NO: 188378 - DNA, 25 bp, Mus musculus
aggagaaccccacccataatggatg

SEQ ID NO: 188379 - DNA, 25 bp, Mus musculus
aggagaaccccagccataatggatg

SEQ ID NO: 188380 - DNA, 25 bp, Mus musculus
aggagaaccccatcatgcggctgtc

SEQ ID NO: 188381 - DNA, 25 bp, Mus musculus
aggagaacccctccatggaatttga

SEQ ID NO: 188382 - DNA, 25 bp, Mus musculus
aggagaacccctgcatggaatttga

SEQ ID NO: 188383 - DNA, 25 bp, Mus musculus
aggagaaccgccacgttggaatgac

SEQ ID NO: 188384 - DNA, 25 bp, Mus musculus
aggagaaccgcctcgttggaatgac

SEQ ID NO: 188385 - DNA, 25 bp, Mus musculus
aggagaacctgcaggtcttcgactt

SEQ ID NO: 188386 - DNA, 25 bp, Mus musculus
aggagaacctgctggtcttcgactt

SEQ ID NO: 188387 - DNA, 25 bp, Mus musculus
aggagaacctggcactgtctctctg

SEQ ID NO: 188388 - DNA, 25 bp, Mus musculus
aggagaacctgggactgtctctctg

SEQ ID NO: 188389 - DNA, 25 bp, Mus musculus
aggagaaccttcctccatgatgtac

SEQ ID NO: 188390 - DNA, 25 bp, Mus musculus
aggagaaccttcgtccatgatgtac

SEQ ID NO: 188391 - DNA, 25 bp, Mus musculus
aggagaactcaacgatcctcaagtt

SEQ ID NO: 188392 - DNA, 25 bp, Mus musculus
aggagaactcaaggatcctcaagtt

SEQ ID NO: 188393 - DNA, 25 bp, Mus musculus
aggagaactccaagtgcctggacct

SEQ ID NO: 188394 - DNA, 25 bp, Mus musculus
aggagaactccatgtgcctggacct

SEQ ID NO: 188395 - DNA, 25 bp, Mus musculus
aggagaactcccaatgaacccatca

SEQ ID NO: 188396 - DNA, 25 bp, Mus musculus
aggagaactcccatcagcggtgcac

SEQ ID NO: 188397 - DNA, 25 bp, Mus musculus
aggagaactcccattagcggtgcac

SEQ ID NO: 188398 - DNA, 25 bp, Mus musculus
aggagaactccctatgaacccatca

SEQ ID NO: 188399 - DNA, 25 bp, Mus musculus
aggagaactcccttcagcggtgcac

SEQ ID NO: 188400 - DNA, 25 bp, Mus musculus
aggagaactccctttagcggtgcac

SEQ ID NO: 188401 - DNA, 25 bp, Mus musculus
aggagaactctcctggtcatgggaa

SEQ ID NO: 188402 - DNA, 25 bp, Mus musculus
aggagaactctcgtggtcatgggaa

SEQ ID NO: 188403 - DNA, 25 bp, Mus musculus
aggagaactgcacccatcggactgc

SEQ ID NO: 188404 - DNA, 25 bp, Mus musculus
aggagaactgcagccatcggactgc

SEQ ID NO: 188405 - DNA, 25 bp, Mus musculus
aggagaactgctcagcctctggtta

SEQ ID NO: 188406 - DNA, 25 bp, Mus musculus
aggagaactgctgagcctctggtta

SEQ ID NO: 188407 - DNA, 25 bp, Mus musculus
aggagaactgtcagtgccgcttcca

SEQ ID NO: 188408 - DNA, 25 bp, Mus musculus
aggagaactgtctgtgccgcttcca

SEQ ID NO: 188409 - DNA, 25 bp, Mus musculus
aggagaacttcaaggtgcacccggc

SEQ ID NO: 188410 - DNA, 25 bp, Mus musculus
aggagaacttcatggtgcacccggc

SEQ ID NO: 188411 - DNA, 25 bp, Mus musculus
aggagaagactcatgtgtcctcccc

SEQ ID NO: 188412 - DNA, 25 bp, Mus musculus
aggagaagactcttgtgtcctcccc

SEQ ID NO: 188413 - DNA, 25 bp, Mus musculus
aggagaagattcctgaccctcatgc

SEQ ID NO: 188414 - DNA, 25 bp, Mus musculus
aggagaagattcgtgaccctcatgc

SEQ ID NO: 188415 - DNA, 25 bp, Mus musculus
aggagaagcaccatgcctatgcctt

SEQ ID NO: 188416 - DNA, 25 bp, Mus musculus
aggagaagcacccttttgtgtcata

SEQ ID NO: 188417 - DNA, 25 bp, Mus musculus
aggagaagcaccgttttgtgtcata

SEQ ID NO: 188418 - DNA, 25 bp, Mus musculus
aggagaagcaccttgcctatgcctt

SEQ ID NO: 188419 - DNA, 25 bp, Mus musculus
aggagaagcatcagctgctaccgct

SEQ ID NO: 188420 - DNA, 25 bp, Mus musculus
aggagaagcatctgctgctaccgct

SEQ ID NO: 188421 - DNA, 25 bp, Mus musculus
aggagaagctacaacgtgaccccac

SEQ ID NO: 188422 - DNA, 25 bp, Mus musculus
aggagaagctaccatgcaggtcctg

SEQ ID NO: 188423 - DNA, 25 bp, Mus musculus
aggagaagctacgatgcaggtcctg

SEQ ID NO: 188424 - DNA, 25 bp, Mus musculus
aggagaagctactacgtgaccccac

SEQ ID NO: 188425 - DNA, 25 bp, Mus musculus
aggagaagctcccaagtgacttgga

SEQ ID NO: 188426 - DNA, 25 bp, Mus musculus
aggagaagctccgaagtgacttgga

SEQ ID NO: 188427 - DNA, 25 bp, Mus musculus
aggagaagctgcatcagctctcagc

SEQ ID NO: 188428 - DNA, 25 bp, Mus musculus
aggagaagctgcttcagctctcagc

SEQ ID NO: 188429 - DNA, 25 bp, Mus musculus
aggagaagctggagccgccacgtac

SEQ ID NO: 188430 - DNA, 25 bp, Mus musculus
aggagaagctggtgccgccacgtac

SEQ ID NO: 188431 - DNA, 25 bp, Mus musculus
aggagaaggaccagcagtacggtat

SEQ ID NO: 188432 - DNA, 25 bp, Mus musculus
aggagaaggacctgcagtacggtat

SEQ ID NO: 188433 - DNA, 25 bp, Mus musculus
aggagaaggagcactcagaccagcc

SEQ ID NO: 188434 - DNA, 25 bp, Mus musculus
aggagaaggagctctcagaccagcc

SEQ ID NO: 188435 - DNA, 25 bp, Mus musculus
aggagaaggccgacctggaccctag

SEQ ID NO: 188436 - DNA, 25 bp, Mus musculus
aggagaaggccgtcctggaccctag

SEQ ID NO: 188437 - DNA, 25 bp, Mus musculus
aggagaagtactaagcaccctcgga

SEQ ID NO: 188438 - DNA, 25 bp, Mus musculus
aggagaagtacttagcaccctcgga

SEQ ID NO: 188439 - DNA, 25 bp, Mus musculus
aggagaagtattagttcattatctg

SEQ ID NO: 188440 - DNA, 25 bp, Mus musculus
aggagaagtatttgttcattatctg

SEQ ID NO: 188441 - DNA, 25 bp, Mus musculus
aggagaagtccaccggccgtactgc

SEQ ID NO: 188442 - DNA, 25 bp, Mus musculus
aggagaagtccagcggccgtactgc

SEQ ID NO: 188443 - DNA, 25 bp, Mus musculus
aggagaagtctgcactcatcaagca

SEQ ID NO: 188444 - DNA, 25 bp, Mus musculus
aggagaagtctggactcatcaagca

SEQ ID NO: 188445 - DNA, 25 bp, Mus musculus
aggagaagtgcactgccctacacag

SEQ ID NO: 188446 - DNA, 25 bp, Mus musculus
aggagaagtgcagtgccctacacag

SEQ ID NO: 188447 - DNA, 25 bp, Mus musculus
aggagaagtttcagcaccacctctg

SEQ ID NO: 188448 - DNA, 25 bp, Mus musculus
aggagaagtttctgcaccacctctg

SEQ ID NO: 188449 - DNA, 25 bp, Mus musculus
aggagaatactgaccacccaagttc

SEQ ID NO: 188450 - DNA, 25 bp, Mus musculus
aggagaatactgtccacccaagttc

SEQ ID NO: 188451 - DNA, 25 bp, Mus musculus
aggagaatagcccttgctgcaagaa

SEQ ID NO: 188452 - DNA, 25 bp, Mus musculus
aggagaatagccgttgctgcaagaa

SEQ ID NO: 188453 - DNA, 25 bp, Mus musculus
aggagaatccaaccctcagacgcca

SEQ ID NO: 188454 - DNA, 25 bp, Mus musculus
aggagaatccaagcctcagacgcca

SEQ ID NO: 188455 - DNA, 25 bp, Mus musculus
aggagaatggtaccttccacctcaa

SEQ ID NO: 188456 - DNA, 25 bp, Mus musculus
aggagaatggtagcttccacctcaa

SEQ ID NO: 188457 - DNA, 25 bp, Mus musculus
aggagaatggtgacctcacccggat

SEQ ID NO: 188458 - DNA, 25 bp, Mus musculus
aggagaatggtgtcctcacccggat

SEQ ID NO: 188459 - DNA, 25 bp, Mus musculus
aggagaatgtcccacagggctgcac

SEQ ID NO: 188460 - DNA, 25 bp, Mus musculus
aggagaatgtccgacagggctgcac

SEQ ID NO: 188461 - DNA, 25 bp, Mus musculus
aggagaatgtgaacatctggtccct

SEQ ID NO: 188462 - DNA, 25 bp, Mus musculus
aggagaatgtgatcatctggtccct

SEQ ID NO: 188463 - DNA, 25 bp, Mus musculus
aggagaattccaccctgagtgaaga

SEQ ID NO: 188464 - DNA, 25 bp, Mus musculus
aggagaattccagcctgagtgaaga

SEQ ID NO: 188465 - DNA, 25 bp, Mus musculus
aggagaattgctacacgagtgccaa

SEQ ID NO: 188466 - DNA, 25 bp, Mus musculus
aggagaattgcttcacgagtgccaa

SEQ ID NO: 188467 - DNA, 25 bp, Mus musculus
aggagaatttacagctaagccatat

SEQ ID NO: 188468 - DNA, 25 bp, Mus musculus
aggagaatttactgctaagccatat

SEQ ID NO: 188469 - DNA, 25 bp, Mus musculus
aggagaatttcaccgcctggcagct

SEQ ID NO: 188470 - DNA, 25 bp, Mus musculus
aggagaatttcagcgcctggcagct

SEQ ID NO: 188471 - DNA, 25 bp, Mus musculus
aggagacaacaaacgcattcccgtc

SEQ ID NO: 188472 - DNA, 25 bp, Mus musculus
aggagacaacaatcgcattcccgtc

SEQ ID NO: 188473 - DNA, 25 bp, Mus musculus
aggagacaacacaaacaggaagctg

SEQ ID NO: 188474 - DNA, 25 bp, Mus musculus
aggagacaacactaacaggaagctg

SEQ ID NO: 188475 - DNA, 25 bp, Mus musculus
aggagacaaccgcagatgccatcgc

SEQ ID NO: 188476 - DNA, 25 bp, Mus musculus
aggagacaaccggagatgccatcgc

SEQ ID NO: 188477 - DNA, 25 bp, Mus musculus
aggagacaagatccagagcgtgttt

SEQ ID NO: 188478 - DNA, 25 bp, Mus musculus
aggagacaagatgcagagcgtgttt

SEQ ID NO: 188479 - DNA, 25 bp, Mus musculus
aggagacaaggccactgtccacttc

SEQ ID NO: 188480 - DNA, 25 bp, Mus musculus
aggagacaaggcgactgtccacttc

SEQ ID NO: 188481 - DNA, 25 bp, Mus musculus
aggagacaatccatgtcacgcggtt

SEQ ID NO: 188482 - DNA, 25 bp, Mus musculus
aggagacaatccttgtcacgcggtt

SEQ ID NO: 188483 - DNA, 25 bp, Mus musculus
aggagacaatcgcatctccccttag

SEQ ID NO: 188484 - DNA, 25 bp, Mus musculus
aggagacaatcggatctccccttag

SEQ ID NO: 188485 - DNA, 25 bp, Mus musculus
aggagacacacgagctgcccacatg

SEQ ID NO: 188486 - DNA, 25 bp, Mus musculus
aggagacacacgtgctgcccacatg

SEQ ID NO: 188487 - DNA, 25 bp, Mus musculus
aggagacaccaaccgcatgccttgt

SEQ ID NO: 188488 - DNA, 25 bp, Mus musculus
aggagacaccaagcgcatgccttgt

SEQ ID NO: 188489 - DNA, 25 bp, Mus musculus
aggagacaccataggcagctcaggc

SEQ ID NO: 188490 - DNA, 25 bp, Mus musculus
aggagacaccattggcagctcaggc

SEQ ID NO: 188491 - DNA, 25 bp, Mus musculus
aggagacaccctcaaagccatcaca

SEQ ID NO: 188492 - DNA, 25 bp, Mus musculus
aggagacaccctgaaagccatcaca

SEQ ID NO: 188493 - DNA, 25 bp, Mus musculus
aggagacaccggattgccaggtcct

SEQ ID NO: 188494 - DNA, 25 bp, Mus musculus
aggagacaccggtttgccaggtcct

SEQ ID NO: 188495 - DNA, 25 bp, Mus musculus
aggagacactcgcagccagcagcaa

SEQ ID NO: 188496 - DNA, 25 bp, Mus musculus
aggagacactcggagccagcagcaa

SEQ ID NO: 188497 - DNA, 25 bp, Mus musculus
aggagacactgtcacaggctggcct

SEQ ID NO: 188498 - DNA, 25 bp, Mus musculus
aggagacactgtgacaggctggcct

SEQ ID NO: 188499 - DNA, 25 bp, Mus musculus
aggagacagaaccacctctgggcag

SEQ ID NO: 188500 - DNA, 25 bp, Mus musculus
aggagacagaacgacctctgggcag

SEQ ID NO: 188501 - DNA, 25 bp, Mus musculus
aggagacagaagacgggatcacctg

SEQ ID NO: 188502 - DNA, 25 bp, Mus musculus
aggagacagaagtcgggatcacctg

SEQ ID NO: 188503 - DNA, 25 bp, Mus musculus
aggagacagcaactactctggagct

SEQ ID NO: 188504 - DNA, 25 bp, Mus musculus
aggagacagcaagtactctggagct

SEQ ID NO: 188505 - DNA, 25 bp, Mus musculus
aggagacagggacgcgaatcaacat

SEQ ID NO: 188506 - DNA, 25 bp, Mus musculus
aggagacagggaggcgaatcaacat

SEQ ID NO: 188507 - DNA, 25 bp, Mus musculus
aggagacagggtagccatggctcca

SEQ ID NO: 188508 - DNA, 25 bp, Mus musculus
aggagacagggttgccatggctcca

SEQ ID NO: 188509 - DNA, 25 bp, Mus musculus
aggagacaggtgagtgtcccttacc

SEQ ID NO: 188510 - DNA, 25 bp, Mus musculus
aggagacaggtgtgtgtcccttacc

SEQ ID NO: 188511 - DNA, 25 bp, Mus musculus
aggagacagtcacatccctagggct

SEQ ID NO: 188512 - DNA, 25 bp, Mus musculus
aggagacagtcagatccctagggct

SEQ ID NO: 188513 - DNA, 25 bp, Mus musculus
aggagacataatccatttctgttga

SEQ ID NO: 188514 - DNA, 25 bp, Mus musculus
aggagacataatgcatttctgttga

SEQ ID NO: 188515 - DNA, 25 bp, Mus musculus
aggagacataccctacggtgcagtc

SEQ ID NO: 188516 - DNA, 25 bp, Mus musculus
aggagacataccgtacggtgcagtc

SEQ ID NO: 188517 - DNA, 25 bp, Mus musculus
aggagacatcccaaaaggatacagg

SEQ ID NO: 188518 - DNA, 25 bp, Mus musculus
aggagacatccctaaaggatacagg

SEQ ID NO: 188519 - DNA, 25 bp, Mus musculus
aggagacattcacgccagcagggat

SEQ ID NO: 188520 - DNA, 25 bp, Mus musculus
aggagacattcaggccagcagggat

SEQ ID NO: 188521 - DNA, 25 bp, Mus musculus
aggagacattctcttaacaccacag

SEQ ID NO: 188522 - DNA, 25 bp, Mus musculus
aggagacattctgttaacaccacag

SEQ ID NO: 188523 - DNA, 25 bp, Mus musculus
aggagaccaaccaagaggcctcttc

SEQ ID NO: 188524 - DNA, 25 bp, Mus musculus
aggagaccaacctagaggcctcttc

SEQ ID NO: 188525 - DNA, 25 bp, Mus musculus
aggagaccacacatgttgggccaat

SEQ ID NO: 188526 - DNA, 25 bp, Mus musculus
aggagaccacacttgttgggccaat

SEQ ID NO: 188527 - DNA, 25 bp, Mus musculus
aggagaccacggcttcctatgtctt

SEQ ID NO: 188528 - DNA, 25 bp, Mus musculus
aggagaccacgggttcctatgtctt

SEQ ID NO: 188529 - DNA, 25 bp, Mus musculus
aggagaccactaaagtgctgctcat

SEQ ID NO: 188530 - DNA, 25 bp, Mus musculus
aggagaccactacccaaagactctg

SEQ ID NO: 188531 - DNA, 25 bp, Mus musculus
aggagaccactagccaaagactctg

SEQ ID NO: 188532 - DNA, 25 bp, Mus musculus
aggagaccactatagtgctgctcat

SEQ ID NO: 188533 - DNA, 25 bp, Mus musculus
aggagaccagacacttgcttctgat

SEQ ID NO: 188534 - DNA, 25 bp, Mus musculus
aggagaccagactcttgcttctgat

SEQ ID NO: 188535 - DNA, 25 bp, Mus musculus
aggagaccagcaactgtttttagtt

SEQ ID NO: 188536 - DNA, 25 bp, Mus musculus
aggagaccagcatctgtttttagtt

SEQ ID NO: 188537 - DNA, 25 bp, Mus musculus
aggagaccataacaccccagaggtt

SEQ ID NO: 188538 - DNA, 25 bp, Mus musculus
aggagaccataagaccccagaggtt

SEQ ID NO: 188539 - DNA, 25 bp, Mus musculus
aggagaccatttccagtggctccct

SEQ ID NO: 188540 - DNA, 25 bp, Mus musculus
aggagaccatttgcagtggctccct

SEQ ID NO: 188541 - DNA, 25 bp, Mus musculus
aggagacccagtcctctgactttga

SEQ ID NO: 188542 - DNA, 25 bp, Mus musculus
aggagacccagtgctctgactttga

SEQ ID NO: 188543 - DNA, 25 bp, Mus musculus
aggagaccccatcgcagaagctgta

SEQ ID NO: 188544 - DNA, 25 bp, Mus musculus
aggagaccccatggcagaagctgta

SEQ ID NO: 188545 - DNA, 25 bp, Mus musculus
aggagacccggaccgctaagttcta

SEQ ID NO: 188546 - DNA, 25 bp, Mus musculus
aggagacccggagcgctaagttcta

SEQ ID NO: 188547 - DNA, 25 bp, Mus musculus
aggagacccggccacagaagcagca

SEQ ID NO: 188548 - DNA, 25 bp, Mus musculus
aggagacccggcgacagaagcagca

SEQ ID NO: 188549 - DNA, 25 bp, Mus musculus
aggagacccgtgacgtcgcagtgaa

SEQ ID NO: 188550 - DNA, 25 bp, Mus musculus
aggagacccgtgtcgtcgcagtgaa

SEQ ID NO: 188551 - DNA, 25 bp, Mus musculus
aggagaccctaccaatcggtatcaa

SEQ ID NO: 188552 - DNA, 25 bp, Mus musculus
aggagaccctacgaatcggtatcaa

SEQ ID NO: 188553 - DNA, 25 bp, Mus musculus
aggagaccctagcaagcggtatcga

SEQ ID NO: 188554 - DNA, 25 bp, Mus musculus
aggagaccctaggaagcggtatcga

SEQ ID NO: 188555 - DNA, 25 bp, Mus musculus
aggagaccctgtcctgtgatcatac

SEQ ID NO: 188556 - DNA, 25 bp, Mus musculus
aggagaccctgtgctgtgatcatac

SEQ ID NO: 188557 - DNA, 25 bp, Mus musculus
aggagacctaagaggttcctgccac

SEQ ID NO: 188558 - DNA, 25 bp, Mus musculus
aggagacctaagtggttcctgccac

SEQ ID NO: 188559 - DNA, 25 bp, Mus musculus
aggagacctacgacaagtgcctgga

SEQ ID NO: 188560 - DNA, 25 bp, Mus musculus
aggagacctacgagccagctgcaga

SEQ ID NO: 188561 - DNA, 25 bp, Mus musculus
aggagacctacgtcaagtgcctgga

SEQ ID NO: 188562 - DNA, 25 bp, Mus musculus
aggagacctacgtgccagctgcaga

SEQ ID NO: 188563 - DNA, 25 bp, Mus musculus
aggagacctcccaaggaactgagaa

SEQ ID NO: 188564 - DNA, 25 bp, Mus musculus
aggagacctccctaggaactgagaa

SEQ ID NO: 188565 - DNA, 25 bp, Mus musculus
aggagacctcgcatggtgtcctaca

SEQ ID NO: 188566 - DNA, 25 bp, Mus musculus
aggagacctcgcttggtgtcctaca

SEQ ID NO: 188567 - DNA, 25 bp, Mus musculus
aggagacctctccaccaggcaggca

SEQ ID NO: 188568 - DNA, 25 bp, Mus musculus
aggagacctctcgaccaggcaggca

SEQ ID NO: 188569 - DNA, 25 bp, Mus musculus
aggagacctgagactgttttttata

SEQ ID NO: 188570 - DNA, 25 bp, Mus musculus
aggagacctgagatgccagcagcct

SEQ ID NO: 188571 - DNA, 25 bp, Mus musculus
aggagacctgagtctgttttttata

SEQ ID NO: 188572 - DNA, 25 bp, Mus musculus
aggagacctgagttgccagcagcct

SEQ ID NO: 188573 - DNA, 25 bp, Mus musculus
aggagacctgcaaggcgatgccaga

SEQ ID NO: 188574 - DNA, 25 bp, Mus musculus
aggagacctgcatggcgatgccaga

SEQ ID NO: 188575 - DNA, 25 bp, Mus musculus
aggagacctggtatgtgagaccaaa

SEQ ID NO: 188576 - DNA, 25 bp, Mus musculus
aggagacctggtttgtgagaccaaa

SEQ ID NO: 188577 - DNA, 25 bp, Mus musculus
aggagacctgtgatctctttgccag

SEQ ID NO: 188578 - DNA, 25 bp, Mus musculus
aggagacctgtgttctctttgccag

SEQ ID NO: 188579 - DNA, 25 bp, Mus musculus
aggagacgagtgcagcatttgcatt

SEQ ID NO: 188580 - DNA, 25 bp, Mus musculus
aggagacgagtggagcatttgcatt

SEQ ID NO: 188581 - DNA, 25 bp, Mus musculus
aggagacgatctcagacccacttgg

SEQ ID NO: 188582 - DNA, 25 bp, Mus musculus
aggagacgatctgagacccacttgg

SEQ ID NO: 188583 - DNA, 25 bp, Mus musculus
aggagacgcccactgagtacctgca

SEQ ID NO: 188584 - DNA, 25 bp, Mus musculus
aggagacgcccagtgagtacctgca

SEQ ID NO: 188585 - DNA, 25 bp, Mus musculus
aggagacgcttcaactggatggaat

SEQ ID NO: 188586 - DNA, 25 bp, Mus musculus
aggagacgcttctactggatggaat

SEQ ID NO: 188587 - DNA, 25 bp, Mus musculus
aggagacggaaactggcatttgctt

SEQ ID NO: 188588 - DNA, 25 bp, Mus musculus
aggagacggaaagtggcatttgctt

SEQ ID NO: 188589 - DNA, 25 bp, Mus musculus
aggagacggcgtcctgtggtccgca

SEQ ID NO: 188590 - DNA, 25 bp, Mus musculus
aggagacggcgtgctgtggtccgca

SEQ ID NO: 188591 - DNA, 25 bp, Mus musculus
aggagacggtaaccgtcacctcgct

SEQ ID NO: 188592 - DNA, 25 bp, Mus musculus
aggagacggtaagcgtcacctcgct

SEQ ID NO: 188593 - DNA, 25 bp, Mus musculus
aggagacggtctatgttcgtgtcca

SEQ ID NO: 188594 - DNA, 25 bp, Mus musculus
aggagacggtctttgttcgtgtcca

SEQ ID NO: 188595 - DNA, 25 bp, Mus musculus
aggagactaatcaagaccagtttct

SEQ ID NO: 188596 - DNA, 25 bp, Mus musculus
aggagactaatctagaccagtttct

SEQ ID NO: 188597 - DNA, 25 bp, Mus musculus
aggagactacaaccagcaaactgca

SEQ ID NO: 188598 - DNA, 25 bp, Mus musculus
aggagactacaagcagcaaactgca

SEQ ID NO: 188599 - DNA, 25 bp, Mus musculus
aggagactacatcggtgcctcttgt

SEQ ID NO: 188600 - DNA, 25 bp, Mus musculus
aggagactacatgggtgcctcttgt

SEQ ID NO: 188601 - DNA, 25 bp, Mus musculus
aggagactaccccaagcctggatga

SEQ ID NO: 188602 - DNA, 25 bp, Mus musculus
aggagactacccgaagcctggatga

SEQ ID NO: 188603 - DNA, 25 bp, Mus musculus
aggagactagacacccagggtcaca

SEQ ID NO: 188604 - DNA, 25 bp, Mus musculus
aggagactagactcccagggtcaca

SEQ ID NO: 188605 - DNA, 25 bp, Mus musculus
aggagactagtaagccctgtgccgg

SEQ ID NO: 188606 - DNA, 25 bp, Mus musculus
aggagactagtatgccctgtgccgg

SEQ ID NO: 188607 - DNA, 25 bp, Mus musculus
aggagactcactaactggcttttgg

SEQ ID NO: 188608 - DNA, 25 bp, Mus musculus
aggagactcacttactggcttttgg

SEQ ID NO: 188609 - DNA, 25 bp, Mus musculus
aggagactcattaaggatctgatct

SEQ ID NO: 188610 - DNA, 25 bp, Mus musculus
aggagactcatttaggatctgatct

SEQ ID NO: 188611 - DNA, 25 bp, Mus musculus
aggagactccaccatggggtctcaa

SEQ ID NO: 188612 - DNA, 25 bp, Mus musculus
aggagactccacgatggggtctcaa

SEQ ID NO: 188613 - DNA, 25 bp, Mus musculus
aggagactctggaactgtgcacact

SEQ ID NO: 188614 - DNA, 25 bp, Mus musculus
aggagactctggtactgtgcacact

SEQ ID NO: 188615 - DNA, 25 bp, Mus musculus
aggagactgagcactactgcggcct

SEQ ID NO: 188616 - DNA, 25 bp, Mus musculus
aggagactgagctctactgcggcct

SEQ ID NO: 188617 - DNA, 25 bp, Mus musculus
aggagactggacatccctaagcacc

SEQ ID NO: 188618 - DNA, 25 bp, Mus musculus
aggagactggacttccctaagcacc

SEQ ID NO: 188619 - DNA, 25 bp, Mus musculus
aggagactggcaactgtgtcgtgcc

SEQ ID NO: 188620 - DNA, 25 bp, Mus musculus
aggagactggcatctgtgtcgtgcc

SEQ ID NO: 188621 - DNA, 25 bp, Mus musculus
aggagactggccatgatttcagaga

SEQ ID NO: 188622 - DNA, 25 bp, Mus musculus
aggagactggccttgatttcagaga

SEQ ID NO: 188623 - DNA, 25 bp, Mus musculus
aggagactggctccgctgcagccga

SEQ ID NO: 188624 - DNA, 25 bp, Mus musculus
aggagactggctgcgctgcagccga

SEQ ID NO: 188625 - DNA, 25 bp, Mus musculus
aggagactgggcagttccatcactc

SEQ ID NO: 188626 - DNA, 25 bp, Mus musculus
aggagactgggctgttccatcactc

SEQ ID NO: 188627 - DNA, 25 bp, Mus musculus
aggagactgggtcctgctgtgcagg

SEQ ID NO: 188628 - DNA, 25 bp, Mus musculus
aggagactgggtgctgctgtgcagg

SEQ ID NO: 188629 - DNA, 25 bp, Mus musculus
aggagactgtacagcatcctacggg

SEQ ID NO: 188630 - DNA, 25 bp, Mus musculus
aggagactgtactgcatcctacggg

SEQ ID NO: 188631 - DNA, 25 bp, Mus musculus
aggagactgtctccatccagtgctc

SEQ ID NO: 188632 - DNA, 25 bp, Mus musculus
aggagactgtctgcatccagtgctc

SEQ ID NO: 188633 - DNA, 25 bp, Mus musculus
aggagactgttcaggccaagtagaa

SEQ ID NO: 188634 - DNA, 25 bp, Mus musculus
aggagactgttctggccaagtagaa

SEQ ID NO: 188635 - DNA, 25 bp, Mus musculus
aggagacttaatagggatgccttag

SEQ ID NO: 188636 - DNA, 25 bp, Mus musculus
aggagacttaattgggatgccttag

SEQ ID NO: 188637 - DNA, 25 bp, Mus musculus
aggagacttaccaagcatgcgtgct

SEQ ID NO: 188638 - DNA, 25 bp, Mus musculus
aggagacttacctagcatgcgtgct

SEQ ID NO: 188639 - DNA, 25 bp, Mus musculus
aggagacttataacatgtttatgga

SEQ ID NO: 188640 - DNA, 25 bp, Mus musculus
aggagacttatatcatgtttatgga

SEQ ID NO: 188641 - DNA, 25 bp, Mus musculus
aggagacttccacagtccaagagcc

SEQ ID NO: 188642 - DNA, 25 bp, Mus musculus
aggagacttccagagtccaagagcc

SEQ ID NO: 188643 - DNA, 25 bp, Mus musculus
aggagacttcccatcagagtagcac

SEQ ID NO: 188644 - DNA, 25 bp, Mus musculus
aggagacttcccttcagagtagcac

SEQ ID NO: 188645 - DNA, 25 bp, Mus musculus
aggagacttcttcgtgacatttctg

SEQ ID NO: 188646 - DNA, 25 bp, Mus musculus
aggagacttcttggtgacatttctg

SEQ ID NO: 188647 - DNA, 25 bp, Mus musculus
aggagacttgccacttttcatgtca

SEQ ID NO: 188648 - DNA, 25 bp, Mus musculus
aggagacttgcctcttttcatgtca

SEQ ID NO: 188649 - DNA, 25 bp, Mus musculus
aggagagaagtcaccactggtccct

SEQ ID NO: 188650 - DNA, 25 bp, Mus musculus
aggagagaagtctccactggtccct

SEQ ID NO: 188651 - DNA, 25 bp, Mus musculus
aggagagacactaggctttaaaatc

SEQ ID NO: 188652 - DNA, 25 bp, Mus musculus
aggagagacacttggctttaaaatc

SEQ ID NO: 188653 - DNA, 25 bp, Mus musculus
aggagagacatgacaccagcattca

SEQ ID NO: 188654 - DNA, 25 bp, Mus musculus
aggagagacatgtcaccagcattca

SEQ ID NO: 188655 - DNA, 25 bp, Mus musculus
aggagagaccaacgcctacaagcta

SEQ ID NO: 188656 - DNA, 25 bp, Mus musculus
aggagagaccaaggcctacaagcta

SEQ ID NO: 188657 - DNA, 25 bp, Mus musculus
aggagagaccaccttttgcttggat

SEQ ID NO: 188658 - DNA, 25 bp, Mus musculus
aggagagaccacgttttgcttggat

SEQ ID NO: 188659 - DNA, 25 bp, Mus musculus
aggagagaccatcagccacacatca

SEQ ID NO: 188660 - DNA, 25 bp, Mus musculus
aggagagaccatgagccacacatca

SEQ ID NO: 188661 - DNA, 25 bp, Mus musculus
aggagagaccgaccagccacaagct

SEQ ID NO: 188662 - DNA, 25 bp, Mus musculus
aggagagaccgagcagccacaagct

SEQ ID NO: 188663 - DNA, 25 bp, Mus musculus
aggagagaccgtcatttctaactac

SEQ ID NO: 188664 - DNA, 25 bp, Mus musculus
aggagagaccgtgatttctaactac

SEQ ID NO: 188665 - DNA, 25 bp, Mus musculus
aggagagacctcagctgccccgtga

SEQ ID NO: 188666 - DNA, 25 bp, Mus musculus
aggagagacctctgctgccccgtga

SEQ ID NO: 188667 - DNA, 25 bp, Mus musculus
aggagagactacctcacggcagcat

SEQ ID NO: 188668 - DNA, 25 bp, Mus musculus
aggagagactacgtcacggcagcat

SEQ ID NO: 188669 - DNA, 25 bp, Mus musculus
aggagagactgccatcacgtagcac

SEQ ID NO: 188670 - DNA, 25 bp, Mus musculus
aggagagactgcgatcacgtagcac

SEQ ID NO: 188671 - DNA, 25 bp, Mus musculus
aggagagacttcatcaggactgagt

SEQ ID NO: 188672 - DNA, 25 bp, Mus musculus
aggagagacttcttcaggactgagt

SEQ ID NO: 188673 - DNA, 25 bp, Mus musculus
aggagagagagcacgcgagagcgca

SEQ ID NO: 188674 - DNA, 25 bp, Mus musculus
aggagagagagctcgcgagagcgca

SEQ ID NO: 188675 - DNA, 25 bp, Mus musculus
aggagagagatactattgtgcagaa

SEQ ID NO: 188676 - DNA, 25 bp, Mus musculus
aggagagagatagtattgtgcagaa

SEQ ID NO: 188677 - DNA, 25 bp, Mus musculus
aggagagagccccagctctacttgc

SEQ ID NO: 188678 - DNA, 25 bp, Mus musculus
aggagagagcccgagctctacttgc

SEQ ID NO: 188679 - DNA, 25 bp, Mus musculus
aggagagagcctcaactaagaagtt

SEQ ID NO: 188680 - DNA, 25 bp, Mus musculus
aggagagagcctcccacccatgatg

SEQ ID NO: 188681 - DNA, 25 bp, Mus musculus
aggagagagcctgaactaagaagtt

SEQ ID NO: 188682 - DNA, 25 bp, Mus musculus
aggagagagcctgccacccatgatg

SEQ ID NO: 188683 - DNA, 25 bp, Mus musculus
aggagagagcttattctgcaatgaa

SEQ ID NO: 188684 - DNA, 25 bp, Mus musculus
aggagagagctttttctgcaatgaa

SEQ ID NO: 188685 - DNA, 25 bp, Mus musculus
aggagagaggctaccgacacacagg

SEQ ID NO: 188686 - DNA, 25 bp, Mus musculus
aggagagaggcttccgacacacagg

SEQ ID NO: 188687 - DNA, 25 bp, Mus musculus
aggagagatcttaaacccctcaggg

SEQ ID NO: 188688 - DNA, 25 bp, Mus musculus
aggagagatctttaacccctcaggg

SEQ ID NO: 188689 - DNA, 25 bp, Mus musculus
aggagagatggcattctgtccctgt

SEQ ID NO: 188690 - DNA, 25 bp, Mus musculus
aggagagatggctttctgtccctgt

SEQ ID NO: 188691 - DNA, 25 bp, Mus musculus
aggagagattgcaaccatcctcgcc

SEQ ID NO: 188692 - DNA, 25 bp, Mus musculus
aggagagattgctaccatcctcgcc

SEQ ID NO: 188693 - DNA, 25 bp, Mus musculus
aggagagattgtacttgcctcccac

SEQ ID NO: 188694 - DNA, 25 bp, Mus musculus
aggagagattgttcttgcctcccac

SEQ ID NO: 188695 - DNA, 25 bp, Mus musculus
aggagagcacctctgctgaaaacat

SEQ ID NO: 188696 - DNA, 25 bp, Mus musculus
aggagagcacctgtgctgaaaacat

SEQ ID NO: 188697 - DNA, 25 bp, Mus musculus
aggagagcacgtatctaaccactgt

SEQ ID NO: 188698 - DNA, 25 bp, Mus musculus
aggagagcacgtttctaaccactgt

SEQ ID NO: 188699 - DNA, 25 bp, Mus musculus
aggagagcactccgcaggcatgttt

SEQ ID NO: 188700 - DNA, 25 bp, Mus musculus
aggagagcactcctagacatgtaaa

SEQ ID NO: 188701 - DNA, 25 bp, Mus musculus
aggagagcactcggcaggcatgttt

SEQ ID NO: 188702 - DNA, 25 bp, Mus musculus
aggagagcactcgtagacatgtaaa

SEQ ID NO: 188703 - DNA, 25 bp, Mus musculus
aggagagcagagacagcacgcccac

SEQ ID NO: 188704 - DNA, 25 bp, Mus musculus
aggagagcagagtcagcacgcccac

SEQ ID NO: 188705 - DNA, 25 bp, Mus musculus
aggagagcagtcatgccttggatcc

SEQ ID NO: 188706 - DNA, 25 bp, Mus musculus
aggagagcagtcttgccttggatcc

SEQ ID NO: 188707 - DNA, 25 bp, Mus musculus
aggagagcatatcacctgttctgtg

SEQ ID NO: 188708 - DNA, 25 bp, Mus musculus
aggagagcatatgacctgttctgtg

SEQ ID NO: 188709 - DNA, 25 bp, Mus musculus
aggagagcatgaaccgtcgcctgga

SEQ ID NO: 188710 - DNA, 25 bp, Mus musculus
aggagagcatgatccgtcgcctgga

SEQ ID NO: 188711 - DNA, 25 bp, Mus musculus
aggagagcatgtaccacgccttggg

SEQ ID NO: 188712 - DNA, 25 bp, Mus musculus
aggagagcatgttccacgccttggg

SEQ ID NO: 188713 - DNA, 25 bp, Mus musculus
aggagagccacaagcccacagagga

SEQ ID NO: 188714 - DNA, 25 bp, Mus musculus
aggagagccacatgcccacagagga

SEQ ID NO: 188715 - DNA, 25 bp, Mus musculus
aggagagccaccagggcactgctga

SEQ ID NO: 188716 - DNA, 25 bp, Mus musculus
aggagagccacctgggcactgctga

SEQ ID NO: 188717 - DNA, 25 bp, Mus musculus
aggagagccacgatcatccgggtga

SEQ ID NO: 188718 - DNA, 25 bp, Mus musculus
aggagagccacgttcatccgggtga

SEQ ID NO: 188719 - DNA, 25 bp, Mus musculus
aggagagccagccacagccctgtct

SEQ ID NO: 188720 - DNA, 25 bp, Mus musculus
aggagagccagcgacagccctgtct

SEQ ID NO: 188721 - DNA, 25 bp, Mus musculus
aggagagccaggaccagctggccac

SEQ ID NO: 188722 - DNA, 25 bp, Mus musculus
aggagagccaggtccagctggccac

SEQ ID NO: 188723 - DNA, 25 bp, Mus musculus
aggagagcccagacaccagggctgc

SEQ ID NO: 188724 - DNA, 25 bp, Mus musculus
aggagagcccagtcaccagggctgc

SEQ ID NO: 188725 - DNA, 25 bp, Mus musculus
aggagagcccctcgtctattctaat

SEQ ID NO: 188726 - DNA, 25 bp, Mus musculus
aggagagcccctggtctattctaat

SEQ ID NO: 188727 - DNA, 25 bp, Mus musculus
aggagagcccgcacttcaggacgaa

SEQ ID NO: 188728 - DNA, 25 bp, Mus musculus
aggagagcccgcatttcaacaacgt

SEQ ID NO: 188729 - DNA, 25 bp, Mus musculus
aggagagcccgctcttcaggacgaa

SEQ ID NO: 188730 - DNA, 25 bp, Mus musculus
aggagagcccgcttttcaacaacgt

SEQ ID NO: 188731 - DNA, 25 bp, Mus musculus
aggagagcccggaggtccacacaga

SEQ ID NO: 188732 - DNA, 25 bp, Mus musculus
aggagagcccggtggtccacacaga

SEQ ID NO: 188733 - DNA, 25 bp, Mus musculus
aggagagccgtcagtggttccacaa

SEQ ID NO: 188734 - DNA, 25 bp, Mus musculus
aggagagccgtctgtggttccacaa

SEQ ID NO: 188735 - DNA, 25 bp, Mus musculus
aggagagcctctcgagcctcgctga

SEQ ID NO: 188736 - DNA, 25 bp, Mus musculus
aggagagcctctggagcctcgctga

SEQ ID NO: 188737 - DNA, 25 bp, Mus musculus
aggagagcctgcaggatcacttgtg

SEQ ID NO: 188738 - DNA, 25 bp, Mus musculus
aggagagcctgctggatcacttgtg

SEQ ID NO: 188739 - DNA, 25 bp, Mus musculus
aggagagcgctgaccctctgacaga

SEQ ID NO: 188740 - DNA, 25 bp, Mus musculus
aggagagcgctgtccctctgacaga

SEQ ID NO: 188741 - DNA, 25 bp, Mus musculus
aggagagctcacagacccgaagcta

SEQ ID NO: 188742 - DNA, 25 bp, Mus musculus
aggagagctcactgacccgaagcta

SEQ ID NO: 188743 - DNA, 25 bp, Mus musculus
aggagagctcagaacagcctcgtga

SEQ ID NO: 188744 - DNA, 25 bp, Mus musculus
aggagagctcagtacagcctcgtga

SEQ ID NO: 188745 - DNA, 25 bp, Mus musculus
aggagagctcataccacaaggccaa

SEQ ID NO: 188746 - DNA, 25 bp, Mus musculus
aggagagctcattccacaaggccaa

SEQ ID NO: 188747 - DNA, 25 bp, Mus musculus
aggagagctcccaagggcctgtgct

SEQ ID NO: 188748 - DNA, 25 bp, Mus musculus
aggagagctccctagggcctgtgct

SEQ ID NO: 188749 - DNA, 25 bp, Mus musculus
aggagagctggaacctcctttgttc

SEQ ID NO: 188750 - DNA, 25 bp, Mus musculus
aggagagctggatcctcctttgttc

SEQ ID NO: 188751 - DNA, 25 bp, Mus musculus
aggagagctggtcttctacgagcct

SEQ ID NO: 188752 - DNA, 25 bp, Mus musculus
aggagagctggtgttctacgagcct

SEQ ID NO: 188753 - DNA, 25 bp, Mus musculus
aggagaggaaacaacatgccacacc

SEQ ID NO: 188754 - DNA, 25 bp, Mus musculus
aggagaggaaactacatgccacacc

SEQ ID NO: 188755 - DNA, 25 bp, Mus musculus
aggagaggagacattgaccccatct

SEQ ID NO: 188756 - DNA, 25 bp, Mus musculus
aggagaggagactttgaccccatct

SEQ ID NO: 188757 - DNA, 25 bp, Mus musculus
aggagaggcagaatttcccttccct

SEQ ID NO: 188758 - DNA, 25 bp, Mus musculus
aggagaggcagattttcccttccct

SEQ ID NO: 188759 - DNA, 25 bp, Mus musculus
aggagaggcctgacatttccaaagg

SEQ ID NO: 188760 - DNA, 25 bp, Mus musculus
aggagaggcctgtcatttccaaagg

SEQ ID NO: 188761 - DNA, 25 bp, Mus musculus
aggagaggcgttaggttcacctgtc

SEQ ID NO: 188762 - DNA, 25 bp, Mus musculus
aggagaggcgtttggttcacctgtc

SEQ ID NO: 188763 - DNA, 25 bp, Mus musculus
aggagaggctgcaaagatcctagct

SEQ ID NO: 188764 - DNA, 25 bp, Mus musculus
aggagaggctgcaatcatcgcccgg

SEQ ID NO: 188765 - DNA, 25 bp, Mus musculus
aggagaggctgctaagatcctagct

SEQ ID NO: 188766 - DNA, 25 bp, Mus musculus
aggagaggctgctatcatcgcccgg

SEQ ID NO: 188767 - DNA, 25 bp, Mus musculus
aggagagggaccaacgctcaaatct

SEQ ID NO: 188768 - DNA, 25 bp, Mus musculus
aggagagggacctacgctcaaatct

SEQ ID NO: 188769 - DNA, 25 bp, Mus musculus
aggagagggattccccatgtagcac

SEQ ID NO: 188770 - DNA, 25 bp, Mus musculus
aggagagggattgcccatgtagcac

SEQ ID NO: 188771 - DNA, 25 bp, Mus musculus
aggagagggcccaccgaagacagat

SEQ ID NO: 188772 - DNA, 25 bp, Mus musculus
aggagagggccctccgaagacagat

SEQ ID NO: 188773 - DNA, 25 bp, Mus musculus
aggagagggcctatttcaactcaca

SEQ ID NO: 188774 - DNA, 25 bp, Mus musculus
aggagagggcctttttcaactcaca

SEQ ID NO: 188775 - DNA, 25 bp, Mus musculus
aggagagggtctcactccgcaccag

SEQ ID NO: 188776 - DNA, 25 bp, Mus musculus
aggagagggtctgactccgcaccag

SEQ ID NO: 188777 - DNA, 25 bp, Mus musculus
aggagaggtcgtcatcatcccttac

SEQ ID NO: 188778 - DNA, 25 bp, Mus musculus
aggagaggtcgtgatcatcccttac

SEQ ID NO: 188779 - DNA, 25 bp, Mus musculus
aggagaggtctccacggctgtccac

SEQ ID NO: 188780 - DNA, 25 bp, Mus musculus
aggagaggtctcgacggctgtccac

SEQ ID NO: 188781 - DNA, 25 bp, Mus musculus
aggagaggtctgctcttcatactgt

SEQ ID NO: 188782 - DNA, 25 bp, Mus musculus
aggagaggtctggtcttcatactgt

SEQ ID NO: 188783 - DNA, 25 bp, Mus musculus
aggagaggttctctctagtttctca

SEQ ID NO: 188784 - DNA, 25 bp, Mus musculus
aggagaggttctgtctagtttctca

SEQ ID NO: 188785 - DNA, 25 bp, Mus musculus
aggagaggtttgatcatttacacaa

SEQ ID NO: 188786 - DNA, 25 bp, Mus musculus
aggagaggtttgttcatttacacaa

SEQ ID NO: 188787 - DNA, 25 bp, Mus musculus
aggagagtaagcattatacactaat

SEQ ID NO: 188788 - DNA, 25 bp, Mus musculus
aggagagtaagctttatacactaat

SEQ ID NO: 188789 - DNA, 25 bp, Mus musculus
aggagagtaaggacctttgcagtgc

SEQ ID NO: 188790 - DNA, 25 bp, Mus musculus
aggagagtaaggtcctttgcagtgc

SEQ ID NO: 188791 - DNA, 25 bp, Mus musculus
aggagagtacagctccagctctttc

SEQ ID NO: 188792 - DNA, 25 bp, Mus musculus
aggagagtacaggtccagctctttc

SEQ ID NO: 188793 - DNA, 25 bp, Mus musculus
aggagagtcaccctttttgcctaag

SEQ ID NO: 188794 - DNA, 25 bp, Mus musculus
aggagagtcaccgtttttgcctaag

SEQ ID NO: 188795 - DNA, 25 bp, Mus musculus
aggagagtcacgagacccacataac

SEQ ID NO: 188796 - DNA, 25 bp, Mus musculus
aggagagtcacgtgacccacataac

SEQ ID NO: 188797 - DNA, 25 bp, Mus musculus
aggagagtcctgctatcttcatcct

SEQ ID NO: 188798 - DNA, 25 bp, Mus musculus
aggagagtcctggtatcttcatcct

SEQ ID NO: 188799 - DNA, 25 bp, Mus musculus
aggagagtcgcaaccaggcggtcaa

SEQ ID NO: 188800 - DNA, 25 bp, Mus musculus
aggagagtcgcatccaggcggtcaa

SEQ ID NO: 188801 - DNA, 25 bp, Mus musculus
aggagagtcgctacctacgggccgt

SEQ ID NO: 188802 - DNA, 25 bp, Mus musculus
aggagagtcgcttcctacgggccgt

SEQ ID NO: 188803 - DNA, 25 bp, Mus musculus
aggagagtcggaagccgcgtcccct

SEQ ID NO: 188804 - DNA, 25 bp, Mus musculus
aggagagtcggatgccgcgtcccct

SEQ ID NO: 188805 - DNA, 25 bp, Mus musculus
aggagagtctaaatcgcttctgccc

SEQ ID NO: 188806 - DNA, 25 bp, Mus musculus
aggagagtctaattcgcttctgccc

SEQ ID NO: 188807 - DNA, 25 bp, Mus musculus
aggagagtctcgatatttgcccctt

SEQ ID NO: 188808 - DNA, 25 bp, Mus musculus
aggagagtctcgctctgttcagcac

SEQ ID NO: 188809 - DNA, 25 bp, Mus musculus
aggagagtctcggtctgttcagcac

SEQ ID NO: 188810 - DNA, 25 bp, Mus musculus
aggagagtctcgttatttgcccctt

SEQ ID NO: 188811 - DNA, 25 bp, Mus musculus
aggagagtctctctgtgttctctgc

SEQ ID NO: 188812 - DNA, 25 bp, Mus musculus
aggagagtctctgtgtgttctctgc

SEQ ID NO: 188813 - DNA, 25 bp, Mus musculus
aggagagtctgcctcagtctctgat

SEQ ID NO: 188814 - DNA, 25 bp, Mus musculus
aggagagtctgcgtcagtctctgat

SEQ ID NO: 188815 - DNA, 25 bp, Mus musculus
aggagagtctgtccattgctgcctc

SEQ ID NO: 188816 - DNA, 25 bp, Mus musculus
aggagagtctgtgcattgctgcctc

SEQ ID NO: 188817 - DNA, 25 bp, Mus musculus
aggagagtcttcactacagcctgca

SEQ ID NO: 188818 - DNA, 25 bp, Mus musculus
aggagagtcttctctacagcctgca

SEQ ID NO: 188819 - DNA, 25 bp, Mus musculus
aggagagtgcagacaccttgagtgt

SEQ ID NO: 188820 - DNA, 25 bp, Mus musculus
aggagagtgcagtcaccttgagtgt

SEQ ID NO: 188821 - DNA, 25 bp, Mus musculus
aggagagtgctcagaagccctcata

SEQ ID NO: 188822 - DNA, 25 bp, Mus musculus
aggagagtgctctgaagccctcata

SEQ ID NO: 188823 - DNA, 25 bp, Mus musculus
aggagagtgtatcccttgcttccca

SEQ ID NO: 188824 - DNA, 25 bp, Mus musculus
aggagagtgtatgccttgcttccca

SEQ ID NO: 188825 - DNA, 25 bp, Mus musculus
aggagagttatcaatcatggacagg

SEQ ID NO: 188826 - DNA, 25 bp, Mus musculus
aggagagttatctatcatggacagg

SEQ ID NO: 188827 - DNA, 25 bp, Mus musculus
aggagagttcctctcaccttgggag

SEQ ID NO: 188828 - DNA, 25 bp, Mus musculus
aggagagttcctgtcaccttgggag

SEQ ID NO: 188829 - DNA, 25 bp, Mus musculus
aggagagttcggactggctagtatt

SEQ ID NO: 188830 - DNA, 25 bp, Mus musculus
aggagagttcggtctggctagtatt

SEQ ID NO: 188831 - DNA, 25 bp, Mus musculus
aggagagttgctatgactactgaac

SEQ ID NO: 188832 - DNA, 25 bp, Mus musculus
aggagagttgctttgactactgaac

SEQ ID NO: 188833 - DNA, 25 bp, Mus musculus
aggagagtttcacccctcgtgtgac

SEQ ID NO: 188834 - DNA, 25 bp, Mus musculus
aggagagtttcagccctcgtgtgac

SEQ ID NO: 188835 - DNA, 25 bp, Mus musculus
aggagataccgtctacagggtagat

SEQ ID NO: 188836 - DNA, 25 bp, Mus musculus
aggagataccgtgtacagggtagat

SEQ ID NO: 188837 - DNA, 25 bp, Mus musculus
aggagatactgacctcatcaccctc

SEQ ID NO: 188838 - DNA, 25 bp, Mus musculus
aggagatactgagctcatcaccctc

SEQ ID NO: 188839 - DNA, 25 bp, Mus musculus
aggagatatctactccagcaagacc

SEQ ID NO: 188840 - DNA, 25 bp, Mus musculus
aggagatatctagtccagcaagacc

SEQ ID NO: 188841 - DNA, 25 bp, Mus musculus
aggagatatggtcccctattcagac

SEQ ID NO: 188842 - DNA, 25 bp, Mus musculus
aggagatatggtgccctattcagac

SEQ ID NO: 188843 - DNA, 25 bp, Mus musculus
aggagatcaaccacttgccagcagc

SEQ ID NO: 188844 - DNA, 25 bp, Mus musculus
aggagatcaacctcttgccagcagc

SEQ ID NO: 188845 - DNA, 25 bp, Mus musculus
aggagatcaatcctttcttcctggg

SEQ ID NO: 188846 - DNA, 25 bp, Mus musculus
aggagatcaatcgtttcttcctggg

SEQ ID NO: 188847 - DNA, 25 bp, Mus musculus
aggagatcaccaccttcatcgatga

SEQ ID NO: 188848 - DNA, 25 bp, Mus musculus
aggagatcaccagcttcatcgatga

SEQ ID NO: 188849 - DNA, 25 bp, Mus musculus
aggagatcacctatgaagcactgaa

SEQ ID NO: 188850 - DNA, 25 bp, Mus musculus
aggagatcacctccctcgcggacag

SEQ ID NO: 188851 - DNA, 25 bp, Mus musculus
aggagatcacctgcctcgcggacag

SEQ ID NO: 188852 - DNA, 25 bp, Mus musculus
aggagatcacctttgaagcactgaa

SEQ ID NO: 188853 - DNA, 25 bp, Mus musculus
aggagatcatcccaatagcagacag

SEQ ID NO: 188854 - DNA, 25 bp, Mus musculus
aggagatcatccgaatagcagacag

SEQ ID NO: 188855 - DNA, 25 bp, Mus musculus
aggagatcatgcagcaccggttctt

SEQ ID NO: 188856 - DNA, 25 bp, Mus musculus
aggagatcatgctgcaccggttctt

SEQ ID NO: 188857 - DNA, 25 bp, Mus musculus
aggagatccacacacttgccaaaga

SEQ ID NO: 188858 - DNA, 25 bp, Mus musculus
aggagatccacagacttgccaaaga

SEQ ID NO: 188859 - DNA, 25 bp, Mus musculus
aggagatcccaaatccagtcaactt

SEQ ID NO: 188860 - DNA, 25 bp, Mus musculus
aggagatcccaattccagtcaactt

SEQ ID NO: 188861 - DNA, 25 bp, Mus musculus
aggagatcccagagctggtcagttt

SEQ ID NO: 188862 - DNA, 25 bp, Mus musculus
aggagatcccagtgctggtcagttt

SEQ ID NO: 188863 - DNA, 25 bp, Mus musculus
aggagatcccgcagctcgtgctgga

SEQ ID NO: 188864 - DNA, 25 bp, Mus musculus
aggagatcccgctgctcgtgctgga

SEQ ID NO: 188865 - DNA, 25 bp, Mus musculus
aggagatccctcaactgctggacgc

SEQ ID NO: 188866 - DNA, 25 bp, Mus musculus
aggagatccctctactgctggacgc

SEQ ID NO: 188867 - DNA, 25 bp, Mus musculus
aggagatcccttcatatcctctatt

SEQ ID NO: 188868 - DNA, 25 bp, Mus musculus
aggagatcccttgatatcctctatt

SEQ ID NO: 188869 - DNA, 25 bp, Mus musculus
aggagatccgcgacggctttgccga

SEQ ID NO: 188870 - DNA, 25 bp, Mus musculus
aggagatccgcgagggtcacagaca

SEQ ID NO: 188871 - DNA, 25 bp, Mus musculus
aggagatccgcgtcggctttgccga

SEQ ID NO: 188872 - DNA, 25 bp, Mus musculus
aggagatccgcgtgggtcacagaca

SEQ ID NO: 188873 - DNA, 25 bp, Mus musculus
aggagatccggcagcgcattcttcg

SEQ ID NO: 188874 - DNA, 25 bp, Mus musculus
aggagatccggctgcgcattcttcg

SEQ ID NO: 188875 - DNA, 25 bp, Mus musculus
aggagatcctatcagcaagcaactg

SEQ ID NO: 188876 - DNA, 25 bp, Mus musculus
aggagatcctatgagcaagcaactg

SEQ ID NO: 188877 - DNA, 25 bp, Mus musculus
aggagatcctggacccaacctgacc

SEQ ID NO: 188878 - DNA, 25 bp, Mus musculus
aggagatcctggtcccaacctgacc

SEQ ID NO: 188879 - DNA, 25 bp, Mus musculus
aggagatcgaaaaagcaagcacctt

SEQ ID NO: 188880 - DNA, 25 bp, Mus musculus
aggagatcgaaatagcaagcacctt

SEQ ID NO: 188881 - DNA, 25 bp, Mus musculus
aggagatcgaagagcccacctctgt

SEQ ID NO: 188882 - DNA, 25 bp, Mus musculus
aggagatcgaagtgcccacctctgt

SEQ ID NO: 188883 - DNA, 25 bp, Mus musculus
aggagatcgcccaggtacacagcaa

SEQ ID NO: 188884 - DNA, 25 bp, Mus musculus
aggagatcgccctggtacacagcaa

SEQ ID NO: 188885 - DNA, 25 bp, Mus musculus
aggagatcgtgcaattcattgggat

SEQ ID NO: 188886 - DNA, 25 bp, Mus musculus
aggagatcgtgctattcattgggat

SEQ ID NO: 188887 - DNA, 25 bp, Mus musculus
aggagatctcacaccctgatactca

SEQ ID NO: 188888 - DNA, 25 bp, Mus musculus
aggagatctcactccctgatactca

SEQ ID NO: 188889 - DNA, 25 bp, Mus musculus
aggagatctcctcgctggcagacag

SEQ ID NO: 188890 - DNA, 25 bp, Mus musculus
aggagatctcctggctggcagacag

SEQ ID NO: 188891 - DNA, 25 bp, Mus musculus
aggagatctctgcacaatgtgaaca

SEQ ID NO: 188892 - DNA, 25 bp, Mus musculus
aggagatctctggacaatgtgaaca

SEQ ID NO: 188893 - DNA, 25 bp, Mus musculus
aggagatctgacctttgccagcccc

SEQ ID NO: 188894 - DNA, 25 bp, Mus musculus
aggagatctgacgtttgccagcccc

SEQ ID NO: 188895 - DNA, 25 bp, Mus musculus
aggagatctgagaacaggctgctgt

SEQ ID NO: 188896 - DNA, 25 bp, Mus musculus
aggagatctgagtacaggctgctgt

SEQ ID NO: 188897 - DNA, 25 bp, Mus musculus
aggagatctgttatatgtcaataaa

SEQ ID NO: 188898 - DNA, 25 bp, Mus musculus
aggagatctgttttatgtcaataaa

SEQ ID NO: 188899 - DNA, 25 bp, Mus musculus
aggagatgacccagccatagcttgc

SEQ ID NO: 188900 - DNA, 25 bp, Mus musculus
aggagatgaccctgccatagcttgc

SEQ ID NO: 188901 - DNA, 25 bp, Mus musculus
aggagatgaccgacaacaggaaccg

SEQ ID NO: 188902 - DNA, 25 bp, Mus musculus
aggagatgaccgtcaacaggaaccg

SEQ ID NO: 188903 - DNA, 25 bp, Mus musculus
aggagatgacctagaagcagtttct

SEQ ID NO: 188904 - DNA, 25 bp, Mus musculus
aggagatgaccttgaagcagtttct

SEQ ID NO: 188905 - DNA, 25 bp, Mus musculus
aggagatgcaacacacctgggtgtg

SEQ ID NO: 188906 - DNA, 25 bp, Mus musculus
aggagatgcaactcacctgggtgtg

SEQ ID NO: 188907 - DNA, 25 bp, Mus musculus
aggagatgcagacccgattccactt

SEQ ID NO: 188908 - DNA, 25 bp, Mus musculus
aggagatgcagagccgattccactt

SEQ ID NO: 188909 - DNA, 25 bp, Mus musculus
aggagatgcagcctacgcatccaat

SEQ ID NO: 188910 - DNA, 25 bp, Mus musculus
aggagatgcagcgtacgcatccaat

SEQ ID NO: 188911 - DNA, 25 bp, Mus musculus
aggagatgctctcgcagcacagtga

SEQ ID NO: 188912 - DNA, 25 bp, Mus musculus
aggagatgctctggcagcacagtga

SEQ ID NO: 188913 - DNA, 25 bp, Mus musculus
aggagatggaatacctcccggctgc

SEQ ID NO: 188914 - DNA, 25 bp, Mus musculus
aggagatggaattcctcccggctgc

SEQ ID NO: 188915 - DNA, 25 bp, Mus musculus
aggagatggccaatgcttccctcac

SEQ ID NO: 188916 - DNA, 25 bp, Mus musculus
aggagatggccattgcttccctcac

SEQ ID NO: 188917 - DNA, 25 bp, Mus musculus
aggagatgggacctttactctgctt

SEQ ID NO: 188918 - DNA, 25 bp, Mus musculus
aggagatgggacgtttactctgctt

SEQ ID NO: 188919 - DNA, 25 bp, Mus musculus
aggagatgttccaggactacagagc

SEQ ID NO: 188920 - DNA, 25 bp, Mus musculus
aggagatgttcctggactacagagc

SEQ ID NO: 188921 - DNA, 25 bp, Mus musculus
aggagatgttctcttgttccaactt

SEQ ID NO: 188922 - DNA, 25 bp, Mus musculus
aggagatgttctgttgttccaactt

SEQ ID NO: 188923 - DNA, 25 bp, Mus musculus
aggagattaaggcttggatcccaaa

SEQ ID NO: 188924 - DNA, 25 bp, Mus musculus
aggagattaagggttggatcccaaa

SEQ ID NO: 188925 - DNA, 25 bp, Mus musculus
aggagattactgctatacatttttg

SEQ ID NO: 188926 - DNA, 25 bp, Mus musculus
aggagattactggtatacatttttg

SEQ ID NO: 188927 - DNA, 25 bp, Mus musculus
aggagattccatatattccctaggg

SEQ ID NO: 188928 - DNA, 25 bp, Mus musculus
aggagattccatttattccctaggg

SEQ ID NO: 188929 - DNA, 25 bp, Mus musculus
aggagattcctaccgagccaatgca

SEQ ID NO: 188930 - DNA, 25 bp, Mus musculus
aggagattcctagcgagccaatgca

SEQ ID NO: 188931 - DNA, 25 bp, Mus musculus
aggagattcctcaggtcttttctgc

SEQ ID NO: 188932 - DNA, 25 bp, Mus musculus
aggagattcctctggtcttttctgc

SEQ ID NO: 188933 - DNA, 25 bp, Mus musculus
aggagattcgcaaggccatgactaa

SEQ ID NO: 188934 - DNA, 25 bp, Mus musculus
aggagattcgcacttactccaccca

SEQ ID NO: 188935 - DNA, 25 bp, Mus musculus
aggagattcgcagttactccaccca

SEQ ID NO: 188936 - DNA, 25 bp, Mus musculus
aggagattcgcatggccatgactaa

SEQ ID NO: 188937 - DNA, 25 bp, Mus musculus
aggagattctccctttggattgagt

SEQ ID NO: 188938 - DNA, 25 bp, Mus musculus
aggagattctccgtttggattgagt

SEQ ID NO: 188939 - DNA, 25 bp, Mus musculus
aggagattgatcagcttaatgacct

SEQ ID NO: 188940 - DNA, 25 bp, Mus musculus
aggagattgatctgcttaatgacct

SEQ ID NO: 188941 - DNA, 25 bp, Mus musculus
aggagattgcagaaccaggatttca

SEQ ID NO: 188942 - DNA, 25 bp, Mus musculus
aggagattgcagtaccaggatttca

SEQ ID NO: 188943 - DNA, 25 bp, Mus musculus
aggagattgccaccttcctaaagtt

SEQ ID NO: 188944 - DNA, 25 bp, Mus musculus
aggagattgccagcttcctaaagtt

SEQ ID NO: 188945 - DNA, 25 bp, Mus musculus
aggagattgccccaagttggctgct

SEQ ID NO: 188946 - DNA, 25 bp, Mus musculus
aggagattgcccgaagttggctgct

SEQ ID NO: 188947 - DNA, 25 bp, Mus musculus
aggagattgtgcacagactttcaaa

SEQ ID NO: 188948 - DNA, 25 bp, Mus musculus
aggagattgtgctcagactttcaaa

SEQ ID NO: 188949 - DNA, 25 bp, Mus musculus
aggagatttagtcgacttcgcccgt

SEQ ID NO: 188950 - DNA, 25 bp, Mus musculus
aggagatttagtggacttcgcccgt

SEQ ID NO: 188951 - DNA, 25 bp, Mus musculus
aggagatttccgagtgtgccaatgt

SEQ ID NO: 188952 - DNA, 25 bp, Mus musculus
aggagatttccgtgtgtgccaatgt

SEQ ID NO: 188953 - DNA, 25 bp, Mus musculus
aggagatttcctacaagctgggaga

SEQ ID NO: 188954 - DNA, 25 bp, Mus musculus
aggagatttccttcaagctgggaga

SEQ ID NO: 188955 - DNA, 25 bp, Mus musculus
aggagcaaagttccccatatctaga

SEQ ID NO: 188956 - DNA, 25 bp, Mus musculus
aggagcaaagttgcccatatctaga

SEQ ID NO: 188957 - DNA, 25 bp, Mus musculus
aggagcaaatcaacttggcgccatc

SEQ ID NO: 188958 - DNA, 25 bp, Mus musculus
aggagcaaatcatcttggcgccatc

SEQ ID NO: 188959 - DNA, 25 bp, Mus musculus
aggagcaaatccacaagcagcgccg

SEQ ID NO: 188960 - DNA, 25 bp, Mus musculus
aggagcaaatcctcaagcagcgccg

SEQ ID NO: 188961 - DNA, 25 bp, Mus musculus
aggagcaaatctactgtgtacccca

SEQ ID NO: 188962 - DNA, 25 bp, Mus musculus
aggagcaaatcttctgtgtacccca

SEQ ID NO: 188963 - DNA, 25 bp, Mus musculus
aggagcaactacagggaccaggccc

SEQ ID NO: 188964 - DNA, 25 bp, Mus musculus
aggagcaactactgggaccaggccc

SEQ ID NO: 188965 - DNA, 25 bp, Mus musculus
aggagcaactctcaagcctttctgc

SEQ ID NO: 188966 - DNA, 25 bp, Mus musculus
aggagcaactctgaagcctttctgc

SEQ ID NO: 188967 - DNA, 25 bp, Mus musculus
aggagcaactttcagccagaggcat

SEQ ID NO: 188968 - DNA, 25 bp, Mus musculus
aggagcaactttgagccagaggcat

SEQ ID NO: 188969 - DNA, 25 bp, Mus musculus
aggagcaagagacccagattagcaa

SEQ ID NO: 188970 - DNA, 25 bp, Mus musculus
aggagcaagagagccagattagcaa

SEQ ID NO: 188971 - DNA, 25 bp, Mus musculus
aggagcaagagcagaactcctgctg

SEQ ID NO: 188972 - DNA, 25 bp, Mus musculus
aggagcaagagctgaactcctgctg

SEQ ID NO: 188973 - DNA, 25 bp, Mus musculus
aggagcaagaggagcccctgtatga

SEQ ID NO: 188974 - DNA, 25 bp, Mus musculus
aggagcaagaggtgcccctgtatga

SEQ ID NO: 188975 - DNA, 25 bp, Mus musculus
aggagcaagcgacgcccccgcagaa

SEQ ID NO: 188976 - DNA, 25 bp, Mus musculus
aggagcaagcgaggcccccgcagaa

SEQ ID NO: 188977 - DNA, 25 bp, Mus musculus
aggagcaatactaccagttccttgc

SEQ ID NO: 188978 - DNA, 25 bp, Mus musculus
aggagcaatacttccagttccttgc

SEQ ID NO: 188979 - DNA, 25 bp, Mus musculus
aggagcaatggacccacactgacga

SEQ ID NO: 188980 - DNA, 25 bp, Mus musculus
aggagcaatggagccacactgacga

SEQ ID NO: 188981 - DNA, 25 bp, Mus musculus
aggagcaattccctgagatcctcag

SEQ ID NO: 188982 - DNA, 25 bp, Mus musculus
aggagcaattccgtgagatcctcag

SEQ ID NO: 188983 - DNA, 25 bp, Mus musculus
aggagcaattggaggtctgtctttc

SEQ ID NO: 188984 - DNA, 25 bp, Mus musculus
aggagcaattggtggtctgtctttc

SEQ ID NO: 188985 - DNA, 25 bp, Mus musculus
aggagcaattttctcactgttccct

SEQ ID NO: 188986 - DNA, 25 bp, Mus musculus
aggagcaattttgtcactgttccct

SEQ ID NO: 188987 - DNA, 25 bp, Mus musculus
aggagcacaaagctacagtgacttt

SEQ ID NO: 188988 - DNA, 25 bp, Mus musculus
aggagcacaaaggtacagtgacttt

SEQ ID NO: 188989 - DNA, 25 bp, Mus musculus
aggagcacacgtcttggcctctctg

SEQ ID NO: 188990 - DNA, 25 bp, Mus musculus
aggagcacacgtgttggcctctctg

SEQ ID NO: 188991 - DNA, 25 bp, Mus musculus
aggagcacagcaaagcactcctggt

SEQ ID NO: 188992 - DNA, 25 bp, Mus musculus
aggagcacagcatagcactcctggt

SEQ ID NO: 188993 - DNA, 25 bp, Mus musculus
aggagcacagctcatctctctgtta

SEQ ID NO: 188994 - DNA, 25 bp, Mus musculus
aggagcacagctgatctctctgtta

SEQ ID NO: 188995 - DNA, 25 bp, Mus musculus
aggagcacaggcagatcgggaccct

SEQ ID NO: 188996 - DNA, 25 bp, Mus musculus
aggagcacaggctgatcgggaccct

SEQ ID NO: 188997 - DNA, 25 bp, Mus musculus
aggagcacagtgcagccatctcttg

SEQ ID NO: 188998 - DNA, 25 bp, Mus musculus
aggagcacagtggagccatctcttg

SEQ ID NO: 188999 - DNA, 25 bp, Mus musculus
aggagcacatccaagaactggtccc

SEQ ID NO: 189000 - DNA, 25 bp, Mus musculus
aggagcacatcctagaactggtccc

SEQ ID NO: 189001 - DNA, 25 bp, Mus musculus
aggagcacatgacacacgccagggt

SEQ ID NO: 189002 - DNA, 25 bp, Mus musculus
aggagcacatgagacacgccagggt

SEQ ID NO: 189003 - DNA, 25 bp, Mus musculus
aggagcaccatcactttggtttacc

SEQ ID NO: 189004 - DNA, 25 bp, Mus musculus
aggagcaccatctctttggtttacc

SEQ ID NO: 189005 - DNA, 25 bp, Mus musculus
aggagcaccctgagctgctcaccga

SEQ ID NO: 189006 - DNA, 25 bp, Mus musculus
aggagcaccctgtgctgctcaccga

SEQ ID NO: 189007 - DNA, 25 bp, Mus musculus
aggagcaccgacaggcatgagaaat

SEQ ID NO: 189008 - DNA, 25 bp, Mus musculus
aggagcaccgactggcatgagaaat

SEQ ID NO: 189009 - DNA, 25 bp, Mus musculus
aggagcaccgcgacttccaggagga

SEQ ID NO: 189010 - DNA, 25 bp, Mus musculus
aggagcaccgcgtcttccaggagga

SEQ ID NO: 189011 - DNA, 25 bp, Mus musculus
aggagcacctagagtcagctggcta

SEQ ID NO: 189012 - DNA, 25 bp, Mus musculus
aggagcacctagtgtcagctggcta

SEQ ID NO: 189013 - DNA, 25 bp, Mus musculus
aggagcacctccatgtcttctggga

SEQ ID NO: 189014 - DNA, 25 bp, Mus musculus
aggagcacctccttgtcttctggga

SEQ ID NO: 189015 - DNA, 25 bp, Mus musculus
aggagcacctctcctggattatctt

SEQ ID NO: 189016 - DNA, 25 bp, Mus musculus
aggagcacctctgctggattatctt

SEQ ID NO: 189017 - DNA, 25 bp, Mus musculus
aggagcacgcacctgtaccttggct

SEQ ID NO: 189018 - DNA, 25 bp, Mus musculus
aggagcacgcacgtgtaccttggct

SEQ ID NO: 189019 - DNA, 25 bp, Mus musculus
aggagcacgtcactcagtcgctcag

SEQ ID NO: 189020 - DNA, 25 bp, Mus musculus
aggagcacgtcagtcagtcgctcag

SEQ ID NO: 189021 - DNA, 25 bp, Mus musculus
aggagcacgtgtcaaccgtcttcgt

SEQ ID NO: 189022 - DNA, 25 bp, Mus musculus
aggagcacgtgtgaaccgtcttcgt

SEQ ID NO: 189023 - DNA, 25 bp, Mus musculus
aggagcactcctatgaggccagagg

SEQ ID NO: 189024 - DNA, 25 bp, Mus musculus
aggagcactcctttgaggccagagg

SEQ ID NO: 189025 - DNA, 25 bp, Mus musculus
aggagcacttgccacagggttacaa

SEQ ID NO: 189026 - DNA, 25 bp, Mus musculus
aggagcacttgcgacagggttacaa

SEQ ID NO: 189027 - DNA, 25 bp, Mus musculus
aggagcagaaacagttgcatatttc

SEQ ID NO: 189028 - DNA, 25 bp, Mus musculus
aggagcagaaactgttgcatatttc

SEQ ID NO: 189029 - DNA, 25 bp, Mus musculus
aggagcagaactcacccatctatat

SEQ ID NO: 189030 - DNA, 25 bp, Mus musculus
aggagcagaactgacccatctatat

SEQ ID NO: 189031 - DNA, 25 bp, Mus musculus
aggagcagacggacccgatcccggt

SEQ ID NO: 189032 - DNA, 25 bp, Mus musculus
aggagcagacggtcccgatcccggt

SEQ ID NO: 189033 - DNA, 25 bp, Mus musculus
aggagcagacgtatctctcttggtg

SEQ ID NO: 189034 - DNA, 25 bp, Mus musculus
aggagcagacgtcccgcgcagggca

SEQ ID NO: 189035 - DNA, 25 bp, Mus musculus
aggagcagacgtgccgcgcagggca

SEQ ID NO: 189036 - DNA, 25 bp, Mus musculus
aggagcagacgtttctctcttggtg

SEQ ID NO: 189037 - DNA, 25 bp, Mus musculus
aggagcagaggcacgcgtctgtcta

SEQ ID NO: 189038 - DNA, 25 bp, Mus musculus
aggagcagaggctcgcgtctgtcta

SEQ ID NO: 189039 - DNA, 25 bp, Mus musculus
aggagcagagggaccagcaccttct

SEQ ID NO: 189040 - DNA, 25 bp, Mus musculus
aggagcagagggtccagcaccttct

SEQ ID NO: 189041 - DNA, 25 bp, Mus musculus
aggagcagaggtcacgcccagccat

SEQ ID NO: 189042 - DNA, 25 bp, Mus musculus
aggagcagaggtgacgcccagccat

SEQ ID NO: 189043 - DNA, 25 bp, Mus musculus
aggagcagagtaccagaggcccatc

SEQ ID NO: 189044 - DNA, 25 bp, Mus musculus
aggagcagagtagcagaggcccatc

SEQ ID NO: 189045 - DNA, 25 bp, Mus musculus
aggagcagagtgaccatgccttgat

SEQ ID NO: 189046 - DNA, 25 bp, Mus musculus
aggagcagagtgtccatgccttgat

SEQ ID NO: 189047 - DNA, 25 bp, Mus musculus
aggagcagagttaaggtacacccta

SEQ ID NO: 189048 - DNA, 25 bp, Mus musculus
aggagcagagttctgtgtccctgcc

SEQ ID NO: 189049 - DNA, 25 bp, Mus musculus
aggagcagagttgtgtgtccctgcc

SEQ ID NO: 189050 - DNA, 25 bp, Mus musculus
aggagcagagtttaggtacacccta

SEQ ID NO: 189051 - DNA, 25 bp, Mus musculus
aggagcagatcaatggtctcagggt

SEQ ID NO: 189052 - DNA, 25 bp, Mus musculus
aggagcagatcattggtctcagggt

SEQ ID NO: 189053 - DNA, 25 bp, Mus musculus
aggagcagatctatgtggtgatcaa

SEQ ID NO: 189054 - DNA, 25 bp, Mus musculus
aggagcagatctttgtggtgatcaa

SEQ ID NO: 189055 - DNA, 25 bp, Mus musculus
aggagcagcaataggcttgggccaa

SEQ ID NO: 189056 - DNA, 25 bp, Mus musculus
aggagcagcaattggcttgggccaa

SEQ ID NO: 189057 - DNA, 25 bp, Mus musculus
aggagcagcagaactcccagcggct

SEQ ID NO: 189058 - DNA, 25 bp, Mus musculus
aggagcagcagatctcccagcggct

SEQ ID NO: 189059 - DNA, 25 bp, Mus musculus
aggagcagcagtccggctgcaccca

SEQ ID NO: 189060 - DNA, 25 bp, Mus musculus
aggagcagcagtgcggctgcaccca

SEQ ID NO: 189061 - DNA, 25 bp, Mus musculus
aggagcagcattctgagtccacgaa

SEQ ID NO: 189062 - DNA, 25 bp, Mus musculus
aggagcagcattgtgagtccacgaa

SEQ ID NO: 189063 - DNA, 25 bp, Mus musculus
aggagcagccaaccattcttcaatt

SEQ ID NO: 189064 - DNA, 25 bp, Mus musculus
aggagcagccaagcattcttcaatt

SEQ ID NO: 189065 - DNA, 25 bp, Mus musculus
aggagcagccaccttgagaaccgtg

SEQ ID NO: 189066 - DNA, 25 bp, Mus musculus
aggagcagccacgttgagaaccgtg

SEQ ID NO: 189067 - DNA, 25 bp, Mus musculus
aggagcagccctactaagtgctact

SEQ ID NO: 189068 - DNA, 25 bp, Mus musculus
aggagcagcccttctaagtgctact

SEQ ID NO: 189069 - DNA, 25 bp, Mus musculus
aggagcagcctacctgtgtcaagag

SEQ ID NO: 189070 - DNA, 25 bp, Mus musculus
aggagcagcctagctgtgtcaagag

SEQ ID NO: 189071 - DNA, 25 bp, Mus musculus
aggagcagcctgaaaccttctggat

SEQ ID NO: 189072 - DNA, 25 bp, Mus musculus
aggagcagcctgcattccagtatag

SEQ ID NO: 189073 - DNA, 25 bp, Mus musculus
aggagcagcctggattccagtatag

SEQ ID NO: 189074 - DNA, 25 bp, Mus musculus
aggagcagcctgtaaccttctggat

SEQ ID NO: 189075 - DNA, 25 bp, Mus musculus
aggagcagcgcacacatcacacttt

SEQ ID NO: 189076 - DNA, 25 bp, Mus musculus
aggagcagcgcagacatcacacttt

SEQ ID NO: 189077 - DNA, 25 bp, Mus musculus
aggagcagcgctcttccttgcaggc

SEQ ID NO: 189078 - DNA, 25 bp, Mus musculus
aggagcagcgctgttccttgcaggc

SEQ ID NO: 189079 - DNA, 25 bp, Mus musculus
aggagcagcggcaagggctttctaa

SEQ ID NO: 189080 - DNA, 25 bp, Mus musculus
aggagcagcggctagggctttctaa

SEQ ID NO: 189081 - DNA, 25 bp, Mus musculus
aggagcagctacaacggcagggcca

SEQ ID NO: 189082 - DNA, 25 bp, Mus musculus
aggagcagctactacggcagggcca

SEQ ID NO: 189083 - DNA, 25 bp, Mus musculus
aggagcagctgcatagtagcctatc

SEQ ID NO: 189084 - DNA, 25 bp, Mus musculus
aggagcagctgcttagtagcctatc

SEQ ID NO: 189085 - DNA, 25 bp, Mus musculus
aggagcagcttacccagatccgggc

SEQ ID NO: 189086 - DNA, 25 bp, Mus musculus
aggagcagcttagccagatccgggc

SEQ ID NO: 189087 - DNA, 25 bp, Mus musculus
aggagcagcttgacttctgggaagc

SEQ ID NO: 189088 - DNA, 25 bp, Mus musculus
aggagcagcttgtcttctgggaagc

SEQ ID NO: 189089 - DNA, 25 bp, Mus musculus
aggagcaggagaagcgcagcccctt

SEQ ID NO: 189090 - DNA, 25 bp, Mus musculus
aggagcaggagatgcgcagcccctt

SEQ ID NO: 189091 - DNA, 25 bp, Mus musculus
aggagcaggaggactgcagtttctc

SEQ ID NO: 189092 - DNA, 25 bp, Mus musculus
aggagcaggaggtctgcagtttctc

SEQ ID NO: 189093 - DNA, 25 bp, Mus musculus
aggagcaggcacagcaactccggaa

SEQ ID NO: 189094 - DNA, 25 bp, Mus musculus
aggagcaggcactgcaactccggaa

SEQ ID NO: 189095 - DNA, 25 bp, Mus musculus
aggagcaggccaccatattcgagga

SEQ ID NO: 189096 - DNA, 25 bp, Mus musculus
aggagcaggccagcatattcgagga

SEQ ID NO: 189097 - DNA, 25 bp, Mus musculus
aggagcagtagacatcccagcggct

SEQ ID NO: 189098 - DNA, 25 bp, Mus musculus
aggagcagtagagatcccagcggct

SEQ ID NO: 189099 - DNA, 25 bp, Mus musculus
aggagcagtatcatgaagcccgaaa

SEQ ID NO: 189100 - DNA, 25 bp, Mus musculus
aggagcagtatcttgaagcccgaaa

SEQ ID NO: 189101 - DNA, 25 bp, Mus musculus
aggagcagtggactcgccgccatat

SEQ ID NO: 189102 - DNA, 25 bp, Mus musculus
aggagcagtggagtcgccgccatat

SEQ ID NO: 189103 - DNA, 25 bp, Mus musculus
aggagcagttcaacagcactttccg

SEQ ID NO: 189104 - DNA, 25 bp, Mus musculus
aggagcagttcatcagcactttccg

SEQ ID NO: 189105 - DNA, 25 bp, Mus musculus
aggagcagttccagcagggcaagct

SEQ ID NO: 189106 - DNA, 25 bp, Mus musculus
aggagcagttcctgcagggcaagct

SEQ ID NO: 189107 - DNA, 25 bp, Mus musculus
aggagcagttgcctgcccggcgaca

SEQ ID NO: 189108 - DNA, 25 bp, Mus musculus
aggagcagttgcgtgcccggcgaca

SEQ ID NO: 189109 - DNA, 25 bp, Mus musculus
aggagcagtttgaggcagtgtatct

SEQ ID NO: 189110 - DNA, 25 bp, Mus musculus
aggagcagtttgtggcagtgtatct

SEQ ID NO: 189111 - DNA, 25 bp, Mus musculus
aggagcatcagtccgcggtcccagc

SEQ ID NO: 189112 - DNA, 25 bp, Mus musculus
aggagcatcagtgcgcggtcccagc

SEQ ID NO: 189113 - DNA, 25 bp, Mus musculus
aggagcatcatgcacttagccaatg

SEQ ID NO: 189114 - DNA, 25 bp, Mus musculus
aggagcatcatggacttagccaatg

SEQ ID NO: 189115 - DNA, 25 bp, Mus musculus
aggagcatcctcctgttagaggcct

SEQ ID NO: 189116 - DNA, 25 bp, Mus musculus
aggagcatcctcgtgttagaggcct

SEQ ID NO: 189117 - DNA, 25 bp, Mus musculus
aggagcatcggaaccctgccagagc

SEQ ID NO: 189118 - DNA, 25 bp, Mus musculus
aggagcatcggatccctgccagagc

SEQ ID NO: 189119 - DNA, 25 bp, Mus musculus
aggagcatcgtaaggacacttcttg

SEQ ID NO: 189120 - DNA, 25 bp, Mus musculus
aggagcatcgtatggacacttcttg

SEQ ID NO: 189121 - DNA, 25 bp, Mus musculus
aggagcatctaacaccaccacagaa

SEQ ID NO: 189122 - DNA, 25 bp, Mus musculus
aggagcatctaagaccaccacagaa

SEQ ID NO: 189123 - DNA, 25 bp, Mus musculus
aggagcatctctagggtgacctggc

SEQ ID NO: 189124 - DNA, 25 bp, Mus musculus
aggagcatctcttgggtgacctggc

SEQ ID NO: 189125 - DNA, 25 bp, Mus musculus
aggagcatgctactgctgctacaaa

SEQ ID NO: 189126 - DNA, 25 bp, Mus musculus
aggagcatgctagtgctgctacaaa

SEQ ID NO: 189127 - DNA, 25 bp, Mus musculus
aggagcatgcttacatgtttgccaa

SEQ ID NO: 189128 - DNA, 25 bp, Mus musculus
aggagcatgctttcatgtttgccaa

SEQ ID NO: 189129 - DNA, 25 bp, Mus musculus
aggagcattgagacgaggaactact

SEQ ID NO: 189130 - DNA, 25 bp, Mus musculus
aggagcattgagtcgaggaactact

SEQ ID NO: 189131 - DNA, 25 bp, Mus musculus
aggagcattgctactctgacttgct

SEQ ID NO: 189132 - DNA, 25 bp, Mus musculus
aggagcattgctatcttgtactaaa

SEQ ID NO: 189133 - DNA, 25 bp, Mus musculus
aggagcattgcttctctgacttgct

SEQ ID NO: 189134 - DNA, 25 bp, Mus musculus
aggagcattgctttcttgtactaaa

SEQ ID NO: 189135 - DNA, 25 bp, Mus musculus
aggagcattggcacgtggcctctac

SEQ ID NO: 189136 - DNA, 25 bp, Mus musculus
aggagcattggctcgtggcctctac

SEQ ID NO: 189137 - DNA, 25 bp, Mus musculus
aggagccaacaacccaagttcacaa

SEQ ID NO: 189138 - DNA, 25 bp, Mus musculus
aggagccaacaagccaagttcacaa

SEQ ID NO: 189139 - DNA, 25 bp, Mus musculus
aggagccaacgcattcttcaaaggt

SEQ ID NO: 189140 - DNA, 25 bp, Mus musculus
aggagccaacgctttcttcaaaggt

SEQ ID NO: 189141 - DNA, 25 bp, Mus musculus
aggagccaagccaatgccagaggaa

SEQ ID NO: 189142 - DNA, 25 bp, Mus musculus
aggagccaagcctatgccagaggaa

SEQ ID NO: 189143 - DNA, 25 bp, Mus musculus
aggagccaaggacaggtctacgacc

SEQ ID NO: 189144 - DNA, 25 bp, Mus musculus
aggagccaaggagaggtctacgacc

SEQ ID NO: 189145 - DNA, 25 bp, Mus musculus
aggagccaatctataccagtcactg

SEQ ID NO: 189146 - DNA, 25 bp, Mus musculus
aggagccaatctttaccagtcactg

SEQ ID NO: 189147 - DNA, 25 bp, Mus musculus
aggagccaatgtccatactgacttg

SEQ ID NO: 189148 - DNA, 25 bp, Mus musculus
aggagccaatgtcggtagctaccaa

SEQ ID NO: 189149 - DNA, 25 bp, Mus musculus
aggagccaatgtgcatactgacttg

SEQ ID NO: 189150 - DNA, 25 bp, Mus musculus
aggagccaatgtgggtagctaccaa

SEQ ID NO: 189151 - DNA, 25 bp, Mus musculus
aggagccaattcaaaacgggatgtt

SEQ ID NO: 189152 - DNA, 25 bp, Mus musculus
aggagccaattctaaacgggatgtt

SEQ ID NO: 189153 - DNA, 25 bp, Mus musculus
aggagccacaaaactaagccaggat

SEQ ID NO: 189154 - DNA, 25 bp, Mus musculus
aggagccacaaatctaagccaggat

SEQ ID NO: 189155 - DNA, 25 bp, Mus musculus
aggagccacataaactgccattgaa

SEQ ID NO: 189156 - DNA, 25 bp, Mus musculus
aggagccacatatactgccattgaa

SEQ ID NO: 189157 - DNA, 25 bp, Mus musculus
aggagccaccccattccaaaagaag

SEQ ID NO: 189158 - DNA, 25 bp, Mus musculus
aggagccacccctttccaaaagaag

SEQ ID NO: 189159 - DNA, 25 bp, Mus musculus
aggagccaccttatctatctaagaa

SEQ ID NO: 189160 - DNA, 25 bp, Mus musculus
aggagccaccttttctatctaagaa

SEQ ID NO: 189161 - DNA, 25 bp, Mus musculus
aggagccactggagcgtgtcccatc

SEQ ID NO: 189162 - DNA, 25 bp, Mus musculus
aggagccactggtgcgtgtcccatc

SEQ ID NO: 189163 - DNA, 25 bp, Mus musculus
aggagccagatgaggaccctgcaga

SEQ ID NO: 189164 - DNA, 25 bp, Mus musculus
aggagccagatgtggaccctgcaga

SEQ ID NO: 189165 - DNA, 25 bp, Mus musculus
aggagccagccgagatgattcaggt

SEQ ID NO: 189166 - DNA, 25 bp, Mus musculus
aggagccagccgtgatgattcaggt

SEQ ID NO: 189167 - DNA, 25 bp, Mus musculus
aggagccaggaaaccactttaagat

SEQ ID NO: 189168 - DNA, 25 bp, Mus musculus
aggagccaggaatccactttaagat

SEQ ID NO: 189169 - DNA, 25 bp, Mus musculus
aggagccaggatcagttcccaggat

SEQ ID NO: 189170 - DNA, 25 bp, Mus musculus
aggagccaggatccctcttacagaa

SEQ ID NO: 189171 - DNA, 25 bp, Mus musculus
aggagccaggatgagttcccaggat

SEQ ID NO: 189172 - DNA, 25 bp, Mus musculus
aggagccaggatgcctcttacagaa

SEQ ID NO: 189173 - DNA, 25 bp, Mus musculus
aggagccaggccattcccaggtgga

SEQ ID NO: 189174 - DNA, 25 bp, Mus musculus
aggagccaggcctttcccaggtgga

SEQ ID NO: 189175 - DNA, 25 bp, Mus musculus
aggagccagtccacactaaagagtt

SEQ ID NO: 189176 - DNA, 25 bp, Mus musculus
aggagccagtcctcactaaagagtt

SEQ ID NO: 189177 - DNA, 25 bp, Mus musculus
aggagccagtgaagtttgtgccaca

SEQ ID NO: 189178 - DNA, 25 bp, Mus musculus
aggagccagtgatgtttgtgccaca

SEQ ID NO: 189179 - DNA, 25 bp, Mus musculus
aggagccagtgcctactgacggtac

SEQ ID NO: 189180 - DNA, 25 bp, Mus musculus
aggagccagtgcgtactgacggtac

SEQ ID NO: 189181 - DNA, 25 bp, Mus musculus
aggagccagtgtcttccagacgctt

SEQ ID NO: 189182 - DNA, 25 bp, Mus musculus
aggagccagtgtgttccagacgctt

SEQ ID NO: 189183 - DNA, 25 bp, Mus musculus
aggagccatagccagtttcccctcc

SEQ ID NO: 189184 - DNA, 25 bp, Mus musculus
aggagccatagcgagtttcccctcc

SEQ ID NO: 189185 - DNA, 25 bp, Mus musculus
aggagccatattacccctaaggtat

SEQ ID NO: 189186 - DNA, 25 bp, Mus musculus
aggagccatatttcccctaaggtat

SEQ ID NO: 189187 - DNA, 25 bp, Mus musculus
aggagccatcaccaccatcgtcaag

SEQ ID NO: 189188 - DNA, 25 bp, Mus musculus
aggagccatcacgaccatcgtcaag

SEQ ID NO: 189189 - DNA, 25 bp, Mus musculus
aggagccatctgaccttgtcggaaa

SEQ ID NO: 189190 - DNA, 25 bp, Mus musculus
aggagccatctgtccttgtcggaaa

SEQ ID NO: 189191 - DNA, 25 bp, Mus musculus
aggagccatgtcctgccgcagagat

SEQ ID NO: 189192 - DNA, 25 bp, Mus musculus
aggagccatgtcgtgccgcagagat

SEQ ID NO: 189193 - DNA, 25 bp, Mus musculus
aggagccattgtctgtttaccctgt

SEQ ID NO: 189194 - DNA, 25 bp, Mus musculus
aggagccattgtgtgtttaccctgt

SEQ ID NO: 189195 - DNA, 25 bp, Mus musculus
aggagccattttatgcctgagccca

SEQ ID NO: 189196 - DNA, 25 bp, Mus musculus
aggagccattttttgcctgagccca

SEQ ID NO: 189197 - DNA, 25 bp, Mus musculus
aggagcccaaagacctggcggcatg

SEQ ID NO: 189198 - DNA, 25 bp, Mus musculus
aggagcccaaagtcctggcggcatg

SEQ ID NO: 189199 - DNA, 25 bp, Mus musculus
aggagcccaagtcacgcctgaacag

SEQ ID NO: 189200 - DNA, 25 bp, Mus musculus
aggagcccaagtgacgcctgaacag

SEQ ID NO: 189201 - DNA, 25 bp, Mus musculus
aggagcccaccactgtgttccagga

SEQ ID NO: 189202 - DNA, 25 bp, Mus musculus
aggagcccaccagtgtgttccagga

SEQ ID NO: 189203 - DNA, 25 bp, Mus musculus
aggagcccagagataagccatgtct

SEQ ID NO: 189204 - DNA, 25 bp, Mus musculus
aggagcccagagttaagccatgtct

SEQ ID NO: 189205 - DNA, 25 bp, Mus musculus
aggagcccagccaagtcatgtgcaa

SEQ ID NO: 189206 - DNA, 25 bp, Mus musculus
aggagcccagcctagtcatgtgcaa

SEQ ID NO: 189207 - DNA, 25 bp, Mus musculus
aggagcccaggacttgatctccaag

SEQ ID NO: 189208 - DNA, 25 bp, Mus musculus
aggagcccaggagttgatctccaag

SEQ ID NO: 189209 - DNA, 25 bp, Mus musculus
aggagcccatccagacagggcactg

SEQ ID NO: 189210 - DNA, 25 bp, Mus musculus
aggagcccatcctgacagggcactg

SEQ ID NO: 189211 - DNA, 25 bp, Mus musculus
aggagcccatggaacatctgcagct

SEQ ID NO: 189212 - DNA, 25 bp, Mus musculus
aggagcccatggtacatctgcagct

SEQ ID NO: 189213 - DNA, 25 bp, Mus musculus
aggagccccaatcgcccaagaaagt

SEQ ID NO: 189214 - DNA, 25 bp, Mus musculus
aggagccccaatggcccaagaaagt

SEQ ID NO: 189215 - DNA, 25 bp, Mus musculus
aggagccccagcctgttacagagtg

SEQ ID NO: 189216 - DNA, 25 bp, Mus musculus
aggagccccagcgtgttacagagtg

SEQ ID NO: 189217 - DNA, 25 bp, Mus musculus
aggagccccataacatactgccgct

SEQ ID NO: 189218 - DNA, 25 bp, Mus musculus
aggagccccatatcatactgccgct

SEQ ID NO: 189219 - DNA, 25 bp, Mus musculus
aggagccccatgagtggtgttccag

SEQ ID NO: 189220 - DNA, 25 bp, Mus musculus
aggagccccatgtgtggtgttccag

SEQ ID NO: 189221 - DNA, 25 bp, Mus musculus
aggagccccattatataggcccttc

SEQ ID NO: 189222 - DNA, 25 bp, Mus musculus
aggagccccattattgtagcggtca

SEQ ID NO: 189223 - DNA, 25 bp, Mus musculus
aggagccccattttataggcccttc

SEQ ID NO: 189224 - DNA, 25 bp, Mus musculus
aggagccccatttttgtagcggtca

SEQ ID NO: 189225 - DNA, 25 bp, Mus musculus
aggagccccgtgagagatcattctg

SEQ ID NO: 189226 - DNA, 25 bp, Mus musculus
aggagccccgtgtgagatcattctg

SEQ ID NO: 189227 - DNA, 25 bp, Mus musculus
aggagcccgatcaacgcgtagagca

SEQ ID NO: 189228 - DNA, 25 bp, Mus musculus
aggagcccgatctacgcgtagagca

SEQ ID NO: 189229 - DNA, 25 bp, Mus musculus
aggagcccgtgaccaggaaactatc

SEQ ID NO: 189230 - DNA, 25 bp, Mus musculus
aggagcccgtgagcaggaaactatc

SEQ ID NO: 189231 - DNA, 25 bp, Mus musculus
aggagcccgtgcaagcagaacctgg

SEQ ID NO: 189232 - DNA, 25 bp, Mus musculus
aggagcccgtgctagcagaacctgg

SEQ ID NO: 189233 - DNA, 25 bp, Mus musculus
aggagccctaaactccaggctggag

SEQ ID NO: 189234 - DNA, 25 bp, Mus musculus
aggagccctaaagtccaggctggag

SEQ ID NO: 189235 - DNA, 25 bp, Mus musculus
aggagccctcgcaccaaggactcag

SEQ ID NO: 189236 - DNA, 25 bp, Mus musculus
aggagccctcgctccaaggactcag

SEQ ID NO: 189237 - DNA, 25 bp, Mus musculus
aggagccctgcgaataactatgagt

SEQ ID NO: 189238 - DNA, 25 bp, Mus musculus
aggagccctgcgtataactatgagt

SEQ ID NO: 189239 - DNA, 25 bp, Mus musculus
aggagccctgctctcagaattggaa

SEQ ID NO: 189240 - DNA, 25 bp, Mus musculus
aggagccctgctgtcagaattggaa

SEQ ID NO: 189241 - DNA, 25 bp, Mus musculus
aggagccctggcacttgctagccag

SEQ ID NO: 189242 - DNA, 25 bp, Mus musculus
aggagccctggctcttgctagccag

SEQ ID NO: 189243 - DNA, 25 bp, Mus musculus
aggagcccttccatatgtgatataa

SEQ ID NO: 189244 - DNA, 25 bp, Mus musculus
aggagcccttccttatgtgatataa

SEQ ID NO: 189245 - DNA, 25 bp, Mus musculus
aggagcccttctagagtcctgggtc

SEQ ID NO: 189246 - DNA, 25 bp, Mus musculus
aggagcccttcttgagtcctgggtc

SEQ ID NO: 189247 - DNA, 25 bp, Mus musculus
aggagcccttggagccctgggatac

SEQ ID NO: 189248 - DNA, 25 bp, Mus musculus
aggagcccttggtgccctgggatac

SEQ ID NO: 189249 - DNA, 25 bp, Mus musculus
aggagccgaggcaattcccagatct

SEQ ID NO: 189250 - DNA, 25 bp, Mus musculus
aggagccgaggctattcccagatct

SEQ ID NO: 189251 - DNA, 25 bp, Mus musculus
aggagccgatgcctggcacctgcac

SEQ ID NO: 189252 - DNA, 25 bp, Mus musculus
aggagccgatgcgtggcacctgcac

SEQ ID NO: 189253 - DNA, 25 bp, Mus musculus
aggagccgcagaaggcctcgtagtc

SEQ ID NO: 189254 - DNA, 25 bp, Mus musculus
aggagccgcagatggcctcgtagtc

SEQ ID NO: 189255 - DNA, 25 bp, Mus musculus
aggagccgctccagaacctggagag

SEQ ID NO: 189256 - DNA, 25 bp, Mus musculus
aggagccgctcctgaacctggagag

SEQ ID NO: 189257 - DNA, 25 bp, Mus musculus
aggagccggaagaagcagacccaga

SEQ ID NO: 189258 - DNA, 25 bp, Mus musculus
aggagccggaagtagcagacccaga

SEQ ID NO: 189259 - DNA, 25 bp, Mus musculus
aggagcctaaggatcccttgaaggt

SEQ ID NO: 189260 - DNA, 25 bp, Mus musculus
aggagcctaaggttcccttgaaggt

SEQ ID NO: 189261 - DNA, 25 bp, Mus musculus
aggagcctacgtatttatcatcttc

SEQ ID NO: 189262 - DNA, 25 bp, Mus musculus
aggagcctacgtttttatcatcttc

SEQ ID NO: 189263 - DNA, 25 bp, Mus musculus
aggagcctacttcccacagtataca

SEQ ID NO: 189264 - DNA, 25 bp, Mus musculus
aggagcctacttgccacagtataca

SEQ ID NO: 189265 - DNA, 25 bp, Mus musculus
aggagcctatcaacaacctgactgg

SEQ ID NO: 189266 - DNA, 25 bp, Mus musculus
aggagcctatcatcaacctgactgg

SEQ ID NO: 189267 - DNA, 25 bp, Mus musculus
aggagcctcaaaatctacagtctgt

SEQ ID NO: 189268 - DNA, 25 bp, Mus musculus
aggagcctcaaattctacagtctgt

SEQ ID NO: 189269 - DNA, 25 bp, Mus musculus
aggagcctcacaagcactgtggaca

SEQ ID NO: 189270 - DNA, 25 bp, Mus musculus
aggagcctcacatgcactgtggaca

SEQ ID NO: 189271 - DNA, 25 bp, Mus musculus
aggagcctcagcagttctgactgca

SEQ ID NO: 189272 - DNA, 25 bp, Mus musculus
aggagcctcagctgttctgactgca

SEQ ID NO: 189273 - DNA, 25 bp, Mus musculus
aggagcctccacaaattgatgcagt

SEQ ID NO: 189274 - DNA, 25 bp, Mus musculus
aggagcctccactaattgatgcagt

SEQ ID NO: 189275 - DNA, 25 bp, Mus musculus
aggagcctcctcagcaagggaagga

SEQ ID NO: 189276 - DNA, 25 bp, Mus musculus
aggagcctcctctgcaagggaagga

SEQ ID NO: 189277 - DNA, 25 bp, Mus musculus
aggagcctcgctcaagtgcaggaca

SEQ ID NO: 189278 - DNA, 25 bp, Mus musculus
aggagcctcgctgaagtgcaggaca

SEQ ID NO: 189279 - DNA, 25 bp, Mus musculus
aggagcctcgttctgttccaagtgg

SEQ ID NO: 189280 - DNA, 25 bp, Mus musculus
aggagcctcgttgtgttccaagtgg

SEQ ID NO: 189281 - DNA, 25 bp, Mus musculus
aggagcctctggaaaaatccaccct

SEQ ID NO: 189282 - DNA, 25 bp, Mus musculus
aggagcctctggtaaaatccaccct

SEQ ID NO: 189283 - DNA, 25 bp, Mus musculus
aggagcctctgtacttacctatttc

SEQ ID NO: 189284 - DNA, 25 bp, Mus musculus
aggagcctctgttcttacctatttc

SEQ ID NO: 189285 - DNA, 25 bp, Mus musculus
aggagcctgactagacactggttct

SEQ ID NO: 189286 - DNA, 25 bp, Mus musculus
aggagcctgacttgacactggttct

SEQ ID NO: 189287 - DNA, 25 bp, Mus musculus
aggagcctgcctcacttcaagaagt

SEQ ID NO: 189288 - DNA, 25 bp, Mus musculus
aggagcctgcctgacttcaagaagt

SEQ ID NO: 189289 - DNA, 25 bp, Mus musculus
aggagcctgctgaagcacctagcct

SEQ ID NO: 189290 - DNA, 25 bp, Mus musculus
aggagcctgctgagtctgctttaaa

SEQ ID NO: 189291 - DNA, 25 bp, Mus musculus
aggagcctgctgtagcacctagcct

SEQ ID NO: 189292 - DNA, 25 bp, Mus musculus
aggagcctgctgtgtctgctttaaa

SEQ ID NO: 189293 - DNA, 25 bp, Mus musculus
aggagcctggacagccgaagaagcc

SEQ ID NO: 189294 - DNA, 25 bp, Mus musculus
aggagcctggactgccgaagaagcc

SEQ ID NO: 189295 - DNA, 25 bp, Mus musculus
aggagcctggccatgaagaagcagc

SEQ ID NO: 189296 - DNA, 25 bp, Mus musculus
aggagcctggccttgaagaagcagc

SEQ ID NO: 189297 - DNA, 25 bp, Mus musculus
aggagcctgtcactctgcacagtga

SEQ ID NO: 189298 - DNA, 25 bp, Mus musculus
aggagcctgtcagtctgcacagtga

SEQ ID NO: 189299 - DNA, 25 bp, Mus musculus
aggagcctgttcatcatgtgtgaga

SEQ ID NO: 189300 - DNA, 25 bp, Mus musculus
aggagcctgttcttcatgtgtgaga

SEQ ID NO: 189301 - DNA, 25 bp, Mus musculus
aggagccttatgaacctgccagggc

SEQ ID NO: 189302 - DNA, 25 bp, Mus musculus
aggagccttatgtacctgccagggc

SEQ ID NO: 189303 - DNA, 25 bp, Mus musculus
aggagccttccacaacaactgtgta

SEQ ID NO: 189304 - DNA, 25 bp, Mus musculus
aggagccttccagaacaactgtgta

SEQ ID NO: 189305 - DNA, 25 bp, Mus musculus
aggagccttcggatggttatttagc

SEQ ID NO: 189306 - DNA, 25 bp, Mus musculus
aggagccttcggttggttatttagc

SEQ ID NO: 189307 - DNA, 25 bp, Mus musculus
aggagccttctcacgaatgtcagac

SEQ ID NO: 189308 - DNA, 25 bp, Mus musculus
aggagccttctctcgaatgtcagac

SEQ ID NO: 189309 - DNA, 25 bp, Mus musculus
aggagcctttagcttaggccacaga

SEQ ID NO: 189310 - DNA, 25 bp, Mus musculus
aggagcctttaggttaggccacaga

SEQ ID NO: 189311 - DNA, 25 bp, Mus musculus
aggagcctttgtcgatgctgtacac

SEQ ID NO: 189312 - DNA, 25 bp, Mus musculus
aggagcctttgtggatgctgtacac

SEQ ID NO: 189313 - DNA, 25 bp, Mus musculus
aggagcgacctactccaggagctga

SEQ ID NO: 189314 - DNA, 25 bp, Mus musculus
aggagcgacctagtccaggagctga

SEQ ID NO: 189315 - DNA, 25 bp, Mus musculus
aggagcgactacattgtattgtact

SEQ ID NO: 189316 - DNA, 25 bp, Mus musculus
aggagcgactactttgtattgtact

SEQ ID NO: 189317 - DNA, 25 bp, Mus musculus
aggagcgagcgcctctttccaagtt

SEQ ID NO: 189318 - DNA, 25 bp, Mus musculus
aggagcgagcgcgtctttccaagtt

SEQ ID NO: 189319 - DNA, 25 bp, Mus musculus
aggagcgagctgacaaacgcagcgt

SEQ ID NO: 189320 - DNA, 25 bp, Mus musculus
aggagcgagctgcacttagccgact

SEQ ID NO: 189321 - DNA, 25 bp, Mus musculus
aggagcgagctggacttagccgact

SEQ ID NO: 189322 - DNA, 25 bp, Mus musculus
aggagcgagctgtcaaacgcagcgt

SEQ ID NO: 189323 - DNA, 25 bp, Mus musculus
aggagcgaggagacttagccgccac

SEQ ID NO: 189324 - DNA, 25 bp, Mus musculus
aggagcgaggagtcttagccgccac

SEQ ID NO: 189325 - DNA, 25 bp, Mus musculus
aggagcgcaccgagctagagcgaca

SEQ ID NO: 189326 - DNA, 25 bp, Mus musculus
aggagcgcaccgtgctagagcgaca

SEQ ID NO: 189327 - DNA, 25 bp, Mus musculus
aggagcgccgggaggccaataatgc

SEQ ID NO: 189328 - DNA, 25 bp, Mus musculus
aggagcgccgggtggccaataatgc

SEQ ID NO: 189329 - DNA, 25 bp, Mus musculus
aggagcgcctttacagcagagccgt

SEQ ID NO: 189330 - DNA, 25 bp, Mus musculus
aggagcgccttttcagcagagccgt

SEQ ID NO: 189331 - DNA, 25 bp, Mus musculus
aggagcgcgatgactttgatctaga

SEQ ID NO: 189332 - DNA, 25 bp, Mus musculus
aggagcgcgatgtctttgatctaga

SEQ ID NO: 189333 - DNA, 25 bp, Mus musculus
aggagcgcgccaccaagccttactg

SEQ ID NO: 189334 - DNA, 25 bp, Mus musculus
aggagcgcgccagcaagccttactg

SEQ ID NO: 189335 - DNA, 25 bp, Mus musculus
aggagcgctgcgacattgttagaac

SEQ ID NO: 189336 - DNA, 25 bp, Mus musculus
aggagcgctgcgtcattgttagaac

SEQ ID NO: 189337 - DNA, 25 bp, Mus musculus
aggagcggcagtacatcgatggact

SEQ ID NO: 189338 - DNA, 25 bp, Mus musculus
aggagcggcagttcatcgatggact

SEQ ID NO: 189339 - DNA, 25 bp, Mus musculus
aggagcggccagaagacctgcagct

SEQ ID NO: 189340 - DNA, 25 bp, Mus musculus
aggagcggccagtagacctgcagct

SEQ ID NO: 189341 - DNA, 25 bp, Mus musculus
aggagcggtgagaccttgccagccc

SEQ ID NO: 189342 - DNA, 25 bp, Mus musculus
aggagcggtgagtccttgccagccc

SEQ ID NO: 189343 - DNA, 25 bp, Mus musculus
aggagcggttcgaggcgtccaatcc

SEQ ID NO: 189344 - DNA, 25 bp, Mus musculus
aggagcggttcgtggcgtccaatcc

SEQ ID NO: 189345 - DNA, 25 bp, Mus musculus
aggagcgtgctacagtctacagtga

SEQ ID NO: 189346 - DNA, 25 bp, Mus musculus
aggagcgtgctagagtctacagtga

SEQ ID NO: 189347 - DNA, 25 bp, Mus musculus
aggagcgtgtttcactcacaggtgc

SEQ ID NO: 189348 - DNA, 25 bp, Mus musculus
aggagcgtgtttgactcacaggtgc

SEQ ID NO: 189349 - DNA, 25 bp, Mus musculus
aggagcgttgcaatgcctgcaaact

SEQ ID NO: 189350 - DNA, 25 bp, Mus musculus
aggagcgttgcattgcctgcaaact

SEQ ID NO: 189351 - DNA, 25 bp, Mus musculus
aggagcgtttccaccagcagggagc

SEQ ID NO: 189352 - DNA, 25 bp, Mus musculus
aggagcgtttcctccagcagggagc

SEQ ID NO: 189353 - DNA, 25 bp, Mus musculus
aggagctaactaactcatgccagga

SEQ ID NO: 189354 - DNA, 25 bp, Mus musculus
aggagctaactatctcatgccagga

SEQ ID NO: 189355 - DNA, 25 bp, Mus musculus
aggagctaagacaggacctgtggct

SEQ ID NO: 189356 - DNA, 25 bp, Mus musculus
aggagctaagactggacctgtggct

SEQ ID NO: 189357 - DNA, 25 bp, Mus musculus
aggagctacagcagtccttagccat

SEQ ID NO: 189358 - DNA, 25 bp, Mus musculus
aggagctacagctgtccttagccat

SEQ ID NO: 189359 - DNA, 25 bp, Mus musculus
aggagctacaggcaccaccacaggt

SEQ ID NO: 189360 - DNA, 25 bp, Mus musculus
aggagctacagggaccaccacaggt

SEQ ID NO: 189361 - DNA, 25 bp, Mus musculus
aggagctacttacactcgccggatg

SEQ ID NO: 189362 - DNA, 25 bp, Mus musculus
aggagctacttagactcgccggatg

SEQ ID NO: 189363 - DNA, 25 bp, Mus musculus
aggagctagaagatccccatgctaa

SEQ ID NO: 189364 - DNA, 25 bp, Mus musculus
aggagctagaagttccccatgctaa

SEQ ID NO: 189365 - DNA, 25 bp, Mus musculus
aggagctagagtattcactattggg

SEQ ID NO: 189366 - DNA, 25 bp, Mus musculus
aggagctagagttttcactattggg

SEQ ID NO: 189367 - DNA, 25 bp, Mus musculus
aggagctagcccagaaggcactgct

SEQ ID NO: 189368 - DNA, 25 bp, Mus musculus
aggagctagccctgaaggcactgct

SEQ ID NO: 189369 - DNA, 25 bp, Mus musculus
aggagctagcctcgtaagcccagct

SEQ ID NO: 189370 - DNA, 25 bp, Mus musculus
aggagctagcctggtaagcccagct

SEQ ID NO: 189371 - DNA, 25 bp, Mus musculus
aggagctagtacaggccatggagaa

SEQ ID NO: 189372 - DNA, 25 bp, Mus musculus
aggagctagtactggccatggagaa

SEQ ID NO: 189373 - DNA, 25 bp, Mus musculus
aggagctatccgcttccaaagcctc

SEQ ID NO: 189374 - DNA, 25 bp, Mus musculus
aggagctatccggttccaaagcctc

SEQ ID NO: 189375 - DNA, 25 bp, Mus musculus
aggagctatctcactttctgctgtg

SEQ ID NO: 189376 - DNA, 25 bp, Mus musculus
aggagctatctctctttctgctgtg

SEQ ID NO: 189377 - DNA, 25 bp, Mus musculus
aggagctatggaacagtctgtccca

SEQ ID NO: 189378 - DNA, 25 bp, Mus musculus
aggagctatggatcagtctgtccca

SEQ ID NO: 189379 - DNA, 25 bp, Mus musculus
aggagctatggtccctctaatgtaa

SEQ ID NO: 189380 - DNA, 25 bp, Mus musculus
aggagctatggtgcctctaatgtaa

SEQ ID NO: 189381 - DNA, 25 bp, Mus musculus
aggagctatgtgactcggtcacttc

SEQ ID NO: 189382 - DNA, 25 bp, Mus musculus
aggagctatgtgtctcggtcacttc

SEQ ID NO: 189383 - DNA, 25 bp, Mus musculus
aggagctattgaactttccactttc

SEQ ID NO: 189384 - DNA, 25 bp, Mus musculus
aggagctattgatctttccactttc

SEQ ID NO: 189385 - DNA, 25 bp, Mus musculus
aggagctcaagcacagcagccggca

SEQ ID NO: 189386 - DNA, 25 bp, Mus musculus
aggagctcaagctcagcagccggca

SEQ ID NO: 189387 - DNA, 25 bp, Mus musculus
aggagctcaagtacttcacatcagt

SEQ ID NO: 189388 - DNA, 25 bp, Mus musculus
aggagctcaagttcttcacatcagt

SEQ ID NO: 189389 - DNA, 25 bp, Mus musculus
aggagctcacgaccctgagaatcag

SEQ ID NO: 189390 - DNA, 25 bp, Mus musculus
aggagctcacgagcctgagaatcag

SEQ ID NO: 189391 - DNA, 25 bp, Mus musculus
aggagctcacgtatgcctgcctgtg

SEQ ID NO: 189392 - DNA, 25 bp, Mus musculus
aggagctcacgtttgcctgcctgtg

SEQ ID NO: 189393 - DNA, 25 bp, Mus musculus
aggagctcagatctacttggcagtg

SEQ ID NO: 189394 - DNA, 25 bp, Mus musculus
aggagctcagatgtacttggcagtg

SEQ ID NO: 189395 - DNA, 25 bp, Mus musculus
aggagctcagctagtggcacataca

SEQ ID NO: 189396 - DNA, 25 bp, Mus musculus
aggagctcagctcgactgttaacat

SEQ ID NO: 189397 - DNA, 25 bp, Mus musculus
aggagctcagctggactgttaacat

SEQ ID NO: 189398 - DNA, 25 bp, Mus musculus
aggagctcagcttgtggcacataca

SEQ ID NO: 189399 - DNA, 25 bp, Mus musculus
aggagctcaggcaattccagcgcct

SEQ ID NO: 189400 - DNA, 25 bp, Mus musculus
aggagctcaggctattccagcgcct

SEQ ID NO: 189401 - DNA, 25 bp, Mus musculus
aggagctcatggataccctcagggc

SEQ ID NO: 189402 - DNA, 25 bp, Mus musculus
aggagctcatggttaccctcagggc

SEQ ID NO: 189403 - DNA, 25 bp, Mus musculus
aggagctcatttcttcgctttccca

SEQ ID NO: 189404 - DNA, 25 bp, Mus musculus
aggagctcatttgttcgctttccca

SEQ ID NO: 189405 - DNA, 25 bp, Mus musculus
aggagctccagtcaatgtccgcaga

SEQ ID NO: 189406 - DNA, 25 bp, Mus musculus
aggagctccagtgaatgtccgcaga

SEQ ID NO: 189407 - DNA, 25 bp, Mus musculus
aggagctccgcaagacactcaagga

SEQ ID NO: 189408 - DNA, 25 bp, Mus musculus
aggagctccgcatgacactcaagga

SEQ ID NO: 189409 - DNA, 25 bp, Mus musculus
aggagctccggcaagggaataacta

SEQ ID NO: 189410 - DNA, 25 bp, Mus musculus
aggagctccggctagggaataacta

SEQ ID NO: 189411 - DNA, 25 bp, Mus musculus
aggagctccgtgatgaccatggaca

SEQ ID NO: 189412 - DNA, 25 bp, Mus musculus
aggagctccgtgttgaccatggaca

SEQ ID NO: 189413 - DNA, 25 bp, Mus musculus
aggagctcctagagactgccatttt

SEQ ID NO: 189414 - DNA, 25 bp, Mus musculus
aggagctcctagtgactgccatttt

SEQ ID NO: 189415 - DNA, 25 bp, Mus musculus
aggagctcctgcaatactctcatga

SEQ ID NO: 189416 - DNA, 25 bp, Mus musculus
aggagctcctgctatactctcatga

SEQ ID NO: 189417 - DNA, 25 bp, Mus musculus
aggagctccttcacaagtatgggca

SEQ ID NO: 189418 - DNA, 25 bp, Mus musculus
aggagctccttctcaagtatgggca

SEQ ID NO: 189419 - DNA, 25 bp, Mus musculus
aggagctcgcttagacccctttgga

SEQ ID NO: 189420 - DNA, 25 bp, Mus musculus
aggagctcgctttgacccctttgga

SEQ ID NO: 189421 - DNA, 25 bp, Mus musculus
aggagctcggctccagtgatcactg

SEQ ID NO: 189422 - DNA, 25 bp, Mus musculus
aggagctcggctgcagtgatcactg

SEQ ID NO: 189423 - DNA, 25 bp, Mus musculus
aggagctcggtgagaaccacagcca

SEQ ID NO: 189424 - DNA, 25 bp, Mus musculus
aggagctcggtgtgaaccacagcca

SEQ ID NO: 189425 - DNA, 25 bp, Mus musculus
aggagctcgtgtatatgtaatctac

SEQ ID NO: 189426 - DNA, 25 bp, Mus musculus
aggagctcgtgtttatgtaatctac

SEQ ID NO: 189427 - DNA, 25 bp, Mus musculus
aggagctcgttcattcaccgcatgg

SEQ ID NO: 189428 - DNA, 25 bp, Mus musculus
aggagctcgttctttcaccgcatgg

SEQ ID NO: 189429 - DNA, 25 bp, Mus musculus
aggagctctcagcttgtgtcttcag

SEQ ID NO: 189430 - DNA, 25 bp, Mus musculus
aggagctctcaggttgtgtcttcag

SEQ ID NO: 189431 - DNA, 25 bp, Mus musculus
aggagctctccacttgacagccaga

SEQ ID NO: 189432 - DNA, 25 bp, Mus musculus
aggagctctccagttgacagccaga

SEQ ID NO: 189433 - DNA, 25 bp, Mus musculus
aggagctctcgaagtgacctggcgc

SEQ ID NO: 189434 - DNA, 25 bp, Mus musculus
aggagctctcgatgtgacctggcgc

SEQ ID NO: 189435 - DNA, 25 bp, Mus musculus
aggagctctgacagtactacttaca

SEQ ID NO: 189436 - DNA, 25 bp, Mus musculus
aggagctctgactgtactacttaca

SEQ ID NO: 189437 - DNA, 25 bp, Mus musculus
aggagctctgatctacctgaagaat

SEQ ID NO: 189438 - DNA, 25 bp, Mus musculus
aggagctctgatctcctctcctgca

SEQ ID NO: 189439 - DNA, 25 bp, Mus musculus
aggagctctgatgtacctgaagaat

SEQ ID NO: 189440 - DNA, 25 bp, Mus musculus
aggagctctgatgtcctctcctgca

SEQ ID NO: 189441 - DNA, 25 bp, Mus musculus
aggagctctgctagcaagtgtgtga

SEQ ID NO: 189442 - DNA, 25 bp, Mus musculus
aggagctctgctctatcttaacggg

SEQ ID NO: 189443 - DNA, 25 bp, Mus musculus
aggagctctgctgtatcttaacggg

SEQ ID NO: 189444 - DNA, 25 bp, Mus musculus
aggagctctgcttgcaagtgtgtga

SEQ ID NO: 189445 - DNA, 25 bp, Mus musculus
aggagctctggcaagcagaacagga

SEQ ID NO: 189446 - DNA, 25 bp, Mus musculus
aggagctctggctagcagaacagga

SEQ ID NO: 189447 - DNA, 25 bp, Mus musculus
aggagctctttacaaggctgtgaag

SEQ ID NO: 189448 - DNA, 25 bp, Mus musculus
aggagctctttagaaggctgtgaag

SEQ ID NO: 189449 - DNA, 25 bp, Mus musculus
aggagctctttgacaaggccaacaa

SEQ ID NO: 189450 - DNA, 25 bp, Mus musculus
aggagctctttgtcaaggccaacaa

SEQ ID NO: 189451 - DNA, 25 bp, Mus musculus
aggagctgaaacagcccagggacat

SEQ ID NO: 189452 - DNA, 25 bp, Mus musculus
aggagctgaaactgcccagggacat

SEQ ID NO: 189453 - DNA, 25 bp, Mus musculus
aggagctgaagaccccataaccagg

SEQ ID NO: 189454 - DNA, 25 bp, Mus musculus
aggagctgaagagcccataaccagg

SEQ ID NO: 189455 - DNA, 25 bp, Mus musculus
aggagctgaaggacactcttggcca

SEQ ID NO: 189456 - DNA, 25 bp, Mus musculus
aggagctgaaggtcactcttggcca

SEQ ID NO: 189457 - DNA, 25 bp, Mus musculus
aggagctgacacagaagatacagca

SEQ ID NO: 189458 - DNA, 25 bp, Mus musculus
aggagctgacactgaagatacagca

SEQ ID NO: 189459 - DNA, 25 bp, Mus musculus
aggagctgacctcatggacactcat

SEQ ID NO: 189460 - DNA, 25 bp, Mus musculus
aggagctgacctgatggacactcat

SEQ ID NO: 189461 - DNA, 25 bp, Mus musculus
aggagctgactgacgttgacacaat

SEQ ID NO: 189462 - DNA, 25 bp, Mus musculus
aggagctgactgtcgttgacacaat

SEQ ID NO: 189463 - DNA, 25 bp, Mus musculus
aggagctgagtcaggttacaagaaa

SEQ ID NO: 189464 - DNA, 25 bp, Mus musculus
aggagctgagtctggttacaagaaa

SEQ ID NO: 189465 - DNA, 25 bp, Mus musculus
aggagctgatctcgctggttcgcac

SEQ ID NO: 189466 - DNA, 25 bp, Mus musculus
aggagctgatctggctggttcgcac

SEQ ID NO: 189467 - DNA, 25 bp, Mus musculus
aggagctgatgaatgacgtcaccaa

SEQ ID NO: 189468 - DNA, 25 bp, Mus musculus
aggagctgatgattgacgtcaccaa

SEQ ID NO: 189469 - DNA, 25 bp, Mus musculus
aggagctgcaagagcgactgtctca

SEQ ID NO: 189470 - DNA, 25 bp, Mus musculus
aggagctgcaagtgcgactgtctca

SEQ ID NO: 189471 - DNA, 25 bp, Mus musculus
aggagctgcagtcctaggtcccgcc

SEQ ID NO: 189472 - DNA, 25 bp, Mus musculus
aggagctgcagtgctaggtcccgcc

SEQ ID NO: 189473 - DNA, 25 bp, Mus musculus
aggagctgcatcacgacagggtgac

SEQ ID NO: 189474 - DNA, 25 bp, Mus musculus
aggagctgcatctcgacagggtgac

SEQ ID NO: 189475 - DNA, 25 bp, Mus musculus
aggagctgccttacaagccagttgt

SEQ ID NO: 189476 - DNA, 25 bp, Mus musculus
aggagctgcctttcaagccagttgt

SEQ ID NO: 189477 - DNA, 25 bp, Mus musculus
aggagctgcgcgaggcccacaagaa

SEQ ID NO: 189478 - DNA, 25 bp, Mus musculus
aggagctgcgcgtggcccacaagaa

SEQ ID NO: 189479 - DNA, 25 bp, Mus musculus
aggagctgcgctacaggtttgagct

SEQ ID NO: 189480 - DNA, 25 bp, Mus musculus
aggagctgcgcttcaggtttgagct

SEQ ID NO: 189481 - DNA, 25 bp, Mus musculus
aggagctgcggtacatcatctatac

SEQ ID NO: 189482 - DNA, 25 bp, Mus musculus
aggagctgcggttcatcatctatac

SEQ ID NO: 189483 - DNA, 25 bp, Mus musculus
aggagctgctccctctaataaaacc

SEQ ID NO: 189484 - DNA, 25 bp, Mus musculus
aggagctgctccgtctaataaaacc

SEQ ID NO: 189485 - DNA, 25 bp, Mus musculus
aggagctgctggatgctattgttcg

SEQ ID NO: 189486 - DNA, 25 bp, Mus musculus
aggagctgctggttgctattgttcg

SEQ ID NO: 189487 - DNA, 25 bp, Mus musculus
aggagctgctgtcatactgtgcact

SEQ ID NO: 189488 - DNA, 25 bp, Mus musculus
aggagctgctgtgatactgtgcact

SEQ ID NO: 189489 - DNA, 25 bp, Mus musculus
aggagctgctttagtgtcccgagcc

SEQ ID NO: 189490 - DNA, 25 bp, Mus musculus
aggagctgcttttgtgtcccgagcc

SEQ ID NO: 189491 - DNA, 25 bp, Mus musculus
aggagctggacacgccacttggaaa

SEQ ID NO: 189492 - DNA, 25 bp, Mus musculus
aggagctggacaggccacttggaaa

SEQ ID NO: 189493 - DNA, 25 bp, Mus musculus
aggagctggaccactttgtgctgct

SEQ ID NO: 189494 - DNA, 25 bp, Mus musculus
aggagctggacctctttgtgctgct

SEQ ID NO: 189495 - DNA, 25 bp, Mus musculus
aggagctggactagccttctccgga

SEQ ID NO: 189496 - DNA, 25 bp, Mus musculus
aggagctggacttgccttctccgga

SEQ ID NO: 189497 - DNA, 25 bp, Mus musculus
aggagctggagtactgtgaaaagct

SEQ ID NO: 189498 - DNA, 25 bp, Mus musculus
aggagctggagttctgtgaaaagct

SEQ ID NO: 189499 - DNA, 25 bp, Mus musculus
aggagctggctaacatggacaagga

SEQ ID NO: 189500 - DNA, 25 bp, Mus musculus
aggagctggctatcatggacaagga

SEQ ID NO: 189501 - DNA, 25 bp, Mus musculus
aggagctgggatcccattgctcata

SEQ ID NO: 189502 - DNA, 25 bp, Mus musculus
aggagctgggatgccattgctcata

SEQ ID NO: 189503 - DNA, 25 bp, Mus musculus
aggagctgggccaattcaccgcggt

SEQ ID NO: 189504 - DNA, 25 bp, Mus musculus
aggagctgggcctattcaccgcggt

SEQ ID NO: 189505 - DNA, 25 bp, Mus musculus
aggagctggttgagatttagtctga

SEQ ID NO: 189506 - DNA, 25 bp, Mus musculus
aggagctggttgtgatttagtctga

SEQ ID NO: 189507 - DNA, 25 bp, Mus musculus
aggagctggtttactgacactggtt

SEQ ID NO: 189508 - DNA, 25 bp, Mus musculus
aggagctggttttctgacactggtt

SEQ ID NO: 189509 - DNA, 25 bp, Mus musculus
aggagctgtcaaattgttacagaca

SEQ ID NO: 189510 - DNA, 25 bp, Mus musculus
aggagctgtcaatttgttacagaca

SEQ ID NO: 189511 - DNA, 25 bp, Mus musculus
aggagctgtcctaaggtctcccgag

SEQ ID NO: 189512 - DNA, 25 bp, Mus musculus
aggagctgtccttaggtctcccgag

SEQ ID NO: 189513 - DNA, 25 bp, Mus musculus
aggagctgtctgacgcaaagcttgc

SEQ ID NO: 189514 - DNA, 25 bp, Mus musculus
aggagctgtctgtcgcaaagcttgc

SEQ ID NO: 189515 - DNA, 25 bp, Mus musculus
aggagctgtgagcattactgccctc

SEQ ID NO: 189516 - DNA, 25 bp, Mus musculus
aggagctgtgaggattactgccctc

SEQ ID NO: 189517 - DNA, 25 bp, Mus musculus
aggagctgtggacactttgtaccaa

SEQ ID NO: 189518 - DNA, 25 bp, Mus musculus
aggagctgtggagactttgtaccaa

SEQ ID NO: 189519 - DNA, 25 bp, Mus musculus
aggagctgtgtcaatgattcaaagt

SEQ ID NO: 189520 - DNA, 25 bp, Mus musculus
aggagctgtgtctatgattcaaagt

SEQ ID NO: 189521 - DNA, 25 bp, Mus musculus
aggagctgtgtgactcatcccattc

SEQ ID NO: 189522 - DNA, 25 bp, Mus musculus
aggagctgtgtgtctcatcccattc

SEQ ID NO: 189523 - DNA, 25 bp, Mus musculus
aggagcttaacgctgagccctggta

SEQ ID NO: 189524 - DNA, 25 bp, Mus musculus
aggagcttaacggtgagccctggta

SEQ ID NO: 189525 - DNA, 25 bp, Mus musculus
aggagcttacatagtacgctgccct

SEQ ID NO: 189526 - DNA, 25 bp, Mus musculus
aggagcttacattgtacgctgccct

SEQ ID NO: 189527 - DNA, 25 bp, Mus musculus
aggagcttagacacctttctagtag

SEQ ID NO: 189528 - DNA, 25 bp, Mus musculus
aggagcttagactcctttctagtag

SEQ ID NO: 189529 - DNA, 25 bp, Mus musculus
aggagcttagcaccatgaaccttcc

SEQ ID NO: 189530 - DNA, 25 bp, Mus musculus
aggagcttagcagcatgaaccttcc

SEQ ID NO: 189531 - DNA, 25 bp, Mus musculus
aggagcttagccactgtatgtccag

SEQ ID NO: 189532 - DNA, 25 bp, Mus musculus
aggagcttagcctctgtatgtccag

SEQ ID NO: 189533 - DNA, 25 bp, Mus musculus
aggagcttcaccaagatgtcgtctt

SEQ ID NO: 189534 - DNA, 25 bp, Mus musculus
aggagcttcacctagatgtcgtctt

SEQ ID NO: 189535 - DNA, 25 bp, Mus musculus
aggagcttcctcattgctgcgcacg

SEQ ID NO: 189536 - DNA, 25 bp, Mus musculus
aggagcttcctccacatattaagaa

SEQ ID NO: 189537 - DNA, 25 bp, Mus musculus
aggagcttcctcctgccgtagatga

SEQ ID NO: 189538 - DNA, 25 bp, Mus musculus
aggagcttcctcgacatattaagaa

SEQ ID NO: 189539 - DNA, 25 bp, Mus musculus
aggagcttcctcgtgccgtagatga

SEQ ID NO: 189540 - DNA, 25 bp, Mus musculus
aggagcttcctctttgctgcgcacg

SEQ ID NO: 189541 - DNA, 25 bp, Mus musculus
aggagcttctcccacaggaacagag

SEQ ID NO: 189542 - DNA, 25 bp, Mus musculus
aggagcttctccgacaggaacagag

SEQ ID NO: 189543 - DNA, 25 bp, Mus musculus
aggagcttctcgaggccatgtgatc

SEQ ID NO: 189544 - DNA, 25 bp, Mus musculus
aggagcttctcgtggccatgtgatc

SEQ ID NO: 189545 - DNA, 25 bp, Mus musculus
aggagcttgccacgctgcggacaaa

SEQ ID NO: 189546 - DNA, 25 bp, Mus musculus
aggagcttgccaggctgcggacaaa

SEQ ID NO: 189547 - DNA, 25 bp, Mus musculus
aggagcttggtcatttgccttcata

SEQ ID NO: 189548 - DNA, 25 bp, Mus musculus
aggagcttggtcttttgccttcata

SEQ ID NO: 189549 - DNA, 25 bp, Mus musculus
aggagcttgtctccctgtccaggga

SEQ ID NO: 189550 - DNA, 25 bp, Mus musculus
aggagcttgtctgcctgtccaggga

SEQ ID NO: 189551 - DNA, 25 bp, Mus musculus
aggagctttccacattggctgaaga

SEQ ID NO: 189552 - DNA, 25 bp, Mus musculus
aggagctttccagattggctgaaga

SEQ ID NO: 189553 - DNA, 25 bp, Mus musculus
aggagcttttctagtgtgtgattta

SEQ ID NO: 189554 - DNA, 25 bp, Mus musculus
aggagcttttcttgtgtgtgattta

SEQ ID NO: 189555 - DNA, 25 bp, Mus musculus
aggaggaaatggcagtcatgctttc

SEQ ID NO: 189556 - DNA, 25 bp, Mus musculus
aggaggaaatgggagtcatgctttc

SEQ ID NO: 189557 - DNA, 25 bp, Mus musculus
aggaggaacataacaaggaagccct

SEQ ID NO: 189558 - DNA, 25 bp, Mus musculus
aggaggaacatatcaaggaagccct

SEQ ID NO: 189559 - DNA, 25 bp, Mus musculus
aggaggaacgctcagttgttccttt

SEQ ID NO: 189560 - DNA, 25 bp, Mus musculus
aggaggaacgctgagttgttccttt

SEQ ID NO: 189561 - DNA, 25 bp, Mus musculus
aggaggaacgttaggccactctctt

SEQ ID NO: 189562 - DNA, 25 bp, Mus musculus
aggaggaacgtttggccactctctt

SEQ ID NO: 189563 - DNA, 25 bp, Mus musculus
aggaggaagcacactcttctgtctc

SEQ ID NO: 189564 - DNA, 25 bp, Mus musculus
aggaggaagcactctcttctgtctc

SEQ ID NO: 189565 - DNA, 25 bp, Mus musculus
aggaggaagctactcatctgccctt

SEQ ID NO: 189566 - DNA, 25 bp, Mus musculus
aggaggaagctagtcatctgccctt

SEQ ID NO: 189567 - DNA, 25 bp, Mus musculus
aggaggaagcttagcacattagaaa

SEQ ID NO: 189568 - DNA, 25 bp, Mus musculus
aggaggaagctttgcacattagaaa

SEQ ID NO: 189569 - DNA, 25 bp, Mus musculus
aggaggaagttgacatttctgaggc

SEQ ID NO: 189570 - DNA, 25 bp, Mus musculus
aggaggaagttgtcatttctgaggc

SEQ ID NO: 189571 - DNA, 25 bp, Mus musculus
aggaggaatccgatccagactcaaa

SEQ ID NO: 189572 - DNA, 25 bp, Mus musculus
aggaggaatccgttccagactcaaa

SEQ ID NO: 189573 - DNA, 25 bp, Mus musculus
aggaggaatggtatgttcttagaat

SEQ ID NO: 189574 - DNA, 25 bp, Mus musculus
aggaggaatggtttgttcttagaat

SEQ ID NO: 189575 - DNA, 25 bp, Mus musculus
aggaggaattctcttactgataatc

SEQ ID NO: 189576 - DNA, 25 bp, Mus musculus
aggaggaattctgttactgataatc

SEQ ID NO: 189577 - DNA, 25 bp, Mus musculus
aggaggaatttcagcgcacctatgc

SEQ ID NO: 189578 - DNA, 25 bp, Mus musculus
aggaggaatttctgcgcacctatgc

SEQ ID NO: 189579 - DNA, 25 bp, Mus musculus
aggaggacaacaccgggctactccc

SEQ ID NO: 189580 - DNA, 25 bp, Mus musculus
aggaggacaacagcgggctactccc

SEQ ID NO: 189581 - DNA, 25 bp, Mus musculus
aggaggacacatagctttccccagt

SEQ ID NO: 189582 - DNA, 25 bp, Mus musculus
aggaggacacattgctttccccagt

SEQ ID NO: 189583 - DNA, 25 bp, Mus musculus
aggaggacacgcaaacacgcgaact

SEQ ID NO: 189584 - DNA, 25 bp, Mus musculus
aggaggacacgcagcagttggcctt

SEQ ID NO: 189585 - DNA, 25 bp, Mus musculus
aggaggacacgctaacacgcgaact

SEQ ID NO: 189586 - DNA, 25 bp, Mus musculus
aggaggacacgctgcagttggcctt

SEQ ID NO: 189587 - DNA, 25 bp, Mus musculus
aggaggacatccagtggtgcactga

SEQ ID NO: 189588 - DNA, 25 bp, Mus musculus
aggaggacatcctgtggtgcactga

SEQ ID NO: 189589 - DNA, 25 bp, Mus musculus
aggaggacattcagtggagaaagac

SEQ ID NO: 189590 - DNA, 25 bp, Mus musculus
aggaggacattctgtggagaaagac

SEQ ID NO: 189591 - DNA, 25 bp, Mus musculus
aggaggacattgatttcctgcccca

SEQ ID NO: 189592 - DNA, 25 bp, Mus musculus
aggaggacattgttttcctgcccca

SEQ ID NO: 189593 - DNA, 25 bp, Mus musculus
aggaggaccaacaccaggatacaca

SEQ ID NO: 189594 - DNA, 25 bp, Mus musculus
aggaggaccaactccaggatacaca

SEQ ID NO: 189595 - DNA, 25 bp, Mus musculus
aggaggaccacacatcccagaccta

SEQ ID NO: 189596 - DNA, 25 bp, Mus musculus
aggaggaccacaccatctgcctcag

SEQ ID NO: 189597 - DNA, 25 bp, Mus musculus
aggaggaccacagatcccagaccta

SEQ ID NO: 189598 - DNA, 25 bp, Mus musculus
aggaggaccacagcatctgcctcag

SEQ ID NO: 189599 - DNA, 25 bp, Mus musculus
aggaggaccagaatctaacagaagc

SEQ ID NO: 189600 - DNA, 25 bp, Mus musculus
aggaggaccagattctaacagaagc

SEQ ID NO: 189601 - DNA, 25 bp, Mus musculus
aggaggaccatgcagctaacccacc

SEQ ID NO: 189602 - DNA, 25 bp, Mus musculus
aggaggaccatggagctaacccacc

SEQ ID NO: 189603 - DNA, 25 bp, Mus musculus
aggaggacccagagaatggcagcct

SEQ ID NO: 189604 - DNA, 25 bp, Mus musculus
aggaggacccagtgaatggcagcct

SEQ ID NO: 189605 - DNA, 25 bp, Mus musculus
aggaggaccctgagaaacagcgcag

SEQ ID NO: 189606 - DNA, 25 bp, Mus musculus
aggaggaccctgtgaaacagcgcag

SEQ ID NO: 189607 - DNA, 25 bp, Mus musculus
aggaggaccgctcaagcggctctca

SEQ ID NO: 189608 - DNA, 25 bp, Mus musculus
aggaggaccgctgaagcggctctca

SEQ ID NO: 189609 - DNA, 25 bp, Mus musculus
aggaggacctcaaattcaaggccat

SEQ ID NO: 189610 - DNA, 25 bp, Mus musculus
aggaggacctcacggctgatacttg

SEQ ID NO: 189611 - DNA, 25 bp, Mus musculus
aggaggacctcagggctgatacttg

SEQ ID NO: 189612 - DNA, 25 bp, Mus musculus
aggaggacctcatattcaaggccat

SEQ ID NO: 189613 - DNA, 25 bp, Mus musculus
aggaggacctgaatcttcctggtct

SEQ ID NO: 189614 - DNA, 25 bp, Mus musculus
aggaggacctgattcttcctggtct

SEQ ID NO: 189615 - DNA, 25 bp, Mus musculus
aggaggacctgtactgcatgcactc

SEQ ID NO: 189616 - DNA, 25 bp, Mus musculus
aggaggacctgtagccttcttatgg

SEQ ID NO: 189617 - DNA, 25 bp, Mus musculus
aggaggacctgttctgcatgcactc

SEQ ID NO: 189618 - DNA, 25 bp, Mus musculus
aggaggacctgttgccttcttatgg

SEQ ID NO: 189619 - DNA, 25 bp, Mus musculus
aggaggactatcctcacactcatgg

SEQ ID NO: 189620 - DNA, 25 bp, Mus musculus
aggaggactatcgtcacactcatgg

SEQ ID NO: 189621 - DNA, 25 bp, Mus musculus
aggaggactcctcttggtgctcttg

SEQ ID NO: 189622 - DNA, 25 bp, Mus musculus
aggaggactcctgttggtgctcttg

SEQ ID NO: 189623 - DNA, 25 bp, Mus musculus
aggaggactcgaccatagactatga

SEQ ID NO: 189624 - DNA, 25 bp, Mus musculus
aggaggactcgagcatagactatga

SEQ ID NO: 189625 - DNA, 25 bp, Mus musculus
aggaggactcttccagggttttgta

SEQ ID NO: 189626 - DNA, 25 bp, Mus musculus
aggaggactcttgcagggttttgta

SEQ ID NO: 189627 - DNA, 25 bp, Mus musculus
aggaggactgaaccagcctggtttt

SEQ ID NO: 189628 - DNA, 25 bp, Mus musculus
aggaggactgaagcagcctggtttt

SEQ ID NO: 189629 - DNA, 25 bp, Mus musculus
aggaggactgccaggcctggactca

SEQ ID NO: 189630 - DNA, 25 bp, Mus musculus
aggaggactgcctggcctggactca

SEQ ID NO: 189631 - DNA, 25 bp, Mus musculus
aggaggacttacatttgcggaactg

SEQ ID NO: 189632 - DNA, 25 bp, Mus musculus
aggaggacttacttttgcggaactg

SEQ ID NO: 189633 - DNA, 25 bp, Mus musculus
aggaggagaccaacgagaggaacct

SEQ ID NO: 189634 - DNA, 25 bp, Mus musculus
aggaggagaccatcgagaggaacct

SEQ ID NO: 189635 - DNA, 25 bp, Mus musculus
aggaggagactccaaactagcccct

SEQ ID NO: 189636 - DNA, 25 bp, Mus musculus
aggaggagactcgaaactagcccct

SEQ ID NO: 189637 - DNA, 25 bp, Mus musculus
aggaggagatcaccaaatttgagga

SEQ ID NO: 189638 - DNA, 25 bp, Mus musculus
aggaggagatcagcaaatttgagga

SEQ ID NO: 189639 - DNA, 25 bp, Mus musculus
aggaggagcactagcggctcttgca

SEQ ID NO: 189640 - DNA, 25 bp, Mus musculus
aggaggagcacttgcggctcttgca

SEQ ID NO: 189641 - DNA, 25 bp, Mus musculus
aggaggagccccatgcggaagacct

SEQ ID NO: 189642 - DNA, 25 bp, Mus musculus
aggaggagccccttgcggaagacct

SEQ ID NO: 189643 - DNA, 25 bp, Mus musculus
aggaggagccctcgcacttgctagc

SEQ ID NO: 189644 - DNA, 25 bp, Mus musculus
aggaggagccctggcacttgctagc

SEQ ID NO: 189645 - DNA, 25 bp, Mus musculus
aggaggagccgcactacagccgcca

SEQ ID NO: 189646 - DNA, 25 bp, Mus musculus
aggaggagccgctctacagccgcca

SEQ ID NO: 189647 - DNA, 25 bp, Mus musculus
aggaggagcgccagtcccgatacca

SEQ ID NO: 189648 - DNA, 25 bp, Mus musculus
aggaggagcgcctgtcccgatacca

SEQ ID NO: 189649 - DNA, 25 bp, Mus musculus
aggaggaggaccaccaagcccagat

SEQ ID NO: 189650 - DNA, 25 bp, Mus musculus
aggaggaggacctccaagcccagat

SEQ ID NO: 189651 - DNA, 25 bp, Mus musculus
aggaggaggataaggacgcacttct

SEQ ID NO: 189652 - DNA, 25 bp, Mus musculus
aggaggaggatatggacgcacttct

SEQ ID NO: 189653 - DNA, 25 bp, Mus musculus
aggaggaggatgatgcaacctatta

SEQ ID NO: 189654 - DNA, 25 bp, Mus musculus
aggaggaggatgttgcaacctatta

SEQ ID NO: 189655 - DNA, 25 bp, Mus musculus
aggaggaggcgcagaggtccaggaa

SEQ ID NO: 189656 - DNA, 25 bp, Mus musculus
aggaggaggcgctgaggtccaggaa

SEQ ID NO: 189657 - DNA, 25 bp, Mus musculus
aggaggagggtgaccagcattctca

SEQ ID NO: 189658 - DNA, 25 bp, Mus musculus
aggaggagggtgtccagcattctca

SEQ ID NO: 189659 - DNA, 25 bp, Mus musculus
aggaggagtcagaaccaggctataa

SEQ ID NO: 189660 - DNA, 25 bp, Mus musculus
aggaggagtcagtaccaggctataa

SEQ ID NO: 189661 - DNA, 25 bp, Mus musculus
aggaggagtcccagaacgcctcgga

SEQ ID NO: 189662 - DNA, 25 bp, Mus musculus
aggaggagtccctgaacgcctcgga

SEQ ID NO: 189663 - DNA, 25 bp, Mus musculus
aggaggagtcctagtgaggcacccc

SEQ ID NO: 189664 - DNA, 25 bp, Mus musculus
aggaggagtccttgtgaggcacccc

SEQ ID NO: 189665 - DNA, 25 bp, Mus musculus
aggaggagttccactgaccttgtgt

SEQ ID NO: 189666 - DNA, 25 bp, Mus musculus
aggaggagttcctctgaccttgtgt

SEQ ID NO: 189667 - DNA, 25 bp, Mus musculus
aggaggagttctacaacctgtcaca

SEQ ID NO: 189668 - DNA, 25 bp, Mus musculus
aggaggagttcttcaacctgtcaca

SEQ ID NO: 189669 - DNA, 25 bp, Mus musculus
aggaggatcaccagtccagggcaat

SEQ ID NO: 189670 - DNA, 25 bp, Mus musculus
aggaggatcacctgtccagggcaat

SEQ ID NO: 189671 - DNA, 25 bp, Mus musculus
aggaggatcccacaacggcagcact

SEQ ID NO: 189672 - DNA, 25 bp, Mus musculus
aggaggatcccagaacggcagcact

SEQ ID NO: 189673 - DNA, 25 bp, Mus musculus
aggaggatccccacttgccaagttt

SEQ ID NO: 189674 - DNA, 25 bp, Mus musculus
aggaggatcccctcttgccaagttt

SEQ ID NO: 189675 - DNA, 25 bp, Mus musculus
aggaggatccctaaggtggcttcac

SEQ ID NO: 189676 - DNA, 25 bp, Mus musculus
aggaggatcccttaggtggcttcac

SEQ ID NO: 189677 - DNA, 25 bp, Mus musculus
aggaggatccggagttcaagccttc

SEQ ID NO: 189678 - DNA, 25 bp, Mus musculus
aggaggatccggtgttcaagccttc

SEQ ID NO: 189679 - DNA, 25 bp, Mus musculus
aggaggatctctcgagcttgctcca

SEQ ID NO: 189680 - DNA, 25 bp, Mus musculus
aggaggatctctggagcttgctcca

SEQ ID NO: 189681 - DNA, 25 bp, Mus musculus
aggaggatcttgactagtctgccca

SEQ ID NO: 189682 - DNA, 25 bp, Mus musculus
aggaggatcttgtctagtctgccca

SEQ ID NO: 189683 - DNA, 25 bp, Mus musculus
aggaggatgaacacccaaggtggct

SEQ ID NO: 189684 - DNA, 25 bp, Mus musculus
aggaggatgaactcccaaggtggct

SEQ ID NO: 189685 - DNA, 25 bp, Mus musculus
aggaggatgagcatcacgtgcgctc

SEQ ID NO: 189686 - DNA, 25 bp, Mus musculus
aggaggatgagcttcacgtgcgctc

SEQ ID NO: 189687 - DNA, 25 bp, Mus musculus
aggaggatgccccacggctccatgc

SEQ ID NO: 189688 - DNA, 25 bp, Mus musculus
aggaggatgcccgacggctccatgc

SEQ ID NO: 189689 - DNA, 25 bp, Mus musculus
aggaggatgctgaccttactgagaa

SEQ ID NO: 189690 - DNA, 25 bp, Mus musculus
aggaggatgctgatttcatcccagt

SEQ ID NO: 189691 - DNA, 25 bp, Mus musculus
aggaggatgctgtccttactgagaa

SEQ ID NO: 189692 - DNA, 25 bp, Mus musculus
aggaggatgctgttttcatcccagt

SEQ ID NO: 189693 - DNA, 25 bp, Mus musculus
aggaggatggctacagaactggcaa

SEQ ID NO: 189694 - DNA, 25 bp, Mus musculus
aggaggatggcttcagaactggcaa

SEQ ID NO: 189695 - DNA, 25 bp, Mus musculus
aggaggatgtcacctgcccaactgc

SEQ ID NO: 189696 - DNA, 25 bp, Mus musculus
aggaggatgtcagctgcccaactgc

SEQ ID NO: 189697 - DNA, 25 bp, Mus musculus
aggaggatgttaactgggtcttcaa

SEQ ID NO: 189698 - DNA, 25 bp, Mus musculus
aggaggatgttatctgggtcttcaa

SEQ ID NO: 189699 - DNA, 25 bp, Mus musculus
aggaggatgttgcaacctattactg

SEQ ID NO: 189700 - DNA, 25 bp, Mus musculus
aggaggatgttggaacctattactg

SEQ ID NO: 189701 - DNA, 25 bp, Mus musculus
aggaggattcaacctgcacttctga

SEQ ID NO: 189702 - DNA, 25 bp, Mus musculus
aggaggattcaagctgcacttctga

SEQ ID NO: 189703 - DNA, 25 bp, Mus musculus
aggaggattcacacgctagtctact

SEQ ID NO: 189704 - DNA, 25 bp, Mus musculus
aggaggattcactcgctagtctact

SEQ ID NO: 189705 - DNA, 25 bp, Mus musculus
aggaggattctacgattcttcttta

SEQ ID NO: 189706 - DNA, 25 bp, Mus musculus
aggaggattctaggattcttcttta

SEQ ID NO: 189707 - DNA, 25 bp, Mus musculus
aggaggatttcacccagcagctacc

SEQ ID NO: 189708 - DNA, 25 bp, Mus musculus
aggaggatttcagccagcagctacc

SEQ ID NO: 189709 - DNA, 25 bp, Mus musculus
aggaggcaaaccatggactcggccc

SEQ ID NO: 189710 - DNA, 25 bp, Mus musculus
aggaggcaaaccttggactcggccc

SEQ ID NO: 189711 - DNA, 25 bp, Mus musculus
aggaggcaagtgacttcatgtcagg

SEQ ID NO: 189712 - DNA, 25 bp, Mus musculus
aggaggcaagtgtcttcatgtcagg

SEQ ID NO: 189713 - DNA, 25 bp, Mus musculus
aggaggcacactagcattgctcaca

SEQ ID NO: 189714 - DNA, 25 bp, Mus musculus
aggaggcacacttgcattgctcaca

SEQ ID NO: 189715 - DNA, 25 bp, Mus musculus
aggaggcacagcaggcctacgggca

SEQ ID NO: 189716 - DNA, 25 bp, Mus musculus
aggaggcacagctggcctacgggca

SEQ ID NO: 189717 - DNA, 25 bp, Mus musculus
aggaggcaccaactgccagatacgt

SEQ ID NO: 189718 - DNA, 25 bp, Mus musculus
aggaggcaccaagtgccagatacgt

SEQ ID NO: 189719 - DNA, 25 bp, Mus musculus
aggaggcaccccacgtgcagtatga

SEQ ID NO: 189720 - DNA, 25 bp, Mus musculus
aggaggcacccctcgtgcagtatga

SEQ ID NO: 189721 - DNA, 25 bp, Mus musculus
aggaggcaccgcaagcaagccttga

SEQ ID NO: 189722 - DNA, 25 bp, Mus musculus
aggaggcaccgctagcaagccttga

SEQ ID NO: 189723 - DNA, 25 bp, Mus musculus
aggaggcactggattcaacccacag

SEQ ID NO: 189724 - DNA, 25 bp, Mus musculus
aggaggcactggtttcaacccacag

SEQ ID NO: 189725 - DNA, 25 bp, Mus musculus
aggaggcagaatacaccataatttc

SEQ ID NO: 189726 - DNA, 25 bp, Mus musculus
aggaggcagaattcaccataatttc

SEQ ID NO: 189727 - DNA, 25 bp, Mus musculus
aggaggcaggatactcttagtccct

SEQ ID NO: 189728 - DNA, 25 bp, Mus musculus
aggaggcaggattctcttagtccct

SEQ ID NO: 189729 - DNA, 25 bp, Mus musculus
aggaggcatctcatccccggtgaag

SEQ ID NO: 189730 - DNA, 25 bp, Mus musculus
aggaggcatctcttccccggtgaag

SEQ ID NO: 189731 - DNA, 25 bp, Mus musculus
aggaggcatgaaccagctgatatga

SEQ ID NO: 189732 - DNA, 25 bp, Mus musculus
aggaggcatgaagcagctgatatga

SEQ ID NO: 189733 - DNA, 25 bp, Mus musculus
aggaggcatgtacccaactcgtgag

SEQ ID NO: 189734 - DNA, 25 bp, Mus musculus
aggaggcatgtagccaactcgtgag

SEQ ID NO: 189735 - DNA, 25 bp, Mus musculus
aggaggcatgtcagtcctacgtcac

SEQ ID NO: 189736 - DNA, 25 bp, Mus musculus
aggaggcatgtctgtcctacgtcac

SEQ ID NO: 189737 - DNA, 25 bp, Mus musculus
aggaggccaaacctagagctgtgca

SEQ ID NO: 189738 - DNA, 25 bp, Mus musculus
aggaggccaaacgtagagctgtgca

SEQ ID NO: 189739 - DNA, 25 bp, Mus musculus
aggaggccaagaactgctaacacag

SEQ ID NO: 189740 - DNA, 25 bp, Mus musculus
aggaggccaagaacttcctgctgcc

SEQ ID NO: 189741 - DNA, 25 bp, Mus musculus
aggaggccaagatctgctaacacag

SEQ ID NO: 189742 - DNA, 25 bp, Mus musculus
aggaggccaagatcttcctgctgcc

SEQ ID NO: 189743 - DNA, 25 bp, Mus musculus
aggaggccaagcagtctgacaagga

SEQ ID NO: 189744 - DNA, 25 bp, Mus musculus
aggaggccaagctgtctgacaagga

SEQ ID NO: 189745 - DNA, 25 bp, Mus musculus
aggaggccacaccacatgcaggctt

SEQ ID NO: 189746 - DNA, 25 bp, Mus musculus
aggaggccacacgacatgcaggctt

SEQ ID NO: 189747 - DNA, 25 bp, Mus musculus
aggaggccagctacagcaggattca

SEQ ID NO: 189748 - DNA, 25 bp, Mus musculus
aggaggccagctactgagagcgttt

SEQ ID NO: 189749 - DNA, 25 bp, Mus musculus
aggaggccagcttcagcaggattca

SEQ ID NO: 189750 - DNA, 25 bp, Mus musculus
aggaggccagcttctgagagcgttt

SEQ ID NO: 189751 - DNA, 25 bp, Mus musculus
aggaggccaggaagtccttcttctc

SEQ ID NO: 189752 - DNA, 25 bp, Mus musculus
aggaggccaggatgtccttcttctc

SEQ ID NO: 189753 - DNA, 25 bp, Mus musculus
aggaggccaggtaccagctgaatag

SEQ ID NO: 189754 - DNA, 25 bp, Mus musculus
aggaggccaggttccagctgaatag

SEQ ID NO: 189755 - DNA, 25 bp, Mus musculus
aggaggccatgaccataccaacatt

SEQ ID NO: 189756 - DNA, 25 bp, Mus musculus
aggaggccatgacttataagaagtc

SEQ ID NO: 189757 - DNA, 25 bp, Mus musculus
aggaggccatgagcataccaacatt

SEQ ID NO: 189758 - DNA, 25 bp, Mus musculus
aggaggccatgagttataagaagtc

SEQ ID NO: 189759 - DNA, 25 bp, Mus musculus
aggaggcccacacggatcacagctc

SEQ ID NO: 189760 - DNA, 25 bp, Mus musculus
aggaggcccacagggatcacagctc

SEQ ID NO: 189761 - DNA, 25 bp, Mus musculus
aggaggcccaggactcttgggctat

SEQ ID NO: 189762 - DNA, 25 bp, Mus musculus
aggaggcccaggtctcttgggctat

SEQ ID NO: 189763 - DNA, 25 bp, Mus musculus
aggaggccccagaaaataacatgct

SEQ ID NO: 189764 - DNA, 25 bp, Mus musculus
aggaggccccagtaaataacatgct

SEQ ID NO: 189765 - DNA, 25 bp, Mus musculus
aggaggcccctacacaaaatgcagc

SEQ ID NO: 189766 - DNA, 25 bp, Mus musculus
aggaggcccctagacaaaatgcagc

SEQ ID NO: 189767 - DNA, 25 bp, Mus musculus
aggaggcccctcaaccatatgggat

SEQ ID NO: 189768 - DNA, 25 bp, Mus musculus
aggaggcccctctaccatatgggat

SEQ ID NO: 189769 - DNA, 25 bp, Mus musculus
aggaggcccctgaccctaatagcct

SEQ ID NO: 189770 - DNA, 25 bp, Mus musculus
aggaggcccctgtccctaatagcct

SEQ ID NO: 189771 - DNA, 25 bp, Mus musculus
aggaggcccgaacctggacattgtc

SEQ ID NO: 189772 - DNA, 25 bp, Mus musculus
aggaggcccgaagctggacattgtc

SEQ ID NO: 189773 - DNA, 25 bp, Mus musculus
aggaggcccgccagggaggagggtg

SEQ ID NO: 189774 - DNA, 25 bp, Mus musculus
aggaggcccgcctgggaggagggtg

SEQ ID NO: 189775 - DNA, 25 bp, Mus musculus
aggaggcccgtaagcttcttagcac

SEQ ID NO: 189776 - DNA, 25 bp, Mus musculus
aggaggcccgtatgcttcttagcac

SEQ ID NO: 189777 - DNA, 25 bp, Mus musculus
aggaggccctacagctgctttttat

SEQ ID NO: 189778 - DNA, 25 bp, Mus musculus
aggaggccctactgctgctttttat

SEQ ID NO: 189779 - DNA, 25 bp, Mus musculus
aggaggccctgaagccactagggaa

SEQ ID NO: 189780 - DNA, 25 bp, Mus musculus
aggaggccctgatgccactagggaa

SEQ ID NO: 189781 - DNA, 25 bp, Mus musculus
aggaggccggttactctgtctggaa

SEQ ID NO: 189782 - DNA, 25 bp, Mus musculus
aggaggccggtttctctgtctggaa

SEQ ID NO: 189783 - DNA, 25 bp, Mus musculus
aggaggcctcagcagggcgcgcctt

SEQ ID NO: 189784 - DNA, 25 bp, Mus musculus
aggaggcctcaggagggcgcgcctt

SEQ ID NO: 189785 - DNA, 25 bp, Mus musculus
aggaggcctctacactgtcacacgg

SEQ ID NO: 189786 - DNA, 25 bp, Mus musculus
aggaggcctctagactgtcacacgg

SEQ ID NO: 189787 - DNA, 25 bp, Mus musculus
aggaggcctctcatcactggtgccc

SEQ ID NO: 189788 - DNA, 25 bp, Mus musculus
aggaggcctctcttcactggtgccc

SEQ ID NO: 189789 - DNA, 25 bp, Mus musculus
aggaggcctctgctgctcactcatt

SEQ ID NO: 189790 - DNA, 25 bp, Mus musculus
aggaggcctctggtgctcactcatt

SEQ ID NO: 189791 - DNA, 25 bp, Mus musculus
aggaggcctcttcttctcttcggaa

SEQ ID NO: 189792 - DNA, 25 bp, Mus musculus
aggaggcctcttgttctcttcggaa

SEQ ID NO: 189793 - DNA, 25 bp, Mus musculus
aggaggcctgccaggcttcctatgg

SEQ ID NO: 189794 - DNA, 25 bp, Mus musculus
aggaggcctgcctggcttcctatgg

SEQ ID NO: 189795 - DNA, 25 bp, Mus musculus
aggaggcctggtctaccacccttga

SEQ ID NO: 189796 - DNA, 25 bp, Mus musculus
aggaggcctggtgtaccacccttga

SEQ ID NO: 189797 - DNA, 25 bp, Mus musculus
aggaggcctgtgacacatccttcaa

SEQ ID NO: 189798 - DNA, 25 bp, Mus musculus
aggaggcctgtgtcacatccttcaa

SEQ ID NO: 189799 - DNA, 25 bp, Mus musculus
aggaggcctgttatgttctgaagat

SEQ ID NO: 189800 - DNA, 25 bp, Mus musculus
aggaggcctgttttgttctgaagat

SEQ ID NO: 189801 - DNA, 25 bp, Mus musculus
aggaggccttccagcaaaggacttg

SEQ ID NO: 189802 - DNA, 25 bp, Mus musculus
aggaggccttcctgcaaaggacttg

SEQ ID NO: 189803 - DNA, 25 bp, Mus musculus
aggaggccttctatcccctgtactt

SEQ ID NO: 189804 - DNA, 25 bp, Mus musculus
aggaggccttctttcccctgtactt

SEQ ID NO: 189805 - DNA, 25 bp, Mus musculus
aggaggcgaagaccctttcacagac

SEQ ID NO: 189806 - DNA, 25 bp, Mus musculus
aggaggcgaagagcctttcacagac

SEQ ID NO: 189807 - DNA, 25 bp, Mus musculus
aggaggcgagcacttgtacaatttt

SEQ ID NO: 189808 - DNA, 25 bp, Mus musculus
aggaggcgagcagttgtacaatttt

SEQ ID NO: 189809 - DNA, 25 bp, Mus musculus
aggaggcgagctacagactgtctgc

SEQ ID NO: 189810 - DNA, 25 bp, Mus musculus
aggaggcgagcttcagactgtctgc

SEQ ID NO: 189811 - DNA, 25 bp, Mus musculus
aggaggcgagtgaccacactgccaa

SEQ ID NO: 189812 - DNA, 25 bp, Mus musculus
aggaggcgagtgtccacactgccaa

SEQ ID NO: 189813 - DNA, 25 bp, Mus musculus
aggaggcgcctgaaccgtggtcttc

SEQ ID NO: 189814 - DNA, 25 bp, Mus musculus
aggaggcgcctgtaccgtggtcttc

SEQ ID NO: 189815 - DNA, 25 bp, Mus musculus
aggaggcggccaatgaacagcctgt

SEQ ID NO: 189816 - DNA, 25 bp, Mus musculus
aggaggcggccattgaacagcctgt

SEQ ID NO: 189817 - DNA, 25 bp, Mus musculus
aggaggcggccgcttcactcctgca

SEQ ID NO: 189818 - DNA, 25 bp, Mus musculus
aggaggcggccggttcactcctgca

SEQ ID NO: 189819 - DNA, 25 bp, Mus musculus
aggaggcggcctacatgcaggacat

SEQ ID NO: 189820 - DNA, 25 bp, Mus musculus
aggaggcggccttcatgcaggacat

SEQ ID NO: 189821 - DNA, 25 bp, Mus musculus
aggaggcggtgcaaagtctgtctcc

SEQ ID NO: 189822 - DNA, 25 bp, Mus musculus
aggaggcggtgctaagtctgtctcc

SEQ ID NO: 189823 - DNA, 25 bp, Mus musculus
aggaggcgttcacgaccatccaggt

SEQ ID NO: 189824 - DNA, 25 bp, Mus musculus
aggaggcgttcaggaccatccaggt

SEQ ID NO: 189825 - DNA, 25 bp, Mus musculus
aggaggctaagcctcttcgtgcccg

SEQ ID NO: 189826 - DNA, 25 bp, Mus musculus
aggaggctaagcgtcttcgtgcccg

SEQ ID NO: 189827 - DNA, 25 bp, Mus musculus
aggaggctaattagctgaccctggc

SEQ ID NO: 189828 - DNA, 25 bp, Mus musculus
aggaggctaatttgctgaccctggc

SEQ ID NO: 189829 - DNA, 25 bp, Mus musculus
aggaggctatgcatcaccagttttc

SEQ ID NO: 189830 - DNA, 25 bp, Mus musculus
aggaggctatgcttcaccagttttc

SEQ ID NO: 189831 - DNA, 25 bp, Mus musculus
aggaggctattcaagatctctggca

SEQ ID NO: 189832 - DNA, 25 bp, Mus musculus
aggaggctattctagatctctggca

SEQ ID NO: 189833 - DNA, 25 bp, Mus musculus
aggaggctatttcatgacattacac

SEQ ID NO: 189834 - DNA, 25 bp, Mus musculus
aggaggctatttgatgacattacac

SEQ ID NO: 189835 - DNA, 25 bp, Mus musculus
aggaggctcagcaacatttctttgc

SEQ ID NO: 189836 - DNA, 25 bp, Mus musculus
aggaggctcagctacatttctttgc

SEQ ID NO: 189837 - DNA, 25 bp, Mus musculus
aggaggctcccacagacacggtctt

SEQ ID NO: 189838 - DNA, 25 bp, Mus musculus
aggaggctcccagagacacggtctt

SEQ ID NO: 189839 - DNA, 25 bp, Mus musculus
aggaggctccccagagaatagacag

SEQ ID NO: 189840 - DNA, 25 bp, Mus musculus
aggaggctcccctgagaatagacag

SEQ ID NO: 189841 - DNA, 25 bp, Mus musculus
aggaggctcctcaaacattgtcttt

SEQ ID NO: 189842 - DNA, 25 bp, Mus musculus
aggaggctcctctaacattgtcttt

SEQ ID NO: 189843 - DNA, 25 bp, Mus musculus
aggaggctcggcatcttgggcttta

SEQ ID NO: 189844 - DNA, 25 bp, Mus musculus
aggaggctcggcttcttgggcttta

SEQ ID NO: 189845 - DNA, 25 bp, Mus musculus
aggaggctctccacttggacagttc

SEQ ID NO: 189846 - DNA, 25 bp, Mus musculus
aggaggctctcctcttggacagttc

SEQ ID NO: 189847 - DNA, 25 bp, Mus musculus
aggaggctctgcagcatggtgactt

SEQ ID NO: 189848 - DNA, 25 bp, Mus musculus
aggaggctctgctgcatggtgactt

SEQ ID NO: 189849 - DNA, 25 bp, Mus musculus
aggaggctcttacttcatcactaga

SEQ ID NO: 189850 - DNA, 25 bp, Mus musculus
aggaggctcttagttcatcactaga

SEQ ID NO: 189851 - DNA, 25 bp, Mus musculus
aggaggctcttcagctcgcatctgc

SEQ ID NO: 189852 - DNA, 25 bp, Mus musculus
aggaggctcttctgctcgcatctgc

SEQ ID NO: 189853 - DNA, 25 bp, Mus musculus
aggaggctgacactggccacctgcc

SEQ ID NO: 189854 - DNA, 25 bp, Mus musculus
aggaggctgacagtggccacctgcc

SEQ ID NO: 189855 - DNA, 25 bp, Mus musculus
aggaggctgccaaggaccgccgcaa

SEQ ID NO: 189856 - DNA, 25 bp, Mus musculus
aggaggctgccatggaccgccgcaa

SEQ ID NO: 189857 - DNA, 25 bp, Mus musculus
aggaggctgcgaaggaacgctgcca

SEQ ID NO: 189858 - DNA, 25 bp, Mus musculus
aggaggctgcgatggaacgctgcca

SEQ ID NO: 189859 - DNA, 25 bp, Mus musculus
aggaggctggatctgcatgctaatc

SEQ ID NO: 189860 - DNA, 25 bp, Mus musculus
aggaggctggatgtgcatgctaatc

SEQ ID NO: 189861 - DNA, 25 bp, Mus musculus
aggaggctggccacaatttggagta

SEQ ID NO: 189862 - DNA, 25 bp, Mus musculus
aggaggctggcctcaatttggagta

SEQ ID NO: 189863 - DNA, 25 bp, Mus musculus
aggaggctggtgatgttctccccag

SEQ ID NO: 189864 - DNA, 25 bp, Mus musculus
aggaggctggtgttgttctccccag

SEQ ID NO: 189865 - DNA, 25 bp, Mus musculus
aggaggctgtccaggtgccaccatt

SEQ ID NO: 189866 - DNA, 25 bp, Mus musculus
aggaggctgtcctggtgccaccatt

SEQ ID NO: 189867 - DNA, 25 bp, Mus musculus
aggaggctgtttccccattctatta

SEQ ID NO: 189868 - DNA, 25 bp, Mus musculus
aggaggctgtttgcccattctatta

SEQ ID NO: 189869 - DNA, 25 bp, Mus musculus
aggaggcttagcaaccaggcatctc

SEQ ID NO: 189870 - DNA, 25 bp, Mus musculus
aggaggcttagctaccaggcatctc

SEQ ID NO: 189871 - DNA, 25 bp, Mus musculus
aggaggcttgatcggctttttgccc

SEQ ID NO: 189872 - DNA, 25 bp, Mus musculus
aggaggcttgatgggctttttgccc

SEQ ID NO: 189873 - DNA, 25 bp, Mus musculus
aggaggcttggtccttattctctta

SEQ ID NO: 189874 - DNA, 25 bp, Mus musculus
aggaggcttggtgcttattctctta

SEQ ID NO: 189875 - DNA, 25 bp, Mus musculus
aggagggaaactcccgtagattgta

SEQ ID NO: 189876 - DNA, 25 bp, Mus musculus
aggagggaaactgccgtagattgta

SEQ ID NO: 189877 - DNA, 25 bp, Mus musculus
aggagggaatgcagtctcccctctg

SEQ ID NO: 189878 - DNA, 25 bp, Mus musculus
aggagggaatgctgtctcccctctg

SEQ ID NO: 189879 - DNA, 25 bp, Mus musculus
aggagggactttacactgcacaggg

SEQ ID NO: 189880 - DNA, 25 bp, Mus musculus
aggagggacttttcactgcacaggg

SEQ ID NO: 189881 - DNA, 25 bp, Mus musculus
aggagggagggcatgccccatttct

SEQ ID NO: 189882 - DNA, 25 bp, Mus musculus
aggagggagggcttgccccatttct

SEQ ID NO: 189883 - DNA, 25 bp, Mus musculus
aggagggatctcaagggcaaagcat

SEQ ID NO: 189884 - DNA, 25 bp, Mus musculus
aggagggatctctagggcaaagcat

SEQ ID NO: 189885 - DNA, 25 bp, Mus musculus
aggagggcaagtactcaaatgtgaa

SEQ ID NO: 189886 - DNA, 25 bp, Mus musculus
aggagggcaagttctcaaatgtgaa

SEQ ID NO: 189887 - DNA, 25 bp, Mus musculus
aggagggcacatacggctcagatcg

SEQ ID NO: 189888 - DNA, 25 bp, Mus musculus
aggagggcacattcggctcagatcg

SEQ ID NO: 189889 - DNA, 25 bp, Mus musculus
aggagggcagcgcaactactttgtt

SEQ ID NO: 189890 - DNA, 25 bp, Mus musculus
aggagggcagcggaactactttgtt

SEQ ID NO: 189891 - DNA, 25 bp, Mus musculus
aggagggcaggcattgtcacccact

SEQ ID NO: 189892 - DNA, 25 bp, Mus musculus
aggagggcaggctttgtcacccact

SEQ ID NO: 189893 - DNA, 25 bp, Mus musculus
aggagggcatcaccgccctgcacaa

SEQ ID NO: 189894 - DNA, 25 bp, Mus musculus
aggagggcatcagcgccctgcacaa

SEQ ID NO: 189895 - DNA, 25 bp, Mus musculus
aggagggcatccacatcctacttag

SEQ ID NO: 189896 - DNA, 25 bp, Mus musculus
aggagggcatcctcatcctacttag

SEQ ID NO: 189897 - DNA, 25 bp, Mus musculus
aggagggccaaaccaccagcctttg

SEQ ID NO: 189898 - DNA, 25 bp, Mus musculus
aggagggccaaagcaccagcctttg

SEQ ID NO: 189899 - DNA, 25 bp, Mus musculus
aggagggccagaatcccagagtgcc

SEQ ID NO: 189900 - DNA, 25 bp, Mus musculus
aggagggccagattcccagagtgcc

SEQ ID NO: 189901 - DNA, 25 bp, Mus musculus
aggagggccatcagtgtacacaact

SEQ ID NO: 189902 - DNA, 25 bp, Mus musculus
aggagggccatctgtgtacacaact

SEQ ID NO: 189903 - DNA, 25 bp, Mus musculus
aggagggccgagcagcacaaaaatc

SEQ ID NO: 189904 - DNA, 25 bp, Mus musculus
aggagggccgaggagcacaaaaatc

SEQ ID NO: 189905 - DNA, 25 bp, Mus musculus
aggagggcctccagacagtttgcag

SEQ ID NO: 189906 - DNA, 25 bp, Mus musculus
aggagggcctcctgacagtttgcag

SEQ ID NO: 189907 - DNA, 25 bp, Mus musculus
aggagggccttgactctatgcaaca

SEQ ID NO: 189908 - DNA, 25 bp, Mus musculus
aggagggccttgtctctatgcaaca

SEQ ID NO: 189909 - DNA, 25 bp, Mus musculus
aggagggcgacacggtgcccgtgtc

SEQ ID NO: 189910 - DNA, 25 bp, Mus musculus
aggagggcgacagggtgcccgtgtc

SEQ ID NO: 189911 - DNA, 25 bp, Mus musculus
aggagggcgagaacttcgacacaga

SEQ ID NO: 189912 - DNA, 25 bp, Mus musculus
aggagggcgagatcttcgacacaga

SEQ ID NO: 189913 - DNA, 25 bp, Mus musculus
aggagggcgctgataccaccaagga

SEQ ID NO: 189914 - DNA, 25 bp, Mus musculus
aggagggcgctgttaccaccaagga

SEQ ID NO: 189915 - DNA, 25 bp, Mus musculus
aggagggctcagacactcttgaatt

SEQ ID NO: 189916 - DNA, 25 bp, Mus musculus
aggagggctcagtcactcttgaatt

SEQ ID NO: 189917 - DNA, 25 bp, Mus musculus
aggagggctcctagctcttgctggc

SEQ ID NO: 189918 - DNA, 25 bp, Mus musculus
aggagggctccttgctcttgctggc

SEQ ID NO: 189919 - DNA, 25 bp, Mus musculus
aggagggctgaaagctttgacaaag

SEQ ID NO: 189920 - DNA, 25 bp, Mus musculus
aggagggctgaatgctttgacaaag

SEQ ID NO: 189921 - DNA, 25 bp, Mus musculus
aggagggctgcaattaagatatata

SEQ ID NO: 189922 - DNA, 25 bp, Mus musculus
aggagggctgcacttaagctaccta

SEQ ID NO: 189923 - DNA, 25 bp, Mus musculus
aggagggctgcagttaagctaccta

SEQ ID NO: 189924 - DNA, 25 bp, Mus musculus
aggagggctgcatttaagatatata

SEQ ID NO: 189925 - DNA, 25 bp, Mus musculus
aggagggctggaaccctctgactta

SEQ ID NO: 189926 - DNA, 25 bp, Mus musculus
aggagggctggatccctctgactta

SEQ ID NO: 189927 - DNA, 25 bp, Mus musculus
aggagggcttccaaatagactgatt

SEQ ID NO: 189928 - DNA, 25 bp, Mus musculus
aggagggcttccaccagcgatggaa

SEQ ID NO: 189929 - DNA, 25 bp, Mus musculus
aggagggcttcctaatagactgatt

SEQ ID NO: 189930 - DNA, 25 bp, Mus musculus
aggagggcttcctccagcgatggaa

SEQ ID NO: 189931 - DNA, 25 bp, Mus musculus
aggaggggactcatggctactctat

SEQ ID NO: 189932 - DNA, 25 bp, Mus musculus
aggaggggactcttggctactctat

SEQ ID NO: 189933 - DNA, 25 bp, Mus musculus
aggagggtaaggaccactttgcagt

SEQ ID NO: 189934 - DNA, 25 bp, Mus musculus
aggagggtaaggtccactttgcagt

SEQ ID NO: 189935 - DNA, 25 bp, Mus musculus
aggagggtaccccatatctctctcc

SEQ ID NO: 189936 - DNA, 25 bp, Mus musculus
aggagggtacccgatatctctctcc

SEQ ID NO: 189937 - DNA, 25 bp, Mus musculus
aggagggtacgtacacgtgtgcaca

SEQ ID NO: 189938 - DNA, 25 bp, Mus musculus
aggagggtacgttcacgtgtgcaca

SEQ ID NO: 189939 - DNA, 25 bp, Mus musculus
aggagggtatccagacatgccacgg

SEQ ID NO: 189940 - DNA, 25 bp, Mus musculus
aggagggtatcctgacatgccacgg

SEQ ID NO: 189941 - DNA, 25 bp, Mus musculus
aggagggtcatcaaaatggctcagt

SEQ ID NO: 189942 - DNA, 25 bp, Mus musculus
aggagggtcatccactttgtcagtg

SEQ ID NO: 189943 - DNA, 25 bp, Mus musculus
aggagggtcatcgactttgtcagtg

SEQ ID NO: 189944 - DNA, 25 bp, Mus musculus
aggagggtcatctaaatggctcagt

SEQ ID NO: 189945 - DNA, 25 bp, Mus musculus
aggagggtccccagctcatctgagt

SEQ ID NO: 189946 - DNA, 25 bp, Mus musculus
aggagggtcccctgctcatctgagt

SEQ ID NO: 189947 - DNA, 25 bp, Mus musculus
aggagggtgcttacccgaggattct

SEQ ID NO: 189948 - DNA, 25 bp, Mus musculus
aggagggtgctttcccgaggattct

SEQ ID NO: 189949 - DNA, 25 bp, Mus musculus
aggagggtgtgcaacccttgcttta

SEQ ID NO: 189950 - DNA, 25 bp, Mus musculus
aggagggtgtgctacccttgcttta

SEQ ID NO: 189951 - DNA, 25 bp, Mus musculus
aggagggttctcagttatttataat

SEQ ID NO: 189952 - DNA, 25 bp, Mus musculus
aggagggttctctgttatttataat

SEQ ID NO: 189953 - DNA, 25 bp, Mus musculus
aggagggttctgattggcattgcct

SEQ ID NO: 189954 - DNA, 25 bp, Mus musculus
aggagggttctgtttggcattgcct

SEQ ID NO: 189955 - DNA, 25 bp, Mus musculus
aggagggtttccatttatgctgtag

SEQ ID NO: 189956 - DNA, 25 bp, Mus musculus
aggagggtttccttttatgctgtag

SEQ ID NO: 189957 - DNA, 25 bp, Mus musculus
aggaggtaaagaatatgctccctgt

SEQ ID NO: 189958 - DNA, 25 bp, Mus musculus
aggaggtaaagattatgctccctgt

SEQ ID NO: 189959 - DNA, 25 bp, Mus musculus
aggaggtactgtcttgccatgttgc

SEQ ID NO: 189960 - DNA, 25 bp, Mus musculus
aggaggtactgtgttgccatgttgc

SEQ ID NO: 189961 - DNA, 25 bp, Mus musculus
aggaggtagaccactacacccaatt

SEQ ID NO: 189962 - DNA, 25 bp, Mus musculus
aggaggtagacctctacacccaatt

SEQ ID NO: 189963 - DNA, 25 bp, Mus musculus
aggaggtagagacagctccctggca

SEQ ID NO: 189964 - DNA, 25 bp, Mus musculus
aggaggtagagagagctccctggca

SEQ ID NO: 189965 - DNA, 25 bp, Mus musculus
aggaggtagcaccattagttctttt

SEQ ID NO: 189966 - DNA, 25 bp, Mus musculus
aggaggtagcacgattagttctttt

SEQ ID NO: 189967 - DNA, 25 bp, Mus musculus
aggaggtagcctagcacacgtgtgc

SEQ ID NO: 189968 - DNA, 25 bp, Mus musculus
aggaggtagccttgcacacgtgtgc

SEQ ID NO: 189969 - DNA, 25 bp, Mus musculus
aggaggtagctgagccgccagggtt

SEQ ID NO: 189970 - DNA, 25 bp, Mus musculus
aggaggtagctgtgccgccagggtt

SEQ ID NO: 189971 - DNA, 25 bp, Mus musculus
aggaggtagttaacccccattggct

SEQ ID NO: 189972 - DNA, 25 bp, Mus musculus
aggaggtagttatcccccattggct

SEQ ID NO: 189973 - DNA, 25 bp, Mus musculus
aggaggtatacgaggctgccttagt

SEQ ID NO: 189974 - DNA, 25 bp, Mus musculus
aggaggtatacgtggctgccttagt

SEQ ID NO: 189975 - DNA, 25 bp, Mus musculus
aggaggtatcagactctggccatgc

SEQ ID NO: 189976 - DNA, 25 bp, Mus musculus
aggaggtatcagtctctggccatgc

SEQ ID NO: 189977 - DNA, 25 bp, Mus musculus
aggaggtatgtgctgtcagcctctt

SEQ ID NO: 189978 - DNA, 25 bp, Mus musculus
aggaggtatgtggtgtcagcctctt

SEQ ID NO: 189979 - DNA, 25 bp, Mus musculus
aggaggtcaagcacaagttcatggt

SEQ ID NO: 189980 - DNA, 25 bp, Mus musculus
aggaggtcaagctcaagttcatggt

SEQ ID NO: 189981 - DNA, 25 bp, Mus musculus
aggaggtcagacattattatccatc

SEQ ID NO: 189982 - DNA, 25 bp, Mus musculus
aggaggtcagactttattatccatc

SEQ ID NO: 189983 - DNA, 25 bp, Mus musculus
aggaggtcagcaccatggtcaactc

SEQ ID NO: 189984 - DNA, 25 bp, Mus musculus
aggaggtcagcagcatggtcaactc

SEQ ID NO: 189985 - DNA, 25 bp, Mus musculus
aggaggtcaggcacgcactcagaaa

SEQ ID NO: 189986 - DNA, 25 bp, Mus musculus
aggaggtcaggctcgcactcagaaa

SEQ ID NO: 189987 - DNA, 25 bp, Mus musculus
aggaggtcataaagcgttccctgcc

SEQ ID NO: 189988 - DNA, 25 bp, Mus musculus
aggaggtcataatgcgttccctgcc

SEQ ID NO: 189989 - DNA, 25 bp, Mus musculus
aggaggtccattactatggcatcca

SEQ ID NO: 189990 - DNA, 25 bp, Mus musculus
aggaggtccatttctatggcatcca

SEQ ID NO: 189991 - DNA, 25 bp, Mus musculus
aggaggtcctgcaacaggctttgac

SEQ ID NO: 189992 - DNA, 25 bp, Mus musculus
aggaggtcctgctacaggctttgac

SEQ ID NO: 189993 - DNA, 25 bp, Mus musculus
aggaggtcggtcctccgcttctgac

SEQ ID NO: 189994 - DNA, 25 bp, Mus musculus
aggaggtcggtcgtccgcttctgac

SEQ ID NO: 189995 - DNA, 25 bp, Mus musculus
aggaggtcgtggagcagactctctc

SEQ ID NO: 189996 - DNA, 25 bp, Mus musculus
aggaggtcgtggtgcagactctctc

SEQ ID NO: 189997 - DNA, 25 bp, Mus musculus
aggaggtctaccatcattttcagta

SEQ ID NO: 189998 - DNA, 25 bp, Mus musculus
aggaggtctaccttcattttcagta

SEQ ID NO: 189999 - DNA, 25 bp, Mus musculus
aggaggtctcatatcaccactgaac

SEQ ID NO: 190000 - DNA, 25 bp, Mus musculus
aggaggtctcatttcaccactgaac

SEQ ID NO: 190001 - DNA, 25 bp, Mus musculus
aggaggtctccaacccgctcaagga

SEQ ID NO: 190002 - DNA, 25 bp, Mus musculus
aggaggtctccaattataggctatc

SEQ ID NO: 190003 - DNA, 25 bp, Mus musculus
aggaggtctccatcccgctcaagga

SEQ ID NO: 190004 - DNA, 25 bp, Mus musculus
aggaggtctccatttataggctatc

SEQ ID NO: 190005 - DNA, 25 bp, Mus musculus
aggaggtctcctacttgctgctcgg

SEQ ID NO: 190006 - DNA, 25 bp, Mus musculus
aggaggtctcctatatggcagtgat

SEQ ID NO: 190007 - DNA, 25 bp, Mus musculus
aggaggtctccttcttgctgctcgg

SEQ ID NO: 190008 - DNA, 25 bp, Mus musculus
aggaggtctcctttatggcagtgat

SEQ ID NO: 190009 - DNA, 25 bp, Mus musculus
aggaggtctctgattcattctccct

SEQ ID NO: 190010 - DNA, 25 bp, Mus musculus
aggaggtctctgtttcattctccct

SEQ ID NO: 190011 - DNA, 25 bp, Mus musculus
aggaggtctggaacaagaacccgag

SEQ ID NO: 190012 - DNA, 25 bp, Mus musculus
aggaggtctggatcaagaacccgag

SEQ ID NO: 190013 - DNA, 25 bp, Mus musculus
aggaggtctgtgcagtagtttcact

SEQ ID NO: 190014 - DNA, 25 bp, Mus musculus
aggaggtctgtggagtagtttcact

SEQ ID NO: 190015 - DNA, 25 bp, Mus musculus
aggaggtcttgcacctcttggcttt

SEQ ID NO: 190016 - DNA, 25 bp, Mus musculus
aggaggtcttgctcctcttggcttt

SEQ ID NO: 190017 - DNA, 25 bp, Mus musculus
aggaggtcttggagtcagcctatgc

SEQ ID NO: 190018 - DNA, 25 bp, Mus musculus
aggaggtcttggtgtcagcctatgc

SEQ ID NO: 190019 - DNA, 25 bp, Mus musculus
aggaggtcttttataggtcatggag

SEQ ID NO: 190020 - DNA, 25 bp, Mus musculus
aggaggtcttttttaggtcatggag

SEQ ID NO: 190021 - DNA, 25 bp, Mus musculus
aggaggtgacaacccgcatacgcac

SEQ ID NO: 190022 - DNA, 25 bp, Mus musculus
aggaggtgacaagccgcatacgcac

SEQ ID NO: 190023 - DNA, 25 bp, Mus musculus
aggaggtgactcataacactgtccc

SEQ ID NO: 190024 - DNA, 25 bp, Mus musculus
aggaggtgactcttaacactgtccc

SEQ ID NO: 190025 - DNA, 25 bp, Mus musculus
aggaggtgagatcctgacaaaagat

SEQ ID NO: 190026 - DNA, 25 bp, Mus musculus
aggaggtgagatgctgacaaaagat

SEQ ID NO: 190027 - DNA, 25 bp, Mus musculus
aggaggtgattaacaagcccgttca

SEQ ID NO: 190028 - DNA, 25 bp, Mus musculus
aggaggtgattatcaagcccgttca

SEQ ID NO: 190029 - DNA, 25 bp, Mus musculus
aggaggtgcagactgtccttacctg

SEQ ID NO: 190030 - DNA, 25 bp, Mus musculus
aggaggtgcagagtgtccttacctg

SEQ ID NO: 190031 - DNA, 25 bp, Mus musculus
aggaggtgctacagaagaggttcta

SEQ ID NO: 190032 - DNA, 25 bp, Mus musculus
aggaggtgctactgaagaggttcta

SEQ ID NO: 190033 - DNA, 25 bp, Mus musculus
aggaggtgctgacctgccgatacct

SEQ ID NO: 190034 - DNA, 25 bp, Mus musculus
aggaggtgctgagctgccgatacct

SEQ ID NO: 190035 - DNA, 25 bp, Mus musculus
aggaggtgcttcaggtgaactgaaa

SEQ ID NO: 190036 - DNA, 25 bp, Mus musculus
aggaggtgcttctggtgaactgaaa

SEQ ID NO: 190037 - DNA, 25 bp, Mus musculus
aggaggtggagaaccaaggctaaat

SEQ ID NO: 190038 - DNA, 25 bp, Mus musculus
aggaggtggagatccaaggctaaat

SEQ ID NO: 190039 - DNA, 25 bp, Mus musculus
aggaggtggctccttgcttaagctt

SEQ ID NO: 190040 - DNA, 25 bp, Mus musculus
aggaggtggctcgttgcttaagctt

SEQ ID NO: 190041 - DNA, 25 bp, Mus musculus
aggaggtggcttagagcttttctta

SEQ ID NO: 190042 - DNA, 25 bp, Mus musculus
aggaggtggctttgagcttttctta

SEQ ID NO: 190043 - DNA, 25 bp, Mus musculus
aggaggtgggacagctcttgccatt

SEQ ID NO: 190044 - DNA, 25 bp, Mus musculus
aggaggtgggactgctcttgccatt

SEQ ID NO: 190045 - DNA, 25 bp, Mus musculus
aggaggtgggcaagctatggatact

SEQ ID NO: 190046 - DNA, 25 bp, Mus musculus
aggaggtgggcatgctatggatact

SEQ ID NO: 190047 - DNA, 25 bp, Mus musculus
aggaggtggttaaaaccctctgacg

SEQ ID NO: 190048 - DNA, 25 bp, Mus musculus
aggaggtggttataaccctctgacg

SEQ ID NO: 190049 - DNA, 25 bp, Mus musculus
aggaggtgtcagctgttatcattca

SEQ ID NO: 190050 - DNA, 25 bp, Mus musculus
aggaggtgtcaggtgttatcattca

SEQ ID NO: 190051 - DNA, 25 bp, Mus musculus
aggaggttaccacctggctgccaag

SEQ ID NO: 190052 - DNA, 25 bp, Mus musculus
aggaggttaccagctggctgccaag

SEQ ID NO: 190053 - DNA, 25 bp, Mus musculus
aggaggttcatacttttgttgctgt

SEQ ID NO: 190054 - DNA, 25 bp, Mus musculus
aggaggttcatagttttgttgctgt

SEQ ID NO: 190055 - DNA, 25 bp, Mus musculus
aggaggttcccaaggaggctacaga

SEQ ID NO: 190056 - DNA, 25 bp, Mus musculus
aggaggttcccatggaggctacaga

SEQ ID NO: 190057 - DNA, 25 bp, Mus musculus
aggaggttctctccatcacagtgtt

SEQ ID NO: 190058 - DNA, 25 bp, Mus musculus
aggaggttctctgcatcacagtgtt

SEQ ID NO: 190059 - DNA, 25 bp, Mus musculus
aggaggttctgtaatcccctttgca

SEQ ID NO: 190060 - DNA, 25 bp, Mus musculus
aggaggttctgttatcccctttgca

SEQ ID NO: 190061 - DNA, 25 bp, Mus musculus
aggaggttgcacagaagaaaaagat

SEQ ID NO: 190062 - DNA, 25 bp, Mus musculus
aggaggttgcacagcttttatatga

SEQ ID NO: 190063 - DNA, 25 bp, Mus musculus
aggaggttgcactgaagaaaaagat

SEQ ID NO: 190064 - DNA, 25 bp, Mus musculus
aggaggttgcactgcttttatatga

SEQ ID NO: 190065 - DNA, 25 bp, Mus musculus
aggaggttggaactcatgccctgaa

SEQ ID NO: 190066 - DNA, 25 bp, Mus musculus
aggaggttggaagtcatgccctgaa

SEQ ID NO: 190067 - DNA, 25 bp, Mus musculus
aggaggttgggtccacagaactctt

SEQ ID NO: 190068 - DNA, 25 bp, Mus musculus
aggaggttgggtgcacagaactctt

SEQ ID NO: 190069 - DNA, 25 bp, Mus musculus
aggaggttgtacattgcctgatgtc

SEQ ID NO: 190070 - DNA, 25 bp, Mus musculus
aggaggttgtactttgcctgatgtc

SEQ ID NO: 190071 - DNA, 25 bp, Mus musculus
aggagtaaatgacccttgccacgcg

SEQ ID NO: 190072 - DNA, 25 bp, Mus musculus
aggagtaaatgagccttgccacgcg

SEQ ID NO: 190073 - DNA, 25 bp, Mus musculus
aggagtaagtatctggctaaacatc

SEQ ID NO: 190074 - DNA, 25 bp, Mus musculus
aggagtaagtatgtggctaaacatc

SEQ ID NO: 190075 - DNA, 25 bp, Mus musculus
aggagtaagttcaggaggcttccgt

SEQ ID NO: 190076 - DNA, 25 bp, Mus musculus
aggagtaagttctggaggcttccgt

SEQ ID NO: 190077 - DNA, 25 bp, Mus musculus
aggagtaattatcccctgttcaagt

SEQ ID NO: 190078 - DNA, 25 bp, Mus musculus
aggagtaattatgccctgttcaagt

SEQ ID NO: 190079 - DNA, 25 bp, Mus musculus
aggagtacaagaactgattcagaca

SEQ ID NO: 190080 - DNA, 25 bp, Mus musculus
aggagtacaagatctgattcagaca

SEQ ID NO: 190081 - DNA, 25 bp, Mus musculus
aggagtacagatccagcagcctctg

SEQ ID NO: 190082 - DNA, 25 bp, Mus musculus
aggagtacagatgcagcagcctctg

SEQ ID NO: 190083 - DNA, 25 bp, Mus musculus
aggagtacagctacacaagtgtgac

SEQ ID NO: 190084 - DNA, 25 bp, Mus musculus
aggagtacagcttcacaagtgtgac

SEQ ID NO: 190085 - DNA, 25 bp, Mus musculus
aggagtacatggctccaggcttact

SEQ ID NO: 190086 - DNA, 25 bp, Mus musculus
aggagtacatgggtccaggcttact

SEQ ID NO: 190087 - DNA, 25 bp, Mus musculus
aggagtaccccgacgagatagagta

SEQ ID NO: 190088 - DNA, 25 bp, Mus musculus
aggagtaccccgtcgagatagagta

SEQ ID NO: 190089 - DNA, 25 bp, Mus musculus
aggagtaccgccagcagttggcagc

SEQ ID NO: 190090 - DNA, 25 bp, Mus musculus
aggagtaccgcctgcagttggcagc

SEQ ID NO: 190091 - DNA, 25 bp, Mus musculus
aggagtacctcaacagcattctgca

SEQ ID NO: 190092 - DNA, 25 bp, Mus musculus
aggagtacctcatcagcattctgca

SEQ ID NO: 190093 - DNA, 25 bp, Mus musculus
aggagtacgactacctcgtggccga

SEQ ID NO: 190094 - DNA, 25 bp, Mus musculus
aggagtacgacttcctcgtggccga

SEQ ID NO: 190095 - DNA, 25 bp, Mus musculus
aggagtacgagcaacgcctggctat

SEQ ID NO: 190096 - DNA, 25 bp, Mus musculus
aggagtacgagctacgcctggctat

SEQ ID NO: 190097 - DNA, 25 bp, Mus musculus
aggagtacttcgagtgggcagccca

SEQ ID NO: 190098 - DNA, 25 bp, Mus musculus
aggagtacttcgtgtgggcagccca

SEQ ID NO: 190099 - DNA, 25 bp, Mus musculus
aggagtagaacaagccccagctcag

SEQ ID NO: 190100 - DNA, 25 bp, Mus musculus
aggagtagaacatgccccagctcag

SEQ ID NO: 190101 - DNA, 25 bp, Mus musculus
aggagtagacagataggagagtata

SEQ ID NO: 190102 - DNA, 25 bp, Mus musculus
aggagtagacagttaggagagtata

SEQ ID NO: 190103 - DNA, 25 bp, Mus musculus
aggagtagccataaaatttagacgg

SEQ ID NO: 190104 - DNA, 25 bp, Mus musculus
aggagtagccattaaatttagacgg

SEQ ID NO: 190105 - DNA, 25 bp, Mus musculus
aggagtaggctaatgatgtgatcat

SEQ ID NO: 190106 - DNA, 25 bp, Mus musculus
aggagtaggctattgatgtgatcat

SEQ ID NO: 190107 - DNA, 25 bp, Mus musculus
aggagtagtagccacttgttctttc

SEQ ID NO: 190108 - DNA, 25 bp, Mus musculus
aggagtagtagcgacttgttctttc

SEQ ID NO: 190109 - DNA, 25 bp, Mus musculus
aggagtatcagcagtaccagcagga

SEQ ID NO: 190110 - DNA, 25 bp, Mus musculus
aggagtatcagctgtaccagcagga

SEQ ID NO: 190111 - DNA, 25 bp, Mus musculus
aggagtatctgccatgccatccaag

SEQ ID NO: 190112 - DNA, 25 bp, Mus musculus
aggagtatctgcgatgccatccaag

SEQ ID NO: 190113 - DNA, 25 bp, Mus musculus
aggagtatgcgactgccccagtgct

SEQ ID NO: 190114 - DNA, 25 bp, Mus musculus
aggagtatgcgagtgccccagtgct

SEQ ID NO: 190115 - DNA, 25 bp, Mus musculus
aggagtatgctgaacttagactgct

SEQ ID NO: 190116 - DNA, 25 bp, Mus musculus
aggagtatgctgtacttagactgct

SEQ ID NO: 190117 - DNA, 25 bp, Mus musculus
aggagtattctgcacgtaaatcatg

SEQ ID NO: 190118 - DNA, 25 bp, Mus musculus
aggagtattctggacgtaaatcatg

SEQ ID NO: 190119 - DNA, 25 bp, Mus musculus
aggagtcaacagaggcgtcggcatc

SEQ ID NO: 190120 - DNA, 25 bp, Mus musculus
aggagtcaacagtggcgtcggcatc

SEQ ID NO: 190121 - DNA, 25 bp, Mus musculus
aggagtcaatacagtcaccaccttg

SEQ ID NO: 190122 - DNA, 25 bp, Mus musculus
aggagtcaatactgtcaccaccttg

SEQ ID NO: 190123 - DNA, 25 bp, Mus musculus
aggagtcacctgacccagagttgtc

SEQ ID NO: 190124 - DNA, 25 bp, Mus musculus
aggagtcacctgtcccagagttgtc

SEQ ID NO: 190125 - DNA, 25 bp, Mus musculus
aggagtcacggcagcacaagatcca

SEQ ID NO: 190126 - DNA, 25 bp, Mus musculus
aggagtcacggctgcacaagatcca

SEQ ID NO: 190127 - DNA, 25 bp, Mus musculus
aggagtcagccaccatccctgaagt

SEQ ID NO: 190128 - DNA, 25 bp, Mus musculus
aggagtcagccagcatccctgaagt

SEQ ID NO: 190129 - DNA, 25 bp, Mus musculus
aggagtcaggaccaagtgccgttca

SEQ ID NO: 190130 - DNA, 25 bp, Mus musculus
aggagtcaggacgaagtgccgttca

SEQ ID NO: 190131 - DNA, 25 bp, Mus musculus
aggagtcaggttaatggcagagcat

SEQ ID NO: 190132 - DNA, 25 bp, Mus musculus
aggagtcaggttcttggcctttgat

SEQ ID NO: 190133 - DNA, 25 bp, Mus musculus
aggagtcaggttgttggcctttgat

SEQ ID NO: 190134 - DNA, 25 bp, Mus musculus
aggagtcaggtttatggcagagcat

SEQ ID NO: 190135 - DNA, 25 bp, Mus musculus
aggagtcagtatccctgtggagttc

SEQ ID NO: 190136 - DNA, 25 bp, Mus musculus
aggagtcagtatgcctgtggagttc

SEQ ID NO: 190137 - DNA, 25 bp, Mus musculus
aggagtcagtgcatcagtcttttta

SEQ ID NO: 190138 - DNA, 25 bp, Mus musculus
aggagtcagtgcttcagtcttttta

SEQ ID NO: 190139 - DNA, 25 bp, Mus musculus
aggagtcagttcactggtacagtgt

SEQ ID NO: 190140 - DNA, 25 bp, Mus musculus
aggagtcagttctctggtacagtgt

SEQ ID NO: 190141 - DNA, 25 bp, Mus musculus
aggagtcatacgagccctagggcca

SEQ ID NO: 190142 - DNA, 25 bp, Mus musculus
aggagtcatacgtgccctagggcca

SEQ ID NO: 190143 - DNA, 25 bp, Mus musculus
aggagtcattagagacccagcactc

SEQ ID NO: 190144 - DNA, 25 bp, Mus musculus
aggagtcattagtgacccagcactc

SEQ ID NO: 190145 - DNA, 25 bp, Mus musculus
aggagtcattatctggtcccatgtg

SEQ ID NO: 190146 - DNA, 25 bp, Mus musculus
aggagtcattatgtggtcccatgtg

SEQ ID NO: 190147 - DNA, 25 bp, Mus musculus
aggagtccaataacgccgctgagga

SEQ ID NO: 190148 - DNA, 25 bp, Mus musculus
aggagtccaatatcgccgctgagga

SEQ ID NO: 190149 - DNA, 25 bp, Mus musculus
aggagtccagacatcctggcaggaa

SEQ ID NO: 190150 - DNA, 25 bp, Mus musculus
aggagtccagacttcctggcaggaa

SEQ ID NO: 190151 - DNA, 25 bp, Mus musculus
aggagtccagttcgcacaattccac

SEQ ID NO: 190152 - DNA, 25 bp, Mus musculus
aggagtccagttggcacaattccac

SEQ ID NO: 190153 - DNA, 25 bp, Mus musculus
aggagtccatataggtctgaaacca

SEQ ID NO: 190154 - DNA, 25 bp, Mus musculus
aggagtccatattggtctgaaacca

SEQ ID NO: 190155 - DNA, 25 bp, Mus musculus
aggagtcccaagacataggcagaga

SEQ ID NO: 190156 - DNA, 25 bp, Mus musculus
aggagtcccaagtcataggcagaga

SEQ ID NO: 190157 - DNA, 25 bp, Mus musculus
aggagtcccaggacttgtaggcaga

SEQ ID NO: 190158 - DNA, 25 bp, Mus musculus
aggagtcccaggtcttgtaggcaga

SEQ ID NO: 190159 - DNA, 25 bp, Mus musculus
aggagtcccctcagtagaatcatac

SEQ ID NO: 190160 - DNA, 25 bp, Mus musculus
aggagtcccctctgtagaatcatac

SEQ ID NO: 190161 - DNA, 25 bp, Mus musculus
aggagtcccgatcctgtaggcgaca

SEQ ID NO: 190162 - DNA, 25 bp, Mus musculus
aggagtcccgatgctgtaggcgaca

SEQ ID NO: 190163 - DNA, 25 bp, Mus musculus
aggagtcccgcgagtgctttgcttg

SEQ ID NO: 190164 - DNA, 25 bp, Mus musculus
aggagtcccgcgtgtgctttgcttg

SEQ ID NO: 190165 - DNA, 25 bp, Mus musculus
aggagtccctttcgcaacctcagga

SEQ ID NO: 190166 - DNA, 25 bp, Mus musculus
aggagtccctttggcaacctcagga

SEQ ID NO: 190167 - DNA, 25 bp, Mus musculus
aggagtccgatgacttgcagagaac

SEQ ID NO: 190168 - DNA, 25 bp, Mus musculus
aggagtccgatgtcttgcagagaac

SEQ ID NO: 190169 - DNA, 25 bp, Mus musculus
aggagtccgtatcgtgacaacccct

SEQ ID NO: 190170 - DNA, 25 bp, Mus musculus
aggagtccgtatggtgacaacccct

SEQ ID NO: 190171 - DNA, 25 bp, Mus musculus
aggagtccgtccaacaattatggtt

SEQ ID NO: 190172 - DNA, 25 bp, Mus musculus
aggagtccgtcctacaattatggtt

SEQ ID NO: 190173 - DNA, 25 bp, Mus musculus
aggagtcctatacactcgtggtcca

SEQ ID NO: 190174 - DNA, 25 bp, Mus musculus
aggagtcctatagactcgtggtcca

SEQ ID NO: 190175 - DNA, 25 bp, Mus musculus
aggagtcctcacaggagagcgagac

SEQ ID NO: 190176 - DNA, 25 bp, Mus musculus
aggagtcctcactggagagcgagac

SEQ ID NO: 190177 - DNA, 25 bp, Mus musculus
aggagtcctcgcaactgaagttggt

SEQ ID NO: 190178 - DNA, 25 bp, Mus musculus
aggagtcctcgctactgaagttggt

SEQ ID NO: 190179 - DNA, 25 bp, Mus musculus
aggagtcctcgtccgtgtgcttata

SEQ ID NO: 190180 - DNA, 25 bp, Mus musculus
aggagtcctcgtgcgtgtgcttata

SEQ ID NO: 190181 - DNA, 25 bp, Mus musculus
aggagtcctgcaccttgctttggga

SEQ ID NO: 190182 - DNA, 25 bp, Mus musculus
aggagtcctgcagcttgctttggga

SEQ ID NO: 190183 - DNA, 25 bp, Mus musculus
aggagtccttccacagggttggcca

SEQ ID NO: 190184 - DNA, 25 bp, Mus musculus
aggagtccttcctcagggttggcca

SEQ ID NO: 190185 - DNA, 25 bp, Mus musculus
aggagtccttggctatgcctgcaca

SEQ ID NO: 190186 - DNA, 25 bp, Mus musculus
aggagtccttgggtatgcctgcaca

SEQ ID NO: 190187 - DNA, 25 bp, Mus musculus
aggagtcgtcgcctcaaagccaacg

SEQ ID NO: 190188 - DNA, 25 bp, Mus musculus
aggagtcgtcgcgtcaaagccaacg

SEQ ID NO: 190189 - DNA, 25 bp, Mus musculus
aggagtcgttctcactctgggacac

SEQ ID NO: 190190 - DNA, 25 bp, Mus musculus
aggagtcgttctgactctgggacac

SEQ ID NO: 190191 - DNA, 25 bp, Mus musculus
aggagtctagcacccctggaagaga

SEQ ID NO: 190192 - DNA, 25 bp, Mus musculus
aggagtctagcagccctggaagaga

SEQ ID NO: 190193 - DNA, 25 bp, Mus musculus
aggagtctccagagccgaatggcca

SEQ ID NO: 190194 - DNA, 25 bp, Mus musculus
aggagtctccagtgccgaatggcca

SEQ ID NO: 190195 - DNA, 25 bp, Mus musculus
aggagtctcccgagaaagtgacaca

SEQ ID NO: 190196 - DNA, 25 bp, Mus musculus
aggagtctcccgtgaaagtgacaca

SEQ ID NO: 190197 - DNA, 25 bp, Mus musculus
aggagtctccctacaggatacagat

SEQ ID NO: 190198 - DNA, 25 bp, Mus musculus
aggagtctccctccaggaactgaat

SEQ ID NO: 190199 - DNA, 25 bp, Mus musculus
aggagtctccctgcaggaactgaat

SEQ ID NO: 190200 - DNA, 25 bp, Mus musculus
aggagtctcccttcaggatacagat

SEQ ID NO: 190201 - DNA, 25 bp, Mus musculus
aggagtctcgacagctgtttctaca

SEQ ID NO: 190202 - DNA, 25 bp, Mus musculus
aggagtctcgactgctgtttctaca

SEQ ID NO: 190203 - DNA, 25 bp, Mus musculus
aggagtctctgcagtcataggccac

SEQ ID NO: 190204 - DNA, 25 bp, Mus musculus
aggagtctctgctgtcataggccac

SEQ ID NO: 190205 - DNA, 25 bp, Mus musculus
aggagtctgaatcttccctcacgag

SEQ ID NO: 190206 - DNA, 25 bp, Mus musculus
aggagtctgaatgttccctcacgag

SEQ ID NO: 190207 - DNA, 25 bp, Mus musculus
aggagtctgacaccgccgatgccag

SEQ ID NO: 190208 - DNA, 25 bp, Mus musculus
aggagtctgacacggatctcagcca

SEQ ID NO: 190209 - DNA, 25 bp, Mus musculus
aggagtctgacagcgccgatgccag

SEQ ID NO: 190210 - DNA, 25 bp, Mus musculus
aggagtctgacagggatctcagcca

SEQ ID NO: 190211 - DNA, 25 bp, Mus musculus
aggagtctgactcgtttgttctgat

SEQ ID NO: 190212 - DNA, 25 bp, Mus musculus
aggagtctgactggtttgttctgat

SEQ ID NO: 190213 - DNA, 25 bp, Mus musculus
aggagtctgagaataagctattcat

SEQ ID NO: 190214 - DNA, 25 bp, Mus musculus
aggagtctgagattaagctattcat

SEQ ID NO: 190215 - DNA, 25 bp, Mus musculus
aggagtctgcacctaacagtcacga

SEQ ID NO: 190216 - DNA, 25 bp, Mus musculus
aggagtctgcacgtaacagtcacga

SEQ ID NO: 190217 - DNA, 25 bp, Mus musculus
aggagtctgcttaagcaaactgagt

SEQ ID NO: 190218 - DNA, 25 bp, Mus musculus
aggagtctgctttagcaaactgagt

SEQ ID NO: 190219 - DNA, 25 bp, Mus musculus
aggagtcttaatatggtgtgccatg

SEQ ID NO: 190220 - DNA, 25 bp, Mus musculus
aggagtcttaatttggtgtgccatg

SEQ ID NO: 190221 - DNA, 25 bp, Mus musculus
aggagtcttccaaggtagccatgcc

SEQ ID NO: 190222 - DNA, 25 bp, Mus musculus
aggagtcttccatggtagccatgcc

SEQ ID NO: 190223 - DNA, 25 bp, Mus musculus
aggagtcttcctaagtggacagctc

SEQ ID NO: 190224 - DNA, 25 bp, Mus musculus
aggagtcttccttagtggacagctc

SEQ ID NO: 190225 - DNA, 25 bp, Mus musculus
aggagtcttctgatttatgtaccga

SEQ ID NO: 190226 - DNA, 25 bp, Mus musculus
aggagtcttctgttttatgtaccga

SEQ ID NO: 190227 - DNA, 25 bp, Mus musculus
aggagtcttgagaagcttgctaatc

SEQ ID NO: 190228 - DNA, 25 bp, Mus musculus
aggagtcttgagactgcactttccc

SEQ ID NO: 190229 - DNA, 25 bp, Mus musculus
aggagtcttgagtagcttgctaatc

SEQ ID NO: 190230 - DNA, 25 bp, Mus musculus
aggagtcttgagtctgcactttccc

SEQ ID NO: 190231 - DNA, 25 bp, Mus musculus
aggagtcttgcaaacacctagaact

SEQ ID NO: 190232 - DNA, 25 bp, Mus musculus
aggagtcttgcatacacctagaact

SEQ ID NO: 190233 - DNA, 25 bp, Mus musculus
aggagtgaaagcagtccatgtaaat

SEQ ID NO: 190234 - DNA, 25 bp, Mus musculus
aggagtgaaagctgtccatgtaaat

SEQ ID NO: 190235 - DNA, 25 bp, Mus musculus
aggagtgactgcacacttgtattta

SEQ ID NO: 190236 - DNA, 25 bp, Mus musculus
aggagtgactgctcacttgtattta

SEQ ID NO: 190237 - DNA, 25 bp, Mus musculus
aggagtgagacacccttcttttgtc

SEQ ID NO: 190238 - DNA, 25 bp, Mus musculus
aggagtgagacagccttcttttgtc

SEQ ID NO: 190239 - DNA, 25 bp, Mus musculus
aggagtgagagtcctcgtctctccc

SEQ ID NO: 190240 - DNA, 25 bp, Mus musculus
aggagtgagagtgctcgtctctccc

SEQ ID NO: 190241 - DNA, 25 bp, Mus musculus
aggagtgagccaactcaagctctgg

SEQ ID NO: 190242 - DNA, 25 bp, Mus musculus
aggagtgagccatctcaagctctgg

SEQ ID NO: 190243 - DNA, 25 bp, Mus musculus
aggagtgagcccattgtctctgtgt

SEQ ID NO: 190244 - DNA, 25 bp, Mus musculus
aggagtgagccctttgtctctgtgt

SEQ ID NO: 190245 - DNA, 25 bp, Mus musculus
aggagtgagcgcacacacggttcct

SEQ ID NO: 190246 - DNA, 25 bp, Mus musculus
aggagtgagcgctcacacggttcct

SEQ ID NO: 190247 - DNA, 25 bp, Mus musculus
aggagtgagctcagcatccaatctg

SEQ ID NO: 190248 - DNA, 25 bp, Mus musculus
aggagtgagctctgcatccaatctg

SEQ ID NO: 190249 - DNA, 25 bp, Mus musculus
aggagtgcaccaaactgggctttaa

SEQ ID NO: 190250 - DNA, 25 bp, Mus musculus
aggagtgcaccatactgggctttaa

SEQ ID NO: 190251 - DNA, 25 bp, Mus musculus
aggagtgcaggcaacacttgggaaa

SEQ ID NO: 190252 - DNA, 25 bp, Mus musculus
aggagtgcaggctacacttgggaaa

SEQ ID NO: 190253 - DNA, 25 bp, Mus musculus
aggagtgcccagacctgaattccag

SEQ ID NO: 190254 - DNA, 25 bp, Mus musculus
aggagtgcccagtcctgaattccag

SEQ ID NO: 190255 - DNA, 25 bp, Mus musculus
aggagtgccggcctttcaccacaga

SEQ ID NO: 190256 - DNA, 25 bp, Mus musculus
aggagtgccggcgtttcaccacaga

SEQ ID NO: 190257 - DNA, 25 bp, Mus musculus
aggagtgcctccaagggcttctaac

SEQ ID NO: 190258 - DNA, 25 bp, Mus musculus
aggagtgcctcctagggcttctaac

SEQ ID NO: 190259 - DNA, 25 bp, Mus musculus
aggagtgcctgacgtgtttatgttc

SEQ ID NO: 190260 - DNA, 25 bp, Mus musculus
aggagtgcctgaggtgtttatgttc

SEQ ID NO: 190261 - DNA, 25 bp, Mus musculus
aggagtgcgaacatcgtgcctctgc

SEQ ID NO: 190262 - DNA, 25 bp, Mus musculus
aggagtgcgaacttcgtgcctctgc

SEQ ID NO: 190263 - DNA, 25 bp, Mus musculus
aggagtgcgaccagctcacttagac

SEQ ID NO: 190264 - DNA, 25 bp, Mus musculus
aggagtgcgacctgctcacttagac

SEQ ID NO: 190265 - DNA, 25 bp, Mus musculus
aggagtgcgcctcaccaggccaagt

SEQ ID NO: 190266 - DNA, 25 bp, Mus musculus
aggagtgcgcctgaccaggccaagt

SEQ ID NO: 190267 - DNA, 25 bp, Mus musculus
aggagtgcggagaccgttttcaccg

SEQ ID NO: 190268 - DNA, 25 bp, Mus musculus
aggagtgcggagtccgttttcaccg

SEQ ID NO: 190269 - DNA, 25 bp, Mus musculus
aggagtgcgtccctaccaatgcctg

SEQ ID NO: 190270 - DNA, 25 bp, Mus musculus
aggagtgcgtccgtaccaatgcctg

SEQ ID NO: 190271 - DNA, 25 bp, Mus musculus
aggagtgctcacataccatctgttt

SEQ ID NO: 190272 - DNA, 25 bp, Mus musculus
aggagtgctcacttaccatctgttt

SEQ ID NO: 190273 - DNA, 25 bp, Mus musculus
aggagtgctcagaactttacgccaa

SEQ ID NO: 190274 - DNA, 25 bp, Mus musculus
aggagtgctcagtactttacgccaa

SEQ ID NO: 190275 - DNA, 25 bp, Mus musculus
aggagtgctccaccgtcagaaagct

SEQ ID NO: 190276 - DNA, 25 bp, Mus musculus
aggagtgctccagcgtcagaaagct

SEQ ID NO: 190277 - DNA, 25 bp, Mus musculus
aggagtgctccgattgccctgagga

SEQ ID NO: 190278 - DNA, 25 bp, Mus musculus
aggagtgctccgtttgccctgagga

SEQ ID NO: 190279 - DNA, 25 bp, Mus musculus
aggagtgctgtgcaaagccagtccc

SEQ ID NO: 190280 - DNA, 25 bp, Mus musculus
aggagtgctgtggaaagccagtccc

SEQ ID NO: 190281 - DNA, 25 bp, Mus musculus
aggagtgcttccatagtgtctggga

SEQ ID NO: 190282 - DNA, 25 bp, Mus musculus
aggagtgcttccctctatagataat

SEQ ID NO: 190283 - DNA, 25 bp, Mus musculus
aggagtgcttccgtctatagataat

SEQ ID NO: 190284 - DNA, 25 bp, Mus musculus
aggagtgcttccttagtgtctggga

SEQ ID NO: 190285 - DNA, 25 bp, Mus musculus
aggagtgcttctacgagcgggtcac

SEQ ID NO: 190286 - DNA, 25 bp, Mus musculus
aggagtgcttcttcgagcgggtcac

SEQ ID NO: 190287 - DNA, 25 bp, Mus musculus
aggagtgctttgacagctgctgtca

SEQ ID NO: 190288 - DNA, 25 bp, Mus musculus
aggagtgctttgtcagctgctgtca

SEQ ID NO: 190289 - DNA, 25 bp, Mus musculus
aggagtggctcaccaatcctcagac

SEQ ID NO: 190290 - DNA, 25 bp, Mus musculus
aggagtggctcagcaatcctcagac

SEQ ID NO: 190291 - DNA, 25 bp, Mus musculus
aggagtggctgcataggttatagta

SEQ ID NO: 190292 - DNA, 25 bp, Mus musculus
aggagtggctgcttaggttatagta

SEQ ID NO: 190293 - DNA, 25 bp, Mus musculus
aggagtgggaccaggcttctctcag

SEQ ID NO: 190294 - DNA, 25 bp, Mus musculus
aggagtgggacctggcttctctcag

SEQ ID NO: 190295 - DNA, 25 bp, Mus musculus
aggagtgggcagcaaaacctgagcc

SEQ ID NO: 190296 - DNA, 25 bp, Mus musculus
aggagtgggcaggaaaacctgagcc

SEQ ID NO: 190297 - DNA, 25 bp, Mus musculus
aggagtgggctgatccctgcttagt

SEQ ID NO: 190298 - DNA, 25 bp, Mus musculus
aggagtgggctgttccctgcttagt

SEQ ID NO: 190299 - DNA, 25 bp, Mus musculus
aggagtggtccacgtgcctcgtacc

SEQ ID NO: 190300 - DNA, 25 bp, Mus musculus
aggagtggtccaggtgcctcgtacc

SEQ ID NO: 190301 - DNA, 25 bp, Mus musculus
aggagtggtcctcagttgctcaaac

SEQ ID NO: 190302 - DNA, 25 bp, Mus musculus
aggagtggtcctgagttgctcaaac

SEQ ID NO: 190303 - DNA, 25 bp, Mus musculus
aggagtgtacaacagcctgaaccaa

SEQ ID NO: 190304 - DNA, 25 bp, Mus musculus
aggagtgtacaagagcctgaaccaa

SEQ ID NO: 190305 - DNA, 25 bp, Mus musculus
aggagtgtacttaagcagcaagcat

SEQ ID NO: 190306 - DNA, 25 bp, Mus musculus
aggagtgtactttagcagcaagcat

SEQ ID NO: 190307 - DNA, 25 bp, Mus musculus
aggagtgtattcaagactaatcaaa

SEQ ID NO: 190308 - DNA, 25 bp, Mus musculus
aggagtgtattctagactaatcaaa

SEQ ID NO: 190309 - DNA, 25 bp, Mus musculus
aggagtgtcagtaacgtccaggcgt

SEQ ID NO: 190310 - DNA, 25 bp, Mus musculus
aggagtgtcagtacctgcacgagga

SEQ ID NO: 190311 - DNA, 25 bp, Mus musculus
aggagtgtcagttacgtccaggcgt

SEQ ID NO: 190312 - DNA, 25 bp, Mus musculus
aggagtgtcagttcctgcacgagga

SEQ ID NO: 190313 - DNA, 25 bp, Mus musculus
aggagtgtccatctgccactgctct

SEQ ID NO: 190314 - DNA, 25 bp, Mus musculus
aggagtgtccatgtgccactgctct

SEQ ID NO: 190315 - DNA, 25 bp, Mus musculus
aggagtgtcctcagcatggtctatg

SEQ ID NO: 190316 - DNA, 25 bp, Mus musculus
aggagtgtcctctgcatggtctatg

SEQ ID NO: 190317 - DNA, 25 bp, Mus musculus
aggagtgtcctgaattgttgaaaga

SEQ ID NO: 190318 - DNA, 25 bp, Mus musculus
aggagtgtcctgtattgttgaaaga

SEQ ID NO: 190319 - DNA, 25 bp, Mus musculus
aggagtgtgactagttaagttgcta

SEQ ID NO: 190320 - DNA, 25 bp, Mus musculus
aggagtgtgacttgttaagttgcta

SEQ ID NO: 190321 - DNA, 25 bp, Mus musculus
aggagtgtgcagagacacctggctt

SEQ ID NO: 190322 - DNA, 25 bp, Mus musculus
aggagtgtgcagtgacacctggctt

SEQ ID NO: 190323 - DNA, 25 bp, Mus musculus
aggagtgtgccaaaaccgagagtga

SEQ ID NO: 190324 - DNA, 25 bp, Mus musculus
aggagtgtgccaagcttacacagcc

SEQ ID NO: 190325 - DNA, 25 bp, Mus musculus
aggagtgtgccataaccgagagtga

SEQ ID NO: 190326 - DNA, 25 bp, Mus musculus
aggagtgtgccatgcttacacagcc

SEQ ID NO: 190327 - DNA, 25 bp, Mus musculus
aggagtgtgctcagatacttacctt

SEQ ID NO: 190328 - DNA, 25 bp, Mus musculus
aggagtgtgctctgatacttacctt

SEQ ID NO: 190329 - DNA, 25 bp, Mus musculus
aggagtgtgcttctgttcctccacc

SEQ ID NO: 190330 - DNA, 25 bp, Mus musculus
aggagtgtgcttgtgttcctccacc

SEQ ID NO: 190331 - DNA, 25 bp, Mus musculus
aggagtgtggccctcagatgccttt

SEQ ID NO: 190332 - DNA, 25 bp, Mus musculus
aggagtgtggccgtcagatgccttt

SEQ ID NO: 190333 - DNA, 25 bp, Mus musculus
aggagtgtggctagctattgtgaaa

SEQ ID NO: 190334 - DNA, 25 bp, Mus musculus
aggagtgtggcttgctattgtgaaa

SEQ ID NO: 190335 - DNA, 25 bp, Mus musculus
aggagtgtgtcccaagcattcaagc

SEQ ID NO: 190336 - DNA, 25 bp, Mus musculus
aggagtgtgtccgaagcattcaagc

SEQ ID NO: 190337 - DNA, 25 bp, Mus musculus
aggagtgttaagaacctgccccact

SEQ ID NO: 190338 - DNA, 25 bp, Mus musculus
aggagtgttaagtacctgccccact

SEQ ID NO: 190339 - DNA, 25 bp, Mus musculus
aggagtgttctccatctcctatctg

SEQ ID NO: 190340 - DNA, 25 bp, Mus musculus
aggagtgttctcgatctcctatctg

SEQ ID NO: 190341 - DNA, 25 bp, Mus musculus
aggagtgttgacacacccaagctca

SEQ ID NO: 190342 - DNA, 25 bp, Mus musculus
aggagtgttgactcacccaagctca

SEQ ID NO: 190343 - DNA, 25 bp, Mus musculus
aggagtgtttatcatgtattgttgt

SEQ ID NO: 190344 - DNA, 25 bp, Mus musculus
aggagtgtttatgatgtattgttgt

SEQ ID NO: 190345 - DNA, 25 bp, Mus musculus
aggagttaactgctgtggacacaag

SEQ ID NO: 190346 - DNA, 25 bp, Mus musculus
aggagttaactggtgtggacacaag

SEQ ID NO: 190347 - DNA, 25 bp, Mus musculus
aggagttaccttagcccttggctct

SEQ ID NO: 190348 - DNA, 25 bp, Mus musculus
aggagttacctttgcccttggctct

SEQ ID NO: 190349 - DNA, 25 bp, Mus musculus
aggagttactatccagcctgagtta

SEQ ID NO: 190350 - DNA, 25 bp, Mus musculus
aggagttactatgcagcctgagtta

SEQ ID NO: 190351 - DNA, 25 bp, Mus musculus
aggagttactgactaagaacctcac

SEQ ID NO: 190352 - DNA, 25 bp, Mus musculus
aggagttactgagtaagaacctcac

SEQ ID NO: 190353 - DNA, 25 bp, Mus musculus
aggagttactggctgagcctccaca

SEQ ID NO: 190354 - DNA, 25 bp, Mus musculus
aggagttactgggtgagcctccaca

SEQ ID NO: 190355 - DNA, 25 bp, Mus musculus
aggagttacttcacgctttctagca

SEQ ID NO: 190356 - DNA, 25 bp, Mus musculus
aggagttacttctcgctttctagca

SEQ ID NO: 190357 - DNA, 25 bp, Mus musculus
aggagttagataaagccaagcttga

SEQ ID NO: 190358 - DNA, 25 bp, Mus musculus
aggagttagatatagccaagcttga

SEQ ID NO: 190359 - DNA, 25 bp, Mus musculus
aggagttaggctacagagagcacag

SEQ ID NO: 190360 - DNA, 25 bp, Mus musculus
aggagttaggcttcagagagcacag

SEQ ID NO: 190361 - DNA, 25 bp, Mus musculus
aggagttagtacacagtccttcatg

SEQ ID NO: 190362 - DNA, 25 bp, Mus musculus
aggagttagtactcagtccttcatg

SEQ ID NO: 190363 - DNA, 25 bp, Mus musculus
aggagttatatcctgccagtcccaa

SEQ ID NO: 190364 - DNA, 25 bp, Mus musculus
aggagttatatcgtgccagtcccaa

SEQ ID NO: 190365 - DNA, 25 bp, Mus musculus
aggagttatctcatcaaatccaaac

SEQ ID NO: 190366 - DNA, 25 bp, Mus musculus
aggagttatctcttcaaatccaaac

SEQ ID NO: 190367 - DNA, 25 bp, Mus musculus
aggagttatctgctgcttcagccga

SEQ ID NO: 190368 - DNA, 25 bp, Mus musculus
aggagttatctggtgcttcagccga

SEQ ID NO: 190369 - DNA, 25 bp, Mus musculus
aggagttattccagtgcccagagct

SEQ ID NO: 190370 - DNA, 25 bp, Mus musculus
aggagttattcctgtgcccagagct

SEQ ID NO: 190371 - DNA, 25 bp, Mus musculus
aggagttcaaaaccatccttgacaa

SEQ ID NO: 190372 - DNA, 25 bp, Mus musculus
aggagttcaaaactatcctgtgcta

SEQ ID NO: 190373 - DNA, 25 bp, Mus musculus
aggagttcaaaagcatccttgacaa

SEQ ID NO: 190374 - DNA, 25 bp, Mus musculus
aggagttcaaaagtatcctgtgcta

SEQ ID NO: 190375 - DNA, 25 bp, Mus musculus
aggagttcaaacaatggtggcttct

SEQ ID NO: 190376 - DNA, 25 bp, Mus musculus
aggagttcaaactatggtggcttct

SEQ ID NO: 190377 - DNA, 25 bp, Mus musculus
aggagttcaagacatggttcccagc

SEQ ID NO: 190378 - DNA, 25 bp, Mus musculus
aggagttcaagagatggttcccagc

SEQ ID NO: 190379 - DNA, 25 bp, Mus musculus
aggagttcaagcatatccttggcaa

SEQ ID NO: 190380 - DNA, 25 bp, Mus musculus
aggagttcaagcttatccttggcaa

SEQ ID NO: 190381 - DNA, 25 bp, Mus musculus
aggagttccaccctcagatttctag

SEQ ID NO: 190382 - DNA, 25 bp, Mus musculus
aggagttccaccgtcagatttctag

SEQ ID NO: 190383 - DNA, 25 bp, Mus musculus
aggagttccactcaccttgtgtaga

SEQ ID NO: 190384 - DNA, 25 bp, Mus musculus
aggagttccactgaccttgtgtaga

SEQ ID NO: 190385 - DNA, 25 bp, Mus musculus
aggagttcccagacattctgcaaag

SEQ ID NO: 190386 - DNA, 25 bp, Mus musculus
aggagttcccagtcattctgcaaag

SEQ ID NO: 190387 - DNA, 25 bp, Mus musculus
aggagttcccctcatttaatgttag

SEQ ID NO: 190388 - DNA, 25 bp, Mus musculus
aggagttcccctgatttaatgttag

SEQ ID NO: 190389 - DNA, 25 bp, Mus musculus
aggagttcccgtacctaaggcgctg

SEQ ID NO: 190390 - DNA, 25 bp, Mus musculus
aggagttcccgttcctaaggcgctg

SEQ ID NO: 190391 - DNA, 25 bp, Mus musculus
aggagttcctccaagagatgagccc

SEQ ID NO: 190392 - DNA, 25 bp, Mus musculus
aggagttcctcctagagatgagccc

SEQ ID NO: 190393 - DNA, 25 bp, Mus musculus
aggagttcctggcacctacatcgct

SEQ ID NO: 190394 - DNA, 25 bp, Mus musculus
aggagttcctgggacctacatcgct

SEQ ID NO: 190395 - DNA, 25 bp, Mus musculus
aggagttccttaatgcccccaacat

SEQ ID NO: 190396 - DNA, 25 bp, Mus musculus
aggagttccttattgcccccaacat

SEQ ID NO: 190397 - DNA, 25 bp, Mus musculus
aggagttccttcataatcgcaacac

SEQ ID NO: 190398 - DNA, 25 bp, Mus musculus
aggagttccttcttaatcgcaacac

SEQ ID NO: 190399 - DNA, 25 bp, Mus musculus
aggagttcgaataggcttctgacaa

SEQ ID NO: 190400 - DNA, 25 bp, Mus musculus
aggagttcgaattggcttctgacaa

SEQ ID NO: 190401 - DNA, 25 bp, Mus musculus
aggagttcgtcacagctctggcagc

SEQ ID NO: 190402 - DNA, 25 bp, Mus musculus
aggagttcgtcagagctctggcagc

SEQ ID NO: 190403 - DNA, 25 bp, Mus musculus
aggagttctagacgtgcccctaaag

SEQ ID NO: 190404 - DNA, 25 bp, Mus musculus
aggagttctagaggtgcccctaaag

SEQ ID NO: 190405 - DNA, 25 bp, Mus musculus
aggagttctagcaggcacacgctgt

SEQ ID NO: 190406 - DNA, 25 bp, Mus musculus
aggagttctagctggcacacgctgt

SEQ ID NO: 190407 - DNA, 25 bp, Mus musculus
aggagttctcaaagatccagtcaga

SEQ ID NO: 190408 - DNA, 25 bp, Mus musculus
aggagttctcaatgatccagtcaga

SEQ ID NO: 190409 - DNA, 25 bp, Mus musculus
aggagttctcatattattccccgcg

SEQ ID NO: 190410 - DNA, 25 bp, Mus musculus
aggagttctcattttattccccgcg

SEQ ID NO: 190411 - DNA, 25 bp, Mus musculus
aggagttctctcagatccgggccga

SEQ ID NO: 190412 - DNA, 25 bp, Mus musculus
aggagttctctctgatccgggccga

SEQ ID NO: 190413 - DNA, 25 bp, Mus musculus
aggagttctctgctgtgccctggaa

SEQ ID NO: 190414 - DNA, 25 bp, Mus musculus
aggagttctctggtgtgccctggaa

SEQ ID NO: 190415 - DNA, 25 bp, Mus musculus
aggagttctcttacctggctggtga

SEQ ID NO: 190416 - DNA, 25 bp, Mus musculus
aggagttctcttagcattccaatct

SEQ ID NO: 190417 - DNA, 25 bp, Mus musculus
aggagttctcttagctcccacacag

SEQ ID NO: 190418 - DNA, 25 bp, Mus musculus
aggagttctctttcctggctggtga

SEQ ID NO: 190419 - DNA, 25 bp, Mus musculus
aggagttctctttgcattccaatct

SEQ ID NO: 190420 - DNA, 25 bp, Mus musculus
aggagttctctttgctcccacacag

SEQ ID NO: 190421 - DNA, 25 bp, Mus musculus
aggagttctgcaactacaaccgcaa

SEQ ID NO: 190422 - DNA, 25 bp, Mus musculus
aggagttctgcatctacaaccgcaa

SEQ ID NO: 190423 - DNA, 25 bp, Mus musculus
aggagttgaagcatgccctgtggct

SEQ ID NO: 190424 - DNA, 25 bp, Mus musculus
aggagttgaagcttgccctgtggct

SEQ ID NO: 190425 - DNA, 25 bp, Mus musculus
aggagttgaatgacggccccgtgta

SEQ ID NO: 190426 - DNA, 25 bp, Mus musculus
aggagttgaatgtcggccccgtgta

SEQ ID NO: 190427 - DNA, 25 bp, Mus musculus
aggagttgatccagtgcttcagagc

SEQ ID NO: 190428 - DNA, 25 bp, Mus musculus
aggagttgatcctgtgcttcagagc

SEQ ID NO: 190429 - DNA, 25 bp, Mus musculus
aggagttgatgacatgaccatgacc

SEQ ID NO: 190430 - DNA, 25 bp, Mus musculus
aggagttgatgagatgaccatgacc

SEQ ID NO: 190431 - DNA, 25 bp, Mus musculus
aggagttgatttatcagctcacagt

SEQ ID NO: 190432 - DNA, 25 bp, Mus musculus
aggagttgatttttcagctcacagt

SEQ ID NO: 190433 - DNA, 25 bp, Mus musculus
aggagttgcaacattttaaacagtg

SEQ ID NO: 190434 - DNA, 25 bp, Mus musculus
aggagttgcaactttttaaacagtg

SEQ ID NO: 190435 - DNA, 25 bp, Mus musculus
aggagttgcagtagcgttccttgca

SEQ ID NO: 190436 - DNA, 25 bp, Mus musculus
aggagttgcagttgcgttccttgca

SEQ ID NO: 190437 - DNA, 25 bp, Mus musculus
aggagttgcattcttccctggagtc

SEQ ID NO: 190438 - DNA, 25 bp, Mus musculus
aggagttgcattgttccctggagtc

SEQ ID NO: 190439 - DNA, 25 bp, Mus musculus
aggagttgccccagatgactgcaaa

SEQ ID NO: 190440 - DNA, 25 bp, Mus musculus
aggagttgcccctgatgactgcaaa

SEQ ID NO: 190441 - DNA, 25 bp, Mus musculus
aggagttgcccgaactcgcgagtgc

SEQ ID NO: 190442 - DNA, 25 bp, Mus musculus
aggagttgcccgcagaccatgtcaa

SEQ ID NO: 190443 - DNA, 25 bp, Mus musculus
aggagttgcccgcttgctctccagt

SEQ ID NO: 190444 - DNA, 25 bp, Mus musculus
aggagttgcccggagaccatgtcaa

SEQ ID NO: 190445 - DNA, 25 bp, Mus musculus
aggagttgcccggttgctctccagt

SEQ ID NO: 190446 - DNA, 25 bp, Mus musculus
aggagttgcccgtactcgcgagtgc

SEQ ID NO: 190447 - DNA, 25 bp, Mus musculus
aggagttgccgcaacaggagaagga

SEQ ID NO: 190448 - DNA, 25 bp, Mus musculus
aggagttgccgctacaggagaagga

SEQ ID NO: 190449 - DNA, 25 bp, Mus musculus
aggagttgctagatcgttcgaagtc

SEQ ID NO: 190450 - DNA, 25 bp, Mus musculus
aggagttgctagttcgttcgaagtc

SEQ ID NO: 190451 - DNA, 25 bp, Mus musculus
aggagttgctcgacacacactgatc

SEQ ID NO: 190452 - DNA, 25 bp, Mus musculus
aggagttgctcgtcacacactgatc

SEQ ID NO: 190453 - DNA, 25 bp, Mus musculus
aggagttgctggattctcagttacc

SEQ ID NO: 190454 - DNA, 25 bp, Mus musculus
aggagttgctggtttctcagttacc

SEQ ID NO: 190455 - DNA, 25 bp, Mus musculus
aggagttgctttcccattctttttt

SEQ ID NO: 190456 - DNA, 25 bp, Mus musculus
aggagttgctttgccattctttttt

SEQ ID NO: 190457 - DNA, 25 bp, Mus musculus
aggagttggagaatgcccggtaaat

SEQ ID NO: 190458 - DNA, 25 bp, Mus musculus
aggagttggagattgcccggtaaat

SEQ ID NO: 190459 - DNA, 25 bp, Mus musculus
aggagttggcctattgtattatgga

SEQ ID NO: 190460 - DNA, 25 bp, Mus musculus
aggagttggccttttgtattatgga

SEQ ID NO: 190461 - DNA, 25 bp, Mus musculus
aggagttggcttcttcagctggctt

SEQ ID NO: 190462 - DNA, 25 bp, Mus musculus
aggagttggcttgttcagctggctt

SEQ ID NO: 190463 - DNA, 25 bp, Mus musculus
aggagttggtccactgtcaggcctc

SEQ ID NO: 190464 - DNA, 25 bp, Mus musculus
aggagttggtcctctgtcaggcctc

SEQ ID NO: 190465 - DNA, 25 bp, Mus musculus
aggagttggtgtattgatctgctac

SEQ ID NO: 190466 - DNA, 25 bp, Mus musculus
aggagttggtgttttgatctgctac

SEQ ID NO: 190467 - DNA, 25 bp, Mus musculus
aggagttggttcactcttccaccat

SEQ ID NO: 190468 - DNA, 25 bp, Mus musculus
aggagttggttctctcttccaccat

SEQ ID NO: 190469 - DNA, 25 bp, Mus musculus
aggagttggttgacacgcccaaggt

SEQ ID NO: 190470 - DNA, 25 bp, Mus musculus
aggagttggttgtcacgcccaaggt

SEQ ID NO: 190471 - DNA, 25 bp, Mus musculus
aggagttgtaccctagactttgtgt

SEQ ID NO: 190472 - DNA, 25 bp, Mus musculus
aggagttgtaccgtagactttgtgt

SEQ ID NO: 190473 - DNA, 25 bp, Mus musculus
aggagttgtcctatgaagtcatcag

SEQ ID NO: 190474 - DNA, 25 bp, Mus musculus
aggagttgtcctttgaagtcatcag

SEQ ID NO: 190475 - DNA, 25 bp, Mus musculus
aggagttgtctcagacctttggacc

SEQ ID NO: 190476 - DNA, 25 bp, Mus musculus
aggagttgtctctgacctttggacc

SEQ ID NO: 190477 - DNA, 25 bp, Mus musculus
aggagttgtggcataactggagact

SEQ ID NO: 190478 - DNA, 25 bp, Mus musculus
aggagttgtggcttaactggagact

SEQ ID NO: 190479 - DNA, 25 bp, Mus musculus
aggagttgttgcattctttgaagta

SEQ ID NO: 190480 - DNA, 25 bp, Mus musculus
aggagttgttgctttctttgaagta

SEQ ID NO: 190481 - DNA, 25 bp, Mus musculus
aggagttgtttacacttccagccct

SEQ ID NO: 190482 - DNA, 25 bp, Mus musculus
aggagttgtttagacttccagccct

SEQ ID NO: 190483 - DNA, 25 bp, Mus musculus
aggagtttaaacacagcgagtacag

SEQ ID NO: 190484 - DNA, 25 bp, Mus musculus
aggagtttaaactcagcgagtacag

SEQ ID NO: 190485 - DNA, 25 bp, Mus musculus
aggagtttaagcaccttgcccagag

SEQ ID NO: 190486 - DNA, 25 bp, Mus musculus
aggagtttaagctccttgcccagag

SEQ ID NO: 190487 - DNA, 25 bp, Mus musculus
aggagtttagctatcccttgaactg

SEQ ID NO: 190488 - DNA, 25 bp, Mus musculus
aggagtttagctttcccttgaactg

SEQ ID NO: 190489 - DNA, 25 bp, Mus musculus
aggagtttaggccagtctaccctgt

SEQ ID NO: 190490 - DNA, 25 bp, Mus musculus
aggagtttaggcgagtctaccctgt

SEQ ID NO: 190491 - DNA, 25 bp, Mus musculus
aggagtttagtcacctctgtgccgc

SEQ ID NO: 190492 - DNA, 25 bp, Mus musculus
aggagtttagtctcctctgtgccgc

SEQ ID NO: 190493 - DNA, 25 bp, Mus musculus
aggagtttatctactctgagctgct

SEQ ID NO: 190494 - DNA, 25 bp, Mus musculus
aggagtttatcttctctgagctgct

SEQ ID NO: 190495 - DNA, 25 bp, Mus musculus
aggagtttcagcagtcgtgagccca

SEQ ID NO: 190496 - DNA, 25 bp, Mus musculus
aggagtttcagctgtcgtgagccca

SEQ ID NO: 190497 - DNA, 25 bp, Mus musculus
aggagtttcattctcagtctcggag

SEQ ID NO: 190498 - DNA, 25 bp, Mus musculus
aggagtttcattgtcagtctcggag

SEQ ID NO: 190499 - DNA, 25 bp, Mus musculus
aggagtttcctaatggcaaactgag

SEQ ID NO: 190500 - DNA, 25 bp, Mus musculus
aggagtttcctattggcaaactgag

SEQ ID NO: 190501 - DNA, 25 bp, Mus musculus
aggagtttgaccacctgctggagga

SEQ ID NO: 190502 - DNA, 25 bp, Mus musculus
aggagtttgacctcctgctggagga

SEQ ID NO: 190503 - DNA, 25 bp, Mus musculus
aggagtttgcagactccagagcagt

SEQ ID NO: 190504 - DNA, 25 bp, Mus musculus
aggagtttgcagtctccagagcagt

SEQ ID NO: 190505 - DNA, 25 bp, Mus musculus
aggagtttgcgtccatcggctccca

SEQ ID NO: 190506 - DNA, 25 bp, Mus musculus
aggagtttgcgtgcatcggctccca

SEQ ID NO: 190507 - DNA, 25 bp, Mus musculus
aggagtttggtcatgttatttgtat

SEQ ID NO: 190508 - DNA, 25 bp, Mus musculus
aggagtttggtcttgttatttgtat

SEQ ID NO: 190509 - DNA, 25 bp, Mus musculus
aggagtttggtgctagctattgtaa

SEQ ID NO: 190510 - DNA, 25 bp, Mus musculus
aggagtttggtggtagctattgtaa

SEQ ID NO: 190511 - DNA, 25 bp, Mus musculus
aggagttttctgatcccctaagagg

SEQ ID NO: 190512 - DNA, 25 bp, Mus musculus
aggagttttctgttcccctaagagg

SEQ ID NO: 190513 - DNA, 25 bp, Mus musculus
aggagttttgctacattactactaa

SEQ ID NO: 190514 - DNA, 25 bp, Mus musculus
aggagttttgcttcattactactaa

SEQ ID NO: 190515 - DNA, 25 bp, Mus musculus
aggataaaaattcccttttcaagct

SEQ ID NO: 190516 - DNA, 25 bp, Mus musculus
aggataaaaattgccttttcaagct

SEQ ID NO: 190517 - DNA, 25 bp, Mus musculus
aggataaaagccagactatttctat

SEQ ID NO: 190518 - DNA, 25 bp, Mus musculus
aggataaaagcctgactatttctat

SEQ ID NO: 190519 - DNA, 25 bp, Mus musculus
aggataaactacctcacatctcttt

SEQ ID NO: 190520 - DNA, 25 bp, Mus musculus
aggataaactacgtcacatctcttt

SEQ ID NO: 190521 - DNA, 25 bp, Mus musculus
aggataaatccccagcgctataaca

SEQ ID NO: 190522 - DNA, 25 bp, Mus musculus
aggataaatcccgagcgctataaca

SEQ ID NO: 190523 - DNA, 25 bp, Mus musculus
aggataaattcccttctgtccatct

SEQ ID NO: 190524 - DNA, 25 bp, Mus musculus
aggataaattccgttctgtccatct

SEQ ID NO: 190525 - DNA, 25 bp, Mus musculus
aggataacaactatccatgtggatt

SEQ ID NO: 190526 - DNA, 25 bp, Mus musculus
aggataacaactttccatgtggatt

SEQ ID NO: 190527 - DNA, 25 bp, Mus musculus
aggataacgcctacttcaggttgcc

SEQ ID NO: 190528 - DNA, 25 bp, Mus musculus
aggataacgccttcttcaggttgcc

SEQ ID NO: 190529 - DNA, 25 bp, Mus musculus
aggataactcgacccgattctttgt

SEQ ID NO: 190530 - DNA, 25 bp, Mus musculus
aggataactcgagccgattctttgt

SEQ ID NO: 190531 - DNA, 25 bp, Mus musculus
aggataactctccttaagagggaag

SEQ ID NO: 190532 - DNA, 25 bp, Mus musculus
aggataactctcgttaagagggaag

SEQ ID NO: 190533 - DNA, 25 bp, Mus musculus
aggataagcgttctggtcgctccat

SEQ ID NO: 190534 - DNA, 25 bp, Mus musculus
aggataagcgttgtggtcgctccat

SEQ ID NO: 190535 - DNA, 25 bp, Mus musculus
aggataaggattcctcagagccaga

SEQ ID NO: 190536 - DNA, 25 bp, Mus musculus
aggataaggattgctcagagccaga

SEQ ID NO: 190537 - DNA, 25 bp, Mus musculus
aggataagtctccagctggctggcc

SEQ ID NO: 190538 - DNA, 25 bp, Mus musculus
aggataagtctcgagctggctggcc

SEQ ID NO: 190539 - DNA, 25 bp, Mus musculus
aggataagttctctctgtgatcaga

SEQ ID NO: 190540 - DNA, 25 bp, Mus musculus
aggataagttctgtctgtgatcaga

SEQ ID NO: 190541 - DNA, 25 bp, Mus musculus
aggataatcttaattgcctaaccaa

SEQ ID NO: 190542 - DNA, 25 bp, Mus musculus
aggataatcttatttgcctaaccaa

SEQ ID NO: 190543 - DNA, 25 bp, Mus musculus
aggataatgctacagtctgccccat

SEQ ID NO: 190544 - DNA, 25 bp, Mus musculus
aggataatgctagagtctgccccat

SEQ ID NO: 190545 - DNA, 25 bp, Mus musculus
aggatacaatatcggagacatacct

SEQ ID NO: 190546 - DNA, 25 bp, Mus musculus
aggatacaatatgggagacatacct

SEQ ID NO: 190547 - DNA, 25 bp, Mus musculus
aggatacacctcaggtttttgtcac

SEQ ID NO: 190548 - DNA, 25 bp, Mus musculus
aggatacacctctggtttttgtcac

SEQ ID NO: 190549 - DNA, 25 bp, Mus musculus
aggatacacgcgctccagcagatag

SEQ ID NO: 190550 - DNA, 25 bp, Mus musculus
aggatacacgcggtccagcagatag

SEQ ID NO: 190551 - DNA, 25 bp, Mus musculus
aggatacactcgagctacacaggaa

SEQ ID NO: 190552 - DNA, 25 bp, Mus musculus
aggatacactcgtgctacacaggaa

SEQ ID NO: 190553 - DNA, 25 bp, Mus musculus
aggatacagacaaggtggattctct

SEQ ID NO: 190554 - DNA, 25 bp, Mus musculus
aggatacagacatggtggattctct

SEQ ID NO: 190555 - DNA, 25 bp, Mus musculus
aggatacaggcacctggatgatgcc

SEQ ID NO: 190556 - DNA, 25 bp, Mus musculus
aggatacaggcagctggatgatgcc

SEQ ID NO: 190557 - DNA, 25 bp, Mus musculus
aggatacagggcaactttccattag

SEQ ID NO: 190558 - DNA, 25 bp, Mus musculus
aggatacagggcctcctgcagcctg

SEQ ID NO: 190559 - DNA, 25 bp, Mus musculus
aggatacagggcgtcctgcagcctg

SEQ ID NO: 190560 - DNA, 25 bp, Mus musculus
aggatacagggctactttccattag

SEQ ID NO: 190561 - DNA, 25 bp, Mus musculus
aggatacagtccaaatcctgcgcac

SEQ ID NO: 190562 - DNA, 25 bp, Mus musculus
aggatacagtcctaatcctgcgcac

SEQ ID NO: 190563 - DNA, 25 bp, Mus musculus
aggatacatcagatgctctaaggta

SEQ ID NO: 190564 - DNA, 25 bp, Mus musculus
aggatacatcagttgctctaaggta

SEQ ID NO: 190565 - DNA, 25 bp, Mus musculus
aggataccaagaagttctagctgtg

SEQ ID NO: 190566 - DNA, 25 bp, Mus musculus
aggataccaagatgttctagctgtg

SEQ ID NO: 190567 - DNA, 25 bp, Mus musculus
aggataccagtccatggctgttcac

SEQ ID NO: 190568 - DNA, 25 bp, Mus musculus
aggataccagtcgatggctgttcac

SEQ ID NO: 190569 - DNA, 25 bp, Mus musculus
aggatacccaatcccaaataaagat

SEQ ID NO: 190570 - DNA, 25 bp, Mus musculus
aggatacccaatgccaaataaagat

SEQ ID NO: 190571 - DNA, 25 bp, Mus musculus
aggatacccactaccattctttgta

SEQ ID NO: 190572 - DNA, 25 bp, Mus musculus
aggatacccacttccattctttgta

SEQ ID NO: 190573 - DNA, 25 bp, Mus musculus
aggataccctgcacgtggtggacat

SEQ ID NO: 190574 - DNA, 25 bp, Mus musculus
aggataccctgctcgtggtggacat

SEQ ID NO: 190575 - DNA, 25 bp, Mus musculus
aggataccctgtagacctgaagtca

SEQ ID NO: 190576 - DNA, 25 bp, Mus musculus
aggataccctgttgacctgaagtca

SEQ ID NO: 190577 - DNA, 25 bp, Mus musculus
aggataccggatctcagccccacag

SEQ ID NO: 190578 - DNA, 25 bp, Mus musculus
aggataccggatgtcagccccacag

SEQ ID NO: 190579 - DNA, 25 bp, Mus musculus
aggataccgggactcgcctgctttc

SEQ ID NO: 190580 - DNA, 25 bp, Mus musculus
aggataccgggagtcgcctgctttc

SEQ ID NO: 190581 - DNA, 25 bp, Mus musculus
aggatacctatgcagacacgctaag

SEQ ID NO: 190582 - DNA, 25 bp, Mus musculus
aggatacctatggagacacgctaag

SEQ ID NO: 190583 - DNA, 25 bp, Mus musculus
aggatacctcgaatagaatttatag

SEQ ID NO: 190584 - DNA, 25 bp, Mus musculus
aggatacctcgattagaatttatag

SEQ ID NO: 190585 - DNA, 25 bp, Mus musculus
aggatacctctcacggcctcttaac

SEQ ID NO: 190586 - DNA, 25 bp, Mus musculus
aggatacctctctcggcctcttaac

SEQ ID NO: 190587 - DNA, 25 bp, Mus musculus
aggatacctgtactgctcttctaga

SEQ ID NO: 190588 - DNA, 25 bp, Mus musculus
aggatacctgtagtgctcttctaga

SEQ ID NO: 190589 - DNA, 25 bp, Mus musculus
aggataccttggcaaacttggcggc

SEQ ID NO: 190590 - DNA, 25 bp, Mus musculus
aggataccttgggaaacttggcggc

SEQ ID NO: 190591 - DNA, 25 bp, Mus musculus
aggatacggtcaagcagtactgagg

SEQ ID NO: 190592 - DNA, 25 bp, Mus musculus
aggatacggtcatgcagtactgagg

SEQ ID NO: 190593 - DNA, 25 bp, Mus musculus
aggatactaagtcagctctgcccag

SEQ ID NO: 190594 - DNA, 25 bp, Mus musculus
aggatactaagtgagctctgcccag

SEQ ID NO: 190595 - DNA, 25 bp, Mus musculus
aggatactaggtaggcagcgttgct

SEQ ID NO: 190596 - DNA, 25 bp, Mus musculus
aggatactaggttggcagcgttgct

SEQ ID NO: 190597 - DNA, 25 bp, Mus musculus
aggatactcacacagcatgctcagt

SEQ ID NO: 190598 - DNA, 25 bp, Mus musculus
aggatactcacagagcatgctcagt

SEQ ID NO: 190599 - DNA, 25 bp, Mus musculus
aggatactcagcctagcagcccgtc

SEQ ID NO: 190600 - DNA, 25 bp, Mus musculus
aggatactcagcgtagcagcccgtc

SEQ ID NO: 190601 - DNA, 25 bp, Mus musculus
aggatacttcagacagtcacaggag

SEQ ID NO: 190602 - DNA, 25 bp, Mus musculus
aggatacttcagtcagtcacaggag

SEQ ID NO: 190603 - DNA, 25 bp, Mus musculus
aggatacttcccaagtgtgtgccag

SEQ ID NO: 190604 - DNA, 25 bp, Mus musculus
aggatacttccctagtgtgtgccag

SEQ ID NO: 190605 - DNA, 25 bp, Mus musculus
aggatacttcggctccaacgaagag

SEQ ID NO: 190606 - DNA, 25 bp, Mus musculus
aggatacttcgggtccaacgaagag

SEQ ID NO: 190607 - DNA, 25 bp, Mus musculus
aggatacttgtgctttctgtctgca

SEQ ID NO: 190608 - DNA, 25 bp, Mus musculus
aggatacttgtggtttctgtctgca

SEQ ID NO: 190609 - DNA, 25 bp, Mus musculus
aggatagaacatagcttggcctgtt

SEQ ID NO: 190610 - DNA, 25 bp, Mus musculus
aggatagaacattgcttggcctgtt

SEQ ID NO: 190611 - DNA, 25 bp, Mus musculus
aggatagacaccatgcttgaggtac

SEQ ID NO: 190612 - DNA, 25 bp, Mus musculus
aggatagacaccttgcttgaggtac

SEQ ID NO: 190613 - DNA, 25 bp, Mus musculus
aggatagacagtaggttctcagaac

SEQ ID NO: 190614 - DNA, 25 bp, Mus musculus
aggatagacagttggttctcagaac

SEQ ID NO: 190615 - DNA, 25 bp, Mus musculus
aggatagacctgctgaaccacttga

SEQ ID NO: 190616 - DNA, 25 bp, Mus musculus
aggatagacctggtgaaccacttga

SEQ ID NO: 190617 - DNA, 25 bp, Mus musculus
aggatagagctgaagcctgacccct

SEQ ID NO: 190618 - DNA, 25 bp, Mus musculus
aggatagagctgtagcctgacccct

SEQ ID NO: 190619 - DNA, 25 bp, Mus musculus
aggatagcacctcaaggacttaggt

SEQ ID NO: 190620 - DNA, 25 bp, Mus musculus
aggatagcacctgaaggacttaggt

SEQ ID NO: 190621 - DNA, 25 bp, Mus musculus
aggatagcatcactctaagcccaga

SEQ ID NO: 190622 - DNA, 25 bp, Mus musculus
aggatagcatcagtctaagcccaga

SEQ ID NO: 190623 - DNA, 25 bp, Mus musculus
aggatagcccggccccctgtggtat

SEQ ID NO: 190624 - DNA, 25 bp, Mus musculus
aggatagcccgggcccctgtggtat

SEQ ID NO: 190625 - DNA, 25 bp, Mus musculus
aggatagccttcagtgttcttcttg

SEQ ID NO: 190626 - DNA, 25 bp, Mus musculus
aggatagccttctgtgttcttcttg

SEQ ID NO: 190627 - DNA, 25 bp, Mus musculus
aggatagccttgactacataacgag

SEQ ID NO: 190628 - DNA, 25 bp, Mus musculus
aggatagccttgtctacataacgag

SEQ ID NO: 190629 - DNA, 25 bp, Mus musculus
aggataggagctatgccatataacc

SEQ ID NO: 190630 - DNA, 25 bp, Mus musculus
aggataggagctttgccatataacc

SEQ ID NO: 190631 - DNA, 25 bp, Mus musculus
aggataggctttagtgcaccctgac

SEQ ID NO: 190632 - DNA, 25 bp, Mus musculus
aggataggcttttgtgcaccctgac

SEQ ID NO: 190633 - DNA, 25 bp, Mus musculus
aggatagggcgcaatcactttaatt

SEQ ID NO: 190634 - DNA, 25 bp, Mus musculus
aggatagggcgctatcactttaatt

SEQ ID NO: 190635 - DNA, 25 bp, Mus musculus
aggatagtacatcttcttacccact

SEQ ID NO: 190636 - DNA, 25 bp, Mus musculus
aggatagtacatgttcttacccact

SEQ ID NO: 190637 - DNA, 25 bp, Mus musculus
aggatagtcttaacactgtgcacaa

SEQ ID NO: 190638 - DNA, 25 bp, Mus musculus
aggatagtcttatcactgtgcacaa

SEQ ID NO: 190639 - DNA, 25 bp, Mus musculus
aggatagtggatccctgcctgctca

SEQ ID NO: 190640 - DNA, 25 bp, Mus musculus
aggatagtggatgcctgcctgctca

SEQ ID NO: 190641 - DNA, 25 bp, Mus musculus
aggatagtggctatgacagcccgct

SEQ ID NO: 190642 - DNA, 25 bp, Mus musculus
aggatagtggctttgacagcccgct

SEQ ID NO: 190643 - DNA, 25 bp, Mus musculus
aggatagttcacaagtccctgctag

SEQ ID NO: 190644 - DNA, 25 bp, Mus musculus
aggatagttcactagtccctgctag

SEQ ID NO: 190645 - DNA, 25 bp, Mus musculus
aggatataacccacctttttgtgag

SEQ ID NO: 190646 - DNA, 25 bp, Mus musculus
aggatataaccctcctttttgtgag

SEQ ID NO: 190647 - DNA, 25 bp, Mus musculus
aggatataagccctgaaccaccagc

SEQ ID NO: 190648 - DNA, 25 bp, Mus musculus
aggatataagccgtgaaccaccagc

SEQ ID NO: 190649 - DNA, 25 bp, Mus musculus
aggatataccctcttctaggctggt

SEQ ID NO: 190650 - DNA, 25 bp, Mus musculus
aggatataccctgttctaggctggt

SEQ ID NO: 190651 - DNA, 25 bp, Mus musculus
aggatatagatgaaaacctcctctt

SEQ ID NO: 190652 - DNA, 25 bp, Mus musculus
aggatatagatgtaaacctcctctt

SEQ ID NO: 190653 - DNA, 25 bp, Mus musculus
aggatatagcgcatgcttcctttcc

SEQ ID NO: 190654 - DNA, 25 bp, Mus musculus
aggatatagcgcttgcttcctttcc

SEQ ID NO: 190655 - DNA, 25 bp, Mus musculus
aggatatatcgcatacagttgtgtc

SEQ ID NO: 190656 - DNA, 25 bp, Mus musculus
aggatatatcgcttacagttgtgtc

SEQ ID NO: 190657 - DNA, 25 bp, Mus musculus
aggatatcaactatgttacaaccca

SEQ ID NO: 190658 - DNA, 25 bp, Mus musculus
aggatatcaactttgttacaaccca

SEQ ID NO: 190659 - DNA, 25 bp, Mus musculus
aggatatcaattctctgcccaaaag

SEQ ID NO: 190660 - DNA, 25 bp, Mus musculus
aggatatcaattgtctgcccaaaag

SEQ ID NO: 190661 - DNA, 25 bp, Mus musculus
aggatatcataaaaccaacatgtct

SEQ ID NO: 190662 - DNA, 25 bp, Mus musculus
aggatatcataataccaacatgtct

SEQ ID NO: 190663 - DNA, 25 bp, Mus musculus
aggatatccacacactagctctggt

SEQ ID NO: 190664 - DNA, 25 bp, Mus musculus
aggatatccacagactagctctggt

SEQ ID NO: 190665 - DNA, 25 bp, Mus musculus
aggatatccctgatatctcacaaga

SEQ ID NO: 190666 - DNA, 25 bp, Mus musculus
aggatatccctgttatctcacaaga

SEQ ID NO: 190667 - DNA, 25 bp, Mus musculus
aggatatcctgccatgcttcatcaa

SEQ ID NO: 190668 - DNA, 25 bp, Mus musculus
aggatatcctgcgatgcttcatcaa

SEQ ID NO: 190669 - DNA, 25 bp, Mus musculus
aggatatctgcacccacgggttgag

SEQ ID NO: 190670 - DNA, 25 bp, Mus musculus
aggatatctgcagccacgggttgag

SEQ ID NO: 190671 - DNA, 25 bp, Mus musculus
aggatatctggtatcacctagcctc

SEQ ID NO: 190672 - DNA, 25 bp, Mus musculus
aggatatctggtttcacctagcctc

SEQ ID NO: 190673 - DNA, 25 bp, Mus musculus
aggatatcttcaccgagcactcata

SEQ ID NO: 190674 - DNA, 25 bp, Mus musculus
aggatatcttcagcgagcactcata

SEQ ID NO: 190675 - DNA, 25 bp, Mus musculus
aggatatcttgcagcgtcttggcca

SEQ ID NO: 190676 - DNA, 25 bp, Mus musculus
aggatatcttgctgcgtcttggcca

SEQ ID NO: 190677 - DNA, 25 bp, Mus musculus
aggatatgaactacactgcttggtc

SEQ ID NO: 190678 - DNA, 25 bp, Mus musculus
aggatatgaacttcactgcttggtc

SEQ ID NO: 190679 - DNA, 25 bp, Mus musculus
aggatatgacaaaatcaccactttt

SEQ ID NO: 190680 - DNA, 25 bp, Mus musculus
aggatatgacaatatcaccactttt

SEQ ID NO: 190681 - DNA, 25 bp, Mus musculus
aggatatgatgcctctgtggcacct

SEQ ID NO: 190682 - DNA, 25 bp, Mus musculus
aggatatgatgcgtctgtggcacct

SEQ ID NO: 190683 - DNA, 25 bp, Mus musculus
aggatatgatggactatgtgctgcc

SEQ ID NO: 190684 - DNA, 25 bp, Mus musculus
aggatatgatggtctatgtgctgcc

SEQ ID NO: 190685 - DNA, 25 bp, Mus musculus
aggatatgcagtaccttactcccaa

SEQ ID NO: 190686 - DNA, 25 bp, Mus musculus
aggatatgcagttccttactcccaa

SEQ ID NO: 190687 - DNA, 25 bp, Mus musculus
aggatatgctccaacttcgacttat

SEQ ID NO: 190688 - DNA, 25 bp, Mus musculus
aggatatgctcctacttcgacttat

SEQ ID NO: 190689 - DNA, 25 bp, Mus musculus
aggatatggtcaacatccccaacat

SEQ ID NO: 190690 - DNA, 25 bp, Mus musculus
aggatatggtcatcatccccaacat

SEQ ID NO: 190691 - DNA, 25 bp, Mus musculus
aggatatggttcaatttacgactgc

SEQ ID NO: 190692 - DNA, 25 bp, Mus musculus
aggatatggttctatttacgactgc

SEQ ID NO: 190693 - DNA, 25 bp, Mus musculus
aggatattacaaatgaagaccatca

SEQ ID NO: 190694 - DNA, 25 bp, Mus musculus
aggatattacaattgaagaccatca

SEQ ID NO: 190695 - DNA, 25 bp, Mus musculus
aggatattaccaagagcttgtccct

SEQ ID NO: 190696 - DNA, 25 bp, Mus musculus
aggatattaccatgagcttgtccct

SEQ ID NO: 190697 - DNA, 25 bp, Mus musculus
aggatattcccaattacaagagctg

SEQ ID NO: 190698 - DNA, 25 bp, Mus musculus
aggatattcccatttacaagagctg

SEQ ID NO: 190699 - DNA, 25 bp, Mus musculus
aggatattcctactgtgccttcgac

SEQ ID NO: 190700 - DNA, 25 bp, Mus musculus
aggatattcctagtgtgccttcgac

SEQ ID NO: 190701 - DNA, 25 bp, Mus musculus
aggatattcgagacagtgcttctgg

SEQ ID NO: 190702 - DNA, 25 bp, Mus musculus
aggatattcgagtcagtgcttctgg

SEQ ID NO: 190703 - DNA, 25 bp, Mus musculus
aggatcaaagacatacaacaccacg

SEQ ID NO: 190704 - DNA, 25 bp, Mus musculus
aggatcaaagacttacaacaccacg

SEQ ID NO: 190705 - DNA, 25 bp, Mus musculus
aggatcaaagagcaccggcccatca

SEQ ID NO: 190706 - DNA, 25 bp, Mus musculus
aggatcaaagaggaccggcccatca

SEQ ID NO: 190707 - DNA, 25 bp, Mus musculus
aggatcaaagcacaagccctgccac

SEQ ID NO: 190708 - DNA, 25 bp, Mus musculus
aggatcaaagcagaagccctgccac

SEQ ID NO: 190709 - DNA, 25 bp, Mus musculus
aggatcaaatccaagtgggcctgag

SEQ ID NO: 190710 - DNA, 25 bp, Mus musculus
aggatcaaatcctagtgggcctgag

SEQ ID NO: 190711 - DNA, 25 bp, Mus musculus
aggatcaactcacgcttctatcagt

SEQ ID NO: 190712 - DNA, 25 bp, Mus musculus
aggatcaactcaggcttctatcagt

SEQ ID NO: 190713 - DNA, 25 bp, Mus musculus
aggatcaactgtctcgctcctggga

SEQ ID NO: 190714 - DNA, 25 bp, Mus musculus
aggatcaactgtgtcgctcctggga

SEQ ID NO: 190715 - DNA, 25 bp, Mus musculus
aggatcaagtaaccctatttatttg

SEQ ID NO: 190716 - DNA, 25 bp, Mus musculus
aggatcaagtaagcctatttatttg

SEQ ID NO: 190717 - DNA, 25 bp, Mus musculus
aggatcaatcctaccaatccactca

SEQ ID NO: 190718 - DNA, 25 bp, Mus musculus
aggatcaatccttccaatccactca

SEQ ID NO: 190719 - DNA, 25 bp, Mus musculus
aggatcaatgtccagactctgccct

SEQ ID NO: 190720 - DNA, 25 bp, Mus musculus
aggatcaatgtcgagactctgccct

SEQ ID NO: 190721 - DNA, 25 bp, Mus musculus
aggatcacaaaacgcaggtctgctg

SEQ ID NO: 190722 - DNA, 25 bp, Mus musculus
aggatcacaaaaggcaggtctgctg

SEQ ID NO: 190723 - DNA, 25 bp, Mus musculus
aggatcacaaccagtatatcaacaa

SEQ ID NO: 190724 - DNA, 25 bp, Mus musculus
aggatcacaacctgtatatcaacaa

SEQ ID NO: 190725 - DNA, 25 bp, Mus musculus
aggatcacaagcacaaggcccatct

SEQ ID NO: 190726 - DNA, 25 bp, Mus musculus
aggatcacaagctcaaggcccatct

SEQ ID NO: 190727 - DNA, 25 bp, Mus musculus
aggatcacagagctgtcgtctctgt

SEQ ID NO: 190728 - DNA, 25 bp, Mus musculus
aggatcacagaggtgtcgtctctgt

SEQ ID NO: 190729 - DNA, 25 bp, Mus musculus
aggatcaccagcaaacagctttgtt

SEQ ID NO: 190730 - DNA, 25 bp, Mus musculus
aggatcaccagctaacagctttgtt

SEQ ID NO: 190731 - DNA, 25 bp, Mus musculus
aggatcacgggcatacgacatcatg

SEQ ID NO: 190732 - DNA, 25 bp, Mus musculus
aggatcacgggcttacgacatcatg

SEQ ID NO: 190733 - DNA, 25 bp, Mus musculus
aggatcacggtcactgggtccagtt

SEQ ID NO: 190734 - DNA, 25 bp, Mus musculus
aggatcacggtctctgggtccagtt

SEQ ID NO: 190735 - DNA, 25 bp, Mus musculus
aggatcactctaccctcgaagaagt

SEQ ID NO: 190736 - DNA, 25 bp, Mus musculus
aggatcactctagcctcgaagaagt

SEQ ID NO: 190737 - DNA, 25 bp, Mus musculus
aggatcactgatcgcttagaactgt

SEQ ID NO: 190738 - DNA, 25 bp, Mus musculus
aggatcactgatggcttagaactgt

SEQ ID NO: 190739 - DNA, 25 bp, Mus musculus
aggatcactggcagaaacacccggg

SEQ ID NO: 190740 - DNA, 25 bp, Mus musculus
aggatcactggctgaaacacccggg

SEQ ID NO: 190741 - DNA, 25 bp, Mus musculus
aggatcagactaatgtcctcccagc

SEQ ID NO: 190742 - DNA, 25 bp, Mus musculus
aggatcagactattgtcctcccagc

SEQ ID NO: 190743 - DNA, 25 bp, Mus musculus
aggatcagagccagctttttctttt

SEQ ID NO: 190744 - DNA, 25 bp, Mus musculus
aggatcagagcctgctttttctttt

SEQ ID NO: 190745 - DNA, 25 bp, Mus musculus
aggatcagatgaagggacaggccct

SEQ ID NO: 190746 - DNA, 25 bp, Mus musculus
aggatcagatgatgggacaggccct

SEQ ID NO: 190747 - DNA, 25 bp, Mus musculus
aggatcagccacacacgtgtttcct

SEQ ID NO: 190748 - DNA, 25 bp, Mus musculus
aggatcagccactcacgtgtttcct

SEQ ID NO: 190749 - DNA, 25 bp, Mus musculus
aggatcagcctgagctacctgagac

SEQ ID NO: 190750 - DNA, 25 bp, Mus musculus
aggatcagcctgtgctacctgagac

SEQ ID NO: 190751 - DNA, 25 bp, Mus musculus
aggatcaggagtcccaggttagcat

SEQ ID NO: 190752 - DNA, 25 bp, Mus musculus
aggatcaggagtgccaggttagcat

SEQ ID NO: 190753 - DNA, 25 bp, Mus musculus
aggatcaggctgatgagacccgccg

SEQ ID NO: 190754 - DNA, 25 bp, Mus musculus
aggatcaggctgttgagacccgccg

SEQ ID NO: 190755 - DNA, 25 bp, Mus musculus
aggatcagggccaagaccttccatg

SEQ ID NO: 190756 - DNA, 25 bp, Mus musculus
aggatcagggcctagaccttccatg

SEQ ID NO: 190757 - DNA, 25 bp, Mus musculus
aggatcagggttcggctctacatta

SEQ ID NO: 190758 - DNA, 25 bp, Mus musculus
aggatcagggttgggctctacatta

SEQ ID NO: 190759 - DNA, 25 bp, Mus musculus
aggatcagtctcacttcagcagcta

SEQ ID NO: 190760 - DNA, 25 bp, Mus musculus
aggatcagtctctcttcagcagcta

SEQ ID NO: 190761 - DNA, 25 bp, Mus musculus
aggatcagtgccattggctacctcg

SEQ ID NO: 190762 - DNA, 25 bp, Mus musculus
aggatcagtgcctttggctacctcg

SEQ ID NO: 190763 - DNA, 25 bp, Mus musculus
aggatcagttccagcaagtcagata

SEQ ID NO: 190764 - DNA, 25 bp, Mus musculus
aggatcagttcctgcaagtcagata

SEQ ID NO: 190765 - DNA, 25 bp, Mus musculus
aggatcagttctcacagaggcttgc

SEQ ID NO: 190766 - DNA, 25 bp, Mus musculus
aggatcagttctgacagaggcttgc

SEQ ID NO: 190767 - DNA, 25 bp, Mus musculus
aggatcatacctattttgggaattt

SEQ ID NO: 190768 - DNA, 25 bp, Mus musculus
aggatcataccttttttgggaattt

SEQ ID NO: 190769 - DNA, 25 bp, Mus musculus
aggatcatacggagcatgagaggcc

SEQ ID NO: 190770 - DNA, 25 bp, Mus musculus
aggatcatacggtgcatgagaggcc

SEQ ID NO: 190771 - DNA, 25 bp, Mus musculus
aggatcatactgcaatcgagagcat

SEQ ID NO: 190772 - DNA, 25 bp, Mus musculus
aggatcatactggaatcgagagcat

SEQ ID NO: 190773 - DNA, 25 bp, Mus musculus
aggatcatagttaagccccactgac

SEQ ID NO: 190774 - DNA, 25 bp, Mus musculus
aggatcatagtttagccccactgac

SEQ ID NO: 190775 - DNA, 25 bp, Mus musculus
aggatcatcatgcaattctggtaat

SEQ ID NO: 190776 - DNA, 25 bp, Mus musculus
aggatcatcatggaattctggtaat

SEQ ID NO: 190777 - DNA, 25 bp, Mus musculus
aggatcatcgacaagcctcggatta

SEQ ID NO: 190778 - DNA, 25 bp, Mus musculus
aggatcatcgactagcctcggatta

SEQ ID NO: 190779 - DNA, 25 bp, Mus musculus
aggatcatctatagtgtgcctgcct

SEQ ID NO: 190780 - DNA, 25 bp, Mus musculus
aggatcatctattgtgtgcctgcct

SEQ ID NO: 190781 - DNA, 25 bp, Mus musculus
aggatcatctgtatccgcttgttga

SEQ ID NO: 190782 - DNA, 25 bp, Mus musculus
aggatcatctgtttccgcttgttga

SEQ ID NO: 190783 - DNA, 25 bp, Mus musculus
aggatcatcttcattgggtcaacaa

SEQ ID NO: 190784 - DNA, 25 bp, Mus musculus
aggatcatcttctttgggtcaacaa

SEQ ID NO: 190785 - DNA, 25 bp, Mus musculus
aggatcatcttgattgtctgcctcc

SEQ ID NO: 190786 - DNA, 25 bp, Mus musculus
aggatcatcttgtttgtctgcctcc

SEQ ID NO: 190787 - DNA, 25 bp, Mus musculus
aggatcatgctcaacttctcatatc

SEQ ID NO: 190788 - DNA, 25 bp, Mus musculus
aggatcatgctctacttctcatatc

SEQ ID NO: 190789 - DNA, 25 bp, Mus musculus
aggatcatggttccacatcagccta

SEQ ID NO: 190790 - DNA, 25 bp, Mus musculus
aggatcatggttgcacatcagccta

SEQ ID NO: 190791 - DNA, 25 bp, Mus musculus
aggatcattacgaagctgctgctgg

SEQ ID NO: 190792 - DNA, 25 bp, Mus musculus
aggatcattacgtagctgctgctgg

SEQ ID NO: 190793 - DNA, 25 bp, Mus musculus
aggatcattcctatggttagtaaat

SEQ ID NO: 190794 - DNA, 25 bp, Mus musculus
aggatcattcctcgtccacagtagc

SEQ ID NO: 190795 - DNA, 25 bp, Mus musculus
aggatcattcctggtccacagtagc

SEQ ID NO: 190796 - DNA, 25 bp, Mus musculus
aggatcattcctttggttagtaaat

SEQ ID NO: 190797 - DNA, 25 bp, Mus musculus
aggatcattcttatcagtatttggg

SEQ ID NO: 190798 - DNA, 25 bp, Mus musculus
aggatcattcttttcagtatttggg

SEQ ID NO: 190799 - DNA, 25 bp, Mus musculus
aggatcatttctacacttcagactc

SEQ ID NO: 190800 - DNA, 25 bp, Mus musculus
aggatcatttcttcacttcagactc

SEQ ID NO: 190801 - DNA, 25 bp, Mus musculus
aggatcatttgcctcttatttgaag

SEQ ID NO: 190802 - DNA, 25 bp, Mus musculus
aggatcatttgcgtcttatttgaag

SEQ ID NO: 190803 - DNA, 25 bp, Mus musculus
aggatccaacgcctgactcagagag

SEQ ID NO: 190804 - DNA, 25 bp, Mus musculus
aggatccaacgcgtgactcagagag

SEQ ID NO: 190805 - DNA, 25 bp, Mus musculus
aggatccaaggtaccaggcccatag

SEQ ID NO: 190806 - DNA, 25 bp, Mus musculus
aggatccaaggttccaggcccatag

SEQ ID NO: 190807 - DNA, 25 bp, Mus musculus
aggatccacaacaccagcttctgga

SEQ ID NO: 190808 - DNA, 25 bp, Mus musculus
aggatccacaactccagcttctgga

SEQ ID NO: 190809 - DNA, 25 bp, Mus musculus
aggatccacaataccggcggaaggt

SEQ ID NO: 190810 - DNA, 25 bp, Mus musculus
aggatccacaattccggcggaaggt

SEQ ID NO: 190811 - DNA, 25 bp, Mus musculus
aggatccacacaagtttgcacgcgc

SEQ ID NO: 190812 - DNA, 25 bp, Mus musculus
aggatccacacatgtttgcacgcgc

SEQ ID NO: 190813 - DNA, 25 bp, Mus musculus
aggatccaccaccaaagtaccttat

SEQ ID NO: 190814 - DNA, 25 bp, Mus musculus
aggatccaccacgaaagtaccttat

SEQ ID NO: 190815 - DNA, 25 bp, Mus musculus
aggatccacgttccaatggttctac

SEQ ID NO: 190816 - DNA, 25 bp, Mus musculus
aggatccacgttgcaatggttctac

SEQ ID NO: 190817 - DNA, 25 bp, Mus musculus
aggatccacttcatggtgccatcat

SEQ ID NO: 190818 - DNA, 25 bp, Mus musculus
aggatccacttcttggtgccatcat

SEQ ID NO: 190819 - DNA, 25 bp, Mus musculus
aggatccagagcactacaacacgtg

SEQ ID NO: 190820 - DNA, 25 bp, Mus musculus
aggatccagagctctacaacacgtg

SEQ ID NO: 190821 - DNA, 25 bp, Mus musculus
aggatccagatgagctcaaccagag

SEQ ID NO: 190822 - DNA, 25 bp, Mus musculus
aggatccagatgtgctcaaccagag

SEQ ID NO: 190823 - DNA, 25 bp, Mus musculus
aggatccagcatcttcacccaaaaa

SEQ ID NO: 190824 - DNA, 25 bp, Mus musculus
aggatccagcatgttcacccaaaaa

SEQ ID NO: 190825 - DNA, 25 bp, Mus musculus
aggatccagctcctaaactgtttag

SEQ ID NO: 190826 - DNA, 25 bp, Mus musculus
aggatccagctcgtaaactgtttag

SEQ ID NO: 190827 - DNA, 25 bp, Mus musculus
aggatccaggagaccgccaagcaga

SEQ ID NO: 190828 - DNA, 25 bp, Mus musculus
aggatccaggagtccgccaagcaga

SEQ ID NO: 190829 - DNA, 25 bp, Mus musculus
aggatccaggcacagacagcgccca

SEQ ID NO: 190830 - DNA, 25 bp, Mus musculus
aggatccaggcacccagactcatgg

SEQ ID NO: 190831 - DNA, 25 bp, Mus musculus
aggatccaggcagagacagcgccca

SEQ ID NO: 190832 - DNA, 25 bp, Mus musculus
aggatccaggcagccagactcatgg

SEQ ID NO: 190833 - DNA, 25 bp, Mus musculus
aggatccagttgagcagcagaggtt

SEQ ID NO: 190834 - DNA, 25 bp, Mus musculus
aggatccagttgtgcagcagaggtt

SEQ ID NO: 190835 - DNA, 25 bp, Mus musculus
aggatccatacaacattgcgctctg

SEQ ID NO: 190836 - DNA, 25 bp, Mus musculus
aggatccatacatcattgcgctctg

SEQ ID NO: 190837 - DNA, 25 bp, Mus musculus
aggatccatagcacaaagccacggg

SEQ ID NO: 190838 - DNA, 25 bp, Mus musculus
aggatccatagctcaaagccacggg

SEQ ID NO: 190839 - DNA, 25 bp, Mus musculus
aggatccattggagggcaagtctgg

SEQ ID NO: 190840 - DNA, 25 bp, Mus musculus
aggatccattggtgggcaagtctgg

SEQ ID NO: 190841 - DNA, 25 bp, Mus musculus
aggatcccacaacccatattctact

SEQ ID NO: 190842 - DNA, 25 bp, Mus musculus
aggatcccacaagccatattctact

SEQ ID NO: 190843 - DNA, 25 bp, Mus musculus
aggatcccacccagatagctcattg

SEQ ID NO: 190844 - DNA, 25 bp, Mus musculus
aggatcccaccctgatagctcattg

SEQ ID NO: 190845 - DNA, 25 bp, Mus musculus
aggatcccacttccttattgtggtt

SEQ ID NO: 190846 - DNA, 25 bp, Mus musculus
aggatcccacttgcttattgtggtt

SEQ ID NO: 190847 - DNA, 25 bp, Mus musculus
aggatcccagagaactttgaagagt

SEQ ID NO: 190848 - DNA, 25 bp, Mus musculus
aggatcccagagtactttgaagagt

SEQ ID NO: 190849 - DNA, 25 bp, Mus musculus
aggatcccaggcatcattccaccga

SEQ ID NO: 190850 - DNA, 25 bp, Mus musculus
aggatcccaggcttcattccaccga

SEQ ID NO: 190851 - DNA, 25 bp, Mus musculus
aggatcccattaaccggagctgtgg

SEQ ID NO: 190852 - DNA, 25 bp, Mus musculus
aggatcccattatccggagctgtgg

SEQ ID NO: 190853 - DNA, 25 bp, Mus musculus
aggatccccactatacctaaggctg

SEQ ID NO: 190854 - DNA, 25 bp, Mus musculus
aggatccccactttacctaaggctg

SEQ ID NO: 190855 - DNA, 25 bp, Mus musculus
aggatccccaggacagtaactcctt

SEQ ID NO: 190856 - DNA, 25 bp, Mus musculus
aggatccccaggtcagtaactcctt

SEQ ID NO: 190857 - DNA, 25 bp, Mus musculus
aggatccccggcctctgtttgaagg

SEQ ID NO: 190858 - DNA, 25 bp, Mus musculus
aggatccccggcgtctgtttgaagg

SEQ ID NO: 190859 - DNA, 25 bp, Mus musculus
aggatcccgtgtcctgcagacgaga

SEQ ID NO: 190860 - DNA, 25 bp, Mus musculus
aggatcccgtgtgctgcagacgaga

SEQ ID NO: 190861 - DNA, 25 bp, Mus musculus
aggatccctagtaacagtgttggtt

SEQ ID NO: 190862 - DNA, 25 bp, Mus musculus
aggatccctagttacagtgttggtt

SEQ ID NO: 190863 - DNA, 25 bp, Mus musculus
aggatcccttcacctggcactatct

SEQ ID NO: 190864 - DNA, 25 bp, Mus musculus
aggatcccttcagctggcactatct

SEQ ID NO: 190865 - DNA, 25 bp, Mus musculus
aggatcccttctctcattgattctt

SEQ ID NO: 190866 - DNA, 25 bp, Mus musculus
aggatcccttctgtcattgattctt

SEQ ID NO: 190867 - DNA, 25 bp, Mus musculus
aggatccgcaataatgaagaacaca

SEQ ID NO: 190868 - DNA, 25 bp, Mus musculus
aggatccgcaattatgaagaacaca

SEQ ID NO: 190869 - DNA, 25 bp, Mus musculus
aggatccggcttctgcacaagaggc

SEQ ID NO: 190870 - DNA, 25 bp, Mus musculus
aggatccggcttgtgcacaagaggc

SEQ ID NO: 190871 - DNA, 25 bp, Mus musculus
aggatccgtgcgactttcaggctgg

SEQ ID NO: 190872 - DNA, 25 bp, Mus musculus
aggatccgtgcgtctttcaggctgg

SEQ ID NO: 190873 - DNA, 25 bp, Mus musculus
aggatcctagagacgtccatgccag

SEQ ID NO: 190874 - DNA, 25 bp, Mus musculus
aggatcctagagtcgtccatgccag

SEQ ID NO: 190875 - DNA, 25 bp, Mus musculus
aggatcctatcaccagcactgagaa

SEQ ID NO: 190876 - DNA, 25 bp, Mus musculus
aggatcctatcagcagcactgagaa

SEQ ID NO: 190877 - DNA, 25 bp, Mus musculus
aggatcctcagcaatcagcaggtca

SEQ ID NO: 190878 - DNA, 25 bp, Mus musculus
aggatcctcagctatcagcaggtca

SEQ ID NO: 190879 - DNA, 25 bp, Mus musculus
aggatcctcataactgccacaagtc

SEQ ID NO: 190880 - DNA, 25 bp, Mus musculus
aggatcctcatatctgccacaagtc

SEQ ID NO: 190881 - DNA, 25 bp, Mus musculus
aggatcctcggactaaaagtggcat

SEQ ID NO: 190882 - DNA, 25 bp, Mus musculus
aggatcctcggagtaaaagtggcat

SEQ ID NO: 190883 - DNA, 25 bp, Mus musculus
aggatcctcggtcgtgctaacctat

SEQ ID NO: 190884 - DNA, 25 bp, Mus musculus
aggatcctcggtggtgctaacctat

SEQ ID NO: 190885 - DNA, 25 bp, Mus musculus
aggatcctctcaatctaactataag

SEQ ID NO: 190886 - DNA, 25 bp, Mus musculus
aggatcctctcattctaactataag

SEQ ID NO: 190887 - DNA, 25 bp, Mus musculus
aggatcctctgcagtaagctttacc

SEQ ID NO: 190888 - DNA, 25 bp, Mus musculus
aggatcctctgctgtaagctttacc

SEQ ID NO: 190889 - DNA, 25 bp, Mus musculus
aggatcctgagcacgtggaggcttt

SEQ ID NO: 190890 - DNA, 25 bp, Mus musculus
aggatcctgagccagatttcactct

SEQ ID NO: 190891 - DNA, 25 bp, Mus musculus
aggatcctgagcgagatttcactct

SEQ ID NO: 190892 - DNA, 25 bp, Mus musculus
aggatcctgagctcgtggaggcttt

SEQ ID NO: 190893 - DNA, 25 bp, Mus musculus
aggatcctgcaacacctcgagagag

SEQ ID NO: 190894 - DNA, 25 bp, Mus musculus
aggatcctgcaagacctcgagagag

SEQ ID NO: 190895 - DNA, 25 bp, Mus musculus
aggatcctgcatcttatagtgccag

SEQ ID NO: 190896 - DNA, 25 bp, Mus musculus
aggatcctgcatgttatagtgccag

SEQ ID NO: 190897 - DNA, 25 bp, Mus musculus
aggatcctgccacccatgaggagat

SEQ ID NO: 190898 - DNA, 25 bp, Mus musculus
aggatcctgccagccatgaggagat

SEQ ID NO: 190899 - DNA, 25 bp, Mus musculus
aggatccttaatatggcccattata

SEQ ID NO: 190900 - DNA, 25 bp, Mus musculus
aggatccttaatttggcccattata

SEQ ID NO: 190901 - DNA, 25 bp, Mus musculus
aggatccttacaacacctaatctgg

SEQ ID NO: 190902 - DNA, 25 bp, Mus musculus
aggatccttacatcacctaatctgg

SEQ ID NO: 190903 - DNA, 25 bp, Mus musculus
aggatccttactagctccgggctat

SEQ ID NO: 190904 - DNA, 25 bp, Mus musculus
aggatccttacttgctccgggctat

SEQ ID NO: 190905 - DNA, 25 bp, Mus musculus
aggatccttcctagagtcactcaca

SEQ ID NO: 190906 - DNA, 25 bp, Mus musculus
aggatccttccttgagtcactcaca

SEQ ID NO: 190907 - DNA, 25 bp, Mus musculus
aggatccttgacagttgccgcaggg

SEQ ID NO: 190908 - DNA, 25 bp, Mus musculus
aggatccttgactgttgccgcaggg

SEQ ID NO: 190909 - DNA, 25 bp, Mus musculus
aggatcctttgacatgggccatgac

SEQ ID NO: 190910 - DNA, 25 bp, Mus musculus
aggatcctttgagatgggccatgac

SEQ ID NO: 190911 - DNA, 25 bp, Mus musculus
aggatcgaagatatttcagcaaagt

SEQ ID NO: 190912 - DNA, 25 bp, Mus musculus
aggatcgaagatttttcagcaaagt

SEQ ID NO: 190913 - DNA, 25 bp, Mus musculus
aggatcgactgaagtgcccattcca

SEQ ID NO: 190914 - DNA, 25 bp, Mus musculus
aggatcgactgatgtgcccattcca

SEQ ID NO: 190915 - DNA, 25 bp, Mus musculus
aggatcgcacggatgtccccttagt

SEQ ID NO: 190916 - DNA, 25 bp, Mus musculus
aggatcgcacggttgtccccttagt

SEQ ID NO: 190917 - DNA, 25 bp, Mus musculus
aggatcgcatctcccgtctgatggg

SEQ ID NO: 190918 - DNA, 25 bp, Mus musculus
aggatcgcatctgccgtctgatggg

SEQ ID NO: 190919 - DNA, 25 bp, Mus musculus
aggatcgccatccggatcacggcaa

SEQ ID NO: 190920 - DNA, 25 bp, Mus musculus
aggatcgccatcgggatcacggcaa

SEQ ID NO: 190921 - DNA, 25 bp, Mus musculus
aggatcgccgatccgctggccagtg

SEQ ID NO: 190922 - DNA, 25 bp, Mus musculus
aggatcgccgatgcgctggccagtg

SEQ ID NO: 190923 - DNA, 25 bp, Mus musculus
aggatcgcttggaccaggcgccatt

SEQ ID NO: 190924 - DNA, 25 bp, Mus musculus
aggatcgcttggtccaggcgccatt

SEQ ID NO: 190925 - DNA, 25 bp, Mus musculus
aggatcggacaactcttcttcggtg

SEQ ID NO: 190926 - DNA, 25 bp, Mus musculus
aggatcggacaagtcttcttcggtg

SEQ ID NO: 190927 - DNA, 25 bp, Mus musculus
aggatcggatgcaacgatttgccca

SEQ ID NO: 190928 - DNA, 25 bp, Mus musculus
aggatcggatgctacgatttgccca

SEQ ID NO: 190929 - DNA, 25 bp, Mus musculus
aggatcgggcaaacctgtcgctcag

SEQ ID NO: 190930 - DNA, 25 bp, Mus musculus
aggatcgggcaatcctgtcgctcag

SEQ ID NO: 190931 - DNA, 25 bp, Mus musculus
aggatcggtatgagttctcttccca

SEQ ID NO: 190932 - DNA, 25 bp, Mus musculus
aggatcggtatgtgttctcttccca

SEQ ID NO: 190933 - DNA, 25 bp, Mus musculus
aggatcgtatcgatttgcgcacgcc

SEQ ID NO: 190934 - DNA, 25 bp, Mus musculus
aggatcgtatcgttttgcgcacgcc

SEQ ID NO: 190935 - DNA, 25 bp, Mus musculus
aggatcgtccttccaaattgctgta

SEQ ID NO: 190936 - DNA, 25 bp, Mus musculus
aggatcgtccttgcaaattgctgta

SEQ ID NO: 190937 - DNA, 25 bp, Mus musculus
aggatcgttcatcttgtggcctgac

SEQ ID NO: 190938 - DNA, 25 bp, Mus musculus
aggatcgttcatgttgtggcctgac

SEQ ID NO: 190939 - DNA, 25 bp, Mus musculus
aggatcgttcttagagtttactcat

SEQ ID NO: 190940 - DNA, 25 bp, Mus musculus
aggatcgttctttgagtttactcat

SEQ ID NO: 190941 - DNA, 25 bp, Mus musculus
aggatcgttttcacatttgtatgct

SEQ ID NO: 190942 - DNA, 25 bp, Mus musculus
aggatcgttttctcatttgtatgct

SEQ ID NO: 190943 - DNA, 25 bp, Mus musculus
aggatctaccttacccaggatgggt

SEQ ID NO: 190944 - DNA, 25 bp, Mus musculus
aggatctacctttcccaggatgggt

SEQ ID NO: 190945 - DNA, 25 bp, Mus musculus
aggatctagatcagcagcatctgca

SEQ ID NO: 190946 - DNA, 25 bp, Mus musculus
aggatctagatctgcagcatctgca

SEQ ID NO: 190947 - DNA, 25 bp, Mus musculus
aggatctaggatccccagccgtggc

SEQ ID NO: 190948 - DNA, 25 bp, Mus musculus
aggatctaggatgcccagccgtggc

SEQ ID NO: 190949 - DNA, 25 bp, Mus musculus
aggatctaggctacccatttcttgg

SEQ ID NO: 190950 - DNA, 25 bp, Mus musculus
aggatctaggcttcccatttcttgg

SEQ ID NO: 190951 - DNA, 25 bp, Mus musculus
aggatctagtgtctcctggtccaag

SEQ ID NO: 190952 - DNA, 25 bp, Mus musculus
aggatctagtgtgtcctggtccaag

SEQ ID NO: 190953 - DNA, 25 bp, Mus musculus
aggatctatgatctctcagttgaat

SEQ ID NO: 190954 - DNA, 25 bp, Mus musculus
aggatctatgatgtctcagttgaat

SEQ ID NO: 190955 - DNA, 25 bp, Mus musculus
aggatctattcaagtgccctgacca

SEQ ID NO: 190956 - DNA, 25 bp, Mus musculus
aggatctattcatgtgccctgacca

SEQ ID NO: 190957 - DNA, 25 bp, Mus musculus
aggatctcaaggacatactgggaag

SEQ ID NO: 190958 - DNA, 25 bp, Mus musculus
aggatctcaaggtcatactgggaag

SEQ ID NO: 190959 - DNA, 25 bp, Mus musculus
aggatctcagtcagcacttcaggaa

SEQ ID NO: 190960 - DNA, 25 bp, Mus musculus
aggatctcagtctgcacttcaggaa

SEQ ID NO: 190961 - DNA, 25 bp, Mus musculus
aggatctcatgcaacctaggctggt

SEQ ID NO: 190962 - DNA, 25 bp, Mus musculus
aggatctcatgctacctaggctggt

SEQ ID NO: 190963 - DNA, 25 bp, Mus musculus
aggatctccctgaagattaccccgt

SEQ ID NO: 190964 - DNA, 25 bp, Mus musculus
aggatctccctgtagattaccccgt

SEQ ID NO: 190965 - DNA, 25 bp, Mus musculus
aggatctcctaactgttcccttgac

SEQ ID NO: 190966 - DNA, 25 bp, Mus musculus
aggatctcctaagtgttcccttgac

SEQ ID NO: 190967 - DNA, 25 bp, Mus musculus
aggatctcctcgacagagttcttgc

SEQ ID NO: 190968 - DNA, 25 bp, Mus musculus
aggatctcctcgtcagagttcttgc

SEQ ID NO: 190969 - DNA, 25 bp, Mus musculus
aggatctccttgaatagctcctctg

SEQ ID NO: 190970 - DNA, 25 bp, Mus musculus
aggatctccttgtatagctcctctg

SEQ ID NO: 190971 - DNA, 25 bp, Mus musculus
aggatctcgccaaagcccaggaggg

SEQ ID NO: 190972 - DNA, 25 bp, Mus musculus
aggatctcgccatagcccaggaggg

SEQ ID NO: 190973 - DNA, 25 bp, Mus musculus
aggatctcgtgaaacccaagctagc

SEQ ID NO: 190974 - DNA, 25 bp, Mus musculus
aggatctcgtgatacccaagctagc

SEQ ID NO: 190975 - DNA, 25 bp, Mus musculus
aggatctcgtgtatgtcttagcagc

SEQ ID NO: 190976 - DNA, 25 bp, Mus musculus
aggatctcgtgtttgtcttagcagc

SEQ ID NO: 190977 - DNA, 25 bp, Mus musculus
aggatctctcttcaggactttgggc

SEQ ID NO: 190978 - DNA, 25 bp, Mus musculus
aggatctctcttgaggactttgggc

SEQ ID NO: 190979 - DNA, 25 bp, Mus musculus
aggatctctgcgcttttattttccc

SEQ ID NO: 190980 - DNA, 25 bp, Mus musculus
aggatctctgcggttttattttccc

SEQ ID NO: 190981 - DNA, 25 bp, Mus musculus
aggatctgaagaaggcctgggccaa

SEQ ID NO: 190982 - DNA, 25 bp, Mus musculus
aggatctgaagatggcctgggccaa

SEQ ID NO: 190983 - DNA, 25 bp, Mus musculus
aggatctgacccaggatcctctgca

SEQ ID NO: 190984 - DNA, 25 bp, Mus musculus
aggatctgaccctggatcctctgca

SEQ ID NO: 190985 - DNA, 25 bp, Mus musculus
aggatctgagtcaactccatgccac

SEQ ID NO: 190986 - DNA, 25 bp, Mus musculus
aggatctgagtctactccatgccac

SEQ ID NO: 190987 - DNA, 25 bp, Mus musculus
aggatctgagttcctttccttgcac

SEQ ID NO: 190988 - DNA, 25 bp, Mus musculus
aggatctgagttgctttccttgcac

SEQ ID NO: 190989 - DNA, 25 bp, Mus musculus
aggatctgatccagtctgctggcca

SEQ ID NO: 190990 - DNA, 25 bp, Mus musculus
aggatctgatcctgtctgctggcca

SEQ ID NO: 190991 - DNA, 25 bp, Mus musculus
aggatctgcaggagccgtttgcacc

SEQ ID NO: 190992 - DNA, 25 bp, Mus musculus
aggatctgcaggtgccgtttgcacc

SEQ ID NO: 190993 - DNA, 25 bp, Mus musculus
aggatctgctcgctgcatgatttta

SEQ ID NO: 190994 - DNA, 25 bp, Mus musculus
aggatctgctcggtgcatgatttta

SEQ ID NO: 190995 - DNA, 25 bp, Mus musculus
aggatctgctctactaggcttgctg

SEQ ID NO: 190996 - DNA, 25 bp, Mus musculus
aggatctgctcttctaggcttgctg

SEQ ID NO: 190997 - DNA, 25 bp, Mus musculus
aggatctggagacgccccactgaag

SEQ ID NO: 190998 - DNA, 25 bp, Mus musculus
aggatctggagaggccccactgaag

SEQ ID NO: 190999 - DNA, 25 bp, Mus musculus
aggatctggcccaggcatcggtacg

SEQ ID NO: 191000 - DNA, 25 bp, Mus musculus
aggatctggccctggcatcggtacg

SEQ ID NO: 191001 - DNA, 25 bp, Mus musculus
aggatctggtagatgttgagtgctt

SEQ ID NO: 191002 - DNA, 25 bp, Mus musculus
aggatctggtagttgttgagtgctt

SEQ ID NO: 191003 - DNA, 25 bp, Mus musculus
aggatctggttcagcgtcttgagcc

SEQ ID NO: 191004 - DNA, 25 bp, Mus musculus
aggatctggttctgcgtcttgagcc

SEQ ID NO: 191005 - DNA, 25 bp, Mus musculus
aggatctggtttcctgttcgctgtc

SEQ ID NO: 191006 - DNA, 25 bp, Mus musculus
aggatctggtttgctgttcgctgtc

SEQ ID NO: 191007 - DNA, 25 bp, Mus musculus
aggatctgtgctcaagctcgtcttc

SEQ ID NO: 191008 - DNA, 25 bp, Mus musculus
aggatctgtgctgaagctcgtcttc

SEQ ID NO: 191009 - DNA, 25 bp, Mus musculus
aggatcttatccagatcttaccctc

SEQ ID NO: 191010 - DNA, 25 bp, Mus musculus
aggatcttatcctgatcttaccctc

SEQ ID NO: 191011 - DNA, 25 bp, Mus musculus
aggatcttatgccacacatagcaac

SEQ ID NO: 191012 - DNA, 25 bp, Mus musculus
aggatcttatgcgacacatagcaac

SEQ ID NO: 191013 - DNA, 25 bp, Mus musculus
aggatcttcacaacgatagctcgca

SEQ ID NO: 191014 - DNA, 25 bp, Mus musculus
aggatcttcacatcgatagctcgca

SEQ ID NO: 191015 - DNA, 25 bp, Mus musculus
aggatcttccagacgctgaatcgca

SEQ ID NO: 191016 - DNA, 25 bp, Mus musculus
aggatcttccagtcgctgaatcgca

SEQ ID NO: 191017 - DNA, 25 bp, Mus musculus
aggatcttctcacgaacctctacga

SEQ ID NO: 191018 - DNA, 25 bp, Mus musculus
aggatcttctcaggaacctctacga

SEQ ID NO: 191019 - DNA, 25 bp, Mus musculus
aggatcttctgtagctatgtagcta

SEQ ID NO: 191020 - DNA, 25 bp, Mus musculus
aggatcttctgttgctatgtagcta

SEQ ID NO: 191021 - DNA, 25 bp, Mus musculus
aggatcttgcctaattttcaaatgg

SEQ ID NO: 191022 - DNA, 25 bp, Mus musculus
aggatcttgccttattttcaaatgg

SEQ ID NO: 191023 - DNA, 25 bp, Mus musculus
aggatcttgctaacactgtaaccaa

SEQ ID NO: 191024 - DNA, 25 bp, Mus musculus
aggatcttgctatcactgtaaccaa

SEQ ID NO: 191025 - DNA, 25 bp, Mus musculus
aggatcttgtttctctacgatgtgg

SEQ ID NO: 191026 - DNA, 25 bp, Mus musculus
aggatcttgtttgtctacgatgtgg

SEQ ID NO: 191027 - DNA, 25 bp, Mus musculus
aggatctttgagactcccggtcctt

SEQ ID NO: 191028 - DNA, 25 bp, Mus musculus
aggatctttgagtctcccggtcctt

SEQ ID NO: 191029 - DNA, 25 bp, Mus musculus
aggatctttgggaggtgctatctcc

SEQ ID NO: 191030 - DNA, 25 bp, Mus musculus
aggatctttgggtggtgctatctcc

SEQ ID NO: 191031 - DNA, 25 bp, Mus musculus
aggatgaacactcctggtctgtcag

SEQ ID NO: 191032 - DNA, 25 bp, Mus musculus
aggatgaacactgctggtctgtcag

SEQ ID NO: 191033 - DNA, 25 bp, Mus musculus
aggatgaacatcacccaactcacgt

SEQ ID NO: 191034 - DNA, 25 bp, Mus musculus
aggatgaacatctcccaactcacgt

SEQ ID NO: 191035 - DNA, 25 bp, Mus musculus
aggatgaactccagaacatctcccc

SEQ ID NO: 191036 - DNA, 25 bp, Mus musculus
aggatgaactcccaaggtggctact

SEQ ID NO: 191037 - DNA, 25 bp, Mus musculus
aggatgaactccgaaggtggctact

SEQ ID NO: 191038 - DNA, 25 bp, Mus musculus
aggatgaactcctgaacatctcccc

SEQ ID NO: 191039 - DNA, 25 bp, Mus musculus
aggatgaagaacctctttctcccct

SEQ ID NO: 191040 - DNA, 25 bp, Mus musculus
aggatgaagaacgtctttctcccct

SEQ ID NO: 191041 - DNA, 25 bp, Mus musculus
aggatgaagacaatccctgctctca

SEQ ID NO: 191042 - DNA, 25 bp, Mus musculus
aggatgaagacattccctgctctca

SEQ ID NO: 191043 - DNA, 25 bp, Mus musculus
aggatgaagaggctcctaaggacca

SEQ ID NO: 191044 - DNA, 25 bp, Mus musculus
aggatgaagagggtcctaaggacca

SEQ ID NO: 191045 - DNA, 25 bp, Mus musculus
aggatgaagcagaccccaagaggca

SEQ ID NO: 191046 - DNA, 25 bp, Mus musculus
aggatgaagcagtccccaagaggca

SEQ ID NO: 191047 - DNA, 25 bp, Mus musculus
aggatgaagccgatcaatgccctga

SEQ ID NO: 191048 - DNA, 25 bp, Mus musculus
aggatgaagccgttcaatgccctga

SEQ ID NO: 191049 - DNA, 25 bp, Mus musculus
aggatgaaggccaagctcataccac

SEQ ID NO: 191050 - DNA, 25 bp, Mus musculus
aggatgaaggccagttcagctaccc

SEQ ID NO: 191051 - DNA, 25 bp, Mus musculus
aggatgaaggcctagctcataccac

SEQ ID NO: 191052 - DNA, 25 bp, Mus musculus
aggatgaaggcctgttcagctaccc

SEQ ID NO: 191053 - DNA, 25 bp, Mus musculus
aggatgaatggtcccttgctcattc

SEQ ID NO: 191054 - DNA, 25 bp, Mus musculus
aggatgaatggtgccttgctcattc

SEQ ID NO: 191055 - DNA, 25 bp, Mus musculus
aggatgaattggagtgtctcccctg

SEQ ID NO: 191056 - DNA, 25 bp, Mus musculus
aggatgaattggtgtgtctcccctg

SEQ ID NO: 191057 - DNA, 25 bp, Mus musculus
aggatgacaaccaccatacacatac

SEQ ID NO: 191058 - DNA, 25 bp, Mus musculus
aggatgacaacctccatacacatac

SEQ ID NO: 191059 - DNA, 25 bp, Mus musculus
aggatgacaagaaccagcgagccct

SEQ ID NO: 191060 - DNA, 25 bp, Mus musculus
aggatgacaagatccagcgagccct

SEQ ID NO: 191061 - DNA, 25 bp, Mus musculus
aggatgacagccaatggaaccctcc

SEQ ID NO: 191062 - DNA, 25 bp, Mus musculus
aggatgacagcctatggaaccctcc

SEQ ID NO: 191063 - DNA, 25 bp, Mus musculus
aggatgacatccatgaccgactgac

SEQ ID NO: 191064 - DNA, 25 bp, Mus musculus
aggatgacatccttgaccgactgac

SEQ ID NO: 191065 - DNA, 25 bp, Mus musculus
aggatgacatgtccttctgtgccaa

SEQ ID NO: 191066 - DNA, 25 bp, Mus musculus
aggatgacatgtgcttctgtgccaa

SEQ ID NO: 191067 - DNA, 25 bp, Mus musculus
aggatgacattccttcattggtgaa

SEQ ID NO: 191068 - DNA, 25 bp, Mus musculus
aggatgacattcgttcattggtgaa

SEQ ID NO: 191069 - DNA, 25 bp, Mus musculus
aggatgaccagtcgcctgatagcat

SEQ ID NO: 191070 - DNA, 25 bp, Mus musculus
aggatgaccagtggcctgatagcat

SEQ ID NO: 191071 - DNA, 25 bp, Mus musculus
aggatgacccaaagcaatttttaat

SEQ ID NO: 191072 - DNA, 25 bp, Mus musculus
aggatgacccaatgcaatttttaat

SEQ ID NO: 191073 - DNA, 25 bp, Mus musculus
aggatgaccccgagcttgtgacctt

SEQ ID NO: 191074 - DNA, 25 bp, Mus musculus
aggatgaccccgtgcttgtgacctt

SEQ ID NO: 191075 - DNA, 25 bp, Mus musculus
aggatgaccctgacatcgtagcttt

SEQ ID NO: 191076 - DNA, 25 bp, Mus musculus
aggatgaccctgtcatcgtagcttt

SEQ ID NO: 191077 - DNA, 25 bp, Mus musculus
aggatgacgcgtcgctttgatgaat

SEQ ID NO: 191078 - DNA, 25 bp, Mus musculus
aggatgacgcgtggctttgatgaat

SEQ ID NO: 191079 - DNA, 25 bp, Mus musculus
aggatgacgctgaactttgacctct

SEQ ID NO: 191080 - DNA, 25 bp, Mus musculus
aggatgacgctgtactttgacctct

SEQ ID NO: 191081 - DNA, 25 bp, Mus musculus
aggatgactccgatgaagaagcccc

SEQ ID NO: 191082 - DNA, 25 bp, Mus musculus
aggatgactccgttgaagaagcccc

SEQ ID NO: 191083 - DNA, 25 bp, Mus musculus
aggatgactctaactttctagttgc

SEQ ID NO: 191084 - DNA, 25 bp, Mus musculus
aggatgactctatctttctagttgc

SEQ ID NO: 191085 - DNA, 25 bp, Mus musculus
aggatgactctgcagggccactagt

SEQ ID NO: 191086 - DNA, 25 bp, Mus musculus
aggatgactctggagggccactagt

SEQ ID NO: 191087 - DNA, 25 bp, Mus musculus
aggatgactgcactgggcctctgcc

SEQ ID NO: 191088 - DNA, 25 bp, Mus musculus
aggatgactgcagtgggcctctgcc

SEQ ID NO: 191089 - DNA, 25 bp, Mus musculus
aggatgactgctagtacaccagcct

SEQ ID NO: 191090 - DNA, 25 bp, Mus musculus
aggatgactgcttgtacaccagcct

SEQ ID NO: 191091 - DNA, 25 bp, Mus musculus
aggatgactgtcatagctccatctt

SEQ ID NO: 191092 - DNA, 25 bp, Mus musculus
aggatgactgtcttagctccatctt

SEQ ID NO: 191093 - DNA, 25 bp, Mus musculus
aggatgacttcaagcagtgggcagc

SEQ ID NO: 191094 - DNA, 25 bp, Mus musculus
aggatgacttcatgcagtgggcagc

SEQ ID NO: 191095 - DNA, 25 bp, Mus musculus
aggatgacttctcgtggcgactgcc

SEQ ID NO: 191096 - DNA, 25 bp, Mus musculus
aggatgacttctggtggcgactgcc

SEQ ID NO: 191097 - DNA, 25 bp, Mus musculus
aggatgactttgagcctctgtaacc

SEQ ID NO: 191098 - DNA, 25 bp, Mus musculus
aggatgactttgtgcctctgtaacc

SEQ ID NO: 191099 - DNA, 25 bp, Mus musculus
aggatgagaattcaaggccgctctt

SEQ ID NO: 191100 - DNA, 25 bp, Mus musculus
aggatgagaattgaaggccgctctt

SEQ ID NO: 191101 - DNA, 25 bp, Mus musculus
aggatgagatgcactgccgggaccc

SEQ ID NO: 191102 - DNA, 25 bp, Mus musculus
aggatgagatgctctgccgggaccc

SEQ ID NO: 191103 - DNA, 25 bp, Mus musculus
aggatgagcagcctctccacgccag

SEQ ID NO: 191104 - DNA, 25 bp, Mus musculus
aggatgagcagcgtctccacgccag

SEQ ID NO: 191105 - DNA, 25 bp, Mus musculus
aggatgagcatgaggcaggccgtgc

SEQ ID NO: 191106 - DNA, 25 bp, Mus musculus
aggatgagcatgtggcaggccgtgc

SEQ ID NO: 191107 - DNA, 25 bp, Mus musculus
aggatgaggattctcgccttgctgt

SEQ ID NO: 191108 - DNA, 25 bp, Mus musculus
aggatgaggattgtcgccttgctgt

SEQ ID NO: 191109 - DNA, 25 bp, Mus musculus
aggatgaggctcatcatcgctcttc

SEQ ID NO: 191110 - DNA, 25 bp, Mus musculus
aggatgaggctcttcatcgctcttc

SEQ ID NO: 191111 - DNA, 25 bp, Mus musculus
aggatgagtaaacagcctgccctcc

SEQ ID NO: 191112 - DNA, 25 bp, Mus musculus
aggatgagtaaagagcctgccctcc

SEQ ID NO: 191113 - DNA, 25 bp, Mus musculus
aggatgagtagcagtacccctctgt

SEQ ID NO: 191114 - DNA, 25 bp, Mus musculus
aggatgagtagctgtacccctctgt

SEQ ID NO: 191115 - DNA, 25 bp, Mus musculus
aggatgagttgtcagccacggccca

SEQ ID NO: 191116 - DNA, 25 bp, Mus musculus
aggatgagttgtctgtttatgcttc

SEQ ID NO: 191117 - DNA, 25 bp, Mus musculus
aggatgagttgtgagccacggccca

SEQ ID NO: 191118 - DNA, 25 bp, Mus musculus
aggatgagttgtgtgtttatgcttc

SEQ ID NO: 191119 - DNA, 25 bp, Mus musculus
aggatgagtttgacgtcttggcctg

SEQ ID NO: 191120 - DNA, 25 bp, Mus musculus
aggatgagtttgtcgtcttggcctg

SEQ ID NO: 191121 - DNA, 25 bp, Mus musculus
aggatgatacctctgtctctgacca

SEQ ID NO: 191122 - DNA, 25 bp, Mus musculus
aggatgatacctgtgtctctgacca

SEQ ID NO: 191123 - DNA, 25 bp, Mus musculus
aggatgatagtcacatttccagctc

SEQ ID NO: 191124 - DNA, 25 bp, Mus musculus
aggatgatagtctcatttccagctc

SEQ ID NO: 191125 - DNA, 25 bp, Mus musculus
aggatgatccataatacccctggtc

SEQ ID NO: 191126 - DNA, 25 bp, Mus musculus
aggatgatccattatacccctggtc

SEQ ID NO: 191127 - DNA, 25 bp, Mus musculus
aggatgatccggatgtgctcacgct

SEQ ID NO: 191128 - DNA, 25 bp, Mus musculus
aggatgatccggttgtgctcacgct

SEQ ID NO: 191129 - DNA, 25 bp, Mus musculus
aggatgatgcctccttttctgagcc

SEQ ID NO: 191130 - DNA, 25 bp, Mus musculus
aggatgatgcctgcttttctgagcc

SEQ ID NO: 191131 - DNA, 25 bp, Mus musculus
aggatgatgctgcaacctagcttga

SEQ ID NO: 191132 - DNA, 25 bp, Mus musculus
aggatgatgctggaacctagcttga

SEQ ID NO: 191133 - DNA, 25 bp, Mus musculus
aggatgatgggcagaccttcttcac

SEQ ID NO: 191134 - DNA, 25 bp, Mus musculus
aggatgatgggctgaccttcttcac

SEQ ID NO: 191135 - DNA, 25 bp, Mus musculus
aggatgatgtcgatctccgggacac

SEQ ID NO: 191136 - DNA, 25 bp, Mus musculus
aggatgatgtcgttctccgggacac

SEQ ID NO: 191137 - DNA, 25 bp, Mus musculus
aggatgattagtctccaccacccat

SEQ ID NO: 191138 - DNA, 25 bp, Mus musculus
aggatgattagtgtccaccacccat

SEQ ID NO: 191139 - DNA, 25 bp, Mus musculus
aggatgattccgaccaagtgcacta

SEQ ID NO: 191140 - DNA, 25 bp, Mus musculus
aggatgattccgtccaagtgcacta

SEQ ID NO: 191141 - DNA, 25 bp, Mus musculus
aggatgatttctacaggcctctaaa

SEQ ID NO: 191142 - DNA, 25 bp, Mus musculus
aggatgatttcttcaggcctctaaa

SEQ ID NO: 191143 - DNA, 25 bp, Mus musculus
aggatgcaccaaaacagggccccgg

SEQ ID NO: 191144 - DNA, 25 bp, Mus musculus
aggatgcaccaatacagggccccgg

SEQ ID NO: 191145 - DNA, 25 bp, Mus musculus
aggatgcaccggcttcttttttcag

SEQ ID NO: 191146 - DNA, 25 bp, Mus musculus
aggatgcaccgggttcttttttcag

SEQ ID NO: 191147 - DNA, 25 bp, Mus musculus
aggatgcacctcaatgtttgagcag

SEQ ID NO: 191148 - DNA, 25 bp, Mus musculus
aggatgcacctctatgtttgagcag

SEQ ID NO: 191149 - DNA, 25 bp, Mus musculus
aggatgcagagtatcgccagggact

SEQ ID NO: 191150 - DNA, 25 bp, Mus musculus
aggatgcagagtttcgccagggact

SEQ ID NO: 191151 - DNA, 25 bp, Mus musculus
aggatgcagccaaccagtccatgtt

SEQ ID NO: 191152 - DNA, 25 bp, Mus musculus
aggatgcagccatccagtccatgtt

SEQ ID NO: 191153 - DNA, 25 bp, Mus musculus
aggatgcaggccagggaccagccaa

SEQ ID NO: 191154 - DNA, 25 bp, Mus musculus
aggatgcaggcctgggaccagccaa

SEQ ID NO: 191155 - DNA, 25 bp, Mus musculus
aggatgcagtgcaatgaatcaatat

SEQ ID NO: 191156 - DNA, 25 bp, Mus musculus
aggatgcagtgctatgaatcaatat

SEQ ID NO: 191157 - DNA, 25 bp, Mus musculus
aggatgcagtggattctccaggaaa

SEQ ID NO: 191158 - DNA, 25 bp, Mus musculus
aggatgcagtggctcctggcactca

SEQ ID NO: 191159 - DNA, 25 bp, Mus musculus
aggatgcagtgggtcctggcactca

SEQ ID NO: 191160 - DNA, 25 bp, Mus musculus
aggatgcagtggtttctccaggaaa

SEQ ID NO: 191161 - DNA, 25 bp, Mus musculus
aggatgcagttcatcggacgcctcg

SEQ ID NO: 191162 - DNA, 25 bp, Mus musculus
aggatgcagttcttcggacgcctcg

SEQ ID NO: 191163 - DNA, 25 bp, Mus musculus
aggatgcatcggcaagcggcgtgcc

SEQ ID NO: 191164 - DNA, 25 bp, Mus musculus
aggatgcatcgggaagcggcgtgcc

SEQ ID NO: 191165 - DNA, 25 bp, Mus musculus
aggatgcatttgagtctggtttttc

SEQ ID NO: 191166 - DNA, 25 bp, Mus musculus
aggatgcatttgtgtctggtttttc

SEQ ID NO: 191167 - DNA, 25 bp, Mus musculus
aggatgccaagtactgctgtaaaat

SEQ ID NO: 191168 - DNA, 25 bp, Mus musculus
aggatgccaagttctgctgtaaaat

SEQ ID NO: 191169 - DNA, 25 bp, Mus musculus
aggatgccaatcaacccgaggcgga

SEQ ID NO: 191170 - DNA, 25 bp, Mus musculus
aggatgccaatctacccgaggcgga

SEQ ID NO: 191171 - DNA, 25 bp, Mus musculus
aggatgccacctatacttctgcccg

SEQ ID NO: 191172 - DNA, 25 bp, Mus musculus
aggatgccacctttacttctgcccg

SEQ ID NO: 191173 - DNA, 25 bp, Mus musculus
aggatgccagacctctgctacttta

SEQ ID NO: 191174 - DNA, 25 bp, Mus musculus
aggatgccagacgtctgctacttta

SEQ ID NO: 191175 - DNA, 25 bp, Mus musculus
aggatgccagctagtctctgactcg

SEQ ID NO: 191176 - DNA, 25 bp, Mus musculus
aggatgccagcttgtctctgactcg

SEQ ID NO: 191177 - DNA, 25 bp, Mus musculus
aggatgccaggtcgacacgcccgtc

SEQ ID NO: 191178 - DNA, 25 bp, Mus musculus
aggatgccaggtggacacgcccgtc

SEQ ID NO: 191179 - DNA, 25 bp, Mus musculus
aggatgccatcaccttcaggtcagc

SEQ ID NO: 191180 - DNA, 25 bp, Mus musculus
aggatgccatcagcttcaggtcagc

SEQ ID NO: 191181 - DNA, 25 bp, Mus musculus
aggatgccatcgagagccagggact

SEQ ID NO: 191182 - DNA, 25 bp, Mus musculus
aggatgccatcgtgagccagggact

SEQ ID NO: 191183 - DNA, 25 bp, Mus musculus
aggatgccatgcagacgttctgttt

SEQ ID NO: 191184 - DNA, 25 bp, Mus musculus
aggatgccatgctgacgttctgttt

SEQ ID NO: 191185 - DNA, 25 bp, Mus musculus
aggatgcccaagaggagtacatcaa

SEQ ID NO: 191186 - DNA, 25 bp, Mus musculus
aggatgcccaagtggagtacatcaa

SEQ ID NO: 191187 - DNA, 25 bp, Mus musculus
aggatgccccagactatcagtgtca

SEQ ID NO: 191188 - DNA, 25 bp, Mus musculus
aggatgccccagtctatcagtgtca

SEQ ID NO: 191189 - DNA, 25 bp, Mus musculus
aggatgcccctgaagaggttcgaaa

SEQ ID NO: 191190 - DNA, 25 bp, Mus musculus
aggatgcccctgtagaggttcgaaa

SEQ ID NO: 191191 - DNA, 25 bp, Mus musculus
aggatgcccgcactgtcttgaagga

SEQ ID NO: 191192 - DNA, 25 bp, Mus musculus
aggatgcccgcagtgtcttgaagga

SEQ ID NO: 191193 - DNA, 25 bp, Mus musculus
aggatgccctaaagaatgctgtggc

SEQ ID NO: 191194 - DNA, 25 bp, Mus musculus
aggatgccctaatgaatgctgtggc

SEQ ID NO: 191195 - DNA, 25 bp, Mus musculus
aggatgccctttactccttgactat

SEQ ID NO: 191196 - DNA, 25 bp, Mus musculus
aggatgcccttttctccttgactat

SEQ ID NO: 191197 - DNA, 25 bp, Mus musculus
aggatgccgagcagtatctcgctcc

SEQ ID NO: 191198 - DNA, 25 bp, Mus musculus
aggatgccgagctgtatctcgctcc

SEQ ID NO: 191199 - DNA, 25 bp, Mus musculus
aggatgccgcagaccattatctggc

SEQ ID NO: 191200 - DNA, 25 bp, Mus musculus
aggatgccgcagtccattatctggc

SEQ ID NO: 191201 - DNA, 25 bp, Mus musculus
aggatgccgctgaggactctacaac

SEQ ID NO: 191202 - DNA, 25 bp, Mus musculus
aggatgccgctgatgggtcacacga

SEQ ID NO: 191203 - DNA, 25 bp, Mus musculus
aggatgccgctgtggactctacaac

SEQ ID NO: 191204 - DNA, 25 bp, Mus musculus
aggatgccgctgttgggtcacacga

SEQ ID NO: 191205 - DNA, 25 bp, Mus musculus
aggatgccggcgacgagactcctga

SEQ ID NO: 191206 - DNA, 25 bp, Mus musculus
aggatgccggcgtcgagactcctga

SEQ ID NO: 191207 - DNA, 25 bp, Mus musculus
aggatgccgggaactggagtcactt

SEQ ID NO: 191208 - DNA, 25 bp, Mus musculus
aggatgccgggatctggagtcactt

SEQ ID NO: 191209 - DNA, 25 bp, Mus musculus
aggatgccgtgaagcatcatctgct

SEQ ID NO: 191210 - DNA, 25 bp, Mus musculus
aggatgccgtgatgcatcatctgct

SEQ ID NO: 191211 - DNA, 25 bp, Mus musculus
aggatgcctaggagggacctcaagc

SEQ ID NO: 191212 - DNA, 25 bp, Mus musculus
aggatgcctaggtgggacctcaagc

SEQ ID NO: 191213 - DNA, 25 bp, Mus musculus
aggatgcctcctcgaagagcctgga

SEQ ID NO: 191214 - DNA, 25 bp, Mus musculus
aggatgcctcctggaagagcctgga

SEQ ID NO: 191215 - DNA, 25 bp, Mus musculus
aggatgcctcgccttaaagctacag

SEQ ID NO: 191216 - DNA, 25 bp, Mus musculus
aggatgcctcgcgttaaagctacag

SEQ ID NO: 191217 - DNA, 25 bp, Mus musculus
aggatgcctgctcacttgggaacca

SEQ ID NO: 191218 - DNA, 25 bp, Mus musculus
aggatgcctgctgacttgggaacca

SEQ ID NO: 191219 - DNA, 25 bp, Mus musculus
aggatgcctttgctctgtgggtcca

SEQ ID NO: 191220 - DNA, 25 bp, Mus musculus
aggatgcctttggtctgtgggtcca

SEQ ID NO: 191221 - DNA, 25 bp, Mus musculus
aggatgcgaaaccacttctgactca

SEQ ID NO: 191222 - DNA, 25 bp, Mus musculus
aggatgcgaaacgacttctgactca

SEQ ID NO: 191223 - DNA, 25 bp, Mus musculus
aggatgcggaaacctgacggctcca

SEQ ID NO: 191224 - DNA, 25 bp, Mus musculus
aggatgcggaaagctgacggctcca

SEQ ID NO: 191225 - DNA, 25 bp, Mus musculus
aggatgcggcctctgatgttcacaa

SEQ ID NO: 191226 - DNA, 25 bp, Mus musculus
aggatgcggcctgtgatgttcacaa

SEQ ID NO: 191227 - DNA, 25 bp, Mus musculus
aggatgctaagaagaccggcttcaa

SEQ ID NO: 191228 - DNA, 25 bp, Mus musculus
aggatgctaagatgaccggcttcaa

SEQ ID NO: 191229 - DNA, 25 bp, Mus musculus
aggatgctaggcacaaggccctcaa

SEQ ID NO: 191230 - DNA, 25 bp, Mus musculus
aggatgctaggctcaaggccctcaa

SEQ ID NO: 191231 - DNA, 25 bp, Mus musculus
aggatgctagtcaatgttcatggtg

SEQ ID NO: 191232 - DNA, 25 bp, Mus musculus
aggatgctagtctatgttcatggtg

SEQ ID NO: 191233 - DNA, 25 bp, Mus musculus
aggatgctatgcacatgttctaggc

SEQ ID NO: 191234 - DNA, 25 bp, Mus musculus
aggatgctatgctcatgttctaggc

SEQ ID NO: 191235 - DNA, 25 bp, Mus musculus
aggatgctcacaagctcatcgattt

SEQ ID NO: 191236 - DNA, 25 bp, Mus musculus
aggatgctcacatgctcatcgattt

SEQ ID NO: 191237 - DNA, 25 bp, Mus musculus
aggatgctcagaccagcctggcaag

SEQ ID NO: 191238 - DNA, 25 bp, Mus musculus
aggatgctcagagcagcctggcaag

SEQ ID NO: 191239 - DNA, 25 bp, Mus musculus
aggatgctccaaatatgcttatata

SEQ ID NO: 191240 - DNA, 25 bp, Mus musculus
aggatgctccaattatgcttatata

SEQ ID NO: 191241 - DNA, 25 bp, Mus musculus
aggatgctccatatgttcacctcat

SEQ ID NO: 191242 - DNA, 25 bp, Mus musculus
aggatgctccatttgttcacctcat

SEQ ID NO: 191243 - DNA, 25 bp, Mus musculus
aggatgctcccgacagaggtactgc

SEQ ID NO: 191244 - DNA, 25 bp, Mus musculus
aggatgctcccgtcagaggtactgc

SEQ ID NO: 191245 - DNA, 25 bp, Mus musculus
aggatgctctgcaccacactgggct

SEQ ID NO: 191246 - DNA, 25 bp, Mus musculus
aggatgctctgctccacactgggct

SEQ ID NO: 191247 - DNA, 25 bp, Mus musculus
aggatgctcttgactctctcggtga

SEQ ID NO: 191248 - DNA, 25 bp, Mus musculus
aggatgctcttgtctctctcggtga

SEQ ID NO: 191249 - DNA, 25 bp, Mus musculus
aggatgctgaaaatgcaaggctgat

SEQ ID NO: 191250 - DNA, 25 bp, Mus musculus
aggatgctgaaattgcaaggctgat

SEQ ID NO: 191251 - DNA, 25 bp, Mus musculus
aggatgctgaacaaacctctctcca

SEQ ID NO: 191252 - DNA, 25 bp, Mus musculus
aggatgctgaactaacctctctcca

SEQ ID NO: 191253 - DNA, 25 bp, Mus musculus
aggatgctgaagactgacctgaccc

SEQ ID NO: 191254 - DNA, 25 bp, Mus musculus
aggatgctgaagtctgacctgaccc

SEQ ID NO: 191255 - DNA, 25 bp, Mus musculus
aggatgctgacgagtaaggaacgga

SEQ ID NO: 191256 - DNA, 25 bp, Mus musculus
aggatgctgacgtgtaaggaacgga

SEQ ID NO: 191257 - DNA, 25 bp, Mus musculus
aggatgctgcccagtacccaaacca

SEQ ID NO: 191258 - DNA, 25 bp, Mus musculus
aggatgctgccctgtacccaaacca

SEQ ID NO: 191259 - DNA, 25 bp, Mus musculus
aggatgctgcctaaagaattgcatg

SEQ ID NO: 191260 - DNA, 25 bp, Mus musculus
aggatgctgccttaagaattgcatg

SEQ ID NO: 191261 - DNA, 25 bp, Mus musculus
aggatgctgctaagctgggctcctc

SEQ ID NO: 191262 - DNA, 25 bp, Mus musculus
aggatgctgctatgctgggctcctc

SEQ ID NO: 191263 - DNA, 25 bp, Mus musculus
aggatgctggaactcctctggcctc

SEQ ID NO: 191264 - DNA, 25 bp, Mus musculus
aggatgctggaagtcctctggcctc

SEQ ID NO: 191265 - DNA, 25 bp, Mus musculus
aggatgctggcaactcccagagaga

SEQ ID NO: 191266 - DNA, 25 bp, Mus musculus
aggatgctggcatctcccagagaga

SEQ ID NO: 191267 - DNA, 25 bp, Mus musculus
aggatgctgggtacgctgtagacta

SEQ ID NO: 191268 - DNA, 25 bp, Mus musculus
aggatgctgggttcgctgtagacta

SEQ ID NO: 191269 - DNA, 25 bp, Mus musculus
aggatgctggtcctcagttgacttt

SEQ ID NO: 191270 - DNA, 25 bp, Mus musculus
aggatgctggtcgtcagttgacttt

SEQ ID NO: 191271 - DNA, 25 bp, Mus musculus
aggatgctgtcccaagagaccaagc

SEQ ID NO: 191272 - DNA, 25 bp, Mus musculus
aggatgctgtcccaatacacacaaa

SEQ ID NO: 191273 - DNA, 25 bp, Mus musculus
aggatgctgtccctgaaaccttagg

SEQ ID NO: 191274 - DNA, 25 bp, Mus musculus
aggatgctgtccgaagagaccaagc

SEQ ID NO: 191275 - DNA, 25 bp, Mus musculus
aggatgctgtccgaatacacacaaa

SEQ ID NO: 191276 - DNA, 25 bp, Mus musculus
aggatgctgtccgtgaaaccttagg

SEQ ID NO: 191277 - DNA, 25 bp, Mus musculus
aggatgctgtgcctcaaacccaggg

SEQ ID NO: 191278 - DNA, 25 bp, Mus musculus
aggatgctgtgcgtcaaacccaggg

SEQ ID NO: 191279 - DNA, 25 bp, Mus musculus
aggatgctgtggctctcatattgaa

SEQ ID NO: 191280 - DNA, 25 bp, Mus musculus
aggatgctgtgggtctcatattgaa

SEQ ID NO: 191281 - DNA, 25 bp, Mus musculus
aggatgcttaggaatccccggtaca

SEQ ID NO: 191282 - DNA, 25 bp, Mus musculus
aggatgcttaggtatccccggtaca

SEQ ID NO: 191283 - DNA, 25 bp, Mus musculus
aggatgcttcatacccagtgctaat

SEQ ID NO: 191284 - DNA, 25 bp, Mus musculus
aggatgcttcatcttccgggcatcg

SEQ ID NO: 191285 - DNA, 25 bp, Mus musculus
aggatgcttcatgttccgggcatcg

SEQ ID NO: 191286 - DNA, 25 bp, Mus musculus
aggatgcttcattcccagtgctaat

SEQ ID NO: 191287 - DNA, 25 bp, Mus musculus
aggatgcttcccactgagcttccca

SEQ ID NO: 191288 - DNA, 25 bp, Mus musculus
aggatgcttccctctgagcttccca

SEQ ID NO: 191289 - DNA, 25 bp, Mus musculus
aggatgcttgcgacgtctgtggacc

SEQ ID NO: 191290 - DNA, 25 bp, Mus musculus
aggatgcttgcgtcgtctgtggacc

SEQ ID NO: 191291 - DNA, 25 bp, Mus musculus
aggatgctttgacaaggtccccaag

SEQ ID NO: 191292 - DNA, 25 bp, Mus musculus
aggatgctttgagaaggtccccaag

SEQ ID NO: 191293 - DNA, 25 bp, Mus musculus
aggatgcttttaaacacaacttgga

SEQ ID NO: 191294 - DNA, 25 bp, Mus musculus
aggatgcttttatacacaacttgga

SEQ ID NO: 191295 - DNA, 25 bp, Mus musculus
aggatggaaagccttactctcccag

SEQ ID NO: 191296 - DNA, 25 bp, Mus musculus
aggatggaaagcgttactctcccag

SEQ ID NO: 191297 - DNA, 25 bp, Mus musculus
aggatggaaaggacccctgcaaaca

SEQ ID NO: 191298 - DNA, 25 bp, Mus musculus
aggatggaaaggactgtagtagcaa

SEQ ID NO: 191299 - DNA, 25 bp, Mus musculus
aggatggaaaggtcccctgcaaaca

SEQ ID NO: 191300 - DNA, 25 bp, Mus musculus
aggatggaaaggtctgtagtagcaa

SEQ ID NO: 191301 - DNA, 25 bp, Mus musculus
aggatggaattaagacactgtcaac

SEQ ID NO: 191302 - DNA, 25 bp, Mus musculus
aggatggaattatgacactgtcaac

SEQ ID NO: 191303 - DNA, 25 bp, Mus musculus
aggatggacagaaggccacgccctc

SEQ ID NO: 191304 - DNA, 25 bp, Mus musculus
aggatggacagatggccacgccctc

SEQ ID NO: 191305 - DNA, 25 bp, Mus musculus
aggatggaccccaggagggccttat

SEQ ID NO: 191306 - DNA, 25 bp, Mus musculus
aggatggacccctggagggccttat

SEQ ID NO: 191307 - DNA, 25 bp, Mus musculus
aggatggacgagacttcaccccagg

SEQ ID NO: 191308 - DNA, 25 bp, Mus musculus
aggatggacgagcaccccgtttgtt

SEQ ID NO: 191309 - DNA, 25 bp, Mus musculus
aggatggacgaggaccccgtttgtt

SEQ ID NO: 191310 - DNA, 25 bp, Mus musculus
aggatggacgagtcttcaccccagg

SEQ ID NO: 191311 - DNA, 25 bp, Mus musculus
aggatggactgccacaacgggacct

SEQ ID NO: 191312 - DNA, 25 bp, Mus musculus
aggatggactgcgacaacgggacct

SEQ ID NO: 191313 - DNA, 25 bp, Mus musculus
aggatggagaccattgaccctaaca

SEQ ID NO: 191314 - DNA, 25 bp, Mus musculus
aggatggagacctttgaccctaaca

SEQ ID NO: 191315 - DNA, 25 bp, Mus musculus
aggatggagccaccattctaacctg

SEQ ID NO: 191316 - DNA, 25 bp, Mus musculus
aggatggagccagcattctaacctg

SEQ ID NO: 191317 - DNA, 25 bp, Mus musculus
aggatggagcctattctgagctagt

SEQ ID NO: 191318 - DNA, 25 bp, Mus musculus
aggatggagccttttctgagctagt

SEQ ID NO: 191319 - DNA, 25 bp, Mus musculus
aggatggaggccagtcaccagtcca

SEQ ID NO: 191320 - DNA, 25 bp, Mus musculus
aggatggaggcctgtcaccagtcca

SEQ ID NO: 191321 - DNA, 25 bp, Mus musculus
aggatggagggcacagcacccagat

SEQ ID NO: 191322 - DNA, 25 bp, Mus musculus
aggatggagggctcagcacccagat

SEQ ID NO: 191323 - DNA, 25 bp, Mus musculus
aggatggagtccaaatcccacatct

SEQ ID NO: 191324 - DNA, 25 bp, Mus musculus
aggatggagtcctaatcccacatct

SEQ ID NO: 191325 - DNA, 25 bp, Mus musculus
aggatggagtctatactgcttcttc

SEQ ID NO: 191326 - DNA, 25 bp, Mus musculus
aggatggagtctttactgcttcttc

SEQ ID NO: 191327 - DNA, 25 bp, Mus musculus
aggatggatctcaatcatgctctcc

SEQ ID NO: 191328 - DNA, 25 bp, Mus musculus
aggatggatctctatcatgctctcc

SEQ ID NO: 191329 - DNA, 25 bp, Mus musculus
aggatggcaaacacctcctggatgc

SEQ ID NO: 191330 - DNA, 25 bp, Mus musculus
aggatggcaaactcctcctggatgc

SEQ ID NO: 191331 - DNA, 25 bp, Mus musculus
aggatggcaaatatgtcttcttcaa

SEQ ID NO: 191332 - DNA, 25 bp, Mus musculus
aggatggcaaatttgtcttcttcaa

SEQ ID NO: 191333 - DNA, 25 bp, Mus musculus
aggatggcacaacttctggatctct

SEQ ID NO: 191334 - DNA, 25 bp, Mus musculus
aggatggcacaagttctggatctct

SEQ ID NO: 191335 - DNA, 25 bp, Mus musculus
aggatggcacagaacctctggcatc

SEQ ID NO: 191336 - DNA, 25 bp, Mus musculus
aggatggcacagtacctctggcatc

SEQ ID NO: 191337 - DNA, 25 bp, Mus musculus
aggatggcagctcaggagttactac

SEQ ID NO: 191338 - DNA, 25 bp, Mus musculus
aggatggcagctgaggagttactac

SEQ ID NO: 191339 - DNA, 25 bp, Mus musculus
aggatggcagtacttttctcagcat

SEQ ID NO: 191340 - DNA, 25 bp, Mus musculus
aggatggcagtagttttctcagcat

SEQ ID NO: 191341 - DNA, 25 bp, Mus musculus
aggatggcatgcaccagggcacctt

SEQ ID NO: 191342 - DNA, 25 bp, Mus musculus
aggatggcatgctccagggcacctt

SEQ ID NO: 191343 - DNA, 25 bp, Mus musculus
aggatggcatgtaggctgctctgac

SEQ ID NO: 191344 - DNA, 25 bp, Mus musculus
aggatggcatgttggctgctctgac

SEQ ID NO: 191345 - DNA, 25 bp, Mus musculus
aggatggccaagacttagccccagg

SEQ ID NO: 191346 - DNA, 25 bp, Mus musculus
aggatggccaagagacaatcggtca

SEQ ID NO: 191347 - DNA, 25 bp, Mus musculus
aggatggccaagtcttagccccagg

SEQ ID NO: 191348 - DNA, 25 bp, Mus musculus
aggatggccaagtgacaatcggtca

SEQ ID NO: 191349 - DNA, 25 bp, Mus musculus
aggatggccacaccctgtctgatta

SEQ ID NO: 191350 - DNA, 25 bp, Mus musculus
aggatggccacagcctgtctgatta

SEQ ID NO: 191351 - DNA, 25 bp, Mus musculus
aggatggccagaacttcagctcagc

SEQ ID NO: 191352 - DNA, 25 bp, Mus musculus
aggatggccagatcttcagctcagc

SEQ ID NO: 191353 - DNA, 25 bp, Mus musculus
aggatggccatcactagtacacctg

SEQ ID NO: 191354 - DNA, 25 bp, Mus musculus
aggatggccatctctagtacacctg

SEQ ID NO: 191355 - DNA, 25 bp, Mus musculus
aggatggcccttctccagtgcctgg

SEQ ID NO: 191356 - DNA, 25 bp, Mus musculus
aggatggcccttgtccagtgcctgg

SEQ ID NO: 191357 - DNA, 25 bp, Mus musculus
aggatggcctatactctgtatttat

SEQ ID NO: 191358 - DNA, 25 bp, Mus musculus
aggatggcctattctctgtatttat

SEQ ID NO: 191359 - DNA, 25 bp, Mus musculus
aggatggcctttctcttatttacca

SEQ ID NO: 191360 - DNA, 25 bp, Mus musculus
aggatggcctttgtcttatttacca

SEQ ID NO: 191361 - DNA, 25 bp, Mus musculus
aggatggcgacacacctgggccaca

SEQ ID NO: 191362 - DNA, 25 bp, Mus musculus
aggatggcgacagacctgggccaca

SEQ ID NO: 191363 - DNA, 25 bp, Mus musculus
aggatggctcagattgtactatgat

SEQ ID NO: 191364 - DNA, 25 bp, Mus musculus
aggatggctcagtttgtactatgat

SEQ ID NO: 191365 - DNA, 25 bp, Mus musculus
aggatggctctgaaccgtggcccta

SEQ ID NO: 191366 - DNA, 25 bp, Mus musculus
aggatggctctgtaccgtggcccta

SEQ ID NO: 191367 - DNA, 25 bp, Mus musculus
aggatggctgacatgttgtttgttt

SEQ ID NO: 191368 - DNA, 25 bp, Mus musculus
aggatggctgacttgttgtttgttt

SEQ ID NO: 191369 - DNA, 25 bp, Mus musculus
aggatggctgctaggctcacgtttc

SEQ ID NO: 191370 - DNA, 25 bp, Mus musculus
aggatggctgcttggctcacgtttc

SEQ ID NO: 191371 - DNA, 25 bp, Mus musculus
aggatggcttcccagagtcttctgg

SEQ ID NO: 191372 - DNA, 25 bp, Mus musculus
aggatggcttccgagagtcttctgg

SEQ ID NO: 191373 - DNA, 25 bp, Mus musculus
aggatgggacagctctcctcagact

SEQ ID NO: 191374 - DNA, 25 bp, Mus musculus
aggatgggacaggtctcctcagact

SEQ ID NO: 191375 - DNA, 25 bp, Mus musculus
aggatgggcacacttctaagcaagt

SEQ ID NO: 191376 - DNA, 25 bp, Mus musculus
aggatgggcacagttctaagcaagt

SEQ ID NO: 191377 - DNA, 25 bp, Mus musculus
aggatgggctacacaatactgcaga

SEQ ID NO: 191378 - DNA, 25 bp, Mus musculus
aggatgggctactcaatactgcaga

SEQ ID NO: 191379 - DNA, 25 bp, Mus musculus
aggatgggtgtcacagcatttgccc

SEQ ID NO: 191380 - DNA, 25 bp, Mus musculus
aggatgggtgtctcagcatttgccc

SEQ ID NO: 191381 - DNA, 25 bp, Mus musculus
aggatggtactcagccatggcacaa

SEQ ID NO: 191382 - DNA, 25 bp, Mus musculus
aggatggtactctgccatggcacaa

SEQ ID NO: 191383 - DNA, 25 bp, Mus musculus
aggatggtcacgagcctctgcttgc

SEQ ID NO: 191384 - DNA, 25 bp, Mus musculus
aggatggtcacgtgcctctgcttgc

SEQ ID NO: 191385 - DNA, 25 bp, Mus musculus
aggatggtcagcatgtctggcttcc

SEQ ID NO: 191386 - DNA, 25 bp, Mus musculus
aggatggtcagcttgtctggcttcc

SEQ ID NO: 191387 - DNA, 25 bp, Mus musculus
aggatggtccccagaaactccgagg

SEQ ID NO: 191388 - DNA, 25 bp, Mus musculus
aggatggtcccctgaaactccgagg

SEQ ID NO: 191389 - DNA, 25 bp, Mus musculus
aggatggtcgcgaccatgccctgag

SEQ ID NO: 191390 - DNA, 25 bp, Mus musculus
aggatggtcgcgtccatgccctgag

SEQ ID NO: 191391 - DNA, 25 bp, Mus musculus
aggatggtctagagcaacctcccca

SEQ ID NO: 191392 - DNA, 25 bp, Mus musculus
aggatggtctagtgcaacctcccca

SEQ ID NO: 191393 - DNA, 25 bp, Mus musculus
aggatggtctgaccctgcagaacca

SEQ ID NO: 191394 - DNA, 25 bp, Mus musculus
aggatggtctgagcctgcagaacca

SEQ ID NO: 191395 - DNA, 25 bp, Mus musculus
aggatggtgacaccgattcccacag

SEQ ID NO: 191396 - DNA, 25 bp, Mus musculus
aggatggtgacacgcaggtcccctt

SEQ ID NO: 191397 - DNA, 25 bp, Mus musculus
aggatggtgacagcgattcccacag

SEQ ID NO: 191398 - DNA, 25 bp, Mus musculus
aggatggtgacaggcaggtcccctt

SEQ ID NO: 191399 - DNA, 25 bp, Mus musculus
aggatggtgagacccctgaagatcc

SEQ ID NO: 191400 - DNA, 25 bp, Mus musculus
aggatggtgagagccctgaagatcc

SEQ ID NO: 191401 - DNA, 25 bp, Mus musculus
aggatggtgagtatctatccaaccc

SEQ ID NO: 191402 - DNA, 25 bp, Mus musculus
aggatggtgagtttctatccaaccc

SEQ ID NO: 191403 - DNA, 25 bp, Mus musculus
aggatggtgctcatgtctccagcga

SEQ ID NO: 191404 - DNA, 25 bp, Mus musculus
aggatggtgctccaatatacttccc

SEQ ID NO: 191405 - DNA, 25 bp, Mus musculus
aggatggtgctcgaatatacttccc

SEQ ID NO: 191406 - DNA, 25 bp, Mus musculus
aggatggtgctcttgtctccagcga

SEQ ID NO: 191407 - DNA, 25 bp, Mus musculus
aggatggtggacacctctgcctgct

SEQ ID NO: 191408 - DNA, 25 bp, Mus musculus
aggatggtggactcctctgcctgct

SEQ ID NO: 191409 - DNA, 25 bp, Mus musculus
aggatggttgacagcatcattatgg

SEQ ID NO: 191410 - DNA, 25 bp, Mus musculus
aggatggttgactgcatcattatgg

SEQ ID NO: 191411 - DNA, 25 bp, Mus musculus
aggatggtttgcagttctctctttc

SEQ ID NO: 191412 - DNA, 25 bp, Mus musculus
aggatggtttgctgttctctctttc

SEQ ID NO: 191413 - DNA, 25 bp, Mus musculus
aggatgtacaggctctagcttctac

SEQ ID NO: 191414 - DNA, 25 bp, Mus musculus
aggatgtacagggtctagcttctac

SEQ ID NO: 191415 - DNA, 25 bp, Mus musculus
aggatgtactttctctggactgctc

SEQ ID NO: 191416 - DNA, 25 bp, Mus musculus
aggatgtactttgtctggactgctc

SEQ ID NO: 191417 - DNA, 25 bp, Mus musculus
aggatgtaggcaaggtgactttctt

SEQ ID NO: 191418 - DNA, 25 bp, Mus musculus
aggatgtaggcatggtgactttctt

SEQ ID NO: 191419 - DNA, 25 bp, Mus musculus
aggatgtatgacaatctccgtgccc

SEQ ID NO: 191420 - DNA, 25 bp, Mus musculus
aggatgtatgactatctccgtgccc

SEQ ID NO: 191421 - DNA, 25 bp, Mus musculus
aggatgtcacccctaagctagcttg

SEQ ID NO: 191422 - DNA, 25 bp, Mus musculus
aggatgtcacccgtaagctagcttg

SEQ ID NO: 191423 - DNA, 25 bp, Mus musculus
aggatgtcagccaggtcctagcagc

SEQ ID NO: 191424 - DNA, 25 bp, Mus musculus
aggatgtcagcctggtcctagcagc

SEQ ID NO: 191425 - DNA, 25 bp, Mus musculus
aggatgtcagtactccccaaagcat

SEQ ID NO: 191426 - DNA, 25 bp, Mus musculus
aggatgtcagtagtccccaaagcat

SEQ ID NO: 191427 - DNA, 25 bp, Mus musculus
aggatgtcctaacttcaggatggaa

SEQ ID NO: 191428 - DNA, 25 bp, Mus musculus
aggatgtcctaagttcaggatggaa

SEQ ID NO: 191429 - DNA, 25 bp, Mus musculus
aggatgtctccgagtggcttcgtgc

SEQ ID NO: 191430 - DNA, 25 bp, Mus musculus
aggatgtctccgtgtggcttcgtgc

SEQ ID NO: 191431 - DNA, 25 bp, Mus musculus
aggatgtctgtgactctaccctctg

SEQ ID NO: 191432 - DNA, 25 bp, Mus musculus
aggatgtctgtgtctctaccctctg

SEQ ID NO: 191433 - DNA, 25 bp, Mus musculus
aggatgtcttaaaagatgtcaccac

SEQ ID NO: 191434 - DNA, 25 bp, Mus musculus
aggatgtcttaatagatgtcaccac

SEQ ID NO: 191435 - DNA, 25 bp, Mus musculus
aggatgtctttaactgcttctcagc

SEQ ID NO: 191436 - DNA, 25 bp, Mus musculus
aggatgtctttatctgcttctcagc

SEQ ID NO: 191437 - DNA, 25 bp, Mus musculus
aggatgtgcaagacttccaggctac

SEQ ID NO: 191438 - DNA, 25 bp, Mus musculus
aggatgtgcaagtcttccaggctac

SEQ ID NO: 191439 - DNA, 25 bp, Mus musculus
aggatgtgcctcagtatgcagcaga

SEQ ID NO: 191440 - DNA, 25 bp, Mus musculus
aggatgtgcctctgtatgcagcaga

SEQ ID NO: 191441 - DNA, 25 bp, Mus musculus
aggatgtgctccaggccatgatcat

SEQ ID NO: 191442 - DNA, 25 bp, Mus musculus
aggatgtgctcctggccatgatcat

SEQ ID NO: 191443 - DNA, 25 bp, Mus musculus
aggatgtgcttcagagacctcatgt

SEQ ID NO: 191444 - DNA, 25 bp, Mus musculus
aggatgtgcttctgagacctcatgt

SEQ ID NO: 191445 - DNA, 25 bp, Mus musculus
aggatgtggccacccgtcagacagc

SEQ ID NO: 191446 - DNA, 25 bp, Mus musculus
aggatgtggccagccgtcagacagc

SEQ ID NO: 191447 - DNA, 25 bp, Mus musculus
aggatgtggcccaggaatgaacttt

SEQ ID NO: 191448 - DNA, 25 bp, Mus musculus
aggatgtggccctggaatgaacttt

SEQ ID NO: 191449 - DNA, 25 bp, Mus musculus
aggatgtgggcaatcagctccgacg

SEQ ID NO: 191450 - DNA, 25 bp, Mus musculus
aggatgtgggcattcagctccgacg

SEQ ID NO: 191451 - DNA, 25 bp, Mus musculus
aggatgtgtagcatggacaccccac

SEQ ID NO: 191452 - DNA, 25 bp, Mus musculus
aggatgtgtagcttggacaccccac

SEQ ID NO: 191453 - DNA, 25 bp, Mus musculus
aggatgtgtcccatctccatggcaa

SEQ ID NO: 191454 - DNA, 25 bp, Mus musculus
aggatgtgtcccttctccatggcaa

SEQ ID NO: 191455 - DNA, 25 bp, Mus musculus
aggatgtgtgctatactgagtatta

SEQ ID NO: 191456 - DNA, 25 bp, Mus musculus
aggatgtgtgctttactgagtatta

SEQ ID NO: 191457 - DNA, 25 bp, Mus musculus
aggatgtgttctctgtacccagcct

SEQ ID NO: 191458 - DNA, 25 bp, Mus musculus
aggatgtgttctgtgtacccagcct

SEQ ID NO: 191459 - DNA, 25 bp, Mus musculus
aggatgttagagatcgaccctgctc

SEQ ID NO: 191460 - DNA, 25 bp, Mus musculus
aggatgttagagttcgaccctgctc

SEQ ID NO: 191461 - DNA, 25 bp, Mus musculus
aggatgttcattcaggacctgcata

SEQ ID NO: 191462 - DNA, 25 bp, Mus musculus
aggatgttcattgaggacctgcata

SEQ ID NO: 191463 - DNA, 25 bp, Mus musculus
aggatgttcttgctctccaaagccc

SEQ ID NO: 191464 - DNA, 25 bp, Mus musculus
aggatgttcttggtctccaaagccc

SEQ ID NO: 191465 - DNA, 25 bp, Mus musculus
aggatgttgcatattgtgtgaccgt

SEQ ID NO: 191466 - DNA, 25 bp, Mus musculus
aggatgttgcattttgtgtgaccgt

SEQ ID NO: 191467 - DNA, 25 bp, Mus musculus
aggatgttgcttattatacccaaat

SEQ ID NO: 191468 - DNA, 25 bp, Mus musculus
aggatgttgctttttatacccaaat

SEQ ID NO: 191469 - DNA, 25 bp, Mus musculus
aggatgttgtacagtgtgtgtgcat

SEQ ID NO: 191470 - DNA, 25 bp, Mus musculus
aggatgttgtactgtgtgtgtgcat

SEQ ID NO: 191471 - DNA, 25 bp, Mus musculus
aggatgtttaccctattggcaaatt

SEQ ID NO: 191472 - DNA, 25 bp, Mus musculus
aggatgtttaccgtattggcaaatt

SEQ ID NO: 191473 - DNA, 25 bp, Mus musculus
aggatgtttcttcgcttcaaaccat

SEQ ID NO: 191474 - DNA, 25 bp, Mus musculus
aggatgtttcttggcttcaaaccat

SEQ ID NO: 191475 - DNA, 25 bp, Mus musculus
aggatgtttgctatccggacggaag

SEQ ID NO: 191476 - DNA, 25 bp, Mus musculus
aggatgtttgctttccggacggaag

SEQ ID NO: 191477 - DNA, 25 bp, Mus musculus
aggatgttttgaaatctcgtcacaa

SEQ ID NO: 191478 - DNA, 25 bp, Mus musculus
aggatgttttgatatctcgtcacaa

SEQ ID NO: 191479 - DNA, 25 bp, Mus musculus
aggattaaacctcaggccttgcacg

SEQ ID NO: 191480 - DNA, 25 bp, Mus musculus
aggattaaacctgaggccttgcacg

SEQ ID NO: 191481 - DNA, 25 bp, Mus musculus
aggattaaagacctggagtcccagc

SEQ ID NO: 191482 - DNA, 25 bp, Mus musculus
aggattaaagacgtggagtcccagc

SEQ ID NO: 191483 - DNA, 25 bp, Mus musculus
aggattaacactctttcctttctgg

SEQ ID NO: 191484 - DNA, 25 bp, Mus musculus
aggattaacactgtttcctttctgg

SEQ ID NO: 191485 - DNA, 25 bp, Mus musculus
aggattaaggctcctttctcctcct

SEQ ID NO: 191486 - DNA, 25 bp, Mus musculus
aggattaaggctgctttctcctcct

SEQ ID NO: 191487 - DNA, 25 bp, Mus musculus
aggattaatggaatctcagaggtga

SEQ ID NO: 191488 - DNA, 25 bp, Mus musculus
aggattaatggattctcagaggtga

SEQ ID NO: 191489 - DNA, 25 bp, Mus musculus
aggattaatgttcctgtcctctcca

SEQ ID NO: 191490 - DNA, 25 bp, Mus musculus
aggattaatgttgctgtcctctcca

SEQ ID NO: 191491 - DNA, 25 bp, Mus musculus
aggattaattaaaacttggctgaac

SEQ ID NO: 191492 - DNA, 25 bp, Mus musculus
aggattaattaatacttggctgaac

SEQ ID NO: 191493 - DNA, 25 bp, Mus musculus
aggattacaacaactatggctgcta

SEQ ID NO: 191494 - DNA, 25 bp, Mus musculus
aggattacaacacccatctcatgcc

SEQ ID NO: 191495 - DNA, 25 bp, Mus musculus
aggattacaacagccatctcatgcc

SEQ ID NO: 191496 - DNA, 25 bp, Mus musculus
aggattacaacatctatggctgcta

SEQ ID NO: 191497 - DNA, 25 bp, Mus musculus
aggattactgatacgtctgcaagag

SEQ ID NO: 191498 - DNA, 25 bp, Mus musculus
aggattactgattcgtctgcaagag

SEQ ID NO: 191499 - DNA, 25 bp, Mus musculus
aggattagaacgcacctgcttggtg

SEQ ID NO: 191500 - DNA, 25 bp, Mus musculus
aggattagaacggacctgcttggtg

SEQ ID NO: 191501 - DNA, 25 bp, Mus musculus
aggattagatatccctctggccagc

SEQ ID NO: 191502 - DNA, 25 bp, Mus musculus
aggattagatatgcctctggccagc

SEQ ID NO: 191503 - DNA, 25 bp, Mus musculus
aggattagggccacaacatcccagc

SEQ ID NO: 191504 - DNA, 25 bp, Mus musculus
aggattagggcctcaacatcccagc

SEQ ID NO: 191505 - DNA, 25 bp, Mus musculus
aggattagggtcctgctctccctga

SEQ ID NO: 191506 - DNA, 25 bp, Mus musculus
aggattagggtcgtgctctccctga

SEQ ID NO: 191507 - DNA, 25 bp, Mus musculus
aggattataacacaggcgaccggtt

SEQ ID NO: 191508 - DNA, 25 bp, Mus musculus
aggattataacagaggcgaccggtt

SEQ ID NO: 191509 - DNA, 25 bp, Mus musculus
aggattataatcattccgtcacaat

SEQ ID NO: 191510 - DNA, 25 bp, Mus musculus
aggattataatctttccgtcacaat

SEQ ID NO: 191511 - DNA, 25 bp, Mus musculus
aggattatccatcttgctaatagcc

SEQ ID NO: 191512 - DNA, 25 bp, Mus musculus
aggattatccatgttgctaatagcc

SEQ ID NO: 191513 - DNA, 25 bp, Mus musculus
aggattatcccaagaggcacgcact

SEQ ID NO: 191514 - DNA, 25 bp, Mus musculus
aggattatcccaccttgttacctca

SEQ ID NO: 191515 - DNA, 25 bp, Mus musculus
aggattatcccagcttgttacctca

SEQ ID NO: 191516 - DNA, 25 bp, Mus musculus
aggattatcccatgaggcacgcact

SEQ ID NO: 191517 - DNA, 25 bp, Mus musculus
aggattatgactcctagcgccctgt

SEQ ID NO: 191518 - DNA, 25 bp, Mus musculus
aggattatgactgctagcgccctgt

SEQ ID NO: 191519 - DNA, 25 bp, Mus musculus
aggattatggtgctctgctgctctt

SEQ ID NO: 191520 - DNA, 25 bp, Mus musculus
aggattatggtggtctgctgctctt

SEQ ID NO: 191521 - DNA, 25 bp, Mus musculus
aggattatgtccagagaacagctct

SEQ ID NO: 191522 - DNA, 25 bp, Mus musculus
aggattatgtcctgagaacagctct

SEQ ID NO: 191523 - DNA, 25 bp, Mus musculus
aggattatgttcagcacgcccaggt

SEQ ID NO: 191524 - DNA, 25 bp, Mus musculus
aggattatgttctgcacgcccaggt

SEQ ID NO: 191525 - DNA, 25 bp, Mus musculus
aggattattctgaatgctgtatata

SEQ ID NO: 191526 - DNA, 25 bp, Mus musculus
aggattattctgtatgctgtatata

SEQ ID NO: 191527 - DNA, 25 bp, Mus musculus
aggattcaacctagtgtactggata

SEQ ID NO: 191528 - DNA, 25 bp, Mus musculus
aggattcaacctccacttctgactg

SEQ ID NO: 191529 - DNA, 25 bp, Mus musculus
aggattcaacctgcacttctgactg

SEQ ID NO: 191530 - DNA, 25 bp, Mus musculus
aggattcaaccttgtgtactggata

SEQ ID NO: 191531 - DNA, 25 bp, Mus musculus
aggattcaatcacttctagtctagt

SEQ ID NO: 191532 - DNA, 25 bp, Mus musculus
aggattcaatcagttctagtctagt

SEQ ID NO: 191533 - DNA, 25 bp, Mus musculus
aggattcaatcccatctttttccct

SEQ ID NO: 191534 - DNA, 25 bp, Mus musculus
aggattcaatccgatctttttccct

SEQ ID NO: 191535 - DNA, 25 bp, Mus musculus
aggattcacaccactgaagggctca

SEQ ID NO: 191536 - DNA, 25 bp, Mus musculus
aggattcacacctctgaagggctca

SEQ ID NO: 191537 - DNA, 25 bp, Mus musculus
aggattcacatcacattggttaaac

SEQ ID NO: 191538 - DNA, 25 bp, Mus musculus
aggattcacatctcattggttaaac

SEQ ID NO: 191539 - DNA, 25 bp, Mus musculus
aggattcactgaactacagttttga

SEQ ID NO: 191540 - DNA, 25 bp, Mus musculus
aggattcactgatctacagttttga

SEQ ID NO: 191541 - DNA, 25 bp, Mus musculus
aggattcactgcagaccgtttactt

SEQ ID NO: 191542 - DNA, 25 bp, Mus musculus
aggattcactgctgaccgtttactt

SEQ ID NO: 191543 - DNA, 25 bp, Mus musculus
aggattcagaaacctccctgtagct

SEQ ID NO: 191544 - DNA, 25 bp, Mus musculus
aggattcagaaagctccctgtagct

SEQ ID NO: 191545 - DNA, 25 bp, Mus musculus
aggattcagctcacatcagaaaccc

SEQ ID NO: 191546 - DNA, 25 bp, Mus musculus
aggattcagctctcatcagaaaccc

SEQ ID NO: 191547 - DNA, 25 bp, Mus musculus
aggattcaggctatacctctagata

SEQ ID NO: 191548 - DNA, 25 bp, Mus musculus
aggattcaggctttacctctagata

SEQ ID NO: 191549 - DNA, 25 bp, Mus musculus
aggattcagtccaccagtcattaac

SEQ ID NO: 191550 - DNA, 25 bp, Mus musculus
aggattcagtcctccagtcattaac

SEQ ID NO: 191551 - DNA, 25 bp, Mus musculus
aggattcatggaacttctctggcta

SEQ ID NO: 191552 - DNA, 25 bp, Mus musculus
aggattcatggatcttctctggcta

SEQ ID NO: 191553 - DNA, 25 bp, Mus musculus
aggattccaacacagtgctactgcc

SEQ ID NO: 191554 - DNA, 25 bp, Mus musculus
aggattccaacagagtgctactgcc

SEQ ID NO: 191555 - DNA, 25 bp, Mus musculus
aggattccaagcagaaccccagaac

SEQ ID NO: 191556 - DNA, 25 bp, Mus musculus
aggattccaagctgaaccccagaac

SEQ ID NO: 191557 - DNA, 25 bp, Mus musculus
aggattccacaaaacttcaaagctc

SEQ ID NO: 191558 - DNA, 25 bp, Mus musculus
aggattccacaaactgtcctgcatg

SEQ ID NO: 191559 - DNA, 25 bp, Mus musculus
aggattccacaatacttcaaagctc

SEQ ID NO: 191560 - DNA, 25 bp, Mus musculus
aggattccacaatctgtcctgcatg

SEQ ID NO: 191561 - DNA, 25 bp, Mus musculus
aggattccacgtaagtgctcatgtg

SEQ ID NO: 191562 - DNA, 25 bp, Mus musculus
aggattccacgttagtgctcatgtg

SEQ ID NO: 191563 - DNA, 25 bp, Mus musculus
aggattccaggcatacaccactata

SEQ ID NO: 191564 - DNA, 25 bp, Mus musculus
aggattccaggcttacaccactata

SEQ ID NO: 191565 - DNA, 25 bp, Mus musculus
aggattccatatagagtcgcgtaca

SEQ ID NO: 191566 - DNA, 25 bp, Mus musculus
aggattccatattgagtcgcgtaca

SEQ ID NO: 191567 - DNA, 25 bp, Mus musculus
aggattccctccagagctggtcatg

SEQ ID NO: 191568 - DNA, 25 bp, Mus musculus
aggattccctcctgagctggtcatg

SEQ ID NO: 191569 - DNA, 25 bp, Mus musculus
aggattccgaagacctcacaggcac

SEQ ID NO: 191570 - DNA, 25 bp, Mus musculus
aggattccgaagtcctcacaggcac

SEQ ID NO: 191571 - DNA, 25 bp, Mus musculus
aggattccgattagacttcactctt

SEQ ID NO: 191572 - DNA, 25 bp, Mus musculus
aggattccgatttgacttcactctt

SEQ ID NO: 191573 - DNA, 25 bp, Mus musculus
aggattcctaatcgcactagaacta

SEQ ID NO: 191574 - DNA, 25 bp, Mus musculus
aggattcctaatggcactagaacta

SEQ ID NO: 191575 - DNA, 25 bp, Mus musculus
aggattcctattactgacaccagtt

SEQ ID NO: 191576 - DNA, 25 bp, Mus musculus
aggattcctatttctgacaccagtt

SEQ ID NO: 191577 - DNA, 25 bp, Mus musculus
aggattcctgtcactatgctgtagc

SEQ ID NO: 191578 - DNA, 25 bp, Mus musculus
aggattcctgtctctatgctgtagc

SEQ ID NO: 191579 - DNA, 25 bp, Mus musculus
aggattcctgtgatgtccattcaat

SEQ ID NO: 191580 - DNA, 25 bp, Mus musculus
aggattcctgtgttgtccattcaat

SEQ ID NO: 191581 - DNA, 25 bp, Mus musculus
aggattcctgttctttatgattttt

SEQ ID NO: 191582 - DNA, 25 bp, Mus musculus
aggattcctgttgtttatgattttt

SEQ ID NO: 191583 - DNA, 25 bp, Mus musculus
aggattccttctaatctctctctgt

SEQ ID NO: 191584 - DNA, 25 bp, Mus musculus
aggattccttcttatctctctctgt

SEQ ID NO: 191585 - DNA, 25 bp, Mus musculus
aggattccttgactggtctgaccag

SEQ ID NO: 191586 - DNA, 25 bp, Mus musculus
aggattccttgagtggtctgaccag

SEQ ID NO: 191587 - DNA, 25 bp, Mus musculus
aggattctaacaagactctcccctt

SEQ ID NO: 191588 - DNA, 25 bp, Mus musculus
aggattctaacatgactctcccctt

SEQ ID NO: 191589 - DNA, 25 bp, Mus musculus
aggattctaggcatgtgcctttacc

SEQ ID NO: 191590 - DNA, 25 bp, Mus musculus
aggattctaggcttgtgcctttacc

SEQ ID NO: 191591 - DNA, 25 bp, Mus musculus
aggattctagtgaccttgctgcaca

SEQ ID NO: 191592 - DNA, 25 bp, Mus musculus
aggattctagtgtccttgctgcaca

SEQ ID NO: 191593 - DNA, 25 bp, Mus musculus
aggattctcagccttcaatggcctg

SEQ ID NO: 191594 - DNA, 25 bp, Mus musculus
aggattctcagcgttcaatggcctg

SEQ ID NO: 191595 - DNA, 25 bp, Mus musculus
aggattctcatgaatattccctcat

SEQ ID NO: 191596 - DNA, 25 bp, Mus musculus
aggattctcatgtatattccctcat

SEQ ID NO: 191597 - DNA, 25 bp, Mus musculus
aggattctccagcatcgtcatctaa

SEQ ID NO: 191598 - DNA, 25 bp, Mus musculus
aggattctccaggatcgtcatctaa

SEQ ID NO: 191599 - DNA, 25 bp, Mus musculus
aggattctctatccgggaatatgct

SEQ ID NO: 191600 - DNA, 25 bp, Mus musculus
aggattctctatgcgggaatatgct

SEQ ID NO: 191601 - DNA, 25 bp, Mus musculus
aggattctctgccagatgtcgagat

SEQ ID NO: 191602 - DNA, 25 bp, Mus musculus
aggattctctgcgagatgtcgagat

SEQ ID NO: 191603 - DNA, 25 bp, Mus musculus
aggattctctttccctagaacacag

SEQ ID NO: 191604 - DNA, 25 bp, Mus musculus
aggattctctttgcctagaacacag

SEQ ID NO: 191605 - DNA, 25 bp, Mus musculus
aggattctgtcacccagcttagagc

SEQ ID NO: 191606 - DNA, 25 bp, Mus musculus
aggattctgtcagccagcttagagc

SEQ ID NO: 191607 - DNA, 25 bp, Mus musculus
aggattcttaggcttattccagagg

SEQ ID NO: 191608 - DNA, 25 bp, Mus musculus
aggattcttagggttattccagagg

SEQ ID NO: 191609 - DNA, 25 bp, Mus musculus
aggattcttcacaagctcgtatgct

SEQ ID NO: 191610 - DNA, 25 bp, Mus musculus
aggattcttcactagctcgtatgct

SEQ ID NO: 191611 - DNA, 25 bp, Mus musculus
aggattcttcagatccttgaaagaa

SEQ ID NO: 191612 - DNA, 25 bp, Mus musculus
aggattcttcagttccttgaaagaa

SEQ ID NO: 191613 - DNA, 25 bp, Mus musculus
aggattcttctcaccaaaggtcact

SEQ ID NO: 191614 - DNA, 25 bp, Mus musculus
aggattcttctctccaaaggtcact

SEQ ID NO: 191615 - DNA, 25 bp, Mus musculus
aggattcttggactaactttcacag

SEQ ID NO: 191616 - DNA, 25 bp, Mus musculus
aggattcttggagtaactttcacag

SEQ ID NO: 191617 - DNA, 25 bp, Mus musculus
aggattgacactacaggactacagt

SEQ ID NO: 191618 - DNA, 25 bp, Mus musculus
aggattgacacttcaggactacagt

SEQ ID NO: 191619 - DNA, 25 bp, Mus musculus
aggattgaggatcgttctctaccca

SEQ ID NO: 191620 - DNA, 25 bp, Mus musculus
aggattgaggatggttctctaccca

SEQ ID NO: 191621 - DNA, 25 bp, Mus musculus
aggattgatcagacaatggctcatt

SEQ ID NO: 191622 - DNA, 25 bp, Mus musculus
aggattgatcagtcaatggctcatt

SEQ ID NO: 191623 - DNA, 25 bp, Mus musculus
aggattgatgacaatgcctgttggg

SEQ ID NO: 191624 - DNA, 25 bp, Mus musculus
aggattgatgactatgcctgttggg

SEQ ID NO: 191625 - DNA, 25 bp, Mus musculus
aggattgcaagtcctaagccagtct

SEQ ID NO: 191626 - DNA, 25 bp, Mus musculus
aggattgcaagtgctaagccagtct

SEQ ID NO: 191627 - DNA, 25 bp, Mus musculus
aggattgcacccaaagagaccggct

SEQ ID NO: 191628 - DNA, 25 bp, Mus musculus
aggattgcacccagtatctgaatgt

SEQ ID NO: 191629 - DNA, 25 bp, Mus musculus
aggattgcaccctaagagaccggct

SEQ ID NO: 191630 - DNA, 25 bp, Mus musculus
aggattgcaccctgtatctgaatgt

SEQ ID NO: 191631 - DNA, 25 bp, Mus musculus
aggattgccatacgttcaggcctca

SEQ ID NO: 191632 - DNA, 25 bp, Mus musculus
aggattgccataggttcaggcctca

SEQ ID NO: 191633 - DNA, 25 bp, Mus musculus
aggattgccccgctgtactgggaat

SEQ ID NO: 191634 - DNA, 25 bp, Mus musculus
aggattgccccggtgtactgggaat

SEQ ID NO: 191635 - DNA, 25 bp, Mus musculus
aggattgccggtcgcatcctggtcc

SEQ ID NO: 191636 - DNA, 25 bp, Mus musculus
aggattgccggtggcatcctggtcc

SEQ ID NO: 191637 - DNA, 25 bp, Mus musculus
aggattgcctaaatactcccaatac

SEQ ID NO: 191638 - DNA, 25 bp, Mus musculus
aggattgcctaattactcccaatac

SEQ ID NO: 191639 - DNA, 25 bp, Mus musculus
aggattgcctcacctttgggacaac

SEQ ID NO: 191640 - DNA, 25 bp, Mus musculus
aggattgcctcagctttgggacaac

SEQ ID NO: 191641 - DNA, 25 bp, Mus musculus
aggattgcctgcatagactataaaa

SEQ ID NO: 191642 - DNA, 25 bp, Mus musculus
aggattgcctgcttagactataaaa

SEQ ID NO: 191643 - DNA, 25 bp, Mus musculus
aggattgccttgagcatatactaca

SEQ ID NO: 191644 - DNA, 25 bp, Mus musculus
aggattgccttgtgcatatactaca

SEQ ID NO: 191645 - DNA, 25 bp, Mus musculus
aggattgctaacagccccttcaaag

SEQ ID NO: 191646 - DNA, 25 bp, Mus musculus
aggattgctaactgccccttcaaag

SEQ ID NO: 191647 - DNA, 25 bp, Mus musculus
aggattgctagacggtcctgcctat

SEQ ID NO: 191648 - DNA, 25 bp, Mus musculus
aggattgctagagggtcctgcctat

SEQ ID NO: 191649 - DNA, 25 bp, Mus musculus
aggattgctcaaaattcacactcat

SEQ ID NO: 191650 - DNA, 25 bp, Mus musculus
aggattgctcaatattcacactcat

SEQ ID NO: 191651 - DNA, 25 bp, Mus musculus
aggattgctgccagtctgagccaag

SEQ ID NO: 191652 - DNA, 25 bp, Mus musculus
aggattgctgccatagagtaactac

SEQ ID NO: 191653 - DNA, 25 bp, Mus musculus
aggattgctgcctgtctgagccaag

SEQ ID NO: 191654 - DNA, 25 bp, Mus musculus
aggattgctgccttagagtaactac

SEQ ID NO: 191655 - DNA, 25 bp, Mus musculus
aggattgctgtaagaagaccaccca

SEQ ID NO: 191656 - DNA, 25 bp, Mus musculus
aggattgctgtatgaagaccaccca

SEQ ID NO: 191657 - DNA, 25 bp, Mus musculus
aggattgcttctactgtcagaggta

SEQ ID NO: 191658 - DNA, 25 bp, Mus musculus
aggattgcttcttctgtcagaggta

SEQ ID NO: 191659 - DNA, 25 bp, Mus musculus
aggattgcttgtaatctggtgttga

SEQ ID NO: 191660 - DNA, 25 bp, Mus musculus
aggattgcttgttatctggtgttga

SEQ ID NO: 191661 - DNA, 25 bp, Mus musculus
aggattggaacccagagcccaccat

SEQ ID NO: 191662 - DNA, 25 bp, Mus musculus
aggattggaaccgagagcccaccat

SEQ ID NO: 191663 - DNA, 25 bp, Mus musculus
aggattggaagcagacgtatgaagt

SEQ ID NO: 191664 - DNA, 25 bp, Mus musculus
aggattggaagctgacgtatgaagt

SEQ ID NO: 191665 - DNA, 25 bp, Mus musculus
aggattggactgacatctcgcatca

SEQ ID NO: 191666 - DNA, 25 bp, Mus musculus
aggattggactgtcatctcgcatca

SEQ ID NO: 191667 - DNA, 25 bp, Mus musculus
aggattggacttcttgagccgcgac

SEQ ID NO: 191668 - DNA, 25 bp, Mus musculus
aggattggacttgttgagccgcgac

SEQ ID NO: 191669 - DNA, 25 bp, Mus musculus
aggattggatggaggcctacctgga

SEQ ID NO: 191670 - DNA, 25 bp, Mus musculus
aggattggatggtggcctacctgga

SEQ ID NO: 191671 - DNA, 25 bp, Mus musculus
aggattgggatgacttctgcttcta

SEQ ID NO: 191672 - DNA, 25 bp, Mus musculus
aggattgggatgtcttctgcttcta

SEQ ID NO: 191673 - DNA, 25 bp, Mus musculus
aggattgggtcaattgcttttccgg

SEQ ID NO: 191674 - DNA, 25 bp, Mus musculus
aggattgggtcatttgcttttccgg

SEQ ID NO: 191675 - DNA, 25 bp, Mus musculus
aggattgggttcaccatgtgtcgcc

SEQ ID NO: 191676 - DNA, 25 bp, Mus musculus
aggattgggttctccatgtgtcgcc

SEQ ID NO: 191677 - DNA, 25 bp, Mus musculus
aggattggtagcctgagtattcagt

SEQ ID NO: 191678 - DNA, 25 bp, Mus musculus
aggattggtagcgtgagtattcagt

SEQ ID NO: 191679 - DNA, 25 bp, Mus musculus
aggattggtcccagcttccgtgacc

SEQ ID NO: 191680 - DNA, 25 bp, Mus musculus
aggattggtccctgcttccgtgacc

SEQ ID NO: 191681 - DNA, 25 bp, Mus musculus
aggattggtctgagacagtccgttt

SEQ ID NO: 191682 - DNA, 25 bp, Mus musculus
aggattggtctgtgacagtccgttt

SEQ ID NO: 191683 - DNA, 25 bp, Mus musculus
aggattggtggtagccctctctgca

SEQ ID NO: 191684 - DNA, 25 bp, Mus musculus
aggattggtggttgccctctctgca

SEQ ID NO: 191685 - DNA, 25 bp, Mus musculus
aggattgtaactcccgaagctgcca

SEQ ID NO: 191686 - DNA, 25 bp, Mus musculus
aggattgtaactgccgaagctgcca

SEQ ID NO: 191687 - DNA, 25 bp, Mus musculus
aggattgtactgcaatcaagagcat

SEQ ID NO: 191688 - DNA, 25 bp, Mus musculus
aggattgtactggaatcaagagcat

SEQ ID NO: 191689 - DNA, 25 bp, Mus musculus
aggattgtagaaccagcgaacagaa

SEQ ID NO: 191690 - DNA, 25 bp, Mus musculus
aggattgtagaagcagcgaacagaa

SEQ ID NO: 191691 - DNA, 25 bp, Mus musculus
aggattgtatgcactggctgccaaa

SEQ ID NO: 191692 - DNA, 25 bp, Mus musculus
aggattgtatgctctggctgccaaa

SEQ ID NO: 191693 - DNA, 25 bp, Mus musculus
aggattgtccctcatctgatcagtg

SEQ ID NO: 191694 - DNA, 25 bp, Mus musculus
aggattgtccctgatctgatcagtg

SEQ ID NO: 191695 - DNA, 25 bp, Mus musculus
aggattgtcggtctgctgcacccag

SEQ ID NO: 191696 - DNA, 25 bp, Mus musculus
aggattgtcggtgtgctgcacccag

SEQ ID NO: 191697 - DNA, 25 bp, Mus musculus
aggattgtgactagactccagccca

SEQ ID NO: 191698 - DNA, 25 bp, Mus musculus
aggattgtgactattatttgataaa

SEQ ID NO: 191699 - DNA, 25 bp, Mus musculus
aggattgtgacttgactccagccca

SEQ ID NO: 191700 - DNA, 25 bp, Mus musculus
aggattgtgacttttatttgataaa

SEQ ID NO: 191701 - DNA, 25 bp, Mus musculus
aggattgtgcagcagccctcacctt

SEQ ID NO: 191702 - DNA, 25 bp, Mus musculus
aggattgtgcaggagccctcacctt

SEQ ID NO: 191703 - DNA, 25 bp, Mus musculus
aggattgtgccactagttttttgga

SEQ ID NO: 191704 - DNA, 25 bp, Mus musculus
aggattgtgccagtagttttttgga

SEQ ID NO: 191705 - DNA, 25 bp, Mus musculus
aggattgtgctccattcaacaccaa

SEQ ID NO: 191706 - DNA, 25 bp, Mus musculus
aggattgtgctcgattcaacaccaa

SEQ ID NO: 191707 - DNA, 25 bp, Mus musculus
aggattgtgggtctcatcgctaagc

SEQ ID NO: 191708 - DNA, 25 bp, Mus musculus
aggattgtgggtgtcatcgctaagc

SEQ ID NO: 191709 - DNA, 25 bp, Mus musculus
aggattgtgttgaagcaatttcctc

SEQ ID NO: 191710 - DNA, 25 bp, Mus musculus
aggattgtgttgtagcaatttcctc

SEQ ID NO: 191711 - DNA, 25 bp, Mus musculus
aggattgttactccccacagtggat

SEQ ID NO: 191712 - DNA, 25 bp, Mus musculus
aggattgttactgcccacagtggat

SEQ ID NO: 191713 - DNA, 25 bp, Mus musculus
aggattgttcgcatgtgacgccata

SEQ ID NO: 191714 - DNA, 25 bp, Mus musculus
aggattgttcgcttgtgacgccata

SEQ ID NO: 191715 - DNA, 25 bp, Mus musculus
aggattgttgctcatttacttactc

SEQ ID NO: 191716 - DNA, 25 bp, Mus musculus
aggattgttgctgatttacttactc

SEQ ID NO: 191717 - DNA, 25 bp, Mus musculus
aggattgttgtgagctcatcttaca

SEQ ID NO: 191718 - DNA, 25 bp, Mus musculus
aggattgttgtgtgctcatcttaca

SEQ ID NO: 191719 - DNA, 25 bp, Mus musculus
aggattgtttctctcatgatgtgga

SEQ ID NO: 191720 - DNA, 25 bp, Mus musculus
aggattgtttctgtcatgatgtgga

SEQ ID NO: 191721 - DNA, 25 bp, Mus musculus
aggattgtttgaattgaggccggaa

SEQ ID NO: 191722 - DNA, 25 bp, Mus musculus
aggattgtttgatttgaggccggaa

SEQ ID NO: 191723 - DNA, 25 bp, Mus musculus
aggattgtttttcagccaggccact

SEQ ID NO: 191724 - DNA, 25 bp, Mus musculus
aggattgtttttgagccaggccact

SEQ ID NO: 191725 - DNA, 25 bp, Mus musculus
aggatttaatggatgctctctgaaa

SEQ ID NO: 191726 - DNA, 25 bp, Mus musculus
aggatttaatggttgctctctgaaa

SEQ ID NO: 191727 - DNA, 25 bp, Mus musculus
aggatttaccaaagttctcctccat

SEQ ID NO: 191728 - DNA, 25 bp, Mus musculus
aggatttaccaatgttctcctccat

SEQ ID NO: 191729 - DNA, 25 bp, Mus musculus
aggatttaccacacccatgttgatg

SEQ ID NO: 191730 - DNA, 25 bp, Mus musculus
aggatttaccactcccatgttgatg

SEQ ID NO: 191731 - DNA, 25 bp, Mus musculus
aggatttaccagattggtcctcctg

SEQ ID NO: 191732 - DNA, 25 bp, Mus musculus
aggatttaccagtttggtcctcctg

SEQ ID NO: 191733 - DNA, 25 bp, Mus musculus
aggatttactccctggatttctgat

SEQ ID NO: 191734 - DNA, 25 bp, Mus musculus
aggatttactccgtggatttctgat

SEQ ID NO: 191735 - DNA, 25 bp, Mus musculus
aggatttactctacaacccgactat

SEQ ID NO: 191736 - DNA, 25 bp, Mus musculus
aggatttactcttcaacccgactat

SEQ ID NO: 191737 - DNA, 25 bp, Mus musculus
aggatttacttcatcttacagattt

SEQ ID NO: 191738 - DNA, 25 bp, Mus musculus
aggatttacttcttcttacagattt

SEQ ID NO: 191739 - DNA, 25 bp, Mus musculus
aggatttatacaattgtctgtgaag

SEQ ID NO: 191740 - DNA, 25 bp, Mus musculus
aggatttatacatttgtctgtgaag

SEQ ID NO: 191741 - DNA, 25 bp, Mus musculus
aggatttattagagagctctccaaa

SEQ ID NO: 191742 - DNA, 25 bp, Mus musculus
aggatttattagtgagctctccaaa

SEQ ID NO: 191743 - DNA, 25 bp, Mus musculus
aggatttcaaagactccacccagtt

SEQ ID NO: 191744 - DNA, 25 bp, Mus musculus
aggatttcaaagtctccacccagtt

SEQ ID NO: 191745 - DNA, 25 bp, Mus musculus
aggatttcaaatcacccttccatgg

SEQ ID NO: 191746 - DNA, 25 bp, Mus musculus
aggatttcaaatgacccttccatgg

SEQ ID NO: 191747 - DNA, 25 bp, Mus musculus
aggatttcaaccattactgtgttct

SEQ ID NO: 191748 - DNA, 25 bp, Mus musculus
aggatttcaacctttactgtgttct

SEQ ID NO: 191749 - DNA, 25 bp, Mus musculus
aggatttcactgaagcccatgatgc

SEQ ID NO: 191750 - DNA, 25 bp, Mus musculus
aggatttcactgtagcccatgatgc

SEQ ID NO: 191751 - DNA, 25 bp, Mus musculus
aggatttcagatacctttggtgtgt

SEQ ID NO: 191752 - DNA, 25 bp, Mus musculus
aggatttcagatacttcccacggaa

SEQ ID NO: 191753 - DNA, 25 bp, Mus musculus
aggatttcagattcctttggtgtgt

SEQ ID NO: 191754 - DNA, 25 bp, Mus musculus
aggatttcagattcttcccacggaa

SEQ ID NO: 191755 - DNA, 25 bp, Mus musculus
aggatttcagcccttgatgttttaa

SEQ ID NO: 191756 - DNA, 25 bp, Mus musculus
aggatttcagccgttgatgttttaa

SEQ ID NO: 191757 - DNA, 25 bp, Mus musculus
aggatttccagtatgcagacgggct

SEQ ID NO: 191758 - DNA, 25 bp, Mus musculus
aggatttccagtttgcagacgggct

SEQ ID NO: 191759 - DNA, 25 bp, Mus musculus
aggatttccctcaattctactgtcc

SEQ ID NO: 191760 - DNA, 25 bp, Mus musculus
aggatttccctctattctactgtcc

SEQ ID NO: 191761 - DNA, 25 bp, Mus musculus
aggatttccctgacatgcctacact

SEQ ID NO: 191762 - DNA, 25 bp, Mus musculus
aggatttccctgtcatgcctacact

SEQ ID NO: 191763 - DNA, 25 bp, Mus musculus
aggatttcctgaacttactcctcac

SEQ ID NO: 191764 - DNA, 25 bp, Mus musculus
aggatttcctgatcttactcctcac

SEQ ID NO: 191765 - DNA, 25 bp, Mus musculus
aggatttcggacagctcccagcggg

SEQ ID NO: 191766 - DNA, 25 bp, Mus musculus
aggatttcggactgctcccagcggg

SEQ ID NO: 191767 - DNA, 25 bp, Mus musculus
aggatttctaacaatactgatataa

SEQ ID NO: 191768 - DNA, 25 bp, Mus musculus
aggatttctaactatactgatataa

SEQ ID NO: 191769 - DNA, 25 bp, Mus musculus
aggatttctaccaggagctccgcaa

SEQ ID NO: 191770 - DNA, 25 bp, Mus musculus
aggatttctaccatgtttgcccctg

SEQ ID NO: 191771 - DNA, 25 bp, Mus musculus
aggatttctacctggagctccgcaa

SEQ ID NO: 191772 - DNA, 25 bp, Mus musculus
aggatttctaccttgtttgcccctg

SEQ ID NO: 191773 - DNA, 25 bp, Mus musculus
aggatttctagcctgatgccacaaa

SEQ ID NO: 191774 - DNA, 25 bp, Mus musculus
aggatttctagcgtgatgccacaaa

SEQ ID NO: 191775 - DNA, 25 bp, Mus musculus
aggatttctgtcacactccttggct

SEQ ID NO: 191776 - DNA, 25 bp, Mus musculus
aggatttctgtcatcaccttctggc

SEQ ID NO: 191777 - DNA, 25 bp, Mus musculus
aggatttctgtctcactccttggct

SEQ ID NO: 191778 - DNA, 25 bp, Mus musculus
aggatttctgtcttcaccttctggc

SEQ ID NO: 191779 - DNA, 25 bp, Mus musculus
aggatttctttgagtgaggctatca

SEQ ID NO: 191780 - DNA, 25 bp, Mus musculus
aggatttctttgtgtgaggctatca

SEQ ID NO: 191781 - DNA, 25 bp, Mus musculus
aggatttgaattctggccctcacta

SEQ ID NO: 191782 - DNA, 25 bp, Mus musculus
aggatttgaattgtggccctcacta

SEQ ID NO: 191783 - DNA, 25 bp, Mus musculus
aggatttgagccattggtctctgaa

SEQ ID NO: 191784 - DNA, 25 bp, Mus musculus
aggatttgagcctttggtctctgaa

SEQ ID NO: 191785 - DNA, 25 bp, Mus musculus
aggatttgagctcaccctgatgaag

SEQ ID NO: 191786 - DNA, 25 bp, Mus musculus
aggatttgagctgaccctgatgaag

SEQ ID NO: 191787 - DNA, 25 bp, Mus musculus
aggatttgagttacgtcctcagcat

SEQ ID NO: 191788 - DNA, 25 bp, Mus musculus
aggatttgagtttcgtcctcagcat

SEQ ID NO: 191789 - DNA, 25 bp, Mus musculus
aggatttgatcccatctgaggtgcc

SEQ ID NO: 191790 - DNA, 25 bp, Mus musculus
aggatttgatccgatctgaggtgcc

SEQ ID NO: 191791 - DNA, 25 bp, Mus musculus
aggatttgccccaggcagctgagca

SEQ ID NO: 191792 - DNA, 25 bp, Mus musculus
aggatttgcccctggcagctgagca

SEQ ID NO: 191793 - DNA, 25 bp, Mus musculus
aggatttgccgacgactatttttgc

SEQ ID NO: 191794 - DNA, 25 bp, Mus musculus
aggatttgccgaggactatttttgc

SEQ ID NO: 191795 - DNA, 25 bp, Mus musculus
aggatttgcctgcagataacaccca

SEQ ID NO: 191796 - DNA, 25 bp, Mus musculus
aggatttgcctggagataacaccca

SEQ ID NO: 191797 - DNA, 25 bp, Mus musculus
aggatttgccttcaggtcccagtgt

SEQ ID NO: 191798 - DNA, 25 bp, Mus musculus
aggatttgccttgaggtcccagtgt

SEQ ID NO: 191799 - DNA, 25 bp, Mus musculus
aggatttggataccccttcagtcaa

SEQ ID NO: 191800 - DNA, 25 bp, Mus musculus
aggatttggatagcccttcagtcaa

SEQ ID NO: 191801 - DNA, 25 bp, Mus musculus
aggatttggattcacccttggccct

SEQ ID NO: 191802 - DNA, 25 bp, Mus musculus
aggatttggattgacccttggccct

SEQ ID NO: 191803 - DNA, 25 bp, Mus musculus
aggatttggcacacttgtggcctac

SEQ ID NO: 191804 - DNA, 25 bp, Mus musculus
aggatttggcactcttgtggcctac

SEQ ID NO: 191805 - DNA, 25 bp, Mus musculus
aggatttgggaactccctggatctc

SEQ ID NO: 191806 - DNA, 25 bp, Mus musculus
aggatttgggaagtccctggatctc

SEQ ID NO: 191807 - DNA, 25 bp, Mus musculus
aggatttggtccatgcaaagcaaga

SEQ ID NO: 191808 - DNA, 25 bp, Mus musculus
aggatttggtccttgcaaagcaaga

SEQ ID NO: 191809 - DNA, 25 bp, Mus musculus
aggatttgtagaacctcagcctcct

SEQ ID NO: 191810 - DNA, 25 bp, Mus musculus
aggatttgtagatcctcagcctcct

SEQ ID NO: 191811 - DNA, 25 bp, Mus musculus
aggatttgtattactttaagtcttg

SEQ ID NO: 191812 - DNA, 25 bp, Mus musculus
aggatttgtatttctttaagtcttg

SEQ ID NO: 191813 - DNA, 25 bp, Mus musculus
aggatttgtggtctgactttgcagt

SEQ ID NO: 191814 - DNA, 25 bp, Mus musculus
aggatttgtggtgtgactttgcagt

SEQ ID NO: 191815 - DNA, 25 bp, Mus musculus
aggatttgtgttcgccttgcacagt

SEQ ID NO: 191816 - DNA, 25 bp, Mus musculus
aggatttgtgttggccttgcacagt

SEQ ID NO: 191817 - DNA, 25 bp, Mus musculus
aggattttagtaacttcagttaagt

SEQ ID NO: 191818 - DNA, 25 bp, Mus musculus
aggattttagtatcttcagttaagt

SEQ ID NO: 191819 - DNA, 25 bp, Mus musculus
aggattttataaagccactgtggtg

SEQ ID NO: 191820 - DNA, 25 bp, Mus musculus
aggattttataatgccactgtggtg

SEQ ID NO: 191821 - DNA, 25 bp, Mus musculus
aggattttcatgcttgtgaccgcca

SEQ ID NO: 191822 - DNA, 25 bp, Mus musculus
aggattttcatggttgtgaccgcca

SEQ ID NO: 191823 - DNA, 25 bp, Mus musculus
aggattttctgtcggttgctctgcc

SEQ ID NO: 191824 - DNA, 25 bp, Mus musculus
aggattttctgtgggttgctctgcc

SEQ ID NO: 191825 - DNA, 25 bp, Mus musculus
aggattttgacacctctgtaggcag

SEQ ID NO: 191826 - DNA, 25 bp, Mus musculus
aggattttgacagctctgtaggcag

SEQ ID NO: 191827 - DNA, 25 bp, Mus musculus
aggattttgattctccttgccttaa

SEQ ID NO: 191828 - DNA, 25 bp, Mus musculus
aggattttgattgtccttgccttaa

SEQ ID NO: 191829 - DNA, 25 bp, Mus musculus
aggattttgcccaaatgtcacccct

SEQ ID NO: 191830 - DNA, 25 bp, Mus musculus
aggattttgccctaatgtcacccct

SEQ ID NO: 191831 - DNA, 25 bp, Mus musculus
aggcaaaaccgaacttcttgtgctc

SEQ ID NO: 191832 - DNA, 25 bp, Mus musculus
aggcaaaaccgatcttcttgtgctc

SEQ ID NO: 191833 - DNA, 25 bp, Mus musculus
aggcaaaaccttctggctgcaggaa

SEQ ID NO: 191834 - DNA, 25 bp, Mus musculus
aggcaaaaccttgtggctgcaggaa

SEQ ID NO: 191835 - DNA, 25 bp, Mus musculus
aggcaaaaggcgagaccctgcttcc

SEQ ID NO: 191836 - DNA, 25 bp, Mus musculus
aggcaaaaggcgtgaccctgcttcc

SEQ ID NO: 191837 - DNA, 25 bp, Mus musculus
aggcaaaatggaaattccctcaggg

SEQ ID NO: 191838 - DNA, 25 bp, Mus musculus
aggcaaaatggatattccctcaggg

SEQ ID NO: 191839 - DNA, 25 bp, Mus musculus
aggcaaaattgtaaagtagcttgtg

SEQ ID NO: 191840 - DNA, 25 bp, Mus musculus
aggcaaaattgttaagtagcttgtg

SEQ ID NO: 191841 - DNA, 25 bp, Mus musculus
aggcaaacaaaacactctaccgctg

SEQ ID NO: 191842 - DNA, 25 bp, Mus musculus
aggcaaacaaaagactctaccgctg

SEQ ID NO: 191843 - DNA, 25 bp, Mus musculus
aggcaaacactgacctttccaggtg

SEQ ID NO: 191844 - DNA, 25 bp, Mus musculus
aggcaaacactgtcctttccaggtg

SEQ ID NO: 191845 - DNA, 25 bp, Mus musculus
aggcaaacaggtagatcgtgggaat

SEQ ID NO: 191846 - DNA, 25 bp, Mus musculus
aggcaaacaggttgatcgtgggaat

SEQ ID NO: 191847 - DNA, 25 bp, Mus musculus
aggcaaacatgtcttccctgaacag

SEQ ID NO: 191848 - DNA, 25 bp, Mus musculus
aggcaaacatgtgttccctgaacag

SEQ ID NO: 191849 - DNA, 25 bp, Mus musculus
aggcaaaccatgaaacgggccattt

SEQ ID NO: 191850 - DNA, 25 bp, Mus musculus
aggcaaaccatgtaacgggccattt

SEQ ID NO: 191851 - DNA, 25 bp, Mus musculus
aggcaaaccgccattcagaggcaat

SEQ ID NO: 191852 - DNA, 25 bp, Mus musculus
aggcaaaccgcctttcagaggcaat

SEQ ID NO: 191853 - DNA, 25 bp, Mus musculus
aggcaaaccgttatagataagtatg

SEQ ID NO: 191854 - DNA, 25 bp, Mus musculus
aggcaaaccgttttagataagtatg

SEQ ID NO: 191855 - DNA, 25 bp, Mus musculus
aggcaaacgaaaacgctgtgtcgat

SEQ ID NO: 191856 - DNA, 25 bp, Mus musculus
aggcaaacgaaatcgctgtgtcgat

SEQ ID NO: 191857 - DNA, 25 bp, Mus musculus
aggcaaagaggcagtctgcttcatc

SEQ ID NO: 191858 - DNA, 25 bp, Mus musculus
aggcaaagaggctgtctgcttcatc

SEQ ID NO: 191859 - DNA, 25 bp, Mus musculus
aggcaaagatcaaagccactgctct

SEQ ID NO: 191860 - DNA, 25 bp, Mus musculus
aggcaaagatcatagccactgctct

SEQ ID NO: 191861 - DNA, 25 bp, Mus musculus
aggcaaagattcaccttcctggatc

SEQ ID NO: 191862 - DNA, 25 bp, Mus musculus
aggcaaagattctccttcctggatc

SEQ ID NO: 191863 - DNA, 25 bp, Mus musculus
aggcaaagatttagctccaggattt

SEQ ID NO: 191864 - DNA, 25 bp, Mus musculus
aggcaaagattttgctccaggattt

SEQ ID NO: 191865 - DNA, 25 bp, Mus musculus
aggcaaagcggtccctgtttacagg

SEQ ID NO: 191866 - DNA, 25 bp, Mus musculus
aggcaaagcggtgcctgtttacagg

SEQ ID NO: 191867 - DNA, 25 bp, Mus musculus
aggcaaaggcacatacacttccagt

SEQ ID NO: 191868 - DNA, 25 bp, Mus musculus
aggcaaaggcacttacacttccagt

SEQ ID NO: 191869 - DNA, 25 bp, Mus musculus
aggcaaaggcttcgattctcctctt

SEQ ID NO: 191870 - DNA, 25 bp, Mus musculus
aggcaaaggcttggattctcctctt

SEQ ID NO: 191871 - DNA, 25 bp, Mus musculus
aggcaaagggctatgacttccccag

SEQ ID NO: 191872 - DNA, 25 bp, Mus musculus
aggcaaagggctttgacttccccag

SEQ ID NO: 191873 - DNA, 25 bp, Mus musculus
aggcaaagtgcgacctcttcaagcc

SEQ ID NO: 191874 - DNA, 25 bp, Mus musculus
aggcaaagtgcgtcctcttcaagcc

SEQ ID NO: 191875 - DNA, 25 bp, Mus musculus
aggcaaagttctcctccatctccat

SEQ ID NO: 191876 - DNA, 25 bp, Mus musculus
aggcaaagttctgctccatctccat

SEQ ID NO: 191877 - DNA, 25 bp, Mus musculus
aggcaaagttgcagggtccgatctc

SEQ ID NO: 191878 - DNA, 25 bp, Mus musculus
aggcaaagttgctgggtccgatctc

SEQ ID NO: 191879 - DNA, 25 bp, Mus musculus
aggcaaagttttcatcgatctccat

SEQ ID NO: 191880 - DNA, 25 bp, Mus musculus
aggcaaagttttgatcgatctccat

SEQ ID NO: 191881 - DNA, 25 bp, Mus musculus
aggcaaataatccagctctgagtta

SEQ ID NO: 191882 - DNA, 25 bp, Mus musculus
aggcaaataatcgagctctgagtta

SEQ ID NO: 191883 - DNA, 25 bp, Mus musculus
aggcaaatacacagtcatgctgggt

SEQ ID NO: 191884 - DNA, 25 bp, Mus musculus
aggcaaatacactgtcatgctgggt

SEQ ID NO: 191885 - DNA, 25 bp, Mus musculus
aggcaaatcctgctgatgttggtgc

SEQ ID NO: 191886 - DNA, 25 bp, Mus musculus
aggcaaatcctggtgatgttggtgc

SEQ ID NO: 191887 - DNA, 25 bp, Mus musculus
aggcaaatctccagagtccccggca

SEQ ID NO: 191888 - DNA, 25 bp, Mus musculus
aggcaaatctcctgagtccccggca

SEQ ID NO: 191889 - DNA, 25 bp, Mus musculus
aggcaaatctctaccatgctccaag

SEQ ID NO: 191890 - DNA, 25 bp, Mus musculus
aggcaaatctcttccatgctccaag

SEQ ID NO: 191891 - DNA, 25 bp, Mus musculus
aggcaaatctgtctcccgctgataa

SEQ ID NO: 191892 - DNA, 25 bp, Mus musculus
aggcaaatctgtgtcccgctgataa

SEQ ID NO: 191893 - DNA, 25 bp, Mus musculus
aggcaaatgcttacctcttgactta

SEQ ID NO: 191894 - DNA, 25 bp, Mus musculus
aggcaaatgcttagatctctttcct

SEQ ID NO: 191895 - DNA, 25 bp, Mus musculus
aggcaaatgcttccactcttcactc

SEQ ID NO: 191896 - DNA, 25 bp, Mus musculus
aggcaaatgcttgcactcttcactc

SEQ ID NO: 191897 - DNA, 25 bp, Mus musculus
aggcaaatgctttcctcttgactta

SEQ ID NO: 191898 - DNA, 25 bp, Mus musculus
aggcaaatgctttgatctctttcct

SEQ ID NO: 191899 - DNA, 25 bp, Mus musculus
aggcaaatgttgcagtagctctccc

SEQ ID NO: 191900 - DNA, 25 bp, Mus musculus
aggcaaatgttggagtagctctccc

SEQ ID NO: 191901 - DNA, 25 bp, Mus musculus
aggcaaattctcagccacaataccc

SEQ ID NO: 191902 - DNA, 25 bp, Mus musculus
aggcaaattctctgccacaataccc

SEQ ID NO: 191903 - DNA, 25 bp, Mus musculus
aggcaaattctgatgcctacttgaa

SEQ ID NO: 191904 - DNA, 25 bp, Mus musculus
aggcaaattctgttgcctacttgaa

SEQ ID NO: 191905 - DNA, 25 bp, Mus musculus
aggcaaattggcacctggtacaagg

SEQ ID NO: 191906 - DNA, 25 bp, Mus musculus
aggcaaattggctcctggtacaagg

SEQ ID NO: 191907 - DNA, 25 bp, Mus musculus
aggcaacaaacccaaggagcgctgt

SEQ ID NO: 191908 - DNA, 25 bp, Mus musculus
aggcaacaaaccgaaggagcgctgt

SEQ ID NO: 191909 - DNA, 25 bp, Mus musculus
aggcaacacccaagcgcatatcagg

SEQ ID NO: 191910 - DNA, 25 bp, Mus musculus
aggcaacacccatgcgcatatcagg

SEQ ID NO: 191911 - DNA, 25 bp, Mus musculus
aggcaacaccgtcccactcgtggat

SEQ ID NO: 191912 - DNA, 25 bp, Mus musculus
aggcaacaccgtgccactcgtggat

SEQ ID NO: 191913 - DNA, 25 bp, Mus musculus
aggcaacacctacactgcagtctaa

SEQ ID NO: 191914 - DNA, 25 bp, Mus musculus
aggcaacacctagactgcagtctaa

SEQ ID NO: 191915 - DNA, 25 bp, Mus musculus
aggcaacactttaggaaatggcaca

SEQ ID NO: 191916 - DNA, 25 bp, Mus musculus
aggcaacacttttggaaatggcaca

SEQ ID NO: 191917 - DNA, 25 bp, Mus musculus
aggcaacagaggcacttgggcttcc

SEQ ID NO: 191918 - DNA, 25 bp, Mus musculus
aggcaacagagggacttgggcttcc

SEQ ID NO: 191919 - DNA, 25 bp, Mus musculus
aggcaacagctcaataaactctacg

SEQ ID NO: 191920 - DNA, 25 bp, Mus musculus
aggcaacagctccagttctcacacc

SEQ ID NO: 191921 - DNA, 25 bp, Mus musculus
aggcaacagctcgagttctcacacc

SEQ ID NO: 191922 - DNA, 25 bp, Mus musculus
aggcaacagctctataaactctacg

SEQ ID NO: 191923 - DNA, 25 bp, Mus musculus
aggcaacaggaacacacatggtttc

SEQ ID NO: 191924 - DNA, 25 bp, Mus musculus
aggcaacaggaagacacatggtttc

SEQ ID NO: 191925 - DNA, 25 bp, Mus musculus
aggcaacatggaagagacctgcata

SEQ ID NO: 191926 - DNA, 25 bp, Mus musculus
aggcaacatggatgagacctgcata

SEQ ID NO: 191927 - DNA, 25 bp, Mus musculus
aggcaaccactcagagggtgaggaa

SEQ ID NO: 191928 - DNA, 25 bp, Mus musculus
aggcaaccactctgagggtgaggaa

SEQ ID NO: 191929 - DNA, 25 bp, Mus musculus
aggcaaccagccagccccgagagag

SEQ ID NO: 191930 - DNA, 25 bp, Mus musculus
aggcaaccagcctgccccgagagag

SEQ ID NO: 191931 - DNA, 25 bp, Mus musculus
aggcaaccaggaaaccctcagtata

SEQ ID NO: 191932 - DNA, 25 bp, Mus musculus
aggcaaccaggataccctcagtata

SEQ ID NO: 191933 - DNA, 25 bp, Mus musculus
aggcaaccatacatcttgaatagca

SEQ ID NO: 191934 - DNA, 25 bp, Mus musculus
aggcaaccatacttcttgaatagca

SEQ ID NO: 191935 - DNA, 25 bp, Mus musculus
aggcaacccctgacccaagcagagg

SEQ ID NO: 191936 - DNA, 25 bp, Mus musculus
aggcaacccctgtcccaagcagagg

SEQ ID NO: 191937 - DNA, 25 bp, Mus musculus
aggcaaccctctcactgttgaaaag

SEQ ID NO: 191938 - DNA, 25 bp, Mus musculus
aggcaaccctctgactgttgaaaag

SEQ ID NO: 191939 - DNA, 25 bp, Mus musculus
aggcaaccgttcaccagcatggcat

SEQ ID NO: 191940 - DNA, 25 bp, Mus musculus
aggcaaccgttctccagcatggcat

SEQ ID NO: 191941 - DNA, 25 bp, Mus musculus
aggcaacctctgctatcctagatgc

SEQ ID NO: 191942 - DNA, 25 bp, Mus musculus
aggcaacctctggtatcctagatgc

SEQ ID NO: 191943 - DNA, 25 bp, Mus musculus
aggcaaccttctcttttatgtccag

SEQ ID NO: 191944 - DNA, 25 bp, Mus musculus
aggcaaccttctgttttatgtccag

SEQ ID NO: 191945 - DNA, 25 bp, Mus musculus
aggcaacgacagcatggagcaccca

SEQ ID NO: 191946 - DNA, 25 bp, Mus musculus
aggcaacgacaggatggagcaccca

SEQ ID NO: 191947 - DNA, 25 bp, Mus musculus
aggcaacggcaacaaattctactct

SEQ ID NO: 191948 - DNA, 25 bp, Mus musculus
aggcaacggcaagaaattctactct

SEQ ID NO: 191949 - DNA, 25 bp, Mus musculus
aggcaactatgcactttgatgagga

SEQ ID NO: 191950 - DNA, 25 bp, Mus musculus
aggcaactatgctctttgatgagga

SEQ ID NO: 191951 - DNA, 25 bp, Mus musculus
aggcaactccaaatagatccagcat

SEQ ID NO: 191952 - DNA, 25 bp, Mus musculus
aggcaactccaattagatccagcat

SEQ ID NO: 191953 - DNA, 25 bp, Mus musculus
aggcaactgaatcaccttctcttta

SEQ ID NO: 191954 - DNA, 25 bp, Mus musculus
aggcaactgaatgaccttctcttta

SEQ ID NO: 191955 - DNA, 25 bp, Mus musculus
aggcaactgagtatgacaatgtcat

SEQ ID NO: 191956 - DNA, 25 bp, Mus musculus
aggcaactgagtttgacaatgtcat

SEQ ID NO: 191957 - DNA, 25 bp, Mus musculus
aggcaactgccaacttaggtccgga

SEQ ID NO: 191958 - DNA, 25 bp, Mus musculus
aggcaactgccatcttaggtccgga

SEQ ID NO: 191959 - DNA, 25 bp, Mus musculus
aggcaactgccgactaactgatcta

SEQ ID NO: 191960 - DNA, 25 bp, Mus musculus
aggcaactgccgtctaactgatcta

SEQ ID NO: 191961 - DNA, 25 bp, Mus musculus
aggcaactgctcacagttttaccca

SEQ ID NO: 191962 - DNA, 25 bp, Mus musculus
aggcaactgctcatgaattccttct

SEQ ID NO: 191963 - DNA, 25 bp, Mus musculus
aggcaactgctctcagttttaccca

SEQ ID NO: 191964 - DNA, 25 bp, Mus musculus
aggcaactgctcttgaattccttct

SEQ ID NO: 191965 - DNA, 25 bp, Mus musculus
aggcaactggacatcagatctcaga

SEQ ID NO: 191966 - DNA, 25 bp, Mus musculus
aggcaactggacttcagatctcaga

SEQ ID NO: 191967 - DNA, 25 bp, Mus musculus
aggcaactgggaacgctcttttgga

SEQ ID NO: 191968 - DNA, 25 bp, Mus musculus
aggcaactgggaactgagttactct

SEQ ID NO: 191969 - DNA, 25 bp, Mus musculus
aggcaactgggatcgctcttttgga

SEQ ID NO: 191970 - DNA, 25 bp, Mus musculus
aggcaactgggatctgagttactct

SEQ ID NO: 191971 - DNA, 25 bp, Mus musculus
aggcaactgtctaatctacccggct

SEQ ID NO: 191972 - DNA, 25 bp, Mus musculus
aggcaactgtcttatctacccggct

SEQ ID NO: 191973 - DNA, 25 bp, Mus musculus
aggcaactgtttcatcgtctgcacc

SEQ ID NO: 191974 - DNA, 25 bp, Mus musculus
aggcaactgtttgatcgtctgcacc

SEQ ID NO: 191975 - DNA, 25 bp, Mus musculus
aggcaagaatttagctccctggatt

SEQ ID NO: 191976 - DNA, 25 bp, Mus musculus
aggcaagaattttgctccctggatt

SEQ ID NO: 191977 - DNA, 25 bp, Mus musculus
aggcaagacttgctgcttttgtgta

SEQ ID NO: 191978 - DNA, 25 bp, Mus musculus
aggcaagacttggtgcttttgtgta

SEQ ID NO: 191979 - DNA, 25 bp, Mus musculus
aggcaagagcacagaccggttttct

SEQ ID NO: 191980 - DNA, 25 bp, Mus musculus
aggcaagagcactgaccggttttct

SEQ ID NO: 191981 - DNA, 25 bp, Mus musculus
aggcaagaggagcaacggcgtagac

SEQ ID NO: 191982 - DNA, 25 bp, Mus musculus
aggcaagaggaggaacggcgtagac

SEQ ID NO: 191983 - DNA, 25 bp, Mus musculus
aggcaagagggtagcccatgagttc

SEQ ID NO: 191984 - DNA, 25 bp, Mus musculus
aggcaagagggttgcccatgagttc

SEQ ID NO: 191985 - DNA, 25 bp, Mus musculus
aggcaagagtctcgtccaggcgaat

SEQ ID NO: 191986 - DNA, 25 bp, Mus musculus
aggcaagagtctggtccaggcgaat

SEQ ID NO: 191987 - DNA, 25 bp, Mus musculus
aggcaagataccagctgtggtagct

SEQ ID NO: 191988 - DNA, 25 bp, Mus musculus
aggcaagatacctgctgtggtagct

SEQ ID NO: 191989 - DNA, 25 bp, Mus musculus
aggcaagatcccaatctcagggccc

SEQ ID NO: 191990 - DNA, 25 bp, Mus musculus
aggcaagatccctatctcagggccc

SEQ ID NO: 191991 - DNA, 25 bp, Mus musculus
aggcaagatcttcccacagtatgtg

SEQ ID NO: 191992 - DNA, 25 bp, Mus musculus
aggcaagatcttgccacagtatgtg

SEQ ID NO: 191993 - DNA, 25 bp, Mus musculus
aggcaagatgtgaccactggtggca

SEQ ID NO: 191994 - DNA, 25 bp, Mus musculus
aggcaagatgtgtccactggtggca

SEQ ID NO: 191995 - DNA, 25 bp, Mus musculus
aggcaagcaacaacactcttcgtgt

SEQ ID NO: 191996 - DNA, 25 bp, Mus musculus
aggcaagcaacatcactcttcgtgt

SEQ ID NO: 191997 - DNA, 25 bp, Mus musculus
aggcaagcaatgctcttgacctggc

SEQ ID NO: 191998 - DNA, 25 bp, Mus musculus
aggcaagcaatggtcttgacctggc

SEQ ID NO: 191999 - DNA, 25 bp, Mus musculus
aggcaagcacagagaggcctccagt

SEQ ID NO: 192000 - DNA, 25 bp, Mus musculus
aggcaagcacagtgaggcctccagt

SEQ ID NO: 192001 - DNA, 25 bp, Mus musculus
aggcaagcactaacttatttcctgc

SEQ ID NO: 192002 - DNA, 25 bp, Mus musculus
aggcaagcactactgactctgtttg

SEQ ID NO: 192003 - DNA, 25 bp, Mus musculus
aggcaagcactagtgactctgtttg

SEQ ID NO: 192004 - DNA, 25 bp, Mus musculus
aggcaagcactatcttatttcctgc

SEQ ID NO: 192005 - DNA, 25 bp, Mus musculus
aggcaagcactcagtaaagctgtaa

SEQ ID NO: 192006 - DNA, 25 bp, Mus musculus
aggcaagcactctgtaaagctgtaa

SEQ ID NO: 192007 - DNA, 25 bp, Mus musculus
aggcaagcaggaaaggtggcaccat

SEQ ID NO: 192008 - DNA, 25 bp, Mus musculus
aggcaagcaggataggtggcaccat

SEQ ID NO: 192009 - DNA, 25 bp, Mus musculus
aggcaagcctcaatgcagtggtttc

SEQ ID NO: 192010 - DNA, 25 bp, Mus musculus
aggcaagcctcattgcagtggtttc

SEQ ID NO: 192011 - DNA, 25 bp, Mus musculus
aggcaagcgaaacggcaaggtctcc

SEQ ID NO: 192012 - DNA, 25 bp, Mus musculus
aggcaagcgaaagggcaaggtctcc

SEQ ID NO: 192013 - DNA, 25 bp, Mus musculus
aggcaagcgcagagttcagctcatg

SEQ ID NO: 192014 - DNA, 25 bp, Mus musculus
aggcaagcgcagtgttcagctcatg

SEQ ID NO: 192015 - DNA, 25 bp, Mus musculus
aggcaagcgcttaggcatcctggtt

SEQ ID NO: 192016 - DNA, 25 bp, Mus musculus
aggcaagcgctttggcatcctggtt

SEQ ID NO: 192017 - DNA, 25 bp, Mus musculus
aggcaagcggcaatgggcactcagt

SEQ ID NO: 192018 - DNA, 25 bp, Mus musculus
aggcaagcggcattgggcactcagt

SEQ ID NO: 192019 - DNA, 25 bp, Mus musculus
aggcaagctcttaaccacatggtag

SEQ ID NO: 192020 - DNA, 25 bp, Mus musculus
aggcaagctcttacacagggttgta

SEQ ID NO: 192021 - DNA, 25 bp, Mus musculus
aggcaagctctttaccacatggtag

SEQ ID NO: 192022 - DNA, 25 bp, Mus musculus
aggcaagctctttcacagggttgta

SEQ ID NO: 192023 - DNA, 25 bp, Mus musculus
aggcaagctgatatcccacacgaat

SEQ ID NO: 192024 - DNA, 25 bp, Mus musculus
aggcaagctgatttcccacacgaat

SEQ ID NO: 192025 - DNA, 25 bp, Mus musculus
aggcaagctgccagccaatcaatcc

SEQ ID NO: 192026 - DNA, 25 bp, Mus musculus
aggcaagctgcctgccaatcaatcc

SEQ ID NO: 192027 - DNA, 25 bp, Mus musculus
aggcaaggcagcaccagttggcaga

SEQ ID NO: 192028 - DNA, 25 bp, Mus musculus
aggcaaggcagctccagttggcaga

SEQ ID NO: 192029 - DNA, 25 bp, Mus musculus
aggcaaggcatgactcagtgtctcc

SEQ ID NO: 192030 - DNA, 25 bp, Mus musculus
aggcaaggcatgtctcagtgtctcc

SEQ ID NO: 192031 - DNA, 25 bp, Mus musculus
aggcaaggccctaccatcactgtgt

SEQ ID NO: 192032 - DNA, 25 bp, Mus musculus
aggcaaggcccttccatcactgtgt

SEQ ID NO: 192033 - DNA, 25 bp, Mus musculus
aggcaaggcctccaacagtttatta

SEQ ID NO: 192034 - DNA, 25 bp, Mus musculus
aggcaaggcctcgaacagtttatta

SEQ ID NO: 192035 - DNA, 25 bp, Mus musculus
aggcaaggctccaagcagtgggact

SEQ ID NO: 192036 - DNA, 25 bp, Mus musculus
aggcaaggctcccttgcacatctca

SEQ ID NO: 192037 - DNA, 25 bp, Mus musculus
aggcaaggctccgttgcacatctca

SEQ ID NO: 192038 - DNA, 25 bp, Mus musculus
aggcaaggctcctagcagtgggact

SEQ ID NO: 192039 - DNA, 25 bp, Mus musculus
aggcaaggctctcgctcagcagctc

SEQ ID NO: 192040 - DNA, 25 bp, Mus musculus
aggcaaggctctggctcagcagctc

SEQ ID NO: 192041 - DNA, 25 bp, Mus musculus
aggcaaggctgtctgtccactagta

SEQ ID NO: 192042 - DNA, 25 bp, Mus musculus
aggcaaggctgtgtgtccactagta

SEQ ID NO: 192043 - DNA, 25 bp, Mus musculus
aggcaaggctttcgttcaacagttc

SEQ ID NO: 192044 - DNA, 25 bp, Mus musculus
aggcaaggctttggttcaacagttc

SEQ ID NO: 192045 - DNA, 25 bp, Mus musculus
aggcaaggtgccacacatctgtaat

SEQ ID NO: 192046 - DNA, 25 bp, Mus musculus
aggcaaggtgccctctcacaaggat

SEQ ID NO: 192047 - DNA, 25 bp, Mus musculus
aggcaaggtgccgtctcacaaggat

SEQ ID NO: 192048 - DNA, 25 bp, Mus musculus
aggcaaggtgcctcacatctgtaat

SEQ ID NO: 192049 - DNA, 25 bp, Mus musculus
aggcaagtacagagtggtgcacacc

SEQ ID NO: 192050 - DNA, 25 bp, Mus musculus
aggcaagtacagtgtggtgcacacc

SEQ ID NO: 192051 - DNA, 25 bp, Mus musculus
aggcaagtactgctttgcccctgtc

SEQ ID NO: 192052 - DNA, 25 bp, Mus musculus
aggcaagtactggtttgcccctgtc

SEQ ID NO: 192053 - DNA, 25 bp, Mus musculus
aggcaagtaggccatcaaaactcag

SEQ ID NO: 192054 - DNA, 25 bp, Mus musculus
aggcaagtaggcgatcaaaactcag

SEQ ID NO: 192055 - DNA, 25 bp, Mus musculus
aggcaagtatgtcagatagttaccc

SEQ ID NO: 192056 - DNA, 25 bp, Mus musculus
aggcaagtatgtgagatagttaccc

SEQ ID NO: 192057 - DNA, 25 bp, Mus musculus
aggcaagtccttccggcatgaaaaa

SEQ ID NO: 192058 - DNA, 25 bp, Mus musculus
aggcaagtccttgcggcatgaaaaa

SEQ ID NO: 192059 - DNA, 25 bp, Mus musculus
aggcaagtctgtagggaagtctata

SEQ ID NO: 192060 - DNA, 25 bp, Mus musculus
aggcaagtctgttgggaagtctata

SEQ ID NO: 192061 - DNA, 25 bp, Mus musculus
aggcaagtgccaaaacagactaaat

SEQ ID NO: 192062 - DNA, 25 bp, Mus musculus
aggcaagtgccataacagactaaat

SEQ ID NO: 192063 - DNA, 25 bp, Mus musculus
aggcaagtgcttattcaccatactc

SEQ ID NO: 192064 - DNA, 25 bp, Mus musculus
aggcaagtgcttctatcctctgtgc

SEQ ID NO: 192065 - DNA, 25 bp, Mus musculus
aggcaagtgcttgtatcctctgtgc

SEQ ID NO: 192066 - DNA, 25 bp, Mus musculus
aggcaagtgctttttcaccatactc

SEQ ID NO: 192067 - DNA, 25 bp, Mus musculus
aggcaagtgtcacatctcttttcta

SEQ ID NO: 192068 - DNA, 25 bp, Mus musculus
aggcaagtgtcagatctcttttcta

SEQ ID NO: 192069 - DNA, 25 bp, Mus musculus
aggcaagttcatccactccagtggt

SEQ ID NO: 192070 - DNA, 25 bp, Mus musculus
aggcaagttcatgcactccagtggt

SEQ ID NO: 192071 - DNA, 25 bp, Mus musculus
aggcaagttgtcctcagttgtacaa

SEQ ID NO: 192072 - DNA, 25 bp, Mus musculus
aggcaagttgtcgtcagttgtacaa

SEQ ID NO: 192073 - DNA, 25 bp, Mus musculus
aggcaagttttgagcagttccaagc

SEQ ID NO: 192074 - DNA, 25 bp, Mus musculus
aggcaagttttgtgcagttccaagc

SEQ ID NO: 192075 - DNA, 25 bp, Mus musculus
aggcaataactcaccaggaccacct

SEQ ID NO: 192076 - DNA, 25 bp, Mus musculus
aggcaataactctccaggaccacct

SEQ ID NO: 192077 - DNA, 25 bp, Mus musculus
aggcaataagcaaccctaaggtttg

SEQ ID NO: 192078 - DNA, 25 bp, Mus musculus
aggcaataagcatccctaaggtttg

SEQ ID NO: 192079 - DNA, 25 bp, Mus musculus
aggcaatacaccattgagcctcttc

SEQ ID NO: 192080 - DNA, 25 bp, Mus musculus
aggcaatacacctttgagcctcttc

SEQ ID NO: 192081 - DNA, 25 bp, Mus musculus
aggcaatacagtcagatccccatct

SEQ ID NO: 192082 - DNA, 25 bp, Mus musculus
aggcaatacagtgagatccccatct

SEQ ID NO: 192083 - DNA, 25 bp, Mus musculus
aggcaatcacagagcagacccatct

SEQ ID NO: 192084 - DNA, 25 bp, Mus musculus
aggcaatcacagtgcagacccatct

SEQ ID NO: 192085 - DNA, 25 bp, Mus musculus
aggcaatcacggcacttggaaggct

SEQ ID NO: 192086 - DNA, 25 bp, Mus musculus
aggcaatcacgggacttggaaggct

SEQ ID NO: 192087 - DNA, 25 bp, Mus musculus
aggcaatcagcccttgcttatctgt

SEQ ID NO: 192088 - DNA, 25 bp, Mus musculus
aggcaatcagccgttgcttatctgt

SEQ ID NO: 192089 - DNA, 25 bp, Mus musculus
aggcaatcatgcaactgtcctgtca

SEQ ID NO: 192090 - DNA, 25 bp, Mus musculus
aggcaatcatgctactgtcctgtca

SEQ ID NO: 192091 - DNA, 25 bp, Mus musculus
aggcaatccatcagctggcctgact

SEQ ID NO: 192092 - DNA, 25 bp, Mus musculus
aggcaatccatctgctggcctgact

SEQ ID NO: 192093 - DNA, 25 bp, Mus musculus
aggcaatcccctaaatgagactccc

SEQ ID NO: 192094 - DNA, 25 bp, Mus musculus
aggcaatccccttaatgagactccc

SEQ ID NO: 192095 - DNA, 25 bp, Mus musculus
aggcaatcctgaacattgctttcag

SEQ ID NO: 192096 - DNA, 25 bp, Mus musculus
aggcaatcctgatcattgctttcag

SEQ ID NO: 192097 - DNA, 25 bp, Mus musculus
aggcaatctgtacagcactcgcagg

SEQ ID NO: 192098 - DNA, 25 bp, Mus musculus
aggcaatctgtagagcactcgcagg

SEQ ID NO: 192099 - DNA, 25 bp, Mus musculus
aggcaatgaaatccttccgttctca

SEQ ID NO: 192100 - DNA, 25 bp, Mus musculus
aggcaatgaaatgcttccgttctca

SEQ ID NO: 192101 - DNA, 25 bp, Mus musculus
aggcaatgggctctggttttataat

SEQ ID NO: 192102 - DNA, 25 bp, Mus musculus
aggcaatgggctgtggttttataat

SEQ ID NO: 192103 - DNA, 25 bp, Mus musculus
aggcaatggtagattcagtgactcc

SEQ ID NO: 192104 - DNA, 25 bp, Mus musculus
aggcaatggtagtttcagtgactcc

SEQ ID NO: 192105 - DNA, 25 bp, Mus musculus
aggcaatgtctcaaacttaacccgt

SEQ ID NO: 192106 - DNA, 25 bp, Mus musculus
aggcaatgtctctaacttaacccgt

SEQ ID NO: 192107 - DNA, 25 bp, Mus musculus
aggcaatgttcgcagccatctctag

SEQ ID NO: 192108 - DNA, 25 bp, Mus musculus
aggcaatgttcggagccatctctag

SEQ ID NO: 192109 - DNA, 25 bp, Mus musculus
aggcaattatccagattgtatgttt

SEQ ID NO: 192110 - DNA, 25 bp, Mus musculus
aggcaattatcctgattgtatgttt

SEQ ID NO: 192111 - DNA, 25 bp, Mus musculus
aggcaattcaagattgtgcagccaa

SEQ ID NO: 192112 - DNA, 25 bp, Mus musculus
aggcaattcaagtttgtgcagccaa

SEQ ID NO: 192113 - DNA, 25 bp, Mus musculus
aggcaattcagtacagttcagcatg

SEQ ID NO: 192114 - DNA, 25 bp, Mus musculus
aggcaattcagttcagttcagcatg

SEQ ID NO: 192115 - DNA, 25 bp, Mus musculus
aggcaattgggaccacttgctgttc

SEQ ID NO: 192116 - DNA, 25 bp, Mus musculus
aggcaattgggagcacttgctgttc

SEQ ID NO: 192117 - DNA, 25 bp, Mus musculus
aggcaattgtgaagccatttgggaa

SEQ ID NO: 192118 - DNA, 25 bp, Mus musculus
aggcaattgtgatgccatttgggaa

SEQ ID NO: 192119 - DNA, 25 bp, Mus musculus
aggcaattttaaaagacttcacaaa

SEQ ID NO: 192120 - DNA, 25 bp, Mus musculus
aggcaattttaatagacttcacaaa

SEQ ID NO: 192121 - DNA, 25 bp, Mus musculus
aggcacaaagagcaccccggtagcg

SEQ ID NO: 192122 - DNA, 25 bp, Mus musculus
aggcacaaagaggaccccggtagcg

SEQ ID NO: 192123 - DNA, 25 bp, Mus musculus
aggcacaaaggcagtcctagctttc

SEQ ID NO: 192124 - DNA, 25 bp, Mus musculus
aggcacaaaggctgtcctagctttc

SEQ ID NO: 192125 - DNA, 25 bp, Mus musculus
aggcacaaatccattcccagaagtt

SEQ ID NO: 192126 - DNA, 25 bp, Mus musculus
aggcacaaatcctttcccagaagtt

SEQ ID NO: 192127 - DNA, 25 bp, Mus musculus
aggcacaaccagcaaaggcgagaaa

SEQ ID NO: 192128 - DNA, 25 bp, Mus musculus
aggcacaaccaggaaaggcgagaaa

SEQ ID NO: 192129 - DNA, 25 bp, Mus musculus
aggcacaactacaggagtcctctct

SEQ ID NO: 192130 - DNA, 25 bp, Mus musculus
aggcacaactactggagtcctctct

SEQ ID NO: 192131 - DNA, 25 bp, Mus musculus
aggcacaagcgacagactgctcagt

SEQ ID NO: 192132 - DNA, 25 bp, Mus musculus
aggcacaagcgagagactgctcagt

SEQ ID NO: 192133 - DNA, 25 bp, Mus musculus
aggcacaataccatccaagttcatc

SEQ ID NO: 192134 - DNA, 25 bp, Mus musculus
aggcacaataccttccaagttcatc

SEQ ID NO: 192135 - DNA, 25 bp, Mus musculus
aggcacaatagcacatacctgttaa

SEQ ID NO: 192136 - DNA, 25 bp, Mus musculus
aggcacaatagctcatacctgttaa

SEQ ID NO: 192137 - DNA, 25 bp, Mus musculus
aggcacaatcacatcctggatcgtg

SEQ ID NO: 192138 - DNA, 25 bp, Mus musculus
aggcacaatcacttcctggatcgtg

SEQ ID NO: 192139 - DNA, 25 bp, Mus musculus
aggcacaatccccaggtgatctttg

SEQ ID NO: 192140 - DNA, 25 bp, Mus musculus
aggcacaatcccgaggtgatctttg

SEQ ID NO: 192141 - DNA, 25 bp, Mus musculus
aggcacaatgagcttcatgtgacat

SEQ ID NO: 192142 - DNA, 25 bp, Mus musculus
aggcacaatgaggttcatgtgacat

SEQ ID NO: 192143 - DNA, 25 bp, Mus musculus
aggcacaatgtgactggaaggacag

SEQ ID NO: 192144 - DNA, 25 bp, Mus musculus
aggcacaatgtgtctggaaggacag

SEQ ID NO: 192145 - DNA, 25 bp, Mus musculus
aggcacacaacactcggtttgctca

SEQ ID NO: 192146 - DNA, 25 bp, Mus musculus
aggcacacaacagtcggtttgctca

SEQ ID NO: 192147 - DNA, 25 bp, Mus musculus
aggcacacacatcgtctatatatgt

SEQ ID NO: 192148 - DNA, 25 bp, Mus musculus
aggcacacacatggtctatatatgt

SEQ ID NO: 192149 - DNA, 25 bp, Mus musculus
aggcacacactgctgatggcatctc

SEQ ID NO: 192150 - DNA, 25 bp, Mus musculus
aggcacacactggtgatggcatctc

SEQ ID NO: 192151 - DNA, 25 bp, Mus musculus
aggcacacacttaagcatcgatgag

SEQ ID NO: 192152 - DNA, 25 bp, Mus musculus
aggcacacactttagcatcgatgag

SEQ ID NO: 192153 - DNA, 25 bp, Mus musculus
aggcacacagggatgctttgctctc

SEQ ID NO: 192154 - DNA, 25 bp, Mus musculus
aggcacacagggttgctttgctctc

SEQ ID NO: 192155 - DNA, 25 bp, Mus musculus
aggcacacagtaagctgtccctagc

SEQ ID NO: 192156 - DNA, 25 bp, Mus musculus
aggcacacagtatgctgtccctagc

SEQ ID NO: 192157 - DNA, 25 bp, Mus musculus
aggcacacatggcagagtcctgctc

SEQ ID NO: 192158 - DNA, 25 bp, Mus musculus
aggcacacatgggagagtcctgctc

SEQ ID NO: 192159 - DNA, 25 bp, Mus musculus
aggcacaccaccattgatgtgtcta

SEQ ID NO: 192160 - DNA, 25 bp, Mus musculus
aggcacaccacctttgatgtgtcta

SEQ ID NO: 192161 - DNA, 25 bp, Mus musculus
aggcacaccggcactggaattccat

SEQ ID NO: 192162 - DNA, 25 bp, Mus musculus
aggcacaccggctctggaattccat

SEQ ID NO: 192163 - DNA, 25 bp, Mus musculus
aggcacacctgaaatctgacatgaa

SEQ ID NO: 192164 - DNA, 25 bp, Mus musculus
aggcacacctgatatctgacatgaa

SEQ ID NO: 192165 - DNA, 25 bp, Mus musculus
aggcacacgatgagaggcaccccag

SEQ ID NO: 192166 - DNA, 25 bp, Mus musculus
aggcacacgatgtgaggcaccccag

SEQ ID NO: 192167 - DNA, 25 bp, Mus musculus
aggcacacgcctatatatattggtt

SEQ ID NO: 192168 - DNA, 25 bp, Mus musculus
aggcacacgcctttatatattggtt

SEQ ID NO: 192169 - DNA, 25 bp, Mus musculus
aggcacactattattggcccatgct

SEQ ID NO: 192170 - DNA, 25 bp, Mus musculus
aggcacactattcttccgcgaaggt

SEQ ID NO: 192171 - DNA, 25 bp, Mus musculus
aggcacactattgttccgcgaaggt

SEQ ID NO: 192172 - DNA, 25 bp, Mus musculus
aggcacactatttttggcccatgct

SEQ ID NO: 192173 - DNA, 25 bp, Mus musculus
aggcacactccactgtcctaaagat

SEQ ID NO: 192174 - DNA, 25 bp, Mus musculus
aggcacactccagtgtcctaaagat

SEQ ID NO: 192175 - DNA, 25 bp, Mus musculus
aggcacactctccaagattgtccaa

SEQ ID NO: 192176 - DNA, 25 bp, Mus musculus
aggcacactctcgaagattgtccaa

SEQ ID NO: 192177 - DNA, 25 bp, Mus musculus
aggcacactgggaagtattctggct

SEQ ID NO: 192178 - DNA, 25 bp, Mus musculus
aggcacactgggtagtattctggct

SEQ ID NO: 192179 - DNA, 25 bp, Mus musculus
aggcacactgtgatatactgcatga

SEQ ID NO: 192180 - DNA, 25 bp, Mus musculus
aggcacactgtgttatactgcatga

SEQ ID NO: 192181 - DNA, 25 bp, Mus musculus
aggcacacttgcaactctatttttg

SEQ ID NO: 192182 - DNA, 25 bp, Mus musculus
aggcacacttgctactctatttttg

SEQ ID NO: 192183 - DNA, 25 bp, Mus musculus
aggcacagaaagctccttagagttg

SEQ ID NO: 192184 - DNA, 25 bp, Mus musculus
aggcacagaaaggtccttagagttg

SEQ ID NO: 192185 - DNA, 25 bp, Mus musculus
aggcacagaattaggctctacattt

SEQ ID NO: 192186 - DNA, 25 bp, Mus musculus
aggcacagaatttggctctacattt

SEQ ID NO: 192187 - DNA, 25 bp, Mus musculus
aggcacagacctagggacttccata

SEQ ID NO: 192188 - DNA, 25 bp, Mus musculus
aggcacagaccttgggacttccata

SEQ ID NO: 192189 - DNA, 25 bp, Mus musculus
aggcacagagaaattacttgatgaa

SEQ ID NO: 192190 - DNA, 25 bp, Mus musculus
aggcacagagaaccagtccctggac

SEQ ID NO: 192191 - DNA, 25 bp, Mus musculus
aggcacagagaactgaatctataga

SEQ ID NO: 192192 - DNA, 25 bp, Mus musculus
aggcacagagaagcagtccctggac

SEQ ID NO: 192193 - DNA, 25 bp, Mus musculus
aggcacagagaagtgaatctataga

SEQ ID NO: 192194 - DNA, 25 bp, Mus musculus
aggcacagagaatttacttgatgaa

SEQ ID NO: 192195 - DNA, 25 bp, Mus musculus
aggcacagagatcacctgggtgtta

SEQ ID NO: 192196 - DNA, 25 bp, Mus musculus
aggcacagagatgacctgggtgtta

SEQ ID NO: 192197 - DNA, 25 bp, Mus musculus
aggcacagagccacagatagagcta

SEQ ID NO: 192198 - DNA, 25 bp, Mus musculus
aggcacagagcctcagatagagcta

SEQ ID NO: 192199 - DNA, 25 bp, Mus musculus
aggcacagaggactctaggctgccc

SEQ ID NO: 192200 - DNA, 25 bp, Mus musculus
aggcacagaggagtctaggctgccc

SEQ ID NO: 192201 - DNA, 25 bp, Mus musculus
aggcacagatggcagctccttgcag

SEQ ID NO: 192202 - DNA, 25 bp, Mus musculus
aggcacagatgggagctccttgcag

SEQ ID NO: 192203 - DNA, 25 bp, Mus musculus
aggcacagcaacaccggaaaaagca

SEQ ID NO: 192204 - DNA, 25 bp, Mus musculus
aggcacagcaactccggaaaaagca

SEQ ID NO: 192205 - DNA, 25 bp, Mus musculus
aggcacagcagtctgcgtccaagga

SEQ ID NO: 192206 - DNA, 25 bp, Mus musculus
aggcacagcagtgtgcgtccaagga

SEQ ID NO: 192207 - DNA, 25 bp, Mus musculus
aggcacaggaggctcaccactgtca

SEQ ID NO: 192208 - DNA, 25 bp, Mus musculus
aggcacaggagggtcaccactgtca

SEQ ID NO: 192209 - DNA, 25 bp, Mus musculus
aggcacaggcacaagcacagtcaca

SEQ ID NO: 192210 - DNA, 25 bp, Mus musculus
aggcacaggcacaggtacaggtaca

SEQ ID NO: 192211 - DNA, 25 bp, Mus musculus
aggcacaggcactagcacagtcaca

SEQ ID NO: 192212 - DNA, 25 bp, Mus musculus
aggcacaggcactggtacaggtaca

SEQ ID NO: 192213 - DNA, 25 bp, Mus musculus
aggcacaggctgcttctagaacctt

SEQ ID NO: 192214 - DNA, 25 bp, Mus musculus
aggcacaggctggttctagaacctt

SEQ ID NO: 192215 - DNA, 25 bp, Mus musculus
aggcacagggagagggtgccccgca

SEQ ID NO: 192216 - DNA, 25 bp, Mus musculus
aggcacagggagtgggtgccccgca

SEQ ID NO: 192217 - DNA, 25 bp, Mus musculus
aggcacagtatcataggcacacacc

SEQ ID NO: 192218 - DNA, 25 bp, Mus musculus
aggcacagtatcttaggcacacacc

SEQ ID NO: 192219 - DNA, 25 bp, Mus musculus
aggcacagtccgatctggttgttca

SEQ ID NO: 192220 - DNA, 25 bp, Mus musculus
aggcacagtccgttctggttgttca

SEQ ID NO: 192221 - DNA, 25 bp, Mus musculus
aggcacatatgaagctcaccttgta

SEQ ID NO: 192222 - DNA, 25 bp, Mus musculus
aggcacatatgatgctcaccttgta

SEQ ID NO: 192223 - DNA, 25 bp, Mus musculus
aggcacatcctgctactggcacaga

SEQ ID NO: 192224 - DNA, 25 bp, Mus musculus
aggcacatcctggtactggcacaga

SEQ ID NO: 192225 - DNA, 25 bp, Mus musculus
aggcacatcgtccagctgcaccggg

SEQ ID NO: 192226 - DNA, 25 bp, Mus musculus
aggcacatcgtcgagctgcaccggg

SEQ ID NO: 192227 - DNA, 25 bp, Mus musculus
aggcacatctgtcagggattctcta

SEQ ID NO: 192228 - DNA, 25 bp, Mus musculus
aggcacatctgtgagggattctcta

SEQ ID NO: 192229 - DNA, 25 bp, Mus musculus
aggcacatggctctttggcgtctca

SEQ ID NO: 192230 - DNA, 25 bp, Mus musculus
aggcacatggctgtttggcgtctca

SEQ ID NO: 192231 - DNA, 25 bp, Mus musculus
aggcacatggtaactgacacagact

SEQ ID NO: 192232 - DNA, 25 bp, Mus musculus
aggcacatggtatctgacacagact

SEQ ID NO: 192233 - DNA, 25 bp, Mus musculus
aggcacattacactggggacatcaa

SEQ ID NO: 192234 - DNA, 25 bp, Mus musculus
aggcacattacagtggggacatcaa

SEQ ID NO: 192235 - DNA, 25 bp, Mus musculus
aggcacattttgcaacgtcttattt

SEQ ID NO: 192236 - DNA, 25 bp, Mus musculus
aggcacattttggaacgtcttattt

SEQ ID NO: 192237 - DNA, 25 bp, Mus musculus
aggcaccaagacaaggcttcctcaa

SEQ ID NO: 192238 - DNA, 25 bp, Mus musculus
aggcaccaagactaggcttcctcaa

SEQ ID NO: 192239 - DNA, 25 bp, Mus musculus
aggcaccacccaaggagaagcctga

SEQ ID NO: 192240 - DNA, 25 bp, Mus musculus
aggcaccacccatggagaagcctga

SEQ ID NO: 192241 - DNA, 25 bp, Mus musculus
aggcaccaccgcatgtggcaagatg

SEQ ID NO: 192242 - DNA, 25 bp, Mus musculus
aggcaccaccgcttgtggcaagatg

SEQ ID NO: 192243 - DNA, 25 bp, Mus musculus
aggcaccactggaccaattaccttt

SEQ ID NO: 192244 - DNA, 25 bp, Mus musculus
aggcaccactggtccaattaccttt

SEQ ID NO: 192245 - DNA, 25 bp, Mus musculus
aggcaccactgtatgtagtctctgc

SEQ ID NO: 192246 - DNA, 25 bp, Mus musculus
aggcaccactgtcactgtctcttca

SEQ ID NO: 192247 - DNA, 25 bp, Mus musculus
aggcaccactgtgactgtctcttca

SEQ ID NO: 192248 - DNA, 25 bp, Mus musculus
aggcaccactgtttgtagtctctgc

SEQ ID NO: 192249 - DNA, 25 bp, Mus musculus
aggcaccaggaaaacagtttatctt

SEQ ID NO: 192250 - DNA, 25 bp, Mus musculus
aggcaccaggaatacagtttatctt

SEQ ID NO: 192251 - DNA, 25 bp, Mus musculus
aggcaccaggtcagaatagtagctt

SEQ ID NO: 192252 - DNA, 25 bp, Mus musculus
aggcaccaggtctgaatagtagctt

SEQ ID NO: 192253 - DNA, 25 bp, Mus musculus
aggcaccagtccagttagatggata

SEQ ID NO: 192254 - DNA, 25 bp, Mus musculus
aggcaccagtcctgttagatggata

SEQ ID NO: 192255 - DNA, 25 bp, Mus musculus
aggcaccatcgtaccatctgtatgc

SEQ ID NO: 192256 - DNA, 25 bp, Mus musculus
aggcaccatcgttccatctgtatgc

SEQ ID NO: 192257 - DNA, 25 bp, Mus musculus
aggcaccatctgcagtttgctgcta

SEQ ID NO: 192258 - DNA, 25 bp, Mus musculus
aggcaccatctggagtttgctgcta

SEQ ID NO: 192259 - DNA, 25 bp, Mus musculus
aggcaccattcacttcagccttctg

SEQ ID NO: 192260 - DNA, 25 bp, Mus musculus
aggcaccattcagttcagccttctg

SEQ ID NO: 192261 - DNA, 25 bp, Mus musculus
aggcacccaaaaagccagcactatg

SEQ ID NO: 192262 - DNA, 25 bp, Mus musculus
aggcacccaaaatgccagcactatg

SEQ ID NO: 192263 - DNA, 25 bp, Mus musculus
aggcacccagacatcaagacaaaag

SEQ ID NO: 192264 - DNA, 25 bp, Mus musculus
aggcacccagacttcaagacaaaag

SEQ ID NO: 192265 - DNA, 25 bp, Mus musculus
aggcacccagccactgaagtcttgt

SEQ ID NO: 192266 - DNA, 25 bp, Mus musculus
aggcacccagcctctgaagtcttgt

SEQ ID NO: 192267 - DNA, 25 bp, Mus musculus
aggcacccaggaagttacccatgag

SEQ ID NO: 192268 - DNA, 25 bp, Mus musculus
aggcacccaggatgttacccatgag

SEQ ID NO: 192269 - DNA, 25 bp, Mus musculus
aggcacccaggtctcctagttggat

SEQ ID NO: 192270 - DNA, 25 bp, Mus musculus
aggcacccaggtgtcctagttggat

SEQ ID NO: 192271 - DNA, 25 bp, Mus musculus
aggcacccagttatgagttactcac

SEQ ID NO: 192272 - DNA, 25 bp, Mus musculus
aggcacccagttttgagttactcac

SEQ ID NO: 192273 - DNA, 25 bp, Mus musculus
aggcaccccagaagggtatgtccaa

SEQ ID NO: 192274 - DNA, 25 bp, Mus musculus
aggcaccccagatgggtatgtccaa

SEQ ID NO: 192275 - DNA, 25 bp, Mus musculus
aggcaccccattcagtaacttcttt

SEQ ID NO: 192276 - DNA, 25 bp, Mus musculus
aggcaccccattgagtaacttcttt

SEQ ID NO: 192277 - DNA, 25 bp, Mus musculus
aggcacccctgtacttgtatgtgga

SEQ ID NO: 192278 - DNA, 25 bp, Mus musculus
aggcacccctgttcttgtatgtgga

SEQ ID NO: 192279 - DNA, 25 bp, Mus musculus
aggcacccgctgcatttgttgggat

SEQ ID NO: 192280 - DNA, 25 bp, Mus musculus
aggcacccgctggatttgttgggat

SEQ ID NO: 192281 - DNA, 25 bp, Mus musculus
aggcaccctgggaacacacgagaac

SEQ ID NO: 192282 - DNA, 25 bp, Mus musculus
aggcaccctgggattcgtagtccgt

SEQ ID NO: 192283 - DNA, 25 bp, Mus musculus
aggcaccctgggtacacacgagaac

SEQ ID NO: 192284 - DNA, 25 bp, Mus musculus
aggcaccctgggtttcgtagtccgt

SEQ ID NO: 192285 - DNA, 25 bp, Mus musculus
aggcaccctgtcatcgtgttaaggc

SEQ ID NO: 192286 - DNA, 25 bp, Mus musculus
aggcaccctgtcttcgtgttaaggc

SEQ ID NO: 192287 - DNA, 25 bp, Mus musculus
aggcaccggcccagggccttaggca

SEQ ID NO: 192288 - DNA, 25 bp, Mus musculus
aggcaccggccctgggccttaggca

SEQ ID NO: 192289 - DNA, 25 bp, Mus musculus
aggcaccggcctcagcgaatgctga

SEQ ID NO: 192290 - DNA, 25 bp, Mus musculus
aggcaccggcctgagcgaatgctga

SEQ ID NO: 192291 - DNA, 25 bp, Mus musculus
aggcaccgtaaccaccagcagggtg

SEQ ID NO: 192292 - DNA, 25 bp, Mus musculus
aggcaccgtaacgaccagcagggtg

SEQ ID NO: 192293 - DNA, 25 bp, Mus musculus
aggcaccgtcagatttcagagaagt

SEQ ID NO: 192294 - DNA, 25 bp, Mus musculus
aggcaccgtcagttttcagagaagt

SEQ ID NO: 192295 - DNA, 25 bp, Mus musculus
aggcaccgtgctcagtggcttcagt

SEQ ID NO: 192296 - DNA, 25 bp, Mus musculus
aggcaccgtgctgagtggcttcagt

SEQ ID NO: 192297 - DNA, 25 bp, Mus musculus
aggcaccgttctccagatggtcatc

SEQ ID NO: 192298 - DNA, 25 bp, Mus musculus
aggcaccgttctgcagatggtcatc

SEQ ID NO: 192299 - DNA, 25 bp, Mus musculus
aggcacctacacagaattgcccgaa

SEQ ID NO: 192300 - DNA, 25 bp, Mus musculus
aggcacctacactgaattgcccgaa

SEQ ID NO: 192301 - DNA, 25 bp, Mus musculus
aggcacctaggacccatggcattca

SEQ ID NO: 192302 - DNA, 25 bp, Mus musculus
aggcacctaggagccatggcattca

SEQ ID NO: 192303 - DNA, 25 bp, Mus musculus
aggcacctataacctgttcttcgac

SEQ ID NO: 192304 - DNA, 25 bp, Mus musculus
aggcacctataagctgttcttcgac

SEQ ID NO: 192305 - DNA, 25 bp, Mus musculus
aggcacctcaagcacttttctgcta

SEQ ID NO: 192306 - DNA, 25 bp, Mus musculus
aggcacctcaagctgggaccgactg

SEQ ID NO: 192307 - DNA, 25 bp, Mus musculus
aggcacctcaaggacttttctgcta

SEQ ID NO: 192308 - DNA, 25 bp, Mus musculus
aggcacctcaaggtgggaccgactg

SEQ ID NO: 192309 - DNA, 25 bp, Mus musculus
aggcacctcacacaacacgttgcaa

SEQ ID NO: 192310 - DNA, 25 bp, Mus musculus
aggcacctcacagaacacgttgcaa

SEQ ID NO: 192311 - DNA, 25 bp, Mus musculus
aggcacctcactcgggattatgacc

SEQ ID NO: 192312 - DNA, 25 bp, Mus musculus
aggcacctcactggggattatgacc

SEQ ID NO: 192313 - DNA, 25 bp, Mus musculus
aggcacctcaggcaaacattcattc

SEQ ID NO: 192314 - DNA, 25 bp, Mus musculus
aggcacctcagggaaacattcattc

SEQ ID NO: 192315 - DNA, 25 bp, Mus musculus
aggcacctccaaactgggtagctac

SEQ ID NO: 192316 - DNA, 25 bp, Mus musculus
aggcacctccaatctgggtagctac

SEQ ID NO: 192317 - DNA, 25 bp, Mus musculus
aggcacctctgcatttaaagagata

SEQ ID NO: 192318 - DNA, 25 bp, Mus musculus
aggcacctctgcttttaaagagata

SEQ ID NO: 192319 - DNA, 25 bp, Mus musculus
aggcacctgaggactgagaccttcg

SEQ ID NO: 192320 - DNA, 25 bp, Mus musculus
aggcacctgaggtctgagaccttcg

SEQ ID NO: 192321 - DNA, 25 bp, Mus musculus
aggcacctgccaccattatctctta

SEQ ID NO: 192322 - DNA, 25 bp, Mus musculus
aggcacctgccagcattatctctta

SEQ ID NO: 192323 - DNA, 25 bp, Mus musculus
aggcacctgcccatgctatggagtg

SEQ ID NO: 192324 - DNA, 25 bp, Mus musculus
aggcacctgcccttgctatggagtg

SEQ ID NO: 192325 - DNA, 25 bp, Mus musculus
aggcacctggcaaggttcttggtcc

SEQ ID NO: 192326 - DNA, 25 bp, Mus musculus
aggcacctggcatggttcttggtcc

SEQ ID NO: 192327 - DNA, 25 bp, Mus musculus
aggcacctgggactcgttcttcatt

SEQ ID NO: 192328 - DNA, 25 bp, Mus musculus
aggcacctgggagtcgttcttcatt

SEQ ID NO: 192329 - DNA, 25 bp, Mus musculus
aggcacctgtagacaacacttggca

SEQ ID NO: 192330 - DNA, 25 bp, Mus musculus
aggcacctgtagtcaacacttggca

SEQ ID NO: 192331 - DNA, 25 bp, Mus musculus
aggcacctgtcgctctgttggaagc

SEQ ID NO: 192332 - DNA, 25 bp, Mus musculus
aggcacctgtcggtctgttggaagc

SEQ ID NO: 192333 - DNA, 25 bp, Mus musculus
aggcaccttagtcgcttttccctag

SEQ ID NO: 192334 - DNA, 25 bp, Mus musculus
aggcaccttagtggcttttccctag

SEQ ID NO: 192335 - DNA, 25 bp, Mus musculus
aggcaccttcacagtaggatgctat

SEQ ID NO: 192336 - DNA, 25 bp, Mus musculus
aggcaccttcactgtaggatgctat

SEQ ID NO: 192337 - DNA, 25 bp, Mus musculus
aggcaccttgcacagcaacttctgt

SEQ ID NO: 192338 - DNA, 25 bp, Mus musculus
aggcaccttgcagagcaacttctgt

SEQ ID NO: 192339 - DNA, 25 bp, Mus musculus
aggcaccttgctagtggaagaggaa

SEQ ID NO: 192340 - DNA, 25 bp, Mus musculus
aggcaccttgcttgtggaagaggaa

SEQ ID NO: 192341 - DNA, 25 bp, Mus musculus
aggcacctttatcactctgctgaat

SEQ ID NO: 192342 - DNA, 25 bp, Mus musculus
aggcacctttatgactctgctgaat

SEQ ID NO: 192343 - DNA, 25 bp, Mus musculus
aggcacctttcacttacatcagtaa

SEQ ID NO: 192344 - DNA, 25 bp, Mus musculus
aggcacctttcagttacatcagtaa

SEQ ID NO: 192345 - DNA, 25 bp, Mus musculus
aggcacctttctaggatgtcctcaa

SEQ ID NO: 192346 - DNA, 25 bp, Mus musculus
aggcacctttcttggatgtcctcaa

SEQ ID NO: 192347 - DNA, 25 bp, Mus musculus
aggcacctttgccacttaagctgcg

SEQ ID NO: 192348 - DNA, 25 bp, Mus musculus
aggcacctttgcgacttaagctgcg

SEQ ID NO: 192349 - DNA, 25 bp, Mus musculus
aggcaccttttaatactggagtcta

SEQ ID NO: 192350 - DNA, 25 bp, Mus musculus
aggcaccttttattactggagtcta

SEQ ID NO: 192351 - DNA, 25 bp, Mus musculus
aggcacgaagtgatcctggtctgtg

SEQ ID NO: 192352 - DNA, 25 bp, Mus musculus
aggcacgaagtgttcctggtctgtg

SEQ ID NO: 192353 - DNA, 25 bp, Mus musculus
aggcacgagacaacctgggaggaaa

SEQ ID NO: 192354 - DNA, 25 bp, Mus musculus
aggcacgagacatcctgggaggaaa

SEQ ID NO: 192355 - DNA, 25 bp, Mus musculus
aggcacgattagctgctctggatat

SEQ ID NO: 192356 - DNA, 25 bp, Mus musculus
aggcacgattaggtgctctggatat

SEQ ID NO: 192357 - DNA, 25 bp, Mus musculus
aggcacgattttcaatcctctctgc

SEQ ID NO: 192358 - DNA, 25 bp, Mus musculus
aggcacgattttgaatcctctctgc

SEQ ID NO: 192359 - DNA, 25 bp, Mus musculus
aggcacgcacggaaagccgagcccg

SEQ ID NO: 192360 - DNA, 25 bp, Mus musculus
aggcacgcacggtaagccgagcccg

SEQ ID NO: 192361 - DNA, 25 bp, Mus musculus
aggcacgcagtaacgcagacgggaa

SEQ ID NO: 192362 - DNA, 25 bp, Mus musculus
aggcacgcagtatcgcagacgggaa

SEQ ID NO: 192363 - DNA, 25 bp, Mus musculus
aggcacgcagtgacatggtcgagct

SEQ ID NO: 192364 - DNA, 25 bp, Mus musculus
aggcacgcagtgtcatggtcgagct

SEQ ID NO: 192365 - DNA, 25 bp, Mus musculus
aggcacgccatactggatgagtcct

SEQ ID NO: 192366 - DNA, 25 bp, Mus musculus
aggcacgccatagtggatgagtcct

SEQ ID NO: 192367 - DNA, 25 bp, Mus musculus
aggcacgccgcaatcaggtgctgag

SEQ ID NO: 192368 - DNA, 25 bp, Mus musculus
aggcacgccgcattcaggtgctgag

SEQ ID NO: 192369 - DNA, 25 bp, Mus musculus
aggcacgctctgctctgcataagga

SEQ ID NO: 192370 - DNA, 25 bp, Mus musculus
aggcacgctctggtctgcataagga

SEQ ID NO: 192371 - DNA, 25 bp, Mus musculus
aggcacggacacaccatgagcagag

SEQ ID NO: 192372 - DNA, 25 bp, Mus musculus
aggcacggacactccatgagcagag

SEQ ID NO: 192373 - DNA, 25 bp, Mus musculus
aggcacggtggcacttctctactgg

SEQ ID NO: 192374 - DNA, 25 bp, Mus musculus
aggcacggtggctcttctctactgg

SEQ ID NO: 192375 - DNA, 25 bp, Mus musculus
aggcacggtgtgcacgcatctgtca

SEQ ID NO: 192376 - DNA, 25 bp, Mus musculus
aggcacggtgtggacgcatctgtca

SEQ ID NO: 192377 - DNA, 25 bp, Mus musculus
aggcacgtgagtataaagctctttt

SEQ ID NO: 192378 - DNA, 25 bp, Mus musculus
aggcacgtgagtttaaagctctttt

SEQ ID NO: 192379 - DNA, 25 bp, Mus musculus
aggcacgtgatgagtgccccattca

SEQ ID NO: 192380 - DNA, 25 bp, Mus musculus
aggcacgtgatgtgtgccccattca

SEQ ID NO: 192381 - DNA, 25 bp, Mus musculus
aggcacgtgggcaggaaatacatca

SEQ ID NO: 192382 - DNA, 25 bp, Mus musculus
aggcacgtgggctggaaatacatca

SEQ ID NO: 192383 - DNA, 25 bp, Mus musculus
aggcacgtggtgatctcaggctctg

SEQ ID NO: 192384 - DNA, 25 bp, Mus musculus
aggcacgtggtgttctcaggctctg

SEQ ID NO: 192385 - DNA, 25 bp, Mus musculus
aggcacgtgtgccttctcttagtcc

SEQ ID NO: 192386 - DNA, 25 bp, Mus musculus
aggcacgtgtgcgttctcttagtcc

SEQ ID NO: 192387 - DNA, 25 bp, Mus musculus
aggcacgttcaacaggcgcaatggt

SEQ ID NO: 192388 - DNA, 25 bp, Mus musculus
aggcacgttcaagaggcgcaatggt

SEQ ID NO: 192389 - DNA, 25 bp, Mus musculus
aggcacgtttccatacatagtatgt

SEQ ID NO: 192390 - DNA, 25 bp, Mus musculus
aggcacgtttccttacatagtatgt

SEQ ID NO: 192391 - DNA, 25 bp, Mus musculus
aggcacgtttggacaggctgcatcc

SEQ ID NO: 192392 - DNA, 25 bp, Mus musculus
aggcacgtttggtcaggctgcatcc

SEQ ID NO: 192393 - DNA, 25 bp, Mus musculus
aggcactaacaaaggacgctcagaa

SEQ ID NO: 192394 - DNA, 25 bp, Mus musculus
aggcactaacaatggacgctcagaa

SEQ ID NO: 192395 - DNA, 25 bp, Mus musculus
aggcactaacacatgcagttcttta

SEQ ID NO: 192396 - DNA, 25 bp, Mus musculus
aggcactaacacttgcagttcttta

SEQ ID NO: 192397 - DNA, 25 bp, Mus musculus
aggcactaactgcactttgtcccag

SEQ ID NO: 192398 - DNA, 25 bp, Mus musculus
aggcactaactggactttgtcccag

SEQ ID NO: 192399 - DNA, 25 bp, Mus musculus
aggcactaagccagttctgacaccg

SEQ ID NO: 192400 - DNA, 25 bp, Mus musculus
aggcactaagcctgttctgacaccg

SEQ ID NO: 192401 - DNA, 25 bp, Mus musculus
aggcactaattgatctttaccctct

SEQ ID NO: 192402 - DNA, 25 bp, Mus musculus
aggcactaattgttctttaccctct

SEQ ID NO: 192403 - DNA, 25 bp, Mus musculus
aggcactacttcaatcgtagggcga

SEQ ID NO: 192404 - DNA, 25 bp, Mus musculus
aggcactacttctatcgtagggcga

SEQ ID NO: 192405 - DNA, 25 bp, Mus musculus
aggcactagctcatcaggactgggc

SEQ ID NO: 192406 - DNA, 25 bp, Mus musculus
aggcactagctcttcaggactgggc

SEQ ID NO: 192407 - DNA, 25 bp, Mus musculus
aggcactaggacactgcccagaggc

SEQ ID NO: 192408 - DNA, 25 bp, Mus musculus
aggcactaggactctgcccagaggc

SEQ ID NO: 192409 - DNA, 25 bp, Mus musculus
aggcactcagcaaggtgataaacaa

SEQ ID NO: 192410 - DNA, 25 bp, Mus musculus
aggcactcagcatggtgataaacaa

SEQ ID NO: 192411 - DNA, 25 bp, Mus musculus
aggcactcagccagaaaccactcag

SEQ ID NO: 192412 - DNA, 25 bp, Mus musculus
aggcactcagcctgaaaccactcag

SEQ ID NO: 192413 - DNA, 25 bp, Mus musculus
aggcactcattacctacatctggta

SEQ ID NO: 192414 - DNA, 25 bp, Mus musculus
aggcactcattagctacatctggta

SEQ ID NO: 192415 - DNA, 25 bp, Mus musculus
aggcactcatttctacctggcatac

SEQ ID NO: 192416 - DNA, 25 bp, Mus musculus
aggcactcatttgtacctggcatac

SEQ ID NO: 192417 - DNA, 25 bp, Mus musculus
aggcactcccatacaggattttcaa

SEQ ID NO: 192418 - DNA, 25 bp, Mus musculus
aggcactcccattcaggattttcaa

SEQ ID NO: 192419 - DNA, 25 bp, Mus musculus
aggcactccctcaagttgattagca

SEQ ID NO: 192420 - DNA, 25 bp, Mus musculus
aggcactccctctagttgattagca

SEQ ID NO: 192421 - DNA, 25 bp, Mus musculus
aggcactcgctgatgatctgataaa

SEQ ID NO: 192422 - DNA, 25 bp, Mus musculus
aggcactcgctgttgatctgataaa

SEQ ID NO: 192423 - DNA, 25 bp, Mus musculus
aggcactcggtgcatggtactaacc

SEQ ID NO: 192424 - DNA, 25 bp, Mus musculus
aggcactcggtggatggtactaacc

SEQ ID NO: 192425 - DNA, 25 bp, Mus musculus
aggcactctcttatctgactatcag

SEQ ID NO: 192426 - DNA, 25 bp, Mus musculus
aggcactctcttttctgactatcag

SEQ ID NO: 192427 - DNA, 25 bp, Mus musculus
aggcactctgatctggtcacaaagg

SEQ ID NO: 192428 - DNA, 25 bp, Mus musculus
aggcactctgatgtggtcacaaagg

SEQ ID NO: 192429 - DNA, 25 bp, Mus musculus
aggcactctggtattacgttatctc

SEQ ID NO: 192430 - DNA, 25 bp, Mus musculus
aggcactctggttttacgttatctc

SEQ ID NO: 192431 - DNA, 25 bp, Mus musculus
aggcactgaaaactccgaggcccag

SEQ ID NO: 192432 - DNA, 25 bp, Mus musculus
aggcactgaaaagtccgaggcccag

SEQ ID NO: 192433 - DNA, 25 bp, Mus musculus
aggcactgaagtagatcccacatcc

SEQ ID NO: 192434 - DNA, 25 bp, Mus musculus
aggcactgaagttgatcccacatcc

SEQ ID NO: 192435 - DNA, 25 bp, Mus musculus
aggcactgacctatgagtaaaccgc

SEQ ID NO: 192436 - DNA, 25 bp, Mus musculus
aggcactgacctttgagtaaaccgc

SEQ ID NO: 192437 - DNA, 25 bp, Mus musculus
aggcactgatccagcaaacctgaac

SEQ ID NO: 192438 - DNA, 25 bp, Mus musculus
aggcactgatcctgcaaacctgaac

SEQ ID NO: 192439 - DNA, 25 bp, Mus musculus
aggcactgcacaaggaagctccagg

SEQ ID NO: 192440 - DNA, 25 bp, Mus musculus
aggcactgcacacacttggtaaaca

SEQ ID NO: 192441 - DNA, 25 bp, Mus musculus
aggcactgcacagacttggtaaaca

SEQ ID NO: 192442 - DNA, 25 bp, Mus musculus
aggcactgcacatggaagctccagg

SEQ ID NO: 192443 - DNA, 25 bp, Mus musculus
aggcactgcagaacttgagtccaca

SEQ ID NO: 192444 - DNA, 25 bp, Mus musculus
aggcactgcagatcttgagtccaca

SEQ ID NO: 192445 - DNA, 25 bp, Mus musculus
aggcactgccctacctagttggtgg

SEQ ID NO: 192446 - DNA, 25 bp, Mus musculus
aggcactgcccttcctagttggtgg

SEQ ID NO: 192447 - DNA, 25 bp, Mus musculus
aggcactggaaaccctctgtcttcc

SEQ ID NO: 192448 - DNA, 25 bp, Mus musculus
aggcactggaaagcctctgtcttcc

SEQ ID NO: 192449 - DNA, 25 bp, Mus musculus
aggcactggagtccttgacatggct

SEQ ID NO: 192450 - DNA, 25 bp, Mus musculus
aggcactggagtgcttgacatggct

SEQ ID NO: 192451 - DNA, 25 bp, Mus musculus
aggcactggcagacaagcagctaga

SEQ ID NO: 192452 - DNA, 25 bp, Mus musculus
aggcactggcagtcaagcagctaga

SEQ ID NO: 192453 - DNA, 25 bp, Mus musculus
aggcactggtccctcttgttgctga

SEQ ID NO: 192454 - DNA, 25 bp, Mus musculus
aggcactggtccgtcttgttgctga

SEQ ID NO: 192455 - DNA, 25 bp, Mus musculus
aggcactggtggaactcacctttta

SEQ ID NO: 192456 - DNA, 25 bp, Mus musculus
aggcactggtggcttcatcgagcac

SEQ ID NO: 192457 - DNA, 25 bp, Mus musculus
aggcactggtgggttcatcgagcac

SEQ ID NO: 192458 - DNA, 25 bp, Mus musculus
aggcactggtggtactcacctttta

SEQ ID NO: 192459 - DNA, 25 bp, Mus musculus
aggcactgtaggaggaagcggactt

SEQ ID NO: 192460 - DNA, 25 bp, Mus musculus
aggcactgtaggtggaagcggactt

SEQ ID NO: 192461 - DNA, 25 bp, Mus musculus
aggcactgtattccctttgctgggc

SEQ ID NO: 192462 - DNA, 25 bp, Mus musculus
aggcactgtattgcctttgctgggc

SEQ ID NO: 192463 - DNA, 25 bp, Mus musculus
aggcactgtcacagcaggtactgtc

SEQ ID NO: 192464 - DNA, 25 bp, Mus musculus
aggcactgtcactgcaggtactgtc

SEQ ID NO: 192465 - DNA, 25 bp, Mus musculus
aggcactgtgcccaaaggactagaa

SEQ ID NO: 192466 - DNA, 25 bp, Mus musculus
aggcactgtgccgaaaggactagaa

SEQ ID NO: 192467 - DNA, 25 bp, Mus musculus
aggcactgttctcaaaagggctcaa

SEQ ID NO: 192468 - DNA, 25 bp, Mus musculus
aggcactgttctgaaaagggctcaa

SEQ ID NO: 192469 - DNA, 25 bp, Mus musculus
aggcactgtttccacggctgaagtt

SEQ ID NO: 192470 - DNA, 25 bp, Mus musculus
aggcactgtttcgacggctgaagtt

SEQ ID NO: 192471 - DNA, 25 bp, Mus musculus
aggcacttaaagcttcctggcaaag

SEQ ID NO: 192472 - DNA, 25 bp, Mus musculus
aggcacttaaaggttcctggcaaag

SEQ ID NO: 192473 - DNA, 25 bp, Mus musculus
aggcacttaactcaagccccgaatt

SEQ ID NO: 192474 - DNA, 25 bp, Mus musculus
aggcacttaactgaagccccgaatt

SEQ ID NO: 192475 - DNA, 25 bp, Mus musculus
aggcacttaccacttcagaatgacc

SEQ ID NO: 192476 - DNA, 25 bp, Mus musculus
aggcacttaccagttcagaatgacc

SEQ ID NO: 192477 - DNA, 25 bp, Mus musculus
aggcacttactgaccattagtatgt

SEQ ID NO: 192478 - DNA, 25 bp, Mus musculus
aggcacttactgtccattagtatgt

SEQ ID NO: 192479 - DNA, 25 bp, Mus musculus
aggcacttaggcagcagcccagagt

SEQ ID NO: 192480 - DNA, 25 bp, Mus musculus
aggcacttaggctgcagcccagagt

SEQ ID NO: 192481 - DNA, 25 bp, Mus musculus
aggcacttcagaccatgcattaagt

SEQ ID NO: 192482 - DNA, 25 bp, Mus musculus
aggcacttcagagcatgcattaagt

SEQ ID NO: 192483 - DNA, 25 bp, Mus musculus
aggcacttcccacttgataactaat

SEQ ID NO: 192484 - DNA, 25 bp, Mus musculus
aggcacttcccagttgataactaat

SEQ ID NO: 192485 - DNA, 25 bp, Mus musculus
aggcacttgctgacaacgttttgag

SEQ ID NO: 192486 - DNA, 25 bp, Mus musculus
aggcacttgctgtcaacgttttgag

SEQ ID NO: 192487 - DNA, 25 bp, Mus musculus
aggcacttggatctgtttcctacaa

SEQ ID NO: 192488 - DNA, 25 bp, Mus musculus
aggcacttggatgtgtttcctacaa

SEQ ID NO: 192489 - DNA, 25 bp, Mus musculus
aggcacttggccatttcagggcaac

SEQ ID NO: 192490 - DNA, 25 bp, Mus musculus
aggcacttggccttttcagggcaac

SEQ ID NO: 192491 - DNA, 25 bp, Mus musculus
aggcacttggtacagcacctggtcc

SEQ ID NO: 192492 - DNA, 25 bp, Mus musculus
aggcacttggtagagcacctggtcc

SEQ ID NO: 192493 - DNA, 25 bp, Mus musculus
aggcacttgtagcttcatacttaat

SEQ ID NO: 192494 - DNA, 25 bp, Mus musculus
aggcacttgtaggttcatacttaat

SEQ ID NO: 192495 - DNA, 25 bp, Mus musculus
aggcacttgtggcaggcagcaattc

SEQ ID NO: 192496 - DNA, 25 bp, Mus musculus
aggcacttgtgggaggcagcaattc

SEQ ID NO: 192497 - DNA, 25 bp, Mus musculus
aggcactttagtcctgctggccgcg

SEQ ID NO: 192498 - DNA, 25 bp, Mus musculus
aggcactttagtgctgctggccgcg

SEQ ID NO: 192499 - DNA, 25 bp, Mus musculus
aggcactttctcagataagcactat

SEQ ID NO: 192500 - DNA, 25 bp, Mus musculus
aggcactttctctgataagcactat

SEQ ID NO: 192501 - DNA, 25 bp, Mus musculus
aggcactttgcaaccaagctggaca

SEQ ID NO: 192502 - DNA, 25 bp, Mus musculus
aggcactttgcatccaagctggaca

SEQ ID NO: 192503 - DNA, 25 bp, Mus musculus
aggcagaaaattacctctgtctccc

SEQ ID NO: 192504 - DNA, 25 bp, Mus musculus
aggcagaaaatttcctctgtctccc

SEQ ID NO: 192505 - DNA, 25 bp, Mus musculus
aggcagaaaccacacagcaggaccc

SEQ ID NO: 192506 - DNA, 25 bp, Mus musculus
aggcagaaaccagacagcaggaccc

SEQ ID NO: 192507 - DNA, 25 bp, Mus musculus
aggcagaacactaacctgaccatgg

SEQ ID NO: 192508 - DNA, 25 bp, Mus musculus
aggcagaacacttacctgaccatgg

SEQ ID NO: 192509 - DNA, 25 bp, Mus musculus
aggcagaacccactgtttggatgct

SEQ ID NO: 192510 - DNA, 25 bp, Mus musculus
aggcagaacccagtgtttggatgct

SEQ ID NO: 192511 - DNA, 25 bp, Mus musculus
aggcagaaccccaaggccaggctgg

SEQ ID NO: 192512 - DNA, 25 bp, Mus musculus
aggcagaacccctaggccaggctgg

SEQ ID NO: 192513 - DNA, 25 bp, Mus musculus
aggcagaacctaactgtctcctgaa

SEQ ID NO: 192514 - DNA, 25 bp, Mus musculus
aggcagaacctatctgtctcctgaa

SEQ ID NO: 192515 - DNA, 25 bp, Mus musculus
aggcagaacggcctgtactcacaca

SEQ ID NO: 192516 - DNA, 25 bp, Mus musculus
aggcagaacggcgtgtactcacaca

SEQ ID NO: 192517 - DNA, 25 bp, Mus musculus
aggcagaactcgactgacatgctcc

SEQ ID NO: 192518 - DNA, 25 bp, Mus musculus
aggcagaactcgtctgacatgctcc

SEQ ID NO: 192519 - DNA, 25 bp, Mus musculus
aggcagaagagtcggctttcactgt

SEQ ID NO: 192520 - DNA, 25 bp, Mus musculus
aggcagaagagtgggctttcactgt

SEQ ID NO: 192521 - DNA, 25 bp, Mus musculus
aggcagaagcagcactgacgtcacc

SEQ ID NO: 192522 - DNA, 25 bp, Mus musculus
aggcagaagcaggactgacgtcacc

SEQ ID NO: 192523 - DNA, 25 bp, Mus musculus
aggcagaagcctaaaacggtcattt

SEQ ID NO: 192524 - DNA, 25 bp, Mus musculus
aggcagaagccttaaacggtcattt

SEQ ID NO: 192525 - DNA, 25 bp, Mus musculus
aggcagaaggacagagttatggtaa

SEQ ID NO: 192526 - DNA, 25 bp, Mus musculus
aggcagaaggactgagttatggtaa

SEQ ID NO: 192527 - DNA, 25 bp, Mus musculus
aggcagaagtcccatcagccatggc

SEQ ID NO: 192528 - DNA, 25 bp, Mus musculus
aggcagaagtccgatcagccatggc

SEQ ID NO: 192529 - DNA, 25 bp, Mus musculus
aggcagacaaatccatcggctatgg

SEQ ID NO: 192530 - DNA, 25 bp, Mus musculus
aggcagacaaatgcatcggctatgg

SEQ ID NO: 192531 - DNA, 25 bp, Mus musculus
aggcagacaccaaagtgaatcccaa

SEQ ID NO: 192532 - DNA, 25 bp, Mus musculus
aggcagacaccatagtgaatcccaa

SEQ ID NO: 192533 - DNA, 25 bp, Mus musculus
aggcagacacgcaacttatatttat

SEQ ID NO: 192534 - DNA, 25 bp, Mus musculus
aggcagacacgctacttatatttat

SEQ ID NO: 192535 - DNA, 25 bp, Mus musculus
aggcagacactgatcgtgaatcaca

SEQ ID NO: 192536 - DNA, 25 bp, Mus musculus
aggcagacactgttcgtgaatcaca

SEQ ID NO: 192537 - DNA, 25 bp, Mus musculus
aggcagacagatccctgggattaca

SEQ ID NO: 192538 - DNA, 25 bp, Mus musculus
aggcagacagatgcctgggattaca

SEQ ID NO: 192539 - DNA, 25 bp, Mus musculus
aggcagacaggaactcttctgagtt

SEQ ID NO: 192540 - DNA, 25 bp, Mus musculus
aggcagacaggatctcttctgagtt

SEQ ID NO: 192541 - DNA, 25 bp, Mus musculus
aggcagaccatgatctacgcggagg

SEQ ID NO: 192542 - DNA, 25 bp, Mus musculus
aggcagaccatgttctacgcggagg

SEQ ID NO: 192543 - DNA, 25 bp, Mus musculus
aggcagacgcagaaatctctccaca

SEQ ID NO: 192544 - DNA, 25 bp, Mus musculus
aggcagacgcagtaatctctccaca

SEQ ID NO: 192545 - DNA, 25 bp, Mus musculus
aggcagacgtgaacttggtgaacgc

SEQ ID NO: 192546 - DNA, 25 bp, Mus musculus
aggcagacgtgatcttggtgaacgc

SEQ ID NO: 192547 - DNA, 25 bp, Mus musculus
aggcagactgaaccttgtacactca

SEQ ID NO: 192548 - DNA, 25 bp, Mus musculus
aggcagactgaagcttgtacactca

SEQ ID NO: 192549 - DNA, 25 bp, Mus musculus
aggcagacttacagtaggcattcaa

SEQ ID NO: 192550 - DNA, 25 bp, Mus musculus
aggcagacttactgtaggcattcaa

SEQ ID NO: 192551 - DNA, 25 bp, Mus musculus
aggcagacttttcgccacagcgtgg

SEQ ID NO: 192552 - DNA, 25 bp, Mus musculus
aggcagacttttggccacagcgtgg

SEQ ID NO: 192553 - DNA, 25 bp, Mus musculus
aggcagagaaccagcccactggtgt

SEQ ID NO: 192554 - DNA, 25 bp, Mus musculus
aggcagagaacctgcccactggtgt

SEQ ID NO: 192555 - DNA, 25 bp, Mus musculus
aggcagagaccccacagtcacatat

SEQ ID NO: 192556 - DNA, 25 bp, Mus musculus
aggcagagacccgacagtcacatat

SEQ ID NO: 192557 - DNA, 25 bp, Mus musculus
aggcagagagcaaggtcctgaccca

SEQ ID NO: 192558 - DNA, 25 bp, Mus musculus
aggcagagagcatggtcctgaccca

SEQ ID NO: 192559 - DNA, 25 bp, Mus musculus
aggcagagatctatatctgaccctc

SEQ ID NO: 192560 - DNA, 25 bp, Mus musculus
aggcagagatctttatctgaccctc

SEQ ID NO: 192561 - DNA, 25 bp, Mus musculus
aggcagagcagaacgccctcaaggg

SEQ ID NO: 192562 - DNA, 25 bp, Mus musculus
aggcagagcagatcgccctcaaggg

SEQ ID NO: 192563 - DNA, 25 bp, Mus musculus
aggcagagctcactgctgtttgctt

SEQ ID NO: 192564 - DNA, 25 bp, Mus musculus
aggcagagctcagtgctgtttgctt

SEQ ID NO: 192565 - DNA, 25 bp, Mus musculus
aggcagagctgaattcagaccgtgt

SEQ ID NO: 192566 - DNA, 25 bp, Mus musculus
aggcagagctgatttcagaccgtgt

SEQ ID NO: 192567 - DNA, 25 bp, Mus musculus
aggcagaggagcctgtccctgcttc

SEQ ID NO: 192568 - DNA, 25 bp, Mus musculus
aggcagaggagcgtgtccctgcttc

SEQ ID NO: 192569 - DNA, 25 bp, Mus musculus
aggcagaggcagacacagacggatt

SEQ ID NO: 192570 - DNA, 25 bp, Mus musculus
aggcagaggcagtcacagacggatt

SEQ ID NO: 192571 - DNA, 25 bp, Mus musculus
aggcagaggcgcatatctgtccgca

SEQ ID NO: 192572 - DNA, 25 bp, Mus musculus
aggcagaggcgcttatctgtccgca

SEQ ID NO: 192573 - DNA, 25 bp, Mus musculus
aggcagaggctccttctgctacctg

SEQ ID NO: 192574 - DNA, 25 bp, Mus musculus
aggcagaggctcgttctgctacctg

SEQ ID NO: 192575 - DNA, 25 bp, Mus musculus
aggcagaggcttctaaatttatcca

SEQ ID NO: 192576 - DNA, 25 bp, Mus musculus
aggcagaggcttgtaaatttatcca

SEQ ID NO: 192577 - DNA, 25 bp, Mus musculus
aggcagagggcaccgactccagcac

SEQ ID NO: 192578 - DNA, 25 bp, Mus musculus
aggcagagggcagcgactccagcac

SEQ ID NO: 192579 - DNA, 25 bp, Mus musculus
aggcagagtagtcacatttcaccag

SEQ ID NO: 192580 - DNA, 25 bp, Mus musculus
aggcagagtagtgacatttcaccag

SEQ ID NO: 192581 - DNA, 25 bp, Mus musculus
aggcagagtatgagcgggccctctt

SEQ ID NO: 192582 - DNA, 25 bp, Mus musculus
aggcagagtatgtgcgggccctctt

SEQ ID NO: 192583 - DNA, 25 bp, Mus musculus
aggcagagtctcctggcttcagtgc

SEQ ID NO: 192584 - DNA, 25 bp, Mus musculus
aggcagagtctcgtggcttcagtgc

SEQ ID NO: 192585 - DNA, 25 bp, Mus musculus
aggcagagtgctacccagctgtcat

SEQ ID NO: 192586 - DNA, 25 bp, Mus musculus
aggcagagtgcttcccagctgtcat

SEQ ID NO: 192587 - DNA, 25 bp, Mus musculus
aggcagagtttcaggccctgcggca

SEQ ID NO: 192588 - DNA, 25 bp, Mus musculus
aggcagagtttcatcagtgttccca

SEQ ID NO: 192589 - DNA, 25 bp, Mus musculus
aggcagagtttctggccctgcggca

SEQ ID NO: 192590 - DNA, 25 bp, Mus musculus
aggcagagtttcttcagtgttccca

SEQ ID NO: 192591 - DNA, 25 bp, Mus musculus
aggcagataatcattgaatttcatc

SEQ ID NO: 192592 - DNA, 25 bp, Mus musculus
aggcagataatctttgaatttcatc

SEQ ID NO: 192593 - DNA, 25 bp, Mus musculus
aggcagatagcaaacccctgtaatc

SEQ ID NO: 192594 - DNA, 25 bp, Mus musculus
aggcagatagcatacccctgtaatc

SEQ ID NO: 192595 - DNA, 25 bp, Mus musculus
aggcagatcacactagaggcaccgc

SEQ ID NO: 192596 - DNA, 25 bp, Mus musculus
aggcagatcacagtagaggcaccgc

SEQ ID NO: 192597 - DNA, 25 bp, Mus musculus
aggcagatcagcatcttgcttcact

SEQ ID NO: 192598 - DNA, 25 bp, Mus musculus
aggcagatcagcttcttgcttcact

SEQ ID NO: 192599 - DNA, 25 bp, Mus musculus
aggcagatccacaagtgtcaatgtc

SEQ ID NO: 192600 - DNA, 25 bp, Mus musculus
aggcagatccactagtgtcaatgtc

SEQ ID NO: 192601 - DNA, 25 bp, Mus musculus
aggcagatccccaatgcaagctgtg

SEQ ID NO: 192602 - DNA, 25 bp, Mus musculus
aggcagatcccctatgcaagctgtg

SEQ ID NO: 192603 - DNA, 25 bp, Mus musculus
aggcagatctgaatgacatcctgtg

SEQ ID NO: 192604 - DNA, 25 bp, Mus musculus
aggcagatctgattgacatcctgtg

SEQ ID NO: 192605 - DNA, 25 bp, Mus musculus
aggcagatgaacaacgcggcacagc

SEQ ID NO: 192606 - DNA, 25 bp, Mus musculus
aggcagatgaacactccttggctac

SEQ ID NO: 192607 - DNA, 25 bp, Mus musculus
aggcagatgaactacgcggcacagc

SEQ ID NO: 192608 - DNA, 25 bp, Mus musculus
aggcagatgaactctccttggctac

SEQ ID NO: 192609 - DNA, 25 bp, Mus musculus
aggcagatgacacctctgagcccct

SEQ ID NO: 192610 - DNA, 25 bp, Mus musculus
aggcagatgacagctctgagcccct

SEQ ID NO: 192611 - DNA, 25 bp, Mus musculus
aggcagatgcatagttccggtggct

SEQ ID NO: 192612 - DNA, 25 bp, Mus musculus
aggcagatgcattgttccggtggct

SEQ ID NO: 192613 - DNA, 25 bp, Mus musculus
aggcagatgcccagccagaaggcgc

SEQ ID NO: 192614 - DNA, 25 bp, Mus musculus
aggcagatgccctgccagaaggcgc

SEQ ID NO: 192615 - DNA, 25 bp, Mus musculus
aggcagatgctgcaatcggtgcatt

SEQ ID NO: 192616 - DNA, 25 bp, Mus musculus
aggcagatgctggaatcggtgcatt

SEQ ID NO: 192617 - DNA, 25 bp, Mus musculus
aggcagatggagcagcgcatcacct

SEQ ID NO: 192618 - DNA, 25 bp, Mus musculus
aggcagatggaggagcgcatcacct

SEQ ID NO: 192619 - DNA, 25 bp, Mus musculus
aggcagatgtccacattgtcacctg

SEQ ID NO: 192620 - DNA, 25 bp, Mus musculus
aggcagatgtcctcattgtcacctg

SEQ ID NO: 192621 - DNA, 25 bp, Mus musculus
aggcagatgttcataatccagtcat

SEQ ID NO: 192622 - DNA, 25 bp, Mus musculus
aggcagatgttcatgtgggcattat

SEQ ID NO: 192623 - DNA, 25 bp, Mus musculus
aggcagatgttcttaatccagtcat

SEQ ID NO: 192624 - DNA, 25 bp, Mus musculus
aggcagatgttcttgtgggcattat

SEQ ID NO: 192625 - DNA, 25 bp, Mus musculus
aggcagattctccatcggtatttta

SEQ ID NO: 192626 - DNA, 25 bp, Mus musculus
aggcagattctcgatcggtatttta

SEQ ID NO: 192627 - DNA, 25 bp, Mus musculus
aggcagattgccactgatcgctgtg

SEQ ID NO: 192628 - DNA, 25 bp, Mus musculus
aggcagattgcctctgatcgctgtg

SEQ ID NO: 192629 - DNA, 25 bp, Mus musculus
aggcagattggacgcattctcaccc

SEQ ID NO: 192630 - DNA, 25 bp, Mus musculus
aggcagattggaggcattctcaccc

SEQ ID NO: 192631 - DNA, 25 bp, Mus musculus
aggcagattttcattggtcttgctc

SEQ ID NO: 192632 - DNA, 25 bp, Mus musculus
aggcagattttctttggtcttgctc

SEQ ID NO: 192633 - DNA, 25 bp, Mus musculus
aggcagcaacatctccttggagagc

SEQ ID NO: 192634 - DNA, 25 bp, Mus musculus
aggcagcaacatgtccttggagagc

SEQ ID NO: 192635 - DNA, 25 bp, Mus musculus
aggcagcaacgcaggatcggtctcc

SEQ ID NO: 192636 - DNA, 25 bp, Mus musculus
aggcagcaacgctggatcggtctcc

SEQ ID NO: 192637 - DNA, 25 bp, Mus musculus
aggcagcaagccatgtatttaccat

SEQ ID NO: 192638 - DNA, 25 bp, Mus musculus
aggcagcaagccttgtatttaccat

SEQ ID NO: 192639 - DNA, 25 bp, Mus musculus
aggcagcaccttagtgtctcagtgt

SEQ ID NO: 192640 - DNA, 25 bp, Mus musculus
aggcagcacctttgtgtctcagtgt

SEQ ID NO: 192641 - DNA, 25 bp, Mus musculus
aggcagcacgaacagccagagagct

SEQ ID NO: 192642 - DNA, 25 bp, Mus musculus
aggcagcacgaagagccagagagct

SEQ ID NO: 192643 - DNA, 25 bp, Mus musculus
aggcagcactacagcagctgagcta

SEQ ID NO: 192644 - DNA, 25 bp, Mus musculus
aggcagcactactgcagctgagcta

SEQ ID NO: 192645 - DNA, 25 bp, Mus musculus
aggcagcactgaacctctgtggact

SEQ ID NO: 192646 - DNA, 25 bp, Mus musculus
aggcagcactgatcctctgtggact

SEQ ID NO: 192647 - DNA, 25 bp, Mus musculus
aggcagcacttgaagagcatctttg

SEQ ID NO: 192648 - DNA, 25 bp, Mus musculus
aggcagcacttgtagagcatctttg

SEQ ID NO: 192649 - DNA, 25 bp, Mus musculus
aggcagcagaacacttgtgaatcag

SEQ ID NO: 192650 - DNA, 25 bp, Mus musculus
aggcagcagaactcttgtgaatcag

SEQ ID NO: 192651 - DNA, 25 bp, Mus musculus
aggcagcagagcaccgagagccagt

SEQ ID NO: 192652 - DNA, 25 bp, Mus musculus
aggcagcagagctccgagagccagt

SEQ ID NO: 192653 - DNA, 25 bp, Mus musculus
aggcagcagaggatttcctccctcc

SEQ ID NO: 192654 - DNA, 25 bp, Mus musculus
aggcagcagaggttttcctccctcc

SEQ ID NO: 192655 - DNA, 25 bp, Mus musculus
aggcagcagcagatgctaaagaaga

SEQ ID NO: 192656 - DNA, 25 bp, Mus musculus
aggcagcagcagttgctaaagaaga

SEQ ID NO: 192657 - DNA, 25 bp, Mus musculus
aggcagcagctaagctgggactggc

SEQ ID NO: 192658 - DNA, 25 bp, Mus musculus
aggcagcagctatgctgggactggc

SEQ ID NO: 192659 - DNA, 25 bp, Mus musculus
aggcagcagctgagagatgattctc

SEQ ID NO: 192660 - DNA, 25 bp, Mus musculus
aggcagcagctgtgagatgattctc

SEQ ID NO: 192661 - DNA, 25 bp, Mus musculus
aggcagcagcttatctgtccaagga

SEQ ID NO: 192662 - DNA, 25 bp, Mus musculus
aggcagcagcttttctgtccaagga

SEQ ID NO: 192663 - DNA, 25 bp, Mus musculus
aggcagcaggctcaccgtttggaat

SEQ ID NO: 192664 - DNA, 25 bp, Mus musculus
aggcagcaggctgaccgtttggaat

SEQ ID NO: 192665 - DNA, 25 bp, Mus musculus
aggcagcaggtgctccttccagctg

SEQ ID NO: 192666 - DNA, 25 bp, Mus musculus
aggcagcaggtggtccttccagctg

SEQ ID NO: 192667 - DNA, 25 bp, Mus musculus
aggcagcatacacttgttggtccaa

SEQ ID NO: 192668 - DNA, 25 bp, Mus musculus
aggcagcatacagttgttggtccaa

SEQ ID NO: 192669 - DNA, 25 bp, Mus musculus
aggcagcatgctcctatgtacaaac

SEQ ID NO: 192670 - DNA, 25 bp, Mus musculus
aggcagcatgctgctatgtacaaac

SEQ ID NO: 192671 - DNA, 25 bp, Mus musculus
aggcagcattacatctttcaggaag

SEQ ID NO: 192672 - DNA, 25 bp, Mus musculus
aggcagcattacttctttcaggaag

SEQ ID NO: 192673 - DNA, 25 bp, Mus musculus
aggcagcattccaagatgtcctggc

SEQ ID NO: 192674 - DNA, 25 bp, Mus musculus
aggcagcattcctagatgtcctggc

SEQ ID NO: 192675 - DNA, 25 bp, Mus musculus
aggcagcattctagggtcccttgtg

SEQ ID NO: 192676 - DNA, 25 bp, Mus musculus
aggcagcattcttgggtcccttgtg

SEQ ID NO: 192677 - DNA, 25 bp, Mus musculus
aggcagcattgaccagccagaagaa

SEQ ID NO: 192678 - DNA, 25 bp, Mus musculus
aggcagcattgagcagccagaagaa

SEQ ID NO: 192679 - DNA, 25 bp, Mus musculus
aggcagccaagaacgcgcgcatcac

SEQ ID NO: 192680 - DNA, 25 bp, Mus musculus
aggcagccaagatcgcgcgcatcac

SEQ ID NO: 192681 - DNA, 25 bp, Mus musculus
aggcagccacaacaggccagctaat

SEQ ID NO: 192682 - DNA, 25 bp, Mus musculus
aggcagccacaagaggccagctaat

SEQ ID NO: 192683 - DNA, 25 bp, Mus musculus
aggcagccacacaagaccacaattg

SEQ ID NO: 192684 - DNA, 25 bp, Mus musculus
aggcagccacactagaccacaattg

SEQ ID NO: 192685 - DNA, 25 bp, Mus musculus
aggcagccacagaagtgtgtgcagc

SEQ ID NO: 192686 - DNA, 25 bp, Mus musculus
aggcagccacagtagtgtgtgcagc

SEQ ID NO: 192687 - DNA, 25 bp, Mus musculus
aggcagccaccactatccagggagg

SEQ ID NO: 192688 - DNA, 25 bp, Mus musculus
aggcagccaccagtatccagggagg

SEQ ID NO: 192689 - DNA, 25 bp, Mus musculus
aggcagccactgagatgtttgcacc

SEQ ID NO: 192690 - DNA, 25 bp, Mus musculus
aggcagccactgtgatgtttgcacc

SEQ ID NO: 192691 - DNA, 25 bp, Mus musculus
aggcagccacttccaaggagcgtac

SEQ ID NO: 192692 - DNA, 25 bp, Mus musculus
aggcagccacttgcaaggagcgtac

SEQ ID NO: 192693 - DNA, 25 bp, Mus musculus
aggcagccagccaagtctgtagcta

SEQ ID NO: 192694 - DNA, 25 bp, Mus musculus
aggcagccagcccatactgtgggaa

SEQ ID NO: 192695 - DNA, 25 bp, Mus musculus
aggcagccagccgatactgtgggaa

SEQ ID NO: 192696 - DNA, 25 bp, Mus musculus
aggcagccagcctagtctgtagcta

SEQ ID NO: 192697 - DNA, 25 bp, Mus musculus
aggcagccagcgcacggactgatct

SEQ ID NO: 192698 - DNA, 25 bp, Mus musculus
aggcagccagcggacggactgatct

SEQ ID NO: 192699 - DNA, 25 bp, Mus musculus
aggcagccaggacttagcttcattc

SEQ ID NO: 192700 - DNA, 25 bp, Mus musculus
aggcagccaggagttagcttcattc

SEQ ID NO: 192701 - DNA, 25 bp, Mus musculus
aggcagccaggtatctagcaatgta

SEQ ID NO: 192702 - DNA, 25 bp, Mus musculus
aggcagccaggtttctagcaatgta

SEQ ID NO: 192703 - DNA, 25 bp, Mus musculus
aggcagccagtcctgatagcatcag

SEQ ID NO: 192704 - DNA, 25 bp, Mus musculus
aggcagccagtcgtgatagcatcag

SEQ ID NO: 192705 - DNA, 25 bp, Mus musculus
aggcagccatagctcctcagggtga

SEQ ID NO: 192706 - DNA, 25 bp, Mus musculus
aggcagccataggtcctcagggtga

SEQ ID NO: 192707 - DNA, 25 bp, Mus musculus
aggcagcccaggaggagtacatcaa

SEQ ID NO: 192708 - DNA, 25 bp, Mus musculus
aggcagcccaggtggagtacatcaa

SEQ ID NO: 192709 - DNA, 25 bp, Mus musculus
aggcagccctagaccaatttaggca

SEQ ID NO: 192710 - DNA, 25 bp, Mus musculus
aggcagccctagtccaatttaggca

SEQ ID NO: 192711 - DNA, 25 bp, Mus musculus
aggcagccctcacaagtcagcagaa

SEQ ID NO: 192712 - DNA, 25 bp, Mus musculus
aggcagccctcagaagtcagcagaa

SEQ ID NO: 192713 - DNA, 25 bp, Mus musculus
aggcagccctgaagaccgctctgcg

SEQ ID NO: 192714 - DNA, 25 bp, Mus musculus
aggcagccctgatgaccgctctgcg

SEQ ID NO: 192715 - DNA, 25 bp, Mus musculus
aggcagccgcgaacctggcgtgtcc

SEQ ID NO: 192716 - DNA, 25 bp, Mus musculus
aggcagccgcgatcctggcgtgtcc

SEQ ID NO: 192717 - DNA, 25 bp, Mus musculus
aggcagccgctaccttaggacgtgc

SEQ ID NO: 192718 - DNA, 25 bp, Mus musculus
aggcagccgctagcttaggacgtgc

SEQ ID NO: 192719 - DNA, 25 bp, Mus musculus
aggcagcctatgacttgttctatca

SEQ ID NO: 192720 - DNA, 25 bp, Mus musculus
aggcagcctatgtcttgttctatca

SEQ ID NO: 192721 - DNA, 25 bp, Mus musculus
aggcagcctcgtcgctgacattggt

SEQ ID NO: 192722 - DNA, 25 bp, Mus musculus
aggcagcctcgtggctgacattggt

SEQ ID NO: 192723 - DNA, 25 bp, Mus musculus
aggcagcctctgacagcttggcaat

SEQ ID NO: 192724 - DNA, 25 bp, Mus musculus
aggcagcctctgacttaagtgtcaa

SEQ ID NO: 192725 - DNA, 25 bp, Mus musculus
aggcagcctctgtcagcttggcaat

SEQ ID NO: 192726 - DNA, 25 bp, Mus musculus
aggcagcctctgtcttaagtgtcaa

SEQ ID NO: 192727 - DNA, 25 bp, Mus musculus
aggcagcctgccatagacttgcagc

SEQ ID NO: 192728 - DNA, 25 bp, Mus musculus
aggcagcctgccttagacttgcagc

SEQ ID NO: 192729 - DNA, 25 bp, Mus musculus
aggcagcctttgctcatcggcaggg

SEQ ID NO: 192730 - DNA, 25 bp, Mus musculus
aggcagcctttggtcatcggcaggg

SEQ ID NO: 192731 - DNA, 25 bp, Mus musculus
aggcagcgccatctgagactgcagt

SEQ ID NO: 192732 - DNA, 25 bp, Mus musculus
aggcagcgccatgtgagactgcagt

SEQ ID NO: 192733 - DNA, 25 bp, Mus musculus
aggcagcgcctacgtcatcgtgtac

SEQ ID NO: 192734 - DNA, 25 bp, Mus musculus
aggcagcgcctaggtcatcgtgtac

SEQ ID NO: 192735 - DNA, 25 bp, Mus musculus
aggcagcgcgccaagagttgcatta

SEQ ID NO: 192736 - DNA, 25 bp, Mus musculus
aggcagcgcgcctagagttgcatta

SEQ ID NO: 192737 - DNA, 25 bp, Mus musculus
aggcagcgctgacaagcctgagccc

SEQ ID NO: 192738 - DNA, 25 bp, Mus musculus
aggcagcgctgagaagcctgagccc

SEQ ID NO: 192739 - DNA, 25 bp, Mus musculus
aggcagcgggccacgtgacattgac

SEQ ID NO: 192740 - DNA, 25 bp, Mus musculus
aggcagcgggcctcgtgacattgac

SEQ ID NO: 192741 - DNA, 25 bp, Mus musculus
aggcagcgggcgaagtaaaagcctt

SEQ ID NO: 192742 - DNA, 25 bp, Mus musculus
aggcagcgggcgtagtaaaagcctt

SEQ ID NO: 192743 - DNA, 25 bp, Mus musculus
aggcagcggttaatgaccattcctt

SEQ ID NO: 192744 - DNA, 25 bp, Mus musculus
aggcagcggttattgaccattcctt

SEQ ID NO: 192745 - DNA, 25 bp, Mus musculus
aggcagcgtggaacacagttctttt

SEQ ID NO: 192746 - DNA, 25 bp, Mus musculus
aggcagcgtggatcacagttctttt

SEQ ID NO: 192747 - DNA, 25 bp, Mus musculus
aggcagcgttgtactggtgtcctcc

SEQ ID NO: 192748 - DNA, 25 bp, Mus musculus
aggcagcgttgttctggtgtcctcc

SEQ ID NO: 192749 - DNA, 25 bp, Mus musculus
aggcagctacctaggtttccttgta

SEQ ID NO: 192750 - DNA, 25 bp, Mus musculus
aggcagctaccttggtttccttgta

SEQ ID NO: 192751 - DNA, 25 bp, Mus musculus
aggcagctagccagggtgtcttcct

SEQ ID NO: 192752 - DNA, 25 bp, Mus musculus
aggcagctagcctgggtgtcttcct

SEQ ID NO: 192753 - DNA, 25 bp, Mus musculus
aggcagctagtcacttccttgactg

SEQ ID NO: 192754 - DNA, 25 bp, Mus musculus
aggcagctagtctcttccttgactg

SEQ ID NO: 192755 - DNA, 25 bp, Mus musculus
aggcagctcaatacttctaccagaa

SEQ ID NO: 192756 - DNA, 25 bp, Mus musculus
aggcagctcaattcttctaccagaa

SEQ ID NO: 192757 - DNA, 25 bp, Mus musculus
aggcagctcctgatataagtttatt

SEQ ID NO: 192758 - DNA, 25 bp, Mus musculus
aggcagctcctgttataagtttatt

SEQ ID NO: 192759 - DNA, 25 bp, Mus musculus
aggcagctctagaactgaccagtca

SEQ ID NO: 192760 - DNA, 25 bp, Mus musculus
aggcagctctagtactgaccagtca

SEQ ID NO: 192761 - DNA, 25 bp, Mus musculus
aggcagctctttagcatgtagtgga

SEQ ID NO: 192762 - DNA, 25 bp, Mus musculus
aggcagctcttttgcatgtagtgga

SEQ ID NO: 192763 - DNA, 25 bp, Mus musculus
aggcagctgacactcgcagttattg

SEQ ID NO: 192764 - DNA, 25 bp, Mus musculus
aggcagctgacagtcgcagttattg

SEQ ID NO: 192765 - DNA, 25 bp, Mus musculus
aggcagctgactacattcttgttta

SEQ ID NO: 192766 - DNA, 25 bp, Mus musculus
aggcagctgacttcattcttgttta

SEQ ID NO: 192767 - DNA, 25 bp, Mus musculus
aggcagctgagcagtcggcctcgtc

SEQ ID NO: 192768 - DNA, 25 bp, Mus musculus
aggcagctgagcataatcccatgaa

SEQ ID NO: 192769 - DNA, 25 bp, Mus musculus
aggcagctgagctgtcggcctcgtc

SEQ ID NO: 192770 - DNA, 25 bp, Mus musculus
aggcagctgagcttaatcccatgaa

SEQ ID NO: 192771 - DNA, 25 bp, Mus musculus
aggcagctgatgagcgccctttcct

SEQ ID NO: 192772 - DNA, 25 bp, Mus musculus
aggcagctgatgtgcgccctttcct

SEQ ID NO: 192773 - DNA, 25 bp, Mus musculus
aggcagctgcagctcagcctagtga

SEQ ID NO: 192774 - DNA, 25 bp, Mus musculus
aggcagctgcaggtcagcctagtga

SEQ ID NO: 192775 - DNA, 25 bp, Mus musculus
aggcagctggtacaggctccacctt

SEQ ID NO: 192776 - DNA, 25 bp, Mus musculus
aggcagctggtaccactgtgttgaa

SEQ ID NO: 192777 - DNA, 25 bp, Mus musculus
aggcagctggtagaggctccacctt

SEQ ID NO: 192778 - DNA, 25 bp, Mus musculus
aggcagctggtagcactgtgttgaa

SEQ ID NO: 192779 - DNA, 25 bp, Mus musculus
aggcagctgtcacatggcatctgta

SEQ ID NO: 192780 - DNA, 25 bp, Mus musculus
aggcagctgtcagatggcatctgta

SEQ ID NO: 192781 - DNA, 25 bp, Mus musculus
aggcagctgtccctgatgcatcccg

SEQ ID NO: 192782 - DNA, 25 bp, Mus musculus
aggcagctgtccgtgatgcatcccg

SEQ ID NO: 192783 - DNA, 25 bp, Mus musculus
aggcagcttacccatagaattaccc

SEQ ID NO: 192784 - DNA, 25 bp, Mus musculus
aggcagcttaccgatagaattaccc

SEQ ID NO: 192785 - DNA, 25 bp, Mus musculus
aggcagcttactatggaggtccaaa

SEQ ID NO: 192786 - DNA, 25 bp, Mus musculus
aggcagcttactttggaggtccaaa

SEQ ID NO: 192787 - DNA, 25 bp, Mus musculus
aggcagcttatgaaccagtggtggt

SEQ ID NO: 192788 - DNA, 25 bp, Mus musculus
aggcagcttatgaagtgtcggagtt

SEQ ID NO: 192789 - DNA, 25 bp, Mus musculus
aggcagcttatgtaccagtggtggt

SEQ ID NO: 192790 - DNA, 25 bp, Mus musculus
aggcagcttatgtagtgtcggagtt

SEQ ID NO: 192791 - DNA, 25 bp, Mus musculus
aggcagcttattaaagcatctccca

SEQ ID NO: 192792 - DNA, 25 bp, Mus musculus
aggcagcttatttaagcatctccca

SEQ ID NO: 192793 - DNA, 25 bp, Mus musculus
aggcagcttcacaggtgtgcacata

SEQ ID NO: 192794 - DNA, 25 bp, Mus musculus
aggcagcttcactggtgtgcacata

SEQ ID NO: 192795 - DNA, 25 bp, Mus musculus
aggcagcttctaatataaaattgga

SEQ ID NO: 192796 - DNA, 25 bp, Mus musculus
aggcagcttctattataaaattgga

SEQ ID NO: 192797 - DNA, 25 bp, Mus musculus
aggcagcttcttcacagcctgttca

SEQ ID NO: 192798 - DNA, 25 bp, Mus musculus
aggcagcttcttgacagcctgttca

SEQ ID NO: 192799 - DNA, 25 bp, Mus musculus
aggcagctttagatcatttcagtat

SEQ ID NO: 192800 - DNA, 25 bp, Mus musculus
aggcagctttagttcatttcagtat

SEQ ID NO: 192801 - DNA, 25 bp, Mus musculus
aggcagctttggatacacagcaaaa

SEQ ID NO: 192802 - DNA, 25 bp, Mus musculus
aggcagctttggattccttgggact

SEQ ID NO: 192803 - DNA, 25 bp, Mus musculus
aggcagctttggttacacagcaaaa

SEQ ID NO: 192804 - DNA, 25 bp, Mus musculus
aggcagctttggtttccttgggact

SEQ ID NO: 192805 - DNA, 25 bp, Mus musculus
aggcaggaaaagctttgttcacagt

SEQ ID NO: 192806 - DNA, 25 bp, Mus musculus
aggcaggaaaaggtttgttcacagt

SEQ ID NO: 192807 - DNA, 25 bp, Mus musculus
aggcaggaacagctttcatccctta

SEQ ID NO: 192808 - DNA, 25 bp, Mus musculus
aggcaggaacaggtttcatccctta

SEQ ID NO: 192809 - DNA, 25 bp, Mus musculus
aggcaggaagccattgtctttcctc

SEQ ID NO: 192810 - DNA, 25 bp, Mus musculus
aggcaggaagcctttgtctttcctc

SEQ ID NO: 192811 - DNA, 25 bp, Mus musculus
aggcaggaagtaaccgacccagctt

SEQ ID NO: 192812 - DNA, 25 bp, Mus musculus
aggcaggaagtatccgacccagctt

SEQ ID NO: 192813 - DNA, 25 bp, Mus musculus
aggcaggaccagaacgaatgtgtga

SEQ ID NO: 192814 - DNA, 25 bp, Mus musculus
aggcaggaccagtacgaatgtgtga

SEQ ID NO: 192815 - DNA, 25 bp, Mus musculus
aggcaggacccaaatttaccatctc

SEQ ID NO: 192816 - DNA, 25 bp, Mus musculus
aggcaggacccatatttaccatctc

SEQ ID NO: 192817 - DNA, 25 bp, Mus musculus
aggcaggaccttatgctcagaaatc

SEQ ID NO: 192818 - DNA, 25 bp, Mus musculus
aggcaggaccttcaggagtcagatt

SEQ ID NO: 192819 - DNA, 25 bp, Mus musculus
aggcaggaccttgaggagtcagatt

SEQ ID NO: 192820 - DNA, 25 bp, Mus musculus
aggcaggaccttttgctcagaaatc

SEQ ID NO: 192821 - DNA, 25 bp, Mus musculus
aggcaggactcacatctcagggtct

SEQ ID NO: 192822 - DNA, 25 bp, Mus musculus
aggcaggactcagatctcagggtct

SEQ ID NO: 192823 - DNA, 25 bp, Mus musculus
aggcaggactctcctcagaaggcag

SEQ ID NO: 192824 - DNA, 25 bp, Mus musculus
aggcaggactctgctcagaaggcag

SEQ ID NO: 192825 - DNA, 25 bp, Mus musculus
aggcaggactgcacacggttacatc

SEQ ID NO: 192826 - DNA, 25 bp, Mus musculus
aggcaggactgctcacggttacatc

SEQ ID NO: 192827 - DNA, 25 bp, Mus musculus
aggcaggactgtctcatgtacccca

SEQ ID NO: 192828 - DNA, 25 bp, Mus musculus
aggcaggactgtgtcatgtacccca

SEQ ID NO: 192829 - DNA, 25 bp, Mus musculus
aggcaggagaccactggttccactg

SEQ ID NO: 192830 - DNA, 25 bp, Mus musculus
aggcaggagacctctggttccactg

SEQ ID NO: 192831 - DNA, 25 bp, Mus musculus
aggcaggagataaggtcccctattc

SEQ ID NO: 192832 - DNA, 25 bp, Mus musculus
aggcaggagatatggtcccctattc

SEQ ID NO: 192833 - DNA, 25 bp, Mus musculus
aggcaggagcctcacaccaacagtg

SEQ ID NO: 192834 - DNA, 25 bp, Mus musculus
aggcaggagcctgacaccaacagtg

SEQ ID NO: 192835 - DNA, 25 bp, Mus musculus
aggcaggagctacagctttttccag

SEQ ID NO: 192836 - DNA, 25 bp, Mus musculus
aggcaggagctagagctttttccag

SEQ ID NO: 192837 - DNA, 25 bp, Mus musculus
aggcaggagctcaggcccttatggt

SEQ ID NO: 192838 - DNA, 25 bp, Mus musculus
aggcaggagctcatgtagacgccat

SEQ ID NO: 192839 - DNA, 25 bp, Mus musculus
aggcaggagctctggcccttatggt

SEQ ID NO: 192840 - DNA, 25 bp, Mus musculus
aggcaggagctcttgtagacgccat

SEQ ID NO: 192841 - DNA, 25 bp, Mus musculus
aggcaggaggaaatcatgttcttaa

SEQ ID NO: 192842 - DNA, 25 bp, Mus musculus
aggcaggaggaattcatgttcttaa

SEQ ID NO: 192843 - DNA, 25 bp, Mus musculus
aggcaggaggctctctagtgaattt

SEQ ID NO: 192844 - DNA, 25 bp, Mus musculus
aggcaggaggctgtctagtgaattt

SEQ ID NO: 192845 - DNA, 25 bp, Mus musculus
aggcaggaggttagactgagcccct

SEQ ID NO: 192846 - DNA, 25 bp, Mus musculus
aggcaggaggttcctcccaacatgc

SEQ ID NO: 192847 - DNA, 25 bp, Mus musculus
aggcaggaggttgctcccaacatgc

SEQ ID NO: 192848 - DNA, 25 bp, Mus musculus
aggcaggaggtttgactgagcccct

SEQ ID NO: 192849 - DNA, 25 bp, Mus musculus
aggcaggagtagatcaccagtgatt

SEQ ID NO: 192850 - DNA, 25 bp, Mus musculus
aggcaggagtagttcaccagtgatt

SEQ ID NO: 192851 - DNA, 25 bp, Mus musculus
aggcaggagtcaccatgcaggtttc

SEQ ID NO: 192852 - DNA, 25 bp, Mus musculus
aggcaggagtcagcatgcaggtttc

SEQ ID NO: 192853 - DNA, 25 bp, Mus musculus
aggcaggagtgtctcctttcagctc

SEQ ID NO: 192854 - DNA, 25 bp, Mus musculus
aggcaggagtgtgtcctttcagctc

SEQ ID NO: 192855 - DNA, 25 bp, Mus musculus
aggcaggatagcacagccctacatt

SEQ ID NO: 192856 - DNA, 25 bp, Mus musculus
aggcaggatagctcagccctacatt

SEQ ID NO: 192857 - DNA, 25 bp, Mus musculus
aggcaggatatgagctatggattct

SEQ ID NO: 192858 - DNA, 25 bp, Mus musculus
aggcaggatatgtgctatggattct

SEQ ID NO: 192859 - DNA, 25 bp, Mus musculus
aggcaggatcagacccgggtcagtt

SEQ ID NO: 192860 - DNA, 25 bp, Mus musculus
aggcaggatcagtcccgggtcagtt

SEQ ID NO: 192861 - DNA, 25 bp, Mus musculus
aggcaggcaatgagaggccagcatt

SEQ ID NO: 192862 - DNA, 25 bp, Mus musculus
aggcaggcaatgtgaggccagcatt

SEQ ID NO: 192863 - DNA, 25 bp, Mus musculus
aggcaggcacacacaggttggcttt

SEQ ID NO: 192864 - DNA, 25 bp, Mus musculus
aggcaggcacaccccaaggagaagt

SEQ ID NO: 192865 - DNA, 25 bp, Mus musculus
aggcaggcacacgccaaggagaagt

SEQ ID NO: 192866 - DNA, 25 bp, Mus musculus
aggcaggcacactcaggttggcttt

SEQ ID NO: 192867 - DNA, 25 bp, Mus musculus
aggcaggcaccaaatacttctttat

SEQ ID NO: 192868 - DNA, 25 bp, Mus musculus
aggcaggcaccacccaagttcagaa

SEQ ID NO: 192869 - DNA, 25 bp, Mus musculus
aggcaggcaccagccaagttcagaa

SEQ ID NO: 192870 - DNA, 25 bp, Mus musculus
aggcaggcaccatatacttctttat

SEQ ID NO: 192871 - DNA, 25 bp, Mus musculus
aggcaggcacctacagtccgtctta

SEQ ID NO: 192872 - DNA, 25 bp, Mus musculus
aggcaggcacctcacacaacacgtt

SEQ ID NO: 192873 - DNA, 25 bp, Mus musculus
aggcaggcacctgacacaacacgtt

SEQ ID NO: 192874 - DNA, 25 bp, Mus musculus
aggcaggcaccttcagtccgtctta

SEQ ID NO: 192875 - DNA, 25 bp, Mus musculus
aggcaggcacgcactgcacgtacat

SEQ ID NO: 192876 - DNA, 25 bp, Mus musculus
aggcaggcacgctctgcacgtacat

SEQ ID NO: 192877 - DNA, 25 bp, Mus musculus
aggcaggcagcgcagattaccagca

SEQ ID NO: 192878 - DNA, 25 bp, Mus musculus
aggcaggcagcggagattaccagca

SEQ ID NO: 192879 - DNA, 25 bp, Mus musculus
aggcaggcagctcatgagttccaga

SEQ ID NO: 192880 - DNA, 25 bp, Mus musculus
aggcaggcagctgatgagttccaga

SEQ ID NO: 192881 - DNA, 25 bp, Mus musculus
aggcaggcaggtattcgctgacctc

SEQ ID NO: 192882 - DNA, 25 bp, Mus musculus
aggcaggcaggttttcgctgacctc

SEQ ID NO: 192883 - DNA, 25 bp, Mus musculus
aggcaggcattcaagtgtggccagt

SEQ ID NO: 192884 - DNA, 25 bp, Mus musculus
aggcaggcattctagtgtggccagt

SEQ ID NO: 192885 - DNA, 25 bp, Mus musculus
aggcaggccaggagtcatgcgcaca

SEQ ID NO: 192886 - DNA, 25 bp, Mus musculus
aggcaggccaggtgtcatgcgcaca

SEQ ID NO: 192887 - DNA, 25 bp, Mus musculus
aggcaggcccatagctagggaagct

SEQ ID NO: 192888 - DNA, 25 bp, Mus musculus
aggcaggcccattgctagggaagct

SEQ ID NO: 192889 - DNA, 25 bp, Mus musculus
aggcaggccccacgacatcttgacg

SEQ ID NO: 192890 - DNA, 25 bp, Mus musculus
aggcaggccccaggacatcttgacg

SEQ ID NO: 192891 - DNA, 25 bp, Mus musculus
aggcaggcccctaaaagcgcaagga

SEQ ID NO: 192892 - DNA, 25 bp, Mus musculus
aggcaggccccttaaagcgcaagga

SEQ ID NO: 192893 - DNA, 25 bp, Mus musculus
aggcaggccctaagacggaggactt

SEQ ID NO: 192894 - DNA, 25 bp, Mus musculus
aggcaggccctatgacggaggactt

SEQ ID NO: 192895 - DNA, 25 bp, Mus musculus
aggcaggccctcagtaattccgaag

SEQ ID NO: 192896 - DNA, 25 bp, Mus musculus
aggcaggccctctgtaattccgaag

SEQ ID NO: 192897 - DNA, 25 bp, Mus musculus
aggcaggccctgagactctggtgtt

SEQ ID NO: 192898 - DNA, 25 bp, Mus musculus
aggcaggccctgtgactctggtgtt

SEQ ID NO: 192899 - DNA, 25 bp, Mus musculus
aggcaggccgtaatgaaatgctctc

SEQ ID NO: 192900 - DNA, 25 bp, Mus musculus
aggcaggccgtattgaaatgctctc

SEQ ID NO: 192901 - DNA, 25 bp, Mus musculus
aggcaggcctgcagggacttaagct

SEQ ID NO: 192902 - DNA, 25 bp, Mus musculus
aggcaggcctgctgggacttaagct

SEQ ID NO: 192903 - DNA, 25 bp, Mus musculus
aggcaggcctttatcagcggtgatc

SEQ ID NO: 192904 - DNA, 25 bp, Mus musculus
aggcaggcctttttcagcggtgatc

SEQ ID NO: 192905 - DNA, 25 bp, Mus musculus
aggcaggcgccaaacgcttggcgat

SEQ ID NO: 192906 - DNA, 25 bp, Mus musculus
aggcaggcgccatacgcttggcgat

SEQ ID NO: 192907 - DNA, 25 bp, Mus musculus
aggcaggcggccaatgctaagacaa

SEQ ID NO: 192908 - DNA, 25 bp, Mus musculus
aggcaggcggcctatgctaagacaa

SEQ ID NO: 192909 - DNA, 25 bp, Mus musculus
aggcaggctaaacccagtactggta

SEQ ID NO: 192910 - DNA, 25 bp, Mus musculus
aggcaggctaaagccagtactggta

SEQ ID NO: 192911 - DNA, 25 bp, Mus musculus
aggcaggctctgacagaattctgca

SEQ ID NO: 192912 - DNA, 25 bp, Mus musculus
aggcaggctctgtcagaattctgca

SEQ ID NO: 192913 - DNA, 25 bp, Mus musculus
aggcaggctcttctgactgggacat

SEQ ID NO: 192914 - DNA, 25 bp, Mus musculus
aggcaggctcttgtgactgggacat

SEQ ID NO: 192915 - DNA, 25 bp, Mus musculus
aggcaggctgcacaggcaaacgtca

SEQ ID NO: 192916 - DNA, 25 bp, Mus musculus
aggcaggctgcacggactgaattat

SEQ ID NO: 192917 - DNA, 25 bp, Mus musculus
aggcaggctgcagaggcaaacgtca

SEQ ID NO: 192918 - DNA, 25 bp, Mus musculus
aggcaggctgcagggactgaattat

SEQ ID NO: 192919 - DNA, 25 bp, Mus musculus
aggcaggctggaacctgtaatcctc

SEQ ID NO: 192920 - DNA, 25 bp, Mus musculus
aggcaggctggatcctgtaatcctc

SEQ ID NO: 192921 - DNA, 25 bp, Mus musculus
aggcagggagtaccttgatcaaaac

SEQ ID NO: 192922 - DNA, 25 bp, Mus musculus
aggcagggagtagcttgatcaaaac

SEQ ID NO: 192923 - DNA, 25 bp, Mus musculus
aggcagggatatcctaccaggtcac

SEQ ID NO: 192924 - DNA, 25 bp, Mus musculus
aggcagggatatgctaccaggtcac

SEQ ID NO: 192925 - DNA, 25 bp, Mus musculus
aggcagggattgagtctttctgttt

SEQ ID NO: 192926 - DNA, 25 bp, Mus musculus
aggcagggattgtgtctttctgttt

SEQ ID NO: 192927 - DNA, 25 bp, Mus musculus
aggcagggcagcatagttcaccgca

SEQ ID NO: 192928 - DNA, 25 bp, Mus musculus
aggcagggcagcttagttcaccgca

SEQ ID NO: 192929 - DNA, 25 bp, Mus musculus
aggcagggccaaaaaggtaccacat

SEQ ID NO: 192930 - DNA, 25 bp, Mus musculus
aggcagggccaataaggtaccacat

SEQ ID NO: 192931 - DNA, 25 bp, Mus musculus
aggcagggccttcaaagagctcaca

SEQ ID NO: 192932 - DNA, 25 bp, Mus musculus
aggcagggccttgaaagagctcaca

SEQ ID NO: 192933 - DNA, 25 bp, Mus musculus
aggcagggctaacttgacttcaatg

SEQ ID NO: 192934 - DNA, 25 bp, Mus musculus
aggcagggctaagttgacttcaatg

SEQ ID NO: 192935 - DNA, 25 bp, Mus musculus
aggcagggctgaccataactccaag

SEQ ID NO: 192936 - DNA, 25 bp, Mus musculus
aggcagggctgagcataactccaag

SEQ ID NO: 192937 - DNA, 25 bp, Mus musculus
aggcagggctgcattttgatgaact

SEQ ID NO: 192938 - DNA, 25 bp, Mus musculus
aggcagggctgctttttgatgaact

SEQ ID NO: 192939 - DNA, 25 bp, Mus musculus
aggcagggggatccgtattacttcc

SEQ ID NO: 192940 - DNA, 25 bp, Mus musculus
aggcagggggatgcgtattacttcc

SEQ ID NO: 192941 - DNA, 25 bp, Mus musculus
aggcagggtaatacagtcttctctt

SEQ ID NO: 192942 - DNA, 25 bp, Mus musculus
aggcagggtaattcagtcttctctt

SEQ ID NO: 192943 - DNA, 25 bp, Mus musculus
aggcagggtctgagactccctagtt

SEQ ID NO: 192944 - DNA, 25 bp, Mus musculus
aggcagggtctgtgactccctagtt

SEQ ID NO: 192945 - DNA, 25 bp, Mus musculus
aggcagggtcttctgttttgtctct

SEQ ID NO: 192946 - DNA, 25 bp, Mus musculus
aggcagggtcttgtgttttgtctct

SEQ ID NO: 192947 - DNA, 25 bp, Mus musculus
aggcagggtgaactcacgcagctca

SEQ ID NO: 192948 - DNA, 25 bp, Mus musculus
aggcagggtgaagtcacgcagctca

SEQ ID NO: 192949 - DNA, 25 bp, Mus musculus
aggcagggtgccaagtctgaactca

SEQ ID NO: 192950 - DNA, 25 bp, Mus musculus
aggcagggtgcctagtctgaactca

SEQ ID NO: 192951 - DNA, 25 bp, Mus musculus
aggcaggtagatcactgctccctac

SEQ ID NO: 192952 - DNA, 25 bp, Mus musculus
aggcaggtagatgactgctccctac

SEQ ID NO: 192953 - DNA, 25 bp, Mus musculus
aggcaggtagcaaattagtcaagaa

SEQ ID NO: 192954 - DNA, 25 bp, Mus musculus
aggcaggtagcaaggctttccgagc

SEQ ID NO: 192955 - DNA, 25 bp, Mus musculus
aggcaggtagcatattagtcaagaa

SEQ ID NO: 192956 - DNA, 25 bp, Mus musculus
aggcaggtagcatggctttccgagc

SEQ ID NO: 192957 - DNA, 25 bp, Mus musculus
aggcaggtagccagcagctcttgtt

SEQ ID NO: 192958 - DNA, 25 bp, Mus musculus
aggcaggtagcctgcagctcttgtt

SEQ ID NO: 192959 - DNA, 25 bp, Mus musculus
aggcaggtcagaatgcaggccacat

SEQ ID NO: 192960 - DNA, 25 bp, Mus musculus
aggcaggtcagattgcaggccacat

SEQ ID NO: 192961 - DNA, 25 bp, Mus musculus
aggcaggtccccacagagatcagga

SEQ ID NO: 192962 - DNA, 25 bp, Mus musculus
aggcaggtcccctcagagatcagga

SEQ ID NO: 192963 - DNA, 25 bp, Mus musculus
aggcaggtccctcgatttagagtac

SEQ ID NO: 192964 - DNA, 25 bp, Mus musculus
aggcaggtccctggatttagagtac

SEQ ID NO: 192965 - DNA, 25 bp, Mus musculus
aggcaggtcctgctgatcttgtctc

SEQ ID NO: 192966 - DNA, 25 bp, Mus musculus
aggcaggtcctggtgatcttgtctc

SEQ ID NO: 192967 - DNA, 25 bp, Mus musculus
aggcaggtcggtacacccggagcca

SEQ ID NO: 192968 - DNA, 25 bp, Mus musculus
aggcaggtcggttcacccggagcca

SEQ ID NO: 192969 - DNA, 25 bp, Mus musculus
aggcaggtctatccaccaatcatta

SEQ ID NO: 192970 - DNA, 25 bp, Mus musculus
aggcaggtctatgcaccaatcatta

SEQ ID NO: 192971 - DNA, 25 bp, Mus musculus
aggcaggtctccaagcatagggtct

SEQ ID NO: 192972 - DNA, 25 bp, Mus musculus
aggcaggtctcctagcatagggtct

SEQ ID NO: 192973 - DNA, 25 bp, Mus musculus
aggcaggtcttaccaaaacccattt

SEQ ID NO: 192974 - DNA, 25 bp, Mus musculus
aggcaggtcttagcaaaacccattt

SEQ ID NO: 192975 - DNA, 25 bp, Mus musculus
aggcaggtgagcctgaaccgtactc

SEQ ID NO: 192976 - DNA, 25 bp, Mus musculus
aggcaggtgagcgtgaaccgtactc

SEQ ID NO: 192977 - DNA, 25 bp, Mus musculus
aggcaggtgctgcatttattgtagc

SEQ ID NO: 192978 - DNA, 25 bp, Mus musculus
aggcaggtgctggatttattgtagc

SEQ ID NO: 192979 - DNA, 25 bp, Mus musculus
aggcaggtggtgatagcttagctaa

SEQ ID NO: 192980 - DNA, 25 bp, Mus musculus
aggcaggtggtgttagcttagctaa

SEQ ID NO: 192981 - DNA, 25 bp, Mus musculus
aggcaggtggttatcgtttgagttt

SEQ ID NO: 192982 - DNA, 25 bp, Mus musculus
aggcaggtggttttcgtttgagttt

SEQ ID NO: 192983 - DNA, 25 bp, Mus musculus
aggcaggttctccatataatattac

SEQ ID NO: 192984 - DNA, 25 bp, Mus musculus
aggcaggttctcgatataatattac

SEQ ID NO: 192985 - DNA, 25 bp, Mus musculus
aggcaggttctgaggaggctacctc

SEQ ID NO: 192986 - DNA, 25 bp, Mus musculus
aggcaggttctgtggaggctacctc

SEQ ID NO: 192987 - DNA, 25 bp, Mus musculus
aggcaggttcttcgatttaatctca

SEQ ID NO: 192988 - DNA, 25 bp, Mus musculus
aggcaggttcttggatttaatctca

SEQ ID NO: 192989 - DNA, 25 bp, Mus musculus
aggcaggttgctataatgtcactct

SEQ ID NO: 192990 - DNA, 25 bp, Mus musculus
aggcaggttgctttaatgtcactct

SEQ ID NO: 192991 - DNA, 25 bp, Mus musculus
aggcaggttgtgatggacctacctc

SEQ ID NO: 192992 - DNA, 25 bp, Mus musculus
aggcaggttgtgttggacctacctc

SEQ ID NO: 192993 - DNA, 25 bp, Mus musculus
aggcaggtttcaatgagacccctca

SEQ ID NO: 192994 - DNA, 25 bp, Mus musculus
aggcaggtttcattgagacccctca

SEQ ID NO: 192995 - DNA, 25 bp, Mus musculus
aggcaggtttctatgaggtgagcct

SEQ ID NO: 192996 - DNA, 25 bp, Mus musculus
aggcaggtttctttgaggtgagcct

SEQ ID NO: 192997 - DNA, 25 bp, Mus musculus
aggcaggttttgcagcctcctgtac

SEQ ID NO: 192998 - DNA, 25 bp, Mus musculus
aggcaggttttggagcctcctgtac

SEQ ID NO: 192999 - DNA, 25 bp, Mus musculus
aggcagtaagatccctccaaggcca

SEQ ID NO: 193000 - DNA, 25 bp, Mus musculus
aggcagtaagatgcctccaaggcca

SEQ ID NO: 193001 - DNA, 25 bp, Mus musculus
aggcagtacatgaatcgaaaaggcg

SEQ ID NO: 193002 - DNA, 25 bp, Mus musculus
aggcagtacatgtatcgaaaaggcg

SEQ ID NO: 193003 - DNA, 25 bp, Mus musculus
aggcagtaccaacttcctggcgaag

SEQ ID NO: 193004 - DNA, 25 bp, Mus musculus
aggcagtaccaagttcctggcgaag

SEQ ID NO: 193005 - DNA, 25 bp, Mus musculus
aggcagtaccatagttctcgcaagt

SEQ ID NO: 193006 - DNA, 25 bp, Mus musculus
aggcagtaccattgttctcgcaagt

SEQ ID NO: 193007 - DNA, 25 bp, Mus musculus
aggcagtacctgctgaaccagggtt

SEQ ID NO: 193008 - DNA, 25 bp, Mus musculus
aggcagtacctggtgaaccagggtt

SEQ ID NO: 193009 - DNA, 25 bp, Mus musculus
aggcagtaccttattctgaacaata

SEQ ID NO: 193010 - DNA, 25 bp, Mus musculus
aggcagtacctttttctgaacaata

SEQ ID NO: 193011 - DNA, 25 bp, Mus musculus
aggcagtacttaccttcctggagtg

SEQ ID NO: 193012 - DNA, 25 bp, Mus musculus
aggcagtacttagcttcctggagtg

SEQ ID NO: 193013 - DNA, 25 bp, Mus musculus
aggcagtagaggctttatcggaaca

SEQ ID NO: 193014 - DNA, 25 bp, Mus musculus
aggcagtagagggtttatcggaaca

SEQ ID NO: 193015 - DNA, 25 bp, Mus musculus
aggcagtagcggacctgctcaggct

SEQ ID NO: 193016 - DNA, 25 bp, Mus musculus
aggcagtagcggtcctgctcaggct

SEQ ID NO: 193017 - DNA, 25 bp, Mus musculus
aggcagtatgccacgggttcttgga

SEQ ID NO: 193018 - DNA, 25 bp, Mus musculus
aggcagtatgcctcgggttcttgga

SEQ ID NO: 193019 - DNA, 25 bp, Mus musculus
aggcagtatgctcggcagcccccaa

SEQ ID NO: 193020 - DNA, 25 bp, Mus musculus
aggcagtatgctgggcagcccccaa

SEQ ID NO: 193021 - DNA, 25 bp, Mus musculus
aggcagtatttcagtcctgaactca

SEQ ID NO: 193022 - DNA, 25 bp, Mus musculus
aggcagtatttctgtcctgaactca

SEQ ID NO: 193023 - DNA, 25 bp, Mus musculus
aggcagtcacgtctgaaccgtcgat

SEQ ID NO: 193024 - DNA, 25 bp, Mus musculus
aggcagtcacgtgtgaaccgtcgat

SEQ ID NO: 193025 - DNA, 25 bp, Mus musculus
aggcagtcactcactattttcagat

SEQ ID NO: 193026 - DNA, 25 bp, Mus musculus
aggcagtcactctctattttcagat

SEQ ID NO: 193027 - DNA, 25 bp, Mus musculus
aggcagtcagccagttttccaaata

SEQ ID NO: 193028 - DNA, 25 bp, Mus musculus
aggcagtcagcctgttttccaaata

SEQ ID NO: 193029 - DNA, 25 bp, Mus musculus
aggcagtcaggcacgcatcgttcta

SEQ ID NO: 193030 - DNA, 25 bp, Mus musculus
aggcagtcaggctcgcatcgttcta

SEQ ID NO: 193031 - DNA, 25 bp, Mus musculus
aggcagtccaccaacaggaatggat

SEQ ID NO: 193032 - DNA, 25 bp, Mus musculus
aggcagtccacctacaggaatggat

SEQ ID NO: 193033 - DNA, 25 bp, Mus musculus
aggcagtccacgcagctggtctcca

SEQ ID NO: 193034 - DNA, 25 bp, Mus musculus
aggcagtccacggagctggtctcca

SEQ ID NO: 193035 - DNA, 25 bp, Mus musculus
aggcagtccaggaaagcagcccctt

SEQ ID NO: 193036 - DNA, 25 bp, Mus musculus
aggcagtccaggtaagcagcccctt

SEQ ID NO: 193037 - DNA, 25 bp, Mus musculus
aggcagtccctccagtaagaagtga

SEQ ID NO: 193038 - DNA, 25 bp, Mus musculus
aggcagtccctcgagtaagaagtga

SEQ ID NO: 193039 - DNA, 25 bp, Mus musculus
aggcagtccctgataaaatgtgtgt

SEQ ID NO: 193040 - DNA, 25 bp, Mus musculus
aggcagtccctgttaaaatgtgtgt

SEQ ID NO: 193041 - DNA, 25 bp, Mus musculus
aggcagtcctaaccagctaggctgt

SEQ ID NO: 193042 - DNA, 25 bp, Mus musculus
aggcagtcctaagcagctaggctgt

SEQ ID NO: 193043 - DNA, 25 bp, Mus musculus
aggcagtcctataagtgctaccact

SEQ ID NO: 193044 - DNA, 25 bp, Mus musculus
aggcagtcctattagtgctaccact

SEQ ID NO: 193045 - DNA, 25 bp, Mus musculus
aggcagtcgctgagccactgaaact

SEQ ID NO: 193046 - DNA, 25 bp, Mus musculus
aggcagtcgctgtgccactgaaact

SEQ ID NO: 193047 - DNA, 25 bp, Mus musculus
aggcagtctgaacaactagtttttc

SEQ ID NO: 193048 - DNA, 25 bp, Mus musculus
aggcagtctgaagaactagtttttc

SEQ ID NO: 193049 - DNA, 25 bp, Mus musculus
aggcagtgacaccagctattattag

SEQ ID NO: 193050 - DNA, 25 bp, Mus musculus
aggcagtgacacgagctattattag

SEQ ID NO: 193051 - DNA, 25 bp, Mus musculus
aggcagtgactacttcgacacaacc

SEQ ID NO: 193052 - DNA, 25 bp, Mus musculus
aggcagtgactagttcgacacaacc

SEQ ID NO: 193053 - DNA, 25 bp, Mus musculus
aggcagtgagctatgcaaacgatct

SEQ ID NO: 193054 - DNA, 25 bp, Mus musculus
aggcagtgagctttgcaaacgatct

SEQ ID NO: 193055 - DNA, 25 bp, Mus musculus
aggcagtgaggtcctggaaacctct

SEQ ID NO: 193056 - DNA, 25 bp, Mus musculus
aggcagtgaggtgctggaaacctct

SEQ ID NO: 193057 - DNA, 25 bp, Mus musculus
aggcagtgccctcaacaggatgaag

SEQ ID NO: 193058 - DNA, 25 bp, Mus musculus
aggcagtgccctgaacaggatgaag

SEQ ID NO: 193059 - DNA, 25 bp, Mus musculus
aggcagtgccgcatgctggtctgca

SEQ ID NO: 193060 - DNA, 25 bp, Mus musculus
aggcagtgccgcttgctggtctgca

SEQ ID NO: 193061 - DNA, 25 bp, Mus musculus
aggcagtgcctgctactccaaaggg

SEQ ID NO: 193062 - DNA, 25 bp, Mus musculus
aggcagtgcctggtactccaaaggg

SEQ ID NO: 193063 - DNA, 25 bp, Mus musculus
aggcagtgccttagattgaaaataa

SEQ ID NO: 193064 - DNA, 25 bp, Mus musculus
aggcagtgcctttgattgaaaataa

SEQ ID NO: 193065 - DNA, 25 bp, Mus musculus
aggcagtgcggtcctttacagaatg

SEQ ID NO: 193066 - DNA, 25 bp, Mus musculus
aggcagtgcggtgctttacagaatg

SEQ ID NO: 193067 - DNA, 25 bp, Mus musculus
aggcagtggcccagtgatcccaggc

SEQ ID NO: 193068 - DNA, 25 bp, Mus musculus
aggcagtggccctgtgatcccaggc

SEQ ID NO: 193069 - DNA, 25 bp, Mus musculus
aggcagtggctgatccagtgactta

SEQ ID NO: 193070 - DNA, 25 bp, Mus musculus
aggcagtggctgttccagtgactta

SEQ ID NO: 193071 - DNA, 25 bp, Mus musculus
aggcagtggtgtagcatgattttaa

SEQ ID NO: 193072 - DNA, 25 bp, Mus musculus
aggcagtggtgttgcatgattttaa

SEQ ID NO: 193073 - DNA, 25 bp, Mus musculus
aggcagtgtcttccgtgccttactg

SEQ ID NO: 193074 - DNA, 25 bp, Mus musculus
aggcagtgtcttgcgtgccttactg

SEQ ID NO: 193075 - DNA, 25 bp, Mus musculus
aggcagtgtgtcaacttcgtaagag

SEQ ID NO: 193076 - DNA, 25 bp, Mus musculus
aggcagtgtgtctacttcgtaagag

SEQ ID NO: 193077 - DNA, 25 bp, Mus musculus
aggcagtgtgtgcatctatgatgtt

SEQ ID NO: 193078 - DNA, 25 bp, Mus musculus
aggcagtgtgtggatctatgatgtt

SEQ ID NO: 193079 - DNA, 25 bp, Mus musculus
aggcagtgtgttaacccgctgggac

SEQ ID NO: 193080 - DNA, 25 bp, Mus musculus
aggcagtgtgtttacccgctgggac

SEQ ID NO: 193081 - DNA, 25 bp, Mus musculus
aggcagtgttgtccagctacctgga

SEQ ID NO: 193082 - DNA, 25 bp, Mus musculus
aggcagtgttgtgcagctacctgga

SEQ ID NO: 193083 - DNA, 25 bp, Mus musculus
aggcagtgtttcacttaacacctaa

SEQ ID NO: 193084 - DNA, 25 bp, Mus musculus
aggcagtgtttctcttaacacctaa

SEQ ID NO: 193085 - DNA, 25 bp, Mus musculus
aggcagtgttttcacaaaagtaact

SEQ ID NO: 193086 - DNA, 25 bp, Mus musculus
aggcagtgttttgacaaaagtaact

SEQ ID NO: 193087 - DNA, 25 bp, Mus musculus
aggcagttacctctgtagagtattt

SEQ ID NO: 193088 - DNA, 25 bp, Mus musculus
aggcagttacctgtgtagagtattt

SEQ ID NO: 193089 - DNA, 25 bp, Mus musculus
aggcagttactcatccgagtttata

SEQ ID NO: 193090 - DNA, 25 bp, Mus musculus
aggcagttactcttccgagtttata

SEQ ID NO: 193091 - DNA, 25 bp, Mus musculus
aggcagttagacagatcagtggaca

SEQ ID NO: 193092 - DNA, 25 bp, Mus musculus
aggcagttagactgatcagtggaca

SEQ ID NO: 193093 - DNA, 25 bp, Mus musculus
aggcagttccccaggaaaagcccag

SEQ ID NO: 193094 - DNA, 25 bp, Mus musculus
aggcagttcccctggaaaagcccag

SEQ ID NO: 193095 - DNA, 25 bp, Mus musculus
aggcagttcctgctgagacagaaca

SEQ ID NO: 193096 - DNA, 25 bp, Mus musculus
aggcagttcctggtgagacagaaca

SEQ ID NO: 193097 - DNA, 25 bp, Mus musculus
aggcagttcttaataagggtaacat

SEQ ID NO: 193098 - DNA, 25 bp, Mus musculus
aggcagttcttattaagggtaacat

SEQ ID NO: 193099 - DNA, 25 bp, Mus musculus
aggcagttgataccattcttcacca

SEQ ID NO: 193100 - DNA, 25 bp, Mus musculus
aggcagttgatagcattcttcacca

SEQ ID NO: 193101 - DNA, 25 bp, Mus musculus
aggcagttgcgtcatgccatcgtca

SEQ ID NO: 193102 - DNA, 25 bp, Mus musculus
aggcagttgcgtgatgccatcgtca

SEQ ID NO: 193103 - DNA, 25 bp, Mus musculus
aggcagttggtcatccttctgaggc

SEQ ID NO: 193104 - DNA, 25 bp, Mus musculus
aggcagttggtcttccttctgaggc

SEQ ID NO: 193105 - DNA, 25 bp, Mus musculus
aggcagttgtcgacgctgcaagcga

SEQ ID NO: 193106 - DNA, 25 bp, Mus musculus
aggcagttgtcgtcgctgcaagcga

SEQ ID NO: 193107 - DNA, 25 bp, Mus musculus
aggcagttgtgccaacccaagggct

SEQ ID NO: 193108 - DNA, 25 bp, Mus musculus
aggcagttgtgcgaacccaagggct

SEQ ID NO: 193109 - DNA, 25 bp, Mus musculus
aggcagttgttgacagctctgttga

SEQ ID NO: 193110 - DNA, 25 bp, Mus musculus
aggcagttgttgtcagctctgttga

SEQ ID NO: 193111 - DNA, 25 bp, Mus musculus
aggcagtttctcagggttgggctct

SEQ ID NO: 193112 - DNA, 25 bp, Mus musculus
aggcagtttctctgggttgggctct

SEQ ID NO: 193113 - DNA, 25 bp, Mus musculus
aggcagttttcaacgatcattaaag

SEQ ID NO: 193114 - DNA, 25 bp, Mus musculus
aggcagttttcatcgatcattaaag

SEQ ID NO: 193115 - DNA, 25 bp, Mus musculus
aggcagttttgtatcacctgtggac

SEQ ID NO: 193116 - DNA, 25 bp, Mus musculus
aggcagttttgtttcacctgtggac

SEQ ID NO: 193117 - DNA, 25 bp, Mus musculus
aggcataaacatacctgcgatcatg

SEQ ID NO: 193118 - DNA, 25 bp, Mus musculus
aggcataaacattcctgcgatcatg

SEQ ID NO: 193119 - DNA, 25 bp, Mus musculus
aggcataaccttccagagacattta

SEQ ID NO: 193120 - DNA, 25 bp, Mus musculus
aggcataaccttgcagagacattta

SEQ ID NO: 193121 - DNA, 25 bp, Mus musculus
aggcataatagactttcacactgaa

SEQ ID NO: 193122 - DNA, 25 bp, Mus musculus
aggcataatagagtttcacactgaa

SEQ ID NO: 193123 - DNA, 25 bp, Mus musculus
aggcataatgaacggcaagaagctt

SEQ ID NO: 193124 - DNA, 25 bp, Mus musculus
aggcataatgaagggcaagaagctt

SEQ ID NO: 193125 - DNA, 25 bp, Mus musculus
aggcatacaatgaagctggtctcac

SEQ ID NO: 193126 - DNA, 25 bp, Mus musculus
aggcatacaatgtagctggtctcac

SEQ ID NO: 193127 - DNA, 25 bp, Mus musculus
aggcatacacataatcctagcacct

SEQ ID NO: 193128 - DNA, 25 bp, Mus musculus
aggcatacacattatcctagcacct

SEQ ID NO: 193129 - DNA, 25 bp, Mus musculus
aggcatacaccaccatgcttagctg

SEQ ID NO: 193130 - DNA, 25 bp, Mus musculus
aggcatacaccagcatgcttagctg

SEQ ID NO: 193131 - DNA, 25 bp, Mus musculus
aggcatacacgacgcagttgtgtct

SEQ ID NO: 193132 - DNA, 25 bp, Mus musculus
aggcatacacgaggcagttgtgtct

SEQ ID NO: 193133 - DNA, 25 bp, Mus musculus
aggcatacagtacgcatcagtcaag

SEQ ID NO: 193134 - DNA, 25 bp, Mus musculus
aggcatacagtaggcatcagtcaag

SEQ ID NO: 193135 - DNA, 25 bp, Mus musculus
aggcatacatcacgcagaatggtga

SEQ ID NO: 193136 - DNA, 25 bp, Mus musculus
aggcatacatcaggcagaatggtga

SEQ ID NO: 193137 - DNA, 25 bp, Mus musculus
aggcatacctatattcttgatttga

SEQ ID NO: 193138 - DNA, 25 bp, Mus musculus
aggcatacctattttcttgatttga

SEQ ID NO: 193139 - DNA, 25 bp, Mus musculus
aggcatactactacactaaattgga

SEQ ID NO: 193140 - DNA, 25 bp, Mus musculus
aggcatactacttcactaaattgga

SEQ ID NO: 193141 - DNA, 25 bp, Mus musculus
aggcatactcctaagtggaccgtga

SEQ ID NO: 193142 - DNA, 25 bp, Mus musculus
aggcatactccttagtggaccgtga

SEQ ID NO: 193143 - DNA, 25 bp, Mus musculus
aggcatactggaagccatcatcatc

SEQ ID NO: 193144 - DNA, 25 bp, Mus musculus
aggcatactggatgccatcatcatc

SEQ ID NO: 193145 - DNA, 25 bp, Mus musculus
aggcatagatggctttatctgtgca

SEQ ID NO: 193146 - DNA, 25 bp, Mus musculus
aggcatagatgggtttatctgtgca

SEQ ID NO: 193147 - DNA, 25 bp, Mus musculus
aggcatagctccattgcaggtggaa

SEQ ID NO: 193148 - DNA, 25 bp, Mus musculus
aggcatagctcctttgcaggtggaa

SEQ ID NO: 193149 - DNA, 25 bp, Mus musculus
aggcatagggtgagctccagaacct

SEQ ID NO: 193150 - DNA, 25 bp, Mus musculus
aggcatagggtgtgctccagaacct

SEQ ID NO: 193151 - DNA, 25 bp, Mus musculus
aggcatagtaccctcttgttgagca

SEQ ID NO: 193152 - DNA, 25 bp, Mus musculus
aggcatagtaccgtcttgttgagca

SEQ ID NO: 193153 - DNA, 25 bp, Mus musculus
aggcatagtagtccacaccttcaaa

SEQ ID NO: 193154 - DNA, 25 bp, Mus musculus
aggcatagtagtgcacaccttcaaa

SEQ ID NO: 193155 - DNA, 25 bp, Mus musculus
aggcatataaagacgtaaagtcatc

SEQ ID NO: 193156 - DNA, 25 bp, Mus musculus
aggcatataaagtcgtaaagtcatc

SEQ ID NO: 193157 - DNA, 25 bp, Mus musculus
aggcatatacgtcccagaagaaccc

SEQ ID NO: 193158 - DNA, 25 bp, Mus musculus
aggcatatacgtgccagaagaaccc

SEQ ID NO: 193159 - DNA, 25 bp, Mus musculus
aggcatatactcagcttctatttaa

SEQ ID NO: 193160 - DNA, 25 bp, Mus musculus
aggcatatactctgcttctatttaa

SEQ ID NO: 193161 - DNA, 25 bp, Mus musculus
aggcatatatatcataactgtgcat

SEQ ID NO: 193162 - DNA, 25 bp, Mus musculus
aggcatatatatgataactgtgcat

SEQ ID NO: 193163 - DNA, 25 bp, Mus musculus
aggcatatattgatgaatggcggaa

SEQ ID NO: 193164 - DNA, 25 bp, Mus musculus
aggcatatattgttgaatggcggaa

SEQ ID NO: 193165 - DNA, 25 bp, Mus musculus
aggcatatcgagagctcagtcgtga

SEQ ID NO: 193166 - DNA, 25 bp, Mus musculus
aggcatatcgagtgctcagtcgtga

SEQ ID NO: 193167 - DNA, 25 bp, Mus musculus
aggcatatgcagaagacctagacat

SEQ ID NO: 193168 - DNA, 25 bp, Mus musculus
aggcatatgcagtagacctagacat

SEQ ID NO: 193169 - DNA, 25 bp, Mus musculus
aggcatatgcatatcctgctaccgc

SEQ ID NO: 193170 - DNA, 25 bp, Mus musculus
aggcatatgcatttcctgctaccgc

SEQ ID NO: 193171 - DNA, 25 bp, Mus musculus
aggcatatgtcacaccagccagcat

SEQ ID NO: 193172 - DNA, 25 bp, Mus musculus
aggcatatgtcagaccagccagcat

SEQ ID NO: 193173 - DNA, 25 bp, Mus musculus
aggcatatttgccttctaccagaga

SEQ ID NO: 193174 - DNA, 25 bp, Mus musculus
aggcatatttgcgttctaccagaga

SEQ ID NO: 193175 - DNA, 25 bp, Mus musculus
aggcatatttttcgctgacttcttt

SEQ ID NO: 193176 - DNA, 25 bp, Mus musculus
aggcatatttttggctgacttcttt

SEQ ID NO: 193177 - DNA, 25 bp, Mus musculus
aggcatcaaaacacaccgtagcaat

SEQ ID NO: 193178 - DNA, 25 bp, Mus musculus
aggcatcaaaactcaccgtagcaat

SEQ ID NO: 193179 - DNA, 25 bp, Mus musculus
aggcatcaacagacacctgtggaat

SEQ ID NO: 193180 - DNA, 25 bp, Mus musculus
aggcatcaacagtcacctgtggaat

SEQ ID NO: 193181 - DNA, 25 bp, Mus musculus
aggcatcaagatacttctccatgaa

SEQ ID NO: 193182 - DNA, 25 bp, Mus musculus
aggcatcaagattcttctccatgaa

SEQ ID NO: 193183 - DNA, 25 bp, Mus musculus
aggcatcaagctctactccattcag

SEQ ID NO: 193184 - DNA, 25 bp, Mus musculus
aggcatcaagctgtactccattcag

SEQ ID NO: 193185 - DNA, 25 bp, Mus musculus
aggcatcaaggactgcgtcttctgt

SEQ ID NO: 193186 - DNA, 25 bp, Mus musculus
aggcatcaaggagtgcgtcttctgt

SEQ ID NO: 193187 - DNA, 25 bp, Mus musculus
aggcatcacaccaaggcagctgcaa

SEQ ID NO: 193188 - DNA, 25 bp, Mus musculus
aggcatcacacctaggcagctgcaa

SEQ ID NO: 193189 - DNA, 25 bp, Mus musculus
aggcatcactctaagatcccttata

SEQ ID NO: 193190 - DNA, 25 bp, Mus musculus
aggcatcactcttagatcccttata

SEQ ID NO: 193191 - DNA, 25 bp, Mus musculus
aggcatcagaccctggatcatccga

SEQ ID NO: 193192 - DNA, 25 bp, Mus musculus
aggcatcagaccgtggatcatccga

SEQ ID NO: 193193 - DNA, 25 bp, Mus musculus
aggcatcagctgcaccccaaggtgg

SEQ ID NO: 193194 - DNA, 25 bp, Mus musculus
aggcatcagctggaccccaaggtgg

SEQ ID NO: 193195 - DNA, 25 bp, Mus musculus
aggcatcaggcccagtgacagtgca

SEQ ID NO: 193196 - DNA, 25 bp, Mus musculus
aggcatcaggccgagtgacagtgca

SEQ ID NO: 193197 - DNA, 25 bp, Mus musculus
aggcatcatctgatgctggtatctt

SEQ ID NO: 193198 - DNA, 25 bp, Mus musculus
aggcatcatctgttgctggtatctt

SEQ ID NO: 193199 - DNA, 25 bp, Mus musculus
aggcatccaaacagatttcctccag

SEQ ID NO: 193200 - DNA, 25 bp, Mus musculus
aggcatccaaactgatttcctccag

SEQ ID NO: 193201 - DNA, 25 bp, Mus musculus
aggcatccatgacctgtacgacctg

SEQ ID NO: 193202 - DNA, 25 bp, Mus musculus
aggcatccatgagctgtacgacctg

SEQ ID NO: 193203 - DNA, 25 bp, Mus musculus
aggcatccattcatctatcactgta

SEQ ID NO: 193204 - DNA, 25 bp, Mus musculus
aggcatccattcttctatcactgta

SEQ ID NO: 193205 - DNA, 25 bp, Mus musculus
aggcatccatttcacactgaggctg

SEQ ID NO: 193206 - DNA, 25 bp, Mus musculus
aggcatccatttgacactgaggctg

SEQ ID NO: 193207 - DNA, 25 bp, Mus musculus
aggcatcccactcagacactgcaga

SEQ ID NO: 193208 - DNA, 25 bp, Mus musculus
aggcatcccactgagacactgcaga

SEQ ID NO: 193209 - DNA, 25 bp, Mus musculus
aggcatcccatcagggaaccagtga

SEQ ID NO: 193210 - DNA, 25 bp, Mus musculus
aggcatcccatctgggaaccagtga

SEQ ID NO: 193211 - DNA, 25 bp, Mus musculus
aggcatcccgtcatggtaccaaagg

SEQ ID NO: 193212 - DNA, 25 bp, Mus musculus
aggcatcccgtcttggtaccaaagg

SEQ ID NO: 193213 - DNA, 25 bp, Mus musculus
aggcatccctggataacctgagtgc

SEQ ID NO: 193214 - DNA, 25 bp, Mus musculus
aggcatccctggttaacctgagtgc

SEQ ID NO: 193215 - DNA, 25 bp, Mus musculus
aggcatccgacacctagaagtctag

SEQ ID NO: 193216 - DNA, 25 bp, Mus musculus
aggcatccgacagctagaagtctag

SEQ ID NO: 193217 - DNA, 25 bp, Mus musculus
aggcatcctaaaatcctttcccgat

SEQ ID NO: 193218 - DNA, 25 bp, Mus musculus
aggcatcctaaattcctttcccgat

SEQ ID NO: 193219 - DNA, 25 bp, Mus musculus
aggcatcctattagggtctcatgaa

SEQ ID NO: 193220 - DNA, 25 bp, Mus musculus
aggcatcctatttgggtctcatgaa

SEQ ID NO: 193221 - DNA, 25 bp, Mus musculus
aggcatcctgccagagttagcgcaa

SEQ ID NO: 193222 - DNA, 25 bp, Mus musculus
aggcatcctgccagcattgaaacag

SEQ ID NO: 193223 - DNA, 25 bp, Mus musculus
aggcatcctgcctgagttagcgcaa

SEQ ID NO: 193224 - DNA, 25 bp, Mus musculus
aggcatcctgcctgcattgaaacag

SEQ ID NO: 193225 - DNA, 25 bp, Mus musculus
aggcatcgagcccagcgactggata

SEQ ID NO: 193226 - DNA, 25 bp, Mus musculus
aggcatcgagccgagcgactggata

SEQ ID NO: 193227 - DNA, 25 bp, Mus musculus
aggcatcggatccactttcagtgat

SEQ ID NO: 193228 - DNA, 25 bp, Mus musculus
aggcatcggatcgactttcagtgat

SEQ ID NO: 193229 - DNA, 25 bp, Mus musculus
aggcatctagttcccatttattcat

SEQ ID NO: 193230 - DNA, 25 bp, Mus musculus
aggcatctagttgccatttattcat

SEQ ID NO: 193231 - DNA, 25 bp, Mus musculus
aggcatctatctcgacctgtttcta

SEQ ID NO: 193232 - DNA, 25 bp, Mus musculus
aggcatctatctggacctgtttcta

SEQ ID NO: 193233 - DNA, 25 bp, Mus musculus
aggcatctcaaaacactggccctca

SEQ ID NO: 193234 - DNA, 25 bp, Mus musculus
aggcatctcaaatcactggccctca

SEQ ID NO: 193235 - DNA, 25 bp, Mus musculus
aggcatctcctgaagcactgtgacc

SEQ ID NO: 193236 - DNA, 25 bp, Mus musculus
aggcatctcctgtagcactgtgacc

SEQ ID NO: 193237 - DNA, 25 bp, Mus musculus
aggcatctccttctttgtgcccaaa

SEQ ID NO: 193238 - DNA, 25 bp, Mus musculus
aggcatctccttgtttgtgcccaaa

SEQ ID NO: 193239 - DNA, 25 bp, Mus musculus
aggcatctctatattcctgctgaat

SEQ ID NO: 193240 - DNA, 25 bp, Mus musculus
aggcatctctattttcctgctgaat

SEQ ID NO: 193241 - DNA, 25 bp, Mus musculus
aggcatctgccacgatgttggcctt

SEQ ID NO: 193242 - DNA, 25 bp, Mus musculus
aggcatctgccaggatgttggcctt

SEQ ID NO: 193243 - DNA, 25 bp, Mus musculus
aggcatctgcctctgtaggttagtc

SEQ ID NO: 193244 - DNA, 25 bp, Mus musculus
aggcatctgcctgtgtaggttagtc

SEQ ID NO: 193245 - DNA, 25 bp, Mus musculus
aggcatctgggaccacaaaacagtt

SEQ ID NO: 193246 - DNA, 25 bp, Mus musculus
aggcatctgggagcacaaaacagtt

SEQ ID NO: 193247 - DNA, 25 bp, Mus musculus
aggcatctggtacatgaacttggat

SEQ ID NO: 193248 - DNA, 25 bp, Mus musculus
aggcatctggtagatgaacttggat

SEQ ID NO: 193249 - DNA, 25 bp, Mus musculus
aggcatctgtaaatgaccctgggat

SEQ ID NO: 193250 - DNA, 25 bp, Mus musculus
aggcatctgtaattgaccctgggat

SEQ ID NO: 193251 - DNA, 25 bp, Mus musculus
aggcatctgtccagctaccagagag

SEQ ID NO: 193252 - DNA, 25 bp, Mus musculus
aggcatctgtcctgctaccagagag

SEQ ID NO: 193253 - DNA, 25 bp, Mus musculus
aggcatcttcacagggccatggagg

SEQ ID NO: 193254 - DNA, 25 bp, Mus musculus
aggcatcttcactgggccatggagg

SEQ ID NO: 193255 - DNA, 25 bp, Mus musculus
aggcatcttcatatgctgagccatt

SEQ ID NO: 193256 - DNA, 25 bp, Mus musculus
aggcatcttcatctttggtgattac

SEQ ID NO: 193257 - DNA, 25 bp, Mus musculus
aggcatcttcatgtttggtgattac

SEQ ID NO: 193258 - DNA, 25 bp, Mus musculus
aggcatcttcatttgctgagccatt

SEQ ID NO: 193259 - DNA, 25 bp, Mus musculus
aggcatcttcgacttgaacagttgg

SEQ ID NO: 193260 - DNA, 25 bp, Mus musculus
aggcatcttcgagttgaacagttgg

SEQ ID NO: 193261 - DNA, 25 bp, Mus musculus
aggcatcttctaagggacccgtgac

SEQ ID NO: 193262 - DNA, 25 bp, Mus musculus
aggcatcttctatgggacccgtgac

SEQ ID NO: 193263 - DNA, 25 bp, Mus musculus
aggcatcttctcaattttctcaata

SEQ ID NO: 193264 - DNA, 25 bp, Mus musculus
aggcatcttctctattttctcaata

SEQ ID NO: 193265 - DNA, 25 bp, Mus musculus
aggcatctttggagactggtccgac

SEQ ID NO: 193266 - DNA, 25 bp, Mus musculus
aggcatctttggtgactggtccgac

SEQ ID NO: 193267 - DNA, 25 bp, Mus musculus
aggcatcttttaatcatctatatgt

SEQ ID NO: 193268 - DNA, 25 bp, Mus musculus
aggcatcttttattcatctatatgt

SEQ ID NO: 193269 - DNA, 25 bp, Mus musculus
aggcatcttttcagaccaattgtag

SEQ ID NO: 193270 - DNA, 25 bp, Mus musculus
aggcatcttttctgaccaattgtag

SEQ ID NO: 193271 - DNA, 25 bp, Mus musculus
aggcatgaaaccatgaattcttttt

SEQ ID NO: 193272 - DNA, 25 bp, Mus musculus
aggcatgaaaccttgaattcttttt

SEQ ID NO: 193273 - DNA, 25 bp, Mus musculus
aggcatgaaatcaccattcctcgat

SEQ ID NO: 193274 - DNA, 25 bp, Mus musculus
aggcatgaaatctccattcctcgat

SEQ ID NO: 193275 - DNA, 25 bp, Mus musculus
aggcatgaacaaagggcttcttttt

SEQ ID NO: 193276 - DNA, 25 bp, Mus musculus
aggcatgaacaatgggcttcttttt

SEQ ID NO: 193277 - DNA, 25 bp, Mus musculus
aggcatgaaccaaccttcagtttac

SEQ ID NO: 193278 - DNA, 25 bp, Mus musculus
aggcatgaaccatccttcagtttac

SEQ ID NO: 193279 - DNA, 25 bp, Mus musculus
aggcatgaactaagtctgttccata

SEQ ID NO: 193280 - DNA, 25 bp, Mus musculus
aggcatgaactatgtctgttccata

SEQ ID NO: 193281 - DNA, 25 bp, Mus musculus
aggcatgaattcatctgtccctttg

SEQ ID NO: 193282 - DNA, 25 bp, Mus musculus
aggcatgaattcttctgtccctttg

SEQ ID NO: 193283 - DNA, 25 bp, Mus musculus
aggcatgaattgcatctggtggtat

SEQ ID NO: 193284 - DNA, 25 bp, Mus musculus
aggcatgaattggatctggtggtat

SEQ ID NO: 193285 - DNA, 25 bp, Mus musculus
aggcatgacaacactcacctgtaat

SEQ ID NO: 193286 - DNA, 25 bp, Mus musculus
aggcatgacaactctcacctgtaat

SEQ ID NO: 193287 - DNA, 25 bp, Mus musculus
aggcatgatcgtcgtacacagctat

SEQ ID NO: 193288 - DNA, 25 bp, Mus musculus
aggcatgatcgtggtacacagctat

SEQ ID NO: 193289 - DNA, 25 bp, Mus musculus
aggcatgatgctcacatcgggcaca

SEQ ID NO: 193290 - DNA, 25 bp, Mus musculus
aggcatgatgctgacatcgggcaca

SEQ ID NO: 193291 - DNA, 25 bp, Mus musculus
aggcatgatggtccaggccaccaat

SEQ ID NO: 193292 - DNA, 25 bp, Mus musculus
aggcatgatggtgcaggccaccaat

SEQ ID NO: 193293 - DNA, 25 bp, Mus musculus
aggcatgattgtccctacctgccat

SEQ ID NO: 193294 - DNA, 25 bp, Mus musculus
aggcatgattgtgcctacctgccat

SEQ ID NO: 193295 - DNA, 25 bp, Mus musculus
aggcatgcaagaacaatctctggac

SEQ ID NO: 193296 - DNA, 25 bp, Mus musculus
aggcatgcaagatcaatctctggac

SEQ ID NO: 193297 - DNA, 25 bp, Mus musculus
aggcatgcaattatggtctgcgaca

SEQ ID NO: 193298 - DNA, 25 bp, Mus musculus
aggcatgcaattttggtctgcgaca

SEQ ID NO: 193299 - DNA, 25 bp, Mus musculus
aggcatgcagccatgagttctgtta

SEQ ID NO: 193300 - DNA, 25 bp, Mus musculus
aggcatgcagccttgagttctgtta

SEQ ID NO: 193301 - DNA, 25 bp, Mus musculus
aggcatgcagttccaaagcccagaa

SEQ ID NO: 193302 - DNA, 25 bp, Mus musculus
aggcatgcagttgcaaagcccagaa

SEQ ID NO: 193303 - DNA, 25 bp, Mus musculus
aggcatgcatgcactctgattggca

SEQ ID NO: 193304 - DNA, 25 bp, Mus musculus
aggcatgcatgctctctgattggca

SEQ ID NO: 193305 - DNA, 25 bp, Mus musculus
aggcatgcatgtcatttcccattgt

SEQ ID NO: 193306 - DNA, 25 bp, Mus musculus
aggcatgcatgtgatttcccattgt

SEQ ID NO: 193307 - DNA, 25 bp, Mus musculus
aggcatgcccatatgtcatcaacat

SEQ ID NO: 193308 - DNA, 25 bp, Mus musculus
aggcatgcccatttgtcatcaacat

SEQ ID NO: 193309 - DNA, 25 bp, Mus musculus
aggcatgcccctactctatgctagt

SEQ ID NO: 193310 - DNA, 25 bp, Mus musculus
aggcatgccccttctctatgctagt

SEQ ID NO: 193311 - DNA, 25 bp, Mus musculus
aggcatgccctaccataagctacag

SEQ ID NO: 193312 - DNA, 25 bp, Mus musculus
aggcatgccctagcataagctacag

SEQ ID NO: 193313 - DNA, 25 bp, Mus musculus
aggcatgccctgctgaagtaacttt

SEQ ID NO: 193314 - DNA, 25 bp, Mus musculus
aggcatgccctggtgaagtaacttt

SEQ ID NO: 193315 - DNA, 25 bp, Mus musculus
aggcatgcccttagagcatggtgtt

SEQ ID NO: 193316 - DNA, 25 bp, Mus musculus
aggcatgccctttgagcatggtgtt

SEQ ID NO: 193317 - DNA, 25 bp, Mus musculus
aggcatgccgggaaactatgtccag

SEQ ID NO: 193318 - DNA, 25 bp, Mus musculus
aggcatgccgggtaactatgtccag

SEQ ID NO: 193319 - DNA, 25 bp, Mus musculus
aggcatgcctccaaaggcttcatgg

SEQ ID NO: 193320 - DNA, 25 bp, Mus musculus
aggcatgcctcctaaggcttcatgg

SEQ ID NO: 193321 - DNA, 25 bp, Mus musculus
aggcatgcgaggactgctttgatct

SEQ ID NO: 193322 - DNA, 25 bp, Mus musculus
aggcatgcgaggtctgctttgatct

SEQ ID NO: 193323 - DNA, 25 bp, Mus musculus
aggcatgctgaaccccggatattca

SEQ ID NO: 193324 - DNA, 25 bp, Mus musculus
aggcatgctgaagcccggatattca

SEQ ID NO: 193325 - DNA, 25 bp, Mus musculus
aggcatgctgcgacccaaggctttg

SEQ ID NO: 193326 - DNA, 25 bp, Mus musculus
aggcatgctgcgtcccaaggctttg

SEQ ID NO: 193327 - DNA, 25 bp, Mus musculus
aggcatgctgtgactgaagtgttta

SEQ ID NO: 193328 - DNA, 25 bp, Mus musculus
aggcatgctgtgtctgaagtgttta

SEQ ID NO: 193329 - DNA, 25 bp, Mus musculus
aggcatgctgttatagttaatgtca

SEQ ID NO: 193330 - DNA, 25 bp, Mus musculus
aggcatgctgttttagttaatgtca

SEQ ID NO: 193331 - DNA, 25 bp, Mus musculus
aggcatgcttacaatgagggttggc

SEQ ID NO: 193332 - DNA, 25 bp, Mus musculus
aggcatgcttactatgagggttggc

SEQ ID NO: 193333 - DNA, 25 bp, Mus musculus
aggcatggacaacctttattaaaga

SEQ ID NO: 193334 - DNA, 25 bp, Mus musculus
aggcatggacaagctttattaaaga

SEQ ID NO: 193335 - DNA, 25 bp, Mus musculus
aggcatggacaccagaggcccagta

SEQ ID NO: 193336 - DNA, 25 bp, Mus musculus
aggcatggacacgagaggcccagta

SEQ ID NO: 193337 - DNA, 25 bp, Mus musculus
aggcatggaccaccgcggagaatct

SEQ ID NO: 193338 - DNA, 25 bp, Mus musculus
aggcatggaccagcgcggagaatct

SEQ ID NO: 193339 - DNA, 25 bp, Mus musculus
aggcatggacgtcacctacatctgg

SEQ ID NO: 193340 - DNA, 25 bp, Mus musculus
aggcatggacgtgacctacatctgg

SEQ ID NO: 193341 - DNA, 25 bp, Mus musculus
aggcatggactaccggatcaagctt

SEQ ID NO: 193342 - DNA, 25 bp, Mus musculus
aggcatggactagcggatcaagctt

SEQ ID NO: 193343 - DNA, 25 bp, Mus musculus
aggcatggatgcctctctgtctcat

SEQ ID NO: 193344 - DNA, 25 bp, Mus musculus
aggcatggatgcgtctctgtctcat

SEQ ID NO: 193345 - DNA, 25 bp, Mus musculus
aggcatggccgaaaacttcaacact

SEQ ID NO: 193346 - DNA, 25 bp, Mus musculus
aggcatggccgataacttcaacact

SEQ ID NO: 193347 - DNA, 25 bp, Mus musculus
aggcatggcggcagatggaatccca

SEQ ID NO: 193348 - DNA, 25 bp, Mus musculus
aggcatggcggctgatggaatccca

SEQ ID NO: 193349 - DNA, 25 bp, Mus musculus
aggcatggtgccaagctgctctacg

SEQ ID NO: 193350 - DNA, 25 bp, Mus musculus
aggcatggtgcctagctgctctacg

SEQ ID NO: 193351 - DNA, 25 bp, Mus musculus
aggcatggtggtaggcccacaactc

SEQ ID NO: 193352 - DNA, 25 bp, Mus musculus
aggcatggtggttggcccacaactc

SEQ ID NO: 193353 - DNA, 25 bp, Mus musculus
aggcatgtaccaccaagcttggttc

SEQ ID NO: 193354 - DNA, 25 bp, Mus musculus
aggcatgtaccagcaagcttggttc

SEQ ID NO: 193355 - DNA, 25 bp, Mus musculus
aggcatgtagcaattaggcttcaga

SEQ ID NO: 193356 - DNA, 25 bp, Mus musculus
aggcatgtagcatttaggcttcaga

SEQ ID NO: 193357 - DNA, 25 bp, Mus musculus
aggcatgtagtaacccacagtactc

SEQ ID NO: 193358 - DNA, 25 bp, Mus musculus
aggcatgtagtatcccacagtactc

SEQ ID NO: 193359 - DNA, 25 bp, Mus musculus
aggcatgtatctcctaagtagctac

SEQ ID NO: 193360 - DNA, 25 bp, Mus musculus
aggcatgtatctgctaagtagctac

SEQ ID NO: 193361 - DNA, 25 bp, Mus musculus
aggcatgtcagaccagctgacctcc

SEQ ID NO: 193362 - DNA, 25 bp, Mus musculus
aggcatgtcagagcagctgacctcc

SEQ ID NO: 193363 - DNA, 25 bp, Mus musculus
aggcatgtgctaccgtgcccgtttc

SEQ ID NO: 193364 - DNA, 25 bp, Mus musculus
aggcatgtgctagcgtgcccgtttc

SEQ ID NO: 193365 - DNA, 25 bp, Mus musculus
aggcatgtgctcactgtgcaccaaa

SEQ ID NO: 193366 - DNA, 25 bp, Mus musculus
aggcatgtgctctctgtgcaccaaa

SEQ ID NO: 193367 - DNA, 25 bp, Mus musculus
aggcatgtggctataccactggcaa

SEQ ID NO: 193368 - DNA, 25 bp, Mus musculus
aggcatgtggctttaccactggcaa

SEQ ID NO: 193369 - DNA, 25 bp, Mus musculus
aggcatgttagcatcctctccccaa

SEQ ID NO: 193370 - DNA, 25 bp, Mus musculus
aggcatgttagcttcctctccccaa

SEQ ID NO: 193371 - DNA, 25 bp, Mus musculus
aggcatgttctaccagattcaccaa

SEQ ID NO: 193372 - DNA, 25 bp, Mus musculus
aggcatgttctagcagattcaccaa

SEQ ID NO: 193373 - DNA, 25 bp, Mus musculus
aggcatgtttcaatcagttgtgaga

SEQ ID NO: 193374 - DNA, 25 bp, Mus musculus
aggcatgtttcattcagttgtgaga

SEQ ID NO: 193375 - DNA, 25 bp, Mus musculus
aggcattactcgagtgctgaggaca

SEQ ID NO: 193376 - DNA, 25 bp, Mus musculus
aggcattactcgtgtgctgaggaca

SEQ ID NO: 193377 - DNA, 25 bp, Mus musculus
aggcattagaaacctttccgtggct

SEQ ID NO: 193378 - DNA, 25 bp, Mus musculus
aggcattagaaagctttccgtggct

SEQ ID NO: 193379 - DNA, 25 bp, Mus musculus
aggcattaggccaactcctggagta

SEQ ID NO: 193380 - DNA, 25 bp, Mus musculus
aggcattaggcctactcctggagta

SEQ ID NO: 193381 - DNA, 25 bp, Mus musculus
aggcattatcagaggacatgctaat

SEQ ID NO: 193382 - DNA, 25 bp, Mus musculus
aggcattatcagtggacatgctaat

SEQ ID NO: 193383 - DNA, 25 bp, Mus musculus
aggcattattacagggcaccgactt

SEQ ID NO: 193384 - DNA, 25 bp, Mus musculus
aggcattattactgggcaccgactt

SEQ ID NO: 193385 - DNA, 25 bp, Mus musculus
aggcattatttgcacctgtgtggta

SEQ ID NO: 193386 - DNA, 25 bp, Mus musculus
aggcattatttggacctgtgtggta

SEQ ID NO: 193387 - DNA, 25 bp, Mus musculus
aggcattcaaccactatgtaattag

SEQ ID NO: 193388 - DNA, 25 bp, Mus musculus
aggcattcaacctctatgtaattag

SEQ ID NO: 193389 - DNA, 25 bp, Mus musculus
aggcattcaggaagcacctcatgaa

SEQ ID NO: 193390 - DNA, 25 bp, Mus musculus
aggcattcaggatgcacctcatgaa

SEQ ID NO: 193391 - DNA, 25 bp, Mus musculus
aggcattcatgaccatggcggccga

SEQ ID NO: 193392 - DNA, 25 bp, Mus musculus
aggcattcatgagcatggcggccga

SEQ ID NO: 193393 - DNA, 25 bp, Mus musculus
aggcattcatgcatgggttccttat

SEQ ID NO: 193394 - DNA, 25 bp, Mus musculus
aggcattcatgcttgggttccttat

SEQ ID NO: 193395 - DNA, 25 bp, Mus musculus
aggcattcattcaatctttgctcaa

SEQ ID NO: 193396 - DNA, 25 bp, Mus musculus
aggcattcattctatctttgctcaa

SEQ ID NO: 193397 - DNA, 25 bp, Mus musculus
aggcattccactaattaaacccaca

SEQ ID NO: 193398 - DNA, 25 bp, Mus musculus
aggcattccacttattaaacccaca

SEQ ID NO: 193399 - DNA, 25 bp, Mus musculus
aggcattccaggaccacagggtagt

SEQ ID NO: 193400 - DNA, 25 bp, Mus musculus
aggcattccaggtccacagggtagt

SEQ ID NO: 193401 - DNA, 25 bp, Mus musculus
aggcattccggcctaaggagcacct

SEQ ID NO: 193402 - DNA, 25 bp, Mus musculus
aggcattccggcgtaaggagcacct

SEQ ID NO: 193403 - DNA, 25 bp, Mus musculus
aggcattcctcacacccagggatgt

SEQ ID NO: 193404 - DNA, 25 bp, Mus musculus
aggcattcctcagacccagggatgt

SEQ ID NO: 193405 - DNA, 25 bp, Mus musculus
aggcattcctgacgctggcagccag

SEQ ID NO: 193406 - DNA, 25 bp, Mus musculus
aggcattcctgaggctggcagccag

SEQ ID NO: 193407 - DNA, 25 bp, Mus musculus
aggcattctataagctagctcctcc

SEQ ID NO: 193408 - DNA, 25 bp, Mus musculus
aggcattctatatgctagctcctcc

SEQ ID NO: 193409 - DNA, 25 bp, Mus musculus
aggcattctggtcactgaccttgaa

SEQ ID NO: 193410 - DNA, 25 bp, Mus musculus
aggcattctggtgactgaccttgaa

SEQ ID NO: 193411 - DNA, 25 bp, Mus musculus
aggcattctttgactgtctgcgtgc

SEQ ID NO: 193412 - DNA, 25 bp, Mus musculus
aggcattctttgtctgtctgcgtgc

SEQ ID NO: 193413 - DNA, 25 bp, Mus musculus
aggcattgacctctgtgatccatgt

SEQ ID NO: 193414 - DNA, 25 bp, Mus musculus
aggcattgacctgtgtgatccatgt

SEQ ID NO: 193415 - DNA, 25 bp, Mus musculus
aggcattgagaccttgagcaccaga

SEQ ID NO: 193416 - DNA, 25 bp, Mus musculus
aggcattgagacgttgagcaccaga

SEQ ID NO: 193417 - DNA, 25 bp, Mus musculus
aggcattgagttagacatttttctg

SEQ ID NO: 193418 - DNA, 25 bp, Mus musculus
aggcattgagtttgacatttttctg

SEQ ID NO: 193419 - DNA, 25 bp, Mus musculus
aggcattgcagcactttgagtccca

SEQ ID NO: 193420 - DNA, 25 bp, Mus musculus
aggcattgcagctctttgagtccca

SEQ ID NO: 193421 - DNA, 25 bp, Mus musculus
aggcattgcagtccagactgaaccc

SEQ ID NO: 193422 - DNA, 25 bp, Mus musculus
aggcattgcagtgcagactgaaccc

SEQ ID NO: 193423 - DNA, 25 bp, Mus musculus
aggcattgccggctgccgctggcga

SEQ ID NO: 193424 - DNA, 25 bp, Mus musculus
aggcattgccgggtgccgctggcga

SEQ ID NO: 193425 - DNA, 25 bp, Mus musculus
aggcattgccttcctaggcatcacg

SEQ ID NO: 193426 - DNA, 25 bp, Mus musculus
aggcattgccttgctaggcatcacg

SEQ ID NO: 193427 - DNA, 25 bp, Mus musculus
aggcattgcgcgagcagttcggaac

SEQ ID NO: 193428 - DNA, 25 bp, Mus musculus
aggcattgcgcgtgcagttcggaac

SEQ ID NO: 193429 - DNA, 25 bp, Mus musculus
aggcattgcgctctatctggtttta

SEQ ID NO: 193430 - DNA, 25 bp, Mus musculus
aggcattgcgctgtatctggtttta

SEQ ID NO: 193431 - DNA, 25 bp, Mus musculus
aggcattgctgacaggatgcagaag

SEQ ID NO: 193432 - DNA, 25 bp, Mus musculus
aggcattgctgagaggatgcagaag

SEQ ID NO: 193433 - DNA, 25 bp, Mus musculus
aggcattgctttccctgggcctcat

SEQ ID NO: 193434 - DNA, 25 bp, Mus musculus
aggcattgctttgcctgggcctcat

SEQ ID NO: 193435 - DNA, 25 bp, Mus musculus
aggcattggcttagcagaacactaa

SEQ ID NO: 193436 - DNA, 25 bp, Mus musculus
aggcattggctttgcagaacactaa

SEQ ID NO: 193437 - DNA, 25 bp, Mus musculus
aggcattgtcctcatgcctataatc

SEQ ID NO: 193438 - DNA, 25 bp, Mus musculus
aggcattgtcctcttatagtgtcac

SEQ ID NO: 193439 - DNA, 25 bp, Mus musculus
aggcattgtcctgatgcctataatc

SEQ ID NO: 193440 - DNA, 25 bp, Mus musculus
aggcattgtcctgttatagtgtcac

SEQ ID NO: 193441 - DNA, 25 bp, Mus musculus
aggcattgtggcacactgtgttcta

SEQ ID NO: 193442 - DNA, 25 bp, Mus musculus
aggcattgtggctcactgtgttcta

SEQ ID NO: 193443 - DNA, 25 bp, Mus musculus
aggcatttaaggctcatccattccc

SEQ ID NO: 193444 - DNA, 25 bp, Mus musculus
aggcatttaagggtcatccattccc

SEQ ID NO: 193445 - DNA, 25 bp, Mus musculus
aggcatttagctctgtctggtcaga

SEQ ID NO: 193446 - DNA, 25 bp, Mus musculus
aggcatttagctgtgtctggtcaga

SEQ ID NO: 193447 - DNA, 25 bp, Mus musculus
aggcatttaggtactgctctctgtg

SEQ ID NO: 193448 - DNA, 25 bp, Mus musculus
aggcatttaggttctgctctctgtg

SEQ ID NO: 193449 - DNA, 25 bp, Mus musculus
aggcatttagtcatcctatcctatg

SEQ ID NO: 193450 - DNA, 25 bp, Mus musculus
aggcatttagtcttcctatcctatg

SEQ ID NO: 193451 - DNA, 25 bp, Mus musculus
aggcatttagttcatccctatccct

SEQ ID NO: 193452 - DNA, 25 bp, Mus musculus
aggcatttagttgatccctatccct

SEQ ID NO: 193453 - DNA, 25 bp, Mus musculus
aggcatttcaaaacacccaggacag

SEQ ID NO: 193454 - DNA, 25 bp, Mus musculus
aggcatttcaaatcacccaggacag

SEQ ID NO: 193455 - DNA, 25 bp, Mus musculus
aggcatttccacataggctctaggc

SEQ ID NO: 193456 - DNA, 25 bp, Mus musculus
aggcatttccacttaggctctaggc

SEQ ID NO: 193457 - DNA, 25 bp, Mus musculus
aggcatttccagaatcacaaggcga

SEQ ID NO: 193458 - DNA, 25 bp, Mus musculus
aggcatttccagtatcacaaggcga

SEQ ID NO: 193459 - DNA, 25 bp, Mus musculus
aggcatttccctatttctgttgaga

SEQ ID NO: 193460 - DNA, 25 bp, Mus musculus
aggcatttccctttttctgttgaga

SEQ ID NO: 193461 - DNA, 25 bp, Mus musculus
aggcatttctgcctcgtgtgcactg

SEQ ID NO: 193462 - DNA, 25 bp, Mus musculus
aggcatttctgcgtcgtgtgcactg

SEQ ID NO: 193463 - DNA, 25 bp, Mus musculus
aggcatttctttaggacacctctac

SEQ ID NO: 193464 - DNA, 25 bp, Mus musculus
aggcatttcttttggacacctctac

SEQ ID NO: 193465 - DNA, 25 bp, Mus musculus
aggcatttgacaatggtgcctgtct

SEQ ID NO: 193466 - DNA, 25 bp, Mus musculus
aggcatttgacattggtgcctgtct

SEQ ID NO: 193467 - DNA, 25 bp, Mus musculus
aggcatttgcccatcatttaggatg

SEQ ID NO: 193468 - DNA, 25 bp, Mus musculus
aggcatttgcccttcatttaggatg

SEQ ID NO: 193469 - DNA, 25 bp, Mus musculus
aggcatttggccatgccccttgagc

SEQ ID NO: 193470 - DNA, 25 bp, Mus musculus
aggcatttggccttgccccttgagc

SEQ ID NO: 193471 - DNA, 25 bp, Mus musculus
aggcatttgggcatgctacttgacc

SEQ ID NO: 193472 - DNA, 25 bp, Mus musculus
aggcatttgggcattcagcacattc

SEQ ID NO: 193473 - DNA, 25 bp, Mus musculus
aggcatttgggcttgctacttgacc

SEQ ID NO: 193474 - DNA, 25 bp, Mus musculus
aggcatttgggctttcagcacattc

SEQ ID NO: 193475 - DNA, 25 bp, Mus musculus
aggcatttgtaaccagcttgacatg

SEQ ID NO: 193476 - DNA, 25 bp, Mus musculus
aggcatttgtaagcagcttgacatg

SEQ ID NO: 193477 - DNA, 25 bp, Mus musculus
aggcatttgtatatccaaggcttaa

SEQ ID NO: 193478 - DNA, 25 bp, Mus musculus
aggcatttgtatttccaaggcttaa

SEQ ID NO: 193479 - DNA, 25 bp, Mus musculus
aggcatttgtccactcaaaacctag

SEQ ID NO: 193480 - DNA, 25 bp, Mus musculus
aggcatttgtcctctcaaaacctag

SEQ ID NO: 193481 - DNA, 25 bp, Mus musculus
aggcatttgtgtcggagccagccat

SEQ ID NO: 193482 - DNA, 25 bp, Mus musculus
aggcatttgtgtcgtgggatttttt

SEQ ID NO: 193483 - DNA, 25 bp, Mus musculus
aggcatttgtgtgggagccagccat

SEQ ID NO: 193484 - DNA, 25 bp, Mus musculus
aggcatttgtgtggtgggatttttt

SEQ ID NO: 193485 - DNA, 25 bp, Mus musculus
aggcattttaaaacagctccctgtg

SEQ ID NO: 193486 - DNA, 25 bp, Mus musculus
aggcattttaaatcagctccctgtg

SEQ ID NO: 193487 - DNA, 25 bp, Mus musculus
aggcattttttacagctacttttca

SEQ ID NO: 193488 - DNA, 25 bp, Mus musculus
aggcattttttagagctacttttca

SEQ ID NO: 193489 - DNA, 25 bp, Mus musculus
aggccaaaatcaaagctgcgcagca

SEQ ID NO: 193490 - DNA, 25 bp, Mus musculus
aggccaaaatcatagctgcgcagca

SEQ ID NO: 193491 - DNA, 25 bp, Mus musculus
aggccaaaatccaatctgacaggga

SEQ ID NO: 193492 - DNA, 25 bp, Mus musculus
aggccaaaatcctatctgacaggga

SEQ ID NO: 193493 - DNA, 25 bp, Mus musculus
aggccaaacataattgcaagtggat

SEQ ID NO: 193494 - DNA, 25 bp, Mus musculus
aggccaaacatatttgcaagtggat

SEQ ID NO: 193495 - DNA, 25 bp, Mus musculus
aggccaaacccaagaacagcgtatg

SEQ ID NO: 193496 - DNA, 25 bp, Mus musculus
aggccaaacccatgaacagcgtatg

SEQ ID NO: 193497 - DNA, 25 bp, Mus musculus
aggccaaaccgcagatgcagaaatg

SEQ ID NO: 193498 - DNA, 25 bp, Mus musculus
aggccaaaccgctgatgcagaaatg

SEQ ID NO: 193499 - DNA, 25 bp, Mus musculus
aggccaaacctacgcttgggagtca

SEQ ID NO: 193500 - DNA, 25 bp, Mus musculus
aggccaaacctaggcttgggagtca

SEQ ID NO: 193501 - DNA, 25 bp, Mus musculus
aggccaaagagccaggttcccttga

SEQ ID NO: 193502 - DNA, 25 bp, Mus musculus
aggccaaagagcgaggttcccttga

SEQ ID NO: 193503 - DNA, 25 bp, Mus musculus
aggccaaagcctcagactcagatga

SEQ ID NO: 193504 - DNA, 25 bp, Mus musculus
aggccaaagcctgagactcagatga

SEQ ID NO: 193505 - DNA, 25 bp, Mus musculus
aggccaaagctccaaggctggtgat

SEQ ID NO: 193506 - DNA, 25 bp, Mus musculus
aggccaaagctcgaaggctggtgat

SEQ ID NO: 193507 - DNA, 25 bp, Mus musculus
aggccaaagcttccaggaacaagta

SEQ ID NO: 193508 - DNA, 25 bp, Mus musculus
aggccaaagcttgcaggaacaagta

SEQ ID NO: 193509 - DNA, 25 bp, Mus musculus
aggccaaaggccaaggtgccctgga

SEQ ID NO: 193510 - DNA, 25 bp, Mus musculus
aggccaaaggcctaggtgccctgga

SEQ ID NO: 193511 - DNA, 25 bp, Mus musculus
aggccaaaggtcctatggtccattt

SEQ ID NO: 193512 - DNA, 25 bp, Mus musculus
aggccaaaggtcgtatggtccattt

SEQ ID NO: 193513 - DNA, 25 bp, Mus musculus
aggccaaaggttcactatgcccgac

SEQ ID NO: 193514 - DNA, 25 bp, Mus musculus
aggccaaaggttgactatgcccgac

SEQ ID NO: 193515 - DNA, 25 bp, Mus musculus
aggccaaatccgagcagaagtcttc

SEQ ID NO: 193516 - DNA, 25 bp, Mus musculus
aggccaaatccgtgcagaagtcttc

SEQ ID NO: 193517 - DNA, 25 bp, Mus musculus
aggccaaatcctagggcagcggttg

SEQ ID NO: 193518 - DNA, 25 bp, Mus musculus
aggccaaatccttgggcagcggttg

SEQ ID NO: 193519 - DNA, 25 bp, Mus musculus
aggccaaatgcaccgtttctctcag

SEQ ID NO: 193520 - DNA, 25 bp, Mus musculus
aggccaaatgcagcgtttctctcag

SEQ ID NO: 193521 - DNA, 25 bp, Mus musculus
aggccaaatgtaactgaccccaagc

SEQ ID NO: 193522 - DNA, 25 bp, Mus musculus
aggccaaatgtatctgaccccaagc

SEQ ID NO: 193523 - DNA, 25 bp, Mus musculus
aggccaaattacaaggcatgtgttt

SEQ ID NO: 193524 - DNA, 25 bp, Mus musculus
aggccaaattactaggcatgtgttt

SEQ ID NO: 193525 - DNA, 25 bp, Mus musculus
aggccaacacaaccttagccttggt

SEQ ID NO: 193526 - DNA, 25 bp, Mus musculus
aggccaacacaagcttagccttggt

SEQ ID NO: 193527 - DNA, 25 bp, Mus musculus
aggccaacaccaacctgtccaagtt

SEQ ID NO: 193528 - DNA, 25 bp, Mus musculus
aggccaacaccaacgaagttctctg

SEQ ID NO: 193529 - DNA, 25 bp, Mus musculus
aggccaacaccatcctgtccaagtt

SEQ ID NO: 193530 - DNA, 25 bp, Mus musculus
aggccaacaccatcgaagttctctg

SEQ ID NO: 193531 - DNA, 25 bp, Mus musculus
aggccaacatacacgatgtcgccgt

SEQ ID NO: 193532 - DNA, 25 bp, Mus musculus
aggccaacatactcgatgtcgccgt

SEQ ID NO: 193533 - DNA, 25 bp, Mus musculus
aggccaacctgcaaagggtgctgct

SEQ ID NO: 193534 - DNA, 25 bp, Mus musculus
aggccaacctgctaagggtgctgct

SEQ ID NO: 193535 - DNA, 25 bp, Mus musculus
aggccaaccttgaacccatgattcc

SEQ ID NO: 193536 - DNA, 25 bp, Mus musculus
aggccaaccttgctgacatgcagtt

SEQ ID NO: 193537 - DNA, 25 bp, Mus musculus
aggccaaccttggtgacatgcagtt

SEQ ID NO: 193538 - DNA, 25 bp, Mus musculus
aggccaaccttgtacccatgattcc

SEQ ID NO: 193539 - DNA, 25 bp, Mus musculus
aggccaacggtaaccacgcagctgg

SEQ ID NO: 193540 - DNA, 25 bp, Mus musculus
aggccaacggtatccacgcagctgg

SEQ ID NO: 193541 - DNA, 25 bp, Mus musculus
aggccaactactctatgctcctctt

SEQ ID NO: 193542 - DNA, 25 bp, Mus musculus
aggccaactactgtatgctcctctt

SEQ ID NO: 193543 - DNA, 25 bp, Mus musculus
aggccaactgtgatgatgacacttg

SEQ ID NO: 193544 - DNA, 25 bp, Mus musculus
aggccaactgtgttgatgacacttg

SEQ ID NO: 193545 - DNA, 25 bp, Mus musculus
aggccaactgttccaaaacttcaag

SEQ ID NO: 193546 - DNA, 25 bp, Mus musculus
aggccaactgttgcaaaacttcaag

SEQ ID NO: 193547 - DNA, 25 bp, Mus musculus
aggccaacttggacttggcatctgt

SEQ ID NO: 193548 - DNA, 25 bp, Mus musculus
aggccaacttggtcttggcatctgt

SEQ ID NO: 193549 - DNA, 25 bp, Mus musculus
aggccaagaagcaatcgacagattt

SEQ ID NO: 193550 - DNA, 25 bp, Mus musculus
aggccaagaagctatcgacagattt

SEQ ID NO: 193551 - DNA, 25 bp, Mus musculus
aggccaagaaggctctgctcttcat

SEQ ID NO: 193552 - DNA, 25 bp, Mus musculus
aggccaagaagggtctgctcttcat

SEQ ID NO: 193553 - DNA, 25 bp, Mus musculus
aggccaagaccaccattgccatagg

SEQ ID NO: 193554 - DNA, 25 bp, Mus musculus
aggccaagaccagcattgccatagg

SEQ ID NO: 193555 - DNA, 25 bp, Mus musculus
aggccaagacggacctcaagctctg

SEQ ID NO: 193556 - DNA, 25 bp, Mus musculus
aggccaagacggtcctcaagctctg

SEQ ID NO: 193557 - DNA, 25 bp, Mus musculus
aggccaagagacacaccattgactc

SEQ ID NO: 193558 - DNA, 25 bp, Mus musculus
aggccaagagactcaccattgactc

SEQ ID NO: 193559 - DNA, 25 bp, Mus musculus
aggccaagatccacctagttctgtt

SEQ ID NO: 193560 - DNA, 25 bp, Mus musculus
aggccaagatcctcctagttctgtt

SEQ ID NO: 193561 - DNA, 25 bp, Mus musculus
aggccaagatcgaggacctgtccca

SEQ ID NO: 193562 - DNA, 25 bp, Mus musculus
aggccaagatcgtggacctgtccca

SEQ ID NO: 193563 - DNA, 25 bp, Mus musculus
aggccaagatgcactatcggaagaa

SEQ ID NO: 193564 - DNA, 25 bp, Mus musculus
aggccaagatgctctatcggaagaa

SEQ ID NO: 193565 - DNA, 25 bp, Mus musculus
aggccaagcaatccctggtcgaagg

SEQ ID NO: 193566 - DNA, 25 bp, Mus musculus
aggccaagcaatgcctggtcgaagg

SEQ ID NO: 193567 - DNA, 25 bp, Mus musculus
aggccaagccacagtctttaatttg

SEQ ID NO: 193568 - DNA, 25 bp, Mus musculus
aggccaagccactgtctttaatttg

SEQ ID NO: 193569 - DNA, 25 bp, Mus musculus
aggccaagccccaaagtaagtgtct

SEQ ID NO: 193570 - DNA, 25 bp, Mus musculus
aggccaagcccctaagtaagtgtct

SEQ ID NO: 193571 - DNA, 25 bp, Mus musculus
aggccaagcctgaagtgtccttcat

SEQ ID NO: 193572 - DNA, 25 bp, Mus musculus
aggccaagcctgagccagaaaacca

SEQ ID NO: 193573 - DNA, 25 bp, Mus musculus
aggccaagcctgtagtgtccttcat

SEQ ID NO: 193574 - DNA, 25 bp, Mus musculus
aggccaagcctgtgccagaaaacca

SEQ ID NO: 193575 - DNA, 25 bp, Mus musculus
aggccaaggctaaatccacagtcga

SEQ ID NO: 193576 - DNA, 25 bp, Mus musculus
aggccaaggctatatccacagtcga

SEQ ID NO: 193577 - DNA, 25 bp, Mus musculus
aggccaaggctgagacaatccgcaa

SEQ ID NO: 193578 - DNA, 25 bp, Mus musculus
aggccaaggctgtgacaatccgcaa

SEQ ID NO: 193579 - DNA, 25 bp, Mus musculus
aggccaaggcttcaaacatttactg

SEQ ID NO: 193580 - DNA, 25 bp, Mus musculus
aggccaaggcttgaaacatttactg

SEQ ID NO: 193581 - DNA, 25 bp, Mus musculus
aggccaaggtggctgtgcgctcggg

SEQ ID NO: 193582 - DNA, 25 bp, Mus musculus
aggccaaggtgggtgtgcgctcggg

SEQ ID NO: 193583 - DNA, 25 bp, Mus musculus
aggccaaggttcactgttcctgcct

SEQ ID NO: 193584 - DNA, 25 bp, Mus musculus
aggccaaggttctctgttcctgcct

SEQ ID NO: 193585 - DNA, 25 bp, Mus musculus
aggccaaggttgacagtcgccttca

SEQ ID NO: 193586 - DNA, 25 bp, Mus musculus
aggccaaggttgctagactgtgctt

SEQ ID NO: 193587 - DNA, 25 bp, Mus musculus
aggccaaggttggtagactgtgctt

SEQ ID NO: 193588 - DNA, 25 bp, Mus musculus
aggccaaggttgtcagtcgccttca

SEQ ID NO: 193589 - DNA, 25 bp, Mus musculus
aggccaagtcaaagtgtctctgttt

SEQ ID NO: 193590 - DNA, 25 bp, Mus musculus
aggccaagtcaatgtgtctctgttt

SEQ ID NO: 193591 - DNA, 25 bp, Mus musculus
aggccaagtcttcgtgcaaagtcaa

SEQ ID NO: 193592 - DNA, 25 bp, Mus musculus
aggccaagtcttggtgcaaagtcaa

SEQ ID NO: 193593 - DNA, 25 bp, Mus musculus
aggccaagtgaaccacaacgctatg

SEQ ID NO: 193594 - DNA, 25 bp, Mus musculus
aggccaagtgaagcacaacgctatg

SEQ ID NO: 193595 - DNA, 25 bp, Mus musculus
aggccaagtgacacttaattcctcc

SEQ ID NO: 193596 - DNA, 25 bp, Mus musculus
aggccaagtgactcttaattcctcc

SEQ ID NO: 193597 - DNA, 25 bp, Mus musculus
aggccaagtgcaacttactgtgtgt

SEQ ID NO: 193598 - DNA, 25 bp, Mus musculus
aggccaagtgcatcttactgtgtgt

SEQ ID NO: 193599 - DNA, 25 bp, Mus musculus
aggccaagtgtactcaagctctgta

SEQ ID NO: 193600 - DNA, 25 bp, Mus musculus
aggccaagtgtagtcaagctctgta

SEQ ID NO: 193601 - DNA, 25 bp, Mus musculus
aggccaagttggactctcagagtac

SEQ ID NO: 193602 - DNA, 25 bp, Mus musculus
aggccaagttggtctctcagagtac

SEQ ID NO: 193603 - DNA, 25 bp, Mus musculus
aggccaagtttcatcctattgtcaa

SEQ ID NO: 193604 - DNA, 25 bp, Mus musculus
aggccaagtttcttcctattgtcaa

SEQ ID NO: 193605 - DNA, 25 bp, Mus musculus
aggccaatacctcagcttaaagtgc

SEQ ID NO: 193606 - DNA, 25 bp, Mus musculus
aggccaatacctgagcttaaagtgc

SEQ ID NO: 193607 - DNA, 25 bp, Mus musculus
aggccaatcggcagcggttgcgccc

SEQ ID NO: 193608 - DNA, 25 bp, Mus musculus
aggccaatcggctgcggttgcgccc

SEQ ID NO: 193609 - DNA, 25 bp, Mus musculus
aggccaatctggcttacaatctgtt

SEQ ID NO: 193610 - DNA, 25 bp, Mus musculus
aggccaatctgggttacaatctgtt

SEQ ID NO: 193611 - DNA, 25 bp, Mus musculus
aggccaatgactcttccagaatctt

SEQ ID NO: 193612 - DNA, 25 bp, Mus musculus
aggccaatgactgttccagaatctt

SEQ ID NO: 193613 - DNA, 25 bp, Mus musculus
aggccaatgatgacgcccgcacttt

SEQ ID NO: 193614 - DNA, 25 bp, Mus musculus
aggccaatgatgtcgcccgcacttt

SEQ ID NO: 193615 - DNA, 25 bp, Mus musculus
aggccaatgcccaggtgtcctagta

SEQ ID NO: 193616 - DNA, 25 bp, Mus musculus
aggccaatgccctggtgtcctagta

SEQ ID NO: 193617 - DNA, 25 bp, Mus musculus
aggccaatgcttattccatctttaa

SEQ ID NO: 193618 - DNA, 25 bp, Mus musculus
aggccaatgctttttccatctttaa

SEQ ID NO: 193619 - DNA, 25 bp, Mus musculus
aggccaatggcccatttctttggaa

SEQ ID NO: 193620 - DNA, 25 bp, Mus musculus
aggccaatggccgatttctttggaa

SEQ ID NO: 193621 - DNA, 25 bp, Mus musculus
aggccaatggctcaccacaaggaag

SEQ ID NO: 193622 - DNA, 25 bp, Mus musculus
aggccaatggctgaccacaaggaag

SEQ ID NO: 193623 - DNA, 25 bp, Mus musculus
aggccaatggtcctcttttatctat

SEQ ID NO: 193624 - DNA, 25 bp, Mus musculus
aggccaatggtcgtcttttatctat

SEQ ID NO: 193625 - DNA, 25 bp, Mus musculus
aggccaatttgaataatctactttc

SEQ ID NO: 193626 - DNA, 25 bp, Mus musculus
aggccaatttgattaatctactttc

SEQ ID NO: 193627 - DNA, 25 bp, Mus musculus
aggccacaagtcagtgtcgtcagtt

SEQ ID NO: 193628 - DNA, 25 bp, Mus musculus
aggccacaagtctgtgtcgtcagtt

SEQ ID NO: 193629 - DNA, 25 bp, Mus musculus
aggccacacacaagtctgcagtgtc

SEQ ID NO: 193630 - DNA, 25 bp, Mus musculus
aggccacacacatgtctgcagtgtc

SEQ ID NO: 193631 - DNA, 25 bp, Mus musculus
aggccacacagtagcttcttgagaa

SEQ ID NO: 193632 - DNA, 25 bp, Mus musculus
aggccacacagttgcttcttgagaa

SEQ ID NO: 193633 - DNA, 25 bp, Mus musculus
aggccacaccgtccatttacagcag

SEQ ID NO: 193634 - DNA, 25 bp, Mus musculus
aggccacaccgtgcatttacagcag

SEQ ID NO: 193635 - DNA, 25 bp, Mus musculus
aggccacaccttcgctgtcactgtg

SEQ ID NO: 193636 - DNA, 25 bp, Mus musculus
aggccacaccttggctgtcactgtg

SEQ ID NO: 193637 - DNA, 25 bp, Mus musculus
aggccacactgacggcagacacttc

SEQ ID NO: 193638 - DNA, 25 bp, Mus musculus
aggccacactgagggcagacacttc

SEQ ID NO: 193639 - DNA, 25 bp, Mus musculus
aggccacactgcagaacatgctgaa

SEQ ID NO: 193640 - DNA, 25 bp, Mus musculus
aggccacactgcatgggatgcgctc

SEQ ID NO: 193641 - DNA, 25 bp, Mus musculus
aggccacactgctgaacatgctgaa

SEQ ID NO: 193642 - DNA, 25 bp, Mus musculus
aggccacactgcttgggatgcgctc

SEQ ID NO: 193643 - DNA, 25 bp, Mus musculus
aggccacagactatcactgaagctt

SEQ ID NO: 193644 - DNA, 25 bp, Mus musculus
aggccacagactttcactgaagctt

SEQ ID NO: 193645 - DNA, 25 bp, Mus musculus
aggccacagataactgctgagtaat

SEQ ID NO: 193646 - DNA, 25 bp, Mus musculus
aggccacagatatctgctgagtaat

SEQ ID NO: 193647 - DNA, 25 bp, Mus musculus
aggccacagatgacatggctcacgt

SEQ ID NO: 193648 - DNA, 25 bp, Mus musculus
aggccacagatgtcatggctcacgt

SEQ ID NO: 193649 - DNA, 25 bp, Mus musculus
aggccacagcaaacctgacctgaaa

SEQ ID NO: 193650 - DNA, 25 bp, Mus musculus
aggccacagcaatcctgacctgaaa

SEQ ID NO: 193651 - DNA, 25 bp, Mus musculus
aggccacagcagcatgcccttggtg

SEQ ID NO: 193652 - DNA, 25 bp, Mus musculus
aggccacagcaggatgcccttggtg

SEQ ID NO: 193653 - DNA, 25 bp, Mus musculus
aggccacagcgcagagcgtcaaatg

SEQ ID NO: 193654 - DNA, 25 bp, Mus musculus
aggccacagcgctgagcgtcaaatg

SEQ ID NO: 193655 - DNA, 25 bp, Mus musculus
aggccacagtgaaacccgtgccgtt

SEQ ID NO: 193656 - DNA, 25 bp, Mus musculus
aggccacagtgatacccgtgccgtt

SEQ ID NO: 193657 - DNA, 25 bp, Mus musculus
aggccacagtttacgaggtcatcta

SEQ ID NO: 193658 - DNA, 25 bp, Mus musculus
aggccacagttttcgaggtcatcta

SEQ ID NO: 193659 - DNA, 25 bp, Mus musculus
aggccacatacaatactcaggtcaa

SEQ ID NO: 193660 - DNA, 25 bp, Mus musculus
aggccacatacattactcaggtcaa

SEQ ID NO: 193661 - DNA, 25 bp, Mus musculus
aggccacatagaccaggcggcagaa

SEQ ID NO: 193662 - DNA, 25 bp, Mus musculus
aggccacatagagcaggcggcagaa

SEQ ID NO: 193663 - DNA, 25 bp, Mus musculus
aggccacatatgcaccagcagtaaa

SEQ ID NO: 193664 - DNA, 25 bp, Mus musculus
aggccacatatggaccagcagtaaa

SEQ ID NO: 193665 - DNA, 25 bp, Mus musculus
aggccacatcacaaggtcaggtctg

SEQ ID NO: 193666 - DNA, 25 bp, Mus musculus
aggccacatcactaggtcaggtctg

SEQ ID NO: 193667 - DNA, 25 bp, Mus musculus
aggccacatccaaaggctgttacct

SEQ ID NO: 193668 - DNA, 25 bp, Mus musculus
aggccacatccataggctgttacct

SEQ ID NO: 193669 - DNA, 25 bp, Mus musculus
aggccacatgtgatctacagagtga

SEQ ID NO: 193670 - DNA, 25 bp, Mus musculus
aggccacatgtgttctacagagtga

SEQ ID NO: 193671 - DNA, 25 bp, Mus musculus
aggccacattcaccttgttgaggct

SEQ ID NO: 193672 - DNA, 25 bp, Mus musculus
aggccacattcagcttgttgaggct

SEQ ID NO: 193673 - DNA, 25 bp, Mus musculus
aggccacattggctctgtgcccttg

SEQ ID NO: 193674 - DNA, 25 bp, Mus musculus
aggccacattgggtctgtgcccttg

SEQ ID NO: 193675 - DNA, 25 bp, Mus musculus
aggccaccaatcaaagtactctgaa

SEQ ID NO: 193676 - DNA, 25 bp, Mus musculus
aggccaccaatcagttttctcagct

SEQ ID NO: 193677 - DNA, 25 bp, Mus musculus
aggccaccaatctaagtactctgaa

SEQ ID NO: 193678 - DNA, 25 bp, Mus musculus
aggccaccaatctgttttctcagct

SEQ ID NO: 193679 - DNA, 25 bp, Mus musculus
aggccaccacacacatagggactga

SEQ ID NO: 193680 - DNA, 25 bp, Mus musculus
aggccaccacactcatagggactga

SEQ ID NO: 193681 - DNA, 25 bp, Mus musculus
aggccaccagaaacagtcttaattt

SEQ ID NO: 193682 - DNA, 25 bp, Mus musculus
aggccaccagaatcagtcttaattt

SEQ ID NO: 193683 - DNA, 25 bp, Mus musculus
aggccaccaggaaatccacctgtca

SEQ ID NO: 193684 - DNA, 25 bp, Mus musculus
aggccaccaggatatccacctgtca

SEQ ID NO: 193685 - DNA, 25 bp, Mus musculus
aggccaccaggcaggagtgtgcaca

SEQ ID NO: 193686 - DNA, 25 bp, Mus musculus
aggccaccaggcatcaggaaatctg

SEQ ID NO: 193687 - DNA, 25 bp, Mus musculus
aggccaccaggctggagtgtgcaca

SEQ ID NO: 193688 - DNA, 25 bp, Mus musculus
aggccaccaggcttcaggaaatctg

SEQ ID NO: 193689 - DNA, 25 bp, Mus musculus
aggccaccatatccttccaagttga

SEQ ID NO: 193690 - DNA, 25 bp, Mus musculus
aggccaccatatgcttccaagttga

SEQ ID NO: 193691 - DNA, 25 bp, Mus musculus
aggccacccacaccaacagtagtaa

SEQ ID NO: 193692 - DNA, 25 bp, Mus musculus
aggccacccacagcaacagtagtaa

SEQ ID NO: 193693 - DNA, 25 bp, Mus musculus
aggccacccactaaaagctgttgaa

SEQ ID NO: 193694 - DNA, 25 bp, Mus musculus
aggccacccacttaaagctgttgaa

SEQ ID NO: 193695 - DNA, 25 bp, Mus musculus
aggccaccctagactacattggagt

SEQ ID NO: 193696 - DNA, 25 bp, Mus musculus
aggccaccctagagacagcactgaa

SEQ ID NO: 193697 - DNA, 25 bp, Mus musculus
aggccaccctagtctacattggagt

SEQ ID NO: 193698 - DNA, 25 bp, Mus musculus
aggccaccctagtgacagcactgaa

SEQ ID NO: 193699 - DNA, 25 bp, Mus musculus
aggccaccctgtaactgtgactgag

SEQ ID NO: 193700 - DNA, 25 bp, Mus musculus
aggccaccctgttactgtgactgag

SEQ ID NO: 193701 - DNA, 25 bp, Mus musculus
aggccaccgcagatactgcttagta

SEQ ID NO: 193702 - DNA, 25 bp, Mus musculus
aggccaccgcagttactgcttagta

SEQ ID NO: 193703 - DNA, 25 bp, Mus musculus
aggccaccggacagcccaacggtag

SEQ ID NO: 193704 - DNA, 25 bp, Mus musculus
aggccaccggactgcccaacggtag

SEQ ID NO: 193705 - DNA, 25 bp, Mus musculus
aggccacctcaacgtcagcaaacag

SEQ ID NO: 193706 - DNA, 25 bp, Mus musculus
aggccacctcaaggtcagcaaacag

SEQ ID NO: 193707 - DNA, 25 bp, Mus musculus
aggccacctctccagtgagatgtgg

SEQ ID NO: 193708 - DNA, 25 bp, Mus musculus
aggccacctctcgagtgagatgtgg

SEQ ID NO: 193709 - DNA, 25 bp, Mus musculus
aggccacctcttcttcatatttcag

SEQ ID NO: 193710 - DNA, 25 bp, Mus musculus
aggccacctcttgttcatatttcag

SEQ ID NO: 193711 - DNA, 25 bp, Mus musculus
aggccacctgaacctcttggcagag

SEQ ID NO: 193712 - DNA, 25 bp, Mus musculus
aggccacctgaagctcttggcagag

SEQ ID NO: 193713 - DNA, 25 bp, Mus musculus
aggccacctggaaatgcttgcaaca

SEQ ID NO: 193714 - DNA, 25 bp, Mus musculus
aggccacctggatatgcttgcaaca

SEQ ID NO: 193715 - DNA, 25 bp, Mus musculus
aggccacctgtacatatcccagaga

SEQ ID NO: 193716 - DNA, 25 bp, Mus musculus
aggccacctgtagatatcccagaga

SEQ ID NO: 193717 - DNA, 25 bp, Mus musculus
aggccacctgtgctcacggtcagtg

SEQ ID NO: 193718 - DNA, 25 bp, Mus musculus
aggccacctgtggtcacggtcagtg

SEQ ID NO: 193719 - DNA, 25 bp, Mus musculus
aggccacctttgctgccctacgttg

SEQ ID NO: 193720 - DNA, 25 bp, Mus musculus
aggccacctttggtgccctacgttg

SEQ ID NO: 193721 - DNA, 25 bp, Mus musculus
aggccacgagcaccgcagagactat

SEQ ID NO: 193722 - DNA, 25 bp, Mus musculus
aggccacgagcagcgcagagactat

SEQ ID NO: 193723 - DNA, 25 bp, Mus musculus
aggccacgaggcagcctgcatcaca

SEQ ID NO: 193724 - DNA, 25 bp, Mus musculus
aggccacgaggctgcctgcatcaca

SEQ ID NO: 193725 - DNA, 25 bp, Mus musculus
aggccacgccaccatgaagcaggac

SEQ ID NO: 193726 - DNA, 25 bp, Mus musculus
aggccacgccacgatgaagcaggac

SEQ ID NO: 193727 - DNA, 25 bp, Mus musculus
aggccacgcctgctcaccttttaaa

SEQ ID NO: 193728 - DNA, 25 bp, Mus musculus
aggccacgcctggtcaccttttaaa

SEQ ID NO: 193729 - DNA, 25 bp, Mus musculus
aggccacggagcactgatttgtgct

SEQ ID NO: 193730 - DNA, 25 bp, Mus musculus
aggccacggagctctgatttgtgct

SEQ ID NO: 193731 - DNA, 25 bp, Mus musculus
aggccacggccaatcggacagagga

SEQ ID NO: 193732 - DNA, 25 bp, Mus musculus
aggccacggccattcggacagagga

SEQ ID NO: 193733 - DNA, 25 bp, Mus musculus
aggccacggtatactggaagcccat

SEQ ID NO: 193734 - DNA, 25 bp, Mus musculus
aggccacggtattctggaagcccat

SEQ ID NO: 193735 - DNA, 25 bp, Mus musculus
aggccacgtcagcaactcaaagagc

SEQ ID NO: 193736 - DNA, 25 bp, Mus musculus
aggccacgtcaggaactcaaagagc

SEQ ID NO: 193737 - DNA, 25 bp, Mus musculus
aggccactagtgacagtttctgtta

SEQ ID NO: 193738 - DNA, 25 bp, Mus musculus
aggccactagtgtcagtttctgtta

SEQ ID NO: 193739 - DNA, 25 bp, Mus musculus
aggccactcatgagatccctagaaa

SEQ ID NO: 193740 - DNA, 25 bp, Mus musculus
aggccactcatgtgatccctagaaa

SEQ ID NO: 193741 - DNA, 25 bp, Mus musculus
aggccactcggcagaagatgcgcga

SEQ ID NO: 193742 - DNA, 25 bp, Mus musculus
aggccactcggctgaagatgcgcga

SEQ ID NO: 193743 - DNA, 25 bp, Mus musculus
aggccactctgaatctttgattcac

SEQ ID NO: 193744 - DNA, 25 bp, Mus musculus
aggccactctgattctttgattcac

SEQ ID NO: 193745 - DNA, 25 bp, Mus musculus
aggccactctgcatctgttatgtct

SEQ ID NO: 193746 - DNA, 25 bp, Mus musculus
aggccactctgcttctgttatgtct

SEQ ID NO: 193747 - DNA, 25 bp, Mus musculus
aggccactctgtcggcattgcttga

SEQ ID NO: 193748 - DNA, 25 bp, Mus musculus
aggccactctgtgggcattgcttga

SEQ ID NO: 193749 - DNA, 25 bp, Mus musculus
aggccactgatactagccagttggc

SEQ ID NO: 193750 - DNA, 25 bp, Mus musculus
aggccactgatagtagccagttggc

SEQ ID NO: 193751 - DNA, 25 bp, Mus musculus
aggccactggaccagccaacatctg

SEQ ID NO: 193752 - DNA, 25 bp, Mus musculus
aggccactggacgagccaacatctg

SEQ ID NO: 193753 - DNA, 25 bp, Mus musculus
aggccactgggacaactacaagcgt

SEQ ID NO: 193754 - DNA, 25 bp, Mus musculus
aggccactgggagaactacaagcgt

SEQ ID NO: 193755 - DNA, 25 bp, Mus musculus
aggccactgggtactaacagccagc

SEQ ID NO: 193756 - DNA, 25 bp, Mus musculus
aggccactgggttctaacagccagc

SEQ ID NO: 193757 - DNA, 25 bp, Mus musculus
aggccactggtcctgtgtcctttgt

SEQ ID NO: 193758 - DNA, 25 bp, Mus musculus
aggccactggtcgtgtgtcctttgt

SEQ ID NO: 193759 - DNA, 25 bp, Mus musculus
aggccactgtccattattgcaggga

SEQ ID NO: 193760 - DNA, 25 bp, Mus musculus
aggccactgtcctttattgcaggga

SEQ ID NO: 193761 - DNA, 25 bp, Mus musculus
aggccacttaggcaattcttagatt

SEQ ID NO: 193762 - DNA, 25 bp, Mus musculus
aggccacttagggaattcttagatt

SEQ ID NO: 193763 - DNA, 25 bp, Mus musculus
aggccacttggcatctcgacagtac

SEQ ID NO: 193764 - DNA, 25 bp, Mus musculus
aggccacttggcttctcgacagtac

SEQ ID NO: 193765 - DNA, 25 bp, Mus musculus
aggccacttgtgatcatctcagaac

SEQ ID NO: 193766 - DNA, 25 bp, Mus musculus
aggccacttgtgttcatctcagaac

SEQ ID NO: 193767 - DNA, 25 bp, Mus musculus
aggccactttgccatgggacactag

SEQ ID NO: 193768 - DNA, 25 bp, Mus musculus
aggccactttgcgatgggacactag

SEQ ID NO: 193769 - DNA, 25 bp, Mus musculus
aggccacttttcaccacaaactaat

SEQ ID NO: 193770 - DNA, 25 bp, Mus musculus
aggccacttttctccacaaactaat

SEQ ID NO: 193771 - DNA, 25 bp, Mus musculus
aggccagaaaccagtgctttcagat

SEQ ID NO: 193772 - DNA, 25 bp, Mus musculus
aggccagaaacctgtgctttcagat

SEQ ID NO: 193773 - DNA, 25 bp, Mus musculus
aggccagaacaccattctagggaat

SEQ ID NO: 193774 - DNA, 25 bp, Mus musculus
aggccagaacacgattctagggaat

SEQ ID NO: 193775 - DNA, 25 bp, Mus musculus
aggccagaactccagtgtcctgtga

SEQ ID NO: 193776 - DNA, 25 bp, Mus musculus
aggccagaactcgagtgtcctgtga

SEQ ID NO: 193777 - DNA, 25 bp, Mus musculus
aggccagaagacaaaagctgaaatc

SEQ ID NO: 193778 - DNA, 25 bp, Mus musculus
aggccagaagactaaagctgaaatc

SEQ ID NO: 193779 - DNA, 25 bp, Mus musculus
aggccagaaggcatcagacacccga

SEQ ID NO: 193780 - DNA, 25 bp, Mus musculus
aggccagaaggcttcagacacccga

SEQ ID NO: 193781 - DNA, 25 bp, Mus musculus
aggccagaagtcagacctgcatatt

SEQ ID NO: 193782 - DNA, 25 bp, Mus musculus
aggccagaagtcagagtccttagct

SEQ ID NO: 193783 - DNA, 25 bp, Mus musculus
aggccagaagtctgacctgcatatt

SEQ ID NO: 193784 - DNA, 25 bp, Mus musculus
aggccagaagtctgagtccttagct

SEQ ID NO: 193785 - DNA, 25 bp, Mus musculus
aggccagaatccatagctgtccaat

SEQ ID NO: 193786 - DNA, 25 bp, Mus musculus
aggccagaatccttagctgtccaat

SEQ ID NO: 193787 - DNA, 25 bp, Mus musculus
aggccagacatgcagtatttaggac

SEQ ID NO: 193788 - DNA, 25 bp, Mus musculus
aggccagacatggagtatttaggac

SEQ ID NO: 193789 - DNA, 25 bp, Mus musculus
aggccagactgcattctgaacttgc

SEQ ID NO: 193790 - DNA, 25 bp, Mus musculus
aggccagactgctttctgaacttgc

SEQ ID NO: 193791 - DNA, 25 bp, Mus musculus
aggccagacttcacttgttttcatt

SEQ ID NO: 193792 - DNA, 25 bp, Mus musculus
aggccagacttctcttgttttcatt

SEQ ID NO: 193793 - DNA, 25 bp, Mus musculus
aggccagagcatctatgtccacaaa

SEQ ID NO: 193794 - DNA, 25 bp, Mus musculus
aggccagagcatgtatgtccacaaa

SEQ ID NO: 193795 - DNA, 25 bp, Mus musculus
aggccagaggacatctgcatcctta

SEQ ID NO: 193796 - DNA, 25 bp, Mus musculus
aggccagaggacttctgcatcctta

SEQ ID NO: 193797 - DNA, 25 bp, Mus musculus
aggccagaggctccagctagtatga

SEQ ID NO: 193798 - DNA, 25 bp, Mus musculus
aggccagaggctgcagctagtatga

SEQ ID NO: 193799 - DNA, 25 bp, Mus musculus
aggccagagtcaattaccagatccc

SEQ ID NO: 193800 - DNA, 25 bp, Mus musculus
aggccagagtcatttaccagatccc

SEQ ID NO: 193801 - DNA, 25 bp, Mus musculus
aggccagagtggctatgaacttaat

SEQ ID NO: 193802 - DNA, 25 bp, Mus musculus
aggccagagtgggtatgaacttaat

SEQ ID NO: 193803 - DNA, 25 bp, Mus musculus
aggccagagtgtcgtctgtccttgc

SEQ ID NO: 193804 - DNA, 25 bp, Mus musculus
aggccagagtgtggtctgtccttgc

SEQ ID NO: 193805 - DNA, 25 bp, Mus musculus
aggccagagttaacacagaagaaga

SEQ ID NO: 193806 - DNA, 25 bp, Mus musculus
aggccagagttatcacagaagaaga

SEQ ID NO: 193807 - DNA, 25 bp, Mus musculus
aggccagagttgacatccaacatca

SEQ ID NO: 193808 - DNA, 25 bp, Mus musculus
aggccagagttgtcatccaacatca

SEQ ID NO: 193809 - DNA, 25 bp, Mus musculus
aggccagataaacaaggttagtgtt

SEQ ID NO: 193810 - DNA, 25 bp, Mus musculus
aggccagataaacacctctctacat

SEQ ID NO: 193811 - DNA, 25 bp, Mus musculus
aggccagataaagaaggttagtgtt

SEQ ID NO: 193812 - DNA, 25 bp, Mus musculus
aggccagataaagacctctctacat

SEQ ID NO: 193813 - DNA, 25 bp, Mus musculus
aggccagatggaagctgttcgaatc

SEQ ID NO: 193814 - DNA, 25 bp, Mus musculus
aggccagatggatgctgttcgaatc

SEQ ID NO: 193815 - DNA, 25 bp, Mus musculus
aggccagatggtccctcagactcag

SEQ ID NO: 193816 - DNA, 25 bp, Mus musculus
aggccagatggtgcctcagactcag

SEQ ID NO: 193817 - DNA, 25 bp, Mus musculus
aggccagatttgctaacctttcatc

SEQ ID NO: 193818 - DNA, 25 bp, Mus musculus
aggccagatttggtaacctttcatc

SEQ ID NO: 193819 - DNA, 25 bp, Mus musculus
aggccagcaaacacggtctcatgag

SEQ ID NO: 193820 - DNA, 25 bp, Mus musculus
aggccagcaaactcggtctcatgag

SEQ ID NO: 193821 - DNA, 25 bp, Mus musculus
aggccagcaaataccaagtctcagt

SEQ ID NO: 193822 - DNA, 25 bp, Mus musculus
aggccagcaaattccaagtctcagt

SEQ ID NO: 193823 - DNA, 25 bp, Mus musculus
aggccagcaaccactgttggttcag

SEQ ID NO: 193824 - DNA, 25 bp, Mus musculus
aggccagcaacctctgttggttcag

SEQ ID NO: 193825 - DNA, 25 bp, Mus musculus
aggccagcaacgcttgtagtgctca

SEQ ID NO: 193826 - DNA, 25 bp, Mus musculus
aggccagcaacggttgtagtgctca

SEQ ID NO: 193827 - DNA, 25 bp, Mus musculus
aggccagcaagtcattgcccacaac

SEQ ID NO: 193828 - DNA, 25 bp, Mus musculus
aggccagcaagtgattgcccacaac

SEQ ID NO: 193829 - DNA, 25 bp, Mus musculus
aggccagcaatgacctctacaactt

SEQ ID NO: 193830 - DNA, 25 bp, Mus musculus
aggccagcaatgtcctctacaactt

SEQ ID NO: 193831 - DNA, 25 bp, Mus musculus
aggccagcacctaggcatatgggcg

SEQ ID NO: 193832 - DNA, 25 bp, Mus musculus
aggccagcaccttggcatatgggcg

SEQ ID NO: 193833 - DNA, 25 bp, Mus musculus
aggccagcagctatgcagacatgat

SEQ ID NO: 193834 - DNA, 25 bp, Mus musculus
aggccagcagctttgcagacatgat

SEQ ID NO: 193835 - DNA, 25 bp, Mus musculus
aggccagcaggtactcacggcactg

SEQ ID NO: 193836 - DNA, 25 bp, Mus musculus
aggccagcaggttctcacggcactg

SEQ ID NO: 193837 - DNA, 25 bp, Mus musculus
aggccagcagtcacgttcaaggagc

SEQ ID NO: 193838 - DNA, 25 bp, Mus musculus
aggccagcagtctcgttcaaggagc

SEQ ID NO: 193839 - DNA, 25 bp, Mus musculus
aggccagcatctcttcaaagcttgc

SEQ ID NO: 193840 - DNA, 25 bp, Mus musculus
aggccagcatctgttcaaagcttgc

SEQ ID NO: 193841 - DNA, 25 bp, Mus musculus
aggccagcattaccagaacacataa

SEQ ID NO: 193842 - DNA, 25 bp, Mus musculus
aggccagcattagcagaacacataa

SEQ ID NO: 193843 - DNA, 25 bp, Mus musculus
aggccagccaacacaatgagactct

SEQ ID NO: 193844 - DNA, 25 bp, Mus musculus
aggccagccaactcaatgagactct

SEQ ID NO: 193845 - DNA, 25 bp, Mus musculus
aggccagccacaatttgttcatgaa

SEQ ID NO: 193846 - DNA, 25 bp, Mus musculus
aggccagccacattttgttcatgaa

SEQ ID NO: 193847 - DNA, 25 bp, Mus musculus
aggccagccagccacgtcatgtgtg

SEQ ID NO: 193848 - DNA, 25 bp, Mus musculus
aggccagccagcgacgtcatgtgtg

SEQ ID NO: 193849 - DNA, 25 bp, Mus musculus
aggccagccagtcttacacggttag

SEQ ID NO: 193850 - DNA, 25 bp, Mus musculus
aggccagccagtgttacacggttag

SEQ ID NO: 193851 - DNA, 25 bp, Mus musculus
aggccagccattcgctccaatacat

SEQ ID NO: 193852 - DNA, 25 bp, Mus musculus
aggccagccattggctccaatacat

SEQ ID NO: 193853 - DNA, 25 bp, Mus musculus
aggccagccccaagataagggaggt

SEQ ID NO: 193854 - DNA, 25 bp, Mus musculus
aggccagccccatgataagggaggt

SEQ ID NO: 193855 - DNA, 25 bp, Mus musculus
aggccagcccgaagacgccaaagag

SEQ ID NO: 193856 - DNA, 25 bp, Mus musculus
aggccagcccgacatacatgagaat

SEQ ID NO: 193857 - DNA, 25 bp, Mus musculus
aggccagcccgagatacatgagaat

SEQ ID NO: 193858 - DNA, 25 bp, Mus musculus
aggccagcccgatgacgccaaagag

SEQ ID NO: 193859 - DNA, 25 bp, Mus musculus
aggccagcctatcttgtcaccactg

SEQ ID NO: 193860 - DNA, 25 bp, Mus musculus
aggccagcctatgttgtcaccactg

SEQ ID NO: 193861 - DNA, 25 bp, Mus musculus
aggccagcctgaactctgtttaaat

SEQ ID NO: 193862 - DNA, 25 bp, Mus musculus
aggccagcctgaccctttagatggg

SEQ ID NO: 193863 - DNA, 25 bp, Mus musculus
aggccagcctgagcctttagatggg

SEQ ID NO: 193864 - DNA, 25 bp, Mus musculus
aggccagcctgatctctgtttaaat

SEQ ID NO: 193865 - DNA, 25 bp, Mus musculus
aggccagcctgcagaacggcaatgc

SEQ ID NO: 193866 - DNA, 25 bp, Mus musculus
aggccagcctgctgaacggcaatgc

SEQ ID NO: 193867 - DNA, 25 bp, Mus musculus
aggccagcctgtctaatcagaccaa

SEQ ID NO: 193868 - DNA, 25 bp, Mus musculus
aggccagcctgtgtaatcagaccaa

SEQ ID NO: 193869 - DNA, 25 bp, Mus musculus
aggccagccttgacaacttaccaaa

SEQ ID NO: 193870 - DNA, 25 bp, Mus musculus
aggccagccttgtcaacttaccaaa

SEQ ID NO: 193871 - DNA, 25 bp, Mus musculus
aggccagcctttcagtggattccta

SEQ ID NO: 193872 - DNA, 25 bp, Mus musculus
aggccagcctttgagtggattccta

SEQ ID NO: 193873 - DNA, 25 bp, Mus musculus
aggccagcgtgcaaatgatcaaagc

SEQ ID NO: 193874 - DNA, 25 bp, Mus musculus
aggccagcgtgctaatgatcaaagc

SEQ ID NO: 193875 - DNA, 25 bp, Mus musculus
aggccagcgtttcctgttttcttaa

SEQ ID NO: 193876 - DNA, 25 bp, Mus musculus
aggccagcgtttgctgttttcttaa

SEQ ID NO: 193877 - DNA, 25 bp, Mus musculus
aggccagctaagaccctggcttaag

SEQ ID NO: 193878 - DNA, 25 bp, Mus musculus
aggccagctaagtccctggcttaag

SEQ ID NO: 193879 - DNA, 25 bp, Mus musculus
aggccagctaccagcacagagagca

SEQ ID NO: 193880 - DNA, 25 bp, Mus musculus
aggccagctacctgcacagagagca

SEQ ID NO: 193881 - DNA, 25 bp, Mus musculus
aggccagctagccagactgacgtga

SEQ ID NO: 193882 - DNA, 25 bp, Mus musculus
aggccagctagcgagactgacgtga

SEQ ID NO: 193883 - DNA, 25 bp, Mus musculus
aggccagctataccctaggctcaga

SEQ ID NO: 193884 - DNA, 25 bp, Mus musculus
aggccagctatagcctaggctcaga

SEQ ID NO: 193885 - DNA, 25 bp, Mus musculus
aggccagctatcaccatcaaacaga

SEQ ID NO: 193886 - DNA, 25 bp, Mus musculus
aggccagctatctccatcaaacaga

SEQ ID NO: 193887 - DNA, 25 bp, Mus musculus
aggccagctcttcaactgatggtga

SEQ ID NO: 193888 - DNA, 25 bp, Mus musculus
aggccagctcttgaactgatggtga

SEQ ID NO: 193889 - DNA, 25 bp, Mus musculus
aggccagctgaaacttggacttagc

SEQ ID NO: 193890 - DNA, 25 bp, Mus musculus
aggccagctgaatcttggacttagc

SEQ ID NO: 193891 - DNA, 25 bp, Mus musculus
aggccagcttaacctgttcacacaa

SEQ ID NO: 193892 - DNA, 25 bp, Mus musculus
aggccagcttaagctgttcacacaa

SEQ ID NO: 193893 - DNA, 25 bp, Mus musculus
aggccagcttcaagtacgggtcagt

SEQ ID NO: 193894 - DNA, 25 bp, Mus musculus
aggccagcttcatgtacgggtcagt

SEQ ID NO: 193895 - DNA, 25 bp, Mus musculus
aggccaggaagtctatttttaatga

SEQ ID NO: 193896 - DNA, 25 bp, Mus musculus
aggccaggaagtgtatttttaatga

SEQ ID NO: 193897 - DNA, 25 bp, Mus musculus
aggccaggacctagcagagttctaa

SEQ ID NO: 193898 - DNA, 25 bp, Mus musculus
aggccaggaccttgcagagttctaa

SEQ ID NO: 193899 - DNA, 25 bp, Mus musculus
aggccaggatccagcagttgctcag

SEQ ID NO: 193900 - DNA, 25 bp, Mus musculus
aggccaggatcctgcagttgctcag

SEQ ID NO: 193901 - DNA, 25 bp, Mus musculus
aggccaggatctagtgtctcctggt

SEQ ID NO: 193902 - DNA, 25 bp, Mus musculus
aggccaggatcttgtgtctcctggt

SEQ ID NO: 193903 - DNA, 25 bp, Mus musculus
aggccaggcaacaagcagcaggtgc

SEQ ID NO: 193904 - DNA, 25 bp, Mus musculus
aggccaggcaactagcagcaggtgc

SEQ ID NO: 193905 - DNA, 25 bp, Mus musculus
aggccaggcagtcctcctctgtata

SEQ ID NO: 193906 - DNA, 25 bp, Mus musculus
aggccaggcagtgctcctctgtata

SEQ ID NO: 193907 - DNA, 25 bp, Mus musculus
aggccaggcatgaaggccaagtctt

SEQ ID NO: 193908 - DNA, 25 bp, Mus musculus
aggccaggcatgtaggccaagtctt

SEQ ID NO: 193909 - DNA, 25 bp, Mus musculus
aggccaggcctcacaaatcggaaat

SEQ ID NO: 193910 - DNA, 25 bp, Mus musculus
aggccaggcctctcaaatcggaaat

SEQ ID NO: 193911 - DNA, 25 bp, Mus musculus
aggccaggcctgatctagccaagta

SEQ ID NO: 193912 - DNA, 25 bp, Mus musculus
aggccaggcctgttctagccaagta

SEQ ID NO: 193913 - DNA, 25 bp, Mus musculus
aggccagggaccacggtctgtctac

SEQ ID NO: 193914 - DNA, 25 bp, Mus musculus
aggccagggacctcggtctgtctac

SEQ ID NO: 193915 - DNA, 25 bp, Mus musculus
aggccagggaggacactgcttgctc

SEQ ID NO: 193916 - DNA, 25 bp, Mus musculus
aggccagggaggtcactgcttgctc

SEQ ID NO: 193917 - DNA, 25 bp, Mus musculus
aggccagggcgtatttatttccata

SEQ ID NO: 193918 - DNA, 25 bp, Mus musculus
aggccagggcgtttttatttccata

SEQ ID NO: 193919 - DNA, 25 bp, Mus musculus
aggccagggcttcttttgactgtgt

SEQ ID NO: 193920 - DNA, 25 bp, Mus musculus
aggccagggcttgttttgactgtgt

SEQ ID NO: 193921 - DNA, 25 bp, Mus musculus
aggccagggtatactagccagctca

SEQ ID NO: 193922 - DNA, 25 bp, Mus musculus
aggccagggtattctagccagctca

SEQ ID NO: 193923 - DNA, 25 bp, Mus musculus
aggccagggttgaagctcagctgca

SEQ ID NO: 193924 - DNA, 25 bp, Mus musculus
aggccagggttgtagctcagctgca

SEQ ID NO: 193925 - DNA, 25 bp, Mus musculus
aggccaggtgaacgcgtcagattca

SEQ ID NO: 193926 - DNA, 25 bp, Mus musculus
aggccaggtgaaggcgtcagattca

SEQ ID NO: 193927 - DNA, 25 bp, Mus musculus
aggccaggtgggacactgaatcccc

SEQ ID NO: 193928 - DNA, 25 bp, Mus musculus
aggccaggtgggtcactgaatcccc

SEQ ID NO: 193929 - DNA, 25 bp, Mus musculus
aggccaggttggaacaaagagagac

SEQ ID NO: 193930 - DNA, 25 bp, Mus musculus
aggccaggttggactgcacagcaaa

SEQ ID NO: 193931 - DNA, 25 bp, Mus musculus
aggccaggttggtacaaagagagac

SEQ ID NO: 193932 - DNA, 25 bp, Mus musculus
aggccaggttggtctgcacagcaaa

SEQ ID NO: 193933 - DNA, 25 bp, Mus musculus
aggccagtacctagtcaccattgat

SEQ ID NO: 193934 - DNA, 25 bp, Mus musculus
aggccagtaccttgtcaccattgat

SEQ ID NO: 193935 - DNA, 25 bp, Mus musculus
aggccagtagatccttctaagttgc

SEQ ID NO: 193936 - DNA, 25 bp, Mus musculus
aggccagtagatgcttctaagttgc

SEQ ID NO: 193937 - DNA, 25 bp, Mus musculus
aggccagtcaaacctagttctattt

SEQ ID NO: 193938 - DNA, 25 bp, Mus musculus
aggccagtcaaagctagttctattt

SEQ ID NO: 193939 - DNA, 25 bp, Mus musculus
aggccagtcagaatgtgggtactat

SEQ ID NO: 193940 - DNA, 25 bp, Mus musculus
aggccagtcagattgtgggtactat

SEQ ID NO: 193941 - DNA, 25 bp, Mus musculus
aggccagtcattaacatgtcacacc

SEQ ID NO: 193942 - DNA, 25 bp, Mus musculus
aggccagtcatttacatgtcacacc

SEQ ID NO: 193943 - DNA, 25 bp, Mus musculus
aggccagtctctccttgtagtagaa

SEQ ID NO: 193944 - DNA, 25 bp, Mus musculus
aggccagtctctgcttgtagtagaa

SEQ ID NO: 193945 - DNA, 25 bp, Mus musculus
aggccagtctgaacttacaaagtga

SEQ ID NO: 193946 - DNA, 25 bp, Mus musculus
aggccagtctgatcttacaaagtga

SEQ ID NO: 193947 - DNA, 25 bp, Mus musculus
aggccagtctgcctttcattacgaa

SEQ ID NO: 193948 - DNA, 25 bp, Mus musculus
aggccagtctgcgtttcattacgaa

SEQ ID NO: 193949 - DNA, 25 bp, Mus musculus
aggccagtctggaactaggatagtc

SEQ ID NO: 193950 - DNA, 25 bp, Mus musculus
aggccagtctggtactaggatagtc

SEQ ID NO: 193951 - DNA, 25 bp, Mus musculus
aggccagtcttgcacacctgacttc

SEQ ID NO: 193952 - DNA, 25 bp, Mus musculus
aggccagtcttggacacctgacttc

SEQ ID NO: 193953 - DNA, 25 bp, Mus musculus
aggccagtgaaacagtctcctgtgc

SEQ ID NO: 193954 - DNA, 25 bp, Mus musculus
aggccagtgaaagagtctcctgtgc

SEQ ID NO: 193955 - DNA, 25 bp, Mus musculus
aggccagtgagaatgtggttactta

SEQ ID NO: 193956 - DNA, 25 bp, Mus musculus
aggccagtgagattgtggttactta

SEQ ID NO: 193957 - DNA, 25 bp, Mus musculus
aggccagtgcagctcatgttctgtt

SEQ ID NO: 193958 - DNA, 25 bp, Mus musculus
aggccagtgcaggtcatgttctgtt

SEQ ID NO: 193959 - DNA, 25 bp, Mus musculus
aggccagtgcctcttacacttttga

SEQ ID NO: 193960 - DNA, 25 bp, Mus musculus
aggccagtgcctgttacacttttga

SEQ ID NO: 193961 - DNA, 25 bp, Mus musculus
aggccagtgcgactttggctccaac

SEQ ID NO: 193962 - DNA, 25 bp, Mus musculus
aggccagtgcgagtttggctccaac

SEQ ID NO: 193963 - DNA, 25 bp, Mus musculus
aggccagtgctcaacctctgtatgt

SEQ ID NO: 193964 - DNA, 25 bp, Mus musculus
aggccagtgctcagtgcgaaccaca

SEQ ID NO: 193965 - DNA, 25 bp, Mus musculus
aggccagtgctctacctctgtatgt

SEQ ID NO: 193966 - DNA, 25 bp, Mus musculus
aggccagtgctctgtgcgaaccaca

SEQ ID NO: 193967 - DNA, 25 bp, Mus musculus
aggccagtgcttaaacatacccgaa

SEQ ID NO: 193968 - DNA, 25 bp, Mus musculus
aggccagtgcttaaccacttagcta

SEQ ID NO: 193969 - DNA, 25 bp, Mus musculus
aggccagtgctttaacatacccgaa

SEQ ID NO: 193970 - DNA, 25 bp, Mus musculus
aggccagtgctttaccacttagcta

SEQ ID NO: 193971 - DNA, 25 bp, Mus musculus
aggccagtggctaggtcctggagag

SEQ ID NO: 193972 - DNA, 25 bp, Mus musculus
aggccagtggcttggtcctggagag

SEQ ID NO: 193973 - DNA, 25 bp, Mus musculus
aggccagtgggtcctgatgtacttc

SEQ ID NO: 193974 - DNA, 25 bp, Mus musculus
aggccagtgggtgctgatgtacttc

SEQ ID NO: 193975 - DNA, 25 bp, Mus musculus
aggccagtgtatctcgtactgagaa

SEQ ID NO: 193976 - DNA, 25 bp, Mus musculus
aggccagtgtatgtcgtactgagaa

SEQ ID NO: 193977 - DNA, 25 bp, Mus musculus
aggccagttatgaaccctgtataga

SEQ ID NO: 193978 - DNA, 25 bp, Mus musculus
aggccagttatgaagctcagttctt

SEQ ID NO: 193979 - DNA, 25 bp, Mus musculus
aggccagttatgtaccctgtataga

SEQ ID NO: 193980 - DNA, 25 bp, Mus musculus
aggccagttatgtagctcagttctt

SEQ ID NO: 193981 - DNA, 25 bp, Mus musculus
aggccagttcgtcagtatgtttacg

SEQ ID NO: 193982 - DNA, 25 bp, Mus musculus
aggccagttcgtgagtatgtttacg

SEQ ID NO: 193983 - DNA, 25 bp, Mus musculus
aggccagttgatctgctctgtttta

SEQ ID NO: 193984 - DNA, 25 bp, Mus musculus
aggccagttgatgtgctctgtttta

SEQ ID NO: 193985 - DNA, 25 bp, Mus musculus
aggccagttggcaggtttaggtcaa

SEQ ID NO: 193986 - DNA, 25 bp, Mus musculus
aggccagttggctggtttaggtcaa

SEQ ID NO: 193987 - DNA, 25 bp, Mus musculus
aggccagttgggactgcacactgag

SEQ ID NO: 193988 - DNA, 25 bp, Mus musculus
aggccagttgggtctgcacactgag

SEQ ID NO: 193989 - DNA, 25 bp, Mus musculus
aggccagtttctcggttagagacca

SEQ ID NO: 193990 - DNA, 25 bp, Mus musculus
aggccagtttctgggttagagacca

SEQ ID NO: 193991 - DNA, 25 bp, Mus musculus
aggccagtttgcataggtcttttgc

SEQ ID NO: 193992 - DNA, 25 bp, Mus musculus
aggccagtttgcttaggtcttttgc

SEQ ID NO: 193993 - DNA, 25 bp, Mus musculus
aggccagttttcagaaggttcctgt

SEQ ID NO: 193994 - DNA, 25 bp, Mus musculus
aggccagttttctgaaggttcctgt

SEQ ID NO: 193995 - DNA, 25 bp, Mus musculus
aggccataaggtatgcgttgcttga

SEQ ID NO: 193996 - DNA, 25 bp, Mus musculus
aggccataaggtttgcgttgcttga

SEQ ID NO: 193997 - DNA, 25 bp, Mus musculus
aggccatacattctgcagcaactta

SEQ ID NO: 193998 - DNA, 25 bp, Mus musculus
aggccatacattgtgcagcaactta

SEQ ID NO: 193999 - DNA, 25 bp, Mus musculus
aggccatacttaaccacacttttat

SEQ ID NO: 194000 - DNA, 25 bp, Mus musculus
aggccatacttatccacacttttat

SEQ ID NO: 194001 - DNA, 25 bp, Mus musculus
aggccatagtgcatgctgttcttgc

SEQ ID NO: 194002 - DNA, 25 bp, Mus musculus
aggccatagtgcttgctgttcttgc

SEQ ID NO: 194003 - DNA, 25 bp, Mus musculus
aggccatattctattgcttgtgcaa

SEQ ID NO: 194004 - DNA, 25 bp, Mus musculus
aggccatattcttttgcttgtgcaa

SEQ ID NO: 194005 - DNA, 25 bp, Mus musculus
aggccatcaagtcccctacaaggtg

SEQ ID NO: 194006 - DNA, 25 bp, Mus musculus
aggccatcaagtgccctacaaggtg

SEQ ID NO: 194007 - DNA, 25 bp, Mus musculus
aggccatcaccaatgaggctgagcc

SEQ ID NO: 194008 - DNA, 25 bp, Mus musculus
aggccatcaccattgaggctgagcc

SEQ ID NO: 194009 - DNA, 25 bp, Mus musculus
aggccatcactcagtcatcggtaga

SEQ ID NO: 194010 - DNA, 25 bp, Mus musculus
aggccatcactctgtcatcggtaga

SEQ ID NO: 194011 - DNA, 25 bp, Mus musculus
aggccatcagatcatcggcttcaga

SEQ ID NO: 194012 - DNA, 25 bp, Mus musculus
aggccatcagatgatcggcttcaga

SEQ ID NO: 194013 - DNA, 25 bp, Mus musculus
aggccatcaggcatacagcaaccat

SEQ ID NO: 194014 - DNA, 25 bp, Mus musculus
aggccatcaggcttacagcaaccat

SEQ ID NO: 194015 - DNA, 25 bp, Mus musculus
aggccatcaggtacccttaattaga

SEQ ID NO: 194016 - DNA, 25 bp, Mus musculus
aggccatcaggttcccttaattaga

SEQ ID NO: 194017 - DNA, 25 bp, Mus musculus
aggccatcatagatccagactcggg

SEQ ID NO: 194018 - DNA, 25 bp, Mus musculus
aggccatcatagttccagactcggg

SEQ ID NO: 194019 - DNA, 25 bp, Mus musculus
aggccatccagacacaactagagga

SEQ ID NO: 194020 - DNA, 25 bp, Mus musculus
aggccatccagagacaactagagga

SEQ ID NO: 194021 - DNA, 25 bp, Mus musculus
aggccatccagccaagactgaacga

SEQ ID NO: 194022 - DNA, 25 bp, Mus musculus
aggccatccagcgaagactgaacga

SEQ ID NO: 194023 - DNA, 25 bp, Mus musculus
aggccatccattctcagcatattaa

SEQ ID NO: 194024 - DNA, 25 bp, Mus musculus
aggccatccattgtcagcatattaa

SEQ ID NO: 194025 - DNA, 25 bp, Mus musculus
aggccatccgccctccaagagtgtt

SEQ ID NO: 194026 - DNA, 25 bp, Mus musculus
aggccatccgccgtccaagagtgtt

SEQ ID NO: 194027 - DNA, 25 bp, Mus musculus
aggccatcctatagggttattattt

SEQ ID NO: 194028 - DNA, 25 bp, Mus musculus
aggccatcctattgggttattattt

SEQ ID NO: 194029 - DNA, 25 bp, Mus musculus
aggccatccttcaaatgtggctctt

SEQ ID NO: 194030 - DNA, 25 bp, Mus musculus
aggccatccttctaatgtggctctt

SEQ ID NO: 194031 - DNA, 25 bp, Mus musculus
aggccatcggaaagccctggcaagc

SEQ ID NO: 194032 - DNA, 25 bp, Mus musculus
aggccatcggaatgccctggcaagc

SEQ ID NO: 194033 - DNA, 25 bp, Mus musculus
aggccatcggacacattgaaaccat

SEQ ID NO: 194034 - DNA, 25 bp, Mus musculus
aggccatcggactcattgaaaccat

SEQ ID NO: 194035 - DNA, 25 bp, Mus musculus
aggccatcgtggacactgagtaaga

SEQ ID NO: 194036 - DNA, 25 bp, Mus musculus
aggccatcgtggtcactgagtaaga

SEQ ID NO: 194037 - DNA, 25 bp, Mus musculus
aggccatcgtgtacctggcgcagag

SEQ ID NO: 194038 - DNA, 25 bp, Mus musculus
aggccatcgtgttcctggcgcagag

SEQ ID NO: 194039 - DNA, 25 bp, Mus musculus
aggccatctcccaaggcaaagaact

SEQ ID NO: 194040 - DNA, 25 bp, Mus musculus
aggccatctccctaggcaaagaact

SEQ ID NO: 194041 - DNA, 25 bp, Mus musculus
aggccatctgagctgttctgtccta

SEQ ID NO: 194042 - DNA, 25 bp, Mus musculus
aggccatctgaggtgttctgtccta

SEQ ID NO: 194043 - DNA, 25 bp, Mus musculus
aggccatctgcacgtgactctgtag

SEQ ID NO: 194044 - DNA, 25 bp, Mus musculus
aggccatctgcaggtgactctgtag

SEQ ID NO: 194045 - DNA, 25 bp, Mus musculus
aggccatctggcatagtagtcatac

SEQ ID NO: 194046 - DNA, 25 bp, Mus musculus
aggccatctggcttagtagtcatac

SEQ ID NO: 194047 - DNA, 25 bp, Mus musculus
aggccatcttccagattcctgggtt

SEQ ID NO: 194048 - DNA, 25 bp, Mus musculus
aggccatcttcctgattcctgggtt

SEQ ID NO: 194049 - DNA, 25 bp, Mus musculus
aggccatcttgaaacagggacagga

SEQ ID NO: 194050 - DNA, 25 bp, Mus musculus
aggccatcttgatacagggacagga

SEQ ID NO: 194051 - DNA, 25 bp, Mus musculus
aggccatgaagaccctgcctgctat

SEQ ID NO: 194052 - DNA, 25 bp, Mus musculus
aggccatgaagagcctgcctgctat

SEQ ID NO: 194053 - DNA, 25 bp, Mus musculus
aggccatgagcgactactgggttgt

SEQ ID NO: 194054 - DNA, 25 bp, Mus musculus
aggccatgagcgtctactgggttgt

SEQ ID NO: 194055 - DNA, 25 bp, Mus musculus
aggccatgagctacgactttgcatc

SEQ ID NO: 194056 - DNA, 25 bp, Mus musculus
aggccatgagcttcgactttgcatc

SEQ ID NO: 194057 - DNA, 25 bp, Mus musculus
aggccatgatctcctctcaaaaatt

SEQ ID NO: 194058 - DNA, 25 bp, Mus musculus
aggccatgatctgctctcaaaaatt

SEQ ID NO: 194059 - DNA, 25 bp, Mus musculus
aggccatgatgtctctgtctatcaa

SEQ ID NO: 194060 - DNA, 25 bp, Mus musculus
aggccatgatgtgtctgtctatcaa

SEQ ID NO: 194061 - DNA, 25 bp, Mus musculus
aggccatgattcactcctataatcc

SEQ ID NO: 194062 - DNA, 25 bp, Mus musculus
aggccatgattctctcctataatcc

SEQ ID NO: 194063 - DNA, 25 bp, Mus musculus
aggccatgcagtccggctggtcagt

SEQ ID NO: 194064 - DNA, 25 bp, Mus musculus
aggccatgcagtgcggctggtcagt

SEQ ID NO: 194065 - DNA, 25 bp, Mus musculus
aggccatgcatcagtggctaaaacc

SEQ ID NO: 194066 - DNA, 25 bp, Mus musculus
aggccatgcatctgtggctaaaacc

SEQ ID NO: 194067 - DNA, 25 bp, Mus musculus
aggccatgcctaccaggttagcttt

SEQ ID NO: 194068 - DNA, 25 bp, Mus musculus
aggccatgcctacgcctgttagtta

SEQ ID NO: 194069 - DNA, 25 bp, Mus musculus
aggccatgcctagcaggttagcttt

SEQ ID NO: 194070 - DNA, 25 bp, Mus musculus
aggccatgcctaggcctgttagtta

SEQ ID NO: 194071 - DNA, 25 bp, Mus musculus
aggccatgcctgcatgcatcagcac

SEQ ID NO: 194072 - DNA, 25 bp, Mus musculus
aggccatgcctggatgcatcagcac

SEQ ID NO: 194073 - DNA, 25 bp, Mus musculus
aggccatgctcactggaccctgaag

SEQ ID NO: 194074 - DNA, 25 bp, Mus musculus
aggccatgctcagtggaccctgaag

SEQ ID NO: 194075 - DNA, 25 bp, Mus musculus
aggccatgctgacactctgtatctg

SEQ ID NO: 194076 - DNA, 25 bp, Mus musculus
aggccatgctgagactctgtatctg

SEQ ID NO: 194077 - DNA, 25 bp, Mus musculus
aggccatgcttcctgtcttaggaaa

SEQ ID NO: 194078 - DNA, 25 bp, Mus musculus
aggccatgcttcgtgtcttaggaaa

SEQ ID NO: 194079 - DNA, 25 bp, Mus musculus
aggccatggcatcagttcacagaat

SEQ ID NO: 194080 - DNA, 25 bp, Mus musculus
aggccatggcatgagttcacagaat

SEQ ID NO: 194081 - DNA, 25 bp, Mus musculus
aggccatggctacctggagacttac

SEQ ID NO: 194082 - DNA, 25 bp, Mus musculus
aggccatggctagctggagacttac

SEQ ID NO: 194083 - DNA, 25 bp, Mus musculus
aggccatggtgcagcaggaccccag

SEQ ID NO: 194084 - DNA, 25 bp, Mus musculus
aggccatggtgctgcaggaccccag

SEQ ID NO: 194085 - DNA, 25 bp, Mus musculus
aggccatgtgggaagctactcggca

SEQ ID NO: 194086 - DNA, 25 bp, Mus musculus
aggccatgtgggtagctactcggca

SEQ ID NO: 194087 - DNA, 25 bp, Mus musculus
aggccatgttacaggtaacgccccg

SEQ ID NO: 194088 - DNA, 25 bp, Mus musculus
aggccatgttactggtaacgccccg

SEQ ID NO: 194089 - DNA, 25 bp, Mus musculus
aggccatgttggattcgtatactca

SEQ ID NO: 194090 - DNA, 25 bp, Mus musculus
aggccatgttggtttcgtatactca

SEQ ID NO: 194091 - DNA, 25 bp, Mus musculus
aggccatgtttcagagcttccaagc

SEQ ID NO: 194092 - DNA, 25 bp, Mus musculus
aggccatgtttctgagcttccaagc

SEQ ID NO: 194093 - DNA, 25 bp, Mus musculus
aggccatgtttgctgtgactcagac

SEQ ID NO: 194094 - DNA, 25 bp, Mus musculus
aggccatgtttggtgtgactcagac

SEQ ID NO: 194095 - DNA, 25 bp, Mus musculus
aggccattcaccctgggcagaatag

SEQ ID NO: 194096 - DNA, 25 bp, Mus musculus
aggccattcaccgtgggcagaatag

SEQ ID NO: 194097 - DNA, 25 bp, Mus musculus
aggccattcactaccaagttctttt

SEQ ID NO: 194098 - DNA, 25 bp, Mus musculus
aggccattcacttccaagttctttt

SEQ ID NO: 194099 - DNA, 25 bp, Mus musculus
aggccattcagaagagctgtgccaa

SEQ ID NO: 194100 - DNA, 25 bp, Mus musculus
aggccattcagatgagctgtgccaa

SEQ ID NO: 194101 - DNA, 25 bp, Mus musculus
aggccattcaggcacttcattagtt

SEQ ID NO: 194102 - DNA, 25 bp, Mus musculus
aggccattcagggacttcattagtt

SEQ ID NO: 194103 - DNA, 25 bp, Mus musculus
aggccattctaaacccttgtttaca

SEQ ID NO: 194104 - DNA, 25 bp, Mus musculus
aggccattctaatcccttgtttaca

SEQ ID NO: 194105 - DNA, 25 bp, Mus musculus
aggccattgcctcagccagaagtta

SEQ ID NO: 194106 - DNA, 25 bp, Mus musculus
aggccattgcctgagccagaagtta

SEQ ID NO: 194107 - DNA, 25 bp, Mus musculus
aggccattgctcatagacctatcaa

SEQ ID NO: 194108 - DNA, 25 bp, Mus musculus
aggccattgctcttagacctatcaa

SEQ ID NO: 194109 - DNA, 25 bp, Mus musculus
aggccattggccaatcgggctgtca

SEQ ID NO: 194110 - DNA, 25 bp, Mus musculus
aggccattggccatcgaaactacca

SEQ ID NO: 194111 - DNA, 25 bp, Mus musculus
aggccattggcctatcgggctgtca

SEQ ID NO: 194112 - DNA, 25 bp, Mus musculus
aggccattggccttcgaaactacca

SEQ ID NO: 194113 - DNA, 25 bp, Mus musculus
aggccattgtaaacacttgtatatg

SEQ ID NO: 194114 - DNA, 25 bp, Mus musculus
aggccattgtaatcacttgtatatg

SEQ ID NO: 194115 - DNA, 25 bp, Mus musculus
aggccattgtccaccagtactacca

SEQ ID NO: 194116 - DNA, 25 bp, Mus musculus
aggccattgtcctccagtactacca

SEQ ID NO: 194117 - DNA, 25 bp, Mus musculus
aggccattgttaactctctcaagga

SEQ ID NO: 194118 - DNA, 25 bp, Mus musculus
aggccattgttatctctctcaagga

SEQ ID NO: 194119 - DNA, 25 bp, Mus musculus
aggccattgttgagctctgcaggaa

SEQ ID NO: 194120 - DNA, 25 bp, Mus musculus
aggccattgttgtgctctgcaggaa

SEQ ID NO: 194121 - DNA, 25 bp, Mus musculus
aggccatttacgatgcagatacaca

SEQ ID NO: 194122 - DNA, 25 bp, Mus musculus
aggccatttacgttgcagatacaca

SEQ ID NO: 194123 - DNA, 25 bp, Mus musculus
aggccatttggtatctcggccctaa

SEQ ID NO: 194124 - DNA, 25 bp, Mus musculus
aggccatttggtttctcggccctaa

SEQ ID NO: 194125 - DNA, 25 bp, Mus musculus
aggccatttttgacctttgcaaggt

SEQ ID NO: 194126 - DNA, 25 bp, Mus musculus
aggccatttttgtcctttgcaaggt

SEQ ID NO: 194127 - DNA, 25 bp, Mus musculus
aggccattttttatgagtgccatta

SEQ ID NO: 194128 - DNA, 25 bp, Mus musculus
aggccattttttttgagtgccatta

SEQ ID NO: 194129 - DNA, 25 bp, Mus musculus
aggcccaaagctacgtgcgcttcgt

SEQ ID NO: 194130 - DNA, 25 bp, Mus musculus
aggcccaaagcttcgtgcgcttcgt

SEQ ID NO: 194131 - DNA, 25 bp, Mus musculus
aggcccaaagttagtcttgtgttat

SEQ ID NO: 194132 - DNA, 25 bp, Mus musculus
aggcccaaagtttgtcttgtgttat

SEQ ID NO: 194133 - DNA, 25 bp, Mus musculus
aggcccaaatgcaaatctgttaaag

SEQ ID NO: 194134 - DNA, 25 bp, Mus musculus
aggcccaaatgctaatctgttaaag

SEQ ID NO: 194135 - DNA, 25 bp, Mus musculus
aggcccaacggtagaactccgacag

SEQ ID NO: 194136 - DNA, 25 bp, Mus musculus
aggcccaacggttgaactccgacag

SEQ ID NO: 194137 - DNA, 25 bp, Mus musculus
aggcccaagagccagttggcactca

SEQ ID NO: 194138 - DNA, 25 bp, Mus musculus
aggcccaagagcgagttggcactca

SEQ ID NO: 194139 - DNA, 25 bp, Mus musculus
aggcccaagataaaacccaccagtg

SEQ ID NO: 194140 - DNA, 25 bp, Mus musculus
aggcccaagatataacccaccagtg

SEQ ID NO: 194141 - DNA, 25 bp, Mus musculus
aggcccaagcaaaggagacactccg

SEQ ID NO: 194142 - DNA, 25 bp, Mus musculus
aggcccaagcaatggagacactccg

SEQ ID NO: 194143 - DNA, 25 bp, Mus musculus
aggcccaagcagaggtactggcttt

SEQ ID NO: 194144 - DNA, 25 bp, Mus musculus
aggcccaagcagtggtactggcttt

SEQ ID NO: 194145 - DNA, 25 bp, Mus musculus
aggcccaaggatagttctctgacac

SEQ ID NO: 194146 - DNA, 25 bp, Mus musculus
aggcccaaggattgttctctgacac

SEQ ID NO: 194147 - DNA, 25 bp, Mus musculus
aggcccaagggcagtgtccgttcca

SEQ ID NO: 194148 - DNA, 25 bp, Mus musculus
aggcccaagggctgtgtccgttcca

SEQ ID NO: 194149 - DNA, 25 bp, Mus musculus
aggcccaagggtataggactctgag

SEQ ID NO: 194150 - DNA, 25 bp, Mus musculus
aggcccaagggtttaggactctgag

SEQ ID NO: 194151 - DNA, 25 bp, Mus musculus
aggcccaaggtgaatgtgtcttctt

SEQ ID NO: 194152 - DNA, 25 bp, Mus musculus
aggcccaaggtgtatgtgtcttctt

SEQ ID NO: 194153 - DNA, 25 bp, Mus musculus
aggcccaagttgctttctttagtgt

SEQ ID NO: 194154 - DNA, 25 bp, Mus musculus
aggcccaagttggtttctttagtgt

SEQ ID NO: 194155 - DNA, 25 bp, Mus musculus
aggcccaagtttcaatcctggctcc

SEQ ID NO: 194156 - DNA, 25 bp, Mus musculus
aggcccaagtttgaatcctggctcc

SEQ ID NO: 194157 - DNA, 25 bp, Mus musculus
aggcccaatgccaaaaacaatcgtg

SEQ ID NO: 194158 - DNA, 25 bp, Mus musculus
aggcccaatgcccagtagtgggaaa

SEQ ID NO: 194159 - DNA, 25 bp, Mus musculus
aggcccaatgccgagtagtgggaaa

SEQ ID NO: 194160 - DNA, 25 bp, Mus musculus
aggcccaatgcctaaaacaatcgtg

SEQ ID NO: 194161 - DNA, 25 bp, Mus musculus
aggcccaattgtcatctaccagaca

SEQ ID NO: 194162 - DNA, 25 bp, Mus musculus
aggcccaattgtgatctaccagaca

SEQ ID NO: 194163 - DNA, 25 bp, Mus musculus
aggcccacaattcccagaagctttg

SEQ ID NO: 194164 - DNA, 25 bp, Mus musculus
aggcccacaattgccagaagctttg

SEQ ID NO: 194165 - DNA, 25 bp, Mus musculus
aggcccacagttataaatgctctcc

SEQ ID NO: 194166 - DNA, 25 bp, Mus musculus
aggcccacagttttaaatgctctcc

SEQ ID NO: 194167 - DNA, 25 bp, Mus musculus
aggcccaccagaccataatgacgtt

SEQ ID NO: 194168 - DNA, 25 bp, Mus musculus
aggcccaccagagcataatgacgtt

SEQ ID NO: 194169 - DNA, 25 bp, Mus musculus
aggcccacccaactggacaaggctt

SEQ ID NO: 194170 - DNA, 25 bp, Mus musculus
aggcccacccaagtggacaaggctt

SEQ ID NO: 194171 - DNA, 25 bp, Mus musculus
aggcccacggcgagcgaagagtcat

SEQ ID NO: 194172 - DNA, 25 bp, Mus musculus
aggcccacggcgtgcgaagagtcat

SEQ ID NO: 194173 - DNA, 25 bp, Mus musculus
aggcccactctgaagagggatccga

SEQ ID NO: 194174 - DNA, 25 bp, Mus musculus
aggcccactctgtagagggatccga

SEQ ID NO: 194175 - DNA, 25 bp, Mus musculus
aggcccactgaaatgatgctttatt

SEQ ID NO: 194176 - DNA, 25 bp, Mus musculus
aggcccactgaattgatgctttatt

SEQ ID NO: 194177 - DNA, 25 bp, Mus musculus
aggcccactgtcagttctgggaata

SEQ ID NO: 194178 - DNA, 25 bp, Mus musculus
aggcccactgtctgttctgggaata

SEQ ID NO: 194179 - DNA, 25 bp, Mus musculus
aggcccacttgtcctgatgctttca

SEQ ID NO: 194180 - DNA, 25 bp, Mus musculus
aggcccacttgtgctgatgctttca

SEQ ID NO: 194181 - DNA, 25 bp, Mus musculus
aggcccagaagaagccagcactgct

SEQ ID NO: 194182 - DNA, 25 bp, Mus musculus
aggcccagaagatgccagcactgct

SEQ ID NO: 194183 - DNA, 25 bp, Mus musculus
aggcccagaccgcacagagcacttt

SEQ ID NO: 194184 - DNA, 25 bp, Mus musculus
aggcccagaccggacagagcacttt

SEQ ID NO: 194185 - DNA, 25 bp, Mus musculus
aggcccagactcaaggtcatattga

SEQ ID NO: 194186 - DNA, 25 bp, Mus musculus
aggcccagactctaggtcatattga

SEQ ID NO: 194187 - DNA, 25 bp, Mus musculus
aggcccagactgaggcagagcagtt

SEQ ID NO: 194188 - DNA, 25 bp, Mus musculus
aggcccagactgtggcagagcagtt

SEQ ID NO: 194189 - DNA, 25 bp, Mus musculus
aggcccagaggcagatctgttcagt

SEQ ID NO: 194190 - DNA, 25 bp, Mus musculus
aggcccagaggctgatctgttcagt

SEQ ID NO: 194191 - DNA, 25 bp, Mus musculus
aggcccagatatatgtctgcacaca

SEQ ID NO: 194192 - DNA, 25 bp, Mus musculus
aggcccagatatttgtctgcacaca

SEQ ID NO: 194193 - DNA, 25 bp, Mus musculus
aggcccagcatacctaagcaatggt

SEQ ID NO: 194194 - DNA, 25 bp, Mus musculus
aggcccagcatagctaagcaatggt

SEQ ID NO: 194195 - DNA, 25 bp, Mus musculus
aggcccagccagcaattcagagcag

SEQ ID NO: 194196 - DNA, 25 bp, Mus musculus
aggcccagccaggaattcagagcag

SEQ ID NO: 194197 - DNA, 25 bp, Mus musculus
aggcccagccgccaggtatcagtac

SEQ ID NO: 194198 - DNA, 25 bp, Mus musculus
aggcccagccgcgaggtatcagtac

SEQ ID NO: 194199 - DNA, 25 bp, Mus musculus
aggcccagcctcaggatcatgctgg

SEQ ID NO: 194200 - DNA, 25 bp, Mus musculus
aggcccagcctctggatcatgctgg

SEQ ID NO: 194201 - DNA, 25 bp, Mus musculus
aggcccagcgggaatgtcagtgtca

SEQ ID NO: 194202 - DNA, 25 bp, Mus musculus
aggcccagcgggtatgtcagtgtca

SEQ ID NO: 194203 - DNA, 25 bp, Mus musculus
aggcccagctggcagagtctgccca

SEQ ID NO: 194204 - DNA, 25 bp, Mus musculus
aggcccagctgggagagtctgccca

SEQ ID NO: 194205 - DNA, 25 bp, Mus musculus
aggcccagcttgatctaacttctag

SEQ ID NO: 194206 - DNA, 25 bp, Mus musculus
aggcccagcttgttctaacttctag

SEQ ID NO: 194207 - DNA, 25 bp, Mus musculus
aggcccaggatccttcttctatgga

SEQ ID NO: 194208 - DNA, 25 bp, Mus musculus
aggcccaggatcgttcttctatgga

SEQ ID NO: 194209 - DNA, 25 bp, Mus musculus
aggcccaggctcaggtgcagcccga

SEQ ID NO: 194210 - DNA, 25 bp, Mus musculus
aggcccaggctctggtgcagcccga

SEQ ID NO: 194211 - DNA, 25 bp, Mus musculus
aggcccaggctgaatcattgcctta

SEQ ID NO: 194212 - DNA, 25 bp, Mus musculus
aggcccaggctgtatcattgcctta

SEQ ID NO: 194213 - DNA, 25 bp, Mus musculus
aggcccagggcaagaacatgggtat

SEQ ID NO: 194214 - DNA, 25 bp, Mus musculus
aggcccagggcatgaacatgggtat

SEQ ID NO: 194215 - DNA, 25 bp, Mus musculus
aggcccagggccacattgccaggaa

SEQ ID NO: 194216 - DNA, 25 bp, Mus musculus
aggcccagggcctcattgccaggaa

SEQ ID NO: 194217 - DNA, 25 bp, Mus musculus
aggcccaggtttagcattcgctaca

SEQ ID NO: 194218 - DNA, 25 bp, Mus musculus
aggcccaggttttgcattcgctaca

SEQ ID NO: 194219 - DNA, 25 bp, Mus musculus
aggcccagtatcactctctttttgt

SEQ ID NO: 194220 - DNA, 25 bp, Mus musculus
aggcccagtatctctctctttttgt

SEQ ID NO: 194221 - DNA, 25 bp, Mus musculus
aggcccagtcggacaccaggaggat

SEQ ID NO: 194222 - DNA, 25 bp, Mus musculus
aggcccagtcggtcaccaggaggat

SEQ ID NO: 194223 - DNA, 25 bp, Mus musculus
aggcccagtctaacctatgaacttc

SEQ ID NO: 194224 - DNA, 25 bp, Mus musculus
aggcccagtctatcctatgaacttc

SEQ ID NO: 194225 - DNA, 25 bp, Mus musculus
aggcccagtgacaatggaatcccca

SEQ ID NO: 194226 - DNA, 25 bp, Mus musculus
aggcccagtgactatggaatcccca

SEQ ID NO: 194227 - DNA, 25 bp, Mus musculus
aggcccagtgcgaacggcagaaaga

SEQ ID NO: 194228 - DNA, 25 bp, Mus musculus
aggcccagtgcgtacggcagaaaga

SEQ ID NO: 194229 - DNA, 25 bp, Mus musculus
aggcccagtggtcagacccacagct

SEQ ID NO: 194230 - DNA, 25 bp, Mus musculus
aggcccagtggtgagacccacagct

SEQ ID NO: 194231 - DNA, 25 bp, Mus musculus
aggcccagtttgaccatggctagca

SEQ ID NO: 194232 - DNA, 25 bp, Mus musculus
aggcccagtttgtccatggctagca

SEQ ID NO: 194233 - DNA, 25 bp, Mus musculus
aggcccataaggcaagggtcgcgtc

SEQ ID NO: 194234 - DNA, 25 bp, Mus musculus
aggcccataagggaagggtcgcgtc

SEQ ID NO: 194235 - DNA, 25 bp, Mus musculus
aggcccatacctcctttaatcggat

SEQ ID NO: 194236 - DNA, 25 bp, Mus musculus
aggcccatacctgctttaatcggat

SEQ ID NO: 194237 - DNA, 25 bp, Mus musculus
aggcccatactcatgagtctctcag

SEQ ID NO: 194238 - DNA, 25 bp, Mus musculus
aggcccatactcttgagtctctcag

SEQ ID NO: 194239 - DNA, 25 bp, Mus musculus
aggcccatagcaacccaggctggaa

SEQ ID NO: 194240 - DNA, 25 bp, Mus musculus
aggcccatagcatcccaggctggaa

SEQ ID NO: 194241 - DNA, 25 bp, Mus musculus
aggcccatagctagggaagcttgcc

SEQ ID NO: 194242 - DNA, 25 bp, Mus musculus
aggcccatagcttgggaagcttgcc

SEQ ID NO: 194243 - DNA, 25 bp, Mus musculus
aggcccatcaggaccactgtgctga

SEQ ID NO: 194244 - DNA, 25 bp, Mus musculus
aggcccatcaggtccactgtgctga

SEQ ID NO: 194245 - DNA, 25 bp, Mus musculus
aggcccatcattcgcataacagctt

SEQ ID NO: 194246 - DNA, 25 bp, Mus musculus
aggcccatcattggcataacagctt

SEQ ID NO: 194247 - DNA, 25 bp, Mus musculus
aggcccatccaaagcttcctgtatg

SEQ ID NO: 194248 - DNA, 25 bp, Mus musculus
aggcccatccaatgcttcctgtatg

SEQ ID NO: 194249 - DNA, 25 bp, Mus musculus
aggcccatccacaggagcatgggta

SEQ ID NO: 194250 - DNA, 25 bp, Mus musculus
aggcccatccactggagcatgggta

SEQ ID NO: 194251 - DNA, 25 bp, Mus musculus
aggcccatccatcttcctgaaaatg

SEQ ID NO: 194252 - DNA, 25 bp, Mus musculus
aggcccatccatgttcctgaaaatg

SEQ ID NO: 194253 - DNA, 25 bp, Mus musculus
aggcccatcctcattaagaccgact

SEQ ID NO: 194254 - DNA, 25 bp, Mus musculus
aggcccatcctctttaagaccgact

SEQ ID NO: 194255 - DNA, 25 bp, Mus musculus
aggcccatcgcaagatctgtgtaag

SEQ ID NO: 194256 - DNA, 25 bp, Mus musculus
aggcccatcgcatgatctgtgtaag

SEQ ID NO: 194257 - DNA, 25 bp, Mus musculus
aggcccatcgtgaggtgccctacag

SEQ ID NO: 194258 - DNA, 25 bp, Mus musculus
aggcccatcgtgtggtgccctacag

SEQ ID NO: 194259 - DNA, 25 bp, Mus musculus
aggcccatctatccagtgcattgaa

SEQ ID NO: 194260 - DNA, 25 bp, Mus musculus
aggcccatctatgcagtgcattgaa

SEQ ID NO: 194261 - DNA, 25 bp, Mus musculus
aggcccatgcagactctgggtcctg

SEQ ID NO: 194262 - DNA, 25 bp, Mus musculus
aggcccatgcagtctctgggtcctg

SEQ ID NO: 194263 - DNA, 25 bp, Mus musculus
aggcccatgctgaacaactaactag

SEQ ID NO: 194264 - DNA, 25 bp, Mus musculus
aggcccatgctgtacaactaactag

SEQ ID NO: 194265 - DNA, 25 bp, Mus musculus
aggcccatggacagaccttggataa

SEQ ID NO: 194266 - DNA, 25 bp, Mus musculus
aggcccatggactgaccttggataa

SEQ ID NO: 194267 - DNA, 25 bp, Mus musculus
aggccccaactgctggaagaggtcc

SEQ ID NO: 194268 - DNA, 25 bp, Mus musculus
aggccccaactggtggaagaggtcc

SEQ ID NO: 194269 - DNA, 25 bp, Mus musculus
aggccccacagcactggtacacata

SEQ ID NO: 194270 - DNA, 25 bp, Mus musculus
aggccccacagctctggtacacata

SEQ ID NO: 194271 - DNA, 25 bp, Mus musculus
aggccccaccttatctgtactgtgt

SEQ ID NO: 194272 - DNA, 25 bp, Mus musculus
aggccccaccttttctgtactgtgt

SEQ ID NO: 194273 - DNA, 25 bp, Mus musculus
aggccccacgttagttttgacagag

SEQ ID NO: 194274 - DNA, 25 bp, Mus musculus
aggccccacgtttgttttgacagag

SEQ ID NO: 194275 - DNA, 25 bp, Mus musculus
aggccccactaacaaggcgactcaa

SEQ ID NO: 194276 - DNA, 25 bp, Mus musculus
aggccccactaagaaggcgactcaa

SEQ ID NO: 194277 - DNA, 25 bp, Mus musculus
aggccccacttacttcaagaagagg

SEQ ID NO: 194278 - DNA, 25 bp, Mus musculus
aggccccacttagttcaagaagagg

SEQ ID NO: 194279 - DNA, 25 bp, Mus musculus
aggccccacttgacctaagaagaga

SEQ ID NO: 194280 - DNA, 25 bp, Mus musculus
aggccccacttgtcctaagaagaga

SEQ ID NO: 194281 - DNA, 25 bp, Mus musculus
aggccccagatgacttacattttgc

SEQ ID NO: 194282 - DNA, 25 bp, Mus musculus
aggccccagatgtcttacattttgc

SEQ ID NO: 194283 - DNA, 25 bp, Mus musculus
aggccccagattatcatagctggcc

SEQ ID NO: 194284 - DNA, 25 bp, Mus musculus
aggccccagattttcatagctggcc

SEQ ID NO: 194285 - DNA, 25 bp, Mus musculus
aggccccagcctaggatgtagtgac

SEQ ID NO: 194286 - DNA, 25 bp, Mus musculus
aggccccagccttggatgtagtgac

SEQ ID NO: 194287 - DNA, 25 bp, Mus musculus
aggccccatcctataaactgaatat

SEQ ID NO: 194288 - DNA, 25 bp, Mus musculus
aggccccatcctttaaactgaatat

SEQ ID NO: 194289 - DNA, 25 bp, Mus musculus
aggccccatgcccatgtataataga

SEQ ID NO: 194290 - DNA, 25 bp, Mus musculus
aggccccatgccgatgtataataga

SEQ ID NO: 194291 - DNA, 25 bp, Mus musculus
aggccccatgttctatgccccataa

SEQ ID NO: 194292 - DNA, 25 bp, Mus musculus
aggccccatgttgtatgccccataa

SEQ ID NO: 194293 - DNA, 25 bp, Mus musculus
aggccccattatccttagccatgtt

SEQ ID NO: 194294 - DNA, 25 bp, Mus musculus
aggccccattatgcttagccatgtt

SEQ ID NO: 194295 - DNA, 25 bp, Mus musculus
aggccccatttgagacgcaaacgtt

SEQ ID NO: 194296 - DNA, 25 bp, Mus musculus
aggccccatttgtgacgcaaacgtt

SEQ ID NO: 194297 - DNA, 25 bp, Mus musculus
aggccccgctgaaagcaactgtaaa

SEQ ID NO: 194298 - DNA, 25 bp, Mus musculus
aggccccgctgatagcaactgtaaa

SEQ ID NO: 194299 - DNA, 25 bp, Mus musculus
aggccccgcttgcaggtttatagac

SEQ ID NO: 194300 - DNA, 25 bp, Mus musculus
aggccccgcttggaggtttatagac

SEQ ID NO: 194301 - DNA, 25 bp, Mus musculus
aggccccggaagcaaaagcgcaatg

SEQ ID NO: 194302 - DNA, 25 bp, Mus musculus
aggccccggaaggaaaagcgcaatg

SEQ ID NO: 194303 - DNA, 25 bp, Mus musculus
aggccccggcacactcaacataggt

SEQ ID NO: 194304 - DNA, 25 bp, Mus musculus
aggccccggcactctcaacataggt

SEQ ID NO: 194305 - DNA, 25 bp, Mus musculus
aggccccgggagcaattaaagacat

SEQ ID NO: 194306 - DNA, 25 bp, Mus musculus
aggccccgggaggaattaaagacat

SEQ ID NO: 194307 - DNA, 25 bp, Mus musculus
aggccccgggatctgctgaagcaat

SEQ ID NO: 194308 - DNA, 25 bp, Mus musculus
aggccccgggatgtgctgaagcaat

SEQ ID NO: 194309 - DNA, 25 bp, Mus musculus
aggccccgtgtgatctgtcagggac

SEQ ID NO: 194310 - DNA, 25 bp, Mus musculus
aggccccgtgtgttctgtcagggac

SEQ ID NO: 194311 - DNA, 25 bp, Mus musculus
aggccccgttggagatggtatgatt

SEQ ID NO: 194312 - DNA, 25 bp, Mus musculus
aggccccgttggtgatggtatgatt

SEQ ID NO: 194313 - DNA, 25 bp, Mus musculus
aggcccctacagcatgttctgcaaa

SEQ ID NO: 194314 - DNA, 25 bp, Mus musculus
aggcccctacaggatgttctgcaaa

SEQ ID NO: 194315 - DNA, 25 bp, Mus musculus
aggcccctactgctttaatagctgc

SEQ ID NO: 194316 - DNA, 25 bp, Mus musculus
aggcccctactggtttaatagctgc

SEQ ID NO: 194317 - DNA, 25 bp, Mus musculus
aggcccctagtcctttacatggata

SEQ ID NO: 194318 - DNA, 25 bp, Mus musculus
aggcccctagtcgtttacatggata

SEQ ID NO: 194319 - DNA, 25 bp, Mus musculus
aggcccctccaacgaagtgcttcgg

SEQ ID NO: 194320 - DNA, 25 bp, Mus musculus
aggcccctccaaggaagtgcttcgg

SEQ ID NO: 194321 - DNA, 25 bp, Mus musculus
aggcccctctccactgattaggtgg

SEQ ID NO: 194322 - DNA, 25 bp, Mus musculus
aggcccctctcctctgattaggtgg

SEQ ID NO: 194323 - DNA, 25 bp, Mus musculus
aggcccctctgcatgagcttaatca

SEQ ID NO: 194324 - DNA, 25 bp, Mus musculus
aggcccctctgcttgagcttaatca

SEQ ID NO: 194325 - DNA, 25 bp, Mus musculus
aggcccctcttcagaggcctgtgat

SEQ ID NO: 194326 - DNA, 25 bp, Mus musculus
aggcccctcttctgaggcctgtgat

SEQ ID NO: 194327 - DNA, 25 bp, Mus musculus
aggcccctgaccagtgacgaagtca

SEQ ID NO: 194328 - DNA, 25 bp, Mus musculus
aggcccctgacctgtgacgaagtca

SEQ ID NO: 194329 - DNA, 25 bp, Mus musculus
aggcccctgagcacttactaacaag

SEQ ID NO: 194330 - DNA, 25 bp, Mus musculus
aggcccctgagctcttactaacaag

SEQ ID NO: 194331 - DNA, 25 bp, Mus musculus
aggcccctgctaaagccagagatca

SEQ ID NO: 194332 - DNA, 25 bp, Mus musculus
aggcccctgctatagccagagatca

SEQ ID NO: 194333 - DNA, 25 bp, Mus musculus
aggcccctgctcctcatgagaagtg

SEQ ID NO: 194334 - DNA, 25 bp, Mus musculus
aggcccctgctcgtcatgagaagtg

SEQ ID NO: 194335 - DNA, 25 bp, Mus musculus
aggcccctggggaatgaatctgagc

SEQ ID NO: 194336 - DNA, 25 bp, Mus musculus
aggcccctggggtatgaatctgagc

SEQ ID NO: 194337 - DNA, 25 bp, Mus musculus
aggcccctggtactgattcatttat

SEQ ID NO: 194338 - DNA, 25 bp, Mus musculus
aggcccctggtagtgattcatttat

SEQ ID NO: 194339 - DNA, 25 bp, Mus musculus
aggcccctgtgaaggccccatagaa

SEQ ID NO: 194340 - DNA, 25 bp, Mus musculus
aggcccctgtgaatttctcacatag

SEQ ID NO: 194341 - DNA, 25 bp, Mus musculus
aggcccctgtgatggccccatagaa

SEQ ID NO: 194342 - DNA, 25 bp, Mus musculus
aggcccctgtgattttctcacatag

SEQ ID NO: 194343 - DNA, 25 bp, Mus musculus
aggcccctgtggctttgaactcctg

SEQ ID NO: 194344 - DNA, 25 bp, Mus musculus
aggcccctgtgggtttgaactcctg

SEQ ID NO: 194345 - DNA, 25 bp, Mus musculus
aggccccttaccaaagcttaagcag

SEQ ID NO: 194346 - DNA, 25 bp, Mus musculus
aggccccttacctaagcttaagcag

SEQ ID NO: 194347 - DNA, 25 bp, Mus musculus
aggccccttcttatggctgaggaac

SEQ ID NO: 194348 - DNA, 25 bp, Mus musculus
aggccccttcttttggctgaggaac

SEQ ID NO: 194349 - DNA, 25 bp, Mus musculus
aggccccttggtctgtgaggatatc

SEQ ID NO: 194350 - DNA, 25 bp, Mus musculus
aggccccttggtgtgtgaggatatc

SEQ ID NO: 194351 - DNA, 25 bp, Mus musculus
aggcccctttcaatgtggcactgag

SEQ ID NO: 194352 - DNA, 25 bp, Mus musculus
aggcccctttcattgtggcactgag

SEQ ID NO: 194353 - DNA, 25 bp, Mus musculus
aggcccctttggactggtgtcagat

SEQ ID NO: 194354 - DNA, 25 bp, Mus musculus
aggcccctttggtctggtgtcagat

SEQ ID NO: 194355 - DNA, 25 bp, Mus musculus
aggcccgaattcactgcagcactaa

SEQ ID NO: 194356 - DNA, 25 bp, Mus musculus
aggcccgaattctctgcagcactaa

SEQ ID NO: 194357 - DNA, 25 bp, Mus musculus
aggcccgactcaatcgagagcgaga

SEQ ID NO: 194358 - DNA, 25 bp, Mus musculus
aggcccgactcattcgagagcgaga

SEQ ID NO: 194359 - DNA, 25 bp, Mus musculus
aggcccgacttgaagccacaatctt

SEQ ID NO: 194360 - DNA, 25 bp, Mus musculus
aggcccgacttgtagccacaatctt

SEQ ID NO: 194361 - DNA, 25 bp, Mus musculus
aggcccgagaggaccctactgagga

SEQ ID NO: 194362 - DNA, 25 bp, Mus musculus
aggcccgagaggtccctactgagga

SEQ ID NO: 194363 - DNA, 25 bp, Mus musculus
aggcccgagatacctcagaaggatc

SEQ ID NO: 194364 - DNA, 25 bp, Mus musculus
aggcccgagatagctcagaaggatc

SEQ ID NO: 194365 - DNA, 25 bp, Mus musculus
aggcccgaggcaaacgcatcaaagt

SEQ ID NO: 194366 - DNA, 25 bp, Mus musculus
aggcccgaggcatacgcatcaaagt

SEQ ID NO: 194367 - DNA, 25 bp, Mus musculus
aggcccgcagagacacttatgccat

SEQ ID NO: 194368 - DNA, 25 bp, Mus musculus
aggcccgcagagtcacttatgccat

SEQ ID NO: 194369 - DNA, 25 bp, Mus musculus
aggcccgcccagatgaggagtgcaa

SEQ ID NO: 194370 - DNA, 25 bp, Mus musculus
aggcccgcccagttgaggagtgcaa

SEQ ID NO: 194371 - DNA, 25 bp, Mus musculus
aggcccggaagccaatcccaggtgt

SEQ ID NO: 194372 - DNA, 25 bp, Mus musculus
aggcccggaagcgaatcccaggtgt

SEQ ID NO: 194373 - DNA, 25 bp, Mus musculus
aggcccggacatcaaggagcatctt

SEQ ID NO: 194374 - DNA, 25 bp, Mus musculus
aggcccggacatgaaggagcatctt

SEQ ID NO: 194375 - DNA, 25 bp, Mus musculus
aggcccggcctgatgtttgtgaaag

SEQ ID NO: 194376 - DNA, 25 bp, Mus musculus
aggcccggcctgttgtttgtgaaag

SEQ ID NO: 194377 - DNA, 25 bp, Mus musculus
aggcccgggcctcacaaagaagcgc

SEQ ID NO: 194378 - DNA, 25 bp, Mus musculus
aggcccgggcctgacaaagaagcgc

SEQ ID NO: 194379 - DNA, 25 bp, Mus musculus
aggcccgtaagacgagcactcatct

SEQ ID NO: 194380 - DNA, 25 bp, Mus musculus
aggcccgtaagaggagcactcatct

SEQ ID NO: 194381 - DNA, 25 bp, Mus musculus
aggcccgtagtgcttcagcttgaag

SEQ ID NO: 194382 - DNA, 25 bp, Mus musculus
aggcccgtagtggttcagcttgaag

SEQ ID NO: 194383 - DNA, 25 bp, Mus musculus
aggcccgtatccagaagctgtttgg

SEQ ID NO: 194384 - DNA, 25 bp, Mus musculus
aggcccgtatcctgaagctgtttgg

SEQ ID NO: 194385 - DNA, 25 bp, Mus musculus
aggcccgtggacagagattcccaga

SEQ ID NO: 194386 - DNA, 25 bp, Mus musculus
aggcccgtggactgagattcccaga

SEQ ID NO: 194387 - DNA, 25 bp, Mus musculus
aggcccgtgggcagtctacaaatat

SEQ ID NO: 194388 - DNA, 25 bp, Mus musculus
aggcccgtgggctgtctacaaatat

SEQ ID NO: 194389 - DNA, 25 bp, Mus musculus
aggcccgtggttcttgtagcagttt

SEQ ID NO: 194390 - DNA, 25 bp, Mus musculus
aggcccgtggttgttgtagcagttt

SEQ ID NO: 194391 - DNA, 25 bp, Mus musculus
aggcccgttgatcctgacaggactc

SEQ ID NO: 194392 - DNA, 25 bp, Mus musculus
aggcccgttgatgctgacaggactc

SEQ ID NO: 194393 - DNA, 25 bp, Mus musculus
aggccctaactgatttctgcaaagt

SEQ ID NO: 194394 - DNA, 25 bp, Mus musculus
aggccctaactgttttctgcaaagt

SEQ ID NO: 194395 - DNA, 25 bp, Mus musculus
aggccctaatgacccttgatgatca

SEQ ID NO: 194396 - DNA, 25 bp, Mus musculus
aggccctaatgagccttgatgatca

SEQ ID NO: 194397 - DNA, 25 bp, Mus musculus
aggccctacacactgaggagtcctg

SEQ ID NO: 194398 - DNA, 25 bp, Mus musculus
aggccctacacagtgaggagtcctg

SEQ ID NO: 194399 - DNA, 25 bp, Mus musculus
aggccctacagcagatggaaatgat

SEQ ID NO: 194400 - DNA, 25 bp, Mus musculus
aggccctacagctgatggaaatgat

SEQ ID NO: 194401 - DNA, 25 bp, Mus musculus
aggccctaggcaccctgaaacagct

SEQ ID NO: 194402 - DNA, 25 bp, Mus musculus
aggccctaggcagcctgaaacagct

SEQ ID NO: 194403 - DNA, 25 bp, Mus musculus
aggccctagggaagcaaactttccg

SEQ ID NO: 194404 - DNA, 25 bp, Mus musculus
aggccctagggatgcaaactttccg

SEQ ID NO: 194405 - DNA, 25 bp, Mus musculus
aggccctagtcacaagatttattca

SEQ ID NO: 194406 - DNA, 25 bp, Mus musculus
aggccctagtcagaagatttattca

SEQ ID NO: 194407 - DNA, 25 bp, Mus musculus
aggccctatctaataacactagaaa

SEQ ID NO: 194408 - DNA, 25 bp, Mus musculus
aggccctatctattaacactagaaa

SEQ ID NO: 194409 - DNA, 25 bp, Mus musculus
aggccctatgcccagaagtagctga

SEQ ID NO: 194410 - DNA, 25 bp, Mus musculus
aggccctatgccgagaagtagctga

SEQ ID NO: 194411 - DNA, 25 bp, Mus musculus
aggccctatgtccaacagtgttttt

SEQ ID NO: 194412 - DNA, 25 bp, Mus musculus
aggccctatgtcgaacagtgttttt

SEQ ID NO: 194413 - DNA, 25 bp, Mus musculus
aggccctcaaagacctttattgcca

SEQ ID NO: 194414 - DNA, 25 bp, Mus musculus
aggccctcaaagtcctttattgcca

SEQ ID NO: 194415 - DNA, 25 bp, Mus musculus
aggccctcaaccacatgtacaagct

SEQ ID NO: 194416 - DNA, 25 bp, Mus musculus
aggccctcaacctcatgtacaagct

SEQ ID NO: 194417 - DNA, 25 bp, Mus musculus
aggccctcagggatacttatgtata

SEQ ID NO: 194418 - DNA, 25 bp, Mus musculus
aggccctcagggttacttatgtata

SEQ ID NO: 194419 - DNA, 25 bp, Mus musculus
aggccctcaggtaagccagcatctc

SEQ ID NO: 194420 - DNA, 25 bp, Mus musculus
aggccctcaggttagccagcatctc

SEQ ID NO: 194421 - DNA, 25 bp, Mus musculus
aggccctcagtaattccgaagcaca

SEQ ID NO: 194422 - DNA, 25 bp, Mus musculus
aggccctcagtatttccgaagcaca

SEQ ID NO: 194423 - DNA, 25 bp, Mus musculus
aggccctcagtgagtccatccaagt

SEQ ID NO: 194424 - DNA, 25 bp, Mus musculus
aggccctcagtgtgtccatccaagt

SEQ ID NO: 194425 - DNA, 25 bp, Mus musculus
aggccctcataaccctaagcaatgg

SEQ ID NO: 194426 - DNA, 25 bp, Mus musculus
aggccctcataagcctaagcaatgg

SEQ ID NO: 194427 - DNA, 25 bp, Mus musculus
aggccctcattgaagagttgctgat

SEQ ID NO: 194428 - DNA, 25 bp, Mus musculus
aggccctcattgtagagttgctgat

SEQ ID NO: 194429 - DNA, 25 bp, Mus musculus
aggccctcctctcatcagtatgact

SEQ ID NO: 194430 - DNA, 25 bp, Mus musculus
aggccctcctctgatcagtatgact

SEQ ID NO: 194431 - DNA, 25 bp, Mus musculus
aggccctctcaacgttctcaattta

SEQ ID NO: 194432 - DNA, 25 bp, Mus musculus
aggccctctcaaggttctcaattta

SEQ ID NO: 194433 - DNA, 25 bp, Mus musculus
aggccctctctaatttcgcaagaag

SEQ ID NO: 194434 - DNA, 25 bp, Mus musculus
aggccctctctattttcgcaagaag

SEQ ID NO: 194435 - DNA, 25 bp, Mus musculus
aggccctctcttagagtagttgtca

SEQ ID NO: 194436 - DNA, 25 bp, Mus musculus
aggccctctctttgagtagttgtca

SEQ ID NO: 194437 - DNA, 25 bp, Mus musculus
aggccctctgggacatcatgcgttg

SEQ ID NO: 194438 - DNA, 25 bp, Mus musculus
aggccctctgggtcatcatgcgttg

SEQ ID NO: 194439 - DNA, 25 bp, Mus musculus
aggccctcttctcatattcatgcat

SEQ ID NO: 194440 - DNA, 25 bp, Mus musculus
aggccctcttctgatattcatgcat

SEQ ID NO: 194441 - DNA, 25 bp, Mus musculus
aggccctctttaaaccaacatcagt

SEQ ID NO: 194442 - DNA, 25 bp, Mus musculus
aggccctctttataccaacatcagt

SEQ ID NO: 194443 - DNA, 25 bp, Mus musculus
aggccctgaaaaccagcctggcggg

SEQ ID NO: 194444 - DNA, 25 bp, Mus musculus
aggccctgaaaagcagcctggcggg

SEQ ID NO: 194445 - DNA, 25 bp, Mus musculus
aggccctgaactcaatgactctgct

SEQ ID NO: 194446 - DNA, 25 bp, Mus musculus
aggccctgaactcttccccagtggg

SEQ ID NO: 194447 - DNA, 25 bp, Mus musculus
aggccctgaactgaatgactctgct

SEQ ID NO: 194448 - DNA, 25 bp, Mus musculus
aggccctgaactgttccccagtggg

SEQ ID NO: 194449 - DNA, 25 bp, Mus musculus
aggccctgaccacctgcgggtttga

SEQ ID NO: 194450 - DNA, 25 bp, Mus musculus
aggccctgaccagctgcgggtttga

SEQ ID NO: 194451 - DNA, 25 bp, Mus musculus
aggccctgagcaagctaggcagaca

SEQ ID NO: 194452 - DNA, 25 bp, Mus musculus
aggccctgagcatgctaggcagaca

SEQ ID NO: 194453 - DNA, 25 bp, Mus musculus
aggccctgagctcttaaggcaccag

SEQ ID NO: 194454 - DNA, 25 bp, Mus musculus
aggccctgagctgttaaggcaccag

SEQ ID NO: 194455 - DNA, 25 bp, Mus musculus
aggccctgaggcagcaagtttacac

SEQ ID NO: 194456 - DNA, 25 bp, Mus musculus
aggccctgaggctgcaagtttacac

SEQ ID NO: 194457 - DNA, 25 bp, Mus musculus
aggccctgagtgacagacatcctta

SEQ ID NO: 194458 - DNA, 25 bp, Mus musculus
aggccctgagtgtcagacatcctta

SEQ ID NO: 194459 - DNA, 25 bp, Mus musculus
aggccctgagttcaacgcaccattt

SEQ ID NO: 194460 - DNA, 25 bp, Mus musculus
aggccctgagttgaacgcaccattt

SEQ ID NO: 194461 - DNA, 25 bp, Mus musculus
aggccctgatgacggatttggttct

SEQ ID NO: 194462 - DNA, 25 bp, Mus musculus
aggccctgatgagggatttggttct

SEQ ID NO: 194463 - DNA, 25 bp, Mus musculus
aggccctgcagcattgtcctaagaa

SEQ ID NO: 194464 - DNA, 25 bp, Mus musculus
aggccctgcagctttgtcctaagaa

SEQ ID NO: 194465 - DNA, 25 bp, Mus musculus
aggccctgccctcggatgtttcacg

SEQ ID NO: 194466 - DNA, 25 bp, Mus musculus
aggccctgccctgggatgtttcacg

SEQ ID NO: 194467 - DNA, 25 bp, Mus musculus
aggccctgccttcatactatgatca

SEQ ID NO: 194468 - DNA, 25 bp, Mus musculus
aggccctgccttgatactatgatca

SEQ ID NO: 194469 - DNA, 25 bp, Mus musculus
aggccctgcgagcagatcagcccag

SEQ ID NO: 194470 - DNA, 25 bp, Mus musculus
aggccctgcgaggagatcagcccag

SEQ ID NO: 194471 - DNA, 25 bp, Mus musculus
aggccctggagaaattctggagaca

SEQ ID NO: 194472 - DNA, 25 bp, Mus musculus
aggccctggagatattctggagaca

SEQ ID NO: 194473 - DNA, 25 bp, Mus musculus
aggccctggagtacagcagctctga

SEQ ID NO: 194474 - DNA, 25 bp, Mus musculus
aggccctggagttcagcagctctga

SEQ ID NO: 194475 - DNA, 25 bp, Mus musculus
aggccctggattagatccctaggca

SEQ ID NO: 194476 - DNA, 25 bp, Mus musculus
aggccctggatttgatccctaggca

SEQ ID NO: 194477 - DNA, 25 bp, Mus musculus
aggccctggcaaccacagacagctg

SEQ ID NO: 194478 - DNA, 25 bp, Mus musculus
aggccctggcaagcacagacagctg

SEQ ID NO: 194479 - DNA, 25 bp, Mus musculus
aggccctggctcagtttgttatata

SEQ ID NO: 194480 - DNA, 25 bp, Mus musculus
aggccctggctctgtttgttatata

SEQ ID NO: 194481 - DNA, 25 bp, Mus musculus
aggccctggctgagatcgtagacgt

SEQ ID NO: 194482 - DNA, 25 bp, Mus musculus
aggccctggctgtgatcgtagacgt

SEQ ID NO: 194483 - DNA, 25 bp, Mus musculus
aggccctgggatctactctgtttca

SEQ ID NO: 194484 - DNA, 25 bp, Mus musculus
aggccctgggatgtactctgtttca

SEQ ID NO: 194485 - DNA, 25 bp, Mus musculus
aggccctgggcccatcttcttggga

SEQ ID NO: 194486 - DNA, 25 bp, Mus musculus
aggccctgggccgatcttcttggga

SEQ ID NO: 194487 - DNA, 25 bp, Mus musculus
aggccctgtaagatcaccattctca

SEQ ID NO: 194488 - DNA, 25 bp, Mus musculus
aggccctgtaagttcaccattctca

SEQ ID NO: 194489 - DNA, 25 bp, Mus musculus
aggccctgtaccatctacgtacgat

SEQ ID NO: 194490 - DNA, 25 bp, Mus musculus
aggccctgtaccttctacgtacgat

SEQ ID NO: 194491 - DNA, 25 bp, Mus musculus
aggccctgtcccagctcagagaaca

SEQ ID NO: 194492 - DNA, 25 bp, Mus musculus
aggccctgtccctgctcagagaaca

SEQ ID NO: 194493 - DNA, 25 bp, Mus musculus
aggccctgtctaattgctatttact

SEQ ID NO: 194494 - DNA, 25 bp, Mus musculus
aggccctgtctatttgctatttact

SEQ ID NO: 194495 - DNA, 25 bp, Mus musculus
aggccctgtgagagtcctgaacatc

SEQ ID NO: 194496 - DNA, 25 bp, Mus musculus
aggccctgtgagtgtcctgaacatc

SEQ ID NO: 194497 - DNA, 25 bp, Mus musculus
aggccctgtggaaagacctgataac

SEQ ID NO: 194498 - DNA, 25 bp, Mus musculus
aggccctgtggatagacctgataac

SEQ ID NO: 194499 - DNA, 25 bp, Mus musculus
aggccctgtggcctcagagctagtt

SEQ ID NO: 194500 - DNA, 25 bp, Mus musculus
aggccctgtggcgtcagagctagtt

SEQ ID NO: 194501 - DNA, 25 bp, Mus musculus
aggccctgtgtgacaacagtaagag

SEQ ID NO: 194502 - DNA, 25 bp, Mus musculus
aggccctgtgtgtcaacagtaagag

SEQ ID NO: 194503 - DNA, 25 bp, Mus musculus
aggccctgtttccttgcagcaaaac

SEQ ID NO: 194504 - DNA, 25 bp, Mus musculus
aggccctgtttcgttgcagcaaaac

SEQ ID NO: 194505 - DNA, 25 bp, Mus musculus
aggcccttaagtacaagctttctct

SEQ ID NO: 194506 - DNA, 25 bp, Mus musculus
aggcccttaagttcaagctttctct

SEQ ID NO: 194507 - DNA, 25 bp, Mus musculus
aggcccttaattccatcactgaaag

SEQ ID NO: 194508 - DNA, 25 bp, Mus musculus
aggcccttaattgcatcactgaaag

SEQ ID NO: 194509 - DNA, 25 bp, Mus musculus
aggcccttacgaaatggtgttccag

SEQ ID NO: 194510 - DNA, 25 bp, Mus musculus
aggcccttacgatatggtgttccag

SEQ ID NO: 194511 - DNA, 25 bp, Mus musculus
aggcccttaggacagcctctgggca

SEQ ID NO: 194512 - DNA, 25 bp, Mus musculus
aggcccttaggagagcctctgggca

SEQ ID NO: 194513 - DNA, 25 bp, Mus musculus
aggcccttaggtagctgaacttcca

SEQ ID NO: 194514 - DNA, 25 bp, Mus musculus
aggcccttaggttgctgaacttcca

SEQ ID NO: 194515 - DNA, 25 bp, Mus musculus
aggcccttcctaagtcacgagtgat

SEQ ID NO: 194516 - DNA, 25 bp, Mus musculus
aggcccttcctatgtcacgagtgat

SEQ ID NO: 194517 - DNA, 25 bp, Mus musculus
aggcccttcctgatgtgatgaatga

SEQ ID NO: 194518 - DNA, 25 bp, Mus musculus
aggcccttcctgttgtgatgaatga

SEQ ID NO: 194519 - DNA, 25 bp, Mus musculus
aggcccttctcgatcaaatgttgtc

SEQ ID NO: 194520 - DNA, 25 bp, Mus musculus
aggcccttctcgttcaaatgttgtc

SEQ ID NO: 194521 - DNA, 25 bp, Mus musculus
aggcccttgactcctactgattctt

SEQ ID NO: 194522 - DNA, 25 bp, Mus musculus
aggcccttgactgctactgattctt

SEQ ID NO: 194523 - DNA, 25 bp, Mus musculus
aggcccttgctcaagtgttctattc

SEQ ID NO: 194524 - DNA, 25 bp, Mus musculus
aggcccttgctctagtgttctattc

SEQ ID NO: 194525 - DNA, 25 bp, Mus musculus
aggcccttggatccctgttttggtg

SEQ ID NO: 194526 - DNA, 25 bp, Mus musculus
aggcccttggatgcctgttttggtg

SEQ ID NO: 194527 - DNA, 25 bp, Mus musculus
aggcccttggctacgagtgggatct

SEQ ID NO: 194528 - DNA, 25 bp, Mus musculus
aggcccttggctagtaaactgtgtc

SEQ ID NO: 194529 - DNA, 25 bp, Mus musculus
aggcccttggcttcgagtgggatct

SEQ ID NO: 194530 - DNA, 25 bp, Mus musculus
aggcccttggcttgtaaactgtgtc

SEQ ID NO: 194531 - DNA, 25 bp, Mus musculus
aggcccttgttgagatgtgctctaa

SEQ ID NO: 194532 - DNA, 25 bp, Mus musculus
aggcccttgttgtgatgtgctctaa

SEQ ID NO: 194533 - DNA, 25 bp, Mus musculus
aggccctttagtagcctatacaaag

SEQ ID NO: 194534 - DNA, 25 bp, Mus musculus
aggccctttagtatgctgtagctca

SEQ ID NO: 194535 - DNA, 25 bp, Mus musculus
aggccctttagttgcctatacaaag

SEQ ID NO: 194536 - DNA, 25 bp, Mus musculus
aggccctttagtttgctgtagctca

SEQ ID NO: 194537 - DNA, 25 bp, Mus musculus
aggccctttcaactgaatcctttga

SEQ ID NO: 194538 - DNA, 25 bp, Mus musculus
aggccctttcaagtgaatcctttga

SEQ ID NO: 194539 - DNA, 25 bp, Mus musculus
aggccctttgctcgttactctaaca

SEQ ID NO: 194540 - DNA, 25 bp, Mus musculus
aggccctttgctggttactctaaca

SEQ ID NO: 194541 - DNA, 25 bp, Mus musculus
aggccgaagtgccaatttcctggat

SEQ ID NO: 194542 - DNA, 25 bp, Mus musculus
aggccgaagtgcgaatttcctggat

SEQ ID NO: 194543 - DNA, 25 bp, Mus musculus
aggccgacaccgagctgactaggat

SEQ ID NO: 194544 - DNA, 25 bp, Mus musculus
aggccgacaccgtgctgactaggat

SEQ ID NO: 194545 - DNA, 25 bp, Mus musculus
aggccgacatgcctgtggccgacat

SEQ ID NO: 194546 - DNA, 25 bp, Mus musculus
aggccgacatgcgtgtggccgacat

SEQ ID NO: 194547 - DNA, 25 bp, Mus musculus
aggccgacattgatggagatggcca

SEQ ID NO: 194548 - DNA, 25 bp, Mus musculus
aggccgacattgttggagatggcca

SEQ ID NO: 194549 - DNA, 25 bp, Mus musculus
aggccgaccctaaaccagatgcgta

SEQ ID NO: 194550 - DNA, 25 bp, Mus musculus
aggccgaccctataccagatgcgta

SEQ ID NO: 194551 - DNA, 25 bp, Mus musculus
aggccgaccctgatgatctacattc

SEQ ID NO: 194552 - DNA, 25 bp, Mus musculus
aggccgaccctgttgatctacattc

SEQ ID NO: 194553 - DNA, 25 bp, Mus musculus
aggccgactctaactttaaaccctg

SEQ ID NO: 194554 - DNA, 25 bp, Mus musculus
aggccgactctatctttaaaccctg

SEQ ID NO: 194555 - DNA, 25 bp, Mus musculus
aggccgactgacatcttggatccga

SEQ ID NO: 194556 - DNA, 25 bp, Mus musculus
aggccgactgacttcttggatccga

SEQ ID NO: 194557 - DNA, 25 bp, Mus musculus
aggccgacttggagtgttctgcttc

SEQ ID NO: 194558 - DNA, 25 bp, Mus musculus
aggccgacttggtgtgttctgcttc

SEQ ID NO: 194559 - DNA, 25 bp, Mus musculus
aggccgagaaccactactggctcag

SEQ ID NO: 194560 - DNA, 25 bp, Mus musculus
aggccgagaacctctactggctcag

SEQ ID NO: 194561 - DNA, 25 bp, Mus musculus
aggccgagagacctgtctcatcgga

SEQ ID NO: 194562 - DNA, 25 bp, Mus musculus
aggccgagagacgtgtctcatcgga

SEQ ID NO: 194563 - DNA, 25 bp, Mus musculus
aggccgagctcaagatcacggtgca

SEQ ID NO: 194564 - DNA, 25 bp, Mus musculus
aggccgagctcatgatcacggtgca

SEQ ID NO: 194565 - DNA, 25 bp, Mus musculus
aggccgaggcaaagcaggcccgact

SEQ ID NO: 194566 - DNA, 25 bp, Mus musculus
aggccgaggcaatgcaggcccgact

SEQ ID NO: 194567 - DNA, 25 bp, Mus musculus
aggccgagggacatcattctgagga

SEQ ID NO: 194568 - DNA, 25 bp, Mus musculus
aggccgagggacttcattctgagga

SEQ ID NO: 194569 - DNA, 25 bp, Mus musculus
aggccgagggctagtttgactttca

SEQ ID NO: 194570 - DNA, 25 bp, Mus musculus
aggccgagggcttgtttgactttca

SEQ ID NO: 194571 - DNA, 25 bp, Mus musculus
aggccgatacctctgcatgctgagt

SEQ ID NO: 194572 - DNA, 25 bp, Mus musculus
aggccgatacctgtgcatgctgagt

SEQ ID NO: 194573 - DNA, 25 bp, Mus musculus
aggccgatattgagcatcttcctca

SEQ ID NO: 194574 - DNA, 25 bp, Mus musculus
aggccgatattgtgcatcttcctca

SEQ ID NO: 194575 - DNA, 25 bp, Mus musculus
aggccgatcgccatgattaagcagg

SEQ ID NO: 194576 - DNA, 25 bp, Mus musculus
aggccgatcgccttgattaagcagg

SEQ ID NO: 194577 - DNA, 25 bp, Mus musculus
aggccgatggccaaagtccttaaat

SEQ ID NO: 194578 - DNA, 25 bp, Mus musculus
aggccgatggcctaagtccttaaat

SEQ ID NO: 194579 - DNA, 25 bp, Mus musculus
aggccgattcccatttgagctttgg

SEQ ID NO: 194580 - DNA, 25 bp, Mus musculus
aggccgattcccttttgagctttgg

SEQ ID NO: 194581 - DNA, 25 bp, Mus musculus
aggccgatttctaacctattggaga

SEQ ID NO: 194582 - DNA, 25 bp, Mus musculus
aggccgatttcttacctattggaga

SEQ ID NO: 194583 - DNA, 25 bp, Mus musculus
aggccgcaagaacatgttcgacgct

SEQ ID NO: 194584 - DNA, 25 bp, Mus musculus
aggccgcaagaagatgttcgacgct

SEQ ID NO: 194585 - DNA, 25 bp, Mus musculus
aggccgcacagtacagtcactgaca

SEQ ID NO: 194586 - DNA, 25 bp, Mus musculus
aggccgcacagttcagtcactgaca

SEQ ID NO: 194587 - DNA, 25 bp, Mus musculus
aggccgcaccggatcaaggaagact

SEQ ID NO: 194588 - DNA, 25 bp, Mus musculus
aggccgcaccggttcaaggaagact

SEQ ID NO: 194589 - DNA, 25 bp, Mus musculus
aggccgcagcagatccagctccaag

SEQ ID NO: 194590 - DNA, 25 bp, Mus musculus
aggccgcagcagttccagctccaag

SEQ ID NO: 194591 - DNA, 25 bp, Mus musculus
aggccgcagggactatctggccttc

SEQ ID NO: 194592 - DNA, 25 bp, Mus musculus
aggccgcagggagtatctggccttc

SEQ ID NO: 194593 - DNA, 25 bp, Mus musculus
aggccgcaggtcacttctaaataaa

SEQ ID NO: 194594 - DNA, 25 bp, Mus musculus
aggccgcaggtctcttctaaataaa

SEQ ID NO: 194595 - DNA, 25 bp, Mus musculus
aggccgcatgcgctcggaactcaag

SEQ ID NO: 194596 - DNA, 25 bp, Mus musculus
aggccgcatgcggtcggaactcaag

SEQ ID NO: 194597 - DNA, 25 bp, Mus musculus
aggccgcatggaccagtcagaaaga

SEQ ID NO: 194598 - DNA, 25 bp, Mus musculus
aggccgcatggagcagtcagaaaga

SEQ ID NO: 194599 - DNA, 25 bp, Mus musculus
aggccgccaacaatcgcgagaggaa

SEQ ID NO: 194600 - DNA, 25 bp, Mus musculus
aggccgccaacattcgcgagaggaa

SEQ ID NO: 194601 - DNA, 25 bp, Mus musculus
aggccgccaagaccttcatcttgga

SEQ ID NO: 194602 - DNA, 25 bp, Mus musculus
aggccgccaagagcttcatcttgga

SEQ ID NO: 194603 - DNA, 25 bp, Mus musculus
aggccgccaccaatgttcatagcat

SEQ ID NO: 194604 - DNA, 25 bp, Mus musculus
aggccgccaccattgttcatagcat

SEQ ID NO: 194605 - DNA, 25 bp, Mus musculus
aggccgccagctaagtcgggttgac

SEQ ID NO: 194606 - DNA, 25 bp, Mus musculus
aggccgccagcttagtcgggttgac

SEQ ID NO: 194607 - DNA, 25 bp, Mus musculus
aggccgcccggcacatcgagatgta

SEQ ID NO: 194608 - DNA, 25 bp, Mus musculus
aggccgcccggctcatcgagatgta

SEQ ID NO: 194609 - DNA, 25 bp, Mus musculus
aggccgccctggaaaaatggtggat

SEQ ID NO: 194610 - DNA, 25 bp, Mus musculus
aggccgccctggaccaggactgctg

SEQ ID NO: 194611 - DNA, 25 bp, Mus musculus
aggccgccctggtaaaatggtggat

SEQ ID NO: 194612 - DNA, 25 bp, Mus musculus
aggccgccctggtccaggactgctg

SEQ ID NO: 194613 - DNA, 25 bp, Mus musculus
aggccgccggatagattatgttctt

SEQ ID NO: 194614 - DNA, 25 bp, Mus musculus
aggccgccggattgattatgttctt

SEQ ID NO: 194615 - DNA, 25 bp, Mus musculus
aggccgcctctcatagtgattaact

SEQ ID NO: 194616 - DNA, 25 bp, Mus musculus
aggccgcctctcttagtgattaact

SEQ ID NO: 194617 - DNA, 25 bp, Mus musculus
aggccgcgagaacgacaaggaccat

SEQ ID NO: 194618 - DNA, 25 bp, Mus musculus
aggccgcgagaaggacaaggaccat

SEQ ID NO: 194619 - DNA, 25 bp, Mus musculus
aggccgcgaggcatattccaaggag

SEQ ID NO: 194620 - DNA, 25 bp, Mus musculus
aggccgcgaggcttattccaaggag

SEQ ID NO: 194621 - DNA, 25 bp, Mus musculus
aggccgctgtgtactaggctggcta

SEQ ID NO: 194622 - DNA, 25 bp, Mus musculus
aggccgctgtgttctaggctggcta

SEQ ID NO: 194623 - DNA, 25 bp, Mus musculus
aggccgcttctgagaatccaggcaa

SEQ ID NO: 194624 - DNA, 25 bp, Mus musculus
aggccgcttctgtgaatccaggcaa

SEQ ID NO: 194625 - DNA, 25 bp, Mus musculus
aggccgctttttagtctccaaatga

SEQ ID NO: 194626 - DNA, 25 bp, Mus musculus
aggccgcttttttgtctccaaatga

SEQ ID NO: 194627 - DNA, 25 bp, Mus musculus
aggccggaagagacctctccagagg

SEQ ID NO: 194628 - DNA, 25 bp, Mus musculus
aggccggaagagtcctctccagagg

SEQ ID NO: 194629 - DNA, 25 bp, Mus musculus
aggccggacttacactcactgtggg

SEQ ID NO: 194630 - DNA, 25 bp, Mus musculus
aggccggacttagactcactgtggg

SEQ ID NO: 194631 - DNA, 25 bp, Mus musculus
aggccggagcacagcgccttgctga

SEQ ID NO: 194632 - DNA, 25 bp, Mus musculus
aggccggagcactgcgccttgctga

SEQ ID NO: 194633 - DNA, 25 bp, Mus musculus
aggccggagtcacagctctctcaga

SEQ ID NO: 194634 - DNA, 25 bp, Mus musculus
aggccggagtcagagctctctcaga

SEQ ID NO: 194635 - DNA, 25 bp, Mus musculus
aggccggcacaaagggacgtcgtca

SEQ ID NO: 194636 - DNA, 25 bp, Mus musculus
aggccggcacaatgggacgtcgtca

SEQ ID NO: 194637 - DNA, 25 bp, Mus musculus
aggccggcacctaattctggagaaa

SEQ ID NO: 194638 - DNA, 25 bp, Mus musculus
aggccggcaccttattctggagaaa

SEQ ID NO: 194639 - DNA, 25 bp, Mus musculus
aggccggccgctaccacttggacgg

SEQ ID NO: 194640 - DNA, 25 bp, Mus musculus
aggccggccgcttccacttggacgg

SEQ ID NO: 194641 - DNA, 25 bp, Mus musculus
aggccggccttacatttcacattct

SEQ ID NO: 194642 - DNA, 25 bp, Mus musculus
aggccggccttagatttcacattct

SEQ ID NO: 194643 - DNA, 25 bp, Mus musculus
aggccggcggcgatcttgagcacct

SEQ ID NO: 194644 - DNA, 25 bp, Mus musculus
aggccggcggcgttcttgagcacct

SEQ ID NO: 194645 - DNA, 25 bp, Mus musculus
aggccgggagctcggcggtgacagc

SEQ ID NO: 194646 - DNA, 25 bp, Mus musculus
aggccgggagctgggcggtgacagc

SEQ ID NO: 194647 - DNA, 25 bp, Mus musculus
aggccgggctgaatggctgactcat

SEQ ID NO: 194648 - DNA, 25 bp, Mus musculus
aggccgggctgattggctgactcat

SEQ ID NO: 194649 - DNA, 25 bp, Mus musculus
aggccggggtctagcaaacacataa

SEQ ID NO: 194650 - DNA, 25 bp, Mus musculus
aggccggggtcttgcaaacacataa

SEQ ID NO: 194651 - DNA, 25 bp, Mus musculus
aggccgggtcctcacatgagtttat

SEQ ID NO: 194652 - DNA, 25 bp, Mus musculus
aggccgggtcctgacatgagtttat

SEQ ID NO: 194653 - DNA, 25 bp, Mus musculus
aggccgggttcaccagtctctagta

SEQ ID NO: 194654 - DNA, 25 bp, Mus musculus
aggccgggttcagcagtctctagta

SEQ ID NO: 194655 - DNA, 25 bp, Mus musculus
aggccggtcccaaattcatggagat

SEQ ID NO: 194656 - DNA, 25 bp, Mus musculus
aggccggtcccatattcatggagat

SEQ ID NO: 194657 - DNA, 25 bp, Mus musculus
aggccggtgtgcatgaatcaggtca

SEQ ID NO: 194658 - DNA, 25 bp, Mus musculus
aggccggtgtgcttgaatcaggtca

SEQ ID NO: 194659 - DNA, 25 bp, Mus musculus
aggccgtagctgatactcctgaaca

SEQ ID NO: 194660 - DNA, 25 bp, Mus musculus
aggccgtagctgttactcctgaaca

SEQ ID NO: 194661 - DNA, 25 bp, Mus musculus
aggccgtcaaagctctgcgcaaaca

SEQ ID NO: 194662 - DNA, 25 bp, Mus musculus
aggccgtcaaaggtctgcgcaaaca

SEQ ID NO: 194663 - DNA, 25 bp, Mus musculus
aggccgtccactacagtctctttgt

SEQ ID NO: 194664 - DNA, 25 bp, Mus musculus
aggccgtccacttcagtctctttgt

SEQ ID NO: 194665 - DNA, 25 bp, Mus musculus
aggccgtccattcgtctgtcagcaa

SEQ ID NO: 194666 - DNA, 25 bp, Mus musculus
aggccgtccattggtctgtcagcaa

SEQ ID NO: 194667 - DNA, 25 bp, Mus musculus
aggccgtctcagaattgcctatggg

SEQ ID NO: 194668 - DNA, 25 bp, Mus musculus
aggccgtctcagtattgcctatggg

SEQ ID NO: 194669 - DNA, 25 bp, Mus musculus
aggccgtctccacaagcgagttgaa

SEQ ID NO: 194670 - DNA, 25 bp, Mus musculus
aggccgtctccagaagcgagttgaa

SEQ ID NO: 194671 - DNA, 25 bp, Mus musculus
aggccgtctgctcccaggaaaatgt

SEQ ID NO: 194672 - DNA, 25 bp, Mus musculus
aggccgtctgctgccaggaaaatgt

SEQ ID NO: 194673 - DNA, 25 bp, Mus musculus
aggccgtctggtaatgagtttgtca

SEQ ID NO: 194674 - DNA, 25 bp, Mus musculus
aggccgtctggttatgagtttgtca

SEQ ID NO: 194675 - DNA, 25 bp, Mus musculus
aggccgtgagctccatccctggctg

SEQ ID NO: 194676 - DNA, 25 bp, Mus musculus
aggccgtgagctgcatccctggctg

SEQ ID NO: 194677 - DNA, 25 bp, Mus musculus
aggccgtgagtgagcaccaaagctc

SEQ ID NO: 194678 - DNA, 25 bp, Mus musculus
aggccgtgagtgtgcaccaaagctc

SEQ ID NO: 194679 - DNA, 25 bp, Mus musculus
aggccgtgcactatcctttgaacat

SEQ ID NO: 194680 - DNA, 25 bp, Mus musculus
aggccgtgcactttcctttgaacat

SEQ ID NO: 194681 - DNA, 25 bp, Mus musculus
aggccgtgctccagatggatgctga

SEQ ID NO: 194682 - DNA, 25 bp, Mus musculus
aggccgtgctcctgatggatgctga

SEQ ID NO: 194683 - DNA, 25 bp, Mus musculus
aggccgtggaacacttgtcatctag

SEQ ID NO: 194684 - DNA, 25 bp, Mus musculus
aggccgtggaactcttgtcatctag

SEQ ID NO: 194685 - DNA, 25 bp, Mus musculus
aggccgtggctcatcgtggagatta

SEQ ID NO: 194686 - DNA, 25 bp, Mus musculus
aggccgtggctcttcgtggagatta

SEQ ID NO: 194687 - DNA, 25 bp, Mus musculus
aggccgtggttcacagagttgcagt

SEQ ID NO: 194688 - DNA, 25 bp, Mus musculus
aggccgtggttctcagagttgcagt

SEQ ID NO: 194689 - DNA, 25 bp, Mus musculus
aggccgtgtacaacgacagctacag

SEQ ID NO: 194690 - DNA, 25 bp, Mus musculus
aggccgtgtacatcgacagctacag

SEQ ID NO: 194691 - DNA, 25 bp, Mus musculus
aggccgttcaaacacagcgtaaaat

SEQ ID NO: 194692 - DNA, 25 bp, Mus musculus
aggccgttcaaagacagcgtaaaat

SEQ ID NO: 194693 - DNA, 25 bp, Mus musculus
aggccgttcggcacagctgtatgtc

SEQ ID NO: 194694 - DNA, 25 bp, Mus musculus
aggccgttcggctcagctgtatgtc

SEQ ID NO: 194695 - DNA, 25 bp, Mus musculus
aggccgttctgtcttatctttatta

SEQ ID NO: 194696 - DNA, 25 bp, Mus musculus
aggccgttctgtgttatctttatta

SEQ ID NO: 194697 - DNA, 25 bp, Mus musculus
aggccgttgaccatagctagacaga

SEQ ID NO: 194698 - DNA, 25 bp, Mus musculus
aggccgttgaccttagctagacaga

SEQ ID NO: 194699 - DNA, 25 bp, Mus musculus
aggcctaacgtgctcctgagtgact

SEQ ID NO: 194700 - DNA, 25 bp, Mus musculus
aggcctaacgtggtcctgagtgact

SEQ ID NO: 194701 - DNA, 25 bp, Mus musculus
aggcctaaggagaagttccaaagca

SEQ ID NO: 194702 - DNA, 25 bp, Mus musculus
aggcctaaggagtagttccaaagca

SEQ ID NO: 194703 - DNA, 25 bp, Mus musculus
aggcctaaggctcttcctggacatt

SEQ ID NO: 194704 - DNA, 25 bp, Mus musculus
aggcctaaggctgttcctggacatt

SEQ ID NO: 194705 - DNA, 25 bp, Mus musculus
aggcctaatcttactattgctcttt

SEQ ID NO: 194706 - DNA, 25 bp, Mus musculus
aggcctaatctttctattgctcttt

SEQ ID NO: 194707 - DNA, 25 bp, Mus musculus
aggcctaatgcaacattgaattcat

SEQ ID NO: 194708 - DNA, 25 bp, Mus musculus
aggcctaatgcatcattgaattcat

SEQ ID NO: 194709 - DNA, 25 bp, Mus musculus
aggcctaatggcaggctctgcgagc

SEQ ID NO: 194710 - DNA, 25 bp, Mus musculus
aggcctaatggctggctctgcgagc

SEQ ID NO: 194711 - DNA, 25 bp, Mus musculus
aggcctacaaagcaaaaatttctct

SEQ ID NO: 194712 - DNA, 25 bp, Mus musculus
aggcctacaaaggaaaaatttctct

SEQ ID NO: 194713 - DNA, 25 bp, Mus musculus
aggcctacaaggaggattatcacaa

SEQ ID NO: 194714 - DNA, 25 bp, Mus musculus
aggcctacaaggtggattatcacaa

SEQ ID NO: 194715 - DNA, 25 bp, Mus musculus
aggcctacacctactcattgatttt

SEQ ID NO: 194716 - DNA, 25 bp, Mus musculus
aggcctacaccttctcattgatttt

SEQ ID NO: 194717 - DNA, 25 bp, Mus musculus
aggcctacacgacagcactggagat

SEQ ID NO: 194718 - DNA, 25 bp, Mus musculus
aggcctacacgagagcactggagat

SEQ ID NO: 194719 - DNA, 25 bp, Mus musculus
aggcctacagccacaatttgatgta

SEQ ID NO: 194720 - DNA, 25 bp, Mus musculus
aggcctacagccatcaaataagaga

SEQ ID NO: 194721 - DNA, 25 bp, Mus musculus
aggcctacagcctcaatttgatgta

SEQ ID NO: 194722 - DNA, 25 bp, Mus musculus
aggcctacagccttcaaataagaga

SEQ ID NO: 194723 - DNA, 25 bp, Mus musculus
aggcctacaggaactacgcaagcaa

SEQ ID NO: 194724 - DNA, 25 bp, Mus musculus
aggcctacaggatctacgcaagcaa

SEQ ID NO: 194725 - DNA, 25 bp, Mus musculus
aggcctacaggtaccatgcatgtgt

SEQ ID NO: 194726 - DNA, 25 bp, Mus musculus
aggcctacaggttccatgcatgtgt

SEQ ID NO: 194727 - DNA, 25 bp, Mus musculus
aggcctacagtcctagatcttcctg

SEQ ID NO: 194728 - DNA, 25 bp, Mus musculus
aggcctacagtcgtagatcttcctg

SEQ ID NO: 194729 - DNA, 25 bp, Mus musculus
aggcctacagtgatgcagatctgca

SEQ ID NO: 194730 - DNA, 25 bp, Mus musculus
aggcctacagtgttgcagatctgca

SEQ ID NO: 194731 - DNA, 25 bp, Mus musculus
aggcctacatcgagcagtgccagga

SEQ ID NO: 194732 - DNA, 25 bp, Mus musculus
aggcctacatcgtgcagtgccagga

SEQ ID NO: 194733 - DNA, 25 bp, Mus musculus
aggcctaccactatcagaagttgaa

SEQ ID NO: 194734 - DNA, 25 bp, Mus musculus
aggcctaccactttcagaagttgaa

SEQ ID NO: 194735 - DNA, 25 bp, Mus musculus
aggcctaccgatactgtgctgagag

SEQ ID NO: 194736 - DNA, 25 bp, Mus musculus
aggcctaccgattctgtgctgagag

SEQ ID NO: 194737 - DNA, 25 bp, Mus musculus
aggcctacttttaagcagctggtgg

SEQ ID NO: 194738 - DNA, 25 bp, Mus musculus
aggcctactttttagcagctggtgg

SEQ ID NO: 194739 - DNA, 25 bp, Mus musculus
aggcctagactcagctactccttag

SEQ ID NO: 194740 - DNA, 25 bp, Mus musculus
aggcctagactctgctactccttag

SEQ ID NO: 194741 - DNA, 25 bp, Mus musculus
aggcctagagtcagctggttgtcct

SEQ ID NO: 194742 - DNA, 25 bp, Mus musculus
aggcctagagtctgctggttgtcct

SEQ ID NO: 194743 - DNA, 25 bp, Mus musculus
aggcctagcctacgagacatgaaac

SEQ ID NO: 194744 - DNA, 25 bp, Mus musculus
aggcctagcctaggagacatgaaac

SEQ ID NO: 194745 - DNA, 25 bp, Mus musculus
aggcctagctagcagcagcacagcc

SEQ ID NO: 194746 - DNA, 25 bp, Mus musculus
aggcctagctaggagcagcacagcc

SEQ ID NO: 194747 - DNA, 25 bp, Mus musculus
aggcctaggcggagatgctcacttt

SEQ ID NO: 194748 - DNA, 25 bp, Mus musculus
aggcctaggcggtgatgctcacttt

SEQ ID NO: 194749 - DNA, 25 bp, Mus musculus
aggcctataataccagctactcaag

SEQ ID NO: 194750 - DNA, 25 bp, Mus musculus
aggcctataatagcagctactcaag

SEQ ID NO: 194751 - DNA, 25 bp, Mus musculus
aggcctatctagcatatggtgcatt

SEQ ID NO: 194752 - DNA, 25 bp, Mus musculus
aggcctatctaggatatggtgcatt

SEQ ID NO: 194753 - DNA, 25 bp, Mus musculus
aggcctatctctaaggtaccctagg

SEQ ID NO: 194754 - DNA, 25 bp, Mus musculus
aggcctatctcttaggtaccctagg

SEQ ID NO: 194755 - DNA, 25 bp, Mus musculus
aggcctatgccaacagaattcccaa

SEQ ID NO: 194756 - DNA, 25 bp, Mus musculus
aggcctatgccatcagaattcccaa

SEQ ID NO: 194757 - DNA, 25 bp, Mus musculus
aggcctatgcctcaagctgtaacag

SEQ ID NO: 194758 - DNA, 25 bp, Mus musculus
aggcctatgcctgaagctgtaacag

SEQ ID NO: 194759 - DNA, 25 bp, Mus musculus
aggcctatgggcattctcacagaga

SEQ ID NO: 194760 - DNA, 25 bp, Mus musculus
aggcctatgggctttctcacagaga

SEQ ID NO: 194761 - DNA, 25 bp, Mus musculus
aggcctatgtagaatcccggacttc

SEQ ID NO: 194762 - DNA, 25 bp, Mus musculus
aggcctatgtagtatcccggacttc

SEQ ID NO: 194763 - DNA, 25 bp, Mus musculus
aggcctcaaatcctgtcacttggcg

SEQ ID NO: 194764 - DNA, 25 bp, Mus musculus
aggcctcaaatcgtgtcacttggcg

SEQ ID NO: 194765 - DNA, 25 bp, Mus musculus
aggcctcaagaaaccccttatgtgt

SEQ ID NO: 194766 - DNA, 25 bp, Mus musculus
aggcctcaagaatccccttatgtgt

SEQ ID NO: 194767 - DNA, 25 bp, Mus musculus
aggcctcaagacagcaaactcggga

SEQ ID NO: 194768 - DNA, 25 bp, Mus musculus
aggcctcaagactgcaaactcggga

SEQ ID NO: 194769 - DNA, 25 bp, Mus musculus
aggcctcacacaagtactctttggg

SEQ ID NO: 194770 - DNA, 25 bp, Mus musculus
aggcctcacacatgtactctttggg

SEQ ID NO: 194771 - DNA, 25 bp, Mus musculus
aggcctcacactaccgattaacagt

SEQ ID NO: 194772 - DNA, 25 bp, Mus musculus
aggcctcacacttccgattaacagt

SEQ ID NO: 194773 - DNA, 25 bp, Mus musculus
aggcctcacagcaaagcaggttgaa

SEQ ID NO: 194774 - DNA, 25 bp, Mus musculus
aggcctcacagcatgggagaagcga

SEQ ID NO: 194775 - DNA, 25 bp, Mus musculus
aggcctcacagctaagcaggttgaa

SEQ ID NO: 194776 - DNA, 25 bp, Mus musculus
aggcctcacagcttgggagaagcga

SEQ ID NO: 194777 - DNA, 25 bp, Mus musculus
aggcctcaccgtagcctggcttgta

SEQ ID NO: 194778 - DNA, 25 bp, Mus musculus
aggcctcaccgttgcctggcttgta

SEQ ID NO: 194779 - DNA, 25 bp, Mus musculus
aggcctcacgttctgtacagtttta

SEQ ID NO: 194780 - DNA, 25 bp, Mus musculus
aggcctcacgttgtgtacagtttta

SEQ ID NO: 194781 - DNA, 25 bp, Mus musculus
aggcctcactccatagaactacagt

SEQ ID NO: 194782 - DNA, 25 bp, Mus musculus
aggcctcactccttagaactacagt

SEQ ID NO: 194783 - DNA, 25 bp, Mus musculus
aggcctcactttacctttatgtgtg

SEQ ID NO: 194784 - DNA, 25 bp, Mus musculus
aggcctcacttttcctttatgtgtg

SEQ ID NO: 194785 - DNA, 25 bp, Mus musculus
aggcctcagaggatccagacaacgt

SEQ ID NO: 194786 - DNA, 25 bp, Mus musculus
aggcctcagaggttccagacaacgt

SEQ ID NO: 194787 - DNA, 25 bp, Mus musculus
aggcctcagattaacacctttctat

SEQ ID NO: 194788 - DNA, 25 bp, Mus musculus
aggcctcagatttacacctttctat

SEQ ID NO: 194789 - DNA, 25 bp, Mus musculus
aggcctcagcacatccaagaagatt

SEQ ID NO: 194790 - DNA, 25 bp, Mus musculus
aggcctcagcacttccaagaagatt

SEQ ID NO: 194791 - DNA, 25 bp, Mus musculus
aggcctcagcccaagagtcacaatt

SEQ ID NO: 194792 - DNA, 25 bp, Mus musculus
aggcctcagccctagagtcacaatt

SEQ ID NO: 194793 - DNA, 25 bp, Mus musculus
aggcctcagccgatcctaatggata

SEQ ID NO: 194794 - DNA, 25 bp, Mus musculus
aggcctcagccgttcctaatggata

SEQ ID NO: 194795 - DNA, 25 bp, Mus musculus
aggcctcagctgaatgggcacgagt

SEQ ID NO: 194796 - DNA, 25 bp, Mus musculus
aggcctcagctgtatgggcacgagt

SEQ ID NO: 194797 - DNA, 25 bp, Mus musculus
aggcctcagtggacttggaaattaa

SEQ ID NO: 194798 - DNA, 25 bp, Mus musculus
aggcctcagtggtcttggaaattaa

SEQ ID NO: 194799 - DNA, 25 bp, Mus musculus
aggcctcagtgtctctaggattcac

SEQ ID NO: 194800 - DNA, 25 bp, Mus musculus
aggcctcagtgtgtctaggattcac

SEQ ID NO: 194801 - DNA, 25 bp, Mus musculus
aggcctcatattagggtcacatcgt

SEQ ID NO: 194802 - DNA, 25 bp, Mus musculus
aggcctcatatttgggtcacatcgt

SEQ ID NO: 194803 - DNA, 25 bp, Mus musculus
aggcctcatgcacacgttcaatgct

SEQ ID NO: 194804 - DNA, 25 bp, Mus musculus
aggcctcatgcagacgttcaatgct

SEQ ID NO: 194805 - DNA, 25 bp, Mus musculus
aggcctcattccaaagatactccga

SEQ ID NO: 194806 - DNA, 25 bp, Mus musculus
aggcctcattcctaagatactccga

SEQ ID NO: 194807 - DNA, 25 bp, Mus musculus
aggcctcattctcggagaactaggg

SEQ ID NO: 194808 - DNA, 25 bp, Mus musculus
aggcctcattctgggagaactaggg

SEQ ID NO: 194809 - DNA, 25 bp, Mus musculus
aggcctcattgcagtcgctgtgttc

SEQ ID NO: 194810 - DNA, 25 bp, Mus musculus
aggcctcattgctgtcgctgtgttc

SEQ ID NO: 194811 - DNA, 25 bp, Mus musculus
aggcctccaagcatggctggtagct

SEQ ID NO: 194812 - DNA, 25 bp, Mus musculus
aggcctccaagcttggctggtagct

SEQ ID NO: 194813 - DNA, 25 bp, Mus musculus
aggcctccacagacagcggtctgag

SEQ ID NO: 194814 - DNA, 25 bp, Mus musculus
aggcctccacagtcagcggtctgag

SEQ ID NO: 194815 - DNA, 25 bp, Mus musculus
aggcctccagtgactgtttctattg

SEQ ID NO: 194816 - DNA, 25 bp, Mus musculus
aggcctccagtgtctgtttctattg

SEQ ID NO: 194817 - DNA, 25 bp, Mus musculus
aggcctccatgccagtacaatgcct

SEQ ID NO: 194818 - DNA, 25 bp, Mus musculus
aggcctccatgcgagtacaatgcct

SEQ ID NO: 194819 - DNA, 25 bp, Mus musculus
aggcctccatgtcggaagtgtgatt

SEQ ID NO: 194820 - DNA, 25 bp, Mus musculus
aggcctccatgtgggaagtgtgatt

SEQ ID NO: 194821 - DNA, 25 bp, Mus musculus
aggcctccgaagagctactgcggga

SEQ ID NO: 194822 - DNA, 25 bp, Mus musculus
aggcctccgaagtgctactgcggga

SEQ ID NO: 194823 - DNA, 25 bp, Mus musculus
aggcctccgattacttacaaggaca

SEQ ID NO: 194824 - DNA, 25 bp, Mus musculus
aggcctccgatttcttacaaggaca

SEQ ID NO: 194825 - DNA, 25 bp, Mus musculus
aggcctccggagaccacagatgaag

SEQ ID NO: 194826 - DNA, 25 bp, Mus musculus
aggcctccggagtccacagatgaag

SEQ ID NO: 194827 - DNA, 25 bp, Mus musculus
aggcctcctcaactccagagcagag

SEQ ID NO: 194828 - DNA, 25 bp, Mus musculus
aggcctcctcaagtccagagcagag

SEQ ID NO: 194829 - DNA, 25 bp, Mus musculus
aggcctcctcatctgagacacggag

SEQ ID NO: 194830 - DNA, 25 bp, Mus musculus
aggcctcctcatgtgagacacggag

SEQ ID NO: 194831 - DNA, 25 bp, Mus musculus
aggcctcctctacagtccactgagt

SEQ ID NO: 194832 - DNA, 25 bp, Mus musculus
aggcctcctctagagtccactgagt

SEQ ID NO: 194833 - DNA, 25 bp, Mus musculus
aggcctcctgatccttcgtagctga

SEQ ID NO: 194834 - DNA, 25 bp, Mus musculus
aggcctcctgatgcttcgtagctga

SEQ ID NO: 194835 - DNA, 25 bp, Mus musculus
aggcctcctgctctatgacatgcac

SEQ ID NO: 194836 - DNA, 25 bp, Mus musculus
aggcctcctgctgtatgacatgcac

SEQ ID NO: 194837 - DNA, 25 bp, Mus musculus
aggcctcctggaaacttccacatgt

SEQ ID NO: 194838 - DNA, 25 bp, Mus musculus
aggcctcctggatacttccacatgt

SEQ ID NO: 194839 - DNA, 25 bp, Mus musculus
aggcctcctggtcttggttgtgatt

SEQ ID NO: 194840 - DNA, 25 bp, Mus musculus
aggcctcctggtgttggttgtgatt

SEQ ID NO: 194841 - DNA, 25 bp, Mus musculus
aggcctccttggactcagctctggg

SEQ ID NO: 194842 - DNA, 25 bp, Mus musculus
aggcctccttggatggcagcagttt

SEQ ID NO: 194843 - DNA, 25 bp, Mus musculus
aggcctccttggtctcagctctggg

SEQ ID NO: 194844 - DNA, 25 bp, Mus musculus
aggcctccttggttggcagcagttt

SEQ ID NO: 194845 - DNA, 25 bp, Mus musculus
aggcctcgacctacgagacatcagt

SEQ ID NO: 194846 - DNA, 25 bp, Mus musculus
aggcctcgaccttcgagacatcagt

SEQ ID NO: 194847 - DNA, 25 bp, Mus musculus
aggcctcgcatactttgacttcatt

SEQ ID NO: 194848 - DNA, 25 bp, Mus musculus
aggcctcgcatagtttgacttcatt

SEQ ID NO: 194849 - DNA, 25 bp, Mus musculus
aggcctcgcccacaaggaacagtgt

SEQ ID NO: 194850 - DNA, 25 bp, Mus musculus
aggcctcgcccagaaggaacagtgt

SEQ ID NO: 194851 - DNA, 25 bp, Mus musculus
aggcctcgctgacattgtgctcaca

SEQ ID NO: 194852 - DNA, 25 bp, Mus musculus
aggcctcgctgagattgtgctcaca

SEQ ID NO: 194853 - DNA, 25 bp, Mus musculus
aggcctcgcttgacacatctttagc

SEQ ID NO: 194854 - DNA, 25 bp, Mus musculus
aggcctcgcttgtcacatctttagc

SEQ ID NO: 194855 - DNA, 25 bp, Mus musculus
aggcctcggcctctaaaagctaagc

SEQ ID NO: 194856 - DNA, 25 bp, Mus musculus
aggcctcggcctgtaaaagctaagc

SEQ ID NO: 194857 - DNA, 25 bp, Mus musculus
aggcctcggcttcagaatcccagtt

SEQ ID NO: 194858 - DNA, 25 bp, Mus musculus
aggcctcggcttgagaatcccagtt

SEQ ID NO: 194859 - DNA, 25 bp, Mus musculus
aggcctcgggatcggaacattattc

SEQ ID NO: 194860 - DNA, 25 bp, Mus musculus
aggcctcgggatgggaacattattc

SEQ ID NO: 194861 - DNA, 25 bp, Mus musculus
aggcctcgggttagctagaggtctc

SEQ ID NO: 194862 - DNA, 25 bp, Mus musculus
aggcctcgggtttgctagaggtctc

SEQ ID NO: 194863 - DNA, 25 bp, Mus musculus
aggcctctaaatccgtgtgtgacca

SEQ ID NO: 194864 - DNA, 25 bp, Mus musculus
aggcctctaaatgcgtgtgtgacca

SEQ ID NO: 194865 - DNA, 25 bp, Mus musculus
aggcctctactgagtgcacaggaga

SEQ ID NO: 194866 - DNA, 25 bp, Mus musculus
aggcctctactgtgtgcacaggaga

SEQ ID NO: 194867 - DNA, 25 bp, Mus musculus
aggcctctagagatagtgtctcttc

SEQ ID NO: 194868 - DNA, 25 bp, Mus musculus
aggcctctagagttagtgtctcttc

SEQ ID NO: 194869 - DNA, 25 bp, Mus musculus
aggcctctaggcaagaccgcagtaa

SEQ ID NO: 194870 - DNA, 25 bp, Mus musculus
aggcctctaggctagaccgcagtaa

SEQ ID NO: 194871 - DNA, 25 bp, Mus musculus
aggcctctataacactgctgctcca

SEQ ID NO: 194872 - DNA, 25 bp, Mus musculus
aggcctctataagactgctgctcca

SEQ ID NO: 194873 - DNA, 25 bp, Mus musculus
aggcctctatctctattgctaagac

SEQ ID NO: 194874 - DNA, 25 bp, Mus musculus
aggcctctatctgtattgctaagac

SEQ ID NO: 194875 - DNA, 25 bp, Mus musculus
aggcctctcagaaggcgccattgct

SEQ ID NO: 194876 - DNA, 25 bp, Mus musculus
aggcctctcagatggcgccattgct

SEQ ID NO: 194877 - DNA, 25 bp, Mus musculus
aggcctctctggcaggctactctgt

SEQ ID NO: 194878 - DNA, 25 bp, Mus musculus
aggcctctctgggaggctactctgt

SEQ ID NO: 194879 - DNA, 25 bp, Mus musculus
aggcctctctgtcagactcgaggag

SEQ ID NO: 194880 - DNA, 25 bp, Mus musculus
aggcctctctgtcagggagacccca

SEQ ID NO: 194881 - DNA, 25 bp, Mus musculus
aggcctctctgtgagactcgaggag

SEQ ID NO: 194882 - DNA, 25 bp, Mus musculus
aggcctctctgtgagggagacccca

SEQ ID NO: 194883 - DNA, 25 bp, Mus musculus
aggcctctcttcactgcctagctac

SEQ ID NO: 194884 - DNA, 25 bp, Mus musculus
aggcctctcttctctgcctagctac

SEQ ID NO: 194885 - DNA, 25 bp, Mus musculus
aggcctctctttctcagtcttgtag

SEQ ID NO: 194886 - DNA, 25 bp, Mus musculus
aggcctctctttgtcagtcttgtag

SEQ ID NO: 194887 - DNA, 25 bp, Mus musculus
aggcctctgaccaaggtgcatctga

SEQ ID NO: 194888 - DNA, 25 bp, Mus musculus
aggcctctgacctaggtgcatctga

SEQ ID NO: 194889 - DNA, 25 bp, Mus musculus
aggcctctgaggaagacaacaagga

SEQ ID NO: 194890 - DNA, 25 bp, Mus musculus
aggcctctgaggtagacaacaagga

SEQ ID NO: 194891 - DNA, 25 bp, Mus musculus
aggcctctgcatacaagggcatgac

SEQ ID NO: 194892 - DNA, 25 bp, Mus musculus
aggcctctgcattcaagggcatgac

SEQ ID NO: 194893 - DNA, 25 bp, Mus musculus
aggcctctgcctagctcgaattgat

SEQ ID NO: 194894 - DNA, 25 bp, Mus musculus
aggcctctgccttgctcgaattgat

SEQ ID NO: 194895 - DNA, 25 bp, Mus musculus
aggcctctgcgcaatggtaacacat

SEQ ID NO: 194896 - DNA, 25 bp, Mus musculus
aggcctctgcgctatggtaacacat

SEQ ID NO: 194897 - DNA, 25 bp, Mus musculus
aggcctctgctccaatcatttgtca

SEQ ID NO: 194898 - DNA, 25 bp, Mus musculus
aggcctctgctcgaatcatttgtca

SEQ ID NO: 194899 - DNA, 25 bp, Mus musculus
aggcctctgggcatagagctctcag

SEQ ID NO: 194900 - DNA, 25 bp, Mus musculus
aggcctctgggcttagagctctcag

SEQ ID NO: 194901 - DNA, 25 bp, Mus musculus
aggcctctgtatctatctctgacca

SEQ ID NO: 194902 - DNA, 25 bp, Mus musculus
aggcctctgtatgtatctctgacca

SEQ ID NO: 194903 - DNA, 25 bp, Mus musculus
aggcctctgtgaccctggcaaacgt

SEQ ID NO: 194904 - DNA, 25 bp, Mus musculus
aggcctctgtgagcctggcaaacgt

SEQ ID NO: 194905 - DNA, 25 bp, Mus musculus
aggcctctgtgcacggtctcatggg

SEQ ID NO: 194906 - DNA, 25 bp, Mus musculus
aggcctctgtgctcggtctcatggg

SEQ ID NO: 194907 - DNA, 25 bp, Mus musculus
aggcctcttcagaagctgggattga

SEQ ID NO: 194908 - DNA, 25 bp, Mus musculus
aggcctcttcagtagctgggattga

SEQ ID NO: 194909 - DNA, 25 bp, Mus musculus
aggcctcttcatctgggaaccagaa

SEQ ID NO: 194910 - DNA, 25 bp, Mus musculus
aggcctcttcatgtgggaaccagaa

SEQ ID NO: 194911 - DNA, 25 bp, Mus musculus
aggcctcttcttctgtgttccggtg

SEQ ID NO: 194912 - DNA, 25 bp, Mus musculus
aggcctcttcttgtgtgttccggtg

SEQ ID NO: 194913 - DNA, 25 bp, Mus musculus
aggcctcttgtgatggcattccttc

SEQ ID NO: 194914 - DNA, 25 bp, Mus musculus
aggcctcttgtgttggcattccttc

SEQ ID NO: 194915 - DNA, 25 bp, Mus musculus
aggcctcttgttcagaacttgtgtc

SEQ ID NO: 194916 - DNA, 25 bp, Mus musculus
aggcctcttgttgagaacttgtgtc

SEQ ID NO: 194917 - DNA, 25 bp, Mus musculus
aggcctgaaagcctgacctgaccag

SEQ ID NO: 194918 - DNA, 25 bp, Mus musculus
aggcctgaaagcgtgacctgaccag

SEQ ID NO: 194919 - DNA, 25 bp, Mus musculus
aggcctgaactacgagcttcttgct

SEQ ID NO: 194920 - DNA, 25 bp, Mus musculus
aggcctgaactaggagcttcttgct

SEQ ID NO: 194921 - DNA, 25 bp, Mus musculus
aggcctgaactccacaggttgtggt

SEQ ID NO: 194922 - DNA, 25 bp, Mus musculus
aggcctgaactcgacaggttgtggt

SEQ ID NO: 194923 - DNA, 25 bp, Mus musculus
aggcctgaagggaccatgtcactga

SEQ ID NO: 194924 - DNA, 25 bp, Mus musculus
aggcctgaagggtccatgtcactga

SEQ ID NO: 194925 - DNA, 25 bp, Mus musculus
aggcctgacgaaactgcaagcatca

SEQ ID NO: 194926 - DNA, 25 bp, Mus musculus
aggcctgacgaatctgcaagcatca

SEQ ID NO: 194927 - DNA, 25 bp, Mus musculus
aggcctgacgttcccatcggtctag

SEQ ID NO: 194928 - DNA, 25 bp, Mus musculus
aggcctgacgttgccatcggtctag

SEQ ID NO: 194929 - DNA, 25 bp, Mus musculus
aggcctgactggacctgtggatgtt

SEQ ID NO: 194930 - DNA, 25 bp, Mus musculus
aggcctgactggtcctgtggatgtt

SEQ ID NO: 194931 - DNA, 25 bp, Mus musculus
aggcctgagatgacaacgacaataa

SEQ ID NO: 194932 - DNA, 25 bp, Mus musculus
aggcctgagatgtcaacgacaataa

SEQ ID NO: 194933 - DNA, 25 bp, Mus musculus
aggcctgagccccatagcgagcttg

SEQ ID NO: 194934 - DNA, 25 bp, Mus musculus
aggcctgagcccgatagcgagcttg

SEQ ID NO: 194935 - DNA, 25 bp, Mus musculus
aggcctgagccgactacccagattc

SEQ ID NO: 194936 - DNA, 25 bp, Mus musculus
aggcctgagccgtctacccagattc

SEQ ID NO: 194937 - DNA, 25 bp, Mus musculus
aggcctgagctaccgacacagcaaa

SEQ ID NO: 194938 - DNA, 25 bp, Mus musculus
aggcctgagctagcgacacagcaaa

SEQ ID NO: 194939 - DNA, 25 bp, Mus musculus
aggcctgagcttagtccaaccagac

SEQ ID NO: 194940 - DNA, 25 bp, Mus musculus
aggcctgagctttgtccaaccagac

SEQ ID NO: 194941 - DNA, 25 bp, Mus musculus
aggcctgaggtgagctgcaagttca

SEQ ID NO: 194942 - DNA, 25 bp, Mus musculus
aggcctgaggtgatcatgtgtgctc

SEQ ID NO: 194943 - DNA, 25 bp, Mus musculus
aggcctgaggtgtgctgcaagttca

SEQ ID NO: 194944 - DNA, 25 bp, Mus musculus
aggcctgaggtgttcatgtgtgctc

SEQ ID NO: 194945 - DNA, 25 bp, Mus musculus
aggcctgagtaaatttcctccattc

SEQ ID NO: 194946 - DNA, 25 bp, Mus musculus
aggcctgagtaattttcctccattc

SEQ ID NO: 194947 - DNA, 25 bp, Mus musculus
aggcctgagtcacaccaagttgtca

SEQ ID NO: 194948 - DNA, 25 bp, Mus musculus
aggcctgagtcagaccaagttgtca

SEQ ID NO: 194949 - DNA, 25 bp, Mus musculus
aggcctgagtgcagagttgtactat

SEQ ID NO: 194950 - DNA, 25 bp, Mus musculus
aggcctgagtgctgagttgtactat

SEQ ID NO: 194951 - DNA, 25 bp, Mus musculus
aggcctgagtgtagcatcacatgca

SEQ ID NO: 194952 - DNA, 25 bp, Mus musculus
aggcctgagtgttgcatcacatgca

SEQ ID NO: 194953 - DNA, 25 bp, Mus musculus
aggcctgatgggagacactgtcgca

SEQ ID NO: 194954 - DNA, 25 bp, Mus musculus
aggcctgatgggtgacactgtcgca

SEQ ID NO: 194955 - DNA, 25 bp, Mus musculus
aggcctgatgtcctgcatcaactca

SEQ ID NO: 194956 - DNA, 25 bp, Mus musculus
aggcctgatgtcgtgcatcaactca

SEQ ID NO: 194957 - DNA, 25 bp, Mus musculus
aggcctgcacttagctttgctagga

SEQ ID NO: 194958 - DNA, 25 bp, Mus musculus
aggcctgcactttgctttgctagga

SEQ ID NO: 194959 - DNA, 25 bp, Mus musculus
aggcctgcagcacagctctttgtgg

SEQ ID NO: 194960 - DNA, 25 bp, Mus musculus
aggcctgcagcagagctctttgtgg

SEQ ID NO: 194961 - DNA, 25 bp, Mus musculus
aggcctgccaggaggacatcaggaa

SEQ ID NO: 194962 - DNA, 25 bp, Mus musculus
aggcctgccaggcattctatatttc

SEQ ID NO: 194963 - DNA, 25 bp, Mus musculus
aggcctgccagggattctatatttc

SEQ ID NO: 194964 - DNA, 25 bp, Mus musculus
aggcctgccaggtggacatcaggaa

SEQ ID NO: 194965 - DNA, 25 bp, Mus musculus
aggcctgccagtaggctcagttcaa

SEQ ID NO: 194966 - DNA, 25 bp, Mus musculus
aggcctgccagttggctcagttcaa

SEQ ID NO: 194967 - DNA, 25 bp, Mus musculus
aggcctgccccacaaaggaggtgtt

SEQ ID NO: 194968 - DNA, 25 bp, Mus musculus
aggcctgccccagaaaggaggtgtt

SEQ ID NO: 194969 - DNA, 25 bp, Mus musculus
aggcctgccctgaaccatattatat

SEQ ID NO: 194970 - DNA, 25 bp, Mus musculus
aggcctgccctgtaccatattatat

SEQ ID NO: 194971 - DNA, 25 bp, Mus musculus
aggcctgcctacattggatgccaat

SEQ ID NO: 194972 - DNA, 25 bp, Mus musculus
aggcctgcctactttggatgccaat

SEQ ID NO: 194973 - DNA, 25 bp, Mus musculus
aggcctgcctctcaaagtccacgtg

SEQ ID NO: 194974 - DNA, 25 bp, Mus musculus
aggcctgcctctgaaagtccacgtg

SEQ ID NO: 194975 - DNA, 25 bp, Mus musculus
aggcctgcctgcactgggtggtcat

SEQ ID NO: 194976 - DNA, 25 bp, Mus musculus
aggcctgcctgctctgggtggtcat

SEQ ID NO: 194977 - DNA, 25 bp, Mus musculus
aggcctgcctggagtatcttcacag

SEQ ID NO: 194978 - DNA, 25 bp, Mus musculus
aggcctgcctggtgtatcttcacag

SEQ ID NO: 194979 - DNA, 25 bp, Mus musculus
aggcctgccttaactaacaagcaag

SEQ ID NO: 194980 - DNA, 25 bp, Mus musculus
aggcctgccttatctaacaagcaag

SEQ ID NO: 194981 - DNA, 25 bp, Mus musculus
aggcctgccttgaatcagctagcca

SEQ ID NO: 194982 - DNA, 25 bp, Mus musculus
aggcctgccttgtatcagctagcca

SEQ ID NO: 194983 - DNA, 25 bp, Mus musculus
aggcctgcgggtctagttagcttat

SEQ ID NO: 194984 - DNA, 25 bp, Mus musculus
aggcctgcgggtgtagttagcttat

SEQ ID NO: 194985 - DNA, 25 bp, Mus musculus
aggcctgctctgaggcaacatatgg

SEQ ID NO: 194986 - DNA, 25 bp, Mus musculus
aggcctgctctgtggcaacatatgg

SEQ ID NO: 194987 - DNA, 25 bp, Mus musculus
aggcctgctgcaatctgctgagtgc

SEQ ID NO: 194988 - DNA, 25 bp, Mus musculus
aggcctgctgcattctgctgagtgc

SEQ ID NO: 194989 - DNA, 25 bp, Mus musculus
aggcctgctgctcaacacagcacaa

SEQ ID NO: 194990 - DNA, 25 bp, Mus musculus
aggcctgctgctgaacacagcacaa

SEQ ID NO: 194991 - DNA, 25 bp, Mus musculus
aggcctgctgggacttaagctatgg

SEQ ID NO: 194992 - DNA, 25 bp, Mus musculus
aggcctgctgggtcttaagctatgg

SEQ ID NO: 194993 - DNA, 25 bp, Mus musculus
aggcctggacacactacaagcatga

SEQ ID NO: 194994 - DNA, 25 bp, Mus musculus
aggcctggacactctacaagcatga

SEQ ID NO: 194995 - DNA, 25 bp, Mus musculus
aggcctggacgtcttgcgcacttaa

SEQ ID NO: 194996 - DNA, 25 bp, Mus musculus
aggcctggacgtgttgcgcacttaa

SEQ ID NO: 194997 - DNA, 25 bp, Mus musculus
aggcctggagatccccacgagacca

SEQ ID NO: 194998 - DNA, 25 bp, Mus musculus
aggcctggagatgcccacgagacca

SEQ ID NO: 194999 - DNA, 25 bp, Mus musculus
aggcctggcagactggctttgattt

SEQ ID NO: 195000 - DNA, 25 bp, Mus musculus
aggcctggcagagtggctttgattt

SEQ ID NO: 195001 - DNA, 25 bp, Mus musculus
aggcctggcatcagtttttggcttt

SEQ ID NO: 195002 - DNA, 25 bp, Mus musculus
aggcctggcatcataaggacttgaa

SEQ ID NO: 195003 - DNA, 25 bp, Mus musculus
aggcctggcatctgtttttggcttt

SEQ ID NO: 195004 - DNA, 25 bp, Mus musculus
aggcctggcatcttaaggacttgaa

SEQ ID NO: 195005 - DNA, 25 bp, Mus musculus
aggcctggccggattgcaggtcctc

SEQ ID NO: 195006 - DNA, 25 bp, Mus musculus
aggcctggccggtttgcaggtcctc

SEQ ID NO: 195007 - DNA, 25 bp, Mus musculus
aggcctggccttcttggtagataca

SEQ ID NO: 195008 - DNA, 25 bp, Mus musculus
aggcctggccttgttggtagataca

SEQ ID NO: 195009 - DNA, 25 bp, Mus musculus
aggcctggcgttctcttgggcaaaa

SEQ ID NO: 195010 - DNA, 25 bp, Mus musculus
aggcctggcgttgtcttgggcaaaa

SEQ ID NO: 195011 - DNA, 25 bp, Mus musculus
aggcctggctaacctcttgcggagc

SEQ ID NO: 195012 - DNA, 25 bp, Mus musculus
aggcctggctaagctcttgcggagc

SEQ ID NO: 195013 - DNA, 25 bp, Mus musculus
aggcctggctagaagaatagggttt

SEQ ID NO: 195014 - DNA, 25 bp, Mus musculus
aggcctggctagtagaatagggttt

SEQ ID NO: 195015 - DNA, 25 bp, Mus musculus
aggcctggctcaagtggcgcttcat

SEQ ID NO: 195016 - DNA, 25 bp, Mus musculus
aggcctggctcatgtggcgcttcat

SEQ ID NO: 195017 - DNA, 25 bp, Mus musculus
aggcctggctctagatacagctgtg

SEQ ID NO: 195018 - DNA, 25 bp, Mus musculus
aggcctggctcttgatacagctgtg

SEQ ID NO: 195019 - DNA, 25 bp, Mus musculus
aggcctggctgcaggcggcacaacc

SEQ ID NO: 195020 - DNA, 25 bp, Mus musculus
aggcctggctgctggcggcacaacc

SEQ ID NO: 195021 - DNA, 25 bp, Mus musculus
aggcctgggacaccctcaacaacaa

SEQ ID NO: 195022 - DNA, 25 bp, Mus musculus
aggcctgggacagcctcaacaacaa

SEQ ID NO: 195023 - DNA, 25 bp, Mus musculus
aggcctgggagtagtagccctgctc

SEQ ID NO: 195024 - DNA, 25 bp, Mus musculus
aggcctgggagttgtagccctgctc

SEQ ID NO: 195025 - DNA, 25 bp, Mus musculus
aggcctgggcagatggatttattca

SEQ ID NO: 195026 - DNA, 25 bp, Mus musculus
aggcctgggcagcaatcattctata

SEQ ID NO: 195027 - DNA, 25 bp, Mus musculus
aggcctgggcaggaatcattctata

SEQ ID NO: 195028 - DNA, 25 bp, Mus musculus
aggcctgggcagttggatttattca

SEQ ID NO: 195029 - DNA, 25 bp, Mus musculus
aggcctgggctcaagcacccaaaag

SEQ ID NO: 195030 - DNA, 25 bp, Mus musculus
aggcctgggctctagcacccaaaag

SEQ ID NO: 195031 - DNA, 25 bp, Mus musculus
aggcctgggcttaagttcttgtgca

SEQ ID NO: 195032 - DNA, 25 bp, Mus musculus
aggcctgggctttagttcttgtgca

SEQ ID NO: 195033 - DNA, 25 bp, Mus musculus
aggcctggtctgatgtctgcagctc

SEQ ID NO: 195034 - DNA, 25 bp, Mus musculus
aggcctggtctgttgtctgcagctc

SEQ ID NO: 195035 - DNA, 25 bp, Mus musculus
aggcctggtgagataggctctaccc

SEQ ID NO: 195036 - DNA, 25 bp, Mus musculus
aggcctggtgagttaggctctaccc

SEQ ID NO: 195037 - DNA, 25 bp, Mus musculus
aggcctggtgctactcactggcaag

SEQ ID NO: 195038 - DNA, 25 bp, Mus musculus
aggcctggtgcttctcactggcaag

SEQ ID NO: 195039 - DNA, 25 bp, Mus musculus
aggcctggtggcaagtgcgtttatc

SEQ ID NO: 195040 - DNA, 25 bp, Mus musculus
aggcctggtggctagtgcgtttatc

SEQ ID NO: 195041 - DNA, 25 bp, Mus musculus
aggcctgtaagcagagcacatccat

SEQ ID NO: 195042 - DNA, 25 bp, Mus musculus
aggcctgtaagctgagcacatccat

SEQ ID NO: 195043 - DNA, 25 bp, Mus musculus
aggcctgtacatacaagcctcttac

SEQ ID NO: 195044 - DNA, 25 bp, Mus musculus
aggcctgtacattcaagcctcttac

SEQ ID NO: 195045 - DNA, 25 bp, Mus musculus
aggcctgtacggagatcaatctgac

SEQ ID NO: 195046 - DNA, 25 bp, Mus musculus
aggcctgtacggtgatcaatctgac

SEQ ID NO: 195047 - DNA, 25 bp, Mus musculus
aggcctgtactgctactcatattag

SEQ ID NO: 195048 - DNA, 25 bp, Mus musculus
aggcctgtactggtactcatattag

SEQ ID NO: 195049 - DNA, 25 bp, Mus musculus
aggcctgtatccagcaacaagttgc

SEQ ID NO: 195050 - DNA, 25 bp, Mus musculus
aggcctgtatcctgcaacaagttgc

SEQ ID NO: 195051 - DNA, 25 bp, Mus musculus
aggcctgtatgacaccccagtgtag

SEQ ID NO: 195052 - DNA, 25 bp, Mus musculus
aggcctgtatgagaccccagtgtag

SEQ ID NO: 195053 - DNA, 25 bp, Mus musculus
aggcctgtcccaatggaagggctga

SEQ ID NO: 195054 - DNA, 25 bp, Mus musculus
aggcctgtcccattggaagggctga

SEQ ID NO: 195055 - DNA, 25 bp, Mus musculus
aggcctgtctggatgctgttgagaa

SEQ ID NO: 195056 - DNA, 25 bp, Mus musculus
aggcctgtctggttgctgttgagaa

SEQ ID NO: 195057 - DNA, 25 bp, Mus musculus
aggcctgtgatgaggatcttcccga

SEQ ID NO: 195058 - DNA, 25 bp, Mus musculus
aggcctgtgatgtggatcttcccga

SEQ ID NO: 195059 - DNA, 25 bp, Mus musculus
aggcctgtgctaccatgtgttgctg

SEQ ID NO: 195060 - DNA, 25 bp, Mus musculus
aggcctgtgctagcatgtgttgctg

SEQ ID NO: 195061 - DNA, 25 bp, Mus musculus
aggcctgtgcttcgaaggtatcaga

SEQ ID NO: 195062 - DNA, 25 bp, Mus musculus
aggcctgtgcttggaaggtatcaga

SEQ ID NO: 195063 - DNA, 25 bp, Mus musculus
aggcctgtggaacaccggacttcac

SEQ ID NO: 195064 - DNA, 25 bp, Mus musculus
aggcctgtggaagaccggacttcac

SEQ ID NO: 195065 - DNA, 25 bp, Mus musculus
aggcctgtgtcacaaatgcgtcttc

SEQ ID NO: 195066 - DNA, 25 bp, Mus musculus
aggcctgtgtcagaaatgcgtcttc

SEQ ID NO: 195067 - DNA, 25 bp, Mus musculus
aggcctgtgtctctctttcagggag

SEQ ID NO: 195068 - DNA, 25 bp, Mus musculus
aggcctgtgtctgtctttcagggag

SEQ ID NO: 195069 - DNA, 25 bp, Mus musculus
aggcctgtgtggacatgcttagtta

SEQ ID NO: 195070 - DNA, 25 bp, Mus musculus
aggcctgtgtggcactcccatgact

SEQ ID NO: 195071 - DNA, 25 bp, Mus musculus
aggcctgtgtgggactcccatgact

SEQ ID NO: 195072 - DNA, 25 bp, Mus musculus
aggcctgtgtggtcatgcttagtta

SEQ ID NO: 195073 - DNA, 25 bp, Mus musculus
aggcctgttagtaagcctggttcaa

SEQ ID NO: 195074 - DNA, 25 bp, Mus musculus
aggcctgttagttagcctggttcaa

SEQ ID NO: 195075 - DNA, 25 bp, Mus musculus
aggcctgttcagagttaataataat

SEQ ID NO: 195076 - DNA, 25 bp, Mus musculus
aggcctgttcagtgttaataataat

SEQ ID NO: 195077 - DNA, 25 bp, Mus musculus
aggcctgttctacaaactctatcac

SEQ ID NO: 195078 - DNA, 25 bp, Mus musculus
aggcctgttctagaaactctatcac

SEQ ID NO: 195079 - DNA, 25 bp, Mus musculus
aggcctgttctcagtccctggacta

SEQ ID NO: 195080 - DNA, 25 bp, Mus musculus
aggcctgttctctgtccctggacta

SEQ ID NO: 195081 - DNA, 25 bp, Mus musculus
aggcctgttgctacttttgatggac

SEQ ID NO: 195082 - DNA, 25 bp, Mus musculus
aggcctgttgcttcttttgatggac

SEQ ID NO: 195083 - DNA, 25 bp, Mus musculus
aggcctgttggaatcctggagttga

SEQ ID NO: 195084 - DNA, 25 bp, Mus musculus
aggcctgttggattcctggagttga

SEQ ID NO: 195085 - DNA, 25 bp, Mus musculus
aggcctgtttcaatagcagaaggaa

SEQ ID NO: 195086 - DNA, 25 bp, Mus musculus
aggcctgtttcattagcagaaggaa

SEQ ID NO: 195087 - DNA, 25 bp, Mus musculus
aggcctgtttccatagttcagttgg

SEQ ID NO: 195088 - DNA, 25 bp, Mus musculus
aggcctgtttccttagttcagttgg

SEQ ID NO: 195089 - DNA, 25 bp, Mus musculus
aggcctgttttgagaactgcgttga

SEQ ID NO: 195090 - DNA, 25 bp, Mus musculus
aggcctgttttgtgaactgcgttga

SEQ ID NO: 195091 - DNA, 25 bp, Mus musculus
aggccttacagccatggagcagtgt

SEQ ID NO: 195092 - DNA, 25 bp, Mus musculus
aggccttacagcgatggagcagtgt

SEQ ID NO: 195093 - DNA, 25 bp, Mus musculus
aggccttacccaacaccagagagtt

SEQ ID NO: 195094 - DNA, 25 bp, Mus musculus
aggccttacccatcaccagagagtt

SEQ ID NO: 195095 - DNA, 25 bp, Mus musculus
aggccttagatccaggaccctatgt

SEQ ID NO: 195096 - DNA, 25 bp, Mus musculus
aggccttagatcgaggaccctatgt

SEQ ID NO: 195097 - DNA, 25 bp, Mus musculus
aggccttaggacactggctctctga

SEQ ID NO: 195098 - DNA, 25 bp, Mus musculus
aggccttaggactctggctctctga

SEQ ID NO: 195099 - DNA, 25 bp, Mus musculus
aggccttagttaccaagcaagttca

SEQ ID NO: 195100 - DNA, 25 bp, Mus musculus
aggccttagttagcaagcaagttca

SEQ ID NO: 195101 - DNA, 25 bp, Mus musculus
aggccttataatcatgctcaaacag

SEQ ID NO: 195102 - DNA, 25 bp, Mus musculus
aggccttataatgatgctcaaacag

SEQ ID NO: 195103 - DNA, 25 bp, Mus musculus
aggccttatgctacctctggtggga

SEQ ID NO: 195104 - DNA, 25 bp, Mus musculus
aggccttatgcttcctctggtggga

SEQ ID NO: 195105 - DNA, 25 bp, Mus musculus
aggccttcaaccatctgaatgtctt

SEQ ID NO: 195106 - DNA, 25 bp, Mus musculus
aggccttcaaccttctgaatgtctt

SEQ ID NO: 195107 - DNA, 25 bp, Mus musculus
aggccttcaacgacaatgcgaagct

SEQ ID NO: 195108 - DNA, 25 bp, Mus musculus
aggccttcaacgtcaatgcgaagct

SEQ ID NO: 195109 - DNA, 25 bp, Mus musculus
aggccttcacgcagctcgctgagct

SEQ ID NO: 195110 - DNA, 25 bp, Mus musculus
aggccttcacgctgctcgctgagct

SEQ ID NO: 195111 - DNA, 25 bp, Mus musculus
aggccttcacttacatagttccttt

SEQ ID NO: 195112 - DNA, 25 bp, Mus musculus
aggccttcactttcatagttccttt

SEQ ID NO: 195113 - DNA, 25 bp, Mus musculus
aggccttcagcgacaaacacaacct

SEQ ID NO: 195114 - DNA, 25 bp, Mus musculus
aggccttcagcgtcaaacacaacct

SEQ ID NO: 195115 - DNA, 25 bp, Mus musculus
aggccttcatggctgtcttgggaaa

SEQ ID NO: 195116 - DNA, 25 bp, Mus musculus
aggccttcatgggtgtcttgggaaa

SEQ ID NO: 195117 - DNA, 25 bp, Mus musculus
aggccttccagcactccaaggctgt

SEQ ID NO: 195118 - DNA, 25 bp, Mus musculus
aggccttccagctctccaaggctgt

SEQ ID NO: 195119 - DNA, 25 bp, Mus musculus
aggccttccaggattgtgtcagctc

SEQ ID NO: 195120 - DNA, 25 bp, Mus musculus
aggccttccaggtttgtgtcagctc

SEQ ID NO: 195121 - DNA, 25 bp, Mus musculus
aggccttccatgatgtcgatgatgt

SEQ ID NO: 195122 - DNA, 25 bp, Mus musculus
aggccttccatgttgtcgatgatgt

SEQ ID NO: 195123 - DNA, 25 bp, Mus musculus
aggccttccattagggcaagagccg

SEQ ID NO: 195124 - DNA, 25 bp, Mus musculus
aggccttccatttgggcaagagccg

SEQ ID NO: 195125 - DNA, 25 bp, Mus musculus
aggccttcccttcgagtcggtgcat

SEQ ID NO: 195126 - DNA, 25 bp, Mus musculus
aggccttcccttggagtcggtgcat

SEQ ID NO: 195127 - DNA, 25 bp, Mus musculus
aggccttccgatcctatacctgtga

SEQ ID NO: 195128 - DNA, 25 bp, Mus musculus
aggccttccgatgctatacctgtga

SEQ ID NO: 195129 - DNA, 25 bp, Mus musculus
aggccttccgcaatgagcagttcac

SEQ ID NO: 195130 - DNA, 25 bp, Mus musculus
aggccttccgcattgagcagttcac

SEQ ID NO: 195131 - DNA, 25 bp, Mus musculus
aggccttccgtcaagagatgctgca

SEQ ID NO: 195132 - DNA, 25 bp, Mus musculus
aggccttccgtctagagatgctgca

SEQ ID NO: 195133 - DNA, 25 bp, Mus musculus
aggccttcctagaagtggatccaca

SEQ ID NO: 195134 - DNA, 25 bp, Mus musculus
aggccttcctagtagtggatccaca

SEQ ID NO: 195135 - DNA, 25 bp, Mus musculus
aggccttcctcactcagcatgtgga

SEQ ID NO: 195136 - DNA, 25 bp, Mus musculus
aggccttcctcagtcagcatgtgga

SEQ ID NO: 195137 - DNA, 25 bp, Mus musculus
aggccttcctctcttacattttaag

SEQ ID NO: 195138 - DNA, 25 bp, Mus musculus
aggccttcctctgttacattttaag

SEQ ID NO: 195139 - DNA, 25 bp, Mus musculus
aggccttcgcacattgacacatgaa

SEQ ID NO: 195140 - DNA, 25 bp, Mus musculus
aggccttcgcactttgacacatgaa

SEQ ID NO: 195141 - DNA, 25 bp, Mus musculus
aggccttcttagactagtgtggtca

SEQ ID NO: 195142 - DNA, 25 bp, Mus musculus
aggccttcttagtctagtgtggtca

SEQ ID NO: 195143 - DNA, 25 bp, Mus musculus
aggccttcttcgcagagccatttct

SEQ ID NO: 195144 - DNA, 25 bp, Mus musculus
aggccttcttcggagagccatttct

SEQ ID NO: 195145 - DNA, 25 bp, Mus musculus
aggccttctttgcctcatgtcagac

SEQ ID NO: 195146 - DNA, 25 bp, Mus musculus
aggccttctttggctcatgtcagac

SEQ ID NO: 195147 - DNA, 25 bp, Mus musculus
aggccttgaacacactgctgtttga

SEQ ID NO: 195148 - DNA, 25 bp, Mus musculus
aggccttgaacagactgctgtttga

SEQ ID NO: 195149 - DNA, 25 bp, Mus musculus
aggccttgaactcggatcctcttgc

SEQ ID NO: 195150 - DNA, 25 bp, Mus musculus
aggccttgaactgggatcctcttgc

SEQ ID NO: 195151 - DNA, 25 bp, Mus musculus
aggccttgaaggcacacttctgata

SEQ ID NO: 195152 - DNA, 25 bp, Mus musculus
aggccttgaagggacacttctgata

SEQ ID NO: 195153 - DNA, 25 bp, Mus musculus
aggccttgacgtatctggacagttc

SEQ ID NO: 195154 - DNA, 25 bp, Mus musculus
aggccttgacgtttctggacagttc

SEQ ID NO: 195155 - DNA, 25 bp, Mus musculus
aggccttgactcactaagctcatag

SEQ ID NO: 195156 - DNA, 25 bp, Mus musculus
aggccttgactctctaagctcatag

SEQ ID NO: 195157 - DNA, 25 bp, Mus musculus
aggccttgagcccagtttgtagctc

SEQ ID NO: 195158 - DNA, 25 bp, Mus musculus
aggccttgagccgagtttgtagctc

SEQ ID NO: 195159 - DNA, 25 bp, Mus musculus
aggccttgagctctgacattaagaa

SEQ ID NO: 195160 - DNA, 25 bp, Mus musculus
aggccttgagctgtgacattaagaa

SEQ ID NO: 195161 - DNA, 25 bp, Mus musculus
aggccttgaggccactgtacctaag

SEQ ID NO: 195162 - DNA, 25 bp, Mus musculus
aggccttgaggcgactgtacctaag

SEQ ID NO: 195163 - DNA, 25 bp, Mus musculus
aggccttgcaggatacccagtatga

SEQ ID NO: 195164 - DNA, 25 bp, Mus musculus
aggccttgcaggttacccagtatga

SEQ ID NO: 195165 - DNA, 25 bp, Mus musculus
aggccttgccgtcagtaaccacagt

SEQ ID NO: 195166 - DNA, 25 bp, Mus musculus
aggccttgccgtgagtaaccacagt

SEQ ID NO: 195167 - DNA, 25 bp, Mus musculus
aggccttggaccaagtcgatcgaga

SEQ ID NO: 195168 - DNA, 25 bp, Mus musculus
aggccttggacctagtcgatcgaga

SEQ ID NO: 195169 - DNA, 25 bp, Mus musculus
aggccttggcaacaacgatcctatt

SEQ ID NO: 195170 - DNA, 25 bp, Mus musculus
aggccttggcaagaacgatcctatt

SEQ ID NO: 195171 - DNA, 25 bp, Mus musculus
aggccttggccaaactagatctctt

SEQ ID NO: 195172 - DNA, 25 bp, Mus musculus
aggccttggccatactagatctctt

SEQ ID NO: 195173 - DNA, 25 bp, Mus musculus
aggccttggtatctattttctataa

SEQ ID NO: 195174 - DNA, 25 bp, Mus musculus
aggccttggtatgtattttctataa

SEQ ID NO: 195175 - DNA, 25 bp, Mus musculus
aggccttggtgtcccagtacctaga

SEQ ID NO: 195176 - DNA, 25 bp, Mus musculus
aggccttggtgtgccagtacctaga

SEQ ID NO: 195177 - DNA, 25 bp, Mus musculus
aggccttggttcctggtccctcttg

SEQ ID NO: 195178 - DNA, 25 bp, Mus musculus
aggccttggttcgtggtccctcttg

SEQ ID NO: 195179 - DNA, 25 bp, Mus musculus
aggccttgtcccagagtcttgccgt

SEQ ID NO: 195180 - DNA, 25 bp, Mus musculus
aggccttgtccctgagtcttgccgt

SEQ ID NO: 195181 - DNA, 25 bp, Mus musculus
aggccttgtccgaactggtgaaact

SEQ ID NO: 195182 - DNA, 25 bp, Mus musculus
aggccttgtccgtactggtgaaact

SEQ ID NO: 195183 - DNA, 25 bp, Mus musculus
aggccttgtctgacatgggtctcca

SEQ ID NO: 195184 - DNA, 25 bp, Mus musculus
aggccttgtctgtcatgggtctcca

SEQ ID NO: 195185 - DNA, 25 bp, Mus musculus
aggccttgtgtcagtggaactcttc

SEQ ID NO: 195186 - DNA, 25 bp, Mus musculus
aggccttgtgtcctggtacctgtga

SEQ ID NO: 195187 - DNA, 25 bp, Mus musculus
aggccttgtgtcctttcttaagtag

SEQ ID NO: 195188 - DNA, 25 bp, Mus musculus
aggccttgtgtcgtggtacctgtga

SEQ ID NO: 195189 - DNA, 25 bp, Mus musculus
aggccttgtgtcgtttcttaagtag

SEQ ID NO: 195190 - DNA, 25 bp, Mus musculus
aggccttgtgtctgtggaactcttc

SEQ ID NO: 195191 - DNA, 25 bp, Mus musculus
aggcctttaccacattcctagttgg

SEQ ID NO: 195192 - DNA, 25 bp, Mus musculus
aggcctttaccagattcctagttgg

SEQ ID NO: 195193 - DNA, 25 bp, Mus musculus
aggcctttactaccttttatcaact

SEQ ID NO: 195194 - DNA, 25 bp, Mus musculus
aggcctttactagcttttatcaact

SEQ ID NO: 195195 - DNA, 25 bp, Mus musculus
aggcctttatctagctgtctcacct

SEQ ID NO: 195196 - DNA, 25 bp, Mus musculus
aggcctttatcttgctgtctcacct

SEQ ID NO: 195197 - DNA, 25 bp, Mus musculus
aggcctttattcagatgtcagaact

SEQ ID NO: 195198 - DNA, 25 bp, Mus musculus
aggcctttattctgatgtcagaact

SEQ ID NO: 195199 - DNA, 25 bp, Mus musculus
aggcctttcacacgtaggactgaga

SEQ ID NO: 195200 - DNA, 25 bp, Mus musculus
aggcctttcacaggtaggactgaga

SEQ ID NO: 195201 - DNA, 25 bp, Mus musculus
aggcctttcagacagctatgccaag

SEQ ID NO: 195202 - DNA, 25 bp, Mus musculus
aggcctttcagagagctatgccaag

SEQ ID NO: 195203 - DNA, 25 bp, Mus musculus
aggcctttcccgacatgcacaattc

SEQ ID NO: 195204 - DNA, 25 bp, Mus musculus
aggcctttcccgtcatgcacaattc

SEQ ID NO: 195205 - DNA, 25 bp, Mus musculus
aggcctttcctactacttgtgatta

SEQ ID NO: 195206 - DNA, 25 bp, Mus musculus
aggcctttcctagtacttgtgatta

SEQ ID NO: 195207 - DNA, 25 bp, Mus musculus
aggcctttccttctgctgagtggag

SEQ ID NO: 195208 - DNA, 25 bp, Mus musculus
aggcctttccttgtgctgagtggag

SEQ ID NO: 195209 - DNA, 25 bp, Mus musculus
aggcctttcgacataattcttctct

SEQ ID NO: 195210 - DNA, 25 bp, Mus musculus
aggcctttcgacttaattcttctct

SEQ ID NO: 195211 - DNA, 25 bp, Mus musculus
aggcctttctctccctatagtggga

SEQ ID NO: 195212 - DNA, 25 bp, Mus musculus
aggcctttctctgcctatagtggga

SEQ ID NO: 195213 - DNA, 25 bp, Mus musculus
aggcctttctggctgctctaaggga

SEQ ID NO: 195214 - DNA, 25 bp, Mus musculus
aggcctttctgggtgctctaaggga

SEQ ID NO: 195215 - DNA, 25 bp, Mus musculus
aggcctttcttaaagcttacccttg

SEQ ID NO: 195216 - DNA, 25 bp, Mus musculus
aggcctttcttatagcttacccttg

SEQ ID NO: 195217 - DNA, 25 bp, Mus musculus
aggcctttgaaaaagcggtccccat

SEQ ID NO: 195218 - DNA, 25 bp, Mus musculus
aggcctttgaaatagcggtccccat

SEQ ID NO: 195219 - DNA, 25 bp, Mus musculus
aggcctttgagcaggtatgtccgtc

SEQ ID NO: 195220 - DNA, 25 bp, Mus musculus
aggcctttgagctggtatgtccgtc

SEQ ID NO: 195221 - DNA, 25 bp, Mus musculus
aggcctttgcccagtggatcgagca

SEQ ID NO: 195222 - DNA, 25 bp, Mus musculus
aggcctttgccctgtggatcgagca

SEQ ID NO: 195223 - DNA, 25 bp, Mus musculus
aggcctttgcgcagccctaaaagaa

SEQ ID NO: 195224 - DNA, 25 bp, Mus musculus
aggcctttgcgctgccctaaaagaa

SEQ ID NO: 195225 - DNA, 25 bp, Mus musculus
aggcctttgcttcctgcttgggaag

SEQ ID NO: 195226 - DNA, 25 bp, Mus musculus
aggcctttgcttgctgcttgggaag

SEQ ID NO: 195227 - DNA, 25 bp, Mus musculus
aggcctttggccatgcaatgaagac

SEQ ID NO: 195228 - DNA, 25 bp, Mus musculus
aggcctttggccttgcaatgaagac

SEQ ID NO: 195229 - DNA, 25 bp, Mus musculus
aggcctttgtagaccacctgcctgc

SEQ ID NO: 195230 - DNA, 25 bp, Mus musculus
aggcctttgtagatttcttctctca

SEQ ID NO: 195231 - DNA, 25 bp, Mus musculus
aggcctttgtagtccacctgcctgc

SEQ ID NO: 195232 - DNA, 25 bp, Mus musculus
aggcctttgtagttttcttctctca

SEQ ID NO: 195233 - DNA, 25 bp, Mus musculus
aggcctttgtatataatatgtctcc

SEQ ID NO: 195234 - DNA, 25 bp, Mus musculus
aggcctttgtatttaatatgtctcc

SEQ ID NO: 195235 - DNA, 25 bp, Mus musculus
aggcctttgtcaaggagaccttcgt

SEQ ID NO: 195236 - DNA, 25 bp, Mus musculus
aggcctttgtcatggagaccttcgt

SEQ ID NO: 195237 - DNA, 25 bp, Mus musculus
aggcctttgttaactttactgactc

SEQ ID NO: 195238 - DNA, 25 bp, Mus musculus
aggcctttgttatctttactgactc

SEQ ID NO: 195239 - DNA, 25 bp, Mus musculus
aggccttttaatcaccagatctctg

SEQ ID NO: 195240 - DNA, 25 bp, Mus musculus
aggccttttaatgaccagatctctg

SEQ ID NO: 195241 - DNA, 25 bp, Mus musculus
aggccttttctgctcgagtgtttgt

SEQ ID NO: 195242 - DNA, 25 bp, Mus musculus
aggccttttctggtcgagtgtttgt

SEQ ID NO: 195243 - DNA, 25 bp, Mus musculus
aggccttttgcaataagcgcctctg

SEQ ID NO: 195244 - DNA, 25 bp, Mus musculus
aggccttttgcattaagcgcctctg

SEQ ID NO: 195245 - DNA, 25 bp, Mus musculus
aggccttttgtgatctaatgacata

SEQ ID NO: 195246 - DNA, 25 bp, Mus musculus
aggccttttgtgttctaatgacata

SEQ ID NO: 195247 - DNA, 25 bp, Mus musculus
aggcgaaagaccaaaatgctccact

SEQ ID NO: 195248 - DNA, 25 bp, Mus musculus
aggcgaaagacctaaatgctccact

SEQ ID NO: 195249 - DNA, 25 bp, Mus musculus
aggcgaacctgtcagagccttcatt

SEQ ID NO: 195250 - DNA, 25 bp, Mus musculus
aggcgaacctgtgagagccttcatt

SEQ ID NO: 195251 - DNA, 25 bp, Mus musculus
aggcgaacgaacactgtatcttcca

SEQ ID NO: 195252 - DNA, 25 bp, Mus musculus
aggcgaacgaactctgtatcttcca

SEQ ID NO: 195253 - DNA, 25 bp, Mus musculus
aggcgaagagctatggcgatgcccc

SEQ ID NO: 195254 - DNA, 25 bp, Mus musculus
aggcgaagagctttggcgatgcccc

SEQ ID NO: 195255 - DNA, 25 bp, Mus musculus
aggcgaagtcgaactggaacataca

SEQ ID NO: 195256 - DNA, 25 bp, Mus musculus
aggcgaagtcgatctggaacataca

SEQ ID NO: 195257 - DNA, 25 bp, Mus musculus
aggcgaatattgaacatggtctgtc

SEQ ID NO: 195258 - DNA, 25 bp, Mus musculus
aggcgaatattgtacatggtctgtc

SEQ ID NO: 195259 - DNA, 25 bp, Mus musculus
aggcgaatcctgcttctcccttaaa

SEQ ID NO: 195260 - DNA, 25 bp, Mus musculus
aggcgaatcctggttctcccttaaa

SEQ ID NO: 195261 - DNA, 25 bp, Mus musculus
aggcgaatcttgctgagcttgagac

SEQ ID NO: 195262 - DNA, 25 bp, Mus musculus
aggcgaatcttggtgagcttgagac

SEQ ID NO: 195263 - DNA, 25 bp, Mus musculus
aggcgaatgcttctgcacccgtgtg

SEQ ID NO: 195264 - DNA, 25 bp, Mus musculus
aggcgaatgcttgtgcacccgtgtg

SEQ ID NO: 195265 - DNA, 25 bp, Mus musculus
aggcgacaccggatcactgtggatt

SEQ ID NO: 195266 - DNA, 25 bp, Mus musculus
aggcgacaccggttcactgtggatt

SEQ ID NO: 195267 - DNA, 25 bp, Mus musculus
aggcgacacttccatgtccaggttt

SEQ ID NO: 195268 - DNA, 25 bp, Mus musculus
aggcgacacttcgatgtccaggttt

SEQ ID NO: 195269 - DNA, 25 bp, Mus musculus
aggcgacaggtgaggctgcagatga

SEQ ID NO: 195270 - DNA, 25 bp, Mus musculus
aggcgacaggtgtggctgcagatga

SEQ ID NO: 195271 - DNA, 25 bp, Mus musculus
aggcgacatgagattcaggtgcaaa

SEQ ID NO: 195272 - DNA, 25 bp, Mus musculus
aggcgacatgagtttcaggtgcaaa

SEQ ID NO: 195273 - DNA, 25 bp, Mus musculus
aggcgacatggccatcacgtttgtg

SEQ ID NO: 195274 - DNA, 25 bp, Mus musculus
aggcgacatggcgatcacgtttgtg

SEQ ID NO: 195275 - DNA, 25 bp, Mus musculus
aggcgacccaagcagattgcatttc

SEQ ID NO: 195276 - DNA, 25 bp, Mus musculus
aggcgacccaaggagattgcatttc

SEQ ID NO: 195277 - DNA, 25 bp, Mus musculus
aggcgacccctgagcattcagatga

SEQ ID NO: 195278 - DNA, 25 bp, Mus musculus
aggcgacccctgtgcattcagatga

SEQ ID NO: 195279 - DNA, 25 bp, Mus musculus
aggcgacctaaccagacttcaggat

SEQ ID NO: 195280 - DNA, 25 bp, Mus musculus
aggcgacctaacgagacttcaggat

SEQ ID NO: 195281 - DNA, 25 bp, Mus musculus
aggcgacctccaagctacaggacat

SEQ ID NO: 195282 - DNA, 25 bp, Mus musculus
aggcgacctccatgctacaggacat

SEQ ID NO: 195283 - DNA, 25 bp, Mus musculus
aggcgacgacctcatcctagagatt

SEQ ID NO: 195284 - DNA, 25 bp, Mus musculus
aggcgacgacctgatcctagagatt

SEQ ID NO: 195285 - DNA, 25 bp, Mus musculus
aggcgactatgccacacctgagcag

SEQ ID NO: 195286 - DNA, 25 bp, Mus musculus
aggcgactatgcgacacctgagcag

SEQ ID NO: 195287 - DNA, 25 bp, Mus musculus
aggcgactcgcgcaggctaagacct

SEQ ID NO: 195288 - DNA, 25 bp, Mus musculus
aggcgactcgcggaggctaagacct

SEQ ID NO: 195289 - DNA, 25 bp, Mus musculus
aggcgactctggctggacccataaa

SEQ ID NO: 195290 - DNA, 25 bp, Mus musculus
aggcgactctgggtggacccataaa

SEQ ID NO: 195291 - DNA, 25 bp, Mus musculus
aggcgactggctagcatttccggca

SEQ ID NO: 195292 - DNA, 25 bp, Mus musculus
aggcgactggcttgcatttccggca

SEQ ID NO: 195293 - DNA, 25 bp, Mus musculus
aggcgacttatgctgagccaaccac

SEQ ID NO: 195294 - DNA, 25 bp, Mus musculus
aggcgacttatggtgagccaaccac

SEQ ID NO: 195295 - DNA, 25 bp, Mus musculus
aggcgacttcttctttaacctcagc

SEQ ID NO: 195296 - DNA, 25 bp, Mus musculus
aggcgacttcttgtttaacctcagc

SEQ ID NO: 195297 - DNA, 25 bp, Mus musculus
aggcgacttgtcacaggagctgtca

SEQ ID NO: 195298 - DNA, 25 bp, Mus musculus
aggcgacttgtctcaggagctgtca

SEQ ID NO: 195299 - DNA, 25 bp, Mus musculus
aggcgagaatgtcctgctggtccat

SEQ ID NO: 195300 - DNA, 25 bp, Mus musculus
aggcgagaatgtgctgctggtccat

SEQ ID NO: 195301 - DNA, 25 bp, Mus musculus
aggcgagaccatccatatgtccgaa

SEQ ID NO: 195302 - DNA, 25 bp, Mus musculus
aggcgagaccatgcatatgtccgaa

SEQ ID NO: 195303 - DNA, 25 bp, Mus musculus
aggcgagacgacacattttctgtta

SEQ ID NO: 195304 - DNA, 25 bp, Mus musculus
aggcgagacgactcattttctgtta

SEQ ID NO: 195305 - DNA, 25 bp, Mus musculus
aggcgagcgcttcaaacattggtat

SEQ ID NO: 195306 - DNA, 25 bp, Mus musculus
aggcgagcgcttgaaacattggtat

SEQ ID NO: 195307 - DNA, 25 bp, Mus musculus
aggcgaggaggcagacttcacccaa

SEQ ID NO: 195308 - DNA, 25 bp, Mus musculus
aggcgaggaggctgacttcacccaa

SEQ ID NO: 195309 - DNA, 25 bp, Mus musculus
aggcgaggcagcagcagttgctaaa

SEQ ID NO: 195310 - DNA, 25 bp, Mus musculus
aggcgaggcagctgcagttgctaaa

SEQ ID NO: 195311 - DNA, 25 bp, Mus musculus
aggcgaggtagaccgtcacttccca

SEQ ID NO: 195312 - DNA, 25 bp, Mus musculus
aggcgaggtagagcgtcacttccca

SEQ ID NO: 195313 - DNA, 25 bp, Mus musculus
aggcgaggtcccatctttgtgaaag

SEQ ID NO: 195314 - DNA, 25 bp, Mus musculus
aggcgaggtcccttctttgtgaaag

SEQ ID NO: 195315 - DNA, 25 bp, Mus musculus
aggcgagtaggcctcacccaagcag

SEQ ID NO: 195316 - DNA, 25 bp, Mus musculus
aggcgagtaggcgtcacccaagcag

SEQ ID NO: 195317 - DNA, 25 bp, Mus musculus
aggcgagtccctatcccaggaggag

SEQ ID NO: 195318 - DNA, 25 bp, Mus musculus
aggcgagtccctttcccaggaggag

SEQ ID NO: 195319 - DNA, 25 bp, Mus musculus
aggcgagtgaccacagtcctagtgt

SEQ ID NO: 195320 - DNA, 25 bp, Mus musculus
aggcgagtgacctcagtcctagtgt

SEQ ID NO: 195321 - DNA, 25 bp, Mus musculus
aggcgagttccacattcttcttgat

SEQ ID NO: 195322 - DNA, 25 bp, Mus musculus
aggcgagttccagattcttcttgat

SEQ ID NO: 195323 - DNA, 25 bp, Mus musculus
aggcgagttgatctaggagcataca

SEQ ID NO: 195324 - DNA, 25 bp, Mus musculus
aggcgagttgatgtaggagcataca

SEQ ID NO: 195325 - DNA, 25 bp, Mus musculus
aggcgataacaacggccccaagtct

SEQ ID NO: 195326 - DNA, 25 bp, Mus musculus
aggcgataacaagggccccaagtct

SEQ ID NO: 195327 - DNA, 25 bp, Mus musculus
aggcgatcagatcagcttggtaagc

SEQ ID NO: 195328 - DNA, 25 bp, Mus musculus
aggcgatcagatgagcttggtaagc

SEQ ID NO: 195329 - DNA, 25 bp, Mus musculus
aggcgatcctcaaatacactgcgta

SEQ ID NO: 195330 - DNA, 25 bp, Mus musculus
aggcgatcctcatatacactgcgta

SEQ ID NO: 195331 - DNA, 25 bp, Mus musculus
aggcgatcctctcgacaagagcatt

SEQ ID NO: 195332 - DNA, 25 bp, Mus musculus
aggcgatcctctggacaagagcatt

SEQ ID NO: 195333 - DNA, 25 bp, Mus musculus
aggcgatgacaaaccttgttgtttc

SEQ ID NO: 195334 - DNA, 25 bp, Mus musculus
aggcgatgacaatccttgttgtttc

SEQ ID NO: 195335 - DNA, 25 bp, Mus musculus
aggcgatgctacagagagccgctcg

SEQ ID NO: 195336 - DNA, 25 bp, Mus musculus
aggcgatgctactgagagccgctcg

SEQ ID NO: 195337 - DNA, 25 bp, Mus musculus
aggcgatggatcagcagcacggcca

SEQ ID NO: 195338 - DNA, 25 bp, Mus musculus
aggcgatggatctgcagcacggcca

SEQ ID NO: 195339 - DNA, 25 bp, Mus musculus
aggcgatggctcagtcactgactct

SEQ ID NO: 195340 - DNA, 25 bp, Mus musculus
aggcgatggctctgtcactgactct

SEQ ID NO: 195341 - DNA, 25 bp, Mus musculus
aggcgatgtagaaatgactgtggat

SEQ ID NO: 195342 - DNA, 25 bp, Mus musculus
aggcgatgtagatatgactgtggat

SEQ ID NO: 195343 - DNA, 25 bp, Mus musculus
aggcgatgtttcctttgtttgccat

SEQ ID NO: 195344 - DNA, 25 bp, Mus musculus
aggcgatgtttcgtttgtttgccat

SEQ ID NO: 195345 - DNA, 25 bp, Mus musculus
aggcgattatctaggttgtatgttt

SEQ ID NO: 195346 - DNA, 25 bp, Mus musculus
aggcgattatcttggttgtatgttt

SEQ ID NO: 195347 - DNA, 25 bp, Mus musculus
aggcgcaaatgtcccagctaagctg

SEQ ID NO: 195348 - DNA, 25 bp, Mus musculus
aggcgcaaatgtgccagctaagctg

SEQ ID NO: 195349 - DNA, 25 bp, Mus musculus
aggcgcaagccaagcagcctgtgga

SEQ ID NO: 195350 - DNA, 25 bp, Mus musculus
aggcgcaagccatgcagcctgtgga

SEQ ID NO: 195351 - DNA, 25 bp, Mus musculus
aggcgcaagtggaagaggctgggca

SEQ ID NO: 195352 - DNA, 25 bp, Mus musculus
aggcgcaagtggtagaggctgggca

SEQ ID NO: 195353 - DNA, 25 bp, Mus musculus
aggcgcacacagctgacccatatgt

SEQ ID NO: 195354 - DNA, 25 bp, Mus musculus
aggcgcacacaggtgacccatatgt

SEQ ID NO: 195355 - DNA, 25 bp, Mus musculus
aggcgcaccgatcttgagtgactca

SEQ ID NO: 195356 - DNA, 25 bp, Mus musculus
aggcgcaccgatgttgagtgactca

SEQ ID NO: 195357 - DNA, 25 bp, Mus musculus
aggcgcaccgtgaacgagctggaaa

SEQ ID NO: 195358 - DNA, 25 bp, Mus musculus
aggcgcaccgtgtacgagctggaaa

SEQ ID NO: 195359 - DNA, 25 bp, Mus musculus
aggcgcacctcaaggtcctcctgga

SEQ ID NO: 195360 - DNA, 25 bp, Mus musculus
aggcgcacctcatggtcctcctgga

SEQ ID NO: 195361 - DNA, 25 bp, Mus musculus
aggcgcacgtgtcaggtccagcact

SEQ ID NO: 195362 - DNA, 25 bp, Mus musculus
aggcgcacgtgtgaggtccagcact

SEQ ID NO: 195363 - DNA, 25 bp, Mus musculus
aggcgcagaagccttagctccagat

SEQ ID NO: 195364 - DNA, 25 bp, Mus musculus
aggcgcagaagcgttagctccagat

SEQ ID NO: 195365 - DNA, 25 bp, Mus musculus
aggcgcagatgtcccaacaacgacc

SEQ ID NO: 195366 - DNA, 25 bp, Mus musculus
aggcgcagatgtgccaacaacgacc

SEQ ID NO: 195367 - DNA, 25 bp, Mus musculus
aggcgcagccttcgtgtcacaaatg

SEQ ID NO: 195368 - DNA, 25 bp, Mus musculus
aggcgcagccttggtgtcacaaatg

SEQ ID NO: 195369 - DNA, 25 bp, Mus musculus
aggcgcagctttcccggtggaacat

SEQ ID NO: 195370 - DNA, 25 bp, Mus musculus
aggcgcagctttgccggtggaacat

SEQ ID NO: 195371 - DNA, 25 bp, Mus musculus
aggcgcagtcctatgagccgagagc

SEQ ID NO: 195372 - DNA, 25 bp, Mus musculus
aggcgcagtcctttgagccgagagc

SEQ ID NO: 195373 - DNA, 25 bp, Mus musculus
aggcgcagttccaacattcacgtta

SEQ ID NO: 195374 - DNA, 25 bp, Mus musculus
aggcgcagttcctacattcacgtta

SEQ ID NO: 195375 - DNA, 25 bp, Mus musculus
aggcgcatcccgattcaagaaagta

SEQ ID NO: 195376 - DNA, 25 bp, Mus musculus
aggcgcatcccgtttcaagaaagta

SEQ ID NO: 195377 - DNA, 25 bp, Mus musculus
aggcgcatgagtattgcctgaggca

SEQ ID NO: 195378 - DNA, 25 bp, Mus musculus
aggcgcatgagttttgcctgaggca

SEQ ID NO: 195379 - DNA, 25 bp, Mus musculus
aggcgccagctcagtgaggctgttt

SEQ ID NO: 195380 - DNA, 25 bp, Mus musculus
aggcgccagctctgtgaggctgttt

SEQ ID NO: 195381 - DNA, 25 bp, Mus musculus
aggcgccattgcagccatcgtgatc

SEQ ID NO: 195382 - DNA, 25 bp, Mus musculus
aggcgccattgctgccatcgtgatc

SEQ ID NO: 195383 - DNA, 25 bp, Mus musculus
aggcgcccaattcgaggtgcggcca

SEQ ID NO: 195384 - DNA, 25 bp, Mus musculus
aggcgcccaattggaggtgcggcca

SEQ ID NO: 195385 - DNA, 25 bp, Mus musculus
aggcgcccctagacagtagtggcta

SEQ ID NO: 195386 - DNA, 25 bp, Mus musculus
aggcgcccctagtcagtagtggcta

SEQ ID NO: 195387 - DNA, 25 bp, Mus musculus
aggcgccctgctagtcatatcagta

SEQ ID NO: 195388 - DNA, 25 bp, Mus musculus
aggcgccctgcttgtcatatcagta

SEQ ID NO: 195389 - DNA, 25 bp, Mus musculus
aggcgcccttggactgaccagaagt

SEQ ID NO: 195390 - DNA, 25 bp, Mus musculus
aggcgcccttggtctgaccagaagt

SEQ ID NO: 195391 - DNA, 25 bp, Mus musculus
aggcgcctcctaagggcagggaaat

SEQ ID NO: 195392 - DNA, 25 bp, Mus musculus
aggcgcctcctatgggcagggaaat

SEQ ID NO: 195393 - DNA, 25 bp, Mus musculus
aggcgcctcctcatgtcagggtgac

SEQ ID NO: 195394 - DNA, 25 bp, Mus musculus
aggcgcctcctcttgtcagggtgac

SEQ ID NO: 195395 - DNA, 25 bp, Mus musculus
aggcgcctgcaacagctgtttagtc

SEQ ID NO: 195396 - DNA, 25 bp, Mus musculus
aggcgcctgcaagagctgtttagtc

SEQ ID NO: 195397 - DNA, 25 bp, Mus musculus
aggcgccttctgacggtatgcagat

SEQ ID NO: 195398 - DNA, 25 bp, Mus musculus
aggcgccttctgtcggtatgcagat

SEQ ID NO: 195399 - DNA, 25 bp, Mus musculus
aggcgcctttgacgactccctgtga

SEQ ID NO: 195400 - DNA, 25 bp, Mus musculus
aggcgcctttgaggactccctgtga

SEQ ID NO: 195401 - DNA, 25 bp, Mus musculus
aggcgccttttgatgtacttgtgtg

SEQ ID NO: 195402 - DNA, 25 bp, Mus musculus
aggcgccttttgttgtacttgtgtg

SEQ ID NO: 195403 - DNA, 25 bp, Mus musculus
aggcgcgcctgcatgaagatgtatt

SEQ ID NO: 195404 - DNA, 25 bp, Mus musculus
aggcgcgcctgcttgaagatgtatt

SEQ ID NO: 195405 - DNA, 25 bp, Mus musculus
aggcgcgttgccagctcctgttcgc

SEQ ID NO: 195406 - DNA, 25 bp, Mus musculus
aggcgcgttgcctgctcctgttcgc

SEQ ID NO: 195407 - DNA, 25 bp, Mus musculus
aggcgctaccagatgtctcgcgata

SEQ ID NO: 195408 - DNA, 25 bp, Mus musculus
aggcgctaccagttgtctcgcgata

SEQ ID NO: 195409 - DNA, 25 bp, Mus musculus
aggcgctagcccaatcccattgcgg

SEQ ID NO: 195410 - DNA, 25 bp, Mus musculus
aggcgctagccctatcccattgcgg

SEQ ID NO: 195411 - DNA, 25 bp, Mus musculus
aggcgctatgaacagacctggaaac

SEQ ID NO: 195412 - DNA, 25 bp, Mus musculus
aggcgctatgaagagacctggaaac

SEQ ID NO: 195413 - DNA, 25 bp, Mus musculus
aggcgctcaagtcctggctcagcaa

SEQ ID NO: 195414 - DNA, 25 bp, Mus musculus
aggcgctcaagtgctggctcagcaa

SEQ ID NO: 195415 - DNA, 25 bp, Mus musculus
aggcgctcaccaatagggagcttca

SEQ ID NO: 195416 - DNA, 25 bp, Mus musculus
aggcgctcaccattagggagcttca

SEQ ID NO: 195417 - DNA, 25 bp, Mus musculus
aggcgctcatgacgccagtcatcag

SEQ ID NO: 195418 - DNA, 25 bp, Mus musculus
aggcgctcatgaggccagtcatcag

SEQ ID NO: 195419 - DNA, 25 bp, Mus musculus
aggcgctcccggacggtgtcaacat

SEQ ID NO: 195420 - DNA, 25 bp, Mus musculus
aggcgctcccggtcggtgtcaacat

SEQ ID NO: 195421 - DNA, 25 bp, Mus musculus
aggcgctccggcatgatgagaccca

SEQ ID NO: 195422 - DNA, 25 bp, Mus musculus
aggcgctccggcttgatgagaccca

SEQ ID NO: 195423 - DNA, 25 bp, Mus musculus
aggcgctctagaagcacaatccaat

SEQ ID NO: 195424 - DNA, 25 bp, Mus musculus
aggcgctctagatgcacaatccaat

SEQ ID NO: 195425 - DNA, 25 bp, Mus musculus
aggcgctctctgaggttcttagggc

SEQ ID NO: 195426 - DNA, 25 bp, Mus musculus
aggcgctctctgtggttcttagggc

SEQ ID NO: 195427 - DNA, 25 bp, Mus musculus
aggcgctctgagcacacacattcta

SEQ ID NO: 195428 - DNA, 25 bp, Mus musculus
aggcgctctgaggacacacattcta

SEQ ID NO: 195429 - DNA, 25 bp, Mus musculus
aggcgctcttatacttgagtctgca

SEQ ID NO: 195430 - DNA, 25 bp, Mus musculus
aggcgctcttattcttgagtctgca

SEQ ID NO: 195431 - DNA, 25 bp, Mus musculus
aggcgctgaactccaggtcctaagt

SEQ ID NO: 195432 - DNA, 25 bp, Mus musculus
aggcgctgaactgcaggtcctaagt

SEQ ID NO: 195433 - DNA, 25 bp, Mus musculus
aggcgctgacagataccactgtgtt

SEQ ID NO: 195434 - DNA, 25 bp, Mus musculus
aggcgctgacagttaccactgtgtt

SEQ ID NO: 195435 - DNA, 25 bp, Mus musculus
aggcgctgcccgacacagacgtgct

SEQ ID NO: 195436 - DNA, 25 bp, Mus musculus
aggcgctgcccgtcacagacgtgct

SEQ ID NO: 195437 - DNA, 25 bp, Mus musculus
aggcgctgccggatacgtaaagatg

SEQ ID NO: 195438 - DNA, 25 bp, Mus musculus
aggcgctgccggttacgtaaagatg

SEQ ID NO: 195439 - DNA, 25 bp, Mus musculus
aggcgctgctgcacacagcatcagc

SEQ ID NO: 195440 - DNA, 25 bp, Mus musculus
aggcgctgctgctcacagcatcagc

SEQ ID NO: 195441 - DNA, 25 bp, Mus musculus
aggcgctggagcagcatgactacca

SEQ ID NO: 195442 - DNA, 25 bp, Mus musculus
aggcgctggagctgcatgactacca

SEQ ID NO: 195443 - DNA, 25 bp, Mus musculus
aggcgctgggttccctcttcagcac

SEQ ID NO: 195444 - DNA, 25 bp, Mus musculus
aggcgctgggttgcctcttcagcac

SEQ ID NO: 195445 - DNA, 25 bp, Mus musculus
aggcgctttcagctttttctcaaga

SEQ ID NO: 195446 - DNA, 25 bp, Mus musculus
aggcgctttcaggtttttctcaaga

SEQ ID NO: 195447 - DNA, 25 bp, Mus musculus
aggcgctttgataaccccgattgaa

SEQ ID NO: 195448 - DNA, 25 bp, Mus musculus
aggcgctttgattaccccgattgaa

SEQ ID NO: 195449 - DNA, 25 bp, Mus musculus
aggcggaaaagtcacctgctccgga

SEQ ID NO: 195450 - DNA, 25 bp, Mus musculus
aggcggaaaagtgacctgctccgga

SEQ ID NO: 195451 - DNA, 25 bp, Mus musculus
aggcggaagctccatgtctctgtga

SEQ ID NO: 195452 - DNA, 25 bp, Mus musculus
aggcggaagctcgatgtctctgtga

SEQ ID NO: 195453 - DNA, 25 bp, Mus musculus
aggcggaaggcccaccttgccaaag

SEQ ID NO: 195454 - DNA, 25 bp, Mus musculus
aggcggaaggccgaccttgccaaag

SEQ ID NO: 195455 - DNA, 25 bp, Mus musculus
aggcggacagacacctcacaggtgt

SEQ ID NO: 195456 - DNA, 25 bp, Mus musculus
aggcggacagactcctcacaggtgt

SEQ ID NO: 195457 - DNA, 25 bp, Mus musculus
aggcggactgaacattgctctagct

SEQ ID NO: 195458 - DNA, 25 bp, Mus musculus
aggcggactgaagattgctctagct

SEQ ID NO: 195459 - DNA, 25 bp, Mus musculus
aggcggactgttactgagctgcgtt

SEQ ID NO: 195460 - DNA, 25 bp, Mus musculus
aggcggactgttagtactgacctcg

SEQ ID NO: 195461 - DNA, 25 bp, Mus musculus
aggcggactgtttctgagctgcgtt

SEQ ID NO: 195462 - DNA, 25 bp, Mus musculus
aggcggactgtttgtactgacctcg

SEQ ID NO: 195463 - DNA, 25 bp, Mus musculus
aggcggagcagcaggccagtaccaa

SEQ ID NO: 195464 - DNA, 25 bp, Mus musculus
aggcggagcagctggccagtaccaa

SEQ ID NO: 195465 - DNA, 25 bp, Mus musculus
aggcggagtagcagctttactctgt

SEQ ID NO: 195466 - DNA, 25 bp, Mus musculus
aggcggagtagctgctttactctgt

SEQ ID NO: 195467 - DNA, 25 bp, Mus musculus
aggcggcaacacacgctgccataaa

SEQ ID NO: 195468 - DNA, 25 bp, Mus musculus
aggcggcaacactcgctgccataaa

SEQ ID NO: 195469 - DNA, 25 bp, Mus musculus
aggcggcaatcacgtgtttcttcca

SEQ ID NO: 195470 - DNA, 25 bp, Mus musculus
aggcggcaatcaggtgtttcttcca

SEQ ID NO: 195471 - DNA, 25 bp, Mus musculus
aggcggcacaaaatgtttttgcaca

SEQ ID NO: 195472 - DNA, 25 bp, Mus musculus
aggcggcacaaattgtttttgcaca

SEQ ID NO: 195473 - DNA, 25 bp, Mus musculus
aggcggcacctgctattgaccatgc

SEQ ID NO: 195474 - DNA, 25 bp, Mus musculus
aggcggcacctggtattgaccatgc

SEQ ID NO: 195475 - DNA, 25 bp, Mus musculus
aggcggcatcgaagatccatcctaa

SEQ ID NO: 195476 - DNA, 25 bp, Mus musculus
aggcggcatcgatgatccatcctaa

SEQ ID NO: 195477 - DNA, 25 bp, Mus musculus
aggcggccaaatctcttttcaagaa

SEQ ID NO: 195478 - DNA, 25 bp, Mus musculus
aggcggccaaatgtcttttcaagaa

SEQ ID NO: 195479 - DNA, 25 bp, Mus musculus
aggcggccaagcatttttcttcagt

SEQ ID NO: 195480 - DNA, 25 bp, Mus musculus
aggcggccaagcttttttcttcagt

SEQ ID NO: 195481 - DNA, 25 bp, Mus musculus
aggcggcccaagcacagtacgttca

SEQ ID NO: 195482 - DNA, 25 bp, Mus musculus
aggcggcccaaggacagtacgttca

SEQ ID NO: 195483 - DNA, 25 bp, Mus musculus
aggcggcccataccagcacggtaag

SEQ ID NO: 195484 - DNA, 25 bp, Mus musculus
aggcggcccatagcagcacggtaag

SEQ ID NO: 195485 - DNA, 25 bp, Mus musculus
aggcggcccgagatatcgtgcagtt

SEQ ID NO: 195486 - DNA, 25 bp, Mus musculus
aggcggcccgagctgtgcacatttt

SEQ ID NO: 195487 - DNA, 25 bp, Mus musculus
aggcggcccgaggtgtgcacatttt

SEQ ID NO: 195488 - DNA, 25 bp, Mus musculus
aggcggcccgagttatcgtgcagtt

SEQ ID NO: 195489 - DNA, 25 bp, Mus musculus
aggcggcctgtgcagacgacttcat

SEQ ID NO: 195490 - DNA, 25 bp, Mus musculus
aggcggcctgtggagacgacttcat

SEQ ID NO: 195491 - DNA, 25 bp, Mus musculus
aggcggccttggcacatgtgcttct

SEQ ID NO: 195492 - DNA, 25 bp, Mus musculus
aggcggccttgggacatgtgcttct

SEQ ID NO: 195493 - DNA, 25 bp, Mus musculus
aggcggcgatgtctgtccagttcat

SEQ ID NO: 195494 - DNA, 25 bp, Mus musculus
aggcggcgatgtgtgtccagttcat

SEQ ID NO: 195495 - DNA, 25 bp, Mus musculus
aggcggctccacctcaaagagaaag

SEQ ID NO: 195496 - DNA, 25 bp, Mus musculus
aggcggctccacgtcaaagagaaag

SEQ ID NO: 195497 - DNA, 25 bp, Mus musculus
aggcggctgaacctgttatcctgga

SEQ ID NO: 195498 - DNA, 25 bp, Mus musculus
aggcggctgaacgtgttatcctgga

SEQ ID NO: 195499 - DNA, 25 bp, Mus musculus
aggcggctgcacagctaccaagtgt

SEQ ID NO: 195500 - DNA, 25 bp, Mus musculus
aggcggctgcactgctaccaagtgt

SEQ ID NO: 195501 - DNA, 25 bp, Mus musculus
aggcggctgcagaacagccctaggc

SEQ ID NO: 195502 - DNA, 25 bp, Mus musculus
aggcggctgcagtacagccctaggc

SEQ ID NO: 195503 - DNA, 25 bp, Mus musculus
aggcggcttctgctggtttcaagac

SEQ ID NO: 195504 - DNA, 25 bp, Mus musculus
aggcggcttctggtggtttcaagac

SEQ ID NO: 195505 - DNA, 25 bp, Mus musculus
aggcggcttggtcccctcaacaatt

SEQ ID NO: 195506 - DNA, 25 bp, Mus musculus
aggcggcttggtgccctcaacaatt

SEQ ID NO: 195507 - DNA, 25 bp, Mus musculus
aggcgggaacaaactagccctcaag

SEQ ID NO: 195508 - DNA, 25 bp, Mus musculus
aggcgggaacaatctagccctcaag

SEQ ID NO: 195509 - DNA, 25 bp, Mus musculus
aggcgggaataccatctagctgtct

SEQ ID NO: 195510 - DNA, 25 bp, Mus musculus
aggcgggaatacgatctagctgtct

SEQ ID NO: 195511 - DNA, 25 bp, Mus musculus
aggcgggactgcatgttgagctcat

SEQ ID NO: 195512 - DNA, 25 bp, Mus musculus
aggcgggactgcttgttgagctcat

SEQ ID NO: 195513 - DNA, 25 bp, Mus musculus
aggcgggagcccaaaggcagcaatt

SEQ ID NO: 195514 - DNA, 25 bp, Mus musculus
aggcgggagccctaaggcagcaatt

SEQ ID NO: 195515 - DNA, 25 bp, Mus musculus
aggcgggatctcatgactctcggac

SEQ ID NO: 195516 - DNA, 25 bp, Mus musculus
aggcgggatctcttgactctcggac

SEQ ID NO: 195517 - DNA, 25 bp, Mus musculus
aggcgggcacaccttagtccctctg

SEQ ID NO: 195518 - DNA, 25 bp, Mus musculus
aggcgggcacacgttagtccctctg

SEQ ID NO: 195519 - DNA, 25 bp, Mus musculus
aggcgggcagctatgggtccctaca

SEQ ID NO: 195520 - DNA, 25 bp, Mus musculus
aggcgggcagctttgggtccctaca

SEQ ID NO: 195521 - DNA, 25 bp, Mus musculus
aggcgggcattgagctctatacttg

SEQ ID NO: 195522 - DNA, 25 bp, Mus musculus
aggcgggcattgtgctctatacttg

SEQ ID NO: 195523 - DNA, 25 bp, Mus musculus
aggcgggtgtctcttggaagacctc

SEQ ID NO: 195524 - DNA, 25 bp, Mus musculus
aggcgggtgtctgttggaagacctc

SEQ ID NO: 195525 - DNA, 25 bp, Mus musculus
aggcggtaaagaccctttctgggca

SEQ ID NO: 195526 - DNA, 25 bp, Mus musculus
aggcggtaaagagcctttctgggca

SEQ ID NO: 195527 - DNA, 25 bp, Mus musculus
aggcggtacctcaagatcccctttg

SEQ ID NO: 195528 - DNA, 25 bp, Mus musculus
aggcggtacctctagatcccctttg

SEQ ID NO: 195529 - DNA, 25 bp, Mus musculus
aggcggtcaacgctctccagatgtg

SEQ ID NO: 195530 - DNA, 25 bp, Mus musculus
aggcggtcaacggtctccagatgtg

SEQ ID NO: 195531 - DNA, 25 bp, Mus musculus
aggcggtcctggcaacagagctttt

SEQ ID NO: 195532 - DNA, 25 bp, Mus musculus
aggcggtcctgggaacagagctttt

SEQ ID NO: 195533 - DNA, 25 bp, Mus musculus
aggcggtcggccacaaagctcgcca

SEQ ID NO: 195534 - DNA, 25 bp, Mus musculus
aggcggtcggcctcaaagctcgcca

SEQ ID NO: 195535 - DNA, 25 bp, Mus musculus
aggcggtctgctcaggctttcttga

SEQ ID NO: 195536 - DNA, 25 bp, Mus musculus
aggcggtctgctgaggctttcttga

SEQ ID NO: 195537 - DNA, 25 bp, Mus musculus
aggcggtgaaccaagcaatccaaag

SEQ ID NO: 195538 - DNA, 25 bp, Mus musculus
aggcggtgaacctagcaatccaaag

SEQ ID NO: 195539 - DNA, 25 bp, Mus musculus
aggcggtgatatctctaagaatgtg

SEQ ID NO: 195540 - DNA, 25 bp, Mus musculus
aggcggtgatatgtctaagaatgtg

SEQ ID NO: 195541 - DNA, 25 bp, Mus musculus
aggcggtgctcaatggtgtttgtac

SEQ ID NO: 195542 - DNA, 25 bp, Mus musculus
aggcggtgctcattggtgtttgtac

SEQ ID NO: 195543 - DNA, 25 bp, Mus musculus
aggcggtggtgtccacattacatga

SEQ ID NO: 195544 - DNA, 25 bp, Mus musculus
aggcggtggtgtgcacattacatga

SEQ ID NO: 195545 - DNA, 25 bp, Mus musculus
aggcggtgttcacagcatgcatgac

SEQ ID NO: 195546 - DNA, 25 bp, Mus musculus
aggcggtgttcagagcatgcatgac

SEQ ID NO: 195547 - DNA, 25 bp, Mus musculus
aggcggttccagattgaaattgtat

SEQ ID NO: 195548 - DNA, 25 bp, Mus musculus
aggcggttccagtttgaaattgtat

SEQ ID NO: 195549 - DNA, 25 bp, Mus musculus
aggcggttttgtaatgtatacattt

SEQ ID NO: 195550 - DNA, 25 bp, Mus musculus
aggcggttttgttatgtatacattt

SEQ ID NO: 195551 - DNA, 25 bp, Mus musculus
aggcgtacaggtcgcctctcaggct

SEQ ID NO: 195552 - DNA, 25 bp, Mus musculus
aggcgtacaggtggcctctcaggct

SEQ ID NO: 195553 - DNA, 25 bp, Mus musculus
aggcgtacagtcacctcctgtgtta

SEQ ID NO: 195554 - DNA, 25 bp, Mus musculus
aggcgtacagtctcctcctgtgtta

SEQ ID NO: 195555 - DNA, 25 bp, Mus musculus
aggcgtaccttgatatagtcttagt

SEQ ID NO: 195556 - DNA, 25 bp, Mus musculus
aggcgtaccttgttatagtcttagt

SEQ ID NO: 195557 - DNA, 25 bp, Mus musculus
aggcgtagggtcagagcaccaccat

SEQ ID NO: 195558 - DNA, 25 bp, Mus musculus
aggcgtagggtctgagcaccaccat

SEQ ID NO: 195559 - DNA, 25 bp, Mus musculus
aggcgtatcctcataaatgtgacat

SEQ ID NO: 195560 - DNA, 25 bp, Mus musculus
aggcgtatcctcttaaatgtgacat

SEQ ID NO: 195561 - DNA, 25 bp, Mus musculus
aggcgtattataatatcttggttgt

SEQ ID NO: 195562 - DNA, 25 bp, Mus musculus
aggcgtattatattatcttggttgt

SEQ ID NO: 195563 - DNA, 25 bp, Mus musculus
aggcgtcacccactaacacggtgtg

SEQ ID NO: 195564 - DNA, 25 bp, Mus musculus
aggcgtcacccagtaacacggtgtg

SEQ ID NO: 195565 - DNA, 25 bp, Mus musculus
aggcgtcaggacctctaacttgaac

SEQ ID NO: 195566 - DNA, 25 bp, Mus musculus
aggcgtcaggacgtctaacttgaac

SEQ ID NO: 195567 - DNA, 25 bp, Mus musculus
aggcgtcagtgcagcgtgccacagg

SEQ ID NO: 195568 - DNA, 25 bp, Mus musculus
aggcgtcagtgctgcgtgccacagg

SEQ ID NO: 195569 - DNA, 25 bp, Mus musculus
aggcgtcattaaagcttgtctccca

SEQ ID NO: 195570 - DNA, 25 bp, Mus musculus
aggcgtcattaatgcttgtctccca

SEQ ID NO: 195571 - DNA, 25 bp, Mus musculus
aggcgtccaacgaatcaacttaaag

SEQ ID NO: 195572 - DNA, 25 bp, Mus musculus
aggcgtccaacgtatcaacttaaag

SEQ ID NO: 195573 - DNA, 25 bp, Mus musculus
aggcgtccagacctacctataggag

SEQ ID NO: 195574 - DNA, 25 bp, Mus musculus
aggcgtccagacgtacctataggag

SEQ ID NO: 195575 - DNA, 25 bp, Mus musculus
aggcgtcccaaacccacgtggctgg

SEQ ID NO: 195576 - DNA, 25 bp, Mus musculus
aggcgtcccaaagccacgtggctgg

SEQ ID NO: 195577 - DNA, 25 bp, Mus musculus
aggcgtccccgacgcagaaaatgca

SEQ ID NO: 195578 - DNA, 25 bp, Mus musculus
aggcgtccccgaggcagaaaatgca

SEQ ID NO: 195579 - DNA, 25 bp, Mus musculus
aggcgtcgcacgaatatttgcagtg

SEQ ID NO: 195580 - DNA, 25 bp, Mus musculus
aggcgtcgcacgtatatttgcagtg

SEQ ID NO: 195581 - DNA, 25 bp, Mus musculus
aggcgtcgcagtcagtactgttaca

SEQ ID NO: 195582 - DNA, 25 bp, Mus musculus
aggcgtcgcagtgagtactgttaca

SEQ ID NO: 195583 - DNA, 25 bp, Mus musculus
aggcgtcgtacgctgcctccaggtc

SEQ ID NO: 195584 - DNA, 25 bp, Mus musculus
aggcgtcgtacggtgcctccaggtc

SEQ ID NO: 195585 - DNA, 25 bp, Mus musculus
aggcgtctacagaacttagcgtgta

SEQ ID NO: 195586 - DNA, 25 bp, Mus musculus
aggcgtctacagtacttagcgtgta

SEQ ID NO: 195587 - DNA, 25 bp, Mus musculus
aggcgtctatctccctgtggtgaca

SEQ ID NO: 195588 - DNA, 25 bp, Mus musculus
aggcgtctatctgcctgtggtgaca

SEQ ID NO: 195589 - DNA, 25 bp, Mus musculus
aggcgtctctttcttgaggtttgac

SEQ ID NO: 195590 - DNA, 25 bp, Mus musculus
aggcgtctctttgttgaggtttgac

SEQ ID NO: 195591 - DNA, 25 bp, Mus musculus
aggcgtctggagacctcttgaagat

SEQ ID NO: 195592 - DNA, 25 bp, Mus musculus
aggcgtctggagtcctcttgaagat

SEQ ID NO: 195593 - DNA, 25 bp, Mus musculus
aggcgtctggccagaacgagcagaa

SEQ ID NO: 195594 - DNA, 25 bp, Mus musculus
aggcgtctggcctgaacgagcagaa

SEQ ID NO: 195595 - DNA, 25 bp, Mus musculus
aggcgtctgggcaatctctttttaa

SEQ ID NO: 195596 - DNA, 25 bp, Mus musculus
aggcgtctgggctatctctttttaa

SEQ ID NO: 195597 - DNA, 25 bp, Mus musculus
aggcgtcttaccaggcggataagaa

SEQ ID NO: 195598 - DNA, 25 bp, Mus musculus
aggcgtcttacctggcggataagaa

SEQ ID NO: 195599 - DNA, 25 bp, Mus musculus
aggcgtgacctgatgttcctgtacc

SEQ ID NO: 195600 - DNA, 25 bp, Mus musculus
aggcgtgacctgttgttcctgtacc

SEQ ID NO: 195601 - DNA, 25 bp, Mus musculus
aggcgtgacttccacaagagtttat

SEQ ID NO: 195602 - DNA, 25 bp, Mus musculus
aggcgtgacttcgacaagagtttat

SEQ ID NO: 195603 - DNA, 25 bp, Mus musculus
aggcgtgagaccataggctgacata

SEQ ID NO: 195604 - DNA, 25 bp, Mus musculus
aggcgtgagaccttaggctgacata

SEQ ID NO: 195605 - DNA, 25 bp, Mus musculus
aggcgtgatcctcagttgggaaaat

SEQ ID NO: 195606 - DNA, 25 bp, Mus musculus
aggcgtgatcctgagttgggaaaat

SEQ ID NO: 195607 - DNA, 25 bp, Mus musculus
aggcgtgccagccattaggaagccc

SEQ ID NO: 195608 - DNA, 25 bp, Mus musculus
aggcgtgccagcgattaggaagccc

SEQ ID NO: 195609 - DNA, 25 bp, Mus musculus
aggcgtgcctccaaaggcatgtgga

SEQ ID NO: 195610 - DNA, 25 bp, Mus musculus
aggcgtgcctcctaaggcatgtgga

SEQ ID NO: 195611 - DNA, 25 bp, Mus musculus
aggcgtgctgcgaatattttcatca

SEQ ID NO: 195612 - DNA, 25 bp, Mus musculus
aggcgtgctgcgtatattttcatca

SEQ ID NO: 195613 - DNA, 25 bp, Mus musculus
aggcgtggaatcaacttgcttccta

SEQ ID NO: 195614 - DNA, 25 bp, Mus musculus
aggcgtggaatctacttgcttccta

SEQ ID NO: 195615 - DNA, 25 bp, Mus musculus
aggcgtggcagcacctcataggctg

SEQ ID NO: 195616 - DNA, 25 bp, Mus musculus
aggcgtggcagctcctcataggctg

SEQ ID NO: 195617 - DNA, 25 bp, Mus musculus
aggcgtggcagtctgcactcaatca

SEQ ID NO: 195618 - DNA, 25 bp, Mus musculus
aggcgtggcagtgtgcactcaatca

SEQ ID NO: 195619 - DNA, 25 bp, Mus musculus
aggcgtggcttacacagtttgcaac

SEQ ID NO: 195620 - DNA, 25 bp, Mus musculus
aggcgtggcttagacagtttgcaac

SEQ ID NO: 195621 - DNA, 25 bp, Mus musculus
aggcgtgtaagcaggcccaatccaa

SEQ ID NO: 195622 - DNA, 25 bp, Mus musculus
aggcgtgtaagctggcccaatccaa

SEQ ID NO: 195623 - DNA, 25 bp, Mus musculus
aggcgtgtacacaaggctccctgta

SEQ ID NO: 195624 - DNA, 25 bp, Mus musculus
aggcgtgtacactaggctccctgta

SEQ ID NO: 195625 - DNA, 25 bp, Mus musculus
aggcgtgtgacgcacatctcgagat

SEQ ID NO: 195626 - DNA, 25 bp, Mus musculus
aggcgtgtgacggacatctcgagat

SEQ ID NO: 195627 - DNA, 25 bp, Mus musculus
aggcgtgttactacagtgccgacat

SEQ ID NO: 195628 - DNA, 25 bp, Mus musculus
aggcgtgttacttcagtgccgacat

SEQ ID NO: 195629 - DNA, 25 bp, Mus musculus
aggcgtgtttgacagataggtttac

SEQ ID NO: 195630 - DNA, 25 bp, Mus musculus
aggcgtgtttgagagataggtttac

SEQ ID NO: 195631 - DNA, 25 bp, Mus musculus
aggcgttagaatacttgcaggcttt

SEQ ID NO: 195632 - DNA, 25 bp, Mus musculus
aggcgttagaattcttgcaggcttt

SEQ ID NO: 195633 - DNA, 25 bp, Mus musculus
aggcgttagcttaacccaaaatgca

SEQ ID NO: 195634 - DNA, 25 bp, Mus musculus
aggcgttagctttacccaaaatgca

SEQ ID NO: 195635 - DNA, 25 bp, Mus musculus
aggcgttattgcctaatcccacatc

SEQ ID NO: 195636 - DNA, 25 bp, Mus musculus
aggcgttattgcgtaatcccacatc

SEQ ID NO: 195637 - DNA, 25 bp, Mus musculus
aggcgttcaagcagagacactcata

SEQ ID NO: 195638 - DNA, 25 bp, Mus musculus
aggcgttcaagctgagacactcata

SEQ ID NO: 195639 - DNA, 25 bp, Mus musculus
aggcgttcagctccttggaattacg

SEQ ID NO: 195640 - DNA, 25 bp, Mus musculus
aggcgttcagctgcttggaattacg

SEQ ID NO: 195641 - DNA, 25 bp, Mus musculus
aggcgttcattaaaggctccatgga

SEQ ID NO: 195642 - DNA, 25 bp, Mus musculus
aggcgttcattataggctccatgga

SEQ ID NO: 195643 - DNA, 25 bp, Mus musculus
aggcgttcccagaaggctgcatgca

SEQ ID NO: 195644 - DNA, 25 bp, Mus musculus
aggcgttcccagtaggctgcatgca

SEQ ID NO: 195645 - DNA, 25 bp, Mus musculus
aggcgttcccggactgggtgcacaa

SEQ ID NO: 195646 - DNA, 25 bp, Mus musculus
aggcgttcccggtctgggtgcacaa

SEQ ID NO: 195647 - DNA, 25 bp, Mus musculus
aggcgttcgtttacgttcagacaga

SEQ ID NO: 195648 - DNA, 25 bp, Mus musculus
aggcgttcgttttcgttcagacaga

SEQ ID NO: 195649 - DNA, 25 bp, Mus musculus
aggcgttctcagctttgggcacata

SEQ ID NO: 195650 - DNA, 25 bp, Mus musculus
aggcgttctcaggtttgggcacata

SEQ ID NO: 195651 - DNA, 25 bp, Mus musculus
aggcgttgcctcaccagatgtgccg

SEQ ID NO: 195652 - DNA, 25 bp, Mus musculus
aggcgttgcctctccagatgtgccg

SEQ ID NO: 195653 - DNA, 25 bp, Mus musculus
aggcgtttgaggagcacgggacagc

SEQ ID NO: 195654 - DNA, 25 bp, Mus musculus
aggcgtttgaggtgcacgggacagc

SEQ ID NO: 195655 - DNA, 25 bp, Mus musculus
aggcgtttgttacccttcagagtga

SEQ ID NO: 195656 - DNA, 25 bp, Mus musculus
aggcgtttgttagccttcagagtga

SEQ ID NO: 195657 - DNA, 25 bp, Mus musculus
aggcgttttgttactggcatggcca

SEQ ID NO: 195658 - DNA, 25 bp, Mus musculus
aggcgttttgtttctggcatggcca

SEQ ID NO: 195659 - DNA, 25 bp, Mus musculus
aggctaaaagtgacaattcagagaa

SEQ ID NO: 195660 - DNA, 25 bp, Mus musculus
aggctaaaagtgtcaattcagagaa

SEQ ID NO: 195661 - DNA, 25 bp, Mus musculus
aggctaaacagaagaacaccctgct

SEQ ID NO: 195662 - DNA, 25 bp, Mus musculus
aggctaaacagatgaacaccctgct

SEQ ID NO: 195663 - DNA, 25 bp, Mus musculus
aggctaaagatcctcctgtatccag

SEQ ID NO: 195664 - DNA, 25 bp, Mus musculus
aggctaaagatcgtcctgtatccag

SEQ ID NO: 195665 - DNA, 25 bp, Mus musculus
aggctaaagcacatgctggtgtctg

SEQ ID NO: 195666 - DNA, 25 bp, Mus musculus
aggctaaagcacttgctggtgtctg

SEQ ID NO: 195667 - DNA, 25 bp, Mus musculus
aggctaacaccaattgcagaatatt

SEQ ID NO: 195668 - DNA, 25 bp, Mus musculus
aggctaacaccatttgcagaatatt

SEQ ID NO: 195669 - DNA, 25 bp, Mus musculus
aggctaaccacaattgcttctggga

SEQ ID NO: 195670 - DNA, 25 bp, Mus musculus
aggctaaccacatttgcttctggga

SEQ ID NO: 195671 - DNA, 25 bp, Mus musculus
aggctaactaccatctgttgggcta

SEQ ID NO: 195672 - DNA, 25 bp, Mus musculus
aggctaactaccttctgttgggcta

SEQ ID NO: 195673 - DNA, 25 bp, Mus musculus
aggctaactcccaagggccttctag

SEQ ID NO: 195674 - DNA, 25 bp, Mus musculus
aggctaactccctagggccttctag

SEQ ID NO: 195675 - DNA, 25 bp, Mus musculus
aggctaactgcgaagctctgaggat

SEQ ID NO: 195676 - DNA, 25 bp, Mus musculus
aggctaactgcgtagctctgaggat

SEQ ID NO: 195677 - DNA, 25 bp, Mus musculus
aggctaagaagaagggcttgccccg

SEQ ID NO: 195678 - DNA, 25 bp, Mus musculus
aggctaagaagatgggcttgccccg

SEQ ID NO: 195679 - DNA, 25 bp, Mus musculus
aggctaagacagcatggcaggtaca

SEQ ID NO: 195680 - DNA, 25 bp, Mus musculus
aggctaagacaggatggcaggtaca

SEQ ID NO: 195681 - DNA, 25 bp, Mus musculus
aggctaagagaccaaacactaccgg

SEQ ID NO: 195682 - DNA, 25 bp, Mus musculus
aggctaagagacgaaacactaccgg

SEQ ID NO: 195683 - DNA, 25 bp, Mus musculus
aggctaagagccacacccagaagac

SEQ ID NO: 195684 - DNA, 25 bp, Mus musculus
aggctaagagcctcacccagaagac

SEQ ID NO: 195685 - DNA, 25 bp, Mus musculus
aggctaagcctccacggtgctgtga

SEQ ID NO: 195686 - DNA, 25 bp, Mus musculus
aggctaagcctcgacggtgctgtga

SEQ ID NO: 195687 - DNA, 25 bp, Mus musculus
aggctaagccttcctttcatgttgc

SEQ ID NO: 195688 - DNA, 25 bp, Mus musculus
aggctaagccttgctttcatgttgc

SEQ ID NO: 195689 - DNA, 25 bp, Mus musculus
aggctaaggcggagtctcgttccca

SEQ ID NO: 195690 - DNA, 25 bp, Mus musculus
aggctaaggcggtgtctcgttccca

SEQ ID NO: 195691 - DNA, 25 bp, Mus musculus
aggctaagggcgatcagtctgctgc

SEQ ID NO: 195692 - DNA, 25 bp, Mus musculus
aggctaagggcgttcagtctgctgc

SEQ ID NO: 195693 - DNA, 25 bp, Mus musculus
aggctaagtggcacctgggcacctt

SEQ ID NO: 195694 - DNA, 25 bp, Mus musculus
aggctaagtggctcctgggcacctt

SEQ ID NO: 195695 - DNA, 25 bp, Mus musculus
aggctaagtttaattgggcagtatt

SEQ ID NO: 195696 - DNA, 25 bp, Mus musculus
aggctaagtttatttgggcagtatt

SEQ ID NO: 195697 - DNA, 25 bp, Mus musculus
aggctaataaccagtacatccccaa

SEQ ID NO: 195698 - DNA, 25 bp, Mus musculus
aggctaataacctgtacatccccaa

SEQ ID NO: 195699 - DNA, 25 bp, Mus musculus
aggctaataggcatgactgtggtca

SEQ ID NO: 195700 - DNA, 25 bp, Mus musculus
aggctaataggcttgactgtggtca

SEQ ID NO: 195701 - DNA, 25 bp, Mus musculus
aggctaatcagactcgtggcaagtc

SEQ ID NO: 195702 - DNA, 25 bp, Mus musculus
aggctaatcagagtcgtggcaagtc

SEQ ID NO: 195703 - DNA, 25 bp, Mus musculus
aggctaatcaggaggcccgagtaag

SEQ ID NO: 195704 - DNA, 25 bp, Mus musculus
aggctaatcaggtggcccgagtaag

SEQ ID NO: 195705 - DNA, 25 bp, Mus musculus
aggctaatcttgcacttaccctgct

SEQ ID NO: 195706 - DNA, 25 bp, Mus musculus
aggctaatcttggacttaccctgct

SEQ ID NO: 195707 - DNA, 25 bp, Mus musculus
aggctaatgagcaccttgccagtga

SEQ ID NO: 195708 - DNA, 25 bp, Mus musculus
aggctaatgagctccttgccagtga

SEQ ID NO: 195709 - DNA, 25 bp, Mus musculus
aggctaatggcaaccagcgccattc

SEQ ID NO: 195710 - DNA, 25 bp, Mus musculus
aggctaatggcacaaccgtccatgt

SEQ ID NO: 195711 - DNA, 25 bp, Mus musculus
aggctaatggcagaaccgtccatgt

SEQ ID NO: 195712 - DNA, 25 bp, Mus musculus
aggctaatggcatccagcgccattc

SEQ ID NO: 195713 - DNA, 25 bp, Mus musculus
aggctaatggccaaagtgtgtgaat

SEQ ID NO: 195714 - DNA, 25 bp, Mus musculus
aggctaatggcctaagtgtgtgaat

SEQ ID NO: 195715 - DNA, 25 bp, Mus musculus
aggctaatgttaagggacactgcag

SEQ ID NO: 195716 - DNA, 25 bp, Mus musculus
aggctaatgttatgggacactgcag

SEQ ID NO: 195717 - DNA, 25 bp, Mus musculus
aggctaattagtctagccaattaat

SEQ ID NO: 195718 - DNA, 25 bp, Mus musculus
aggctaattagtgtagccaattaat

SEQ ID NO: 195719 - DNA, 25 bp, Mus musculus
aggctacacagcctgtcaagctgac

SEQ ID NO: 195720 - DNA, 25 bp, Mus musculus
aggctacacagcgtgtcaagctgac

SEQ ID NO: 195721 - DNA, 25 bp, Mus musculus
aggctacacaggaagatctaggcca

SEQ ID NO: 195722 - DNA, 25 bp, Mus musculus
aggctacacaggtagatctaggcca

SEQ ID NO: 195723 - DNA, 25 bp, Mus musculus
aggctacaccaaagcactcactagc

SEQ ID NO: 195724 - DNA, 25 bp, Mus musculus
aggctacaccaatgcactcactagc

SEQ ID NO: 195725 - DNA, 25 bp, Mus musculus
aggctacaggacatggccgcttgtt

SEQ ID NO: 195726 - DNA, 25 bp, Mus musculus
aggctacaggacttggccgcttgtt

SEQ ID NO: 195727 - DNA, 25 bp, Mus musculus
aggctacattttcaacagacttttc

SEQ ID NO: 195728 - DNA, 25 bp, Mus musculus
aggctacattttgaacagacttttc

SEQ ID NO: 195729 - DNA, 25 bp, Mus musculus
aggctaccaaccatggaccaaggtc

SEQ ID NO: 195730 - DNA, 25 bp, Mus musculus
aggctaccaaccttggaccaaggtc

SEQ ID NO: 195731 - DNA, 25 bp, Mus musculus
aggctaccaggcactgtcggatagc

SEQ ID NO: 195732 - DNA, 25 bp, Mus musculus
aggctaccaggctctgtcggatagc

SEQ ID NO: 195733 - DNA, 25 bp, Mus musculus
aggctaccatctcgcaatgcaggat

SEQ ID NO: 195734 - DNA, 25 bp, Mus musculus
aggctaccatctggcaatgcaggat

SEQ ID NO: 195735 - DNA, 25 bp, Mus musculus
aggctaccatggacacatcagagga

SEQ ID NO: 195736 - DNA, 25 bp, Mus musculus
aggctaccatggtcacatcagagga

SEQ ID NO: 195737 - DNA, 25 bp, Mus musculus
aggctaccccaaaggatcgctgcca

SEQ ID NO: 195738 - DNA, 25 bp, Mus musculus
aggctaccccaatggatcgctgcca

SEQ ID NO: 195739 - DNA, 25 bp, Mus musculus
aggctaccctgaattcactctgtaa

SEQ ID NO: 195740 - DNA, 25 bp, Mus musculus
aggctaccctgatttcactctgtaa

SEQ ID NO: 195741 - DNA, 25 bp, Mus musculus
aggctaccctgcactatacaaagtt

SEQ ID NO: 195742 - DNA, 25 bp, Mus musculus
aggctaccctgctctatacaaagtt

SEQ ID NO: 195743 - DNA, 25 bp, Mus musculus
aggctacccttgatcatgtctctta

SEQ ID NO: 195744 - DNA, 25 bp, Mus musculus
aggctacccttgttcatgtctctta

SEQ ID NO: 195745 - DNA, 25 bp, Mus musculus
aggctaccggacactgatagaccag

SEQ ID NO: 195746 - DNA, 25 bp, Mus musculus
aggctaccggactctgatagaccag

SEQ ID NO: 195747 - DNA, 25 bp, Mus musculus
aggctaccggtgcttagctttgtcc

SEQ ID NO: 195748 - DNA, 25 bp, Mus musculus
aggctaccggtggttagctttgtcc

SEQ ID NO: 195749 - DNA, 25 bp, Mus musculus
aggctacctcttactaaagcccagg

SEQ ID NO: 195750 - DNA, 25 bp, Mus musculus
aggctacctctttctaaagcccagg

SEQ ID NO: 195751 - DNA, 25 bp, Mus musculus
aggctacctgatcctgtcttcggtg

SEQ ID NO: 195752 - DNA, 25 bp, Mus musculus
aggctacctgatgctgtcttcggtg

SEQ ID NO: 195753 - DNA, 25 bp, Mus musculus
aggctacctgctcccggtgaccgtg

SEQ ID NO: 195754 - DNA, 25 bp, Mus musculus
aggctacctgctgccggtgaccgtg

SEQ ID NO: 195755 - DNA, 25 bp, Mus musculus
aggctaccttcaagtctgctatgga

SEQ ID NO: 195756 - DNA, 25 bp, Mus musculus
aggctaccttcatgtctgctatgga

SEQ ID NO: 195757 - DNA, 25 bp, Mus musculus
aggctacctttgactacacagcgaa

SEQ ID NO: 195758 - DNA, 25 bp, Mus musculus
aggctacctttgtctacacagcgaa

SEQ ID NO: 195759 - DNA, 25 bp, Mus musculus
aggctacgagaccattttccagggc

SEQ ID NO: 195760 - DNA, 25 bp, Mus musculus
aggctacgagacgattttccagggc

SEQ ID NO: 195761 - DNA, 25 bp, Mus musculus
aggctacgcatcaggaaagtggtct

SEQ ID NO: 195762 - DNA, 25 bp, Mus musculus
aggctacgcatctggaaagtggtct

SEQ ID NO: 195763 - DNA, 25 bp, Mus musculus
aggctacgctgccttccaggaagac

SEQ ID NO: 195764 - DNA, 25 bp, Mus musculus
aggctacgctgcgttccaggaagac

SEQ ID NO: 195765 - DNA, 25 bp, Mus musculus
aggctacgtgttcagcgtgtccgac

SEQ ID NO: 195766 - DNA, 25 bp, Mus musculus
aggctacgtgttgagcgtgtccgac

SEQ ID NO: 195767 - DNA, 25 bp, Mus musculus
aggctactacaaagttctgggcaag

SEQ ID NO: 195768 - DNA, 25 bp, Mus musculus
aggctactacaatgttctgggcaag

SEQ ID NO: 195769 - DNA, 25 bp, Mus musculus
aggctactactgaactctggcatgg

SEQ ID NO: 195770 - DNA, 25 bp, Mus musculus
aggctactactgtactctggcatgg

SEQ ID NO: 195771 - DNA, 25 bp, Mus musculus
aggctactcagacggctcgctttga

SEQ ID NO: 195772 - DNA, 25 bp, Mus musculus
aggctactcagagggctcgctttga

SEQ ID NO: 195773 - DNA, 25 bp, Mus musculus
aggctactcccacgcagaccaggaa

SEQ ID NO: 195774 - DNA, 25 bp, Mus musculus
aggctactcccaggcagaccaggaa

SEQ ID NO: 195775 - DNA, 25 bp, Mus musculus
aggctactgtatcatgtccgtcacc

SEQ ID NO: 195776 - DNA, 25 bp, Mus musculus
aggctactgtatgatgtccgtcacc

SEQ ID NO: 195777 - DNA, 25 bp, Mus musculus
aggctactgtcacctcgcctcgaga

SEQ ID NO: 195778 - DNA, 25 bp, Mus musculus
aggctactgtcagctcgcctcgaga

SEQ ID NO: 195779 - DNA, 25 bp, Mus musculus
aggctactgtctatcaactaactcc

SEQ ID NO: 195780 - DNA, 25 bp, Mus musculus
aggctactgtctttcaactaactcc

SEQ ID NO: 195781 - DNA, 25 bp, Mus musculus
aggctacttcaaatccactttaatc

SEQ ID NO: 195782 - DNA, 25 bp, Mus musculus
aggctacttcaattccactttaatc

SEQ ID NO: 195783 - DNA, 25 bp, Mus musculus
aggctacttgcactggctttgccag

SEQ ID NO: 195784 - DNA, 25 bp, Mus musculus
aggctacttgcagtggctttgccag

SEQ ID NO: 195785 - DNA, 25 bp, Mus musculus
aggctacttttgcacacagaatctt

SEQ ID NO: 195786 - DNA, 25 bp, Mus musculus
aggctacttttggacacagaatctt

SEQ ID NO: 195787 - DNA, 25 bp, Mus musculus
aggctagaactgatcctgggttatc

SEQ ID NO: 195788 - DNA, 25 bp, Mus musculus
aggctagaactgttcctgggttatc

SEQ ID NO: 195789 - DNA, 25 bp, Mus musculus
aggctagaagataattgccaaagcc

SEQ ID NO: 195790 - DNA, 25 bp, Mus musculus
aggctagaagattattgccaaagcc

SEQ ID NO: 195791 - DNA, 25 bp, Mus musculus
aggctagaaggacgctgttttccct

SEQ ID NO: 195792 - DNA, 25 bp, Mus musculus
aggctagaaggaggctgttttccct

SEQ ID NO: 195793 - DNA, 25 bp, Mus musculus
aggctagacaacatagtgtagactt

SEQ ID NO: 195794 - DNA, 25 bp, Mus musculus
aggctagacaacttagtgtagactt

SEQ ID NO: 195795 - DNA, 25 bp, Mus musculus
aggctagactgacctttcagatccc

SEQ ID NO: 195796 - DNA, 25 bp, Mus musculus
aggctagactgagctttcagatccc

SEQ ID NO: 195797 - DNA, 25 bp, Mus musculus
aggctagatacacagcctgccttcc

SEQ ID NO: 195798 - DNA, 25 bp, Mus musculus
aggctagatacagagcctgccttcc

SEQ ID NO: 195799 - DNA, 25 bp, Mus musculus
aggctagatctgcatgaggcaaatt

SEQ ID NO: 195800 - DNA, 25 bp, Mus musculus
aggctagatctggatgaggcaaatt

SEQ ID NO: 195801 - DNA, 25 bp, Mus musculus
aggctagcacagagacttcctcgag

SEQ ID NO: 195802 - DNA, 25 bp, Mus musculus
aggctagcacagtgacttcctcgag

SEQ ID NO: 195803 - DNA, 25 bp, Mus musculus
aggctagcactaaatactcaggctt

SEQ ID NO: 195804 - DNA, 25 bp, Mus musculus
aggctagcactatatactcaggctt

SEQ ID NO: 195805 - DNA, 25 bp, Mus musculus
aggctagcagcaacttgcactgtga

SEQ ID NO: 195806 - DNA, 25 bp, Mus musculus
aggctagcagcatcttgcactgtga

SEQ ID NO: 195807 - DNA, 25 bp, Mus musculus
aggctagcagctcgcctcagtctgt

SEQ ID NO: 195808 - DNA, 25 bp, Mus musculus
aggctagcagctggcctcagtctgt

SEQ ID NO: 195809 - DNA, 25 bp, Mus musculus
aggctagccatgaatggccccacaa

SEQ ID NO: 195810 - DNA, 25 bp, Mus musculus
aggctagccatgtatggccccacaa

SEQ ID NO: 195811 - DNA, 25 bp, Mus musculus
aggctagccattcctgaggtcacac

SEQ ID NO: 195812 - DNA, 25 bp, Mus musculus
aggctagccattgctgaggtcacac

SEQ ID NO: 195813 - DNA, 25 bp, Mus musculus
aggctagccgtcactcagcacagct

SEQ ID NO: 195814 - DNA, 25 bp, Mus musculus
aggctagccgtctctcagcacagct

SEQ ID NO: 195815 - DNA, 25 bp, Mus musculus
aggctagcctagattagagttccag

SEQ ID NO: 195816 - DNA, 25 bp, Mus musculus
aggctagcctagtttagagttccag

SEQ ID NO: 195817 - DNA, 25 bp, Mus musculus
aggctagcctcgacacttcatgaaa

SEQ ID NO: 195818 - DNA, 25 bp, Mus musculus
aggctagcctcgtcacttcatgaaa

SEQ ID NO: 195819 - DNA, 25 bp, Mus musculus
aggctagccttacatgttcaggcga

SEQ ID NO: 195820 - DNA, 25 bp, Mus musculus
aggctagccttagatgttcaggcga

SEQ ID NO: 195821 - DNA, 25 bp, Mus musculus
aggctagcgtcaacctctggtttag

SEQ ID NO: 195822 - DNA, 25 bp, Mus musculus
aggctagcgtcatcctctggtttag

SEQ ID NO: 195823 - DNA, 25 bp, Mus musculus
aggctagcttcaaccaatccattaa

SEQ ID NO: 195824 - DNA, 25 bp, Mus musculus
aggctagcttcatccaatccattaa

SEQ ID NO: 195825 - DNA, 25 bp, Mus musculus
aggctaggcactacctggctaggac

SEQ ID NO: 195826 - DNA, 25 bp, Mus musculus
aggctaggcacttcctggctaggac

SEQ ID NO: 195827 - DNA, 25 bp, Mus musculus
aggctaggcagaaacttctgaccct

SEQ ID NO: 195828 - DNA, 25 bp, Mus musculus
aggctaggcagatacttctgaccct

SEQ ID NO: 195829 - DNA, 25 bp, Mus musculus
aggctagggctaagcggtccccgtt

SEQ ID NO: 195830 - DNA, 25 bp, Mus musculus
aggctagggctatgcggtccccgtt

SEQ ID NO: 195831 - DNA, 25 bp, Mus musculus
aggctaggtgagactacctttccac

SEQ ID NO: 195832 - DNA, 25 bp, Mus musculus
aggctaggtgagtctacctttccac

SEQ ID NO: 195833 - DNA, 25 bp, Mus musculus
aggctagtaactcccagatcccagg

SEQ ID NO: 195834 - DNA, 25 bp, Mus musculus
aggctagtaactgccagatcccagg

SEQ ID NO: 195835 - DNA, 25 bp, Mus musculus
aggctagtactcagtatttttgtgt

SEQ ID NO: 195836 - DNA, 25 bp, Mus musculus
aggctagtactctgtatttttgtgt

SEQ ID NO: 195837 - DNA, 25 bp, Mus musculus
aggctagtctgaactacatagttag

SEQ ID NO: 195838 - DNA, 25 bp, Mus musculus
aggctagtctgatctacatagttag

SEQ ID NO: 195839 - DNA, 25 bp, Mus musculus
aggctagtctttaaccccatatgta

SEQ ID NO: 195840 - DNA, 25 bp, Mus musculus
aggctagtcttttaccccatatgta

SEQ ID NO: 195841 - DNA, 25 bp, Mus musculus
aggctagtggagaaggatagacacc

SEQ ID NO: 195842 - DNA, 25 bp, Mus musculus
aggctagtggagtaggatagacacc

SEQ ID NO: 195843 - DNA, 25 bp, Mus musculus
aggctagtgttcaaaagcactctaa

SEQ ID NO: 195844 - DNA, 25 bp, Mus musculus
aggctagtgttctaaagcactctaa

SEQ ID NO: 195845 - DNA, 25 bp, Mus musculus
aggctagtttctcagtgccaagtca

SEQ ID NO: 195846 - DNA, 25 bp, Mus musculus
aggctagtttctgagtgccaagtca

SEQ ID NO: 195847 - DNA, 25 bp, Mus musculus
aggctataactccagcattcaagag

SEQ ID NO: 195848 - DNA, 25 bp, Mus musculus
aggctataactcgagcattcaagag

SEQ ID NO: 195849 - DNA, 25 bp, Mus musculus
aggctataagcccaagtacctccag

SEQ ID NO: 195850 - DNA, 25 bp, Mus musculus
aggctataagccgaagtacctccag

SEQ ID NO: 195851 - DNA, 25 bp, Mus musculus
aggctatacactcgagctgggccct

SEQ ID NO: 195852 - DNA, 25 bp, Mus musculus
aggctatacactggagctgggccct

SEQ ID NO: 195853 - DNA, 25 bp, Mus musculus
aggctataccccacgtagaaaactg

SEQ ID NO: 195854 - DNA, 25 bp, Mus musculus
aggctatacccctcgtagaaaactg

SEQ ID NO: 195855 - DNA, 25 bp, Mus musculus
aggctatagaaaccgccatcggtgg

SEQ ID NO: 195856 - DNA, 25 bp, Mus musculus
aggctatagaaagcgccatcggtgg

SEQ ID NO: 195857 - DNA, 25 bp, Mus musculus
aggctatatatcactcaccaaggaa

SEQ ID NO: 195858 - DNA, 25 bp, Mus musculus
aggctatatatctctcaccaaggaa

SEQ ID NO: 195859 - DNA, 25 bp, Mus musculus
aggctatatctcactggaatctgga

SEQ ID NO: 195860 - DNA, 25 bp, Mus musculus
aggctatatctctctggaatctgga

SEQ ID NO: 195861 - DNA, 25 bp, Mus musculus
aggctatcaagcacctgtattttga

SEQ ID NO: 195862 - DNA, 25 bp, Mus musculus
aggctatcaagctcctgtattttga

SEQ ID NO: 195863 - DNA, 25 bp, Mus musculus
aggctatccaggcatccattagacg

SEQ ID NO: 195864 - DNA, 25 bp, Mus musculus
aggctatccagggatccattagacg

SEQ ID NO: 195865 - DNA, 25 bp, Mus musculus
aggctatcccaaacttctctatgct

SEQ ID NO: 195866 - DNA, 25 bp, Mus musculus
aggctatcccaatcttctctatgct

SEQ ID NO: 195867 - DNA, 25 bp, Mus musculus
aggctatcgtgtcaggtaaaggacc

SEQ ID NO: 195868 - DNA, 25 bp, Mus musculus
aggctatcgtgtgaggtaaaggacc

SEQ ID NO: 195869 - DNA, 25 bp, Mus musculus
aggctatctatccttcagctgtatg

SEQ ID NO: 195870 - DNA, 25 bp, Mus musculus
aggctatctatcgttcagctgtatg

SEQ ID NO: 195871 - DNA, 25 bp, Mus musculus
aggctatctgtacagtgtccacaca

SEQ ID NO: 195872 - DNA, 25 bp, Mus musculus
aggctatctgtagagtgtccacaca

SEQ ID NO: 195873 - DNA, 25 bp, Mus musculus
aggctatgagccaatccccgtgcag

SEQ ID NO: 195874 - DNA, 25 bp, Mus musculus
aggctatgagcctatccccgtgcag

SEQ ID NO: 195875 - DNA, 25 bp, Mus musculus
aggctatgccaccttgaccaagttg

SEQ ID NO: 195876 - DNA, 25 bp, Mus musculus
aggctatgccacgttgaccaagttg

SEQ ID NO: 195877 - DNA, 25 bp, Mus musculus
aggctatgctcaccaccaggactga

SEQ ID NO: 195878 - DNA, 25 bp, Mus musculus
aggctatgctcagcaccaggactga

SEQ ID NO: 195879 - DNA, 25 bp, Mus musculus
aggctatggatcagcactcactgtc

SEQ ID NO: 195880 - DNA, 25 bp, Mus musculus
aggctatggatctgcactcactgtc

SEQ ID NO: 195881 - DNA, 25 bp, Mus musculus
aggctatggccaccactgagtgaat

SEQ ID NO: 195882 - DNA, 25 bp, Mus musculus
aggctatggccagcactgagtgaat

SEQ ID NO: 195883 - DNA, 25 bp, Mus musculus
aggctatgggcaagctcctcaaaac

SEQ ID NO: 195884 - DNA, 25 bp, Mus musculus
aggctatgggcatgctcctcaaaac

SEQ ID NO: 195885 - DNA, 25 bp, Mus musculus
aggctatgtaggcaaactctgcctc

SEQ ID NO: 195886 - DNA, 25 bp, Mus musculus
aggctatgtagggaaactctgcctc

SEQ ID NO: 195887 - DNA, 25 bp, Mus musculus
aggctatgtatgaatcttctctgga

SEQ ID NO: 195888 - DNA, 25 bp, Mus musculus
aggctatgtatgtatcttctctgga

SEQ ID NO: 195889 - DNA, 25 bp, Mus musculus
aggctatgtcacaaaagatttttac

SEQ ID NO: 195890 - DNA, 25 bp, Mus musculus
aggctatgtcactaaagatttttac

SEQ ID NO: 195891 - DNA, 25 bp, Mus musculus
aggctatgtccaaactgggtcttcg

SEQ ID NO: 195892 - DNA, 25 bp, Mus musculus
aggctatgtccatactgggtcttcg

SEQ ID NO: 195893 - DNA, 25 bp, Mus musculus
aggctatgtgacacaagaactggat

SEQ ID NO: 195894 - DNA, 25 bp, Mus musculus
aggctatgtgactcaagaactggat

SEQ ID NO: 195895 - DNA, 25 bp, Mus musculus
aggctatgttggcaccgcagtgata

SEQ ID NO: 195896 - DNA, 25 bp, Mus musculus
aggctatgttgggaccgcagtgata

SEQ ID NO: 195897 - DNA, 25 bp, Mus musculus
aggctatgtttcctgtatggctaca

SEQ ID NO: 195898 - DNA, 25 bp, Mus musculus
aggctatgtttcgtgtatggctaca

SEQ ID NO: 195899 - DNA, 25 bp, Mus musculus
aggctattactgacaaccctagtca

SEQ ID NO: 195900 - DNA, 25 bp, Mus musculus
aggctattactgtcaaccctagtca

SEQ ID NO: 195901 - DNA, 25 bp, Mus musculus
aggctattccaactgttgtcctgtt

SEQ ID NO: 195902 - DNA, 25 bp, Mus musculus
aggctattccaagtgttgtcctgtt

SEQ ID NO: 195903 - DNA, 25 bp, Mus musculus
aggctattcggccaggctatcacta

SEQ ID NO: 195904 - DNA, 25 bp, Mus musculus
aggctattcggcgaggctatcacta

SEQ ID NO: 195905 - DNA, 25 bp, Mus musculus
aggctattctcactactgggtcata

SEQ ID NO: 195906 - DNA, 25 bp, Mus musculus
aggctattctcagtactgggtcata

SEQ ID NO: 195907 - DNA, 25 bp, Mus musculus
aggctattctgtcagccggccagaa

SEQ ID NO: 195908 - DNA, 25 bp, Mus musculus
aggctattctgtgagccggccagaa

SEQ ID NO: 195909 - DNA, 25 bp, Mus musculus
aggctattgtccatccaggtcagat

SEQ ID NO: 195910 - DNA, 25 bp, Mus musculus
aggctattgtccttccaggtcagat

SEQ ID NO: 195911 - DNA, 25 bp, Mus musculus
aggctatttagcagctcgctctcat

SEQ ID NO: 195912 - DNA, 25 bp, Mus musculus
aggctatttagctgctcgctctcat

SEQ ID NO: 195913 - DNA, 25 bp, Mus musculus
aggctatttctaaaagtctgtgaca

SEQ ID NO: 195914 - DNA, 25 bp, Mus musculus
aggctatttctaaatactggattca

SEQ ID NO: 195915 - DNA, 25 bp, Mus musculus
aggctatttctataagtctgtgaca

SEQ ID NO: 195916 - DNA, 25 bp, Mus musculus
aggctatttctatatactggattca

SEQ ID NO: 195917 - DNA, 25 bp, Mus musculus
aggctatttgccactgttatctgat

SEQ ID NO: 195918 - DNA, 25 bp, Mus musculus
aggctatttgcctctgttatctgat

SEQ ID NO: 195919 - DNA, 25 bp, Mus musculus
aggctcaaaagtaaactatcaagtc

SEQ ID NO: 195920 - DNA, 25 bp, Mus musculus
aggctcaaaagttaactatcaagtc

SEQ ID NO: 195921 - DNA, 25 bp, Mus musculus
aggctcaaaccacttctcaggttaa

SEQ ID NO: 195922 - DNA, 25 bp, Mus musculus
aggctcaaaccagttctcaggttaa

SEQ ID NO: 195923 - DNA, 25 bp, Mus musculus
aggctcaaaggcactacaaaaagaa

SEQ ID NO: 195924 - DNA, 25 bp, Mus musculus
aggctcaaaggctctacaaaaagaa

SEQ ID NO: 195925 - DNA, 25 bp, Mus musculus
aggctcaacctcctagttctcacgg

SEQ ID NO: 195926 - DNA, 25 bp, Mus musculus
aggctcaacctcgtagttctcacgg

SEQ ID NO: 195927 - DNA, 25 bp, Mus musculus
aggctcaaccttcttgttcctagga

SEQ ID NO: 195928 - DNA, 25 bp, Mus musculus
aggctcaaccttgttgttcctagga

SEQ ID NO: 195929 - DNA, 25 bp, Mus musculus
aggctcaacgctactgggttcaggt

SEQ ID NO: 195930 - DNA, 25 bp, Mus musculus
aggctcaacgcttctgggttcaggt

SEQ ID NO: 195931 - DNA, 25 bp, Mus musculus
aggctcaagagccatcactgatcca

SEQ ID NO: 195932 - DNA, 25 bp, Mus musculus
aggctcaagagcgatcactgatcca

SEQ ID NO: 195933 - DNA, 25 bp, Mus musculus
aggctcaagccaaccttgtgctaag

SEQ ID NO: 195934 - DNA, 25 bp, Mus musculus
aggctcaagccatccttgtgctaag

SEQ ID NO: 195935 - DNA, 25 bp, Mus musculus
aggctcaaggagcattagaatccca

SEQ ID NO: 195936 - DNA, 25 bp, Mus musculus
aggctcaaggaggattagaatccca

SEQ ID NO: 195937 - DNA, 25 bp, Mus musculus
aggctcaaggtgacggtaccctggt

SEQ ID NO: 195938 - DNA, 25 bp, Mus musculus
aggctcaaggtgctcaatccaggga

SEQ ID NO: 195939 - DNA, 25 bp, Mus musculus
aggctcaaggtggtcaatccaggga

SEQ ID NO: 195940 - DNA, 25 bp, Mus musculus
aggctcaaggtgtcggtaccctggt

SEQ ID NO: 195941 - DNA, 25 bp, Mus musculus
aggctcaagtgccacccagtgtgtg

SEQ ID NO: 195942 - DNA, 25 bp, Mus musculus
aggctcaagtgcgacccagtgtgtg

SEQ ID NO: 195943 - DNA, 25 bp, Mus musculus
aggctcacacagaatcatggactgt

SEQ ID NO: 195944 - DNA, 25 bp, Mus musculus
aggctcacacagtatcatggactgt

SEQ ID NO: 195945 - DNA, 25 bp, Mus musculus
aggctcacacatcgcctgggagcag

SEQ ID NO: 195946 - DNA, 25 bp, Mus musculus
aggctcacacatggcctgggagcag

SEQ ID NO: 195947 - DNA, 25 bp, Mus musculus
aggctcacactcactctctgttgag

SEQ ID NO: 195948 - DNA, 25 bp, Mus musculus
aggctcacactctctctctgttgag

SEQ ID NO: 195949 - DNA, 25 bp, Mus musculus
aggctcacatgtagaagctggcagt

SEQ ID NO: 195950 - DNA, 25 bp, Mus musculus
aggctcacatgttgaagctggcagt

SEQ ID NO: 195951 - DNA, 25 bp, Mus musculus
aggctcaccacacacatcttgtaat

SEQ ID NO: 195952 - DNA, 25 bp, Mus musculus
aggctcaccacagacatcttgtaat

SEQ ID NO: 195953 - DNA, 25 bp, Mus musculus
aggctcacccagatggctagggacg

SEQ ID NO: 195954 - DNA, 25 bp, Mus musculus
aggctcacccagttggctagggacg

SEQ ID NO: 195955 - DNA, 25 bp, Mus musculus
aggctcaccccgctaataaattctt

SEQ ID NO: 195956 - DNA, 25 bp, Mus musculus
aggctcaccccggtaataaattctt

SEQ ID NO: 195957 - DNA, 25 bp, Mus musculus
aggctcacctgaaacactttgcgaa

SEQ ID NO: 195958 - DNA, 25 bp, Mus musculus
aggctcacctgatacactttgcgaa

SEQ ID NO: 195959 - DNA, 25 bp, Mus musculus
aggctcactcagacgtgtgtgtgaa

SEQ ID NO: 195960 - DNA, 25 bp, Mus musculus
aggctcactcagtcgtgtgtgtgaa

SEQ ID NO: 195961 - DNA, 25 bp, Mus musculus
aggctcactgtcacattcactttgt

SEQ ID NO: 195962 - DNA, 25 bp, Mus musculus
aggctcactgtctcattcactttgt

SEQ ID NO: 195963 - DNA, 25 bp, Mus musculus
aggctcagaaagaaaggcccactga

SEQ ID NO: 195964 - DNA, 25 bp, Mus musculus
aggctcagaaagtaaggcccactga

SEQ ID NO: 195965 - DNA, 25 bp, Mus musculus
aggctcagacaaagggttcctcctt

SEQ ID NO: 195966 - DNA, 25 bp, Mus musculus
aggctcagacaatgggttcctcctt

SEQ ID NO: 195967 - DNA, 25 bp, Mus musculus
aggctcagagccaaagtatcggact

SEQ ID NO: 195968 - DNA, 25 bp, Mus musculus
aggctcagagcctaagtatcggact

SEQ ID NO: 195969 - DNA, 25 bp, Mus musculus
aggctcagagggatggcaaggcctt

SEQ ID NO: 195970 - DNA, 25 bp, Mus musculus
aggctcagagggttggcaaggcctt

SEQ ID NO: 195971 - DNA, 25 bp, Mus musculus
aggctcagagttaccaagcaacctg

SEQ ID NO: 195972 - DNA, 25 bp, Mus musculus
aggctcagagtttccaagcaacctg

SEQ ID NO: 195973 - DNA, 25 bp, Mus musculus
aggctcagcaatcgctgctctgtgt

SEQ ID NO: 195974 - DNA, 25 bp, Mus musculus
aggctcagcaatggctgctctgtgt

SEQ ID NO: 195975 - DNA, 25 bp, Mus musculus
aggctcagctggatctacctgacat

SEQ ID NO: 195976 - DNA, 25 bp, Mus musculus
aggctcagctggttctacctgacat

SEQ ID NO: 195977 - DNA, 25 bp, Mus musculus
aggctcaggaaaaccctagtccacg

SEQ ID NO: 195978 - DNA, 25 bp, Mus musculus
aggctcaggaaatccctagtccacg

SEQ ID NO: 195979 - DNA, 25 bp, Mus musculus
aggctcaggaggcttgtcataaatt

SEQ ID NO: 195980 - DNA, 25 bp, Mus musculus
aggctcaggagggttgtcataaatt

SEQ ID NO: 195981 - DNA, 25 bp, Mus musculus
aggctcaggcaacacggctccaagt

SEQ ID NO: 195982 - DNA, 25 bp, Mus musculus
aggctcaggcaagacggctccaagt

SEQ ID NO: 195983 - DNA, 25 bp, Mus musculus
aggctcaggccaatgacatcacagt

SEQ ID NO: 195984 - DNA, 25 bp, Mus musculus
aggctcaggccacacggcttcctat

SEQ ID NO: 195985 - DNA, 25 bp, Mus musculus
aggctcaggccagacggcttcctat

SEQ ID NO: 195986 - DNA, 25 bp, Mus musculus
aggctcaggccattgacatcacagt

SEQ ID NO: 195987 - DNA, 25 bp, Mus musculus
aggctcaggctcagtgtacgtcgaa

SEQ ID NO: 195988 - DNA, 25 bp, Mus musculus
aggctcaggctctgtgtacgtcgaa

SEQ ID NO: 195989 - DNA, 25 bp, Mus musculus
aggctcagggtaactttggctgtgc

SEQ ID NO: 195990 - DNA, 25 bp, Mus musculus
aggctcagggtatctttggctgtgc

SEQ ID NO: 195991 - DNA, 25 bp, Mus musculus
aggctcaggtttcccaaagcatttt

SEQ ID NO: 195992 - DNA, 25 bp, Mus musculus
aggctcaggtttgccaaagcatttt

SEQ ID NO: 195993 - DNA, 25 bp, Mus musculus
aggctcagtcatcttcctgaagctg

SEQ ID NO: 195994 - DNA, 25 bp, Mus musculus
aggctcagtcatgttcctgaagctg

SEQ ID NO: 195995 - DNA, 25 bp, Mus musculus
aggctcagtcctaatgtactatcag

SEQ ID NO: 195996 - DNA, 25 bp, Mus musculus
aggctcagtcctctataccataaga

SEQ ID NO: 195997 - DNA, 25 bp, Mus musculus
aggctcagtcctgtataccataaga

SEQ ID NO: 195998 - DNA, 25 bp, Mus musculus
aggctcagtccttatgtactatcag

SEQ ID NO: 195999 - DNA, 25 bp, Mus musculus
aggctcagtgttctgtcccctagag

SEQ ID NO: 196000 - DNA, 25 bp, Mus musculus
aggctcagtgttgtgtcccctagag

SEQ ID NO: 196001 - DNA, 25 bp, Mus musculus
aggctcagttcccatcacatgaaca

SEQ ID NO: 196002 - DNA, 25 bp, Mus musculus
aggctcagttccgatcacatgaaca

SEQ ID NO: 196003 - DNA, 25 bp, Mus musculus
aggctcagttgcaccatgttagttc

SEQ ID NO: 196004 - DNA, 25 bp, Mus musculus
aggctcagttgctccatgttagttc

SEQ ID NO: 196005 - DNA, 25 bp, Mus musculus
aggctcagttgtctgtttcctcttc

SEQ ID NO: 196006 - DNA, 25 bp, Mus musculus
aggctcagttgtgtgtttcctcttc

SEQ ID NO: 196007 - DNA, 25 bp, Mus musculus
aggctcagttttagtgtgaagcata

SEQ ID NO: 196008 - DNA, 25 bp, Mus musculus
aggctcagttttctcacattggtgc

SEQ ID NO: 196009 - DNA, 25 bp, Mus musculus
aggctcagttttgtcacattggtgc

SEQ ID NO: 196010 - DNA, 25 bp, Mus musculus
aggctcagtttttgtgtgaagcata

SEQ ID NO: 196011 - DNA, 25 bp, Mus musculus
aggctcataaaaatgctctcccctg

SEQ ID NO: 196012 - DNA, 25 bp, Mus musculus
aggctcataaaattgctctcccctg

SEQ ID NO: 196013 - DNA, 25 bp, Mus musculus
aggctcatacctccatacggaacag

SEQ ID NO: 196014 - DNA, 25 bp, Mus musculus
aggctcatacctgcatacggaacag

SEQ ID NO: 196015 - DNA, 25 bp, Mus musculus
aggctcatagacaccaaaatcccac

SEQ ID NO: 196016 - DNA, 25 bp, Mus musculus
aggctcatagactccaaaatcccac

SEQ ID NO: 196017 - DNA, 25 bp, Mus musculus
aggctcatcatgactctgacccagg

SEQ ID NO: 196018 - DNA, 25 bp, Mus musculus
aggctcatcatgtctctgacccagg

SEQ ID NO: 196019 - DNA, 25 bp, Mus musculus
aggctcatccctagtttgtctagtg

SEQ ID NO: 196020 - DNA, 25 bp, Mus musculus
aggctcatcccttgtttgtctagtg

SEQ ID NO: 196021 - DNA, 25 bp, Mus musculus
aggctcatcctgaccatcgtgtgcc

SEQ ID NO: 196022 - DNA, 25 bp, Mus musculus
aggctcatcctgtccatcgtgtgcc

SEQ ID NO: 196023 - DNA, 25 bp, Mus musculus
aggctcatcttaaattttctacccc

SEQ ID NO: 196024 - DNA, 25 bp, Mus musculus
aggctcatcttatattttctacccc

SEQ ID NO: 196025 - DNA, 25 bp, Mus musculus
aggctcatgaagaggctctgcccca

SEQ ID NO: 196026 - DNA, 25 bp, Mus musculus
aggctcatgaagtggctctgcccca

SEQ ID NO: 196027 - DNA, 25 bp, Mus musculus
aggctcatgaccagtgggacctatc

SEQ ID NO: 196028 - DNA, 25 bp, Mus musculus
aggctcatgacctgtgggacctatc

SEQ ID NO: 196029 - DNA, 25 bp, Mus musculus
aggctcatgagcaccaacataacag

SEQ ID NO: 196030 - DNA, 25 bp, Mus musculus
aggctcatgagctccaacataacag

SEQ ID NO: 196031 - DNA, 25 bp, Mus musculus
aggctcatgcccactggtttgtagc

SEQ ID NO: 196032 - DNA, 25 bp, Mus musculus
aggctcatgccctctggtttgtagc

SEQ ID NO: 196033 - DNA, 25 bp, Mus musculus
aggctcatgctcagtgctttcttat

SEQ ID NO: 196034 - DNA, 25 bp, Mus musculus
aggctcatgctctgtgctttcttat

SEQ ID NO: 196035 - DNA, 25 bp, Mus musculus
aggctcatggcgagtctgacaactg

SEQ ID NO: 196036 - DNA, 25 bp, Mus musculus
aggctcatggcgtgtctgacaactg

SEQ ID NO: 196037 - DNA, 25 bp, Mus musculus
aggctcatggctcagataggcaaga

SEQ ID NO: 196038 - DNA, 25 bp, Mus musculus
aggctcatggctgagataggcaaga

SEQ ID NO: 196039 - DNA, 25 bp, Mus musculus
aggctcatgggcagcctgggtaatt

SEQ ID NO: 196040 - DNA, 25 bp, Mus musculus
aggctcatgggctgcctgggtaatt

SEQ ID NO: 196041 - DNA, 25 bp, Mus musculus
aggctcatgtacagtcaggaatggt

SEQ ID NO: 196042 - DNA, 25 bp, Mus musculus
aggctcatgtactgtcaggaatggt

SEQ ID NO: 196043 - DNA, 25 bp, Mus musculus
aggctcatgttaaaacacctccctc

SEQ ID NO: 196044 - DNA, 25 bp, Mus musculus
aggctcatgttataacacctccctc

SEQ ID NO: 196045 - DNA, 25 bp, Mus musculus
aggctcattcacctttcatgaccaa

SEQ ID NO: 196046 - DNA, 25 bp, Mus musculus
aggctcattcacgtttcatgaccaa

SEQ ID NO: 196047 - DNA, 25 bp, Mus musculus
aggctcattccacggttcatggact

SEQ ID NO: 196048 - DNA, 25 bp, Mus musculus
aggctcattccagggttcatggact

SEQ ID NO: 196049 - DNA, 25 bp, Mus musculus
aggctcattgtgagcatctgatttc

SEQ ID NO: 196050 - DNA, 25 bp, Mus musculus
aggctcattgtgtgcatctgatttc

SEQ ID NO: 196051 - DNA, 25 bp, Mus musculus
aggctcatttgaactcctccgggat

SEQ ID NO: 196052 - DNA, 25 bp, Mus musculus
aggctcatttgatctcctccgggat

SEQ ID NO: 196053 - DNA, 25 bp, Mus musculus
aggctccaagaaaccgtgcttcaaa

SEQ ID NO: 196054 - DNA, 25 bp, Mus musculus
aggctccaagaatccgtgcttcaaa

SEQ ID NO: 196055 - DNA, 25 bp, Mus musculus
aggctccaagagctgccatcgccag

SEQ ID NO: 196056 - DNA, 25 bp, Mus musculus
aggctccaagaggtgccatcgccag

SEQ ID NO: 196057 - DNA, 25 bp, Mus musculus
aggctccaagcgacccacttgtgtg

SEQ ID NO: 196058 - DNA, 25 bp, Mus musculus
aggctccaagcgtcccacttgtgtg

SEQ ID NO: 196059 - DNA, 25 bp, Mus musculus
aggctccactaccaaagcgtatgat

SEQ ID NO: 196060 - DNA, 25 bp, Mus musculus
aggctccactacgaaagcgtatgat

SEQ ID NO: 196061 - DNA, 25 bp, Mus musculus
aggctccacttccttggtcattaag

SEQ ID NO: 196062 - DNA, 25 bp, Mus musculus
aggctccacttcgttggtcattaag

SEQ ID NO: 196063 - DNA, 25 bp, Mus musculus
aggctccagaacacaccagggttaa

SEQ ID NO: 196064 - DNA, 25 bp, Mus musculus
aggctccagaactcaccagggttaa

SEQ ID NO: 196065 - DNA, 25 bp, Mus musculus
aggctccagagaatgcataaggttt

SEQ ID NO: 196066 - DNA, 25 bp, Mus musculus
aggctccagagattgcataaggttt

SEQ ID NO: 196067 - DNA, 25 bp, Mus musculus
aggctccagaggcaacttcaggttc

SEQ ID NO: 196068 - DNA, 25 bp, Mus musculus
aggctccagagggaacttcaggttc

SEQ ID NO: 196069 - DNA, 25 bp, Mus musculus
aggctccagatcaacttcagacaat

SEQ ID NO: 196070 - DNA, 25 bp, Mus musculus
aggctccagatctacttcagacaat

SEQ ID NO: 196071 - DNA, 25 bp, Mus musculus
aggctccagctgcaagatgggctcc

SEQ ID NO: 196072 - DNA, 25 bp, Mus musculus
aggctccagctggaagatgggctcc

SEQ ID NO: 196073 - DNA, 25 bp, Mus musculus
aggctccaggaaactttggccacta

SEQ ID NO: 196074 - DNA, 25 bp, Mus musculus
aggctccaggaatctttggccacta

SEQ ID NO: 196075 - DNA, 25 bp, Mus musculus
aggctccaggatcactgctgaacaa

SEQ ID NO: 196076 - DNA, 25 bp, Mus musculus
aggctccaggatgactgctgaacaa

SEQ ID NO: 196077 - DNA, 25 bp, Mus musculus
aggctccaggcacggaagattttga

SEQ ID NO: 196078 - DNA, 25 bp, Mus musculus
aggctccaggcagggaagattttga

SEQ ID NO: 196079 - DNA, 25 bp, Mus musculus
aggctccataaccatgtgcttgcct

SEQ ID NO: 196080 - DNA, 25 bp, Mus musculus
aggctccataacgatgtgcttgcct

SEQ ID NO: 196081 - DNA, 25 bp, Mus musculus
aggctccatattcttggcctccagg

SEQ ID NO: 196082 - DNA, 25 bp, Mus musculus
aggctccatattgttggcctccagg

SEQ ID NO: 196083 - DNA, 25 bp, Mus musculus
aggctccatggtacttgctgataag

SEQ ID NO: 196084 - DNA, 25 bp, Mus musculus
aggctccatggttcttgctgataag

SEQ ID NO: 196085 - DNA, 25 bp, Mus musculus
aggctcccaatcctgaagttttctt

SEQ ID NO: 196086 - DNA, 25 bp, Mus musculus
aggctcccaatcgtgaagttttctt

SEQ ID NO: 196087 - DNA, 25 bp, Mus musculus
aggctcccacggcccatggaaactt

SEQ ID NO: 196088 - DNA, 25 bp, Mus musculus
aggctcccacgggccatggaaactt

SEQ ID NO: 196089 - DNA, 25 bp, Mus musculus
aggctcccactgatgagggtctaca

SEQ ID NO: 196090 - DNA, 25 bp, Mus musculus
aggctcccactgttgagggtctaca

SEQ ID NO: 196091 - DNA, 25 bp, Mus musculus
aggctcccaggactttcctgaggta

SEQ ID NO: 196092 - DNA, 25 bp, Mus musculus
aggctcccaggagtttcctgaggta

SEQ ID NO: 196093 - DNA, 25 bp, Mus musculus
aggctcccataaagcccgtgtgcga

SEQ ID NO: 196094 - DNA, 25 bp, Mus musculus
aggctcccataatgcccgtgtgcga

SEQ ID NO: 196095 - DNA, 25 bp, Mus musculus
aggctcccatggcttcacttggtat

SEQ ID NO: 196096 - DNA, 25 bp, Mus musculus
aggctcccatgggttcacttggtat

SEQ ID NO: 196097 - DNA, 25 bp, Mus musculus
aggctccccgaaagaccttcatggc

SEQ ID NO: 196098 - DNA, 25 bp, Mus musculus
aggctccccgaatgaccttcatggc

SEQ ID NO: 196099 - DNA, 25 bp, Mus musculus
aggctcccctctcgatttaggccgt

SEQ ID NO: 196100 - DNA, 25 bp, Mus musculus
aggctcccctctggatttaggccgt

SEQ ID NO: 196101 - DNA, 25 bp, Mus musculus
aggctcccctgtcagcaaatgcagg

SEQ ID NO: 196102 - DNA, 25 bp, Mus musculus
aggctcccctgtgagcaaatgcagg

SEQ ID NO: 196103 - DNA, 25 bp, Mus musculus
aggctcccggaaaaacaactctgag

SEQ ID NO: 196104 - DNA, 25 bp, Mus musculus
aggctcccggaataacaactctgag

SEQ ID NO: 196105 - DNA, 25 bp, Mus musculus
aggctcccggcacaccaaggacgag

SEQ ID NO: 196106 - DNA, 25 bp, Mus musculus
aggctcccggcagaccaaggacgag

SEQ ID NO: 196107 - DNA, 25 bp, Mus musculus
aggctccctgttcgctcctggcatt

SEQ ID NO: 196108 - DNA, 25 bp, Mus musculus
aggctccctgttggctcctggcatt

SEQ ID NO: 196109 - DNA, 25 bp, Mus musculus
aggctccgacataaagctggtctgc

SEQ ID NO: 196110 - DNA, 25 bp, Mus musculus
aggctccgacattaagctggtctgc

SEQ ID NO: 196111 - DNA, 25 bp, Mus musculus
aggctccggaacaatgtcccagagg

SEQ ID NO: 196112 - DNA, 25 bp, Mus musculus
aggctccggaactatgtcccagagg

SEQ ID NO: 196113 - DNA, 25 bp, Mus musculus
aggctccggcctcagctaagtcagc

SEQ ID NO: 196114 - DNA, 25 bp, Mus musculus
aggctccggcctgagctaagtcagc

SEQ ID NO: 196115 - DNA, 25 bp, Mus musculus
aggctccgtcttcatcatggttggg

SEQ ID NO: 196116 - DNA, 25 bp, Mus musculus
aggctccgtcttgatcatggttggg

SEQ ID NO: 196117 - DNA, 25 bp, Mus musculus
aggctccgttgcatgatctggacag

SEQ ID NO: 196118 - DNA, 25 bp, Mus musculus
aggctccgttgcttgatctggacag

SEQ ID NO: 196119 - DNA, 25 bp, Mus musculus
aggctcctaagaagaccacaacttc

SEQ ID NO: 196120 - DNA, 25 bp, Mus musculus
aggctcctaagatgaccacaacttc

SEQ ID NO: 196121 - DNA, 25 bp, Mus musculus
aggctcctaaggctaaagtaactga

SEQ ID NO: 196122 - DNA, 25 bp, Mus musculus
aggctcctaagggtaaagtaactga

SEQ ID NO: 196123 - DNA, 25 bp, Mus musculus
aggctcctaggaattttcatgctgg

SEQ ID NO: 196124 - DNA, 25 bp, Mus musculus
aggctcctaggatttttcatgctgg

SEQ ID NO: 196125 - DNA, 25 bp, Mus musculus
aggctcctagtgcttttgcacccaa

SEQ ID NO: 196126 - DNA, 25 bp, Mus musculus
aggctcctagtggttttgcacccaa

SEQ ID NO: 196127 - DNA, 25 bp, Mus musculus
aggctcctataacttcatctccagc

SEQ ID NO: 196128 - DNA, 25 bp, Mus musculus
aggctcctataagttcatctccagc

SEQ ID NO: 196129 - DNA, 25 bp, Mus musculus
aggctcctatcaccaagctattgtt

SEQ ID NO: 196130 - DNA, 25 bp, Mus musculus
aggctcctatcagcaagctattgtt

SEQ ID NO: 196131 - DNA, 25 bp, Mus musculus
aggctcctatgcacaaatgatcttg

SEQ ID NO: 196132 - DNA, 25 bp, Mus musculus
aggctcctatgctcaaatgatcttg

SEQ ID NO: 196133 - DNA, 25 bp, Mus musculus
aggctcctattgcagtctgttgtat

SEQ ID NO: 196134 - DNA, 25 bp, Mus musculus
aggctcctattggagtctgttgtat

SEQ ID NO: 196135 - DNA, 25 bp, Mus musculus
aggctcctcattctgctgccatatt

SEQ ID NO: 196136 - DNA, 25 bp, Mus musculus
aggctcctcattgtgctgccatatt

SEQ ID NO: 196137 - DNA, 25 bp, Mus musculus
aggctcctccagctaggccagtgaa

SEQ ID NO: 196138 - DNA, 25 bp, Mus musculus
aggctcctccaggtaggccagtgaa

SEQ ID NO: 196139 - DNA, 25 bp, Mus musculus
aggctcctcctacagtcgggactga

SEQ ID NO: 196140 - DNA, 25 bp, Mus musculus
aggctcctcctagagtcgggactga

SEQ ID NO: 196141 - DNA, 25 bp, Mus musculus
aggctcctcgctaggaagaccacgg

SEQ ID NO: 196142 - DNA, 25 bp, Mus musculus
aggctcctcgcttggaagaccacgg

SEQ ID NO: 196143 - DNA, 25 bp, Mus musculus
aggctcctctatcggaacacagcca

SEQ ID NO: 196144 - DNA, 25 bp, Mus musculus
aggctcctctatgggaacacagcca

SEQ ID NO: 196145 - DNA, 25 bp, Mus musculus
aggctcctctcgatacacagacatt

SEQ ID NO: 196146 - DNA, 25 bp, Mus musculus
aggctcctctcgttacacagacatt

SEQ ID NO: 196147 - DNA, 25 bp, Mus musculus
aggctcctgaagaacactgctggct

SEQ ID NO: 196148 - DNA, 25 bp, Mus musculus
aggctcctgaagaggatcttgtcat

SEQ ID NO: 196149 - DNA, 25 bp, Mus musculus
aggctcctgaagtacactgctggct

SEQ ID NO: 196150 - DNA, 25 bp, Mus musculus
aggctcctgaagtggatcttgtcat

SEQ ID NO: 196151 - DNA, 25 bp, Mus musculus
aggctcctgaggaacatgggcttca

SEQ ID NO: 196152 - DNA, 25 bp, Mus musculus
aggctcctgaggtacatgggcttca

SEQ ID NO: 196153 - DNA, 25 bp, Mus musculus
aggctcctgagtcgatgatgcccca

SEQ ID NO: 196154 - DNA, 25 bp, Mus musculus
aggctcctgagtggatgatgcccca

SEQ ID NO: 196155 - DNA, 25 bp, Mus musculus
aggctcctgcaacacattcgagatc

SEQ ID NO: 196156 - DNA, 25 bp, Mus musculus
aggctcctgcaagacattcgagatc

SEQ ID NO: 196157 - DNA, 25 bp, Mus musculus
aggctcctggatacgttgcatttgg

SEQ ID NO: 196158 - DNA, 25 bp, Mus musculus
aggctcctggattcgttgcatttgg

SEQ ID NO: 196159 - DNA, 25 bp, Mus musculus
aggctcctggtcagagaaaggagac

SEQ ID NO: 196160 - DNA, 25 bp, Mus musculus
aggctcctggtcaggctggaagcat

SEQ ID NO: 196161 - DNA, 25 bp, Mus musculus
aggctcctggtctgagaaaggagac

SEQ ID NO: 196162 - DNA, 25 bp, Mus musculus
aggctcctggtctggctggaagcat

SEQ ID NO: 196163 - DNA, 25 bp, Mus musculus
aggctcctgtacatatttcttgtgc

SEQ ID NO: 196164 - DNA, 25 bp, Mus musculus
aggctcctgtacttatttcttgtgc

SEQ ID NO: 196165 - DNA, 25 bp, Mus musculus
aggctcctgtgacaggacctcagct

SEQ ID NO: 196166 - DNA, 25 bp, Mus musculus
aggctcctgtgagaggacctcagct

SEQ ID NO: 196167 - DNA, 25 bp, Mus musculus
aggctcctgtttaaaacctttgcag

SEQ ID NO: 196168 - DNA, 25 bp, Mus musculus
aggctcctgttttaaacctttgcag

SEQ ID NO: 196169 - DNA, 25 bp, Mus musculus
aggctccttagcactgtggctgtga

SEQ ID NO: 196170 - DNA, 25 bp, Mus musculus
aggctccttagctctgtggctgtga

SEQ ID NO: 196171 - DNA, 25 bp, Mus musculus
aggctccttagtccccgcagggatg

SEQ ID NO: 196172 - DNA, 25 bp, Mus musculus
aggctccttagtgcccgcagggatg

SEQ ID NO: 196173 - DNA, 25 bp, Mus musculus
aggctccttcaacggcttggaggaa

SEQ ID NO: 196174 - DNA, 25 bp, Mus musculus
aggctccttcaagggcttggaggaa

SEQ ID NO: 196175 - DNA, 25 bp, Mus musculus
aggctcctttctattctcagtctgg

SEQ ID NO: 196176 - DNA, 25 bp, Mus musculus
aggctcctttcttttctcagtctgg

SEQ ID NO: 196177 - DNA, 25 bp, Mus musculus
aggctcgagatacgctgtgcttttc

SEQ ID NO: 196178 - DNA, 25 bp, Mus musculus
aggctcgagataggctgtgcttttc

SEQ ID NO: 196179 - DNA, 25 bp, Mus musculus
aggctcgagtcaacagcgtcatgct

SEQ ID NO: 196180 - DNA, 25 bp, Mus musculus
aggctcgagtcatcagcgtcatgct

SEQ ID NO: 196181 - DNA, 25 bp, Mus musculus
aggctcgagttgatgcccacaggtg

SEQ ID NO: 196182 - DNA, 25 bp, Mus musculus
aggctcgagttgttgcccacaggtg

SEQ ID NO: 196183 - DNA, 25 bp, Mus musculus
aggctcgcacacacagggtctgctg

SEQ ID NO: 196184 - DNA, 25 bp, Mus musculus
aggctcgcacactcagggtctgctg

SEQ ID NO: 196185 - DNA, 25 bp, Mus musculus
aggctcgccaagagtgctgacagtg

SEQ ID NO: 196186 - DNA, 25 bp, Mus musculus
aggctcgccaagtgtgctgacagtg

SEQ ID NO: 196187 - DNA, 25 bp, Mus musculus
aggctcgccactcttgctcagtggg

SEQ ID NO: 196188 - DNA, 25 bp, Mus musculus
aggctcgccactgttgctcagtggg

SEQ ID NO: 196189 - DNA, 25 bp, Mus musculus
aggctcgcctcaaactttacagaga

SEQ ID NO: 196190 - DNA, 25 bp, Mus musculus
aggctcgcctcatactttacagaga

SEQ ID NO: 196191 - DNA, 25 bp, Mus musculus
aggctcgcctctcaccgggttggct

SEQ ID NO: 196192 - DNA, 25 bp, Mus musculus
aggctcgcctctgaccgggttggct

SEQ ID NO: 196193 - DNA, 25 bp, Mus musculus
aggctcgccttgaacttaggacatc

SEQ ID NO: 196194 - DNA, 25 bp, Mus musculus
aggctcgccttgtacttaggacatc

SEQ ID NO: 196195 - DNA, 25 bp, Mus musculus
aggctcgctagacagtgcaacctat

SEQ ID NO: 196196 - DNA, 25 bp, Mus musculus
aggctcgctagagagtgcaacctat

SEQ ID NO: 196197 - DNA, 25 bp, Mus musculus
aggctcgctggaaattgctgcaggt

SEQ ID NO: 196198 - DNA, 25 bp, Mus musculus
aggctcgctggatattgctgcaggt

SEQ ID NO: 196199 - DNA, 25 bp, Mus musculus
aggctcggcaaaccctgatggaaaa

SEQ ID NO: 196200 - DNA, 25 bp, Mus musculus
aggctcggcaaagcctgatggaaaa

SEQ ID NO: 196201 - DNA, 25 bp, Mus musculus
aggctcggcgcacctgcacaagtct

SEQ ID NO: 196202 - DNA, 25 bp, Mus musculus
aggctcggcgcagctgcacaagtct

SEQ ID NO: 196203 - DNA, 25 bp, Mus musculus
aggctcgggaacagggttggcgtag

SEQ ID NO: 196204 - DNA, 25 bp, Mus musculus
aggctcgggaactgggttggcgtag

SEQ ID NO: 196205 - DNA, 25 bp, Mus musculus
aggctcgggcttcgcacaccaaagg

SEQ ID NO: 196206 - DNA, 25 bp, Mus musculus
aggctcgggcttggcacaccaaagg

SEQ ID NO: 196207 - DNA, 25 bp, Mus musculus
aggctcggtgacacgggaatcctga

SEQ ID NO: 196208 - DNA, 25 bp, Mus musculus
aggctcggtgactcgggaatcctga

SEQ ID NO: 196209 - DNA, 25 bp, Mus musculus
aggctcgtcactcgaggacatagga

SEQ ID NO: 196210 - DNA, 25 bp, Mus musculus
aggctcgtcactggaggacatagga

SEQ ID NO: 196211 - DNA, 25 bp, Mus musculus
aggctcgtgacaatttctctgggtc

SEQ ID NO: 196212 - DNA, 25 bp, Mus musculus
aggctcgtgacattttctctgggtc

SEQ ID NO: 196213 - DNA, 25 bp, Mus musculus
aggctctaaaatcccctcctaagaa

SEQ ID NO: 196214 - DNA, 25 bp, Mus musculus
aggctctaaaatgccctcctaagaa

SEQ ID NO: 196215 - DNA, 25 bp, Mus musculus
aggctctaaagcaccttcagaaaaa

SEQ ID NO: 196216 - DNA, 25 bp, Mus musculus
aggctctaaagctccttcagaaaaa

SEQ ID NO: 196217 - DNA, 25 bp, Mus musculus
aggctctaagcacagaagctttcaa

SEQ ID NO: 196218 - DNA, 25 bp, Mus musculus
aggctctaagcagagaagctttcaa

SEQ ID NO: 196219 - DNA, 25 bp, Mus musculus
aggctctaaggcaatgctgctgtca

SEQ ID NO: 196220 - DNA, 25 bp, Mus musculus
aggctctaaggctatgctgctgtca

SEQ ID NO: 196221 - DNA, 25 bp, Mus musculus
aggctctaatagctggaccaaatag

SEQ ID NO: 196222 - DNA, 25 bp, Mus musculus
aggctctaataggtggaccaaatag

SEQ ID NO: 196223 - DNA, 25 bp, Mus musculus
aggctctaccctcctcagattttta

SEQ ID NO: 196224 - DNA, 25 bp, Mus musculus
aggctctaccctgctcagattttta

SEQ ID NO: 196225 - DNA, 25 bp, Mus musculus
aggctctagttgatgccggcgacaa

SEQ ID NO: 196226 - DNA, 25 bp, Mus musculus
aggctctagttgttgccggcgacaa

SEQ ID NO: 196227 - DNA, 25 bp, Mus musculus
aggctctataacagtgtttggcact

SEQ ID NO: 196228 - DNA, 25 bp, Mus musculus
aggctctataactgtgtttggcact

SEQ ID NO: 196229 - DNA, 25 bp, Mus musculus
aggctctatcctcttggtggctttt

SEQ ID NO: 196230 - DNA, 25 bp, Mus musculus
aggctctatcctgttggtggctttt

SEQ ID NO: 196231 - DNA, 25 bp, Mus musculus
aggctctatctgattacagtgttcc

SEQ ID NO: 196232 - DNA, 25 bp, Mus musculus
aggctctatctgtttacagtgttcc

SEQ ID NO: 196233 - DNA, 25 bp, Mus musculus
aggctctatgtcacatcaggacggc

SEQ ID NO: 196234 - DNA, 25 bp, Mus musculus
aggctctatgtctcatcaggacggc

SEQ ID NO: 196235 - DNA, 25 bp, Mus musculus
aggctctcaaccatgaagctacagt

SEQ ID NO: 196236 - DNA, 25 bp, Mus musculus
aggctctcaaccttgaagctacagt

SEQ ID NO: 196237 - DNA, 25 bp, Mus musculus
aggctctcaaggctttaggacctgg

SEQ ID NO: 196238 - DNA, 25 bp, Mus musculus
aggctctcaagggtttaggacctgg

SEQ ID NO: 196239 - DNA, 25 bp, Mus musculus
aggctctcacacatgcatagcaagg

SEQ ID NO: 196240 - DNA, 25 bp, Mus musculus
aggctctcacacttgcatagcaagg

SEQ ID NO: 196241 - DNA, 25 bp, Mus musculus
aggctctcacagcagcatcccaggg

SEQ ID NO: 196242 - DNA, 25 bp, Mus musculus
aggctctcacaggagcatcccaggg

SEQ ID NO: 196243 - DNA, 25 bp, Mus musculus
aggctctcacccagcaaggaaatga

SEQ ID NO: 196244 - DNA, 25 bp, Mus musculus
aggctctcaccctgcaaggaaatga

SEQ ID NO: 196245 - DNA, 25 bp, Mus musculus
aggctctcactaaatgtccttgact

SEQ ID NO: 196246 - DNA, 25 bp, Mus musculus
aggctctcactatatgtccttgact

SEQ ID NO: 196247 - DNA, 25 bp, Mus musculus
aggctctcacttcggcatttggttc

SEQ ID NO: 196248 - DNA, 25 bp, Mus musculus
aggctctcacttgggcatttggttc

SEQ ID NO: 196249 - DNA, 25 bp, Mus musculus
aggctctcagctagttatgggtcca

SEQ ID NO: 196250 - DNA, 25 bp, Mus musculus
aggctctcagcttgttatgggtcca

SEQ ID NO: 196251 - DNA, 25 bp, Mus musculus
aggctctcagtgaggatgcgccctt

SEQ ID NO: 196252 - DNA, 25 bp, Mus musculus
aggctctcagtgtggatgcgccctt

SEQ ID NO: 196253 - DNA, 25 bp, Mus musculus
aggctctcagttatgatgcccagaa

SEQ ID NO: 196254 - DNA, 25 bp, Mus musculus
aggctctcagttttgatgcccagaa

SEQ ID NO: 196255 - DNA, 25 bp, Mus musculus
aggctctcatggaaaccttttcagt

SEQ ID NO: 196256 - DNA, 25 bp, Mus musculus
aggctctcatggtaaccttttcagt

SEQ ID NO: 196257 - DNA, 25 bp, Mus musculus
aggctctccacgagcagctcaaaga

SEQ ID NO: 196258 - DNA, 25 bp, Mus musculus
aggctctccacgtgcagctcaaaga

SEQ ID NO: 196259 - DNA, 25 bp, Mus musculus
aggctctccaggcaacactgtgtat

SEQ ID NO: 196260 - DNA, 25 bp, Mus musculus
aggctctccagggaacactgtgtat

SEQ ID NO: 196261 - DNA, 25 bp, Mus musculus
aggctctcccaaatcaatacttatg

SEQ ID NO: 196262 - DNA, 25 bp, Mus musculus
aggctctcccaattcaatacttatg

SEQ ID NO: 196263 - DNA, 25 bp, Mus musculus
aggctctcctatcaggtactttaac

SEQ ID NO: 196264 - DNA, 25 bp, Mus musculus
aggctctcctatgaggtactttaac

SEQ ID NO: 196265 - DNA, 25 bp, Mus musculus
aggctctcgctcagcagctcctgtt

SEQ ID NO: 196266 - DNA, 25 bp, Mus musculus
aggctctcgctctgcagctcctgtt

SEQ ID NO: 196267 - DNA, 25 bp, Mus musculus
aggctctcgctgaatttttaactgg

SEQ ID NO: 196268 - DNA, 25 bp, Mus musculus
aggctctcgctgtatttttaactgg

SEQ ID NO: 196269 - DNA, 25 bp, Mus musculus
aggctctctaagatacacgaaaggg

SEQ ID NO: 196270 - DNA, 25 bp, Mus musculus
aggctctctaagttacacgaaaggg

SEQ ID NO: 196271 - DNA, 25 bp, Mus musculus
aggctctctaccctaggcagatttc

SEQ ID NO: 196272 - DNA, 25 bp, Mus musculus
aggctctctaccgtaggcagatttc

SEQ ID NO: 196273 - DNA, 25 bp, Mus musculus
aggctctctccccagattatgaggg

SEQ ID NO: 196274 - DNA, 25 bp, Mus musculus
aggctctctcccgagattatgaggg

SEQ ID NO: 196275 - DNA, 25 bp, Mus musculus
aggctctctgatcgccacagagaga

SEQ ID NO: 196276 - DNA, 25 bp, Mus musculus
aggctctctgatctgtggctgtaaa

SEQ ID NO: 196277 - DNA, 25 bp, Mus musculus
aggctctctgatggccacagagaga

SEQ ID NO: 196278 - DNA, 25 bp, Mus musculus
aggctctctgatgtgtggctgtaaa

SEQ ID NO: 196279 - DNA, 25 bp, Mus musculus
aggctctctgcacacttacagattt

SEQ ID NO: 196280 - DNA, 25 bp, Mus musculus
aggctctctgcagacttacagattt

SEQ ID NO: 196281 - DNA, 25 bp, Mus musculus
aggctctctgccattgtacttatgt

SEQ ID NO: 196282 - DNA, 25 bp, Mus musculus
aggctctctgcctttgtacttatgt

SEQ ID NO: 196283 - DNA, 25 bp, Mus musculus
aggctctctgtaattgctttcttaa

SEQ ID NO: 196284 - DNA, 25 bp, Mus musculus
aggctctctgtatttgctttcttaa

SEQ ID NO: 196285 - DNA, 25 bp, Mus musculus
aggctctctgtgcttgcactgtgaa

SEQ ID NO: 196286 - DNA, 25 bp, Mus musculus
aggctctctgtggttgcactgtgaa

SEQ ID NO: 196287 - DNA, 25 bp, Mus musculus
aggctctctttcaggtgtgatgtct

SEQ ID NO: 196288 - DNA, 25 bp, Mus musculus
aggctctctttctggtgtgatgtct

SEQ ID NO: 196289 - DNA, 25 bp, Mus musculus
aggctctcttttcctagagaccgta

SEQ ID NO: 196290 - DNA, 25 bp, Mus musculus
aggctctcttttgctagagaccgta

SEQ ID NO: 196291 - DNA, 25 bp, Mus musculus
aggctctgaatcacacgctgggcag

SEQ ID NO: 196292 - DNA, 25 bp, Mus musculus
aggctctgaatctcacgctgggcag

SEQ ID NO: 196293 - DNA, 25 bp, Mus musculus
aggctctgacttcgagttcatcttt

SEQ ID NO: 196294 - DNA, 25 bp, Mus musculus
aggctctgacttggagttcatcttt

SEQ ID NO: 196295 - DNA, 25 bp, Mus musculus
aggctctgaggacggataccccacc

SEQ ID NO: 196296 - DNA, 25 bp, Mus musculus
aggctctgaggagggataccccacc

SEQ ID NO: 196297 - DNA, 25 bp, Mus musculus
aggctctgagtgacagcccatctcg

SEQ ID NO: 196298 - DNA, 25 bp, Mus musculus
aggctctgagtgtcagcccatctcg

SEQ ID NO: 196299 - DNA, 25 bp, Mus musculus
aggctctgcaaacctcggtcagagt

SEQ ID NO: 196300 - DNA, 25 bp, Mus musculus
aggctctgcaaagctcggtcagagt

SEQ ID NO: 196301 - DNA, 25 bp, Mus musculus
aggctctgcagaccttagcggcagt

SEQ ID NO: 196302 - DNA, 25 bp, Mus musculus
aggctctgcagagcttagcggcagt

SEQ ID NO: 196303 - DNA, 25 bp, Mus musculus
aggctctgccaacctgtagctggtg

SEQ ID NO: 196304 - DNA, 25 bp, Mus musculus
aggctctgccaagctgtagctggtg

SEQ ID NO: 196305 - DNA, 25 bp, Mus musculus
aggctctgcccaagattcaacaaga

SEQ ID NO: 196306 - DNA, 25 bp, Mus musculus
aggctctgcccatgattcaacaaga

SEQ ID NO: 196307 - DNA, 25 bp, Mus musculus
aggctctgccccagattctttacag

SEQ ID NO: 196308 - DNA, 25 bp, Mus musculus
aggctctgcccctgattctttacag

SEQ ID NO: 196309 - DNA, 25 bp, Mus musculus
aggctctgcccgatggaccctagct

SEQ ID NO: 196310 - DNA, 25 bp, Mus musculus
aggctctgcccgttggaccctagct

SEQ ID NO: 196311 - DNA, 25 bp, Mus musculus
aggctctgcctaaagtttccggcca

SEQ ID NO: 196312 - DNA, 25 bp, Mus musculus
aggctctgcctatagtttccggcca

SEQ ID NO: 196313 - DNA, 25 bp, Mus musculus
aggctctgcgggaagccgaagacct

SEQ ID NO: 196314 - DNA, 25 bp, Mus musculus
aggctctgcgggtagccgaagacct

SEQ ID NO: 196315 - DNA, 25 bp, Mus musculus
aggctctgctctcgaatcttcaagg

SEQ ID NO: 196316 - DNA, 25 bp, Mus musculus
aggctctgctctggaatcttcaagg

SEQ ID NO: 196317 - DNA, 25 bp, Mus musculus
aggctctgctgacctatgccaaaga

SEQ ID NO: 196318 - DNA, 25 bp, Mus musculus
aggctctgctgagctatgccaaaga

SEQ ID NO: 196319 - DNA, 25 bp, Mus musculus
aggctctgcttcatctatggatggc

SEQ ID NO: 196320 - DNA, 25 bp, Mus musculus
aggctctgcttcttctatggatggc

SEQ ID NO: 196321 - DNA, 25 bp, Mus musculus
aggctctggaccatgcgtgtaccgt

SEQ ID NO: 196322 - DNA, 25 bp, Mus musculus
aggctctggaccttgcgtgtaccgt

SEQ ID NO: 196323 - DNA, 25 bp, Mus musculus
aggctctggacgctaacctctggag

SEQ ID NO: 196324 - DNA, 25 bp, Mus musculus
aggctctggacggtaacctctggag

SEQ ID NO: 196325 - DNA, 25 bp, Mus musculus
aggctctggagaacagcacatcccc

SEQ ID NO: 196326 - DNA, 25 bp, Mus musculus
aggctctggagatcagcacatcccc

SEQ ID NO: 196327 - DNA, 25 bp, Mus musculus
aggctctggagcaggacaccttggt

SEQ ID NO: 196328 - DNA, 25 bp, Mus musculus
aggctctggagctggacaccttggt

SEQ ID NO: 196329 - DNA, 25 bp, Mus musculus
aggctctggagtcttgtgttcgatt

SEQ ID NO: 196330 - DNA, 25 bp, Mus musculus
aggctctggagtgttgtgttcgatt

SEQ ID NO: 196331 - DNA, 25 bp, Mus musculus
aggctctggatcaatttgccaccgt

SEQ ID NO: 196332 - DNA, 25 bp, Mus musculus
aggctctggatctatttgccaccgt

SEQ ID NO: 196333 - DNA, 25 bp, Mus musculus
aggctctggccaagctcatgctggg

SEQ ID NO: 196334 - DNA, 25 bp, Mus musculus
aggctctggccaaggtgacctaaaa

SEQ ID NO: 196335 - DNA, 25 bp, Mus musculus
aggctctggccatgctcatgctggg

SEQ ID NO: 196336 - DNA, 25 bp, Mus musculus
aggctctggccatggtgacctaaaa

SEQ ID NO: 196337 - DNA, 25 bp, Mus musculus
aggctctggcctaggatccaagcct

SEQ ID NO: 196338 - DNA, 25 bp, Mus musculus
aggctctggccttggatccaagcct

SEQ ID NO: 196339 - DNA, 25 bp, Mus musculus
aggctctggctcaatgctggctgtt

SEQ ID NO: 196340 - DNA, 25 bp, Mus musculus
aggctctggctctatgctggctgtt

SEQ ID NO: 196341 - DNA, 25 bp, Mus musculus
aggctctggctgagcctccctctgg

SEQ ID NO: 196342 - DNA, 25 bp, Mus musculus
aggctctggctgtgcctccctctgg

SEQ ID NO: 196343 - DNA, 25 bp, Mus musculus
aggctctgggccaggtgtagcactc

SEQ ID NO: 196344 - DNA, 25 bp, Mus musculus
aggctctgggcctggtgtagcactc

SEQ ID NO: 196345 - DNA, 25 bp, Mus musculus
aggctctgggctaagggtgctacat

SEQ ID NO: 196346 - DNA, 25 bp, Mus musculus
aggctctgggctcttgattcttctt

SEQ ID NO: 196347 - DNA, 25 bp, Mus musculus
aggctctgggctgttgattcttctt

SEQ ID NO: 196348 - DNA, 25 bp, Mus musculus
aggctctgggcttagggtgctacat

SEQ ID NO: 196349 - DNA, 25 bp, Mus musculus
aggctctggggtctaaactcataca

SEQ ID NO: 196350 - DNA, 25 bp, Mus musculus
aggctctggggtgtaaactcataca

SEQ ID NO: 196351 - DNA, 25 bp, Mus musculus
aggctctgggtccatcttcctgcag

SEQ ID NO: 196352 - DNA, 25 bp, Mus musculus
aggctctgggtcgatcttcctgcag

SEQ ID NO: 196353 - DNA, 25 bp, Mus musculus
aggctctggtgcagcccgagcatgc

SEQ ID NO: 196354 - DNA, 25 bp, Mus musculus
aggctctggtgcagcgctacataga

SEQ ID NO: 196355 - DNA, 25 bp, Mus musculus
aggctctggtgctgcccgagcatgc

SEQ ID NO: 196356 - DNA, 25 bp, Mus musculus
aggctctggtgctgcgctacataga

SEQ ID NO: 196357 - DNA, 25 bp, Mus musculus
aggctctgtctaactcggtgggaga

SEQ ID NO: 196358 - DNA, 25 bp, Mus musculus
aggctctgtctatctcggtgggaga

SEQ ID NO: 196359 - DNA, 25 bp, Mus musculus
aggctctgtggtcccttggtgacat

SEQ ID NO: 196360 - DNA, 25 bp, Mus musculus
aggctctgtggtgccttggtgacat

SEQ ID NO: 196361 - DNA, 25 bp, Mus musculus
aggctctgtgtcaccattctgaata

SEQ ID NO: 196362 - DNA, 25 bp, Mus musculus
aggctctgtgtctccattctgaata

SEQ ID NO: 196363 - DNA, 25 bp, Mus musculus
aggctctgttcacctgcaatgggcg

SEQ ID NO: 196364 - DNA, 25 bp, Mus musculus
aggctctgttcagctgcaatgggcg

SEQ ID NO: 196365 - DNA, 25 bp, Mus musculus
aggctctgtttccagcacctagatg

SEQ ID NO: 196366 - DNA, 25 bp, Mus musculus
aggctctgtttcgagcacctagatg

SEQ ID NO: 196367 - DNA, 25 bp, Mus musculus
aggctctgttttctgcagtagtctt

SEQ ID NO: 196368 - DNA, 25 bp, Mus musculus
aggctctgttttgtgcagtagtctt

SEQ ID NO: 196369 - DNA, 25 bp, Mus musculus
aggctcttaaacacaggcaactgca

SEQ ID NO: 196370 - DNA, 25 bp, Mus musculus
aggctcttaaactcaggcaactgca

SEQ ID NO: 196371 - DNA, 25 bp, Mus musculus
aggctcttacctagtattttataag

SEQ ID NO: 196372 - DNA, 25 bp, Mus musculus
aggctcttaccttgtattttataag

SEQ ID NO: 196373 - DNA, 25 bp, Mus musculus
aggctcttagacctggagatcctgg

SEQ ID NO: 196374 - DNA, 25 bp, Mus musculus
aggctcttagacgtggagatcctgg

SEQ ID NO: 196375 - DNA, 25 bp, Mus musculus
aggctcttagccagcagaaaaccac

SEQ ID NO: 196376 - DNA, 25 bp, Mus musculus
aggctcttagcctgcagaaaaccac

SEQ ID NO: 196377 - DNA, 25 bp, Mus musculus
aggctcttagctccctctggaaatg

SEQ ID NO: 196378 - DNA, 25 bp, Mus musculus
aggctcttagctgcctctggaaatg

SEQ ID NO: 196379 - DNA, 25 bp, Mus musculus
aggctcttatctctcgggaacttgt

SEQ ID NO: 196380 - DNA, 25 bp, Mus musculus
aggctcttatctgtcgggaacttgt

SEQ ID NO: 196381 - DNA, 25 bp, Mus musculus
aggctcttcatgacctaaacttgag

SEQ ID NO: 196382 - DNA, 25 bp, Mus musculus
aggctcttcatgtcctaaacttgag

SEQ ID NO: 196383 - DNA, 25 bp, Mus musculus
aggctcttccggcttagacacacag

SEQ ID NO: 196384 - DNA, 25 bp, Mus musculus
aggctcttccgggttagacacacag

SEQ ID NO: 196385 - DNA, 25 bp, Mus musculus
aggctcttccttagactgggtttat

SEQ ID NO: 196386 - DNA, 25 bp, Mus musculus
aggctcttccttcagttggaggtaa

SEQ ID NO: 196387 - DNA, 25 bp, Mus musculus
aggctcttccttctggttcatttta

SEQ ID NO: 196388 - DNA, 25 bp, Mus musculus
aggctcttccttgagttggaggtaa

SEQ ID NO: 196389 - DNA, 25 bp, Mus musculus
aggctcttccttgtggttcatttta

SEQ ID NO: 196390 - DNA, 25 bp, Mus musculus
aggctcttcctttgactgggtttat

SEQ ID NO: 196391 - DNA, 25 bp, Mus musculus
aggctcttctccaacgtttcagaac

SEQ ID NO: 196392 - DNA, 25 bp, Mus musculus
aggctcttctccaactgtcattgtg

SEQ ID NO: 196393 - DNA, 25 bp, Mus musculus
aggctcttctcctacgtttcagaac

SEQ ID NO: 196394 - DNA, 25 bp, Mus musculus
aggctcttctcctactgtcattgtg

SEQ ID NO: 196395 - DNA, 25 bp, Mus musculus
aggctcttgaaaaggacccttcaaa

SEQ ID NO: 196396 - DNA, 25 bp, Mus musculus
aggctcttgaaatggacccttcaaa

SEQ ID NO: 196397 - DNA, 25 bp, Mus musculus
aggctcttgcctagctgattgctgc

SEQ ID NO: 196398 - DNA, 25 bp, Mus musculus
aggctcttgccttgctgattgctgc

SEQ ID NO: 196399 - DNA, 25 bp, Mus musculus
aggctcttgctgataggaacatttc

SEQ ID NO: 196400 - DNA, 25 bp, Mus musculus
aggctcttgctgttaggaacatttc

SEQ ID NO: 196401 - DNA, 25 bp, Mus musculus
aggctcttgcttcagtctccgagtg

SEQ ID NO: 196402 - DNA, 25 bp, Mus musculus
aggctcttgcttgagtctccgagtg

SEQ ID NO: 196403 - DNA, 25 bp, Mus musculus
aggctcttggccaatactcagttat

SEQ ID NO: 196404 - DNA, 25 bp, Mus musculus
aggctcttggcctatactcagttat

SEQ ID NO: 196405 - DNA, 25 bp, Mus musculus
aggctcttgtgcctgtgctgcaagc

SEQ ID NO: 196406 - DNA, 25 bp, Mus musculus
aggctcttgtgcgtgtgctgcaagc

SEQ ID NO: 196407 - DNA, 25 bp, Mus musculus
aggctctttaccctgagtcatagaa

SEQ ID NO: 196408 - DNA, 25 bp, Mus musculus
aggctctttaccgtgagtcatagaa

SEQ ID NO: 196409 - DNA, 25 bp, Mus musculus
aggctctttatgaaggtctttggaa

SEQ ID NO: 196410 - DNA, 25 bp, Mus musculus
aggctctttatgtaggtctttggaa

SEQ ID NO: 196411 - DNA, 25 bp, Mus musculus
aggctctttcctcagatgtactcaa

SEQ ID NO: 196412 - DNA, 25 bp, Mus musculus
aggctctttcctgagatgtactcaa

SEQ ID NO: 196413 - DNA, 25 bp, Mus musculus
aggctctttgagctgctgacccttc

SEQ ID NO: 196414 - DNA, 25 bp, Mus musculus
aggctctttgaggtgctgacccttc

SEQ ID NO: 196415 - DNA, 25 bp, Mus musculus
aggctctttggcaatttgcatctgg

SEQ ID NO: 196416 - DNA, 25 bp, Mus musculus
aggctctttggccagtgacctactg

SEQ ID NO: 196417 - DNA, 25 bp, Mus musculus
aggctctttggcgagtgacctactg

SEQ ID NO: 196418 - DNA, 25 bp, Mus musculus
aggctctttggctatttgcatctgg

SEQ ID NO: 196419 - DNA, 25 bp, Mus musculus
aggctcttttctctcagagtccaag

SEQ ID NO: 196420 - DNA, 25 bp, Mus musculus
aggctcttttctgtcagagtccaag

SEQ ID NO: 196421 - DNA, 25 bp, Mus musculus
aggctgaaaaatcccctttgacttg

SEQ ID NO: 196422 - DNA, 25 bp, Mus musculus
aggctgaaaaatgccctttgacttg

SEQ ID NO: 196423 - DNA, 25 bp, Mus musculus
aggctgaaacacatcacctgttctt

SEQ ID NO: 196424 - DNA, 25 bp, Mus musculus
aggctgaaacacttcacctgttctt

SEQ ID NO: 196425 - DNA, 25 bp, Mus musculus
aggctgaaactcacatacgaggcga

SEQ ID NO: 196426 - DNA, 25 bp, Mus musculus
aggctgaaactctcatacgaggcga

SEQ ID NO: 196427 - DNA, 25 bp, Mus musculus
aggctgaaagtccaaccagaggttc

SEQ ID NO: 196428 - DNA, 25 bp, Mus musculus
aggctgaaagtcgaaccagaggttc

SEQ ID NO: 196429 - DNA, 25 bp, Mus musculus
aggctgaacacacagccggacccag

SEQ ID NO: 196430 - DNA, 25 bp, Mus musculus
aggctgaacacagagccggacccag

SEQ ID NO: 196431 - DNA, 25 bp, Mus musculus
aggctgaacattcctggttggtcct

SEQ ID NO: 196432 - DNA, 25 bp, Mus musculus
aggctgaacattgctggttggtcct

SEQ ID NO: 196433 - DNA, 25 bp, Mus musculus
aggctgaactggcaaagcaactctt

SEQ ID NO: 196434 - DNA, 25 bp, Mus musculus
aggctgaactgggaaagcaactctt

SEQ ID NO: 196435 - DNA, 25 bp, Mus musculus
aggctgaactgtctctttaaacttc

SEQ ID NO: 196436 - DNA, 25 bp, Mus musculus
aggctgaactgtgtctttaaacttc

SEQ ID NO: 196437 - DNA, 25 bp, Mus musculus
aggctgaacttgacctcctaaggct

SEQ ID NO: 196438 - DNA, 25 bp, Mus musculus
aggctgaacttgtcctcctaaggct

SEQ ID NO: 196439 - DNA, 25 bp, Mus musculus
aggctgaagagaaccgccggcagct

SEQ ID NO: 196440 - DNA, 25 bp, Mus musculus
aggctgaagagatccgccggcagct

SEQ ID NO: 196441 - DNA, 25 bp, Mus musculus
aggctgaagcagacaagccctcggc

SEQ ID NO: 196442 - DNA, 25 bp, Mus musculus
aggctgaagcagtcaagccctcggc

SEQ ID NO: 196443 - DNA, 25 bp, Mus musculus
aggctgaagcggcaccattgtcatg

SEQ ID NO: 196444 - DNA, 25 bp, Mus musculus
aggctgaagcgggaccattgtcatg

SEQ ID NO: 196445 - DNA, 25 bp, Mus musculus
aggctgaaggatctgtgtctctgca

SEQ ID NO: 196446 - DNA, 25 bp, Mus musculus
aggctgaaggatgtgtgtctctgca

SEQ ID NO: 196447 - DNA, 25 bp, Mus musculus
aggctgaatatgacactccaaagag

SEQ ID NO: 196448 - DNA, 25 bp, Mus musculus
aggctgaatatgtcactccaaagag

SEQ ID NO: 196449 - DNA, 25 bp, Mus musculus
aggctgacaatgaagcccgtctctc

SEQ ID NO: 196450 - DNA, 25 bp, Mus musculus
aggctgacaatgtagcccgtctctc

SEQ ID NO: 196451 - DNA, 25 bp, Mus musculus
aggctgacacttctgtcagttgcct

SEQ ID NO: 196452 - DNA, 25 bp, Mus musculus
aggctgacacttgtgtcagttgcct

SEQ ID NO: 196453 - DNA, 25 bp, Mus musculus
aggctgacagcaaacttcggaacgt

SEQ ID NO: 196454 - DNA, 25 bp, Mus musculus
aggctgacagcaccaactactacaa

SEQ ID NO: 196455 - DNA, 25 bp, Mus musculus
aggctgacagcagcaactactacaa

SEQ ID NO: 196456 - DNA, 25 bp, Mus musculus
aggctgacagcatacttcggaacgt

SEQ ID NO: 196457 - DNA, 25 bp, Mus musculus
aggctgacagctatgcgaattaaaa

SEQ ID NO: 196458 - DNA, 25 bp, Mus musculus
aggctgacagctttgcgaattaaaa

SEQ ID NO: 196459 - DNA, 25 bp, Mus musculus
aggctgacaggccacgtccttttta

SEQ ID NO: 196460 - DNA, 25 bp, Mus musculus
aggctgacaggcgacgtccttttta

SEQ ID NO: 196461 - DNA, 25 bp, Mus musculus
aggctgacatgaagccattcctgta

SEQ ID NO: 196462 - DNA, 25 bp, Mus musculus
aggctgacatgatgccattcctgta

SEQ ID NO: 196463 - DNA, 25 bp, Mus musculus
aggctgaccaacctaggtagcagac

SEQ ID NO: 196464 - DNA, 25 bp, Mus musculus
aggctgaccaacgtaggtagcagac

SEQ ID NO: 196465 - DNA, 25 bp, Mus musculus
aggctgaccacgatttcatctgctt

SEQ ID NO: 196466 - DNA, 25 bp, Mus musculus
aggctgaccacgttttcatctgctt

SEQ ID NO: 196467 - DNA, 25 bp, Mus musculus
aggctgaccccaccagacctttcac

SEQ ID NO: 196468 - DNA, 25 bp, Mus musculus
aggctgaccccagcagacctttcac

SEQ ID NO: 196469 - DNA, 25 bp, Mus musculus
aggctgacctgcctgagaaagtgct

SEQ ID NO: 196470 - DNA, 25 bp, Mus musculus
aggctgacctgcgtgagaaagtgct

SEQ ID NO: 196471 - DNA, 25 bp, Mus musculus
aggctgaccttactggaatctctaa

SEQ ID NO: 196472 - DNA, 25 bp, Mus musculus
aggctgaccttagtggaatctctaa

SEQ ID NO: 196473 - DNA, 25 bp, Mus musculus
aggctgacgccgagggcttgacaaa

SEQ ID NO: 196474 - DNA, 25 bp, Mus musculus
aggctgacgccgtgggcttgacaaa

SEQ ID NO: 196475 - DNA, 25 bp, Mus musculus
aggctgacgtggaggtcctcaacga

SEQ ID NO: 196476 - DNA, 25 bp, Mus musculus
aggctgacgtggtggtcctcaacga

SEQ ID NO: 196477 - DNA, 25 bp, Mus musculus
aggctgactaccagtaccggtgacc

SEQ ID NO: 196478 - DNA, 25 bp, Mus musculus
aggctgactacctgtaccggtgacc

SEQ ID NO: 196479 - DNA, 25 bp, Mus musculus
aggctgactatcacaaagggactca

SEQ ID NO: 196480 - DNA, 25 bp, Mus musculus
aggctgactatctcaaagggactca

SEQ ID NO: 196481 - DNA, 25 bp, Mus musculus
aggctgactctgaacttgctaccaa

SEQ ID NO: 196482 - DNA, 25 bp, Mus musculus
aggctgactctgtacttgctaccaa

SEQ ID NO: 196483 - DNA, 25 bp, Mus musculus
aggctgactgctatggagccgatgt

SEQ ID NO: 196484 - DNA, 25 bp, Mus musculus
aggctgactgctttggagccgatgt

SEQ ID NO: 196485 - DNA, 25 bp, Mus musculus
aggctgactgggatcccgccaccag

SEQ ID NO: 196486 - DNA, 25 bp, Mus musculus
aggctgactgggttcccgccaccag

SEQ ID NO: 196487 - DNA, 25 bp, Mus musculus
aggctgactttaagctttgcctcag

SEQ ID NO: 196488 - DNA, 25 bp, Mus musculus
aggctgactttactatgtgggtaaa

SEQ ID NO: 196489 - DNA, 25 bp, Mus musculus
aggctgactttagtatgtgggtaaa

SEQ ID NO: 196490 - DNA, 25 bp, Mus musculus
aggctgactttatgctttgcctcag

SEQ ID NO: 196491 - DNA, 25 bp, Mus musculus
aggctgagaaccaccagctaatggg

SEQ ID NO: 196492 - DNA, 25 bp, Mus musculus
aggctgagaacctccagctaatggg

SEQ ID NO: 196493 - DNA, 25 bp, Mus musculus
aggctgagaacgacgctgctgaaac

SEQ ID NO: 196494 - DNA, 25 bp, Mus musculus
aggctgagaacgtcgctgctgaaac

SEQ ID NO: 196495 - DNA, 25 bp, Mus musculus
aggctgagaataacgaggctgagta

SEQ ID NO: 196496 - DNA, 25 bp, Mus musculus
aggctgagaatatcgaggctgagta

SEQ ID NO: 196497 - DNA, 25 bp, Mus musculus
aggctgagaattcgccctgctaagc

SEQ ID NO: 196498 - DNA, 25 bp, Mus musculus
aggctgagaattggccctgctaagc

SEQ ID NO: 196499 - DNA, 25 bp, Mus musculus
aggctgagagccactgattctaaaa

SEQ ID NO: 196500 - DNA, 25 bp, Mus musculus
aggctgagagcccttcagactggca

SEQ ID NO: 196501 - DNA, 25 bp, Mus musculus
aggctgagagccgttcagactggca

SEQ ID NO: 196502 - DNA, 25 bp, Mus musculus
aggctgagagcctctgattctaaaa

SEQ ID NO: 196503 - DNA, 25 bp, Mus musculus
aggctgagattgaccaagtgatccg

SEQ ID NO: 196504 - DNA, 25 bp, Mus musculus
aggctgagattgtccaagtgatccg

SEQ ID NO: 196505 - DNA, 25 bp, Mus musculus
aggctgagcaaaccatgagcccctg

SEQ ID NO: 196506 - DNA, 25 bp, Mus musculus
aggctgagcaaagcatgagcccctg

SEQ ID NO: 196507 - DNA, 25 bp, Mus musculus
aggctgagcacccattttccagagg

SEQ ID NO: 196508 - DNA, 25 bp, Mus musculus
aggctgagcaccgattttccagagg

SEQ ID NO: 196509 - DNA, 25 bp, Mus musculus
aggctgagcagccttccattctgtg

SEQ ID NO: 196510 - DNA, 25 bp, Mus musculus
aggctgagcagcgttccattctgtg

SEQ ID NO: 196511 - DNA, 25 bp, Mus musculus
aggctgagcatgcttatccagggcc

SEQ ID NO: 196512 - DNA, 25 bp, Mus musculus
aggctgagcatggttatccagggcc

SEQ ID NO: 196513 - DNA, 25 bp, Mus musculus
aggctgagcctgatccaaagcacat

SEQ ID NO: 196514 - DNA, 25 bp, Mus musculus
aggctgagcctgttccaaagcacat

SEQ ID NO: 196515 - DNA, 25 bp, Mus musculus
aggctgagctccacgagcctcggag

SEQ ID NO: 196516 - DNA, 25 bp, Mus musculus
aggctgagctcctcgagcctcggag

SEQ ID NO: 196517 - DNA, 25 bp, Mus musculus
aggctgaggatgaccccgagcttgt

SEQ ID NO: 196518 - DNA, 25 bp, Mus musculus
aggctgaggatgtccccgagcttgt

SEQ ID NO: 196519 - DNA, 25 bp, Mus musculus
aggctgaggcagacaaaaacgacaa

SEQ ID NO: 196520 - DNA, 25 bp, Mus musculus
aggctgaggcagtcaaaaacgacaa

SEQ ID NO: 196521 - DNA, 25 bp, Mus musculus
aggctgaggctcctcggccttgatc

SEQ ID NO: 196522 - DNA, 25 bp, Mus musculus
aggctgaggctcgtcggccttgatc

SEQ ID NO: 196523 - DNA, 25 bp, Mus musculus
aggctgaggctgctattcctttagc

SEQ ID NO: 196524 - DNA, 25 bp, Mus musculus
aggctgaggctggtattcctttagc

SEQ ID NO: 196525 - DNA, 25 bp, Mus musculus
aggctgaggcttccaagctaaagga

SEQ ID NO: 196526 - DNA, 25 bp, Mus musculus
aggctgaggcttgcaagctaaagga

SEQ ID NO: 196527 - DNA, 25 bp, Mus musculus
aggctgaggttcatgtcactcctta

SEQ ID NO: 196528 - DNA, 25 bp, Mus musculus
aggctgaggttcttgtcactcctta

SEQ ID NO: 196529 - DNA, 25 bp, Mus musculus
aggctgagtactccatccgtcggat

SEQ ID NO: 196530 - DNA, 25 bp, Mus musculus
aggctgagtactgcatccgtcggat

SEQ ID NO: 196531 - DNA, 25 bp, Mus musculus
aggctgagtcagctactacggatct

SEQ ID NO: 196532 - DNA, 25 bp, Mus musculus
aggctgagtcaggtactacggatct

SEQ ID NO: 196533 - DNA, 25 bp, Mus musculus
aggctgagtctcatgcagctgagtt

SEQ ID NO: 196534 - DNA, 25 bp, Mus musculus
aggctgagtctcttgcagctgagtt

SEQ ID NO: 196535 - DNA, 25 bp, Mus musculus
aggctgagttgacggctacacatta

SEQ ID NO: 196536 - DNA, 25 bp, Mus musculus
aggctgagttgagggctacacatta

SEQ ID NO: 196537 - DNA, 25 bp, Mus musculus
aggctgatacctaaagtgttctaga

SEQ ID NO: 196538 - DNA, 25 bp, Mus musculus
aggctgataccttaagtgttctaga

SEQ ID NO: 196539 - DNA, 25 bp, Mus musculus
aggctgatagaccaggccggtaccc

SEQ ID NO: 196540 - DNA, 25 bp, Mus musculus
aggctgatagacgaggccggtaccc

SEQ ID NO: 196541 - DNA, 25 bp, Mus musculus
aggctgatcactctggattcccagg

SEQ ID NO: 196542 - DNA, 25 bp, Mus musculus
aggctgatcactgtggattcccagg

SEQ ID NO: 196543 - DNA, 25 bp, Mus musculus
aggctgatcagcataccaggccagt

SEQ ID NO: 196544 - DNA, 25 bp, Mus musculus
aggctgatcagcttaccaggccagt

SEQ ID NO: 196545 - DNA, 25 bp, Mus musculus
aggctgatccagcattctggttcat

SEQ ID NO: 196546 - DNA, 25 bp, Mus musculus
aggctgatccaggattctggttcat

SEQ ID NO: 196547 - DNA, 25 bp, Mus musculus
aggctgatcctgcactttgtctacg

SEQ ID NO: 196548 - DNA, 25 bp, Mus musculus
aggctgatcctggactttgtctacg

SEQ ID NO: 196549 - DNA, 25 bp, Mus musculus
aggctgatcgaacgatcgagagatt

SEQ ID NO: 196550 - DNA, 25 bp, Mus musculus
aggctgatcgaaggatcgagagatt

SEQ ID NO: 196551 - DNA, 25 bp, Mus musculus
aggctgatcgcgacagcctccagga

SEQ ID NO: 196552 - DNA, 25 bp, Mus musculus
aggctgatcgcgtcagcctccagga

SEQ ID NO: 196553 - DNA, 25 bp, Mus musculus
aggctgatgagaaaatgcttgacca

SEQ ID NO: 196554 - DNA, 25 bp, Mus musculus
aggctgatgagataatgcttgacca

SEQ ID NO: 196555 - DNA, 25 bp, Mus musculus
aggctgatgctaatgaggtcactct

SEQ ID NO: 196556 - DNA, 25 bp, Mus musculus
aggctgatgctattgaggtcactct

SEQ ID NO: 196557 - DNA, 25 bp, Mus musculus
aggctgatggctctgtacctattcc

SEQ ID NO: 196558 - DNA, 25 bp, Mus musculus
aggctgatggctgtgtacctattcc

SEQ ID NO: 196559 - DNA, 25 bp, Mus musculus
aggctgatgtggaggttccttaaca

SEQ ID NO: 196560 - DNA, 25 bp, Mus musculus
aggctgatgtggtggttccttaaca

SEQ ID NO: 196561 - DNA, 25 bp, Mus musculus
aggctgatgtgtagaagattcttaa

SEQ ID NO: 196562 - DNA, 25 bp, Mus musculus
aggctgatgtgttgaagattcttaa

SEQ ID NO: 196563 - DNA, 25 bp, Mus musculus
aggctgcaaagcactcatctgtcca

SEQ ID NO: 196564 - DNA, 25 bp, Mus musculus
aggctgcaaagctctcatctgtcca

SEQ ID NO: 196565 - DNA, 25 bp, Mus musculus
aggctgcaacctagtaccaaatcac

SEQ ID NO: 196566 - DNA, 25 bp, Mus musculus
aggctgcaaccttgtaccaaatcac

SEQ ID NO: 196567 - DNA, 25 bp, Mus musculus
aggctgcaatatccagatgtttatt

SEQ ID NO: 196568 - DNA, 25 bp, Mus musculus
aggctgcaatatgcagatgtttatt

SEQ ID NO: 196569 - DNA, 25 bp, Mus musculus
aggctgcaatgtacctagtggcaaa

SEQ ID NO: 196570 - DNA, 25 bp, Mus musculus
aggctgcaatgttcctagtggcaaa

SEQ ID NO: 196571 - DNA, 25 bp, Mus musculus
aggctgcacattaacagtcctcgtg

SEQ ID NO: 196572 - DNA, 25 bp, Mus musculus
aggctgcacatttacagtcctcgtg

SEQ ID NO: 196573 - DNA, 25 bp, Mus musculus
aggctgcaccatctatatgtaacat

SEQ ID NO: 196574 - DNA, 25 bp, Mus musculus
aggctgcaccatgtatatgtaacat

SEQ ID NO: 196575 - DNA, 25 bp, Mus musculus
aggctgcacccacgacagaaggaga

SEQ ID NO: 196576 - DNA, 25 bp, Mus musculus
aggctgcacccaggacagaaggaga

SEQ ID NO: 196577 - DNA, 25 bp, Mus musculus
aggctgcagaatcctgggagtctct

SEQ ID NO: 196578 - DNA, 25 bp, Mus musculus
aggctgcagaatgctgggagtctct

SEQ ID NO: 196579 - DNA, 25 bp, Mus musculus
aggctgcagccacctcttcaaagag

SEQ ID NO: 196580 - DNA, 25 bp, Mus musculus
aggctgcagccagctcttcaaagag

SEQ ID NO: 196581 - DNA, 25 bp, Mus musculus
aggctgcagcccagtataaggtctc

SEQ ID NO: 196582 - DNA, 25 bp, Mus musculus
aggctgcagccccaagtctagaagc

SEQ ID NO: 196583 - DNA, 25 bp, Mus musculus
aggctgcagcccgaagtctagaagc

SEQ ID NO: 196584 - DNA, 25 bp, Mus musculus
aggctgcagccctgtataaggtctc

SEQ ID NO: 196585 - DNA, 25 bp, Mus musculus
aggctgcagctgcttttgagatgtt

SEQ ID NO: 196586 - DNA, 25 bp, Mus musculus
aggctgcagctggttttgagatgtt

SEQ ID NO: 196587 - DNA, 25 bp, Mus musculus
aggctgcaggatcttttgggcacaa

SEQ ID NO: 196588 - DNA, 25 bp, Mus musculus
aggctgcaggatgttttgggcacaa

SEQ ID NO: 196589 - DNA, 25 bp, Mus musculus
aggctgcagtccactgtgcgcacag

SEQ ID NO: 196590 - DNA, 25 bp, Mus musculus
aggctgcagtcctctgtgcgcacag

SEQ ID NO: 196591 - DNA, 25 bp, Mus musculus
aggctgcatatcagaggaagaccca

SEQ ID NO: 196592 - DNA, 25 bp, Mus musculus
aggctgcatatctgaggaagaccca

SEQ ID NO: 196593 - DNA, 25 bp, Mus musculus
aggctgcatcccatatcaaggtact

SEQ ID NO: 196594 - DNA, 25 bp, Mus musculus
aggctgcatcccttatcaaggtact

SEQ ID NO: 196595 - DNA, 25 bp, Mus musculus
aggctgcatgacagacacctggcaa

SEQ ID NO: 196596 - DNA, 25 bp, Mus musculus
aggctgcatgactgacacctggcaa

SEQ ID NO: 196597 - DNA, 25 bp, Mus musculus
aggctgcatgctaccgcacttaaat

SEQ ID NO: 196598 - DNA, 25 bp, Mus musculus
aggctgcatgctagtgtttccagaa

SEQ ID NO: 196599 - DNA, 25 bp, Mus musculus
aggctgcatgcttccgcacttaaat

SEQ ID NO: 196600 - DNA, 25 bp, Mus musculus
aggctgcatgcttgtgtttccagaa

SEQ ID NO: 196601 - DNA, 25 bp, Mus musculus
aggctgcattgcagctggtgctgtc

SEQ ID NO: 196602 - DNA, 25 bp, Mus musculus
aggctgcattgctgctggtgctgtc

SEQ ID NO: 196603 - DNA, 25 bp, Mus musculus
aggctgccaagcaccccagaaaggg

SEQ ID NO: 196604 - DNA, 25 bp, Mus musculus
aggctgccaagctccccagaaaggg

SEQ ID NO: 196605 - DNA, 25 bp, Mus musculus
aggctgccacacagctgacttcaag

SEQ ID NO: 196606 - DNA, 25 bp, Mus musculus
aggctgccacactgctgacttcaag

SEQ ID NO: 196607 - DNA, 25 bp, Mus musculus
aggctgccagcaagggctccctgct

SEQ ID NO: 196608 - DNA, 25 bp, Mus musculus
aggctgccagcatgggctccctgct

SEQ ID NO: 196609 - DNA, 25 bp, Mus musculus
aggctgccagcccttgggacacaaa

SEQ ID NO: 196610 - DNA, 25 bp, Mus musculus
aggctgccagccgttgggacacaaa

SEQ ID NO: 196611 - DNA, 25 bp, Mus musculus
aggctgccaggcactctgaccagga

SEQ ID NO: 196612 - DNA, 25 bp, Mus musculus
aggctgccaggctctctgaccagga

SEQ ID NO: 196613 - DNA, 25 bp, Mus musculus
aggctgccatgacttttctgagtga

SEQ ID NO: 196614 - DNA, 25 bp, Mus musculus
aggctgccatgagttttctgagtga

SEQ ID NO: 196615 - DNA, 25 bp, Mus musculus
aggctgccatgtagcactgagtgat

SEQ ID NO: 196616 - DNA, 25 bp, Mus musculus
aggctgccatgttgcactgagtgat

SEQ ID NO: 196617 - DNA, 25 bp, Mus musculus
aggctgccattacctcaggagctta

SEQ ID NO: 196618 - DNA, 25 bp, Mus musculus
aggctgccattagctcaggagctta

SEQ ID NO: 196619 - DNA, 25 bp, Mus musculus
aggctgcccaatcgttactacgcgg

SEQ ID NO: 196620 - DNA, 25 bp, Mus musculus
aggctgcccaatggttactacgcgg

SEQ ID NO: 196621 - DNA, 25 bp, Mus musculus
aggctgcccacccatagctgcttgg

SEQ ID NO: 196622 - DNA, 25 bp, Mus musculus
aggctgcccaccgatagctgcttgg

SEQ ID NO: 196623 - DNA, 25 bp, Mus musculus
aggctgcccagcaattgcactatat

SEQ ID NO: 196624 - DNA, 25 bp, Mus musculus
aggctgcccagctattgcactatat

SEQ ID NO: 196625 - DNA, 25 bp, Mus musculus
aggctgcccataccttagaagcctg

SEQ ID NO: 196626 - DNA, 25 bp, Mus musculus
aggctgcccatagcttagaagcctg

SEQ ID NO: 196627 - DNA, 25 bp, Mus musculus
aggctgccccaacacactatgtaaa

SEQ ID NO: 196628 - DNA, 25 bp, Mus musculus
aggctgccccaagacactatgtaaa

SEQ ID NO: 196629 - DNA, 25 bp, Mus musculus
aggctgccccataagatcttccggg

SEQ ID NO: 196630 - DNA, 25 bp, Mus musculus
aggctgccccattagatcttccggg

SEQ ID NO: 196631 - DNA, 25 bp, Mus musculus
aggctgcccgggaatcttcacctgg

SEQ ID NO: 196632 - DNA, 25 bp, Mus musculus
aggctgcccgggtatcttcacctgg

SEQ ID NO: 196633 - DNA, 25 bp, Mus musculus
aggctgcccgtaatgcttatatatg

SEQ ID NO: 196634 - DNA, 25 bp, Mus musculus
aggctgcccgtaattgtgccaacaa

SEQ ID NO: 196635 - DNA, 25 bp, Mus musculus
aggctgcccgtattgcttatatatg

SEQ ID NO: 196636 - DNA, 25 bp, Mus musculus
aggctgcccgtatttgtgccaacaa

SEQ ID NO: 196637 - DNA, 25 bp, Mus musculus
aggctgccctcaaatccacagaggt

SEQ ID NO: 196638 - DNA, 25 bp, Mus musculus
aggctgccctcatatccacagaggt

SEQ ID NO: 196639 - DNA, 25 bp, Mus musculus
aggctgccctgaagttatccatagt

SEQ ID NO: 196640 - DNA, 25 bp, Mus musculus
aggctgccctgatgttatccatagt

SEQ ID NO: 196641 - DNA, 25 bp, Mus musculus
aggctgccctggagcgcctcaaggt

SEQ ID NO: 196642 - DNA, 25 bp, Mus musculus
aggctgccctggtgcgcctcaaggt

SEQ ID NO: 196643 - DNA, 25 bp, Mus musculus
aggctgcccttcatgggacaagtgt

SEQ ID NO: 196644 - DNA, 25 bp, Mus musculus
aggctgcccttcttgggacaagtgt

SEQ ID NO: 196645 - DNA, 25 bp, Mus musculus
aggctgccctttcaaggccgtttca

SEQ ID NO: 196646 - DNA, 25 bp, Mus musculus
aggctgccctttgaaggccgtttca

SEQ ID NO: 196647 - DNA, 25 bp, Mus musculus
aggctgccgattccttaaacttggg

SEQ ID NO: 196648 - DNA, 25 bp, Mus musculus
aggctgccgattgcttaaacttggg

SEQ ID NO: 196649 - DNA, 25 bp, Mus musculus
aggctgccgcggagtatttcccaat

SEQ ID NO: 196650 - DNA, 25 bp, Mus musculus
aggctgccgcggtgtatttcccaat

SEQ ID NO: 196651 - DNA, 25 bp, Mus musculus
aggctgccgcttcctaacttattaa

SEQ ID NO: 196652 - DNA, 25 bp, Mus musculus
aggctgccgcttgctaacttattaa

SEQ ID NO: 196653 - DNA, 25 bp, Mus musculus
aggctgccgggccataatcagagaa

SEQ ID NO: 196654 - DNA, 25 bp, Mus musculus
aggctgccgggcgataatcagagaa

SEQ ID NO: 196655 - DNA, 25 bp, Mus musculus
aggctgcctacaaaaacctcattag

SEQ ID NO: 196656 - DNA, 25 bp, Mus musculus
aggctgcctacaactcattctgttg

SEQ ID NO: 196657 - DNA, 25 bp, Mus musculus
aggctgcctacataaacctcattag

SEQ ID NO: 196658 - DNA, 25 bp, Mus musculus
aggctgcctacatctcattctgttg

SEQ ID NO: 196659 - DNA, 25 bp, Mus musculus
aggctgcctcttaactgaatgttgt

SEQ ID NO: 196660 - DNA, 25 bp, Mus musculus
aggctgcctctttactgaatgttgt

SEQ ID NO: 196661 - DNA, 25 bp, Mus musculus
aggctgcctgtcaggaaatgacaaa

SEQ ID NO: 196662 - DNA, 25 bp, Mus musculus
aggctgcctgtctggaaatgacaaa

SEQ ID NO: 196663 - DNA, 25 bp, Mus musculus
aggctgccttcaaaggcccctactg

SEQ ID NO: 196664 - DNA, 25 bp, Mus musculus
aggctgccttcataggcccctactg

SEQ ID NO: 196665 - DNA, 25 bp, Mus musculus
aggctgccttgcacgatgtagactt

SEQ ID NO: 196666 - DNA, 25 bp, Mus musculus
aggctgccttgctcgatgtagactt

SEQ ID NO: 196667 - DNA, 25 bp, Mus musculus
aggctgcgagctccccacagtggaa

SEQ ID NO: 196668 - DNA, 25 bp, Mus musculus
aggctgcgagctgcccacagtggaa

SEQ ID NO: 196669 - DNA, 25 bp, Mus musculus
aggctgcgctggatgttaccgagac

SEQ ID NO: 196670 - DNA, 25 bp, Mus musculus
aggctgcgctggttgttaccgagac

SEQ ID NO: 196671 - DNA, 25 bp, Mus musculus
aggctgcgtcccatcgcaccttgtt

SEQ ID NO: 196672 - DNA, 25 bp, Mus musculus
aggctgcgtcccttcgcaccttgtt

SEQ ID NO: 196673 - DNA, 25 bp, Mus musculus
aggctgctattcacagggaccttag

SEQ ID NO: 196674 - DNA, 25 bp, Mus musculus
aggctgctattctcagggaccttag

SEQ ID NO: 196675 - DNA, 25 bp, Mus musculus
aggctgctcacgacagcctgtaagt

SEQ ID NO: 196676 - DNA, 25 bp, Mus musculus
aggctgctcacgtcagcctgtaagt

SEQ ID NO: 196677 - DNA, 25 bp, Mus musculus
aggctgctcaggctgctcagttcac

SEQ ID NO: 196678 - DNA, 25 bp, Mus musculus
aggctgctcagggtgctcagttcac

SEQ ID NO: 196679 - DNA, 25 bp, Mus musculus
aggctgctcatcagctgaacgatgc

SEQ ID NO: 196680 - DNA, 25 bp, Mus musculus
aggctgctcatctgctgaacgatgc

SEQ ID NO: 196681 - DNA, 25 bp, Mus musculus
aggctgctccagaactcaagggaac

SEQ ID NO: 196682 - DNA, 25 bp, Mus musculus
aggctgctccagtactcaagggaac

SEQ ID NO: 196683 - DNA, 25 bp, Mus musculus
aggctgctccgcatcaccaagagag

SEQ ID NO: 196684 - DNA, 25 bp, Mus musculus
aggctgctccgcttcaccaagagag

SEQ ID NO: 196685 - DNA, 25 bp, Mus musculus
aggctgctcctacaggttatttctc

SEQ ID NO: 196686 - DNA, 25 bp, Mus musculus
aggctgctcctagaggttatttctc

SEQ ID NO: 196687 - DNA, 25 bp, Mus musculus
aggctgctcctccttaggactttgt

SEQ ID NO: 196688 - DNA, 25 bp, Mus musculus
aggctgctcctcgttaggactttgt

SEQ ID NO: 196689 - DNA, 25 bp, Mus musculus
aggctgctctcaaaactcctgggct

SEQ ID NO: 196690 - DNA, 25 bp, Mus musculus
aggctgctctcaaaggcccctggtc

SEQ ID NO: 196691 - DNA, 25 bp, Mus musculus
aggctgctctcataactcctgggct

SEQ ID NO: 196692 - DNA, 25 bp, Mus musculus
aggctgctctcataggcccctggtc

SEQ ID NO: 196693 - DNA, 25 bp, Mus musculus
aggctgctctctctgtcctgcataa

SEQ ID NO: 196694 - DNA, 25 bp, Mus musculus
aggctgctctctgtgtcctgcataa

SEQ ID NO: 196695 - DNA, 25 bp, Mus musculus
aggctgctctgaacctctttactgg

SEQ ID NO: 196696 - DNA, 25 bp, Mus musculus
aggctgctctgatcctctttactgg

SEQ ID NO: 196697 - DNA, 25 bp, Mus musculus
aggctgctctggacgtcttctggaa

SEQ ID NO: 196698 - DNA, 25 bp, Mus musculus
aggctgctctggtcgtcttctggaa

SEQ ID NO: 196699 - DNA, 25 bp, Mus musculus
aggctgctgactaggtgcatccaga

SEQ ID NO: 196700 - DNA, 25 bp, Mus musculus
aggctgctgacttggtgcatccaga

SEQ ID NO: 196701 - DNA, 25 bp, Mus musculus
aggctgctgagacgcagcttccttc

SEQ ID NO: 196702 - DNA, 25 bp, Mus musculus
aggctgctgagaggcagcttccttc

SEQ ID NO: 196703 - DNA, 25 bp, Mus musculus
aggctgctgagcacaaactgaatta

SEQ ID NO: 196704 - DNA, 25 bp, Mus musculus
aggctgctgagcacggtgcagacac

SEQ ID NO: 196705 - DNA, 25 bp, Mus musculus
aggctgctgagctcaaactgaatta

SEQ ID NO: 196706 - DNA, 25 bp, Mus musculus
aggctgctgagctcggtgcagacac

SEQ ID NO: 196707 - DNA, 25 bp, Mus musculus
aggctgctgagtcacctcactggaa

SEQ ID NO: 196708 - DNA, 25 bp, Mus musculus
aggctgctgagtgacctcactggaa

SEQ ID NO: 196709 - DNA, 25 bp, Mus musculus
aggctgctgatacttgtgttcttgc

SEQ ID NO: 196710 - DNA, 25 bp, Mus musculus
aggctgctgatagttgtgttcttgc

SEQ ID NO: 196711 - DNA, 25 bp, Mus musculus
aggctgctgcagctttgtcctgttt

SEQ ID NO: 196712 - DNA, 25 bp, Mus musculus
aggctgctgcaggtttgtcctgttt

SEQ ID NO: 196713 - DNA, 25 bp, Mus musculus
aggctgctgcccaggcggcccgagg

SEQ ID NO: 196714 - DNA, 25 bp, Mus musculus
aggctgctgccctggcggcccgagg

SEQ ID NO: 196715 - DNA, 25 bp, Mus musculus
aggctgctgctgagacttcaaaacc

SEQ ID NO: 196716 - DNA, 25 bp, Mus musculus
aggctgctgctgtgacttcaaaacc

SEQ ID NO: 196717 - DNA, 25 bp, Mus musculus
aggctgctggatattcaaggcttta

SEQ ID NO: 196718 - DNA, 25 bp, Mus musculus
aggctgctggattttcaaggcttta

SEQ ID NO: 196719 - DNA, 25 bp, Mus musculus
aggctgctggttctctacccttgga

SEQ ID NO: 196720 - DNA, 25 bp, Mus musculus
aggctgctggttgtctacccttgga

SEQ ID NO: 196721 - DNA, 25 bp, Mus musculus
aggctgctgtaaactgcctgcagag

SEQ ID NO: 196722 - DNA, 25 bp, Mus musculus
aggctgctgtaatctgcctgcagag

SEQ ID NO: 196723 - DNA, 25 bp, Mus musculus
aggctgctgtacctggttctgaaat

SEQ ID NO: 196724 - DNA, 25 bp, Mus musculus
aggctgctgtacgtggttctgaaat

SEQ ID NO: 196725 - DNA, 25 bp, Mus musculus
aggctgctgtctccagtgccatctc

SEQ ID NO: 196726 - DNA, 25 bp, Mus musculus
aggctgctgtctgcagtgccatctc

SEQ ID NO: 196727 - DNA, 25 bp, Mus musculus
aggctgctgttaaccgtggccagaa

SEQ ID NO: 196728 - DNA, 25 bp, Mus musculus
aggctgctgttatccgtggccagaa

SEQ ID NO: 196729 - DNA, 25 bp, Mus musculus
aggctgctgttgagcctaaaagcca

SEQ ID NO: 196730 - DNA, 25 bp, Mus musculus
aggctgctgttgtgcctaaaagcca

SEQ ID NO: 196731 - DNA, 25 bp, Mus musculus
aggctgcttactcagatgatctggt

SEQ ID NO: 196732 - DNA, 25 bp, Mus musculus
aggctgcttactgagatgatctggt

SEQ ID NO: 196733 - DNA, 25 bp, Mus musculus
aggctgcttcacaacctaaacagtt

SEQ ID NO: 196734 - DNA, 25 bp, Mus musculus
aggctgcttcactacctaaacagtt

SEQ ID NO: 196735 - DNA, 25 bp, Mus musculus
aggctgcttcccacaagagtaacta

SEQ ID NO: 196736 - DNA, 25 bp, Mus musculus
aggctgcttccctcaagagtaacta

SEQ ID NO: 196737 - DNA, 25 bp, Mus musculus
aggctgcttggtcatgtgacctcca

SEQ ID NO: 196738 - DNA, 25 bp, Mus musculus
aggctgcttggtgatgtgacctcca

SEQ ID NO: 196739 - DNA, 25 bp, Mus musculus
aggctgcttttcagacttggatctc

SEQ ID NO: 196740 - DNA, 25 bp, Mus musculus
aggctgcttttctgacttggatctc

SEQ ID NO: 196741 - DNA, 25 bp, Mus musculus
aggctggaacaaaggcttagtgctt

SEQ ID NO: 196742 - DNA, 25 bp, Mus musculus
aggctggaacaatggcttagtgctt

SEQ ID NO: 196743 - DNA, 25 bp, Mus musculus
aggctggaacaccacctaccgcttt

SEQ ID NO: 196744 - DNA, 25 bp, Mus musculus
aggctggaacacgacctaccgcttt

SEQ ID NO: 196745 - DNA, 25 bp, Mus musculus
aggctggaacataacccattctgcg

SEQ ID NO: 196746 - DNA, 25 bp, Mus musculus
aggctggaacattacccattctgcg

SEQ ID NO: 196747 - DNA, 25 bp, Mus musculus
aggctggaacgcaagtgtcccatgg

SEQ ID NO: 196748 - DNA, 25 bp, Mus musculus
aggctggaacgctagtgtcccatgg

SEQ ID NO: 196749 - DNA, 25 bp, Mus musculus
aggctggaagcaacaccgtgtctat

SEQ ID NO: 196750 - DNA, 25 bp, Mus musculus
aggctggaagcatcaccgtgtctat

SEQ ID NO: 196751 - DNA, 25 bp, Mus musculus
aggctggaatccaggagcccttaac

SEQ ID NO: 196752 - DNA, 25 bp, Mus musculus
aggctggaatcctggagcccttaac

SEQ ID NO: 196753 - DNA, 25 bp, Mus musculus
aggctggacaccaggatgtgcttct

SEQ ID NO: 196754 - DNA, 25 bp, Mus musculus
aggctggacacctggatgtgcttct

SEQ ID NO: 196755 - DNA, 25 bp, Mus musculus
aggctggacagcaacctgcgtgcac

SEQ ID NO: 196756 - DNA, 25 bp, Mus musculus
aggctggacagctacctgcgtgcac

SEQ ID NO: 196757 - DNA, 25 bp, Mus musculus
aggctggaccctctgcactgcaaat

SEQ ID NO: 196758 - DNA, 25 bp, Mus musculus
aggctggaccctgtgcactgcaaat

SEQ ID NO: 196759 - DNA, 25 bp, Mus musculus
aggctggacctaacagagaccctgt

SEQ ID NO: 196760 - DNA, 25 bp, Mus musculus
aggctggacctatcagagaccctgt

SEQ ID NO: 196761 - DNA, 25 bp, Mus musculus
aggctggactccctggacaggaaca

SEQ ID NO: 196762 - DNA, 25 bp, Mus musculus
aggctggactccgtggacaggaaca

SEQ ID NO: 196763 - DNA, 25 bp, Mus musculus
aggctggacttcatctgattagtga

SEQ ID NO: 196764 - DNA, 25 bp, Mus musculus
aggctggacttcttctgattagtga

SEQ ID NO: 196765 - DNA, 25 bp, Mus musculus
aggctggagcaccatggcaccctac

SEQ ID NO: 196766 - DNA, 25 bp, Mus musculus
aggctggagcacgatggcaccctac

SEQ ID NO: 196767 - DNA, 25 bp, Mus musculus
aggctggagcagactctgtgtcact

SEQ ID NO: 196768 - DNA, 25 bp, Mus musculus
aggctggagcagtctctgtgtcact

SEQ ID NO: 196769 - DNA, 25 bp, Mus musculus
aggctggaggttacgaactctgttc

SEQ ID NO: 196770 - DNA, 25 bp, Mus musculus
aggctggaggtttcgaactctgttc

SEQ ID NO: 196771 - DNA, 25 bp, Mus musculus
aggctggagtagactgctctggctc

SEQ ID NO: 196772 - DNA, 25 bp, Mus musculus
aggctggagtagtctgctctggctc

SEQ ID NO: 196773 - DNA, 25 bp, Mus musculus
aggctggagtgacacccttttcttt

SEQ ID NO: 196774 - DNA, 25 bp, Mus musculus
aggctggagtgagacccttttcttt

SEQ ID NO: 196775 - DNA, 25 bp, Mus musculus
aggctggatctgacccgaggaagct

SEQ ID NO: 196776 - DNA, 25 bp, Mus musculus
aggctggatctgaggacgcgattcc

SEQ ID NO: 196777 - DNA, 25 bp, Mus musculus
aggctggatctgtcccgaggaagct

SEQ ID NO: 196778 - DNA, 25 bp, Mus musculus
aggctggatctgtggacgcgattcc

SEQ ID NO: 196779 - DNA, 25 bp, Mus musculus
aggctggcaaacctcagagcccatg

SEQ ID NO: 196780 - DNA, 25 bp, Mus musculus
aggctggcaaacgtcagagcccatg

SEQ ID NO: 196781 - DNA, 25 bp, Mus musculus
aggctggcaagaacacgtgcttgtg

SEQ ID NO: 196782 - DNA, 25 bp, Mus musculus
aggctggcaagatcacgtgcttgtg

SEQ ID NO: 196783 - DNA, 25 bp, Mus musculus
aggctggcaatcacggccgacataa

SEQ ID NO: 196784 - DNA, 25 bp, Mus musculus
aggctggcaatctcggccgacataa

SEQ ID NO: 196785 - DNA, 25 bp, Mus musculus
aggctggcaccaaatttcatagttt

SEQ ID NO: 196786 - DNA, 25 bp, Mus musculus
aggctggcaccatatttcatagttt

SEQ ID NO: 196787 - DNA, 25 bp, Mus musculus
aggctggcacccagaacccttgctg

SEQ ID NO: 196788 - DNA, 25 bp, Mus musculus
aggctggcaccctgaacccttgctg

SEQ ID NO: 196789 - DNA, 25 bp, Mus musculus
aggctggcagcgagttcaagaacat

SEQ ID NO: 196790 - DNA, 25 bp, Mus musculus
aggctggcagcgtgttcaagaacat

SEQ ID NO: 196791 - DNA, 25 bp, Mus musculus
aggctggcatcgcacttgtagtgac

SEQ ID NO: 196792 - DNA, 25 bp, Mus musculus
aggctggcatcggacttgtagtgac

SEQ ID NO: 196793 - DNA, 25 bp, Mus musculus
aggctggcattgaaccctggtattc

SEQ ID NO: 196794 - DNA, 25 bp, Mus musculus
aggctggcattgtaccctggtattc

SEQ ID NO: 196795 - DNA, 25 bp, Mus musculus
aggctggccaagagctttctctgta

SEQ ID NO: 196796 - DNA, 25 bp, Mus musculus
aggctggccaagtgctttctctgta

SEQ ID NO: 196797 - DNA, 25 bp, Mus musculus
aggctggccacacttgagagctgca

SEQ ID NO: 196798 - DNA, 25 bp, Mus musculus
aggctggccacagttgagagctgca

SEQ ID NO: 196799 - DNA, 25 bp, Mus musculus
aggctggccacgcttcacaaaggag

SEQ ID NO: 196800 - DNA, 25 bp, Mus musculus
aggctggccacggttcacaaaggag

SEQ ID NO: 196801 - DNA, 25 bp, Mus musculus
aggctggccctcagactcaccaaga

SEQ ID NO: 196802 - DNA, 25 bp, Mus musculus
aggctggccctctgactcaccaaga

SEQ ID NO: 196803 - DNA, 25 bp, Mus musculus
aggctggcccttcttcatgtcaatt

SEQ ID NO: 196804 - DNA, 25 bp, Mus musculus
aggctggcccttgttcatgtcaatt

SEQ ID NO: 196805 - DNA, 25 bp, Mus musculus
aggctggcctacagcttgagcccaa

SEQ ID NO: 196806 - DNA, 25 bp, Mus musculus
aggctggcctactgcttgagcccaa

SEQ ID NO: 196807 - DNA, 25 bp, Mus musculus
aggctggcctagaatgtgctcactg

SEQ ID NO: 196808 - DNA, 25 bp, Mus musculus
aggctggcctagagatcacctacct

SEQ ID NO: 196809 - DNA, 25 bp, Mus musculus
aggctggcctagtatgtgctcactg

SEQ ID NO: 196810 - DNA, 25 bp, Mus musculus
aggctggcctagtgatcacctacct

SEQ ID NO: 196811 - DNA, 25 bp, Mus musculus
aggctggcctcgaaaagcactactt

SEQ ID NO: 196812 - DNA, 25 bp, Mus musculus
aggctggcctcgtaaagcactactt

SEQ ID NO: 196813 - DNA, 25 bp, Mus musculus
aggctggcctgaatccaccaaagga

SEQ ID NO: 196814 - DNA, 25 bp, Mus musculus
aggctggcctgattccaccaaagga

SEQ ID NO: 196815 - DNA, 25 bp, Mus musculus
aggctggcctgtccccatcctgggt

SEQ ID NO: 196816 - DNA, 25 bp, Mus musculus
aggctggcctgtgcccatcctgggt

SEQ ID NO: 196817 - DNA, 25 bp, Mus musculus
aggctggccttccaagggacaacag

SEQ ID NO: 196818 - DNA, 25 bp, Mus musculus
aggctggccttcgaagggacaacag

SEQ ID NO: 196819 - DNA, 25 bp, Mus musculus
aggctggcctttactgcatggtatc

SEQ ID NO: 196820 - DNA, 25 bp, Mus musculus
aggctggccttttctgcatggtatc

SEQ ID NO: 196821 - DNA, 25 bp, Mus musculus
aggctggcgaccaggctctggctat

SEQ ID NO: 196822 - DNA, 25 bp, Mus musculus
aggctggcgacctggctctggctat

SEQ ID NO: 196823 - DNA, 25 bp, Mus musculus
aggctggcgcttagaacagttggac

SEQ ID NO: 196824 - DNA, 25 bp, Mus musculus
aggctggcgctttgaacagttggac

SEQ ID NO: 196825 - DNA, 25 bp, Mus musculus
aggctggcgtcaatggttaccatca

SEQ ID NO: 196826 - DNA, 25 bp, Mus musculus
aggctggcgtcattggttaccatca

SEQ ID NO: 196827 - DNA, 25 bp, Mus musculus
aggctggctaacctatctgactgtg

SEQ ID NO: 196828 - DNA, 25 bp, Mus musculus
aggctggctaacgtatctgactgtg

SEQ ID NO: 196829 - DNA, 25 bp, Mus musculus
aggctggctacaatctaggctgctg

SEQ ID NO: 196830 - DNA, 25 bp, Mus musculus
aggctggctacattctaggctgctg

SEQ ID NO: 196831 - DNA, 25 bp, Mus musculus
aggctggctactaggtactggataa

SEQ ID NO: 196832 - DNA, 25 bp, Mus musculus
aggctggctacttggtactggataa

SEQ ID NO: 196833 - DNA, 25 bp, Mus musculus
aggctggctagccataagcctccag

SEQ ID NO: 196834 - DNA, 25 bp, Mus musculus
aggctggctagcgataagcctccag

SEQ ID NO: 196835 - DNA, 25 bp, Mus musculus
aggctggctaggcagcaagctctaa

SEQ ID NO: 196836 - DNA, 25 bp, Mus musculus
aggctggctagggagcaagctctaa

SEQ ID NO: 196837 - DNA, 25 bp, Mus musculus
aggctggctatgcacacagcccagt

SEQ ID NO: 196838 - DNA, 25 bp, Mus musculus
aggctggctatggacacagcccagt

SEQ ID NO: 196839 - DNA, 25 bp, Mus musculus
aggctggctcaaacctcctctgtga

SEQ ID NO: 196840 - DNA, 25 bp, Mus musculus
aggctggctcaactgcggtacagac

SEQ ID NO: 196841 - DNA, 25 bp, Mus musculus
aggctggctcaagtgcggtacagac

SEQ ID NO: 196842 - DNA, 25 bp, Mus musculus
aggctggctcaatcctcctctgtga

SEQ ID NO: 196843 - DNA, 25 bp, Mus musculus
aggctggctcataagccttccaggt

SEQ ID NO: 196844 - DNA, 25 bp, Mus musculus
aggctggctcattagccttccaggt

SEQ ID NO: 196845 - DNA, 25 bp, Mus musculus
aggctggctcctcaagttttggtgc

SEQ ID NO: 196846 - DNA, 25 bp, Mus musculus
aggctggctcctgaagttttggtgc

SEQ ID NO: 196847 - DNA, 25 bp, Mus musculus
aggctggctgtcagcggctctcaga

SEQ ID NO: 196848 - DNA, 25 bp, Mus musculus
aggctggctgtctgcggctctcaga

SEQ ID NO: 196849 - DNA, 25 bp, Mus musculus
aggctggctgttcaaatcccacatt

SEQ ID NO: 196850 - DNA, 25 bp, Mus musculus
aggctggctgttgaaatcccacatt

SEQ ID NO: 196851 - DNA, 25 bp, Mus musculus
aggctggcttcacattattaaacac

SEQ ID NO: 196852 - DNA, 25 bp, Mus musculus
aggctggcttcactctgtgcctctg

SEQ ID NO: 196853 - DNA, 25 bp, Mus musculus
aggctggcttcagattattaaacac

SEQ ID NO: 196854 - DNA, 25 bp, Mus musculus
aggctggcttcagtctgtgcctctg

SEQ ID NO: 196855 - DNA, 25 bp, Mus musculus
aggctggcttcgattttccaaggag

SEQ ID NO: 196856 - DNA, 25 bp, Mus musculus
aggctggcttcgtttttccaaggag

SEQ ID NO: 196857 - DNA, 25 bp, Mus musculus
aggctgggaacccagcagtaagata

SEQ ID NO: 196858 - DNA, 25 bp, Mus musculus
aggctgggaaccgagcagtaagata

SEQ ID NO: 196859 - DNA, 25 bp, Mus musculus
aggctgggaccaaagtactcaaacc

SEQ ID NO: 196860 - DNA, 25 bp, Mus musculus
aggctgggaccatagtactcaaacc

SEQ ID NO: 196861 - DNA, 25 bp, Mus musculus
aggctgggatcacattcctgctctt

SEQ ID NO: 196862 - DNA, 25 bp, Mus musculus
aggctgggatcagattcctgctctt

SEQ ID NO: 196863 - DNA, 25 bp, Mus musculus
aggctgggcatcagggaccacgtca

SEQ ID NO: 196864 - DNA, 25 bp, Mus musculus
aggctgggcatctgggaccacgtca

SEQ ID NO: 196865 - DNA, 25 bp, Mus musculus
aggctgggccaaagagactctactg

SEQ ID NO: 196866 - DNA, 25 bp, Mus musculus
aggctgggccaatgagactctactg

SEQ ID NO: 196867 - DNA, 25 bp, Mus musculus
aggctgggcttgacccgatctgtgt

SEQ ID NO: 196868 - DNA, 25 bp, Mus musculus
aggctgggcttgtcccgatctgtgt

SEQ ID NO: 196869 - DNA, 25 bp, Mus musculus
aggctgggtcccagtgctgtgttca

SEQ ID NO: 196870 - DNA, 25 bp, Mus musculus
aggctgggtccctgtgctgtgttca

SEQ ID NO: 196871 - DNA, 25 bp, Mus musculus
aggctgggtctcagcacaatgcatt

SEQ ID NO: 196872 - DNA, 25 bp, Mus musculus
aggctgggtctctgcacaatgcatt

SEQ ID NO: 196873 - DNA, 25 bp, Mus musculus
aggctgggtcttaccactaacctga

SEQ ID NO: 196874 - DNA, 25 bp, Mus musculus
aggctgggtctttccactaacctga

SEQ ID NO: 196875 - DNA, 25 bp, Mus musculus
aggctgggtggcatctgtcagtcat

SEQ ID NO: 196876 - DNA, 25 bp, Mus musculus
aggctgggtggcttctgtcagtcat

SEQ ID NO: 196877 - DNA, 25 bp, Mus musculus
aggctgggtgtcacttcctgtatta

SEQ ID NO: 196878 - DNA, 25 bp, Mus musculus
aggctgggtgtctcttcctgtatta

SEQ ID NO: 196879 - DNA, 25 bp, Mus musculus
aggctgggtgtgaactctgcaactc

SEQ ID NO: 196880 - DNA, 25 bp, Mus musculus
aggctgggtgtgtactctgcaactc

SEQ ID NO: 196881 - DNA, 25 bp, Mus musculus
aggctgggtttcagggtttgcacca

SEQ ID NO: 196882 - DNA, 25 bp, Mus musculus
aggctgggtttctgggtttgcacca

SEQ ID NO: 196883 - DNA, 25 bp, Mus musculus
aggctgggtttgcttgcagcttcaa

SEQ ID NO: 196884 - DNA, 25 bp, Mus musculus
aggctgggtttggttgcagcttcaa

SEQ ID NO: 196885 - DNA, 25 bp, Mus musculus
aggctggtacgcagtgcccgagtca

SEQ ID NO: 196886 - DNA, 25 bp, Mus musculus
aggctggtacgctgtgcccgagtca

SEQ ID NO: 196887 - DNA, 25 bp, Mus musculus
aggctggtatgccactcatattgaa

SEQ ID NO: 196888 - DNA, 25 bp, Mus musculus
aggctggtatgcgactcatattgaa

SEQ ID NO: 196889 - DNA, 25 bp, Mus musculus
aggctggtcagcataggtaaaatgg

SEQ ID NO: 196890 - DNA, 25 bp, Mus musculus
aggctggtcagcttaggtaaaatgg

SEQ ID NO: 196891 - DNA, 25 bp, Mus musculus
aggctggtcgccacagagttgtcga

SEQ ID NO: 196892 - DNA, 25 bp, Mus musculus
aggctggtcgcctcagagttgtcga

SEQ ID NO: 196893 - DNA, 25 bp, Mus musculus
aggctggtctccaccacttattttg

SEQ ID NO: 196894 - DNA, 25 bp, Mus musculus
aggctggtctcctccacttattttg

SEQ ID NO: 196895 - DNA, 25 bp, Mus musculus
aggctggtctctaaagttgctgtga

SEQ ID NO: 196896 - DNA, 25 bp, Mus musculus
aggctggtctcttaagttgctgtga

SEQ ID NO: 196897 - DNA, 25 bp, Mus musculus
aggctggtctggaacctatactctc

SEQ ID NO: 196898 - DNA, 25 bp, Mus musculus
aggctggtctggtacctatactctc

SEQ ID NO: 196899 - DNA, 25 bp, Mus musculus
aggctggtcttcatcgtgaacgtgg

SEQ ID NO: 196900 - DNA, 25 bp, Mus musculus
aggctggtcttcttcgtgaacgtgg

SEQ ID NO: 196901 - DNA, 25 bp, Mus musculus
aggctggtgcctacatatgcacacc

SEQ ID NO: 196902 - DNA, 25 bp, Mus musculus
aggctggtgccttcatatgcacacc

SEQ ID NO: 196903 - DNA, 25 bp, Mus musculus
aggctggtggatcatgctgcccaaa

SEQ ID NO: 196904 - DNA, 25 bp, Mus musculus
aggctggtggatgatgctgcccaaa

SEQ ID NO: 196905 - DNA, 25 bp, Mus musculus
aggctggttcatcagggccagtctc

SEQ ID NO: 196906 - DNA, 25 bp, Mus musculus
aggctggttcatgagggccagtctc

SEQ ID NO: 196907 - DNA, 25 bp, Mus musculus
aggctggttgcaaagcttagctatt

SEQ ID NO: 196908 - DNA, 25 bp, Mus musculus
aggctggttgcatagcttagctatt

SEQ ID NO: 196909 - DNA, 25 bp, Mus musculus
aggctggtttcccacagagtccatg

SEQ ID NO: 196910 - DNA, 25 bp, Mus musculus
aggctggtttccgacagagtccatg

SEQ ID NO: 196911 - DNA, 25 bp, Mus musculus
aggctgtaaaatcgcagactctcct

SEQ ID NO: 196912 - DNA, 25 bp, Mus musculus
aggctgtaaaatggcagactctcct

SEQ ID NO: 196913 - DNA, 25 bp, Mus musculus
aggctgtaaacaagagttgctcaag

SEQ ID NO: 196914 - DNA, 25 bp, Mus musculus
aggctgtaaacatgagttgctcaag

SEQ ID NO: 196915 - DNA, 25 bp, Mus musculus
aggctgtaacaactcctggcacagt

SEQ ID NO: 196916 - DNA, 25 bp, Mus musculus
aggctgtaacaagtcctggcacagt

SEQ ID NO: 196917 - DNA, 25 bp, Mus musculus
aggctgtaacagcttgtttgtaaaa

SEQ ID NO: 196918 - DNA, 25 bp, Mus musculus
aggctgtaacaggttgtttgtaaaa

SEQ ID NO: 196919 - DNA, 25 bp, Mus musculus
aggctgtaacccatagtcacttgtt

SEQ ID NO: 196920 - DNA, 25 bp, Mus musculus
aggctgtaacccttagtcacttgtt

SEQ ID NO: 196921 - DNA, 25 bp, Mus musculus
aggctgtaaggtccttctgtgccta

SEQ ID NO: 196922 - DNA, 25 bp, Mus musculus
aggctgtaaggtgcttctgtgccta

SEQ ID NO: 196923 - DNA, 25 bp, Mus musculus
aggctgtaatgacctgcccaacaat

SEQ ID NO: 196924 - DNA, 25 bp, Mus musculus
aggctgtaatgagctgcccaacaat

SEQ ID NO: 196925 - DNA, 25 bp, Mus musculus
aggctgtactatagtcactgcactg

SEQ ID NO: 196926 - DNA, 25 bp, Mus musculus
aggctgtactattgtcactgcactg

SEQ ID NO: 196927 - DNA, 25 bp, Mus musculus
aggctgtactgtctctgttgaggca

SEQ ID NO: 196928 - DNA, 25 bp, Mus musculus
aggctgtactgtgtctgttgaggca

SEQ ID NO: 196929 - DNA, 25 bp, Mus musculus
aggctgtagaacacaaacctccaat

SEQ ID NO: 196930 - DNA, 25 bp, Mus musculus
aggctgtagaactcaaacctccaat

SEQ ID NO: 196931 - DNA, 25 bp, Mus musculus
aggctgtagaagctatgtattgtgt

SEQ ID NO: 196932 - DNA, 25 bp, Mus musculus
aggctgtagaaggtatgtattgtgt

SEQ ID NO: 196933 - DNA, 25 bp, Mus musculus
aggctgtagatgacattcgttgcat

SEQ ID NO: 196934 - DNA, 25 bp, Mus musculus
aggctgtagatgtcattcgttgcat

SEQ ID NO: 196935 - DNA, 25 bp, Mus musculus
aggctgtagccaaatatcttcgatt

SEQ ID NO: 196936 - DNA, 25 bp, Mus musculus
aggctgtagccatatatcttcgatt

SEQ ID NO: 196937 - DNA, 25 bp, Mus musculus
aggctgtaggttcctggccttgctc

SEQ ID NO: 196938 - DNA, 25 bp, Mus musculus
aggctgtaggttgctggccttgctc

SEQ ID NO: 196939 - DNA, 25 bp, Mus musculus
aggctgtagtgcattagcatatcaa

SEQ ID NO: 196940 - DNA, 25 bp, Mus musculus
aggctgtagtgcattgctagagaaa

SEQ ID NO: 196941 - DNA, 25 bp, Mus musculus
aggctgtagtgctttagcatatcaa

SEQ ID NO: 196942 - DNA, 25 bp, Mus musculus
aggctgtagtgctttgctagagaaa

SEQ ID NO: 196943 - DNA, 25 bp, Mus musculus
aggctgtatgtgagcctggccacat

SEQ ID NO: 196944 - DNA, 25 bp, Mus musculus
aggctgtatgtgtgcctggccacat

SEQ ID NO: 196945 - DNA, 25 bp, Mus musculus
aggctgtatgttccctttggtttta

SEQ ID NO: 196946 - DNA, 25 bp, Mus musculus
aggctgtatgttgcctttggtttta

SEQ ID NO: 196947 - DNA, 25 bp, Mus musculus
aggctgtattttaggcttgctttca

SEQ ID NO: 196948 - DNA, 25 bp, Mus musculus
aggctgtatttttggcttgctttca

SEQ ID NO: 196949 - DNA, 25 bp, Mus musculus
aggctgtcactcatcaagtgaaatt

SEQ ID NO: 196950 - DNA, 25 bp, Mus musculus
aggctgtcactcttcaagtgaaatt

SEQ ID NO: 196951 - DNA, 25 bp, Mus musculus
aggctgtccaaacggcatgtctctt

SEQ ID NO: 196952 - DNA, 25 bp, Mus musculus
aggctgtccaaagggcatgtctctt

SEQ ID NO: 196953 - DNA, 25 bp, Mus musculus
aggctgtccacaagatctgccacag

SEQ ID NO: 196954 - DNA, 25 bp, Mus musculus
aggctgtccacatgatctgccacag

SEQ ID NO: 196955 - DNA, 25 bp, Mus musculus
aggctgtccctcacagcgagctaac

SEQ ID NO: 196956 - DNA, 25 bp, Mus musculus
aggctgtccctctcagcgagctaac

SEQ ID NO: 196957 - DNA, 25 bp, Mus musculus
aggctgtccctgagaaccctatcat

SEQ ID NO: 196958 - DNA, 25 bp, Mus musculus
aggctgtccctgtgaaccctatcat

SEQ ID NO: 196959 - DNA, 25 bp, Mus musculus
aggctgtcctgcaatggattgcagc

SEQ ID NO: 196960 - DNA, 25 bp, Mus musculus
aggctgtcctgctatggattgcagc

SEQ ID NO: 196961 - DNA, 25 bp, Mus musculus
aggctgtcctggaccaatatgtgga

SEQ ID NO: 196962 - DNA, 25 bp, Mus musculus
aggctgtcctggtccaatatgtgga

SEQ ID NO: 196963 - DNA, 25 bp, Mus musculus
aggctgtccttcagaaacaccagga

SEQ ID NO: 196964 - DNA, 25 bp, Mus musculus
aggctgtccttctgaaacaccagga

SEQ ID NO: 196965 - DNA, 25 bp, Mus musculus
aggctgtctccactgttagaccgtg

SEQ ID NO: 196966 - DNA, 25 bp, Mus musculus
aggctgtctccagtgttagaccgtg

SEQ ID NO: 196967 - DNA, 25 bp, Mus musculus
aggctgtctgcaactcaaatctgtc

SEQ ID NO: 196968 - DNA, 25 bp, Mus musculus
aggctgtctgcatctcaaatctgtc

SEQ ID NO: 196969 - DNA, 25 bp, Mus musculus
aggctgtgaaccactgctgagatga

SEQ ID NO: 196970 - DNA, 25 bp, Mus musculus
aggctgtgaacctctgctgagatga

SEQ ID NO: 196971 - DNA, 25 bp, Mus musculus
aggctgtgacttccaggatcccacc

SEQ ID NO: 196972 - DNA, 25 bp, Mus musculus
aggctgtgacttgcaggatcccacc

SEQ ID NO: 196973 - DNA, 25 bp, Mus musculus
aggctgtgagacacctgacagtgct

SEQ ID NO: 196974 - DNA, 25 bp, Mus musculus
aggctgtgagactcctgacagtgct

SEQ ID NO: 196975 - DNA, 25 bp, Mus musculus
aggctgtgaggcaggtgacctttat

SEQ ID NO: 196976 - DNA, 25 bp, Mus musculus
aggctgtgaggctggtgacctttat

SEQ ID NO: 196977 - DNA, 25 bp, Mus musculus
aggctgtgagggacaccagagcagg

SEQ ID NO: 196978 - DNA, 25 bp, Mus musculus
aggctgtgagggtcaccagagcagg

SEQ ID NO: 196979 - DNA, 25 bp, Mus musculus
aggctgtgatccagcccatatggtt

SEQ ID NO: 196980 - DNA, 25 bp, Mus musculus
aggctgtgatcctgcccatatggtt

SEQ ID NO: 196981 - DNA, 25 bp, Mus musculus
aggctgtgcaccctggctcagagca

SEQ ID NO: 196982 - DNA, 25 bp, Mus musculus
aggctgtgcaccgtggctcagagca

SEQ ID NO: 196983 - DNA, 25 bp, Mus musculus
aggctgtgccctagagttctaacat

SEQ ID NO: 196984 - DNA, 25 bp, Mus musculus
aggctgtgcccttgagttctaacat

SEQ ID NO: 196985 - DNA, 25 bp, Mus musculus
aggctgtgcctcatgggtagtattg

SEQ ID NO: 196986 - DNA, 25 bp, Mus musculus
aggctgtgcctcttgggtagtattg

SEQ ID NO: 196987 - DNA, 25 bp, Mus musculus
aggctgtgcggacctgggtcagctg

SEQ ID NO: 196988 - DNA, 25 bp, Mus musculus
aggctgtgcggagctgggtcagctg

SEQ ID NO: 196989 - DNA, 25 bp, Mus musculus
aggctgtgctgtcgaatcctggccc

SEQ ID NO: 196990 - DNA, 25 bp, Mus musculus
aggctgtgctgtggaatcctggccc

SEQ ID NO: 196991 - DNA, 25 bp, Mus musculus
aggctgtggagcatttatttagttg

SEQ ID NO: 196992 - DNA, 25 bp, Mus musculus
aggctgtggagcttttatttagttg

SEQ ID NO: 196993 - DNA, 25 bp, Mus musculus
aggctgtggcccaaaggcaggcaca

SEQ ID NO: 196994 - DNA, 25 bp, Mus musculus
aggctgtggcccatgcttggtagct

SEQ ID NO: 196995 - DNA, 25 bp, Mus musculus
aggctgtggccctaaggcaggcaca

SEQ ID NO: 196996 - DNA, 25 bp, Mus musculus
aggctgtggcccttgcttggtagct

SEQ ID NO: 196997 - DNA, 25 bp, Mus musculus
aggctgtggtgtacagttccctcaa

SEQ ID NO: 196998 - DNA, 25 bp, Mus musculus
aggctgtggtgttcagttccctcaa

SEQ ID NO: 196999 - DNA, 25 bp, Mus musculus
aggctgtggttactggttcccgcct

SEQ ID NO: 197000 - DNA, 25 bp, Mus musculus
aggctgtggttagtggttcccgcct

SEQ ID NO: 197001 - DNA, 25 bp, Mus musculus
aggctgtgtaatagctttctgatag

SEQ ID NO: 197002 - DNA, 25 bp, Mus musculus
aggctgtgtaattgctttctgatag

SEQ ID NO: 197003 - DNA, 25 bp, Mus musculus
aggctgtgtataaaggtgttcatcc

SEQ ID NO: 197004 - DNA, 25 bp, Mus musculus
aggctgtgtatataggtgttcatcc

SEQ ID NO: 197005 - DNA, 25 bp, Mus musculus
aggctgtgtcagaagatccctctaa

SEQ ID NO: 197006 - DNA, 25 bp, Mus musculus
aggctgtgtcagtagatccctctaa

SEQ ID NO: 197007 - DNA, 25 bp, Mus musculus
aggctgtgtcctcgtttcagtgaaa

SEQ ID NO: 197008 - DNA, 25 bp, Mus musculus
aggctgtgtcctggtttcagtgaaa

SEQ ID NO: 197009 - DNA, 25 bp, Mus musculus
aggctgtgtcttcgtttcttatata

SEQ ID NO: 197010 - DNA, 25 bp, Mus musculus
aggctgtgtcttggtttcttatata

SEQ ID NO: 197011 - DNA, 25 bp, Mus musculus
aggctgtgttccagagtcactgtgc

SEQ ID NO: 197012 - DNA, 25 bp, Mus musculus
aggctgtgttcctgagtcactgtgc

SEQ ID NO: 197013 - DNA, 25 bp, Mus musculus
aggctgtgttctctcgcatgcttct

SEQ ID NO: 197014 - DNA, 25 bp, Mus musculus
aggctgtgttctgtcgcatgcttct

SEQ ID NO: 197015 - DNA, 25 bp, Mus musculus
aggctgttaatcacggaagtgtccc

SEQ ID NO: 197016 - DNA, 25 bp, Mus musculus
aggctgttaatctcggaagtgtccc

SEQ ID NO: 197017 - DNA, 25 bp, Mus musculus
aggctgttagcgaagcgctctgttc

SEQ ID NO: 197018 - DNA, 25 bp, Mus musculus
aggctgttagcgtagcgctctgttc

SEQ ID NO: 197019 - DNA, 25 bp, Mus musculus
aggctgttcaagctcgccagtagac

SEQ ID NO: 197020 - DNA, 25 bp, Mus musculus
aggctgttcaaggtcgccagtagac

SEQ ID NO: 197021 - DNA, 25 bp, Mus musculus
aggctgttcacacctgatctggcac

SEQ ID NO: 197022 - DNA, 25 bp, Mus musculus
aggctgttcacagctgatctggcac

SEQ ID NO: 197023 - DNA, 25 bp, Mus musculus
aggctgttcaccatggcgctttcaa

SEQ ID NO: 197024 - DNA, 25 bp, Mus musculus
aggctgttcaccttggcgctttcaa

SEQ ID NO: 197025 - DNA, 25 bp, Mus musculus
aggctgttcatccacagatacctgt

SEQ ID NO: 197026 - DNA, 25 bp, Mus musculus
aggctgttcatcgacagatacctgt

SEQ ID NO: 197027 - DNA, 25 bp, Mus musculus
aggctgttcccacttctctctaggg

SEQ ID NO: 197028 - DNA, 25 bp, Mus musculus
aggctgttcccagttctctctaggg

SEQ ID NO: 197029 - DNA, 25 bp, Mus musculus
aggctgttctctagcctctttggac

SEQ ID NO: 197030 - DNA, 25 bp, Mus musculus
aggctgttctcttgcctctttggac

SEQ ID NO: 197031 - DNA, 25 bp, Mus musculus
aggctgttctgtcgacgctgccaaa

SEQ ID NO: 197032 - DNA, 25 bp, Mus musculus
aggctgttctgtggacgctgccaaa

SEQ ID NO: 197033 - DNA, 25 bp, Mus musculus
aggctgttgaacattccacattcaa

SEQ ID NO: 197034 - DNA, 25 bp, Mus musculus
aggctgttgaactttccacattcaa

SEQ ID NO: 197035 - DNA, 25 bp, Mus musculus
aggctgttgaatcaccttggcaagt

SEQ ID NO: 197036 - DNA, 25 bp, Mus musculus
aggctgttgaatgaccttggcaagt

SEQ ID NO: 197037 - DNA, 25 bp, Mus musculus
aggctgttggccatgatgatgccct

SEQ ID NO: 197038 - DNA, 25 bp, Mus musculus
aggctgttggccctgtttgaactct

SEQ ID NO: 197039 - DNA, 25 bp, Mus musculus
aggctgttggccgtgtttgaactct

SEQ ID NO: 197040 - DNA, 25 bp, Mus musculus
aggctgttggccttgatgatgccct

SEQ ID NO: 197041 - DNA, 25 bp, Mus musculus
aggctgttgggtatctgtcgttcac

SEQ ID NO: 197042 - DNA, 25 bp, Mus musculus
aggctgttgggtttctgtcgttcac

SEQ ID NO: 197043 - DNA, 25 bp, Mus musculus
aggctgtttactcaggttcccaaca

SEQ ID NO: 197044 - DNA, 25 bp, Mus musculus
aggctgtttactgaggttcccaaca

SEQ ID NO: 197045 - DNA, 25 bp, Mus musculus
aggctgtttgctcaactcaaggtcc

SEQ ID NO: 197046 - DNA, 25 bp, Mus musculus
aggctgtttgctgaactcaaggtcc

SEQ ID NO: 197047 - DNA, 25 bp, Mus musculus
aggctgttttccagagagactggga

SEQ ID NO: 197048 - DNA, 25 bp, Mus musculus
aggctgttttcctgagagactggga

SEQ ID NO: 197049 - DNA, 25 bp, Mus musculus
aggcttaactctaatttgtggacta

SEQ ID NO: 197050 - DNA, 25 bp, Mus musculus
aggcttaactcttatttgtggacta

SEQ ID NO: 197051 - DNA, 25 bp, Mus musculus
aggcttaaggtgagcgctgcccact

SEQ ID NO: 197052 - DNA, 25 bp, Mus musculus
aggcttaaggtgtgcgctgcccact

SEQ ID NO: 197053 - DNA, 25 bp, Mus musculus
aggcttaatactaatggctccttag

SEQ ID NO: 197054 - DNA, 25 bp, Mus musculus
aggcttaatacttatggctccttag

SEQ ID NO: 197055 - DNA, 25 bp, Mus musculus
aggcttacaatactcccaatggcag

SEQ ID NO: 197056 - DNA, 25 bp, Mus musculus
aggcttacaatagtcccaatggcag

SEQ ID NO: 197057 - DNA, 25 bp, Mus musculus
aggcttacatccagtttctttctga

SEQ ID NO: 197058 - DNA, 25 bp, Mus musculus
aggcttacatcctgtttctttctga

SEQ ID NO: 197059 - DNA, 25 bp, Mus musculus
aggcttaccaaaagagctcctttga

SEQ ID NO: 197060 - DNA, 25 bp, Mus musculus
aggcttaccaaatgagctcctttga

SEQ ID NO: 197061 - DNA, 25 bp, Mus musculus
aggcttaccactacactttggatct

SEQ ID NO: 197062 - DNA, 25 bp, Mus musculus
aggcttaccacttcactttggatct

SEQ ID NO: 197063 - DNA, 25 bp, Mus musculus
aggcttacgaacatcctgtctgggt

SEQ ID NO: 197064 - DNA, 25 bp, Mus musculus
aggcttacgaacttcctgtctgggt

SEQ ID NO: 197065 - DNA, 25 bp, Mus musculus
aggcttactatacccctagctgtag

SEQ ID NO: 197066 - DNA, 25 bp, Mus musculus
aggcttactatagccctagctgtag

SEQ ID NO: 197067 - DNA, 25 bp, Mus musculus
aggcttagagctactcggcactggg

SEQ ID NO: 197068 - DNA, 25 bp, Mus musculus
aggcttagagcttctcggcactggg

SEQ ID NO: 197069 - DNA, 25 bp, Mus musculus
aggcttagatctcaccatcttcgag

SEQ ID NO: 197070 - DNA, 25 bp, Mus musculus
aggcttagatctgaccatcttcgag

SEQ ID NO: 197071 - DNA, 25 bp, Mus musculus
aggcttagatgtattgcgggcgcta

SEQ ID NO: 197072 - DNA, 25 bp, Mus musculus
aggcttagatgttttgcgggcgcta

SEQ ID NO: 197073 - DNA, 25 bp, Mus musculus
aggcttagcatcatcaacttgttta

SEQ ID NO: 197074 - DNA, 25 bp, Mus musculus
aggcttagcatcttcaacttgttta

SEQ ID NO: 197075 - DNA, 25 bp, Mus musculus
aggcttagccccatagctgacctct

SEQ ID NO: 197076 - DNA, 25 bp, Mus musculus
aggcttagccccttagctgacctct

SEQ ID NO: 197077 - DNA, 25 bp, Mus musculus
aggcttagctatccctacagttttg

SEQ ID NO: 197078 - DNA, 25 bp, Mus musculus
aggcttagctatgcctacagttttg

SEQ ID NO: 197079 - DNA, 25 bp, Mus musculus
aggcttagctgaaggcttaggccat

SEQ ID NO: 197080 - DNA, 25 bp, Mus musculus
aggcttagctgatggcttaggccat

SEQ ID NO: 197081 - DNA, 25 bp, Mus musculus
aggcttaggcccactgatgactgtg

SEQ ID NO: 197082 - DNA, 25 bp, Mus musculus
aggcttaggccctctgatgactgtg

SEQ ID NO: 197083 - DNA, 25 bp, Mus musculus
aggcttagtcagatctctcgggaaa

SEQ ID NO: 197084 - DNA, 25 bp, Mus musculus
aggcttagtcagttctctcgggaaa

SEQ ID NO: 197085 - DNA, 25 bp, Mus musculus
aggcttataatcacttcaccaagtc

SEQ ID NO: 197086 - DNA, 25 bp, Mus musculus
aggcttataatctcttcaccaagtc

SEQ ID NO: 197087 - DNA, 25 bp, Mus musculus
aggcttatattcaaccatggacttt

SEQ ID NO: 197088 - DNA, 25 bp, Mus musculus
aggcttatattctaccatggacttt

SEQ ID NO: 197089 - DNA, 25 bp, Mus musculus
aggcttatcatccatcccttttaac

SEQ ID NO: 197090 - DNA, 25 bp, Mus musculus
aggcttatcatcgatcccttttaac

SEQ ID NO: 197091 - DNA, 25 bp, Mus musculus
aggcttatctacctctttcaagttc

SEQ ID NO: 197092 - DNA, 25 bp, Mus musculus
aggcttatctacgtctttcaagttc

SEQ ID NO: 197093 - DNA, 25 bp, Mus musculus
aggcttatctataggccatgatggc

SEQ ID NO: 197094 - DNA, 25 bp, Mus musculus
aggcttatctattggccatgatggc

SEQ ID NO: 197095 - DNA, 25 bp, Mus musculus
aggcttatgtggctattgctgctct

SEQ ID NO: 197096 - DNA, 25 bp, Mus musculus
aggcttatgtgggtattgctgctct

SEQ ID NO: 197097 - DNA, 25 bp, Mus musculus
aggcttattcatcgttgccatctct

SEQ ID NO: 197098 - DNA, 25 bp, Mus musculus
aggcttattcatggttgccatctct

SEQ ID NO: 197099 - DNA, 25 bp, Mus musculus
aggcttattcttatcttcccacaag

SEQ ID NO: 197100 - DNA, 25 bp, Mus musculus
aggcttattcttttcttcccacaag

SEQ ID NO: 197101 - DNA, 25 bp, Mus musculus
aggcttattgatcccaaccgctgca

SEQ ID NO: 197102 - DNA, 25 bp, Mus musculus
aggcttattgatgccaaccgctgca

SEQ ID NO: 197103 - DNA, 25 bp, Mus musculus
aggcttattttactcacggtcccag

SEQ ID NO: 197104 - DNA, 25 bp, Mus musculus
aggcttattttagtcacggtcccag

SEQ ID NO: 197105 - DNA, 25 bp, Mus musculus
aggcttcaaagaaggcttgcgcata

SEQ ID NO: 197106 - DNA, 25 bp, Mus musculus
aggcttcaaagatggcttgcgcata

SEQ ID NO: 197107 - DNA, 25 bp, Mus musculus
aggcttcaagagaagtcagttttca

SEQ ID NO: 197108 - DNA, 25 bp, Mus musculus
aggcttcaagagtagtcagttttca

SEQ ID NO: 197109 - DNA, 25 bp, Mus musculus
aggcttcaagctagtcaggcaagca

SEQ ID NO: 197110 - DNA, 25 bp, Mus musculus
aggcttcaagctcctaaacacctgc

SEQ ID NO: 197111 - DNA, 25 bp, Mus musculus
aggcttcaagctgctaaacacctgc

SEQ ID NO: 197112 - DNA, 25 bp, Mus musculus
aggcttcaagcttgtcaggcaagca

SEQ ID NO: 197113 - DNA, 25 bp, Mus musculus
aggcttcaagttccctgtagaattc

SEQ ID NO: 197114 - DNA, 25 bp, Mus musculus
aggcttcaagttgcctgtagaattc

SEQ ID NO: 197115 - DNA, 25 bp, Mus musculus
aggcttcaattacgtctttacatag

SEQ ID NO: 197116 - DNA, 25 bp, Mus musculus
aggcttcaattaggtctttacatag

SEQ ID NO: 197117 - DNA, 25 bp, Mus musculus
aggcttcacaaaacttactctgctg

SEQ ID NO: 197118 - DNA, 25 bp, Mus musculus
aggcttcacaaatcttactctgctg

SEQ ID NO: 197119 - DNA, 25 bp, Mus musculus
aggcttcaccggaacaggcttttgc

SEQ ID NO: 197120 - DNA, 25 bp, Mus musculus
aggcttcaccggtacaggcttttgc

SEQ ID NO: 197121 - DNA, 25 bp, Mus musculus
aggcttcaccttagagtaccgctac

SEQ ID NO: 197122 - DNA, 25 bp, Mus musculus
aggcttcacctttgagtaccgctac

SEQ ID NO: 197123 - DNA, 25 bp, Mus musculus
aggcttcactgcatattgtctgttg

SEQ ID NO: 197124 - DNA, 25 bp, Mus musculus
aggcttcactgcttattgtctgttg

SEQ ID NO: 197125 - DNA, 25 bp, Mus musculus
aggcttcagaacaaaagtccgtcta

SEQ ID NO: 197126 - DNA, 25 bp, Mus musculus
aggcttcagaacctgtctctatggt

SEQ ID NO: 197127 - DNA, 25 bp, Mus musculus
aggcttcagaacgtgtctctatggt

SEQ ID NO: 197128 - DNA, 25 bp, Mus musculus
aggcttcagaactaaagtccgtcta

SEQ ID NO: 197129 - DNA, 25 bp, Mus musculus
aggcttcagagcatttccctgtatt

SEQ ID NO: 197130 - DNA, 25 bp, Mus musculus
aggcttcagagcttttccctgtatt

SEQ ID NO: 197131 - DNA, 25 bp, Mus musculus
aggcttcaggaaaccccactggcat

SEQ ID NO: 197132 - DNA, 25 bp, Mus musculus
aggcttcaggaatccccactggcat

SEQ ID NO: 197133 - DNA, 25 bp, Mus musculus
aggcttcaggcccaatgtctgttac

SEQ ID NO: 197134 - DNA, 25 bp, Mus musculus
aggcttcaggccgaatgtctgttac

SEQ ID NO: 197135 - DNA, 25 bp, Mus musculus
aggcttcaggctcttcgtgggccac

SEQ ID NO: 197136 - DNA, 25 bp, Mus musculus
aggcttcaggctgttcgtgggccac

SEQ ID NO: 197137 - DNA, 25 bp, Mus musculus
aggcttcagggactgatgctttgac

SEQ ID NO: 197138 - DNA, 25 bp, Mus musculus
aggcttcagggagtgatgctttgac

SEQ ID NO: 197139 - DNA, 25 bp, Mus musculus
aggcttcagtggcagcaccacatgg

SEQ ID NO: 197140 - DNA, 25 bp, Mus musculus
aggcttcagtgggagcaccacatgg

SEQ ID NO: 197141 - DNA, 25 bp, Mus musculus
aggcttcagtttctgctaccttaga

SEQ ID NO: 197142 - DNA, 25 bp, Mus musculus
aggcttcagtttgtgctaccttaga

SEQ ID NO: 197143 - DNA, 25 bp, Mus musculus
aggcttcatcgacttcatcgggcag

SEQ ID NO: 197144 - DNA, 25 bp, Mus musculus
aggcttcatcgagttcatcgggcag

SEQ ID NO: 197145 - DNA, 25 bp, Mus musculus
aggcttcatcttaaatcacgccagg

SEQ ID NO: 197146 - DNA, 25 bp, Mus musculus
aggcttcatctttaatcacgccagg

SEQ ID NO: 197147 - DNA, 25 bp, Mus musculus
aggcttcatgctacacagatgacag

SEQ ID NO: 197148 - DNA, 25 bp, Mus musculus
aggcttcatgcttcacagatgacag

SEQ ID NO: 197149 - DNA, 25 bp, Mus musculus
aggcttcatggacctctgccagaat

SEQ ID NO: 197150 - DNA, 25 bp, Mus musculus
aggcttcatggagctctgccagaat

SEQ ID NO: 197151 - DNA, 25 bp, Mus musculus
aggcttccaaggctgctctgtggcc

SEQ ID NO: 197152 - DNA, 25 bp, Mus musculus
aggcttccaagggtgctctgtggcc

SEQ ID NO: 197153 - DNA, 25 bp, Mus musculus
aggcttccaagtccactgctacaag

SEQ ID NO: 197154 - DNA, 25 bp, Mus musculus
aggcttccaagtgcactgctacaag

SEQ ID NO: 197155 - DNA, 25 bp, Mus musculus
aggcttccacacagatgtgtgctga

SEQ ID NO: 197156 - DNA, 25 bp, Mus musculus
aggcttccacactgatgtgtgctga

SEQ ID NO: 197157 - DNA, 25 bp, Mus musculus
aggcttccagacattgccctgtgtg

SEQ ID NO: 197158 - DNA, 25 bp, Mus musculus
aggcttccagactttgccctgtgtg

SEQ ID NO: 197159 - DNA, 25 bp, Mus musculus
aggcttccaggccatcagacacaac

SEQ ID NO: 197160 - DNA, 25 bp, Mus musculus
aggcttccaggcgatcagacacaac

SEQ ID NO: 197161 - DNA, 25 bp, Mus musculus
aggcttcccaagagtataatccgac

SEQ ID NO: 197162 - DNA, 25 bp, Mus musculus
aggcttcccaagtgtataatccgac

SEQ ID NO: 197163 - DNA, 25 bp, Mus musculus
aggcttcccagtcgcacaggctgat

SEQ ID NO: 197164 - DNA, 25 bp, Mus musculus
aggcttcccagtggcacaggctgat

SEQ ID NO: 197165 - DNA, 25 bp, Mus musculus
aggcttcccggaattggcaggagct

SEQ ID NO: 197166 - DNA, 25 bp, Mus musculus
aggcttcccggatttggcaggagct

SEQ ID NO: 197167 - DNA, 25 bp, Mus musculus
aggcttccctgactggctgtttgtg

SEQ ID NO: 197168 - DNA, 25 bp, Mus musculus
aggcttccctgagtggctgtttgtg

SEQ ID NO: 197169 - DNA, 25 bp, Mus musculus
aggcttccctgcagagttacaactc

SEQ ID NO: 197170 - DNA, 25 bp, Mus musculus
aggcttccctgctgagttacaactc

SEQ ID NO: 197171 - DNA, 25 bp, Mus musculus
aggcttccggaaagcaatttcctgc

SEQ ID NO: 197172 - DNA, 25 bp, Mus musculus
aggcttccggaatgcaatttcctgc

SEQ ID NO: 197173 - DNA, 25 bp, Mus musculus
aggcttcctaagatagttgcccact

SEQ ID NO: 197174 - DNA, 25 bp, Mus musculus
aggcttcctaagttagttgcccact

SEQ ID NO: 197175 - DNA, 25 bp, Mus musculus
aggcttcctagaccgtcaggcacga

SEQ ID NO: 197176 - DNA, 25 bp, Mus musculus
aggcttcctagagcgtcaggcacga

SEQ ID NO: 197177 - DNA, 25 bp, Mus musculus
aggcttcctaggactcttacaccta

SEQ ID NO: 197178 - DNA, 25 bp, Mus musculus
aggcttcctaggtctcttacaccta

SEQ ID NO: 197179 - DNA, 25 bp, Mus musculus
aggcttcctagtcataggctgcaga

SEQ ID NO: 197180 - DNA, 25 bp, Mus musculus
aggcttcctagtgataggctgcaga

SEQ ID NO: 197181 - DNA, 25 bp, Mus musculus
aggcttcctcatcgatataaagact

SEQ ID NO: 197182 - DNA, 25 bp, Mus musculus
aggcttcctcatggatataaagact

SEQ ID NO: 197183 - DNA, 25 bp, Mus musculus
aggcttcctcttaagcaccagtcta

SEQ ID NO: 197184 - DNA, 25 bp, Mus musculus
aggcttcctctttagcaccagtcta

SEQ ID NO: 197185 - DNA, 25 bp, Mus musculus
aggcttcctgaacaatctgctcctt

SEQ ID NO: 197186 - DNA, 25 bp, Mus musculus
aggcttcctgaagaatctgctcctt

SEQ ID NO: 197187 - DNA, 25 bp, Mus musculus
aggcttcctggacatccttgagatt

SEQ ID NO: 197188 - DNA, 25 bp, Mus musculus
aggcttcctggagatccttgagatt

SEQ ID NO: 197189 - DNA, 25 bp, Mus musculus
aggcttcctgtacctgattccattg

SEQ ID NO: 197190 - DNA, 25 bp, Mus musculus
aggcttcctgtagctgattccattg

SEQ ID NO: 197191 - DNA, 25 bp, Mus musculus
aggcttcctgttctatcacgtgtgt

SEQ ID NO: 197192 - DNA, 25 bp, Mus musculus
aggcttcctgttgtatcacgtgtgt

SEQ ID NO: 197193 - DNA, 25 bp, Mus musculus
aggcttcctttcataccattctgta

SEQ ID NO: 197194 - DNA, 25 bp, Mus musculus
aggcttcctttcttaccattctgta

SEQ ID NO: 197195 - DNA, 25 bp, Mus musculus
aggcttcgccttccaagttcaggat

SEQ ID NO: 197196 - DNA, 25 bp, Mus musculus
aggcttcgccttgcaagttcaggat

SEQ ID NO: 197197 - DNA, 25 bp, Mus musculus
aggcttcggctccaccgggaagaat

SEQ ID NO: 197198 - DNA, 25 bp, Mus musculus
aggcttcggctcgaccgggaagaat

SEQ ID NO: 197199 - DNA, 25 bp, Mus musculus
aggcttcgtatcaaccaccatgact

SEQ ID NO: 197200 - DNA, 25 bp, Mus musculus
aggcttcgtatctaccaccatgact

SEQ ID NO: 197201 - DNA, 25 bp, Mus musculus
aggcttcgtcttacacagattatga

SEQ ID NO: 197202 - DNA, 25 bp, Mus musculus
aggcttcgtctttcacagattatga

SEQ ID NO: 197203 - DNA, 25 bp, Mus musculus
aggcttctaaccagtggactgttca

SEQ ID NO: 197204 - DNA, 25 bp, Mus musculus
aggcttctaacctgtggactgttca

SEQ ID NO: 197205 - DNA, 25 bp, Mus musculus
aggcttctaactaattgctttaatc

SEQ ID NO: 197206 - DNA, 25 bp, Mus musculus
aggcttctaacttattgctttaatc

SEQ ID NO: 197207 - DNA, 25 bp, Mus musculus
aggcttctactgaggtcacttacgt

SEQ ID NO: 197208 - DNA, 25 bp, Mus musculus
aggcttctactgtggtcacttacgt

SEQ ID NO: 197209 - DNA, 25 bp, Mus musculus
aggcttctagaactactaatctgat

SEQ ID NO: 197210 - DNA, 25 bp, Mus musculus
aggcttctagaagtactaatctgat

SEQ ID NO: 197211 - DNA, 25 bp, Mus musculus
aggcttctagtaccacaccaaaggg

SEQ ID NO: 197212 - DNA, 25 bp, Mus musculus
aggcttctagtagcacaccaaaggg

SEQ ID NO: 197213 - DNA, 25 bp, Mus musculus
aggcttctatcacttccaaccaaaa

SEQ ID NO: 197214 - DNA, 25 bp, Mus musculus
aggcttctatcagttccaaccaaaa

SEQ ID NO: 197215 - DNA, 25 bp, Mus musculus
aggcttctatttctaccaccggtct

SEQ ID NO: 197216 - DNA, 25 bp, Mus musculus
aggcttctatttgtaccaccggtct

SEQ ID NO: 197217 - DNA, 25 bp, Mus musculus
aggcttctcactcgcactttagcaa

SEQ ID NO: 197218 - DNA, 25 bp, Mus musculus
aggcttctcactggcactttagcaa

SEQ ID NO: 197219 - DNA, 25 bp, Mus musculus
aggcttctcatacaaacattctcca

SEQ ID NO: 197220 - DNA, 25 bp, Mus musculus
aggcttctcatagaaacattctcca

SEQ ID NO: 197221 - DNA, 25 bp, Mus musculus
aggcttctccttcgctatctgagta

SEQ ID NO: 197222 - DNA, 25 bp, Mus musculus
aggcttctccttggctatctgagta

SEQ ID NO: 197223 - DNA, 25 bp, Mus musculus
aggcttctctaaaggtctaccaact

SEQ ID NO: 197224 - DNA, 25 bp, Mus musculus
aggcttctctaatggtctaccaact

SEQ ID NO: 197225 - DNA, 25 bp, Mus musculus
aggcttctctagacttatgagaact

SEQ ID NO: 197226 - DNA, 25 bp, Mus musculus
aggcttctctagtcttatgagaact

SEQ ID NO: 197227 - DNA, 25 bp, Mus musculus
aggcttctctccagtgttaacatat

SEQ ID NO: 197228 - DNA, 25 bp, Mus musculus
aggcttctctcctgtgttaacatat

SEQ ID NO: 197229 - DNA, 25 bp, Mus musculus
aggcttctctctataggaccacttt

SEQ ID NO: 197230 - DNA, 25 bp, Mus musculus
aggcttctctctctactgtctaggg

SEQ ID NO: 197231 - DNA, 25 bp, Mus musculus
aggcttctctctgtactgtctaggg

SEQ ID NO: 197232 - DNA, 25 bp, Mus musculus
aggcttctctctttaggaccacttt

SEQ ID NO: 197233 - DNA, 25 bp, Mus musculus
aggcttctctggctgactgctctat

SEQ ID NO: 197234 - DNA, 25 bp, Mus musculus
aggcttctctgggtgactgctctat

SEQ ID NO: 197235 - DNA, 25 bp, Mus musculus
aggcttctcttccaggaacttcgac

SEQ ID NO: 197236 - DNA, 25 bp, Mus musculus
aggcttctcttcgaggaacttcgac

SEQ ID NO: 197237 - DNA, 25 bp, Mus musculus
aggcttctcttgctttgttttgtgc

SEQ ID NO: 197238 - DNA, 25 bp, Mus musculus
aggcttctcttggtttgttttgtgc

SEQ ID NO: 197239 - DNA, 25 bp, Mus musculus
aggcttctgataaccggtcgtcaga

SEQ ID NO: 197240 - DNA, 25 bp, Mus musculus
aggcttctgatacatatatctctat

SEQ ID NO: 197241 - DNA, 25 bp, Mus musculus
aggcttctgatagatatatctctat

SEQ ID NO: 197242 - DNA, 25 bp, Mus musculus
aggcttctgatatccggtcgtcaga

SEQ ID NO: 197243 - DNA, 25 bp, Mus musculus
aggcttctgattaacttgtctggat

SEQ ID NO: 197244 - DNA, 25 bp, Mus musculus
aggcttctgatttacttgtctggat

SEQ ID NO: 197245 - DNA, 25 bp, Mus musculus
aggcttctgcaaatatcctcagcta

SEQ ID NO: 197246 - DNA, 25 bp, Mus musculus
aggcttctgcaattatcctcagcta

SEQ ID NO: 197247 - DNA, 25 bp, Mus musculus
aggcttctgcagctgtagattctca

SEQ ID NO: 197248 - DNA, 25 bp, Mus musculus
aggcttctgcaggtgtagattctca

SEQ ID NO: 197249 - DNA, 25 bp, Mus musculus
aggcttctgcctcatagggattatt

SEQ ID NO: 197250 - DNA, 25 bp, Mus musculus
aggcttctgcctgatagggattatt

SEQ ID NO: 197251 - DNA, 25 bp, Mus musculus
aggcttctgcttactcctaggagca

SEQ ID NO: 197252 - DNA, 25 bp, Mus musculus
aggcttctgctttctcctaggagca

SEQ ID NO: 197253 - DNA, 25 bp, Mus musculus
aggcttctgggaaggctcatttgca

SEQ ID NO: 197254 - DNA, 25 bp, Mus musculus
aggcttctgggatggctcatttgca

SEQ ID NO: 197255 - DNA, 25 bp, Mus musculus
aggcttctgggcaatctagacttcc

SEQ ID NO: 197256 - DNA, 25 bp, Mus musculus
aggcttctgggctatctagacttcc

SEQ ID NO: 197257 - DNA, 25 bp, Mus musculus
aggcttctgtctctacatcatagca

SEQ ID NO: 197258 - DNA, 25 bp, Mus musculus
aggcttctgtctgtacatcatagca

SEQ ID NO: 197259 - DNA, 25 bp, Mus musculus
aggcttctgttcaacatgaaattca

SEQ ID NO: 197260 - DNA, 25 bp, Mus musculus
aggcttctgttctacatgaaattca

SEQ ID NO: 197261 - DNA, 25 bp, Mus musculus
aggcttctgtttaccaacattaatc

SEQ ID NO: 197262 - DNA, 25 bp, Mus musculus
aggcttctgttttccaacattaatc

SEQ ID NO: 197263 - DNA, 25 bp, Mus musculus
aggcttcttaacatagctgtcgaca

SEQ ID NO: 197264 - DNA, 25 bp, Mus musculus
aggcttcttaacttagctgtcgaca

SEQ ID NO: 197265 - DNA, 25 bp, Mus musculus
aggcttcttcaaatggagctccaga

SEQ ID NO: 197266 - DNA, 25 bp, Mus musculus
aggcttcttcaattggagctccaga

SEQ ID NO: 197267 - DNA, 25 bp, Mus musculus
aggcttcttcacagatcagcatagc

SEQ ID NO: 197268 - DNA, 25 bp, Mus musculus
aggcttcttcactgatcagcatagc

SEQ ID NO: 197269 - DNA, 25 bp, Mus musculus
aggcttcttctccagctgcttctgt

SEQ ID NO: 197270 - DNA, 25 bp, Mus musculus
aggcttcttctcgagctgcttctgt

SEQ ID NO: 197271 - DNA, 25 bp, Mus musculus
aggcttcttgccctggttagtgtca

SEQ ID NO: 197272 - DNA, 25 bp, Mus musculus
aggcttcttgccgtggttagtgtca

SEQ ID NO: 197273 - DNA, 25 bp, Mus musculus
aggcttcttgggacaggtggcccct

SEQ ID NO: 197274 - DNA, 25 bp, Mus musculus
aggcttcttgggactcattttcaga

SEQ ID NO: 197275 - DNA, 25 bp, Mus musculus
aggcttcttgggtcaggtggcccct

SEQ ID NO: 197276 - DNA, 25 bp, Mus musculus
aggcttcttgggtctcattttcaga

SEQ ID NO: 197277 - DNA, 25 bp, Mus musculus
aggcttcttgttccatagcacttgg

SEQ ID NO: 197278 - DNA, 25 bp, Mus musculus
aggcttcttgttgcatagcacttgg

SEQ ID NO: 197279 - DNA, 25 bp, Mus musculus
aggcttctttgaagccttgttctta

SEQ ID NO: 197280 - DNA, 25 bp, Mus musculus
aggcttctttgatgccttgttctta

SEQ ID NO: 197281 - DNA, 25 bp, Mus musculus
aggcttcttttgcatttaccttgct

SEQ ID NO: 197282 - DNA, 25 bp, Mus musculus
aggcttcttttggatttaccttgct

SEQ ID NO: 197283 - DNA, 25 bp, Mus musculus
aggcttgaaagaaacccagacgatt

SEQ ID NO: 197284 - DNA, 25 bp, Mus musculus
aggcttgaaagatacccagacgatt

SEQ ID NO: 197285 - DNA, 25 bp, Mus musculus
aggcttgaaataatactgttcctat

SEQ ID NO: 197286 - DNA, 25 bp, Mus musculus
aggcttgaaatattactgttcctat

SEQ ID NO: 197287 - DNA, 25 bp, Mus musculus
aggcttgaagcacccttcggttcat

SEQ ID NO: 197288 - DNA, 25 bp, Mus musculus
aggcttgaagcagccttcggttcat

SEQ ID NO: 197289 - DNA, 25 bp, Mus musculus
aggcttgacagcagagctgcagcct

SEQ ID NO: 197290 - DNA, 25 bp, Mus musculus
aggcttgacagctgagctgcagcct

SEQ ID NO: 197291 - DNA, 25 bp, Mus musculus
aggcttgactctactgtgtaccctt

SEQ ID NO: 197292 - DNA, 25 bp, Mus musculus
aggcttgactcttctgtgtaccctt

SEQ ID NO: 197293 - DNA, 25 bp, Mus musculus
aggcttgagattacatctgctctcc

SEQ ID NO: 197294 - DNA, 25 bp, Mus musculus
aggcttgagatttcatctgctctcc

SEQ ID NO: 197295 - DNA, 25 bp, Mus musculus
aggcttgagctcacagcaggccagt

SEQ ID NO: 197296 - DNA, 25 bp, Mus musculus
aggcttgagctctcagcaggccagt

SEQ ID NO: 197297 - DNA, 25 bp, Mus musculus
aggcttgaggccaatttcagtctgg

SEQ ID NO: 197298 - DNA, 25 bp, Mus musculus
aggcttgaggccacattagttgaca

SEQ ID NO: 197299 - DNA, 25 bp, Mus musculus
aggcttgaggcctatttcagtctgg

SEQ ID NO: 197300 - DNA, 25 bp, Mus musculus
aggcttgaggcctcattagttgaca

SEQ ID NO: 197301 - DNA, 25 bp, Mus musculus
aggcttgatcaaaaattcgtggtgt

SEQ ID NO: 197302 - DNA, 25 bp, Mus musculus
aggcttgatcaataattcgtggtgt

SEQ ID NO: 197303 - DNA, 25 bp, Mus musculus
aggcttgcacacaggccaggaggaa

SEQ ID NO: 197304 - DNA, 25 bp, Mus musculus
aggcttgcacactggccaggaggaa

SEQ ID NO: 197305 - DNA, 25 bp, Mus musculus
aggcttgcacctcgtgagggccttc

SEQ ID NO: 197306 - DNA, 25 bp, Mus musculus
aggcttgcacctggtgagggccttc

SEQ ID NO: 197307 - DNA, 25 bp, Mus musculus
aggcttgcagacaccttgagctgat

SEQ ID NO: 197308 - DNA, 25 bp, Mus musculus
aggcttgcagactccttgagctgat

SEQ ID NO: 197309 - DNA, 25 bp, Mus musculus
aggcttgcagcccagcgagcgagcg

SEQ ID NO: 197310 - DNA, 25 bp, Mus musculus
aggcttgcagccgagcgagcgagcg

SEQ ID NO: 197311 - DNA, 25 bp, Mus musculus
aggcttgcagttctccacagtgggt

SEQ ID NO: 197312 - DNA, 25 bp, Mus musculus
aggcttgcagttgtccacagtgggt

SEQ ID NO: 197313 - DNA, 25 bp, Mus musculus
aggcttgccacaagcccagcaaagc

SEQ ID NO: 197314 - DNA, 25 bp, Mus musculus
aggcttgccacatgcccagcaaagc

SEQ ID NO: 197315 - DNA, 25 bp, Mus musculus
aggcttgccagaatgtgaagaatgt

SEQ ID NO: 197316 - DNA, 25 bp, Mus musculus
aggcttgccagattgtgaagaatgt

SEQ ID NO: 197317 - DNA, 25 bp, Mus musculus
aggcttgccccgaggaggactacgt

SEQ ID NO: 197318 - DNA, 25 bp, Mus musculus
aggcttgccccgtggaggactacgt

SEQ ID NO: 197319 - DNA, 25 bp, Mus musculus
aggcttgccctgagccagaaaacaa

SEQ ID NO: 197320 - DNA, 25 bp, Mus musculus
aggcttgccctgtgccagaaaacaa

SEQ ID NO: 197321 - DNA, 25 bp, Mus musculus
aggcttgcctacaactcacaatagc

SEQ ID NO: 197322 - DNA, 25 bp, Mus musculus
aggcttgcctactactcacaatagc

SEQ ID NO: 197323 - DNA, 25 bp, Mus musculus
aggcttgcctcaccatgcagtcagt

SEQ ID NO: 197324 - DNA, 25 bp, Mus musculus
aggcttgcctcagcatgcagtcagt

SEQ ID NO: 197325 - DNA, 25 bp, Mus musculus
aggcttgcctgcactatcagaaagg

SEQ ID NO: 197326 - DNA, 25 bp, Mus musculus
aggcttgcctgcagagattgagcgc

SEQ ID NO: 197327 - DNA, 25 bp, Mus musculus
aggcttgcctgctctatcagaaagg

SEQ ID NO: 197328 - DNA, 25 bp, Mus musculus
aggcttgcctgctgagattgagcgc

SEQ ID NO: 197329 - DNA, 25 bp, Mus musculus
aggcttgcctggagtcagctgccga

SEQ ID NO: 197330 - DNA, 25 bp, Mus musculus
aggcttgcctggtgtcagctgccga

SEQ ID NO: 197331 - DNA, 25 bp, Mus musculus
aggcttgccttaagtgctcctaggg

SEQ ID NO: 197332 - DNA, 25 bp, Mus musculus
aggcttgccttatgtgctcctaggg

SEQ ID NO: 197333 - DNA, 25 bp, Mus musculus
aggcttgccttcaacttataaccct

SEQ ID NO: 197334 - DNA, 25 bp, Mus musculus
aggcttgccttctacttataaccct

SEQ ID NO: 197335 - DNA, 25 bp, Mus musculus
aggcttgcgcaacggactcattcgg

SEQ ID NO: 197336 - DNA, 25 bp, Mus musculus
aggcttgcgcaagggactcattcgg

SEQ ID NO: 197337 - DNA, 25 bp, Mus musculus
aggcttgcgctcagctcagttagag

SEQ ID NO: 197338 - DNA, 25 bp, Mus musculus
aggcttgcgctctgctcagttagag

SEQ ID NO: 197339 - DNA, 25 bp, Mus musculus
aggcttgcggccaaacagagcagtg

SEQ ID NO: 197340 - DNA, 25 bp, Mus musculus
aggcttgcggcctaacagagcagtg

SEQ ID NO: 197341 - DNA, 25 bp, Mus musculus
aggcttgctagacagtgcgtttatc

SEQ ID NO: 197342 - DNA, 25 bp, Mus musculus
aggcttgctagagagtgcgtttatc

SEQ ID NO: 197343 - DNA, 25 bp, Mus musculus
aggcttgctctcagaggatcctaaa

SEQ ID NO: 197344 - DNA, 25 bp, Mus musculus
aggcttgctctctgaggatcctaaa

SEQ ID NO: 197345 - DNA, 25 bp, Mus musculus
aggcttgctgtaaaatggtgcgtta

SEQ ID NO: 197346 - DNA, 25 bp, Mus musculus
aggcttgctgtataatggtgcgtta

SEQ ID NO: 197347 - DNA, 25 bp, Mus musculus
aggcttgcttccaccttacttttga

SEQ ID NO: 197348 - DNA, 25 bp, Mus musculus
aggcttgcttcctccttacttttga

SEQ ID NO: 197349 - DNA, 25 bp, Mus musculus
aggcttgcttctaattacaggctcc

SEQ ID NO: 197350 - DNA, 25 bp, Mus musculus
aggcttgcttctaggaaaggcttcc

SEQ ID NO: 197351 - DNA, 25 bp, Mus musculus
aggcttgcttctcctgttctgtgga

SEQ ID NO: 197352 - DNA, 25 bp, Mus musculus
aggcttgcttctgctgttctgtgga

SEQ ID NO: 197353 - DNA, 25 bp, Mus musculus
aggcttgcttcttattacaggctcc

SEQ ID NO: 197354 - DNA, 25 bp, Mus musculus
aggcttgcttcttggaaaggcttcc

SEQ ID NO: 197355 - DNA, 25 bp, Mus musculus
aggcttgcttggaaagccagaccaa

SEQ ID NO: 197356 - DNA, 25 bp, Mus musculus
aggcttgcttggtaagccagaccaa

SEQ ID NO: 197357 - DNA, 25 bp, Mus musculus
aggcttggaactatgtagagactca

SEQ ID NO: 197358 - DNA, 25 bp, Mus musculus
aggcttggaactccttgggagtaac

SEQ ID NO: 197359 - DNA, 25 bp, Mus musculus
aggcttggaactgcttgggagtaac

SEQ ID NO: 197360 - DNA, 25 bp, Mus musculus
aggcttggaactttgtagagactca

SEQ ID NO: 197361 - DNA, 25 bp, Mus musculus
aggcttggacttcgccatggccgct

SEQ ID NO: 197362 - DNA, 25 bp, Mus musculus
aggcttggacttggccatggccgct

SEQ ID NO: 197363 - DNA, 25 bp, Mus musculus
aggcttggatatatgagttcctcac

SEQ ID NO: 197364 - DNA, 25 bp, Mus musculus
aggcttggatatttgagttcctcac

SEQ ID NO: 197365 - DNA, 25 bp, Mus musculus
aggcttggatctaggattcttgacc

SEQ ID NO: 197366 - DNA, 25 bp, Mus musculus
aggcttggatcttggattcttgacc

SEQ ID NO: 197367 - DNA, 25 bp, Mus musculus
aggcttggattcaggcggtagcaac

SEQ ID NO: 197368 - DNA, 25 bp, Mus musculus
aggcttggattctggcggtagcaac

SEQ ID NO: 197369 - DNA, 25 bp, Mus musculus
aggcttggcagcactgaacagttga

SEQ ID NO: 197370 - DNA, 25 bp, Mus musculus
aggcttggcagctctgaacagttga

SEQ ID NO: 197371 - DNA, 25 bp, Mus musculus
aggcttggccagatctcggacccat

SEQ ID NO: 197372 - DNA, 25 bp, Mus musculus
aggcttggccagttctcggacccat

SEQ ID NO: 197373 - DNA, 25 bp, Mus musculus
aggcttggcctgatatttattctgc

SEQ ID NO: 197374 - DNA, 25 bp, Mus musculus
aggcttggcctgttatttattctgc

SEQ ID NO: 197375 - DNA, 25 bp, Mus musculus
aggcttggcgaacgccactggtaaa

SEQ ID NO: 197376 - DNA, 25 bp, Mus musculus
aggcttggcgaaggccactggtaaa

SEQ ID NO: 197377 - DNA, 25 bp, Mus musculus
aggcttggctaaatgctttgggcac

SEQ ID NO: 197378 - DNA, 25 bp, Mus musculus
aggcttggctaattgctttgggcac

SEQ ID NO: 197379 - DNA, 25 bp, Mus musculus
aggcttggctgccagattgcttata

SEQ ID NO: 197380 - DNA, 25 bp, Mus musculus
aggcttggctgcgagattgcttata

SEQ ID NO: 197381 - DNA, 25 bp, Mus musculus
aggcttggctgtagttcctaatgca

SEQ ID NO: 197382 - DNA, 25 bp, Mus musculus
aggcttggctgttgttcctaatgca

SEQ ID NO: 197383 - DNA, 25 bp, Mus musculus
aggcttggtagtcggcacctgtcat

SEQ ID NO: 197384 - DNA, 25 bp, Mus musculus
aggcttggtagtgggcacctgtcat

SEQ ID NO: 197385 - DNA, 25 bp, Mus musculus
aggcttggtctaactcattgggaac

SEQ ID NO: 197386 - DNA, 25 bp, Mus musculus
aggcttggtctatctcattgggaac

SEQ ID NO: 197387 - DNA, 25 bp, Mus musculus
aggcttggttgcaggtttgtgtttt

SEQ ID NO: 197388 - DNA, 25 bp, Mus musculus
aggcttggttgctggtttgtgtttt

SEQ ID NO: 197389 - DNA, 25 bp, Mus musculus
aggcttggtttactgcccagaggct

SEQ ID NO: 197390 - DNA, 25 bp, Mus musculus
aggcttggtttagtgcccagaggct

SEQ ID NO: 197391 - DNA, 25 bp, Mus musculus
aggcttggtttcagcctcagggagc

SEQ ID NO: 197392 - DNA, 25 bp, Mus musculus
aggcttggtttccagtactcacaca

SEQ ID NO: 197393 - DNA, 25 bp, Mus musculus
aggcttggtttcgagtactcacaca

SEQ ID NO: 197394 - DNA, 25 bp, Mus musculus
aggcttggtttctgcctcagggagc

SEQ ID NO: 197395 - DNA, 25 bp, Mus musculus
aggcttgtaccacagctcagaggcg

SEQ ID NO: 197396 - DNA, 25 bp, Mus musculus
aggcttgtaccagagctcagaggcg

SEQ ID NO: 197397 - DNA, 25 bp, Mus musculus
aggcttgtactcagcgcattgaata

SEQ ID NO: 197398 - DNA, 25 bp, Mus musculus
aggcttgtactctgcgcattgaata

SEQ ID NO: 197399 - DNA, 25 bp, Mus musculus
aggcttgtcccaacggaggcagcta

SEQ ID NO: 197400 - DNA, 25 bp, Mus musculus
aggcttgtcccatcggaggcagcta

SEQ ID NO: 197401 - DNA, 25 bp, Mus musculus
aggcttgtcggccttgtgcctgtaa

SEQ ID NO: 197402 - DNA, 25 bp, Mus musculus
aggcttgtcggcgttgtgcctgtaa

SEQ ID NO: 197403 - DNA, 25 bp, Mus musculus
aggcttgtctggaaccaaatccctg

SEQ ID NO: 197404 - DNA, 25 bp, Mus musculus
aggcttgtctggtaccaaatccctg

SEQ ID NO: 197405 - DNA, 25 bp, Mus musculus
aggcttgtcttcatgtgtcagtgct

SEQ ID NO: 197406 - DNA, 25 bp, Mus musculus
aggcttgtcttcttgtgtcagtgct

SEQ ID NO: 197407 - DNA, 25 bp, Mus musculus
aggcttgtcttgagtggagaccgaa

SEQ ID NO: 197408 - DNA, 25 bp, Mus musculus
aggcttgtcttgtgtggagaccgaa

SEQ ID NO: 197409 - DNA, 25 bp, Mus musculus
aggcttgtgaagagagattttataa

SEQ ID NO: 197410 - DNA, 25 bp, Mus musculus
aggcttgtgaagtgagattttataa

SEQ ID NO: 197411 - DNA, 25 bp, Mus musculus
aggcttgtgactagctcatgcacaa

SEQ ID NO: 197412 - DNA, 25 bp, Mus musculus
aggcttgtgacttgctcatgcacaa

SEQ ID NO: 197413 - DNA, 25 bp, Mus musculus
aggcttgtgcacctggagatccctt

SEQ ID NO: 197414 - DNA, 25 bp, Mus musculus
aggcttgtgcacgtggagatccctt

SEQ ID NO: 197415 - DNA, 25 bp, Mus musculus
aggcttgtgccacttctacctgtgg

SEQ ID NO: 197416 - DNA, 25 bp, Mus musculus
aggcttgtgccagttctacctgtgg

SEQ ID NO: 197417 - DNA, 25 bp, Mus musculus
aggcttgtggctcctgaactcacgt

SEQ ID NO: 197418 - DNA, 25 bp, Mus musculus
aggcttgtggctgctgaactcacgt

SEQ ID NO: 197419 - DNA, 25 bp, Mus musculus
aggcttgtgggcacagaaaacttgt

SEQ ID NO: 197420 - DNA, 25 bp, Mus musculus
aggcttgtgggctcagaaaacttgt

SEQ ID NO: 197421 - DNA, 25 bp, Mus musculus
aggcttgtgtacaacccctcgagga

SEQ ID NO: 197422 - DNA, 25 bp, Mus musculus
aggcttgtgtactacccctcgagga

SEQ ID NO: 197423 - DNA, 25 bp, Mus musculus
aggcttgtgttgactacattttcaa

SEQ ID NO: 197424 - DNA, 25 bp, Mus musculus
aggcttgtgttgtctacattttcaa

SEQ ID NO: 197425 - DNA, 25 bp, Mus musculus
aggcttgttagcagtgatcactaga

SEQ ID NO: 197426 - DNA, 25 bp, Mus musculus
aggcttgttagctgtgatcactaga

SEQ ID NO: 197427 - DNA, 25 bp, Mus musculus
aggcttgttgcccagagtgtagcac

SEQ ID NO: 197428 - DNA, 25 bp, Mus musculus
aggcttgttgccgagagtgtagcac

SEQ ID NO: 197429 - DNA, 25 bp, Mus musculus
aggctttaaaggaactctgctatga

SEQ ID NO: 197430 - DNA, 25 bp, Mus musculus
aggctttaaaggtactctgctatga

SEQ ID NO: 197431 - DNA, 25 bp, Mus musculus
aggctttaagaactgggccccactg

SEQ ID NO: 197432 - DNA, 25 bp, Mus musculus
aggctttaagaagtgggccccactg

SEQ ID NO: 197433 - DNA, 25 bp, Mus musculus
aggctttaattaatccatcactctg

SEQ ID NO: 197434 - DNA, 25 bp, Mus musculus
aggctttaattattccatcactctg

SEQ ID NO: 197435 - DNA, 25 bp, Mus musculus
aggctttagcgcactagccctgggt

SEQ ID NO: 197436 - DNA, 25 bp, Mus musculus
aggctttagcgctctagccctgggt

SEQ ID NO: 197437 - DNA, 25 bp, Mus musculus
aggctttaggaaccaccaccattct

SEQ ID NO: 197438 - DNA, 25 bp, Mus musculus
aggctttaggaagcaccaccattct

SEQ ID NO: 197439 - DNA, 25 bp, Mus musculus
aggctttaggtcaaggctgatgtaa

SEQ ID NO: 197440 - DNA, 25 bp, Mus musculus
aggctttaggtctaggctgatgtaa

SEQ ID NO: 197441 - DNA, 25 bp, Mus musculus
aggctttagtctattcctgctccca

SEQ ID NO: 197442 - DNA, 25 bp, Mus musculus
aggctttagtcttttcctgctccca

SEQ ID NO: 197443 - DNA, 25 bp, Mus musculus
aggctttagtttcgccaaccagaag

SEQ ID NO: 197444 - DNA, 25 bp, Mus musculus
aggctttagtttggccaaccagaag

SEQ ID NO: 197445 - DNA, 25 bp, Mus musculus
aggctttatctcatgatcacagttg

SEQ ID NO: 197446 - DNA, 25 bp, Mus musculus
aggctttatctcttgatcacagttg

SEQ ID NO: 197447 - DNA, 25 bp, Mus musculus
aggctttatgccatgtctgctggga

SEQ ID NO: 197448 - DNA, 25 bp, Mus musculus
aggctttatgccttgtctgctggga

SEQ ID NO: 197449 - DNA, 25 bp, Mus musculus
aggctttatggcctttttcagacat

SEQ ID NO: 197450 - DNA, 25 bp, Mus musculus
aggctttatggcgtttttcagacat

SEQ ID NO: 197451 - DNA, 25 bp, Mus musculus
aggctttattgtagagccttaaagt

SEQ ID NO: 197452 - DNA, 25 bp, Mus musculus
aggctttattgttgagccttaaagt

SEQ ID NO: 197453 - DNA, 25 bp, Mus musculus
aggctttcaaagcctctgcccagtc

SEQ ID NO: 197454 - DNA, 25 bp, Mus musculus
aggctttcaaaggctctgcccagtc

SEQ ID NO: 197455 - DNA, 25 bp, Mus musculus
aggctttcaatgaatagctctggct

SEQ ID NO: 197456 - DNA, 25 bp, Mus musculus
aggctttcaatgtatagctctggct

SEQ ID NO: 197457 - DNA, 25 bp, Mus musculus
aggctttcacagcaaaagttgggtg

SEQ ID NO: 197458 - DNA, 25 bp, Mus musculus
aggctttcacaggaaaagttgggtg

SEQ ID NO: 197459 - DNA, 25 bp, Mus musculus
aggctttcacctaaattgatcactc

SEQ ID NO: 197460 - DNA, 25 bp, Mus musculus
aggctttcaccttaattgatcactc

SEQ ID NO: 197461 - DNA, 25 bp, Mus musculus
aggctttcacggaagctgcggtgca

SEQ ID NO: 197462 - DNA, 25 bp, Mus musculus
aggctttcacggtagctgcggtgca

SEQ ID NO: 197463 - DNA, 25 bp, Mus musculus
aggctttcatcgctctaacaacgac

SEQ ID NO: 197464 - DNA, 25 bp, Mus musculus
aggctttcatcggtctaacaacgac

SEQ ID NO: 197465 - DNA, 25 bp, Mus musculus
aggctttccaacagcagggacacgg

SEQ ID NO: 197466 - DNA, 25 bp, Mus musculus
aggctttccaactgcagggacacgg

SEQ ID NO: 197467 - DNA, 25 bp, Mus musculus
aggctttccagccttggcaggaact

SEQ ID NO: 197468 - DNA, 25 bp, Mus musculus
aggctttccagcgttggcaggaact

SEQ ID NO: 197469 - DNA, 25 bp, Mus musculus
aggctttccatgacagctatctgga

SEQ ID NO: 197470 - DNA, 25 bp, Mus musculus
aggctttccatgtcagctatctgga

SEQ ID NO: 197471 - DNA, 25 bp, Mus musculus
aggctttccgcaagtttccggatat

SEQ ID NO: 197472 - DNA, 25 bp, Mus musculus
aggctttccgcatgtttccggatat

SEQ ID NO: 197473 - DNA, 25 bp, Mus musculus
aggctttcctgaaggtgtcctttgg

SEQ ID NO: 197474 - DNA, 25 bp, Mus musculus
aggctttcctgatggtgtcctttgg

SEQ ID NO: 197475 - DNA, 25 bp, Mus musculus
aggctttctaccacatagggctgat

SEQ ID NO: 197476 - DNA, 25 bp, Mus musculus
aggctttctacctcatagggctgat

SEQ ID NO: 197477 - DNA, 25 bp, Mus musculus
aggctttctcctagttacacagatc

SEQ ID NO: 197478 - DNA, 25 bp, Mus musculus
aggctttctccttgttacacagatc

SEQ ID NO: 197479 - DNA, 25 bp, Mus musculus
aggctttctcttaaagttgctcggg

SEQ ID NO: 197480 - DNA, 25 bp, Mus musculus
aggctttctctttaagttgctcggg

SEQ ID NO: 197481 - DNA, 25 bp, Mus musculus
aggctttctggtagggtactctcaa

SEQ ID NO: 197482 - DNA, 25 bp, Mus musculus
aggctttctggttgggtactctcaa

SEQ ID NO: 197483 - DNA, 25 bp, Mus musculus
aggctttctgttcgcttaatatttc

SEQ ID NO: 197484 - DNA, 25 bp, Mus musculus
aggctttctgttggcttaatatttc

SEQ ID NO: 197485 - DNA, 25 bp, Mus musculus
aggctttcttcaacctgagttcaga

SEQ ID NO: 197486 - DNA, 25 bp, Mus musculus
aggctttcttcatcctgagttcaga

SEQ ID NO: 197487 - DNA, 25 bp, Mus musculus
aggctttcttcgactcacattggac

SEQ ID NO: 197488 - DNA, 25 bp, Mus musculus
aggctttcttcgtctcacattggac

SEQ ID NO: 197489 - DNA, 25 bp, Mus musculus
aggctttcttctatccactggtgtt

SEQ ID NO: 197490 - DNA, 25 bp, Mus musculus
aggctttcttctttccactggtgtt

SEQ ID NO: 197491 - DNA, 25 bp, Mus musculus
aggctttctttcaccagatacatac

SEQ ID NO: 197492 - DNA, 25 bp, Mus musculus
aggctttctttcatggcaaagtcaa

SEQ ID NO: 197493 - DNA, 25 bp, Mus musculus
aggctttctttctccagatacatac

SEQ ID NO: 197494 - DNA, 25 bp, Mus musculus
aggctttctttcttggcaaagtcaa

SEQ ID NO: 197495 - DNA, 25 bp, Mus musculus
aggctttgaaccaccttgtcattct

SEQ ID NO: 197496 - DNA, 25 bp, Mus musculus
aggctttgaacctccttgtcattct

SEQ ID NO: 197497 - DNA, 25 bp, Mus musculus
aggctttgagaaagacagggcatgc

SEQ ID NO: 197498 - DNA, 25 bp, Mus musculus
aggctttgagaatgacagggcatgc

SEQ ID NO: 197499 - DNA, 25 bp, Mus musculus
aggctttgagagcttgttatttcaa

SEQ ID NO: 197500 - DNA, 25 bp, Mus musculus
aggctttgagaggttgttatttcaa

SEQ ID NO: 197501 - DNA, 25 bp, Mus musculus
aggctttgagccacccagtgagaca

SEQ ID NO: 197502 - DNA, 25 bp, Mus musculus
aggctttgagcctcccagtgagaca

SEQ ID NO: 197503 - DNA, 25 bp, Mus musculus
aggctttgaggtactacatcctggt

SEQ ID NO: 197504 - DNA, 25 bp, Mus musculus
aggctttgaggttctacatcctggt

SEQ ID NO: 197505 - DNA, 25 bp, Mus musculus
aggctttgatggatcctctaatccc

SEQ ID NO: 197506 - DNA, 25 bp, Mus musculus
aggctttgatggttcctctaatccc

SEQ ID NO: 197507 - DNA, 25 bp, Mus musculus
aggctttgccctataactgccttgt

SEQ ID NO: 197508 - DNA, 25 bp, Mus musculus
aggctttgccctttaactgccttgt

SEQ ID NO: 197509 - DNA, 25 bp, Mus musculus
aggctttgcggcacccgtggcttag

SEQ ID NO: 197510 - DNA, 25 bp, Mus musculus
aggctttgcggctcccgtggcttag

SEQ ID NO: 197511 - DNA, 25 bp, Mus musculus
aggctttgcttaaactctcagatgg

SEQ ID NO: 197512 - DNA, 25 bp, Mus musculus
aggctttgcttatactctcagatgg

SEQ ID NO: 197513 - DNA, 25 bp, Mus musculus
aggctttgcttgacactgtgcagca

SEQ ID NO: 197514 - DNA, 25 bp, Mus musculus
aggctttgcttgtcactgtgcagca

SEQ ID NO: 197515 - DNA, 25 bp, Mus musculus
aggctttggatactgcaggctttag

SEQ ID NO: 197516 - DNA, 25 bp, Mus musculus
aggctttggatagtgcaggctttag

SEQ ID NO: 197517 - DNA, 25 bp, Mus musculus
aggctttggccaccacagtggagat

SEQ ID NO: 197518 - DNA, 25 bp, Mus musculus
aggctttggccagcacagtggagat

SEQ ID NO: 197519 - DNA, 25 bp, Mus musculus
aggctttggcgtaggctgcgaacca

SEQ ID NO: 197520 - DNA, 25 bp, Mus musculus
aggctttggcgttggctgcgaacca

SEQ ID NO: 197521 - DNA, 25 bp, Mus musculus
aggctttggctacgacctcagtcaa

SEQ ID NO: 197522 - DNA, 25 bp, Mus musculus
aggctttggctaggacctcagtcaa

SEQ ID NO: 197523 - DNA, 25 bp, Mus musculus
aggctttggtagagaacttggcatt

SEQ ID NO: 197524 - DNA, 25 bp, Mus musculus
aggctttggtagtgaacttggcatt

SEQ ID NO: 197525 - DNA, 25 bp, Mus musculus
aggctttgtagcatgtgagtcatat

SEQ ID NO: 197526 - DNA, 25 bp, Mus musculus
aggctttgtagcttgtgagtcatat

SEQ ID NO: 197527 - DNA, 25 bp, Mus musculus
aggctttgtggtccgagatgctccc

SEQ ID NO: 197528 - DNA, 25 bp, Mus musculus
aggctttgtggtgcgagatgctccc

SEQ ID NO: 197529 - DNA, 25 bp, Mus musculus
aggctttgttgcagaggccacattc

SEQ ID NO: 197530 - DNA, 25 bp, Mus musculus
aggctttgttgctgaggccacattc

SEQ ID NO: 197531 - DNA, 25 bp, Mus musculus
aggctttgtttcagcctggaagtga

SEQ ID NO: 197532 - DNA, 25 bp, Mus musculus
aggctttgtttctgcctggaagtga

SEQ ID NO: 197533 - DNA, 25 bp, Mus musculus
aggcttttaacacctggtccagaag

SEQ ID NO: 197534 - DNA, 25 bp, Mus musculus
aggcttttaacagctggtccagaag

SEQ ID NO: 197535 - DNA, 25 bp, Mus musculus
aggcttttaagcatgacgggaccaa

SEQ ID NO: 197536 - DNA, 25 bp, Mus musculus
aggcttttaagcttgacgggaccaa

SEQ ID NO: 197537 - DNA, 25 bp, Mus musculus
aggcttttaataatctctggctcat

SEQ ID NO: 197538 - DNA, 25 bp, Mus musculus
aggcttttaatattctctggctcat

SEQ ID NO: 197539 - DNA, 25 bp, Mus musculus
aggcttttattaatgcctctccctg

SEQ ID NO: 197540 - DNA, 25 bp, Mus musculus
aggcttttattattgcctctccctg

SEQ ID NO: 197541 - DNA, 25 bp, Mus musculus
aggcttttattcaccagttgtgcag

SEQ ID NO: 197542 - DNA, 25 bp, Mus musculus
aggcttttattctccagttgtgcag

SEQ ID NO: 197543 - DNA, 25 bp, Mus musculus
aggcttttattgacaagttccaggg

SEQ ID NO: 197544 - DNA, 25 bp, Mus musculus
aggcttttattgtcaagttccaggg

SEQ ID NO: 197545 - DNA, 25 bp, Mus musculus
aggcttttatttactgggatggtgg

SEQ ID NO: 197546 - DNA, 25 bp, Mus musculus
aggcttttattttctgggatggtgg

SEQ ID NO: 197547 - DNA, 25 bp, Mus musculus
aggcttttcaaacgcgtcggcgaag

SEQ ID NO: 197548 - DNA, 25 bp, Mus musculus
aggcttttcaaaggcgtcggcgaag

SEQ ID NO: 197549 - DNA, 25 bp, Mus musculus
aggcttttcacgagagggcttttga

SEQ ID NO: 197550 - DNA, 25 bp, Mus musculus
aggcttttcacgtgagggcttttga

SEQ ID NO: 197551 - DNA, 25 bp, Mus musculus
aggcttttcaggaagtgcaccacac

SEQ ID NO: 197552 - DNA, 25 bp, Mus musculus
aggcttttcaggtagtgcaccacac

SEQ ID NO: 197553 - DNA, 25 bp, Mus musculus
aggcttttccgtactagggctgtat

SEQ ID NO: 197554 - DNA, 25 bp, Mus musculus
aggcttttccgttctagggctgtat

SEQ ID NO: 197555 - DNA, 25 bp, Mus musculus
aggcttttcctcacttcaaatgtct

SEQ ID NO: 197556 - DNA, 25 bp, Mus musculus
aggcttttcctctcttcaaatgtct

SEQ ID NO: 197557 - DNA, 25 bp, Mus musculus
aggcttttcctgctatctctgctgt

SEQ ID NO: 197558 - DNA, 25 bp, Mus musculus
aggcttttcctggtatctctgctgt

SEQ ID NO: 197559 - DNA, 25 bp, Mus musculus
aggcttttctccacgctgtagagca

SEQ ID NO: 197560 - DNA, 25 bp, Mus musculus
aggcttttctcctcgctgtagagca

SEQ ID NO: 197561 - DNA, 25 bp, Mus musculus
aggcttttgccactctccgaatggc

SEQ ID NO: 197562 - DNA, 25 bp, Mus musculus
aggcttttgccagtctccgaatggc

SEQ ID NO: 197563 - DNA, 25 bp, Mus musculus
aggcttttgcttaaatattctgagt

SEQ ID NO: 197564 - DNA, 25 bp, Mus musculus
aggcttttgctttaatattctgagt

SEQ ID NO: 197565 - DNA, 25 bp, Mus musculus
aggcttttggctacagcactgtttg

SEQ ID NO: 197566 - DNA, 25 bp, Mus musculus
aggcttttggctcgatttcatctca

SEQ ID NO: 197567 - DNA, 25 bp, Mus musculus
aggcttttggctggatttcatctca

SEQ ID NO: 197568 - DNA, 25 bp, Mus musculus
aggcttttggcttcagcactgtttg

SEQ ID NO: 197569 - DNA, 25 bp, Mus musculus
aggcttttgggaccttgcatggaaa

SEQ ID NO: 197570 - DNA, 25 bp, Mus musculus
aggcttttgggagcttgcatggaaa

SEQ ID NO: 197571 - DNA, 25 bp, Mus musculus
aggcttttggtgctcaacacactga

SEQ ID NO: 197572 - DNA, 25 bp, Mus musculus
aggcttttggtggtcaacacactga

SEQ ID NO: 197573 - DNA, 25 bp, Mus musculus
aggcttttgtccaccgagatcagag

SEQ ID NO: 197574 - DNA, 25 bp, Mus musculus
aggcttttgtcctccgagatcagag

SEQ ID NO: 197575 - DNA, 25 bp, Mus musculus
aggctttttacaatcagaagatgct

SEQ ID NO: 197576 - DNA, 25 bp, Mus musculus
aggctttttacattcagaagatgct

SEQ ID NO: 197577 - DNA, 25 bp, Mus musculus
aggctttttatcactcttcaactca

SEQ ID NO: 197578 - DNA, 25 bp, Mus musculus
aggctttttatctctcttcaactca

SEQ ID NO: 197579 - DNA, 25 bp, Mus musculus
aggctttttattctcttggtaatga

SEQ ID NO: 197580 - DNA, 25 bp, Mus musculus
aggctttttattgtcttggtaatga

SEQ ID NO: 197581 - DNA, 25 bp, Mus musculus
aggctttttctacaccaggattgtt

SEQ ID NO: 197582 - DNA, 25 bp, Mus musculus
aggctttttctagaccaggattgtt

SEQ ID NO: 197583 - DNA, 25 bp, Mus musculus
aggctttttctgactaggcggctgc

SEQ ID NO: 197584 - DNA, 25 bp, Mus musculus
aggctttttctgatatttgtgcaca

SEQ ID NO: 197585 - DNA, 25 bp, Mus musculus
aggctttttctgtctaggcggctgc

SEQ ID NO: 197586 - DNA, 25 bp, Mus musculus
aggctttttctgttatttgtgcaca

SEQ ID NO: 197587 - DNA, 25 bp, Mus musculus
aggctttttgtcatgcatctaagga

SEQ ID NO: 197588 - DNA, 25 bp, Mus musculus
aggctttttgtcttgcatctaagga

SEQ ID NO: 197589 - DNA, 25 bp, Mus musculus
aggctttttgttatacagagctgaa

SEQ ID NO: 197590 - DNA, 25 bp, Mus musculus
aggctttttgttttacagagctgaa

SEQ ID NO: 197591 - DNA, 25 bp, Mus musculus
aggcttttttggctatgcagagaca

SEQ ID NO: 197592 - DNA, 25 bp, Mus musculus
aggcttttttgggtatgcagagaca

SEQ ID NO: 197593 - DNA, 25 bp, Mus musculus
agggaaaaccctctcttcagccact

SEQ ID NO: 197594 - DNA, 25 bp, Mus musculus
agggaaaaccctgtcttcagccact

SEQ ID NO: 197595 - DNA, 25 bp, Mus musculus
agggaaaactgtccgagcacctgcg

SEQ ID NO: 197596 - DNA, 25 bp, Mus musculus
agggaaaactgtgcgagcacctgcg

SEQ ID NO: 197597 - DNA, 25 bp, Mus musculus
agggaaacaagtccctaaatgtctt

SEQ ID NO: 197598 - DNA, 25 bp, Mus musculus
agggaaacaagtgcctaaatgtctt

SEQ ID NO: 197599 - DNA, 25 bp, Mus musculus
agggaaacacctcaatgctcacatc

SEQ ID NO: 197600 - DNA, 25 bp, Mus musculus
agggaaacacctgaatgctcacatc

SEQ ID NO: 197601 - DNA, 25 bp, Mus musculus
agggaaacagttctttcattgcagt

SEQ ID NO: 197602 - DNA, 25 bp, Mus musculus
agggaaacagttgtttcattgcagt

SEQ ID NO: 197603 - DNA, 25 bp, Mus musculus
agggaaacatcacttctcctccggt

SEQ ID NO: 197604 - DNA, 25 bp, Mus musculus
agggaaacatcagttctcctccggt

SEQ ID NO: 197605 - DNA, 25 bp, Mus musculus
agggaaacatctctgacaattaaga

SEQ ID NO: 197606 - DNA, 25 bp, Mus musculus
agggaaacatctgtgacaattaaga

SEQ ID NO: 197607 - DNA, 25 bp, Mus musculus
agggaaaccagaaccaccaccttgg

SEQ ID NO: 197608 - DNA, 25 bp, Mus musculus
agggaaaccagatccaccaccttgg

SEQ ID NO: 197609 - DNA, 25 bp, Mus musculus
agggaaaccccgagctagacaatgt

SEQ ID NO: 197610 - DNA, 25 bp, Mus musculus
agggaaaccccgtgctagacaatgt

SEQ ID NO: 197611 - DNA, 25 bp, Mus musculus
agggaaactcacacacaggctgatg

SEQ ID NO: 197612 - DNA, 25 bp, Mus musculus
agggaaactcactcacaggctgatg

SEQ ID NO: 197613 - DNA, 25 bp, Mus musculus
agggaaactgatccccaacccactt

SEQ ID NO: 197614 - DNA, 25 bp, Mus musculus
agggaaactgatgcccaacccactt

SEQ ID NO: 197615 - DNA, 25 bp, Mus musculus
agggaaactgtcatgcctgtcctcc

SEQ ID NO: 197616 - DNA, 25 bp, Mus musculus
agggaaactgtcttgcctgtcctcc

SEQ ID NO: 197617 - DNA, 25 bp, Mus musculus
agggaaactgttcacatatctgtgc

SEQ ID NO: 197618 - DNA, 25 bp, Mus musculus
agggaaactgttgacatatctgtgc

SEQ ID NO: 197619 - DNA, 25 bp, Mus musculus
agggaaacttcccagtctgctcttg

SEQ ID NO: 197620 - DNA, 25 bp, Mus musculus
agggaaacttccgagtctgctcttg

SEQ ID NO: 197621 - DNA, 25 bp, Mus musculus
agggaaagacagagctctcgacagg

SEQ ID NO: 197622 - DNA, 25 bp, Mus musculus
agggaaagacagtgctctcgacagg

SEQ ID NO: 197623 - DNA, 25 bp, Mus musculus
agggaaagacgtcgcccttctcttg

SEQ ID NO: 197624 - DNA, 25 bp, Mus musculus
agggaaagacgtggcccttctcttg

SEQ ID NO: 197625 - DNA, 25 bp, Mus musculus
agggaaagacttagcagactgctct

SEQ ID NO: 197626 - DNA, 25 bp, Mus musculus
agggaaagactttgcagactgctct

SEQ ID NO: 197627 - DNA, 25 bp, Mus musculus
agggaaagagccagccgtctacctg

SEQ ID NO: 197628 - DNA, 25 bp, Mus musculus
agggaaagagcctgccgtctacctg

SEQ ID NO: 197629 - DNA, 25 bp, Mus musculus
agggaaagagtgacactcctggctg

SEQ ID NO: 197630 - DNA, 25 bp, Mus musculus
agggaaagagtgtcactcctggctg

SEQ ID NO: 197631 - DNA, 25 bp, Mus musculus
agggaaagatgaacccgcgaccgtc

SEQ ID NO: 197632 - DNA, 25 bp, Mus musculus
agggaaagatgatcccgcgaccgtc

SEQ ID NO: 197633 - DNA, 25 bp, Mus musculus
agggaaagcaatacctgcctcaaaa

SEQ ID NO: 197634 - DNA, 25 bp, Mus musculus
agggaaagcaattcctgcctcaaaa

SEQ ID NO: 197635 - DNA, 25 bp, Mus musculus
agggaaagcccacatatctatgaaa

SEQ ID NO: 197636 - DNA, 25 bp, Mus musculus
agggaaagcccagatatctatgaaa

SEQ ID NO: 197637 - DNA, 25 bp, Mus musculus
agggaaagccttctggaccagcatc

SEQ ID NO: 197638 - DNA, 25 bp, Mus musculus
agggaaagccttgtggaccagcatc

SEQ ID NO: 197639 - DNA, 25 bp, Mus musculus
agggaaagtttgacgcgtccatcct

SEQ ID NO: 197640 - DNA, 25 bp, Mus musculus
agggaaagtttgtcgcgtccatcct

SEQ ID NO: 197641 - DNA, 25 bp, Mus musculus
agggaaatcatccttgtctgctcaa

SEQ ID NO: 197642 - DNA, 25 bp, Mus musculus
agggaaatcatcgttgtctgctcaa

SEQ ID NO: 197643 - DNA, 25 bp, Mus musculus
agggaaatcgaacacactcacacac

SEQ ID NO: 197644 - DNA, 25 bp, Mus musculus
agggaaatcgaagacactcacacac

SEQ ID NO: 197645 - DNA, 25 bp, Mus musculus
agggaaatggccatcattccagagg

SEQ ID NO: 197646 - DNA, 25 bp, Mus musculus
agggaaatggccttcattccagagg

SEQ ID NO: 197647 - DNA, 25 bp, Mus musculus
agggaaatgtcaagcgtggaacaga

SEQ ID NO: 197648 - DNA, 25 bp, Mus musculus
agggaaatgtcatgcgtggaacaga

SEQ ID NO: 197649 - DNA, 25 bp, Mus musculus
agggaaattcctaccacagtgttca

SEQ ID NO: 197650 - DNA, 25 bp, Mus musculus
agggaaattccttccacagtgttca

SEQ ID NO: 197651 - DNA, 25 bp, Mus musculus
agggaacaaccgatggccttttgct

SEQ ID NO: 197652 - DNA, 25 bp, Mus musculus
agggaacaaccgttggccttttgct

SEQ ID NO: 197653 - DNA, 25 bp, Mus musculus
agggaacaccaaatgcagctaatac

SEQ ID NO: 197654 - DNA, 25 bp, Mus musculus
agggaacaccaattgcagctaatac

SEQ ID NO: 197655 - DNA, 25 bp, Mus musculus
agggaacactcaagggcagctggca

SEQ ID NO: 197656 - DNA, 25 bp, Mus musculus
agggaacactcatgggcagctggca

SEQ ID NO: 197657 - DNA, 25 bp, Mus musculus
agggaacacttgaccttgaccctcg

SEQ ID NO: 197658 - DNA, 25 bp, Mus musculus
agggaacacttgctgacctgtgact

SEQ ID NO: 197659 - DNA, 25 bp, Mus musculus
agggaacacttggtgacctgtgact

SEQ ID NO: 197660 - DNA, 25 bp, Mus musculus
agggaacacttgtccttgaccctcg

SEQ ID NO: 197661 - DNA, 25 bp, Mus musculus
agggaacagactctggctagccaga

SEQ ID NO: 197662 - DNA, 25 bp, Mus musculus
agggaacagactgtggctagccaga

SEQ ID NO: 197663 - DNA, 25 bp, Mus musculus
agggaacagagtagccaaggccatc

SEQ ID NO: 197664 - DNA, 25 bp, Mus musculus
agggaacagagttgccaaggccatc

SEQ ID NO: 197665 - DNA, 25 bp, Mus musculus
agggaacatccccatgtgaagttaa

SEQ ID NO: 197666 - DNA, 25 bp, Mus musculus
agggaacatcccgatgtgaagttaa

SEQ ID NO: 197667 - DNA, 25 bp, Mus musculus
agggaaccaactccctggacacctt

SEQ ID NO: 197668 - DNA, 25 bp, Mus musculus
agggaaccaactgcctggacacctt

SEQ ID NO: 197669 - DNA, 25 bp, Mus musculus
agggaaccacccatgggttactcat

SEQ ID NO: 197670 - DNA, 25 bp, Mus musculus
agggaaccacccttgggttactcat

SEQ ID NO: 197671 - DNA, 25 bp, Mus musculus
agggaaccactgatagcggtctctt

SEQ ID NO: 197672 - DNA, 25 bp, Mus musculus
agggaaccactgttagcggtctctt

SEQ ID NO: 197673 - DNA, 25 bp, Mus musculus
agggaaccagacctttctctggcag

SEQ ID NO: 197674 - DNA, 25 bp, Mus musculus
agggaaccagacgtttctctggcag

SEQ ID NO: 197675 - DNA, 25 bp, Mus musculus
agggaaccagctacaagctaagaga

SEQ ID NO: 197676 - DNA, 25 bp, Mus musculus
agggaaccagcttcaagctaagaga

SEQ ID NO: 197677 - DNA, 25 bp, Mus musculus
agggaaccatggaggaaactgtgaa

SEQ ID NO: 197678 - DNA, 25 bp, Mus musculus
agggaaccatggtggaaactgtgaa

SEQ ID NO: 197679 - DNA, 25 bp, Mus musculus
agggaacccctacaggtgcagcagc

SEQ ID NO: 197680 - DNA, 25 bp, Mus musculus
agggaacccctagaggtgcagcagc

SEQ ID NO: 197681 - DNA, 25 bp, Mus musculus
agggaaccctccagataggaagcta

SEQ ID NO: 197682 - DNA, 25 bp, Mus musculus
agggaaccctcctgataggaagcta

SEQ ID NO: 197683 - DNA, 25 bp, Mus musculus
agggaaccctctctgcttatgaagc

SEQ ID NO: 197684 - DNA, 25 bp, Mus musculus
agggaaccctctgtgcttatgaagc

SEQ ID NO: 197685 - DNA, 25 bp, Mus musculus
agggaacgagatcaaagaccaagct

SEQ ID NO: 197686 - DNA, 25 bp, Mus musculus
agggaacgagatcccctggaccaat

SEQ ID NO: 197687 - DNA, 25 bp, Mus musculus
agggaacgagatgaaagaccaagct

SEQ ID NO: 197688 - DNA, 25 bp, Mus musculus
agggaacgagatgccctggaccaat

SEQ ID NO: 197689 - DNA, 25 bp, Mus musculus
agggaacgctaacttgtttgagatc

SEQ ID NO: 197690 - DNA, 25 bp, Mus musculus
agggaacgctaagttgtttgagatc

SEQ ID NO: 197691 - DNA, 25 bp, Mus musculus
agggaacgctccagcaacagtgctt

SEQ ID NO: 197692 - DNA, 25 bp, Mus musculus
agggaacgctcctgcaacagtgctt

SEQ ID NO: 197693 - DNA, 25 bp, Mus musculus
agggaacgtcatcctttggtaagcg

SEQ ID NO: 197694 - DNA, 25 bp, Mus musculus
agggaacgtcatgctttggtaagcg

SEQ ID NO: 197695 - DNA, 25 bp, Mus musculus
agggaacgtgtgactctttcatgca

SEQ ID NO: 197696 - DNA, 25 bp, Mus musculus
agggaacgtgtgtctctttcatgca

SEQ ID NO: 197697 - DNA, 25 bp, Mus musculus
agggaactagaacgccactgtcact

SEQ ID NO: 197698 - DNA, 25 bp, Mus musculus
agggaactagaaggccactgtcact

SEQ ID NO: 197699 - DNA, 25 bp, Mus musculus
agggaactcgaaaccatgcaggccg

SEQ ID NO: 197700 - DNA, 25 bp, Mus musculus
agggaactcgaatccatgcaggccg

SEQ ID NO: 197701 - DNA, 25 bp, Mus musculus
agggaactctatacattctgttaac

SEQ ID NO: 197702 - DNA, 25 bp, Mus musculus
agggaactctattcattctgttaac

SEQ ID NO: 197703 - DNA, 25 bp, Mus musculus
agggaactcttcaccttaccagtag

SEQ ID NO: 197704 - DNA, 25 bp, Mus musculus
agggaactcttctccttaccagtag

SEQ ID NO: 197705 - DNA, 25 bp, Mus musculus
agggaactgcacaagtgtacgagct

SEQ ID NO: 197706 - DNA, 25 bp, Mus musculus
agggaactgcactagtgtacgagct

SEQ ID NO: 197707 - DNA, 25 bp, Mus musculus
agggaactgcagagtgccatgctgt

SEQ ID NO: 197708 - DNA, 25 bp, Mus musculus
agggaactgcagtgtgccatgctgt

SEQ ID NO: 197709 - DNA, 25 bp, Mus musculus
agggaactgccactcctggttgcca

SEQ ID NO: 197710 - DNA, 25 bp, Mus musculus
agggaactgccagtcctggttgcca

SEQ ID NO: 197711 - DNA, 25 bp, Mus musculus
agggaactggagaccattttgcagc

SEQ ID NO: 197712 - DNA, 25 bp, Mus musculus
agggaactggagtccattttgcagc

SEQ ID NO: 197713 - DNA, 25 bp, Mus musculus
agggaactggatcctgacctgcgca

SEQ ID NO: 197714 - DNA, 25 bp, Mus musculus
agggaactggatgctgacctgcgca

SEQ ID NO: 197715 - DNA, 25 bp, Mus musculus
agggaactgggaagagtcatcaaaa

SEQ ID NO: 197716 - DNA, 25 bp, Mus musculus
agggaactgggaagatgaatcttca

SEQ ID NO: 197717 - DNA, 25 bp, Mus musculus
agggaactgggatgagtcatcaaaa

SEQ ID NO: 197718 - DNA, 25 bp, Mus musculus
agggaactgggatgatgaatcttca

SEQ ID NO: 197719 - DNA, 25 bp, Mus musculus
agggaactgtttacagtctgctctg

SEQ ID NO: 197720 - DNA, 25 bp, Mus musculus
agggaactgttttcagtctgctctg

SEQ ID NO: 197721 - DNA, 25 bp, Mus musculus
agggaacttctacagcaaaggctca

SEQ ID NO: 197722 - DNA, 25 bp, Mus musculus
agggaacttctagagcaaaggctca

SEQ ID NO: 197723 - DNA, 25 bp, Mus musculus
agggaagaaggcacactctctatgg

SEQ ID NO: 197724 - DNA, 25 bp, Mus musculus
agggaagaaggctcactctctatgg

SEQ ID NO: 197725 - DNA, 25 bp, Mus musculus
agggaagacacactttctctgcagt

SEQ ID NO: 197726 - DNA, 25 bp, Mus musculus
agggaagacacagtttctctgcagt

SEQ ID NO: 197727 - DNA, 25 bp, Mus musculus
agggaagacaccaccacaactgact

SEQ ID NO: 197728 - DNA, 25 bp, Mus musculus
agggaagacacctccacaactgact

SEQ ID NO: 197729 - DNA, 25 bp, Mus musculus
agggaagacccacaaccttctggct

SEQ ID NO: 197730 - DNA, 25 bp, Mus musculus
agggaagacccagaaccttctggct

SEQ ID NO: 197731 - DNA, 25 bp, Mus musculus
agggaagacctcaagctctgcaaat

SEQ ID NO: 197732 - DNA, 25 bp, Mus musculus
agggaagacctctagctctgcaaat

SEQ ID NO: 197733 - DNA, 25 bp, Mus musculus
agggaagacgccatactcgctgaga

SEQ ID NO: 197734 - DNA, 25 bp, Mus musculus
agggaagacgccttactcgctgaga

SEQ ID NO: 197735 - DNA, 25 bp, Mus musculus
agggaagacttcagctcttaacttt

SEQ ID NO: 197736 - DNA, 25 bp, Mus musculus
agggaagacttccagttctgacaaa

SEQ ID NO: 197737 - DNA, 25 bp, Mus musculus
agggaagacttcgagttctgacaaa

SEQ ID NO: 197738 - DNA, 25 bp, Mus musculus
agggaagacttctgctcttaacttt

SEQ ID NO: 197739 - DNA, 25 bp, Mus musculus
agggaagagagcctcctcctcactg

SEQ ID NO: 197740 - DNA, 25 bp, Mus musculus
agggaagagagcgtcctcctcactg

SEQ ID NO: 197741 - DNA, 25 bp, Mus musculus
agggaagagcctccaacacccaagt

SEQ ID NO: 197742 - DNA, 25 bp, Mus musculus
agggaagagcctgcaacacccaagt

SEQ ID NO: 197743 - DNA, 25 bp, Mus musculus
agggaagaggctactccttcataac

SEQ ID NO: 197744 - DNA, 25 bp, Mus musculus
agggaagaggcttctccttcataac

SEQ ID NO: 197745 - DNA, 25 bp, Mus musculus
agggaagatactatgctgttgatgg

SEQ ID NO: 197746 - DNA, 25 bp, Mus musculus
agggaagatactttgctgttgatgg

SEQ ID NO: 197747 - DNA, 25 bp, Mus musculus
agggaagcaacgcaatcttcagcat

SEQ ID NO: 197748 - DNA, 25 bp, Mus musculus
agggaagcaacggaatcttcagcat

SEQ ID NO: 197749 - DNA, 25 bp, Mus musculus
agggaagcaactcggcaaactgtta

SEQ ID NO: 197750 - DNA, 25 bp, Mus musculus
agggaagcaactgggcaaactgtta

SEQ ID NO: 197751 - DNA, 25 bp, Mus musculus
agggaagcatccaactcgggataac

SEQ ID NO: 197752 - DNA, 25 bp, Mus musculus
agggaagcatcctactcgggataac

SEQ ID NO: 197753 - DNA, 25 bp, Mus musculus
agggaagcatgtagccatctggtcc

SEQ ID NO: 197754 - DNA, 25 bp, Mus musculus
agggaagcatgttgccatctggtcc

SEQ ID NO: 197755 - DNA, 25 bp, Mus musculus
agggaagccacactggccactttct

SEQ ID NO: 197756 - DNA, 25 bp, Mus musculus
agggaagccacagtggccactttct

SEQ ID NO: 197757 - DNA, 25 bp, Mus musculus
agggaagccagaagcatgcagactt

SEQ ID NO: 197758 - DNA, 25 bp, Mus musculus
agggaagccagatgcatgcagactt

SEQ ID NO: 197759 - DNA, 25 bp, Mus musculus
agggaagccagtccccttcatcgtt

SEQ ID NO: 197760 - DNA, 25 bp, Mus musculus
agggaagccagtgcccttcatcgtt

SEQ ID NO: 197761 - DNA, 25 bp, Mus musculus
agggaagccattcccacttgttctg

SEQ ID NO: 197762 - DNA, 25 bp, Mus musculus
agggaagccattgccacttgttctg

SEQ ID NO: 197763 - DNA, 25 bp, Mus musculus
agggaagcccttcatcctgtgtaac

SEQ ID NO: 197764 - DNA, 25 bp, Mus musculus
agggaagcccttgatcctgtgtaac

SEQ ID NO: 197765 - DNA, 25 bp, Mus musculus
agggaagccgtcaacctctgaaagc

SEQ ID NO: 197766 - DNA, 25 bp, Mus musculus
agggaagccgtctacctctgaaagc

SEQ ID NO: 197767 - DNA, 25 bp, Mus musculus
agggaagcgcccagtgtaacatttc

SEQ ID NO: 197768 - DNA, 25 bp, Mus musculus
agggaagcgccctgtgtaacatttc

SEQ ID NO: 197769 - DNA, 25 bp, Mus musculus
agggaagcggttcactatctcccta

SEQ ID NO: 197770 - DNA, 25 bp, Mus musculus
agggaagcggttgactatctcccta

SEQ ID NO: 197771 - DNA, 25 bp, Mus musculus
agggaagctccacaagttcctcttc

SEQ ID NO: 197772 - DNA, 25 bp, Mus musculus
agggaagctccagaagttcctcttc

SEQ ID NO: 197773 - DNA, 25 bp, Mus musculus
agggaagctctgactgtgtactcct

SEQ ID NO: 197774 - DNA, 25 bp, Mus musculus
agggaagctctgtctgtgtactcct

SEQ ID NO: 197775 - DNA, 25 bp, Mus musculus
agggaagctggaagccgtcatgaaa

SEQ ID NO: 197776 - DNA, 25 bp, Mus musculus
agggaagctggatgccgtcatgaaa

SEQ ID NO: 197777 - DNA, 25 bp, Mus musculus
agggaagctgggatcatcgtcccta

SEQ ID NO: 197778 - DNA, 25 bp, Mus musculus
agggaagctgggttcatcgtcccta

SEQ ID NO: 197779 - DNA, 25 bp, Mus musculus
agggaagcttggactgatctttgcc

SEQ ID NO: 197780 - DNA, 25 bp, Mus musculus
agggaagcttggtctgatctttgcc

SEQ ID NO: 197781 - DNA, 25 bp, Mus musculus
agggaaggaaaaatcacaatcactg

SEQ ID NO: 197782 - DNA, 25 bp, Mus musculus
agggaaggaaaattcacaatcactg

SEQ ID NO: 197783 - DNA, 25 bp, Mus musculus
agggaaggacccatgagcctggctc

SEQ ID NO: 197784 - DNA, 25 bp, Mus musculus
agggaaggacccttgagcctggctc

SEQ ID NO: 197785 - DNA, 25 bp, Mus musculus
agggaaggagcacccatgtccactg

SEQ ID NO: 197786 - DNA, 25 bp, Mus musculus
agggaaggagcagccatgtccactg

SEQ ID NO: 197787 - DNA, 25 bp, Mus musculus
agggaaggagccctcctactgtcca

SEQ ID NO: 197788 - DNA, 25 bp, Mus musculus
agggaaggagccgtcctactgtcca

SEQ ID NO: 197789 - DNA, 25 bp, Mus musculus
agggaaggaggcagccacccaccag

SEQ ID NO: 197790 - DNA, 25 bp, Mus musculus
agggaaggaggctgccacccaccag

SEQ ID NO: 197791 - DNA, 25 bp, Mus musculus
agggaaggattgcactcgtcctgtt

SEQ ID NO: 197792 - DNA, 25 bp, Mus musculus
agggaaggattggactcgtcctgtt

SEQ ID NO: 197793 - DNA, 25 bp, Mus musculus
agggaaggccctcctgaaacggctt

SEQ ID NO: 197794 - DNA, 25 bp, Mus musculus
agggaaggccctctatctgtagagt

SEQ ID NO: 197795 - DNA, 25 bp, Mus musculus
agggaaggccctctctgagcacaga

SEQ ID NO: 197796 - DNA, 25 bp, Mus musculus
agggaaggccctgctgaaacggctt

SEQ ID NO: 197797 - DNA, 25 bp, Mus musculus
agggaaggccctgtatctgtagagt

SEQ ID NO: 197798 - DNA, 25 bp, Mus musculus
agggaaggccctgtctgagcacaga

SEQ ID NO: 197799 - DNA, 25 bp, Mus musculus
agggaaggcttcagctgccacgtct

SEQ ID NO: 197800 - DNA, 25 bp, Mus musculus
agggaaggcttctgctgccacgtct

SEQ ID NO: 197801 - DNA, 25 bp, Mus musculus
agggaaggtatccacgcagctttct

SEQ ID NO: 197802 - DNA, 25 bp, Mus musculus
agggaaggtatcgacgcagctttct

SEQ ID NO: 197803 - DNA, 25 bp, Mus musculus
agggaaggtcacagagctccaccac

SEQ ID NO: 197804 - DNA, 25 bp, Mus musculus
agggaaggtcactgagctccaccac

SEQ ID NO: 197805 - DNA, 25 bp, Mus musculus
agggaaggttccatatagcatattg

SEQ ID NO: 197806 - DNA, 25 bp, Mus musculus
agggaaggttccttatagcatattg

SEQ ID NO: 197807 - DNA, 25 bp, Mus musculus
agggaagtagacacaccccaactcg

SEQ ID NO: 197808 - DNA, 25 bp, Mus musculus
agggaagtagactcaccccaactcg

SEQ ID NO: 197809 - DNA, 25 bp, Mus musculus
agggaagtgactctacacctgcctc

SEQ ID NO: 197810 - DNA, 25 bp, Mus musculus
agggaagtgactgtacacctgcctc

SEQ ID NO: 197811 - DNA, 25 bp, Mus musculus
agggaagttatcctctttgcagatt

SEQ ID NO: 197812 - DNA, 25 bp, Mus musculus
agggaagttatcgtctttgcagatt

SEQ ID NO: 197813 - DNA, 25 bp, Mus musculus
agggaagttccacctgttattctgt

SEQ ID NO: 197814 - DNA, 25 bp, Mus musculus
agggaagttccagctgttattctgt

SEQ ID NO: 197815 - DNA, 25 bp, Mus musculus
agggaagttctgatactcacctcct

SEQ ID NO: 197816 - DNA, 25 bp, Mus musculus
agggaagttctgttactcacctcct

SEQ ID NO: 197817 - DNA, 25 bp, Mus musculus
agggaagttgaactcctgtcttact

SEQ ID NO: 197818 - DNA, 25 bp, Mus musculus
agggaagttgaagtcctgtcttact

SEQ ID NO: 197819 - DNA, 25 bp, Mus musculus
agggaagttgctcactcttacgcgc

SEQ ID NO: 197820 - DNA, 25 bp, Mus musculus
agggaagttgctgactcttacgcgc

SEQ ID NO: 197821 - DNA, 25 bp, Mus musculus
agggaagttggcctcatctgccttc

SEQ ID NO: 197822 - DNA, 25 bp, Mus musculus
agggaagttggcgtcatctgccttc

SEQ ID NO: 197823 - DNA, 25 bp, Mus musculus
agggaagttgtgatttactagtagt

SEQ ID NO: 197824 - DNA, 25 bp, Mus musculus
agggaagttgtgttttactagtagt

SEQ ID NO: 197825 - DNA, 25 bp, Mus musculus
agggaataccacatttcaggctcac

SEQ ID NO: 197826 - DNA, 25 bp, Mus musculus
agggaataccacttttcaggctcac

SEQ ID NO: 197827 - DNA, 25 bp, Mus musculus
agggaatactgcagtctgggaatct

SEQ ID NO: 197828 - DNA, 25 bp, Mus musculus
agggaatactgctgtctgggaatct

SEQ ID NO: 197829 - DNA, 25 bp, Mus musculus
agggaatagactccttccctccatg

SEQ ID NO: 197830 - DNA, 25 bp, Mus musculus
agggaatagactgcttccctccatg

SEQ ID NO: 197831 - DNA, 25 bp, Mus musculus
agggaatagtgccaggacttctgtt

SEQ ID NO: 197832 - DNA, 25 bp, Mus musculus
agggaatagtgcgaggacttctgtt

SEQ ID NO: 197833 - DNA, 25 bp, Mus musculus
agggaatatctgatgagttttggta

SEQ ID NO: 197834 - DNA, 25 bp, Mus musculus
agggaatatctgttgagttttggta

SEQ ID NO: 197835 - DNA, 25 bp, Mus musculus
agggaatatgacaggccgtttgcaa

SEQ ID NO: 197836 - DNA, 25 bp, Mus musculus
agggaatatgactggccgtttgcaa

SEQ ID NO: 197837 - DNA, 25 bp, Mus musculus
agggaatatgcccaagctatgcctt

SEQ ID NO: 197838 - DNA, 25 bp, Mus musculus
agggaatatgccgaagctatgcctt

SEQ ID NO: 197839 - DNA, 25 bp, Mus musculus
agggaatatggcaccagggcctgca

SEQ ID NO: 197840 - DNA, 25 bp, Mus musculus
agggaatatggctccagggcctgca

SEQ ID NO: 197841 - DNA, 25 bp, Mus musculus
agggaatcacagatttgtggccatc

SEQ ID NO: 197842 - DNA, 25 bp, Mus musculus
agggaatcacagttttgtggccatc

SEQ ID NO: 197843 - DNA, 25 bp, Mus musculus
agggaatcattcactggctaccgtc

SEQ ID NO: 197844 - DNA, 25 bp, Mus musculus
agggaatcattctctggctaccgtc

SEQ ID NO: 197845 - DNA, 25 bp, Mus musculus
agggaatcccaaacaccagggactt

SEQ ID NO: 197846 - DNA, 25 bp, Mus musculus
agggaatcccaatcaccagggactt

SEQ ID NO: 197847 - DNA, 25 bp, Mus musculus
agggaatccccaaggtgtctctgca

SEQ ID NO: 197848 - DNA, 25 bp, Mus musculus
agggaatccccatggtgtctctgca

SEQ ID NO: 197849 - DNA, 25 bp, Mus musculus
agggaatcctctctactcatccttc

SEQ ID NO: 197850 - DNA, 25 bp, Mus musculus
agggaatcctctgtactcatccttc

SEQ ID NO: 197851 - DNA, 25 bp, Mus musculus
agggaatctaacctaggtcctctag

SEQ ID NO: 197852 - DNA, 25 bp, Mus musculus
agggaatctaacgtaggtcctctag

SEQ ID NO: 197853 - DNA, 25 bp, Mus musculus
agggaatctacgcacaacccagagc

SEQ ID NO: 197854 - DNA, 25 bp, Mus musculus
agggaatctacggacaacccagagc

SEQ ID NO: 197855 - DNA, 25 bp, Mus musculus
agggaatctcacacttctggtctga

SEQ ID NO: 197856 - DNA, 25 bp, Mus musculus
agggaatctcactcttctggtctga

SEQ ID NO: 197857 - DNA, 25 bp, Mus musculus
agggaatctcctcatccacagcttt

SEQ ID NO: 197858 - DNA, 25 bp, Mus musculus
agggaatctcctgatccacagcttt

SEQ ID NO: 197859 - DNA, 25 bp, Mus musculus
agggaatctgagactctcttttggc

SEQ ID NO: 197860 - DNA, 25 bp, Mus musculus
agggaatctgagtctctcttttggc

SEQ ID NO: 197861 - DNA, 25 bp, Mus musculus
agggaatctgccatctgacctccag

SEQ ID NO: 197862 - DNA, 25 bp, Mus musculus
agggaatctgccttctgacctccag

SEQ ID NO: 197863 - DNA, 25 bp, Mus musculus
agggaatctggcacaaagcctaaca

SEQ ID NO: 197864 - DNA, 25 bp, Mus musculus
agggaatctggctcaaagcctaaca

SEQ ID NO: 197865 - DNA, 25 bp, Mus musculus
agggaatgaagtccatgcaagcaca

SEQ ID NO: 197866 - DNA, 25 bp, Mus musculus
agggaatgaagtgcatgcaagcaca

SEQ ID NO: 197867 - DNA, 25 bp, Mus musculus
agggaatgagcacacctgccaagga

SEQ ID NO: 197868 - DNA, 25 bp, Mus musculus
agggaatgagcagacctgccaagga

SEQ ID NO: 197869 - DNA, 25 bp, Mus musculus
agggaatgcttcagcctgacagatc

SEQ ID NO: 197870 - DNA, 25 bp, Mus musculus
agggaatgcttcctatgaccctgct

SEQ ID NO: 197871 - DNA, 25 bp, Mus musculus
agggaatgcttcgtatgaccctgct

SEQ ID NO: 197872 - DNA, 25 bp, Mus musculus
agggaatgcttctgcctgacagatc

SEQ ID NO: 197873 - DNA, 25 bp, Mus musculus
agggaatggctcaatccctagctgc

SEQ ID NO: 197874 - DNA, 25 bp, Mus musculus
agggaatggctctatccctagctgc

SEQ ID NO: 197875 - DNA, 25 bp, Mus musculus
agggaatgggaaccgccaccaccag

SEQ ID NO: 197876 - DNA, 25 bp, Mus musculus
agggaatgggaagcgccaccaccag

SEQ ID NO: 197877 - DNA, 25 bp, Mus musculus
agggaatgtaccagacttgacagaa

SEQ ID NO: 197878 - DNA, 25 bp, Mus musculus
agggaatgtacctgacttgacagaa

SEQ ID NO: 197879 - DNA, 25 bp, Mus musculus
agggaatgtgctacagccttggaag

SEQ ID NO: 197880 - DNA, 25 bp, Mus musculus
agggaatgtgcttcagccttggaag

SEQ ID NO: 197881 - DNA, 25 bp, Mus musculus
agggaatgtggcagcctccggagca

SEQ ID NO: 197882 - DNA, 25 bp, Mus musculus
agggaatgtggctgcctccggagca

SEQ ID NO: 197883 - DNA, 25 bp, Mus musculus
agggaatgtgtcagtctcactgtcg

SEQ ID NO: 197884 - DNA, 25 bp, Mus musculus
agggaatgtgtctgtctcactgtcg

SEQ ID NO: 197885 - DNA, 25 bp, Mus musculus
agggaatgttgtcgtcgtgtggctt

SEQ ID NO: 197886 - DNA, 25 bp, Mus musculus
agggaatgttgtggtcgtgtggctt

SEQ ID NO: 197887 - DNA, 25 bp, Mus musculus
agggaatgtttcatgtgccattaac

SEQ ID NO: 197888 - DNA, 25 bp, Mus musculus
agggaatgtttcttgtgccattaac

SEQ ID NO: 197889 - DNA, 25 bp, Mus musculus
agggaattacatcctctcttgtcct

SEQ ID NO: 197890 - DNA, 25 bp, Mus musculus
agggaattacatgctctcttgtcct

SEQ ID NO: 197891 - DNA, 25 bp, Mus musculus
agggaattcgagatgggacttgctt

SEQ ID NO: 197892 - DNA, 25 bp, Mus musculus
agggaattcgagttgggacttgctt

SEQ ID NO: 197893 - DNA, 25 bp, Mus musculus
agggaattctgaagccacctcactt

SEQ ID NO: 197894 - DNA, 25 bp, Mus musculus
agggaattctgatgccacctcactt

SEQ ID NO: 197895 - DNA, 25 bp, Mus musculus
agggaatttcagacaacagcaggta

SEQ ID NO: 197896 - DNA, 25 bp, Mus musculus
agggaatttcagtcaacagcaggta

SEQ ID NO: 197897 - DNA, 25 bp, Mus musculus
agggaatttcatctagcacttggcc

SEQ ID NO: 197898 - DNA, 25 bp, Mus musculus
agggaatttcatgtagcacttggcc

SEQ ID NO: 197899 - DNA, 25 bp, Mus musculus
agggaatttctgcttcagccaccaa

SEQ ID NO: 197900 - DNA, 25 bp, Mus musculus
agggaatttctggttcagccaccaa

SEQ ID NO: 197901 - DNA, 25 bp, Mus musculus
agggaattttgtcttctgtctccat

SEQ ID NO: 197902 - DNA, 25 bp, Mus musculus
agggaattttgtgttctgtctccat

SEQ ID NO: 197903 - DNA, 25 bp, Mus musculus
agggacaaaagcacctctagaggat

SEQ ID NO: 197904 - DNA, 25 bp, Mus musculus
agggacaaaagctcctctagaggat

SEQ ID NO: 197905 - DNA, 25 bp, Mus musculus
agggacaaacctatcacattcactc

SEQ ID NO: 197906 - DNA, 25 bp, Mus musculus
agggacaaacctttcacattcactc

SEQ ID NO: 197907 - DNA, 25 bp, Mus musculus
agggacaaactgcagctgagcttct

SEQ ID NO: 197908 - DNA, 25 bp, Mus musculus
agggacaaactggagctgagcttct

SEQ ID NO: 197909 - DNA, 25 bp, Mus musculus
agggacaaatttctattatctgttt

SEQ ID NO: 197910 - DNA, 25 bp, Mus musculus
agggacaaatttgtattatctgttt

SEQ ID NO: 197911 - DNA, 25 bp, Mus musculus
agggacaacagacctcctccctact

SEQ ID NO: 197912 - DNA, 25 bp, Mus musculus
agggacaacagagctcctccctact

SEQ ID NO: 197913 - DNA, 25 bp, Mus musculus
agggacaactacagcagctttcggg

SEQ ID NO: 197914 - DNA, 25 bp, Mus musculus
agggacaactactgcagctttcggg

SEQ ID NO: 197915 - DNA, 25 bp, Mus musculus
agggacaaggccacttctccaagac

SEQ ID NO: 197916 - DNA, 25 bp, Mus musculus
agggacaaggcctcttctccaagac

SEQ ID NO: 197917 - DNA, 25 bp, Mus musculus
agggacaatgatccgtctttgttca

SEQ ID NO: 197918 - DNA, 25 bp, Mus musculus
agggacaatgatgcgtctttgttca

SEQ ID NO: 197919 - DNA, 25 bp, Mus musculus
agggacaatgttctgcatggccttc

SEQ ID NO: 197920 - DNA, 25 bp, Mus musculus
agggacaatgttgtgcatggccttc

SEQ ID NO: 197921 - DNA, 25 bp, Mus musculus
agggacaatttcagggacccagtgt

SEQ ID NO: 197922 - DNA, 25 bp, Mus musculus
agggacaatttctgggacccagtgt

SEQ ID NO: 197923 - DNA, 25 bp, Mus musculus
agggacacaaccattatccgaccag

SEQ ID NO: 197924 - DNA, 25 bp, Mus musculus
agggacacaacctttatccgaccag

SEQ ID NO: 197925 - DNA, 25 bp, Mus musculus
agggacacaactacatggcctttca

SEQ ID NO: 197926 - DNA, 25 bp, Mus musculus
agggacacaacttcatggcctttca

SEQ ID NO: 197927 - DNA, 25 bp, Mus musculus
agggacacacacatcatttaaaaca

SEQ ID NO: 197928 - DNA, 25 bp, Mus musculus
agggacacacacattcgttttattg

SEQ ID NO: 197929 - DNA, 25 bp, Mus musculus
agggacacacacttcatttaaaaca

SEQ ID NO: 197930 - DNA, 25 bp, Mus musculus
agggacacacactttcgttttattg

SEQ ID NO: 197931 - DNA, 25 bp, Mus musculus
agggacacagtcagcaccccagggc

SEQ ID NO: 197932 - DNA, 25 bp, Mus musculus
agggacacagtctgcaccccagggc

SEQ ID NO: 197933 - DNA, 25 bp, Mus musculus
agggacacatatcacgagctcttct

SEQ ID NO: 197934 - DNA, 25 bp, Mus musculus
agggacacatatgacgagctcttct

SEQ ID NO: 197935 - DNA, 25 bp, Mus musculus
agggacacccctctatcatagtgga

SEQ ID NO: 197936 - DNA, 25 bp, Mus musculus
agggacacccctgtatcatagtgga

SEQ ID NO: 197937 - DNA, 25 bp, Mus musculus
agggacacccttcacgtcctgcaag

SEQ ID NO: 197938 - DNA, 25 bp, Mus musculus
agggacacccttgacgtcctgcaag

SEQ ID NO: 197939 - DNA, 25 bp, Mus musculus
agggacaccgtcaatctttatacca

SEQ ID NO: 197940 - DNA, 25 bp, Mus musculus
agggacaccgtctatctttatacca

SEQ ID NO: 197941 - DNA, 25 bp, Mus musculus
agggacacctgtagggattccccat

SEQ ID NO: 197942 - DNA, 25 bp, Mus musculus
agggacacctgttgggattccccat

SEQ ID NO: 197943 - DNA, 25 bp, Mus musculus
agggacacctttcctgcactgggtc

SEQ ID NO: 197944 - DNA, 25 bp, Mus musculus
agggacacctttgctgcactgggtc

SEQ ID NO: 197945 - DNA, 25 bp, Mus musculus
agggacacgactcaccgtcctagag

SEQ ID NO: 197946 - DNA, 25 bp, Mus musculus
agggacacgactgaccgtcctagag

SEQ ID NO: 197947 - DNA, 25 bp, Mus musculus
agggacacgctacccttccttatga

SEQ ID NO: 197948 - DNA, 25 bp, Mus musculus
agggacacgctagccttccttatga

SEQ ID NO: 197949 - DNA, 25 bp, Mus musculus
agggacacggacaggaggccacctt

SEQ ID NO: 197950 - DNA, 25 bp, Mus musculus
agggacacggactggaggccacctt

SEQ ID NO: 197951 - DNA, 25 bp, Mus musculus
agggacactacccagatctgccagt

SEQ ID NO: 197952 - DNA, 25 bp, Mus musculus
agggacactaccgagatctgccagt

SEQ ID NO: 197953 - DNA, 25 bp, Mus musculus
agggacactgatacaggcagcctgc

SEQ ID NO: 197954 - DNA, 25 bp, Mus musculus
agggacactgattcaggcagcctgc

SEQ ID NO: 197955 - DNA, 25 bp, Mus musculus
agggacactgcacctgaatgagaaa

SEQ ID NO: 197956 - DNA, 25 bp, Mus musculus
agggacactgcagctgaatgagaaa

SEQ ID NO: 197957 - DNA, 25 bp, Mus musculus
agggacactggtcccacggctcctg

SEQ ID NO: 197958 - DNA, 25 bp, Mus musculus
agggacactggtgccacggctcctg

SEQ ID NO: 197959 - DNA, 25 bp, Mus musculus
agggacacttttctggccacttagt

SEQ ID NO: 197960 - DNA, 25 bp, Mus musculus
agggacacttttgtggccacttagt

SEQ ID NO: 197961 - DNA, 25 bp, Mus musculus
agggacagacaccttctgagcagga

SEQ ID NO: 197962 - DNA, 25 bp, Mus musculus
agggacagacacgttctgagcagga

SEQ ID NO: 197963 - DNA, 25 bp, Mus musculus
agggacagagcactcagccagccca

SEQ ID NO: 197964 - DNA, 25 bp, Mus musculus
agggacagagcagtcagccagccca

SEQ ID NO: 197965 - DNA, 25 bp, Mus musculus
agggacagagccacatgcctaagcg

SEQ ID NO: 197966 - DNA, 25 bp, Mus musculus
agggacagagcctcatgcctaagcg

SEQ ID NO: 197967 - DNA, 25 bp, Mus musculus
agggacagatcaaatttgggtctat

SEQ ID NO: 197968 - DNA, 25 bp, Mus musculus
agggacagatcatatttgggtctat

SEQ ID NO: 197969 - DNA, 25 bp, Mus musculus
agggacagcatcagtgcccttggac

SEQ ID NO: 197970 - DNA, 25 bp, Mus musculus
agggacagcatcatgctgttcagcc

SEQ ID NO: 197971 - DNA, 25 bp, Mus musculus
agggacagcatctgtgcccttggac

SEQ ID NO: 197972 - DNA, 25 bp, Mus musculus
agggacagcatcttgctgttcagcc

SEQ ID NO: 197973 - DNA, 25 bp, Mus musculus
agggacagccatacccactgatgta

SEQ ID NO: 197974 - DNA, 25 bp, Mus musculus
agggacagccattcccactgatgta

SEQ ID NO: 197975 - DNA, 25 bp, Mus musculus
agggacagctacatatgctcctcac

SEQ ID NO: 197976 - DNA, 25 bp, Mus musculus
agggacagctacatcacactgttta

SEQ ID NO: 197977 - DNA, 25 bp, Mus musculus
agggacagctacttatgctcctcac

SEQ ID NO: 197978 - DNA, 25 bp, Mus musculus
agggacagctacttcacactgttta

SEQ ID NO: 197979 - DNA, 25 bp, Mus musculus
agggacagctgacgtccactcgtga

SEQ ID NO: 197980 - DNA, 25 bp, Mus musculus
agggacagctgaggtccactcgtga

SEQ ID NO: 197981 - DNA, 25 bp, Mus musculus
agggacaggcggatgatataaccat

SEQ ID NO: 197982 - DNA, 25 bp, Mus musculus
agggacaggcggttgatataaccat

SEQ ID NO: 197983 - DNA, 25 bp, Mus musculus
agggacagggccactttggaattag

SEQ ID NO: 197984 - DNA, 25 bp, Mus musculus
agggacagggcctctttggaattag

SEQ ID NO: 197985 - DNA, 25 bp, Mus musculus
agggacagggtcagtctcacatcac

SEQ ID NO: 197986 - DNA, 25 bp, Mus musculus
agggacagggtctgtctcacatcac

SEQ ID NO: 197987 - DNA, 25 bp, Mus musculus
agggacaggtcccaccaacaggtgc

SEQ ID NO: 197988 - DNA, 25 bp, Mus musculus
agggacaggtccgaccaacaggtgc

SEQ ID NO: 197989 - DNA, 25 bp, Mus musculus
agggacaggtggctcatcaccgtca

SEQ ID NO: 197990 - DNA, 25 bp, Mus musculus
agggacaggtgggtcatcaccgtca

SEQ ID NO: 197991 - DNA, 25 bp, Mus musculus
agggacagtaatacacctgtagctt

SEQ ID NO: 197992 - DNA, 25 bp, Mus musculus
agggacagtaattcacctgtagctt

SEQ ID NO: 197993 - DNA, 25 bp, Mus musculus
agggacagtcaactccactccattt

SEQ ID NO: 197994 - DNA, 25 bp, Mus musculus
agggacagtcaagtccactccattt

SEQ ID NO: 197995 - DNA, 25 bp, Mus musculus
agggacagtgaacagccctgcagtc

SEQ ID NO: 197996 - DNA, 25 bp, Mus musculus
agggacagtgaagagccctgcagtc

SEQ ID NO: 197997 - DNA, 25 bp, Mus musculus
agggacagtgggaatctcgttcatc

SEQ ID NO: 197998 - DNA, 25 bp, Mus musculus
agggacagtgggtatctcgttcatc

SEQ ID NO: 197999 - DNA, 25 bp, Mus musculus
agggacagtgtcagacttctccagg

SEQ ID NO: 198000 - DNA, 25 bp, Mus musculus
agggacagtgtctgacttctccagg

SEQ ID NO: 198001 - DNA, 25 bp, Mus musculus
agggacagttcacatctgcagcctt

SEQ ID NO: 198002 - DNA, 25 bp, Mus musculus
agggacagttcagatctgcagcctt

SEQ ID NO: 198003 - DNA, 25 bp, Mus musculus
agggacagttttcacttcgccatca

SEQ ID NO: 198004 - DNA, 25 bp, Mus musculus
agggacagttttgacttcgccatca

SEQ ID NO: 198005 - DNA, 25 bp, Mus musculus
agggacatacagagttgccaaaaaa

SEQ ID NO: 198006 - DNA, 25 bp, Mus musculus
agggacatacagtgttgccaaaaaa

SEQ ID NO: 198007 - DNA, 25 bp, Mus musculus
agggacatagccactatcctgcaat

SEQ ID NO: 198008 - DNA, 25 bp, Mus musculus
agggacatagcctctatcctgcaat

SEQ ID NO: 198009 - DNA, 25 bp, Mus musculus
agggacatcagcaggcaatcatgaa

SEQ ID NO: 198010 - DNA, 25 bp, Mus musculus
agggacatcagctggcaatcatgaa

SEQ ID NO: 198011 - DNA, 25 bp, Mus musculus
agggacatcagtacgagacctgctc

SEQ ID NO: 198012 - DNA, 25 bp, Mus musculus
agggacatcagttcgagacctgctc

SEQ ID NO: 198013 - DNA, 25 bp, Mus musculus
agggacatccggaagcagacatgac

SEQ ID NO: 198014 - DNA, 25 bp, Mus musculus
agggacatccggtagcagacatgac

SEQ ID NO: 198015 - DNA, 25 bp, Mus musculus
agggacatcctgcagctttgtatct

SEQ ID NO: 198016 - DNA, 25 bp, Mus musculus
agggacatcctggagctttgtatct

SEQ ID NO: 198017 - DNA, 25 bp, Mus musculus
agggacatcttaagctgccttgaca

SEQ ID NO: 198018 - DNA, 25 bp, Mus musculus
agggacatcttatgctgccttgaca

SEQ ID NO: 198019 - DNA, 25 bp, Mus musculus
agggacatgaagactttccacatca

SEQ ID NO: 198020 - DNA, 25 bp, Mus musculus
agggacatgaagtctttccacatca

SEQ ID NO: 198021 - DNA, 25 bp, Mus musculus
agggacatgcacagaaaactctgag

SEQ ID NO: 198022 - DNA, 25 bp, Mus musculus
agggacatgcactgaaaactctgag

SEQ ID NO: 198023 - DNA, 25 bp, Mus musculus
agggacatgggcattccagaccctt

SEQ ID NO: 198024 - DNA, 25 bp, Mus musculus
agggacatgggctttccagaccctt

SEQ ID NO: 198025 - DNA, 25 bp, Mus musculus
agggacattaatctctgccatcgtg

SEQ ID NO: 198026 - DNA, 25 bp, Mus musculus
agggacattaatgtctgccatcgtg

SEQ ID NO: 198027 - DNA, 25 bp, Mus musculus
agggacattagcattctgtctgctc

SEQ ID NO: 198028 - DNA, 25 bp, Mus musculus
agggacattagctttctgtctgctc

SEQ ID NO: 198029 - DNA, 25 bp, Mus musculus
agggacattggtaattcatctgtaa

SEQ ID NO: 198030 - DNA, 25 bp, Mus musculus
agggacattggttattcatctgtaa

SEQ ID NO: 198031 - DNA, 25 bp, Mus musculus
agggacatttccagggatatatgca

SEQ ID NO: 198032 - DNA, 25 bp, Mus musculus
agggacatttcctgggatatatgca

SEQ ID NO: 198033 - DNA, 25 bp, Mus musculus
agggaccaaagaactttccttagat

SEQ ID NO: 198034 - DNA, 25 bp, Mus musculus
agggaccaaagatctttccttagat

SEQ ID NO: 198035 - DNA, 25 bp, Mus musculus
agggaccaagatacgaactcatgaa

SEQ ID NO: 198036 - DNA, 25 bp, Mus musculus
agggaccaagattcgaactcatgaa

SEQ ID NO: 198037 - DNA, 25 bp, Mus musculus
agggaccaagtgattgcttctccta

SEQ ID NO: 198038 - DNA, 25 bp, Mus musculus
agggaccaagtgtttgcttctccta

SEQ ID NO: 198039 - DNA, 25 bp, Mus musculus
agggaccaatccatacctggtggtg

SEQ ID NO: 198040 - DNA, 25 bp, Mus musculus
agggaccaatccttacctggtggtg

SEQ ID NO: 198041 - DNA, 25 bp, Mus musculus
agggaccacagcagggactccacat

SEQ ID NO: 198042 - DNA, 25 bp, Mus musculus
agggaccacagctgggactccacat

SEQ ID NO: 198043 - DNA, 25 bp, Mus musculus
agggaccaccatatctctgcccggg

SEQ ID NO: 198044 - DNA, 25 bp, Mus musculus
agggaccaccatttctctgcccggg

SEQ ID NO: 198045 - DNA, 25 bp, Mus musculus
agggaccacgatctttctgcactgg

SEQ ID NO: 198046 - DNA, 25 bp, Mus musculus
agggaccacgatgtttctgcactgg

SEQ ID NO: 198047 - DNA, 25 bp, Mus musculus
agggaccactctatctgaggacatg

SEQ ID NO: 198048 - DNA, 25 bp, Mus musculus
agggaccactctttctgaggacatg

SEQ ID NO: 198049 - DNA, 25 bp, Mus musculus
agggaccagactcgccgggctgacc

SEQ ID NO: 198050 - DNA, 25 bp, Mus musculus
agggaccagactggccgggctgacc

SEQ ID NO: 198051 - DNA, 25 bp, Mus musculus
agggaccagcctcgcaaaggtcttt

SEQ ID NO: 198052 - DNA, 25 bp, Mus musculus
agggaccagcctggcaaaggtcttt

SEQ ID NO: 198053 - DNA, 25 bp, Mus musculus
agggaccagcttcctccaaagagac

SEQ ID NO: 198054 - DNA, 25 bp, Mus musculus
agggaccagcttgctccaaagagac

SEQ ID NO: 198055 - DNA, 25 bp, Mus musculus
agggaccaggaacatgtttatatgg

SEQ ID NO: 198056 - DNA, 25 bp, Mus musculus
agggaccaggaagatgtttatatgg

SEQ ID NO: 198057 - DNA, 25 bp, Mus musculus
agggaccaggctcagtaaactatct

SEQ ID NO: 198058 - DNA, 25 bp, Mus musculus
agggaccaggctgagtaaactatct

SEQ ID NO: 198059 - DNA, 25 bp, Mus musculus
agggaccaggtccttcactaacagt

SEQ ID NO: 198060 - DNA, 25 bp, Mus musculus
agggaccaggtcgttcactaacagt

SEQ ID NO: 198061 - DNA, 25 bp, Mus musculus
agggaccagtcccagagcagctaca

SEQ ID NO: 198062 - DNA, 25 bp, Mus musculus
agggaccagtccgagagcagctaca

SEQ ID NO: 198063 - DNA, 25 bp, Mus musculus
agggaccattgcattgttacagatc

SEQ ID NO: 198064 - DNA, 25 bp, Mus musculus
agggaccattgctttgttacagatc

SEQ ID NO: 198065 - DNA, 25 bp, Mus musculus
agggaccattggagaagcaggctct

SEQ ID NO: 198066 - DNA, 25 bp, Mus musculus
agggaccattggtgaagcaggctct

SEQ ID NO: 198067 - DNA, 25 bp, Mus musculus
agggaccattgtattgtgtaagata

SEQ ID NO: 198068 - DNA, 25 bp, Mus musculus
agggaccattgttttgtgtaagata

SEQ ID NO: 198069 - DNA, 25 bp, Mus musculus
agggacccaaagcaatgctcttctt

SEQ ID NO: 198070 - DNA, 25 bp, Mus musculus
agggacccaaaggaatgctcttctt

SEQ ID NO: 198071 - DNA, 25 bp, Mus musculus
agggacccaaatccttcagacattt

SEQ ID NO: 198072 - DNA, 25 bp, Mus musculus
agggacccaaatgcttcagacattt

SEQ ID NO: 198073 - DNA, 25 bp, Mus musculus
agggacccaaggctctcagaccttg

SEQ ID NO: 198074 - DNA, 25 bp, Mus musculus
agggacccaagggtctcagaccttg

SEQ ID NO: 198075 - DNA, 25 bp, Mus musculus
agggacccagtgcagaatctccagc

SEQ ID NO: 198076 - DNA, 25 bp, Mus musculus
agggacccagtgctagcagcagcaa

SEQ ID NO: 198077 - DNA, 25 bp, Mus musculus
agggacccagtggagaatctccagc

SEQ ID NO: 198078 - DNA, 25 bp, Mus musculus
agggacccagtggtagcagcagcaa

SEQ ID NO: 198079 - DNA, 25 bp, Mus musculus
agggacccatctatgggccaagtgt

SEQ ID NO: 198080 - DNA, 25 bp, Mus musculus
agggacccatctttgggccaagtgt

SEQ ID NO: 198081 - DNA, 25 bp, Mus musculus
agggaccccaaaattgtctcagcga

SEQ ID NO: 198082 - DNA, 25 bp, Mus musculus
agggaccccaaatttgtctcagcga

SEQ ID NO: 198083 - DNA, 25 bp, Mus musculus
agggaccccagcacttcaggaaggg

SEQ ID NO: 198084 - DNA, 25 bp, Mus musculus
agggaccccagcagttttggagatg

SEQ ID NO: 198085 - DNA, 25 bp, Mus musculus
agggaccccagctcttcaggaaggg

SEQ ID NO: 198086 - DNA, 25 bp, Mus musculus
agggaccccagctgttttggagatg

SEQ ID NO: 198087 - DNA, 25 bp, Mus musculus
agggacccgattcgtgctggacaca

SEQ ID NO: 198088 - DNA, 25 bp, Mus musculus
agggacccgattggtgctggacaca

SEQ ID NO: 198089 - DNA, 25 bp, Mus musculus
agggacccggaaacaacacattgct

SEQ ID NO: 198090 - DNA, 25 bp, Mus musculus
agggacccggaatcaacacattgct

SEQ ID NO: 198091 - DNA, 25 bp, Mus musculus
agggacccggtgcacacagatgaca

SEQ ID NO: 198092 - DNA, 25 bp, Mus musculus
agggacccggtggacacagatgaca

SEQ ID NO: 198093 - DNA, 25 bp, Mus musculus
agggacccgttcaatgacatgttgg

SEQ ID NO: 198094 - DNA, 25 bp, Mus musculus
agggacccgttctatgacatgttgg

SEQ ID NO: 198095 - DNA, 25 bp, Mus musculus
agggaccctccgactgagatcgaaa

SEQ ID NO: 198096 - DNA, 25 bp, Mus musculus
agggaccctccgtctgagatcgaaa

SEQ ID NO: 198097 - DNA, 25 bp, Mus musculus
agggaccctgcacgagctatgccaa

SEQ ID NO: 198098 - DNA, 25 bp, Mus musculus
agggaccctgcaggagctatgccaa

SEQ ID NO: 198099 - DNA, 25 bp, Mus musculus
agggaccctgtcatacgatgctttt

SEQ ID NO: 198100 - DNA, 25 bp, Mus musculus
agggaccctgtcttacgatgctttt

SEQ ID NO: 198101 - DNA, 25 bp, Mus musculus
agggaccgcccaactcgagagcata

SEQ ID NO: 198102 - DNA, 25 bp, Mus musculus
agggaccgcccatctcgagagcata

SEQ ID NO: 198103 - DNA, 25 bp, Mus musculus
agggaccggacaatcactcagtgag

SEQ ID NO: 198104 - DNA, 25 bp, Mus musculus
agggaccggacattcactcagtgag

SEQ ID NO: 198105 - DNA, 25 bp, Mus musculus
agggacctacaccaggcggcctcag

SEQ ID NO: 198106 - DNA, 25 bp, Mus musculus
agggacctacacgaggcggcctcag

SEQ ID NO: 198107 - DNA, 25 bp, Mus musculus
agggacctagtcaggagcctgtctt

SEQ ID NO: 198108 - DNA, 25 bp, Mus musculus
agggacctagtctggagcctgtctt

SEQ ID NO: 198109 - DNA, 25 bp, Mus musculus
agggacctatagctctagccacatt

SEQ ID NO: 198110 - DNA, 25 bp, Mus musculus
agggacctataggtctagccacatt

SEQ ID NO: 198111 - DNA, 25 bp, Mus musculus
agggacctattcagtcactgtgggc

SEQ ID NO: 198112 - DNA, 25 bp, Mus musculus
agggacctattctgtcactgtgggc

SEQ ID NO: 198113 - DNA, 25 bp, Mus musculus
agggacctatttatgccagacagta

SEQ ID NO: 198114 - DNA, 25 bp, Mus musculus
agggacctatttttgccagacagta

SEQ ID NO: 198115 - DNA, 25 bp, Mus musculus
agggacctcagacccatgacttttt

SEQ ID NO: 198116 - DNA, 25 bp, Mus musculus
agggacctcagagccatgacttttt

SEQ ID NO: 198117 - DNA, 25 bp, Mus musculus
agggacctcattacaagactgttaa

SEQ ID NO: 198118 - DNA, 25 bp, Mus musculus
agggacctcatttcaagactgttaa

SEQ ID NO: 198119 - DNA, 25 bp, Mus musculus
agggacctccggagttctgagccaa

SEQ ID NO: 198120 - DNA, 25 bp, Mus musculus
agggacctccggtgttctgagccaa

SEQ ID NO: 198121 - DNA, 25 bp, Mus musculus
agggacctccttcacggaagaagtg

SEQ ID NO: 198122 - DNA, 25 bp, Mus musculus
agggacctccttccctgcagaagag

SEQ ID NO: 198123 - DNA, 25 bp, Mus musculus
agggacctccttgacggaagaagtg

SEQ ID NO: 198124 - DNA, 25 bp, Mus musculus
agggacctccttgcctgcagaagag

SEQ ID NO: 198125 - DNA, 25 bp, Mus musculus
agggacctctggattctgtgttgac

SEQ ID NO: 198126 - DNA, 25 bp, Mus musculus
agggacctctggtttctgtgttgac

SEQ ID NO: 198127 - DNA, 25 bp, Mus musculus
agggacctctgtccttttttcgcca

SEQ ID NO: 198128 - DNA, 25 bp, Mus musculus
agggacctctgtgcttttttcgcca

SEQ ID NO: 198129 - DNA, 25 bp, Mus musculus
agggacctgcctcaaagcctggagc

SEQ ID NO: 198130 - DNA, 25 bp, Mus musculus
agggacctgcctcattgacatctga

SEQ ID NO: 198131 - DNA, 25 bp, Mus musculus
agggacctgcctgaaagcctggagc

SEQ ID NO: 198132 - DNA, 25 bp, Mus musculus
agggacctgcctgattgacatctga

SEQ ID NO: 198133 - DNA, 25 bp, Mus musculus
agggacctggccatgaacatccaag

SEQ ID NO: 198134 - DNA, 25 bp, Mus musculus
agggacctggccttgaacatccaag

SEQ ID NO: 198135 - DNA, 25 bp, Mus musculus
agggacctgggacgctttaagacat

SEQ ID NO: 198136 - DNA, 25 bp, Mus musculus
agggacctgggaggctttaagacat

SEQ ID NO: 198137 - DNA, 25 bp, Mus musculus
agggacctgggcacggacagtatcc

SEQ ID NO: 198138 - DNA, 25 bp, Mus musculus
agggacctgggctcggacagtatcc

SEQ ID NO: 198139 - DNA, 25 bp, Mus musculus
agggacctgtgacactcggcctttg

SEQ ID NO: 198140 - DNA, 25 bp, Mus musculus
agggacctgtgacccagtgtcattc

SEQ ID NO: 198141 - DNA, 25 bp, Mus musculus
agggacctgtgactgggaacaccac

SEQ ID NO: 198142 - DNA, 25 bp, Mus musculus
agggacctgtgagactcggcctttg

SEQ ID NO: 198143 - DNA, 25 bp, Mus musculus
agggacctgtgagccagtgtcattc

SEQ ID NO: 198144 - DNA, 25 bp, Mus musculus
agggacctgtgagtgggaacaccac

SEQ ID NO: 198145 - DNA, 25 bp, Mus musculus
agggacctgtttctcgctgggacat

SEQ ID NO: 198146 - DNA, 25 bp, Mus musculus
agggacctgtttgtcgctgggacat

SEQ ID NO: 198147 - DNA, 25 bp, Mus musculus
agggaccttacaagtttgctacctc

SEQ ID NO: 198148 - DNA, 25 bp, Mus musculus
agggaccttacatgtttgctacctc

SEQ ID NO: 198149 - DNA, 25 bp, Mus musculus
agggaccttattctattggaacata

SEQ ID NO: 198150 - DNA, 25 bp, Mus musculus
agggaccttattgtattggaacata

SEQ ID NO: 198151 - DNA, 25 bp, Mus musculus
agggaccttcagaggtaagatttgt

SEQ ID NO: 198152 - DNA, 25 bp, Mus musculus
agggaccttcagtggtaagatttgt

SEQ ID NO: 198153 - DNA, 25 bp, Mus musculus
agggacctttccagacctatcagaa

SEQ ID NO: 198154 - DNA, 25 bp, Mus musculus
agggacctttcctgacctatcagaa

SEQ ID NO: 198155 - DNA, 25 bp, Mus musculus
agggacctttgacgcttggctcaga

SEQ ID NO: 198156 - DNA, 25 bp, Mus musculus
agggacctttgaggcttggctcaga

SEQ ID NO: 198157 - DNA, 25 bp, Mus musculus
agggacgactgccctcataagctct

SEQ ID NO: 198158 - DNA, 25 bp, Mus musculus
agggacgactgcgctcataagctct

SEQ ID NO: 198159 - DNA, 25 bp, Mus musculus
agggacgagtgtcctgtctgtcctt

SEQ ID NO: 198160 - DNA, 25 bp, Mus musculus
agggacgagtgtgctgtctgtcctt

SEQ ID NO: 198161 - DNA, 25 bp, Mus musculus
agggacgatcacactcccagcttca

SEQ ID NO: 198162 - DNA, 25 bp, Mus musculus
agggacgatcactctcccagcttca

SEQ ID NO: 198163 - DNA, 25 bp, Mus musculus
agggacgcatcgatgatggccatga

SEQ ID NO: 198164 - DNA, 25 bp, Mus musculus
agggacgcatcgttgatggccatga

SEQ ID NO: 198165 - DNA, 25 bp, Mus musculus
agggacgccgaccataaatttgagt

SEQ ID NO: 198166 - DNA, 25 bp, Mus musculus
agggacgccgacgataaatttgagt

SEQ ID NO: 198167 - DNA, 25 bp, Mus musculus
agggacgccgctccaggtgattctt

SEQ ID NO: 198168 - DNA, 25 bp, Mus musculus
agggacgccgctgcaggtgattctt

SEQ ID NO: 198169 - DNA, 25 bp, Mus musculus
agggacgctgcaatgacttttaagt

SEQ ID NO: 198170 - DNA, 25 bp, Mus musculus
agggacgctgcattgacttttaagt

SEQ ID NO: 198171 - DNA, 25 bp, Mus musculus
agggacgctgtcacaaactttgttg

SEQ ID NO: 198172 - DNA, 25 bp, Mus musculus
agggacgctgtctcaaactttgttg

SEQ ID NO: 198173 - DNA, 25 bp, Mus musculus
agggacggctgaacagacttcctgc

SEQ ID NO: 198174 - DNA, 25 bp, Mus musculus
agggacggctgatcagacttcctgc

SEQ ID NO: 198175 - DNA, 25 bp, Mus musculus
agggacggctggaggctttcacttc

SEQ ID NO: 198176 - DNA, 25 bp, Mus musculus
agggacggctggtggctttcacttc

SEQ ID NO: 198177 - DNA, 25 bp, Mus musculus
agggacggtctacaaactgccattt

SEQ ID NO: 198178 - DNA, 25 bp, Mus musculus
agggacggtctagaaactgccattt

SEQ ID NO: 198179 - DNA, 25 bp, Mus musculus
agggacgtgcaaactttgccagcgg

SEQ ID NO: 198180 - DNA, 25 bp, Mus musculus
agggacgtgcaatctttgccagcgg

SEQ ID NO: 198181 - DNA, 25 bp, Mus musculus
agggacgtgtcgcagcttctcaagc

SEQ ID NO: 198182 - DNA, 25 bp, Mus musculus
agggacgtgtcggagcttctcaagc

SEQ ID NO: 198183 - DNA, 25 bp, Mus musculus
agggacgttcagacggagctgatat

SEQ ID NO: 198184 - DNA, 25 bp, Mus musculus
agggacgttcagtcggagctgatat

SEQ ID NO: 198185 - DNA, 25 bp, Mus musculus
agggactacacccttcttgaagatg

SEQ ID NO: 198186 - DNA, 25 bp, Mus musculus
agggactacaccgttcttgaagatg

SEQ ID NO: 198187 - DNA, 25 bp, Mus musculus
agggactactcactgagaccaggaa

SEQ ID NO: 198188 - DNA, 25 bp, Mus musculus
agggactactcagtgagaccaggaa

SEQ ID NO: 198189 - DNA, 25 bp, Mus musculus
agggactataggaacgacgtatggt

SEQ ID NO: 198190 - DNA, 25 bp, Mus musculus
agggactataggtacgacgtatggt

SEQ ID NO: 198191 - DNA, 25 bp, Mus musculus
agggactatgagacccactcagtgg

SEQ ID NO: 198192 - DNA, 25 bp, Mus musculus
agggactatgagtcccactcagtgg

SEQ ID NO: 198193 - DNA, 25 bp, Mus musculus
agggactccaggcattaacaatgac

SEQ ID NO: 198194 - DNA, 25 bp, Mus musculus
agggactccagggattaacaatgac

SEQ ID NO: 198195 - DNA, 25 bp, Mus musculus
agggactcccagaatctcctgagag

SEQ ID NO: 198196 - DNA, 25 bp, Mus musculus
agggactcccagtatctcctgagag

SEQ ID NO: 198197 - DNA, 25 bp, Mus musculus
agggactcccatacacattatctct

SEQ ID NO: 198198 - DNA, 25 bp, Mus musculus
agggactcccattcacattatctct

SEQ ID NO: 198199 - DNA, 25 bp, Mus musculus
agggactcccgacattggcagctgc

SEQ ID NO: 198200 - DNA, 25 bp, Mus musculus
agggactcccgagattggcagctgc

SEQ ID NO: 198201 - DNA, 25 bp, Mus musculus
agggactcctagacgtgtttcaagc

SEQ ID NO: 198202 - DNA, 25 bp, Mus musculus
agggactcctagtcgtgtttcaagc

SEQ ID NO: 198203 - DNA, 25 bp, Mus musculus
agggactcctcacctccaggagggt

SEQ ID NO: 198204 - DNA, 25 bp, Mus musculus
agggactcctcagctccaggagggt

SEQ ID NO: 198205 - DNA, 25 bp, Mus musculus
agggactcctggaactatcttggga

SEQ ID NO: 198206 - DNA, 25 bp, Mus musculus
agggactcctggtactatcttggga

SEQ ID NO: 198207 - DNA, 25 bp, Mus musculus
agggactcctgtcatctggtactct

SEQ ID NO: 198208 - DNA, 25 bp, Mus musculus
agggactcctgtgatctggtactct

SEQ ID NO: 198209 - DNA, 25 bp, Mus musculus
agggactccttgcaatggtttctgt

SEQ ID NO: 198210 - DNA, 25 bp, Mus musculus
agggactccttggaatggtttctgt

SEQ ID NO: 198211 - DNA, 25 bp, Mus musculus
agggactcggagatcatgcagcaga

SEQ ID NO: 198212 - DNA, 25 bp, Mus musculus
agggactcggagttcatgcagcaga

SEQ ID NO: 198213 - DNA, 25 bp, Mus musculus
agggactcgggcatagctcttgtat

SEQ ID NO: 198214 - DNA, 25 bp, Mus musculus
agggactcgggcttagctcttgtat

SEQ ID NO: 198215 - DNA, 25 bp, Mus musculus
agggactctacacccaggagaaccc

SEQ ID NO: 198216 - DNA, 25 bp, Mus musculus
agggactctacagccaggagaaccc

SEQ ID NO: 198217 - DNA, 25 bp, Mus musculus
agggactctgaactatctggcttct

SEQ ID NO: 198218 - DNA, 25 bp, Mus musculus
agggactctgaagtatctggcttct

SEQ ID NO: 198219 - DNA, 25 bp, Mus musculus
agggactctggcagttatatctcat

SEQ ID NO: 198220 - DNA, 25 bp, Mus musculus
agggactctggctgttatatctcat

SEQ ID NO: 198221 - DNA, 25 bp, Mus musculus
agggactctgtacctcaccaaggtt

SEQ ID NO: 198222 - DNA, 25 bp, Mus musculus
agggactctgtagctcaccaaggtt

SEQ ID NO: 198223 - DNA, 25 bp, Mus musculus
agggactctgtgaaatgtgcctttt

SEQ ID NO: 198224 - DNA, 25 bp, Mus musculus
agggactctgtgtaatgtgcctttt

SEQ ID NO: 198225 - DNA, 25 bp, Mus musculus
agggactcttggcaactggtaatgc

SEQ ID NO: 198226 - DNA, 25 bp, Mus musculus
agggactcttgggaactggtaatgc

SEQ ID NO: 198227 - DNA, 25 bp, Mus musculus
agggactctttgactcagaaactac

SEQ ID NO: 198228 - DNA, 25 bp, Mus musculus
agggactctttgtctcagaaactac

SEQ ID NO: 198229 - DNA, 25 bp, Mus musculus
agggactgatgtacccctacatctt

SEQ ID NO: 198230 - DNA, 25 bp, Mus musculus
agggactgatgttcccctacatctt

SEQ ID NO: 198231 - DNA, 25 bp, Mus musculus
agggactgccaccttacagctggtt

SEQ ID NO: 198232 - DNA, 25 bp, Mus musculus
agggactgccacgttacagctggtt

SEQ ID NO: 198233 - DNA, 25 bp, Mus musculus
agggactgcctcactgagtatggct

SEQ ID NO: 198234 - DNA, 25 bp, Mus musculus
agggactgcctctctgagtatggct

SEQ ID NO: 198235 - DNA, 25 bp, Mus musculus
agggactgctggagagttcaactat

SEQ ID NO: 198236 - DNA, 25 bp, Mus musculus
agggactgctggtgagttcaactat

SEQ ID NO: 198237 - DNA, 25 bp, Mus musculus
agggactggacaacattcccgatcc

SEQ ID NO: 198238 - DNA, 25 bp, Mus musculus
agggactggacatcattcccgatcc

SEQ ID NO: 198239 - DNA, 25 bp, Mus musculus
agggactggactacaactttgagcc

SEQ ID NO: 198240 - DNA, 25 bp, Mus musculus
agggactggacttcaactttgagcc

SEQ ID NO: 198241 - DNA, 25 bp, Mus musculus
agggactggcagagtatgcttctcc

SEQ ID NO: 198242 - DNA, 25 bp, Mus musculus
agggactggcagtgtatgcttctcc

SEQ ID NO: 198243 - DNA, 25 bp, Mus musculus
agggactggcgcaccagagccccag

SEQ ID NO: 198244 - DNA, 25 bp, Mus musculus
agggactggcgctccagagccccag

SEQ ID NO: 198245 - DNA, 25 bp, Mus musculus
agggactggctcattgccccaggca

SEQ ID NO: 198246 - DNA, 25 bp, Mus musculus
agggactggctctttgccccaggca

SEQ ID NO: 198247 - DNA, 25 bp, Mus musculus
agggactgggccagccgtccatgca

SEQ ID NO: 198248 - DNA, 25 bp, Mus musculus
agggactgggcctgccgtccatgca

SEQ ID NO: 198249 - DNA, 25 bp, Mus musculus
agggactgggtaaatggatcatgac

SEQ ID NO: 198250 - DNA, 25 bp, Mus musculus
agggactgggtatatggatcatgac

SEQ ID NO: 198251 - DNA, 25 bp, Mus musculus
agggactgtcaaagtgtcatatcaa

SEQ ID NO: 198252 - DNA, 25 bp, Mus musculus
agggactgtcaatgtgtcatatcaa

SEQ ID NO: 198253 - DNA, 25 bp, Mus musculus
agggactgtcctctcgtgagtgtac

SEQ ID NO: 198254 - DNA, 25 bp, Mus musculus
agggactgtcctgtcgtgagtgtac

SEQ ID NO: 198255 - DNA, 25 bp, Mus musculus
agggactgtcttagagatcactctc

SEQ ID NO: 198256 - DNA, 25 bp, Mus musculus
agggactgtctttgagatcactctc

SEQ ID NO: 198257 - DNA, 25 bp, Mus musculus
agggactgtgatcctattagcttgt

SEQ ID NO: 198258 - DNA, 25 bp, Mus musculus
agggactgtgatgctattagcttgt

SEQ ID NO: 198259 - DNA, 25 bp, Mus musculus
agggactgtgttcgctacgcatcga

SEQ ID NO: 198260 - DNA, 25 bp, Mus musculus
agggactgtgttggctacgcatcga

SEQ ID NO: 198261 - DNA, 25 bp, Mus musculus
agggactgttatcgccacattctat

SEQ ID NO: 198262 - DNA, 25 bp, Mus musculus
agggactgttatggccacattctat

SEQ ID NO: 198263 - DNA, 25 bp, Mus musculus
agggactgttggcagacccttctga

SEQ ID NO: 198264 - DNA, 25 bp, Mus musculus
agggactgttgggagacccttctga

SEQ ID NO: 198265 - DNA, 25 bp, Mus musculus
agggacttacggcttgatgaaacaa

SEQ ID NO: 198266 - DNA, 25 bp, Mus musculus
agggacttacgggttgatgaaacaa

SEQ ID NO: 198267 - DNA, 25 bp, Mus musculus
agggacttacttccaggatacggaa

SEQ ID NO: 198268 - DNA, 25 bp, Mus musculus
agggacttacttgcaggatacggaa

SEQ ID NO: 198269 - DNA, 25 bp, Mus musculus
agggacttagacctggtcactgctc

SEQ ID NO: 198270 - DNA, 25 bp, Mus musculus
agggacttagacgtggtcactgctc

SEQ ID NO: 198271 - DNA, 25 bp, Mus musculus
agggacttagccctctgcctggatc

SEQ ID NO: 198272 - DNA, 25 bp, Mus musculus
agggacttagccgtctgcctggatc

SEQ ID NO: 198273 - DNA, 25 bp, Mus musculus
agggacttcaacactgcagctctga

SEQ ID NO: 198274 - DNA, 25 bp, Mus musculus
agggacttcaactctgcagctctga

SEQ ID NO: 198275 - DNA, 25 bp, Mus musculus
agggacttcaatacgatgttggcaa

SEQ ID NO: 198276 - DNA, 25 bp, Mus musculus
agggacttcaattcgatgttggcaa

SEQ ID NO: 198277 - DNA, 25 bp, Mus musculus
agggacttcaccaagccacaggatg

SEQ ID NO: 198278 - DNA, 25 bp, Mus musculus
agggacttcacctagccacaggatg

SEQ ID NO: 198279 - DNA, 25 bp, Mus musculus
agggacttcattcctactaatcgcc

SEQ ID NO: 198280 - DNA, 25 bp, Mus musculus
agggacttcattgctactaatcgcc

SEQ ID NO: 198281 - DNA, 25 bp, Mus musculus
agggacttcttgatggctaaccaat

SEQ ID NO: 198282 - DNA, 25 bp, Mus musculus
agggacttcttgttggctaaccaat

SEQ ID NO: 198283 - DNA, 25 bp, Mus musculus
agggacttgcagactcaagcctaca

SEQ ID NO: 198284 - DNA, 25 bp, Mus musculus
agggacttgcagtctcaagcctaca

SEQ ID NO: 198285 - DNA, 25 bp, Mus musculus
agggacttggaacctgcagccctct

SEQ ID NO: 198286 - DNA, 25 bp, Mus musculus
agggacttggaagctgcagccctct

SEQ ID NO: 198287 - DNA, 25 bp, Mus musculus
agggactttgaaacgctgtatttca

SEQ ID NO: 198288 - DNA, 25 bp, Mus musculus
agggactttgaatcgctgtatttca

SEQ ID NO: 198289 - DNA, 25 bp, Mus musculus
agggacttttctcgccattgggcag

SEQ ID NO: 198290 - DNA, 25 bp, Mus musculus
agggacttttctggccattgggcag

SEQ ID NO: 198291 - DNA, 25 bp, Mus musculus
agggagaaacccacgactgtcctgt

SEQ ID NO: 198292 - DNA, 25 bp, Mus musculus
agggagaaaccctcgactgtcctgt

SEQ ID NO: 198293 - DNA, 25 bp, Mus musculus
agggagaaagttactcatctgcaga

SEQ ID NO: 198294 - DNA, 25 bp, Mus musculus
agggagaaagtttctcatctgcaga

SEQ ID NO: 198295 - DNA, 25 bp, Mus musculus
agggagaaatgacctttgattggag

SEQ ID NO: 198296 - DNA, 25 bp, Mus musculus
agggagaaatgagctttgattggag

SEQ ID NO: 198297 - DNA, 25 bp, Mus musculus
agggagaaccccaggagattgacta

SEQ ID NO: 198298 - DNA, 25 bp, Mus musculus
agggagaacccctggagattgacta

SEQ ID NO: 198299 - DNA, 25 bp, Mus musculus
agggagaacctcactttagccaaat

SEQ ID NO: 198300 - DNA, 25 bp, Mus musculus
agggagaacctctctttagccaaat

SEQ ID NO: 198301 - DNA, 25 bp, Mus musculus
agggagaacgttcagcttctctgtg

SEQ ID NO: 198302 - DNA, 25 bp, Mus musculus
agggagaacgttgagcttctctgtg

SEQ ID NO: 198303 - DNA, 25 bp, Mus musculus
agggagaactcaactcttctcttct

SEQ ID NO: 198304 - DNA, 25 bp, Mus musculus
agggagaactcatctcttctcttct

SEQ ID NO: 198305 - DNA, 25 bp, Mus musculus
agggagaagagtagaccgctacttg

SEQ ID NO: 198306 - DNA, 25 bp, Mus musculus
agggagaagagttgaccgctacttg

SEQ ID NO: 198307 - DNA, 25 bp, Mus musculus
agggagaaggtccttgccacccgca

SEQ ID NO: 198308 - DNA, 25 bp, Mus musculus
agggagaaggtcgttgccacccgca

SEQ ID NO: 198309 - DNA, 25 bp, Mus musculus
agggagaatgccacgcagctatcag

SEQ ID NO: 198310 - DNA, 25 bp, Mus musculus
agggagaatgcctcgcagctatcag

SEQ ID NO: 198311 - DNA, 25 bp, Mus musculus
agggagaattacactgaccattgct

SEQ ID NO: 198312 - DNA, 25 bp, Mus musculus
agggagaattactctgaccattgct

SEQ ID NO: 198313 - DNA, 25 bp, Mus musculus
agggagacaagtacacaccttgact

SEQ ID NO: 198314 - DNA, 25 bp, Mus musculus
agggagacaagttcacaccttgact

SEQ ID NO: 198315 - DNA, 25 bp, Mus musculus
agggagacacatctgacacctgcag

SEQ ID NO: 198316 - DNA, 25 bp, Mus musculus
agggagacacatgtgacacctgcag

SEQ ID NO: 198317 - DNA, 25 bp, Mus musculus
agggagacagatcttgcccaagaag

SEQ ID NO: 198318 - DNA, 25 bp, Mus musculus
agggagacagatgttgcccaagaag

SEQ ID NO: 198319 - DNA, 25 bp, Mus musculus
agggagacaggcatctgccctgtgc

SEQ ID NO: 198320 - DNA, 25 bp, Mus musculus
agggagacaggcttctgccctgtgc

SEQ ID NO: 198321 - DNA, 25 bp, Mus musculus
agggagacatggcatcccttttctc

SEQ ID NO: 198322 - DNA, 25 bp, Mus musculus
agggagacatgggatcccttttctc

SEQ ID NO: 198323 - DNA, 25 bp, Mus musculus
agggagaccaacactttcccagaat

SEQ ID NO: 198324 - DNA, 25 bp, Mus musculus
agggagaccaactctttcccagaat

SEQ ID NO: 198325 - DNA, 25 bp, Mus musculus
agggagaccaagcacatgagcacta

SEQ ID NO: 198326 - DNA, 25 bp, Mus musculus
agggagaccaaggacatgagcacta

SEQ ID NO: 198327 - DNA, 25 bp, Mus musculus
agggagaccagaccctgaaacctgc

SEQ ID NO: 198328 - DNA, 25 bp, Mus musculus
agggagaccagagcctgaaacctgc

SEQ ID NO: 198329 - DNA, 25 bp, Mus musculus
agggagaccagcacacaagggcctc

SEQ ID NO: 198330 - DNA, 25 bp, Mus musculus
agggagaccagctcacaagggcctc

SEQ ID NO: 198331 - DNA, 25 bp, Mus musculus
agggagacgcgactggcggctccag

SEQ ID NO: 198332 - DNA, 25 bp, Mus musculus
agggagacgcgagtggcggctccag

SEQ ID NO: 198333 - DNA, 25 bp, Mus musculus
agggagactgtcagggtcaccagct

SEQ ID NO: 198334 - DNA, 25 bp, Mus musculus
agggagactgtctgggtcaccagct

SEQ ID NO: 198335 - DNA, 25 bp, Mus musculus
agggagagactgattcactgtggaa

SEQ ID NO: 198336 - DNA, 25 bp, Mus musculus
agggagagactgtttcactgtggaa

SEQ ID NO: 198337 - DNA, 25 bp, Mus musculus
agggagagatctccgtcagctgtat

SEQ ID NO: 198338 - DNA, 25 bp, Mus musculus
agggagagatctgcgtcagctgtat

SEQ ID NO: 198339 - DNA, 25 bp, Mus musculus
agggagagccacctggtactttcgt

SEQ ID NO: 198340 - DNA, 25 bp, Mus musculus
agggagagccacgtggtactttcgt

SEQ ID NO: 198341 - DNA, 25 bp, Mus musculus
agggagagccctccatctccatttg

SEQ ID NO: 198342 - DNA, 25 bp, Mus musculus
agggagagccctgcatctccatttg

SEQ ID NO: 198343 - DNA, 25 bp, Mus musculus
agggagagctccaggcaaagatcaa

SEQ ID NO: 198344 - DNA, 25 bp, Mus musculus
agggagagctcctggcaaagatcaa

SEQ ID NO: 198345 - DNA, 25 bp, Mus musculus
agggagaggggaagctattctttta

SEQ ID NO: 198346 - DNA, 25 bp, Mus musculus
agggagaggggatgctattctttta

SEQ ID NO: 198347 - DNA, 25 bp, Mus musculus
agggagaggtctacacctgccatgt

SEQ ID NO: 198348 - DNA, 25 bp, Mus musculus
agggagaggtcttcacctgccatgt

SEQ ID NO: 198349 - DNA, 25 bp, Mus musculus
agggagagttctagggacaccgtct

SEQ ID NO: 198350 - DNA, 25 bp, Mus musculus
agggagagttcttgggacaccgtct

SEQ ID NO: 198351 - DNA, 25 bp, Mus musculus
agggagatcaacagctgcctagttt

SEQ ID NO: 198352 - DNA, 25 bp, Mus musculus
agggagatcaactgctgcctagttt

SEQ ID NO: 198353 - DNA, 25 bp, Mus musculus
agggagatggcaattgctactgagc

SEQ ID NO: 198354 - DNA, 25 bp, Mus musculus
agggagatggcatttgctactgagc

SEQ ID NO: 198355 - DNA, 25 bp, Mus musculus
agggagatggccataagtgctactc

SEQ ID NO: 198356 - DNA, 25 bp, Mus musculus
agggagatggccttaagtgctactc

SEQ ID NO: 198357 - DNA, 25 bp, Mus musculus
agggagatgtccacttttgcttctg

SEQ ID NO: 198358 - DNA, 25 bp, Mus musculus
agggagatgtcctcttttgcttctg

SEQ ID NO: 198359 - DNA, 25 bp, Mus musculus
agggagatgtcgaccaagaccatcc

SEQ ID NO: 198360 - DNA, 25 bp, Mus musculus
agggagatgtcgtccaagaccatcc

SEQ ID NO: 198361 - DNA, 25 bp, Mus musculus
agggagattagcaccccactattgc

SEQ ID NO: 198362 - DNA, 25 bp, Mus musculus
agggagattagccagaaacttgact

SEQ ID NO: 198363 - DNA, 25 bp, Mus musculus
agggagattagcgagaaacttgact

SEQ ID NO: 198364 - DNA, 25 bp, Mus musculus
agggagattagctccccactattgc

SEQ ID NO: 198365 - DNA, 25 bp, Mus musculus
agggagattcctcaggtcaacctct

SEQ ID NO: 198366 - DNA, 25 bp, Mus musculus
agggagattcctgaggtcaacctct

SEQ ID NO: 198367 - DNA, 25 bp, Mus musculus
agggagatttaaaccctgatcccat

SEQ ID NO: 198368 - DNA, 25 bp, Mus musculus
agggagatttaatccctgatcccat

SEQ ID NO: 198369 - DNA, 25 bp, Mus musculus
agggagcacaatcgctgtgtagtta

SEQ ID NO: 198370 - DNA, 25 bp, Mus musculus
agggagcacaatggctgtgtagtta

SEQ ID NO: 198371 - DNA, 25 bp, Mus musculus
agggagcaccccaatggtagatatt

SEQ ID NO: 198372 - DNA, 25 bp, Mus musculus
agggagcacccctatggtagatatt

SEQ ID NO: 198373 - DNA, 25 bp, Mus musculus
agggagcacccgcagcggtacttca

SEQ ID NO: 198374 - DNA, 25 bp, Mus musculus
agggagcacccggagcggtacttca

SEQ ID NO: 198375 - DNA, 25 bp, Mus musculus
agggagcagcttatcgtcaatactt

SEQ ID NO: 198376 - DNA, 25 bp, Mus musculus
agggagcagcttttcgtcaatactt

SEQ ID NO: 198377 - DNA, 25 bp, Mus musculus
agggagcaggcaaacgaagacactt

SEQ ID NO: 198378 - DNA, 25 bp, Mus musculus
agggagcaggcatacgaagacactt

SEQ ID NO: 198379 - DNA, 25 bp, Mus musculus
agggagcatcaactacccaagttcc

SEQ ID NO: 198380 - DNA, 25 bp, Mus musculus
agggagcatcaagtacccaagttcc

SEQ ID NO: 198381 - DNA, 25 bp, Mus musculus
agggagcatcttcccaagcgggcca

SEQ ID NO: 198382 - DNA, 25 bp, Mus musculus
agggagcatcttgccaagcgggcca

SEQ ID NO: 198383 - DNA, 25 bp, Mus musculus
agggagcatgacagcttttctcctc

SEQ ID NO: 198384 - DNA, 25 bp, Mus musculus
agggagcatgactgcttttctcctc

SEQ ID NO: 198385 - DNA, 25 bp, Mus musculus
agggagcattagctcacaaggtcat

SEQ ID NO: 198386 - DNA, 25 bp, Mus musculus
agggagcattaggtcacaaggtcat

SEQ ID NO: 198387 - DNA, 25 bp, Mus musculus
agggagccacagaaaacattgcaac

SEQ ID NO: 198388 - DNA, 25 bp, Mus musculus
agggagccacagtaaacattgcaac

SEQ ID NO: 198389 - DNA, 25 bp, Mus musculus
agggagccagcaccctgtgtcttct

SEQ ID NO: 198390 - DNA, 25 bp, Mus musculus
agggagccagcagcctgtgtcttct

SEQ ID NO: 198391 - DNA, 25 bp, Mus musculus
agggagccagcccaagcaacttggt

SEQ ID NO: 198392 - DNA, 25 bp, Mus musculus
agggagccagccgaagcaacttggt

SEQ ID NO: 198393 - DNA, 25 bp, Mus musculus
agggagccaggcactgccgtccaaa

SEQ ID NO: 198394 - DNA, 25 bp, Mus musculus
agggagccaggctctgccgtccaaa

SEQ ID NO: 198395 - DNA, 25 bp, Mus musculus
agggagcccaagcatcgcccctgta

SEQ ID NO: 198396 - DNA, 25 bp, Mus musculus
agggagcccaaggatcgcccctgta

SEQ ID NO: 198397 - DNA, 25 bp, Mus musculus
agggagcccaggctcaattctcagc

SEQ ID NO: 198398 - DNA, 25 bp, Mus musculus
agggagcccagggtcaattctcagc

SEQ ID NO: 198399 - DNA, 25 bp, Mus musculus
agggagccctctcaaagagccacag

SEQ ID NO: 198400 - DNA, 25 bp, Mus musculus
agggagccctctgaaagagccacag

SEQ ID NO: 198401 - DNA, 25 bp, Mus musculus
agggagccctggcagaatgcggcct

SEQ ID NO: 198402 - DNA, 25 bp, Mus musculus
agggagccctgggagaatgcggcct

SEQ ID NO: 198403 - DNA, 25 bp, Mus musculus
agggagcctcagacctttgaggcat

SEQ ID NO: 198404 - DNA, 25 bp, Mus musculus
agggagcctcagtcctttgaggcat

SEQ ID NO: 198405 - DNA, 25 bp, Mus musculus
agggagcctgctccttgcacaagtt

SEQ ID NO: 198406 - DNA, 25 bp, Mus musculus
agggagcctgctgcttgcacaagtt

SEQ ID NO: 198407 - DNA, 25 bp, Mus musculus
agggagcgcgtgctgctggatatcc

SEQ ID NO: 198408 - DNA, 25 bp, Mus musculus
agggagcgcgtggtgctggatatcc

SEQ ID NO: 198409 - DNA, 25 bp, Mus musculus
agggagcgctaaagtcagctgtcaa

SEQ ID NO: 198410 - DNA, 25 bp, Mus musculus
agggagcgctaatgtcagctgtcaa

SEQ ID NO: 198411 - DNA, 25 bp, Mus musculus
agggagcggctcctggactcacaac

SEQ ID NO: 198412 - DNA, 25 bp, Mus musculus
agggagcggctcgtggactcacaac

SEQ ID NO: 198413 - DNA, 25 bp, Mus musculus
agggagctcccgagttgaatttatt

SEQ ID NO: 198414 - DNA, 25 bp, Mus musculus
agggagctcccgtgttgaatttatt

SEQ ID NO: 198415 - DNA, 25 bp, Mus musculus
agggagctcgccactgtagcagtca

SEQ ID NO: 198416 - DNA, 25 bp, Mus musculus
agggagctcgcctctgtagcagtca

SEQ ID NO: 198417 - DNA, 25 bp, Mus musculus
agggagctgaggaacgccatgactc

SEQ ID NO: 198418 - DNA, 25 bp, Mus musculus
agggagctgaggtacgccatgactc

SEQ ID NO: 198419 - DNA, 25 bp, Mus musculus
agggagctgcacatttgttttgacc

SEQ ID NO: 198420 - DNA, 25 bp, Mus musculus
agggagctgcacttttgttttgacc

SEQ ID NO: 198421 - DNA, 25 bp, Mus musculus
agggagctgcatcgtatcttgttac

SEQ ID NO: 198422 - DNA, 25 bp, Mus musculus
agggagctgcatggtatcttgttac

SEQ ID NO: 198423 - DNA, 25 bp, Mus musculus
agggagctggagatgagcctcctcc

SEQ ID NO: 198424 - DNA, 25 bp, Mus musculus
agggagctggagttgagcctcctcc

SEQ ID NO: 198425 - DNA, 25 bp, Mus musculus
agggagctggccctgcctaaaacaa

SEQ ID NO: 198426 - DNA, 25 bp, Mus musculus
agggagctggccgtgcctaaaacaa

SEQ ID NO: 198427 - DNA, 25 bp, Mus musculus
agggagcttaccattctggtgggat

SEQ ID NO: 198428 - DNA, 25 bp, Mus musculus
agggagcttacctttctggtgggat

SEQ ID NO: 198429 - DNA, 25 bp, Mus musculus
agggagcttaggaacctgtgtcctt

SEQ ID NO: 198430 - DNA, 25 bp, Mus musculus
agggagcttaggtacctgtgtcctt

SEQ ID NO: 198431 - DNA, 25 bp, Mus musculus
agggagcttctcagcaacttcaggt

SEQ ID NO: 198432 - DNA, 25 bp, Mus musculus
agggagcttctctgcaacttcaggt

SEQ ID NO: 198433 - DNA, 25 bp, Mus musculus
agggagcttctgctatcactaggca

SEQ ID NO: 198434 - DNA, 25 bp, Mus musculus
agggagcttctggtatcactaggca

SEQ ID NO: 198435 - DNA, 25 bp, Mus musculus
agggagcttggaaagcccacctcta

SEQ ID NO: 198436 - DNA, 25 bp, Mus musculus
agggagcttggatagcccacctcta

SEQ ID NO: 198437 - DNA, 25 bp, Mus musculus
agggagctttggactcaccaggtgt

SEQ ID NO: 198438 - DNA, 25 bp, Mus musculus
agggagctttggtctcaccaggtgt

SEQ ID NO: 198439 - DNA, 25 bp, Mus musculus
agggaggaccagagcctatgctata

SEQ ID NO: 198440 - DNA, 25 bp, Mus musculus
agggaggaccagtgcctatgctata

SEQ ID NO: 198441 - DNA, 25 bp, Mus musculus
agggaggactcaattgtgttgttaa

SEQ ID NO: 198442 - DNA, 25 bp, Mus musculus
agggaggactcatttgtgttgttaa

SEQ ID NO: 198443 - DNA, 25 bp, Mus musculus
agggaggactgcagaacttgctcaa

SEQ ID NO: 198444 - DNA, 25 bp, Mus musculus
agggaggactgctgaacttgctcaa

SEQ ID NO: 198445 - DNA, 25 bp, Mus musculus
agggaggactgtcttccactgcctg

SEQ ID NO: 198446 - DNA, 25 bp, Mus musculus
agggaggactgtgttccactgcctg

SEQ ID NO: 198447 - DNA, 25 bp, Mus musculus
agggaggacttgcacactgcactgc

SEQ ID NO: 198448 - DNA, 25 bp, Mus musculus
agggaggacttggacactgcactgc

SEQ ID NO: 198449 - DNA, 25 bp, Mus musculus
agggaggactttcttcacaaggaag

SEQ ID NO: 198450 - DNA, 25 bp, Mus musculus
agggaggactttgttcacaaggaag

SEQ ID NO: 198451 - DNA, 25 bp, Mus musculus
agggaggagcatacctgccacttca

SEQ ID NO: 198452 - DNA, 25 bp, Mus musculus
agggaggagcattcctgccacttca

SEQ ID NO: 198453 - DNA, 25 bp, Mus musculus
agggaggagtcaactgttacacagt

SEQ ID NO: 198454 - DNA, 25 bp, Mus musculus
agggaggagtcatctgttacacagt

SEQ ID NO: 198455 - DNA, 25 bp, Mus musculus
agggaggatgagaccctactgaagt

SEQ ID NO: 198456 - DNA, 25 bp, Mus musculus
agggaggatgagtccctactgaagt

SEQ ID NO: 198457 - DNA, 25 bp, Mus musculus
agggaggattcaccttatcccattt

SEQ ID NO: 198458 - DNA, 25 bp, Mus musculus
agggaggattcagcttatcccattt

SEQ ID NO: 198459 - DNA, 25 bp, Mus musculus
agggaggcaagaccctgttctctta

SEQ ID NO: 198460 - DNA, 25 bp, Mus musculus
agggaggcaagagcctgttctctta

SEQ ID NO: 198461 - DNA, 25 bp, Mus musculus
agggaggcagatctatctccctcaa

SEQ ID NO: 198462 - DNA, 25 bp, Mus musculus
agggaggcagatgtatctccctcaa

SEQ ID NO: 198463 - DNA, 25 bp, Mus musculus
agggaggcatttaccagctgttttc

SEQ ID NO: 198464 - DNA, 25 bp, Mus musculus
agggaggcattttccagctgttttc

SEQ ID NO: 198465 - DNA, 25 bp, Mus musculus
agggaggccaggagtgacctcatct

SEQ ID NO: 198466 - DNA, 25 bp, Mus musculus
agggaggccaggtgtgacctcatct

SEQ ID NO: 198467 - DNA, 25 bp, Mus musculus
agggaggccatgacttgaccgccat

SEQ ID NO: 198468 - DNA, 25 bp, Mus musculus
agggaggccatgacttgtcctccac

SEQ ID NO: 198469 - DNA, 25 bp, Mus musculus
agggaggccatgtcttgaccgccat

SEQ ID NO: 198470 - DNA, 25 bp, Mus musculus
agggaggccatgtcttgtcctccac

SEQ ID NO: 198471 - DNA, 25 bp, Mus musculus
agggaggccattatccacgcaggca

SEQ ID NO: 198472 - DNA, 25 bp, Mus musculus
agggaggccattttccacgcaggca

SEQ ID NO: 198473 - DNA, 25 bp, Mus musculus
agggaggcctcgagtcacggcccca

SEQ ID NO: 198474 - DNA, 25 bp, Mus musculus
agggaggcctcgtgtcacggcccca

SEQ ID NO: 198475 - DNA, 25 bp, Mus musculus
agggaggcctctatctctcaaatct

SEQ ID NO: 198476 - DNA, 25 bp, Mus musculus
agggaggcctctttctctcaaatct

SEQ ID NO: 198477 - DNA, 25 bp, Mus musculus
agggaggccttgagtatctcagaga

SEQ ID NO: 198478 - DNA, 25 bp, Mus musculus
agggaggccttgtgtatctcagaga

SEQ ID NO: 198479 - DNA, 25 bp, Mus musculus
agggaggcctttctgacctctgact

SEQ ID NO: 198480 - DNA, 25 bp, Mus musculus
agggaggcctttgtgacctctgact

SEQ ID NO: 198481 - DNA, 25 bp, Mus musculus
agggaggcgcgaccagcacctcttt

SEQ ID NO: 198482 - DNA, 25 bp, Mus musculus
agggaggcgcgagcagcacctcttt

SEQ ID NO: 198483 - DNA, 25 bp, Mus musculus
agggaggctctgagcttttgctaag

SEQ ID NO: 198484 - DNA, 25 bp, Mus musculus
agggaggctctgtgcttttgctaag

SEQ ID NO: 198485 - DNA, 25 bp, Mus musculus
agggaggctgccattgatacagaga

SEQ ID NO: 198486 - DNA, 25 bp, Mus musculus
agggaggctgcctttgatacagaga

SEQ ID NO: 198487 - DNA, 25 bp, Mus musculus
agggaggctggaagaccacattttt

SEQ ID NO: 198488 - DNA, 25 bp, Mus musculus
agggaggctggatgaccacattttt

SEQ ID NO: 198489 - DNA, 25 bp, Mus musculus
agggagggactgcattctcctcgtt

SEQ ID NO: 198490 - DNA, 25 bp, Mus musculus
agggagggactggattctcctcgtt

SEQ ID NO: 198491 - DNA, 25 bp, Mus musculus
agggagggagccactttcaggccct

SEQ ID NO: 198492 - DNA, 25 bp, Mus musculus
agggagggagcctctttcaggccct

SEQ ID NO: 198493 - DNA, 25 bp, Mus musculus
agggagggccagcactcaggcagaa

SEQ ID NO: 198494 - DNA, 25 bp, Mus musculus
agggagggccaggactcaggcagaa

SEQ ID NO: 198495 - DNA, 25 bp, Mus musculus
agggagggcctgataccaagtacca

SEQ ID NO: 198496 - DNA, 25 bp, Mus musculus
agggagggcctgttaccaagtacca

SEQ ID NO: 198497 - DNA, 25 bp, Mus musculus
agggagggctgcactaaaagagtcc

SEQ ID NO: 198498 - DNA, 25 bp, Mus musculus
agggagggctgctctaaaagagtcc

SEQ ID NO: 198499 - DNA, 25 bp, Mus musculus
agggagggcttcctagttctagaca

SEQ ID NO: 198500 - DNA, 25 bp, Mus musculus
agggagggcttcgtagttctagaca

SEQ ID NO: 198501 - DNA, 25 bp, Mus musculus
agggagggtcccaatcccactggca

SEQ ID NO: 198502 - DNA, 25 bp, Mus musculus
agggagggtccctatcccactggca

SEQ ID NO: 198503 - DNA, 25 bp, Mus musculus
agggagggtcctcgtctactcatga

SEQ ID NO: 198504 - DNA, 25 bp, Mus musculus
agggagggtcctggtctactcatga

SEQ ID NO: 198505 - DNA, 25 bp, Mus musculus
agggaggtacctccagtgaccttgc

SEQ ID NO: 198506 - DNA, 25 bp, Mus musculus
agggaggtacctgcagtgaccttgc

SEQ ID NO: 198507 - DNA, 25 bp, Mus musculus
agggaggtctcccagattccagtgc

SEQ ID NO: 198508 - DNA, 25 bp, Mus musculus
agggaggtctccgagattccagtgc

SEQ ID NO: 198509 - DNA, 25 bp, Mus musculus
agggaggtctcgagtacgtctgtct

SEQ ID NO: 198510 - DNA, 25 bp, Mus musculus
agggaggtctcgtgtacgtctgtct

SEQ ID NO: 198511 - DNA, 25 bp, Mus musculus
agggaggtctctcgtttgataccca

SEQ ID NO: 198512 - DNA, 25 bp, Mus musculus
agggaggtctctggtttgataccca

SEQ ID NO: 198513 - DNA, 25 bp, Mus musculus
agggaggtctgtaatgtgaaacaac

SEQ ID NO: 198514 - DNA, 25 bp, Mus musculus
agggaggtctgtataatcagcaaga

SEQ ID NO: 198515 - DNA, 25 bp, Mus musculus
agggaggtctgttatgtgaaacaac

SEQ ID NO: 198516 - DNA, 25 bp, Mus musculus
agggaggtctgtttaatcagcaaga

SEQ ID NO: 198517 - DNA, 25 bp, Mus musculus
agggaggtgagaccttcccacccat

SEQ ID NO: 198518 - DNA, 25 bp, Mus musculus
agggaggtgagagcttcccacccat

SEQ ID NO: 198519 - DNA, 25 bp, Mus musculus
agggaggtgggcacccacgtcttct

SEQ ID NO: 198520 - DNA, 25 bp, Mus musculus
agggaggtgggctcccacgtcttct

SEQ ID NO: 198521 - DNA, 25 bp, Mus musculus
agggaggttttcctcttggcagcca

SEQ ID NO: 198522 - DNA, 25 bp, Mus musculus
agggaggttttcgtcttggcagcca

SEQ ID NO: 198523 - DNA, 25 bp, Mus musculus
agggagtaaccgctctgtcctgtca

SEQ ID NO: 198524 - DNA, 25 bp, Mus musculus
agggagtaaccggtctgtcctgtca

SEQ ID NO: 198525 - DNA, 25 bp, Mus musculus
agggagtacacaactttgaagctga

SEQ ID NO: 198526 - DNA, 25 bp, Mus musculus
agggagtacacatctttgaagctga

SEQ ID NO: 198527 - DNA, 25 bp, Mus musculus
agggagtagcctacgaattcttgag

SEQ ID NO: 198528 - DNA, 25 bp, Mus musculus
agggagtagccttcgaattcttgag

SEQ ID NO: 198529 - DNA, 25 bp, Mus musculus
agggagtagtcacataccacaccac

SEQ ID NO: 198530 - DNA, 25 bp, Mus musculus
agggagtagtcagataccacaccac

SEQ ID NO: 198531 - DNA, 25 bp, Mus musculus
agggagtatggacccactttgacca

SEQ ID NO: 198532 - DNA, 25 bp, Mus musculus
agggagtatggagccactttgacca

SEQ ID NO: 198533 - DNA, 25 bp, Mus musculus
agggagtattctcataagctagttg

SEQ ID NO: 198534 - DNA, 25 bp, Mus musculus
agggagtattctgataagctagttg

SEQ ID NO: 198535 - DNA, 25 bp, Mus musculus
agggagtcaactatcacaccattcg

SEQ ID NO: 198536 - DNA, 25 bp, Mus musculus
agggagtcaactttcacaccattcg

SEQ ID NO: 198537 - DNA, 25 bp, Mus musculus
agggagtcaggtatactggccctgt

SEQ ID NO: 198538 - DNA, 25 bp, Mus musculus
agggagtcaggtttactggccctgt

SEQ ID NO: 198539 - DNA, 25 bp, Mus musculus
agggagtcagtcagtaccggctgat

SEQ ID NO: 198540 - DNA, 25 bp, Mus musculus
agggagtcagtctgtaccggctgat

SEQ ID NO: 198541 - DNA, 25 bp, Mus musculus
agggagtcatccagcccatcaaaag

SEQ ID NO: 198542 - DNA, 25 bp, Mus musculus
agggagtcatcctgcccatcaaaag

SEQ ID NO: 198543 - DNA, 25 bp, Mus musculus
agggagtcccagcttagtaacctcg

SEQ ID NO: 198544 - DNA, 25 bp, Mus musculus
agggagtcccaggttagtaacctcg

SEQ ID NO: 198545 - DNA, 25 bp, Mus musculus
agggagtccttgcttcagtgataca

SEQ ID NO: 198546 - DNA, 25 bp, Mus musculus
agggagtccttggttcagtgataca

SEQ ID NO: 198547 - DNA, 25 bp, Mus musculus
agggagtcgtcccaatgtctgacaa

SEQ ID NO: 198548 - DNA, 25 bp, Mus musculus
agggagtcgtccgaatgtctgacaa

SEQ ID NO: 198549 - DNA, 25 bp, Mus musculus
agggagtgaaatctctctttaccag

SEQ ID NO: 198550 - DNA, 25 bp, Mus musculus
agggagtgaaatgtctctttaccag

SEQ ID NO: 198551 - DNA, 25 bp, Mus musculus
agggagtgagatactgctcttcctc

SEQ ID NO: 198552 - DNA, 25 bp, Mus musculus
agggagtgagattctgctcttcctc

SEQ ID NO: 198553 - DNA, 25 bp, Mus musculus
agggagtgagcacccggccaccttt

SEQ ID NO: 198554 - DNA, 25 bp, Mus musculus
agggagtgagcagccggccaccttt

SEQ ID NO: 198555 - DNA, 25 bp, Mus musculus
agggagtgagccagcgtctttgtct

SEQ ID NO: 198556 - DNA, 25 bp, Mus musculus
agggagtgagcctgcgtctttgtct

SEQ ID NO: 198557 - DNA, 25 bp, Mus musculus
agggagtgcccgagcttgtttcagc

SEQ ID NO: 198558 - DNA, 25 bp, Mus musculus
agggagtgcccgtgcttgtttcagc

SEQ ID NO: 198559 - DNA, 25 bp, Mus musculus
agggagtgcttgcttcagcatcaac

SEQ ID NO: 198560 - DNA, 25 bp, Mus musculus
agggagtgcttggttcagcatcaac

SEQ ID NO: 198561 - DNA, 25 bp, Mus musculus
agggagtggcaaaagcttttcttgt

SEQ ID NO: 198562 - DNA, 25 bp, Mus musculus
agggagtggcaatagcttttcttgt

SEQ ID NO: 198563 - DNA, 25 bp, Mus musculus
agggagtggcccagtatgcaccatc

SEQ ID NO: 198564 - DNA, 25 bp, Mus musculus
agggagtggccctgtatgcaccatc

SEQ ID NO: 198565 - DNA, 25 bp, Mus musculus
agggagtgtggtaaacaggtctgcg

SEQ ID NO: 198566 - DNA, 25 bp, Mus musculus
agggagtgtggttaacaggtctgcg

SEQ ID NO: 198567 - DNA, 25 bp, Mus musculus
agggagttagaacgccagccctgca

SEQ ID NO: 198568 - DNA, 25 bp, Mus musculus
agggagttagaaggccagccctgca

SEQ ID NO: 198569 - DNA, 25 bp, Mus musculus
agggagttccggactggctctagca

SEQ ID NO: 198570 - DNA, 25 bp, Mus musculus
agggagttccggtctggctctagca

SEQ ID NO: 198571 - DNA, 25 bp, Mus musculus
agggagttgatcagccatctgcttg

SEQ ID NO: 198572 - DNA, 25 bp, Mus musculus
agggagttgatctgccatctgcttg

SEQ ID NO: 198573 - DNA, 25 bp, Mus musculus
agggagtttcctacatgcaagacaa

SEQ ID NO: 198574 - DNA, 25 bp, Mus musculus
agggagtttccttcatgcaagacaa

SEQ ID NO: 198575 - DNA, 25 bp, Mus musculus
agggagtttggcaaccaggcgtaat

SEQ ID NO: 198576 - DNA, 25 bp, Mus musculus
agggagtttggctaccaggcgtaat

SEQ ID NO: 198577 - DNA, 25 bp, Mus musculus
agggataaacctacgccatagctca

SEQ ID NO: 198578 - DNA, 25 bp, Mus musculus
agggataaaccttcgccatagctca

SEQ ID NO: 198579 - DNA, 25 bp, Mus musculus
agggatacacagcatgcacacgcat

SEQ ID NO: 198580 - DNA, 25 bp, Mus musculus
agggatacacaggatgcacacgcat

SEQ ID NO: 198581 - DNA, 25 bp, Mus musculus
agggatacacatcaacaccaagttt

SEQ ID NO: 198582 - DNA, 25 bp, Mus musculus
agggatacacatgaacaccaagttt

SEQ ID NO: 198583 - DNA, 25 bp, Mus musculus
agggatacactgattgctgctgcac

SEQ ID NO: 198584 - DNA, 25 bp, Mus musculus
agggatacactgtttgctgctgcac

SEQ ID NO: 198585 - DNA, 25 bp, Mus musculus
agggatacatccctttcttcaccat

SEQ ID NO: 198586 - DNA, 25 bp, Mus musculus
agggatacatccgtttcttcaccat

SEQ ID NO: 198587 - DNA, 25 bp, Mus musculus
agggatacccaacaggcccctggat

SEQ ID NO: 198588 - DNA, 25 bp, Mus musculus
agggatacccaagaggcccctggat

SEQ ID NO: 198589 - DNA, 25 bp, Mus musculus
agggatacctcaagacaccttttat

SEQ ID NO: 198590 - DNA, 25 bp, Mus musculus
agggatacctcatgacaccttttat

SEQ ID NO: 198591 - DNA, 25 bp, Mus musculus
agggatacggtccacactatcccaa

SEQ ID NO: 198592 - DNA, 25 bp, Mus musculus
agggatacggtcgacactatcccaa

SEQ ID NO: 198593 - DNA, 25 bp, Mus musculus
agggatactcccatatgggttgagc

SEQ ID NO: 198594 - DNA, 25 bp, Mus musculus
agggatactcccttatgggttgagc

SEQ ID NO: 198595 - DNA, 25 bp, Mus musculus
agggatagacgaaccaatcgttcca

SEQ ID NO: 198596 - DNA, 25 bp, Mus musculus
agggatagacgatccaatcgttcca

SEQ ID NO: 198597 - DNA, 25 bp, Mus musculus
agggatagctgtctttcattttgaa

SEQ ID NO: 198598 - DNA, 25 bp, Mus musculus
agggatagctgtgtttcattttgaa

SEQ ID NO: 198599 - DNA, 25 bp, Mus musculus
agggatagtgcaacttttaaaatac

SEQ ID NO: 198600 - DNA, 25 bp, Mus musculus
agggatagtgcatcttttaaaatac

SEQ ID NO: 198601 - DNA, 25 bp, Mus musculus
agggatatccaacctctactattct

SEQ ID NO: 198602 - DNA, 25 bp, Mus musculus
agggatatccaagctctactattct

SEQ ID NO: 198603 - DNA, 25 bp, Mus musculus
agggatatggagacaaactctgcaa

SEQ ID NO: 198604 - DNA, 25 bp, Mus musculus
agggatatggagtcaaactctgcaa

SEQ ID NO: 198605 - DNA, 25 bp, Mus musculus
agggatatggctcagtactgtaact

SEQ ID NO: 198606 - DNA, 25 bp, Mus musculus
agggatatggctgagtactgtaact

SEQ ID NO: 198607 - DNA, 25 bp, Mus musculus
agggatattcaacaactgtgtgcca

SEQ ID NO: 198608 - DNA, 25 bp, Mus musculus
agggatattcaagaactgtgtgcca

SEQ ID NO: 198609 - DNA, 25 bp, Mus musculus
agggatattcatagactttgggcgg

SEQ ID NO: 198610 - DNA, 25 bp, Mus musculus
agggatattcattgactttgggcgg

SEQ ID NO: 198611 - DNA, 25 bp, Mus musculus
agggatattggcattgagacagtaa

SEQ ID NO: 198612 - DNA, 25 bp, Mus musculus
agggatattggctttgagacagtaa

SEQ ID NO: 198613 - DNA, 25 bp, Mus musculus
agggatcaaaacacaaggcgctaag

SEQ ID NO: 198614 - DNA, 25 bp, Mus musculus
agggatcaaaactcaaggcgctaag

SEQ ID NO: 198615 - DNA, 25 bp, Mus musculus
agggatcaattgacctgtgaactct

SEQ ID NO: 198616 - DNA, 25 bp, Mus musculus
agggatcaattgtcctgtgaactct

SEQ ID NO: 198617 - DNA, 25 bp, Mus musculus
agggatcacccaacattctgaggtc

SEQ ID NO: 198618 - DNA, 25 bp, Mus musculus
agggatcacccatcattctgaggtc

SEQ ID NO: 198619 - DNA, 25 bp, Mus musculus
agggatcagaaaagatggtacagtg

SEQ ID NO: 198620 - DNA, 25 bp, Mus musculus
agggatcagaaatgatggtacagtg

SEQ ID NO: 198621 - DNA, 25 bp, Mus musculus
agggatcagcccactcagcctaagg

SEQ ID NO: 198622 - DNA, 25 bp, Mus musculus
agggatcagcccagacgggtctttg

SEQ ID NO: 198623 - DNA, 25 bp, Mus musculus
agggatcagccctctcagcctaagg

SEQ ID NO: 198624 - DNA, 25 bp, Mus musculus
agggatcagccctgacgggtctttg

SEQ ID NO: 198625 - DNA, 25 bp, Mus musculus
agggatcagtgtaacccaccatctg

SEQ ID NO: 198626 - DNA, 25 bp, Mus musculus
agggatcagtgttacccaccatctg

SEQ ID NO: 198627 - DNA, 25 bp, Mus musculus
agggatcatgacctcctttatgccc

SEQ ID NO: 198628 - DNA, 25 bp, Mus musculus
agggatcatgacgtcctttatgccc

SEQ ID NO: 198629 - DNA, 25 bp, Mus musculus
agggatcatgtgctacgcttctcct

SEQ ID NO: 198630 - DNA, 25 bp, Mus musculus
agggatcatgtggtacgcttctcct

SEQ ID NO: 198631 - DNA, 25 bp, Mus musculus
agggatcattacaatctcgggccac

SEQ ID NO: 198632 - DNA, 25 bp, Mus musculus
agggatcattactatctcgggccac

SEQ ID NO: 198633 - DNA, 25 bp, Mus musculus
agggatcatttgatagagaagccac

SEQ ID NO: 198634 - DNA, 25 bp, Mus musculus
agggatcatttgcatctccttgtcc

SEQ ID NO: 198635 - DNA, 25 bp, Mus musculus
agggatcatttggatctccttgtcc

SEQ ID NO: 198636 - DNA, 25 bp, Mus musculus
agggatcatttgttagagaagccac

SEQ ID NO: 198637 - DNA, 25 bp, Mus musculus
agggatcattttagtgcgtagaaag

SEQ ID NO: 198638 - DNA, 25 bp, Mus musculus
agggatcatttttgtgcgtagaaag

SEQ ID NO: 198639 - DNA, 25 bp, Mus musculus
agggatccaccacttactcggtgca

SEQ ID NO: 198640 - DNA, 25 bp, Mus musculus
agggatccaccagttactcggtgca

SEQ ID NO: 198641 - DNA, 25 bp, Mus musculus
agggatccatggaccctgacacaca

SEQ ID NO: 198642 - DNA, 25 bp, Mus musculus
agggatccatggtccctgacacaca

SEQ ID NO: 198643 - DNA, 25 bp, Mus musculus
agggatcccctgcagagcagttatt

SEQ ID NO: 198644 - DNA, 25 bp, Mus musculus
agggatcccctggagagcagttatt

SEQ ID NO: 198645 - DNA, 25 bp, Mus musculus
agggatccctgaatgccaacctgtc

SEQ ID NO: 198646 - DNA, 25 bp, Mus musculus
agggatccctgactttaccagcgtg

SEQ ID NO: 198647 - DNA, 25 bp, Mus musculus
agggatccctgagtttaccagcgtg

SEQ ID NO: 198648 - DNA, 25 bp, Mus musculus
agggatccctgattgccaacctgtc

SEQ ID NO: 198649 - DNA, 25 bp, Mus musculus
agggatcctagccagtggaccaccc

SEQ ID NO: 198650 - DNA, 25 bp, Mus musculus
agggatcctagcgagtggaccaccc

SEQ ID NO: 198651 - DNA, 25 bp, Mus musculus
agggatcctatgcaacctgtcctcc

SEQ ID NO: 198652 - DNA, 25 bp, Mus musculus
agggatcctatggaacctgtcctcc

SEQ ID NO: 198653 - DNA, 25 bp, Mus musculus
agggatcctggaacatcacaactca

SEQ ID NO: 198654 - DNA, 25 bp, Mus musculus
agggatcctggatcatcacaactca

SEQ ID NO: 198655 - DNA, 25 bp, Mus musculus
agggatcctgggactctttacactg

SEQ ID NO: 198656 - DNA, 25 bp, Mus musculus
agggatcctgggtctctttacactg

SEQ ID NO: 198657 - DNA, 25 bp, Mus musculus
agggatcctttaaggctggttggca

SEQ ID NO: 198658 - DNA, 25 bp, Mus musculus
agggatcctttatggctggttggca

SEQ ID NO: 198659 - DNA, 25 bp, Mus musculus
agggatcgaatcagggttctggaaa

SEQ ID NO: 198660 - DNA, 25 bp, Mus musculus
agggatcgaatctgggttctggaaa

SEQ ID NO: 198661 - DNA, 25 bp, Mus musculus
agggatcgcaacagtgatgggcaaa

SEQ ID NO: 198662 - DNA, 25 bp, Mus musculus
agggatcgcaactgtgatgggcaaa

SEQ ID NO: 198663 - DNA, 25 bp, Mus musculus
agggatcggagccatcatcgcgcca

SEQ ID NO: 198664 - DNA, 25 bp, Mus musculus
agggatcggagcgatcatcgcgcca

SEQ ID NO: 198665 - DNA, 25 bp, Mus musculus
agggatcgttatagagacttattaa

SEQ ID NO: 198666 - DNA, 25 bp, Mus musculus
agggatcgttattgagacttattaa

SEQ ID NO: 198667 - DNA, 25 bp, Mus musculus
agggatctaccaagcatatctcaaa

SEQ ID NO: 198668 - DNA, 25 bp, Mus musculus
agggatctaccatgcatatctcaaa

SEQ ID NO: 198669 - DNA, 25 bp, Mus musculus
agggatctagaaaagtctctcgctt

SEQ ID NO: 198670 - DNA, 25 bp, Mus musculus
agggatctagaatagtctctcgctt

SEQ ID NO: 198671 - DNA, 25 bp, Mus musculus
agggatctcaacaagatgaccttct

SEQ ID NO: 198672 - DNA, 25 bp, Mus musculus
agggatctcaactagatgaccttct

SEQ ID NO: 198673 - DNA, 25 bp, Mus musculus
agggatctgctcacccttttttggg

SEQ ID NO: 198674 - DNA, 25 bp, Mus musculus
agggatctgctctcccttttttggg

SEQ ID NO: 198675 - DNA, 25 bp, Mus musculus
agggatctggccaagcagctcaagg

SEQ ID NO: 198676 - DNA, 25 bp, Mus musculus
agggatctggcctagcagctcaagg

SEQ ID NO: 198677 - DNA, 25 bp, Mus musculus
agggatcttaggcctctctcggcag

SEQ ID NO: 198678 - DNA, 25 bp, Mus musculus
agggatcttagggctctctcggcag

SEQ ID NO: 198679 - DNA, 25 bp, Mus musculus
agggatcttcccagaactgatattc

SEQ ID NO: 198680 - DNA, 25 bp, Mus musculus
agggatcttccctgaactgatattc

SEQ ID NO: 198681 - DNA, 25 bp, Mus musculus
agggatgaccatactgcaactacac

SEQ ID NO: 198682 - DNA, 25 bp, Mus musculus
agggatgaccattctgcaactacac

SEQ ID NO: 198683 - DNA, 25 bp, Mus musculus
agggatgacctcaggtctgcaggat

SEQ ID NO: 198684 - DNA, 25 bp, Mus musculus
agggatgacctctggtctgcaggat

SEQ ID NO: 198685 - DNA, 25 bp, Mus musculus
agggatgactggcaactcctgtagt

SEQ ID NO: 198686 - DNA, 25 bp, Mus musculus
agggatgactgggaactcctgtagt

SEQ ID NO: 198687 - DNA, 25 bp, Mus musculus
agggatgagaccagagacttcctat

SEQ ID NO: 198688 - DNA, 25 bp, Mus musculus
agggatgagacctgagacttcctat

SEQ ID NO: 198689 - DNA, 25 bp, Mus musculus
agggatgatcacactcttagaccat

SEQ ID NO: 198690 - DNA, 25 bp, Mus musculus
agggatgatcactctcttagaccat

SEQ ID NO: 198691 - DNA, 25 bp, Mus musculus
agggatgatcctaatgtgatataat

SEQ ID NO: 198692 - DNA, 25 bp, Mus musculus
agggatgatccttatgtgatataat

SEQ ID NO: 198693 - DNA, 25 bp, Mus musculus
agggatgatggaatcattcctggaa

SEQ ID NO: 198694 - DNA, 25 bp, Mus musculus
agggatgatggattcattcctggaa

SEQ ID NO: 198695 - DNA, 25 bp, Mus musculus
agggatgatgggaacttgctacagt

SEQ ID NO: 198696 - DNA, 25 bp, Mus musculus
agggatgatgggaccaccgctttaa

SEQ ID NO: 198697 - DNA, 25 bp, Mus musculus
agggatgatgggtacttgctacagt

SEQ ID NO: 198698 - DNA, 25 bp, Mus musculus
agggatgatgggtccaccgctttaa

SEQ ID NO: 198699 - DNA, 25 bp, Mus musculus
agggatgatttcactacacgctgca

SEQ ID NO: 198700 - DNA, 25 bp, Mus musculus
agggatgatttctctacacgctgca

SEQ ID NO: 198701 - DNA, 25 bp, Mus musculus
agggatgcaaaacccacagcattat

SEQ ID NO: 198702 - DNA, 25 bp, Mus musculus
agggatgcaaaagccacagcattat

SEQ ID NO: 198703 - DNA, 25 bp, Mus musculus
agggatgcaagtcgtcctgctaaac

SEQ ID NO: 198704 - DNA, 25 bp, Mus musculus
agggatgcaagtggtcctgctaaac

SEQ ID NO: 198705 - DNA, 25 bp, Mus musculus
agggatgcagtaccacttgcagaca

SEQ ID NO: 198706 - DNA, 25 bp, Mus musculus
agggatgcagtagcacttgcagaca

SEQ ID NO: 198707 - DNA, 25 bp, Mus musculus
agggatgcatccaaaagtcaaggcc

SEQ ID NO: 198708 - DNA, 25 bp, Mus musculus
agggatgcatcctaaagtcaaggcc

SEQ ID NO: 198709 - DNA, 25 bp, Mus musculus
agggatgccatcctgtttctgactg

SEQ ID NO: 198710 - DNA, 25 bp, Mus musculus
agggatgccatcgtgtttctgactg

SEQ ID NO: 198711 - DNA, 25 bp, Mus musculus
agggatgccatgattctgtggcccc

SEQ ID NO: 198712 - DNA, 25 bp, Mus musculus
agggatgccatgtttctgtggcccc

SEQ ID NO: 198713 - DNA, 25 bp, Mus musculus
agggatgccccaaccagaggctgtg

SEQ ID NO: 198714 - DNA, 25 bp, Mus musculus
agggatgccccatccagaggctgtg

SEQ ID NO: 198715 - DNA, 25 bp, Mus musculus
agggatgcccggaacaccctgacca

SEQ ID NO: 198716 - DNA, 25 bp, Mus musculus
agggatgcccggtacaccctgacca

SEQ ID NO: 198717 - DNA, 25 bp, Mus musculus
agggatgcgattccacggcaacttt

SEQ ID NO: 198718 - DNA, 25 bp, Mus musculus
agggatgcgattgcacggcaacttt

SEQ ID NO: 198719 - DNA, 25 bp, Mus musculus
agggatgcgcctcatgctggctctt

SEQ ID NO: 198720 - DNA, 25 bp, Mus musculus
agggatgcgcctgatgctggctctt

SEQ ID NO: 198721 - DNA, 25 bp, Mus musculus
agggatgctacccagctattcactc

SEQ ID NO: 198722 - DNA, 25 bp, Mus musculus
agggatgctaccgagctattcactc

SEQ ID NO: 198723 - DNA, 25 bp, Mus musculus
agggatgctgcgatcagccattcca

SEQ ID NO: 198724 - DNA, 25 bp, Mus musculus
agggatgctgcgttcagccattcca

SEQ ID NO: 198725 - DNA, 25 bp, Mus musculus
agggatgctggccaccaagaccgaa

SEQ ID NO: 198726 - DNA, 25 bp, Mus musculus
agggatgctggcgaccaagaccgaa

SEQ ID NO: 198727 - DNA, 25 bp, Mus musculus
agggatgctgggagccaaccgtccc

SEQ ID NO: 198728 - DNA, 25 bp, Mus musculus
agggatgctgggatcgcactcctgt

SEQ ID NO: 198729 - DNA, 25 bp, Mus musculus
agggatgctgggtgccaaccgtccc

SEQ ID NO: 198730 - DNA, 25 bp, Mus musculus
agggatgctgggttcgcactcctgt

SEQ ID NO: 198731 - DNA, 25 bp, Mus musculus
agggatgcttaactatagccccacc

SEQ ID NO: 198732 - DNA, 25 bp, Mus musculus
agggatgcttaagtatagccccacc

SEQ ID NO: 198733 - DNA, 25 bp, Mus musculus
agggatggacatacttctaaacaat

SEQ ID NO: 198734 - DNA, 25 bp, Mus musculus
agggatggacattcttctaaacaat

SEQ ID NO: 198735 - DNA, 25 bp, Mus musculus
agggatggcatactttggacagact

SEQ ID NO: 198736 - DNA, 25 bp, Mus musculus
agggatggcatagtttggacagact

SEQ ID NO: 198737 - DNA, 25 bp, Mus musculus
agggatggctccagagagtgcctct

SEQ ID NO: 198738 - DNA, 25 bp, Mus musculus
agggatggctcctgagagtgcctct

SEQ ID NO: 198739 - DNA, 25 bp, Mus musculus
agggatggtctcatcacagtctgtg

SEQ ID NO: 198740 - DNA, 25 bp, Mus musculus
agggatggtctcttcacagtctgtg

SEQ ID NO: 198741 - DNA, 25 bp, Mus musculus
agggatggtgctcttcccatgactc

SEQ ID NO: 198742 - DNA, 25 bp, Mus musculus
agggatggtgctgttcccatgactc

SEQ ID NO: 198743 - DNA, 25 bp, Mus musculus
agggatgtaaataccatctctgatt

SEQ ID NO: 198744 - DNA, 25 bp, Mus musculus
agggatgtaaattccatctctgatt

SEQ ID NO: 198745 - DNA, 25 bp, Mus musculus
agggatgtaatgacagctcgtgaca

SEQ ID NO: 198746 - DNA, 25 bp, Mus musculus
agggatgtaatgtcagctcgtgaca

SEQ ID NO: 198747 - DNA, 25 bp, Mus musculus
agggatgtacctcgtcagctgctga

SEQ ID NO: 198748 - DNA, 25 bp, Mus musculus
agggatgtacctggtcagctgctga

SEQ ID NO: 198749 - DNA, 25 bp, Mus musculus
agggatgtagtactatcacacagat

SEQ ID NO: 198750 - DNA, 25 bp, Mus musculus
agggatgtagtagtatcacacagat

SEQ ID NO: 198751 - DNA, 25 bp, Mus musculus
agggatgtcagtagtttttagaaga

SEQ ID NO: 198752 - DNA, 25 bp, Mus musculus
agggatgtcagttgtttttagaaga

SEQ ID NO: 198753 - DNA, 25 bp, Mus musculus
agggatgtcatcattgtaggtctca

SEQ ID NO: 198754 - DNA, 25 bp, Mus musculus
agggatgtcatctttgtaggtctca

SEQ ID NO: 198755 - DNA, 25 bp, Mus musculus
agggatgtccacaccctcctgagag

SEQ ID NO: 198756 - DNA, 25 bp, Mus musculus
agggatgtccactccctcctgagag

SEQ ID NO: 198757 - DNA, 25 bp, Mus musculus
agggatgtctttacagtactttcat

SEQ ID NO: 198758 - DNA, 25 bp, Mus musculus
agggatgtcttttcagtactttcat

SEQ ID NO: 198759 - DNA, 25 bp, Mus musculus
agggatgtggaaagcctgactccag

SEQ ID NO: 198760 - DNA, 25 bp, Mus musculus
agggatgtggaatgcctgactccag

SEQ ID NO: 198761 - DNA, 25 bp, Mus musculus
agggatgtgtgcactggctgactcc

SEQ ID NO: 198762 - DNA, 25 bp, Mus musculus
agggatgtgtgctctggctgactcc

SEQ ID NO: 198763 - DNA, 25 bp, Mus musculus
agggatgttgctaacttccaggcca

SEQ ID NO: 198764 - DNA, 25 bp, Mus musculus
agggatgttgcttacttccaggcca

SEQ ID NO: 198765 - DNA, 25 bp, Mus musculus
agggatgtttatagtgttccaacac

SEQ ID NO: 198766 - DNA, 25 bp, Mus musculus
agggatgtttattgtgttccaacac

SEQ ID NO: 198767 - DNA, 25 bp, Mus musculus
agggattaactaactgctgaagaca

SEQ ID NO: 198768 - DNA, 25 bp, Mus musculus
agggattaactatctgctgaagaca

SEQ ID NO: 198769 - DNA, 25 bp, Mus musculus
agggattaagagagcctgctgcctt

SEQ ID NO: 198770 - DNA, 25 bp, Mus musculus
agggattaagagtgcctgctgcctt

SEQ ID NO: 198771 - DNA, 25 bp, Mus musculus
agggattacatcaccagaggcgctc

SEQ ID NO: 198772 - DNA, 25 bp, Mus musculus
agggattacatctccagaggcgctc

SEQ ID NO: 198773 - DNA, 25 bp, Mus musculus
agggattaggatctttgcaatgttt

SEQ ID NO: 198774 - DNA, 25 bp, Mus musculus
agggattaggatgtttgcaatgttt

SEQ ID NO: 198775 - DNA, 25 bp, Mus musculus
agggattaggctatactgtgtttat

SEQ ID NO: 198776 - DNA, 25 bp, Mus musculus
agggattaggctttactgtgtttat

SEQ ID NO: 198777 - DNA, 25 bp, Mus musculus
agggattagtgaccttgtttctgtc

SEQ ID NO: 198778 - DNA, 25 bp, Mus musculus
agggattagtgagcttgtttctgtc

SEQ ID NO: 198779 - DNA, 25 bp, Mus musculus
agggattcaagtacatgtttatgtc

SEQ ID NO: 198780 - DNA, 25 bp, Mus musculus
agggattcaagttcatgtttatgtc

SEQ ID NO: 198781 - DNA, 25 bp, Mus musculus
agggattcatggagctgacccaggc

SEQ ID NO: 198782 - DNA, 25 bp, Mus musculus
agggattcatggtgctgacccaggc

SEQ ID NO: 198783 - DNA, 25 bp, Mus musculus
agggattccctgagtttctctaaca

SEQ ID NO: 198784 - DNA, 25 bp, Mus musculus
agggattccctgtgtttctctaaca

SEQ ID NO: 198785 - DNA, 25 bp, Mus musculus
agggattccttgaagacggctgttg

SEQ ID NO: 198786 - DNA, 25 bp, Mus musculus
agggattccttgtagacggctgttg

SEQ ID NO: 198787 - DNA, 25 bp, Mus musculus
agggattcgctgattgttcgacacc

SEQ ID NO: 198788 - DNA, 25 bp, Mus musculus
agggattcgctgtttgttcgacacc

SEQ ID NO: 198789 - DNA, 25 bp, Mus musculus
agggattctcagagctggtttcgtc

SEQ ID NO: 198790 - DNA, 25 bp, Mus musculus
agggattctcagtgctggtttcgtc

SEQ ID NO: 198791 - DNA, 25 bp, Mus musculus
agggattctgtacctttaacttgta

SEQ ID NO: 198792 - DNA, 25 bp, Mus musculus
agggattctgtagctttaacttgta

SEQ ID NO: 198793 - DNA, 25 bp, Mus musculus
agggattcttaactgcgatgcgaca

SEQ ID NO: 198794 - DNA, 25 bp, Mus musculus
agggattcttaagtgcgatgcgaca

SEQ ID NO: 198795 - DNA, 25 bp, Mus musculus
agggattcttgcaagaggttcctgt

SEQ ID NO: 198796 - DNA, 25 bp, Mus musculus
agggattcttgctagaggttcctgt

SEQ ID NO: 198797 - DNA, 25 bp, Mus musculus
agggattgaatcctgttctgtgcag

SEQ ID NO: 198798 - DNA, 25 bp, Mus musculus
agggattgaatcgtgttctgtgcag

SEQ ID NO: 198799 - DNA, 25 bp, Mus musculus
agggattgatacactcacgggacaa

SEQ ID NO: 198800 - DNA, 25 bp, Mus musculus
agggattgatactctcacgggacaa

SEQ ID NO: 198801 - DNA, 25 bp, Mus musculus
agggattgcacaactgtatcagagt

SEQ ID NO: 198802 - DNA, 25 bp, Mus musculus
agggattgcacatctgtatcagagt

SEQ ID NO: 198803 - DNA, 25 bp, Mus musculus
agggattgcatcagcagtaccttaa

SEQ ID NO: 198804 - DNA, 25 bp, Mus musculus
agggattgcatctgcagtaccttaa

SEQ ID NO: 198805 - DNA, 25 bp, Mus musculus
agggattgcctgcactcctgaaatt

SEQ ID NO: 198806 - DNA, 25 bp, Mus musculus
agggattgcctggactcctgaaatt

SEQ ID NO: 198807 - DNA, 25 bp, Mus musculus
agggattggactcctcactagactt

SEQ ID NO: 198808 - DNA, 25 bp, Mus musculus
agggattggactgctcactagactt

SEQ ID NO: 198809 - DNA, 25 bp, Mus musculus
agggattggcatactgcccggtcac

SEQ ID NO: 198810 - DNA, 25 bp, Mus musculus
agggattggcattctgcccggtcac

SEQ ID NO: 198811 - DNA, 25 bp, Mus musculus
agggattggtacatgcccatggaat

SEQ ID NO: 198812 - DNA, 25 bp, Mus musculus
agggattggtacttgcccatggaat

SEQ ID NO: 198813 - DNA, 25 bp, Mus musculus
agggatttaaccatcatctgccact

SEQ ID NO: 198814 - DNA, 25 bp, Mus musculus
agggatttaaccttcatctgccact

SEQ ID NO: 198815 - DNA, 25 bp, Mus musculus
agggatttcaccacagacaggcgtc

SEQ ID NO: 198816 - DNA, 25 bp, Mus musculus
agggatttcacctcagacaggcgtc

SEQ ID NO: 198817 - DNA, 25 bp, Mus musculus
agggatttccctcaggtcagcagaa

SEQ ID NO: 198818 - DNA, 25 bp, Mus musculus
agggatttccctgaggtcagcagaa

SEQ ID NO: 198819 - DNA, 25 bp, Mus musculus
agggatttctctcgagctctcttga

SEQ ID NO: 198820 - DNA, 25 bp, Mus musculus
agggatttctctggagctctcttga

SEQ ID NO: 198821 - DNA, 25 bp, Mus musculus
agggatttctgcaaagtgttcttca

SEQ ID NO: 198822 - DNA, 25 bp, Mus musculus
agggatttctgctaagtgttcttca

SEQ ID NO: 198823 - DNA, 25 bp, Mus musculus
agggatttgcctcttggtcttggac

SEQ ID NO: 198824 - DNA, 25 bp, Mus musculus
agggatttgcctgttggtcttggac

SEQ ID NO: 198825 - DNA, 25 bp, Mus musculus
agggatttgctgagagaattcttat

SEQ ID NO: 198826 - DNA, 25 bp, Mus musculus
agggatttgctgtgagaattcttat

SEQ ID NO: 198827 - DNA, 25 bp, Mus musculus
agggatttgggcactctacacacat

SEQ ID NO: 198828 - DNA, 25 bp, Mus musculus
agggatttgggctctctacacacat

SEQ ID NO: 198829 - DNA, 25 bp, Mus musculus
agggatttgtgtaggctttgctctc

SEQ ID NO: 198830 - DNA, 25 bp, Mus musculus
agggatttgtgttggctttgctctc

SEQ ID NO: 198831 - DNA, 25 bp, Mus musculus
agggattttctgactcctgactcag

SEQ ID NO: 198832 - DNA, 25 bp, Mus musculus
agggattttctgtctcctgactcag

SEQ ID NO: 198833 - DNA, 25 bp, Mus musculus
agggattttgccaacactcacatgt

SEQ ID NO: 198834 - DNA, 25 bp, Mus musculus
agggattttgcctacactcacatgt

SEQ ID NO: 198835 - DNA, 25 bp, Mus musculus
agggatttttaccacagacttgcct

SEQ ID NO: 198836 - DNA, 25 bp, Mus musculus
agggatttttacgacagacttgcct

SEQ ID NO: 198837 - DNA, 25 bp, Mus musculus
agggcaaaagcacctcctcttcctg

SEQ ID NO: 198838 - DNA, 25 bp, Mus musculus
agggcaaaagcagctcctcttcctg

SEQ ID NO: 198839 - DNA, 25 bp, Mus musculus
agggcaaaagccagcatatctcctg

SEQ ID NO: 198840 - DNA, 25 bp, Mus musculus
agggcaaaagcctgcatatctcctg

SEQ ID NO: 198841 - DNA, 25 bp, Mus musculus
agggcaaacttaacacccagagcct

SEQ ID NO: 198842 - DNA, 25 bp, Mus musculus
agggcaaacttatcacccagagcct

SEQ ID NO: 198843 - DNA, 25 bp, Mus musculus
agggcaaagaccagcatttccccgt

SEQ ID NO: 198844 - DNA, 25 bp, Mus musculus
agggcaaagacctgcatttccccgt

SEQ ID NO: 198845 - DNA, 25 bp, Mus musculus
agggcaaaggaaactcacccgttct

SEQ ID NO: 198846 - DNA, 25 bp, Mus musculus
agggcaaaggaatctcacccgttct

SEQ ID NO: 198847 - DNA, 25 bp, Mus musculus
agggcaaagtccaggtctagtttca

SEQ ID NO: 198848 - DNA, 25 bp, Mus musculus
agggcaaagtcctggtctagtttca

SEQ ID NO: 198849 - DNA, 25 bp, Mus musculus
agggcaaatctacagcaggctctcc

SEQ ID NO: 198850 - DNA, 25 bp, Mus musculus
agggcaaatctagagcaggctctcc

SEQ ID NO: 198851 - DNA, 25 bp, Mus musculus
agggcaaatctcactgtaacgttca

SEQ ID NO: 198852 - DNA, 25 bp, Mus musculus
agggcaaatctctctgtaacgttca

SEQ ID NO: 198853 - DNA, 25 bp, Mus musculus
agggcaaattatcctgtcatgaact

SEQ ID NO: 198854 - DNA, 25 bp, Mus musculus
agggcaaattatgctgtcatgaact

SEQ ID NO: 198855 - DNA, 25 bp, Mus musculus
agggcaaattggcaacctctgtgcc

SEQ ID NO: 198856 - DNA, 25 bp, Mus musculus
agggcaaattgggaacctctgtgcc

SEQ ID NO: 198857 - DNA, 25 bp, Mus musculus
agggcaacaacacggtatctgagaa

SEQ ID NO: 198858 - DNA, 25 bp, Mus musculus
agggcaacaacagggtatctgagaa

SEQ ID NO: 198859 - DNA, 25 bp, Mus musculus
agggcaacacggaagggctgcagaa

SEQ ID NO: 198860 - DNA, 25 bp, Mus musculus
agggcaacacggtagggctgcagaa

SEQ ID NO: 198861 - DNA, 25 bp, Mus musculus
agggcaacagccacacaggtcactg

SEQ ID NO: 198862 - DNA, 25 bp, Mus musculus
agggcaacagcctcacaggtcactg

SEQ ID NO: 198863 - DNA, 25 bp, Mus musculus
agggcaacatacacacttaccatag

SEQ ID NO: 198864 - DNA, 25 bp, Mus musculus
agggcaacatactcacttaccatag

SEQ ID NO: 198865 - DNA, 25 bp, Mus musculus
agggcaaccagcagctccagatgtg

SEQ ID NO: 198866 - DNA, 25 bp, Mus musculus
agggcaaccagctgctccagatgtg

SEQ ID NO: 198867 - DNA, 25 bp, Mus musculus
agggcaaccgtgaggacggctattt

SEQ ID NO: 198868 - DNA, 25 bp, Mus musculus
agggcaaccgtgtggacggctattt

SEQ ID NO: 198869 - DNA, 25 bp, Mus musculus
agggcaacctatcatttgactggta

SEQ ID NO: 198870 - DNA, 25 bp, Mus musculus
agggcaacctatgatttgactggta

SEQ ID NO: 198871 - DNA, 25 bp, Mus musculus
agggcaacgtaacgctctgtccagt

SEQ ID NO: 198872 - DNA, 25 bp, Mus musculus
agggcaacgtaaggctctgtccagt

SEQ ID NO: 198873 - DNA, 25 bp, Mus musculus
agggcaacgtggattctcaagagca

SEQ ID NO: 198874 - DNA, 25 bp, Mus musculus
agggcaacgtggtttctcaagagca

SEQ ID NO: 198875 - DNA, 25 bp, Mus musculus
agggcaacgtttacagctccagcag

SEQ ID NO: 198876 - DNA, 25 bp, Mus musculus
agggcaacgttttcagctccagcag

SEQ ID NO: 198877 - DNA, 25 bp, Mus musculus
agggcaactcccaatggtgctaagt

SEQ ID NO: 198878 - DNA, 25 bp, Mus musculus
agggcaactccctatggtgctaagt

SEQ ID NO: 198879 - DNA, 25 bp, Mus musculus
agggcaactggcacccctggctatg

SEQ ID NO: 198880 - DNA, 25 bp, Mus musculus
agggcaactggctcccctggctatg

SEQ ID NO: 198881 - DNA, 25 bp, Mus musculus
agggcaagcactacacagggcggaa

SEQ ID NO: 198882 - DNA, 25 bp, Mus musculus
agggcaagcacttcacagggcggaa

SEQ ID NO: 198883 - DNA, 25 bp, Mus musculus
agggcaagcagaaattagtttataa

SEQ ID NO: 198884 - DNA, 25 bp, Mus musculus
agggcaagcagatattagtttataa

SEQ ID NO: 198885 - DNA, 25 bp, Mus musculus
agggcaagcattacaccctgagcct

SEQ ID NO: 198886 - DNA, 25 bp, Mus musculus
agggcaagcatttcaccctgagcct

SEQ ID NO: 198887 - DNA, 25 bp, Mus musculus
agggcaaggactcacacagccacct

SEQ ID NO: 198888 - DNA, 25 bp, Mus musculus
agggcaaggactgacacagccacct

SEQ ID NO: 198889 - DNA, 25 bp, Mus musculus
agggcaaggatcacttcactctgga

SEQ ID NO: 198890 - DNA, 25 bp, Mus musculus
agggcaaggatctcttcactctgga

SEQ ID NO: 198891 - DNA, 25 bp, Mus musculus
agggcaaggctgcaccctatcactg

SEQ ID NO: 198892 - DNA, 25 bp, Mus musculus
agggcaaggctggaccctatcactg

SEQ ID NO: 198893 - DNA, 25 bp, Mus musculus
agggcaaggtatcccagtcagagca

SEQ ID NO: 198894 - DNA, 25 bp, Mus musculus
agggcaaggtatgccagtcagagca

SEQ ID NO: 198895 - DNA, 25 bp, Mus musculus
agggcaagtaccacatcctcaagga

SEQ ID NO: 198896 - DNA, 25 bp, Mus musculus
agggcaagtacctcatcctcaagga

SEQ ID NO: 198897 - DNA, 25 bp, Mus musculus
agggcaagtggtcaatccagcgctc

SEQ ID NO: 198898 - DNA, 25 bp, Mus musculus
agggcaagtggtgaatccagcgctc

SEQ ID NO: 198899 - DNA, 25 bp, Mus musculus
agggcaatatccctcttcagatatc

SEQ ID NO: 198900 - DNA, 25 bp, Mus musculus
agggcaatatccgtcttcagatatc

SEQ ID NO: 198901 - DNA, 25 bp, Mus musculus
agggcaatatttaactgctagcttg

SEQ ID NO: 198902 - DNA, 25 bp, Mus musculus
agggcaatattttactgctagcttg

SEQ ID NO: 198903 - DNA, 25 bp, Mus musculus
agggcaatcactctgtatttccttt

SEQ ID NO: 198904 - DNA, 25 bp, Mus musculus
agggcaatcactgtgtatttccttt

SEQ ID NO: 198905 - DNA, 25 bp, Mus musculus
agggcaatcaggatgtcttgaacat

SEQ ID NO: 198906 - DNA, 25 bp, Mus musculus
agggcaatcaggttgtcttgaacat

SEQ ID NO: 198907 - DNA, 25 bp, Mus musculus
agggcaatccagcactgtgcactaa

SEQ ID NO: 198908 - DNA, 25 bp, Mus musculus
agggcaatccaggactgtgcactaa

SEQ ID NO: 198909 - DNA, 25 bp, Mus musculus
agggcaatccttatctactgcatgt

SEQ ID NO: 198910 - DNA, 25 bp, Mus musculus
agggcaatccttttctactgcatgt

SEQ ID NO: 198911 - DNA, 25 bp, Mus musculus
agggcaatctagctcactgcaggaa

SEQ ID NO: 198912 - DNA, 25 bp, Mus musculus
agggcaatctaggtcactgcaggaa

SEQ ID NO: 198913 - DNA, 25 bp, Mus musculus
agggcaatctccaaaagcactgatt

SEQ ID NO: 198914 - DNA, 25 bp, Mus musculus
agggcaatctcctaaagcactgatt

SEQ ID NO: 198915 - DNA, 25 bp, Mus musculus
agggcaatgaaaactcaacagcttt

SEQ ID NO: 198916 - DNA, 25 bp, Mus musculus
agggcaatgaaatctcaacagcttt

SEQ ID NO: 198917 - DNA, 25 bp, Mus musculus
agggcaatgattccttcctcgtctc

SEQ ID NO: 198918 - DNA, 25 bp, Mus musculus
agggcaatgattgcttcctcgtctc

SEQ ID NO: 198919 - DNA, 25 bp, Mus musculus
agggcaatgcatcacaccaaccttg

SEQ ID NO: 198920 - DNA, 25 bp, Mus musculus
agggcaatgcatgacaccaaccttg

SEQ ID NO: 198921 - DNA, 25 bp, Mus musculus
agggcaatgctcctgtcagtgttca

SEQ ID NO: 198922 - DNA, 25 bp, Mus musculus
agggcaatgctcgtgtcagtgttca

SEQ ID NO: 198923 - DNA, 25 bp, Mus musculus
agggcaatgtctatgccacatctgc

SEQ ID NO: 198924 - DNA, 25 bp, Mus musculus
agggcaatgtctttgccacatctgc

SEQ ID NO: 198925 - DNA, 25 bp, Mus musculus
agggcaattacaagctgacgtgctc

SEQ ID NO: 198926 - DNA, 25 bp, Mus musculus
agggcaattacatgctgacgtgctc

SEQ ID NO: 198927 - DNA, 25 bp, Mus musculus
agggcaattgtaagtttctagtgta

SEQ ID NO: 198928 - DNA, 25 bp, Mus musculus
agggcaattgtatgtttctagtgta

SEQ ID NO: 198929 - DNA, 25 bp, Mus musculus
agggcacaaaaactcactctaggtt

SEQ ID NO: 198930 - DNA, 25 bp, Mus musculus
agggcacaaaaagtcactctaggtt

SEQ ID NO: 198931 - DNA, 25 bp, Mus musculus
agggcacaaattccgcttcttgtaa

SEQ ID NO: 198932 - DNA, 25 bp, Mus musculus
agggcacaaattgcgcttcttgtaa

SEQ ID NO: 198933 - DNA, 25 bp, Mus musculus
agggcacaacccacttgatagaaat

SEQ ID NO: 198934 - DNA, 25 bp, Mus musculus
agggcacaaccctcttgatagaaat

SEQ ID NO: 198935 - DNA, 25 bp, Mus musculus
agggcacaagccagagactcacacg

SEQ ID NO: 198936 - DNA, 25 bp, Mus musculus
agggcacaagcctgagactcacacg

SEQ ID NO: 198937 - DNA, 25 bp, Mus musculus
agggcacacagaagccttggctctg

SEQ ID NO: 198938 - DNA, 25 bp, Mus musculus
agggcacacagatgccttggctctg

SEQ ID NO: 198939 - DNA, 25 bp, Mus musculus
agggcacacccgagttccctgcagt

SEQ ID NO: 198940 - DNA, 25 bp, Mus musculus
agggcacacccgattggtaaccatg

SEQ ID NO: 198941 - DNA, 25 bp, Mus musculus
agggcacacccgtgttccctgcagt

SEQ ID NO: 198942 - DNA, 25 bp, Mus musculus
agggcacacccgtttggtaaccatg

SEQ ID NO: 198943 - DNA, 25 bp, Mus musculus
agggcacacgcaacacctttgagaa

SEQ ID NO: 198944 - DNA, 25 bp, Mus musculus
agggcacacgcatcacctttgagaa

SEQ ID NO: 198945 - DNA, 25 bp, Mus musculus
agggcacactgtcttgaactctgaa

SEQ ID NO: 198946 - DNA, 25 bp, Mus musculus
agggcacactgtgttgaactctgaa

SEQ ID NO: 198947 - DNA, 25 bp, Mus musculus
agggcacagaatcctctttagtctt

SEQ ID NO: 198948 - DNA, 25 bp, Mus musculus
agggcacagaatgctctttagtctt

SEQ ID NO: 198949 - DNA, 25 bp, Mus musculus
agggcacagcagaatagtggaccaa

SEQ ID NO: 198950 - DNA, 25 bp, Mus musculus
agggcacagcagtatagtggaccaa

SEQ ID NO: 198951 - DNA, 25 bp, Mus musculus
agggcacagcctactttggtatgag

SEQ ID NO: 198952 - DNA, 25 bp, Mus musculus
agggcacagccttctttggtatgag

SEQ ID NO: 198953 - DNA, 25 bp, Mus musculus
agggcacaggacaacctctggagtc

SEQ ID NO: 198954 - DNA, 25 bp, Mus musculus
agggcacaggactacctctggagtc

SEQ ID NO: 198955 - DNA, 25 bp, Mus musculus
agggcacaggagactgaccacaggc

SEQ ID NO: 198956 - DNA, 25 bp, Mus musculus
agggcacaggagtctgaccacaggc

SEQ ID NO: 198957 - DNA, 25 bp, Mus musculus
agggcacaggctagacctcatggaa

SEQ ID NO: 198958 - DNA, 25 bp, Mus musculus
agggcacaggcttgacctcatggaa

SEQ ID NO: 198959 - DNA, 25 bp, Mus musculus
agggcacatagtaaaggtgtcacct

SEQ ID NO: 198960 - DNA, 25 bp, Mus musculus
agggcacatagttaaggtgtcacct

SEQ ID NO: 198961 - DNA, 25 bp, Mus musculus
agggcacatcagaattttatagttg

SEQ ID NO: 198962 - DNA, 25 bp, Mus musculus
agggcacatcagtattttatagttg

SEQ ID NO: 198963 - DNA, 25 bp, Mus musculus
agggcacatcataagcatgaggcaa

SEQ ID NO: 198964 - DNA, 25 bp, Mus musculus
agggcacatcattagcatgaggcaa

SEQ ID NO: 198965 - DNA, 25 bp, Mus musculus
agggcacatgctagcctctcattgt

SEQ ID NO: 198966 - DNA, 25 bp, Mus musculus
agggcacatgcttgcctctcattgt

SEQ ID NO: 198967 - DNA, 25 bp, Mus musculus
agggcacattttacaatgattaact

SEQ ID NO: 198968 - DNA, 25 bp, Mus musculus
agggcacattttaccagacatcagt

SEQ ID NO: 198969 - DNA, 25 bp, Mus musculus
agggcacatttttcaatgattaact

SEQ ID NO: 198970 - DNA, 25 bp, Mus musculus
agggcacatttttccagacatcagt

SEQ ID NO: 198971 - DNA, 25 bp, Mus musculus
agggcaccaagcatgttggtggtac

SEQ ID NO: 198972 - DNA, 25 bp, Mus musculus
agggcaccaagccagcatactgcat

SEQ ID NO: 198973 - DNA, 25 bp, Mus musculus
agggcaccaagcgagcatactgcat

SEQ ID NO: 198974 - DNA, 25 bp, Mus musculus
agggcaccaagcttgttggtggtac

SEQ ID NO: 198975 - DNA, 25 bp, Mus musculus
agggcaccaagtacagcaccaaaga

SEQ ID NO: 198976 - DNA, 25 bp, Mus musculus
agggcaccaagttcagcaccaaaga

SEQ ID NO: 198977 - DNA, 25 bp, Mus musculus
agggcaccacaccaatgctgcagat

SEQ ID NO: 198978 - DNA, 25 bp, Mus musculus
agggcaccacacgaatgctgcagat

SEQ ID NO: 198979 - DNA, 25 bp, Mus musculus
agggcaccatcaaaaagcagttctt

SEQ ID NO: 198980 - DNA, 25 bp, Mus musculus
agggcaccatcataaagcagttctt

SEQ ID NO: 198981 - DNA, 25 bp, Mus musculus
agggcaccctttctagtttgtagat

SEQ ID NO: 198982 - DNA, 25 bp, Mus musculus
agggcaccctttgtagtttgtagat

SEQ ID NO: 198983 - DNA, 25 bp, Mus musculus
agggcaccgcagagctgcaccgctg

SEQ ID NO: 198984 - DNA, 25 bp, Mus musculus
agggcaccgcagtgctgcaccgctg

SEQ ID NO: 198985 - DNA, 25 bp, Mus musculus
agggcacctaccaggatgtgggcaa

SEQ ID NO: 198986 - DNA, 25 bp, Mus musculus
agggcacctacctggatgtgggcaa

SEQ ID NO: 198987 - DNA, 25 bp, Mus musculus
agggcacctcaacttctgggacatt

SEQ ID NO: 198988 - DNA, 25 bp, Mus musculus
agggcacctcaagttctgggacatt

SEQ ID NO: 198989 - DNA, 25 bp, Mus musculus
agggcacctcctagactgtggacaa

SEQ ID NO: 198990 - DNA, 25 bp, Mus musculus
agggcacctccttgactgtggacaa

SEQ ID NO: 198991 - DNA, 25 bp, Mus musculus
agggcacctctgcagcaacatggcc

SEQ ID NO: 198992 - DNA, 25 bp, Mus musculus
agggcacctctggagcaacatggcc

SEQ ID NO: 198993 - DNA, 25 bp, Mus musculus
agggcacctggaatgttctgttatc

SEQ ID NO: 198994 - DNA, 25 bp, Mus musculus
agggcacctggattgttctgttatc

SEQ ID NO: 198995 - DNA, 25 bp, Mus musculus
agggcacctggtactgggcagctca

SEQ ID NO: 198996 - DNA, 25 bp, Mus musculus
agggcacctggttctgggcagctca

SEQ ID NO: 198997 - DNA, 25 bp, Mus musculus
agggcacctgtcagccgaaggaatt

SEQ ID NO: 198998 - DNA, 25 bp, Mus musculus
agggcacctgtctgccgaaggaatt

SEQ ID NO: 198999 - DNA, 25 bp, Mus musculus
agggcacctgtgctaggcgcttcct

SEQ ID NO: 199000 - DNA, 25 bp, Mus musculus
agggcacctgtggtaggcgcttcct

SEQ ID NO: 199001 - DNA, 25 bp, Mus musculus
agggcacctgttctggagccttaaa

SEQ ID NO: 199002 - DNA, 25 bp, Mus musculus
agggcacctgttgtggagccttaaa

SEQ ID NO: 199003 - DNA, 25 bp, Mus musculus
agggcacgccatatctgtagttcat

SEQ ID NO: 199004 - DNA, 25 bp, Mus musculus
agggcacgccatttctgtagttcat

SEQ ID NO: 199005 - DNA, 25 bp, Mus musculus
agggcacgccttatcattgtatttt

SEQ ID NO: 199006 - DNA, 25 bp, Mus musculus
agggcacgccttttcattgtatttt

SEQ ID NO: 199007 - DNA, 25 bp, Mus musculus
agggcacggaacactgccttactta

SEQ ID NO: 199008 - DNA, 25 bp, Mus musculus
agggcacggaactctgccttactta

SEQ ID NO: 199009 - DNA, 25 bp, Mus musculus
agggcacggacacagactcttcagg

SEQ ID NO: 199010 - DNA, 25 bp, Mus musculus
agggcacggacagagactcttcagg

SEQ ID NO: 199011 - DNA, 25 bp, Mus musculus
agggcacggcctattccagataggt

SEQ ID NO: 199012 - DNA, 25 bp, Mus musculus
agggcacggccttttccagataggt

SEQ ID NO: 199013 - DNA, 25 bp, Mus musculus
agggcacgggaaccaccagcagcca

SEQ ID NO: 199014 - DNA, 25 bp, Mus musculus
agggcacgggaagcaccagcagcca

SEQ ID NO: 199015 - DNA, 25 bp, Mus musculus
agggcacgtgagaaagtatcccgtt

SEQ ID NO: 199016 - DNA, 25 bp, Mus musculus
agggcacgtgagtaagtatcccgtt

SEQ ID NO: 199017 - DNA, 25 bp, Mus musculus
agggcacgtttcatgcagcatatga

SEQ ID NO: 199018 - DNA, 25 bp, Mus musculus
agggcacgtttcttgcagcatatga

SEQ ID NO: 199019 - DNA, 25 bp, Mus musculus
agggcactaaccctatgttgcacac

SEQ ID NO: 199020 - DNA, 25 bp, Mus musculus
agggcactaaccgtatgttgcacac

SEQ ID NO: 199021 - DNA, 25 bp, Mus musculus
agggcactaagaatcgcacatatga

SEQ ID NO: 199022 - DNA, 25 bp, Mus musculus
agggcactaagattcgcacatatga

SEQ ID NO: 199023 - DNA, 25 bp, Mus musculus
agggcactcactcagggcctaattc

SEQ ID NO: 199024 - DNA, 25 bp, Mus musculus
agggcactcactgagggcctaattc

SEQ ID NO: 199025 - DNA, 25 bp, Mus musculus
agggcactcgtgcacatttatcctc

SEQ ID NO: 199026 - DNA, 25 bp, Mus musculus
agggcactcgtggacatttatcctc

SEQ ID NO: 199027 - DNA, 25 bp, Mus musculus
agggcactgaagatggatgctttag

SEQ ID NO: 199028 - DNA, 25 bp, Mus musculus
agggcactgaagttggatgctttag

SEQ ID NO: 199029 - DNA, 25 bp, Mus musculus
agggcactgacaaatgctgctacct

SEQ ID NO: 199030 - DNA, 25 bp, Mus musculus
agggcactgacatatgctgctacct

SEQ ID NO: 199031 - DNA, 25 bp, Mus musculus
agggcactgactagctcaagctgac

SEQ ID NO: 199032 - DNA, 25 bp, Mus musculus
agggcactgactcatagcgaacact

SEQ ID NO: 199033 - DNA, 25 bp, Mus musculus
agggcactgactgatagcgaacact

SEQ ID NO: 199034 - DNA, 25 bp, Mus musculus
agggcactgacttgctcaagctgac

SEQ ID NO: 199035 - DNA, 25 bp, Mus musculus
agggcactgataacactgtgaacag

SEQ ID NO: 199036 - DNA, 25 bp, Mus musculus
agggcactgatatcactgtgaacag

SEQ ID NO: 199037 - DNA, 25 bp, Mus musculus
agggcactgcctaatgtcatactca

SEQ ID NO: 199038 - DNA, 25 bp, Mus musculus
agggcactgcctatcacagagaaga

SEQ ID NO: 199039 - DNA, 25 bp, Mus musculus
agggcactgcctcactgactgaaag

SEQ ID NO: 199040 - DNA, 25 bp, Mus musculus
agggcactgcctgactgactgaaag

SEQ ID NO: 199041 - DNA, 25 bp, Mus musculus
agggcactgccttatgtcatactca

SEQ ID NO: 199042 - DNA, 25 bp, Mus musculus
agggcactgcctttcacagagaaga

SEQ ID NO: 199043 - DNA, 25 bp, Mus musculus
agggcactgcttaagatctagcggg

SEQ ID NO: 199044 - DNA, 25 bp, Mus musculus
agggcactgctttagatctagcggg

SEQ ID NO: 199045 - DNA, 25 bp, Mus musculus
agggcactggacagctgggccacat

SEQ ID NO: 199046 - DNA, 25 bp, Mus musculus
agggcactggactgctgggccacat

SEQ ID NO: 199047 - DNA, 25 bp, Mus musculus
agggcactggctaattactcttctg

SEQ ID NO: 199048 - DNA, 25 bp, Mus musculus
agggcactggcttattactcttctg

SEQ ID NO: 199049 - DNA, 25 bp, Mus musculus
agggcactgggaattaagatatgac

SEQ ID NO: 199050 - DNA, 25 bp, Mus musculus
agggcactgggatttaagatatgac

SEQ ID NO: 199051 - DNA, 25 bp, Mus musculus
agggcactgtgaccacccaggaagt

SEQ ID NO: 199052 - DNA, 25 bp, Mus musculus
agggcactgtgagcacccaggaagt

SEQ ID NO: 199053 - DNA, 25 bp, Mus musculus
agggcactgtgcacagctagacctg

SEQ ID NO: 199054 - DNA, 25 bp, Mus musculus
agggcactgtgctcagctagacctg

SEQ ID NO: 199055 - DNA, 25 bp, Mus musculus
agggcacttcagctggcagagacca

SEQ ID NO: 199056 - DNA, 25 bp, Mus musculus
agggcacttcaggtggcagagacca

SEQ ID NO: 199057 - DNA, 25 bp, Mus musculus
agggcacttggcagtgggtttttct

SEQ ID NO: 199058 - DNA, 25 bp, Mus musculus
agggcacttggctgtgggtttttct

SEQ ID NO: 199059 - DNA, 25 bp, Mus musculus
agggcacttggtctccttgaagatg

SEQ ID NO: 199060 - DNA, 25 bp, Mus musculus
agggcacttggtgtccttgaagatg

SEQ ID NO: 199061 - DNA, 25 bp, Mus musculus
agggcactttcaattggacactcag

SEQ ID NO: 199062 - DNA, 25 bp, Mus musculus
agggcactttcatttggacactcag

SEQ ID NO: 199063 - DNA, 25 bp, Mus musculus
agggcactttgtaacaggtggccat

SEQ ID NO: 199064 - DNA, 25 bp, Mus musculus
agggcactttgttacaggtggccat

SEQ ID NO: 199065 - DNA, 25 bp, Mus musculus
agggcagaaaagctcctctattcaa

SEQ ID NO: 199066 - DNA, 25 bp, Mus musculus
agggcagaaaaggtcctctattcaa

SEQ ID NO: 199067 - DNA, 25 bp, Mus musculus
agggcagaaacacgcctctctaatt

SEQ ID NO: 199068 - DNA, 25 bp, Mus musculus
agggcagaaacaggcctctctaatt

SEQ ID NO: 199069 - DNA, 25 bp, Mus musculus
agggcagaacagagctcagcctctt

SEQ ID NO: 199070 - DNA, 25 bp, Mus musculus
agggcagaacagtgctcagcctctt

SEQ ID NO: 199071 - DNA, 25 bp, Mus musculus
agggcagaacatatgtcctctcagc

SEQ ID NO: 199072 - DNA, 25 bp, Mus musculus
agggcagaacatttgtcctctcagc

SEQ ID NO: 199073 - DNA, 25 bp, Mus musculus
agggcagacaatccatggctgatct

SEQ ID NO: 199074 - DNA, 25 bp, Mus musculus
agggcagacaatgcatggctgatct

SEQ ID NO: 199075 - DNA, 25 bp, Mus musculus
agggcagaccagatgcagagctgat

SEQ ID NO: 199076 - DNA, 25 bp, Mus musculus
agggcagaccagttgcagagctgat

SEQ ID NO: 199077 - DNA, 25 bp, Mus musculus
agggcagaccccaagagttggagat

SEQ ID NO: 199078 - DNA, 25 bp, Mus musculus
agggcagacccctagagttggagat

SEQ ID NO: 199079 - DNA, 25 bp, Mus musculus
agggcagacggtctgctcccttcct

SEQ ID NO: 199080 - DNA, 25 bp, Mus musculus
agggcagacggtgtgctcccttcct

SEQ ID NO: 199081 - DNA, 25 bp, Mus musculus
agggcagactccctcctgtggaaaa

SEQ ID NO: 199082 - DNA, 25 bp, Mus musculus
agggcagactccgtcctgtggaaaa

SEQ ID NO: 199083 - DNA, 25 bp, Mus musculus
agggcagagacgagccagccagcta

SEQ ID NO: 199084 - DNA, 25 bp, Mus musculus
agggcagagacgtgccagccagcta

SEQ ID NO: 199085 - DNA, 25 bp, Mus musculus
agggcagagactatctgtaccgctc

SEQ ID NO: 199086 - DNA, 25 bp, Mus musculus
agggcagagactttctgtaccgctc

SEQ ID NO: 199087 - DNA, 25 bp, Mus musculus
agggcagagccgacctgaagctgat

SEQ ID NO: 199088 - DNA, 25 bp, Mus musculus
agggcagagccgtcctgaagctgat

SEQ ID NO: 199089 - DNA, 25 bp, Mus musculus
agggcagatgagaagcttcctcctg

SEQ ID NO: 199090 - DNA, 25 bp, Mus musculus
agggcagatgagtagcttcctcctg

SEQ ID NO: 199091 - DNA, 25 bp, Mus musculus
agggcagatgttaatatttaatgga

SEQ ID NO: 199092 - DNA, 25 bp, Mus musculus
agggcagatgtttatatttaatgga

SEQ ID NO: 199093 - DNA, 25 bp, Mus musculus
agggcagcaacgatgcgtaccacag

SEQ ID NO: 199094 - DNA, 25 bp, Mus musculus
agggcagcaacgttgcgtaccacag

SEQ ID NO: 199095 - DNA, 25 bp, Mus musculus
agggcagcactcagcgactgaatta

SEQ ID NO: 199096 - DNA, 25 bp, Mus musculus
agggcagcactctgcgactgaatta

SEQ ID NO: 199097 - DNA, 25 bp, Mus musculus
agggcagcagacattggactcacgc

SEQ ID NO: 199098 - DNA, 25 bp, Mus musculus
agggcagcagactttggactcacgc

SEQ ID NO: 199099 - DNA, 25 bp, Mus musculus
agggcagcagatctccctggcacta

SEQ ID NO: 199100 - DNA, 25 bp, Mus musculus
agggcagcagatgtccctggcacta

SEQ ID NO: 199101 - DNA, 25 bp, Mus musculus
agggcagcagcactatctccacaat

SEQ ID NO: 199102 - DNA, 25 bp, Mus musculus
agggcagcagcagtatctccacaat

SEQ ID NO: 199103 - DNA, 25 bp, Mus musculus
agggcagcagctaaaacttgagtat

SEQ ID NO: 199104 - DNA, 25 bp, Mus musculus
agggcagcagcttaaacttgagtat

SEQ ID NO: 199105 - DNA, 25 bp, Mus musculus
agggcagcataaacccagctttcca

SEQ ID NO: 199106 - DNA, 25 bp, Mus musculus
agggcagcataatcccagctttcca

SEQ ID NO: 199107 - DNA, 25 bp, Mus musculus
agggcagcatacctggtttatttta

SEQ ID NO: 199108 - DNA, 25 bp, Mus musculus
agggcagcatacgtggtttatttta

SEQ ID NO: 199109 - DNA, 25 bp, Mus musculus
agggcagcatcactttggccctgaa

SEQ ID NO: 199110 - DNA, 25 bp, Mus musculus
agggcagcatcagtttggccctgaa

SEQ ID NO: 199111 - DNA, 25 bp, Mus musculus
agggcagcatccaaggatcctgtgg

SEQ ID NO: 199112 - DNA, 25 bp, Mus musculus
agggcagcatcctaggatcctgtgg

SEQ ID NO: 199113 - DNA, 25 bp, Mus musculus
agggcagcatctcggttctgcgcca

SEQ ID NO: 199114 - DNA, 25 bp, Mus musculus
agggcagcatctgggttctgcgcca

SEQ ID NO: 199115 - DNA, 25 bp, Mus musculus
agggcagcattgcagtcacaggcca

SEQ ID NO: 199116 - DNA, 25 bp, Mus musculus
agggcagcattggagtcacaggcca

SEQ ID NO: 199117 - DNA, 25 bp, Mus musculus
agggcagcccacagaatcagcctga

SEQ ID NO: 199118 - DNA, 25 bp, Mus musculus
agggcagcccactgaatcagcctga

SEQ ID NO: 199119 - DNA, 25 bp, Mus musculus
agggcagcccctacaagggccagct

SEQ ID NO: 199120 - DNA, 25 bp, Mus musculus
agggcagccccttcaagggccagct

SEQ ID NO: 199121 - DNA, 25 bp, Mus musculus
agggcagccctaagctactgatgtt

SEQ ID NO: 199122 - DNA, 25 bp, Mus musculus
agggcagccctatgctactgatgtt

SEQ ID NO: 199123 - DNA, 25 bp, Mus musculus
agggcagccctcctttgatgtgtgt

SEQ ID NO: 199124 - DNA, 25 bp, Mus musculus
agggcagccctcgtttgatgtgtgt

SEQ ID NO: 199125 - DNA, 25 bp, Mus musculus
agggcagccctgaacaactgataac

SEQ ID NO: 199126 - DNA, 25 bp, Mus musculus
agggcagccctgtacaactgataac

SEQ ID NO: 199127 - DNA, 25 bp, Mus musculus
agggcagcctaaagtccacttagaa

SEQ ID NO: 199128 - DNA, 25 bp, Mus musculus
agggcagcctaatgtccacttagaa

SEQ ID NO: 199129 - DNA, 25 bp, Mus musculus
agggcagcctcaaaagacaccatat

SEQ ID NO: 199130 - DNA, 25 bp, Mus musculus
agggcagcctcataagacaccatat

SEQ ID NO: 199131 - DNA, 25 bp, Mus musculus
agggcagcctctcagatcatcagtg

SEQ ID NO: 199132 - DNA, 25 bp, Mus musculus
agggcagcctctgagatcatcagtg

SEQ ID NO: 199133 - DNA, 25 bp, Mus musculus
agggcagcctggcacacttggcttt

SEQ ID NO: 199134 - DNA, 25 bp, Mus musculus
agggcagcctgggacacttggcttt

SEQ ID NO: 199135 - DNA, 25 bp, Mus musculus
agggcagccttgctgcagtttcatt

SEQ ID NO: 199136 - DNA, 25 bp, Mus musculus
agggcagccttggtgcagtttcatt

SEQ ID NO: 199137 - DNA, 25 bp, Mus musculus
agggcagcgactacctgatcgcgct

SEQ ID NO: 199138 - DNA, 25 bp, Mus musculus
agggcagcgacttcctgatcgcgct

SEQ ID NO: 199139 - DNA, 25 bp, Mus musculus
agggcagcgcaaaactctcagaacc

SEQ ID NO: 199140 - DNA, 25 bp, Mus musculus
agggcagcgcaatactctcagaacc

SEQ ID NO: 199141 - DNA, 25 bp, Mus musculus
agggcagcgccaaccgcagagcaga

SEQ ID NO: 199142 - DNA, 25 bp, Mus musculus
agggcagcgccatccgcagagcaga

SEQ ID NO: 199143 - DNA, 25 bp, Mus musculus
agggcagcgctgaactggaaagatt

SEQ ID NO: 199144 - DNA, 25 bp, Mus musculus
agggcagcgctgtactggaaagatt

SEQ ID NO: 199145 - DNA, 25 bp, Mus musculus
agggcagcggccatcagttaagtga

SEQ ID NO: 199146 - DNA, 25 bp, Mus musculus
agggcagcggccttcagttaagtga

SEQ ID NO: 199147 - DNA, 25 bp, Mus musculus
agggcagcgtgacgtcttgtcatca

SEQ ID NO: 199148 - DNA, 25 bp, Mus musculus
agggcagcgtgaggtcttgtcatca

SEQ ID NO: 199149 - DNA, 25 bp, Mus musculus
agggcagctaagattttcttcccag

SEQ ID NO: 199150 - DNA, 25 bp, Mus musculus
agggcagctaagtttttcttcccag

SEQ ID NO: 199151 - DNA, 25 bp, Mus musculus
agggcagctccacacgagggctcac

SEQ ID NO: 199152 - DNA, 25 bp, Mus musculus
agggcagctccagacgagggctcac

SEQ ID NO: 199153 - DNA, 25 bp, Mus musculus
agggcagctcctagttgatatattt

SEQ ID NO: 199154 - DNA, 25 bp, Mus musculus
agggcagctccttgttgatatattt

SEQ ID NO: 199155 - DNA, 25 bp, Mus musculus
agggcagctgcaaaaggtaacaaca

SEQ ID NO: 199156 - DNA, 25 bp, Mus musculus
agggcagctgcaagcctgaagccag

SEQ ID NO: 199157 - DNA, 25 bp, Mus musculus
agggcagctgcactgctgtatttat

SEQ ID NO: 199158 - DNA, 25 bp, Mus musculus
agggcagctgcagtgctgtatttat

SEQ ID NO: 199159 - DNA, 25 bp, Mus musculus
agggcagctgcataaggtaacaaca

SEQ ID NO: 199160 - DNA, 25 bp, Mus musculus
agggcagctgcatgcctgaagccag

SEQ ID NO: 199161 - DNA, 25 bp, Mus musculus
agggcagctgtcaaaccctcttggt

SEQ ID NO: 199162 - DNA, 25 bp, Mus musculus
agggcagctgtctaaccctcttggt

SEQ ID NO: 199163 - DNA, 25 bp, Mus musculus
agggcagctgtgacatttcataagt

SEQ ID NO: 199164 - DNA, 25 bp, Mus musculus
agggcagctgtgtcatttcataagt

SEQ ID NO: 199165 - DNA, 25 bp, Mus musculus
agggcagcttggatactcgggttac

SEQ ID NO: 199166 - DNA, 25 bp, Mus musculus
agggcagcttggttactcgggttac

SEQ ID NO: 199167 - DNA, 25 bp, Mus musculus
agggcaggaactctcgtgttacttc

SEQ ID NO: 199168 - DNA, 25 bp, Mus musculus
agggcaggaactgtcgtgttacttc

SEQ ID NO: 199169 - DNA, 25 bp, Mus musculus
agggcaggatatctcttgcttccag

SEQ ID NO: 199170 - DNA, 25 bp, Mus musculus
agggcaggatatgtcttgcttccag

SEQ ID NO: 199171 - DNA, 25 bp, Mus musculus
agggcaggcaacacctgagtcggcc

SEQ ID NO: 199172 - DNA, 25 bp, Mus musculus
agggcaggcaacaggcaccctgcag

SEQ ID NO: 199173 - DNA, 25 bp, Mus musculus
agggcaggcaactcctgagtcggcc

SEQ ID NO: 199174 - DNA, 25 bp, Mus musculus
agggcaggcaactggcaccctgcag

SEQ ID NO: 199175 - DNA, 25 bp, Mus musculus
agggcaggcactatgtaaacattat

SEQ ID NO: 199176 - DNA, 25 bp, Mus musculus
agggcaggcactttgtaaacattat

SEQ ID NO: 199177 - DNA, 25 bp, Mus musculus
agggcagggaaccagatcagtcttc

SEQ ID NO: 199178 - DNA, 25 bp, Mus musculus
agggcagggaacgagatcagtcttc

SEQ ID NO: 199179 - DNA, 25 bp, Mus musculus
agggcagggcctaagcaccatacag

SEQ ID NO: 199180 - DNA, 25 bp, Mus musculus
agggcagggccttagcaccatacag

SEQ ID NO: 199181 - DNA, 25 bp, Mus musculus
agggcagggctgaatcctctcattt

SEQ ID NO: 199182 - DNA, 25 bp, Mus musculus
agggcagggctgtatcctctcattt

SEQ ID NO: 199183 - DNA, 25 bp, Mus musculus
agggcaggtatcatccagagtttcc

SEQ ID NO: 199184 - DNA, 25 bp, Mus musculus
agggcaggtatcttccagagtttcc

SEQ ID NO: 199185 - DNA, 25 bp, Mus musculus
agggcaggtccaacggttcatgtgt

SEQ ID NO: 199186 - DNA, 25 bp, Mus musculus
agggcaggtccatcggttcatgtgt

SEQ ID NO: 199187 - DNA, 25 bp, Mus musculus
agggcaggtgacacagccacccagt

SEQ ID NO: 199188 - DNA, 25 bp, Mus musculus
agggcaggtgactcagccacccagt

SEQ ID NO: 199189 - DNA, 25 bp, Mus musculus
agggcaggtgccattctcaggcatg

SEQ ID NO: 199190 - DNA, 25 bp, Mus musculus
agggcaggtgcctttctcaggcatg

SEQ ID NO: 199191 - DNA, 25 bp, Mus musculus
agggcaggttctatcggcgctgttt

SEQ ID NO: 199192 - DNA, 25 bp, Mus musculus
agggcaggttctttcggcgctgttt

SEQ ID NO: 199193 - DNA, 25 bp, Mus musculus
agggcagtcaccaagccactgcttc

SEQ ID NO: 199194 - DNA, 25 bp, Mus musculus
agggcagtcaccaccaggcataggg

SEQ ID NO: 199195 - DNA, 25 bp, Mus musculus
agggcagtcacctagccactgcttc

SEQ ID NO: 199196 - DNA, 25 bp, Mus musculus
agggcagtcacctccaggcataggg

SEQ ID NO: 199197 - DNA, 25 bp, Mus musculus
agggcagtcatgcacacaacccaga

SEQ ID NO: 199198 - DNA, 25 bp, Mus musculus
agggcagtcatggacacaacccaga

SEQ ID NO: 199199 - DNA, 25 bp, Mus musculus
agggcagtcattactggctaggcaa

SEQ ID NO: 199200 - DNA, 25 bp, Mus musculus
agggcagtcattcccaggagacaca

SEQ ID NO: 199201 - DNA, 25 bp, Mus musculus
agggcagtcattgccaggagacaca

SEQ ID NO: 199202 - DNA, 25 bp, Mus musculus
agggcagtcatttctggctaggcaa

SEQ ID NO: 199203 - DNA, 25 bp, Mus musculus
agggcagtccacattgtgctgcaca

SEQ ID NO: 199204 - DNA, 25 bp, Mus musculus
agggcagtccactttgtgctgcaca

SEQ ID NO: 199205 - DNA, 25 bp, Mus musculus
agggcagtccatactaaatctagca

SEQ ID NO: 199206 - DNA, 25 bp, Mus musculus
agggcagtccattctaaatctagca

SEQ ID NO: 199207 - DNA, 25 bp, Mus musculus
agggcagtccggatactaagcgaga

SEQ ID NO: 199208 - DNA, 25 bp, Mus musculus
agggcagtccggttactaagcgaga

SEQ ID NO: 199209 - DNA, 25 bp, Mus musculus
agggcagtccttccattaatagtgc

SEQ ID NO: 199210 - DNA, 25 bp, Mus musculus
agggcagtccttgcattaatagtgc

SEQ ID NO: 199211 - DNA, 25 bp, Mus musculus
agggcagtctggagctagccactct

SEQ ID NO: 199212 - DNA, 25 bp, Mus musculus
agggcagtctggtgctagccactct

SEQ ID NO: 199213 - DNA, 25 bp, Mus musculus
agggcagtctgtccacgtcatttgt

SEQ ID NO: 199214 - DNA, 25 bp, Mus musculus
agggcagtctgtgcacgtcatttgt

SEQ ID NO: 199215 - DNA, 25 bp, Mus musculus
agggcagtcttacataattttggat

SEQ ID NO: 199216 - DNA, 25 bp, Mus musculus
agggcagtcttagataattttggat

SEQ ID NO: 199217 - DNA, 25 bp, Mus musculus
agggcagtgcctcagcccctgcagt

SEQ ID NO: 199218 - DNA, 25 bp, Mus musculus
agggcagtgcctgagcccctgcagt

SEQ ID NO: 199219 - DNA, 25 bp, Mus musculus
agggcagtgcttacactctgccgtc

SEQ ID NO: 199220 - DNA, 25 bp, Mus musculus
agggcagtgctttcactctgccgtc

SEQ ID NO: 199221 - DNA, 25 bp, Mus musculus
agggcagtggccacatcagtctgcc

SEQ ID NO: 199222 - DNA, 25 bp, Mus musculus
agggcagtggcctcatcagtctgcc

SEQ ID NO: 199223 - DNA, 25 bp, Mus musculus
agggcagtgtcccttccacaacttg

SEQ ID NO: 199224 - DNA, 25 bp, Mus musculus
agggcagtgtccgttccacaacttg

SEQ ID NO: 199225 - DNA, 25 bp, Mus musculus
agggcagtgtggatcccatgaaact

SEQ ID NO: 199226 - DNA, 25 bp, Mus musculus
agggcagtgtggttcccatgaaact

SEQ ID NO: 199227 - DNA, 25 bp, Mus musculus
agggcagttcagagtctcatgatcc

SEQ ID NO: 199228 - DNA, 25 bp, Mus musculus
agggcagttcagtgtctcatgatcc

SEQ ID NO: 199229 - DNA, 25 bp, Mus musculus
agggcagttcctacagatgaagcaa

SEQ ID NO: 199230 - DNA, 25 bp, Mus musculus
agggcagttccttcagatgaagcaa

SEQ ID NO: 199231 - DNA, 25 bp, Mus musculus
agggcagttctaataaaactctatt

SEQ ID NO: 199232 - DNA, 25 bp, Mus musculus
agggcagttctattaaaactctatt

SEQ ID NO: 199233 - DNA, 25 bp, Mus musculus
agggcagttttcagcttcccttagg

SEQ ID NO: 199234 - DNA, 25 bp, Mus musculus
agggcagttttctgcttcccttagg

SEQ ID NO: 199235 - DNA, 25 bp, Mus musculus
agggcataatctacagtgaccttaa

SEQ ID NO: 199236 - DNA, 25 bp, Mus musculus
agggcataatcttcagtgaccttaa

SEQ ID NO: 199237 - DNA, 25 bp, Mus musculus
agggcataatgtactttccccttga

SEQ ID NO: 199238 - DNA, 25 bp, Mus musculus
agggcataatgttctttccccttga

SEQ ID NO: 199239 - DNA, 25 bp, Mus musculus
agggcatacctaatggctctttaaa

SEQ ID NO: 199240 - DNA, 25 bp, Mus musculus
agggcatacctattggctctttaaa

SEQ ID NO: 199241 - DNA, 25 bp, Mus musculus
agggcatagcgtccagcttcctcta

SEQ ID NO: 199242 - DNA, 25 bp, Mus musculus
agggcatagcgtgcagcttcctcta

SEQ ID NO: 199243 - DNA, 25 bp, Mus musculus
agggcataggcccatgctcttagca

SEQ ID NO: 199244 - DNA, 25 bp, Mus musculus
agggcataggccgatgctcttagca

SEQ ID NO: 199245 - DNA, 25 bp, Mus musculus
agggcatcaaccagcaagagcgcgt

SEQ ID NO: 199246 - DNA, 25 bp, Mus musculus
agggcatcaacctgcaagagcgcgt

SEQ ID NO: 199247 - DNA, 25 bp, Mus musculus
agggcatcaaggctactgctcctga

SEQ ID NO: 199248 - DNA, 25 bp, Mus musculus
agggcatcaagggtactgctcctga

SEQ ID NO: 199249 - DNA, 25 bp, Mus musculus
agggcatcaattacctcatctggag

SEQ ID NO: 199250 - DNA, 25 bp, Mus musculus
agggcatcaatttcctcatctggag

SEQ ID NO: 199251 - DNA, 25 bp, Mus musculus
agggcatcatgcctaccagttacct

SEQ ID NO: 199252 - DNA, 25 bp, Mus musculus
agggcatcatgcgtaccagttacct

SEQ ID NO: 199253 - DNA, 25 bp, Mus musculus
agggcatcatggctcagcagcactg

SEQ ID NO: 199254 - DNA, 25 bp, Mus musculus
agggcatcatgggtcagcagcactg

SEQ ID NO: 199255 - DNA, 25 bp, Mus musculus
agggcatccactatgaggccccatc

SEQ ID NO: 199256 - DNA, 25 bp, Mus musculus
agggcatccactttgaggccccatc

SEQ ID NO: 199257 - DNA, 25 bp, Mus musculus
agggcatcccatcccaggcacaaag

SEQ ID NO: 199258 - DNA, 25 bp, Mus musculus
agggcatcccatgccaggcacaaag

SEQ ID NO: 199259 - DNA, 25 bp, Mus musculus
agggcatccctgaggactgagtctc

SEQ ID NO: 199260 - DNA, 25 bp, Mus musculus
agggcatccctgtggactgagtctc

SEQ ID NO: 199261 - DNA, 25 bp, Mus musculus
agggcatccgccagcgctttgagaa

SEQ ID NO: 199262 - DNA, 25 bp, Mus musculus
agggcatccgcctgcgctttgagaa

SEQ ID NO: 199263 - DNA, 25 bp, Mus musculus
agggcatccggtctcaggcttctgt

SEQ ID NO: 199264 - DNA, 25 bp, Mus musculus
agggcatccggtgtcaggcttctgt

SEQ ID NO: 199265 - DNA, 25 bp, Mus musculus
agggcatcctcaagcggccgccaga

SEQ ID NO: 199266 - DNA, 25 bp, Mus musculus
agggcatcctcatgcggccgccaga

SEQ ID NO: 199267 - DNA, 25 bp, Mus musculus
agggcatcctgacactgaacatccg

SEQ ID NO: 199268 - DNA, 25 bp, Mus musculus
agggcatcctgagactgaacatccg

SEQ ID NO: 199269 - DNA, 25 bp, Mus musculus
agggcatcctggagccagtctccac

SEQ ID NO: 199270 - DNA, 25 bp, Mus musculus
agggcatcctggtgccagtctccac

SEQ ID NO: 199271 - DNA, 25 bp, Mus musculus
agggcatctagtcgaccagtctcca

SEQ ID NO: 199272 - DNA, 25 bp, Mus musculus
agggcatctagtggaccagtctcca

SEQ ID NO: 199273 - DNA, 25 bp, Mus musculus
agggcatctatcactttcaggcaca

SEQ ID NO: 199274 - DNA, 25 bp, Mus musculus
agggcatctatctctttcaggcaca

SEQ ID NO: 199275 - DNA, 25 bp, Mus musculus
agggcatctcccagaactaatacct

SEQ ID NO: 199276 - DNA, 25 bp, Mus musculus
agggcatctccctgaactaatacct

SEQ ID NO: 199277 - DNA, 25 bp, Mus musculus
agggcatctctccagctgtcagttt

SEQ ID NO: 199278 - DNA, 25 bp, Mus musculus
agggcatctctcgagctgtcagttt

SEQ ID NO: 199279 - DNA, 25 bp, Mus musculus
agggcatgaaacctgctccatgtgc

SEQ ID NO: 199280 - DNA, 25 bp, Mus musculus
agggcatgaaacgtgctccatgtgc

SEQ ID NO: 199281 - DNA, 25 bp, Mus musculus
agggcatgaactcttaccgaggctc

SEQ ID NO: 199282 - DNA, 25 bp, Mus musculus
agggcatgaactgttaccgaggctc

SEQ ID NO: 199283 - DNA, 25 bp, Mus musculus
agggcatgatgcaccactcttagaa

SEQ ID NO: 199284 - DNA, 25 bp, Mus musculus
agggcatgatgctccactcttagaa

SEQ ID NO: 199285 - DNA, 25 bp, Mus musculus
agggcatgcaggaggaagatttaaa

SEQ ID NO: 199286 - DNA, 25 bp, Mus musculus
agggcatgcaggtggaagatttaaa

SEQ ID NO: 199287 - DNA, 25 bp, Mus musculus
agggcatgcctcacctgcttttttg

SEQ ID NO: 199288 - DNA, 25 bp, Mus musculus
agggcatgcctctcctgcttttttg

SEQ ID NO: 199289 - DNA, 25 bp, Mus musculus
agggcatggaacatctgctcagcat

SEQ ID NO: 199290 - DNA, 25 bp, Mus musculus
agggcatggaacttctgctcagcat

SEQ ID NO: 199291 - DNA, 25 bp, Mus musculus
agggcatggctcaaagtttcttctc

SEQ ID NO: 199292 - DNA, 25 bp, Mus musculus
agggcatggctcctctaacaggtga

SEQ ID NO: 199293 - DNA, 25 bp, Mus musculus
agggcatggctcgtctaacaggtga

SEQ ID NO: 199294 - DNA, 25 bp, Mus musculus
agggcatggctctaagtttcttctc

SEQ ID NO: 199295 - DNA, 25 bp, Mus musculus
agggcatgggtaattttacggcaat

SEQ ID NO: 199296 - DNA, 25 bp, Mus musculus
agggcatgggtatttttacggcaat

SEQ ID NO: 199297 - DNA, 25 bp, Mus musculus
agggcatgtcttccatgtatcacaa

SEQ ID NO: 199298 - DNA, 25 bp, Mus musculus
agggcatgtcttgcatgtatcacaa

SEQ ID NO: 199299 - DNA, 25 bp, Mus musculus
agggcattacacagcctatgcgaag

SEQ ID NO: 199300 - DNA, 25 bp, Mus musculus
agggcattacactgcctatgcgaag

SEQ ID NO: 199301 - DNA, 25 bp, Mus musculus
agggcattagccagactcaagtctg

SEQ ID NO: 199302 - DNA, 25 bp, Mus musculus
agggcattagcctgactcaagtctg

SEQ ID NO: 199303 - DNA, 25 bp, Mus musculus
agggcattagctcccagagtccgaa

SEQ ID NO: 199304 - DNA, 25 bp, Mus musculus
agggcattagctgccagagtccgaa

SEQ ID NO: 199305 - DNA, 25 bp, Mus musculus
agggcattaggtctcctctagcact

SEQ ID NO: 199306 - DNA, 25 bp, Mus musculus
agggcattaggtgtcctctagcact

SEQ ID NO: 199307 - DNA, 25 bp, Mus musculus
agggcattcaccaactcatgtacat

SEQ ID NO: 199308 - DNA, 25 bp, Mus musculus
agggcattcacctactcatgtacat

SEQ ID NO: 199309 - DNA, 25 bp, Mus musculus
agggcattcccacccagagggagat

SEQ ID NO: 199310 - DNA, 25 bp, Mus musculus
agggcattcccagccagagggagat

SEQ ID NO: 199311 - DNA, 25 bp, Mus musculus
agggcattcggtaggacaggaatca

SEQ ID NO: 199312 - DNA, 25 bp, Mus musculus
agggcattcggttggacaggaatca

SEQ ID NO: 199313 - DNA, 25 bp, Mus musculus
agggcattgaccacttggcatcatt

SEQ ID NO: 199314 - DNA, 25 bp, Mus musculus
agggcattgacctcttggcatcatt

SEQ ID NO: 199315 - DNA, 25 bp, Mus musculus
agggcattgactactctagactgga

SEQ ID NO: 199316 - DNA, 25 bp, Mus musculus
agggcattgacttctctagactgga

SEQ ID NO: 199317 - DNA, 25 bp, Mus musculus
agggcattgcacagaggactttcag

SEQ ID NO: 199318 - DNA, 25 bp, Mus musculus
agggcattgcactgaggactttcag

SEQ ID NO: 199319 - DNA, 25 bp, Mus musculus
agggcattgggtcacacggcataac

SEQ ID NO: 199320 - DNA, 25 bp, Mus musculus
agggcattgggtgacacggcataac

SEQ ID NO: 199321 - DNA, 25 bp, Mus musculus
agggcattgtatctcttaggactga

SEQ ID NO: 199322 - DNA, 25 bp, Mus musculus
agggcattgtatgtcttaggactga

SEQ ID NO: 199323 - DNA, 25 bp, Mus musculus
agggcatttaagacttctcccgtgg

SEQ ID NO: 199324 - DNA, 25 bp, Mus musculus
agggcatttaagtcttctcccgtgg

SEQ ID NO: 199325 - DNA, 25 bp, Mus musculus
agggcatttgtaaactcggcagaag

SEQ ID NO: 199326 - DNA, 25 bp, Mus musculus
agggcatttgtaatcatgacatcaa

SEQ ID NO: 199327 - DNA, 25 bp, Mus musculus
agggcatttgtatactcggcagaag

SEQ ID NO: 199328 - DNA, 25 bp, Mus musculus
agggcatttgtattcatgacatcaa

SEQ ID NO: 199329 - DNA, 25 bp, Mus musculus
agggccaaacgtagtcccaagcatc

SEQ ID NO: 199330 - DNA, 25 bp, Mus musculus
agggccaaacgttgtcccaagcatc

SEQ ID NO: 199331 - DNA, 25 bp, Mus musculus
agggccaacactcgtaccagcttca

SEQ ID NO: 199332 - DNA, 25 bp, Mus musculus
agggccaacactggtaccagcttca

SEQ ID NO: 199333 - DNA, 25 bp, Mus musculus
agggccaaccctcgaacaatgcgca

SEQ ID NO: 199334 - DNA, 25 bp, Mus musculus
agggccaaccctggaacaatgcgca

SEQ ID NO: 199335 - DNA, 25 bp, Mus musculus
agggccaactcaactttcctgttgt

SEQ ID NO: 199336 - DNA, 25 bp, Mus musculus
agggccaactcatctttcctgttgt

SEQ ID NO: 199337 - DNA, 25 bp, Mus musculus
agggccaactgtcgtctgcatacag

SEQ ID NO: 199338 - DNA, 25 bp, Mus musculus
agggccaactgtggtctgcatacag

SEQ ID NO: 199339 - DNA, 25 bp, Mus musculus
agggccaagaaaccaccacagacag

SEQ ID NO: 199340 - DNA, 25 bp, Mus musculus
agggccaagaaagcaccacagacag

SEQ ID NO: 199341 - DNA, 25 bp, Mus musculus
agggccaagaccatccatggttgtt

SEQ ID NO: 199342 - DNA, 25 bp, Mus musculus
agggccaagaccttccatggttgtt

SEQ ID NO: 199343 - DNA, 25 bp, Mus musculus
agggccaagcccaggttgcttctat

SEQ ID NO: 199344 - DNA, 25 bp, Mus musculus
agggccaagccctggttgcttctat

SEQ ID NO: 199345 - DNA, 25 bp, Mus musculus
agggccaagctccacatggctttct

SEQ ID NO: 199346 - DNA, 25 bp, Mus musculus
agggccaagctcgacatggctttct

SEQ ID NO: 199347 - DNA, 25 bp, Mus musculus
agggccaaggtcagcagtgcaagta

SEQ ID NO: 199348 - DNA, 25 bp, Mus musculus
agggccaaggtctgcagtgcaagta

SEQ ID NO: 199349 - DNA, 25 bp, Mus musculus
agggccaataacagcacaactactg

SEQ ID NO: 199350 - DNA, 25 bp, Mus musculus
agggccaataactgcacaactactg

SEQ ID NO: 199351 - DNA, 25 bp, Mus musculus
agggccaatgcaaagtctcagcacc

SEQ ID NO: 199352 - DNA, 25 bp, Mus musculus
agggccaatgcatagtctcagcacc

SEQ ID NO: 199353 - DNA, 25 bp, Mus musculus
agggccaatgttcaatcctctcttg

SEQ ID NO: 199354 - DNA, 25 bp, Mus musculus
agggccaatgttgaatcctctcttg

SEQ ID NO: 199355 - DNA, 25 bp, Mus musculus
agggccacacacaccacggagggaa

SEQ ID NO: 199356 - DNA, 25 bp, Mus musculus
agggccacacacctggctgctgtta

SEQ ID NO: 199357 - DNA, 25 bp, Mus musculus
agggccacacacgtggctgctgtta

SEQ ID NO: 199358 - DNA, 25 bp, Mus musculus
agggccacacactccacggagggaa

SEQ ID NO: 199359 - DNA, 25 bp, Mus musculus
agggccacagcacagctcattgcaa

SEQ ID NO: 199360 - DNA, 25 bp, Mus musculus
agggccacagcagagctcattgcaa

SEQ ID NO: 199361 - DNA, 25 bp, Mus musculus
agggccacaggaactcacttggcaa

SEQ ID NO: 199362 - DNA, 25 bp, Mus musculus
agggccacaggatctcacttggcaa

SEQ ID NO: 199363 - DNA, 25 bp, Mus musculus
agggccacaggcacgtaaacataga

SEQ ID NO: 199364 - DNA, 25 bp, Mus musculus
agggccacaggctcgtaaacataga

SEQ ID NO: 199365 - DNA, 25 bp, Mus musculus
agggccacagtccagtccacacgaa

SEQ ID NO: 199366 - DNA, 25 bp, Mus musculus
agggccacagtcgagtccacacgaa

SEQ ID NO: 199367 - DNA, 25 bp, Mus musculus
agggccacatttaacctcatggtat

SEQ ID NO: 199368 - DNA, 25 bp, Mus musculus
agggccacattttacctcatggtat

SEQ ID NO: 199369 - DNA, 25 bp, Mus musculus
agggccaccagacaaggaccctgga

SEQ ID NO: 199370 - DNA, 25 bp, Mus musculus
agggccaccagagaaggaccctgga

SEQ ID NO: 199371 - DNA, 25 bp, Mus musculus
agggccaccagtacttcctgagacg

SEQ ID NO: 199372 - DNA, 25 bp, Mus musculus
agggccaccagttcttcctgagacg

SEQ ID NO: 199373 - DNA, 25 bp, Mus musculus
agggccacccgcaggatgactgctt

SEQ ID NO: 199374 - DNA, 25 bp, Mus musculus
agggccacccgctggatgactgctt

SEQ ID NO: 199375 - DNA, 25 bp, Mus musculus
agggccaccgccatcttacggcggg

SEQ ID NO: 199376 - DNA, 25 bp, Mus musculus
agggccaccgccttcttacggcggg

SEQ ID NO: 199377 - DNA, 25 bp, Mus musculus
agggccacctctctacttgaaggag

SEQ ID NO: 199378 - DNA, 25 bp, Mus musculus
agggccacctctgtacttgaaggag

SEQ ID NO: 199379 - DNA, 25 bp, Mus musculus
agggccacgccaattggtgaagcca

SEQ ID NO: 199380 - DNA, 25 bp, Mus musculus
agggccacgccatttggtgaagcca

SEQ ID NO: 199381 - DNA, 25 bp, Mus musculus
agggccacgcttctgtcagtgcttt

SEQ ID NO: 199382 - DNA, 25 bp, Mus musculus
agggccacgcttgtgtcagtgcttt

SEQ ID NO: 199383 - DNA, 25 bp, Mus musculus
agggccactataaacaagactccat

SEQ ID NO: 199384 - DNA, 25 bp, Mus musculus
agggccactatatacaagactccat

SEQ ID NO: 199385 - DNA, 25 bp, Mus musculus
agggccactgatatcaaaggacact

SEQ ID NO: 199386 - DNA, 25 bp, Mus musculus
agggccactgatttcaaaggacact

SEQ ID NO: 199387 - DNA, 25 bp, Mus musculus
agggccactgctagccatgtcagga

SEQ ID NO: 199388 - DNA, 25 bp, Mus musculus
agggccactgctagctcgctagaag

SEQ ID NO: 199389 - DNA, 25 bp, Mus musculus
agggccactgcttgccatgtcagga

SEQ ID NO: 199390 - DNA, 25 bp, Mus musculus
agggccactgcttgctcgctagaag

SEQ ID NO: 199391 - DNA, 25 bp, Mus musculus
agggccacttcacaaggcttgttat

SEQ ID NO: 199392 - DNA, 25 bp, Mus musculus
agggccacttcagaaggcttgttat

SEQ ID NO: 199393 - DNA, 25 bp, Mus musculus
agggccagacagaaatttcccaggt

SEQ ID NO: 199394 - DNA, 25 bp, Mus musculus
agggccagacagtaatttcccaggt

SEQ ID NO: 199395 - DNA, 25 bp, Mus musculus
agggccagaccactctctgtatgga

SEQ ID NO: 199396 - DNA, 25 bp, Mus musculus
agggccagaccagtctctgtatgga

SEQ ID NO: 199397 - DNA, 25 bp, Mus musculus
agggccagaccgagtatttcaggtt

SEQ ID NO: 199398 - DNA, 25 bp, Mus musculus
agggccagaccgtgtatttcaggtt

SEQ ID NO: 199399 - DNA, 25 bp, Mus musculus
agggccagactacttattccatcaa

SEQ ID NO: 199400 - DNA, 25 bp, Mus musculus
agggccagactagttattccatcaa

SEQ ID NO: 199401 - DNA, 25 bp, Mus musculus
agggccagagcaagggcacgcctta

SEQ ID NO: 199402 - DNA, 25 bp, Mus musculus
agggccagagcatgggcacgcctta

SEQ ID NO: 199403 - DNA, 25 bp, Mus musculus
agggccagatctcaccatttcaggg

SEQ ID NO: 199404 - DNA, 25 bp, Mus musculus
agggccagatctgaccatttcaggg

SEQ ID NO: 199405 - DNA, 25 bp, Mus musculus
agggccagatggaaaatccctgaga

SEQ ID NO: 199406 - DNA, 25 bp, Mus musculus
agggccagatggtaaatccctgaga

SEQ ID NO: 199407 - DNA, 25 bp, Mus musculus
agggccagcaccacagtgggcagca

SEQ ID NO: 199408 - DNA, 25 bp, Mus musculus
agggccagcaccacgcagatagagg

SEQ ID NO: 199409 - DNA, 25 bp, Mus musculus
agggccagcacctcagtgggcagca

SEQ ID NO: 199410 - DNA, 25 bp, Mus musculus
agggccagcacctcgcagatagagg

SEQ ID NO: 199411 - DNA, 25 bp, Mus musculus
agggccagcagacgctacaaaaact

SEQ ID NO: 199412 - DNA, 25 bp, Mus musculus
agggccagcagaggctacaaaaact

SEQ ID NO: 199413 - DNA, 25 bp, Mus musculus
agggccagccacacacagtaggaag

SEQ ID NO: 199414 - DNA, 25 bp, Mus musculus
agggccagccactcacagtaggaag

SEQ ID NO: 199415 - DNA, 25 bp, Mus musculus
agggccagccagaatcaccagacct

SEQ ID NO: 199416 - DNA, 25 bp, Mus musculus
agggccagccagtatcaccagacct

SEQ ID NO: 199417 - DNA, 25 bp, Mus musculus
agggccagcccaaggcaggcttcac

SEQ ID NO: 199418 - DNA, 25 bp, Mus musculus
agggccagcccatggcaggcttcac

SEQ ID NO: 199419 - DNA, 25 bp, Mus musculus
agggccagctatcatgtcagaatat

SEQ ID NO: 199420 - DNA, 25 bp, Mus musculus
agggccagctatgatgtcagaatat

SEQ ID NO: 199421 - DNA, 25 bp, Mus musculus
agggccagctcgcttgctctcatga

SEQ ID NO: 199422 - DNA, 25 bp, Mus musculus
agggccagctcggttgctctcatga

SEQ ID NO: 199423 - DNA, 25 bp, Mus musculus
agggccagcttgaccaatccagcct

SEQ ID NO: 199424 - DNA, 25 bp, Mus musculus
agggccagcttgtccaatccagcct

SEQ ID NO: 199425 - DNA, 25 bp, Mus musculus
agggccaggacacctttgttttcca

SEQ ID NO: 199426 - DNA, 25 bp, Mus musculus
agggccaggacagctttgttttcca

SEQ ID NO: 199427 - DNA, 25 bp, Mus musculus
agggccaggccactcccttcctggc

SEQ ID NO: 199428 - DNA, 25 bp, Mus musculus
agggccaggccagtcccttcctggc

SEQ ID NO: 199429 - DNA, 25 bp, Mus musculus
agggccaggcgtagtcagcactgaa

SEQ ID NO: 199430 - DNA, 25 bp, Mus musculus
agggccaggcgttgtcagcactgaa

SEQ ID NO: 199431 - DNA, 25 bp, Mus musculus
agggccaggctcatcgacgttcgat

SEQ ID NO: 199432 - DNA, 25 bp, Mus musculus
agggccaggctcttcgacgttcgat

SEQ ID NO: 199433 - DNA, 25 bp, Mus musculus
agggccagggctagtcactgcaggt

SEQ ID NO: 199434 - DNA, 25 bp, Mus musculus
agggccagggcttgtcactgcaggt

SEQ ID NO: 199435 - DNA, 25 bp, Mus musculus
agggccaggttgcacaagctgcata

SEQ ID NO: 199436 - DNA, 25 bp, Mus musculus
agggccaggttggacaagctgcata

SEQ ID NO: 199437 - DNA, 25 bp, Mus musculus
agggccagtataacctaactctgtc

SEQ ID NO: 199438 - DNA, 25 bp, Mus musculus
agggccagtatatcctaactctgtc

SEQ ID NO: 199439 - DNA, 25 bp, Mus musculus
agggccagtcgccttgcaagtccag

SEQ ID NO: 199440 - DNA, 25 bp, Mus musculus
agggccagtcgcgttgcaagtccag

SEQ ID NO: 199441 - DNA, 25 bp, Mus musculus
agggccagtgtccttattatccttg

SEQ ID NO: 199442 - DNA, 25 bp, Mus musculus
agggccagtgtcgttattatccttg

SEQ ID NO: 199443 - DNA, 25 bp, Mus musculus
agggccagttttacagcagcagaat

SEQ ID NO: 199444 - DNA, 25 bp, Mus musculus
agggccagtttttcagcagcagaat

SEQ ID NO: 199445 - DNA, 25 bp, Mus musculus
agggccatagccagcctgaacgctt

SEQ ID NO: 199446 - DNA, 25 bp, Mus musculus
agggccatagcctgcctgaacgctt

SEQ ID NO: 199447 - DNA, 25 bp, Mus musculus
agggccatatttatcacagggtgac

SEQ ID NO: 199448 - DNA, 25 bp, Mus musculus
agggccatatttttcacagggtgac

SEQ ID NO: 199449 - DNA, 25 bp, Mus musculus
agggccatcactcaagaggacctca

SEQ ID NO: 199450 - DNA, 25 bp, Mus musculus
agggccatcactgaagaggacctca

SEQ ID NO: 199451 - DNA, 25 bp, Mus musculus
agggccatcagcatttttattgaca

SEQ ID NO: 199452 - DNA, 25 bp, Mus musculus
agggccatcagcttttttattgaca

SEQ ID NO: 199453 - DNA, 25 bp, Mus musculus
agggccatccttatcagctaagtaa

SEQ ID NO: 199454 - DNA, 25 bp, Mus musculus
agggccatccttttcagctaagtaa

SEQ ID NO: 199455 - DNA, 25 bp, Mus musculus
agggccatctgcctatccatcaaga

SEQ ID NO: 199456 - DNA, 25 bp, Mus musculus
agggccatctgcgtatccatcaaga

SEQ ID NO: 199457 - DNA, 25 bp, Mus musculus
agggccatgattctttatgtcccac

SEQ ID NO: 199458 - DNA, 25 bp, Mus musculus
agggccatgattgtttatgtcccac

SEQ ID NO: 199459 - DNA, 25 bp, Mus musculus
agggccatggacactgactggtttc

SEQ ID NO: 199460 - DNA, 25 bp, Mus musculus
agggccatggactctgactggtttc

SEQ ID NO: 199461 - DNA, 25 bp, Mus musculus
agggccatggtgagtgtcattacaa

SEQ ID NO: 199462 - DNA, 25 bp, Mus musculus
agggccatggtgtgtgtcattacaa

SEQ ID NO: 199463 - DNA, 25 bp, Mus musculus
agggccattcgacaaactgtcagaa

SEQ ID NO: 199464 - DNA, 25 bp, Mus musculus
agggccattcgagaaactgtcagaa

SEQ ID NO: 199465 - DNA, 25 bp, Mus musculus
agggccattctcacatggattgcta

SEQ ID NO: 199466 - DNA, 25 bp, Mus musculus
agggccattctctcatggattgcta

SEQ ID NO: 199467 - DNA, 25 bp, Mus musculus
agggccattgctctgagagtcccag

SEQ ID NO: 199468 - DNA, 25 bp, Mus musculus
agggccattgctgtgagagtcccag

SEQ ID NO: 199469 - DNA, 25 bp, Mus musculus
agggccattggcaggatttatttcc

SEQ ID NO: 199470 - DNA, 25 bp, Mus musculus
agggccattggctggatttatttcc

SEQ ID NO: 199471 - DNA, 25 bp, Mus musculus
agggcccaaatcaaaatgcattcag

SEQ ID NO: 199472 - DNA, 25 bp, Mus musculus
agggcccaaatctaaatgcattcag

SEQ ID NO: 199473 - DNA, 25 bp, Mus musculus
agggcccaacagagctctgtgtgtt

SEQ ID NO: 199474 - DNA, 25 bp, Mus musculus
agggcccaacagtgctctgtgtgtt

SEQ ID NO: 199475 - DNA, 25 bp, Mus musculus
agggcccaagatacttgtccggaga

SEQ ID NO: 199476 - DNA, 25 bp, Mus musculus
agggcccaagattcttgtccggaga

SEQ ID NO: 199477 - DNA, 25 bp, Mus musculus
agggcccaagctactggctacataa

SEQ ID NO: 199478 - DNA, 25 bp, Mus musculus
agggcccaagcttctggctacataa

SEQ ID NO: 199479 - DNA, 25 bp, Mus musculus
agggcccaaggcctagcaagtccag

SEQ ID NO: 199480 - DNA, 25 bp, Mus musculus
agggcccaaggcgtagcaagtccag

SEQ ID NO: 199481 - DNA, 25 bp, Mus musculus
agggcccaatcaaccatcaagacat

SEQ ID NO: 199482 - DNA, 25 bp, Mus musculus
agggcccaatcatccatcaagacat

SEQ ID NO: 199483 - DNA, 25 bp, Mus musculus
agggcccaatgtcctgccagtgtta

SEQ ID NO: 199484 - DNA, 25 bp, Mus musculus
agggcccaatgtgctgccagtgtta

SEQ ID NO: 199485 - DNA, 25 bp, Mus musculus
agggcccacaaaaagataatcttta

SEQ ID NO: 199486 - DNA, 25 bp, Mus musculus
agggcccacaaatagataatcttta

SEQ ID NO: 199487 - DNA, 25 bp, Mus musculus
agggcccacaccacagtaacactga

SEQ ID NO: 199488 - DNA, 25 bp, Mus musculus
agggcccacacctcagtaacactga

SEQ ID NO: 199489 - DNA, 25 bp, Mus musculus
agggcccacactctctgaggacaag

SEQ ID NO: 199490 - DNA, 25 bp, Mus musculus
agggcccacactgtctgaggacaag

SEQ ID NO: 199491 - DNA, 25 bp, Mus musculus
agggcccacatgactatgctactat

SEQ ID NO: 199492 - DNA, 25 bp, Mus musculus
agggcccacatgtctatgctactat

SEQ ID NO: 199493 - DNA, 25 bp, Mus musculus
agggcccaccgaagacagatctcat

SEQ ID NO: 199494 - DNA, 25 bp, Mus musculus
agggcccaccgatgacagatctcat

SEQ ID NO: 199495 - DNA, 25 bp, Mus musculus
agggcccagcatctcagcaggagac

SEQ ID NO: 199496 - DNA, 25 bp, Mus musculus
agggcccagcatgtcagcaggagac

SEQ ID NO: 199497 - DNA, 25 bp, Mus musculus
agggcccaggctctgaatcacaagt

SEQ ID NO: 199498 - DNA, 25 bp, Mus musculus
agggcccaggctgtgaatcacaagt

SEQ ID NO: 199499 - DNA, 25 bp, Mus musculus
agggcccagtctagtactgaccaaa

SEQ ID NO: 199500 - DNA, 25 bp, Mus musculus
agggcccagtcttgtactgaccaaa

SEQ ID NO: 199501 - DNA, 25 bp, Mus musculus
agggcccagtgcaacacaatttaca

SEQ ID NO: 199502 - DNA, 25 bp, Mus musculus
agggcccagtgctacacaatttaca

SEQ ID NO: 199503 - DNA, 25 bp, Mus musculus
agggcccatccgagatcagatgtga

SEQ ID NO: 199504 - DNA, 25 bp, Mus musculus
agggcccatccgtgatcagatgtga

SEQ ID NO: 199505 - DNA, 25 bp, Mus musculus
agggcccatcctatttctgggtatc

SEQ ID NO: 199506 - DNA, 25 bp, Mus musculus
agggcccatcctttttctgggtatc

SEQ ID NO: 199507 - DNA, 25 bp, Mus musculus
agggcccatcgaccactgaagacaa

SEQ ID NO: 199508 - DNA, 25 bp, Mus musculus
agggcccatcgagcactgaagacaa

SEQ ID NO: 199509 - DNA, 25 bp, Mus musculus
agggcccatcttcctgggacgatgt

SEQ ID NO: 199510 - DNA, 25 bp, Mus musculus
agggcccatcttgctgggacgatgt

SEQ ID NO: 199511 - DNA, 25 bp, Mus musculus
agggcccatgctcctctcatgggtt

SEQ ID NO: 199512 - DNA, 25 bp, Mus musculus
agggcccatgctgctctcatgggtt

SEQ ID NO: 199513 - DNA, 25 bp, Mus musculus
agggcccattgcacccatatttgag

SEQ ID NO: 199514 - DNA, 25 bp, Mus musculus
agggcccattgctcccatatttgag

SEQ ID NO: 199515 - DNA, 25 bp, Mus musculus
agggccccaaacaatgtaagtgcat

SEQ ID NO: 199516 - DNA, 25 bp, Mus musculus
agggccccaaactatgtaagtgcat

SEQ ID NO: 199517 - DNA, 25 bp, Mus musculus
agggccccaaagaaaatgcacatga

SEQ ID NO: 199518 - DNA, 25 bp, Mus musculus
agggccccaaagtaaatgcacatga

SEQ ID NO: 199519 - DNA, 25 bp, Mus musculus
agggccccaaggagcgcagctactt

SEQ ID NO: 199520 - DNA, 25 bp, Mus musculus
agggccccaaggtgcgcagctactt

SEQ ID NO: 199521 - DNA, 25 bp, Mus musculus
agggccccacagccaattcctagag

SEQ ID NO: 199522 - DNA, 25 bp, Mus musculus
agggccccacaggcaattcctagag

SEQ ID NO: 199523 - DNA, 25 bp, Mus musculus
agggccccagagcaagtcgaatgct

SEQ ID NO: 199524 - DNA, 25 bp, Mus musculus
agggccccagaggaagtcgaatgct

SEQ ID NO: 199525 - DNA, 25 bp, Mus musculus
agggccccagtacacgtggaatcca

SEQ ID NO: 199526 - DNA, 25 bp, Mus musculus
agggccccagtagacgtggaatcca

SEQ ID NO: 199527 - DNA, 25 bp, Mus musculus
agggccccatccaggtgctaggcac

SEQ ID NO: 199528 - DNA, 25 bp, Mus musculus
agggccccatcctggtgctaggcac

SEQ ID NO: 199529 - DNA, 25 bp, Mus musculus
agggccccattcagaacatgagttt

SEQ ID NO: 199530 - DNA, 25 bp, Mus musculus
agggccccattctgaacatgagttt

SEQ ID NO: 199531 - DNA, 25 bp, Mus musculus
agggccccgtctacaaaggagtctg

SEQ ID NO: 199532 - DNA, 25 bp, Mus musculus
agggccccgtcttcaaaggagtctg

SEQ ID NO: 199533 - DNA, 25 bp, Mus musculus
agggcccgaagtcgcccagatccag

SEQ ID NO: 199534 - DNA, 25 bp, Mus musculus
agggcccgaagtggcccagatccag

SEQ ID NO: 199535 - DNA, 25 bp, Mus musculus
agggcccgagctagatctccgttag

SEQ ID NO: 199536 - DNA, 25 bp, Mus musculus
agggcccgagcttgatctccgttag

SEQ ID NO: 199537 - DNA, 25 bp, Mus musculus
agggcccggatccagtgcttagaca

SEQ ID NO: 199538 - DNA, 25 bp, Mus musculus
agggcccggatcgagtgcttagaca

SEQ ID NO: 199539 - DNA, 25 bp, Mus musculus
agggcccggctgcaagccacagaaa

SEQ ID NO: 199540 - DNA, 25 bp, Mus musculus
agggcccggctggaagccacagaaa

SEQ ID NO: 199541 - DNA, 25 bp, Mus musculus
agggcccgtcggagagccatgttta

SEQ ID NO: 199542 - DNA, 25 bp, Mus musculus
agggcccgtcggtgagccatgttta

SEQ ID NO: 199543 - DNA, 25 bp, Mus musculus
agggccctaactcgctccttctatt

SEQ ID NO: 199544 - DNA, 25 bp, Mus musculus
agggccctaactggctccttctatt

SEQ ID NO: 199545 - DNA, 25 bp, Mus musculus
agggccctagtcatgcaataaccaa

SEQ ID NO: 199546 - DNA, 25 bp, Mus musculus
agggccctagtcttgcaataaccaa

SEQ ID NO: 199547 - DNA, 25 bp, Mus musculus
agggccctcatgcagagcagagtca

SEQ ID NO: 199548 - DNA, 25 bp, Mus musculus
agggccctcatggagagcagagtca

SEQ ID NO: 199549 - DNA, 25 bp, Mus musculus
agggccctcgaacatgccatatggg

SEQ ID NO: 199550 - DNA, 25 bp, Mus musculus
agggccctcgaagatgccatatggg

SEQ ID NO: 199551 - DNA, 25 bp, Mus musculus
agggccctcggccagccaaggagcg

SEQ ID NO: 199552 - DNA, 25 bp, Mus musculus
agggccctcggcgagccaaggagcg

SEQ ID NO: 199553 - DNA, 25 bp, Mus musculus
agggccctgatccacattgtgagtt

SEQ ID NO: 199554 - DNA, 25 bp, Mus musculus
agggccctgatcgacattgtgagtt

SEQ ID NO: 199555 - DNA, 25 bp, Mus musculus
agggccctgcctatagcaggctaat

SEQ ID NO: 199556 - DNA, 25 bp, Mus musculus
agggccctgcctttagcaggctaat

SEQ ID NO: 199557 - DNA, 25 bp, Mus musculus
agggccctggcactcatgaagacac

SEQ ID NO: 199558 - DNA, 25 bp, Mus musculus
agggccctggcagtcatgaagacac

SEQ ID NO: 199559 - DNA, 25 bp, Mus musculus
agggccctggttatcatggacagtc

SEQ ID NO: 199560 - DNA, 25 bp, Mus musculus
agggccctggttttcatggacagtc

SEQ ID NO: 199561 - DNA, 25 bp, Mus musculus
agggccctgttcaagctaggtaagt

SEQ ID NO: 199562 - DNA, 25 bp, Mus musculus
agggccctgttctagctaggtaagt

SEQ ID NO: 199563 - DNA, 25 bp, Mus musculus
agggcccttagaacaggatcctcgg

SEQ ID NO: 199564 - DNA, 25 bp, Mus musculus
agggcccttagatcaggatcctcgg

SEQ ID NO: 199565 - DNA, 25 bp, Mus musculus
agggcccttccgataggtgtagctg

SEQ ID NO: 199566 - DNA, 25 bp, Mus musculus
agggcccttccgttaggtgtagctg

SEQ ID NO: 199567 - DNA, 25 bp, Mus musculus
agggcccttctgcaaattcaggcta

SEQ ID NO: 199568 - DNA, 25 bp, Mus musculus
agggcccttctggaaattcaggcta

SEQ ID NO: 199569 - DNA, 25 bp, Mus musculus
agggccgaagccacgataccaacga

SEQ ID NO: 199570 - DNA, 25 bp, Mus musculus
agggccgaagcctcgataccaacga

SEQ ID NO: 199571 - DNA, 25 bp, Mus musculus
agggccgacagcaatccagattaac

SEQ ID NO: 199572 - DNA, 25 bp, Mus musculus
agggccgacagctatccagattaac

SEQ ID NO: 199573 - DNA, 25 bp, Mus musculus
agggccgagctcatcaacatccatc

SEQ ID NO: 199574 - DNA, 25 bp, Mus musculus
agggccgagctcttcaacatccatc

SEQ ID NO: 199575 - DNA, 25 bp, Mus musculus
agggccgaggcgagctcatcgtatt

SEQ ID NO: 199576 - DNA, 25 bp, Mus musculus
agggccgaggcgtgctcatcgtatt

SEQ ID NO: 199577 - DNA, 25 bp, Mus musculus
agggccgcacctcaagatgctgaag

SEQ ID NO: 199578 - DNA, 25 bp, Mus musculus
agggccgcacctgaagatgctgaag

SEQ ID NO: 199579 - DNA, 25 bp, Mus musculus
agggccgctggtaactttgaagaat

SEQ ID NO: 199580 - DNA, 25 bp, Mus musculus
agggccgctggttactttgaagaat

SEQ ID NO: 199581 - DNA, 25 bp, Mus musculus
agggccgctttaacaaagtgtttca

SEQ ID NO: 199582 - DNA, 25 bp, Mus musculus
agggccgctttatcaaagtgtttca

SEQ ID NO: 199583 - DNA, 25 bp, Mus musculus
agggccggattaagaagaaggtcca

SEQ ID NO: 199584 - DNA, 25 bp, Mus musculus
agggccggattatgaagaaggtcca

SEQ ID NO: 199585 - DNA, 25 bp, Mus musculus
agggccggcaggactacttgtccag

SEQ ID NO: 199586 - DNA, 25 bp, Mus musculus
agggccggcaggtctacttgtccag

SEQ ID NO: 199587 - DNA, 25 bp, Mus musculus
agggccgtcattcttaaagctgaaa

SEQ ID NO: 199588 - DNA, 25 bp, Mus musculus
agggccgtcattgttaaagctgaaa

SEQ ID NO: 199589 - DNA, 25 bp, Mus musculus
agggccgtggaaaattctgtgtcta

SEQ ID NO: 199590 - DNA, 25 bp, Mus musculus
agggccgtggaatattctgtgtcta

SEQ ID NO: 199591 - DNA, 25 bp, Mus musculus
agggccgtggttagagcttagcaaa

SEQ ID NO: 199592 - DNA, 25 bp, Mus musculus
agggccgtggtttgagcttagcaaa

SEQ ID NO: 199593 - DNA, 25 bp, Mus musculus
agggccgttgctcaagtactacctt

SEQ ID NO: 199594 - DNA, 25 bp, Mus musculus
agggccgttgctgaagtactacctt

SEQ ID NO: 199595 - DNA, 25 bp, Mus musculus
agggccgttgttcctgagcaagctt

SEQ ID NO: 199596 - DNA, 25 bp, Mus musculus
agggccgttgttgctgagcaagctt

SEQ ID NO: 199597 - DNA, 25 bp, Mus musculus
agggccgttttgcattcacgcacac

SEQ ID NO: 199598 - DNA, 25 bp, Mus musculus
agggccgttttggattcacgcacac

SEQ ID NO: 199599 - DNA, 25 bp, Mus musculus
agggcctaagcaccatacagctctg

SEQ ID NO: 199600 - DNA, 25 bp, Mus musculus
agggcctaagcagcatacagctctg

SEQ ID NO: 199601 - DNA, 25 bp, Mus musculus
agggcctaagcgagcaggacttctc

SEQ ID NO: 199602 - DNA, 25 bp, Mus musculus
agggcctaagcgtgcaggacttctc

SEQ ID NO: 199603 - DNA, 25 bp, Mus musculus
agggcctaaggcacctaatgacttt

SEQ ID NO: 199604 - DNA, 25 bp, Mus musculus
agggcctaaggctcctaatgacttt

SEQ ID NO: 199605 - DNA, 25 bp, Mus musculus
agggcctactgccttcgggccttag

SEQ ID NO: 199606 - DNA, 25 bp, Mus musculus
agggcctactgcgttcgggccttag

SEQ ID NO: 199607 - DNA, 25 bp, Mus musculus
agggcctacttccagcaggaatctc

SEQ ID NO: 199608 - DNA, 25 bp, Mus musculus
agggcctacttcgagcaggaatctc

SEQ ID NO: 199609 - DNA, 25 bp, Mus musculus
agggcctagaggagatcccgctgct

SEQ ID NO: 199610 - DNA, 25 bp, Mus musculus
agggcctagaggtgatcccgctgct

SEQ ID NO: 199611 - DNA, 25 bp, Mus musculus
agggcctattccatcaagaccacat

SEQ ID NO: 199612 - DNA, 25 bp, Mus musculus
agggcctattccttcaagaccacat

SEQ ID NO: 199613 - DNA, 25 bp, Mus musculus
agggcctatttcatgtgtggatcac

SEQ ID NO: 199614 - DNA, 25 bp, Mus musculus
agggcctatttcttgtgtggatcac

SEQ ID NO: 199615 - DNA, 25 bp, Mus musculus
agggcctcaaacaagctgactgctc

SEQ ID NO: 199616 - DNA, 25 bp, Mus musculus
agggcctcaaactagctgactgctc

SEQ ID NO: 199617 - DNA, 25 bp, Mus musculus
agggcctcaagaattccccaagaga

SEQ ID NO: 199618 - DNA, 25 bp, Mus musculus
agggcctcaagatttccccaagaga

SEQ ID NO: 199619 - DNA, 25 bp, Mus musculus
agggcctcaagcaggtgaccgcgct

SEQ ID NO: 199620 - DNA, 25 bp, Mus musculus
agggcctcaagctggtgaccgcgct

SEQ ID NO: 199621 - DNA, 25 bp, Mus musculus
agggcctcacacacggtaggcaaac

SEQ ID NO: 199622 - DNA, 25 bp, Mus musculus
agggcctcacacctgagacaagcat

SEQ ID NO: 199623 - DNA, 25 bp, Mus musculus
agggcctcacacgtgagacaagcat

SEQ ID NO: 199624 - DNA, 25 bp, Mus musculus
agggcctcacactcggtaggcaaac

SEQ ID NO: 199625 - DNA, 25 bp, Mus musculus
agggcctcactaactagctgggtaa

SEQ ID NO: 199626 - DNA, 25 bp, Mus musculus
agggcctcactatctagctgggtaa

SEQ ID NO: 199627 - DNA, 25 bp, Mus musculus
agggcctcagacagtctgggctgac

SEQ ID NO: 199628 - DNA, 25 bp, Mus musculus
agggcctcagactgtctgggctgac

SEQ ID NO: 199629 - DNA, 25 bp, Mus musculus
agggcctcagcaaggcctacaagta

SEQ ID NO: 199630 - DNA, 25 bp, Mus musculus
agggcctcagcatggcctacaagta

SEQ ID NO: 199631 - DNA, 25 bp, Mus musculus
agggcctcagcgatgggttcttcat

SEQ ID NO: 199632 - DNA, 25 bp, Mus musculus
agggcctcagcgttgggttcttcat

SEQ ID NO: 199633 - DNA, 25 bp, Mus musculus
agggcctcaggcacgcttgacgaat

SEQ ID NO: 199634 - DNA, 25 bp, Mus musculus
agggcctcaggctcgcttgacgaat

SEQ ID NO: 199635 - DNA, 25 bp, Mus musculus
agggcctcaggtattctggtttcta

SEQ ID NO: 199636 - DNA, 25 bp, Mus musculus
agggcctcaggttttctggtttcta

SEQ ID NO: 199637 - DNA, 25 bp, Mus musculus
agggcctcagtgcataccaggcaag

SEQ ID NO: 199638 - DNA, 25 bp, Mus musculus
agggcctcagtggataccaggcaag

SEQ ID NO: 199639 - DNA, 25 bp, Mus musculus
agggcctcatgcattctaggtctta

SEQ ID NO: 199640 - DNA, 25 bp, Mus musculus
agggcctcatgctttctaggtctta

SEQ ID NO: 199641 - DNA, 25 bp, Mus musculus
agggcctcatggatgatggctcgtt

SEQ ID NO: 199642 - DNA, 25 bp, Mus musculus
agggcctcatggttgatggctcgtt

SEQ ID NO: 199643 - DNA, 25 bp, Mus musculus
agggcctcattaccagtgtggaaca

SEQ ID NO: 199644 - DNA, 25 bp, Mus musculus
agggcctcattagcagtgtggaaca

SEQ ID NO: 199645 - DNA, 25 bp, Mus musculus
agggcctcatttaaacaccagcacc

SEQ ID NO: 199646 - DNA, 25 bp, Mus musculus
agggcctcattttaacaccagcacc

SEQ ID NO: 199647 - DNA, 25 bp, Mus musculus
agggcctccagcactgatatctgaa

SEQ ID NO: 199648 - DNA, 25 bp, Mus musculus
agggcctccagctctgatatctgaa

SEQ ID NO: 199649 - DNA, 25 bp, Mus musculus
agggcctccattcctttacatgcaa

SEQ ID NO: 199650 - DNA, 25 bp, Mus musculus
agggcctccattgctttacatgcaa

SEQ ID NO: 199651 - DNA, 25 bp, Mus musculus
agggcctcccacagtcctgtgatct

SEQ ID NO: 199652 - DNA, 25 bp, Mus musculus
agggcctcccactgtcctgtgatct

SEQ ID NO: 199653 - DNA, 25 bp, Mus musculus
agggcctccctaagtaaggtagcag

SEQ ID NO: 199654 - DNA, 25 bp, Mus musculus
agggcctccctatgtaaggtagcag

SEQ ID NO: 199655 - DNA, 25 bp, Mus musculus
agggcctccctcaaacaaggaacat

SEQ ID NO: 199656 - DNA, 25 bp, Mus musculus
agggcctccctctaacaaggaacat

SEQ ID NO: 199657 - DNA, 25 bp, Mus musculus
agggcctcctcacttgatgagttta

SEQ ID NO: 199658 - DNA, 25 bp, Mus musculus
agggcctcctcagttgatgagttta

SEQ ID NO: 199659 - DNA, 25 bp, Mus musculus
agggcctccttcacatcattcgaca

SEQ ID NO: 199660 - DNA, 25 bp, Mus musculus
agggcctccttcctagatcttatca

SEQ ID NO: 199661 - DNA, 25 bp, Mus musculus
agggcctccttcgtagatcttatca

SEQ ID NO: 199662 - DNA, 25 bp, Mus musculus
agggcctccttctcatcattcgaca

SEQ ID NO: 199663 - DNA, 25 bp, Mus musculus
agggcctcgtcaagcctttgaattt

SEQ ID NO: 199664 - DNA, 25 bp, Mus musculus
agggcctcgtcatgcctttgaattt

SEQ ID NO: 199665 - DNA, 25 bp, Mus musculus
agggcctctacaatttctccagccc

SEQ ID NO: 199666 - DNA, 25 bp, Mus musculus
agggcctctacattttctccagccc

SEQ ID NO: 199667 - DNA, 25 bp, Mus musculus
agggcctctagacttacgcagtttt

SEQ ID NO: 199668 - DNA, 25 bp, Mus musculus
agggcctctagagttacgcagtttt

SEQ ID NO: 199669 - DNA, 25 bp, Mus musculus
agggcctctctgcaagcaacactcg

SEQ ID NO: 199670 - DNA, 25 bp, Mus musculus
agggcctctctggaagcaacactcg

SEQ ID NO: 199671 - DNA, 25 bp, Mus musculus
agggcctctggtaaagcccaggcta

SEQ ID NO: 199672 - DNA, 25 bp, Mus musculus
agggcctctggttaagcccaggcta

SEQ ID NO: 199673 - DNA, 25 bp, Mus musculus
agggcctctgtcaggtgtttagtta

SEQ ID NO: 199674 - DNA, 25 bp, Mus musculus
agggcctctgtctggtgtttagtta

SEQ ID NO: 199675 - DNA, 25 bp, Mus musculus
agggcctcttacagaatcaccttga

SEQ ID NO: 199676 - DNA, 25 bp, Mus musculus
agggcctcttacctcggatggaagt

SEQ ID NO: 199677 - DNA, 25 bp, Mus musculus
agggcctcttacgtcggatggaagt

SEQ ID NO: 199678 - DNA, 25 bp, Mus musculus
agggcctcttactgaatcaccttga

SEQ ID NO: 199679 - DNA, 25 bp, Mus musculus
agggcctcttgaaagttgccataga

SEQ ID NO: 199680 - DNA, 25 bp, Mus musculus
agggcctcttgatagttgccataga

SEQ ID NO: 199681 - DNA, 25 bp, Mus musculus
agggcctctttccttctcagggtct

SEQ ID NO: 199682 - DNA, 25 bp, Mus musculus
agggcctctttcgttctcagggtct

SEQ ID NO: 199683 - DNA, 25 bp, Mus musculus
agggcctgaagtcccatggtcatat

SEQ ID NO: 199684 - DNA, 25 bp, Mus musculus
agggcctgaagtgccatggtcatat

SEQ ID NO: 199685 - DNA, 25 bp, Mus musculus
agggcctgactgaacatgcatctta

SEQ ID NO: 199686 - DNA, 25 bp, Mus musculus
agggcctgactgtacatgcatctta

SEQ ID NO: 199687 - DNA, 25 bp, Mus musculus
agggcctgacttatacagcttttct

SEQ ID NO: 199688 - DNA, 25 bp, Mus musculus
agggcctgacttttacagcttttct

SEQ ID NO: 199689 - DNA, 25 bp, Mus musculus
agggcctgaggcctgccctttagaa

SEQ ID NO: 199690 - DNA, 25 bp, Mus musculus
agggcctgaggcgtgccctttagaa

SEQ ID NO: 199691 - DNA, 25 bp, Mus musculus
agggcctgcatcaccgagttcagaa

SEQ ID NO: 199692 - DNA, 25 bp, Mus musculus
agggcctgcatctccgagttcagaa

SEQ ID NO: 199693 - DNA, 25 bp, Mus musculus
agggcctgccaccactagactgtgt

SEQ ID NO: 199694 - DNA, 25 bp, Mus musculus
agggcctgccacgactagactgtgt

SEQ ID NO: 199695 - DNA, 25 bp, Mus musculus
agggcctgcttcactggaacatagg

SEQ ID NO: 199696 - DNA, 25 bp, Mus musculus
agggcctgcttcatgggaccagcta

SEQ ID NO: 199697 - DNA, 25 bp, Mus musculus
agggcctgcttctctggaacatagg

SEQ ID NO: 199698 - DNA, 25 bp, Mus musculus
agggcctgcttcttgggaccagcta

SEQ ID NO: 199699 - DNA, 25 bp, Mus musculus
agggcctggactatcatcgattcta

SEQ ID NO: 199700 - DNA, 25 bp, Mus musculus
agggcctggactttcatcgattcta

SEQ ID NO: 199701 - DNA, 25 bp, Mus musculus
agggcctggatcacacagggcctta

SEQ ID NO: 199702 - DNA, 25 bp, Mus musculus
agggcctggatctcacagggcctta

SEQ ID NO: 199703 - DNA, 25 bp, Mus musculus
agggcctggtagatgtcagttcacc

SEQ ID NO: 199704 - DNA, 25 bp, Mus musculus
agggcctggtagttgtcagttcacc

SEQ ID NO: 199705 - DNA, 25 bp, Mus musculus
agggcctgtaagacctctgggagca

SEQ ID NO: 199706 - DNA, 25 bp, Mus musculus
agggcctgtaagtcctctgggagca

SEQ ID NO: 199707 - DNA, 25 bp, Mus musculus
agggcctgtgaaacttgtgcataaa

SEQ ID NO: 199708 - DNA, 25 bp, Mus musculus
agggcctgtgaatcttgtgcataaa

SEQ ID NO: 199709 - DNA, 25 bp, Mus musculus
agggcctgtgtgaggaccccatgtc

SEQ ID NO: 199710 - DNA, 25 bp, Mus musculus
agggcctgtgtgtggaccccatgtc

SEQ ID NO: 199711 - DNA, 25 bp, Mus musculus
agggcctgttgcacaagagtgcact

SEQ ID NO: 199712 - DNA, 25 bp, Mus musculus
agggcctgttgctcaagagtgcact

SEQ ID NO: 199713 - DNA, 25 bp, Mus musculus
agggcctgtttaaaatcagcttcaa

SEQ ID NO: 199714 - DNA, 25 bp, Mus musculus
agggcctgtttataatcagcttcaa

SEQ ID NO: 199715 - DNA, 25 bp, Mus musculus
agggcctgtttgaggacatcgatac

SEQ ID NO: 199716 - DNA, 25 bp, Mus musculus
agggcctgtttgtggacatcgatac

SEQ ID NO: 199717 - DNA, 25 bp, Mus musculus
agggccttagacacccaagcttggg

SEQ ID NO: 199718 - DNA, 25 bp, Mus musculus
agggccttagactcccaagcttggg

SEQ ID NO: 199719 - DNA, 25 bp, Mus musculus
agggccttagtgactgtaacctcag

SEQ ID NO: 199720 - DNA, 25 bp, Mus musculus
agggccttagtgtctgtaacctcag

SEQ ID NO: 199721 - DNA, 25 bp, Mus musculus
agggccttatgcagctgtctgtatc

SEQ ID NO: 199722 - DNA, 25 bp, Mus musculus
agggccttatgctgctgtctgtatc

SEQ ID NO: 199723 - DNA, 25 bp, Mus musculus
agggccttcaagaacagcctatcac

SEQ ID NO: 199724 - DNA, 25 bp, Mus musculus
agggccttcaagacactgggcagga

SEQ ID NO: 199725 - DNA, 25 bp, Mus musculus
agggccttcaagtacagcctatcac

SEQ ID NO: 199726 - DNA, 25 bp, Mus musculus
agggccttcaagtcactgggcagga

SEQ ID NO: 199727 - DNA, 25 bp, Mus musculus
agggccttcctgagtcaatgcagtg

SEQ ID NO: 199728 - DNA, 25 bp, Mus musculus
agggccttcctgtgtcaatgcagtg

SEQ ID NO: 199729 - DNA, 25 bp, Mus musculus
agggccttcgataaatgtcaattga

SEQ ID NO: 199730 - DNA, 25 bp, Mus musculus
agggccttcgattaatgtcaattga

SEQ ID NO: 199731 - DNA, 25 bp, Mus musculus
agggccttcggactcaggttcaaga

SEQ ID NO: 199732 - DNA, 25 bp, Mus musculus
agggccttcggagtcaggttcaaga

SEQ ID NO: 199733 - DNA, 25 bp, Mus musculus
agggccttctgtctaccctgaagag

SEQ ID NO: 199734 - DNA, 25 bp, Mus musculus
agggccttctgtgtaccctgaagag

SEQ ID NO: 199735 - DNA, 25 bp, Mus musculus
agggccttgaatctatgatcccctg

SEQ ID NO: 199736 - DNA, 25 bp, Mus musculus
agggccttgaatgtatgatcccctg

SEQ ID NO: 199737 - DNA, 25 bp, Mus musculus
agggccttgcataggctaagtgcca

SEQ ID NO: 199738 - DNA, 25 bp, Mus musculus
agggccttgcattggctaagtgcca

SEQ ID NO: 199739 - DNA, 25 bp, Mus musculus
agggccttgccaagtctcagggaac

SEQ ID NO: 199740 - DNA, 25 bp, Mus musculus
agggccttgccatgtctcagggaac

SEQ ID NO: 199741 - DNA, 25 bp, Mus musculus
agggccttgcctcgtgagctgtcat

SEQ ID NO: 199742 - DNA, 25 bp, Mus musculus
agggccttgcctggtgagctgtcat

SEQ ID NO: 199743 - DNA, 25 bp, Mus musculus
agggccttgctcattctgatacatt

SEQ ID NO: 199744 - DNA, 25 bp, Mus musculus
agggccttgctctttctgatacatt

SEQ ID NO: 199745 - DNA, 25 bp, Mus musculus
agggccttgggcaactggacaagct

SEQ ID NO: 199746 - DNA, 25 bp, Mus musculus
agggccttgggctactggacaagct

SEQ ID NO: 199747 - DNA, 25 bp, Mus musculus
agggccttggtacctggatactgcc

SEQ ID NO: 199748 - DNA, 25 bp, Mus musculus
agggccttggtagctggatactgcc

SEQ ID NO: 199749 - DNA, 25 bp, Mus musculus
agggccttgtcccagaagtgtcctg

SEQ ID NO: 199750 - DNA, 25 bp, Mus musculus
agggccttgtccgagaagtgtcctg

SEQ ID NO: 199751 - DNA, 25 bp, Mus musculus
agggcctttacaccattctttatgg

SEQ ID NO: 199752 - DNA, 25 bp, Mus musculus
agggcctttacagcattctttatgg

SEQ ID NO: 199753 - DNA, 25 bp, Mus musculus
agggcctttcaacactgggagataa

SEQ ID NO: 199754 - DNA, 25 bp, Mus musculus
agggcctttcaagactgggagataa

SEQ ID NO: 199755 - DNA, 25 bp, Mus musculus
agggcctttcacatgctagtcaact

SEQ ID NO: 199756 - DNA, 25 bp, Mus musculus
agggcctttcacttgctagtcaact

SEQ ID NO: 199757 - DNA, 25 bp, Mus musculus
agggcctttgacacacctgtgagcc

SEQ ID NO: 199758 - DNA, 25 bp, Mus musculus
agggcctttgactcacctgtgagcc

SEQ ID NO: 199759 - DNA, 25 bp, Mus musculus
agggcctttgttctacctctgagga

SEQ ID NO: 199760 - DNA, 25 bp, Mus musculus
agggcctttgttgtacctctgagga

SEQ ID NO: 199761 - DNA, 25 bp, Mus musculus
agggccttttgcagtatgtagattg

SEQ ID NO: 199762 - DNA, 25 bp, Mus musculus
agggccttttgccagttgatcagca

SEQ ID NO: 199763 - DNA, 25 bp, Mus musculus
agggccttttgcgagttgatcagca

SEQ ID NO: 199764 - DNA, 25 bp, Mus musculus
agggccttttgctgtatgtagattg

SEQ ID NO: 199765 - DNA, 25 bp, Mus musculus
agggcgaacctgagttaccgataca

SEQ ID NO: 199766 - DNA, 25 bp, Mus musculus
agggcgaacctgtgttaccgataca

SEQ ID NO: 199767 - DNA, 25 bp, Mus musculus
agggcgaagatccacccgaggttct

SEQ ID NO: 199768 - DNA, 25 bp, Mus musculus
agggcgaagatcgacccgaggttct

SEQ ID NO: 199769 - DNA, 25 bp, Mus musculus
agggcgacacagagaccaggacaat

SEQ ID NO: 199770 - DNA, 25 bp, Mus musculus
agggcgacacagtgaccaggacaat

SEQ ID NO: 199771 - DNA, 25 bp, Mus musculus
agggcgacagtcaagcttataagga

SEQ ID NO: 199772 - DNA, 25 bp, Mus musculus
agggcgacagtctagcttataagga

SEQ ID NO: 199773 - DNA, 25 bp, Mus musculus
agggcgactacaacgtgtccgtgaa

SEQ ID NO: 199774 - DNA, 25 bp, Mus musculus
agggcgactacatcgtgtccgtgaa

SEQ ID NO: 199775 - DNA, 25 bp, Mus musculus
agggcgacttccacattagggacag

SEQ ID NO: 199776 - DNA, 25 bp, Mus musculus
agggcgacttcctcattagggacag

SEQ ID NO: 199777 - DNA, 25 bp, Mus musculus
agggcgagaaacagctgtttgagaa

SEQ ID NO: 199778 - DNA, 25 bp, Mus musculus
agggcgagaaactgctgtttgagaa

SEQ ID NO: 199779 - DNA, 25 bp, Mus musculus
agggcgagaagcagcaactcctgag

SEQ ID NO: 199780 - DNA, 25 bp, Mus musculus
agggcgagaagctgcaactcctgag

SEQ ID NO: 199781 - DNA, 25 bp, Mus musculus
agggcgagatcgctactattcttgc

SEQ ID NO: 199782 - DNA, 25 bp, Mus musculus
agggcgagatcggtactattcttgc

SEQ ID NO: 199783 - DNA, 25 bp, Mus musculus
agggcgagcgtcacccgggccgaag

SEQ ID NO: 199784 - DNA, 25 bp, Mus musculus
agggcgagcgtctcccgggccgaag

SEQ ID NO: 199785 - DNA, 25 bp, Mus musculus
agggcgaggctcaggatgcatccaa

SEQ ID NO: 199786 - DNA, 25 bp, Mus musculus
agggcgaggctctggatgcatccaa

SEQ ID NO: 199787 - DNA, 25 bp, Mus musculus
agggcgaggctgacttctccatgct

SEQ ID NO: 199788 - DNA, 25 bp, Mus musculus
agggcgaggctgtcttctccatgct

SEQ ID NO: 199789 - DNA, 25 bp, Mus musculus
agggcgataatcattaacactccga

SEQ ID NO: 199790 - DNA, 25 bp, Mus musculus
agggcgataatctttaacactccga

SEQ ID NO: 199791 - DNA, 25 bp, Mus musculus
agggcgatatcaacacactcactaa

SEQ ID NO: 199792 - DNA, 25 bp, Mus musculus
agggcgatatcatcacactcactaa

SEQ ID NO: 199793 - DNA, 25 bp, Mus musculus
agggcgatccctagggagtctcaaa

SEQ ID NO: 199794 - DNA, 25 bp, Mus musculus
agggcgatcccttgggagtctcaaa

SEQ ID NO: 199795 - DNA, 25 bp, Mus musculus
agggcgatggctcatctgtctcagt

SEQ ID NO: 199796 - DNA, 25 bp, Mus musculus
agggcgatggctgatctgtctcagt

SEQ ID NO: 199797 - DNA, 25 bp, Mus musculus
agggcgatttcgatgagcacacaga

SEQ ID NO: 199798 - DNA, 25 bp, Mus musculus
agggcgatttcgttgagcacacaga

SEQ ID NO: 199799 - DNA, 25 bp, Mus musculus
agggcgatttgactgactgccacct

SEQ ID NO: 199800 - DNA, 25 bp, Mus musculus
agggcgatttgagtgactgccacct

SEQ ID NO: 199801 - DNA, 25 bp, Mus musculus
agggcgcacaccatatcacacgtgg

SEQ ID NO: 199802 - DNA, 25 bp, Mus musculus
agggcgcacaccttatcacacgtgg

SEQ ID NO: 199803 - DNA, 25 bp, Mus musculus
agggcgcagcacacgatggtgcaca

SEQ ID NO: 199804 - DNA, 25 bp, Mus musculus
agggcgcagcactcgatggtgcaca

SEQ ID NO: 199805 - DNA, 25 bp, Mus musculus
agggcgcatgatcgattctttgcta

SEQ ID NO: 199806 - DNA, 25 bp, Mus musculus
agggcgcatgatggattctttgcta

SEQ ID NO: 199807 - DNA, 25 bp, Mus musculus
agggcgcatttcatggactgttacc

SEQ ID NO: 199808 - DNA, 25 bp, Mus musculus
agggcgcatttcttggactgttacc

SEQ ID NO: 199809 - DNA, 25 bp, Mus musculus
agggcgccaggacctctagaattgc

SEQ ID NO: 199810 - DNA, 25 bp, Mus musculus
agggcgccaggagctctagaattgc

SEQ ID NO: 199811 - DNA, 25 bp, Mus musculus
agggcgccttctatagttaccatgg

SEQ ID NO: 199812 - DNA, 25 bp, Mus musculus
agggcgccttctttagttaccatgg

SEQ ID NO: 199813 - DNA, 25 bp, Mus musculus
agggcgccttgacgccgcagacact

SEQ ID NO: 199814 - DNA, 25 bp, Mus musculus
agggcgccttgaggccgcagacact

SEQ ID NO: 199815 - DNA, 25 bp, Mus musculus
agggcgccttggatagcatcaccaa

SEQ ID NO: 199816 - DNA, 25 bp, Mus musculus
agggcgccttggttagcatcaccaa

SEQ ID NO: 199817 - DNA, 25 bp, Mus musculus
agggcgctcctgcacatgtgcttgc

SEQ ID NO: 199818 - DNA, 25 bp, Mus musculus
agggcgctcctggacatgtgcttgc

SEQ ID NO: 199819 - DNA, 25 bp, Mus musculus
agggcgctctttatgtgcacagtcc

SEQ ID NO: 199820 - DNA, 25 bp, Mus musculus
agggcgctctttttgtgcacagtcc

SEQ ID NO: 199821 - DNA, 25 bp, Mus musculus
agggcgctgagacaacaccacacca

SEQ ID NO: 199822 - DNA, 25 bp, Mus musculus
agggcgctgagagaacaccacacca

SEQ ID NO: 199823 - DNA, 25 bp, Mus musculus
agggcgctgagcaccatcaggtcag

SEQ ID NO: 199824 - DNA, 25 bp, Mus musculus
agggcgctgagctccatcaggtcag

SEQ ID NO: 199825 - DNA, 25 bp, Mus musculus
agggcgcttatcagactttctgctg

SEQ ID NO: 199826 - DNA, 25 bp, Mus musculus
agggcgcttatctgactttctgctg

SEQ ID NO: 199827 - DNA, 25 bp, Mus musculus
agggcggcatgtattgagtttcaga

SEQ ID NO: 199828 - DNA, 25 bp, Mus musculus
agggcggcatgttttgagtttcaga

SEQ ID NO: 199829 - DNA, 25 bp, Mus musculus
agggcggccagaaccttcagacagc

SEQ ID NO: 199830 - DNA, 25 bp, Mus musculus
agggcggccagatccttcagacagc

SEQ ID NO: 199831 - DNA, 25 bp, Mus musculus
agggcggctctgacttgcgccccga

SEQ ID NO: 199832 - DNA, 25 bp, Mus musculus
agggcggctctgtcttgcgccccga

SEQ ID NO: 199833 - DNA, 25 bp, Mus musculus
agggcgggaaagagcctaagctcaa

SEQ ID NO: 199834 - DNA, 25 bp, Mus musculus
agggcgggaaagtgcctaagctcaa

SEQ ID NO: 199835 - DNA, 25 bp, Mus musculus
agggcgggctcgagctgatcactct

SEQ ID NO: 199836 - DNA, 25 bp, Mus musculus
agggcgggctcgtgctgatcactct

SEQ ID NO: 199837 - DNA, 25 bp, Mus musculus
agggcgggttccacttttggagcat

SEQ ID NO: 199838 - DNA, 25 bp, Mus musculus
agggcgggttcctcttttggagcat

SEQ ID NO: 199839 - DNA, 25 bp, Mus musculus
agggcggtccatcctggagaccatc

SEQ ID NO: 199840 - DNA, 25 bp, Mus musculus
agggcggtccatgctggagaccatc

SEQ ID NO: 199841 - DNA, 25 bp, Mus musculus
agggcggtcgccagcagcaagaagc

SEQ ID NO: 199842 - DNA, 25 bp, Mus musculus
agggcggtcgcctgcagcaagaagc

SEQ ID NO: 199843 - DNA, 25 bp, Mus musculus
agggcgtatggcagctaggtctcca

SEQ ID NO: 199844 - DNA, 25 bp, Mus musculus
agggcgtatggctgctaggtctcca

SEQ ID NO: 199845 - DNA, 25 bp, Mus musculus
agggcgtccggaactcattaggagt

SEQ ID NO: 199846 - DNA, 25 bp, Mus musculus
agggcgtccggatctcattaggagt

SEQ ID NO: 199847 - DNA, 25 bp, Mus musculus
agggcgtctactacattggcatcgg

SEQ ID NO: 199848 - DNA, 25 bp, Mus musculus
agggcgtctacttcattggcatcgg

SEQ ID NO: 199849 - DNA, 25 bp, Mus musculus
agggcgtctatccttgaaactcgga

SEQ ID NO: 199850 - DNA, 25 bp, Mus musculus
agggcgtctatcgttgaaactcgga

SEQ ID NO: 199851 - DNA, 25 bp, Mus musculus
agggcgtgatttcaagttcccagca

SEQ ID NO: 199852 - DNA, 25 bp, Mus musculus
agggcgtgatttgaagttcccagca

SEQ ID NO: 199853 - DNA, 25 bp, Mus musculus
agggcgtgctacaagctggtctgtc

SEQ ID NO: 199854 - DNA, 25 bp, Mus musculus
agggcgtgctactagctggtctgtc

SEQ ID NO: 199855 - DNA, 25 bp, Mus musculus
agggcgtgcttgacacacaggtagc

SEQ ID NO: 199856 - DNA, 25 bp, Mus musculus
agggcgtgcttgtcacacaggtagc

SEQ ID NO: 199857 - DNA, 25 bp, Mus musculus
agggcgtggccaagtcagagttctc

SEQ ID NO: 199858 - DNA, 25 bp, Mus musculus
agggcgtggccatgtcagagttctc

SEQ ID NO: 199859 - DNA, 25 bp, Mus musculus
agggcgtgtactctgtggactattc

SEQ ID NO: 199860 - DNA, 25 bp, Mus musculus
agggcgtgtactgtgtggactattc

SEQ ID NO: 199861 - DNA, 25 bp, Mus musculus
agggcgttcacaaccatgggtctgt

SEQ ID NO: 199862 - DNA, 25 bp, Mus musculus
agggcgttcacatccatgggtctgt

SEQ ID NO: 199863 - DNA, 25 bp, Mus musculus
agggcgtttaatcagcagattgcaa

SEQ ID NO: 199864 - DNA, 25 bp, Mus musculus
agggcgtttaatgagcagattgcaa

SEQ ID NO: 199865 - DNA, 25 bp, Mus musculus
agggcgtttcatatctactgtccat

SEQ ID NO: 199866 - DNA, 25 bp, Mus musculus
agggcgtttcatttctactgtccat

SEQ ID NO: 199867 - DNA, 25 bp, Mus musculus
agggctaaaactcgctggctttccg

SEQ ID NO: 199868 - DNA, 25 bp, Mus musculus
agggctaaaactggctggctttccg

SEQ ID NO: 199869 - DNA, 25 bp, Mus musculus
agggctaaactaccatcagcattta

SEQ ID NO: 199870 - DNA, 25 bp, Mus musculus
agggctaaactagcatcagcattta

SEQ ID NO: 199871 - DNA, 25 bp, Mus musculus
agggctaaactcactgcaactcatt

SEQ ID NO: 199872 - DNA, 25 bp, Mus musculus
agggctaaactctctgcaactcatt

SEQ ID NO: 199873 - DNA, 25 bp, Mus musculus
agggctaaacttatctctctactcg

SEQ ID NO: 199874 - DNA, 25 bp, Mus musculus
agggctaaacttttctctctactcg

SEQ ID NO: 199875 - DNA, 25 bp, Mus musculus
agggctaaagctaatgtcactgaca

SEQ ID NO: 199876 - DNA, 25 bp, Mus musculus
agggctaaagcttatgtcactgaca

SEQ ID NO: 199877 - DNA, 25 bp, Mus musculus
agggctaacataccgagtgctgtca

SEQ ID NO: 199878 - DNA, 25 bp, Mus musculus
agggctaacatagcgagtgctgtca

SEQ ID NO: 199879 - DNA, 25 bp, Mus musculus
agggctaacatcaacccacagggtt

SEQ ID NO: 199880 - DNA, 25 bp, Mus musculus
agggctaacatctacccacagggtt

SEQ ID NO: 199881 - DNA, 25 bp, Mus musculus
agggctaacctcacttcagacttga

SEQ ID NO: 199882 - DNA, 25 bp, Mus musculus
agggctaacctctcttcagacttga

SEQ ID NO: 199883 - DNA, 25 bp, Mus musculus
agggctaagatgctcctgtttgctt

SEQ ID NO: 199884 - DNA, 25 bp, Mus musculus
agggctaagatggtcctgtttgctt

SEQ ID NO: 199885 - DNA, 25 bp, Mus musculus
agggctaagctacacttctccttta

SEQ ID NO: 199886 - DNA, 25 bp, Mus musculus
agggctaagctagacttctccttta

SEQ ID NO: 199887 - DNA, 25 bp, Mus musculus
agggctaattgcacaacctctccat

SEQ ID NO: 199888 - DNA, 25 bp, Mus musculus
agggctaattgctcaacctctccat

SEQ ID NO: 199889 - DNA, 25 bp, Mus musculus
agggctacactcctacctctaggat

SEQ ID NO: 199890 - DNA, 25 bp, Mus musculus
agggctacactcgtacctctaggat

SEQ ID NO: 199891 - DNA, 25 bp, Mus musculus
agggctacagacataaggaactcca

SEQ ID NO: 199892 - DNA, 25 bp, Mus musculus
agggctacagacttaaggaactcca

SEQ ID NO: 199893 - DNA, 25 bp, Mus musculus
agggctacagccatgaaaactgggt

SEQ ID NO: 199894 - DNA, 25 bp, Mus musculus
agggctacagccttgaaaactgggt

SEQ ID NO: 199895 - DNA, 25 bp, Mus musculus
agggctacagctcctacaggacaga

SEQ ID NO: 199896 - DNA, 25 bp, Mus musculus
agggctacagctgctacaggacaga

SEQ ID NO: 199897 - DNA, 25 bp, Mus musculus
agggctacatctacccaatctcaga

SEQ ID NO: 199898 - DNA, 25 bp, Mus musculus
agggctacatcttcccaatctcaga

SEQ ID NO: 199899 - DNA, 25 bp, Mus musculus
agggctacattcatctgactcctaa

SEQ ID NO: 199900 - DNA, 25 bp, Mus musculus
agggctacattcttctgactcctaa

SEQ ID NO: 199901 - DNA, 25 bp, Mus musculus
agggctaccagaacctgcagttggg

SEQ ID NO: 199902 - DNA, 25 bp, Mus musculus
agggctaccagatcctgcagttggg

SEQ ID NO: 199903 - DNA, 25 bp, Mus musculus
agggctacccttagggtctctgagg

SEQ ID NO: 199904 - DNA, 25 bp, Mus musculus
agggctaccctttgggtctctgagg

SEQ ID NO: 199905 - DNA, 25 bp, Mus musculus
agggctaccgctcactcggaactta

SEQ ID NO: 199906 - DNA, 25 bp, Mus musculus
agggctaccgctgactcggaactta

SEQ ID NO: 199907 - DNA, 25 bp, Mus musculus
agggctacctatatattcctcacac

SEQ ID NO: 199908 - DNA, 25 bp, Mus musculus
agggctacctatttattcctcacac

SEQ ID NO: 199909 - DNA, 25 bp, Mus musculus
agggctaccttgacactggccgatg

SEQ ID NO: 199910 - DNA, 25 bp, Mus musculus
agggctaccttgtcactggccgatg

SEQ ID NO: 199911 - DNA, 25 bp, Mus musculus
agggctacctttactcactctggag

SEQ ID NO: 199912 - DNA, 25 bp, Mus musculus
agggctacctttctagagcgtccat

SEQ ID NO: 199913 - DNA, 25 bp, Mus musculus
agggctacctttgtagagcgtccat

SEQ ID NO: 199914 - DNA, 25 bp, Mus musculus
agggctaccttttctcactctggag

SEQ ID NO: 199915 - DNA, 25 bp, Mus musculus
agggctacggcaaggcatacactgt

SEQ ID NO: 199916 - DNA, 25 bp, Mus musculus
agggctacggcatggcatacactgt

SEQ ID NO: 199917 - DNA, 25 bp, Mus musculus
agggctactagactggttcagcaga

SEQ ID NO: 199918 - DNA, 25 bp, Mus musculus
agggctactagagtggttcagcaga

SEQ ID NO: 199919 - DNA, 25 bp, Mus musculus
agggctactagtcgcaacagcagtc

SEQ ID NO: 199920 - DNA, 25 bp, Mus musculus
agggctactagtggcaacagcagtc

SEQ ID NO: 199921 - DNA, 25 bp, Mus musculus
agggctactatgcttgatattgcaa

SEQ ID NO: 199922 - DNA, 25 bp, Mus musculus
agggctactatggttgatattgcaa

SEQ ID NO: 199923 - DNA, 25 bp, Mus musculus
agggctactcatcaggaccaggaat

SEQ ID NO: 199924 - DNA, 25 bp, Mus musculus
agggctactcatgaggaccaggaat

SEQ ID NO: 199925 - DNA, 25 bp, Mus musculus
agggctactgccctgacagagtcta

SEQ ID NO: 199926 - DNA, 25 bp, Mus musculus
agggctactgccgtgacagagtcta

SEQ ID NO: 199927 - DNA, 25 bp, Mus musculus
agggctacttggcttcaaatcctgc

SEQ ID NO: 199928 - DNA, 25 bp, Mus musculus
agggctacttgggttcaaatcctgc

SEQ ID NO: 199929 - DNA, 25 bp, Mus musculus
agggctacttttaactaggtgacag

SEQ ID NO: 199930 - DNA, 25 bp, Mus musculus
agggctactttttactaggtgacag

SEQ ID NO: 199931 - DNA, 25 bp, Mus musculus
agggctagccttcactgccctagtg

SEQ ID NO: 199932 - DNA, 25 bp, Mus musculus
agggctagccttgactgccctagtg

SEQ ID NO: 199933 - DNA, 25 bp, Mus musculus
agggctagctgacccactcgatgga

SEQ ID NO: 199934 - DNA, 25 bp, Mus musculus
agggctagctgagccactcgatgga

SEQ ID NO: 199935 - DNA, 25 bp, Mus musculus
agggctagctggacttttcactgtc

SEQ ID NO: 199936 - DNA, 25 bp, Mus musculus
agggctagctggtcttttcactgtc

SEQ ID NO: 199937 - DNA, 25 bp, Mus musculus
agggctagtagtcagaccagctcaa

SEQ ID NO: 199938 - DNA, 25 bp, Mus musculus
agggctagtagtgagaccagctcaa

SEQ ID NO: 199939 - DNA, 25 bp, Mus musculus
agggctagtctgaggatttgcgtat

SEQ ID NO: 199940 - DNA, 25 bp, Mus musculus
agggctagtctgtggatttgcgtat

SEQ ID NO: 199941 - DNA, 25 bp, Mus musculus
agggctatacatctgccagcagctg

SEQ ID NO: 199942 - DNA, 25 bp, Mus musculus
agggctatacatgtgccagcagctg

SEQ ID NO: 199943 - DNA, 25 bp, Mus musculus
agggctatcaggaccaaatggccat

SEQ ID NO: 199944 - DNA, 25 bp, Mus musculus
agggctatcaggtccaaatggccat

SEQ ID NO: 199945 - DNA, 25 bp, Mus musculus
agggctatccacatcatttccctct

SEQ ID NO: 199946 - DNA, 25 bp, Mus musculus
agggctatccacttcatttccctct

SEQ ID NO: 199947 - DNA, 25 bp, Mus musculus
agggctatccagcaacctcgatcga

SEQ ID NO: 199948 - DNA, 25 bp, Mus musculus
agggctatccaggaacctcgatcga

SEQ ID NO: 199949 - DNA, 25 bp, Mus musculus
agggctatcccacaaatacgacaca

SEQ ID NO: 199950 - DNA, 25 bp, Mus musculus
agggctatcccagaaatacgacaca

SEQ ID NO: 199951 - DNA, 25 bp, Mus musculus
agggctatggagagtctgtgtcaaa

SEQ ID NO: 199952 - DNA, 25 bp, Mus musculus
agggctatggagtgtctgtgtcaaa

SEQ ID NO: 199953 - DNA, 25 bp, Mus musculus
agggctcaaatcaactcaggttttt

SEQ ID NO: 199954 - DNA, 25 bp, Mus musculus
agggctcaaatctactcaggttttt

SEQ ID NO: 199955 - DNA, 25 bp, Mus musculus
agggctcaactaatatggtctgtac

SEQ ID NO: 199956 - DNA, 25 bp, Mus musculus
agggctcaactattatggtctgtac

SEQ ID NO: 199957 - DNA, 25 bp, Mus musculus
agggctcaagtcctgaaagctcaga

SEQ ID NO: 199958 - DNA, 25 bp, Mus musculus
agggctcaagtcgtgaaagctcaga

SEQ ID NO: 199959 - DNA, 25 bp, Mus musculus
agggctcacagaagccagcttttat

SEQ ID NO: 199960 - DNA, 25 bp, Mus musculus
agggctcacagatgccagcttttat

SEQ ID NO: 199961 - DNA, 25 bp, Mus musculus
agggctcacatactgcgttctagaa

SEQ ID NO: 199962 - DNA, 25 bp, Mus musculus
agggctcacatagtgcgttctagaa

SEQ ID NO: 199963 - DNA, 25 bp, Mus musculus
agggctcaccttctcagatttagtg

SEQ ID NO: 199964 - DNA, 25 bp, Mus musculus
agggctcaccttgtcagatttagtg

SEQ ID NO: 199965 - DNA, 25 bp, Mus musculus
agggctcacgatccgaagctcacca

SEQ ID NO: 199966 - DNA, 25 bp, Mus musculus
agggctcacgatgcgaagctcacca

SEQ ID NO: 199967 - DNA, 25 bp, Mus musculus
agggctcactagaaggctgcacatg

SEQ ID NO: 199968 - DNA, 25 bp, Mus musculus
agggctcactagtaggctgcacatg

SEQ ID NO: 199969 - DNA, 25 bp, Mus musculus
agggctcactccactatgggtaatt

SEQ ID NO: 199970 - DNA, 25 bp, Mus musculus
agggctcactcctctatgggtaatt

SEQ ID NO: 199971 - DNA, 25 bp, Mus musculus
agggctcactgcacataaatgtcaa

SEQ ID NO: 199972 - DNA, 25 bp, Mus musculus
agggctcactgcattttacctcccg

SEQ ID NO: 199973 - DNA, 25 bp, Mus musculus
agggctcactgctcataaatgtcaa

SEQ ID NO: 199974 - DNA, 25 bp, Mus musculus
agggctcactgctttttacctcccg

SEQ ID NO: 199975 - DNA, 25 bp, Mus musculus
agggctcactttatactgaaatcca

SEQ ID NO: 199976 - DNA, 25 bp, Mus musculus
agggctcactttttactgaaatcca

SEQ ID NO: 199977 - DNA, 25 bp, Mus musculus
agggctcagacaccaccattaattg

SEQ ID NO: 199978 - DNA, 25 bp, Mus musculus
agggctcagacagcaccattaattg

SEQ ID NO: 199979 - DNA, 25 bp, Mus musculus
agggctcagagactaaagttcctgt

SEQ ID NO: 199980 - DNA, 25 bp, Mus musculus
agggctcagagagtaaagttcctgt

SEQ ID NO: 199981 - DNA, 25 bp, Mus musculus
agggctcagattacctgtaataaaa

SEQ ID NO: 199982 - DNA, 25 bp, Mus musculus
agggctcagatttcctgtaataaaa

SEQ ID NO: 199983 - DNA, 25 bp, Mus musculus
agggctcagcctaattcaaaataac

SEQ ID NO: 199984 - DNA, 25 bp, Mus musculus
agggctcagccttattcaaaataac

SEQ ID NO: 199985 - DNA, 25 bp, Mus musculus
agggctcagctcattatgtgtacaa

SEQ ID NO: 199986 - DNA, 25 bp, Mus musculus
agggctcagctctttatgtgtacaa

SEQ ID NO: 199987 - DNA, 25 bp, Mus musculus
agggctcagggtcctttgttatctc

SEQ ID NO: 199988 - DNA, 25 bp, Mus musculus
agggctcagggtgctttgttatctc

SEQ ID NO: 199989 - DNA, 25 bp, Mus musculus
agggctcagtgaccacaagcagtga

SEQ ID NO: 199990 - DNA, 25 bp, Mus musculus
agggctcagtgagcacaagcagtga

SEQ ID NO: 199991 - DNA, 25 bp, Mus musculus
agggctcagtgtaccctcgggagac

SEQ ID NO: 199992 - DNA, 25 bp, Mus musculus
agggctcagtgttccctcgggagac

SEQ ID NO: 199993 - DNA, 25 bp, Mus musculus
agggctcatcagaactgctgcgaca

SEQ ID NO: 199994 - DNA, 25 bp, Mus musculus
agggctcatcagtactgctgcgaca

SEQ ID NO: 199995 - DNA, 25 bp, Mus musculus
agggctcatttcacaactgctttac

SEQ ID NO: 199996 - DNA, 25 bp, Mus musculus
agggctcatttctcaactgctttac

SEQ ID NO: 199997 - DNA, 25 bp, Mus musculus
agggctccaaggacactgggatcat

SEQ ID NO: 199998 - DNA, 25 bp, Mus musculus
agggctccaaggtcactgggatcat

SEQ ID NO: 199999 - DNA, 25 bp, Mus musculus
agggctccagatcggttagctgcat

SEQ ID NO: 200000 - DNA, 25 bp, Mus musculus
agggctccagatgggttagctgcat

SEQ ID NO: 200001 - DNA, 25 bp, Mus musculus
agggctccagtcagaccagaaggtt

SEQ ID NO: 200002 - DNA, 25 bp, Mus musculus
agggctccagtctgaccagaaggtt

SEQ ID NO: 200003 - DNA, 25 bp, Mus musculus
agggctccatcacctgtggtatatg

SEQ ID NO: 200004 - DNA, 25 bp, Mus musculus
agggctccatcagctgtggtatatg

SEQ ID NO: 200005 - DNA, 25 bp, Mus musculus
agggctcccaatccactcggaagtc

SEQ ID NO: 200006 - DNA, 25 bp, Mus musculus
agggctcccaatgcactcggaagtc

SEQ ID NO: 200007 - DNA, 25 bp, Mus musculus
agggctcccatcattgtattttgta

SEQ ID NO: 200008 - DNA, 25 bp, Mus musculus
agggctcccatctttgtattttgta

SEQ ID NO: 200009 - DNA, 25 bp, Mus musculus
agggctccccagcaaatttcttgtg

SEQ ID NO: 200010 - DNA, 25 bp, Mus musculus
agggctccccaggaaatttcttgtg

SEQ ID NO: 200011 - DNA, 25 bp, Mus musculus
agggctccctagagtcttagggaca

SEQ ID NO: 200012 - DNA, 25 bp, Mus musculus
agggctccctagtgtcttagggaca

SEQ ID NO: 200013 - DNA, 25 bp, Mus musculus
agggctccctgacccttgggagaat

SEQ ID NO: 200014 - DNA, 25 bp, Mus musculus
agggctccctgagccttgggagaat

SEQ ID NO: 200015 - DNA, 25 bp, Mus musculus
agggctccctgcagttctatgacat

SEQ ID NO: 200016 - DNA, 25 bp, Mus musculus
agggctccctgctgttctatgacat

SEQ ID NO: 200017 - DNA, 25 bp, Mus musculus
agggctccctggcaacaccatcttt

SEQ ID NO: 200018 - DNA, 25 bp, Mus musculus
agggctccctgggaacaccatcttt

SEQ ID NO: 200019 - DNA, 25 bp, Mus musculus
agggctcccttcatggcttgtgaac

SEQ ID NO: 200020 - DNA, 25 bp, Mus musculus
agggctcccttcttggcttgtgaac

SEQ ID NO: 200021 - DNA, 25 bp, Mus musculus
agggctccctttcgatgtctacaat

SEQ ID NO: 200022 - DNA, 25 bp, Mus musculus
agggctccctttggatgtctacaat

SEQ ID NO: 200023 - DNA, 25 bp, Mus musculus
agggctccgctcagcagcccaaagg

SEQ ID NO: 200024 - DNA, 25 bp, Mus musculus
agggctccgctctgcagcccaaagg

SEQ ID NO: 200025 - DNA, 25 bp, Mus musculus
agggctccgggaagttgttactaag

SEQ ID NO: 200026 - DNA, 25 bp, Mus musculus
agggctccgggatgttgttactaag

SEQ ID NO: 200027 - DNA, 25 bp, Mus musculus
agggctcctactcagactgggttta

SEQ ID NO: 200028 - DNA, 25 bp, Mus musculus
agggctcctactgagactgggttta

SEQ ID NO: 200029 - DNA, 25 bp, Mus musculus
agggctcctcacaacagggtcacac

SEQ ID NO: 200030 - DNA, 25 bp, Mus musculus
agggctcctcactacagggtcacac

SEQ ID NO: 200031 - DNA, 25 bp, Mus musculus
agggctcctgagaacaaccctctgg

SEQ ID NO: 200032 - DNA, 25 bp, Mus musculus
agggctcctgagtacaaccctctgg

SEQ ID NO: 200033 - DNA, 25 bp, Mus musculus
agggctcctgctacgaggttattct

SEQ ID NO: 200034 - DNA, 25 bp, Mus musculus
agggctcctgcttcgaggttattct

SEQ ID NO: 200035 - DNA, 25 bp, Mus musculus
agggctcctggacatgtcctatgga

SEQ ID NO: 200036 - DNA, 25 bp, Mus musculus
agggctcctggagatgtcctatgga

SEQ ID NO: 200037 - DNA, 25 bp, Mus musculus
agggctcctggcaagggtacatttc

SEQ ID NO: 200038 - DNA, 25 bp, Mus musculus
agggctcctggctagggtacatttc

SEQ ID NO: 200039 - DNA, 25 bp, Mus musculus
agggctcctggtatttcatggactg

SEQ ID NO: 200040 - DNA, 25 bp, Mus musculus
agggctcctggtttttcatggactg

SEQ ID NO: 200041 - DNA, 25 bp, Mus musculus
agggctcctgtcagcgttctctctg

SEQ ID NO: 200042 - DNA, 25 bp, Mus musculus
agggctcctgtctgcgttctctctg

SEQ ID NO: 200043 - DNA, 25 bp, Mus musculus
agggctccttctcctcgtctcaggg

SEQ ID NO: 200044 - DNA, 25 bp, Mus musculus
agggctccttctgctcgtctcaggg

SEQ ID NO: 200045 - DNA, 25 bp, Mus musculus
agggctccttgcataaagacctgga

SEQ ID NO: 200046 - DNA, 25 bp, Mus musculus
agggctccttgccaagatctttgga

SEQ ID NO: 200047 - DNA, 25 bp, Mus musculus
agggctccttgcgaagatctttgga

SEQ ID NO: 200048 - DNA, 25 bp, Mus musculus
agggctccttgcttaaagacctgga

SEQ ID NO: 200049 - DNA, 25 bp, Mus musculus
agggctcctttcaaaagcaatggct

SEQ ID NO: 200050 - DNA, 25 bp, Mus musculus
agggctcctttctaaagcaatggct

SEQ ID NO: 200051 - DNA, 25 bp, Mus musculus
agggctccttttcggaggaccatgc

SEQ ID NO: 200052 - DNA, 25 bp, Mus musculus
agggctccttttgggaggaccatgc

SEQ ID NO: 200053 - DNA, 25 bp, Mus musculus
agggctcgacggacagctatggcaa

SEQ ID NO: 200054 - DNA, 25 bp, Mus musculus
agggctcgacggtcagctatggcaa

SEQ ID NO: 200055 - DNA, 25 bp, Mus musculus
agggctcggagcacctgcctggtca

SEQ ID NO: 200056 - DNA, 25 bp, Mus musculus
agggctcggagctcctgcctggtca

SEQ ID NO: 200057 - DNA, 25 bp, Mus musculus
agggctcggcaaactttgctattca

SEQ ID NO: 200058 - DNA, 25 bp, Mus musculus
agggctcggcaatctttgctattca

SEQ ID NO: 200059 - DNA, 25 bp, Mus musculus
agggctcggttcacagcaggctgaa

SEQ ID NO: 200060 - DNA, 25 bp, Mus musculus
agggctcggttctcagcaggctgaa

SEQ ID NO: 200061 - DNA, 25 bp, Mus musculus
agggctcgtcatcatatttgcgcat

SEQ ID NO: 200062 - DNA, 25 bp, Mus musculus
agggctcgtcatgatatttgcgcat

SEQ ID NO: 200063 - DNA, 25 bp, Mus musculus
agggctctacctcttacttttcaat

SEQ ID NO: 200064 - DNA, 25 bp, Mus musculus
agggctctacctgttacttttcaat

SEQ ID NO: 200065 - DNA, 25 bp, Mus musculus
agggctctagagaaagcagctagtg

SEQ ID NO: 200066 - DNA, 25 bp, Mus musculus
agggctctagagtaagcagctagtg

SEQ ID NO: 200067 - DNA, 25 bp, Mus musculus
agggctctatttagaaggctgtgaa

SEQ ID NO: 200068 - DNA, 25 bp, Mus musculus
agggctctattttgaaggctgtgaa

SEQ ID NO: 200069 - DNA, 25 bp, Mus musculus
agggctctcaaaagcgtggatggat

SEQ ID NO: 200070 - DNA, 25 bp, Mus musculus
agggctctcaaatgcgtggatggat

SEQ ID NO: 200071 - DNA, 25 bp, Mus musculus
agggctctcagtctggtgtccttac

SEQ ID NO: 200072 - DNA, 25 bp, Mus musculus
agggctctcagtgtggtgtccttac

SEQ ID NO: 200073 - DNA, 25 bp, Mus musculus
agggctctcatccaaatgacgaccc

SEQ ID NO: 200074 - DNA, 25 bp, Mus musculus
agggctctcatcgaaatgacgaccc

SEQ ID NO: 200075 - DNA, 25 bp, Mus musculus
agggctctccacaccagaatcttag

SEQ ID NO: 200076 - DNA, 25 bp, Mus musculus
agggctctccactccagaatcttag

SEQ ID NO: 200077 - DNA, 25 bp, Mus musculus
agggctctccctcataggcttgata

SEQ ID NO: 200078 - DNA, 25 bp, Mus musculus
agggctctccctgataggcttgata

SEQ ID NO: 200079 - DNA, 25 bp, Mus musculus
agggctctccgccatgtaatgggca

SEQ ID NO: 200080 - DNA, 25 bp, Mus musculus
agggctctccgcgatgtaatgggca

SEQ ID NO: 200081 - DNA, 25 bp, Mus musculus
agggctctctggaaggacaccaaac

SEQ ID NO: 200082 - DNA, 25 bp, Mus musculus
agggctctctggtaggacaccaaac

SEQ ID NO: 200083 - DNA, 25 bp, Mus musculus
agggctctgaccatgttcatagcgg

SEQ ID NO: 200084 - DNA, 25 bp, Mus musculus
agggctctgaccttgttcatagcgg

SEQ ID NO: 200085 - DNA, 25 bp, Mus musculus
agggctctgattcccagtttctaag

SEQ ID NO: 200086 - DNA, 25 bp, Mus musculus
agggctctgattgccagtttctaag

SEQ ID NO: 200087 - DNA, 25 bp, Mus musculus
agggctctgcagcactgtctgcata

SEQ ID NO: 200088 - DNA, 25 bp, Mus musculus
agggctctgcagctgttgagctaaa

SEQ ID NO: 200089 - DNA, 25 bp, Mus musculus
agggctctgcaggactgtctgcata

SEQ ID NO: 200090 - DNA, 25 bp, Mus musculus
agggctctgcaggtgttgagctaaa

SEQ ID NO: 200091 - DNA, 25 bp, Mus musculus
agggctctggctcggatacaatcct

SEQ ID NO: 200092 - DNA, 25 bp, Mus musculus
agggctctggctgggatacaatcct

SEQ ID NO: 200093 - DNA, 25 bp, Mus musculus
agggctctgtcccttacagacagga

SEQ ID NO: 200094 - DNA, 25 bp, Mus musculus
agggctctgtccgttacagacagga

SEQ ID NO: 200095 - DNA, 25 bp, Mus musculus
agggctctgtgtctccgatattagg

SEQ ID NO: 200096 - DNA, 25 bp, Mus musculus
agggctctgtgtgtccgatattagg

SEQ ID NO: 200097 - DNA, 25 bp, Mus musculus
agggctcttaggaccttgctagctt

SEQ ID NO: 200098 - DNA, 25 bp, Mus musculus
agggctcttaggtccttgctagctt

SEQ ID NO: 200099 - DNA, 25 bp, Mus musculus
agggctcttattctgtaattctctt

SEQ ID NO: 200100 - DNA, 25 bp, Mus musculus
agggctcttattgtgtaattctctt

SEQ ID NO: 200101 - DNA, 25 bp, Mus musculus
agggctcttgctatctggaaattgt

SEQ ID NO: 200102 - DNA, 25 bp, Mus musculus
agggctcttgctttctggaaattgt

SEQ ID NO: 200103 - DNA, 25 bp, Mus musculus
agggctctttaaatctgggcccaag

SEQ ID NO: 200104 - DNA, 25 bp, Mus musculus
agggctctttaacagaagcaccgtc

SEQ ID NO: 200105 - DNA, 25 bp, Mus musculus
agggctctttaagagaagcaccgtc

SEQ ID NO: 200106 - DNA, 25 bp, Mus musculus
agggctctttaattctgggcccaag

SEQ ID NO: 200107 - DNA, 25 bp, Mus musculus
agggctgaaagcacggagccttccg

SEQ ID NO: 200108 - DNA, 25 bp, Mus musculus
agggctgaaagctcggagccttccg

SEQ ID NO: 200109 - DNA, 25 bp, Mus musculus
agggctgaactcacagaagtggtta

SEQ ID NO: 200110 - DNA, 25 bp, Mus musculus
agggctgaactctcagaagtggtta

SEQ ID NO: 200111 - DNA, 25 bp, Mus musculus
agggctgaactgatgttactgaaat

SEQ ID NO: 200112 - DNA, 25 bp, Mus musculus
agggctgaactgttgttactgaaat

SEQ ID NO: 200113 - DNA, 25 bp, Mus musculus
agggctgaagatctacccagtcctg

SEQ ID NO: 200114 - DNA, 25 bp, Mus musculus
agggctgaagatgtacccagtcctg

SEQ ID NO: 200115 - DNA, 25 bp, Mus musculus
agggctgaagttctgtgttctactt

SEQ ID NO: 200116 - DNA, 25 bp, Mus musculus
agggctgaagttgtgtgttctactt

SEQ ID NO: 200117 - DNA, 25 bp, Mus musculus
agggctgacacacagcacctcggaa

SEQ ID NO: 200118 - DNA, 25 bp, Mus musculus
agggctgacacagagcacctcggaa

SEQ ID NO: 200119 - DNA, 25 bp, Mus musculus
agggctgaccgcatcaagggcaagt

SEQ ID NO: 200120 - DNA, 25 bp, Mus musculus
agggctgaccgcttcaagggcaagt

SEQ ID NO: 200121 - DNA, 25 bp, Mus musculus
agggctgacctcagtgttttaccgt

SEQ ID NO: 200122 - DNA, 25 bp, Mus musculus
agggctgacctctgtgttttaccgt

SEQ ID NO: 200123 - DNA, 25 bp, Mus musculus
agggctgactgaactggcctccttt

SEQ ID NO: 200124 - DNA, 25 bp, Mus musculus
agggctgactgaatactgtgacact

SEQ ID NO: 200125 - DNA, 25 bp, Mus musculus
agggctgactgatctggcctccttt

SEQ ID NO: 200126 - DNA, 25 bp, Mus musculus
agggctgactgattactgtgacact

SEQ ID NO: 200127 - DNA, 25 bp, Mus musculus
agggctgactgtattgtgcactgta

SEQ ID NO: 200128 - DNA, 25 bp, Mus musculus
agggctgactgttttgtgcactgta

SEQ ID NO: 200129 - DNA, 25 bp, Mus musculus
agggctgagcacatgtttgtcatca

SEQ ID NO: 200130 - DNA, 25 bp, Mus musculus
agggctgagcacttgtttgtcatca

SEQ ID NO: 200131 - DNA, 25 bp, Mus musculus
agggctgagctcaggtctctggtct

SEQ ID NO: 200132 - DNA, 25 bp, Mus musculus
agggctgagctcatctaaacagact

SEQ ID NO: 200133 - DNA, 25 bp, Mus musculus
agggctgagctctggtctctggtct

SEQ ID NO: 200134 - DNA, 25 bp, Mus musculus
agggctgagctcttctaaacagact

SEQ ID NO: 200135 - DNA, 25 bp, Mus musculus
agggctgaggtcacttactctgtat

SEQ ID NO: 200136 - DNA, 25 bp, Mus musculus
agggctgaggtctcttactctgtat

SEQ ID NO: 200137 - DNA, 25 bp, Mus musculus
agggctgagtccagaggctgaacaa

SEQ ID NO: 200138 - DNA, 25 bp, Mus musculus
agggctgagtcctgaggctgaacaa

SEQ ID NO: 200139 - DNA, 25 bp, Mus musculus
agggctgatctgatgcttctggata

SEQ ID NO: 200140 - DNA, 25 bp, Mus musculus
agggctgatctgttgcttctggata

SEQ ID NO: 200141 - DNA, 25 bp, Mus musculus
agggctgatcttatttctctttgtt

SEQ ID NO: 200142 - DNA, 25 bp, Mus musculus
agggctgatcttttttctctttgtt

SEQ ID NO: 200143 - DNA, 25 bp, Mus musculus
agggctgcaaatccacgaactgcaa

SEQ ID NO: 200144 - DNA, 25 bp, Mus musculus
agggctgcaaatgcacgaactgcaa

SEQ ID NO: 200145 - DNA, 25 bp, Mus musculus
agggctgcatctccaaagaggcttc

SEQ ID NO: 200146 - DNA, 25 bp, Mus musculus
agggctgcatctgcaaagaggcttc

SEQ ID NO: 200147 - DNA, 25 bp, Mus musculus
agggctgcatgcactttgtgaggca

SEQ ID NO: 200148 - DNA, 25 bp, Mus musculus
agggctgcatgctctttgtgaggca

SEQ ID NO: 200149 - DNA, 25 bp, Mus musculus
agggctgcccttatttgctactggg

SEQ ID NO: 200150 - DNA, 25 bp, Mus musculus
agggctgcccttttttgctactggg

SEQ ID NO: 200151 - DNA, 25 bp, Mus musculus
agggctgccgacctctggatctgaa

SEQ ID NO: 200152 - DNA, 25 bp, Mus musculus
agggctgccgacgtctggatctgaa

SEQ ID NO: 200153 - DNA, 25 bp, Mus musculus
agggctgcctaccatcgacattgat

SEQ ID NO: 200154 - DNA, 25 bp, Mus musculus
agggctgcctacgatcgacattgat

SEQ ID NO: 200155 - DNA, 25 bp, Mus musculus
agggctgcgattatctttatttctc

SEQ ID NO: 200156 - DNA, 25 bp, Mus musculus
agggctgcgattttctttatttctc

SEQ ID NO: 200157 - DNA, 25 bp, Mus musculus
agggctgcgctgaaactgagcttca

SEQ ID NO: 200158 - DNA, 25 bp, Mus musculus
agggctgcgctgtaactgagcttca

SEQ ID NO: 200159 - DNA, 25 bp, Mus musculus
agggctgcggcaagtgattcttcat

SEQ ID NO: 200160 - DNA, 25 bp, Mus musculus
agggctgcggcatgtgattcttcat

SEQ ID NO: 200161 - DNA, 25 bp, Mus musculus
agggctgctacactgcacagaggtt

SEQ ID NO: 200162 - DNA, 25 bp, Mus musculus
agggctgctacagtgcacagaggtt

SEQ ID NO: 200163 - DNA, 25 bp, Mus musculus
agggctgctactccaggttgcttat

SEQ ID NO: 200164 - DNA, 25 bp, Mus musculus
agggctgctactgcaggttgcttat

SEQ ID NO: 200165 - DNA, 25 bp, Mus musculus
agggctgctcgacctctgactctaa

SEQ ID NO: 200166 - DNA, 25 bp, Mus musculus
agggctgctcgagctctgactctaa

SEQ ID NO: 200167 - DNA, 25 bp, Mus musculus
agggctgctgcaaatgagtacatac

SEQ ID NO: 200168 - DNA, 25 bp, Mus musculus
agggctgctgcatatgagtacatac

SEQ ID NO: 200169 - DNA, 25 bp, Mus musculus
agggctgctgctaagcaatcgattt

SEQ ID NO: 200170 - DNA, 25 bp, Mus musculus
agggctgctgcttagcaatcgattt

SEQ ID NO: 200171 - DNA, 25 bp, Mus musculus
agggctgcttctacacagtagtgaa

SEQ ID NO: 200172 - DNA, 25 bp, Mus musculus
agggctgcttcttcacagtagtgaa

SEQ ID NO: 200173 - DNA, 25 bp, Mus musculus
agggctgctttaattctggaggatt

SEQ ID NO: 200174 - DNA, 25 bp, Mus musculus
agggctgctttatttctggaggatt

SEQ ID NO: 200175 - DNA, 25 bp, Mus musculus
agggctgctttgctaaatgtttcta

SEQ ID NO: 200176 - DNA, 25 bp, Mus musculus
agggctgctttggtaaatgtttcta

SEQ ID NO: 200177 - DNA, 25 bp, Mus musculus
agggctggaattacaggcgtctgac

SEQ ID NO: 200178 - DNA, 25 bp, Mus musculus
agggctggaatttcaggcgtctgac

SEQ ID NO: 200179 - DNA, 25 bp, Mus musculus
agggctggatttcaatgcatttatc

SEQ ID NO: 200180 - DNA, 25 bp, Mus musculus
agggctggatttgaatgcatttatc

SEQ ID NO: 200181 - DNA, 25 bp, Mus musculus
agggctggcaagcagtaaccttcct

SEQ ID NO: 200182 - DNA, 25 bp, Mus musculus
agggctggcaaggagtaaccttcct

SEQ ID NO: 200183 - DNA, 25 bp, Mus musculus
agggctggcacacatggcatctaac

SEQ ID NO: 200184 - DNA, 25 bp, Mus musculus
agggctggcacagatggcatctaac

SEQ ID NO: 200185 - DNA, 25 bp, Mus musculus
agggctggcactaggcaatgtcacc

SEQ ID NO: 200186 - DNA, 25 bp, Mus musculus
agggctggcacttggcaatgtcacc

SEQ ID NO: 200187 - DNA, 25 bp, Mus musculus
agggctggcagcaaggggcttggca

SEQ ID NO: 200188 - DNA, 25 bp, Mus musculus
agggctggcagctaggggcttggca

SEQ ID NO: 200189 - DNA, 25 bp, Mus musculus
agggctggcaggagatgaccttcac

SEQ ID NO: 200190 - DNA, 25 bp, Mus musculus
agggctggcaggtgatgaccttcac

SEQ ID NO: 200191 - DNA, 25 bp, Mus musculus
agggctggccaaagggtccagttct

SEQ ID NO: 200192 - DNA, 25 bp, Mus musculus
agggctggccaatgggtccagttct

SEQ ID NO: 200193 - DNA, 25 bp, Mus musculus
agggctggccagcttctgccaccga

SEQ ID NO: 200194 - DNA, 25 bp, Mus musculus
agggctggccaggttctgccaccga

SEQ ID NO: 200195 - DNA, 25 bp, Mus musculus
agggctggccatcggtaccttactt

SEQ ID NO: 200196 - DNA, 25 bp, Mus musculus
agggctggccatgggtaccttactt

SEQ ID NO: 200197 - DNA, 25 bp, Mus musculus
agggctggcccaatacttgtcacag

SEQ ID NO: 200198 - DNA, 25 bp, Mus musculus
agggctggcccaattcattttgtca

SEQ ID NO: 200199 - DNA, 25 bp, Mus musculus
agggctggcccattacttgtcacag

SEQ ID NO: 200200 - DNA, 25 bp, Mus musculus
agggctggcccatttcattttgtca

SEQ ID NO: 200201 - DNA, 25 bp, Mus musculus
agggctggccccagaggattctact

SEQ ID NO: 200202 - DNA, 25 bp, Mus musculus
agggctggcccctgaggattctact

SEQ ID NO: 200203 - DNA, 25 bp, Mus musculus
agggctggccctccaagaaggttca

SEQ ID NO: 200204 - DNA, 25 bp, Mus musculus
agggctggccctgcaagaaggttca

SEQ ID NO: 200205 - DNA, 25 bp, Mus musculus
agggctggcctgcattaagatttca

SEQ ID NO: 200206 - DNA, 25 bp, Mus musculus
agggctggcctggattaagatttca

SEQ ID NO: 200207 - DNA, 25 bp, Mus musculus
agggctggccttaccatggttggca

SEQ ID NO: 200208 - DNA, 25 bp, Mus musculus
agggctggcctttccatggttggca

SEQ ID NO: 200209 - DNA, 25 bp, Mus musculus
agggctggctacagcagctccgctg

SEQ ID NO: 200210 - DNA, 25 bp, Mus musculus
agggctggctactgcagctccgctg

SEQ ID NO: 200211 - DNA, 25 bp, Mus musculus
agggctggctgcagatcaaggcaca

SEQ ID NO: 200212 - DNA, 25 bp, Mus musculus
agggctggctgctgatcaaggcaca

SEQ ID NO: 200213 - DNA, 25 bp, Mus musculus
agggctgggatcaaaaccagactct

SEQ ID NO: 200214 - DNA, 25 bp, Mus musculus
agggctgggatcagattcttggtca

SEQ ID NO: 200215 - DNA, 25 bp, Mus musculus
agggctgggatctaaaccagactct

SEQ ID NO: 200216 - DNA, 25 bp, Mus musculus
agggctgggatctgattcttggtca

SEQ ID NO: 200217 - DNA, 25 bp, Mus musculus
agggctggtcatcaactcggatata

SEQ ID NO: 200218 - DNA, 25 bp, Mus musculus
agggctggtcatgaactcggatata

SEQ ID NO: 200219 - DNA, 25 bp, Mus musculus
agggctggtcctaccataataaagc

SEQ ID NO: 200220 - DNA, 25 bp, Mus musculus
agggctggtccttccataataaagc

SEQ ID NO: 200221 - DNA, 25 bp, Mus musculus
agggctggtctgacaatcatgccaa

SEQ ID NO: 200222 - DNA, 25 bp, Mus musculus
agggctggtctgcaatcggcaccaa

SEQ ID NO: 200223 - DNA, 25 bp, Mus musculus
agggctggtctggaatcggcaccaa

SEQ ID NO: 200224 - DNA, 25 bp, Mus musculus
agggctggtctgtcaatcatgccaa

SEQ ID NO: 200225 - DNA, 25 bp, Mus musculus
agggctggttatatttatctcagtt

SEQ ID NO: 200226 - DNA, 25 bp, Mus musculus
agggctggttatttttatctcagtt

SEQ ID NO: 200227 - DNA, 25 bp, Mus musculus
agggctggttgtacctgcccatatt

SEQ ID NO: 200228 - DNA, 25 bp, Mus musculus
agggctggttgttcctgcccatatt

SEQ ID NO: 200229 - DNA, 25 bp, Mus musculus
agggctggtttgcaatcctctagaa

SEQ ID NO: 200230 - DNA, 25 bp, Mus musculus
agggctggtttggaatcctctagaa

SEQ ID NO: 200231 - DNA, 25 bp, Mus musculus
agggctggttttctcattcagacta

SEQ ID NO: 200232 - DNA, 25 bp, Mus musculus
agggctggttttgtcattcagacta

SEQ ID NO: 200233 - DNA, 25 bp, Mus musculus
agggctgtaactatatttcatattt

SEQ ID NO: 200234 - DNA, 25 bp, Mus musculus
agggctgtaactcgcctttgccagg

SEQ ID NO: 200235 - DNA, 25 bp, Mus musculus
agggctgtaactggcctttgccagg

SEQ ID NO: 200236 - DNA, 25 bp, Mus musculus
agggctgtaactttatttcatattt

SEQ ID NO: 200237 - DNA, 25 bp, Mus musculus
agggctgtacttaatctacttaatc

SEQ ID NO: 200238 - DNA, 25 bp, Mus musculus
agggctgtactttatctacttaatc

SEQ ID NO: 200239 - DNA, 25 bp, Mus musculus
agggctgtagagaacctgttctgaa

SEQ ID NO: 200240 - DNA, 25 bp, Mus musculus
agggctgtagagtacctgttctgaa

SEQ ID NO: 200241 - DNA, 25 bp, Mus musculus
agggctgtagctcgactactcagtc

SEQ ID NO: 200242 - DNA, 25 bp, Mus musculus
agggctgtagctggactactcagtc

SEQ ID NO: 200243 - DNA, 25 bp, Mus musculus
agggctgtagtgcatgttcatgctt

SEQ ID NO: 200244 - DNA, 25 bp, Mus musculus
agggctgtagtggatgttcatgctt

SEQ ID NO: 200245 - DNA, 25 bp, Mus musculus
agggctgtatctcgtctacattcta

SEQ ID NO: 200246 - DNA, 25 bp, Mus musculus
agggctgtatctggtctacattcta

SEQ ID NO: 200247 - DNA, 25 bp, Mus musculus
agggctgtatttcatgttcgctact

SEQ ID NO: 200248 - DNA, 25 bp, Mus musculus
agggctgtatttgatgttcgctact

SEQ ID NO: 200249 - DNA, 25 bp, Mus musculus
agggctgtcacaacaaaacgcaatg

SEQ ID NO: 200250 - DNA, 25 bp, Mus musculus
agggctgtcacatcaaaacgcaatg

SEQ ID NO: 200251 - DNA, 25 bp, Mus musculus
agggctgtcactcaatatgcctagc

SEQ ID NO: 200252 - DNA, 25 bp, Mus musculus
agggctgtcactgaatatgcctagc

SEQ ID NO: 200253 - DNA, 25 bp, Mus musculus
agggctgtcatcatagcggttctcc

SEQ ID NO: 200254 - DNA, 25 bp, Mus musculus
agggctgtcatcttagcggttctcc

SEQ ID NO: 200255 - DNA, 25 bp, Mus musculus
agggctgtgcagatatttgtgttgt

SEQ ID NO: 200256 - DNA, 25 bp, Mus musculus
agggctgtgcagttatttgtgttgt

SEQ ID NO: 200257 - DNA, 25 bp, Mus musculus
agggctgtgccacgcgtggaaggag

SEQ ID NO: 200258 - DNA, 25 bp, Mus musculus
agggctgtgccaggcgtggaaggag

SEQ ID NO: 200259 - DNA, 25 bp, Mus musculus
agggctgtgcctcgaacactctgga

SEQ ID NO: 200260 - DNA, 25 bp, Mus musculus
agggctgtgcctggaacactctgga

SEQ ID NO: 200261 - DNA, 25 bp, Mus musculus
agggctgtgctgaagccgtctccag

SEQ ID NO: 200262 - DNA, 25 bp, Mus musculus
agggctgtgctgcagtcatccccaa

SEQ ID NO: 200263 - DNA, 25 bp, Mus musculus
agggctgtgctggagtcatccccaa

SEQ ID NO: 200264 - DNA, 25 bp, Mus musculus
agggctgtgctgtagccgtctccag

SEQ ID NO: 200265 - DNA, 25 bp, Mus musculus
agggctgtggacatctgccctccgt

SEQ ID NO: 200266 - DNA, 25 bp, Mus musculus
agggctgtggacttctgccctccgt

SEQ ID NO: 200267 - DNA, 25 bp, Mus musculus
agggctgtggatactgtgaacagca

SEQ ID NO: 200268 - DNA, 25 bp, Mus musculus
agggctgtggatattctgttctcat

SEQ ID NO: 200269 - DNA, 25 bp, Mus musculus
agggctgtggattctgtgaacagca

SEQ ID NO: 200270 - DNA, 25 bp, Mus musculus
agggctgtggattttctgttctcat

SEQ ID NO: 200271 - DNA, 25 bp, Mus musculus
agggctgtggccataactccagagg

SEQ ID NO: 200272 - DNA, 25 bp, Mus musculus
agggctgtggccttaactccagagg

SEQ ID NO: 200273 - DNA, 25 bp, Mus musculus
agggctgtgggaatctcttctggca

SEQ ID NO: 200274 - DNA, 25 bp, Mus musculus
agggctgtgggattctcttctggca

SEQ ID NO: 200275 - DNA, 25 bp, Mus musculus
agggctgtggtcagtttcttccctc

SEQ ID NO: 200276 - DNA, 25 bp, Mus musculus
agggctgtggtctgtttcttccctc

SEQ ID NO: 200277 - DNA, 25 bp, Mus musculus
agggctgtggtgactacttgttcat

SEQ ID NO: 200278 - DNA, 25 bp, Mus musculus
agggctgtggtgtctacttgttcat

SEQ ID NO: 200279 - DNA, 25 bp, Mus musculus
agggctgtggttaggttgccatccc

SEQ ID NO: 200280 - DNA, 25 bp, Mus musculus
agggctgtggtttggttgccatccc

SEQ ID NO: 200281 - DNA, 25 bp, Mus musculus
agggctgtgtataactccctggact

SEQ ID NO: 200282 - DNA, 25 bp, Mus musculus
agggctgtgtattactccctggact

SEQ ID NO: 200283 - DNA, 25 bp, Mus musculus
agggctgtgtcaccatcactgtacg

SEQ ID NO: 200284 - DNA, 25 bp, Mus musculus
agggctgtgtcagcatcactgtacg

SEQ ID NO: 200285 - DNA, 25 bp, Mus musculus
agggctgtgtccacactaagtgctc

SEQ ID NO: 200286 - DNA, 25 bp, Mus musculus
agggctgtgtcctcactaagtgctc

SEQ ID NO: 200287 - DNA, 25 bp, Mus musculus
agggctgtgtctacttccaaagatc

SEQ ID NO: 200288 - DNA, 25 bp, Mus musculus
agggctgtgtcttcttccaaagatc

SEQ ID NO: 200289 - DNA, 25 bp, Mus musculus
agggctgtttacattcagtaatgaa

SEQ ID NO: 200290 - DNA, 25 bp, Mus musculus
agggctgtttactttcagtaatgaa

SEQ ID NO: 200291 - DNA, 25 bp, Mus musculus
agggctgtttctccaatgctataag

SEQ ID NO: 200292 - DNA, 25 bp, Mus musculus
agggctgtttctgcaatgctataag

SEQ ID NO: 200293 - DNA, 25 bp, Mus musculus
agggctgtttggattgaggacttca

SEQ ID NO: 200294 - DNA, 25 bp, Mus musculus
agggctgtttggtttgaggacttca

SEQ ID NO: 200295 - DNA, 25 bp, Mus musculus
agggctgtttttaatattcttgtga

SEQ ID NO: 200296 - DNA, 25 bp, Mus musculus
agggctgttttttatattcttgtga

SEQ ID NO: 200297 - DNA, 25 bp, Mus musculus
agggcttaacgacccatctggcaaa

SEQ ID NO: 200298 - DNA, 25 bp, Mus musculus
agggcttaacgagccatctggcaaa

SEQ ID NO: 200299 - DNA, 25 bp, Mus musculus
agggcttaatagaggcattttctac

SEQ ID NO: 200300 - DNA, 25 bp, Mus musculus
agggcttaatagtggcattttctac

SEQ ID NO: 200301 - DNA, 25 bp, Mus musculus
agggcttacactcggaggctacttc

SEQ ID NO: 200302 - DNA, 25 bp, Mus musculus
agggcttacactgggaggctacttc

SEQ ID NO: 200303 - DNA, 25 bp, Mus musculus
agggcttacagcaacagttcctgct

SEQ ID NO: 200304 - DNA, 25 bp, Mus musculus
agggcttacagctacagttcctgct

SEQ ID NO: 200305 - DNA, 25 bp, Mus musculus
agggcttaccctagcaaggcagcca

SEQ ID NO: 200306 - DNA, 25 bp, Mus musculus
agggcttacccttgcaaggcagcca

SEQ ID NO: 200307 - DNA, 25 bp, Mus musculus
agggcttacctcagcaagacttaac

SEQ ID NO: 200308 - DNA, 25 bp, Mus musculus
agggcttacctctgcaagacttaac

SEQ ID NO: 200309 - DNA, 25 bp, Mus musculus
agggcttaccttctagacccagaat

SEQ ID NO: 200310 - DNA, 25 bp, Mus musculus
agggcttaccttgtagacccagaat

SEQ ID NO: 200311 - DNA, 25 bp, Mus musculus
agggcttactctcgtgatactccgt

SEQ ID NO: 200312 - DNA, 25 bp, Mus musculus
agggcttactctggtgatactccgt

SEQ ID NO: 200313 - DNA, 25 bp, Mus musculus
agggcttagaccagcctttgccttt

SEQ ID NO: 200314 - DNA, 25 bp, Mus musculus
agggcttagacctgcctttgccttt

SEQ ID NO: 200315 - DNA, 25 bp, Mus musculus
agggcttagagcctcacatttccta

SEQ ID NO: 200316 - DNA, 25 bp, Mus musculus
agggcttagagcgtcacatttccta

SEQ ID NO: 200317 - DNA, 25 bp, Mus musculus
agggcttagctgagggctgtttcac

SEQ ID NO: 200318 - DNA, 25 bp, Mus musculus
agggcttagctgtgggctgtttcac

SEQ ID NO: 200319 - DNA, 25 bp, Mus musculus
agggcttatcagattgcaggtcgaa

SEQ ID NO: 200320 - DNA, 25 bp, Mus musculus
agggcttatcagtttgcaggtcgaa

SEQ ID NO: 200321 - DNA, 25 bp, Mus musculus
agggcttatcttcttgggccaaata

SEQ ID NO: 200322 - DNA, 25 bp, Mus musculus
agggcttatcttgttgggccaaata

SEQ ID NO: 200323 - DNA, 25 bp, Mus musculus
agggcttattttagtctgtgttctc

SEQ ID NO: 200324 - DNA, 25 bp, Mus musculus
agggcttatttttgtctgtgttctc

SEQ ID NO: 200325 - DNA, 25 bp, Mus musculus
agggcttcaaggacaccctttgcta

SEQ ID NO: 200326 - DNA, 25 bp, Mus musculus
agggcttcaaggcacaaaccagcaa

SEQ ID NO: 200327 - DNA, 25 bp, Mus musculus
agggcttcaagggacaaaccagcaa

SEQ ID NO: 200328 - DNA, 25 bp, Mus musculus
agggcttcaaggtcaccctttgcta

SEQ ID NO: 200329 - DNA, 25 bp, Mus musculus
agggcttcacatagctgctgtcttc

SEQ ID NO: 200330 - DNA, 25 bp, Mus musculus
agggcttcacatattgctcaaccat

SEQ ID NO: 200331 - DNA, 25 bp, Mus musculus
agggcttcacattgctgctgtcttc

SEQ ID NO: 200332 - DNA, 25 bp, Mus musculus
agggcttcacattttgctcaaccat

SEQ ID NO: 200333 - DNA, 25 bp, Mus musculus
agggcttcacctagttcaggcagat

SEQ ID NO: 200334 - DNA, 25 bp, Mus musculus
agggcttcaccttgttcaggcagat

SEQ ID NO: 200335 - DNA, 25 bp, Mus musculus
agggcttcactgaatccaccaggtt

SEQ ID NO: 200336 - DNA, 25 bp, Mus musculus
agggcttcactgtatccaccaggtt

SEQ ID NO: 200337 - DNA, 25 bp, Mus musculus
agggcttcagaaagaattcccacac

SEQ ID NO: 200338 - DNA, 25 bp, Mus musculus
agggcttcagaactcacaggacagg

SEQ ID NO: 200339 - DNA, 25 bp, Mus musculus
agggcttcagaagtcacaggacagg

SEQ ID NO: 200340 - DNA, 25 bp, Mus musculus
agggcttcagaatgaattcccacac

SEQ ID NO: 200341 - DNA, 25 bp, Mus musculus
agggcttcagacaacaccagtcttc

SEQ ID NO: 200342 - DNA, 25 bp, Mus musculus
agggcttcagactacaccagtcttc

SEQ ID NO: 200343 - DNA, 25 bp, Mus musculus
agggcttcagcaaagtttggactag

SEQ ID NO: 200344 - DNA, 25 bp, Mus musculus
agggcttcagcatagtttggactag

SEQ ID NO: 200345 - DNA, 25 bp, Mus musculus
agggcttcagccagggcgtgttcct

SEQ ID NO: 200346 - DNA, 25 bp, Mus musculus
agggcttcagcctgggcgtgttcct

SEQ ID NO: 200347 - DNA, 25 bp, Mus musculus
agggcttcagctcagtgtcacaatt

SEQ ID NO: 200348 - DNA, 25 bp, Mus musculus
agggcttcagctcgaactccgttct

SEQ ID NO: 200349 - DNA, 25 bp, Mus musculus
agggcttcagctgagtgtcacaatt

SEQ ID NO: 200350 - DNA, 25 bp, Mus musculus
agggcttcagctggaactccgttct

SEQ ID NO: 200351 - DNA, 25 bp, Mus musculus
agggcttcaggcactggtctttccc

SEQ ID NO: 200352 - DNA, 25 bp, Mus musculus
agggcttcaggctctggtctttccc

SEQ ID NO: 200353 - DNA, 25 bp, Mus musculus
agggcttcagtgatggctgtctgcc

SEQ ID NO: 200354 - DNA, 25 bp, Mus musculus
agggcttcagtgttggctgtctgcc

SEQ ID NO: 200355 - DNA, 25 bp, Mus musculus
agggcttccaagctgcttcgcatat

SEQ ID NO: 200356 - DNA, 25 bp, Mus musculus
agggcttccaaggtgcttcgcatat

SEQ ID NO: 200357 - DNA, 25 bp, Mus musculus
agggcttccagcctgttccatgtga

SEQ ID NO: 200358 - DNA, 25 bp, Mus musculus
agggcttccagcgtgttccatgtga

SEQ ID NO: 200359 - DNA, 25 bp, Mus musculus
agggcttccgcaaaactaacctgct

SEQ ID NO: 200360 - DNA, 25 bp, Mus musculus
agggcttccgcataactaacctgct

SEQ ID NO: 200361 - DNA, 25 bp, Mus musculus
agggcttcctgacttatgtgcttga

SEQ ID NO: 200362 - DNA, 25 bp, Mus musculus
agggcttcctgagttatgtgcttga

SEQ ID NO: 200363 - DNA, 25 bp, Mus musculus
agggcttcctgcacaagtcacagtt

SEQ ID NO: 200364 - DNA, 25 bp, Mus musculus
agggcttcctgctcaagtcacagtt

SEQ ID NO: 200365 - DNA, 25 bp, Mus musculus
agggcttccttgactctttgtgaaa

SEQ ID NO: 200366 - DNA, 25 bp, Mus musculus
agggcttccttgtctctttgtgaaa

SEQ ID NO: 200367 - DNA, 25 bp, Mus musculus
agggcttcggagaggacaagacctt

SEQ ID NO: 200368 - DNA, 25 bp, Mus musculus
agggcttcggagtggacaagacctt

SEQ ID NO: 200369 - DNA, 25 bp, Mus musculus
agggcttcggttcccttttgaaatg

SEQ ID NO: 200370 - DNA, 25 bp, Mus musculus
agggcttcggttgccttttgaaatg

SEQ ID NO: 200371 - DNA, 25 bp, Mus musculus
agggcttctcaccatgacattagtc

SEQ ID NO: 200372 - DNA, 25 bp, Mus musculus
agggcttctcacgatgacattagtc

SEQ ID NO: 200373 - DNA, 25 bp, Mus musculus
agggcttcttccatctgggtgtggc

SEQ ID NO: 200374 - DNA, 25 bp, Mus musculus
agggcttcttccttctgggtgtggc

SEQ ID NO: 200375 - DNA, 25 bp, Mus musculus
agggcttcttcgagtctgtgttcta

SEQ ID NO: 200376 - DNA, 25 bp, Mus musculus
agggcttcttcgtgtctgtgttcta

SEQ ID NO: 200377 - DNA, 25 bp, Mus musculus
agggcttgaccgagatgaccccaca

SEQ ID NO: 200378 - DNA, 25 bp, Mus musculus
agggcttgaccgtgatgaccccaca

SEQ ID NO: 200379 - DNA, 25 bp, Mus musculus
agggcttgagatcagtccctagcac

SEQ ID NO: 200380 - DNA, 25 bp, Mus musculus
agggcttgagatgagtccctagcac

SEQ ID NO: 200381 - DNA, 25 bp, Mus musculus
agggcttgaggcatgtctttgacaa

SEQ ID NO: 200382 - DNA, 25 bp, Mus musculus
agggcttgaggcttgtctttgacaa

SEQ ID NO: 200383 - DNA, 25 bp, Mus musculus
agggcttgccatcaagacctgagaa

SEQ ID NO: 200384 - DNA, 25 bp, Mus musculus
agggcttgccatgaagacctgagaa

SEQ ID NO: 200385 - DNA, 25 bp, Mus musculus
agggcttgcctacctgtggcttaaa

SEQ ID NO: 200386 - DNA, 25 bp, Mus musculus
agggcttgcctacgtgcacggtcct

SEQ ID NO: 200387 - DNA, 25 bp, Mus musculus
agggcttgcctagctgtggcttaaa

SEQ ID NO: 200388 - DNA, 25 bp, Mus musculus
agggcttgcctaggtgcacggtcct

SEQ ID NO: 200389 - DNA, 25 bp, Mus musculus
agggcttgctctcgtgaccgtcttc

SEQ ID NO: 200390 - DNA, 25 bp, Mus musculus
agggcttgctctggtgaccgtcttc

SEQ ID NO: 200391 - DNA, 25 bp, Mus musculus
agggcttggagactaccccgagcct

SEQ ID NO: 200392 - DNA, 25 bp, Mus musculus
agggcttggagagtaccccgagcct

SEQ ID NO: 200393 - DNA, 25 bp, Mus musculus
agggcttggcacagatggagtccca

SEQ ID NO: 200394 - DNA, 25 bp, Mus musculus
agggcttggcactgatggagtccca

SEQ ID NO: 200395 - DNA, 25 bp, Mus musculus
agggcttggcccacatgggaatcat

SEQ ID NO: 200396 - DNA, 25 bp, Mus musculus
agggcttggccctcatgggaatcat

SEQ ID NO: 200397 - DNA, 25 bp, Mus musculus
agggcttggcctactgtgaaactca

SEQ ID NO: 200398 - DNA, 25 bp, Mus musculus
agggcttggccttctgtgaaactca

SEQ ID NO: 200399 - DNA, 25 bp, Mus musculus
agggcttgggcaactggattcctgc

SEQ ID NO: 200400 - DNA, 25 bp, Mus musculus
agggcttgggcatctggattcctgc

SEQ ID NO: 200401 - DNA, 25 bp, Mus musculus
agggcttgggttcaatcctgctcag

SEQ ID NO: 200402 - DNA, 25 bp, Mus musculus
agggcttgggttgaatcctgctcag

SEQ ID NO: 200403 - DNA, 25 bp, Mus musculus
agggcttggtgcaacggtcagattt

SEQ ID NO: 200404 - DNA, 25 bp, Mus musculus
agggcttggtgctacggtcagattt

SEQ ID NO: 200405 - DNA, 25 bp, Mus musculus
agggcttgtactatgcactttttat

SEQ ID NO: 200406 - DNA, 25 bp, Mus musculus
agggcttgtactttgcactttttat

SEQ ID NO: 200407 - DNA, 25 bp, Mus musculus
agggcttgtatgacttttaaaatag

SEQ ID NO: 200408 - DNA, 25 bp, Mus musculus
agggcttgtatgtcttttaaaatag

SEQ ID NO: 200409 - DNA, 25 bp, Mus musculus
agggcttgtcataagagccacggct

SEQ ID NO: 200410 - DNA, 25 bp, Mus musculus
agggcttgtcattagagccacggct

SEQ ID NO: 200411 - DNA, 25 bp, Mus musculus
agggcttgtcttcactgtcagaggt

SEQ ID NO: 200412 - DNA, 25 bp, Mus musculus
agggcttgtcttgactgtcagaggt

SEQ ID NO: 200413 - DNA, 25 bp, Mus musculus
agggcttgtgaaacctagtcttgag

SEQ ID NO: 200414 - DNA, 25 bp, Mus musculus
agggcttgtgaatcctagtcttgag

SEQ ID NO: 200415 - DNA, 25 bp, Mus musculus
agggcttgtgcaaggtcatctcctg

SEQ ID NO: 200416 - DNA, 25 bp, Mus musculus
agggcttgtgcatggtcatctcctg

SEQ ID NO: 200417 - DNA, 25 bp, Mus musculus
agggcttgtggaagtgtagacttat

SEQ ID NO: 200418 - DNA, 25 bp, Mus musculus
agggcttgtggatgtgtagacttat

SEQ ID NO: 200419 - DNA, 25 bp, Mus musculus
agggctttacctctattcacactga

SEQ ID NO: 200420 - DNA, 25 bp, Mus musculus
agggctttacctgtattcacactga

SEQ ID NO: 200421 - DNA, 25 bp, Mus musculus
agggctttaggacttgagacattgt

SEQ ID NO: 200422 - DNA, 25 bp, Mus musculus
agggctttaggagttgagacattgt

SEQ ID NO: 200423 - DNA, 25 bp, Mus musculus
agggctttattcattcttggcacca

SEQ ID NO: 200424 - DNA, 25 bp, Mus musculus
agggctttattctttcttggcacca

SEQ ID NO: 200425 - DNA, 25 bp, Mus musculus
agggctttattgaacatattgctta

SEQ ID NO: 200426 - DNA, 25 bp, Mus musculus
agggctttattgtacatattgctta

SEQ ID NO: 200427 - DNA, 25 bp, Mus musculus
agggctttcaagctctctcatattt

SEQ ID NO: 200428 - DNA, 25 bp, Mus musculus
agggctttcaaggtctctcatattt

SEQ ID NO: 200429 - DNA, 25 bp, Mus musculus
agggctttcaatcgctccagcaatg

SEQ ID NO: 200430 - DNA, 25 bp, Mus musculus
agggctttcaatggctccagcaatg

SEQ ID NO: 200431 - DNA, 25 bp, Mus musculus
agggctttcattcttgtatccccat

SEQ ID NO: 200432 - DNA, 25 bp, Mus musculus
agggctttcattgttgtatccccat

SEQ ID NO: 200433 - DNA, 25 bp, Mus musculus
agggctttccctattcagtgaggag

SEQ ID NO: 200434 - DNA, 25 bp, Mus musculus
agggctttcccttttcagtgaggag

SEQ ID NO: 200435 - DNA, 25 bp, Mus musculus
agggctttcgctcttgctgatgctc

SEQ ID NO: 200436 - DNA, 25 bp, Mus musculus
agggctttcgctgttgctgatgctc

SEQ ID NO: 200437 - DNA, 25 bp, Mus musculus
agggctttctcaatttgtcatcatc

SEQ ID NO: 200438 - DNA, 25 bp, Mus musculus
agggctttctcattttgtcatcatc

SEQ ID NO: 200439 - DNA, 25 bp, Mus musculus
agggctttctgtatgacttacctca

SEQ ID NO: 200440 - DNA, 25 bp, Mus musculus
agggctttctgtttgacttacctca

SEQ ID NO: 200441 - DNA, 25 bp, Mus musculus
agggctttgaatagttgctctctcc

SEQ ID NO: 200442 - DNA, 25 bp, Mus musculus
agggctttgaattgttgctctctcc

SEQ ID NO: 200443 - DNA, 25 bp, Mus musculus
agggctttgaccaacgctcaggagt

SEQ ID NO: 200444 - DNA, 25 bp, Mus musculus
agggctttgacctacgctcaggagt

SEQ ID NO: 200445 - DNA, 25 bp, Mus musculus
agggctttgagcatgatcttttgaa

SEQ ID NO: 200446 - DNA, 25 bp, Mus musculus
agggctttgagcatgctagactagc

SEQ ID NO: 200447 - DNA, 25 bp, Mus musculus
agggctttgagcttgatcttttgaa

SEQ ID NO: 200448 - DNA, 25 bp, Mus musculus
agggctttgagcttgctagactagc

SEQ ID NO: 200449 - DNA, 25 bp, Mus musculus
agggctttgccacccaattggtctg

SEQ ID NO: 200450 - DNA, 25 bp, Mus musculus
agggctttgccagccaattggtctg

SEQ ID NO: 200451 - DNA, 25 bp, Mus musculus
agggctttgctcagttcatgtgtag

SEQ ID NO: 200452 - DNA, 25 bp, Mus musculus
agggctttgctctgttcatgtgtag

SEQ ID NO: 200453 - DNA, 25 bp, Mus musculus
agggctttgctgctacgcactgaca

SEQ ID NO: 200454 - DNA, 25 bp, Mus musculus
agggctttgctggtacgcactgaca

SEQ ID NO: 200455 - DNA, 25 bp, Mus musculus
agggctttgcttagtcaaccattta

SEQ ID NO: 200456 - DNA, 25 bp, Mus musculus
agggctttgctttgtcaaccattta

SEQ ID NO: 200457 - DNA, 25 bp, Mus musculus
agggctttgggaatctacccatctg

SEQ ID NO: 200458 - DNA, 25 bp, Mus musculus
agggctttgggattctacccatctg

SEQ ID NO: 200459 - DNA, 25 bp, Mus musculus
agggctttgtcacactgccttcatg

SEQ ID NO: 200460 - DNA, 25 bp, Mus musculus
agggctttgtcagactgccttcatg

SEQ ID NO: 200461 - DNA, 25 bp, Mus musculus
agggctttgtgcagtgtctgtcagt

SEQ ID NO: 200462 - DNA, 25 bp, Mus musculus
agggctttgtgctgtgtctgtcagt

SEQ ID NO: 200463 - DNA, 25 bp, Mus musculus
agggctttgttacccagtgaagtca

SEQ ID NO: 200464 - DNA, 25 bp, Mus musculus
agggctttgttagccagtgaagtca

SEQ ID NO: 200465 - DNA, 25 bp, Mus musculus
agggctttgttgcttggcctaagct

SEQ ID NO: 200466 - DNA, 25 bp, Mus musculus
agggctttgttggttggcctaagct

SEQ ID NO: 200467 - DNA, 25 bp, Mus musculus
agggcttttaggctggacttctact

SEQ ID NO: 200468 - DNA, 25 bp, Mus musculus
agggcttttagggtggacttctact

SEQ ID NO: 200469 - DNA, 25 bp, Mus musculus
agggctttttgaactggtattatca

SEQ ID NO: 200470 - DNA, 25 bp, Mus musculus
agggctttttgatctggtattatca

SEQ ID NO: 200471 - DNA, 25 bp, Mus musculus
agggcttttttaaattgcatccagt

SEQ ID NO: 200472 - DNA, 25 bp, Mus musculus
agggcttttttaatagtgtgtaatg

SEQ ID NO: 200473 - DNA, 25 bp, Mus musculus
agggcttttttatattgcatccagt

SEQ ID NO: 200474 - DNA, 25 bp, Mus musculus
agggcttttttattagtgtgtaatg

SEQ ID NO: 200475 - DNA, 25 bp, Mus musculus
aggggacacgatccctcctcaggca

SEQ ID NO: 200476 - DNA, 25 bp, Mus musculus
aggggacacgatgcctcctcaggca

SEQ ID NO: 200477 - DNA, 25 bp, Mus musculus
aggggacatgtcactttcctttcta

SEQ ID NO: 200478 - DNA, 25 bp, Mus musculus
aggggacatgtctctttcctttcta

SEQ ID NO: 200479 - DNA, 25 bp, Mus musculus
aggggaccagcaaccctagatattt

SEQ ID NO: 200480 - DNA, 25 bp, Mus musculus
aggggaccagcatccctagatattt

SEQ ID NO: 200481 - DNA, 25 bp, Mus musculus
aggggacctgtcacttagtgttagg

SEQ ID NO: 200482 - DNA, 25 bp, Mus musculus
aggggacctgtctcttagtgttagg

SEQ ID NO: 200483 - DNA, 25 bp, Mus musculus
aggggagccaccacagtgagtttca

SEQ ID NO: 200484 - DNA, 25 bp, Mus musculus
aggggagccacctcagtgagtttca

SEQ ID NO: 200485 - DNA, 25 bp, Mus musculus
aggggatatagaccagccgtccctc

SEQ ID NO: 200486 - DNA, 25 bp, Mus musculus
aggggatatagagcagccgtccctc

SEQ ID NO: 200487 - DNA, 25 bp, Mus musculus
aggggatcgcagaaccagggcatct

SEQ ID NO: 200488 - DNA, 25 bp, Mus musculus
aggggatcgcagtaccagggcatct

SEQ ID NO: 200489 - DNA, 25 bp, Mus musculus
aggggccatgcacgagcttgaagca

SEQ ID NO: 200490 - DNA, 25 bp, Mus musculus
aggggccatgcaggagcttgaagca

SEQ ID NO: 200491 - DNA, 25 bp, Mus musculus
aggggccattttcgcacagactcgt

SEQ ID NO: 200492 - DNA, 25 bp, Mus musculus
aggggccattttggcacagactcgt

SEQ ID NO: 200493 - DNA, 25 bp, Mus musculus
aggggctcttttccagcctctgtca

SEQ ID NO: 200494 - DNA, 25 bp, Mus musculus
aggggctcttttgcagcctctgtca

SEQ ID NO: 200495 - DNA, 25 bp, Mus musculus
agggggcttaccagagaatccactg

SEQ ID NO: 200496 - DNA, 25 bp, Mus musculus
agggggcttacctgagaatccactg

SEQ ID NO: 200497 - DNA, 25 bp, Mus musculus
aggggggcccagcaaggtcattctt

SEQ ID NO: 200498 - DNA, 25 bp, Mus musculus
aggggggcccaggaaggtcattctt

SEQ ID NO: 200499 - DNA, 25 bp, Mus musculus
aggggtcaccagaagcaattttgga

SEQ ID NO: 200500 - DNA, 25 bp, Mus musculus
aggggtcaccagtagcaattttgga

SEQ ID NO: 200501 - DNA, 25 bp, Mus musculus
aggggtggtgccaaacatctttaat

SEQ ID NO: 200502 - DNA, 25 bp, Mus musculus
aggggtggtgcctaacatctttaat

SEQ ID NO: 200503 - DNA, 25 bp, Mus musculus
agggtaaaactcaagctagcacatg

SEQ ID NO: 200504 - DNA, 25 bp, Mus musculus
agggtaaaactctagctagcacatg

SEQ ID NO: 200505 - DNA, 25 bp, Mus musculus
agggtaaacacccatttagctctgt

SEQ ID NO: 200506 - DNA, 25 bp, Mus musculus
agggtaaacaccgatttagctctgt

SEQ ID NO: 200507 - DNA, 25 bp, Mus musculus
agggtaacagagatggctccattga

SEQ ID NO: 200508 - DNA, 25 bp, Mus musculus
agggtaacagagttggctccattga

SEQ ID NO: 200509 - DNA, 25 bp, Mus musculus
agggtaactgtgactgcagggctca

SEQ ID NO: 200510 - DNA, 25 bp, Mus musculus
agggtaactgtgtctgcagggctca

SEQ ID NO: 200511 - DNA, 25 bp, Mus musculus
agggtaagcgcacccattttggatt

SEQ ID NO: 200512 - DNA, 25 bp, Mus musculus
agggtaagcgcagccattttggatt

SEQ ID NO: 200513 - DNA, 25 bp, Mus musculus
agggtaagcgtgacaatcctgttct

SEQ ID NO: 200514 - DNA, 25 bp, Mus musculus
agggtaagcgtgtcaatcctgttct

SEQ ID NO: 200515 - DNA, 25 bp, Mus musculus
agggtaagtactccaggctactctt

SEQ ID NO: 200516 - DNA, 25 bp, Mus musculus
agggtaagtactgcaggctactctt

SEQ ID NO: 200517 - DNA, 25 bp, Mus musculus
agggtaagtatgcttgtaacacaca

SEQ ID NO: 200518 - DNA, 25 bp, Mus musculus
agggtaagtatggttgtaacacaca

SEQ ID NO: 200519 - DNA, 25 bp, Mus musculus
agggtaagtgtaattgtcaatctcc

SEQ ID NO: 200520 - DNA, 25 bp, Mus musculus
agggtaagtgtatttgtcaatctcc

SEQ ID NO: 200521 - DNA, 25 bp, Mus musculus
agggtaatgggcattgctctgctaa

SEQ ID NO: 200522 - DNA, 25 bp, Mus musculus
agggtaatgggctttgctctgctaa

SEQ ID NO: 200523 - DNA, 25 bp, Mus musculus
agggtacaacttcaggacagccaat

SEQ ID NO: 200524 - DNA, 25 bp, Mus musculus
agggtacaacttgaggacagccaat

SEQ ID NO: 200525 - DNA, 25 bp, Mus musculus
agggtacagggtcctgctcaccaat

SEQ ID NO: 200526 - DNA, 25 bp, Mus musculus
agggtacagggtgctgctcaccaat

SEQ ID NO: 200527 - DNA, 25 bp, Mus musculus
agggtaccaagcacgagcctgttag

SEQ ID NO: 200528 - DNA, 25 bp, Mus musculus
agggtaccaagctcgagcctgttag

SEQ ID NO: 200529 - DNA, 25 bp, Mus musculus
agggtaccccttaattctgctgcag

SEQ ID NO: 200530 - DNA, 25 bp, Mus musculus
agggtacccctttattctgctgcag

SEQ ID NO: 200531 - DNA, 25 bp, Mus musculus
agggtaccctgtccttcttggtgct

SEQ ID NO: 200532 - DNA, 25 bp, Mus musculus
agggtaccctgtgcttcttggtgct

SEQ ID NO: 200533 - DNA, 25 bp, Mus musculus
agggtaccgggcaggcattgcctaa

SEQ ID NO: 200534 - DNA, 25 bp, Mus musculus
agggtaccgggctggcattgcctaa

SEQ ID NO: 200535 - DNA, 25 bp, Mus musculus
agggtacctggtaacatctgtcctg

SEQ ID NO: 200536 - DNA, 25 bp, Mus musculus
agggtacctggttacatctgtcctg

SEQ ID NO: 200537 - DNA, 25 bp, Mus musculus
agggtaccttcacccttgagccaca

SEQ ID NO: 200538 - DNA, 25 bp, Mus musculus
agggtaccttcagccttgagccaca

SEQ ID NO: 200539 - DNA, 25 bp, Mus musculus
agggtacctttcatatggcccagct

SEQ ID NO: 200540 - DNA, 25 bp, Mus musculus
agggtacctttcttatggcccagct

SEQ ID NO: 200541 - DNA, 25 bp, Mus musculus
agggtacgaggtctagcatctccat

SEQ ID NO: 200542 - DNA, 25 bp, Mus musculus
agggtacgaggtgtagcatctccat

SEQ ID NO: 200543 - DNA, 25 bp, Mus musculus
agggtacgatgtatccagtgtggac

SEQ ID NO: 200544 - DNA, 25 bp, Mus musculus
agggtacgatgtttccagtgtggac

SEQ ID NO: 200545 - DNA, 25 bp, Mus musculus
agggtacgcgctactgcagcgggaa

SEQ ID NO: 200546 - DNA, 25 bp, Mus musculus
agggtacgcgcttctgcagcgggaa

SEQ ID NO: 200547 - DNA, 25 bp, Mus musculus
agggtacgtgccatcatctctccaa

SEQ ID NO: 200548 - DNA, 25 bp, Mus musculus
agggtacgtgccttcatctctccaa

SEQ ID NO: 200549 - DNA, 25 bp, Mus musculus
agggtacgtttcaaatgtatccaga

SEQ ID NO: 200550 - DNA, 25 bp, Mus musculus
agggtacgtttctaatgtatccaga

SEQ ID NO: 200551 - DNA, 25 bp, Mus musculus
agggtactaagcacttcagtgccac

SEQ ID NO: 200552 - DNA, 25 bp, Mus musculus
agggtactaagctcttcagtgccac

SEQ ID NO: 200553 - DNA, 25 bp, Mus musculus
agggtactcagtctcttggctcaga

SEQ ID NO: 200554 - DNA, 25 bp, Mus musculus
agggtactcagtgtcttggctcaga

SEQ ID NO: 200555 - DNA, 25 bp, Mus musculus
agggtactctggatgccatgctggc

SEQ ID NO: 200556 - DNA, 25 bp, Mus musculus
agggtactctggttgccatgctggc

SEQ ID NO: 200557 - DNA, 25 bp, Mus musculus
agggtactgaatactttgcaggcac

SEQ ID NO: 200558 - DNA, 25 bp, Mus musculus
agggtactgaattctttgcaggcac

SEQ ID NO: 200559 - DNA, 25 bp, Mus musculus
agggtactgctgatgtcacgggtcc

SEQ ID NO: 200560 - DNA, 25 bp, Mus musculus
agggtactgctgttgtcacgggtcc

SEQ ID NO: 200561 - DNA, 25 bp, Mus musculus
agggtactggtcataagttgcattc

SEQ ID NO: 200562 - DNA, 25 bp, Mus musculus
agggtactggtcttaagttgcattc

SEQ ID NO: 200563 - DNA, 25 bp, Mus musculus
agggtacttaacagggcatctctgt

SEQ ID NO: 200564 - DNA, 25 bp, Mus musculus
agggtacttaactgggcatctctgt

SEQ ID NO: 200565 - DNA, 25 bp, Mus musculus
agggtacttatcaaggcacatataa

SEQ ID NO: 200566 - DNA, 25 bp, Mus musculus
agggtacttatctaggcacatataa

SEQ ID NO: 200567 - DNA, 25 bp, Mus musculus
agggtacttctcaggaatagactca

SEQ ID NO: 200568 - DNA, 25 bp, Mus musculus
agggtacttctctggaatagactca

SEQ ID NO: 200569 - DNA, 25 bp, Mus musculus
agggtagaaggcagtcactcctcac

SEQ ID NO: 200570 - DNA, 25 bp, Mus musculus
agggtagaaggctgtcactcctcac

SEQ ID NO: 200571 - DNA, 25 bp, Mus musculus
agggtagacacgcagtgcacactca

SEQ ID NO: 200572 - DNA, 25 bp, Mus musculus
agggtagacacggagtgcacactca

SEQ ID NO: 200573 - DNA, 25 bp, Mus musculus
agggtagagagtccttccaaaagaa

SEQ ID NO: 200574 - DNA, 25 bp, Mus musculus
agggtagagagtgcttccaaaagaa

SEQ ID NO: 200575 - DNA, 25 bp, Mus musculus
agggtagagcccctgtctatcactc

SEQ ID NO: 200576 - DNA, 25 bp, Mus musculus
agggtagagcccgtgtctatcactc

SEQ ID NO: 200577 - DNA, 25 bp, Mus musculus
agggtagaggctccctacagtgcca

SEQ ID NO: 200578 - DNA, 25 bp, Mus musculus
agggtagaggctgcctacagtgcca

SEQ ID NO: 200579 - DNA, 25 bp, Mus musculus
agggtagagggcatgttcctcacct

SEQ ID NO: 200580 - DNA, 25 bp, Mus musculus
agggtagagggcttgttcctcacct

SEQ ID NO: 200581 - DNA, 25 bp, Mus musculus
agggtagcagtcctatgccaacaca

SEQ ID NO: 200582 - DNA, 25 bp, Mus musculus
agggtagcagtcgtatgccaacaca

SEQ ID NO: 200583 - DNA, 25 bp, Mus musculus
agggtagccctactaaggacattga

SEQ ID NO: 200584 - DNA, 25 bp, Mus musculus
agggtagccctagtaaggacattga

SEQ ID NO: 200585 - DNA, 25 bp, Mus musculus
agggtagcggagaccttgcatgata

SEQ ID NO: 200586 - DNA, 25 bp, Mus musculus
agggtagcggagtccttgcatgata

SEQ ID NO: 200587 - DNA, 25 bp, Mus musculus
agggtagctagcagctcctgcgcct

SEQ ID NO: 200588 - DNA, 25 bp, Mus musculus
agggtagctagctgctcctgcgcct

SEQ ID NO: 200589 - DNA, 25 bp, Mus musculus
agggtagctccaacatgcttgctct

SEQ ID NO: 200590 - DNA, 25 bp, Mus musculus
agggtagctccatcatgcttgctct

SEQ ID NO: 200591 - DNA, 25 bp, Mus musculus
agggtagcttagcttcatttcataa

SEQ ID NO: 200592 - DNA, 25 bp, Mus musculus
agggtagcttaggttcatttcataa

SEQ ID NO: 200593 - DNA, 25 bp, Mus musculus
agggtaggatagcttattgtcattt

SEQ ID NO: 200594 - DNA, 25 bp, Mus musculus
agggtaggataggttattgtcattt

SEQ ID NO: 200595 - DNA, 25 bp, Mus musculus
agggtagggtgcctcattcctctgc

SEQ ID NO: 200596 - DNA, 25 bp, Mus musculus
agggtagggtgcgtcattcctctgc

SEQ ID NO: 200597 - DNA, 25 bp, Mus musculus
agggtagtaattatgctgaatgttt

SEQ ID NO: 200598 - DNA, 25 bp, Mus musculus
agggtagtaattttgctgaatgttt

SEQ ID NO: 200599 - DNA, 25 bp, Mus musculus
agggtagtaggcacatgctttagta

SEQ ID NO: 200600 - DNA, 25 bp, Mus musculus
agggtagtaggctcatgctttagta

SEQ ID NO: 200601 - DNA, 25 bp, Mus musculus
agggtagtcctaattatctcttatt

SEQ ID NO: 200602 - DNA, 25 bp, Mus musculus
agggtagtcctatttatctcttatt

SEQ ID NO: 200603 - DNA, 25 bp, Mus musculus
agggtagttctaaccctgctcagga

SEQ ID NO: 200604 - DNA, 25 bp, Mus musculus
agggtagttctatccctgctcagga

SEQ ID NO: 200605 - DNA, 25 bp, Mus musculus
agggtataactcaggcacgcaggct

SEQ ID NO: 200606 - DNA, 25 bp, Mus musculus
agggtataactctggcacgcaggct

SEQ ID NO: 200607 - DNA, 25 bp, Mus musculus
agggtatagaatcccatcacgcgtg

SEQ ID NO: 200608 - DNA, 25 bp, Mus musculus
agggtatagaatgccatcacgcgtg

SEQ ID NO: 200609 - DNA, 25 bp, Mus musculus
agggtataggatacttcacaagctc

SEQ ID NO: 200610 - DNA, 25 bp, Mus musculus
agggtataggattcttcacaagctc

SEQ ID NO: 200611 - DNA, 25 bp, Mus musculus
agggtatatcccaacaagactttgt

SEQ ID NO: 200612 - DNA, 25 bp, Mus musculus
agggtatatccccacttctccttat

SEQ ID NO: 200613 - DNA, 25 bp, Mus musculus
agggtatatcccgacttctccttat

SEQ ID NO: 200614 - DNA, 25 bp, Mus musculus
agggtatatccctacaagactttgt

SEQ ID NO: 200615 - DNA, 25 bp, Mus musculus
agggtatattacattttctccattt

SEQ ID NO: 200616 - DNA, 25 bp, Mus musculus
agggtatattactttttctccattt

SEQ ID NO: 200617 - DNA, 25 bp, Mus musculus
agggtatcaggtctctgaaactgga

SEQ ID NO: 200618 - DNA, 25 bp, Mus musculus
agggtatcaggtgtctgaaactgga

SEQ ID NO: 200619 - DNA, 25 bp, Mus musculus
agggtatcatcaaatcctggctccc

SEQ ID NO: 200620 - DNA, 25 bp, Mus musculus
agggtatcatcatatcctggctccc

SEQ ID NO: 200621 - DNA, 25 bp, Mus musculus
agggtatcatcgacagtgccttcgg

SEQ ID NO: 200622 - DNA, 25 bp, Mus musculus
agggtatcatcgtcagtgccttcgg

SEQ ID NO: 200623 - DNA, 25 bp, Mus musculus
agggtatccaacattcagccagaat

SEQ ID NO: 200624 - DNA, 25 bp, Mus musculus
agggtatccaactttcagccagaat

SEQ ID NO: 200625 - DNA, 25 bp, Mus musculus
agggtatccacgaggcgaactctgt

SEQ ID NO: 200626 - DNA, 25 bp, Mus musculus
agggtatccacgtggcgaactctgt

SEQ ID NO: 200627 - DNA, 25 bp, Mus musculus
agggtatcccaaactcttgatgtta

SEQ ID NO: 200628 - DNA, 25 bp, Mus musculus
agggtatcccaatctcttgatgtta

SEQ ID NO: 200629 - DNA, 25 bp, Mus musculus
agggtatcccagcatgaagcctcat

SEQ ID NO: 200630 - DNA, 25 bp, Mus musculus
agggtatcccaggatgaagcctcat

SEQ ID NO: 200631 - DNA, 25 bp, Mus musculus
agggtatcctctacaggtgttccaa

SEQ ID NO: 200632 - DNA, 25 bp, Mus musculus
agggtatcctcttcaggtgttccaa

SEQ ID NO: 200633 - DNA, 25 bp, Mus musculus
agggtatcgagactgccctgttact

SEQ ID NO: 200634 - DNA, 25 bp, Mus musculus
agggtatcgagagtgccctgttact

SEQ ID NO: 200635 - DNA, 25 bp, Mus musculus
agggtatcgtgcctgatttctagaa

SEQ ID NO: 200636 - DNA, 25 bp, Mus musculus
agggtatcgtgcgtgatttctagaa

SEQ ID NO: 200637 - DNA, 25 bp, Mus musculus
agggtatctgctcctttgtcctttt

SEQ ID NO: 200638 - DNA, 25 bp, Mus musculus
agggtatctgctgctttgtcctttt

SEQ ID NO: 200639 - DNA, 25 bp, Mus musculus
agggtatctggtaccttaactcctg

SEQ ID NO: 200640 - DNA, 25 bp, Mus musculus
agggtatctggttccttaactcctg

SEQ ID NO: 200641 - DNA, 25 bp, Mus musculus
agggtatgcctactcttgcagtgac

SEQ ID NO: 200642 - DNA, 25 bp, Mus musculus
agggtatgcctagtcttgcagtgac

SEQ ID NO: 200643 - DNA, 25 bp, Mus musculus
agggtatggactccacgctccagag

SEQ ID NO: 200644 - DNA, 25 bp, Mus musculus
agggtatggactgcacgctccagag

SEQ ID NO: 200645 - DNA, 25 bp, Mus musculus
agggtatggtgactcctacctgtaa

SEQ ID NO: 200646 - DNA, 25 bp, Mus musculus
agggtatggtgagtcctacctgtaa

SEQ ID NO: 200647 - DNA, 25 bp, Mus musculus
agggtattatagaccttgccctaat

SEQ ID NO: 200648 - DNA, 25 bp, Mus musculus
agggtattatagtccttgccctaat

SEQ ID NO: 200649 - DNA, 25 bp, Mus musculus
agggtattcaggagctttgtgcttg

SEQ ID NO: 200650 - DNA, 25 bp, Mus musculus
agggtattcaggtgctttgtgcttg

SEQ ID NO: 200651 - DNA, 25 bp, Mus musculus
agggtattcggacgcccagcatcct

SEQ ID NO: 200652 - DNA, 25 bp, Mus musculus
agggtattcggaggcccagcatcct

SEQ ID NO: 200653 - DNA, 25 bp, Mus musculus
agggtattctagctcaagggccaat

SEQ ID NO: 200654 - DNA, 25 bp, Mus musculus
agggtattctaggtcaagggccaat

SEQ ID NO: 200655 - DNA, 25 bp, Mus musculus
agggtattgaggctccattgcccaa

SEQ ID NO: 200656 - DNA, 25 bp, Mus musculus
agggtattgagggtccattgcccaa

SEQ ID NO: 200657 - DNA, 25 bp, Mus musculus
agggtcaaactacaactcttctctt

SEQ ID NO: 200658 - DNA, 25 bp, Mus musculus
agggtcaaactagaactcttctctt

SEQ ID NO: 200659 - DNA, 25 bp, Mus musculus
agggtcaacttgaacctacatgctc

SEQ ID NO: 200660 - DNA, 25 bp, Mus musculus
agggtcaacttgtacctacatgctc

SEQ ID NO: 200661 - DNA, 25 bp, Mus musculus
agggtcaagaggacaaggcaagcct

SEQ ID NO: 200662 - DNA, 25 bp, Mus musculus
agggtcaagaggtcaaggcaagcct

SEQ ID NO: 200663 - DNA, 25 bp, Mus musculus
agggtcaagctcatagctctatgga

SEQ ID NO: 200664 - DNA, 25 bp, Mus musculus
agggtcaagctcttagctctatgga

SEQ ID NO: 200665 - DNA, 25 bp, Mus musculus
agggtcaagggcatcatgcccttgc

SEQ ID NO: 200666 - DNA, 25 bp, Mus musculus
agggtcaagggcttcatgcccttgc

SEQ ID NO: 200667 - DNA, 25 bp, Mus musculus
agggtcacaaacaccagctggctac

SEQ ID NO: 200668 - DNA, 25 bp, Mus musculus
agggtcacaaactccagctggctac

SEQ ID NO: 200669 - DNA, 25 bp, Mus musculus
agggtcacaccaagcagctcatggg

SEQ ID NO: 200670 - DNA, 25 bp, Mus musculus
agggtcacaccatgcagctcatggg

SEQ ID NO: 200671 - DNA, 25 bp, Mus musculus
agggtcacactgaaatcctggctga

SEQ ID NO: 200672 - DNA, 25 bp, Mus musculus
agggtcacactgtaatcctggctga

SEQ ID NO: 200673 - DNA, 25 bp, Mus musculus
agggtcacatatagtgctgctgctt

SEQ ID NO: 200674 - DNA, 25 bp, Mus musculus
agggtcacatattgtgctgctgctt

SEQ ID NO: 200675 - DNA, 25 bp, Mus musculus
agggtcacatcgctgagcctgagat

SEQ ID NO: 200676 - DNA, 25 bp, Mus musculus
agggtcacatcggtgagcctgagat

SEQ ID NO: 200677 - DNA, 25 bp, Mus musculus
agggtcacatgcacagctcaagctg

SEQ ID NO: 200678 - DNA, 25 bp, Mus musculus
agggtcacatgctcagctcaagctg

SEQ ID NO: 200679 - DNA, 25 bp, Mus musculus
agggtcacattcacagctcagggta

SEQ ID NO: 200680 - DNA, 25 bp, Mus musculus
agggtcacattctcagctcagggta

SEQ ID NO: 200681 - DNA, 25 bp, Mus musculus
agggtcaccagcagtggtccagttg

SEQ ID NO: 200682 - DNA, 25 bp, Mus musculus
agggtcaccagctgtggtccagttg

SEQ ID NO: 200683 - DNA, 25 bp, Mus musculus
agggtcacccacagagtgctttaat

SEQ ID NO: 200684 - DNA, 25 bp, Mus musculus
agggtcacccactgagtgctttaat

SEQ ID NO: 200685 - DNA, 25 bp, Mus musculus
agggtcaccctcagctgtatgacga

SEQ ID NO: 200686 - DNA, 25 bp, Mus musculus
agggtcaccctctgctgtatgacga

SEQ ID NO: 200687 - DNA, 25 bp, Mus musculus
agggtcacctagatctcaagatcag

SEQ ID NO: 200688 - DNA, 25 bp, Mus musculus
agggtcacctagttctcaagatcag

SEQ ID NO: 200689 - DNA, 25 bp, Mus musculus
agggtcacctcaaggttcatttttc

SEQ ID NO: 200690 - DNA, 25 bp, Mus musculus
agggtcacctcatggttcatttttc

SEQ ID NO: 200691 - DNA, 25 bp, Mus musculus
agggtcacctctctgaagctataga

SEQ ID NO: 200692 - DNA, 25 bp, Mus musculus
agggtcacctctgtgaagctataga

SEQ ID NO: 200693 - DNA, 25 bp, Mus musculus
agggtcacgaagctcgcacctcgtg

SEQ ID NO: 200694 - DNA, 25 bp, Mus musculus
agggtcacgaaggtcgcacctcgtg

SEQ ID NO: 200695 - DNA, 25 bp, Mus musculus
agggtcacggtcattgcagagcatt

SEQ ID NO: 200696 - DNA, 25 bp, Mus musculus
agggtcacggtctttgcagagcatt

SEQ ID NO: 200697 - DNA, 25 bp, Mus musculus
agggtcactcccaatgtttctttgt

SEQ ID NO: 200698 - DNA, 25 bp, Mus musculus
agggtcactccctatgtttctttgt

SEQ ID NO: 200699 - DNA, 25 bp, Mus musculus
agggtcagaacccagggcatcgcac

SEQ ID NO: 200700 - DNA, 25 bp, Mus musculus
agggtcagaaccgagggcatcgcac

SEQ ID NO: 200701 - DNA, 25 bp, Mus musculus
agggtcagaagcagacgtcctcctt

SEQ ID NO: 200702 - DNA, 25 bp, Mus musculus
agggtcagaagctgacgtcctcctt

SEQ ID NO: 200703 - DNA, 25 bp, Mus musculus
agggtcagagggatcagctcgccac

SEQ ID NO: 200704 - DNA, 25 bp, Mus musculus
agggtcagagggttcagctcgccac

SEQ ID NO: 200705 - DNA, 25 bp, Mus musculus
agggtcagatggacgcttttgcctc

SEQ ID NO: 200706 - DNA, 25 bp, Mus musculus
agggtcagatggtcgcttttgcctc

SEQ ID NO: 200707 - DNA, 25 bp, Mus musculus
agggtcagctacagtgccgtgttaa

SEQ ID NO: 200708 - DNA, 25 bp, Mus musculus
agggtcagctactgtgccgtgttaa

SEQ ID NO: 200709 - DNA, 25 bp, Mus musculus
agggtcagctccagcgcacagaaag

SEQ ID NO: 200710 - DNA, 25 bp, Mus musculus
agggtcagctcctgcgcacagaaag

SEQ ID NO: 200711 - DNA, 25 bp, Mus musculus
agggtcaggtgtccatagccacttt

SEQ ID NO: 200712 - DNA, 25 bp, Mus musculus
agggtcaggtgtgcatagccacttt

SEQ ID NO: 200713 - DNA, 25 bp, Mus musculus
agggtcagtcttctgatgcatcaga

SEQ ID NO: 200714 - DNA, 25 bp, Mus musculus
agggtcagtcttgtgatgcatcaga

SEQ ID NO: 200715 - DNA, 25 bp, Mus musculus
agggtcagttccagcctagcaggat

SEQ ID NO: 200716 - DNA, 25 bp, Mus musculus
agggtcagttcctgcctagcaggat

SEQ ID NO: 200717 - DNA, 25 bp, Mus musculus
agggtcatacttccttgtcagacaa

SEQ ID NO: 200718 - DNA, 25 bp, Mus musculus
agggtcatacttgcttgtcagacaa

SEQ ID NO: 200719 - DNA, 25 bp, Mus musculus
agggtcatcattatctctaacggtc

SEQ ID NO: 200720 - DNA, 25 bp, Mus musculus
agggtcatcattttctctaacggtc

SEQ ID NO: 200721 - DNA, 25 bp, Mus musculus
agggtcatccagctcactcgagtca

SEQ ID NO: 200722 - DNA, 25 bp, Mus musculus
agggtcatccaggtcactcgagtca

SEQ ID NO: 200723 - DNA, 25 bp, Mus musculus
agggtcatcctgagaaaagcatcca

SEQ ID NO: 200724 - DNA, 25 bp, Mus musculus
agggtcatcctgtgaaaagcatcca

SEQ ID NO: 200725 - DNA, 25 bp, Mus musculus
agggtcatggcaactttgacttccc

SEQ ID NO: 200726 - DNA, 25 bp, Mus musculus
agggtcatggcatctttgacttccc

SEQ ID NO: 200727 - DNA, 25 bp, Mus musculus
agggtcattgaactacagattggat

SEQ ID NO: 200728 - DNA, 25 bp, Mus musculus
agggtcattgaagtacagattggat

SEQ ID NO: 200729 - DNA, 25 bp, Mus musculus
agggtcattggcagtgaccgtgcac

SEQ ID NO: 200730 - DNA, 25 bp, Mus musculus
agggtcattggctgtgaccgtgcac

SEQ ID NO: 200731 - DNA, 25 bp, Mus musculus
agggtcattttcatcctcctgaaat

SEQ ID NO: 200732 - DNA, 25 bp, Mus musculus
agggtcattttcttcctcctgaaat

SEQ ID NO: 200733 - DNA, 25 bp, Mus musculus
agggtccaaaacctgggcagactca

SEQ ID NO: 200734 - DNA, 25 bp, Mus musculus
agggtccaaaacgtgggcagactca

SEQ ID NO: 200735 - DNA, 25 bp, Mus musculus
agggtccaaaccatgtcactagatg

SEQ ID NO: 200736 - DNA, 25 bp, Mus musculus
agggtccaaaccttgtcactagatg

SEQ ID NO: 200737 - DNA, 25 bp, Mus musculus
agggtccaacctcaaagcatccaga

SEQ ID NO: 200738 - DNA, 25 bp, Mus musculus
agggtccaacctgaaagcatccaga

SEQ ID NO: 200739 - DNA, 25 bp, Mus musculus
agggtccaactcaggcctaatcttt

SEQ ID NO: 200740 - DNA, 25 bp, Mus musculus
agggtccaactctggcctaatcttt

SEQ ID NO: 200741 - DNA, 25 bp, Mus musculus
agggtccaagacactgtggccggct

SEQ ID NO: 200742 - DNA, 25 bp, Mus musculus
agggtccaagactctgtggccggct

SEQ ID NO: 200743 - DNA, 25 bp, Mus musculus
agggtccaccatacatatgcagatt

SEQ ID NO: 200744 - DNA, 25 bp, Mus musculus
agggtccaccattcatatgcagatt

SEQ ID NO: 200745 - DNA, 25 bp, Mus musculus
agggtccagagacacacgcctccaa

SEQ ID NO: 200746 - DNA, 25 bp, Mus musculus
agggtccagagagacacgcctccaa

SEQ ID NO: 200747 - DNA, 25 bp, Mus musculus
agggtccagccgatatttgagcagc

SEQ ID NO: 200748 - DNA, 25 bp, Mus musculus
agggtccagccgttatttgagcagc

SEQ ID NO: 200749 - DNA, 25 bp, Mus musculus
agggtccagtgcagagttatttaat

SEQ ID NO: 200750 - DNA, 25 bp, Mus musculus
agggtccagtgctgagttatttaat

SEQ ID NO: 200751 - DNA, 25 bp, Mus musculus
agggtccatcagcttccctggtgcc

SEQ ID NO: 200752 - DNA, 25 bp, Mus musculus
agggtccatcaggttccctggtgcc

SEQ ID NO: 200753 - DNA, 25 bp, Mus musculus
agggtccatctgactaatgctggtt

SEQ ID NO: 200754 - DNA, 25 bp, Mus musculus
agggtccatctgtctaatgctggtt

SEQ ID NO: 200755 - DNA, 25 bp, Mus musculus
agggtccatgttccttcccagggag

SEQ ID NO: 200756 - DNA, 25 bp, Mus musculus
agggtccatgttgcttcccagggag

SEQ ID NO: 200757 - DNA, 25 bp, Mus musculus
agggtcccactcagtagctggccta

SEQ ID NO: 200758 - DNA, 25 bp, Mus musculus
agggtcccactctgtagctggccta

SEQ ID NO: 200759 - DNA, 25 bp, Mus musculus
agggtcccactgctgttagacatgg

SEQ ID NO: 200760 - DNA, 25 bp, Mus musculus
agggtcccactggtgttagacatgg

SEQ ID NO: 200761 - DNA, 25 bp, Mus musculus
agggtcccagacacacatttgttcc

SEQ ID NO: 200762 - DNA, 25 bp, Mus musculus
agggtcccagactcacatttgttcc

SEQ ID NO: 200763 - DNA, 25 bp, Mus musculus
agggtccccaaaagcaaccgcatca

SEQ ID NO: 200764 - DNA, 25 bp, Mus musculus
agggtccccaaatgcaaccgcatca

SEQ ID NO: 200765 - DNA, 25 bp, Mus musculus
agggtccccagcaagtggcggattc

SEQ ID NO: 200766 - DNA, 25 bp, Mus musculus
agggtccccagctagtggcggattc

SEQ ID NO: 200767 - DNA, 25 bp, Mus musculus
agggtccccggcactgtagagcaga

SEQ ID NO: 200768 - DNA, 25 bp, Mus musculus
agggtccccggctctgtagagcaga

SEQ ID NO: 200769 - DNA, 25 bp, Mus musculus
agggtcccctctctgctagagcatt

SEQ ID NO: 200770 - DNA, 25 bp, Mus musculus
agggtcccctctgtgctagagcatt

SEQ ID NO: 200771 - DNA, 25 bp, Mus musculus
agggtcccgcgcatctaggctgagg

SEQ ID NO: 200772 - DNA, 25 bp, Mus musculus
agggtcccgcgcttctaggctgagg

SEQ ID NO: 200773 - DNA, 25 bp, Mus musculus
agggtcccggtcagcagtagaggcc

SEQ ID NO: 200774 - DNA, 25 bp, Mus musculus
agggtcccggtctgcagtagaggcc

SEQ ID NO: 200775 - DNA, 25 bp, Mus musculus
agggtccctatgaactgtgagctct

SEQ ID NO: 200776 - DNA, 25 bp, Mus musculus
agggtccctatgtactgtgagctct

SEQ ID NO: 200777 - DNA, 25 bp, Mus musculus
agggtccctgagctcagtctgatga

SEQ ID NO: 200778 - DNA, 25 bp, Mus musculus
agggtccctgaggtcagtctgatga

SEQ ID NO: 200779 - DNA, 25 bp, Mus musculus
agggtcccttctcactcttagctca

SEQ ID NO: 200780 - DNA, 25 bp, Mus musculus
agggtcccttctgactcttagctca

SEQ ID NO: 200781 - DNA, 25 bp, Mus musculus
agggtccgagatatcaacgaggctt

SEQ ID NO: 200782 - DNA, 25 bp, Mus musculus
agggtccgagatttcaacgaggctt

SEQ ID NO: 200783 - DNA, 25 bp, Mus musculus
agggtccgagtgaggaattgacact

SEQ ID NO: 200784 - DNA, 25 bp, Mus musculus
agggtccgagtgtggaattgacact

SEQ ID NO: 200785 - DNA, 25 bp, Mus musculus
agggtccgggccagagtagctcaca

SEQ ID NO: 200786 - DNA, 25 bp, Mus musculus
agggtccgggcctgagtagctcaca

SEQ ID NO: 200787 - DNA, 25 bp, Mus musculus
agggtccgtctgctgcaagatgcat

SEQ ID NO: 200788 - DNA, 25 bp, Mus musculus
agggtccgtctggtgcaagatgcat

SEQ ID NO: 200789 - DNA, 25 bp, Mus musculus
agggtcctagatatagccagtttca

SEQ ID NO: 200790 - DNA, 25 bp, Mus musculus
agggtcctagatttagccagtttca

SEQ ID NO: 200791 - DNA, 25 bp, Mus musculus
agggtcctagcacacatgtctggtg

SEQ ID NO: 200792 - DNA, 25 bp, Mus musculus
agggtcctagcagacatgtctggtg

SEQ ID NO: 200793 - DNA, 25 bp, Mus musculus
agggtcctcaacacttcatagcaga

SEQ ID NO: 200794 - DNA, 25 bp, Mus musculus
agggtcctcaactcttcatagcaga

SEQ ID NO: 200795 - DNA, 25 bp, Mus musculus
agggtcctcattatctggtacaaga

SEQ ID NO: 200796 - DNA, 25 bp, Mus musculus
agggtcctcattttctggtacaaga

SEQ ID NO: 200797 - DNA, 25 bp, Mus musculus
agggtcctctcaattctgttcagga

SEQ ID NO: 200798 - DNA, 25 bp, Mus musculus
agggtcctctcatttctgttcagga

SEQ ID NO: 200799 - DNA, 25 bp, Mus musculus
agggtcctctggcatatggcataaa

SEQ ID NO: 200800 - DNA, 25 bp, Mus musculus
agggtcctctgggatatggcataaa

SEQ ID NO: 200801 - DNA, 25 bp, Mus musculus
agggtcctgaaactccataccagat

SEQ ID NO: 200802 - DNA, 25 bp, Mus musculus
agggtcctgaaagtccataccagat

SEQ ID NO: 200803 - DNA, 25 bp, Mus musculus
agggtcctgaggactgatttacatc

SEQ ID NO: 200804 - DNA, 25 bp, Mus musculus
agggtcctgaggtctgatttacatc

SEQ ID NO: 200805 - DNA, 25 bp, Mus musculus
agggtcctgctaaatatccctggct

SEQ ID NO: 200806 - DNA, 25 bp, Mus musculus
agggtcctgctatatatccctggct

SEQ ID NO: 200807 - DNA, 25 bp, Mus musculus
agggtcctgctcacagccagggaat

SEQ ID NO: 200808 - DNA, 25 bp, Mus musculus
agggtcctgctctcagccagggaat

SEQ ID NO: 200809 - DNA, 25 bp, Mus musculus
agggtcctgctgacagtgctctatc

SEQ ID NO: 200810 - DNA, 25 bp, Mus musculus
agggtcctgctgcttccgtaacctg

SEQ ID NO: 200811 - DNA, 25 bp, Mus musculus
agggtcctgctggttccgtaacctg

SEQ ID NO: 200812 - DNA, 25 bp, Mus musculus
agggtcctgctgtcagtgctctatc

SEQ ID NO: 200813 - DNA, 25 bp, Mus musculus
agggtccttcacatgctggagccat

SEQ ID NO: 200814 - DNA, 25 bp, Mus musculus
agggtccttcacttgctggagccat

SEQ ID NO: 200815 - DNA, 25 bp, Mus musculus
agggtccttcatcattgctttttac

SEQ ID NO: 200816 - DNA, 25 bp, Mus musculus
agggtccttcatgattgctttttac

SEQ ID NO: 200817 - DNA, 25 bp, Mus musculus
agggtccttctcagacattactgca

SEQ ID NO: 200818 - DNA, 25 bp, Mus musculus
agggtccttctctgacattactgca

SEQ ID NO: 200819 - DNA, 25 bp, Mus musculus
agggtcctttctaggcatgtaacat

SEQ ID NO: 200820 - DNA, 25 bp, Mus musculus
agggtcctttcttggcatgtaacat

SEQ ID NO: 200821 - DNA, 25 bp, Mus musculus
agggtcctttgtatctccatctgag

SEQ ID NO: 200822 - DNA, 25 bp, Mus musculus
agggtcctttgtttctccatctgag

SEQ ID NO: 200823 - DNA, 25 bp, Mus musculus
agggtcgacaggatgagctttaaaa

SEQ ID NO: 200824 - DNA, 25 bp, Mus musculus
agggtcgacaggttgagctttaaaa

SEQ ID NO: 200825 - DNA, 25 bp, Mus musculus
agggtcgagagcctggtctctccaa

SEQ ID NO: 200826 - DNA, 25 bp, Mus musculus
agggtcgagagcgtggtctctccaa

SEQ ID NO: 200827 - DNA, 25 bp, Mus musculus
agggtcgagcagaatcctggctgaa

SEQ ID NO: 200828 - DNA, 25 bp, Mus musculus
agggtcgagcagtatcctggctgaa

SEQ ID NO: 200829 - DNA, 25 bp, Mus musculus
agggtcgcatgtactgcctgagcac

SEQ ID NO: 200830 - DNA, 25 bp, Mus musculus
agggtcgcatgttctgcctgagcac

SEQ ID NO: 200831 - DNA, 25 bp, Mus musculus
agggtcgccttgcatttctttccca

SEQ ID NO: 200832 - DNA, 25 bp, Mus musculus
agggtcgccttggatttctttccca

SEQ ID NO: 200833 - DNA, 25 bp, Mus musculus
agggtcgcctttctttggtctgcag

SEQ ID NO: 200834 - DNA, 25 bp, Mus musculus
agggtcgcctttgtttggtctgcag

SEQ ID NO: 200835 - DNA, 25 bp, Mus musculus
agggtcgcgtctcatgtatgcacct

SEQ ID NO: 200836 - DNA, 25 bp, Mus musculus
agggtcgcgtctgatgtatgcacct

SEQ ID NO: 200837 - DNA, 25 bp, Mus musculus
agggtcgctagtataggctctccga

SEQ ID NO: 200838 - DNA, 25 bp, Mus musculus
agggtcgctagtttaggctctccga

SEQ ID NO: 200839 - DNA, 25 bp, Mus musculus
agggtcgctctacttgaactctcca

SEQ ID NO: 200840 - DNA, 25 bp, Mus musculus
agggtcgctctagttgaactctcca

SEQ ID NO: 200841 - DNA, 25 bp, Mus musculus
agggtcgctgcgctcgttgactaac

SEQ ID NO: 200842 - DNA, 25 bp, Mus musculus
agggtcgctgcggtcgttgactaac

SEQ ID NO: 200843 - DNA, 25 bp, Mus musculus
agggtcgcttcacggcagagctact

SEQ ID NO: 200844 - DNA, 25 bp, Mus musculus
agggtcgcttcagggcagagctact

SEQ ID NO: 200845 - DNA, 25 bp, Mus musculus
agggtcggcgttcttgtctatgaca

SEQ ID NO: 200846 - DNA, 25 bp, Mus musculus
agggtcggcgttgttgtctatgaca

SEQ ID NO: 200847 - DNA, 25 bp, Mus musculus
agggtcggtcgcacagacatcttga

SEQ ID NO: 200848 - DNA, 25 bp, Mus musculus
agggtcggtcgctcagacatcttga

SEQ ID NO: 200849 - DNA, 25 bp, Mus musculus
agggtcgtcgccctccgctgactta

SEQ ID NO: 200850 - DNA, 25 bp, Mus musculus
agggtcgtcgccgtccgctgactta

SEQ ID NO: 200851 - DNA, 25 bp, Mus musculus
agggtcgtgggcactactgtctcag

SEQ ID NO: 200852 - DNA, 25 bp, Mus musculus
agggtcgtgggctctactgtctcag

SEQ ID NO: 200853 - DNA, 25 bp, Mus musculus
agggtcgttgacagtcacaacctgt

SEQ ID NO: 200854 - DNA, 25 bp, Mus musculus
agggtcgttgactgtcacaacctgt

SEQ ID NO: 200855 - DNA, 25 bp, Mus musculus
agggtcgttgccattttggcagcag

SEQ ID NO: 200856 - DNA, 25 bp, Mus musculus
agggtcgttgcctttttggcagcag

SEQ ID NO: 200857 - DNA, 25 bp, Mus musculus
agggtctacaagcattcttcatggc

SEQ ID NO: 200858 - DNA, 25 bp, Mus musculus
agggtctacaaggattcttcatggc

SEQ ID NO: 200859 - DNA, 25 bp, Mus musculus
agggtctacagactcagatcgctca

SEQ ID NO: 200860 - DNA, 25 bp, Mus musculus
agggtctacagagtcagatcgctca

SEQ ID NO: 200861 - DNA, 25 bp, Mus musculus
agggtctaccctcaaaagcagccac

SEQ ID NO: 200862 - DNA, 25 bp, Mus musculus
agggtctaccctgaaaagcagccac

SEQ ID NO: 200863 - DNA, 25 bp, Mus musculus
agggtctactggctgcatttagtta

SEQ ID NO: 200864 - DNA, 25 bp, Mus musculus
agggtctactgggtgcatttagtta

SEQ ID NO: 200865 - DNA, 25 bp, Mus musculus
agggtctcaaaaaagccgaatgtcg

SEQ ID NO: 200866 - DNA, 25 bp, Mus musculus
agggtctcaaaatagccgaatgtcg

SEQ ID NO: 200867 - DNA, 25 bp, Mus musculus
agggtctcaccaactgtaaacgaca

SEQ ID NO: 200868 - DNA, 25 bp, Mus musculus
agggtctcaccaaggcgaaggcgaa

SEQ ID NO: 200869 - DNA, 25 bp, Mus musculus
agggtctcaccatctgtaaacgaca

SEQ ID NO: 200870 - DNA, 25 bp, Mus musculus
agggtctcaccatggcgaaggcgaa

SEQ ID NO: 200871 - DNA, 25 bp, Mus musculus
agggtctcatctcctgtacttgctt

SEQ ID NO: 200872 - DNA, 25 bp, Mus musculus
agggtctcatctgctgtacttgctt

SEQ ID NO: 200873 - DNA, 25 bp, Mus musculus
agggtctcattacccactgatggta

SEQ ID NO: 200874 - DNA, 25 bp, Mus musculus
agggtctcattagccactgatggta

SEQ ID NO: 200875 - DNA, 25 bp, Mus musculus
agggtctccgaaactacttactgat

SEQ ID NO: 200876 - DNA, 25 bp, Mus musculus
agggtctccgaatctacttactgat

SEQ ID NO: 200877 - DNA, 25 bp, Mus musculus
agggtctccgctcattaaagcttcc

SEQ ID NO: 200878 - DNA, 25 bp, Mus musculus
agggtctccgctgattaaagcttcc

SEQ ID NO: 200879 - DNA, 25 bp, Mus musculus
agggtctcctgtctacacaagggta

SEQ ID NO: 200880 - DNA, 25 bp, Mus musculus
agggtctcctgtgtacacaagggta

SEQ ID NO: 200881 - DNA, 25 bp, Mus musculus
agggtctcgcctccaaacagtccag

SEQ ID NO: 200882 - DNA, 25 bp, Mus musculus
agggtctcgcctgcaaacagtccag

SEQ ID NO: 200883 - DNA, 25 bp, Mus musculus
agggtctcgctaattccagctggct

SEQ ID NO: 200884 - DNA, 25 bp, Mus musculus
agggtctcgctatttccagctggct

SEQ ID NO: 200885 - DNA, 25 bp, Mus musculus
agggtctctacacatctacctctgg

SEQ ID NO: 200886 - DNA, 25 bp, Mus musculus
agggtctctacagatctacctctgg

SEQ ID NO: 200887 - DNA, 25 bp, Mus musculus
agggtctctatgaagtttgggctga

SEQ ID NO: 200888 - DNA, 25 bp, Mus musculus
agggtctctatgtagtttgggctga

SEQ ID NO: 200889 - DNA, 25 bp, Mus musculus
agggtctctcatacacattcagtgc

SEQ ID NO: 200890 - DNA, 25 bp, Mus musculus
agggtctctcattcacattcagtgc

SEQ ID NO: 200891 - DNA, 25 bp, Mus musculus
agggtctctccaacatttggctgaa

SEQ ID NO: 200892 - DNA, 25 bp, Mus musculus
agggtctctccatcatttggctgaa

SEQ ID NO: 200893 - DNA, 25 bp, Mus musculus
agggtctctctacacagctctttct

SEQ ID NO: 200894 - DNA, 25 bp, Mus musculus
agggtctctctacagagctgactgt

SEQ ID NO: 200895 - DNA, 25 bp, Mus musculus
agggtctctctagacagctctttct

SEQ ID NO: 200896 - DNA, 25 bp, Mus musculus
agggtctctctagagagctgactgt

SEQ ID NO: 200897 - DNA, 25 bp, Mus musculus
agggtctctctgaaggccttctcct

SEQ ID NO: 200898 - DNA, 25 bp, Mus musculus
agggtctctctgtaggccttctcct

SEQ ID NO: 200899 - DNA, 25 bp, Mus musculus
agggtctctcttaagtttgctacat

SEQ ID NO: 200900 - DNA, 25 bp, Mus musculus
agggtctctctttagtttgctacat

SEQ ID NO: 200901 - DNA, 25 bp, Mus musculus
agggtctctgtaatcctatatatac

SEQ ID NO: 200902 - DNA, 25 bp, Mus musculus
agggtctctgtattcctatatatac

SEQ ID NO: 200903 - DNA, 25 bp, Mus musculus
agggtctcttctcctgttaccctag

SEQ ID NO: 200904 - DNA, 25 bp, Mus musculus
agggtctcttctgctgttaccctag

SEQ ID NO: 200905 - DNA, 25 bp, Mus musculus
agggtctgaaatccccaggtagcca

SEQ ID NO: 200906 - DNA, 25 bp, Mus musculus
agggtctgaaatgcccaggtagcca

SEQ ID NO: 200907 - DNA, 25 bp, Mus musculus
agggtctgaccactgctctcaatgg

SEQ ID NO: 200908 - DNA, 25 bp, Mus musculus
agggtctgaccagtgctctcaatgg

SEQ ID NO: 200909 - DNA, 25 bp, Mus musculus
agggtctgaccgactgtgggatcaa

SEQ ID NO: 200910 - DNA, 25 bp, Mus musculus
agggtctgaccgtctgtgggatcaa

SEQ ID NO: 200911 - DNA, 25 bp, Mus musculus
agggtctgacttcctagagtgaaaa

SEQ ID NO: 200912 - DNA, 25 bp, Mus musculus
agggtctgacttgctagagtgaaaa

SEQ ID NO: 200913 - DNA, 25 bp, Mus musculus
agggtctgaggcatggtcccacctg

SEQ ID NO: 200914 - DNA, 25 bp, Mus musculus
agggtctgaggcttggtcccacctg

SEQ ID NO: 200915 - DNA, 25 bp, Mus musculus
agggtctgatgcctgatggtttctc

SEQ ID NO: 200916 - DNA, 25 bp, Mus musculus
agggtctgatgcgtgatggtttctc

SEQ ID NO: 200917 - DNA, 25 bp, Mus musculus
agggtctgcccaactttctctagct

SEQ ID NO: 200918 - DNA, 25 bp, Mus musculus
agggtctgcccatctttctctagct

SEQ ID NO: 200919 - DNA, 25 bp, Mus musculus
agggtctgctcaaactgggttttca

SEQ ID NO: 200920 - DNA, 25 bp, Mus musculus
agggtctgctcatactgggttttca

SEQ ID NO: 200921 - DNA, 25 bp, Mus musculus
agggtctggccgaacgtgtttctgt

SEQ ID NO: 200922 - DNA, 25 bp, Mus musculus
agggtctggccgtacgtgtttctgt

SEQ ID NO: 200923 - DNA, 25 bp, Mus musculus
agggtctggctcactagaggttgca

SEQ ID NO: 200924 - DNA, 25 bp, Mus musculus
agggtctggctctctagaggttgca

SEQ ID NO: 200925 - DNA, 25 bp, Mus musculus
agggtctggtctcttctcagccaga

SEQ ID NO: 200926 - DNA, 25 bp, Mus musculus
agggtctggtctgttctcagccaga

SEQ ID NO: 200927 - DNA, 25 bp, Mus musculus
agggtctgtaaaattggctcttgca

SEQ ID NO: 200928 - DNA, 25 bp, Mus musculus
agggtctgtaaatttggctcttgca

SEQ ID NO: 200929 - DNA, 25 bp, Mus musculus
agggtctgtgacaccctagtttgcc

SEQ ID NO: 200930 - DNA, 25 bp, Mus musculus
agggtctgtgacatatttcatttgc

SEQ ID NO: 200931 - DNA, 25 bp, Mus musculus
agggtctgtgactccctagtttgcc

SEQ ID NO: 200932 - DNA, 25 bp, Mus musculus
agggtctgtgacttatttcatttgc

SEQ ID NO: 200933 - DNA, 25 bp, Mus musculus
agggtctgtgtcaaaggagcccaca

SEQ ID NO: 200934 - DNA, 25 bp, Mus musculus
agggtctgtgtctaaggagcccaca

SEQ ID NO: 200935 - DNA, 25 bp, Mus musculus
agggtctgttttccagagttactgc

SEQ ID NO: 200936 - DNA, 25 bp, Mus musculus
agggtctgttttgcagagttactgc

SEQ ID NO: 200937 - DNA, 25 bp, Mus musculus
agggtcttaaagcttctccttgctg

SEQ ID NO: 200938 - DNA, 25 bp, Mus musculus
agggtcttaaaggttctccttgctg

SEQ ID NO: 200939 - DNA, 25 bp, Mus musculus
agggtcttaaccagccttctctctg

SEQ ID NO: 200940 - DNA, 25 bp, Mus musculus
agggtcttaacctgccttctctctg

SEQ ID NO: 200941 - DNA, 25 bp, Mus musculus
agggtcttaatcatgaggagtgtca

SEQ ID NO: 200942 - DNA, 25 bp, Mus musculus
agggtcttaatcttgaggagtgtca

SEQ ID NO: 200943 - DNA, 25 bp, Mus musculus
agggtcttaccaaggcccatgcagt

SEQ ID NO: 200944 - DNA, 25 bp, Mus musculus
agggtcttaccatggcccatgcagt

SEQ ID NO: 200945 - DNA, 25 bp, Mus musculus
agggtcttatgcagctcagtggttc

SEQ ID NO: 200946 - DNA, 25 bp, Mus musculus
agggtcttatgctgctcagtggttc

SEQ ID NO: 200947 - DNA, 25 bp, Mus musculus
agggtcttattactatttgtttcat

SEQ ID NO: 200948 - DNA, 25 bp, Mus musculus
agggtcttattagtatttgtttcat

SEQ ID NO: 200949 - DNA, 25 bp, Mus musculus
agggtcttcctaactgaacacagta

SEQ ID NO: 200950 - DNA, 25 bp, Mus musculus
agggtcttcctatctgaacacagta

SEQ ID NO: 200951 - DNA, 25 bp, Mus musculus
agggtcttctaaacctcattacatt

SEQ ID NO: 200952 - DNA, 25 bp, Mus musculus
agggtcttctaatcctcattacatt

SEQ ID NO: 200953 - DNA, 25 bp, Mus musculus
agggtcttgcagaggatccttggct

SEQ ID NO: 200954 - DNA, 25 bp, Mus musculus
agggtcttgcagtggatccttggct

SEQ ID NO: 200955 - DNA, 25 bp, Mus musculus
agggtcttgctacgtagtcctgtct

SEQ ID NO: 200956 - DNA, 25 bp, Mus musculus
agggtcttgctaggtagtcctgtct

SEQ ID NO: 200957 - DNA, 25 bp, Mus musculus
agggtcttgctgctggtcacttgca

SEQ ID NO: 200958 - DNA, 25 bp, Mus musculus
agggtcttgctggtggtcacttgca

SEQ ID NO: 200959 - DNA, 25 bp, Mus musculus
agggtcttggatattgtgattctgt

SEQ ID NO: 200960 - DNA, 25 bp, Mus musculus
agggtcttggattttgtgattctgt

SEQ ID NO: 200961 - DNA, 25 bp, Mus musculus
agggtcttgggtaagaaccacaatg

SEQ ID NO: 200962 - DNA, 25 bp, Mus musculus
agggtcttgggttagaaccacaatg

SEQ ID NO: 200963 - DNA, 25 bp, Mus musculus
agggtctttacacaattgcttcaaa

SEQ ID NO: 200964 - DNA, 25 bp, Mus musculus
agggtctttacagaattgcttcaaa

SEQ ID NO: 200965 - DNA, 25 bp, Mus musculus
agggtctttcccaaagtgacatatg

SEQ ID NO: 200966 - DNA, 25 bp, Mus musculus
agggtctttccctaagtgacatatg

SEQ ID NO: 200967 - DNA, 25 bp, Mus musculus
agggtgaaatgcagaccactcctgt

SEQ ID NO: 200968 - DNA, 25 bp, Mus musculus
agggtgaaatgctgaccactcctgt

SEQ ID NO: 200969 - DNA, 25 bp, Mus musculus
agggtgaacggacgcagcgggaaca

SEQ ID NO: 200970 - DNA, 25 bp, Mus musculus
agggtgaacggaggcagcgggaaca

SEQ ID NO: 200971 - DNA, 25 bp, Mus musculus
agggtgaacgtcctccattgagtaa

SEQ ID NO: 200972 - DNA, 25 bp, Mus musculus
agggtgaacgtcgtccattgagtaa

SEQ ID NO: 200973 - DNA, 25 bp, Mus musculus
agggtgaagcccaaagcagctatcg

SEQ ID NO: 200974 - DNA, 25 bp, Mus musculus
agggtgaagccctaagcagctatcg

SEQ ID NO: 200975 - DNA, 25 bp, Mus musculus
agggtgaaggcacgtccacaccttt

SEQ ID NO: 200976 - DNA, 25 bp, Mus musculus
agggtgaaggcaggtccacaccttt

SEQ ID NO: 200977 - DNA, 25 bp, Mus musculus
agggtgaagttcatttcatctggga

SEQ ID NO: 200978 - DNA, 25 bp, Mus musculus
agggtgaagttcttttcatctggga

SEQ ID NO: 200979 - DNA, 25 bp, Mus musculus
agggtgaattccacacattccagcg

SEQ ID NO: 200980 - DNA, 25 bp, Mus musculus
agggtgaattcctcacattccagcg

SEQ ID NO: 200981 - DNA, 25 bp, Mus musculus
agggtgacacaaccacagcgtgatt

SEQ ID NO: 200982 - DNA, 25 bp, Mus musculus
agggtgacacaagcacagcgtgatt

SEQ ID NO: 200983 - DNA, 25 bp, Mus musculus
agggtgacacacactgggctgcctg

SEQ ID NO: 200984 - DNA, 25 bp, Mus musculus
agggtgacacactctgggctgcctg

SEQ ID NO: 200985 - DNA, 25 bp, Mus musculus
agggtgacacttccggagactacag

SEQ ID NO: 200986 - DNA, 25 bp, Mus musculus
agggtgacacttcctgaatccgaca

SEQ ID NO: 200987 - DNA, 25 bp, Mus musculus
agggtgacacttgcggagactacag

SEQ ID NO: 200988 - DNA, 25 bp, Mus musculus
agggtgacacttgctgaatccgaca

SEQ ID NO: 200989 - DNA, 25 bp, Mus musculus
agggtgacatcaagtctcgcttcct

SEQ ID NO: 200990 - DNA, 25 bp, Mus musculus
agggtgacatcatgtctcgcttcct

SEQ ID NO: 200991 - DNA, 25 bp, Mus musculus
agggtgacatgtcccctgcatggaa

SEQ ID NO: 200992 - DNA, 25 bp, Mus musculus
agggtgacatgtgccctgcatggaa

SEQ ID NO: 200993 - DNA, 25 bp, Mus musculus
agggtgaccaatcctctggaactga

SEQ ID NO: 200994 - DNA, 25 bp, Mus musculus
agggtgaccaatgctctggaactga

SEQ ID NO: 200995 - DNA, 25 bp, Mus musculus
agggtgaccagcagacccaggaaca

SEQ ID NO: 200996 - DNA, 25 bp, Mus musculus
agggtgaccagcattctcaacaaac

SEQ ID NO: 200997 - DNA, 25 bp, Mus musculus
agggtgaccagctgacccaggaaca

SEQ ID NO: 200998 - DNA, 25 bp, Mus musculus
agggtgaccagctttctcaacaaac

SEQ ID NO: 200999 - DNA, 25 bp, Mus musculus
agggtgaccccactagccagaggtc

SEQ ID NO: 201000 - DNA, 25 bp, Mus musculus
agggtgaccccagtagccagaggtc

SEQ ID NO: 201001 - DNA, 25 bp, Mus musculus
agggtgaccccgattgtctataatt

SEQ ID NO: 201002 - DNA, 25 bp, Mus musculus
agggtgaccccgtttgtctataatt

SEQ ID NO: 201003 - DNA, 25 bp, Mus musculus
agggtgaccctcaggttcatggctg

SEQ ID NO: 201004 - DNA, 25 bp, Mus musculus
agggtgaccctctggttcatggctg

SEQ ID NO: 201005 - DNA, 25 bp, Mus musculus
agggtgacctggctctatgacctta

SEQ ID NO: 201006 - DNA, 25 bp, Mus musculus
agggtgacctgggtctatgacctta

SEQ ID NO: 201007 - DNA, 25 bp, Mus musculus
agggtgaccttcctgattgcactta

SEQ ID NO: 201008 - DNA, 25 bp, Mus musculus
agggtgaccttcgtgattgcactta

SEQ ID NO: 201009 - DNA, 25 bp, Mus musculus
agggtgactcacctcgacttctagg

SEQ ID NO: 201010 - DNA, 25 bp, Mus musculus
agggtgactcacgtcgacttctagg

SEQ ID NO: 201011 - DNA, 25 bp, Mus musculus
agggtgactccaaggccgctgagct

SEQ ID NO: 201012 - DNA, 25 bp, Mus musculus
agggtgactccatggccgctgagct

SEQ ID NO: 201013 - DNA, 25 bp, Mus musculus
agggtgactcccaagagtgggcact

SEQ ID NO: 201014 - DNA, 25 bp, Mus musculus
agggtgactccctagagtgggcact

SEQ ID NO: 201015 - DNA, 25 bp, Mus musculus
agggtgactctgaatcatttgacaa

SEQ ID NO: 201016 - DNA, 25 bp, Mus musculus
agggtgactctgtatcatttgacaa

SEQ ID NO: 201017 - DNA, 25 bp, Mus musculus
agggtgactcttcatatctctgtct

SEQ ID NO: 201018 - DNA, 25 bp, Mus musculus
agggtgactcttgatatctctgtct

SEQ ID NO: 201019 - DNA, 25 bp, Mus musculus
agggtgactgaaacacggcacttct

SEQ ID NO: 201020 - DNA, 25 bp, Mus musculus
agggtgactgaatcacggcacttct

SEQ ID NO: 201021 - DNA, 25 bp, Mus musculus
agggtgactgtgaatcccaaccctt

SEQ ID NO: 201022 - DNA, 25 bp, Mus musculus
agggtgactgtgtatcccaaccctt

SEQ ID NO: 201023 - DNA, 25 bp, Mus musculus
agggtgacttcaccctactagacca

SEQ ID NO: 201024 - DNA, 25 bp, Mus musculus
agggtgacttcagcctactagacca

SEQ ID NO: 201025 - DNA, 25 bp, Mus musculus
agggtgagacccaatatttaatctg

SEQ ID NO: 201026 - DNA, 25 bp, Mus musculus
agggtgagaccctatatttaatctg

SEQ ID NO: 201027 - DNA, 25 bp, Mus musculus
agggtgagagttcctcccgctttct

SEQ ID NO: 201028 - DNA, 25 bp, Mus musculus
agggtgagagttgctcccgctttct

SEQ ID NO: 201029 - DNA, 25 bp, Mus musculus
agggtgagcgacacctgtactgtag

SEQ ID NO: 201030 - DNA, 25 bp, Mus musculus
agggtgagcgactcctgtactgtag

SEQ ID NO: 201031 - DNA, 25 bp, Mus musculus
agggtgagctcccaagagctgccct

SEQ ID NO: 201032 - DNA, 25 bp, Mus musculus
agggtgagctccgaagagctgccct

SEQ ID NO: 201033 - DNA, 25 bp, Mus musculus
agggtgagctgcatcgcaccgacta

SEQ ID NO: 201034 - DNA, 25 bp, Mus musculus
agggtgagctgcttcgcaccgacta

SEQ ID NO: 201035 - DNA, 25 bp, Mus musculus
agggtgaggacaagtgtgggaggct

SEQ ID NO: 201036 - DNA, 25 bp, Mus musculus
agggtgaggacatgtgtgggaggct

SEQ ID NO: 201037 - DNA, 25 bp, Mus musculus
agggtgagtgtgatcagcccatgct

SEQ ID NO: 201038 - DNA, 25 bp, Mus musculus
agggtgagtgtgttcagcccatgct

SEQ ID NO: 201039 - DNA, 25 bp, Mus musculus
agggtgatatctctgaccctgcccg

SEQ ID NO: 201040 - DNA, 25 bp, Mus musculus
agggtgatatctgtgaccctgcccg

SEQ ID NO: 201041 - DNA, 25 bp, Mus musculus
agggtgatattaacaaatgctatta

SEQ ID NO: 201042 - DNA, 25 bp, Mus musculus
agggtgatattatcaaatgctatta

SEQ ID NO: 201043 - DNA, 25 bp, Mus musculus
agggtgatcctgataccacagtagt

SEQ ID NO: 201044 - DNA, 25 bp, Mus musculus
agggtgatcctgttaccacagtagt

SEQ ID NO: 201045 - DNA, 25 bp, Mus musculus
agggtgatcttgagtcttaagacat

SEQ ID NO: 201046 - DNA, 25 bp, Mus musculus
agggtgatcttgtgtcttaagacat

SEQ ID NO: 201047 - DNA, 25 bp, Mus musculus
agggtgatttgcattcgtttttaca

SEQ ID NO: 201048 - DNA, 25 bp, Mus musculus
agggtgatttgctttcgtttttaca

SEQ ID NO: 201049 - DNA, 25 bp, Mus musculus
agggtgcaagcacttcagctcaggc

SEQ ID NO: 201050 - DNA, 25 bp, Mus musculus
agggtgcaagcagttcagctcaggc

SEQ ID NO: 201051 - DNA, 25 bp, Mus musculus
agggtgcacattcgtcacagtttgc

SEQ ID NO: 201052 - DNA, 25 bp, Mus musculus
agggtgcacattggtcacagtttgc

SEQ ID NO: 201053 - DNA, 25 bp, Mus musculus
agggtgcacgaacacctgattctcc

SEQ ID NO: 201054 - DNA, 25 bp, Mus musculus
agggtgcacgaagacctgattctcc

SEQ ID NO: 201055 - DNA, 25 bp, Mus musculus
agggtgcagacactgaggcattcct

SEQ ID NO: 201056 - DNA, 25 bp, Mus musculus
agggtgcagacagtgaggcattcct

SEQ ID NO: 201057 - DNA, 25 bp, Mus musculus
agggtgcagatacctacctgtggaa

SEQ ID NO: 201058 - DNA, 25 bp, Mus musculus
agggtgcagatagctacctgtggaa

SEQ ID NO: 201059 - DNA, 25 bp, Mus musculus
agggtgcagcacataacctactatg

SEQ ID NO: 201060 - DNA, 25 bp, Mus musculus
agggtgcagcacttaacctactatg

SEQ ID NO: 201061 - DNA, 25 bp, Mus musculus
agggtgcagtggcacatactccacc

SEQ ID NO: 201062 - DNA, 25 bp, Mus musculus
agggtgcagtgggacatactccacc

SEQ ID NO: 201063 - DNA, 25 bp, Mus musculus
agggtgcagttccacttcaggagct

SEQ ID NO: 201064 - DNA, 25 bp, Mus musculus
agggtgcagttcgacttcaggagct

SEQ ID NO: 201065 - DNA, 25 bp, Mus musculus
agggtgcattttagctatgtgcgta

SEQ ID NO: 201066 - DNA, 25 bp, Mus musculus
agggtgcatttttgctatgtgcgta

SEQ ID NO: 201067 - DNA, 25 bp, Mus musculus
agggtgccactgacctgtaaatcca

SEQ ID NO: 201068 - DNA, 25 bp, Mus musculus
agggtgccactgtcctgtaaatcca

SEQ ID NO: 201069 - DNA, 25 bp, Mus musculus
agggtgccagcaactgaactcgggt

SEQ ID NO: 201070 - DNA, 25 bp, Mus musculus
agggtgccagcatctgaactcgggt

SEQ ID NO: 201071 - DNA, 25 bp, Mus musculus
agggtgccagctctgccttgaattt

SEQ ID NO: 201072 - DNA, 25 bp, Mus musculus
agggtgccagctgtgccttgaattt

SEQ ID NO: 201073 - DNA, 25 bp, Mus musculus
agggtgccagttccctgccctaggc

SEQ ID NO: 201074 - DNA, 25 bp, Mus musculus
agggtgccagttgcctgccctaggc

SEQ ID NO: 201075 - DNA, 25 bp, Mus musculus
agggtgccatgcatatccttgggct

SEQ ID NO: 201076 - DNA, 25 bp, Mus musculus
agggtgccatgcttatccttgggct

SEQ ID NO: 201077 - DNA, 25 bp, Mus musculus
agggtgccctgtcttcattttgcga

SEQ ID NO: 201078 - DNA, 25 bp, Mus musculus
agggtgccctgtgttcattttgcga

SEQ ID NO: 201079 - DNA, 25 bp, Mus musculus
agggtgccgcctatgagaattccaa

SEQ ID NO: 201080 - DNA, 25 bp, Mus musculus
agggtgccgcctttgagaattccaa

SEQ ID NO: 201081 - DNA, 25 bp, Mus musculus
agggtgccggtgactcttcaaatgc

SEQ ID NO: 201082 - DNA, 25 bp, Mus musculus
agggtgccggtgtctcttcaaatgc

SEQ ID NO: 201083 - DNA, 25 bp, Mus musculus
agggtgcctccaacagaacaggtgt

SEQ ID NO: 201084 - DNA, 25 bp, Mus musculus
agggtgcctccatcagaacaggtgt

SEQ ID NO: 201085 - DNA, 25 bp, Mus musculus
agggtgccttcactgtgttttctga

SEQ ID NO: 201086 - DNA, 25 bp, Mus musculus
agggtgccttcagtgtgttttctga

SEQ ID NO: 201087 - DNA, 25 bp, Mus musculus
agggtgcgacagacacagccgattc

SEQ ID NO: 201088 - DNA, 25 bp, Mus musculus
agggtgcgacagtcacagccgattc

SEQ ID NO: 201089 - DNA, 25 bp, Mus musculus
agggtgcgagcccacaatagtgact

SEQ ID NO: 201090 - DNA, 25 bp, Mus musculus
agggtgcgagccgacaatagtgact

SEQ ID NO: 201091 - DNA, 25 bp, Mus musculus
agggtgcgcttcaccgaggccaata

SEQ ID NO: 201092 - DNA, 25 bp, Mus musculus
agggtgcgcttctccgaggccaata

SEQ ID NO: 201093 - DNA, 25 bp, Mus musculus
agggtgctagacacagctatcttag

SEQ ID NO: 201094 - DNA, 25 bp, Mus musculus
agggtgctagactcagctatcttag

SEQ ID NO: 201095 - DNA, 25 bp, Mus musculus
agggtgctatggcaacaggcccact

SEQ ID NO: 201096 - DNA, 25 bp, Mus musculus
agggtgctatgggaacaggcccact

SEQ ID NO: 201097 - DNA, 25 bp, Mus musculus
agggtgctattccacgactagttca

SEQ ID NO: 201098 - DNA, 25 bp, Mus musculus
agggtgctattcgacgactagttca

SEQ ID NO: 201099 - DNA, 25 bp, Mus musculus
agggtgctcactcaaggttctggca

SEQ ID NO: 201100 - DNA, 25 bp, Mus musculus
agggtgctcactgaaggttctggca

SEQ ID NO: 201101 - DNA, 25 bp, Mus musculus
agggtgctcagcacatagccgtggc

SEQ ID NO: 201102 - DNA, 25 bp, Mus musculus
agggtgctcagctcatagccgtggc

SEQ ID NO: 201103 - DNA, 25 bp, Mus musculus
agggtgctccaaagtgacctgcatc

SEQ ID NO: 201104 - DNA, 25 bp, Mus musculus
agggtgctccaatgtgacctgcatc

SEQ ID NO: 201105 - DNA, 25 bp, Mus musculus
agggtgctccctaccaacgaactca

SEQ ID NO: 201106 - DNA, 25 bp, Mus musculus
agggtgctcccttccaacgaactca

SEQ ID NO: 201107 - DNA, 25 bp, Mus musculus
agggtgctctgacgcgatctcgtca

SEQ ID NO: 201108 - DNA, 25 bp, Mus musculus
agggtgctctgaggcgatctcgtca

SEQ ID NO: 201109 - DNA, 25 bp, Mus musculus
agggtgctctggacatgttgaccaa

SEQ ID NO: 201110 - DNA, 25 bp, Mus musculus
agggtgctctggtcatgttgaccaa

SEQ ID NO: 201111 - DNA, 25 bp, Mus musculus
agggtgctcttgaactctttatggt

SEQ ID NO: 201112 - DNA, 25 bp, Mus musculus
agggtgctcttgtactctttatggt

SEQ ID NO: 201113 - DNA, 25 bp, Mus musculus
agggtgctgagcactcgcgacagct

SEQ ID NO: 201114 - DNA, 25 bp, Mus musculus
agggtgctgagctctcgcgacagct

SEQ ID NO: 201115 - DNA, 25 bp, Mus musculus
agggtgctgaggaccgtacctttgc

SEQ ID NO: 201116 - DNA, 25 bp, Mus musculus
agggtgctgaggtccgtacctttgc

SEQ ID NO: 201117 - DNA, 25 bp, Mus musculus
agggtgctgggcacttcttactggc

SEQ ID NO: 201118 - DNA, 25 bp, Mus musculus
agggtgctgggctcttcttactggc

SEQ ID NO: 201119 - DNA, 25 bp, Mus musculus
agggtgctgtagcatacaccacgct

SEQ ID NO: 201120 - DNA, 25 bp, Mus musculus
agggtgctgtaggatacaccacgct

SEQ ID NO: 201121 - DNA, 25 bp, Mus musculus
agggtgctgtgtcccatatcaacat

SEQ ID NO: 201122 - DNA, 25 bp, Mus musculus
agggtgctgtgtgccatatcaacat

SEQ ID NO: 201123 - DNA, 25 bp, Mus musculus
agggtgcttccaaagtaactcttga

SEQ ID NO: 201124 - DNA, 25 bp, Mus musculus
agggtgcttccatagtaactcttga

SEQ ID NO: 201125 - DNA, 25 bp, Mus musculus
agggtgcttgaaacaaaattgatct

SEQ ID NO: 201126 - DNA, 25 bp, Mus musculus
agggtgcttgaatcaaaattgatct

SEQ ID NO: 201127 - DNA, 25 bp, Mus musculus
agggtgcttgtgcatccctgagcct

SEQ ID NO: 201128 - DNA, 25 bp, Mus musculus
agggtgcttgtggatccctgagcct

SEQ ID NO: 201129 - DNA, 25 bp, Mus musculus
agggtggacagaattcaagtctgct

SEQ ID NO: 201130 - DNA, 25 bp, Mus musculus
agggtggacagatttcaagtctgct

SEQ ID NO: 201131 - DNA, 25 bp, Mus musculus
agggtggacagtagcttgcctgctt

SEQ ID NO: 201132 - DNA, 25 bp, Mus musculus
agggtggacagttgcttgcctgctt

SEQ ID NO: 201133 - DNA, 25 bp, Mus musculus
agggtggacatgacctcacggccat

SEQ ID NO: 201134 - DNA, 25 bp, Mus musculus
agggtggacatgtcctcacggccat

SEQ ID NO: 201135 - DNA, 25 bp, Mus musculus
agggtggagagtactgcttttctct

SEQ ID NO: 201136 - DNA, 25 bp, Mus musculus
agggtggagagttctgcttttctct

SEQ ID NO: 201137 - DNA, 25 bp, Mus musculus
agggtggagatcaagagcgctaaaa

SEQ ID NO: 201138 - DNA, 25 bp, Mus musculus
agggtggagatctagagcgctaaaa

SEQ ID NO: 201139 - DNA, 25 bp, Mus musculus
agggtggagattccagaccgctcca

SEQ ID NO: 201140 - DNA, 25 bp, Mus musculus
agggtggagattgcagaccgctcca

SEQ ID NO: 201141 - DNA, 25 bp, Mus musculus
agggtggagcctatgcggtgagtga

SEQ ID NO: 201142 - DNA, 25 bp, Mus musculus
agggtggagcctttgcggtgagtga

SEQ ID NO: 201143 - DNA, 25 bp, Mus musculus
agggtggagctgctttactctccgc

SEQ ID NO: 201144 - DNA, 25 bp, Mus musculus
agggtggagctggtttactctccgc

SEQ ID NO: 201145 - DNA, 25 bp, Mus musculus
agggtggagtctcgcagcaccattt

SEQ ID NO: 201146 - DNA, 25 bp, Mus musculus
agggtggagtctggcagcaccattt

SEQ ID NO: 201147 - DNA, 25 bp, Mus musculus
agggtggatccaacatggcctcgag

SEQ ID NO: 201148 - DNA, 25 bp, Mus musculus
agggtggatccatcatggcctcgag

SEQ ID NO: 201149 - DNA, 25 bp, Mus musculus
agggtggatgctactaagtccgtac

SEQ ID NO: 201150 - DNA, 25 bp, Mus musculus
agggtggatgcttctaagtccgtac

SEQ ID NO: 201151 - DNA, 25 bp, Mus musculus
agggtggcaagaagtccagcttcct

SEQ ID NO: 201152 - DNA, 25 bp, Mus musculus
agggtggcaagatgtccagcttcct

SEQ ID NO: 201153 - DNA, 25 bp, Mus musculus
agggtggcagtcactctggaccttg

SEQ ID NO: 201154 - DNA, 25 bp, Mus musculus
agggtggcagtctctctggaccttg

SEQ ID NO: 201155 - DNA, 25 bp, Mus musculus
agggtggcatagaacttgtctgtaa

SEQ ID NO: 201156 - DNA, 25 bp, Mus musculus
agggtggcatagtacttgtctgtaa

SEQ ID NO: 201157 - DNA, 25 bp, Mus musculus
agggtggcattcactatatagtttc

SEQ ID NO: 201158 - DNA, 25 bp, Mus musculus
agggtggcattctctatatagtttc

SEQ ID NO: 201159 - DNA, 25 bp, Mus musculus
agggtggccactacagctacacact

SEQ ID NO: 201160 - DNA, 25 bp, Mus musculus
agggtggccacttcagctacacact

SEQ ID NO: 201161 - DNA, 25 bp, Mus musculus
agggtggccttcagtccctaggcaa

SEQ ID NO: 201162 - DNA, 25 bp, Mus musculus
agggtggccttctgtccctaggcaa

SEQ ID NO: 201163 - DNA, 25 bp, Mus musculus
agggtggctattcctactcctcagt

SEQ ID NO: 201164 - DNA, 25 bp, Mus musculus
agggtggctattgctactcctcagt

SEQ ID NO: 201165 - DNA, 25 bp, Mus musculus
agggtggctcacactgctaaaagca

SEQ ID NO: 201166 - DNA, 25 bp, Mus musculus
agggtggctcactctgctaaaagca

SEQ ID NO: 201167 - DNA, 25 bp, Mus musculus
agggtggctcttatgttattgtcaa

SEQ ID NO: 201168 - DNA, 25 bp, Mus musculus
agggtggctcttttgttattgtcaa

SEQ ID NO: 201169 - DNA, 25 bp, Mus musculus
agggtggctgcactcagcaactaat

SEQ ID NO: 201170 - DNA, 25 bp, Mus musculus
agggtggctgcagtcagcaactaat

SEQ ID NO: 201171 - DNA, 25 bp, Mus musculus
agggtggcttagacactgtcttagg

SEQ ID NO: 201172 - DNA, 25 bp, Mus musculus
agggtggcttagtcactgtcttagg

SEQ ID NO: 201173 - DNA, 25 bp, Mus musculus
agggtgggcagaatcagcttgttcc

SEQ ID NO: 201174 - DNA, 25 bp, Mus musculus
agggtgggcagattcagcttgttcc

SEQ ID NO: 201175 - DNA, 25 bp, Mus musculus
agggtgggtggtacacctctcttct

SEQ ID NO: 201176 - DNA, 25 bp, Mus musculus
agggtgggtggttcacctctcttct

SEQ ID NO: 201177 - DNA, 25 bp, Mus musculus
agggtgggttttctagttcatgtct

SEQ ID NO: 201178 - DNA, 25 bp, Mus musculus
agggtgggttttgtagttcatgtct

SEQ ID NO: 201179 - DNA, 25 bp, Mus musculus
agggtggtaatcacgctttggccat

SEQ ID NO: 201180 - DNA, 25 bp, Mus musculus
agggtggtaatctcgctttggccat

SEQ ID NO: 201181 - DNA, 25 bp, Mus musculus
agggtggtcagtcttgccatgtcaa

SEQ ID NO: 201182 - DNA, 25 bp, Mus musculus
agggtggtcagtgttgccatgtcaa

SEQ ID NO: 201183 - DNA, 25 bp, Mus musculus
agggtggtcctcagtaaagctgtac

SEQ ID NO: 201184 - DNA, 25 bp, Mus musculus
agggtggtcctctgtaaagctgtac

SEQ ID NO: 201185 - DNA, 25 bp, Mus musculus
agggtggtctttccgctcagtattg

SEQ ID NO: 201186 - DNA, 25 bp, Mus musculus
agggtggtctttgcgctcagtattg

SEQ ID NO: 201187 - DNA, 25 bp, Mus musculus
agggtggtggaaacagccctgttca

SEQ ID NO: 201188 - DNA, 25 bp, Mus musculus
agggtggtggaatcagccctgttca

SEQ ID NO: 201189 - DNA, 25 bp, Mus musculus
agggtggtggagattctttcccaat

SEQ ID NO: 201190 - DNA, 25 bp, Mus musculus
agggtggtggagtttctttcccaat

SEQ ID NO: 201191 - DNA, 25 bp, Mus musculus
agggtggtggcactccttagcccca

SEQ ID NO: 201192 - DNA, 25 bp, Mus musculus
agggtggtggcagtccttagcccca

SEQ ID NO: 201193 - DNA, 25 bp, Mus musculus
agggtggtttccaagaaactgtgtg

SEQ ID NO: 201194 - DNA, 25 bp, Mus musculus
agggtggtttccagcagccctcaaa

SEQ ID NO: 201195 - DNA, 25 bp, Mus musculus
agggtggtttcctagaaactgtgtg

SEQ ID NO: 201196 - DNA, 25 bp, Mus musculus
agggtggtttcctgcagccctcaaa

SEQ ID NO: 201197 - DNA, 25 bp, Mus musculus
agggtgtaaaagagctcgtccatct

SEQ ID NO: 201198 - DNA, 25 bp, Mus musculus
agggtgtaaaagtgctcgtccatct

SEQ ID NO: 201199 - DNA, 25 bp, Mus musculus
agggtgtaactcaagtctcctgact

SEQ ID NO: 201200 - DNA, 25 bp, Mus musculus
agggtgtaactctagtctcctgact

SEQ ID NO: 201201 - DNA, 25 bp, Mus musculus
agggtgtaccaaccatggtgcccac

SEQ ID NO: 201202 - DNA, 25 bp, Mus musculus
agggtgtaccaagcatggtgcccac

SEQ ID NO: 201203 - DNA, 25 bp, Mus musculus
agggtgtagtttcacaccttgcctt

SEQ ID NO: 201204 - DNA, 25 bp, Mus musculus
agggtgtagtttgacaccttgcctt

SEQ ID NO: 201205 - DNA, 25 bp, Mus musculus
agggtgtcactcagccagggagtac

SEQ ID NO: 201206 - DNA, 25 bp, Mus musculus
agggtgtcactctgccagggagtac

SEQ ID NO: 201207 - DNA, 25 bp, Mus musculus
agggtgtcccggacattaacagtgt

SEQ ID NO: 201208 - DNA, 25 bp, Mus musculus
agggtgtcccggtcattaacagtgt

SEQ ID NO: 201209 - DNA, 25 bp, Mus musculus
agggtgtcctgaacattttcgatga

SEQ ID NO: 201210 - DNA, 25 bp, Mus musculus
agggtgtcctgatcattttcgatga

SEQ ID NO: 201211 - DNA, 25 bp, Mus musculus
agggtgtcctggcttttgtcatcca

SEQ ID NO: 201212 - DNA, 25 bp, Mus musculus
agggtgtcctgggttttgtcatcca

SEQ ID NO: 201213 - DNA, 25 bp, Mus musculus
agggtgtctatcacctactgagtag

SEQ ID NO: 201214 - DNA, 25 bp, Mus musculus
agggtgtctatctcctactgagtag

SEQ ID NO: 201215 - DNA, 25 bp, Mus musculus
agggtgtctcccataagagccagaa

SEQ ID NO: 201216 - DNA, 25 bp, Mus musculus
agggtgtctcccttaagagccagaa

SEQ ID NO: 201217 - DNA, 25 bp, Mus musculus
agggtgtctctccagatgaacttaa

SEQ ID NO: 201218 - DNA, 25 bp, Mus musculus
agggtgtctctcgagatgaacttaa

SEQ ID NO: 201219 - DNA, 25 bp, Mus musculus
agggtgtctctgagtgtaaaccaga

SEQ ID NO: 201220 - DNA, 25 bp, Mus musculus
agggtgtctctgtgtgtaaaccaga

SEQ ID NO: 201221 - DNA, 25 bp, Mus musculus
agggtgtctgcacttcgagagctcc

SEQ ID NO: 201222 - DNA, 25 bp, Mus musculus
agggtgtctgcagttcgagagctcc

SEQ ID NO: 201223 - DNA, 25 bp, Mus musculus
agggtgtcttttagtccacttctca

SEQ ID NO: 201224 - DNA, 25 bp, Mus musculus
agggtgtctttttgtccacttctca

SEQ ID NO: 201225 - DNA, 25 bp, Mus musculus
agggtgtgacctagtacagagcccc

SEQ ID NO: 201226 - DNA, 25 bp, Mus musculus
agggtgtgaccttgtacagagcccc

SEQ ID NO: 201227 - DNA, 25 bp, Mus musculus
agggtgtgccccacgaagagcatgc

SEQ ID NO: 201228 - DNA, 25 bp, Mus musculus
agggtgtgcccctcgaagagcatgc

SEQ ID NO: 201229 - DNA, 25 bp, Mus musculus
agggtgtgccttaaaatttcttgtg

SEQ ID NO: 201230 - DNA, 25 bp, Mus musculus
agggtgtgcctttaaatttcttgtg

SEQ ID NO: 201231 - DNA, 25 bp, Mus musculus
agggtgtgctcaaggttcacactca

SEQ ID NO: 201232 - DNA, 25 bp, Mus musculus
agggtgtgctcatggttcacactca

SEQ ID NO: 201233 - DNA, 25 bp, Mus musculus
agggtgtggcatcattaggaggtgt

SEQ ID NO: 201234 - DNA, 25 bp, Mus musculus
agggtgtggcatgattaggaggtgt

SEQ ID NO: 201235 - DNA, 25 bp, Mus musculus
agggtgtggccaattccgaagacca

SEQ ID NO: 201236 - DNA, 25 bp, Mus musculus
agggtgtggccatttccgaagacca

SEQ ID NO: 201237 - DNA, 25 bp, Mus musculus
agggtgtggcttcctgcagacaaca

SEQ ID NO: 201238 - DNA, 25 bp, Mus musculus
agggtgtggcttgctgcagacaaca

SEQ ID NO: 201239 - DNA, 25 bp, Mus musculus
agggtgtgggttacatccccaacat

SEQ ID NO: 201240 - DNA, 25 bp, Mus musculus
agggtgtgggtttcatccccaacat

SEQ ID NO: 201241 - DNA, 25 bp, Mus musculus
agggtgtgtgcaaacctctgtcctg

SEQ ID NO: 201242 - DNA, 25 bp, Mus musculus
agggtgtgtgcatacctctgtcctg

SEQ ID NO: 201243 - DNA, 25 bp, Mus musculus
agggtgtgtggtctgtccttccaac

SEQ ID NO: 201244 - DNA, 25 bp, Mus musculus
agggtgtgtggtgtgtccttccaac

SEQ ID NO: 201245 - DNA, 25 bp, Mus musculus
agggtgttactgatactgctgtcaa

SEQ ID NO: 201246 - DNA, 25 bp, Mus musculus
agggtgttactgttactgctgtcaa

SEQ ID NO: 201247 - DNA, 25 bp, Mus musculus
agggtgttctgtcgtcttaagcttc

SEQ ID NO: 201248 - DNA, 25 bp, Mus musculus
agggtgttctgtggtcttaagcttc

SEQ ID NO: 201249 - DNA, 25 bp, Mus musculus
agggtgttggttcttctgcgctacc

SEQ ID NO: 201250 - DNA, 25 bp, Mus musculus
agggtgttggttgttctgcgctacc

SEQ ID NO: 201251 - DNA, 25 bp, Mus musculus
agggtgtttcagaatgccactccaa

SEQ ID NO: 201252 - DNA, 25 bp, Mus musculus
agggtgtttcagtatgccactccaa

SEQ ID NO: 201253 - DNA, 25 bp, Mus musculus
agggtgtttctcacgaacatgccat

SEQ ID NO: 201254 - DNA, 25 bp, Mus musculus
agggtgtttctctcgaacatgccat

SEQ ID NO: 201255 - DNA, 25 bp, Mus musculus
agggttaaacttccctgtctgcagt

SEQ ID NO: 201256 - DNA, 25 bp, Mus musculus
agggttaaacttgcctgtctgcagt

SEQ ID NO: 201257 - DNA, 25 bp, Mus musculus
agggttaagataactcctctccttg

SEQ ID NO: 201258 - DNA, 25 bp, Mus musculus
agggttaagatatctcctctccttg

SEQ ID NO: 201259 - DNA, 25 bp, Mus musculus
agggttaagcttcaagtgctcagta

SEQ ID NO: 201260 - DNA, 25 bp, Mus musculus
agggttaagcttgaagtgctcagta

SEQ ID NO: 201261 - DNA, 25 bp, Mus musculus
agggttacagacaaccatgcaacaa

SEQ ID NO: 201262 - DNA, 25 bp, Mus musculus
agggttacagactaccatgcaacaa

SEQ ID NO: 201263 - DNA, 25 bp, Mus musculus
agggttacatccaggtcacagattt

SEQ ID NO: 201264 - DNA, 25 bp, Mus musculus
agggttacatcctggtcacagattt

SEQ ID NO: 201265 - DNA, 25 bp, Mus musculus
agggttactcccataatgatgtgta

SEQ ID NO: 201266 - DNA, 25 bp, Mus musculus
agggttactcccttaatgatgtgta

SEQ ID NO: 201267 - DNA, 25 bp, Mus musculus
agggttactgcacctgatccaggcg

SEQ ID NO: 201268 - DNA, 25 bp, Mus musculus
agggttactgcagctgatccaggcg

SEQ ID NO: 201269 - DNA, 25 bp, Mus musculus
agggttactggcctgtttcaccagg

SEQ ID NO: 201270 - DNA, 25 bp, Mus musculus
agggttactggcgtgtttcaccagg

SEQ ID NO: 201271 - DNA, 25 bp, Mus musculus
agggttactttgaccaggacacaag

SEQ ID NO: 201272 - DNA, 25 bp, Mus musculus
agggttactttgtccaggacacaag

SEQ ID NO: 201273 - DNA, 25 bp, Mus musculus
agggttagaagaacacttcatcggt

SEQ ID NO: 201274 - DNA, 25 bp, Mus musculus
agggttagaagatcacttcatcggt

SEQ ID NO: 201275 - DNA, 25 bp, Mus musculus
agggttagaagcagccactcctcaa

SEQ ID NO: 201276 - DNA, 25 bp, Mus musculus
agggttagaagctgccactcctcaa

SEQ ID NO: 201277 - DNA, 25 bp, Mus musculus
agggttagatgcctcttccatagtc

SEQ ID NO: 201278 - DNA, 25 bp, Mus musculus
agggttagatgcgtcttccatagtc

SEQ ID NO: 201279 - DNA, 25 bp, Mus musculus
agggttagatttagccttgtctcct

SEQ ID NO: 201280 - DNA, 25 bp, Mus musculus
agggttagattttgccttgtctcct

SEQ ID NO: 201281 - DNA, 25 bp, Mus musculus
agggttagcaagctccacaggtgaa

SEQ ID NO: 201282 - DNA, 25 bp, Mus musculus
agggttagcaaggtccacaggtgaa

SEQ ID NO: 201283 - DNA, 25 bp, Mus musculus
agggttaggcaactcttctcccact

SEQ ID NO: 201284 - DNA, 25 bp, Mus musculus
agggttaggcaagtcttctcccact

SEQ ID NO: 201285 - DNA, 25 bp, Mus musculus
agggttagtaccatctgacttctat

SEQ ID NO: 201286 - DNA, 25 bp, Mus musculus
agggttagtaccttctgacttctat

SEQ ID NO: 201287 - DNA, 25 bp, Mus musculus
agggttagtggacctcagtttcatg

SEQ ID NO: 201288 - DNA, 25 bp, Mus musculus
agggttagtggagctcagtttcatg

SEQ ID NO: 201289 - DNA, 25 bp, Mus musculus
agggttattattctgatccccaaat

SEQ ID NO: 201290 - DNA, 25 bp, Mus musculus
agggttattattgtgatccccaaat

SEQ ID NO: 201291 - DNA, 25 bp, Mus musculus
agggttattcttccctacatagtaa

SEQ ID NO: 201292 - DNA, 25 bp, Mus musculus
agggttattcttgcctacatagtaa

SEQ ID NO: 201293 - DNA, 25 bp, Mus musculus
agggttattgacaccatgcatgcag

SEQ ID NO: 201294 - DNA, 25 bp, Mus musculus
agggttattgactccatgcatgcag

SEQ ID NO: 201295 - DNA, 25 bp, Mus musculus
agggttatttccatcatatgacttt

SEQ ID NO: 201296 - DNA, 25 bp, Mus musculus
agggttatttccttcatatgacttt

SEQ ID NO: 201297 - DNA, 25 bp, Mus musculus
agggttcaaatgctaaatctccgcc

SEQ ID NO: 201298 - DNA, 25 bp, Mus musculus
agggttcaaatggtaaatctccgcc

SEQ ID NO: 201299 - DNA, 25 bp, Mus musculus
agggttcaagtcacaacacccgcaa

SEQ ID NO: 201300 - DNA, 25 bp, Mus musculus
agggttcaagtctcaacacccgcaa

SEQ ID NO: 201301 - DNA, 25 bp, Mus musculus
agggttcaatctatgtacgcccaga

SEQ ID NO: 201302 - DNA, 25 bp, Mus musculus
agggttcaatctttgtacgcccaga

SEQ ID NO: 201303 - DNA, 25 bp, Mus musculus
agggttcaatttaggcgtcctctct

SEQ ID NO: 201304 - DNA, 25 bp, Mus musculus
agggttcaattttggcgtcctctct

SEQ ID NO: 201305 - DNA, 25 bp, Mus musculus
agggttcacactacagagcatctgc

SEQ ID NO: 201306 - DNA, 25 bp, Mus musculus
agggttcacacttcagagcatctgc

SEQ ID NO: 201307 - DNA, 25 bp, Mus musculus
agggttcacgaactattctgagact

SEQ ID NO: 201308 - DNA, 25 bp, Mus musculus
agggttcacgaagtattctgagact

SEQ ID NO: 201309 - DNA, 25 bp, Mus musculus
agggttcagaggacatcaacagcaa

SEQ ID NO: 201310 - DNA, 25 bp, Mus musculus
agggttcagaggacgcagagcactt

SEQ ID NO: 201311 - DNA, 25 bp, Mus musculus
agggttcagaggtcatcaacagcaa

SEQ ID NO: 201312 - DNA, 25 bp, Mus musculus
agggttcagaggtcgcagagcactt

SEQ ID NO: 201313 - DNA, 25 bp, Mus musculus
agggttcagatacctctgcaggctt

SEQ ID NO: 201314 - DNA, 25 bp, Mus musculus
agggttcagatagctctgcaggctt

SEQ ID NO: 201315 - DNA, 25 bp, Mus musculus
agggttcagtccagcagtttgcgct

SEQ ID NO: 201316 - DNA, 25 bp, Mus musculus
agggttcagtcctgcagtttgcgct

SEQ ID NO: 201317 - DNA, 25 bp, Mus musculus
agggttcataagcagagtcttctgc

SEQ ID NO: 201318 - DNA, 25 bp, Mus musculus
agggttcataaggagagtcttctgc

SEQ ID NO: 201319 - DNA, 25 bp, Mus musculus
agggttccagaaacctgagcgtgca

SEQ ID NO: 201320 - DNA, 25 bp, Mus musculus
agggttccagaatcctgagcgtgca

SEQ ID NO: 201321 - DNA, 25 bp, Mus musculus
agggttccagcacttgcatctctgt

SEQ ID NO: 201322 - DNA, 25 bp, Mus musculus
agggttccagcagttgcatctctgt

SEQ ID NO: 201323 - DNA, 25 bp, Mus musculus
agggttccagtgattgctagccaag

SEQ ID NO: 201324 - DNA, 25 bp, Mus musculus
agggttccagtgtttgctagccaag

SEQ ID NO: 201325 - DNA, 25 bp, Mus musculus
agggttccatccatgacctctggta

SEQ ID NO: 201326 - DNA, 25 bp, Mus musculus
agggttccatccttgacctctggta

SEQ ID NO: 201327 - DNA, 25 bp, Mus musculus
agggttccatctactcagaggaaaa

SEQ ID NO: 201328 - DNA, 25 bp, Mus musculus
agggttccatcttctcagaggaaaa

SEQ ID NO: 201329 - DNA, 25 bp, Mus musculus
agggttccatgcacctgaaattcgc

SEQ ID NO: 201330 - DNA, 25 bp, Mus musculus
agggttccatgctcctgaaattcgc

SEQ ID NO: 201331 - DNA, 25 bp, Mus musculus
agggttcccagaacctgcatatata

SEQ ID NO: 201332 - DNA, 25 bp, Mus musculus
agggttcccagatcctgcatatata

SEQ ID NO: 201333 - DNA, 25 bp, Mus musculus
agggttcccagcaacacttgtgcag

SEQ ID NO: 201334 - DNA, 25 bp, Mus musculus
agggttcccagctacacttgtgcag

SEQ ID NO: 201335 - DNA, 25 bp, Mus musculus
agggttcccgcgactgctggccctg

SEQ ID NO: 201336 - DNA, 25 bp, Mus musculus
agggttcccgcgtctgctggccctg

SEQ ID NO: 201337 - DNA, 25 bp, Mus musculus
agggttccctgactcacctactatg

SEQ ID NO: 201338 - DNA, 25 bp, Mus musculus
agggttccctgagtcacctactatg

SEQ ID NO: 201339 - DNA, 25 bp, Mus musculus
agggttccggtgctacagaattcca

SEQ ID NO: 201340 - DNA, 25 bp, Mus musculus
agggttccggtggtacagaattcca

SEQ ID NO: 201341 - DNA, 25 bp, Mus musculus
agggttcctcacaacctcatttgga

SEQ ID NO: 201342 - DNA, 25 bp, Mus musculus
agggttcctcactacctcatttgga

SEQ ID NO: 201343 - DNA, 25 bp, Mus musculus
agggttcctctgatctgtagtctca

SEQ ID NO: 201344 - DNA, 25 bp, Mus musculus
agggttcctctgttctgtagtctca

SEQ ID NO: 201345 - DNA, 25 bp, Mus musculus
agggttcctggaagtgtcacctgag

SEQ ID NO: 201346 - DNA, 25 bp, Mus musculus
agggttcctggatgtgtcacctgag

SEQ ID NO: 201347 - DNA, 25 bp, Mus musculus
agggttcctgtactgccaggccttt

SEQ ID NO: 201348 - DNA, 25 bp, Mus musculus
agggttcctgtagtgccaggccttt

SEQ ID NO: 201349 - DNA, 25 bp, Mus musculus
agggttcctgttcagagtgcctgaa

SEQ ID NO: 201350 - DNA, 25 bp, Mus musculus
agggttcctgttcttctactttatg

SEQ ID NO: 201351 - DNA, 25 bp, Mus musculus
agggttcctgttgagagtgcctgaa

SEQ ID NO: 201352 - DNA, 25 bp, Mus musculus
agggttcctgttgttctactttatg

SEQ ID NO: 201353 - DNA, 25 bp, Mus musculus
agggttcgcgatactctctgtccat

SEQ ID NO: 201354 - DNA, 25 bp, Mus musculus
agggttcgcgattctctctgtccat

SEQ ID NO: 201355 - DNA, 25 bp, Mus musculus
agggttcggcatcaattccagatac

SEQ ID NO: 201356 - DNA, 25 bp, Mus musculus
agggttcggcatgaattccagatac

SEQ ID NO: 201357 - DNA, 25 bp, Mus musculus
agggttcggttgacctggtgcatcc

SEQ ID NO: 201358 - DNA, 25 bp, Mus musculus
agggttcggttgtcctggtgcatcc

SEQ ID NO: 201359 - DNA, 25 bp, Mus musculus
agggttcgtggcatacaactccggg

SEQ ID NO: 201360 - DNA, 25 bp, Mus musculus
agggttcgtggcttacaactccggg

SEQ ID NO: 201361 - DNA, 25 bp, Mus musculus
agggttctaagccagccatttgtaa

SEQ ID NO: 201362 - DNA, 25 bp, Mus musculus
agggttctaagcgagccatttgtaa

SEQ ID NO: 201363 - DNA, 25 bp, Mus musculus
agggttctagttctcctctacaaat

SEQ ID NO: 201364 - DNA, 25 bp, Mus musculus
agggttctagttgtcctctacaaat

SEQ ID NO: 201365 - DNA, 25 bp, Mus musculus
agggttctatagacctacatctgcc

SEQ ID NO: 201366 - DNA, 25 bp, Mus musculus
agggttctatagtcctacatctgcc

SEQ ID NO: 201367 - DNA, 25 bp, Mus musculus
agggttctcagaatcttctctgtgt

SEQ ID NO: 201368 - DNA, 25 bp, Mus musculus
agggttctcagattcttctctgtgt

SEQ ID NO: 201369 - DNA, 25 bp, Mus musculus
agggttctccaacgacatctacacc

SEQ ID NO: 201370 - DNA, 25 bp, Mus musculus
agggttctccaaggacatctacacc

SEQ ID NO: 201371 - DNA, 25 bp, Mus musculus
agggttctgctgaccggctttgcga

SEQ ID NO: 201372 - DNA, 25 bp, Mus musculus
agggttctgctgtccggctttgcga

SEQ ID NO: 201373 - DNA, 25 bp, Mus musculus
agggttctggccaggattggtcaaa

SEQ ID NO: 201374 - DNA, 25 bp, Mus musculus
agggttctggccatgaagccttgga

SEQ ID NO: 201375 - DNA, 25 bp, Mus musculus
agggttctggcctggattggtcaaa

SEQ ID NO: 201376 - DNA, 25 bp, Mus musculus
agggttctggccttgaagccttgga

SEQ ID NO: 201377 - DNA, 25 bp, Mus musculus
agggttctgttacaattccatgtgt

SEQ ID NO: 201378 - DNA, 25 bp, Mus musculus
agggttctgttagaattccatgtgt

SEQ ID NO: 201379 - DNA, 25 bp, Mus musculus
agggttcttgccagacaactgcagt

SEQ ID NO: 201380 - DNA, 25 bp, Mus musculus
agggttcttgcctgacaactgcagt

SEQ ID NO: 201381 - DNA, 25 bp, Mus musculus
agggttcttgggaagcacctgcatg

SEQ ID NO: 201382 - DNA, 25 bp, Mus musculus
agggttcttgggtagcacctgcatg

SEQ ID NO: 201383 - DNA, 25 bp, Mus musculus
agggttctttccactcacaattgac

SEQ ID NO: 201384 - DNA, 25 bp, Mus musculus
agggttctttcctctcacaattgac

SEQ ID NO: 201385 - DNA, 25 bp, Mus musculus
agggttctttgacagtcagctcccc

SEQ ID NO: 201386 - DNA, 25 bp, Mus musculus
agggttctttgagagtcagctcccc

SEQ ID NO: 201387 - DNA, 25 bp, Mus musculus
agggttgacaagatgggctgcttcc

SEQ ID NO: 201388 - DNA, 25 bp, Mus musculus
agggttgacaagttgggctgcttcc

SEQ ID NO: 201389 - DNA, 25 bp, Mus musculus
agggttgacttcagacaggactcta

SEQ ID NO: 201390 - DNA, 25 bp, Mus musculus
agggttgacttctgacaggactcta

SEQ ID NO: 201391 - DNA, 25 bp, Mus musculus
agggttgagatacactcctgtcctg

SEQ ID NO: 201392 - DNA, 25 bp, Mus musculus
agggttgagatagactcctgtcctg

SEQ ID NO: 201393 - DNA, 25 bp, Mus musculus
agggttgaggcaccgtgacctcttc

SEQ ID NO: 201394 - DNA, 25 bp, Mus musculus
agggttgaggcagcgtgacctcttc

SEQ ID NO: 201395 - DNA, 25 bp, Mus musculus
agggttgatggtattgccctccttg

SEQ ID NO: 201396 - DNA, 25 bp, Mus musculus
agggttgatggttttgccctccttg

SEQ ID NO: 201397 - DNA, 25 bp, Mus musculus
agggttgatgtaatctttccatgca

SEQ ID NO: 201398 - DNA, 25 bp, Mus musculus
agggttgatgtattctttccatgca

SEQ ID NO: 201399 - DNA, 25 bp, Mus musculus
agggttgatttgcaggtgacttcaa

SEQ ID NO: 201400 - DNA, 25 bp, Mus musculus
agggttgatttggaggtgacttcaa

SEQ ID NO: 201401 - DNA, 25 bp, Mus musculus
agggttgcagaacccctgcattgtt

SEQ ID NO: 201402 - DNA, 25 bp, Mus musculus
agggttgcagaagccctgcattgtt

SEQ ID NO: 201403 - DNA, 25 bp, Mus musculus
agggttgcatgcaactctctaagac

SEQ ID NO: 201404 - DNA, 25 bp, Mus musculus
agggttgcatgctactctctaagac

SEQ ID NO: 201405 - DNA, 25 bp, Mus musculus
agggttgccaaaccctggtgtgtcc

SEQ ID NO: 201406 - DNA, 25 bp, Mus musculus
agggttgccaaagcctggtgtgtcc

SEQ ID NO: 201407 - DNA, 25 bp, Mus musculus
agggttgccttaaattgtgccaggg

SEQ ID NO: 201408 - DNA, 25 bp, Mus musculus
agggttgccttatattgtgccaggg

SEQ ID NO: 201409 - DNA, 25 bp, Mus musculus
agggttgcctttacagagttccagg

SEQ ID NO: 201410 - DNA, 25 bp, Mus musculus
agggttgcctttctactctattatg

SEQ ID NO: 201411 - DNA, 25 bp, Mus musculus
agggttgcctttgtactctattatg

SEQ ID NO: 201412 - DNA, 25 bp, Mus musculus
agggttgccttttcagagttccagg

SEQ ID NO: 201413 - DNA, 25 bp, Mus musculus
agggttgcgtgcaccagccaaatat

SEQ ID NO: 201414 - DNA, 25 bp, Mus musculus
agggttgcgtgctccagccaaatat

SEQ ID NO: 201415 - DNA, 25 bp, Mus musculus
agggttgctctgagacttgaataca

SEQ ID NO: 201416 - DNA, 25 bp, Mus musculus
agggttgctctgtgacttgaataca

SEQ ID NO: 201417 - DNA, 25 bp, Mus musculus
agggttgctgacaaatgccggctta

SEQ ID NO: 201418 - DNA, 25 bp, Mus musculus
agggttgctgactaatgccggctta

SEQ ID NO: 201419 - DNA, 25 bp, Mus musculus
agggttgctgagctttctctaccaa

SEQ ID NO: 201420 - DNA, 25 bp, Mus musculus
agggttgctgaggtttctctaccaa

SEQ ID NO: 201421 - DNA, 25 bp, Mus musculus
agggttgctgttactcttagtcgct

SEQ ID NO: 201422 - DNA, 25 bp, Mus musculus
agggttgctgtttctcttagtcgct

SEQ ID NO: 201423 - DNA, 25 bp, Mus musculus
agggttggactcctgatatctcagt

SEQ ID NO: 201424 - DNA, 25 bp, Mus musculus
agggttggactcgtgatatctcagt

SEQ ID NO: 201425 - DNA, 25 bp, Mus musculus
agggttggcagcacttcctcacagc

SEQ ID NO: 201426 - DNA, 25 bp, Mus musculus
agggttggcagctcttcctcacagc

SEQ ID NO: 201427 - DNA, 25 bp, Mus musculus
agggttggcccacactcggagattt

SEQ ID NO: 201428 - DNA, 25 bp, Mus musculus
agggttggcccagactcggagattt

SEQ ID NO: 201429 - DNA, 25 bp, Mus musculus
agggttggtgtgctaacttctctca

SEQ ID NO: 201430 - DNA, 25 bp, Mus musculus
agggttggtgtggtaacttctctca

SEQ ID NO: 201431 - DNA, 25 bp, Mus musculus
agggttggtttcaggcccaggctct

SEQ ID NO: 201432 - DNA, 25 bp, Mus musculus
agggttggtttctggcccaggctct

SEQ ID NO: 201433 - DNA, 25 bp, Mus musculus
agggttgtaaccagtgcctgggcat

SEQ ID NO: 201434 - DNA, 25 bp, Mus musculus
agggttgtaacctgtgcctgggcat

SEQ ID NO: 201435 - DNA, 25 bp, Mus musculus
agggttgtacctcggcatgcatcta

SEQ ID NO: 201436 - DNA, 25 bp, Mus musculus
agggttgtacctgggcatgcatcta

SEQ ID NO: 201437 - DNA, 25 bp, Mus musculus
agggttgtccctctgactggataca

SEQ ID NO: 201438 - DNA, 25 bp, Mus musculus
agggttgtccctgtgactggataca

SEQ ID NO: 201439 - DNA, 25 bp, Mus musculus
agggttgtgcacaccactgaggaga

SEQ ID NO: 201440 - DNA, 25 bp, Mus musculus
agggttgtgcactccactgaggaga

SEQ ID NO: 201441 - DNA, 25 bp, Mus musculus
agggttgtgcctaacctcaggagcc

SEQ ID NO: 201442 - DNA, 25 bp, Mus musculus
agggttgtgccttacctcaggagcc

SEQ ID NO: 201443 - DNA, 25 bp, Mus musculus
agggttgtgttcacagtttgttcat

SEQ ID NO: 201444 - DNA, 25 bp, Mus musculus
agggttgtgttctcagtttgttcat

SEQ ID NO: 201445 - DNA, 25 bp, Mus musculus
agggttgttcacatacatgcgcaat

SEQ ID NO: 201446 - DNA, 25 bp, Mus musculus
agggttgttcacttacatgcgcaat

SEQ ID NO: 201447 - DNA, 25 bp, Mus musculus
agggttgttgttagagtttgcttgt

SEQ ID NO: 201448 - DNA, 25 bp, Mus musculus
agggttgttgtttgagtttgcttgt

SEQ ID NO: 201449 - DNA, 25 bp, Mus musculus
agggttgtttctaccacacaccaga

SEQ ID NO: 201450 - DNA, 25 bp, Mus musculus
agggttgtttcttccacacaccaga

SEQ ID NO: 201451 - DNA, 25 bp, Mus musculus
agggtttactgcactgaatgcttgt

SEQ ID NO: 201452 - DNA, 25 bp, Mus musculus
agggtttactgctctgaatgcttgt

SEQ ID NO: 201453 - DNA, 25 bp, Mus musculus
agggtttagacgaagattctctagt

SEQ ID NO: 201454 - DNA, 25 bp, Mus musculus
agggtttagacgtagattctctagt

SEQ ID NO: 201455 - DNA, 25 bp, Mus musculus
agggtttaggagaagtcagtgttat

SEQ ID NO: 201456 - DNA, 25 bp, Mus musculus
agggtttaggagtagtcagtgttat

SEQ ID NO: 201457 - DNA, 25 bp, Mus musculus
agggtttatccaacgtcttcttcgg

SEQ ID NO: 201458 - DNA, 25 bp, Mus musculus
agggtttatccatcgtcttcttcgg

SEQ ID NO: 201459 - DNA, 25 bp, Mus musculus
agggtttatgccacttatcaggtaa

SEQ ID NO: 201460 - DNA, 25 bp, Mus musculus
agggtttatgcctcttatcaggtaa

SEQ ID NO: 201461 - DNA, 25 bp, Mus musculus
agggtttatgtcaggatctctcagc

SEQ ID NO: 201462 - DNA, 25 bp, Mus musculus
agggtttatgtctggatctctcagc

SEQ ID NO: 201463 - DNA, 25 bp, Mus musculus
agggtttatgttcccgactctctca

SEQ ID NO: 201464 - DNA, 25 bp, Mus musculus
agggtttatgttgccgactctctca

SEQ ID NO: 201465 - DNA, 25 bp, Mus musculus
agggtttcactgaatcgctccacta

SEQ ID NO: 201466 - DNA, 25 bp, Mus musculus
agggtttcactgtatcgctccacta

SEQ ID NO: 201467 - DNA, 25 bp, Mus musculus
agggtttcagatcccctataacgag

SEQ ID NO: 201468 - DNA, 25 bp, Mus musculus
agggtttcagatgccctataacgag

SEQ ID NO: 201469 - DNA, 25 bp, Mus musculus
agggtttcatcacaccggccaatgt

SEQ ID NO: 201470 - DNA, 25 bp, Mus musculus
agggtttcatcagaccggccaatgt

SEQ ID NO: 201471 - DNA, 25 bp, Mus musculus
agggtttccatgcacgactcctaag

SEQ ID NO: 201472 - DNA, 25 bp, Mus musculus
agggtttccatggacgactcctaag

SEQ ID NO: 201473 - DNA, 25 bp, Mus musculus
agggtttcccagaggcatcttcata

SEQ ID NO: 201474 - DNA, 25 bp, Mus musculus
agggtttcccagtggcatcttcata

SEQ ID NO: 201475 - DNA, 25 bp, Mus musculus
agggtttcccatccagggtctggaa

SEQ ID NO: 201476 - DNA, 25 bp, Mus musculus
agggtttcccatgcagggtctggaa

SEQ ID NO: 201477 - DNA, 25 bp, Mus musculus
agggtttctaacaaggctgcatgac

SEQ ID NO: 201478 - DNA, 25 bp, Mus musculus
agggtttctaactaggctgcatgac

SEQ ID NO: 201479 - DNA, 25 bp, Mus musculus
agggtttctctgctacagctttgat

SEQ ID NO: 201480 - DNA, 25 bp, Mus musculus
agggtttctctggtacagctttgat

SEQ ID NO: 201481 - DNA, 25 bp, Mus musculus
agggtttctgagcttactgtcacta

SEQ ID NO: 201482 - DNA, 25 bp, Mus musculus
agggtttctgaggttactgtcacta

SEQ ID NO: 201483 - DNA, 25 bp, Mus musculus
agggtttcttgcagaccttgtcacc

SEQ ID NO: 201484 - DNA, 25 bp, Mus musculus
agggtttcttgctgaccttgtcacc

SEQ ID NO: 201485 - DNA, 25 bp, Mus musculus
agggtttgaccccatcagatcacag

SEQ ID NO: 201486 - DNA, 25 bp, Mus musculus
agggtttgacccgatcagatcacag

SEQ ID NO: 201487 - DNA, 25 bp, Mus musculus
agggtttgagctcatccagacactg

SEQ ID NO: 201488 - DNA, 25 bp, Mus musculus
agggtttgagctgatccagacactg

SEQ ID NO: 201489 - DNA, 25 bp, Mus musculus
agggtttgatgcaacttctgtgtct

SEQ ID NO: 201490 - DNA, 25 bp, Mus musculus
agggtttgatgctacttctgtgtct

SEQ ID NO: 201491 - DNA, 25 bp, Mus musculus
agggtttgcagacgccactggcaca

SEQ ID NO: 201492 - DNA, 25 bp, Mus musculus
agggtttgcagaggccactggcaca

SEQ ID NO: 201493 - DNA, 25 bp, Mus musculus
agggtttgcaggatccacagccatt

SEQ ID NO: 201494 - DNA, 25 bp, Mus musculus
agggtttgcaggttccacagccatt

SEQ ID NO: 201495 - DNA, 25 bp, Mus musculus
agggtttgccttccagtgtttagtg

SEQ ID NO: 201496 - DNA, 25 bp, Mus musculus
agggtttgccttgcagtgtttagtg

SEQ ID NO: 201497 - DNA, 25 bp, Mus musculus
agggtttgctcgctgtcagttgatt

SEQ ID NO: 201498 - DNA, 25 bp, Mus musculus
agggtttgctcggtgtcagttgatt

SEQ ID NO: 201499 - DNA, 25 bp, Mus musculus
agggtttgctgcattctctgctgca

SEQ ID NO: 201500 - DNA, 25 bp, Mus musculus
agggtttgctgctttctctgctgca

SEQ ID NO: 201501 - DNA, 25 bp, Mus musculus
agggtttgggctccgtgtctctcct

SEQ ID NO: 201502 - DNA, 25 bp, Mus musculus
agggtttgggctgcgtgtctctcct

SEQ ID NO: 201503 - DNA, 25 bp, Mus musculus
agggtttggtctacacctgagggca

SEQ ID NO: 201504 - DNA, 25 bp, Mus musculus
agggtttggtcttcacctgagggca

SEQ ID NO: 201505 - DNA, 25 bp, Mus musculus
agggtttgtcttagtagctatggct
